United States Patent 7,250,496 (BIOINFORMATICALLY DETECTABLE GROUP OF NOVEL REGULATORY GENES AND USES THEREOF) - sequence listing, part 15

SEQ ID NO: 605732 - RNA, 19 nt, Human
gagauggcacagcaggacc

SEQ ID NO: 605733 - RNA, 23 nt, Human
gaggcaggaaaggauggccagag

SEQ ID NO: 605734 - RNA, 21 nt, Human
gaggcuguccggcccgggccc

SEQ ID NO: 605735 - RNA, 21 nt, Human
gagggauggagcgugcugcug

SEQ ID NO: 605736 - RNA, 24 nt, Human
gagucagccugcccugggaaccag

SEQ ID NO: 605737 - RNA, 23 nt, Human
gcacggagccaccuggaaagcca

SEQ ID NO: 605738 - RNA, 18 nt, Human
gcaggcuccagcucccca

SEQ ID NO: 605739 - RNA, 18 nt, Human
gccaggggucugcaugug

SEQ ID NO: 605740 - RNA, 20 nt, Human
gcccuagaacccuagccuuc

SEQ ID NO: 605741 - RNA, 22 nt, Human
gccggccuggcuguagcugcac

SEQ ID NO: 605742 - RNA, 22 nt, Human
gcugcagggcaggcuccagcuc

SEQ ID NO: 605743 - RNA, 21 nt, Human
ggaaccucccaaguccugccc

SEQ ID NO: 605744 - RNA, 25 nt, Human
ggauugggaggaaagagggagccug

SEQ ID NO: 605745 - RNA, 25 nt, Human
ggcaggaaaggauggccagagccca

SEQ ID NO: 605746 - RNA, 21 nt, Human
ggccagcgugggacuggaggc

SEQ ID NO: 605747 - RNA, 19 nt, Human
ggcugcagggcaggcucca

SEQ ID NO: 605748 - RNA, 19 nt, Human
gggcaggagggcccagagc

SEQ ID NO: 605749 - RNA, 20 nt, Human
ggggcaggagggcccagagc

SEQ ID NO: 605750 - RNA, 20 nt, Human
gugccagggccaggcuugga

SEQ ID NO: 605751 - RNA, 28 nt, Human
guggggcaggggacggagcugaggcugu

SEQ ID NO: 605752 - RNA, 20 nt, Human
guggugccagagcuacgggg

SEQ ID NO: 605753 - RNA, 19 nt, Human
uaaguucuguucauggccu

SEQ ID NO: 605754 - RNA, 30 nt, Human
uaccacugcccaccuggugccaccccagcc

SEQ ID NO: 605755 - RNA, 20 nt, Human
ucacugcagcaaggggcaga

SEQ ID NO: 605756 - RNA, 18 nt, Human
ucacuggggagggaggag

SEQ ID NO: 605757 - RNA, 20 nt, Human
ucacuuggugcucucuggcc

SEQ ID NO: 605758 - RNA, 20 nt, Human
uccugcccccugcauuuccc

SEQ ID NO: 605759 - RNA, 20 nt, Human
ugcccugggaaccaggcagg

SEQ ID NO: 605760 - RNA, 23 nt, Human
ugccgcagaccuggcccagcagc

SEQ ID NO: 605761 - RNA, 23 nt, Human
uggaaagccaaaggcaagcucca

SEQ ID NO: 605762 - RNA, 19 nt, Human
uggccagggccacccuccc

SEQ ID NO: 605763 - RNA, 18 nt, Human
uggcccagcagcuccugc

SEQ ID NO: 605764 - RNA, 19 nt, Human
uggccgcagaggcagcuga

SEQ ID NO: 605765 - RNA, 23 nt, Human
uggcuuuacugcaggggagaggg

SEQ ID NO: 605766 - RNA, 20 nt, Human
ugggacuggaggcccaggug

SEQ ID NO: 605767 - RNA, 21 nt, Human
uggggccagcgugggacugga

SEQ ID NO: 605768 - RNA, 22 nt, Human
ugguggugccagagcuacgggg

SEQ ID NO: 605769 - RNA, 23 nt, Human
uuagcccuguuuugcacuggugg

SEQ ID NO: 605770 - RNA, 20 nt, Human
uuccaggaccccugaccuag

SEQ ID NO: 605771 - RNA, 19 nt, Human
uuccugaccugccguccgu

SEQ ID NO: 605772 - RNA, 21 nt, Human
uucuccaggcugcagggcagg

SEQ ID NO: 605773 - RNA, 20 nt, Human
uuuugcacugguggauugau

SEQ ID NO: 605774 - RNA, 23 nt, Human
aaaaaaaacaaaaaaacuucauu

SEQ ID NO: 605775 - RNA, 24 nt, Human
aaaaaaaacaaaaaaacuucauuu

SEQ ID NO: 605776 - RNA, 23 nt, Human
aaaaaacaaaaaaacuucauuua

SEQ ID NO: 605777 - RNA, 24 nt, Human
aaaacaaaaaaaacaaaaaaacuu

SEQ ID NO: 605778 - RNA, 24 nt, Human
aaaaggaaaacaaaaaaaacaaaa

SEQ ID NO: 605779 - RNA, 18 nt, Human
aaacaaaaaaaacaaaaa

SEQ ID NO: 605780 - RNA, 20 nt, Human
aacaacaccagcaacgcugc

SEQ ID NO: 605781 - RNA, 22 nt, Human
aacaguauuuucagcuucuuac

SEQ ID NO: 605782 - RNA, 19 nt, Human
aagcucccuuccagguauc

SEQ ID NO: 605783 - RNA, 19 nt, Human
aaggagcuggcccugugga

SEQ ID NO: 605784 - RNA, 21 nt, Human
aagguaccuuggccccugaua

SEQ ID NO: 605785 - RNA, 23 nt, Human
acaaaaaaaacaaaaaaacuuca

SEQ ID NO: 605786 - RNA, 21 nt, Human
acaagaaucgccaauacccac

SEQ ID NO: 605787 - RNA, 19 nt, Human
acacagugccucuccaucc

SEQ ID NO: 605788 - RNA, 23 nt, Human
acaggcccccacucccacacccu

SEQ ID NO: 605789 - RNA, 23 nt, Human
acauuuuuuuuuuucuggggggc

SEQ ID NO: 605790 - RNA, 19 nt, Human
acccaucagagacagugac

SEQ ID NO: 605791 - RNA, 23 nt, Human
acgaagccccagaugcuccagug

SEQ ID NO: 605792 - RNA, 19 nt, Human
acuccacccccaagaaaaa

SEQ ID NO: 605793 - RNA, 24 nt, Human
agaaagaaggggaggagccuccag

SEQ ID NO: 605794 - RNA, 22 nt, Human
agaaggaagagaaagaagggga

SEQ ID NO: 605795 - RNA, 23 nt, Human
agaaggggaggagccuccagagu

SEQ ID NO: 605796 - RNA, 23 nt, Human
agacaaauagacaaccacccaga

SEQ ID NO: 605797 - RNA, 23 nt, Human
agacaacacuggacccacagacc

SEQ ID NO: 605798 - RNA, 24 nt, Human
agacaacacuggacccacagacca

SEQ ID NO: 605799 - RNA, 19 nt, Human
agacagcccccaccccaag

SEQ ID NO: 605800 - RNA, 19 nt, Human
agacagcccccaccccaag

SEQ ID NO: 605801 - RNA, 20 nt, Human
agaccuucauagcagagggc

SEQ ID NO: 605802 - RNA, 18 nt, Human
agagaaagaaggggagga

SEQ ID NO: 605803 - RNA, 23 nt, Human
agagacccagccucuucaagggu

SEQ ID NO: 605804 - RNA, 18 nt, Human
agaggggaggggagaaag

SEQ ID NO: 605805 - RNA, 19 nt, Human
agagucccagccccaaccc

SEQ ID NO: 605806 - RNA, 26 nt, Human
agauaaacuuccguuccccaagccca

SEQ ID NO: 605807 - RNA, 21 nt, Human
agcagcugggggcacggggga

SEQ ID NO: 605808 - RNA, 22 nt, Human
agccaggcaaauacccaucaga

SEQ ID NO: 605809 - RNA, 24 nt, Human
agccauaacaauaaaucuggaagu

SEQ ID NO: 605810 - RNA, 22 nt, Human
agcggcugagggcgggagcccg

SEQ ID NO: 605811 - RNA, 24 nt, Human
aggaaagaggggaggggagaaagg

SEQ ID NO: 605812 - RNA, 18 nt, Human
aggaagagaaagaagggg

SEQ ID NO: 605813 - RNA, 21 nt, Human
aggaagagaaagaaggggagg

SEQ ID NO: 605814 - RNA, 22 nt, Human
aggcaaauacccaucagagaca

SEQ ID NO: 605815 - RNA, 26 nt, Human
aggcagaaggaagagaaaggggaccc

SEQ ID NO: 605816 - RNA, 20 nt, Human
agggaggaaaagggcauugg

SEQ ID NO: 605817 - RNA, 22 nt, Human
aggggaggggagaaaggugcuc

SEQ ID NO: 605818 - RNA, 23 nt, Human
agugacaagagcagcugggggca

SEQ ID NO: 605819 - RNA, 20 nt, Human
agugccucuccaucccuggg

SEQ ID NO: 605820 - RNA, 28 nt, Human
auacagauagagaagcaacaaagccagg

SEQ ID NO: 605821 - RNA, 24 nt, Human
aucacaagaaucgccaauacccac

SEQ ID NO: 605822 - RNA, 18 nt, Human
aucuagaaaagggugagg

SEQ ID NO: 605823 - RNA, 22 nt, Human
augauccacaaggcagagaccu

SEQ ID NO: 605824 - RNA, 22 nt, Human
auggcuggacacugacugaggc

SEQ ID NO: 605825 - RNA, 22 nt, Human
caaaaaaaacaaaaaaacuuca

SEQ ID NO: 605826 - RNA, 18 nt, Human
caaagccaggcaaauacc

SEQ ID NO: 605827 - RNA, 23 nt, Human
caaagccaggcaaauacccauca

SEQ ID NO: 605828 - RNA, 24 nt, Human
caaauacccaucagagacagugac

SEQ ID NO: 605829 - RNA, 24 nt, Human
caaauagacaaccacccagacugc

SEQ ID NO: 605830 - RNA, 22 nt, Human
caacaaagccaggcaaauaccc

SEQ ID NO: 605831 - RNA, 21 nt, Human
caagagcauucuucuaagccc

SEQ ID NO: 605832 - RNA, 19 nt, Human
cacagacagcccccacccc

SEQ ID NO: 605833 - RNA, 24 nt, Human
caccaaaaaggaaaacaaaaaaaa

SEQ ID NO: 605834 - RNA, 24 nt, Human
caccaaaaaggaaaacaaaaaaaa

SEQ ID NO: 605835 - RNA, 20 nt, Human
caccagcaacgcugcucgcc

SEQ ID NO: 605836 - RNA, 20 nt, Human
caccccaagcucccuuccag

SEQ ID NO: 605837 - RNA, 23 nt, Human
cacuauccucucccuuaugcaug

SEQ ID NO: 605838 - RNA, 19 nt, Human
cagacaaauagacaaccac

SEQ ID NO: 605839 - RNA, 24 nt, Human
cagacagcccccaccccaagcucc

SEQ ID NO: 605840 - RNA, 20 nt, Human
cagcaacgcugcucgccccg

SEQ ID NO: 605841 - RNA, 19 nt, Human
cagcggcugagggcgggag

SEQ ID NO: 605842 - RNA, 22 nt, Human
cagcuucuuacggugccaugca

SEQ ID NO: 605843 - RNA, 24 nt, Human
cagugccaaggaggucagaccggg

SEQ ID NO: 605844 - RNA, 23 nt, Human
ccagagucccagccccaaccccc

SEQ ID NO: 605845 - RNA, 19 nt, Human
ccccagaugcuccagugcc

SEQ ID NO: 605846 - RNA, 19 nt, Human
cccccaagaaaaauacccu

SEQ ID NO: 605847 - RNA, 18 nt, Human
cccccacucccacacccu

SEQ ID NO: 605848 - RNA, 20 nt, Human
cccccuuacuccacccccaa

SEQ ID NO: 605849 - RNA, 22 nt, Human
ccccgggcccccggccccgccc

SEQ ID NO: 605850 - RNA, 18 nt, Human
ccccggggcccgccgccc

SEQ ID NO: 605851 - RNA, 24 nt, Human
ccccuuacuccacccccaagaaaa

SEQ ID NO: 605852 - RNA, 21 nt, Human
cccgccgccccggcgcccgcc

SEQ ID NO: 605853 - RNA, 21 nt, Human
cccgcugccgccgccgccgcc

SEQ ID NO: 605854 - RNA, 19 nt, Human
cccucgcucuaggugcucc

SEQ ID NO: 605855 - RNA, 19 nt, Human
cccucugccauuggcuacc

SEQ ID NO: 605856 - RNA, 18 nt, Human
cccuuugcacagauccuc

SEQ ID NO: 605857 - RNA, 21 nt, Human
ccgaacccgccgccgcugccg

SEQ ID NO: 605858 - RNA, 22 nt, Human
ccgcccgcugccgccgccgccg

SEQ ID NO: 605859 - RNA, 25 nt, Human
ccgcccgcugccgccgccgccgccc

SEQ ID NO: 605860 - RNA, 25 nt, Human
ccgccgccgccgcccacacauccgg

SEQ ID NO: 605861 - RNA, 25 nt, Human
ccgccgccgccgcccacacauccgg

SEQ ID NO: 605862 - RNA, 21 nt, Human
ccgccgccgcugccgcuaacg

SEQ ID NO: 605863 - RNA, 18 nt, Human
ccgcugccgccgccgccg

SEQ ID NO: 605864 - RNA, 24 nt, Human
ccggcgcccgccguugccgccucc

SEQ ID NO: 605865 - RNA, 18 nt, Human
ccuaaagcacauuuuuuu

SEQ ID NO: 605866 - RNA, 18 nt, Human
ccucuucaaggguaucca

SEQ ID NO: 605867 - RNA, 23 nt, Human
ccugggguugaagugaggaggac

SEQ ID NO: 605868 - RNA, 19 nt, Human
ccuuugcuuccugcccucc

SEQ ID NO: 605869 - RNA, 20 nt, Human
cgaggaauggaagagggaaa

SEQ ID NO: 605870 - RNA, 19 nt, Human
cgccccggggcccgccgcc

SEQ ID NO: 605871 - RNA, 20 nt, Human
cgccgccgcccacacauccg

SEQ ID NO: 605872 - RNA, 22 nt, Human
cgccgccgcugccgcuaacgcc

SEQ ID NO: 605873 - RNA, 23 nt, Human
cggcaggaaaggcggcccgaacc

SEQ ID NO: 605874 - RNA, 20 nt, Human
cgugggcagcggcugagggc

SEQ ID NO: 605875 - RNA, 23 nt, Human
cucccaaauaggacauucuccuu

SEQ ID NO: 605876 - RNA, 21 nt, Human
cucccccuuacuccaccccca

SEQ ID NO: 605877 - RNA, 27 nt, Human
cucccccuuacuccacccccaagaaaa

SEQ ID NO: 605878 - RNA, 21 nt, Human
cugaagacagacaaauagaca

SEQ ID NO: 605879 - RNA, 22 nt, Human
cugugcauauauuuccucaacu

SEQ ID NO: 605880 - RNA, 23 nt, Human
cugugcauauauuuccucaacuc

SEQ ID NO: 605881 - RNA, 18 nt, Human
cuuugugcccagcccccc

SEQ ID NO: 605882 - RNA, 24 nt, Human
gaaaaacaaaauuaugcuggccug

SEQ ID NO: 605883 - RNA, 21 nt, Human
gaaauuggaagcagggucccu

SEQ ID NO: 605884 - RNA, 18 nt, Human
gaacaggcccccacuccc

SEQ ID NO: 605885 - RNA, 22 nt, Human
gaaggaaggcagggaggaaaag

SEQ ID NO: 605886 - RNA, 27 nt, Human
gaaggggaggagccuccagagucccag

SEQ ID NO: 605887 - RNA, 21 nt, Human
gagagguguguugguuguuuu

SEQ ID NO: 605888 - RNA, 21 nt, Human
gauagagaagcaacaaagcca

SEQ ID NO: 605889 - RNA, 19 nt, Human
gcagaaggaagagaaagaa

SEQ ID NO: 605890 - RNA, 21 nt, Human
gccaaccagcuaaaggaucac

SEQ ID NO: 605891 - RNA, 19 nt, Human
gccauaacaauaaaucugg

SEQ ID NO: 605892 - RNA, 19 nt, Human
gccccggggcccgccgccc

SEQ ID NO: 605893 - RNA, 20 nt, Human
gcccgccgccccggcgcccg

SEQ ID NO: 605894 - RNA, 21 nt, Human
gccgccgcugccgcuaacgcc

SEQ ID NO: 605895 - RNA, 21 nt, Human
gccgccuccucagucggacuc

SEQ ID NO: 605896 - RNA, 21 nt, Human
gcgcucgccgucccagucgga

SEQ ID NO: 605897 - RNA, 23 nt, Human
ggaaauaaugggggaaggaaggc

SEQ ID NO: 605898 - RNA, 19 nt, Human
ggaaggaaggcagggagga

SEQ ID NO: 605899 - RNA, 19 nt, Human
ggaaggauggauucccuug

SEQ ID NO: 605900 - RNA, 20 nt, Human
ggaaggggagaugggagcag

SEQ ID NO: 605901 - RNA, 21 nt, Human
ggagaaaggugcucaggugcu

SEQ ID NO: 605902 - RNA, 22 nt, Human
ggagcccgggcagcggagccag

SEQ ID NO: 605903 - RNA, 19 nt, Human
ggaggaaaagggcauuggg

SEQ ID NO: 605904 - RNA, 18 nt, Human
ggaggggagaaaggugcu

SEQ ID NO: 605905 - RNA, 22 nt, Human
ggcacgggggaggcagaaggaa

SEQ ID NO: 605906 - RNA, 23 nt, Human
ggcacgggggaggcagaaggaag

SEQ ID NO: 605907 - RNA, 20 nt, Human
ggcagguacacacuauccuc

SEQ ID NO: 605908 - RNA, 21 nt, Human
gggcagguacacacuauccuc

SEQ ID NO: 605909 - RNA, 20 nt, Human
gggcccccggccccgcccgc

SEQ ID NO: 605910 - RNA, 18 nt, Human
ggggaaggaaggcaggga

SEQ ID NO: 605911 - RNA, 25 nt, Human
ggggaaggggagaugggagcagggu

SEQ ID NO: 605912 - RNA, 20 nt, Human
ggggagaaaggugcucaggu

SEQ ID NO: 605913 - RNA, 25 nt, Human
ggggagaaaggugcucaggugcuag

SEQ ID NO: 605914 - RNA, 20 nt, Human
gggggaaggaaggcagggaa

SEQ ID NO: 605915 - RNA, 21 nt, Human
gggugaggaaagaggggaggg

SEQ ID NO: 605916 - RNA, 22 nt, Human
uaaagacaucucuuugacuccu

SEQ ID NO: 605917 - RNA, 18 nt, Human
uacagggcaccuaaagca

SEQ ID NO: 605918 - RNA, 26 nt, Human
uacuccacccccaagaaaaauacccu

SEQ ID NO: 605919 - RNA, 20 nt, Human
uagcagagggcagggcaggu

SEQ ID NO: 605920 - RNA, 26 nt, Human
uaucaaaaaggggaaggauggauucc

SEQ ID NO: 605921 - RNA, 24 nt, Human
ucacauuuaccuucugucuuacau

SEQ ID NO: 605922 - RNA, 21 nt, Human
ucagagacagugacaagagca

SEQ ID NO: 605923 - RNA, 26 nt, Human
ucagagacagugacaagagcagcugg

SEQ ID NO: 605924 - RNA, 22 nt, Human
uccaagauaaacuuccguuccc

SEQ ID NO: 605925 - RNA, 27 nt, Human
uccaagauaaacuuccguuccccaagc

SEQ ID NO: 605926 - RNA, 22 nt, Human
uccagagucccagccccaaccc

SEQ ID NO: 605927 - RNA, 19 nt, Human
ucccagccccaacccccuc

SEQ ID NO: 605928 - RNA, 20 nt, Human
ucccagccccaacccccucu

SEQ ID NO: 605929 - RNA, 23 nt, Human
ucccagccccaacccccucugcc

SEQ ID NO: 605930 - RNA, 19 nt, Human
ucccagucggagcugagcc

SEQ ID NO: 605931 - RNA, 20 nt, Human
ucccauauacacagcagcug

SEQ ID NO: 605932 - RNA, 18 nt, Human
ucccugggguugaaguga

SEQ ID NO: 605933 - RNA, 25 nt, Human
uccuucucuuuggucugucggacuc

SEQ ID NO: 605934 - RNA, 21 nt, Human
ucgccccggggcccgccgccc

SEQ ID NO: 605935 - RNA, 21 nt, Human
ucuaagcccuggaguagcucg

SEQ ID NO: 605936 - RNA, 19 nt, Human
ugaacgaagccccagaugc

SEQ ID NO: 605937 - RNA, 21 nt, Human
ugacaagagcagcugggggca

SEQ ID NO: 605938 - RNA, 27 nt, Human
ugacuauaaauuaggaaaaacaaaauu

SEQ ID NO: 605939 - RNA, 21 nt, Human
ugacugaggcccugcaucaca

SEQ ID NO: 605940 - RNA, 23 nt, Human
ugagccaaccagcuaaaggauca

SEQ ID NO: 605941 - RNA, 20 nt, Human
ugaggaggacuacaggcugg

SEQ ID NO: 605942 - RNA, 25 nt, Human
ugccaugcaggcuuuaccaagaccu

SEQ ID NO: 605943 - RNA, 21 nt, Human
ugccgccgccgccgcccacac

SEQ ID NO: 605944 - RNA, 18 nt, Human
ugccuguguugggaacuu

SEQ ID NO: 605945 - RNA, 21 nt, Human
ugcuccccacaaaucccuggg

SEQ ID NO: 605946 - RNA, 21 nt, Human
uggacccacagaccaagagca

SEQ ID NO: 605947 - RNA, 23 nt, Human
uggaugacagacaacacuggacc

SEQ ID NO: 605948 - RNA, 21 nt, Human
ugggcagcggcugagggcggg

SEQ ID NO: 605949 - RNA, 26 nt, Human
ugggggaaggaaggcagggaggaaaa

SEQ ID NO: 605950 - RNA, 22 nt, Human
ugggguggggggaagggauucu

SEQ ID NO: 605951 - RNA, 20 nt, Human
ugggguugaagugaggagga

SEQ ID NO: 605952 - RNA, 21 nt, Human
ugugaagagacccagccucuu

SEQ ID NO: 605953 - RNA, 22 nt, Human
uuacuccacccccaagaaaaau

SEQ ID NO: 605954 - RNA, 23 nt, Human
uuccccaagcccaccaaucccug

SEQ ID NO: 605955 - RNA, 22 nt, Human
uuccuuugcuuccugcccuccc

SEQ ID NO: 605956 - RNA, 19 nt, Human
uucuauguaguggcucuaa

SEQ ID NO: 605957 - RNA, 18 nt, Human
uugaugcccaggauuaca

SEQ ID NO: 605958 - RNA, 19 nt, Human
uugcaccaaaaaggaaaac

SEQ ID NO: 605959 - RNA, 18 nt, Human
uuuuuuuuuuuuuuucug

SEQ ID NO: 605960 - RNA, 21 nt, Human
aaacacaggaucugacuggug

SEQ ID NO: 605961 - RNA, 23 nt, Human
aacugcagggccucaauuucccu

SEQ ID NO: 605962 - RNA, 23 nt, Human
aagcugccuuuccccuguccugc

SEQ ID NO: 605963 - RNA, 23 nt, Human
aaggggcaguggggugagaaggu

SEQ ID NO: 605964 - RNA, 21 nt, Human
acacaagcucaggggcuuggg

SEQ ID NO: 605965 - RNA, 24 nt, Human
acaggaucugacuggugggcacaa

SEQ ID NO: 605966 - RNA, 18 nt, Human
acccuccccagcuccacc

SEQ ID NO: 605967 - RNA, 25 nt, Human
agcggcagcagccaggcggcuggag

SEQ ID NO: 605968 - RNA, 22 nt, Human
aggaggaggcagcggcagcagc

SEQ ID NO: 605969 - RNA, 23 nt, Human
aggcggcuggaggacaucagcga

SEQ ID NO: 605970 - RNA, 18 nt, Human
aggguggaguuggcauga

SEQ ID NO: 605971 - RNA, 19 nt, Human
agguggggugggcaguccu

SEQ ID NO: 605972 - RNA, 22 nt, Human
agguggggugggcaguccuccg

SEQ ID NO: 605973 - RNA, 23 nt, Human
caaaacacaggaucugacuggug

SEQ ID NO: 605974 - RNA, 21 nt, Human
caagccucuuccgccagugcc

SEQ ID NO: 605975 - RNA, 20 nt, Human
caaggaggaacgggaggacc

SEQ ID NO: 605976 - RNA, 23 nt, Human
cacaggaucugacuggugggcac

SEQ ID NO: 605977 - RNA, 19 nt, Human
cacccuccccagcuccacc

SEQ ID NO: 605978 - RNA, 24 nt, Human
cagaaugggugcccagagagugcc

SEQ ID NO: 605979 - RNA, 19 nt, Human
cagcaggaggaaagggugg

SEQ ID NO: 605980 - RNA, 20 nt, Human
cagcgaggacccgagcuggg

SEQ ID NO: 605981 - RNA, 18 nt, Human
caggaggaggcagcggca

SEQ ID NO: 605982 - RNA, 21 nt, Human
caggcagggcugaugguggca

SEQ ID NO: 605983 - RNA, 18 nt, Human
caggcagugacgagcugg

SEQ ID NO: 605984 - RNA, 23 nt, Human
caguggccguguuccucuggggc

SEQ ID NO: 605985 - RNA, 18 nt, Human
ccaugcugggaggugggg

SEQ ID NO: 605986 - RNA, 24 nt, Human
ccccaggccccggcaccaagccuc

SEQ ID NO: 605987 - RNA, 19 nt, Human
cccugggcuugggccuccg

SEQ ID NO: 605988 - RNA, 18 nt, Human
ccucacaggaaguggggg

SEQ ID NO: 605989 - RNA, 22 nt, Human
ccucacaggaagugggggugag

SEQ ID NO: 605990 - RNA, 21 nt, Human
ccucagagccccaggccccgg

SEQ ID NO: 605991 - RNA, 19 nt, Human
ccuccccagcuccaccgcc

SEQ ID NO: 605992 - RNA, 21 nt, Human
ccuccgccccuuacccaggag

SEQ ID NO: 605993 - RNA, 19 nt, Human
ccugcucugguuuugugga

SEQ ID NO: 605994 - RNA, 25 nt, Human
ccuggcccacccgcugguccccugg

SEQ ID NO: 605995 - RNA, 18 nt, Human
ccuggcuccccuucuccc

SEQ ID NO: 605996 - RNA, 22 nt, Human
cgggaggaccuggaugcugaug

SEQ ID NO: 605997 - RNA, 20 nt, Human
cguucgugcucccacccucc

SEQ ID NO: 605998 - RNA, 23 nt, Human
cuccagguuccugcccugggcuu

SEQ ID NO: 605999 - RNA, 20 nt, Human
cuccggcauagcaaggagga

SEQ ID NO: 606000 - RNA, 20 nt, Human
cugcccugggcuugggccuc

SEQ ID NO: 606001 - RNA, 26 nt, Human
cugcucugguuuuguggaaugagcag

SEQ ID NO: 606002 - RNA, 24 nt, Human
cuguggccaaaguguccuugcucc

SEQ ID NO: 606003 - RNA, 20 nt, Human
gagcagagguggggugggca

SEQ ID NO: 606004 - RNA, 20 nt, Human
gagccugcggugcuccccag

SEQ ID NO: 606005 - RNA, 19 nt, Human
gagguggggcuggaggagc

SEQ ID NO: 606006 - RNA, 22 nt, Human
gauggguuggugauuaaagccu

SEQ ID NO: 606007 - RNA, 25 nt, Human
gcaaggaggaacgggaggaccugga

SEQ ID NO: 606008 - RNA, 19 nt, Human
gcaccaagccucuuccgcc

SEQ ID NO: 606009 - RNA, 22 nt, Human
gcagcaaggcuccucacucccu

SEQ ID NO: 606010 - RNA, 22 nt, Human
gcccugggcuugggccuccguc

SEQ ID NO: 606011 - RNA, 19 nt, Human
gccuggcccacccgcugca

SEQ ID NO: 606012 - RNA, 20 nt, Human
gcuccagguuccugcccugg

SEQ ID NO: 606013 - RNA, 19 nt, Human
gcucccacccuccccagcu

SEQ ID NO: 606014 - RNA, 23 nt, Human
gcucccacccuccccagcuccac

SEQ ID NO: 606015 - RNA, 21 nt, Human
ggaggaacgggaggaccugga

SEQ ID NO: 606016 - RNA, 20 nt, Human
ggaggacaucagcgaggacc

SEQ ID NO: 606017 - RNA, 21 nt, Human
ggcagcagccaggcggcugga

SEQ ID NO: 606018 - RNA, 18 nt, Human
ggccaacggcuuuaaaca

SEQ ID NO: 606019 - RNA, 18 nt, Human
ggccuggcccacccgcug

SEQ ID NO: 606020 - RNA, 23 nt, Human
ggcuugggguuuaucccgagggc

SEQ ID NO: 606021 - RNA, 19 nt, Human
gggcaggcagugacgagcu

SEQ ID NO: 606022 - RNA, 20 nt, Human
gggcuggaggagcugaguuc

SEQ ID NO: 606023 - RNA, 20 nt, Human
gggcuugggccuccgucugg

SEQ ID NO: 606024 - RNA, 18 nt, Human
ggggaaggggcagugggg

SEQ ID NO: 606025 - RNA, 23 nt, Human
ggggaggcuugauguugaugggu

SEQ ID NO: 606026 - RNA, 21 nt, Human
ggugggcaguccuccgccccu

SEQ ID NO: 606027 - RNA, 22 nt, Human
gguuuuguugccaaagggcagg

SEQ ID NO: 606028 - RNA, 23 nt, Human
gucaaccucaaugcccugcucau

SEQ ID NO: 606029 - RNA, 21 nt, Human
guccuggcuccccuucucccg

SEQ ID NO: 606030 - RNA, 18 nt, Human
gugaggagccugcggugc

SEQ ID NO: 606031 - RNA, 21 nt, Human
gugcccagagagugccaugga

SEQ ID NO: 606032 - RNA, 19 nt, Human
uacccaggaggaggcagcg

SEQ ID NO: 606033 - RNA, 21 nt, Human
uagacuggacagaggugggua

SEQ ID NO: 606034 - RNA, 18 nt, Human
uaucccgagggcacaggg

SEQ ID NO: 606035 - RNA, 18 nt, Human
uccagguuccugcccugg

SEQ ID NO: 606036 - RNA, 21 nt, Human
ucccaaagccaauccuuggca

SEQ ID NO: 606037 - RNA, 21 nt, Human
uccccagaaaaggggaagggg

SEQ ID NO: 606038 - RNA, 23 nt, Human
uccccagaaaaggggaaggggca

SEQ ID NO: 606039 - RNA, 23 nt, Human
uccccagcuccaccgccuggucu

SEQ ID NO: 606040 - RNA, 23 nt, Human
uccccagcuccaccgccuggucu

SEQ ID NO: 606041 - RNA, 25 nt, Human
uccccagcuccaccgccuggucuuc

SEQ ID NO: 606042 - RNA, 21 nt, Human
ucugccuggggcccacugcau

SEQ ID NO: 606043 - RNA, 23 nt, Human
ugaacgcccacaaaaagguuugg

SEQ ID NO: 606044 - RNA, 20 nt, Human
ugaaugguagggcaccaugc

SEQ ID NO: 606045 - RNA, 19 nt, Human
ugaugguggcagggugggg

SEQ ID NO: 606046 - RNA, 19 nt, Human
ugcagggccucaauuuccc

SEQ ID NO: 606047 - RNA, 24 nt, Human
ugcaguugcccuaaggaaaaauaa

SEQ ID NO: 606048 - RNA, 19 nt, Human
ugccaggccagugucacaa

SEQ ID NO: 606049 - RNA, 18 nt, Human
ugccauggagaugaaugg

SEQ ID NO: 606050 - RNA, 21 nt, Human
ugcccagagagugccauggag

SEQ ID NO: 606051 - RNA, 30 nt, Human
ugccuaagaccaacugcguuggacaccauu

SEQ ID NO: 606052 - RNA, 18 nt, Human
ugccuggggcccacugca

SEQ ID NO: 606053 - RNA, 23 nt, Human
ugcuccagguuccugcccugggc

SEQ ID NO: 606054 - RNA, 19 nt, Human
ugcugggagguggggcugg

SEQ ID NO: 606055 - RNA, 22 nt, Human
uggaaugagcagagguggggug

SEQ ID NO: 606056 - RNA, 19 nt, Human
uggacaccauaagccacag

SEQ ID NO: 606057 - RNA, 25 nt, Human
uggcauggccuuugggacucaaaac

SEQ ID NO: 606058 - RNA, 23 nt, Human
uggcuccaggcagggcugauggu

SEQ ID NO: 606059 - RNA, 23 nt, Human
ugggagcacacaggcacagaaca

SEQ ID NO: 606060 - RNA, 18 nt, Human
ugggagguggggcuggag

SEQ ID NO: 606061 - RNA, 22 nt, Human
ugggggugaggagccugcggug

SEQ ID NO: 606062 - RNA, 21 nt, Human
uggguguggaaggauggccgg

SEQ ID NO: 606063 - RNA, 25 nt, Human
uggguguggaaggauggccggguuu

SEQ ID NO: 606064 - RNA, 23 nt, Human
uguaggguggaguuggcaugagu

SEQ ID NO: 606065 - RNA, 20 nt, Human
ugucacaagcgcuaccaucu

SEQ ID NO: 606066 - RNA, 20 nt, Human
uuaaacacaagcucaggggc

SEQ ID NO: 606067 - RNA, 23 nt, Human
uuacccaggaggaggcagcggca

SEQ ID NO: 606068 - RNA, 23 nt, Human
uuauuugaaccggccugggggag

SEQ ID NO: 606069 - RNA, 18 nt, Human
uuccccuguccugcugug

SEQ ID NO: 606070 - RNA, 24 nt, Human
aaaaagaugcacagagagacccuc

SEQ ID NO: 606071 - RNA, 22 nt, Human
aaagaugcacagagagacccuc

SEQ ID NO: 606072 - RNA, 26 nt, Human
aaaugccagagugcugcaccauuucc

SEQ ID NO: 606073 - RNA, 24 nt, Human
aacccucagagcaaccagaaggga

SEQ ID NO: 606074 - RNA, 18 nt, Human
agagagagagaagcagag

SEQ ID NO: 606075 - RNA, 19 nt, Human
agagcaugggcagcagcag

SEQ ID NO: 606076 - RNA, 19 nt, Human
agaggguagggaaggagag

SEQ ID NO: 606077 - RNA, 23 nt, Human
agaggguagggaaggagagggag

SEQ ID NO: 606078 - RNA, 20 nt, Human
agcagcaggagugagagggg

SEQ ID NO: 606079 - RNA, 19 nt, Human
agggagggcagagcauggg

SEQ ID NO: 606080 - RNA, 18 nt, Human
auggaaacacagcuugcc

SEQ ID NO: 606081 - RNA, 19 nt, Human
caaccagaagggagggcag

SEQ ID NO: 606082 - RNA, 21 nt, Human
caaccagaagggagggcagag

SEQ ID NO: 606083 - RNA, 21 nt, Human
caauaacgggggaagaaagga

SEQ ID NO: 606084 - RNA, 24 nt, Human
cacagagagacccucagagaggcc

SEQ ID NO: 606085 - RNA, 18 nt, Human
cagcagcaggagugagag

SEQ ID NO: 606086 - RNA, 20 nt, Human
cagcagcaggagugagaggg

SEQ ID NO: 606087 - RNA, 21 nt, Human
cagcagcaggagugagagggg

SEQ ID NO: 606088 - RNA, 22 nt, Human
ccaacaagcaagguagcuccag

SEQ ID NO: 606089 - RNA, 21 nt, Human
ccccaucuguuagugcaucug

SEQ ID NO: 606090 - RNA, 19 nt, Human
cccccaacaagcaagguag

SEQ ID NO: 606091 - RNA, 19 nt, Human
cccgcuccagccgauccac

SEQ ID NO: 606092 - RNA, 18 nt, Human
cccgugggguccagggag

SEQ ID NO: 606093 - RNA, 22 nt, Human
ccugggacaggggcccgugggg

SEQ ID NO: 606094 - RNA, 21 nt, Human
cguccagcuccugcugcagcc

SEQ ID NO: 606095 - RNA, 20 nt, Human
cucagagaggccaagaaaga

SEQ ID NO: 606096 - RNA, 22 nt, Human
cucccugccugccccgcuccuc

SEQ ID NO: 606097 - RNA, 24 nt, Human
cuccucuguguuuaggggucaucc

SEQ ID NO: 606098 - RNA, 27 nt, Human
cuucugucgcucaggaguucaggggug

SEQ ID NO: 606099 - RNA, 21 nt, Human
gacgcagaaaugggggaagga

SEQ ID NO: 606100 - RNA, 19 nt, Human
gagaagcagagggaauggg

SEQ ID NO: 606101 - RNA, 23 nt, Human
gagagggguccccuuguccugcc

SEQ ID NO: 606102 - RNA, 20 nt, Human
gaggguaaaggacacuccuu

SEQ ID NO: 606103 - RNA, 23 nt, Human
gauggugagaggguagggaagga

SEQ ID NO: 606104 - RNA, 19 nt, Human
gcacagagagacccucaga

SEQ ID NO: 606105 - RNA, 21 nt, Human
ggaagaaaggaggacagggag

SEQ ID NO: 606106 - RNA, 22 nt, Human
ggaagaaaggaggacagggagc

SEQ ID NO: 606107 - RNA, 24 nt, Human
ggagguugcaggggacccaggugg

SEQ ID NO: 606108 - RNA, 21 nt, Human
ggcugguggaggccuggggcc

SEQ ID NO: 606109 - RNA, 19 nt, Human
ggguagggaaggagaggga

SEQ ID NO: 606110 - RNA, 25 nt, Human
ggguuggaguuuauuucugccagag

SEQ ID NO: 606111 - RNA, 22 nt, Human
guccugccccuuugcaagggaa

SEQ ID NO: 606112 - RNA, 20 nt, Human
gugagaggguagggaaggag

SEQ ID NO: 606113 - RNA, 22 nt, Human
uacccagucccccaacaagcaa

SEQ ID NO: 606114 - RNA, 18 nt, Human
uagggaaggagagggagg

SEQ ID NO: 606115 - RNA, 18 nt, Human
ucaaggcugguggaggcc

SEQ ID NO: 606116 - RNA, 24 nt, Human
ucagagaggccaagaaagauggug

SEQ ID NO: 606117 - RNA, 20 nt, Human
uccagcuccugcugcagccg

SEQ ID NO: 606118 - RNA, 24 nt, Human
ucccccaacaagcaagguagcucc

SEQ ID NO: 606119 - RNA, 21 nt, Human
ucccugccugccccgcucccc

SEQ ID NO: 606120 - RNA, 21 nt, Human
ucugccagagccuggaggcug

SEQ ID NO: 606121 - RNA, 24 nt, Human
ucuguguuuaggggucauccuuug

SEQ ID NO: 606122 - RNA, 18 nt, Human
ugccagagccuggaggcu

SEQ ID NO: 606123 - RNA, 18 nt, Human
ugccccgcuccucugugu

SEQ ID NO: 606124 - RNA, 21 nt, Human
uggaggccuggggcuucuguc

SEQ ID NO: 606125 - RNA, 22 nt, Human
uggaggcugggaggguaaagga

SEQ ID NO: 606126 - RNA, 21 nt, Human
uggcgucguccagcuccugcu

SEQ ID NO: 606127 - RNA, 27 nt, Human
ugggacaggggcccgugggguccaggg

SEQ ID NO: 606128 - RNA, 24 nt, Human
ugggaggguaaaggacacuccuuu

SEQ ID NO: 606129 - RNA, 23 nt, Human
ugggggaaggagaguggcuacgu

SEQ ID NO: 606130 - RNA, 25 nt, Human
uguccugccccuuugcaaggguuca

SEQ ID NO: 606131 - RNA, 23 nt, Human
uuggaguuuauuucugccagagc

SEQ ID NO: 606132 - RNA, 19 nt, Human
aaaacgcaaggguguucug

SEQ ID NO: 606133 - RNA, 19 nt, Human
aaacagccgccuuucccuu

SEQ ID NO: 606134 - RNA, 19 nt, Human
aacccccguccggcuggga

SEQ ID NO: 606135 - RNA, 18 nt, Human
aagcgguccuccugccuu

SEQ ID NO: 606136 - RNA, 24 nt, Human
aagcgguccuccugccuuggccuu

SEQ ID NO: 606137 - RNA, 23 nt, Human
acagcgcuuuccacacacccugu

SEQ ID NO: 606138 - RNA, 21 nt, Human
accagccccacagcugaggcc

SEQ ID NO: 606139 - RNA, 20 nt, Human
acuacagaaguaaaagcaac

SEQ ID NO: 606140 - RNA, 21 nt, Human
acuggagugagugggcaacau

SEQ ID NO: 606141 - RNA, 21 nt, Human
acugugagcggcucgggaggg

SEQ ID NO: 606142 - RNA, 22 nt, Human
agaaaccagccccaaacucauc

SEQ ID NO: 606143 - RNA, 18 nt, Human
agaaagagccaaacagcc

SEQ ID NO: 606144 - RNA, 20 nt, Human
agaagcuaucacagaugcua

SEQ ID NO: 606145 - RNA, 22 nt, Human
agagacagggucucgcucuauu

SEQ ID NO: 606146 - RNA, 18 nt, Human
agcgguccuccugccuug

SEQ ID NO: 606147 - RNA, 24 nt, Human
agcgguccuccugccuuggccuuc

SEQ ID NO: 606148 - RNA, 18 nt, Human
aggcagaggcuguggcaa

SEQ ID NO: 606149 - RNA, 20 nt, Human
aggcagaggcuguggcaaac

SEQ ID NO: 606150 - RNA, 20 nt, Human
aggcagugccucugaguguc

SEQ ID NO: 606151 - RNA, 19 nt, Human
agguuccaggcagaggcug

SEQ ID NO: 606152 - RNA, 18 nt, Human
aguagcugggauucuagg

SEQ ID NO: 606153 - RNA, 20 nt, Human
agucccuggcccgggccucc

SEQ ID NO: 606154 - RNA, 20 nt, Human
aucacagaugcuacagggcu

SEQ ID NO: 606155 - RNA, 19 nt, Human
auugcccagguuggccuug

SEQ ID NO: 606156 - RNA, 23 nt, Human
caaaaauggagccaaggcucuaa

SEQ ID NO: 606157 - RNA, 24 nt, Human
caaaaccccgagguaaaaggcugg

SEQ ID NO: 606158 - RNA, 25 nt, Human
caacaaaacgcaaggguguucugcu

SEQ ID NO: 606159 - RNA, 27 nt, Human
caagcgguccuccugccuuggccuucc

SEQ ID NO: 606160 - RNA, 23 nt, Human
caaggugaggcucucuguccccc

SEQ ID NO: 606161 - RNA, 22 nt, Human
cacacacccaggccuucccaga

SEQ ID NO: 606162 - RNA, 25 nt, Human
cacacacccugugcccuugugaccc

SEQ ID NO: 606163 - RNA, 18 nt, Human
cagaggcuguggcaaaca

SEQ ID NO: 606164 - RNA, 21 nt, Human
cagcacagugccccguccucu

SEQ ID NO: 606165 - RNA, 25 nt, Human
caggcccccuggcucccagggaggc

SEQ ID NO: 606166 - RNA, 23 nt, Human
cagggcucagagaggggccgggg

SEQ ID NO: 606167 - RNA, 24 nt, Human
cagggucucgcucuauugcccagg

SEQ ID NO: 606168 - RNA, 22 nt, Human
caguuucacaagcgagcggcgg

SEQ ID NO: 606169 - RNA, 23 nt, Human
caugccccugcgccgggcugccc

SEQ ID NO: 606170 - RNA, 24 nt, Human
cccagaaaccagccccaaacucau

SEQ ID NO: 606171 - RNA, 24 nt, Human
ccccacagcugaggccaucuccuc

SEQ ID NO: 606172 - RNA, 25 nt, Human
ccccucaggcucccaaaccugccaa

SEQ ID NO: 606173 - RNA, 22 nt, Human
ccccuggugaagucccuggccc

SEQ ID NO: 606174 - RNA, 22 nt, Human
cccugcgccgggcugcccugcu

SEQ ID NO: 606175 - RNA, 24 nt, Human
cccuucccagaaaccagccccaaa

SEQ ID NO: 606176 - RNA, 22 nt, Human
cccuugugacccagccccuggu

SEQ ID NO: 606177 - RNA, 18 nt, Human
ccucccaggcccccuggc

SEQ ID NO: 606178 - RNA, 24 nt, Human
ccuccugccuuggccuuccgagua

SEQ ID NO: 606179 - RNA, 23 nt, Human
ccucuauggcgugguccccacuu

SEQ ID NO: 606180 - RNA, 20 nt, Human
ccuggacucaagcgguccuc

SEQ ID NO: 606181 - RNA, 23 nt, Human
ccuggcccgggccuccuugugca

SEQ ID NO: 606182 - RNA, 22 nt, Human
ccuguuggccucaaaaccccga

SEQ ID NO: 606183 - RNA, 22 nt, Human
ccuucccagaaaccagccccaa

SEQ ID NO: 606184 - RNA, 18 nt, Human
ccuugaaucccuggacuc

SEQ ID NO: 606185 - RNA, 19 nt, Human
ccuugugacccagccccug

SEQ ID NO: 606186 - RNA, 19 nt, Human
ccuuucccuucacucaaaa

SEQ ID NO: 606187 - RNA, 22 nt, Human
cgagagcaccgggagcugcagu

SEQ ID NO: 606188 - RNA, 19 nt, Human
cggcucgggaggggucucc

SEQ ID NO: 606189 - RNA, 21 nt, Human
cgggaugaaaucacagcuguu

SEQ ID NO: 606190 - RNA, 22 nt, Human
cggugaccggcucuucccccac

SEQ ID NO: 606191 - RNA, 21 nt, Human
cuaggcgcaugccccugcgcc

SEQ ID NO: 606192 - RNA, 18 nt, Human
cucaagcgguccuccugc

SEQ ID NO: 606193 - RNA, 19 nt, Human
cucacgguccacauguccc

SEQ ID NO: 606194 - RNA, 24 nt, Human
cucccaggcccccuggcucccagc

SEQ ID NO: 606195 - RNA, 18 nt, Human
cucuauugcccagguugg

SEQ ID NO: 606196 - RNA, 24 nt, Human
cucucugucccccuuuaccaggag

SEQ ID NO: 606197 - RNA, 20 nt, Human
cucugcacgggcccagugcc

SEQ ID NO: 606198 - RNA, 23 nt, Human
cucugcacgggcccagugccugg

SEQ ID NO: 606199 - RNA, 20 nt, Human
cucuucuccccgcuggcccc

SEQ ID NO: 606200 - RNA, 18 nt, Human
cugcagugggagcagacc

SEQ ID NO: 606201 - RNA, 23 nt, Human
cugccuuggccuuccgaguagcu

SEQ ID NO: 606202 - RNA, 22 nt, Human
cuucccagaaaccagccccaaa

SEQ ID NO: 606203 - RNA, 24 nt, Human
cuuggccuuccgaguagcugggau

SEQ ID NO: 606204 - RNA, 19 nt, Human
gaagucccuggcccgggcc

SEQ ID NO: 606205 - RNA, 20 nt, Human
gagagcaccgggagcugcag

SEQ ID NO: 606206 - RNA, 22 nt, Human
gagcuccacccacuugacccag

SEQ ID NO: 606207 - RNA, 26 nt, Human
gaguagcugggauucuaggcgcaugc

SEQ ID NO: 606208 - RNA, 20 nt, Human
gauucuaggcgcaugccccu

SEQ ID NO: 606209 - RNA, 26 nt, Human
gccaucuccucacugagccugggacc

SEQ ID NO: 606210 - RNA, 20 nt, Human
gccuuggccuuccgaguagc

SEQ ID NO: 606211 - RNA, 20 nt, Human
gcgccgggcugcccugcucu

SEQ ID NO: 606212 - RNA, 22 nt, Human
gcuccacccacuugacccaguc

SEQ ID NO: 606213 - RNA, 21 nt, Human
ggaaucccucgccuucugcuc

SEQ ID NO: 606214 - RNA, 24 nt, Human
ggauggugucugcaaggcagugcc

SEQ ID NO: 606215 - RNA, 25 nt, Human
ggccaucuccucacugagccuggga

SEQ ID NO: 606216 - RNA, 19 nt, Human
ggcccccuggcucccagca

SEQ ID NO: 606217 - RNA, 21 nt, Human
gugggaaugguggcaucucag

SEQ ID NO: 606218 - RNA, 22 nt, Human
uaaacguucccuucccagaaac

SEQ ID NO: 606219 - RNA, 22 nt, Human
uaaauaaacguucccuucccag

SEQ ID NO: 606220 - RNA, 22 nt, Human
uacuaaauaaacguucccuucc

SEQ ID NO: 606221 - RNA, 21 nt, Human
uaggcgcaugccccugcgccg

SEQ ID NO: 606222 - RNA, 19 nt, Human
uaucacagaugcuacaggg

SEQ ID NO: 606223 - RNA, 19 nt, Human
ucacagaugcuacagggcu

SEQ ID NO: 606224 - RNA, 21 nt, Human
ucacugagccugggaccaggu

SEQ ID NO: 606225 - RNA, 19 nt, Human
ucaguccccgugggaaugg

SEQ ID NO: 606226 - RNA, 25 nt, Human
ucccagaaaccagccccaaacucau

SEQ ID NO: 606227 - RNA, 22 nt, Human
ucccagaacacgagagcaccgg

SEQ ID NO: 606228 - RNA, 22 nt, Human
ucccucgccuucugcucuggcu

SEQ ID NO: 606229 - RNA, 24 nt, Human
ucccuggacucaagcgguccuccu

SEQ ID NO: 606230 - RNA, 25 nt, Human
ucccuggacucaagcgguccuccug

SEQ ID NO: 606231 - RNA, 19 nt, Human
uccgaguagcugggauucu

SEQ ID NO: 606232 - RNA, 23 nt, Human
uccgaguagcugggauucuaggc

SEQ ID NO: 606233 - RNA, 24 nt, Human
uccgaguagcugggauucuaggcg

SEQ ID NO: 606234 - RNA, 24 nt, Human
uccgccugcucacucuccggugac

SEQ ID NO: 606235 - RNA, 22 nt, Human
uccggcugggaaucccucgccu

SEQ ID NO: 606236 - RNA, 22 nt, Human
ucuacacuacagaaguaaaagc

SEQ ID NO: 606237 - RNA, 21 nt, Human
ucuccagaguguuugcgacuc

SEQ ID NO: 606238 - RNA, 18 nt, Human
ucucgcucuauugcccag

SEQ ID NO: 606239 - RNA, 19 nt, Human
ucucgcucuauugcccagg

SEQ ID NO: 606240 - RNA, 19 nt, Human
ucucgcucuauugcccagg

SEQ ID NO: 606241 - RNA, 23 nt, Human
ucucgcucuauugcccagguugg

SEQ ID NO: 606242 - RNA, 26 nt, Human
ucucgcucuauugcccagguuggccu

SEQ ID NO: 606243 - RNA, 27 nt, Human
ucucgcucuauugcccagguuggccuu

SEQ ID NO: 606244 - RNA, 24 nt, Human
ucugcaggugccuucucugcacgg

SEQ ID NO: 606245 - RNA, 21 nt, Human
ucuggcucagcccagcuugga

SEQ ID NO: 606246 - RNA, 19 nt, Human
ucuucaguccccgugggaa

SEQ ID NO: 606247 - RNA, 18 nt, Human
ugacccagccccugguga

SEQ ID NO: 606248 - RNA, 24 nt, Human
ugagugggcaacauggaccagccc

SEQ ID NO: 606249 - RNA, 19 nt, Human
ugcacgggcccagugccug

SEQ ID NO: 606250 - RNA, 19 nt, Human
ugccccguccucuguguuc

SEQ ID NO: 606251 - RNA, 27 nt, Human
ugccucugagugucagggagauggccc

SEQ ID NO: 606252 - RNA, 21 nt, Human
ugccuggaugccaguuugagg

SEQ ID NO: 606253 - RNA, 20 nt, Human
ugccuuggccuuccgaguaa

SEQ ID NO: 606254 - RNA, 21 nt, Human
ugcucuggcucagcccagcuu

SEQ ID NO: 606255 - RNA, 24 nt, Human
uggacucaagcgguccuccugccu

SEQ ID NO: 606256 - RNA, 21 nt, Human
uggagugagugggcaacaugg

SEQ ID NO: 606257 - RNA, 23 nt, Human
uggccccucaggcucccaaaccu

SEQ ID NO: 606258 - RNA, 19 nt, Human
uggcgugguccccacuucc

SEQ ID NO: 606259 - RNA, 24 nt, Human
uggugaagucccuggcccgggccu

SEQ ID NO: 606260 - RNA, 20 nt, Human
ugugucuucaguccccgugg

SEQ ID NO: 606261 - RNA, 23 nt, Human
uguucuguuuagacccccuucca

SEQ ID NO: 606262 - RNA, 20 nt, Human
uuaccaggagcacggauggu

SEQ ID NO: 606263 - RNA, 21 nt, Human
uucccuucccagaaaccagcc

SEQ ID NO: 606264 - RNA, 24 nt, Human
uuccgaguagcugggauucuaggc

SEQ ID NO: 606265 - RNA, 23 nt, Human
uugacccagucccgccucucuca

SEQ ID NO: 606266 - RNA, 18 nt, Human
uugcagucaugcaaggag

SEQ ID NO: 606267 - RNA, 19 nt, Human
uugugcacacacccaggcc

SEQ ID NO: 606268 - RNA, 24 nt, Human
uugugcacacacccaggccuuccc

SEQ ID NO: 606269 - RNA, 19 nt, Human
uuuagacccccuuccacuu

SEQ ID NO: 606270 - RNA, 23 nt, Human
aagacacccccaauccccaucug

SEQ ID NO: 606271 - RNA, 19 nt, Human
aaggcugaaagccagcccu

SEQ ID NO: 606272 - RNA, 18 nt, Human
aaggcugaaagccagccu

SEQ ID NO: 606273 - RNA, 21 nt, Human
acacccccaauccccaucuga

SEQ ID NO: 606274 - RNA, 19 nt, Human
acaggcaucucuggguccc

SEQ ID NO: 606275 - RNA, 22 nt, Human
agccagugaggccaccuggucc

SEQ ID NO: 606276 - RNA, 18 nt, Human
agcccgggucccaguugg

SEQ ID NO: 606277 - RNA, 20 nt, Human
agccgacggcaaacgcgcag

SEQ ID NO: 606278 - RNA, 20 nt, Human
aggccgagggcagcauggga

SEQ ID NO: 606279 - RNA, 19 nt, Human
aguccaggagccuuaggaa

SEQ ID NO: 606280 - RNA, 22 nt, Human
auccucccacccccuccugccg

SEQ ID NO: 606281 - RNA, 23 nt, Human
augcagcagccgacggcaaacgc

SEQ ID NO: 606282 - RNA, 24 nt, Human
auuaguuucuggcccuggaggugg

SEQ ID NO: 606283 - RNA, 19 nt, Human
caacacgggucccaucccc

SEQ ID NO: 606284 - RNA, 19 nt, Human
caacacgggucccaucccc

SEQ ID NO: 606285 - RNA, 20 nt, Human
caacacgggucccauccccc

SEQ ID NO: 606286 - RNA, 23 nt, Human
cacccccuccugccgcgcaggcc

SEQ ID NO: 606287 - RNA, 21 nt, Human
caccguggucuggcggaggcc

SEQ ID NO: 606288 - RNA, 25 nt, Human
cagccgacggcaaacgcgcaggcuc

SEQ ID NO: 606289 - RNA, 24 nt, Human
caugcuggaaggggguccucucca

SEQ ID NO: 606290 - RNA, 22 nt, Human
ccccgcuggccucuggagucca

SEQ ID NO: 606291 - RNA, 21 nt, Human
ccccuccugccgcgcaggccu

SEQ ID NO: 606292 - RNA, 23 nt, Human
cccuccugccgcgcaggccucac

SEQ ID NO: 606293 - RNA, 19 nt, Human
cccuuggcaggcaccgugg

SEQ ID NO: 606294 - RNA, 21 nt, Human
ccucggccagcgucgggccuc

SEQ ID NO: 606295 - RNA, 18 nt, Human
ccuuggcaggcaccgugg

SEQ ID NO: 606296 - RNA, 25 nt, Human
cgcccgcauccucccacccccuccu

SEQ ID NO: 606297 - RNA, 24 nt, Human
cggcccgcccgcauccucccaccc

SEQ ID NO: 606298 - RNA, 21 nt, Human
cguccagggcgcccugcagcu

SEQ ID NO: 606299 - RNA, 22 nt, Human
cguccagggcgcccugcagcuc

SEQ ID NO: 606300 - RNA, 21 nt, Human
cucccacccccuccugccgcg

SEQ ID NO: 606301 - RNA, 18 nt, Human
cuccccgcuggccucugg

SEQ ID NO: 606302 - RNA, 22 nt, Human
cugcagcucggccaccagccug

SEQ ID NO: 606303 - RNA, 19 nt, Human
cuuguggacugggugugca

SEQ ID NO: 606304 - RNA, 24 nt, Human
gagaaaacagagggagccgguacc

SEQ ID NO: 606305 - RNA, 19 nt, Human
gcaaacgcgcaggcucugc

SEQ ID NO: 606306 - RNA, 18 nt, Human
gccaccagccugggggac

SEQ ID NO: 606307 - RNA, 24 nt, Human
gccaccagccugggggacgcaccg

SEQ ID NO: 606308 - RNA, 19 nt, Human
gccccgcgccuggcuaccg

SEQ ID NO: 606309 - RNA, 19 nt, Human
gcuucaaagcccggguccc

SEQ ID NO: 606310 - RNA, 18 nt, Human
ggacugggugugcaugcu

SEQ ID NO: 606311 - RNA, 20 nt, Human
ggaggcccuuggugggucuc

SEQ ID NO: 606312 - RNA, 20 nt, Human
ggcgcucaggguggcccuug

SEQ ID NO: 606313 - RNA, 23 nt, Human
gucucucucuccggccuuaguga

SEQ ID NO: 606314 - RNA, 21 nt, Human
uagauuucaggcugggggccu

SEQ ID NO: 606315 - RNA, 18 nt, Human
uaggaaggcugaaagcca

SEQ ID NO: 606316 - RNA, 18 nt, Human
uaggaaggcugaaagcca

SEQ ID NO: 606317 - RNA, 25 nt, Human
uaguuucuggcccuggagguggcuu

SEQ ID NO: 606318 - RNA, 23 nt, Human
ucuacagugagagaaaacagagg

SEQ ID NO: 606319 - RNA, 21 nt, Human
ucucuggguccccgagcacag

SEQ ID NO: 606320 - RNA, 19 nt, Human
ugagaagagccagugaggc

SEQ ID NO: 606321 - RNA, 20 nt, Human
ugcagcucggccaccagccu

SEQ ID NO: 606322 - RNA, 18 nt, Human
ugccagaagaggugacaa

SEQ ID NO: 606323 - RNA, 26 nt, Human
ugccagaagaggugacaauggaccua

SEQ ID NO: 606324 - RNA, 23 nt, Human
uggccucuggaguccaggagccu

SEQ ID NO: 606325 - RNA, 19 nt, Human
uggccuggggaaugcggug

SEQ ID NO: 606326 - RNA, 21 nt, Human
uggcuucaaagcccggguccc

SEQ ID NO: 606327 - RNA, 18 nt, Human
ugggucagaaacuccaac

SEQ ID NO: 606328 - RNA, 21 nt, Human
ugggucagaaacuccaacucu

SEQ ID NO: 606329 - RNA, 18 nt, Human
uggucuggcggaggcccu

SEQ ID NO: 606330 - RNA, 20 nt, Human
ugucucucucuccggccuua

SEQ ID NO: 606331 - RNA, 24 nt, Human
uucccagggaagcacaggcaucuc

SEQ ID NO: 606332 - RNA, 23 nt, Human
uucuggcccuggagguggcuuca

SEQ ID NO: 606333 - RNA, 23 nt, Human
aaaaacaaaaaacaaacaaacaa

SEQ ID NO: 606334 - RNA, 25 nt, Human
aaaaacagcaauaaacguucugcac

SEQ ID NO: 606335 - RNA, 21 nt, Human
aaaacaaaaaacaaacaaaca

SEQ ID NO: 606336 - RNA, 25 nt, Human
aaacaaacaaaaacccaaccaaaca

SEQ ID NO: 606337 - RNA, 20 nt, Human
aaacaaacaaacaaaaaccc

SEQ ID NO: 606338 - RNA, 21 nt, Human
aaacaaacaaacaaaaaccca

SEQ ID NO: 606339 - RNA, 27 nt, Human
aaacaaacaaacaaaaacccaaccaaa

SEQ ID NO: 606340 - RNA, 19 nt, Human
aaacaaaccccagcucucc

SEQ ID NO: 606341 - RNA, 24 nt, Human
aaagcaaaaacaaaaaacaaacaa

SEQ ID NO: 606342 - RNA, 30 nt, Human
aaauaaaaaugcaaauuaguuucauaaccc

SEQ ID NO: 606343 - RNA, 19 nt, Human
aacaaaaaacaaacaaaca

SEQ ID NO: 606344 - RNA, 22 nt, Human
aacacaaaaacagcaauaaacg

SEQ ID NO: 606345 - RNA, 19 nt, Human
aaccaaacaauaguacucc

SEQ ID NO: 606346 - RNA, 21 nt, Human
aagacuucucacaccagccag

SEQ ID NO: 606347 - RNA, 27 nt, Human
aagcaaaaacaaaaaacaaacaaacaa

SEQ ID NO: 606348 - RNA, 21 nt, Human
aaguacaaaaaccugcauuga

SEQ ID NO: 606349 - RNA, 26 nt, Human
aaugacaaaaguaaaagcaggaggaa

SEQ ID NO: 606350 - RNA, 21 nt, Human
acaaacaaaaacccaaccaaa

SEQ ID NO: 606351 - RNA, 23 nt, Human
acaaacaaaaacccaaccaaaca

SEQ ID NO: 606352 - RNA, 21 nt, Human
acaggaaauaaaacuuuuuca

SEQ ID NO: 606353 - RNA, 23 nt, Human
agagggggaacuucaaagaggau

SEQ ID NO: 606354 - RNA, 23 nt, Human
agcaaaaacaaaaaacaaacaaa

SEQ ID NO: 606355 - RNA, 22 nt, Human
agccgcacagcacggaguagcc

SEQ ID NO: 606356 - RNA, 19 nt, Human
aggaauauuaaacacaugg

SEQ ID NO: 606357 - RNA, 19 nt, Human
aggcaucaaacauuauacu

SEQ ID NO: 606358 - RNA, 23 nt, Human
agguaaacauuuuagaaaaaaca

SEQ ID NO: 606359 - RNA, 23 nt, Human
aguacucuuucuccucacaaaca

SEQ ID NO: 606360 - RNA, 20 nt, Human
aguuugucucuguucucuuc

SEQ ID NO: 606361 - RNA, 19 nt, Human
aucaaaaagcauaucugga

SEQ ID NO: 606362 - RNA, 25 nt, Human
augcuaacggaagacuucucacacc

SEQ ID NO: 606363 - RNA, 20 nt, Human
caaacaaaaacccaaccaaa

SEQ ID NO: 606364 - RNA, 22 nt, Human
caaacaaaaacccaaccaaaca

SEQ ID NO: 606365 - RNA, 22 nt, Human
caaacaaacaaaaacccaacca

SEQ ID NO: 606366 - RNA, 23 nt, Human
caaacaaaccccagcucucccag

SEQ ID NO: 606367 - RNA, 18 nt, Human
caaaguuucuggagcauu

SEQ ID NO: 606368 - RNA, 25 nt, Human
caaauaaaaaugcaaauuaguuuca

SEQ ID NO: 606369 - RNA, 19 nt, Human
caagaaaaugacaaaagua

SEQ ID NO: 606370 - RNA, 25 nt, Human
caagaccaagagaguaaauaucaac

SEQ ID NO: 606371 - RNA, 21 nt, Human
caagcaccucuuggcaauaaa

SEQ ID NO: 606372 - RNA, 19 nt, Human
cacaaaaacagcaauaaac

SEQ ID NO: 606373 - RNA, 21 nt, Human
cacaaacaaaccccagcucuc

SEQ ID NO: 606374 - RNA, 19 nt, Human
cacgcagccugcuggggcu

SEQ ID NO: 606375 - RNA, 20 nt, Human
cacuaacagguuggcaaagu

SEQ ID NO: 606376 - RNA, 20 nt, Human
cacugcuuuagcaaagagag

SEQ ID NO: 606377 - RNA, 25 nt, Human
cacuucuaacuuuagaauuucauuu

SEQ ID NO: 606378 - RNA, 24 nt, Human
cagaagaaauaaaguugcaaaaua

SEQ ID NO: 606379 - RNA, 18 nt, Human
cagauucacagucaauga

SEQ ID NO: 606380 - RNA, 23 nt, Human
caugucagaagaaauaaaguugc

SEQ ID NO: 606381 - RNA, 23 nt, Human
ccaaccaaacaauaguacuccuu

SEQ ID NO: 606382 - RNA, 21 nt, Human
ccgcagccguucggcccgggc

SEQ ID NO: 606383 - RNA, 26 nt, Human
ccggagacggcggcgcucggcuccuc

SEQ ID NO: 606384 - RNA, 20 nt, Human
ccucacaaacaaaccccagc

SEQ ID NO: 606385 - RNA, 18 nt, Human
ccucggcgcccagguguc

SEQ ID NO: 606386 - RNA, 21 nt, Human
ccuggaauucucuaccuucuc

SEQ ID NO: 606387 - RNA, 19 nt, Human
ccuggccacaugguacuca

SEQ ID NO: 606388 - RNA, 23 nt, Human
cgcccagguguccgcagccguuc

SEQ ID NO: 606389 - RNA, 23 nt, Human
cggaagacuucucacaccagcca

SEQ ID NO: 606390 - RNA, 24 nt, Human
cuccucacaaacaaaccccagcuc

SEQ ID NO: 606391 - RNA, 22 nt, Human
cucuaugcuaacggaagacuuc

SEQ ID NO: 606392 - RNA, 23 nt, Human
cugcaugcagagcuaaaaugcag

SEQ ID NO: 606393 - RNA, 22 nt, Human
cuuaaaaaguaaaaaaaucacc

SEQ ID NO: 606394 - RNA, 20 nt, Human
gaagauaccucacaagagaa

SEQ ID NO: 606395 - RNA, 18 nt, Human
gagaugauacgcuuugca

SEQ ID NO: 606396 - RNA, 21 nt, Human
gaucagaaaugaagaccaaga

SEQ ID NO: 606397 - RNA, 23 nt, Human
gaugauacgcuuugcagaagaga

SEQ ID NO: 606398 - RNA, 18 nt, Human
gcagaagagaggcaucaa

SEQ ID NO: 606399 - RNA, 19 nt, Human
gcguccugcuccucguucc

SEQ ID NO: 606400 - RNA, 19 nt, Human
gcuaaaaugcaggugugcu

SEQ ID NO: 606401 - RNA, 22 nt, Human
ggagcagaggaaaacaucaaaa

SEQ ID NO: 606402 - RNA, 20 nt, Human
ggaguccuugguuagcugca

SEQ ID NO: 606403 - RNA, 18 nt, Human
gggggaacuucaaagagg

SEQ ID NO: 606404 - RNA, 24 nt, Human
gguguauuuacuugaucagaaaug

SEQ ID NO: 606405 - RNA, 19 nt, Human
guccugcuccucguucccc

SEQ ID NO: 606406 - RNA, 20 nt, Human
gugaagcagaaucauggggc

SEQ ID NO: 606407 - RNA, 25 nt, Human
gugauucccccucccucaaaccaag

SEQ ID NO: 606408 - RNA, 22 nt, Human
uaaaagcaaaaacaaaaaacaa

SEQ ID NO: 606409 - RNA, 25 nt, Human
uaaaagcaaaaacaaaaaacaaaca

SEQ ID NO: 606410 - RNA, 19 nt, Human
uaaacugguuuacacccuu

SEQ ID NO: 606411 - RNA, 20 nt, Human
uaaguacaaaaaccugcauu

SEQ ID NO: 606412 - RNA, 22 nt, Human
uacacacaugcacaacacugug

SEQ ID NO: 606413 - RNA, 28 nt, Human
uacacacaugcacaacacugugucugca

SEQ ID NO: 606414 - RNA, 23 nt, Human
uauaauaaacugguuuacacccu

SEQ ID NO: 606415 - RNA, 19 nt, Human
uauaauagggcuaccaaga

SEQ ID NO: 606416 - RNA, 20 nt, Human
uauacaauacacacaugcac

SEQ ID NO: 606417 - RNA, 21 nt, Human
uaucaagaaaaugacaaaagu

SEQ ID NO: 606418 - RNA, 22 nt, Human
uaucaagaaaaugacaaaagua

SEQ ID NO: 606419 - RNA, 23 nt, Human
ucacaaacaaaccccagcucucc

SEQ ID NO: 606420 - RNA, 18 nt, Human
ucaccgggagcacucccc

SEQ ID NO: 606421 - RNA, 19 nt, Human
ucaccgggagcacuccccu

SEQ ID NO: 606422 - RNA, 18 nt, Human
ucaguuucacuuacaaau

SEQ ID NO: 606423 - RNA, 23 nt, Human
ucauaaccacaauucaauuuauc

SEQ ID NO: 606424 - RNA, 20 nt, Human
uccacaguacucuuucuccu

SEQ ID NO: 606425 - RNA, 22 nt, Human
uccauguaguucgucauacaga

SEQ ID NO: 606426 - RNA, 18 nt, Human
ucccucaaaccaagucca

SEQ ID NO: 606427 - RNA, 25 nt, Human
ucucuuccuucacugcuuuagcaaa

SEQ ID NO: 606428 - RNA, 21 nt, Human
ucugugauucccccucccuca

SEQ ID NO: 606429 - RNA, 19 nt, Human
ugacaaaaguaaaagcagg

SEQ ID NO: 606430 - RNA, 21 nt, Human
ugagaugauacgcuuugcaga

SEQ ID NO: 606431 - RNA, 22 nt, Human
ugaucagaaaugaagaccaaga

SEQ ID NO: 606432 - RNA, 19 nt, Human
ugaugggucugguaacugc

SEQ ID NO: 606433 - RNA, 24 nt, Human
ugcaggugugcugacuucuuggag

SEQ ID NO: 606434 - RNA, 18 nt, Human
ugcuggggcugcaugcag

SEQ ID NO: 606435 - RNA, 21 nt, Human
uggagcagaggaaaacaucaa

SEQ ID NO: 606436 - RNA, 21 nt, Human
uggggccagacugagguugga

SEQ ID NO: 606437 - RNA, 28 nt, Human
uggugcacauauacaauacacacaugca

SEQ ID NO: 606438 - RNA, 18 nt, Human
ugucagaagaaauaaagu

SEQ ID NO: 606439 - RNA, 19 nt, Human
ugucagaagaaauaaaguu

SEQ ID NO: 606440 - RNA, 24 nt, Human
uucaaacacaaaaacagcaauaaa

SEQ ID NO: 606441 - RNA, 22 nt, Human
uucacaguccaaagaguuuguc

SEQ ID NO: 606442 - RNA, 22 nt, Human
uucaccgggagcacuccccuca

SEQ ID NO: 606443 - RNA, 18 nt, Human
uucacuccaugucagaag

SEQ ID NO: 606444 - RNA, 20 nt, Human
uuccaacagugaagcagaau

SEQ ID NO: 606445 - RNA, 19 nt, Human
uuccuuccagauacacaau

SEQ ID NO: 606446 - RNA, 21 nt, Human
uuuaucaaacuuuuucugaag

SEQ ID NO: 606447 - RNA, 19 nt, Human
uuuccauguaguucgucau

SEQ ID NO: 606448 - RNA, 18 nt, Human
uuugcagaagagaggcau

SEQ ID NO: 606449 - RNA, 19 nt, Human
uuuguagucacucauaggu

SEQ ID NO: 606450 - RNA, 23 nt, Human
uuuuagaacuggaacaugcugcu

SEQ ID NO: 606451 - RNA, 20 nt, Human
uuuuuuuuuuuuuuauucgg

SEQ ID NO: 606452 - RNA, 26 nt, Human
uuuuuuuuuuuuuuuuuuuuauucgg

SEQ ID NO: 606453 - RNA, 18 nt, Human
aaaaaaagcacaacggag

SEQ ID NO: 606454 - RNA, 24 nt, Human
aaacaacaauuccaucuuaaaaca

SEQ ID NO: 606455 - RNA, 22 nt, Human
aagacucacagagccagggaca

SEQ ID NO: 606456 - RNA, 23 nt, Human
aagacucacagagccagggacac

SEQ ID NO: 606457 - RNA, 25 nt, Human
agaacauauucauguacaaagccaa

SEQ ID NO: 606458 - RNA, 25 nt, Human
agauguaaugcaggcugguuaacag

SEQ ID NO: 606459 - RNA, 21 nt, Human
agcagugaugcccugcaaaca

SEQ ID NO: 606460 - RNA, 18 nt, Human
agcauuuugugaacaggc

SEQ ID NO: 606461 - RNA, 21 nt, Human
aggaaaaaaaaagcacaacgg

SEQ ID NO: 606462 - RNA, 23 nt, Human
aggcaaauaagaucaagagagca

SEQ ID NO: 606463 - RNA, 21 nt, Human
aggcaggcagcaggagauauc

SEQ ID NO: 606464 - RNA, 26 nt, Human
cacaauucugauagcuuugauuaucu

SEQ ID NO: 606465 - RNA, 23 nt, Human
caggcgaugacccaguuuguacc

SEQ ID NO: 606466 - RNA, 18 nt, Human
cccuuuuccuccuuuauc

SEQ ID NO: 606467 - RNA, 23 nt, Human
cccuuuuccuccuuuaucugggg

SEQ ID NO: 606468 - RNA, 20 nt, Human
ccugaguauagaguaugagg

SEQ ID NO: 606469 - RNA, 22 nt, Human
ccugcaaacagucuaaugggcc

SEQ ID NO: 606470 - RNA, 20 nt, Human
ccuugaucuccaggaaaaga

SEQ ID NO: 606471 - RNA, 20 nt, Human
cgaggcaauaacaagcucag

SEQ ID NO: 606472 - RNA, 22 nt, Human
cucacagagccagggacaccca

SEQ ID NO: 606473 - RNA, 18 nt, Human
cucuguacaaccaugagg

SEQ ID NO: 606474 - RNA, 25 nt, Human
cugacagcuuuucuagacagggagu

SEQ ID NO: 606475 - RNA, 26 nt, Human
cuucuggguugacugcugaguuaugc

SEQ ID NO: 606476 - RNA, 20 nt, Human
cuuggguuaaagggccuggg

SEQ ID NO: 606477 - RNA, 20 nt, Human
gaaaaaaaaagcacaacgga

SEQ ID NO: 606478 - RNA, 20 nt, Human
gaagaggaaaaaaaaagcac

SEQ ID NO: 606479 - RNA, 22 nt, Human
gaagaggaaaaaaaaagcacaa

SEQ ID NO: 606480 - RNA, 22 nt, Human
gauuucuccuuggccauggguu

SEQ ID NO: 606481 - RNA, 19 nt, Human
gcauccuugaucuccagga

SEQ ID NO: 606482 - RNA, 23 nt, Human
gcuagugaaacuguacaucugaa

SEQ ID NO: 606483 - RNA, 23 nt, Human
gcuuuguggcuagugaaacugua

SEQ ID NO: 606484 - RNA, 25 nt, Human
gcuuuucuagacagggaguagaauu

SEQ ID NO: 606485 - RNA, 18 nt, Human
ggaagacucacagagcca

SEQ ID NO: 606486 - RNA, 21 nt, Human
ggagggauacgucugugagga

SEQ ID NO: 606487 - RNA, 20 nt, Human
guaaauggucagggaucuuc

SEQ ID NO: 606488 - RNA, 21 nt, Human
uaaaacaggcauuuuaaaagc

SEQ ID NO: 606489 - RNA, 18 nt, Human
uaaauggucagggaucuu

SEQ ID NO: 606490 - RNA, 26 nt, Human
uaacaagcucaguuuaaccauuuccc

SEQ ID NO: 606491 - RNA, 22 nt, Human
uaauuuccaaagacaaagacaa

SEQ ID NO: 606492 - RNA, 26 nt, Human
uacaaccaugaggaagaugaggcaaa

SEQ ID NO: 606493 - RNA, 28 nt, Human
uacagaacauauucauguacaaagccaa

SEQ ID NO: 606494 - RNA, 18 nt, Human
uagggguguacaagacgg

SEQ ID NO: 606495 - RNA, 20 nt, Human
ucagcacccaaguccugacu

SEQ ID NO: 606496 - RNA, 19 nt, Human
uccagauguaaugcaggcu

SEQ ID NO: 606497 - RNA, 18 nt, Human
uccaggaaaagagauuag

SEQ ID NO: 606498 - RNA, 21 nt, Human
ucccuauaauucucuauggcc

SEQ ID NO: 606499 - RNA, 19 nt, Human
ucccugcaggcaggcagca

SEQ ID NO: 606500 - RNA, 24 nt, Human
ucccugcaggcaggcagcaggaga

SEQ ID NO: 606501 - RNA, 18 nt, Human
uccuugaucuccaggaaa

SEQ ID NO: 606502 - RNA, 27 nt, Human
ucuccgaggcaauaacaagcucaguuu

SEQ ID NO: 606503 - RNA, 18 nt, Human
ucugccuuucccuuuucc

SEQ ID NO: 606504 - RNA, 18 nt, Human
ugaaagagcacuuguaca

SEQ ID NO: 606505 - RNA, 21 nt, Human
ugaagcuguccaaacucccag

SEQ ID NO: 606506 - RNA, 23 nt, Human
ugacccaguuuguaccugugcuu

SEQ ID NO: 606507 - RNA, 19 nt, Human
ugaggcaaauaagaucaag

SEQ ID NO: 606508 - RNA, 20 nt, Human
ugauagcuuugauuaucugu

SEQ ID NO: 606509 - RNA, 21 nt, Human
ugcacaaucuggauacccaaa

SEQ ID NO: 606510 - RNA, 18 nt, Human
uggaagacucacagagcc

SEQ ID NO: 606511 - RNA, 20 nt, Human
ugggacaggauucugguucu

SEQ ID NO: 606512 - RNA, 25 nt, Human
uggguucuuggguuaaagggccugg

SEQ ID NO: 606513 - RNA, 22 nt, Human
uguacaucugaagcuguccaaa

SEQ ID NO: 606514 - RNA, 20 nt, Human
ugucagggggaagcagugau

SEQ ID NO: 606515 - RNA, 19 nt, Human
uuaaaacaggcauuuuaaa

SEQ ID NO: 606516 - RNA, 22 nt, Human
uuaaaacaggcauuuuaaaagc

SEQ ID NO: 606517 - RNA, 21 nt, Human
uucccuuuuccuccuuuaucu

SEQ ID NO: 606518 - RNA, 19 nt, Human
uugcuaaaacauggauuua

SEQ ID NO: 606519 - RNA, 23 nt, Human
uuguaccugugcuuuguggcuag

SEQ ID NO: 606520 - RNA, 19 nt, Human
uuuccaaagacaaagacaa

SEQ ID NO: 606521 - RNA, 23 nt, Human
uuucuccuuggccauggguucuu

SEQ ID NO: 606522 - RNA, 18 nt, Human
uuugcuaaaacauggauu

SEQ ID NO: 606523 - RNA, 23 nt, Human
uuuucuagacagggaguagaauu

SEQ ID NO: 606524 - RNA, 18 nt, Human
uuuuuuuuuuuuuuuuug

SEQ ID NO: 606525 - RNA, 20 nt, Human
uuuuuuuuuuuuuuuuugcu

SEQ ID NO: 606526 - RNA, 21 nt, Human
aaacuggucuuucuauucuca

SEQ ID NO: 606527 - RNA, 18 nt, Human
aaagauaucuuuuguucc

SEQ ID NO: 606528 - RNA, 20 nt, Human
aaaugaaaaaucuguaaaga

SEQ ID NO: 606529 - RNA, 20 nt, Human
aacacaaucuucccaugcug

SEQ ID NO: 606530 - RNA, 18 nt, Human
aaggacgugccggaaaaa

SEQ ID NO: 606531 - RNA, 18 nt, Human
aagugcauaagccugaaa

SEQ ID NO: 606532 - RNA, 19 nt, Human
aauuucugaauuuuucccc

SEQ ID NO: 606533 - RNA, 19 nt, Human
agacaauaucucaguucuu

SEQ ID NO: 606534 - RNA, 22 nt, Human
aggaaaagaaaacuuuggccaa

SEQ ID NO: 606535 - RNA, 22 nt, Human
aggcaggcaggcaagcaggaau

SEQ ID NO: 606536 - RNA, 21 nt, Human
auaaaacagagagacacagaa

SEQ ID NO: 606537 - RNA, 23 nt, Human
auaaaauguaccaucuagcaccc

SEQ ID NO: 606538 - RNA, 23 nt, Human
auaacaacauauaauacaaguuu

SEQ ID NO: 606539 - RNA, 18 nt, Human
aucucaguucuuuuuaaa

SEQ ID NO: 606540 - RNA, 22 nt, Human
auugcagacagccccugguggu

SEQ ID NO: 606541 - RNA, 19 nt, Human
caauauaaguauacaagac

SEQ ID NO: 606542 - RNA, 22 nt, Human
cacuccaugcucaaaugaaaaa

SEQ ID NO: 606543 - RNA, 22 nt, Human
cagcaauggcuccaaagacucu

SEQ ID NO: 606544 - RNA, 29 nt, Human
cauaacaacauauaauacaaguuucaaaa

SEQ ID NO: 606545 - RNA, 20 nt, Human
cauauacauaaagugcaugg

SEQ ID NO: 606546 - RNA, 20 nt, Human
caucacguuuuuccaaagga

SEQ ID NO: 606547 - RNA, 21 nt, Human
ccaaugccuguaaauaccaga

SEQ ID NO: 606548 - RNA, 18 nt, Human
ccuaagcuggauucaggg

SEQ ID NO: 606549 - RNA, 22 nt, Human
ccuuuuaaacucugaagacaaa

SEQ ID NO: 606550 - RNA, 20 nt, Human
cgauacucuucaucacguuu

SEQ ID NO: 606551 - RNA, 18 nt, Human
cggcaacagaaagcggcg

SEQ ID NO: 606552 - RNA, 19 nt, Human
cugaacuaaguaaccuaag

SEQ ID NO: 606553 - RNA, 21 nt, Human
cugauucccaacauuuaagaa

SEQ ID NO: 606554 - RNA, 19 nt, Human
gaacacaaucuucccaugc

SEQ ID NO: 606555 - RNA, 18 nt, Human
gauacucuucaucacguu

SEQ ID NO: 606556 - RNA, 20 nt, Human
gccccugguggucaucaucu

SEQ ID NO: 606557 - RNA, 24 nt, Human
ggaaaagaaaacuuuggccaauau

SEQ ID NO: 606558 - RNA, 19 nt, Human
ggcaggcaggcaggcaagc

SEQ ID NO: 606559 - RNA, 20 nt, Human
uaaaacagagagacacagaa

SEQ ID NO: 606560 - RNA, 23 nt, Human
uaaaacauuauuauauaauagca

SEQ ID NO: 606561 - RNA, 20 nt, Human
uaaaagaaaugaaguggaaa

SEQ ID NO: 606562 - RNA, 25 nt, Human
uaaaucacauagacaugguuaaaga

SEQ ID NO: 606563 - RNA, 21 nt, Human
uaacauaaaacagagagacac

SEQ ID NO: 606564 - RNA, 23 nt, Human
uaagugcauaagccugaaacugg

SEQ ID NO: 606565 - RNA, 20 nt, Human
uaccaguauuuuuaagccag

SEQ ID NO: 606566 - RNA, 22 nt, Human
uagcugaaggagcucaaaauau

SEQ ID NO: 606567 - RNA, 19 nt, Human
uauacauauagaacuacau

SEQ ID NO: 606568 - RNA, 21 nt, Human
uaucucaguucuuuuuaaaau

SEQ ID NO: 606569 - RNA, 22 nt, Human
ucccaugcuguauucacaugcu

SEQ ID NO: 606570 - RNA, 18 nt, Human
ucucacuccaugcucaaa

SEQ ID NO: 606571 - RNA, 25 nt, Human
ugaauaacugauucccaacauuuaa

SEQ ID NO: 606572 - RNA, 23 nt, Human
ugaauaucuucacuucgauacuc

SEQ ID NO: 606573 - RNA, 21 nt, Human
ugcgcccggcaacagaaagcg

SEQ ID NO: 606574 - RNA, 21 nt, Human
uguaaauaccagaauuccauc

SEQ ID NO: 606575 - RNA, 22 nt, Human
uguaccaucuagcaccaaugcc

SEQ ID NO: 606576 - RNA, 19 nt, Human
uguuccuccaaucuucuga

SEQ ID NO: 606577 - RNA, 23 nt, Human
uuagagccuuggguaagaugauu

SEQ ID NO: 606578 - RNA, 19 nt, Human
uucacugcuucauguaaac

SEQ ID NO: 606579 - RNA, 20 nt, Human
uucacuucgauacucuucau

SEQ ID NO: 606580 - RNA, 20 nt, Human
uucauuugguauauacauau

SEQ ID NO: 606581 - RNA, 19 nt, Human
uucuauucucacuccaugc

SEQ ID NO: 606582 - RNA, 24 nt, Human
uuuaaaagaaaugaaguggaaaau

SEQ ID NO: 606583 - RNA, 19 nt, Human
uuuaucucuagcuuccugu

SEQ ID NO: 606584 - RNA, 22 nt, Human
uuucuauucucacuccaugcuc

SEQ ID NO: 606585 - RNA, 22 nt, Human
uuuuaagccagauuuuccugga

SEQ ID NO: 606586 - RNA, 20 nt, Human
uuuuagaguuuucagcaaug

SEQ ID NO: 606587 - RNA, 19 nt, Human
acacacaguauuccccuag

SEQ ID NO: 606588 - RNA, 23 nt, Human
acacaguauuccccuaguauuca

SEQ ID NO: 606589 - RNA, 20 nt, Human
acauaucagugcccaaacgc

SEQ ID NO: 606590 - RNA, 23 nt, Human
accuccuuguaauccuucuccag

SEQ ID NO: 606591 - RNA, 21 nt, Human
acucacccuccuccaugcccu

SEQ ID NO: 606592 - RNA, 23 nt, Human
aggcaccacagugggaggcuggu

SEQ ID NO: 606593 - RNA, 22 nt, Human
auccccccuaucuuuucuuccc

SEQ ID NO: 606594 - RNA, 20 nt, Human
caaacugaaugcugcacuug

SEQ ID NO: 606595 - RNA, 18 nt, Human
cacacaguauuccccuag

SEQ ID NO: 606596 - RNA, 18 nt, Human
cacagaaccacccccccc

SEQ ID NO: 606597 - RNA, 20 nt, Human
caccccccccccgugacuca

SEQ ID NO: 606598 - RNA, 22 nt, Human
cagcaauggcagcguugacauc

SEQ ID NO: 606599 - RNA, 20 nt, Human
caugcacauggcacguugca

SEQ ID NO: 606600 - RNA, 22 nt, Human
cauguugcucagcaugcacaug

SEQ ID NO: 606601 - RNA, 19 nt, Human
ccacacuauccaugcccac

SEQ ID NO: 606602 - RNA, 19 nt, Human
ccacacuccacacuaucca

SEQ ID NO: 606603 - RNA, 18 nt, Human
ccacagaaccaccccccc

SEQ ID NO: 606604 - RNA, 21 nt, Human
ccacagaaccacccccccccc

SEQ ID NO: 606605 - RNA, 21 nt, Human
ccacagugggaggcuggugau

SEQ ID NO: 606606 - RNA, 20 nt, Human
ccaccccccccccgugacuc

SEQ ID NO: 606607 - RNA, 23 nt, Human
ccaccccccccccgugacucagc

SEQ ID NO: 606608 - RNA, 19 nt, Human
ccaggucacucccaggcac

SEQ ID NO: 606609 - RNA, 22 nt, Human
ccaggucacucccaggcaccac

SEQ ID NO: 606610 - RNA, 25 nt, Human
cccacacuccacacuauccaugccc

SEQ ID NO: 606611 - RNA, 22 nt, Human
cccccccgugacucagcaccuc

SEQ ID NO: 606612 - RNA, 21 nt, Human
ccccccgugacucagcacccc

SEQ ID NO: 606613 - RNA, 22 nt, Human
cccccgugacucagcaccccgc

SEQ ID NO: 606614 - RNA, 21 nt, Human
ccccuaguauucauccccccu

SEQ ID NO: 606615 - RNA, 22 nt, Human
ccccuaucuuuucuuccccaca

SEQ ID NO: 606616 - RNA, 22 nt, Human
cucacccacauaucagugccca

SEQ ID NO: 606617 - RNA, 24 nt, Human
cuccacacuauccaugcccaccuc

SEQ ID NO: 606618 - RNA, 21 nt, Human
cuccagccgaagcccgggugc

SEQ ID NO: 606619 - RNA, 19 nt, Human
cucuccagccgaagcccgg

SEQ ID NO: 606620 - RNA, 22 nt, Human
cugaagcgagcuggcccucucc

SEQ ID NO: 606621 - RNA, 19 nt, Human
cuguguaugcauuccaacu

SEQ ID NO: 606622 - RNA, 23 nt, Human
gccuccugaagcgagcuggcccu

SEQ ID NO: 606623 - RNA, 20 nt, Human
gcgggcccaggccauagugg

SEQ ID NO: 606624 - RNA, 20 nt, Human
gguauagcaggcagcaggcc

SEQ ID NO: 606625 - RNA, 18 nt, Human
uaggacagacacacagua

SEQ ID NO: 606626 - RNA, 19 nt, Human
ucagugcccaaacgcccuc

SEQ ID NO: 606627 - RNA, 20 nt, Human
ucaugggccuuggagaacuc

SEQ ID NO: 606628 - RNA, 22 nt, Human
uccaacuauccacagaaccacc

SEQ ID NO: 606629 - RNA, 24 nt, Human
uccacagaaccaccccccccccgu

SEQ ID NO: 606630 - RNA, 22 nt, Human
uccaugcccaccuccuuguaau

SEQ ID NO: 606631 - RNA, 21 nt, Human
ucuguguaugcauuccaacua

SEQ ID NO: 606632 - RNA, 22 nt, Human
ugaaugcugcacuuggucuuga

SEQ ID NO: 606633 - RNA, 24 nt, Human
ugauaucaaccuuaaagccugugg

SEQ ID NO: 606634 - RNA, 18 nt, Human
ugcacauggcacguugca

SEQ ID NO: 606635 - RNA, 21 nt, Human
ugcacauggcacguugcacuu

SEQ ID NO: 606636 - RNA, 18 nt, Human
ugcacuuggucuugaugg

SEQ ID NO: 606637 - RNA, 22 nt, Human
ugcccaaacgcccucuuggcau

SEQ ID NO: 606638 - RNA, 20 nt, Human
uggcagcaauggcagcguug

SEQ ID NO: 606639 - RNA, 19 nt, Human
uggcauacaucaggucaaa

SEQ ID NO: 606640 - RNA, 20 nt, Human
ugguccaggcgggcccaggg

SEQ ID NO: 606641 - RNA, 24 nt, Human
uggugggaacgggguucggccucc

SEQ ID NO: 606642 - RNA, 24 nt, Human
uuaaagccuguggggcaccagucc

SEQ ID NO: 606643 - RNA, 18 nt, Human
uuuaccaggucacuccca

SEQ ID NO: 606644 - RNA, 23 nt, Human
uuuaccaggucacucccaggcac

SEQ ID NO: 606645 - RNA, 19 nt, Human
aagccagcaaccacggggc

SEQ ID NO: 606646 - RNA, 22 nt, Human
acggggcucuggagaaucgggg

SEQ ID NO: 606647 - RNA, 19 nt, Human
cagagucacgcaagcagag

SEQ ID NO: 606648 - RNA, 25 nt, Human
ccacggggcucuggagaaucgggga

SEQ ID NO: 606649 - RNA, 20 nt, Human
ccuccuguggacacggggcu

SEQ ID NO: 606650 - RNA, 21 nt, Human
cgagguggccuccuguggaca

SEQ ID NO: 606651 - RNA, 22 nt, Human
gagcagagucacgcaagcagag

SEQ ID NO: 606652 - RNA, 23 nt, Human
ucuggagaaucggggagcagagu

SEQ ID NO: 606653 - RNA, 20 nt, Human
gcaguaauuacaaagguuaa

SEQ ID NO: 606654 - RNA, 20 nt, Human
uaacaguuauaauuacacac

SEQ ID NO: 606655 - RNA, 27 nt, Human
ugauuccaauaaauaucacaggaaaua

SEQ ID NO: 606656 - RNA, 25 nt, Human
uuaaagacucuuccaucucaaauaa

SEQ ID NO: 606657 - RNA, 18 nt, Human
uugacauaggaaagccua

SEQ ID NO: 606658 - RNA, 21 nt, Human
aaaauaccucuguuccaccug

SEQ ID NO: 606659 - RNA, 20 nt, Human
accucuguuccaccugagag

SEQ ID NO: 606660 - RNA, 24 nt, Human
accucuguuccaccugagagcaag

SEQ ID NO: 606661 - RNA, 24 nt, Human
aggcagucggggauggggcggggu

SEQ ID NO: 606662 - RNA, 22 nt, Human
aggcgguccagggcaaugcagu

SEQ ID NO: 606663 - RNA, 19 nt, Human
caagacauucccccucccc

SEQ ID NO: 606664 - RNA, 22 nt, Human
caggcuagagagacccaaaaua

SEQ ID NO: 606665 - RNA, 20 nt, Human
ccaccugagagcaaggugga

SEQ ID NO: 606666 - RNA, 23 nt, Human
cccaaaauaccucuguuccaccu

SEQ ID NO: 606667 - RNA, 24 nt, Human
cccaagacauuuucagacuuaaaa

SEQ ID NO: 606668 - RNA, 20 nt, Human
ccugagagcaagguggaagu

SEQ ID NO: 606669 - RNA, 24 nt, Human
cgcuggacuugcgguccgucuccu

SEQ ID NO: 606670 - RNA, 20 nt, Human
cuagagagacccaaaauacc

SEQ ID NO: 606671 - RNA, 23 nt, Human
uaaagucaguguuacaggugcug

SEQ ID NO: 606672 - RNA, 23 nt, Human
ugagucgucuguggguacgcugg

SEQ ID NO: 606673 - RNA, 21 nt, Human
ugggauaaaggaggcggucca

SEQ ID NO: 606674 - RNA, 18 nt, Human
uguggguacgcuggacuu

SEQ ID NO: 606675 - RNA, 22 nt, Human
uucaggcuagagagacccaaaa

SEQ ID NO: 606676 - RNA, 23 nt, Human
aaaaaaaaaaaaaaaaaaaagag

SEQ ID NO: 606677 - RNA, 19 nt, Human
aaagugcugggauuacagg

SEQ ID NO: 606678 - RNA, 22 nt, Human
aaagugcugggauuacaggcau

SEQ ID NO: 606679 - RNA, 24 nt, Human
aaagugcugggauuacaggcauca

SEQ ID NO: 606680 - RNA, 19 nt, Human
aacguggugaaacccgucu

SEQ ID NO: 606681 - RNA, 20 nt, Human
aacguggugaaacccgucuc

SEQ ID NO: 606682 - RNA, 20 nt, Human
aacuuccgccucccggcuuc

SEQ ID NO: 606683 - RNA, 21 nt, Human
aagccgaggcggguggaucac

SEQ ID NO: 606684 - RNA, 24 nt, Human
aagcggggguugccgugagccgag

SEQ ID NO: 606685 - RNA, 19 nt, Human
aagugcugggauuacaggc

SEQ ID NO: 606686 - RNA, 21 nt, Human
aagugcugggauuacaggcau

SEQ ID NO: 606687 - RNA, 18 nt, Human
aauugcuugaacccggga

SEQ ID NO: 606688 - RNA, 24 nt, Human
aauuuuguauuuucaguagagacg

SEQ ID NO: 606689 - RNA, 19 nt, Human
acaaugcccggcuaauuuu

SEQ ID NO: 606690 - RNA, 21 nt, Human
acaggcaucagccacugcgcc

SEQ ID NO: 606691 - RNA, 20 nt, Human
acgggguuucuccauggugg

SEQ ID NO: 606692 - RNA, 24 nt, Human
acgggguuucuccaugguggucag

SEQ ID NO: 606693 - RNA, 24 nt, Human
acucuuguugcccaggcuggagug

SEQ ID NO: 606694 - RNA, 18 nt, Human
acugcauuccagccuggg

SEQ ID NO: 606695 - RNA, 21 nt, Human
acugcauuccagccugggcaa

SEQ ID NO: 606696 - RNA, 25 nt, Human
acugcauuccagccugggcaacaag

SEQ ID NO: 606697 - RNA, 18 nt, Human
agagauucuccuaccuca

SEQ ID NO: 606698 - RNA, 24 nt, Human
agagauucuccuaccucagcuucc

SEQ ID NO: 606699 - RNA, 23 nt, Human
agcacgguggcucacgcccguaa

SEQ ID NO: 606700 - RNA, 23 nt, Human
agccgggcaugguggcggaugcc

SEQ ID NO: 606701 - RNA, 22 nt, Human
agccuggccaacguggugaaac

SEQ ID NO: 606702 - RNA, 24 nt, Human
agccuggccaacguggugaaaccc

SEQ ID NO: 606703 - RNA, 21 nt, Human
aggaggacccagccuuauaug

SEQ ID NO: 606704 - RNA, 21 nt, Human
aggcagccaaaggccucugga

SEQ ID NO: 606705 - RNA, 24 nt, Human
aggcaggagaauugcuugaacccg

SEQ ID NO: 606706 - RNA, 23 nt, Human
aggcaugcaccaccacaaugccc

SEQ ID NO: 606707 - RNA, 26 nt, Human
aggcggguggaucaccugacgucagg

SEQ ID NO: 606708 - RNA, 21 nt, Human
aggcugaggcaggagaauugc

SEQ ID NO: 606709 - RNA, 24 nt, Human
aggcugaggcaggagaauugcuug

SEQ ID NO: 606710 - RNA, 25 nt, Human
aggcuggagugcaguggcgcgaucu

SEQ ID NO: 606711 - RNA, 24 nt, Human
aggugauccacccaucuuggccuc

SEQ ID NO: 606712 - RNA, 21 nt, Human
aguagcugggguuacaggcau

SEQ ID NO: 606713 - RNA, 20 nt, Human
agugcaguggcgcgaucucg

SEQ ID NO: 606714 - RNA, 23 nt, Human
agugcaguggcgcgaucucggcu

SEQ ID NO: 606715 - RNA, 24 nt, Human
agugcaguggcgcgaucucggcuc

SEQ ID NO: 606716 - RNA, 18 nt, Human
agugcugggauuacaggc

SEQ ID NO: 606717 - RNA, 24 nt, Human
aucgugccacugcauuccagccug

SEQ ID NO: 606718 - RNA, 24 nt, Human
caaagugcugggauuacaggcauc

SEQ ID NO: 606719 - RNA, 26 nt, Human
caacaagagugaaacuccgccccaaa

SEQ ID NO: 606720 - RNA, 23 nt, Human
caacguggugaaacccgucucua

SEQ ID NO: 606721 - RNA, 24 nt, Human
caagaccagccuggccaacguggu

SEQ ID NO: 606722 - RNA, 21 nt, Human
caccacaacuuccgccucccg

SEQ ID NO: 606723 - RNA, 22 nt, Human
cacccaucuuggccucccaaag

SEQ ID NO: 606724 - RNA, 23 nt, Human
cacccaucuuggccucccaaagu

SEQ ID NO: 606725 - RNA, 24 nt, Human
cacccaucuuggccucccaaagug

SEQ ID NO: 606726 - RNA, 24 nt, Human
cacgcccguaaucccagcacuuug

SEQ ID NO: 606727 - RNA, 24 nt, Human
cacucuuguugcccaggcuggagu

SEQ ID NO: 606728 - RNA, 19 nt, Human
cacugcauuccagccuggg

SEQ ID NO: 606729 - RNA, 22 nt, Human
cacugcauuccagccugggcaa

SEQ ID NO: 606730 - RNA, 23 nt, Human
cacugcauuccagccugggcaac

SEQ ID NO: 606731 - RNA, 24 nt, Human
cacugcauuccagccugggcaaca

SEQ ID NO: 606732 - RNA, 24 nt, Human
cagcacuuugggaagccgaggcgg

SEQ ID NO: 606733 - RNA, 24 nt, Human
cagccacucgagaggcugaggcag

SEQ ID NO: 606734 - RNA, 21 nt, Human
cagccugggcaacaagaguga

SEQ ID NO: 606735 - RNA, 21 nt, Human
cagcuucccgaguagcugggg

SEQ ID NO: 606736 - RNA, 24 nt, Human
caguagagacgggguuucuccaug

SEQ ID NO: 606737 - RNA, 24 nt, Human
cauuccagccugggcaacaagagu

SEQ ID NO: 606738 - RNA, 25 nt, Human
cauuccagccugggcaacaagagug

SEQ ID NO: 606739 - RNA, 22 nt, Human
ccaaaaaaaaaaaaaaaaaaaa

SEQ ID NO: 606740 - RNA, 23 nt, Human
ccaaaaaaaaaaaaaaaaaaaaa

SEQ ID NO: 606741 - RNA, 18 nt, Human
ccaaaggccucuggacug

SEQ ID NO: 606742 - RNA, 23 nt, Human
ccaaagugcugggauuacaggca

SEQ ID NO: 606743 - RNA, 24 nt, Human
ccaaagugcugggauuacaggcau

SEQ ID NO: 606744 - RNA, 20 nt, Human
ccacugcauuccagccuggg

SEQ ID NO: 606745 - RNA, 20 nt, Human
ccacugcauuccagccuggg

SEQ ID NO: 606746 - RNA, 21 nt, Human
ccacugcauuccagccugggc

SEQ ID NO: 606747 - RNA, 23 nt, Human
ccacugcauuccagccugggcaa

SEQ ID NO: 606748 - RNA, 24 nt, Human
ccacugcauuccagccugggcaac

SEQ ID NO: 606749 - RNA, 19 nt, Human
ccaugguggucaggcuggu

SEQ ID NO: 606750 - RNA, 23 nt, Human
ccaugguggucaggcuggucucg

SEQ ID NO: 606751 - RNA, 18 nt, Human
cccaaaaaaaaaaaaaaa

SEQ ID NO: 606752 - RNA, 24 nt, Human
cccaaagugcugggauuacaggca

SEQ ID NO: 606753 - RNA, 18 nt, Human
ccccggccccagcugcuc

SEQ ID NO: 606754 - RNA, 23 nt, Human
cccgaguagcugggguuacaggc

SEQ ID NO: 606755 - RNA, 24 nt, Human
cccgaguagcugggguuacaggca

SEQ ID NO: 606756 - RNA, 22 nt, Human
cccguaaucccagcacuuuggg

SEQ ID NO: 606757 - RNA, 22 nt, Human
cccgucucuauuaaaaauacaa

SEQ ID NO: 606758 - RNA, 23 nt, Human
ccgaguagcugggguuacaggca

SEQ ID NO: 606759 - RNA, 24 nt, Human
ccgaguagcugggguuacaggcau

SEQ ID NO: 606760 - RNA, 18 nt, Human
ccgugagccgagaucgug

SEQ ID NO: 606761 - RNA, 24 nt, Human
ccuaccucagcuucccgaguagcu

SEQ ID NO: 606762 - RNA, 24 nt, Human
ccucccggcuucaagagauucucc

SEQ ID NO: 606763 - RNA, 23 nt, Human
ccugaccucaggugauccaccca

SEQ ID NO: 606764 - RNA, 24 nt, Human
ccugaccucaggugauccacccau

SEQ ID NO: 606765 - RNA, 22 nt, Human
ccuggccaacguggugaaaccc

SEQ ID NO: 606766 - RNA, 23 nt, Human
ccuggccaacguggugaaacccg

SEQ ID NO: 606767 - RNA, 19 nt, Human
ccuguaaucccagccacuc

SEQ ID NO: 606768 - RNA, 24 nt, Human
cgagaucgugccacugcauuccag

SEQ ID NO: 606769 - RNA, 19 nt, Human
cgaggcggguggaucaccu

SEQ ID NO: 606770 - RNA, 20 nt, Human
cgaggcggguggaucaccug

SEQ ID NO: 606771 - RNA, 22 nt, Human
cgccccaaaaaaaaaaaaaaaa

SEQ ID NO: 606772 - RNA, 23 nt, Human
cgcccguaaucccagcacuuugg

SEQ ID NO: 606773 - RNA, 27 nt, Human
cgcccguaaucccagcacuuugggaag

SEQ ID NO: 606774 - RNA, 24 nt, Human
cggguggaucaccugacgucagga

SEQ ID NO: 606775 - RNA, 22 nt, Human
cucacgcccguaaucccagcac

SEQ ID NO: 606776 - RNA, 24 nt, Human
cucacgcccguaaucccagcacuu

SEQ ID NO: 606777 - RNA, 24 nt, Human
cucagcuucccgaguagcuggggu

SEQ ID NO: 606778 - RNA, 24 nt, Human
cucaggugauccacccaucuuggc

SEQ ID NO: 606779 - RNA, 24 nt, Human
cuccaugguggucaggcuggucuc

SEQ ID NO: 606780 - RNA, 19 nt, Human
cuccgccccaaaaaaaaaa

SEQ ID NO: 606781 - RNA, 24 nt, Human
cuccgccccaaaaaaaaaaaaaaa

SEQ ID NO: 606782 - RNA, 23 nt, Human
cucggagcccuaacucucccgga

SEQ ID NO: 606783 - RNA, 18 nt, Human
cucuuguugcccaggcug

SEQ ID NO: 606784 - RNA, 18 nt, Human
cuucuugacccugccuug

SEQ ID NO: 606785 - RNA, 24 nt, Human
cuugacccugccuuggcuguuggg

SEQ ID NO: 606786 - RNA, 24 nt, Human
cuuguugcccaggcuggagugcag

SEQ ID NO: 606787 - RNA, 23 nt, Human
gaccucaggugauccacccaucu

SEQ ID NO: 606788 - RNA, 23 nt, Human
gagacgggguuucuccauggugg

SEQ ID NO: 606789 - RNA, 25 nt, Human
gaggcggguggaucaccugacguca

SEQ ID NO: 606790 - RNA, 24 nt, Human
gaguagcugggguuacaggcaugc

SEQ ID NO: 606791 - RNA, 18 nt, Human
gaucaccugacgucagga

SEQ ID NO: 606792 - RNA, 24 nt, Human
gaucaccugacgucaggaguacaa

SEQ ID NO: 606793 - RNA, 18 nt, Human
gauuacaggcaucagcca

SEQ ID NO: 606794 - RNA, 22 nt, Human
gauuacaggcaucagccacugc

SEQ ID NO: 606795 - RNA, 22 nt, Human
gauuacaggcaucagccacugc

SEQ ID NO: 606796 - RNA, 23 nt, Human
gcaccaccacaaugcccggcuaa

SEQ ID NO: 606797 - RNA, 23 nt, Human
gccaacguggugaaacccgucuc

SEQ ID NO: 606798 - RNA, 22 nt, Human
gccacugcauuccagccugggc

SEQ ID NO: 606799 - RNA, 24 nt, Human
gccacugcauuccagccugggcaa

SEQ ID NO: 606800 - RNA, 19 nt, Human
gcccaggcuggagugcagu

SEQ ID NO: 606801 - RNA, 20 nt, Human
gccgagaucgugccacugca

SEQ ID NO: 606802 - RNA, 19 nt, Human
gcuggagugcaguggcgcg

SEQ ID NO: 606803 - RNA, 23 nt, Human
gcuggucucgaacuccugaccuc

SEQ ID NO: 606804 - RNA, 22 nt, Human
ggauuacaggcaucagccacug

SEQ ID NO: 606805 - RNA, 21 nt, Human
ggcggaugccuguaaucccag

SEQ ID NO: 606806 - RNA, 21 nt, Human
ggcucacgcccguaaucccag

SEQ ID NO: 606807 - RNA, 24 nt, Human
ggcuggucucgaacuccugaccuc

SEQ ID NO: 606808 - RNA, 24 nt, Human
gggcaugguggcggaugccuguaa

SEQ ID NO: 606809 - RNA, 24 nt, Human
ggggguugccgugagccgagaucg

SEQ ID NO: 606810 - RNA, 23 nt, Human
gggguugccgugagccgagaucg

SEQ ID NO: 606811 - RNA, 24 nt, Human
ggguggaucaccugacgucaggag

SEQ ID NO: 606812 - RNA, 19 nt, Human
ggucucgaacuccugaccu

SEQ ID NO: 606813 - RNA, 24 nt, Human
gguggcggaugccuguaaucccag

SEQ ID NO: 606814 - RNA, 18 nt, Human
guagcugggguuacaggc

SEQ ID NO: 606815 - RNA, 20 nt, Human
guagcugggguuacaggcau

SEQ ID NO: 606816 - RNA, 24 nt, Human
gugauccacccaucuuggccuccc

SEQ ID NO: 606817 - RNA, 23 nt, Human
guggcucacgcccguaaucccag

SEQ ID NO: 606818 - RNA, 20 nt, Human
guggucaggcuggucucgaa

SEQ ID NO: 606819 - RNA, 21 nt, Human
uaaaaauacaaaaacuagccg

SEQ ID NO: 606820 - RNA, 19 nt, Human
uaaguccuggguccaggcc

SEQ ID NO: 606821 - RNA, 23 nt, Human
uaauuuuguauuuucaguagaga

SEQ ID NO: 606822 - RNA, 24 nt, Human
uacaagaccagccuggccaacgug

SEQ ID NO: 606823 - RNA, 22 nt, Human
uacaggcaucagccacugcgcc

SEQ ID NO: 606824 - RNA, 24 nt, Human
uaccucagcuucccgaguagcugg

SEQ ID NO: 606825 - RNA, 24 nt, Human
ucaccacaacuuccgccucccggc

SEQ ID NO: 606826 - RNA, 27 nt, Human
ucaccacaacuuccgccucccggcuuc

SEQ ID NO: 606827 - RNA, 22 nt, Human
ucacucuuguugcccaggcugg

SEQ ID NO: 606828 - RNA, 23 nt, Human
ucacucuuguugcccaggcugga

SEQ ID NO: 606829 - RNA, 20 nt, Human
ucagcuucccgaguagcugg

SEQ ID NO: 606830 - RNA, 24 nt, Human
ucaguagagacgggguuucuccau

SEQ ID NO: 606831 - RNA, 20 nt, Human
uccagccugggcaacaagag

SEQ ID NO: 606832 - RNA, 20 nt, Human
uccaggccaaaggaggaccc

SEQ ID NO: 606833 - RNA, 24 nt, Human
ucccaaagugcugggauuacaggc

SEQ ID NO: 606834 - RNA, 24 nt, Human
ucccgaguagcugggguuacaggc

SEQ ID NO: 606835 - RNA, 24 nt, Human
ucccggcuucaagagauucuccug

SEQ ID NO: 606836 - RNA, 23 nt, Human
uccgccccaaaaaaaaaaaaaaa

SEQ ID NO: 606837 - RNA, 25 nt, Human
uccgccccaaaaaaaaaaaaaaaaa

SEQ ID NO: 606838 - RNA, 23 nt, Human
ucgugccacugcauuccagccug

SEQ ID NO: 606839 - RNA, 23 nt, Human
ucucgaacuccugaccucaggug

SEQ ID NO: 606840 - RNA, 21 nt, Human
ucucuauuaaaaauacaaaaa

SEQ ID NO: 606841 - RNA, 24 nt, Human
ucuugacccugccuuggcuguugg

SEQ ID NO: 606842 - RNA, 20 nt, Human
ucuuggccucccaaagugcu

SEQ ID NO: 606843 - RNA, 22 nt, Human
ucuuguugcccaggcuggagug

SEQ ID NO: 606844 - RNA, 21 nt, Human
ugaccucaggugauccaccca

SEQ ID NO: 606845 - RNA, 24 nt, Human
ugaccucaggugauccacccaucu

SEQ ID NO: 606846 - RNA, 22 nt, Human
ugagccgagaucgugccacugc

SEQ ID NO: 606847 - RNA, 24 nt, Human
ugaggcaggagaauugcuugaacc

SEQ ID NO: 606848 - RNA, 25 nt, Human
ugaggcaggagaauugcuugaaccc

SEQ ID NO: 606849 - RNA, 24 nt, Human
ugauccacccaucuuggccuccca

SEQ ID NO: 606850 - RNA, 18 nt, Human
ugcccaggcuggagugca

SEQ ID NO: 606851 - RNA, 21 nt, Human
ugcccaggcuggagugcagug

SEQ ID NO: 606852 - RNA, 22 nt, Human
ugcccaggcuggagugcagugg

SEQ ID NO: 606853 - RNA, 24 nt, Human
ugcccaggcuggagugcaguggcg

SEQ ID NO: 606854 - RNA, 23 nt, Human
ugcccggcuaauuuuguauuuuc

SEQ ID NO: 606855 - RNA, 23 nt, Human
ugccgugagccgagaucgugcca

SEQ ID NO: 606856 - RNA, 19 nt, Human
ugccuugggccgagcacgg

SEQ ID NO: 606857 - RNA, 20 nt, Human
ugcugggauuacaggcauca

SEQ ID NO: 606858 - RNA, 23 nt, Human
uggagugcaguggcgcgaucucg

SEQ ID NO: 606859 - RNA, 24 nt, Human
uggagugcaguggcgcgaucucgg

SEQ ID NO: 606860 - RNA, 19 nt, Human
uggaucaccugacgucagg

SEQ ID NO: 606861 - RNA, 27 nt, Human
uggaucaccugacgucaggaguacaag

SEQ ID NO: 606862 - RNA, 23 nt, Human
uggccaacguggugaaacccguc

SEQ ID NO: 606863 - RNA, 24 nt, Human
uggcgcgaucucggcucaccacaa

SEQ ID NO: 606864 - RNA, 22 nt, Human
uggcucacgcccguaaucccag

SEQ ID NO: 606865 - RNA, 24 nt, Human
uggcucacgcccguaaucccagca

SEQ ID NO: 606866 - RNA, 24 nt, Human
ugggaagccgaggcggguggauca

SEQ ID NO: 606867 - RNA, 21 nt, Human
ugggauuacaggcaucagcca

SEQ ID NO: 606868 - RNA, 22 nt, Human
ugggauuacaggcaucagccac

SEQ ID NO: 606869 - RNA, 22 nt, Human
ugggauuacaggcaucagccac

SEQ ID NO: 606870 - RNA, 24 nt, Human
ugggauuacaggcaucagccacug

SEQ ID NO: 606871 - RNA, 24 nt, Human
ugggauuacaggcaucagccacug

SEQ ID NO: 606872 - RNA, 21 nt, Human
ugggguuacaggcaugcacca

SEQ ID NO: 606873 - RNA, 24 nt, Human
ugggguuacaggcaugcaccacca

SEQ ID NO: 606874 - RNA, 24 nt, Human
uggucaggcuggucucgaacuccu

SEQ ID NO: 606875 - RNA, 24 nt, Human
ugguggcggaugccuguaauccca

SEQ ID NO: 606876 - RNA, 18 nt, Human
uucaagagauucuccugc

SEQ ID NO: 606877 - RNA, 24 nt, Human
uucacucuuguugcccaggcugga

SEQ ID NO: 606878 - RNA, 24 nt, Human
uugcccaggcuggagugcaguggc

SEQ ID NO: 606879 - RNA, 22 nt, Human
uugccgugagccgagaucgugc

SEQ ID NO: 606880 - RNA, 23 nt, Human
uugcuugaacccgggaagcgggg

SEQ ID NO: 606881 - RNA, 24 nt, Human
uugggccgagcacgguggcucacg

SEQ ID NO: 606882 - RNA, 24 nt, Human
uuucacucuuguugcccaggcugg

SEQ ID NO: 606883 - RNA, 20 nt, Human
uuuuguauuuucaguagaga

SEQ ID NO: 606884 - RNA, 19 nt, Human
aaaugaaugcuagcacaug

SEQ ID NO: 606885 - RNA, 23 nt, Human
agaccucuuucuucucuccacuu

SEQ ID NO: 606886 - RNA, 22 nt, Human
agcauuuagaccucuuucuucu

SEQ ID NO: 606887 - RNA, 22 nt, Human
agcugcugacacaaauugaaca

SEQ ID NO: 606888 - RNA, 27 nt, Human
auuuagaccucuuucuucucuccacuu

SEQ ID NO: 606889 - RNA, 20 nt, Human
caccuggcucccgcccccgc

SEQ ID NO: 606890 - RNA, 24 nt, Human
cacguaaaaagcccaccagucaag

SEQ ID NO: 606891 - RNA, 20 nt, Human
cacuccaaaucacauuccau

SEQ ID NO: 606892 - RNA, 26 nt, Human
cagccacuuccugcucggugcccggg

SEQ ID NO: 606893 - RNA, 23 nt, Human
ccauccuucucagcauuuagacc

SEQ ID NO: 606894 - RNA, 24 nt, Human
ccccgcccuguugcaccgcgagga

SEQ ID NO: 606895 - RNA, 19 nt, Human
ccucccggggccguccagc

SEQ ID NO: 606896 - RNA, 21 nt, Human
cgaggcgggcgcgccgaggcc

SEQ ID NO: 606897 - RNA, 20 nt, Human
cucccgcccccgcgcggccg

SEQ ID NO: 606898 - RNA, 26 nt, Human
cugcauuguuccuauuuuaguacaug

SEQ ID NO: 606899 - RNA, 18 nt, Human
gagcagccgggcucugag

SEQ ID NO: 606900 - RNA, 21 nt, Human
gaggcgggcgcgccgaggcca

SEQ ID NO: 606901 - RNA, 19 nt, Human
gccuggccgggcgcugccu

SEQ ID NO: 606902 - RNA, 18 nt, Human
gcggccgccuccccgccc

SEQ ID NO: 606903 - RNA, 19 nt, Human
gcugcggccgccuccccgc

SEQ ID NO: 606904 - RNA, 20 nt, Human
ggcggucugcggccucccgg

SEQ ID NO: 606905 - RNA, 20 nt, Human
gggaaaggacugaaaugaau

SEQ ID NO: 606906 - RNA, 23 nt, Human
guccaggguguggggaacacucc

SEQ ID NO: 606907 - RNA, 21 nt, Human
uaacaggccaacagccauccu

SEQ ID NO: 606908 - RNA, 21 nt, Human
uaaucacuagggagaggucca

SEQ ID NO: 606909 - RNA, 20 nt, Human
uacacguaaaaagcccacca

SEQ ID NO: 606910 - RNA, 19 nt, Human
uaggugcucccagccuggc

SEQ ID NO: 606911 - RNA, 21 nt, Human
uccccgauuguccauagacgc

SEQ ID NO: 606912 - RNA, 22 nt, Human
uccccgauuguccauagacgcu

SEQ ID NO: 606913 - RNA, 18 nt, Human
uccggcucgggcugcggc

SEQ ID NO: 606914 - RNA, 20 nt, Human
uccggcucgggcugcggccg

SEQ ID NO: 606915 - RNA, 23 nt, Human
ucgcucccggcgcucgggcuccg

SEQ ID NO: 606916 - RNA, 25 nt, Human
ucuuuugggagugagguuguggggc

SEQ ID NO: 606917 - RNA, 24 nt, Human
ugacuugcaauucuaacuuaguac

SEQ ID NO: 606918 - RNA, 21 nt, Human
ugaggugggggaaaggacuga

SEQ ID NO: 606919 - RNA, 24 nt, Human
ugaggugggggaaaggacugaaau

SEQ ID NO: 606920 - RNA, 23 nt, Human
ugauagcauuaguuuucagaaaa

SEQ ID NO: 606921 - RNA, 22 nt, Human
ugcccgggcgaggcgggcgcgc

SEQ ID NO: 606922 - RNA, 18 nt, Human
ugggagaagccaccuaug

SEQ ID NO: 606923 - RNA, 19 nt, Human
uuagaccucuuucuucucu

SEQ ID NO: 606924 - RNA, 24 nt, Human
uuaguacaugggcuacugaaacaa

SEQ ID NO: 606925 - RNA, 26 nt, Human
uugaaaggugagauuuuuauagggag

SEQ ID NO: 606926 - RNA, 20 nt, Human
aauuccugugccugcacuca

SEQ ID NO: 606927 - RNA, 22 nt, Human
aauucucuggacugcacugacu

SEQ ID NO: 606928 - RNA, 20 nt, Human
agugaaauaaacucuaggcu

SEQ ID NO: 606929 - RNA, 20 nt, Human
caacgagaaaaucuucccuu

SEQ ID NO: 606930 - RNA, 23 nt, Human
caauuccugugccugcacucaga

SEQ ID NO: 606931 - RNA, 19 nt, Human
caucuggaugauggugauu

SEQ ID NO: 606932 - RNA, 24 nt, Human
ccuuucucacagcugcuuuccucg

SEQ ID NO: 606933 - RNA, 19 nt, Human
cucggccaccaccucucca

SEQ ID NO: 606934 - RNA, 23 nt, Human
cucucggccaccaccucuccauc

SEQ ID NO: 606935 - RNA, 23 nt, Human
cugaaucaugaacaguaauugag

SEQ ID NO: 606936 - RNA, 28 nt, Human
cugacagccuuucucacagcugcuuucc

SEQ ID NO: 606937 - RNA, 20 nt, Human
cuuucucacagcugcuuucc

SEQ ID NO: 606938 - RNA, 24 nt, Human
gccaaaccauacuucaccagaucc

SEQ ID NO: 606939 - RNA, 21 nt, Human
gcgucagcugcaaacugcugc

SEQ ID NO: 606940 - RNA, 18 nt, Human
gcugcucuccuggcugca

SEQ ID NO: 606941 - RNA, 18 nt, Human
ggcaauuguaaauugcca

SEQ ID NO: 606942 - RNA, 18 nt, Human
gguaauaauucaauaaac

SEQ ID NO: 606943 - RNA, 19 nt, Human
ggugauuguugucguggau

SEQ ID NO: 606944 - RNA, 18 nt, Human
uaccacaucagccaaacc

SEQ ID NO: 606945 - RNA, 25 nt, Human
uaccacaucagccaaaccauacuuc

SEQ ID NO: 606946 - RNA, 21 nt, Human
uagcaaaaacucaucuacaua

SEQ ID NO: 606947 - RNA, 22 nt, Human
uagguugauaucaaccaaucga

SEQ ID NO: 606948 - RNA, 23 nt, Human
ucagaccaacucgagcacaaccc

SEQ ID NO: 606949 - RNA, 22 nt, Human
ucaucuggaugauggugauugu

SEQ ID NO: 606950 - RNA, 21 nt, Human
uccaucuugaguggucugaga

SEQ ID NO: 606951 - RNA, 22 nt, Human
ucuccuggcugcagaucuugcc

SEQ ID NO: 606952 - RNA, 20 nt, Human
ucucuggacugcacugacuc

SEQ ID NO: 606953 - RNA, 24 nt, Human
ucuucccuuuuguuuacuuggguu

SEQ ID NO: 606954 - RNA, 21 nt, Human
ugaaacaccaauuccugugcc

SEQ ID NO: 606955 - RNA, 20 nt, Human
ugaacaguaauugagguugg

SEQ ID NO: 606956 - RNA, 18 nt, Human
ugaaucaugaacaguaau

SEQ ID NO: 606957 - RNA, 22 nt, Human
ugaccugacagccuuucucaca

SEQ ID NO: 606958 - RNA, 18 nt, Human
ugacugcuuucaucccua

SEQ ID NO: 606959 - RNA, 20 nt, Human
ugaugaaacaccaauuccug

SEQ ID NO: 606960 - RNA, 18 nt, Human
uggaguucugguugcuaa

SEQ ID NO: 606961 - RNA, 23 nt, Human
uggccaaaagaguccagcuucaa

SEQ ID NO: 606962 - RNA, 21 nt, Human
uggcccaucugaugggaguug

SEQ ID NO: 606963 - RNA, 22 nt, Human
uggcugugagcuggaguauuau

SEQ ID NO: 606964 - RNA, 20 nt, Human
uguagcaaaaacucaucuac

SEQ ID NO: 606965 - RNA, 23 nt, Human
uuaucgucauuguuggaguucug

SEQ ID NO: 606966 - RNA, 21 nt, Human
uucaucccuauaucagugaug

SEQ ID NO: 606967 - RNA, 25 nt, Human
uucucuggacugcacugacucucca

SEQ ID NO: 606968 - RNA, 20 nt, Human
uuggaguucugguugcuaac

SEQ ID NO: 606969 - RNA, 19 nt, Human
uuggcauuguuauucuggg

SEQ ID NO: 606970 - RNA, 21 nt, Human
aaccgagcagccucaacgaga

SEQ ID NO: 606971 - RNA, 21 nt, Human
aggggagggcuaugcgguccu

SEQ ID NO: 606972 - RNA, 23 nt, Human
aggggagggguguagacaguuaa

SEQ ID NO: 606973 - RNA, 19 nt, Human
cacuucuuccuucauccug

SEQ ID NO: 606974 - RNA, 19 nt, Human
ccaaacacacacugaggac

SEQ ID NO: 606975 - RNA, 21 nt, Human
ccacaaccgagcagccucaac

SEQ ID NO: 606976 - RNA, 20 nt, Human
ccacagauucuaagucuuca

SEQ ID NO: 606977 - RNA, 21 nt, Human
ccagagccagcguuucuggcc

SEQ ID NO: 606978 - RNA, 23 nt, Human
ccaggcaccuagccgcauaagau

SEQ ID NO: 606979 - RNA, 20 nt, Human
ccaucaacuucugucuucuc

SEQ ID NO: 606980 - RNA, 20 nt, Human
cccuaaaauucacauugcac

SEQ ID NO: 606981 - RNA, 23 nt, Human
ccucuugcuguuacuucccaggc

SEQ ID NO: 606982 - RNA, 25 nt, Human
cuaaaauucacauugcacuuuguac

SEQ ID NO: 606983 - RNA, 22 nt, Human
cuggccacaaccgagcagccuc

SEQ ID NO: 606984 - RNA, 21 nt, Human
gaaauguccguccacauucuc

SEQ ID NO: 606985 - RNA, 19 nt, Human
gacauuaagauggcgaaag

SEQ ID NO: 606986 - RNA, 25 nt, Human
gaggugcuucuucucccuaaaauuc

SEQ ID NO: 606987 - RNA, 22 nt, Human
gccacaaccgagcagccucaac

SEQ ID NO: 606988 - RNA, 21 nt, Human
gccucaacgagagggguuggu

SEQ ID NO: 606989 - RNA, 23 nt, Human
ggaggggagggcuaugcgguccu

SEQ ID NO: 606990 - RNA, 19 nt, Human
ggggaggggagggcuaugc

SEQ ID NO: 606991 - RNA, 25 nt, Human
ggggggaggggagggcuaugcgguc

SEQ ID NO: 606992 - RNA, 26 nt, Human
uagcaggugacucagaaucacucucu

SEQ ID NO: 606993 - RNA, 18 nt, Human
uaugccuguggaggugcu

SEQ ID NO: 606994 - RNA, 19 nt, Human
uaugccuguggaggugcuu

SEQ ID NO: 606995 - RNA, 25 nt, Human
uauuugaaagaaaagugcuaguaug

SEQ ID NO: 606996 - RNA, 23 nt, Human
ucaacgagagggguuggugacug

SEQ ID NO: 606997 - RNA, 20 nt, Human
ucaguugauucaggcuucac

SEQ ID NO: 606998 - RNA, 23 nt, Human
uccacagauucuaagucuucauc

SEQ ID NO: 606999 - RNA, 19 nt, Human
ucuucacagcaguaguacc

SEQ ID NO: 607000 - RNA, 20 nt, Human
uguaaucgugcacuucuucc

SEQ ID NO: 607001 - RNA, 24 nt, Human
ugucuucucuccuggugaauaauc

SEQ ID NO: 607002 - RNA, 18 nt, Human
ugugcaaugccucgaugg

SEQ ID NO: 607003 - RNA, 23 nt, Human
uguggaggugcuucuucucccua

SEQ ID NO: 607004 - RNA, 23 nt, Human
uguugcacaaauguuuuagggca

SEQ ID NO: 607005 - RNA, 21 nt, Human
uucccaggcaccuagccgcau

SEQ ID NO: 607006 - RNA, 22 nt, Human
uucugugagucuacugcuugua

SEQ ID NO: 607007 - RNA, 18 nt, Human
uuuaucuuuuucaugggu

SEQ ID NO: 607008 - RNA, 23 nt, Human
uuuaucuuuuucauggguuuuag

SEQ ID NO: 607009 - RNA, 23 nt, Human
aaaaauugggagaaaauagacaa

SEQ ID NO: 607010 - RNA, 19 nt, Human
aaagugcugggauuacagg

SEQ ID NO: 607011 - RNA, 24 nt, Human
aaagugcugggauuacaggugcga

SEQ ID NO: 607012 - RNA, 20 nt, Human
aaccuccgccuccgaggcuc

SEQ ID NO: 607013 - RNA, 25 nt, Human
aagcacagaaaaaggcauacugugc

SEQ ID NO: 607014 - RNA, 25 nt, Human
aagcgauccucccaccucagucucc

SEQ ID NO: 607015 - RNA, 18 nt, Human
aagugcugggauuacagg

SEQ ID NO: 607016 - RNA, 19 nt, Human
aagugcugggauuacaggu

SEQ ID NO: 607017 - RNA, 26 nt, Human
aagugcugggauuacaggugcgagcc

SEQ ID NO: 607018 - RNA, 23 nt, Human
aauaaauucaaacaagcuugagc

SEQ ID NO: 607019 - RNA, 18 nt, Human
aauagacaacaacaagac

SEQ ID NO: 607020 - RNA, 22 nt, Human
aauuucaaaaaaaaauugggag

SEQ ID NO: 607021 - RNA, 19 nt, Human
acacuuugaccuugggcuu

SEQ ID NO: 607022 - RNA, 19 nt, Human
acagaaaaaggcauacugu

SEQ ID NO: 607023 - RNA, 18 nt, Human
acaggguuuugccauguu

SEQ ID NO: 607024 - RNA, 19 nt, Human
acaggguuuugccauguug

SEQ ID NO: 607025 - RNA, 24 nt, Human
acaggguuuugccauguuguccag

SEQ ID NO: 607026 - RNA, 21 nt, Human
accacaggugugugccaccau

SEQ ID NO: 607027 - RNA, 24 nt, Human
acuccagccuaggugacagaguga

SEQ ID NO: 607028 - RNA, 24 nt, Human
acugcacuccagccuaggugacag

SEQ ID NO: 607029 - RNA, 26 nt, Human
acugcacuccagccuaggugacagag

SEQ ID NO: 607030 - RNA, 18 nt, Human
acuguguuugggaacugg

SEQ ID NO: 607031 - RNA, 26 nt, Human
agaaaauagacaacaacaagacaaaa

SEQ ID NO: 607032 - RNA, 18 nt, Human
agacaggguuuugccaug

SEQ ID NO: 607033 - RNA, 19 nt, Human
agagacaggguuuugccau

SEQ ID NO: 607034 - RNA, 21 nt, Human
agagacaggguuuugccaugu

SEQ ID NO: 607035 - RNA, 18 nt, Human
agcacaguccucuggcuu

SEQ ID NO: 607036 - RNA, 24 nt, Human
agccuaggugacagagugaggcuc

SEQ ID NO: 607037 - RNA, 20 nt, Human
agcuagccacucgcagcaca

SEQ ID NO: 607038 - RNA, 20 nt, Human
aggcaggaggaugacuggaa

SEQ ID NO: 607039 - RNA, 24 nt, Human
aggcaggaggaugacuggaaucug

SEQ ID NO: 607040 - RNA, 24 nt, Human
aguaccggggcagugagggaggga

SEQ ID NO: 607041 - RNA, 23 nt, Human
aguagcugggaccacaggugugu

SEQ ID NO: 607042 - RNA, 25 nt, Human
aguagcugggaccacaggugugugc

SEQ ID NO: 607043 - RNA, 21 nt, Human
aguccuugaauagcacagucc

SEQ ID NO: 607044 - RNA, 19 nt, Human
agucuugugaaaggagugg

SEQ ID NO: 607045 - RNA, 21 nt, Human
aucuaaacuggcuuugcagaa

SEQ ID NO: 607046 - RNA, 20 nt, Human
auugcaccacugcacuccag

SEQ ID NO: 607047 - RNA, 24 nt, Human
caaagugcugggauuacaggugcg

SEQ ID NO: 607048 - RNA, 20 nt, Human
caagcgauccucccaccuca

SEQ ID NO: 607049 - RNA, 27 nt, Human
caagcgauccucccaccucagucuccu

SEQ ID NO: 607050 - RNA, 24 nt, Human
caagcgaucugccugccucagccc

SEQ ID NO: 607051 - RNA, 26 nt, Human
caccacugcacuccagccuaggugac

SEQ ID NO: 607052 - RNA, 24 nt, Human
caccaugccuggcuaauuuuugua

SEQ ID NO: 607053 - RNA, 23 nt, Human
caccucagucuccugaguagcug

SEQ ID NO: 607054 - RNA, 24 nt, Human
caccucagucuccugaguagcugg

SEQ ID NO: 607055 - RNA, 22 nt, Human
cacuccagccuaggugacagag

SEQ ID NO: 607056 - RNA, 22 nt, Human
cacuccagccuaggugacagag

SEQ ID NO: 607057 - RNA, 24 nt, Human
cacuccagccuaggugacagagug

SEQ ID NO: 607058 - RNA, 19 nt, Human
cacugcacuccagccuagg

SEQ ID NO: 607059 - RNA, 19 nt, Human
cacugcacuccagccuagg

SEQ ID NO: 607060 - RNA, 23 nt, Human
cacugcacuccagccuaggugac

SEQ ID NO: 607061 - RNA, 25 nt, Human
cacugcacuccagccuaggugacag

SEQ ID NO: 607062 - RNA, 18 nt, Human
cacuuguuuuuuccuauu

SEQ ID NO: 607063 - RNA, 24 nt, Human
caggguuuugccauguuguccagg

SEQ ID NO: 607064 - RNA, 25 nt, Human
caggugugugccaccaugccuggcu

SEQ ID NO: 607065 - RNA, 20 nt, Human
cagucuccugaguagcuggg

SEQ ID NO: 607066 - RNA, 24 nt, Human
cauguuguccaggcuggucuugaa

SEQ ID NO: 607067 - RNA, 20 nt, Human
cauugcaccuggccuaacaa

SEQ ID NO: 607068 - RNA, 21 nt, Human
ccaaagugcugggauuacagg

SEQ ID NO: 607069 - RNA, 21 nt, Human
ccaaagugcugggauuacagg

SEQ ID NO: 607070 - RNA, 22 nt, Human
ccaaagugcugggauuacaggu

SEQ ID NO: 607071 - RNA, 19 nt, Human
ccacugcacuccagccuag

SEQ ID NO: 607072 - RNA, 20 nt, Human
ccacugcacuccagccuagg

SEQ ID NO: 607073 - RNA, 20 nt, Human
ccacugcacuccagccuagg

SEQ ID NO: 607074 - RNA, 21 nt, Human
ccacugcacuccagccuaggu

SEQ ID NO: 607075 - RNA, 24 nt, Human
ccacugcacuccagccuaggugac

SEQ ID NO: 607076 - RNA, 25 nt, Human
ccacugcacuccagccuaggugaca

SEQ ID NO: 607077 - RNA, 25 nt, Human
ccagggcgaaggucggggccgagaa

SEQ ID NO: 607078 - RNA, 19 nt, Human
ccauguuguccaggcuggu

SEQ ID NO: 607079 - RNA, 21 nt, Human
ccauguuguccaggcuggucu

SEQ ID NO: 607080 - RNA, 21 nt, Human
ccauguuguccaggcuggucu

SEQ ID NO: 607081 - RNA, 24 nt, Human
cccaccucagucuccugaguagcu

SEQ ID NO: 607082 - RNA, 18 nt, Human
cccagggcucugcccagc

SEQ ID NO: 607083 - RNA, 23 nt, Human
ccccaaagugcugggauuacagg

SEQ ID NO: 607084 - RNA, 18 nt, Human
ccccagggcucugcccag

SEQ ID NO: 607085 - RNA, 23 nt, Human
cccuguggucccagcuucuuggg

SEQ ID NO: 607086 - RNA, 22 nt, Human
ccuaggugacagagugaggcuc

SEQ ID NO: 607087 - RNA, 24 nt, Human
ccucccaccucagucuccugagua

SEQ ID NO: 607088 - RNA, 19 nt, Human
ccucgacacagcgccccuc

SEQ ID NO: 607089 - RNA, 22 nt, Human
ccucgacacagcgccccucccg

SEQ ID NO: 607090 - RNA, 21 nt, Human
ccugagcucaagcgaucugcc

SEQ ID NO: 607091 - RNA, 22 nt, Human
ccuguggucccagcuucuuggg

SEQ ID NO: 607092 - RNA, 25 nt, Human
ccuguggucccagcuucuugggugg

SEQ ID NO: 607093 - RNA, 23 nt, Human
cgcagugguacaaucucagcuca

SEQ ID NO: 607094 - RNA, 23 nt, Human
cgcgcccccagggcucugcccag

SEQ ID NO: 607095 - RNA, 24 nt, Human
cucaagcgauccucccaccucagu

SEQ ID NO: 607096 - RNA, 21 nt, Human
cucagccccccaaagugcugg

SEQ ID NO: 607097 - RNA, 24 nt, Human
cucagucuccugaguagcugggac

SEQ ID NO: 607098 - RNA, 24 nt, Human
cuccugaguagcugggaccacagg

SEQ ID NO: 607099 - RNA, 22 nt, Human
cugcagugagccauaauugcac

SEQ ID NO: 607100 - RNA, 22 nt, Human
cuuaaaaugcacaaaggagcuc

SEQ ID NO: 607101 - RNA, 23 nt, Human
gacacagcgccccucccggcacc

SEQ ID NO: 607102 - RNA, 19 nt, Human
gacaggguuuugccauguu

SEQ ID NO: 607103 - RNA, 23 nt, Human
gacaggguuuugccauguugucc

SEQ ID NO: 607104 - RNA, 18 nt, Human
gagacaaggucucaccau

SEQ ID NO: 607105 - RNA, 24 nt, Human
gagcucaagcgaucugccugccuc

SEQ ID NO: 607106 - RNA, 18 nt, Human
gauuacaggugcgagcca

SEQ ID NO: 607107 - RNA, 18 nt, Human
gauuacaggugcgagcca

SEQ ID NO: 607108 - RNA, 23 nt, Human
gauuacaggugcgagccauugca

SEQ ID NO: 607109 - RNA, 20 nt, Human
gcaaccuccgccuccgaggc

SEQ ID NO: 607110 - RNA, 24 nt, Human
gcacuccagccuaggugacagagu

SEQ ID NO: 607111 - RNA, 25 nt, Human
gcagaacauacuguggacuuccccc

SEQ ID NO: 607112 - RNA, 21 nt, Human
gcagggcgcacacacggggcg

SEQ ID NO: 607113 - RNA, 21 nt, Human
gcagugguacaaucucagcuc

SEQ ID NO: 607114 - RNA, 19 nt, Human
gccauguuguccaggcugg

SEQ ID NO: 607115 - RNA, 20 nt, Human
gccauguuguccaggcuggu

SEQ ID NO: 607116 - RNA, 18 nt, Human
gcgaucugccugccucag

SEQ ID NO: 607117 - RNA, 21 nt, Human
gcgaucugccugccucagccc

SEQ ID NO: 607118 - RNA, 20 nt, Human
ggagagacaggguuuugcca

SEQ ID NO: 607119 - RNA, 19 nt, Human
ggagguugaaacugcagug

SEQ ID NO: 607120 - RNA, 18 nt, Human
ggcgaaggucggggccga

SEQ ID NO: 607121 - RNA, 24 nt, Human
ggcuggucuugaacuccugagcuc

SEQ ID NO: 607122 - RNA, 24 nt, Human
guagcugggaccacaggugugugc

SEQ ID NO: 607123 - RNA, 21 nt, Human
gugcauuuucacuuguuuuuu

SEQ ID NO: 607124 - RNA, 23 nt, Human
guuuugccauguuguccaggcug

SEQ ID NO: 607125 - RNA, 24 nt, Human
guuuugccauguuguccaggcugg

SEQ ID NO: 607126 - RNA, 24 nt, Human
uaacuuguaagcggcgaucaacca

SEQ ID NO: 607127 - RNA, 18 nt, Human
uaagccuaaacaaauaaa

SEQ ID NO: 607128 - RNA, 23 nt, Human
uaagugcagggcgcacacacggu

SEQ ID NO: 607129 - RNA, 18 nt, Human
uaauacacuuugaccuug

SEQ ID NO: 607130 - RNA, 22 nt, Human
uaauuuuuguauucuugggaga

SEQ ID NO: 607131 - RNA, 21 nt, Human
uagauguaauaaauucaaaca

SEQ ID NO: 607132 - RNA, 23 nt, Human
uagcugggaccacaggugugugc

SEQ ID NO: 607133 - RNA, 20 nt, Human
ucacugcaaccuccgccucc

SEQ ID NO: 607134 - RNA, 21 nt, Human
ucacugcaaccuccgccuccg

SEQ ID NO: 607135 - RNA, 24 nt, Human
ucacugcaaccuccgccuccgagg

SEQ ID NO: 607136 - RNA, 25 nt, Human
ucacugcaaccuccgccuccgaggc

SEQ ID NO: 607137 - RNA, 26 nt, Human
ucacugcaaccuccgccuccgaggcu

SEQ ID NO: 607138 - RNA, 20 nt, Human
ucagccccccaaagugcugg

SEQ ID NO: 607139 - RNA, 23 nt, Human
ucagucuccugaguagcugggac

SEQ ID NO: 607140 - RNA, 23 nt, Human
uccagccuaggugacagagugag

SEQ ID NO: 607141 - RNA, 24 nt, Human
uccagccuaggugacagagugagg

SEQ ID NO: 607142 - RNA, 22 nt, Human
ucccuguggucccagcuucuug

SEQ ID NO: 607143 - RNA, 23 nt, Human
ucccuguggucccagcuucuugg

SEQ ID NO: 607144 - RNA, 24 nt, Human
uccugaguagcugggaccacaggu

SEQ ID NO: 607145 - RNA, 24 nt, Human
ucucaccaugucacccaguuugga

SEQ ID NO: 607146 - RNA, 23 nt, Human
ucuugaacuccugagcucaagcg

SEQ ID NO: 607147 - RNA, 25 nt, Human
ugaaaauaaugucagcaugggcugu

SEQ ID NO: 607148 - RNA, 20 nt, Human
ugacaaaacggcaggaaaag

SEQ ID NO: 607149 - RNA, 25 nt, Human
ugaggcaggaggaugacuggaaucc

SEQ ID NO: 607150 - RNA, 25 nt, Human
ugaggcaggaggaugacuggaaucu

SEQ ID NO: 607151 - RNA, 19 nt, Human
ugaguaccggggcagugag

SEQ ID NO: 607152 - RNA, 19 nt, Human
ugaucccuguggucccagc

SEQ ID NO: 607153 - RNA, 19 nt, Human
ugcaaugguuucuggaauu

SEQ ID NO: 607154 - RNA, 21 nt, Human
ugcaccacugcacuccagccu

SEQ ID NO: 607155 - RNA, 22 nt, Human
ugcagugagccauaauugcacc

SEQ ID NO: 607156 - RNA, 24 nt, Human
ugccauguuguccaggcuggucuu

SEQ ID NO: 607157 - RNA, 27 nt, Human
ugccauguuguccaggcuggucuugaa

SEQ ID NO: 607158 - RNA, 24 nt, Human
ugccucagccccccaaagugcugg

SEQ ID NO: 607159 - RNA, 28 nt, Human
ugccuggcuaauuuuuguauucuuggga

SEQ ID NO: 607160 - RNA, 24 nt, Human
ugcugggauuacaggugcgagcca

SEQ ID NO: 607161 - RNA, 24 nt, Human
ugcuuuucaucuaaacuggcuuug

SEQ ID NO: 607162 - RNA, 24 nt, Human
uggagcgcagugguacaaucucag

SEQ ID NO: 607163 - RNA, 20 nt, Human
uggccagaaccucccagggc

SEQ ID NO: 607164 - RNA, 19 nt, Human
uggcugaggcaggaggaug

SEQ ID NO: 607165 - RNA, 19 nt, Human
ugggaagagucugacugug

SEQ ID NO: 607166 - RNA, 21 nt, Human
ugggaccacaggugugugcca

SEQ ID NO: 607167 - RNA, 24 nt, Human
ugggaccacaggugugugccacca

SEQ ID NO: 607168 - RNA, 24 nt, Human
ugggagagacaggguuuugccaug

SEQ ID NO: 607169 - RNA, 24 nt, Human
ugggagguugaaacugcagugagc

SEQ ID NO: 607170 - RNA, 19 nt, Human
ugggauuacaggugcgagc

SEQ ID NO: 607171 - RNA, 21 nt, Human
ugggauuacaggugcgagcca

SEQ ID NO: 607172 - RNA, 21 nt, Human
ugggauuacaggugcgagcca

SEQ ID NO: 607173 - RNA, 21 nt, Human
ugggauuacaggugcgagcca

SEQ ID NO: 607174 - RNA, 22 nt, Human
ugggauuacaggugcgagccau

SEQ ID NO: 607175 - RNA, 24 nt, Human
ugggauuacaggugcgagccauug

SEQ ID NO: 607176 - RNA, 27 nt, Human
ugggauuacaggugcgagccauugcac

SEQ ID NO: 607177 - RNA, 18 nt, Human
uggguggcugaggcagga

SEQ ID NO: 607178 - RNA, 24 nt, Human
ugguacaaucucagcucacugcaa

SEQ ID NO: 607179 - RNA, 27 nt, Human
uguacuuccccaauuuuaaccccuggg

SEQ ID NO: 607180 - RNA, 24 nt, Human
uguccaggcuggucuugaacuccu

SEQ ID NO: 607181 - RNA, 20 nt, Human
uucaaagcacagaaaaaggc

SEQ ID NO: 607182 - RNA, 20 nt, Human
uucacuuguuuuuuccuauu

SEQ ID NO: 607183 - RNA, 21 nt, Human
uucuugggagagacaggguuu

SEQ ID NO: 607184 - RNA, 26 nt, Human
uucuuuuuuucucauugucuuuugag

SEQ ID NO: 607185 - RNA, 19 nt, Human
uugaaugcuuauaaaaauc

SEQ ID NO: 607186 - RNA, 24 nt, Human
uugggagagacaggguuuugccau

SEQ ID NO: 607187 - RNA, 24 nt, Human
uuguauucuugggagagacagggu

SEQ ID NO: 607188 - RNA, 31 nt, Human
uuugcagaacauacuguggacuuccccuuuu

SEQ ID NO: 607189 - RNA, 23 nt, Human
uuuugccauguuguccaggcugg

SEQ ID NO: 607190 - RNA, 23 nt, Human
caggcaccgggcacguccgcgcc

SEQ ID NO: 607191 - RNA, 18 nt, Human
cgccggccggggcaccgg

SEQ ID NO: 607192 - RNA, 20 nt, Human
aaaugcagccacucccaccg

SEQ ID NO: 607193 - RNA, 22 nt, Human
aaucugggagaagaauauguuc

SEQ ID NO: 607194 - RNA, 22 nt, Human
agaaguucuuuggcuagguugg

SEQ ID NO: 607195 - RNA, 18 nt, Human
aggaagaaaaggucucau

SEQ ID NO: 607196 - RNA, 18 nt, Human
cacucccaccggcaggau

SEQ ID NO: 607197 - RNA, 20 nt, Human
caggccgaggaaagcucagc

SEQ ID NO: 607198 - RNA, 20 nt, Human
cauggucucccgagggcgga

SEQ ID NO: 607199 - RNA, 26 nt, Human
ccucuuacaaaucaaagcuauaagac

SEQ ID NO: 607200 - RNA, 20 nt, Human
cgccuggccucgcgcgugag

SEQ ID NO: 607201 - RNA, 19 nt, Human
cuccggugucgugaagugg

SEQ ID NO: 607202 - RNA, 20 nt, Human
cucggggccucgccuggccu

SEQ ID NO: 607203 - RNA, 22 nt, Human
cugcagcauggucucccgaggg

SEQ ID NO: 607204 - RNA, 23 nt, Human
cugccagcaaugcaaaucuuccc

SEQ ID NO: 607205 - RNA, 20 nt, Human
gaagaggggugagcgcggug

SEQ ID NO: 607206 - RNA, 22 nt, Human
gagaaaaguagaaccuuacagc

SEQ ID NO: 607207 - RNA, 22 nt, Human
gccccgggacugcggggcgacg

SEQ ID NO: 607208 - RNA, 19 nt, Human
gccucggggccucgccugg

SEQ ID NO: 607209 - RNA, 22 nt, Human
gcugcccgcgaaggccguuugg

SEQ ID NO: 607210 - RNA, 20 nt, Human
ggacguggcggcgaagaggg

SEQ ID NO: 607211 - RNA, 20 nt, Human
gggagccccgggacugcggg

SEQ ID NO: 607212 - RNA, 22 nt, Human
gggcaggggggucgcagccucu

SEQ ID NO: 607213 - RNA, 22 nt, Human
ggugacaauuaggccuuauaaa

SEQ ID NO: 607214 - RNA, 20 nt, Human
ggugagcgcggugcccgggg

SEQ ID NO: 607215 - RNA, 24 nt, Human
guggcggcgaagaggggugagcgc

SEQ ID NO: 607216 - RNA, 24 nt, Human
uauaaauucacaugagacaaagau

SEQ ID NO: 607217 - RNA, 24 nt, Human
uccccagaaagggaaggaagaaaa

SEQ ID NO: 607218 - RNA, 21 nt, Human
ucuggcgcccgguucgcuccg

SEQ ID NO: 607219 - RNA, 20 nt, Human
ugaaaaacuauuacaauugu

SEQ ID NO: 607220 - RNA, 19 nt, Human
ugaaguggugggcgccucg

SEQ ID NO: 607221 - RNA, 19 nt, Human
ugagacaaagaugccaacc

SEQ ID NO: 607222 - RNA, 23 nt, Human
ugccagcaaugcaaaucuuccca

SEQ ID NO: 607223 - RNA, 20 nt, Human
uggcuagguuggauuguuga

SEQ ID NO: 607224 - RNA, 21 nt, Human
ugggagccccgggacugcggg

SEQ ID NO: 607225 - RNA, 21 nt, Human
uuaaagaaauuaugaaaaacu

SEQ ID NO: 607226 - RNA, 19 nt, Human
uucccggggcuucggggac

SEQ ID NO: 607227 - RNA, 19 nt, Human
aaaaaggacaaauagaaau

SEQ ID NO: 607228 - RNA, 19 nt, Human
aaaacaaaaaaaggacaaa

SEQ ID NO: 607229 - RNA, 25 nt, Human
aaagagaucccuuccuucgccuuuu

SEQ ID NO: 607230 - RNA, 19 nt, Human
aacagaaaacaaaaaaagg

SEQ ID NO: 607231 - RNA, 23 nt, Human
aaucacaaugucccaaaagagau

SEQ ID NO: 607232 - RNA, 25 nt, Human
acaaaaaaaggacaaauagaaauac

SEQ ID NO: 607233 - RNA, 21 nt, Human
acaaacaaaaaagaugaaucu

SEQ ID NO: 607234 - RNA, 18 nt, Human
agaaaacaaaaaaaggac

SEQ ID NO: 607235 - RNA, 18 nt, Human
agaaaacaaaaaaaggac

SEQ ID NO: 607236 - RNA, 21 nt, Human
agaaaacaaaaaaaggacaaa

SEQ ID NO: 607237 - RNA, 25 nt, Human
agaaaaucauuuucuccuccuaggc

SEQ ID NO: 607238 - RNA, 22 nt, Human
agaacagaaaacaaaaaaagga

SEQ ID NO: 607239 - RNA, 19 nt, Human
aucccaucuuucuucucua

SEQ ID NO: 607240 - RNA, 20 nt, Human
augcaucuuuuaagagaaaa

SEQ ID NO: 607241 - RNA, 19 nt, Human
caaaaaagaugaaucucac

SEQ ID NO: 607242 - RNA, 27 nt, Human
caauuagaacagaaaacaaaaaaagga

SEQ ID NO: 607243 - RNA, 23 nt, Human
cacaaacaaaaaagaugaaucuc

SEQ ID NO: 607244 - RNA, 18 nt, Human
cacacaaacaaaaaagau

SEQ ID NO: 607245 - RNA, 21 nt, Human
caucuuuguuguugucacuac

SEQ ID NO: 607246 - RNA, 21 nt, Human
cauuuucuccuccuaggccua

SEQ ID NO: 607247 - RNA, 22 nt, Human
cguaugauacaugcaucuuuua

SEQ ID NO: 607248 - RNA, 21 nt, Human
cuaaaacaaucacaauguccc

SEQ ID NO: 607249 - RNA, 19 nt, Human
cuaaugaaagcuaauuaaa

SEQ ID NO: 607250 - RNA, 24 nt, Human
cuauagccacuacauaugucccug

SEQ ID NO: 607251 - RNA, 19 nt, Human
gaacagaaaacaaaaaaag

SEQ ID NO: 607252 - RNA, 21 nt, Human
gaacagaaaacaaaaaaagga

SEQ ID NO: 607253 - RNA, 21 nt, Human
gcuuugguauauaaugaaguu

SEQ ID NO: 607254 - RNA, 20 nt, Human
uaaaacaaucacaauguccc

SEQ ID NO: 607255 - RNA, 18 nt, Human
uaagagaaaaccgaagug

SEQ ID NO: 607256 - RNA, 20 nt, Human
uaaguaaaccuauagccacu

SEQ ID NO: 607257 - RNA, 21 nt, Human
uaaguaaaccuauagccacua

SEQ ID NO: 607258 - RNA, 22 nt, Human
uaauaauugaggauccguacac

SEQ ID NO: 607259 - RNA, 22 nt, Human
uaauagaaagaaaaucauuuuc

SEQ ID NO: 607260 - RNA, 23 nt, Human
uaauagaauuuucccugugauuu

SEQ ID NO: 607261 - RNA, 21 nt, Human
uauagccacuacauauguccc

SEQ ID NO: 607262 - RNA, 24 nt, Human
uaugucccugacaauuagaacaga

SEQ ID NO: 607263 - RNA, 21 nt, Human
ucacuagaggugggucuuuau

SEQ ID NO: 607264 - RNA, 21 nt, Human
ucucugcuaaaacaaucacaa

SEQ ID NO: 607265 - RNA, 21 nt, Human
ugacauaaggggaaauaaguu

SEQ ID NO: 607266 - RNA, 23 nt, Human
ugacuugcuuaaagcacguauga

SEQ ID NO: 607267 - RNA, 18 nt, Human
ugauguagacagacagca

SEQ ID NO: 607268 - RNA, 24 nt, Human
uuaaacauguaauagaauuuuccc

SEQ ID NO: 607269 - RNA, 22 nt, Human
aaggggggggaugaaaagagga

SEQ ID NO: 607270 - RNA, 28 nt, Human
aagugcuuuucgggggggccggucugcc

SEQ ID NO: 607271 - RNA, 22 nt, Human
aaucuguaagacguuuccuauc

SEQ ID NO: 607272 - RNA, 18 nt, Human
acccuggaguuggcugca

SEQ ID NO: 607273 - RNA, 18 nt, Human
agaaaaccuggggaacug

SEQ ID NO: 607274 - RNA, 18 nt, Human
agccgauuuagaaugccc

SEQ ID NO: 607275 - RNA, 21 nt, Human
aggggggggaugaaaagagga

SEQ ID NO: 607276 - RNA, 21 nt, Human
cagaagagccuucccgcuucc

SEQ ID NO: 607277 - RNA, 20 nt, Human
cagcaggugagaccuccuuc

SEQ ID NO: 607278 - RNA, 23 nt, Human
caggacaaggcgaagugcuuuuc

SEQ ID NO: 607279 - RNA, 18 nt, Human
ccaacuccgcagcaaaau

SEQ ID NO: 607280 - RNA, 23 nt, Human
cccgcuucccuccaccauguccc

SEQ ID NO: 607281 - RNA, 19 nt, Human
ccuccaccaugucccccuu

SEQ ID NO: 607282 - RNA, 18 nt, Human
ccuucccgcuucccucca

SEQ ID NO: 607283 - RNA, 24 nt, Human
cgggggggcccuugggucugggcu

SEQ ID NO: 607284 - RNA, 20 nt, Human
cugcagcucuccacaaucug

SEQ ID NO: 607285 - RNA, 20 nt, Human
cuggggcgucccagggcugg

SEQ ID NO: 607286 - RNA, 22 nt, Human
cuucccgcuucccuccaccaug

SEQ ID NO: 607287 - RNA, 21 nt, Human
gaggagaaaaccuggggaacu

SEQ ID NO: 607288 - RNA, 18 nt, Human
gaguaguaaaugcucucc

SEQ ID NO: 607289 - RNA, 21 nt, Human
gcaaaaugaggagaaaaccug

SEQ ID NO: 607290 - RNA, 26 nt, Human
ggcggaagcugcggaggucagccaag

SEQ ID NO: 607291 - RNA, 21 nt, Human
gggaaggggggggaugaaaag

SEQ ID NO: 607292 - RNA, 18 nt, Human
gggcccuugggucugggc

SEQ ID NO: 607293 - RNA, 18 nt, Human
ggggggaaggggggggau

SEQ ID NO: 607294 - RNA, 25 nt, Human
gugcuuuucgggggggcccuugggu

SEQ ID NO: 607295 - RNA, 20 nt, Human
guuggggggggggaaggggg

SEQ ID NO: 607296 - RNA, 23 nt, Human
uagaucgugcgaugccacagaag

SEQ ID NO: 607297 - RNA, 22 nt, Human
uagccagagucgggcggaagcu

SEQ ID NO: 607298 - RNA, 18 nt, Human
ucaaagcucgacuccugc

SEQ ID NO: 607299 - RNA, 21 nt, Human
ucaaggcaguagccuccaaga

SEQ ID NO: 607300 - RNA, 18 nt, Human
ucccuagaggucaucuuc

SEQ ID NO: 607301 - RNA, 21 nt, Human
uccucagacuggaaacccugg

SEQ ID NO: 607302 - RNA, 19 nt, Human
ugaaaagaggagccggagu

SEQ ID NO: 607303 - RNA, 20 nt, Human
ugauggcgaccagucuacac

SEQ ID NO: 607304 - RNA, 21 nt, Human
ugcagggucuuguccuucacc

SEQ ID NO: 607305 - RNA, 19 nt, Human
ugggaugacagcagcgagg

SEQ ID NO: 607306 - RNA, 19 nt, Human
uggggggggggaagggggg

SEQ ID NO: 607307 - RNA, 22 nt, Human
uggggggggggaagggggggga

SEQ ID NO: 607308 - RNA, 18 nt, Human
ugggucugggcugguccc

SEQ ID NO: 607309 - RNA, 25 nt, Human
uucaccugcuggggcgucccagggc

SEQ ID NO: 607310 - RNA, 19 nt, Human
aaagugcugggguuacagg

SEQ ID NO: 607311 - RNA, 19 nt, Human
aaagugcugggguuacagg

SEQ ID NO: 607312 - RNA, 23 nt, Human
aaagugcugggguuacaggugua

SEQ ID NO: 607313 - RNA, 27 nt, Human
aaggcuucucucccguaugaauguucu

SEQ ID NO: 607314 - RNA, 26 nt, Human
aagugcugggguuacagguguaagcc

SEQ ID NO: 607315 - RNA, 22 nt, Human
aaucucugcucggugcaacccc

SEQ ID NO: 607316 - RNA, 20 nt, Human
aaugacugaccaaacuucug

SEQ ID NO: 607317 - RNA, 25 nt, Human
aauuuuguauuuuuuaguagagaca

SEQ ID NO: 607318 - RNA, 18 nt, Human
agacaggguuucaccgug

SEQ ID NO: 607319 - RNA, 20 nt, Human
agacaggguuucaccguggu

SEQ ID NO: 607320 - RNA, 19 nt, Human
agagacaggguuucaccgu

SEQ ID NO: 607321 - RNA, 19 nt, Human
agugcaguggugcaaucuc

SEQ ID NO: 607322 - RNA, 21 nt, Human
agugcaguggugcaaucucug

SEQ ID NO: 607323 - RNA, 19 nt, Human
caaaaggcuucucucccgu

SEQ ID NO: 607324 - RNA, 24 nt, Human
caaagugcugggguuacaggugua

SEQ ID NO: 607325 - RNA, 18 nt, Human
caacccccaccuccuggg

SEQ ID NO: 607326 - RNA, 23 nt, Human
caacccccaccuccuggguucaa

SEQ ID NO: 607327 - RNA, 20 nt, Human
caagcgauucuccugccuca

SEQ ID NO: 607328 - RNA, 22 nt, Human
caagcgauucuccugccucagc

SEQ ID NO: 607329 - RNA, 21 nt, Human
caauuacugcauucaaaaggc

SEQ ID NO: 607330 - RNA, 22 nt, Human
caccaccacgcccagcuaauuu

SEQ ID NO: 607331 - RNA, 20 nt, Human
cagccaguaauucuuaucaa

SEQ ID NO: 607332 - RNA, 21 nt, Human
caggugcgcaccaccacgccc

SEQ ID NO: 607333 - RNA, 24 nt, Human
caguagcugagauuacaggugcgc

SEQ ID NO: 607334 - RNA, 20 nt, Human
ccaaagugcugggguuacag

SEQ ID NO: 607335 - RNA, 20 nt, Human
ccaaagugcugggguuacag

SEQ ID NO: 607336 - RNA, 21 nt, Human
ccaaagugcugggguuacagg

SEQ ID NO: 607337 - RNA, 24 nt, Human
ccaaagugcugggguuacaggugu

SEQ ID NO: 607338 - RNA, 22 nt, Human
ccaaugacuuuugcucuuuggc

SEQ ID NO: 607339 - RNA, 24 nt, Human
ccaccuccuggguucaagcgauuc

SEQ ID NO: 607340 - RNA, 20 nt, Human
ccaguagcugagauuacagg

SEQ ID NO: 607341 - RNA, 26 nt, Human
ccgccugucucagccucccaaagugc

SEQ ID NO: 607342 - RNA, 24 nt, Human
ccuccuggguucaagcgauucucc

SEQ ID NO: 607343 - RNA, 23 nt, Human
ccugccucagccucuccaguagc

SEQ ID NO: 607344 - RNA, 24 nt, Human
ccugccucagccucuccaguagcu

SEQ ID NO: 607345 - RNA, 23 nt, Human
ccuggguucaagcgauucuccug

SEQ ID NO: 607346 - RNA, 24 nt, Human
cgugauccgccugucucagccucc

SEQ ID NO: 607347 - RNA, 25 nt, Human
cuaauuuuguauuuuuuaguagaga

SEQ ID NO: 607348 - RNA, 21 nt, Human
cuccuggguucaagcgauucu

SEQ ID NO: 607349 - RNA, 20 nt, Human
cucuguugcccagacuggag

SEQ ID NO: 607350 - RNA, 23 nt, Human
cucuguugcccagacuggagugc

SEQ ID NO: 607351 - RNA, 24 nt, Human
cucuugaccucgugauccgccugu

SEQ ID NO: 607352 - RNA, 23 nt, Human
cugucucagccucccaaagugcu

SEQ ID NO: 607353 - RNA, 24 nt, Human
cugucucagccucccaaagugcug

SEQ ID NO: 607354 - RNA, 21 nt, Human
gacaggguuucaccguggucu

SEQ ID NO: 607355 - RNA, 22 nt, Human
gaccucgugauccgccugucuc

SEQ ID NO: 607356 - RNA, 24 nt, Human
gaccucgugauccgccugucucag

SEQ ID NO: 607357 - RNA, 20 nt, Human
gauucuccugccucagccuc

SEQ ID NO: 607358 - RNA, 22 nt, Human
gcaacccccaccuccuggguuc

SEQ ID NO: 607359 - RNA, 24 nt, Human
gcgauucuccugccucagccucuc

SEQ ID NO: 607360 - RNA, 22 nt, Human
ggguuacagguguaagccacug

SEQ ID NO: 607361 - RNA, 18 nt, Human
gguuacagguguaagcca

SEQ ID NO: 607362 - RNA, 22 nt, Human
gguuacagguguaagccacugc

SEQ ID NO: 607363 - RNA, 24 nt, Human
gugauccgccugucucagccuccc

SEQ ID NO: 607364 - RNA, 24 nt, Human
uacaggugcgcaccaccacgccca

SEQ ID NO: 607365 - RNA, 24 nt, Human
uacagguguaagccacugcgccca

SEQ ID NO: 607366 - RNA, 22 nt, Human
uagagacaggguuucaccgugg

SEQ ID NO: 607367 - RNA, 19 nt, Human
uaggauggaugagaucugu

SEQ ID NO: 607368 - RNA, 21 nt, Human
uaguagagacaggguuucacc

SEQ ID NO: 607369 - RNA, 24 nt, Human
uaguagagacaggguuucaccgug

SEQ ID NO: 607370 - RNA, 21 nt, Human
ucaaauccugaggucaaaauc

SEQ ID NO: 607371 - RNA, 19 nt, Human
ucaagcgauucuccugccu

SEQ ID NO: 607372 - RNA, 20 nt, Human
ucagccucccaaagugcugg

SEQ ID NO: 607373 - RNA, 23 nt, Human
uccaguagcugagauuacaggug

SEQ ID NO: 607374 - RNA, 23 nt, Human
ucccaaagugcugggguuacagg

SEQ ID NO: 607375 - RNA, 21 nt, Human
uccuggguucaagcgauucuc

SEQ ID NO: 607376 - RNA, 24 nt, Human
uccuggguucaagcgauucuccug

SEQ ID NO: 607377 - RNA, 24 nt, Human
ucggugcaacccccaccuccuggg

SEQ ID NO: 607378 - RNA, 24 nt, Human
ucuccaguagcugagauuacaggu

SEQ ID NO: 607379 - RNA, 26 nt, Human
ucuccugccucagccucuccaguagc

SEQ ID NO: 607380 - RNA, 24 nt, Human
ucuugcucuguugcccagacugga

SEQ ID NO: 607381 - RNA, 24 nt, Human
ucuuuccacugugaauucucugau

SEQ ID NO: 607382 - RNA, 19 nt, Human
ugacugaccaaacuucuga

SEQ ID NO: 607383 - RNA, 21 nt, Human
ugagauuacaggugcgcacca

SEQ ID NO: 607384 - RNA, 24 nt, Human
ugagauuacaggugcgcaccacca

SEQ ID NO: 607385 - RNA, 24 nt, Human
ugauugaagcuuuccccacauuua

SEQ ID NO: 607386 - RNA, 22 nt, Human
ugccauauguuugauagccuca

SEQ ID NO: 607387 - RNA, 21 nt, Human
ugcccagacuggagugcagug

SEQ ID NO: 607388 - RNA, 24 nt, Human
ugcccagacuggagugcaguggug

SEQ ID NO: 607389 - RNA, 21 nt, Human
ugccucagccucuccaguagc

SEQ ID NO: 607390 - RNA, 24 nt, Human
ugccucagccucuccaguagcuga

SEQ ID NO: 607391 - RNA, 21 nt, Human
ugcgcaccaccacgcccagcu

SEQ ID NO: 607392 - RNA, 18 nt, Human
uggagugcaguggugcaa

SEQ ID NO: 607393 - RNA, 22 nt, Human
uggagugcaguggugcaaucuc

SEQ ID NO: 607394 - RNA, 22 nt, Human
ugggguuacagguguaagccac

SEQ ID NO: 607395 - RNA, 22 nt, Human
ugggguuacagguguaagccac

SEQ ID NO: 607396 - RNA, 24 nt, Human
ugggguuacagguguaagccacug

SEQ ID NO: 607397 - RNA, 23 nt, Human
uggguucaagcgauucuccugcc

SEQ ID NO: 607398 - RNA, 24 nt, Human
uguagaauaaggguuguucuuuga

SEQ ID NO: 607399 - RNA, 24 nt, Human
ugucucagccucccaaagugcugg

SEQ ID NO: 607400 - RNA, 21 nt, Human
uguugcccagacuggagugca

SEQ ID NO: 607401 - RNA, 20 nt, Human
uuacagguguaagccacugc

SEQ ID NO: 607402 - RNA, 21 nt, Human
uuacugcauucaaaaggcuuc

SEQ ID NO: 607403 - RNA, 22 nt, Human
uuaguagagacaggguuucacc

SEQ ID NO: 607404 - RNA, 24 nt, Human
uuaguagagacaggguuucaccgu

SEQ ID NO: 607405 - RNA, 21 nt, Human
uucaagcgauucuccugccuc

SEQ ID NO: 607406 - RNA, 23 nt, Human
uucaagcgauucuccugccucag

SEQ ID NO: 607407 - RNA, 24 nt, Human
uucaagcgauucuccugccucagc

SEQ ID NO: 607408 - RNA, 19 nt, Human
uucacaaugacugaccaaa

SEQ ID NO: 607409 - RNA, 24 nt, Human
uugcccagacuggagugcaguggu

SEQ ID NO: 607410 - RNA, 20 nt, Human
uuuuguauuuuuuaguagag

SEQ ID NO: 607411 - RNA, 21 nt, Human
uuuuguauuuuuuaguagaga

SEQ ID NO: 607412 - RNA, 24 nt, Human
uuuuuaguagagacaggguuucac

SEQ ID NO: 607413 - RNA, 23 nt, Human
uuuuuuaguagagacaggguuuc

SEQ ID NO: 607414 - RNA, 26 nt, Human
aacccguuugcuccuuccucagcucc

SEQ ID NO: 607415 - RNA, 18 nt, Human
aacuuguuccaccucccc

SEQ ID NO: 607416 - RNA, 26 nt, Human
aaguagccagccacggggccuagagc

SEQ ID NO: 607417 - RNA, 19 nt, Human
acagccgggaacacacauu

SEQ ID NO: 607418 - RNA, 20 nt, Human
acuucuauccccuacuccuc

SEQ ID NO: 607419 - RNA, 18 nt, Human
agcuggucaggacagugc

SEQ ID NO: 607420 - RNA, 22 nt, Human
caaguucuugcccaggaucaca

SEQ ID NO: 607421 - RNA, 23 nt, Human
cacacagccgggaacacacauuc

SEQ ID NO: 607422 - RNA, 23 nt, Human
caccccaaucgugacuccccaga

SEQ ID NO: 607423 - RNA, 22 nt, Human
cagcaacuuguuccaccucccc

SEQ ID NO: 607424 - RNA, 23 nt, Human
cagcaacuuguuccaccucccca

SEQ ID NO: 607425 - RNA, 18 nt, Human
cagcaaggacuagaagua

SEQ ID NO: 607426 - RNA, 21 nt, Human
cagcagguuugcucaucuccc

SEQ ID NO: 607427 - RNA, 21 nt, Human
cagggguccuugggcaggucc

SEQ ID NO: 607428 - RNA, 19 nt, Human
caguccggagccgcggcgg

SEQ ID NO: 607429 - RNA, 25 nt, Human
ccaagaggccucucccucccccuuc

SEQ ID NO: 607430 - RNA, 24 nt, Human
ccacagggaccaagaggccucucc

SEQ ID NO: 607431 - RNA, 18 nt, Human
ccagggaggucaaguucu

SEQ ID NO: 607432 - RNA, 18 nt, Human
cccggggccagucccggg

SEQ ID NO: 607433 - RNA, 21 nt, Human
cccggggccagucccggggcc

SEQ ID NO: 607434 - RNA, 22 nt, Human
cccggggccagucccggggcca

SEQ ID NO: 607435 - RNA, 18 nt, Human
cccuacuccucccuccuu

SEQ ID NO: 607436 - RNA, 18 nt, Human
cccuacuccucccuccuu

SEQ ID NO: 607437 - RNA, 21 nt, Human
ccuucgccgcgggagcaggga

SEQ ID NO: 607438 - RNA, 27 nt, Human
cgcgaaaacccguuugcuccuuccuca

SEQ ID NO: 607439 - RNA, 29 nt, Human
cucccaccccaaucgugacuccccagacc

SEQ ID NO: 607440 - RNA, 29 nt, Human
cucccaccccaaucgugacuccccagacc

SEQ ID NO: 607441 - RNA, 20 nt, Human
cuccccagaccgggucucca

SEQ ID NO: 607442 - RNA, 22 nt, Human
gaaauacuucuauccccuacuc

SEQ ID NO: 607443 - RNA, 18 nt, Human
gaacacacauuccaaaac

SEQ ID NO: 607444 - RNA, 19 nt, Human
gaucacacagccgggaaca

SEQ ID NO: 607445 - RNA, 20 nt, Human
gcaaaggcacccagcgcgcc

SEQ ID NO: 607446 - RNA, 19 nt, Human
gccgggaacacacauucca

SEQ ID NO: 607447 - RNA, 22 nt, Human
gggaacacacauuccaaaaccc

SEQ ID NO: 607448 - RNA, 20 nt, Human
uaaguagccagccacggggc

SEQ ID NO: 607449 - RNA, 20 nt, Human
uagaaguaacuuugguggca

SEQ ID NO: 607450 - RNA, 20 nt, Human
uaugcugggcacuuugccau

SEQ ID NO: 607451 - RNA, 21 nt, Human
ucacugaccucugcaugggag

SEQ ID NO: 607452 - RNA, 20 nt, Human
uccaccuccccaagguucag

SEQ ID NO: 607453 - RNA, 26 nt, Human
uccgugcccggggccagucccggggc

SEQ ID NO: 607454 - RNA, 19 nt, Human
ucgccgcgggagcagggaa

SEQ ID NO: 607455 - RNA, 19 nt, Human
ugcagggguccuugggcag

SEQ ID NO: 607456 - RNA, 26 nt, Human
ugcccaggaucacacagccgggaacu

SEQ ID NO: 607457 - RNA, 18 nt, Human
ugcuccuuccucagcucc

SEQ ID NO: 607458 - RNA, 19 nt, Human
ugcuccuuccucagcuccc

SEQ ID NO: 607459 - RNA, 19 nt, Human
uugcuccuuccucagcucc

SEQ ID NO: 607460 - RNA, 21 nt, Human
aaacagcaauaaauuaaauca

SEQ ID NO: 607461 - RNA, 22 nt, Human
aacaccaaaaagcaucuacgca

SEQ ID NO: 607462 - RNA, 22 nt, Human
aacauuuacaaggacacauaca

SEQ ID NO: 607463 - RNA, 21 nt, Human
aacgaacaaacucacagcaac

SEQ ID NO: 607464 - RNA, 25 nt, Human
aagccagcuacauucuuaaaaccag

SEQ ID NO: 607465 - RNA, 22 nt, Human
aaugaagaggccacccuguuuc

SEQ ID NO: 607466 - RNA, 25 nt, Human
acaaugaugaccauaagacagacac

SEQ ID NO: 607467 - RNA, 23 nt, Human
acaccaaagccaggcuuguugga

SEQ ID NO: 607468 - RNA, 22 nt, Human
agacaguggcaaugggcaaagc

SEQ ID NO: 607469 - RNA, 25 nt, Human
agaggccacccuguuuccaaauccu

SEQ ID NO: 607470 - RNA, 23 nt, Human
agugaugcugaauguggaugugg

SEQ ID NO: 607471 - RNA, 20 nt, Human
auaaaacccaugaaaugucu

SEQ ID NO: 607472 - RNA, 20 nt, Human
auaaauaaugaagaggccac

SEQ ID NO: 607473 - RNA, 25 nt, Human
aucaagcuucugauucuucuugcug

SEQ ID NO: 607474 - RNA, 21 nt, Human
aucucauucucuccgcuucca

SEQ ID NO: 607475 - RNA, 24 nt, Human
aucucauucucuccgcuuccacaa

SEQ ID NO: 607476 - RNA, 27 nt, Human
auggauuuuuacucaugagaucuggcu

SEQ ID NO: 607477 - RNA, 23 nt, Human
caaaucucuccccuaugaaucau

SEQ ID NO: 607478 - RNA, 23 nt, Human
caacacaaaggucugcaacgaac

SEQ ID NO: 607479 - RNA, 23 nt, Human
cagaaggggcaguaaagacagug

SEQ ID NO: 607480 - RNA, 21 nt, Human
cagauucccaggacccaacac

SEQ ID NO: 607481 - RNA, 22 nt, Human
caggguaaaauccuauagaauu

SEQ ID NO: 607482 - RNA, 21 nt, Human
caguauguaacgugugcagcu

SEQ ID NO: 607483 - RNA, 21 nt, Human
cauaagacagacacuuauuuc

SEQ ID NO: 607484 - RNA, 22 nt, Human
cauaagacagacacuuauuucc

SEQ ID NO: 607485 - RNA, 21 nt, Human
caugcaccgugacagcuuugu

SEQ ID NO: 607486 - RNA, 19 nt, Human
ccaaagccaggcuuguugg

SEQ ID NO: 607487 - RNA, 22 nt, Human
ccaaagccaggcuuguuggagu

SEQ ID NO: 607488 - RNA, 23 nt, Human
ccaacuuccucauguagccccaa

SEQ ID NO: 607489 - RNA, 22 nt, Human
ccaccaugcacagggaacaaag

SEQ ID NO: 607490 - RNA, 19 nt, Human
ccagaagacaggggucaca

SEQ ID NO: 607491 - RNA, 18 nt, Human
cccaaagagauuuccaca

SEQ ID NO: 607492 - RNA, 23 nt, Human
cccaaagagauuuccacaaauag

SEQ ID NO: 607493 - RNA, 19 nt, Human
ccuauccaaaaaucuaaga

SEQ ID NO: 607494 - RNA, 21 nt, Human
ccuggccccccuauccaaaaa

SEQ ID NO: 607495 - RNA, 24 nt, Human
ccuguuuccaaaucugaauuugcc

SEQ ID NO: 607496 - RNA, 19 nt, Human
cuccuuuucuacacaaaac

SEQ ID NO: 607497 - RNA, 21 nt, Human
cucuccccuaugaaucaucuc

SEQ ID NO: 607498 - RNA, 22 nt, Human
cucuugguuucaauuauccacc

SEQ ID NO: 607499 - RNA, 18 nt, Human
cuggccccccuauccaaa

SEQ ID NO: 607500 - RNA, 19 nt, Human
cuucuauuucuguuagagg

SEQ ID NO: 607501 - RNA, 20 nt, Human
gaagaggccacccuguuucc

SEQ ID NO: 607502 - RNA, 21 nt, Human
gacuggaugagaaaauacuga

SEQ ID NO: 607503 - RNA, 22 nt, Human
gaucucccaaagagauuuccac

SEQ ID NO: 607504 - RNA, 20 nt, Human
gauucuucuugcugaguaug

SEQ ID NO: 607505 - RNA, 18 nt, Human
gcacuaguuucucuuucu

SEQ ID NO: 607506 - RNA, 21 nt, Human
gccuacucacaaauuucuacc

SEQ ID NO: 607507 - RNA, 21 nt, Human
gcuacauucuuaaaaccagca

SEQ ID NO: 607508 - RNA, 22 nt, Human
ggcaagaugcugacacauccuu

SEQ ID NO: 607509 - RNA, 23 nt, Human
gggcaagaugcugacacauccuu

SEQ ID NO: 607510 - RNA, 21 nt, Human
ggguggaggggcagaaggggc

SEQ ID NO: 607511 - RNA, 22 nt, Human
gguggaggggcagaaggggcag

SEQ ID NO: 607512 - RNA, 22 nt, Human
uaaagacaacugaaaaagaagc

SEQ ID NO: 607513 - RNA, 24 nt, Human
uaaagacaacugaaaaagaagcug

SEQ ID NO: 607514 - RNA, 24 nt, Human
uaaagacaguggcaaugggcaaag

SEQ ID NO: 607515 - RNA, 23 nt, Human
uaaauuauccuuuuugaaaucug

SEQ ID NO: 607516 - RNA, 21 nt, Human
uaagaagacaaugaugaccau

SEQ ID NO: 607517 - RNA, 25 nt, Human
uaagacagacacuuauuuccaacac

SEQ ID NO: 607518 - RNA, 21 nt, Human
uaaugagaaauuugaacaaac

SEQ ID NO: 607519 - RNA, 25 nt, Human
uaccuggccccccuauccaaaaauc

SEQ ID NO: 607520 - RNA, 19 nt, Human
uacucugaguacguggcau

SEQ ID NO: 607521 - RNA, 23 nt, Human
uaggucgaggggccuaauuuggg

SEQ ID NO: 607522 - RNA, 18 nt, Human
uauguugugauuuacacu

SEQ ID NO: 607523 - RNA, 23 nt, Human
ucagcucauuaccaacuuccuca

SEQ ID NO: 607524 - RNA, 25 nt, Human
ucaucucauucucuccgcuuccaca

SEQ ID NO: 607525 - RNA, 18 nt, Human
ucaucucccacugauaua

SEQ ID NO: 607526 - RNA, 21 nt, Human
ucaugcaccgugacagcuuug

SEQ ID NO: 607527 - RNA, 19 nt, Human
uccaaaaaucuaagaagac

SEQ ID NO: 607528 - RNA, 25 nt, Human
uccacaaauagccaguguauacugg

SEQ ID NO: 607529 - RNA, 21 nt, Human
uccaccaugcacagggaacaa

SEQ ID NO: 607530 - RNA, 28 nt, Human
ucugaacaccaucaucucauucucuccg

SEQ ID NO: 607531 - RNA, 20 nt, Human
ucugagucucccccuaccug

SEQ ID NO: 607532 - RNA, 22 nt, Human
ucuguccaacuaucaugcaccg

SEQ ID NO: 607533 - RNA, 21 nt, Human
ugaaaagccagcuacauucuu

SEQ ID NO: 607534 - RNA, 23 nt, Human
ugaacaaacuccaauccagcacc

SEQ ID NO: 607535 - RNA, 19 nt, Human
ugaaucaaagcaaugcagc

SEQ ID NO: 607536 - RNA, 21 nt, Human
ugagggagagauggacucuau

SEQ ID NO: 607537 - RNA, 24 nt, Human
ugaguucuaaagacaacugaaaaa

SEQ ID NO: 607538 - RNA, 20 nt, Human
uggggugugauuaaauaaaa

SEQ ID NO: 607539 - RNA, 23 nt, Human
ugguaaguaggcccuuuauuccu

SEQ ID NO: 607540 - RNA, 25 nt, Human
ugguagccuauguugugauuuacac

SEQ ID NO: 607541 - RNA, 18 nt, Human
uguccaacuaucaugcac

SEQ ID NO: 607542 - RNA, 19 nt, Human
ugucccaagaaacacaggg

SEQ ID NO: 607543 - RNA, 26 nt, Human
uguggguggaggggcagaaggggcag

SEQ ID NO: 607544 - RNA, 23 nt, Human
uguuccuuccaguuuauaaacac

SEQ ID NO: 607545 - RNA, 19 nt, Human
uuaaaacuugaacacugac

SEQ ID NO: 607546 - RNA, 18 nt, Human
uuacucucaugucugcau

SEQ ID NO: 607547 - RNA, 22 nt, Human
uugaaacacuuccauuguguuu

SEQ ID NO: 607548 - RNA, 21 nt, Human
uugaaggggcacuaaauuauu

SEQ ID NO: 607549 - RNA, 22 nt, Human
uuuauaaacacucacaguggcc

SEQ ID NO: 607550 - RNA, 19 nt, Human
uuugaaaucugaacacccu

SEQ ID NO: 607551 - RNA, 19 nt, Human
uuugaccuguaucaauguc

SEQ ID NO: 607552 - RNA, 21 nt, Human
uuuuugaaaucugaacacccu

SEQ ID NO: 607553 - RNA, 23 nt, Human
aaacaagccgaacaaaccggacc

SEQ ID NO: 607554 - RNA, 22 nt, Human
aaacacaggcaauacacagaca

SEQ ID NO: 607555 - RNA, 22 nt, Human
aaacaggaaaaaaaaaaaccug

SEQ ID NO: 607556 - RNA, 23 nt, Human
aaacaggaaaaaaaaaaagggac

SEQ ID NO: 607557 - RNA, 24 nt, Human
aaauccgaaaauccaaaaccugaa

SEQ ID NO: 607558 - RNA, 21 nt, Human
aacacaggcaauacacagaca

SEQ ID NO: 607559 - RNA, 18 nt, Human
aacaggaaaaaaaaaaac

SEQ ID NO: 607560 - RNA, 21 nt, Human
aacaugggggcagacuucccc

SEQ ID NO: 607561 - RNA, 21 nt, Human
aagccguggggaaaggacaau

SEQ ID NO: 607562 - RNA, 28 nt, Human
aaguaucccaaauccgaaaauccaaaac

SEQ ID NO: 607563 - RNA, 19 nt, Human
aauacagugcucaaacagu

SEQ ID NO: 607564 - RNA, 19 nt, Human
aauccaaaaccugaaaagc

SEQ ID NO: 607565 - RNA, 22 nt, Human
aaucccgggaccuccgagcccc

SEQ ID NO: 607566 - RNA, 18 nt, Human
acaaacacaggcaauaca

SEQ ID NO: 607567 - RNA, 20 nt, Human
acacaaacacaggcaauaca

SEQ ID NO: 607568 - RNA, 18 nt, Human
acugaaacaugggggcag

SEQ ID NO: 607569 - RNA, 22 nt, Human
acuuaagaaacaggaaaaaaaa

SEQ ID NO: 607570 - RNA, 21 nt, Human
agauuauacucucuugguaua

SEQ ID NO: 607571 - RNA, 18 nt, Human
aggaaaaaaaaaaaccug

SEQ ID NO: 607572 - RNA, 21 nt, Human
agguaaaacagggaugguauu

SEQ ID NO: 607573 - RNA, 18 nt, Human
aguaucccaaauccgaaa

SEQ ID NO: 607574 - RNA, 19 nt, Human
aguuuauguuugacuguac

SEQ ID NO: 607575 - RNA, 18 nt, Human
auaaauguuuccuccagu

SEQ ID NO: 607576 - RNA, 21 nt, Human
caagaacagauaaauacagug

SEQ ID NO: 607577 - RNA, 24 nt, Human
caagaacagauaaauacagugcuc

SEQ ID NO: 607578 - RNA, 20 nt, Human
caagucccggguccuuuccc

SEQ ID NO: 607579 - RNA, 22 nt, Human
cacagacaccagguaaaacagg

SEQ ID NO: 607580 - RNA, 23 nt, Human
caccguaaucccgggaccuccga

SEQ ID NO: 607581 - RNA, 24 nt, Human
caccuguagaacugugagucaauu

SEQ ID NO: 607582 - RNA, 21 nt, Human
cacuguucaagucccgggucc

SEQ ID NO: 607583 - RNA, 20 nt, Human
caugauaaaccuugguuucu

SEQ ID NO: 607584 - RNA, 24 nt, Human
ccaaaaccugaaaagcucuaauga

SEQ ID NO: 607585 - RNA, 26 nt, Human
ccaacagccucuacugcuuguuuccc

SEQ ID NO: 607586 - RNA, 21 nt, Human
ccccuggggcugugcgguggc

SEQ ID NO: 607587 - RNA, 21 nt, Human
cccgggaccuccgagccccug

SEQ ID NO: 607588 - RNA, 20 nt, Human
cccuuugcccuccuccucug

SEQ ID NO: 607589 - RNA, 26 nt, Human
ccuccacagccaugcuuccuguauca

SEQ ID NO: 607590 - RNA, 22 nt, Human
ccuccgagccccugcuccgcgg

SEQ ID NO: 607591 - RNA, 22 nt, Human
ccuuugcccuccuccucuggcu

SEQ ID NO: 607592 - RNA, 25 nt, Human
cggggccagcuucaaaguccaaccc

SEQ ID NO: 607593 - RNA, 23 nt, Human
cuagucaaguaucccaaauccga

SEQ ID NO: 607594 - RNA, 27 nt, Human
cuccacagccaugcuuccuguaucacc

SEQ ID NO: 607595 - RNA, 22 nt, Human
cugcuuccgcuucaccuuccgc

SEQ ID NO: 607596 - RNA, 21 nt, Human
gaaaauccaaaaccugaaaag

SEQ ID NO: 607597 - RNA, 22 nt, Human
gaaaauccaaaaccugaaaagc

SEQ ID NO: 607598 - RNA, 20 nt, Human
gaaacaggaaaaaaaaaaac

SEQ ID NO: 607599 - RNA, 21 nt, Human
gaaacaggaaaaaaaaaaacc

SEQ ID NO: 607600 - RNA, 18 nt, Human
gaaaggacaauguuccca

SEQ ID NO: 607601 - RNA, 22 nt, Human
gaaagugugcagcaucugcccc

SEQ ID NO: 607602 - RNA, 21 nt, Human
gaugguauuucuggaugguuu

SEQ ID NO: 607603 - RNA, 19 nt, Human
gcaccguaaucccgggacc

SEQ ID NO: 607604 - RNA, 22 nt, Human
gcggcgugcggccgcuggcgcc

SEQ ID NO: 607605 - RNA, 23 nt, Human
gcugugcgguggccgucggcggg

SEQ ID NO: 607606 - RNA, 22 nt, Human
ggagacguaccccucccuaauc

SEQ ID NO: 607607 - RNA, 22 nt, Human
uaagaaacaggaaaaaaaaaaa

SEQ ID NO: 607608 - RNA, 21 nt, Human
uacaccccuggggcugugcgg

SEQ ID NO: 607609 - RNA, 21 nt, Human
uagagcaugauaaaccuuggu

SEQ ID NO: 607610 - RNA, 18 nt, Human
uaucugaaaugcuuggga

SEQ ID NO: 607611 - RNA, 18 nt, Human
uauuucuggaugguuuaa

SEQ ID NO: 607612 - RNA, 25 nt, Human
ucaaaguccaacccacaaggcacag

SEQ ID NO: 607613 - RNA, 21 nt, Human
ucacagguaggaccacuuccc

SEQ ID NO: 607614 - RNA, 19 nt, Human
uccaaaaccugaaaagcuc

SEQ ID NO: 607615 - RNA, 19 nt, Human
ucccgggaccuccgagccc

SEQ ID NO: 607616 - RNA, 22 nt, Human
ucccgggaccuccgagccccug

SEQ ID NO: 607617 - RNA, 19 nt, Human
uccuagagcaugauaaacc

SEQ ID NO: 607618 - RNA, 21 nt, Human
uccuagagcaugauaaaccuu

SEQ ID NO: 607619 - RNA, 24 nt, Human
ucuucgguguuggaggaggggccu

SEQ ID NO: 607620 - RNA, 25 nt, Human
ucuuuuagacuuugguuuuuuugug

SEQ ID NO: 607621 - RNA, 18 nt, Human
ugacugaaacaugggggc

SEQ ID NO: 607622 - RNA, 19 nt, Human
ugccaagauuaaccaacag

SEQ ID NO: 607623 - RNA, 21 nt, Human
ugcccuccuccucuggcucua

SEQ ID NO: 607624 - RNA, 26 nt, Human
ugcucuguguccccacacaaaucuca

SEQ ID NO: 607625 - RNA, 23 nt, Human
uggaggaggggccuggagggagg

SEQ ID NO: 607626 - RNA, 19 nt, Human
uggagggaggugacugaaa

SEQ ID NO: 607627 - RNA, 23 nt, Human
uggggcugugcgguggccgucgg

SEQ ID NO: 607628 - RNA, 25 nt, Human
uggggcugugcgguggccgucggcg

SEQ ID NO: 607629 - RNA, 27 nt, Human
ugggggagacguaccccucccuaauuc

SEQ ID NO: 607630 - RNA, 26 nt, Human
ugguuuucaugauuaaagccguggag

SEQ ID NO: 607631 - RNA, 24 nt, Human
uguacuuaagaaacaggaaaaaaa

SEQ ID NO: 607632 - RNA, 23 nt, Human
ugugcgguggccgucggcggggc

SEQ ID NO: 607633 - RNA, 20 nt, Human
uguguacaagaacguacaug

SEQ ID NO: 607634 - RNA, 24 nt, Human
uguuuccucgucuguguuuaacac

SEQ ID NO: 607635 - RNA, 25 nt, Human
uuaagaaacaggaaaaaaaaaaacc

SEQ ID NO: 607636 - RNA, 21 nt, Human
uucaugauuaaagccgugggg

SEQ ID NO: 607637 - RNA, 21 nt, Human
uucaugguguacauuucacaa

SEQ ID NO: 607638 - RNA, 25 nt, Human
uugguuuuuuuguguguuuuggaau

SEQ ID NO: 607639 - RNA, 21 nt, Human
uuugcccuccuccucuggcuc

SEQ ID NO: 607640 - RNA, 18 nt, Human
aaacacuaaaaacuagua

SEQ ID NO: 607641 - RNA, 18 nt, Human
aaacaggaaggaaugucu

SEQ ID NO: 607642 - RNA, 25 nt, Human
aaaccaaggaccaggcccguagaaa

SEQ ID NO: 607643 - RNA, 24 nt, Human
aaagugcugggauuacgggcauga

SEQ ID NO: 607644 - RNA, 22 nt, Human
aacacucccuuucaauaaagac

SEQ ID NO: 607645 - RNA, 21 nt, Human
aaccugugagugcagaggcac

SEQ ID NO: 607646 - RNA, 18 nt, Human
aacuuguaaucaguagca

SEQ ID NO: 607647 - RNA, 21 nt, Human
aagagggguccagcacagccc

SEQ ID NO: 607648 - RNA, 22 nt, Human
aagcaaguuccaaaugcacuga

SEQ ID NO: 607649 - RNA, 22 nt, Human
aagccacagcagcaucacagcc

SEQ ID NO: 607650 - RNA, 24 nt, Human
aaggacaugcacaaaucccugggg

SEQ ID NO: 607651 - RNA, 21 nt, Human
aagguagcugucaacuugaaa

SEQ ID NO: 607652 - RNA, 19 nt, Human
aagugcugggauuacgggc

SEQ ID NO: 607653 - RNA, 21 nt, Human
aagugcugggauuacgggcau

SEQ ID NO: 607654 - RNA, 26 nt, Human
aagugcugggauuacgggcaugagcc

SEQ ID NO: 607655 - RNA, 18 nt, Human
aaugguaaaugugauuca

SEQ ID NO: 607656 - RNA, 23 nt, Human
acagcagcaucacagccuuugcc

SEQ ID NO: 607657 - RNA, 22 nt, Human
acaguaaugcaaggcgcacguc

SEQ ID NO: 607658 - RNA, 23 nt, Human
acauccaugagaggccacucaga

SEQ ID NO: 607659 - RNA, 19 nt, Human
accuugggugaucugcuug

SEQ ID NO: 607660 - RNA, 23 nt, Human
agaaacaggaaggaaugucuggc

SEQ ID NO: 607661 - RNA, 20 nt, Human
agaaacgagcagcugacuca

SEQ ID NO: 607662 - RNA, 21 nt, Human
agaaagccacagcagcaucac

SEQ ID NO: 607663 - RNA, 19 nt, Human
agaaauguuuauucugucc

SEQ ID NO: 607664 - RNA, 21 nt, Human
agaaauucuccaccaaggggc

SEQ ID NO: 607665 - RNA, 21 nt, Human
agaagcgaaaagaggggucca

SEQ ID NO: 607666 - RNA, 22 nt, Human
agacgccacaucagccugagca

SEQ ID NO: 607667 - RNA, 21 nt, Human
agcaaguagaaaaaaauguca

SEQ ID NO: 607668 - RNA, 18 nt, Human
agcaucaacauugucuga

SEQ ID NO: 607669 - RNA, 23 nt, Human
agccacagcagcaucacagccuu

SEQ ID NO: 607670 - RNA, 18 nt, Human
aggcaggucaguugcaga

SEQ ID NO: 607671 - RNA, 24 nt, Human
aggcaggugccggccaaaagggac

SEQ ID NO: 607672 - RNA, 22 nt, Human
aggcuucugggucaacacuccc

SEQ ID NO: 607673 - RNA, 24 nt, Human
agguagcugucaacuugaaauuca

SEQ ID NO: 607674 - RNA, 24 nt, Human
aggugcggaauccacagaaugacc

SEQ ID NO: 607675 - RNA, 22 nt, Human
aguuggccaggcuggucuugaa

SEQ ID NO: 607676 - RNA, 24 nt, Human
caaagugcugggauuacgggcaug

SEQ ID NO: 607677 - RNA, 19 nt, Human
caacugagucacuggaaaa

SEQ ID NO: 607678 - RNA, 22 nt, Human
caaguagaaaaaaaugucacuc

SEQ ID NO: 607679 - RNA, 19 nt, Human
cacaacagauucgccucca

SEQ ID NO: 607680 - RNA, 24 nt, Human
cacacacuuaggcucgccugugca

SEQ ID NO: 607681 - RNA, 24 nt, Human
cacauccaugagaggccacucaga

SEQ ID NO: 607682 - RNA, 19 nt, Human
cacuuguguucucaucagc

SEQ ID NO: 607683 - RNA, 26 nt, Human
cagaagcaacuucacacccaccauaa

SEQ ID NO: 607684 - RNA, 22 nt, Human
cagaagcaaguagaaaaaaaug

SEQ ID NO: 607685 - RNA, 26 nt, Human
cagcacgggaggacuaugaccaccua

SEQ ID NO: 607686 - RNA, 25 nt, Human
cagcugacucaaguuauuccaaugc

SEQ ID NO: 607687 - RNA, 20 nt, Human
caggggcuucugcuucaccc

SEQ ID NO: 607688 - RNA, 23 nt, Human
caguagcaucaacauugucugag

SEQ ID NO: 607689 - RNA, 22 nt, Human
cauaguguacacuguccacagu

SEQ ID NO: 607690 - RNA, 24 nt, Human
caugugggcugcagugcagucacc

SEQ ID NO: 607691 - RNA, 24 nt, Human
ccaaagugcugggauuacgggcau

SEQ ID NO: 607692 - RNA, 23 nt, Human
ccaacaucacaaacuccuugucu

SEQ ID NO: 607693 - RNA, 19 nt, Human
ccaaguuggccaggcuggu

SEQ ID NO: 607694 - RNA, 21 nt, Human
ccacugcuccuggccucaggc

SEQ ID NO: 607695 - RNA, 22 nt, Human
ccauaccauggcgcuccaggca

SEQ ID NO: 607696 - RNA, 28 nt, Human
cccacgauucuuccugacagccugaaac

SEQ ID NO: 607697 - RNA, 21 nt, Human
cccauaccauggcgcuccagg

SEQ ID NO: 607698 - RNA, 18 nt, Human
ccccaaauacuguaaaau

SEQ ID NO: 607699 - RNA, 23 nt, Human
ccccaggggcuucugcuucaccc

SEQ ID NO: 607700 - RNA, 28 nt, Human
ccccaggggcuucugcuuccuccgcggg

SEQ ID NO: 607701 - RNA, 19 nt, Human
ccccauaccauggcgcucc

SEQ ID NO: 607702 - RNA, 24 nt, Human
ccccauaccauggcgcuccaggca

SEQ ID NO: 607703 - RNA, 21 nt, Human
ccgagaaauucuccaccaagg

SEQ ID NO: 607704 - RNA, 21 nt, Human
ccguguucugcgccacagugg

SEQ ID NO: 607705 - RNA, 24 nt, Human
ccugacagccugaaacagcaggcu

SEQ ID NO: 607706 - RNA, 23 nt, Human
ccugaccuugggugaucugcuug

SEQ ID NO: 607707 - RNA, 21 nt, Human
ccugugcacacacucacacca

SEQ ID NO: 607708 - RNA, 20 nt, Human
ccuugggucugggccuuuug

SEQ ID NO: 607709 - RNA, 24 nt, Human
ccuuuuggguuugggucccucugu

SEQ ID NO: 607710 - RNA, 20 nt, Human
cgacauucaccccacugcac

SEQ ID NO: 607711 - RNA, 22 nt, Human
cggaauccacagaaugacccac

SEQ ID NO: 607712 - RNA, 24 nt, Human
cuccaaguuggccaggcuggucuu

SEQ ID NO: 607713 - RNA, 20 nt, Human
cuccagccguguucugcgcc

SEQ ID NO: 607714 - RNA, 24 nt, Human
cucccagcaugcaugcugugacga

SEQ ID NO: 607715 - RNA, 22 nt, Human
cuccugaccuugggugaucugc

SEQ ID NO: 607716 - RNA, 18 nt, Human
cugcugccagagucccca

SEQ ID NO: 607717 - RNA, 19 nt, Human
cugugcggccaaggcaggu

SEQ ID NO: 607718 - RNA, 24 nt, Human
cuuccccauaccauggcgcuccag

SEQ ID NO: 607719 - RNA, 22 nt, Human
cuuggucucccaaagugcuggg

SEQ ID NO: 607720 - RNA, 21 nt, Human
gaacaacaugccaucaaagca

SEQ ID NO: 607721 - RNA, 18 nt, Human
gaaccaggacuggcucac

SEQ ID NO: 607722 - RNA, 18 nt, Human
gagcaagcuugagucucc

SEQ ID NO: 607723 - RNA, 19 nt, Human
gagcaggcuugggucccca

SEQ ID NO: 607724 - RNA, 20 nt, Human
gagcugggguuucuccaagu

SEQ ID NO: 607725 - RNA, 22 nt, Human
gaggaaccuugggucucaggag

SEQ ID NO: 607726 - RNA, 18 nt, Human
gauuacgggcaugagcca

SEQ ID NO: 607727 - RNA, 19 nt, Human
gauuacgggcaugagccac

SEQ ID NO: 607728 - RNA, 21 nt, Human
gauuacgggcaugagccacug

SEQ ID NO: 607729 - RNA, 19 nt, Human
gcacugaggccucucaaaa

SEQ ID NO: 607730 - RNA, 24 nt, Human
gcaguuccaggcaggugccggcca

SEQ ID NO: 607731 - RNA, 22 nt, Human
gccacagcagcaucacagccuu

SEQ ID NO: 607732 - RNA, 22 nt, Human
gcuaugaugacuccagccgugu

SEQ ID NO: 607733 - RNA, 18 nt, Human
ggaagaccgacugccagg

SEQ ID NO: 607734 - RNA, 19 nt, Human
ggcccaaggcucaguuccc

SEQ ID NO: 607735 - RNA, 23 nt, Human
ggcuggucuugaacuccugaccu

SEQ ID NO: 607736 - RNA, 18 nt, Human
gggaagguggcgcccuuu

SEQ ID NO: 607737 - RNA, 22 nt, Human
ggguuucuccaaguuggccagg

SEQ ID NO: 607738 - RNA, 19 nt, Human
ggucuugaacuccugaccu

SEQ ID NO: 607739 - RNA, 21 nt, Human
ggugggcugccagagacaugu

SEQ ID NO: 607740 - RNA, 22 nt, Human
gguuccaccuguccuuccccau

SEQ ID NO: 607741 - RNA, 19 nt, Human
gucuuggucucccaaagug

SEQ ID NO: 607742 - RNA, 21 nt, Human
guggagccaagggacagccuc

SEQ ID NO: 607743 - RNA, 24 nt, Human
uaacuauauuuauauauaaauccc

SEQ ID NO: 607744 - RNA, 19 nt, Human
uaaugguaaaugugauuca

SEQ ID NO: 607745 - RNA, 24 nt, Human
uaaugguaaaugugauucagucuc

SEQ ID NO: 607746 - RNA, 19 nt, Human
uacacgcauucacauccau

SEQ ID NO: 607747 - RNA, 21 nt, Human
uacacugaacaacaugccauu

SEQ ID NO: 607748 - RNA, 18 nt, Human
uaccccaggggcuucugc

SEQ ID NO: 607749 - RNA, 23 nt, Human
uaccccaggggcuucugcuucac

SEQ ID NO: 607750 - RNA, 24 nt, Human
uacgggcaugagccacugcuccug

SEQ ID NO: 607751 - RNA, 21 nt, Human
uagaaagccacagcagcauca

SEQ ID NO: 607752 - RNA, 18 nt, Human
uagaaggaucuguugugg

SEQ ID NO: 607753 - RNA, 22 nt, Human
ucacaccauaguguacacuggu

SEQ ID NO: 607754 - RNA, 23 nt, Human
ucaguucccugggccagugccuc

SEQ ID NO: 607755 - RNA, 23 nt, Human
uccaacaucacaaacuccuuguc

SEQ ID NO: 607756 - RNA, 24 nt, Human
uccaaugcauaagcaaguuccaaa

SEQ ID NO: 607757 - RNA, 25 nt, Human
uccacaguggcacugccugcuacuu

SEQ ID NO: 607758 - RNA, 24 nt, Human
ucccaaagugcugggauuacgggc

SEQ ID NO: 607759 - RNA, 18 nt, Human
uccccaaauacuguaaaa

SEQ ID NO: 607760 - RNA, 23 nt, Human
uccccagggcccauagaaagcca

SEQ ID NO: 607761 - RNA, 20 nt, Human
uccccauaccauggcgcucc

SEQ ID NO: 607762 - RNA, 18 nt, Human
ucccugagaagguagcug

SEQ ID NO: 607763 - RNA, 20 nt, Human
ucccuguuucuuucaaaaac

SEQ ID NO: 607764 - RNA, 24 nt, Human
ucuccaaguuggccaggcuggucu

SEQ ID NO: 607765 - RNA, 22 nt, Human
ucucuggguugcauuucaucau

SEQ ID NO: 607766 - RNA, 21 nt, Human
ucugcgccacaguggguggag

SEQ ID NO: 607767 - RNA, 23 nt, Human
ucuugaacuccugaccuugggug

SEQ ID NO: 607768 - RNA, 23 nt, Human
ugacagcagggagagaagcgaaa

SEQ ID NO: 607769 - RNA, 18 nt, Human
ugaggccucucaaaaucc

SEQ ID NO: 607770 - RNA, 27 nt, Human
ugaggcuucugggucaacacucccuuu

SEQ ID NO: 607771 - RNA, 21 nt, Human
ugaguacacacacuuaggcuc

SEQ ID NO: 607772 - RNA, 20 nt, Human
ugagucuccgggcacaucuc

SEQ ID NO: 607773 - RNA, 24 nt, Human
ugaguuucaacugagucacuggaa

SEQ ID NO: 607774 - RNA, 22 nt, Human
ugcacaaaucccuggggagugu

SEQ ID NO: 607775 - RNA, 18 nt, Human
ugcacacacucacaccau

SEQ ID NO: 607776 - RNA, 25 nt, Human
ugcacucaucaucaucaaugugacu

SEQ ID NO: 607777 - RNA, 18 nt, Human
ugcggaauccacagaaug

SEQ ID NO: 607778 - RNA, 21 nt, Human
uggaaacaaauaaaugaaagc

SEQ ID NO: 607779 - RNA, 23 nt, Human
uggagugcucacaguggguccuc

SEQ ID NO: 607780 - RNA, 22 nt, Human
uggcaacccaccaagggucaga

SEQ ID NO: 607781 - RNA, 24 nt, Human
uggccaggcuggucuugaacuccu

SEQ ID NO: 607782 - RNA, 23 nt, Human
ugggaagguggcgcccuuugugg

SEQ ID NO: 607783 - RNA, 19 nt, Human
ugggauuacgggcaugagc

SEQ ID NO: 607784 - RNA, 22 nt, Human
ugggauuacgggcaugagccac

SEQ ID NO: 607785 - RNA, 22 nt, Human
ugggauuacgggcaugagccac

SEQ ID NO: 607786 - RNA, 23 nt, Human
ugggauuacgggcaugagccacu

SEQ ID NO: 607787 - RNA, 24 nt, Human
ugggauuacgggcaugagccacug

SEQ ID NO: 607788 - RNA, 20 nt, Human
ugggguagaaaccaaggacc

SEQ ID NO: 607789 - RNA, 24 nt, Human
ugggguuucuccaaguuggccagg

SEQ ID NO: 607790 - RNA, 21 nt, Human
uggguggagugcucacagugg

SEQ ID NO: 607791 - RNA, 21 nt, Human
uggguuugggucccucugugc

SEQ ID NO: 607792 - RNA, 18 nt, Human
ugugacuguuguuuuaga

SEQ ID NO: 607793 - RNA, 27 nt, Human
ugugcacacacucacaccauaguguac

SEQ ID NO: 607794 - RNA, 19 nt, Human
uguggucaggguuccaccu

SEQ ID NO: 607795 - RNA, 21 nt, Human
uguuaaugaaggaaccuguga

SEQ ID NO: 607796 - RNA, 27 nt, Human
uuacucaaaucaauucagguagugugu

SEQ ID NO: 607797 - RNA, 19 nt, Human
uuagagcugcagcucucca

SEQ ID NO: 607798 - RNA, 24 nt, Human
uuccaaugcauaagcaaguuccaa

SEQ ID NO: 607799 - RNA, 18 nt, Human
uugcauccuuuucaggcc

SEQ ID NO: 607800 - RNA, 24 nt, Human
aaaccaccaaagcacaccuaacaa

SEQ ID NO: 607801 - RNA, 18 nt, Human
aacaaguuuacugcuuca

SEQ ID NO: 607802 - RNA, 19 nt, Human
aacaaguuuacugcuucag

SEQ ID NO: 607803 - RNA, 24 nt, Human
aaccguaacaguggagcagcugcc

SEQ ID NO: 607804 - RNA, 24 nt, Human
aaggaaaaacaacaguacguaaug

SEQ ID NO: 607805 - RNA, 21 nt, Human
aaugauaaagaaauguagaga

SEQ ID NO: 607806 - RNA, 23 nt, Human
aauguagagacaacccuagggga

SEQ ID NO: 607807 - RNA, 19 nt, Human
aauuacacugaagaaaaca

SEQ ID NO: 607808 - RNA, 21 nt, Human
aauuaccaagaacaauuacac

SEQ ID NO: 607809 - RNA, 22 nt, Human
acacaaccccccccauuucccc

SEQ ID NO: 607810 - RNA, 23 nt, Human
acacacacacacacacacacaca

SEQ ID NO: 607811 - RNA, 18 nt, Human
acgcugcggaggcagcag

SEQ ID NO: 607812 - RNA, 24 nt, Human
acuaucaauuugacugcaugcauc

SEQ ID NO: 607813 - RNA, 21 nt, Human
acucuucccacacaacccccc

SEQ ID NO: 607814 - RNA, 23 nt, Human
acucuucccacacaacccccccc

SEQ ID NO: 607815 - RNA, 24 nt, Human
acucuucccacacaacccccccca

SEQ ID NO: 607816 - RNA, 26 nt, Human
agagaacagguagaguuugaggcuca

SEQ ID NO: 607817 - RNA, 22 nt, Human
agcuggggggacgcugcggagg

SEQ ID NO: 607818 - RNA, 21 nt, Human
aguacguaaugaaaaaagcaa

SEQ ID NO: 607819 - RNA, 21 nt, Human
auacauguacaugcagcaaga

SEQ ID NO: 607820 - RNA, 21 nt, Human
auguacaugcagcaagaugug

SEQ ID NO: 607821 - RNA, 23 nt, Human
caaaugaaaaacacacacugaca

SEQ ID NO: 607822 - RNA, 21 nt, Human
caagaacaauuacacugaaga

SEQ ID NO: 607823 - RNA, 19 nt, Human
caauuugacugcaugcauc

SEQ ID NO: 607824 - RNA, 22 nt, Human
cacaaccccccccauuucccca

SEQ ID NO: 607825 - RNA, 20 nt, Human
cacaauaauauuaaaaccac

SEQ ID NO: 607826 - RNA, 21 nt, Human
cacacaaucucacagucacau

SEQ ID NO: 607827 - RNA, 20 nt, Human
cacacacacacacacacaca

SEQ ID NO: 607828 - RNA, 20 nt, Human
cacacacacacacacacaca

SEQ ID NO: 607829 - RNA, 20 nt, Human
cacacacacacacacacaca

SEQ ID NO: 607830 - RNA, 29 nt, Human
cacacacacacacacacacacacagagua

SEQ ID NO: 607831 - RNA, 27 nt, Human
cacacacacacacagaguaguuaaaua

SEQ ID NO: 607832 - RNA, 19 nt, Human
cagcuaaacccuacccacu

SEQ ID NO: 607833 - RNA, 22 nt, Human
cauguacaugcagcaagaugug

SEQ ID NO: 607834 - RNA, 23 nt, Human
cccaacuaauccuucugauuugc

SEQ ID NO: 607835 - RNA, 28 nt, Human
cccacacaaccccccccauuuccccauc

SEQ ID NO: 607836 - RNA, 22 nt, Human
ccccaagauaaauaaaucaaau

SEQ ID NO: 607837 - RNA, 19 nt, Human
ccccagcuaaacccuaccc

SEQ ID NO: 607838 - RNA, 21 nt, Human
ccccagcuaaacccuacccac

SEQ ID NO: 607839 - RNA, 18 nt, Human
cccccauuuccccauccc

SEQ ID NO: 607840 - RNA, 28 nt, Human
cccccccauuuccccaucccuggcacaa

SEQ ID NO: 607841 - RNA, 22 nt, Human
ccguauacauguacaugcagug

SEQ ID NO: 607842 - RNA, 20 nt, Human
cgcacacacacacacacaca

SEQ ID NO: 607843 - RNA, 20 nt, Human
cucugcuugugugugcguga

SEQ ID NO: 607844 - RNA, 22 nt, Human
cuucccacacaaccccccccau

SEQ ID NO: 607845 - RNA, 21 nt, Human
cuugugugugcgugagugugu

SEQ ID NO: 607846 - RNA, 23 nt, Human
gaaugagagaaauaaaacagaga

SEQ ID NO: 607847 - RNA, 24 nt, Human
gagaauaguggaagugaggcaacc

SEQ ID NO: 607848 - RNA, 23 nt, Human
gcacacacacacacacacacaca

SEQ ID NO: 607849 - RNA, 19 nt, Human
gcacaccuaacaaggaaaa

SEQ ID NO: 607850 - RNA, 23 nt, Human
gcacaccuaacaaggaaaaacaa

SEQ ID NO: 607851 - RNA, 21 nt, Human
gcacagggagagcugggggga

SEQ ID NO: 607852 - RNA, 22 nt, Human
gcagcaggcagcuagaaugaca

SEQ ID NO: 607853 - RNA, 23 nt, Human
gcuggggggacgcugcggaggca

SEQ ID NO: 607854 - RNA, 22 nt, Human
gcuugugugugcgugagugugu

SEQ ID NO: 607855 - RNA, 19 nt, Human
ggaagguccacucuuugca

SEQ ID NO: 607856 - RNA, 22 nt, Human
ggaagugaggcaacuuugggcu

SEQ ID NO: 607857 - RNA, 24 nt, Human
ggagcagcugccaaauccugguug

SEQ ID NO: 607858 - RNA, 21 nt, Human
guagccguauacauguacaug

SEQ ID NO: 607859 - RNA, 21 nt, Human
guccacucuuugcacuuccac

SEQ ID NO: 607860 - RNA, 22 nt, Human
gucccaacuaauccuucugauu

SEQ ID NO: 607861 - RNA, 19 nt, Human
gugcaggauuaguucaaga

SEQ ID NO: 607862 - RNA, 23 nt, Human
gugcgcacacacacacacacaca

SEQ ID NO: 607863 - RNA, 22 nt, Human
uaaacaacuguuggacuagagc

SEQ ID NO: 607864 - RNA, 27 nt, Human
uaacaaggaaaaacaacaguacguaau

SEQ ID NO: 607865 - RNA, 28 nt, Human
uaacaaggaaaaacaacaguacguaaug

SEQ ID NO: 607866 - RNA, 25 nt, Human
uaauauuaaaaccaccaaagcacac

SEQ ID NO: 607867 - RNA, 22 nt, Human
uacugcuucaguuucaaacugu

SEQ ID NO: 607868 - RNA, 18 nt, Human
uagcacagggagagcugg

SEQ ID NO: 607869 - RNA, 19 nt, Human
uagcacagggagagcuggg

SEQ ID NO: 607870 - RNA, 24 nt, Human
uagcauauagauguacacaagcca

SEQ ID NO: 607871 - RNA, 20 nt, Human
ucaagaucagcgccuucucu

SEQ ID NO: 607872 - RNA, 20 nt, Human
ucagugaagaaucaguaaga

SEQ ID NO: 607873 - RNA, 22 nt, Human
ucaguguccgaaauugaauguu

SEQ ID NO: 607874 - RNA, 19 nt, Human
uccaaggugcaggcaguua

SEQ ID NO: 607875 - RNA, 22 nt, Human
ucccacacaaccccccccauuu

SEQ ID NO: 607876 - RNA, 20 nt, Human
ugaaaaagaugucuggaaac

SEQ ID NO: 607877 - RNA, 21 nt, Human
ugaaagaaugagagaaauaaa

SEQ ID NO: 607878 - RNA, 25 nt, Human
ugcgcacacacacacacacacacac

SEQ ID NO: 607879 - RNA, 22 nt, Human
ugcuggaaucaaucuauaaagg

SEQ ID NO: 607880 - RNA, 18 nt, Human
uggaaucaaucuauaaag

SEQ ID NO: 607881 - RNA, 23 nt, Human
uggagcagcugccaaauccuggu

SEQ ID NO: 607882 - RNA, 23 nt, Human
uggggggacgcugcggaggcagc

SEQ ID NO: 607883 - RNA, 18 nt, Human
ugucauggacgcaacugc

SEQ ID NO: 607884 - RNA, 20 nt, Human
ugugagaguugccccagagu

SEQ ID NO: 607885 - RNA, 18 nt, Human
ugugcgcgugcgcgcgug

SEQ ID NO: 607886 - RNA, 24 nt, Human
ugugcgcgugcgcgcgugcgcaca

SEQ ID NO: 607887 - RNA, 22 nt, Human
ugugugcgcgugcgcgcgugcg

SEQ ID NO: 607888 - RNA, 22 nt, Human
ugugugcgcgugcgcgcgugcg

SEQ ID NO: 607889 - RNA, 28 nt, Human
ugugugcgugagugugugcgcgugcgcg

SEQ ID NO: 607890 - RNA, 20 nt, Human
ugugugugcgugagugugug

SEQ ID NO: 607891 - RNA, 21 nt, Human
ugugugugcgugagugugugc

SEQ ID NO: 607892 - RNA, 18 nt, Human
uuaaaaccaccaaagcac

SEQ ID NO: 607893 - RNA, 21 nt, Human
uuacugcuucaguuucaaacu

SEQ ID NO: 607894 - RNA, 24 nt, Human
uucccacacacaaucucacaguca

SEQ ID NO: 607895 - RNA, 22 nt, Human
uucccccagcuaaacccuaccc

SEQ ID NO: 607896 - RNA, 23 nt, Human
uugaauguuuuuuuuuuucuccu

SEQ ID NO: 607897 - RNA, 24 nt, Human
aaagugcugggauuacaggcguga

SEQ ID NO: 607898 - RNA, 20 nt, Human
aacaucuucaaagaguuuca

SEQ ID NO: 607899 - RNA, 18 nt, Human
aagaaugacccaggaacc

SEQ ID NO: 607900 - RNA, 22 nt, Human
aagaaugacccaggaacccuga

SEQ ID NO: 607901 - RNA, 18 nt, Human
aagagugacccaggagcc

SEQ ID NO: 607902 - RNA, 18 nt, Human
aaggccugggcggcagga

SEQ ID NO: 607903 - RNA, 19 nt, Human
aagugcugggauuacaggc

SEQ ID NO: 607904 - RNA, 19 nt, Human
aagugcugggauuacaggc

SEQ ID NO: 607905 - RNA, 26 nt, Human
aagugcugggauuacaggcgugagcc

SEQ ID NO: 607906 - RNA, 19 nt, Human
acaggguuucaccguguua

SEQ ID NO: 607907 - RNA, 20 nt, Human
acaggguuucaccguguuag

SEQ ID NO: 607908 - RNA, 21 nt, Human
acaggguuucaccguguuagc

SEQ ID NO: 607909 - RNA, 24 nt, Human
acaggguuucaccguguuagccag

SEQ ID NO: 607910 - RNA, 22 nt, Human
acccccacccccggccccaggc

SEQ ID NO: 607911 - RNA, 20 nt, Human
acccugagaaggcccaagag

SEQ ID NO: 607912 - RNA, 21 nt, Human
acccugagaaggcccaagagu

SEQ ID NO: 607913 - RNA, 24 nt, Human
accguguuagccagguuggucucg

SEQ ID NO: 607914 - RNA, 21 nt, Human
accuccaaggccugggcggca

SEQ ID NO: 607915 - RNA, 25 nt, Human
accucccagguucacaccauucucc

SEQ ID NO: 607916 - RNA, 20 nt, Human
acugcaagcuccaccuccca

SEQ ID NO: 607917 - RNA, 18 nt, Human
agaaggaaggacgcugcc

SEQ ID NO: 607918 - RNA, 20 nt, Human
agaccggaaggcucagggug

SEQ ID NO: 607919 - RNA, 22 nt, Human
agagggcgaggggacauagagc

SEQ ID NO: 607920 - RNA, 21 nt, Human
agagugacccaggagcccuca

SEQ ID NO: 607921 - RNA, 22 nt, Human
agcagccuggggaacgcuuucc

SEQ ID NO: 607922 - RNA, 22 nt, Human
agccccauuccgggagggugac

SEQ ID NO: 607923 - RNA, 22 nt, Human
agcccugcagcccccccacccc

SEQ ID NO: 607924 - RNA, 19 nt, Human
agcgacaggguuucaccgu

SEQ ID NO: 607925 - RNA, 18 nt, Human
agcgggaggggccgcucg

SEQ ID NO: 607926 - RNA, 22 nt, Human
aggcucccagcaggaggcgucu

SEQ ID NO: 607927 - RNA, 25 nt, Human
aggcuggagugcaguagugugaucu

SEQ ID NO: 607928 - RNA, 23 nt, Human
aguaccuccaaggccugggcggc

SEQ ID NO: 607929 - RNA, 18 nt, Human
aguagcugggacuacagg

SEQ ID NO: 607930 - RNA, 19 nt, Human
aguagcugggacuacaggc

SEQ ID NO: 607931 - RNA, 21 nt, Human
agucaggagaggcgcagccgu

SEQ ID NO: 607932 - RNA, 20 nt, Human
agugcaguagugugaucucg

SEQ ID NO: 607933 - RNA, 24 nt, Human
agugcaguagugugaucucggcuc

SEQ ID NO: 607934 - RNA, 19 nt, Human
auagagcccuguguagggg

SEQ ID NO: 607935 - RNA, 20 nt, Human
auguaggggcugcggggggc

SEQ ID NO: 607936 - RNA, 21 nt, Human
auucuccugccucagccuccc

SEQ ID NO: 607937 - RNA, 24 nt, Human
caaagugcugggauuacaggcgug

SEQ ID NO: 607938 - RNA, 23 nt, Human
caagaggguguaaguuccaagaa

SEQ ID NO: 607939 - RNA, 22 nt, Human
cacaccauucuccugccucagc

SEQ ID NO: 607940 - RNA, 18 nt, Human
cacaccauuguucucagg

SEQ ID NO: 607941 - RNA, 18 nt, Human
cacccccuuccuccaccc

SEQ ID NO: 607942 - RNA, 20 nt, Human
cacccccuuccuccacccag

SEQ ID NO: 607943 - RNA, 19 nt, Human
cacccccuuccuccaccuc

SEQ ID NO: 607944 - RNA, 21 nt, Human
caccguguuagccagguuggu

SEQ ID NO: 607945 - RNA, 24 nt, Human
caccguguuagccagguuggucuc

SEQ ID NO: 607946 - RNA, 20 nt, Human
caccucucacgcccagaccu

SEQ ID NO: 607947 - RNA, 21 nt, Human
cacugcaagcuccaccuccca

SEQ ID NO: 607948 - RNA, 24 nt, Human
cagcaacaaacguucuccugagca

SEQ ID NO: 607949 - RNA, 18 nt, Human
cagcaguaccuccaaggc

SEQ ID NO: 607950 - RNA, 19 nt, Human
cagcccccccacccccacc

SEQ ID NO: 607951 - RNA, 22 nt, Human
cagcccccccacccccaccccc

SEQ ID NO: 607952 - RNA, 24 nt, Human
cagcguguagccuccucccaggau

SEQ ID NO: 607953 - RNA, 19 nt, Human
caggagaggcgcagccgug

SEQ ID NO: 607954 - RNA, 18 nt, Human
caggagcccucagauggc

SEQ ID NO: 607955 - RNA, 21 nt, Human
caggcgcccgccaccacgccc

SEQ ID NO: 607956 - RNA, 21 nt, Human
cagggcagggggagcacaggg

SEQ ID NO: 607957 - RNA, 24 nt, Human
caggguuucaccguguuagccagg

SEQ ID NO: 607958 - RNA, 19 nt, Human
cagguggguaugggagggg

SEQ ID NO: 607959 - RNA, 22 nt, Human
cauuccgggagggugacugucc

SEQ ID NO: 607960 - RNA, 20 nt, Human
ccaaagugcugggauuacag

SEQ ID NO: 607961 - RNA, 22 nt, Human
ccaaagugcugggauuacaggc

SEQ ID NO: 607962 - RNA, 22 nt, Human
ccaaagugcugggauuacaggc

SEQ ID NO: 607963 - RNA, 24 nt, Human
ccaaagugcugggauuacaggcgu

SEQ ID NO: 607964 - RNA, 19 nt, Human
ccaagaacgcgagucucug

SEQ ID NO: 607965 - RNA, 19 nt, Human
ccagggcagggggagcaca

SEQ ID NO: 607966 - RNA, 20 nt, Human
ccauggagaccggaaggcuc

SEQ ID NO: 607967 - RNA, 21 nt, Human
cccacacgcggugugucccug

SEQ ID NO: 607968 - RNA, 21 nt, Human
cccacaggccuuggaucucug

SEQ ID NO: 607969 - RNA, 22 nt, Human
cccacccccacccccggcccca

SEQ ID NO: 607970 - RNA, 22 nt, Human
cccacccccggccccaggcagc

SEQ ID NO: 607971 - RNA, 23 nt, Human
cccaggcagcaguaccuccaagg

SEQ ID NO: 607972 - RNA, 22 nt, Human
cccagggcagggggagcacagg

SEQ ID NO: 607973 - RNA, 20 nt, Human
cccagguucacaccauucuc

SEQ ID NO: 607974 - RNA, 19 nt, Human
ccccacccccggccccagg

SEQ ID NO: 607975 - RNA, 23 nt, Human
cccccacccccacccccggcccc

SEQ ID NO: 607976 - RNA, 23 nt, Human
ccccccacccccacccccggccc

SEQ ID NO: 607977 - RNA, 28 nt, Human
ccccccacccccacccccggccccaggc

SEQ ID NO: 607978 - RNA, 23 nt, Human
cccgaguagcugggacuacaggc

SEQ ID NO: 607979 - RNA, 24 nt, Human
cccgaguagcugggacuacaggcg

SEQ ID NO: 607980 - RNA, 21 nt, Human
cccgccaccacgcccagcuaa

SEQ ID NO: 607981 - RNA, 18 nt, Human
cccuuggcuugugguggc

SEQ ID NO: 607982 - RNA, 26 nt, Human
ccgcccgccucagccucccaaagugc

SEQ ID NO: 607983 - RNA, 24 nt, Human
ccgccucagccucccaaagugcug

SEQ ID NO: 607984 - RNA, 25 nt, Human
ccggagcaggaggguggcugucuuu

SEQ ID NO: 607985 - RNA, 18 nt, Human
ccucccuccgugccggag

SEQ ID NO: 607986 - RNA, 22 nt, Human
ccuccgugccggaggcuggugg

SEQ ID NO: 607987 - RNA, 25 nt, Human
ccucucacgcccagaccucccuugg

SEQ ID NO: 607988 - RNA, 18 nt, Human
cgcccagaccucccuugg

SEQ ID NO: 607989 - RNA, 24 nt, Human
cggagucuugcuuugucgcccagg

SEQ ID NO: 607990 - RNA, 20 nt, Human
cgguuggaaggugacugccc

SEQ ID NO: 607991 - RNA, 24 nt, Human
cgugauccgcccgccucagccucc

SEQ ID NO: 607992 - RNA, 24 nt, Human
cguggcccacaggccuuggaucuc

SEQ ID NO: 607993 - RNA, 24 nt, Human
cucacugcaagcuccaccucccag

SEQ ID NO: 607994 - RNA, 24 nt, Human
cucagccucccgaguagcugggac

SEQ ID NO: 607995 - RNA, 23 nt, Human
cucaggguggguaaaaauagcaa

SEQ ID NO: 607996 - RNA, 22 nt, Human
cucccugggugcuaaauccugg

SEQ ID NO: 607997 - RNA, 22 nt, Human
cucccuuggcuugugguggccu

SEQ ID NO: 607998 - RNA, 24 nt, Human
cuccugaccucgugauccgcccgc

SEQ ID NO: 607999 - RNA, 21 nt, Human
cugcaagcacgcucccuuccu

SEQ ID NO: 608000 - RNA, 24 nt, Human
cugcaagcuccaccucccagguuc

SEQ ID NO: 608001 - RNA, 23 nt, Human
cugccucagccucccgaguagcu

SEQ ID NO: 608002 - RNA, 20 nt, Human
cuggaaucugcuguuuggag

SEQ ID NO: 608003 - RNA, 19 nt, Human
cuggcuugcagccacccac

SEQ ID NO: 608004 - RNA, 19 nt, Human
cuugcagccacccacacgc

SEQ ID NO: 608005 - RNA, 22 nt, Human
cuuggcuugugguggccuugac

SEQ ID NO: 608006 - RNA, 20 nt, Human
cuuugucgcccaggcuggag

SEQ ID NO: 608007 - RNA, 25 nt, Human
gacccaggagcccucagauggccca

SEQ ID NO: 608008 - RNA, 18 nt, Human
gaccucccuuggcuugug

SEQ ID NO: 608009 - RNA, 22 nt, Human
gaccucgugauccgcccgccuc

SEQ ID NO: 608010 - RNA, 24 nt, Human
gaccucgugauccgcccgccucag

SEQ ID NO: 608011 - RNA, 25 nt, Human
gacggagucuugcuuugucgcccag

SEQ ID NO: 608012 - RNA, 18 nt, Human
gagaaggaaggacgcugc

SEQ ID NO: 608013 - RNA, 21 nt, Human
gagcuuuguccccgcgcaggg

SEQ ID NO: 608014 - RNA, 25 nt, Human
gaggacagagggcccaggcugggag

SEQ ID NO: 608015 - RNA, 20 nt, Human
gagggauccagggugauucc

SEQ ID NO: 608016 - RNA, 25 nt, Human
gaguagcugggacuacaggcgcccg

SEQ ID NO: 608017 - RNA, 23 nt, Human
gauccggagcaggaggguggcug

SEQ ID NO: 608018 - RNA, 18 nt, Human
gauuacaggcgugagcca

SEQ ID NO: 608019 - RNA, 22 nt, Human
gauuacaggcgugagccacugc

SEQ ID NO: 608020 - RNA, 22 nt, Human
gauuacaggcgugagccacugc

SEQ ID NO: 608021 - RNA, 18 nt, Human
gcaagcuccaccucccag

SEQ ID NO: 608022 - RNA, 21 nt, Human
gcagcccccccacccccaccc

SEQ ID NO: 608023 - RNA, 23 nt, Human
gcagcccccccacccccaccccc

SEQ ID NO: 608024 - RNA, 19 nt, Human
gcagggcacccccuuccuc

SEQ ID NO: 608025 - RNA, 24 nt, Human
gcagggcacccccuuccuccaccc

SEQ ID NO: 608026 - RNA, 24 nt, Human
gccaggcagguugcugucucagcg

SEQ ID NO: 608027 - RNA, 19 nt, Human
gcccaggcuggagugcagu

SEQ ID NO: 608028 - RNA, 19 nt, Human
gcccccccacccccacccc

SEQ ID NO: 608029 - RNA, 21 nt, Human
gcccugcagcccccccacccc

SEQ ID NO: 608030 - RNA, 20 nt, Human
gcccuguguagggguuucuc

SEQ ID NO: 608031 - RNA, 18 nt, Human
gccgccuggaaucugcug

SEQ ID NO: 608032 - RNA, 23 nt, Human
gccucagccucccaaagugcugg

SEQ ID NO: 608033 - RNA, 20 nt, Human
gccucagccucccgaguagc

SEQ ID NO: 608034 - RNA, 21 nt, Human
gcugggagucuagcgggaggg

SEQ ID NO: 608035 - RNA, 24 nt, Human
ggaagcccugcagcccccccaccc

SEQ ID NO: 608036 - RNA, 23 nt, Human
ggagucuugcuuugucgcccagg

SEQ ID NO: 608037 - RNA, 18 nt, Human
ggcgggcguggcaggcuc

SEQ ID NO: 608038 - RNA, 21 nt, Human
gggcuucccaggccaggcagg

SEQ ID NO: 608039 - RNA, 23 nt, Human
ggggagggauccagggugauucc

SEQ ID NO: 608040 - RNA, 19 nt, Human
gggggagcaccaggugggu

SEQ ID NO: 608041 - RNA, 18 nt, Human
ggguaugggagggggcca

SEQ ID NO: 608042 - RNA, 20 nt, Human
ggguaugggagggggccagg

SEQ ID NO: 608043 - RNA, 20 nt, Human
ggucucgaucuccugaccuc

SEQ ID NO: 608044 - RNA, 21 nt, Human
gugagccacugcgccaagagc

SEQ ID NO: 608045 - RNA, 24 nt, Human
gugauccgcccgccucagccuccc

SEQ ID NO: 608046 - RNA, 21 nt, Human
gugaucucggcucacugcaag

SEQ ID NO: 608047 - RNA, 22 nt, Human
guggggagggauccagggugau

SEQ ID NO: 608048 - RNA, 19 nt, Human
uaaaaauagcaaacccaag

SEQ ID NO: 608049 - RNA, 24 nt, Human
uacaggcgcccgccaccacgccca

SEQ ID NO: 608050 - RNA, 19 nt, Human
uacaggcgugagccacugc

SEQ ID NO: 608051 - RNA, 23 nt, Human
uacaggcgugagccacugcgcca

SEQ ID NO: 608052 - RNA, 21 nt, Human
uaccuccaaggccugggcggc

SEQ ID NO: 608053 - RNA, 24 nt, Human
uagccagguuggucucgaucuccu

SEQ ID NO: 608054 - RNA, 24 nt, Human
uaggagcgacaggguuucaccgug

SEQ ID NO: 608055 - RNA, 21 nt, Human
ucacaccauucuccugccuca

SEQ ID NO: 608056 - RNA, 24 nt, Human
ucaccguguuagccagguuggucu

SEQ ID NO: 608057 - RNA, 19 nt, Human
ucacugcaagcuccaccuc

SEQ ID NO: 608058 - RNA, 24 nt, Human
ucacugcaagcuccaccucccagg

SEQ ID NO: 608059 - RNA, 23 nt, Human
ucagccucccgaguagcugggac

SEQ ID NO: 608060 - RNA, 24 nt, Human
ucccaaagugcugggauuacaggc

SEQ ID NO: 608061 - RNA, 24 nt, Human
ucccagccccgagaaaggaagccc

SEQ ID NO: 608062 - RNA, 20 nt, Human
ucccagguucacaccauucu

SEQ ID NO: 608063 - RNA, 21 nt, Human
ucccagguucacaccauucuc

SEQ ID NO: 608064 - RNA, 24 nt, Human
ucccagguucacaccauucuccug

SEQ ID NO: 608065 - RNA, 20 nt, Human
uccccgagcgggggggugac

SEQ ID NO: 608066 - RNA, 24 nt, Human
ucccgaguagcugggacuacaggc

SEQ ID NO: 608067 - RNA, 25 nt, Human
ucccgcagagcugcuccaaggggcc

SEQ ID NO: 608068 - RNA, 21 nt, Human
uccgcccgccucagccuccca

SEQ ID NO: 608069 - RNA, 24 nt, Human
ucgcccaggcuggagugcaguagu

SEQ ID NO: 608070 - RNA, 24 nt, Human
ucuccugccucagccucccgagua

SEQ ID NO: 608071 - RNA, 23 nt, Human
ucuugcuuugucgcccaggcugg

SEQ ID NO: 608072 - RNA, 24 nt, Human
ucuugcuuugucgcccaggcugga

SEQ ID NO: 608073 - RNA, 24 nt, Human
ugacccaggaacccugagaaggcc

SEQ ID NO: 608074 - RNA, 23 nt, Human
ugacuguccccgagcaggggggu

SEQ ID NO: 608075 - RNA, 23 nt, Human
ugacuguccccgagcaggggggu

SEQ ID NO: 608076 - RNA, 23 nt, Human
ugacuguccccgagcggggggau

SEQ ID NO: 608077 - RNA, 23 nt, Human
ugacuguccccgagcgggggggu

SEQ ID NO: 608078 - RNA, 24 nt, Human
ugagcagccuggggaacgcuuucc

SEQ ID NO: 608079 - RNA, 20 nt, Human
ugagccacugcgccaagagc

SEQ ID NO: 608080 - RNA, 22 nt, Human
ugcaguagugugaucucggcuc

SEQ ID NO: 608081 - RNA, 26 nt, Human
ugccacagccacggagagcuuugucc

SEQ ID NO: 608082 - RNA, 24 nt, Human
ugccucagccucccgaguagcugg

SEQ ID NO: 608083 - RNA, 21 nt, Human
ugccuggaggacagagggccc

SEQ ID NO: 608084 - RNA, 24 nt, Human
ugcugggauuacaggcgugagcca

SEQ ID NO: 608085 - RNA, 22 nt, Human
ugcugugggguucccgcagagc

SEQ ID NO: 608086 - RNA, 24 nt, Human
uggaacaucuucaaagaguuucag

SEQ ID NO: 608087 - RNA, 21 nt, Human
uggaaucugcuguuuggaggc

SEQ ID NO: 608088 - RNA, 19 nt, Human
uggagugcaguagugugau

SEQ ID NO: 608089 - RNA, 23 nt, Human
uggagugcaguagugugaucucg

SEQ ID NO: 608090 - RNA, 24 nt, Human
uggagugcaguagugugaucucgg

SEQ ID NO: 608091 - RNA, 22 nt, Human
uggcaggcucccagcaggaggc

SEQ ID NO: 608092 - RNA, 19 nt, Human
uggcccaagagcaccccga

SEQ ID NO: 608093 - RNA, 21 nt, Human
ugggacuacaggcgcccgcca

SEQ ID NO: 608094 - RNA, 22 nt, Human
ugggacuacaggcgcccgccac

SEQ ID NO: 608095 - RNA, 24 nt, Human
ugggacuacaggcgcccgccacca

SEQ ID NO: 608096 - RNA, 18 nt, Human
ugggauuacaggcgugag

SEQ ID NO: 608097 - RNA, 19 nt, Human
ugggauuacaggcgugagc

SEQ ID NO: 608098 - RNA, 22 nt, Human
ugggauuacaggcgugagccac

SEQ ID NO: 608099 - RNA, 22 nt, Human
ugggauuacaggcgugagccac

SEQ ID NO: 608100 - RNA, 24 nt, Human
ugggauuacaggcgugagccacug

SEQ ID NO: 608101 - RNA, 26 nt, Human
ugggauuacaggcgugagccacugcg

SEQ ID NO: 608102 - RNA, 30 nt, Human
ugggauuacaggcgugagccacugcgccaa

SEQ ID NO: 608103 - RNA, 22 nt, Human
uggggagggauccagggugauu

SEQ ID NO: 608104 - RNA, 24 nt, Human
uuaggagcgacaggguuucaccgu

SEQ ID NO: 608105 - RNA, 25 nt, Human
uucccagccccgagaaaggaagccc

SEQ ID NO: 608106 - RNA, 24 nt, Human
uugcuuugucgcccaggcuggagu

SEQ ID NO: 608107 - RNA, 21 nt, Human
uugggggagcaccaggugggu

SEQ ID NO: 608108 - RNA, 19 nt, Human
uuucaccguguuagccagg

SEQ ID NO: 608109 - RNA, 24 nt, Human
uuugucgcccaggcuggagugcag

SEQ ID NO: 608110 - RNA, 24 nt, Human
uuuuuaggagcgacaggguuucac

SEQ ID NO: 608111 - RNA, 21 nt, Human
ccagcugcagccucuggcugu

SEQ ID NO: 608112 - RNA, 19 nt, Human
cugcagccucuggcugucc

SEQ ID NO: 608113 - RNA, 25 nt, Human
gaugcaggugaguugagcccuggca

SEQ ID NO: 608114 - RNA, 20 nt, Human
uccagcugcagccucuggcu

SEQ ID NO: 608115 - RNA, 19 nt, Human
uggcaaagagcugucagag

SEQ ID NO: 608116 - RNA, 21 nt, Human
uggcaaagagcugucagagaa

SEQ ID NO: 608117 - RNA, 23 nt, Human
aaagggacuguucugcugcggug

SEQ ID NO: 608118 - RNA, 28 nt, Human
aaugacaaaggaagagacuugggagaga

SEQ ID NO: 608119 - RNA, 25 nt, Human
acaccuggcccucggucugcccagu

SEQ ID NO: 608120 - RNA, 23 nt, Human
acagaauaugccacccggugccc

SEQ ID NO: 608121 - RNA, 21 nt, Human
acccagugggcacagaagucc

SEQ ID NO: 608122 - RNA, 20 nt, Human
acguggcaagccagcaagau

SEQ ID NO: 608123 - RNA, 25 nt, Human
acuguucugcugcggugcccuaaga

SEQ ID NO: 608124 - RNA, 22 nt, Human
agagaagacaggagaguggcua

SEQ ID NO: 608125 - RNA, 23 nt, Human
agagaugcauacuuucugggacc

SEQ ID NO: 608126 - RNA, 18 nt, Human
agagauguaaaaucccua

SEQ ID NO: 608127 - RNA, 23 nt, Human
agagguuacaggaacagcucugc

SEQ ID NO: 608128 - RNA, 21 nt, Human
aggaaagagccagugugcugg

SEQ ID NO: 608129 - RNA, 21 nt, Human
aggcuuuuaagauuagaaaug

SEQ ID NO: 608130 - RNA, 19 nt, Human
aguguccucuuucaaaaga

SEQ ID NO: 608131 - RNA, 19 nt, Human
augcauacuuucugggacc

SEQ ID NO: 608132 - RNA, 21 nt, Human
auggaauguggagaaggcccc

SEQ ID NO: 608133 - RNA, 23 nt, Human
augggcucagggcugacaauguu

SEQ ID NO: 608134 - RNA, 20 nt, Human
auguggggacagaauaugcc

SEQ ID NO: 608135 - RNA, 22 nt, Human
caaaacaaugcaaagaaaaaaa

SEQ ID NO: 608136 - RNA, 23 nt, Human
cacccaggcuugaguuuggaggc

SEQ ID NO: 608137 - RNA, 23 nt, Human
caccccaaugaccggggccugga

SEQ ID NO: 608138 - RNA, 24 nt, Human
cagagcaccccgaaaugccaucuc

SEQ ID NO: 608139 - RNA, 22 nt, Human
cagccgggcugaaggugggagg

SEQ ID NO: 608140 - RNA, 23 nt, Human
cagccgggcugaaggugggaggc

SEQ ID NO: 608141 - RNA, 21 nt, Human
cagcugucugucauuuaggag

SEQ ID NO: 608142 - RNA, 20 nt, Human
cagggccccuauuucuuguc

SEQ ID NO: 608143 - RNA, 18 nt, Human
caucugcugguuacauuu

SEQ ID NO: 608144 - RNA, 21 nt, Human
ccaacagagauccagacauga

SEQ ID NO: 608145 - RNA, 19 nt, Human
ccaaugaccggggccugga

SEQ ID NO: 608146 - RNA, 24 nt, Human
ccaucccuggcccucacaccuggc

SEQ ID NO: 608147 - RNA, 24 nt, Human
ccgccaccugugucuuucugaucu

SEQ ID NO: 608148 - RNA, 23 nt, Human
ccgcugcccaguugucagaguug

SEQ ID NO: 608149 - RNA, 21 nt, Human
ccggcggccaccguggucacc

SEQ ID NO: 608150 - RNA, 22 nt, Human
cgucacucuuucuucccugcaa

SEQ ID NO: 608151 - RNA, 19 nt, Human
cgugcgucacucuuucuuc

SEQ ID NO: 608152 - RNA, 20 nt, Human
cuaagaggaguggaugacuc

SEQ ID NO: 608153 - RNA, 27 nt, Human
cucagucagauugggaauuaaacccaa

SEQ ID NO: 608154 - RNA, 21 nt, Human
cugauuuccaaaacaaaggca

SEQ ID NO: 608155 - RNA, 21 nt, Human
cugcacccagcagcuuuggug

SEQ ID NO: 608156 - RNA, 19 nt, Human
cugcggugcccuaagagga

SEQ ID NO: 608157 - RNA, 19 nt, Human
cugggaguaaguuucuuuc

SEQ ID NO: 608158 - RNA, 18 nt, Human
cuugaacugggaguaagu

SEQ ID NO: 608159 - RNA, 23 nt, Human
gaaaaaacccacccaggcuugag

SEQ ID NO: 608160 - RNA, 18 nt, Human
gaacguggcaagccagca

SEQ ID NO: 608161 - RNA, 18 nt, Human
gacuugggagagaagaca

SEQ ID NO: 608162 - RNA, 18 nt, Human
gagagaagacaggagagu

SEQ ID NO: 608163 - RNA, 18 nt, Human
gagagaagacaggagagu

SEQ ID NO: 608164 - RNA, 25 nt, Human
gccccaaacuagggacuccaguccu

SEQ ID NO: 608165 - RNA, 24 nt, Human
gcgugcgucacucuuucuucccug

SEQ ID NO: 608166 - RNA, 23 nt, Human
gcucugaauguccucauggaugg

SEQ ID NO: 608167 - RNA, 19 nt, Human
gcugccugcacccagcagc

SEQ ID NO: 608168 - RNA, 20 nt, Human
ggaggcugggccacuccaua

SEQ ID NO: 608169 - RNA, 18 nt, Human
ggcccucggucugcccag

SEQ ID NO: 608170 - RNA, 18 nt, Human
ggcucaggaccaccacag

SEQ ID NO: 608171 - RNA, 21 nt, Human
gggcacagaaguccugcaggg

SEQ ID NO: 608172 - RNA, 20 nt, Human
ggguuuuaugugggaaggcu

SEQ ID NO: 608173 - RNA, 23 nt, Human
guagacaccccguugggccagac

SEQ ID NO: 608174 - RNA, 20 nt, Human
guggggcagaucccagcuug

SEQ ID NO: 608175 - RNA, 25 nt, Human
uaaauagagaagcgaguuacaugga

SEQ ID NO: 608176 - RNA, 21 nt, Human
uaaccaaaacaaugcaaagaa

SEQ ID NO: 608177 - RNA, 23 nt, Human
ucauggauggaauguggagaagg

SEQ ID NO: 608178 - RNA, 22 nt, Human
ucccuggcccucacaccuggcc

SEQ ID NO: 608179 - RNA, 23 nt, Human
ucccuggcccucacaccuggccc

SEQ ID NO: 608180 - RNA, 23 nt, Human
ucugccgaaaggcagagcacccc

SEQ ID NO: 608181 - RNA, 20 nt, Human
ucuuaaagcaagaguuuacc

SEQ ID NO: 608182 - RNA, 18 nt, Human
ucuuuuuuuuuuuuuuuu

SEQ ID NO: 608183 - RNA, 22 nt, Human
ugacaaaggaagagacuuggga

SEQ ID NO: 608184 - RNA, 21 nt, Human
ugacauuagaucugacagaca

SEQ ID NO: 608185 - RNA, 18 nt, Human
ugacgccaucacgcagag

SEQ ID NO: 608186 - RNA, 19 nt, Human
ugaguuuggaggcauuugu

SEQ ID NO: 608187 - RNA, 24 nt, Human
ugcaaagaaaaaaaucaauuuagu

SEQ ID NO: 608188 - RNA, 23 nt, Human
ugccuugggcuuuggcauagccu

SEQ ID NO: 608189 - RNA, 24 nt, Human
ugcugagccccaaacuagggacuc

SEQ ID NO: 608190 - RNA, 21 nt, Human
uggaauuucgaggaaagagcc

SEQ ID NO: 608191 - RNA, 20 nt, Human
uggcaagccagcaagaucuu

SEQ ID NO: 608192 - RNA, 21 nt, Human
uggcaagccagcaagaucuug

SEQ ID NO: 608193 - RNA, 18 nt, Human
ugggaaggcugggaaguu

SEQ ID NO: 608194 - RNA, 20 nt, Human
ugggaccgucuaguguccuc

SEQ ID NO: 608195 - RNA, 24 nt, Human
ugggaggcugggccacuccauagg

SEQ ID NO: 608196 - RNA, 23 nt, Human
ugggcucagggcugacaauguuu

SEQ ID NO: 608197 - RNA, 24 nt, Human
uggggcagaucccagcuuggugcu

SEQ ID NO: 608198 - RNA, 25 nt, Human
ugguagagggaaucuuagcagggcc

SEQ ID NO: 608199 - RNA, 18 nt, Human
ugucagaguugguaacuc

SEQ ID NO: 608200 - RNA, 22 nt, Human
ugucagaguugguaacucauga

SEQ ID NO: 608201 - RNA, 23 nt, Human
uuaaaaaauaugcaguuguuuga

SEQ ID NO: 608202 - RNA, 26 nt, Human
uucccugcaaauauaaggggcuccau

SEQ ID NO: 608203 - RNA, 20 nt, Human
uuucuuguccccucccuucc

SEQ ID NO: 608204 - RNA, 23 nt, Human
uuugacauuagaucugacagaca

SEQ ID NO: 608205 - RNA, 20 nt, Human
uuuuuuuuuuuuuaaaggga

SEQ ID NO: 608206 - RNA, 23 nt, Human
uuuuuuuuuuuuuuuuuaaaggg

SEQ ID NO: 608207 - RNA, 24 nt, Human
aaagugcugggauuacaggcauga

SEQ ID NO: 608208 - RNA, 23 nt, Human
aacaagccauucuagccaaagcc

SEQ ID NO: 608209 - RNA, 21 nt, Human
aagagcucuuccauccuccca

SEQ ID NO: 608210 - RNA, 22 nt, Human
aagagcucuuccauccucccag

SEQ ID NO: 608211 - RNA, 24 nt, Human
aagugaucugccugccuuggccuc

SEQ ID NO: 608212 - RNA, 19 nt, Human
aagugcugggauuacaggc

SEQ ID NO: 608213 - RNA, 21 nt, Human
aagugcugggauuacaggcau

SEQ ID NO: 608214 - RNA, 26 nt, Human
aagugcugggauuacaggcaugagcc

SEQ ID NO: 608215 - RNA, 21 nt, Human
acacauuucaccuccccugcu

SEQ ID NO: 608216 - RNA, 24 nt, Human
accauguugccugggcuggucuug

SEQ ID NO: 608217 - RNA, 18 nt, Human
accccggggcccuagccu

SEQ ID NO: 608218 - RNA, 22 nt, Human
accuggcuaggaaccuuggagc

SEQ ID NO: 608219 - RNA, 21 nt, Human
acugcuuggacuuguaccggg

SEQ ID NO: 608220 - RNA, 21 nt, Human
acuuguaccgggagggacuuc

SEQ ID NO: 608221 - RNA, 23 nt, Human
acuuguaccgggagggacuucag

SEQ ID NO: 608222 - RNA, 22 nt, Human
agaaggucaggggugggagcgc

SEQ ID NO: 608223 - RNA, 23 nt, Human
agacaacaccuggucucccuggc

SEQ ID NO: 608224 - RNA, 19 nt, Human
agacagaaaagaucugaac

SEQ ID NO: 608225 - RNA, 18 nt, Human
agagcacccaccuggcua

SEQ ID NO: 608226 - RNA, 19 nt, Human
agagcacccaccuggcuag

SEQ ID NO: 608227 - RNA, 18 nt, Human
agagcucuuccauccucc

SEQ ID NO: 608228 - RNA, 25 nt, Human
agcuagguugaucauccuggaagcu

SEQ ID NO: 608229 - RNA, 18 nt, Human
agggacacaaugcuuucu

SEQ ID NO: 608230 - RNA, 20 nt, Human
aggggaucagggcaagcugg

SEQ ID NO: 608231 - RNA, 22 nt, Human
augaagcugaggagaaggucag

SEQ ID NO: 608232 - RNA, 23 nt, Human
auggggucaccauguugccuggg

SEQ ID NO: 608233 - RNA, 24 nt, Human
caaagugcugggauuacaggcaug

SEQ ID NO: 608234 - RNA, 26 nt, Human
caacaaugcaaguauaaacacaugug

SEQ ID NO: 608235 - RNA, 22 nt, Human
caagugaucugccugccuuggc

SEQ ID NO: 608236 - RNA, 19 nt, Human
caaugcaaguauaaacaca

SEQ ID NO: 608237 - RNA, 23 nt, Human
caccauguugccugggcuggucu

SEQ ID NO: 608238 - RNA, 24 nt, Human
caccauguugccugggcuggucuu

SEQ ID NO: 608239 - RNA, 23 nt, Human
caccuccccugcuuccagcggcc

SEQ ID NO: 608240 - RNA, 24 nt, Human
caccuggucucccuggcuggggac

SEQ ID NO: 608241 - RNA, 23 nt, Human
cacuacuuggcccaaaccaaacc

SEQ ID NO: 608242 - RNA, 21 nt, Human
cagccccagcaggaacaagcc

SEQ ID NO: 608243 - RNA, 20 nt, Human
caggaacaagccauucuagc

SEQ ID NO: 608244 - RNA, 19 nt, Human
cauguugccugggcugguc

SEQ ID NO: 608245 - RNA, 20 nt, Human
cauguugccugggcuggucu

SEQ ID NO: 608246 - RNA, 24 nt, Human
cauguugccugggcuggucuugaa

SEQ ID NO: 608247 - RNA, 23 nt, Human
ccaaagugcugggauuacaggca

SEQ ID NO: 608248 - RNA, 24 nt, Human
ccaaagugcugggauuacaggcau

SEQ ID NO: 608249 - RNA, 21 nt, Human
ccagacagaaaagaucugaac

SEQ ID NO: 608250 - RNA, 24 nt, Human
cccaaagugcugggauuacaggca

SEQ ID NO: 608251 - RNA, 25 nt, Human
cccgccacuuuaugggaccugggga

SEQ ID NO: 608252 - RNA, 23 nt, Human
cccuuccucccuuuugcaauccc

SEQ ID NO: 608253 - RNA, 19 nt, Human
ccuacgcuacgaugcuccc

SEQ ID NO: 608254 - RNA, 19 nt, Human
ccuccugaaacucccugaa

SEQ ID NO: 608255 - RNA, 22 nt, Human
ccugccuuggccucccaaagug

SEQ ID NO: 608256 - RNA, 18 nt, Human
ccuggccucaagugaucu

SEQ ID NO: 608257 - RNA, 21 nt, Human
ccuggccucaagugaucugcc

SEQ ID NO: 608258 - RNA, 23 nt, Human
ccuggccucaagugaucugccug

SEQ ID NO: 608259 - RNA, 22 nt, Human
cgagaguucucuccuccacugg

SEQ ID NO: 608260 - RNA, 22 nt, Human
cuaacuuugcagagcacccacc

SEQ ID NO: 608261 - RNA, 20 nt, Human
cucaagugaucugccugccu

SEQ ID NO: 608262 - RNA, 27 nt, Human
cuccccugcuuccagcggccggggugg

SEQ ID NO: 608263 - RNA, 25 nt, Human
cucccuuccucccuuuugcaauccc

SEQ ID NO: 608264 - RNA, 23 nt, Human
cugccuuggccucccaaagugcu

SEQ ID NO: 608265 - RNA, 21 nt, Human
cuucgaagagcucuuccaucc

SEQ ID NO: 608266 - RNA, 22 nt, Human
cuucucuagcucacugguccga

SEQ ID NO: 608267 - RNA, 25 nt, Human
cuuuuguuccuccaucucaguucua

SEQ ID NO: 608268 - RNA, 21 nt, Human
gaggaaaagagccagacagaa

SEQ ID NO: 608269 - RNA, 18 nt, Human
gauuacaggcaugagcca

SEQ ID NO: 608270 - RNA, 22 nt, Human
gauuacaggcaugagccaccgc

SEQ ID NO: 608271 - RNA, 22 nt, Human
gauuacaggcaugagccaccgc

SEQ ID NO: 608272 - RNA, 22 nt, Human
gccuuggccucccaaagugcug

SEQ ID NO: 608273 - RNA, 24 nt, Human
gcugaggagaaggucagggguggg

SEQ ID NO: 608274 - RNA, 23 nt, Human
gcuggucuugaacuccuggccuc

SEQ ID NO: 608275 - RNA, 21 nt, Human
ggagagcagugaggguaggga

SEQ ID NO: 608276 - RNA, 19 nt, Human
ggaucagggcaagcugggc

SEQ ID NO: 608277 - RNA, 22 nt, Human
ggauuacaggcaugagccaccg

SEQ ID NO: 608278 - RNA, 18 nt, Human
ggcaagcugggccaggcu

SEQ ID NO: 608279 - RNA, 24 nt, Human
ggcccacaucuuuccucuaaccuu

SEQ ID NO: 608280 - RNA, 24 nt, Human
ggccucaagugaucugccugccuu

SEQ ID NO: 608281 - RNA, 21 nt, Human
ggcuaagggacuaaagggaca

SEQ ID NO: 608282 - RNA, 24 nt, Human
ggcuggucuugaacuccuggccuc

SEQ ID NO: 608283 - RNA, 21 nt, Human
gggaccuggggagugggaggg

SEQ ID NO: 608284 - RNA, 20 nt, Human
gggcacaggagagcagugag

SEQ ID NO: 608285 - RNA, 20 nt, Human
gggcuggucuugaacuccug

SEQ ID NO: 608286 - RNA, 18 nt, Human
ggggacacgaagagcaaa

SEQ ID NO: 608287 - RNA, 21 nt, Human
ggggagugggaggggacuggg

SEQ ID NO: 608288 - RNA, 21 nt, Human
gguagagauggggucaccaug

SEQ ID NO: 608289 - RNA, 21 nt, Human
ggucaggggugggagcgcguu

SEQ ID NO: 608290 - RNA, 20 nt, Human
guagagauggggucaccaug

SEQ ID NO: 608291 - RNA, 21 nt, Human
guagagauggggucaccaugu

SEQ ID NO: 608292 - RNA, 20 nt, Human
ucaggggaucagggcaagcu

SEQ ID NO: 608293 - RNA, 18 nt, Human
uccacuggggaaagaugc

SEQ ID NO: 608294 - RNA, 19 nt, Human
uccacuggggaaagaugca

SEQ ID NO: 608295 - RNA, 24 nt, Human
ucccaaagugcugggauuacaggc

SEQ ID NO: 608296 - RNA, 19 nt, Human
ucucccuggcuggggacug

SEQ ID NO: 608297 - RNA, 21 nt, Human
ucuugaacuccuggccucaag

SEQ ID NO: 608298 - RNA, 19 nt, Human
ucuuugcccuaacuuugca

SEQ ID NO: 608299 - RNA, 20 nt, Human
ugccaaaaaggcaauuggac

SEQ ID NO: 608300 - RNA, 23 nt, Human
ugccaaaaaggcaauuggacccc

SEQ ID NO: 608301 - RNA, 18 nt, Human
ugccugccuuggccuccc

SEQ ID NO: 608302 - RNA, 24 nt, Human
ugccugggcuggucuugaacuccu

SEQ ID NO: 608303 - RNA, 21 nt, Human
ugccuuugccaaaaaggcaau

SEQ ID NO: 608304 - RNA, 22 nt, Human
uggaagcugaggaacuugaggu

SEQ ID NO: 608305 - RNA, 26 nt, Human
uggacacauuucaccuccccugcuuc

SEQ ID NO: 608306 - RNA, 18 nt, Human
uggccucaagugaucugc

SEQ ID NO: 608307 - RNA, 20 nt, Human
uggccucaagugaucugccu

SEQ ID NO: 608308 - RNA, 24 nt, Human
uggccucaagugaucugccugccu

SEQ ID NO: 608309 - RNA, 24 nt, Human
uggcuggggacugcuuggacuugu

SEQ ID NO: 608310 - RNA, 18 nt, Human
ugggaggggugcugagug

SEQ ID NO: 608311 - RNA, 18 nt, Human
ugggauuacaggcaugag

SEQ ID NO: 608312 - RNA, 19 nt, Human
ugggauuacaggcaugagc

SEQ ID NO: 608313 - RNA, 21 nt, Human
ugggauuacaggcaugagcca

SEQ ID NO: 608314 - RNA, 22 nt, Human
ugggauuacaggcaugagccac

SEQ ID NO: 608315 - RNA, 23 nt, Human
ugggauuacaggcaugagccacc

SEQ ID NO: 608316 - RNA, 24 nt, Human
ugggauuacaggcaugagccaccg

SEQ ID NO: 608317 - RNA, 25 nt, Human
ugggauuacaggcaugagccaccgc

SEQ ID NO: 608318 - RNA, 23 nt, Human
ugggcuggucuugaacuccuggc

SEQ ID NO: 608319 - RNA, 22 nt, Human
uggggucaccauguugccuggg

SEQ ID NO: 608320 - RNA, 23 nt, Human
ugguccgagaguucucuccucca

SEQ ID NO: 608321 - RNA, 19 nt, Human
ugugccgauguguguggga

SEQ ID NO: 608322 - RNA, 20 nt, Human
uuaugggaccuggggagugg

SEQ ID NO: 608323 - RNA, 19 nt, Human
uucaccuccccugcuucca

SEQ ID NO: 608324 - RNA, 24 nt, Human
uuccuugugugcaagacucacagu

SEQ ID NO: 608325 - RNA, 19 nt, Human
uuggcccaaaccaaacccc

SEQ ID NO: 608326 - RNA, 18 nt, Human
uuggccucccaaagugcu

SEQ ID NO: 608327 - RNA, 19 nt, Human
uuggcucccuuccucccuu

SEQ ID NO: 608328 - RNA, 21 nt, Human
uuguguuaauaaccugggcac

SEQ ID NO: 608329 - RNA, 21 nt, Human
uuugcaaucccccaagugugc

SEQ ID NO: 608330 - RNA, 25 nt, Human
aaacaauucuuaugccucagccucc

SEQ ID NO: 608331 - RNA, 18 nt, Human
aaagugcugggauuacaa

SEQ ID NO: 608332 - RNA, 18 nt, Human
aaagugcugggauuacaa

SEQ ID NO: 608333 - RNA, 24 nt, Human
aaagugcugggauuacaaguguga

SEQ ID NO: 608334 - RNA, 24 nt, Human
aaagugcugggauuacaaguguga

SEQ ID NO: 608335 - RNA, 24 nt, Human
aaagugcugggauuacaggcguga

SEQ ID NO: 608336 - RNA, 19 nt, Human
aacaugcugauuucacugg

SEQ ID NO: 608337 - RNA, 20 nt, Human
aacaugcugauuucacuggg

SEQ ID NO: 608338 - RNA, 20 nt, Human
aaccucugccucccaggcuc

SEQ ID NO: 608339 - RNA, 18 nt, Human
aacugagaaagugccaca

SEQ ID NO: 608340 - RNA, 19 nt, Human
aaguagcugggauuacagg

SEQ ID NO: 608341 - RNA, 24 nt, Human
aaguagcugggauuacaggcacgc

SEQ ID NO: 608342 - RNA, 18 nt, Human
aagugauccgcccgccuc

SEQ ID NO: 608343 - RNA, 18 nt, Human
aagugcugggauuacaag

SEQ ID NO: 608344 - RNA, 18 nt, Human
aagugcugggauuacaag

SEQ ID NO: 608345 - RNA, 19 nt, Human
aagugcugggauuacaagu

SEQ ID NO: 608346 - RNA, 19 nt, Human
aagugcugggauuacaagu

SEQ ID NO: 608347 - RNA, 26 nt, Human
aagugcugggauuacaagugugagcc

SEQ ID NO: 608348 - RNA, 26 nt, Human
aagugcugggauuacaagugugagcc

SEQ ID NO: 608349 - RNA, 19 nt, Human
aagugcugggauuacaggc

SEQ ID NO: 608350 - RNA, 19 nt, Human
aagugcugggauuacaggc

SEQ ID NO: 608351 - RNA, 26 nt, Human
aagugcugggauuacaggcgugagcc

SEQ ID NO: 608352 - RNA, 20 nt, Human
aaucucugccucccaggcuc

SEQ ID NO: 608353 - RNA, 23 nt, Human
aauuucuguauuuuuaguagaga

SEQ ID NO: 608354 - RNA, 21 nt, Human
acaguggcgcaaucuuggcuc

SEQ ID NO: 608355 - RNA, 22 nt, Human
accaggcuggagugcaguggug

SEQ ID NO: 608356 - RNA, 24 nt, Human
accauguuggccaggauggucucg

SEQ ID NO: 608357 - RNA, 24 nt, Human
acccagcugauuuuucuauuuuua

SEQ ID NO: 608358 - RNA, 24 nt, Human
accucaugauccgcccaccuuggc

SEQ ID NO: 608359 - RNA, 24 nt, Human
accuugugauccgccugccucggc

SEQ ID NO: 608360 - RNA, 18 nt, Human
acgggguuucaccauguu

SEQ ID NO: 608361 - RNA, 23 nt, Human
acgggguuucaccauguuggcca

SEQ ID NO: 608362 - RNA, 24 nt, Human
acgggguuucaccauguuggccag

SEQ ID NO: 608363 - RNA, 18 nt, Human
agaagaaaacaucaggag

SEQ ID NO: 608364 - RNA, 23 nt, Human
agagggagaagaaaacaucagga

SEQ ID NO: 608365 - RNA, 21 nt, Human
agccaccacgccccgccuaga

SEQ ID NO: 608366 - RNA, 24 nt, Human
aggaugucuguugcccaggcugga

SEQ ID NO: 608367 - RNA, 25 nt, Human
aggcuggagugcaguggugcgaucu

SEQ ID NO: 608368 - RNA, 20 nt, Human
aguacaguggcgcaaucuug

SEQ ID NO: 608369 - RNA, 24 nt, Human
aguacaguggcgcaaucuuggcuc

SEQ ID NO: 608370 - RNA, 22 nt, Human
aguagagacgggguuucaccau

SEQ ID NO: 608371 - RNA, 19 nt, Human
aguagcugggacuacaggc

SEQ ID NO: 608372 - RNA, 21 nt, Human
aguagcugggacuacaggcau

SEQ ID NO: 608373 - RNA, 23 nt, Human
aguagcugguauuacaggcgugu

SEQ ID NO: 608374 - RNA, 19 nt, Human
aguaggcaaauucucaaau

SEQ ID NO: 608375 - RNA, 20 nt, Human
aguauaguggcgcgaucucg

SEQ ID NO: 608376 - RNA, 24 nt, Human
aguauaguggcgcgaucucggcuc

SEQ ID NO: 608377 - RNA, 20 nt, Human
agugcaguggugcgaucucg

SEQ ID NO: 608378 - RNA, 23 nt, Human
agugcaguggugcgaucucggcu

SEQ ID NO: 608379 - RNA, 24 nt, Human
agugcaguggugcgaucucggcuc

SEQ ID NO: 608380 - RNA, 24 nt, Human
agugcugggauuacaagugugagc

SEQ ID NO: 608381 - RNA, 24 nt, Human
agugcugggauuacaagugugagc

SEQ ID NO: 608382 - RNA, 18 nt, Human
agugcugggauuacaggc

SEQ ID NO: 608383 - RNA, 19 nt, Human
aguggcgcgaucucggcuc

SEQ ID NO: 608384 - RNA, 22 nt, Human
augccucagccucccaaguagc

SEQ ID NO: 608385 - RNA, 18 nt, Human
augggguuucaccacguu

SEQ ID NO: 608386 - RNA, 20 nt, Human
augggguuucaccacguugg

SEQ ID NO: 608387 - RNA, 21 nt, Human
augucuguugcccaggcugga

SEQ ID NO: 608388 - RNA, 22 nt, Human
auuuuucuauuuuuaguagaga

SEQ ID NO: 608389 - RNA, 24 nt, Human
auuuuucuauuuuuaguagagaug

SEQ ID NO: 608390 - RNA, 24 nt, Human
auuuuuguauuuuuaguagagacg

SEQ ID NO: 608391 - RNA, 24 nt, Human
caaagugcugggauuacaagugug

SEQ ID NO: 608392 - RNA, 24 nt, Human
caaagugcugggauuacaagugug

SEQ ID NO: 608393 - RNA, 24 nt, Human
caaagugcugggauuacaggcgug

SEQ ID NO: 608394 - RNA, 23 nt, Human
caaccucugccucccaggcucaa

SEQ ID NO: 608395 - RNA, 21 nt, Human
caacugaacucagggcagagc

SEQ ID NO: 608396 - RNA, 24 nt, Human
caagcaauucuuaugccucagcca

SEQ ID NO: 608397 - RNA, 22 nt, Human
caaguuucugaaucggccuauu

SEQ ID NO: 608398 - RNA, 18 nt, Human
caccacgcccagccaggc

SEQ ID NO: 608399 - RNA, 22 nt, Human
caccacgccccgccuagaacuc

SEQ ID NO: 608400 - RNA, 18 nt, Human
caccacguuggccaggau

SEQ ID NO: 608401 - RNA, 22 nt, Human
caccacguuggccaggaugguc

SEQ ID NO: 608402 - RNA, 24 nt, Human
caccacguuggccaggauggucuc

SEQ ID NO: 608403 - RNA, 24 nt, Human
caccaugcccagcuaauuuuugua

SEQ ID NO: 608404 - RNA, 18 nt, Human
caccauguuggccaggau

SEQ ID NO: 608405 - RNA, 22 nt, Human
caccauguuggccaggaugguc

SEQ ID NO: 608406 - RNA, 24 nt, Human
caccauguuggccaggauggucuc

SEQ ID NO: 608407 - RNA, 18 nt, Human
cacugcaaccucugccuc

SEQ ID NO: 608408 - RNA, 21 nt, Human
cacugcaaccucugccuccca

SEQ ID NO: 608409 - RNA, 25 nt, Human
cagcagcuagaacagcagugcacac

SEQ ID NO: 608410 - RNA, 19 nt, Human
caggaugucuguugcccag

SEQ ID NO: 608411 - RNA, 20 nt, Human
caggucuuugggaaguucug

SEQ ID NO: 608412 - RNA, 23 nt, Human
cagguucccucauuaucugaggg

SEQ ID NO: 608413 - RNA, 24 nt, Human
cauguuggccaggcuggucuugaa

SEQ ID NO: 608414 - RNA, 21 nt, Human
cauugcacucaaguuucugaa

SEQ ID NO: 608415 - RNA, 21 nt, Human
ccaaagugcugggauuacaag

SEQ ID NO: 608416 - RNA, 21 nt, Human
ccaaagugcugggauuacaag

SEQ ID NO: 608417 - RNA, 24 nt, Human
ccaaagugcugggauuacaagugu

SEQ ID NO: 608418 - RNA, 24 nt, Human
ccaaagugcugggauuacaagugu

SEQ ID NO: 608419 - RNA, 22 nt, Human
ccaaagugcugggauuacaggc

SEQ ID NO: 608420 - RNA, 22 nt, Human
ccaaagugcugggauuacaggc

SEQ ID NO: 608421 - RNA, 24 nt, Human
ccaaagugcugggauuacaggcgu

SEQ ID NO: 608422 - RNA, 18 nt, Human
ccaaccuaacauuuagga

SEQ ID NO: 608423 - RNA, 23 nt, Human
ccaaguagcugggauuacaggca

SEQ ID NO: 608424 - RNA, 18 nt, Human
ccaccugaguagcuggua

SEQ ID NO: 608425 - RNA, 19 nt, Human
ccauguuggccaggcuggu

SEQ ID NO: 608426 - RNA, 21 nt, Human
ccauguuggccaggcuggucu

SEQ ID NO: 608427 - RNA, 21 nt, Human
ccauguuggccaggcuggucu

SEQ ID NO: 608428 - RNA, 23 nt, Human
cccaaguagcugggauuacaggc

SEQ ID NO: 608429 - RNA, 24 nt, Human
cccaaguagcugggauuacaggca

SEQ ID NO: 608430 - RNA, 22 nt, Human
cccaggcuggaguauaguggcg

SEQ ID NO: 608431 - RNA, 20 nt, Human
ccgccgcggcuuagccggcc

SEQ ID NO: 608432 - RNA, 24 nt, Human
ccuaacauuuaggaaaauggagag

SEQ ID NO: 608433 - RNA, 23 nt, Human
ccugaguagcugguauuacaggc

SEQ ID NO: 608434 - RNA, 18 nt, Human
ccuggccucaagugaucc

SEQ ID NO: 608435 - RNA, 18 nt, Human
ccuggccucaagugaucc

SEQ ID NO: 608436 - RNA, 22 nt, Human
ccuggccucaagugauccgccc

SEQ ID NO: 608437 - RNA, 24 nt, Human
cgccucagcaucccaaagugcugg

SEQ ID NO: 608438 - RNA, 18 nt, Human
cggcaccacacccagcug

SEQ ID NO: 608439 - RNA, 24 nt, Human
cgggguuucaccauguuggccagg

SEQ ID NO: 608440 - RNA, 22 nt, Human
cgguuacaaguccacaaacugu

SEQ ID NO: 608441 - RNA, 19 nt, Human
cucaagcaauucuuaugcc

SEQ ID NO: 608442 - RNA, 24 nt, Human
cucacugcaaccucugccucccag

SEQ ID NO: 608443 - RNA, 24 nt, Human
cucacugcaaccucugccucccag

SEQ ID NO: 608444 - RNA, 23 nt, Human
cucagccucccaaguagcuggga

SEQ ID NO: 608445 - RNA, 20 nt, Human
cuccugaccucaugauccgc

SEQ ID NO: 608446 - RNA, 24 nt, Human
cucuggaccuugugauccgccugc

SEQ ID NO: 608447 - RNA, 23 nt, Human
cugcaaccucugccucccaggcu

SEQ ID NO: 608448 - RNA, 21 nt, Human
cugcagguaggaacacuuccu

SEQ ID NO: 608449 - RNA, 23 nt, Human
cugccucacccuucugaguagcu

SEQ ID NO: 608450 - RNA, 23 nt, Human
cugccucggccucccaaagugcu

SEQ ID NO: 608451 - RNA, 25 nt, Human
cuuaugccucagccucccaaguagc

SEQ ID NO: 608452 - RNA, 20 nt, Human
cuuccugcagguaggaacac

SEQ ID NO: 608453 - RNA, 20 nt, Human
cuuugggaaguucuggggcc

SEQ ID NO: 608454 - RNA, 20 nt, Human
gaacacuuccucugcaguca

SEQ ID NO: 608455 - RNA, 22 nt, Human
gaaguucuggggccaggaaacc

SEQ ID NO: 608456 - RNA, 24 nt, Human
gaauuucuguauuuuuaguagaga

SEQ ID NO: 608457 - RNA, 25 nt, Human
gaccucaugauccgcccaccuuggc

SEQ ID NO: 608458 - RNA, 22 nt, Human
gaccuugugauccgccugccuc

SEQ ID NO: 608459 - RNA, 24 nt, Human
gaccuugugauccgccugccucgg

SEQ ID NO: 608460 - RNA, 24 nt, Human
gacuacaggcaugccccaccaugc

SEQ ID NO: 608461 - RNA, 20 nt, Human
gagaagaaaacaucaggagc

SEQ ID NO: 608462 - RNA, 24 nt, Human
gagacgggguuucaccauguuggc

SEQ ID NO: 608463 - RNA, 20 nt, Human
gagaugggguuucaccacgu

SEQ ID NO: 608464 - RNA, 24 nt, Human
gagaugggguuucaccacguuggc

SEQ ID NO: 608465 - RNA, 24 nt, Human
gaguagcugggacuacaggcaugc

SEQ ID NO: 608466 - RNA, 24 nt, Human
gaugucuguugcccaggcuggagu

SEQ ID NO: 608467 - RNA, 18 nt, Human
gauuacaagugugagcca

SEQ ID NO: 608468 - RNA, 18 nt, Human
gauuacaagugugagcca

SEQ ID NO: 608469 - RNA, 18 nt, Human
gauuacaggcgugagcca

SEQ ID NO: 608470 - RNA, 21 nt, Human
gauuacaggcgugagccacca

SEQ ID NO: 608471 - RNA, 22 nt, Human
gauuacaggcgugagccaccac

SEQ ID NO: 608472 - RNA, 22 nt, Human
gcaaccucugccucccaggcuc

SEQ ID NO: 608473 - RNA, 19 nt, Human
gcagucccaggugaaggcu

SEQ ID NO: 608474 - RNA, 20 nt, Human
gccauguuggccaggcuggu

SEQ ID NO: 608475 - RNA, 22 nt, Human
gccauguuggccaggcuggucu

SEQ ID NO: 608476 - RNA, 22 nt, Human
gcccagcuaauuuuuguauuuu

SEQ ID NO: 608477 - RNA, 19 nt, Human
gccuagaacucuuauagag

SEQ ID NO: 608478 - RNA, 21 nt, Human
gcucacugcaaccucugccuc

SEQ ID NO: 608479 - RNA, 21 nt, Human
gcucugucaccaggcuggagu

SEQ ID NO: 608480 - RNA, 25 nt, Human
gcucuguugcccaagcuggaguaca

SEQ ID NO: 608481 - RNA, 19 nt, Human
gcuggaguacaguggcgca

SEQ ID NO: 608482 - RNA, 23 nt, Human
gcuggucuugaacuccuggccuc

SEQ ID NO: 608483 - RNA, 19 nt, Human
ggauuacaggcgugagcca

SEQ ID NO: 608484 - RNA, 22 nt, Human
ggauuuugccauguuggccagg

SEQ ID NO: 608485 - RNA, 24 nt, Human
ggccucaagugauccgcccgccuc

SEQ ID NO: 608486 - RNA, 24 nt, Human
ggcuggucuugaacuccuggccuc

SEQ ID NO: 608487 - RNA, 18 nt, Human
gggauuuugccauguugg

SEQ ID NO: 608488 - RNA, 22 nt, Human
gggauuuugccauguuggccag

SEQ ID NO: 608489 - RNA, 22 nt, Human
gggguuucaccacguuggccag

SEQ ID NO: 608490 - RNA, 23 nt, Human
gggguuucaccauguuggccagg

SEQ ID NO: 608491 - RNA, 20 nt, Human
ggucucgaucuccugaccuc

SEQ ID NO: 608492 - RNA, 24 nt, Human
gguuucaccauguuggccaggaug

SEQ ID NO: 608493 - RNA, 23 nt, Human
guagagacgggguuucaccaugu

SEQ ID NO: 608494 - RNA, 23 nt, Human
guagagaugggauuuugccaugu

SEQ ID NO: 608495 - RNA, 18 nt, Human
guagcugggauuacaggc

SEQ ID NO: 608496 - RNA, 24 nt, Human
gugauccgcccgccucagcauccc

SEQ ID NO: 608497 - RNA, 19 nt, Human
gugugagccaccacgcccc

SEQ ID NO: 608498 - RNA, 19 nt, Human
uaaaaauggcaaaaaccac

SEQ ID NO: 608499 - RNA, 19 nt, Human
uaacugagaaagugccaca

SEQ ID NO: 608500 - RNA, 24 nt, Human
uaauuuuuguauuuuuaguagaga

SEQ ID NO: 608501 - RNA, 23 nt, Human
uacaagugugagccaccacgccc

SEQ ID NO: 608502 - RNA, 22 nt, Human
uacaagugugagccaccgcucc

SEQ ID NO: 608503 - RNA, 24 nt, Human
uacaggcaugccccaccaugccca

SEQ ID NO: 608504 - RNA, 24 nt, Human
uacaggcgugagccaccacgccca

SEQ ID NO: 608505 - RNA, 23 nt, Human
uacaguggcgcaaucuuggcuca

SEQ ID NO: 608506 - RNA, 24 nt, Human
uagagaaugaagaaugcguuuuga

SEQ ID NO: 608507 - RNA, 22 nt, Human
uagagacgggguuucaccaugu

SEQ ID NO: 608508 - RNA, 22 nt, Human
uagagaugggauuuugccaugu

SEQ ID NO: 608509 - RNA, 22 nt, Human
uagagaugggguuucaccacgu

SEQ ID NO: 608510 - RNA, 19 nt, Human
uagccggccggagcccacg

SEQ ID NO: 608511 - RNA, 24 nt, Human
uaguagagacgggguuucaccaug

SEQ ID NO: 608512 - RNA, 25 nt, Human
uaguagagacgggguuucaccaugu

SEQ ID NO: 608513 - RNA, 24 nt, Human
uaguagagaugggauuuugccaug

SEQ ID NO: 608514 - RNA, 19 nt, Human
uaguagagaugggguuuca

SEQ ID NO: 608515 - RNA, 24 nt, Human
uaguagagaugggguuucaccacg

SEQ ID NO: 608516 - RNA, 26 nt, Human
uaguagagaugggguuucaccacguu

SEQ ID NO: 608517 - RNA, 18 nt, Human
uauuacaggcgugugcca

SEQ ID NO: 608518 - RNA, 24 nt, Human
ucaccacguuggccaggauggucu

SEQ ID NO: 608519 - RNA, 24 nt, Human
ucaccaggcuggagugcaguggug

SEQ ID NO: 608520 - RNA, 24 nt, Human
ucaccauguuggccaggauggucu

SEQ ID NO: 608521 - RNA, 23 nt, Human
ucacccuucugaguagcugggac

SEQ ID NO: 608522 - RNA, 19 nt, Human
ucacugcaaccucugccuc

SEQ ID NO: 608523 - RNA, 24 nt, Human
ucacugcaaccucugccucccagg

SEQ ID NO: 608524 - RNA, 25 nt, Human
ucacugcaaccucugccucccaggc

SEQ ID NO: 608525 - RNA, 18 nt, Human
ucacugcagucuccgccu

SEQ ID NO: 608526 - RNA, 20 nt, Human
ucacugcagucuccgccucg

SEQ ID NO: 608527 - RNA, 23 nt, Human
ucacugcagucuccgccucgcgg

SEQ ID NO: 608528 - RNA, 24 nt, Human
ucacugcagucuccgccucgcggg

SEQ ID NO: 608529 - RNA, 18 nt, Human
ucacuggggauguggcag

SEQ ID NO: 608530 - RNA, 22 nt, Human
ucagcagcuagaacagcagugc

SEQ ID NO: 608531 - RNA, 20 nt, Human
ucagccucccaaguagcugg

SEQ ID NO: 608532 - RNA, 19 nt, Human
ucagugcaaucucugccuc

SEQ ID NO: 608533 - RNA, 24 nt, Human
ucagugcaaucucugccucccagg

SEQ ID NO: 608534 - RNA, 18 nt, Human
ucccaaagugcugggauu

SEQ ID NO: 608535 - RNA, 18 nt, Human
ucccaaagugcugggauu

SEQ ID NO: 608536 - RNA, 23 nt, Human
ucccaaagugcugggauuacaag

SEQ ID NO: 608537 - RNA, 23 nt, Human
ucccaaagugcugggauuacaag

SEQ ID NO: 608538 - RNA, 24 nt, Human
ucccaaagugcugggauuacaggc

SEQ ID NO: 608539 - RNA, 24 nt, Human
ucccaaguagcugggauuacaggc

SEQ ID NO: 608540 - RNA, 20 nt, Human
ucccaggcucaaacaauucu

SEQ ID NO: 608541 - RNA, 20 nt, Human
ucccaggcucaagcaauucu

SEQ ID NO: 608542 - RNA, 20 nt, Human
ucccaggcucaagcaauucu

SEQ ID NO: 608543 - RNA, 21 nt, Human
uccgcccgccucagcauccca

SEQ ID NO: 608544 - RNA, 22 nt, Human
uccucugcagucagagggagaa

SEQ ID NO: 608545 - RNA, 23 nt, Human
ucugaguagcugggacuacaggc

SEQ ID NO: 608546 - RNA, 24 nt, Human
ucugaguagcugggacuacaggca

SEQ ID NO: 608547 - RNA, 21 nt, Human
ucugccucccaggcucaaaca

SEQ ID NO: 608548 - RNA, 23 nt, Human
ucugucaccaggcuggagugcag

SEQ ID NO: 608549 - RNA, 18 nt, Human
ucuguugcccaggcugga

SEQ ID NO: 608550 - RNA, 21 nt, Human
ucuugaacuccuggccucaag

SEQ ID NO: 608551 - RNA, 22 nt, Human
ucuugcucuguugcccaagcug

SEQ ID NO: 608552 - RNA, 23 nt, Human
ucuugcucuguugcccaagcugg

SEQ ID NO: 608553 - RNA, 24 nt, Human
ucuugcucuguugcccaagcugga

SEQ ID NO: 608554 - RNA, 24 nt, Human
ucuuuuuuuuuugagauggagucu

SEQ ID NO: 608555 - RNA, 21 nt, Human
ugacaggugccuuccugcagg

SEQ ID NO: 608556 - RNA, 18 nt, Human
ugagaaagugccacagua

SEQ ID NO: 608557 - RNA, 22 nt, Human
ugagauggagucuugcucuguu

SEQ ID NO: 608558 - RNA, 19 nt, Human
ugaguaggcaaauucucaa

SEQ ID NO: 608559 - RNA, 25 nt, Human
ugagugaacgcccugugugacaggu

SEQ ID NO: 608560 - RNA, 24 nt, Human
ugauccgcccaccuuggccuccca

SEQ ID NO: 608561 - RNA, 24 nt, Human
ugauuuuucuauuuuuaguagaga

SEQ ID NO: 608562 - RNA, 18 nt, Human
ugcacacacagcaggugc

SEQ ID NO: 608563 - RNA, 22 nt, Human
ugcaguggugcgaucucggcuc

SEQ ID NO: 608564 - RNA, 27 nt, Human
ugccauguuggccaggcuggucuugaa

SEQ ID NO: 608565 - RNA, 21 nt, Human
ugcccaagcuggaguacagug

SEQ ID NO: 608566 - RNA, 21 nt, Human
ugcccaggcuggaguauagug

SEQ ID NO: 608567 - RNA, 21 nt, Human
ugcccaggcuggaguauagug

SEQ ID NO: 608568 - RNA, 18 nt, Human
ugccccaccaugcccagc

SEQ ID NO: 608569 - RNA, 21 nt, Human
ugccucagccaccugaguagc

SEQ ID NO: 608570 - RNA, 22 nt, Human
ugccucagccaccugaguagcu

SEQ ID NO: 608571 - RNA, 24 nt, Human
ugccucagccaccugaguagcugg

SEQ ID NO: 608572 - RNA, 22 nt, Human
ugccucagccucccaaguagcu

SEQ ID NO: 608573 - RNA, 24 nt, Human
ugccucagccucccaaguagcugg

SEQ ID NO: 608574 - RNA, 21 nt, Human
ugccucggccucccaaagugc

SEQ ID NO: 608575 - RNA, 24 nt, Human
ugccucggccucccaaagugcugg

SEQ ID NO: 608576 - RNA, 19 nt, Human
ugcucuguugcccaagcug

SEQ ID NO: 608577 - RNA, 24 nt, Human
ugcugggauuacaagugugagcca

SEQ ID NO: 608578 - RNA, 26 nt, Human
ugcugggauuacaagugugagccacc

SEQ ID NO: 608579 - RNA, 24 nt, Human
ugcugggauuacaggcgugagcca

SEQ ID NO: 608580 - RNA, 24 nt, Human
uggaguacaguggcgcaaucuugg

SEQ ID NO: 608581 - RNA, 24 nt, Human
uggaguauaguggcgcgaucucgg

SEQ ID NO: 608582 - RNA, 23 nt, Human
uggagugcaguggugcgaucucg

SEQ ID NO: 608583 - RNA, 24 nt, Human
uggagugcaguggugcgaucucgg

SEQ ID NO: 608584 - RNA, 21 nt, Human
uggccaggauggucucgaucu

SEQ ID NO: 608585 - RNA, 24 nt, Human
uggccaggauggucucgaucuccu

SEQ ID NO: 608586 - RNA, 24 nt, Human
uggccaggcuggucuugaacuccu

SEQ ID NO: 608587 - RNA, 18 nt, Human
uggccucaagugauccgc

SEQ ID NO: 608588 - RNA, 24 nt, Human
uggccucaagugauccgcccgccu

SEQ ID NO: 608589 - RNA, 24 nt, Human
ugggacuacaggcaugccccacca

SEQ ID NO: 608590 - RNA, 25 nt, Human
ugggacuacaggcaugccccaccau

SEQ ID NO: 608591 - RNA, 18 nt, Human
ugggauuacaagugugag

SEQ ID NO: 608592 - RNA, 19 nt, Human
ugggauuacaagugugagc

SEQ ID NO: 608593 - RNA, 19 nt, Human
ugggauuacaagugugagc

SEQ ID NO: 608594 - RNA, 21 nt, Human
ugggauuacaagugugagcca

SEQ ID NO: 608595 - RNA, 22 nt, Human
ugggauuacaagugugagccac

SEQ ID NO: 608596 - RNA, 22 nt, Human
ugggauuacaagugugagccac

SEQ ID NO: 608597 - RNA, 23 nt, Human
ugggauuacaagugugagccacc

SEQ ID NO: 608598 - RNA, 23 nt, Human
ugggauuacaagugugagccacc

SEQ ID NO: 608599 - RNA, 24 nt, Human
ugggauuacaagugugagccacca

SEQ ID NO: 608600 - RNA, 24 nt, Human
ugggauuacaagugugagccaccg

SEQ ID NO: 608601 - RNA, 24 nt, Human
ugggauuacaggcacgcggcacca

SEQ ID NO: 608602 - RNA, 18 nt, Human
ugggauuacaggcgugag

SEQ ID NO: 608603 - RNA, 19 nt, Human
ugggauuacaggcgugagc

SEQ ID NO: 608604 - RNA, 22 nt, Human
ugggauuacaggcgugagccac

SEQ ID NO: 608605 - RNA, 23 nt, Human
ugggauuacaggcgugagccacc

SEQ ID NO: 608606 - RNA, 24 nt, Human
ugggauuacaggcgugagccacca

SEQ ID NO: 608607 - RNA, 24 nt, Human
ugggauuuugccauguuggccagg

SEQ ID NO: 608608 - RNA, 24 nt, Human
ugggguuucaccacguuggccagg

SEQ ID NO: 608609 - RNA, 18 nt, Human
ugguauuacaggcgugug

SEQ ID NO: 608610 - RNA, 21 nt, Human
ugguauuacaggcgugugcca

SEQ ID NO: 608611 - RNA, 24 nt, Human
uggugcgaucucggcucacugcag

SEQ ID NO: 608612 - RNA, 21 nt, Human
uguauuuuuaguagagacggg

SEQ ID NO: 608613 - RNA, 18 nt, Human
ugucuguugcccaggcug

SEQ ID NO: 608614 - RNA, 20 nt, Human
ugucuguugcccaggcugga

SEQ ID NO: 608615 - RNA, 21 nt, Human
ugucuguugcccaggcuggag

SEQ ID NO: 608616 - RNA, 22 nt, Human
ugugacaggugccuuccugcag

SEQ ID NO: 608617 - RNA, 19 nt, Human
ugugugacaggugccuucc

SEQ ID NO: 608618 - RNA, 21 nt, Human
ugugugacaggugccuuccug

SEQ ID NO: 608619 - RNA, 25 nt, Human
uguuuaacuggacauaugugaggug

SEQ ID NO: 608620 - RNA, 20 nt, Human
uuacaggcacgcggcaccac

SEQ ID NO: 608621 - RNA, 18 nt, Human
uuaguagagacgggguuu

SEQ ID NO: 608622 - RNA, 22 nt, Human
uuaguagagacgggguuucacc

SEQ ID NO: 608623 - RNA, 24 nt, Human
uuaguagagacgggguuucaccau

SEQ ID NO: 608624 - RNA, 18 nt, Human
uuaguagagaugggauuu

SEQ ID NO: 608625 - RNA, 18 nt, Human
uuaguagagaugggauuu

SEQ ID NO: 608626 - RNA, 24 nt, Human
uuaguagagaugggauuuugccau

SEQ ID NO: 608627 - RNA, 18 nt, Human
uuaguagagaugggguuu

SEQ ID NO: 608628 - RNA, 22 nt, Human
uuaguagagaugggguuucacc

SEQ ID NO: 608629 - RNA, 25 nt, Human
uuaguagagaugggguuucaccacg

SEQ ID NO: 608630 - RNA, 21 nt, Human
uucagaucugcaccgagaaac

SEQ ID NO: 608631 - RNA, 24 nt, Human
uucugaguagcugggacuacaggc

SEQ ID NO: 608632 - RNA, 20 nt, Human
uucuguauuuuuaguagaga

SEQ ID NO: 608633 - RNA, 21 nt, Human
uugagauggagucuugcucug

SEQ ID NO: 608634 - RNA, 24 nt, Human
uugcccaggcuggaguauaguggc

SEQ ID NO: 608635 - RNA, 18 nt, Human
uuggccucccaaagugcu

SEQ ID NO: 608636 - RNA, 23 nt, Human
uuguauuuuuaguagagacgggg

SEQ ID NO: 608637 - RNA, 19 nt, Human
uuucaccacguuggccagg

SEQ ID NO: 608638 - RNA, 19 nt, Human
uuucaccauguuggccagg

SEQ ID NO: 608639 - RNA, 20 nt, Human
uuucaccauguuggccagga

SEQ ID NO: 608640 - RNA, 20 nt, Human
uuucuguauuuuuaguagag

SEQ ID NO: 608641 - RNA, 23 nt, Human
uuuugccauguuggccaggcugg

SEQ ID NO: 608642 - RNA, 24 nt, Human
uuuuuaguagagacgggguuucac

SEQ ID NO: 608643 - RNA, 24 nt, Human
uuuuuaguagagaugggauuuugc

SEQ ID NO: 608644 - RNA, 24 nt, Human
uuuuuaguagagaugggguuucac

SEQ ID NO: 608645 - RNA, 20 nt, Human
uuuuucuauuuuuaguagag

SEQ ID NO: 608646 - RNA, 20 nt, Human
uuuuuguauuuuuaguagag

SEQ ID NO: 608647 - RNA, 25 nt, Human
aaacaccacccaacauggacaagga

SEQ ID NO: 608648 - RNA, 22 nt, Human
aaacccuccgugcacgagcucc

SEQ ID NO: 608649 - RNA, 24 nt, Human
aaagaaaaaacacagcuuuauugg

SEQ ID NO: 608650 - RNA, 21 nt, Human
aaaggggcccuggggcccagg

SEQ ID NO: 608651 - RNA, 24 nt, Human
aagcagcccagcuccaccacaggc

SEQ ID NO: 608652 - RNA, 20 nt, Human
aaugcaaaaggaaagugaga

SEQ ID NO: 608653 - RNA, 19 nt, Human
acaaaacaaacagaacaag

SEQ ID NO: 608654 - RNA, 19 nt, Human
acagaagugugucccagaa

SEQ ID NO: 608655 - RNA, 18 nt, Human
accacaggcauaaaaaua

SEQ ID NO: 608656 - RNA, 24 nt, Human
agaaacaccacccaacauggacaa

SEQ ID NO: 608657 - RNA, 20 nt, Human
agaaaucuuuccguucccuu

SEQ ID NO: 608658 - RNA, 24 nt, Human
agaacaagauauucauauuaaugc

SEQ ID NO: 608659 - RNA, 20 nt, Human
agacaaaacaaacagaacaa

SEQ ID NO: 608660 - RNA, 18 nt, Human
agaguacugaggcuucca

SEQ ID NO: 608661 - RNA, 22 nt, Human
agcagucgguccccccggccuc

SEQ ID NO: 608662 - RNA, 19 nt, Human
aggagacaaaacaaacaga

SEQ ID NO: 608663 - RNA, 18 nt, Human
aggcggcccaggccagcg

SEQ ID NO: 608664 - RNA, 23 nt, Human
agucagggcucugacagggcuuc

SEQ ID NO: 608665 - RNA, 22 nt, Human
agugguucuacuccagucacag

SEQ ID NO: 608666 - RNA, 18 nt, Human
aguuuuaagaaaucuuuc

SEQ ID NO: 608667 - RNA, 19 nt, Human
auuuguaaacaucuuaccc

SEQ ID NO: 608668 - RNA, 22 nt, Human
caacaccccacaguguggcacu

SEQ ID NO: 608669 - RNA, 21 nt, Human
caagguggagcccuuuccacc

SEQ ID NO: 608670 - RNA, 20 nt, Human
cacagcagcagcuacaaaca

SEQ ID NO: 608671 - RNA, 20 nt, Human
cacaguguggcacuggaagg

SEQ ID NO: 608672 - RNA, 19 nt, Human
cagaguacugaggcuucca

SEQ ID NO: 608673 - RNA, 19 nt, Human
cagcagcagcuacaaacag

SEQ ID NO: 608674 - RNA, 20 nt, Human
cagcagcagcuacaaacagg

SEQ ID NO: 608675 - RNA, 20 nt, Human
ccacaggcauaaaaauagga

SEQ ID NO: 608676 - RNA, 27 nt, Human
ccagaacacugaaaacuuugggaaccc

SEQ ID NO: 608677 - RNA, 22 nt, Human
ccaguccugccacugucaggag

SEQ ID NO: 608678 - RNA, 19 nt, Human
cccagcuccaccacaggca

SEQ ID NO: 608679 - RNA, 22 nt, Human
cccagcuccaccacaggcauaa

SEQ ID NO: 608680 - RNA, 19 nt, Human
ccccaugggacugggcagg

SEQ ID NO: 608681 - RNA, 21 nt, Human
ccccgggcgccaagagcaguc

SEQ ID NO: 608682 - RNA, 23 nt, Human
cccuacacccugacucaacgaau

SEQ ID NO: 608683 - RNA, 21 nt, Human
ccgugcacgagcuccuccagu

SEQ ID NO: 608684 - RNA, 28 nt, Human
ccucccgccggcaaaggggcccuggggc

SEQ ID NO: 608685 - RNA, 20 nt, Human
ccugaccccgggcgccaaga

SEQ ID NO: 608686 - RNA, 18 nt, Human
ccuggaacucacuuuuca

SEQ ID NO: 608687 - RNA, 25 nt, Human
ccuuuuauacucuguggccucuaac

SEQ ID NO: 608688 - RNA, 20 nt, Human
cgcaccugccaaugugcugc

SEQ ID NO: 608689 - RNA, 24 nt, Human
cgcccgggagccgagguuucccgg

SEQ ID NO: 608690 - RNA, 19 nt, Human
cggcccaggccagcgccgg

SEQ ID NO: 608691 - RNA, 23 nt, Human
cuagggucuccccaugggacugg

SEQ ID NO: 608692 - RNA, 23 nt, Human
cucccuuccccacuaagcagccc

SEQ ID NO: 608693 - RNA, 19 nt, Human
cuccgugcacgagcuccuc

SEQ ID NO: 608694 - RNA, 24 nt, Human
cuggaagggaccuaaaaacccacc

SEQ ID NO: 608695 - RNA, 22 nt, Human
cuggaauuucccuacacccuga

SEQ ID NO: 608696 - RNA, 21 nt, Human
cuggacaccucgggacauccu

SEQ ID NO: 608697 - RNA, 22 nt, Human
cuggaggcggaggcuagaaaca

SEQ ID NO: 608698 - RNA, 18 nt, Human
cuucccagggcccaaugc

SEQ ID NO: 608699 - RNA, 18 nt, Human
cuuuccguucccugaagu

SEQ ID NO: 608700 - RNA, 19 nt, Human
gaaacaccacccaacaugg

SEQ ID NO: 608701 - RNA, 19 nt, Human
gacugggcagggcgugucc

SEQ ID NO: 608702 - RNA, 19 nt, Human
gaggaugggagaaguugag

SEQ ID NO: 608703 - RNA, 19 nt, Human
gaggcggaggcuagaaaca

SEQ ID NO: 608704 - RNA, 21 nt, Human
gcccacugggucagcaguggu

SEQ ID NO: 608705 - RNA, 21 nt, Human
gcccgggagccgagguuuccc

SEQ ID NO: 608706 - RNA, 22 nt, Human
gcccuuuccaccacuucuggcc

SEQ ID NO: 608707 - RNA, 21 nt, Human
gcgaggcccggcgcggccgcg

SEQ ID NO: 608708 - RNA, 18 nt, Human
gcggaggcuagaaacacc

SEQ ID NO: 608709 - RNA, 24 nt, Human
gcggccccucaacaccccacagug

SEQ ID NO: 608710 - RNA, 24 nt, Human
gcuuucuccuuuccccuuccccac

SEQ ID NO: 608711 - RNA, 24 nt, Human
ggaaggacagaagugugucccaga

SEQ ID NO: 608712 - RNA, 22 nt, Human
ggacagaagugugucccagaac

SEQ ID NO: 608713 - RNA, 18 nt, Human
ggagcccuuuccaccacu

SEQ ID NO: 608714 - RNA, 19 nt, Human
ggcagggucaggggugaga

SEQ ID NO: 608715 - RNA, 24 nt, Human
ggccucuaaccuuccuggaacucu

SEQ ID NO: 608716 - RNA, 25 nt, Human
ggccugggugccugucgcccgggag

SEQ ID NO: 608717 - RNA, 21 nt, Human
ggcugagaagggccugggugc

SEQ ID NO: 608718 - RNA, 19 nt, Human
gggcugagaagggccuggg

SEQ ID NO: 608719 - RNA, 22 nt, Human
guggaucuggguuuuagucagg

SEQ ID NO: 608720 - RNA, 22 nt, Human
uaagcagcccagcuccaccaca

SEQ ID NO: 608721 - RNA, 22 nt, Human
uacccauguccuugaccggccu

SEQ ID NO: 608722 - RNA, 27 nt, Human
uacccauguccuugaccggccuuuucg

SEQ ID NO: 608723 - RNA, 26 nt, Human
uacucuguggccucuaaccuuccugg

SEQ ID NO: 608724 - RNA, 18 nt, Human
uaggaggugagaggaugg

SEQ ID NO: 608725 - RNA, 19 nt, Human
uauaccauuguuccacugu

SEQ ID NO: 608726 - RNA, 21 nt, Human
ucacagcagcagcuacaaaca

SEQ ID NO: 608727 - RNA, 22 nt, Human
ucacccgccuggaggcggaggc

SEQ ID NO: 608728 - RNA, 20 nt, Human
ucacgugugcgcaccugccu

SEQ ID NO: 608729 - RNA, 23 nt, Human
ucacuuuuaaaucuauccaaauu

SEQ ID NO: 608730 - RNA, 22 nt, Human
ucaguagccuuuucugucuuuu

SEQ ID NO: 608731 - RNA, 18 nt, Human
uccaccacuucuggccau

SEQ ID NO: 608732 - RNA, 23 nt, Human
uccaccacuucuggccauuacgu

SEQ ID NO: 608733 - RNA, 24 nt, Human
uccaccacuucuggccauuacguc

SEQ ID NO: 608734 - RNA, 20 nt, Human
ucccggccuccccugacccc

SEQ ID NO: 608735 - RNA, 22 nt, Human
uccucacccgccuggaggcgga

SEQ ID NO: 608736 - RNA, 20 nt, Human
uccuggaacucacuuuucag

SEQ ID NO: 608737 - RNA, 20 nt, Human
ucgguccccccggccucccg

SEQ ID NO: 608738 - RNA, 24 nt, Human
ucucaaaugaugucuugacaaauu

SEQ ID NO: 608739 - RNA, 21 nt, Human
ucucaggagacaaaacaaaca

SEQ ID NO: 608740 - RNA, 20 nt, Human
ucuccuuuccccuuccccac

SEQ ID NO: 608741 - RNA, 20 nt, Human
ucuguggccucuaaccuucc

SEQ ID NO: 608742 - RNA, 25 nt, Human
ugaugucuugacaaauuaaaguuuu

SEQ ID NO: 608743 - RNA, 21 nt, Human
ugcaacaaaugaggggaagaa

SEQ ID NO: 608744 - RNA, 22 nt, Human
ugcacagaaacaccacccaaca

SEQ ID NO: 608745 - RNA, 21 nt, Human
ugccacugucaggagggucag

SEQ ID NO: 608746 - RNA, 21 nt, Human
ugccucgcgcggccccucaac

SEQ ID NO: 608747 - RNA, 23 nt, Human
uggaagggaccuaaaaacccacc

SEQ ID NO: 608748 - RNA, 19 nt, Human
uggaagggccugccucgcg

SEQ ID NO: 608749 - RNA, 22 nt, Human
uggaggcggaggcuagaaacac

SEQ ID NO: 608750 - RNA, 23 nt, Human
uggcuuccgaaauggaauuccuu

SEQ ID NO: 608751 - RNA, 23 nt, Human
ugggaacccaguguucaguguug

SEQ ID NO: 608752 - RNA, 19 nt, Human
ugggagaaguugagggaug

SEQ ID NO: 608753 - RNA, 20 nt, Human
ugggagaaguugagggaugg

SEQ ID NO: 608754 - RNA, 20 nt, Human
ugggagaaguugagggaugg

SEQ ID NO: 608755 - RNA, 21 nt, Human
ugggagaaguugagggaugga

SEQ ID NO: 608756 - RNA, 24 nt, Human
uguaaagaaaaaacacagcuuuau

SEQ ID NO: 608757 - RNA, 19 nt, Human
uguuccacuguuuaguuuu

SEQ ID NO: 608758 - RNA, 22 nt, Human
uucaguagccuuuucugucuuu

SEQ ID NO: 608759 - RNA, 18 nt, Human
uucccagggcccaaugcc

SEQ ID NO: 608760 - RNA, 18 nt, Human
uuucccggccuccccuga

SEQ ID NO: 608761 - RNA, 20 nt, Human
uuuucugucuuuuccuuccu

SEQ ID NO: 608762 - RNA, 20 nt, Human
uuuucugucuuuuccuuccu

SEQ ID NO: 608763 - RNA, 21 nt, Human
aagaagcugggguaucccggg

SEQ ID NO: 608764 - RNA, 23 nt, Human
acagaagcacacaggagccucca

SEQ ID NO: 608765 - RNA, 24 nt, Human
agacagggccugcugcugagcccc

SEQ ID NO: 608766 - RNA, 20 nt, Human
aggcgaagugggcuacaacc

SEQ ID NO: 608767 - RNA, 20 nt, Human
agucuuuuuuuuuuuuuuuu

SEQ ID NO: 608768 - RNA, 23 nt, Human
agucuuuuuuuuuuuuuuuuucc

SEQ ID NO: 608769 - RNA, 19 nt, Human
auaggaaaaaaaaaauccu

SEQ ID NO: 608770 - RNA, 23 nt, Human
auagugcagacgacacacagcgc

SEQ ID NO: 608771 - RNA, 23 nt, Human
aucaagucuuuuuuuuuuuuuuu

SEQ ID NO: 608772 - RNA, 20 nt, Human
caacacagauugcucagccc

SEQ ID NO: 608773 - RNA, 23 nt, Human
caagucuuuuuuuuuuuuuuuuu

SEQ ID NO: 608774 - RNA, 18 nt, Human
cacacagcgccuauguaa

SEQ ID NO: 608775 - RNA, 23 nt, Human
cacagcucccaggagcacagcca

SEQ ID NO: 608776 - RNA, 25 nt, Human
cacaggagccuccagggcaucugca

SEQ ID NO: 608777 - RNA, 22 nt, Human
cagagcaagaaacaaaggaaaa

SEQ ID NO: 608778 - RNA, 22 nt, Human
cagaggcugggaggagaggggg

SEQ ID NO: 608779 - RNA, 20 nt, Human
cagaguggcucuccuggguu

SEQ ID NO: 608780 - RNA, 19 nt, Human
cagcauucuccaaauagac

SEQ ID NO: 608781 - RNA, 27 nt, Human
cagccccuuggcuucaaagcacuccuu

SEQ ID NO: 608782 - RNA, 19 nt, Human
cccaaccaggugugggaug

SEQ ID NO: 608783 - RNA, 18 nt, Human
cccgggugugcagaggcg

SEQ ID NO: 608784 - RNA, 20 nt, Human
cccgggugugcagaggcggg

SEQ ID NO: 608785 - RNA, 18 nt, Human
ccucaaguggcugcugug

SEQ ID NO: 608786 - RNA, 22 nt, Human
ccugcugcugagccccucugac

SEQ ID NO: 608787 - RNA, 19 nt, Human
ccugcuggaggaacgggag

SEQ ID NO: 608788 - RNA, 24 nt, Human
cuaaaacuucaggaguuccaacgg

SEQ ID NO: 608789 - RNA, 22 nt, Human
cucagcccugcccucaaguggc

SEQ ID NO: 608790 - RNA, 21 nt, Human
cucugaccagaguggcucucc

SEQ ID NO: 608791 - RNA, 21 nt, Human
cugaacuugaaaaaucucaca

SEQ ID NO: 608792 - RNA, 24 nt, Human
cugugccagggacagaaagggggu

SEQ ID NO: 608793 - RNA, 23 nt, Human
cuuuuuuuuuuuuuuuuuccuuu

SEQ ID NO: 608794 - RNA, 24 nt, Human
cuuuuuuuuuuuuuuuuuccuuua

SEQ ID NO: 608795 - RNA, 22 nt, Human
gaacagcuugagggaaagaagc

SEQ ID NO: 608796 - RNA, 28 nt, Human
gaaucaagucuuuuuuuuuuuuuuuuuc

SEQ ID NO: 608797 - RNA, 21 nt, Human
gacccaggaacccagcuggug

SEQ ID NO: 608798 - RNA, 24 nt, Human
gacuuagccgcacucacuaauagg

SEQ ID NO: 608799 - RNA, 21 nt, Human
gagacagggccugcugcugag

SEQ ID NO: 608800 - RNA, 21 nt, Human
gaggcugggaggagagggggc

SEQ ID NO: 608801 - RNA, 26 nt, Human
gcacagcucccaggagcacagccaga

SEQ ID NO: 608802 - RNA, 21 nt, Human
gccugccaggaacagucacag

SEQ ID NO: 608803 - RNA, 20 nt, Human
gcuacaaccggccugcuguu

SEQ ID NO: 608804 - RNA, 18 nt, Human
gcugugggacagugggag

SEQ ID NO: 608805 - RNA, 22 nt, Human
gcuugagggaaagaagcugggg

SEQ ID NO: 608806 - RNA, 21 nt, Human
gcuuugacgcauagugcagac

SEQ ID NO: 608807 - RNA, 25 nt, Human
ggaaagaagcugggguaucccgggu

SEQ ID NO: 608808 - RNA, 19 nt, Human
ggacagaaagggggugugg

SEQ ID NO: 608809 - RNA, 22 nt, Human
ggacaggcagaggcugggagga

SEQ ID NO: 608810 - RNA, 18 nt, Human
ggagcacagccagacccc

SEQ ID NO: 608811 - RNA, 19 nt, Human
ggcaucugcaggccucuca

SEQ ID NO: 608812 - RNA, 21 nt, Human
ggcugggaggagagggggcug

SEQ ID NO: 608813 - RNA, 23 nt, Human
gggaaagaagcugggguaucccg

SEQ ID NO: 608814 - RNA, 18 nt, Human
gggacaggcagaggcugg

SEQ ID NO: 608815 - RNA, 18 nt, Human
gggacagugggaggacuc

SEQ ID NO: 608816 - RNA, 18 nt, Human
ggggguguggaugcggag

SEQ ID NO: 608817 - RNA, 19 nt, Human
gucacagaagcacacagga

SEQ ID NO: 608818 - RNA, 18 nt, Human
gugacuucugaugaaacu

SEQ ID NO: 608819 - RNA, 19 nt, Human
uaccugggauaugcacagg

SEQ ID NO: 608820 - RNA, 19 nt, Human
uaccugggauaugcacagg

SEQ ID NO: 608821 - RNA, 22 nt, Human
uaccugggauaugcacaggugu

SEQ ID NO: 608822 - RNA, 23 nt, Human
uauguaauaggaaaaaaaaaauc

SEQ ID NO: 608823 - RNA, 21 nt, Human
ucccaggagcacagccagacc

SEQ ID NO: 608824 - RNA, 22 nt, Human
ucugcaggccucucaggugagg

SEQ ID NO: 608825 - RNA, 19 nt, Human
ucugugggacaggcagagg

SEQ ID NO: 608826 - RNA, 23 nt, Human
ucuuuuuuuuuuuuuuuuuccuu

SEQ ID NO: 608827 - RNA, 21 nt, Human
ugaaacuugacccaggaaccc

SEQ ID NO: 608828 - RNA, 26 nt, Human
ugaacagcuugagggaaagaagcugg

SEQ ID NO: 608829 - RNA, 20 nt, Human
ugacccaggaacccagcugg

SEQ ID NO: 608830 - RNA, 21 nt, Human
ugcaucaggcugcacuuuauc

SEQ ID NO: 608831 - RNA, 24 nt, Human
ugccaggaacagucacagaagcac

SEQ ID NO: 608832 - RNA, 20 nt, Human
ugcucagccccuuggcuuca

SEQ ID NO: 608833 - RNA, 20 nt, Human
uggaguuucugaacuugaaa

SEQ ID NO: 608834 - RNA, 24 nt, Human
ugggacagugggaggacucaauau

SEQ ID NO: 608835 - RNA, 18 nt, Human
ugggaggagagggggcug

SEQ ID NO: 608836 - RNA, 20 nt, Human
ugggaggagagggggcuggg

SEQ ID NO: 608837 - RNA, 21 nt, Human
ugggaugagggguggauacag

SEQ ID NO: 608838 - RNA, 18 nt, Human
uucaagggacaagcuucc

SEQ ID NO: 608839 - RNA, 20 nt, Human
uugaaaaaucucacacuuuu

SEQ ID NO: 608840 - RNA, 19 nt, Human
uugcucagccccuuggcuu

SEQ ID NO: 608841 - RNA, 24 nt, Human
uuuuuuuuuuuuuuuccuuuaggg

SEQ ID NO: 608842 - RNA, 19 nt, Human
aaagugcuaggauuacagg

SEQ ID NO: 608843 - RNA, 24 nt, Human
aaagugcuaggauuacaggcggga

SEQ ID NO: 608844 - RNA, 19 nt, Human
aaguagcugagauuacagg

SEQ ID NO: 608845 - RNA, 26 nt, Human
aaguagcugagauuacaggcgcacgc

SEQ ID NO: 608846 - RNA, 27 nt, Human
aagugauucuccugccccaggcuccca

SEQ ID NO: 608847 - RNA, 26 nt, Human
aagugcuaggauuacaggcgggagcc

SEQ ID NO: 608848 - RNA, 20 nt, Human
acaccccagcaagagaagcc

SEQ ID NO: 608849 - RNA, 19 nt, Human
accgauucaaucaccggcc

SEQ ID NO: 608850 - RNA, 21 nt, Human
accugcagggccgccuccccc

SEQ ID NO: 608851 - RNA, 19 nt, Human
agacaccaacgcgaugucc

SEQ ID NO: 608852 - RNA, 24 nt, Human
agacaccaacgcgauguccuacaa

SEQ ID NO: 608853 - RNA, 22 nt, Human
agaucuccgcucacugcaaccu

SEQ ID NO: 608854 - RNA, 22 nt, Human
agcccugucucuccugauugcu

SEQ ID NO: 608855 - RNA, 22 nt, Human
agcucgaugagcugggccggug

SEQ ID NO: 608856 - RNA, 18 nt, Human
aggcgggcggccggcccg

SEQ ID NO: 608857 - RNA, 25 nt, Human
aggcguugaaauacauggaugaacc

SEQ ID NO: 608858 - RNA, 21 nt, Human
agggccgccucccccacgccg

SEQ ID NO: 608859 - RNA, 21 nt, Human
agguucaagugauucuccugc

SEQ ID NO: 608860 - RNA, 22 nt, Human
agguucaagugauucuccugcc

SEQ ID NO: 608861 - RNA, 19 nt, Human
auccgcccgccucggccuc

SEQ ID NO: 608862 - RNA, 27 nt, Human
caaagugcuaggauuacaggcgggagc

SEQ ID NO: 608863 - RNA, 19 nt, Human
caagagaagccggggccuc

SEQ ID NO: 608864 - RNA, 22 nt, Human
caauuucggcaagaauuaggga

SEQ ID NO: 608865 - RNA, 18 nt, Human
caccccgccuucaccaac

SEQ ID NO: 608866 - RNA, 18 nt, Human
caccgcacccggccaagu

SEQ ID NO: 608867 - RNA, 24 nt, Human
cacgccaccacgcccaauuaauuu

SEQ ID NO: 608868 - RNA, 21 nt, Human
cacugcaaccuccgccuccca

SEQ ID NO: 608869 - RNA, 21 nt, Human
cagaacaccagcaguuggaac

SEQ ID NO: 608870 - RNA, 24 nt, Human
cagaccccugagaccuccccgccu

SEQ ID NO: 608871 - RNA, 24 nt, Human
cagcaagagaagccggggccucag

SEQ ID NO: 608872 - RNA, 21 nt, Human
cagcucuccaacucccucuca

SEQ ID NO: 608873 - RNA, 19 nt, Human
ccaaagugcuaggauuaca

SEQ ID NO: 608874 - RNA, 18 nt, Human
ccaagccaaggcggaugg

SEQ ID NO: 608875 - RNA, 22 nt, Human
ccaaguagcugagauuacaggc

SEQ ID NO: 608876 - RNA, 20 nt, Human
ccagcucuccaacucccucu

SEQ ID NO: 608877 - RNA, 21 nt, Human
ccagcucuccaacucccucuc

SEQ ID NO: 608878 - RNA, 19 nt, Human
ccauguuggccaggauggu

SEQ ID NO: 608879 - RNA, 21 nt, Human
ccauguuggccaggauggucu

SEQ ID NO: 608880 - RNA, 21 nt, Human
ccauguuggccaggauggucu

SEQ ID NO: 608881 - RNA, 19 nt, Human
cccaaguagcugagauuac

SEQ ID NO: 608882 - RNA, 24 nt, Human
cccaaguagcugagauuacaggcg

SEQ ID NO: 608883 - RNA, 24 nt, Human
cccaauuaauuuuuuguauuuuua

SEQ ID NO: 608884 - RNA, 23 nt, Human
cccagguucaagugauucuccuc

SEQ ID NO: 608885 - RNA, 23 nt, Human
cccagguucaagugauucuccug

SEQ ID NO: 608886 - RNA, 21 nt, Human
ccccaccccgccuucaccaac

SEQ ID NO: 608887 - RNA, 18 nt, Human
ccccacgccgcgcccgag

SEQ ID NO: 608888 - RNA, 19 nt, Human
ccccaggcucccaaguagc

SEQ ID NO: 608889 - RNA, 20 nt, Human
cccccaccccgccuucacca

SEQ ID NO: 608890 - RNA, 24 nt, Human
cccccaccccgccuucaccaaccc

SEQ ID NO: 608891 - RNA, 23 nt, Human
ccccccaccccgccuucaccaac

SEQ ID NO: 608892 - RNA, 20 nt, Human
cccccccaccccgccuucac

SEQ ID NO: 608893 - RNA, 23 nt, Human
cccccggccucggccucgcgccc

SEQ ID NO: 608894 - RNA, 22 nt, Human
cccccuucucagguuccaauuu

SEQ ID NO: 608895 - RNA, 19 nt, Human
ccccggccucggccucgcg

SEQ ID NO: 608896 - RNA, 18 nt, Human
ccccugagaccuccccgc

SEQ ID NO: 608897 - RNA, 20 nt, Human
ccccugagaccuccccgccu

SEQ ID NO: 608898 - RNA, 21 nt, Human
ccccuuccuaacugccccccc

SEQ ID NO: 608899 - RNA, 28 nt, Human
cccggccucggccucgcgcccaccaggc

SEQ ID NO: 608900 - RNA, 19 nt, Human
cccggguacgcaccugcag

SEQ ID NO: 608901 - RNA, 22 nt, Human
cccuccuguucacagcugggaa

SEQ ID NO: 608902 - RNA, 18 nt, Human
cccugucugggcgccccc

SEQ ID NO: 608903 - RNA, 21 nt, Human
cccugucugggcgcccccuuc

SEQ ID NO: 608904 - RNA, 21 nt, Human
ccgccccguucucucggccgc

SEQ ID NO: 608905 - RNA, 24 nt, Human
ccgccucccagguucaagugauuc

SEQ ID NO: 608906 - RNA, 22 nt, Human
ccgccucugggaaucgccuccc

SEQ ID NO: 608907 - RNA, 24 nt, Human
ccgcgcccucagcccucccgaauc

SEQ ID NO: 608908 - RNA, 19 nt, Human
ccggccucggccucgcgcc

SEQ ID NO: 608909 - RNA, 28 nt, Human
ccggggaccccacgacccccuucucagg

SEQ ID NO: 608910 - RNA, 22 nt, Human
ccuaacugcccccccaccccgc

SEQ ID NO: 608911 - RNA, 24 nt, Human
ccucccagguucaagugauucucc

SEQ ID NO: 608912 - RNA, 22 nt, Human
ccuccuguucacagcugggaag

SEQ ID NO: 608913 - RNA, 19 nt, Human
ccucggccucgcgcccacc

SEQ ID NO: 608914 - RNA, 18 nt, Human
ccuuccccgagcccuguc

SEQ ID NO: 608915 - RNA, 24 nt, Human
cgacaccccagcaagagaagccgg

SEQ ID NO: 608916 - RNA, 22 nt, Human
cgacccccuucucagguuccaa

SEQ ID NO: 608917 - RNA, 22 nt, Human
cgcccaggcuaaaguacagugc

SEQ ID NO: 608918 - RNA, 21 nt, Human
cgccccguucucucggccgcg

SEQ ID NO: 608919 - RNA, 22 nt, Human
cgccucccagguucaagugauu

SEQ ID NO: 608920 - RNA, 24 nt, Human
cgccucggccucccaaagugcuag

SEQ ID NO: 608921 - RNA, 25 nt, Human
cgccuucaccaacccgaagcccgag

SEQ ID NO: 608922 - RNA, 25 nt, Human
cggcggcggugaccgccccguucuc

SEQ ID NO: 608923 - RNA, 20 nt, Human
cgggagccaccgcacccggc

SEQ ID NO: 608924 - RNA, 21 nt, Human
cuaaaguacagugcccagauc

SEQ ID NO: 608925 - RNA, 24 nt, Human
cucacugcaaccuccgccucccag

SEQ ID NO: 608926 - RNA, 21 nt, Human
cuccacaccaaccagcucucc

SEQ ID NO: 608927 - RNA, 25 nt, Human
cucccaagccaaggcggaugcaggc

SEQ ID NO: 608928 - RNA, 21 nt, Human
cucccaaguagcugagauuac

SEQ ID NO: 608929 - RNA, 18 nt, Human
cucccagguucaagugau

SEQ ID NO: 608930 - RNA, 19 nt, Human
cucuccaacucccucucag

SEQ ID NO: 608931 - RNA, 20 nt, Human
cucugucgcccaggcuaaag

SEQ ID NO: 608932 - RNA, 23 nt, Human
cucugucgcccaggcuaaaguac

SEQ ID NO: 608933 - RNA, 24 nt, Human
cucuugaccgugugauccgcccgc

SEQ ID NO: 608934 - RNA, 23 nt, Human
cugcaaccuccgccucccagguu

SEQ ID NO: 608935 - RNA, 24 nt, Human
cugcaaccuccgccucccagguuc

SEQ ID NO: 608936 - RNA, 20 nt, Human
cugcagggccgccuccccca

SEQ ID NO: 608937 - RNA, 18 nt, Human
cuugcagaacaccagcag

SEQ ID NO: 608938 - RNA, 24 nt, Human
gaaaacgauuccucuacccacaga

SEQ ID NO: 608939 - RNA, 22 nt, Human
gaaauacauggaugaaccaccg

SEQ ID NO: 608940 - RNA, 18 nt, Human
gaaucgacaccccagcaa

SEQ ID NO: 608941 - RNA, 20 nt, Human
gaccccacgacccccuucuc

SEQ ID NO: 608942 - RNA, 24 nt, Human
gaccgugugauccgcccgccucgg

SEQ ID NO: 608943 - RNA, 18 nt, Human
gagcuagugcagaaccca

SEQ ID NO: 608944 - RNA, 18 nt, Human
gauuacaggcgcacgcca

SEQ ID NO: 608945 - RNA, 18 nt, Human
gauuacaggcgggagcca

SEQ ID NO: 608946 - RNA, 24 nt, Human
gauucaaucaccggccacugcccc

SEQ ID NO: 608947 - RNA, 22 nt, Human
gcaaccuccgccucccagguuc

SEQ ID NO: 608948 - RNA, 18 nt, Human
gcacggggcggacaggag

SEQ ID NO: 608949 - RNA, 22 nt, Human
gccauguuggccaggauggucu

SEQ ID NO: 608950 - RNA, 21 nt, Human
gcccaauuaauuuuuuguauu

SEQ ID NO: 608951 - RNA, 26 nt, Human
gcccccccaccccgccuucaccaacc

SEQ ID NO: 608952 - RNA, 24 nt, Human
gccccguucucucggccgcgcccu

SEQ ID NO: 608953 - RNA, 20 nt, Human
gcccucccgaaucgacaccc

SEQ ID NO: 608954 - RNA, 18 nt, Human
gcggaugcaggccuggcg

SEQ ID NO: 608955 - RNA, 18 nt, Human
gcuaaaguacagugccca

SEQ ID NO: 608956 - RNA, 22 nt, Human
ggaugaaccaccgacccgcaag

SEQ ID NO: 608957 - RNA, 22 nt, Human
ggauuacaggcgggagccaccg

SEQ ID NO: 608958 - RNA, 22 nt, Human
gggaagaagcucgaugagcugg

SEQ ID NO: 608959 - RNA, 21 nt, Human
gggaggcggggagucucagag

SEQ ID NO: 608960 - RNA, 19 nt, Human
ggggguuuugccauguugg

SEQ ID NO: 608961 - RNA, 24 nt, Human
ggggguuuugccauguuggccagg

SEQ ID NO: 608962 - RNA, 22 nt, Human
gggguuuugccauguuggccag

SEQ ID NO: 608963 - RNA, 23 nt, Human
gggguuuugccauguuggccagg

SEQ ID NO: 608964 - RNA, 24 nt, Human
ggucucucugucgcccaggcuaaa

SEQ ID NO: 608965 - RNA, 24 nt, Human
gugauccgcccgccucggccuccc

SEQ ID NO: 608966 - RNA, 24 nt, Human
uaacagucucaaagagaaaacgau

SEQ ID NO: 608967 - RNA, 24 nt, Human
uaauuuuuuguauuuuuagucgag

SEQ ID NO: 608968 - RNA, 25 nt, Human
uaauuuuuuguauuuuuagucgaga

SEQ ID NO: 608969 - RNA, 24 nt, Human
uacaaaggccugaagacgcgcagc

SEQ ID NO: 608970 - RNA, 24 nt, Human
uacaggcgcacgccaccacgccca

SEQ ID NO: 608971 - RNA, 23 nt, Human
uacaggcgggagccaccgcaccc

SEQ ID NO: 608972 - RNA, 21 nt, Human
uaggauuacaggcgggagcca

SEQ ID NO: 608973 - RNA, 22 nt, Human
uaggauuacaggcgggagccac

SEQ ID NO: 608974 - RNA, 23 nt, Human
uaggauuacaggcgggagccacc

SEQ ID NO: 608975 - RNA, 24 nt, Human
uaggauuacaggcgggagccaccg

SEQ ID NO: 608976 - RNA, 25 nt, Human
uagucgagauggggguuuugccaug

SEQ ID NO: 608977 - RNA, 19 nt, Human
ucacugcaaccuccgccuc

SEQ ID NO: 608978 - RNA, 24 nt, Human
ucacugcaaccuccgccucccagg

SEQ ID NO: 608979 - RNA, 25 nt, Human
ucacugcaaccuccgccucccaggu

SEQ ID NO: 608980 - RNA, 27 nt, Human
ucacugcaaccuccgccucccagguuc

SEQ ID NO: 608981 - RNA, 23 nt, Human
uccacaccaaccagcucuccaac

SEQ ID NO: 608982 - RNA, 24 nt, Human
ucccaaagugcuaggauuacaggc

SEQ ID NO: 608983 - RNA, 24 nt, Human
ucccaaguagcugagauuacaggc

SEQ ID NO: 608984 - RNA, 22 nt, Human
ucccacaagaccaccccgacuu

SEQ ID NO: 608985 - RNA, 21 nt, Human
ucccagguucaagugauucuc

SEQ ID NO: 608986 - RNA, 24 nt, Human
ucccagguucaagugauucuccug

SEQ ID NO: 608987 - RNA, 18 nt, Human
ucccuccacaccaaccag

SEQ ID NO: 608988 - RNA, 21 nt, Human
uccuaacugcccccccacccc

SEQ ID NO: 608989 - RNA, 22 nt, Human
uccugauugcucccaagccaag

SEQ ID NO: 608990 - RNA, 21 nt, Human
ucgacaccccagcaagagaag

SEQ ID NO: 608991 - RNA, 18 nt, Human
ucggccucccaaagugcu

SEQ ID NO: 608992 - RNA, 22 nt, Human
ucucucugucgcccaggcuaaa

SEQ ID NO: 608993 - RNA, 24 nt, Human
ucucucugucgcccaggcuaaagu

SEQ ID NO: 608994 - RNA, 21 nt, Human
ucucuuccgccgcagccccgg

SEQ ID NO: 608995 - RNA, 22 nt, Human
ucucuugaccgugugauccgcc

SEQ ID NO: 608996 - RNA, 22 nt, Human
ucugucaccaauugcccggagc

SEQ ID NO: 608997 - RNA, 24 nt, Human
ucugucgcccaggcuaaaguacag

SEQ ID NO: 608998 - RNA, 19 nt, Human
ugaccgauucaaucaccgg

SEQ ID NO: 608999 - RNA, 18 nt, Human
ugagaugggucucucugu

SEQ ID NO: 609000 - RNA, 22 nt, Human
ugagauuacaggcgcacgccac

SEQ ID NO: 609001 - RNA, 24 nt, Human
ugagauuacaggcgcacgccacca

SEQ ID NO: 609002 - RNA, 20 nt, Human
ugccaagugcagacgguggg

SEQ ID NO: 609003 - RNA, 22 nt, Human
ugccauguuggccaggaugguc

SEQ ID NO: 609004 - RNA, 24 nt, Human
ugccauguuggccaggauggucuu

SEQ ID NO: 609005 - RNA, 21 nt, Human
ugccccaggcucccaaguagc

SEQ ID NO: 609006 - RNA, 24 nt, Human
ugccccaggcucccaaguagcuga

SEQ ID NO: 609007 - RNA, 20 nt, Human
ugcccggagcuagugcagaa

SEQ ID NO: 609008 - RNA, 24 nt, Human
ugcuaggauuacaggcgggagcca

SEQ ID NO: 609009 - RNA, 24 nt, Human
uggccaggauggucuugaucucuu

SEQ ID NO: 609010 - RNA, 23 nt, Human
ugggaggcggggagucucagagg

SEQ ID NO: 609011 - RNA, 24 nt, Human
uggggguuuugccauguuggccag

SEQ ID NO: 609012 - RNA, 25 nt, Human
uuagucgagauggggguuuugccau

SEQ ID NO: 609013 - RNA, 25 nt, Human
uucaagugauucuccugccccaggc

SEQ ID NO: 609014 - RNA, 23 nt, Human
uucuccugccccaggcucccaag

SEQ ID NO: 609015 - RNA, 19 nt, Human
uugcccggagcuagugcag

SEQ ID NO: 609016 - RNA, 24 nt, Human
uuguauuuuuagucgagauggggg

SEQ ID NO: 609017 - RNA, 18 nt, Human
uuuacaggaaauaacauu

SEQ ID NO: 609018 - RNA, 21 nt, Human
uuuuaaaaaaugaaaauauuu

SEQ ID NO: 609019 - RNA, 20 nt, Human
uuuuguauuuuuagucgaga

SEQ ID NO: 609020 - RNA, 18 nt, Human
uuuuuagucgagaugggg

SEQ ID NO: 609021 - RNA, 21 nt, Human
uuuuuguauuuuuagucgaga

SEQ ID NO: 609022 - RNA, 24 nt, Human
aaaaaaagaaaaaaaaagaaagaa

SEQ ID NO: 609023 - RNA, 25 nt, Human
aaaaaaagaaagaaaagguaaaaag

SEQ ID NO: 609024 - RNA, 18 nt, Human
aacuccuggugacagagu

SEQ ID NO: 609025 - RNA, 19 nt, Human
aacuugcccuucuuccucc

SEQ ID NO: 609026 - RNA, 18 nt, Human
aagaaaaaaaaagaaaga

SEQ ID NO: 609027 - RNA, 19 nt, Human
aagagaaacccagggcagc

SEQ ID NO: 609028 - RNA, 22 nt, Human
aagcacaucaagcgaaagcucu

SEQ ID NO: 609029 - RNA, 20 nt, Human
aagcaccagcccuggcuacc

SEQ ID NO: 609030 - RNA, 23 nt, Human
acacguggcugggccgaaguggg

SEQ ID NO: 609031 - RNA, 22 nt, Human
acagcuccuuagcugcccucag

SEQ ID NO: 609032 - RNA, 19 nt, Human
acaggcuugaauguacggu

SEQ ID NO: 609033 - RNA, 20 nt, Human
acuuaugacuaucucucccu

SEQ ID NO: 609034 - RNA, 19 nt, Human
acuuguuucacuuuuccuc

SEQ ID NO: 609035 - RNA, 23 nt, Human
agaagaagacaggaugcuacaaa

SEQ ID NO: 609036 - RNA, 24 nt, Human
agaagaagacaggaugcuacaaag

SEQ ID NO: 609037 - RNA, 18 nt, Human
agaagacaggaugcuaca

SEQ ID NO: 609038 - RNA, 19 nt, Human
agaggaaggagaucgggga

SEQ ID NO: 609039 - RNA, 19 nt, Human
agccaaugagcucauggcc

SEQ ID NO: 609040 - RNA, 20 nt, Human
agccccuaugucccacccag

SEQ ID NO: 609041 - RNA, 21 nt, Human
agcccuggcuacccagccucc

SEQ ID NO: 609042 - RNA, 19 nt, Human
agccugcaucugaacuugc

SEQ ID NO: 609043 - RNA, 23 nt, Human
aggaaggagaucggggagcauga

SEQ ID NO: 609044 - RNA, 18 nt, Human
aggcaaggaaaggcccca

SEQ ID NO: 609045 - RNA, 23 nt, Human
aggcaaggaaaggccccagcagc

SEQ ID NO: 609046 - RNA, 21 nt, Human
aggcagaagagcccuccagag

SEQ ID NO: 609047 - RNA, 26 nt, Human
agggauugaguaagagaaacccaggg

SEQ ID NO: 609048 - RNA, 18 nt, Human
aguguuguggggcaagcu

SEQ ID NO: 609049 - RNA, 24 nt, Human
auaggacaagaaaaggauacaaaa

SEQ ID NO: 609050 - RNA, 23 nt, Human
augagcucauggccucagggguu

SEQ ID NO: 609051 - RNA, 18 nt, Human
augugccauauccacuuu

SEQ ID NO: 609052 - RNA, 22 nt, Human
caaaccaggcagcacagaagaa

SEQ ID NO: 609053 - RNA, 23 nt, Human
caaaccuaaccuccgccgaauuc

SEQ ID NO: 609054 - RNA, 31 nt, Human
cacagcuucaaccuucuccucuaccccuuuu

SEQ ID NO: 609055 - RNA, 21 nt, Human
caccagcccuggcuacccagc

SEQ ID NO: 609056 - RNA, 25 nt, Human
cacccugaccacagccagccacacc

SEQ ID NO: 609057 - RNA, 20 nt, Human
cacgcuagcuccacucccaa

SEQ ID NO: 609058 - RNA, 18 nt, Human
cacgugugacugagagau

SEQ ID NO: 609059 - RNA, 22 nt, Human
cagcaaaucaucugacucuagu

SEQ ID NO: 609060 - RNA, 20 nt, Human
cagcagccugcacaggcucu

SEQ ID NO: 609061 - RNA, 23 nt, Human
cagccccuaugucccacccagga

SEQ ID NO: 609062 - RNA, 26 nt, Human
cagccuaccugaacucccucacacug

SEQ ID NO: 609063 - RNA, 25 nt, Human
caggaugcuacaaaggcagccaaug

SEQ ID NO: 609064 - RNA, 26 nt, Human
caggcccaagacccaugccccgaggg

SEQ ID NO: 609065 - RNA, 27 nt, Human
cauauccacuuucaucaucugggcuaa

SEQ ID NO: 609066 - RNA, 20 nt, Human
cauccucuuccucccccaag

SEQ ID NO: 609067 - RNA, 21 nt, Human
caucuccccacgagaaacuug

SEQ ID NO: 609068 - RNA, 19 nt, Human
ccacaggucauccuuggug

SEQ ID NO: 609069 - RNA, 19 nt, Human
ccagccacccagccugcau

SEQ ID NO: 609070 - RNA, 26 nt, Human
ccaggacaaccccuaggagguuuuga

SEQ ID NO: 609071 - RNA, 23 nt, Human
cccagcagcucuguccccuaccc

SEQ ID NO: 609072 - RNA, 23 nt, Human
cccagccacccagccugcaucug

SEQ ID NO: 609073 - RNA, 24 nt, Human
cccagggcagcccugccacagaga

SEQ ID NO: 609074 - RNA, 23 nt, Human
ccccagcagcucuguccccuacc

SEQ ID NO: 609075 - RNA, 19 nt, Human
ccccaucucucucagcccc

SEQ ID NO: 609076 - RNA, 20 nt, Human
cccccaucucucucagcccc

SEQ ID NO: 609077 - RNA, 19 nt, Human
ccccuaugucccacccagg

SEQ ID NO: 609078 - RNA, 22 nt, Human
cccuacccugggcucugccucc

SEQ ID NO: 609079 - RNA, 19 nt, Human
cccuaccuagaggcacagg

SEQ ID NO: 609080 - RNA, 18 nt, Human
cccucacacugaugcucc

SEQ ID NO: 609081 - RNA, 18 nt, Human
cccuuccuuuuuucuguc

SEQ ID NO: 609082 - RNA, 20 nt, Human
cccuuccuuuuuucugucug

SEQ ID NO: 609083 - RNA, 18 nt, Human
cccuucuuccuccuuccu

SEQ ID NO: 609084 - RNA, 20 nt, Human
ccuccagaguagucccuuag

SEQ ID NO: 609085 - RNA, 23 nt, Human
ccuggacagcaaacuucucucuu

SEQ ID NO: 609086 - RNA, 21 nt, Human
ccuggcuacccagccucccuu

SEQ ID NO: 609087 - RNA, 22 nt, Human
ccuggcuacccagccucccuug

SEQ ID NO: 609088 - RNA, 18 nt, Human
cgggagugcgcugauggu

SEQ ID NO: 609089 - RNA, 21 nt, Human
cuacccugggcucugccucca

SEQ ID NO: 609090 - RNA, 21 nt, Human
cucccaaaccuaaccuccgcc

SEQ ID NO: 609091 - RNA, 18 nt, Human
cuccuggugacagagugg

SEQ ID NO: 609092 - RNA, 19 nt, Human
cucuccuucccacucacua

SEQ ID NO: 609093 - RNA, 22 nt, Human
cugaacuugcccuucuuccucc

SEQ ID NO: 609094 - RNA, 20 nt, Human
cugauauugaaaaaaagaaa

SEQ ID NO: 609095 - RNA, 18 nt, Human
cugcuugcaucuguugag

SEQ ID NO: 609096 - RNA, 21 nt, Human
cuugggacaacagguaggugc

SEQ ID NO: 609097 - RNA, 23 nt, Human
gaaaggccccagcagcucugucc

SEQ ID NO: 609098 - RNA, 18 nt, Human
gaaccgaggcagccaagg

SEQ ID NO: 609099 - RNA, 22 nt, Human
gaacucccucacacugaugcuc

SEQ ID NO: 609100 - RNA, 20 nt, Human
gaagaagacaggaugcuaca

SEQ ID NO: 609101 - RNA, 18 nt, Human
gagaaacccagggcagcc

SEQ ID NO: 609102 - RNA, 18 nt, Human
gaggagcugagccaaugg

SEQ ID NO: 609103 - RNA, 24 nt, Human
gaggagcugagccaauggcgggag

SEQ ID NO: 609104 - RNA, 18 nt, Human
gccagcuucacagucaug

SEQ ID NO: 609105 - RNA, 18 nt, Human
gccccagcagcucugucc

SEQ ID NO: 609106 - RNA, 19 nt, Human
gccuaccugaacucccuca

SEQ ID NO: 609107 - RNA, 18 nt, Human
gcugcaaacacguggcug

SEQ ID NO: 609108 - RNA, 20 nt, Human
ggaaaggccccagcagcucu

SEQ ID NO: 609109 - RNA, 21 nt, Human
ggacaagaaaaggauacaaaa

SEQ ID NO: 609110 - RNA, 22 nt, Human
ggcaccugccacagcagcuccc

SEQ ID NO: 609111 - RNA, 20 nt, Human
ggcagccaaggaaugugagc

SEQ ID NO: 609112 - RNA, 19 nt, Human
ggccccagcagcucugucc

SEQ ID NO: 609113 - RNA, 23 nt, Human
ggccucagggguuuuaagcacca

SEQ ID NO: 609114 - RNA, 20 nt, Human
gggccgaagugggcaaugcc

SEQ ID NO: 609115 - RNA, 20 nt, Human
gggccgaagugggcaaugcc

SEQ ID NO: 609116 - RNA, 18 nt, Human
gggcugccuggggcucgu

SEQ ID NO: 609117 - RNA, 18 nt, Human
ggggaugggaguggggaa

SEQ ID NO: 609118 - RNA, 23 nt, Human
ggggcucccguucacucuggggg

SEQ ID NO: 609119 - RNA, 20 nt, Human
guagcacccugaccacagcc

SEQ ID NO: 609120 - RNA, 25 nt, Human
uaaaaagguaaucugugacacaaaa

SEQ ID NO: 609121 - RNA, 19 nt, Human
uaaccuccgccgaauucuc

SEQ ID NO: 609122 - RNA, 26 nt, Human
uaagagaaacccagggcagcccugcc

SEQ ID NO: 609123 - RNA, 24 nt, Human
uacagcaaaucaucugacucuagu

SEQ ID NO: 609124 - RNA, 25 nt, Human
uacagcaaaucaucugacucuagua

SEQ ID NO: 609125 - RNA, 26 nt, Human
uacagcaaaucaucugacucuaguaa

SEQ ID NO: 609126 - RNA, 22 nt, Human
uaccugaacucccucacacuga

SEQ ID NO: 609127 - RNA, 20 nt, Human
uagaggaaggagaucgggga

SEQ ID NO: 609128 - RNA, 21 nt, Human
uagcacgcuagcuccacuccc

SEQ ID NO: 609129 - RNA, 21 nt, Human
uaguagcacccugaccacagc

SEQ ID NO: 609130 - RNA, 25 nt, Human
uaugacuaucucucccuuucuccaa

SEQ ID NO: 609131 - RNA, 22 nt, Human
uaugucccacccaggacaaagc

SEQ ID NO: 609132 - RNA, 25 nt, Human
ucacucaucauacuaaugugauucc

SEQ ID NO: 609133 - RNA, 19 nt, Human
ucacuuguuucacuuuucc

SEQ ID NO: 609134 - RNA, 19 nt, Human
ucagaacaguggccuacug

SEQ ID NO: 609135 - RNA, 21 nt, Human
ucagaacaguggccuacuggg

SEQ ID NO: 609136 - RNA, 20 nt, Human
ucaggcccaagacccaugcc

SEQ ID NO: 609137 - RNA, 22 nt, Human
ucaugccacacugccaacacag

SEQ ID NO: 609138 - RNA, 24 nt, Human
ucccacagcaggggcucccguuca

SEQ ID NO: 609139 - RNA, 18 nt, Human
ucccacccaggacaaagc

SEQ ID NO: 609140 - RNA, 22 nt, Human
uccgccccagugccugccaccu

SEQ ID NO: 609141 - RNA, 18 nt, Human
uccgccgaauucucugca

SEQ ID NO: 609142 - RNA, 21 nt, Human
ucgccagcuucacagucaugc

SEQ ID NO: 609143 - RNA, 18 nt, Human
ucucacucuccuucccac

SEQ ID NO: 609144 - RNA, 21 nt, Human
ucucagccccuaugucccacc

SEQ ID NO: 609145 - RNA, 23 nt, Human
ucuccccccaucucucucagccc

SEQ ID NO: 609146 - RNA, 20 nt, Human
ucucucagccccuauguccc

SEQ ID NO: 609147 - RNA, 19 nt, Human
ucugggggcaccugccaca

SEQ ID NO: 609148 - RNA, 21 nt, Human
ucugucuugguagggcuugau

SEQ ID NO: 609149 - RNA, 21 nt, Human
ucuuccacuuaugacuaucuc

SEQ ID NO: 609150 - RNA, 26 nt, Human
ugaaggcucuggcuuuaggagugcuc

SEQ ID NO: 609151 - RNA, 21 nt, Human
ugaauguacgguuuuuccaau

SEQ ID NO: 609152 - RNA, 26 nt, Human
ugacacaauccaaaugcuuacacucc

SEQ ID NO: 609153 - RNA, 20 nt, Human
ugacucccaggacaaccccu

SEQ ID NO: 609154 - RNA, 20 nt, Human
ugacucccaggacaaccccu

SEQ ID NO: 609155 - RNA, 19 nt, Human
ugacuuuugacauuaguga

SEQ ID NO: 609156 - RNA, 21 nt, Human
ugagaagcucagcagaugggc

SEQ ID NO: 609157 - RNA, 18 nt, Human
ugagaucaaaccaggcaa

SEQ ID NO: 609158 - RNA, 23 nt, Human
ugagcgccugucagccuacgacc

SEQ ID NO: 609159 - RNA, 19 nt, Human
ugaguaagagaaacccagg

SEQ ID NO: 609160 - RNA, 23 nt, Human
ugcacacccacacugcuugcauc

SEQ ID NO: 609161 - RNA, 18 nt, Human
ugcaucuguugaguguug

SEQ ID NO: 609162 - RNA, 18 nt, Human
ugccaggcagaagagccc

SEQ ID NO: 609163 - RNA, 22 nt, Human
ugccucauuuccauuuccuuca

SEQ ID NO: 609164 - RNA, 22 nt, Human
ugccuccaucuccccacgagaa

SEQ ID NO: 609165 - RNA, 21 nt, Human
ugccuggggcucgucagcagc

SEQ ID NO: 609166 - RNA, 19 nt, Human
uggcugggccgaagugggc

SEQ ID NO: 609167 - RNA, 19 nt, Human
ugggccgaagugggcaaug

SEQ ID NO: 609168 - RNA, 18 nt, Human
ugggggaugggagugggg

SEQ ID NO: 609169 - RNA, 19 nt, Human
ugguagaggaaggagaucg

SEQ ID NO: 609170 - RNA, 20 nt, Human
ugucuccccccaucucucuc

SEQ ID NO: 609171 - RNA, 18 nt, Human
uguucagcauccgauggc

SEQ ID NO: 609172 - RNA, 19 nt, Human
uuaaacuccuggugacaga

SEQ ID NO: 609173 - RNA, 19 nt, Human
uuaagcaccagcccuggcu

SEQ ID NO: 609174 - RNA, 22 nt, Human
uuaagcaccagcccuggcuacc

SEQ ID NO: 609175 - RNA, 20 nt, Human
uuagugaguuaauucuuaac

SEQ ID NO: 609176 - RNA, 23 nt, Human
uucacaaaguucccacagcaggg

SEQ ID NO: 609177 - RNA, 18 nt, Human
uucacagucaugcaggga

SEQ ID NO: 609178 - RNA, 26 nt, Human
uucagcauccgauggcaguccacagg

SEQ ID NO: 609179 - RNA, 21 nt, Human
uucccaggcaaggaaaggccc

SEQ ID NO: 609180 - RNA, 24 nt, Human
uucugucugucuugguagggcuug

SEQ ID NO: 609181 - RNA, 22 nt, Human
uuuccauuuccuucacaucugu

SEQ ID NO: 609182 - RNA, 19 nt, Human
uuuuaagcaccagcccugg

SEQ ID NO: 609183 - RNA, 18 nt, Human
acacaauacaaaagacac

SEQ ID NO: 609184 - RNA, 22 nt, Human
acucuaaauuuuuaaaaaugga

SEQ ID NO: 609185 - RNA, 23 nt, Human
auaaauauaacuuuccaguccau

SEQ ID NO: 609186 - RNA, 24 nt, Human
auauaaauauaacuuuccagucca

SEQ ID NO: 609187 - RNA, 22 nt, Human
auguacauaggcaauuaucaua

SEQ ID NO: 609188 - RNA, 23 nt, Human
caaaagacacaggcuaaaacagg

SEQ ID NO: 609189 - RNA, 31 nt, Human
cacaauacaaaagacacaggcuaaaacaggg

SEQ ID NO: 609190 - RNA, 19 nt, Human
cacacaauacaaaagacac

SEQ ID NO: 609191 - RNA, 19 nt, Human
cacaggcuaaaacaggccu

SEQ ID NO: 609192 - RNA, 21 nt, Human
cagaguagagcgcaagcuauu

SEQ ID NO: 609193 - RNA, 24 nt, Human
ccuaugacaaugccauuguuuauu

SEQ ID NO: 609194 - RNA, 25 nt, Human
cuaagauauauaccuaaugaagauu

SEQ ID NO: 609195 - RNA, 25 nt, Human
cucaacagaagcuccaacguuuucc

SEQ ID NO: 609196 - RNA, 21 nt, Human
cucaguaacacagaaauaaga

SEQ ID NO: 609197 - RNA, 19 nt, Human
uaaaaggaaggccuaugac

SEQ ID NO: 609198 - RNA, 22 nt, Human
uaacgcagcccuucuauuuccc

SEQ ID NO: 609199 - RNA, 21 nt, Human
uaagugauuaggguccucagu

SEQ ID NO: 609200 - RNA, 24 nt, Human
uacaaaagacacaggcuaaaacag

SEQ ID NO: 609201 - RNA, 21 nt, Human
uagaauucuuuagcaacacac

SEQ ID NO: 609202 - RNA, 21 nt, Human
ucacugucuuuccugaaguuc

SEQ ID NO: 609203 - RNA, 24 nt, Human
ucagaaagagacuucauaaaaaca

SEQ ID NO: 609204 - RNA, 22 nt, Human
uccacagcaauuuucuaacccu

SEQ ID NO: 609205 - RNA, 23 nt, Human
uccacauaacuacagaguagagc

SEQ ID NO: 609206 - RNA, 21 nt, Human
ugaaauagguauauuuggaua

SEQ ID NO: 609207 - RNA, 19 nt, Human
uggauguuccacagcaauu

SEQ ID NO: 609208 - RNA, 20 nt, Human
uuuccauuuuucacugucuu

SEQ ID NO: 609209 - RNA, 20 nt, Human
aaaguccccuccagcuuucc

SEQ ID NO: 609210 - RNA, 21 nt, Human
aagaggggaccuggggcugcc

SEQ ID NO: 609211 - RNA, 20 nt, Human
aagcagcauuuggaaugcag

SEQ ID NO: 609212 - RNA, 19 nt, Human
aaggagcugcaagaacagg

SEQ ID NO: 609213 - RNA, 19 nt, Human
aaggagcugcaagaacagg

SEQ ID NO: 609214 - RNA, 21 nt, Human
aaggagucucggcgaugccug

SEQ ID NO: 609215 - RNA, 20 nt, Human
acacugcagcuaugcugggc

SEQ ID NO: 609216 - RNA, 24 nt, Human
accccgucugcccaggguuguucc

SEQ ID NO: 609217 - RNA, 21 nt, Human
agaaggggucagauggacagg

SEQ ID NO: 609218 - RNA, 19 nt, Human
agagccuuccagaagacuc

SEQ ID NO: 609219 - RNA, 18 nt, Human
agauucaggcagucagca

SEQ ID NO: 609220 - RNA, 18 nt, Human
agcccaguuagauggcug

SEQ ID NO: 609221 - RNA, 23 nt, Human
aggacccaaggagucucggcgau

SEQ ID NO: 609222 - RNA, 20 nt, Human
aggcagccucagcagagauu

SEQ ID NO: 609223 - RNA, 20 nt, Human
aggccuuggagcagcagcuu

SEQ ID NO: 609224 - RNA, 22 nt, Human
aggcggaaggacacaggucccu

SEQ ID NO: 609225 - RNA, 18 nt, Human
aggguggggccucugagc

SEQ ID NO: 609226 - RNA, 25 nt, Human
augagacagaacgcuacaaucuguu

SEQ ID NO: 609227 - RNA, 19 nt, Human
auggagcaugccaaggucc

SEQ ID NO: 609228 - RNA, 25 nt, Human
auggcgcggcccuccugccagcacc

SEQ ID NO: 609229 - RNA, 18 nt, Human
auggcuuugugacacugc

SEQ ID NO: 609230 - RNA, 21 nt, Human
caaggcacaggacugcccccu

SEQ ID NO: 609231 - RNA, 25 nt, Human
cacaaggccaggcccuacaagacag

SEQ ID NO: 609232 - RNA, 20 nt, Human
caccugcggcacugacagca

SEQ ID NO: 609233 - RNA, 23 nt, Human
cacugggucagcccuggggaugg

SEQ ID NO: 609234 - RNA, 18 nt, Human
cagaagcagggaggggag

SEQ ID NO: 609235 - RNA, 21 nt, Human
cagcacccugagagcccgugg

SEQ ID NO: 609236 - RNA, 19 nt, Human
cagcaggcagagguuucca

SEQ ID NO: 609237 - RNA, 19 nt, Human
cagcaugagggagggcggg

SEQ ID NO: 609238 - RNA, 19 nt, Human
cagcuuuccaggaaggagc

SEQ ID NO: 609239 - RNA, 19 nt, Human
caggguggggccucugagc

SEQ ID NO: 609240 - RNA, 20 nt, Human
caucggagggcagggcaggc

SEQ ID NO: 609241 - RNA, 25 nt, Human
caucucugcccucagaggcugaggg

SEQ ID NO: 609242 - RNA, 23 nt, Human
cauggugcggcccucccgccagc

SEQ ID NO: 609243 - RNA, 22 nt, Human
ccaggaaggagcugcaagaaca

SEQ ID NO: 609244 - RNA, 24 nt, Human
ccaggccuuggagcagcagcuugu

SEQ ID NO: 609245 - RNA, 24 nt, Human
cccacgguguucuguucccgagcc

SEQ ID NO: 609246 - RNA, 19 nt, Human
cccaggguuguuccucccu

SEQ ID NO: 609247 - RNA, 23 nt, Human
ccccaccccaccccugcaucgga

SEQ ID NO: 609248 - RNA, 19 nt, Human
ccccagcacccugagagcc

SEQ ID NO: 609249 - RNA, 20 nt, Human
ccccagcacccugagagccc

SEQ ID NO: 609250 - RNA, 21 nt, Human
cccccaggcugcccaccccuc

SEQ ID NO: 609251 - RNA, 24 nt, Human
cccccaggcuucuuugggcugguu

SEQ ID NO: 609252 - RNA, 19 nt, Human
ccccccaccccaccccugc

SEQ ID NO: 609253 - RNA, 22 nt, Human
cccccugcccacaaggccaggc

SEQ ID NO: 609254 - RNA, 19 nt, Human
ccccuggccccagcugagu

SEQ ID NO: 609255 - RNA, 25 nt, Human
cccguggcugggcagcucuggaggc

SEQ ID NO: 609256 - RNA, 22 nt, Human
cccucagaggcugagggcccac

SEQ ID NO: 609257 - RNA, 20 nt, Human
cccugagaccccgucugccc

SEQ ID NO: 609258 - RNA, 27 nt, Human
cccugcccacaaggccaggcccuacaa

SEQ ID NO: 609259 - RNA, 20 nt, Human
ccgccccccaccccaccccu

SEQ ID NO: 609260 - RNA, 18 nt, Human
ccucccucucccuccucc

SEQ ID NO: 609261 - RNA, 21 nt, Human
ccucccucucccuccuccuca

SEQ ID NO: 609262 - RNA, 22 nt, Human
ccuccuccucaggcuggggcag

SEQ ID NO: 609263 - RNA, 24 nt, Human
ccuccugucugcauguggccaggc

SEQ ID NO: 609264 - RNA, 19 nt, Human
ccugagaccccgucugccc

SEQ ID NO: 609265 - RNA, 22 nt, Human
ccugagaccccgucugcccagg

SEQ ID NO: 609266 - RNA, 26 nt, Human
ccugcagcuggggcaggccgacgagc

SEQ ID NO: 609267 - RNA, 20 nt, Human
ccugcaucggagggcagggc

SEQ ID NO: 609268 - RNA, 22 nt, Human
ccugccagcaccgucaaggagg

SEQ ID NO: 609269 - RNA, 20 nt, Human
ccuucauucugagggccccu

SEQ ID NO: 609270 - RNA, 21 nt, Human
cgcauccuggaggcgaaggga

SEQ ID NO: 609271 - RNA, 22 nt, Human
cgccccccaccccaccccugca

SEQ ID NO: 609272 - RNA, 20 nt, Human
cggggaggacccaaggaguc

SEQ ID NO: 609273 - RNA, 18 nt, Human
cgucaaggagggggaugc

SEQ ID NO: 609274 - RNA, 23 nt, Human
cguggcugggcagcucuggaggc

SEQ ID NO: 609275 - RNA, 24 nt, Human
cguguagcaccgggccugcagcug

SEQ ID NO: 609276 - RNA, 22 nt, Human
cucagcgcauccuggaggcgaa

SEQ ID NO: 609277 - RNA, 19 nt, Human
cucccucucccuccuccuc

SEQ ID NO: 609278 - RNA, 21 nt, Human
cugcagcuggggcaggccgac

SEQ ID NO: 609279 - RNA, 27 nt, Human
cugcccacaaggccaggcccuacaaga

SEQ ID NO: 609280 - RNA, 21 nt, Human
cugcuccugccuggugccuga

SEQ ID NO: 609281 - RNA, 19 nt, Human
gacuccgccccccacccca

SEQ ID NO: 609282 - RNA, 19 nt, Human
gagccuuugugucugcugu

SEQ ID NO: 609283 - RNA, 19 nt, Human
gagcucagcuuccuccugu

SEQ ID NO: 609284 - RNA, 19 nt, Human
gagcugaagagccuuugug

SEQ ID NO: 609285 - RNA, 22 nt, Human
gaggacccaaggagucucggcg

SEQ ID NO: 609286 - RNA, 18 nt, Human
gagugggagaggcccagu

SEQ ID NO: 609287 - RNA, 20 nt, Human
gccacuccucaccccccagg

SEQ ID NO: 609288 - RNA, 19 nt, Human
gcccaccccucaucagccc

SEQ ID NO: 609289 - RNA, 19 nt, Human
gccccagcacccugagagc

SEQ ID NO: 609290 - RNA, 20 nt, Human
gccccccaccccaccccugc

SEQ ID NO: 609291 - RNA, 20 nt, Human
gccgcuaggacccucugcca

SEQ ID NO: 609292 - RNA, 20 nt, Human
gcggcccucccgccagcacu

SEQ ID NO: 609293 - RNA, 19 nt, Human
gcugaaggguggggccugg

SEQ ID NO: 609294 - RNA, 20 nt, Human
ggaaagccucccccaggcug

SEQ ID NO: 609295 - RNA, 21 nt, Human
ggacccaaggagucucggcga

SEQ ID NO: 609296 - RNA, 19 nt, Human
ggacugcccccugcccaca

SEQ ID NO: 609297 - RNA, 21 nt, Human
ggagggcggggaggacccaag

SEQ ID NO: 609298 - RNA, 20 nt, Human
ggaugcugcuccugccuggu

SEQ ID NO: 609299 - RNA, 20 nt, Human
ggcagggcaggcagcaagca

SEQ ID NO: 609300 - RNA, 27 nt, Human
ggcagguguggggcaggggggaggucc

SEQ ID NO: 609301 - RNA, 23 nt, Human
ggccccuggccccagcugaguuc

SEQ ID NO: 609302 - RNA, 21 nt, Human
ggcccuccugccagcaccguc

SEQ ID NO: 609303 - RNA, 23 nt, Human
ggcggcugaaggguggggccugg

SEQ ID NO: 609304 - RNA, 18 nt, Human
ggcgggacuccgcccccc

SEQ ID NO: 609305 - RNA, 22 nt, Human
gggccacuccucaccccccagg

SEQ ID NO: 609306 - RNA, 20 nt, Human
gggcccacaaggcacaggac

SEQ ID NO: 609307 - RNA, 19 nt, Human
gggcgcugagcugggcccg

SEQ ID NO: 609308 - RNA, 19 nt, Human
gggcugagccucagagcuc

SEQ ID NO: 609309 - RNA, 23 nt, Human
ggggagccggcggccgcuggggg

SEQ ID NO: 609310 - RNA, 23 nt, Human
ggggcaggguggggccucugagc

SEQ ID NO: 609311 - RNA, 19 nt, Human
gguguggggcagggugggg

SEQ ID NO: 609312 - RNA, 21 nt, Human
guccauggcagagccuuccag

SEQ ID NO: 609313 - RNA, 21 nt, Human
guguggggcaggguggggccu

SEQ ID NO: 609314 - RNA, 21 nt, Human
guucaacacugggcuggacac

SEQ ID NO: 609315 - RNA, 21 nt, Human
guuccucccucucccuccucc

SEQ ID NO: 609316 - RNA, 18 nt, Human
ucagagcucugugcuugc

SEQ ID NO: 609317 - RNA, 21 nt, Human
ucagcaggucagcugaaugga

SEQ ID NO: 609318 - RNA, 26 nt, Human
ucagcgcauccuggaggcgaagggag

SEQ ID NO: 609319 - RNA, 21 nt, Human
ucccagggcacugguaacugc

SEQ ID NO: 609320 - RNA, 22 nt, Human
ucccugagaccccgucugccca

SEQ ID NO: 609321 - RNA, 19 nt, Human
uccucccucucccuccucc

SEQ ID NO: 609322 - RNA, 21 nt, Human
ucucccuccuccucaggcugg

SEQ ID NO: 609323 - RNA, 19 nt, Human
ugaaggguggggccuggug

SEQ ID NO: 609324 - RNA, 24 nt, Human
ugagaccccgucugcccaggguug

SEQ ID NO: 609325 - RNA, 23 nt, Human
ugagagcccguggcugggcagcu

SEQ ID NO: 609326 - RNA, 23 nt, Human
ugcaagaacaggcagcggagugg

SEQ ID NO: 609327 - RNA, 21 nt, Human
ugcagaaaacagaagggguca

SEQ ID NO: 609328 - RNA, 20 nt, Human
ugcagcuaugcugggcggga

SEQ ID NO: 609329 - RNA, 22 nt, Human
ugccagcaccgucaaggagggg

SEQ ID NO: 609330 - RNA, 19 nt, Human
ugcccaccccucaucagcc

SEQ ID NO: 609331 - RNA, 19 nt, Human
ugccccagcacccugagag

SEQ ID NO: 609332 - RNA, 20 nt, Human
ugcggcccucccgccagcac

SEQ ID NO: 609333 - RNA, 20 nt, Human
uggagagggcgcugagcugg

SEQ ID NO: 609334 - RNA, 21 nt, Human
uggccaggccuuggagcagca

SEQ ID NO: 609335 - RNA, 23 nt, Human
uggccaggccuuggagcagcagc

SEQ ID NO: 609336 - RNA, 21 nt, Human
uggcugggcagcucuggaggc

SEQ ID NO: 609337 - RNA, 19 nt, Human
ugggagaggcccagugagg

SEQ ID NO: 609338 - RNA, 21 nt, Human
uggggccucugagcccgagga

SEQ ID NO: 609339 - RNA, 19 nt, Human
ugucccgaggcuccugugc

SEQ ID NO: 609340 - RNA, 18 nt, Human
ugugccagggggcugagc

SEQ ID NO: 609341 - RNA, 22 nt, Human
uguggcagcaugagggagggcg

SEQ ID NO: 609342 - RNA, 19 nt, Human
uguggccaggccuuggagc

SEQ ID NO: 609343 - RNA, 20 nt, Human
uuccuccugucugcaugugg

SEQ ID NO: 609344 - RNA, 19 nt, Human
uucuuugggcugguucugg

SEQ ID NO: 609345 - RNA, 22 nt, Human
uucuuugggcugguucuggaag

SEQ ID NO: 609346 - RNA, 24 nt, Human
aaaagcacccaauaugggauccuc

SEQ ID NO: 609347 - RNA, 20 nt, Human
aaaaugguucucuccaacca

SEQ ID NO: 609348 - RNA, 23 nt, Human
aaacaaaacaaaaauugcuucca

SEQ ID NO: 609349 - RNA, 21 nt, Human
aaacaaaggcaagacagccac

SEQ ID NO: 609350 - RNA, 25 nt, Human
aaacaagacaucuuacgaaacagaa

SEQ ID NO: 609351 - RNA, 22 nt, Human
aaacagaaagcaagaccacuuc

SEQ ID NO: 609352 - RNA, 24 nt, Human
aaacagaaagcaagaccacuucgg

SEQ ID NO: 609353 - RNA, 19 nt, Human
aaacgcccauguacauccc

SEQ ID NO: 609354 - RNA, 22 nt, Human
aaacucaugcccuguaaguaug

SEQ ID NO: 609355 - RNA, 26 nt, Human
aaagaacaugcugagcacaagcugcg

SEQ ID NO: 609356 - RNA, 22 nt, Human
aaaggagcacagacccuccacg

SEQ ID NO: 609357 - RNA, 21 nt, Human
aaagucuuuaaugcuaaaaac

SEQ ID NO: 609358 - RNA, 18 nt, Human
aacagaaagcaagaccac

SEQ ID NO: 609359 - RNA, 20 nt, Human
aacggagguuggcaaaggaa

SEQ ID NO: 609360 - RNA, 21 nt, Human
aagagucuuccugagggcccc

SEQ ID NO: 609361 - RNA, 24 nt, Human
aagcugcgagucagaauaaaaaca

SEQ ID NO: 609362 - RNA, 18 nt, Human
aaggcaagacagccaccc

SEQ ID NO: 609363 - RNA, 19 nt, Human
acaugcuugagaucagugg

SEQ ID NO: 609364 - RNA, 22 nt, Human
acccucacaauccccagguccc

SEQ ID NO: 609365 - RNA, 24 nt, Human
acugugccucgcaaggcaaacacu

SEQ ID NO: 609366 - RNA, 19 nt, Human
acuuggcugagcucuccuc

SEQ ID NO: 609367 - RNA, 21 nt, Human
agaacggagguuggcaaagga

SEQ ID NO: 609368 - RNA, 21 nt, Human
agcaggauuucaauacacgug

SEQ ID NO: 609369 - RNA, 19 nt, Human
agccacacucaaagccuag

SEQ ID NO: 609370 - RNA, 18 nt, Human
aggaaaaaaaaacaacaa

SEQ ID NO: 609371 - RNA, 22 nt, Human
aggaaaaaaaaacaacaacaaa

SEQ ID NO: 609372 - RNA, 18 nt, Human
aggugggacuaagcaaau

SEQ ID NO: 609373 - RNA, 20 nt, Human
caaacgcccauguacauccc

SEQ ID NO: 609374 - RNA, 18 nt, Human
caaagaacaugcugagca

SEQ ID NO: 609375 - RNA, 23 nt, Human
caaaggcaagacagccacccacu

SEQ ID NO: 609376 - RNA, 24 nt, Human
caacaaaugaacgugcagccuccu

SEQ ID NO: 609377 - RNA, 21 nt, Human
caaccccaaacuaaaccaaag

SEQ ID NO: 609378 - RNA, 21 nt, Human
caagacagguauuccucaaac

SEQ ID NO: 609379 - RNA, 18 nt, Human
caaugugucccccaaccc

SEQ ID NO: 609380 - RNA, 19 nt, Human
caccaagccauccuuuugu

SEQ ID NO: 609381 - RNA, 21 nt, Human
caccccgucucuuuucuuacu

SEQ ID NO: 609382 - RNA, 18 nt, Human
cacugugccucgcaaggc

SEQ ID NO: 609383 - RNA, 22 nt, Human
cagacagauacaagaacuugaa

SEQ ID NO: 609384 - RNA, 21 nt, Human
cagcaaagaauagaaaagucu

SEQ ID NO: 609385 - RNA, 22 nt, Human
cagcaaagaauagaaaagucuu

SEQ ID NO: 609386 - RNA, 21 nt, Human
cagcagacagcugccuuccug

SEQ ID NO: 609387 - RNA, 20 nt, Human
cagccacccacugugccucc

SEQ ID NO: 609388 - RNA, 20 nt, Human
cagccacccacugugccucg

SEQ ID NO: 609389 - RNA, 23 nt, Human
cagccuccaagacguggaaucuu

SEQ ID NO: 609390 - RNA, 26 nt, Human
caggccccucugcauagagccaggga

SEQ ID NO: 609391 - RNA, 22 nt, Human
cagguauuccucaaacaaaaca

SEQ ID NO: 609392 - RNA, 28 nt, Human
caggucccagaacagacagauacaagaa

SEQ ID NO: 609393 - RNA, 22 nt, Human
ccaaagaacaugcugagcacaa

SEQ ID NO: 609394 - RNA, 25 nt, Human
ccaacacaggccgcagcgaccacag

SEQ ID NO: 609395 - RNA, 23 nt, Human
ccaaccccaaacuaaaccaaaga

SEQ ID NO: 609396 - RNA, 21 nt, Human
ccaccaagccauccuuuugua

SEQ ID NO: 609397 - RNA, 18 nt, Human
ccagaacagacagauaca

SEQ ID NO: 609398 - RNA, 21 nt, Human
ccagggaaagaaaagcaccca

SEQ ID NO: 609399 - RNA, 22 nt, Human
ccaugcugagauuuucagcugc

SEQ ID NO: 609400 - RNA, 19 nt, Human
cccaaccccaaacuaaacc

SEQ ID NO: 609401 - RNA, 24 nt, Human
cccaaccccaaacuaaaccaaaga

SEQ ID NO: 609402 - RNA, 24 nt, Human
cccauguacaucccacuccccaaa

SEQ ID NO: 609403 - RNA, 21 nt, Human
ccccaaacuaaaccaaagaac

SEQ ID NO: 609404 - RNA, 18 nt, Human
ccccaaccccaaacuaaa

SEQ ID NO: 609405 - RNA, 25 nt, Human
ccccaggucccagaacagacagaua

SEQ ID NO: 609406 - RNA, 21 nt, Human
cccccaaccccaaacuaaacc

SEQ ID NO: 609407 - RNA, 22 nt, Human
ccccucugcauagagccaggga

SEQ ID NO: 609408 - RNA, 23 nt, Human
ccugcugccucacuuggcugagc

SEQ ID NO: 609409 - RNA, 21 nt, Human
ccuguaaguaugugguggaga

SEQ ID NO: 609410 - RNA, 20 nt, Human
ccuuuuguacccuagccacc

SEQ ID NO: 609411 - RNA, 24 nt, Human
cggccccugccacagucuccagga

SEQ ID NO: 609412 - RNA, 19 nt, Human
cucaggcauacacaccaac

SEQ ID NO: 609413 - RNA, 19 nt, Human
cugcugggugaacaaugug

SEQ ID NO: 609414 - RNA, 21 nt, Human
cuuccuggcggccccugccac

SEQ ID NO: 609415 - RNA, 22 nt, Human
cuuccuggcggccccugccaca

SEQ ID NO: 609416 - RNA, 24 nt, Human
gaccacagaaggcuggaauuugua

SEQ ID NO: 609417 - RNA, 22 nt, Human
gagauccucugcaggucucugg

SEQ ID NO: 609418 - RNA, 18 nt, Human
gcacauaaauagaacgga

SEQ ID NO: 609419 - RNA, 19 nt, Human
gcccauguacaucccacuc

SEQ ID NO: 609420 - RNA, 22 nt, Human
gcccauguacaucccacucccc

SEQ ID NO: 609421 - RNA, 19 nt, Human
gccucgcaaggcaaacacu

SEQ ID NO: 609422 - RNA, 21 nt, Human
gcugagcucuccucuucagug

SEQ ID NO: 609423 - RNA, 20 nt, Human
gcugccccuccuuuuucagc

SEQ ID NO: 609424 - RNA, 23 nt, Human
ggaauccaagacagguauuccuc

SEQ ID NO: 609425 - RNA, 18 nt, Human
ggcagagucuuauccaca

SEQ ID NO: 609426 - RNA, 22 nt, Human
gggaaagaaaagcacccaauau

SEQ ID NO: 609427 - RNA, 20 nt, Human
gggucgugcuggcugugagg

SEQ ID NO: 609428 - RNA, 24 nt, Human
gucauacacuaccagcaggauuuc

SEQ ID NO: 609429 - RNA, 19 nt, Human
uacgaaacagaaagcaaga

SEQ ID NO: 609430 - RNA, 24 nt, Human
uagaaaagucuuuaaugcuaaaaa

SEQ ID NO: 609431 - RNA, 20 nt, Human
uagacuggguuaaacucaug

SEQ ID NO: 609432 - RNA, 24 nt, Human
uaucuaaaaggcugaaaaugguuu

SEQ ID NO: 609433 - RNA, 19 nt, Human
ucaaacgcccauguacauc

SEQ ID NO: 609434 - RNA, 18 nt, Human
ucaaguaucaccaaaucc

SEQ ID NO: 609435 - RNA, 22 nt, Human
ucacaauccccaggucccagaa

SEQ ID NO: 609436 - RNA, 18 nt, Human
ucacugggccccugugug

SEQ ID NO: 609437 - RNA, 19 nt, Human
ucagaauaaaaacauauug

SEQ ID NO: 609438 - RNA, 24 nt, Human
ucagcugcucuggaaagauucacc

SEQ ID NO: 609439 - RNA, 23 nt, Human
uccaguagggagaaagcugcagg

SEQ ID NO: 609440 - RNA, 19 nt, Human
uccaugcugagauuuucag

SEQ ID NO: 609441 - RNA, 19 nt, Human
ucccccaaccccaaacuaa

SEQ ID NO: 609442 - RNA, 24 nt, Human
ucccuaaauacuggcuuuugaucc

SEQ ID NO: 609443 - RNA, 20 nt, Human
uccgaucugacucagcagca

SEQ ID NO: 609444 - RNA, 19 nt, Human
uccugagaacacgccaggc

SEQ ID NO: 609445 - RNA, 20 nt, Human
ucuccaaggcuuccucguga

SEQ ID NO: 609446 - RNA, 18 nt, Human
ucuccuggccucuuauca

SEQ ID NO: 609447 - RNA, 18 nt, Human
ugaaaaugguuuuagguu

SEQ ID NO: 609448 - RNA, 18 nt, Human
ugacucagcagcagacag

SEQ ID NO: 609449 - RNA, 23 nt, Human
ugagaucaguggucuguguccag

SEQ ID NO: 609450 - RNA, 24 nt, Human
ugagaucaguggucuguguccagu

SEQ ID NO: 609451 - RNA, 23 nt, Human
ugagggaacccucacaaucccca

SEQ ID NO: 609452 - RNA, 21 nt, Human
ugagggcccucucgcugcaga

SEQ ID NO: 609453 - RNA, 24 nt, Human
ugcaggucucugguccaguaggga

SEQ ID NO: 609454 - RNA, 26 nt, Human
ugcaggucucugguccaguagggaga

SEQ ID NO: 609455 - RNA, 23 nt, Human
ugccaucagcaaagaauagaaaa

SEQ ID NO: 609456 - RNA, 20 nt, Human
ugccucacuuggcugagcuc

SEQ ID NO: 609457 - RNA, 21 nt, Human
uggaaucuuccggaaccgaga

SEQ ID NO: 609458 - RNA, 21 nt, Human
uggaggccccaacacaggccg

SEQ ID NO: 609459 - RNA, 18 nt, Human
uggcaaggggcuaaggaa

SEQ ID NO: 609460 - RNA, 21 nt, Human
uggcaaggggcuaaggaaucc

SEQ ID NO: 609461 - RNA, 19 nt, Human
uggcugagcucuccucuuc

SEQ ID NO: 609462 - RNA, 23 nt, Human
uggcugagcucuccucuucagug

SEQ ID NO: 609463 - RNA, 18 nt, Human
ugggugaacaaugugucc

SEQ ID NO: 609464 - RNA, 21 nt, Human
uguuauugaauguuuugcucu

SEQ ID NO: 609465 - RNA, 22 nt, Human
uuaaugcuaaaaacuggacaug

SEQ ID NO: 609466 - RNA, 19 nt, Human
uuauugaauguuuugcucu

SEQ ID NO: 609467 - RNA, 19 nt, Human
uuccucugcccacaucucc

SEQ ID NO: 609468 - RNA, 24 nt, Human
uucucagaggaaugcucucgggug

SEQ ID NO: 609469 - RNA, 19 nt, Human
uugcaccucccaguucugc

SEQ ID NO: 609470 - RNA, 23 nt, Human
uuuaaugcuaaaaacuggacaug

SEQ ID NO: 609471 - RNA, 23 nt, Human
uuuuuuuuuuuuuuuuuagcagg

SEQ ID NO: 609472 - RNA, 22 nt, Human
aaaaaaaaaaaauugccgagga

SEQ ID NO: 609473 - RNA, 22 nt, Human
aaaacaggagauggaaaggccc

SEQ ID NO: 609474 - RNA, 18 nt, Human
aaaagccaaaggccucug

SEQ ID NO: 609475 - RNA, 19 nt, Human
aaaagcccccagaccugga

SEQ ID NO: 609476 - RNA, 22 nt, Human
aaacaggagauggaaaggccca

SEQ ID NO: 609477 - RNA, 25 nt, Human
aaacaggagauggaaaggcccaggg

SEQ ID NO: 609478 - RNA, 23 nt, Human
aaacauccuuccaaaaggucccc

SEQ ID NO: 609479 - RNA, 20 nt, Human
aaccacagagaauaaacauc

SEQ ID NO: 609480 - RNA, 22 nt, Human
aaccuccugcuccagaaaugcc

SEQ ID NO: 609481 - RNA, 24 nt, Human
aacugaaaaaguaagcccaagcau

SEQ ID NO: 609482 - RNA, 25 nt, Human
aagcccccagaccuggagggagcag

SEQ ID NO: 609483 - RNA, 21 nt, Human
aaguaagcccaagcaugauua

SEQ ID NO: 609484 - RNA, 22 nt, Human
aaguacaaugggucuauacuga

SEQ ID NO: 609485 - RNA, 18 nt, Human
aagucaaauccagauaga

SEQ ID NO: 609486 - RNA, 27 nt, Human
acacacgcaugcaugcacauaugcuua

SEQ ID NO: 609487 - RNA, 21 nt, Human
acagagaauaaacauccuucc

SEQ ID NO: 609488 - RNA, 20 nt, Human
acauucccagagcccugcug

SEQ ID NO: 609489 - RNA, 21 nt, Human
agagcccugcugaguaggggc

SEQ ID NO: 609490 - RNA, 18 nt, Human
agcacuguaaagcaugga

SEQ ID NO: 609491 - RNA, 23 nt, Human
agcuguuaucagugagaccgaca

SEQ ID NO: 609492 - RNA, 22 nt, Human
aggagauggaaaggcccagggg

SEQ ID NO: 609493 - RNA, 20 nt, Human
aggcucaaugaaagacaggg

SEQ ID NO: 609494 - RNA, 20 nt, Human
auaaagcaagagccccccuc

SEQ ID NO: 609495 - RNA, 24 nt, Human
auaaauacuagucucaaauguuaa

SEQ ID NO: 609496 - RNA, 18 nt, Human
aucaguuacauaaauuau

SEQ ID NO: 609497 - RNA, 22 nt, Human
auccugaaccacuuccagucuc

SEQ ID NO: 609498 - RNA, 19 nt, Human
augcuagaaauucucagca

SEQ ID NO: 609499 - RNA, 20 nt, Human
caagagcacaauucuaaucc

SEQ ID NO: 609500 - RNA, 19 nt, Human
caagcuuuuugacuuaaaa

SEQ ID NO: 609501 - RNA, 21 nt, Human
caagguggauaaaagccccca

SEQ ID NO: 609502 - RNA, 24 nt, Human
caauucuaaucaaucauauuucaa

SEQ ID NO: 609503 - RNA, 27 nt, Human
cacauaugcuuaaccuuacaaacugaa

SEQ ID NO: 609504 - RNA, 24 nt, Human
caccaaaauaaagagguuuacaac

SEQ ID NO: 609505 - RNA, 23 nt, Human
caccguggcagcuuagacugauc

SEQ ID NO: 609506 - RNA, 24 nt, Human
cagaaagugaccauuaggcaacug

SEQ ID NO: 609507 - RNA, 24 nt, Human
cagagggggagccuugucuuuuuu

SEQ ID NO: 609508 - RNA, 24 nt, Human
cagcaauucugaaacuaaaauaag

SEQ ID NO: 609509 - RNA, 19 nt, Human
cagcaccgugccaaggccu

SEQ ID NO: 609510 - RNA, 24 nt, Human
cagcacuguaaagcauggaaacau

SEQ ID NO: 609511 - RNA, 20 nt, Human
caggacaguacccuaaagga

SEQ ID NO: 609512 - RNA, 18 nt, Human
cauaaaccuccacaucac

SEQ ID NO: 609513 - RNA, 21 nt, Human
caucacuaggaaccuaaaggg

SEQ ID NO: 609514 - RNA, 31 nt, Human
cauuuauauacacacgcaugcaugcacauag

SEQ ID NO: 609515 - RNA, 19 nt, Human
ccagagcccugcugaguag

SEQ ID NO: 609516 - RNA, 25 nt, Human
ccagucucuuuucccaggagcucug

SEQ ID NO: 609517 - RNA, 20 nt, Human
ccccaagugcuucacaugcu

SEQ ID NO: 609518 - RNA, 19 nt, Human
ccccagugcagcuuuuccu

SEQ ID NO: 609519 - RNA, 18 nt, Human
ccgugcuugcguuucucu

SEQ ID NO: 609520 - RNA, 21 nt, Human
ccugggucaaaagccaaaggc

SEQ ID NO: 609521 - RNA, 22 nt, Human
ccuuccaaaagguccugcccac

SEQ ID NO: 609522 - RNA, 22 nt, Human
cgaugguaaaaaguuguaaacu

SEQ ID NO: 609523 - RNA, 20 nt, Human
cuccaaaggccaacacaucc

SEQ ID NO: 609524 - RNA, 26 nt, Human
cuccagccucgcggcccuccuggguc

SEQ ID NO: 609525 - RNA, 23 nt, Human
cuuagacugaucuucaccuucuc

SEQ ID NO: 609526 - RNA, 24 nt, Human
cuuaggaugaaaaugaaauaacuc

SEQ ID NO: 609527 - RNA, 20 nt, Human
gaaaggcccagagaugagga

SEQ ID NO: 609528 - RNA, 18 nt, Human
gaacuccaaaggccaaca

SEQ ID NO: 609529 - RNA, 18 nt, Human
gacagggcagcuccagcc

SEQ ID NO: 609530 - RNA, 18 nt, Human
gaggaguucccucuccac

SEQ ID NO: 609531 - RNA, 21 nt, Human
gaucugagucaggcuggcaag

SEQ ID NO: 609532 - RNA, 20 nt, Human
ggaaaugcuaaggcucaaug

SEQ ID NO: 609533 - RNA, 21 nt, Human
ggagauggaaaggcccagggg

SEQ ID NO: 609534 - RNA, 23 nt, Human
gggcagcuccagccucgcggccc

SEQ ID NO: 609535 - RNA, 29 nt, Human
guccugcccacaucuccccucucucccaa

SEQ ID NO: 609536 - RNA, 20 nt, Human
gucucuuuucccaggagcuc

SEQ ID NO: 609537 - RNA, 18 nt, Human
uaaaccuccacaucacua

SEQ ID NO: 609538 - RNA, 22 nt, Human
uaaccacagagaauaaacaucc

SEQ ID NO: 609539 - RNA, 21 nt, Human
uaaggcucaaugaaagacagg

SEQ ID NO: 609540 - RNA, 19 nt, Human
uaauugaugacugcucucc

SEQ ID NO: 609541 - RNA, 21 nt, Human
uaauugaugacugcucuccuc

SEQ ID NO: 609542 - RNA, 18 nt, Human
uacacaagccauuguggg

SEQ ID NO: 609543 - RNA, 18 nt, Human
uacagucuauuuacugca

SEQ ID NO: 609544 - RNA, 24 nt, Human
uaggaaagcaugaugagaaagucc

SEQ ID NO: 609545 - RNA, 25 nt, Human
uauacacacgcaugcaugcacauau

SEQ ID NO: 609546 - RNA, 21 nt, Human
uauacacacgcaugcauggug

SEQ ID NO: 609547 - RNA, 20 nt, Human
uauauacacacgcaugcaug

SEQ ID NO: 609548 - RNA, 22 nt, Human
ucaccccacugaaaaugaacag

SEQ ID NO: 609549 - RNA, 19 nt, Human
uccaacaucggagggagaa

SEQ ID NO: 609550 - RNA, 20 nt, Human
uccucacccaccaguggggu

SEQ ID NO: 609551 - RNA, 24 nt, Human
uccugggucaaaagccaaaggccu

SEQ ID NO: 609552 - RNA, 21 nt, Human
uccuuccaaaagguccugccc

SEQ ID NO: 609553 - RNA, 18 nt, Human
ucuccccaccccagugca

SEQ ID NO: 609554 - RNA, 19 nt, Human
ucucucacacaacgggaga

SEQ ID NO: 609555 - RNA, 24 nt, Human
ucuggagcuguuaucagugagacc

SEQ ID NO: 609556 - RNA, 19 nt, Human
ugaagacucaccccacuga

SEQ ID NO: 609557 - RNA, 18 nt, Human
ugacuuaaaaaaaaaaaa

SEQ ID NO: 609558 - RNA, 21 nt, Human
ugagaggaagccugagaggga

SEQ ID NO: 609559 - RNA, 21 nt, Human
ugagagggaaaugcuaaggcu

SEQ ID NO: 609560 - RNA, 24 nt, Human
ugagcuugagaggaagccugagag

SEQ ID NO: 609561 - RNA, 21 nt, Human
ugcacaaauaucaaaugugua

SEQ ID NO: 609562 - RNA, 19 nt, Human
ugcuaccuacugaugcucc

SEQ ID NO: 609563 - RNA, 22 nt, Human
ugcuccagaaaugccaggagca

SEQ ID NO: 609564 - RNA, 18 nt, Human
ugcugaguaggggcuuca

SEQ ID NO: 609565 - RNA, 24 nt, Human
uggacauuucucucccaucacucu

SEQ ID NO: 609566 - RNA, 18 nt, Human
uguaaacuggcuaacagu

SEQ ID NO: 609567 - RNA, 21 nt, Human
uguccugacaaccuccugcuc

SEQ ID NO: 609568 - RNA, 20 nt, Human
uguuugaaauucucagcaga

SEQ ID NO: 609569 - RNA, 22 nt, Human
uuaaguacaaugggucuauacu

SEQ ID NO: 609570 - RNA, 25 nt, Human
uugcuaccuacugaugcuccauuug

SEQ ID NO: 609571 - RNA, 18 nt, Human
uuguguuuuuagugugaa

SEQ ID NO: 609572 - RNA, 23 nt, Human
uuuacaacaacgguuuccccuua

SEQ ID NO: 609573 - RNA, 18 nt, Human
uuuguuugaaauucucag

SEQ ID NO: 609574 - RNA, 26 nt, Human
uuuuccaugcuuccuggagaauccuc

SEQ ID NO: 609575 - RNA, 22 nt, Human
uuuucuggagcuguuaucagug

SEQ ID NO: 609576 - RNA, 20 nt, Human
uuuuggacauuucucuccca

SEQ ID NO: 609577 - RNA, 24 nt, Human
aaagugcugggauuacaggcguga

SEQ ID NO: 609578 - RNA, 19 nt, Human
aagugcugggauuacaggc

SEQ ID NO: 609579 - RNA, 19 nt, Human
aagugcugggauuacaggc

SEQ ID NO: 609580 - RNA, 26 nt, Human
aagugcugggauuacaggcgugagcc

SEQ ID NO: 609581 - RNA, 18 nt, Human
accagcagaugcugggac

SEQ ID NO: 609582 - RNA, 18 nt, Human
acucuaccccagagaggg

SEQ ID NO: 609583 - RNA, 19 nt, Human
agagaugggguuucaccgu

SEQ ID NO: 609584 - RNA, 20 nt, Human
aggaggcccugaggugagga

SEQ ID NO: 609585 - RNA, 18 nt, Human
aguagagaugggguuuca

SEQ ID NO: 609586 - RNA, 20 nt, Human
aguagagaugggguuucacc

SEQ ID NO: 609587 - RNA, 21 nt, Human
aguagagaugggguuucaccg

SEQ ID NO: 609588 - RNA, 23 nt, Human
aguagagaugggguuucaccgug

SEQ ID NO: 609589 - RNA, 24 nt, Human
aguagagaugggguuucaccgugu

SEQ ID NO: 609590 - RNA, 24 nt, Human
augauccgcccgccucggccuccc

SEQ ID NO: 609591 - RNA, 19 nt, Human
augcuaccaucucagcauc

SEQ ID NO: 609592 - RNA, 19 nt, Human
augggguuucaccguguua

SEQ ID NO: 609593 - RNA, 20 nt, Human
augggguuucaccguguuag

SEQ ID NO: 609594 - RNA, 24 nt, Human
augggguuucaccguguuagccag

SEQ ID NO: 609595 - RNA, 19 nt, Human
auuucuaugcuaccaucuc

SEQ ID NO: 609596 - RNA, 24 nt, Human
caaagugcugggauuacaggcgug

SEQ ID NO: 609597 - RNA, 20 nt, Human
cacagugcuugguuuugcac

SEQ ID NO: 609598 - RNA, 18 nt, Human
caccguguuagccagggu

SEQ ID NO: 609599 - RNA, 24 nt, Human
caccguguuagccaggguggucuu

SEQ ID NO: 609600 - RNA, 24 nt, Human
cagcacucugggcacaaugacacu

SEQ ID NO: 609601 - RNA, 24 nt, Human
cagcaggccucaccuugcagcacu

SEQ ID NO: 609602 - RNA, 20 nt, Human
ccaaagugcugggauuacag

SEQ ID NO: 609603 - RNA, 22 nt, Human
ccaaagugcugggauuacaggc

SEQ ID NO: 609604 - RNA, 22 nt, Human
ccaaagugcugggauuacaggc

SEQ ID NO: 609605 - RNA, 24 nt, Human
ccaaagugcugggauuacaggcgu

SEQ ID NO: 609606 - RNA, 23 nt, Human
cccacagugcuugguuuugcacu

SEQ ID NO: 609607 - RNA, 23 nt, Human
cccaccagacagguuuaaagagg

SEQ ID NO: 609608 - RNA, 19 nt, Human
cccagggguucugguuggg

SEQ ID NO: 609609 - RNA, 18 nt, Human
cucaugauccgcccgccu

SEQ ID NO: 609610 - RNA, 24 nt, Human
cuccugaccucaugauccgcccgc

SEQ ID NO: 609611 - RNA, 19 nt, Human
cuggccgggcagugugcug

SEQ ID NO: 609612 - RNA, 26 nt, Human
gaaaccucuucauucacagggcacuc

SEQ ID NO: 609613 - RNA, 22 nt, Human
gaccucaugauccgcccgccuc

SEQ ID NO: 609614 - RNA, 24 nt, Human
gagaugggguuucaccguguuagc

SEQ ID NO: 609615 - RNA, 22 nt, Human
gaggggaggggugccacuuccu

SEQ ID NO: 609616 - RNA, 20 nt, Human
gaggugaggauaucuggggg

SEQ ID NO: 609617 - RNA, 18 nt, Human
gauuacaggcgugagcca

SEQ ID NO: 609618 - RNA, 22 nt, Human
gauuacaggcgugagccaccgc

SEQ ID NO: 609619 - RNA, 22 nt, Human
gauuacaggcgugagccaccgc

SEQ ID NO: 609620 - RNA, 23 nt, Human
gccucggccucccaaagugcugg

SEQ ID NO: 609621 - RNA, 21 nt, Human
ggcagugugcugggcccugcc

SEQ ID NO: 609622 - RNA, 22 nt, Human
gggguuucaccguguuagccag

SEQ ID NO: 609623 - RNA, 22 nt, Human
ggguuucaccguguuagccagg

SEQ ID NO: 609624 - RNA, 23 nt, Human
gguggucuugaucuccugaccuc

SEQ ID NO: 609625 - RNA, 21 nt, Human
ggugguucuuggagaacauau

SEQ ID NO: 609626 - RNA, 19 nt, Human
guagagaugggguuucacc

SEQ ID NO: 609627 - RNA, 23 nt, Human
uacaggcgugagccaccgcgccc

SEQ ID NO: 609628 - RNA, 23 nt, Human
uaccccagagagggaaacaccau

SEQ ID NO: 609629 - RNA, 22 nt, Human
uaggaggacuggccgggcagug

SEQ ID NO: 609630 - RNA, 24 nt, Human
ucaccguguuagccaggguggucu

SEQ ID NO: 609631 - RNA, 24 nt, Human
ucaccuugcagcacucugggcaca

SEQ ID NO: 609632 - RNA, 21 nt, Human
uccacuguagucucuaggaug

SEQ ID NO: 609633 - RNA, 24 nt, Human
ucccaaagugcugggauuacaggc

SEQ ID NO: 609634 - RNA, 23 nt, Human
ucccagggguucugguugggacu

SEQ ID NO: 609635 - RNA, 18 nt, Human
ucggccucccaaagugcu

SEQ ID NO: 609636 - RNA, 20 nt, Human
ugaggagacagaccaggugg

SEQ ID NO: 609637 - RNA, 21 nt, Human
ugaggugaggauaucuggggg

SEQ ID NO: 609638 - RNA, 24 nt, Human
ugcugggauuacaggcgugagcca

SEQ ID NO: 609639 - RNA, 18 nt, Human
ugcuugguuuugcacuca

SEQ ID NO: 609640 - RNA, 21 nt, Human
uggccgggcagugugcugggc

SEQ ID NO: 609641 - RNA, 18 nt, Human
ugggauuacaggcgugag

SEQ ID NO: 609642 - RNA, 19 nt, Human
ugggauuacaggcgugagc

SEQ ID NO: 609643 - RNA, 21 nt, Human
ugggauuacaggcgugagcca

SEQ ID NO: 609644 - RNA, 22 nt, Human
ugggauuacaggcgugagccac

SEQ ID NO: 609645 - RNA, 23 nt, Human
ugggauuacaggcgugagccacc

SEQ ID NO: 609646 - RNA, 24 nt, Human
ugggauuacaggcgugagccaccg

SEQ ID NO: 609647 - RNA, 27 nt, Human
uggggagcugcagagcuuagcagcugg

SEQ ID NO: 609648 - RNA, 24 nt, Human
ugggguuucaccguguuagccagg

SEQ ID NO: 609649 - RNA, 20 nt, Human
ugguucuuggagaacauaug

SEQ ID NO: 609650 - RNA, 21 nt, Human
uguggugaggggaggggugcc

SEQ ID NO: 609651 - RNA, 22 nt, Human
uguggugaggggaggggugcca

SEQ ID NO: 609652 - RNA, 18 nt, Human
uucaccguguuagccagg

SEQ ID NO: 609653 - RNA, 19 nt, Human
uuccucuuugcccagcgag

SEQ ID NO: 609654 - RNA, 19 nt, Human
uuccuggaggacgucucug

SEQ ID NO: 609655 - RNA, 19 nt, Human
uuucaccguguuagccagg

SEQ ID NO: 609656 - RNA, 20 nt, Human
uuugcaaaaaaaggaggccu

SEQ ID NO: 609657 - RNA, 18 nt, Human
aaaggccacugaccaagu

SEQ ID NO: 609658 - RNA, 18 nt, Human
aaaggccacugaccaagu

SEQ ID NO: 609659 - RNA, 22 nt, Human
aaggcauccccacacccucccu

SEQ ID NO: 609660 - RNA, 19 nt, Human
acaccgauguccccacaga

SEQ ID NO: 609661 - RNA, 21 nt, Human
acaccgauguccccacagaca

SEQ ID NO: 609662 - RNA, 24 nt, Human
acaucauucacugagaauuuccaa

SEQ ID NO: 609663 - RNA, 18 nt, Human
acccaggcuucugccugg

SEQ ID NO: 609664 - RNA, 19 nt, Human
acccugaggacgacgaagg

SEQ ID NO: 609665 - RNA, 19 nt, Human
acccugaggacgacgaagg

SEQ ID NO: 609666 - RNA, 19 nt, Human
acccugcagggcccagucc

SEQ ID NO: 609667 - RNA, 21 nt, Human
acggcggcggggacuccgggc

SEQ ID NO: 609668 - RNA, 19 nt, Human
agacccacccagacccugc

SEQ ID NO: 609669 - RNA, 20 nt, Human
aggcagcuccacuggugaaa

SEQ ID NO: 609670 - RNA, 20 nt, Human
aggcagcuccacuggugaaa

SEQ ID NO: 609671 - RNA, 19 nt, Human
aggcggugcaggcugggag

SEQ ID NO: 609672 - RNA, 19 nt, Human
aggcggugcaggcugggag

SEQ ID NO: 609673 - RNA, 20 nt, Human
aggcugggagcccugcccag

SEQ ID NO: 609674 - RNA, 20 nt, Human
aggcugggagcccugcccag

SEQ ID NO: 609675 - RNA, 25 nt, Human
agggggaaggaggaagaacuggggc

SEQ ID NO: 609676 - RNA, 25 nt, Human
agggggaaggaggaagaacuggggc

SEQ ID NO: 609677 - RNA, 20 nt, Human
aggguaggggaaggggagga

SEQ ID NO: 609678 - RNA, 26 nt, Human
caaguccagacccugaggacgacgaa

SEQ ID NO: 609679 - RNA, 26 nt, Human
caaguccagacccugaggacgacgaa

SEQ ID NO: 609680 - RNA, 20 nt, Human
cacacccucccuccccuuca

SEQ ID NO: 609681 - RNA, 27 nt, Human
cagcuccacuggugaaaggccacugac

SEQ ID NO: 609682 - RNA, 27 nt, Human
cagcuccacuggugaaaggccacugac

SEQ ID NO: 609683 - RNA, 18 nt, Human
caggccccuggcagccac

SEQ ID NO: 609684 - RNA, 18 nt, Human
caggccccuggcagccac

SEQ ID NO: 609685 - RNA, 23 nt, Human
caggcuucuacuuuggccccaca

SEQ ID NO: 609686 - RNA, 19 nt, Human
cauccuuggggcugggcuu

SEQ ID NO: 609687 - RNA, 25 nt, Human
caugucuugcuucauccuuggggcu

SEQ ID NO: 609688 - RNA, 23 nt, Human
ccacacccucccuccccuucaug

SEQ ID NO: 609689 - RNA, 21 nt, Human
ccagccccaguuugggucugu

SEQ ID NO: 609690 - RNA, 21 nt, Human
ccagccccaguuugggucugu

SEQ ID NO: 609691 - RNA, 25 nt, Human
ccaggcccaggccagucagucaccc

SEQ ID NO: 609692 - RNA, 25 nt, Human
ccaggcccaggccagucagucaccc

SEQ ID NO: 609693 - RNA, 22 nt, Human
cccacacccucccuccccuuca

SEQ ID NO: 609694 - RNA, 27 nt, Human
cccagaggcccaagaaggccauggacu

SEQ ID NO: 609695 - RNA, 27 nt, Human
cccagaggcccaagaaggccauggacu

SEQ ID NO: 609696 - RNA, 18 nt, Human
cccagccccaguuugggu

SEQ ID NO: 609697 - RNA, 23 nt, Human
ccccacacccucccuccccuuca

SEQ ID NO: 609698 - RNA, 27 nt, Human
ccccuggcagccacgaggagcagaggc

SEQ ID NO: 609699 - RNA, 27 nt, Human
ccccuggcagccacgaggagcagaggc

SEQ ID NO: 609700 - RNA, 18 nt, Human
cccuucacaccgaugucc

SEQ ID NO: 609701 - RNA, 19 nt, Human
cccuucacaccgauguccc

SEQ ID NO: 609702 - RNA, 22 nt, Human
ccuggccuccccuggggguggg

SEQ ID NO: 609703 - RNA, 18 nt, Human
ccugggaaagggggaagg

SEQ ID NO: 609704 - RNA, 18 nt, Human
ccugggaaagggggaagg

SEQ ID NO: 609705 - RNA, 19 nt, Human
ccuucucccugggaaggca

SEQ ID NO: 609706 - RNA, 19 nt, Human
ccuucucccugggaaggca

SEQ ID NO: 609707 - RNA, 18 nt, Human
cggggcagaagccugaga

SEQ ID NO: 609708 - RNA, 19 nt, Human
cuacuuuggccccacagcc

SEQ ID NO: 609709 - RNA, 23 nt, Human
cucccgcagcccgcaggcuucua

SEQ ID NO: 609710 - RNA, 22 nt, Human
cugccuggccuccccugggggu

SEQ ID NO: 609711 - RNA, 23 nt, Human
cuucccugccccaugugacaccu

SEQ ID NO: 609712 - RNA, 23 nt, Human
cuucccugccccaugugacaccu

SEQ ID NO: 609713 - RNA, 21 nt, Human
cuucccuucacaccgaugucc

SEQ ID NO: 609714 - RNA, 18 nt, Human
gaacagaggcagaggagg

SEQ ID NO: 609715 - RNA, 18 nt, Human
gaacagaggcagaggagg

SEQ ID NO: 609716 - RNA, 21 nt, Human
gaggcccagccccaguuuggg

SEQ ID NO: 609717 - RNA, 21 nt, Human
gaggcccagccccaguuuggg

SEQ ID NO: 609718 - RNA, 24 nt, Human
gaggcccagccccaguuugggucu

SEQ ID NO: 609719 - RNA, 24 nt, Human
gaggcccagccccaguuugggucu

SEQ ID NO: 609720 - RNA, 20 nt, Human
gcaaggcauccccacacccu

SEQ ID NO: 609721 - RNA, 25 nt, Human
gcaaggcauccccacacccucccuc

SEQ ID NO: 609722 - RNA, 22 nt, Human
gcagcuccacuggugaaaggcc

SEQ ID NO: 609723 - RNA, 22 nt, Human
gcagcuccacuggugaaaggcc

SEQ ID NO: 609724 - RNA, 19 nt, Human
gcccagccccaguuugggu

SEQ ID NO: 609725 - RNA, 20 nt, Human
gcuacggccccacaugucuu

SEQ ID NO: 609726 - RNA, 20 nt, Human
gcuacggccccacaugucuu

SEQ ID NO: 609727 - RNA, 21 nt, Human
gcugugacccaggcuucugcc

SEQ ID NO: 609728 - RNA, 22 nt, Human
gcugugacccaggcuucugccu

SEQ ID NO: 609729 - RNA, 25 nt, Human
ggaaagcuaugacccaguuugcuga

SEQ ID NO: 609730 - RNA, 25 nt, Human
ggaaagcuaugacccaguuugcuga

SEQ ID NO: 609731 - RNA, 23 nt, Human
ggauagaggcccagccccaguuu

SEQ ID NO: 609732 - RNA, 23 nt, Human
ggauagaggcccagccccaguuu

SEQ ID NO: 609733 - RNA, 22 nt, Human
ggccucggggcagaagccugag

SEQ ID NO: 609734 - RNA, 22 nt, Human
ggccucggggcagaagccugag

SEQ ID NO: 609735 - RNA, 24 nt, Human
ggcggcggggacuccgggcggggc

SEQ ID NO: 609736 - RNA, 21 nt, Human
gucugugcuggggcuggcaga

SEQ ID NO: 609737 - RNA, 21 nt, Human
gucugugcuggggcuggcaga

SEQ ID NO: 609738 - RNA, 22 nt, Human
ucagaacacuccagacagccga

SEQ ID NO: 609739 - RNA, 22 nt, Human
ucagaacacuccagacagccga

SEQ ID NO: 609740 - RNA, 20 nt, Human
ucagucacccaggcuacagc

SEQ ID NO: 609741 - RNA, 20 nt, Human
ucagucacccaggcuacagc

SEQ ID NO: 609742 - RNA, 21 nt, Human
ucauucacugagaauuuccaa

SEQ ID NO: 609743 - RNA, 21 nt, Human
uccccacacccucccuccccu

SEQ ID NO: 609744 - RNA, 22 nt, Human
uccccacacccucccuccccuu

SEQ ID NO: 609745 - RNA, 24 nt, Human
uccccacagacaggccugcugggc

SEQ ID NO: 609746 - RNA, 21 nt, Human
uccccaccccaggcccaggcc

SEQ ID NO: 609747 - RNA, 21 nt, Human
uccccaccccaggcccaggcc

SEQ ID NO: 609748 - RNA, 18 nt, Human
uccugggaaagggggaag

SEQ ID NO: 609749 - RNA, 21 nt, Human
uccugggaaagggggaaggag

SEQ ID NO: 609750 - RNA, 21 nt, Human
uccugggaaagggggaaggag

SEQ ID NO: 609751 - RNA, 20 nt, Human
uccuuggggcugggcuucug

SEQ ID NO: 609752 - RNA, 23 nt, Human
uccuuggggcugggcuucugguu

SEQ ID NO: 609753 - RNA, 22 nt, Human
ucugugcccagaggcccaagaa

SEQ ID NO: 609754 - RNA, 22 nt, Human
ucugugcccagaggcccaagaa

SEQ ID NO: 609755 - RNA, 22 nt, Human
ucugugcuggggcuggcagaac

SEQ ID NO: 609756 - RNA, 22 nt, Human
ucugugcuggggcuggcagaac

SEQ ID NO: 609757 - RNA, 19 nt, Human
ugacaccucgcuacggccc

SEQ ID NO: 609758 - RNA, 24 nt, Human
ugaccaaguccagacccugaggac

SEQ ID NO: 609759 - RNA, 24 nt, Human
ugaccaaguccagacccugaggac

SEQ ID NO: 609760 - RNA, 19 nt, Human
ugagagccgcucccgcagc

SEQ ID NO: 609761 - RNA, 20 nt, Human
ugagagccgcucccgcagcc

SEQ ID NO: 609762 - RNA, 22 nt, Human
ugagcuguggggaaagcuauga

SEQ ID NO: 609763 - RNA, 22 nt, Human
ugagcuguggggaaagcuauga

SEQ ID NO: 609764 - RNA, 21 nt, Human
ugcaucaagaggaggcucagg

SEQ ID NO: 609765 - RNA, 21 nt, Human
ugcaucaagaggaggcucagg

SEQ ID NO: 609766 - RNA, 21 nt, Human
ugcccagaggcccaagaaggc

SEQ ID NO: 609767 - RNA, 21 nt, Human
ugcccagaggcccaagaaggc

SEQ ID NO: 609768 - RNA, 21 nt, Human
ugcccaggccccaggcugagc

SEQ ID NO: 609769 - RNA, 21 nt, Human
ugcccaggccccaggcugagc

SEQ ID NO: 609770 - RNA, 23 nt, Human
ugccuagaccuguguaccagcgc

SEQ ID NO: 609771 - RNA, 23 nt, Human
ugccuagaccuguguaccagcgc

SEQ ID NO: 609772 - RNA, 21 nt, Human
uggaaccaugcaguucugggu

SEQ ID NO: 609773 - RNA, 26 nt, Human
uggcagugggaggcggugcaggcugg

SEQ ID NO: 609774 - RNA, 26 nt, Human
uggcagugggaggcggugcaggcugg

SEQ ID NO: 609775 - RNA, 19 nt, Human
uggccuccccugggggugg

SEQ ID NO: 609776 - RNA, 20 nt, Human
uggccuccccuggggguggg

SEQ ID NO: 609777 - RNA, 19 nt, Human
uggcucugugcccagaggc

SEQ ID NO: 609778 - RNA, 19 nt, Human
uggcucugugcccagaggc

SEQ ID NO: 609779 - RNA, 23 nt, Human
uggcuuggggacguccccacccc

SEQ ID NO: 609780 - RNA, 23 nt, Human
uggcuuggggacguccccacccc

SEQ ID NO: 609781 - RNA, 20 nt, Human
ugggaaggcagcuccacugg

SEQ ID NO: 609782 - RNA, 20 nt, Human
ugggaaggcagcuccacugg

SEQ ID NO: 609783 - RNA, 21 nt, Human
ugggaggcggugcaggcuggg

SEQ ID NO: 609784 - RNA, 21 nt, Human
ugggaggcggugcaggcuggg

SEQ ID NO: 609785 - RNA, 18 nt, Human
ugggccaggggccagcau

SEQ ID NO: 609786 - RNA, 19 nt, Human
ugggcuggccuuuccuggg

SEQ ID NO: 609787 - RNA, 19 nt, Human
ugggcuggccuuuccuggg

SEQ ID NO: 609788 - RNA, 18 nt, Human
ugggucugugcuggggcu

SEQ ID NO: 609789 - RNA, 18 nt, Human
ugggucugugcuggggcu

SEQ ID NO: 609790 - RNA, 24 nt, Human
ugggucugugcuggggcuggcaga

SEQ ID NO: 609791 - RNA, 24 nt, Human
ugggucugugcuggggcuggcaga

SEQ ID NO: 609792 - RNA, 18 nt, Human
uguaccagcgcucugggg

SEQ ID NO: 609793 - RNA, 18 nt, Human
uguaccagcgcucugggg

SEQ ID NO: 609794 - RNA, 21 nt, Human
ugugacaccucgcuacggccc

SEQ ID NO: 609795 - RNA, 19 nt, Human
uuccugggaaagggggaag

SEQ ID NO: 609796 - RNA, 20 nt, Human
uuggccccacagccccggag

SEQ ID NO: 609797 - RNA, 19 nt, Human
aaaaacacacacacacaac

SEQ ID NO: 609798 - RNA, 23 nt, Human
aaaaacacacacacacaacuaca

SEQ ID NO: 609799 - RNA, 26 nt, Human
aaacguuuacaaacaaaaagauuuuc

SEQ ID NO: 609800 - RNA, 24 nt, Human
aaagugcugagauuacaggcauga

SEQ ID NO: 609801 - RNA, 24 nt, Human
aaagugcugggauuacagguguga

SEQ ID NO: 609802 - RNA, 24 nt, Human
aacaacauaccaagucaucacagg

SEQ ID NO: 609803 - RNA, 22 nt, Human
aacauaccaagucaucacagaa

SEQ ID NO: 609804 - RNA, 23 nt, Human
aacuccagugauccacccaccuc

SEQ ID NO: 609805 - RNA, 23 nt, Human
aagcgcggcggcagcagcgggcc

SEQ ID NO: 609806 - RNA, 24 nt, Human
aaguagcugggauuacaggcaggu

SEQ ID NO: 609807 - RNA, 26 nt, Human
aaguagcugggauuacaggcaggugc

SEQ ID NO: 609808 - RNA, 25 nt, Human
aagugauucuccugccucagccucc

SEQ ID NO: 609809 - RNA, 26 nt, Human
aagugcugagauuacaggcaugagcc

SEQ ID NO: 609810 - RNA, 18 nt, Human
aagugcugggauuacagg

SEQ ID NO: 609811 - RNA, 19 nt, Human
aagugcugggauuacaggu

SEQ ID NO: 609812 - RNA, 26 nt, Human
aagugcugggauuacaggugugagcc

SEQ ID NO: 609813 - RNA, 24 nt, Human
acaaacaaaaagauuuucgaugca

SEQ ID NO: 609814 - RNA, 22 nt, Human
acaggucagggaaccaaaacac

SEQ ID NO: 609815 - RNA, 23 nt, Human
accaaggcuggagugcaguggug

SEQ ID NO: 609816 - RNA, 24 nt, Human
accaaggcuggagugcaguggugu

SEQ ID NO: 609817 - RNA, 22 nt, Human
acccaggcuggagugcacaauu

SEQ ID NO: 609818 - RNA, 23 nt, Human
accucagccucccaaagugcuga

SEQ ID NO: 609819 - RNA, 24 nt, Human
accucgugauccgcccaucuuggc

SEQ ID NO: 609820 - RNA, 24 nt, Human
acuauguuggccaggcuggucucg

SEQ ID NO: 609821 - RNA, 25 nt, Human
acucugucaccaaggcuggagugca

SEQ ID NO: 609822 - RNA, 19 nt, Human
agagaugggguuucacuau

SEQ ID NO: 609823 - RNA, 21 nt, Human
agaguuaugcaccguccccuc

SEQ ID NO: 609824 - RNA, 19 nt, Human
agauuacaggcaugagcca

SEQ ID NO: 609825 - RNA, 22 nt, Human
agauuacaggcaugagccacca

SEQ ID NO: 609826 - RNA, 20 nt, Human
agccaccacgccuggcccca

SEQ ID NO: 609827 - RNA, 22 nt, Human
agcggcgggagcccagcgcaca

SEQ ID NO: 609828 - RNA, 23 nt, Human
aggaaccccagggcuucugaugg

SEQ ID NO: 609829 - RNA, 23 nt, Human
aggcaaaaacacacacacacaac

SEQ ID NO: 609830 - RNA, 25 nt, Human
aggcuggagugcaguggugugaucu

SEQ ID NO: 609831 - RNA, 22 nt, Human
aguagagaugggguuucaccau

SEQ ID NO: 609832 - RNA, 19 nt, Human
agugauccacccaccucag

SEQ ID NO: 609833 - RNA, 19 nt, Human
agugcaguggugugaucuc

SEQ ID NO: 609834 - RNA, 21 nt, Human
agugcaguggugugaucucag

SEQ ID NO: 609835 - RNA, 23 nt, Human
agugcaguggugugaucucagcu

SEQ ID NO: 609836 - RNA, 24 nt, Human
agugcaguggugugaucucagcuc

SEQ ID NO: 609837 - RNA, 23 nt, Human
agugggaacuugguuuuguuuug

SEQ ID NO: 609838 - RNA, 18 nt, Human
aguggugugaucucagcu

SEQ ID NO: 609839 - RNA, 21 nt, Human
augagccaccacgccuggccc

SEQ ID NO: 609840 - RNA, 24 nt, Human
augauucucgcgggcucccugucc

SEQ ID NO: 609841 - RNA, 22 nt, Human
augggguuucaccauguuggcc

SEQ ID NO: 609842 - RNA, 23 nt, Human
augggguuucaccauguuggcca

SEQ ID NO: 609843 - RNA, 24 nt, Human
augggguuucaccauguuggccag

SEQ ID NO: 609844 - RNA, 24 nt, Human
augggguuucacuauguuggccag

SEQ ID NO: 609845 - RNA, 24 nt, Human
auuucuguauuuuuaguagagaug

SEQ ID NO: 609846 - RNA, 18 nt, Human
caaaauauucccuagaaa

SEQ ID NO: 609847 - RNA, 24 nt, Human
caaagugcugagauuacaggcaug

SEQ ID NO: 609848 - RNA, 24 nt, Human
caaagugcugggauuacaggugug

SEQ ID NO: 609849 - RNA, 22 nt, Human
caagugauucuccugccucagc

SEQ ID NO: 609850 - RNA, 24 nt, Human
cacacacacaacuacaaaauauuc

SEQ ID NO: 609851 - RNA, 22 nt, Human
caccaacagucugguccugucc

SEQ ID NO: 609852 - RNA, 24 nt, Human
caccaaggcuggagugcaguggug

SEQ ID NO: 609853 - RNA, 20 nt, Human
caccacaacuucugccuccc

SEQ ID NO: 609854 - RNA, 21 nt, Human
caccacaacuucugccuccca

SEQ ID NO: 609855 - RNA, 22 nt, Human
caccacaacuucugccucccag

SEQ ID NO: 609856 - RNA, 18 nt, Human
caccauguuggccagggu

SEQ ID NO: 609857 - RNA, 22 nt, Human
caccauguuggccagggugguc

SEQ ID NO: 609858 - RNA, 24 nt, Human
caccauguuggccaggguggucuc

SEQ ID NO: 609859 - RNA, 22 nt, Human
cacccaccucagccucccaaag

SEQ ID NO: 609860 - RNA, 23 nt, Human
cacccaccucagccucccaaagu

SEQ ID NO: 609861 - RNA, 23 nt, Human
cacgccuggccccaaacugacuc

SEQ ID NO: 609862 - RNA, 20 nt, Human
cacggcccucagaugacaga

SEQ ID NO: 609863 - RNA, 21 nt, Human
cacuauguuggccaggcuggu

SEQ ID NO: 609864 - RNA, 24 nt, Human
cacuauguuggccaggcuggucuc

SEQ ID NO: 609865 - RNA, 24 nt, Human
cacucugucaccaaggcuggagug

SEQ ID NO: 609866 - RNA, 22 nt, Human
cacugcuuggggaauaauucca

SEQ ID NO: 609867 - RNA, 18 nt, Human
cagcagccugaggagcug

SEQ ID NO: 609868 - RNA, 24 nt, Human
caggcugcaggaacuggaugcuaa

SEQ ID NO: 609869 - RNA, 19 nt, Human
cagggacacggcccucaga

SEQ ID NO: 609870 - RNA, 20 nt, Human
caggugccaccaugccuggc

SEQ ID NO: 609871 - RNA, 24 nt, Human
caggugugagccacugugccuggc

SEQ ID NO: 609872 - RNA, 20 nt, Human
caugugccacagaaauagag

SEQ ID NO: 609873 - RNA, 23 nt, Human
caugugccacagaaauagagcuu

SEQ ID NO: 609874 - RNA, 23 nt, Human
ccaaagugcugagauuacaggca

SEQ ID NO: 609875 - RNA, 24 nt, Human
ccaaagugcugagauuacaggcau

SEQ ID NO: 609876 - RNA, 21 nt, Human
ccaaagugcugggauuacagg

SEQ ID NO: 609877 - RNA, 21 nt, Human
ccaaagugcugggauuacagg

SEQ ID NO: 609878 - RNA, 24 nt, Human
ccaaagugcugggauuacaggugu

SEQ ID NO: 609879 - RNA, 23 nt, Human
ccaacccugacgugcagggcaga

SEQ ID NO: 609880 - RNA, 20 nt, Human
ccaaggcaaaaacacacaca

SEQ ID NO: 609881 - RNA, 23 nt, Human
ccaaguagcugggauuacaggca

SEQ ID NO: 609882 - RNA, 18 nt, Human
ccaagucaucacagaaga

SEQ ID NO: 609883 - RNA, 23 nt, Human
ccacaacuucugccucccagguu

SEQ ID NO: 609884 - RNA, 24 nt, Human
ccacaacuucugccucccagguuc

SEQ ID NO: 609885 - RNA, 20 nt, Human
ccacagugaccccagcuuuu

SEQ ID NO: 609886 - RNA, 26 nt, Human
ccacccaccucagccucccaaagugc

SEQ ID NO: 609887 - RNA, 24 nt, Human
ccaccuccugggcucaagugauuc

SEQ ID NO: 609888 - RNA, 19 nt, Human
ccacugugccuggccgggg

SEQ ID NO: 609889 - RNA, 23 nt, Human
ccagagcucacggccgucugcac

SEQ ID NO: 609890 - RNA, 22 nt, Human
ccaggaacuugugaacugcuaa

SEQ ID NO: 609891 - RNA, 19 nt, Human
ccaggcugcaggaacugga

SEQ ID NO: 609892 - RNA, 19 nt, Human
ccagugauccacccaccuc

SEQ ID NO: 609893 - RNA, 27 nt, Human
ccagugauccacccaccucagccuccc

SEQ ID NO: 609894 - RNA, 23 nt, Human
cccaaguagcugggauuacaggc

SEQ ID NO: 609895 - RNA, 24 nt, Human
cccaaguagcugggauuacaggca

SEQ ID NO: 609896 - RNA, 21 nt, Human
cccagguucaagcaauucgcc

SEQ ID NO: 609897 - RNA, 23 nt, Human
cccagguucaagcaauucgccug

SEQ ID NO: 609898 - RNA, 22 nt, Human
cccaucuuggccucccaaagug

SEQ ID NO: 609899 - RNA, 18 nt, Human
ccccagggcuucugaugg

SEQ ID NO: 609900 - RNA, 21 nt, Human
cccuagaaaaaugcaagaucc

SEQ ID NO: 609901 - RNA, 18 nt, Human
ccggggcccgagacgggc

SEQ ID NO: 609902 - RNA, 22 nt, Human
ccuccaccuccugggcucaagu

SEQ ID NO: 609903 - RNA, 21 nt, Human
ccucccagguucaagcaauuc

SEQ ID NO: 609904 - RNA, 21 nt, Human
ccuccugggcucaagugauuc

SEQ ID NO: 609905 - RNA, 24 nt, Human
ccuccugggcucaagugauucucc

SEQ ID NO: 609906 - RNA, 20 nt, Human
ccugaggagcugggacuaca

SEQ ID NO: 609907 - RNA, 23 nt, Human
ccugaggagcugggacuacaggc

SEQ ID NO: 609908 - RNA, 24 nt, Human
ccugaggagcugggacuacaggca

SEQ ID NO: 609909 - RNA, 23 nt, Human
ccugccucagccucccaaguagc

SEQ ID NO: 609910 - RNA, 24 nt, Human
ccuggccccaaacugacucuugac

SEQ ID NO: 609911 - RNA, 23 nt, Human
ccugggcucaagugauucuccuc

SEQ ID NO: 609912 - RNA, 23 nt, Human
ccugggcucaagugauucuccug

SEQ ID NO: 609913 - RNA, 18 nt, Human
cgacaccaugcccggcua

SEQ ID NO: 609914 - RNA, 24 nt, Human
cgcucuguuacccaggcuggagug

SEQ ID NO: 609915 - RNA, 24 nt, Human
cggcucacggggggccaggaaccc

SEQ ID NO: 609916 - RNA, 20 nt, Human
cgggagcccagcgcacagag

SEQ ID NO: 609917 - RNA, 23 nt, Human
cggggggccaggaaccccagggc

SEQ ID NO: 609918 - RNA, 24 nt, Human
cuaacauaaacacaaaaacagguc

SEQ ID NO: 609919 - RNA, 23 nt, Human
cucaagugauucuccugccucag

SEQ ID NO: 609920 - RNA, 24 nt, Human
cucaagugauucuccugccucagc

SEQ ID NO: 609921 - RNA, 24 nt, Human
cucaccacaacuucugccucccag

SEQ ID NO: 609922 - RNA, 24 nt, Human
cucacucugucaccaaggcuggag

SEQ ID NO: 609923 - RNA, 24 nt, Human
cucagccucccaaguagcugggau

SEQ ID NO: 609924 - RNA, 21 nt, Human
cucccaaagugcugagauuac

SEQ ID NO: 609925 - RNA, 22 nt, Human
cuccugaccucgugauccgccc

SEQ ID NO: 609926 - RNA, 21 nt, Human
cuccugggcucaagugauucu

SEQ ID NO: 609927 - RNA, 25 nt, Human
cuccugggcucaagugauucuccug

SEQ ID NO: 609928 - RNA, 18 nt, Human
cucgcgggcucccugucu

SEQ ID NO: 609929 - RNA, 24 nt, Human
cucgcucuguuacccaggcuggag

SEQ ID NO: 609930 - RNA, 22 nt, Human
cucgcugaaaccuccaccuccu

SEQ ID NO: 609931 - RNA, 24 nt, Human
cucgcugaaaccuccaccuccugg

SEQ ID NO: 609932 - RNA, 21 nt, Human
cucuguuuagguuugcccaga

SEQ ID NO: 609933 - RNA, 24 nt, Human
cugaaaccuccaccuccugggcuc

SEQ ID NO: 609934 - RNA, 23 nt, Human
cugccucagccucccaaguagcu

SEQ ID NO: 609935 - RNA, 20 nt, Human
cugcuaaggggaugaccagg

SEQ ID NO: 609936 - RNA, 24 nt, Human
cuggagugcaguggugugaucuca

SEQ ID NO: 609937 - RNA, 23 nt, Human
cuguauuuuuaguagagaugggg

SEQ ID NO: 609938 - RNA, 20 nt, Human
gaauguuaucuggaaugcag

SEQ ID NO: 609939 - RNA, 19 nt, Human
gaccaaagaaucugauuug

SEQ ID NO: 609940 - RNA, 22 nt, Human
gaccaaggcaaaaacacacaca

SEQ ID NO: 609941 - RNA, 21 nt, Human
gaccucgugauccgcccaucu

SEQ ID NO: 609942 - RNA, 24 nt, Human
gaccucgugauccgcccaucuugg

SEQ ID NO: 609943 - RNA, 25 nt, Human
gaccucgugauccgcccaucuuggc

SEQ ID NO: 609944 - RNA, 18 nt, Human
gagaugggguuucaccau

SEQ ID NO: 609945 - RNA, 24 nt, Human
gagaugggguuucaccauguuggc

SEQ ID NO: 609946 - RNA, 20 nt, Human
gagaugggguuucacuaugu

SEQ ID NO: 609947 - RNA, 24 nt, Human
gagaugggguuucacuauguuggc

SEQ ID NO: 609948 - RNA, 22 nt, Human
gagccaccacgccuggccccaa

SEQ ID NO: 609949 - RNA, 25 nt, Human
gagcgguagcacguagcgcggguaa

SEQ ID NO: 609950 - RNA, 21 nt, Human
gaugacagacuccaggaagaa

SEQ ID NO: 609951 - RNA, 24 nt, Human
gauuacaggcaggugccaccaugc

SEQ ID NO: 609952 - RNA, 18 nt, Human
gauuacaggcaugagcca

SEQ ID NO: 609953 - RNA, 22 nt, Human
gauuacaggcaugagccaccac

SEQ ID NO: 609954 - RNA, 18 nt, Human
gauuacaggugugagcca

SEQ ID NO: 609955 - RNA, 19 nt, Human
gauuacaggugugagccac

SEQ ID NO: 609956 - RNA, 21 nt, Human
gauuacaggugugagccacug

SEQ ID NO: 609957 - RNA, 21 nt, Human
gauucuccugccucagccucc

SEQ ID NO: 609958 - RNA, 33 nt, Human
gcagccugaggagcugggacuacaggcacgccg

SEQ ID NO: 609959 - RNA, 18 nt, Human
gcaggcaacgcauccucc

SEQ ID NO: 609960 - RNA, 20 nt, Human
gcccagagcucacggccguc

SEQ ID NO: 609961 - RNA, 19 nt, Human
gcggacuggguccggggcc

SEQ ID NO: 609962 - RNA, 18 nt, Human
gcuaaggggaugaccagg

SEQ ID NO: 609963 - RNA, 26 nt, Human
gcucuguuacccaggcuggagugcac

SEQ ID NO: 609964 - RNA, 23 nt, Human
gcuggagugcacaaucucggcuc

SEQ ID NO: 609965 - RNA, 23 nt, Human
gcuggucucgaacuccugaccuc

SEQ ID NO: 609966 - RNA, 18 nt, Human
ggaagaaagagcaugaga

SEQ ID NO: 609967 - RNA, 19 nt, Human
ggaucuggguggaugccaa

SEQ ID NO: 609968 - RNA, 22 nt, Human
ggaugccaacccugacgugcag

SEQ ID NO: 609969 - RNA, 19 nt, Human
ggccaggguggucucaaac

SEQ ID NO: 609970 - RNA, 19 nt, Human
ggcgcgcagcagcggcggg

SEQ ID NO: 609971 - RNA, 19 nt, Human
ggcgggagcccagcgcaca

SEQ ID NO: 609972 - RNA, 22 nt, Human
ggcuggagugcaguggugugau

SEQ ID NO: 609973 - RNA, 24 nt, Human
ggcuggucucgaacuccugaccuc

SEQ ID NO: 609974 - RNA, 23 nt, Human
gggcagagcaccaggcugcagga

SEQ ID NO: 609975 - RNA, 20 nt, Human
gggccaggaaccccagggcu

SEQ ID NO: 609976 - RNA, 22 nt, Human
gggcucaagugauucuccugcc

SEQ ID NO: 609977 - RNA, 27 nt, Human
gggggccggggaaggagucaccaacag

SEQ ID NO: 609978 - RNA, 22 nt, Human
gggguuucaccauguuggccag

SEQ ID NO: 609979 - RNA, 23 nt, Human
gggguuucaccauguuggccagg

SEQ ID NO: 609980 - RNA, 22 nt, Human
gggguuucacuauguuggccag

SEQ ID NO: 609981 - RNA, 23 nt, Human
gggguuucacuauguuggccagg

SEQ ID NO: 609982 - RNA, 18 nt, Human
ggguuucacuauguuggc

SEQ ID NO: 609983 - RNA, 20 nt, Human
gguagcacguagcgcgggua

SEQ ID NO: 609984 - RNA, 23 nt, Human
ggucagggaaccaaaacacugug

SEQ ID NO: 609985 - RNA, 19 nt, Human
ggucucgaacuccugaccu

SEQ ID NO: 609986 - RNA, 21 nt, Human
ggugugaucucagcucgcuga

SEQ ID NO: 609987 - RNA, 23 nt, Human
guagagaugggguuucaccaugu

SEQ ID NO: 609988 - RNA, 24 nt, Human
gugauccacccaccucagccuccc

SEQ ID NO: 609989 - RNA, 24 nt, Human
gugauucuccugccucagccuccc

SEQ ID NO: 609990 - RNA, 22 nt, Human
uaacauaaacacaaaaacaggu

SEQ ID NO: 609991 - RNA, 24 nt, Human
uaauuucuguauuuuuaguagaga

SEQ ID NO: 609992 - RNA, 23 nt, Human
uaauuuuuguuuuaguagagaug

SEQ ID NO: 609993 - RNA, 22 nt, Human
uacaggcaggugccaccaugcc

SEQ ID NO: 609994 - RNA, 22 nt, Human
uacaggcaugagccaccacgcc

SEQ ID NO: 609995 - RNA, 22 nt, Human
uacaggugugagccacugugcc

SEQ ID NO: 609996 - RNA, 22 nt, Human
uacaggugugagccacugugcc

SEQ ID NO: 609997 - RNA, 23 nt, Human
uacaggugugagccacugugccu

SEQ ID NO: 609998 - RNA, 19 nt, Human
uacccaggcuggagugcac

SEQ ID NO: 609999 - RNA, 22 nt, Human
uacccaggcuggagugcacaau

SEQ ID NO: 610000 - RNA, 22 nt, Human
uagagaugggguuucaccaugu

SEQ ID NO: 610001 - RNA, 22 nt, Human
uagagaugggguuucacuaugu

SEQ ID NO: 610002 - RNA, 24 nt, Human
uaguagagaugggguuucaccaug

SEQ ID NO: 610003 - RNA, 26 nt, Human
uaguagagaugggguuucaccauguu

SEQ ID NO: 610004 - RNA, 24 nt, Human
uaguagagaugggguuucacuaug

SEQ ID NO: 610005 - RNA, 24 nt, Human
uauguuggccaggcuggucucgaa

SEQ ID NO: 610006 - RNA, 19 nt, Human
ucaaaagacaugugccaca

SEQ ID NO: 610007 - RNA, 25 nt, Human
ucaaaagacaugugccacagaaaua

SEQ ID NO: 610008 - RNA, 24 nt, Human
ucaccacaacuucugccucccagg

SEQ ID NO: 610009 - RNA, 25 nt, Human
ucaccacaacuucugccucccaggu

SEQ ID NO: 610010 - RNA, 24 nt, Human
ucaccauguuggccaggguggucu

SEQ ID NO: 610011 - RNA, 22 nt, Human
ucacuauguuggccaggcuggu

SEQ ID NO: 610012 - RNA, 25 nt, Human
ucagacaggcaucaccagugggaac

SEQ ID NO: 610013 - RNA, 20 nt, Human
ucagauccuaacauaaacac

SEQ ID NO: 610014 - RNA, 18 nt, Human
ucagccucccaaagugcu

SEQ ID NO: 610015 - RNA, 20 nt, Human
ucagccucccaaguagcugg

SEQ ID NO: 610016 - RNA, 21 nt, Human
uccacccaccucagccuccca

SEQ ID NO: 610017 - RNA, 20 nt, Human
uccaucuggaucugggugga

SEQ ID NO: 610018 - RNA, 24 nt, Human
ucccaaagugcugagauuacaggc

SEQ ID NO: 610019 - RNA, 23 nt, Human
ucccaaagugcugggauuacagg

SEQ ID NO: 610020 - RNA, 24 nt, Human
ucccaaguagcugggauuacaggc

SEQ ID NO: 610021 - RNA, 19 nt, Human
ucccagguucaagcaauuc

SEQ ID NO: 610022 - RNA, 21 nt, Human
ucccagguucaagcaauucgc

SEQ ID NO: 610023 - RNA, 24 nt, Human
ucccagguucaagcaauucgccug

SEQ ID NO: 610024 - RNA, 24 nt, Human
ucccuagaaaaaugcaagauccuc

SEQ ID NO: 610025 - RNA, 19 nt, Human
uccucguccccuuacccag

SEQ ID NO: 610026 - RNA, 21 nt, Human
uccugggcucaagugauucuc

SEQ ID NO: 610027 - RNA, 24 nt, Human
uccugggcucaagugauucuccug

SEQ ID NO: 610028 - RNA, 24 nt, Human
ucgcucuguuacccaggcuggagu

SEQ ID NO: 610029 - RNA, 24 nt, Human
ucgcugaaaccuccaccuccuggg

SEQ ID NO: 610030 - RNA, 25 nt, Human
ucuacagccacagugaccccagcuu

SEQ ID NO: 610031 - RNA, 24 nt, Human
ucucacucugucaccaaggcugga

SEQ ID NO: 610032 - RNA, 26 nt, Human
ucuccugccucagccucccaaguagc

SEQ ID NO: 610033 - RNA, 19 nt, Human
ucucgaacuccugaccucg

SEQ ID NO: 610034 - RNA, 19 nt, Human
ucucgcucuguuacccagg

SEQ ID NO: 610035 - RNA, 23 nt, Human
ucucgcucuguuacccaggcugg

SEQ ID NO: 610036 - RNA, 24 nt, Human
ucucgcucuguuacccaggcugga

SEQ ID NO: 610037 - RNA, 26 nt, Human
ucucgcucuguuacccaggcuggagu

SEQ ID NO: 610038 - RNA, 24 nt, Human
ucugucaccaaggcuggagugcag

SEQ ID NO: 610039 - RNA, 18 nt, Human
ucuguuacccaggcugga

SEQ ID NO: 610040 - RNA, 24 nt, Human
ucuguuacccaggcuggagugcac

SEQ ID NO: 610041 - RNA, 20 nt, Human
ucuuggccucccaaagugcu

SEQ ID NO: 610042 - RNA, 22 nt, Human
ugagauggagucucgcucuguu

SEQ ID NO: 610043 - RNA, 22 nt, Human
ugagauuacaggcaugagccac

SEQ ID NO: 610044 - RNA, 23 nt, Human
ugagauuacaggcaugagccacc

SEQ ID NO: 610045 - RNA, 24 nt, Human
ugagauuacaggcaugagccacca

SEQ ID NO: 610046 - RNA, 24 nt, Human
ugagauuacaggcaugagccacca

SEQ ID NO: 610047 - RNA, 21 nt, Human
ugagggaagaggaggcaaagg

SEQ ID NO: 610048 - RNA, 24 nt, Human
ugauccacccaccucagccuccca

SEQ ID NO: 610049 - RNA, 24 nt, Human
ugauccgcccaucuuggccuccca

SEQ ID NO: 610050 - RNA, 20 nt, Human
ugauucuccugccucagccu

SEQ ID NO: 610051 - RNA, 27 nt, Human
ugcaagauccuccgaaaaucaagaucu

SEQ ID NO: 610052 - RNA, 23 nt, Human
ugcacaaucucggcucaccacaa

SEQ ID NO: 610053 - RNA, 24 nt, Human
ugcccggcuaauuucuguauuuuu

SEQ ID NO: 610054 - RNA, 24 nt, Human
ugccucagccucccaaguagcugg

SEQ ID NO: 610055 - RNA, 21 nt, Human
ugcgcugacacggacgcgaag

SEQ ID NO: 610056 - RNA, 24 nt, Human
ugcugggauuacaggugugagcca

SEQ ID NO: 610057 - RNA, 21 nt, Human
uggaacauuugccaggaacuu

SEQ ID NO: 610058 - RNA, 18 nt, Human
uggacacccccacugcca

SEQ ID NO: 610059 - RNA, 22 nt, Human
uggagugcacaaucucggcuca

SEQ ID NO: 610060 - RNA, 19 nt, Human
uggagugcaguggugugau

SEQ ID NO: 610061 - RNA, 24 nt, Human
uggagugcaguggugugaucucag

SEQ ID NO: 610062 - RNA, 24 nt, Human
uggccaggcuggucucgaacuccu

SEQ ID NO: 610063 - RNA, 21 nt, Human
uggccaggguggucucaaacu

SEQ ID NO: 610064 - RNA, 24 nt, Human
ugggacuacaggcacgcgacacca

SEQ ID NO: 610065 - RNA, 21 nt, Human
ugggauuacaggcaggugcca

SEQ ID NO: 610066 - RNA, 22 nt, Human
ugggauuacaggcaggugccac

SEQ ID NO: 610067 - RNA, 24 nt, Human
ugggauuacaggcaggugccacca

SEQ ID NO: 610068 - RNA, 25 nt, Human
ugggauuacaggcaggugccaccau

SEQ ID NO: 610069 - RNA, 18 nt, Human
ugggauuacaggugugag

SEQ ID NO: 610070 - RNA, 21 nt, Human
ugggauuacaggugugagcca

SEQ ID NO: 610071 - RNA, 22 nt, Human
ugggauuacaggugugagccac

SEQ ID NO: 610072 - RNA, 22 nt, Human
ugggauuacaggugugagccac

SEQ ID NO: 610073 - RNA, 22 nt, Human
ugggauuacaggugugagccac

SEQ ID NO: 610074 - RNA, 24 nt, Human
ugggauuacaggugugagccacug

SEQ ID NO: 610075 - RNA, 18 nt, Human
ugggcucaagugauucuc

SEQ ID NO: 610076 - RNA, 24 nt, Human
ugggcucaagugauucuccugccu

SEQ ID NO: 610077 - RNA, 18 nt, Human
ugggggccggggaaggag

SEQ ID NO: 610078 - RNA, 24 nt, Human
ugggguuucaccauguuggccagg

SEQ ID NO: 610079 - RNA, 24 nt, Human
ugggguuucacuauguuggccagg

SEQ ID NO: 610080 - RNA, 18 nt, Human
uggugagggaagaggagg

SEQ ID NO: 610081 - RNA, 22 nt, Human
uggugugaucucagcucgcuga

SEQ ID NO: 610082 - RNA, 20 nt, Human
ugucugcuuggugacccugu

SEQ ID NO: 610083 - RNA, 19 nt, Human
ugugcauaggacacgggca

SEQ ID NO: 610084 - RNA, 24 nt, Human
uguuuuguuuuuuuuugagaugga

SEQ ID NO: 610085 - RNA, 23 nt, Human
uguuuuuuuuugagauggagucu

SEQ ID NO: 610086 - RNA, 18 nt, Human
uuacccaggcuggagugc

SEQ ID NO: 610087 - RNA, 18 nt, Human
uuaguagagaugggguuu

SEQ ID NO: 610088 - RNA, 18 nt, Human
uuaguagagaugggguuu

SEQ ID NO: 610089 - RNA, 21 nt, Human
uuaguagagaugggguuucac

SEQ ID NO: 610090 - RNA, 21 nt, Human
uuaguagagaugggguuucac

SEQ ID NO: 610091 - RNA, 22 nt, Human
uuaguagagaugggguuucacc

SEQ ID NO: 610092 - RNA, 24 nt, Human
uuaguagagaugggguuucaccau

SEQ ID NO: 610093 - RNA, 24 nt, Human
uuaguagagaugggguuucacuau

SEQ ID NO: 610094 - RNA, 21 nt, Human
uucaagcaauucgccugccuc

SEQ ID NO: 610095 - RNA, 23 nt, Human
uugguuuuguuuuguuuuuuuuu

SEQ ID NO: 610096 - RNA, 19 nt, Human
uuucaccauguuggccagg

SEQ ID NO: 610097 - RNA, 23 nt, Human
uuucacuauguuggccaggcugu

SEQ ID NO: 610098 - RNA, 20 nt, Human
uuucuguauuuuuaguagag

SEQ ID NO: 610099 - RNA, 20 nt, Human
uuugaagcuucucucgaagc

SEQ ID NO: 610100 - RNA, 23 nt, Human
uuuuaguagagaugggguuucac

SEQ ID NO: 610101 - RNA, 18 nt, Human
uuuugaagcuucucucga

SEQ ID NO: 610102 - RNA, 24 nt, Human
uuuuuaguagagaugggguuucac

SEQ ID NO: 610103 - RNA, 22 nt, Human
uuuuuuuuugagauggagucuc

SEQ ID NO: 610104 - RNA, 19 nt, Human
aaaacaagaacucuggagc

SEQ ID NO: 610105 - RNA, 18 nt, Human
aaauaacugcugaaagcu

SEQ ID NO: 610106 - RNA, 18 nt, Human
aacaaguuaacacuugga

SEQ ID NO: 610107 - RNA, 18 nt, Human
aacaguaaauaccccauu

SEQ ID NO: 610108 - RNA, 24 nt, Human
acacugaagaaaaugggaaaaaaa

SEQ ID NO: 610109 - RNA, 25 nt, Human
acauuuauuacauucauaggguuuu

SEQ ID NO: 610110 - RNA, 22 nt, Human
acucuggagccaaucucagcuc

SEQ ID NO: 610111 - RNA, 19 nt, Human
agaguuuuccauccaguac

SEQ ID NO: 610112 - RNA, 23 nt, Human
aggauccuucaacaucucugcuu

SEQ ID NO: 610113 - RNA, 23 nt, Human
aggcugagcgauuccuaaaaacu

SEQ ID NO: 610114 - RNA, 21 nt, Human
agguuuuucccuuagcaauuc

SEQ ID NO: 610115 - RNA, 18 nt, Human
aguaaguauguauauaca

SEQ ID NO: 610116 - RNA, 27 nt, Human
caaaagguuucucuccuguaugagucc

SEQ ID NO: 610117 - RNA, 24 nt, Human
caaacuaauugcccaacaaugcag

SEQ ID NO: 610118 - RNA, 19 nt, Human
caaauguacaagaaacgaa

SEQ ID NO: 610119 - RNA, 22 nt, Human
cagcacauaaguguuauaugua

SEQ ID NO: 610120 - RNA, 24 nt, Human
cagcugaaggcuuuuccacauuua

SEQ ID NO: 610121 - RNA, 22 nt, Human
caguaugaguuuucuuauguug

SEQ ID NO: 610122 - RNA, 25 nt, Human
ccaguugaaagauuucccacacuca

SEQ ID NO: 610123 - RNA, 20 nt, Human
ccccacagucaugguccucc

SEQ ID NO: 610124 - RNA, 21 nt, Human
ccguuagucaucucauucauu

SEQ ID NO: 610125 - RNA, 26 nt, Human
ccucugauguccaauaagaugagagu

SEQ ID NO: 610126 - RNA, 19 nt, Human
cuaaauaacugcugaaagc

SEQ ID NO: 610127 - RNA, 18 nt, Human
cuccugggcacccagacc

SEQ ID NO: 610128 - RNA, 23 nt, Human
cugaaugauuucccacauucagu

SEQ ID NO: 610129 - RNA, 25 nt, Human
cugcaguguaagugcuuguauguug

SEQ ID NO: 610130 - RNA, 19 nt, Human
cugguagaccauaagggga

SEQ ID NO: 610131 - RNA, 18 nt, Human
cuuuuccauggaucuuuc

SEQ ID NO: 610132 - RNA, 21 nt, Human
gagccaaucucagcucuacuc

SEQ ID NO: 610133 - RNA, 20 nt, Human
gaucacuuucuguccagcaa

SEQ ID NO: 610134 - RNA, 24 nt, Human
gcugaaaacaagaacucuggagcc

SEQ ID NO: 610135 - RNA, 22 nt, Human
uaaaagaugccucauuccccac

SEQ ID NO: 610136 - RNA, 22 nt, Human
uaaaggggacuaaacaaguuaa

SEQ ID NO: 610137 - RNA, 23 nt, Human
ucaauacuauuauuuuucuuaca

SEQ ID NO: 610138 - RNA, 21 nt, Human
ucaguacauucaaaagguuuc

SEQ ID NO: 610139 - RNA, 19 nt, Human
ucauuccccacagucaugg

SEQ ID NO: 610140 - RNA, 21 nt, Human
ucccuauucuuuuccuucaug

SEQ ID NO: 610141 - RNA, 23 nt, Human
ucccuauucuuuuccuucauggg

SEQ ID NO: 610142 - RNA, 21 nt, Human
ucccuuagcaauucacaccaa

SEQ ID NO: 610143 - RNA, 21 nt, Human
ucucaacuggguuaacuuuuc

SEQ ID NO: 610144 - RNA, 20 nt, Human
ucucugcaguguaagugcuu

SEQ ID NO: 610145 - RNA, 26 nt, Human
ucucuuauguacaauaagaugagaau

SEQ ID NO: 610146 - RNA, 23 nt, Human
ucugcauaagguuuuucccuuag

SEQ ID NO: 610147 - RNA, 22 nt, Human
ugaaaacaagaacucuggagcc

SEQ ID NO: 610148 - RNA, 24 nt, Human
ugaaaacaagaacucuggagccaa

SEQ ID NO: 610149 - RNA, 19 nt, Human
ugccucauuccccacaguc

SEQ ID NO: 610150 - RNA, 30 nt, Human
ugccucauuccccacagucaugguccucaa

SEQ ID NO: 610151 - RNA, 21 nt, Human
ugcuucagcuuagccauuugu

SEQ ID NO: 610152 - RNA, 20 nt, Human
uggaaagcauuuaaaagaaa

SEQ ID NO: 610153 - RNA, 20 nt, Human
uggcugaaaacaagaacucu

SEQ ID NO: 610154 - RNA, 22 nt, Human
ugggaaaaaaaaucacuggaga

SEQ ID NO: 610155 - RNA, 18 nt, Human
ugggguaacaguaccuau

SEQ ID NO: 610156 - RNA, 19 nt, Human
uguuuauaggguuuuccuc

SEQ ID NO: 610157 - RNA, 19 nt, Human
uuacaguaaguauguauau

SEQ ID NO: 610158 - RNA, 18 nt, Human
uuaucaaaucucugcuau

SEQ ID NO: 610159 - RNA, 18 nt, Human
uucaguacauucaaaagg

SEQ ID NO: 610160 - RNA, 19 nt, Human
uucccacacucauuacaaa

SEQ ID NO: 610161 - RNA, 21 nt, Human
uucuacaauuaugcacaaaau

SEQ ID NO: 610162 - RNA, 26 nt, Human
uuucuuauguugaauaagguaagagc

SEQ ID NO: 610163 - RNA, 24 nt, Human
uuuuccauggaucuuucagguccu

SEQ ID NO: 610164 - RNA, 24 nt, Human
uuuuucccuuagcaauucacacca

SEQ ID NO: 610165 - RNA, 21 nt, Human
aagaagaaaagagguacagaa

SEQ ID NO: 610166 - RNA, 28 nt, Human
aagaagaaaagagguacagaacacccag

SEQ ID NO: 610167 - RNA, 24 nt, Human
aagcgagagaaacaagugcaggaa

SEQ ID NO: 610168 - RNA, 24 nt, Human
aagcgauccgcccgccucggccuc

SEQ ID NO: 610169 - RNA, 18 nt, Human
acaggguuucgccauguu

SEQ ID NO: 610170 - RNA, 19 nt, Human
acaggguuucgccauguug

SEQ ID NO: 610171 - RNA, 21 nt, Human
acaggguuucgccauguugcc

SEQ ID NO: 610172 - RNA, 23 nt, Human
acaggguuucgccauguugccua

SEQ ID NO: 610173 - RNA, 24 nt, Human
acaggguuucgccauguugccuag

SEQ ID NO: 610174 - RNA, 24 nt, Human
acagugcugggauuccaggcguga

SEQ ID NO: 610175 - RNA, 20 nt, Human
accuggucuccugggcucaa

SEQ ID NO: 610176 - RNA, 21 nt, Human
agaacacccagaggugcccuc

SEQ ID NO: 610177 - RNA, 20 nt, Human
agaagccaaaaagacaggug

SEQ ID NO: 610178 - RNA, 18 nt, Human
agacaggguuucgccaug

SEQ ID NO: 610179 - RNA, 18 nt, Human
agacaggguuucgccaug

SEQ ID NO: 610180 - RNA, 23 nt, Human
agacaggguuucgccauguugcc

SEQ ID NO: 610181 - RNA, 18 nt, Human
agaggaagggaaaguugg

SEQ ID NO: 610182 - RNA, 23 nt, Human
agcagcgcguccgccucccgcgc

SEQ ID NO: 610183 - RNA, 23 nt, Human
agcgagagaaacaagugcaggaa

SEQ ID NO: 610184 - RNA, 18 nt, Human
agcggugggaaagggggg

SEQ ID NO: 610185 - RNA, 20 nt, Human
agcuccuuaggagaaggugg

SEQ ID NO: 610186 - RNA, 22 nt, Human
aggaaggcggggguaggggagc

SEQ ID NO: 610187 - RNA, 22 nt, Human
aggaggaaggagggagguccag

SEQ ID NO: 610188 - RNA, 26 nt, Human
aggcaaaaggaaacaccuugagcugg

SEQ ID NO: 610189 - RNA, 18 nt, Human
aggcggggguaggggagc

SEQ ID NO: 610190 - RNA, 19 nt, Human
aggcuggucuccaaccugg

SEQ ID NO: 610191 - RNA, 22 nt, Human
aggugcccucgauuccgucuug

SEQ ID NO: 610192 - RNA, 22 nt, Human
agugcugggauuccaggcguga

SEQ ID NO: 610193 - RNA, 18 nt, Human
aguuggggcuuacugcag

SEQ ID NO: 610194 - RNA, 24 nt, Human
cacagugcugggauuccaggcgug

SEQ ID NO: 610195 - RNA, 19 nt, Human
cagaggugcccucgauucc

SEQ ID NO: 610196 - RNA, 21 nt, Human
caggcaaaaggaaacaccuug

SEQ ID NO: 610197 - RNA, 24 nt, Human
caggguuucgccauguugccuagg

SEQ ID NO: 610198 - RNA, 18 nt, Human
caggugagcagcgcgucc

SEQ ID NO: 610199 - RNA, 19 nt, Human
cauguugccuaggcugguc

SEQ ID NO: 610200 - RNA, 24 nt, Human
cauguugccuaggcuggucuccaa

SEQ ID NO: 610201 - RNA, 21 nt, Human
ccaaggugcaagaagaaaaga

SEQ ID NO: 610202 - RNA, 24 nt, Human
ccacagugcugggauuccaggcgu

SEQ ID NO: 610203 - RNA, 20 nt, Human
ccagcaauaaagcgagagaa

SEQ ID NO: 610204 - RNA, 22 nt, Human
cccggccuauuuacuuuucuua

SEQ ID NO: 610205 - RNA, 20 nt, Human
cccugccucagccacuccuc

SEQ ID NO: 610206 - RNA, 22 nt, Human
cccugccucagccacuccuccu

SEQ ID NO: 610207 - RNA, 23 nt, Human
cccugccucagccacuccuccug

SEQ ID NO: 610208 - RNA, 21 nt, Human
cccuucuuccaucccacgucc

SEQ ID NO: 610209 - RNA, 19 nt, Human
ccggcagucaugggagaag

SEQ ID NO: 610210 - RNA, 22 nt, Human
ccucccgcgcacaggugagggc

SEQ ID NO: 610211 - RNA, 18 nt, Human
ccugggcucaagcgaucc

SEQ ID NO: 610212 - RNA, 22 nt, Human
ccugggcucaagcgauccgccc

SEQ ID NO: 610213 - RNA, 22 nt, Human
ccugggcucaagcgauccgccc

SEQ ID NO: 610214 - RNA, 24 nt, Human
cgccauguugccuaggcuggucuc

SEQ ID NO: 610215 - RNA, 24 nt, Human
cgccccuaggccuugcggcggcuu

SEQ ID NO: 610216 - RNA, 24 nt, Human
cgccucggccucccacagugcugg

SEQ ID NO: 610217 - RNA, 20 nt, Human
cggcuuggcaggaaggcggg

SEQ ID NO: 610218 - RNA, 22 nt, Human
cuccaaccuggucuccugggcu

SEQ ID NO: 610219 - RNA, 21 nt, Human
cuccugggcucaagcgauccg

SEQ ID NO: 610220 - RNA, 21 nt, Human
cugguuaccaggcaaaaggaa

SEQ ID NO: 610221 - RNA, 23 nt, Human
gagaaacaagugcaggaaacugg

SEQ ID NO: 610222 - RNA, 21 nt, Human
gagaagguggggaggaggaag

SEQ ID NO: 610223 - RNA, 22 nt, Human
gaggaagggaaaguuggggcuu

SEQ ID NO: 610224 - RNA, 20 nt, Human
gagguacagaacacccagag

SEQ ID NO: 610225 - RNA, 23 nt, Human
gaggugcccucgauuccgucuug

SEQ ID NO: 610226 - RNA, 21 nt, Human
gcccgccccuaggccuugcgg

SEQ ID NO: 610227 - RNA, 22 nt, Human
gcccugccucagccacuccucc

SEQ ID NO: 610228 - RNA, 24 nt, Human
gcccugccucagccacuccuccug

SEQ ID NO: 610229 - RNA, 20 nt, Human
gccuaggcuggucuccaacc

SEQ ID NO: 610230 - RNA, 18 nt, Human
gccuauuuacuuuucuua

SEQ ID NO: 610231 - RNA, 24 nt, Human
gcgauccgcccgccucggccuccc

SEQ ID NO: 610232 - RNA, 18 nt, Human
ggagggagguccaggccc

SEQ ID NO: 610233 - RNA, 24 nt, Human
gggcucaagcgauccgcccgccuc

SEQ ID NO: 610234 - RNA, 21 nt, Human
ggggagcggugggaaaggggg

SEQ ID NO: 610235 - RNA, 18 nt, Human
gugggaaagggggguggg

SEQ ID NO: 610236 - RNA, 21 nt, Human
uagagacaggguuucgccaug

SEQ ID NO: 610237 - RNA, 22 nt, Human
uagagacaggguuucgccaugu

SEQ ID NO: 610238 - RNA, 22 nt, Human
uaggagaagguggggaggagga

SEQ ID NO: 610239 - RNA, 24 nt, Human
ucccacagugcugggauuccaggc

SEQ ID NO: 610240 - RNA, 18 nt, Human
uccugggcucaagcgauc

SEQ ID NO: 610241 - RNA, 20 nt, Human
uccugggcucaagcgauccg

SEQ ID NO: 610242 - RNA, 20 nt, Human
uccuuaggagaagguggggg

SEQ ID NO: 610243 - RNA, 22 nt, Human
ucgccauguugccuaggcuggu

SEQ ID NO: 610244 - RNA, 21 nt, Human
ucugccugucggcggcggcac

SEQ ID NO: 610245 - RNA, 22 nt, Human
ucuuccaucccacguccuccac

SEQ ID NO: 610246 - RNA, 18 nt, Human
ucuugcacuugcccuucu

SEQ ID NO: 610247 - RNA, 21 nt, Human
ugcaagaagaaaagagguaca

SEQ ID NO: 610248 - RNA, 21 nt, Human
ugccuaggcuggucuccaacc

SEQ ID NO: 610249 - RNA, 19 nt, Human
ugccucagccacuccuccu

SEQ ID NO: 610250 - RNA, 21 nt, Human
uggcaggaaggcggggguagg

SEQ ID NO: 610251 - RNA, 19 nt, Human
uggccaggagcuaccagcg

SEQ ID NO: 610252 - RNA, 22 nt, Human
ugggagaagccaaaaagacagg

SEQ ID NO: 610253 - RNA, 18 nt, Human
ugggauuccaggcgugag

SEQ ID NO: 610254 - RNA, 19 nt, Human
ugggauuccaggcgugagc

SEQ ID NO: 610255 - RNA, 24 nt, Human
ugggauuccaggcgugagcuaccg

SEQ ID NO: 610256 - RNA, 23 nt, Human
uggggaggaggaaggagggaggu

SEQ ID NO: 610257 - RNA, 21 nt, Human
uuccaucccacguccuccacu

SEQ ID NO: 610258 - RNA, 20 nt, Human
uugcacuugcccuucuccca

SEQ ID NO: 610259 - RNA, 24 nt, Human
uuucgccauguugccuaggcuggu

SEQ ID NO: 610260 - RNA, 25 nt, Human
aaaaaaacuuaaacaaagaacaaag

SEQ ID NO: 610261 - RNA, 20 nt, Human
aaacacagaagacuagaaau

SEQ ID NO: 610262 - RNA, 23 nt, Human
aaacacuaaaagaauuuaaauaa

SEQ ID NO: 610263 - RNA, 27 nt, Human
aaaccaaacuuacuuacagaaaaaaua

SEQ ID NO: 610264 - RNA, 22 nt, Human
aaccuccaucuccucuuuccuc

SEQ ID NO: 610265 - RNA, 21 nt, Human
aacuacauucaggaaaaaaaa

SEQ ID NO: 610266 - RNA, 21 nt, Human
aagcaagcuuucuauaagcuu

SEQ ID NO: 610267 - RNA, 21 nt, Human
aauggagaaucacuaaaacug

SEQ ID NO: 610268 - RNA, 19 nt, Human
acuacauucaggaaaaaaa

SEQ ID NO: 610269 - RNA, 24 nt, Human
aggaaaaaaaacuuaaacaaagaa

SEQ ID NO: 610270 - RNA, 25 nt, Human
aguauuggaauuuuaaaugacauaa

SEQ ID NO: 610271 - RNA, 20 nt, Human
aucaauucccucuaagcuga

SEQ ID NO: 610272 - RNA, 19 nt, Human
aucagcuucacaaccucaa

SEQ ID NO: 610273 - RNA, 22 nt, Human
aucagcuucacaaccucaaugg

SEQ ID NO: 610274 - RNA, 25 nt, Human
aucuccucuuuccucuucucuuuca

SEQ ID NO: 610275 - RNA, 18 nt, Human
auuuauagccauuuccuc

SEQ ID NO: 610276 - RNA, 21 nt, Human
caaccucaauggaaauuaaau

SEQ ID NO: 610277 - RNA, 20 nt, Human
caucuccucuuuccucuucu

SEQ ID NO: 610278 - RNA, 20 nt, Human
cauuucuaugcauguauaug

SEQ ID NO: 610279 - RNA, 18 nt, Human
ccacauauuugacaccuu

SEQ ID NO: 610280 - RNA, 20 nt, Human
ccauuaaccgaguaugaagc

SEQ ID NO: 610281 - RNA, 20 nt, Human
ccuccaucuccucuuuccuc

SEQ ID NO: 610282 - RNA, 19 nt, Human
ccucuucucuuucaugucc

SEQ ID NO: 610283 - RNA, 20 nt, Human
ccucuuuccucuucucuuuc

SEQ ID NO: 610284 - RNA, 23 nt, Human
cuuuccucuucucuuucaugucc

SEQ ID NO: 610285 - RNA, 22 nt, Human
gaaaaaaaacuuaaacaaagaa

SEQ ID NO: 610286 - RNA, 23 nt, Human
gaaaaaccuccaucuccucuuuc

SEQ ID NO: 610287 - RNA, 18 nt, Human
gcuaaacacagaagacua

SEQ ID NO: 610288 - RNA, 23 nt, Human
gcuuguucuucauugcccgugag

SEQ ID NO: 610289 - RNA, 18 nt, Human
ggucauuuuagcaguuuu

SEQ ID NO: 610290 - RNA, 21 nt, Human
uaaaagcaucuguugcuccaa

SEQ ID NO: 610291 - RNA, 26 nt, Human
uaaacacagaaaaaccuccaucuccu

SEQ ID NO: 610292 - RNA, 23 nt, Human
uaaagaguacgcuaaaagguaua

SEQ ID NO: 610293 - RNA, 21 nt, Human
uacaggcaucaaaaacuucaa

SEQ ID NO: 610294 - RNA, 20 nt, Human
uacaucaaaauuugguggcc

SEQ ID NO: 610295 - RNA, 21 nt, Human
uacuauaagauuuuacacaaa

SEQ ID NO: 610296 - RNA, 18 nt, Human
uacuguuuucgcuuuucu

SEQ ID NO: 610297 - RNA, 19 nt, Human
uagaaaucaaauaguuuca

SEQ ID NO: 610298 - RNA, 25 nt, Human
uagcaguuuuauucaacagaugcca

SEQ ID NO: 610299 - RNA, 22 nt, Human
uauaagauuuuacacaaaguua

SEQ ID NO: 610300 - RNA, 22 nt, Human
uaucauggauuuacuuacaagg

SEQ ID NO: 610301 - RNA, 22 nt, Human
ucaccaagaaacugcaaauuuc

SEQ ID NO: 610302 - RNA, 19 nt, Human
ucaccagcaucuuucguaa

SEQ ID NO: 610303 - RNA, 21 nt, Human
ucuccucuuuccucuucucuu

SEQ ID NO: 610304 - RNA, 20 nt, Human
ucuggaguuauaucagcuuc

SEQ ID NO: 610305 - RNA, 22 nt, Human
ucuuuccucuucucuuucaugu

SEQ ID NO: 610306 - RNA, 20 nt, Human
ucuuucugaaaaaguuucau

SEQ ID NO: 610307 - RNA, 22 nt, Human
ugaaaccaaacuuacuuacaga

SEQ ID NO: 610308 - RNA, 23 nt, Human
ugcuccaagugcaugguuuuugu

SEQ ID NO: 610309 - RNA, 23 nt, Human
uggagaaucacuaaaacuggaaa

SEQ ID NO: 610310 - RNA, 24 nt, Human
uggauaaacacagaaaaaccucca

SEQ ID NO: 610311 - RNA, 22 nt, Human
uguacacuaccugaaggaaauc

SEQ ID NO: 610312 - RNA, 23 nt, Human
uucauaaaacuaaauagcaaacu

SEQ ID NO: 610313 - RNA, 23 nt, Human
uucuacaccaguucauuuaucuc

SEQ ID NO: 610314 - RNA, 25 nt, Human
uuguuuuuucuuucugaaaaaguuu

SEQ ID NO: 610315 - RNA, 24 nt, Human
uuuauagccauuuccucauauuuu

SEQ ID NO: 610316 - RNA, 21 nt, Human
uuuucuggauuacuuaaaaca

SEQ ID NO: 610317 - RNA, 20 nt, Human
aaaaggccugagacagaggg

SEQ ID NO: 610318 - RNA, 23 nt, Human
aagcacaaaauagacccauguug

SEQ ID NO: 610319 - RNA, 19 nt, Human
aagcagccugugggaaaag

SEQ ID NO: 610320 - RNA, 22 nt, Human
aauaucuuuccugccaagcagc

SEQ ID NO: 610321 - RNA, 19 nt, Human
aaucuuuaccaaacuuuuc

SEQ ID NO: 610322 - RNA, 19 nt, Human
agagaauucuauggccaca

SEQ ID NO: 610323 - RNA, 21 nt, Human
agaggaauaucuuuccugcca

SEQ ID NO: 610324 - RNA, 22 nt, Human
aggguccaucccggugaacagc

SEQ ID NO: 610325 - RNA, 24 nt, Human
agguguggaagcagggaagugagg

SEQ ID NO: 610326 - RNA, 21 nt, Human
caccaugauggccacacgguc

SEQ ID NO: 610327 - RNA, 23 nt, Human
caccuagggagaccagguuucug

SEQ ID NO: 610328 - RNA, 19 nt, Human
cagguaacuuacaugccau

SEQ ID NO: 610329 - RNA, 24 nt, Human
caucaacauuucccagcgccugcu

SEQ ID NO: 610330 - RNA, 18 nt, Human
caucccggugaacagcuc

SEQ ID NO: 610331 - RNA, 19 nt, Human
cauuuccacucuucuggag

SEQ ID NO: 610332 - RNA, 22 nt, Human
ccaagcagccugugggaaaagc

SEQ ID NO: 610333 - RNA, 21 nt, Human
ccaauacccgcagguuacaga

SEQ ID NO: 610334 - RNA, 25 nt, Human
cccucaggguccaucccggugaaca

SEQ ID NO: 610335 - RNA, 21 nt, Human
ccgcagguuacagagcgaugg

SEQ ID NO: 610336 - RNA, 19 nt, Human
ccucccugagguguggaag

SEQ ID NO: 610337 - RNA, 20 nt, Human
ccugagacagaggguggaca

SEQ ID NO: 610338 - RNA, 21 nt, Human
ccugccaagcagccuguggga

SEQ ID NO: 610339 - RNA, 21 nt, Human
ccugugggaaaagcuucaaaa

SEQ ID NO: 610340 - RNA, 23 nt, Human
ccuucauccuaaaauuuuuaaaa

SEQ ID NO: 610341 - RNA, 23 nt, Human
cgccugcucuuuacagaguucua

SEQ ID NO: 610342 - RNA, 22 nt, Human
cucccugagguguggaagcagg

SEQ ID NO: 610343 - RNA, 20 nt, Human
cugaggcucuggcaaaauca

SEQ ID NO: 610344 - RNA, 19 nt, Human
cuggcaaaaucaccgaggc

SEQ ID NO: 610345 - RNA, 26 nt, Human
cugggcaggguccaggcauuuccacu

SEQ ID NO: 610346 - RNA, 21 nt, Human
gaacaccugcuccaagguagc

SEQ ID NO: 610347 - RNA, 25 nt, Human
gaaccaauacaccuuagcguuccug

SEQ ID NO: 610348 - RNA, 20 nt, Human
gaauucuauggccacauccc

SEQ ID NO: 610349 - RNA, 19 nt, Human
gagcagcaucuuugcccag

SEQ ID NO: 610350 - RNA, 20 nt, Human
gagcagcaucuuugcccagu

SEQ ID NO: 610351 - RNA, 18 nt, Human
ggaggcugaggcucuggc

SEQ ID NO: 610352 - RNA, 26 nt, Human
gucugaguuuguuaauuuugucugcu

SEQ ID NO: 610353 - RNA, 21 nt, Human
uaagaacaccugcuccaaggu

SEQ ID NO: 610354 - RNA, 18 nt, Human
uagaguuuucacgggagc

SEQ ID NO: 610355 - RNA, 22 nt, Human
uagguucuuucauuuuuauuuc

SEQ ID NO: 610356 - RNA, 20 nt, Human
ucccgugggagaaguuucca

SEQ ID NO: 610357 - RNA, 23 nt, Human
ucccugaauguuaaggguuccau

SEQ ID NO: 610358 - RNA, 20 nt, Human
ucccugagguguggaagcag

SEQ ID NO: 610359 - RNA, 21 nt, Human
uccuuucacggcugcauacaa

SEQ ID NO: 610360 - RNA, 20 nt, Human
ucuaagaacaccugcuccaa

SEQ ID NO: 610361 - RNA, 19 nt, Human
ucuuguagaauuauggaac

SEQ ID NO: 610362 - RNA, 22 nt, Human
ugauaauaaccaaaaacaaacc

SEQ ID NO: 610363 - RNA, 23 nt, Human
ugccuuuaauuugaaaaaggccu

SEQ ID NO: 610364 - RNA, 26 nt, Human
uggaggcugaggcucuggcaaaauca

SEQ ID NO: 610365 - RNA, 20 nt, Human
uggggaugaauaacaugucu

SEQ ID NO: 610366 - RNA, 20 nt, Human
uguuggggaugaauaacaug

SEQ ID NO: 610367 - RNA, 19 nt, Human
uucuccaacaucacaucuc

SEQ ID NO: 610368 - RNA, 19 nt, Human
uucuguaguucuccaacau

SEQ ID NO: 610369 - RNA, 22 nt, Human
uugaaggucuguuucacugccu

SEQ ID NO: 610370 - RNA, 30 nt, Human
uuucacggcugcauacaacuccaaaugcuu

SEQ ID NO: 610371 - RNA, 26 nt, Human
uuuccacucuucuggagagaauucua

SEQ ID NO: 610372 - RNA, 18 nt, Human
uuucccagcgccugcucu

SEQ ID NO: 610373 - RNA, 23 nt, Human
aaguggcuucggggaugaaauac

SEQ ID NO: 610374 - RNA, 28 nt, Human
aaugaugaaggaaaccgaaaaauuggaa

SEQ ID NO: 610375 - RNA, 25 nt, Human
gagaaugaugaaggaaaccgguacc

SEQ ID NO: 610376 - RNA, 24 nt, Human
uauguauucaaaauaagaaaagga

SEQ ID NO: 610377 - RNA, 20 nt, Human
uuaggauuuuauguagcuug

SEQ ID NO: 610378 - RNA, 20 nt, Human
uucaaaauaagaaaaggaaa

SEQ ID NO: 610379 - RNA, 25 nt, Human
uuggcugauaaaacuagaaaauaaa

SEQ ID NO: 610380 - RNA, 22 nt, Human
agagggaggagggugagggggc

SEQ ID NO: 610381 - RNA, 23 nt, Human
agagggaggagggugagggggcu

SEQ ID NO: 610382 - RNA, 22 nt, Human
agcgucgaucgcggugcagcgg

SEQ ID NO: 610383 - RNA, 18 nt, Human
aggaggagggagagggag

SEQ ID NO: 610384 - RNA, 22 nt, Human
aggagggugagggggcuggggu

SEQ ID NO: 610385 - RNA, 23 nt, Human
aggcagcgccgcugggggggcgg

SEQ ID NO: 610386 - RNA, 18 nt, Human
agggagagggaggagggu

SEQ ID NO: 610387 - RNA, 22 nt, Human
aguccgguggggaaggguuggg

SEQ ID NO: 610388 - RNA, 22 nt, Human
cagcgucgaucgcggugcagcg

SEQ ID NO: 610389 - RNA, 18 nt, Human
caguaguggagguugcag

SEQ ID NO: 610390 - RNA, 25 nt, Human
ccgccgccaccgccgcuggccccgg

SEQ ID NO: 610391 - RNA, 24 nt, Human
ccgccgccgccaccgccgcuggcc

SEQ ID NO: 610392 - RNA, 18 nt, Human
ccgccgccgccgccaccg

SEQ ID NO: 610393 - RNA, 22 nt, Human
ccgccgccgccgccaccgccgc

SEQ ID NO: 610394 - RNA, 22 nt, Human
ccucgccgccuccccuccucca

SEQ ID NO: 610395 - RNA, 21 nt, Human
cgccuccgccgccgccgccac

SEQ ID NO: 610396 - RNA, 22 nt, Human
cuccccuccuccaccgacgccu

SEQ ID NO: 610397 - RNA, 21 nt, Human
cuccgccgccgccgccaccgc

SEQ ID NO: 610398 - RNA, 19 nt, Human
cuccuccaccgacgccucc

SEQ ID NO: 610399 - RNA, 19 nt, Human
gagcaccggggaggcgagc

SEQ ID NO: 610400 - RNA, 21 nt, Human
gaggagggagagggaggaggg

SEQ ID NO: 610401 - RNA, 21 nt, Human
gaggagggugagggggcuggg

SEQ ID NO: 610402 - RNA, 19 nt, Human
gccaccgccgcuggccccg

SEQ ID NO: 610403 - RNA, 20 nt, Human
gcgagcucccggggcgggug

SEQ ID NO: 610404 - RNA, 20 nt, Human
gcggcgacggcaggugggga

SEQ ID NO: 610405 - RNA, 22 nt, Human
ggagagggaggagggugagggg

SEQ ID NO: 610406 - RNA, 22 nt, Human
ggaggagggagagggaggaggg

SEQ ID NO: 610407 - RNA, 26 nt, Human
ggagggagagggaggagggugagggg

SEQ ID NO: 610408 - RNA, 22 nt, Human
ggcgacggcagguggggaggga

SEQ ID NO: 610409 - RNA, 23 nt, Human
gggaggagggugagggggcuggg

SEQ ID NO: 610410 - RNA, 23 nt, Human
ggggagggcgggggagcaccggg

SEQ ID NO: 610411 - RNA, 19 nt, Human
ggggcggggagggcggggg

SEQ ID NO: 610412 - RNA, 18 nt, Human
ggugagggggcuggggug

SEQ ID NO: 610413 - RNA, 22 nt, Human
ggugcagcgggagcugcgccuc

SEQ ID NO: 610414 - RNA, 25 nt, Human
uaaauaaauacacaguccggugggg

SEQ ID NO: 610415 - RNA, 19 nt, Human
ucgccgccuccccuccucc

SEQ ID NO: 610416 - RNA, 18 nt, Human
uggggagggaggaggagg

SEQ ID NO: 610417 - RNA, 22 nt, Human
uggggagggaggaggagggaga

SEQ ID NO: 610418 - RNA, 25 nt, Human
uggggagggaggaggagggagaggg

SEQ ID NO: 610419 - RNA, 18 nt, Human
ugggggggcggggagggc

SEQ ID NO: 610420 - RNA, 23 nt, Human
aaaccacaggcaaagcugacuua

SEQ ID NO: 610421 - RNA, 19 nt, Human
aaaucccccaucuacuuuc

SEQ ID NO: 610422 - RNA, 24 nt, Human
aaauugcugggauuacaggcauga

SEQ ID NO: 610423 - RNA, 19 nt, Human
aacagagugacgucauaga

SEQ ID NO: 610424 - RNA, 21 nt, Human
aacaucuucacagccacuuug

SEQ ID NO: 610425 - RNA, 22 nt, Human
aaccacaggcaaagcugacuua

SEQ ID NO: 610426 - RNA, 22 nt, Human
aagcagaccaaaugcaccucuu

SEQ ID NO: 610427 - RNA, 18 nt, Human
aagcagcaagccccaccc

SEQ ID NO: 610428 - RNA, 24 nt, Human
aagcccuggccccgcagucaccag

SEQ ID NO: 610429 - RNA, 18 nt, Human
aagccugcugcggcugcc

SEQ ID NO: 610430 - RNA, 20 nt, Human
aagcucuucucugagcugag

SEQ ID NO: 610431 - RNA, 27 nt, Human
aaggcaacucaguucaccuguccaggc

SEQ ID NO: 610432 - RNA, 20 nt, Human
aaggugcugggauuacaggc

SEQ ID NO: 610433 - RNA, 24 nt, Human
aaggugcugggauuacaggcguga

SEQ ID NO: 610434 - RNA, 18 nt, Human
aagugauccacccgccuc

SEQ ID NO: 610435 - RNA, 24 nt, Human
acacccccuccacucccagguaac

SEQ ID NO: 610436 - RNA, 19 nt, Human
acaguucucuucucuaccc

SEQ ID NO: 610437 - RNA, 20 nt, Human
accagagaagcuguucugcu

SEQ ID NO: 610438 - RNA, 18 nt, Human
accccccaccccauugcc

SEQ ID NO: 610439 - RNA, 24 nt, Human
accgcaaccuccgccucccguguu

SEQ ID NO: 610440 - RNA, 20 nt, Human
acgccaaggaacagagugac

SEQ ID NO: 610441 - RNA, 20 nt, Human
acuugauucucuccucccca

SEQ ID NO: 610442 - RNA, 22 nt, Human
acuuuuuguauuuuuaguagag

SEQ ID NO: 610443 - RNA, 23 nt, Human
agaagaaccccagaguucaugga

SEQ ID NO: 610444 - RNA, 23 nt, Human
agagacggcagcaggcaaacagg

SEQ ID NO: 610445 - RNA, 26 nt, Human
agaggcagguguacgggugggaggcc

SEQ ID NO: 610446 - RNA, 21 nt, Human
agaguucauggaugcacugga

SEQ ID NO: 610447 - RNA, 21 nt, Human
agcaaggaagggggacggggu

SEQ ID NO: 610448 - RNA, 24 nt, Human
agcagaaaguggaaugaagggacc

SEQ ID NO: 610449 - RNA, 20 nt, Human
agcagaggcagguguacggg

SEQ ID NO: 610450 - RNA, 18 nt, Human
agcaggcuuggagggccc

SEQ ID NO: 610451 - RNA, 22 nt, Human
agccagaaaauaaggcccaaag

SEQ ID NO: 610452 - RNA, 18 nt, Human
aggaaagccugcaagcga

SEQ ID NO: 610453 - RNA, 18 nt, Human
aggauaaacaccugacca

SEQ ID NO: 610454 - RNA, 22 nt, Human
aggcaccccaucuccaccucuc

SEQ ID NO: 610455 - RNA, 23 nt, Human
aggcgugagccacugugccuggc

SEQ ID NO: 610456 - RNA, 19 nt, Human
agggauggccuagaaccau

SEQ ID NO: 610457 - RNA, 22 nt, Human
agggcccuaucugagacuuuuc

SEQ ID NO: 610458 - RNA, 24 nt, Human
aguacaauggcgugaucuuggcuc

SEQ ID NO: 610459 - RNA, 22 nt, Human
aguagagaugggguuucaccau

SEQ ID NO: 610460 - RNA, 21 nt, Human
aguagcuggaauuacaggcau

SEQ ID NO: 610461 - RNA, 21 nt, Human
aguagcugggauuauaggcau

SEQ ID NO: 610462 - RNA, 20 nt, Human
agugcaauggcgcgaucucg

SEQ ID NO: 610463 - RNA, 20 nt, Human
auaaacaccugaccacaacc

SEQ ID NO: 610464 - RNA, 20 nt, Human
auccaggauaaacaccugac

SEQ ID NO: 610465 - RNA, 20 nt, Human
aucgugaagccugcugcggc

SEQ ID NO: 610466 - RNA, 22 nt, Human
aucgugaagccugcugcggcug

SEQ ID NO: 610467 - RNA, 22 nt, Human
aucgugcuacacaagccccauc

SEQ ID NO: 610468 - RNA, 19 nt, Human
auggaacacgcuuugcccc

SEQ ID NO: 610469 - RNA, 20 nt, Human
auggauccaggauaaacacc

SEQ ID NO: 610470 - RNA, 18 nt, Human
auggcccuucucugcaaa

SEQ ID NO: 610471 - RNA, 24 nt, Human
augggguuucaccauuuugaccag

SEQ ID NO: 610472 - RNA, 20 nt, Human
caaaccacaggcaaagcuga

SEQ ID NO: 610473 - RNA, 22 nt, Human
caaagcugacuuaauuuccaaa

SEQ ID NO: 610474 - RNA, 23 nt, Human
caaccuccaccucccggguucaa

SEQ ID NO: 610475 - RNA, 21 nt, Human
caacucaguucaccuguccag

SEQ ID NO: 610476 - RNA, 21 nt, Human
caagcagcaagccccaccccu

SEQ ID NO: 610477 - RNA, 22 nt, Human
caagugauccacccgccucacc

SEQ ID NO: 610478 - RNA, 22 nt, Human
caagugaucuuccugccucggc

SEQ ID NO: 610479 - RNA, 22 nt, Human
cacaagccccaucuucauuaau

SEQ ID NO: 610480 - RNA, 23 nt, Human
cacacaccugugccaucuguacc

SEQ ID NO: 610481 - RNA, 22 nt, Human
caccaccugcccaaagcagccc

SEQ ID NO: 610482 - RNA, 21 nt, Human
caccagagaagcuguucugcu

SEQ ID NO: 610483 - RNA, 18 nt, Human
cacccaaaucucaucuug

SEQ ID NO: 610484 - RNA, 20 nt, Human
caccccccaccccauugcca

SEQ ID NO: 610485 - RNA, 21 nt, Human
caccccccaccccauugccac

SEQ ID NO: 610486 - RNA, 22 nt, Human
caccccccaccccauugccaca

SEQ ID NO: 610487 - RNA, 20 nt, Human
caccuguuggccaggcuggu

SEQ ID NO: 610488 - RNA, 23 nt, Human
caccuguuggccaggcuggucuc

SEQ ID NO: 610489 - RNA, 21 nt, Human
cacugcaaccuccaccucccg

SEQ ID NO: 610490 - RNA, 23 nt, Human
cacugcaaccuccaccucccggg

SEQ ID NO: 610491 - RNA, 19 nt, Human
cacugcacccagccugagc

SEQ ID NO: 610492 - RNA, 23 nt, Human
cacugcacccagccugagcgcuc

SEQ ID NO: 610493 - RNA, 22 nt, Human
cagauguuucugaguccucugu

SEQ ID NO: 610494 - RNA, 22 nt, Human
cagcaagccccaccccugggcu

SEQ ID NO: 610495 - RNA, 22 nt, Human
cagcagcaagcccuggccccgc

SEQ ID NO: 610496 - RNA, 20 nt, Human
cagcaggcaaacaggauaca

SEQ ID NO: 610497 - RNA, 22 nt, Human
cagcagugugaaaauggacuaa

SEQ ID NO: 610498 - RNA, 20 nt, Human
cagccuccugaguagcuggg

SEQ ID NO: 610499 - RNA, 26 nt, Human
cagcggagcaggugugggcagcaaag

SEQ ID NO: 610500 - RNA, 26 nt, Human
cagcucccagcgagggucuucgggaa

SEQ ID NO: 610501 - RNA, 18 nt, Human
caggagggugggcugcuc

SEQ ID NO: 610502 - RNA, 22 nt, Human
caggcacccagggauccugcaa

SEQ ID NO: 610503 - RNA, 18 nt, Human
caggguguuagcaggcuu

SEQ ID NO: 610504 - RNA, 26 nt, Human
cagguaaccccaagcaggcagcggag

SEQ ID NO: 610505 - RNA, 19 nt, Human
caguacaggagggugggcu

SEQ ID NO: 610506 - RNA, 19 nt, Human
cagucaccagccaccaccc

SEQ ID NO: 610507 - RNA, 19 nt, Human
cauuucaugaaccuucacc

SEQ ID NO: 610508 - RNA, 24 nt, Human
cauuuuauaacugaucauugcagu

SEQ ID NO: 610509 - RNA, 26 nt, Human
ccaaagcuauaaauuagggacaaugg

SEQ ID NO: 610510 - RNA, 23 nt, Human
ccaaauugcugggauuacaggca

SEQ ID NO: 610511 - RNA, 24 nt, Human
ccaaauugcugggauuacaggcau

SEQ ID NO: 610512 - RNA, 18 nt, Human
ccaaggacggaaggagcc

SEQ ID NO: 610513 - RNA, 20 nt, Human
ccaaggugcugggauuacag

SEQ ID NO: 610514 - RNA, 22 nt, Human
ccaaggugcugggauuacaggc

SEQ ID NO: 610515 - RNA, 22 nt, Human
ccaaggugcugggauuacaggc

SEQ ID NO: 610516 - RNA, 24 nt, Human
ccaaggugcugggauuacaggcgu

SEQ ID NO: 610517 - RNA, 23 nt, Human
ccacucccagguaaccccaagca

SEQ ID NO: 610518 - RNA, 19 nt, Human
ccacugcacccagccugag

SEQ ID NO: 610519 - RNA, 19 nt, Human
ccacugcacccagccugag

SEQ ID NO: 610520 - RNA, 20 nt, Human
ccacugcacccagccugagc

SEQ ID NO: 610521 - RNA, 21 nt, Human
ccacugugccuggccuauuua

SEQ ID NO: 610522 - RNA, 23 nt, Human
ccagaaaauaaggcccaaagcua

SEQ ID NO: 610523 - RNA, 20 nt, Human
ccagcccgauagccucugcc

SEQ ID NO: 610524 - RNA, 20 nt, Human
ccaggcuggucuccaacucc

SEQ ID NO: 610525 - RNA, 18 nt, Human
ccauaauuacucagcugc

SEQ ID NO: 610526 - RNA, 18 nt, Human
cccaaagcagcccucucc

SEQ ID NO: 610527 - RNA, 24 nt, Human
cccaaauugcugggauuacaggca

SEQ ID NO: 610528 - RNA, 19 nt, Human
cccaagcuggaguacaaug

SEQ ID NO: 610529 - RNA, 19 nt, Human
cccaaggacggaaggagcc

SEQ ID NO: 610530 - RNA, 26 nt, Human
ccccaccccauugccacagcagcuaa

SEQ ID NO: 610531 - RNA, 27 nt, Human
ccccaccccugggcugagcacuugaga

SEQ ID NO: 610532 - RNA, 23 nt, Human
cccgaguagcuggaauuacaggc

SEQ ID NO: 610533 - RNA, 21 nt, Human
cccgcagucaccagccaccac

SEQ ID NO: 610534 - RNA, 19 nt, Human
cccugggcugagcacuuga

SEQ ID NO: 610535 - RNA, 19 nt, Human
cccuguacaagcucucuuc

SEQ ID NO: 610536 - RNA, 24 nt, Human
ccgaguagcuggaauuacaggcau

SEQ ID NO: 610537 - RNA, 24 nt, Human
ccgcaaccuccgccucccguguuc

SEQ ID NO: 610538 - RNA, 24 nt, Human
ccgccucacccucccaaggugcug

SEQ ID NO: 610539 - RNA, 24 nt, Human
ccucccguguucaaacgauucucc

SEQ ID NO: 610540 - RNA, 18 nt, Human
ccucucuuaacccccuuc

SEQ ID NO: 610541 - RNA, 22 nt, Human
ccugaccucaagugauccaccc

SEQ ID NO: 610542 - RNA, 26 nt, Human
ccugaccucaagugauccacccgccu

SEQ ID NO: 610543 - RNA, 23 nt, Human
ccugaguagcugggauuauaggc

SEQ ID NO: 610544 - RNA, 24 nt, Human
ccugaguagcugggauuauaggca

SEQ ID NO: 610545 - RNA, 23 nt, Human
ccugaucucaagugaucuuccug

SEQ ID NO: 610546 - RNA, 20 nt, Human
ccuguacaagcucucuucuc

SEQ ID NO: 610547 - RNA, 19 nt, Human
ccugucuccuguccccugg

SEQ ID NO: 610548 - RNA, 20 nt, Human
ccuuccacaggccuccuccc

SEQ ID NO: 610549 - RNA, 19 nt, Human
ccuugggacugauacccca

SEQ ID NO: 610550 - RNA, 18 nt, Human
cgugaagccugcugcggc

SEQ ID NO: 610551 - RNA, 20 nt, Human
cguugcccaagcuggagugc

SEQ ID NO: 610552 - RNA, 18 nt, Human
cuagaaccaucgugcuac

SEQ ID NO: 610553 - RNA, 24 nt, Human
cucaagugaucuuccugccucggc

SEQ ID NO: 610554 - RNA, 24 nt, Human
cucacugcaaccuccaccucccgg

SEQ ID NO: 610555 - RNA, 21 nt, Human
cuccccacuucauccaaacug

SEQ ID NO: 610556 - RNA, 21 nt, Human
cuccuccccacuucauccaaa

SEQ ID NO: 610557 - RNA, 18 nt, Human
cucguugcccaagcugga

SEQ ID NO: 610558 - RNA, 19 nt, Human
cucucuguauuucacccaa

SEQ ID NO: 610559 - RNA, 19 nt, Human
cucugugccuugcccagaa

SEQ ID NO: 610560 - RNA, 26 nt, Human
cucuuagaccauaauuacucagcugg

SEQ ID NO: 610561 - RNA, 24 nt, Human
cugaguagcugggauuauaggcau

SEQ ID NO: 610562 - RNA, 18 nt, Human
cugcaaccuccaccuccc

SEQ ID NO: 610563 - RNA, 23 nt, Human
cugcaaccuccaccucccggguu

SEQ ID NO: 610564 - RNA, 25 nt, Human
cugcaggcuccuuccucccuggcuc

SEQ ID NO: 610565 - RNA, 23 nt, Human
cugccacagccucccgaguagcu

SEQ ID NO: 610566 - RNA, 19 nt, Human
cugccucggccucccaaau

SEQ ID NO: 610567 - RNA, 20 nt, Human
cugcucuuugcaagcagcaa

SEQ ID NO: 610568 - RNA, 18 nt, Human
cugugucaucucuguagg

SEQ ID NO: 610569 - RNA, 21 nt, Human
cuuacacuucaacaucuucac

SEQ ID NO: 610570 - RNA, 21 nt, Human
cuuugcaaggacagaagcauc

SEQ ID NO: 610571 - RNA, 21 nt, Human
cuuuuguauuuuuuaguagag

SEQ ID NO: 610572 - RNA, 24 nt, Human
cuuuuuguauuuuuaguagagaug

SEQ ID NO: 610573 - RNA, 21 nt, Human
gaacacccccuccacucccag

SEQ ID NO: 610574 - RNA, 21 nt, Human
gaaggagccugcccuggagga

SEQ ID NO: 610575 - RNA, 26 nt, Human
gaccauaauuacucagcugccucugg

SEQ ID NO: 610576 - RNA, 24 nt, Human
gaccucaagugauccacccgccuc

SEQ ID NO: 610577 - RNA, 20 nt, Human
gacugggauuguggcacuag

SEQ ID NO: 610578 - RNA, 19 nt, Human
gagaagagguguagggccc

SEQ ID NO: 610579 - RNA, 18 nt, Human
gagaugggguuucaccau

SEQ ID NO: 610580 - RNA, 23 nt, Human
gagaugggguuucaccuguuggc

SEQ ID NO: 610581 - RNA, 23 nt, Human
gagcagaggcagguguacgggug

SEQ ID NO: 610582 - RNA, 24 nt, Human
gaguagcuggaauuacaggcaugc

SEQ ID NO: 610583 - RNA, 22 nt, Human
gaguagcugggauuauaggcau

SEQ ID NO: 610584 - RNA, 24 nt, Human
gaguagcugggauuauaggcaugc

SEQ ID NO: 610585 - RNA, 18 nt, Human
gaguaucucccaagcugg

SEQ ID NO: 610586 - RNA, 24 nt, Human
gaucucaagugaucuuccugccuc

SEQ ID NO: 610587 - RNA, 24 nt, Human
gaugggguuucaccuguuggccag

SEQ ID NO: 610588 - RNA, 18 nt, Human
gauuacaggcaugagcca

SEQ ID NO: 610589 - RNA, 22 nt, Human
gauuacaggcaugagccacugc

SEQ ID NO: 610590 - RNA, 23 nt, Human
gauuacaggcaugagccacugca

SEQ ID NO: 610591 - RNA, 18 nt, Human
gauuacaggcgugagcca

SEQ ID NO: 610592 - RNA, 21 nt, Human
gauuacaggcgugagccacug

SEQ ID NO: 610593 - RNA, 24 nt, Human
gauuacaggcgugagccacugugc

SEQ ID NO: 610594 - RNA, 19 nt, Human
gauucagcccucaaagcug

SEQ ID NO: 610595 - RNA, 22 nt, Human
gcaaccuccaccucccggguuc

SEQ ID NO: 610596 - RNA, 22 nt, Human
gcaccagagaagcuguucugcu

SEQ ID NO: 610597 - RNA, 27 nt, Human
gcaguacaggagggugggcugcucuuu

SEQ ID NO: 610598 - RNA, 21 nt, Human
gccacugcacccagccugagc

SEQ ID NO: 610599 - RNA, 18 nt, Human
gccgaaccagaagaaccc

SEQ ID NO: 610600 - RNA, 23 nt, Human
gccucacccucccaaggugcugg

SEQ ID NO: 610601 - RNA, 20 nt, Human
gcgucagccuccugaguagc

SEQ ID NO: 610602 - RNA, 22 nt, Human
gcgucagccuccugaguagcug

SEQ ID NO: 610603 - RNA, 21 nt, Human
gcucagcuggacuggagaggu

SEQ ID NO: 610604 - RNA, 19 nt, Human
gcucguugcccaagcugga

SEQ ID NO: 610605 - RNA, 18 nt, Human
gcugcacauucuguccaa

SEQ ID NO: 610606 - RNA, 19 nt, Human
gcuggagugcaauggcgcg

SEQ ID NO: 610607 - RNA, 23 nt, Human
gcuggucuccaacuccugaccuc

SEQ ID NO: 610608 - RNA, 24 nt, Human
ggaaagccagucuggccggcaccc

SEQ ID NO: 610609 - RNA, 18 nt, Human
ggacugggauuguggcac

SEQ ID NO: 610610 - RNA, 21 nt, Human
ggacuucacucaccuuuaaaa

SEQ ID NO: 610611 - RNA, 29 nt, Human
ggaggacuugcagugugauauggagggug

SEQ ID NO: 610612 - RNA, 19 nt, Human
ggaggagucgggcugcagg

SEQ ID NO: 610613 - RNA, 22 nt, Human
ggauuacaggcaugagccacug

SEQ ID NO: 610614 - RNA, 22 nt, Human
ggcaggauaaaggcuaagggag

SEQ ID NO: 610615 - RNA, 23 nt, Human
ggcagguguacgggugggaggcc

SEQ ID NO: 610616 - RNA, 24 nt, Human
ggcccagagagagagguggugcug

SEQ ID NO: 610617 - RNA, 22 nt, Human
ggccgaaccagaagaaccccag

SEQ ID NO: 610618 - RNA, 22 nt, Human
ggcgaggucaucacugcuggcc

SEQ ID NO: 610619 - RNA, 24 nt, Human
ggcuggucuccaacuccugaccuc

SEQ ID NO: 610620 - RNA, 23 nt, Human
gggaggcugcuggacccaaggac

SEQ ID NO: 610621 - RNA, 20 nt, Human
gggcagggauguggugagga

SEQ ID NO: 610622 - RNA, 19 nt, Human
gggcuacacuagcuugaaa

SEQ ID NO: 610623 - RNA, 22 nt, Human
gggguuucaccauuuugaccag

SEQ ID NO: 610624 - RNA, 21 nt, Human
gggguuucaccuguuggccag

SEQ ID NO: 610625 - RNA, 21 nt, Human
ggguuucaccuguuggccagg

SEQ ID NO: 610626 - RNA, 20 nt, Human
ggucucgaacuccugaucuc

SEQ ID NO: 610627 - RNA, 18 nt, Human
ggugcugggauuacaggc

SEQ ID NO: 610628 - RNA, 18 nt, Human
guagcugggauuauaggc

SEQ ID NO: 610629 - RNA, 20 nt, Human
guagcugggauuauaggcau

SEQ ID NO: 610630 - RNA, 20 nt, Human
guauuuuuuaguagagaugg

SEQ ID NO: 610631 - RNA, 19 nt, Human
guccaugcgaggucccgcu

SEQ ID NO: 610632 - RNA, 19 nt, Human
guccauuaaaccucuuucu

SEQ ID NO: 610633 - RNA, 20 nt, Human
gucuuggguaugucuuucuc

SEQ ID NO: 610634 - RNA, 24 nt, Human
gugaauaaaucucacgagaucuga

SEQ ID NO: 610635 - RNA, 24 nt, Human
gugauccacccgccucacccuccc

SEQ ID NO: 610636 - RNA, 21 nt, Human
gugcugggauuacaggcguga

SEQ ID NO: 610637 - RNA, 20 nt, Human
guggcggcagggggcggagu

SEQ ID NO: 610638 - RNA, 18 nt, Human
gugggcagcaaaggcacc

SEQ ID NO: 610639 - RNA, 19 nt, Human
uaaaccucugccaaagcag

SEQ ID NO: 610640 - RNA, 21 nt, Human
uaacaugcggggacacagaug

SEQ ID NO: 610641 - RNA, 19 nt, Human
uaaccccaagcaggcagcg

SEQ ID NO: 610642 - RNA, 21 nt, Human
uaaccgcaaccuccgccuccc

SEQ ID NO: 610643 - RNA, 25 nt, Human
uaacuuuuguauuuuuuaguagaga

SEQ ID NO: 610644 - RNA, 18 nt, Human
uaaggcccaaagcuauaa

SEQ ID NO: 610645 - RNA, 19 nt, Human
uaagggagugggguaugug

SEQ ID NO: 610646 - RNA, 24 nt, Human
uacaggcaugagccacugcaccca

SEQ ID NO: 610647 - RNA, 23 nt, Human
uacaggcaugcgccaccacgccc

SEQ ID NO: 610648 - RNA, 22 nt, Human
uacaggcgugagccacugugcc

SEQ ID NO: 610649 - RNA, 23 nt, Human
uacaggcgugagccacugugccu

SEQ ID NO: 610650 - RNA, 19 nt, Human
uacauggacaucgugaagc

SEQ ID NO: 610651 - RNA, 24 nt, Human
uacuuuuuguauuuuuaguagaga

SEQ ID NO: 610652 - RNA, 18 nt, Human
uagaauagcaagcaagga

SEQ ID NO: 610653 - RNA, 21 nt, Human
uagaauagcaagcaaggaaug

SEQ ID NO: 610654 - RNA, 20 nt, Human
uagacgaugaccgaccccac

SEQ ID NO: 610655 - RNA, 19 nt, Human
uagacgaugaccgaccccc

SEQ ID NO: 610656 - RNA, 23 nt, Human
uagcuuauggauuccuaacuccc

SEQ ID NO: 610657 - RNA, 19 nt, Human
uaguagagaugggguuuca

SEQ ID NO: 610658 - RNA, 21 nt, Human
uaguagagaugggguuucacc

SEQ ID NO: 610659 - RNA, 23 nt, Human
uaguagagaugggguuucaccau

SEQ ID NO: 610660 - RNA, 23 nt, Human
uaguagagaugggguuucaccug

SEQ ID NO: 610661 - RNA, 22 nt, Human
uaguauacacaccuuccaccac

SEQ ID NO: 610662 - RNA, 24 nt, Human
uaugcgucagccuccugaguagcu

SEQ ID NO: 610663 - RNA, 19 nt, Human
uauuccucugugccuugcc

SEQ ID NO: 610664 - RNA, 19 nt, Human
ucaccccccaccccauugc

SEQ ID NO: 610665 - RNA, 23 nt, Human
ucacugcaaccuccaccucccgg

SEQ ID NO: 610666 - RNA, 24 nt, Human
ucacugcaaccuccaccucccggg

SEQ ID NO: 610667 - RNA, 25 nt, Human
ucacugcaaccuccaccucccgggu

SEQ ID NO: 610668 - RNA, 26 nt, Human
ucacugcaaccuccaccucccggguu

SEQ ID NO: 610669 - RNA, 19 nt, Human
ucagcagugugaaaaugga

SEQ ID NO: 610670 - RNA, 18 nt, Human
ucagcccucaaagcuggg

SEQ ID NO: 610671 - RNA, 20 nt, Human
ucagcccucaaagcuggggc

SEQ ID NO: 610672 - RNA, 20 nt, Human
ucagccuccugaguagcugg

SEQ ID NO: 610673 - RNA, 19 nt, Human
ucaguacccagcggagggg

SEQ ID NO: 610674 - RNA, 22 nt, Human
ucauacucagagaccccugcuu

SEQ ID NO: 610675 - RNA, 22 nt, Human
uccaaagaccaugguaggccag

SEQ ID NO: 610676 - RNA, 24 nt, Human
uccagaaugagcacaggcuucuga

SEQ ID NO: 610677 - RNA, 22 nt, Human
uccaugucccaggaguccggag

SEQ ID NO: 610678 - RNA, 25 nt, Human
uccaugucccaggaguccggaggac

SEQ ID NO: 610679 - RNA, 24 nt, Human
ucccaaauugcugggauuacaggc

SEQ ID NO: 610680 - RNA, 22 nt, Human
ucccaagcuggaguacaauggc

SEQ ID NO: 610681 - RNA, 24 nt, Human
ucccaaggugcugggauuacaggc

SEQ ID NO: 610682 - RNA, 23 nt, Human
ucccagggguuugccuaagaccc

SEQ ID NO: 610683 - RNA, 25 nt, Human
uccccacccaaaucucaucuugaau

SEQ ID NO: 610684 - RNA, 24 nt, Human
ucccgaguagcuggaauuacaggc

SEQ ID NO: 610685 - RNA, 19 nt, Human
ucccggguucaagcaaguc

SEQ ID NO: 610686 - RNA, 20 nt, Human
ucccggguucaagcaagucu

SEQ ID NO: 610687 - RNA, 21 nt, Human
ucccguguucaaacgauucuc

SEQ ID NO: 610688 - RNA, 24 nt, Human
ucccguguucaaacgauucuccug

SEQ ID NO: 610689 - RNA, 19 nt, Human
ucccuaagaagacacgggg

SEQ ID NO: 610690 - RNA, 18 nt, Human
uccugagccuccuugcuc

SEQ ID NO: 610691 - RNA, 24 nt, Human
uccugaguagcugggauuauaggc

SEQ ID NO: 610692 - RNA, 21 nt, Human
ucgugaagccugcugcggcug

SEQ ID NO: 610693 - RNA, 20 nt, Human
ucuccuguccccugggaacu

SEQ ID NO: 610694 - RNA, 23 nt, Human
ucuccuguccccugggaacuuuu

SEQ ID NO: 610695 - RNA, 21 nt, Human
ucucgaacuccugaucucaag

SEQ ID NO: 610696 - RNA, 21 nt, Human
ucucuucucgucugccgccau

SEQ ID NO: 610697 - RNA, 19 nt, Human
ucugcaauugugaggccuc

SEQ ID NO: 610698 - RNA, 19 nt, Human
ucugccaacaccaccugcc

SEQ ID NO: 610699 - RNA, 21 nt, Human
ucuggacuucacucaccuuua

SEQ ID NO: 610700 - RNA, 23 nt, Human
ucuuucgggggaaacagagagug

SEQ ID NO: 610701 - RNA, 18 nt, Human
ucuuugcaagcagcaagc

SEQ ID NO: 610702 - RNA, 18 nt, Human
ugaaccuucaccgcccag

SEQ ID NO: 610703 - RNA, 18 nt, Human
ugacagaggacaggaggg

SEQ ID NO: 610704 - RNA, 24 nt, Human
ugaccagacuggucucgaacuccu

SEQ ID NO: 610705 - RNA, 24 nt, Human
ugaccucaagugauccacccgccu

SEQ ID NO: 610706 - RNA, 25 nt, Human
ugacucaugggggcaggucuucccu

SEQ ID NO: 610707 - RNA, 23 nt, Human
ugaucucaagugaucuuccugcc

SEQ ID NO: 610708 - RNA, 24 nt, Human
ugaucucaagugaucuuccugccu

SEQ ID NO: 610709 - RNA, 19 nt, Human
ugaugacagaggacaggag

SEQ ID NO: 610710 - RNA, 24 nt, Human
ugcaaaacuagggaagcucuucuc

SEQ ID NO: 610711 - RNA, 23 nt, Human
ugcaggguaaacccagaucccgg

SEQ ID NO: 610712 - RNA, 23 nt, Human
ugccacagcagcuaagccaguuc

SEQ ID NO: 610713 - RNA, 24 nt, Human
ugccacagccucccgaguagcugg

SEQ ID NO: 610714 - RNA, 23 nt, Human
ugcccaaagcagcccucucccag

SEQ ID NO: 610715 - RNA, 21 nt, Human
ugcccaagcuggagugcaaug

SEQ ID NO: 610716 - RNA, 21 nt, Human
ugccucggccucccaaauugc

SEQ ID NO: 610717 - RNA, 24 nt, Human
ugccucggccucccaaauugcugg

SEQ ID NO: 610718 - RNA, 23 nt, Human
ugcgccugcaaaacuagggaagc

SEQ ID NO: 610719 - RNA, 24 nt, Human
ugcgucagccuccugaguagcugg

SEQ ID NO: 610720 - RNA, 20 nt, Human
ugcgugcaggcccccagcag

SEQ ID NO: 610721 - RNA, 21 nt, Human
ugcgugcaggcccccagcagg

SEQ ID NO: 610722 - RNA, 21 nt, Human
ugcucagcuggacuggagagg

SEQ ID NO: 610723 - RNA, 23 nt, Human
ugcucguugcccaagcuggagug

SEQ ID NO: 610724 - RNA, 20 nt, Human
ugcugggauuacaggcauga

SEQ ID NO: 610725 - RNA, 24 nt, Human
ugcugggauuacaggcgugagcca

SEQ ID NO: 610726 - RNA, 22 nt, Human
ugcugggcccgaggccugcugu

SEQ ID NO: 610727 - RNA, 21 nt, Human
uggaauuacaggcaugcgcca

SEQ ID NO: 610728 - RNA, 22 nt, Human
uggaauuacaggcaugcgccac

SEQ ID NO: 610729 - RNA, 24 nt, Human
uggaauuacaggcaugcgccacca

SEQ ID NO: 610730 - RNA, 19 nt, Human
uggaguacaauggcgugau

SEQ ID NO: 610731 - RNA, 23 nt, Human
uggaguacaauggcgugaucuug

SEQ ID NO: 610732 - RNA, 24 nt, Human
uggaguacaauggcgugaucuugg

SEQ ID NO: 610733 - RNA, 23 nt, Human
uggagugcaauggcgcgaucucg

SEQ ID NO: 610734 - RNA, 24 nt, Human
uggagugcaauggcgcgaucucgg

SEQ ID NO: 610735 - RNA, 22 nt, Human
uggcaaguucuagcuaggacug

SEQ ID NO: 610736 - RNA, 24 nt, Human
uggccaggcuggucuccaacuccu

SEQ ID NO: 610737 - RNA, 20 nt, Human
ugggaagggaggagggcagg

SEQ ID NO: 610738 - RNA, 21 nt, Human
ugggaagggaggagggcagga

SEQ ID NO: 610739 - RNA, 20 nt, Human
ugggacaagauuuucuuugc

SEQ ID NO: 610740 - RNA, 19 nt, Human
ugggagaggagagacggca

SEQ ID NO: 610741 - RNA, 25 nt, Human
ugggagccguuguugcaauaggugg

SEQ ID NO: 610742 - RNA, 23 nt, Human
ugggaggccuccgugcgccugcc

SEQ ID NO: 610743 - RNA, 19 nt, Human
ugggauuacaggcaugagc

SEQ ID NO: 610744 - RNA, 21 nt, Human
ugggauuacaggcaugagcca

SEQ ID NO: 610745 - RNA, 22 nt, Human
ugggauuacaggcaugagccac

SEQ ID NO: 610746 - RNA, 22 nt, Human
ugggauuacaggcaugagccac

SEQ ID NO: 610747 - RNA, 24 nt, Human
ugggauuacaggcaugagccacug

SEQ ID NO: 610748 - RNA, 26 nt, Human
ugggauuacaggcaugagccacugca

SEQ ID NO: 610749 - RNA, 21 nt, Human
ugggauuacaggcgugagcca

SEQ ID NO: 610750 - RNA, 22 nt, Human
ugggauuacaggcgugagccac

SEQ ID NO: 610751 - RNA, 22 nt, Human
ugggauuacaggcgugagccac

SEQ ID NO: 610752 - RNA, 22 nt, Human
ugggauuacaggcgugagccac

SEQ ID NO: 610753 - RNA, 23 nt, Human
ugggauuacaggcgugagccacu

SEQ ID NO: 610754 - RNA, 24 nt, Human
ugggauuacaggcgugagccacug

SEQ ID NO: 610755 - RNA, 18 nt, Human
ugggauuauaggcaugcg

SEQ ID NO: 610756 - RNA, 20 nt, Human
ugggauuauaggcaugcgug

SEQ ID NO: 610757 - RNA, 24 nt, Human
ugggauuauaggcaugcgugacca

SEQ ID NO: 610758 - RNA, 24 nt, Human
ugggcugcucuuugcaagcagcaa

SEQ ID NO: 610759 - RNA, 18 nt, Human
ugggguuucaccauuuug

SEQ ID NO: 610760 - RNA, 23 nt, Human
ugggguuucaccuguuggccagg

SEQ ID NO: 610761 - RNA, 18 nt, Human
uggugaggaaagccugca

SEQ ID NO: 610762 - RNA, 21 nt, Human
uguauuuuuaguagagauggg

SEQ ID NO: 610763 - RNA, 23 nt, Human
ugucccgaggcagcucccagcga

SEQ ID NO: 610764 - RNA, 23 nt, Human
ugucuguguaucugauguucuuu

SEQ ID NO: 610765 - RNA, 26 nt, Human
ugugcacagccaucuggcuguggaag

SEQ ID NO: 610766 - RNA, 24 nt, Human
uuagaggcccagagagagaggugg

SEQ ID NO: 610767 - RNA, 18 nt, Human
uuaguagagaugggguuu

SEQ ID NO: 610768 - RNA, 22 nt, Human
uuaguagagaugggguuucacc

SEQ ID NO: 610769 - RNA, 22 nt, Human
uuaguagagaugggguuucacc

SEQ ID NO: 610770 - RNA, 24 nt, Human
uuaguagagaugggguuucaccau

SEQ ID NO: 610771 - RNA, 23 nt, Human
uuaguagagaugggguuucaccu

SEQ ID NO: 610772 - RNA, 25 nt, Human
uuaguagagaugggguuucaccugu

SEQ ID NO: 610773 - RNA, 19 nt, Human
uucaaacgauucuccugcc

SEQ ID NO: 610774 - RNA, 25 nt, Human
uucaaauucuacucauaggccccaa

SEQ ID NO: 610775 - RNA, 18 nt, Human
uucaagcaagucuuaugc

SEQ ID NO: 610776 - RNA, 26 nt, Human
uucacucaccuuuaaaauaagcagac

SEQ ID NO: 610777 - RNA, 28 nt, Human
uucagcacgagaggcugggaggcuuuca

SEQ ID NO: 610778 - RNA, 19 nt, Human
uuccugagccuccuugcuc

SEQ ID NO: 610779 - RNA, 23 nt, Human
uuccugccucggccucccaaauu

SEQ ID NO: 610780 - RNA, 22 nt, Human
uucugcaggccacaguaccugg

SEQ ID NO: 610781 - RNA, 19 nt, Human
uugauucucuccuccccac

SEQ ID NO: 610782 - RNA, 18 nt, Human
uugcccaagcuggagugc

SEQ ID NO: 610783 - RNA, 19 nt, Human
uugcucguugcccaagcug

SEQ ID NO: 610784 - RNA, 21 nt, Human
uugcucguugcccaagcugga

SEQ ID NO: 610785 - RNA, 18 nt, Human
uuggcugcacauucuguc

SEQ ID NO: 610786 - RNA, 23 nt, Human
uuguauuuuuaguagagaugggg

SEQ ID NO: 610787 - RNA, 21 nt, Human
uuucaccuguuggccaggcug

SEQ ID NO: 610788 - RNA, 23 nt, Human
uuucaccuguuggccaggcuggu

SEQ ID NO: 610789 - RNA, 25 nt, Human
uuucucagcagugugaaaauggacu

SEQ ID NO: 610790 - RNA, 24 nt, Human
uuuggcuguguccccacccaaauc

SEQ ID NO: 610791 - RNA, 23 nt, Human
uuuugcucguugcccaagcugga

SEQ ID NO: 610792 - RNA, 23 nt, Human
uuuuguauuuuuuaguagagaug

SEQ ID NO: 610793 - RNA, 24 nt, Human
uuuuuaguagagaugggguuucac

SEQ ID NO: 610794 - RNA, 24 nt, Human
uuuuuaguagagaugggguuucac

SEQ ID NO: 610795 - RNA, 21 nt, Human
uuuuuguauuuuuaguagaga

SEQ ID NO: 610796 - RNA, 23 nt, Human
uuuuuuaguagagaugggguuuc

SEQ ID NO: 610797 - RNA, 24 nt, Human
aaaaugcugagauuacagauguga

SEQ ID NO: 610798 - RNA, 22 nt, Human
aaacaaauguaaaaguuuccac

SEQ ID NO: 610799 - RNA, 20 nt, Human
aaaggagagcaugggcuuga

SEQ ID NO: 610800 - RNA, 21 nt, Human
aaaggccagaugcagagaagu

SEQ ID NO: 610801 - RNA, 23 nt, Human
aaaugcugggauuguaggcauga

SEQ ID NO: 610802 - RNA, 22 nt, Human
aacagugguggaaaauaagcaa

SEQ ID NO: 610803 - RNA, 25 nt, Human
aagcaauccucccaccugagccucc

SEQ ID NO: 610804 - RNA, 27 nt, Human
aagcaauucucuugacucacccucccg

SEQ ID NO: 610805 - RNA, 19 nt, Human
aagugcugggauuacaggc

SEQ ID NO: 610806 - RNA, 21 nt, Human
aagugcugggauuacaggcau

SEQ ID NO: 610807 - RNA, 23 nt, Human
aagugcugggauuacaggcauga

SEQ ID NO: 610808 - RNA, 23 nt, Human
aaugucacuauuauggcucugac

SEQ ID NO: 610809 - RNA, 21 nt, Human
acacgcaaggugcacgacgug

SEQ ID NO: 610810 - RNA, 24 nt, Human
acagagcaagcacacaguaggugc

SEQ ID NO: 610811 - RNA, 18 nt, Human
acagagcaccggcgucuc

SEQ ID NO: 610812 - RNA, 23 nt, Human
acaggugcccgccaccacgcccg

SEQ ID NO: 610813 - RNA, 22 nt, Human
acaugcaaaagagcccccggga

SEQ ID NO: 610814 - RNA, 28 nt, Human
accacaguacaggcgcuagacacacauu

SEQ ID NO: 610815 - RNA, 24 nt, Human
acccccagaggaugcgccuucucc

SEQ ID NO: 610816 - RNA, 19 nt, Human
accgcuuaggaaugacugc

SEQ ID NO: 610817 - RNA, 23 nt, Human
accucagccuccugaguaacugg

SEQ ID NO: 610818 - RNA, 21 nt, Human
accugggacacaggagggcuc

SEQ ID NO: 610819 - RNA, 22 nt, Human
acgacccccagaggaugcgccc

SEQ ID NO: 610820 - RNA, 18 nt, Human
acgacgugcucacuaagc

SEQ ID NO: 610821 - RNA, 18 nt, Human
acgggguuucaccguguu

SEQ ID NO: 610822 - RNA, 23 nt, Human
acgggguuucaccguguuggcca

SEQ ID NO: 610823 - RNA, 24 nt, Human
acgggguuucaccguguuggccag

SEQ ID NO: 610824 - RNA, 24 nt, Human
acguuuguauuuuuaguagagacg

SEQ ID NO: 610825 - RNA, 23 nt, Human
acuauuuaucaagcaccuacuac

SEQ ID NO: 610826 - RNA, 18 nt, Human
acucuauuauccaggcug

SEQ ID NO: 610827 - RNA, 28 nt, Human
acucuuuggaaggccuuuuuuuucuuuu

SEQ ID NO: 610828 - RNA, 19 nt, Human
acugugggccaccagggca

SEQ ID NO: 610829 - RNA, 20 nt, Human
agaaccaaguucaaacagga

SEQ ID NO: 610830 - RNA, 19 nt, Human
agaagccaacugugcccau

SEQ ID NO: 610831 - RNA, 25 nt, Human
agacaggagggaaaugggcccaagg

SEQ ID NO: 610832 - RNA, 23 nt, Human
agacagggucucacuauguugcc

SEQ ID NO: 610833 - RNA, 18 nt, Human
agagaguugggaugaacc

SEQ ID NO: 610834 - RNA, 19 nt, Human
agagccagggaccaaacag

SEQ ID NO: 610835 - RNA, 19 nt, Human
agaggaaagggcuggaaga

SEQ ID NO: 610836 - RNA, 21 nt, Human
agaggaaagggcuggaagaga

SEQ ID NO: 610837 - RNA, 19 nt, Human
agagggcaggcacguaggc

SEQ ID NO: 610838 - RNA, 24 nt, Human
agaugcuggagggcugaagaaguu

SEQ ID NO: 610839 - RNA, 23 nt, Human
agauuacagaugugagccacugc

SEQ ID NO: 610840 - RNA, 18 nt, Human
agccaacuccagcucucc

SEQ ID NO: 610841 - RNA, 19 nt, Human
agccagggaagcagggcuc

SEQ ID NO: 610842 - RNA, 24 nt, Human
agcuggucucaaacuccuggccuc

SEQ ID NO: 610843 - RNA, 26 nt, Human
aggaaacaaagaacuaacagagcaag

SEQ ID NO: 610844 - RNA, 18 nt, Human
aggaagaaggggaucagu

SEQ ID NO: 610845 - RNA, 23 nt, Human
aggagggaaaugggcccaaggac

SEQ ID NO: 610846 - RNA, 18 nt, Human
aggcacgguguccuugcc

SEQ ID NO: 610847 - RNA, 19 nt, Human
aggcaggacugaugcuggu

SEQ ID NO: 610848 - RNA, 20 nt, Human
aggcaggcuagcaggguggg

SEQ ID NO: 610849 - RNA, 20 nt, Human
aggcaugagucacugcaccc

SEQ ID NO: 610850 - RNA, 18 nt, Human
aggcucagaacggagcag

SEQ ID NO: 610851 - RNA, 23 nt, Human
aggcugaaggcugagggcagcug

SEQ ID NO: 610852 - RNA, 19 nt, Human
aggcugauuccuacuuacu

SEQ ID NO: 610853 - RNA, 25 nt, Human
aggcuggagugcagugacgcgaucu

SEQ ID NO: 610854 - RNA, 21 nt, Human
aggcuuccagccagggaagcc

SEQ ID NO: 610855 - RNA, 20 nt, Human
agugcagugacgcgaucucg

SEQ ID NO: 610856 - RNA, 24 nt, Human
agugcagugacgcgaucucggcuc

SEQ ID NO: 610857 - RNA, 18 nt, Human
aguugccagaaaucacca

SEQ ID NO: 610858 - RNA, 22 nt, Human
auccagacaagcccgucugcag

SEQ ID NO: 610859 - RNA, 18 nt, Human
auccucccaccugagccu

SEQ ID NO: 610860 - RNA, 18 nt, Human
augagaugggagacacac

SEQ ID NO: 610861 - RNA, 19 nt, Human
caaaagagcccccgggaga

SEQ ID NO: 610862 - RNA, 24 nt, Human
caaaugcugggauuguaggcauga

SEQ ID NO: 610863 - RNA, 23 nt, Human
caaccuccaccucccagguucaa

SEQ ID NO: 610864 - RNA, 20 nt, Human
caaggagccuggacuugaag

SEQ ID NO: 610865 - RNA, 19 nt, Human
caaggugcacgacgugcuc

SEQ ID NO: 610866 - RNA, 22 nt, Human
caaguguuccaccugccucggc

SEQ ID NO: 610867 - RNA, 23 nt, Human
cacagcaaacaaggauccagaca

SEQ ID NO: 610868 - RNA, 21 nt, Human
cacaguaggugcuccaagaac

SEQ ID NO: 610869 - RNA, 24 nt, Human
caccccaagagcauccaauuuaga

SEQ ID NO: 610870 - RNA, 24 nt, Human
cacccccucuguggcuacaccaag

SEQ ID NO: 610871 - RNA, 23 nt, Human
cacccugggcuggugccaggguc

SEQ ID NO: 610872 - RNA, 26 nt, Human
caccgaggcucagaacggagcagugg

SEQ ID NO: 610873 - RNA, 19 nt, Human
caccguguuggccagccug

SEQ ID NO: 610874 - RNA, 21 nt, Human
caccguguuggccagccuggu

SEQ ID NO: 610875 - RNA, 24 nt, Human
caccguguuggccagccuggucuc

SEQ ID NO: 610876 - RNA, 23 nt, Human
caccugagccucccaaaugcugg

SEQ ID NO: 610877 - RNA, 20 nt, Human
caccugggacacaggagggc

SEQ ID NO: 610878 - RNA, 20 nt, Human
caccuuuuccccuugaggca

SEQ ID NO: 610879 - RNA, 21 nt, Human
cacgcaccugggacacaggag

SEQ ID NO: 610880 - RNA, 24 nt, Human
cacuauguugcccaaacuggucuc

SEQ ID NO: 610881 - RNA, 27 nt, Human
cacuauguugcccaaacuggucucaaa

SEQ ID NO: 610882 - RNA, 24 nt, Human
cacuauguugcccaagcuggucuc

SEQ ID NO: 610883 - RNA, 27 nt, Human
cacuauguugcccaagcuggucucaaa

SEQ ID NO: 610884 - RNA, 23 nt, Human
cacucuauuauccaggcuggaau

SEQ ID NO: 610885 - RNA, 25 nt, Human
cacucuccucccccagcaagccaag

SEQ ID NO: 610886 - RNA, 21 nt, Human
cacugauucacagcuacuucg

SEQ ID NO: 610887 - RNA, 21 nt, Human
cacugcaaccuccaccuccca

SEQ ID NO: 610888 - RNA, 18 nt, Human
cacuguauuucucuuuug

SEQ ID NO: 610889 - RNA, 18 nt, Human
cagacgcggagcugaagg

SEQ ID NO: 610890 - RNA, 21 nt, Human
cagaguuccucaguuuuuuuc

SEQ ID NO: 610891 - RNA, 19 nt, Human
cagcaaauacugcucccau

SEQ ID NO: 610892 - RNA, 21 nt, Human
cagccacacaaguggaaauuu

SEQ ID NO: 610893 - RNA, 20 nt, Human
cagccucaaauuccugggcu

SEQ ID NO: 610894 - RNA, 19 nt, Human
cagccuccugaguaacugg

SEQ ID NO: 610895 - RNA, 19 nt, Human
cagcucccuucugaugcuc

SEQ ID NO: 610896 - RNA, 21 nt, Human
caggagggaaaugggcccaag

SEQ ID NO: 610897 - RNA, 18 nt, Human
cagggccagcgaucaagg

SEQ ID NO: 610898 - RNA, 18 nt, Human
cagggucucacuauguug

SEQ ID NO: 610899 - RNA, 24 nt, Human
cagggucucacuauguugcccaag

SEQ ID NO: 610900 - RNA, 19 nt, Human
caggugcccgccaccacgc

SEQ ID NO: 610901 - RNA, 21 nt, Human
caggugcccgccaccacgccc

SEQ ID NO: 610902 - RNA, 21 nt, Human
caugccggguccuccucccca

SEQ ID NO: 610903 - RNA, 18 nt, Human
cauuucaucauucugcgc

SEQ ID NO: 610904 - RNA, 24 nt, Human
ccaaaaugcugagauuacagaugu

SEQ ID NO: 610905 - RNA, 24 nt, Human
ccaaacagugguggaaaauaagcc

SEQ ID NO: 610906 - RNA, 23 nt, Human
ccaaaugcugggauuguaggcau

SEQ ID NO: 610907 - RNA, 25 nt, Human
ccaggccaacccgacagcccaacuc

SEQ ID NO: 610908 - RNA, 20 nt, Human
ccaggcuggaaugcagugac

SEQ ID NO: 610909 - RNA, 24 nt, Human
cccaaaugcugggauuguaggcau

SEQ ID NO: 610910 - RNA, 24 nt, Human
cccacaccucauuuuccgacuauu

SEQ ID NO: 610911 - RNA, 18 nt, Human
cccacccuaccccagcac

SEQ ID NO: 610912 - RNA, 20 nt, Human
cccacccuaccccagcacau

SEQ ID NO: 610913 - RNA, 19 nt, Human
cccacgacagccaucccgg

SEQ ID NO: 610914 - RNA, 20 nt, Human
cccagcaagccaagggcugu

SEQ ID NO: 610915 - RNA, 20 nt, Human
cccagguucaagcaauucuc

SEQ ID NO: 610916 - RNA, 27 nt, Human
ccccacccuaccccagcacaucugcaa

SEQ ID NO: 610917 - RNA, 18 nt, Human
ccccacgacagccauccc

SEQ ID NO: 610918 - RNA, 23 nt, Human
cccccuucccccauugauacucc

SEQ ID NO: 610919 - RNA, 24 nt, Human
ccccgggagacaggagggaaaugg

SEQ ID NO: 610920 - RNA, 24 nt, Human
cccgaagugcugggauuacaggca

SEQ ID NO: 610921 - RNA, 24 nt, Human
ccgaagugcugggauuacaggcau

SEQ ID NO: 610922 - RNA, 20 nt, Human
ccggguccuccuccccauca

SEQ ID NO: 610923 - RNA, 18 nt, Human
ccucccaaaugcugggau

SEQ ID NO: 610924 - RNA, 24 nt, Human
ccucccagguucaagcaauucucu

SEQ ID NO: 610925 - RNA, 21 nt, Human
ccugagccucccaaaugcugg

SEQ ID NO: 610926 - RNA, 23 nt, Human
ccugaucucaaguguuccaccug

SEQ ID NO: 610927 - RNA, 18 nt, Human
ccugcaggucucggcagc

SEQ ID NO: 610928 - RNA, 22 nt, Human
ccugcaggucucggcagcugga

SEQ ID NO: 610929 - RNA, 24 nt, Human
ccugccucggccucccgaagugcu

SEQ ID NO: 610930 - RNA, 24 nt, Human
ccuggccucaagcaauccucccac

SEQ ID NO: 610931 - RNA, 23 nt, Human
ccuggcguuuccaccucggcuuc

SEQ ID NO: 610932 - RNA, 22 nt, Human
cggaggggguuccugggaggcc

SEQ ID NO: 610933 - RNA, 23 nt, Human
cgggguuucaccguguuggccag

SEQ ID NO: 610934 - RNA, 20 nt, Human
cuacugcaccuggucuaaag

SEQ ID NO: 610935 - RNA, 24 nt, Human
cuacugcaccuggucuaaaggugc

SEQ ID NO: 610936 - RNA, 18 nt, Human
cucaaaagaucucucacc

SEQ ID NO: 610937 - RNA, 24 nt, Human
cucaagcaauccucccaccugagc

SEQ ID NO: 610938 - RNA, 20 nt, Human
cucacucuauuauccaggcc

SEQ ID NO: 610939 - RNA, 24 nt, Human
cucacugcaaccuccaccucccag

SEQ ID NO: 610940 - RNA, 21 nt, Human
cucccaaaaugcugagauuac

SEQ ID NO: 610941 - RNA, 23 nt, Human
cucccaccugagccucccaaaug

SEQ ID NO: 610942 - RNA, 19 nt, Human
cucgcacgcccccacccua

SEQ ID NO: 610943 - RNA, 24 nt, Human
cucgcacgcccccacccuacccca

SEQ ID NO: 610944 - RNA, 21 nt, Human
cucgcugcagccucaaauucc

SEQ ID NO: 610945 - RNA, 23 nt, Human
cugcaaccuccaccucccagguu

SEQ ID NO: 610946 - RNA, 21 nt, Human
cuggccucaagcaauccuccc

SEQ ID NO: 610947 - RNA, 22 nt, Human
cuggccucaagcaauccuccca

SEQ ID NO: 610948 - RNA, 19 nt, Human
cuggggaagucccaggcag

SEQ ID NO: 610949 - RNA, 21 nt, Human
cuggggccuccaggaagaagg

SEQ ID NO: 610950 - RNA, 21 nt, Human
cuggugccagggucggggcca

SEQ ID NO: 610951 - RNA, 21 nt, Human
cugugggccaccagggcaagc

SEQ ID NO: 610952 - RNA, 18 nt, Human
cuucaaaacuagcggucc

SEQ ID NO: 610953 - RNA, 18 nt, Human
cuugaaguaagacucaac

SEQ ID NO: 610954 - RNA, 22 nt, Human
cuugcucgucuguaccaagauc

SEQ ID NO: 610955 - RNA, 24 nt, Human
gaaggaaacaaagaacuaacagag

SEQ ID NO: 610956 - RNA, 24 nt, Human
gaagugcugggauuacaggcauga

SEQ ID NO: 610957 - RNA, 19 nt, Human
gaaguggaacaauggaacc

SEQ ID NO: 610958 - RNA, 24 nt, Human
gagacgggguuucaccguguuggc

SEQ ID NO: 610959 - RNA, 22 nt, Human
gagcauccaauuuagaggaggg

SEQ ID NO: 610960 - RNA, 24 nt, Human
gaucucaaguguuccaccugccuc

SEQ ID NO: 610961 - RNA, 22 nt, Human
gaugcgccuucuccacccccuc

SEQ ID NO: 610962 - RNA, 18 nt, Human
gauuacagaugugagcca

SEQ ID NO: 610963 - RNA, 22 nt, Human
gauuacagaugugagccacugc

SEQ ID NO: 610964 - RNA, 19 nt, Human
gauuacaggcaugagcuac

SEQ ID NO: 610965 - RNA, 23 nt, Human
gauuacaggcaugagcuacugca

SEQ ID NO: 610966 - RNA, 22 nt, Human
gauuguaggcaugagucacugc

SEQ ID NO: 610967 - RNA, 23 nt, Human
gauuguaggcaugagucacugca

SEQ ID NO: 610968 - RNA, 21 nt, Human
gcaaaaaaaggagagcauggg

SEQ ID NO: 610969 - RNA, 22 nt, Human
gcaaccuccaccucccagguuc

SEQ ID NO: 610970 - RNA, 18 nt, Human
gcaccggcgucuccuuuc

SEQ ID NO: 610971 - RNA, 19 nt, Human
gccaugucccucugggaga

SEQ ID NO: 610972 - RNA, 18 nt, Human
gcccagccacaaugagau

SEQ ID NO: 610973 - RNA, 26 nt, Human
gcccagggcugcagauauacagcagu

SEQ ID NO: 610974 - RNA, 18 nt, Human
gcccccacccuaccccag

SEQ ID NO: 610975 - RNA, 19 nt, Human
gcgccacugacucugggac

SEQ ID NO: 610976 - RNA, 18 nt, Human
gcgucuccuuucagcaca

SEQ ID NO: 610977 - RNA, 18 nt, Human
gcuccucugggcugugau

SEQ ID NO: 610978 - RNA, 19 nt, Human
gcugcagccucaaauuccu

SEQ ID NO: 610979 - RNA, 25 nt, Human
gcuggaaugcagugacgugaucccu

SEQ ID NO: 610980 - RNA, 19 nt, Human
gcuggagugcagugacgcg

SEQ ID NO: 610981 - RNA, 19 nt, Human
gcugguugcuggucugcuu

SEQ ID NO: 610982 - RNA, 20 nt, Human
ggagacaggagggaaauggg

SEQ ID NO: 610983 - RNA, 21 nt, Human
ggagacaggagggaaaugggc

SEQ ID NO: 610984 - RNA, 22 nt, Human
ggauuacaggcaugagcuacug

SEQ ID NO: 610985 - RNA, 19 nt, Human
gggaagcuucuaccagcug

SEQ ID NO: 610986 - RNA, 20 nt, Human
gggcaucaagggagaggcuu

SEQ ID NO: 610987 - RNA, 20 nt, Human
ggggaucagucuggagacuc

SEQ ID NO: 610988 - RNA, 22 nt, Human
gggguuucaccguguuggccag

SEQ ID NO: 610989 - RNA, 18 nt, Human
ggguuccugggaggcagg

SEQ ID NO: 610990 - RNA, 24 nt, Human
gguaggguggggcucccuggcguu

SEQ ID NO: 610991 - RNA, 20 nt, Human
gguccacgacccccagagga

SEQ ID NO: 610992 - RNA, 21 nt, Human
ggucggggccaaggccguccu

SEQ ID NO: 610993 - RNA, 18 nt, Human
ggucuccaacuccugauc

SEQ ID NO: 610994 - RNA, 20 nt, Human
ggugggggcagaggaaaggg

SEQ ID NO: 610995 - RNA, 23 nt, Human
guagagacgggguuucaccgugu

SEQ ID NO: 610996 - RNA, 22 nt, Human
guagagaugagaucucacuaug

SEQ ID NO: 610997 - RNA, 23 nt, Human
guugcuggucugcuuuuccacgc

SEQ ID NO: 610998 - RNA, 20 nt, Human
uaaaaaacacaaaaaaacua

SEQ ID NO: 610999 - RNA, 23 nt, Human
uaaaccucugcgaguucuccagg

SEQ ID NO: 611000 - RNA, 23 nt, Human
uaaaggugcauuuuuguaauguc

SEQ ID NO: 611001 - RNA, 23 nt, Human
uaacguuuguauuuuuaguagag

SEQ ID NO: 611002 - RNA, 24 nt, Human
uaacguuuguauuuuuaguagaga

SEQ ID NO: 611003 - RNA, 24 nt, Human
uacagcagugaacagaauaaacaa

SEQ ID NO: 611004 - RNA, 22 nt, Human
uacaggcaugagcuacugcacc

SEQ ID NO: 611005 - RNA, 23 nt, Human
uacaggugcccgccaccacgccc

SEQ ID NO: 611006 - RNA, 21 nt, Human
uaccacaguacaggcgcuaga

SEQ ID NO: 611007 - RNA, 22 nt, Human
uacccuagguucagaugccagc

SEQ ID NO: 611008 - RNA, 19 nt, Human
uagaaacgggcaagcauug

SEQ ID NO: 611009 - RNA, 22 nt, Human
uagagacagggucucacuaugu

SEQ ID NO: 611010 - RNA, 22 nt, Human
uagagaugagaucucacuaugu

SEQ ID NO: 611011 - RNA, 20 nt, Human
uagcagggugggcaccaagc

SEQ ID NO: 611012 - RNA, 24 nt, Human
uagcucuguuguccaggcuggagu

SEQ ID NO: 611013 - RNA, 21 nt, Human
uaguagagacgggguuucacc

SEQ ID NO: 611014 - RNA, 24 nt, Human
uaguagagacgggguuucaccgug

SEQ ID NO: 611015 - RNA, 26 nt, Human
uaguagagacgggguuucaccguugg

SEQ ID NO: 611016 - RNA, 22 nt, Human
uagugaaagcugaaugaaugaa

SEQ ID NO: 611017 - RNA, 24 nt, Human
uauccaggcuggaaugcagugacg

SEQ ID NO: 611018 - RNA, 24 nt, Human
uauggagccaacuccagcucuccu

SEQ ID NO: 611019 - RNA, 24 nt, Human
uauguugcccaaacuggucucaaa

SEQ ID NO: 611020 - RNA, 23 nt, Human
uauguugcccaagcuggucucaa

SEQ ID NO: 611021 - RNA, 24 nt, Human
uauguugcccaagcuggucucaaa

SEQ ID NO: 611022 - RNA, 22 nt, Human
ucaaaacuagcggucccaccac

SEQ ID NO: 611023 - RNA, 21 nt, Human
ucaaagucacccaccugggca

SEQ ID NO: 611024 - RNA, 20 nt, Human
ucaagcaccuacuacgugcc

SEQ ID NO: 611025 - RNA, 24 nt, Human
ucaccguguuggccagccuggucu

SEQ ID NO: 611026 - RNA, 25 nt, Human
ucaccguguuggccagccuggucuc

SEQ ID NO: 611027 - RNA, 23 nt, Human
ucacgcaccugggacacaggagg

SEQ ID NO: 611028 - RNA, 24 nt, Human
ucacugcaaccuccaccucccagg

SEQ ID NO: 611029 - RNA, 25 nt, Human
ucacugcaaccuccaccucccaggu

SEQ ID NO: 611030 - RNA, 27 nt, Human
ucacugcaaccuccaccucccagguuc

SEQ ID NO: 611031 - RNA, 24 nt, Human
ucauggaggugugucugagacgga

SEQ ID NO: 611032 - RNA, 21 nt, Human
uccaaccucgcacgcccccac

SEQ ID NO: 611033 - RNA, 19 nt, Human
uccaagggagagagggaaa

SEQ ID NO: 611034 - RNA, 22 nt, Human
ucccaaaugcugggauuguagg

SEQ ID NO: 611035 - RNA, 23 nt, Human
ucccaaaugcugggauuguaggc

SEQ ID NO: 611036 - RNA, 22 nt, Human
ucccaggcaggcuagcagggug

SEQ ID NO: 611037 - RNA, 21 nt, Human
ucccagguucaagcaauucuc

SEQ ID NO: 611038 - RNA, 21 nt, Human
ucccagguucaagcaauucuc

SEQ ID NO: 611039 - RNA, 24 nt, Human
ucccagguucaagcaauucucuug

SEQ ID NO: 611040 - RNA, 24 nt, Human
ucccccuucccccauugauacucc

SEQ ID NO: 611041 - RNA, 19 nt, Human
ucccgaagugcugggauua

SEQ ID NO: 611042 - RNA, 24 nt, Human
ucccgaagugcugggauuacaggc

SEQ ID NO: 611043 - RNA, 18 nt, Human
ucccugguucuccucccc

SEQ ID NO: 611044 - RNA, 18 nt, Human
uccgagacacccuuccuc

SEQ ID NO: 611045 - RNA, 19 nt, Human
uccugggcucaaaagaucu

SEQ ID NO: 611046 - RNA, 20 nt, Human
uccugggcucaaaagaucuc

SEQ ID NO: 611047 - RNA, 21 nt, Human
uccugggcucaaaagaucucu

SEQ ID NO: 611048 - RNA, 22 nt, Human
uccugggcucaaaagaucucuc

SEQ ID NO: 611049 - RNA, 19 nt, Human
uccuuggcaggacuguccu

SEQ ID NO: 611050 - RNA, 24 nt, Human
ucgcugcagccucaaauuccuggg

SEQ ID NO: 611051 - RNA, 18 nt, Human
ucggccucccgaagugcu

SEQ ID NO: 611052 - RNA, 23 nt, Human
ucuagcucuguuguccaggcugg

SEQ ID NO: 611053 - RNA, 24 nt, Human
ucuagcucuguuguccaggcugga

SEQ ID NO: 611054 - RNA, 23 nt, Human
ucucacuauguugcccaaacugg

SEQ ID NO: 611055 - RNA, 26 nt, Human
ucucacuauguugcccaaacuggucu

SEQ ID NO: 611056 - RNA, 27 nt, Human
ucucacuauguugcccaaacuggucuc

SEQ ID NO: 611057 - RNA, 23 nt, Human
ucucacuauguugcccaagcugg

SEQ ID NO: 611058 - RNA, 24 nt, Human
ucucacuauguugcccaagcuggu

SEQ ID NO: 611059 - RNA, 26 nt, Human
ucucacuauguugcccaagcuggucu

SEQ ID NO: 611060 - RNA, 27 nt, Human
ucucacuauguugcccaagcuggucuc

SEQ ID NO: 611061 - RNA, 24 nt, Human
ucucacucuauuauccaggcugga

SEQ ID NO: 611062 - RNA, 23 nt, Human
ucugaggcaguugccagaaauca

SEQ ID NO: 611063 - RNA, 24 nt, Human
ucuggagacucucaaugucccaca

SEQ ID NO: 611064 - RNA, 24 nt, Human
ucuguuguccaggcuggagugcag

SEQ ID NO: 611065 - RNA, 25 nt, Human
ugaaaaacugcacccccuguucuaa

SEQ ID NO: 611066 - RNA, 21 nt, Human
ugaaagcgagaaacaaaugua

SEQ ID NO: 611067 - RNA, 22 nt, Human
ugaagaaguuagugaaagcuga

SEQ ID NO: 611068 - RNA, 22 nt, Human
ugacaccaggucaaagucaccc

SEQ ID NO: 611069 - RNA, 19 nt, Human
ugagacaguauguauagaa

SEQ ID NO: 611070 - RNA, 25 nt, Human
ugagacccccgcucgaccaugugcg

SEQ ID NO: 611071 - RNA, 23 nt, Human
ugagaucucacuauguugcccaa

SEQ ID NO: 611072 - RNA, 22 nt, Human
ugagauuacagaugugagccac

SEQ ID NO: 611073 - RNA, 22 nt, Human
ugagauuacagaugugagccac

SEQ ID NO: 611074 - RNA, 24 nt, Human
ugagauuacagaugugagccacug

SEQ ID NO: 611075 - RNA, 22 nt, Human
ugagggcagcugggugggggca

SEQ ID NO: 611076 - RNA, 20 nt, Human
ugauauuugaagaaacuggg

SEQ ID NO: 611077 - RNA, 22 nt, Human
ugaugcuggugcuaaugcuggg

SEQ ID NO: 611078 - RNA, 19 nt, Human
ugauggggagagagaacca

SEQ ID NO: 611079 - RNA, 21 nt, Human
ugauggggagagagaaccagg

SEQ ID NO: 611080 - RNA, 18 nt, Human
ugcagaaggggugaggcc

SEQ ID NO: 611081 - RNA, 22 nt, Human
ugcagaaggggugaggccaucc

SEQ ID NO: 611082 - RNA, 22 nt, Human
ugcagugacgcgaucucggcuc

SEQ ID NO: 611083 - RNA, 23 nt, Human
ugccgccucucucuggcccgcuu

SEQ ID NO: 611084 - RNA, 21 nt, Human
ugccucggccucccgaagugc

SEQ ID NO: 611085 - RNA, 24 nt, Human
ugccucggccucccgaagugcugg

SEQ ID NO: 611086 - RNA, 24 nt, Human
ugcugagauuacagaugugagcca

SEQ ID NO: 611087 - RNA, 20 nt, Human
ugcugggauuacaggcauga

SEQ ID NO: 611088 - RNA, 19 nt, Human
uggaaaauaagcaaaaaaa

SEQ ID NO: 611089 - RNA, 20 nt, Human
uggaacccccagaaugagac

SEQ ID NO: 611090 - RNA, 21 nt, Human
uggaacuauaggcacacacca

SEQ ID NO: 611091 - RNA, 24 nt, Human
uggaacuauaggcacacaccacug

SEQ ID NO: 611092 - RNA, 20 nt, Human
uggaagguccacgaccccca

SEQ ID NO: 611093 - RNA, 19 nt, Human
uggaaugcagugacgugau

SEQ ID NO: 611094 - RNA, 28 nt, Human
uggaaugcagugacgugauggcucuagc

SEQ ID NO: 611095 - RNA, 23 nt, Human
uggaggacuaacgacccaaaggc

SEQ ID NO: 611096 - RNA, 19 nt, Human
uggagugcagugacgcgau

SEQ ID NO: 611097 - RNA, 23 nt, Human
uggagugcagugacgcgaucucg

SEQ ID NO: 611098 - RNA, 24 nt, Human
uggagugcagugacgcgaucucgg

SEQ ID NO: 611099 - RNA, 24 nt, Human
uggccagccuggucuccaacuccu

SEQ ID NO: 611100 - RNA, 20 nt, Human
uggccucaagcaauccuccc

SEQ ID NO: 611101 - RNA, 21 nt, Human
uggccucaagcaauccuccca

SEQ ID NO: 611102 - RNA, 18 nt, Human
uggcucaaaucacagcaa

SEQ ID NO: 611103 - RNA, 22 nt, Human
ugggaugugaggcagggaccaa

SEQ ID NO: 611104 - RNA, 19 nt, Human
ugggauuacaggcaugagc

SEQ ID NO: 611105 - RNA, 22 nt, Human
ugggauuacaggcaugagcuac

SEQ ID NO: 611106 - RNA, 22 nt, Human
ugggauuacaggcaugagcuac

SEQ ID NO: 611107 - RNA, 24 nt, Human
ugggauuacaggcaugagcuacug

SEQ ID NO: 611108 - RNA, 24 nt, Human
ugggauuacaggcaugagcuacug

SEQ ID NO: 611109 - RNA, 18 nt, Human
ugggauuguaggcaugag

SEQ ID NO: 611110 - RNA, 22 nt, Human
ugggauuguaggcaugagucac

SEQ ID NO: 611111 - RNA, 22 nt, Human
ugggauuguaggcaugagucac

SEQ ID NO: 611112 - RNA, 24 nt, Human
ugggauuguaggcaugagucacug

SEQ ID NO: 611113 - RNA, 20 nt, Human
ugggcagagggcaggcacgu

SEQ ID NO: 611114 - RNA, 22 nt, Human
ugggcucuuuccuaaaugacau

SEQ ID NO: 611115 - RNA, 21 nt, Human
uggggaccuggaaccagggau

SEQ ID NO: 611116 - RNA, 21 nt, Human
ugggggcagaggaaagggcug

SEQ ID NO: 611117 - RNA, 25 nt, Human
ugggugggggcagaggaaagggcug

SEQ ID NO: 611118 - RNA, 26 nt, Human
ugggugggggcagaggaaagggcugg

SEQ ID NO: 611119 - RNA, 24 nt, Human
ugguagagaugagaucucacuaug

SEQ ID NO: 611120 - RNA, 21 nt, Human
ugguauuacaggugcccgcca

SEQ ID NO: 611121 - RNA, 22 nt, Human
ugguauuacaggugcccgccac

SEQ ID NO: 611122 - RNA, 24 nt, Human
ugguauuacaggugcccgccacca

SEQ ID NO: 611123 - RNA, 21 nt, Human
ugguugcuggucugcuuuucc

SEQ ID NO: 611124 - RNA, 21 nt, Human
uguauuuuuaguagagacggg

SEQ ID NO: 611125 - RNA, 20 nt, Human
uguccaggcuggagugcagu

SEQ ID NO: 611126 - RNA, 24 nt, Human
uguccaggcuggagugcagugacg

SEQ ID NO: 611127 - RNA, 18 nt, Human
uguggcuacaccaaggga

SEQ ID NO: 611128 - RNA, 22 nt, Human
ugugguuucugucuucuugaac

SEQ ID NO: 611129 - RNA, 19 nt, Human
uguuguccaggcuggagug

SEQ ID NO: 611130 - RNA, 20 nt, Human
uuaacccuucaauugucaac

SEQ ID NO: 611131 - RNA, 22 nt, Human
uuaauccucacaaucaaccacc

SEQ ID NO: 611132 - RNA, 18 nt, Human
uuaguagagacgggguuu

SEQ ID NO: 611133 - RNA, 22 nt, Human
uuaguagagacgggguuucacc

SEQ ID NO: 611134 - RNA, 24 nt, Human
uuaguagagacgggguuucaccgu

SEQ ID NO: 611135 - RNA, 23 nt, Human
uucaagcaauucucuugacucac

SEQ ID NO: 611136 - RNA, 24 nt, Human
uucccccgcacagcacuggccccc

SEQ ID NO: 611137 - RNA, 23 nt, Human
uuccucaggccaucccugguucu

SEQ ID NO: 611138 - RNA, 20 nt, Human
uuccuccagugaggcugaag

SEQ ID NO: 611139 - RNA, 23 nt, Human
uuccugcaggucucggcagcugg

SEQ ID NO: 611140 - RNA, 21 nt, Human
uuccugggcucaaaagaucuc

SEQ ID NO: 611141 - RNA, 21 nt, Human
uucucuuuuguucuuugcacc

SEQ ID NO: 611142 - RNA, 22 nt, Human
uucucuuuuguucuuugcaccu

SEQ ID NO: 611143 - RNA, 24 nt, Human
uugccagggagagccuuuccucag

SEQ ID NO: 611144 - RNA, 24 nt, Human
uugcuagagacagggucucacuau

SEQ ID NO: 611145 - RNA, 21 nt, Human
uugcugccgccucucucuggc

SEQ ID NO: 611146 - RNA, 24 nt, Human
uugcugccgccucucucuggcccg

SEQ ID NO: 611147 - RNA, 24 nt, Human
uuggaaggccuuuuuuuucuuuuc

SEQ ID NO: 611148 - RNA, 19 nt, Human
uuggccagccuggucucca

SEQ ID NO: 611149 - RNA, 24 nt, Human
uugguagagaugagaucucacuau

SEQ ID NO: 611150 - RNA, 23 nt, Human
uuguauuuuuaguagagacgggg

SEQ ID NO: 611151 - RNA, 24 nt, Human
uuguccaggcuggagugcagugac

SEQ ID NO: 611152 - RNA, 20 nt, Human
uuucaccguguuggccagcu

SEQ ID NO: 611153 - RNA, 18 nt, Human
uuuccagcucccagaagc

SEQ ID NO: 611154 - RNA, 24 nt, Human
uuugaagaaacugggaugugaggc

SEQ ID NO: 611155 - RNA, 24 nt, Human
uuugagaauagcuucagauuuaca

SEQ ID NO: 611156 - RNA, 19 nt, Human
uuugugguuucugucuucu

SEQ ID NO: 611157 - RNA, 24 nt, Human
uuuuuaguagagacgggguuucac

SEQ ID NO: 611158 - RNA, 24 nt, Human
uuuuugguagagaugagaucucac

SEQ ID NO: 611159 - RNA, 18 nt, Human
uuuuuugguagagaugag

SEQ ID NO: 611160 - RNA, 24 nt, Human
aaagugcugggauuacaggcguga

SEQ ID NO: 611161 - RNA, 19 nt, Human
aagugcugggauuacaggc

SEQ ID NO: 611162 - RNA, 19 nt, Human
aagugcugggauuacaggc

SEQ ID NO: 611163 - RNA, 26 nt, Human
aagugcugggauuacaggcgugagcc

SEQ ID NO: 611164 - RNA, 24 nt, Human
acagcguuucaccguguuggccag

SEQ ID NO: 611165 - RNA, 24 nt, Human
accguguuggccagccuggucucg

SEQ ID NO: 611166 - RNA, 24 nt, Human
acucuuguugcccaggcuggagug

SEQ ID NO: 611167 - RNA, 24 nt, Human
agaccucaggugaucccccugccu

SEQ ID NO: 611168 - RNA, 18 nt, Human
aggugaucccccugccuc

SEQ ID NO: 611169 - RNA, 21 nt, Human
agguucaagugauucuccugc

SEQ ID NO: 611170 - RNA, 22 nt, Human
agguucaagugauucuccugcc

SEQ ID NO: 611171 - RNA, 28 nt, Human
agguugagucuacacagaggaacacuuc

SEQ ID NO: 611172 - RNA, 20 nt, Human
aguagagacagcguuucacc

SEQ ID NO: 611173 - RNA, 19 nt, Human
aguagcugggauuacaggc

SEQ ID NO: 611174 - RNA, 24 nt, Human
agugauucuccugccucagccucc

SEQ ID NO: 611175 - RNA, 18 nt, Human
agugcugggauuacaggc

SEQ ID NO: 611176 - RNA, 18 nt, Human
auucuccugccucagccu

SEQ ID NO: 611177 - RNA, 24 nt, Human
auuuuuguauuuuuaguagagaca

SEQ ID NO: 611178 - RNA, 24 nt, Human
caaagugcugggauuacaggcgug

SEQ ID NO: 611179 - RNA, 20 nt, Human
caagugauucuccugccuca

SEQ ID NO: 611180 - RNA, 22 nt, Human
caagugauucuccugccucagc

SEQ ID NO: 611181 - RNA, 24 nt, Human
caccacacccagcuaauuuuugua

SEQ ID NO: 611182 - RNA, 19 nt, Human
caccguguuggccagccug

SEQ ID NO: 611183 - RNA, 21 nt, Human
caccguguuggccagccuggu

SEQ ID NO: 611184 - RNA, 24 nt, Human
caccguguuggccagccuggucuc

SEQ ID NO: 611185 - RNA, 24 nt, Human
cacucuuguugcccaggcuggagu

SEQ ID NO: 611186 - RNA, 21 nt, Human
cacugcaaccuccgccuccca

SEQ ID NO: 611187 - RNA, 19 nt, Human
cagcguuucaccguguugg

SEQ ID NO: 611188 - RNA, 22 nt, Human
caggugaucccccugccucggc

SEQ ID NO: 611189 - RNA, 23 nt, Human
cauggugugaugcuugcuccgca

SEQ ID NO: 611190 - RNA, 20 nt, Human
ccaaagugcugggauuacag

SEQ ID NO: 611191 - RNA, 22 nt, Human
ccaaagugcugggauuacaggc

SEQ ID NO: 611192 - RNA, 22 nt, Human
ccaaagugcugggauuacaggc

SEQ ID NO: 611193 - RNA, 24 nt, Human
ccaaagugcugggauuacaggcgu

SEQ ID NO: 611194 - RNA, 23 nt, Human
cccagguucaagugauucuccuc

SEQ ID NO: 611195 - RNA, 23 nt, Human
cccagguucaagugauucuccug

SEQ ID NO: 611196 - RNA, 26 nt, Human
cccccugccucggccucccaaagugc

SEQ ID NO: 611197 - RNA, 23 nt, Human
cccgaguagcugggauuacaggc

SEQ ID NO: 611198 - RNA, 24 nt, Human
cccgaguagcugggauuacaggcg

SEQ ID NO: 611199 - RNA, 22 nt, Human
ccgaguagcugggauuacaggc

SEQ ID NO: 611200 - RNA, 24 nt, Human
ccgaguagcugggauuacaggcgu

SEQ ID NO: 611201 - RNA, 24 nt, Human
ccgccucccagguucaagugauuc

SEQ ID NO: 611202 - RNA, 24 nt, Human
ccucccagguucaagugauucucc

SEQ ID NO: 611203 - RNA, 24 nt, Human
ccugccucagccucccgaguagcu

SEQ ID NO: 611204 - RNA, 24 nt, Human
ccugccucggccucccaaagugcu

SEQ ID NO: 611205 - RNA, 22 nt, Human
cgccucccagguucaagugauu

SEQ ID NO: 611206 - RNA, 18 nt, Human
cgugcaccaccacaccca

SEQ ID NO: 611207 - RNA, 23 nt, Human
cgugcaccaccacacccagcuaa

SEQ ID NO: 611208 - RNA, 23 nt, Human
cuaauuuuuguauuuuuaguaga

SEQ ID NO: 611209 - RNA, 24 nt, Human
cucacugcaaccuccgccucccag

SEQ ID NO: 611210 - RNA, 24 nt, Human
cucagccucccgaguagcugggau

SEQ ID NO: 611211 - RNA, 19 nt, Human
cucccagguucaagugauu

SEQ ID NO: 611212 - RNA, 18 nt, Human
cucuuguugcccaggcug

SEQ ID NO: 611213 - RNA, 23 nt, Human
cugcaaccuccgccucccagguu

SEQ ID NO: 611214 - RNA, 24 nt, Human
cugcaaccuccgccucccagguuc

SEQ ID NO: 611215 - RNA, 24 nt, Human
cuggagugcaauggcaugaucucg

SEQ ID NO: 611216 - RNA, 24 nt, Human
cuuguugcccaggcuggagugcaa

SEQ ID NO: 611217 - RNA, 23 nt, Human
gaccucaggugaucccccugccu

SEQ ID NO: 611218 - RNA, 24 nt, Human
gaccucaggugaucccccugccuc

SEQ ID NO: 611219 - RNA, 24 nt, Human
gaguagcugggauuacaggcgugc

SEQ ID NO: 611220 - RNA, 18 nt, Human
gauuacaggcgugagcca

SEQ ID NO: 611221 - RNA, 21 nt, Human
gauuacaggcgugagccacca

SEQ ID NO: 611222 - RNA, 22 nt, Human
gauuacaggcgugagccaccac

SEQ ID NO: 611223 - RNA, 22 nt, Human
gcaaccuccgccucccagguuc

SEQ ID NO: 611224 - RNA, 24 nt, Human
gcccaggcuggagugcaauggcau

SEQ ID NO: 611225 - RNA, 20 nt, Human
gccucagccucccgaguagc

SEQ ID NO: 611226 - RNA, 19 nt, Human
gcuggagugcaauggcaug

SEQ ID NO: 611227 - RNA, 19 nt, Human
ggauuacaggcgugagcca

SEQ ID NO: 611228 - RNA, 18 nt, Human
guagcugggauuacaggc

SEQ ID NO: 611229 - RNA, 18 nt, Human
guagcugggauuacaggc

SEQ ID NO: 611230 - RNA, 24 nt, Human
gugauucuccugccucagccuccc

SEQ ID NO: 611231 - RNA, 24 nt, Human
uaauuuuuguauuuuuaguagaga

SEQ ID NO: 611232 - RNA, 23 nt, Human
uacaggcgugagccaccacgccc

SEQ ID NO: 611233 - RNA, 24 nt, Human
uacaggcgugcaccaccacaccca

SEQ ID NO: 611234 - RNA, 21 nt, Human
uaguagagacagcguuucacc

SEQ ID NO: 611235 - RNA, 24 nt, Human
uaguagagacagcguuucaccgug

SEQ ID NO: 611236 - RNA, 26 nt, Human
uaguagagacagcguuucaccguguu

SEQ ID NO: 611237 - RNA, 19 nt, Human
ucaagugauucuccugccu

SEQ ID NO: 611238 - RNA, 24 nt, Human
ucaccguguuggccagccuggucu

SEQ ID NO: 611239 - RNA, 22 nt, Human
ucacucuuguugcccaggcugg

SEQ ID NO: 611240 - RNA, 23 nt, Human
ucacucuuguugcccaggcugga

SEQ ID NO: 611241 - RNA, 19 nt, Human
ucacugcaaccuccgccuc

SEQ ID NO: 611242 - RNA, 24 nt, Human
ucacugcaaccuccgccucccagg

SEQ ID NO: 611243 - RNA, 25 nt, Human
ucacugcaaccuccgccucccaggu

SEQ ID NO: 611244 - RNA, 27 nt, Human
ucacugcaaccuccgccucccagguuc

SEQ ID NO: 611245 - RNA, 20 nt, Human
ucagccucccgaguagcugg

SEQ ID NO: 611246 - RNA, 24 nt, Human
ucccaaagugcugggauuacaggc

SEQ ID NO: 611247 - RNA, 21 nt, Human
ucccagguucaagugauucuc

SEQ ID NO: 611248 - RNA, 24 nt, Human
ucccagguucaagugauucuccug

SEQ ID NO: 611249 - RNA, 19 nt, Human
ucccccugccucggccucc

SEQ ID NO: 611250 - RNA, 24 nt, Human
ucccgaguagcugggauuacaggc

SEQ ID NO: 611251 - RNA, 18 nt, Human
ucggccucccaaagugcu

SEQ ID NO: 611252 - RNA, 24 nt, Human
ucuccugccucagccucccgagua

SEQ ID NO: 611253 - RNA, 22 nt, Human
ucuuguugcccaggcuggagug

SEQ ID NO: 611254 - RNA, 18 nt, Human
ugcccaggcuggagugca

SEQ ID NO: 611255 - RNA, 21 nt, Human
ugcccaggcuggagugcaaug

SEQ ID NO: 611256 - RNA, 24 nt, Human
ugcccaggcuggagugcaauggca

SEQ ID NO: 611257 - RNA, 24 nt, Human
ugccucagccucccgaguagcugg

SEQ ID NO: 611258 - RNA, 21 nt, Human
ugccucggccucccaaagugc

SEQ ID NO: 611259 - RNA, 24 nt, Human
ugccucggccucccaaagugcugg

SEQ ID NO: 611260 - RNA, 24 nt, Human
ugcugggauuacaggcgugagcca

SEQ ID NO: 611261 - RNA, 19 nt, Human
uggagugcaauggcaugau

SEQ ID NO: 611262 - RNA, 23 nt, Human
uggagugcaauggcaugaucucg

SEQ ID NO: 611263 - RNA, 23 nt, Human
uggccagccuggucucgaacucg

SEQ ID NO: 611264 - RNA, 18 nt, Human
ugggauuacaggcgugag

SEQ ID NO: 611265 - RNA, 19 nt, Human
ugggauuacaggcgugagc

SEQ ID NO: 611266 - RNA, 22 nt, Human
ugggauuacaggcgugagccac

SEQ ID NO: 611267 - RNA, 23 nt, Human
ugggauuacaggcgugagccacc

SEQ ID NO: 611268 - RNA, 24 nt, Human
ugggauuacaggcgugagccacca

SEQ ID NO: 611269 - RNA, 21 nt, Human
ugggauuacaggcgugcacca

SEQ ID NO: 611270 - RNA, 22 nt, Human
ugggauuacaggcgugcaccac

SEQ ID NO: 611271 - RNA, 24 nt, Human
ugggauuacaggcgugcaccacca

SEQ ID NO: 611272 - RNA, 21 nt, Human
uguucuuccccuuugguggca

SEQ ID NO: 611273 - RNA, 20 nt, Human
uguugcccaggcuggagugc

SEQ ID NO: 611274 - RNA, 22 nt, Human
uuaguagagacagcguuucacc

SEQ ID NO: 611275 - RNA, 24 nt, Human
uuaguagagacagcguuucaccgu

SEQ ID NO: 611276 - RNA, 21 nt, Human
uucaagugauucuccugccuc

SEQ ID NO: 611277 - RNA, 23 nt, Human
uucaagugauucuccugccucag

SEQ ID NO: 611278 - RNA, 24 nt, Human
uucaagugauucuccugccucagc

SEQ ID NO: 611279 - RNA, 24 nt, Human
uucacucuuguugcccaggcugga

SEQ ID NO: 611280 - RNA, 18 nt, Human
uugcccaggcuggagugc

SEQ ID NO: 611281 - RNA, 19 nt, Human
uuggccagccuggucucga

SEQ ID NO: 611282 - RNA, 21 nt, Human
uuucaccguguuggccagccu

SEQ ID NO: 611283 - RNA, 24 nt, Human
uuucacucuuguugcccaggcugg

SEQ ID NO: 611284 - RNA, 23 nt, Human
uuuguauuuuuaguagagacagc

SEQ ID NO: 611285 - RNA, 24 nt, Human
uuuuuaguagagacagcguuucac

SEQ ID NO: 611286 - RNA, 20 nt, Human
uuuuuguauuuuuaguagag

SEQ ID NO: 611287 - RNA, 24 nt, Human
aaagugcugggauuacaggcguga

SEQ ID NO: 611288 - RNA, 24 nt, Human
aaagugcugggauuacagguguga

SEQ ID NO: 611289 - RNA, 23 nt, Human
aacauccccuggagugacaagga

SEQ ID NO: 611290 - RNA, 21 nt, Human
aaccaaagaccccugggcucu

SEQ ID NO: 611291 - RNA, 25 nt, Human
aagcucuuggcucacggcaacaucc

SEQ ID NO: 611292 - RNA, 19 nt, Human
aaguagcugggacuacaga

SEQ ID NO: 611293 - RNA, 24 nt, Human
aaguagcugggacuacagaugggu

SEQ ID NO: 611294 - RNA, 26 nt, Human
aaguagcugggacuacagaugggugc

SEQ ID NO: 611295 - RNA, 18 nt, Human
aagugcugggauuacagg

SEQ ID NO: 611296 - RNA, 19 nt, Human
aagugcugggauuacaggc

SEQ ID NO: 611297 - RNA, 19 nt, Human
aagugcugggauuacaggc

SEQ ID NO: 611298 - RNA, 26 nt, Human
aagugcugggauuacaggcgugagcc

SEQ ID NO: 611299 - RNA, 19 nt, Human
aagugcugggauuacaggu

SEQ ID NO: 611300 - RNA, 26 nt, Human
aagugcugggauuacaggugugagcc

SEQ ID NO: 611301 - RNA, 18 nt, Human
acaacuucuaagaggccg

SEQ ID NO: 611302 - RNA, 18 nt, Human
acaccgcacucuggccgg

SEQ ID NO: 611303 - RNA, 19 nt, Human
acacuggucucgcuggugg

SEQ ID NO: 611304 - RNA, 21 nt, Human
acaggcaccugccaccaugcc

SEQ ID NO: 611305 - RNA, 22 nt, Human
accacaggacagagaucgagac

SEQ ID NO: 611306 - RNA, 20 nt, Human
acccuggcucugagccccug

SEQ ID NO: 611307 - RNA, 23 nt, Human
accucagccucccaaguagcugg

SEQ ID NO: 611308 - RNA, 21 nt, Human
acgcaggaggugcaaccaaag

SEQ ID NO: 611309 - RNA, 18 nt, Human
acgccuggggcugugcuc

SEQ ID NO: 611310 - RNA, 18 nt, Human
acgggguuucaccguguu

SEQ ID NO: 611311 - RNA, 19 nt, Human
acgggguuucaccguguua

SEQ ID NO: 611312 - RNA, 20 nt, Human
acgggguuucaccguguuag

SEQ ID NO: 611313 - RNA, 22 nt, Human
acgggguuucaccguguuagcc

SEQ ID NO: 611314 - RNA, 24 nt, Human
acgggguuucaccguguuagccgg

SEQ ID NO: 611315 - RNA, 19 nt, Human
acucucagucccagcaucu

SEQ ID NO: 611316 - RNA, 20 nt, Human
agaugccagcccgacugugg

SEQ ID NO: 611317 - RNA, 24 nt, Human
agcagggacggaggcuccaccaug

SEQ ID NO: 611318 - RNA, 19 nt, Human
agccaccacacuggucucg

SEQ ID NO: 611319 - RNA, 19 nt, Human
agccccucuccacccuccc

SEQ ID NO: 611320 - RNA, 18 nt, Human
aggaggcccuucagaccc

SEQ ID NO: 611321 - RNA, 25 nt, Human
aggcgauccucccaccucagccucc

SEQ ID NO: 611322 - RNA, 25 nt, Human
aggcuggagugcaguggugugaucu

SEQ ID NO: 611323 - RNA, 23 nt, Human
agggauccaccugccuugacuuc

SEQ ID NO: 611324 - RNA, 20 nt, Human
aguagagacgggguuucacc

SEQ ID NO: 611325 - RNA, 21 nt, Human
aguagagacgggguuucaccg

SEQ ID NO: 611326 - RNA, 18 nt, Human
aguagcugggacuacagg

SEQ ID NO: 611327 - RNA, 19 nt, Human
aguagcugggacuacaggc

SEQ ID NO: 611328 - RNA, 19 nt, Human
agugcaguggugugaucuc

SEQ ID NO: 611329 - RNA, 20 nt, Human
agugcaguggugugaucucg

SEQ ID NO: 611330 - RNA, 23 nt, Human
agugcaguggugugaucucggcu

SEQ ID NO: 611331 - RNA, 24 nt, Human
agugcaguggugugaucucggcuc

SEQ ID NO: 611332 - RNA, 22 nt, Human
agugcauacaccccuacuccag

SEQ ID NO: 611333 - RNA, 18 nt, Human
agugcugggauuacaggc

SEQ ID NO: 611334 - RNA, 18 nt, Human
augagcagggacggaggc

SEQ ID NO: 611335 - RNA, 19 nt, Human
auguugcccaggcuggucu

SEQ ID NO: 611336 - RNA, 24 nt, Human
caaagugcugggauuacaggcgug

SEQ ID NO: 611337 - RNA, 24 nt, Human
caaagugcugggauuacaggugug

SEQ ID NO: 611338 - RNA, 18 nt, Human
caaccaaagaccccuggg

SEQ ID NO: 611339 - RNA, 23 nt, Human
caagcucuuggcucacggcaaca

SEQ ID NO: 611340 - RNA, 24 nt, Human
caccacacuggucucgcugguggu

SEQ ID NO: 611341 - RNA, 21 nt, Human
caccaugacacucucaguccc

SEQ ID NO: 611342 - RNA, 24 nt, Human
caccguguuagccgggauggucuc

SEQ ID NO: 611343 - RNA, 23 nt, Human
caccugccuugacuucccaaagu

SEQ ID NO: 611344 - RNA, 22 nt, Human
cacgccauucuucugccucagc

SEQ ID NO: 611345 - RNA, 21 nt, Human
cacuguaagcuccaccuccca

SEQ ID NO: 611346 - RNA, 22 nt, Human
cagagggaaagcugaccaggac

SEQ ID NO: 611347 - RNA, 25 nt, Human
cagcaacauccccuggagugacugg

SEQ ID NO: 611348 - RNA, 18 nt, Human
cagcacaccgcacucugg

SEQ ID NO: 611349 - RNA, 24 nt, Human
cagcaucuccucagcccagucacc

SEQ ID NO: 611350 - RNA, 24 nt, Human
cagggucuugcucuguugcccagg

SEQ ID NO: 611351 - RNA, 18 nt, Human
caggugggguaaaggcag

SEQ ID NO: 611352 - RNA, 27 nt, Human
caucucagccugcagugcauacacccc

SEQ ID NO: 611353 - RNA, 21 nt, Human
caucuccucagcccagucacc

SEQ ID NO: 611354 - RNA, 21 nt, Human
ccaaagugcugggauuacagg

SEQ ID NO: 611355 - RNA, 21 nt, Human
ccaaagugcugggauuacagg

SEQ ID NO: 611356 - RNA, 22 nt, Human
ccaaagugcugggauuacaggc

SEQ ID NO: 611357 - RNA, 22 nt, Human
ccaaagugcugggauuacaggc

SEQ ID NO: 611358 - RNA, 24 nt, Human
ccaaagugcugggauuacaggcgu

SEQ ID NO: 611359 - RNA, 24 nt, Human
ccaaagugcugggauuacaggugu

SEQ ID NO: 611360 - RNA, 21 nt, Human
ccacaggacagagaucgagac

SEQ ID NO: 611361 - RNA, 20 nt, Human
ccaccgcgcccagcccugcc

SEQ ID NO: 611362 - RNA, 20 nt, Human
ccaccgcgcccagcccugcc

SEQ ID NO: 611363 - RNA, 22 nt, Human
ccagcacagcacaccgcacucu

SEQ ID NO: 611364 - RNA, 27 nt, Human
ccagcacagcacaccgcacucuggccg

SEQ ID NO: 611365 - RNA, 22 nt, Human
ccagcaucuccucagcccaguc

SEQ ID NO: 611366 - RNA, 27 nt, Human
ccagcccugccuggcuaguuuuuguaa

SEQ ID NO: 611367 - RNA, 20 nt, Human
ccaggcuggagugcaguggu

SEQ ID NO: 611368 - RNA, 23 nt, Human
cccaaguagcugggacuacagau

SEQ ID NO: 611369 - RNA, 23 nt, Human
cccaccucagccucccaaguagc

SEQ ID NO: 611370 - RNA, 22 nt, Human
cccaggcuggagugcaguggug

SEQ ID NO: 611371 - RNA, 21 nt, Human
ccccaggcuggagugcagugg

SEQ ID NO: 611372 - RNA, 24 nt, Human
ccccugaucacaccugcugacacc

SEQ ID NO: 611373 - RNA, 18 nt, Human
ccccugggcucucacagg

SEQ ID NO: 611374 - RNA, 23 nt, Human
cccgaguagcugggacuacaggc

SEQ ID NO: 611375 - RNA, 24 nt, Human
cccgaguagcugggacuacaggca

SEQ ID NO: 611376 - RNA, 22 nt, Human
cccuacuccaggccugucccuc

SEQ ID NO: 611377 - RNA, 25 nt, Human
cccucaggcucaggcgauccuccca

SEQ ID NO: 611378 - RNA, 20 nt, Human
cccuggagugacaaggacuc

SEQ ID NO: 611379 - RNA, 21 nt, Human
cccugggcucucacaggaccc

SEQ ID NO: 611380 - RNA, 22 nt, Human
cccugggcucucacaggacccu

SEQ ID NO: 611381 - RNA, 24 nt, Human
ccucccaaguucacgccauucuuc

SEQ ID NO: 611382 - RNA, 23 nt, Human
ccucccaccucagccucccaagu

SEQ ID NO: 611383 - RNA, 24 nt, Human
ccuccugcuggacacuugccccuc

SEQ ID NO: 611384 - RNA, 18 nt, Human
ccucugcacccugggagu

SEQ ID NO: 611385 - RNA, 21 nt, Human
ccugagcucaagggauccacc

SEQ ID NO: 611386 - RNA, 22 nt, Human
ccugaucacaccugcugacacc

SEQ ID NO: 611387 - RNA, 22 nt, Human
cgagauccgcccgccucggccu

SEQ ID NO: 611388 - RNA, 24 nt, Human
cgccucggccucccaaagugcugg

SEQ ID NO: 611389 - RNA, 18 nt, Human
cgccucuggggugugggg

SEQ ID NO: 611390 - RNA, 23 nt, Human
cgcgcccagcccugccuggcuag

SEQ ID NO: 611391 - RNA, 23 nt, Human
cgcgucugacucucuuccugcag

SEQ ID NO: 611392 - RNA, 20 nt, Human
cggcaacaucccccucaggc

SEQ ID NO: 611393 - RNA, 24 nt, Human
cgggguuucaccguguuagccggg

SEQ ID NO: 611394 - RNA, 24 nt, Human
cucacaggacccuggcucugagcc

SEQ ID NO: 611395 - RNA, 21 nt, Human
cucacggcaacaucccccuca

SEQ ID NO: 611396 - RNA, 24 nt, Human
cucacuguaagcuccaccucccaa

SEQ ID NO: 611397 - RNA, 21 nt, Human
cucagccccucuccacccucc

SEQ ID NO: 611398 - RNA, 24 nt, Human
cucagccucccaaguagcugggac

SEQ ID NO: 611399 - RNA, 24 nt, Human
cucagccucccgaguagcugggac

SEQ ID NO: 611400 - RNA, 24 nt, Human
cucaggcgauccucccaccucagc

SEQ ID NO: 611401 - RNA, 20 nt, Human
cucaggcucaggcgauccuc

SEQ ID NO: 611402 - RNA, 19 nt, Human
cucaucucagccugcagug

SEQ ID NO: 611403 - RNA, 19 nt, Human
cuccagcacagcacaccgc

SEQ ID NO: 611404 - RNA, 24 nt, Human
cuccugaccucgagauccgcccgc

SEQ ID NO: 611405 - RNA, 24 nt, Human
cucgcucugucccccaggcuggag

SEQ ID NO: 611406 - RNA, 19 nt, Human
cucuggguggcagugaggu

SEQ ID NO: 611407 - RNA, 20 nt, Human
cucugucccccaggcuggag

SEQ ID NO: 611408 - RNA, 20 nt, Human
cucuguugcccaggcuggag

SEQ ID NO: 611409 - RNA, 23 nt, Human
cugccucagccucccgaguagcu

SEQ ID NO: 611410 - RNA, 24 nt, Human
cuguaagcuccaccucccaaguuc

SEQ ID NO: 611411 - RNA, 23 nt, Human
cuucccugccacacccucugccc

SEQ ID NO: 611412 - RNA, 21 nt, Human
cuugcucuguugcccaggcug

SEQ ID NO: 611413 - RNA, 24 nt, Human
gacuacaggcaccugccaccaugc

SEQ ID NO: 611414 - RNA, 21 nt, Human
gagacagggucuugcucuguu

SEQ ID NO: 611415 - RNA, 24 nt, Human
gagacgggguuucaccguguuagc

SEQ ID NO: 611416 - RNA, 24 nt, Human
gagcucaagggauccaccugccuu

SEQ ID NO: 611417 - RNA, 18 nt, Human
gaggaggcccuucagacc

SEQ ID NO: 611418 - RNA, 27 nt, Human
gaggcccuucagaccccgcaggccucu

SEQ ID NO: 611419 - RNA, 25 nt, Human
gaguagcugggacuacaggcaccug

SEQ ID NO: 611420 - RNA, 18 nt, Human
gagugcugagugagcagc

SEQ ID NO: 611421 - RNA, 22 nt, Human
gauccgcccgccucggccuccc

SEQ ID NO: 611422 - RNA, 18 nt, Human
gauuacaggcgugagcca

SEQ ID NO: 611423 - RNA, 22 nt, Human
gauuacaggcgugagccaccgc

SEQ ID NO: 611424 - RNA, 22 nt, Human
gauuacaggcgugagccaccgc

SEQ ID NO: 611425 - RNA, 18 nt, Human
gauuacaggugugagcca

SEQ ID NO: 611426 - RNA, 21 nt, Human
gauuacaggugugagccacca

SEQ ID NO: 611427 - RNA, 22 nt, Human
gauuacaggugugagccaccac

SEQ ID NO: 611428 - RNA, 22 nt, Human
gcaacaucccccucaggcucag

SEQ ID NO: 611429 - RNA, 25 nt, Human
gcccagcuaauuuuuuuuguauuuu

SEQ ID NO: 611430 - RNA, 19 nt, Human
gcccaggcuggaguccagu

SEQ ID NO: 611431 - RNA, 25 nt, Human
gcucuguugcccaggcuggagucca

SEQ ID NO: 611432 - RNA, 24 nt, Human
ggauggucucaaucuccugaccuc

SEQ ID NO: 611433 - RNA, 23 nt, Human
ggccagcauauggcaucugugug

SEQ ID NO: 611434 - RNA, 22 nt, Human
ggcuggagugcaguggugugau

SEQ ID NO: 611435 - RNA, 24 nt, Human
ggcuggucuugaacuccugagcuc

SEQ ID NO: 611436 - RNA, 22 nt, Human
gggagucucuguuucagccucc

SEQ ID NO: 611437 - RNA, 24 nt, Human
gggauccaccugccuugacuuccc

SEQ ID NO: 611438 - RNA, 28 nt, Human
gggcccaggugggguaaaggggacugcc

SEQ ID NO: 611439 - RNA, 20 nt, Human
gggggcugagugcuggagug

SEQ ID NO: 611440 - RNA, 23 nt, Human
gggguuucaccguguuagccggg

SEQ ID NO: 611441 - RNA, 21 nt, Human
ggguguggggguguugguccu

SEQ ID NO: 611442 - RNA, 23 nt, Human
guagagacgggguuucaccgugu

SEQ ID NO: 611443 - RNA, 18 nt, Human
guagagauggggucuugc

SEQ ID NO: 611444 - RNA, 19 nt, Human
guauuuuuuguagagaugg

SEQ ID NO: 611445 - RNA, 21 nt, Human
gucccagcaucuccucagccc

SEQ ID NO: 611446 - RNA, 24 nt, Human
gucuugcucuguugcccaggcugg

SEQ ID NO: 611447 - RNA, 23 nt, Human
guuuuuuuuuuuuuuuuuuuggg

SEQ ID NO: 611448 - RNA, 24 nt, Human
uacaggcaccugccaccaugccca

SEQ ID NO: 611449 - RNA, 24 nt, Human
uacaggcgugagccaccgcgccca

SEQ ID NO: 611450 - RNA, 21 nt, Human
uacaggugugagccaccacac

SEQ ID NO: 611451 - RNA, 21 nt, Human
uacaggugugagccaccacac

SEQ ID NO: 611452 - RNA, 22 nt, Human
uacaggugugagccaccacacu

SEQ ID NO: 611453 - RNA, 22 nt, Human
uagagauggggucuugcuaugu

SEQ ID NO: 611454 - RNA, 21 nt, Human
uaguagagacgggguuucacc

SEQ ID NO: 611455 - RNA, 24 nt, Human
uaguagagacgggguuucaccgug

SEQ ID NO: 611456 - RNA, 26 nt, Human
uaguagagacgggguuucaccguguu

SEQ ID NO: 611457 - RNA, 24 nt, Human
uaguuuuuguauuuuuuguagaga

SEQ ID NO: 611458 - RNA, 23 nt, Human
uauguugcccaggcuggucuuga

SEQ ID NO: 611459 - RNA, 24 nt, Human
uauguugcccaggcuggucuugaa

SEQ ID NO: 611460 - RNA, 24 nt, Human
ucaccguguuagccgggauggucu

SEQ ID NO: 611461 - RNA, 19 nt, Human
ucacugccucucacugggc

SEQ ID NO: 611462 - RNA, 19 nt, Human
ucacuguaagcuccaccuc

SEQ ID NO: 611463 - RNA, 24 nt, Human
ucacuguaagcuccaccucccaag

SEQ ID NO: 611464 - RNA, 20 nt, Human
ucagccccucuccacccucc

SEQ ID NO: 611465 - RNA, 18 nt, Human
ucagccucccaaguagcu

SEQ ID NO: 611466 - RNA, 20 nt, Human
ucagccucccaaguagcugg

SEQ ID NO: 611467 - RNA, 23 nt, Human
ucagccucccgaguagcugggac

SEQ ID NO: 611468 - RNA, 23 nt, Human
ucccaaagugcugggauuacagg

SEQ ID NO: 611469 - RNA, 24 nt, Human
ucccaaagugcugggauuacaggc

SEQ ID NO: 611470 - RNA, 23 nt, Human
ucccaaguagcugggacuacaga

SEQ ID NO: 611471 - RNA, 20 nt, Human
ucccaaguucacgccauucu

SEQ ID NO: 611472 - RNA, 24 nt, Human
ucccaaguucacgccauucuucug

SEQ ID NO: 611473 - RNA, 24 nt, Human
ucccccaggcuggagugcaguggu

SEQ ID NO: 611474 - RNA, 24 nt, Human
ucccgaguagcugggacuacaggc

SEQ ID NO: 611475 - RNA, 18 nt, Human
ucccucagccccucucca

SEQ ID NO: 611476 - RNA, 27 nt, Human
uccucccaccucagccucccaaguagc

SEQ ID NO: 611477 - RNA, 18 nt, Human
ucggccucccaaagugcu

SEQ ID NO: 611478 - RNA, 18 nt, Human
ucucacaggacccuggcu

SEQ ID NO: 611479 - RNA, 22 nt, Human
ucucacuucccugccacacccu

SEQ ID NO: 611480 - RNA, 22 nt, Human
ucucgcucugucccccaggcug

SEQ ID NO: 611481 - RNA, 23 nt, Human
ucucgcucugucccccaggcugg

SEQ ID NO: 611482 - RNA, 24 nt, Human
ucucgcucugucccccaggcugga

SEQ ID NO: 611483 - RNA, 23 nt, Human
ucucgcuggugguuuucccccgg

SEQ ID NO: 611484 - RNA, 19 nt, Human
ucuggccggcugucuuccc

SEQ ID NO: 611485 - RNA, 20 nt, Human
ucugggaaggugggagucuc

SEQ ID NO: 611486 - RNA, 19 nt, Human
ucugucccccaggcuggag

SEQ ID NO: 611487 - RNA, 24 nt, Human
ucugucccccaggcuggagugcag

SEQ ID NO: 611488 - RNA, 22 nt, Human
ucuguguggcacugcccaggag

SEQ ID NO: 611489 - RNA, 18 nt, Human
ucuguugcccaggcugga

SEQ ID NO: 611490 - RNA, 22 nt, Human
ucuugaacuccugagcucaagg

SEQ ID NO: 611491 - RNA, 18 nt, Human
ucuugcuauguugcccag

SEQ ID NO: 611492 - RNA, 19 nt, Human
ucuugcuauguugcccagg

SEQ ID NO: 611493 - RNA, 23 nt, Human
ucuugcuauguugcccaggcugg

SEQ ID NO: 611494 - RNA, 24 nt, Human
ucuugcuauguugcccaggcuggu

SEQ ID NO: 611495 - RNA, 22 nt, Human
ucuugcucuguugcccaggcug

SEQ ID NO: 611496 - RNA, 23 nt, Human
ucuugcucuguugcccaggcugg

SEQ ID NO: 611497 - RNA, 24 nt, Human
ucuugcucuguugcccaggcugga

SEQ ID NO: 611498 - RNA, 22 nt, Human
ugagacggagucucgcucuguc

SEQ ID NO: 611499 - RNA, 20 nt, Human
ugagccccugaucacaccug

SEQ ID NO: 611500 - RNA, 20 nt, Human
ugagugagcagcaacauccc

SEQ ID NO: 611501 - RNA, 22 nt, Human
ugcaguggugugaucucggcuc

SEQ ID NO: 611502 - RNA, 27 nt, Human
ugcccaggcuggaguccagucacaagc

SEQ ID NO: 611503 - RNA, 24 nt, Human
ugcccaggcuggucuugaacuccu

SEQ ID NO: 611504 - RNA, 28 nt, Human
ugcccaggcuggucuugaacuccugagc

SEQ ID NO: 611505 - RNA, 24 nt, Human
ugccucagccucccgaguagcugg

SEQ ID NO: 611506 - RNA, 24 nt, Human
ugcuauguugcccaggcuggucuu

SEQ ID NO: 611507 - RNA, 27 nt, Human
ugcuauguugcccaggcuggucuugaa

SEQ ID NO: 611508 - RNA, 24 nt, Human
ugcugggauuacaggcgugagcca

SEQ ID NO: 611509 - RNA, 24 nt, Human
ugcugggauuacaggugugagcca

SEQ ID NO: 611510 - RNA, 19 nt, Human
uggagugcaguggugugau

SEQ ID NO: 611511 - RNA, 23 nt, Human
uggagugcaguggugugaucucg

SEQ ID NO: 611512 - RNA, 24 nt, Human
uggagugcaguggugugaucucgg

SEQ ID NO: 611513 - RNA, 24 nt, Human
uggcuaguuuuuuuuuuuuuuuuu

SEQ ID NO: 611514 - RNA, 21 nt, Human
ugggacuacagaugggugcca

SEQ ID NO: 611515 - RNA, 24 nt, Human
ugggacuacagaugggugccacca

SEQ ID NO: 611516 - RNA, 21 nt, Human
ugggacuacaggcaccugcca

SEQ ID NO: 611517 - RNA, 22 nt, Human
ugggacuacaggcaccugccac

SEQ ID NO: 611518 - RNA, 24 nt, Human
ugggacuacaggcaccugccacca

SEQ ID NO: 611519 - RNA, 25 nt, Human
ugggacuacaggcaccugccaccau

SEQ ID NO: 611520 - RNA, 18 nt, Human
ugggauuacaggcgugag

SEQ ID NO: 611521 - RNA, 19 nt, Human
ugggauuacaggcgugagc

SEQ ID NO: 611522 - RNA, 21 nt, Human
ugggauuacaggcgugagcca

SEQ ID NO: 611523 - RNA, 22 nt, Human
ugggauuacaggcgugagccac

SEQ ID NO: 611524 - RNA, 23 nt, Human
ugggauuacaggcgugagccacc

SEQ ID NO: 611525 - RNA, 24 nt, Human
ugggauuacaggcgugagccaccg

SEQ ID NO: 611526 - RNA, 18 nt, Human
ugggauuacaggugugag

SEQ ID NO: 611527 - RNA, 19 nt, Human
ugggauuacaggugugagc

SEQ ID NO: 611528 - RNA, 22 nt, Human
ugggauuacaggugugagccac

SEQ ID NO: 611529 - RNA, 23 nt, Human
ugggauuacaggugugagccacc

SEQ ID NO: 611530 - RNA, 24 nt, Human
ugggauuacaggugugagccacca

SEQ ID NO: 611531 - RNA, 24 nt, Human
uggggucuugcuauguugcccagg

SEQ ID NO: 611532 - RNA, 19 nt, Human
uggucccugggcacuuccc

SEQ ID NO: 611533 - RNA, 21 nt, Human
uggucccugggcacuucccug

SEQ ID NO: 611534 - RNA, 24 nt, Human
uggugugaucucggcucacuguaa

SEQ ID NO: 611535 - RNA, 24 nt, Human
uguagagauggggucuugcuaugu

SEQ ID NO: 611536 - RNA, 21 nt, Human
uguauuuuuaguagagacggg

SEQ ID NO: 611537 - RNA, 21 nt, Human
uguguggcacugcccaggaga

SEQ ID NO: 611538 - RNA, 22 nt, Human
uguguggcacugcccaggagac

SEQ ID NO: 611539 - RNA, 18 nt, Human
uuaguagagacgggguuu

SEQ ID NO: 611540 - RNA, 22 nt, Human
uuaguagagacgggguuucacc

SEQ ID NO: 611541 - RNA, 24 nt, Human
uuaguagagacgggguuucaccgu

SEQ ID NO: 611542 - RNA, 19 nt, Human
uucccugccacacccucug

SEQ ID NO: 611543 - RNA, 24 nt, Human
uugcucuguugcccaggcuggagu

SEQ ID NO: 611544 - RNA, 24 nt, Human
uuguagagauggggucuugcuaug

SEQ ID NO: 611545 - RNA, 23 nt, Human
uuguauuuuuaguagagacgggg

SEQ ID NO: 611546 - RNA, 19 nt, Human
uuucaccguguuagccggg

SEQ ID NO: 611547 - RNA, 20 nt, Human
uuuguagagauggggucuug

SEQ ID NO: 611548 - RNA, 24 nt, Human
uuuguagagauggggucuugcuau

SEQ ID NO: 611549 - RNA, 20 nt, Human
uuugucacgccuggggcugu

SEQ ID NO: 611550 - RNA, 21 nt, Human
uuuuguauuuuuaguagagac

SEQ ID NO: 611551 - RNA, 24 nt, Human
uuuuuaguagagacgggguuucac

SEQ ID NO: 611552 - RNA, 21 nt, Human
uuuuuguauuuuuaguagaga

SEQ ID NO: 611553 - RNA, 20 nt, Human
uuuuuguauuuuuuguagag

SEQ ID NO: 611554 - RNA, 21 nt, Human
uuuuuguauuuuuuguagaga

SEQ ID NO: 611555 - RNA, 23 nt, Human
uuuuuguauuuuuuguagagaug

SEQ ID NO: 611556 - RNA, 24 nt, Human
uuuuuuguagagauggggucuugc

SEQ ID NO: 611557 - RNA, 21 nt, Human
uuuuuuguauuuuuaguagag

SEQ ID NO: 611558 - RNA, 25 nt, Human
uuuuuuuuuuuugagacggagucuc

SEQ ID NO: 611559 - RNA, 22 nt, Human
uuuuuuuuuuuuuugagacgga

SEQ ID NO: 611560 - RNA, 19 nt, Human
aaaaaaaaaaaaaaaggca

SEQ ID NO: 611561 - RNA, 23 nt, Human
aaaaaaaaaaaaaaaggcagcca

SEQ ID NO: 611562 - RNA, 28 nt, Human
aaaaaaaaaaaaggcagccaggaccuga

SEQ ID NO: 611563 - RNA, 19 nt, Human
aaaauuuuccccagcacac

SEQ ID NO: 611564 - RNA, 19 nt, Human
aaagaaacaggacuuugca

SEQ ID NO: 611565 - RNA, 22 nt, Human
aaagcucccccuucagcugccc

SEQ ID NO: 611566 - RNA, 19 nt, Human
aagcaggggguggagagcg

SEQ ID NO: 611567 - RNA, 26 nt, Human
aagcaggggguggagagcgggggacc

SEQ ID NO: 611568 - RNA, 27 nt, Human
aagcaggggguggagagcgggggaccc

SEQ ID NO: 611569 - RNA, 24 nt, Human
acaaagcaagaccauguaugucuu

SEQ ID NO: 611570 - RNA, 24 nt, Human
acacugccacugcacuccagccug

SEQ ID NO: 611571 - RNA, 19 nt, Human
accucauccaagagaugau

SEQ ID NO: 611572 - RNA, 20 nt, Human
acucuacugcccaguauugg

SEQ ID NO: 611573 - RNA, 18 nt, Human
acugcacuccagccuggg

SEQ ID NO: 611574 - RNA, 23 nt, Human
acugcacuccagccugggcgaca

SEQ ID NO: 611575 - RNA, 21 nt, Human
agcaacucgggcugagguggg

SEQ ID NO: 611576 - RNA, 23 nt, Human
agcacuuugggaggcugaggcag

SEQ ID NO: 611577 - RNA, 24 nt, Human
agcacuuugggaggcugaggcagg

SEQ ID NO: 611578 - RNA, 20 nt, Human
agcgcaugggucacugcugg

SEQ ID NO: 611579 - RNA, 23 nt, Human
agcuggguaugguggcgugugcc

SEQ ID NO: 611580 - RNA, 24 nt, Human
aggauugcuugagcucaggaguuc

SEQ ID NO: 611581 - RNA, 19 nt, Human
aggcaggaggauugcuuga

SEQ ID NO: 611582 - RNA, 23 nt, Human
aggcaggaggauugcuugagcuc

SEQ ID NO: 611583 - RNA, 21 nt, Human
aggcugaggcaggaggauugc

SEQ ID NO: 611584 - RNA, 24 nt, Human
aggcugaggcaggaggauugcuug

SEQ ID NO: 611585 - RNA, 24 nt, Human
agguugaggcugcagugagccaug

SEQ ID NO: 611586 - RNA, 24 nt, Human
aguggcucacgccuguaauccuag

SEQ ID NO: 611587 - RNA, 19 nt, Human
auugcuugagcccagcagg

SEQ ID NO: 611588 - RNA, 18 nt, Human
caccucuaagcauauucu

SEQ ID NO: 611589 - RNA, 19 nt, Human
caccuggcauuagggccag

SEQ ID NO: 611590 - RNA, 20 nt, Human
cacgccuguaauccuagcac

SEQ ID NO: 611591 - RNA, 24 nt, Human
cacgccuguaauccuagcacuuug

SEQ ID NO: 611592 - RNA, 19 nt, Human
cacugcacuccagccuggg

SEQ ID NO: 611593 - RNA, 20 nt, Human
cacugcacuccagccugggc

SEQ ID NO: 611594 - RNA, 22 nt, Human
cacugcacuccagccugggcga

SEQ ID NO: 611595 - RNA, 23 nt, Human
cacugcacuccagccugggcgac

SEQ ID NO: 611596 - RNA, 24 nt, Human
cacugcacuccagccugggcgaca

SEQ ID NO: 611597 - RNA, 26 nt, Human
cacugcacuccagccugggcgacaaa

SEQ ID NO: 611598 - RNA, 20 nt, Human
cacugcuggcccagacuccu

SEQ ID NO: 611599 - RNA, 19 nt, Human
cagauaggccccaaguccu

SEQ ID NO: 611600 - RNA, 22 nt, Human
cagggccacaccucauccaaga

SEQ ID NO: 611601 - RNA, 19 nt, Human
caggggguggagagcggca

SEQ ID NO: 611602 - RNA, 23 nt, Human
caggggguggagagcggcaacug

SEQ ID NO: 611603 - RNA, 21 nt, Human
cagugagccaugacacugcca

SEQ ID NO: 611604 - RNA, 22 nt, Human
caugucucaagcucugggagaa

SEQ ID NO: 611605 - RNA, 24 nt, Human
caugucucaagcucugggagaagg

SEQ ID NO: 611606 - RNA, 19 nt, Human
ccacaggucugcgcaggca

SEQ ID NO: 611607 - RNA, 20 nt, Human
ccacugcacuccagccuggg

SEQ ID NO: 611608 - RNA, 20 nt, Human
ccacugcacuccagccuggg

SEQ ID NO: 611609 - RNA, 21 nt, Human
ccacugcacuccagccugggc

SEQ ID NO: 611610 - RNA, 21 nt, Human
ccacugcacuccagccugggc

SEQ ID NO: 611611 - RNA, 24 nt, Human
ccacugcacuccagccugggcgac

SEQ ID NO: 611612 - RNA, 24 nt, Human
ccagggcagggccacacaccugcc

SEQ ID NO: 611613 - RNA, 21 nt, Human
cccacacucacuacggggcca

SEQ ID NO: 611614 - RNA, 20 nt, Human
cccagcaacucgggcugagg

SEQ ID NO: 611615 - RNA, 24 nt, Human
cccagcaacucgggcugagguggg

SEQ ID NO: 611616 - RNA, 23 nt, Human
ccccuucagcugcccaugagggc

SEQ ID NO: 611617 - RNA, 20 nt, Human
ccuauggcagcagggggcuc

SEQ ID NO: 611618 - RNA, 22 nt, Human
ccugucaucccagcaacucggg

SEQ ID NO: 611619 - RNA, 22 nt, Human
ccuuccacgagcaggcgagggu

SEQ ID NO: 611620 - RNA, 23 nt, Human
cgaaacucuacugcccaguauug

SEQ ID NO: 611621 - RNA, 18 nt, Human
cgccuguaauccuagcac

SEQ ID NO: 611622 - RNA, 24 nt, Human
cgccuguaauccuagcacuuuggg

SEQ ID NO: 611623 - RNA, 24 nt, Human
cggguaaguggcucacgccuguaa

SEQ ID NO: 611624 - RNA, 24 nt, Human
cucacgccuguaauccuagcacuu

SEQ ID NO: 611625 - RNA, 22 nt, Human
cucauggaggccucaaaagggc

SEQ ID NO: 611626 - RNA, 19 nt, Human
cuccaaaaccugcccucuc

SEQ ID NO: 611627 - RNA, 23 nt, Human
cucucagguaaauacagcagcac

SEQ ID NO: 611628 - RNA, 20 nt, Human
cuugagcucaggaguucaag

SEQ ID NO: 611629 - RNA, 23 nt, Human
cuugagcucaggaguucaagacu

SEQ ID NO: 611630 - RNA, 19 nt, Human
gaaggaacgggcacagcag

SEQ ID NO: 611631 - RNA, 21 nt, Human
gacacugccacugcacuccag

SEQ ID NO: 611632 - RNA, 24 nt, Human
gaggugggaggauugcuugagccc

SEQ ID NO: 611633 - RNA, 24 nt, Human
gauugcuugagcucaggaguucaa

SEQ ID NO: 611634 - RNA, 22 nt, Human
gccacugcacuccagccugggc

SEQ ID NO: 611635 - RNA, 24 nt, Human
gccacugcacuccagccugggcga

SEQ ID NO: 611636 - RNA, 24 nt, Human
gcccagcagguugaggcugcagug

SEQ ID NO: 611637 - RNA, 21 nt, Human
gccccaaguccuauggcagca

SEQ ID NO: 611638 - RNA, 21 nt, Human
gccugggcaacauagugagac

SEQ ID NO: 611639 - RNA, 22 nt, Human
gccugggcaacauagugagacc

SEQ ID NO: 611640 - RNA, 23 nt, Human
gccugggcaacauagugagaccu

SEQ ID NO: 611641 - RNA, 20 nt, Human
ggaauuucucuaaagcgcau

SEQ ID NO: 611642 - RNA, 23 nt, Human
ggacuuugcacgcucaccuggca

SEQ ID NO: 611643 - RNA, 23 nt, Human
ggauugcuugagcucaggaguuc

SEQ ID NO: 611644 - RNA, 19 nt, Human
ggccacaccucauccaaga

SEQ ID NO: 611645 - RNA, 18 nt, Human
ggccccacacucacuacg

SEQ ID NO: 611646 - RNA, 24 nt, Human
gggcugaggugggaggauugcuug

SEQ ID NO: 611647 - RNA, 18 nt, Human
ggguaugguggcgugugc

SEQ ID NO: 611648 - RNA, 28 nt, Human
guaugucuuuaaaaaaaaaaaaaaaaaa

SEQ ID NO: 611649 - RNA, 22 nt, Human
uaaggaaaggaaccugggguag

SEQ ID NO: 611650 - RNA, 25 nt, Human
uagcacuuugggaggcugaggcagg

SEQ ID NO: 611651 - RNA, 22 nt, Human
uaggccccaaguccuauggcag

SEQ ID NO: 611652 - RNA, 19 nt, Human
uauaaaaauuagcugggua

SEQ ID NO: 611653 - RNA, 25 nt, Human
uauuccacaggucugcgcaggcaug

SEQ ID NO: 611654 - RNA, 18 nt, Human
uauucugggaggaguggg

SEQ ID NO: 611655 - RNA, 20 nt, Human
ucaaaagggcaggaccagca

SEQ ID NO: 611656 - RNA, 20 nt, Human
ucagguaaauacagcagcac

SEQ ID NO: 611657 - RNA, 24 nt, Human
uccagccugggcgacaaagcaaga

SEQ ID NO: 611658 - RNA, 24 nt, Human
ucucuaaagcgcaucgcccggucc

SEQ ID NO: 611659 - RNA, 23 nt, Human
ucucuggguuggaagagccuuug

SEQ ID NO: 611660 - RNA, 20 nt, Human
ucuuuaaaaaaaaaaaaaaa

SEQ ID NO: 611661 - RNA, 23 nt, Human
ugaaaagcauagcucucagguaa

SEQ ID NO: 611662 - RNA, 21 nt, Human
ugaaauaauagggaauuucuc

SEQ ID NO: 611663 - RNA, 18 nt, Human
ugagccaugacacugcca

SEQ ID NO: 611664 - RNA, 22 nt, Human
ugagcccagcagguugaggcug

SEQ ID NO: 611665 - RNA, 24 nt, Human
ugaggcaggaggauugcuugagcu

SEQ ID NO: 611666 - RNA, 25 nt, Human
ugaggcaggaggauugcuugagcuc

SEQ ID NO: 611667 - RNA, 19 nt, Human
ugagggcacaggugggccc

SEQ ID NO: 611668 - RNA, 20 nt, Human
ugaggugggaggauugcuug

SEQ ID NO: 611669 - RNA, 22 nt, Human
ugaggugggaggauugcuugag

SEQ ID NO: 611670 - RNA, 23 nt, Human
ugaggugggaggauugcuugagc

SEQ ID NO: 611671 - RNA, 24 nt, Human
ugaggugggaggauugcuugagcc

SEQ ID NO: 611672 - RNA, 23 nt, Human
ugcaccaaauggccccagacucc

SEQ ID NO: 611673 - RNA, 20 nt, Human
ugcagugagccaugacacug

SEQ ID NO: 611674 - RNA, 23 nt, Human
ugccugucaucccagcaacucgg

SEQ ID NO: 611675 - RNA, 22 nt, Human
ugcuggcccagacuccuuccac

SEQ ID NO: 611676 - RNA, 22 nt, Human
uggcagauaggccccaaguccu

SEQ ID NO: 611677 - RNA, 24 nt, Human
uggcgugugccugucaucccagca

SEQ ID NO: 611678 - RNA, 24 nt, Human
uggcucacgccuguaauccuagca

SEQ ID NO: 611679 - RNA, 20 nt, Human
ugggaggaguggguuuuaug

SEQ ID NO: 611680 - RNA, 21 nt, Human
ugggaggaguggguuuuauga

SEQ ID NO: 611681 - RNA, 23 nt, Human
ugggaggaguggguuuuaugagg

SEQ ID NO: 611682 - RNA, 20 nt, Human
ugggaggcugaggcaggagg

SEQ ID NO: 611683 - RNA, 22 nt, Human
ugggaggcugaggcaggaggau

SEQ ID NO: 611684 - RNA, 23 nt, Human
ugggggcagauggguucucuggg

SEQ ID NO: 611685 - RNA, 24 nt, Human
ugguggcgugugccugucauccca

SEQ ID NO: 611686 - RNA, 19 nt, Human
uguaaagacaaagaaacag

SEQ ID NO: 611687 - RNA, 23 nt, Human
ugugcugcaguugugaagauggc

SEQ ID NO: 611688 - RNA, 20 nt, Human
uuaaaaaaaaaaaaaaaaaa

SEQ ID NO: 611689 - RNA, 19 nt, Human
uuagcuggguaugguggcg

SEQ ID NO: 611690 - RNA, 24 nt, Human
uuagcuggguaugguggcgugugc

SEQ ID NO: 611691 - RNA, 18 nt, Human
uucaguaaggaaaggaac

SEQ ID NO: 611692 - RNA, 20 nt, Human
uuccucagcagagacccuag

SEQ ID NO: 611693 - RNA, 22 nt, Human
uucugggaggaguggguuuuau

SEQ ID NO: 611694 - RNA, 18 nt, Human
uugcuugagcccagcagg

SEQ ID NO: 611695 - RNA, 20 nt, Human
uugggaggcugaggcaggag

SEQ ID NO: 611696 - RNA, 20 nt, Human
uuuguauucugguuuuuguu

SEQ ID NO: 611697 - RNA, 23 nt, Human
aaaagaaacaucuuaaggcuuua

SEQ ID NO: 611698 - RNA, 19 nt, Human
aaccagcgaccccacacuu

SEQ ID NO: 611699 - RNA, 19 nt, Human
acccccauccccaaaccuc

SEQ ID NO: 611700 - RNA, 23 nt, Human
acccccauccccaaaccucucau

SEQ ID NO: 611701 - RNA, 25 nt, Human
accccuaaacacccccauccccaaa

SEQ ID NO: 611702 - RNA, 22 nt, Human
acuuccccaccaaccagcgacc

SEQ ID NO: 611703 - RNA, 21 nt, Human
agccguguguccccaaggaau

SEQ ID NO: 611704 - RNA, 24 nt, Human
aggaggauguggauagguuacaug

SEQ ID NO: 611705 - RNA, 22 nt, Human
caaccagcgaccccacacuuca

SEQ ID NO: 611706 - RNA, 22 nt, Human
cacccccauccccaaaccucuc

SEQ ID NO: 611707 - RNA, 23 nt, Human
cacccccauccccaaaccucuca

SEQ ID NO: 611708 - RNA, 23 nt, Human
caccucccgucccaggauucgcc

SEQ ID NO: 611709 - RNA, 31 nt, Human
cagggugaaaaccccacgagggaacccacuu

SEQ ID NO: 611710 - RNA, 22 nt, Human
ccaaggaauggaaaccugagcc

SEQ ID NO: 611711 - RNA, 24 nt, Human
cccaaggaauggaaaccugagccc

SEQ ID NO: 611712 - RNA, 21 nt, Human
cccaagguuccccgcugccag

SEQ ID NO: 611713 - RNA, 20 nt, Human
ccccaccaaccagcgacccc

SEQ ID NO: 611714 - RNA, 22 nt, Human
ccccacugccucgcgggggccg

SEQ ID NO: 611715 - RNA, 22 nt, Human
ccccuaaacacccccaucccca

SEQ ID NO: 611716 - RNA, 23 nt, Human
ccccuaaacacccccauccccaa

SEQ ID NO: 611717 - RNA, 24 nt, Human
ccccuaaacacccccauccccaaa

SEQ ID NO: 611718 - RNA, 23 nt, Human
cccuaaacacccccauccccaaa

SEQ ID NO: 611719 - RNA, 21 nt, Human
ccugugccgguuacagccgca

SEQ ID NO: 611720 - RNA, 23 nt, Human
cgccccuguccagaccccuaaac

SEQ ID NO: 611721 - RNA, 22 nt, Human
cgcggugucccguguucucccc

SEQ ID NO: 611722 - RNA, 22 nt, Human
cuggcgccaagcagggugaaaa

SEQ ID NO: 611723 - RNA, 22 nt, Human
gaccccuaaacacccccauccc

SEQ ID NO: 611724 - RNA, 18 nt, Human
gaucucggagagcugcuc

SEQ ID NO: 611725 - RNA, 22 nt, Human
gcgaaccugugccgguuacagc

SEQ ID NO: 611726 - RNA, 23 nt, Human
ggaggcggaacuggggucuucuc

SEQ ID NO: 611727 - RNA, 18 nt, Human
gggaacccacucagcagg

SEQ ID NO: 611728 - RNA, 25 nt, Human
gucacuuccccaccaaccagcgacc

SEQ ID NO: 611729 - RNA, 21 nt, Human
uaaaauuaaugaaugcuuuuc

SEQ ID NO: 611730 - RNA, 23 nt, Human
uaaacacccccauccccaaaccu

SEQ ID NO: 611731 - RNA, 22 nt, Human
uaaacacccccauccccaaacu

SEQ ID NO: 611732 - RNA, 19 nt, Human
uaccauguguuugcauuca

SEQ ID NO: 611733 - RNA, 21 nt, Human
uagguaugcuuagggggucug

SEQ ID NO: 611734 - RNA, 22 nt, Human
ucccaggauucgccugucacuu

SEQ ID NO: 611735 - RNA, 20 nt, Human
ucuccucucccccuauuaaa

SEQ ID NO: 611736 - RNA, 24 nt, Human
ucucggagagcugcucgaguugcc

SEQ ID NO: 611737 - RNA, 20 nt, Human
ucugcugcaggccuuggagu

SEQ ID NO: 611738 - RNA, 25 nt, Human
ucuucucuccucucccccuauuaaa

SEQ ID NO: 611739 - RNA, 22 nt, Human
ugaauuccaacggaaaggcugg

SEQ ID NO: 611740 - RNA, 18 nt, Human
uggaaaccugagccccac

SEQ ID NO: 611741 - RNA, 19 nt, Human
uggaaaccugagccccacu

SEQ ID NO: 611742 - RNA, 23 nt, Human
uggaaaccugagccccacugccu

SEQ ID NO: 611743 - RNA, 20 nt, Human
aagaucccuuacaacugugg

SEQ ID NO: 611744 - RNA, 21 nt, Human
aggcgggaggcgggaggcggg

SEQ ID NO: 611745 - RNA, 18 nt, Human
ccacaagaucccuuacaa

SEQ ID NO: 611746 - RNA, 26 nt, Human
ccuuacaacuguggccuggugccgcc

SEQ ID NO: 611747 - RNA, 21 nt, Human
cugacagccacaagaucccuu

SEQ ID NO: 611748 - RNA, 24 nt, Human
uggagggaggcgggaggcgggagg

SEQ ID NO: 611749 - RNA, 19 nt, Human
uguggccuggugccgccgc

SEQ ID NO: 611750 - RNA, 23 nt, Human
uugaccaacaacauggggucuga

SEQ ID NO: 611751 - RNA, 22 nt, Human
aagcaguaaggaaaugcaaacc

SEQ ID NO: 611752 - RNA, 25 nt, Human
aagcaguaaggaaaugcaaaccuga

SEQ ID NO: 611753 - RNA, 21 nt, Human
agaagcucuuuaaagaaguug

SEQ ID NO: 611754 - RNA, 18 nt, Human
aggcaguucugccaccac

SEQ ID NO: 611755 - RNA, 22 nt, Human
aggcaguucugccaccaccggg

SEQ ID NO: 611756 - RNA, 23 nt, Human
aggcauuugauucugcaaaggca

SEQ ID NO: 611757 - RNA, 23 nt, Human
cacccuccuugcuaagccuccaa

SEQ ID NO: 611758 - RNA, 24 nt, Human
ccacgugugcgacucucuguaacc

SEQ ID NO: 611759 - RNA, 19 nt, Human
ccggcaccacccuccuugc

SEQ ID NO: 611760 - RNA, 23 nt, Human
cgcacaggcaguucugccaccac

SEQ ID NO: 611761 - RNA, 21 nt, Human
cggcaccacccuccuugcuaa

SEQ ID NO: 611762 - RNA, 20 nt, Human
cugccaccaccgggcggagg

SEQ ID NO: 611763 - RNA, 23 nt, Human
gauacauuggaauugugccuuuu

SEQ ID NO: 611764 - RNA, 19 nt, Human
gcgcagcccacguggaagc

SEQ ID NO: 611765 - RNA, 24 nt, Human
uaaaugauacauuggaauugugcc

SEQ ID NO: 611766 - RNA, 19 nt, Human
uaggcccgacaugacgccc

SEQ ID NO: 611767 - RNA, 22 nt, Human
ucugccaccaccgggcggaggc

SEQ ID NO: 611768 - RNA, 24 nt, Human
ugacgcccggcggcgcagcccacg

SEQ ID NO: 611769 - RNA, 20 nt, Human
ugccuuuucuaccacacugg

SEQ ID NO: 611770 - RNA, 19 nt, Human
uguagagcgugucucuuag

SEQ ID NO: 611771 - RNA, 24 nt, Human
uuaaagaaguuguuucuuccaaaa

SEQ ID NO: 611772 - RNA, 21 nt, Human
uucaagacaaagcaguaagga

SEQ ID NO: 611773 - RNA, 18 nt, Human
aaacaggguuucaccgug

SEQ ID NO: 611774 - RNA, 18 nt, Human
aaagugcuggauuacagg

SEQ ID NO: 611775 - RNA, 23 nt, Human
aaagugcuggauuacaggcguga

SEQ ID NO: 611776 - RNA, 24 nt, Human
aaagugcugggauuauagguguga

SEQ ID NO: 611777 - RNA, 18 nt, Human
aagugcugggauuauagg

SEQ ID NO: 611778 - RNA, 26 nt, Human
aagugcugggauuauaggugugagcc

SEQ ID NO: 611779 - RNA, 23 nt, Human
acaggcacccgccaccacgcccg

SEQ ID NO: 611780 - RNA, 18 nt, Human
acaggguuucaccguguu

SEQ ID NO: 611781 - RNA, 19 nt, Human
acaggguuucaccguguua

SEQ ID NO: 611782 - RNA, 20 nt, Human
acaggguuucaccguguuag

SEQ ID NO: 611783 - RNA, 24 nt, Human
acaggguuucaccguguuagccag

SEQ ID NO: 611784 - RNA, 21 nt, Human
accaugcccugccuaaucuug

SEQ ID NO: 611785 - RNA, 20 nt, Human
acgggguuucuccauguugg

SEQ ID NO: 611786 - RNA, 21 nt, Human
acgggguuucuccauguuggu

SEQ ID NO: 611787 - RNA, 24 nt, Human
acgggguuucuccauguuggucag

SEQ ID NO: 611788 - RNA, 20 nt, Human
acugcaagcuccgccuccca

SEQ ID NO: 611789 - RNA, 18 nt, Human
agccaccucgcccagccc

SEQ ID NO: 611790 - RNA, 24 nt, Human
agcgauucuccugccucagccucc

SEQ ID NO: 611791 - RNA, 20 nt, Human
aggcacccgccaccacgccc

SEQ ID NO: 611792 - RNA, 18 nt, Human
aggcaggaaaaaaacggc

SEQ ID NO: 611793 - RNA, 21 nt, Human
aggcaggaaaaaaacggcagg

SEQ ID NO: 611794 - RNA, 22 nt, Human
aggcaggaaaaaaacggcaggg

SEQ ID NO: 611795 - RNA, 22 nt, Human
aggcaggaaaaaaacggcaggu

SEQ ID NO: 611796 - RNA, 20 nt, Human
aggcaggaguggaagguagg

SEQ ID NO: 611797 - RNA, 23 nt, Human
aggcaggaguggaagguaggugg

SEQ ID NO: 611798 - RNA, 18 nt, Human
agguccccuuccuccuag

SEQ ID NO: 611799 - RNA, 24 nt, Human
aggugauccgccugccucagccuc

SEQ ID NO: 611800 - RNA, 20 nt, Human
aggugugagccaccaugccc

SEQ ID NO: 611801 - RNA, 21 nt, Human
aggugugagccaccaugcccu

SEQ ID NO: 611802 - RNA, 18 nt, Human
aguagcugggacuacagg

SEQ ID NO: 611803 - RNA, 23 nt, Human
aguagcugggacuacaggcaccc

SEQ ID NO: 611804 - RNA, 21 nt, Human
aguagcugggguuacaggcau

SEQ ID NO: 611805 - RNA, 24 nt, Human
agugcaauggcacaaucucggcuc

SEQ ID NO: 611806 - RNA, 20 nt, Human
aguggaaacaggguuucacc

SEQ ID NO: 611807 - RNA, 22 nt, Human
auuuuguauuuuuaguagagac

SEQ ID NO: 611808 - RNA, 23 nt, Human
caaagugcuggauuacaggcgug

SEQ ID NO: 611809 - RNA, 24 nt, Human
caaagugcuggauuacaggcguga

SEQ ID NO: 611810 - RNA, 24 nt, Human
caaagugcugggauuauaggugug

SEQ ID NO: 611811 - RNA, 18 nt, Human
caagcaccugguaaggcg

SEQ ID NO: 611812 - RNA, 22 nt, Human
caagcgauucuccugccucagc

SEQ ID NO: 611813 - RNA, 22 nt, Human
cacaccauucuccugccucagc

SEQ ID NO: 611814 - RNA, 18 nt, Human
caccguguuagccaggau

SEQ ID NO: 611815 - RNA, 23 nt, Human
caccguguuagccaggauggucu

SEQ ID NO: 611816 - RNA, 24 nt, Human
caccguguuagccaggauggucuu

SEQ ID NO: 611817 - RNA, 21 nt, Human
cagccuccugaguagcugggg

SEQ ID NO: 611818 - RNA, 24 nt, Human
caggguuucaccguguuagccagg

SEQ ID NO: 611819 - RNA, 22 nt, Human
caggugauccgccugccucagc

SEQ ID NO: 611820 - RNA, 19 nt, Human
ccaaagugcuggauuacag

SEQ ID NO: 611821 - RNA, 21 nt, Human
ccaaagugcuggauuacaggc

SEQ ID NO: 611822 - RNA, 23 nt, Human
ccaaagugcuggauuacaggcgu

SEQ ID NO: 611823 - RNA, 20 nt, Human
ccaaagugcugggauuauag

SEQ ID NO: 611824 - RNA, 21 nt, Human
ccaaagugcugggauuauagg

SEQ ID NO: 611825 - RNA, 24 nt, Human
ccaaagugcugggauuauaggugu

SEQ ID NO: 611826 - RNA, 23 nt, Human
ccaccucgcccagccccuaaucu

SEQ ID NO: 611827 - RNA, 19 nt, Human
ccaggcaggaaaaaaacgg

SEQ ID NO: 611828 - RNA, 21 nt, Human
ccaggcaggaaaaaaacggca

SEQ ID NO: 611829 - RNA, 19 nt, Human
ccauguuggucaggcuggu

SEQ ID NO: 611830 - RNA, 20 nt, Human
ccauguuggucaggcugguc

SEQ ID NO: 611831 - RNA, 24 nt, Human
cccaaagugcuggauuacaggcgu

SEQ ID NO: 611832 - RNA, 23 nt, Human
cccaggcaggaaaaaaacggcag

SEQ ID NO: 611833 - RNA, 19 nt, Human
cccaggcuggagugcaaug

SEQ ID NO: 611834 - RNA, 20 nt, Human
cccagguucacaccauucuc

SEQ ID NO: 611835 - RNA, 18 nt, Human
cccgaccucaggugaucc

SEQ ID NO: 611836 - RNA, 21 nt, Human
cccgaccucaggugauccgcc

SEQ ID NO: 611837 - RNA, 23 nt, Human
cccgaccucaggugauccgccug

SEQ ID NO: 611838 - RNA, 23 nt, Human
cccgaguagcugggacuacaggc

SEQ ID NO: 611839 - RNA, 24 nt, Human
cccgaguagcugggacuacaggca

SEQ ID NO: 611840 - RNA, 20 nt, Human
cccuuguugcccaggcugga

SEQ ID NO: 611841 - RNA, 21 nt, Human
cccuuguugcccaggcuggag

SEQ ID NO: 611842 - RNA, 22 nt, Human
cccuuguugcccaggcuggagu

SEQ ID NO: 611843 - RNA, 21 nt, Human
ccgcaaccuucgccuccuagg

SEQ ID NO: 611844 - RNA, 24 nt, Human
ccgcaaccuucgccuccuagguuc

SEQ ID NO: 611845 - RNA, 26 nt, Human
ccgccugccucagccucccaaagugc

SEQ ID NO: 611846 - RNA, 23 nt, Human
ccuagguucaagcgauucuccug

SEQ ID NO: 611847 - RNA, 24 nt, Human
ccuccuagguucaagcgauucucc

SEQ ID NO: 611848 - RNA, 19 nt, Human
ccuccugacaagcaccugg

SEQ ID NO: 611849 - RNA, 23 nt, Human
ccugaguagcugggguuacaggc

SEQ ID NO: 611850 - RNA, 24 nt, Human
ccugaguagcugggguuacaggca

SEQ ID NO: 611851 - RNA, 24 nt, Human
ccugccucagccucccgaguagcu

SEQ ID NO: 611852 - RNA, 23 nt, Human
ccugccucagccuccugaguagc

SEQ ID NO: 611853 - RNA, 18 nt, Human
cgaccucaggugauccgc

SEQ ID NO: 611854 - RNA, 19 nt, Human
cgccucccagguucacacc

SEQ ID NO: 611855 - RNA, 24 nt, Human
cucagccucccgaguagcugggac

SEQ ID NO: 611856 - RNA, 24 nt, Human
cucagccuccugaguagcuggggu

SEQ ID NO: 611857 - RNA, 23 nt, Human
cucaggugauccgccugccucag

SEQ ID NO: 611858 - RNA, 22 nt, Human
cuccauguuggucaggcugguc

SEQ ID NO: 611859 - RNA, 26 nt, Human
cucccgaccucaggugauccgccugc

SEQ ID NO: 611860 - RNA, 21 nt, Human
cuccgggcuagguccccuucc

SEQ ID NO: 611861 - RNA, 24 nt, Human
cuccugaccucaugauccgccugc

SEQ ID NO: 611862 - RNA, 23 nt, Human
cugaguagcugggguuacaggca

SEQ ID NO: 611863 - RNA, 24 nt, Human
cugaguagcugggguuacaggcau

SEQ ID NO: 611864 - RNA, 24 nt, Human
cugcaagcuccgccucccagguuc

SEQ ID NO: 611865 - RNA, 23 nt, Human
cugccucagccucccaaagugcu

SEQ ID NO: 611866 - RNA, 24 nt, Human
cugccucagccucccaaagugcug

SEQ ID NO: 611867 - RNA, 23 nt, Human
cugccucagccuccugaguagcu

SEQ ID NO: 611868 - RNA, 23 nt, Human
cugccucggucucccaaagugcu

SEQ ID NO: 611869 - RNA, 19 nt, Human
cuggagauguuccaggcug

SEQ ID NO: 611870 - RNA, 28 nt, Human
cuggcuaauuuuguauuuuuaguagaga

SEQ ID NO: 611871 - RNA, 21 nt, Human
cugggauuauaggugugagcc

SEQ ID NO: 611872 - RNA, 18 nt, Human
cugucacccaggcuggag

SEQ ID NO: 611873 - RNA, 19 nt, Human
cugucacccaggcuggagu

SEQ ID NO: 611874 - RNA, 24 nt, Human
cuuguugcccaggcuggagugcaa

SEQ ID NO: 611875 - RNA, 18 nt, Human
gaaacaggguuucaccgu

SEQ ID NO: 611876 - RNA, 23 nt, Human
gaccucaggugauccgccugccu

SEQ ID NO: 611877 - RNA, 24 nt, Human
gaccucaggugauccgccugccuc

SEQ ID NO: 611878 - RNA, 22 nt, Human
gaccucaugauccgccugccuc

SEQ ID NO: 611879 - RNA, 22 nt, Human
gaccucaugauccgccugccuc

SEQ ID NO: 611880 - RNA, 24 nt, Human
gaccucaugauccgccugccucgg

SEQ ID NO: 611881 - RNA, 23 nt, Human
gagacgggguuucuccauguugg

SEQ ID NO: 611882 - RNA, 24 nt, Human
gagacgggguuucuccauguuggu

SEQ ID NO: 611883 - RNA, 20 nt, Human
gaguagcugggacuacaggc

SEQ ID NO: 611884 - RNA, 22 nt, Human
gaguagcugggguuacaggcau

SEQ ID NO: 611885 - RNA, 24 nt, Human
gaguagcugggguuacaggcaugc

SEQ ID NO: 611886 - RNA, 18 nt, Human
gauuacaggcgugagcca

SEQ ID NO: 611887 - RNA, 20 nt, Human
gauuacaggcgugagccacc

SEQ ID NO: 611888 - RNA, 24 nt, Human
gauuacaggcgugagccaccucgc

SEQ ID NO: 611889 - RNA, 18 nt, Human
gauuauaggugugagcca

SEQ ID NO: 611890 - RNA, 21 nt, Human
gauuauaggugugagccacca

SEQ ID NO: 611891 - RNA, 22 nt, Human
gauuauaggugugagccaccau

SEQ ID NO: 611892 - RNA, 22 nt, Human
gcaagcuccgccucccagguuc

SEQ ID NO: 611893 - RNA, 19 nt, Human
gcccaggcuggagugcaau

SEQ ID NO: 611894 - RNA, 23 nt, Human
gcccggcuaauuuuuuguauuuu

SEQ ID NO: 611895 - RNA, 20 nt, Human
gcccuuguugcccaggcugg

SEQ ID NO: 611896 - RNA, 21 nt, Human
gcccuuguugcccaggcugga

SEQ ID NO: 611897 - RNA, 20 nt, Human
gccucagccucccgaguagc

SEQ ID NO: 611898 - RNA, 25 nt, Human
gccucccagguucacaccauucucc

SEQ ID NO: 611899 - RNA, 23 nt, Human
gcgauucuccugccucagccucc

SEQ ID NO: 611900 - RNA, 27 nt, Human
gcucugucacccaggcuggagugcugu

SEQ ID NO: 611901 - RNA, 19 nt, Human
gcuggagugcaauggcaca

SEQ ID NO: 611902 - RNA, 23 nt, Human
gcuggucuggaacucccgaccuc

SEQ ID NO: 611903 - RNA, 22 nt, Human
ggaagguagguggcugcugggg

SEQ ID NO: 611904 - RNA, 24 nt, Human
ggaagguagguggcugcuggggau

SEQ ID NO: 611905 - RNA, 24 nt, Human
ggauggucuugaucuccugaccuc

SEQ ID NO: 611906 - RNA, 20 nt, Human
ggauuacaggcgugagccac

SEQ ID NO: 611907 - RNA, 24 nt, Human
ggauuauaggugugagccaccaug

SEQ ID NO: 611908 - RNA, 23 nt, Human
gggguuucuccauguuggucagg

SEQ ID NO: 611909 - RNA, 19 nt, Human
ggguuacaggcaugcgcca

SEQ ID NO: 611910 - RNA, 22 nt, Human
ggguuucuccauguuggucagg

SEQ ID NO: 611911 - RNA, 24 nt, Human
ggugauccgccugccucagccucc

SEQ ID NO: 611912 - RNA, 23 nt, Human
guagagacgggguuucuccaugu

SEQ ID NO: 611913 - RNA, 20 nt, Human
guagcugggguuacaggcau

SEQ ID NO: 611914 - RNA, 24 nt, Human
gucuugcucugucacccaggcugg

SEQ ID NO: 611915 - RNA, 18 nt, Human
gugauccgccugccucag

SEQ ID NO: 611916 - RNA, 24 nt, Human
gugauccgccugccucagccuccc

SEQ ID NO: 611917 - RNA, 20 nt, Human
uaauuuuuuguauuuuuagu

SEQ ID NO: 611918 - RNA, 23 nt, Human
uacaggcacccgccaccacgccc

SEQ ID NO: 611919 - RNA, 22 nt, Human
uacaggcaugcgccaccacacc

SEQ ID NO: 611920 - RNA, 18 nt, Human
uacaggcgugagccaccu

SEQ ID NO: 611921 - RNA, 24 nt, Human
uaguagagacgggguuucuccaug

SEQ ID NO: 611922 - RNA, 21 nt, Human
uaguggaaacaggguuucacc

SEQ ID NO: 611923 - RNA, 24 nt, Human
uaguggaaacaggguuucaccgug

SEQ ID NO: 611924 - RNA, 26 nt, Human
uaguggaaacaggguuucaccguguu

SEQ ID NO: 611925 - RNA, 24 nt, Human
uauaggugugagccaccaugcccu

SEQ ID NO: 611926 - RNA, 21 nt, Human
ucacaccauucuccugccuca

SEQ ID NO: 611927 - RNA, 18 nt, Human
ucacccaggcuggagugc

SEQ ID NO: 611928 - RNA, 24 nt, Human
ucaccguguuagccaggauggucu

SEQ ID NO: 611929 - RNA, 18 nt, Human
ucacugcaagcuccgccu

SEQ ID NO: 611930 - RNA, 19 nt, Human
ucacugcaagcuccgccuc

SEQ ID NO: 611931 - RNA, 19 nt, Human
ucacugcaagcuccgccuc

SEQ ID NO: 611932 - RNA, 24 nt, Human
ucacugcaagcuccgccucccagg

SEQ ID NO: 611933 - RNA, 23 nt, Human
ucagccucccgaguagcugggac

SEQ ID NO: 611934 - RNA, 20 nt, Human
ucagccuccugaguagcugg

SEQ ID NO: 611935 - RNA, 19 nt, Human
ucagcucacugcaagcucc

SEQ ID NO: 611936 - RNA, 25 nt, Human
ucagcucacugcaagcuccgccucc

SEQ ID NO: 611937 - RNA, 22 nt, Human
ucaggugauccgccugccucag

SEQ ID NO: 611938 - RNA, 18 nt, Human
uccaggcuggagcggggg

SEQ ID NO: 611939 - RNA, 23 nt, Human
ucccaaagugcuggauuacaggc

SEQ ID NO: 611940 - RNA, 23 nt, Human
ucccaaagugcugggauuauagg

SEQ ID NO: 611941 - RNA, 21 nt, Human
ucccagguucacaccauucuc

SEQ ID NO: 611942 - RNA, 24 nt, Human
ucccagguucacaccauucuccug

SEQ ID NO: 611943 - RNA, 24 nt, Human
ucccgaguagcugggacuacaggc

SEQ ID NO: 611944 - RNA, 24 nt, Human
uccgcaaccuucgccuccuagguu

SEQ ID NO: 611945 - RNA, 29 nt, Human
uccgccugccucggucucccaaagugcug

SEQ ID NO: 611946 - RNA, 21 nt, Human
uccuagguucaagcgauucuc

SEQ ID NO: 611947 - RNA, 24 nt, Human
uccuagguucaagcgauucuccug

SEQ ID NO: 611948 - RNA, 24 nt, Human
uccuagugugcuuugcagcugacc

SEQ ID NO: 611949 - RNA, 24 nt, Human
uccugaguagcugggguuacaggc

SEQ ID NO: 611950 - RNA, 21 nt, Human
uccuggucccaggcuccuuag

SEQ ID NO: 611951 - RNA, 26 nt, Human
uccuuaggauucaggacugguuccca

SEQ ID NO: 611952 - RNA, 25 nt, Human
ucuccaguaugcuuuccuucccaag

SEQ ID NO: 611953 - RNA, 24 nt, Human
ucuccgcaaccuucgccuccuagg

SEQ ID NO: 611954 - RNA, 24 nt, Human
ucuccugccucagccucccgagua

SEQ ID NO: 611955 - RNA, 24 nt, Human
ucuccugccucagccuccugagua

SEQ ID NO: 611956 - RNA, 18 nt, Human
ucugucacccaggcugga

SEQ ID NO: 611957 - RNA, 22 nt, Human
ucuugcucugucacccaggcug

SEQ ID NO: 611958 - RNA, 23 nt, Human
ucuugcucugucacccaggcugg

SEQ ID NO: 611959 - RNA, 24 nt, Human
ucuugcucugucacccaggcugga

SEQ ID NO: 611960 - RNA, 20 nt, Human
ugacaagcaccugguaaggc

SEQ ID NO: 611961 - RNA, 18 nt, Human
ugagacagagucuugcuc

SEQ ID NO: 611962 - RNA, 22 nt, Human
ugagacagagucuugcucuguc

SEQ ID NO: 611963 - RNA, 18 nt, Human
ugcccaggcuggagugca

SEQ ID NO: 611964 - RNA, 21 nt, Human
ugcccaggcuggagugcaaug

SEQ ID NO: 611965 - RNA, 24 nt, Human
ugcccaggcuggagugcaauggca

SEQ ID NO: 611966 - RNA, 20 nt, Human
ugcccugccuaaucuuggau

SEQ ID NO: 611967 - RNA, 22 nt, Human
ugcccuuguugcccaggcugga

SEQ ID NO: 611968 - RNA, 24 nt, Human
ugccucagccucccaaagugcugg

SEQ ID NO: 611969 - RNA, 24 nt, Human
ugccucagccucccgaguagcugg

SEQ ID NO: 611970 - RNA, 24 nt, Human
ugccucagccuccugaguagcugg

SEQ ID NO: 611971 - RNA, 20 nt, Human
ugccugagggcaagccaggc

SEQ ID NO: 611972 - RNA, 24 nt, Human
ugcucugucacccaggcuggagug

SEQ ID NO: 611973 - RNA, 22 nt, Human
ugcuguggcuggaucucagcuc

SEQ ID NO: 611974 - RNA, 23 nt, Human
uggagugcaauggcacaaucucg

SEQ ID NO: 611975 - RNA, 24 nt, Human
uggagugcaauggcacaaucucgg

SEQ ID NO: 611976 - RNA, 20 nt, Human
uggauuacaggcgugagcca

SEQ ID NO: 611977 - RNA, 25 nt, Human
uggauuacaggcgugagccaccucg

SEQ ID NO: 611978 - RNA, 24 nt, Human
uggcacaaucucggcucuccgcaa

SEQ ID NO: 611979 - RNA, 22 nt, Human
uggcuccuggucccaggcuccu

SEQ ID NO: 611980 - RNA, 23 nt, Human
uggcuccuggucccaggcuccuu

SEQ ID NO: 611981 - RNA, 24 nt, Human
uggcuggaucucagcucacugcaa

SEQ ID NO: 611982 - RNA, 21 nt, Human
ugggacuacaggcacccgcca

SEQ ID NO: 611983 - RNA, 22 nt, Human
ugggacuacaggcacccgccac

SEQ ID NO: 611984 - RNA, 24 nt, Human
ugggacuacaggcacccgccacca

SEQ ID NO: 611985 - RNA, 18 nt, Human
ugggauuauaggugugag

SEQ ID NO: 611986 - RNA, 22 nt, Human
ugggauuauaggugugagccac

SEQ ID NO: 611987 - RNA, 23 nt, Human
ugggauuauaggugugagccacc

SEQ ID NO: 611988 - RNA, 24 nt, Human
ugggauuauaggugugagccacca

SEQ ID NO: 611989 - RNA, 25 nt, Human
ugggauuauaggugugagccaccau

SEQ ID NO: 611990 - RNA, 23 nt, Human
ugggcuggagauguuccaggcug

SEQ ID NO: 611991 - RNA, 18 nt, Human
ugggguuacaggcaugcg

SEQ ID NO: 611992 - RNA, 22 nt, Human
ugggguuacaggcaugcgccac

SEQ ID NO: 611993 - RNA, 24 nt, Human
ugggguuacaggcaugcgccacca

SEQ ID NO: 611994 - RNA, 21 nt, Human
uggucaggcuggucuggaacu

SEQ ID NO: 611995 - RNA, 23 nt, Human
uggucuggaacucccgaccucag

SEQ ID NO: 611996 - RNA, 23 nt, Human
ugguguugccugagggcaagcca

SEQ ID NO: 611997 - RNA, 21 nt, Human
uguauuuuuaguagagacggg

SEQ ID NO: 611998 - RNA, 25 nt, Human
ugucugggcuggagauguuccaggu

SEQ ID NO: 611999 - RNA, 19 nt, Human
ugugagccaccaugcccug

SEQ ID NO: 612000 - RNA, 20 nt, Human
uguugcccaggcuggagugc

SEQ ID NO: 612001 - RNA, 18 nt, Human
uuaguagagacgggguuu

SEQ ID NO: 612002 - RNA, 24 nt, Human
uuaguagagacgggguuucuccau

SEQ ID NO: 612003 - RNA, 22 nt, Human
uuaguggaaacaggguuucacc

SEQ ID NO: 612004 - RNA, 24 nt, Human
uuaguggaaacaggguuucaccgu

SEQ ID NO: 612005 - RNA, 21 nt, Human
uucaagcgauucuccugccuc

SEQ ID NO: 612006 - RNA, 23 nt, Human
uucaagcgauucuccugccucag

SEQ ID NO: 612007 - RNA, 24 nt, Human
uucaagcgauucuccugccucagc

SEQ ID NO: 612008 - RNA, 18 nt, Human
uugcccaggcuggagugc

SEQ ID NO: 612009 - RNA, 22 nt, Human
uugcccuuguugcccaggcugg

SEQ ID NO: 612010 - RNA, 23 nt, Human
uugcccuuguugcccaggcugga

SEQ ID NO: 612011 - RNA, 19 nt, Human
uuucaccguguuagccagg

SEQ ID NO: 612012 - RNA, 21 nt, Human
uuucuccauguuggucaggcu

SEQ ID NO: 612013 - RNA, 24 nt, Human
uuugcccuuguugcccaggcugga

SEQ ID NO: 612014 - RNA, 23 nt, Human
uuuugcccuuguugcccaggcug

SEQ ID NO: 612015 - RNA, 19 nt, Human
uuuuguauuuuuaguagag

SEQ ID NO: 612016 - RNA, 20 nt, Human
uuuuguauuuuuaguagaga

SEQ ID NO: 612017 - RNA, 22 nt, Human
uuuuuaguagagacgggguuuc

SEQ ID NO: 612018 - RNA, 24 nt, Human
uuuuuaguggaaacaggguuucac

SEQ ID NO: 612019 - RNA, 19 nt, Human
uuuuuguauuuuuagugga

SEQ ID NO: 612020 - RNA, 18 nt, Human
uuuuuuguauuuuuagug

SEQ ID NO: 612021 - RNA, 20 nt, Human
uuuuuuuuuuugagacagag

SEQ ID NO: 612022 - RNA, 24 nt, Human
uuuuuuuuuuuugagacagagucu

SEQ ID NO: 612023 - RNA, 18 nt, Human
uuuuuuuuuuuuuuuuug

SEQ ID NO: 612024 - RNA, 25 nt, Human
aagcaguccucccaccccagccucc

SEQ ID NO: 612025 - RNA, 19 nt, Human
aaguagcugggacuacaga

SEQ ID NO: 612026 - RNA, 27 nt, Human
aaguagcugggacuacagauacucaac

SEQ ID NO: 612027 - RNA, 21 nt, Human
acagauacucaacaccacacc

SEQ ID NO: 612028 - RNA, 25 nt, Human
accauguugcccaggcuggccucga

SEQ ID NO: 612029 - RNA, 19 nt, Human
acucuaugcccaggcugga

SEQ ID NO: 612030 - RNA, 20 nt, Human
acucuaugcccaggcuggag

SEQ ID NO: 612031 - RNA, 24 nt, Human
acucuaugcccaggcuggagugca

SEQ ID NO: 612032 - RNA, 23 nt, Human
agcaguccucccaccccagccuc

SEQ ID NO: 612033 - RNA, 25 nt, Human
aggcuggagugcaguagcucaaucu

SEQ ID NO: 612034 - RNA, 22 nt, Human
agugcugguauuacaggcguga

SEQ ID NO: 612035 - RNA, 27 nt, Human
caagcaguccucccaccccagccuccc

SEQ ID NO: 612036 - RNA, 27 nt, Human
caagcaguccucccaccccagccuccc

SEQ ID NO: 612037 - RNA, 19 nt, Human
caccacgccccaccaagau

SEQ ID NO: 612038 - RNA, 24 nt, Human
caccauguugcccaggcuggccuc

SEQ ID NO: 612039 - RNA, 27 nt, Human
caccauguugcccaggcuggccucgaa

SEQ ID NO: 612040 - RNA, 24 nt, Human
caccccagccucccaaguagcugg

SEQ ID NO: 612041 - RNA, 18 nt, Human
caccucaaccucccacag

SEQ ID NO: 612042 - RNA, 24 nt, Human
caccucaaccucccacagugcugg

SEQ ID NO: 612043 - RNA, 21 nt, Human
cagauacucaacaccacaccc

SEQ ID NO: 612044 - RNA, 24 nt, Human
cagccucaaccugcuggacucaag

SEQ ID NO: 612045 - RNA, 19 nt, Human
cauguugcccaggcuggcc

SEQ ID NO: 612046 - RNA, 21 nt, Human
cauguugcccaggcuggccuc

SEQ ID NO: 612047 - RNA, 24 nt, Human
cauguugcccaggcuggccucgaa

SEQ ID NO: 612048 - RNA, 24 nt, Human
ccacagugcugguauuacaggcgu

SEQ ID NO: 612049 - RNA, 19 nt, Human
ccaccccagccucccaagu

SEQ ID NO: 612050 - RNA, 23 nt, Human
cccaaguagcugggacuacagau

SEQ ID NO: 612051 - RNA, 23 nt, Human
cccaccccagccucccaaguagc

SEQ ID NO: 612052 - RNA, 23 nt, Human
ccccgagcgccgccggagcaacu

SEQ ID NO: 612053 - RNA, 21 nt, Human
cccgagcgccgccggagcaac

SEQ ID NO: 612054 - RNA, 19 nt, Human
cccucccucccuuccuucc

SEQ ID NO: 612055 - RNA, 23 nt, Human
ccucccaccccagccucccaagu

SEQ ID NO: 612056 - RNA, 19 nt, Human
ccucccuuccuuccuuuuu

SEQ ID NO: 612057 - RNA, 20 nt, Human
ccucccuuccuuccuuuuuc

SEQ ID NO: 612058 - RNA, 24 nt, Human
cgaucugcccaccucaaccuccca

SEQ ID NO: 612059 - RNA, 24 nt, Human
cucaagcaguccucccaccccagc

SEQ ID NO: 612060 - RNA, 21 nt, Human
cucaggcgaucugcccaccuc

SEQ ID NO: 612061 - RNA, 23 nt, Human
cugcagccucaaccugcuggacu

SEQ ID NO: 612062 - RNA, 20 nt, Human
gcccaggcuggagugcagua

SEQ ID NO: 612063 - RNA, 25 nt, Human
gcuggagugcaguagcucaaucuca

SEQ ID NO: 612064 - RNA, 22 nt, Human
ggaauuucaccauguugcccag

SEQ ID NO: 612065 - RNA, 23 nt, Human
ggaauuucaccauguugcccagg

SEQ ID NO: 612066 - RNA, 22 nt, Human
guagagauggaauuucaccaug

SEQ ID NO: 612067 - RNA, 18 nt, Human
gugaagccaccacgcccc

SEQ ID NO: 612068 - RNA, 23 nt, Human
uacagauacucaacaccacaccc

SEQ ID NO: 612069 - RNA, 22 nt, Human
uagagauggaauuucaccaugu

SEQ ID NO: 612070 - RNA, 23 nt, Human
uagcucaaucucagcucacugca

SEQ ID NO: 612071 - RNA, 20 nt, Human
uaugcccaggcuggagugca

SEQ ID NO: 612072 - RNA, 21 nt, Human
ucaccauguugcccaggcugg

SEQ ID NO: 612073 - RNA, 18 nt, Human
ucacugcagccucaaccu

SEQ ID NO: 612074 - RNA, 19 nt, Human
ucacugcagccucaaccug

SEQ ID NO: 612075 - RNA, 19 nt, Human
uccaguaguaguccaagaa

SEQ ID NO: 612076 - RNA, 18 nt, Human
ucccaaguagcugggacu

SEQ ID NO: 612077 - RNA, 24 nt, Human
ucccacagugcugguauuacaggc

SEQ ID NO: 612078 - RNA, 18 nt, Human
uccuaggcucaggcgauc

SEQ ID NO: 612079 - RNA, 20 nt, Human
uccuaggcucaggcgaucug

SEQ ID NO: 612080 - RNA, 27 nt, Human
uccucccaccccagccucccaaguagc

SEQ ID NO: 612081 - RNA, 21 nt, Human
ucugcccaccucaaccuccca

SEQ ID NO: 612082 - RNA, 19 nt, Human
ucuucugugucuucccaug

SEQ ID NO: 612083 - RNA, 22 nt, Human
ugcaguagcucaaucucagcuc

SEQ ID NO: 612084 - RNA, 19 nt, Human
ugcccaggcuggagugcag

SEQ ID NO: 612085 - RNA, 25 nt, Human
ugcccaggcuggagugcaguagcuc

SEQ ID NO: 612086 - RNA, 24 nt, Human
ugcccaggcuggccucgaacuccu

SEQ ID NO: 612087 - RNA, 24 nt, Human
uggaauuucaccauguugcccagg

SEQ ID NO: 612088 - RNA, 24 nt, Human
ugggacuacagauacucaacacca

SEQ ID NO: 612089 - RNA, 19 nt, Human
ugguauuacaggcgugaag

SEQ ID NO: 612090 - RNA, 23 nt, Human
ugguauuacaggcgugaagccac

SEQ ID NO: 612091 - RNA, 25 nt, Human
ugguauuacaggcgugaagccacca

SEQ ID NO: 612092 - RNA, 20 nt, Human
uguagagauggaauuucacc

SEQ ID NO: 612093 - RNA, 18 nt, Human
uuacaggcgugaagccac

SEQ ID NO: 612094 - RNA, 23 nt, Human
uuacucuaugcccaggcuggagu

SEQ ID NO: 612095 - RNA, 24 nt, Human
uucccucccucccuuccuuccuuu

SEQ ID NO: 612096 - RNA, 24 nt, Human
uuguagagauggaauuucaccaug

SEQ ID NO: 612097 - RNA, 24 nt, Human
uuguuggcaugguugauucccucc

SEQ ID NO: 612098 - RNA, 21 nt, Human
uuucaccauguugcccaggcu

SEQ ID NO: 612099 - RNA, 22 nt, Human
uuucaccauguugcccaggcug

SEQ ID NO: 612100 - RNA, 24 nt, Human
uuuguagagauggaauuucaccau

SEQ ID NO: 612101 - RNA, 24 nt, Human
uuuuuuguagagauggaauuucac

SEQ ID NO: 612102 - RNA, 25 nt, Human
acagugacacagaaaaaugucucac

SEQ ID NO: 612103 - RNA, 19 nt, Human
agagucaugcaugcccucc

SEQ ID NO: 612104 - RNA, 20 nt, Human
cacgcagagcaacacgcagu

SEQ ID NO: 612105 - RNA, 23 nt, Human
cagcaauaaaaacacguggcucc

SEQ ID NO: 612106 - RNA, 25 nt, Human
cagcaauaaaaacacguggcuccaa

SEQ ID NO: 612107 - RNA, 23 nt, Human
cagugagacuucugggaaggcuu

SEQ ID NO: 612108 - RNA, 18 nt, Human
ccaacagggccuagaucc

SEQ ID NO: 612109 - RNA, 21 nt, Human
cccaaaccuugagcuccccuc

SEQ ID NO: 612110 - RNA, 24 nt, Human
ccccacccaaaccuugagcucccc

SEQ ID NO: 612111 - RNA, 21 nt, Human
cccuccugaugggcucucaac

SEQ ID NO: 612112 - RNA, 19 nt, Human
ccuagauccucuggguucu

SEQ ID NO: 612113 - RNA, 27 nt, Human
cgaauuauaaaaagacaccaaaugucu

SEQ ID NO: 612114 - RNA, 19 nt, Human
cgcacggacaugggaacac

SEQ ID NO: 612115 - RNA, 22 nt, Human
cuccaagauaauacauguugcc

SEQ ID NO: 612116 - RNA, 18 nt, Human
cuccccuccccuccccaa

SEQ ID NO: 612117 - RNA, 18 nt, Human
cuccccuccccuccccaa

SEQ ID NO: 612118 - RNA, 23 nt, Human
cuggguucuccaugccccaucug

SEQ ID NO: 612119 - RNA, 24 nt, Human
cuggugggacagcugcuuuucgua

SEQ ID NO: 612120 - RNA, 18 nt, Human
gagacuucugggaaggcu

SEQ ID NO: 612121 - RNA, 21 nt, Human
uaaaaacacguggcuccaaga

SEQ ID NO: 612122 - RNA, 27 nt, Human
ucagcaauaaaaacacguggcuccaag

SEQ ID NO: 612123 - RNA, 21 nt, Human
uccucuggguucuccaugccc

SEQ ID NO: 612124 - RNA, 23 nt, Human
uccucuggguucuccaugcccca

SEQ ID NO: 612125 - RNA, 20 nt, Human
ugagacuucugggaaggcuu

SEQ ID NO: 612126 - RNA, 19 nt, Human
ugagcuccccuccccuccc

SEQ ID NO: 612127 - RNA, 20 nt, Human
ugagcuccccuccccucccc

SEQ ID NO: 612128 - RNA, 19 nt, Human
ugaguccccacccaaaccu

SEQ ID NO: 612129 - RNA, 20 nt, Human
ugggaacacacgcagagcaa

SEQ ID NO: 612130 - RNA, 21 nt, Human
ugggaaggcuuucccacagug

SEQ ID NO: 612131 - RNA, 19 nt, Human
ugggcucucaacacacgca

SEQ ID NO: 612132 - RNA, 20 nt, Human
ugggcugaguccccacccaa

SEQ ID NO: 612133 - RNA, 18 nt, Human
uggguucuccaugcccca

SEQ ID NO: 612134 - RNA, 21 nt, Human
uugagcuccccuccccucccc

SEQ ID NO: 612135 - RNA, 25 nt, Human
aaaaaaaaaagaaaaaaaaaggggg

SEQ ID NO: 612136 - RNA, 24 nt, Human
aaaaagaaaaaaaaaggcaaaccg

SEQ ID NO: 612137 - RNA, 19 nt, Human
aaaaaguuuccugggccuc

SEQ ID NO: 612138 - RNA, 20 nt, Human
aaaagaaaaaaaaaggcaaa

SEQ ID NO: 612139 - RNA, 25 nt, Human
aaaagaaaaaaaaaggcaaaccgca

SEQ ID NO: 612140 - RNA, 28 nt, Human
aaacaggcuaacacauagaccggacccc

SEQ ID NO: 612141 - RNA, 20 nt, Human
aaagaagguagagaguggga

SEQ ID NO: 612142 - RNA, 18 nt, Human
aaaggcaaaccgcaaaaa

SEQ ID NO: 612143 - RNA, 23 nt, Human
aaaggcaaaccgcaaaaaaaaau

SEQ ID NO: 612144 - RNA, 22 nt, Human
aagaaaaaaaaaggcaaaccgc

SEQ ID NO: 612145 - RNA, 24 nt, Human
aagaaaaaaaaaggcaaaccgcaa

SEQ ID NO: 612146 - RNA, 19 nt, Human
aagacccucuccaccuuaa

SEQ ID NO: 612147 - RNA, 21 nt, Human
acaaagcuuuuaguaacaguu

SEQ ID NO: 612148 - RNA, 23 nt, Human
acagccugcaggcccgagagcca

SEQ ID NO: 612149 - RNA, 27 nt, Human
acuccugccucagccucccacaugagc

SEQ ID NO: 612150 - RNA, 23 nt, Human
aggcuuuuaaacaaccgcgguuc

SEQ ID NO: 612151 - RNA, 22 nt, Human
auaauggcuucccuauaaaaca

SEQ ID NO: 612152 - RNA, 21 nt, Human
auacuccugccucagccuccc

SEQ ID NO: 612153 - RNA, 22 nt, Human
aucauaaucaaguuauuuuaau

SEQ ID NO: 612154 - RNA, 19 nt, Human
auuuuuaagcucccauuag

SEQ ID NO: 612155 - RNA, 20 nt, Human
cacaauacuccugccucagc

SEQ ID NO: 612156 - RNA, 22 nt, Human
caccuccucucucucuugcucc

SEQ ID NO: 612157 - RNA, 24 nt, Human
cagcaucuugcuauguugcucagg

SEQ ID NO: 612158 - RNA, 21 nt, Human
ccaaaaaaaaaaaaagaaaaa

SEQ ID NO: 612159 - RNA, 24 nt, Human
ccccauaugacuuggcugcuaccu

SEQ ID NO: 612160 - RNA, 26 nt, Human
ccgcgguuccaaaaaaaaaaaaagaa

SEQ ID NO: 612161 - RNA, 21 nt, Human
ccucaugaauagcuuggugcc

SEQ ID NO: 612162 - RNA, 19 nt, Human
ccuccagguucccucaggc

SEQ ID NO: 612163 - RNA, 20 nt, Human
ccuccucucucucuugcucc

SEQ ID NO: 612164 - RNA, 22 nt, Human
ccucuuuuuuuuaugaauuacc

SEQ ID NO: 612165 - RNA, 27 nt, Human
ccugcaggcccgagagccaaauaagcc

SEQ ID NO: 612166 - RNA, 19 nt, Human
ccugggccucaccagaagc

SEQ ID NO: 612167 - RNA, 18 nt, Human
cgacaccuccugcagccg

SEQ ID NO: 612168 - RNA, 20 nt, Human
cgacaccuccugcagccgca

SEQ ID NO: 612169 - RNA, 23 nt, Human
cucacaauacuccugccucagcc

SEQ ID NO: 612170 - RNA, 19 nt, Human
cuccagguucccucaggcu

SEQ ID NO: 612171 - RNA, 24 nt, Human
cugccucagccucccacaugagcu

SEQ ID NO: 612172 - RNA, 24 nt, Human
cuuaggcaagucacucugaauccc

SEQ ID NO: 612173 - RNA, 22 nt, Human
cuuuuaaacaaccgcgguucca

SEQ ID NO: 612174 - RNA, 21 nt, Human
gaaaaaaaaaggcaaaccgca

SEQ ID NO: 612175 - RNA, 22 nt, Human
gaaaucaaaagacaaagcuuuu

SEQ ID NO: 612176 - RNA, 22 nt, Human
gaaucccagguacaguuuucua

SEQ ID NO: 612177 - RNA, 22 nt, Human
gcccgagagccaaauaagccuc

SEQ ID NO: 612178 - RNA, 18 nt, Human
gcuaccauaccugguagg

SEQ ID NO: 612179 - RNA, 20 nt, Human
gcucgacaccuccugcagcc

SEQ ID NO: 612180 - RNA, 23 nt, Human
gcugaucuggaacuccuggccuc

SEQ ID NO: 612181 - RNA, 22 nt, Human
ggagguguuugggucauggagg

SEQ ID NO: 612182 - RNA, 22 nt, Human
guuccaaaaaaaaaaaaagaaa

SEQ ID NO: 612183 - RNA, 23 nt, Human
uaaugaguucucacuguuaguuc

SEQ ID NO: 612184 - RNA, 22 nt, Human
uacagacagcaucuugcuaugu

SEQ ID NO: 612185 - RNA, 21 nt, Human
uacccagaugucaauuacuaa

SEQ ID NO: 612186 - RNA, 23 nt, Human
uaggcaagucacucugaauccca

SEQ ID NO: 612187 - RNA, 20 nt, Human
uauguugcucaggcugaucu

SEQ ID NO: 612188 - RNA, 21 nt, Human
uauguugcucaggcugaucug

SEQ ID NO: 612189 - RNA, 23 nt, Human
uauguugcucaggcugaucugga

SEQ ID NO: 612190 - RNA, 24 nt, Human
uauguugcucaggcugaucuggaa

SEQ ID NO: 612191 - RNA, 21 nt, Human
uccaaaaaaaaaaaaagaaaa

SEQ ID NO: 612192 - RNA, 23 nt, Human
uccaaaaaaaaaaaaagaaaaaa

SEQ ID NO: 612193 - RNA, 25 nt, Human
uccaaaaaaaaaaaaagaaaaaaaa

SEQ ID NO: 612194 - RNA, 21 nt, Human
uccacaugguaaauaaugagu

SEQ ID NO: 612195 - RNA, 21 nt, Human
ucccacaugagcuaccauacc

SEQ ID NO: 612196 - RNA, 25 nt, Human
ucccagguacaguuuucuaaucuac

SEQ ID NO: 612197 - RNA, 21 nt, Human
ucgacaccuccugcagccgca

SEQ ID NO: 612198 - RNA, 23 nt, Human
ucggagucacaaacucggaggaa

SEQ ID NO: 612199 - RNA, 24 nt, Human
ucucuugcuccugcuauccccaua

SEQ ID NO: 612200 - RNA, 21 nt, Human
ucuuaggcaagucacucugaa

SEQ ID NO: 612201 - RNA, 18 nt, Human
ucuugcuauguugcucag

SEQ ID NO: 612202 - RNA, 19 nt, Human
ucuugcuauguugcucagg

SEQ ID NO: 612203 - RNA, 23 nt, Human
ucuugcuauguugcucaggcuga

SEQ ID NO: 612204 - RNA, 20 nt, Human
ugagcagauguuggugucau

SEQ ID NO: 612205 - RNA, 20 nt, Human
ugccucagccucccacauga

SEQ ID NO: 612206 - RNA, 22 nt, Human
ugcuauguugcucaggcugauc

SEQ ID NO: 612207 - RNA, 18 nt, Human
uggccucacaauacuccu

SEQ ID NO: 612208 - RNA, 18 nt, Human
ugggagccccccuccagg

SEQ ID NO: 612209 - RNA, 21 nt, Human
uguuggugucaugcuuguaca

SEQ ID NO: 612210 - RNA, 18 nt, Human
uuuagagccugccaccuc

SEQ ID NO: 612211 - RNA, 19 nt, Human
uuuccugggccucaccaga

SEQ ID NO: 612212 - RNA, 21 nt, Human
uuuuaagcucccauuaggugg

SEQ ID NO: 612213 - RNA, 18 nt, Human
aaaaaaacagucaccacc

SEQ ID NO: 612214 - RNA, 22 nt, Human
aaaaaaacagucaccacccaaa

SEQ ID NO: 612215 - RNA, 23 nt, Human
aaaaaaacagucaccacccaaaa

SEQ ID NO: 612216 - RNA, 24 nt, Human
aaagaugcauauuccccuuucucc

SEQ ID NO: 612217 - RNA, 22 nt, Human
aaauagagaguagccguccaua

SEQ ID NO: 612218 - RNA, 18 nt, Human
aagugaccccacagagga

SEQ ID NO: 612219 - RNA, 24 nt, Human
acaaaaacaacacucucccaucau

SEQ ID NO: 612220 - RNA, 21 nt, Human
acccaaaagaaaauagugcag

SEQ ID NO: 612221 - RNA, 25 nt, Human
agaaaaaaacagucaccacccaaaa

SEQ ID NO: 612222 - RNA, 22 nt, Human
agacaagcugguaaggccaugc

SEQ ID NO: 612223 - RNA, 18 nt, Human
agacugcaagaaucccua

SEQ ID NO: 612224 - RNA, 24 nt, Human
agaguagccguccauagagaguga

SEQ ID NO: 612225 - RNA, 19 nt, Human
agggagcaggggagcaugc

SEQ ID NO: 612226 - RNA, 20 nt, Human
aucucuuccuuccuccuaca

SEQ ID NO: 612227 - RNA, 19 nt, Human
aucuucucacaucucuguu

SEQ ID NO: 612228 - RNA, 21 nt, Human
augaaagcacaggagaagagg

SEQ ID NO: 612229 - RNA, 22 nt, Human
caaaaacaacacucucccauca

SEQ ID NO: 612230 - RNA, 22 nt, Human
caaaagaaaauagugcagacaa

SEQ ID NO: 612231 - RNA, 23 nt, Human
caaccugucaccaccggagccag

SEQ ID NO: 612232 - RNA, 18 nt, Human
caacuuuuccaccuagca

SEQ ID NO: 612233 - RNA, 20 nt, Human
caagugacaaaaacaacacu

SEQ ID NO: 612234 - RNA, 22 nt, Human
cacagcccuaccuuucucccuc

SEQ ID NO: 612235 - RNA, 22 nt, Human
caccaagucuggcuuguucuca

SEQ ID NO: 612236 - RNA, 20 nt, Human
cauagaaaaugcaauuugac

SEQ ID NO: 612237 - RNA, 18 nt, Human
ccauagcaggacagcacc

SEQ ID NO: 612238 - RNA, 22 nt, Human
ccccuuucucccaacuuuucca

SEQ ID NO: 612239 - RNA, 22 nt, Human
ccuccuaaugcuaaguggaagc

SEQ ID NO: 612240 - RNA, 21 nt, Human
ccugauuggacaggagaaaac

SEQ ID NO: 612241 - RNA, 20 nt, Human
cuacugccuagcucuucuca

SEQ ID NO: 612242 - RNA, 20 nt, Human
cuaguuuuuucccaaagcag

SEQ ID NO: 612243 - RNA, 21 nt, Human
cucauucccccuccacagucc

SEQ ID NO: 612244 - RNA, 22 nt, Human
cuguauuaucuucucacaucuc

SEQ ID NO: 612245 - RNA, 21 nt, Human
cuuugugcuagguacucuucu

SEQ ID NO: 612246 - RNA, 22 nt, Human
cuuuuggggaaagggguaggag

SEQ ID NO: 612247 - RNA, 21 nt, Human
gaccucuccuuccaaaacccc

SEQ ID NO: 612248 - RNA, 23 nt, Human
gcaagugacaaaaacaacacucu

SEQ ID NO: 612249 - RNA, 18 nt, Human
ggagcaggggagcaugcu

SEQ ID NO: 612250 - RNA, 18 nt, Human
gugaauucaccaaaacua

SEQ ID NO: 612251 - RNA, 23 nt, Human
guuauuuugagcuguauaaacca

SEQ ID NO: 612252 - RNA, 19 nt, Human
uaaaugcauuauaccauag

SEQ ID NO: 612253 - RNA, 21 nt, Human
uaaggccaugcuuuggccaca

SEQ ID NO: 612254 - RNA, 19 nt, Human
uacuagggauaucacagug

SEQ ID NO: 612255 - RNA, 22 nt, Human
uaguuuuuaaagugaccccaca

SEQ ID NO: 612256 - RNA, 19 nt, Human
uauagcuagaggcccaugu

SEQ ID NO: 612257 - RNA, 26 nt, Human
uauuaaagaccucuccuuccaaaacc

SEQ ID NO: 612258 - RNA, 21 nt, Human
uauuauguggcucaguacacc

SEQ ID NO: 612259 - RNA, 25 nt, Human
ucaaagcacucuuugccacaggucc

SEQ ID NO: 612260 - RNA, 22 nt, Human
ucacagugaacuuaagucuaaa

SEQ ID NO: 612261 - RNA, 21 nt, Human
ucuagggauaugcaaagucag

SEQ ID NO: 612262 - RNA, 25 nt, Human
ucucuuacacagcagguaccuagac

SEQ ID NO: 612263 - RNA, 22 nt, Human
ugacaaaaacaacacucuccca

SEQ ID NO: 612264 - RNA, 22 nt, Human
ugaccuguccgccuuucuccuu

SEQ ID NO: 612265 - RNA, 21 nt, Human
ugauggugaccuguccgccuu

SEQ ID NO: 612266 - RNA, 19 nt, Human
ugcaaagucagaaaaaaac

SEQ ID NO: 612267 - RNA, 25 nt, Human
ugcaaagucagaaaaaaacagucac

SEQ ID NO: 612268 - RNA, 23 nt, Human
ugccacagguccagcaguguggg

SEQ ID NO: 612269 - RNA, 21 nt, Human
ugccuagcucuucucagccca

SEQ ID NO: 612270 - RNA, 21 nt, Human
ugccugugaaacauuccaccu

SEQ ID NO: 612271 - RNA, 19 nt, Human
uggcuccuaauugcuccuu

SEQ ID NO: 612272 - RNA, 24 nt, Human
uggcuuguucucauucccccucca

SEQ ID NO: 612273 - RNA, 19 nt, Human
uggggaaagggguaggagc

SEQ ID NO: 612274 - RNA, 21 nt, Human
ugucaccaccggagccagagc

SEQ ID NO: 612275 - RNA, 21 nt, Human
uuccccuuucucccaacuuuu

SEQ ID NO: 612276 - RNA, 23 nt, Human
uugaagcuaguaguuuuuaaagu

SEQ ID NO: 612277 - RNA, 24 nt, Human
aaaaaugcagagaagcacacaaga

SEQ ID NO: 612278 - RNA, 22 nt, Human
aaagaaaacacaugacuuugca

SEQ ID NO: 612279 - RNA, 23 nt, Human
aagacaaccaucugaaaggucac

SEQ ID NO: 612280 - RNA, 22 nt, Human
aagcacacaagacaaccaucug

SEQ ID NO: 612281 - RNA, 23 nt, Human
agaaagaaaacacaugacuuugc

SEQ ID NO: 612282 - RNA, 24 nt, Human
agaaagaaaacacaugacuuugca

SEQ ID NO: 612283 - RNA, 25 nt, Human
agagcaccuguccugggcaucuggu

SEQ ID NO: 612284 - RNA, 23 nt, Human
cagagaagcacacaagacaacca

SEQ ID NO: 612285 - RNA, 25 nt, Human
cagcgggacuucuccucucacaucc

SEQ ID NO: 612286 - RNA, 23 nt, Human
caucugguugagauagcagcauc

SEQ ID NO: 612287 - RNA, 18 nt, Human
caugagucuacaauaauc

SEQ ID NO: 612288 - RNA, 24 nt, Human
ccacauuugucuuucuccaauccc

SEQ ID NO: 612289 - RNA, 18 nt, Human
ccaucugaaaguaucccu

SEQ ID NO: 612290 - RNA, 19 nt, Human
cccggucaaaacaacacug

SEQ ID NO: 612291 - RNA, 20 nt, Human
cccuuccuuucuccucuuuc

SEQ ID NO: 612292 - RNA, 18 nt, Human
ccuguuccaggugaccac

SEQ ID NO: 612293 - RNA, 23 nt, Human
cggcuucgcugggguggcuggca

SEQ ID NO: 612294 - RNA, 18 nt, Human
cucuagaucucccgguca

SEQ ID NO: 612295 - RNA, 23 nt, Human
cucucuagaucucccggucaaaa

SEQ ID NO: 612296 - RNA, 23 nt, Human
cucuucccugaacuccuauuugu

SEQ ID NO: 612297 - RNA, 22 nt, Human
cuuccuuucuccucuuucuuuu

SEQ ID NO: 612298 - RNA, 23 nt, Human
gaaaauaguaucccuuuuaguuc

SEQ ID NO: 612299 - RNA, 21 nt, Human
gaaguggggcggguggacagg

SEQ ID NO: 612300 - RNA, 24 nt, Human
gagaaagaaaacacaugacuuugc

SEQ ID NO: 612301 - RNA, 23 nt, Human
gcagaacuaucuuuugcuucuua

SEQ ID NO: 612302 - RNA, 21 nt, Human
gcgaaccgggguuccaggagc

SEQ ID NO: 612303 - RNA, 18 nt, Human
gugguccuaauggcuaga

SEQ ID NO: 612304 - RNA, 24 nt, Human
uaacagaggcugagccacauagug

SEQ ID NO: 612305 - RNA, 19 nt, Human
uaacauagauuggagaccu

SEQ ID NO: 612306 - RNA, 24 nt, Human
uaacccaguaaugcuucccuuccu

SEQ ID NO: 612307 - RNA, 23 nt, Human
uaacugacauguccauuuguggu

SEQ ID NO: 612308 - RNA, 25 nt, Human
uauauguagguguuaggcguauaua

SEQ ID NO: 612309 - RNA, 20 nt, Human
uaucccuuuuaguuccaggg

SEQ ID NO: 612310 - RNA, 23 nt, Human
uaugcuuguaugaagaauauagc

SEQ ID NO: 612311 - RNA, 24 nt, Human
ucaaaacaacacuguccuuugaag

SEQ ID NO: 612312 - RNA, 19 nt, Human
uccugugauuccaaaugcc

SEQ ID NO: 612313 - RNA, 21 nt, Human
ucugagcacucucuagaucuc

SEQ ID NO: 612314 - RNA, 21 nt, Human
ugaaaguaucccuucuuugau

SEQ ID NO: 612315 - RNA, 20 nt, Human
ugagaaagaaaacacaugac

SEQ ID NO: 612316 - RNA, 23 nt, Human
ugauuucuuccacauuugucuuu

SEQ ID NO: 612317 - RNA, 21 nt, Human
ugcagagaagcacacaagaca

SEQ ID NO: 612318 - RNA, 27 nt, Human
ugcagagaagcacacaagacaaccauc

SEQ ID NO: 612319 - RNA, 18 nt, Human
uggcaagcgaaguggggc

SEQ ID NO: 612320 - RNA, 25 nt, Human
uggcaucgccgcgaaccgggguucc

SEQ ID NO: 612321 - RNA, 20 nt, Human
uggggcggguggacagggaa

SEQ ID NO: 612322 - RNA, 24 nt, Human
ugggguggcuggcaucgccgcgaa

SEQ ID NO: 612323 - RNA, 26 nt, Human
uguaaagcacaaaaguagucuccagc

SEQ ID NO: 612324 - RNA, 23 nt, Human
uguacaagaaugucuugucuuuu

SEQ ID NO: 612325 - RNA, 19 nt, Human
uuccaggugaccacaaucc

SEQ ID NO: 612326 - RNA, 18 nt, Human
uuccuuucuccucuuucu

SEQ ID NO: 612327 - RNA, 18 nt, Human
uuccuuucuccucuuucu

SEQ ID NO: 612328 - RNA, 24 nt, Human
uucgcugggguggcuggcaucgcc

SEQ ID NO: 612329 - RNA, 19 nt, Human
uugaauuugcagaacuauc

SEQ ID NO: 612330 - RNA, 19 nt, Human
uugaucuuuuggcucuuug

SEQ ID NO: 612331 - RNA, 27 nt, Human
uuucuuauaaaaauacaggaugagagu

SEQ ID NO: 612332 - RNA, 19 nt, Human
uuugaucuuuuggcucuuu

SEQ ID NO: 612333 - RNA, 20 nt, Human
aaaaacaacaaacuaagggc

SEQ ID NO: 612334 - RNA, 22 nt, Human
aaaaagaaguaaggaaagagaa

SEQ ID NO: 612335 - RNA, 19 nt, Human
aaaacaaacaaacaaaaaa

SEQ ID NO: 612336 - RNA, 20 nt, Human
aaaacaaaggaucaaggaaa

SEQ ID NO: 612337 - RNA, 21 nt, Human
aaacuagaguuacuaccuaau

SEQ ID NO: 612338 - RNA, 19 nt, Human
aaagagcacuucuaccucc

SEQ ID NO: 612339 - RNA, 26 nt, Human
aaaguuccuuccuccucccuccacuu

SEQ ID NO: 612340 - RNA, 20 nt, Human
aacagagugagacuccaucu

SEQ ID NO: 612341 - RNA, 19 nt, Human
aacaugguaaaaccccauc

SEQ ID NO: 612342 - RNA, 20 nt, Human
aacaugguaaaaccccaucu

SEQ ID NO: 612343 - RNA, 21 nt, Human
aacaugguaaaaccccaucuc

SEQ ID NO: 612344 - RNA, 21 nt, Human
aacaugguaaaaccccaucuc

SEQ ID NO: 612345 - RNA, 21 nt, Human
aacccacagacccucuuccuc

SEQ ID NO: 612346 - RNA, 23 nt, Human
aacccgaaaacaaaggaucaagg

SEQ ID NO: 612347 - RNA, 21 nt, Human
aagaagcaccuccauccucac

SEQ ID NO: 612348 - RNA, 24 nt, Human
aagacagaagacaggcaaagagga

SEQ ID NO: 612349 - RNA, 20 nt, Human
aagacgccaccagaagaaga

SEQ ID NO: 612350 - RNA, 21 nt, Human
aagcagaaucugccacgaucu

SEQ ID NO: 612351 - RNA, 21 nt, Human
aagcagacugcaagaugaccc

SEQ ID NO: 612352 - RNA, 19 nt, Human
aagcagguggaucacgagg

SEQ ID NO: 612353 - RNA, 24 nt, Human
aagcagguggaucacgaggucaga

SEQ ID NO: 612354 - RNA, 18 nt, Human
aaggaaagagaagcacag

SEQ ID NO: 612355 - RNA, 18 nt, Human
aaggaaagagaagcacag

SEQ ID NO: 612356 - RNA, 20 nt, Human
aagggcaggccuccucugga

SEQ ID NO: 612357 - RNA, 22 nt, Human
aagggcaggccuccucuggagg

SEQ ID NO: 612358 - RNA, 21 nt, Human
aaguaaggaaagagaagcaca

SEQ ID NO: 612359 - RNA, 22 nt, Human
aaguagaaggggaaauagugag

SEQ ID NO: 612360 - RNA, 24 nt, Human
aaucgcuugaacccaggaggcaga

SEQ ID NO: 612361 - RNA, 21 nt, Human
aauuaucucuucccuuuucug

SEQ ID NO: 612362 - RNA, 20 nt, Human
acaccuggccuacccccuga

SEQ ID NO: 612363 - RNA, 21 nt, Human
acaccuguaaucucagcacuu

SEQ ID NO: 612364 - RNA, 23 nt, Human
acagagugagacuccaucucaaa

SEQ ID NO: 612365 - RNA, 24 nt, Human
acagagugagacuccaucucaaaa

SEQ ID NO: 612366 - RNA, 18 nt, Human
acagccccuccuucuagg

SEQ ID NO: 612367 - RNA, 22 nt, Human
accacauccucccuucaacaac

SEQ ID NO: 612368 - RNA, 24 nt, Human
accauacccccaacccucccaaac

SEQ ID NO: 612369 - RNA, 24 nt, Human
accccaucucugcuaaaaauacaa

SEQ ID NO: 612370 - RNA, 22 nt, Human
accuggccuacccccugacagc

SEQ ID NO: 612371 - RNA, 18 nt, Human
acuacacucuagccuggg

SEQ ID NO: 612372 - RNA, 24 nt, Human
acuacacucuagccuggguaacag

SEQ ID NO: 612373 - RNA, 21 nt, Human
acuccccccucugucuaccac

SEQ ID NO: 612374 - RNA, 24 nt, Human
acucuagccuggguaacagaguga

SEQ ID NO: 612375 - RNA, 18 nt, Human
agaaaggaggggaggagg

SEQ ID NO: 612376 - RNA, 23 nt, Human
agaaguugcagugagcugagauc

SEQ ID NO: 612377 - RNA, 24 nt, Human
agaaguugcagugagcugagauca

SEQ ID NO: 612378 - RNA, 21 nt, Human
agacaaaagaugaaaagagaa

SEQ ID NO: 612379 - RNA, 23 nt, Human
agacaaaagaugaaaagagaaca

SEQ ID NO: 612380 - RNA, 21 nt, Human
agacagaagacaggcaaagag

SEQ ID NO: 612381 - RNA, 22 nt, Human
agagagaaagaugcacagagga

SEQ ID NO: 612382 - RNA, 26 nt, Human
agagaggacagaaaggaggggaggag

SEQ ID NO: 612383 - RNA, 20 nt, Human
agaggaauuccauaaacacu

SEQ ID NO: 612384 - RNA, 18 nt, Human
agaggacagaaaggaggg

SEQ ID NO: 612385 - RNA, 24 nt, Human
agaguucauuucaucuaaaguucc

SEQ ID NO: 612386 - RNA, 20 nt, Human
agcacuuugggaggccgaag

SEQ ID NO: 612387 - RNA, 24 nt, Human
agccuggguaacagagugagacuc

SEQ ID NO: 612388 - RNA, 22 nt, Human
agcucugaugcagugaccuuga

SEQ ID NO: 612389 - RNA, 24 nt, Human
aggaaaugcaaaggcagagagaaa

SEQ ID NO: 612390 - RNA, 23 nt, Human
aggaagacagaagacaggcaaag

SEQ ID NO: 612391 - RNA, 24 nt, Human
aggaagacagaagacaggcaaaga

SEQ ID NO: 612392 - RNA, 23 nt, Human
aggacagaaaggaggggaggagg

SEQ ID NO: 612393 - RNA, 26 nt, Human
aggacagaaaggaggggaggaggggg

SEQ ID NO: 612394 - RNA, 18 nt, Human
aggagggaggaggagggc

SEQ ID NO: 612395 - RNA, 19 nt, Human
aggaggggaggagggggaa

SEQ ID NO: 612396 - RNA, 21 nt, Human
aggagucaagaucaucaagcu

SEQ ID NO: 612397 - RNA, 20 nt, Human
aggcagaaguugcagugagc

SEQ ID NO: 612398 - RNA, 24 nt, Human
aggcagaaguugcagugagcugag

SEQ ID NO: 612399 - RNA, 18 nt, Human
aggcagcucucugucccu

SEQ ID NO: 612400 - RNA, 23 nt, Human
aggcaggggaaucgcuugaaccc

SEQ ID NO: 612401 - RNA, 20 nt, Human
aggcugaggcaggggaaucg

SEQ ID NO: 612402 - RNA, 24 nt, Human
aggcugaggcaggggaaucgcuug

SEQ ID NO: 612403 - RNA, 22 nt, Human
aggcuuuggaguuuucagagaa

SEQ ID NO: 612404 - RNA, 24 nt, Human
agggaagagaaagugggagaggau

SEQ ID NO: 612405 - RNA, 23 nt, Human
agggaccacuuacagcuucugcc

SEQ ID NO: 612406 - RNA, 21 nt, Human
agggggaaaaagaaguaagga

SEQ ID NO: 612407 - RNA, 24 nt, Human
agguggaucacgaggucagaaguu

SEQ ID NO: 612408 - RNA, 24 nt, Human
aguggcuuacaccuguaaucucag

SEQ ID NO: 612409 - RNA, 23 nt, Human
aguuccaaucauaauaucucugu

SEQ ID NO: 612410 - RNA, 24 nt, Human
aucaugccacuacacucuagccug

SEQ ID NO: 612411 - RNA, 23 nt, Human
aucuaaaguuccuuccuccuccc

SEQ ID NO: 612412 - RNA, 25 nt, Human
aucucuucccuuuucugucucccca

SEQ ID NO: 612413 - RNA, 19 nt, Human
augaagcauaugcaugugu

SEQ ID NO: 612414 - RNA, 20 nt, Human
augcauguguuauaggaguu

SEQ ID NO: 612415 - RNA, 21 nt, Human
auuccaggcagcucucugucc

SEQ ID NO: 612416 - RNA, 19 nt, Human
auuccauaaacacucacca

SEQ ID NO: 612417 - RNA, 22 nt, Human
auucuugucuuuaguauguucu

SEQ ID NO: 612418 - RNA, 23 nt, Human
caaacaaaaaaucucaguuuaga

SEQ ID NO: 612419 - RNA, 21 nt, Human
caaacaaacaaaaaaucucag

SEQ ID NO: 612420 - RNA, 25 nt, Human
caaacacacauacaaacagagccac

SEQ ID NO: 612421 - RNA, 18 nt, Human
caaacuaagggcaggccu

SEQ ID NO: 612422 - RNA, 27 nt, Human
caacaacacccucacccaguuugacua

SEQ ID NO: 612423 - RNA, 21 nt, Human
caagaugacccucagucuuga

SEQ ID NO: 612424 - RNA, 20 nt, Human
caaggaaagcagaaucugcc

SEQ ID NO: 612425 - RNA, 23 nt, Human
caaguacaauguggaaugaagca

SEQ ID NO: 612426 - RNA, 19 nt, Human
cacaccuguaaucccagcu

SEQ ID NO: 612427 - RNA, 22 nt, Human
caccagaagaagaagcaccucc

SEQ ID NO: 612428 - RNA, 22 nt, Human
caccauacccccaacccuccca

SEQ ID NO: 612429 - RNA, 24 nt, Human
caccuguaaucccagcuacucagg

SEQ ID NO: 612430 - RNA, 23 nt, Human
caccuguaaucucagcacuuugg

SEQ ID NO: 612431 - RNA, 24 nt, Human
caccuguaaucucagcacuuuggg

SEQ ID NO: 612432 - RNA, 22 nt, Human
caccuuaaccccuuccaaucac

SEQ ID NO: 612433 - RNA, 24 nt, Human
caccuuaaccccuuccaaucacga

SEQ ID NO: 612434 - RNA, 24 nt, Human
cacuacacucuagccuggguaaca

SEQ ID NO: 612435 - RNA, 22 nt, Human
cacucuagccuggguaacagag

SEQ ID NO: 612436 - RNA, 22 nt, Human
cacucuagccuggguaacagag

SEQ ID NO: 612437 - RNA, 24 nt, Human
cacucuagccuggguaacagagug

SEQ ID NO: 612438 - RNA, 19 nt, Human
cagaagaagaagcaccucc

SEQ ID NO: 612439 - RNA, 20 nt, Human
cagaagaagaagcaccucca

SEQ ID NO: 612440 - RNA, 19 nt, Human
cagaagugcuaagaaaagg

SEQ ID NO: 612441 - RNA, 24 nt, Human
cagcacuuugggaggccgaagcag

SEQ ID NO: 612442 - RNA, 26 nt, Human
cagcacuuugggaggccgaagcaggu

SEQ ID NO: 612443 - RNA, 20 nt, Human
cagccaccacucuggucuug

SEQ ID NO: 612444 - RNA, 24 nt, Human
cagcuacucaggaggcugaggcag

SEQ ID NO: 612445 - RNA, 21 nt, Human
caggguagguccaucaguauc

SEQ ID NO: 612446 - RNA, 24 nt, Human
caguaagcaaacugguaaauaucu

SEQ ID NO: 612447 - RNA, 21 nt, Human
cauccucuagaggacagaaca

SEQ ID NO: 612448 - RNA, 20 nt, Human
caucucaaaaacaaacaaac

SEQ ID NO: 612449 - RNA, 23 nt, Human
ccaacccucccaaacacacauac

SEQ ID NO: 612450 - RNA, 20 nt, Human
ccacuacacucuagccuggg

SEQ ID NO: 612451 - RNA, 20 nt, Human
ccacuacacucuagccuggg

SEQ ID NO: 612452 - RNA, 21 nt, Human
ccacuacacucuagccugggu

SEQ ID NO: 612453 - RNA, 22 nt, Human
ccacuacacucuagccugggua

SEQ ID NO: 612454 - RNA, 24 nt, Human
ccacuacacucuagccuggguaac

SEQ ID NO: 612455 - RNA, 24 nt, Human
ccacuuacagcuucugcccauacc

SEQ ID NO: 612456 - RNA, 22 nt, Human
ccauacccccaacccucccaaa

SEQ ID NO: 612457 - RNA, 24 nt, Human
ccauacccccaacccucccaaaca

SEQ ID NO: 612458 - RNA, 19 nt, Human
cccaaauagucaauuacca

SEQ ID NO: 612459 - RNA, 25 nt, Human
cccaacccucccaaacacacauaca

SEQ ID NO: 612460 - RNA, 22 nt, Human
cccacagacccucuuccucaga

SEQ ID NO: 612461 - RNA, 28 nt, Human
cccccaacccucccaaacacacauacaa

SEQ ID NO: 612462 - RNA, 19 nt, Human
ccccugacagccccuccuu

SEQ ID NO: 612463 - RNA, 22 nt, Human
ccccuuuagugcacaagcucaa

SEQ ID NO: 612464 - RNA, 19 nt, Human
ccgaaaacaaaggaucaag

SEQ ID NO: 612465 - RNA, 22 nt, Human
ccuccauccucaccugagaguc

SEQ ID NO: 612466 - RNA, 18 nt, Human
ccuccucccuccacuucu

SEQ ID NO: 612467 - RNA, 24 nt, Human
ccugaccaacaugguaaaacccca

SEQ ID NO: 612468 - RNA, 22 nt, Human
ccuggguaacagagugagacuc

SEQ ID NO: 612469 - RNA, 20 nt, Human
ccuggugcaguuuguuuccu

SEQ ID NO: 612470 - RNA, 21 nt, Human
ccuguaaucccagcuacucag

SEQ ID NO: 612471 - RNA, 25 nt, Human
ccuuccuccucccuccacuucuccc

SEQ ID NO: 612472 - RNA, 20 nt, Human
cgggaaacuagaguuacuac

SEQ ID NO: 612473 - RNA, 18 nt, Human
cuccucccuccacuucuc

SEQ ID NO: 612474 - RNA, 24 nt, Human
cucuacucaccuuaaccccuucca

SEQ ID NO: 612475 - RNA, 25 nt, Human
cucucaguuccaaucauaauaucuc

SEQ ID NO: 612476 - RNA, 20 nt, Human
cucugaugcagugaccuuga

SEQ ID NO: 612477 - RNA, 18 nt, Human
cucuguuacauucccugu

SEQ ID NO: 612478 - RNA, 23 nt, Human
cugaccaacaugguaaaacccca

SEQ ID NO: 612479 - RNA, 26 nt, Human
cuggcccccucgaaucuguccuucca

SEQ ID NO: 612480 - RNA, 21 nt, Human
cuguaaucccagcuacucagg

SEQ ID NO: 612481 - RNA, 22 nt, Human
cuuacaccuguaaucucagcac

SEQ ID NO: 612482 - RNA, 19 nt, Human
cuucaacaacacccucacc

SEQ ID NO: 612483 - RNA, 21 nt, Human
gaaaaaaugcuaaaagagcac

SEQ ID NO: 612484 - RNA, 21 nt, Human
gaaaaagaaguaaggaaagag

SEQ ID NO: 612485 - RNA, 21 nt, Human
gaaaggaggggaggaggggga

SEQ ID NO: 612486 - RNA, 18 nt, Human
gaacccacagacccucuu

SEQ ID NO: 612487 - RNA, 23 nt, Human
gaagacagaagacaggcaaagag

SEQ ID NO: 612488 - RNA, 23 nt, Human
gaagcagguggaucacgagguca

SEQ ID NO: 612489 - RNA, 21 nt, Human
gacaccauacccccaacccuc

SEQ ID NO: 612490 - RNA, 23 nt, Human
gacaugguggcgcacaccuguaa

SEQ ID NO: 612491 - RNA, 21 nt, Human
gagacauagaucaacccgaaa

SEQ ID NO: 612492 - RNA, 19 nt, Human
gagcacuucuaccuccagg

SEQ ID NO: 612493 - RNA, 19 nt, Human
gaggaugggaugagagaga

SEQ ID NO: 612494 - RNA, 19 nt, Human
gaggggaggagggggaaaa

SEQ ID NO: 612495 - RNA, 20 nt, Human
gaguagagggaagagaaagu

SEQ ID NO: 612496 - RNA, 24 nt, Human
gaucacgaggucagaaguuugaga

SEQ ID NO: 612497 - RNA, 24 nt, Human
gcagaauccccuuuagugcacaag

SEQ ID NO: 612498 - RNA, 20 nt, Human
gcauagcuuagauggcagga

SEQ ID NO: 612499 - RNA, 24 nt, Human
gccacuacacucuagccuggguaa

SEQ ID NO: 612500 - RNA, 20 nt, Human
gcugagaucaugccacuaca

SEQ ID NO: 612501 - RNA, 19 nt, Human
ggaaagacaaggaagacag

SEQ ID NO: 612502 - RNA, 22 nt, Human
ggaaagagaagcacaggacagg

SEQ ID NO: 612503 - RNA, 23 nt, Human
ggaaagauuuggagcauggcaau

SEQ ID NO: 612504 - RNA, 23 nt, Human
ggaaagcagaaucugccacgauc

SEQ ID NO: 612505 - RNA, 24 nt, Human
ggaagacagaagacaggcaaagag

SEQ ID NO: 612506 - RNA, 20 nt, Human
ggaagcagaguaagauaugg

SEQ ID NO: 612507 - RNA, 25 nt, Human
ggaaggcuuuggaguuuucagagaa

SEQ ID NO: 612508 - RNA, 21 nt, Human
ggacaccauacccccaacccu

SEQ ID NO: 612509 - RNA, 22 nt, Human
ggacaccauacccccaacccuc

SEQ ID NO: 612510 - RNA, 23 nt, Human
gggaaagacaaggaagacagaag

SEQ ID NO: 612511 - RNA, 19 nt, Human
gggcaggccuccucuggag

SEQ ID NO: 612512 - RNA, 23 nt, Human
gggcaugaagaggggcaaugugg

SEQ ID NO: 612513 - RNA, 24 nt, Human
gggcucaguggcuuacaccuguaa

SEQ ID NO: 612514 - RNA, 18 nt, Human
ggggagagagauggaagc

SEQ ID NO: 612515 - RNA, 25 nt, Human
gggggaaaaagaaguaaggaaagag

SEQ ID NO: 612516 - RNA, 24 nt, Human
gguggcgcacaccuguaaucccag

SEQ ID NO: 612517 - RNA, 20 nt, Human
guaaggaaagagaagcacag

SEQ ID NO: 612518 - RNA, 26 nt, Human
gucccagagccuucuggaauuccucc

SEQ ID NO: 612519 - RNA, 18 nt, Human
gucugaaguccuucagcc

SEQ ID NO: 612520 - RNA, 24 nt, Human
guugcagugagcugagaucaugcc

SEQ ID NO: 612521 - RNA, 19 nt, Human
uaaagcagacugcaagaug

SEQ ID NO: 612522 - RNA, 21 nt, Human
uaaagcagacugcaagaugac

SEQ ID NO: 612523 - RNA, 18 nt, Human
uaacagguggccaggacu

SEQ ID NO: 612524 - RNA, 23 nt, Human
uaagggcaggccuccucuggagg

SEQ ID NO: 612525 - RNA, 23 nt, Human
uaaguagaaggggaaauagugag

SEQ ID NO: 612526 - RNA, 24 nt, Human
uacaccuguaaucucagcacuuug

SEQ ID NO: 612527 - RNA, 19 nt, Human
uaccaagucuucucaguuc

SEQ ID NO: 612528 - RNA, 22 nt, Human
uaccacauccucccuucaacaa

SEQ ID NO: 612529 - RNA, 18 nt, Human
uacccccaacccucccaa

SEQ ID NO: 612530 - RNA, 19 nt, Human
uacccccaacccucccaaa

SEQ ID NO: 612531 - RNA, 23 nt, Human
uaccuggacaccauacccccaac

SEQ ID NO: 612532 - RNA, 19 nt, Human
uagaguuacuaccuaaucc

SEQ ID NO: 612533 - RNA, 23 nt, Human
uagaugucucuuuuccugggaaa

SEQ ID NO: 612534 - RNA, 18 nt, Human
uagccggacaugguggcg

SEQ ID NO: 612535 - RNA, 20 nt, Human
uaggacugcgugugaguucc

SEQ ID NO: 612536 - RNA, 24 nt, Human
ucacgaggucagaaguuugagacc

SEQ ID NO: 612537 - RNA, 24 nt, Human
ucacuaugaauaaggguugcagaa

SEQ ID NO: 612538 - RNA, 22 nt, Human
ucaggaaucaugccuuuuuauu

SEQ ID NO: 612539 - RNA, 18 nt, Human
uccacuucucugagaaaa

SEQ ID NO: 612540 - RNA, 21 nt, Human
uccacuucucugagaaaacua

SEQ ID NO: 612541 - RNA, 22 nt, Human
uccauaaacacucaccaagggu

SEQ ID NO: 612542 - RNA, 18 nt, Human
ucccaaauagucaauuac

SEQ ID NO: 612543 - RNA, 23 nt, Human
ucccaaauagucaauuaccaagu

SEQ ID NO: 612544 - RNA, 22 nt, Human
uccccaaguagacugaaaguuc

SEQ ID NO: 612545 - RNA, 19 nt, Human
ucccuggugcaguuuguuu

SEQ ID NO: 612546 - RNA, 24 nt, Human
ucuagccuggguaacagagugaga

SEQ ID NO: 612547 - RNA, 21 nt, Human
ucuccccaaguagacugaaag

SEQ ID NO: 612548 - RNA, 21 nt, Human
ucucugcuaaaaauacaaaaa

SEQ ID NO: 612549 - RNA, 24 nt, Human
ugaaaaaaugcuaaaagagcacuu

SEQ ID NO: 612550 - RNA, 21 nt, Human
ugaagaaacuaagaggaaaag

SEQ ID NO: 612551 - RNA, 23 nt, Human
ugagaccagccugaccaacaugg

SEQ ID NO: 612552 - RNA, 24 nt, Human
ugagaccagccugaccaacauggu

SEQ ID NO: 612553 - RNA, 19 nt, Human
ugagagaagagaggggaga

SEQ ID NO: 612554 - RNA, 21 nt, Human
ugagagagaggacagaaagga

SEQ ID NO: 612555 - RNA, 24 nt, Human
ugagaucaugccacuacacucuag

SEQ ID NO: 612556 - RNA, 19 nt, Human
ugagcugagaucaugccac

SEQ ID NO: 612557 - RNA, 18 nt, Human
ugaggagggaggaggagg

SEQ ID NO: 612558 - RNA, 24 nt, Human
ugaggcaggggaaucgcuugaacc

SEQ ID NO: 612559 - RNA, 25 nt, Human
ugaggcaggggaaucgcuugaaccc

SEQ ID NO: 612560 - RNA, 21 nt, Human
ugaguagagggaagagaaagu

SEQ ID NO: 612561 - RNA, 21 nt, Human
ugauaaaugaguguuggcugu

SEQ ID NO: 612562 - RNA, 20 nt, Human
ugcauugaaucggccugagc

SEQ ID NO: 612563 - RNA, 18 nt, Human
uggaacccacagacccuc

SEQ ID NO: 612564 - RNA, 24 nt, Human
uggccaggacuuuggaacccacag

SEQ ID NO: 612565 - RNA, 21 nt, Human
uggcuuacaccuguaaucuca

SEQ ID NO: 612566 - RNA, 22 nt, Human
uggcuuacaccuguaaucucag

SEQ ID NO: 612567 - RNA, 24 nt, Human
uggcuuacaccuguaaucucagca

SEQ ID NO: 612568 - RNA, 24 nt, Human
ugggaggccgaagcagguggauca

SEQ ID NO: 612569 - RNA, 24 nt, Human
ugguggcgcacaccuguaauccca

SEQ ID NO: 612570 - RNA, 21 nt, Human
uguauauggguagcaguaagc

SEQ ID NO: 612571 - RNA, 22 nt, Human
uguauggggcaugaagaggggc

SEQ ID NO: 612572 - RNA, 19 nt, Human
ugucccugucuacaauacu

SEQ ID NO: 612573 - RNA, 20 nt, Human
uguggaaugaagcauaugca

SEQ ID NO: 612574 - RNA, 23 nt, Human
uuaucucuucccuuuucugucuc

SEQ ID NO: 612575 - RNA, 23 nt, Human
uucccugcacagaggaauuccau

SEQ ID NO: 612576 - RNA, 22 nt, Human
uucccugugccuagaacuuuac

SEQ ID NO: 612577 - RNA, 19 nt, Human
uuccucagagcagagccua

SEQ ID NO: 612578 - RNA, 19 nt, Human
uuccuggcaagguaccugg

SEQ ID NO: 612579 - RNA, 18 nt, Human
uuccugggaaaucuuccc

SEQ ID NO: 612580 - RNA, 19 nt, Human
uugcagugagcugagauca

SEQ ID NO: 612581 - RNA, 20 nt, Human
uugcagugagcugagaucau

SEQ ID NO: 612582 - RNA, 20 nt, Human
uuucuacuaagaaacacauu

SEQ ID NO: 612583 - RNA, 21 nt, Human
aacacaccaucccaaccccuc

SEQ ID NO: 612584 - RNA, 22 nt, Human
aacacaccaucccaaccccucc

SEQ ID NO: 612585 - RNA, 23 nt, Human
aacccaagcaacuaggacccaaa

SEQ ID NO: 612586 - RNA, 19 nt, Human
aagauggacaagaggaccc

SEQ ID NO: 612587 - RNA, 22 nt, Human
acuauggucccagcuuucccag

SEQ ID NO: 612588 - RNA, 22 nt, Human
acuccucugcaagcccccacug

SEQ ID NO: 612589 - RNA, 21 nt, Human
acucuuggugaccacugaggu

SEQ ID NO: 612590 - RNA, 21 nt, Human
agagaaaacacaccaucccaa

SEQ ID NO: 612591 - RNA, 24 nt, Human
cacaccaucccaaccccuccucag

SEQ ID NO: 612592 - RNA, 22 nt, Human
cacuccucugcaagcccccacu

SEQ ID NO: 612593 - RNA, 19 nt, Human
cagccccucagucaguccu

SEQ ID NO: 612594 - RNA, 18 nt, Human
cagggauggggaaggcua

SEQ ID NO: 612595 - RNA, 27 nt, Human
cagucaguccuuccucucugcuggcuu

SEQ ID NO: 612596 - RNA, 21 nt, Human
caucccaaccccuccucagga

SEQ ID NO: 612597 - RNA, 23 nt, Human
ccaaauucccauaagaggaccgg

SEQ ID NO: 612598 - RNA, 22 nt, Human
ccaaccccuccucaggacauac

SEQ ID NO: 612599 - RNA, 19 nt, Human
cccaaccccuccucaggac

SEQ ID NO: 612600 - RNA, 22 nt, Human
ccccacugugaggcuugaagau

SEQ ID NO: 612601 - RNA, 25 nt, Human
cccccugaccccagcccugcgaggc

SEQ ID NO: 612602 - RNA, 23 nt, Human
cccugaccccagcccugcgaggc

SEQ ID NO: 612603 - RNA, 27 nt, Human
ccgccgccgccguaguugcugcugccg

SEQ ID NO: 612604 - RNA, 18 nt, Human
ccggggcuccuguggguc

SEQ ID NO: 612605 - RNA, 21 nt, Human
ccuaguucucaagggagcccu

SEQ ID NO: 612606 - RNA, 20 nt, Human
ccucauaaaagggaggugag

SEQ ID NO: 612607 - RNA, 27 nt, Human
cgcugcuggguucugccgccgccgccg

SEQ ID NO: 612608 - RNA, 21 nt, Human
cuauggauuuucaggucaaac

SEQ ID NO: 612609 - RNA, 23 nt, Human
cuccccuagucuuugggcuggag

SEQ ID NO: 612610 - RNA, 24 nt, Human
cuccucugcaagcccccacuguga

SEQ ID NO: 612611 - RNA, 20 nt, Human
cucucugcuggcuucagucu

SEQ ID NO: 612612 - RNA, 24 nt, Human
cugcaagcccccacugugaggcuu

SEQ ID NO: 612613 - RNA, 19 nt, Human
cuugaagauggacaagagg

SEQ ID NO: 612614 - RNA, 21 nt, Human
cuuuccuggcuuucccucugg

SEQ ID NO: 612615 - RNA, 23 nt, Human
gaaaacacaccaucccaaccccu

SEQ ID NO: 612616 - RNA, 27 nt, Human
gaagcaauuccuguauuguccaaccca

SEQ ID NO: 612617 - RNA, 25 nt, Human
gacaagaggacccucauaaaaggga

SEQ ID NO: 612618 - RNA, 18 nt, Human
gagcacuauggucccagc

SEQ ID NO: 612619 - RNA, 23 nt, Human
gcccugcgaggcuauaccagggg

SEQ ID NO: 612620 - RNA, 24 nt, Human
gcuugaagauggacaagaggaccc

SEQ ID NO: 612621 - RNA, 22 nt, Human
ggacaagacgagggauguuccc

SEQ ID NO: 612622 - RNA, 19 nt, Human
guccuuccucucugcuggc

SEQ ID NO: 612623 - RNA, 23 nt, Human
uagugggcccugcccuauggauu

SEQ ID NO: 612624 - RNA, 23 nt, Human
uaucuugccacucuuggugacca

SEQ ID NO: 612625 - RNA, 21 nt, Human
ucagacagggauggggaaggc

SEQ ID NO: 612626 - RNA, 20 nt, Human
uccaccuccacaucgcugcu

SEQ ID NO: 612627 - RNA, 18 nt, Human
ucccucugggcaggguau

SEQ ID NO: 612628 - RNA, 24 nt, Human
uccucugcaagcccccacugugag

SEQ ID NO: 612629 - RNA, 22 nt, Human
ucuuugggcuggagcacuaugg

SEQ ID NO: 612630 - RNA, 22 nt, Human
ugaccacccacuucccaaucuu

SEQ ID NO: 612631 - RNA, 20 nt, Human
ugagugggcaagggcccccu

SEQ ID NO: 612632 - RNA, 21 nt, Human
ugcaagcccccacugugaggc

SEQ ID NO: 612633 - RNA, 18 nt, Human
ugcuggcuucagucugca

SEQ ID NO: 612634 - RNA, 22 nt, Human
uggggaaggcuaggugaguggg

SEQ ID NO: 612635 - RNA, 21 nt, Human
uucugccgccgccgccguagu

SEQ ID NO: 612636 - RNA, 24 nt, Human
uucuuuaucuugccacucuuggug

SEQ ID NO: 612637 - RNA, 21 nt, Human
aaaggugcauacucugcuuuc

SEQ ID NO: 612638 - RNA, 22 nt, Human
acagaaaaacaaguccuccccu

SEQ ID NO: 612639 - RNA, 23 nt, Human
accacaaauccacuccuggguga

SEQ ID NO: 612640 - RNA, 23 nt, Human
acuuucugagaggacugggaaau

SEQ ID NO: 612641 - RNA, 19 nt, Human
agaaaaacaaguccucccc

SEQ ID NO: 612642 - RNA, 22 nt, Human
agaaacagauaaaacucaaacg

SEQ ID NO: 612643 - RNA, 21 nt, Human
agagaaacagauaaaacucaa

SEQ ID NO: 612644 - RNA, 22 nt, Human
agagaaacagauaaaacucaaa

SEQ ID NO: 612645 - RNA, 18 nt, Human
cacacacuguucaucagg

SEQ ID NO: 612646 - RNA, 22 nt, Human
caccuuauucaaguacaaaucu

SEQ ID NO: 612647 - RNA, 21 nt, Human
cagaaaaacaaguccuccccu

SEQ ID NO: 612648 - RNA, 18 nt, Human
ccugggugagaaauaacu

SEQ ID NO: 612649 - RNA, 25 nt, Human
ccugggugagaaauaacuagcuucu

SEQ ID NO: 612650 - RNA, 21 nt, Human
cucaaggagaacaugaaaaaa

SEQ ID NO: 612651 - RNA, 22 nt, Human
cucaaggagaacaugaaaaaag

SEQ ID NO: 612652 - RNA, 23 nt, Human
cuuucaauuuccucauccuuccu

SEQ ID NO: 612653 - RNA, 20 nt, Human
gaaaaacaaguccuccccuc

SEQ ID NO: 612654 - RNA, 27 nt, Human
ggaaauaaaggagagaaaccgguaccc

SEQ ID NO: 612655 - RNA, 21 nt, Human
guacucuuguauguuguguga

SEQ ID NO: 612656 - RNA, 18 nt, Human
uaaaaagaccacaacagg

SEQ ID NO: 612657 - RNA, 20 nt, Human
uacaagcaaauccccacaca

SEQ ID NO: 612658 - RNA, 24 nt, Human
uacauacaagcaaauccccacaca

SEQ ID NO: 612659 - RNA, 22 nt, Human
uauaguaacuuguaaaagaauu

SEQ ID NO: 612660 - RNA, 26 nt, Human
ucuaaaacagaaaaacaaguccuccc

SEQ ID NO: 612661 - RNA, 18 nt, Human
ucuucaccuuauucaagu

SEQ ID NO: 612662 - RNA, 20 nt, Human
ugaaaaauagaaaaacuacc

SEQ ID NO: 612663 - RNA, 18 nt, Human
ugaaauucuucaccuuau

SEQ ID NO: 612664 - RNA, 23 nt, Human
ugaagccaaaccacaaauccacu

SEQ ID NO: 612665 - RNA, 18 nt, Human
ugaggcuaauccaguagg

SEQ ID NO: 612666 - RNA, 18 nt, Human
ugccgaauaauaauaaac

SEQ ID NO: 612667 - RNA, 22 nt, Human
ugccgaauaauaauaaacaaca

SEQ ID NO: 612668 - RNA, 26 nt, Human
ugucacaaagauuuaacgauauaagg

SEQ ID NO: 612669 - RNA, 25 nt, Human
aaagcaaugagguuuggcugaaggc

SEQ ID NO: 612670 - RNA, 27 nt, Human
aaagcaaugagguuuggcugaaggcuc

SEQ ID NO: 612671 - RNA, 24 nt, Human
aaagugcugagguuacaggcguga

SEQ ID NO: 612672 - RNA, 24 nt, Human
aagaggcccagcccaguuaggacc

SEQ ID NO: 612673 - RNA, 24 nt, Human
aagauuuuuccauacuuaccacac

SEQ ID NO: 612674 - RNA, 20 nt, Human
aaggcucucccacauuaccc

SEQ ID NO: 612675 - RNA, 19 nt, Human
aaguagcugggacuacagg

SEQ ID NO: 612676 - RNA, 20 nt, Human
aaguagcugggacuacaggc

SEQ ID NO: 612677 - RNA, 26 nt, Human
aagugcugagguuacaggcgugagcc

SEQ ID NO: 612678 - RNA, 21 nt, Human
aauaauaugcauccucugauc

SEQ ID NO: 612679 - RNA, 18 nt, Human
acaggguuucacuguguu

SEQ ID NO: 612680 - RNA, 19 nt, Human
acaggguuucacuguguua

SEQ ID NO: 612681 - RNA, 20 nt, Human
acaggguuucacuguguuag

SEQ ID NO: 612682 - RNA, 24 nt, Human
acaggguuucacuguguuagccag

SEQ ID NO: 612683 - RNA, 24 nt, Human
acauccaccaaagcccuucccaca

SEQ ID NO: 612684 - RNA, 19 nt, Human
accacaggaaagaggccca

SEQ ID NO: 612685 - RNA, 25 nt, Human
acucugucucccaggcuggagugca

SEQ ID NO: 612686 - RNA, 20 nt, Human
agacacggccacagccacgc

SEQ ID NO: 612687 - RNA, 18 nt, Human
agacaggguuucacugug

SEQ ID NO: 612688 - RNA, 19 nt, Human
agagacaggguuucacugu

SEQ ID NO: 612689 - RNA, 21 nt, Human
agaugaauacugaagcuugaa

SEQ ID NO: 612690 - RNA, 21 nt, Human
aggaagagauacaacugaaga

SEQ ID NO: 612691 - RNA, 18 nt, Human
aggcagaaaaucaccaga

SEQ ID NO: 612692 - RNA, 23 nt, Human
aggcagaaaaucaccagacaagg

SEQ ID NO: 612693 - RNA, 18 nt, Human
aggcucucccacauuacc

SEQ ID NO: 612694 - RNA, 25 nt, Human
aggcuggagugcaguggcgugaucu

SEQ ID NO: 612695 - RNA, 19 nt, Human
agguaugaauuuucugaug

SEQ ID NO: 612696 - RNA, 24 nt, Human
agguuacaggcgugagccaccgcg

SEQ ID NO: 612697 - RNA, 23 nt, Human
aguagcugggacuacaggcgccc

SEQ ID NO: 612698 - RNA, 19 nt, Human
agugcaguggcgugaucuc

SEQ ID NO: 612699 - RNA, 22 nt, Human
agugcaguggcgugaucucggc

SEQ ID NO: 612700 - RNA, 23 nt, Human
agugcaguggcgugaucucggcu

SEQ ID NO: 612701 - RNA, 24 nt, Human
agugcaguggcgugaucucggcug

SEQ ID NO: 612702 - RNA, 18 nt, Human
aucaaagcguucccacau

SEQ ID NO: 612703 - RNA, 24 nt, Human
caaagauccugucuauuaaucucc

SEQ ID NO: 612704 - RNA, 24 nt, Human
caaagugcugagguuacaggcgug

SEQ ID NO: 612705 - RNA, 31 nt, Human
caaguuggaaaggaacuuuccucacauucaa

SEQ ID NO: 612706 - RNA, 25 nt, Human
caccaggcagaaaaucaccagacaa

SEQ ID NO: 612707 - RNA, 24 nt, Human
cacccaugcaugacacccugcccc

SEQ ID NO: 612708 - RNA, 22 nt, Human
cacgccauucuccugucucagc

SEQ ID NO: 612709 - RNA, 24 nt, Human
cacucugucucccaggcuggagug

SEQ ID NO: 612710 - RNA, 18 nt, Human
cacuguguuagccaggau

SEQ ID NO: 612711 - RNA, 19 nt, Human
cacuguguuagccaggaug

SEQ ID NO: 612712 - RNA, 24 nt, Human
cacuguguuagccaggauggucuc

SEQ ID NO: 612713 - RNA, 25 nt, Human
cagcccaguuaggacuauaggccaa

SEQ ID NO: 612714 - RNA, 22 nt, Human
caggagacacggccacagccac

SEQ ID NO: 612715 - RNA, 24 nt, Human
caggguuucacuguguuagccagg

SEQ ID NO: 612716 - RNA, 27 nt, Human
caggucccgaggccuggcuuucaggaa

SEQ ID NO: 612717 - RNA, 22 nt, Human
caucauguucccaagguuucuc

SEQ ID NO: 612718 - RNA, 20 nt, Human
ccaaagugcugagguuacag

SEQ ID NO: 612719 - RNA, 22 nt, Human
ccaaagugcugagguuacaggc

SEQ ID NO: 612720 - RNA, 22 nt, Human
ccaaagugcugagguuacaggc

SEQ ID NO: 612721 - RNA, 24 nt, Human
ccaaagugcugagguuacaggcgu

SEQ ID NO: 612722 - RNA, 22 nt, Human
ccaaguagcugggacuacaggc

SEQ ID NO: 612723 - RNA, 22 nt, Human
ccacacuuguaggauuucucuc

SEQ ID NO: 612724 - RNA, 20 nt, Human
ccaccaggcagaaaaucacc

SEQ ID NO: 612725 - RNA, 20 nt, Human
ccaccgcgcccagccuauuu

SEQ ID NO: 612726 - RNA, 18 nt, Human
ccaggagacacggccaca

SEQ ID NO: 612727 - RNA, 21 nt, Human
cccaccaggcagaaaaucacc

SEQ ID NO: 612728 - RNA, 19 nt, Human
cccaggcuggagugcagug

SEQ ID NO: 612729 - RNA, 22 nt, Human
cccaggcuggagugcaguggcg

SEQ ID NO: 612730 - RNA, 18 nt, Human
ccccgcugucccugccua

SEQ ID NO: 612731 - RNA, 20 nt, Human
ccccggcucggcuccuccuc

SEQ ID NO: 612732 - RNA, 20 nt, Human
cccgaggccuggcuuucagg

SEQ ID NO: 612733 - RNA, 22 nt, Human
ccuuucucagccuccauccucu

SEQ ID NO: 612734 - RNA, 24 nt, Human
cgccucggccucccaaagugcuga

SEQ ID NO: 612735 - RNA, 18 nt, Human
cggcucggcuccuccuca

SEQ ID NO: 612736 - RNA, 21 nt, Human
cucacauucaucauguuccca

SEQ ID NO: 612737 - RNA, 24 nt, Human
cucacucugucucccaggcuggag

SEQ ID NO: 612738 - RNA, 24 nt, Human
cucagccuuccaaguagcugggac

SEQ ID NO: 612739 - RNA, 19 nt, Human
cuccagcugaaagcccuuc

SEQ ID NO: 612740 - RNA, 24 nt, Human
cuccugaccucgugaucuguccgc

SEQ ID NO: 612741 - RNA, 18 nt, Human
cucggcugacugcaagcu

SEQ ID NO: 612742 - RNA, 25 nt, Human
cugaaagcccuucuauauucacuga

SEQ ID NO: 612743 - RNA, 23 nt, Human
cugucucagccuuccaaguagcu

SEQ ID NO: 612744 - RNA, 18 nt, Human
cuucuauauucacugaau

SEQ ID NO: 612745 - RNA, 21 nt, Human
gacacggccacagccacgccc

SEQ ID NO: 612746 - RNA, 22 nt, Human
gaccucgugaucuguccgccuc

SEQ ID NO: 612747 - RNA, 24 nt, Human
gaccucgugaucuguccgccucgg

SEQ ID NO: 612748 - RNA, 22 nt, Human
gacuacaggcgcccgccaccau

SEQ ID NO: 612749 - RNA, 22 nt, Human
gagagacaggguuucacugugu

SEQ ID NO: 612750 - RNA, 19 nt, Human
gaucauggguagcugucua

SEQ ID NO: 612751 - RNA, 24 nt, Human
gccuggcuaauuuuuuuguauuuu

SEQ ID NO: 612752 - RNA, 19 nt, Human
gcuggagugcaguggcgug

SEQ ID NO: 612753 - RNA, 19 nt, Human
ggaaaggaacuuuccucac

SEQ ID NO: 612754 - RNA, 22 nt, Human
ggagagacaggguuucacugug

SEQ ID NO: 612755 - RNA, 19 nt, Human
ggaggaagagcaggauucu

SEQ ID NO: 612756 - RNA, 24 nt, Human
ggauggucucgaacuccugaccuc

SEQ ID NO: 612757 - RNA, 22 nt, Human
ggcucggcuccuccucaggacc

SEQ ID NO: 612758 - RNA, 22 nt, Human
ggcuggagugcaguggcgugau

SEQ ID NO: 612759 - RNA, 23 nt, Human
ggcugucugaugcugaauaauau

SEQ ID NO: 612760 - RNA, 21 nt, Human
gguuacaggcgugagccaccg

SEQ ID NO: 612761 - RNA, 22 nt, Human
gguuacaggcgugagccaccgc

SEQ ID NO: 612762 - RNA, 18 nt, Human
gucaguaacagcaugagg

SEQ ID NO: 612763 - RNA, 21 nt, Human
gugaucucggcugacugcaag

SEQ ID NO: 612764 - RNA, 21 nt, Human
guggaacauccaccaaagccc

SEQ ID NO: 612765 - RNA, 19 nt, Human
uaacugaaggcuugccaca

SEQ ID NO: 612766 - RNA, 26 nt, Human
uacaaauggccccaccaggcagaaaa

SEQ ID NO: 612767 - RNA, 24 nt, Human
uacaggcgugagccaccgcgccca

SEQ ID NO: 612768 - RNA, 19 nt, Human
uagcacaaauucucuaaug

SEQ ID NO: 612769 - RNA, 24 nt, Human
uagccaggauggucucgaacuccu

SEQ ID NO: 612770 - RNA, 24 nt, Human
uaggagagacaggguuucacugug

SEQ ID NO: 612771 - RNA, 20 nt, Human
ucacaaagaaagguaacaug

SEQ ID NO: 612772 - RNA, 24 nt, Human
ucaccagacaaggugauuucucag

SEQ ID NO: 612773 - RNA, 24 nt, Human
ucacuguguuagccaggauggucu

SEQ ID NO: 612774 - RNA, 21 nt, Human
ucagacuaccaggagacacgg

SEQ ID NO: 612775 - RNA, 18 nt, Human
ucagcuucuuuucagcuc

SEQ ID NO: 612776 - RNA, 23 nt, Human
uccaaguagcugggacuacaggc

SEQ ID NO: 612777 - RNA, 23 nt, Human
uccaaguagcugggacuacaggc

SEQ ID NO: 612778 - RNA, 18 nt, Human
uccacacgcacagugggc

SEQ ID NO: 612779 - RNA, 19 nt, Human
uccaccaaagcccuuccca

SEQ ID NO: 612780 - RNA, 23 nt, Human
uccaccaaagcccuucccacauu

SEQ ID NO: 612781 - RNA, 25 nt, Human
uccauacuacagcugugaaccacag

SEQ ID NO: 612782 - RNA, 28 nt, Human
uccauacuacagcugugaaccacaggaa

SEQ ID NO: 612783 - RNA, 25 nt, Human
uccauacuuaccacacuuguaggau

SEQ ID NO: 612784 - RNA, 24 nt, Human
ucccaaagugcugagguuacaggc

SEQ ID NO: 612785 - RNA, 24 nt, Human
ucccaggcuggagugcaguggcgu

SEQ ID NO: 612786 - RNA, 23 nt, Human
uccuagaccacuccauugccuca

SEQ ID NO: 612787 - RNA, 19 nt, Human
ucggagggacacacccagc

SEQ ID NO: 612788 - RNA, 18 nt, Human
ucggccucccaaagugcu

SEQ ID NO: 612789 - RNA, 20 nt, Human
ucuaccuuucucagccucca

SEQ ID NO: 612790 - RNA, 23 nt, Human
ucucacucugucucccaggcugg

SEQ ID NO: 612791 - RNA, 24 nt, Human
ucucacucugucucccaggcugga

SEQ ID NO: 612792 - RNA, 22 nt, Human
ucuccauacuacagcugugaac

SEQ ID NO: 612793 - RNA, 24 nt, Human
ucucccaggcuggagugcaguggc

SEQ ID NO: 612794 - RNA, 20 nt, Human
ucuccugggaaucucucugg

SEQ ID NO: 612795 - RNA, 26 nt, Human
ucuccugucucagccuuccaaguagc

SEQ ID NO: 612796 - RNA, 19 nt, Human
ucucgaacuccugaccucg

SEQ ID NO: 612797 - RNA, 20 nt, Human
ucucuccaguacaaguuauc

SEQ ID NO: 612798 - RNA, 21 nt, Human
ucucuuuaguaauuauugccu

SEQ ID NO: 612799 - RNA, 19 nt, Human
ucugucucccaggcuggag

SEQ ID NO: 612800 - RNA, 26 nt, Human
ucuucccacauacauuacaccuuuag

SEQ ID NO: 612801 - RNA, 22 nt, Human
ucuuuaguaauuauugccugau

SEQ ID NO: 612802 - RNA, 18 nt, Human
ugacugaaggccuuccuc

SEQ ID NO: 612803 - RNA, 19 nt, Human
ugacugcaagcucugccuc

SEQ ID NO: 612804 - RNA, 18 nt, Human
ugagaaggggaagccccg

SEQ ID NO: 612805 - RNA, 22 nt, Human
ugagaaggggaagccccggcuc

SEQ ID NO: 612806 - RNA, 24 nt, Human
ugagaaggggaagccccggcucgg

SEQ ID NO: 612807 - RNA, 22 nt, Human
ugagacggagucucacucuguc

SEQ ID NO: 612808 - RNA, 19 nt, Human
ugagaugaauacugaagcu

SEQ ID NO: 612809 - RNA, 19 nt, Human
ugagguuacaggcgugagc

SEQ ID NO: 612810 - RNA, 22 nt, Human
ugagguuacaggcgugagccac

SEQ ID NO: 612811 - RNA, 23 nt, Human
ugagguuacaggcgugagccacc

SEQ ID NO: 612812 - RNA, 24 nt, Human
ugagguuacaggcgugagccaccg

SEQ ID NO: 612813 - RNA, 18 nt, Human
ugauaaggcuccucccca

SEQ ID NO: 612814 - RNA, 23 nt, Human
ugaucaaagcguucccacauuca

SEQ ID NO: 612815 - RNA, 24 nt, Human
ugcacagucccuagcggggggcac

SEQ ID NO: 612816 - RNA, 18 nt, Human
ugcacccaugcaugacac

SEQ ID NO: 612817 - RNA, 20 nt, Human
uggaacauccaccaaagccc

SEQ ID NO: 612818 - RNA, 19 nt, Human
uggagugcaguggcgugau

SEQ ID NO: 612819 - RNA, 23 nt, Human
uggagugcaguggcgugaucucg

SEQ ID NO: 612820 - RNA, 24 nt, Human
uggagugcaguggcgugaucucgg

SEQ ID NO: 612821 - RNA, 23 nt, Human
ugggaaucucucuggaggaagag

SEQ ID NO: 612822 - RNA, 21 nt, Human
ugggacuacaggcgcccgcca

SEQ ID NO: 612823 - RNA, 22 nt, Human
ugggacuacaggcgcccgccac

SEQ ID NO: 612824 - RNA, 24 nt, Human
ugggacuacaggcgcccgccacca

SEQ ID NO: 612825 - RNA, 25 nt, Human
ugggacuacaggcgcccgccaccau

SEQ ID NO: 612826 - RNA, 19 nt, Human
ugucucagccuuccaagua

SEQ ID NO: 612827 - RNA, 21 nt, Human
ugucucccaggcuggagugca

SEQ ID NO: 612828 - RNA, 23 nt, Human
ugugaaccacaggaaagaggccc

SEQ ID NO: 612829 - RNA, 24 nt, Human
uuaggagagacaggguuucacugu

SEQ ID NO: 612830 - RNA, 21 nt, Human
uucacuguguuagccaggaug

SEQ ID NO: 612831 - RNA, 19 nt, Human
uuucacuguguuagccagg

SEQ ID NO: 612832 - RNA, 23 nt, Human
uuucccaguuucacuaaauuuga

SEQ ID NO: 612833 - RNA, 20 nt, Human
uuucucagguaugaauuuuc

SEQ ID NO: 612834 - RNA, 24 nt, Human
uuuuuaggagagacaggguuucac

SEQ ID NO: 612835 - RNA, 19 nt, Human
uuuuuuguauuuuuaggag

SEQ ID NO: 612836 - RNA, 24 nt, Human
uuuuuuguauuuuuaggagagaca

SEQ ID NO: 612837 - RNA, 24 nt, Human
aaagggcuaggauuacaggcguga

SEQ ID NO: 612838 - RNA, 24 nt, Human
aagugaucugcccgccuuggccuu

SEQ ID NO: 612839 - RNA, 23 nt, Human
aauagcugagaccacagguaugu

SEQ ID NO: 612840 - RNA, 24 nt, Human
aauuuuguauuuuuaguacagaug

SEQ ID NO: 612841 - RNA, 22 nt, Human
acagcgaguguguggccccacu

SEQ ID NO: 612842 - RNA, 25 nt, Human
acggaguuucacuguuguugcccag

SEQ ID NO: 612843 - RNA, 24 nt, Human
acuguuguugcccaggcuggagug

SEQ ID NO: 612844 - RNA, 19 nt, Human
acuuuggccccccaccgcc

SEQ ID NO: 612845 - RNA, 22 nt, Human
agagacagagucucccucuguu

SEQ ID NO: 612846 - RNA, 22 nt, Human
agaugggguuucuccauguugg

SEQ ID NO: 612847 - RNA, 23 nt, Human
agaugggguuucuccauguuggu

SEQ ID NO: 612848 - RNA, 24 nt, Human
agcgauucuccugccucagccucc

SEQ ID NO: 612849 - RNA, 24 nt, Human
agcugggauuacaagcaugcgcca

SEQ ID NO: 612850 - RNA, 21 nt, Human
aggaggaggcacccagguggc

SEQ ID NO: 612851 - RNA, 18 nt, Human
aggcaaucuuccugccuc

SEQ ID NO: 612852 - RNA, 19 nt, Human
aggcccaacaaauacaaga

SEQ ID NO: 612853 - RNA, 21 nt, Human
agggagguugagacggacagg

SEQ ID NO: 612854 - RNA, 18 nt, Human
agggcuaggauuacaggc

SEQ ID NO: 612855 - RNA, 18 nt, Human
agguggaccuggagcugg

SEQ ID NO: 612856 - RNA, 21 nt, Human
agguuggagugcagugguguu

SEQ ID NO: 612857 - RNA, 21 nt, Human
aguagcugggauuacaagcau

SEQ ID NO: 612858 - RNA, 23 nt, Human
aguagcugggauuacaagcaugc

SEQ ID NO: 612859 - RNA, 21 nt, Human
agugcaauggcgcgaucucag

SEQ ID NO: 612860 - RNA, 23 nt, Human
agugcagugguguuaccauagcu

SEQ ID NO: 612861 - RNA, 24 nt, Human
agugcagugguguuaccauagcuc

SEQ ID NO: 612862 - RNA, 24 nt, Human
aguguguggccccacuuuggcccc

SEQ ID NO: 612863 - RNA, 24 nt, Human
auagcucacugcagacuuggccuc

SEQ ID NO: 612864 - RNA, 19 nt, Human
auccuccugccuuggccuc

SEQ ID NO: 612865 - RNA, 21 nt, Human
augggguuucuccauguuggu

SEQ ID NO: 612866 - RNA, 24 nt, Human
augggguuucuccauguuggucag

SEQ ID NO: 612867 - RNA, 25 nt, Human
caaacuccugggcucaagagauccu

SEQ ID NO: 612868 - RNA, 24 nt, Human
caaagggcuaggauuacaggcgug

SEQ ID NO: 612869 - RNA, 24 nt, Human
caaagugcagaaauuucucuuaua

SEQ ID NO: 612870 - RNA, 22 nt, Human
caagagauccuccugccuuggc

SEQ ID NO: 612871 - RNA, 22 nt, Human
caagcgauucuccugccucagc

SEQ ID NO: 612872 - RNA, 22 nt, Human
cacaggcuguccgugaggcugg

SEQ ID NO: 612873 - RNA, 22 nt, Human
cacagguaugugccaccauacc

SEQ ID NO: 612874 - RNA, 18 nt, Human
cacccagguggcacuggc

SEQ ID NO: 612875 - RNA, 21 nt, Human
cacugcaaccuccgccuccug

SEQ ID NO: 612876 - RNA, 23 nt, Human
cacugcaaccuccgccuccuggg

SEQ ID NO: 612877 - RNA, 19 nt, Human
cacuggcacaggggaggag

SEQ ID NO: 612878 - RNA, 24 nt, Human
cacuguuguugcccaggcuggagu

SEQ ID NO: 612879 - RNA, 24 nt, Human
cagagucucccucuguugcccagg

SEQ ID NO: 612880 - RNA, 26 nt, Human
cagcaggagguggaccuggagcuggg

SEQ ID NO: 612881 - RNA, 22 nt, Human
cagcccccugcacaggcugucc

SEQ ID NO: 612882 - RNA, 23 nt, Human
caggaggaggcacccagguggca

SEQ ID NO: 612883 - RNA, 24 nt, Human
cagggugagcaguagcccaggccc

SEQ ID NO: 612884 - RNA, 21 nt, Human
caguuucaaagugcagaaauu

SEQ ID NO: 612885 - RNA, 22 nt, Human
ccaaagggcuaggauuacaggc

SEQ ID NO: 612886 - RNA, 22 nt, Human
ccaaagggcuaggauuacaggc

SEQ ID NO: 612887 - RNA, 24 nt, Human
ccaaagggcuaggauuacaggcgu

SEQ ID NO: 612888 - RNA, 21 nt, Human
ccaccauaccuggcuuaaaau

SEQ ID NO: 612889 - RNA, 20 nt, Human
ccaccaugcagggcaaauuu

SEQ ID NO: 612890 - RNA, 19 nt, Human
ccauguuggucaggcuggu

SEQ ID NO: 612891 - RNA, 23 nt, Human
ccauguuggucaggcuggucucg

SEQ ID NO: 612892 - RNA, 24 nt, Human
cccaggcccaacaaauacaagaca

SEQ ID NO: 612893 - RNA, 18 nt, Human
ccccaccgccucccagca

SEQ ID NO: 612894 - RNA, 19 nt, Human
ccccccaccgccucccagc

SEQ ID NO: 612895 - RNA, 20 nt, Human
ccccccaccgccucccagca

SEQ ID NO: 612896 - RNA, 19 nt, Human
cccccugcacaggcugucc

SEQ ID NO: 612897 - RNA, 19 nt, Human
cccgaguagcugggauuac

SEQ ID NO: 612898 - RNA, 23 nt, Human
cccgccuuggccuuccaaagggc

SEQ ID NO: 612899 - RNA, 23 nt, Human
cccguggcuggcuaauuuuugua

SEQ ID NO: 612900 - RNA, 24 nt, Human
ccgccuccuggguucaagcgauuc

SEQ ID NO: 612901 - RNA, 19 nt, Human
ccucccagcaggaggugga

SEQ ID NO: 612902 - RNA, 19 nt, Human
ccuccgccuccuggguuca

SEQ ID NO: 612903 - RNA, 24 nt, Human
ccuccugccuuggccuccugaaua

SEQ ID NO: 612904 - RNA, 24 nt, Human
ccuccugggcuuaggcaaucuucc

SEQ ID NO: 612905 - RNA, 24 nt, Human
ccuccuggguucaagcgauucucc

SEQ ID NO: 612906 - RNA, 23 nt, Human
ccugccucagccucccgaguagc

SEQ ID NO: 612907 - RNA, 24 nt, Human
ccugccucagccucccgaguagcu

SEQ ID NO: 612908 - RNA, 25 nt, Human
ccugccucagucucucaaaggagcu

SEQ ID NO: 612909 - RNA, 23 nt, Human
ccugccuuggccuccugaauagc

SEQ ID NO: 612910 - RNA, 20 nt, Human
ccugggcucaagagauccuc

SEQ ID NO: 612911 - RNA, 23 nt, Human
ccuggguucaagcgauucuccug

SEQ ID NO: 612912 - RNA, 18 nt, Human
cgaccucaagugaucugc

SEQ ID NO: 612913 - RNA, 22 nt, Human
cggcgguggcggggcccccggg

SEQ ID NO: 612914 - RNA, 22 nt, Human
cgggggcuccccguccccgcug

SEQ ID NO: 612915 - RNA, 18 nt, Human
cucaagagauccuccugc

SEQ ID NO: 612916 - RNA, 24 nt, Human
cucacugcaaccuccgccuccugg

SEQ ID NO: 612917 - RNA, 23 nt, Human
cucagccucccgaguagcuggga

SEQ ID NO: 612918 - RNA, 24 nt, Human
cuccauguuggucaggcuggucuc

SEQ ID NO: 612919 - RNA, 20 nt, Human
cuccccguccccgcugcggc

SEQ ID NO: 612920 - RNA, 26 nt, Human
cucccgaccucaagugaucugcccgc

SEQ ID NO: 612921 - RNA, 20 nt, Human
cuccggcggcugccgcuggu

SEQ ID NO: 612922 - RNA, 24 nt, Human
cuccugaauagcugagaccacagg

SEQ ID NO: 612923 - RNA, 21 nt, Human
cuccugccuuggccuccugaa

SEQ ID NO: 612924 - RNA, 25 nt, Human
cuccugggcucaagagauccuccug

SEQ ID NO: 612925 - RNA, 20 nt, Human
cuccugggcuuaggcaaucu

SEQ ID NO: 612926 - RNA, 21 nt, Human
cuccuggguucaagcgauucu

SEQ ID NO: 612927 - RNA, 18 nt, Human
cucuguugcccagguugg

SEQ ID NO: 612928 - RNA, 21 nt, Human
cugaagcccagcccccugcac

SEQ ID NO: 612929 - RNA, 23 nt, Human
cugcaaccuccgccuccuggguu

SEQ ID NO: 612930 - RNA, 25 nt, Human
cugcacaggcuguccgugaggcugg

SEQ ID NO: 612931 - RNA, 19 nt, Human
cugccccuugcugaagccc

SEQ ID NO: 612932 - RNA, 23 nt, Human
cugccuuggccuccugaauagcu

SEQ ID NO: 612933 - RNA, 22 nt, Human
cugggcuuaggcaaucuuccug

SEQ ID NO: 612934 - RNA, 25 nt, Human
gaauagcugagaccacagguaugug

SEQ ID NO: 612935 - RNA, 24 nt, Human
gaccucaagugaucugcccgccuu

SEQ ID NO: 612936 - RNA, 24 nt, Human
gaguaacucuggccgauccagucc

SEQ ID NO: 612937 - RNA, 21 nt, Human
gagugcaauggcgcgaucuca

SEQ ID NO: 612938 - RNA, 18 nt, Human
gauuacaggcgugagcca

SEQ ID NO: 612939 - RNA, 21 nt, Human
gauuacaggcgugagccacca

SEQ ID NO: 612940 - RNA, 24 nt, Human
gauuacaggcgugagccaccaugc

SEQ ID NO: 612941 - RNA, 22 nt, Human
gcaaccuccgccuccuggguuc

SEQ ID NO: 612942 - RNA, 18 nt, Human
gcacuggaagggcccaga

SEQ ID NO: 612943 - RNA, 19 nt, Human
gcaguagcccaggcccaac

SEQ ID NO: 612944 - RNA, 23 nt, Human
gccaaagcacuggaagggcccag

SEQ ID NO: 612945 - RNA, 19 nt, Human
gcccaggcuggagugcaau

SEQ ID NO: 612946 - RNA, 18 nt, Human
gccuccugaauagcugag

SEQ ID NO: 612947 - RNA, 24 nt, Human
gcgauucuccugccucagccuccc

SEQ ID NO: 612948 - RNA, 19 nt, Human
gcuggagugcaauggcgcg

SEQ ID NO: 612949 - RNA, 25 nt, Human
gcuggggcaggacaaggucaugggg

SEQ ID NO: 612950 - RNA, 23 nt, Human
gcuggucucgaacucccgaccuc

SEQ ID NO: 612951 - RNA, 22 nt, Human
ggaggagaggggacacagcgag

SEQ ID NO: 612952 - RNA, 21 nt, Human
ggagugcagugguguuaccau

SEQ ID NO: 612953 - RNA, 22 nt, Human
ggauuacaggcgugagccacca

SEQ ID NO: 612954 - RNA, 24 nt, Human
ggauuacaggcgugagccaccaug

SEQ ID NO: 612955 - RNA, 21 nt, Human
ggcggacggcggcgguggcgg

SEQ ID NO: 612956 - RNA, 18 nt, Human
gggcccccgggggcuccc

SEQ ID NO: 612957 - RNA, 22 nt, Human
gggcucaagagauccuccugcc

SEQ ID NO: 612958 - RNA, 18 nt, Human
gggguuucuccauguugg

SEQ ID NO: 612959 - RNA, 22 nt, Human
gggguuucuccauguuggucag

SEQ ID NO: 612960 - RNA, 18 nt, Human
gguggaccuggagcuggg

SEQ ID NO: 612961 - RNA, 18 nt, Human
guagcugggauuacaagc

SEQ ID NO: 612962 - RNA, 19 nt, Human
guauuuuuaguacagaugg

SEQ ID NO: 612963 - RNA, 25 nt, Human
gugacggcggacggcggcgguggcg

SEQ ID NO: 612964 - RNA, 24 nt, Human
guuguugcccaggcuggagugcaa

SEQ ID NO: 612965 - RNA, 25 nt, Human
uaauuuuuguauuuuuuguuugaga

SEQ ID NO: 612966 - RNA, 18 nt, Human
uacaggcgugagccacca

SEQ ID NO: 612967 - RNA, 22 nt, Human
uagagacagagucucccucugu

SEQ ID NO: 612968 - RNA, 18 nt, Human
uaggauuacaggcgugag

SEQ ID NO: 612969 - RNA, 22 nt, Human
uaggauuacaggcgugagccac

SEQ ID NO: 612970 - RNA, 24 nt, Human
uaggauuacaggcgugagccacca

SEQ ID NO: 612971 - RNA, 25 nt, Human
uaggauuacaggcgugagccaccau

SEQ ID NO: 612972 - RNA, 24 nt, Human
uaguacagaugggguuucuccaug

SEQ ID NO: 612973 - RNA, 30 nt, Human
uauuuaugugucacacacacauguacacag

SEQ ID NO: 612974 - RNA, 22 nt, Human
uauuuuuuguuugagauggggu

SEQ ID NO: 612975 - RNA, 19 nt, Human
ucaagcgauucuccugccu

SEQ ID NO: 612976 - RNA, 23 nt, Human
ucacugcaaccuccgccuccugg

SEQ ID NO: 612977 - RNA, 24 nt, Human
ucacugcaaccuccgccuccuggg

SEQ ID NO: 612978 - RNA, 25 nt, Human
ucacugcaaccuccgccuccugggu

SEQ ID NO: 612979 - RNA, 26 nt, Human
ucacugcaaccuccgccuccuggguu

SEQ ID NO: 612980 - RNA, 24 nt, Human
ucacugcagacuuggccuccuggg

SEQ ID NO: 612981 - RNA, 23 nt, Human
ucacuguuguugcccaggcugga

SEQ ID NO: 612982 - RNA, 20 nt, Human
ucagccucccgaguagcugg

SEQ ID NO: 612983 - RNA, 24 nt, Human
ucccagcaggagguggaccuggag

SEQ ID NO: 612984 - RNA, 18 nt, Human
ucccgaguagcugggauu

SEQ ID NO: 612985 - RNA, 19 nt, Human
ucccuccacgcucugcccc

SEQ ID NO: 612986 - RNA, 26 nt, Human
uccgugaggcuggggcagggguaccc

SEQ ID NO: 612987 - RNA, 18 nt, Human
uccugggcucaagagauc

SEQ ID NO: 612988 - RNA, 22 nt, Human
uccugggcucaagagauccucc

SEQ ID NO: 612989 - RNA, 21 nt, Human
uccuggguucaagcgauucuc

SEQ ID NO: 612990 - RNA, 24 nt, Human
uccuggguucaagcgauucuccug

SEQ ID NO: 612991 - RNA, 23 nt, Human
ucucaaacuccugggcucaagag

SEQ ID NO: 612992 - RNA, 18 nt, Human
ucucaaaggagcuggaag

SEQ ID NO: 612993 - RNA, 19 nt, Human
ucucccucuguugcccagg

SEQ ID NO: 612994 - RNA, 23 nt, Human
ucucccucuguugcccagguugg

SEQ ID NO: 612995 - RNA, 24 nt, Human
ucucccucuguugcccagguugga

SEQ ID NO: 612996 - RNA, 24 nt, Human
ucuccugccucagccucccgagua

SEQ ID NO: 612997 - RNA, 19 nt, Human
ucugccccuugcugaagcc

SEQ ID NO: 612998 - RNA, 24 nt, Human
ucuguugcccagguuggagugcag

SEQ ID NO: 612999 - RNA, 21 nt, Human
ugagaccacagguaugugcca

SEQ ID NO: 613000 - RNA, 24 nt, Human
ugagaccacagguaugugccacca

SEQ ID NO: 613001 - RNA, 20 nt, Human
ugagauggggucucaaacuu

SEQ ID NO: 613002 - RNA, 18 nt, Human
ugcccaggcuggagugca

SEQ ID NO: 613003 - RNA, 21 nt, Human
ugcccaggcuggagugcaaug

SEQ ID NO: 613004 - RNA, 21 nt, Human
ugcccaggcuggagugcaaug

SEQ ID NO: 613005 - RNA, 24 nt, Human
ugcccaggcuggagugcaauggcg

SEQ ID NO: 613006 - RNA, 18 nt, Human
ugcccagguuggagugca

SEQ ID NO: 613007 - RNA, 24 nt, Human
ugcccagguuggagugcaguggug

SEQ ID NO: 613008 - RNA, 24 nt, Human
ugccucagccucccgaguagcugg

SEQ ID NO: 613009 - RNA, 24 nt, Human
ugccuuggccuccugaauagcuga

SEQ ID NO: 613010 - RNA, 21 nt, Human
ugcggcggcggcuccggcggc

SEQ ID NO: 613011 - RNA, 23 nt, Human
ugcggcggcggcuccggcggcug

SEQ ID NO: 613012 - RNA, 27 nt, Human
ugcuuauucucuuagaggacaguuuca

SEQ ID NO: 613013 - RNA, 24 nt, Human
uggagugcaauggcgcgaucucag

SEQ ID NO: 613014 - RNA, 28 nt, Human
uggagugcagugguguuacggcucuagc

SEQ ID NO: 613015 - RNA, 19 nt, Human
uggcacaggggaggagagg

SEQ ID NO: 613016 - RNA, 24 nt, Human
uggcgcgaucucagcucacugcaa

SEQ ID NO: 613017 - RNA, 21 nt, Human
ugggauuacaagcaugcgcca

SEQ ID NO: 613018 - RNA, 22 nt, Human
ugggauuacaagcaugcgccac

SEQ ID NO: 613019 - RNA, 24 nt, Human
ugggauuacaagcaugcgccacca

SEQ ID NO: 613020 - RNA, 24 nt, Human
ugggcucaagagauccuccugccu

SEQ ID NO: 613021 - RNA, 24 nt, Human
ugggcuuaggcaaucuuccugccu

SEQ ID NO: 613022 - RNA, 24 nt, Human
ugggguuucuccauguuggucagg

SEQ ID NO: 613023 - RNA, 23 nt, Human
uggguucaagcgauucuccugcc

SEQ ID NO: 613024 - RNA, 24 nt, Human
uggguucaagcgauucuccugccu

SEQ ID NO: 613025 - RNA, 23 nt, Human
uggucaggcuggucucgaacucc

SEQ ID NO: 613026 - RNA, 19 nt, Human
uggucucgaacucccgacc

SEQ ID NO: 613027 - RNA, 24 nt, Human
ugguguuaccauagcucacugcag

SEQ ID NO: 613028 - RNA, 21 nt, Human
uguauuuuuaguacagauggg

SEQ ID NO: 613029 - RNA, 20 nt, Human
uguugcccaggcuggagugc

SEQ ID NO: 613030 - RNA, 18 nt, Human
uuaguacagaugggguuu

SEQ ID NO: 613031 - RNA, 24 nt, Human
uuaguacagaugggguuucuccau

SEQ ID NO: 613032 - RNA, 21 nt, Human
uucaaagugcagaaauuucuc

SEQ ID NO: 613033 - RNA, 21 nt, Human
uucaagcgauucuccugccuc

SEQ ID NO: 613034 - RNA, 23 nt, Human
uucaagcgauucuccugccucag

SEQ ID NO: 613035 - RNA, 24 nt, Human
uucaagcgauucuccugccucagc

SEQ ID NO: 613036 - RNA, 24 nt, Human
uucacuguuguugcccaggcugga

SEQ ID NO: 613037 - RNA, 18 nt, Human
uugcccaggcuggagugc

SEQ ID NO: 613038 - RNA, 26 nt, Human
uugcccagguuggagugcaguggugu

SEQ ID NO: 613039 - RNA, 23 nt, Human
uuguauuuuuaguacagaugggg

SEQ ID NO: 613040 - RNA, 22 nt, Human
uuuaaguuuuccuagaggcuca

SEQ ID NO: 613041 - RNA, 23 nt, Human
uuucacuguuguugcccaggcug

SEQ ID NO: 613042 - RNA, 24 nt, Human
uuucacuguuguugcccaggcugg

SEQ ID NO: 613043 - RNA, 21 nt, Human
uuucuccauguuggucaggcu

SEQ ID NO: 613044 - RNA, 20 nt, Human
uuuuguauuuuuaguacaga

SEQ ID NO: 613045 - RNA, 22 nt, Human
uuuuuaguacagaugggguuuc

SEQ ID NO: 613046 - RNA, 24 nt, Human
uuuuuguauuuuuuguuugagaug

SEQ ID NO: 613047 - RNA, 18 nt, Human
aaccuuccuuucccgccc

SEQ ID NO: 613048 - RNA, 18 nt, Human
accaccccaggagagggc

SEQ ID NO: 613049 - RNA, 23 nt, Human
accagccccagccccagcccggc

SEQ ID NO: 613050 - RNA, 22 nt, Human
accccaggagagggcgggguga

SEQ ID NO: 613051 - RNA, 22 nt, Human
acgccgcaaggccggccuggac

SEQ ID NO: 613052 - RNA, 18 nt, Human
agagcuagggaccuugcc

SEQ ID NO: 613053 - RNA, 20 nt, Human
aggaguaaggcggacuuagg

SEQ ID NO: 613054 - RNA, 21 nt, Human
aggcccugguauggagaaagg

SEQ ID NO: 613055 - RNA, 22 nt, Human
aguggucuaaccagccccagcc

SEQ ID NO: 613056 - RNA, 24 nt, Human
aguggucuaaccagccccagcccc

SEQ ID NO: 613057 - RNA, 18 nt, Human
auggagaaagggugaagg

SEQ ID NO: 613058 - RNA, 18 nt, Human
caagcggccccccagccc

SEQ ID NO: 613059 - RNA, 20 nt, Human
caagcggccccccagccccc

SEQ ID NO: 613060 - RNA, 18 nt, Human
cagcccccaccaccaccc

SEQ ID NO: 613061 - RNA, 21 nt, Human
cagcuucccggguccggcgcc

SEQ ID NO: 613062 - RNA, 20 nt, Human
ccacgccuucgccgcgccgu

SEQ ID NO: 613063 - RNA, 20 nt, Human
ccagccugacccuggggcag

SEQ ID NO: 613064 - RNA, 23 nt, Human
cccauggccuacaguccuuuauu

SEQ ID NO: 613065 - RNA, 18 nt, Human
ccccagccccagcccggc

SEQ ID NO: 613066 - RNA, 20 nt, Human
ccccagccccagcccggcac

SEQ ID NO: 613067 - RNA, 22 nt, Human
ccccagcccccaccaccacccc

SEQ ID NO: 613068 - RNA, 21 nt, Human
cccccaccaccaccccaggag

SEQ ID NO: 613069 - RNA, 20 nt, Human
cccccagcccccaccaccac

SEQ ID NO: 613070 - RNA, 21 nt, Human
cccccauauaugauggguccc

SEQ ID NO: 613071 - RNA, 20 nt, Human
cccgccacgccuucgccgcg

SEQ ID NO: 613072 - RNA, 26 nt, Human
cccgccccgccccgcgacgggcucca

SEQ ID NO: 613073 - RNA, 18 nt, Human
ccgccacgccuucgccgc

SEQ ID NO: 613074 - RNA, 21 nt, Human
ccgccacgccuucgccgcgcc

SEQ ID NO: 613075 - RNA, 19 nt, Human
ccuuuauuagagcgagagu

SEQ ID NO: 613076 - RNA, 24 nt, Human
cgagagucccgaggcccagccccc

SEQ ID NO: 613077 - RNA, 19 nt, Human
cgaggccaggccccagcgc

SEQ ID NO: 613078 - RNA, 24 nt, Human
cgccccgccccgcgacgggcucca

SEQ ID NO: 613079 - RNA, 19 nt, Human
cggccccccagcccccacc

SEQ ID NO: 613080 - RNA, 22 nt, Human
cucagucccgacgccgcaaggc

SEQ ID NO: 613081 - RNA, 19 nt, Human
cucgagacccggcgcccag

SEQ ID NO: 613082 - RNA, 18 nt, Human
cugacccuggggcaggca

SEQ ID NO: 613083 - RNA, 22 nt, Human
cuuuacuccgagcgcguucucc

SEQ ID NO: 613084 - RNA, 23 nt, Human
gagagucccgaggcccagccccc

SEQ ID NO: 613085 - RNA, 19 nt, Human
gagcgagagucccgaggcc

SEQ ID NO: 613086 - RNA, 18 nt, Human
gaggaccugcgcucagga

SEQ ID NO: 613087 - RNA, 18 nt, Human
gccccagcccggcaccac

SEQ ID NO: 613088 - RNA, 23 nt, Human
gcccugguauggagaaaggguga

SEQ ID NO: 613089 - RNA, 19 nt, Human
gcguggccgacugugcggg

SEQ ID NO: 613090 - RNA, 23 nt, Human
ggagagagaggaccugcgcucag

SEQ ID NO: 613091 - RNA, 19 nt, Human
ggcaggcaagcggcccccc

SEQ ID NO: 613092 - RNA, 18 nt, Human
ggcggggugagaaccgga

SEQ ID NO: 613093 - RNA, 21 nt, Human
gggccggguccaagcgccuga

SEQ ID NO: 613094 - RNA, 24 nt, Human
ggguucaaguacauggaggagagg

SEQ ID NO: 613095 - RNA, 23 nt, Human
gucuaaccagccccagccccagc

SEQ ID NO: 613096 - RNA, 21 nt, Human
gugaagggagagagaggaccu

SEQ ID NO: 613097 - RNA, 22 nt, Human
uaggccccauggccuacagucc

SEQ ID NO: 613098 - RNA, 19 nt, Human
uagggaccuugcccagccu

SEQ ID NO: 613099 - RNA, 19 nt, Human
uccuuuauuagagcgagag

SEQ ID NO: 613100 - RNA, 19 nt, Human
ugcacucgagacccggcgc

SEQ ID NO: 613101 - RNA, 19 nt, Human
uggagaaagggugaaggga

SEQ ID NO: 613102 - RNA, 21 nt, Human
uggcgggaaccacgggucccg

SEQ ID NO: 613103 - RNA, 18 nt, Human
uggggcaggcaagcggcc

SEQ ID NO: 613104 - RNA, 23 nt, Human
ugguauggagaaagggugaaggg

SEQ ID NO: 613105 - RNA, 18 nt, Human
uuuuuuuuuuuuuuuucg

SEQ ID NO: 613106 - RNA, 21 nt, Human
uuuuuuuuuuuuuuuucgugg

SEQ ID NO: 613107 - RNA, 25 nt, Human
uuuuuuuuuuuuuuuuucgugguuu

SEQ ID NO: 613108 - RNA, 21 nt, Human
aagcucgcuucguagcagccu

SEQ ID NO: 613109 - RNA, 24 nt, Human
aaguagagacgggguuucaccaug

SEQ ID NO: 613110 - RNA, 19 nt, Human
aaguagcugggacuacagg

SEQ ID NO: 613111 - RNA, 20 nt, Human
aaguagcugggacuacaggc

SEQ ID NO: 613112 - RNA, 24 nt, Human
accaucccuaaagaacuccuccca

SEQ ID NO: 613113 - RNA, 18 nt, Human
acccacuaccacacccag

SEQ ID NO: 613114 - RNA, 18 nt, Human
acgggguuucaccauguu

SEQ ID NO: 613115 - RNA, 19 nt, Human
acgggguuucaccauguua

SEQ ID NO: 613116 - RNA, 20 nt, Human
acgggguuucaccauguuag

SEQ ID NO: 613117 - RNA, 24 nt, Human
acgggguuucaccauguuagccag

SEQ ID NO: 613118 - RNA, 20 nt, Human
acugcaagcuccgccuccug

SEQ ID NO: 613119 - RNA, 18 nt, Human
agcuccgccuccuggguu

SEQ ID NO: 613120 - RNA, 19 nt, Human
aggcagccagagcuucagg

SEQ ID NO: 613121 - RNA, 25 nt, Human
aggcuggagugcaguggugccaucu

SEQ ID NO: 613122 - RNA, 22 nt, Human
aguagagacgggguuucaccau

SEQ ID NO: 613123 - RNA, 23 nt, Human
aguagagacgggguuucaccaug

SEQ ID NO: 613124 - RNA, 23 nt, Human
aguagcugggacuacaggcaccc

SEQ ID NO: 613125 - RNA, 20 nt, Human
agugcaguggugccaucucg

SEQ ID NO: 613126 - RNA, 24 nt, Human
agugcaguggugccaucucggcuc

SEQ ID NO: 613127 - RNA, 21 nt, Human
auucuccugccucagccuccc

SEQ ID NO: 613128 - RNA, 21 nt, Human
caagagcugccugagcccagc

SEQ ID NO: 613129 - RNA, 21 nt, Human
caccauguuagccagcauggu

SEQ ID NO: 613130 - RNA, 24 nt, Human
caccauguuagccagcauggucuc

SEQ ID NO: 613131 - RNA, 24 nt, Human
cacccggcaccagcugccacaacc

SEQ ID NO: 613132 - RNA, 22 nt, Human
caccucccuccuggagauucua

SEQ ID NO: 613133 - RNA, 24 nt, Human
caccugccuacuccuggugagagc

SEQ ID NO: 613134 - RNA, 22 nt, Human
cacgccauucuccugccucagc

SEQ ID NO: 613135 - RNA, 24 nt, Human
cagagucuugcucuguugcccagg

SEQ ID NO: 613136 - RNA, 23 nt, Human
caggcacccacuaccacacccag

SEQ ID NO: 613137 - RNA, 23 nt, Human
ccagcccaggcucccacccugcc

SEQ ID NO: 613138 - RNA, 18 nt, Human
cccaaggccucaggcacu

SEQ ID NO: 613139 - RNA, 22 nt, Human
cccaaggccucaggcacugcuc

SEQ ID NO: 613140 - RNA, 23 nt, Human
cccaaguagcugggacuacaggc

SEQ ID NO: 613141 - RNA, 24 nt, Human
cccaaguagcugggacuacaggca

SEQ ID NO: 613142 - RNA, 21 nt, Human
cccacccggcaccagcugcca

SEQ ID NO: 613143 - RNA, 18 nt, Human
cccagcccaggcucccac

SEQ ID NO: 613144 - RNA, 22 nt, Human
ccccgcaggccgcugcuccucc

SEQ ID NO: 613145 - RNA, 24 nt, Human
ccccgcaggccgcugcuccuccca

SEQ ID NO: 613146 - RNA, 22 nt, Human
ccccuaagccaccucccuccug

SEQ ID NO: 613147 - RNA, 26 nt, Human
ccccugagcuccuagaggaccuugga

SEQ ID NO: 613148 - RNA, 18 nt, Human
cccgacccaucgcccucc

SEQ ID NO: 613149 - RNA, 22 nt, Human
cccuaaagaacuccucccaagg

SEQ ID NO: 613150 - RNA, 22 nt, Human
cccugagcuccuagaggaccuu

SEQ ID NO: 613151 - RNA, 19 nt, Human
ccggcaccagcugccacaa

SEQ ID NO: 613152 - RNA, 22 nt, Human
ccuaagccaccucccuccugga

SEQ ID NO: 613153 - RNA, 23 nt, Human
ccuaagccaccucccuccuggag

SEQ ID NO: 613154 - RNA, 22 nt, Human
ccuccagguucaggccugaucc

SEQ ID NO: 613155 - RNA, 18 nt, Human
ccucccaagcucgcuucg

SEQ ID NO: 613156 - RNA, 22 nt, Human
cgacccaucgcccuccaccccu

SEQ ID NO: 613157 - RNA, 19 nt, Human
cgccuccuggguucacgcc

SEQ ID NO: 613158 - RNA, 19 nt, Human
cgggguuucaccauguuag

SEQ ID NO: 613159 - RNA, 19 nt, Human
cucagagacaggauccacc

SEQ ID NO: 613160 - RNA, 24 nt, Human
cucagccucccaaguagcugggac

SEQ ID NO: 613161 - RNA, 21 nt, Human
cuccuggguucacgccauucu

SEQ ID NO: 613162 - RNA, 20 nt, Human
cucuguugcccaggcuggag

SEQ ID NO: 613163 - RNA, 23 nt, Human
cugccucagccucccaaguagcu

SEQ ID NO: 613164 - RNA, 20 nt, Human
cuggugagagcucuagagag

SEQ ID NO: 613165 - RNA, 21 nt, Human
cuugcucuguugcccaggcug

SEQ ID NO: 613166 - RNA, 21 nt, Human
gaaaaggcagucaccucccac

SEQ ID NO: 613167 - RNA, 20 nt, Human
gacccaucgcccuccacccc

SEQ ID NO: 613168 - RNA, 21 nt, Human
gagacagagucuugcucuguu

SEQ ID NO: 613169 - RNA, 24 nt, Human
gagacgggguuucaccauguuagc

SEQ ID NO: 613170 - RNA, 21 nt, Human
gagcccagcccaggcucccac

SEQ ID NO: 613171 - RNA, 22 nt, Human
gagcugccugagcccagcccag

SEQ ID NO: 613172 - RNA, 19 nt, Human
gaggaccuuggagacggga

SEQ ID NO: 613173 - RNA, 21 nt, Human
gcccagcccaggcucccaccc

SEQ ID NO: 613174 - RNA, 22 nt, Human
gccccgcaggccgcugcuccuc

SEQ ID NO: 613175 - RNA, 19 nt, Human
gccccuaagccaccucccu

SEQ ID NO: 613176 - RNA, 20 nt, Human
gccucagccucccaaguagc

SEQ ID NO: 613177 - RNA, 25 nt, Human
gccuccuggguucacgccauucucc

SEQ ID NO: 613178 - RNA, 22 nt, Human
gccugagauccuuuccuagggg

SEQ ID NO: 613179 - RNA, 21 nt, Human
gccugagcccagcccaggcuc

SEQ ID NO: 613180 - RNA, 25 nt, Human
gcucuguugcccaggcuggagugca

SEQ ID NO: 613181 - RNA, 23 nt, Human
gcugccacaaccugaaaauccgc

SEQ ID NO: 613182 - RNA, 21 nt, Human
gcuggagugcaguggugccag

SEQ ID NO: 613183 - RNA, 19 nt, Human
ggaaaaggggaauccauac

SEQ ID NO: 613184 - RNA, 19 nt, Human
ggauccaccugccuacucc

SEQ ID NO: 613185 - RNA, 19 nt, Human
ggcacccacuaccacaccc

SEQ ID NO: 613186 - RNA, 19 nt, Human
ggcccggcccagcuggcug

SEQ ID NO: 613187 - RNA, 21 nt, Human
ggcccggcccagcuggcugca

SEQ ID NO: 613188 - RNA, 18 nt, Human
gggguuucaccauguuag

SEQ ID NO: 613189 - RNA, 23 nt, Human
guagagacgggguuucaccaugu

SEQ ID NO: 613190 - RNA, 25 nt, Human
uaaaauuaaaaggaaaaggcaguca

SEQ ID NO: 613191 - RNA, 19 nt, Human
uaaagaacuccucccaagg

SEQ ID NO: 613192 - RNA, 22 nt, Human
uaaagaacuccucccaaggccu

SEQ ID NO: 613193 - RNA, 24 nt, Human
uaaguagagacgggguuucaccau

SEQ ID NO: 613194 - RNA, 19 nt, Human
uaauuuuuuguauuuuaag

SEQ ID NO: 613195 - RNA, 24 nt, Human
uaauuuuuuguauuuuaaguagag

SEQ ID NO: 613196 - RNA, 25 nt, Human
uaauuuuuuguauuuuaaguagaga

SEQ ID NO: 613197 - RNA, 21 nt, Human
uagagacgggguuucaccaug

SEQ ID NO: 613198 - RNA, 22 nt, Human
uagagacgggguuucaccaugu

SEQ ID NO: 613199 - RNA, 19 nt, Human
uagccccuaagccaccucc

SEQ ID NO: 613200 - RNA, 24 nt, Human
uagccccuaagccaccucccuccu

SEQ ID NO: 613201 - RNA, 20 nt, Human
uauacaaaagaaagguguuc

SEQ ID NO: 613202 - RNA, 18 nt, Human
ucacugcaagcuccgccu

SEQ ID NO: 613203 - RNA, 23 nt, Human
ucacugcaagcuccgccuccugg

SEQ ID NO: 613204 - RNA, 24 nt, Human
ucacugcaagcuccgccuccuggg

SEQ ID NO: 613205 - RNA, 18 nt, Human
ucagccucccaaguagcu

SEQ ID NO: 613206 - RNA, 20 nt, Human
ucagccucccaaguagcugg

SEQ ID NO: 613207 - RNA, 24 nt, Human
ucccaaguagcugggacuacaggc

SEQ ID NO: 613208 - RNA, 22 nt, Human
uccccacccggcaccagcugcc

SEQ ID NO: 613209 - RNA, 19 nt, Human
uccccagggcuggggaugu

SEQ ID NO: 613210 - RNA, 24 nt, Human
uccuggguucacgccauucuccug

SEQ ID NO: 613211 - RNA, 21 nt, Human
ucuccagcuucccgacccauc

SEQ ID NO: 613212 - RNA, 26 nt, Human
ucuccugccucagccucccaaguagc

SEQ ID NO: 613213 - RNA, 18 nt, Human
ucuguugcccaggcugga

SEQ ID NO: 613214 - RNA, 24 nt, Human
ucuguugcccaggcuggagugcag

SEQ ID NO: 613215 - RNA, 22 nt, Human
ucuugcucuguugcccaggcug

SEQ ID NO: 613216 - RNA, 23 nt, Human
ucuugcucuguugcccaggcugg

SEQ ID NO: 613217 - RNA, 24 nt, Human
ucuugcucuguugcccaggcugga

SEQ ID NO: 613218 - RNA, 23 nt, Human
ugaaaguagccccuaagccaccu

SEQ ID NO: 613219 - RNA, 22 nt, Human
ugcaguggugccaucucggcuc

SEQ ID NO: 613220 - RNA, 18 nt, Human
ugcccaggcuggagugca

SEQ ID NO: 613221 - RNA, 21 nt, Human
ugcccaggcuggagugcagug

SEQ ID NO: 613222 - RNA, 24 nt, Human
ugcccaggcuggagugcaguggug

SEQ ID NO: 613223 - RNA, 24 nt, Human
ugccucagccucccaaguagcugg

SEQ ID NO: 613224 - RNA, 20 nt, Human
ugccugagcccagcccaggc

SEQ ID NO: 613225 - RNA, 28 nt, Human
uggagugcaguggugccauccuagcacg

SEQ ID NO: 613226 - RNA, 23 nt, Human
uggagugcaguggugccaucucg

SEQ ID NO: 613227 - RNA, 24 nt, Human
uggagugcaguggugccaucucgg

SEQ ID NO: 613228 - RNA, 18 nt, Human
uggcugcaggcgcagcug

SEQ ID NO: 613229 - RNA, 19 nt, Human
ugggacuacaggcacccac

SEQ ID NO: 613230 - RNA, 19 nt, Human
ugggacuacaggcacccac

SEQ ID NO: 613231 - RNA, 20 nt, Human
ugggacuacaggcacccacu

SEQ ID NO: 613232 - RNA, 21 nt, Human
ugggacuacaggcacccacua

SEQ ID NO: 613233 - RNA, 24 nt, Human
ugggacuacaggcacccacuacca

SEQ ID NO: 613234 - RNA, 20 nt, Human
uggguucacgccauucuccu

SEQ ID NO: 613235 - RNA, 24 nt, Human
uugcccaggcuggagugcaguggu

SEQ ID NO: 613236 - RNA, 24 nt, Human
uugcucuguugcccaggcuggagu

SEQ ID NO: 613237 - RNA, 18 nt, Human
uuucaccauguuagccag

SEQ ID NO: 613238 - RNA, 24 nt, Human
uuuuaaguagagacgggguuucac

SEQ ID NO: 613239 - RNA, 21 nt, Human
uuuuuguauuuuaaguagaga

SEQ ID NO: 613240 - RNA, 24 nt, Human
uuuuuuguauuuuaaguagagacg

SEQ ID NO: 613241 - RNA, 22 nt, Human
aaaugucccaccucaaccucac

SEQ ID NO: 613242 - RNA, 21 nt, Human
aagcaucuuuaaaaauuugau

SEQ ID NO: 613243 - RNA, 19 nt, Human
aagccaucuccaagccuag

SEQ ID NO: 613244 - RNA, 18 nt, Human
acggaccaaccaaagcca

SEQ ID NO: 613245 - RNA, 22 nt, Human
acugcaaacugcuagccuguag

SEQ ID NO: 613246 - RNA, 20 nt, Human
agcaggcuuuuccacagugc

SEQ ID NO: 613247 - RNA, 22 nt, Human
aggauacauacuacacgcagcg

SEQ ID NO: 613248 - RNA, 23 nt, Human
augccgcuccccgcuacugccuu

SEQ ID NO: 613249 - RNA, 21 nt, Human
auuauguucuuuccaaccacg

SEQ ID NO: 613250 - RNA, 19 nt, Human
caccucaaccucacacuca

SEQ ID NO: 613251 - RNA, 23 nt, Human
caccucaaccucacacucaauac

SEQ ID NO: 613252 - RNA, 22 nt, Human
cacgcagcgaaaaugccaacca

SEQ ID NO: 613253 - RNA, 20 nt, Human
cagaauuuucaagauggcac

SEQ ID NO: 613254 - RNA, 18 nt, Human
cagcuucucugaagaaau

SEQ ID NO: 613255 - RNA, 24 nt, Human
cagggucuucacugugcucccagg

SEQ ID NO: 613256 - RNA, 21 nt, Human
cagucugccuggcccugggcu

SEQ ID NO: 613257 - RNA, 22 nt, Human
cccacacuauagcugggcaauc

SEQ ID NO: 613258 - RNA, 24 nt, Human
ccccgcuacugccuuacacccagu

SEQ ID NO: 613259 - RNA, 22 nt, Human
cccuguagcagcugaguugcuu

SEQ ID NO: 613260 - RNA, 22 nt, Human
ccuggcccugggcucuguucca

SEQ ID NO: 613261 - RNA, 19 nt, Human
cgaaaaugccaaccacuga

SEQ ID NO: 613262 - RNA, 28 nt, Human
cggaccaaccaaagccaucuccaagccu

SEQ ID NO: 613263 - RNA, 24 nt, Human
cuagccuguagaccaaauucaacc

SEQ ID NO: 613264 - RNA, 25 nt, Human
cuggaugcugugauauuuguuaacc

SEQ ID NO: 613265 - RNA, 18 nt, Human
gacagcaugccgcucccc

SEQ ID NO: 613266 - RNA, 22 nt, Human
gaccaaccaaagccaucuccaa

SEQ ID NO: 613267 - RNA, 20 nt, Human
ggcagggagacuuccagcag

SEQ ID NO: 613268 - RNA, 27 nt, Human
uacacugggagguuucacauaaauauc

SEQ ID NO: 613269 - RNA, 25 nt, Human
ucacaucgguucuccuugcucagca

SEQ ID NO: 613270 - RNA, 19 nt, Human
ucaggggccaaccugcgcu

SEQ ID NO: 613271 - RNA, 25 nt, Human
uccaagugagaaguuagcagagucc

SEQ ID NO: 613272 - RNA, 20 nt, Human
ucccaggugccaggaugcuc

SEQ ID NO: 613273 - RNA, 21 nt, Human
ucccaggugccaggaugcucu

SEQ ID NO: 613274 - RNA, 20 nt, Human
ucccaggugccagggugcuc

SEQ ID NO: 613275 - RNA, 21 nt, Human
ucccaggugccagggugcucc

SEQ ID NO: 613276 - RNA, 24 nt, Human
ucccuaaucagaguucaguagggc

SEQ ID NO: 613277 - RNA, 18 nt, Human
ugaccuuuaguuuuccuu

SEQ ID NO: 613278 - RNA, 18 nt, Human
ugaccuuuaguuuuccuu

SEQ ID NO: 613279 - RNA, 19 nt, Human
ugaucccggauucugaccu

SEQ ID NO: 613280 - RNA, 22 nt, Human
ugccuggcccugggcucuguuc

SEQ ID NO: 613281 - RNA, 20 nt, Human
uggagcuaacagcuguuaga

SEQ ID NO: 613282 - RNA, 22 nt, Human
uggcaauacacugggagguuuc

SEQ ID NO: 613283 - RNA, 21 nt, Human
uggcaccuuuccccaaacuuc

SEQ ID NO: 613284 - RNA, 21 nt, Human
uggcagcacucucauaacuac

SEQ ID NO: 613285 - RNA, 19 nt, Human
uggcccugggcucuguucc

SEQ ID NO: 613286 - RNA, 23 nt, Human
uguuagacagcaugccgcucccc

SEQ ID NO: 613287 - RNA, 19 nt, Human
uucaagauggcaccuuucc

SEQ ID NO: 613288 - RNA, 19 nt, Human
uucacggaccaaccaaagc

SEQ ID NO: 613289 - RNA, 25 nt, Human
uucacugugcucccaggugccaggg

SEQ ID NO: 613290 - RNA, 27 nt, Human
uucuauaccauucauuaaacauagacu

SEQ ID NO: 613291 - RNA, 22 nt, Human
aagcccaaaacacuucaagcaa

SEQ ID NO: 613292 - RNA, 21 nt, Human
aggaauugccauuucagcauc

SEQ ID NO: 613293 - RNA, 24 nt, Human
augauguccuaaguagcuuccucu

SEQ ID NO: 613294 - RNA, 19 nt, Human
caagcuccuaggcuccccu

SEQ ID NO: 613295 - RNA, 21 nt, Human
caccccauuuauuaagcccaa

SEQ ID NO: 613296 - RNA, 20 nt, Human
cauuuuagauccucugguug

SEQ ID NO: 613297 - RNA, 21 nt, Human
cgcucagaggccagagccaga

SEQ ID NO: 613298 - RNA, 20 nt, Human
cugaaaaucugaaugugaca

SEQ ID NO: 613299 - RNA, 25 nt, Human
gaggccagagccagaccuagcgaaa

SEQ ID NO: 613300 - RNA, 21 nt, Human
uaagcccaaaacacuucaagc

SEQ ID NO: 613301 - RNA, 18 nt, Human
ucccagaagaucauggcc

SEQ ID NO: 613302 - RNA, 22 nt, Human
ucugagauuuuaugcccaagag

SEQ ID NO: 613303 - RNA, 22 nt, Human
ugacuagaaggucaauccaagc

SEQ ID NO: 613304 - RNA, 20 nt, Human
ugggaaaacuugcuuaaaug

SEQ ID NO: 613305 - RNA, 20 nt, Human
ugggaaagaauguguuucag

SEQ ID NO: 613306 - RNA, 27 nt, Human
ugggcagaggaggagggucgaacguuu

SEQ ID NO: 613307 - RNA, 22 nt, Human
uggugagucccagaagaucaug

SEQ ID NO: 613308 - RNA, 24 nt, Human
ugugacauuuuagauccucugguu

SEQ ID NO: 613309 - RNA, 22 nt, Human
uucuggagauggugagucccag

SEQ ID NO: 613310 - RNA, 18 nt, Human
uugguuuagucucccgau

SEQ ID NO: 613311 - RNA, 18 nt, Human
acagaugacagugaacac

SEQ ID NO: 613312 - RNA, 20 nt, Human
acaugguuuuucugaaaagu

SEQ ID NO: 613313 - RNA, 18 nt, Human
agacagaagagcaauaau

SEQ ID NO: 613314 - RNA, 23 nt, Human
aggcaaagacaggacaaacaaaa

SEQ ID NO: 613315 - RNA, 21 nt, Human
aggcacaguaucauucaaaau

SEQ ID NO: 613316 - RNA, 20 nt, Human
auggaaugacaccacauuug

SEQ ID NO: 613317 - RNA, 24 nt, Human
cagaagagcaauaaucccgagaaa

SEQ ID NO: 613318 - RNA, 24 nt, Human
caggcaaagacaggacaaacaaaa

SEQ ID NO: 613319 - RNA, 24 nt, Human
cccgagaaaauauaauuaaaauac

SEQ ID NO: 613320 - RNA, 23 nt, Human
cuuaacacuggcaaaauuuggaa

SEQ ID NO: 613321 - RNA, 23 nt, Human
gacagggaggugugguauauagg

SEQ ID NO: 613322 - RNA, 19 nt, Human
gauccaggcaaagacagga

SEQ ID NO: 613323 - RNA, 18 nt, Human
uauagcauaaaagacaug

SEQ ID NO: 613324 - RNA, 23 nt, Human
uaucuuaaaaaaaauacagagca

SEQ ID NO: 613325 - RNA, 23 nt, Human
ucaaaacugggucuacaauccau

SEQ ID NO: 613326 - RNA, 22 nt, Human
uccaggcaaagacaggacaaac

SEQ ID NO: 613327 - RNA, 18 nt, Human
ugaaaaguggacagggag

SEQ ID NO: 613328 - RNA, 23 nt, Human
ugaaaaguggacagggaggugug

SEQ ID NO: 613329 - RNA, 25 nt, Human
ugugguauauaggaaaguggcucac

SEQ ID NO: 613330 - RNA, 22 nt, Human
uuagauucuagguuucuuuuuu

SEQ ID NO: 613331 - RNA, 23 nt, Human
uucuagguuucuuuuuugguuuc

SEQ ID NO: 613332 - RNA, 22 nt, Human
agccugggcggggcuggggugg

SEQ ID NO: 613333 - RNA, 22 nt, Human
aggcacaagacgguagcccggc

SEQ ID NO: 613334 - RNA, 19 nt, Human
aggcagggaucugucugac

SEQ ID NO: 613335 - RNA, 21 nt, Human
caaggcagggaucugucugac

SEQ ID NO: 613336 - RNA, 19 nt, Human
cacuggcagcagccugggc

SEQ ID NO: 613337 - RNA, 20 nt, Human
cacuggcagcagccugggcg

SEQ ID NO: 613338 - RNA, 22 nt, Human
cagcagccugggcggggcuggg

SEQ ID NO: 613339 - RNA, 21 nt, Human
cccaccaaggcagggaucugu

SEQ ID NO: 613340 - RNA, 21 nt, Human
ccccagcuggggacaggcccc

SEQ ID NO: 613341 - RNA, 19 nt, Human
ccugagccacccacagguc

SEQ ID NO: 613342 - RNA, 22 nt, Human
cuccguucuggggucugggagg

SEQ ID NO: 613343 - RNA, 23 nt, Human
cucggcccggccucgugccgguu

SEQ ID NO: 613344 - RNA, 22 nt, Human
cuggcagcagccugggcggggc

SEQ ID NO: 613345 - RNA, 24 nt, Human
cugggguggagcccggggucugcu

SEQ ID NO: 613346 - RNA, 20 nt, Human
gcacuggcagcagccugggc

SEQ ID NO: 613347 - RNA, 19 nt, Human
gcugggguggagcccgggg

SEQ ID NO: 613348 - RNA, 20 nt, Human
ggaucugucugacuugaagc

SEQ ID NO: 613349 - RNA, 21 nt, Human
ggaucugucugacuugaagcu

SEQ ID NO: 613350 - RNA, 18 nt, Human
gggcggggcuggggugga

SEQ ID NO: 613351 - RNA, 21 nt, Human
gggcugggguggagcccgggg

SEQ ID NO: 613352 - RNA, 30 nt, Human
gucugggaggcgugggcaggagugagggcu

SEQ ID NO: 613353 - RNA, 19 nt, Human
guucuggggucugggaggc

SEQ ID NO: 613354 - RNA, 28 nt, Human
uggaaggcagaacugcccaccaaggcag

SEQ ID NO: 613355 - RNA, 21 nt, Human
uggcagcagccugggcggggc

SEQ ID NO: 613356 - RNA, 21 nt, Human
ugggcaggagugagggcccca

SEQ ID NO: 613357 - RNA, 23 nt, Human
ugggcaggagugagggccccagg

SEQ ID NO: 613358 - RNA, 24 nt, Human
ugggccugagccacccacaggucc

SEQ ID NO: 613359 - RNA, 23 nt, Human
uuuguaaaagugugcacuggcag

SEQ ID NO: 613360 - RNA, 18 nt, Human
uuuuuuuuuuuuuuuuug

SEQ ID NO: 613361 - RNA, 25 nt, Human
uuuuuuuuuuuuuuuuuugucuuuu

SEQ ID NO: 613362 - RNA, 29 nt, Human
uuuuuuuuuuuuuuuuuuugucuuuuuaa

SEQ ID NO: 613363 - RNA, 21 nt, Human
aaaaaaaaaaaaagaagaaga

SEQ ID NO: 613364 - RNA, 21 nt, Human
aaaaagaaaaaaaucuggcaa

SEQ ID NO: 613365 - RNA, 20 nt, Human
aaagcaauacaacuugagga

SEQ ID NO: 613366 - RNA, 21 nt, Human
aaaggaacccauacgguaaaa

SEQ ID NO: 613367 - RNA, 19 nt, Human
aaaucauuucagaaggucc

SEQ ID NO: 613368 - RNA, 25 nt, Human
aacauuuuaggguucuucauuguau

SEQ ID NO: 613369 - RNA, 21 nt, Human
aaccaacaggucacauaagca

SEQ ID NO: 613370 - RNA, 20 nt, Human
aaccuggcuagcccuuggga

SEQ ID NO: 613371 - RNA, 27 nt, Human
aacucauacauauacauuugcuaccau

SEQ ID NO: 613372 - RNA, 20 nt, Human
aagaagaagacacacuuugg

SEQ ID NO: 613373 - RNA, 20 nt, Human
aagaggaaauggauauaaaa

SEQ ID NO: 613374 - RNA, 30 nt, Human
aagcagaaagauaaaacuauaccccaaggg

SEQ ID NO: 613375 - RNA, 24 nt, Human
aagucgucaguaagaauuuauuac

SEQ ID NO: 613376 - RNA, 22 nt, Human
aaucacccaccaaaaggaaccc

SEQ ID NO: 613377 - RNA, 21 nt, Human
aaucauggcaaauggagagcu

SEQ ID NO: 613378 - RNA, 18 nt, Human
acacugcuacauacccgc

SEQ ID NO: 613379 - RNA, 19 nt, Human
acauauacauuugcuacca

SEQ ID NO: 613380 - RNA, 18 nt, Human
acccgcagucuguucccu

SEQ ID NO: 613381 - RNA, 18 nt, Human
acugaauccuugagcuga

SEQ ID NO: 613382 - RNA, 21 nt, Human
agaaagugggaaagaaauuag

SEQ ID NO: 613383 - RNA, 19 nt, Human
agaacgcagugauggcaac

SEQ ID NO: 613384 - RNA, 19 nt, Human
agacccccgcuguucccag

SEQ ID NO: 613385 - RNA, 22 nt, Human
aggaaauggauauaaaaccaag

SEQ ID NO: 613386 - RNA, 20 nt, Human
aggcagaagguggaggcagg

SEQ ID NO: 613387 - RNA, 21 nt, Human
aggcauuuaaaaaaaaaaaaa

SEQ ID NO: 613388 - RNA, 18 nt, Human
aggggccacugggcagga

SEQ ID NO: 613389 - RNA, 21 nt, Human
agggggaauaauggagaagga

SEQ ID NO: 613390 - RNA, 23 nt, Human
aggugcagagacuggggggaggu

SEQ ID NO: 613391 - RNA, 24 nt, Human
auaagcaacaagaacuuccaagag

SEQ ID NO: 613392 - RNA, 20 nt, Human
auccuugagcugaaucccag

SEQ ID NO: 613393 - RNA, 21 nt, Human
auuuaaaaaaaaaaaaaagaa

SEQ ID NO: 613394 - RNA, 25 nt, Human
caaaagcacagcaaagcuggagacc

SEQ ID NO: 613395 - RNA, 23 nt, Human
caacacuacagaauacaaacuca

SEQ ID NO: 613396 - RNA, 19 nt, Human
caacagccccaugcccucc

SEQ ID NO: 613397 - RNA, 22 nt, Human
caacagccccaugcccuccagg

SEQ ID NO: 613398 - RNA, 27 nt, Human
caagagauacugcugcucugacaccac

SEQ ID NO: 613399 - RNA, 28 nt, Human
caagagauacugcugcucugacaccacu

SEQ ID NO: 613400 - RNA, 23 nt, Human
caaucacccaccaaaaggaaccc

SEQ ID NO: 613401 - RNA, 19 nt, Human
cacagcaaagcaauacaac

SEQ ID NO: 613402 - RNA, 18 nt, Human
cacaggagccuguguccu

SEQ ID NO: 613403 - RNA, 18 nt, Human
cacgcaggucuccauggg

SEQ ID NO: 613404 - RNA, 21 nt, Human
cacugggcaggacagccucug

SEQ ID NO: 613405 - RNA, 20 nt, Human
cagcaugcugaugucauggc

SEQ ID NO: 613406 - RNA, 19 nt, Human
caggcagaagguggaggca

SEQ ID NO: 613407 - RNA, 19 nt, Human
caggucacauaagcaacaa

SEQ ID NO: 613408 - RNA, 18 nt, Human
caguagggcagcaccccc

SEQ ID NO: 613409 - RNA, 22 nt, Human
caguagggcagcacccccaaac

SEQ ID NO: 613410 - RNA, 18 nt, Human
ccccaaacccagggggcc

SEQ ID NO: 613411 - RNA, 24 nt, Human
ccccagacgauacuaagugaggcu

SEQ ID NO: 613412 - RNA, 22 nt, Human
cccucaccaccaugcugaaacc

SEQ ID NO: 613413 - RNA, 23 nt, Human
cccucaccaccaugcugaaaccu

SEQ ID NO: 613414 - RNA, 18 nt, Human
cccuggaaauggcgugag

SEQ ID NO: 613415 - RNA, 19 nt, Human
ccucaaucacccaccaaaa

SEQ ID NO: 613416 - RNA, 19 nt, Human
ccuuuuucccucaccacca

SEQ ID NO: 613417 - RNA, 19 nt, Human
cgcaaagaaagggaggcuc

SEQ ID NO: 613418 - RNA, 20 nt, Human
cgccuccugcaggcucacac

SEQ ID NO: 613419 - RNA, 21 nt, Human
cgccuccugcaggcucacacg

SEQ ID NO: 613420 - RNA, 19 nt, Human
cgucccuucuuccaaaagc

SEQ ID NO: 613421 - RNA, 22 nt, Human
cuacagcccucagcaccaagaa

SEQ ID NO: 613422 - RNA, 18 nt, Human
cuaccauagguucuacaa

SEQ ID NO: 613423 - RNA, 20 nt, Human
cucaccaccaugcugaaacc

SEQ ID NO: 613424 - RNA, 22 nt, Human
cuccaagagauacugcugcucu

SEQ ID NO: 613425 - RNA, 26 nt, Human
cuccaagauuuccuaauuuuugauuu

SEQ ID NO: 613426 - RNA, 24 nt, Human
cuccuuuuucccucaccaccaugc

SEQ ID NO: 613427 - RNA, 24 nt, Human
cugcugaguugaccgcaaacucca

SEQ ID NO: 613428 - RNA, 19 nt, Human
cugggugcugggccccaga

SEQ ID NO: 613429 - RNA, 22 nt, Human
cugguuugagaaacucccucau

SEQ ID NO: 613430 - RNA, 25 nt, Human
cuuugaggagggggaaaguugggug

SEQ ID NO: 613431 - RNA, 18 nt, Human
gagggggaaaguugggug

SEQ ID NO: 613432 - RNA, 20 nt, Human
gaugaaugggaggaaaauca

SEQ ID NO: 613433 - RNA, 26 nt, Human
gcauuuaaaaaaaaaaaaaagaagaa

SEQ ID NO: 613434 - RNA, 20 nt, Human
gcccugaccuccagccacau

SEQ ID NO: 613435 - RNA, 22 nt, Human
gcucagacgggugacagacccc

SEQ ID NO: 613436 - RNA, 23 nt, Human
ggaagacucuaacacaacuaagc

SEQ ID NO: 613437 - RNA, 21 nt, Human
ggagaugaugagggguugagg

SEQ ID NO: 613438 - RNA, 21 nt, Human
ggcagcacccccaaacccagg

SEQ ID NO: 613439 - RNA, 18 nt, Human
ggcucagacgggugacag

SEQ ID NO: 613440 - RNA, 18 nt, Human
gggagacgcaaagaaagg

SEQ ID NO: 613441 - RNA, 18 nt, Human
gggagggggaauaaugga

SEQ ID NO: 613442 - RNA, 18 nt, Human
gugcagagacugggggga

SEQ ID NO: 613443 - RNA, 19 nt, Human
guucuaccaaaaaagaaaa

SEQ ID NO: 613444 - RNA, 26 nt, Human
uaaaacaauuggcaagaaccaaauca

SEQ ID NO: 613445 - RNA, 19 nt, Human
uaaaaccaaggaaaguggu

SEQ ID NO: 613446 - RNA, 25 nt, Human
uaagaaaagagugucaagaaaccag

SEQ ID NO: 613447 - RNA, 20 nt, Human
uacaacuugaggacucccuc

SEQ ID NO: 613448 - RNA, 24 nt, Human
uacacugcuacauacccgcagucu

SEQ ID NO: 613449 - RNA, 22 nt, Human
uacaguaaaucacugaagcaga

SEQ ID NO: 613450 - RNA, 20 nt, Human
uacauaggaaaagguggccu

SEQ ID NO: 613451 - RNA, 28 nt, Human
uaccaaaaaagaaaaaaaucuggcaauu

SEQ ID NO: 613452 - RNA, 20 nt, Human
uaguacaaaacucuuuaaac

SEQ ID NO: 613453 - RNA, 24 nt, Human
ucaaucacccaccaaaaggaaccc

SEQ ID NO: 613454 - RNA, 21 nt, Human
ucacugaagcagaaagauaaa

SEQ ID NO: 613455 - RNA, 22 nt, Human
ucaggcaggaugaagacccaca

SEQ ID NO: 613456 - RNA, 22 nt, Human
ucagucccaugcuggaagacuc

SEQ ID NO: 613457 - RNA, 22 nt, Human
uccaugggcacugcugaguuga

SEQ ID NO: 613458 - RNA, 25 nt, Human
uccaugggcacugcugaguugaccg

SEQ ID NO: 613459 - RNA, 27 nt, Human
uccaugggcacugcugaguugaccgca

SEQ ID NO: 613460 - RNA, 21 nt, Human
ucccugugugaacagugccgu

SEQ ID NO: 613461 - RNA, 22 nt, Human
uccugaauuauuaacagaccuu

SEQ ID NO: 613462 - RNA, 19 nt, Human
uccuggagaugaugagggg

SEQ ID NO: 613463 - RNA, 18 nt, Human
uccuugagcugaauccca

SEQ ID NO: 613464 - RNA, 20 nt, Human
ucgcauagacuuugcccaag

SEQ ID NO: 613465 - RNA, 21 nt, Human
ucgcugggggccagucuuucc

SEQ ID NO: 613466 - RNA, 22 nt, Human
ucgcugggggccagucuuuccg

SEQ ID NO: 613467 - RNA, 24 nt, Human
ucgcugggggccagucuuuccggg

SEQ ID NO: 613468 - RNA, 26 nt, Human
ucuaccaaaaaagaaaaaaaucuggc

SEQ ID NO: 613469 - RNA, 19 nt, Human
ucuuccaaaagcacagcaa

SEQ ID NO: 613470 - RNA, 23 nt, Human
ugaaacagaggcugguugcugau

SEQ ID NO: 613471 - RNA, 26 nt, Human
ugaaaccgagcgcucacuggcaggug

SEQ ID NO: 613472 - RNA, 24 nt, Human
ugaagacacugaauccuugagcug

SEQ ID NO: 613473 - RNA, 23 nt, Human
ugaaucccaggugcagagacugg

SEQ ID NO: 613474 - RNA, 19 nt, Human
ugagaaacucccucaugau

SEQ ID NO: 613475 - RNA, 21 nt, Human
ugagaacgucgcugggggcca

SEQ ID NO: 613476 - RNA, 19 nt, Human
ugaggagggggaaaguugg

SEQ ID NO: 613477 - RNA, 24 nt, Human
ugaggggagcuggcgcuugcccag

SEQ ID NO: 613478 - RNA, 18 nt, Human
ugaggguggaggcuggca

SEQ ID NO: 613479 - RNA, 23 nt, Human
ugagugcagcagcuucccuaggg

SEQ ID NO: 613480 - RNA, 22 nt, Human
ugaguugaccgcaaacuccacu

SEQ ID NO: 613481 - RNA, 22 nt, Human
ugcuacaccaacacuacagaau

SEQ ID NO: 613482 - RNA, 19 nt, Human
ugcuggaagacucuaacac

SEQ ID NO: 613483 - RNA, 23 nt, Human
uggagauggcgccauaccgggcu

SEQ ID NO: 613484 - RNA, 19 nt, Human
uggcaacauggagauggcg

SEQ ID NO: 613485 - RNA, 19 nt, Human
uggcaagaaccaaaucaaa

SEQ ID NO: 613486 - RNA, 23 nt, Human
uggcgccauaccgggcuugaggc

SEQ ID NO: 613487 - RNA, 24 nt, Human
uggcuucugccagagaagccccgg

SEQ ID NO: 613488 - RNA, 22 nt, Human
ugguggucagggcuggggaagg

SEQ ID NO: 613489 - RNA, 18 nt, Human
uguaccacugggcagccu

SEQ ID NO: 613490 - RNA, 19 nt, Human
uguaggugcccaguccggg

SEQ ID NO: 613491 - RNA, 19 nt, Human
ugugccaacugggauuucu

SEQ ID NO: 613492 - RNA, 18 nt, Human
uucccaguagggcagcac

SEQ ID NO: 613493 - RNA, 21 nt, Human
uugaaacacauccuuugagga

SEQ ID NO: 613494 - RNA, 22 nt, Human
uuuauccuccuccaccacacca

SEQ ID NO: 613495 - RNA, 19 nt, Human
uuuguaaaaaugaagacac

SEQ ID NO: 613496 - RNA, 20 nt, Human
uuuguaaaaaugaagacacu

SEQ ID NO: 613497 - RNA, 20 nt, Human
aaaaacaauucaaaccacug

SEQ ID NO: 613498 - RNA, 21 nt, Human
aaaaacaauucaaaccacugg

SEQ ID NO: 613499 - RNA, 20 nt, Human
aaaauaaaacuagucacaga

SEQ ID NO: 613500 - RNA, 18 nt, Human
aaacaguagcucaucucc

SEQ ID NO: 613501 - RNA, 21 nt, Human
aaacagugcuccauggccuga

SEQ ID NO: 613502 - RNA, 22 nt, Human
aagaaaaaaagucaugugagga

SEQ ID NO: 613503 - RNA, 25 nt, Human
aagacaagaaaaaaagucaugugag

SEQ ID NO: 613504 - RNA, 23 nt, Human
acaguaccaggaaacaaucuagc

SEQ ID NO: 613505 - RNA, 18 nt, Human
accggcccgucgggcgcg

SEQ ID NO: 613506 - RNA, 18 nt, Human
agaaaaaaaggcauaagg

SEQ ID NO: 613507 - RNA, 18 nt, Human
agaaacagugcuccaugg

SEQ ID NO: 613508 - RNA, 26 nt, Human
agaaacagugcuccauggccugaagc

SEQ ID NO: 613509 - RNA, 22 nt, Human
agacaacacugccagcaacaca

SEQ ID NO: 613510 - RNA, 23 nt, Human
agacaagaaaaaaagucauguga

SEQ ID NO: 613511 - RNA, 23 nt, Human
aggaaacaaucuagccuccccgc

SEQ ID NO: 613512 - RNA, 21 nt, Human
aggcauaagggcaugagugga

SEQ ID NO: 613513 - RNA, 23 nt, Human
agggcucagucauuuuagggaga

SEQ ID NO: 613514 - RNA, 20 nt, Human
auaauauuucucccuacuuu

SEQ ID NO: 613515 - RNA, 25 nt, Human
aucuccuuaaaccuaguuuuuacca

SEQ ID NO: 613516 - RNA, 25 nt, Human
auggucggcugcuccucugcgugcc

SEQ ID NO: 613517 - RNA, 21 nt, Human
auuagaugaacccagggcuca

SEQ ID NO: 613518 - RNA, 18 nt, Human
cacccgagucgggaacau

SEQ ID NO: 613519 - RNA, 24 nt, Human
caguggcagugacaguaccaggaa

SEQ ID NO: 613520 - RNA, 19 nt, Human
cauggccugaagcaaaugg

SEQ ID NO: 613521 - RNA, 22 nt, Human
cauguugucucggggcaugguc

SEQ ID NO: 613522 - RNA, 23 nt, Human
ccaaacugaaaaaaucauuuagu

SEQ ID NO: 613523 - RNA, 20 nt, Human
ccaaaucaaagccccagugg

SEQ ID NO: 613524 - RNA, 19 nt, Human
ccaguagauccaacgccca

SEQ ID NO: 613525 - RNA, 18 nt, Human
ccagucgcccgugcuucc

SEQ ID NO: 613526 - RNA, 21 nt, Human
cccaggcuaggggguagagac

SEQ ID NO: 613527 - RNA, 25 nt, Human
cccauaaccgugcccggcggcugcu

SEQ ID NO: 613528 - RNA, 26 nt, Human
ccccauaaccgugcccggcggcugcu

SEQ ID NO: 613529 - RNA, 24 nt, Human
cccccauaaccgugcccggcggcu

SEQ ID NO: 613530 - RNA, 19 nt, Human
ccccgcccaccccgccccc

SEQ ID NO: 613531 - RNA, 23 nt, Human
ccccgcccccauaaccgugcccg

SEQ ID NO: 613532 - RNA, 19 nt, Human
cccgggucgaggcgggagg

SEQ ID NO: 613533 - RNA, 23 nt, Human
ccgcccaccccgcccccauaacc

SEQ ID NO: 613534 - RNA, 19 nt, Human
ccgcggccgccccagcugc

SEQ ID NO: 613535 - RNA, 21 nt, Human
ccugagagaauaugaaacaac

SEQ ID NO: 613536 - RNA, 19 nt, Human
cgaggaagcggcugcugcu

SEQ ID NO: 613537 - RNA, 21 nt, Human
cgccaaccucagcagccacgc

SEQ ID NO: 613538 - RNA, 19 nt, Human
cgccgccaaccucagcagc

SEQ ID NO: 613539 - RNA, 19 nt, Human
cgccgccaaccucagcagg

SEQ ID NO: 613540 - RNA, 18 nt, Human
cgccuugagcccccucuc

SEQ ID NO: 613541 - RNA, 21 nt, Human
cuccuuugaaucuucccguua

SEQ ID NO: 613542 - RNA, 30 nt, Human
cugccccauuccuccaaaucaaagccccaa

SEQ ID NO: 613543 - RNA, 24 nt, Human
cugcgugccgggaccggcccccuc

SEQ ID NO: 613544 - RNA, 21 nt, Human
cugugaucuucugugccuucu

SEQ ID NO: 613545 - RNA, 21 nt, Human
gaaguaaauaaauauagggaa

SEQ ID NO: 613546 - RNA, 20 nt, Human
gacaagaaaaaaagucaugu

SEQ ID NO: 613547 - RNA, 23 nt, Human
gagaaugauccccaaacugaaaa

SEQ ID NO: 613548 - RNA, 21 nt, Human
gaggaaagaaaauaaaucuug

SEQ ID NO: 613549 - RNA, 23 nt, Human
gauagcaagacuucauuucagga

SEQ ID NO: 613550 - RNA, 22 nt, Human
gcccaggcuaggggguagagac

SEQ ID NO: 613551 - RNA, 19 nt, Human
gccuccgcgccagaagccg

SEQ ID NO: 613552 - RNA, 19 nt, Human
gcuucagauaguccccugc

SEQ ID NO: 613553 - RNA, 21 nt, Human
ggaaacaaucuagccuccccg

SEQ ID NO: 613554 - RNA, 20 nt, Human
ggaagcgccgcggccgcccc

SEQ ID NO: 613555 - RNA, 23 nt, Human
ggcccccuccuuuccuccgcccc

SEQ ID NO: 613556 - RNA, 29 nt, Human
ggcuaggggguagagacacagcccuugug

SEQ ID NO: 613557 - RNA, 19 nt, Human
gggagugggaaguaggaag

SEQ ID NO: 613558 - RNA, 23 nt, Human
gggcauggucggcugcuccucug

SEQ ID NO: 613559 - RNA, 20 nt, Human
ggggcauggucggcugcucc

SEQ ID NO: 613560 - RNA, 23 nt, Human
gucgcgaucggaagcgccgcggc

SEQ ID NO: 613561 - RNA, 23 nt, Human
guuuggaagcauaacacauucag

SEQ ID NO: 613562 - RNA, 19 nt, Human
uaaaagcacaaaaauaaaa

SEQ ID NO: 613563 - RNA, 19 nt, Human
uaaacccuauuuaacuaag

SEQ ID NO: 613564 - RNA, 19 nt, Human
uaagacaagaaaaaaaguc

SEQ ID NO: 613565 - RNA, 20 nt, Human
uaaggaaaaccacauuagau

SEQ ID NO: 613566 - RNA, 24 nt, Human
uaaguuaaaaaacuauaagaaaaa

SEQ ID NO: 613567 - RNA, 20 nt, Human
uaaucccaaguuuuggugcc

SEQ ID NO: 613568 - RNA, 19 nt, Human
uacaugcauaguuauguug

SEQ ID NO: 613569 - RNA, 22 nt, Human
uaccaggaaacaaucuagccuc

SEQ ID NO: 613570 - RNA, 20 nt, Human
uacugggcaaagggaggaaa

SEQ ID NO: 613571 - RNA, 18 nt, Human
uagcaagacuucauuuca

SEQ ID NO: 613572 - RNA, 21 nt, Human
uagccuccccgcccaccccgg

SEQ ID NO: 613573 - RNA, 21 nt, Human
ucacagauagcaagacuucau

SEQ ID NO: 613574 - RNA, 18 nt, Human
ucacagaucuggagauuc

SEQ ID NO: 613575 - RNA, 19 nt, Human
uccccgcccaccccgcccc

SEQ ID NO: 613576 - RNA, 21 nt, Human
uccgccccuugcgguccccgg

SEQ ID NO: 613577 - RNA, 20 nt, Human
ucugcaacaugaaaucugcu

SEQ ID NO: 613578 - RNA, 22 nt, Human
ucugcaacaugaaaucugcucg

SEQ ID NO: 613579 - RNA, 18 nt, Human
ucugcucgacucacagau

SEQ ID NO: 613580 - RNA, 23 nt, Human
ugaacuaaaaacaauucaaacca

SEQ ID NO: 613581 - RNA, 21 nt, Human
ugagaaugauccccaaacuga

SEQ ID NO: 613582 - RNA, 20 nt, Human
ugaguaaaccagauguggcu

SEQ ID NO: 613583 - RNA, 22 nt, Human
uggaaguaaauaaauauaggga

SEQ ID NO: 613584 - RNA, 21 nt, Human
uggcagugacaguaccaggaa

SEQ ID NO: 613585 - RNA, 18 nt, Human
ugggagcaagaaaaccac

SEQ ID NO: 613586 - RNA, 19 nt, Human
ugggagcaagaaaaccacu

SEQ ID NO: 613587 - RNA, 22 nt, Human
ugggcaaagggaggaaagaaaa

SEQ ID NO: 613588 - RNA, 20 nt, Human
ugugguaggguagggcacgu

SEQ ID NO: 613589 - RNA, 20 nt, Human
uuccuccaaaucaaagcccc

SEQ ID NO: 613590 - RNA, 22 nt, Human
uuccuccaaaucaaagccccag

SEQ ID NO: 613591 - RNA, 22 nt, Human
uugaacuaaaaacaauucaaac

SEQ ID NO: 613592 - RNA, 24 nt, Human
uuuuuuuuuuuuuuuuuuuauuuu

SEQ ID NO: 613593 - RNA, 22 nt, Human
agcuggugagccaccucgggcc

SEQ ID NO: 613594 - RNA, 25 nt, Human
agggaagugggguguggugggaagg

SEQ ID NO: 613595 - RNA, 19 nt, Human
auagcugaggccagaaagc

SEQ ID NO: 613596 - RNA, 18 nt, Human
aucugaacagcuggugag

SEQ ID NO: 613597 - RNA, 21 nt, Human
ccuggacucuggucgccuggg

SEQ ID NO: 613598 - RNA, 19 nt, Human
cgccugggguccucugggc

SEQ ID NO: 613599 - RNA, 22 nt, Human
gcgcggcuggcggaaggcgggc

SEQ ID NO: 613600 - RNA, 19 nt, Human
ggaaguggggugugguggg

SEQ ID NO: 613601 - RNA, 19 nt, Human
ggcgcggcuggcggaaggc

SEQ ID NO: 613602 - RNA, 20 nt, Human
ggguagguggcgcagggcga

SEQ ID NO: 613603 - RNA, 24 nt, Human
ggguagguggcgcagggcgcggcu

SEQ ID NO: 613604 - RNA, 20 nt, Human
gucgccugggguccucuggg

SEQ ID NO: 613605 - RNA, 24 nt, Human
ucagccuggacucuggucgccugg

SEQ ID NO: 613606 - RNA, 21 nt, Human
ugaaaguggaaggagagggaa

SEQ ID NO: 613607 - RNA, 22 nt, Human
ugaaaguggaaggagagggaag

SEQ ID NO: 613608 - RNA, 20 nt, Human
uggaaggagagggaaguggg

SEQ ID NO: 613609 - RNA, 24 nt, Human
uggaaggagagggaaguggggugu

SEQ ID NO: 613610 - RNA, 23 nt, Human
uggugggaagggacauuccugca

SEQ ID NO: 613611 - RNA, 19 nt, Human
ugugaaaguggaaggagag

SEQ ID NO: 613612 - RNA, 21 nt, Human
ugugaaaguggaaggagaggg

SEQ ID NO: 613613 - RNA, 25 nt, Human
aaaaaaaaaaaaaaugccaucagag

SEQ ID NO: 613614 - RNA, 25 nt, Human
aaaaaaaaaaaaugccaucagagga

SEQ ID NO: 613615 - RNA, 23 nt, Human
aaaaaaaaaaugccaucagagga

SEQ ID NO: 613616 - RNA, 19 nt, Human
aaaaaugugagaaaaacua

SEQ ID NO: 613617 - RNA, 19 nt, Human
aaaaugccaucagaggaaa

SEQ ID NO: 613618 - RNA, 18 nt, Human
aaaccaccuaugugaguc

SEQ ID NO: 613619 - RNA, 26 nt, Human
aaagaaagaaacacagaacaucccua

SEQ ID NO: 613620 - RNA, 23 nt, Human
aaagagucacuuuaaucucaaaa

SEQ ID NO: 613621 - RNA, 27 nt, Human
aacaaguguuagagaacugauacacaa

SEQ ID NO: 613622 - RNA, 22 nt, Human
aacacagaacaucccuaaauac

SEQ ID NO: 613623 - RNA, 21 nt, Human
aaccuaacuaacucaccacuu

SEQ ID NO: 613624 - RNA, 18 nt, Human
aacuugcuccuuucuucu

SEQ ID NO: 613625 - RNA, 19 nt, Human
aagaaagaaacacagaaca

SEQ ID NO: 613626 - RNA, 20 nt, Human
aagcauccccaagcucacag

SEQ ID NO: 613627 - RNA, 23 nt, Human
aaggaugcucgaaccaagugcag

SEQ ID NO: 613628 - RNA, 21 nt, Human
aagggaguggagguucagaug

SEQ ID NO: 613629 - RNA, 20 nt, Human
aaugaacauuuuauuuuaaa

SEQ ID NO: 613630 - RNA, 23 nt, Human
acaaagcaggauugucaccaagg

SEQ ID NO: 613631 - RNA, 22 nt, Human
acagugccuuugccugugacca

SEQ ID NO: 613632 - RNA, 18 nt, Human
accucagcuucuguccga

SEQ ID NO: 613633 - RNA, 18 nt, Human
accucagcuucuguccga

SEQ ID NO: 613634 - RNA, 21 nt, Human
accuuagugacauuucugcug

SEQ ID NO: 613635 - RNA, 22 nt, Human
acgucacaggcccugccucagc

SEQ ID NO: 613636 - RNA, 23 nt, Human
acuucaaaaaagaaagaaacaca

SEQ ID NO: 613637 - RNA, 23 nt, Human
agaacaucccuaaauacaacguc

SEQ ID NO: 613638 - RNA, 24 nt, Human
agaacugauacacaacccuccaga

SEQ ID NO: 613639 - RNA, 21 nt, Human
agagacuauuuauauuaaaua

SEQ ID NO: 613640 - RNA, 25 nt, Human
agagaggaaauaagaauaaaaaaga

SEQ ID NO: 613641 - RNA, 19 nt, Human
agaggaaaagacaggggca

SEQ ID NO: 613642 - RNA, 18 nt, Human
agauuuugagacuguggc

SEQ ID NO: 613643 - RNA, 22 nt, Human
agcugcagcuggccuccuggaa

SEQ ID NO: 613644 - RNA, 23 nt, Human
aggagaaugaacauuaaacagaa

SEQ ID NO: 613645 - RNA, 18 nt, Human
aggaggccugggccugug

SEQ ID NO: 613646 - RNA, 22 nt, Human
aggcagcccuaggcauguucuu

SEQ ID NO: 613647 - RNA, 23 nt, Human
aggguuuccuuuagcucccguuu

SEQ ID NO: 613648 - RNA, 21 nt, Human
aggugggcuggcaccaggugg

SEQ ID NO: 613649 - RNA, 23 nt, Human
auaagacagggcccugcuuccuu

SEQ ID NO: 613650 - RNA, 19 nt, Human
aucugucccugagcugcag

SEQ ID NO: 613651 - RNA, 19 nt, Human
augaaucuguaaacacaga

SEQ ID NO: 613652 - RNA, 20 nt, Human
augaugcugagcuccagguc

SEQ ID NO: 613653 - RNA, 22 nt, Human
auucagagauuuugagacugug

SEQ ID NO: 613654 - RNA, 18 nt, Human
caaaaaagaaagaaacac

SEQ ID NO: 613655 - RNA, 19 nt, Human
caacccuccagaaaugagg

SEQ ID NO: 613656 - RNA, 23 nt, Human
caacuugcugagaauuuugccag

SEQ ID NO: 613657 - RNA, 20 nt, Human
cacaaggaacagcacugcca

SEQ ID NO: 613658 - RNA, 24 nt, Human
caccaaagacacgugacccauaag

SEQ ID NO: 613659 - RNA, 23 nt, Human
caccaagguccacauugacauga

SEQ ID NO: 613660 - RNA, 21 nt, Human
cacccuaaccaaaaaucacca

SEQ ID NO: 613661 - RNA, 24 nt, Human
caccugggucagaagaugggcccc

SEQ ID NO: 613662 - RNA, 22 nt, Human
cacgcgcaaccuguccuucaca

SEQ ID NO: 613663 - RNA, 23 nt, Human
cacuuuguucuuggaaggagaau

SEQ ID NO: 613664 - RNA, 19 nt, Human
cagagcuggugccaaaagc

SEQ ID NO: 613665 - RNA, 24 nt, Human
caucuggggugggaccugggccug

SEQ ID NO: 613666 - RNA, 23 nt, Human
caucuuccaccaaagucuaaaca

SEQ ID NO: 613667 - RNA, 21 nt, Human
ccaccccccaccaaaaagaua

SEQ ID NO: 613668 - RNA, 18 nt, Human
ccagcacccaccccccac

SEQ ID NO: 613669 - RNA, 24 nt, Human
ccaggugggugguguccacggugg

SEQ ID NO: 613670 - RNA, 24 nt, Human
ccauucaaauaccagcacccaccc

SEQ ID NO: 613671 - RNA, 22 nt, Human
cccccggauuucuuccuucuuc

SEQ ID NO: 613672 - RNA, 21 nt, Human
cccugagcugcagcuggccuc

SEQ ID NO: 613673 - RNA, 18 nt, Human
ccgagagaggccuguucu

SEQ ID NO: 613674 - RNA, 19 nt, Human
ccggagcugagccaggugc

SEQ ID NO: 613675 - RNA, 24 nt, Human
ccggagcugagccaggugcccccg

SEQ ID NO: 613676 - RNA, 20 nt, Human
ccggauuucuuccuucuucu

SEQ ID NO: 613677 - RNA, 21 nt, Human
ccuccagaaaugaggcagaga

SEQ ID NO: 613678 - RNA, 28 nt, Human
ccuccaugaugcugagcuccagguccac

SEQ ID NO: 613679 - RNA, 19 nt, Human
ccucgccccggcacuccuc

SEQ ID NO: 613680 - RNA, 24 nt, Human
ccugugaccacgaccgagagaggc

SEQ ID NO: 613681 - RNA, 21 nt, Human
ccuuuggcucugaaaagggac

SEQ ID NO: 613682 - RNA, 19 nt, Human
cuccagcagguaaggagga

SEQ ID NO: 613683 - RNA, 24 nt, Human
cuccagcugcuguucucccagguu

SEQ ID NO: 613684 - RNA, 19 nt, Human
cuccuggaaucuacccaua

SEQ ID NO: 613685 - RNA, 23 nt, Human
cuccuggaaucuacccauagcuu

SEQ ID NO: 613686 - RNA, 18 nt, Human
cucgaaccaagugcagac

SEQ ID NO: 613687 - RNA, 20 nt, Human
cucggucagauucucucuca

SEQ ID NO: 613688 - RNA, 21 nt, Human
cucgucaauuuccuucagcuu

SEQ ID NO: 613689 - RNA, 20 nt, Human
cugagcugcagcuggccucc

SEQ ID NO: 613690 - RNA, 18 nt, Human
cugggccugugcacugcu

SEQ ID NO: 613691 - RNA, 21 nt, Human
cugggccugugcacugcuggg

SEQ ID NO: 613692 - RNA, 22 nt, Human
cuuaggucuccaaagaagccuc

SEQ ID NO: 613693 - RNA, 20 nt, Human
cuucugcuccaggcucgcca

SEQ ID NO: 613694 - RNA, 22 nt, Human
gaaaagacaggggcagcacaag

SEQ ID NO: 613695 - RNA, 19 nt, Human
gaagcauccccaagcucac

SEQ ID NO: 613696 - RNA, 24 nt, Human
gaccacagcaaugaaucuguaaac

SEQ ID NO: 613697 - RNA, 19 nt, Human
gcacccaccccccaccaaa

SEQ ID NO: 613698 - RNA, 22 nt, Human
gccaaaagcaaaggcagcccua

SEQ ID NO: 613699 - RNA, 21 nt, Human
gccuuggacuggaaagaaguc

SEQ ID NO: 613700 - RNA, 21 nt, Human
gcgggggcucacauucuccag

SEQ ID NO: 613701 - RNA, 22 nt, Human
gcuggcaccaggugggguggcc

SEQ ID NO: 613702 - RNA, 23 nt, Human
ggaaaagacaggggcagcacaag

SEQ ID NO: 613703 - RNA, 22 nt, Human
ggaggcugggagugacugcuua

SEQ ID NO: 613704 - RNA, 18 nt, Human
ggcagagauaauagauga

SEQ ID NO: 613705 - RNA, 20 nt, Human
ggcgaucacccuaaccaaaa

SEQ ID NO: 613706 - RNA, 21 nt, Human
ggcucacauucuccagguggg

SEQ ID NO: 613707 - RNA, 19 nt, Human
ggggaggaggccugggccu

SEQ ID NO: 613708 - RNA, 24 nt, Human
ggggcucacauucuccaggugggu

SEQ ID NO: 613709 - RNA, 19 nt, Human
guccacgcgccugcucucc

SEQ ID NO: 613710 - RNA, 24 nt, Human
uaaauaacucuucccuuaaaaaug

SEQ ID NO: 613711 - RNA, 22 nt, Human
uaauccccaacugcuaaguauu

SEQ ID NO: 613712 - RNA, 23 nt, Human
uacaaugaacauuuuauuuuaaa

SEQ ID NO: 613713 - RNA, 19 nt, Human
uacacaacccuccagaaau

SEQ ID NO: 613714 - RNA, 21 nt, Human
uagcugaagcucuccauucac

SEQ ID NO: 613715 - RNA, 19 nt, Human
uaguugggugggcaacuuu

SEQ ID NO: 613716 - RNA, 25 nt, Human
ucaaaaaagaaagaaacacagaaca

SEQ ID NO: 613717 - RNA, 23 nt, Human
ucaaauaccagcacccacccccc

SEQ ID NO: 613718 - RNA, 20 nt, Human
ucagaggaaaagacaggggc

SEQ ID NO: 613719 - RNA, 25 nt, Human
uccaauagacuuaggucuccaaaga

SEQ ID NO: 613720 - RNA, 18 nt, Human
uccacgcgccugcucucc

SEQ ID NO: 613721 - RNA, 24 nt, Human
uccagcugcuguucucccagguuc

SEQ ID NO: 613722 - RNA, 22 nt, Human
uccaggcucgccaggacuuccu

SEQ ID NO: 613723 - RNA, 18 nt, Human
uccauucacaguaccuca

SEQ ID NO: 613724 - RNA, 19 nt, Human
ucccaaauauuuuccccau

SEQ ID NO: 613725 - RNA, 19 nt, Human
ucccugagcugcagcuggc

SEQ ID NO: 613726 - RNA, 21 nt, Human
ucccugagcugcagcuggccu

SEQ ID NO: 613727 - RNA, 25 nt, Human
ucccugagcugcagcuggccuccug

SEQ ID NO: 613728 - RNA, 20 nt, Human
uccuucagcuucugcuccag

SEQ ID NO: 613729 - RNA, 23 nt, Human
uccuucagcuucugcuccaggcu

SEQ ID NO: 613730 - RNA, 21 nt, Human
uccuucuucuuuucaagccuc

SEQ ID NO: 613731 - RNA, 25 nt, Human
uccuugauucaucuuccaccaaagu

SEQ ID NO: 613732 - RNA, 21 nt, Human
ucuccagcugcuguucuccca

SEQ ID NO: 613733 - RNA, 19 nt, Human
ucugcuccaggcucgccag

SEQ ID NO: 613734 - RNA, 19 nt, Human
ucuggaguacagugccuuu

SEQ ID NO: 613735 - RNA, 20 nt, Human
ucuuagcugaagcucuccau

SEQ ID NO: 613736 - RNA, 22 nt, Human
ucuuuaguuuuaaugguagaag

SEQ ID NO: 613737 - RNA, 18 nt, Human
ugaaaacucagucauaau

SEQ ID NO: 613738 - RNA, 19 nt, Human
ugaagcauccccaagcuca

SEQ ID NO: 613739 - RNA, 18 nt, Human
ugaaggcauggcaaagcc

SEQ ID NO: 613740 - RNA, 21 nt, Human
ugacccauaagacagggcccu

SEQ ID NO: 613741 - RNA, 22 nt, Human
ugagcuccagguccacgcgccu

SEQ ID NO: 613742 - RNA, 18 nt, Human
ugagucuguuucuuuagu

SEQ ID NO: 613743 - RNA, 22 nt, Human
ugcagaaaggacuugacaggug

SEQ ID NO: 613744 - RNA, 20 nt, Human
ugccaaaagcaaaggcagcc

SEQ ID NO: 613745 - RNA, 19 nt, Human
ugcccccggauuucuuccu

SEQ ID NO: 613746 - RNA, 20 nt, Human
ugccuaacgucacaggcccu

SEQ ID NO: 613747 - RNA, 21 nt, Human
uggaaagaagucuuuaacuua

SEQ ID NO: 613748 - RNA, 20 nt, Human
uggcaaagccauggccacuc

SEQ ID NO: 613749 - RNA, 21 nt, Human
ugguugcagaguugacuggga

SEQ ID NO: 613750 - RNA, 19 nt, Human
ugguuggucagugccagag

SEQ ID NO: 613751 - RNA, 18 nt, Human
uguggagggcaagaacug

SEQ ID NO: 613752 - RNA, 21 nt, Human
uguuagagaacugauacacaa

SEQ ID NO: 613753 - RNA, 23 nt, Human
uuacauccaauagacuuaggucu

SEQ ID NO: 613754 - RNA, 21 nt, Human
uuagugcuucagcuugguccc

SEQ ID NO: 613755 - RNA, 33 nt, Human
uucaaccuguguuaaaaaaaaaaaaaaaaaaaa

SEQ ID NO: 613756 - RNA, 21 nt, Human
uucacaguaccucagucuuug

SEQ ID NO: 613757 - RNA, 20 nt, Human
uucugcuccaggcucgccag

SEQ ID NO: 613758 - RNA, 22 nt, Human
uugccaagcuugaucucugcac

SEQ ID NO: 613759 - RNA, 22 nt, Human
aaaaacucaguaggaaacauca

SEQ ID NO: 613760 - RNA, 21 nt, Human
aaacaucaggaucaccuagcc

SEQ ID NO: 613761 - RNA, 19 nt, Human
aaagaggagugcugugaca

SEQ ID NO: 613762 - RNA, 19 nt, Human
aagcagaugaaccacccaa

SEQ ID NO: 613763 - RNA, 24 nt, Human
aagcagaugaaccacccaaucaaa

SEQ ID NO: 613764 - RNA, 18 nt, Human
acagugggauuaaugggc

SEQ ID NO: 613765 - RNA, 19 nt, Human
accuucccgaggccaggcu

SEQ ID NO: 613766 - RNA, 23 nt, Human
acgaaguugaaguacugaguguu

SEQ ID NO: 613767 - RNA, 20 nt, Human
acgcagccgcacaugcuucc

SEQ ID NO: 613768 - RNA, 21 nt, Human
acucgguuuccagaaaucugg

SEQ ID NO: 613769 - RNA, 20 nt, Human
agaaaaacucaguaggaaac

SEQ ID NO: 613770 - RNA, 18 nt, Human
agcagggcuggcuggaag

SEQ ID NO: 613771 - RNA, 22 nt, Human
agcgcagggcagcagcaggcag

SEQ ID NO: 613772 - RNA, 21 nt, Human
augggagaaggggaagucagg

SEQ ID NO: 613773 - RNA, 20 nt, Human
caccccagagacaacaagau

SEQ ID NO: 613774 - RNA, 22 nt, Human
cagaugaaccacccaaucaaac

SEQ ID NO: 613775 - RNA, 23 nt, Human
cagcagcaggcagcuccacgaag

SEQ ID NO: 613776 - RNA, 19 nt, Human
caucaggaucaccuagcca

SEQ ID NO: 613777 - RNA, 23 nt, Human
cauuuaaugaauguuccaaacac

SEQ ID NO: 613778 - RNA, 22 nt, Human
ccacaccccagagacaacaaga

SEQ ID NO: 613779 - RNA, 18 nt, Human
ccacaggaccgcugccag

SEQ ID NO: 613780 - RNA, 21 nt, Human
ccacgaaguugaaguacugag

SEQ ID NO: 613781 - RNA, 23 nt, Human
ccagaaaaacucaguaggaaaca

SEQ ID NO: 613782 - RNA, 20 nt, Human
ccaugugugugccgcccucc

SEQ ID NO: 613783 - RNA, 21 nt, Human
ccaugugugugccgcccuccu

SEQ ID NO: 613784 - RNA, 25 nt, Human
cccaaucaaacaguacaugauuacu

SEQ ID NO: 613785 - RNA, 24 nt, Human
cccgugcacaccaugugugugccg

SEQ ID NO: 613786 - RNA, 19 nt, Human
ccuccucuccucuuccucc

SEQ ID NO: 613787 - RNA, 19 nt, Human
ccucuccucuuccuccucc

SEQ ID NO: 613788 - RNA, 20 nt, Human
ccugcuaaggaacuucucca

SEQ ID NO: 613789 - RNA, 24 nt, Human
cucuccucuuccuccucccugcua

SEQ ID NO: 613790 - RNA, 22 nt, Human
cugcaggagccaccuucccgag

SEQ ID NO: 613791 - RNA, 22 nt, Human
gagacaacaagaugauguggag

SEQ ID NO: 613792 - RNA, 26 nt, Human
gaggagugcugugacaccacaccccc

SEQ ID NO: 613793 - RNA, 22 nt, Human
gccaccuucccgaggccaggcu

SEQ ID NO: 613794 - RNA, 23 nt, Human
gcugaacugcaggagccaccuuc

SEQ ID NO: 613795 - RNA, 19 nt, Human
ggccugucggcugagggcc

SEQ ID NO: 613796 - RNA, 20 nt, Human
ggcuggaagcgccgggagcc

SEQ ID NO: 613797 - RNA, 19 nt, Human
gugauucuuugcuuccucc

SEQ ID NO: 613798 - RNA, 24 nt, Human
uaaugaauguuccaaacacacccu

SEQ ID NO: 613799 - RNA, 25 nt, Human
ucacugggauggaagcagaugaacc

SEQ ID NO: 613800 - RNA, 20 nt, Human
ucaggaucaccuagccagag

SEQ ID NO: 613801 - RNA, 20 nt, Human
ucccagaagucuccacagug

SEQ ID NO: 613802 - RNA, 19 nt, Human
ucccuuaucucuagggcaa

SEQ ID NO: 613803 - RNA, 20 nt, Human
uccuccucuccucuuccucc

SEQ ID NO: 613804 - RNA, 21 nt, Human
uccucuccucuuccuccuccc

SEQ ID NO: 613805 - RNA, 20 nt, Human
ucuggauaccagaaaaacuc

SEQ ID NO: 613806 - RNA, 23 nt, Human
ugacaccacaccccagagacaac

SEQ ID NO: 613807 - RNA, 25 nt, Human
ugacaccacaccccagagacaacaa

SEQ ID NO: 613808 - RNA, 18 nt, Human
ugauguggaggcacaggc

SEQ ID NO: 613809 - RNA, 24 nt, Human
ugcaugcucacgcagccgcacaug

SEQ ID NO: 613810 - RNA, 21 nt, Human
ugcuaaggaacuucuccaggg

SEQ ID NO: 613811 - RNA, 18 nt, Human
ugcuggggcuggcucugg

SEQ ID NO: 613812 - RNA, 22 nt, Human
uggaagcagaugaaccacccaa

SEQ ID NO: 613813 - RNA, 25 nt, Human
uggaagcagaugaaccacccaauca

SEQ ID NO: 613814 - RNA, 20 nt, Human
uggaguagcagagccacuug

SEQ ID NO: 613815 - RNA, 22 nt, Human
ugggauuaaugggcccagggac

SEQ ID NO: 613816 - RNA, 18 nt, Human
ugugugcgugcggcccgu

SEQ ID NO: 613817 - RNA, 23 nt, Human
ugugugcgugcggcccgugcaca

SEQ ID NO: 613818 - RNA, 23 nt, Human
uuugcuuccuccucuccucuucc

SEQ ID NO: 613819 - RNA, 18 nt, Human
uuuuuuuuuuuuuuuuug

SEQ ID NO: 613820 - RNA, 21 nt, Human
uuuuuuuuuuuuuuuuugcuu

SEQ ID NO: 613821 - RNA, 25 nt, Human
uuuuuuuuuuuuuuuuuuugcuuag

SEQ ID NO: 613822 - RNA, 23 nt, Human
aaaaagccagcccggagcugggc

SEQ ID NO: 613823 - RNA, 23 nt, Human
aagaagaggaggaggaggaagag

SEQ ID NO: 613824 - RNA, 22 nt, Human
accuguccccuccaccugcgcc

SEQ ID NO: 613825 - RNA, 19 nt, Human
agaaaggaggaagaagagg

SEQ ID NO: 613826 - RNA, 18 nt, Human
agacaggcucccaccccc

SEQ ID NO: 613827 - RNA, 27 nt, Human
agagaaaaacaagaaacugaguuggaa

SEQ ID NO: 613828 - RNA, 24 nt, Human
agagaagagaaaggaggaagaaga

SEQ ID NO: 613829 - RNA, 24 nt, Human
agagaggccagugaccugcuugag

SEQ ID NO: 613830 - RNA, 22 nt, Human
agaggccagugaccugcuugag

SEQ ID NO: 613831 - RNA, 19 nt, Human
agagggcccuggagcaauc

SEQ ID NO: 613832 - RNA, 18 nt, Human
agauguggagacugaggc

SEQ ID NO: 613833 - RNA, 21 nt, Human
agccagcccggagcugggccc

SEQ ID NO: 613834 - RNA, 20 nt, Human
aggaaauaguuuuuuucucu

SEQ ID NO: 613835 - RNA, 18 nt, Human
aggaagaagaggaggagg

SEQ ID NO: 613836 - RNA, 18 nt, Human
aggaagaagaggaggagg

SEQ ID NO: 613837 - RNA, 18 nt, Human
aggacgucaaaaguuugc

SEQ ID NO: 613838 - RNA, 24 nt, Human
aggagggcagguggugagggcugg

SEQ ID NO: 613839 - RNA, 22 nt, Human
aggcuggggugggccccaccuc

SEQ ID NO: 613840 - RNA, 22 nt, Human
agggcuggcggggggcagcagg

SEQ ID NO: 613841 - RNA, 19 nt, Human
agguccugguagaaggagg

SEQ ID NO: 613842 - RNA, 20 nt, Human
aggugggaaggacuggagag

SEQ ID NO: 613843 - RNA, 21 nt, Human
agguggugagggcuggcgggg

SEQ ID NO: 613844 - RNA, 22 nt, Human
agguggugagggcuggcggggg

SEQ ID NO: 613845 - RNA, 22 nt, Human
agugagcagguggcggccaggc

SEQ ID NO: 613846 - RNA, 18 nt, Human
caaaaagccagcccggag

SEQ ID NO: 613847 - RNA, 20 nt, Human
caagccaggcucccaccccu

SEQ ID NO: 613848 - RNA, 21 nt, Human
caaucaggacgucaaaaguuu

SEQ ID NO: 613849 - RNA, 23 nt, Human
cacacagcaagugagcagcagag

SEQ ID NO: 613850 - RNA, 19 nt, Human
cacacccaagccaggcucc

SEQ ID NO: 613851 - RNA, 21 nt, Human
cacacccaagccaggcuccca

SEQ ID NO: 613852 - RNA, 23 nt, Human
cacacccaagccaggcucccaaa

SEQ ID NO: 613853 - RNA, 20 nt, Human
cacccaagccaggcucccac

SEQ ID NO: 613854 - RNA, 19 nt, Human
cagacaggcucccaccccc

SEQ ID NO: 613855 - RNA, 22 nt, Human
cagacaggcucccacccccauc

SEQ ID NO: 613856 - RNA, 19 nt, Human
cagagcugggaccagaggc

SEQ ID NO: 613857 - RNA, 22 nt, Human
cagcagacaggcucccaccccc

SEQ ID NO: 613858 - RNA, 18 nt, Human
cagccacacccaagccag

SEQ ID NO: 613859 - RNA, 18 nt, Human
caguggugccgccuggca

SEQ ID NO: 613860 - RNA, 19 nt, Human
caucggcagaccugucccc

SEQ ID NO: 613861 - RNA, 19 nt, Human
caucucaucaauuccucac

SEQ ID NO: 613862 - RNA, 19 nt, Human
ccagccccuggcucucucc

SEQ ID NO: 613863 - RNA, 20 nt, Human
ccagccccuggcucucucca

SEQ ID NO: 613864 - RNA, 19 nt, Human
ccaggccccuuccccugcc

SEQ ID NO: 613865 - RNA, 20 nt, Human
cccagccucuguccagaguc

SEQ ID NO: 613866 - RNA, 22 nt, Human
cccaucggcagaccuguccccu

SEQ ID NO: 613867 - RNA, 25 nt, Human
ccccaggaggaccccagccucuguc

SEQ ID NO: 613868 - RNA, 24 nt, Human
ccccaucggcagaccuguccccuc

SEQ ID NO: 613869 - RNA, 19 nt, Human
ccccuuccccugcccggcc

SEQ ID NO: 613870 - RNA, 18 nt, Human
cccggagcugggcccagg

SEQ ID NO: 613871 - RNA, 23 nt, Human
ccuccuuuccuguuuuccugagu

SEQ ID NO: 613872 - RNA, 23 nt, Human
ccugcuccugauggugccugggg

SEQ ID NO: 613873 - RNA, 28 nt, Human
ccuggcagcccagcagacaggcucccac

SEQ ID NO: 613874 - RNA, 18 nt, Human
ccugguagaaggagggca

SEQ ID NO: 613875 - RNA, 26 nt, Human
cgcccgggggucccugccccccgccc

SEQ ID NO: 613876 - RNA, 24 nt, Human
cgcccugcaaaaagccagcccgga

SEQ ID NO: 613877 - RNA, 21 nt, Human
cggcagaccuguccccuccac

SEQ ID NO: 613878 - RNA, 18 nt, Human
cggggugggcaggugggu

SEQ ID NO: 613879 - RNA, 19 nt, Human
cugcccccuagccugcucc

SEQ ID NO: 613880 - RNA, 21 nt, Human
cugggcccaggccugcccccu

SEQ ID NO: 613881 - RNA, 19 nt, Human
cuggggcggggugggcagg

SEQ ID NO: 613882 - RNA, 19 nt, Human
gaaacccaaguuacagaga

SEQ ID NO: 613883 - RNA, 26 nt, Human
gacugugcugucccccaggaggaccc

SEQ ID NO: 613884 - RNA, 22 nt, Human
gagacugaggcccagagaggcc

SEQ ID NO: 613885 - RNA, 22 nt, Human
gagcagcagagcugggaccaga

SEQ ID NO: 613886 - RNA, 27 nt, Human
gcaaaaagccagcccggagcugggccc

SEQ ID NO: 613887 - RNA, 21 nt, Human
gccccuggcucucuccacuga

SEQ ID NO: 613888 - RNA, 18 nt, Human
gcccgggggucccugccc

SEQ ID NO: 613889 - RNA, 21 nt, Human
gcuggcggggggcagcagggg

SEQ ID NO: 613890 - RNA, 27 nt, Human
ggaccccagccucuguccagagucuca

SEQ ID NO: 613891 - RNA, 21 nt, Human
ggaggaccccagccucugucc

SEQ ID NO: 613892 - RNA, 20 nt, Human
ggcagcaggggacggaggcg

SEQ ID NO: 613893 - RNA, 23 nt, Human
ggccacacagcaagugagcagca

SEQ ID NO: 613894 - RNA, 19 nt, Human
ggccaggccccuuccccug

SEQ ID NO: 613895 - RNA, 19 nt, Human
ggccccaccuccagccccu

SEQ ID NO: 613896 - RNA, 18 nt, Human
ggcuucugagguccuggu

SEQ ID NO: 613897 - RNA, 20 nt, Human
gggcagcaggggacggaggc

SEQ ID NO: 613898 - RNA, 24 nt, Human
gggcuggcggggggcagcagggga

SEQ ID NO: 613899 - RNA, 22 nt, Human
ggggcggggugggcaggugggu

SEQ ID NO: 613900 - RNA, 21 nt, Human
ggggggcagcaggggacggag

SEQ ID NO: 613901 - RNA, 19 nt, Human
gggguccccaggucugggc

SEQ ID NO: 613902 - RNA, 24 nt, Human
ggggugggcagguggguggggcug

SEQ ID NO: 613903 - RNA, 20 nt, Human
ggggugggccccaccuccag

SEQ ID NO: 613904 - RNA, 22 nt, Human
gguggugagggcuggcgggggg

SEQ ID NO: 613905 - RNA, 21 nt, Human
guccccaggucugggcuucug

SEQ ID NO: 613906 - RNA, 20 nt, Human
gugggaaggacuggagagug

SEQ ID NO: 613907 - RNA, 22 nt, Human
gugggaaggacuggagagugag

SEQ ID NO: 613908 - RNA, 18 nt, Human
guggggcuggaaccuccu

SEQ ID NO: 613909 - RNA, 20 nt, Human
uacaucaucucaucaauucc

SEQ ID NO: 613910 - RNA, 20 nt, Human
uaggagagguugaggaagcg

SEQ ID NO: 613911 - RNA, 21 nt, Human
ucaauggugcugaugggguuu

SEQ ID NO: 613912 - RNA, 23 nt, Human
ucccccaggaggaccccagccuc

SEQ ID NO: 613913 - RNA, 21 nt, Human
uccccugcccggccgcccggg

SEQ ID NO: 613914 - RNA, 22 nt, Human
ucccugccccccgccccggccc

SEQ ID NO: 613915 - RNA, 18 nt, Human
uccugauggugccugggg

SEQ ID NO: 613916 - RNA, 21 nt, Human
ugaccugcuugaggccacaca

SEQ ID NO: 613917 - RNA, 20 nt, Human
ugagcagguggcggccaggc

SEQ ID NO: 613918 - RNA, 22 nt, Human
ugagcagguggcggccaggccc

SEQ ID NO: 613919 - RNA, 21 nt, Human
ugaggcccagagaggccagug

SEQ ID NO: 613920 - RNA, 24 nt, Human
ugagggcuggcggggggcagcagg

SEQ ID NO: 613921 - RNA, 25 nt, Human
ugagggcuggcgggggggggucguc

SEQ ID NO: 613922 - RNA, 20 nt, Human
ugagguaggcagggcagggg

SEQ ID NO: 613923 - RNA, 21 nt, Human
ugccuggggcggggugggcag

SEQ ID NO: 613924 - RNA, 21 nt, Human
ugcugucccccaggaggaccc

SEQ ID NO: 613925 - RNA, 24 nt, Human
uggaaccuccuuuccuguuuuccu

SEQ ID NO: 613926 - RNA, 20 nt, Human
uggaagagggcccuggagca

SEQ ID NO: 613927 - RNA, 23 nt, Human
ugggaaggacuggagagugagca

SEQ ID NO: 613928 - RNA, 24 nt, Human
uggggaagagaagagaaaggagga

SEQ ID NO: 613929 - RNA, 25 nt, Human
uggggcuggaaccuccuuuccuguu

SEQ ID NO: 613930 - RNA, 24 nt, Human
uggugccuggggcggggugggcag

SEQ ID NO: 613931 - RNA, 20 nt, Human
uguggagacugaggcccaga

SEQ ID NO: 613932 - RNA, 18 nt, Human
aaaagaacaggaugucag

SEQ ID NO: 613933 - RNA, 23 nt, Human
aaacaaacacaaaugaaaaugca

SEQ ID NO: 613934 - RNA, 20 nt, Human
aaccugcuucuuccuccucc

SEQ ID NO: 613935 - RNA, 22 nt, Human
aaggcacucuccccuccuucac

SEQ ID NO: 613936 - RNA, 24 nt, Human
aaguccuggucacuguagcagccc

SEQ ID NO: 613937 - RNA, 19 nt, Human
aauccucugaagucaggcu

SEQ ID NO: 613938 - RNA, 22 nt, Human
acaaaugaaaaugcaaaucaga

SEQ ID NO: 613939 - RNA, 25 nt, Human
acaggcagugcauggauguguaaac

SEQ ID NO: 613940 - RNA, 19 nt, Human
acauacauccucugaccuc

SEQ ID NO: 613941 - RNA, 25 nt, Human
accacagcugucagauaccaaccca

SEQ ID NO: 613942 - RNA, 19 nt, Human
acgcggcuguggggcugga

SEQ ID NO: 613943 - RNA, 23 nt, Human
agagcuuccucaaacagcuccau

SEQ ID NO: 613944 - RNA, 21 nt, Human
agccaguccucugaccuccug

SEQ ID NO: 613945 - RNA, 23 nt, Human
agccuuucucucccacaggcccc

SEQ ID NO: 613946 - RNA, 19 nt, Human
agcugggagaaugcagacu

SEQ ID NO: 613947 - RNA, 22 nt, Human
aggagccuucucucugccaccc

SEQ ID NO: 613948 - RNA, 23 nt, Human
aggccugccgcacacagugcagc

SEQ ID NO: 613949 - RNA, 18 nt, Human
aggcgguugaggugggga

SEQ ID NO: 613950 - RNA, 18 nt, Human
agggcccagccccaccuc

SEQ ID NO: 613951 - RNA, 20 nt, Human
aucccuggucugagccccca

SEQ ID NO: 613952 - RNA, 25 nt, Human
auggggguggggcaaagucaggggc

SEQ ID NO: 613953 - RNA, 21 nt, Human
caaacagcuccaugccuugca

SEQ ID NO: 613954 - RNA, 24 nt, Human
caaaugaaaaugcaaaucagagug

SEQ ID NO: 613955 - RNA, 19 nt, Human
caacccccucucucacagc

SEQ ID NO: 613956 - RNA, 19 nt, Human
caaccuggaaagggcagag

SEQ ID NO: 613957 - RNA, 21 nt, Human
caagugguccccgggcccaca

SEQ ID NO: 613958 - RNA, 24 nt, Human
caagugguccccgggcccacaggu

SEQ ID NO: 613959 - RNA, 22 nt, Human
cacaacaacccccucucucaca

SEQ ID NO: 613960 - RNA, 23 nt, Human
cacaacaacccccucucucacag

SEQ ID NO: 613961 - RNA, 21 nt, Human
cacacagugcagcuuggccag

SEQ ID NO: 613962 - RNA, 26 nt, Human
cacacauaccagagggccccuccaca

SEQ ID NO: 613963 - RNA, 22 nt, Human
cacacucuaccauccaaaaguc

SEQ ID NO: 613964 - RNA, 21 nt, Human
caccccccagcccgugccgcc

SEQ ID NO: 613965 - RNA, 18 nt, Human
caccucugccccaucucu

SEQ ID NO: 613966 - RNA, 20 nt, Human
cacgccccagaaggacaggg

SEQ ID NO: 613967 - RNA, 20 nt, Human
cacugagaagacacugccgg

SEQ ID NO: 613968 - RNA, 20 nt, Human
cacugccgggcugacaggac

SEQ ID NO: 613969 - RNA, 23 nt, Human
cagagccacagcagaacgcguug

SEQ ID NO: 613970 - RNA, 19 nt, Human
cagagccagguacccucug

SEQ ID NO: 613971 - RNA, 23 nt, Human
cagagccagguacccucuggcgc

SEQ ID NO: 613972 - RNA, 24 nt, Human
cagagccagguacccucuggcgcc

SEQ ID NO: 613973 - RNA, 23 nt, Human
cagccuuucucucccacaggccc

SEQ ID NO: 613974 - RNA, 20 nt, Human
cagcuggugggcagccaggg

SEQ ID NO: 613975 - RNA, 18 nt, Human
caggaaccguucuucucc

SEQ ID NO: 613976 - RNA, 18 nt, Human
cagugcacacacucuacc

SEQ ID NO: 613977 - RNA, 19 nt, Human
ccacaacaacccccucucu

SEQ ID NO: 613978 - RNA, 22 nt, Human
ccacacccagcaucaucuccuc

SEQ ID NO: 613979 - RNA, 18 nt, Human
ccaggcaccauccacgcc

SEQ ID NO: 613980 - RNA, 23 nt, Human
ccagguacccucuggcgccgcuc

SEQ ID NO: 613981 - RNA, 23 nt, Human
ccauccaaaagucgaagcuguga

SEQ ID NO: 613982 - RNA, 18 nt, Human
cccagcugcuccccuccc

SEQ ID NO: 613983 - RNA, 25 nt, Human
cccaggaggggaguguguuccgucg

SEQ ID NO: 613984 - RNA, 21 nt, Human
cccauggaacccuccugccca

SEQ ID NO: 613985 - RNA, 24 nt, Human
cccauggaacccuccugcccagga

SEQ ID NO: 613986 - RNA, 24 nt, Human
cccauggaacccuccugcccaggg

SEQ ID NO: 613987 - RNA, 21 nt, Human
ccccaggaaccguucuucucc

SEQ ID NO: 613988 - RNA, 24 nt, Human
ccccauccuucaccuccacccucc

SEQ ID NO: 613989 - RNA, 22 nt, Human
cccccaagugguccccgggccc

SEQ ID NO: 613990 - RNA, 24 nt, Human
cccccaagugguccccgggcccac

SEQ ID NO: 613991 - RNA, 21 nt, Human
cccccaggaaccguucuucuc

SEQ ID NO: 613992 - RNA, 19 nt, Human
ccccgggcccacaggugac

SEQ ID NO: 613993 - RNA, 21 nt, Human
cccgagugcuugcugggcuca

SEQ ID NO: 613994 - RNA, 18 nt, Human
cccgcagccgcagcgagc

SEQ ID NO: 613995 - RNA, 20 nt, Human
cccgcagccgcagcgagccc

SEQ ID NO: 613996 - RNA, 23 nt, Human
cccucugggccuuggggacuccc

SEQ ID NO: 613997 - RNA, 21 nt, Human
ccgcagcgagcccucggucag

SEQ ID NO: 613998 - RNA, 24 nt, Human
ccgucgccucuucagcuggugggc

SEQ ID NO: 613999 - RNA, 19 nt, Human
ccgugcccagcugcucccc

SEQ ID NO: 614000 - RNA, 21 nt, Human
ccuccacagagccagguaccc

SEQ ID NO: 614001 - RNA, 21 nt, Human
ccuccaucccucuggcauccc

SEQ ID NO: 614002 - RNA, 23 nt, Human
ccucccccaagugguccccgggc

SEQ ID NO: 614003 - RNA, 27 nt, Human
ccucucaaccuggaaagggcagagcca

SEQ ID NO: 614004 - RNA, 21 nt, Human
ccucugggccuuggggacucc

SEQ ID NO: 614005 - RNA, 19 nt, Human
ccuggccucugcuuccccc

SEQ ID NO: 614006 - RNA, 22 nt, Human
ccuggggcauccuggcucugcc

SEQ ID NO: 614007 - RNA, 18 nt, Human
cguugcucuugcugcugg

SEQ ID NO: 614008 - RNA, 23 nt, Human
cguugcucuugcugcuggggcuc

SEQ ID NO: 614009 - RNA, 26 nt, Human
cucacagucagugcacacacucuacc

SEQ ID NO: 614010 - RNA, 24 nt, Human
cucacggcccgcacgccugcuuug

SEQ ID NO: 614011 - RNA, 24 nt, Human
cucagggccaagagcuuccaagga

SEQ ID NO: 614012 - RNA, 24 nt, Human
cucccagcacccuugucagcagcc

SEQ ID NO: 614013 - RNA, 19 nt, Human
cuccugcccaggaagcugc

SEQ ID NO: 614014 - RNA, 18 nt, Human
cucuguggugcgcccucc

SEQ ID NO: 614015 - RNA, 22 nt, Human
cucuugucuuccagaagccccu

SEQ ID NO: 614016 - RNA, 22 nt, Human
cugcaaacuccuuccgcuguga

SEQ ID NO: 614017 - RNA, 22 nt, Human
cugccaccccccagcccgugcc

SEQ ID NO: 614018 - RNA, 21 nt, Human
cugccccaucucuggauggcc

SEQ ID NO: 614019 - RNA, 24 nt, Human
cugcccccaugaggccccaggagc

SEQ ID NO: 614020 - RNA, 20 nt, Human
cugccuccgggcaucagccu

SEQ ID NO: 614021 - RNA, 18 nt, Human
cuggcucugccuguccca

SEQ ID NO: 614022 - RNA, 22 nt, Human
cugggucccaggcaccauccac

SEQ ID NO: 614023 - RNA, 21 nt, Human
cuguagcagcccagcagcucc

SEQ ID NO: 614024 - RNA, 18 nt, Human
cuucaccuccacccuccc

SEQ ID NO: 614025 - RNA, 21 nt, Human
cuucugcagagcuuccucaaa

SEQ ID NO: 614026 - RNA, 24 nt, Human
cuuggccagaaaguccuggucacu

SEQ ID NO: 614027 - RNA, 22 nt, Human
gaagaaaagcugguuacucuug

SEQ ID NO: 614028 - RNA, 25 nt, Human
gaagccccucgaaggccugccgcac

SEQ ID NO: 614029 - RNA, 21 nt, Human
gaaggggcccacagaagaugg

SEQ ID NO: 614030 - RNA, 21 nt, Human
gaagguggggaagcugguccg

SEQ ID NO: 614031 - RNA, 18 nt, Human
gaccauauagccacaggu

SEQ ID NO: 614032 - RNA, 18 nt, Human
gaccuuccuggccaagag

SEQ ID NO: 614033 - RNA, 21 nt, Human
gagacuccuccaucccucugg

SEQ ID NO: 614034 - RNA, 18 nt, Human
gagggcaucaggacaggc

SEQ ID NO: 614035 - RNA, 21 nt, Human
gagguuuuggggucccccacc

SEQ ID NO: 614036 - RNA, 23 nt, Human
gcaaagucaggggcaacggcccu

SEQ ID NO: 614037 - RNA, 21 nt, Human
gcacacacucuaccauccaaa

SEQ ID NO: 614038 - RNA, 19 nt, Human
gcagagcuuccucaaacag

SEQ ID NO: 614039 - RNA, 19 nt, Human
gcaucagccugggaggcgg

SEQ ID NO: 614040 - RNA, 19 nt, Human
gcaucagccugggaggugg

SEQ ID NO: 614041 - RNA, 23 nt, Human
gccccaggcaaaguccucagggc

SEQ ID NO: 614042 - RNA, 18 nt, Human
gcccucagccaccacagc

SEQ ID NO: 614043 - RNA, 18 nt, Human
gccugccgcacacagugc

SEQ ID NO: 614044 - RNA, 18 nt, Human
gcugagaccauauagcca

SEQ ID NO: 614045 - RNA, 25 nt, Human
gcugcccacuaagguggccccacuc

SEQ ID NO: 614046 - RNA, 21 nt, Human
ggaaacccaggaggggagugu

SEQ ID NO: 614047 - RNA, 21 nt, Human
ggagccaguccucugaccucc

SEQ ID NO: 614048 - RNA, 22 nt, Human
ggaugggcgggggcaggagggc

SEQ ID NO: 614049 - RNA, 26 nt, Human
ggccaagaggauagggaggggcaccg

SEQ ID NO: 614050 - RNA, 24 nt, Human
ggccacauacauccucugaccucc

SEQ ID NO: 614051 - RNA, 18 nt, Human
ggcccaguuccugcucag

SEQ ID NO: 614052 - RNA, 21 nt, Human
ggcgggggcaggagggcccag

SEQ ID NO: 614053 - RNA, 19 nt, Human
gggaggcggguuagugccc

SEQ ID NO: 614054 - RNA, 20 nt, Human
gggagguuuugggguccccc

SEQ ID NO: 614055 - RNA, 19 nt, Human
gggcagccagggccagggc

SEQ ID NO: 614056 - RNA, 20 nt, Human
gggcaucaggacaggccagc

SEQ ID NO: 614057 - RNA, 23 nt, Human
ggggguggggcaaagucaggggc

SEQ ID NO: 614058 - RNA, 22 nt, Human
gggguggggcaaagucaggggc

SEQ ID NO: 614059 - RNA, 20 nt, Human
ggguuccggaggccgucccu

SEQ ID NO: 614060 - RNA, 20 nt, Human
ggucugggcucauggaaggg

SEQ ID NO: 614061 - RNA, 19 nt, Human
ggugacagaggugggagga

SEQ ID NO: 614062 - RNA, 20 nt, Human
gugcagcuuggccagaaagu

SEQ ID NO: 614063 - RNA, 26 nt, Human
uaaacaaacacaaaugaaaaugcugu

SEQ ID NO: 614064 - RNA, 24 nt, Human
uagcugggagaaugcagacugccc

SEQ ID NO: 614065 - RNA, 22 nt, Human
uauucgacucacagucagugca

SEQ ID NO: 614066 - RNA, 21 nt, Human
ucaaccguagcugggagaaug

SEQ ID NO: 614067 - RNA, 22 nt, Human
ucaauggaagagaugccacuca

SEQ ID NO: 614068 - RNA, 22 nt, Human
ucacagcacaggguaagugcaa

SEQ ID NO: 614069 - RNA, 19 nt, Human
ucacugccaucaucgaggc

SEQ ID NO: 614070 - RNA, 24 nt, Human
ucacugccaucaucgaggccacac

SEQ ID NO: 614071 - RNA, 21 nt, Human
ucagagacuccuccaucccuc

SEQ ID NO: 614072 - RNA, 24 nt, Human
ucagagacuccuccaucccucugg

SEQ ID NO: 614073 - RNA, 23 nt, Human
ucagagugggcggggccaaggcc

SEQ ID NO: 614074 - RNA, 18 nt, Human
ucagcuggugggcagcca

SEQ ID NO: 614075 - RNA, 21 nt, Human
ucaggggcagcaugagggucc

SEQ ID NO: 614076 - RNA, 18 nt, Human
uccacaacaacccccucu

SEQ ID NO: 614077 - RNA, 20 nt, Human
ucccaggcaccauccacgcc

SEQ ID NO: 614078 - RNA, 22 nt, Human
ucccaggcaccauccacgcccc

SEQ ID NO: 614079 - RNA, 25 nt, Human
ucccaggcaccauccacgccccaga

SEQ ID NO: 614080 - RNA, 22 nt, Human
ucccauccccagaccccuuucc

SEQ ID NO: 614081 - RNA, 22 nt, Human
ucccccaggaaccguucuucuc

SEQ ID NO: 614082 - RNA, 18 nt, Human
ucccugggcaugggggug

SEQ ID NO: 614083 - RNA, 22 nt, Human
uccucagggccaagagcuucca

SEQ ID NO: 614084 - RNA, 18 nt, Human
uccuucaccagcugcagg

SEQ ID NO: 614085 - RNA, 20 nt, Human
uccuuccgcugugacucugg

SEQ ID NO: 614086 - RNA, 23 nt, Human
ucggcccacuuucccgaagaaaa

SEQ ID NO: 614087 - RNA, 21 nt, Human
ucuaggccccauccuucaccu

SEQ ID NO: 614088 - RNA, 18 nt, Human
ucuccacaacaacccccu

SEQ ID NO: 614089 - RNA, 23 nt, Human
ucuccauggaaauguccccucug

SEQ ID NO: 614090 - RNA, 19 nt, Human
ucucccacaggccccacug

SEQ ID NO: 614091 - RNA, 18 nt, Human
ucucggccaccgucaugg

SEQ ID NO: 614092 - RNA, 23 nt, Human
ucucucacagccuuucucuccca

SEQ ID NO: 614093 - RNA, 20 nt, Human
ucucuggauggcccaggccu

SEQ ID NO: 614094 - RNA, 19 nt, Human
ucucuggguuccggaggcc

SEQ ID NO: 614095 - RNA, 21 nt, Human
ucugcagagcuuccucaaaca

SEQ ID NO: 614096 - RNA, 21 nt, Human
ucugcaggcccaggggaggcu

SEQ ID NO: 614097 - RNA, 18 nt, Human
ucugccccaucucuggau

SEQ ID NO: 614098 - RNA, 20 nt, Human
ucuuccagaagccccucgaa

SEQ ID NO: 614099 - RNA, 23 nt, Human
ugaagacacugagaagacacugc

SEQ ID NO: 614100 - RNA, 21 nt, Human
ugaagguggggaagcuggucc

SEQ ID NO: 614101 - RNA, 18 nt, Human
ugacaggaccccgcggcg

SEQ ID NO: 614102 - RNA, 19 nt, Human
ugagaccauauagccacag

SEQ ID NO: 614103 - RNA, 21 nt, Human
ugagcccccagcucagagccu

SEQ ID NO: 614104 - RNA, 22 nt, Human
ugagcccccagcucagagccua

SEQ ID NO: 614105 - RNA, 20 nt, Human
ugagguggggagggcaucag

SEQ ID NO: 614106 - RNA, 19 nt, Human
ugaguguggaaacccagga

SEQ ID NO: 614107 - RNA, 19 nt, Human
ugaugcagucucuggguuc

SEQ ID NO: 614108 - RNA, 21 nt, Human
ugaugcagucucuggguuccg

SEQ ID NO: 614109 - RNA, 18 nt, Human
ugcacacacucuaccauc

SEQ ID NO: 614110 - RNA, 22 nt, Human
ugcccaaacgucguguacagga

SEQ ID NO: 614111 - RNA, 19 nt, Human
ugcccagcugcuccccucc

SEQ ID NO: 614112 - RNA, 20 nt, Human
ugccccaggcaaaguccuca

SEQ ID NO: 614113 - RNA, 21 nt, Human
ugcgcccucccauccccagac

SEQ ID NO: 614114 - RNA, 22 nt, Human
uggaaagggcagagccacagca

SEQ ID NO: 614115 - RNA, 18 nt, Human
uggaacccuccugcccag

SEQ ID NO: 614116 - RNA, 22 nt, Human
uggagccgaacuccuccugcag

SEQ ID NO: 614117 - RNA, 18 nt, Human
uggaggcugccuccaggc

SEQ ID NO: 614118 - RNA, 20 nt, Human
uggaucauagacgugcccuc

SEQ ID NO: 614119 - RNA, 19 nt, Human
uggcaaagaggacuuuccg

SEQ ID NO: 614120 - RNA, 22 nt, Human
uggccagaaaguccuggucacu

SEQ ID NO: 614121 - RNA, 24 nt, Human
uggccagggccuggaucauagacg

SEQ ID NO: 614122 - RNA, 21 nt, Human
uggccucugcuucccccagga

SEQ ID NO: 614123 - RNA, 22 nt, Human
uggcucugccugucccaauucu

SEQ ID NO: 614124 - RNA, 21 nt, Human
uggcuucuagcucaggacacu

SEQ ID NO: 614125 - RNA, 22 nt, Human
ugggaaggggcccacagaagau

SEQ ID NO: 614126 - RNA, 24 nt, Human
ugggagaaugcagacugcccaaac

SEQ ID NO: 614127 - RNA, 21 nt, Human
ugggaggagaaaagacgaucu

SEQ ID NO: 614128 - RNA, 23 nt, Human
ugggaggcccaccucugccccau

SEQ ID NO: 614129 - RNA, 22 nt, Human
ugggagguuuugggguccccca

SEQ ID NO: 614130 - RNA, 19 nt, Human
ugggcgggggcaggagggc

SEQ ID NO: 614131 - RNA, 21 nt, Human
uggggguggggcaaagucagg

SEQ ID NO: 614132 - RNA, 21 nt, Human
uggugggcagccagggccagg

SEQ ID NO: 614133 - RNA, 22 nt, Human
ugucugggaaggggcccacaga

SEQ ID NO: 614134 - RNA, 22 nt, Human
uguguaaacaaacacaaaugaa

SEQ ID NO: 614135 - RNA, 19 nt, Human
uguuacauucacagcacag

SEQ ID NO: 614136 - RNA, 20 nt, Human
uucucugcaaacuccuuccg

SEQ ID NO: 614137 - RNA, 22 nt, Human
uugccagcugggucccaggcac

SEQ ID NO: 614138 - RNA, 19 nt, Human
uugcugggcucaauggaag

SEQ ID NO: 614139 - RNA, 22 nt, Human
uuucuccugcaggccucucaac

SEQ ID NO: 614140 - RNA, 19 nt, Human
uuugugcguugaacugaag

SEQ ID NO: 614141 - RNA, 20 nt, Human
aaacacaagcacccacguuc

SEQ ID NO: 614142 - RNA, 24 nt, Human
aaacauaguuacaacagacauguu

SEQ ID NO: 614143 - RNA, 24 nt, Human
aaccacauccccguuucucacuaa

SEQ ID NO: 614144 - RNA, 22 nt, Human
aacugauaagaggacacaccaa

SEQ ID NO: 614145 - RNA, 25 nt, Human
acacauacauacacgcacacacaca

SEQ ID NO: 614146 - RNA, 23 nt, Human
acaccaaacuagaucacugaacu

SEQ ID NO: 614147 - RNA, 20 nt, Human
acacuuuuuuucauuuuugg

SEQ ID NO: 614148 - RNA, 21 nt, Human
acauuaaaugaaaaaaaggaa

SEQ ID NO: 614149 - RNA, 22 nt, Human
accagcaccuaaccacaucccc

SEQ ID NO: 614150 - RNA, 23 nt, Human
acccaaugaaucauuuaugacuu

SEQ ID NO: 614151 - RNA, 21 nt, Human
acgcacacacacaaacgcaua

SEQ ID NO: 614152 - RNA, 24 nt, Human
acugagcucccucauuguuuaaag

SEQ ID NO: 614153 - RNA, 22 nt, Human
agagaagaacaccuuuuggagg

SEQ ID NO: 614154 - RNA, 30 nt, Human
auacauacacgcacacacacaaacgcauag

SEQ ID NO: 614155 - RNA, 25 nt, Human
aucuuccauaacuugcuuuuuguua

SEQ ID NO: 614156 - RNA, 21 nt, Human
auggcugaaaaggucaaacac

SEQ ID NO: 614157 - RNA, 24 nt, Human
auguuacauuaaaugaaaaaaagg

SEQ ID NO: 614158 - RNA, 31 nt, Human
auuuaauauacacauacauacacgcacacag

SEQ ID NO: 614159 - RNA, 22 nt, Human
caacuaauaacugcagaaauaa

SEQ ID NO: 614160 - RNA, 24 nt, Human
caagggagaagacagcagcagcca

SEQ ID NO: 614161 - RNA, 20 nt, Human
caauauauggcugaaaaggu

SEQ ID NO: 614162 - RNA, 18 nt, Human
caaugcugaucacugaac

SEQ ID NO: 614163 - RNA, 26 nt, Human
cacauacauacacgcacacacacaaa

SEQ ID NO: 614164 - RNA, 29 nt, Human
cacgcacacacacaaacgcauacucacau

SEQ ID NO: 614165 - RNA, 22 nt, Human
cagcagccaauuucugagauuc

SEQ ID NO: 614166 - RNA, 19 nt, Human
cagccugcuucuuuggcug

SEQ ID NO: 614167 - RNA, 22 nt, Human
cagccugcuucuuuggcugugg

SEQ ID NO: 614168 - RNA, 22 nt, Human
caguguugagcacauggcugcc

SEQ ID NO: 614169 - RNA, 20 nt, Human
cauggucagaacuugaacgg

SEQ ID NO: 614170 - RNA, 25 nt, Human
cauuaaacgacuacagauagauaca

SEQ ID NO: 614171 - RNA, 20 nt, Human
ccaccauucaaaguacaacu

SEQ ID NO: 614172 - RNA, 24 nt, Human
ccauucaaaguacaacugaagaau

SEQ ID NO: 614173 - RNA, 19 nt, Human
ccugaaacuuccaccccac

SEQ ID NO: 614174 - RNA, 24 nt, Human
cgcauacucacaugucuaggaacc

SEQ ID NO: 614175 - RNA, 19 nt, Human
cguagaaaggagucuauuu

SEQ ID NO: 614176 - RNA, 18 nt, Human
cuaggaaccagcaccuaa

SEQ ID NO: 614177 - RNA, 22 nt, Human
cuaguauuuucauuugauuauc

SEQ ID NO: 614178 - RNA, 19 nt, Human
cugaacuguacaaaugauc

SEQ ID NO: 614179 - RNA, 24 nt, Human
cuucauggucagaacuugaacggg

SEQ ID NO: 614180 - RNA, 18 nt, Human
gaaaaggucaaacacaag

SEQ ID NO: 614181 - RNA, 24 nt, Human
gacagcagcagccaauuucugaga

SEQ ID NO: 614182 - RNA, 21 nt, Human
gagcucccucauuguuuaaag

SEQ ID NO: 614183 - RNA, 22 nt, Human
gagcucccucauuguuuaaaga

SEQ ID NO: 614184 - RNA, 24 nt, Human
gauauauacauuuaauauacacaa

SEQ ID NO: 614185 - RNA, 22 nt, Human
gauucaacuguuccuccucaug

SEQ ID NO: 614186 - RNA, 18 nt, Human
gcugccuaacaaccauuc

SEQ ID NO: 614187 - RNA, 20 nt, Human
ggcauuuugauguguacauu

SEQ ID NO: 614188 - RNA, 20 nt, Human
guguugagcacauggcugcc

SEQ ID NO: 614189 - RNA, 25 nt, Human
uaaaaacacucaacuuaaaaaaggu

SEQ ID NO: 614190 - RNA, 20 nt, Human
uaaagaaauacaguaaaagc

SEQ ID NO: 614191 - RNA, 20 nt, Human
uaaagaacacauaaccuuaa

SEQ ID NO: 614192 - RNA, 23 nt, Human
uaaauuuaaaaaguuuauacuca

SEQ ID NO: 614193 - RNA, 18 nt, Human
uaaccacauccccguuuc

SEQ ID NO: 614194 - RNA, 18 nt, Human
uaggaaccagcaccuaac

SEQ ID NO: 614195 - RNA, 18 nt, Human
uagggcacaauuuauaau

SEQ ID NO: 614196 - RNA, 23 nt, Human
uauaaggcuguacaauauauggc

SEQ ID NO: 614197 - RNA, 28 nt, Human
uauacacauacauacacgcacacacaca

SEQ ID NO: 614198 - RNA, 21 nt, Human
uauacucaagaggugaaauca

SEQ ID NO: 614199 - RNA, 27 nt, Human
uauauacauuuaauauacacauacaua

SEQ ID NO: 614200 - RNA, 20 nt, Human
uauggcaagggagaagacag

SEQ ID NO: 614201 - RNA, 21 nt, Human
uaugggcauuuugauguguac

SEQ ID NO: 614202 - RNA, 23 nt, Human
uauuuaagaaacauaguuacaac

SEQ ID NO: 614203 - RNA, 18 nt, Human
ucaacuguuccuccucau

SEQ ID NO: 614204 - RNA, 22 nt, Human
ucagaguauaaaaccauaaaca

SEQ ID NO: 614205 - RNA, 22 nt, Human
uccaccccaccauucaaaguac

SEQ ID NO: 614206 - RNA, 23 nt, Human
uccaccccaccauucaaaguaca

SEQ ID NO: 614207 - RNA, 25 nt, Human
uccauaacuugcuuuuuguuaucca

SEQ ID NO: 614208 - RNA, 20 nt, Human
uccauuguucaccugaaacu

SEQ ID NO: 614209 - RNA, 19 nt, Human
ucuaggaaccagcaccuaa

SEQ ID NO: 614210 - RNA, 22 nt, Human
ucuccauaccacuuaucgguca

SEQ ID NO: 614211 - RNA, 18 nt, Human
ugaaaaaaauucacauau

SEQ ID NO: 614212 - RNA, 27 nt, Human
ugaaaggccuuuuaaucccccaauugg

SEQ ID NO: 614213 - RNA, 22 nt, Human
ugagcacauggcugccuaacaa

SEQ ID NO: 614214 - RNA, 24 nt, Human
ugauucagaaggcaccucaagauu

SEQ ID NO: 614215 - RNA, 19 nt, Human
ugcugcgugguuaggugcc

SEQ ID NO: 614216 - RNA, 22 nt, Human
uggaugguuguagcuuuauggc

SEQ ID NO: 614217 - RNA, 20 nt, Human
uggcaaucaacguuuuacca

SEQ ID NO: 614218 - RNA, 21 nt, Human
uggcugccuaacaaccauuca

SEQ ID NO: 614219 - RNA, 24 nt, Human
ugugagacacauuaucagauaaau

SEQ ID NO: 614220 - RNA, 25 nt, Human
uguggauauauacauuuaauauaca

SEQ ID NO: 614221 - RNA, 19 nt, Human
uguguggauauauacauuu

SEQ ID NO: 614222 - RNA, 22 nt, Human
uuaaaugaaaaaaaggaaagaa

SEQ ID NO: 614223 - RNA, 20 nt, Human
uuaagaaacauaguuacaac

SEQ ID NO: 614224 - RNA, 21 nt, Human
uuaccacagccuggaggccca

SEQ ID NO: 614225 - RNA, 18 nt, Human
uuaguaaaauuuugaaaa

SEQ ID NO: 614226 - RNA, 21 nt, Human
uucaaugcugaucacugaacu

SEQ ID NO: 614227 - RNA, 19 nt, Human
aaaauaccaguuaacuuag

SEQ ID NO: 614228 - RNA, 23 nt, Human
aaagcacauuaucugaggugcaa

SEQ ID NO: 614229 - RNA, 24 nt, Human
aaagugcugggauuacaggcguga

SEQ ID NO: 614230 - RNA, 23 nt, Human
aagaugaacaguguaccuuggac

SEQ ID NO: 614231 - RNA, 19 nt, Human
aagcagcagccuggguugc

SEQ ID NO: 614232 - RNA, 19 nt, Human
aagugcugggauuacaggc

SEQ ID NO: 614233 - RNA, 19 nt, Human
aagugcugggauuacaggc

SEQ ID NO: 614234 - RNA, 26 nt, Human
aagugcugggauuacaggcgugagcc

SEQ ID NO: 614235 - RNA, 19 nt, Human
aaugugaagaaaaagauga

SEQ ID NO: 614236 - RNA, 23 nt, Human
acaacuuauaaaaagacuauacu

SEQ ID NO: 614237 - RNA, 21 nt, Human
acaguggccaguguggugugc

SEQ ID NO: 614238 - RNA, 25 nt, Human
acccgccucagccucccaaagugcu

SEQ ID NO: 614239 - RNA, 22 nt, Human
accgacuuagccaggauggucu

SEQ ID NO: 614240 - RNA, 23 nt, Human
accgacuuagccaggauggucuc

SEQ ID NO: 614241 - RNA, 19 nt, Human
acuacaggcgcgugccacc

SEQ ID NO: 614242 - RNA, 21 nt, Human
acuggaacugugggaaggagc

SEQ ID NO: 614243 - RNA, 21 nt, Human
acuucuggguccuuuuguccc

SEQ ID NO: 614244 - RNA, 19 nt, Human
agaguaugggacuaacccc

SEQ ID NO: 614245 - RNA, 18 nt, Human
agcagccugcagcucucu

SEQ ID NO: 614246 - RNA, 22 nt, Human
agcaggcucaugguccagcccc

SEQ ID NO: 614247 - RNA, 22 nt, Human
agccugaagcuggaggagcuuc

SEQ ID NO: 614248 - RNA, 26 nt, Human
agccuggguugcaggggcugggacuu

SEQ ID NO: 614249 - RNA, 21 nt, Human
agcgauucuuccugccucagc

SEQ ID NO: 614250 - RNA, 22 nt, Human
aggaagacagcugucuaagaac

SEQ ID NO: 614251 - RNA, 20 nt, Human
aggaagugggcccucaccag

SEQ ID NO: 614252 - RNA, 22 nt, Human
aggcagagcuaagcaaaaaaga

SEQ ID NO: 614253 - RNA, 18 nt, Human
aggcuggagugcaguggc

SEQ ID NO: 614254 - RNA, 19 nt, Human
aggugauuaggucaugaga

SEQ ID NO: 614255 - RNA, 24 nt, Human
aguaaacagaauugacaagagaaa

SEQ ID NO: 614256 - RNA, 19 nt, Human
aguagcugggacuacaggc

SEQ ID NO: 614257 - RNA, 23 nt, Human
aguagcugggacuacaggcgcgu

SEQ ID NO: 614258 - RNA, 20 nt, Human
agugcaguggcgcggucucg

SEQ ID NO: 614259 - RNA, 23 nt, Human
agugcaguggcgcggucucggcu

SEQ ID NO: 614260 - RNA, 24 nt, Human
agugcaguggcgcggucucggcuc

SEQ ID NO: 614261 - RNA, 18 nt, Human
agugcugggauuacaggc

SEQ ID NO: 614262 - RNA, 24 nt, Human
aguuagagccugaagcuggaggag

SEQ ID NO: 614263 - RNA, 21 nt, Human
auagaguaugggacuaacccc

SEQ ID NO: 614264 - RNA, 22 nt, Human
aucuuauaaaagggaccccgga

SEQ ID NO: 614265 - RNA, 21 nt, Human
auggcuaaugaaaagacagga

SEQ ID NO: 614266 - RNA, 24 nt, Human
caaagugcugggauuacaggcgug

SEQ ID NO: 614267 - RNA, 26 nt, Human
caccacuccauccccauucuucuacu

SEQ ID NO: 614268 - RNA, 19 nt, Human
cacccgcaaccgaacgggc

SEQ ID NO: 614269 - RNA, 21 nt, Human
cacccgcaaccgaacgggcuc

SEQ ID NO: 614270 - RNA, 23 nt, Human
cacccgccucagccucccaaagu

SEQ ID NO: 614271 - RNA, 27 nt, Human
cacuauaguuguauaugcauuauagcu

SEQ ID NO: 614272 - RNA, 21 nt, Human
cacugcaaccucugccucccg

SEQ ID NO: 614273 - RNA, 23 nt, Human
cacugcaaccucugccucccggg

SEQ ID NO: 614274 - RNA, 22 nt, Human
cagaacugugagaaauaaauuc

SEQ ID NO: 614275 - RNA, 21 nt, Human
cagaaucucccuaucucccuc

SEQ ID NO: 614276 - RNA, 25 nt, Human
cagcagccuggguugcaggggcugg

SEQ ID NO: 614277 - RNA, 20 nt, Human
cagcaggcucaugguccagc

SEQ ID NO: 614278 - RNA, 21 nt, Human
cagcauccagaacugugagaa

SEQ ID NO: 614279 - RNA, 22 nt, Human
cagccuggguugcaggggcugg

SEQ ID NO: 614280 - RNA, 19 nt, Human
cagggccagagacacccgc

SEQ ID NO: 614281 - RNA, 22 nt, Human
cagggcugaccgcagggccaga

SEQ ID NO: 614282 - RNA, 20 nt, Human
cauccagaacugugagaaau

SEQ ID NO: 614283 - RNA, 22 nt, Human
cauucuggcucuucuucgggag

SEQ ID NO: 614284 - RNA, 22 nt, Human
ccaaaaauccaguugcauggaa

SEQ ID NO: 614285 - RNA, 22 nt, Human
ccaaagugcugggauuacaggc

SEQ ID NO: 614286 - RNA, 22 nt, Human
ccaaagugcugggauuacaggc

SEQ ID NO: 614287 - RNA, 24 nt, Human
ccaaagugcugggauuacaggcgu

SEQ ID NO: 614288 - RNA, 20 nt, Human
ccaccacgccuggcuaauuu

SEQ ID NO: 614289 - RNA, 26 nt, Human
ccacccgccucagccucccaaagugc

SEQ ID NO: 614290 - RNA, 20 nt, Human
ccagacauugaaucugcgcu

SEQ ID NO: 614291 - RNA, 19 nt, Human
ccagagacacccgcaaccg

SEQ ID NO: 614292 - RNA, 21 nt, Human
cccagggaaaaccaucaccac

SEQ ID NO: 614293 - RNA, 28 nt, Human
ccccggagagcugccuuccucuucuacc

SEQ ID NO: 614294 - RNA, 23 nt, Human
cccgaguagcugggacuacaggc

SEQ ID NO: 614295 - RNA, 24 nt, Human
cccgaguagcugggacuacaggcg

SEQ ID NO: 614296 - RNA, 22 nt, Human
cccgcaaccgaacgggcucccg

SEQ ID NO: 614297 - RNA, 21 nt, Human
cccgcggcgaggaagcgaggc

SEQ ID NO: 614298 - RNA, 24 nt, Human
cccggguucaagcgauucuuccug

SEQ ID NO: 614299 - RNA, 18 nt, Human
cccucccuuuccagacag

SEQ ID NO: 614300 - RNA, 24 nt, Human
ccgccucagccucccaaagugcug

SEQ ID NO: 614301 - RNA, 24 nt, Human
ccucccggguucaagcgauucuuc

SEQ ID NO: 614302 - RNA, 20 nt, Human
ccugaccucuugauccaccc

SEQ ID NO: 614303 - RNA, 23 nt, Human
ccugccucagccucccgaguagc

SEQ ID NO: 614304 - RNA, 24 nt, Human
ccugccucagccucccgaguagcu

SEQ ID NO: 614305 - RNA, 21 nt, Human
ccuucuuucuucuuuugcuuu

SEQ ID NO: 614306 - RNA, 25 nt, Human
cgcaaccgaacgggcucccggcgcc

SEQ ID NO: 614307 - RNA, 24 nt, Human
cgccucagccucccaaagugcugg

SEQ ID NO: 614308 - RNA, 27 nt, Human
cgggagcuuuuucauccuggccuugcu

SEQ ID NO: 614309 - RNA, 24 nt, Human
cucacugcaaccucugccucccgg

SEQ ID NO: 614310 - RNA, 24 nt, Human
cucagccucccgaguagcugggac

SEQ ID NO: 614311 - RNA, 18 nt, Human
cucccuuuccagacagcc

SEQ ID NO: 614312 - RNA, 24 nt, Human
cuccugaccucuugauccacccgc

SEQ ID NO: 614313 - RNA, 23 nt, Human
cucuaaacacugcugccugaucc

SEQ ID NO: 614314 - RNA, 21 nt, Human
cucuaccuuaaugcuauuaac

SEQ ID NO: 614315 - RNA, 18 nt, Human
cucuguugcccaggcugg

SEQ ID NO: 614316 - RNA, 20 nt, Human
cucuguugcccaggcuggag

SEQ ID NO: 614317 - RNA, 23 nt, Human
cucuguugcccaggcuggagugc

SEQ ID NO: 614318 - RNA, 19 nt, Human
cugaggugcaauacaaagg

SEQ ID NO: 614319 - RNA, 19 nt, Human
cugcaaccucugccucccg

SEQ ID NO: 614320 - RNA, 23 nt, Human
cugcaaccucugccucccggguu

SEQ ID NO: 614321 - RNA, 24 nt, Human
cugcaaccucugccucccggguuc

SEQ ID NO: 614322 - RNA, 26 nt, Human
cuucuacuucuggguccuuuuguccc

SEQ ID NO: 614323 - RNA, 20 nt, Human
cuucuggguccuuuuguccc

SEQ ID NO: 614324 - RNA, 24 nt, Human
cuugauccacccgccucagccucc

SEQ ID NO: 614325 - RNA, 22 nt, Human
cuuggacuggacuuuccaucuc

SEQ ID NO: 614326 - RNA, 19 nt, Human
gaccgcagggccagagaca

SEQ ID NO: 614327 - RNA, 22 nt, Human
gaccucuugauccacccgccuc

SEQ ID NO: 614328 - RNA, 25 nt, Human
gagaaaaaaagaaaaacacugcauu

SEQ ID NO: 614329 - RNA, 26 nt, Human
gaguagcugggacuacaggcgcgugc

SEQ ID NO: 614330 - RNA, 18 nt, Human
gauuacaggcgugagcca

SEQ ID NO: 614331 - RNA, 21 nt, Human
gauuacaggcgugagccaccg

SEQ ID NO: 614332 - RNA, 24 nt, Human
gauuacaggcgugagccaccgugc

SEQ ID NO: 614333 - RNA, 19 nt, Human
gcccaggcuggagugcagu

SEQ ID NO: 614334 - RNA, 23 nt, Human
gccuggcuaauuuuuuguauuuu

SEQ ID NO: 614335 - RNA, 20 nt, Human
gcucuguugcccaggcugga

SEQ ID NO: 614336 - RNA, 25 nt, Human
ggaaaaccaucaccacaggaccuuc

SEQ ID NO: 614337 - RNA, 23 nt, Human
ggaguuuugcucuguugcccagg

SEQ ID NO: 614338 - RNA, 20 nt, Human
ggcuuugucuguuccgggcu

SEQ ID NO: 614339 - RNA, 19 nt, Human
gggccucuaggaaucuagc

SEQ ID NO: 614340 - RNA, 22 nt, Human
ggguaacuaaggcaucccacag

SEQ ID NO: 614341 - RNA, 20 nt, Human
ggucucgaucuccugaccuc

SEQ ID NO: 614342 - RNA, 29 nt, Human
guaccuucuuucuucuuuugcuuuaagaa

SEQ ID NO: 614343 - RNA, 20 nt, Human
gugagaaauaaauucauguu

SEQ ID NO: 614344 - RNA, 21 nt, Human
gugcucuaaacacugcugccu

SEQ ID NO: 614345 - RNA, 21 nt, Human
gugggaaaauauuuguuauau

SEQ ID NO: 614346 - RNA, 24 nt, Human
guuuugcucuguugcccaggcugg

SEQ ID NO: 614347 - RNA, 21 nt, Human
uaaaaagcacauuaucugagg

SEQ ID NO: 614348 - RNA, 23 nt, Human
uaaaagcagcauauaucauuucu

SEQ ID NO: 614349 - RNA, 22 nt, Human
uaaaugucuuucuaaaaugagg

SEQ ID NO: 614350 - RNA, 19 nt, Human
uaacuaaggcaucccacag

SEQ ID NO: 614351 - RNA, 18 nt, Human
uaagcagcagccuggguu

SEQ ID NO: 614352 - RNA, 24 nt, Human
uaauuuuuuguauuuuuauuagag

SEQ ID NO: 614353 - RNA, 22 nt, Human
uacaggcgcgugccaccacgcc

SEQ ID NO: 614354 - RNA, 24 nt, Human
uacaggcgugagccaccgugccca

SEQ ID NO: 614355 - RNA, 19 nt, Human
uacgggggccccaggacgc

SEQ ID NO: 614356 - RNA, 20 nt, Human
uacgggggccccaggacgcu

SEQ ID NO: 614357 - RNA, 27 nt, Human
uacguacacacuauaguuguauaugca

SEQ ID NO: 614358 - RNA, 18 nt, Human
uagcaaguaccuucuuuc

SEQ ID NO: 614359 - RNA, 21 nt, Human
uagcaaguaccuucuuucuuu

SEQ ID NO: 614360 - RNA, 27 nt, Human
uauacguacacacuauaguuguauaug

SEQ ID NO: 614361 - RNA, 19 nt, Human
uauauguauaugugguaua

SEQ ID NO: 614362 - RNA, 26 nt, Human
uaugcagagaaaaaaagaaaaacacu

SEQ ID NO: 614363 - RNA, 24 nt, Human
ucacugcaaccucugccucccggg

SEQ ID NO: 614364 - RNA, 25 nt, Human
ucacugcaaccucugccucccgggu

SEQ ID NO: 614365 - RNA, 25 nt, Human
ucagaaucucccuaucucccucguu

SEQ ID NO: 614366 - RNA, 23 nt, Human
ucagccucccgaguagcugggac

SEQ ID NO: 614367 - RNA, 22 nt, Human
uccaaaaauccaguugcaugga

SEQ ID NO: 614368 - RNA, 21 nt, Human
uccacccgccucagccuccca

SEQ ID NO: 614369 - RNA, 24 nt, Human
ucccaaagugcugggauuacaggc

SEQ ID NO: 614370 - RNA, 21 nt, Human
uccccuucccgauuugcuauu

SEQ ID NO: 614371 - RNA, 24 nt, Human
ucccgaguagcugggacuacaggc

SEQ ID NO: 614372 - RNA, 19 nt, Human
ucccggcgccucccagcac

SEQ ID NO: 614373 - RNA, 20 nt, Human
ucccggguucaagcgauucu

SEQ ID NO: 614374 - RNA, 25 nt, Human
ucccggguucaagcgauucuuccug

SEQ ID NO: 614375 - RNA, 21 nt, Human
uccugccucagccucccgagu

SEQ ID NO: 614376 - RNA, 24 nt, Human
ucuguugcccaggcuggagugcag

SEQ ID NO: 614377 - RNA, 23 nt, Human
ugaaauacguuaguaucuucuuu

SEQ ID NO: 614378 - RNA, 18 nt, Human
ugacaugaaaauuaagca

SEQ ID NO: 614379 - RNA, 19 nt, Human
ugaccgcagggccagagac

SEQ ID NO: 614380 - RNA, 18 nt, Human
ugaccucuugauccaccc

SEQ ID NO: 614381 - RNA, 25 nt, Human
ugaggacacugcaggaagacagcug

SEQ ID NO: 614382 - RNA, 23 nt, Human
ugauccacccgccucagccuccc

SEQ ID NO: 614383 - RNA, 22 nt, Human
ugcaguggcgcggucucggcuc

SEQ ID NO: 614384 - RNA, 18 nt, Human
ugcccaggcuggagugca

SEQ ID NO: 614385 - RNA, 21 nt, Human
ugcccaggcuggagugcagug

SEQ ID NO: 614386 - RNA, 22 nt, Human
ugcccaggcuggagugcagugg

SEQ ID NO: 614387 - RNA, 24 nt, Human
ugcccaggcuggagugcaguggcg

SEQ ID NO: 614388 - RNA, 24 nt, Human
ugccucagccucccgaguagcugg

SEQ ID NO: 614389 - RNA, 19 nt, Human
ugcucuaaacacugcugcc

SEQ ID NO: 614390 - RNA, 24 nt, Human
ugcugggauuacaggcgugagcca

SEQ ID NO: 614391 - RNA, 20 nt, Human
uggagugcaguggcgcgguc

SEQ ID NO: 614392 - RNA, 23 nt, Human
uggagugcaguggcgcggucucg

SEQ ID NO: 614393 - RNA, 24 nt, Human
uggagugcaguggcgcggucucgg

SEQ ID NO: 614394 - RNA, 24 nt, Human
uggaguuuugcucuguugcccagg

SEQ ID NO: 614395 - RNA, 24 nt, Human
uggccaguguggugugcuucacag

SEQ ID NO: 614396 - RNA, 20 nt, Human
uggcgcggucucggcucacu

SEQ ID NO: 614397 - RNA, 19 nt, Human
ugggaaggagcugcagccu

SEQ ID NO: 614398 - RNA, 21 nt, Human
ugggacuacaggcgcgugcca

SEQ ID NO: 614399 - RNA, 22 nt, Human
ugggacuacaggcgcgugccac

SEQ ID NO: 614400 - RNA, 24 nt, Human
ugggacuacaggcgcgugccacca

SEQ ID NO: 614401 - RNA, 22 nt, Human
ugggagguggggccuuugggag

SEQ ID NO: 614402 - RNA, 18 nt, Human
ugggauuacaggcgugag

SEQ ID NO: 614403 - RNA, 21 nt, Human
ugggauuacaggcgugagcca

SEQ ID NO: 614404 - RNA, 22 nt, Human
ugggauuacaggcgugagccac

SEQ ID NO: 614405 - RNA, 23 nt, Human
ugggauuacaggcgugagccacc

SEQ ID NO: 614406 - RNA, 23 nt, Human
ugggauuacaggcgugagccacc

SEQ ID NO: 614407 - RNA, 24 nt, Human
ugggauuacaggcgugagccaccg

SEQ ID NO: 614408 - RNA, 19 nt, Human
uggguccuuuugucccucc

SEQ ID NO: 614409 - RNA, 21 nt, Human
ugguauugggagguggggccu

SEQ ID NO: 614410 - RNA, 21 nt, Human
ugugaauuuguguuaucauau

SEQ ID NO: 614411 - RNA, 18 nt, Human
ugugggaaggagcugcag

SEQ ID NO: 614412 - RNA, 23 nt, Human
uuacucaggcuguaauaguggga

SEQ ID NO: 614413 - RNA, 20 nt, Human
uuacuucugaauugcugccu

SEQ ID NO: 614414 - RNA, 24 nt, Human
uuacuucugaauugcugccuucuu

SEQ ID NO: 614415 - RNA, 22 nt, Human
uucaagcgauucuuccugccuc

SEQ ID NO: 614416 - RNA, 24 nt, Human
uucaagcgauucuuccugccucag

SEQ ID NO: 614417 - RNA, 25 nt, Human
uuccagacagcccuugguaaccugc

SEQ ID NO: 614418 - RNA, 21 nt, Human
uucuuccugccucagccuccc

SEQ ID NO: 614419 - RNA, 24 nt, Human
uugcccaggcuggagugcaguggc

SEQ ID NO: 614420 - RNA, 20 nt, Human
uugcucuguugcccaggcug

SEQ ID NO: 614421 - RNA, 22 nt, Human
uugcucuguugcccaggcugga

SEQ ID NO: 614422 - RNA, 24 nt, Human
uugcucuguugcccaggcuggagu

SEQ ID NO: 614423 - RNA, 19 nt, Human
uugcugccuucuuucauau

SEQ ID NO: 614424 - RNA, 23 nt, Human
uuuaagaaauuuuuccucaagac

SEQ ID NO: 614425 - RNA, 20 nt, Human
uuucccagggaaaaccaucu

SEQ ID NO: 614426 - RNA, 24 nt, Human
uuuugcucuguugcccaggcugga

SEQ ID NO: 614427 - RNA, 21 nt, Human
uuuuuguauuuuuauuagaga

SEQ ID NO: 614428 - RNA, 19 nt, Human
aaaaaacagcaggaacaac

SEQ ID NO: 614429 - RNA, 27 nt, Human
aaaaaacagcaggaacaaccgguaccc

SEQ ID NO: 614430 - RNA, 21 nt, Human
aaaaagcagcuuacacagaug

SEQ ID NO: 614431 - RNA, 18 nt, Human
aagaguauauugcuggug

SEQ ID NO: 614432 - RNA, 22 nt, Human
aagcaaaauggaaaacggccuu

SEQ ID NO: 614433 - RNA, 21 nt, Human
aagcagcuuacacagaugugu

SEQ ID NO: 614434 - RNA, 18 nt, Human
acaagucagagcauccaa

SEQ ID NO: 614435 - RNA, 20 nt, Human
acagagaagaacaaaacaaa

SEQ ID NO: 614436 - RNA, 23 nt, Human
acggccuucagauaaacacacua

SEQ ID NO: 614437 - RNA, 25 nt, Human
agaugucaaauaccgcauuuaaacc

SEQ ID NO: 614438 - RNA, 18 nt, Human
aggucaacagcauacaga

SEQ ID NO: 614439 - RNA, 18 nt, Human
auuacauuugaguugucu

SEQ ID NO: 614440 - RNA, 24 nt, Human
auuuuuucucuuuuucuguuuaau

SEQ ID NO: 614441 - RNA, 25 nt, Human
caaaauggaaaacggccuucagaua

SEQ ID NO: 614442 - RNA, 22 nt, Human
cacacuaaaaagcagcuuacac

SEQ ID NO: 614443 - RNA, 20 nt, Human
cacuaaaaagcagcuuacac

SEQ ID NO: 614444 - RNA, 19 nt, Human
cagagaagaacaaaacaaa

SEQ ID NO: 614445 - RNA, 22 nt, Human
cagcaggaacaacucaauucuu

SEQ ID NO: 614446 - RNA, 19 nt, Human
ccaaauguaagcucaauuc

SEQ ID NO: 614447 - RNA, 23 nt, Human
ccucauucgauuauuugcccuau

SEQ ID NO: 614448 - RNA, 18 nt, Human
ccuuacaaaguucacagu

SEQ ID NO: 614449 - RNA, 21 nt, Human
cgacaaggcucagaucccaaa

SEQ ID NO: 614450 - RNA, 23 nt, Human
cucaaacucaaaacaugaaggaa

SEQ ID NO: 614451 - RNA, 21 nt, Human
gagcauccaaaaacugcaaga

SEQ ID NO: 614452 - RNA, 25 nt, Human
gaggcugccugcucuugccuaaagc

SEQ ID NO: 614453 - RNA, 24 nt, Human
gcucaagauaauuuuuucucuuuu

SEQ ID NO: 614454 - RNA, 22 nt, Human
gcugccugcucuugccuaaagc

SEQ ID NO: 614455 - RNA, 21 nt, Human
guuguuuuaaaaaaaagagau

SEQ ID NO: 614456 - RNA, 23 nt, Human
uaaaaaacagcaggaacaacuca

SEQ ID NO: 614457 - RNA, 18 nt, Human
uaaaaagcagcuuacaca

SEQ ID NO: 614458 - RNA, 20 nt, Human
uaaaauaacaugucuaagac

SEQ ID NO: 614459 - RNA, 22 nt, Human
uaaaauaacaugucuaagacuu

SEQ ID NO: 614460 - RNA, 23 nt, Human
uaaacccagcacagugaucccuu

SEQ ID NO: 614461 - RNA, 18 nt, Human
uaacaaaaauaaagaugu

SEQ ID NO: 614462 - RNA, 25 nt, Human
uaacaaaaauaaagaugugaggcug

SEQ ID NO: 614463 - RNA, 25 nt, Human
uacauuaagcaaaauggaaaacggc

SEQ ID NO: 614464 - RNA, 29 nt, Human
uacauuaagcaaaauggaaaacggccaac

SEQ ID NO: 614465 - RNA, 21 nt, Human
uagaaaauuuugcauuuucug

SEQ ID NO: 614466 - RNA, 21 nt, Human
uaugccucaugcacacacaca

SEQ ID NO: 614467 - RNA, 22 nt, Human
ucaaaacaugaaggaaacagga

SEQ ID NO: 614468 - RNA, 28 nt, Human
ucaccuuggauguaacaaaaauaaagau

SEQ ID NO: 614469 - RNA, 19 nt, Human
ucagauaaacacacuaaaa

SEQ ID NO: 614470 - RNA, 18 nt, Human
uccccgaauguggcucca

SEQ ID NO: 614471 - RNA, 24 nt, Human
ugaaaaaauacaauuucaaugaaa

SEQ ID NO: 614472 - RNA, 26 nt, Human
ugcccuauucaaaacauaaaaauaca

SEQ ID NO: 614473 - RNA, 23 nt, Human
ugccuaucaccaagaugucaaau

SEQ ID NO: 614474 - RNA, 24 nt, Human
ugcucuugccuaaagcauggcuug

SEQ ID NO: 614475 - RNA, 22 nt, Human
uggaucaaauaaaaaacagcag

SEQ ID NO: 614476 - RNA, 20 nt, Human
uggugcuauaaucuuuuugc

SEQ ID NO: 614477 - RNA, 19 nt, Human
ugugaggcugccugcucuu

SEQ ID NO: 614478 - RNA, 21 nt, Human
uuggaucaaauaaaaaacagc

SEQ ID NO: 614479 - RNA, 22 nt, Human
uuucaauugauaguaaccgcuu

SEQ ID NO: 614480 - RNA, 18 nt, Human
uuuuugcaugucuuuguu

SEQ ID NO: 614481 - RNA, 22 nt, Human
acacuggguuccgucacccugg

SEQ ID NO: 614482 - RNA, 24 nt, Human
agaauuccaggucugacucccagc

SEQ ID NO: 614483 - RNA, 18 nt, Human
agauggcuacggggaggc

SEQ ID NO: 614484 - RNA, 22 nt, Human
agccgaggagcccagcaccagg

SEQ ID NO: 614485 - RNA, 20 nt, Human
agccuuggucacagcuuuca

SEQ ID NO: 614486 - RNA, 19 nt, Human
agcuugccagagacuccaa

SEQ ID NO: 614487 - RNA, 20 nt, Human
aggcauucgggaauccucag

SEQ ID NO: 614488 - RNA, 20 nt, Human
auccguguugcugcuguggc

SEQ ID NO: 614489 - RNA, 25 nt, Human
aucuuccuuaacaccugauucacug

SEQ ID NO: 614490 - RNA, 19 nt, Human
auggcccccaguuccccag

SEQ ID NO: 614491 - RNA, 18 nt, Human
cacccuggagauggcuac

SEQ ID NO: 614492 - RNA, 19 nt, Human
cagguaauacacuggguuc

SEQ ID NO: 614493 - RNA, 25 nt, Human
caguuccccagaggggccagccuug

SEQ ID NO: 614494 - RNA, 22 nt, Human
ccaaaguaauaaagaguuugga

SEQ ID NO: 614495 - RNA, 21 nt, Human
cccagacaauucagcaaucac

SEQ ID NO: 614496 - RNA, 21 nt, Human
cccccaguuccccagaggggc

SEQ ID NO: 614497 - RNA, 21 nt, Human
ccccgccgccagccgaggagc

SEQ ID NO: 614498 - RNA, 18 nt, Human
cgagaagagcgcuggugg

SEQ ID NO: 614499 - RNA, 18 nt, Human
cucccccuccucuucguc

SEQ ID NO: 614500 - RNA, 19 nt, Human
cugagcgccuggcugcggu

SEQ ID NO: 614501 - RNA, 19 nt, Human
gagguaggcauucgggaau

SEQ ID NO: 614502 - RNA, 20 nt, Human
gcaucuuccuuaacaccuga

SEQ ID NO: 614503 - RNA, 25 nt, Human
gcccagcaccaggcuggaggggaac

SEQ ID NO: 614504 - RNA, 24 nt, Human
gcuggaggggaacgagcugguggg

SEQ ID NO: 614505 - RNA, 21 nt, Human
ggcuggaggggaacgagcucc

SEQ ID NO: 614506 - RNA, 20 nt, Human
gggaggcugccugauaagcc

SEQ ID NO: 614507 - RNA, 25 nt, Human
gguuccagcagguaauacacugggu

SEQ ID NO: 614508 - RNA, 22 nt, Human
uaauuggagaaaccauuggggu

SEQ ID NO: 614509 - RNA, 18 nt, Human
ucagaacuccauguugac

SEQ ID NO: 614510 - RNA, 20 nt, Human
ucagacucucaaagacgcca

SEQ ID NO: 614511 - RNA, 18 nt, Human
ucauccacacucgccucg

SEQ ID NO: 614512 - RNA, 23 nt, Human
uccaaaccugcccagacaauuca

SEQ ID NO: 614513 - RNA, 24 nt, Human
ucccaaggaccgcuggcucugcag

SEQ ID NO: 614514 - RNA, 19 nt, Human
uccccagaggggccagccu

SEQ ID NO: 614515 - RNA, 19 nt, Human
uccuuaacaccugauucac

SEQ ID NO: 614516 - RNA, 18 nt, Human
ugcacagucaggggagcu

SEQ ID NO: 614517 - RNA, 25 nt, Human
ugccagagacuccaaaccugcccag

SEQ ID NO: 614518 - RNA, 19 nt, Human
uggggaggcugccucugcc

SEQ ID NO: 614519 - RNA, 24 nt, Human
ugguggggaggcugccugauaagc

SEQ ID NO: 614520 - RNA, 22 nt, Human
uguugcugcuguggcgucucug

SEQ ID NO: 614521 - RNA, 20 nt, Human
uguuuuauuguuuugguggc

SEQ ID NO: 614522 - RNA, 21 nt, Human
uucaauggcccccaguucccc

SEQ ID NO: 614523 - RNA, 20 nt, Human
aaaggcacacuggcaccaca

SEQ ID NO: 614524 - RNA, 19 nt, Human
aagaacucaggcaaaggca

SEQ ID NO: 614525 - RNA, 22 nt, Human
aagcgacaccccaaagaucuug

SEQ ID NO: 614526 - RNA, 18 nt, Human
aauggcaccugauuucug

SEQ ID NO: 614527 - RNA, 22 nt, Human
accagaaaagcgacaccccaaa

SEQ ID NO: 614528 - RNA, 24 nt, Human
aggacaagaacucaggcaaaggca

SEQ ID NO: 614529 - RNA, 18 nt, Human
aggcuacaccacgggcuc

SEQ ID NO: 614530 - RNA, 24 nt, Human
auaguccaguguuucaaaggaugg

SEQ ID NO: 614531 - RNA, 18 nt, Human
caaugugggaccugggga

SEQ ID NO: 614532 - RNA, 22 nt, Human
caccacagacauuuccgaccag

SEQ ID NO: 614533 - RNA, 21 nt, Human
caccccauguaacaauggcac

SEQ ID NO: 614534 - RNA, 21 nt, Human
cacuggcaccacagacauuuc

SEQ ID NO: 614535 - RNA, 24 nt, Human
cacuguggccuccucuguccuccc

SEQ ID NO: 614536 - RNA, 21 nt, Human
ccagaaaagcgacaccccaaa

SEQ ID NO: 614537 - RNA, 19 nt, Human
ccuccucuguccucccggg

SEQ ID NO: 614538 - RNA, 19 nt, Human
ccugcagcguucagugggc

SEQ ID NO: 614539 - RNA, 22 nt, Human
cgaccagaaaagcgacacccca

SEQ ID NO: 614540 - RNA, 23 nt, Human
cgaccagaaaagcgacaccccaa

SEQ ID NO: 614541 - RNA, 22 nt, Human
cguucagugggcuuacgcaccu

SEQ ID NO: 614542 - RNA, 24 nt, Human
cucccgggcacugacaucccccaa

SEQ ID NO: 614543 - RNA, 18 nt, Human
cugcagcguucagugggc

SEQ ID NO: 614544 - RNA, 23 nt, Human
cuuguaacaaugugggaccuggg

SEQ ID NO: 614545 - RNA, 21 nt, Human
gggagccuggaaacccaucuu

SEQ ID NO: 614546 - RNA, 23 nt, Human
uaacaauggcaccugauuucugu

SEQ ID NO: 614547 - RNA, 22 nt, Human
uaucucauucuuucuggacgca

SEQ ID NO: 614548 - RNA, 19 nt, Human
ucaccccauguaacaaugg

SEQ ID NO: 614549 - RNA, 27 nt, Human
ucacuguggccuccucuguccucccgg

SEQ ID NO: 614550 - RNA, 21 nt, Human
ucaucacuguggccuccucug

SEQ ID NO: 614551 - RNA, 21 nt, Human
uccgaccagaaaagcgacacc

SEQ ID NO: 614552 - RNA, 29 nt, Human
ucucugguuauuucuguauaucuuugacu

SEQ ID NO: 614553 - RNA, 21 nt, Human
ucuuguaacaaugugggaccu

SEQ ID NO: 614554 - RNA, 21 nt, Human
ugagaccauuuauuucuuccc

SEQ ID NO: 614555 - RNA, 19 nt, Human
ugccucaaacuuuucucug

SEQ ID NO: 614556 - RNA, 23 nt, Human
ugccucaaacuuuucucugguua

SEQ ID NO: 614557 - RNA, 24 nt, Human
uggcaccacagacauuuccgacca

SEQ ID NO: 614558 - RNA, 21 nt, Human
uuaaauguccucuucgucccc

SEQ ID NO: 614559 - RNA, 22 nt, Human
uucaaaggauggcaaagaagau

SEQ ID NO: 614560 - RNA, 23 nt, Human
uucaaaggauggcaaagaagauc

SEQ ID NO: 614561 - RNA, 21 nt, Human
uucucugguuauuucuguaua

SEQ ID NO: 614562 - RNA, 22 nt, Human
uuguguccgcuguggugcagga

SEQ ID NO: 614563 - RNA, 18 nt, Human
uuuggucgaggccucagc

SEQ ID NO: 614564 - RNA, 20 nt, Human
aaaagaucuacacguaagga

SEQ ID NO: 614565 - RNA, 24 nt, Human
aaaauguugggauuacagguguga

SEQ ID NO: 614566 - RNA, 19 nt, Human
aaauguugaauguuacucc

SEQ ID NO: 614567 - RNA, 26 nt, Human
aaauguugggauuacaggugugagcc

SEQ ID NO: 614568 - RNA, 21 nt, Human
aagaauuuucuuaacucagcu

SEQ ID NO: 614569 - RNA, 18 nt, Human
aagauuuucuggacaaca

SEQ ID NO: 614570 - RNA, 22 nt, Human
accacagucuuucuuucucugc

SEQ ID NO: 614571 - RNA, 24 nt, Human
acuccagcuggagugcaguggcgu

SEQ ID NO: 614572 - RNA, 21 nt, Human
acuuggccaacucuucgucac

SEQ ID NO: 614573 - RNA, 27 nt, Human
agacauauacacucaauccaaggcaug

SEQ ID NO: 614574 - RNA, 19 nt, Human
agacggugcaccuagcaug

SEQ ID NO: 614575 - RNA, 18 nt, Human
agccccguggaagaagcc

SEQ ID NO: 614576 - RNA, 24 nt, Human
agcgauucuccugccucagccucc

SEQ ID NO: 614577 - RNA, 19 nt, Human
aggaagacggugcaccuag

SEQ ID NO: 614578 - RNA, 20 nt, Human
aggcacgcaccaccacgccc

SEQ ID NO: 614579 - RNA, 24 nt, Human
agguagcuggaacuacaggcacgc

SEQ ID NO: 614580 - RNA, 23 nt, Human
agugcaguggcgugaucuuggcu

SEQ ID NO: 614581 - RNA, 24 nt, Human
agugcaguggcgugaucuuggcuc

SEQ ID NO: 614582 - RNA, 21 nt, Human
auccaccuaucaggauacacg

SEQ ID NO: 614583 - RNA, 18 nt, Human
augagguuucaccauguu

SEQ ID NO: 614584 - RNA, 20 nt, Human
augagguuucaccauguugg

SEQ ID NO: 614585 - RNA, 24 nt, Human
augagguuucaccauguuggccag

SEQ ID NO: 614586 - RNA, 24 nt, Human
augauccacccuucucggccuccc

SEQ ID NO: 614587 - RNA, 19 nt, Human
caaaaaccacuccacggca

SEQ ID NO: 614588 - RNA, 24 nt, Human
caaaauguugggauuacaggugug

SEQ ID NO: 614589 - RNA, 18 nt, Human
caaaggcuggagagcucc

SEQ ID NO: 614590 - RNA, 22 nt, Human
caagcgauucuccugccucagc

SEQ ID NO: 614591 - RNA, 27 nt, Human
caagcgauucuccugccucagccuccc

SEQ ID NO: 614592 - RNA, 19 nt, Human
cacauuaacuauugugaua

SEQ ID NO: 614593 - RNA, 22 nt, Human
caccaccacgcccagcuaauuu

SEQ ID NO: 614594 - RNA, 24 nt, Human
caccacgcccagcuaauuuuugua

SEQ ID NO: 614595 - RNA, 18 nt, Human
caccauguuggccaggau

SEQ ID NO: 614596 - RNA, 22 nt, Human
caccauguuggccaggaugguc

SEQ ID NO: 614597 - RNA, 24 nt, Human
caccauguuggccaggauggucuc

SEQ ID NO: 614598 - RNA, 22 nt, Human
caccuagcauggggccgugggg

SEQ ID NO: 614599 - RNA, 24 nt, Human
cacuccagcuggagugcaguggcg

SEQ ID NO: 614600 - RNA, 23 nt, Human
cacuuggccaacucuucgucacc

SEQ ID NO: 614601 - RNA, 22 nt, Human
caggauggucuccaucuccuga

SEQ ID NO: 614602 - RNA, 21 nt, Human
caggcacgcaccaccacgccc

SEQ ID NO: 614603 - RNA, 18 nt, Human
cagugucgagacuuacac

SEQ ID NO: 614604 - RNA, 21 nt, Human
cauccccucccuuuagccuga

SEQ ID NO: 614605 - RNA, 21 nt, Human
ccaaaauguugggauuacagg

SEQ ID NO: 614606 - RNA, 21 nt, Human
ccaaaauguugggauuacagg

SEQ ID NO: 614607 - RNA, 24 nt, Human
ccaaaauguugggauuacaggugu

SEQ ID NO: 614608 - RNA, 21 nt, Human
ccaaagccccuguccacgagc

SEQ ID NO: 614609 - RNA, 23 nt, Human
ccacccuucucggccucccaaaa

SEQ ID NO: 614610 - RNA, 22 nt, Human
ccagccccagagccuugaacuc

SEQ ID NO: 614611 - RNA, 21 nt, Human
ccagggaaggcaaacaugaua

SEQ ID NO: 614612 - RNA, 24 nt, Human
ccauuugaaaaaaaaaaaaagauc

SEQ ID NO: 614613 - RNA, 23 nt, Human
cccaacauccccucccuuuagcc

SEQ ID NO: 614614 - RNA, 20 nt, Human
cccagauggugaaacagggu

SEQ ID NO: 614615 - RNA, 22 nt, Human
cccaguccccggccuccucagc

SEQ ID NO: 614616 - RNA, 21 nt, Human
cccagugcuaagcgugccuuc

SEQ ID NO: 614617 - RNA, 23 nt, Human
cccuagagaaacacagaggugcc

SEQ ID NO: 614618 - RNA, 19 nt, Human
ccuagcacugugcacaugu

SEQ ID NO: 614619 - RNA, 21 nt, Human
ccucaugauccacccuucucg

SEQ ID NO: 614620 - RNA, 24 nt, Human
ccucccagguagcuggaacuacag

SEQ ID NO: 614621 - RNA, 21 nt, Human
ccucccguccuagcacugugc

SEQ ID NO: 614622 - RNA, 27 nt, Human
ccucuaauuaugacauauuucuucauc

SEQ ID NO: 614623 - RNA, 20 nt, Human
ccucucaucuuaaccuuuuc

SEQ ID NO: 614624 - RNA, 19 nt, Human
ccugguucaagcgauucuc

SEQ ID NO: 614625 - RNA, 18 nt, Human
ccuguuccuaauccaccu

SEQ ID NO: 614626 - RNA, 21 nt, Human
ccuucucauuucacgcggggg

SEQ ID NO: 614627 - RNA, 19 nt, Human
cgggggcugcucugguguc

SEQ ID NO: 614628 - RNA, 22 nt, Human
cucacuacaaguuccgacugcc

SEQ ID NO: 614629 - RNA, 20 nt, Human
cuccucagcacagcuguggc

SEQ ID NO: 614630 - RNA, 18 nt, Human
cuccugaccucaugaucc

SEQ ID NO: 614631 - RNA, 20 nt, Human
cuccugccucagccucccag

SEQ ID NO: 614632 - RNA, 23 nt, Human
cugccucagccucccagguagcu

SEQ ID NO: 614633 - RNA, 23 nt, Human
cugccugguucaagcgauucucc

SEQ ID NO: 614634 - RNA, 21 nt, Human
cugcucuggugucaagccccg

SEQ ID NO: 614635 - RNA, 21 nt, Human
cuggaagcccccucucaucuu

SEQ ID NO: 614636 - RNA, 22 nt, Human
cuggagagcuccaaguaaaaga

SEQ ID NO: 614637 - RNA, 27 nt, Human
cugguuuccugacuuuuuuucuaucug

SEQ ID NO: 614638 - RNA, 20 nt, Human
cuuccaaaggucccaauucc

SEQ ID NO: 614639 - RNA, 21 nt, Human
gaagacauauacacucaaucc

SEQ ID NO: 614640 - RNA, 18 nt, Human
gaagaggaagaaaaaagg

SEQ ID NO: 614641 - RNA, 23 nt, Human
gaagcccccucucaucuuaaccu

SEQ ID NO: 614642 - RNA, 22 nt, Human
gaccucaugauccacccuucuc

SEQ ID NO: 614643 - RNA, 24 nt, Human
gagccuugaacucuggccugcauc

SEQ ID NO: 614644 - RNA, 21 nt, Human
gaggaagacggugcaccuagc

SEQ ID NO: 614645 - RNA, 22 nt, Human
gagguuucaccauguuggccag

SEQ ID NO: 614646 - RNA, 18 nt, Human
gauuacaggugugagcca

SEQ ID NO: 614647 - RNA, 22 nt, Human
gauuacaggugugagccacugc

SEQ ID NO: 614648 - RNA, 23 nt, Human
gauuacaggugugagccacugca

SEQ ID NO: 614649 - RNA, 20 nt, Human
gauucccaguccccggccuc

SEQ ID NO: 614650 - RNA, 20 nt, Human
gcaccaccacgcccagcuaa

SEQ ID NO: 614651 - RNA, 22 nt, Human
gcccagcuaauuuuuguauuuu

SEQ ID NO: 614652 - RNA, 22 nt, Human
gcccccucucaucuuaaccuuu

SEQ ID NO: 614653 - RNA, 18 nt, Human
gccguggggggucagggg

SEQ ID NO: 614654 - RNA, 24 nt, Human
gcgauucuccugccucagccuccc

SEQ ID NO: 614655 - RNA, 20 nt, Human
gcucugucacuccagcugga

SEQ ID NO: 614656 - RNA, 19 nt, Human
gcuggagugcaguggcgug

SEQ ID NO: 614657 - RNA, 19 nt, Human
ggaaggcaaacaugauaaa

SEQ ID NO: 614658 - RNA, 24 nt, Human
ggauggucuccaucuccugaccuc

SEQ ID NO: 614659 - RNA, 23 nt, Human
gggcugguggaccugcucugagc

SEQ ID NO: 614660 - RNA, 22 nt, Human
guuucuccucccaacauccccu

SEQ ID NO: 614661 - RNA, 18 nt, Human
uaaaaagucaaauggagg

SEQ ID NO: 614662 - RNA, 23 nt, Human
uaaaaagucaaauggaggaagac

SEQ ID NO: 614663 - RNA, 25 nt, Human
uaaaaagucaaauggaggaagacgg

SEQ ID NO: 614664 - RNA, 28 nt, Human
uaaaguagcagcacaggcaguaggaacc

SEQ ID NO: 614665 - RNA, 24 nt, Human
uaauuuuuguauuuuuaguagaga

SEQ ID NO: 614666 - RNA, 22 nt, Human
uacaggugugagccacugcacc

SEQ ID NO: 614667 - RNA, 22 nt, Human
uacaggugugagccacugcacc

SEQ ID NO: 614668 - RNA, 23 nt, Human
uacaggugugagccacugcaccu

SEQ ID NO: 614669 - RNA, 22 nt, Human
uagagaugagguuucaccaugu

SEQ ID NO: 614670 - RNA, 24 nt, Human
uaguagagaugagguuucaccaug

SEQ ID NO: 614671 - RNA, 25 nt, Human
uaguagagaugagguuucaccaugu

SEQ ID NO: 614672 - RNA, 23 nt, Human
ucaagaccuaauaaccuuccaaa

SEQ ID NO: 614673 - RNA, 19 nt, Human
ucaagcgauucuccugccu

SEQ ID NO: 614674 - RNA, 22 nt, Human
ucaaggaaaauaaaugauugcc

SEQ ID NO: 614675 - RNA, 24 nt, Human
ucaccauguuggccaggauggucu

SEQ ID NO: 614676 - RNA, 25 nt, Human
ucacuacaaguuccgacugccuggu

SEQ ID NO: 614677 - RNA, 20 nt, Human
ucacuuggccaacucuucgu

SEQ ID NO: 614678 - RNA, 19 nt, Human
ucaggauacacgauucaau

SEQ ID NO: 614679 - RNA, 18 nt, Human
ucagugaucaugacacau

SEQ ID NO: 614680 - RNA, 22 nt, Human
ucauuuugaaaggcagagauug

SEQ ID NO: 614681 - RNA, 22 nt, Human
uccaaguuuuggaaccaaagcc

SEQ ID NO: 614682 - RNA, 21 nt, Human
uccacccuucucggccuccca

SEQ ID NO: 614683 - RNA, 22 nt, Human
uccacccuucucggccucccaa

SEQ ID NO: 614684 - RNA, 23 nt, Human
ucccaaaauguugggauuacagg

SEQ ID NO: 614685 - RNA, 21 nt, Human
ucccaacauccccucccuuua

SEQ ID NO: 614686 - RNA, 24 nt, Human
ucccagguagcuggaacuacaggc

SEQ ID NO: 614687 - RNA, 27 nt, Human
ucccuagagaaacacagaggugcccac

SEQ ID NO: 614688 - RNA, 19 nt, Human
uccugcuauaggugggcug

SEQ ID NO: 614689 - RNA, 20 nt, Human
uccugcuauaggugggcugg

SEQ ID NO: 614690 - RNA, 18 nt, Human
ucgucaccaagacaugcu

SEQ ID NO: 614691 - RNA, 26 nt, Human
ucuacacguaaggaagaggaagaaaa

SEQ ID NO: 614692 - RNA, 21 nt, Human
ucuccaucuccugaccucaug

SEQ ID NO: 614693 - RNA, 25 nt, Human
ucuccucccaacauccccucccuuu

SEQ ID NO: 614694 - RNA, 25 nt, Human
ucuccugccucagccucccagguag

SEQ ID NO: 614695 - RNA, 24 nt, Human
ucucugccucaguuucccuaucug

SEQ ID NO: 614696 - RNA, 24 nt, Human
ucugcagugucgagacuuacaccu

SEQ ID NO: 614697 - RNA, 27 nt, Human
ucuggaagcccccucucaucuuaaccu

SEQ ID NO: 614698 - RNA, 24 nt, Human
ucugucacuccagcuggagugcag

SEQ ID NO: 614699 - RNA, 19 nt, Human
ucuuucucugcuguuuugc

SEQ ID NO: 614700 - RNA, 21 nt, Human
ucuuucuuucucugcuguuuu

SEQ ID NO: 614701 - RNA, 23 nt, Human
ugaaaggcagagaugcugacuug

SEQ ID NO: 614702 - RNA, 24 nt, Human
ugagguuucaccauguuggccagg

SEQ ID NO: 614703 - RNA, 24 nt, Human
ugauaaagaauuuucuuaacucag

SEQ ID NO: 614704 - RNA, 22 nt, Human
ugcaguggcgugaucuuggcuc

SEQ ID NO: 614705 - RNA, 24 nt, Human
ugccucagccucccagguagcugg

SEQ ID NO: 614706 - RNA, 21 nt, Human
ugccucaguuucccuaucugg

SEQ ID NO: 614707 - RNA, 24 nt, Human
ugccugguucaagcgauucuccug

SEQ ID NO: 614708 - RNA, 25 nt, Human
uggaacaacccucgcccugguuuau

SEQ ID NO: 614709 - RNA, 21 nt, Human
uggaacuacaggcacgcacca

SEQ ID NO: 614710 - RNA, 24 nt, Human
uggaacuacaggcacgcaccacca

SEQ ID NO: 614711 - RNA, 25 nt, Human
uggaagaagccucuugugaggccag

SEQ ID NO: 614712 - RNA, 24 nt, Human
uggaggaagacggugcaccuagca

SEQ ID NO: 614713 - RNA, 19 nt, Human
uggagugcaguggcgugau

SEQ ID NO: 614714 - RNA, 23 nt, Human
uggagugcaguggcgugaucuug

SEQ ID NO: 614715 - RNA, 24 nt, Human
uggagugcaguggcgugaucuugg

SEQ ID NO: 614716 - RNA, 19 nt, Human
uggaugaccacaaggaaaa

SEQ ID NO: 614717 - RNA, 22 nt, Human
uggcaaaaaccacuccacggca

SEQ ID NO: 614718 - RNA, 24 nt, Human
uggccaggauggucuccaucuccu

SEQ ID NO: 614719 - RNA, 24 nt, Human
uggcgugaucuuggcucacuacaa

SEQ ID NO: 614720 - RNA, 19 nt, Human
uggcucacuacaaguuccg

SEQ ID NO: 614721 - RNA, 18 nt, Human
ugggauuacaggugugag

SEQ ID NO: 614722 - RNA, 19 nt, Human
ugggauuacaggugugagc

SEQ ID NO: 614723 - RNA, 21 nt, Human
ugggauuacaggugugagcca

SEQ ID NO: 614724 - RNA, 22 nt, Human
ugggauuacaggugugagccac

SEQ ID NO: 614725 - RNA, 22 nt, Human
ugggauuacaggugugagccac

SEQ ID NO: 614726 - RNA, 24 nt, Human
ugggauuacaggugugagccacug

SEQ ID NO: 614727 - RNA, 22 nt, Human
ugggcugguggaccugcucuga

SEQ ID NO: 614728 - RNA, 19 nt, Human
ugguaugggguuucgggcu

SEQ ID NO: 614729 - RNA, 23 nt, Human
ugguucaagcgauucuccugccu

SEQ ID NO: 614730 - RNA, 19 nt, Human
uguaauugaucaccuccug

SEQ ID NO: 614731 - RNA, 24 nt, Human
ugucguuuagccaaaaguuaaagu

SEQ ID NO: 614732 - RNA, 18 nt, Human
uuaguagagaugagguuu

SEQ ID NO: 614733 - RNA, 22 nt, Human
uuaguagagaugagguuucacc

SEQ ID NO: 614734 - RNA, 24 nt, Human
uuaguagagaugagguuucaccau

SEQ ID NO: 614735 - RNA, 21 nt, Human
uucaagcgauucuccugccuc

SEQ ID NO: 614736 - RNA, 23 nt, Human
uucaagcgauucuccugccucag

SEQ ID NO: 614737 - RNA, 24 nt, Human
uucaagcgauucuccugccucagc

SEQ ID NO: 614738 - RNA, 22 nt, Human
uucccaguccccggccuccuca

SEQ ID NO: 614739 - RNA, 19 nt, Human
uuccugcuauaggugggcu

SEQ ID NO: 614740 - RNA, 20 nt, Human
uucgugagggcucugcccuc

SEQ ID NO: 614741 - RNA, 22 nt, Human
uucuccugccucagccucccag

SEQ ID NO: 614742 - RNA, 21 nt, Human
uucucggccucccaaaauguu

SEQ ID NO: 614743 - RNA, 22 nt, Human
uucucugcuguuuugcccaagc

SEQ ID NO: 614744 - RNA, 23 nt, Human
uuggcucugucacuccagcugga

SEQ ID NO: 614745 - RNA, 21 nt, Human
uugggauuacaggugugagcc

SEQ ID NO: 614746 - RNA, 19 nt, Human
uuucaccauguuggccagg

SEQ ID NO: 614747 - RNA, 20 nt, Human
uuucaccauguuggccagga

SEQ ID NO: 614748 - RNA, 24 nt, Human
uuuggcucugucacuccagcugga

SEQ ID NO: 614749 - RNA, 20 nt, Human
uuuuguauuuuuaguagaga

SEQ ID NO: 614750 - RNA, 24 nt, Human
uuuuuaguagagaugagguuucac

SEQ ID NO: 614751 - RNA, 20 nt, Human
uuuuuguauuuuuaguagag

SEQ ID NO: 614752 - RNA, 22 nt, Human
aaaaaaagaaaaaaaaacuuua

SEQ ID NO: 614753 - RNA, 18 nt, Human
aaaacaaagucuguuuuc

SEQ ID NO: 614754 - RNA, 23 nt, Human
aaaacugagacagaagggucuuu

SEQ ID NO: 614755 - RNA, 26 nt, Human
aaaagaaaaaaaaacuuuacucaaag

SEQ ID NO: 614756 - RNA, 20 nt, Human
aaaggaggacgaggaggagg

SEQ ID NO: 614757 - RNA, 24 nt, Human
aaagugcugggauuacaggcauga

SEQ ID NO: 614758 - RNA, 20 nt, Human
aagcuauggaccauccacga

SEQ ID NO: 614759 - RNA, 18 nt, Human
aagugcugggauuacagg

SEQ ID NO: 614760 - RNA, 19 nt, Human
aagugcugggauuacaggc

SEQ ID NO: 614761 - RNA, 21 nt, Human
aagugcugggauuacaggcau

SEQ ID NO: 614762 - RNA, 26 nt, Human
aagugcugggauuacaggcaugagcc

SEQ ID NO: 614763 - RNA, 19 nt, Human
aagugcugggauuacaggu

SEQ ID NO: 614764 - RNA, 22 nt, Human
aagugcugggauuacaggugug

SEQ ID NO: 614765 - RNA, 23 nt, Human
aagugcugggauuacagguguga

SEQ ID NO: 614766 - RNA, 26 nt, Human
aagugcugggauuacaggugugagcc

SEQ ID NO: 614767 - RNA, 23 nt, Human
aauaaaugauagaaacuauacac

SEQ ID NO: 614768 - RNA, 21 nt, Human
acaaagucucugaaacuggaa

SEQ ID NO: 614769 - RNA, 18 nt, Human
acacccauacuaggugcc

SEQ ID NO: 614770 - RNA, 26 nt, Human
acuggagcacagagacauggaaccua

SEQ ID NO: 614771 - RNA, 24 nt, Human
acuguguugcccaggcuggucuug

SEQ ID NO: 614772 - RNA, 25 nt, Human
acuguguugcccaggcuggucuuga

SEQ ID NO: 614773 - RNA, 21 nt, Human
acuucugcccccuuuuuuccc

SEQ ID NO: 614774 - RNA, 23 nt, Human
agacagaagggucuuucccaaaa

SEQ ID NO: 614775 - RNA, 20 nt, Human
agacagagcagcaccugaac

SEQ ID NO: 614776 - RNA, 18 nt, Human
agacauggaaccuagcua

SEQ ID NO: 614777 - RNA, 24 nt, Human
agcaaaacugagacagaagggucu

SEQ ID NO: 614778 - RNA, 24 nt, Human
agccacauuuacaaagcugcagcc

SEQ ID NO: 614779 - RNA, 23 nt, Human
aggcaugagccacugugccuggc

SEQ ID NO: 614780 - RNA, 22 nt, Human
aggcuguggcaaagggccccag

SEQ ID NO: 614781 - RNA, 18 nt, Human
aggcuucagaaccaggug

SEQ ID NO: 614782 - RNA, 18 nt, Human
aguucucccacaauccag

SEQ ID NO: 614783 - RNA, 24 nt, Human
auuacaggugugagccacagcacu

SEQ ID NO: 614784 - RNA, 24 nt, Human
caaagugcugggauuacaggcaug

SEQ ID NO: 614785 - RNA, 18 nt, Human
caacauaaaaauagccac

SEQ ID NO: 614786 - RNA, 24 nt, Human
cacaacagcuggcccagacagagc

SEQ ID NO: 614787 - RNA, 20 nt, Human
cacauuuaguucucccacaa

SEQ ID NO: 614788 - RNA, 24 nt, Human
cacccauacuaggugccuaaggac

SEQ ID NO: 614789 - RNA, 24 nt, Human
caccucugcuucccaaagugcugg

SEQ ID NO: 614790 - RNA, 22 nt, Human
caccugaacaaccugauggccc

SEQ ID NO: 614791 - RNA, 19 nt, Human
cacuguguugcccaggcug

SEQ ID NO: 614792 - RNA, 21 nt, Human
cacuguguugcccaggcuggu

SEQ ID NO: 614793 - RNA, 24 nt, Human
cacuguguugcccaggcuggucuu

SEQ ID NO: 614794 - RNA, 20 nt, Human
cagagcuuuuuucaaaccgg

SEQ ID NO: 614795 - RNA, 18 nt, Human
cagcagccacugcaguca

SEQ ID NO: 614796 - RNA, 18 nt, Human
cagcuccuccuggucugg

SEQ ID NO: 614797 - RNA, 22 nt, Human
caggagcuucugaacaugaagc

SEQ ID NO: 614798 - RNA, 24 nt, Human
caggcuguggcaaagggccccagu

SEQ ID NO: 614799 - RNA, 20 nt, Human
cauaaccacuucugcccccu

SEQ ID NO: 614800 - RNA, 24 nt, Human
caugcccgcguucagggcccaaaa

SEQ ID NO: 614801 - RNA, 23 nt, Human
ccaaagugcugggauuacaggca

SEQ ID NO: 614802 - RNA, 24 nt, Human
ccaaagugcugggauuacaggcau

SEQ ID NO: 614803 - RNA, 22 nt, Human
ccacaacaggggaaagaugaaa

SEQ ID NO: 614804 - RNA, 24 nt, Human
ccaggcuggucuugaacuccuggg

SEQ ID NO: 614805 - RNA, 18 nt, Human
ccaggugaaggcucggga

SEQ ID NO: 614806 - RNA, 22 nt, Human
ccauccacgagcugcugcaaga

SEQ ID NO: 614807 - RNA, 19 nt, Human
cccaaaaaucccuuuucuc

SEQ ID NO: 614808 - RNA, 24 nt, Human
cccaaagugcugggauuacaggca

SEQ ID NO: 614809 - RNA, 21 nt, Human
cccauacuaggugccuaagga

SEQ ID NO: 614810 - RNA, 24 nt, Human
cccgaagugcugggauuacaggug

SEQ ID NO: 614811 - RNA, 23 nt, Human
ccgaagugcugggauuacaggug

SEQ ID NO: 614812 - RNA, 24 nt, Human
ccgaagugcugggauuacaggugu

SEQ ID NO: 614813 - RNA, 24 nt, Human
ccuagcuacuuccugggagguggg

SEQ ID NO: 614814 - RNA, 19 nt, Human
ccugaacaaccugauggcc

SEQ ID NO: 614815 - RNA, 20 nt, Human
ccugaacaaccugauggccc

SEQ ID NO: 614816 - RNA, 25 nt, Human
ccugggagguggggcggggacuccu

SEQ ID NO: 614817 - RNA, 21 nt, Human
ccuuggcugggaaggagggac

SEQ ID NO: 614818 - RNA, 21 nt, Human
cgaggaggagguuggugacag

SEQ ID NO: 614819 - RNA, 20 nt, Human
cguucagggcccaaaaaucc

SEQ ID NO: 614820 - RNA, 20 nt, Human
cugcaagauagcaagccgga

SEQ ID NO: 614821 - RNA, 28 nt, Human
cugcuggagcugggauuugaacccagcu

SEQ ID NO: 614822 - RNA, 19 nt, Human
cuggucuugaacuccuggg

SEQ ID NO: 614823 - RNA, 22 nt, Human
cuucaguacugcccuuuccuuc

SEQ ID NO: 614824 - RNA, 20 nt, Human
gacgaggaggagguugguga

SEQ ID NO: 614825 - RNA, 19 nt, Human
gaggaggcccuuggcuucc

SEQ ID NO: 614826 - RNA, 21 nt, Human
gagguggagacaaagucucug

SEQ ID NO: 614827 - RNA, 21 nt, Human
gaguagucacuuacucgaggu

SEQ ID NO: 614828 - RNA, 18 nt, Human
gauuacaggcaugagcca

SEQ ID NO: 614829 - RNA, 21 nt, Human
gauuacaggcaugagccacug

SEQ ID NO: 614830 - RNA, 24 nt, Human
gauuacaggcaugagccacugugc

SEQ ID NO: 614831 - RNA, 18 nt, Human
gauuacaggugugagcca

SEQ ID NO: 614832 - RNA, 23 nt, Human
gauuacaggugugagccacagca

SEQ ID NO: 614833 - RNA, 20 nt, Human
gcaaugauucugugaauuuu

SEQ ID NO: 614834 - RNA, 23 nt, Human
gcacaggagguugauugcugcag

SEQ ID NO: 614835 - RNA, 20 nt, Human
gccacauuuacaaagcugcg

SEQ ID NO: 614836 - RNA, 20 nt, Human
gcuggcucuggagacugagg

SEQ ID NO: 614837 - RNA, 24 nt, Human
ggaacauuccugaucucuccccac

SEQ ID NO: 614838 - RNA, 23 nt, Human
ggaauggggacauagguugggag

SEQ ID NO: 614839 - RNA, 20 nt, Human
ggacgaggaggagguuggug

SEQ ID NO: 614840 - RNA, 21 nt, Human
ggaggacgaggaggagguugg

SEQ ID NO: 614841 - RNA, 24 nt, Human
ggauuacaggcaugagccacugug

SEQ ID NO: 614842 - RNA, 20 nt, Human
ggccauggacacagcacaga

SEQ ID NO: 614843 - RNA, 23 nt, Human
ggccauggacacagcacagagcu

SEQ ID NO: 614844 - RNA, 19 nt, Human
ggcggggacuacggagaag

SEQ ID NO: 614845 - RNA, 18 nt, Human
ggcuggucuugaacuccu

SEQ ID NO: 614846 - RNA, 20 nt, Human
gggagguaacggaugugaag

SEQ ID NO: 614847 - RNA, 18 nt, Human
gggcggggacuacggaga

SEQ ID NO: 614848 - RNA, 24 nt, Human
gucucacucacuguguugcccagg

SEQ ID NO: 614849 - RNA, 21 nt, Human
uaaaggaggacgaggaggagg

SEQ ID NO: 614850 - RNA, 24 nt, Human
uaaauagagacagggucucacuca

SEQ ID NO: 614851 - RNA, 22 nt, Human
uacaggcaugagccacugugcc

SEQ ID NO: 614852 - RNA, 21 nt, Human
uacaggugugagccacagcac

SEQ ID NO: 614853 - RNA, 22 nt, Human
uacaggugugagccacagcacu

SEQ ID NO: 614854 - RNA, 24 nt, Human
uacaggugugagccacagcacuca

SEQ ID NO: 614855 - RNA, 22 nt, Human
uacauaaccacuucugcccccu

SEQ ID NO: 614856 - RNA, 23 nt, Human
uacuaggugccuaaggacaacug

SEQ ID NO: 614857 - RNA, 22 nt, Human
uacucuggcuggagcccagcag

SEQ ID NO: 614858 - RNA, 22 nt, Human
uacugcccuuuccuucuuccac

SEQ ID NO: 614859 - RNA, 18 nt, Human
uagagacagggucucacu

SEQ ID NO: 614860 - RNA, 20 nt, Human
uagagggagcuccagcucuu

SEQ ID NO: 614861 - RNA, 21 nt, Human
uagcaaaacugagacagaagg

SEQ ID NO: 614862 - RNA, 22 nt, Human
uaggauugugauucucugaggu

SEQ ID NO: 614863 - RNA, 22 nt, Human
uauggaggcuucagaaccaggu

SEQ ID NO: 614864 - RNA, 24 nt, Human
ucacugucuccaucucaaauugca

SEQ ID NO: 614865 - RNA, 22 nt, Human
ucaggccugggaggagcccaca

SEQ ID NO: 614866 - RNA, 20 nt, Human
uccaugcuacaagagugggg

SEQ ID NO: 614867 - RNA, 24 nt, Human
ucccaaagugcugggauuacaggc

SEQ ID NO: 614868 - RNA, 22 nt, Human
uccccagagcaacagcuggccc

SEQ ID NO: 614869 - RNA, 23 nt, Human
uccccagagcaacagcuggccca

SEQ ID NO: 614870 - RNA, 19 nt, Human
ucccgaagugcugggauua

SEQ ID NO: 614871 - RNA, 23 nt, Human
ucccgaagugcugggauuacagg

SEQ ID NO: 614872 - RNA, 24 nt, Human
ucccgaagugcugggauuacaggu

SEQ ID NO: 614873 - RNA, 18 nt, Human
ucccuuuucucauagcaa

SEQ ID NO: 614874 - RNA, 21 nt, Human
uccucuaguuuuucuggcugc

SEQ ID NO: 614875 - RNA, 27 nt, Human
ucucacucacuguguugcccaggcugg

SEQ ID NO: 614876 - RNA, 18 nt, Human
ucucuuggcuggcucugg

SEQ ID NO: 614877 - RNA, 21 nt, Human
ucugcuucccaaagugcuggg

SEQ ID NO: 614878 - RNA, 19 nt, Human
ucuugaacuccugggcugg

SEQ ID NO: 614879 - RNA, 20 nt, Human
ugaacaugaagcuauggacc

SEQ ID NO: 614880 - RNA, 23 nt, Human
ugagccacagcacucagccacca

SEQ ID NO: 614881 - RNA, 24 nt, Human
ugagguaaaaacccaaucacuguc

SEQ ID NO: 614882 - RNA, 19 nt, Human
ugagguauccugaguucug

SEQ ID NO: 614883 - RNA, 23 nt, Human
ugaguggacauuucuucagugug

SEQ ID NO: 614884 - RNA, 24 nt, Human
ugcaagauagcaagccggacaagg

SEQ ID NO: 614885 - RNA, 24 nt, Human
ugcccaggcuggucuugaacuccu

SEQ ID NO: 614886 - RNA, 28 nt, Human
ugcccaggcuggucuugaacuccugggc

SEQ ID NO: 614887 - RNA, 25 nt, Human
ugcugggauuacaggugugagccac

SEQ ID NO: 614888 - RNA, 21 nt, Human
uggaacauuccugaucucucc

SEQ ID NO: 614889 - RNA, 21 nt, Human
uggaccauccacgagcugcug

SEQ ID NO: 614890 - RNA, 21 nt, Human
uggagguggagacaaagucuc

SEQ ID NO: 614891 - RNA, 23 nt, Human
uggcaacugcuggagcugggauu

SEQ ID NO: 614892 - RNA, 20 nt, Human
uggcccaguugacacaacag

SEQ ID NO: 614893 - RNA, 21 nt, Human
uggcccaguugacacaacagc

SEQ ID NO: 614894 - RNA, 23 nt, Human
ugggagguggggcggggacuacg

SEQ ID NO: 614895 - RNA, 18 nt, Human
ugggauuacaggcaugag

SEQ ID NO: 614896 - RNA, 21 nt, Human
ugggauuacaggcaugagcca

SEQ ID NO: 614897 - RNA, 22 nt, Human
ugggauuacaggcaugagccac

SEQ ID NO: 614898 - RNA, 22 nt, Human
ugggauuacaggcaugagccac

SEQ ID NO: 614899 - RNA, 22 nt, Human
ugggauuacaggcaugagccac

SEQ ID NO: 614900 - RNA, 23 nt, Human
ugggauuacaggcaugagccacu

SEQ ID NO: 614901 - RNA, 24 nt, Human
ugggauuacaggcaugagccacug

SEQ ID NO: 614902 - RNA, 18 nt, Human
ugggauuacaggugugag

SEQ ID NO: 614903 - RNA, 19 nt, Human
ugggauuacaggugugagc

SEQ ID NO: 614904 - RNA, 21 nt, Human
ugggauuacaggugugagcca

SEQ ID NO: 614905 - RNA, 22 nt, Human
ugggauuacaggugugagccac

SEQ ID NO: 614906 - RNA, 22 nt, Human
ugggauuacaggugugagccac

SEQ ID NO: 614907 - RNA, 24 nt, Human
ugggauuacaggugugagccacag

SEQ ID NO: 614908 - RNA, 25 nt, Human
ugggauuacaggugugagccacagc

SEQ ID NO: 614909 - RNA, 22 nt, Human
uggggcggggacuacggagaag

SEQ ID NO: 614910 - RNA, 20 nt, Human
uggucuguggacauaagcag

SEQ ID NO: 614911 - RNA, 21 nt, Human
uguacacacccauacuaggug

SEQ ID NO: 614912 - RNA, 24 nt, Human
uguguugcccaggcuggucuugaa

SEQ ID NO: 614913 - RNA, 18 nt, Human
uguguuuuuucgauccua

SEQ ID NO: 614914 - RNA, 21 nt, Human
uguuaggggcugguucauuug

SEQ ID NO: 614915 - RNA, 22 nt, Human
uguugcccaggcuggucuugaa

SEQ ID NO: 614916 - RNA, 22 nt, Human
uuaaaggaggacgaggaggagg

SEQ ID NO: 614917 - RNA, 20 nt, Human
uuaggacaaaaagaggcugc

SEQ ID NO: 614918 - RNA, 21 nt, Human
uuaguucucccacaauccagu

SEQ ID NO: 614919 - RNA, 24 nt, Human
uucccgaagugcugggauuacagg

SEQ ID NO: 614920 - RNA, 21 nt, Human
uugauugcugcagccaguguu

SEQ ID NO: 614921 - RNA, 21 nt, Human
uugguccaggcaaacagaaag

SEQ ID NO: 614922 - RNA, 22 nt, Human
uuggugacagucaggccuggga

SEQ ID NO: 614923 - RNA, 25 nt, Human
uuuaaaggaggacgaggaggagguu

SEQ ID NO: 614924 - RNA, 23 nt, Human
uuucccaaaaaaaagaaaaaaaa

SEQ ID NO: 614925 - RNA, 20 nt, Human
uuucuggcugcugauagccc

SEQ ID NO: 614926 - RNA, 24 nt, Human
aaaugucaaaguuucacuuaagcc

SEQ ID NO: 614927 - RNA, 20 nt, Human
aauacaacuccuggccaccu

SEQ ID NO: 614928 - RNA, 28 nt, Human
acagggcagaggugaggcgccaacggaa

SEQ ID NO: 614929 - RNA, 19 nt, Human
agaaauacaacuccuggcc

SEQ ID NO: 614930 - RNA, 21 nt, Human
agaaauacaacuccuggccac

SEQ ID NO: 614931 - RNA, 23 nt, Human
agauucuuuacacgaucuagcuc

SEQ ID NO: 614932 - RNA, 21 nt, Human
agcaaagcguucaucauagaa

SEQ ID NO: 614933 - RNA, 18 nt, Human
aggcagaggagggcggcc

SEQ ID NO: 614934 - RNA, 21 nt, Human
aggcagaggagggcggcugca

SEQ ID NO: 614935 - RNA, 24 nt, Human
aggcagauucuuuacacgaucuag

SEQ ID NO: 614936 - RNA, 21 nt, Human
agggguacagugugaugggag

SEQ ID NO: 614937 - RNA, 19 nt, Human
caaagcagaaauacaacuc

SEQ ID NO: 614938 - RNA, 23 nt, Human
caacggaauagcaaaugucaaag

SEQ ID NO: 614939 - RNA, 19 nt, Human
caccugcugucagcaaagc

SEQ ID NO: 614940 - RNA, 21 nt, Human
ccaccuuacagggcagagguu

SEQ ID NO: 614941 - RNA, 20 nt, Human
ccacucgcgucccaguuccc

SEQ ID NO: 614942 - RNA, 21 nt, Human
ccagccagccacucgcguccc

SEQ ID NO: 614943 - RNA, 22 nt, Human
cccccugugggucaaaucucac

SEQ ID NO: 614944 - RNA, 22 nt, Human
ccuugccuucuugcuccuuuuu

SEQ ID NO: 614945 - RNA, 24 nt, Human
cgccaacggaauagcaaaugucaa

SEQ ID NO: 614946 - RNA, 20 nt, Human
cggcugcagcauuccgagca

SEQ ID NO: 614947 - RNA, 22 nt, Human
cuucauggcugcguaauccugg

SEQ ID NO: 614948 - RNA, 25 nt, Human
cuucauggcugcguaauccugggcc

SEQ ID NO: 614949 - RNA, 19 nt, Human
cuuuuuggcuuucuccugg

SEQ ID NO: 614950 - RNA, 20 nt, Human
ggaaagguaggaggccuugc

SEQ ID NO: 614951 - RNA, 23 nt, Human
gggaagcaggaaugcaccugcug

SEQ ID NO: 614952 - RNA, 19 nt, Human
gggguacagugugauggga

SEQ ID NO: 614953 - RNA, 22 nt, Human
gugaggcgccaacggaauagca

SEQ ID NO: 614954 - RNA, 18 nt, Human
ucccggcugccaauggcc

SEQ ID NO: 614955 - RNA, 19 nt, Human
ucccggcugccaauggccu

SEQ ID NO: 614956 - RNA, 22 nt, Human
ucccuccuagcaaagcagaaau

SEQ ID NO: 614957 - RNA, 23 nt, Human
uccgagcaaagagagugucgagg

SEQ ID NO: 614958 - RNA, 18 nt, Human
ucuccugggccuucaugg

SEQ ID NO: 614959 - RNA, 20 nt, Human
ugaaggacacgcuugucugc

SEQ ID NO: 614960 - RNA, 21 nt, Human
ugaggcgccaacggaauagca

SEQ ID NO: 614961 - RNA, 18 nt, Human
ugcagaaaggauggaggg

SEQ ID NO: 614962 - RNA, 22 nt, Human
ugcucccggcugccaauggccu

SEQ ID NO: 614963 - RNA, 23 nt, Human
uggaauggucaccuuggcuugga

SEQ ID NO: 614964 - RNA, 28 nt, Human
uguaauugcagaaaggauggagggguac

SEQ ID NO: 614965 - RNA, 18 nt, Human
uucaaauauuuccguuuc

SEQ ID NO: 614966 - RNA, 21 nt, Human
uugcagaaaggauggaggggu

SEQ ID NO: 614967 - RNA, 24 nt, Human
uuggcccccugugggucaaaucuc

SEQ ID NO: 614968 - RNA, 18 nt, Human
aaaacucuccuguaauau

SEQ ID NO: 614969 - RNA, 19 nt, Human
aaaagacuaaaauucccaa

SEQ ID NO: 614970 - RNA, 25 nt, Human
aaccugccagccuguuaguaccugu

SEQ ID NO: 614971 - RNA, 18 nt, Human
aagaaaacaaagacccag

SEQ ID NO: 614972 - RNA, 20 nt, Human
aagaaaacaaagacccaggg

SEQ ID NO: 614973 - RNA, 26 nt, Human
aagaugguggggugacacuuuuggua

SEQ ID NO: 614974 - RNA, 24 nt, Human
aauaucucuccucagacuccacca

SEQ ID NO: 614975 - RNA, 24 nt, Human
acacagccucaggggccaucagcc

SEQ ID NO: 614976 - RNA, 20 nt, Human
acagccuggaaacagcaaac

SEQ ID NO: 614977 - RNA, 22 nt, Human
acaggaaauaauaagcucuaaa

SEQ ID NO: 614978 - RNA, 18 nt, Human
agaugguggggugacacu

SEQ ID NO: 614979 - RNA, 26 nt, Human
agcugcacaagccccaggcaaaaaug

SEQ ID NO: 614980 - RNA, 19 nt, Human
auuaccccaaaucaagaaa

SEQ ID NO: 614981 - RNA, 20 nt, Human
caagccccaggcaaaaaugg

SEQ ID NO: 614982 - RNA, 18 nt, Human
cacaagccccaggcaaaa

SEQ ID NO: 614983 - RNA, 22 nt, Human
cacuaggaaaauauaucacagc

SEQ ID NO: 614984 - RNA, 21 nt, Human
caggcugaaagaugcagcaug

SEQ ID NO: 614985 - RNA, 22 nt, Human
ccaaaucaagaaaacaaagacc

SEQ ID NO: 614986 - RNA, 21 nt, Human
ccagguuuucccaaauccagu

SEQ ID NO: 614987 - RNA, 21 nt, Human
cccaaaucaagaaaacaaaga

SEQ ID NO: 614988 - RNA, 24 nt, Human
cccagaaaacuuucuuucccuucu

SEQ ID NO: 614989 - RNA, 21 nt, Human
ccccgcggcgcuccgcgccgg

SEQ ID NO: 614990 - RNA, 22 nt, Human
ccuuauuuauuuuuaaagucaa

SEQ ID NO: 614991 - RNA, 18 nt, Human
cuccgcgccggcgcccau

SEQ ID NO: 614992 - RNA, 24 nt, Human
cuccucagacuccaccaacucuaa

SEQ ID NO: 614993 - RNA, 25 nt, Human
cuccucagacuccaccaacucuaac

SEQ ID NO: 614994 - RNA, 20 nt, Human
cugaaagaugcagcauguaa

SEQ ID NO: 614995 - RNA, 21 nt, Human
cugccagccuguuaguaccug

SEQ ID NO: 614996 - RNA, 24 nt, Human
cuucauuuacucuguuguaaucaa

SEQ ID NO: 614997 - RNA, 21 nt, Human
cuugcccucagccugauggcc

SEQ ID NO: 614998 - RNA, 27 nt, Human
gaagaugguggggugacacuuuuggua

SEQ ID NO: 614999 - RNA, 20 nt, Human
gcaggaacacugccagcugc

SEQ ID NO: 615000 - RNA, 21 nt, Human
ggaaacagcaaacggacaggc

SEQ ID NO: 615001 - RNA, 20 nt, Human
gggaaaguguuacugcaaga

SEQ ID NO: 615002 - RNA, 23 nt, Human
gggagucagcucauccuagcccc

SEQ ID NO: 615003 - RNA, 19 nt, Human
gggcucuggcuuguuacag

SEQ ID NO: 615004 - RNA, 19 nt, Human
gucagcucauccuagccca

SEQ ID NO: 615005 - RNA, 23 nt, Human
gucucaauugggcucuguuaauu

SEQ ID NO: 615006 - RNA, 23 nt, Human
uaaaaaauauauucuugcccuca

SEQ ID NO: 615007 - RNA, 23 nt, Human
uaaaauaaccaguguccagaggc

SEQ ID NO: 615008 - RNA, 19 nt, Human
uaccccaaaucaagaaaac

SEQ ID NO: 615009 - RNA, 23 nt, Human
uauaaauuaccccaaaucaagaa

SEQ ID NO: 615010 - RNA, 19 nt, Human
ucaaaacccccuucucuuc

SEQ ID NO: 615011 - RNA, 21 nt, Human
ucaagaaaacaaagacccaga

SEQ ID NO: 615012 - RNA, 22 nt, Human
ucauuuacucuguuguaaucaa

SEQ ID NO: 615013 - RNA, 24 nt, Human
ucccaaauccaguacuucauuuac

SEQ ID NO: 615014 - RNA, 24 nt, Human
ucccauaauuagugugucaucacc

SEQ ID NO: 615015 - RNA, 21 nt, Human
ucucccuugaauuuccuguug

SEQ ID NO: 615016 - RNA, 18 nt, Human
uggaaacagcaaacggac

SEQ ID NO: 615017 - RNA, 21 nt, Human
uggaagaugguggggugacac

SEQ ID NO: 615018 - RNA, 20 nt, Human
uggccauccuucauuucuuc

SEQ ID NO: 615019 - RNA, 23 nt, Human
uguaguaagaagagucugguacc

SEQ ID NO: 615020 - RNA, 31 nt, Human
uguccugucauuuuguuacacacagccucaa

SEQ ID NO: 615021 - RNA, 23 nt, Human
uguuucacagcuuauggaagaug

SEQ ID NO: 615022 - RNA, 22 nt, Human
uuccuguugccagggguuuguc

SEQ ID NO: 615023 - RNA, 24 nt, Human
uugguaaacaggauguuggcaaca

SEQ ID NO: 615024 - RNA, 19 nt, Human
uugucucaauugggcucug

SEQ ID NO: 615025 - RNA, 26 nt, Human
uuucaaguaauaaguuggugaaaauu

SEQ ID NO: 615026 - RNA, 21 nt, Human
aaaaucucagagcagcuccac

SEQ ID NO: 615027 - RNA, 19 nt, Human
aagcuccaagugucagugu

SEQ ID NO: 615028 - RNA, 21 nt, Human
aggaggagacgaaugaaagaa

SEQ ID NO: 615029 - RNA, 26 nt, Human
agggcugugggccgauggcuuuagca

SEQ ID NO: 615030 - RNA, 21 nt, Human
aucaucucugcagaagaacuc

SEQ ID NO: 615031 - RNA, 25 nt, Human
caaaaaaaaaauccauuacauuuau

SEQ ID NO: 615032 - RNA, 18 nt, Human
cacaguauaaacacaugg

SEQ ID NO: 615033 - RNA, 19 nt, Human
cagccucugggaaagagaa

SEQ ID NO: 615034 - RNA, 18 nt, Human
caggaggcagccuccagg

SEQ ID NO: 615035 - RNA, 18 nt, Human
caguagcugucugagccc

SEQ ID NO: 615036 - RNA, 19 nt, Human
ccacuccagauccagggca

SEQ ID NO: 615037 - RNA, 23 nt, Human
ccugccacucuggucugaggucc

SEQ ID NO: 615038 - RNA, 21 nt, Human
ccuggcauggaaaaagggccc

SEQ ID NO: 615039 - RNA, 22 nt, Human
cgagccuggucccccaggcuag

SEQ ID NO: 615040 - RNA, 24 nt, Human
cgaucgcccuucagguuuaguuuu

SEQ ID NO: 615041 - RNA, 22 nt, Human
cgugaacagggcugugggccga

SEQ ID NO: 615042 - RNA, 27 nt, Human
cucaaaaucucagagcagcuccacucc

SEQ ID NO: 615043 - RNA, 25 nt, Human
cuccacuccagauccagggcaggag

SEQ ID NO: 615044 - RNA, 22 nt, Human
cuggcugggaccagccucuggg

SEQ ID NO: 615045 - RNA, 21 nt, Human
gcagcuccacuccagauccag

SEQ ID NO: 615046 - RNA, 20 nt, Human
gcgcccacuggucucauaca

SEQ ID NO: 615047 - RNA, 21 nt, Human
ggcaggaggcagccuccaggg

SEQ ID NO: 615048 - RNA, 23 nt, Human
gggaaagagaagcaccaagacgu

SEQ ID NO: 615049 - RNA, 22 nt, Human
gggcaggaggcagccuccaggg

SEQ ID NO: 615050 - RNA, 21 nt, Human
uacaaaaaaaaaauccauuac

SEQ ID NO: 615051 - RNA, 18 nt, Human
uauccugauagcaugagg

SEQ ID NO: 615052 - RNA, 27 nt, Human
ucauccuguucuuuuaaauggcgccca

SEQ ID NO: 615053 - RNA, 21 nt, Human
uccagauccagggcaggaggc

SEQ ID NO: 615054 - RNA, 22 nt, Human
uccagggcaggaggcagccucc

SEQ ID NO: 615055 - RNA, 24 nt, Human
ucucauacagaggagcugugugac

SEQ ID NO: 615056 - RNA, 22 nt, Human
ugcagaagaacucaaaaucuca

SEQ ID NO: 615057 - RNA, 23 nt, Human
uggaaaaagggcccuguuguuua

SEQ ID NO: 615058 - RNA, 20 nt, Human
uguaaccgaucgcccuucag

SEQ ID NO: 615059 - RNA, 24 nt, Human
ugucuuccuuaucugcaagcucca

SEQ ID NO: 615060 - RNA, 22 nt, Human
uucgagccuggucccccaggcu

SEQ ID NO: 615061 - RNA, 24 nt, Human
uuuuuuuuuuuuuuuuuuacaaaa

SEQ ID NO: 615062 - RNA, 19 nt, Human
aaaaaaccuauaaauaugc

SEQ ID NO: 615063 - RNA, 20 nt, Human
aagugcucugggggagccac

SEQ ID NO: 615064 - RNA, 21 nt, Human
aauaucuaccucaaaggugac

SEQ ID NO: 615065 - RNA, 24 nt, Human
acccgcaccuggugcagcaccgcc

SEQ ID NO: 615066 - RNA, 25 nt, Human
accucaaaggugacuagaagaaaga

SEQ ID NO: 615067 - RNA, 18 nt, Human
acggauauacuauacucc

SEQ ID NO: 615068 - RNA, 23 nt, Human
acuccagaaaaucacaauaucua

SEQ ID NO: 615069 - RNA, 18 nt, Human
agacuuccaagauaacac

SEQ ID NO: 615070 - RNA, 24 nt, Human
agccacguggccaccacccacccc

SEQ ID NO: 615071 - RNA, 23 nt, Human
aggcaauaucaaaucaaagcuca

SEQ ID NO: 615072 - RNA, 18 nt, Human
aggcagagauaggagcca

SEQ ID NO: 615073 - RNA, 21 nt, Human
aggcagagauaggagccagga

SEQ ID NO: 615074 - RNA, 22 nt, Human
aggcaggcggguccgaauccgg

SEQ ID NO: 615075 - RNA, 20 nt, Human
aggcggguccgaauccggga

SEQ ID NO: 615076 - RNA, 22 nt, Human
aguuaggaagugcucuggggga

SEQ ID NO: 615077 - RNA, 20 nt, Human
auaauacuuuccucagguua

SEQ ID NO: 615078 - RNA, 19 nt, Human
augaaauguaauaugccaa

SEQ ID NO: 615079 - RNA, 19 nt, Human
auuuccacaaaguucacca

SEQ ID NO: 615080 - RNA, 20 nt, Human
cacccaccccagcacacucg

SEQ ID NO: 615081 - RNA, 19 nt, Human
cagagaaaagagggagaac

SEQ ID NO: 615082 - RNA, 25 nt, Human
cagcagcaucgcauguacacauggc

SEQ ID NO: 615083 - RNA, 21 nt, Human
cagcugggagaugccuggaag

SEQ ID NO: 615084 - RNA, 22 nt, Human
ccagaaaaucacaauaucuacc

SEQ ID NO: 615085 - RNA, 24 nt, Human
cccgaacccacaggccugccaccu

SEQ ID NO: 615086 - RNA, 22 nt, Human
ccgaacccacaggccugccacc

SEQ ID NO: 615087 - RNA, 19 nt, Human
ccucaagacaucucucucu

SEQ ID NO: 615088 - RNA, 21 nt, Human
ccugccaccuaucagcuaaga

SEQ ID NO: 615089 - RNA, 20 nt, Human
ccuggaaggcagagauagga

SEQ ID NO: 615090 - RNA, 19 nt, Human
cggguguggaggaggggcu

SEQ ID NO: 615091 - RNA, 21 nt, Human
cgugcagcugggagaugccug

SEQ ID NO: 615092 - RNA, 22 nt, Human
cgugcagcugggagaugccugg

SEQ ID NO: 615093 - RNA, 28 nt, Human
cugccaccuaucagcuaagaggcaucug

SEQ ID NO: 615094 - RNA, 21 nt, Human
gaaacccggccaggaccggga

SEQ ID NO: 615095 - RNA, 20 nt, Human
gaagauagaggaggagccgg

SEQ ID NO: 615096 - RNA, 24 nt, Human
gaggcagggcuuagggcucugagc

SEQ ID NO: 615097 - RNA, 19 nt, Human
gcagcaucgcauguacaca

SEQ ID NO: 615098 - RNA, 19 nt, Human
gccuagcgugggcgugaag

SEQ ID NO: 615099 - RNA, 21 nt, Human
ggagccggaacgugcaaggga

SEQ ID NO: 615100 - RNA, 25 nt, Human
ggaggaggggcucgcgcuugggaag

SEQ ID NO: 615101 - RNA, 21 nt, Human
gggagaacccgaacccacagg

SEQ ID NO: 615102 - RNA, 19 nt, Human
gggcggagaggcgccgugc

SEQ ID NO: 615103 - RNA, 19 nt, Human
gggcgugaagauagaggag

SEQ ID NO: 615104 - RNA, 21 nt, Human
gugcagcaccgccccaggcag

SEQ ID NO: 615105 - RNA, 22 nt, Human
guggaggaggggcucgcgcuug

SEQ ID NO: 615106 - RNA, 21 nt, Human
guggccaccacccaccccagc

SEQ ID NO: 615107 - RNA, 18 nt, Human
uaaugggucucccagcuu

SEQ ID NO: 615108 - RNA, 26 nt, Human
ucaaaucacuucaguacaaaugucaa

SEQ ID NO: 615109 - RNA, 29 nt, Human
ucacaauaucuaccucaaaggugacuagg

SEQ ID NO: 615110 - RNA, 22 nt, Human
ucaguacaaaugucaaagagaa

SEQ ID NO: 615111 - RNA, 21 nt, Human
uccaacuuaauggauauucaa

SEQ ID NO: 615112 - RNA, 20 nt, Human
uccagagaaaagagggagaa

SEQ ID NO: 615113 - RNA, 21 nt, Human
uccgggacgcggggcugggac

SEQ ID NO: 615114 - RNA, 18 nt, Human
ugaagauagaggaggagc

SEQ ID NO: 615115 - RNA, 18 nt, Human
ugacuagaagaaagacca

SEQ ID NO: 615116 - RNA, 20 nt, Human
ugagccgggcccgagcgugc

SEQ ID NO: 615117 - RNA, 20 nt, Human
ugcagcugggagaugccugg

SEQ ID NO: 615118 - RNA, 23 nt, Human
ugcaucuaguaaaccuaagacac

SEQ ID NO: 615119 - RNA, 24 nt, Human
ugccuggaaggcagagauaggagc

SEQ ID NO: 615120 - RNA, 18 nt, Human
uggaggaggggcucgcgc

SEQ ID NO: 615121 - RNA, 20 nt, Human
ugggagaugccuggaaggca

SEQ ID NO: 615122 - RNA, 20 nt, Human
uguguuccccugagcucaga

SEQ ID NO: 615123 - RNA, 22 nt, Human
uuccccugagcucagagaagac

SEQ ID NO: 615124 - RNA, 21 nt, Human
uuguguuccccugagcucaga

SEQ ID NO: 615125 - RNA, 24 nt, Human
aaaaaaaaaguuuggacuucuuaa

SEQ ID NO: 615126 - RNA, 22 nt, Human
aaaaagaaacaguccaagccuc

SEQ ID NO: 615127 - RNA, 23 nt, Human
aaacaguccaagccucacccccg

SEQ ID NO: 615128 - RNA, 20 nt, Human
aacaccuugacagaggaagu

SEQ ID NO: 615129 - RNA, 20 nt, Human
aagcaugauuuauuaugacc

SEQ ID NO: 615130 - RNA, 19 nt, Human
agcuaguaauaaaaaaaaa

SEQ ID NO: 615131 - RNA, 28 nt, Human
auaauauuugugugugugugugugugug

SEQ ID NO: 615132 - RNA, 21 nt, Human
cacuguguaguccauggacug

SEQ ID NO: 615133 - RNA, 22 nt, Human
cuggcaaacaguagguuaccau

SEQ ID NO: 615134 - RNA, 26 nt, Human
ggaaaaagaaacaguccaagccucac

SEQ ID NO: 615135 - RNA, 21 nt, Human
gugugugugugugugugugug

SEQ ID NO: 615136 - RNA, 21 nt, Human
uaaagaaccucuacucacugu

SEQ ID NO: 615137 - RNA, 26 nt, Human
uaauaauauuuguguguguguguguu

SEQ ID NO: 615138 - RNA, 21 nt, Human
uagaagucagaaucaugguca

SEQ ID NO: 615139 - RNA, 25 nt, Human
uagaugaacuuucucuuuugagcuc

SEQ ID NO: 615140 - RNA, 19 nt, Human
uauuugugugugugugugu

SEQ ID NO: 615141 - RNA, 19 nt, Human
uauuugugugugugugugu

SEQ ID NO: 615142 - RNA, 19 nt, Human
uauuugugugugugugugu

SEQ ID NO: 615143 - RNA, 23 nt, Human
uccaucaacagcagaauggauaa

SEQ ID NO: 615144 - RNA, 19 nt, Human
ucuacaggguuuacuauga

SEQ ID NO: 615145 - RNA, 22 nt, Human
uggaaaaagaaacaguccaagc

SEQ ID NO: 615146 - RNA, 26 nt, Human
uggaaaaagaaacaguccaagccuca

SEQ ID NO: 615147 - RNA, 18 nt, Human
ugugugugugugugugug

SEQ ID NO: 615148 - RNA, 18 nt, Human
ugugugugugugugugug

SEQ ID NO: 615149 - RNA, 18 nt, Human
ugugugugugugugugug

SEQ ID NO: 615150 - RNA, 18 nt, Human
ugugugugugugugugug

SEQ ID NO: 615151 - RNA, 18 nt, Human
ugugugugugugugugug

SEQ ID NO: 615152 - RNA, 18 nt, Human
ugugugugugugugugug

SEQ ID NO: 615153 - RNA, 22 nt, Human
ugugugugugugugugugugag

SEQ ID NO: 615154 - RNA, 21 nt, Human
ugugugugugugugugugugu

SEQ ID NO: 615155 - RNA, 21 nt, Human
ugugugugugugugugugugu

SEQ ID NO: 615156 - RNA, 21 nt, Human
ugugugugugugugugugugu

SEQ ID NO: 615157 - RNA, 21 nt, Human
ugugugugugugugugugugu

SEQ ID NO: 615158 - RNA, 21 nt, Human
ugugugugugugugugugugu

SEQ ID NO: 615159 - RNA, 21 nt, Human
ugugugugugugugugugugu

SEQ ID NO: 615160 - RNA, 21 nt, Human
ugugugugugugugugugugu

SEQ ID NO: 615161 - RNA, 21 nt, Human
ugugugugugugugugugugu

SEQ ID NO: 615162 - RNA, 21 nt, Human
ugugugugugugugugugugu

SEQ ID NO: 615163 - RNA, 21 nt, Human
ugugugugugugugugugugu

SEQ ID NO: 615164 - RNA, 22 nt, Human
ugugugugugugugugugugug

SEQ ID NO: 615165 - RNA, 22 nt, Human
ugugugugugugugugugugug

SEQ ID NO: 615166 - RNA, 24 nt, Human
uucauaccuccuucuuuuaaagaa

SEQ ID NO: 615167 - RNA, 25 nt, Human
uucauaccuccuucuuuuaaagaac

SEQ ID NO: 615168 - RNA, 24 nt, Human
uuugugugugugugugugugugug

SEQ ID NO: 615169 - RNA, 23 nt, Human
aagcagccucggauuggcugggu

SEQ ID NO: 615170 - RNA, 22 nt, Human
aaggagccuggacccaagggac

SEQ ID NO: 615171 - RNA, 27 nt, Human
aaugcccauccauuccaugaguuccua

SEQ ID NO: 615172 - RNA, 24 nt, Human
accccagccucccucucacagccc

SEQ ID NO: 615173 - RNA, 24 nt, Human
agaacuggggccaguggccugggc

SEQ ID NO: 615174 - RNA, 20 nt, Human
agacgugaacagcuuuggcc

SEQ ID NO: 615175 - RNA, 23 nt, Human
agcagaugguugagcacagacgu

SEQ ID NO: 615176 - RNA, 21 nt, Human
agggcggaggggagagggagg

SEQ ID NO: 615177 - RNA, 26 nt, Human
aggucccacucccagccccgcccagg

SEQ ID NO: 615178 - RNA, 24 nt, Human
aucuuuggcaacgaauuucugcag

SEQ ID NO: 615179 - RNA, 27 nt, Human
caaaugcccauccauuccaugaguucc

SEQ ID NO: 615180 - RNA, 18 nt, Human
caacaggaggagcaaaag

SEQ ID NO: 615181 - RNA, 18 nt, Human
cacagugguggccuuggu

SEQ ID NO: 615182 - RNA, 20 nt, Human
caccaggcagagggcaaagu

SEQ ID NO: 615183 - RNA, 21 nt, Human
cagccccgcccaggcacccca

SEQ ID NO: 615184 - RNA, 20 nt, Human
cagccucccucucacagccc

SEQ ID NO: 615185 - RNA, 24 nt, Human
cagggccugcccauggugcuggcu

SEQ ID NO: 615186 - RNA, 24 nt, Human
cagugguggccuuggucuugccug

SEQ ID NO: 615187 - RNA, 22 nt, Human
ccaacccagccucuacuccuuc

SEQ ID NO: 615188 - RNA, 23 nt, Human
ccacucccagccccgcccaggca

SEQ ID NO: 615189 - RNA, 22 nt, Human
ccagccucuacuccuuccucag

SEQ ID NO: 615190 - RNA, 20 nt, Human
ccauagguagcugcccuggg

SEQ ID NO: 615191 - RNA, 25 nt, Human
cccagccccgcccaggcaccccagc

SEQ ID NO: 615192 - RNA, 22 nt, Human
cccaguggagagagagcaccag

SEQ ID NO: 615193 - RNA, 23 nt, Human
cccauagguagcugcccuggggc

SEQ ID NO: 615194 - RNA, 18 nt, Human
cccauggcagggccugcc

SEQ ID NO: 615195 - RNA, 23 nt, Human
ccccauuuccuucggugucucug

SEQ ID NO: 615196 - RNA, 24 nt, Human
ccccugcacacccuguaacagacc

SEQ ID NO: 615197 - RNA, 28 nt, Human
cccgcccucccccucccucucucccuuu

SEQ ID NO: 615198 - RNA, 23 nt, Human
cccgcuucgcccgcccucccccu

SEQ ID NO: 615199 - RNA, 19 nt, Human
cccugguguaggggaggga

SEQ ID NO: 615200 - RNA, 21 nt, Human
cccuguaacagaccaccgccc

SEQ ID NO: 615201 - RNA, 24 nt, Human
cccuguaacagaccaccgcccucc

SEQ ID NO: 615202 - RNA, 20 nt, Human
ccgcgcucagcgccgaggag

SEQ ID NO: 615203 - RNA, 22 nt, Human
ccuccacauacuggcccagucc

SEQ ID NO: 615204 - RNA, 20 nt, Human
ccucccucucucccuuucuc

SEQ ID NO: 615205 - RNA, 20 nt, Human
ccucucucccuuucuccccc

SEQ ID NO: 615206 - RNA, 20 nt, Human
cgggcagcugcgccgccggc

SEQ ID NO: 615207 - RNA, 18 nt, Human
cucacagccccuaaggcu

SEQ ID NO: 615208 - RNA, 19 nt, Human
cuccagccaacccagccuc

SEQ ID NO: 615209 - RNA, 24 nt, Human
cucccagccccgcccaggcacccc

SEQ ID NO: 615210 - RNA, 21 nt, Human
cucccgcuucgcccgcccucc

SEQ ID NO: 615211 - RNA, 22 nt, Human
cucccuucuggugaugcuuagg

SEQ ID NO: 615212 - RNA, 21 nt, Human
cucccuuucucccccucgccc

SEQ ID NO: 615213 - RNA, 19 nt, Human
cuggacccaagggacacug

SEQ ID NO: 615214 - RNA, 18 nt, Human
cugggcagccaaugaagg

SEQ ID NO: 615215 - RNA, 20 nt, Human
gacuggaaggagggcccaca

SEQ ID NO: 615216 - RNA, 18 nt, Human
gcagcuggacagugggcc

SEQ ID NO: 615217 - RNA, 22 nt, Human
gcccaugggggugggucacagu

SEQ ID NO: 615218 - RNA, 21 nt, Human
gccccgcccaggcaccccagc

SEQ ID NO: 615219 - RNA, 21 nt, Human
gccugacuggaaggagggccc

SEQ ID NO: 615220 - RNA, 19 nt, Human
gcgcgaggcaggggcgugg

SEQ ID NO: 615221 - RNA, 18 nt, Human
gcgcucagcgccgaggag

SEQ ID NO: 615222 - RNA, 18 nt, Human
gcugagcucuccccuccc

SEQ ID NO: 615223 - RNA, 24 nt, Human
gcugcccuggggcaagucccuggu

SEQ ID NO: 615224 - RNA, 20 nt, Human
gcuggggaagcaaagaccca

SEQ ID NO: 615225 - RNA, 22 nt, Human
gcuucgcccgcccucccccucc

SEQ ID NO: 615226 - RNA, 21 nt, Human
ggagagggaggcaggcgugcu

SEQ ID NO: 615227 - RNA, 25 nt, Human
ggccugggcagccaaugaaggggag

SEQ ID NO: 615228 - RNA, 19 nt, Human
ggcuggcuggggaagcaaa

SEQ ID NO: 615229 - RNA, 23 nt, Human
ggcugggugagggcggaggggag

SEQ ID NO: 615230 - RNA, 19 nt, Human
gggagggaguaauauugcu

SEQ ID NO: 615231 - RNA, 21 nt, Human
gggaucucaggucccacuccc

SEQ ID NO: 615232 - RNA, 19 nt, Human
ggucugagugagucggggg

SEQ ID NO: 615233 - RNA, 23 nt, Human
gucacagagcaacgguguggcuu

SEQ ID NO: 615234 - RNA, 24 nt, Human
guggagagagagcaccaggucaga

SEQ ID NO: 615235 - RNA, 18 nt, Human
uagcagaaccacugacuc

SEQ ID NO: 615236 - RNA, 18 nt, Human
uaggacggcuccagccaa

SEQ ID NO: 615237 - RNA, 20 nt, Human
ucagagggccaagaugaccc

SEQ ID NO: 615238 - RNA, 23 nt, Human
ucagagggccaagaugaccccca

SEQ ID NO: 615239 - RNA, 22 nt, Human
ucaggccacgugcaggcugaac

SEQ ID NO: 615240 - RNA, 18 nt, Human
ucccagccccgcccaggc

SEQ ID NO: 615241 - RNA, 23 nt, Human
ucccagccccgcccaggcacccc

SEQ ID NO: 615242 - RNA, 20 nt, Human
uccucaggccacgugcaggc

SEQ ID NO: 615243 - RNA, 18 nt, Human
uccuccacauacuggccc

SEQ ID NO: 615244 - RNA, 22 nt, Human
ucgcugugggguuucaccaccc

SEQ ID NO: 615245 - RNA, 20 nt, Human
ucucacagccccuaaggcuu

SEQ ID NO: 615246 - RNA, 22 nt, Human
ucucaggucccacucccagccc

SEQ ID NO: 615247 - RNA, 19 nt, Human
ucugcagcuggacaguggg

SEQ ID NO: 615248 - RNA, 20 nt, Human
ucugcagcuggacagugggc

SEQ ID NO: 615249 - RNA, 21 nt, Human
ucugcagcuggacagugggcc

SEQ ID NO: 615250 - RNA, 24 nt, Human
ucugccccugcacacccuguaaca

SEQ ID NO: 615251 - RNA, 21 nt, Human
ugagaggcuguaggcugggca

SEQ ID NO: 615252 - RNA, 21 nt, Human
ugagcacaaggaaggggcggg

SEQ ID NO: 615253 - RNA, 23 nt, Human
ugccccugcacacccuguaacag

SEQ ID NO: 615254 - RNA, 18 nt, Human
ugcccuggggcaaguccc

SEQ ID NO: 615255 - RNA, 23 nt, Human
ugcccuggggcaagucccuggug

SEQ ID NO: 615256 - RNA, 21 nt, Human
uggcagggccugcccauggug

SEQ ID NO: 615257 - RNA, 20 nt, Human
ugggggugggucacagugag

SEQ ID NO: 615258 - RNA, 22 nt, Human
uggggucugagugagucggggg

SEQ ID NO: 615259 - RNA, 24 nt, Human
uggugcuggcugccugggacgggg

SEQ ID NO: 615260 - RNA, 22 nt, Human
uuggccauuugagcacaaggaa

SEQ ID NO: 615261 - RNA, 21 nt, Human
uuucuugacauuuuggggcuu

SEQ ID NO: 615262 - RNA, 22 nt, Human
uuuggcaacgaauuucugcagc

SEQ ID NO: 615263 - RNA, 24 nt, Human
uuuggcaacgaauuucugcagcug

SEQ ID NO: 615264 - RNA, 21 nt, Human
uuuuuuucuugacauuuuggg

SEQ ID NO: 615265 - RNA, 18 nt, Human
uuuuuuuuuuuuuucuug

SEQ ID NO: 615266 - RNA, 22 nt, Human
aaugguggggguaggggaagga

SEQ ID NO: 615267 - RNA, 23 nt, Human
acucuggugcgccuguuuccucc

SEQ ID NO: 615268 - RNA, 23 nt, Human
agaguggucuucaccuggcuggu

SEQ ID NO: 615269 - RNA, 19 nt, Human
agccaguguggggagacac

SEQ ID NO: 615270 - RNA, 20 nt, Human
aggaggcccagaaagaacca

SEQ ID NO: 615271 - RNA, 18 nt, Human
aggcggcagccagccugg

SEQ ID NO: 615272 - RNA, 20 nt, Human
agggaagggggaauauggua

SEQ ID NO: 615273 - RNA, 24 nt, Human
caacuguacccagcagcccuauaa

SEQ ID NO: 615274 - RNA, 18 nt, Human
cacccuccauccggccac

SEQ ID NO: 615275 - RNA, 21 nt, Human
cacccugacucuggugcgccu

SEQ ID NO: 615276 - RNA, 22 nt, Human
cacccugacucuggugcgccug

SEQ ID NO: 615277 - RNA, 23 nt, Human
cagaauacuggggagccagugug

SEQ ID NO: 615278 - RNA, 19 nt, Human
cagcugccugaccccuggg

SEQ ID NO: 615279 - RNA, 24 nt, Human
caggaaaaugacgccccuuccuca

SEQ ID NO: 615280 - RNA, 24 nt, Human
ccagugacuuccuaucggccuccu

SEQ ID NO: 615281 - RNA, 21 nt, Human
cccccaggcccucacuguguc

SEQ ID NO: 615282 - RNA, 19 nt, Human
ccccugugggcaucagcag

SEQ ID NO: 615283 - RNA, 21 nt, Human
cccugacucuggugcgccugu

SEQ ID NO: 615284 - RNA, 19 nt, Human
cccugccacccuccauccg

SEQ ID NO: 615285 - RNA, 20 nt, Human
cccuugugcagugcacagcc

SEQ ID NO: 615286 - RNA, 20 nt, Human
ccguauguccgcagggcagg

SEQ ID NO: 615287 - RNA, 18 nt, Human
ccucacuguguccugggg

SEQ ID NO: 615288 - RNA, 22 nt, Human
ccucgaagaaggcaaggauggg

SEQ ID NO: 615289 - RNA, 19 nt, Human
ccucugcugugagugaggg

SEQ ID NO: 615290 - RNA, 21 nt, Human
ccugccuaucuuucccugccu

SEQ ID NO: 615291 - RNA, 21 nt, Human
ccugggccccugucccaggag

SEQ ID NO: 615292 - RNA, 21 nt, Human
cucacuguguccuggggcaac

SEQ ID NO: 615293 - RNA, 19 nt, Human
cuccagcuuuccaccucug

SEQ ID NO: 615294 - RNA, 22 nt, Human
cucccuccaugucauccggcca

SEQ ID NO: 615295 - RNA, 21 nt, Human
cuccuauggucagggagcucc

SEQ ID NO: 615296 - RNA, 18 nt, Human
cucuguguuaggaaggaa

SEQ ID NO: 615297 - RNA, 20 nt, Human
cugcaccccaccuuggccug

SEQ ID NO: 615298 - RNA, 21 nt, Human
cuggggcaaccgauggugggg

SEQ ID NO: 615299 - RNA, 23 nt, Human
gaauggggaugggggugcaacuc

SEQ ID NO: 615300 - RNA, 26 nt, Human
gacucuggugcgccuguuuccuccug

SEQ ID NO: 615301 - RNA, 19 nt, Human
gagcgccccugcgagccgc

SEQ ID NO: 615302 - RNA, 19 nt, Human
gcaccccaccuuggccugg

SEQ ID NO: 615303 - RNA, 21 nt, Human
gccuguuuccuccugcacccc

SEQ ID NO: 615304 - RNA, 22 nt, Human
gcgacugggucagucuccagcu

SEQ ID NO: 615305 - RNA, 22 nt, Human
ggagacacuuugggcccaguga

SEQ ID NO: 615306 - RNA, 20 nt, Human
ggagcucccuccaugucauc

SEQ ID NO: 615307 - RNA, 21 nt, Human
ggccacagcgaggcggcagcc

SEQ ID NO: 615308 - RNA, 23 nt, Human
ggccugggccccugucccaggag

SEQ ID NO: 615309 - RNA, 24 nt, Human
gggagccaguguggggagacacag

SEQ ID NO: 615310 - RNA, 24 nt, Human
gggcaucagcaggcacaggguggg

SEQ ID NO: 615311 - RNA, 19 nt, Human
ggggaauaugguaguccag

SEQ ID NO: 615312 - RNA, 23 nt, Human
ggggguaggggaaggaggaacag

SEQ ID NO: 615313 - RNA, 23 nt, Human
ggguagaggggcgucgugucucu

SEQ ID NO: 615314 - RNA, 24 nt, Human
ggucugggccucccaguuaaaacc

SEQ ID NO: 615315 - RNA, 22 nt, Human
gugacuuccuaucggccuccug

SEQ ID NO: 615316 - RNA, 23 nt, Human
guggggaggggccuugguaugug

SEQ ID NO: 615317 - RNA, 18 nt, Human
guggggcugagcgccccu

SEQ ID NO: 615318 - RNA, 18 nt, Human
guuugggugaaaguggug

SEQ ID NO: 615319 - RNA, 21 nt, Human
uaaaaaaaacauucucagaga

SEQ ID NO: 615320 - RNA, 26 nt, Human
uaaaaaaaacauucucagagauuugu

SEQ ID NO: 615321 - RNA, 19 nt, Human
uaagauguauuggagggaa

SEQ ID NO: 615322 - RNA, 19 nt, Human
uaggaaggaaugguggggg

SEQ ID NO: 615323 - RNA, 21 nt, Human
uaggggaaggaggaacagggg

SEQ ID NO: 615324 - RNA, 19 nt, Human
ucagcaggcacaggguggg

SEQ ID NO: 615325 - RNA, 21 nt, Human
uccagcuuuccaccucugcug

SEQ ID NO: 615326 - RNA, 23 nt, Human
uccccugugggcaucagcaggca

SEQ ID NO: 615327 - RNA, 21 nt, Human
ucccucgaagaaggcaaggau

SEQ ID NO: 615328 - RNA, 18 nt, Human
uccugccuaucuuucccu

SEQ ID NO: 615329 - RNA, 18 nt, Human
uccuuuuucuucuuucuc

SEQ ID NO: 615330 - RNA, 19 nt, Human
ucuaaccccuccuaugguc

SEQ ID NO: 615331 - RNA, 18 nt, Human
ucuccuuggacaaggugc

SEQ ID NO: 615332 - RNA, 23 nt, Human
ucucucccugccucugccagcuu

SEQ ID NO: 615333 - RNA, 24 nt, Human
ucugcgacugggucagucuccagc

SEQ ID NO: 615334 - RNA, 24 nt, Human
ucuggugcgccuguuuccuccugc

SEQ ID NO: 615335 - RNA, 23 nt, Human
ugagcgccccugcgagccgccca

SEQ ID NO: 615336 - RNA, 19 nt, Human
ugagcuggggguccccagu

SEQ ID NO: 615337 - RNA, 21 nt, Human
ugcaggaaaggaguuggucug

SEQ ID NO: 615338 - RNA, 24 nt, Human
ugcccugccacccuccauccggcc

SEQ ID NO: 615339 - RNA, 21 nt, Human
ugcgaacaggaaaaugacgcc

SEQ ID NO: 615340 - RNA, 20 nt, Human
uggagagagauacaguaccg

SEQ ID NO: 615341 - RNA, 19 nt, Human
uggagggaagggggaauau

SEQ ID NO: 615342 - RNA, 25 nt, Human
uggcugguggggagacacuuugggc

SEQ ID NO: 615343 - RNA, 25 nt, Human
ugggccccugucccaggaggcccag

SEQ ID NO: 615344 - RNA, 21 nt, Human
uggggaugggggugcaacucu

SEQ ID NO: 615345 - RNA, 18 nt, Human
uggggcaaccgauggugg

SEQ ID NO: 615346 - RNA, 23 nt, Human
uguaccccuuuuccagaauacug

SEQ ID NO: 615347 - RNA, 19 nt, Human
ugucuccuuggacaaggug

SEQ ID NO: 615348 - RNA, 23 nt, Human
ugugggcaucagcaggcacaggg

SEQ ID NO: 615349 - RNA, 18 nt, Human
uguguuaggaaggaaugg

SEQ ID NO: 615350 - RNA, 22 nt, Human
uguguuaggaaggaaugguggg

SEQ ID NO: 615351 - RNA, 18 nt, Human
uguuuccuccugcacccc

SEQ ID NO: 615352 - RNA, 18 nt, Human
uuaaaaccaggagggucc

SEQ ID NO: 615353 - RNA, 22 nt, Human
uugaucgugugggacaggccuu

SEQ ID NO: 615354 - RNA, 21 nt, Human
uuuccuuuuucuucuuucucu

SEQ ID NO: 615355 - RNA, 22 nt, Human
auuaccaugauuugugaaaagc

SEQ ID NO: 615356 - RNA, 20 nt, Human
caaggaaggacacagacagu

SEQ ID NO: 615357 - RNA, 21 nt, Human
uccagcggccccacgcucccc

SEQ ID NO: 615358 - RNA, 18 nt, Human
ucccggugcucgccucuc

SEQ ID NO: 615359 - RNA, 22 nt, Human
uguuuuauuaccaugauuugug

SEQ ID NO: 615360 - RNA, 19 nt, Human
uucaaggaaggacacagac

SEQ ID NO: 615361 - RNA, 20 nt, Human
uucaaggaaggacacagaca

SEQ ID NO: 615362 - RNA, 26 nt, Human
aaaaaaaacgugaauaagaauaucau

SEQ ID NO: 615363 - RNA, 24 nt, Human
aaaagcuguacccaggaauccacu

SEQ ID NO: 615364 - RNA, 26 nt, Human
aaacaaaacaugucccugccccaagg

SEQ ID NO: 615365 - RNA, 21 nt, Human
aaacaaacugcacagcaucac

SEQ ID NO: 615366 - RNA, 19 nt, Human
aaagaugaauuugugaaaa

SEQ ID NO: 615367 - RNA, 23 nt, Human
aacugcccuucaaaaauuuacau

SEQ ID NO: 615368 - RNA, 21 nt, Human
aagaaaaagaauacugggagc

SEQ ID NO: 615369 - RNA, 19 nt, Human
aagcuguacccaggaaucc

SEQ ID NO: 615370 - RNA, 18 nt, Human
aauaaauaauaaagaaaa

SEQ ID NO: 615371 - RNA, 22 nt, Human
aauaauaaagaaagauuuggga

SEQ ID NO: 615372 - RNA, 24 nt, Human
aauacugggagcuucaaggaggaa

SEQ ID NO: 615373 - RNA, 23 nt, Human
acaaaagcuguacccaggaaucc

SEQ ID NO: 615374 - RNA, 18 nt, Human
acagaacaaggggaagcu

SEQ ID NO: 615375 - RNA, 18 nt, Human
acccacccuaaguaacau

SEQ ID NO: 615376 - RNA, 23 nt, Human
acugcccuucaaaaauuuacauc

SEQ ID NO: 615377 - RNA, 19 nt, Human
aggaagaaaagggccacag

SEQ ID NO: 615378 - RNA, 18 nt, Human
aggaaucuuuaaucauga

SEQ ID NO: 615379 - RNA, 23 nt, Human
aggaggaagaaaagggccacaga

SEQ ID NO: 615380 - RNA, 18 nt, Human
aucaacaaagccuauaua

SEQ ID NO: 615381 - RNA, 21 nt, Human
augaaguauuaaacguucucc

SEQ ID NO: 615382 - RNA, 23 nt, Human
augauuugccuuuaaaagccuac

SEQ ID NO: 615383 - RNA, 21 nt, Human
augugcugaaagcugcaugcc

SEQ ID NO: 615384 - RNA, 19 nt, Human
caacaaaauuagcuuccca

SEQ ID NO: 615385 - RNA, 18 nt, Human
caacaaagccuauauaua

SEQ ID NO: 615386 - RNA, 20 nt, Human
caccauacuauacacuccuc

SEQ ID NO: 615387 - RNA, 22 nt, Human
cacugcaugaccaucuuagagc

SEQ ID NO: 615388 - RNA, 22 nt, Human
cauacuauacacuccucucaga

SEQ ID NO: 615389 - RNA, 19 nt, Human
cauuccauuggaugaaagc

SEQ ID NO: 615390 - RNA, 24 nt, Human
ccaagaaacaaaaaugauacccaa

SEQ ID NO: 615391 - RNA, 27 nt, Human
ccaauuaaaaacaaaagaagcuguaaa

SEQ ID NO: 615392 - RNA, 24 nt, Human
ccaggaauccacucaacguccucu

SEQ ID NO: 615393 - RNA, 21 nt, Human
ccauacuauacacuccucuca

SEQ ID NO: 615394 - RNA, 23 nt, Human
ccauacuauacacuccucucaga

SEQ ID NO: 615395 - RNA, 19 nt, Human
cccaagaaacaaaaauggu

SEQ ID NO: 615396 - RNA, 21 nt, Human
cccaauuaaaaacaaaagaaa

SEQ ID NO: 615397 - RNA, 18 nt, Human
ccuaauaccaccuccuga

SEQ ID NO: 615398 - RNA, 18 nt, Human
cuccuugcucucuuugcc

SEQ ID NO: 615399 - RNA, 21 nt, Human
cuggcauuagcugauggcaca

SEQ ID NO: 615400 - RNA, 19 nt, Human
gaaguauuaaacguucucc

SEQ ID NO: 615401 - RNA, 23 nt, Human
gacgucagagggauuaggaagga

SEQ ID NO: 615402 - RNA, 20 nt, Human
gaggcagccaccuauaugac

SEQ ID NO: 615403 - RNA, 19 nt, Human
gcaugccucaucaguuuuu

SEQ ID NO: 615404 - RNA, 19 nt, Human
gccuauauauauauauaua

SEQ ID NO: 615405 - RNA, 20 nt, Human
ggguuuuuuucucccaaagg

SEQ ID NO: 615406 - RNA, 23 nt, Human
gugaaaaacugcuuuauggucua

SEQ ID NO: 615407 - RNA, 20 nt, Human
guugcugugcucucaccaug

SEQ ID NO: 615408 - RNA, 22 nt, Human
uaaaaacaaaagaagcuguaaa

SEQ ID NO: 615409 - RNA, 18 nt, Human
uaagccuggcauuagcug

SEQ ID NO: 615410 - RNA, 27 nt, Human
uaauaaagaaagauuugggauuuggua

SEQ ID NO: 615411 - RNA, 21 nt, Human
uaauggguuaacacagucauc

SEQ ID NO: 615412 - RNA, 19 nt, Human
uacccaggaauccacucaa

SEQ ID NO: 615413 - RNA, 19 nt, Human
uagaggggaaaagaaaaag

SEQ ID NO: 615414 - RNA, 22 nt, Human
uagaggggaaaagaaaaagaau

SEQ ID NO: 615415 - RNA, 24 nt, Human
uagcauuaaaaaacaucgacucau

SEQ ID NO: 615416 - RNA, 19 nt, Human
uauaaaaacaaacugcaca

SEQ ID NO: 615417 - RNA, 21 nt, Human
ucaacaaaauuagcuuccccc

SEQ ID NO: 615418 - RNA, 18 nt, Human
ucuaaggaggcagccacc

SEQ ID NO: 615419 - RNA, 22 nt, Human
ugaaagccauggugacauuuuu

SEQ ID NO: 615420 - RNA, 20 nt, Human
ugacuucuaaggaaacuuuu

SEQ ID NO: 615421 - RNA, 19 nt, Human
ugaguguagauaggcacca

SEQ ID NO: 615422 - RNA, 20 nt, Human
ugcaugccucaucaguuuuu

SEQ ID NO: 615423 - RNA, 21 nt, Human
ugcucucaccauggagcagug

SEQ ID NO: 615424 - RNA, 24 nt, Human
uggcauuagcugauggcacauucu

SEQ ID NO: 615425 - RNA, 19 nt, Human
ugggaaugauuugccuuua

SEQ ID NO: 615426 - RNA, 24 nt, Human
uuaugguuaaaaaaaacgugaaua

SEQ ID NO: 615427 - RNA, 23 nt, Human
uucaaagucugggguuuuuuucu

SEQ ID NO: 615428 - RNA, 21 nt, Human
uuccccacccgaauuaaaccc

SEQ ID NO: 615429 - RNA, 20 nt, Human
uuuagaggggaaaagaaaaa

SEQ ID NO: 615430 - RNA, 23 nt, Human
uuuccauauaaaaacaaacugca

SEQ ID NO: 615431 - RNA, 21 nt, Human
uuugcagaaucuucuggccca

SEQ ID NO: 615432 - RNA, 18 nt, Human
uuugcagaaucuucuggg

SEQ ID NO: 615433 - RNA, 24 nt, Human
uuuuucaucaacaaagccuauaua

SEQ ID NO: 615434 - RNA, 25 nt, Human
aaacaccccacccccaccccagagc

SEQ ID NO: 615435 - RNA, 20 nt, Human
aaaggaaaaauggccccucu

SEQ ID NO: 615436 - RNA, 22 nt, Human
aacaccccacccccaccccaga

SEQ ID NO: 615437 - RNA, 19 nt, Human
aaccaagauaccgacuuuc

SEQ ID NO: 615438 - RNA, 20 nt, Human
aagcccaggacagacugcgg

SEQ ID NO: 615439 - RNA, 22 nt, Human
aauacacacagaauuauauaua

SEQ ID NO: 615440 - RNA, 18 nt, Human
acaccccacccccacccc

SEQ ID NO: 615441 - RNA, 20 nt, Human
acaucagaaacaccccaccc

SEQ ID NO: 615442 - RNA, 23 nt, Human
acauuaaaaaccccaacaugaca

SEQ ID NO: 615443 - RNA, 18 nt, Human
accaaggggaggucaagc

SEQ ID NO: 615444 - RNA, 18 nt, Human
accccacccccaccccag

SEQ ID NO: 615445 - RNA, 25 nt, Human
accccagagcacaaccaagauaccg

SEQ ID NO: 615446 - RNA, 22 nt, Human
agaaacaccccacccccacccc

SEQ ID NO: 615447 - RNA, 20 nt, Human
agagcacaaccaagauaccg

SEQ ID NO: 615448 - RNA, 22 nt, Human
agcccacuugucugugucagca

SEQ ID NO: 615449 - RNA, 21 nt, Human
aggagggugggggaaguaaag

SEQ ID NO: 615450 - RNA, 23 nt, Human
aggcagcugaaggagccuccgca

SEQ ID NO: 615451 - RNA, 18 nt, Human
agguggcgggggcugggg

SEQ ID NO: 615452 - RNA, 21 nt, Human
agguggcgggggcuggggcuc

SEQ ID NO: 615453 - RNA, 23 nt, Human
augacacagaauacacacagaau

SEQ ID NO: 615454 - RNA, 26 nt, Human
caaaaucaaagugcugaggcagcuga

SEQ ID NO: 615455 - RNA, 22 nt, Human
caagcccaggacagacugcggg

SEQ ID NO: 615456 - RNA, 22 nt, Human
caagcugggcucacccaagccc

SEQ ID NO: 615457 - RNA, 21 nt, Human
caaucacauuaaaaaccccaa

SEQ ID NO: 615458 - RNA, 24 nt, Human
caccccacccccaccccagagcac

SEQ ID NO: 615459 - RNA, 22 nt, Human
caccccagagcacaaccaagau

SEQ ID NO: 615460 - RNA, 22 nt, Human
cagaaacaccccacccccaccc

SEQ ID NO: 615461 - RNA, 21 nt, Human
caggacccugggaaccaaggg

SEQ ID NO: 615462 - RNA, 19 nt, Human
caugaccccugaaauucag

SEQ ID NO: 615463 - RNA, 18 nt, Human
ccaaaaccaaccauaucc

SEQ ID NO: 615464 - RNA, 22 nt, Human
ccaccuggugggggaugggagc

SEQ ID NO: 615465 - RNA, 22 nt, Human
cccacccccaccccagagcaca

SEQ ID NO: 615466 - RNA, 26 nt, Human
cccacccccaccccagagcacaacca

SEQ ID NO: 615467 - RNA, 19 nt, Human
ccccaccccagagcacaac

SEQ ID NO: 615468 - RNA, 18 nt, Human
ccccacccccaccccaga

SEQ ID NO: 615469 - RNA, 19 nt, Human
cccccaccccagagcacaa

SEQ ID NO: 615470 - RNA, 19 nt, Human
cccccaggcaggaggcccg

SEQ ID NO: 615471 - RNA, 26 nt, Human
ccccugaaauucagaugcacggcgga

SEQ ID NO: 615472 - RNA, 24 nt, Human
ccggcggcggagguggcgggggcu

SEQ ID NO: 615473 - RNA, 18 nt, Human
ccucgaaagccaaaagga

SEQ ID NO: 615474 - RNA, 19 nt, Human
ccucugguuaagggaagcc

SEQ ID NO: 615475 - RNA, 19 nt, Human
cggcggcccgcggugcccc

SEQ ID NO: 615476 - RNA, 24 nt, Human
cucaaacuccaggucuggugacuc

SEQ ID NO: 615477 - RNA, 20 nt, Human
cucaggcagagaugacugcu

SEQ ID NO: 615478 - RNA, 28 nt, Human
cugccggcggcggagguggcgggggcug

SEQ ID NO: 615479 - RNA, 24 nt, Human
cuguccaaaaucaaagugcugagg

SEQ ID NO: 615480 - RNA, 20 nt, Human
cuuucuggcccuggcccuaa

SEQ ID NO: 615481 - RNA, 19 nt, Human
gaacuaggacagucccaca

SEQ ID NO: 615482 - RNA, 23 nt, Human
gaacucgcgggcuuugcccccag

SEQ ID NO: 615483 - RNA, 18 nt, Human
gaagacacaguggggcug

SEQ ID NO: 615484 - RNA, 18 nt, Human
gaauggaucucaggcaga

SEQ ID NO: 615485 - RNA, 27 nt, Human
gagccaaaaccaaccauauccaagaga

SEQ ID NO: 615486 - RNA, 18 nt, Human
gcccaggacagacugcgg

SEQ ID NO: 615487 - RNA, 18 nt, Human
gggugguggcugugcggc

SEQ ID NO: 615488 - RNA, 20 nt, Human
gggugguggcugugcggcug

SEQ ID NO: 615489 - RNA, 19 nt, Human
gguggcgggggcuggggcu

SEQ ID NO: 615490 - RNA, 23 nt, Human
gguggcugugcggcugccggcgg

SEQ ID NO: 615491 - RNA, 18 nt, Human
gugaaaugagccaaaacc

SEQ ID NO: 615492 - RNA, 21 nt, Human
gugcugccaccugguggggga

SEQ ID NO: 615493 - RNA, 20 nt, Human
uaauguagcaggaggcugga

SEQ ID NO: 615494 - RNA, 21 nt, Human
uaccuugucccuguccaaaau

SEQ ID NO: 615495 - RNA, 25 nt, Human
ucagaaacaccccacccccacccca

SEQ ID NO: 615496 - RNA, 22 nt, Human
uccaaaaucaaagugcugaggc

SEQ ID NO: 615497 - RNA, 24 nt, Human
ucccaucccauuccagcuuuccca

SEQ ID NO: 615498 - RNA, 19 nt, Human
ucccauuccagcuuuccca

SEQ ID NO: 615499 - RNA, 23 nt, Human
ucccuguccaaaaucaaagugcu

SEQ ID NO: 615500 - RNA, 27 nt, Human
uccuuugcaagcugacaaagcaaggau

SEQ ID NO: 615501 - RNA, 25 nt, Human
ucuggcccuggcccuaauccuaaac

SEQ ID NO: 615502 - RNA, 22 nt, Human
ugaaaugagccaaaaccaacca

SEQ ID NO: 615503 - RNA, 23 nt, Human
ugagccaaaaccaaccauaucca

SEQ ID NO: 615504 - RNA, 22 nt, Human
ugcggaagacacaguggggcug

SEQ ID NO: 615505 - RNA, 19 nt, Human
uggcccuggcccuaauccu

SEQ ID NO: 615506 - RNA, 22 nt, Human
ugucccuguccaaaaucaaagu

SEQ ID NO: 615507 - RNA, 21 nt, Human
ugugaaaugagccaaaaccaa

SEQ ID NO: 615508 - RNA, 19 nt, Human
aaaaguaucccacgaagag

SEQ ID NO: 615509 - RNA, 18 nt, Human
aaccaacucugcugacac

SEQ ID NO: 615510 - RNA, 20 nt, Human
aaccacaauuacuuuugcac

SEQ ID NO: 615511 - RNA, 19 nt, Human
aagagacaaugucuacuca

SEQ ID NO: 615512 - RNA, 21 nt, Human
aagcuuuuuaaggggccaaca

SEQ ID NO: 615513 - RNA, 24 nt, Human
aauggucuaauuauuaaguccauu

SEQ ID NO: 615514 - RNA, 24 nt, Human
acaaaacauucccaagcuuuuuaa

SEQ ID NO: 615515 - RNA, 26 nt, Human
agccacaagauauuaggaaacagaca

SEQ ID NO: 615516 - RNA, 22 nt, Human
agccuccagaaggaaccaacuc

SEQ ID NO: 615517 - RNA, 19 nt, Human
agggaaaggccgugugaac

SEQ ID NO: 615518 - RNA, 23 nt, Human
caaaacauucccaagcuuuuuaa

SEQ ID NO: 615519 - RNA, 24 nt, Human
cacuuuguuucucauaaguauaua

SEQ ID NO: 615520 - RNA, 20 nt, Human
cauacaaaacauucccaagc

SEQ ID NO: 615521 - RNA, 20 nt, Human
ccuccagaaggaaccaacuc

SEQ ID NO: 615522 - RNA, 23 nt, Human
cugucugcaauacuuggacaaga

SEQ ID NO: 615523 - RNA, 21 nt, Human
cuuggacaagauuuguccaga

SEQ ID NO: 615524 - RNA, 21 nt, Human
gaauacaaacuuacuuggaac

SEQ ID NO: 615525 - RNA, 23 nt, Human
gagaagacagagggaaaggccgu

SEQ ID NO: 615526 - RNA, 22 nt, Human
gcugucugcaauacuuggacaa

SEQ ID NO: 615527 - RNA, 20 nt, Human
ggaauuagugaaagagcuuc

SEQ ID NO: 615528 - RNA, 24 nt, Human
gguaaugaagagaagacagaggga

SEQ ID NO: 615529 - RNA, 20 nt, Human
uaaaaaaaacuaauguaauu

SEQ ID NO: 615530 - RNA, 22 nt, Human
uaagcaacuuuucaaucaagaa

SEQ ID NO: 615531 - RNA, 24 nt, Human
uagaaugucuguuuauggauucuu

SEQ ID NO: 615532 - RNA, 21 nt, Human
uagauuguaaacaauaaccaa

SEQ ID NO: 615533 - RNA, 23 nt, Human
uagcuuuauuuaaucccacauua

SEQ ID NO: 615534 - RNA, 18 nt, Human
uauaauaaaaaaaaucua

SEQ ID NO: 615535 - RNA, 23 nt, Human
uaucccacgaagagacaaugucu

SEQ ID NO: 615536 - RNA, 21 nt, Human
uauggaagcccugggaagcua

SEQ ID NO: 615537 - RNA, 23 nt, Human
ucuccagacacaaucacccuaga

SEQ ID NO: 615538 - RNA, 23 nt, Human
ucuuuguaaacauaauuaagggu

SEQ ID NO: 615539 - RNA, 20 nt, Human
ugaaaaguaucccacgaaga

SEQ ID NO: 615540 - RNA, 20 nt, Human
ugaaagagcuucaucauuuc

SEQ ID NO: 615541 - RNA, 18 nt, Human
ugaacacagaggcagaga

SEQ ID NO: 615542 - RNA, 22 nt, Human
ugaacacagaggcagagacugg

SEQ ID NO: 615543 - RNA, 23 nt, Human
ugaagagaagacagagggaaagg

SEQ ID NO: 615544 - RNA, 23 nt, Human
ugaagcauacccaguuuuaauaa

SEQ ID NO: 615545 - RNA, 20 nt, Human
ugcaauacuuggacaagauu

SEQ ID NO: 615546 - RNA, 19 nt, Human
uggaacaugggucuuugua

SEQ ID NO: 615547 - RNA, 18 nt, Human
ugggaagcuaauacaaua

SEQ ID NO: 615548 - RNA, 21 nt, Human
uguccagaagccaaagaacuc

SEQ ID NO: 615549 - RNA, 19 nt, Human
uguuuauggauucuuccuu

SEQ ID NO: 615550 - RNA, 21 nt, Human
uuagcuuuauuuaaucccaca

SEQ ID NO: 615551 - RNA, 21 nt, Human
uuauaaucaauacaauuuguc

SEQ ID NO: 615552 - RNA, 20 nt, Human
uucucaguucuuugccacuu

SEQ ID NO: 615553 - RNA, 23 nt, Human
uuggacaagauuuguccagaagc

SEQ ID NO: 615554 - RNA, 22 nt, Human
uuucacaguucgaaauaucacu

SEQ ID NO: 615555 - RNA, 24 nt, Human
aaaaaaaaaaagaauguaagagaa

SEQ ID NO: 615556 - RNA, 23 nt, Human
aaaaaaaaaagaauguaagagaa

SEQ ID NO: 615557 - RNA, 23 nt, Human
aaaaaaaacaggaggaggaugag

SEQ ID NO: 615558 - RNA, 21 nt, Human
aaaaaaaagaauguaagagaa

SEQ ID NO: 615559 - RNA, 21 nt, Human
aaaaaaaagaauguaagagaa

SEQ ID NO: 615560 - RNA, 22 nt, Human
aaaaaaaagaauguaagagaaa

SEQ ID NO: 615561 - RNA, 20 nt, Human
aaaacaggaggaggaugagc

SEQ ID NO: 615562 - RNA, 25 nt, Human
aaacaggaaaaaaaaaaaggggacc

SEQ ID NO: 615563 - RNA, 23 nt, Human
aaacaggaggaggaugagcagaa

SEQ ID NO: 615564 - RNA, 22 nt, Human
aagagccaccacuguggccacc

SEQ ID NO: 615565 - RNA, 22 nt, Human
aagaugaagcagauguccagaa

SEQ ID NO: 615566 - RNA, 19 nt, Human
aagcaaaucauaauaaugc

SEQ ID NO: 615567 - RNA, 18 nt, Human
acaagacuagccgcaaag

SEQ ID NO: 615568 - RNA, 19 nt, Human
acaguagaucccugauacu

SEQ ID NO: 615569 - RNA, 21 nt, Human
accccaucaaaaaaaaaauua

SEQ ID NO: 615570 - RNA, 22 nt, Human
accccaucaaaaaaaaaauuaa

SEQ ID NO: 615571 - RNA, 19 nt, Human
accuugggaguugcacauu

SEQ ID NO: 615572 - RNA, 21 nt, Human
agaagagauucuuuaccugaa

SEQ ID NO: 615573 - RNA, 23 nt, Human
agagaaaaaaaaaaacaggagga

SEQ ID NO: 615574 - RNA, 19 nt, Human
aggaagguagaaauuaaga

SEQ ID NO: 615575 - RNA, 19 nt, Human
auggaagacaugggaagaa

SEQ ID NO: 615576 - RNA, 22 nt, Human
augggaagaagcaaaucauaau

SEQ ID NO: 615577 - RNA, 24 nt, Human
auuuauaaauacaagauuuacaca

SEQ ID NO: 615578 - RNA, 23 nt, Human
caaauaucuacauauauuucaua

SEQ ID NO: 615579 - RNA, 21 nt, Human
caacgaggcugucuccguaac

SEQ ID NO: 615580 - RNA, 24 nt, Human
cagagauggcguaugcagaauccc

SEQ ID NO: 615581 - RNA, 18 nt, Human
cagcaccccaucaaaaaa

SEQ ID NO: 615582 - RNA, 21 nt, Human
cagcaccccaucaaaaaaaaa

SEQ ID NO: 615583 - RNA, 20 nt, Human
caugaagucaccaggggugu

SEQ ID NO: 615584 - RNA, 18 nt, Human
ccaccagcacaacgaggc

SEQ ID NO: 615585 - RNA, 18 nt, Human
ccagaagagccaccacug

SEQ ID NO: 615586 - RNA, 25 nt, Human
cccauccagcaccaugaagucacca

SEQ ID NO: 615587 - RNA, 20 nt, Human
ccuacaaucucuauguugcc

SEQ ID NO: 615588 - RNA, 20 nt, Human
cucaaaaaauagcaagacac

SEQ ID NO: 615589 - RNA, 19 nt, Human
cuguucugugccuucugcu

SEQ ID NO: 615590 - RNA, 24 nt, Human
gaagagccaccacuguggccacca

SEQ ID NO: 615591 - RNA, 20 nt, Human
gacaccagguccaggaaucu

SEQ ID NO: 615592 - RNA, 20 nt, Human
gagaagcaggacauggaaga

SEQ ID NO: 615593 - RNA, 20 nt, Human
gaggcugucuccguaacugg

SEQ ID NO: 615594 - RNA, 23 nt, Human
gcccuaguuaaugguccauuuac

SEQ ID NO: 615595 - RNA, 18 nt, Human
gggaguugcacauuauuu

SEQ ID NO: 615596 - RNA, 23 nt, Human
gugcagcaaaauacauauaaauc

SEQ ID NO: 615597 - RNA, 18 nt, Human
uaaaaggagacuagguuu

SEQ ID NO: 615598 - RNA, 24 nt, Human
uaaauguauucagucaguacacaa

SEQ ID NO: 615599 - RNA, 24 nt, Human
uaacagaaaacgugaccgagaaga

SEQ ID NO: 615600 - RNA, 23 nt, Human
uaacuggcagaaagauaugcucc

SEQ ID NO: 615601 - RNA, 22 nt, Human
uaaguuuguaaugaaaauuucu

SEQ ID NO: 615602 - RNA, 20 nt, Human
uacucagagcaguuaaggca

SEQ ID NO: 615603 - RNA, 21 nt, Human
uacucagagcaguuaaggcag

SEQ ID NO: 615604 - RNA, 19 nt, Human
uaggaagcuuaaccuaaaa

SEQ ID NO: 615605 - RNA, 23 nt, Human
uaggaagcuuaaccuaaaaacca

SEQ ID NO: 615606 - RNA, 24 nt, Human
uauguuaucucuguucauagcaga

SEQ ID NO: 615607 - RNA, 28 nt, Human
ucaaaaaauagcaagacacuuaucguga

SEQ ID NO: 615608 - RNA, 26 nt, Human
ucaccagggguguggcucccuccaug

SEQ ID NO: 615609 - RNA, 21 nt, Human
ucagagcaguuaaggcaggag

SEQ ID NO: 615610 - RNA, 20 nt, Human
ucaggcagagauucuggaac

SEQ ID NO: 615611 - RNA, 25 nt, Human
uccauaaaacaucucaaaaaauagc

SEQ ID NO: 615612 - RNA, 20 nt, Human
ugaagcagauguccagaaga

SEQ ID NO: 615613 - RNA, 26 nt, Human
ugaagcagauguccagaagagccacc

SEQ ID NO: 615614 - RNA, 20 nt, Human
ugaagucaccaggggugugg

SEQ ID NO: 615615 - RNA, 24 nt, Human
ugaauugaaaacaaaugcauacuc

SEQ ID NO: 615616 - RNA, 22 nt, Human
ugacaagacuagccgcaaaggu

SEQ ID NO: 615617 - RNA, 19 nt, Human
ugcugaaaagggcauggaa

SEQ ID NO: 615618 - RNA, 20 nt, Human
uggacccaaccaggacacca

SEQ ID NO: 615619 - RNA, 22 nt, Human
ugggaagaagcaaaucauaaua

SEQ ID NO: 615620 - RNA, 25 nt, Human
uuaaacagauugaaauaaagaugaa

SEQ ID NO: 615621 - RNA, 23 nt, Human
uuaaccuaaaaaccaauagcaua

SEQ ID NO: 615622 - RNA, 18 nt, Human
uuacacagcaccccauca

SEQ ID NO: 615623 - RNA, 25 nt, Human
uucaaaauauauuuucuuuuaaaug

SEQ ID NO: 615624 - RNA, 20 nt, Human
uucucaggcagagauucugg

SEQ ID NO: 615625 - RNA, 20 nt, Human
aaaccaacagagauggagag

SEQ ID NO: 615626 - RNA, 21 nt, Human
aaaguccccaugucuugggga

SEQ ID NO: 615627 - RNA, 19 nt, Human
acagagacagacaaaccaa

SEQ ID NO: 615628 - RNA, 24 nt, Human
acagagacagacaaaccaacagag

SEQ ID NO: 615629 - RNA, 21 nt, Human
acgagggggcaaggucgaggc

SEQ ID NO: 615630 - RNA, 22 nt, Human
agacagacaaaccaacagagag

SEQ ID NO: 615631 - RNA, 22 nt, Human
agccaaaugcccccuuccccua

SEQ ID NO: 615632 - RNA, 19 nt, Human
aggccacagccuagaccag

SEQ ID NO: 615633 - RNA, 22 nt, Human
aggccacagccuagaccagccc

SEQ ID NO: 615634 - RNA, 19 nt, Human
agggaccucaggcucagga

SEQ ID NO: 615635 - RNA, 19 nt, Human
aggggggauucgagggcag

SEQ ID NO: 615636 - RNA, 21 nt, Human
agucuauucuaguguuugggg

SEQ ID NO: 615637 - RNA, 20 nt, Human
auuucggcuauauccauuuu

SEQ ID NO: 615638 - RNA, 18 nt, Human
cacagccuagaccagccc

SEQ ID NO: 615639 - RNA, 21 nt, Human
caggagucucucccuagauuu

SEQ ID NO: 615640 - RNA, 22 nt, Human
cagggggcaucuacccuggucc

SEQ ID NO: 615641 - RNA, 25 nt, Human
caguguccaccaccucccacucaga

SEQ ID NO: 615642 - RNA, 21 nt, Human
caugugaugggggugugugca

SEQ ID NO: 615643 - RNA, 18 nt, Human
cauuccagggaccucagg

SEQ ID NO: 615644 - RNA, 21 nt, Human
cccaguguccaccaccuccca

SEQ ID NO: 615645 - RNA, 22 nt, Human
ccccaccucuccagucaggguc

SEQ ID NO: 615646 - RNA, 19 nt, Human
cccccuagccaaaugcccc

SEQ ID NO: 615647 - RNA, 20 nt, Human
ccuggucccucuuucagcac

SEQ ID NO: 615648 - RNA, 18 nt, Human
cgagggggcaaggucgag

SEQ ID NO: 615649 - RNA, 24 nt, Human
cuacccacacucauuccagggacc

SEQ ID NO: 615650 - RNA, 18 nt, Human
cucacugcaaagucccca

SEQ ID NO: 615651 - RNA, 22 nt, Human
cuuacggcuacccacacucauu

SEQ ID NO: 615652 - RNA, 18 nt, Human
gaaaaaggggaaaggcag

SEQ ID NO: 615653 - RNA, 21 nt, Human
gacagagacagacaaaccaac

SEQ ID NO: 615654 - RNA, 20 nt, Human
gagacagacaaaccaacaga

SEQ ID NO: 615655 - RNA, 19 nt, Human
gagggggcaaggucgaggc

SEQ ID NO: 615656 - RNA, 23 nt, Human
gauugggaggaagacagagacag

SEQ ID NO: 615657 - RNA, 21 nt, Human
gcagcgggggcagcgucacuu

SEQ ID NO: 615658 - RNA, 21 nt, Human
gcucacaggggcacccccuag

SEQ ID NO: 615659 - RNA, 24 nt, Human
ggaggcuggguggagggcagggcg

SEQ ID NO: 615660 - RNA, 23 nt, Human
ggauugggaggaagacagagaca

SEQ ID NO: 615661 - RNA, 20 nt, Human
ggcggggaagaucguuaggg

SEQ ID NO: 615662 - RNA, 22 nt, Human
gggcacccccuagccaaaugcc

SEQ ID NO: 615663 - RNA, 23 nt, Human
gggcggggaagaucguuaggguc

SEQ ID NO: 615664 - RNA, 20 nt, Human
ggggaggggggauucgaggg

SEQ ID NO: 615665 - RNA, 24 nt, Human
ggggaggggggauucgagggcagg

SEQ ID NO: 615666 - RNA, 22 nt, Human
ggucccucuuucagcacaggga

SEQ ID NO: 615667 - RNA, 20 nt, Human
gguccuggaaacacugggga

SEQ ID NO: 615668 - RNA, 22 nt, Human
gguuuauuggggguccuggaaa

SEQ ID NO: 615669 - RNA, 21 nt, Human
guccaccaccucccacucaga

SEQ ID NO: 615670 - RNA, 19 nt, Human
guggcccccaccucuccag

SEQ ID NO: 615671 - RNA, 23 nt, Human
uacccacacucauuccagggacc

SEQ ID NO: 615672 - RNA, 21 nt, Human
uacccuggucccucuuucagc

SEQ ID NO: 615673 - RNA, 18 nt, Human
uaccucccucugggcgcc

SEQ ID NO: 615674 - RNA, 18 nt, Human
uagauuugggcuccccug

SEQ ID NO: 615675 - RNA, 21 nt, Human
uccaccaccucccacucagau

SEQ ID NO: 615676 - RNA, 18 nt, Human
uccaggccgaguccagga

SEQ ID NO: 615677 - RNA, 21 nt, Human
uccccugccccagcuaaggac

SEQ ID NO: 615678 - RNA, 19 nt, Human
ucggcuauauccauuuucu

SEQ ID NO: 615679 - RNA, 23 nt, Human
ugcaaaguccccaugucuugggg

SEQ ID NO: 615680 - RNA, 23 nt, Human
uggaaacacuggggagagggacg

SEQ ID NO: 615681 - RNA, 18 nt, Human
uggggagagggacgaggg

SEQ ID NO: 615682 - RNA, 19 nt, Human
uggggagagggacgagggg

SEQ ID NO: 615683 - RNA, 22 nt, Human
uggggguccuggaaacacuggg

SEQ ID NO: 615684 - RNA, 20 nt, Human
ugggggugugugcacauaga

SEQ ID NO: 615685 - RNA, 25 nt, Human
uggggucaccagugacucugguggg

SEQ ID NO: 615686 - RNA, 24 nt, Human
uggguggagggcagggcgcacgca

SEQ ID NO: 615687 - RNA, 18 nt, Human
uggguggcauuuggaggg

SEQ ID NO: 615688 - RNA, 22 nt, Human
uggguuuuugguggcccccacc

SEQ ID NO: 615689 - RNA, 23 nt, Human
ugguggcccccaccucuccaguc

SEQ ID NO: 615690 - RNA, 19 nt, Human
uggugggggugggugccca

SEQ ID NO: 615691 - RNA, 24 nt, Human
uggugggggugggugcccaucuuu

SEQ ID NO: 615692 - RNA, 25 nt, Human
uuccccuagggauugggaggaagac

SEQ ID NO: 615693 - RNA, 20 nt, Human
uugguggcccccaccucucc

SEQ ID NO: 615694 - RNA, 18 nt, Human
uuucagggccugcgucug

SEQ ID NO: 615695 - RNA, 20 nt, Human
uuuucuggggucaccaguga

SEQ ID NO: 615696 - RNA, 23 nt, Human
aaaaaaaaaagcucuugcaaaaa

SEQ ID NO: 615697 - RNA, 22 nt, Human
aaaaaagcucuugcaaaaacca

SEQ ID NO: 615698 - RNA, 21 nt, Human
aaaaccacaaguaaacaacug

SEQ ID NO: 615699 - RNA, 21 nt, Human
aaaaccauccagucccuaagc

SEQ ID NO: 615700 - RNA, 21 nt, Human
aaaguccucugacuagagcca

SEQ ID NO: 615701 - RNA, 24 nt, Human
aacagaaaauuuguuuccccaaaa

SEQ ID NO: 615702 - RNA, 19 nt, Human
aaccacuaccuugacauag

SEQ ID NO: 615703 - RNA, 19 nt, Human
aagaagacaacacgucugc

SEQ ID NO: 615704 - RNA, 24 nt, Human
aaggugccucugcucaucugauuc

SEQ ID NO: 615705 - RNA, 20 nt, Human
aaguagccucuuaauagaaa

SEQ ID NO: 615706 - RNA, 20 nt, Human
acaacaccuuaauuguugac

SEQ ID NO: 615707 - RNA, 21 nt, Human
acugcagugaucuuucaguuc

SEQ ID NO: 615708 - RNA, 18 nt, Human
agaacaucuacauacuga

SEQ ID NO: 615709 - RNA, 18 nt, Human
agaagacaacacgucugc

SEQ ID NO: 615710 - RNA, 23 nt, Human
agacagcuugucagugaagaaga

SEQ ID NO: 615711 - RNA, 22 nt, Human
agacugaaaagccaacaggcau

SEQ ID NO: 615712 - RNA, 25 nt, Human
agagacuauuauuagggagugugcu

SEQ ID NO: 615713 - RNA, 19 nt, Human
agagagggaacagaggggg

SEQ ID NO: 615714 - RNA, 24 nt, Human
agcuggugacccgacaguuccugg

SEQ ID NO: 615715 - RNA, 21 nt, Human
agggagugugcuucacugaca

SEQ ID NO: 615716 - RNA, 20 nt, Human
agggcgagugggcaggaggg

SEQ ID NO: 615717 - RNA, 19 nt, Human
augaguuuuccucaaacca

SEQ ID NO: 615718 - RNA, 21 nt, Human
auucuaguuuugucacaaagg

SEQ ID NO: 615719 - RNA, 21 nt, Human
caacaacaccuuaauuguuga

SEQ ID NO: 615720 - RNA, 23 nt, Human
caagacaguccucauuuccaaau

SEQ ID NO: 615721 - RNA, 23 nt, Human
caauauuagcaguguauccuuuc

SEQ ID NO: 615722 - RNA, 20 nt, Human
cacagaaggcaagaaacugc

SEQ ID NO: 615723 - RNA, 23 nt, Human
cacagaaugaguuuuccucaaac

SEQ ID NO: 615724 - RNA, 19 nt, Human
cacgcuccacagcugguga

SEQ ID NO: 615725 - RNA, 22 nt, Human
cacgcuccacagcuggugaccc

SEQ ID NO: 615726 - RNA, 22 nt, Human
cacuaccaaguagccucuuaau

SEQ ID NO: 615727 - RNA, 25 nt, Human
cagcaaaaccacaaguaaacaacug

SEQ ID NO: 615728 - RNA, 22 nt, Human
cauggcaacacaucugucucuc

SEQ ID NO: 615729 - RNA, 25 nt, Human
cauuuuaucagcguucaacaacacc

SEQ ID NO: 615730 - RNA, 21 nt, Human
ccaauggcagguugucccccc

SEQ ID NO: 615731 - RNA, 21 nt, Human
ccacaaguaaacaacugccug

SEQ ID NO: 615732 - RNA, 21 nt, Human
cccacccccucgggccuuggc

SEQ ID NO: 615733 - RNA, 24 nt, Human
ccccccggcacgcuccacagcugg

SEQ ID NO: 615734 - RNA, 18 nt, Human
cccuaaauaaauacuacc

SEQ ID NO: 615735 - RNA, 19 nt, Human
ccgguggcgaguaccccuc

SEQ ID NO: 615736 - RNA, 19 nt, Human
ccuauauuuuggaaaaaaa

SEQ ID NO: 615737 - RNA, 20 nt, Human
ccucauuuccaaauucuagu

SEQ ID NO: 615738 - RNA, 19 nt, Human
cgcagccgguggcgaguac

SEQ ID NO: 615739 - RNA, 25 nt, Human
cgcccacccccucgggccuuggcuc

SEQ ID NO: 615740 - RNA, 18 nt, Human
cggccgccacgcccaccc

SEQ ID NO: 615741 - RNA, 20 nt, Human
cggccgccacgcccaccccc

SEQ ID NO: 615742 - RNA, 24 nt, Human
cuaaaggugccucugcucaucuga

SEQ ID NO: 615743 - RNA, 21 nt, Human
cucaggccaacucuaaggcac

SEQ ID NO: 615744 - RNA, 19 nt, Human
cucugcucaucugauucuc

SEQ ID NO: 615745 - RNA, 22 nt, Human
cuugcaaaaaccauccaguccc

SEQ ID NO: 615746 - RNA, 19 nt, Human
cuuuaaaaguugggagaug

SEQ ID NO: 615747 - RNA, 23 nt, Human
gaaggcaagaaacugccggcaca

SEQ ID NO: 615748 - RNA, 24 nt, Human
gaagugccugugucuacccuuuuc

SEQ ID NO: 615749 - RNA, 22 nt, Human
gagggcgagugggcaggagggc

SEQ ID NO: 615750 - RNA, 19 nt, Human
gcaaaaaccauccaguccc

SEQ ID NO: 615751 - RNA, 26 nt, Human
gcaaaaccacaaguaaacaacugccu

SEQ ID NO: 615752 - RNA, 19 nt, Human
gcggagggcgagugggcag

SEQ ID NO: 615753 - RNA, 23 nt, Human
gcggccgccacgcccacccccuc

SEQ ID NO: 615754 - RNA, 18 nt, Human
ggagggcgagugggcagg

SEQ ID NO: 615755 - RNA, 24 nt, Human
ggagggcgagugggcaggagggcu

SEQ ID NO: 615756 - RNA, 19 nt, Human
ggauggaagcuacgcggcg

SEQ ID NO: 615757 - RNA, 21 nt, Human
gguaguuuaaaaaaaaaaaaa

SEQ ID NO: 615758 - RNA, 18 nt, Human
ggugaaagaguuaacugc

SEQ ID NO: 615759 - RNA, 18 nt, Human
guagaguuucuaguugac

SEQ ID NO: 615760 - RNA, 22 nt, Human
guaguuuaaaaaaaaaaaaagc

SEQ ID NO: 615761 - RNA, 21 nt, Human
gucugaauuggaucugauugu

SEQ ID NO: 615762 - RNA, 19 nt, Human
gugcagacucugguggaau

SEQ ID NO: 615763 - RNA, 18 nt, Human
guucuggugaugaugguu

SEQ ID NO: 615764 - RNA, 23 nt, Human
uaaauacuaccacauuauuucuu

SEQ ID NO: 615765 - RNA, 25 nt, Human
uaacauggcaacacaucugucucuc

SEQ ID NO: 615766 - RNA, 20 nt, Human
uaccacauuauuucuucuaa

SEQ ID NO: 615767 - RNA, 24 nt, Human
uacuaccacauuauuucuucuaaa

SEQ ID NO: 615768 - RNA, 18 nt, Human
uacuagcuugagcuacua

SEQ ID NO: 615769 - RNA, 21 nt, Human
uacuauggauucaacacacag

SEQ ID NO: 615770 - RNA, 19 nt, Human
uagagccaucgugcuucuc

SEQ ID NO: 615771 - RNA, 22 nt, Human
uaucagcguucaacaacaccuu

SEQ ID NO: 615772 - RNA, 23 nt, Human
uauggauucaacacacagaauga

SEQ ID NO: 615773 - RNA, 21 nt, Human
ucagcguucaacaacaccuua

SEQ ID NO: 615774 - RNA, 21 nt, Human
ucagugcaagacugaaucaag

SEQ ID NO: 615775 - RNA, 23 nt, Human
ucccaaaauuucacaauacuugu

SEQ ID NO: 615776 - RNA, 21 nt, Human
ucccgcauuuuuaaaaggccc

SEQ ID NO: 615777 - RNA, 22 nt, Human
ucugaggugcagacucuggugg

SEQ ID NO: 615778 - RNA, 24 nt, Human
ucugauuguucuccuguuacacag

SEQ ID NO: 615779 - RNA, 22 nt, Human
ugaagaagacaacacgucugca

SEQ ID NO: 615780 - RNA, 18 nt, Human
ugacuaaguaacauggca

SEQ ID NO: 615781 - RNA, 22 nt, Human
ugacuaaguaacauggcaacac

SEQ ID NO: 615782 - RNA, 20 nt, Human
ugagaucauguaagcugcug

SEQ ID NO: 615783 - RNA, 27 nt, Human
ugccauguuuccuacuaaagucugagg

SEQ ID NO: 615784 - RNA, 18 nt, Human
uggaauagugacacagaa

SEQ ID NO: 615785 - RNA, 19 nt, Human
ugucccaaaauuucacaau

SEQ ID NO: 615786 - RNA, 21 nt, Human
ugugcugugugcauguguguu

SEQ ID NO: 615787 - RNA, 22 nt, Human
uucaaagccccuuugaaauugc

SEQ ID NO: 615788 - RNA, 19 nt, Human
uucacagaaggcaagaaac

SEQ ID NO: 615789 - RNA, 22 nt, Human
uucucagccacaccaaucuuuc

SEQ ID NO: 615790 - RNA, 22 nt, Human
uugaaauugcaauagugcagca

SEQ ID NO: 615791 - RNA, 19 nt, Human
uugcagccucuuccagaac

SEQ ID NO: 615792 - RNA, 26 nt, Human
uugcagccucuuccagaacaguuucc

SEQ ID NO: 615793 - RNA, 19 nt, Human
uuucacugauggaaugugg

SEQ ID NO: 615794 - RNA, 22 nt, Human
aaacaggcaacuggcacaagca

SEQ ID NO: 615795 - RNA, 18 nt, Human
aaaccaaggccaacagcu

SEQ ID NO: 615796 - RNA, 18 nt, Human
aacuggcacaagcagcaa

SEQ ID NO: 615797 - RNA, 19 nt, Human
aacugggugccuggcccag

SEQ ID NO: 615798 - RNA, 24 nt, Human
aagaaaacaagaaagaggaauuca

SEQ ID NO: 615799 - RNA, 24 nt, Human
aagaaagaggaauucaaggagaaa

SEQ ID NO: 615800 - RNA, 18 nt, Human
aagcagcaagcugaggca

SEQ ID NO: 615801 - RNA, 20 nt, Human
aaggauggaaggggagaaag

SEQ ID NO: 615802 - RNA, 20 nt, Human
aagugcuagaaucaaacacu

SEQ ID NO: 615803 - RNA, 20 nt, Human
acaaccaggaaagaaaacaa

SEQ ID NO: 615804 - RNA, 24 nt, Human
acacaccuccaggggccugcuggg

SEQ ID NO: 615805 - RNA, 23 nt, Human
agaaggagcaggucuggagggga

SEQ ID NO: 615806 - RNA, 19 nt, Human
agacaggccccagagccuc

SEQ ID NO: 615807 - RNA, 24 nt, Human
agagaagcgugacaggggccugag

SEQ ID NO: 615808 - RNA, 19 nt, Human
agagagguccccuggcccu

SEQ ID NO: 615809 - RNA, 20 nt, Human
agcagggagaaggagcaggu

SEQ ID NO: 615810 - RNA, 18 nt, Human
agcagguuggggugggga

SEQ ID NO: 615811 - RNA, 18 nt, Human
agcaucaugcccgaauag

SEQ ID NO: 615812 - RNA, 23 nt, Human
aggaaagaaaacaagaaagagga

SEQ ID NO: 615813 - RNA, 22 nt, Human
aggcccagcagcacaacagcuc

SEQ ID NO: 615814 - RNA, 18 nt, Human
agggagaaggagcagguc

SEQ ID NO: 615815 - RNA, 21 nt, Human
aggggagggaggggccacgcu

SEQ ID NO: 615816 - RNA, 21 nt, Human
aggggccugagccaguggggg

SEQ ID NO: 615817 - RNA, 19 nt, Human
auggggagccagagaccua

SEQ ID NO: 615818 - RNA, 25 nt, Human
auucaaggagaaauaccauggugag

SEQ ID NO: 615819 - RNA, 25 nt, Human
caaagagagguccccuggcccugcc

SEQ ID NO: 615820 - RNA, 27 nt, Human
caaagcgagugggaccacccacauacc

SEQ ID NO: 615821 - RNA, 22 nt, Human
caaagggaggcccagcagcaca

SEQ ID NO: 615822 - RNA, 23 nt, Human
caaagggaggcccagcagcacaa

SEQ ID NO: 615823 - RNA, 20 nt, Human
caaccagggacucaggccca

SEQ ID NO: 615824 - RNA, 19 nt, Human
caaggccaacagcuccugc

SEQ ID NO: 615825 - RNA, 21 nt, Human
cacccgcuuucccuacagccc

SEQ ID NO: 615826 - RNA, 25 nt, Human
cacgcugccccucugggcuugcuca

SEQ ID NO: 615827 - RNA, 27 nt, Human
cagcacaacagcucacccgcuuucccu

SEQ ID NO: 615828 - RNA, 18 nt, Human
cagcuaaggcucuggggu

SEQ ID NO: 615829 - RNA, 22 nt, Human
cagcugagauagggugcucacg

SEQ ID NO: 615830 - RNA, 22 nt, Human
caggcccagggacugacaacag

SEQ ID NO: 615831 - RNA, 21 nt, Human
ccaaagcgagugggaccaccc

SEQ ID NO: 615832 - RNA, 21 nt, Human
ccaggucagaaacgugggcac

SEQ ID NO: 615833 - RNA, 21 nt, Human
ccauuccuguccaaccaggga

SEQ ID NO: 615834 - RNA, 23 nt, Human
ccauuccuguccaaccagggacu

SEQ ID NO: 615835 - RNA, 23 nt, Human
cccacacagggccggugagggaa

SEQ ID NO: 615836 - RNA, 21 nt, Human
ccucuacaaagcaucaugccc

SEQ ID NO: 615837 - RNA, 26 nt, Human
ccugccagggguaugacagcagcaac

SEQ ID NO: 615838 - RNA, 18 nt, Human
cggggcaggaaaagggga

SEQ ID NO: 615839 - RNA, 22 nt, Human
cuacccucuacaaagcaucaug

SEQ ID NO: 615840 - RNA, 24 nt, Human
cucaagggaaagauggagagccua

SEQ ID NO: 615841 - RNA, 22 nt, Human
cucuuccucccuggaaaaguca

SEQ ID NO: 615842 - RNA, 18 nt, Human
cugugcaaaccaaggcca

SEQ ID NO: 615843 - RNA, 21 nt, Human
cuguggugccugagcagguug

SEQ ID NO: 615844 - RNA, 21 nt, Human
cuuccucccuggaaaagucac

SEQ ID NO: 615845 - RNA, 22 nt, Human
cuuccucccuggaaaagucacu

SEQ ID NO: 615846 - RNA, 21 nt, Human
gaaaggacagagaugaccaaa

SEQ ID NO: 615847 - RNA, 19 nt, Human
gacaacaguggcagcacca

SEQ ID NO: 615848 - RNA, 23 nt, Human
gacaggccccagagccucagccc

SEQ ID NO: 615849 - RNA, 20 nt, Human
gagauagagggcuugguggg

SEQ ID NO: 615850 - RNA, 18 nt, Human
gagggaaagggggaccca

SEQ ID NO: 615851 - RNA, 24 nt, Human
gcagcagccagugaaaagggcgcc

SEQ ID NO: 615852 - RNA, 21 nt, Human
gcucacccgcuuucccuacag

SEQ ID NO: 615853 - RNA, 23 nt, Human
ggacggggcaggaaaaggggagg

SEQ ID NO: 615854 - RNA, 24 nt, Human
ggacucaggcccagggacugacag

SEQ ID NO: 615855 - RNA, 23 nt, Human
ggagaaggagcaggucuggaggg

SEQ ID NO: 615856 - RNA, 21 nt, Human
ggagggaggggccacgcugcc

SEQ ID NO: 615857 - RNA, 21 nt, Human
ggcaggaaaaggggagggagg

SEQ ID NO: 615858 - RNA, 20 nt, Human
gggagggggccagggguuga

SEQ ID NO: 615859 - RNA, 22 nt, Human
gggcacagagaagcgugacagg

SEQ ID NO: 615860 - RNA, 21 nt, Human
ggggagggggccagggguuga

SEQ ID NO: 615861 - RNA, 23 nt, Human
ggggcaggaaaaggggagggagg

SEQ ID NO: 615862 - RNA, 18 nt, Human
gggguggggagccagcuc

SEQ ID NO: 615863 - RNA, 19 nt, Human
gguggcacugguaaagaaa

SEQ ID NO: 615864 - RNA, 18 nt, Human
gucuuccuggggcagcag

SEQ ID NO: 615865 - RNA, 22 nt, Human
gugccugagcagguuggggugg

SEQ ID NO: 615866 - RNA, 22 nt, Human
uaaacaugcaacaggcacccac

SEQ ID NO: 615867 - RNA, 26 nt, Human
uaaacgaagccucugggaagucagga

SEQ ID NO: 615868 - RNA, 18 nt, Human
uacggggagggggccagg

SEQ ID NO: 615869 - RNA, 18 nt, Human
uagaaggagauagagggc

SEQ ID NO: 615870 - RNA, 19 nt, Human
uagcagcugagauagggug

SEQ ID NO: 615871 - RNA, 18 nt, Human
ucccuacagcccuacccg

SEQ ID NO: 615872 - RNA, 22 nt, Human
ucuguggugccugagcagguug

SEQ ID NO: 615873 - RNA, 24 nt, Human
ucuguggugccugagcagguuggg

SEQ ID NO: 615874 - RNA, 22 nt, Human
ugacaacaguggcagcaccagg

SEQ ID NO: 615875 - RNA, 25 nt, Human
ugacaacaguggcagcaccagguca

SEQ ID NO: 615876 - RNA, 21 nt, Human
ugagcagggagaaggagcagg

SEQ ID NO: 615877 - RNA, 20 nt, Human
uggaaggggagaaaggagug

SEQ ID NO: 615878 - RNA, 18 nt, Human
uggcacaagcagcaagcu

SEQ ID NO: 615879 - RNA, 19 nt, Human
ugggaccacccacauacca

SEQ ID NO: 615880 - RNA, 18 nt, Human
uggggcagcagccaguga

SEQ ID NO: 615881 - RNA, 21 nt, Human
uggugaguaggggagggggcu

SEQ ID NO: 615882 - RNA, 19 nt, Human
uguggguccagguaugggg

SEQ ID NO: 615883 - RNA, 20 nt, Human
uuccucccuggaaaagucac

SEQ ID NO: 615884 - RNA, 18 nt, Human
aaagacugaaaaaaauuu

SEQ ID NO: 615885 - RNA, 19 nt, Human
aaagauggugagucaaaca

SEQ ID NO: 615886 - RNA, 21 nt, Human
aacugagcugcuaaaaccaaa

SEQ ID NO: 615887 - RNA, 20 nt, Human
aagagucaguggcucagaga

SEQ ID NO: 615888 - RNA, 23 nt, Human
aagaucgugccacugcacuccag

SEQ ID NO: 615889 - RNA, 22 nt, Human
aaucucauuucuuugaaugugg

SEQ ID NO: 615890 - RNA, 23 nt, Human
aaugaaaaaaagacucaaaaucu

SEQ ID NO: 615891 - RNA, 18 nt, Human
aauugcuugagccuggga

SEQ ID NO: 615892 - RNA, 24 nt, Human
aauugcuugagccugggaggcaga

SEQ ID NO: 615893 - RNA, 20 nt, Human
acaaaacgggaugcacaucu

SEQ ID NO: 615894 - RNA, 24 nt, Human
acaccaaaaguacuuaaaagaagc

SEQ ID NO: 615895 - RNA, 22 nt, Human
accauacugcagauaacaaaaa

SEQ ID NO: 615896 - RNA, 24 nt, Human
acugcacuccagucugcguugaca

SEQ ID NO: 615897 - RNA, 25 nt, Human
acugcacuccagucugcguugacag

SEQ ID NO: 615898 - RNA, 20 nt, Human
agaaguuguagugagcuaag

SEQ ID NO: 615899 - RNA, 24 nt, Human
aggcagaaguuguagugagcuaag

SEQ ID NO: 615900 - RNA, 22 nt, Human
aggcaggagaauugcuugagcc

SEQ ID NO: 615901 - RNA, 24 nt, Human
aggcaggagaauugcuugagccug

SEQ ID NO: 615902 - RNA, 21 nt, Human
aggcugaggcaggagaauugc

SEQ ID NO: 615903 - RNA, 24 nt, Human
aggcugaggcaggagaauugcuug

SEQ ID NO: 615904 - RNA, 24 nt, Human
aguggcucgcaccuauaaucccag

SEQ ID NO: 615905 - RNA, 24 nt, Human
aucgugccacugcacuccagucug

SEQ ID NO: 615906 - RNA, 20 nt, Human
auggugcuuuuaaugaagua

SEQ ID NO: 615907 - RNA, 28 nt, Human
caacauacaccaaaaguacuuaaaagaa

SEQ ID NO: 615908 - RNA, 20 nt, Human
cacacucuuaacuaaaaccc

SEQ ID NO: 615909 - RNA, 18 nt, Human
caccuauaaucccagcua

SEQ ID NO: 615910 - RNA, 24 nt, Human
caccuauaaucccagcuacucagg

SEQ ID NO: 615911 - RNA, 18 nt, Human
cacugcacuccagucugc

SEQ ID NO: 615912 - RNA, 20 nt, Human
cacugcacuccagucugcgu

SEQ ID NO: 615913 - RNA, 25 nt, Human
cacugcacuccagucugcguugaca

SEQ ID NO: 615914 - RNA, 25 nt, Human
cacugcacuccagucugcguugaca

SEQ ID NO: 615915 - RNA, 19 nt, Human
cagaaguuguagugagcua

SEQ ID NO: 615916 - RNA, 24 nt, Human
cagcuacucaggaggcugaggcag

SEQ ID NO: 615917 - RNA, 18 nt, Human
cagcuguuuccagguuua

SEQ ID NO: 615918 - RNA, 18 nt, Human
ccaaauuaaaacuaccag

SEQ ID NO: 615919 - RNA, 18 nt, Human
ccacugcacuccagucug

SEQ ID NO: 615920 - RNA, 18 nt, Human
ccacugcacuccagucug

SEQ ID NO: 615921 - RNA, 19 nt, Human
ccacugcacuccagucugc

SEQ ID NO: 615922 - RNA, 26 nt, Human
ccacugcacuccagucugcguugacc

SEQ ID NO: 615923 - RNA, 20 nt, Human
cccaaauuaaaacuaccagc

SEQ ID NO: 615924 - RNA, 21 nt, Human
ccuauaaucccagcuacucag

SEQ ID NO: 615925 - RNA, 19 nt, Human
ccucucuaaaaaaaaaaaa

SEQ ID NO: 615926 - RNA, 21 nt, Human
gacagaauuuacaaauacaga

SEQ ID NO: 615927 - RNA, 19 nt, Human
gacauccucaguaacuuuu

SEQ ID NO: 615928 - RNA, 23 nt, Human
gagaauugcuugagccugggagg

SEQ ID NO: 615929 - RNA, 21 nt, Human
gagucaaacaaaacauacaaa

SEQ ID NO: 615930 - RNA, 20 nt, Human
gcuaagaucgugccacugca

SEQ ID NO: 615931 - RNA, 19 nt, Human
gcuugagccugggaggcag

SEQ ID NO: 615932 - RNA, 27 nt, Human
ggaaacauuaaaaaaaaaaaaaaaaaa

SEQ ID NO: 615933 - RNA, 24 nt, Human
gggcgcaguggcucgcaccuauaa

SEQ ID NO: 615934 - RNA, 18 nt, Human
gguuacaaugaaaaaaag

SEQ ID NO: 615935 - RNA, 18 nt, Human
gguugcaguuuuguaguc

SEQ ID NO: 615936 - RNA, 18 nt, Human
uaaaaagagaacuuuaaa

SEQ ID NO: 615937 - RNA, 20 nt, Human
uaaaauaacugaggcugggc

SEQ ID NO: 615938 - RNA, 24 nt, Human
uaggauaucacugugaucuuaaaa

SEQ ID NO: 615939 - RNA, 21 nt, Human
uagugagucugcauaugugua

SEQ ID NO: 615940 - RNA, 19 nt, Human
uauaaucccagcuacucag

SEQ ID NO: 615941 - RNA, 18 nt, Human
uauggaauaguaaaacug

SEQ ID NO: 615942 - RNA, 23 nt, Human
ucaagaaaauauaugcaauugcc

SEQ ID NO: 615943 - RNA, 21 nt, Human
ucaauaaaaauccgaaggguu

SEQ ID NO: 615944 - RNA, 23 nt, Human
ucaauacuuucaaaccuccuuua

SEQ ID NO: 615945 - RNA, 24 nt, Human
ucacacucuuaacuaaaacccaaa

SEQ ID NO: 615946 - RNA, 20 nt, Human
ucagaagagucaguggcuca

SEQ ID NO: 615947 - RNA, 20 nt, Human
uccagguuuacauaagauga

SEQ ID NO: 615948 - RNA, 23 nt, Human
ucgugccacugcacuccagucug

SEQ ID NO: 615949 - RNA, 18 nt, Human
ucucuaaaaaaaaaaaag

SEQ ID NO: 615950 - RNA, 24 nt, Human
ucucuaaaaaaaaaaaagacugaa

SEQ ID NO: 615951 - RNA, 26 nt, Human
ucucuaaaaaaaaaaaagacugaaaa

SEQ ID NO: 615952 - RNA, 24 nt, Human
ugaaaaaaagacucaaaaucuauu

SEQ ID NO: 615953 - RNA, 18 nt, Human
ugaaagacagaauuuaca

SEQ ID NO: 615954 - RNA, 19 nt, Human
ugaaauuucugaaaagcga

SEQ ID NO: 615955 - RNA, 30 nt, Human
ugacagagacccucucuaaaaaaaaaaaaa

SEQ ID NO: 615956 - RNA, 24 nt, Human
ugagccugggaggcagaaguugua

SEQ ID NO: 615957 - RNA, 22 nt, Human
ugagcuaagaucgugccacugc

SEQ ID NO: 615958 - RNA, 24 nt, Human
ugaggcaggagaauugcuugagcc

SEQ ID NO: 615959 - RNA, 25 nt, Human
ugaggcaggagaauugcuugagccu

SEQ ID NO: 615960 - RNA, 23 nt, Human
ugagggaaugacaaaacgggaag

SEQ ID NO: 615961 - RNA, 24 nt, Human
ugccacugcacuccagucugcguu

SEQ ID NO: 615962 - RNA, 23 nt, Human
ugcuaaaaccaaaguaguaaaca

SEQ ID NO: 615963 - RNA, 25 nt, Human
uggccggaaaacgcaggcucgcgcc

SEQ ID NO: 615964 - RNA, 22 nt, Human
uggcucagagauguuuaguuuc

SEQ ID NO: 615965 - RNA, 22 nt, Human
uggcucgcaccuauaaucccag

SEQ ID NO: 615966 - RNA, 24 nt, Human
ugggaggcagaaguuguagugagc

SEQ ID NO: 615967 - RNA, 25 nt, Human
uggggaaacauuaaaaaaaaaaaaa

SEQ ID NO: 615968 - RNA, 18 nt, Human
ugguaacuucucacccuc

SEQ ID NO: 615969 - RNA, 22 nt, Human
ugguacaagaaucagguagaug

SEQ ID NO: 615970 - RNA, 21 nt, Human
uguaacauacacccaugugua

SEQ ID NO: 615971 - RNA, 24 nt, Human
uguuaaaucuaaagagucuguaac

SEQ ID NO: 615972 - RNA, 20 nt, Human
uuaaaaaaaaaaaaaaaaaa

SEQ ID NO: 615973 - RNA, 20 nt, Human
uugaaagacagaauuuacaa

SEQ ID NO: 615974 - RNA, 24 nt, Human
uugagccugggaggcagaaguugu

SEQ ID NO: 615975 - RNA, 18 nt, Human
uugcuugagccugggagg

SEQ ID NO: 615976 - RNA, 25 nt, Human
uugcuugagccugggaggcagaagu

SEQ ID NO: 615977 - RNA, 21 nt, Human
uuguagugagcuaagaucgug

SEQ ID NO: 615978 - RNA, 22 nt, Human
uuuaaaaaauuugaagauagga

SEQ ID NO: 615979 - RNA, 25 nt, Human
uuuaaaauauacauaaacuuaauac

SEQ ID NO: 615980 - RNA, 18 nt, Human
uuucagaagagucagugg

SEQ ID NO: 615981 - RNA, 21 nt, Human
uuuucuguuaaaucuaaagag

SEQ ID NO: 615982 - RNA, 23 nt, Human
acaagccucaucccagcccugcc

SEQ ID NO: 615983 - RNA, 20 nt, Human
acagagagcaggugggcaca

SEQ ID NO: 615984 - RNA, 26 nt, Human
accagggaaacgggguggggguuggc

SEQ ID NO: 615985 - RNA, 21 nt, Human
acccuggagucccugggaaau

SEQ ID NO: 615986 - RNA, 19 nt, Human
agacagccaccucagggaa

SEQ ID NO: 615987 - RNA, 21 nt, Human
agaccugaccucagagagacc

SEQ ID NO: 615988 - RNA, 19 nt, Human
agaggacugcagaccccag

SEQ ID NO: 615989 - RNA, 20 nt, Human
agcaccggagucacgguggg

SEQ ID NO: 615990 - RNA, 22 nt, Human
agcagcuccccauccugaccuc

SEQ ID NO: 615991 - RNA, 19 nt, Human
agcccugcccuuguggcug

SEQ ID NO: 615992 - RNA, 22 nt, Human
agcguguccagcagcuccugcu

SEQ ID NO: 615993 - RNA, 22 nt, Human
agcugggugggggauggguugg

SEQ ID NO: 615994 - RNA, 21 nt, Human
aggaagagcacggcaccggug

SEQ ID NO: 615995 - RNA, 18 nt, Human
aggagaggcugcuaggca

SEQ ID NO: 615996 - RNA, 24 nt, Human
aggagaggcugcuaggcagcuccc

SEQ ID NO: 615997 - RNA, 19 nt, Human
aggaggccuuggaaaagcc

SEQ ID NO: 615998 - RNA, 22 nt, Human
aggcaggaguuggggucgucaa

SEQ ID NO: 615999 - RNA, 22 nt, Human
aggccccagcccagaaaaccaa

SEQ ID NO: 616000 - RNA, 24 nt, Human
aggccccagcccagaaaaccaaga

SEQ ID NO: 616001 - RNA, 19 nt, Human
agggccccacccaccuucc

SEQ ID NO: 616002 - RNA, 19 nt, Human
agggcgcuguuggcgcugg

SEQ ID NO: 616003 - RNA, 23 nt, Human
agugggaggggaagggagaacgg

SEQ ID NO: 616004 - RNA, 18 nt, Human
auccugaccucagggccu

SEQ ID NO: 616005 - RNA, 20 nt, Human
caagccucaucccagcccug

SEQ ID NO: 616006 - RNA, 23 nt, Human
cagcagaggcaagagaucaguga

SEQ ID NO: 616007 - RNA, 18 nt, Human
cagcagccggggcagcug

SEQ ID NO: 616008 - RNA, 18 nt, Human
cagcagcuccccauccug

SEQ ID NO: 616009 - RNA, 19 nt, Human
cagccaggcugaggcccuu

SEQ ID NO: 616010 - RNA, 22 nt, Human
cagcccagaaaaccaagagcuu

SEQ ID NO: 616011 - RNA, 21 nt, Human
cagcccuuucggaggcccccc

SEQ ID NO: 616012 - RNA, 20 nt, Human
cagcucugaggcucgggcca

SEQ ID NO: 616013 - RNA, 19 nt, Human
cagugagcugccaaaugga

SEQ ID NO: 616014 - RNA, 24 nt, Human
ccaccaacccccaguggugccaag

SEQ ID NO: 616015 - RNA, 19 nt, Human
cccacagccaggcugaggc

SEQ ID NO: 616016 - RNA, 20 nt, Human
cccacggugcagggccccac

SEQ ID NO: 616017 - RNA, 23 nt, Human
cccagcccugccuaggccccagc

SEQ ID NO: 616018 - RNA, 21 nt, Human
ccccaaaggcagcagcucccc

SEQ ID NO: 616019 - RNA, 20 nt, Human
ccccacacccccuaggcacc

SEQ ID NO: 616020 - RNA, 22 nt, Human
ccccacacccccuaggcaccug

SEQ ID NO: 616021 - RNA, 22 nt, Human
ccccacggugcagggccccacc

SEQ ID NO: 616022 - RNA, 18 nt, Human
ccccagcccagaaaacca

SEQ ID NO: 616023 - RNA, 22 nt, Human
ccccaguggugccaagucaaau

SEQ ID NO: 616024 - RNA, 24 nt, Human
cccccaaggcccuccugggaggcc

SEQ ID NO: 616025 - RNA, 23 nt, Human
ccccuaggcaccugccaucgguu

SEQ ID NO: 616026 - RNA, 26 nt, Human
cccggcuccagcccugcccuuguggc

SEQ ID NO: 616027 - RNA, 20 nt, Human
cccugccuaggccccagccc

SEQ ID NO: 616028 - RNA, 19 nt, Human
cccuugggggagagguggg

SEQ ID NO: 616029 - RNA, 20 nt, Human
cccuugggggagaggugggu

SEQ ID NO: 616030 - RNA, 19 nt, Human
ccuaggccccagcccagaa

SEQ ID NO: 616031 - RNA, 23 nt, Human
ccugccaucgguuguccuuugga

SEQ ID NO: 616032 - RNA, 22 nt, Human
ccuuuggaggaagccaccuccc

SEQ ID NO: 616033 - RNA, 19 nt, Human
cgaggagaggcugcuaggc

SEQ ID NO: 616034 - RNA, 22 nt, Human
cgaggccugggcgcucuccagg

SEQ ID NO: 616035 - RNA, 21 nt, Human
cgguuguccuuuggaggaagc

SEQ ID NO: 616036 - RNA, 23 nt, Human
cucagaccugaccucagagagac

SEQ ID NO: 616037 - RNA, 24 nt, Human
cuccaggggugcugucugcccccu

SEQ ID NO: 616038 - RNA, 21 nt, Human
cuccccuccugcccgaggaga

SEQ ID NO: 616039 - RNA, 21 nt, Human
cugacuccagcccuuucggag

SEQ ID NO: 616040 - RNA, 21 nt, Human
cugcaugugugcacacaagga

SEQ ID NO: 616041 - RNA, 20 nt, Human
cugcccccugcucucugucc

SEQ ID NO: 616042 - RNA, 21 nt, Human
cugcccccugcucucuguccc

SEQ ID NO: 616043 - RNA, 20 nt, Human
cuggccuggguccagguggg

SEQ ID NO: 616044 - RNA, 18 nt, Human
cugggaggccucaggacc

SEQ ID NO: 616045 - RNA, 19 nt, Human
cugggaggccucaggaccc

SEQ ID NO: 616046 - RNA, 21 nt, Human
cuguccgcccuuuccacagug

SEQ ID NO: 616047 - RNA, 22 nt, Human
gaagccaccuccccuccugccc

SEQ ID NO: 616048 - RNA, 23 nt, Human
gagcugccaaauggagggggugg

SEQ ID NO: 616049 - RNA, 19 nt, Human
gagcugggugggggauggg

SEQ ID NO: 616050 - RNA, 19 nt, Human
gagcugggugggggauggg

SEQ ID NO: 616051 - RNA, 20 nt, Human
gcagccggggcagcuggucg

SEQ ID NO: 616052 - RNA, 22 nt, Human
gcagccggggcagcuggucggc

SEQ ID NO: 616053 - RNA, 19 nt, Human
gcccugccuaggccccagc

SEQ ID NO: 616054 - RNA, 24 nt, Human
gcuccagcccugcccuuguggcug

SEQ ID NO: 616055 - RNA, 19 nt, Human
gcugcuaggcagcucccca

SEQ ID NO: 616056 - RNA, 24 nt, Human
ggacggccgggagcuggguggggg

SEQ ID NO: 616057 - RNA, 20 nt, Human
ggagcugggugggggauggg

SEQ ID NO: 616058 - RNA, 20 nt, Human
ggcaaacagcaccggaguca

SEQ ID NO: 616059 - RNA, 19 nt, Human
ggccaggggacggcaaaca

SEQ ID NO: 616060 - RNA, 24 nt, Human
ggccgggcagggcagagggugccu

SEQ ID NO: 616061 - RNA, 21 nt, Human
ggcgcgugggcgugguucagg

SEQ ID NO: 616062 - RNA, 23 nt, Human
ggcugaggcccuugggggagagg

SEQ ID NO: 616063 - RNA, 20 nt, Human
ggcugggccuggugcucugu

SEQ ID NO: 616064 - RNA, 20 nt, Human
gggaaacgggguggggguug

SEQ ID NO: 616065 - RNA, 18 nt, Human
gggacggcaaacagcacc

SEQ ID NO: 616066 - RNA, 23 nt, Human
gggcagacuccaccauccuggcc

SEQ ID NO: 616067 - RNA, 20 nt, Human
gggcagagggugccuggggc

SEQ ID NO: 616068 - RNA, 23 nt, Human
gggcagcuggucggccagcgugu

SEQ ID NO: 616069 - RNA, 21 nt, Human
ggggguggggacggcgagaag

SEQ ID NO: 616070 - RNA, 20 nt, Human
gggguggggguuggcauugg

SEQ ID NO: 616071 - RNA, 21 nt, Human
ggucaaugaggaugcugaggu

SEQ ID NO: 616072 - RNA, 19 nt, Human
gguggggguuguacaagcc

SEQ ID NO: 616073 - RNA, 22 nt, Human
gguggguggccuccagggaacu

SEQ ID NO: 616074 - RNA, 19 nt, Human
gguggucccugucccuuga

SEQ ID NO: 616075 - RNA, 23 nt, Human
gucagggauggcccggccccucc

SEQ ID NO: 616076 - RNA, 19 nt, Human
gugcugucugcccccugcu

SEQ ID NO: 616077 - RNA, 20 nt, Human
gugcugucugcccccugcuc

SEQ ID NO: 616078 - RNA, 25 nt, Human
guggcugcugguccugggagccugc

SEQ ID NO: 616079 - RNA, 21 nt, Human
guggguggccuccagggaacu

SEQ ID NO: 616080 - RNA, 20 nt, Human
uagcgcaguccagccccacg

SEQ ID NO: 616081 - RNA, 24 nt, Human
uaggcaccugccaucgguuguccu

SEQ ID NO: 616082 - RNA, 26 nt, Human
uaggccccagcccagaaaaccaagag

SEQ ID NO: 616083 - RNA, 23 nt, Human
ucacacggccucucccaccaacc

SEQ ID NO: 616084 - RNA, 19 nt, Human
ucagcgccugcagcaccga

SEQ ID NO: 616085 - RNA, 24 nt, Human
ucaggacccuggagucccugggaa

SEQ ID NO: 616086 - RNA, 22 nt, Human
ucagugagcugccaaauggagg

SEQ ID NO: 616087 - RNA, 22 nt, Human
uccaccauccuggccaggggac

SEQ ID NO: 616088 - RNA, 19 nt, Human
uccagguggugccuggucu

SEQ ID NO: 616089 - RNA, 18 nt, Human
ucccagcccugccuaggc

SEQ ID NO: 616090 - RNA, 21 nt, Human
uccccccgaccccauuugccc

SEQ ID NO: 616091 - RNA, 23 nt, Human
ucccugggaaauugguggugggg

SEQ ID NO: 616092 - RNA, 21 nt, Human
ucgccgggccgggccuggccu

SEQ ID NO: 616093 - RNA, 23 nt, Human
ucggaggccccccaucaggaggc

SEQ ID NO: 616094 - RNA, 18 nt, Human
ucgggccagcagccgggg

SEQ ID NO: 616095 - RNA, 23 nt, Human
ucggggcagcgcgggucaaugag

SEQ ID NO: 616096 - RNA, 24 nt, Human
ucucugggcaccagggaaacgggg

SEQ ID NO: 616097 - RNA, 18 nt, Human
ucugaggcucgggccagc

SEQ ID NO: 616098 - RNA, 23 nt, Human
ucugaggcucgggccagcagccg

SEQ ID NO: 616099 - RNA, 18 nt, Human
ucugcuaggaggacucca

SEQ ID NO: 616100 - RNA, 21 nt, Human
ugacagcgugcuggguguugg

SEQ ID NO: 616101 - RNA, 21 nt, Human
ugaccagggcgcuguuggcgc

SEQ ID NO: 616102 - RNA, 22 nt, Human
ugaccagggcgcuguuggcgcu

SEQ ID NO: 616103 - RNA, 20 nt, Human
ugagcagacagcugaggacc

SEQ ID NO: 616104 - RNA, 20 nt, Human
ugaggcccuugggggagagg

SEQ ID NO: 616105 - RNA, 21 nt, Human
ugagguggucccugucccuug

SEQ ID NO: 616106 - RNA, 20 nt, Human
ugcagcaccgaggccugggc

SEQ ID NO: 616107 - RNA, 19 nt, Human
ugccccaguccccccgagg

SEQ ID NO: 616108 - RNA, 18 nt, Human
ugcccgaggagaggcugc

SEQ ID NO: 616109 - RNA, 22 nt, Human
ugcccgaggagaggcugcuagg

SEQ ID NO: 616110 - RNA, 21 nt, Human
ugccggggcacagggugggug

SEQ ID NO: 616111 - RNA, 23 nt, Human
ugcugucugcccccugcucucuu

SEQ ID NO: 616112 - RNA, 23 nt, Human
uggaggauacuggccucagaccu

SEQ ID NO: 616113 - RNA, 20 nt, Human
uggcagccccagcugcccca

SEQ ID NO: 616114 - RNA, 21 nt, Human
uggcagccccagugcugacga

SEQ ID NO: 616115 - RNA, 20 nt, Human
uggccgggcagggcagaggg

SEQ ID NO: 616116 - RNA, 19 nt, Human
uggcugcugguccugggag

SEQ ID NO: 616117 - RNA, 25 nt, Human
ugggagggcuggaggauacuggccu

SEQ ID NO: 616118 - RNA, 18 nt, Human
uggggacggcgagaaggc

SEQ ID NO: 616119 - RNA, 19 nt, Human
uggggacggcgagaaggcg

SEQ ID NO: 616120 - RNA, 21 nt, Human
uggggccacccagcccacagc

SEQ ID NO: 616121 - RNA, 19 nt, Human
uggggguuggcauugggag

SEQ ID NO: 616122 - RNA, 22 nt, Human
uggggguuguacaagccucauc

SEQ ID NO: 616123 - RNA, 23 nt, Human
uggguccccaaaggcagcagcuc

SEQ ID NO: 616124 - RNA, 22 nt, Human
uggguggccuccagggaacugg

SEQ ID NO: 616125 - RNA, 18 nt, Human
ugggugggggauggguug

SEQ ID NO: 616126 - RNA, 23 nt, Human
uggucccugucccuugaccacuc

SEQ ID NO: 616127 - RNA, 22 nt, Human
uggugguggggguuguacaagc

SEQ ID NO: 616128 - RNA, 25 nt, Human
ugugugcacacaaggaguggggaug

SEQ ID NO: 616129 - RNA, 19 nt, Human
uuagcgcaguccagcccca

SEQ ID NO: 616130 - RNA, 22 nt, Human
uuggcgcuggcagccccagugc

SEQ ID NO: 616131 - RNA, 19 nt, Human
aacugaacagugaacugaa

SEQ ID NO: 616132 - RNA, 22 nt, Human
aggagaaagaaaaucaagcuag

SEQ ID NO: 616133 - RNA, 24 nt, Human
auugaacuagguuaaauaaugauc

SEQ ID NO: 616134 - RNA, 21 nt, Human
caauaaacaaaauaaauagau

SEQ ID NO: 616135 - RNA, 19 nt, Human
cauucuauaacacgaggcu

SEQ ID NO: 616136 - RNA, 20 nt, Human
ccccgcguacacugccccuc

SEQ ID NO: 616137 - RNA, 21 nt, Human
cccgcguacacugccccuccg

SEQ ID NO: 616138 - RNA, 23 nt, Human
cccgcguacacugccccuccgcg

SEQ ID NO: 616139 - RNA, 24 nt, Human
cgcguacacugccccuccgcgagc

SEQ ID NO: 616140 - RNA, 24 nt, Human
cuagguuaaauaaugaucuuuccc

SEQ ID NO: 616141 - RNA, 23 nt, Human
gcguacacugccccuccgcgagc

SEQ ID NO: 616142 - RNA, 22 nt, Human
ggagaaagaaaaucaagcuagu

SEQ ID NO: 616143 - RNA, 23 nt, Human
guaugauuauuuuauuauuuuaa

SEQ ID NO: 616144 - RNA, 19 nt, Human
uaaacugaacagugaacug

SEQ ID NO: 616145 - RNA, 18 nt, Human
uaagauaaauuacugacu

SEQ ID NO: 616146 - RNA, 26 nt, Human
uaaugaucuuucccccuuagaucaau

SEQ ID NO: 616147 - RNA, 19 nt, Human
uauaacacgaggcuagacu

SEQ ID NO: 616148 - RNA, 22 nt, Human
ucagccuuuuaacucugugaaa

SEQ ID NO: 616149 - RNA, 28 nt, Human
ucuauaacacgaggcuagaccggggucc

SEQ ID NO: 616150 - RNA, 24 nt, Human
ugcaaguucauucuauaacacgag

SEQ ID NO: 616151 - RNA, 26 nt, Human
aacacaggaguccugacucccagaca

SEQ ID NO: 616152 - RNA, 18 nt, Human
aauuggaccggucagggu

SEQ ID NO: 616153 - RNA, 23 nt, Human
acaggaguccugacucccagaca

SEQ ID NO: 616154 - RNA, 22 nt, Human
acccugucucccuccaggucac

SEQ ID NO: 616155 - RNA, 20 nt, Human
acuggagucagggccaccca

SEQ ID NO: 616156 - RNA, 18 nt, Human
agccuucuuugagcccuc

SEQ ID NO: 616157 - RNA, 20 nt, Human
aggaaaggcugagcuuggug

SEQ ID NO: 616158 - RNA, 19 nt, Human
aggcaaguaacucacccag

SEQ ID NO: 616159 - RNA, 21 nt, Human
aggcaaguaacucacccaggg

SEQ ID NO: 616160 - RNA, 24 nt, Human
aggcugaggaggccucaugggggc

SEQ ID NO: 616161 - RNA, 18 nt, Human
agggagagggaggcuaga

SEQ ID NO: 616162 - RNA, 19 nt, Human
agggagagggaggcuagag

SEQ ID NO: 616163 - RNA, 20 nt, Human
agggagagggaggcuagagg

SEQ ID NO: 616164 - RNA, 18 nt, Human
aguccugacucccagaca

SEQ ID NO: 616165 - RNA, 18 nt, Human
auccuguccucauggaug

SEQ ID NO: 616166 - RNA, 20 nt, Human
caaguaacucacccagggcc

SEQ ID NO: 616167 - RNA, 18 nt, Human
cacaagcugaacagugac

SEQ ID NO: 616168 - RNA, 20 nt, Human
cacagcucagucagggcccc

SEQ ID NO: 616169 - RNA, 23 nt, Human
cacaguguggcuggggcucuugg

SEQ ID NO: 616170 - RNA, 26 nt, Human
cacccugucucccuccaggucaccuc

SEQ ID NO: 616171 - RNA, 18 nt, Human
caccuccaggucacaguu

SEQ ID NO: 616172 - RNA, 18 nt, Human
cagcacccugccuagagg

SEQ ID NO: 616173 - RNA, 20 nt, Human
cagggaaggcaaguaacuca

SEQ ID NO: 616174 - RNA, 22 nt, Human
cagggccccaggaaggagggag

SEQ ID NO: 616175 - RNA, 19 nt, Human
caggucacaguguggcugg

SEQ ID NO: 616176 - RNA, 20 nt, Human
caguuuucuuccugccgagu

SEQ ID NO: 616177 - RNA, 25 nt, Human
caugcuuccggcucuguugcccaca

SEQ ID NO: 616178 - RNA, 25 nt, Human
cauuucgcacaccaagaggcugagu

SEQ ID NO: 616179 - RNA, 21 nt, Human
ccacagugcucucuucccacg

SEQ ID NO: 616180 - RNA, 24 nt, Human
ccaccagccuucuuugagcccucc

SEQ ID NO: 616181 - RNA, 21 nt, Human
ccacggcagcacccugccuag

SEQ ID NO: 616182 - RNA, 20 nt, Human
ccaggucaccuccaggucac

SEQ ID NO: 616183 - RNA, 18 nt, Human
ccauugcugcccuccagg

SEQ ID NO: 616184 - RNA, 23 nt, Human
cccacggcagcacccugccuaga

SEQ ID NO: 616185 - RNA, 21 nt, Human
cccagggccacacagcccguc

SEQ ID NO: 616186 - RNA, 20 nt, Human
ccccacugccucacaggccu

SEQ ID NO: 616187 - RNA, 19 nt, Human
ccccccaggcugaggaggc

SEQ ID NO: 616188 - RNA, 24 nt, Human
ccuagaggaugguggcugggccag

SEQ ID NO: 616189 - RNA, 21 nt, Human
ccucaccacagugcucucuuc

SEQ ID NO: 616190 - RNA, 21 nt, Human
ccucccagcagcggcaagaac

SEQ ID NO: 616191 - RNA, 20 nt, Human
ccucuugggggucagagauu

SEQ ID NO: 616192 - RNA, 23 nt, Human
ccugccuucuuggaacccuucug

SEQ ID NO: 616193 - RNA, 27 nt, Human
ccuggcuucugucaaggcggcucugug

SEQ ID NO: 616194 - RNA, 23 nt, Human
cgaagccucggaggaaaggcuga

SEQ ID NO: 616195 - RNA, 21 nt, Human
cuccaggucaccuccaggucc

SEQ ID NO: 616196 - RNA, 19 nt, Human
cucucuucccacggcagca

SEQ ID NO: 616197 - RNA, 24 nt, Human
cuugggccuucaguuuucuuccug

SEQ ID NO: 616198 - RNA, 22 nt, Human
gagcagcaugagauuuuuccau

SEQ ID NO: 616199 - RNA, 21 nt, Human
gcccagagagggugaguggcu

SEQ ID NO: 616200 - RNA, 21 nt, Human
gcccuggcuucugucaaggcg

SEQ ID NO: 616201 - RNA, 21 nt, Human
gcgaagccucggaggaaaggc

SEQ ID NO: 616202 - RNA, 18 nt, Human
gcuggggcucuugggccu

SEQ ID NO: 616203 - RNA, 20 nt, Human
ggcagcacccugccuagagg

SEQ ID NO: 616204 - RNA, 20 nt, Human
ggcaguggugggggaucagg

SEQ ID NO: 616205 - RNA, 22 nt, Human
ggcucugagucacugggucccc

SEQ ID NO: 616206 - RNA, 21 nt, Human
gggaaguuugccuucauucag

SEQ ID NO: 616207 - RNA, 19 nt, Human
gggaaugggcagugguggg

SEQ ID NO: 616208 - RNA, 22 nt, Human
gggaaugggcagugguggggga

SEQ ID NO: 616209 - RNA, 20 nt, Human
guucggggccuacucugucc

SEQ ID NO: 616210 - RNA, 21 nt, Human
uagguagucccuccuccaucc

SEQ ID NO: 616211 - RNA, 23 nt, Human
uaggugccuuacugggaaugggc

SEQ ID NO: 616212 - RNA, 18 nt, Human
ucacccagggccacacag

SEQ ID NO: 616213 - RNA, 18 nt, Human
ucaccuccaggucacagu

SEQ ID NO: 616214 - RNA, 23 nt, Human
ucagggccacccaaacacaggag

SEQ ID NO: 616215 - RNA, 21 nt, Human
uccauugcugcccuccaggga

SEQ ID NO: 616216 - RNA, 23 nt, Human
ucccaaaacccaugcaaagggca

SEQ ID NO: 616217 - RNA, 21 nt, Human
ucccacggcagcacccugccu

SEQ ID NO: 616218 - RNA, 21 nt, Human
ucccauggcuugggguguugg

SEQ ID NO: 616219 - RNA, 26 nt, Human
uccggcucuguugcccacaagcugaa

SEQ ID NO: 616220 - RNA, 19 nt, Human
ucugccauggagcccccca

SEQ ID NO: 616221 - RNA, 26 nt, Human
ucuuccugccgaguggguucaggaag

SEQ ID NO: 616222 - RNA, 22 nt, Human
ucuuugagcccucccuuggcuu

SEQ ID NO: 616223 - RNA, 21 nt, Human
ugacccggggcacgcggucuc

SEQ ID NO: 616224 - RNA, 22 nt, Human
ugaggaggccucaugggggcca

SEQ ID NO: 616225 - RNA, 23 nt, Human
ugauggauggcccagagagggug

SEQ ID NO: 616226 - RNA, 19 nt, Human
ugccauggagccccccagg

SEQ ID NO: 616227 - RNA, 25 nt, Human
ugccauggagccccccaggcugagg

SEQ ID NO: 616228 - RNA, 23 nt, Human
ugcccaagauugggccucuggug

SEQ ID NO: 616229 - RNA, 18 nt, Human
ugcccacaagcugaacag

SEQ ID NO: 616230 - RNA, 23 nt, Human
ugccucacaggccucuugggggu

SEQ ID NO: 616231 - RNA, 24 nt, Human
ugccuggggccacagagcaaacug

SEQ ID NO: 616232 - RNA, 22 nt, Human
ugcgaagccucggaggaaaggc

SEQ ID NO: 616233 - RNA, 22 nt, Human
ugggaaugggcagugguggggg

SEQ ID NO: 616234 - RNA, 21 nt, Human
ugggccucuggugagugacag

SEQ ID NO: 616235 - RNA, 20 nt, Human
ugggguguugggaaguuugc

SEQ ID NO: 616236 - RNA, 22 nt, Human
uggugggggaucagggagaggg

SEQ ID NO: 616237 - RNA, 18 nt, Human
ugucaaggcggcucugug

SEQ ID NO: 616238 - RNA, 18 nt, Human
uguggcuggggcucuugg

SEQ ID NO: 616239 - RNA, 20 nt, Human
uugagcccucccuuggcuuu

SEQ ID NO: 616240 - RNA, 24 nt, Human
uuggugucaggguggcaaagagaa

SEQ ID NO: 616241 - RNA, 23 nt, Human
aaaaagaaaguagaaaaagggac

SEQ ID NO: 616242 - RNA, 22 nt, Human
aaaaagauauauauagcaacca

SEQ ID NO: 616243 - RNA, 18 nt, Human
aaaaagccagggaaaggu

SEQ ID NO: 616244 - RNA, 21 nt, Human
aaacaacugcaaaccauauuu

SEQ ID NO: 616245 - RNA, 19 nt, Human
aaacaauucaucaacagca

SEQ ID NO: 616246 - RNA, 22 nt, Human
aaaccauauuuacauaguaaca

SEQ ID NO: 616247 - RNA, 24 nt, Human
aaagacaagauuccacacaaaaac

SEQ ID NO: 616248 - RNA, 22 nt, Human
aacaauucaucaacagcaaaaa

SEQ ID NO: 616249 - RNA, 22 nt, Human
aaccaaaggccaacuagaucua

SEQ ID NO: 616250 - RNA, 19 nt, Human
aacugccuucuacaagaau

SEQ ID NO: 616251 - RNA, 19 nt, Human
aagaaaaaaacucaaugaa

SEQ ID NO: 616252 - RNA, 24 nt, Human
aagaaaaaaacucaaugaaauucu

SEQ ID NO: 616253 - RNA, 25 nt, Human
aagaaaaaaacucaaugaaauucug

SEQ ID NO: 616254 - RNA, 19 nt, Human
aagauuccacacaaaaaca

SEQ ID NO: 616255 - RNA, 22 nt, Human
aagcaaaggcaaguuuggcuaa

SEQ ID NO: 616256 - RNA, 19 nt, Human
aagcagacacccaaaggca

SEQ ID NO: 616257 - RNA, 21 nt, Human
aagccagggaaaggugggagg

SEQ ID NO: 616258 - RNA, 20 nt, Human
aaggaaaaaagauauauauu

SEQ ID NO: 616259 - RNA, 23 nt, Human
aaugaacacauaaugagcagcac

SEQ ID NO: 616260 - RNA, 24 nt, Human
accaacauaugaaaacuaaggaau

SEQ ID NO: 616261 - RNA, 21 nt, Human
agcaagaaagaccucuuucau

SEQ ID NO: 616262 - RNA, 19 nt, Human
agccacuuaccuccgaccu

SEQ ID NO: 616263 - RNA, 23 nt, Human
aggaaggacaaaaaaaguucaag

SEQ ID NO: 616264 - RNA, 21 nt, Human
aggaaguggcaagcagacacc

SEQ ID NO: 616265 - RNA, 18 nt, Human
aggauaguagagaaguac

SEQ ID NO: 616266 - RNA, 19 nt, Human
aggauaguagagaaguacu

SEQ ID NO: 616267 - RNA, 18 nt, Human
aggcaaggaagaaaaaaa

SEQ ID NO: 616268 - RNA, 24 nt, Human
aggcacgguggcucacgccuguaa

SEQ ID NO: 616269 - RNA, 21 nt, Human
aggcacuguaaaggaaugaua

SEQ ID NO: 616270 - RNA, 20 nt, Human
augaguggggcagaauuaca

SEQ ID NO: 616271 - RNA, 21 nt, Human
auggaauggaggcaaaaagcc

SEQ ID NO: 616272 - RNA, 24 nt, Human
augggacaucaaggaaaaaagaua

SEQ ID NO: 616273 - RNA, 22 nt, Human
caaaacaucacacuuuaaaaag

SEQ ID NO: 616274 - RNA, 24 nt, Human
caacauaugaaaacuaaggaauau

SEQ ID NO: 616275 - RNA, 19 nt, Human
caagcagacacccaaaggc

SEQ ID NO: 616276 - RNA, 24 nt, Human
caagcagacacccaaaggcaagga

SEQ ID NO: 616277 - RNA, 26 nt, Human
cacccaaaggcaaggaagaaaaaaac

SEQ ID NO: 616278 - RNA, 23 nt, Human
cacuguaaaggaaugauaggggg

SEQ ID NO: 616279 - RNA, 19 nt, Human
cagacacccaaaggcaagg

SEQ ID NO: 616280 - RNA, 25 nt, Human
cagcaaaaagaaaguagaaaaauuc

SEQ ID NO: 616281 - RNA, 26 nt, Human
cauaaaaauaaauauacauauaaaua

SEQ ID NO: 616282 - RNA, 20 nt, Human
caucaaggaaaaaagauaua

SEQ ID NO: 616283 - RNA, 23 nt, Human
ccaacauaugaaaacuaaggaau

SEQ ID NO: 616284 - RNA, 18 nt, Human
ccacacaaaaacaacugc

SEQ ID NO: 616285 - RNA, 23 nt, Human
ccacacaaaaacaacugcaaacc

SEQ ID NO: 616286 - RNA, 18 nt, Human
ccccuaaaauaaaaugaa

SEQ ID NO: 616287 - RNA, 24 nt, Human
ccuugaaagucuaaaauaaaccuu

SEQ ID NO: 616288 - RNA, 22 nt, Human
cgacuucuauagccacuuaccu

SEQ ID NO: 616289 - RNA, 21 nt, Human
cgccuguaauccagcacuuug

SEQ ID NO: 616290 - RNA, 19 nt, Human
cggaaagacaagauuccac

SEQ ID NO: 616291 - RNA, 21 nt, Human
cguccucuggguuccgggucc

SEQ ID NO: 616292 - RNA, 21 nt, Human
cuaaagaaaaaauuuuuggac

SEQ ID NO: 616293 - RNA, 24 nt, Human
cuagcaggcagccuuacuguaugc

SEQ ID NO: 616294 - RNA, 23 nt, Human
cucacgccuguaauccagcacuu

SEQ ID NO: 616295 - RNA, 18 nt, Human
cuccuggucuuuaggugg

SEQ ID NO: 616296 - RNA, 20 nt, Human
gaaacaauucaucaacagca

SEQ ID NO: 616297 - RNA, 24 nt, Human
gaagagaaauguauaaaacccagg

SEQ ID NO: 616298 - RNA, 23 nt, Human
gagaaugggacaucaaggaaaaa

SEQ ID NO: 616299 - RNA, 23 nt, Human
gcaaaaagaaaguagaaaaauuc

SEQ ID NO: 616300 - RNA, 18 nt, Human
gccaaagcaagaaagacc

SEQ ID NO: 616301 - RNA, 19 nt, Human
ggaaagacaagauuccaca

SEQ ID NO: 616302 - RNA, 21 nt, Human
ggaaagacaagauuccacaca

SEQ ID NO: 616303 - RNA, 20 nt, Human
ggaguagaaagucuaggucu

SEQ ID NO: 616304 - RNA, 21 nt, Human
ggaguuugaugaaacaguaga

SEQ ID NO: 616305 - RNA, 20 nt, Human
gguaaacaaaugaguggggc

SEQ ID NO: 616306 - RNA, 23 nt, Human
gguggcucacgccuguaauccag

SEQ ID NO: 616307 - RNA, 22 nt, Human
guagaggaaacugccuucuaca

SEQ ID NO: 616308 - RNA, 18 nt, Human
guggggcagaauuacaga

SEQ ID NO: 616309 - RNA, 22 nt, Human
uaaauagacauaugaauaacca

SEQ ID NO: 616310 - RNA, 21 nt, Human
uaacauacauaaaaauaaaua

SEQ ID NO: 616311 - RNA, 24 nt, Human
uaagaaauuuguauaggaggauaa

SEQ ID NO: 616312 - RNA, 23 nt, Human
uaagaagaacccuaaucuauagg

SEQ ID NO: 616313 - RNA, 18 nt, Human
uaaguuuuuaacuauguc

SEQ ID NO: 616314 - RNA, 24 nt, Human
uaaguuuuuaacuaugucagucaa

SEQ ID NO: 616315 - RNA, 20 nt, Human
uacuguaugccucauggaau

SEQ ID NO: 616316 - RNA, 21 nt, Human
uagaagucuaucuggugaaag

SEQ ID NO: 616317 - RNA, 21 nt, Human
uagagaaguacucagugcucu

SEQ ID NO: 616318 - RNA, 18 nt, Human
uagggaaugcucaugucc

SEQ ID NO: 616319 - RNA, 23 nt, Human
uaguagagaaguacucagugcuc

SEQ ID NO: 616320 - RNA, 23 nt, Human
uauagcaaccaacccagaaggcu

SEQ ID NO: 616321 - RNA, 18 nt, Human
uauagggaaugcucaugu

SEQ ID NO: 616322 - RNA, 21 nt, Human
uaugucagucaaauucaauga

SEQ ID NO: 616323 - RNA, 23 nt, Human
uauuccaggaaggacaaaaaaag

SEQ ID NO: 616324 - RNA, 24 nt, Human
uauuccaggaaggacaaaaaaagu

SEQ ID NO: 616325 - RNA, 25 nt, Human
uauuuaggccaggcacgguggcuca

SEQ ID NO: 616326 - RNA, 24 nt, Human
ucacgccuguaauccagcacuuug

SEQ ID NO: 616327 - RNA, 23 nt, Human
ucagccaaagcaagaaagaccuc

SEQ ID NO: 616328 - RNA, 27 nt, Human
ucaucaacagcaaaaagaaaguagaaa

SEQ ID NO: 616329 - RNA, 20 nt, Human
ucccugaaggaggacagguc

SEQ ID NO: 616330 - RNA, 19 nt, Human
ucuagguaacugcaagugu

SEQ ID NO: 616331 - RNA, 22 nt, Human
ucuauagccacuuaccuccgac

SEQ ID NO: 616332 - RNA, 22 nt, Human
ucucagccaaagcaagaaagac

SEQ ID NO: 616333 - RNA, 21 nt, Human
ucugaagcuauuccaggaagg

SEQ ID NO: 616334 - RNA, 22 nt, Human
ucuuaggaaguggcaagcagac

SEQ ID NO: 616335 - RNA, 24 nt, Human
ugaaacaauucaucaacagcaaaa

SEQ ID NO: 616336 - RNA, 23 nt, Human
ugaaagacacuacaauguuagau

SEQ ID NO: 616337 - RNA, 21 nt, Human
ugaaauucugaggcagaggau

SEQ ID NO: 616338 - RNA, 21 nt, Human
ugaagcaaaggcaaguuuggc

SEQ ID NO: 616339 - RNA, 20 nt, Human
ugaauaaccaacauaugaaa

SEQ ID NO: 616340 - RNA, 23 nt, Human
ugaggcagaggaucuaucaacca

SEQ ID NO: 616341 - RNA, 21 nt, Human
ugauagggggaauaauuuaua

SEQ ID NO: 616342 - RNA, 21 nt, Human
ugcaaaccauauuuacauagu

SEQ ID NO: 616343 - RNA, 19 nt, Human
uggaagagaaugggacauc

SEQ ID NO: 616344 - RNA, 18 nt, Human
uggcaagcagacacccaa

SEQ ID NO: 616345 - RNA, 23 nt, Human
uggcucacgccuguaauccagca

SEQ ID NO: 616346 - RNA, 21 nt, Human
ugggaaguggauuguauaugc

SEQ ID NO: 616347 - RNA, 18 nt, Human
uggguuccggguccgccc

SEQ ID NO: 616348 - RNA, 23 nt, Human
uguaaaggaaugauagggggaau

SEQ ID NO: 616349 - RNA, 18 nt, Human
ugugacugcuuacuagca

SEQ ID NO: 616350 - RNA, 24 nt, Human
uuaggccaggcacgguggcucacg

SEQ ID NO: 616351 - RNA, 20 nt, Human
uuccaggaaggacaaaaaaa

SEQ ID NO: 616352 - RNA, 19 nt, Human
uucucuccuggucuuuagg

SEQ ID NO: 616353 - RNA, 21 nt, Human
uugguccuaacaauuuaagaa

SEQ ID NO: 616354 - RNA, 20 nt, Human
uuuaagaaauuuguauagga

SEQ ID NO: 616355 - RNA, 18 nt, Human
uuuuuuuuuuuuuuuuug

SEQ ID NO: 616356 - RNA, 28 nt, Human
uuuuuuuuuuuuuuuuuuuuuuuggggg

SEQ ID NO: 616357 - RNA, 19 nt, Human
aucauuuauacuccaugau

SEQ ID NO: 616358 - RNA, 25 nt, Human
cccgcggcgggggcaacgaggaagc

SEQ ID NO: 616359 - RNA, 20 nt, Human
uaauacaguacaagauauuu

SEQ ID NO: 616360 - RNA, 19 nt, Human
uacaguacaagauauuugu

SEQ ID NO: 616361 - RNA, 19 nt, Human
ucgcgcccgcggcgggggc

SEQ ID NO: 616362 - RNA, 25 nt, Human
ugauuagcaauggauccugucugaa

SEQ ID NO: 616363 - RNA, 19 nt, Human
aagcugagcaucuuggcuc

SEQ ID NO: 616364 - RNA, 18 nt, Human
aauguccuccuacccugg

SEQ ID NO: 616365 - RNA, 21 nt, Human
acagacagccuggaaaaacuc

SEQ ID NO: 616366 - RNA, 23 nt, Human
acagcacugugaaguagcuucga

SEQ ID NO: 616367 - RNA, 24 nt, Human
acccagaacccagcacuuugcccu

SEQ ID NO: 616368 - RNA, 22 nt, Human
auccagaaacccagaacccagc

SEQ ID NO: 616369 - RNA, 22 nt, Human
augaauguccuccuacccuggc

SEQ ID NO: 616370 - RNA, 20 nt, Human
caggauaaagggaggcacug

SEQ ID NO: 616371 - RNA, 20 nt, Human
caggccccuggguuggcacu

SEQ ID NO: 616372 - RNA, 18 nt, Human
caguugccguuguguucc

SEQ ID NO: 616373 - RNA, 21 nt, Human
cauaccugucgccguggcccc

SEQ ID NO: 616374 - RNA, 21 nt, Human
cauuuaauccucucaacagca

SEQ ID NO: 616375 - RNA, 18 nt, Human
cccccaaauccgcaaucg

SEQ ID NO: 616376 - RNA, 19 nt, Human
ccccggacccccggcagcc

SEQ ID NO: 616377 - RNA, 21 nt, Human
cccgucggugagggcgcgggg

SEQ ID NO: 616378 - RNA, 22 nt, Human
cccugcuuccgaggcucccucc

SEQ ID NO: 616379 - RNA, 18 nt, Human
ccucagggacccgucccc

SEQ ID NO: 616380 - RNA, 21 nt, Human
ccuccuacccuggcaaggggc

SEQ ID NO: 616381 - RNA, 21 nt, Human
ccugagcaggaagcuuggcuu

SEQ ID NO: 616382 - RNA, 25 nt, Human
ccuucuucccaccaggucuggaccc

SEQ ID NO: 616383 - RNA, 20 nt, Human
cgcgaauccagaaacccaga

SEQ ID NO: 616384 - RNA, 24 nt, Human
cgcgaauccagaaacccagaaccc

SEQ ID NO: 616385 - RNA, 25 nt, Human
cggcagccuaggccgucccggggca

SEQ ID NO: 616386 - RNA, 22 nt, Human
cgucccggggcaccgcgcgcgg

SEQ ID NO: 616387 - RNA, 19 nt, Human
cgucggugagggcgcgggg

SEQ ID NO: 616388 - RNA, 23 nt, Human
cucccuccugcaaagagcuuuac

SEQ ID NO: 616389 - RNA, 20 nt, Human
cugccuguggucccugguga

SEQ ID NO: 616390 - RNA, 22 nt, Human
cuggugacagcaggugugcucu

SEQ ID NO: 616391 - RNA, 19 nt, Human
cuucuuuaauaccuggggu

SEQ ID NO: 616392 - RNA, 19 nt, Human
gccccggacccccggcagc

SEQ ID NO: 616393 - RNA, 22 nt, Human
gccccggacccccggcagccua

SEQ ID NO: 616394 - RNA, 24 nt, Human
gcgaauccagaaacccagaaccca

SEQ ID NO: 616395 - RNA, 22 nt, Human
gcgcggacggacucacccgagg

SEQ ID NO: 616396 - RNA, 26 nt, Human
ggaaaaacuccucuagggcuugcaga

SEQ ID NO: 616397 - RNA, 18 nt, Human
ggcuugcagacuuagcug

SEQ ID NO: 616398 - RNA, 21 nt, Human
gggaggugccaggccccuggg

SEQ ID NO: 616399 - RNA, 19 nt, Human
ggugaagucacauguguag

SEQ ID NO: 616400 - RNA, 20 nt, Human
gucuggacccgucggugagg

SEQ ID NO: 616401 - RNA, 23 nt, Human
uaggcaucgggauccucagggac

SEQ ID NO: 616402 - RNA, 22 nt, Human
uccagaaacccagaacccagca

SEQ ID NO: 616403 - RNA, 23 nt, Human
uccagaaacccagaacccagcac

SEQ ID NO: 616404 - RNA, 21 nt, Human
ucccaguugccguuguguucc

SEQ ID NO: 616405 - RNA, 22 nt, Human
uccgcaaucgggagaaaaaggc

SEQ ID NO: 616406 - RNA, 19 nt, Human
uccugcaaagagcuuuaca

SEQ ID NO: 616407 - RNA, 24 nt, Human
ucugcagcccggaaugccuggggc

SEQ ID NO: 616408 - RNA, 18 nt, Human
ucugcccccacaggggcu

SEQ ID NO: 616409 - RNA, 19 nt, Human
ugaaacaguguucacucac

SEQ ID NO: 616410 - RNA, 18 nt, Human
ugaagucacauguguagg

SEQ ID NO: 616411 - RNA, 23 nt, Human
ugcuaugucugucugcccccaca

SEQ ID NO: 616412 - RNA, 24 nt, Human
uggcagcaagacaauggaugaugu

SEQ ID NO: 616413 - RNA, 25 nt, Human
ugggguucccugggugaugaauguc

SEQ ID NO: 616414 - RNA, 21 nt, Human
uguguuccccaggcuucacag

SEQ ID NO: 616415 - RNA, 19 nt, Human
uguuucauuuaauccucuc

SEQ ID NO: 616416 - RNA, 22 nt, Human
uuccccaggcuucacagacagc

SEQ ID NO: 616417 - RNA, 22 nt, Human
uucccugggugaugaauguccu

SEQ ID NO: 616418 - RNA, 18 nt, Human
uugagacagggcuggaga

SEQ ID NO: 616419 - RNA, 23 nt, Human
uugagacagggcuggagagaggc

SEQ ID NO: 616420 - RNA, 22 nt, Human
aacucuguggcccuucugccuc

SEQ ID NO: 616421 - RNA, 20 nt, Human
aagcauauguagugauucau

SEQ ID NO: 616422 - RNA, 22 nt, Human
aagcugccacucgcugggagcc

SEQ ID NO: 616423 - RNA, 20 nt, Human
aaguguucaaaguagagaau

SEQ ID NO: 616424 - RNA, 20 nt, Human
aaugugguacauaacauuuc

SEQ ID NO: 616425 - RNA, 18 nt, Human
acccuccccccagccuau

SEQ ID NO: 616426 - RNA, 22 nt, Human
acucaggacccauaacucuucc

SEQ ID NO: 616427 - RNA, 23 nt, Human
aggauuuuuuuuccuuuucaaga

SEQ ID NO: 616428 - RNA, 22 nt, Human
aggcugccacaaaaacucccag

SEQ ID NO: 616429 - RNA, 19 nt, Human
agggaguuccgauuucagg

SEQ ID NO: 616430 - RNA, 23 nt, Human
aggggaaucagcugcccugggcc

SEQ ID NO: 616431 - RNA, 19 nt, Human
aggugaggagggggucggu

SEQ ID NO: 616432 - RNA, 20 nt, Human
agguuugaguucaagggguu

SEQ ID NO: 616433 - RNA, 18 nt, Human
aucacauccacagaagca

SEQ ID NO: 616434 - RNA, 18 nt, Human
aucagcugcccugggccu

SEQ ID NO: 616435 - RNA, 26 nt, Human
caaaggcugccacaaaaacucccagg

SEQ ID NO: 616436 - RNA, 18 nt, Human
caaaguagagaauauccc

SEQ ID NO: 616437 - RNA, 22 nt, Human
caaaguagagaauaucccccag

SEQ ID NO: 616438 - RNA, 19 nt, Human
caacugcuacaauguucag

SEQ ID NO: 616439 - RNA, 19 nt, Human
caccgccugcuuccguccg

SEQ ID NO: 616440 - RNA, 21 nt, Human
cacgcagguggaaguaucugc

SEQ ID NO: 616441 - RNA, 19 nt, Human
cagcugcccugggccugcc

SEQ ID NO: 616442 - RNA, 18 nt, Human
caggcaguguguggcagg

SEQ ID NO: 616443 - RNA, 19 nt, Human
caggcuuuugcccagccag

SEQ ID NO: 616444 - RNA, 22 nt, Human
cagguggaaguaucugccuccc

SEQ ID NO: 616445 - RNA, 21 nt, Human
cagugaaagauggcacaggcu

SEQ ID NO: 616446 - RNA, 25 nt, Human
cagugccaugggaccaaggccuuuc

SEQ ID NO: 616447 - RNA, 21 nt, Human
cauuguagccaugagaugaaa

SEQ ID NO: 616448 - RNA, 25 nt, Human
ccacaaaggcugccacaaaaacucc

SEQ ID NO: 616449 - RNA, 21 nt, Human
ccagucagaccacucccacaa

SEQ ID NO: 616450 - RNA, 22 nt, Human
cccaccuccuacccucccccca

SEQ ID NO: 616451 - RNA, 22 nt, Human
ccccacccagugccaugggacc

SEQ ID NO: 616452 - RNA, 19 nt, Human
ccccagccccacccagugc

SEQ ID NO: 616453 - RNA, 20 nt, Human
cccccagccccacccagugc

SEQ ID NO: 616454 - RNA, 23 nt, Human
cccccagccccacccagugccau

SEQ ID NO: 616455 - RNA, 28 nt, Human
ccccccagccuauagucuaguccgagga

SEQ ID NO: 616456 - RNA, 20 nt, Human
ccccugccggcccacggcca

SEQ ID NO: 616457 - RNA, 22 nt, Human
ccccugccggcccacggccacg

SEQ ID NO: 616458 - RNA, 19 nt, Human
cccgggcggccccucccaa

SEQ ID NO: 616459 - RNA, 22 nt, Human
cccucccaagcugccacucgcu

SEQ ID NO: 616460 - RNA, 19 nt, Human
cccugggccugccagggca

SEQ ID NO: 616461 - RNA, 22 nt, Human
ccgcgucgucgguccucacacc

SEQ ID NO: 616462 - RNA, 22 nt, Human
ccggcaccugaugguccccagg

SEQ ID NO: 616463 - RNA, 22 nt, Human
ccggcgcagcgcggccccuuuu

SEQ ID NO: 616464 - RNA, 19 nt, Human
ccucacaccgccugcuucc

SEQ ID NO: 616465 - RNA, 18 nt, Human
ccucccaccuccuacccu

SEQ ID NO: 616466 - RNA, 20 nt, Human
ccucccaccuccuacccucc

SEQ ID NO: 616467 - RNA, 23 nt, Human
ccuccuacccuccccccagccua

SEQ ID NO: 616468 - RNA, 21 nt, Human
cgccucgccccugccggccca

SEQ ID NO: 616469 - RNA, 25 nt, Human
cgcucaggugccagucugaccgccc

SEQ ID NO: 616470 - RNA, 22 nt, Human
cggccccuuuuauccgcccucc

SEQ ID NO: 616471 - RNA, 20 nt, Human
cuagcacaggccuggagugc

SEQ ID NO: 616472 - RNA, 20 nt, Human
cucaggacccauaacucuuc

SEQ ID NO: 616473 - RNA, 20 nt, Human
cuccuggcuuccuucuacau

SEQ ID NO: 616474 - RNA, 18 nt, Human
cucgcugggagcccugca

SEQ ID NO: 616475 - RNA, 24 nt, Human
cugaccgcccgggcggccccuccc

SEQ ID NO: 616476 - RNA, 22 nt, Human
cuuaaccccuugcucgacaggu

SEQ ID NO: 616477 - RNA, 18 nt, Human
gacccauaacucuuccuc

SEQ ID NO: 616478 - RNA, 19 nt, Human
gaggggccgggcgcccugc

SEQ ID NO: 616479 - RNA, 21 nt, Human
gaugguccccaggaggggccg

SEQ ID NO: 616480 - RNA, 18 nt, Human
gcaagagaacagaacucu

SEQ ID NO: 616481 - RNA, 18 nt, Human
gcccacggccacgacccc

SEQ ID NO: 616482 - RNA, 19 nt, Human
gcccacggccacgacccca

SEQ ID NO: 616483 - RNA, 20 nt, Human
gcccacggccacgaccccag

SEQ ID NO: 616484 - RNA, 23 nt, Human
gcuuucuucuauuuugcuuuuag

SEQ ID NO: 616485 - RNA, 20 nt, Human
ggagaaguguucaaaguaga

SEQ ID NO: 616486 - RNA, 20 nt, Human
ggcacaggcuuuugcccagc

SEQ ID NO: 616487 - RNA, 21 nt, Human
gggaaucagcugcccugggcc

SEQ ID NO: 616488 - RNA, 18 nt, Human
uaaaauucccaacugaca

SEQ ID NO: 616489 - RNA, 18 nt, Human
uaaaauucccaacugaca

SEQ ID NO: 616490 - RNA, 22 nt, Human
uaacauuucaaauauaagugga

SEQ ID NO: 616491 - RNA, 24 nt, Human
uacuguccuagcaaccuggcuacu

SEQ ID NO: 616492 - RNA, 19 nt, Human
uaggggaaucagcugcccu

SEQ ID NO: 616493 - RNA, 21 nt, Human
uauaaguggaaggaucaucag

SEQ ID NO: 616494 - RNA, 22 nt, Human
ucagccgcgcgcgaggugagga

SEQ ID NO: 616495 - RNA, 23 nt, Human
ucccacaaaggcugccacaaaaa

SEQ ID NO: 616496 - RNA, 25 nt, Human
ucccacaaaggcugccacaaaaacc

SEQ ID NO: 616497 - RNA, 22 nt, Human
ucccaccuccuacccucccccc

SEQ ID NO: 616498 - RNA, 23 nt, Human
ucccaccuccuacccucccccca

SEQ ID NO: 616499 - RNA, 24 nt, Human
ucccaccuccuacccuccccccag

SEQ ID NO: 616500 - RNA, 21 nt, Human
ucccagugaaagauggcacag

SEQ ID NO: 616501 - RNA, 20 nt, Human
uccccaggaggggccgggcg

SEQ ID NO: 616502 - RNA, 19 nt, Human
ucuguggcccuucugccuc

SEQ ID NO: 616503 - RNA, 23 nt, Human
ugaacgcuaagaaaaguuuuaau

SEQ ID NO: 616504 - RNA, 18 nt, Human
ugagaaaaauguucaggg

SEQ ID NO: 616505 - RNA, 23 nt, Human
ugccacaaaaacucccagggaac

SEQ ID NO: 616506 - RNA, 21 nt, Human
uggaugcuccaagcagagggc

SEQ ID NO: 616507 - RNA, 19 nt, Human
uggcaggaugaaaaacaua

SEQ ID NO: 616508 - RNA, 19 nt, Human
uggcccuucugccucuuug

SEQ ID NO: 616509 - RNA, 20 nt, Human
ugggagcccugcaggcaccg

SEQ ID NO: 616510 - RNA, 21 nt, Human
uguagauaggauuuuuuuucc

SEQ ID NO: 616511 - RNA, 22 nt, Human
uguggcccuucugccucuuugg

SEQ ID NO: 616512 - RNA, 21 nt, Human
aagaggaagcgggguacagag

SEQ ID NO: 616513 - RNA, 22 nt, Human
aaggagcucuuacagauggacc

SEQ ID NO: 616514 - RNA, 18 nt, Human
aaggcucaggaaggggcc

SEQ ID NO: 616515 - RNA, 24 nt, Human
aauccggacgcucuccugcagcca

SEQ ID NO: 616516 - RNA, 18 nt, Human
acaaagaggugagaacgg

SEQ ID NO: 616517 - RNA, 22 nt, Human
accauggcagugaccaaggagc

SEQ ID NO: 616518 - RNA, 20 nt, Human
agaacacaauucccagaggg

SEQ ID NO: 616519 - RNA, 18 nt, Human
aggaagcgggguacagag

SEQ ID NO: 616520 - RNA, 21 nt, Human
aggagaaggcagcggacaaag

SEQ ID NO: 616521 - RNA, 25 nt, Human
aggcagcggacaaagaggugagaac

SEQ ID NO: 616522 - RNA, 28 nt, Human
aggccggaaccauggcagugaccaagga

SEQ ID NO: 616523 - RNA, 24 nt, Human
agggcuaggcgccgcucggagccu

SEQ ID NO: 616524 - RNA, 24 nt, Human
agucagucaagccugacccagaac

SEQ ID NO: 616525 - RNA, 23 nt, Human
auucacgacugccggccucccuc

SEQ ID NO: 616526 - RNA, 23 nt, Human
caagcucucccaucggacguccu

SEQ ID NO: 616527 - RNA, 24 nt, Human
cacugucccgccgcgaccuagagc

SEQ ID NO: 616528 - RNA, 21 nt, Human
cagcaccgcagggucugcaga

SEQ ID NO: 616529 - RNA, 24 nt, Human
cagcggcggcaacgggggcugcug

SEQ ID NO: 616530 - RNA, 18 nt, Human
caguagagccagacaagc

SEQ ID NO: 616531 - RNA, 24 nt, Human
cagugaccaaggagcucuuacaga

SEQ ID NO: 616532 - RNA, 22 nt, Human
ccagcuccgcccuucccuuccc

SEQ ID NO: 616533 - RNA, 22 nt, Human
ccccgccccacacgcccacugg

SEQ ID NO: 616534 - RNA, 23 nt, Human
ccccgccccgccccacacgccca

SEQ ID NO: 616535 - RNA, 18 nt, Human
cccgccccgccccacacg

SEQ ID NO: 616536 - RNA, 21 nt, Human
cccuccgcaggcgggcuccca

SEQ ID NO: 616537 - RNA, 21 nt, Human
ccuagagccagguuacagggc

SEQ ID NO: 616538 - RNA, 23 nt, Human
ccuauccaucaucaguagagcca

SEQ ID NO: 616539 - RNA, 19 nt, Human
ccucaagaggaagcggggu

SEQ ID NO: 616540 - RNA, 22 nt, Human
ccucaccccagcuccgcccuuc

SEQ ID NO: 616541 - RNA, 18 nt, Human
ccucccagucauucucuc

SEQ ID NO: 616542 - RNA, 21 nt, Human
ccugcaguccucacgcgcgcu

SEQ ID NO: 616543 - RNA, 21 nt, Human
ccugcaguccucacgcgcgcu

SEQ ID NO: 616544 - RNA, 19 nt, Human
ccugccccgccccgccccc

SEQ ID NO: 616545 - RNA, 20 nt, Human
ccugcccugccccgccccgc

SEQ ID NO: 616546 - RNA, 19 nt, Human
ccuguacgcgcugcuaggc

SEQ ID NO: 616547 - RNA, 20 nt, Human
ccuguacgcgcugcuaggca

SEQ ID NO: 616548 - RNA, 18 nt, Human
ccuguggcugggcccaga

SEQ ID NO: 616549 - RNA, 19 nt, Human
ccugugggacugcccuucc

SEQ ID NO: 616550 - RNA, 21 nt, Human
cgaggaaggcugaucuugaga

SEQ ID NO: 616551 - RNA, 21 nt, Human
cgguggcgaggaaggcugauc

SEQ ID NO: 616552 - RNA, 24 nt, Human
cgucaggccggaaccauggcagug

SEQ ID NO: 616553 - RNA, 22 nt, Human
cucccagcaccgcagggucugc

SEQ ID NO: 616554 - RNA, 23 nt, Human
cugccccgccccgccccacacgc

SEQ ID NO: 616555 - RNA, 22 nt, Human
cugccugugggacugcccuucc

SEQ ID NO: 616556 - RNA, 21 nt, Human
cugugcucuccccguggcccc

SEQ ID NO: 616557 - RNA, 26 nt, Human
cuucgcgccgaguggcugugcucucc

SEQ ID NO: 616558 - RNA, 19 nt, Human
gcagggucugcagagcuga

SEQ ID NO: 616559 - RNA, 18 nt, Human
gccccgacuucuucccuc

SEQ ID NO: 616560 - RNA, 19 nt, Human
gccugugggacugcccuuc

SEQ ID NO: 616561 - RNA, 20 nt, Human
ggcaacgggggcugcuggga

SEQ ID NO: 616562 - RNA, 21 nt, Human
ggcagcggcggcaacgggggc

SEQ ID NO: 616563 - RNA, 23 nt, Human
ggccccuuggacccucaccccag

SEQ ID NO: 616564 - RNA, 24 nt, Human
ggcucacccguagauucagucugg

SEQ ID NO: 616565 - RNA, 20 nt, Human
guccugggccccuuggaccc

SEQ ID NO: 616566 - RNA, 18 nt, Human
guggccccugucuccuag

SEQ ID NO: 616567 - RNA, 18 nt, Human
guuacagggcucacccgu

SEQ ID NO: 616568 - RNA, 19 nt, Human
uagagccagguuacagggc

SEQ ID NO: 616569 - RNA, 22 nt, Human
uccaucaucaguagagccagac

SEQ ID NO: 616570 - RNA, 21 nt, Human
ucccagagggcuaggcgccuc

SEQ ID NO: 616571 - RNA, 22 nt, Human
uccccaucaugccucucacuuc

SEQ ID NO: 616572 - RNA, 22 nt, Human
uccggacgcucuccugcagcca

SEQ ID NO: 616573 - RNA, 19 nt, Human
uccugggccccuuggaccc

SEQ ID NO: 616574 - RNA, 19 nt, Human
ucgcgccgaguggcugugc

SEQ ID NO: 616575 - RNA, 21 nt, Human
ucgcgccgaguggcugugcuc

SEQ ID NO: 616576 - RNA, 19 nt, Human
ucggguccugggcggggag

SEQ ID NO: 616577 - RNA, 20 nt, Human
ucucuccccaucaugccucu

SEQ ID NO: 616578 - RNA, 19 nt, Human
ucugcagagcugagaucac

SEQ ID NO: 616579 - RNA, 28 nt, Human
ucuuacagauggaccuguacgcgcugcu

SEQ ID NO: 616580 - RNA, 22 nt, Human
ucuuuccucauuccagggacac

SEQ ID NO: 616581 - RNA, 20 nt, Human
ugaccaaggagcucuuacag

SEQ ID NO: 616582 - RNA, 24 nt, Human
ugagaucacgccggccaaguccug

SEQ ID NO: 616583 - RNA, 22 nt, Human
ugcccugccccgccccgcccca

SEQ ID NO: 616584 - RNA, 22 nt, Human
uguggcugggcccagaaauggg

SEQ ID NO: 616585 - RNA, 19 nt, Human
uuagacccacuaagugccg

SEQ ID NO: 616586 - RNA, 20 nt, Human
uuccagggacaccaaggcuc

SEQ ID NO: 616587 - RNA, 22 nt, Human
uucgcgccgaguggcugugcuc

SEQ ID NO: 616588 - RNA, 19 nt, Human
uuuauuagacccacuaagu

SEQ ID NO: 616589 - RNA, 24 nt, Human
aaagaccaacaaacuaaguaccau

SEQ ID NO: 616590 - RNA, 27 nt, Human
aaagggaaaacuaugucauuucucuca

SEQ ID NO: 616591 - RNA, 22 nt, Human
aaaugcuauaagcuucacagcu

SEQ ID NO: 616592 - RNA, 20 nt, Human
aaccugccagccaacgaaaa

SEQ ID NO: 616593 - RNA, 18 nt, Human
aacucuaccugccccucu

SEQ ID NO: 616594 - RNA, 24 nt, Human
aaggcuccuucauccuucccucca

SEQ ID NO: 616595 - RNA, 22 nt, Human
aaucauggaucaucugagcugu

SEQ ID NO: 616596 - RNA, 22 nt, Human
aaugucaacuuucuuaagcagc

SEQ ID NO: 616597 - RNA, 18 nt, Human
agaguacaguagccaagg

SEQ ID NO: 616598 - RNA, 20 nt, Human
agcagaccauuucuuuccug

SEQ ID NO: 616599 - RNA, 22 nt, Human
agcagccccaauguccaaccaa

SEQ ID NO: 616600 - RNA, 18 nt, Human
aucaugaauucuaacuug

SEQ ID NO: 616601 - RNA, 21 nt, Human
augaccacauccuuccaauca

SEQ ID NO: 616602 - RNA, 24 nt, Human
auuuuuuuuuuuuuuuuuuuuggc

SEQ ID NO: 616603 - RNA, 25 nt, Human
auuuuuuuuuuuuuuuuuuuugggg

SEQ ID NO: 616604 - RNA, 21 nt, Human
caaccugccagccaacgaaaa

SEQ ID NO: 616605 - RNA, 24 nt, Human
caagugaaaauucuuucuucuuuc

SEQ ID NO: 616606 - RNA, 22 nt, Human
caaucaaaggcuauccucaauc

SEQ ID NO: 616607 - RNA, 18 nt, Human
cacuuccacagguuggga

SEQ ID NO: 616608 - RNA, 22 nt, Human
cauccuucccuccaggaacucu

SEQ ID NO: 616609 - RNA, 20 nt, Human
ccaauguccaaccaagugaa

SEQ ID NO: 616610 - RNA, 23 nt, Human
ccacauccuuccaaucauggauc

SEQ ID NO: 616611 - RNA, 23 nt, Human
ccagccuuaacuucugaaaccgg

SEQ ID NO: 616612 - RNA, 19 nt, Human
ccggagaaagaaagacauc

SEQ ID NO: 616613 - RNA, 26 nt, Human
ccuaaagaccaacaaacuaaguacca

SEQ ID NO: 616614 - RNA, 19 nt, Human
ccuccucaagcuguaagag

SEQ ID NO: 616615 - RNA, 24 nt, Human
ccucugagauagauauugagucuu

SEQ ID NO: 616616 - RNA, 22 nt, Human
ccugccagccaacgaaaauggg

SEQ ID NO: 616617 - RNA, 25 nt, Human
cgcuagagaaacugucauaaccuaa

SEQ ID NO: 616618 - RNA, 25 nt, Human
cuccaggaacucuaccugccccucu

SEQ ID NO: 616619 - RNA, 18 nt, Human
cucuucgcuuugauugga

SEQ ID NO: 616620 - RNA, 20 nt, Human
cugugccacuucacacugac

SEQ ID NO: 616621 - RNA, 22 nt, Human
cuuggugaugaccacauccuuc

SEQ ID NO: 616622 - RNA, 25 nt, Human
cuuuccaaagucauuccacgacaaa

SEQ ID NO: 616623 - RNA, 19 nt, Human
gaaaaagauucuuuuagaa

SEQ ID NO: 616624 - RNA, 22 nt, Human
gaacagguaugacugccucccc

SEQ ID NO: 616625 - RNA, 18 nt, Human
gaacucuaccugccccuc

SEQ ID NO: 616626 - RNA, 24 nt, Human
gaagucuuuccaaagucauuccac

SEQ ID NO: 616627 - RNA, 24 nt, Human
gacugccuccccauaaaccaguau

SEQ ID NO: 616628 - RNA, 21 nt, Human
gagaaagaaagacaucuuggu

SEQ ID NO: 616629 - RNA, 19 nt, Human
ggaaaacacuucaggucug

SEQ ID NO: 616630 - RNA, 22 nt, Human
ggaaaacuaugucauuucucuc

SEQ ID NO: 616631 - RNA, 24 nt, Human
ggaacucuaccugccccucuacuc

SEQ ID NO: 616632 - RNA, 22 nt, Human
ggucucuguacaccaacagccu

SEQ ID NO: 616633 - RNA, 18 nt, Human
gugacuugcucagucaca

SEQ ID NO: 616634 - RNA, 21 nt, Human
uaaaacacugucacagucagu

SEQ ID NO: 616635 - RNA, 22 nt, Human
uaaagaccaacaaacuaaguac

SEQ ID NO: 616636 - RNA, 20 nt, Human
uaaagggaaaacuaugucau

SEQ ID NO: 616637 - RNA, 21 nt, Human
uaacuucugaaaccggaagaa

SEQ ID NO: 616638 - RNA, 22 nt, Human
uaagagucacauggggagacag

SEQ ID NO: 616639 - RNA, 24 nt, Human
uaagcagccccaauguccaaccaa

SEQ ID NO: 616640 - RNA, 23 nt, Human
uaagcuucacagcuuagaaauua

SEQ ID NO: 616641 - RNA, 20 nt, Human
uaccugccccucuacuccca

SEQ ID NO: 616642 - RNA, 23 nt, Human
uaguaaagugaacagaagugcua

SEQ ID NO: 616643 - RNA, 20 nt, Human
uaugacugccuccccauaaa

SEQ ID NO: 616644 - RNA, 23 nt, Human
ucaacuuucuuaagcagccccaa

SEQ ID NO: 616645 - RNA, 21 nt, Human
ucacauggggagacaguggca

SEQ ID NO: 616646 - RNA, 25 nt, Human
uccacagguugggagccucccccau

SEQ ID NO: 616647 - RNA, 19 nt, Human
uccacggacucuccgcgga

SEQ ID NO: 616648 - RNA, 21 nt, Human
ucccagaugcccaccucaagu

SEQ ID NO: 616649 - RNA, 21 nt, Human
ucuacccuguauucccagaug

SEQ ID NO: 616650 - RNA, 22 nt, Human
ucuaccugccccucuacuccca

SEQ ID NO: 616651 - RNA, 19 nt, Human
ucucugaacagguaugacu

SEQ ID NO: 616652 - RNA, 22 nt, Human
ucugcauucccuaagcucccac

SEQ ID NO: 616653 - RNA, 18 nt, Human
ucuggaaaacugggaacc

SEQ ID NO: 616654 - RNA, 19 nt, Human
ucuggaaaacugggaaccg

SEQ ID NO: 616655 - RNA, 20 nt, Human
ucuuccugguucucugaaca

SEQ ID NO: 616656 - RNA, 19 nt, Human
ugaaaccggaagaauccgc

SEQ ID NO: 616657 - RNA, 22 nt, Human
ugaauggauauggauuuuuuuu

SEQ ID NO: 616658 - RNA, 18 nt, Human
ugacaagucagaaugugg

SEQ ID NO: 616659 - RNA, 22 nt, Human
ugacaggcaguguuuaagaaaa

SEQ ID NO: 616660 - RNA, 24 nt, Human
ugaccacauccuuccaaucaugga

SEQ ID NO: 616661 - RNA, 18 nt, Human
ugcuauaagcuucacagc

SEQ ID NO: 616662 - RNA, 26 nt, Human
uggaaaacacuucaggucuggaaaac

SEQ ID NO: 616663 - RNA, 20 nt, Human
ugggaaauaaagggaaaacu

SEQ ID NO: 616664 - RNA, 18 nt, Human
uggucuccuauuucauuc

SEQ ID NO: 616665 - RNA, 24 nt, Human
uguaagagucacauggggagacag

SEQ ID NO: 616666 - RNA, 18 nt, Human
ugugccacuucacacuga

SEQ ID NO: 616667 - RNA, 22 nt, Human
uuaaaaaugcuauaagcuucac

SEQ ID NO: 616668 - RNA, 25 nt, Human
uuagaagucuuuccaaagucauucc

SEQ ID NO: 616669 - RNA, 19 nt, Human
uucacaggaccacuuccac

SEQ ID NO: 616670 - RNA, 21 nt, Human
uucaggucuggaaaacuggga

SEQ ID NO: 616671 - RNA, 23 nt, Human
uuccacagguugggagccucccc

SEQ ID NO: 616672 - RNA, 26 nt, Human
uuccucugagauagauauugagucuu

SEQ ID NO: 616673 - RNA, 22 nt, Human
uuccuggguaaccauauuuccu

SEQ ID NO: 616674 - RNA, 20 nt, Human
uuccugguucucugaacagg

SEQ ID NO: 616675 - RNA, 19 nt, Human
uucuuagcucugagucacc

SEQ ID NO: 616676 - RNA, 22 nt, Human
uuggaaaacacuucaggucugg

SEQ ID NO: 616677 - RNA, 18 nt, Human
uuuauaucucauuuuuuu

SEQ ID NO: 616678 - RNA, 24 nt, Human
uuucuggguagcaguuaagaacau

SEQ ID NO: 616679 - RNA, 22 nt, Human
uuugucaaugucaagggucagc

SEQ ID NO: 616680 - RNA, 21 nt, Human
uuuuagaagucuuuccaaagu

SEQ ID NO: 616681 - RNA, 20 nt, Human
uuuuuuuuuuuuuuuuccag

SEQ ID NO: 616682 - RNA, 21 nt, Human
uuuuuuuuuuuuuuuuccaga

SEQ ID NO: 616683 - RNA, 18 nt, Human
uuuuuuuuuuuuuuuuug

SEQ ID NO: 616684 - RNA, 19 nt, Human
aacggcagaggguuggggg

SEQ ID NO: 616685 - RNA, 25 nt, Human
aacggcagaggguugggggcagugu

SEQ ID NO: 616686 - RNA, 20 nt, Human
accccaggccucccuaggcc

SEQ ID NO: 616687 - RNA, 21 nt, Human
agccuggggguacccaucaaa

SEQ ID NO: 616688 - RNA, 24 nt, Human
aggcaacggcagaggguugggggc

SEQ ID NO: 616689 - RNA, 21 nt, Human
aucacgcuaauacuaagcacu

SEQ ID NO: 616690 - RNA, 18 nt, Human
caaaccacccccagggac

SEQ ID NO: 616691 - RNA, 21 nt, Human
caagcaucacgcuaauacuaa

SEQ ID NO: 616692 - RNA, 19 nt, Human
cacagcaaaccacccccag

SEQ ID NO: 616693 - RNA, 22 nt, Human
cacagcaaaccacccccaggga

SEQ ID NO: 616694 - RNA, 20 nt, Human
cagcaccauugcugagcccc

SEQ ID NO: 616695 - RNA, 23 nt, Human
cagccgagucccagacgaggcuc

SEQ ID NO: 616696 - RNA, 21 nt, Human
cagccuucaguccuguccagg

SEQ ID NO: 616697 - RNA, 22 nt, Human
caugcagucacagcaaaccacc

SEQ ID NO: 616698 - RNA, 20 nt, Human
ccacagaccgcugugggugu

SEQ ID NO: 616699 - RNA, 20 nt, Human
ccacuggguccggcucugca

SEQ ID NO: 616700 - RNA, 18 nt, Human
ccccaggccucccuaggc

SEQ ID NO: 616701 - RNA, 23 nt, Human
ccccagggacucggcaucaccag

SEQ ID NO: 616702 - RNA, 21 nt, Human
ccccagguuaccccaggccuc

SEQ ID NO: 616703 - RNA, 21 nt, Human
cccccagguuaccccaggccu

SEQ ID NO: 616704 - RNA, 22 nt, Human
ccccuaagcuccaagaguucug

SEQ ID NO: 616705 - RNA, 24 nt, Human
cccgcccccgggcccagcccaaga

SEQ ID NO: 616706 - RNA, 20 nt, Human
cccgcugcgcgccgcaugca

SEQ ID NO: 616707 - RNA, 18 nt, Human
cccgggcccagcccaaga

SEQ ID NO: 616708 - RNA, 18 nt, Human
cccuaagcuccaagaguu

SEQ ID NO: 616709 - RNA, 19 nt, Human
ccgcccccgggcccagccc

SEQ ID NO: 616710 - RNA, 18 nt, Human
ccgccccgcuccgccugc

SEQ ID NO: 616711 - RNA, 19 nt, Human
ccgcuccgccugccuggcg

SEQ ID NO: 616712 - RNA, 20 nt, Human
ccucccuaggccagcuccag

SEQ ID NO: 616713 - RNA, 23 nt, Human
cgacgcagcaaaacugggcagag

SEQ ID NO: 616714 - RNA, 20 nt, Human
cggcagaggguugggggcag

SEQ ID NO: 616715 - RNA, 24 nt, Human
cggggcggggccgagcuugugcgc

SEQ ID NO: 616716 - RNA, 20 nt, Human
cgugggucuccccuaagcuc

SEQ ID NO: 616717 - RNA, 18 nt, Human
cugcagcaaacggguugu

SEQ ID NO: 616718 - RNA, 21 nt, Human
cugcccugggcggaggacaaa

SEQ ID NO: 616719 - RNA, 21 nt, Human
cugggcagaggggugggugug

SEQ ID NO: 616720 - RNA, 21 nt, Human
cugggcggaggacaaaggggg

SEQ ID NO: 616721 - RNA, 19 nt, Human
gagccccccagguuacccc

SEQ ID NO: 616722 - RNA, 18 nt, Human
gcagaggguugggggcag

SEQ ID NO: 616723 - RNA, 21 nt, Human
gcaguguguguguauuuguga

SEQ ID NO: 616724 - RNA, 18 nt, Human
gccgagcuugugcgcccc

SEQ ID NO: 616725 - RNA, 24 nt, Human
gcgacgcagcaaaacugggcagag

SEQ ID NO: 616726 - RNA, 18 nt, Human
ggacuaaaagccggggcg

SEQ ID NO: 616727 - RNA, 21 nt, Human
gggcagaggggugggugugag

SEQ ID NO: 616728 - RNA, 19 nt, Human
uaaccccaagcaucacgcu

SEQ ID NO: 616729 - RNA, 23 nt, Human
uaccccaggccucccuaggccag

SEQ ID NO: 616730 - RNA, 24 nt, Human
uaccccaggccucccuaggccagc

SEQ ID NO: 616731 - RNA, 22 nt, Human
uacuaagcacuuucccugcccu

SEQ ID NO: 616732 - RNA, 18 nt, Human
uaguaaaauauuucauuc

SEQ ID NO: 616733 - RNA, 19 nt, Human
uauuucauucaguacgucu

SEQ ID NO: 616734 - RNA, 18 nt, Human
uccuguccaggugggcau

SEQ ID NO: 616735 - RNA, 18 nt, Human
ucucuaccacagaccgcu

SEQ ID NO: 616736 - RNA, 24 nt, Human
ugagagaggcaacggcagaggguu

SEQ ID NO: 616737 - RNA, 21 nt, Human
ugagccccccagguuacccca

SEQ ID NO: 616738 - RNA, 18 nt, Human
ugcccugggcggaggaca

SEQ ID NO: 616739 - RNA, 21 nt, Human
ugcgcgccgcaugcagucaca

SEQ ID NO: 616740 - RNA, 21 nt, Human
uggggugacgcccaucugguu

SEQ ID NO: 616741 - RNA, 20 nt, Human
uggguguagccacugggucc

SEQ ID NO: 616742 - RNA, 20 nt, Human
ugguuuaccgcucaggguga

SEQ ID NO: 616743 - RNA, 18 nt, Human
uguagccacuggguccgg

SEQ ID NO: 616744 - RNA, 23 nt, Human
ugugucugcagaacuggggugac

SEQ ID NO: 616745 - RNA, 23 nt, Human
uugcugagccccccagguuaccc

SEQ ID NO: 616746 - RNA, 22 nt, Human
uuuccccagccuggggguaccc

SEQ ID NO: 616747 - RNA, 24 nt, Human
aaagugcugggauuacaggcauga

SEQ ID NO: 616748 - RNA, 24 nt, Human
aaaugucucuugaaccuagucacc

SEQ ID NO: 616749 - RNA, 22 nt, Human
aacuccucagcucaagcaaucu

SEQ ID NO: 616750 - RNA, 22 nt, Human
aagcaaaugucucuugaaccua

SEQ ID NO: 616751 - RNA, 19 nt, Human
aagugcugggauuacaggc

SEQ ID NO: 616752 - RNA, 21 nt, Human
aagugcugggauuacaggcau

SEQ ID NO: 616753 - RNA, 26 nt, Human
aagugcugggauuacaggcaugagcc

SEQ ID NO: 616754 - RNA, 23 nt, Human
agcaaucugcccaccccagccuc

SEQ ID NO: 616755 - RNA, 21 nt, Human
agggaagggaucuugcuaugu

SEQ ID NO: 616756 - RNA, 24 nt, Human
agggaucuugcuauguugcccagg

SEQ ID NO: 616757 - RNA, 18 nt, Human
agugcugggauuacaggc

SEQ ID NO: 616758 - RNA, 19 nt, Human
agugcugggauuacaggca

SEQ ID NO: 616759 - RNA, 22 nt, Human
auccucauuuuacagauaagga

SEQ ID NO: 616760 - RNA, 23 nt, Human
caaaacgcuaccauuucacacuc

SEQ ID NO: 616761 - RNA, 24 nt, Human
caccccagccucugaaagugcugg

SEQ ID NO: 616762 - RNA, 20 nt, Human
cacuaugggcccucaaaagg

SEQ ID NO: 616763 - RNA, 19 nt, Human
cagcacacuuuaauauuca

SEQ ID NO: 616764 - RNA, 28 nt, Human
cagcagcuccuccccuuucuagaggccu

SEQ ID NO: 616765 - RNA, 22 nt, Human
cccacucaagaggagcagaaau

SEQ ID NO: 616766 - RNA, 21 nt, Human
cccagccucugaaagugcugg

SEQ ID NO: 616767 - RNA, 19 nt, Human
cccaugagacccacucaag

SEQ ID NO: 616768 - RNA, 20 nt, Human
cccaugagacccacucaagg

SEQ ID NO: 616769 - RNA, 24 nt, Human
cccucuacauuuuuuucuuuaaaa

SEQ ID NO: 616770 - RNA, 22 nt, Human
cuaccaaguaauuaugccaugc

SEQ ID NO: 616771 - RNA, 24 nt, Human
cucaagcaaucugcccaccccagc

SEQ ID NO: 616772 - RNA, 21 nt, Human
cucagcucaagcaaucugccc

SEQ ID NO: 616773 - RNA, 19 nt, Human
cugcccaccccagccucug

SEQ ID NO: 616774 - RNA, 24 nt, Human
gaaagugcugggauuacaggcaug

SEQ ID NO: 616775 - RNA, 20 nt, Human
gaguccuacaugagcacccu

SEQ ID NO: 616776 - RNA, 18 nt, Human
gauuacaggcaugagcca

SEQ ID NO: 616777 - RNA, 21 nt, Human
gauuacaggcaugagccacca

SEQ ID NO: 616778 - RNA, 24 nt, Human
gauuacaggcaugagccaccaugu

SEQ ID NO: 616779 - RNA, 22 nt, Human
gccaugcguuucuucuaaccuu

SEQ ID NO: 616780 - RNA, 21 nt, Human
ggaaacugaggcuaagugacg

SEQ ID NO: 616781 - RNA, 21 nt, Human
ggaaagugcaccuguguuccc

SEQ ID NO: 616782 - RNA, 23 nt, Human
ggaagggaucuugcuauguugcc

SEQ ID NO: 616783 - RNA, 22 nt, Human
ggaucuugcuauguugcccagg

SEQ ID NO: 616784 - RNA, 24 nt, Human
ggauuacaggcaugagccaccaug

SEQ ID NO: 616785 - RNA, 19 nt, Human
gugcugggauuacaggcau

SEQ ID NO: 616786 - RNA, 24 nt, Human
uacaggcaugagccaccaugucca

SEQ ID NO: 616787 - RNA, 24 nt, Human
uaccauuucacacucccagaucua

SEQ ID NO: 616788 - RNA, 23 nt, Human
uagcuaccaaguaauuaugccuu

SEQ ID NO: 616789 - RNA, 23 nt, Human
uauguugcccaggcuggucucaa

SEQ ID NO: 616790 - RNA, 24 nt, Human
uauguugcccaggcuggucucaaa

SEQ ID NO: 616791 - RNA, 24 nt, Human
ucaccuggggggacaaguguggga

SEQ ID NO: 616792 - RNA, 20 nt, Human
ucccaugagacccacucaag

SEQ ID NO: 616793 - RNA, 23 nt, Human
ucucccuaugauagugugaagac

SEQ ID NO: 616794 - RNA, 24 nt, Human
ucugaaagugcugggauuacaggc

SEQ ID NO: 616795 - RNA, 18 nt, Human
ucuugaaccuagucaccu

SEQ ID NO: 616796 - RNA, 18 nt, Human
ucuugcuauguugcccag

SEQ ID NO: 616797 - RNA, 19 nt, Human
ucuugcuauguugcccagg

SEQ ID NO: 616798 - RNA, 23 nt, Human
ucuugcuauguugcccaggcugg

SEQ ID NO: 616799 - RNA, 24 nt, Human
ucuugcuauguugcccaggcuggu

SEQ ID NO: 616800 - RNA, 24 nt, Human
ugaaagugcugggauuacaggcau

SEQ ID NO: 616801 - RNA, 19 nt, Human
ugagacccacucaagagga

SEQ ID NO: 616802 - RNA, 27 nt, Human
ugagcacccuugcuacuacagcagcuc

SEQ ID NO: 616803 - RNA, 24 nt, Human
ugcccaggcuggucucaaacuccu

SEQ ID NO: 616804 - RNA, 24 nt, Human
ugcuauguugcccaggcuggucuc

SEQ ID NO: 616805 - RNA, 27 nt, Human
ugcuauguugcccaggcuggucucaaa

SEQ ID NO: 616806 - RNA, 22 nt, Human
uggccccucuacauuuuuuucu

SEQ ID NO: 616807 - RNA, 18 nt, Human
ugggauuacaggcaugag

SEQ ID NO: 616808 - RNA, 22 nt, Human
ugggauuacaggcaugagccac

SEQ ID NO: 616809 - RNA, 23 nt, Human
ugggauuacaggcaugagccacc

SEQ ID NO: 616810 - RNA, 24 nt, Human
ugggauuacaggcaugagccacca

SEQ ID NO: 616811 - RNA, 25 nt, Human
ugggauuacaggcaugagccaccau

SEQ ID NO: 616812 - RNA, 25 nt, Human
uucauguuuauuggccccucuacca

SEQ ID NO: 616813 - RNA, 18 nt, Human
uugcccaaggccacacag

SEQ ID NO: 616814 - RNA, 19 nt, Human
uuuguggggccaccaaaag

SEQ ID NO: 616815 - RNA, 25 nt, Human
aagaaaaaaagcacaaaugccaaga

SEQ ID NO: 616816 - RNA, 27 nt, Human
aagcagaacaaucccucaagaaaaaaa

SEQ ID NO: 616817 - RNA, 21 nt, Human
aaucuaugaaacaauuuccuu

SEQ ID NO: 616818 - RNA, 22 nt, Human
acccaucauacagccaggaagc

SEQ ID NO: 616819 - RNA, 22 nt, Human
agaaaaaaagcacaaaugccaa

SEQ ID NO: 616820 - RNA, 21 nt, Human
agaaauugaaaagaguaccau

SEQ ID NO: 616821 - RNA, 18 nt, Human
aggaagcagaacaauccc

SEQ ID NO: 616822 - RNA, 22 nt, Human
auacagccaggaagcagaacaa

SEQ ID NO: 616823 - RNA, 22 nt, Human
augugaucuguuuaauaugacu

SEQ ID NO: 616824 - RNA, 23 nt, Human
caaaugccaagaugcucuccaac

SEQ ID NO: 616825 - RNA, 21 nt, Human
caagaaaaaaagcacaaaugc

SEQ ID NO: 616826 - RNA, 24 nt, Human
caagaaaaaaagcacaaaugccaa

SEQ ID NO: 616827 - RNA, 18 nt, Human
cacaaaugccaagaugcu

SEQ ID NO: 616828 - RNA, 23 nt, Human
caccggcgcccucgccgggcucc

SEQ ID NO: 616829 - RNA, 23 nt, Human
cagaacaaagcaccggcgcccuc

SEQ ID NO: 616830 - RNA, 24 nt, Human
caucauacagccaggaagcagaac

SEQ ID NO: 616831 - RNA, 20 nt, Human
cgcggucaaacuuccuggcc

SEQ ID NO: 616832 - RNA, 20 nt, Human
cuggccucagacagaacaaa

SEQ ID NO: 616833 - RNA, 18 nt, Human
gcagaacaaucccucaag

SEQ ID NO: 616834 - RNA, 18 nt, Human
gcggucaaacuuccuggc

SEQ ID NO: 616835 - RNA, 28 nt, Human
uaccuuuauuaucaggagaaagaaugau

SEQ ID NO: 616836 - RNA, 25 nt, Human
ucaaacuuccuggccucagacagaa

SEQ ID NO: 616837 - RNA, 21 nt, Human
ucccucaagaaaaaaagcaca

SEQ ID NO: 616838 - RNA, 23 nt, Human
ucccucaagaaaaaaagcacaaa

SEQ ID NO: 616839 - RNA, 24 nt, Human
uucaauaccuuuauuaucaggaga

SEQ ID NO: 616840 - RNA, 20 nt, Human
uucauaacagauauucaaua

SEQ ID NO: 616841 - RNA, 19 nt, Human
aaacaauacccaaagguuu

SEQ ID NO: 616842 - RNA, 18 nt, Human
aacauuguuuuguuguug

SEQ ID NO: 616843 - RNA, 18 nt, Human
aagaaaaagcuggaucuc

SEQ ID NO: 616844 - RNA, 18 nt, Human
aauuaguaauuuauagaa

SEQ ID NO: 616845 - RNA, 18 nt, Human
acuguaccuaacaaaaac

SEQ ID NO: 616846 - RNA, 18 nt, Human
agaaaaacauucuuagaa

SEQ ID NO: 616847 - RNA, 23 nt, Human
agaaagccacuaaauauagcuaa

SEQ ID NO: 616848 - RNA, 21 nt, Human
agaauuccuucauucccacac

SEQ ID NO: 616849 - RNA, 23 nt, Human
agaauuccuucauucccacacuc

SEQ ID NO: 616850 - RNA, 26 nt, Human
agccacuaaauauagcuaaaauauuc

SEQ ID NO: 616851 - RNA, 28 nt, Human
auaauauuacacaaagcucaauuacauc

SEQ ID NO: 616852 - RNA, 23 nt, Human
aucaauaaauaagacuuccuaaa

SEQ ID NO: 616853 - RNA, 21 nt, Human
augaaagaaucccaagaauua

SEQ ID NO: 616854 - RNA, 24 nt, Human
augauaucuugccuuugauagguu

SEQ ID NO: 616855 - RNA, 27 nt, Human
caaaauaagauucagacguauuccauc

SEQ ID NO: 616856 - RNA, 23 nt, Human
caacuggaacauuaaaaccaaga

SEQ ID NO: 616857 - RNA, 25 nt, Human
caauggcaaccugcacauaagucuc

SEQ ID NO: 616858 - RNA, 19 nt, Human
cacaaagcucaauuacauc

SEQ ID NO: 616859 - RNA, 23 nt, Human
ccaacuuguuuuaaaaagcaaga

SEQ ID NO: 616860 - RNA, 30 nt, Human
ccaauauuuacuuaagaaacaauacccaaa

SEQ ID NO: 616861 - RNA, 22 nt, Human
ccaugauccagacuguaccuaa

SEQ ID NO: 616862 - RNA, 18 nt, Human
cugacauauuaaacugaa

SEQ ID NO: 616863 - RNA, 20 nt, Human
cuugccaaaaacaaaauaga

SEQ ID NO: 616864 - RNA, 21 nt, Human
gaacaauaucuauuauacuga

SEQ ID NO: 616865 - RNA, 25 nt, Human
gcuaaaauucucuuugccaccaaag

SEQ ID NO: 616866 - RNA, 21 nt, Human
ggaacauuaaaaccaagaaca

SEQ ID NO: 616867 - RNA, 23 nt, Human
guaaaaaacuauuuggaauaucg

SEQ ID NO: 616868 - RNA, 22 nt, Human
guccaauaaaugauaucuugcc

SEQ ID NO: 616869 - RNA, 21 nt, Human
guuugcuuaccaugauugucc

SEQ ID NO: 616870 - RNA, 23 nt, Human
uaaaaauagauauaacccagaua

SEQ ID NO: 616871 - RNA, 21 nt, Human
uaaaauaccaucaugcauuuc

SEQ ID NO: 616872 - RNA, 21 nt, Human
uaaauaccggcauaaagugaa

SEQ ID NO: 616873 - RNA, 20 nt, Human
uaaauccugcaaguuucaag

SEQ ID NO: 616874 - RNA, 23 nt, Human
uaagaaaaagcuggaucucagca

SEQ ID NO: 616875 - RNA, 21 nt, Human
uaagaaacaauacccaaaggu

SEQ ID NO: 616876 - RNA, 24 nt, Human
uaaggugaaaaaugcaguuacaga

SEQ ID NO: 616877 - RNA, 19 nt, Human
uacaugccaugauccagac

SEQ ID NO: 616878 - RNA, 18 nt, Human
uagauauaacccagauaa

SEQ ID NO: 616879 - RNA, 23 nt, Human
uauacaucuaaauccuacuuccc

SEQ ID NO: 616880 - RNA, 22 nt, Human
ucagcugaagacuuacaaaauc

SEQ ID NO: 616881 - RNA, 26 nt, Human
uccaauguaaaaaacuauuuggaauu

SEQ ID NO: 616882 - RNA, 25 nt, Human
uccacaucuagcuauucaucucccg

SEQ ID NO: 616883 - RNA, 18 nt, Human
ucccaugaaaauaaauua

SEQ ID NO: 616884 - RNA, 19 nt, Human
ucuacaugccaugauccag

SEQ ID NO: 616885 - RNA, 24 nt, Human
ucuauuauacugacauauuaaacu

SEQ ID NO: 616886 - RNA, 24 nt, Human
ucuguguaacagauuacaccacuu

SEQ ID NO: 616887 - RNA, 20 nt, Human
ucuucagacagguacagaca

SEQ ID NO: 616888 - RNA, 24 nt, Human
ugaaaaaugcaguuacagaacuaa

SEQ ID NO: 616889 - RNA, 22 nt, Human
ugacauaauauuacacaaagcu

SEQ ID NO: 616890 - RNA, 20 nt, Human
uggcaaccugugaccuaugu

SEQ ID NO: 616891 - RNA, 21 nt, Human
uggcaaccugugaccuauguu

SEQ ID NO: 616892 - RNA, 20 nt, Human
ugggauuuaaaaucaaaggu

SEQ ID NO: 616893 - RNA, 22 nt, Human
ugucaaaaagcuccagaauucc

SEQ ID NO: 616894 - RNA, 26 nt, Human
uguuaaaaaguucaaauaugcacauc

SEQ ID NO: 616895 - RNA, 21 nt, Human
uucaagaaguccaauaaauga

SEQ ID NO: 616896 - RNA, 20 nt, Human
uucaaggaauaaaauaccau

SEQ ID NO: 616897 - RNA, 21 nt, Human
uucaaggaauaaaauaccauc

SEQ ID NO: 616898 - RNA, 19 nt, Human
uucacuucuugccaaaaac

SEQ ID NO: 616899 - RNA, 22 nt, Human
uucccacacuccuacauguaaa

SEQ ID NO: 616900 - RNA, 20 nt, Human
uucccaugaaaauaaauuau

SEQ ID NO: 616901 - RNA, 21 nt, Human
uugccugcauucccaugaaaa

SEQ ID NO: 616902 - RNA, 20 nt, Human
uuguuuacauaucucuuucc

SEQ ID NO: 616903 - RNA, 23 nt, Human
uuuacauaucucuuuccacaucu

SEQ ID NO: 616904 - RNA, 21 nt, Human
uuuggaauaucguaaaggagc

SEQ ID NO: 616905 - RNA, 18 nt, Human
aaagugccuugcccugua

SEQ ID NO: 616906 - RNA, 23 nt, Human
acaguuuugucuuucugaaguuu

SEQ ID NO: 616907 - RNA, 24 nt, Human
acccccaacaggggcggcgaugac

SEQ ID NO: 616908 - RNA, 18 nt, Human
ccagcugaaggccgcuuc

SEQ ID NO: 616909 - RNA, 22 nt, Human
ccaguaaaaauggcaaacaguu

SEQ ID NO: 616910 - RNA, 21 nt, Human
gagcaaauguaagcuuauaau

SEQ ID NO: 616911 - RNA, 19 nt, Human
ggcgaugacacccucgaag

SEQ ID NO: 616912 - RNA, 21 nt, Human
ucagagcaaauguaagcuuau

SEQ ID NO: 616913 - RNA, 20 nt, Human
ugaagucauuuacuucagag

SEQ ID NO: 616914 - RNA, 21 nt, Human
ugccuugcccuguaugcucca

SEQ ID NO: 616915 - RNA, 21 nt, Human
uuggcaggggacacuuacuag

SEQ ID NO: 616916 - RNA, 18 nt, Human
aaccauaaagcagcacac

SEQ ID NO: 616917 - RNA, 22 nt, Human
aaccauaaagcagcacacaggg

SEQ ID NO: 616918 - RNA, 22 nt, Human
aaggaacugacccagacaugac

SEQ ID NO: 616919 - RNA, 25 nt, Human
aaggacacucucucacagcagcuuu

SEQ ID NO: 616920 - RNA, 20 nt, Human
aagggagaacaauguucugu

SEQ ID NO: 616921 - RNA, 19 nt, Human
acaaggaacugacccagac

SEQ ID NO: 616922 - RNA, 22 nt, Human
acagggacuucuuuacaccaaa

SEQ ID NO: 616923 - RNA, 19 nt, Human
agaaccugccgugccccuc

SEQ ID NO: 616924 - RNA, 20 nt, Human
agaacugagcuaaaaacuca

SEQ ID NO: 616925 - RNA, 27 nt, Human
agauaaaagguagaacugaggggaccc

SEQ ID NO: 616926 - RNA, 23 nt, Human
caacacacuccagaccauguuga

SEQ ID NO: 616927 - RNA, 18 nt, Human
caaggaacugacccagac

SEQ ID NO: 616928 - RNA, 20 nt, Human
cagaaccugccgugccccuc

SEQ ID NO: 616929 - RNA, 22 nt, Human
cagaugggaaaggacacucucu

SEQ ID NO: 616930 - RNA, 19 nt, Human
cagcccuuccuucugugcc

SEQ ID NO: 616931 - RNA, 21 nt, Human
ccagcccuuccuucugugccu

SEQ ID NO: 616932 - RNA, 20 nt, Human
ccgggacccuccacccggcg

SEQ ID NO: 616933 - RNA, 19 nt, Human
ccucagaaccugccgugcc

SEQ ID NO: 616934 - RNA, 24 nt, Human
ccucagaaccugccgugccccucc

SEQ ID NO: 616935 - RNA, 19 nt, Human
ccugccgugccccuccugg

SEQ ID NO: 616936 - RNA, 24 nt, Human
cgggacccuccacccggcggcugg

SEQ ID NO: 616937 - RNA, 24 nt, Human
cuaguaauaaugugucagauaaaa

SEQ ID NO: 616938 - RNA, 19 nt, Human
cuaguucauucuucucucc

SEQ ID NO: 616939 - RNA, 20 nt, Human
cuaguucauucuucucucca

SEQ ID NO: 616940 - RNA, 25 nt, Human
cucaaacuuuaaaaauguacagcaa

SEQ ID NO: 616941 - RNA, 24 nt, Human
cuccuggaugcaccaggaaaguca

SEQ ID NO: 616942 - RNA, 18 nt, Human
gaaacagaacaccaaguu

SEQ ID NO: 616943 - RNA, 22 nt, Human
gaagaaagguuuauuuagccaa

SEQ ID NO: 616944 - RNA, 21 nt, Human
gcacacagggacuucuuuaca

SEQ ID NO: 616945 - RNA, 21 nt, Human
gccaaagagaaucugagaauc

SEQ ID NO: 616946 - RNA, 22 nt, Human
gcccuuccuucugugccugcca

SEQ ID NO: 616947 - RNA, 23 nt, Human
ggcaggcggacucagcccgugcc

SEQ ID NO: 616948 - RNA, 21 nt, Human
ggccgggacccuccacccggc

SEQ ID NO: 616949 - RNA, 19 nt, Human
gggacccuccacccggcgg

SEQ ID NO: 616950 - RNA, 19 nt, Human
uaaagcagcacacagggac

SEQ ID NO: 616951 - RNA, 23 nt, Human
uaaagcagcacacagggacuucu

SEQ ID NO: 616952 - RNA, 21 nt, Human
uaacaaaguuaacacuaguaa

SEQ ID NO: 616953 - RNA, 27 nt, Human
uacaaggaacugacccagacaugacag

SEQ ID NO: 616954 - RNA, 18 nt, Human
uagaacugagcuaaaaac

SEQ ID NO: 616955 - RNA, 23 nt, Human
uagauacaaggaacugacccaga

SEQ ID NO: 616956 - RNA, 18 nt, Human
ucacagcagcuuugcucc

SEQ ID NO: 616957 - RNA, 22 nt, Human
ucacagcagcuuugcuccaguc

SEQ ID NO: 616958 - RNA, 19 nt, Human
uccagucaccaagcccaac

SEQ ID NO: 616959 - RNA, 18 nt, Human
uccgcaacacacuccaga

SEQ ID NO: 616960 - RNA, 21 nt, Human
ucuaguucauucuucucucca

SEQ ID NO: 616961 - RNA, 24 nt, Human
ucuaguucauucuucucuccauuu

SEQ ID NO: 616962 - RNA, 19 nt, Human
ucucacagcagcuuugcuc

SEQ ID NO: 616963 - RNA, 21 nt, Human
ugcuccagucaccaagcccaa

SEQ ID NO: 616964 - RNA, 24 nt, Human
uggcggcucgugaccccgcccccu

SEQ ID NO: 616965 - RNA, 19 nt, Human
ugggaaaggacacucucuc

SEQ ID NO: 616966 - RNA, 20 nt, Human
uguaguccgcaacacacucc

SEQ ID NO: 616967 - RNA, 23 nt, Human
uucacauaugaaaacuggaagag

SEQ ID NO: 616968 - RNA, 19 nt, Human
uugaguuaccucagaaccu

SEQ ID NO: 616969 - RNA, 19 nt, Human
aacagaaaggaaacuauaa

SEQ ID NO: 616970 - RNA, 23 nt, Human
aaccgcacaacuccaucauagga

SEQ ID NO: 616971 - RNA, 21 nt, Human
cacucauagauggccuggcua

SEQ ID NO: 616972 - RNA, 20 nt, Human
caugacgccgagcccugcuc

SEQ ID NO: 616973 - RNA, 25 nt, Human
cugaccucaccccggucacauauac

SEQ ID NO: 616974 - RNA, 22 nt, Human
cugguuacaaaauagaggcuga

SEQ ID NO: 616975 - RNA, 20 nt, Human
gagcagcucccggcaggaga

SEQ ID NO: 616976 - RNA, 32 nt, Human
ggagacacacauuccucacagcauugccccuu

SEQ ID NO: 616977 - RNA, 19 nt, Human
gugggaacagaaaggaaac

SEQ ID NO: 616978 - RNA, 25 nt, Human
uaaugauuuuuuuuucacguagcuu

SEQ ID NO: 616979 - RNA, 23 nt, Human
uacaaaauagaggcugacacuga

SEQ ID NO: 616980 - RNA, 21 nt, Human
uacacguggugcaggcauuuu

SEQ ID NO: 616981 - RNA, 20 nt, Human
uacuugugggaacagaaagg

SEQ ID NO: 616982 - RNA, 19 nt, Human
uaggagcagcucccggcag

SEQ ID NO: 616983 - RNA, 21 nt, Human
ucaaacuauucacccaacagc

SEQ ID NO: 616984 - RNA, 22 nt, Human
ucaaacuauucacccaacagca

SEQ ID NO: 616985 - RNA, 24 nt, Human
ucauccugguuacaaaauagaggc

SEQ ID NO: 616986 - RNA, 19 nt, Human
ucccuuucaucuccucaac

SEQ ID NO: 616987 - RNA, 20 nt, Human
ucucaggggcaggcaggccu

SEQ ID NO: 616988 - RNA, 24 nt, Human
ugcucugacccuuuccgcaucuca

SEQ ID NO: 616989 - RNA, 19 nt, Human
ugggaacagaaaggaaacu

SEQ ID NO: 616990 - RNA, 19 nt, Human
uggguguauuauaaaauuu

SEQ ID NO: 616991 - RNA, 28 nt, Human
ugugggaacagaaaggaaacuauaauac

SEQ ID NO: 616992 - RNA, 24 nt, Human
uugcccaugacgccgagcccugcu

SEQ ID NO: 616993 - RNA, 21 nt, Human
aaaaagcaccuagaggaaugg

SEQ ID NO: 616994 - RNA, 23 nt, Human
aaaaagcaccuagaggaauggag

SEQ ID NO: 616995 - RNA, 20 nt, Human
aaacagguguguccgguuua

SEQ ID NO: 616996 - RNA, 20 nt, Human
aaacagguguguccgguuua

SEQ ID NO: 616997 - RNA, 20 nt, Human
aaccaaaaacuaaacuacag

SEQ ID NO: 616998 - RNA, 23 nt, Human
aaccacaacaaaccaaaaacuaa

SEQ ID NO: 616999 - RNA, 22 nt, Human
aagaaaaaaacuaaaauauucu

SEQ ID NO: 617000 - RNA, 22 nt, Human
aagaaaaaaacuaaaauauucu

SEQ ID NO: 617001 - RNA, 19 nt, Human
aagcagccuuacauuugaa

SEQ ID NO: 617002 - RNA, 19 nt, Human
aagcugucucuuccugcug

SEQ ID NO: 617003 - RNA, 20 nt, Human
aauaacagcagcagcacaaa

SEQ ID NO: 617004 - RNA, 22 nt, Human
acugacuaggccuggauaaugu

SEQ ID NO: 617005 - RNA, 19 nt, Human
acugaguccauuacucauu

SEQ ID NO: 617006 - RNA, 22 nt, Human
acugaguccauuacucauuccc

SEQ ID NO: 617007 - RNA, 21 nt, Human
acuucuauuucuuccuguguu

SEQ ID NO: 617008 - RNA, 21 nt, Human
agaaaaacuggauccugcagg

SEQ ID NO: 617009 - RNA, 21 nt, Human
agcagcacaaaucccaggauu

SEQ ID NO: 617010 - RNA, 24 nt, Human
auaacagcagcagcacaaauccca

SEQ ID NO: 617011 - RNA, 23 nt, Human
auccuccucuucuuccucuucac

SEQ ID NO: 617012 - RNA, 25 nt, Human
auccuccucuucuuccucuucacug

SEQ ID NO: 617013 - RNA, 23 nt, Human
augaaacuaugaaaaaaugggcu

SEQ ID NO: 617014 - RNA, 21 nt, Human
caaaaccaugacuaauauuag

SEQ ID NO: 617015 - RNA, 18 nt, Human
caaaacucagcaccuccu

SEQ ID NO: 617016 - RNA, 18 nt, Human
caaaacucagcaccuccu

SEQ ID NO: 617017 - RNA, 20 nt, Human
caaaacucagcaccuccuuc

SEQ ID NO: 617018 - RNA, 20 nt, Human
caaaacucagcaccuccuuc

SEQ ID NO: 617019 - RNA, 20 nt, Human
caaaucccaggauucucaaa

SEQ ID NO: 617020 - RNA, 22 nt, Human
caaaugaaacuaugaaaaaaug

SEQ ID NO: 617021 - RNA, 21 nt, Human
caagucucgguagcuucuccg

SEQ ID NO: 617022 - RNA, 19 nt, Human
cacaaaucccaggauucuc

SEQ ID NO: 617023 - RNA, 18 nt, Human
cagauacaaccucccaag

SEQ ID NO: 617024 - RNA, 25 nt, Human
caggaggccauguggacuaaaacca

SEQ ID NO: 617025 - RNA, 25 nt, Human
caggaggccauguggacuaaaacca

SEQ ID NO: 617026 - RNA, 22 nt, Human
caggauucucaaagcaguucca

SEQ ID NO: 617027 - RNA, 22 nt, Human
ccaagaaaaacuggauccugca

SEQ ID NO: 617028 - RNA, 23 nt, Human
ccagguucagaaaaagcaccuag

SEQ ID NO: 617029 - RNA, 22 nt, Human
cccuuggcuucuuucacucacu

SEQ ID NO: 617030 - RNA, 18 nt, Human
ccgguuuaauaaaaaggg

SEQ ID NO: 617031 - RNA, 18 nt, Human
ccgguuuaauaaaaaggg

SEQ ID NO: 617032 - RNA, 25 nt, Human
ccuccuguagcgcagugugggagag

SEQ ID NO: 617033 - RNA, 23 nt, Human
ccuccuucauuaaaaauaaaggu

SEQ ID NO: 617034 - RNA, 23 nt, Human
ccuccuucauuaaaaauaaaggu

SEQ ID NO: 617035 - RNA, 18 nt, Human
ccuuaugaccagauacaa

SEQ ID NO: 617036 - RNA, 18 nt, Human
ccuuuauacucucauaag

SEQ ID NO: 617037 - RNA, 18 nt, Human
ccuuuauacucucauaag

SEQ ID NO: 617038 - RNA, 26 nt, Human
cgaaaugggaaacagguguguccccu

SEQ ID NO: 617039 - RNA, 19 nt, Human
cgggagacuuugaguggcu

SEQ ID NO: 617040 - RNA, 19 nt, Human
cuaaaaccaaacugagucc

SEQ ID NO: 617041 - RNA, 19 nt, Human
cuaaaaccaaacugagucc

SEQ ID NO: 617042 - RNA, 19 nt, Human
cuagcaauuuaggucaaaa

SEQ ID NO: 617043 - RNA, 19 nt, Human
cucuaauucucugccccuc

SEQ ID NO: 617044 - RNA, 22 nt, Human
cuucacaguuccugcugggacu

SEQ ID NO: 617045 - RNA, 21 nt, Human
cuugcuccgaugccuuucucg

SEQ ID NO: 617046 - RNA, 23 nt, Human
cuuucaaaacugcuacaaaccag

SEQ ID NO: 617047 - RNA, 21 nt, Human
gagcacuaacucgaggcucca

SEQ ID NO: 617048 - RNA, 23 nt, Human
gaggggcuucuccuuuugggaga

SEQ ID NO: 617049 - RNA, 19 nt, Human
gaucugugccgccgaucuc

SEQ ID NO: 617050 - RNA, 24 nt, Human
gaucuuaauccuuccacauacaga

SEQ ID NO: 617051 - RNA, 24 nt, Human
gaucuuaauccuuccacauacaga

SEQ ID NO: 617052 - RNA, 19 nt, Human
ggacuuggaacgggaucug

SEQ ID NO: 617053 - RNA, 23 nt, Human
ggauccugcagggcagcuggucu

SEQ ID NO: 617054 - RNA, 22 nt, Human
ggccauuccaguuuucaauagg

SEQ ID NO: 617055 - RNA, 21 nt, Human
uaaaaaaugcuuuaauacugc

SEQ ID NO: 617056 - RNA, 19 nt, Human
uaaaaagauacaaaacuca

SEQ ID NO: 617057 - RNA, 19 nt, Human
uaaaaagauacaaaacuca

SEQ ID NO: 617058 - RNA, 21 nt, Human
uaaacagcuuaggcgaccacc

SEQ ID NO: 617059 - RNA, 23 nt, Human
uaaacucuggucccuaucuccaa

SEQ ID NO: 617060 - RNA, 24 nt, Human
uaacagcagcagcacaaaucccag

SEQ ID NO: 617061 - RNA, 24 nt, Human
uaagaaaaaaacuaaaauauucuu

SEQ ID NO: 617062 - RNA, 24 nt, Human
uaagaaaaaaacuaaaauauucuu

SEQ ID NO: 617063 - RNA, 25 nt, Human
uaagaaaaaaacuaaaauauucuua

SEQ ID NO: 617064 - RNA, 25 nt, Human
uaagaaaaaaacuaaaauauucuua

SEQ ID NO: 617065 - RNA, 24 nt, Human
uaaguuugaauacagucaagguuc

SEQ ID NO: 617066 - RNA, 24 nt, Human
uaaguuugaauacagucaagguuc

SEQ ID NO: 617067 - RNA, 20 nt, Human
uaauauuagauacuuuccuc

SEQ ID NO: 617068 - RNA, 23 nt, Human
uaccaccauccucuaauucucug

SEQ ID NO: 617069 - RNA, 19 nt, Human
uaccacuugcugcugcugg

SEQ ID NO: 617070 - RNA, 22 nt, Human
uaccuuaugaccagauacaacc

SEQ ID NO: 617071 - RNA, 22 nt, Human
uaggucaaaaccaugacuaaua

SEQ ID NO: 617072 - RNA, 22 nt, Human
ucaaucccguuacccuacugcu

SEQ ID NO: 617073 - RNA, 25 nt, Human
ucaauucuggccuagaucgcuaugu

SEQ ID NO: 617074 - RNA, 22 nt, Human
ucacucucuccuaauucuccug

SEQ ID NO: 617075 - RNA, 20 nt, Human
ucauauccccaaccuccaga

SEQ ID NO: 617076 - RNA, 20 nt, Human
ucauauccccaaccuccaga

SEQ ID NO: 617077 - RNA, 19 nt, Human
ucauccauguccucuucca

SEQ ID NO: 617078 - RNA, 18 nt, Human
uccacaucauccaugucc

SEQ ID NO: 617079 - RNA, 21 nt, Human
uccccaaccuccagauccuuu

SEQ ID NO: 617080 - RNA, 21 nt, Human
uccccaaccuccagauccuuu

SEQ ID NO: 617081 - RNA, 18 nt, Human
ucggcgaggggaggggcu

SEQ ID NO: 617082 - RNA, 20 nt, Human
ucgggaccugcugcggugac

SEQ ID NO: 617083 - RNA, 21 nt, Human
ucuaaaagcugucucuuccug

SEQ ID NO: 617084 - RNA, 18 nt, Human
ucuagagcaggcauagaa

SEQ ID NO: 617085 - RNA, 24 nt, Human
ucucuguugaacuguuugaugaaa

SEQ ID NO: 617086 - RNA, 24 nt, Human
ucuuauugacagauuccaccauua

SEQ ID NO: 617087 - RNA, 19 nt, Human
ucuucuagcaaagaucuua

SEQ ID NO: 617088 - RNA, 21 nt, Human
ugaccagauacaaccucccaa

SEQ ID NO: 617089 - RNA, 18 nt, Human
ugaguggcuccugugucu

SEQ ID NO: 617090 - RNA, 19 nt, Human
ugcugcugcuggaaaaaag

SEQ ID NO: 617091 - RNA, 19 nt, Human
ugcugggacuacaguugca

SEQ ID NO: 617092 - RNA, 20 nt, Human
ugcugggacuacaguugcag

SEQ ID NO: 617093 - RNA, 22 nt, Human
uggaggcuuuuuaguccuuccu

SEQ ID NO: 617094 - RNA, 21 nt, Human
uggauccugcagggcagcugg

SEQ ID NO: 617095 - RNA, 26 nt, Human
uggauccugcagggcagcuggucuuc

SEQ ID NO: 617096 - RNA, 23 nt, Human
uggccacagccuuuccuugucag

SEQ ID NO: 617097 - RNA, 23 nt, Human
uggccacagccuuuccuugucag

SEQ ID NO: 617098 - RNA, 23 nt, Human
ugggacuacaguugcagaaguca

SEQ ID NO: 617099 - RNA, 21 nt, Human
ugggagaccggcuccuacucc

SEQ ID NO: 617100 - RNA, 19 nt, Human
uggucccuaucuccaacuu

SEQ ID NO: 617101 - RNA, 20 nt, Human
uguccucuuccagagcacua

SEQ ID NO: 617102 - RNA, 19 nt, Human
uguggacuaaaaccaaacu

SEQ ID NO: 617103 - RNA, 21 nt, Human
uguggacuaaaaccaaacuga

SEQ ID NO: 617104 - RNA, 25 nt, Human
uguuuuacuccuuugaucuuugaau

SEQ ID NO: 617105 - RNA, 24 nt, Human
uuaugaccagauacaaccucccaa

SEQ ID NO: 617106 - RNA, 19 nt, Human
uucauuacuaccaccaucc

SEQ ID NO: 617107 - RNA, 23 nt, Human
uuccaaccacaacaaaccaaaaa

SEQ ID NO: 617108 - RNA, 24 nt, Human
uuccuugucagucauauccccaac

SEQ ID NO: 617109 - RNA, 20 nt, Human
uugaauaacagcagcagcac

SEQ ID NO: 617110 - RNA, 21 nt, Human
uuuccaacuucucauccuccu

SEQ ID NO: 617111 - RNA, 23 nt, Human
uuuucauuacuaccaccauccuc

SEQ ID NO: 617112 - RNA, 27 nt, Human
uuuuuuuuuuuuuuuuuuuuuuauggg

SEQ ID NO: 617113 - RNA, 23 nt, Human
aaaaaacaaguggaaagaaaaga

SEQ ID NO: 617114 - RNA, 19 nt, Human
aaagccacccagaaagugg

SEQ ID NO: 617115 - RNA, 20 nt, Human
aacagaggaacagauaugga

SEQ ID NO: 617116 - RNA, 20 nt, Human
aacauggugaaacccugucu

SEQ ID NO: 617117 - RNA, 21 nt, Human
aacauggugaaacccugucuc

SEQ ID NO: 617118 - RNA, 26 nt, Human
aagcagguggauuaccugcggucagg

SEQ ID NO: 617119 - RNA, 24 nt, Human
aaguggaaagaaaagaugggguga

SEQ ID NO: 617120 - RNA, 24 nt, Human
aauugcuugaaccugggaggugga

SEQ ID NO: 617121 - RNA, 22 nt, Human
acagugagacucugucucaaaa

SEQ ID NO: 617122 - RNA, 21 nt, Human
accacacccagcuuggccugc

SEQ ID NO: 617123 - RNA, 23 nt, Human
accacacccagcuuggccugcag

SEQ ID NO: 617124 - RNA, 22 nt, Human
accagcugcaagccaggagccc

SEQ ID NO: 617125 - RNA, 23 nt, Human
acccaaaaagccacccagaaagu

SEQ ID NO: 617126 - RNA, 23 nt, Human
acccagaaagugggaaaaggaac

SEQ ID NO: 617127 - RNA, 24 nt, Human
acccugucucuacuaaaaauacaa

SEQ ID NO: 617128 - RNA, 24 nt, Human
accugcggucaggaguucaagacc

SEQ ID NO: 617129 - RNA, 18 nt, Human
acugcaguucagccuggg

SEQ ID NO: 617130 - RNA, 24 nt, Human
acugcaguucagccugggugacag

SEQ ID NO: 617131 - RNA, 18 nt, Human
agacaggagcugaggcag

SEQ ID NO: 617132 - RNA, 27 nt, Human
agacaggagcugaggcagaagggaccc

SEQ ID NO: 617133 - RNA, 21 nt, Human
agagcaagaguggguuucuuc

SEQ ID NO: 617134 - RNA, 19 nt, Human
agagucuauccauuccugu

SEQ ID NO: 617135 - RNA, 21 nt, Human
agaugcugggggaauuugggg

SEQ ID NO: 617136 - RNA, 20 nt, Human
agcacuuugggaggccgaag

SEQ ID NO: 617137 - RNA, 24 nt, Human
agccugaggcaggauaauugcuug

SEQ ID NO: 617138 - RNA, 22 nt, Human
agccuggccaacauggugaaac

SEQ ID NO: 617139 - RNA, 24 nt, Human
agccuggccaacauggugaaaccc

SEQ ID NO: 617140 - RNA, 22 nt, Human
agccugggugacagugagacuc

SEQ ID NO: 617141 - RNA, 22 nt, Human
aggaaacugaggcccggggggu

SEQ ID NO: 617142 - RNA, 22 nt, Human
aggcaggauaauugcuugaacc

SEQ ID NO: 617143 - RNA, 24 nt, Human
aggcaggauaauugcuugaaccug

SEQ ID NO: 617144 - RNA, 19 nt, Human
agggcucagcaagacagga

SEQ ID NO: 617145 - RNA, 22 nt, Human
aggggguggaggggggcuccuu

SEQ ID NO: 617146 - RNA, 24 nt, Human
agguggagguugcagugagccuag

SEQ ID NO: 617147 - RNA, 27 nt, Human
agugagccuagaucacaccacugcagu

SEQ ID NO: 617148 - RNA, 24 nt, Human
aguugcacaugccuguaaucccag

SEQ ID NO: 617149 - RNA, 22 nt, Human
auagagcccagcuccuccaagc

SEQ ID NO: 617150 - RNA, 20 nt, Human
aucaaggaauggaaagaagc

SEQ ID NO: 617151 - RNA, 24 nt, Human
aucacaccacugcaguucagccug

SEQ ID NO: 617152 - RNA, 19 nt, Human
augguuccagcuucuggag

SEQ ID NO: 617153 - RNA, 22 nt, Human
auguucaaaugcccaccagcau

SEQ ID NO: 617154 - RNA, 24 nt, Human
auuaccugcggucaggaguucaag

SEQ ID NO: 617155 - RNA, 19 nt, Human
caaaaagccacccagaaag

SEQ ID NO: 617156 - RNA, 21 nt, Human
caaaaagccacccagaaagug

SEQ ID NO: 617157 - RNA, 24 nt, Human
caacauggugaaacccugucucua

SEQ ID NO: 617158 - RNA, 24 nt, Human
caagaccagccuggccaacauggu

SEQ ID NO: 617159 - RNA, 21 nt, Human
caagccaggagccccgugggu

SEQ ID NO: 617160 - RNA, 24 nt, Human
caccacugcgaagggagccgaagg

SEQ ID NO: 617161 - RNA, 21 nt, Human
cacugcaguucagccugggug

SEQ ID NO: 617162 - RNA, 23 nt, Human
cagcaagacaggagcugaggcag

SEQ ID NO: 617163 - RNA, 24 nt, Human
cagcacuuugggaggccgaagcag

SEQ ID NO: 617164 - RNA, 26 nt, Human
cagcacuuugggaggccgaagcaggu

SEQ ID NO: 617165 - RNA, 18 nt, Human
cagcuccuccaagccucu

SEQ ID NO: 617166 - RNA, 19 nt, Human
cagcugcaagccaggagcc

SEQ ID NO: 617167 - RNA, 19 nt, Human
caggagccccgugggucac

SEQ ID NO: 617168 - RNA, 19 nt, Human
caggcccagccuuggccaa

SEQ ID NO: 617169 - RNA, 18 nt, Human
cagggcccaggucgaugg

SEQ ID NO: 617170 - RNA, 21 nt, Human
caguagaggggcgugugugug

SEQ ID NO: 617171 - RNA, 20 nt, Human
cagugcugggggccaucgug

SEQ ID NO: 617172 - RNA, 23 nt, Human
cagugcugggggccaucguggca

SEQ ID NO: 617173 - RNA, 20 nt, Human
ccacugcaguucagccuggg

SEQ ID NO: 617174 - RNA, 21 nt, Human
ccacugcaguucagccugggu

SEQ ID NO: 617175 - RNA, 23 nt, Human
ccacugcaguucagccuggguga

SEQ ID NO: 617176 - RNA, 24 nt, Human
ccacugcaguucagccugggugac

SEQ ID NO: 617177 - RNA, 18 nt, Human
cccagcuuggccugcagc

SEQ ID NO: 617178 - RNA, 18 nt, Human
ccccgccgccuaauaugc

SEQ ID NO: 617179 - RNA, 22 nt, Human
cccuaaauaccacacccagcuu

SEQ ID NO: 617180 - RNA, 23 nt, Human
cccucugaggggggcagagggcg

SEQ ID NO: 617181 - RNA, 22 nt, Human
ccuagaucacaccacugcaguu

SEQ ID NO: 617182 - RNA, 18 nt, Human
ccucugccagcccccagg

SEQ ID NO: 617183 - RNA, 23 nt, Human
ccugcagcauccuggcugggugg

SEQ ID NO: 617184 - RNA, 18 nt, Human
ccugcugagcugcccuaa

SEQ ID NO: 617185 - RNA, 22 nt, Human
ccuggccaacauggugaaaccc

SEQ ID NO: 617186 - RNA, 24 nt, Human
ccuggccaacauggugaaacccug

SEQ ID NO: 617187 - RNA, 21 nt, Human
ccugggagguggagguugcag

SEQ ID NO: 617188 - RNA, 20 nt, Human
ccugggugacagugagacuc

SEQ ID NO: 617189 - RNA, 22 nt, Human
ccuguaaucccagcacuuuggg

SEQ ID NO: 617190 - RNA, 19 nt, Human
ccuguaaucccagcuacuu

SEQ ID NO: 617191 - RNA, 21 nt, Human
ccuguaaucccagcuacuugg

SEQ ID NO: 617192 - RNA, 21 nt, Human
ccugugaccuugagaaccuca

SEQ ID NO: 617193 - RNA, 24 nt, Human
ccuuccaccccgguagggugguuu

SEQ ID NO: 617194 - RNA, 26 nt, Human
cgaagcagguggauuaccugcgguca

SEQ ID NO: 617195 - RNA, 19 nt, Human
cgaagggagccgaagggcg

SEQ ID NO: 617196 - RNA, 20 nt, Human
cgccuguaaucccagcacuu

SEQ ID NO: 617197 - RNA, 23 nt, Human
cgccuguaaucccagcacuuugg

SEQ ID NO: 617198 - RNA, 22 nt, Human
cggggggucuggaugaugguga

SEQ ID NO: 617199 - RNA, 21 nt, Human
cgugugugugugugugugugu

SEQ ID NO: 617200 - RNA, 20 nt, Human
cucacauucugcagacuuug

SEQ ID NO: 617201 - RNA, 26 nt, Human
cucagcaagacaggagcugaggcaga

SEQ ID NO: 617202 - RNA, 24 nt, Human
cugaaaucauaaccgucaggccca

SEQ ID NO: 617203 - RNA, 18 nt, Human
cugaccauggggacaagu

SEQ ID NO: 617204 - RNA, 21 nt, Human
cugcugagcugcccuaaauac

SEQ ID NO: 617205 - RNA, 23 nt, Human
cugcugagcugcccuaaauacca

SEQ ID NO: 617206 - RNA, 18 nt, Human
cuggagcagugcuggggg

SEQ ID NO: 617207 - RNA, 21 nt, Human
cuggagcagugcugggggcca

SEQ ID NO: 617208 - RNA, 18 nt, Human
cuggaggcuggguggggg

SEQ ID NO: 617209 - RNA, 21 nt, Human
cuggaggcugggugggggugg

SEQ ID NO: 617210 - RNA, 24 nt, Human
cuggccaacauggugaaacccugu

SEQ ID NO: 617211 - RNA, 19 nt, Human
cuggguggggguggggugg

SEQ ID NO: 617212 - RNA, 24 nt, Human
cuggguggggguggggugggggug

SEQ ID NO: 617213 - RNA, 21 nt, Human
cuuggccugcagcauccuggc

SEQ ID NO: 617214 - RNA, 19 nt, Human
gaaacccugucucuacuaa

SEQ ID NO: 617215 - RNA, 19 nt, Human
gacgucucuggaaaggagg

SEQ ID NO: 617216 - RNA, 26 nt, Human
gaggcugggugggggugggguggggg

SEQ ID NO: 617217 - RNA, 19 nt, Human
gagguugcagugagccuag

SEQ ID NO: 617218 - RNA, 23 nt, Human
gauuaccugcggucaggaguuca

SEQ ID NO: 617219 - RNA, 24 nt, Human
gauuaccugcggucaggaguucaa

SEQ ID NO: 617220 - RNA, 19 nt, Human
gcacaugccuguaauccca

SEQ ID NO: 617221 - RNA, 19 nt, Human
gcaggacagcugggucucc

SEQ ID NO: 617222 - RNA, 22 nt, Human
gcagggcuggcugcugggaggg

SEQ ID NO: 617223 - RNA, 24 nt, Human
gcagugcugggggccaucguggca

SEQ ID NO: 617224 - RNA, 24 nt, Human
gccaacauggugaaacccugucuc

SEQ ID NO: 617225 - RNA, 21 nt, Human
gccaggcaccugcugucugcc

SEQ ID NO: 617226 - RNA, 20 nt, Human
gccuagaucacaccacugca

SEQ ID NO: 617227 - RNA, 20 nt, Human
gccuguaaucccagcuacuu

SEQ ID NO: 617228 - RNA, 22 nt, Human
gcuggcugcugggagggggcag

SEQ ID NO: 617229 - RNA, 19 nt, Human
ggaaagaagcugggcuggg

SEQ ID NO: 617230 - RNA, 19 nt, Human
ggaggagcauguucaaaug

SEQ ID NO: 617231 - RNA, 20 nt, Human
ggagguugcagugagccuag

SEQ ID NO: 617232 - RNA, 24 nt, Human
ggagguugcagugagccuagauca

SEQ ID NO: 617233 - RNA, 19 nt, Human
ggcgcuggugcccccugcc

SEQ ID NO: 617234 - RNA, 19 nt, Human
ggcgugugugugugugugu

SEQ ID NO: 617235 - RNA, 23 nt, Human
ggcuggguggcuugcgccuguaa

SEQ ID NO: 617236 - RNA, 24 nt, Human
gggacgucucuggaaaggaggagg

SEQ ID NO: 617237 - RNA, 19 nt, Human
gggcggggugacagagggg

SEQ ID NO: 617238 - RNA, 23 nt, Human
gggcgugugugugugugugugug

SEQ ID NO: 617239 - RNA, 24 nt, Human
gggcuggcugcugggagggggcag

SEQ ID NO: 617240 - RNA, 20 nt, Human
ggggccucugccagccccca

SEQ ID NO: 617241 - RNA, 19 nt, Human
ggggugggguggggguggg

SEQ ID NO: 617242 - RNA, 23 nt, Human
gggugaguugcacaugccuguaa

SEQ ID NO: 617243 - RNA, 18 nt, Human
gggugggguggggguggg

SEQ ID NO: 617244 - RNA, 23 nt, Human
gguggcuugcgccuguaauccca

SEQ ID NO: 617245 - RNA, 24 nt, Human
gguggcuugcgccuguaaucccag

SEQ ID NO: 617246 - RNA, 23 nt, Human
ggugggggugggguggggguggg

SEQ ID NO: 617247 - RNA, 24 nt, Human
guagagcaagaguggguuucuucc

SEQ ID NO: 617248 - RNA, 23 nt, Human
gugacagaggggcuggagcagug

SEQ ID NO: 617249 - RNA, 22 nt, Human
gugacagugagacucugucuca

SEQ ID NO: 617250 - RNA, 24 nt, Human
gugacagugagacucugucucaaa

SEQ ID NO: 617251 - RNA, 19 nt, Human
guggacccaaaaagccacc

SEQ ID NO: 617252 - RNA, 21 nt, Human
gugugugugugugugugugug

SEQ ID NO: 617253 - RNA, 21 nt, Human
gugugugugugugugugugug

SEQ ID NO: 617254 - RNA, 21 nt, Human
gugugugugugugugugugug

SEQ ID NO: 617255 - RNA, 21 nt, Human
gugugugugugugugugugug

SEQ ID NO: 617256 - RNA, 21 nt, Human
gugugugugugugugugugug

SEQ ID NO: 617257 - RNA, 18 nt, Human
uaaaaauacaaaauuagc

SEQ ID NO: 617258 - RNA, 19 nt, Human
uaaaaauacaaaauuagcu

SEQ ID NO: 617259 - RNA, 21 nt, Human
uaauaugcaacauuagggcag

SEQ ID NO: 617260 - RNA, 21 nt, Human
uaccacacccagcuuggccug

SEQ ID NO: 617261 - RNA, 21 nt, Human
uaucaaggaauggaaagaagc

SEQ ID NO: 617262 - RNA, 24 nt, Human
uaucaaggaauggaaagaagcugg

SEQ ID NO: 617263 - RNA, 23 nt, Human
ucacaccacugcaguucagccug

SEQ ID NO: 617264 - RNA, 21 nt, Human
ucaggcccagccuuggccaaa

SEQ ID NO: 617265 - RNA, 25 nt, Human
ucccagcuacuugggagccugaggc

SEQ ID NO: 617266 - RNA, 23 nt, Human
ucuaugauugaggaaacugaggc

SEQ ID NO: 617267 - RNA, 22 nt, Human
ucucuacuaaaaauacaaaauu

SEQ ID NO: 617268 - RNA, 20 nt, Human
ucucucgggggacgucucug

SEQ ID NO: 617269 - RNA, 18 nt, Human
ucucugcccccgccgccu

SEQ ID NO: 617270 - RNA, 20 nt, Human
ucugcagacuuuggcggcgg

SEQ ID NO: 617271 - RNA, 18 nt, Human
ucuggaggcugggugggg

SEQ ID NO: 617272 - RNA, 22 nt, Human
ucuggaugauggugacugcuga

SEQ ID NO: 617273 - RNA, 24 nt, Human
ugaaccugggagguggagguugca

SEQ ID NO: 617274 - RNA, 19 nt, Human
ugacccucccuuccacccc

SEQ ID NO: 617275 - RNA, 18 nt, Human
ugacucucugcuuccccc

SEQ ID NO: 617276 - RNA, 25 nt, Human
ugacugcugaaggccauagcagguu

SEQ ID NO: 617277 - RNA, 18 nt, Human
ugaggaaacugaggcccg

SEQ ID NO: 617278 - RNA, 22 nt, Human
ugaggaaacugaggcccggggg

SEQ ID NO: 617279 - RNA, 26 nt, Human
ugaggcagaaucacagagagauggcc

SEQ ID NO: 617280 - RNA, 24 nt, Human
ugaggcaggauaauugcuugaacc

SEQ ID NO: 617281 - RNA, 25 nt, Human
ugaggcaggauaauugcuugaaccu

SEQ ID NO: 617282 - RNA, 18 nt, Human
ugaggcccggggggucug

SEQ ID NO: 617283 - RNA, 19 nt, Human
ugaucuggcggaggucacc

SEQ ID NO: 617284 - RNA, 19 nt, Human
ugcaagggggugcaggaca

SEQ ID NO: 617285 - RNA, 21 nt, Human
ugcaagggggugcaggacagc

SEQ ID NO: 617286 - RNA, 20 nt, Human
ugcccccugcccugguuccc

SEQ ID NO: 617287 - RNA, 22 nt, Human
ugcccuaaauaccacacccagc

SEQ ID NO: 617288 - RNA, 23 nt, Human
ugccuguaaucccagcuacuugg

SEQ ID NO: 617289 - RNA, 24 nt, Human
ugccuguaaucccagcuacuuggg

SEQ ID NO: 617290 - RNA, 18 nt, Human
ugcgaagggagccgaagg

SEQ ID NO: 617291 - RNA, 20 nt, Human
ugcgccuguaaucccagcac

SEQ ID NO: 617292 - RNA, 24 nt, Human
ugcgccuguaaucccagcacuuug

SEQ ID NO: 617293 - RNA, 23 nt, Human
ugcgggagaaaugguuccagcuu

SEQ ID NO: 617294 - RNA, 18 nt, Human
ugcugggggccaucgugg

SEQ ID NO: 617295 - RNA, 20 nt, Human
ugcugucugccacgaaacag

SEQ ID NO: 617296 - RNA, 21 nt, Human
ugcuugaaccugggaggugga

SEQ ID NO: 617297 - RNA, 22 nt, Human
uggaaagaagcugggcugggug

SEQ ID NO: 617298 - RNA, 18 nt, Human
uggaggggggcuccuuag

SEQ ID NO: 617299 - RNA, 24 nt, Human
uggauuaccugcggucaggaguuc

SEQ ID NO: 617300 - RNA, 19 nt, Human
uggcagggcuggcugcugg

SEQ ID NO: 617301 - RNA, 24 nt, Human
uggccaacauggugaaacccuguc

SEQ ID NO: 617302 - RNA, 20 nt, Human
uggcccuuaucucugccccc

SEQ ID NO: 617303 - RNA, 22 nt, Human
uggcuggguggacccaaaaagc

SEQ ID NO: 617304 - RNA, 19 nt, Human
uggcugggugggcuggucu

SEQ ID NO: 617305 - RNA, 24 nt, Human
uggcuugcgccuguaaucccagca

SEQ ID NO: 617306 - RNA, 24 nt, Human
ugggaggccgaagcagguggauua

SEQ ID NO: 617307 - RNA, 18 nt, Human
ugggagguggagguugca

SEQ ID NO: 617308 - RNA, 29 nt, Human
ugggagguggagguugcagugacaacggu

SEQ ID NO: 617309 - RNA, 24 nt, Human
ugggagguggagguugcagugagc

SEQ ID NO: 617310 - RNA, 18 nt, Human
ugggauagagcccagcuc

SEQ ID NO: 617311 - RNA, 18 nt, Human
ugggauagagcccagcuu

SEQ ID NO: 617312 - RNA, 19 nt, Human
ugggcuggguggcuugcgc

SEQ ID NO: 617313 - RNA, 20 nt, Human
ugggggccaucguggcaccu

SEQ ID NO: 617314 - RNA, 20 nt, Human
uggggguggggugggggugg

SEQ ID NO: 617315 - RNA, 23 nt, Human
ugggggugggugugggauagagc

SEQ ID NO: 617316 - RNA, 21 nt, Human
ugggucuccucugaccauggg

SEQ ID NO: 617317 - RNA, 18 nt, Human
uggguggacccaaaaagc

SEQ ID NO: 617318 - RNA, 21 nt, Human
ugggugggcuggucucagccu

SEQ ID NO: 617319 - RNA, 21 nt, Human
ugggugggggugggguggggg

SEQ ID NO: 617320 - RNA, 22 nt, Human
uggguggggguggggugggggu

SEQ ID NO: 617321 - RNA, 25 nt, Human
ugggugggggugggguggggguggg

SEQ ID NO: 617322 - RNA, 23 nt, Human
uggguuucuucccugacccuccc

SEQ ID NO: 617323 - RNA, 24 nt, Human
ugugaccuugagaaccucaucuca

SEQ ID NO: 617324 - RNA, 22 nt, Human
uguggcugugaggcugguugaa

SEQ ID NO: 617325 - RNA, 25 nt, Human
ugugggauagagcccagcuccucca

SEQ ID NO: 617326 - RNA, 20 nt, Human
ugugugggcagggcccaggu

SEQ ID NO: 617327 - RNA, 18 nt, Human
ugugugugugugugugug

SEQ ID NO: 617328 - RNA, 18 nt, Human
ugugugugugugugugug

SEQ ID NO: 617329 - RNA, 18 nt, Human
ugugugugugugugugug

SEQ ID NO: 617330 - RNA, 18 nt, Human
ugugugugugugugugug

SEQ ID NO: 617331 - RNA, 18 nt, Human
ugugugugugugugugug

SEQ ID NO: 617332 - RNA, 18 nt, Human
ugugugugugugugugug

SEQ ID NO: 617333 - RNA, 18 nt, Human
ugugugugugugugugug

SEQ ID NO: 617334 - RNA, 18 nt, Human
ugugugugugugugugug

SEQ ID NO: 617335 - RNA, 18 nt, Human
ugugugugugugugugug

SEQ ID NO: 617336 - RNA, 18 nt, Human
ugugugugugugugugug

SEQ ID NO: 617337 - RNA, 18 nt, Human
ugugugugugugugugug

SEQ ID NO: 617338 - RNA, 18 nt, Human
ugugugugugugugugug

SEQ ID NO: 617339 - RNA, 18 nt, Human
ugugugugugugugugug

SEQ ID NO: 617340 - RNA, 18 nt, Human
ugugugugugugugugug

SEQ ID NO: 617341 - RNA, 18 nt, Human
ugugugugugugugugug

SEQ ID NO: 617342 - RNA, 21 nt, Human
ugugugugugugugugugugu

SEQ ID NO: 617343 - RNA, 21 nt, Human
ugugugugugugugugugugu

SEQ ID NO: 617344 - RNA, 21 nt, Human
ugugugugugugugugugugu

SEQ ID NO: 617345 - RNA, 21 nt, Human
ugugugugugugugugugugu

SEQ ID NO: 617346 - RNA, 21 nt, Human
ugugugugugugugugugugu

SEQ ID NO: 617347 - RNA, 21 nt, Human
ugugugugugugugugugugu

SEQ ID NO: 617348 - RNA, 21 nt, Human
ugugugugugugugugugugu

SEQ ID NO: 617349 - RNA, 21 nt, Human
ugugugugugugugugugugu

SEQ ID NO: 617350 - RNA, 21 nt, Human
ugugugugugugugugugugu

SEQ ID NO: 617351 - RNA, 21 nt, Human
ugugugugugugugugugugu

SEQ ID NO: 617352 - RNA, 21 nt, Human
ugugugugugugugugugugu

SEQ ID NO: 617353 - RNA, 21 nt, Human
ugugugugugugugugugugu

SEQ ID NO: 617354 - RNA, 21 nt, Human
ugugugugugugugugugugu

SEQ ID NO: 617355 - RNA, 21 nt, Human
ugugugugugugugugugugu

SEQ ID NO: 617356 - RNA, 21 nt, Human
ugugugugugugugugugugu

SEQ ID NO: 617357 - RNA, 21 nt, Human
ugugugugugugugugugugu

SEQ ID NO: 617358 - RNA, 21 nt, Human
ugugugugugugugugugugu

SEQ ID NO: 617359 - RNA, 21 nt, Human
ugugugugugugugugugugu

SEQ ID NO: 617360 - RNA, 21 nt, Human
ugugugugugugugugugugu

SEQ ID NO: 617361 - RNA, 21 nt, Human
ugugugugugugugugugugu

SEQ ID NO: 617362 - RNA, 21 nt, Human
ugugugugugugugugugugu

SEQ ID NO: 617363 - RNA, 21 nt, Human
ugugugugugugugugugugu

SEQ ID NO: 617364 - RNA, 21 nt, Human
ugugugugugugugugugugu

SEQ ID NO: 617365 - RNA, 21 nt, Human
ugugugugugugugugugugu

SEQ ID NO: 617366 - RNA, 21 nt, Human
ugugugugugugugugugugu

SEQ ID NO: 617367 - RNA, 21 nt, Human
ugugugugugugugugugugu

SEQ ID NO: 617368 - RNA, 21 nt, Human
ugugugugugugugugugugu

SEQ ID NO: 617369 - RNA, 21 nt, Human
ugugugugugugugugugugu

SEQ ID NO: 617370 - RNA, 22 nt, Human
ugugugugugugugugugugug

SEQ ID NO: 617371 - RNA, 22 nt, Human
ugugugugugugugugugugug

SEQ ID NO: 617372 - RNA, 22 nt, Human
ugugugugugugugugugugug

SEQ ID NO: 617373 - RNA, 22 nt, Human
ugugugugugugugugugugug

SEQ ID NO: 617374 - RNA, 22 nt, Human
ugugugugugugugugugugug

SEQ ID NO: 617375 - RNA, 22 nt, Human
ugugugugugugugugugugug

SEQ ID NO: 617376 - RNA, 22 nt, Human
ugugugugugugugugugugug

SEQ ID NO: 617377 - RNA, 22 nt, Human
ugugugugugugugugugugug

SEQ ID NO: 617378 - RNA, 19 nt, Human
uguguguguguguguguug

SEQ ID NO: 617379 - RNA, 23 nt, Human
uguguguguguguguuggagcgu

SEQ ID NO: 617380 - RNA, 24 nt, Human
uguguguguguguguuggagcgug

SEQ ID NO: 617381 - RNA, 22 nt, Human
uucagccugggugacagugaga

SEQ ID NO: 617382 - RNA, 20 nt, Human
uucccugacccucccuucca

SEQ ID NO: 617383 - RNA, 19 nt, Human
uucuucccugacccucccu

SEQ ID NO: 617384 - RNA, 21 nt, Human
uucuugaccaucaccagcugc

SEQ ID NO: 617385 - RNA, 24 nt, Human
uugaaccugggagguggagguugc

SEQ ID NO: 617386 - RNA, 19 nt, Human
uugaugccaaucccccuag

SEQ ID NO: 617387 - RNA, 20 nt, Human
uugcagugagccuagaucac

SEQ ID NO: 617388 - RNA, 24 nt, Human
uugcuugaaccugggagguggagg

SEQ ID NO: 617389 - RNA, 19 nt, Human
uugggggagggcucagcaa

SEQ ID NO: 617390 - RNA, 24 nt, Human
uuuuuuuuuuuuuuuuuuuuuggg

SEQ ID NO: 617391 - RNA, 27 nt, Human
aaaaaaaaagaauacucaauauagaug

SEQ ID NO: 617392 - RNA, 18 nt, Human
aaacagacacacacuccc

SEQ ID NO: 617393 - RNA, 21 nt, Human
aaacagacacacacucccaaa

SEQ ID NO: 617394 - RNA, 19 nt, Human
aaaccauacccuaaagcag

SEQ ID NO: 617395 - RNA, 20 nt, Human
aaaccauacccuaaagcaga

SEQ ID NO: 617396 - RNA, 21 nt, Human
aaacuggucuuugacuuuaau

SEQ ID NO: 617397 - RNA, 28 nt, Human
aaagcaaaaaacagaagaaaagggaccc

SEQ ID NO: 617398 - RNA, 19 nt, Human
aacauggugaaaccccguc

SEQ ID NO: 617399 - RNA, 20 nt, Human
aacauggugaaaccccgucu

SEQ ID NO: 617400 - RNA, 21 nt, Human
aacauggugaaaccccgucuc

SEQ ID NO: 617401 - RNA, 23 nt, Human
aaccaaaacagacacacacuccc

SEQ ID NO: 617402 - RNA, 26 nt, Human
aacuuuacaaaccagccacccuacca

SEQ ID NO: 617403 - RNA, 28 nt, Human
aagcaaaaaacagaagaaaaggggaccc

SEQ ID NO: 617404 - RNA, 23 nt, Human
aagguugcgccauugcacuccag

SEQ ID NO: 617405 - RNA, 24 nt, Human
aaucacuugaaccagggaggcaga

SEQ ID NO: 617406 - RNA, 22 nt, Human
aauggcugggcgugguggcuca

SEQ ID NO: 617407 - RNA, 19 nt, Human
acaagaaugaaacuccauc

SEQ ID NO: 617408 - RNA, 20 nt, Human
acaagaaugaaacuccaucu

SEQ ID NO: 617409 - RNA, 21 nt, Human
acaagaaugaaacuccaucuc

SEQ ID NO: 617410 - RNA, 23 nt, Human
acacgccucugccugacuucugu

SEQ ID NO: 617411 - RNA, 21 nt, Human
acaggcccccacccuauuggg

SEQ ID NO: 617412 - RNA, 24 nt, Human
accaacauggugaaaccccgucuc

SEQ ID NO: 617413 - RNA, 24 nt, Human
accugaggucaggaguucaagacc

SEQ ID NO: 617414 - RNA, 25 nt, Human
acugcuguauucugugugccaagga

SEQ ID NO: 617415 - RNA, 21 nt, Human
acugggccuggccugugggca

SEQ ID NO: 617416 - RNA, 18 nt, Human
agaaggacagacagaggg

SEQ ID NO: 617417 - RNA, 21 nt, Human
agaauuccagauaaacuaagc

SEQ ID NO: 617418 - RNA, 20 nt, Human
agagguugcagugagccaag

SEQ ID NO: 617419 - RNA, 20 nt, Human
agagguugcagugagccaag

SEQ ID NO: 617420 - RNA, 24 nt, Human
agagguugcagugagccaagguug

SEQ ID NO: 617421 - RNA, 18 nt, Human
agauaaacuaagcaaaca

SEQ ID NO: 617422 - RNA, 24 nt, Human
agcacuuugggaggcugaggcagg

SEQ ID NO: 617423 - RNA, 21 nt, Human
agcagcugagcacuaccaucu

SEQ ID NO: 617424 - RNA, 18 nt, Human
agccaggagugguggugg

SEQ ID NO: 617425 - RNA, 18 nt, Human
agccauguggccuggccc

SEQ ID NO: 617426 - RNA, 24 nt, Human
agccugaccaacauggugaaaccc

SEQ ID NO: 617427 - RNA, 19 nt, Human
agcuacuuucucacaaacc

SEQ ID NO: 617428 - RNA, 24 nt, Human
aggaugaggcaggagaaucacuug

SEQ ID NO: 617429 - RNA, 24 nt, Human
aggcagagguugcagugagccaag

SEQ ID NO: 617430 - RNA, 18 nt, Human
aggcaggagaaucacuug

SEQ ID NO: 617431 - RNA, 22 nt, Human
aggcaggagaaucacuugaacc

SEQ ID NO: 617432 - RNA, 18 nt, Human
aggcagguggaucaccug

SEQ ID NO: 617433 - RNA, 22 nt, Human
aggcagguggaucaccugaggu

SEQ ID NO: 617434 - RNA, 26 nt, Human
aggcagguggaucaccugaggucagg

SEQ ID NO: 617435 - RNA, 21 nt, Human
aggcugaggcagguggaucac

SEQ ID NO: 617436 - RNA, 24 nt, Human
aggcugaggcagguggaucaccug

SEQ ID NO: 617437 - RNA, 18 nt, Human
agggcugaguacagaggu

SEQ ID NO: 617438 - RNA, 19 nt, Human
agguacuuccacagcccgg

SEQ ID NO: 617439 - RNA, 22 nt, Human
agguggaucaccugaggucagg

SEQ ID NO: 617440 - RNA, 21 nt, Human
auaccgcaugcguugccaacu

SEQ ID NO: 617441 - RNA, 24 nt, Human
aucaccugaggucaggaguucaag

SEQ ID NO: 617442 - RNA, 21 nt, Human
aucucaaaaaaaaaaaaaaag

SEQ ID NO: 617443 - RNA, 19 nt, Human
augccuguaaucucagcac

SEQ ID NO: 617444 - RNA, 31 nt, Human
auggcugggcgugguggcucaugccuguaaa

SEQ ID NO: 617445 - RNA, 18 nt, Human
auugcacuccagccucgg

SEQ ID NO: 617446 - RNA, 20 nt, Human
auugucauuuaucacccccu

SEQ ID NO: 617447 - RNA, 23 nt, Human
caaaacagacacacacucccaaa

SEQ ID NO: 617448 - RNA, 24 nt, Human
caaaccaaaacagacacacacucc

SEQ ID NO: 617449 - RNA, 20 nt, Human
caaaccagccacccuaccaa

SEQ ID NO: 617450 - RNA, 22 nt, Human
caaagcgaccaaaccauacccu

SEQ ID NO: 617451 - RNA, 19 nt, Human
caacagcagcaguucguga

SEQ ID NO: 617452 - RNA, 24 nt, Human
caacauggugaaaccccgucucua

SEQ ID NO: 617453 - RNA, 21 nt, Human
caagcaaccuucuggcuuucc

SEQ ID NO: 617454 - RNA, 18 nt, Human
caaggccauagcugcagu

SEQ ID NO: 617455 - RNA, 19 nt, Human
caauucuucuuuuccaacu

SEQ ID NO: 617456 - RNA, 18 nt, Human
cacauuccaaacccaaca

SEQ ID NO: 617457 - RNA, 23 nt, Human
caccugaggucaggaguucaaga

SEQ ID NO: 617458 - RNA, 18 nt, Human
cacuaaucugcacuuugu

SEQ ID NO: 617459 - RNA, 22 nt, Human
cagaaggacagacagagggcug

SEQ ID NO: 617460 - RNA, 28 nt, Human
cagacacacacucccaaaguucuugggu

SEQ ID NO: 617461 - RNA, 19 nt, Human
cagagggcugaguacagag

SEQ ID NO: 617462 - RNA, 18 nt, Human
cagaggugcucaaccucc

SEQ ID NO: 617463 - RNA, 24 nt, Human
cagaugcuccccucccugccuccc

SEQ ID NO: 617464 - RNA, 24 nt, Human
cagcacuuugggaggcugaggcag

SEQ ID NO: 617465 - RNA, 24 nt, Human
cagcacuuugggaggcugaggcag

SEQ ID NO: 617466 - RNA, 21 nt, Human
caggguccucucccugaccau

SEQ ID NO: 617467 - RNA, 24 nt, Human
cagguggaucaccugaggucagga

SEQ ID NO: 617468 - RNA, 18 nt, Human
cagugggugguggcuccu

SEQ ID NO: 617469 - RNA, 23 nt, Human
cauccguaaucucagcuucuugg

SEQ ID NO: 617470 - RNA, 19 nt, Human
caugaccuuaccagacacc

SEQ ID NO: 617471 - RNA, 24 nt, Human
caugccuguaaucucagcacuuug

SEQ ID NO: 617472 - RNA, 21 nt, Human
caugggcaguuuugcuucuug

SEQ ID NO: 617473 - RNA, 19 nt, Human
cauugcacuccagccucgg

SEQ ID NO: 617474 - RNA, 21 nt, Human
cauugcacuccagccucggca

SEQ ID NO: 617475 - RNA, 22 nt, Human
cauugcacuccagccucggcaa

SEQ ID NO: 617476 - RNA, 23 nt, Human
cauugcacuccagccucggcaac

SEQ ID NO: 617477 - RNA, 24 nt, Human
cauugcacuccagccucggcaaca

SEQ ID NO: 617478 - RNA, 25 nt, Human
ccaaaacagacacacacucccaaag

SEQ ID NO: 617479 - RNA, 23 nt, Human
ccaaaccauacccuaaagcagag

SEQ ID NO: 617480 - RNA, 25 nt, Human
ccaaaccauacccuaaagcagagac

SEQ ID NO: 617481 - RNA, 19 nt, Human
ccaaacccaacagcagcag

SEQ ID NO: 617482 - RNA, 23 nt, Human
ccacacagcccuauccuuccaga

SEQ ID NO: 617483 - RNA, 22 nt, Human
ccacaccccacauaagcaggca

SEQ ID NO: 617484 - RNA, 18 nt, Human
ccacuccacuauaccgca

SEQ ID NO: 617485 - RNA, 19 nt, Human
ccaggagugguggugguca

SEQ ID NO: 617486 - RNA, 25 nt, Human
ccaucucaaaaaaaaaaaaaaagaa

SEQ ID NO: 617487 - RNA, 20 nt, Human
ccauugcacuccagccucgg

SEQ ID NO: 617488 - RNA, 21 nt, Human
ccauugcacuccagccucggc

SEQ ID NO: 617489 - RNA, 24 nt, Human
ccauugcacuccagccucggcaac

SEQ ID NO: 617490 - RNA, 23 nt, Human
cccacuccacuauaccgcaugcg

SEQ ID NO: 617491 - RNA, 19 nt, Human
cccauacccacaucugccu

SEQ ID NO: 617492 - RNA, 20 nt, Human
cccauacccacaucugccua

SEQ ID NO: 617493 - RNA, 24 nt, Human
cccauacccacaucugccuaucuc

SEQ ID NO: 617494 - RNA, 18 nt, Human
ccccaugaccuuaccaga

SEQ ID NO: 617495 - RNA, 23 nt, Human
cccccauacccucuuauuccccc

SEQ ID NO: 617496 - RNA, 24 nt, Human
cccccaugaccuuaccagacaccu

SEQ ID NO: 617497 - RNA, 21 nt, Human
cccugagauccugcucaaucc

SEQ ID NO: 617498 - RNA, 21 nt, Human
ccgaucccaaaagcuugcugu

SEQ ID NO: 617499 - RNA, 21 nt, Human
ccguaaucucagcuucuuggg

SEQ ID NO: 617500 - RNA, 18 nt, Human
ccuacaacucucccuacc

SEQ ID NO: 617501 - RNA, 19 nt, Human
ccucaaccacucccugcca

SEQ ID NO: 617502 - RNA, 22 nt, Human
ccucagaaggacagacagaggg

SEQ ID NO: 617503 - RNA, 23 nt, Human
ccugaccaacauggugaaacccc

SEQ ID NO: 617504 - RNA, 24 nt, Human
ccugaccaacauggugaaaccccg

SEQ ID NO: 617505 - RNA, 21 nt, Human
ccuggccugugggcaugccug

SEQ ID NO: 617506 - RNA, 24 nt, Human
ccuggccugugggcaugccugggg

SEQ ID NO: 617507 - RNA, 24 nt, Human
cgccauugcacuccagccucggca

SEQ ID NO: 617508 - RNA, 23 nt, Human
cggccacaccccacauaagcagg

SEQ ID NO: 617509 - RNA, 19 nt, Human
cuagcuaaagaaaauacuc

SEQ ID NO: 617510 - RNA, 27 nt, Human
cucacaaaccaaaacagacacacacuc

SEQ ID NO: 617511 - RNA, 25 nt, Human
cucacaacaccccaguggguggugg

SEQ ID NO: 617512 - RNA, 23 nt, Human
cucacacugggccccauacccac

SEQ ID NO: 617513 - RNA, 24 nt, Human
cucaugacaaccaaagcgaccaaa

SEQ ID NO: 617514 - RNA, 24 nt, Human
cucaugccuguaaucucagcacuu

SEQ ID NO: 617515 - RNA, 22 nt, Human
cuccagacucccacccuuaaac

SEQ ID NO: 617516 - RNA, 19 nt, Human
cuccaucucaaaaaaaaaa

SEQ ID NO: 617517 - RNA, 20 nt, Human
cucccugaaauuccucucca

SEQ ID NO: 617518 - RNA, 21 nt, Human
cucuccagccauguggccugg

SEQ ID NO: 617519 - RNA, 18 nt, Human
cucucucuucucaccucu

SEQ ID NO: 617520 - RNA, 21 nt, Human
cugagcacuaccaucucugcc

SEQ ID NO: 617521 - RNA, 18 nt, Human
cugcagcuccugcaggaa

SEQ ID NO: 617522 - RNA, 23 nt, Human
cuggcacaggugggacuccaugg

SEQ ID NO: 617523 - RNA, 20 nt, Human
cuggcccacaggcccccacc

SEQ ID NO: 617524 - RNA, 20 nt, Human
cuggcccccagaccucaacc

SEQ ID NO: 617525 - RNA, 20 nt, Human
cuguuucuuucuucccuucc

SEQ ID NO: 617526 - RNA, 22 nt, Human
cuuaccagacaccucccaccuc

SEQ ID NO: 617527 - RNA, 21 nt, Human
cuuaccuacaacucucccuac

SEQ ID NO: 617528 - RNA, 20 nt, Human
cuuccuucucacacugggcc

SEQ ID NO: 617529 - RNA, 19 nt, Human
cuucucacacugggcccca

SEQ ID NO: 617530 - RNA, 19 nt, Human
cuucucaccucugcuccuc

SEQ ID NO: 617531 - RNA, 18 nt, Human
gaaaacccuucucuuaac

SEQ ID NO: 617532 - RNA, 19 nt, Human
gaccgugggcacuaaucug

SEQ ID NO: 617533 - RNA, 19 nt, Human
gacugggccuggccugugg

SEQ ID NO: 617534 - RNA, 22 nt, Human
gagaaucacuugaaccagggag

SEQ ID NO: 617535 - RNA, 21 nt, Human
gagaugagccgggacuugaaa

SEQ ID NO: 617536 - RNA, 18 nt, Human
gagcuccccuucacuuuc

SEQ ID NO: 617537 - RNA, 21 nt, Human
gaggcagagguugcagugagc

SEQ ID NO: 617538 - RNA, 18 nt, Human
gagguugcagugagccaa

SEQ ID NO: 617539 - RNA, 23 nt, Human
gaucaccugaggucaggaguuca

SEQ ID NO: 617540 - RNA, 24 nt, Human
gaucaccugaggucaggaguucaa

SEQ ID NO: 617541 - RNA, 22 nt, Human
gcaggagaaucacuugaaccag

SEQ ID NO: 617542 - RNA, 19 nt, Human
gccacaccccacauaagca

SEQ ID NO: 617543 - RNA, 24 nt, Human
gccacccuaccaagccuccaucac

SEQ ID NO: 617544 - RNA, 23 nt, Human
gccagaaugaggggcagcuacuu

SEQ ID NO: 617545 - RNA, 21 nt, Human
gcccuauccuuccagaaacgg

SEQ ID NO: 617546 - RNA, 21 nt, Human
gccuggcccccagaccucaac

SEQ ID NO: 617547 - RNA, 21 nt, Human
gcugggcgugguggcucaugc

SEQ ID NO: 617548 - RNA, 22 nt, Human
ggaucaccugaggucaggaguu

SEQ ID NO: 617549 - RNA, 21 nt, Human
ggcugggcgugguggcucaug

SEQ ID NO: 617550 - RNA, 23 nt, Human
gggcugaggcuucucucagcagg

SEQ ID NO: 617551 - RNA, 24 nt, Human
gguggcucaugccuguaaucucag

SEQ ID NO: 617552 - RNA, 18 nt, Human
gguggcugcagcuccugc

SEQ ID NO: 617553 - RNA, 24 nt, Human
gucucuagguaugagugggcugag

SEQ ID NO: 617554 - RNA, 23 nt, Human
guggcucaugccuguaaucucag

SEQ ID NO: 617555 - RNA, 20 nt, Human
guggucauccguaaucucag

SEQ ID NO: 617556 - RNA, 19 nt, Human
gugguggcuccugguccuc

SEQ ID NO: 617557 - RNA, 19 nt, Human
gugugcugaccuuccccag

SEQ ID NO: 617558 - RNA, 23 nt, Human
guugcgccauugcacuccagccu

SEQ ID NO: 617559 - RNA, 21 nt, Human
uaaacuaagcaaacaaggcca

SEQ ID NO: 617560 - RNA, 22 nt, Human
uaaacugcaaaagcucucuguc

SEQ ID NO: 617561 - RNA, 23 nt, Human
uaaacugggcugaccacucugaa

SEQ ID NO: 617562 - RNA, 18 nt, Human
uaaagaaaauacucuuga

SEQ ID NO: 617563 - RNA, 21 nt, Human
uaaagcaaaaaacagaagaaa

SEQ ID NO: 617564 - RNA, 19 nt, Human
uacaaaccagccacccuac

SEQ ID NO: 617565 - RNA, 21 nt, Human
uacagaggugcucaaccucca

SEQ ID NO: 617566 - RNA, 22 nt, Human
uaccaagccuccaucacauucc

SEQ ID NO: 617567 - RNA, 18 nt, Human
uacccagaccaugugaac

SEQ ID NO: 617568 - RNA, 24 nt, Human
uaccuggaaaggaccgugggcacu

SEQ ID NO: 617569 - RNA, 21 nt, Human
uagauguggaaggggcuuggc

SEQ ID NO: 617570 - RNA, 25 nt, Human
uauaugucaccaacucacagggucc

SEQ ID NO: 617571 - RNA, 23 nt, Human
uauucugugugccaaggacugug

SEQ ID NO: 617572 - RNA, 21 nt, Human
ucaaaaaaaaaaaaaaagaau

SEQ ID NO: 617573 - RNA, 24 nt, Human
ucaauccaccucuugcccacacau

SEQ ID NO: 617574 - RNA, 20 nt, Human
uccaaacccaacagcagcag

SEQ ID NO: 617575 - RNA, 19 nt, Human
uccacagcccgggagagca

SEQ ID NO: 617576 - RNA, 19 nt, Human
uccagacucccacccuuaa

SEQ ID NO: 617577 - RNA, 24 nt, Human
uccaggaggggaggaauuuuugcc

SEQ ID NO: 617578 - RNA, 23 nt, Human
uccaucucaaaaaaaaaaaaaaa

SEQ ID NO: 617579 - RNA, 22 nt, Human
uccaugaccacuacaauucuuc

SEQ ID NO: 617580 - RNA, 24 nt, Human
ucccaacauuuuaaacugcaaaag

SEQ ID NO: 617581 - RNA, 20 nt, Human
ucccccagcuuucaagaacu

SEQ ID NO: 617582 - RNA, 23 nt, Human
ucccugccagccugcugcuggcg

SEQ ID NO: 617583 - RNA, 23 nt, Human
uccucagaaggacagacagaggg

SEQ ID NO: 617584 - RNA, 18 nt, Human
uccucaggcaucccaaca

SEQ ID NO: 617585 - RNA, 22 nt, Human
ucucacacugggccccauaccc

SEQ ID NO: 617586 - RNA, 23 nt, Human
ucuccagccauguggccuggccc

SEQ ID NO: 617587 - RNA, 21 nt, Human
ucucuacuaaauacaaaaaau

SEQ ID NO: 617588 - RNA, 23 nt, Human
ucucuagguaugagugggcugag

SEQ ID NO: 617589 - RNA, 25 nt, Human
ucucuagguaugagugggcugaggc

SEQ ID NO: 617590 - RNA, 18 nt, Human
ucucucagcaggcuuacu

SEQ ID NO: 617591 - RNA, 19 nt, Human
ucucucagcaggcuuacug

SEQ ID NO: 617592 - RNA, 18 nt, Human
ucucucaucucccuuccc

SEQ ID NO: 617593 - RNA, 20 nt, Human
ucucucaucucccuuccccc

SEQ ID NO: 617594 - RNA, 18 nt, Human
ucucucucuucucaccuc

SEQ ID NO: 617595 - RNA, 19 nt, Human
ucucucucuucucaccucu

SEQ ID NO: 617596 - RNA, 26 nt, Human
ucugccuaucuccucucucaucuccc

SEQ ID NO: 617597 - RNA, 22 nt, Human
ucuuauucccccgaucccaaaa

SEQ ID NO: 617598 - RNA, 19 nt, Human
ucuugcccacacauccccc

SEQ ID NO: 617599 - RNA, 20 nt, Human
ugaaccagggaggcagaggu

SEQ ID NO: 617600 - RNA, 21 nt, Human
ugaagcagcugagcacuacca

SEQ ID NO: 617601 - RNA, 18 nt, Human
ugaaugacuaaagggagg

SEQ ID NO: 617602 - RNA, 19 nt, Human
ugacacaggaaggccagga

SEQ ID NO: 617603 - RNA, 24 nt, Human
ugaccaacauggugaaaccccguc

SEQ ID NO: 617604 - RNA, 20 nt, Human
ugaccuguggaagcccagcu

SEQ ID NO: 617605 - RNA, 21 nt, Human
ugagauccugcucaauccacc

SEQ ID NO: 617606 - RNA, 22 nt, Human
ugagccaagguugcgccauugc

SEQ ID NO: 617607 - RNA, 23 nt, Human
ugagccaagguugcgccauugca

SEQ ID NO: 617608 - RNA, 20 nt, Human
ugaggcaggagaaucacuug

SEQ ID NO: 617609 - RNA, 24 nt, Human
ugaggcaggagaaucacuugaacc

SEQ ID NO: 617610 - RNA, 20 nt, Human
ugaggcagguggaucaccug

SEQ ID NO: 617611 - RNA, 24 nt, Human
ugaggcagguggaucaccugaggu

SEQ ID NO: 617612 - RNA, 26 nt, Human
ugaggcagguggaucaccugagguca

SEQ ID NO: 617613 - RNA, 19 nt, Human
ugagggucaaagugagcuc

SEQ ID NO: 617614 - RNA, 21 nt, Human
ugaguacagaggugcucaacc

SEQ ID NO: 617615 - RNA, 20 nt, Human
ugauuggucucaguggcaga

SEQ ID NO: 617616 - RNA, 19 nt, Human
ugcacuccagccucggcaa

SEQ ID NO: 617617 - RNA, 23 nt, Human
ugccagccugcugcuggcgaugu

SEQ ID NO: 617618 - RNA, 21 nt, Human
ugccuggggacugucacauug

SEQ ID NO: 617619 - RNA, 23 nt, Human
ugccuguaaucucagcacuuugg

SEQ ID NO: 617620 - RNA, 23 nt, Human
ugccuguaaucucagcacuuugg

SEQ ID NO: 617621 - RNA, 24 nt, Human
ugccuguaaucucagcacuuuggg

SEQ ID NO: 617622 - RNA, 21 nt, Human
ugcucaauccaccucuugccc

SEQ ID NO: 617623 - RNA, 18 nt, Human
ugcuccccucccugccuc

SEQ ID NO: 617624 - RNA, 24 nt, Human
uggaucaccugaggucaggaguuc

SEQ ID NO: 617625 - RNA, 27 nt, Human
uggaucaccugaggucaggaguucaag

SEQ ID NO: 617626 - RNA, 21 nt, Human
uggcccacaggcccccacccu

SEQ ID NO: 617627 - RNA, 25 nt, Human
uggcccccagaccucaaccacuccc

SEQ ID NO: 617628 - RNA, 22 nt, Human
uggcucaugccuguaaucucag

SEQ ID NO: 617629 - RNA, 24 nt, Human
uggcucaugccuguaaucucagca

SEQ ID NO: 617630 - RNA, 20 nt, Human
uggcuccagacucccacccu

SEQ ID NO: 617631 - RNA, 23 nt, Human
uggcugggcgugguggcucaugc

SEQ ID NO: 617632 - RNA, 24 nt, Human
uggcugggcgugguggcucaugcc

SEQ ID NO: 617633 - RNA, 22 nt, Human
ugggagaagcagcagggaaauu

SEQ ID NO: 617634 - RNA, 24 nt, Human
ugggaggcugaggcagguggauca

SEQ ID NO: 617635 - RNA, 20 nt, Human
ugggcucugaccuggcacag

SEQ ID NO: 617636 - RNA, 19 nt, Human
uggucauccguaaucucag

SEQ ID NO: 617637 - RNA, 25 nt, Human
ugguggcucaugccuguaaucucaa

SEQ ID NO: 617638 - RNA, 21 nt, Human
ugguggucauccguaaucuca

SEQ ID NO: 617639 - RNA, 19 nt, Human
ugguuuaaaauauguacaa

SEQ ID NO: 617640 - RNA, 22 nt, Human
uguggaacaggggccucagccu

SEQ ID NO: 617641 - RNA, 24 nt, Human
uguggccuggcccccagaccucaa

SEQ ID NO: 617642 - RNA, 26 nt, Human
uuaccagacaccucccaccucauucu

SEQ ID NO: 617643 - RNA, 21 nt, Human
uuaguucuuaaagcaaaaaac

SEQ ID NO: 617644 - RNA, 24 nt, Human
uuaguucuuaaagcaaaaaacaga

SEQ ID NO: 617645 - RNA, 20 nt, Human
uucccuuccucgacauaacc

SEQ ID NO: 617646 - RNA, 19 nt, Human
uuccucgacauaacccuga

SEQ ID NO: 617647 - RNA, 19 nt, Human
uucuguuucuuucuucccu

SEQ ID NO: 617648 - RNA, 18 nt, Human
uugcagugagccaagguu

SEQ ID NO: 617649 - RNA, 22 nt, Human
uugcagugagccaagguugcgc

SEQ ID NO: 617650 - RNA, 25 nt, Human
uugggaggcugaggcagguggauca

SEQ ID NO: 617651 - RNA, 21 nt, Human
uuuccugacacugagcuccag

SEQ ID NO: 617652 - RNA, 23 nt, Human
uuugucuuggcagggggagugau

SEQ ID NO: 617653 - RNA, 26 nt, Human
aaaaaaaggcaaauauggauauauua

SEQ ID NO: 617654 - RNA, 20 nt, Human
aacaccuccagucugagagc

SEQ ID NO: 617655 - RNA, 24 nt, Human
aaguagcaggaaagucaagucuuu

SEQ ID NO: 617656 - RNA, 20 nt, Human
aaugauaaaaguagcaggaa

SEQ ID NO: 617657 - RNA, 19 nt, Human
acuaacuucuucaggccca

SEQ ID NO: 617658 - RNA, 19 nt, Human
agaaagacccaugagggug

SEQ ID NO: 617659 - RNA, 19 nt, Human
agccagggagagggacuac

SEQ ID NO: 617660 - RNA, 21 nt, Human
agcucuuggccuguccagcuc

SEQ ID NO: 617661 - RNA, 19 nt, Human
agggagauagcucuuggcc

SEQ ID NO: 617662 - RNA, 19 nt, Human
auaaauccugcagaaagac

SEQ ID NO: 617663 - RNA, 22 nt, Human
caaaaaaaggcaaauauggaua

SEQ ID NO: 617664 - RNA, 19 nt, Human
caacaacaccuccagucug

SEQ ID NO: 617665 - RNA, 19 nt, Human
caacaacaccuccagucug

SEQ ID NO: 617666 - RNA, 24 nt, Human
caacgugcagccagggagagggac

SEQ ID NO: 617667 - RNA, 25 nt, Human
caccuccagucugagagccuggcug

SEQ ID NO: 617668 - RNA, 22 nt, Human
cacuggcccucccucuucuucc

SEQ ID NO: 617669 - RNA, 25 nt, Human
cauacaaaaaaaggcaaauauggau

SEQ ID NO: 617670 - RNA, 26 nt, Human
cauacaaaaaaaggcaaauauggaua

SEQ ID NO: 617671 - RNA, 27 nt, Human
cauuuggaaacuggucauccauacaaa

SEQ ID NO: 617672 - RNA, 27 nt, Human
ccaguacucccuuuuucccggucuucu

SEQ ID NO: 617673 - RNA, 22 nt, Human
cccggucuucuccagccaaggg

SEQ ID NO: 617674 - RNA, 20 nt, Human
cccucccucuucuuccuucc

SEQ ID NO: 617675 - RNA, 20 nt, Human
cccucccucuucuuccuucc

SEQ ID NO: 617676 - RNA, 24 nt, Human
ccggucccaacgugcagccaggga

SEQ ID NO: 617677 - RNA, 24 nt, Human
ccggucuucuccagccaagggaga

SEQ ID NO: 617678 - RNA, 18 nt, Human
cgugcagccagggagagg

SEQ ID NO: 617679 - RNA, 20 nt, Human
cucaaauguucuauuaagcu

SEQ ID NO: 617680 - RNA, 19 nt, Human
cuccaguacucccuuuuuc

SEQ ID NO: 617681 - RNA, 20 nt, Human
cuccaguacucccuuuuucc

SEQ ID NO: 617682 - RNA, 19 nt, Human
cugacauuuggaaacuggu

SEQ ID NO: 617683 - RNA, 20 nt, Human
cugccaacaacaccuccagg

SEQ ID NO: 617684 - RNA, 20 nt, Human
cugccaacaacaccuccagu

SEQ ID NO: 617685 - RNA, 21 nt, Human
cuuaaaauaaaauuaaggcuc

SEQ ID NO: 617686 - RNA, 22 nt, Human
cuuucugacauuuggaaacugg

SEQ ID NO: 617687 - RNA, 26 nt, Human
ggaaagucaagucuuugugucacuuu

SEQ ID NO: 617688 - RNA, 18 nt, Human
uagcucuuggccugucca

SEQ ID NO: 617689 - RNA, 20 nt, Human
uauguaaucaguaaucucaa

SEQ ID NO: 617690 - RNA, 24 nt, Human
ucaggcccaacuucuccuuuacca

SEQ ID NO: 617691 - RNA, 22 nt, Human
ucaguaaucucaagguuucucc

SEQ ID NO: 617692 - RNA, 19 nt, Human
ucaucugccaacaacaccu

SEQ ID NO: 617693 - RNA, 22 nt, Human
ucccggucuucuccagccaagg

SEQ ID NO: 617694 - RNA, 21 nt, Human
ucugccaacaacaccuccagu

SEQ ID NO: 617695 - RNA, 20 nt, Human
ucuggaagaaccuugggaag

SEQ ID NO: 617696 - RNA, 19 nt, Human
ucuucaggcccaacuucuc

SEQ ID NO: 617697 - RNA, 27 nt, Human
ugaaaaggcagcuucucaaaaaucuua

SEQ ID NO: 617698 - RNA, 23 nt, Human
ugagagccuggcugaaguugacu

SEQ ID NO: 617699 - RNA, 18 nt, Human
ugcagaaagacccaugag

SEQ ID NO: 617700 - RNA, 21 nt, Human
ugcagaaagacccaugagggu

SEQ ID NO: 617701 - RNA, 24 nt, Human
ugcuuuauguaaucaguaaucuca

SEQ ID NO: 617702 - RNA, 20 nt, Human
uggaagaaccuugggaagaa

SEQ ID NO: 617703 - RNA, 23 nt, Human
uuaaaaaaugcaguaagguauaa

SEQ ID NO: 617704 - RNA, 21 nt, Human
uuaaaauaaaauuaaggcuca

SEQ ID NO: 617705 - RNA, 21 nt, Human
uuaccagcacuggcccucccu

SEQ ID NO: 617706 - RNA, 19 nt, Human
uuuaaaaaaugcaguaagg

SEQ ID NO: 617707 - RNA, 19 nt, Human
cauccggacccucaagaca

SEQ ID NO: 617708 - RNA, 20 nt, Human
cccgcgcccggagcucuaga

SEQ ID NO: 617709 - RNA, 18 nt, Human
cccucaagacaacuggag

SEQ ID NO: 617710 - RNA, 19 nt, Human
ccugagcccauccggaccc

SEQ ID NO: 617711 - RNA, 25 nt, Human
cggacccucaagacaacuggagccc

SEQ ID NO: 617712 - RNA, 18 nt, Human
cuggagcccacccugccc

SEQ ID NO: 617713 - RNA, 24 nt, Human
aacuaucaaaagcuacauuuuacu

SEQ ID NO: 617714 - RNA, 19 nt, Human
gaguuuccuuuaaucaaag

SEQ ID NO: 617715 - RNA, 21 nt, Human
gugaguuuccuuuaaucaaag

SEQ ID NO: 617716 - RNA, 18 nt, Human
uaaucaaagacaaccaug

SEQ ID NO: 617717 - RNA, 19 nt, Human
uauggcggugaguuuccuu

SEQ ID NO: 617718 - RNA, 23 nt, Human
uuaaaaauguugaaucauacaau

SEQ ID NO: 617719 - RNA, 18 nt, Human
uuuuuuauuugugaauau

SEQ ID NO: 617720 - RNA, 21 nt, Human
uuuuuuuuuuuuuuuuuauuu

SEQ ID NO: 617721 - RNA, 22 nt, Human
aaaaacaacaaaucucuguccu

SEQ ID NO: 617722 - RNA, 21 nt, Human
aaacacgucagacacaccccu

SEQ ID NO: 617723 - RNA, 22 nt, Human
aaagacagggucuugcucuguu

SEQ ID NO: 617724 - RNA, 18 nt, Human
aaagaggccccccccccc

SEQ ID NO: 617725 - RNA, 19 nt, Human
aaagugcugggauuacagg

SEQ ID NO: 617726 - RNA, 21 nt, Human
aaagugcugggauuacaggca

SEQ ID NO: 617727 - RNA, 23 nt, Human
aaagugcugggauuacaggcaug

SEQ ID NO: 617728 - RNA, 24 nt, Human
aaagugcugggauuacaggcaugc

SEQ ID NO: 617729 - RNA, 24 nt, Human
aaagugcugggauuacaggcguga

SEQ ID NO: 617730 - RNA, 24 nt, Human
aaaguguugagauuacaggcguga

SEQ ID NO: 617731 - RNA, 21 nt, Human
aacaacaaaucucuguccuuu

SEQ ID NO: 617732 - RNA, 25 nt, Human
aagcaauccuccugccuuagccucc

SEQ ID NO: 617733 - RNA, 24 nt, Human
aagugaucugcccgccucggccuc

SEQ ID NO: 617734 - RNA, 19 nt, Human
aagugcugggauuacaggc

SEQ ID NO: 617735 - RNA, 19 nt, Human
aagugcugggauuacaggc

SEQ ID NO: 617736 - RNA, 19 nt, Human
aagugcugggauuacaggc

SEQ ID NO: 617737 - RNA, 21 nt, Human
aagugcugggauuacaggcau

SEQ ID NO: 617738 - RNA, 26 nt, Human
aagugcugggauuacaggcgugaacc

SEQ ID NO: 617739 - RNA, 26 nt, Human
aaguguugagauuacaggcgugagcc

SEQ ID NO: 617740 - RNA, 24 nt, Human
aauuuugcguuuuuaguagagaug

SEQ ID NO: 617741 - RNA, 24 nt, Human
acagagugagacucugccucaaaa

SEQ ID NO: 617742 - RNA, 24 nt, Human
acagggcuucaccauguuggccag

SEQ ID NO: 617743 - RNA, 18 nt, Human
accauguuggccaggcug

SEQ ID NO: 617744 - RNA, 24 nt, Human
accauguuggccaggcuggucucg

SEQ ID NO: 617745 - RNA, 19 nt, Human
acccaggcuggagugcagu

SEQ ID NO: 617746 - RNA, 23 nt, Human
accccugccucagggccuuugca

SEQ ID NO: 617747 - RNA, 24 nt, Human
acccugggcgacagagugagacuc

SEQ ID NO: 617748 - RNA, 24 nt, Human
accgcacuccacccugggcgacag

SEQ ID NO: 617749 - RNA, 21 nt, Human
accgggcuguccggcgguggc

SEQ ID NO: 617750 - RNA, 21 nt, Human
accgggcuguccggcgguggc

SEQ ID NO: 617751 - RNA, 22 nt, Human
accucccguggcccuucuacca

SEQ ID NO: 617752 - RNA, 22 nt, Human
accucccguggcccuucuacca

SEQ ID NO: 617753 - RNA, 26 nt, Human
acguccuuguuuuuuuuuuuuuuuuu

SEQ ID NO: 617754 - RNA, 18 nt, Human
acucugucacccaggcug

SEQ ID NO: 617755 - RNA, 24 nt, Human
acucugucacccaggcuggagugc

SEQ ID NO: 617756 - RNA, 20 nt, Human
agaauagcugagauuaaagg

SEQ ID NO: 617757 - RNA, 19 nt, Human
agacagagucucccucugu

SEQ ID NO: 617758 - RNA, 22 nt, Human
agauuacaggcgugagccaccg

SEQ ID NO: 617759 - RNA, 18 nt, Human
agccauucuccccugccu

SEQ ID NO: 617760 - RNA, 19 nt, Human
agccuccagaauagcugag

SEQ ID NO: 617761 - RNA, 21 nt, Human
agccucccgaguagcugggac

SEQ ID NO: 617762 - RNA, 21 nt, Human
agcgaccuuggcggcgagggc

SEQ ID NO: 617763 - RNA, 24 nt, Human
agcgauucuccugccucagccucc

SEQ ID NO: 617764 - RNA, 19 nt, Human
aggcagagcucgcugcgac

SEQ ID NO: 617765 - RNA, 20 nt, Human
aggcaggcgccaccacgccc

SEQ ID NO: 617766 - RNA, 20 nt, Human
aggcaugcaccaccaggccc

SEQ ID NO: 617767 - RNA, 19 nt, Human
aggcaugcgccaccacacc

SEQ ID NO: 617768 - RNA, 28 nt, Human
aggcccccccccccccaagccauucucc

SEQ ID NO: 617769 - RNA, 19 nt, Human
aggccuggggcuggggguc

SEQ ID NO: 617770 - RNA, 19 nt, Human
aggccuggggcuggggguc

SEQ ID NO: 617771 - RNA, 19 nt, Human
aggcggagguugcaaugag

SEQ ID NO: 617772 - RNA, 23 nt, Human
aggcgugagccaccgugcccggc

SEQ ID NO: 617773 - RNA, 24 nt, Human
aggcugaggcagcagaauggcuug

SEQ ID NO: 617774 - RNA, 25 nt, Human
aggcuggagugcaguggcgcgaucu

SEQ ID NO: 617775 - RNA, 25 nt, Human
aggcuggagugcagugguguaaucu

SEQ ID NO: 617776 - RNA, 24 nt, Human
aggugauccgcccaucuuggccuc

SEQ ID NO: 617777 - RNA, 22 nt, Human
aguagagaugggguuucuccau

SEQ ID NO: 617778 - RNA, 21 nt, Human
aguagagauggguuucaccau

SEQ ID NO: 617779 - RNA, 21 nt, Human
aguagcugggacuauaggcau

SEQ ID NO: 617780 - RNA, 18 nt, Human
aguagcugggauuacagg

SEQ ID NO: 617781 - RNA, 20 nt, Human
aguagcugggauuacaggca

SEQ ID NO: 617782 - RNA, 18 nt, Human
aguaucugggauuacagg

SEQ ID NO: 617783 - RNA, 20 nt, Human
aguaucugggauuacaggug

SEQ ID NO: 617784 - RNA, 25 nt, Human
agucuggucucaaacuccugaccuc

SEQ ID NO: 617785 - RNA, 24 nt, Human
agugauucuccugccucagccucc

SEQ ID NO: 617786 - RNA, 21 nt, Human
agugcaguggcgcgaucucag

SEQ ID NO: 617787 - RNA, 23 nt, Human
agugcaguggcgcgaucucagcu

SEQ ID NO: 617788 - RNA, 24 nt, Human
agugcaguggcgcgaucucagcuc

SEQ ID NO: 617789 - RNA, 19 nt, Human
agugcagugguguaaucuc

SEQ ID NO: 617790 - RNA, 21 nt, Human
agugcagugguguaaucucag

SEQ ID NO: 617791 - RNA, 23 nt, Human
agugcagugguguaaucucagcu

SEQ ID NO: 617792 - RNA, 18 nt, Human
agugcugggauuacaggc

SEQ ID NO: 617793 - RNA, 18 nt, Human
agugcugggauuacaggc

SEQ ID NO: 617794 - RNA, 24 nt, Human
agugguguaaucucagcucacugc

SEQ ID NO: 617795 - RNA, 21 nt, Human
auccuccugccuuagccuccc

SEQ ID NO: 617796 - RNA, 24 nt, Human
aucgugccaccgcacuccacccug

SEQ ID NO: 617797 - RNA, 18 nt, Human
aucucacucugucaccca

SEQ ID NO: 617798 - RNA, 23 nt, Human
aucucuucucugagggacuccaa

SEQ ID NO: 617799 - RNA, 24 nt, Human
augggguuucuccauguuggucag

SEQ ID NO: 617800 - RNA, 23 nt, Human
auggguuucaccauguuggccag

SEQ ID NO: 617801 - RNA, 24 nt, Human
auggguuucaccauguuggccagg

SEQ ID NO: 617802 - RNA, 18 nt, Human
auucuccugccucagccu

SEQ ID NO: 617803 - RNA, 18 nt, Human
auugucuccaccaccucc

SEQ ID NO: 617804 - RNA, 24 nt, Human
auuuuuaguagagauggguuucac

SEQ ID NO: 617805 - RNA, 24 nt, Human
auuuuuguauuuuuaguagagaug

SEQ ID NO: 617806 - RNA, 23 nt, Human
caaaaacaacaaaucucuguccu

SEQ ID NO: 617807 - RNA, 24 nt, Human
caaagugcugggauuacaggcaug

SEQ ID NO: 617808 - RNA, 24 nt, Human
caaagugcugggauuacaggcgug

SEQ ID NO: 617809 - RNA, 24 nt, Human
caaaguguugagauuacaggcgug

SEQ ID NO: 617810 - RNA, 23 nt, Human
caaccuccaccuccuggguucaa

SEQ ID NO: 617811 - RNA, 22 nt, Human
caagcaauccuccugccuuagc

SEQ ID NO: 617812 - RNA, 27 nt, Human
caagcaauccuccugccuuagccuccc

SEQ ID NO: 617813 - RNA, 28 nt, Human
caagcaauucucaugccucagccucccg

SEQ ID NO: 617814 - RNA, 20 nt, Human
caagcgauucuccugccuca

SEQ ID NO: 617815 - RNA, 22 nt, Human
caagcgauucuccugccucagc

SEQ ID NO: 617816 - RNA, 27 nt, Human
caagugauucucccgccuaagccucca

SEQ ID NO: 617817 - RNA, 22 nt, Human
caagugauucuccugccucagc

SEQ ID NO: 617818 - RNA, 19 nt, Human
cacaccuguuaucccagcu

SEQ ID NO: 617819 - RNA, 19 nt, Human
cacauugucuccaccaccu

SEQ ID NO: 617820 - RNA, 24 nt, Human
caccacacccagcuaauuuuugua

SEQ ID NO: 617821 - RNA, 24 nt, Human
caccacaccuggcuaauuuuugua

SEQ ID NO: 617822 - RNA, 21 nt, Human
caccacaccuguuaucccagc

SEQ ID NO: 617823 - RNA, 19 nt, Human
caccaggcccagcuaauuu

SEQ ID NO: 617824 - RNA, 21 nt, Human
caccauguuggccaggcuggu

SEQ ID NO: 617825 - RNA, 21 nt, Human
caccauguuggccaggcuggu

SEQ ID NO: 617826 - RNA, 24 nt, Human
caccauguuggccaggcuggucuc

SEQ ID NO: 617827 - RNA, 24 nt, Human
caccauguuggccaggcuggucuc

SEQ ID NO: 617828 - RNA, 27 nt, Human
caccauguuggccaggcuggucuccaa

SEQ ID NO: 617829 - RNA, 27 nt, Human
caccauguuggccaggcuggucucgaa

SEQ ID NO: 617830 - RNA, 24 nt, Human
cacccaggcuggagugcaguggcg

SEQ ID NO: 617831 - RNA, 24 nt, Human
caccgcacuccacccugggcgaca

SEQ ID NO: 617832 - RNA, 21 nt, Human
caccuccaccucccguggccc

SEQ ID NO: 617833 - RNA, 21 nt, Human
caccuccaccucccguggccc

SEQ ID NO: 617834 - RNA, 18 nt, Human
caccuguuaucccagcua

SEQ ID NO: 617835 - RNA, 24 nt, Human
caccuguuaucccagcuacucagg

SEQ ID NO: 617836 - RNA, 22 nt, Human
cacuccacccugggcgacagag

SEQ ID NO: 617837 - RNA, 23 nt, Human
cacucugucacccaggcuggagu

SEQ ID NO: 617838 - RNA, 24 nt, Human
cacucugucacccaggcuggagug

SEQ ID NO: 617839 - RNA, 21 nt, Human
cacugcaaccuccaccuccug

SEQ ID NO: 617840 - RNA, 23 nt, Human
cacugcaaccuccaccuccuggg

SEQ ID NO: 617841 - RNA, 18 nt, Human
cacugcaaccucugccuc

SEQ ID NO: 617842 - RNA, 21 nt, Human
cacugcaaccucugccuccca

SEQ ID NO: 617843 - RNA, 21 nt, Human
cacugcaaccucugccuccug

SEQ ID NO: 617844 - RNA, 23 nt, Human
cacugcaaccucugccuccuggg

SEQ ID NO: 617845 - RNA, 19 nt, Human
cacuggguccucuggggga

SEQ ID NO: 617846 - RNA, 22 nt, Human
cagaauagcugagauuaaaggc

SEQ ID NO: 617847 - RNA, 22 nt, Human
cagagcucgcugcgaccccggc

SEQ ID NO: 617848 - RNA, 24 nt, Human
cagagucucccucuguugcccagg

SEQ ID NO: 617849 - RNA, 20 nt, Human
cagcacagcgaccuuggcgg

SEQ ID NO: 617850 - RNA, 20 nt, Human
cagccucccgaguaucuggg

SEQ ID NO: 617851 - RNA, 20 nt, Human
cagccuccuggguagcugag

SEQ ID NO: 617852 - RNA, 24 nt, Human
cagcuacucaggaggcugaggcag

SEQ ID NO: 617853 - RNA, 20 nt, Human
caggaggcugaggcagcaga

SEQ ID NO: 617854 - RNA, 24 nt, Human
cagggcuucaccauguuggccagg

SEQ ID NO: 617855 - RNA, 21 nt, Human
caggugcccaccaccacaccc

SEQ ID NO: 617856 - RNA, 23 nt, Human
caggugcccaccaccacacccag

SEQ ID NO: 617857 - RNA, 24 nt, Human
caggugggcucucaggccuaccag

SEQ ID NO: 617858 - RNA, 24 nt, Human
caggugggcucucaggccuaccag

SEQ ID NO: 617859 - RNA, 24 nt, Human
cauguuggccaggcuggucuccaa

SEQ ID NO: 617860 - RNA, 24 nt, Human
cauguuggccaggcuggucucgaa

SEQ ID NO: 617861 - RNA, 18 nt, Human
cauugccagggcccucag

SEQ ID NO: 617862 - RNA, 18 nt, Human
cauugccagggcccucag

SEQ ID NO: 617863 - RNA, 22 nt, Human
ccaaagugcugggauuacaggc

SEQ ID NO: 617864 - RNA, 22 nt, Human
ccaaagugcugggauuacaggc

SEQ ID NO: 617865 - RNA, 23 nt, Human
ccaaagugcugggauuacaggca

SEQ ID NO: 617866 - RNA, 24 nt, Human
ccaaagugcugggauuacaggcau

SEQ ID NO: 617867 - RNA, 24 nt, Human
ccaaagugcugggauuacaggcgu

SEQ ID NO: 617868 - RNA, 22 nt, Human
ccaaaguguugagauuacaggc

SEQ ID NO: 617869 - RNA, 22 nt, Human
ccaaaguguugagauuacaggc

SEQ ID NO: 617870 - RNA, 24 nt, Human
ccaaaguguugagauuacaggcgu

SEQ ID NO: 617871 - RNA, 23 nt, Human
ccaagccauucuccccugccugc

SEQ ID NO: 617872 - RNA, 25 nt, Human
ccaccacgcccggcuaauuuugcgu

SEQ ID NO: 617873 - RNA, 24 nt, Human
ccaccgcacuccacccugggcgac

SEQ ID NO: 617874 - RNA, 24 nt, Human
ccaccuccuggguucaagugauuc

SEQ ID NO: 617875 - RNA, 20 nt, Human
ccaggcuggucuccaacucc

SEQ ID NO: 617876 - RNA, 24 nt, Human
cccaaagugcugggauuacaggca

SEQ ID NO: 617877 - RNA, 18 nt, Human
cccacacuccgggucucc

SEQ ID NO: 617878 - RNA, 21 nt, Human
cccacacuccgggucuccagu

SEQ ID NO: 617879 - RNA, 21 nt, Human
cccaccaccacacccagcuaa

SEQ ID NO: 617880 - RNA, 23 nt, Human
cccagguucaagcaauucucaug

SEQ ID NO: 617881 - RNA, 22 nt, Human
cccaucuuggccucccaaagug

SEQ ID NO: 617882 - RNA, 19 nt, Human
ccccaagccauucuccccu

SEQ ID NO: 617883 - RNA, 25 nt, Human
ccccaagccauucuccccugccugc

SEQ ID NO: 617884 - RNA, 20 nt, Human
ccccccaagccauucucccc

SEQ ID NO: 617885 - RNA, 21 nt, Human
cccccccaagccauucucccc

SEQ ID NO: 617886 - RNA, 21 nt, Human
cccccccccccccaagccauu

SEQ ID NO: 617887 - RNA, 20 nt, Human
ccccugccugccugcgaccg

SEQ ID NO: 617888 - RNA, 19 nt, Human
cccgaguagcugggacuau

SEQ ID NO: 617889 - RNA, 24 nt, Human
cccgaguagcugggacuauaggca

SEQ ID NO: 617890 - RNA, 19 nt, Human
cccgaguaucugggauuac

SEQ ID NO: 617891 - RNA, 20 nt, Human
cccgccuaagccuccagaau

SEQ ID NO: 617892 - RNA, 24 nt, Human
cccucuguugcccaggcuggagug

SEQ ID NO: 617893 - RNA, 22 nt, Human
cccugccuggacccuggcguuc

SEQ ID NO: 617894 - RNA, 19 nt, Human
cccugugccguaaggcucc

SEQ ID NO: 617895 - RNA, 19 nt, Human
cccugugccguaaggcucc

SEQ ID NO: 617896 - RNA, 21 nt, Human
ccgaguaucugggauuacagg

SEQ ID NO: 617897 - RNA, 24 nt, Human
ccgcacccugccuggacccuggcg

SEQ ID NO: 617898 - RNA, 22 nt, Human
ccuccaccuccuggguucaagu

SEQ ID NO: 617899 - RNA, 18 nt, Human
ccuccagaauagcugaga

SEQ ID NO: 617900 - RNA, 22 nt, Human
ccucccagguucaagcaauucu

SEQ ID NO: 617901 - RNA, 21 nt, Human
ccuccuggguucaagugauuc

SEQ ID NO: 617902 - RNA, 24 nt, Human
ccuccuggguucaagugauucucc

SEQ ID NO: 617903 - RNA, 24 nt, Human
ccuccuggguucaagugauucucc

SEQ ID NO: 617904 - RNA, 22 nt, Human
ccucugccuccuggguucaagu

SEQ ID NO: 617905 - RNA, 23 nt, Human
ccucugggggaucggggaggucc

SEQ ID NO: 617906 - RNA, 19 nt, Human
ccugaccucaagugaucug

SEQ ID NO: 617907 - RNA, 22 nt, Human
ccugaccucaagugaucugccc

SEQ ID NO: 617908 - RNA, 18 nt, Human
ccugaccucaggugaucc

SEQ ID NO: 617909 - RNA, 23 nt, Human
ccugaccucaggugauccgccca

SEQ ID NO: 617910 - RNA, 22 nt, Human
ccugaccucaggugaucugccc

SEQ ID NO: 617911 - RNA, 19 nt, Human
ccugcagcuccugcagcgc

SEQ ID NO: 617912 - RNA, 23 nt, Human
ccugccuuagccucccgaguagc

SEQ ID NO: 617913 - RNA, 24 nt, Human
ccugcgaccgcuuaccugcugcuc

SEQ ID NO: 617914 - RNA, 22 nt, Human
ccuggguucaagugauucuccc

SEQ ID NO: 617915 - RNA, 23 nt, Human
ccuggguucaagugauucuccuc

SEQ ID NO: 617916 - RNA, 23 nt, Human
ccuggguucaagugauucuccug

SEQ ID NO: 617917 - RNA, 23 nt, Human
ccuuaguagcugggauuacaggc

SEQ ID NO: 617918 - RNA, 22 nt, Human
ccuuccuuccucccuaaguccc

SEQ ID NO: 617919 - RNA, 21 nt, Human
cgaacccaggugcccacacuc

SEQ ID NO: 617920 - RNA, 22 nt, Human
cgccaccgcacccugccuggac

SEQ ID NO: 617921 - RNA, 20 nt, Human
cgccuaagccuccagaauag

SEQ ID NO: 617922 - RNA, 24 nt, Human
cgccuaagccuccagaauagcuga

SEQ ID NO: 617923 - RNA, 24 nt, Human
cgccucggccucccaaagugcugg

SEQ ID NO: 617924 - RNA, 22 nt, Human
cgcugugcgggggcgccagcgg

SEQ ID NO: 617925 - RNA, 22 nt, Human
cgcugugcgggggcgccagcgg

SEQ ID NO: 617926 - RNA, 24 nt, Human
cuaauuuugcguuuuuaguagaga

SEQ ID NO: 617927 - RNA, 23 nt, Human
cuaauuuuuguauuuuuaguaga

SEQ ID NO: 617928 - RNA, 23 nt, Human
cuaauuuuuguauuuuuaguaga

SEQ ID NO: 617929 - RNA, 24 nt, Human
cucaagcaauccuccugccuuagc

SEQ ID NO: 617930 - RNA, 24 nt, Human
cucacucugucacccaggcuggag

SEQ ID NO: 617931 - RNA, 24 nt, Human
cucacugcaaccuccaccuccugg

SEQ ID NO: 617932 - RNA, 27 nt, Human
cucacugcaaccuccaccuccuggguu

SEQ ID NO: 617933 - RNA, 24 nt, Human
cucacugcaaccucugccucccag

SEQ ID NO: 617934 - RNA, 24 nt, Human
cucacugcaaccucugccucccag

SEQ ID NO: 617935 - RNA, 24 nt, Human
cucacugcaaccucugccuccugg

SEQ ID NO: 617936 - RNA, 24 nt, Human
cucagccuccuuaguagcugggau

SEQ ID NO: 617937 - RNA, 20 nt, Human
cucagggccuuugcacugcu

SEQ ID NO: 617938 - RNA, 24 nt, Human
cuccauguuggucagucuggucuc

SEQ ID NO: 617939 - RNA, 18 nt, Human
cucccgccuaagccucca

SEQ ID NO: 617940 - RNA, 23 nt, Human
cucccgccuaagccuccagaaua

SEQ ID NO: 617941 - RNA, 21 nt, Human
cucccuaacuucuccaggugu

SEQ ID NO: 617942 - RNA, 20 nt, Human
cucccuaaguccccgaggca

SEQ ID NO: 617943 - RNA, 24 nt, Human
cucccucuguugcccaggcuggag

SEQ ID NO: 617944 - RNA, 26 nt, Human
cuccugaccucaagugaucugcccgc

SEQ ID NO: 617945 - RNA, 26 nt, Human
cuccugaccucaggugaucugcccgc

SEQ ID NO: 617946 - RNA, 23 nt, Human
cuccuggguagcugagguuuaca

SEQ ID NO: 617947 - RNA, 20 nt, Human
cuccuggguucaagugauuc

SEQ ID NO: 617948 - RNA, 21 nt, Human
cuccuggguucaagugauucu

SEQ ID NO: 617949 - RNA, 21 nt, Human
cuccuggguucaagugauucu

SEQ ID NO: 617950 - RNA, 23 nt, Human
cucucaggccuaccaggcauugc

SEQ ID NO: 617951 - RNA, 23 nt, Human
cucucaggccuaccaggcauugc

SEQ ID NO: 617952 - RNA, 23 nt, Human
cucuguugcccaggcuggagugc

SEQ ID NO: 617953 - RNA, 18 nt, Human
cucuuguugccuaggcug

SEQ ID NO: 617954 - RNA, 22 nt, Human
cucuuguugccuaggcuggagu

SEQ ID NO: 617955 - RNA, 24 nt, Human
cugaggcagcagaauggcuugaag

SEQ ID NO: 617956 - RNA, 18 nt, Human
cugcaaccuccaccuccu

SEQ ID NO: 617957 - RNA, 23 nt, Human
cugcaaccuccaccuccuggguu

SEQ ID NO: 617958 - RNA, 24 nt, Human
cugcaaccuccaccuccuggguuc

SEQ ID NO: 617959 - RNA, 24 nt, Human
cugcaaccuccgcuucccuaguuc

SEQ ID NO: 617960 - RNA, 23 nt, Human
cugcaaccucugccucccagguu

SEQ ID NO: 617961 - RNA, 24 nt, Human
cugcaaccucugccucccagguuc

SEQ ID NO: 617962 - RNA, 23 nt, Human
cugcaaccucugccuccuggguu

SEQ ID NO: 617963 - RNA, 24 nt, Human
cugcaaccucugccuccuggguuc

SEQ ID NO: 617964 - RNA, 18 nt, Human
cugcagcuccugcagcgc

SEQ ID NO: 617965 - RNA, 23 nt, Human
cugccucagccuccuggguagcu

SEQ ID NO: 617966 - RNA, 23 nt, Human
cugccucagccuccuuaguagcu

SEQ ID NO: 617967 - RNA, 23 nt, Human
cugccuccuggguucaagugauu

SEQ ID NO: 617968 - RNA, 23 nt, Human
cugccuuagccucccgaguagcu

SEQ ID NO: 617969 - RNA, 20 nt, Human
cugcgaccgcuuaccugcug

SEQ ID NO: 617970 - RNA, 24 nt, Human
cuggagugcaauggcaugaucuca

SEQ ID NO: 617971 - RNA, 19 nt, Human
cugggcccgcugugcgggg

SEQ ID NO: 617972 - RNA, 19 nt, Human
cugggcccgcugugcgggg

SEQ ID NO: 617973 - RNA, 20 nt, Human
cugggcucaagcaauccucc

SEQ ID NO: 617974 - RNA, 21 nt, Human
cuggggcugggggucagccug

SEQ ID NO: 617975 - RNA, 21 nt, Human
cuggggcugggggucagccug

SEQ ID NO: 617976 - RNA, 18 nt, Human
cuggguagcugagguuua

SEQ ID NO: 617977 - RNA, 21 nt, Human
cuguuaucccagcuacucagg

SEQ ID NO: 617978 - RNA, 24 nt, Human
cuuagccucccgaguagcugggac

SEQ ID NO: 617979 - RNA, 21 nt, Human
cuucaccauguuggccaggcu

SEQ ID NO: 617980 - RNA, 20 nt, Human
cuugcucuguugccaggcug

SEQ ID NO: 617981 - RNA, 24 nt, Human
cuuguugccuaggcuggagugcaa

SEQ ID NO: 617982 - RNA, 24 nt, Human
gaagaaagaggccccccccccccc

SEQ ID NO: 617983 - RNA, 24 nt, Human
gaauagcugagauuaaaggcaugc

SEQ ID NO: 617984 - RNA, 24 nt, Human
gacagagugagacucugccucaaa

SEQ ID NO: 617985 - RNA, 24 nt, Human
gaccucaagugaucugcccgccuc

SEQ ID NO: 617986 - RNA, 24 nt, Human
gaccucaggugauccgcccaucuu

SEQ ID NO: 617987 - RNA, 22 nt, Human
gaccucaggugaucugcccgcc

SEQ ID NO: 617988 - RNA, 22 nt, Human
gaccuuggcggcgagggcagcc

SEQ ID NO: 617989 - RNA, 22 nt, Human
gagacagaguuucacucuuguu

SEQ ID NO: 617990 - RNA, 24 nt, Human
gagaugggguuucuccauguuggu

SEQ ID NO: 617991 - RNA, 24 nt, Human
gagauggguuucaccauguuggcc

SEQ ID NO: 617992 - RNA, 19 nt, Human
gagguugcaaugagcccag

SEQ ID NO: 617993 - RNA, 24 nt, Human
gaguagcugggacuauaggcaugc

SEQ ID NO: 617994 - RNA, 22 nt, Human
gaucucuggcucacugcaaccu

SEQ ID NO: 617995 - RNA, 18 nt, Human
gauuacaggcaugcgcca

SEQ ID NO: 617996 - RNA, 21 nt, Human
gauuacaggcgugaaccagug

SEQ ID NO: 617997 - RNA, 18 nt, Human
gauuacaggcgugagcca

SEQ ID NO: 617998 - RNA, 24 nt, Human
gauuacaggcgugagccaccgugc

SEQ ID NO: 617999 - RNA, 22 nt, Human
gcaaccucugccucccagguuc

SEQ ID NO: 618000 - RNA, 20 nt, Human
gcaccaccaggcccagcuaa

SEQ ID NO: 618001 - RNA, 20 nt, Human
gcacugcuuguuccugcugc

SEQ ID NO: 618002 - RNA, 21 nt, Human
gccaccacaccuguuauccca

SEQ ID NO: 618003 - RNA, 19 nt, Human
gccaccgcacuccacccug

SEQ ID NO: 618004 - RNA, 23 nt, Human
gcccaagucccguucucgaaccc

SEQ ID NO: 618005 - RNA, 20 nt, Human
gcccagaucgugccaccgca

SEQ ID NO: 618006 - RNA, 20 nt, Human
gcccaggcuggagugcagug

SEQ ID NO: 618007 - RNA, 24 nt, Human
gcccaggcuggagugcaguggugu

SEQ ID NO: 618008 - RNA, 24 nt, Human
gccuaggcuggagugcaauggcau

SEQ ID NO: 618009 - RNA, 21 nt, Human
gccuggggcugggggucagcc

SEQ ID NO: 618010 - RNA, 21 nt, Human
gccuggggcugggggucagcc

SEQ ID NO: 618011 - RNA, 23 nt, Human
gcgauucuccugccucagccucc

SEQ ID NO: 618012 - RNA, 19 nt, Human
gcuggagugcaauggcaug

SEQ ID NO: 618013 - RNA, 23 nt, Human
gcuggucuccaacuccugaccuc

SEQ ID NO: 618014 - RNA, 23 nt, Human
gcuggucucgaacuccugaccuc

SEQ ID NO: 618015 - RNA, 19 nt, Human
gcugugggguggcccagga

SEQ ID NO: 618016 - RNA, 24 nt, Human
ggagguugcaaugagcccagaucg

SEQ ID NO: 618017 - RNA, 22 nt, Human
ggauuacaggcaugcgccaccg

SEQ ID NO: 618018 - RNA, 21 nt, Human
ggccaggccuggggcuggggg

SEQ ID NO: 618019 - RNA, 21 nt, Human
ggccaggccuggggcuggggg

SEQ ID NO: 618020 - RNA, 24 nt, Human
ggccucguccuuccuuccucccua

SEQ ID NO: 618021 - RNA, 24 nt, Human
ggcuggucuccaacuccugaccuc

SEQ ID NO: 618022 - RNA, 24 nt, Human
ggcuggucucgaacuccugaccuc

SEQ ID NO: 618023 - RNA, 20 nt, Human
gggagguccaggcagagcuc

SEQ ID NO: 618024 - RNA, 22 nt, Human
gggcucaagcaauccuccugcc

SEQ ID NO: 618025 - RNA, 22 nt, Human
gggcuucaccauguuggccagg

SEQ ID NO: 618026 - RNA, 20 nt, Human
gggggaucggggagguccag

SEQ ID NO: 618027 - RNA, 18 nt, Human
gggguuucuccauguugg

SEQ ID NO: 618028 - RNA, 22 nt, Human
gggguuucuccauguuggucag

SEQ ID NO: 618029 - RNA, 21 nt, Human
ggguuucaccauguuggccag

SEQ ID NO: 618030 - RNA, 19 nt, Human
ggucucgaacuccugaccu

SEQ ID NO: 618031 - RNA, 18 nt, Human
guagcugggauuacaggc

SEQ ID NO: 618032 - RNA, 23 nt, Human
gucaucucuucucugagggacuc

SEQ ID NO: 618033 - RNA, 24 nt, Human
gucuugcucuguugccaggcugga

SEQ ID NO: 618034 - RNA, 24 nt, Human
gugaucugcccgccucggccuccc

SEQ ID NO: 618035 - RNA, 23 nt, Human
gugauucuccugccucagccucc

SEQ ID NO: 618036 - RNA, 22 nt, Human
uaaacacgucagacacaccccu

SEQ ID NO: 618037 - RNA, 22 nt, Human
uaaagacagggucuugcucugu

SEQ ID NO: 618038 - RNA, 24 nt, Human
uaauuuuuguauuuuuaguagaga

SEQ ID NO: 618039 - RNA, 24 nt, Human
uaauuuuuguauuuuuaguagaga

SEQ ID NO: 618040 - RNA, 22 nt, Human
uacaggcgcacgccaccacacc

SEQ ID NO: 618041 - RNA, 23 nt, Human
uacaggcgugagccaccgugccc

SEQ ID NO: 618042 - RNA, 24 nt, Human
uacaggugcccaccaccacaccca

SEQ ID NO: 618043 - RNA, 22 nt, Human
uagagacagggcuucaccaugu

SEQ ID NO: 618044 - RNA, 21 nt, Human
uagagauggguuucaccaugu

SEQ ID NO: 618045 - RNA, 24 nt, Human
uaguagagacagggcuucaccaug

SEQ ID NO: 618046 - RNA, 25 nt, Human
uaguagagacagggcuucaccaugu

SEQ ID NO: 618047 - RNA, 24 nt, Human
uaguagagaugggguuucuccaug

SEQ ID NO: 618048 - RNA, 23 nt, Human
uaguagagauggguuucaccaug

SEQ ID NO: 618049 - RNA, 21 nt, Human
uaguagcugggauuacaggca

SEQ ID NO: 618050 - RNA, 25 nt, Human
uaguagcugggauuacaggcaggcg

SEQ ID NO: 618051 - RNA, 25 nt, Human
uaucugggcucaagcaauccuccug

SEQ ID NO: 618052 - RNA, 22 nt, Human
ucaaaaacaaaaacaacaaauc

SEQ ID NO: 618053 - RNA, 19 nt, Human
ucaagugauucucccgccu

SEQ ID NO: 618054 - RNA, 19 nt, Human
ucaagugauucuccugccu

SEQ ID NO: 618055 - RNA, 24 nt, Human
ucacaguagccuugacuaucuggg

SEQ ID NO: 618056 - RNA, 24 nt, Human
ucacccaggcuggagugcaguggc

SEQ ID NO: 618057 - RNA, 20 nt, Human
ucacucccuaacuucuccag

SEQ ID NO: 618058 - RNA, 24 nt, Human
ucacucugucacccaggcuggagu

SEQ ID NO: 618059 - RNA, 21 nt, Human
ucacucuuguugccuaggcug

SEQ ID NO: 618060 - RNA, 23 nt, Human
ucacucuuguugccuaggcugga

SEQ ID NO: 618061 - RNA, 23 nt, Human
ucacugcaaccuccaccuccugg

SEQ ID NO: 618062 - RNA, 24 nt, Human
ucacugcaaccuccaccuccuggg

SEQ ID NO: 618063 - RNA, 25 nt, Human
ucacugcaaccuccaccuccugggu

SEQ ID NO: 618064 - RNA, 27 nt, Human
ucacugcaaccuccaccuccuggguuc

SEQ ID NO: 618065 - RNA, 18 nt, Human
ucacugcaaccuccgcuu

SEQ ID NO: 618066 - RNA, 19 nt, Human
ucacugcaaccuccgcuuc

SEQ ID NO: 618067 - RNA, 21 nt, Human
ucacugcaaccuccgcuuccc

SEQ ID NO: 618068 - RNA, 24 nt, Human
ucacugcaaccuccgcuucccuag

SEQ ID NO: 618069 - RNA, 27 nt, Human
ucacugcaaccuccgcuucccuaguuc

SEQ ID NO: 618070 - RNA, 28 nt, Human
ucacugcaaccuccgcuucggguccucc

SEQ ID NO: 618071 - RNA, 19 nt, Human
ucacugcaaccucugccuc

SEQ ID NO: 618072 - RNA, 24 nt, Human
ucacugcaaccucugccucccagg

SEQ ID NO: 618073 - RNA, 25 nt, Human
ucacugcaaccucugccucccaggu

SEQ ID NO: 618074 - RNA, 24 nt, Human
ucacugcaaccucugccuccuggg

SEQ ID NO: 618075 - RNA, 25 nt, Human
ucacugcaaccucugccuccugggu

SEQ ID NO: 618076 - RNA, 27 nt, Human
ucacugcaaccucugccuccuggguuc

SEQ ID NO: 618077 - RNA, 18 nt, Human
ucacuugagggacugcga

SEQ ID NO: 618078 - RNA, 20 nt, Human
ucagccuccuggguagcuga

SEQ ID NO: 618079 - RNA, 22 nt, Human
ucagccugccgggccugagcug

SEQ ID NO: 618080 - RNA, 22 nt, Human
ucagccugccgggccugagcug

SEQ ID NO: 618081 - RNA, 28 nt, Human
ucagcucacugcaaccuccgcuucccua

SEQ ID NO: 618082 - RNA, 27 nt, Human
ucagcucacugcaaccucugccuccca

SEQ ID NO: 618083 - RNA, 24 nt, Human
uccacccugggcgacagagugaga

SEQ ID NO: 618084 - RNA, 24 nt, Human
ucccaaagugcugggauuacaggc

SEQ ID NO: 618085 - RNA, 24 nt, Human
ucccaaagugcugggauuacaggc

SEQ ID NO: 618086 - RNA, 24 nt, Human
ucccaaaguguugagauuacaggc

SEQ ID NO: 618087 - RNA, 21 nt, Human
ucccagguucaagcaauucuc

SEQ ID NO: 618088 - RNA, 24 nt, Human
ucccagguucaagcaauucucaug

SEQ ID NO: 618089 - RNA, 23 nt, Human
uccccaucacucgccaucccacg

SEQ ID NO: 618090 - RNA, 22 nt, Human
uccccgaggcaggguccuccca

SEQ ID NO: 618091 - RNA, 24 nt, Human
ucccgaguagcugggacuauaggc

SEQ ID NO: 618092 - RNA, 23 nt, Human
ucccgaguaucugggauuacagg

SEQ ID NO: 618093 - RNA, 24 nt, Human
ucccgaguaucugggauuacaggu

SEQ ID NO: 618094 - RNA, 22 nt, Human
ucccguggcccuucuaccaccc

SEQ ID NO: 618095 - RNA, 22 nt, Human
ucccguggcccuucuaccaccc

SEQ ID NO: 618096 - RNA, 21 nt, Human
ucccuaguucaagcgauucuc

SEQ ID NO: 618097 - RNA, 22 nt, Human
ucccuaguucaagcgauucucc

SEQ ID NO: 618098 - RNA, 24 nt, Human
ucccuaguucaagcgauucuccug

SEQ ID NO: 618099 - RNA, 20 nt, Human
ucccucuguugcccaggcug

SEQ ID NO: 618100 - RNA, 24 nt, Human
ucccucuguugcccaggcuggagu

SEQ ID NO: 618101 - RNA, 26 nt, Human
uccuccugccuuagccucccgaguag

SEQ ID NO: 618102 - RNA, 21 nt, Human
uccugcugcccggaagaccau

SEQ ID NO: 618103 - RNA, 25 nt, Human
uccuggguagcugagguuuacaggc

SEQ ID NO: 618104 - RNA, 21 nt, Human
uccuggguucaagugauucuc

SEQ ID NO: 618105 - RNA, 21 nt, Human
uccuggguucaagugauucuc

SEQ ID NO: 618106 - RNA, 24 nt, Human
uccuggguucaagugauucucccg

SEQ ID NO: 618107 - RNA, 24 nt, Human
uccuggguucaagugauucuccug

SEQ ID NO: 618108 - RNA, 24 nt, Human
uccuuaguagcugggauuacaggc

SEQ ID NO: 618109 - RNA, 18 nt, Human
ucggccucccaaagugcu

SEQ ID NO: 618110 - RNA, 23 nt, Human
ucucacucugucacccaggcugg

SEQ ID NO: 618111 - RNA, 24 nt, Human
ucucacucugucacccaggcugga

SEQ ID NO: 618112 - RNA, 26 nt, Human
ucucacucugucacccaggcuggagu

SEQ ID NO: 618113 - RNA, 27 nt, Human
ucucacucugucacccaggcuggagug

SEQ ID NO: 618114 - RNA, 22 nt, Human
ucucccucuguugcccaggcug

SEQ ID NO: 618115 - RNA, 23 nt, Human
ucucccucuguugcccaggcugg

SEQ ID NO: 618116 - RNA, 24 nt, Human
ucucccucuguugcccaggcugga

SEQ ID NO: 618117 - RNA, 24 nt, Human
ucuccugccucagccuccugggua

SEQ ID NO: 618118 - RNA, 25 nt, Human
ucuccugccucagccuccuuaguag

SEQ ID NO: 618119 - RNA, 23 nt, Human
ucucgaacuccugaccucaggug

SEQ ID NO: 618120 - RNA, 24 nt, Human
ucucugagggacuccaauagcuuu

SEQ ID NO: 618121 - RNA, 22 nt, Human
ucucuguccuuucagagaccca

SEQ ID NO: 618122 - RNA, 20 nt, Human
ucugccucaaaaacaaaaac

SEQ ID NO: 618123 - RNA, 23 nt, Human
ucugggggaucggggagguccag

SEQ ID NO: 618124 - RNA, 24 nt, Human
ucugucacccaggcuggagugcag

SEQ ID NO: 618125 - RNA, 18 nt, Human
ucuguugccaggcuggag

SEQ ID NO: 618126 - RNA, 18 nt, Human
ucuguugcccaggcugga

SEQ ID NO: 618127 - RNA, 24 nt, Human
ucuguugcccaggcuggagugcag

SEQ ID NO: 618128 - RNA, 21 nt, Human
ucuugcucuguugccaggcug

SEQ ID NO: 618129 - RNA, 21 nt, Human
ucuugcucuguugccaggcug

SEQ ID NO: 618130 - RNA, 22 nt, Human
ucuugcucuguugccaggcugg

SEQ ID NO: 618131 - RNA, 23 nt, Human
ucuugcucuguugccaggcugga

SEQ ID NO: 618132 - RNA, 19 nt, Human
ucuuguugccuaggcugga

SEQ ID NO: 618133 - RNA, 19 nt, Human
ugaagccgggaggcggagg

SEQ ID NO: 618134 - RNA, 18 nt, Human
ugaccucaagugaucugc

SEQ ID NO: 618135 - RNA, 24 nt, Human
ugaccucaagugaucugcccgccu

SEQ ID NO: 618136 - RNA, 18 nt, Human
ugaccucaggugauccgc

SEQ ID NO: 618137 - RNA, 21 nt, Human
ugaccucaggugauccgccca

SEQ ID NO: 618138 - RNA, 24 nt, Human
ugaccucaggugauccgcccaucu

SEQ ID NO: 618139 - RNA, 18 nt, Human
ugaccucaggugaucugc

SEQ ID NO: 618140 - RNA, 20 nt, Human
ugaccucaggugaucugccc

SEQ ID NO: 618141 - RNA, 23 nt, Human
ugaccucaggugaucugcccgcc

SEQ ID NO: 618142 - RNA, 22 nt, Human
ugagacagagucucccucuguu

SEQ ID NO: 618143 - RNA, 24 nt, Human
ugagacagagucucccucuguugc

SEQ ID NO: 618144 - RNA, 23 nt, Human
ugagacagaguuuugcucuuguu

SEQ ID NO: 618145 - RNA, 21 nt, Human
ugagauuaaaggcaugcgcca

SEQ ID NO: 618146 - RNA, 24 nt, Human
ugagauuaaaggcaugcgccacca

SEQ ID NO: 618147 - RNA, 21 nt, Human
ugagauuacaggcgugagcca

SEQ ID NO: 618148 - RNA, 22 nt, Human
ugagauuacaggcgugagccac

SEQ ID NO: 618149 - RNA, 23 nt, Human
ugagauuacaggcgugagccacc

SEQ ID NO: 618150 - RNA, 23 nt, Human
ugagauuacaggcgugagccacc

SEQ ID NO: 618151 - RNA, 24 nt, Human
ugagauuacaggcgugagccaccg

SEQ ID NO: 618152 - RNA, 22 nt, Human
ugagcccagaucgugccaccgc

SEQ ID NO: 618153 - RNA, 20 nt, Human
ugaggcagcagaauggcuuc

SEQ ID NO: 618154 - RNA, 22 nt, Human
ugaggcggaaucucacucuguc

SEQ ID NO: 618155 - RNA, 24 nt, Human
ugauccgcccaucuuggccuccca

SEQ ID NO: 618156 - RNA, 22 nt, Human
ugcaguggcgcgaucucagcuc

SEQ ID NO: 618157 - RNA, 22 nt, Human
ugcagugguguaaucucagcuc

SEQ ID NO: 618158 - RNA, 20 nt, Human
ugccaggcuggaguauagug

SEQ ID NO: 618159 - RNA, 22 nt, Human
ugccaggcuggaguauaguggu

SEQ ID NO: 618160 - RNA, 18 nt, Human
ugccagggcccucagccc

SEQ ID NO: 618161 - RNA, 18 nt, Human
ugccagggcccucagccc

SEQ ID NO: 618162 - RNA, 21 nt, Human
ugcccaccaccacacccagcu

SEQ ID NO: 618163 - RNA, 18 nt, Human
ugcccaggcuggagugca

SEQ ID NO: 618164 - RNA, 21 nt, Human
ugcccaggcuggagugcagug

SEQ ID NO: 618165 - RNA, 24 nt, Human
ugcccaggcuggagugcaguggug

SEQ ID NO: 618166 - RNA, 18 nt, Human
ugccgggccugagcugcc

SEQ ID NO: 618167 - RNA, 18 nt, Human
ugccgggccugagcugcc

SEQ ID NO: 618168 - RNA, 20 nt, Human
ugccuaggcuggagugcaau

SEQ ID NO: 618169 - RNA, 21 nt, Human
ugccuaggcuggagugcaaug

SEQ ID NO: 618170 - RNA, 24 nt, Human
ugccuaggcuggagugcaauggca

SEQ ID NO: 618171 - RNA, 18 nt, Human
ugccucaaaaacaaaaac

SEQ ID NO: 618172 - RNA, 18 nt, Human
ugccucagccucccgagu

SEQ ID NO: 618173 - RNA, 24 nt, Human
ugccucagccucccgaguaucugg

SEQ ID NO: 618174 - RNA, 23 nt, Human
ugccucagccuccuggguagcug

SEQ ID NO: 618175 - RNA, 24 nt, Human
ugccucagccuccuggguagcuga

SEQ ID NO: 618176 - RNA, 24 nt, Human
ugccucagccuccuuaguagcugg

SEQ ID NO: 618177 - RNA, 18 nt, Human
ugccucagggccuuugca

SEQ ID NO: 618178 - RNA, 19 nt, Human
ugccucagggccuuugcac

SEQ ID NO: 618179 - RNA, 21 nt, Human
ugccucagggccuuugcacug

SEQ ID NO: 618180 - RNA, 22 nt, Human
ugccucagggccuuugcacugc

SEQ ID NO: 618181 - RNA, 22 nt, Human
ugccuccuggguucaagugauu

SEQ ID NO: 618182 - RNA, 23 nt, Human
ugccugcgaccgcuuaccugcug

SEQ ID NO: 618183 - RNA, 24 nt, Human
ugccuuagccucccgaguagcugg

SEQ ID NO: 618184 - RNA, 23 nt, Human
ugcugggauuacaggcgugaacc

SEQ ID NO: 618185 - RNA, 22 nt, Human
ugcugguagcugcagcgggcac

SEQ ID NO: 618186 - RNA, 19 nt, Human
uggagugcaauggcaugau

SEQ ID NO: 618187 - RNA, 24 nt, Human
uggagugcaauggcaugaucucag

SEQ ID NO: 618188 - RNA, 23 nt, Human
uggagugcaguggcgcgaucuca

SEQ ID NO: 618189 - RNA, 24 nt, Human
uggagugcaguggcgcgaucucag

SEQ ID NO: 618190 - RNA, 26 nt, Human
uggagugcagugguguaaggcucuag

SEQ ID NO: 618191 - RNA, 23 nt, Human
uggagugcagugguguaaucuca

SEQ ID NO: 618192 - RNA, 24 nt, Human
uggagugcagugguguaaucucag

SEQ ID NO: 618193 - RNA, 24 nt, Human
uggcaugaucucagcucacugcaa

SEQ ID NO: 618194 - RNA, 21 nt, Human
uggccaggccuggggcugggg

SEQ ID NO: 618195 - RNA, 21 nt, Human
uggccaggccuggggcugggg

SEQ ID NO: 618196 - RNA, 24 nt, Human
uggccaggcuggucuccaacuccu

SEQ ID NO: 618197 - RNA, 24 nt, Human
uggccaggcuggucucgaacuccu

SEQ ID NO: 618198 - RNA, 20 nt, Human
uggcccaggaacuucuggcu

SEQ ID NO: 618199 - RNA, 23 nt, Human
uggccugaaugcuccuuaaacac

SEQ ID NO: 618200 - RNA, 24 nt, Human
uggcgcgaucucagcucacugcaa

SEQ ID NO: 618201 - RNA, 24 nt, Human
uggcuugaagccgggaggcggagg

SEQ ID NO: 618202 - RNA, 29 nt, Human
ugggaagaaagaggcccccccccccccaa

SEQ ID NO: 618203 - RNA, 21 nt, Human
ugggacuauaggcaugcacca

SEQ ID NO: 618204 - RNA, 24 nt, Human
ugggacuauaggcaugcaccacca

SEQ ID NO: 618205 - RNA, 18 nt, Human
ugggauuacaggcaggcg

SEQ ID NO: 618206 - RNA, 21 nt, Human
ugggauuacaggcaggcgcca

SEQ ID NO: 618207 - RNA, 22 nt, Human
ugggauuacaggcaggcgccac

SEQ ID NO: 618208 - RNA, 24 nt, Human
ugggauuacaggcaggcgccacca

SEQ ID NO: 618209 - RNA, 18 nt, Human
ugggauuacaggcaugcg

SEQ ID NO: 618210 - RNA, 21 nt, Human
ugggauuacaggcaugcgcca

SEQ ID NO: 618211 - RNA, 22 nt, Human
ugggauuacaggcaugcgccac

SEQ ID NO: 618212 - RNA, 23 nt, Human
ugggauuacaggcaugcgccacc

SEQ ID NO: 618213 - RNA, 24 nt, Human
ugggauuacaggcaugcgccaccg

SEQ ID NO: 618214 - RNA, 19 nt, Human
ugggauuacaggcgugaac

SEQ ID NO: 618215 - RNA, 21 nt, Human
ugggauuacaggcgugaacca

SEQ ID NO: 618216 - RNA, 21 nt, Human
ugggauuacaggcgugaacca

SEQ ID NO: 618217 - RNA, 21 nt, Human
ugggauuacaggcgugaacca

SEQ ID NO: 618218 - RNA, 24 nt, Human
ugggauuacaggcgugaaccagug

SEQ ID NO: 618219 - RNA, 27 nt, Human
ugggauuacaggcgugaaccagugagu

SEQ ID NO: 618220 - RNA, 21 nt, Human
ugggauuacaggugcccacca

SEQ ID NO: 618221 - RNA, 24 nt, Human
ugggauuacaggugcccaccacca

SEQ ID NO: 618222 - RNA, 21 nt, Human
ugggcgacagagugagacucu

SEQ ID NO: 618223 - RNA, 24 nt, Human
ugggcucaagcaauccuccugccu

SEQ ID NO: 618224 - RNA, 20 nt, Human
ugggggaucggggaggucca

SEQ ID NO: 618225 - RNA, 19 nt, Human
ugggguuucuccauguugg

SEQ ID NO: 618226 - RNA, 23 nt, Human
uggguucaagugauucucccgcc

SEQ ID NO: 618227 - RNA, 23 nt, Human
uggguucaagugauucuccugcc

SEQ ID NO: 618228 - RNA, 23 nt, Human
uggguuucaccauguuggccagg

SEQ ID NO: 618229 - RNA, 24 nt, Human
uggucagucuggucucaaacuccu

SEQ ID NO: 618230 - RNA, 24 nt, Human
ugguguaaucucagcucacugcaa

SEQ ID NO: 618231 - RNA, 18 nt, Human
ugugggguggcccaggaa

SEQ ID NO: 618232 - RNA, 19 nt, Human
ugugggguggcccaggaac

SEQ ID NO: 618233 - RNA, 20 nt, Human
uguugccuaggcuggagugc

SEQ ID NO: 618234 - RNA, 24 nt, Human
uuaguagagacagggcuucaccau

SEQ ID NO: 618235 - RNA, 18 nt, Human
uuaguagagaugggguuu

SEQ ID NO: 618236 - RNA, 24 nt, Human
uuaguagagaugggguuucuccau

SEQ ID NO: 618237 - RNA, 21 nt, Human
uuaguagagauggguuucacc

SEQ ID NO: 618238 - RNA, 23 nt, Human
uuaguagagauggguuucaccau

SEQ ID NO: 618239 - RNA, 24 nt, Human
uuaguagagauggguuucaccaug

SEQ ID NO: 618240 - RNA, 21 nt, Human
uucaagcgauucuccugccuc

SEQ ID NO: 618241 - RNA, 23 nt, Human
uucaagcgauucuccugccucag

SEQ ID NO: 618242 - RNA, 24 nt, Human
uucaagcgauucuccugccucagc

SEQ ID NO: 618243 - RNA, 24 nt, Human
uucaagugauucucccgccuaagc

SEQ ID NO: 618244 - RNA, 21 nt, Human
uucaagugauucuccugccuc

SEQ ID NO: 618245 - RNA, 23 nt, Human
uucaagugauucuccugccucag

SEQ ID NO: 618246 - RNA, 24 nt, Human
uucaagugauucuccugccucagc

SEQ ID NO: 618247 - RNA, 24 nt, Human
uucacucuuguugccuaggcugga

SEQ ID NO: 618248 - RNA, 18 nt, Human
uucagagacccacccauc

SEQ ID NO: 618249 - RNA, 24 nt, Human
uugaagccgggaggcggagguugc

SEQ ID NO: 618250 - RNA, 22 nt, Human
uugcaaugagcccagaucgugc

SEQ ID NO: 618251 - RNA, 19 nt, Human
uugcacugcuuguuccugc

SEQ ID NO: 618252 - RNA, 22 nt, Human
uugcacugcuuguuccugcugc

SEQ ID NO: 618253 - RNA, 18 nt, Human
uugccuaggcuggagugc

SEQ ID NO: 618254 - RNA, 23 nt, Human
uugcguuuuuaguagagaugggg

SEQ ID NO: 618255 - RNA, 21 nt, Human
uuggaagucacuugagggacu

SEQ ID NO: 618256 - RNA, 25 nt, Human
uuggcggcgagggcagccuccccau

SEQ ID NO: 618257 - RNA, 24 nt, Human
uuuaguagagauggguuucaccau

SEQ ID NO: 618258 - RNA, 24 nt, Human
uuucaccauguuggccaggcuggu

SEQ ID NO: 618259 - RNA, 24 nt, Human
uuucacucuuguugccuaggcugg

SEQ ID NO: 618260 - RNA, 18 nt, Human
uuucuccauguuggucag

SEQ ID NO: 618261 - RNA, 19 nt, Human
uuuugcguuuuuaguagag

SEQ ID NO: 618262 - RNA, 20 nt, Human
uuuugcguuuuuaguagaga

SEQ ID NO: 618263 - RNA, 18 nt, Human
uuuugcucuuguugccca

SEQ ID NO: 618264 - RNA, 22 nt, Human
uuuuguauuuuuaguagagaca

SEQ ID NO: 618265 - RNA, 22 nt, Human
uuuuuaguagagaugggguuuc

SEQ ID NO: 618266 - RNA, 20 nt, Human
uuuuuguauuuuuaguagag

SEQ ID NO: 618267 - RNA, 20 nt, Human
uuuuuguauuuuuaguagag

SEQ ID NO: 618268 - RNA, 20 nt, Human
uuuuuuucuuugagacagag

SEQ ID NO: 618269 - RNA, 24 nt, Human
uuuuuuugcuuaaagacagggucu

SEQ ID NO: 618270 - RNA, 20 nt, Human
uuuuuuuuuuugagacagag

SEQ ID NO: 618271 - RNA, 18 nt, Human
uuuuuuuuuuugaggcgg

SEQ ID NO: 618272 - RNA, 26 nt, Human
uuuuuuuuuuuugaggcggaaucuca

SEQ ID NO: 618273 - RNA, 18 nt, Human
uuuuuuuuuuuuucuuug

SEQ ID NO: 618274 - RNA, 22 nt, Human
uuuuuuuuuuuuuugaggcgga

SEQ ID NO: 618275 - RNA, 26 nt, Human
uuuuuuuuuuuuuuuuuuuuuugggg

SEQ ID NO: 618276 - RNA, 22 nt, Human
aacacagcaaaaaucaacaucu

SEQ ID NO: 618277 - RNA, 29 nt, Human
aaccaucuaaaacacauggcaacaucuaa

SEQ ID NO: 618278 - RNA, 19 nt, Human
aggcuccccgagcugagcc

SEQ ID NO: 618279 - RNA, 20 nt, Human
auaaaacacagcaaaaauca

SEQ ID NO: 618280 - RNA, 19 nt, Human
auccuacguaggaaaaccc

SEQ ID NO: 618281 - RNA, 23 nt, Human
auccuacguaggaaaacccuggc

SEQ ID NO: 618282 - RNA, 23 nt, Human
augaaaaaaauacaucaucuaca

SEQ ID NO: 618283 - RNA, 22 nt, Human
auguagaucacuuuuaaagucu

SEQ ID NO: 618284 - RNA, 23 nt, Human
auugguaccaugggugcacucuu

SEQ ID NO: 618285 - RNA, 22 nt, Human
caccacgcggcccccguagagc

SEQ ID NO: 618286 - RNA, 22 nt, Human
cagaauagauaaaaguuucuac

SEQ ID NO: 618287 - RNA, 19 nt, Human
ccccgagcugagccaaguc

SEQ ID NO: 618288 - RNA, 23 nt, Human
ccccuggggauggcaccacgcgg

SEQ ID NO: 618289 - RNA, 22 nt, Human
cgaacaacuacauaauacugaa

SEQ ID NO: 618290 - RNA, 21 nt, Human
cggcccccguagagccggggg

SEQ ID NO: 618291 - RNA, 19 nt, Human
cggccgggcuggcuugggg

SEQ ID NO: 618292 - RNA, 21 nt, Human
cggccuggacgccccaggagc

SEQ ID NO: 618293 - RNA, 26 nt, Human
cgggggaggcugcccugaggagugca

SEQ ID NO: 618294 - RNA, 23 nt, Human
cuaaaacacauggcaacaucuaa

SEQ ID NO: 618295 - RNA, 21 nt, Human
cucuuggcauacacacuccga

SEQ ID NO: 618296 - RNA, 20 nt, Human
cuggagggaccaagaacuug

SEQ ID NO: 618297 - RNA, 22 nt, Human
cuggaugcagcuucuccuaaca

SEQ ID NO: 618298 - RNA, 22 nt, Human
cuuguauaaccaacgaacaacu

SEQ ID NO: 618299 - RNA, 21 nt, Human
gcauacacacuccgagaacac

SEQ ID NO: 618300 - RNA, 18 nt, Human
ggcagggggccggggugg

SEQ ID NO: 618301 - RNA, 29 nt, Human
ggcagggggccggggugguucuggagggg

SEQ ID NO: 618302 - RNA, 18 nt, Human
ggcuggcuugggguuggg

SEQ ID NO: 618303 - RNA, 19 nt, Human
gggauggcaccacgcggcc

SEQ ID NO: 618304 - RNA, 24 nt, Human
ggggaggcugcccugaggagugca

SEQ ID NO: 618305 - RNA, 21 nt, Human
gggguugggugggcgucgggg

SEQ ID NO: 618306 - RNA, 18 nt, Human
gguugggugggcgucggg

SEQ ID NO: 618307 - RNA, 19 nt, Human
uaaaacacagcaaaaauca

SEQ ID NO: 618308 - RNA, 28 nt, Human
uaaaacaguacauauaaauaaaaaggca

SEQ ID NO: 618309 - RNA, 18 nt, Human
uaacaaaaaagaugaaaa

SEQ ID NO: 618310 - RNA, 20 nt, Human
uaacaaaaaagaugaaaaaa

SEQ ID NO: 618311 - RNA, 25 nt, Human
uaaccaacgaacaacuacauaauac

SEQ ID NO: 618312 - RNA, 21 nt, Human
uaccaugggugcacucuuggc

SEQ ID NO: 618313 - RNA, 23 nt, Human
uauaaaacacagcaaaaaucaac

SEQ ID NO: 618314 - RNA, 22 nt, Human
ucacuuguuuccuauuucagau

SEQ ID NO: 618315 - RNA, 25 nt, Human
ucaguuaacaaaaaagaugaaaaaa

SEQ ID NO: 618316 - RNA, 18 nt, Human
uccccgagcugagccaag

SEQ ID NO: 618317 - RNA, 22 nt, Human
uccccgagcugagccaagucug

SEQ ID NO: 618318 - RNA, 21 nt, Human
ugaaaaaaggaaucaauaaau

SEQ ID NO: 618319 - RNA, 22 nt, Human
ugcacucuuggcauacacacuc

SEQ ID NO: 618320 - RNA, 21 nt, Human
uggagggaccaagaacuugua

SEQ ID NO: 618321 - RNA, 20 nt, Human
uggcuugggguugggugggc

SEQ ID NO: 618322 - RNA, 24 nt, Human
uggggauggcaccacgcggccccc

SEQ ID NO: 618323 - RNA, 19 nt, Human
ugguaccaugggugcacuc

SEQ ID NO: 618324 - RNA, 23 nt, Human
ugguucuggagggaccaagaacu

SEQ ID NO: 618325 - RNA, 23 nt, Human
uucaacuucccuucuccaacauc

SEQ ID NO: 618326 - RNA, 23 nt, Human
uucucagaauagauaaaaguuuc

SEQ ID NO: 618327 - RNA, 18 nt, Human
uucuccaacaucauuucu

SEQ ID NO: 618328 - RNA, 21 nt, Human
uuuuuuuuuuuuuuuuucacc

SEQ ID NO: 618329 - RNA, 20 nt, Human
aaagugcugggauuacaggc

SEQ ID NO: 618330 - RNA, 24 nt, Human
aaagugcugggauuacaggcccga

SEQ ID NO: 618331 - RNA, 24 nt, Human
aaagugcugggauuacaggcguga

SEQ ID NO: 618332 - RNA, 23 nt, Human
aacaccugggucccaggcccaaa

SEQ ID NO: 618333 - RNA, 20 nt, Human
aaccuccgccucccagacuc

SEQ ID NO: 618334 - RNA, 27 nt, Human
aacucaugaccucaagugaucuaccuu

SEQ ID NO: 618335 - RNA, 26 nt, Human
aagcgauucucgugccugagccuccu

SEQ ID NO: 618336 - RNA, 18 nt, Human
aagugcugggauuacagg

SEQ ID NO: 618337 - RNA, 19 nt, Human
aagugcugggauuacaggc

SEQ ID NO: 618338 - RNA, 19 nt, Human
aagugcugggauuacaggc

SEQ ID NO: 618339 - RNA, 19 nt, Human
aagugcugggauuacaggc

SEQ ID NO: 618340 - RNA, 26 nt, Human
aagugcugggauuacaggcccgagcc

SEQ ID NO: 618341 - RNA, 26 nt, Human
aagugcugggauuacaggcgugagcc

SEQ ID NO: 618342 - RNA, 18 nt, Human
accacgcccggcuaauuu

SEQ ID NO: 618343 - RNA, 23 nt, Human
accacgcccggcuaauuuuugua

SEQ ID NO: 618344 - RNA, 18 nt, Human
accuugggggcgaugggg

SEQ ID NO: 618345 - RNA, 24 nt, Human
acucuaucgcccaggcuggauugc

SEQ ID NO: 618346 - RNA, 24 nt, Human
acugcaaucucugccuccagguuc

SEQ ID NO: 618347 - RNA, 19 nt, Human
agagacgccucagaaccac

SEQ ID NO: 618348 - RNA, 24 nt, Human
agcgauuuuccugccucagccucu

SEQ ID NO: 618349 - RNA, 23 nt, Human
aggcgugagccaccgugccuggc

SEQ ID NO: 618350 - RNA, 24 nt, Human
aggugaucugccuuccuuggccuc

SEQ ID NO: 618351 - RNA, 18 nt, Human
aguagcugggaauacggg

SEQ ID NO: 618352 - RNA, 19 nt, Human
aguagcugggauuacaggc

SEQ ID NO: 618353 - RNA, 21 nt, Human
aguagcugggauuacaggcgu

SEQ ID NO: 618354 - RNA, 24 nt, Human
agugcaaugcaaugaucucggcuc

SEQ ID NO: 618355 - RNA, 18 nt, Human
agugcugggauuacaggc

SEQ ID NO: 618356 - RNA, 18 nt, Human
agugcugggauuacaggc

SEQ ID NO: 618357 - RNA, 20 nt, Human
augggguuucgccauguugg

SEQ ID NO: 618358 - RNA, 23 nt, Human
augggguuucgccauguuggcca

SEQ ID NO: 618359 - RNA, 25 nt, Human
augggguuucgccauguuggccaag

SEQ ID NO: 618360 - RNA, 25 nt, Human
auugcaguggccacgaucucagcuc

SEQ ID NO: 618361 - RNA, 24 nt, Human
auuuuuguauuuuuaguagagaca

SEQ ID NO: 618362 - RNA, 19 nt, Human
auuuuuuuuuuggcggggg

SEQ ID NO: 618363 - RNA, 24 nt, Human
caaagugcugggauuacaggcgug

SEQ ID NO: 618364 - RNA, 23 nt, Human
caaccuccgccucccagacucaa

SEQ ID NO: 618365 - RNA, 22 nt, Human
caagcgauuuuccugccucagc

SEQ ID NO: 618366 - RNA, 23 nt, Human
cacacccagcuaauuuuugcauu

SEQ ID NO: 618367 - RNA, 19 nt, Human
caccugggucccaggccca

SEQ ID NO: 618368 - RNA, 18 nt, Human
cacucuaucgcccaggcu

SEQ ID NO: 618369 - RNA, 21 nt, Human
cacucuuccccgugcaccgcg

SEQ ID NO: 618370 - RNA, 21 nt, Human
cacugcaaccuccgccuccca

SEQ ID NO: 618371 - RNA, 18 nt, Human
cacugcaaucucugccuc

SEQ ID NO: 618372 - RNA, 23 nt, Human
cacugcaaucucugccuccaggu

SEQ ID NO: 618373 - RNA, 19 nt, Human
caguggccacgaucucagc

SEQ ID NO: 618374 - RNA, 20 nt, Human
caucaugagugugugccagg

SEQ ID NO: 618375 - RNA, 24 nt, Human
caugaccucaagugaucuaccuuc

SEQ ID NO: 618376 - RNA, 24 nt, Human
cauguuggucaggcuggucuugaa

SEQ ID NO: 618377 - RNA, 22 nt, Human
ccaaaaccacguccgccgccca

SEQ ID NO: 618378 - RNA, 22 nt, Human
ccaaagugcugggauuacaggc

SEQ ID NO: 618379 - RNA, 22 nt, Human
ccaaagugcugggauuacaggc

SEQ ID NO: 618380 - RNA, 24 nt, Human
ccaaagugcugggauuacaggcgu

SEQ ID NO: 618381 - RNA, 22 nt, Human
ccacguccgccgcccacucuuc

SEQ ID NO: 618382 - RNA, 22 nt, Human
ccagguucaagcgauuuuccug

SEQ ID NO: 618383 - RNA, 24 nt, Human
ccauguuggccaaggcuggucucg

SEQ ID NO: 618384 - RNA, 19 nt, Human
ccauguuggucaggcuggu

SEQ ID NO: 618385 - RNA, 21 nt, Human
ccccccaccacacccagcuaa

SEQ ID NO: 618386 - RNA, 19 nt, Human
ccccggcgcucuccugccc

SEQ ID NO: 618387 - RNA, 21 nt, Human
cccggcgcucuccugcccucc

SEQ ID NO: 618388 - RNA, 24 nt, Human
cccggcgcucuccugcccucccug

SEQ ID NO: 618389 - RNA, 21 nt, Human
cccucuguugcucaagcugga

SEQ ID NO: 618390 - RNA, 22 nt, Human
cccugggaguggggacccacac

SEQ ID NO: 618391 - RNA, 23 nt, Human
ccgaaagugcugggauuacaggc

SEQ ID NO: 618392 - RNA, 20 nt, Human
ccgccgcccacucuuccccg

SEQ ID NO: 618393 - RNA, 24 nt, Human
ccgccucccagacucaagcgauuc

SEQ ID NO: 618394 - RNA, 22 nt, Human
ccgcgcccagccgcuucugauc

SEQ ID NO: 618395 - RNA, 20 nt, Human
ccuaauucucugaggacaag

SEQ ID NO: 618396 - RNA, 22 nt, Human
ccuccagguucaagcgauuuuc

SEQ ID NO: 618397 - RNA, 23 nt, Human
ccuccagguucaagcgauuuucc

SEQ ID NO: 618398 - RNA, 23 nt, Human
ccugaguagcugggauuacaggc

SEQ ID NO: 618399 - RNA, 24 nt, Human
ccugaguagcugggauuacaggcg

SEQ ID NO: 618400 - RNA, 21 nt, Human
ccugggucccaggcccaaaac

SEQ ID NO: 618401 - RNA, 23 nt, Human
cgaaagugcugggauuacaggcc

SEQ ID NO: 618402 - RNA, 23 nt, Human
cgccauguuggccaaggcugguc

SEQ ID NO: 618403 - RNA, 25 nt, Human
cgccauguuggccaaggcuggucuc

SEQ ID NO: 618404 - RNA, 20 nt, Human
cucacucuaucgcccaggcc

SEQ ID NO: 618405 - RNA, 24 nt, Human
cucacugcaaccuccgccucccag

SEQ ID NO: 618406 - RNA, 24 nt, Human
cucacugcaaucucugccuccagg

SEQ ID NO: 618407 - RNA, 24 nt, Human
cuccagguucaagcgauuuuccug

SEQ ID NO: 618408 - RNA, 21 nt, Human
cucggccuccgaaagugcugg

SEQ ID NO: 618409 - RNA, 21 nt, Human
cucuccugcccucccugggag

SEQ ID NO: 618410 - RNA, 24 nt, Human
cugagccuccugaguagcugggau

SEQ ID NO: 618411 - RNA, 22 nt, Human
cugaguagcugggauuacaggc

SEQ ID NO: 618412 - RNA, 24 nt, Human
cugaguagcugggauuacaggcgu

SEQ ID NO: 618413 - RNA, 23 nt, Human
cugcaaccuccgccucccagacu

SEQ ID NO: 618414 - RNA, 23 nt, Human
cugcaaucucugccuccagguuc

SEQ ID NO: 618415 - RNA, 22 nt, Human
cugccucagccucugaguagcu

SEQ ID NO: 618416 - RNA, 24 nt, Human
cuggagugcaaugcaaugaucucg

SEQ ID NO: 618417 - RNA, 20 nt, Human
cuggccucaggugaucugcc

SEQ ID NO: 618418 - RNA, 18 nt, Human
gaaagugcugggauuaca

SEQ ID NO: 618419 - RNA, 19 nt, Human
gaacaaguuaccuaauucu

SEQ ID NO: 618420 - RNA, 18 nt, Human
gaccucaagugaucuacc

SEQ ID NO: 618421 - RNA, 20 nt, Human
gaguagcugggauuacaggc

SEQ ID NO: 618422 - RNA, 24 nt, Human
gaguagcugggauuacaggcgugc

SEQ ID NO: 618423 - RNA, 21 nt, Human
gaucuaccuuccucggccucc

SEQ ID NO: 618424 - RNA, 18 nt, Human
gauuacaggcccgagcca

SEQ ID NO: 618425 - RNA, 18 nt, Human
gauuacaggcgugagcca

SEQ ID NO: 618426 - RNA, 21 nt, Human
gauuacaggcgugagccaccg

SEQ ID NO: 618427 - RNA, 24 nt, Human
gauuacaggcgugagccaccgugc

SEQ ID NO: 618428 - RNA, 19 nt, Human
gauuacaggcgugcgcuac

SEQ ID NO: 618429 - RNA, 21 nt, Human
gauucucgugccugagccucc

SEQ ID NO: 618430 - RNA, 23 nt, Human
gauucugcucacacucuggugcc

SEQ ID NO: 618431 - RNA, 22 nt, Human
gcaaccuccgccucccagacuc

SEQ ID NO: 618432 - RNA, 24 nt, Human
gccauguuggucaggcuggucuug

SEQ ID NO: 618433 - RNA, 22 nt, Human
gcccggcuaauuuuuguauuuu

SEQ ID NO: 618434 - RNA, 22 nt, Human
ggagaaugggagagacaguuau

SEQ ID NO: 618435 - RNA, 20 nt, Human
ggaggaauaagugacaucau

SEQ ID NO: 618436 - RNA, 24 nt, Human
ggccacgaucucagcucacugcaa

SEQ ID NO: 618437 - RNA, 24 nt, Human
ggccauguuggucaggcuggucuu

SEQ ID NO: 618438 - RNA, 24 nt, Human
ggccucaggugaucugccuuccuu

SEQ ID NO: 618439 - RNA, 18 nt, Human
ggcuggauugcaguggcc

SEQ ID NO: 618440 - RNA, 21 nt, Human
ggggcgauggggacugggagc

SEQ ID NO: 618441 - RNA, 22 nt, Human
gggguuucgccauguuggccaa

SEQ ID NO: 618442 - RNA, 24 nt, Human
ggugaucugccuuccuuggccucc

SEQ ID NO: 618443 - RNA, 18 nt, Human
ggugccagcgugggggag

SEQ ID NO: 618444 - RNA, 18 nt, Human
guagcugggauuacaggc

SEQ ID NO: 618445 - RNA, 22 nt, Human
gugccugagccuccugaguagc

SEQ ID NO: 618446 - RNA, 22 nt, Human
guuauaucuguugcuucugacc

SEQ ID NO: 618447 - RNA, 21 nt, Human
uaagccgauucugcucacacu

SEQ ID NO: 618448 - RNA, 24 nt, Human
uaauuuuugcauuuuuaguagcga

SEQ ID NO: 618449 - RNA, 24 nt, Human
uaauuuuuguauuuuuaguagaga

SEQ ID NO: 618450 - RNA, 24 nt, Human
uacaggcccgagccaccgcgccca

SEQ ID NO: 618451 - RNA, 22 nt, Human
uacaggcgugagccaccgugcc

SEQ ID NO: 618452 - RNA, 23 nt, Human
uacaggcgugagccaccgugccu

SEQ ID NO: 618453 - RNA, 24 nt, Human
uacgggugccccccaccacaccca

SEQ ID NO: 618454 - RNA, 22 nt, Human
uagcgaugggguuucgccaugu

SEQ ID NO: 618455 - RNA, 24 nt, Human
uaguagcgaugggguuucgccaug

SEQ ID NO: 618456 - RNA, 24 nt, Human
uagucucacucuaucgcccaggcu

SEQ ID NO: 618457 - RNA, 18 nt, Human
ucacugcaaccuccgccu

SEQ ID NO: 618458 - RNA, 19 nt, Human
ucacugcaaccuccgccuc

SEQ ID NO: 618459 - RNA, 23 nt, Human
ucacugcaaccuccgccucccag

SEQ ID NO: 618460 - RNA, 27 nt, Human
ucacugcaaccuccgccucccagacuc

SEQ ID NO: 618461 - RNA, 19 nt, Human
ucacugcaaucucugccuc

SEQ ID NO: 618462 - RNA, 23 nt, Human
ucacugcaaucucugccuccagg

SEQ ID NO: 618463 - RNA, 27 nt, Human
ucagcucacugcaaccuccgccuccca

SEQ ID NO: 618464 - RNA, 24 nt, Human
ucccaaagugcugggauuacaggc

SEQ ID NO: 618465 - RNA, 21 nt, Human
ucccagacucaagcgauucuc

SEQ ID NO: 618466 - RNA, 24 nt, Human
uccccgugcaccgcgaguggaggc

SEQ ID NO: 618467 - RNA, 20 nt, Human
ucccucuguugcucaagcug

SEQ ID NO: 618468 - RNA, 24 nt, Human
uccgaaagugcugggauuacaggc

SEQ ID NO: 618469 - RNA, 24 nt, Human
uccugaguagcugggauuacaggc

SEQ ID NO: 618470 - RNA, 18 nt, Human
uccugcccucccugggag

SEQ ID NO: 618471 - RNA, 23 nt, Human
ucgccauguuggccaaggcuggu

SEQ ID NO: 618472 - RNA, 25 nt, Human
ucgccauguuggccaaggcuggucu

SEQ ID NO: 618473 - RNA, 24 nt, Human
ucgcccaggcuggauugcaguggc

SEQ ID NO: 618474 - RNA, 19 nt, Human
ucuaccuuccucggccucc

SEQ ID NO: 618475 - RNA, 22 nt, Human
ucucacucuaucgcccaggcug

SEQ ID NO: 618476 - RNA, 23 nt, Human
ucucacucuaucgcccaggcugg

SEQ ID NO: 618477 - RNA, 24 nt, Human
ucucacucuaucgcccaggcugga

SEQ ID NO: 618478 - RNA, 26 nt, Human
ucucacucuaucgcccaggcuggauu

SEQ ID NO: 618479 - RNA, 27 nt, Human
ucucacucuaucgcccaggcuggauug

SEQ ID NO: 618480 - RNA, 20 nt, Human
ucucgaacuucuggccucag

SEQ ID NO: 618481 - RNA, 18 nt, Human
ucucgugccugagccucc

SEQ ID NO: 618482 - RNA, 23 nt, Human
ucugaguagcugggaauacgggu

SEQ ID NO: 618483 - RNA, 24 nt, Human
ucugaguagcugggaauacgggug

SEQ ID NO: 618484 - RNA, 23 nt, Human
ucugccuuccuuggccucccaaa

SEQ ID NO: 618485 - RNA, 24 nt, Human
ucuguugcucaagcuggagugcaa

SEQ ID NO: 618486 - RNA, 21 nt, Human
ugacaucaugagugugugcca

SEQ ID NO: 618487 - RNA, 19 nt, Human
ugaccucaagugaucuacc

SEQ ID NO: 618488 - RNA, 21 nt, Human
ugaccucaagugaucuaccuu

SEQ ID NO: 618489 - RNA, 20 nt, Human
ugagaaggggggaaagagua

SEQ ID NO: 618490 - RNA, 21 nt, Human
ugcaguagugagaagggggga

SEQ ID NO: 618491 - RNA, 20 nt, Human
ugccucagccucugaguagc

SEQ ID NO: 618492 - RNA, 23 nt, Human
ugccucagccucugaguagcugg

SEQ ID NO: 618493 - RNA, 22 nt, Human
ugccuccagguucaagcgauuu

SEQ ID NO: 618494 - RNA, 21 nt, Human
ugccugagccuccugaguagc

SEQ ID NO: 618495 - RNA, 22 nt, Human
ugccugagccuccugaguagcu

SEQ ID NO: 618496 - RNA, 24 nt, Human
ugccugagccuccugaguagcugg

SEQ ID NO: 618497 - RNA, 24 nt, Human
ugcugggauuacaggcgugagcca

SEQ ID NO: 618498 - RNA, 21 nt, Human
uggagugcaaugcaaugaucc

SEQ ID NO: 618499 - RNA, 24 nt, Human
uggagugcaaugcaaugaucucgg

SEQ ID NO: 618500 - RNA, 25 nt, Human
uggccaaggcuggucucgaacuucu

SEQ ID NO: 618501 - RNA, 19 nt, Human
uggccucaggugaucugcc

SEQ ID NO: 618502 - RNA, 20 nt, Human
uggccucaggugaucugccu

SEQ ID NO: 618503 - RNA, 21 nt, Human
ugggagagacaguuaucuauu

SEQ ID NO: 618504 - RNA, 18 nt, Human
ugggaggaauaagugaca

SEQ ID NO: 618505 - RNA, 21 nt, Human
ugggauuacaggcccgagcca

SEQ ID NO: 618506 - RNA, 22 nt, Human
ugggauuacaggcccgagccac

SEQ ID NO: 618507 - RNA, 23 nt, Human
ugggauuacaggcccgagccacc

SEQ ID NO: 618508 - RNA, 24 nt, Human
ugggauuacaggcccgagccaccg

SEQ ID NO: 618509 - RNA, 18 nt, Human
ugggauuacaggcgugag

SEQ ID NO: 618510 - RNA, 21 nt, Human
ugggauuacaggcgugagcca

SEQ ID NO: 618511 - RNA, 22 nt, Human
ugggauuacaggcgugagccac

SEQ ID NO: 618512 - RNA, 23 nt, Human
ugggauuacaggcgugagccacc

SEQ ID NO: 618513 - RNA, 23 nt, Human
ugggauuacaggcgugagccacc

SEQ ID NO: 618514 - RNA, 24 nt, Human
ugggauuacaggcgugagccaccg

SEQ ID NO: 618515 - RNA, 18 nt, Human
ugggauuacaggcgugcg

SEQ ID NO: 618516 - RNA, 19 nt, Human
ugggauuacaggcgugcgc

SEQ ID NO: 618517 - RNA, 22 nt, Human
ugggauuacaggcgugcgcuac

SEQ ID NO: 618518 - RNA, 24 nt, Human
ugggauuacaggcgugcgcuacca

SEQ ID NO: 618519 - RNA, 24 nt, Human
ugggcagcgaugcccgcccugggc

SEQ ID NO: 618520 - RNA, 24 nt, Human
ugggguuucgccauguuggccaag

SEQ ID NO: 618521 - RNA, 25 nt, Human
ugggguuucgccauguuggccaagg

SEQ ID NO: 618522 - RNA, 24 nt, Human
uggucaggcuggucuugaacucau

SEQ ID NO: 618523 - RNA, 24 nt, Human
ugucccgauucuuucgaccuuggg

SEQ ID NO: 618524 - RNA, 18 nt, Human
uguccgccauauggcugu

SEQ ID NO: 618525 - RNA, 18 nt, Human
uuaguagcgaugggguuu

SEQ ID NO: 618526 - RNA, 24 nt, Human
uuaguagcgaugggguuucgccau

SEQ ID NO: 618527 - RNA, 19 nt, Human
uuauaucuguugcuucuga

SEQ ID NO: 618528 - RNA, 21 nt, Human
uucaagcgauuuuccugccuc

SEQ ID NO: 618529 - RNA, 23 nt, Human
uucaagcgauuuuccugccucag

SEQ ID NO: 618530 - RNA, 24 nt, Human
uucaagcgauuuuccugccucagc

SEQ ID NO: 618531 - RNA, 21 nt, Human
uuccuuggccucccaaagugc

SEQ ID NO: 618532 - RNA, 23 nt, Human
uuccuuggccucccaaagugcug

SEQ ID NO: 618533 - RNA, 19 nt, Human
uucugccuuuccacuugcu

SEQ ID NO: 618534 - RNA, 22 nt, Human
uuucgccauguuggccaaggcu

SEQ ID NO: 618535 - RNA, 20 nt, Human
uuugcauuuuuaguagcgau

SEQ ID NO: 618536 - RNA, 23 nt, Human
uuuuuaguagcgaugggguuucg

SEQ ID NO: 618537 - RNA, 24 nt, Human
uuuuuaguagcgaugggguuucgc

SEQ ID NO: 618538 - RNA, 20 nt, Human
uuuuuguauuuuuaguagag

SEQ ID NO: 618539 - RNA, 27 nt, Human
uuuuuuuuuuuuugagacguagucuca

SEQ ID NO: 618540 - RNA, 18 nt, Human
uuuuuuuuuuuuuuuuug

SEQ ID NO: 618541 - RNA, 21 nt, Human
aacaaacacacauuucaagga

SEQ ID NO: 618542 - RNA, 22 nt, Human
aagagccagaagccgccuugcc

SEQ ID NO: 618543 - RNA, 21 nt, Human
aagcacacaggaacccacaac

SEQ ID NO: 618544 - RNA, 22 nt, Human
aagugucugaguuaacgaaugg

SEQ ID NO: 618545 - RNA, 22 nt, Human
aaugaaaauacauccaucuaaa

SEQ ID NO: 618546 - RNA, 23 nt, Human
aaugcaaauaguaaaauuacaaa

SEQ ID NO: 618547 - RNA, 23 nt, Human
acaggaacccacaacugagccug

SEQ ID NO: 618548 - RNA, 19 nt, Human
aggaaaagauggaaggagg

SEQ ID NO: 618549 - RNA, 18 nt, Human
aggaacccacaacugagc

SEQ ID NO: 618550 - RNA, 19 nt, Human
agugaagggggagauggaa

SEQ ID NO: 618551 - RNA, 22 nt, Human
aucuuucuugauggccagacug

SEQ ID NO: 618552 - RNA, 21 nt, Human
augcaaauaguaaaauuacaa

SEQ ID NO: 618553 - RNA, 20 nt, Human
cacuuaguagccuccccauc

SEQ ID NO: 618554 - RNA, 19 nt, Human
caggaacccacaacugagc

SEQ ID NO: 618555 - RNA, 22 nt, Human
ccacaccuuuccuguuccaauc

SEQ ID NO: 618556 - RNA, 19 nt, Human
ccagaucaguccagccugu

SEQ ID NO: 618557 - RNA, 23 nt, Human
ccaucagcucagcuuugugacga

SEQ ID NO: 618558 - RNA, 18 nt, Human
ccaucuagaauauacucc

SEQ ID NO: 618559 - RNA, 22 nt, Human
cccacaacugagccugcggaag

SEQ ID NO: 618560 - RNA, 18 nt, Human
cccuuccacaccuuuccu

SEQ ID NO: 618561 - RNA, 19 nt, Human
cccuuugugaaggcaggcc

SEQ ID NO: 618562 - RNA, 18 nt, Human
cuccagaucaguccagcc

SEQ ID NO: 618563 - RNA, 21 nt, Human
cuguucacaagcuaagugagg

SEQ ID NO: 618564 - RNA, 21 nt, Human
cuuccacaccuuuccuguucc

SEQ ID NO: 618565 - RNA, 21 nt, Human
gaacaaacacacauuucaagg

SEQ ID NO: 618566 - RNA, 22 nt, Human
gaacccacaacugagccugcgg

SEQ ID NO: 618567 - RNA, 26 nt, Human
gaaccuuugccaaagaaaggaauaau

SEQ ID NO: 618568 - RNA, 22 nt, Human
gaauauacuccgugaucuuucu

SEQ ID NO: 618569 - RNA, 24 nt, Human
gagggugcucccaucagcucagcu

SEQ ID NO: 618570 - RNA, 20 nt, Human
guaaaauuacaaauauaaag

SEQ ID NO: 618571 - RNA, 23 nt, Human
gugaagggggagauggaagaugg

SEQ ID NO: 618572 - RNA, 24 nt, Human
uaaaacaacacgauugcugcuaca

SEQ ID NO: 618573 - RNA, 18 nt, Human
uaaaauuacaaauauaaa

SEQ ID NO: 618574 - RNA, 24 nt, Human
uaguaaaauuacaaauauaaagua

SEQ ID NO: 618575 - RNA, 18 nt, Human
uaucugaaaaaagugaag

SEQ ID NO: 618576 - RNA, 25 nt, Human
ucaguccagccugugucggacccga

SEQ ID NO: 618577 - RNA, 20 nt, Human
ucuccagaucaguccagccu

SEQ ID NO: 618578 - RNA, 26 nt, Human
ucuuuuucgccaacagaaguaaaggu

SEQ ID NO: 618579 - RNA, 18 nt, Human
ugaaagaacuguaagguu

SEQ ID NO: 618580 - RNA, 26 nt, Human
ugaaggcaggcccuucgcggcucucc

SEQ ID NO: 618581 - RNA, 23 nt, Human
ugaagggggagauggaagauggu

SEQ ID NO: 618582 - RNA, 23 nt, Human
ugaccucuggggagggugcuccc

SEQ ID NO: 618583 - RNA, 18 nt, Human
ugagccugcggaagagcc

SEQ ID NO: 618584 - RNA, 19 nt, Human
ugccaaagaaaggaauaau

SEQ ID NO: 618585 - RNA, 24 nt, Human
uggccagacuguguaaaauucaua

SEQ ID NO: 618586 - RNA, 19 nt, Human
ugguaaaugccaaggaaaa

SEQ ID NO: 618587 - RNA, 18 nt, Human
uuaguagccuccccaucu

SEQ ID NO: 618588 - RNA, 19 nt, Human
uucaaggagggcacuacag

SEQ ID NO: 618589 - RNA, 24 nt, Human
uucgccaacagaaguaaagguaaa

SEQ ID NO: 618590 - RNA, 20 nt, Human
uuuuuuuuuuuuuuuuucac

SEQ ID NO: 618591 - RNA, 18 nt, Human
aaagccauccucccgccu

SEQ ID NO: 618592 - RNA, 24 nt, Human
aaaguacucggauuacagguguga

SEQ ID NO: 618593 - RNA, 24 nt, Human
aaaguguuaggauuacagguguga

SEQ ID NO: 618594 - RNA, 19 nt, Human
aaaugaucccaugucccca

SEQ ID NO: 618595 - RNA, 25 nt, Human
aacacauuccccaaaugaagggacu

SEQ ID NO: 618596 - RNA, 25 nt, Human
aaccaaaaaaguguggccacggucc

SEQ ID NO: 618597 - RNA, 25 nt, Human
aagcaauucucccaccuuagccucc

SEQ ID NO: 618598 - RNA, 23 nt, Human
aagcaugagucaggcugagccug

SEQ ID NO: 618599 - RNA, 26 nt, Human
aaguguuaggauuacaggugugagcc

SEQ ID NO: 618600 - RNA, 23 nt, Human
acccuguucccuaauccaacaca

SEQ ID NO: 618601 - RNA, 24 nt, Human
accgaggcuggagugcaguggcgu

SEQ ID NO: 618602 - RNA, 24 nt, Human
accguguuggccaggcuggucucg

SEQ ID NO: 618603 - RNA, 20 nt, Human
accuuagccucccgaguagc

SEQ ID NO: 618604 - RNA, 20 nt, Human
acggguuuucaccguguugg

SEQ ID NO: 618605 - RNA, 24 nt, Human
acggguuuucaccguguuggccag

SEQ ID NO: 618606 - RNA, 21 nt, Human
acuacaggugugugccaccau

SEQ ID NO: 618607 - RNA, 25 nt, Human
acuauguugcccaggcuggccucaa

SEQ ID NO: 618608 - RNA, 18 nt, Human
agccauccucccgccuca

SEQ ID NO: 618609 - RNA, 18 nt, Human
agccucccgaguagcugg

SEQ ID NO: 618610 - RNA, 22 nt, Human
aggaggcccuguucugugcucc

SEQ ID NO: 618611 - RNA, 18 nt, Human
aggaggcucucagauuuc

SEQ ID NO: 618612 - RNA, 25 nt, Human
aggcuggagugcaguggcgugaucu

SEQ ID NO: 618613 - RNA, 22 nt, Human
agggacagggucuugcucuguu

SEQ ID NO: 618614 - RNA, 23 nt, Human
aggugugagccacugugcccggc

SEQ ID NO: 618615 - RNA, 23 nt, Human
aggugugagucaccgcgccuggc

SEQ ID NO: 618616 - RNA, 18 nt, Human
aguagcugggacuacagg

SEQ ID NO: 618617 - RNA, 23 nt, Human
aguagcugggacuacaggugugu

SEQ ID NO: 618618 - RNA, 23 nt, Human
agugcaguggcgugaucuuggcu

SEQ ID NO: 618619 - RNA, 24 nt, Human
agugcaguggcgugaucuuggcuc

SEQ ID NO: 618620 - RNA, 20 nt, Human
agugcagugguaugaucaug

SEQ ID NO: 618621 - RNA, 24 nt, Human
agugcagugguaugaucaugagcu

SEQ ID NO: 618622 - RNA, 25 nt, Human
agugcagugguaugaucaugagcuc

SEQ ID NO: 618623 - RNA, 21 nt, Human
aucagucaagucuggagccaa

SEQ ID NO: 618624 - RNA, 18 nt, Human
auccucccgccucagccu

SEQ ID NO: 618625 - RNA, 18 nt, Human
auggggcuggaaggaggc

SEQ ID NO: 618626 - RNA, 23 nt, Human
caaaguacucggauuacaggugu

SEQ ID NO: 618627 - RNA, 24 nt, Human
caaaguacucggauuacaggugug

SEQ ID NO: 618628 - RNA, 24 nt, Human
caaaguguuaggauuacaggugug

SEQ ID NO: 618629 - RNA, 23 nt, Human
caaaucuucaacccuguucccua

SEQ ID NO: 618630 - RNA, 18 nt, Human
cacagcaucaggggucag

SEQ ID NO: 618631 - RNA, 24 nt, Human
cacagcaucaggggucagccaucu

SEQ ID NO: 618632 - RNA, 19 nt, Human
cacaucccccaacccuccc

SEQ ID NO: 618633 - RNA, 24 nt, Human
caccacacccggcuaauuuuugua

SEQ ID NO: 618634 - RNA, 24 nt, Human
caccgaggcuggagugcaguggcg

SEQ ID NO: 618635 - RNA, 21 nt, Human
caccguguuggccaggcuggu

SEQ ID NO: 618636 - RNA, 24 nt, Human
caccguguuggccaggcuggucuc

SEQ ID NO: 618637 - RNA, 24 nt, Human
caccuuagccucccgaguagcugg

SEQ ID NO: 618638 - RNA, 27 nt, Human
cacgguccagguggaagggggcugccu

SEQ ID NO: 618639 - RNA, 19 nt, Human
cacuauguugcccaggcug

SEQ ID NO: 618640 - RNA, 24 nt, Human
cacuauguugcccaggcuggccuc

SEQ ID NO: 618641 - RNA, 21 nt, Human
cacugcaaccuccgccuccca

SEQ ID NO: 618642 - RNA, 23 nt, Human
cauguccccaagacugugacaaa

SEQ ID NO: 618643 - RNA, 18 nt, Human
cauuccccaaaugaaggg

SEQ ID NO: 618644 - RNA, 22 nt, Human
ccaaaaaaguguggccacgguc

SEQ ID NO: 618645 - RNA, 21 nt, Human
ccaaaguguuaggauuacagg

SEQ ID NO: 618646 - RNA, 24 nt, Human
ccaaaguguuaggauuacaggugu

SEQ ID NO: 618647 - RNA, 23 nt, Human
ccaccuuagccucccgaguagcu

SEQ ID NO: 618648 - RNA, 23 nt, Human
ccccaagacugugacaaacuaaa

SEQ ID NO: 618649 - RNA, 23 nt, Human
cccgaguagcugggauuacggcu

SEQ ID NO: 618650 - RNA, 24 nt, Human
cccuaauccaacacauuccccaaa

SEQ ID NO: 618651 - RNA, 19 nt, Human
ccgcccaccucagccuccc

SEQ ID NO: 618652 - RNA, 23 nt, Human
ccgccucagccuuucgaguagcu

SEQ ID NO: 618653 - RNA, 27 nt, Human
ccgccucccagguucaagcaauucuuu

SEQ ID NO: 618654 - RNA, 27 nt, Human
ccucacaucccccaacccucccugggc

SEQ ID NO: 618655 - RNA, 24 nt, Human
ccucccagguucaagcaauucucc

SEQ ID NO: 618656 - RNA, 24 nt, Human
ccucccgccucagccuuucgagua

SEQ ID NO: 618657 - RNA, 24 nt, Human
ccuggcaucaagugauccgcccac

SEQ ID NO: 618658 - RNA, 22 nt, Human
cgugggggugucaagcaugagu

SEQ ID NO: 618659 - RNA, 19 nt, Human
cuaaacuucaaaucuucaa

SEQ ID NO: 618660 - RNA, 30 nt, Human
cucaagcaauccucccaccugagccccgcc

SEQ ID NO: 618661 - RNA, 24 nt, Human
cucacugcaaccuccgccucccag

SEQ ID NO: 618662 - RNA, 20 nt, Human
cucagauuucccugcccucc

SEQ ID NO: 618663 - RNA, 24 nt, Human
cucagccuuucgaguagcugggac

SEQ ID NO: 618664 - RNA, 21 nt, Human
cuccucauuucaaucccggga

SEQ ID NO: 618665 - RNA, 23 nt, Human
cugacucugaagcuguucccagc

SEQ ID NO: 618666 - RNA, 23 nt, Human
cugcaaccuccgccucccagguu

SEQ ID NO: 618667 - RNA, 24 nt, Human
cugcaaccuccgccucccagguuc

SEQ ID NO: 618668 - RNA, 28 nt, Human
cugcccuccucacaucccccaacccucc

SEQ ID NO: 618669 - RNA, 19 nt, Human
cuggcaucaagugauccgc

SEQ ID NO: 618670 - RNA, 21 nt, Human
cuggccucaagcaauccuccc

SEQ ID NO: 618671 - RNA, 22 nt, Human
cuggccucaagcaauccuccca

SEQ ID NO: 618672 - RNA, 18 nt, Human
cugucaccgaggcuggag

SEQ ID NO: 618673 - RNA, 24 nt, Human
cuuagccucccgaguagcugggau

SEQ ID NO: 618674 - RNA, 21 nt, Human
cuugcucugucaccgaggcug

SEQ ID NO: 618675 - RNA, 23 nt, Human
gaacuccuggcaucaagugaucc

SEQ ID NO: 618676 - RNA, 26 nt, Human
gacauggugguaaagccauccucccg

SEQ ID NO: 618677 - RNA, 22 nt, Human
gacuacaggugugugccaccau

SEQ ID NO: 618678 - RNA, 26 nt, Human
gaguagcugggacuacaggugugugc

SEQ ID NO: 618679 - RNA, 18 nt, Human
gaguugcaggaggcccug

SEQ ID NO: 618680 - RNA, 18 nt, Human
gauuacaggugugagcca

SEQ ID NO: 618681 - RNA, 21 nt, Human
gauuacaggugugagccacug

SEQ ID NO: 618682 - RNA, 24 nt, Human
gauuacaggugugagccacugugc

SEQ ID NO: 618683 - RNA, 18 nt, Human
gauuacaggugugaguca

SEQ ID NO: 618684 - RNA, 22 nt, Human
gauuacaggugugagucaccgc

SEQ ID NO: 618685 - RNA, 22 nt, Human
gauuacaggugugagucaccgc

SEQ ID NO: 618686 - RNA, 18 nt, Human
gauuacggcugugaguca

SEQ ID NO: 618687 - RNA, 19 nt, Human
gauuacggcugugagucac

SEQ ID NO: 618688 - RNA, 24 nt, Human
gcaaaguacucggauuacaggugu

SEQ ID NO: 618689 - RNA, 19 nt, Human
gcuggagugcaguggcgug

SEQ ID NO: 618690 - RNA, 24 nt, Human
ggacuacaggugugugccaccaug

SEQ ID NO: 618691 - RNA, 22 nt, Human
ggauuacaggugugagccacug

SEQ ID NO: 618692 - RNA, 19 nt, Human
ggauuacaggugugaguca

SEQ ID NO: 618693 - RNA, 21 nt, Human
ggauuacaggugugagucacc

SEQ ID NO: 618694 - RNA, 22 nt, Human
ggauuacaggugugagucaccg

SEQ ID NO: 618695 - RNA, 24 nt, Human
ggcaucaagugauccgcccaccuc

SEQ ID NO: 618696 - RNA, 22 nt, Human
ggcuggagugcaguggcgugau

SEQ ID NO: 618697 - RNA, 24 nt, Human
gggggucucacuauguugcccagg

SEQ ID NO: 618698 - RNA, 22 nt, Human
gggucucacuauguugcccagg

SEQ ID NO: 618699 - RNA, 23 nt, Human
ggguuuucaccguguuggccagg

SEQ ID NO: 618700 - RNA, 23 nt, Human
gguaugaucaugagcucacugca

SEQ ID NO: 618701 - RNA, 19 nt, Human
guagagacggguuuucacc

SEQ ID NO: 618702 - RNA, 19 nt, Human
guagagaugggggucucac

SEQ ID NO: 618703 - RNA, 24 nt, Human
guagcugggauuacggcugugagu

SEQ ID NO: 618704 - RNA, 19 nt, Human
guauuuuuuguagagaugg

SEQ ID NO: 618705 - RNA, 23 nt, Human
gugaguugcaggaggcccuguuc

SEQ ID NO: 618706 - RNA, 24 nt, Human
gugauccgcccaccucagccuccc

SEQ ID NO: 618707 - RNA, 18 nt, Human
guggccacgguccaggug

SEQ ID NO: 618708 - RNA, 21 nt, Human
uaauccaacacauuccccaaa

SEQ ID NO: 618709 - RNA, 24 nt, Human
uaauguuuguauuuuuuguagaga

SEQ ID NO: 618710 - RNA, 24 nt, Human
uaauuuuuguaguuuuuguagaga

SEQ ID NO: 618711 - RNA, 23 nt, Human
uacaggugugagccacugugccc

SEQ ID NO: 618712 - RNA, 23 nt, Human
uacaggugugagccacugugccc

SEQ ID NO: 618713 - RNA, 22 nt, Human
uacaggugugagucaccgcgcc

SEQ ID NO: 618714 - RNA, 23 nt, Human
uacaggugugagucaccgcgccu

SEQ ID NO: 618715 - RNA, 24 nt, Human
uacggcugugagucaccacacccg

SEQ ID NO: 618716 - RNA, 21 nt, Human
uaggauuacaggugugagcca

SEQ ID NO: 618717 - RNA, 22 nt, Human
uaggauuacaggugugagccac

SEQ ID NO: 618718 - RNA, 22 nt, Human
uaggauuacaggugugagccac

SEQ ID NO: 618719 - RNA, 22 nt, Human
uaggauuacaggugugagccac

SEQ ID NO: 618720 - RNA, 24 nt, Human
uaggauuacaggugugagccacug

SEQ ID NO: 618721 - RNA, 23 nt, Human
uauguugcccaggcuggccucaa

SEQ ID NO: 618722 - RNA, 23 nt, Human
uauguugcccaggcuggccucaa

SEQ ID NO: 618723 - RNA, 24 nt, Human
uauguugcccaggcuggccucaag

SEQ ID NO: 618724 - RNA, 24 nt, Human
uauguugcccaggcuggccucaag

SEQ ID NO: 618725 - RNA, 22 nt, Human
uauuuuuuguagagaugggggu

SEQ ID NO: 618726 - RNA, 20 nt, Human
ucaagcaauucucccaccuu

SEQ ID NO: 618727 - RNA, 24 nt, Human
ucaccguguuggccaggcuggucu

SEQ ID NO: 618728 - RNA, 19 nt, Human
ucacugcaaccuccgccuc

SEQ ID NO: 618729 - RNA, 24 nt, Human
ucacugcaaccuccgccucccagg

SEQ ID NO: 618730 - RNA, 25 nt, Human
ucacugcaaccuccgccucccaggu

SEQ ID NO: 618731 - RNA, 26 nt, Human
ucacugcaaccuccgccucccagguu

SEQ ID NO: 618732 - RNA, 20 nt, Human
ucacugcagccuugacaugg

SEQ ID NO: 618733 - RNA, 26 nt, Human
ucacugcagccuugacaugggggccu

SEQ ID NO: 618734 - RNA, 21 nt, Human
ucacugcagccuugacauggu

SEQ ID NO: 618735 - RNA, 23 nt, Human
ucagccuuucgaguagcugggac

SEQ ID NO: 618736 - RNA, 18 nt, Human
ucagucaagucuggagcc

SEQ ID NO: 618737 - RNA, 23 nt, Human
ucagucaagucuggagccaagga

SEQ ID NO: 618738 - RNA, 22 nt, Human
uccaacacauuccccaaaugaa

SEQ ID NO: 618739 - RNA, 23 nt, Human
ucccaaaguguuaggauuacagg

SEQ ID NO: 618740 - RNA, 21 nt, Human
ucccagguucaagcaauucuc

SEQ ID NO: 618741 - RNA, 23 nt, Human
ucccagguucaagcaauucuccc

SEQ ID NO: 618742 - RNA, 24 nt, Human
ucccauguccccaagacugugaca

SEQ ID NO: 618743 - RNA, 20 nt, Human
uccccaagacugugacaaac

SEQ ID NO: 618744 - RNA, 23 nt, Human
ucccgaguagcugggauuacggc

SEQ ID NO: 618745 - RNA, 21 nt, Human
ucccugcccuccucacauccc

SEQ ID NO: 618746 - RNA, 18 nt, Human
ucccugggcgugggggug

SEQ ID NO: 618747 - RNA, 21 nt, Human
uccgcccaccucagccuccca

SEQ ID NO: 618748 - RNA, 22 nt, Human
uccugggcagggcucacacugc

SEQ ID NO: 618749 - RNA, 21 nt, Human
ucgaguagcugggacuacagg

SEQ ID NO: 618750 - RNA, 22 nt, Human
ucggauuacaggugugagucac

SEQ ID NO: 618751 - RNA, 24 nt, Human
ucggauuacaggugugagucaccg

SEQ ID NO: 618752 - RNA, 18 nt, Human
ucucacuauguugcccag

SEQ ID NO: 618753 - RNA, 19 nt, Human
ucucacuauguugcccagg

SEQ ID NO: 618754 - RNA, 23 nt, Human
ucucacuauguugcccaggcugg

SEQ ID NO: 618755 - RNA, 26 nt, Human
ucucacuauguugcccaggcuggccu

SEQ ID NO: 618756 - RNA, 27 nt, Human
ucucacuauguugcccaggcuggccuc

SEQ ID NO: 618757 - RNA, 24 nt, Human
ucucccaccuuagccucccgagua

SEQ ID NO: 618758 - RNA, 21 nt, Human
ucucgaacuccuggcaucaag

SEQ ID NO: 618759 - RNA, 24 nt, Human
ucugucaccgaggcuggagugcag

SEQ ID NO: 618760 - RNA, 18 nt, Human
ucuugcucugucaccgaa

SEQ ID NO: 618761 - RNA, 23 nt, Human
ucuugcucugucaccgaggcugg

SEQ ID NO: 618762 - RNA, 24 nt, Human
ucuugcucugucaccgaggcugga

SEQ ID NO: 618763 - RNA, 18 nt, Human
ucuugcucuguugccaag

SEQ ID NO: 618764 - RNA, 18 nt, Human
ugaucccauguccccaag

SEQ ID NO: 618765 - RNA, 24 nt, Human
ugauccgcccaccucagccuccca

SEQ ID NO: 618766 - RNA, 22 nt, Human
ugcaguggcgugaucuuggcuc

SEQ ID NO: 618767 - RNA, 19 nt, Human
ugcccuccucacauccccc

SEQ ID NO: 618768 - RNA, 22 nt, Human
ugcccuccucacaucccccaac

SEQ ID NO: 618769 - RNA, 24 nt, Human
ugcucugucaccgaggcuggagug

SEQ ID NO: 618770 - RNA, 21 nt, Human
uggaaggaggcucucagauuu

SEQ ID NO: 618771 - RNA, 19 nt, Human
uggagugcaguggcgugau

SEQ ID NO: 618772 - RNA, 23 nt, Human
uggagugcaguggcgugaucuug

SEQ ID NO: 618773 - RNA, 24 nt, Human
uggagugcaguggcgugaucuugg

SEQ ID NO: 618774 - RNA, 24 nt, Human
uggccaggcuggucucgaacuccu

SEQ ID NO: 618775 - RNA, 20 nt, Human
uggccucaagcaauccuccc

SEQ ID NO: 618776 - RNA, 21 nt, Human
uggccucaagcaauccuccca

SEQ ID NO: 618777 - RNA, 18 nt, Human
ugggacuacaggugugug

SEQ ID NO: 618778 - RNA, 21 nt, Human
ugggacuacaggugugugcca

SEQ ID NO: 618779 - RNA, 22 nt, Human
ugggacuacaggugugugccac

SEQ ID NO: 618780 - RNA, 24 nt, Human
ugggacuacaggugugugccacca

SEQ ID NO: 618781 - RNA, 25 nt, Human
ugggacuacaggugugugccaccau

SEQ ID NO: 618782 - RNA, 18 nt, Human
ugggauuacggcugugag

SEQ ID NO: 618783 - RNA, 18 nt, Human
ugggauuacggcugugag

SEQ ID NO: 618784 - RNA, 22 nt, Human
ugggauuacggcugugagucac

SEQ ID NO: 618785 - RNA, 24 nt, Human
ugggauuacggcugugagucacca

SEQ ID NO: 618786 - RNA, 24 nt, Human
uguagagacggguuuucaccgugu

SEQ ID NO: 618787 - RNA, 24 nt, Human
uguagagaugggggucucacuaug

SEQ ID NO: 618788 - RNA, 25 nt, Human
uguagagaugggggucucacuaugu

SEQ ID NO: 618789 - RNA, 21 nt, Human
uguucugugcuccucauuuca

SEQ ID NO: 618790 - RNA, 24 nt, Human
uucaagcaauucucccaccuuagc

SEQ ID NO: 618791 - RNA, 24 nt, Human
uucgaguagcugggacuacaggug

SEQ ID NO: 618792 - RNA, 22 nt, Human
uucucuugaaaccccgugaguu

SEQ ID NO: 618793 - RNA, 23 nt, Human
uuguagagacggguuuucaccgu

SEQ ID NO: 618794 - RNA, 24 nt, Human
uuguagagacggguuuucaccgug

SEQ ID NO: 618795 - RNA, 24 nt, Human
uuguagagaugggggucucacuau

SEQ ID NO: 618796 - RNA, 25 nt, Human
uuguagagaugggggucucacuaug

SEQ ID NO: 618797 - RNA, 24 nt, Human
uuucaccguguuggccaggcuggu

SEQ ID NO: 618798 - RNA, 24 nt, Human
uuucgaguagcugggacuacaggu

SEQ ID NO: 618799 - RNA, 24 nt, Human
uuuguagagacggguuuucaccgu

SEQ ID NO: 618800 - RNA, 25 nt, Human
uuuguagagaugggggucucacuau

SEQ ID NO: 618801 - RNA, 25 nt, Human
uuuguaguuuuuguagagacggguu

SEQ ID NO: 618802 - RNA, 19 nt, Human
uuuguauuuuuuguagaga

SEQ ID NO: 618803 - RNA, 23 nt, Human
uuuucaccguguuggccaggcug

SEQ ID NO: 618804 - RNA, 25 nt, Human
uuuucaccguguuggccaggcuggu

SEQ ID NO: 618805 - RNA, 20 nt, Human
uuuuuuguagagaugggggu

SEQ ID NO: 618806 - RNA, 22 nt, Human
uuuuuuuuuuucaaaacagucu

SEQ ID NO: 618807 - RNA, 18 nt, Human
uuuuuuuuuuuuguuuuc

SEQ ID NO: 618808 - RNA, 20 nt, Human
uuuuuuuuuuuuuuuuuugg

SEQ ID NO: 618809 - RNA, 23 nt, Human
uuuuuuuuuuuuuuuuuuguuuu

SEQ ID NO: 618810 - RNA, 19 nt, Human
aaaccccaggcucccccaa

SEQ ID NO: 618811 - RNA, 27 nt, Human
aaauagguuucuuuacgacggaagucu

SEQ ID NO: 618812 - RNA, 18 nt, Human
aagcaaucgacagagucc

SEQ ID NO: 618813 - RNA, 23 nt, Human
aagcaaucgacagaguccacgac

SEQ ID NO: 618814 - RNA, 21 nt, Human
aagcaggcagggagcacaaug

SEQ ID NO: 618815 - RNA, 22 nt, Human
aagcaggcagggagcacaaugu

SEQ ID NO: 618816 - RNA, 19 nt, Human
agaaaaaaaggucuguaaa

SEQ ID NO: 618817 - RNA, 18 nt, Human
agagauuagguauuuuuc

SEQ ID NO: 618818 - RNA, 20 nt, Human
aguuuuuuuuuuuuuuuuuu

SEQ ID NO: 618819 - RNA, 18 nt, Human
auaaagcacucuucaaac

SEQ ID NO: 618820 - RNA, 19 nt, Human
auaaagcacucuucaaaca

SEQ ID NO: 618821 - RNA, 23 nt, Human
auaaagcacucuucaaacaucua

SEQ ID NO: 618822 - RNA, 20 nt, Human
caaaccccaggcucccccaa

SEQ ID NO: 618823 - RNA, 23 nt, Human
caaaccccaggcucccccaaaag

SEQ ID NO: 618824 - RNA, 28 nt, Human
caacaacaguuuuuuuuuuuuuuuuuuu

SEQ ID NO: 618825 - RNA, 21 nt, Human
cacaacccacgcccaagugcu

SEQ ID NO: 618826 - RNA, 22 nt, Human
cacaacccacgcccaagugcuu

SEQ ID NO: 618827 - RNA, 21 nt, Human
caucugcauucugaaaauagg

SEQ ID NO: 618828 - RNA, 23 nt, Human
ccaaaccccaggcucccccaaaa

SEQ ID NO: 618829 - RNA, 21 nt, Human
ccaagugcuuguuucuguucc

SEQ ID NO: 618830 - RNA, 21 nt, Human
cccaaaagcagucacaaccca

SEQ ID NO: 618831 - RNA, 23 nt, Human
cccaaaccccaggcucccccaaa

SEQ ID NO: 618832 - RNA, 24 nt, Human
cccaaaccccaggcucccccaaaa

SEQ ID NO: 618833 - RNA, 24 nt, Human
cccucgggagcccuggcuuuccug

SEQ ID NO: 618834 - RNA, 23 nt, Human
cuuuuuuuuuuuuuaauuccuuu

SEQ ID NO: 618835 - RNA, 18 nt, Human
gccacaacgccugucacc

SEQ ID NO: 618836 - RNA, 18 nt, Human
gccacaguucaacaacag

SEQ ID NO: 618837 - RNA, 19 nt, Human
gcccuggcuuuccugaaag

SEQ ID NO: 618838 - RNA, 20 nt, Human
uaaaaauacaugaaauggug

SEQ ID NO: 618839 - RNA, 22 nt, Human
uaaaacauaaagcaauuuuuaa

SEQ ID NO: 618840 - RNA, 24 nt, Human
uaaaaccauuaaaaagcuaauuaa

SEQ ID NO: 618841 - RNA, 18 nt, Human
uacaaguaucuauggcca

SEQ ID NO: 618842 - RNA, 20 nt, Human
uauaaagcacucuucaaaca

SEQ ID NO: 618843 - RNA, 24 nt, Human
ucaccuugacgaaggggcgaaagc

SEQ ID NO: 618844 - RNA, 22 nt, Human
uccugaucaagcaggcagggag

SEQ ID NO: 618845 - RNA, 27 nt, Human
ucuuuugaguccauuauuugguaaaua

SEQ ID NO: 618846 - RNA, 23 nt, Human
ugauaaaaccauuaaaaagcuaa

SEQ ID NO: 618847 - RNA, 21 nt, Human
ugcacaaguuuccugaucaag

SEQ ID NO: 618848 - RNA, 20 nt, Human
uggccacaguucaacaacag

SEQ ID NO: 618849 - RNA, 25 nt, Human
ugggagcccaaaccccaggcucccc

SEQ ID NO: 618850 - RNA, 18 nt, Human
ugguaaauauguaacugc

SEQ ID NO: 618851 - RNA, 18 nt, Human
ugguguggagcugcccuc

SEQ ID NO: 618852 - RNA, 22 nt, Human
uguaaacaggugggagcccaaa

SEQ ID NO: 618853 - RNA, 28 nt, Human
uguucauauauauauuuuuuaaaacaua

SEQ ID NO: 618854 - RNA, 26 nt, Human
uguuuuguuuuguuuuuuuuuuuuuu

SEQ ID NO: 618855 - RNA, 23 nt, Human
uuccauugucuuucuuccuugca

SEQ ID NO: 618856 - RNA, 22 nt, Human
uuguuuuguuuuguuuuuuuuu

SEQ ID NO: 618857 - RNA, 21 nt, Human
uuuuucuuuuuuuucauuuuu

SEQ ID NO: 618858 - RNA, 20 nt, Human
uuuuuuuuuuuuuuuucucu

SEQ ID NO: 618859 - RNA, 22 nt, Human
uuuuuuuuuuuuuuuuguauuu

SEQ ID NO: 618860 - RNA, 23 nt, Human
uuuuuuuuuuuuuuuuucucuuu

SEQ ID NO: 618861 - RNA, 24 nt, Human
aaagugcuaagauaauaggcguga

SEQ ID NO: 618862 - RNA, 21 nt, Human
acagguacuugccaccaugcc

SEQ ID NO: 618863 - RNA, 20 nt, Human
acuccuggccucaagugauu

SEQ ID NO: 618864 - RNA, 23 nt, Human
agaggcagguuuagcuggggucu

SEQ ID NO: 618865 - RNA, 19 nt, Human
agauaauaggcgugagcca

SEQ ID NO: 618866 - RNA, 18 nt, Human
aggcagguuuagcugggg

SEQ ID NO: 618867 - RNA, 22 nt, Human
aggccugcaggccagagugcug

SEQ ID NO: 618868 - RNA, 20 nt, Human
aggcgugagccaccauaccc

SEQ ID NO: 618869 - RNA, 23 nt, Human
agggucucagcguguugcccagg

SEQ ID NO: 618870 - RNA, 24 nt, Human
agugauuuuccauccucagccucc

SEQ ID NO: 618871 - RNA, 21 nt, Human
agugcagugguacgaucauug

SEQ ID NO: 618872 - RNA, 22 nt, Human
agugcagugguacgaucauugg

SEQ ID NO: 618873 - RNA, 24 nt, Human
caaagugcuaagauaauaggcgug

SEQ ID NO: 618874 - RNA, 22 nt, Human
caagugauuuuccauccucagc

SEQ ID NO: 618875 - RNA, 26 nt, Human
caauagcugagacuacagguacuugc

SEQ ID NO: 618876 - RNA, 22 nt, Human
cacucaguuuucuugccucagc

SEQ ID NO: 618877 - RNA, 20 nt, Human
cagaggcagguuuagcuggg

SEQ ID NO: 618878 - RNA, 25 nt, Human
cagagugaacagcauagucucuucc

SEQ ID NO: 618879 - RNA, 25 nt, Human
cagcauagucucuuccugggggccu

SEQ ID NO: 618880 - RNA, 25 nt, Human
cagccucgaacucccaggcucacuc

SEQ ID NO: 618881 - RNA, 18 nt, Human
caucagagugaacagcau

SEQ ID NO: 618882 - RNA, 18 nt, Human
ccaccauacccgucccca

SEQ ID NO: 618883 - RNA, 27 nt, Human
ccauacccguccccagauccuucuuuu

SEQ ID NO: 618884 - RNA, 23 nt, Human
ccccuguauccccauccaggccu

SEQ ID NO: 618885 - RNA, 22 nt, Human
ccucagccucccaaagugcuaa

SEQ ID NO: 618886 - RNA, 19 nt, Human
ccucgaacucccaggcuca

SEQ ID NO: 618887 - RNA, 22 nt, Human
ccuggccucaagugauuuucca

SEQ ID NO: 618888 - RNA, 22 nt, Human
cguguugcccaggcuagccuua

SEQ ID NO: 618889 - RNA, 24 nt, Human
cguguugcccaggcuagccuuaaa

SEQ ID NO: 618890 - RNA, 23 nt, Human
cucaagugauuuuccauccucag

SEQ ID NO: 618891 - RNA, 21 nt, Human
cucacugcagccucgaacucc

SEQ ID NO: 618892 - RNA, 20 nt, Human
cucccaauagcugagacuac

SEQ ID NO: 618893 - RNA, 22 nt, Human
cucccaauagcugagacuacag

SEQ ID NO: 618894 - RNA, 18 nt, Human
cucccaggcucacucagu

SEQ ID NO: 618895 - RNA, 22 nt, Human
cucccaggcucacucaguuuuc

SEQ ID NO: 618896 - RNA, 19 nt, Human
cugcagccucgaacuccca

SEQ ID NO: 618897 - RNA, 23 nt, Human
cugcagccucgaacucccaggcu

SEQ ID NO: 618898 - RNA, 19 nt, Human
cuguauccccauccaggcc

SEQ ID NO: 618899 - RNA, 21 nt, Human
cuugcccugucaccuaggcug

SEQ ID NO: 618900 - RNA, 24 nt, Human
cuugcccugucaccuaggcuggag

SEQ ID NO: 618901 - RNA, 22 nt, Human
cuugccucagccucccaauagc

SEQ ID NO: 618902 - RNA, 23 nt, Human
cuugccucagccucccaauagcu

SEQ ID NO: 618903 - RNA, 23 nt, Human
gaacucccaggcucacucaguuu

SEQ ID NO: 618904 - RNA, 24 nt, Human
gacuacagguacuugccaccaugc

SEQ ID NO: 618905 - RNA, 22 nt, Human
gagaacacuccuggguccuggg

SEQ ID NO: 618906 - RNA, 21 nt, Human
gagccaccauacccgucccca

SEQ ID NO: 618907 - RNA, 24 nt, Human
gauaauaggcgugagccaccauac

SEQ ID NO: 618908 - RNA, 19 nt, Human
gcuagccuuaaacuccugg

SEQ ID NO: 618909 - RNA, 23 nt, Human
gcuagccuuaaacuccuggccuc

SEQ ID NO: 618910 - RNA, 24 nt, Human
ggcacagaggcagguuuagcuggg

SEQ ID NO: 618911 - RNA, 24 nt, Human
gugauuuuccauccucagccuccc

SEQ ID NO: 618912 - RNA, 22 nt, Human
uaacuuuccccccuguaucccc

SEQ ID NO: 618913 - RNA, 22 nt, Human
uacagguacuugccaccaugcc

SEQ ID NO: 618914 - RNA, 20 nt, Human
uagccuuaaacuccuggccu

SEQ ID NO: 618915 - RNA, 24 nt, Human
uagggucucagcguguugcccagg

SEQ ID NO: 618916 - RNA, 24 nt, Human
ucaccuaggcuggagugcaguggu

SEQ ID NO: 618917 - RNA, 19 nt, Human
ucacugcagccucgaacuc

SEQ ID NO: 618918 - RNA, 24 nt, Human
ucacugcagccucgaacucccagg

SEQ ID NO: 618919 - RNA, 21 nt, Human
ucagcguguugcccaggcuag

SEQ ID NO: 618920 - RNA, 22 nt, Human
ucagugaaggggggugucaggg

SEQ ID NO: 618921 - RNA, 20 nt, Human
ucccaaagugcuaagauaau

SEQ ID NO: 618922 - RNA, 22 nt, Human
ucccaggcucacucaguuuucu

SEQ ID NO: 618923 - RNA, 22 nt, Human
uccucagccucccaaagugcua

SEQ ID NO: 618924 - RNA, 20 nt, Human
uccuggguccuggggucauc

SEQ ID NO: 618925 - RNA, 22 nt, Human
ucuugcccugucaccuaggcug

SEQ ID NO: 618926 - RNA, 23 nt, Human
ucuugcccugucaccuaggcugg

SEQ ID NO: 618927 - RNA, 24 nt, Human
ucuugcccugucaccuaggcugga

SEQ ID NO: 618928 - RNA, 25 nt, Human
ucuugccucagccucccaauagcug

SEQ ID NO: 618929 - RNA, 21 nt, Human
ugagacuacagguacuugcca

SEQ ID NO: 618930 - RNA, 24 nt, Human
ugagacuacagguacuugccacca

SEQ ID NO: 618931 - RNA, 22 nt, Human
ugcaggccagagugcugauacc

SEQ ID NO: 618932 - RNA, 25 nt, Human
ugcaucagugaaggggggugucagg

SEQ ID NO: 618933 - RNA, 24 nt, Human
ugcccugucaccuaggcuggagug

SEQ ID NO: 618934 - RNA, 20 nt, Human
ugccucagccucccaauagc

SEQ ID NO: 618935 - RNA, 25 nt, Human
ugccucagccucccaauagcugaga

SEQ ID NO: 618936 - RNA, 19 nt, Human
uggagugcagugguacgau

SEQ ID NO: 618937 - RNA, 21 nt, Human
uggagugcagugguacgauca

SEQ ID NO: 618938 - RNA, 18 nt, Human
uggcacagaggcagguuu

SEQ ID NO: 618939 - RNA, 21 nt, Human
uggccucaagugauuuuccau

SEQ ID NO: 618940 - RNA, 24 nt, Human
uggccucaagugauuuuccauccu

SEQ ID NO: 618941 - RNA, 20 nt, Human
ugucaccuaggcuggagugc

SEQ ID NO: 618942 - RNA, 21 nt, Human
ugucaccuaggcuggagugca

SEQ ID NO: 618943 - RNA, 22 nt, Human
uguugcccaggcuagccuuaaa

SEQ ID NO: 618944 - RNA, 24 nt, Human
uugcccugucaccuaggcuggagu

SEQ ID NO: 618945 - RNA, 19 nt, Human
uuuuguaacuuuccccccu

SEQ ID NO: 618946 - RNA, 20 nt, Human
aaaaacaaugccuccacucc

SEQ ID NO: 618947 - RNA, 19 nt, Human
aaacaaugccuccacucca

SEQ ID NO: 618948 - RNA, 18 nt, Human
acaugacauguuuuucuu

SEQ ID NO: 618949 - RNA, 20 nt, Human
agauccaaaauaauugccac

SEQ ID NO: 618950 - RNA, 24 nt, Human
caaauaaaucacagucaaaauaaa

SEQ ID NO: 618951 - RNA, 21 nt, Human
caagaugacaucagucccguu

SEQ ID NO: 618952 - RNA, 22 nt, Human
cucaagaugacaucagucccgu

SEQ ID NO: 618953 - RNA, 24 nt, Human
gucccguuugucuuaaguccuggu

SEQ ID NO: 618954 - RNA, 21 nt, Human
uaaaaacaaugccuccacucc

SEQ ID NO: 618955 - RNA, 25 nt, Human
uaaaucacagucaaaauaaaugaag

SEQ ID NO: 618956 - RNA, 24 nt, Human
uaaaugcauuuuauuuuuagacaa

SEQ ID NO: 618957 - RNA, 20 nt, Human
uacaugacauguuuuucuua

SEQ ID NO: 618958 - RNA, 18 nt, Human
ucaaaauaaaugaagagc

SEQ ID NO: 618959 - RNA, 19 nt, Human
uuuagacaaccuacaugac

SEQ ID NO: 618960 - RNA, 18 nt, Human
uuuuuuuuuuuuuuuuug

SEQ ID NO: 618961 - RNA, 24 nt, Human
uuuuuuuuuuuuuuuuuugaguuu

SEQ ID NO: 618962 - RNA, 24 nt, Human
aauucuuuuggaaaaacugcaugu

SEQ ID NO: 618963 - RNA, 20 nt, Human
ugcauguaagugaaguucuc

SEQ ID NO: 618964 - RNA, 23 nt, Human
uggaaaaacugcauguaagugaa

SEQ ID NO: 618965 - RNA, 18 nt, Human
uucacaagacacaagcau

SEQ ID NO: 618966 - RNA, 22 nt, Human
uuggaaaaacugcauguaagug

SEQ ID NO: 618967 - RNA, 19 nt, Human
aaaacaagcaacugcccaa

SEQ ID NO: 618968 - RNA, 21 nt, Human
aaaauauuccauagaaacccu

SEQ ID NO: 618969 - RNA, 19 nt, Human
aaacaagcaacugcccaaa

SEQ ID NO: 618970 - RNA, 23 nt, Human
aaacuuggaaaaauacuaaaagc

SEQ ID NO: 618971 - RNA, 24 nt, Human
aaagccuuuccaauaaggaagcau

SEQ ID NO: 618972 - RNA, 20 nt, Human
aacucuguaaaacuuucaaa

SEQ ID NO: 618973 - RNA, 24 nt, Human
aacugaugcucgcuuuagagcaac

SEQ ID NO: 618974 - RNA, 24 nt, Human
aagaccaccugaagucaacguggc

SEQ ID NO: 618975 - RNA, 18 nt, Human
aagcaaacacccuucacc

SEQ ID NO: 618976 - RNA, 24 nt, Human
aaggaagaggagagaccuuaaaaa

SEQ ID NO: 618977 - RNA, 24 nt, Human
aauccagaaucuauuaagaaaaau

SEQ ID NO: 618978 - RNA, 22 nt, Human
aauuaaauaguuacacugaacu

SEQ ID NO: 618979 - RNA, 21 nt, Human
acaagaaaggaaucccaucuc

SEQ ID NO: 618980 - RNA, 23 nt, Human
accacagcuagcaaaauauucca

SEQ ID NO: 618981 - RNA, 25 nt, Human
aggaaaagaaauuuuaaaugcuggu

SEQ ID NO: 618982 - RNA, 19 nt, Human
aggacaccaacugugaaua

SEQ ID NO: 618983 - RNA, 26 nt, Human
aguaucuauuacuuuaaaaaaauggc

SEQ ID NO: 618984 - RNA, 24 nt, Human
auccagaaucuauuaagaaaaauc

SEQ ID NO: 618985 - RNA, 19 nt, Human
augaguucaagcaaacacc

SEQ ID NO: 618986 - RNA, 23 nt, Human
caaacacccuucaccaucauuuc

SEQ ID NO: 618987 - RNA, 22 nt, Human
caagaaaggaaucccaucuccc

SEQ ID NO: 618988 - RNA, 19 nt, Human
cacaauuaaauaguuacac

SEQ ID NO: 618989 - RNA, 18 nt, Human
cacagcagcauaaaaugg

SEQ ID NO: 618990 - RNA, 21 nt, Human
caccaacugugaauauaaaac

SEQ ID NO: 618991 - RNA, 22 nt, Human
caccagcacaagucugcagaga

SEQ ID NO: 618992 - RNA, 20 nt, Human
caggggcggcaaaauuguuu

SEQ ID NO: 618993 - RNA, 20 nt, Human
caguuuccaggcaggggcgg

SEQ ID NO: 618994 - RNA, 21 nt, Human
ccacacagcagcauaaaaugg

SEQ ID NO: 618995 - RNA, 24 nt, Human
cccacacaauuaaauaguuacaau

SEQ ID NO: 618996 - RNA, 25 nt, Human
cccaucucccugugaguggaaucca

SEQ ID NO: 618997 - RNA, 19 nt, Human
cgaccaaauaagagaacug

SEQ ID NO: 618998 - RNA, 22 nt, Human
cucacuccugauguccuggaua

SEQ ID NO: 618999 - RNA, 21 nt, Human
cugaagaaaaacagugcuuua

SEQ ID NO: 619000 - RNA, 18 nt, Human
cugacugguuucagaaau

SEQ ID NO: 619001 - RNA, 21 nt, Human
cuguuuaugucacacauucac

SEQ ID NO: 619002 - RNA, 24 nt, Human
cuuuagaaaguucaggcugaucag

SEQ ID NO: 619003 - RNA, 26 nt, Human
gaccaccugaagucaacguggcucga

SEQ ID NO: 619004 - RNA, 21 nt, Human
gaguucaagcaaacacccuuc

SEQ ID NO: 619005 - RNA, 20 nt, Human
gauucccaggaaaagaaauu

SEQ ID NO: 619006 - RNA, 21 nt, Human
guagaagaccaccugaaguca

SEQ ID NO: 619007 - RNA, 21 nt, Human
guauuaucuacacuacauaca

SEQ ID NO: 619008 - RNA, 24 nt, Human
gucagaaaucuucauuaaaaaguc

SEQ ID NO: 619009 - RNA, 23 nt, Human
guuacacugaacugaaguagauu

SEQ ID NO: 619010 - RNA, 24 nt, Human
uaaaacuaauaaaacucuguaaaa

SEQ ID NO: 619011 - RNA, 22 nt, Human
uaaauaguuacacugaacugaa

SEQ ID NO: 619012 - RNA, 21 nt, Human
uaacaaaccacacagcagcau

SEQ ID NO: 619013 - RNA, 22 nt, Human
uacaagucaguaaacucugggc

SEQ ID NO: 619014 - RNA, 18 nt, Human
uaccccacucaaugacua

SEQ ID NO: 619015 - RNA, 24 nt, Human
uagaaacccuucuuauaaaguccu

SEQ ID NO: 619016 - RNA, 24 nt, Human
uagagaauuacaagucaguaaacu

SEQ ID NO: 619017 - RNA, 18 nt, Human
uauauaagaaauagcuga

SEQ ID NO: 619018 - RNA, 19 nt, Human
ucaacguggcucgaucuag

SEQ ID NO: 619019 - RNA, 19 nt, Human
ucagaaaagauaaucuauu

SEQ ID NO: 619020 - RNA, 21 nt, Human
ucaucuagaaaacuacauugu

SEQ ID NO: 619021 - RNA, 19 nt, Human
ucauuaaaaagucuaugga

SEQ ID NO: 619022 - RNA, 20 nt, Human
ucccacuuaugcauauaccc

SEQ ID NO: 619023 - RNA, 18 nt, Human
uccccaccagcaguuucc

SEQ ID NO: 619024 - RNA, 18 nt, Human
ugaaaacuuggaaaaaua

SEQ ID NO: 619025 - RNA, 19 nt, Human
ugaacaccacagcuagcaa

SEQ ID NO: 619026 - RNA, 19 nt, Human
ugacaugcauuacaucugu

SEQ ID NO: 619027 - RNA, 21 nt, Human
ugagaaggcuaguuuaugaga

SEQ ID NO: 619028 - RNA, 22 nt, Human
ugaguucaagcaaacacccuuc

SEQ ID NO: 619029 - RNA, 21 nt, Human
ugcaaaacaagcaacugccca

SEQ ID NO: 619030 - RNA, 23 nt, Human
ugcaaaacaagcaacugcccaaa

SEQ ID NO: 619031 - RNA, 22 nt, Human
ugcaacuauuccgagcugcugg

SEQ ID NO: 619032 - RNA, 21 nt, Human
uggacaagaaaggaaucccau

SEQ ID NO: 619033 - RNA, 23 nt, Human
uggcuccaggccuuuuauccccu

SEQ ID NO: 619034 - RNA, 18 nt, Human
uggggaaggaagaggaga

SEQ ID NO: 619035 - RNA, 25 nt, Human
ugugaguuaccuugauucccaggaa

SEQ ID NO: 619036 - RNA, 19 nt, Human
uguuugguuuuucucuccc

SEQ ID NO: 619037 - RNA, 19 nt, Human
uuacacugaacugaaguag

SEQ ID NO: 619038 - RNA, 21 nt, Human
uuagagauuuuacgcagcugg

SEQ ID NO: 619039 - RNA, 24 nt, Human
uuggggaaggaagaggagagaccu

SEQ ID NO: 619040 - RNA, 23 nt, Human
uuuaacaaaccacacagcagcau

SEQ ID NO: 619041 - RNA, 19 nt, Human
uuuccccaccagcaguuuc

SEQ ID NO: 619042 - RNA, 20 nt, Human
uuuuacgcagcuggucagug

SEQ ID NO: 619043 - RNA, 18 nt, Human
uuuuuuuuuuuuuuuuug

SEQ ID NO: 619044 - RNA, 18 nt, Human
aaaacaaacaaacaagcc

SEQ ID NO: 619045 - RNA, 24 nt, Human
aaaacaaacaaacaagccccuccc

SEQ ID NO: 619046 - RNA, 27 nt, Human
aaaaggccagguacaguggugggcacc

SEQ ID NO: 619047 - RNA, 19 nt, Human
aaacaaacaaacaagcccc

SEQ ID NO: 619048 - RNA, 23 nt, Human
aaacaaacaaacaagccccuccc

SEQ ID NO: 619049 - RNA, 22 nt, Human
aaacaaacaagccccuccccgc

SEQ ID NO: 619050 - RNA, 20 nt, Human
aaacaagccccuccccgcag

SEQ ID NO: 619051 - RNA, 23 nt, Human
aaacagcucucacugauaagagc

SEQ ID NO: 619052 - RNA, 24 nt, Human
aaagaguccaauaacaacuucucc

SEQ ID NO: 619053 - RNA, 24 nt, Human
aaagugcugggauuacaggcguga

SEQ ID NO: 619054 - RNA, 19 nt, Human
aacauggagagaccccauc

SEQ ID NO: 619055 - RNA, 20 nt, Human
aacauggagagaccccaucu

SEQ ID NO: 619056 - RNA, 21 nt, Human
aacauggagagaccccaucuc

SEQ ID NO: 619057 - RNA, 23 nt, Human
aacccuccuggagccuccuccau

SEQ ID NO: 619058 - RNA, 21 nt, Human
aaccugccuuucacuguccca

SEQ ID NO: 619059 - RNA, 21 nt, Human
aacuggaaucaagaaagacaa

SEQ ID NO: 619060 - RNA, 24 nt, Human
aagaaagacaaaauucuuacaaaa

SEQ ID NO: 619061 - RNA, 21 nt, Human
aagcacccggggccccagcuc

SEQ ID NO: 619062 - RNA, 21 nt, Human
aagcuccccugcuggcuuccc

SEQ ID NO: 619063 - RNA, 19 nt, Human
aagugcugggauuacaggc

SEQ ID NO: 619064 - RNA, 19 nt, Human
aagugcugggauuacaggc

SEQ ID NO: 619065 - RNA, 24 nt, Human
aaucacuugaacccgggaggcaga

SEQ ID NO: 619066 - RNA, 19 nt, Human
aauccgucaaaacccuccu

SEQ ID NO: 619067 - RNA, 23 nt, Human
acagcccuccugucuaagagcug

SEQ ID NO: 619068 - RNA, 22 nt, Human
accacagaagcacccggggccc

SEQ ID NO: 619069 - RNA, 22 nt, Human
accauggagggagucucccccu

SEQ ID NO: 619070 - RNA, 24 nt, Human
accauguuggcuagguuggucucg

SEQ ID NO: 619071 - RNA, 21 nt, Human
accccaaaccucccccaucac

SEQ ID NO: 619072 - RNA, 25 nt, Human
accccaucucuacuaaaaaauacaa

SEQ ID NO: 619073 - RNA, 20 nt, Human
acccuccuggagccuccucc

SEQ ID NO: 619074 - RNA, 22 nt, Human
accugggugcaggucaggugag

SEQ ID NO: 619075 - RNA, 21 nt, Human
acgggguuucaccauguuggc

SEQ ID NO: 619076 - RNA, 22 nt, Human
acgggguuucaccauguuggcu

SEQ ID NO: 619077 - RNA, 23 nt, Human
acgggguuucaccauguuggcua

SEQ ID NO: 619078 - RNA, 24 nt, Human
acgggguuucaccauguuggcuag

SEQ ID NO: 619079 - RNA, 25 nt, Human
acuccagccugggcaacaagaguga

SEQ ID NO: 619080 - RNA, 22 nt, Human
acuucaugaggggccauggccu

SEQ ID NO: 619081 - RNA, 22 nt, Human
agaaagacaaaauucuuacaaa

SEQ ID NO: 619082 - RNA, 22 nt, Human
agaaaugcacacucauaccuuc

SEQ ID NO: 619083 - RNA, 21 nt, Human
agacaggaaacaccuccaggg

SEQ ID NO: 619084 - RNA, 22 nt, Human
agagaccuuuuaugcaggggag

SEQ ID NO: 619085 - RNA, 21 nt, Human
agagacgggguuucaccaugu

SEQ ID NO: 619086 - RNA, 18 nt, Human
agagguugcagugagcug

SEQ ID NO: 619087 - RNA, 22 nt, Human
agagguugcagugagcugagau

SEQ ID NO: 619088 - RNA, 23 nt, Human
agagguugcagugagcugagauc

SEQ ID NO: 619089 - RNA, 24 nt, Human
agagguugcagugagcugagauca

SEQ ID NO: 619090 - RNA, 20 nt, Human
agagguugcagugagcuggc

SEQ ID NO: 619091 - RNA, 24 nt, Human
agcaagcgaggggacaguccccuu

SEQ ID NO: 619092 - RNA, 20 nt, Human
agcaccucuggcuuuuucuu

SEQ ID NO: 619093 - RNA, 23 nt, Human
agcagcucugauucacggccaag

SEQ ID NO: 619094 - RNA, 20 nt, Human
agccaccccacaaacaacag

SEQ ID NO: 619095 - RNA, 23 nt, Human
agccgggcauggugacacaugcc

SEQ ID NO: 619096 - RNA, 24 nt, Human
aggaaggcacgaggacagaaccau

SEQ ID NO: 619097 - RNA, 21 nt, Human
aggacacugccaggcgggccu

SEQ ID NO: 619098 - RNA, 18 nt, Human
aggaccccauggugcuuc

SEQ ID NO: 619099 - RNA, 21 nt, Human
aggaccucggcaggaggggca

SEQ ID NO: 619100 - RNA, 18 nt, Human
aggaggucaaugccgggg

SEQ ID NO: 619101 - RNA, 27 nt, Human
aggaggucaaugccgggggcugcaucc

SEQ ID NO: 619102 - RNA, 20 nt, Human
aggcagagguugcagugagc

SEQ ID NO: 619103 - RNA, 24 nt, Human
aggcagagguugcagugagcugag

SEQ ID NO: 619104 - RNA, 18 nt, Human
aggcaggagaaucacuug

SEQ ID NO: 619105 - RNA, 24 nt, Human
aggcaggagaaucacuugaacccg

SEQ ID NO: 619106 - RNA, 24 nt, Human
aggccaaggcggaucaccugaggu

SEQ ID NO: 619107 - RNA, 24 nt, Human
aggcugaggcaggagaaucacuug

SEQ ID NO: 619108 - RNA, 18 nt, Human
agggcagaauccagccgu

SEQ ID NO: 619109 - RNA, 18 nt, Human
agggcuggggacacccag

SEQ ID NO: 619110 - RNA, 24 nt, Human
agguacaguggcucacuucuguaa

SEQ ID NO: 619111 - RNA, 24 nt, Human
aggugcagacacuaacgcaggacc

SEQ ID NO: 619112 - RNA, 26 nt, Human
agugcccacccaccuugggaugaggc

SEQ ID NO: 619113 - RNA, 18 nt, Human
agugcugggauuacaggc

SEQ ID NO: 619114 - RNA, 24 nt, Human
aguggcucacuucuguaaucccag

SEQ ID NO: 619115 - RNA, 20 nt, Human
aucaccugaggucgggaguu

SEQ ID NO: 619116 - RNA, 24 nt, Human
aucaugccauuguacuccagccug

SEQ ID NO: 619117 - RNA, 20 nt, Human
auccagcugagauccgugcc

SEQ ID NO: 619118 - RNA, 22 nt, Human
aucccagcacuucgggaggcca

SEQ ID NO: 619119 - RNA, 26 nt, Human
aucuaaaaaauuaguccaaaaggcca

SEQ ID NO: 619120 - RNA, 24 nt, Human
augauccaccugccucagcaucuc

SEQ ID NO: 619121 - RNA, 25 nt, Human
augcacacacacccaugcacauaca

SEQ ID NO: 619122 - RNA, 24 nt, Human
auuguacuccagccugggcaacaa

SEQ ID NO: 619123 - RNA, 21 nt, Human
caaaacccuccuggagccucc

SEQ ID NO: 619124 - RNA, 23 nt, Human
caaaacccuccuggagccuccuc

SEQ ID NO: 619125 - RNA, 21 nt, Human
caaacaugcacacacacccau

SEQ ID NO: 619126 - RNA, 22 nt, Human
caaacaugcacacacacccaug

SEQ ID NO: 619127 - RNA, 22 nt, Human
caaaccucccccaucaccgcua

SEQ ID NO: 619128 - RNA, 21 nt, Human
caaagugcugggauuacaggc

SEQ ID NO: 619129 - RNA, 24 nt, Human
caaagugcugggauuacaggcgug

SEQ ID NO: 619130 - RNA, 22 nt, Human
caacuagagagccagaaaugcc

SEQ ID NO: 619131 - RNA, 21 nt, Human
caaggcggaucaccugagguc

SEQ ID NO: 619132 - RNA, 21 nt, Human
caccauguuggcuagguuggu

SEQ ID NO: 619133 - RNA, 24 nt, Human
caccauguuggcuagguuggucuc

SEQ ID NO: 619134 - RNA, 21 nt, Human
caccccaaaccucccccauca

SEQ ID NO: 619135 - RNA, 22 nt, Human
caccccaaaccucccccaucac

SEQ ID NO: 619136 - RNA, 23 nt, Human
caccgcaccccaaaccuccccca

SEQ ID NO: 619137 - RNA, 23 nt, Human
caccgcugucuccgcacaugaca

SEQ ID NO: 619138 - RNA, 24 nt, Human
cacuucuguaaucccagcacuucg

SEQ ID NO: 619139 - RNA, 18 nt, Human
cagagcagggacugggag

SEQ ID NO: 619140 - RNA, 24 nt, Human
cagcacuucgggaggccaaggcgg

SEQ ID NO: 619141 - RNA, 22 nt, Human
cagcagcucaaaccugccuuuc

SEQ ID NO: 619142 - RNA, 22 nt, Human
cagcaugaagaacccaggagau

SEQ ID NO: 619143 - RNA, 23 nt, Human
cagcaugaagaacccaggagaug

SEQ ID NO: 619144 - RNA, 24 nt, Human
cagcccuccugucuaagagcugac

SEQ ID NO: 619145 - RNA, 24 nt, Human
cagccugaccaacauggagagacc

SEQ ID NO: 619146 - RNA, 21 nt, Human
cagccugaccacagaagcacc

SEQ ID NO: 619147 - RNA, 24 nt, Human
cagcuacucgggaggcugaggcag

SEQ ID NO: 619148 - RNA, 19 nt, Human
caggcgggccuuugccucu

SEQ ID NO: 619149 - RNA, 20 nt, Human
cagggguccgcguggccccu

SEQ ID NO: 619150 - RNA, 20 nt, Human
caguucuccccauggccagc

SEQ ID NO: 619151 - RNA, 20 nt, Human
caucugcggcgggcagagcu

SEQ ID NO: 619152 - RNA, 19 nt, Human
caugacacagccuuccaug

SEQ ID NO: 619153 - RNA, 25 nt, Human
caugcaggguccagccaccccacaa

SEQ ID NO: 619154 - RNA, 20 nt, Human
cauggugcuucugugguucc

SEQ ID NO: 619155 - RNA, 19 nt, Human
cauuguacuccagccuggg

SEQ ID NO: 619156 - RNA, 21 nt, Human
cauuguacuccagccugggca

SEQ ID NO: 619157 - RNA, 22 nt, Human
cauuguacuccagccugggcaa

SEQ ID NO: 619158 - RNA, 24 nt, Human
cauuguacuccagccugggcaaca

SEQ ID NO: 619159 - RNA, 23 nt, Human
ccaacagcugagaaagccaaaac

SEQ ID NO: 619160 - RNA, 21 nt, Human
ccacaaacaacagcgccccau

SEQ ID NO: 619161 - RNA, 18 nt, Human
ccaccccacaaacaacag

SEQ ID NO: 619162 - RNA, 23 nt, Human
ccaccccacaaacaacagcgccc

SEQ ID NO: 619163 - RNA, 18 nt, Human
ccagaaaugccagauaaa

SEQ ID NO: 619164 - RNA, 22 nt, Human
ccagccaccccacaaacaacag

SEQ ID NO: 619165 - RNA, 21 nt, Human
ccagccaucuggcaacuccaa

SEQ ID NO: 619166 - RNA, 19 nt, Human
ccaggaaggcacgaggaca

SEQ ID NO: 619167 - RNA, 27 nt, Human
ccaugcacauacaugcaaaccugcaca

SEQ ID NO: 619168 - RNA, 19 nt, Human
ccauggccagcuucuagag

SEQ ID NO: 619169 - RNA, 20 nt, Human
ccauuguacuccagccuggg

SEQ ID NO: 619170 - RNA, 21 nt, Human
ccauuguacuccagccugggc

SEQ ID NO: 619171 - RNA, 23 nt, Human
ccauuguacuccagccugggcaa

SEQ ID NO: 619172 - RNA, 24 nt, Human
ccauuguacuccagccugggcaac

SEQ ID NO: 619173 - RNA, 19 nt, Human
cccacaaacaacagcgccc

SEQ ID NO: 619174 - RNA, 22 nt, Human
cccacaaacaacagcgccccau

SEQ ID NO: 619175 - RNA, 24 nt, Human
cccaccccgaggccaggccucgac

SEQ ID NO: 619176 - RNA, 18 nt, Human
cccaugcacauacaugca

SEQ ID NO: 619177 - RNA, 22 nt, Human
ccccacaaacaacagcgcccca

SEQ ID NO: 619178 - RNA, 26 nt, Human
ccccaccuaccccucaguucucccca

SEQ ID NO: 619179 - RNA, 20 nt, Human
ccccuccccaccuaccccuc

SEQ ID NO: 619180 - RNA, 20 nt, Human
cccucaccgcaccccaaacc

SEQ ID NO: 619181 - RNA, 20 nt, Human
cccuggaaugaaaaugaggc

SEQ ID NO: 619182 - RNA, 18 nt, Human
cccuggaugcaagggcuc

SEQ ID NO: 619183 - RNA, 26 nt, Human
ccgcaccccaaaccucccccaucacc

SEQ ID NO: 619184 - RNA, 21 nt, Human
ccuaccccucaguucucccca

SEQ ID NO: 619185 - RNA, 22 nt, Human
ccuagagaccaaucccaccccc

SEQ ID NO: 619186 - RNA, 18 nt, Human
ccucaagcuuacaggaag

SEQ ID NO: 619187 - RNA, 21 nt, Human
ccucuggauccacgaaagcuc

SEQ ID NO: 619188 - RNA, 24 nt, Human
ccugaccaacauggagagacccca

SEQ ID NO: 619189 - RNA, 20 nt, Human
ccugaccucaaaugauccac

SEQ ID NO: 619190 - RNA, 21 nt, Human
ccugaccucaaaugauccacc

SEQ ID NO: 619191 - RNA, 23 nt, Human
ccugaccucaaaugauccaccug

SEQ ID NO: 619192 - RNA, 23 nt, Human
ccugaccucaaaugauccaccug

SEQ ID NO: 619193 - RNA, 22 nt, Human
ccugaggucgggaguuugagac

SEQ ID NO: 619194 - RNA, 19 nt, Human
ccugcacacacaccaacaa

SEQ ID NO: 619195 - RNA, 21 nt, Human
ccugucuaagagcugaccggg

SEQ ID NO: 619196 - RNA, 19 nt, Human
cgagcagcucugauucauc

SEQ ID NO: 619197 - RNA, 22 nt, Human
cgcugauggugauagaugcagc

SEQ ID NO: 619198 - RNA, 18 nt, Human
cggaagaacauggcaccc

SEQ ID NO: 619199 - RNA, 24 nt, Human
cggaucaccugaggucgggaguuu

SEQ ID NO: 619200 - RNA, 24 nt, Human
cgggaggcagagguugcagugagc

SEQ ID NO: 619201 - RNA, 21 nt, Human
cgggauuaaaaacaaacaaac

SEQ ID NO: 619202 - RNA, 27 nt, Human
cgggauuaaaaacaaacaaacaagcca

SEQ ID NO: 619203 - RNA, 23 nt, Human
cggggccccagcucauccugaug

SEQ ID NO: 619204 - RNA, 24 nt, Human
cgggguuucaccauguuggcuagg

SEQ ID NO: 619205 - RNA, 22 nt, Human
cuaaccugaaccuagagaccaa

SEQ ID NO: 619206 - RNA, 18 nt, Human
cucaccgcaccccaaacc

SEQ ID NO: 619207 - RNA, 24 nt, Human
cucacuucuguaaucccagcacuu

SEQ ID NO: 619208 - RNA, 20 nt, Human
cuccaguucagggaggaccc

SEQ ID NO: 619209 - RNA, 23 nt, Human
cucccccucaccgcaccccaaac

SEQ ID NO: 619210 - RNA, 23 nt, Human
cucuggauccacgaaagcuccau

SEQ ID NO: 619211 - RNA, 21 nt, Human
cugcacgagcagcucugauuc

SEQ ID NO: 619212 - RNA, 24 nt, Human
cugcaggcugcuggguauguggag

SEQ ID NO: 619213 - RNA, 18 nt, Human
cugcgggcugacaaugug

SEQ ID NO: 619214 - RNA, 21 nt, Human
cugggccccuggccgcgcuga

SEQ ID NO: 619215 - RNA, 19 nt, Human
cuguaaucccagcacuucg

SEQ ID NO: 619216 - RNA, 23 nt, Human
cugucaggaaugucaaaaccuaa

SEQ ID NO: 619217 - RNA, 23 nt, Human
cuucuccaucuacuucauaaaaa

SEQ ID NO: 619218 - RNA, 20 nt, Human
gaaaaaacagcucucacuga

SEQ ID NO: 619219 - RNA, 24 nt, Human
gaccucaaaugauccaccugccuc

SEQ ID NO: 619220 - RNA, 22 nt, Human
gagaaagccaaaacugaauuca

SEQ ID NO: 619221 - RNA, 23 nt, Human
gagaaucacuugaacccgggagg

SEQ ID NO: 619222 - RNA, 24 nt, Human
gagacgggguuucaccauguuggc

SEQ ID NO: 619223 - RNA, 20 nt, Human
gaggaccucggcaggaggag

SEQ ID NO: 619224 - RNA, 24 nt, Human
gaucaccugaggucgggaguuuga

SEQ ID NO: 619225 - RNA, 19 nt, Human
gauggcuccggggcuucgg

SEQ ID NO: 619226 - RNA, 18 nt, Human
gauuacaggcgugagcca

SEQ ID NO: 619227 - RNA, 21 nt, Human
gauuacaggcgugagccacca

SEQ ID NO: 619228 - RNA, 24 nt, Human
gauuacaggcgugagccaccaugc

SEQ ID NO: 619229 - RNA, 19 nt, Human
gcaccccaaaccuccccca

SEQ ID NO: 619230 - RNA, 18 nt, Human
gcaccccagcauccaccc

SEQ ID NO: 619231 - RNA, 23 nt, Human
gcaggagaaucacuugaacccgg

SEQ ID NO: 619232 - RNA, 22 nt, Human
gccauuguacuccagccugggc

SEQ ID NO: 619233 - RNA, 23 nt, Human
gccauuguacuccagccugggca

SEQ ID NO: 619234 - RNA, 24 nt, Human
gccauuguacuccagccugggcaa

SEQ ID NO: 619235 - RNA, 21 nt, Human
gcccuaaggauggcuccgggg

SEQ ID NO: 619236 - RNA, 22 nt, Human
gcuccggggcuucggcaagcuc

SEQ ID NO: 619237 - RNA, 18 nt, Human
gcuuagccuuggcccuag

SEQ ID NO: 619238 - RNA, 22 nt, Human
ggagcagaugaggucagagaca

SEQ ID NO: 619239 - RNA, 21 nt, Human
ggaggcugggaccaccaagga

SEQ ID NO: 619240 - RNA, 19 nt, Human
ggaguuugagaccagccug

SEQ ID NO: 619241 - RNA, 20 nt, Human
ggaucaccugaggucgggaa

SEQ ID NO: 619242 - RNA, 22 nt, Human
ggaucaccugaggucgggaguu

SEQ ID NO: 619243 - RNA, 24 nt, Human
ggauuacaggcgugagccaccaug

SEQ ID NO: 619244 - RNA, 20 nt, Human
ggcacuaaccugaaccuaga

SEQ ID NO: 619245 - RNA, 23 nt, Human
ggcauggugacacaugccuguaa

SEQ ID NO: 619246 - RNA, 18 nt, Human
ggccccuggccgcgcuga

SEQ ID NO: 619247 - RNA, 23 nt, Human
gggaagcagcgggggugaggaug

SEQ ID NO: 619248 - RNA, 18 nt, Human
gggaggccaaggcggauc

SEQ ID NO: 619249 - RNA, 23 nt, Human
gggaggcugaggcaggagaauca

SEQ ID NO: 619250 - RNA, 22 nt, Human
gggagucucccccucaccgcac

SEQ ID NO: 619251 - RNA, 23 nt, Human
gggguuucaccauguuggcuagg

SEQ ID NO: 619252 - RNA, 19 nt, Human
ggucgggaguuugagacca

SEQ ID NO: 619253 - RNA, 19 nt, Human
ggucucgaacuccugaccu

SEQ ID NO: 619254 - RNA, 24 nt, Human
gguuggucucgaacuccugaccuc

SEQ ID NO: 619255 - RNA, 22 nt, Human
guacaaacaugcacacacaccc

SEQ ID NO: 619256 - RNA, 25 nt, Human
guacuccagccugggcaacaagagu

SEQ ID NO: 619257 - RNA, 18 nt, Human
gugccauugcucuccucu

SEQ ID NO: 619258 - RNA, 20 nt, Human
gugcuggcacccggagaagu

SEQ ID NO: 619259 - RNA, 24 nt, Human
guugcagugagcugagaucaugcc

SEQ ID NO: 619260 - RNA, 27 nt, Human
uaaaaaauuaguccaaaaggccaggua

SEQ ID NO: 619261 - RNA, 21 nt, Human
uaacagacagaggcuggaugc

SEQ ID NO: 619262 - RNA, 23 nt, Human
uacaaaacaugggcccugcuuga

SEQ ID NO: 619263 - RNA, 24 nt, Human
uacaggcgugagccaccaugccca

SEQ ID NO: 619264 - RNA, 23 nt, Human
uacuccagccugggcaacaagag

SEQ ID NO: 619265 - RNA, 24 nt, Human
uacuccagccugggcaacaagagu

SEQ ID NO: 619266 - RNA, 25 nt, Human
uacuccagccugggcaacaagagug

SEQ ID NO: 619267 - RNA, 19 nt, Human
uagaaaaaacagcucucac

SEQ ID NO: 619268 - RNA, 24 nt, Human
uagaagagacgggguuucaccaug

SEQ ID NO: 619269 - RNA, 22 nt, Human
uagcagguggucacagaggcuc

SEQ ID NO: 619270 - RNA, 21 nt, Human
uaggggcacuaaccugaaccu

SEQ ID NO: 619271 - RNA, 20 nt, Human
uaucacagagcuuauuuccc

SEQ ID NO: 619272 - RNA, 22 nt, Human
ucaaaagccuauuuuaaaguuc

SEQ ID NO: 619273 - RNA, 22 nt, Human
ucaaagugcugggauuacaggc

SEQ ID NO: 619274 - RNA, 24 nt, Human
ucaaagugcugggauuacaggcgu

SEQ ID NO: 619275 - RNA, 18 nt, Human
ucaaugccgggggcugca

SEQ ID NO: 619276 - RNA, 24 nt, Human
ucacagggcagaauccagccgugc

SEQ ID NO: 619277 - RNA, 24 nt, Human
ucagagcagggacugggaggcugg

SEQ ID NO: 619278 - RNA, 24 nt, Human
ucaggaguaacagacagaggcugg

SEQ ID NO: 619279 - RNA, 23 nt, Human
ucauaccuucugaauacaagauc

SEQ ID NO: 619280 - RNA, 19 nt, Human
ucaucaagcuuucagagca

SEQ ID NO: 619281 - RNA, 23 nt, Human
ucaugccauuguacuccagccug

SEQ ID NO: 619282 - RNA, 18 nt, Human
uccacgaaagcuccaucc

SEQ ID NO: 619283 - RNA, 23 nt, Human
uccauagaaucugguggaugcua

SEQ ID NO: 619284 - RNA, 19 nt, Human
uccaugcaggguccagcca

SEQ ID NO: 619285 - RNA, 19 nt, Human
ucccagccugaccacagaa

SEQ ID NO: 619286 - RNA, 24 nt, Human
uccccaccuaccccucaguucucc

SEQ ID NO: 619287 - RNA, 20 nt, Human
uccccugcuggcuuccccuu

SEQ ID NO: 619288 - RNA, 24 nt, Human
ucccugugagugagaacaaagucc

SEQ ID NO: 619289 - RNA, 19 nt, Human
uccgcguggccccucccca

SEQ ID NO: 619290 - RNA, 23 nt, Human
uccgucaaaacccuccuggagcc

SEQ ID NO: 619291 - RNA, 19 nt, Human
uccguccccaucaacccua

SEQ ID NO: 619292 - RNA, 19 nt, Human
uccgugccaggcauaacag

SEQ ID NO: 619293 - RNA, 18 nt, Human
uccugaccucaaaugauc

SEQ ID NO: 619294 - RNA, 25 nt, Human
ucgggaggcugaggcaggagaauca

SEQ ID NO: 619295 - RNA, 24 nt, Human
ucucaaagugcugggauuacaggc

SEQ ID NO: 619296 - RNA, 20 nt, Human
ucucccccucaccgcacccc

SEQ ID NO: 619297 - RNA, 19 nt, Human
ucucgaacuccugaccuca

SEQ ID NO: 619298 - RNA, 23 nt, Human
ucucuacuaaaaaauacaaaauu

SEQ ID NO: 619299 - RNA, 20 nt, Human
ucugcaggcugcuggguaug

SEQ ID NO: 619300 - RNA, 23 nt, Human
ucugcaggcugcuggguaugugg

SEQ ID NO: 619301 - RNA, 22 nt, Human
ucuggggcuggagggcugggga

SEQ ID NO: 619302 - RNA, 19 nt, Human
ucugguggaugcuauagcu

SEQ ID NO: 619303 - RNA, 24 nt, Human
ugagaccagccugaccaacaugga

SEQ ID NO: 619304 - RNA, 26 nt, Human
ugaggagcuuaggauugagugguugg

SEQ ID NO: 619305 - RNA, 20 nt, Human
ugaggcaggagaaucacuug

SEQ ID NO: 619306 - RNA, 24 nt, Human
ugaggcaggagaaucacuugaacc

SEQ ID NO: 619307 - RNA, 25 nt, Human
ugaggcaggagaaucacuugaaccc

SEQ ID NO: 619308 - RNA, 21 nt, Human
ugaggggccauggccuucagc

SEQ ID NO: 619309 - RNA, 23 nt, Human
ugauggugauagaugcagccggg

SEQ ID NO: 619310 - RNA, 20 nt, Human
ugcacacacaccaacaacuu

SEQ ID NO: 619311 - RNA, 21 nt, Human
ugcacacacaccaacaacuuu

SEQ ID NO: 619312 - RNA, 21 nt, Human
ugccagacagacgcgccuucu

SEQ ID NO: 619313 - RNA, 24 nt, Human
ugccaggcgggccuuugccucuuc

SEQ ID NO: 619314 - RNA, 21 nt, Human
ugccauugcucuccucugggc

SEQ ID NO: 619315 - RNA, 23 nt, Human
ugccccaggacacugccaggcgg

SEQ ID NO: 619316 - RNA, 21 nt, Human
ugccccgcucaggagccucuc

SEQ ID NO: 619317 - RNA, 19 nt, Human
ugcccugaggccacacagc

SEQ ID NO: 619318 - RNA, 23 nt, Human
ugccuguaaugccagcuacucgg

SEQ ID NO: 619319 - RNA, 24 nt, Human
ugccuguaaugccagcuacucggg

SEQ ID NO: 619320 - RNA, 18 nt, Human
ugcuauagcuccucgccc

SEQ ID NO: 619321 - RNA, 19 nt, Human
ugcucacucagcaccccag

SEQ ID NO: 619322 - RNA, 20 nt, Human
ugcucagagaggaccucggc

SEQ ID NO: 619323 - RNA, 21 nt, Human
ugcucagagaggaccucggca

SEQ ID NO: 619324 - RNA, 24 nt, Human
ugcucuccucugggcuuagccuug

SEQ ID NO: 619325 - RNA, 24 nt, Human
ugcugggauuacaggcgugagcca

SEQ ID NO: 619326 - RNA, 18 nt, Human
ugcuugaaucugaaagug

SEQ ID NO: 619327 - RNA, 19 nt, Human
uggcaagcaguggcaaugg

SEQ ID NO: 619328 - RNA, 22 nt, Human
uggcaagcaguggcaaugggcu

SEQ ID NO: 619329 - RNA, 21 nt, Human
uggccccuccccaccuacccc

SEQ ID NO: 619330 - RNA, 24 nt, Human
uggcuagguuggucucgaacuccu

SEQ ID NO: 619331 - RNA, 21 nt, Human
uggcucacuucuguaauccca

SEQ ID NO: 619332 - RNA, 22 nt, Human
uggcucacuucuguaaucccag

SEQ ID NO: 619333 - RNA, 24 nt, Human
uggcucacuucuguaaucccagca

SEQ ID NO: 619334 - RNA, 24 nt, Human
ugggaagcagcagugccuggccug

SEQ ID NO: 619335 - RNA, 18 nt, Human
ugggauuacaggcgugag

SEQ ID NO: 619336 - RNA, 22 nt, Human
ugggauuacaggcgugagccac

SEQ ID NO: 619337 - RNA, 23 nt, Human
ugggauuacaggcgugagccacc

SEQ ID NO: 619338 - RNA, 24 nt, Human
ugggauuacaggcgugagccacca

SEQ ID NO: 619339 - RNA, 25 nt, Human
ugggauuacaggcgugagccaccau

SEQ ID NO: 619340 - RNA, 19 nt, Human
uguacuccagccugggcaa

SEQ ID NO: 619341 - RNA, 22 nt, Human
uguacuccagccugggcaacaa

SEQ ID NO: 619342 - RNA, 20 nt, Human
ugugauggggagcaggugcu

SEQ ID NO: 619343 - RNA, 20 nt, Human
ugugccauugcucuccucug

SEQ ID NO: 619344 - RNA, 24 nt, Human
uuagaagagacgggguuucaccau

SEQ ID NO: 619345 - RNA, 20 nt, Human
uuagacccagcaauuacacc

SEQ ID NO: 619346 - RNA, 24 nt, Human
uuagccgggcauggugacacaugc

SEQ ID NO: 619347 - RNA, 20 nt, Human
uucagggaggaccccauggu

SEQ ID NO: 619348 - RNA, 18 nt, Human
uucaugaggggccauggc

SEQ ID NO: 619349 - RNA, 18 nt, Human
uucccaagcgccagagcc

SEQ ID NO: 619350 - RNA, 21 nt, Human
uuccguccccaucaacccuag

SEQ ID NO: 619351 - RNA, 24 nt, Human
uucuccaugcaggguccagccacc

SEQ ID NO: 619352 - RNA, 18 nt, Human
uugcagugagcugagauc

SEQ ID NO: 619353 - RNA, 20 nt, Human
uugcagugagcugagaucau

SEQ ID NO: 619354 - RNA, 21 nt, Human
uugcagugagcugagaucaug

SEQ ID NO: 619355 - RNA, 19 nt, Human
uuucaccauguuggcuagg

SEQ ID NO: 619356 - RNA, 20 nt, Human
uuucaccauguuggcuaggu

SEQ ID NO: 619357 - RNA, 18 nt, Human
uuucuacugggccgcugg

SEQ ID NO: 619358 - RNA, 21 nt, Human
uuucuaguucugcuuaucaca

SEQ ID NO: 619359 - RNA, 24 nt, Human
uuuuuagaagagacgggguuucac

SEQ ID NO: 619360 - RNA, 19 nt, Human
aagaaaccaagauucaggu

SEQ ID NO: 619361 - RNA, 18 nt, Human
aagaaucaaaaacgugac

SEQ ID NO: 619362 - RNA, 22 nt, Human
agaagcauaagaaucaaaaacg

SEQ ID NO: 619363 - RNA, 21 nt, Human
auauacaauuacaauaaagca

SEQ ID NO: 619364 - RNA, 20 nt, Human
cucuuuccacuucaucguaa

SEQ ID NO: 619365 - RNA, 18 nt, Human
uaaaaagaaaccaagauu

SEQ ID NO: 619366 - RNA, 25 nt, Human
uacuauggaauuauuuuugaguggu

SEQ ID NO: 619367 - RNA, 19 nt, Human
uacucaguuauaaaaagaa

SEQ ID NO: 619368 - RNA, 21 nt, Human
ucaguuauaaaaagaaaccaa

SEQ ID NO: 619369 - RNA, 22 nt, Human
ucaguuauaaaaagaaaccaag

SEQ ID NO: 619370 - RNA, 19 nt, Human
ucuauaauucaacgcaucc

SEQ ID NO: 619371 - RNA, 18 nt, Human
ugcucuuuccacuucauc

SEQ ID NO: 619372 - RNA, 18 nt, Human
uggcaagaagcauaagaa

SEQ ID NO: 619373 - RNA, 21 nt, Human
uucaacgcauccagauagacu

SEQ ID NO: 619374 - RNA, 25 nt, Human
uuuccacuucaucguaauguauuuc

SEQ ID NO: 619375 - RNA, 23 nt, Human
uuuuuuuuuuugguaaacagauc

SEQ ID NO: 619376 - RNA, 20 nt, Human
uuuuuuuuuuuuuuuuuggu

SEQ ID NO: 619377 - RNA, 28 nt, Human
uuuuuuuuuuuuuuuuuuuuuuuggggg

SEQ ID NO: 619378 - RNA, 19 nt, Human
aaaagaaaacaugguagaa

SEQ ID NO: 619379 - RNA, 23 nt, Human
aaauaaaacagcauacuaauaug

SEQ ID NO: 619380 - RNA, 22 nt, Human
aacugcuacugugugaagagaa

SEQ ID NO: 619381 - RNA, 19 nt, Human
aauacaaaauuugugaaag

SEQ ID NO: 619382 - RNA, 24 nt, Human
acacagcugcaccgggagacaggc

SEQ ID NO: 619383 - RNA, 22 nt, Human
accaaacaacagcgcccagagc

SEQ ID NO: 619384 - RNA, 20 nt, Human
agaaaagaaaacaugguaga

SEQ ID NO: 619385 - RNA, 20 nt, Human
augguagacaacuuaauaca

SEQ ID NO: 619386 - RNA, 21 nt, Human
caaacaacagcgcccagagcc

SEQ ID NO: 619387 - RNA, 22 nt, Human
caacagcgcccagagccgccga

SEQ ID NO: 619388 - RNA, 21 nt, Human
caggacuagcggggcgagcgg

SEQ ID NO: 619389 - RNA, 21 nt, Human
ccagagccgccgaaccgccca

SEQ ID NO: 619390 - RNA, 20 nt, Human
ccuccagauaacgccccucc

SEQ ID NO: 619391 - RNA, 23 nt, Human
cgcccagagccgccgaaccgccc

SEQ ID NO: 619392 - RNA, 24 nt, Human
cggcccuccagauaacgccccucc

SEQ ID NO: 619393 - RNA, 22 nt, Human
cuaacagacacguucaacauua

SEQ ID NO: 619394 - RNA, 20 nt, Human
cuagcggggcgagcggcccu

SEQ ID NO: 619395 - RNA, 18 nt, Human
cuccagauaacgccccuc

SEQ ID NO: 619396 - RNA, 26 nt, Human
cugcacccgcggcccuccagauaacg

SEQ ID NO: 619397 - RNA, 20 nt, Human
cuuaauacauuuucaccaaa

SEQ ID NO: 619398 - RNA, 19 nt, Human
gaaaagaaaacaugguaga

SEQ ID NO: 619399 - RNA, 22 nt, Human
gcaaaacuggaaaaaaagcaau

SEQ ID NO: 619400 - RNA, 18 nt, Human
gcuacugugugaagagaa

SEQ ID NO: 619401 - RNA, 21 nt, Human
uaaaacagcauacuaauaugc

SEQ ID NO: 619402 - RNA, 18 nt, Human
uaaagaccaaacaacagc

SEQ ID NO: 619403 - RNA, 22 nt, Human
uagcggggcgagcggcccuguc

SEQ ID NO: 619404 - RNA, 18 nt, Human
ucaaacauucaaauacug

SEQ ID NO: 619405 - RNA, 19 nt, Human
ucaaauacuguggucccuu

SEQ ID NO: 619406 - RNA, 19 nt, Human
ucagcuagaaaagaaaaca

SEQ ID NO: 619407 - RNA, 22 nt, Human
uccgcaggccuaaagaccaaac

SEQ ID NO: 619408 - RNA, 23 nt, Human
uccgcaggccuaaagaccaaaca

SEQ ID NO: 619409 - RNA, 19 nt, Human
uccgcaggccuaaagaccu

SEQ ID NO: 619410 - RNA, 20 nt, Human
ucugcaaaacuggaaaaaaa

SEQ ID NO: 619411 - RNA, 20 nt, Human
ugcaaaacuggaaaaaaagc

SEQ ID NO: 619412 - RNA, 18 nt, Human
ugugaagagaacuagaau

SEQ ID NO: 619413 - RNA, 20 nt, Human
ugugaagagaacuagaaugu

SEQ ID NO: 619414 - RNA, 21 nt, Human
uucagcuagaaaagaaaacau

SEQ ID NO: 619415 - RNA, 19 nt, Human
uuguaugcagugauauuuu

SEQ ID NO: 619416 - RNA, 23 nt, Human
uuuuuuuuuuuuuuuucuaacag

SEQ ID NO: 619417 - RNA, 21 nt, Human
aaaaaaaaaaaccacaaaaaa

SEQ ID NO: 619418 - RNA, 19 nt, Human
aaaaaaaaccacaaaaaaa

SEQ ID NO: 619419 - RNA, 19 nt, Human
aaaaaaauaaguaaaagaa

SEQ ID NO: 619420 - RNA, 22 nt, Human
aaaaauaauaaagcaaagaaaa

SEQ ID NO: 619421 - RNA, 18 nt, Human
aaagauaugucauucucc

SEQ ID NO: 619422 - RNA, 23 nt, Human
aaagauaugucauucucccaaag

SEQ ID NO: 619423 - RNA, 22 nt, Human
aaccccccuaccccauucaaaa

SEQ ID NO: 619424 - RNA, 22 nt, Human
aagcaaauauaauagauacuau

SEQ ID NO: 619425 - RNA, 24 nt, Human
aagcuuugauugcaguagcucugg

SEQ ID NO: 619426 - RNA, 20 nt, Human
aaucuugcuucuucuaacac

SEQ ID NO: 619427 - RNA, 22 nt, Human
aaugaugucuuucuuuccacuc

SEQ ID NO: 619428 - RNA, 26 nt, Human
aauugcuugaucugguguugagugga

SEQ ID NO: 619429 - RNA, 21 nt, Human
accccccuaccccauucaaaa

SEQ ID NO: 619430 - RNA, 19 nt, Human
agaaaauaauucauuucug

SEQ ID NO: 619431 - RNA, 20 nt, Human
agaaucacaggugcugacug

SEQ ID NO: 619432 - RNA, 20 nt, Human
agaauucuuuauugccacuu

SEQ ID NO: 619433 - RNA, 24 nt, Human
agauagaauugcuugaucuggugu

SEQ ID NO: 619434 - RNA, 18 nt, Human
aggaaagcuuugcauaug

SEQ ID NO: 619435 - RNA, 24 nt, Human
aggcccuuccucugcugcugcaga

SEQ ID NO: 619436 - RNA, 24 nt, Human
agggagucugaucucaccauauuc

SEQ ID NO: 619437 - RNA, 21 nt, Human
agguacaggcccuuccucugc

SEQ ID NO: 619438 - RNA, 21 nt, Human
aguaucuauuucuaagcuggc

SEQ ID NO: 619439 - RNA, 22 nt, Human
aguguuauuucuucuagacaac

SEQ ID NO: 619440 - RNA, 21 nt, Human
auaaaaccagguaaacccccc

SEQ ID NO: 619441 - RNA, 18 nt, Human
aucuuuuacaucuuccuc

SEQ ID NO: 619442 - RNA, 23 nt, Human
auuaaaauccucaaaugcaucuc

SEQ ID NO: 619443 - RNA, 18 nt, Human
caaaggagacacaggugg

SEQ ID NO: 619444 - RNA, 21 nt, Human
caaaugcaucucaaaccaaga

SEQ ID NO: 619445 - RNA, 20 nt, Human
cacagcuaauaucccugcuc

SEQ ID NO: 619446 - RNA, 21 nt, Human
cagguaaaccccccuacccca

SEQ ID NO: 619447 - RNA, 18 nt, Human
cauauaagcuuugauugc

SEQ ID NO: 619448 - RNA, 21 nt, Human
cauuauaaaaaugaaccugaa

SEQ ID NO: 619449 - RNA, 21 nt, Human
cauugccuuuuagcaggcaac

SEQ ID NO: 619450 - RNA, 20 nt, Human
cauugguagggagguacagg

SEQ ID NO: 619451 - RNA, 21 nt, Human
ccccccuaccccauucaaaag

SEQ ID NO: 619452 - RNA, 19 nt, Human
cuaugccuggucauaaaac

SEQ ID NO: 619453 - RNA, 21 nt, Human
cuauuuauaaaccugaacaac

SEQ ID NO: 619454 - RNA, 20 nt, Human
cucaaaugcaucucaaacca

SEQ ID NO: 619455 - RNA, 27 nt, Human
cucaaucaguaagaacuggauauuacu

SEQ ID NO: 619456 - RNA, 18 nt, Human
cucccaaaggagacacag

SEQ ID NO: 619457 - RNA, 21 nt, Human
cuugccuagaaugaaauucug

SEQ ID NO: 619458 - RNA, 19 nt, Human
gacaccaagucauugguag

SEQ ID NO: 619459 - RNA, 23 nt, Human
gaucagcaccacugaaguucaaa

SEQ ID NO: 619460 - RNA, 19 nt, Human
ggagucugaucucaccaua

SEQ ID NO: 619461 - RNA, 21 nt, Human
guaaaaauaauaaagcaaaga

SEQ ID NO: 619462 - RNA, 20 nt, Human
gucaauaccaaaaaaucuug

SEQ ID NO: 619463 - RNA, 19 nt, Human
guggagaaagaaaagugau

SEQ ID NO: 619464 - RNA, 21 nt, Human
uaaaauccucaaaugcaucuc

SEQ ID NO: 619465 - RNA, 26 nt, Human
uaaaauccucaaaugcaucucaaacc

SEQ ID NO: 619466 - RNA, 27 nt, Human
uaaaccccccuaccccauucaaaaggc

SEQ ID NO: 619467 - RNA, 23 nt, Human
uaaaccugaacaaccuuuuccaa

SEQ ID NO: 619468 - RNA, 25 nt, Human
uaaaugaauauuaaugaugcaccuu

SEQ ID NO: 619469 - RNA, 24 nt, Human
uaacacacccaauaaauuaaugcc

SEQ ID NO: 619470 - RNA, 20 nt, Human
uaaugcaguauacauuagau

SEQ ID NO: 619471 - RNA, 19 nt, Human
uacacuguaccuuuggaau

SEQ ID NO: 619472 - RNA, 21 nt, Human
uacaguguuauuucuucuaga

SEQ ID NO: 619473 - RNA, 23 nt, Human
uagaagaauaagcuacguaaaua

SEQ ID NO: 619474 - RNA, 23 nt, Human
uagcaggcaacucuaccauauuc

SEQ ID NO: 619475 - RNA, 22 nt, Human
ucaaaacaagcauaauccucua

SEQ ID NO: 619476 - RNA, 23 nt, Human
ucaaaccaagaugguauuuccac

SEQ ID NO: 619477 - RNA, 19 nt, Human
ucagaacccauuuggacac

SEQ ID NO: 619478 - RNA, 21 nt, Human
ucagaacccauuuggacacag

SEQ ID NO: 619479 - RNA, 18 nt, Human
uccauacugcaucuagga

SEQ ID NO: 619480 - RNA, 23 nt, Human
uccauacugcaucuaggaauuca

SEQ ID NO: 619481 - RNA, 24 nt, Human
ucccuuaugcaccacucaaaacaa

SEQ ID NO: 619482 - RNA, 21 nt, Human
uccuccauccagaguuacacu

SEQ ID NO: 619483 - RNA, 20 nt, Human
ucucaauacaauacuucucu

SEQ ID NO: 619484 - RNA, 22 nt, Human
ucuuggaccagccaaaugccuu

SEQ ID NO: 619485 - RNA, 19 nt, Human
ugaaaauagauuaucucuc

SEQ ID NO: 619486 - RNA, 19 nt, Human
ugaauaccacauucuguaa

SEQ ID NO: 619487 - RNA, 20 nt, Human
ugaaugaauaccacauucug

SEQ ID NO: 619488 - RNA, 25 nt, Human
ugacuugguuggaguugcuagcaag

SEQ ID NO: 619489 - RNA, 24 nt, Human
ugagaauucuuuauugccacuucu

SEQ ID NO: 619490 - RNA, 19 nt, Human
ugaguggguggagaaagaa

SEQ ID NO: 619491 - RNA, 21 nt, Human
ugauaaggaaaacauuuucau

SEQ ID NO: 619492 - RNA, 24 nt, Human
ugcaccacucaaaacaagcauaau

SEQ ID NO: 619493 - RNA, 19 nt, Human
ugccuagaaugaaauucug

SEQ ID NO: 619494 - RNA, 20 nt, Human
uggcaucgcaguucugacuu

SEQ ID NO: 619495 - RNA, 22 nt, Human
uggcugcaaucaaauguguguu

SEQ ID NO: 619496 - RNA, 24 nt, Human
ugguggcugcaaucaaaugugugu

SEQ ID NO: 619497 - RNA, 20 nt, Human
uguaccuuuggaaugacagu

SEQ ID NO: 619498 - RNA, 21 nt, Human
uguugugcuuuccauaaauua

SEQ ID NO: 619499 - RNA, 19 nt, Human
uugguuggaguugcuagca

SEQ ID NO: 619500 - RNA, 20 nt, Human
uuuguaaguguuguagugau

SEQ ID NO: 619501 - RNA, 25 nt, Human
uuuuugguggcugcaaucaaaugug

SEQ ID NO: 619502 - RNA, 21 nt, Human
uuuuugguuuugaaguaucuu

SEQ ID NO: 619503 - RNA, 19 nt, Human
aaaaagccaaagaucauug

SEQ ID NO: 619504 - RNA, 22 nt, Human
aaacagugugaaacugacaaaa

SEQ ID NO: 619505 - RNA, 24 nt, Human
aaaguaaaggcuuugcaggcuucu

SEQ ID NO: 619506 - RNA, 21 nt, Human
aaggcuuugcaggcuucuuca

SEQ ID NO: 619507 - RNA, 26 nt, Human
acaaaacuccaagggggagggaacgc

SEQ ID NO: 619508 - RNA, 23 nt, Human
acaacagggcuuuaccucuaacu

SEQ ID NO: 619509 - RNA, 23 nt, Human
acaauagaagugcugccacuaaa

SEQ ID NO: 619510 - RNA, 19 nt, Human
acaguuaaaaaaacugugu

SEQ ID NO: 619511 - RNA, 20 nt, Human
acuguguagccacauuacug

SEQ ID NO: 619512 - RNA, 23 nt, Human
agcaaacagugugaaacugacaa

SEQ ID NO: 619513 - RNA, 23 nt, Human
aguaugcugauaagugaagggac

SEQ ID NO: 619514 - RNA, 26 nt, Human
agugugaaacugacaaaacuccaagg

SEQ ID NO: 619515 - RNA, 19 nt, Human
auacuagaaacccuuaaua

SEQ ID NO: 619516 - RNA, 22 nt, Human
caaaacuccaagggggaaacau

SEQ ID NO: 619517 - RNA, 25 nt, Human
caaacaguacaccugggccagcaaa

SEQ ID NO: 619518 - RNA, 22 nt, Human
cagcaaacagugugaaacugac

SEQ ID NO: 619519 - RNA, 20 nt, Human
gaaaccaaucugacucccaa

SEQ ID NO: 619520 - RNA, 22 nt, Human
gaagcauucuuuugcuccagcc

SEQ ID NO: 619521 - RNA, 27 nt, Human
uaaaaaguacgauaaaaauuugcacaa

SEQ ID NO: 619522 - RNA, 21 nt, Human
uaacaaaggccacaaacagua

SEQ ID NO: 619523 - RNA, 18 nt, Human
uaccucuaacucagaauu

SEQ ID NO: 619524 - RNA, 23 nt, Human
uagcaaauaaaucaaaaagccaa

SEQ ID NO: 619525 - RNA, 24 nt, Human
uagcaaauaaaucaaaaagccaaa

SEQ ID NO: 619526 - RNA, 18 nt, Human
ugaaacugacaaaacucc

SEQ ID NO: 619527 - RNA, 19 nt, Human
ugaagcauucuuuugcucc

SEQ ID NO: 619528 - RNA, 23 nt, Human
ugccacuaaacuuucaguugagg

SEQ ID NO: 619529 - RNA, 23 nt, Human
uuaaaaaaacuguguagccacau

SEQ ID NO: 619530 - RNA, 21 nt, Human
uuuuuuuuuuuuuuuuuuaag

SEQ ID NO: 619531 - RNA, 24 nt, Human
aaaaaacagagcgaggcccccccc

SEQ ID NO: 619532 - RNA, 23 nt, Human
aaaaagaaggagguaaguccuaa

SEQ ID NO: 619533 - RNA, 22 nt, Human
aaagaggaggaugaggccuagg

SEQ ID NO: 619534 - RNA, 22 nt, Human
aacagcucccuuccaccggaag

SEQ ID NO: 619535 - RNA, 23 nt, Human
aacauacaagagaccuuacaaaa

SEQ ID NO: 619536 - RNA, 21 nt, Human
aacuuggggacgucuggccuu

SEQ ID NO: 619537 - RNA, 21 nt, Human
aagcaaagcgcuuggagcccg

SEQ ID NO: 619538 - RNA, 21 nt, Human
aagcauuggaaaccagacagu

SEQ ID NO: 619539 - RNA, 21 nt, Human
aagccggaguuccggaagcaa

SEQ ID NO: 619540 - RNA, 22 nt, Human
aaugagagagcggcgagagaga

SEQ ID NO: 619541 - RNA, 21 nt, Human
acaaaguucucuugccuggaa

SEQ ID NO: 619542 - RNA, 18 nt, Human
acaacgcuaagcggccag

SEQ ID NO: 619543 - RNA, 23 nt, Human
acagaucagucuccacgcggcaa

SEQ ID NO: 619544 - RNA, 18 nt, Human
acagugucagagccucug

SEQ ID NO: 619545 - RNA, 18 nt, Human
acgccagcuccccgugag

SEQ ID NO: 619546 - RNA, 23 nt, Human
acgccgaguccccagacucugac

SEQ ID NO: 619547 - RNA, 25 nt, Human
agagaaaccagcgaucccgccuggg

SEQ ID NO: 619548 - RNA, 22 nt, Human
agcuuccuggacauggcaguuc

SEQ ID NO: 619549 - RNA, 19 nt, Human
aggaugcccaggagcccca

SEQ ID NO: 619550 - RNA, 24 nt, Human
aggcaaaaaaggauucacacccag

SEQ ID NO: 619551 - RNA, 22 nt, Human
aggcugcuuuuccagacugugu

SEQ ID NO: 619552 - RNA, 20 nt, Human
aguccccagacucugacagg

SEQ ID NO: 619553 - RNA, 28 nt, Human
aucauuucuucagcugucaauacugugu

SEQ ID NO: 619554 - RNA, 19 nt, Human
aucccagcaagccccgcaa

SEQ ID NO: 619555 - RNA, 21 nt, Human
caaaaaaggauucacacccag

SEQ ID NO: 619556 - RNA, 19 nt, Human
caaaguucucuugccugga

SEQ ID NO: 619557 - RNA, 28 nt, Human
caacauacaagagaccuuacaaaaagaa

SEQ ID NO: 619558 - RNA, 19 nt, Human
caacgcuaagcggccagca

SEQ ID NO: 619559 - RNA, 22 nt, Human
caccacccaccucagaggcaaa

SEQ ID NO: 619560 - RNA, 20 nt, Human
cacccagaucucuagaaaaa

SEQ ID NO: 619561 - RNA, 26 nt, Human
cacccagaucucuagaaaaaugaucu

SEQ ID NO: 619562 - RNA, 20 nt, Human
cacggcaugucgggcagagc

SEQ ID NO: 619563 - RNA, 18 nt, Human
cacugacgcggcugcggc

SEQ ID NO: 619564 - RNA, 22 nt, Human
cacuuggaaaaaacagagcgag

SEQ ID NO: 619565 - RNA, 18 nt, Human
cagaagccaguggacagg

SEQ ID NO: 619566 - RNA, 18 nt, Human
cagcuccccagagaggau

SEQ ID NO: 619567 - RNA, 22 nt, Human
cagcugggcccgucucucacca

SEQ ID NO: 619568 - RNA, 20 nt, Human
caguggacaggccuccagcc

SEQ ID NO: 619569 - RNA, 24 nt, Human
cauaguuauacaaagaaaaugaga

SEQ ID NO: 619570 - RNA, 22 nt, Human
ccacacagagaagggguacaaa

SEQ ID NO: 619571 - RNA, 24 nt, Human
ccacccaccucagaggcaaaaaag

SEQ ID NO: 619572 - RNA, 23 nt, Human
ccagaaagagagggaaggcugca

SEQ ID NO: 619573 - RNA, 18 nt, Human
ccagcccaaccucuaugc

SEQ ID NO: 619574 - RNA, 22 nt, Human
ccagcggccgccuuccucccag

SEQ ID NO: 619575 - RNA, 24 nt, Human
cccaaccucuaugccaggcgugac

SEQ ID NO: 619576 - RNA, 23 nt, Human
cccagcaagccccgcaacagcuc

SEQ ID NO: 619577 - RNA, 21 nt, Human
ccccagcggccgccuuccucc

SEQ ID NO: 619578 - RNA, 21 nt, Human
cccccaacuuggggacgucug

SEQ ID NO: 619579 - RNA, 23 nt, Human
ccccccaagaggcagcgcccacc

SEQ ID NO: 619580 - RNA, 22 nt, Human
ccccgcaacagcucccuuccac

SEQ ID NO: 619581 - RNA, 23 nt, Human
ccccgcaacagcucccuuccacc

SEQ ID NO: 619582 - RNA, 21 nt, Human
cccgaauuuucaccgugacgc

SEQ ID NO: 619583 - RNA, 20 nt, Human
cccgugucagaagaaggccc

SEQ ID NO: 619584 - RNA, 22 nt, Human
ccuuccucccaggcucugcugg

SEQ ID NO: 619585 - RNA, 24 nt, Human
cgcaacagcucccuuccaccggaa

SEQ ID NO: 619586 - RNA, 18 nt, Human
cgccgaguccccagacuc

SEQ ID NO: 619587 - RNA, 19 nt, Human
cgccgggaagcagugacga

SEQ ID NO: 619588 - RNA, 24 nt, Human
cgugacaaggcacugacagacgcc

SEQ ID NO: 619589 - RNA, 26 nt, Human
cuccagaagccaguggacaggccucc

SEQ ID NO: 619590 - RNA, 22 nt, Human
cucugaccugcaggcgggaggc

SEQ ID NO: 619591 - RNA, 18 nt, Human
cuuggaaaaaacagagcg

SEQ ID NO: 619592 - RNA, 24 nt, Human
cuuggacagcugggcccgucucuc

SEQ ID NO: 619593 - RNA, 19 nt, Human
gaaaaaacagagcgagggg

SEQ ID NO: 619594 - RNA, 19 nt, Human
gacgugcuggacacugacg

SEQ ID NO: 619595 - RNA, 23 nt, Human
gacugucccgggcuuggucaggu

SEQ ID NO: 619596 - RNA, 20 nt, Human
gagagagaggcauuugugau

SEQ ID NO: 619597 - RNA, 23 nt, Human
gcaaaaaaggauucacacccaga

SEQ ID NO: 619598 - RNA, 22 nt, Human
gccccgcaacagcucccuucca

SEQ ID NO: 619599 - RNA, 23 nt, Human
gcgagagagaggcauuugugaug

SEQ ID NO: 619600 - RNA, 19 nt, Human
ggagcucugcgaggucgag

SEQ ID NO: 619601 - RNA, 21 nt, Human
ggcaguucauuacaucucggg

SEQ ID NO: 619602 - RNA, 24 nt, Human
ggcaugucgggcagagcccgugca

SEQ ID NO: 619603 - RNA, 28 nt, Human
ggcauuugugaugcucuguaaacauccc

SEQ ID NO: 619604 - RNA, 21 nt, Human
ggcccgucucucaccacccac

SEQ ID NO: 619605 - RNA, 18 nt, Human
gucccgggcuuggucagg

SEQ ID NO: 619606 - RNA, 21 nt, Human
gucuggccuuggacagcuggg

SEQ ID NO: 619607 - RNA, 22 nt, Human
uaaauuaaaaaaaccacaagcc

SEQ ID NO: 619608 - RNA, 21 nt, Human
uaacaacauacaagagaccuu

SEQ ID NO: 619609 - RNA, 23 nt, Human
uaagcugauaaaauacgauaccu

SEQ ID NO: 619610 - RNA, 22 nt, Human
uagcaccaagaacgcuuccuuc

SEQ ID NO: 619611 - RNA, 22 nt, Human
ucagagccucugaccugcaggc

SEQ ID NO: 619612 - RNA, 22 nt, Human
uccacacagagaagggguacaa

SEQ ID NO: 619613 - RNA, 20 nt, Human
uccagcccaaccucuaugcc

SEQ ID NO: 619614 - RNA, 20 nt, Human
uccucccaggcucugcuggg

SEQ ID NO: 619615 - RNA, 22 nt, Human
ucuagaaaaaugaucaaaagca

SEQ ID NO: 619616 - RNA, 21 nt, Human
ucuaugccaggcgugacaagg

SEQ ID NO: 619617 - RNA, 24 nt, Human
ucuguaaacaucccgaauuuucac

SEQ ID NO: 619618 - RNA, 22 nt, Human
ucuucucacagccaagcuuccu

SEQ ID NO: 619619 - RNA, 24 nt, Human
ugaagcccaggcugcuuuuccaga

SEQ ID NO: 619620 - RNA, 23 nt, Human
ugaagucccaaacaucccagaaa

SEQ ID NO: 619621 - RNA, 24 nt, Human
ugagagagcggcgagagagaggca

SEQ ID NO: 619622 - RNA, 23 nt, Human
ugcacgccgaguccccagacucc

SEQ ID NO: 619623 - RNA, 19 nt, Human
ugcccaggagccccagcgg

SEQ ID NO: 619624 - RNA, 22 nt, Human
ugcucuguaaacaucccgaauu

SEQ ID NO: 619625 - RNA, 19 nt, Human
uggaaaguacaaauugaga

SEQ ID NO: 619626 - RNA, 18 nt, Human
uggcaaagaggaggauga

SEQ ID NO: 619627 - RNA, 22 nt, Human
ugucagaagaaggcccggccuc

SEQ ID NO: 619628 - RNA, 18 nt, Human
ugucaggagcucugcgag

SEQ ID NO: 619629 - RNA, 22 nt, Human
uuccagaggaaaaacgcugggg

SEQ ID NO: 619630 - RNA, 21 nt, Human
uugugaugcucuguaaacauc

SEQ ID NO: 619631 - RNA, 25 nt, Human
uuuaagccaaacauuuaacaacaua

SEQ ID NO: 619632 - RNA, 22 nt, Human
uuuauaauuguuuaagccaaac

SEQ ID NO: 619633 - RNA, 21 nt, Human
aaaaaaauucaaaagcaccua

SEQ ID NO: 619634 - RNA, 20 nt, Human
aaaucaaagaucccacuccu

SEQ ID NO: 619635 - RNA, 19 nt, Human
aagaccaagaauuauucug

SEQ ID NO: 619636 - RNA, 23 nt, Human
acacacacacacacacacacaca

SEQ ID NO: 619637 - RNA, 23 nt, Human
acacacacacacacacacacaca

SEQ ID NO: 619638 - RNA, 23 nt, Human
acacacacacacacacacacaca

SEQ ID NO: 619639 - RNA, 23 nt, Human
acacacacacacacacacacaca

SEQ ID NO: 619640 - RNA, 23 nt, Human
acacacacacacacacacacaca

SEQ ID NO: 619641 - RNA, 26 nt, Human
acacacacacacacacacacacccca

SEQ ID NO: 619642 - RNA, 19 nt, Human
acauaagcgcacacugacu

SEQ ID NO: 619643 - RNA, 23 nt, Human
acuauaaagggaagugaaaaaaa

SEQ ID NO: 619644 - RNA, 22 nt, Human
aucaaagaucccacuccuuucc

SEQ ID NO: 619645 - RNA, 23 nt, Human
augugcguguguguguguguguu

SEQ ID NO: 619646 - RNA, 18 nt, Human
cacacacacacacacaca

SEQ ID NO: 619647 - RNA, 20 nt, Human
cacacacacacacacacaca

SEQ ID NO: 619648 - RNA, 20 nt, Human
cacacacacacacacacaca

SEQ ID NO: 619649 - RNA, 20 nt, Human
cacacacacacacacacaca

SEQ ID NO: 619650 - RNA, 20 nt, Human
cacacacacacacacacaca

SEQ ID NO: 619651 - RNA, 20 nt, Human
cacacacacacacacacaca

SEQ ID NO: 619652 - RNA, 20 nt, Human
cacacacacacacacacaca

SEQ ID NO: 619653 - RNA, 20 nt, Human
cacacacacacacacacaca

SEQ ID NO: 619654 - RNA, 20 nt, Human
cacacacacacacacacaca

SEQ ID NO: 619655 - RNA, 20 nt, Human
cacacacacacacacacaca

SEQ ID NO: 619656 - RNA, 20 nt, Human
cacacacacacacacacaca

SEQ ID NO: 619657 - RNA, 22 nt, Human
cacacacacacacacacacaca

SEQ ID NO: 619658 - RNA, 22 nt, Human
cacacacacacacacacacaca

SEQ ID NO: 619659 - RNA, 22 nt, Human
cacacacacacacacacacaca

SEQ ID NO: 619660 - RNA, 22 nt, Human
cacacacacacacacacacaca

SEQ ID NO: 619661 - RNA, 26 nt, Human
cacacacacacacacacacacacaca

SEQ ID NO: 619662 - RNA, 26 nt, Human
cacacacacacacacacacacacaca

SEQ ID NO: 619663 - RNA, 26 nt, Human
cacacacacacacacacacacacaca

SEQ ID NO: 619664 - RNA, 26 nt, Human
cacacacacacacacacacacacaca

SEQ ID NO: 619665 - RNA, 26 nt, Human
cacacacacacacacacacacacaca

SEQ ID NO: 619666 - RNA, 26 nt, Human
cacacacacacacacacacacacaca

SEQ ID NO: 619667 - RNA, 30 nt, Human; identical to SEQ ID NO: 326474

SEQ ID NO: 619668 - RNA, 29 nt, Human
cacacacacacacacacacacacacccca

SEQ ID NO: 619669 - RNA, 23 nt, Human
cacacacacacacaccccaagua

SEQ ID NO: 619670 - RNA, 22 nt, Human
caccccaaguacauaagcgcac

SEQ ID NO: 619671 - RNA, 26 nt, Human
cacccugaaaucaaagaucccacucc

SEQ ID NO: 619672 - RNA, 25 nt, Human
cggcccuccuuauuucaguccuuga

SEQ ID NO: 619673 - RNA, 23 nt, Human
gaucccacuccuuucccaaaacu

SEQ ID NO: 619674 - RNA, 20 nt, Human
gaucccacuccuuucccaag

SEQ ID NO: 619675 - RNA, 21 nt, Human
gcacacugugugugugugugu

SEQ ID NO: 619676 - RNA, 21 nt, Human
gugugugugcgugugugugug

SEQ ID NO: 619677 - RNA, 21 nt, Human
gugugugugugugugugcgug

SEQ ID NO: 619678 - RNA, 20 nt, Human
uacguguguguauauguagc

SEQ ID NO: 619679 - RNA, 25 nt, Human
uaugcacacacacacacacacacac

SEQ ID NO: 619680 - RNA, 25 nt, Human
uaugcacacacacacacacacacag

SEQ ID NO: 619681 - RNA, 20 nt, Human
uaugcacacacacacacagu

SEQ ID NO: 619682 - RNA, 19 nt, Human
uaugugcgugugugugugu

SEQ ID NO: 619683 - RNA, 24 nt, Human
uaugugcgugugugugugugugag

SEQ ID NO: 619684 - RNA, 20 nt, Human
ucuguuuucacccugaaauc

SEQ ID NO: 619685 - RNA, 21 nt, Human
ugaaaaaaauucaaaagcacc

SEQ ID NO: 619686 - RNA, 20 nt, Human
ugacuauggcaguucaaaca

SEQ ID NO: 619687 - RNA, 21 nt, Human
ugacuauggcaguucaaacac

SEQ ID NO: 619688 - RNA, 25 nt, Human
ugcacacacacacacacacacacac

SEQ ID NO: 619689 - RNA, 18 nt, Human
ugcacacugugugugugu

SEQ ID NO: 619690 - RNA, 22 nt, Human
ugcaggcaacagucauggguac

SEQ ID NO: 619691 - RNA, 23 nt, Human
ugcguguguguguguguguguaa

SEQ ID NO: 619692 - RNA, 19 nt, Human
uggcauuuguaguguccau

SEQ ID NO: 619693 - RNA, 21 nt, Human
uguaugugcgugugugugugu

SEQ ID NO: 619694 - RNA, 21 nt, Human
ugugcgugugugugugugugu

SEQ ID NO: 619695 - RNA, 21 nt, Human
ugugcgugugugugugugugu

SEQ ID NO: 619696 - RNA, 21 nt, Human
uguguaugugcgugugugugu

SEQ ID NO: 619697 - RNA, 19 nt, Human
ugugugcgugugugugugu

SEQ ID NO: 619698 - RNA, 21 nt, Human
ugugugcgugugugugugugu

SEQ ID NO: 619699 - RNA, 20 nt, Human
uguguguaugugcgugugug

SEQ ID NO: 619700 - RNA, 22 nt, Human
uguguguaugugcgugugugug

SEQ ID NO: 619701 - RNA, 21 nt, Human
ugugugugcgugugugugugu

SEQ ID NO: 619702 - RNA, 21 nt, Human
ugugugugcgugugugugugu

SEQ ID NO: 619703 - RNA, 21 nt, Human
ugugugugcgugugugugugu

SEQ ID NO: 619704 - RNA, 25 nt, Human
ugugugugcgugugugugugugugu

SEQ ID NO: 619705 - RNA, 19 nt, Human
uguguguguaugugcgugu

SEQ ID NO: 619706 - RNA, 31 nt, Human
uguguguguaugugcgugugugugugugugg

SEQ ID NO: 619707 - RNA, 21 nt, Human
ugugugugugcgugugugugu

SEQ ID NO: 619708 - RNA, 25 nt, Human
ugugugugugcgugugugugugugu

SEQ ID NO: 619709 - RNA, 21 nt, Human
uguguguguguaugugcgugu

SEQ ID NO: 619710 - RNA, 21 nt, Human
uguguguguguaugugcgugu

SEQ ID NO: 619711 - RNA, 20 nt, Human
ugugugugugugcgugugug

SEQ ID NO: 619712 - RNA, 22 nt, Human
ugugugugugugcgugugugug

SEQ ID NO: 619713 - RNA, 21 nt, Human
ugugugugugugugcgugugu

SEQ ID NO: 619714 - RNA, 21 nt, Human
ugugugugugugugcgugugu

SEQ ID NO: 619715 - RNA, 20 nt, Human
uguguguguguguguaugug

SEQ ID NO: 619716 - RNA, 21 nt, Human
uguguguguguguguaugugc

SEQ ID NO: 619717 - RNA, 26 nt, Human
uguguguguguguguguaugugcgug

SEQ ID NO: 619718 - RNA, 22 nt, Human
uguguguguguguguguauguu

SEQ ID NO: 619719 - RNA, 18 nt, Human
ugugugugugugugugug

SEQ ID NO: 619720 - RNA, 19 nt, Human
ugugugugugugugugugu

SEQ ID NO: 619721 - RNA, 20 nt, Human
ugugugugugugugugugug

SEQ ID NO: 619722 - RNA, 21 nt, Human
ugugugugugugugugugugc

SEQ ID NO: 619723 - RNA, 21 nt, Human
uucccaaaacuauaaagggaa

SEQ ID NO: 619724 - RNA, 28 nt, Human
uugcacacugugugugugugugugugug

SEQ ID NO: 619725 - RNA, 21 nt, Human
uuuguaguguccauucugaga

SEQ ID NO: 619726 - RNA, 24 nt, Human
uuuuuuuuuuuuuuuuucccuuuu

SEQ ID NO: 619727 - RNA, 24 nt, Human
aaaaacaaaacaaaacaaaaaaga

SEQ ID NO: 619728 - RNA, 22 nt, Human
aaaacaaaaaccaaaaaaagca

SEQ ID NO: 619729 - RNA, 21 nt, Human
aaaacaaaacaaaacaaaaac

SEQ ID NO: 619730 - RNA, 27 nt, Human
aaacaaaacaaaaaccaaaaaaagcaa

SEQ ID NO: 619731 - RNA, 23 nt, Human
aaacaaaacaaaacaaaaaccaa

SEQ ID NO: 619732 - RNA, 24 nt, Human
aaacaaaacaaaacaaaaaccaaa

SEQ ID NO: 619733 - RNA, 25 nt, Human
aaacaaaacaaaacaaaaaccaaaa

SEQ ID NO: 619734 - RNA, 23 nt, Human
aaacaagaaauuguccuuuccaa

SEQ ID NO: 619735 - RNA, 25 nt, Human
aaacaagaaauuguccuuuccaaaa

SEQ ID NO: 619736 - RNA, 23 nt, Human
aaagaaccaauuaauucucacca

SEQ ID NO: 619737 - RNA, 24 nt, Human
aaagugcugggauuagagguguga

SEQ ID NO: 619738 - RNA, 26 nt, Human
aacaaaacaaaaaccaaaaaaagcaa

SEQ ID NO: 619739 - RNA, 22 nt, Human
aacaaaacaaaacaaaaaccaa

SEQ ID NO: 619740 - RNA, 21 nt, Human
aacaaagcgagacuccgucuc

SEQ ID NO: 619741 - RNA, 21 nt, Human
aacauggugaauccccauuuc

SEQ ID NO: 619742 - RNA, 25 nt, Human
aagcgauucuccagccucagccucc

SEQ ID NO: 619743 - RNA, 23 nt, Human
aagguggguggaucacgagguca

SEQ ID NO: 619744 - RNA, 20 nt, Human
aaguaaggauaggccccaaa

SEQ ID NO: 619745 - RNA, 20 nt, Human
aaguagcugggauuacaagc

SEQ ID NO: 619746 - RNA, 26 nt, Human
aaguagcugggauuacaagcgccugc

SEQ ID NO: 619747 - RNA, 18 nt, Human
aagugcugggauuagagg

SEQ ID NO: 619748 - RNA, 19 nt, Human
aagugcugggauuagaggu

SEQ ID NO: 619749 - RNA, 26 nt, Human
aagugcugggauuagaggugugagcc

SEQ ID NO: 619750 - RNA, 24 nt, Human
aauugccugaacccaggaggcaga

SEQ ID NO: 619751 - RNA, 24 nt, Human
aauuuuguauuuuucguagagaug

SEQ ID NO: 619752 - RNA, 19 nt, Human
acaaaacaaaacaaaaacc

SEQ ID NO: 619753 - RNA, 24 nt, Human
acaaaacaaaacaaaaaccaaaaa

SEQ ID NO: 619754 - RNA, 23 nt, Human
acaaagcgagacuccgucucaaa

SEQ ID NO: 619755 - RNA, 24 nt, Human
acaaagcgagacuccgucucaaaa

SEQ ID NO: 619756 - RNA, 24 nt, Human
acagccucuaauguuaccaaccuu

SEQ ID NO: 619757 - RNA, 24 nt, Human
acccaggaggcagagguugcagug

SEQ ID NO: 619758 - RNA, 22 nt, Human
acggaguuucgcucuucucacc

SEQ ID NO: 619759 - RNA, 18 nt, Human
acugcacuccagccuggg

SEQ ID NO: 619760 - RNA, 23 nt, Human
agagaugggguuucaccauuugg

SEQ ID NO: 619761 - RNA, 24 nt, Human
agagguugcagugagccgagaucg

SEQ ID NO: 619762 - RNA, 24 nt, Human
agcacuuugggaggccaagguggg

SEQ ID NO: 619763 - RNA, 23 nt, Human
agccucagccucccaaguagcug

SEQ ID NO: 619764 - RNA, 24 nt, Human
agccugggaaacaaagcgagacuc

SEQ ID NO: 619765 - RNA, 24 nt, Human
agcuacucaggaggcugagguggg

SEQ ID NO: 619766 - RNA, 23 nt, Human
agcugagcaugguggcaugugcc

SEQ ID NO: 619767 - RNA, 24 nt, Human
agcugggauuacaagcgccugcua

SEQ ID NO: 619768 - RNA, 21 nt, Human
aggcagagguugcagugagcc

SEQ ID NO: 619769 - RNA, 24 nt, Human
aggcagagguugcagugagccgag

SEQ ID NO: 619770 - RNA, 21 nt, Human
aggccaagguggguggaucac

SEQ ID NO: 619771 - RNA, 24 nt, Human
aggcgugguggcucaugccuguaa

SEQ ID NO: 619772 - RNA, 20 nt, Human
aggcugaggugggagaauug

SEQ ID NO: 619773 - RNA, 18 nt, Human
aggugggagaauugccug

SEQ ID NO: 619774 - RNA, 24 nt, Human
agguggguggaucacgaggucagg

SEQ ID NO: 619775 - RNA, 18 nt, Human
auacagugggauuagaua

SEQ ID NO: 619776 - RNA, 20 nt, Human
aucacgaggucaggaguucc

SEQ ID NO: 619777 - RNA, 24 nt, Human
aucgugccacugcacuccagccug

SEQ ID NO: 619778 - RNA, 19 nt, Human
augccuguaaucccagcac

SEQ ID NO: 619779 - RNA, 24 nt, Human
augggguuucaccauuuggccagg

SEQ ID NO: 619780 - RNA, 25 nt, Human
caaaaaaagcaaacauauuuuuuca

SEQ ID NO: 619781 - RNA, 23 nt, Human
caaaaacaaaacaaaacaaaaac

SEQ ID NO: 619782 - RNA, 24 nt, Human
caaaaacaaaacaaaacaaaaacc

SEQ ID NO: 619783 - RNA, 22 nt, Human
caaaacaaaaaccaaaaaaagc

SEQ ID NO: 619784 - RNA, 24 nt, Human
caaaacaaaaaccaaaaaaagcaa

SEQ ID NO: 619785 - RNA, 20 nt, Human
caaaacaaaacaaaaaccaa

SEQ ID NO: 619786 - RNA, 26 nt, Human
caaacuccugaccuugggugauccaa

SEQ ID NO: 619787 - RNA, 24 nt, Human
caaagugcugggauuagaggugug

SEQ ID NO: 619788 - RNA, 19 nt, Human
cacaaauggccaaacaaga

SEQ ID NO: 619789 - RNA, 23 nt, Human
cacaacuggacucagagccccca

SEQ ID NO: 619790 - RNA, 20 nt, Human
caccauuuggccaggcuggu

SEQ ID NO: 619791 - RNA, 23 nt, Human
caccauuuggccaggcuggucuc

SEQ ID NO: 619792 - RNA, 18 nt, Human
cacccgcgcaccuaggag

SEQ ID NO: 619793 - RNA, 23 nt, Human
caccuaccucagccucccaaagu

SEQ ID NO: 619794 - RNA, 21 nt, Human
cacugcaaccuucaccuccug

SEQ ID NO: 619795 - RNA, 23 nt, Human
cacugcaaccuucaccuccuggg

SEQ ID NO: 619796 - RNA, 24 nt, Human
cacugcaaccuucaccuccugggu

SEQ ID NO: 619797 - RNA, 18 nt, Human
cacugcacuccagccugg

SEQ ID NO: 619798 - RNA, 19 nt, Human
cacugcacuccagccuggg

SEQ ID NO: 619799 - RNA, 19 nt, Human
cacugcacuccagccuggg

SEQ ID NO: 619800 - RNA, 24 nt, Human
cacugcacuccagccugggaaaca

SEQ ID NO: 619801 - RNA, 21 nt, Human
cagcacuuugggaggccaagg

SEQ ID NO: 619802 - RNA, 24 nt, Human
cagcacuuugggaggccaaggugg

SEQ ID NO: 619803 - RNA, 25 nt, Human
cagccucagccucccaaguagcugg

SEQ ID NO: 619804 - RNA, 22 nt, Human
cagccucuaauguuaccaaccu

SEQ ID NO: 619805 - RNA, 24 nt, Human
cagcuacucaggaggcugaggugg

SEQ ID NO: 619806 - RNA, 20 nt, Human
caugccuguaaucccagcac

SEQ ID NO: 619807 - RNA, 24 nt, Human
caugccuguaaucccagcacuuug

SEQ ID NO: 619808 - RNA, 20 nt, Human
ccaaagugcugggauuagag

SEQ ID NO: 619809 - RNA, 20 nt, Human
ccaaagugcugggauuagag

SEQ ID NO: 619810 - RNA, 21 nt, Human
ccaaagugcugggauuagagg

SEQ ID NO: 619811 - RNA, 24 nt, Human
ccaaagugcugggauuagaggugu

SEQ ID NO: 619812 - RNA, 26 nt, Human
ccaccuaccucagccucccaaagugc

SEQ ID NO: 619813 - RNA, 19 nt, Human
ccacugcacuccagccugg

SEQ ID NO: 619814 - RNA, 20 nt, Human
ccacugcacuccagccuggg

SEQ ID NO: 619815 - RNA, 24 nt, Human
ccacugcacuccagccugggaaac

SEQ ID NO: 619816 - RNA, 23 nt, Human
ccagccucagccucccaaguagc

SEQ ID NO: 619817 - RNA, 19 nt, Human
cccaaguagcugggauuac

SEQ ID NO: 619818 - RNA, 21 nt, Human
cccaggcuggagugcaauggc

SEQ ID NO: 619819 - RNA, 22 nt, Human
cccccagaucggugcaaccagc

SEQ ID NO: 619820 - RNA, 18 nt, Human
cccgagcccgggaagccc

SEQ ID NO: 619821 - RNA, 19 nt, Human
cccgggaagcccccagauc

SEQ ID NO: 619822 - RNA, 22 nt, Human
ccgucucaaaaacaaaacaaaa

SEQ ID NO: 619823 - RNA, 24 nt, Human
ccuccuggguucaagcgauucucc

SEQ ID NO: 619824 - RNA, 24 nt, Human
ccugaccaacauggugaaucccca

SEQ ID NO: 619825 - RNA, 24 nt, Human
ccugaccuugggugauccaccuac

SEQ ID NO: 619826 - RNA, 22 nt, Human
ccuguaaucccagcacuuuggg

SEQ ID NO: 619827 - RNA, 21 nt, Human
ccuguaaucccagcuacucag

SEQ ID NO: 619828 - RNA, 19 nt, Human
ccuucaccuccuggguuca

SEQ ID NO: 619829 - RNA, 24 nt, Human
cgagaucgugccacugcacuccag

SEQ ID NO: 619830 - RNA, 24 nt, Human
cucagccucccaaguagcugggau

SEQ ID NO: 619831 - RNA, 18 nt, Human
cucaggaggcugaggugg

SEQ ID NO: 619832 - RNA, 24 nt, Human
cucaugccuguaaucccagcacuu

SEQ ID NO: 619833 - RNA, 24 nt, Human
cuccagccucagccucccaaguag

SEQ ID NO: 619834 - RNA, 21 nt, Human
cuccuggguucaagcgauucu

SEQ ID NO: 619835 - RNA, 19 nt, Human
cucuucucacccaggcugg

SEQ ID NO: 619836 - RNA, 22 nt, Human
cucuucucacccaggcuggagu

SEQ ID NO: 619837 - RNA, 23 nt, Human
cugcaaccuucaccuccuggguu

SEQ ID NO: 619838 - RNA, 21 nt, Human
cuucucgagaagccgggaauu

SEQ ID NO: 619839 - RNA, 22 nt, Human
gaaggaagaaugccugccuggc

SEQ ID NO: 619840 - RNA, 24 nt, Human
gaccuugggugauccaccuaccuc

SEQ ID NO: 619841 - RNA, 19 nt, Human
gagaacagugcaaagaacc

SEQ ID NO: 619842 - RNA, 25 nt, Human
gagaacagugcaaagaaccaauuaa

SEQ ID NO: 619843 - RNA, 18 nt, Human
gagaugggguuucaccau

SEQ ID NO: 619844 - RNA, 23 nt, Human
gagaugggguuucaccauuuggc

SEQ ID NO: 619845 - RNA, 24 nt, Human
gagcaugguggcaugugccuguaa

SEQ ID NO: 619846 - RNA, 21 nt, Human
gaucacgaggucaggaguucg

SEQ ID NO: 619847 - RNA, 22 nt, Human
gaucacgaggucaggaguucga

SEQ ID NO: 619848 - RNA, 24 nt, Human
gaucacgaggucaggaguucgaga

SEQ ID NO: 619849 - RNA, 20 nt, Human
gaugggguuucaccauuugg

SEQ ID NO: 619850 - RNA, 24 nt, Human
gauuacaagcgccugcuaccaugc

SEQ ID NO: 619851 - RNA, 18 nt, Human
gauuagaggugugagcca

SEQ ID NO: 619852 - RNA, 22 nt, Human
gauuagaggugugagccacugc

SEQ ID NO: 619853 - RNA, 22 nt, Human
gauuagaggugugagccacugc

SEQ ID NO: 619854 - RNA, 22 nt, Human
gcaaagaaccaauuaauucuca

SEQ ID NO: 619855 - RNA, 20 nt, Human
gccgagaucgugccacugca

SEQ ID NO: 619856 - RNA, 18 nt, Human
gccugggaaacaaagcga

SEQ ID NO: 619857 - RNA, 24 nt, Human
gcgauucuccagccucagccuccc

SEQ ID NO: 619858 - RNA, 22 nt, Human
gcucacagccucuaauguuacc

SEQ ID NO: 619859 - RNA, 24 nt, Human
gcucuucucacccaggcuggagug

SEQ ID NO: 619860 - RNA, 26 nt, Human
gcuggagugcaauggcgucaucuccg

SEQ ID NO: 619861 - RNA, 22 nt, Human
ggaggcagagguugcagugagc

SEQ ID NO: 619862 - RNA, 18 nt, Human
ggccccaaauguggacag

SEQ ID NO: 619863 - RNA, 23 nt, Human
ggcuggucucaaacuccugaccu

SEQ ID NO: 619864 - RNA, 20 nt, Human
gggauauaccuccuugaggc

SEQ ID NO: 619865 - RNA, 21 nt, Human
gggguuucaccauuuggccag

SEQ ID NO: 619866 - RNA, 22 nt, Human
ggguucaagcgauucuccagcc

SEQ ID NO: 619867 - RNA, 23 nt, Human
ggugauccaccuaccucagccuc

SEQ ID NO: 619868 - RNA, 23 nt, Human
gguggaucacgaggucaggaguu

SEQ ID NO: 619869 - RNA, 24 nt, Human
gguggcaugugccuguaaucccag

SEQ ID NO: 619870 - RNA, 24 nt, Human
gguggcucaugccuguaaucccag

SEQ ID NO: 619871 - RNA, 21 nt, Human
guaacacaagcucacagccuc

SEQ ID NO: 619872 - RNA, 19 nt, Human
guagagaugggguuucacc

SEQ ID NO: 619873 - RNA, 21 nt, Human
guagagaugggguuucaccau

SEQ ID NO: 619874 - RNA, 22 nt, Human
gucucaaaaacaaaacaaaaca

SEQ ID NO: 619875 - RNA, 24 nt, Human
gugauccaccuaccucagccuccc

SEQ ID NO: 619876 - RNA, 23 nt, Human
guggaucacgaggucaggaguuc

SEQ ID NO: 619877 - RNA, 23 nt, Human
guggcucaugccuguaaucccag

SEQ ID NO: 619878 - RNA, 24 nt, Human
guugcagugagccgagaucgugcc

SEQ ID NO: 619879 - RNA, 24 nt, Human
uaaaacauauuuuuuuggccaggc

SEQ ID NO: 619880 - RNA, 21 nt, Human
uaaagaaaggcugucaugaaa

SEQ ID NO: 619881 - RNA, 24 nt, Human
uaaauuuuguauuuuucguagaga

SEQ ID NO: 619882 - RNA, 21 nt, Human
uaauuuauucugguuuccccu

SEQ ID NO: 619883 - RNA, 18 nt, Human
uacccgagcccgggaagc

SEQ ID NO: 619884 - RNA, 23 nt, Human
uacccgagcccgggaagccccca

SEQ ID NO: 619885 - RNA, 24 nt, Human
uaccucagccucccaaagugcugg

SEQ ID NO: 619886 - RNA, 21 nt, Human
uaggccccaaauguggacaga

SEQ ID NO: 619887 - RNA, 24 nt, Human
uauuuuuuuuuugagacggaguuu

SEQ ID NO: 619888 - RNA, 22 nt, Human
ucaccauuuggccaggcugguc

SEQ ID NO: 619889 - RNA, 18 nt, Human
ucacccaggcuggagugc

SEQ ID NO: 619890 - RNA, 20 nt, Human
ucacccaggcuggagugcaa

SEQ ID NO: 619891 - RNA, 18 nt, Human
ucacgaggucaggaguuc

SEQ ID NO: 619892 - RNA, 24 nt, Human
ucacgaggucaggaguucgagaau

SEQ ID NO: 619893 - RNA, 24 nt, Human
ucacugcaaccuucaccuccuggg

SEQ ID NO: 619894 - RNA, 25 nt, Human
ucacugcaaccuucaccuccugggu

SEQ ID NO: 619895 - RNA, 27 nt, Human
ucacugcaaccuucaccuccuggguuc

SEQ ID NO: 619896 - RNA, 18 nt, Human
ucagccucccaaagugcu

SEQ ID NO: 619897 - RNA, 18 nt, Human
ucagccucccaaguagcu

SEQ ID NO: 619898 - RNA, 20 nt, Human
ucagccucccaaguagcugg

SEQ ID NO: 619899 - RNA, 22 nt, Human
ucaugccuguaaucccagcacu

SEQ ID NO: 619900 - RNA, 20 nt, Human
uccagccugggaaacaaagc

SEQ ID NO: 619901 - RNA, 23 nt, Human
ucccaaagugcugggauuagagg

SEQ ID NO: 619902 - RNA, 22 nt, Human
uccgguuacccgagcccgggaa

SEQ ID NO: 619903 - RNA, 21 nt, Human
uccuggguucaagcgauucuc

SEQ ID NO: 619904 - RNA, 24 nt, Human
uccuggguucaagcgauucuccag

SEQ ID NO: 619905 - RNA, 23 nt, Human
ucgcucuucucacccaggcugga

SEQ ID NO: 619906 - RNA, 21 nt, Human
ucguagagaugggguuucacc

SEQ ID NO: 619907 - RNA, 23 nt, Human
ucguagagaugggguuucaccau

SEQ ID NO: 619908 - RNA, 25 nt, Human
ucguagagaugggguuucaccauuu

SEQ ID NO: 619909 - RNA, 23 nt, Human
ucgugccacugcacuccagccug

SEQ ID NO: 619910 - RNA, 19 nt, Human
ugaccuugggugauccacc

SEQ ID NO: 619911 - RNA, 20 nt, Human
ugaccuugggugauccaccu

SEQ ID NO: 619912 - RNA, 22 nt, Human
ugagccgagaucgugccacugc

SEQ ID NO: 619913 - RNA, 18 nt, Human
ugaggugggagaauugcc

SEQ ID NO: 619914 - RNA, 24 nt, Human
ugauccaccuaccucagccuccca

SEQ ID NO: 619915 - RNA, 25 nt, Human
ugcccggcuaaauuuuguauuuuuc

SEQ ID NO: 619916 - RNA, 23 nt, Human
ugccuguaaucccagcacuuugg

SEQ ID NO: 619917 - RNA, 23 nt, Human
ugccuguaaucccagcacuuugg

SEQ ID NO: 619918 - RNA, 24 nt, Human
ugccuguaaucccagcuacucagg

SEQ ID NO: 619919 - RNA, 22 nt, Human
uggaucacgaggucaggaguuc

SEQ ID NO: 619920 - RNA, 21 nt, Human
uggcaugugccuguaauccca

SEQ ID NO: 619921 - RNA, 22 nt, Human
uggcaugugccuguaaucccag

SEQ ID NO: 619922 - RNA, 24 nt, Human
uggcaugugccuguaaucccagcu

SEQ ID NO: 619923 - RNA, 24 nt, Human
uggccaggcgugguggcucaugcc

SEQ ID NO: 619924 - RNA, 24 nt, Human
uggccaggcuggucucaaacuccu

SEQ ID NO: 619925 - RNA, 24 nt, Human
uggcucaugccuguaaucccagca

SEQ ID NO: 619926 - RNA, 23 nt, Human
ugggaggccaagguggguggauc

SEQ ID NO: 619927 - RNA, 24 nt, Human
ugggaggccaagguggguggauca

SEQ ID NO: 619928 - RNA, 22 nt, Human
ugggauuacaagcgccugcuac

SEQ ID NO: 619929 - RNA, 24 nt, Human
ugggauuacaagcgccugcuacca

SEQ ID NO: 619930 - RNA, 25 nt, Human
ugggauuacaagcgccugcuaccau

SEQ ID NO: 619931 - RNA, 19 nt, Human
ugggauuagaggugugagc

SEQ ID NO: 619932 - RNA, 22 nt, Human
ugggauuagaggugugagccac

SEQ ID NO: 619933 - RNA, 22 nt, Human
ugggauuagaggugugagccac

SEQ ID NO: 619934 - RNA, 24 nt, Human
ugggauuagaggugugagccacug

SEQ ID NO: 619935 - RNA, 23 nt, Human
ugggguuucaccauuuggccagg

SEQ ID NO: 619936 - RNA, 24 nt, Human
ugguggcaugugccuguaauccca

SEQ ID NO: 619937 - RNA, 24 nt, Human
ugguggcucaugccuguaauccca

SEQ ID NO: 619938 - RNA, 21 nt, Human
uguuaccaaccuuguacacaa

SEQ ID NO: 619939 - RNA, 24 nt, Human
uuagauaccagcacuccgguuacc

SEQ ID NO: 619940 - RNA, 24 nt, Human
uuagcugagcaugguggcaugugc

SEQ ID NO: 619941 - RNA, 23 nt, Human
uucaagcgauucuccagccucag

SEQ ID NO: 619942 - RNA, 24 nt, Human
uucgcucuucucacccaggcugga

SEQ ID NO: 619943 - RNA, 24 nt, Human
uucguagagaugggguuucaccau

SEQ ID NO: 619944 - RNA, 18 nt, Human
uugcagugagccgagauc

SEQ ID NO: 619945 - RNA, 21 nt, Human
uugcagugagccgagaucgug

SEQ ID NO: 619946 - RNA, 22 nt, Human
uugcagugagccgagaucgugc

SEQ ID NO: 619947 - RNA, 26 nt, Human
uuuaaaacauauuuuuuuggccaggc

SEQ ID NO: 619948 - RNA, 23 nt, Human
uuucaccauuuggccaggcuggu

SEQ ID NO: 619949 - RNA, 24 nt, Human
uuucgcucuucucacccaggcugg

SEQ ID NO: 619950 - RNA, 23 nt, Human
uuucuacuaaaaauacaaaaauu

SEQ ID NO: 619951 - RNA, 18 nt, Human
uuuggccaggcguggugg

SEQ ID NO: 619952 - RNA, 24 nt, Human
uuuggccaggcgugguggcucaug

SEQ ID NO: 619953 - RNA, 24 nt, Human
uuuuucguagagaugggguuucac

SEQ ID NO: 619954 - RNA, 23 nt, Human
uuuuuuuuuugagacggaguuuc

SEQ ID NO: 619955 - RNA, 20 nt, Human
uuuuuuuuuuuuuuuucucu

SEQ ID NO: 619956 - RNA, 20 nt, Human
acaugagucacaauuacacc

SEQ ID NO: 619957 - RNA, 26 nt, Human
accaacaccaccacuccaguguucug

SEQ ID NO: 619958 - RNA, 20 nt, Human
auccaauguuuucaccaaca

SEQ ID NO: 619959 - RNA, 22 nt, Human
auuggagaaacuuuaaugggga

SEQ ID NO: 619960 - RNA, 22 nt, Human
caaaacugaauaugaaagcuga

SEQ ID NO: 619961 - RNA, 20 nt, Human
cccaaucucgaguugccggc

SEQ ID NO: 619962 - RNA, 18 nt, Human
cgaguugccggcuugaaa

SEQ ID NO: 619963 - RNA, 18 nt, Human
gggaaguuuuaaaaacuc

SEQ ID NO: 619964 - RNA, 21 nt, Human
uaaaaaugagcccaaucucga

SEQ ID NO: 619965 - RNA, 18 nt, Human
ucacaauuacaccaggca

SEQ ID NO: 619966 - RNA, 23 nt, Human
uggcaaaacugaauaugaaagcu

SEQ ID NO: 619967 - RNA, 25 nt, Human
uggcaaaacugaauaugaaagcuga

SEQ ID NO: 619968 - RNA, 18 nt, Human
uggugagcagguacuugg

SEQ ID NO: 619969 - RNA, 20 nt, Human
uguuuucaccaacaccacca

SEQ ID NO: 619970 - RNA, 18 nt, Human
uuuggcaaaacugaauau

SEQ ID NO: 619971 - RNA, 23 nt, Human
uuuuuuuuuuuuuugaaauugga

SEQ ID NO: 619972 - RNA, 18 nt, Human
uuuuuuuuuuuuuuuuug

SEQ ID NO: 619973 - RNA, 19 nt, Human
aaaaaaaaaaaaaaaggca

SEQ ID NO: 619974 - RNA, 25 nt, Human
aaaaagaagagaauaaagcacccag

SEQ ID NO: 619975 - RNA, 21 nt, Human
aaauaaagaaaaagaagagaa

SEQ ID NO: 619976 - RNA, 19 nt, Human
aagaagagaauaaagcacc

SEQ ID NO: 619977 - RNA, 20 nt, Human
aagaagagaauaaagcaccc

SEQ ID NO: 619978 - RNA, 19 nt, Human
aagcacccugcacaggaag

SEQ ID NO: 619979 - RNA, 19 nt, Human
acaggaagacuucugcgug

SEQ ID NO: 619980 - RNA, 18 nt, Human
acuccgaggucugcugug

SEQ ID NO: 619981 - RNA, 18 nt, Human
agaaaaagaagagaauaa

SEQ ID NO: 619982 - RNA, 21 nt, Human
agaagaacgccugggaagaaa

SEQ ID NO: 619983 - RNA, 18 nt, Human
aggcaggggaugggggug

SEQ ID NO: 619984 - RNA, 18 nt, Human
aggcaggggaugggggug

SEQ ID NO: 619985 - RNA, 19 nt, Human
aggcaggggaugggggugg

SEQ ID NO: 619986 - RNA, 21 nt, Human
aggcaggggaugggggugggg

SEQ ID NO: 619987 - RNA, 22 nt, Human
aggcaggggauggggguggggg

SEQ ID NO: 619988 - RNA, 23 nt, Human
aggcaggggaugggggugggggc

SEQ ID NO: 619989 - RNA, 24 nt, Human
aggcaggggaugggggugggggcg

SEQ ID NO: 619990 - RNA, 29 nt, Human
aggcaggggaugggggugggggggacccc

SEQ ID NO: 619991 - RNA, 19 nt, Human
agggcaaucuguagcugcc

SEQ ID NO: 619992 - RNA, 18 nt, Human
aucaagaauaaauugcua

SEQ ID NO: 619993 - RNA, 22 nt, Human
augaauauucauaaaaccucau

SEQ ID NO: 619994 - RNA, 20 nt, Human
caauuccacaucaggaagga

SEQ ID NO: 619995 - RNA, 18 nt, Human
cacccugcacaggaagac

SEQ ID NO: 619996 - RNA, 22 nt, Human
cacucuguucuuagcugugcuc

SEQ ID NO: 619997 - RNA, 20 nt, Human
ccaugggccucucucacucu

SEQ ID NO: 619998 - RNA, 23 nt, Human
ccuucaaaaacaugaauauucau

SEQ ID NO: 619999 - RNA, 26 nt, Human
cuauacaaaaaaaaaaaaaaaaaaaa

SEQ ID NO: 620000 - RNA, 21 nt, Human
cuccgaggucugcuguggugu

SEQ ID NO: 620001 - RNA, 21 nt, Human
gauuaccaagaaauggaucug

SEQ ID NO: 620002 - RNA, 25 nt, Human
uaaagcacccagagaagagggaguc

SEQ ID NO: 620003 - RNA, 19 nt, Human
uaagugaauauuugugaaa

SEQ ID NO: 620004 - RNA, 28 nt, Human
uacaaaaaaaaaaaaaaaaaaaaggcag

SEQ ID NO: 620005 - RNA, 22 nt, Human
uaccaagaaauggaucuguuuc

SEQ ID NO: 620006 - RNA, 25 nt, Human
uauacaaaaaaaaaaaaaaaaaaaa

SEQ ID NO: 620007 - RNA, 26 nt, Human
uauacaaaaaaaaaaaaaaaaaaaag

SEQ ID NO: 620008 - RNA, 20 nt, Human
uaugcaaaggucaccgacca

SEQ ID NO: 620009 - RNA, 25 nt, Human
uauucauaaaaccucauuccaauca

SEQ ID NO: 620010 - RNA, 25 nt, Human
uauuucauuuaucuccaaaaacuca

SEQ ID NO: 620011 - RNA, 19 nt, Human
ucaaaaacaugaauauuca

SEQ ID NO: 620012 - RNA, 21 nt, Human
ucaaaguauucucucuuaaaa

SEQ ID NO: 620013 - RNA, 22 nt, Human
ucacucuguucuuagcugugcu

SEQ ID NO: 620014 - RNA, 19 nt, Human
ucagccaugggccucucuc

SEQ ID NO: 620015 - RNA, 22 nt, Human
ucuauacaaaaaaaaaaaaaaa

SEQ ID NO: 620016 - RNA, 25 nt, Human
ucuauacaaaaaaaaaaaaaaaaaa

SEQ ID NO: 620017 - RNA, 26 nt, Human
ucucacucuguucuuagaggucagac

SEQ ID NO: 620018 - RNA, 21 nt, Human
ucugcugugguguuacuugug

SEQ ID NO: 620019 - RNA, 19 nt, Human
ugaauauucauaaaaccuc

SEQ ID NO: 620020 - RNA, 24 nt, Human
ugcaaaggguuggaggaagaccaa

SEQ ID NO: 620021 - RNA, 19 nt, Human
ugggaagaaaagauguugc

SEQ ID NO: 620022 - RNA, 21 nt, Human
ugggagaagguaaaaaccaua

SEQ ID NO: 620023 - RNA, 22 nt, Human
ugggccucucucacucuguucu

SEQ ID NO: 620024 - RNA, 21 nt, Human
ugguaaaaucagccaugggcc

SEQ ID NO: 620025 - RNA, 20 nt, Human
ugguauaaauauacauauga

SEQ ID NO: 620026 - RNA, 23 nt, Human
uguguguccaguuauuucauuua

SEQ ID NO: 620027 - RNA, 24 nt, Human
uuccccaugggagaagguaaaaac

SEQ ID NO: 620028 - RNA, 20 nt, Human
uuuuuuuuuuuuuuuuccac

SEQ ID NO: 620029 - RNA, 22 nt, Human
uuuuuuuuuuuuuuuuccacuu

SEQ ID NO: 620030 - RNA, 27 nt, Human
uuuuuuuuuuuuuuuuuccacuugauu

SEQ ID NO: 620031 - RNA, 21 nt, Human
aaaaaaaaaaagcuuaaagaa

SEQ ID NO: 620032 - RNA, 20 nt, Human
aaaauaaaacaaaaccccca

SEQ ID NO: 620033 - RNA, 22 nt, Human
aaauggaaaaaaaacuaguucc

SEQ ID NO: 620034 - RNA, 18 nt, Human
aacaggacaaaauaaaaa

SEQ ID NO: 620035 - RNA, 22 nt, Human
aacccagagaaaaugaucaagg

SEQ ID NO: 620036 - RNA, 22 nt, Human
aagcauccggaacggcuccgaa

SEQ ID NO: 620037 - RNA, 25 nt, Human
aagcauccggaacggcuccgaaccc

SEQ ID NO: 620038 - RNA, 27 nt, Human
aagccaauauagucuugauaccaaaau

SEQ ID NO: 620039 - RNA, 23 nt, Human
aaggaagagacaugcggggaaga

SEQ ID NO: 620040 - RNA, 22 nt, Human
acaacaggacaaaauaaaaaca

SEQ ID NO: 620041 - RNA, 22 nt, Human
acagagaauaaauucucucuca

SEQ ID NO: 620042 - RNA, 28 nt, Human
acuccacucccaaacccagagaaaauga

SEQ ID NO: 620043 - RNA, 21 nt, Human
agaaacugaaacaaugucuuu

SEQ ID NO: 620044 - RNA, 20 nt, Human
agaggaaggcauuaacagau

SEQ ID NO: 620045 - RNA, 23 nt, Human
agauguaaucaagaaaacauugu

SEQ ID NO: 620046 - RNA, 19 nt, Human
agauuccaauaaacuacag

SEQ ID NO: 620047 - RNA, 22 nt, Human
aggaagagacaugcggggaaga

SEQ ID NO: 620048 - RNA, 25 nt, Human
aggcauuaacagauuccaauaaacu

SEQ ID NO: 620049 - RNA, 20 nt, Human
auaaaauaaaacaaaacccc

SEQ ID NO: 620050 - RNA, 24 nt, Human
auaaaauuaaaaugagaaacuaac

SEQ ID NO: 620051 - RNA, 21 nt, Human
augacauuaaaaaaaaaaagc

SEQ ID NO: 620052 - RNA, 19 nt, Human
augagaaacuaacaugaua

SEQ ID NO: 620053 - RNA, 18 nt, Human
cagcacaauuuuaagggc

SEQ ID NO: 620054 - RNA, 22 nt, Human
cauuguaccuaaauuuccucua

SEQ ID NO: 620055 - RNA, 26 nt, Human
ccaauauuauuuauuugcugcagccc

SEQ ID NO: 620056 - RNA, 22 nt, Human
cccaaacccagagaaaaugauc

SEQ ID NO: 620057 - RNA, 23 nt, Human
cgagcagcuccugaaaaagccag

SEQ ID NO: 620058 - RNA, 18 nt, Human
cucaucauuccauuaaac

SEQ ID NO: 620059 - RNA, 19 nt, Human
cucaugugcagggagcagu

SEQ ID NO: 620060 - RNA, 22 nt, Human
cugcagacaaaauuguauacga

SEQ ID NO: 620061 - RNA, 21 nt, Human
cuucagauguaaucaagaaaa

SEQ ID NO: 620062 - RNA, 26 nt, Human
gagcacaacaggacaaaauaaaaaca

SEQ ID NO: 620063 - RNA, 22 nt, Human
gagcagcuccugaaaaagccag

SEQ ID NO: 620064 - RNA, 21 nt, Human
gagccuguuuucuuugccaga

SEQ ID NO: 620065 - RNA, 24 nt, Human
gauaaaauaaaacaaaacccccaa

SEQ ID NO: 620066 - RNA, 18 nt, Human
gauaauucaucugaucua

SEQ ID NO: 620067 - RNA, 28 nt, Human
guaauauagugugagucugagggccccc

SEQ ID NO: 620068 - RNA, 26 nt, Human
gucaaauccaugccaucuuaaacccu

SEQ ID NO: 620069 - RNA, 22 nt, Human
uaaaacaaaacccccaauaggu

SEQ ID NO: 620070 - RNA, 22 nt, Human
uaaaacuguacauuuaucccua

SEQ ID NO: 620071 - RNA, 25 nt, Human
uaaaagagaagagacuucagaugua

SEQ ID NO: 620072 - RNA, 21 nt, Human
uacacaguguuaaaaauauuc

SEQ ID NO: 620073 - RNA, 19 nt, Human
uacaguaacacguaaugaa

SEQ ID NO: 620074 - RNA, 18 nt, Human
uaccagguauuacaucau

SEQ ID NO: 620075 - RNA, 21 nt, Human
uaccagguauuacaucauucu

SEQ ID NO: 620076 - RNA, 18 nt, Human
uagguucaaggccuuuug

SEQ ID NO: 620077 - RNA, 23 nt, Human
uagugugagucugugguauuugg

SEQ ID NO: 620078 - RNA, 22 nt, Human
uauaccaaaaaaaaaaaaaaau

SEQ ID NO: 620079 - RNA, 21 nt, Human
ucaaagucuacaaaguaugcc

SEQ ID NO: 620080 - RNA, 21 nt, Human
ucacauaauacuccacuccca

SEQ ID NO: 620081 - RNA, 23 nt, Human
ucacauaauacuccacucccaaa

SEQ ID NO: 620082 - RNA, 25 nt, Human
ucaguauaccaaaaaaaaaaaaaaa

SEQ ID NO: 620083 - RNA, 26 nt, Human
ucaguauaccaaaaaaaaaaaaaaau

SEQ ID NO: 620084 - RNA, 19 nt, Human
uccauaagccaugaauucc

SEQ ID NO: 620085 - RNA, 22 nt, Human
ucccaaacccagagaaaaugau

SEQ ID NO: 620086 - RNA, 21 nt, Human
uccgaacccggaaaaaaaaag

SEQ ID NO: 620087 - RNA, 23 nt, Human
ucucagaaacugaaacaaugucu

SEQ ID NO: 620088 - RNA, 21 nt, Human
ucuuucugaguccuucaaaag

SEQ ID NO: 620089 - RNA, 20 nt, Human
ugaaguuuuuagaaaaagau

SEQ ID NO: 620090 - RNA, 19 nt, Human
ugauuuccauaagccauga

SEQ ID NO: 620091 - RNA, 21 nt, Human
ugcauagauuuuuuuccugau

SEQ ID NO: 620092 - RNA, 24 nt, Human
uggaaaaaaaacuaguuccaaaga

SEQ ID NO: 620093 - RNA, 26 nt, Human
uggaaaaaaaacuaguuccaaagacu

SEQ ID NO: 620094 - RNA, 20 nt, Human
uggcugcgagcgagcagcuu

SEQ ID NO: 620095 - RNA, 30 nt, Human
ugguaaacagagaauaaauucucucucagg

SEQ ID NO: 620096 - RNA, 26 nt, Human
uguaaucaagaaaacauuguguaacu

SEQ ID NO: 620097 - RNA, 24 nt, Human
uuaagggucugaagucuaucuucu

SEQ ID NO: 620098 - RNA, 18 nt, Human
uuaauagagagaugagag

SEQ ID NO: 620099 - RNA, 18 nt, Human
uucacuuuaugcaggcuc

SEQ ID NO: 620100 - RNA, 19 nt, Human
uuguggagucccagucaca

SEQ ID NO: 620101 - RNA, 25 nt, Human
uuuacuuaaaauuacaaacauguuu

SEQ ID NO: 620102 - RNA, 20 nt, Human
uuugggagccuguuuucuuu

SEQ ID NO: 620103 - RNA, 18 nt, Human
uuuuacacucaugugcag

SEQ ID NO: 620104 - RNA, 21 nt, Human
uuuuuuuuuuuuuuugccuaa

SEQ ID NO: 620105 - RNA, 24 nt, Human
aaacauacauacaaacuaguaccu

SEQ ID NO: 620106 - RNA, 19 nt, Human
aaacauggcuauagugcuu

SEQ ID NO: 620107 - RNA, 23 nt, Human
aaauagcaaaggcauacagagag

SEQ ID NO: 620108 - RNA, 23 nt, Human
aacaagugagaaaaauguugcaa

SEQ ID NO: 620109 - RNA, 20 nt, Human
aacuuauccuucaaacuuua

SEQ ID NO: 620110 - RNA, 21 nt, Human
aagcaaauuaaauauuuccau

SEQ ID NO: 620111 - RNA, 23 nt, Human
aauagcaaaggcauacagagaga

SEQ ID NO: 620112 - RNA, 19 nt, Human
acaaaagccaccugaagug

SEQ ID NO: 620113 - RNA, 23 nt, Human
accucggguucccuccacaaaag

SEQ ID NO: 620114 - RNA, 27 nt, Human
agaaaaauguugcaaaugcaaaaaaaa

SEQ ID NO: 620115 - RNA, 20 nt, Human
agagagcuuuuuaaucuuga

SEQ ID NO: 620116 - RNA, 22 nt, Human
aggcauuauugcucugcagaac

SEQ ID NO: 620117 - RNA, 21 nt, Human
auacagagagacugaaaacuc

SEQ ID NO: 620118 - RNA, 22 nt, Human
caaaggcauacagagagacuga

SEQ ID NO: 620119 - RNA, 23 nt, Human
cacccauuguugauaugaccucg

SEQ ID NO: 620120 - RNA, 22 nt, Human
cagugcaccuccuuucuugacu

SEQ ID NO: 620121 - RNA, 22 nt, Human
cauacagagagacugaaaacuc

SEQ ID NO: 620122 - RNA, 24 nt, Human
ccucggguucccuccacaaaagcc

SEQ ID NO: 620123 - RNA, 23 nt, Human
gaaaugaacaagugagaaaaaug

SEQ ID NO: 620124 - RNA, 24 nt, Human
guagaauucgcuuuauauuuaaaa

SEQ ID NO: 620125 - RNA, 27 nt, Human
uaacuuauccuucaaacuuuauacaua

SEQ ID NO: 620126 - RNA, 18 nt, Human
uaauucagcacuuccuau

SEQ ID NO: 620127 - RNA, 19 nt, Human
uaguauaguagcuacuggu

SEQ ID NO: 620128 - RNA, 21 nt, Human
uauaguagcuacugguuaugu

SEQ ID NO: 620129 - RNA, 23 nt, Human
uaugugcauggguuacauaugca

SEQ ID NO: 620130 - RNA, 20 nt, Human
ucaaccagauuaguauagua

SEQ ID NO: 620131 - RNA, 21 nt, Human
ucacauuguaauucagcacuu

SEQ ID NO: 620132 - RNA, 26 nt, Human
uccauuaagagagcuuuccucguggg

SEQ ID NO: 620133 - RNA, 22 nt, Human
ucucauggucaauacauacuuu

SEQ ID NO: 620134 - RNA, 18 nt, Human
ugcaaaugcaaaaaaaaa

SEQ ID NO: 620135 - RNA, 20 nt, Human
uggaaaacauggcuauagug

SEQ ID NO: 620136 - RNA, 23 nt, Human
uguaugcacccauuguugauaug

SEQ ID NO: 620137 - RNA, 24 nt, Human
ugucucauuuguaaacagaaguug

SEQ ID NO: 620138 - RNA, 20 nt, Human
uguugcaaaugcaaaaaaaa

SEQ ID NO: 620139 - RNA, 18 nt, Human
uuaaauauuuccauuaag

SEQ ID NO: 620140 - RNA, 26 nt, Human
uuguaaacagaagucauuaacuucac

SEQ ID NO: 620141 - RNA, 20 nt, Human
uuuguaaacagaagucauua

SEQ ID NO: 620142 - RNA, 21 nt, Human
uuuuuuuuuuuuuugucagga

SEQ ID NO: 620143 - RNA, 22 nt, Human
uuuuuuuuuuuuuuuugucagg

SEQ ID NO: 620144 - RNA, 18 nt, Human
uuuuuuuuuuuuuuuuug

SEQ ID NO: 620145 - RNA, 19 nt, Human
uuuuuuuuuuuuuuuuugu

SEQ ID NO: 620146 - RNA, 20 nt, Human
aaagugcugggauuacaggc

SEQ ID NO: 620147 - RNA, 24 nt, Human
aaagugcugggauuacaggcguga

SEQ ID NO: 620148 - RNA, 20 nt, Human
aagcauaauacauaaugcac

SEQ ID NO: 620149 - RNA, 19 nt, Human
aagugcugggauuacaggc

SEQ ID NO: 620150 - RNA, 19 nt, Human
aagugcugggauuacaggc

SEQ ID NO: 620151 - RNA, 26 nt, Human
aagugcugggauuacaggcgugagcc

SEQ ID NO: 620152 - RNA, 19 nt, Human
aauguaguggcgugaucuu

SEQ ID NO: 620153 - RNA, 20 nt, Human
aauguaguggcgugaucuug

SEQ ID NO: 620154 - RNA, 24 nt, Human
acaauuuagacgauacaguugucu

SEQ ID NO: 620155 - RNA, 18 nt, Human
acaggguuucaccguguu

SEQ ID NO: 620156 - RNA, 19 nt, Human
acaggguuucaccguguua

SEQ ID NO: 620157 - RNA, 20 nt, Human
acaggguuucaccguguuag

SEQ ID NO: 620158 - RNA, 24 nt, Human
acaggguuucaccguguuagccag

SEQ ID NO: 620159 - RNA, 18 nt, Human
agacagagucuugcugug

SEQ ID NO: 620160 - RNA, 18 nt, Human
agacaggguuucaccgug

SEQ ID NO: 620161 - RNA, 22 nt, Human
agagucuugcuguguugcccag

SEQ ID NO: 620162 - RNA, 19 nt, Human
aggcuccucccaaacaagg

SEQ ID NO: 620163 - RNA, 19 nt, Human
aguagcugggacuucaggc

SEQ ID NO: 620164 - RNA, 23 nt, Human
aguagcugggacuucaggcgugu

SEQ ID NO: 620165 - RNA, 24 nt, Human
agugauucucuugccucagccucc

SEQ ID NO: 620166 - RNA, 18 nt, Human
agugcugggauuacaggc

SEQ ID NO: 620167 - RNA, 22 nt, Human
auuuuuuguauuuuugguggag

SEQ ID NO: 620168 - RNA, 21 nt, Human
caagaauacugugacuccaau

SEQ ID NO: 620169 - RNA, 20 nt, Human
caagaauacugugacuccag

SEQ ID NO: 620170 - RNA, 22 nt, Human
caagugauucucuugccucagc

SEQ ID NO: 620171 - RNA, 18 nt, Human
caccguguuagccaggau

SEQ ID NO: 620172 - RNA, 24 nt, Human
caccguguuagccaggauggucuc

SEQ ID NO: 620173 - RNA, 22 nt, Human
cacucccugcuccagggccacu

SEQ ID NO: 620174 - RNA, 21 nt, Human
cacugcaaccucugccuccug

SEQ ID NO: 620175 - RNA, 23 nt, Human
cacugcaaccucugccuccuggg

SEQ ID NO: 620176 - RNA, 18 nt, Human
cagagucuugcuguguug

SEQ ID NO: 620177 - RNA, 20 nt, Human
cagccuccugaguagcuggg

SEQ ID NO: 620178 - RNA, 18 nt, Human
cagccucggccuccuaaa

SEQ ID NO: 620179 - RNA, 21 nt, Human
caggcgugugccaccacgccc

SEQ ID NO: 620180 - RNA, 24 nt, Human
caggcuccucccaaacaaggaaga

SEQ ID NO: 620181 - RNA, 24 nt, Human
caggguuucaccguguuagccagg

SEQ ID NO: 620182 - RNA, 20 nt, Human
ccaccacgcccggcagauuu

SEQ ID NO: 620183 - RNA, 23 nt, Human
ccacguggugacccacuuuucuu

SEQ ID NO: 620184 - RNA, 24 nt, Human
ccacugcaaccucugccuccuggg

SEQ ID NO: 620185 - RNA, 25 nt, Human
ccacugcaaccucugccuccugggu

SEQ ID NO: 620186 - RNA, 27 nt, Human
ccacugcaaccucugccuccuggguuc

SEQ ID NO: 620187 - RNA, 24 nt, Human
cccacugcaaccucugccuccugg

SEQ ID NO: 620188 - RNA, 23 nt, Human
ccuaaagugcugggauuacaggc

SEQ ID NO: 620189 - RNA, 21 nt, Human
ccuccuggguucaagugauuc

SEQ ID NO: 620190 - RNA, 22 nt, Human
ccucugccuccuggguucaagu

SEQ ID NO: 620191 - RNA, 21 nt, Human
ccucuggagaauugcugauuu

SEQ ID NO: 620192 - RNA, 21 nt, Human
ccugcuccagggccacucgug

SEQ ID NO: 620193 - RNA, 21 nt, Human
ccuggguucaagugauucucu

SEQ ID NO: 620194 - RNA, 25 nt, Human
cgcccggcagauuuuuuguauuuuu

SEQ ID NO: 620195 - RNA, 22 nt, Human
cuaaagugcugggauuacaggc

SEQ ID NO: 620196 - RNA, 24 nt, Human
cuaaagugcugggauuacaggcgu

SEQ ID NO: 620197 - RNA, 24 nt, Human
cucagccuccugaguagcugggac

SEQ ID NO: 620198 - RNA, 24 nt, Human
cuccugaccuugugaucugccagc

SEQ ID NO: 620199 - RNA, 21 nt, Human
cuccuggguucaagugauucu

SEQ ID NO: 620200 - RNA, 21 nt, Human
cugcaaccucugccuccuggg

SEQ ID NO: 620201 - RNA, 23 nt, Human
cugcaaccucugccuccuggguu

SEQ ID NO: 620202 - RNA, 24 nt, Human
cugcaaccucugccuccuggguuc

SEQ ID NO: 620203 - RNA, 23 nt, Human
cugccuccuggguucaagugauu

SEQ ID NO: 620204 - RNA, 23 nt, Human
cuugccucagccuccugaguagc

SEQ ID NO: 620205 - RNA, 20 nt, Human
cuugcuguguugcccagcug

SEQ ID NO: 620206 - RNA, 18 nt, Human
gacacauggucugauucu

SEQ ID NO: 620207 - RNA, 22 nt, Human
gaccuugugaucugccagccuc

SEQ ID NO: 620208 - RNA, 24 nt, Human
gaccuugugaucugccagccucgg

SEQ ID NO: 620209 - RNA, 18 nt, Human
gagacaggguuucaccgu

SEQ ID NO: 620210 - RNA, 23 nt, Human
gaucugcuccaccacucccugcu

SEQ ID NO: 620211 - RNA, 22 nt, Human
gaugcugaaaaauaaaaaggga

SEQ ID NO: 620212 - RNA, 18 nt, Human
gauuacaggcgugagcca

SEQ ID NO: 620213 - RNA, 22 nt, Human
gauuacaggcgugagccacugc

SEQ ID NO: 620214 - RNA, 23 nt, Human
gauuacaggcgugagccacugca

SEQ ID NO: 620215 - RNA, 24 nt, Human
gauuuuuuguauuuuugguggaga

SEQ ID NO: 620216 - RNA, 22 nt, Human
gcaaccucugccuccuggguuc

SEQ ID NO: 620217 - RNA, 19 nt, Human
gccaugggacacauggucu

SEQ ID NO: 620218 - RNA, 18 nt, Human
ggacacauggucugauuc

SEQ ID NO: 620219 - RNA, 24 nt, Human
ggauggucucgaucuccugaccuu

SEQ ID NO: 620220 - RNA, 20 nt, Human
ggucucgaucuccugaccuu

SEQ ID NO: 620221 - RNA, 23 nt, Human
gugaucugccagccucggccucc

SEQ ID NO: 620222 - RNA, 24 nt, Human
gugauucucuugccucagccuccu

SEQ ID NO: 620223 - RNA, 19 nt, Human
guggagacaggguuucacc

SEQ ID NO: 620224 - RNA, 19 nt, Human
guggagacaggguuucacc

SEQ ID NO: 620225 - RNA, 19 nt, Human
uaaaacagguaaccggagc

SEQ ID NO: 620226 - RNA, 24 nt, Human
uaaagugcugggauuacaggcgug

SEQ ID NO: 620227 - RNA, 26 nt, Human
uaaggguacuuguuccuacaaaacca

SEQ ID NO: 620228 - RNA, 22 nt, Human
uacaggcgugagccacugcacc

SEQ ID NO: 620229 - RNA, 23 nt, Human
uacaggcgugagccacugcaccu

SEQ ID NO: 620230 - RNA, 22 nt, Human
uacaguugucuagauacaacuu

SEQ ID NO: 620231 - RNA, 22 nt, Human
uaccuaccaauaaacuuuuagu

SEQ ID NO: 620232 - RNA, 23 nt, Human
uagaaaauguaugugaacaccac

SEQ ID NO: 620233 - RNA, 24 nt, Human
uauaugaacuaucuuuaccaagac

SEQ ID NO: 620234 - RNA, 21 nt, Human
uauggcauacugcaccuuuaa

SEQ ID NO: 620235 - RNA, 20 nt, Human
uauugcaaggguuugccuuu

SEQ ID NO: 620236 - RNA, 19 nt, Human
ucaagugauucucuugccu

SEQ ID NO: 620237 - RNA, 24 nt, Human
ucaccguguuagccaggauggucu

SEQ ID NO: 620238 - RNA, 23 nt, Human
ucagccuccugaguagcugggac

SEQ ID NO: 620239 - RNA, 19 nt, Human
ucaggcuccucccaaacaa

SEQ ID NO: 620240 - RNA, 20 nt, Human
uccaccucaggcuccuccca

SEQ ID NO: 620241 - RNA, 27 nt, Human
uccauguuuaaaacagguaaccggagc

SEQ ID NO: 620242 - RNA, 21 nt, Human
ucccaaacaaggaagaucugc

SEQ ID NO: 620243 - RNA, 24 nt, Human
uccuaaagugcugggauuacaggc

SEQ ID NO: 620244 - RNA, 24 nt, Human
uccugaguagcugggacuucaggc

SEQ ID NO: 620245 - RNA, 21 nt, Human
uccuggguucaagugauucuc

SEQ ID NO: 620246 - RNA, 24 nt, Human
uccuggguucaagugauucucuug

SEQ ID NO: 620247 - RNA, 18 nt, Human
ucggccuccuaaagugcu

SEQ ID NO: 620248 - RNA, 19 nt, Human
ucgugagggcuaucuggga

SEQ ID NO: 620249 - RNA, 23 nt, Human
ucuugcuguguugcccagcugga

SEQ ID NO: 620250 - RNA, 22 nt, Human
ugacuuaugugagauaguccuc

SEQ ID NO: 620251 - RNA, 22 nt, Human
ugagacagagucuugcuguguu

SEQ ID NO: 620252 - RNA, 23 nt, Human
ugagacagagucuugcuguguug

SEQ ID NO: 620253 - RNA, 20 nt, Human
ugcccagcuggaauguagug

SEQ ID NO: 620254 - RNA, 22 nt, Human
ugccucagccuccugaguagcu

SEQ ID NO: 620255 - RNA, 24 nt, Human
ugccucagccuccugaguagcugg

SEQ ID NO: 620256 - RNA, 22 nt, Human
ugccuccuggguucaagugauu

SEQ ID NO: 620257 - RNA, 24 nt, Human
ugcugggauuacaggcgugagcca

SEQ ID NO: 620258 - RNA, 21 nt, Human
uggauucacauugccauggga

SEQ ID NO: 620259 - RNA, 18 nt, Human
ugggauuacaggcgugag

SEQ ID NO: 620260 - RNA, 19 nt, Human
ugggauuacaggcgugagc

SEQ ID NO: 620261 - RNA, 21 nt, Human
ugggauuacaggcgugagcca

SEQ ID NO: 620262 - RNA, 22 nt, Human
ugggauuacaggcgugagccac

SEQ ID NO: 620263 - RNA, 22 nt, Human
ugggauuacaggcgugagccac

SEQ ID NO: 620264 - RNA, 24 nt, Human
ugggauuacaggcgugagccacug

SEQ ID NO: 620265 - RNA, 24 nt, Human
ugggauuacaggcgugagccacug

SEQ ID NO: 620266 - RNA, 20 nt, Human
uggguucaagugauucucuu

SEQ ID NO: 620267 - RNA, 23 nt, Human
uggguucaagugauucucuugcc

SEQ ID NO: 620268 - RNA, 24 nt, Human
uggguucaagugauucucuugccu

SEQ ID NO: 620269 - RNA, 24 nt, Human
ugguggagacaggguuucaccgug

SEQ ID NO: 620270 - RNA, 25 nt, Human
uguaugugaacaccacguggugacc

SEQ ID NO: 620271 - RNA, 20 nt, Human
uguccugugagcucauaaga

SEQ ID NO: 620272 - RNA, 18 nt, Human
uguugcccagcuggaaug

SEQ ID NO: 620273 - RNA, 18 nt, Human
uucaagaaucauucacag

SEQ ID NO: 620274 - RNA, 23 nt, Human
uucaagugauucucuugccucag

SEQ ID NO: 620275 - RNA, 25 nt, Human
uucuauagucauuauguaauugacu

SEQ ID NO: 620276 - RNA, 22 nt, Human
uugagacagagucuugcugugu

SEQ ID NO: 620277 - RNA, 24 nt, Human
uugguggagacaggguuucaccgu

SEQ ID NO: 620278 - RNA, 19 nt, Human
uuucaccguguuagccagg

SEQ ID NO: 620279 - RNA, 22 nt, Human
uuuuugguggagacaggguuuc

SEQ ID NO: 620280 - RNA, 24 nt, Human
uuuuugguggagacaggguuucac

SEQ ID NO: 620281 - RNA, 21 nt, Human
uuuuuguauuuuugguggaga

SEQ ID NO: 620282 - RNA, 24 nt, Human
uuuuuuguauuuuugguggagaca

SEQ ID NO: 620283 - RNA, 20 nt, Human
uuuuuuuuuuugagacagag

SEQ ID NO: 620284 - RNA, 24 nt, Human
uuuuuuuuuuuugagacagagucu

SEQ ID NO: 620285 - RNA, 18 nt, Human
uuuuuuuuuuuuuuuuug

SEQ ID NO: 620286 - RNA, 24 nt, Human
aaagugcugggaccacaggcguga

SEQ ID NO: 620287 - RNA, 24 nt, Human
aaagugcugggauuacaggcauga

SEQ ID NO: 620288 - RNA, 26 nt, Human
aagugcugggaccacaggcgugagcc

SEQ ID NO: 620289 - RNA, 19 nt, Human
aagugcugggauuacaggc

SEQ ID NO: 620290 - RNA, 21 nt, Human
aagugcugggauuacaggcau

SEQ ID NO: 620291 - RNA, 26 nt, Human
aagugcugggauuacaggcaugaacc

SEQ ID NO: 620292 - RNA, 24 nt, Human
aauuuuguauuuuuagcagagacg

SEQ ID NO: 620293 - RNA, 24 nt, Human
accauauuagccaggcuggucuug

SEQ ID NO: 620294 - RNA, 18 nt, Human
acgggguuucaccauauu

SEQ ID NO: 620295 - RNA, 20 nt, Human
acgggguuucaccauauuag

SEQ ID NO: 620296 - RNA, 20 nt, Human
acgggguuucuccauguugg

SEQ ID NO: 620297 - RNA, 21 nt, Human
acgggguuucuccauguuggu

SEQ ID NO: 620298 - RNA, 24 nt, Human
acgggguuucuccauguuggucag

SEQ ID NO: 620299 - RNA, 19 nt, Human
aggcaugaaccaccacgcc

SEQ ID NO: 620300 - RNA, 20 nt, Human
aguagcugggauuacaggca

SEQ ID NO: 620301 - RNA, 19 nt, Human
agugaucuauccaccucgg

SEQ ID NO: 620302 - RNA, 24 nt, Human
agugcaauggcucgaucucggcuc

SEQ ID NO: 620303 - RNA, 23 nt, Human
auauuagccaggcuggucuugaa

SEQ ID NO: 620304 - RNA, 24 nt, Human
caaagugcugggaccacaggcgug

SEQ ID NO: 620305 - RNA, 24 nt, Human
caaagugcugggauuacaggcaug

SEQ ID NO: 620306 - RNA, 19 nt, Human
caagugaucuauccaccuc

SEQ ID NO: 620307 - RNA, 24 nt, Human
cacaggcgugagccaccacgccca

SEQ ID NO: 620308 - RNA, 21 nt, Human
caccauauuagccaggcuggu

SEQ ID NO: 620309 - RNA, 23 nt, Human
caccauauuagccaggcuggucu

SEQ ID NO: 620310 - RNA, 27 nt, Human
caccauauuagccaggcuggucuugaa

SEQ ID NO: 620311 - RNA, 21 nt, Human
caccgcgaccuccaccucccg

SEQ ID NO: 620312 - RNA, 23 nt, Human
caccgcgaccuccaccucccggg

SEQ ID NO: 620313 - RNA, 24 nt, Human
caccucggccucccaaagugcugg

SEQ ID NO: 620314 - RNA, 22 nt, Human
caggcaaugcgccaccacgccc

SEQ ID NO: 620315 - RNA, 22 nt, Human
caggugauuggccugccucagc

SEQ ID NO: 620316 - RNA, 23 nt, Human
cauauuagccaggcuggucuuga

SEQ ID NO: 620317 - RNA, 24 nt, Human
cauauuagccaggcuggucuugaa

SEQ ID NO: 620318 - RNA, 22 nt, Human
ccaaagugcugggaccacaggc

SEQ ID NO: 620319 - RNA, 24 nt, Human
ccaaagugcugggaccacaggcgu

SEQ ID NO: 620320 - RNA, 23 nt, Human
ccaaagugcugggauuacaggca

SEQ ID NO: 620321 - RNA, 24 nt, Human
ccaaagugcugggauuacaggcau

SEQ ID NO: 620322 - RNA, 20 nt, Human
ccaccacgcccagcuaauuu

SEQ ID NO: 620323 - RNA, 27 nt, Human
ccaccucccggguucaagcaauucuuu

SEQ ID NO: 620324 - RNA, 19 nt, Human
ccauguuggucaggcuggu

SEQ ID NO: 620325 - RNA, 22 nt, Human
ccauguuggucaggcuggucuc

SEQ ID NO: 620326 - RNA, 23 nt, Human
ccauguuggucaggcuggucucg

SEQ ID NO: 620327 - RNA, 24 nt, Human
cccaaagugcugggauuacaggca

SEQ ID NO: 620328 - RNA, 23 nt, Human
cccgaccucaggugauuggccug

SEQ ID NO: 620329 - RNA, 23 nt, Human
cccggguucaagcaauucuccug

SEQ ID NO: 620330 - RNA, 23 nt, Human
cccuaguagcugggauuacaggc

SEQ ID NO: 620331 - RNA, 18 nt, Human
ccgcgaccuccaccuccc

SEQ ID NO: 620332 - RNA, 24 nt, Human
ccgcgaccuccaccucccggguuc

SEQ ID NO: 620333 - RNA, 23 nt, Human
ccuaguagcugggauuacaggca

SEQ ID NO: 620334 - RNA, 24 nt, Human
ccucccggguucaagcaauucucc

SEQ ID NO: 620335 - RNA, 24 nt, Human
ccugaccucaagugaucuauccac

SEQ ID NO: 620336 - RNA, 24 nt, Human
ccugcuguccaggcuggagugcaa

SEQ ID NO: 620337 - RNA, 24 nt, Human
cgggguuucuccauguuggucagg

SEQ ID NO: 620338 - RNA, 22 nt, Human
cuaguagcugggauuacaggca

SEQ ID NO: 620339 - RNA, 24 nt, Human
cucaagugaucuauccaccucggc

SEQ ID NO: 620340 - RNA, 24 nt, Human
cucaccgcgaccuccaccucccgg

SEQ ID NO: 620341 - RNA, 23 nt, Human
cucaggugauuggccugccucag

SEQ ID NO: 620342 - RNA, 23 nt, Human
cugccucagccucccaaagugcu

SEQ ID NO: 620343 - RNA, 24 nt, Human
cugccucagccucccaaagugcug

SEQ ID NO: 620344 - RNA, 24 nt, Human
gaccucaagugaucuauccaccuc

SEQ ID NO: 620345 - RNA, 23 nt, Human
gaccucaggugauuggccugccu

SEQ ID NO: 620346 - RNA, 24 nt, Human
gaccucaggugauuggccugccuc

SEQ ID NO: 620347 - RNA, 18 nt, Human
gagacgggguuucaccau

SEQ ID NO: 620348 - RNA, 23 nt, Human
gagacgggguuucuccauguugg

SEQ ID NO: 620349 - RNA, 24 nt, Human
gagacgggguuucuccauguuggu

SEQ ID NO: 620350 - RNA, 19 nt, Human
gauuacaggcaaugcgcca

SEQ ID NO: 620351 - RNA, 21 nt, Human
gauuacaggcaugaaccacca

SEQ ID NO: 620352 - RNA, 23 nt, Human
gcuccugcuguccaggcuggagu

SEQ ID NO: 620353 - RNA, 25 nt, Human
gcuggagugcaauggcucgaucucg

SEQ ID NO: 620354 - RNA, 23 nt, Human
gcuggucucgaacucccgaccuc

SEQ ID NO: 620355 - RNA, 23 nt, Human
gcuggucuugaacuccugaccuc

SEQ ID NO: 620356 - RNA, 19 nt, Human
ggaccacaggcgugagcca

SEQ ID NO: 620357 - RNA, 19 nt, Human
ggauuacaggcaugaacca

SEQ ID NO: 620358 - RNA, 24 nt, Human
ggcuggucuugaacuccugaccuc

SEQ ID NO: 620359 - RNA, 23 nt, Human
gggguuucaccauauuagccagg

SEQ ID NO: 620360 - RNA, 23 nt, Human
gggguuucuccauguuggucagg

SEQ ID NO: 620361 - RNA, 22 nt, Human
ggguuucaccauauuagccagg

SEQ ID NO: 620362 - RNA, 19 nt, Human
ggucuugaacuccugaccu

SEQ ID NO: 620363 - RNA, 24 nt, Human
ggugauuggccugccucagccucc

SEQ ID NO: 620364 - RNA, 18 nt, Human
guagcugggauuacaggc

SEQ ID NO: 620365 - RNA, 19 nt, Human
guccaggcuggagugcaau

SEQ ID NO: 620366 - RNA, 24 nt, Human
gugauuggccugccucagccuccc

SEQ ID NO: 620367 - RNA, 24 nt, Human
guuucgcuccugcuguccaggcug

SEQ ID NO: 620368 - RNA, 22 nt, Human
uacaggcaugaaccaccacgcc

SEQ ID NO: 620369 - RNA, 24 nt, Human
uagcagagacgggguuucuccaug

SEQ ID NO: 620370 - RNA, 24 nt, Human
uagccaggcuggucuugaacuccu

SEQ ID NO: 620371 - RNA, 23 nt, Human
uaguagagacgggguuucaccau

SEQ ID NO: 620372 - RNA, 26 nt, Human
uaguagagacgggguuucaccauauu

SEQ ID NO: 620373 - RNA, 25 nt, Human
uaguagcugggauuacaggcaaugc

SEQ ID NO: 620374 - RNA, 22 nt, Human
uauccaccucggccucccaaag

SEQ ID NO: 620375 - RNA, 23 nt, Human
uauuuauuuuugagacggaguuu

SEQ ID NO: 620376 - RNA, 24 nt, Human
ucaccgcgaccuccaccucccggg

SEQ ID NO: 620377 - RNA, 18 nt, Human
ucccaaagugcugggacc

SEQ ID NO: 620378 - RNA, 24 nt, Human
ucccaaagugcugggaccacaggc

SEQ ID NO: 620379 - RNA, 24 nt, Human
ucccaaagugcugggauuacaggc

SEQ ID NO: 620380 - RNA, 21 nt, Human
ucccggguucaagcaauucuc

SEQ ID NO: 620381 - RNA, 24 nt, Human
ucccggguucaagcaauucuccug

SEQ ID NO: 620382 - RNA, 24 nt, Human
ucccuaguagcugggauuacaggc

SEQ ID NO: 620383 - RNA, 18 nt, Human
uccugcuguccaggcugg

SEQ ID NO: 620384 - RNA, 22 nt, Human
ucgcuccugcuguccaggcugg

SEQ ID NO: 620385 - RNA, 23 nt, Human
ucgcuccugcuguccaggcugga

SEQ ID NO: 620386 - RNA, 18 nt, Human
ucggccucccaaagugcu

SEQ ID NO: 620387 - RNA, 21 nt, Human
ucuugaacuccugaccucaag

SEQ ID NO: 620388 - RNA, 19 nt, Human
ugaccucaagugaucuauc

SEQ ID NO: 620389 - RNA, 24 nt, Human
ugaucuauccaccucggccuccca

SEQ ID NO: 620390 - RNA, 24 nt, Human
ugccgcagccucccuaguagcugg

SEQ ID NO: 620391 - RNA, 24 nt, Human
ugccucagccucccaaagugcugg

SEQ ID NO: 620392 - RNA, 24 nt, Human
ugcugggaccacaggcgugagcca

SEQ ID NO: 620393 - RNA, 23 nt, Human
ugcugggauuacaggcaugaacc

SEQ ID NO: 620394 - RNA, 19 nt, Human
ugcuguccaggcuggagug

SEQ ID NO: 620395 - RNA, 19 nt, Human
uggagugcaauggcucgau

SEQ ID NO: 620396 - RNA, 23 nt, Human
uggagugcaauggcucgaucucg

SEQ ID NO: 620397 - RNA, 24 nt, Human
uggagugcaauggcucgaucucgg

SEQ ID NO: 620398 - RNA, 24 nt, Human
ugggaccacaggcgugagccacca

SEQ ID NO: 620399 - RNA, 19 nt, Human
ugggauuacaggcaaugcg

SEQ ID NO: 620400 - RNA, 22 nt, Human
ugggauuacaggcaaugcgcca

SEQ ID NO: 620401 - RNA, 23 nt, Human
ugggauuacaggcaaugcgccac

SEQ ID NO: 620402 - RNA, 25 nt, Human
ugggauuacaggcaaugcgccacca

SEQ ID NO: 620403 - RNA, 23 nt, Human
ugggauuacaggcaugaaccacc

SEQ ID NO: 620404 - RNA, 24 nt, Human
ugggauuacaggcaugaaccacca

SEQ ID NO: 620405 - RNA, 24 nt, Human
ugggauuacaggcaugaaccacca

SEQ ID NO: 620406 - RNA, 23 nt, Human
uggucaggcuggucucgaacucc

SEQ ID NO: 620407 - RNA, 19 nt, Human
uggucucgaacucccgacc

SEQ ID NO: 620408 - RNA, 21 nt, Human
uguauuuuuagcagagacggg

SEQ ID NO: 620409 - RNA, 21 nt, Human
uguccaggcuggagugcaaug

SEQ ID NO: 620410 - RNA, 25 nt, Human
uguccaggcuggagugcaauggcuc

SEQ ID NO: 620411 - RNA, 31 nt, Human
uuaauaaugauuauguacuuggucccucuuu

SEQ ID NO: 620412 - RNA, 18 nt, Human
uuacaggcaaugcgccac

SEQ ID NO: 620413 - RNA, 22 nt, Human
uuagcagagacgggguuucucc

SEQ ID NO: 620414 - RNA, 24 nt, Human
uuagcagagacgggguuucuccau

SEQ ID NO: 620415 - RNA, 18 nt, Human
uuaguagagacgggguuu

SEQ ID NO: 620416 - RNA, 22 nt, Human
uuaguagagacgggguuucacc

SEQ ID NO: 620417 - RNA, 24 nt, Human
uuaguagagacgggguuucaccau

SEQ ID NO: 620418 - RNA, 19 nt, Human
uucaagcaauucuccugcc

SEQ ID NO: 620419 - RNA, 22 nt, Human
uucgcuccugcuguccaggcug

SEQ ID NO: 620420 - RNA, 24 nt, Human
uucgcuccugcuguccaggcugga

SEQ ID NO: 620421 - RNA, 23 nt, Human
uuguauuuuuagcagagacgggg

SEQ ID NO: 620422 - RNA, 18 nt, Human
uuuaaaauugaaauucca

SEQ ID NO: 620423 - RNA, 24 nt, Human
uuucgcuccugcuguccaggcugg

SEQ ID NO: 620424 - RNA, 21 nt, Human
uuucuccauguuggucaggcu

SEQ ID NO: 620425 - RNA, 20 nt, Human
uuuuguauuuuuagcagaga

SEQ ID NO: 620426 - RNA, 24 nt, Human
uuuuuaguagagacgggguuucac

SEQ ID NO: 620427 - RNA, 23 nt, Human
uuuuuuaguagagacgggguuuc

SEQ ID NO: 620428 - RNA, 21 nt, Human
uuuuuuuuuuuuuuuuuauuu

SEQ ID NO: 620429 - RNA, 19 nt, Human
aaaaauauuaaagaaggcc

SEQ ID NO: 620430 - RNA, 26 nt, Human
aacaaaaacuauccuuauauuaauug

SEQ ID NO: 620431 - RNA, 22 nt, Human
aagaggaaaaaauccaaacaua

SEQ ID NO: 620432 - RNA, 24 nt, Human
aaucaaaauggcuucccauugcuu

SEQ ID NO: 620433 - RNA, 21 nt, Human
acaaagaggaaaaaauccaaa

SEQ ID NO: 620434 - RNA, 20 nt, Human
acccagagagucaauuaguu

SEQ ID NO: 620435 - RNA, 24 nt, Human
aggcauuaggaauuuuuuuaaacc

SEQ ID NO: 620436 - RNA, 21 nt, Human
auaguuauauuaaauggguac

SEQ ID NO: 620437 - RNA, 23 nt, Human
caaaauggcuucccauugcuuga

SEQ ID NO: 620438 - RNA, 23 nt, Human
caauagcuuuucuccaugagcuc

SEQ ID NO: 620439 - RNA, 23 nt, Human
cacuuuauuccaucaaacaucac

SEQ ID NO: 620440 - RNA, 22 nt, Human
cagagagcuguggugaaucaga

SEQ ID NO: 620441 - RNA, 21 nt, Human
cccaagguacuacuuuucuca

SEQ ID NO: 620442 - RNA, 21 nt, Human
gcauagcuucaauuuaagugc

SEQ ID NO: 620443 - RNA, 21 nt, Human
uaaaaauauuaaagaaggcua

SEQ ID NO: 620444 - RNA, 23 nt, Human
uaaaaguuguauaguucucuaag

SEQ ID NO: 620445 - RNA, 19 nt, Human
uaaagaaggcuaaaaggca

SEQ ID NO: 620446 - RNA, 22 nt, Human
uaagaagggguuagaacccaga

SEQ ID NO: 620447 - RNA, 24 nt, Human
uacaaagaggaaaaaauccaaaca

SEQ ID NO: 620448 - RNA, 22 nt, Human
uacacaucccaagguacuacuu

SEQ ID NO: 620449 - RNA, 23 nt, Human
uacucaagaaaucaaaauggcuu

SEQ ID NO: 620450 - RNA, 24 nt, Human
ugaaaaacaguguuacacuuccaa

SEQ ID NO: 620451 - RNA, 21 nt, Human
uggugaaucagauaaaacugc

SEQ ID NO: 620452 - RNA, 23 nt, Human
uguuaagaagggguuagaaccca

SEQ ID NO: 620453 - RNA, 22 nt, Human
uuaaugcuuacaagauuacuca

SEQ ID NO: 620454 - RNA, 23 nt, Human
uucaguuaucaaguuuucuggag

SEQ ID NO: 620455 - RNA, 18 nt, Human
uucauuuucuauccugug

SEQ ID NO: 620456 - RNA, 22 nt, Human
uuucugguuagccagaauguuc

SEQ ID NO: 620457 - RNA, 25 nt, Human
uuuucuauccuguggcauagcuuca

SEQ ID NO: 620458 - RNA, 18 nt, Human
aaaagaacaaaaaaugaa

SEQ ID NO: 620459 - RNA, 23 nt, Human
aaaugccuuuuuuuuaaaguucu

SEQ ID NO: 620460 - RNA, 19 nt, Human
aaccucugccuccuggguc

SEQ ID NO: 620461 - RNA, 27 nt, Human
aagaaguaguggauccuuucuuccucc

SEQ ID NO: 620462 - RNA, 24 nt, Human
aaggugcuaggauuacaggcauga

SEQ ID NO: 620463 - RNA, 20 nt, Human
accauguuggucaggcuggu

SEQ ID NO: 620464 - RNA, 24 nt, Human
acccggcugauuuuuguauuuuua

SEQ ID NO: 620465 - RNA, 18 nt, Human
accucaaugcccaacauu

SEQ ID NO: 620466 - RNA, 24 nt, Human
agaaaaaaacaagcuuguacaaga

SEQ ID NO: 620467 - RNA, 21 nt, Human
agaaaggagucaagaaaagaa

SEQ ID NO: 620468 - RNA, 19 nt, Human
agaagauauuucacacugg

SEQ ID NO: 620469 - RNA, 20 nt, Human
agacccggcugauuuuugua

SEQ ID NO: 620470 - RNA, 24 nt, Human
agcugcuuaucuuuuuuguuuuuu

SEQ ID NO: 620471 - RNA, 20 nt, Human
aggcuucaccaguuaucagu

SEQ ID NO: 620472 - RNA, 24 nt, Human
aggugauccaccugccucagccuc

SEQ ID NO: 620473 - RNA, 22 nt, Human
aguagagaugggguuucaccau

SEQ ID NO: 620474 - RNA, 23 nt, Human
agugcaauggcgugaucuuggcu

SEQ ID NO: 620475 - RNA, 24 nt, Human
agugcaauggcgugaucuuggcuc

SEQ ID NO: 620476 - RNA, 21 nt, Human
auacauccagaacaaugaaaa

SEQ ID NO: 620477 - RNA, 24 nt, Human
augggguuucaccauguuggucag

SEQ ID NO: 620478 - RNA, 23 nt, Human
auucacaagacagaaaaaaacaa

SEQ ID NO: 620479 - RNA, 22 nt, Human
auuuuuguauuuuuaguagaga

SEQ ID NO: 620480 - RNA, 24 nt, Human
auuuuuguauuuuuaguagagaug

SEQ ID NO: 620481 - RNA, 19 nt, Human
caacugaacucaaaggcca

SEQ ID NO: 620482 - RNA, 21 nt, Human
caagcaauucuccugccucag

SEQ ID NO: 620483 - RNA, 24 nt, Human
caaggugcuaggauuacaggcaug

SEQ ID NO: 620484 - RNA, 21 nt, Human
caauauaaguaccaauacuuu

SEQ ID NO: 620485 - RNA, 18 nt, Human
cacaagacagaaaaaaac

SEQ ID NO: 620486 - RNA, 19 nt, Human
cacaagacagaaaaaaaca

SEQ ID NO: 620487 - RNA, 18 nt, Human
cacacacuugagaaagga

SEQ ID NO: 620488 - RNA, 18 nt, Human
caccauguuggucaggcu

SEQ ID NO: 620489 - RNA, 21 nt, Human
caccauguuggucaggcuggu

SEQ ID NO: 620490 - RNA, 24 nt, Human
caccauguuggucaggcugguguu

SEQ ID NO: 620491 - RNA, 21 nt, Human
cacugcaaccucugccuccug

SEQ ID NO: 620492 - RNA, 23 nt, Human
cacugcaaccucugccuccuggg

SEQ ID NO: 620493 - RNA, 23 nt, Human
cagaaaaaaacaagcuuguacaa

SEQ ID NO: 620494 - RNA, 20 nt, Human
cagcugcuuaucuuuuaaau

SEQ ID NO: 620495 - RNA, 23 nt, Human
caggugccugccaugagacccgg

SEQ ID NO: 620496 - RNA, 18 nt, Human
caguagaugggauuacag

SEQ ID NO: 620497 - RNA, 19 nt, Human
caguagaugggauuacagg

SEQ ID NO: 620498 - RNA, 23 nt, Human
cauuauaauaucaaacuucaaaa

SEQ ID NO: 620499 - RNA, 19 nt, Human
ccaaggugcuaggauuaca

SEQ ID NO: 620500 - RNA, 24 nt, Human
ccaaggugcuaggauuacaggcau

SEQ ID NO: 620501 - RNA, 25 nt, Human
ccaccugccucagccucccaaggug

SEQ ID NO: 620502 - RNA, 24 nt, Human
ccccaggcuggagugcaauggcgu

SEQ ID NO: 620503 - RNA, 22 nt, Human
ccucaguagaugggauuacagg

SEQ ID NO: 620504 - RNA, 23 nt, Human
ccuccugggucaagcaauucucc

SEQ ID NO: 620505 - RNA, 21 nt, Human
ccugaccuuaggugauccacc

SEQ ID NO: 620506 - RNA, 23 nt, Human
ccugaccuuaggugauccaccug

SEQ ID NO: 620507 - RNA, 24 nt, Human
ccugccucagccucccaaggugcu

SEQ ID NO: 620508 - RNA, 22 nt, Human
ccugggucaagcaauucuccug

SEQ ID NO: 620509 - RNA, 21 nt, Human
ccuuucuuccuccuuaguauc

SEQ ID NO: 620510 - RNA, 24 nt, Human
cucacugcaaccucugccuccugg

SEQ ID NO: 620511 - RNA, 22 nt, Human
cuccugccucaguagaugggau

SEQ ID NO: 620512 - RNA, 20 nt, Human
cucugucccccaggcuggag

SEQ ID NO: 620513 - RNA, 19 nt, Human
cugcaaccucugccuccug

SEQ ID NO: 620514 - RNA, 23 nt, Human
cugcaaccucugccuccuggguc

SEQ ID NO: 620515 - RNA, 24 nt, Human
cugccucagccucccaaggugcua

SEQ ID NO: 620516 - RNA, 18 nt, Human
cuggcugggcccagcugu

SEQ ID NO: 620517 - RNA, 19 nt, Human
cugggcccagcuguaccug

SEQ ID NO: 620518 - RNA, 23 nt, Human
cuuaggugauccaccugccucag

SEQ ID NO: 620519 - RNA, 23 nt, Human
cuucaccaguuaucagugccacu

SEQ ID NO: 620520 - RNA, 21 nt, Human
cuugcucugucccccaggcug

SEQ ID NO: 620521 - RNA, 22 nt, Human
gaaaaaaacaagcuuguacaag

SEQ ID NO: 620522 - RNA, 22 nt, Human
gacacacagacuuauacaucca

SEQ ID NO: 620523 - RNA, 24 nt, Human
gaccuuaggugauccaccugccuc

SEQ ID NO: 620524 - RNA, 24 nt, Human
gagaugggguuucaccauguuggu

SEQ ID NO: 620525 - RNA, 18 nt, Human
gauuacaggcaugaggca

SEQ ID NO: 620526 - RNA, 24 nt, Human
gauuacaggcaugaggcaccgugc

SEQ ID NO: 620527 - RNA, 18 nt, Human
gauuacaggugccugcca

SEQ ID NO: 620528 - RNA, 20 nt, Human
gccacguugauuuuuccacc

SEQ ID NO: 620529 - RNA, 21 nt, Human
gcucacugcaaccucugccuc

SEQ ID NO: 620530 - RNA, 19 nt, Human
gcuggagugcaauggcgug

SEQ ID NO: 620531 - RNA, 20 nt, Human
gcuucaccaguuaucagugc

SEQ ID NO: 620532 - RNA, 22 nt, Human
ggagauagagucuugcucuguc

SEQ ID NO: 620533 - RNA, 22 nt, Human
ggauuacaggcaugaggcaccg

SEQ ID NO: 620534 - RNA, 24 nt, Human
ggauuacaggcaugaggcaccgug

SEQ ID NO: 620535 - RNA, 22 nt, Human
ggcuggagugcaauggcgugau

SEQ ID NO: 620536 - RNA, 22 nt, Human
gggguuucaccauguuggucag

SEQ ID NO: 620537 - RNA, 24 nt, Human
ggugauccaccugccucagccucc

SEQ ID NO: 620538 - RNA, 23 nt, Human
guagagaugggguuucaccaugu

SEQ ID NO: 620539 - RNA, 18 nt, Human
gugauccaccugccucag

SEQ ID NO: 620540 - RNA, 19 nt, Human
gugauccaccugccucagc

SEQ ID NO: 620541 - RNA, 24 nt, Human
gugauccaccugccucagccuccc

SEQ ID NO: 620542 - RNA, 21 nt, Human
gugcuaggauuacaggcauga

SEQ ID NO: 620543 - RNA, 24 nt, Human
uaaaugauuacuuaacagacaucc

SEQ ID NO: 620544 - RNA, 19 nt, Human
uaaugcaauauaauaaugu

SEQ ID NO: 620545 - RNA, 22 nt, Human
uaaugcaauauaauaauguaaa

SEQ ID NO: 620546 - RNA, 24 nt, Human
uacaggcaugaggcaccgugccca

SEQ ID NO: 620547 - RNA, 21 nt, Human
uagaagauauuucacacuggg

SEQ ID NO: 620548 - RNA, 22 nt, Human
uagagaugggguuucaccaugu

SEQ ID NO: 620549 - RNA, 26 nt, Human
uagcaucacacauacaaccauuacca

SEQ ID NO: 620550 - RNA, 18 nt, Human
uaggauuacaggcaugag

SEQ ID NO: 620551 - RNA, 21 nt, Human
uaggauuacaggcaugaggca

SEQ ID NO: 620552 - RNA, 23 nt, Human
uaggauuacaggcaugaggcacc

SEQ ID NO: 620553 - RNA, 24 nt, Human
uaggauuacaggcaugaggcaccg

SEQ ID NO: 620554 - RNA, 24 nt, Human
uaguagagaugggguuucaccaug

SEQ ID NO: 620555 - RNA, 26 nt, Human
uaguagagaugggguuucaccauguu

SEQ ID NO: 620556 - RNA, 22 nt, Human
uauaacaacugaacucaaaggc

SEQ ID NO: 620557 - RNA, 18 nt, Human
ucacaagacagaaaaaaa

SEQ ID NO: 620558 - RNA, 24 nt, Human
ucacugcaaccucugccuccuggg

SEQ ID NO: 620559 - RNA, 25 nt, Human
ucacugcaaccucugccuccugggu

SEQ ID NO: 620560 - RNA, 27 nt, Human
ucacugcaaccucugccuccuggguca

SEQ ID NO: 620561 - RNA, 21 nt, Human
ucagcugcuuaucuuuuaaau

SEQ ID NO: 620562 - RNA, 18 nt, Human
ucauuaguuuuccaacac

SEQ ID NO: 620563 - RNA, 24 nt, Human
ucccaaggugcuaggauuacaggc

SEQ ID NO: 620564 - RNA, 18 nt, Human
ucccccaggcuggagugc

SEQ ID NO: 620565 - RNA, 20 nt, Human
uccugggucaagcaauucuc

SEQ ID NO: 620566 - RNA, 23 nt, Human
uccugggucaagcaauucuccug

SEQ ID NO: 620567 - RNA, 23 nt, Human
uccuuucuuccuccuuaguaucu

SEQ ID NO: 620568 - RNA, 23 nt, Human
ucugccuccugggucaagcaauu

SEQ ID NO: 620569 - RNA, 19 nt, Human
ucugucccccaggcuggag

SEQ ID NO: 620570 - RNA, 18 nt, Human
ucuuccuccuuaguaucu

SEQ ID NO: 620571 - RNA, 19 nt, Human
ucuugcucugucccccagg

SEQ ID NO: 620572 - RNA, 23 nt, Human
ucuugcucugucccccaggcugg

SEQ ID NO: 620573 - RNA, 24 nt, Human
ucuugcucugucccccaggcugga

SEQ ID NO: 620574 - RNA, 20 nt, Human
ugaagagaaauuccauuugg

SEQ ID NO: 620575 - RNA, 24 nt, Human
ugaccuuaggugauccaccugccu

SEQ ID NO: 620576 - RNA, 19 nt, Human
ugacucaagcuggcugggc

SEQ ID NO: 620577 - RNA, 24 nt, Human
ugauuuuuguauuuuuaguagaga

SEQ ID NO: 620578 - RNA, 19 nt, Human
ugccacucaacacuuucaa

SEQ ID NO: 620579 - RNA, 24 nt, Human
ugccucagccucccaaggugcuag

SEQ ID NO: 620580 - RNA, 24 nt, Human
ugcuaggauuacaggcaugaggca

SEQ ID NO: 620581 - RNA, 19 nt, Human
uggagugcaauggcgugau

SEQ ID NO: 620582 - RNA, 23 nt, Human
uggagugcaauggcgugaucuug

SEQ ID NO: 620583 - RNA, 24 nt, Human
uggagugcaauggcgugaucuugg

SEQ ID NO: 620584 - RNA, 22 nt, Human
ugggaacauuguugccagucca

SEQ ID NO: 620585 - RNA, 19 nt, Human
ugggauuacaggugccugc

SEQ ID NO: 620586 - RNA, 21 nt, Human
ugggauuacaggugccugcca

SEQ ID NO: 620587 - RNA, 21 nt, Human
ugggauuacaggugccugcca

SEQ ID NO: 620588 - RNA, 22 nt, Human
ugggauuacaggugccugccau

SEQ ID NO: 620589 - RNA, 24 nt, Human
ugggcaaaauuuacaccucaaugc

SEQ ID NO: 620590 - RNA, 25 nt, Human
ugggcauagcaucacacauacaacc

SEQ ID NO: 620591 - RNA, 24 nt, Human
ugggguuucaccauguuggucagg

SEQ ID NO: 620592 - RNA, 27 nt, Human
uggucaggcugguguuguugaacuccu

SEQ ID NO: 620593 - RNA, 24 nt, Human
ugguguuguugaacuccugaccuu

SEQ ID NO: 620594 - RNA, 22 nt, Human
ugucccccaggcuggagugcaa

SEQ ID NO: 620595 - RNA, 18 nt, Human
uuacaggcaugaggcacc

SEQ ID NO: 620596 - RNA, 22 nt, Human
uuagaaaguaaauuguuuucuu

SEQ ID NO: 620597 - RNA, 22 nt, Human
uuaggugauccaccugccucag

SEQ ID NO: 620598 - RNA, 18 nt, Human
uuaguagagaugggguuu

SEQ ID NO: 620599 - RNA, 22 nt, Human
uuaguagagaugggguuucacc

SEQ ID NO: 620600 - RNA, 24 nt, Human
uuaguagagaugggguuucaccau

SEQ ID NO: 620601 - RNA, 24 nt, Human
uuauuuuaauggaauugacugucu

SEQ ID NO: 620602 - RNA, 20 nt, Human
uucacaagacagaaaaaaac

SEQ ID NO: 620603 - RNA, 22 nt, Human
uucacaagacagaaaaaaacaa

SEQ ID NO: 620604 - RNA, 20 nt, Human
uucugauuuuucuagaguca

SEQ ID NO: 620605 - RNA, 18 nt, Human
uugaucuuaagaaacaca

SEQ ID NO: 620606 - RNA, 24 nt, Human
uugcucugucccccaggcuggagu

SEQ ID NO: 620607 - RNA, 23 nt, Human
uuguauuuuuaguagagaugggg

SEQ ID NO: 620608 - RNA, 18 nt, Human
uuuacaccucaaugccca

SEQ ID NO: 620609 - RNA, 24 nt, Human
uuucaccauguuggucaggcuggu

SEQ ID NO: 620610 - RNA, 25 nt, Human
uuucucacuucuuauuuuaauggaa

SEQ ID NO: 620611 - RNA, 23 nt, Human
uuuucuagagucauucauaagaa

SEQ ID NO: 620612 - RNA, 24 nt, Human
uuuuguuuuuuggagauagagucu

SEQ ID NO: 620613 - RNA, 24 nt, Human
uuuuuaguagagaugggguuucac

SEQ ID NO: 620614 - RNA, 20 nt, Human
uuuuuguauuuuuaguagag

SEQ ID NO: 620615 - RNA, 20 nt, Human
aaaaagccugggcaagagaa

SEQ ID NO: 620616 - RNA, 23 nt, Human
aaauuugcuucacuuauaaggcc

SEQ ID NO: 620617 - RNA, 24 nt, Human
aagagaccugggcaggucgaaaaa

SEQ ID NO: 620618 - RNA, 23 nt, Human
aauauuaccuccacaucuguggu

SEQ ID NO: 620619 - RNA, 26 nt, Human
acaaaaucaaaguuacuucuggauca

SEQ ID NO: 620620 - RNA, 21 nt, Human
acucauaaggccuuucuccag

SEQ ID NO: 620621 - RNA, 19 nt, Human
acucgcugauggugaauga

SEQ ID NO: 620622 - RNA, 24 nt, Human
acugugggcaccugccaaguggua

SEQ ID NO: 620623 - RNA, 19 nt, Human
agaccugggcaggucgaaa

SEQ ID NO: 620624 - RNA, 22 nt, Human
aggagcaaaaagccugggcaag

SEQ ID NO: 620625 - RNA, 23 nt, Human
aggcuggaguuuucagcaaagga

SEQ ID NO: 620626 - RNA, 18 nt, Human
aucugugguauuuuccuc

SEQ ID NO: 620627 - RNA, 18 nt, Human
augcaguucccacauacc

SEQ ID NO: 620628 - RNA, 22 nt, Human
auugaagaaaaaauaauauuac

SEQ ID NO: 620629 - RNA, 26 nt, Human
caaaggauuucccacagucacugcac

SEQ ID NO: 620630 - RNA, 20 nt, Human
caaccacuccucccgagcuc

SEQ ID NO: 620631 - RNA, 24 nt, Human
cacaaucaaugcauucauauggcc

SEQ ID NO: 620632 - RNA, 21 nt, Human
cacauaccuggaauguaugca

SEQ ID NO: 620633 - RNA, 24 nt, Human
cacucauaacaccuugaucuggug

SEQ ID NO: 620634 - RNA, 26 nt, Human
caguguuauauugaagaaaaaauaau

SEQ ID NO: 620635 - RNA, 22 nt, Human
ccacaaccacuccucccgagcu

SEQ ID NO: 620636 - RNA, 19 nt, Human
ccacacugcccgcacucau

SEQ ID NO: 620637 - RNA, 23 nt, Human
ccauuugucacacucauaacacc

SEQ ID NO: 620638 - RNA, 23 nt, Human
cccacauaccuggaauguaugca

SEQ ID NO: 620639 - RNA, 19 nt, Human
ccucugugccaaaaaugag

SEQ ID NO: 620640 - RNA, 22 nt, Human
ccugccaagugguaaaggugaa

SEQ ID NO: 620641 - RNA, 23 nt, Human
cggauggaccugacaggccaaaa

SEQ ID NO: 620642 - RNA, 20 nt, Human
cuggccuugaaggagcaaaa

SEQ ID NO: 620643 - RNA, 23 nt, Human
gagcaaaaagccugggcaagaga

SEQ ID NO: 620644 - RNA, 19 nt, Human
gcgacggaacgaagaacug

SEQ ID NO: 620645 - RNA, 21 nt, Human
gcggggggggaacgcgggcuc

SEQ ID NO: 620646 - RNA, 21 nt, Human
gcuaaagaauauuccccauuu

SEQ ID NO: 620647 - RNA, 19 nt, Human
ggaucaugaugaguuaggc

SEQ ID NO: 620648 - RNA, 19 nt, Human
ggcaagagaauuuccaaaa

SEQ ID NO: 620649 - RNA, 19 nt, Human
ggcuaaaggauuucccaca

SEQ ID NO: 620650 - RNA, 24 nt, Human
gggcaagagaauuuccaaaauuug

SEQ ID NO: 620651 - RNA, 20 nt, Human
gguaaccaaugagagagggc

SEQ ID NO: 620652 - RNA, 23 nt, Human
guuaggcgaaugauguacugugg

SEQ ID NO: 620653 - RNA, 24 nt, Human
uaaccaaugagagagggcugaagg

SEQ ID NO: 620654 - RNA, 22 nt, Human
uaacucauuggagagaaaggaa

SEQ ID NO: 620655 - RNA, 25 nt, Human
uaagcuaaaggauuucccacauuca

SEQ ID NO: 620656 - RNA, 18 nt, Human
uaaggccuuucuccugug

SEQ ID NO: 620657 - RNA, 18 nt, Human
uaagggguuuccuccagu

SEQ ID NO: 620658 - RNA, 22 nt, Human
uacuaugcaguucccacauacc

SEQ ID NO: 620659 - RNA, 27 nt, Human
uacuaugcaguucccacauaccuggaa

SEQ ID NO: 620660 - RNA, 21 nt, Human
uagaagagaacuguaagucac

SEQ ID NO: 620661 - RNA, 19 nt, Human
uauugugguaaccaaugag

SEQ ID NO: 620662 - RNA, 24 nt, Human
uccacacucaacgcauucauaagg

SEQ ID NO: 620663 - RNA, 25 nt, Human
uccacacucaacgcauucauaaggc

SEQ ID NO: 620664 - RNA, 20 nt, Human
ucccgagcucguccagaccc

SEQ ID NO: 620665 - RNA, 20 nt, Human
ugaaggagcaaaaagccugg

SEQ ID NO: 620666 - RNA, 24 nt, Human
ugagauccaaaagaucccugaaaa

SEQ ID NO: 620667 - RNA, 19 nt, Human
ugcaauggccacaaccacu

SEQ ID NO: 620668 - RNA, 21 nt, Human
ugcauucauauggccuuccuc

SEQ ID NO: 620669 - RNA, 22 nt, Human
ugcuuuuuagaagagaacugua

SEQ ID NO: 620670 - RNA, 21 nt, Human
uggagagaaaggaaugagaau

SEQ ID NO: 620671 - RNA, 20 nt, Human
uggaguuuucagcaaaggau

SEQ ID NO: 620672 - RNA, 21 nt, Human
uguaaagaagcuagcauucua

SEQ ID NO: 620673 - RNA, 23 nt, Human
uguaugcagcuauuugauguaug

SEQ ID NO: 620674 - RNA, 24 nt, Human
uucaaguuaucagaagaguccucu

SEQ ID NO: 620675 - RNA, 21 nt, Human
uuuccacacucaacgcauuca

SEQ ID NO: 620676 - RNA, 24 nt, Human
uuucccacauucacuacauucaua

SEQ ID NO: 620677 - RNA, 21 nt, Human
uuuuuuuuuuuuuuuuuuaag

SEQ ID NO: 620678 - RNA, 24 nt, Human
aaaaacuaguaaaauuccagcuuu

SEQ ID NO: 620679 - RNA, 20 nt, Human
aaacaugggcuagauagaaa

SEQ ID NO: 620680 - RNA, 24 nt, Human
aaagucagaauaaaaaacuguaug

SEQ ID NO: 620681 - RNA, 26 nt, Human
aacacacacacagauuaccacaacua

SEQ ID NO: 620682 - RNA, 22 nt, Human
aaguagcugggauuauaggcau

SEQ ID NO: 620683 - RNA, 24 nt, Human
aauggugugaucucggcucacugc

SEQ ID NO: 620684 - RNA, 18 nt, Human
acuuucagcaaacagcaa

SEQ ID NO: 620685 - RNA, 22 nt, Human
agauagaaauuaaaaugugaga

SEQ ID NO: 620686 - RNA, 23 nt, Human
agcaaacagcaaauaauaaacaa

SEQ ID NO: 620687 - RNA, 23 nt, Human
agcacagcaauucuuccaaaaga

SEQ ID NO: 620688 - RNA, 20 nt, Human
aggcaucagccaccacaccc

SEQ ID NO: 620689 - RNA, 24 nt, Human
aguacaauggugugaucucggcuc

SEQ ID NO: 620690 - RNA, 22 nt, Human
auacaguuaauguugaaagaag

SEQ ID NO: 620691 - RNA, 21 nt, Human
auaggcaucagccaccacacc

SEQ ID NO: 620692 - RNA, 21 nt, Human
auauguauguguguguauaua

SEQ ID NO: 620693 - RNA, 24 nt, Human
caaacagcacagcaauucuuccaa

SEQ ID NO: 620694 - RNA, 22 nt, Human
caagcgauucuccugccucagc

SEQ ID NO: 620695 - RNA, 22 nt, Human
caaguagcugggauuauaggca

SEQ ID NO: 620696 - RNA, 23 nt, Human
caaguagcugggauuauaggcau

SEQ ID NO: 620697 - RNA, 21 nt, Human
caccacacccggcccacaggc

SEQ ID NO: 620698 - RNA, 23 nt, Human
cacugcaaccucuauuuccuggg

SEQ ID NO: 620699 - RNA, 23 nt, Human
cagaauaaaaaacuguaugaagu

SEQ ID NO: 620700 - RNA, 23 nt, Human
cagaguacaauggugugaucucg

SEQ ID NO: 620701 - RNA, 18 nt, Human
cagcaaacagcaaauaau

SEQ ID NO: 620702 - RNA, 23 nt, Human
cagcaauucuuccaaaagaucuu

SEQ ID NO: 620703 - RNA, 24 nt, Human
cagcacagcaauucuuccaaaaga

SEQ ID NO: 620704 - RNA, 21 nt, Human
cagccaccacacccggcccac

SEQ ID NO: 620705 - RNA, 23 nt, Human
ccuggguucaagcgauucuccug

SEQ ID NO: 620706 - RNA, 23 nt, Human
cucaaguagcugggauuauaggc

SEQ ID NO: 620707 - RNA, 24 nt, Human
cucacugcaaccucuauuuccugg

SEQ ID NO: 620708 - RNA, 24 nt, Human
cucagccucucaaguagcugggau

SEQ ID NO: 620709 - RNA, 23 nt, Human
cugcaaccucuauuuccuggguu

SEQ ID NO: 620710 - RNA, 23 nt, Human
cugccucagccucucaaguagcu

SEQ ID NO: 620711 - RNA, 21 nt, Human
gauuauaggcaucagccacca

SEQ ID NO: 620712 - RNA, 20 nt, Human
gauucuccugccucagccuc

SEQ ID NO: 620713 - RNA, 22 nt, Human
gcaaccucuauuuccuggguuc

SEQ ID NO: 620714 - RNA, 23 nt, Human
gccaccacacccggcccacaggc

SEQ ID NO: 620715 - RNA, 24 nt, Human
gcgauucuccugccucagccucuc

SEQ ID NO: 620716 - RNA, 24 nt, Human
gcucaggccagaguacaauggugu

SEQ ID NO: 620717 - RNA, 19 nt, Human
ggauuauaggcaucagcca

SEQ ID NO: 620718 - RNA, 21 nt, Human
ggcuagauagaaauuaaaaug

SEQ ID NO: 620719 - RNA, 21 nt, Human
guaaaaacuaguaaaauucca

SEQ ID NO: 620720 - RNA, 18 nt, Human
uaaaugagcaaaaauggg

SEQ ID NO: 620721 - RNA, 22 nt, Human
uacaauggugugaucucggcuc

SEQ ID NO: 620722 - RNA, 20 nt, Human
uaccacagaaaaaugcucau

SEQ ID NO: 620723 - RNA, 24 nt, Human
uauacaacacacacacagauuacc

SEQ ID NO: 620724 - RNA, 24 nt, Human
uauaguaaaauagacugcaaauac

SEQ ID NO: 620725 - RNA, 26 nt, Human
uauauacaacacacacacagauuacc

SEQ ID NO: 620726 - RNA, 19 nt, Human
ucaagcgauucuccugccu

SEQ ID NO: 620727 - RNA, 24 nt, Human
ucaaguagcugggauuauaggcau

SEQ ID NO: 620728 - RNA, 24 nt, Human
ucacugcaaccucuauuuccuggg

SEQ ID NO: 620729 - RNA, 19 nt, Human
ucaggccagaguacaaugg

SEQ ID NO: 620730 - RNA, 25 nt, Human
uccucugacaucugacagaugaaca

SEQ ID NO: 620731 - RNA, 20 nt, Human
uccuggguucaagcgauucu

SEQ ID NO: 620732 - RNA, 21 nt, Human
uccuggguucaagcgauucuc

SEQ ID NO: 620733 - RNA, 24 nt, Human
uccuggguucaagcgauucuccug

SEQ ID NO: 620734 - RNA, 24 nt, Human
ucucaaguagcugggauuauaggc

SEQ ID NO: 620735 - RNA, 26 nt, Human
ucuccugccucagccucucaaguagc

SEQ ID NO: 620736 - RNA, 23 nt, Human
ucuuccaaaagaucuucugaguc

SEQ ID NO: 620737 - RNA, 21 nt, Human
ucuuuugacaguaaaaacuag

SEQ ID NO: 620738 - RNA, 19 nt, Human
ugaaguuguaauuccuccu

SEQ ID NO: 620739 - RNA, 23 nt, Human
ugaucaacugcaucaaacagcac

SEQ ID NO: 620740 - RNA, 24 nt, Human
ugccucagccucucaaguagcugg

SEQ ID NO: 620741 - RNA, 18 nt, Human
uggaauaucagugaucaa

SEQ ID NO: 620742 - RNA, 18 nt, Human
ugggauuauaggcaucag

SEQ ID NO: 620743 - RNA, 21 nt, Human
ugggauuauaggcaucagcca

SEQ ID NO: 620744 - RNA, 22 nt, Human
ugggauuauaggcaucagccac

SEQ ID NO: 620745 - RNA, 24 nt, Human
ugggauuauaggcaucagccacca

SEQ ID NO: 620746 - RNA, 23 nt, Human
uggguucaagcgauucuccugcc

SEQ ID NO: 620747 - RNA, 24 nt, Human
uggguucaagcgauucuccugccu

SEQ ID NO: 620748 - RNA, 27 nt, Human
uguauuaaauauguauguguguguaua

SEQ ID NO: 620749 - RNA, 20 nt, Human
uucaaagaauugauaauacc

SEQ ID NO: 620750 - RNA, 25 nt, Human
uucaaagaauugauaauaccacaga

SEQ ID NO: 620751 - RNA, 21 nt, Human
uucaagcgauucuccugccuc

SEQ ID NO: 620752 - RNA, 23 nt, Human
uucaagcgauucuccugccucag

SEQ ID NO: 620753 - RNA, 24 nt, Human
uucaagcgauucuccugccucagc

SEQ ID NO: 620754 - RNA, 21 nt, Human
uucaugauaacuaagagugga

SEQ ID NO: 620755 - RNA, 22 nt, Human
uucuacugauauuucaugauaa

SEQ ID NO: 620756 - RNA, 25 nt, Human
uuguauuaaauauguaugugugugu

SEQ ID NO: 620757 - RNA, 24 nt, Human
uuuccuggguucaagcgauucucc

SEQ ID NO: 620758 - RNA, 18 nt, Human
uuuuacucucguugcuca

SEQ ID NO: 620759 - RNA, 19 nt, Human
uuuuuuuuuuuguguguga

SEQ ID NO: 620760 - RNA, 23 nt, Human
uuuuuuuuuuugugugugagacg

SEQ ID NO: 620761 - RNA, 18 nt, Human
uuuuuuuuuuuuuuuuug

SEQ ID NO: 620762 - RNA, 19 nt, Human
uuuuuuuuuuuuuuuuugu

SEQ ID NO: 620763 - RNA, 21 nt, Human
aaacauaaccauggaaucuuc

SEQ ID NO: 620764 - RNA, 24 nt, Human
aaacauaaccauggaaucuucaau

SEQ ID NO: 620765 - RNA, 22 nt, Human
aaagaaaaccagguuuuugucc

SEQ ID NO: 620766 - RNA, 20 nt, Human
aaauaagauccagagaccug

SEQ ID NO: 620767 - RNA, 20 nt, Human
aaccauggaaucuucaauaa

SEQ ID NO: 620768 - RNA, 21 nt, Human
aagaggaaauuaaauacugca

SEQ ID NO: 620769 - RNA, 19 nt, Human
aauacugcauguacagauc

SEQ ID NO: 620770 - RNA, 23 nt, Human
aauuagcuauagagacaaauuuc

SEQ ID NO: 620771 - RNA, 18 nt, Human
accagguuuuuguccugu

SEQ ID NO: 620772 - RNA, 22 nt, Human
agaaaccaaaaaagaaaaccag

SEQ ID NO: 620773 - RNA, 22 nt, Human
aucuaaagucuauauguugccc

SEQ ID NO: 620774 - RNA, 21 nt, Human
aucucacuccuuccuuuuuca

SEQ ID NO: 620775 - RNA, 19 nt, Human
caaauaagauccagagacc

SEQ ID NO: 620776 - RNA, 23 nt, Human
caucaaugauguuaaccaaacca

SEQ ID NO: 620777 - RNA, 20 nt, Human
caugucacgggugaugugug

SEQ ID NO: 620778 - RNA, 20 nt, Human
ccagacauucuaaugucuaa

SEQ ID NO: 620779 - RNA, 18 nt, Human
ccaggcccauaaugucug

SEQ ID NO: 620780 - RNA, 23 nt, Human
ccaguacauuggcaucuucugga

SEQ ID NO: 620781 - RNA, 22 nt, Human
ccuuccuuuuucacuauugucc

SEQ ID NO: 620782 - RNA, 22 nt, Human
cucacugcaugaaaaggcaauc

SEQ ID NO: 620783 - RNA, 21 nt, Human
cuucagaagacugguuggucc

SEQ ID NO: 620784 - RNA, 18 nt, Human
guacuuccaggcccauaa

SEQ ID NO: 620785 - RNA, 19 nt, Human
guuuguuuggaggggaguu

SEQ ID NO: 620786 - RNA, 22 nt, Human
uaaagucuauauguugcccuuu

SEQ ID NO: 620787 - RNA, 18 nt, Human
uacacuaacuucuccuga

SEQ ID NO: 620788 - RNA, 21 nt, Human
uagaggcuguaucuauaaccu

SEQ ID NO: 620789 - RNA, 28 nt, Human
uaguaggauuuuuuuaaaauuucuuuug

SEQ ID NO: 620790 - RNA, 28 nt, Human
uauccucaaauaucuagucuguguucaa

SEQ ID NO: 620791 - RNA, 18 nt, Human
uauuuugucaucaaugau

SEQ ID NO: 620792 - RNA, 20 nt, Human
ucaaauaucuagucuguguu

SEQ ID NO: 620793 - RNA, 23 nt, Human
ucaaugauguuaaccaaaccaag

SEQ ID NO: 620794 - RNA, 18 nt, Human
uccccaacauuuuuuugg

SEQ ID NO: 620795 - RNA, 19 nt, Human
uccccaacauuuuuuuggu

SEQ ID NO: 620796 - RNA, 19 nt, Human
uccgaugacuucugugggc

SEQ ID NO: 620797 - RNA, 23 nt, Human
uccucuguuuuggaagauccuug

SEQ ID NO: 620798 - RNA, 28 nt, Human
uccuuugcaauuucuuucuuuuuugguu

SEQ ID NO: 620799 - RNA, 23 nt, Human
ucgcugguuguuuuuguucaaaa

SEQ ID NO: 620800 - RNA, 20 nt, Human
ucucacugcaugaaaaggca

SEQ ID NO: 620801 - RNA, 22 nt, Human
ucugauugccuaauaauugauu

SEQ ID NO: 620802 - RNA, 25 nt, Human
ugaagaaaccaaaaaagaaaaccag

SEQ ID NO: 620803 - RNA, 21 nt, Human
ugauacauugaugaucugcuu

SEQ ID NO: 620804 - RNA, 19 nt, Human
ugccaguacauuggcaucu

SEQ ID NO: 620805 - RNA, 21 nt, Human
ugccauuugaguagacaaucu

SEQ ID NO: 620806 - RNA, 18 nt, Human
uggauauugcugauugca

SEQ ID NO: 620807 - RNA, 21 nt, Human
uggcaagaccaugucacgggu

SEQ ID NO: 620808 - RNA, 21 nt, Human
ugguaaguagugggguucugu

SEQ ID NO: 620809 - RNA, 20 nt, Human
uguccugugaauuuccccuu

SEQ ID NO: 620810 - RNA, 22 nt, Human
uguguagccagcuuauuacacu

SEQ ID NO: 620811 - RNA, 20 nt, Human
uguuuggaggggaguugaua

SEQ ID NO: 620812 - RNA, 24 nt, Human
uucuagaucaugucauuuauuuac

SEQ ID NO: 620813 - RNA, 24 nt, Human
uuugcaauuucuuucuuuuuuggu

SEQ ID NO: 620814 - RNA, 23 nt, Human
aaaaaagaacaggauaacagcaa

SEQ ID NO: 620815 - RNA, 27 nt, Human
aaaagaacaggauaacagcagugggca

SEQ ID NO: 620816 - RNA, 26 nt, Human
aaacaaaaaaacuaaaaaugugaagc

SEQ ID NO: 620817 - RNA, 22 nt, Human
aaacaagagagauaaccuuaaa

SEQ ID NO: 620818 - RNA, 18 nt, Human
aaacuauaggcaugcauc

SEQ ID NO: 620819 - RNA, 22 nt, Human
aaagcaagaaaauauuuagaga

SEQ ID NO: 620820 - RNA, 18 nt, Human
aaauaaaagccuacagcc

SEQ ID NO: 620821 - RNA, 18 nt, Human
aaauuagaaaacuuguac

SEQ ID NO: 620822 - RNA, 22 nt, Human
aaccagaacuuggagauuugga

SEQ ID NO: 620823 - RNA, 22 nt, Human
aagccuacagccaaaccaacaa

SEQ ID NO: 620824 - RNA, 25 nt, Human
aaggcagguggaucaccaaagguca

SEQ ID NO: 620825 - RNA, 24 nt, Human
aaguagcuaaaacuauaggcaugc

SEQ ID NO: 620826 - RNA, 22 nt, Human
aauaauugcauuaacugcacaa

SEQ ID NO: 620827 - RNA, 23 nt, Human
acaaaaaaacuaaaaaugugaag

SEQ ID NO: 620828 - RNA, 24 nt, Human
acaaacaaaaaaacuaaaaaugug

SEQ ID NO: 620829 - RNA, 26 nt, Human
acaaacaauagcaugagugauuugug

SEQ ID NO: 620830 - RNA, 23 nt, Human
acacacacacacacacacacaca

SEQ ID NO: 620831 - RNA, 21 nt, Human
acacauacacacacacacaca

SEQ ID NO: 620832 - RNA, 18 nt, Human
acagaacagaacagucaa

SEQ ID NO: 620833 - RNA, 24 nt, Human
accaacauggagaaacccugucuc

SEQ ID NO: 620834 - RNA, 25 nt, Human
accacaauaaagguuaaacggcacu

SEQ ID NO: 620835 - RNA, 22 nt, Human
accauugcacuccagccugggc

SEQ ID NO: 620836 - RNA, 24 nt, Human
acccugucucuacuaaaaauacaa

SEQ ID NO: 620837 - RNA, 23 nt, Human
acuaaaaauacaaacuuagcuaa

SEQ ID NO: 620838 - RNA, 24 nt, Human
acucaggagguggagguugcggug

SEQ ID NO: 620839 - RNA, 23 nt, Human
acugcaaucucuaaacauaaauu

SEQ ID NO: 620840 - RNA, 22 nt, Human
acuuguacugaagagaauccuc

SEQ ID NO: 620841 - RNA, 20 nt, Human
acuuuuccugcaggacauug

SEQ ID NO: 620842 - RNA, 21 nt, Human
agaacaggauaacagcaaugu

SEQ ID NO: 620843 - RNA, 18 nt, Human
agaagggggcggggaggg

SEQ ID NO: 620844 - RNA, 21 nt, Human
agaaugcacaccugggagugg

SEQ ID NO: 620845 - RNA, 20 nt, Human
agacagaacagaacagucaa

SEQ ID NO: 620846 - RNA, 21 nt, Human
agacagaacagaacagucaag

SEQ ID NO: 620847 - RNA, 18 nt, Human
agagaagggggcggggag

SEQ ID NO: 620848 - RNA, 18 nt, Human
agauaacaagccagagcc

SEQ ID NO: 620849 - RNA, 24 nt, Human
agauacgguggcucaggccuguaa

SEQ ID NO: 620850 - RNA, 24 nt, Human
agcuggucuagaaccccugggcuc

SEQ ID NO: 620851 - RNA, 22 nt, Human
agcuugagacagauaaaauggu

SEQ ID NO: 620852 - RNA, 18 nt, Human
aggaagaggaaauuccca

SEQ ID NO: 620853 - RNA, 18 nt, Human
aggaagugggcacuuaca

SEQ ID NO: 620854 - RNA, 21 nt, Human
aggcaggagaaucacuggaac

SEQ ID NO: 620855 - RNA, 26 nt, Human
aggcagguggaucaccaaaggucaga

SEQ ID NO: 620856 - RNA, 19 nt, Human
aggcaugaggaaagagcaa

SEQ ID NO: 620857 - RNA, 19 nt, Human
agggggcggggagggggga

SEQ ID NO: 620858 - RNA, 22 nt, Human
agggggcggggaggggggagac

SEQ ID NO: 620859 - RNA, 23 nt, Human
agggggcggggaggggggagacc

SEQ ID NO: 620860 - RNA, 24 nt, Human
agguggagguugcggugagccaag

SEQ ID NO: 620861 - RNA, 20 nt, Human
aguacugaccucaccauccu

SEQ ID NO: 620862 - RNA, 19 nt, Human
agucagggaccccaaacgg

SEQ ID NO: 620863 - RNA, 24 nt, Human
auacauauguguauauauauguau

SEQ ID NO: 620864 - RNA, 20 nt, Human
auauguguauauauauguau

SEQ ID NO: 620865 - RNA, 24 nt, Human
aucauaccauugcacuccagccug

SEQ ID NO: 620866 - RNA, 19 nt, Human
augcccagacucagguaac

SEQ ID NO: 620867 - RNA, 27 nt, Human
auggacagagaagacagaacagaacag

SEQ ID NO: 620868 - RNA, 23 nt, Human
auggcagaaaaacauggauugug

SEQ ID NO: 620869 - RNA, 23 nt, Human
auguguauauauauguauauaua

SEQ ID NO: 620870 - RNA, 23 nt, Human
auguuguauucagaaccuguagg

SEQ ID NO: 620871 - RNA, 24 nt, Human
auugcacuccagccugggcaacaa

SEQ ID NO: 620872 - RNA, 24 nt, Human
auugcagaagaaguuguuaaggaa

SEQ ID NO: 620873 - RNA, 21 nt, Human
auuuagagagagcuucaucgu

SEQ ID NO: 620874 - RNA, 22 nt, Human
auuucaccuugguccugugauc

SEQ ID NO: 620875 - RNA, 19 nt, Human
auuugcacacucccucccc

SEQ ID NO: 620876 - RNA, 19 nt, Human
auuuguuggucuccaucgu

SEQ ID NO: 620877 - RNA, 25 nt, Human
caaaaucucugcagcacugugacau

SEQ ID NO: 620878 - RNA, 24 nt, Human
caacauggagaaacccugucucua

SEQ ID NO: 620879 - RNA, 26 nt, Human
caacauggagaucagccuaaccaaca

SEQ ID NO: 620880 - RNA, 24 nt, Human
caaggcagguggaucaccaaaggu

SEQ ID NO: 620881 - RNA, 22 nt, Human
caaucugugagccauuacaacc

SEQ ID NO: 620882 - RNA, 18 nt, Human
cacacacacacacacaca

SEQ ID NO: 620883 - RNA, 20 nt, Human
cacacacacacacacacaca

SEQ ID NO: 620884 - RNA, 20 nt, Human
cacacacacacacacacaca

SEQ ID NO: 620885 - RNA, 20 nt, Human
cacacacacacacacacaca

SEQ ID NO: 620886 - RNA, 22 nt, Human
cacacacacacacacacacaca

SEQ ID NO: 620887 - RNA, 26 nt, Human
cacacacagugaccccccaaauuuca

SEQ ID NO: 620888 - RNA, 22 nt, Human
cacagguggggugaggaauaca

SEQ ID NO: 620889 - RNA, 20 nt, Human
caccuugaaaaaagaacagg

SEQ ID NO: 620890 - RNA, 24 nt, Human
cacuccagccugggcaacaagagc

SEQ ID NO: 620891 - RNA, 19 nt, Human
cagaaaacuggaaaacugc

SEQ ID NO: 620892 - RNA, 18 nt, Human
cagacucagguaaccaug

SEQ ID NO: 620893 - RNA, 18 nt, Human
cagaucugaccaacaugg

SEQ ID NO: 620894 - RNA, 24 nt, Human
cagcacuuugggaggccaaggcag

SEQ ID NO: 620895 - RNA, 25 nt, Human
cagcacuuugggaggccaaggcagg

SEQ ID NO: 620896 - RNA, 24 nt, Human
cagccuaaccaacauggagaaacc

SEQ ID NO: 620897 - RNA, 23 nt, Human
caggacauaaccucuucaaaaaa

SEQ ID NO: 620898 - RNA, 21 nt, Human
caggagguggagguugcggug

SEQ ID NO: 620899 - RNA, 20 nt, Human
caggccccccaaaucuggcc

SEQ ID NO: 620900 - RNA, 23 nt, Human
caggccccccaaaucuggccaua

SEQ ID NO: 620901 - RNA, 24 nt, Human
caggccuguaaucccagcacuuug

SEQ ID NO: 620902 - RNA, 20 nt, Human
cagucucccauagcacuccc

SEQ ID NO: 620903 - RNA, 18 nt, Human
cauugcacuccagccugg

SEQ ID NO: 620904 - RNA, 19 nt, Human
cauugcacuccagccuggg

SEQ ID NO: 620905 - RNA, 21 nt, Human
cauugcacuccagccugggca

SEQ ID NO: 620906 - RNA, 24 nt, Human
cauugcacuccagccugggcaaca

SEQ ID NO: 620907 - RNA, 21 nt, Human
ccacgacccagcuggucucgg

SEQ ID NO: 620908 - RNA, 19 nt, Human
ccauggcagaaaaacaugg

SEQ ID NO: 620909 - RNA, 24 nt, Human
ccauuacaaccuccaaaagggccc

SEQ ID NO: 620910 - RNA, 20 nt, Human
ccauugcacuccagccuggg

SEQ ID NO: 620911 - RNA, 21 nt, Human
ccauugcacuccagccugggc

SEQ ID NO: 620912 - RNA, 23 nt, Human
ccauugcacuccagccugggcaa

SEQ ID NO: 620913 - RNA, 24 nt, Human
ccauugcacuccagccugggcaac

SEQ ID NO: 620914 - RNA, 24 nt, Human
cccaaguagcuaaaacuauaggca

SEQ ID NO: 620915 - RNA, 19 nt, Human
cccauagcacucccaggcu

SEQ ID NO: 620916 - RNA, 23 nt, Human
cccccuggguguagccaucucuu

SEQ ID NO: 620917 - RNA, 18 nt, Human
cccuccccuuuugaaaau

SEQ ID NO: 620918 - RNA, 22 nt, Human
cccugggcucaggccacccucc

SEQ ID NO: 620919 - RNA, 24 nt, Human
cccugggcucaggccacccuccca

SEQ ID NO: 620920 - RNA, 20 nt, Human
cccuugugauuuccuaugcc

SEQ ID NO: 620921 - RNA, 21 nt, Human
ccuaaaccacaaacaauagca

SEQ ID NO: 620922 - RNA, 22 nt, Human
ccuaaaccacaaacaauagcau

SEQ ID NO: 620923 - RNA, 20 nt, Human
ccucugaagcugauggugag

SEQ ID NO: 620924 - RNA, 18 nt, Human
ccucuggggccuacauca

SEQ ID NO: 620925 - RNA, 21 nt, Human
ccugcaguacugaccucacca

SEQ ID NO: 620926 - RNA, 21 nt, Human
ccugugaucucgcccugccuc

SEQ ID NO: 620927 - RNA, 22 nt, Human
cgauucccacucugcacuauau

SEQ ID NO: 620928 - RNA, 22 nt, Human
cucaaaguguggcugaacaauc

SEQ ID NO: 620929 - RNA, 24 nt, Human
cucaggccuguaaucccagcacuu

SEQ ID NO: 620930 - RNA, 24 nt, Human
cuccauuucaaaaaaaaaaaaaaa

SEQ ID NO: 620931 - RNA, 20 nt, Human
cucugcagcacugugacaug

SEQ ID NO: 620932 - RNA, 20 nt, Human
cugauggugagaugugccuc

SEQ ID NO: 620933 - RNA, 23 nt, Human
cugcaauuaaaaacaaacaaaaa

SEQ ID NO: 620934 - RNA, 21 nt, Human
cuggaacucaggagguggagg

SEQ ID NO: 620935 - RNA, 24 nt, Human
cugggcaacaagagcaaaacucca

SEQ ID NO: 620936 - RNA, 24 nt, Human
gaaaauauuuagagagagcuucau

SEQ ID NO: 620937 - RNA, 21 nt, Human
gaacaugcuauugggaaauga

SEQ ID NO: 620938 - RNA, 22 nt, Human
gaacucaggagguggagguugc

SEQ ID NO: 620939 - RNA, 19 nt, Human
gaaucacuggaacucagga

SEQ ID NO: 620940 - RNA, 20 nt, Human
gaauucagccucauaaacua

SEQ ID NO: 620941 - RNA, 21 nt, Human
gaccucaccauccaugacccc

SEQ ID NO: 620942 - RNA, 21 nt, Human
gagaaacccugucucuacuaa

SEQ ID NO: 620943 - RNA, 23 nt, Human
gagaagggggcggggagggggga

SEQ ID NO: 620944 - RNA, 23 nt, Human
gagaaucacuggaacucaggagg

SEQ ID NO: 620945 - RNA, 23 nt, Human
gagaucagccuaaccaacaugga

SEQ ID NO: 620946 - RNA, 21 nt, Human
gagccugucccuuucuuucuc

SEQ ID NO: 620947 - RNA, 21 nt, Human
gaggauguauauuaccucagg

SEQ ID NO: 620948 - RNA, 21 nt, Human
gagguggagguugcggugagc

SEQ ID NO: 620949 - RNA, 22 nt, Human
gagguugcggugagccaagauc

SEQ ID NO: 620950 - RNA, 22 nt, Human
gaugcaucuaaggccaaucugu

SEQ ID NO: 620951 - RNA, 23 nt, Human
gcaaaaaugcaaaaggagaccug

SEQ ID NO: 620952 - RNA, 23 nt, Human
gccacacuggcagccacuaacca

SEQ ID NO: 620953 - RNA, 26 nt, Human
gccacacuggcagccacuaaccaaca

SEQ ID NO: 620954 - RNA, 26 nt, Human
gccuugugauauucuauuaccuugua

SEQ ID NO: 620955 - RNA, 24 nt, Human
ggaaauucccaccuaauaaauuuu

SEQ ID NO: 620956 - RNA, 20 nt, Human
ggagguugcggugagccaag

SEQ ID NO: 620957 - RNA, 24 nt, Human
ggagguugcggugagccaagauca

SEQ ID NO: 620958 - RNA, 20 nt, Human
ggcaaaaaugcaaaaggaga

SEQ ID NO: 620959 - RNA, 23 nt, Human
ggccuguaaucccagcacuuugg

SEQ ID NO: 620960 - RNA, 24 nt, Human
ggccuguaaucccagcacuuuggg

SEQ ID NO: 620961 - RNA, 19 nt, Human
ggcggggaggggggagacc

SEQ ID NO: 620962 - RNA, 21 nt, Human
ggcucaggccuguaaucccag

SEQ ID NO: 620963 - RNA, 29 nt, Human
gguauacauacauauguguauauauuaca

SEQ ID NO: 620964 - RNA, 23 nt, Human
gguggcucaggccuguaauccca

SEQ ID NO: 620965 - RNA, 24 nt, Human
gguggcucaggccuguaaucccag

SEQ ID NO: 620966 - RNA, 23 nt, Human
guaaagcaagaaaauauuuagag

SEQ ID NO: 620967 - RNA, 24 nt, Human
guaaagcaagaaaauauuuagaga

SEQ ID NO: 620968 - RNA, 18 nt, Human
gucccuuuauuucucaag

SEQ ID NO: 620969 - RNA, 20 nt, Human
gucuuucuugaugccaagau

SEQ ID NO: 620970 - RNA, 22 nt, Human
gugacccacaccuauuugcaca

SEQ ID NO: 620971 - RNA, 21 nt, Human
guguauauauauguauauaaa

SEQ ID NO: 620972 - RNA, 19 nt, Human
guuguauucagaaccugua

SEQ ID NO: 620973 - RNA, 24 nt, Human
guugugcagcggguuaaaaucagu

SEQ ID NO: 620974 - RNA, 24 nt, Human
uaaaacuauaggcaugcaucacca

SEQ ID NO: 620975 - RNA, 25 nt, Human
uaaaauggacagagaagacagaaca

SEQ ID NO: 620976 - RNA, 22 nt, Human
uaaacaugaucaucacagagga

SEQ ID NO: 620977 - RNA, 22 nt, Human
uaaaguggugaagaacuuggca

SEQ ID NO: 620978 - RNA, 20 nt, Human
uaacaacacucauauccuua

SEQ ID NO: 620979 - RNA, 19 nt, Human
uaacagaagugagaagaga

SEQ ID NO: 620980 - RNA, 19 nt, Human
uaacagaagugagaagaga

SEQ ID NO: 620981 - RNA, 24 nt, Human
uaacagcaauguuuaggaaacaag

SEQ ID NO: 620982 - RNA, 21 nt, Human
uaagcuggucuagaaccccug

SEQ ID NO: 620983 - RNA, 20 nt, Human
uacagcauguguguuugagc

SEQ ID NO: 620984 - RNA, 21 nt, Human
uacaggcaaucuccauucccu

SEQ ID NO: 620985 - RNA, 24 nt, Human
uacaggcaaucuccauucccuuuu

SEQ ID NO: 620986 - RNA, 26 nt, Human
uacauacauauguguauauauaugua

SEQ ID NO: 620987 - RNA, 19 nt, Human
uacauauguguauauauau

SEQ ID NO: 620988 - RNA, 18 nt, Human
uacaucaucuuggcuucu

SEQ ID NO: 620989 - RNA, 21 nt, Human
uaccagaaugagggcaagcaa

SEQ ID NO: 620990 - RNA, 24 nt, Human
uaccauugcacuccagccugggca

SEQ ID NO: 620991 - RNA, 23 nt, Human
uagaaccccugggcucaggccac

SEQ ID NO: 620992 - RNA, 23 nt, Human
uaggcaugaggaaagagcaaaug

SEQ ID NO: 620993 - RNA, 22 nt, Human
uauaaaguggugaagaacuugg

SEQ ID NO: 620994 - RNA, 19 nt, Human
uauauauauacacauacac

SEQ ID NO: 620995 - RNA, 23 nt, Human
uauauauauguauauauauauac

SEQ ID NO: 620996 - RNA, 24 nt, Human
uauauauauguauauauauauaca

SEQ ID NO: 620997 - RNA, 19 nt, Human
uauauauguauauauauau

SEQ ID NO: 620998 - RNA, 18 nt, Human
uauauguauauauauaua

SEQ ID NO: 620999 - RNA, 21 nt, Human
uauggaugguuucacuccuga

SEQ ID NO: 621000 - RNA, 22 nt, Human
uauguauauauauauacacaua

SEQ ID NO: 621001 - RNA, 22 nt, Human
uauguguauauauauguauaua

SEQ ID NO: 621002 - RNA, 20 nt, Human
uauguugccuaagcuggucu

SEQ ID NO: 621003 - RNA, 23 nt, Human
uauguugccuaagcuggucuaga

SEQ ID NO: 621004 - RNA, 24 nt, Human
uauguugccuaagcuggucuagaa

SEQ ID NO: 621005 - RNA, 19 nt, Human
ucaccuugguccugugauc

SEQ ID NO: 621006 - RNA, 18 nt, Human
ucaggagguggagguugc

SEQ ID NO: 621007 - RNA, 23 nt, Human
ucaggccacccucccaaguagcu

SEQ ID NO: 621008 - RNA, 23 nt, Human
ucauaccauugcacuccagccug

SEQ ID NO: 621009 - RNA, 18 nt, Human
uccaguaaagcaagaaaa

SEQ ID NO: 621010 - RNA, 22 nt, Human
uccauacugcaaaaauuagaaa

SEQ ID NO: 621011 - RNA, 24 nt, Human
ucccaaguagcuaaaacuauaggc

SEQ ID NO: 621012 - RNA, 23 nt, Human
ucccaggcuuauuaggaagagga

SEQ ID NO: 621013 - RNA, 18 nt, Human
ucccauagcacucccagg

SEQ ID NO: 621014 - RNA, 23 nt, Human
ucccuuucuuucucauaaggaau

SEQ ID NO: 621015 - RNA, 18 nt, Human
ucgugugaaaacaugagg

SEQ ID NO: 621016 - RNA, 22 nt, Human
ucuccacgacccagcuggucuc

SEQ ID NO: 621017 - RNA, 19 nt, Human
ucucuacuaaaaauacaaa

SEQ ID NO: 621018 - RNA, 23 nt, Human
ucugccccggacacccagcuuua

SEQ ID NO: 621019 - RNA, 23 nt, Human
ucuugcuauguugccuaagcugg

SEQ ID NO: 621020 - RNA, 24 nt, Human
ucuugcuauguugccuaagcuggu

SEQ ID NO: 621021 - RNA, 20 nt, Human
ugaaauagaccccagucucc

SEQ ID NO: 621022 - RNA, 19 nt, Human
ugaagcagcuuugaaacug

SEQ ID NO: 621023 - RNA, 19 nt, Human
ugacaauggugcccaaaac

SEQ ID NO: 621024 - RNA, 22 nt, Human
ugaccaugcuggcacucugauc

SEQ ID NO: 621025 - RNA, 19 nt, Human
ugagaagugagguacugca

SEQ ID NO: 621026 - RNA, 19 nt, Human
ugaggcaggagaaucacug

SEQ ID NO: 621027 - RNA, 21 nt, Human
ugaggcaggagaaucacugga

SEQ ID NO: 621028 - RNA, 23 nt, Human
ugaggcaggagaaucacuggaac

SEQ ID NO: 621029 - RNA, 23 nt, Human
ugaggcaggagaaucacuggaac

SEQ ID NO: 621030 - RNA, 25 nt, Human
ugaggcaggagaaucacuggaacuc

SEQ ID NO: 621031 - RNA, 18 nt, Human
ugaggugucauuggggaa

SEQ ID NO: 621032 - RNA, 25 nt, Human
ugagugcuuacaggaaaaugugcug

SEQ ID NO: 621033 - RNA, 27 nt, Human
ugagugcuuacaggaaaaugugcuggg

SEQ ID NO: 621034 - RNA, 22 nt, Human
ugaucucgcccugccuccacuu

SEQ ID NO: 621035 - RNA, 20 nt, Human
ugaugaucuuugcacugcca

SEQ ID NO: 621036 - RNA, 23 nt, Human
ugaugccaagaucgccucagggc

SEQ ID NO: 621037 - RNA, 21 nt, Human
ugaugucugccccggacaccc

SEQ ID NO: 621038 - RNA, 19 nt, Human
ugcacuccagccugggcaa

SEQ ID NO: 621039 - RNA, 22 nt, Human
ugcacuccagccugggcaacaa

SEQ ID NO: 621040 - RNA, 22 nt, Human
ugccaauaauuaaagauggcaa

SEQ ID NO: 621041 - RNA, 19 nt, Human
ugcgguauucucuuauggu

SEQ ID NO: 621042 - RNA, 22 nt, Human
uggaucaccaaaggucagaucu

SEQ ID NO: 621043 - RNA, 20 nt, Human
uggcagccacuaaccaacag

SEQ ID NO: 621044 - RNA, 22 nt, Human
uggcucaggccuguaaucccag

SEQ ID NO: 621045 - RNA, 24 nt, Human
uggcucaggccuguaaucccagca

SEQ ID NO: 621046 - RNA, 24 nt, Human
uggcugaagccauggcagaaaaac

SEQ ID NO: 621047 - RNA, 21 nt, Human
ugggacaaacucuguucaagc

SEQ ID NO: 621048 - RNA, 24 nt, Human
ugggaggccaaggcagguggauca

SEQ ID NO: 621049 - RNA, 24 nt, Human
uggggucuugcuauguugccuaag

SEQ ID NO: 621050 - RNA, 21 nt, Human
uggguuagggucuccacgacc

SEQ ID NO: 621051 - RNA, 23 nt, Human
ugguaaggguuauucuggugagg

SEQ ID NO: 621052 - RNA, 23 nt, Human
uguaaaaacuggauauaaagaaa

SEQ ID NO: 621053 - RNA, 18 nt, Human
uguauauauauguauaua

SEQ ID NO: 621054 - RNA, 22 nt, Human
uguauauauauguauauauaua

SEQ ID NO: 621055 - RNA, 20 nt, Human
uguauauauauguauauauu

SEQ ID NO: 621056 - RNA, 20 nt, Human
uguauauuaccucaggaccc

SEQ ID NO: 621057 - RNA, 20 nt, Human
ugucugugacccacaccuau

SEQ ID NO: 621058 - RNA, 20 nt, Human
ugugcagcggguuaaaauca

SEQ ID NO: 621059 - RNA, 22 nt, Human
ugugcugggaacaggcccccca

SEQ ID NO: 621060 - RNA, 20 nt, Human
uguguauauauauguauaua

SEQ ID NO: 621061 - RNA, 19 nt, Human
uguugcaggaagucaggga

SEQ ID NO: 621062 - RNA, 21 nt, Human
uguuuaucacaggcuuacugu

SEQ ID NO: 621063 - RNA, 26 nt, Human
uuaauacuuuuauaauuucuuaugcc

SEQ ID NO: 621064 - RNA, 27 nt, Human
uuaaugcuaugaucuuaggaaucuaau

SEQ ID NO: 621065 - RNA, 19 nt, Human
uuagguaccaucaugagcu

SEQ ID NO: 621066 - RNA, 22 nt, Human
uuagucagaccaguugaucuca

SEQ ID NO: 621067 - RNA, 20 nt, Human
uucacuccugacaugcucug

SEQ ID NO: 621068 - RNA, 24 nt, Human
uucauggacacuuaucacuucccc

SEQ ID NO: 621069 - RNA, 24 nt, Human
uucauggacauuuauuaguucccc

SEQ ID NO: 621070 - RNA, 26 nt, Human
uuccuaaaccacaaacaauagcauga

SEQ ID NO: 621071 - RNA, 22 nt, Human
uuccugagugcuuacaggaaaa

SEQ ID NO: 621072 - RNA, 19 nt, Human
uucuaagccauuuggucug

SEQ ID NO: 621073 - RNA, 21 nt, Human
uucucagccuauccauacugc

SEQ ID NO: 621074 - RNA, 22 nt, Human
uugagauggggucuugcuaugu

SEQ ID NO: 621075 - RNA, 20 nt, Human
uugcggugagccaagaucau

SEQ ID NO: 621076 - RNA, 19 nt, Human
uuuaggaaacaagagagaa

SEQ ID NO: 621077 - RNA, 24 nt, Human
uuuaucaguaaauaaacaugauca

SEQ ID NO: 621078 - RNA, 22 nt, Human
uuuuguacucugucccuuuauu

SEQ ID NO: 621079 - RNA, 24 nt, Human
uuuuuuuuuugagauggggucuug

SEQ ID NO: 621080 - RNA, 19 nt, Human
aagcaauagaaacugucca

SEQ ID NO: 621081 - RNA, 18 nt, Human
aagggauggaaaaaagga

SEQ ID NO: 621082 - RNA, 21 nt, Human
acccuccgcccucuuccgccg

SEQ ID NO: 621083 - RNA, 18 nt, Human
agggauggaaaaaaggaa

SEQ ID NO: 621084 - RNA, 22 nt, Human
caccauggacgcccacccggag

SEQ ID NO: 621085 - RNA, 18 nt, Human
cacccggaguuucaccgc

SEQ ID NO: 621086 - RNA, 21 nt, Human
caccgcugccgcgggaccccc

SEQ ID NO: 621087 - RNA, 19 nt, Human
caccuccuccgcggagacc

SEQ ID NO: 621088 - RNA, 21 nt, Human
cagcaccauggacgcccaccc

SEQ ID NO: 621089 - RNA, 24 nt, Human
cagcaccauggacgcccacccgga

SEQ ID NO: 621090 - RNA, 23 nt, Human
cagcagcaccauggacgcccacc

SEQ ID NO: 621091 - RNA, 18 nt, Human
caucccacuacccuccgc

SEQ ID NO: 621092 - RNA, 19 nt, Human
caucccacuacccuccgcc

SEQ ID NO: 621093 - RNA, 19 nt, Human
ccauggacgcccacccgga

SEQ ID NO: 621094 - RNA, 20 nt, Human
cccacuacccuccgcccucu

SEQ ID NO: 621095 - RNA, 19 nt, Human
ccccaucccacuacccucc

SEQ ID NO: 621096 - RNA, 20 nt, Human
ccccccgcccacuccacaca

SEQ ID NO: 621097 - RNA, 22 nt, Human
cccucuuccgccgccgccgcua

SEQ ID NO: 621098 - RNA, 23 nt, Human
cgcccacuccacacacucuccca

SEQ ID NO: 621099 - RNA, 21 nt, Human
cgccgccuccuccaccuccuc

SEQ ID NO: 621100 - RNA, 19 nt, Human
cggcugcgaugggcauggc

SEQ ID NO: 621101 - RNA, 22 nt, Human
cuacccuccgcccucuuccgcc

SEQ ID NO: 621102 - RNA, 21 nt, Human
cucuuccgccgccgccgccgc

SEQ ID NO: 621103 - RNA, 20 nt, Human
cugccgcgggacccccaucc

SEQ ID NO: 621104 - RNA, 21 nt, Human
gacccccaucccacuacccuc

SEQ ID NO: 621105 - RNA, 21 nt, Human
gggcauggcucaggggcccgg

SEQ ID NO: 621106 - RNA, 22 nt, Human
gggcauggcucaggggcccggg

SEQ ID NO: 621107 - RNA, 18 nt, Human
ucaggggcccggggagga

SEQ ID NO: 621108 - RNA, 22 nt, Human
ucccacuacccuccgcccucuu

SEQ ID NO: 621109 - RNA, 20 nt, Human
uccgcggagaccccccgccc

SEQ ID NO: 621110 - RNA, 27 nt, Human
uccgcggagaccccccgcccacuccaa

SEQ ID NO: 621111 - RNA, 27 nt, Human
ucuuccgccgccgccgccgccuccucc

SEQ ID NO: 621112 - RNA, 22 nt, Human
ugccgcgggacccccaucccac

SEQ ID NO: 621113 - RNA, 24 nt, Human
ugcgaugggcauggcucaggggcc

SEQ ID NO: 621114 - RNA, 21 nt, Human
uggacgcccacccggaguuuc

SEQ ID NO: 621115 - RNA, 23 nt, Human
ugggcauggcucaggggcccggg

SEQ ID NO: 621116 - RNA, 19 nt, Human
uguucaguugcuuucaaau

SEQ ID NO: 621117 - RNA, 24 nt, Human
uuuuuuuuuuuuuuuuuuaauuag

SEQ ID NO: 621118 - RNA, 28 nt, Human
aaaaagaagcaaagaaaaguaaaaagga

SEQ ID NO: 621119 - RNA, 21 nt, Human
aaaacuaaaaagaagcaaaga

SEQ ID NO: 621120 - RNA, 24 nt, Human
aaacuaaaaagaagcaaagaaaag

SEQ ID NO: 621121 - RNA, 19 nt, Human
aaagaaaaaaagaaagaaa

SEQ ID NO: 621122 - RNA, 22 nt, Human
aaagaaaaaaagaaagaaagag

SEQ ID NO: 621123 - RNA, 21 nt, Human
aaagaugcagaauuuaucagu

SEQ ID NO: 621124 - RNA, 19 nt, Human
aaagugcugggauuacagg

SEQ ID NO: 621125 - RNA, 19 nt, Human
aaagugcugggauuacagg

SEQ ID NO: 621126 - RNA, 23 nt, Human
aaagugcugggauuacagguauu

SEQ ID NO: 621127 - RNA, 18 nt, Human
aacccauuccugucccca

SEQ ID NO: 621128 - RNA, 22 nt, Human
aacucccgggcccaagcaaucc

SEQ ID NO: 621129 - RNA, 31 nt, Human
aagaaaaaaacuaaaaagaagcaaagaaaaa

SEQ ID NO: 621130 - RNA, 21 nt, Human
aagaagaaaaaaacuaaaaag

SEQ ID NO: 621131 - RNA, 25 nt, Human
aagaagcaaagaaaaguaaaaagga

SEQ ID NO: 621132 - RNA, 23 nt, Human
aagcaaaaauaacuucaagcuau

SEQ ID NO: 621133 - RNA, 25 nt, Human
aagcaauccucuugccucagccucc

SEQ ID NO: 621134 - RNA, 24 nt, Human
aagcauaaaaucaauuagcaucau

SEQ ID NO: 621135 - RNA, 18 nt, Human
aagugcugggauuacagg

SEQ ID NO: 621136 - RNA, 19 nt, Human
aagugcugggauuacaggu

SEQ ID NO: 621137 - RNA, 20 nt, Human
aaguuuucaugaagcaaucc

SEQ ID NO: 621138 - RNA, 24 nt, Human
acccauuccuguccccaguucccu

SEQ ID NO: 621139 - RNA, 24 nt, Human
agaaaaagcaaaaauaacuucaag

SEQ ID NO: 621140 - RNA, 26 nt, Human
agaaaaagucugacaauuccgacgac

SEQ ID NO: 621141 - RNA, 20 nt, Human
agaaagaaaaaaagaaagaa

SEQ ID NO: 621142 - RNA, 27 nt, Human
agagagaaaauggaauaaaagggaccc

SEQ ID NO: 621143 - RNA, 22 nt, Human
agagagaaaauggaauaaaagu

SEQ ID NO: 621144 - RNA, 19 nt, Human
agcaauccucuugccucag

SEQ ID NO: 621145 - RNA, 25 nt, Human
agcaauccucuugccucagccuccu

SEQ ID NO: 621146 - RNA, 18 nt, Human
aggaagaagaaaaaaacu

SEQ ID NO: 621147 - RNA, 19 nt, Human
aggaagaagaaaaaaacua

SEQ ID NO: 621148 - RNA, 24 nt, Human
aggaagaagaaaaaaacuaaaaag

SEQ ID NO: 621149 - RNA, 25 nt, Human
aggaagaagaaaaaaacuaaaaaga

SEQ ID NO: 621150 - RNA, 26 nt, Human
aggaagaagaaaaaaacuaaaaagaa

SEQ ID NO: 621151 - RNA, 23 nt, Human
aguuacuaguauaaugcaccaaa

SEQ ID NO: 621152 - RNA, 18 nt, Human
auagcucacugcaacuuc

SEQ ID NO: 621153 - RNA, 20 nt, Human
auccucuugccucagccucc

SEQ ID NO: 621154 - RNA, 19 nt, Human
auggcugcucucacacuac

SEQ ID NO: 621155 - RNA, 19 nt, Human
auuccuguccccaguuccc

SEQ ID NO: 621156 - RNA, 22 nt, Human
caaaacagggucucauucuguc

SEQ ID NO: 621157 - RNA, 25 nt, Human
caaacucccgggcccaagcaauccu

SEQ ID NO: 621158 - RNA, 26 nt, Human
caaagugcugggauuacagguauuuu

SEQ ID NO: 621159 - RNA, 24 nt, Human
caacuucaaacucccgggcccaag

SEQ ID NO: 621160 - RNA, 27 nt, Human
caagugauccuccuguguuggccuccc

SEQ ID NO: 621161 - RNA, 24 nt, Human
cacaaagauuacauggcucacaaa

SEQ ID NO: 621162 - RNA, 21 nt, Human
cacugcaacuucaaacucccg

SEQ ID NO: 621163 - RNA, 23 nt, Human
cacugcaacuucaaacucccggg

SEQ ID NO: 621164 - RNA, 21 nt, Human
cagaaagaaaaaaagaaagaa

SEQ ID NO: 621165 - RNA, 24 nt, Human
caggaucucguuauaaugcccagg

SEQ ID NO: 621166 - RNA, 18 nt, Human
cauggcucacaaagucua

SEQ ID NO: 621167 - RNA, 18 nt, Human
cauucaaacccauuccug

SEQ ID NO: 621168 - RNA, 21 nt, Human
cauucaaacccauuccugucc

SEQ ID NO: 621169 - RNA, 22 nt, Human
cauucugucacccagguuagug

SEQ ID NO: 621170 - RNA, 21 nt, Human
ccaaagugcugggauuacagg

SEQ ID NO: 621171 - RNA, 21 nt, Human
ccaaagugcugggauuacagg

SEQ ID NO: 621172 - RNA, 22 nt, Human
ccaaagugcugggauuacaggu

SEQ ID NO: 621173 - RNA, 24 nt, Human
ccaaagugcugggauuacagguau

SEQ ID NO: 621174 - RNA, 18 nt, Human
cccgggcccaagcaaucc

SEQ ID NO: 621175 - RNA, 24 nt, Human
ccucuugccucagccuccugauua

SEQ ID NO: 621176 - RNA, 21 nt, Human
cucacugcaacuucaaacucc

SEQ ID NO: 621177 - RNA, 24 nt, Human
cucacugcaacuucaaacucccgg

SEQ ID NO: 621178 - RNA, 25 nt, Human
cucucacacuacaauggcagaguua

SEQ ID NO: 621179 - RNA, 19 nt, Human
cugauuagcugggacuaca

SEQ ID NO: 621180 - RNA, 20 nt, Human
cuucuagugaacuguuuuca

SEQ ID NO: 621181 - RNA, 24 nt, Human
cuugccucagccuccugauuagcu

SEQ ID NO: 621182 - RNA, 27 nt, Human
gaaaaaaacuaaaaagaagcaaagaaa

SEQ ID NO: 621183 - RNA, 23 nt, Human
gaagaaaaaaacuaaaaagaagc

SEQ ID NO: 621184 - RNA, 19 nt, Human
ggaagaagaaaaaaacuaa

SEQ ID NO: 621185 - RNA, 22 nt, Human
guuccagaaagaaaaaaagaaa

SEQ ID NO: 621186 - RNA, 24 nt, Human
uaaaaagaagcaaagaaaaguaaa

SEQ ID NO: 621187 - RNA, 19 nt, Human
uaagaaaaagcaaaaauaa

SEQ ID NO: 621188 - RNA, 20 nt, Human
uaaguagaugccacaaagaa

SEQ ID NO: 621189 - RNA, 19 nt, Human
uaauaaaaacaaucacgua

SEQ ID NO: 621190 - RNA, 24 nt, Human
uagaaaaagucugacaauuccuaa

SEQ ID NO: 621191 - RNA, 20 nt, Human
uagcccacuagcuauuuuua

SEQ ID NO: 621192 - RNA, 24 nt, Human
uauaaugcccaggcuugucucaaa

SEQ ID NO: 621193 - RNA, 21 nt, Human
uaucagcauccuauuuuuucu

SEQ ID NO: 621194 - RNA, 22 nt, Human
uaucuaagaaaaagcaaaaaua

SEQ ID NO: 621195 - RNA, 21 nt, Human
ucaaacccauuccugucccca

SEQ ID NO: 621196 - RNA, 23 nt, Human
ucaaaguacauaauuuauaucag

SEQ ID NO: 621197 - RNA, 24 nt, Human
ucacugcaacuucaaacucccggg

SEQ ID NO: 621198 - RNA, 18 nt, Human
ucagcauccuauuuuuuc

SEQ ID NO: 621199 - RNA, 23 nt, Human
uccagaaagaaaaaaagaaagaa

SEQ ID NO: 621200 - RNA, 24 nt, Human
uccagaaagaaaaaaagaaagaaa

SEQ ID NO: 621201 - RNA, 25 nt, Human
uccagaaagaaaaaaagaaagaaag

SEQ ID NO: 621202 - RNA, 23 nt, Human
ucccaaagugcugggauuacagg

SEQ ID NO: 621203 - RNA, 21 nt, Human
ucccgggcccaagcaauccuc

SEQ ID NO: 621204 - RNA, 23 nt, Human
ucccgggcccaagcaauccucuu

SEQ ID NO: 621205 - RNA, 22 nt, Human
uccuguccccaguucccucacc

SEQ ID NO: 621206 - RNA, 21 nt, Human
ucuaaaauauuuacuguuugg

SEQ ID NO: 621207 - RNA, 19 nt, Human
ucucauucugucacccagg

SEQ ID NO: 621208 - RNA, 19 nt, Human
ucucauucugucacccagg

SEQ ID NO: 621209 - RNA, 22 nt, Human
ucucauucugucacccagguua

SEQ ID NO: 621210 - RNA, 23 nt, Human
ucucauucugucacccagguuag

SEQ ID NO: 621211 - RNA, 24 nt, Human
ucugucacccagguuagugugcaa

SEQ ID NO: 621212 - RNA, 20 nt, Human
ugacaauauaauaaaaacaa

SEQ ID NO: 621213 - RNA, 20 nt, Human
ugccauugaugaaacgucaa

SEQ ID NO: 621214 - RNA, 24 nt, Human
ugccucagccuccugauuagcugg

SEQ ID NO: 621215 - RNA, 23 nt, Human
ugcugggauuacagguauuuuga

SEQ ID NO: 621216 - RNA, 24 nt, Human
ugcugggauuacagguauuuugag

SEQ ID NO: 621217 - RNA, 21 nt, Human
uggaauaaaaguuugugagua

SEQ ID NO: 621218 - RNA, 19 nt, Human
uggcaagcuaucaccaugg

SEQ ID NO: 621219 - RNA, 24 nt, Human
ugggacuacaggagugcaacacca

SEQ ID NO: 621220 - RNA, 24 nt, Human
uggugcauucauagcucacugcaa

SEQ ID NO: 621221 - RNA, 21 nt, Human
ugucucaaacuccagucucaa

SEQ ID NO: 621222 - RNA, 23 nt, Human
uguguuggccucccaaagugcug

SEQ ID NO: 621223 - RNA, 18 nt, Human
uuagcaucauucauuuag

SEQ ID NO: 621224 - RNA, 21 nt, Human
uucccucaccacagguuccua

SEQ ID NO: 621225 - RNA, 26 nt, Human
uuuaggaagaagaaaaaaacuaaaaa

SEQ ID NO: 621226 - RNA, 22 nt, Human
uuugagacuuuuuuaaagaugc

SEQ ID NO: 621227 - RNA, 18 nt, Human
uuuuuuuucaaaacaggg

SEQ ID NO: 621228 - RNA, 23 nt, Human
uuuuuuuuuuucaaaacaggguc

SEQ ID NO: 621229 - RNA, 26 nt, Human
uuuuuuuuuuucaaaacagggucuca

SEQ ID NO: 621230 - RNA, 24 nt, Human
uuuuuuuuuuuuuucaaaacaggg

SEQ ID NO: 621231 - RNA, 21 nt, Human
aaaagaaagaaggucuuccaa

SEQ ID NO: 621232 - RNA, 22 nt, Human
acaguggucucuucccuguccu

SEQ ID NO: 621233 - RNA, 20 nt, Human
accagcacacccuaggcaga

SEQ ID NO: 621234 - RNA, 21 nt, Human
accucuggggagggagcaagu

SEQ ID NO: 621235 - RNA, 20 nt, Human
caguggucucuucccugucc

SEQ ID NO: 621236 - RNA, 21 nt, Human
ccccgcugggaccuucucucu

SEQ ID NO: 621237 - RNA, 23 nt, Human
ccccgcugggaccuucucucuca

SEQ ID NO: 621238 - RNA, 19 nt, Human
ccucuggggagggagcaag

SEQ ID NO: 621239 - RNA, 24 nt, Human
cgcucuguugcccaggcuggagug

SEQ ID NO: 621240 - RNA, 21 nt, Human
cgcuuugcccugaaaccugua

SEQ ID NO: 621241 - RNA, 21 nt, Human
cucacaguccucuccacaguc

SEQ ID NO: 621242 - RNA, 21 nt, Human
cuccacagucauuggccaagc

SEQ ID NO: 621243 - RNA, 21 nt, Human
cucgcucuguugcccaggcug

SEQ ID NO: 621244 - RNA, 24 nt, Human
cucgcucuguugcccaggcuggag

SEQ ID NO: 621245 - RNA, 19 nt, Human
gcccaggcuggagugcagu

SEQ ID NO: 621246 - RNA, 25 nt, Human
gcucuguugcccaggcuggagugca

SEQ ID NO: 621247 - RNA, 21 nt, Human
gcuggagugcaguggucucug

SEQ ID NO: 621248 - RNA, 24 nt, Human
uauuuauuuauugagauggagucu

SEQ ID NO: 621249 - RNA, 25 nt, Human
uauuuauuuauuuauuuauuuauug

SEQ ID NO: 621250 - RNA, 24 nt, Human
ucgcucuguugcccaggcuggagu

SEQ ID NO: 621251 - RNA, 19 nt, Human
ucucgcucuguugcccagg

SEQ ID NO: 621252 - RNA, 23 nt, Human
ucucgcucuguugcccaggcugg

SEQ ID NO: 621253 - RNA, 24 nt, Human
ucucgcucuguugcccaggcugga

SEQ ID NO: 621254 - RNA, 26 nt, Human
ucucgcucuguugcccaggcuggagu

SEQ ID NO: 621255 - RNA, 18 nt, Human
ucuguugcccaggcugga

SEQ ID NO: 621256 - RNA, 24 nt, Human
ucuguugcccaggcuggagugcag

SEQ ID NO: 621257 - RNA, 22 nt, Human
ucuuauuccucuggcugucauc

SEQ ID NO: 621258 - RNA, 20 nt, Human
ugaaaaggacaaaccagcaa

SEQ ID NO: 621259 - RNA, 22 nt, Human
ugagauggagucucgcucuguu

SEQ ID NO: 621260 - RNA, 18 nt, Human
ugcccaggcuggagugca

SEQ ID NO: 621261 - RNA, 21 nt, Human
ugcccaggcuggagugcagug

SEQ ID NO: 621262 - RNA, 22 nt, Human
ugcccaggcuggagugcagugg

SEQ ID NO: 621263 - RNA, 22 nt, Human
ugcccugaaaccuguaccagac

SEQ ID NO: 621264 - RNA, 20 nt, Human
ugccugagcuucacuggccc

SEQ ID NO: 621265 - RNA, 19 nt, Human
uggaccaaguguuuaccuc

SEQ ID NO: 621266 - RNA, 20 nt, Human
uggaccaaguguuuaccucu

SEQ ID NO: 621267 - RNA, 24 nt, Human
uggagucucgcucuguugcccagg

SEQ ID NO: 621268 - RNA, 21 nt, Human
uggagugcaguggucucugca

SEQ ID NO: 621269 - RNA, 25 nt, Human
uugcccaggcuggagugcagugguc

SEQ ID NO: 621270 - RNA, 22 nt, Human
uuuauuuauuuauuuauuuauu

SEQ ID NO: 621271 - RNA, 24 nt, Human
uuuuuucuuuuuaaaaaauauuua

SEQ ID NO: 621272 - RNA, 26 nt, Human
uuuuuuuuuucuuuuuuuuucuuuuu

SEQ ID NO: 621273 - RNA, 25 nt, Human
uuuuuuuuuuuuuuuuuuucuuuuu

SEQ ID NO: 621274 - RNA, 25 nt, Human
aaaaaaaaaucuuucaacuuauaga

SEQ ID NO: 621275 - RNA, 21 nt, Human
aaaaaccccgcgacagucccc

SEQ ID NO: 621276 - RNA, 21 nt, Human
aaaagcaaaaaaaugaaacac

SEQ ID NO: 621277 - RNA, 30 nt, Human
aaacaaaaaugaaacuaaaagcagaccugg

SEQ ID NO: 621278 - RNA, 20 nt, Human
aaaccacaacagaaaaaccc

SEQ ID NO: 621279 - RNA, 20 nt, Human
aaagcccacgggaaaggucc

SEQ ID NO: 621280 - RNA, 19 nt, Human
aaccacaacagaaaaaccc

SEQ ID NO: 621281 - RNA, 20 nt, Human
aagcaaaaaaaugaaacacc

SEQ ID NO: 621282 - RNA, 22 nt, Human
aauaaaccacaacagaaaaacc

SEQ ID NO: 621283 - RNA, 20 nt, Human
acaacagaaaaaccccgcga

SEQ ID NO: 621284 - RNA, 18 nt, Human
acaguccccccuccagcu

SEQ ID NO: 621285 - RNA, 24 nt, Human
accccgcgacaguccccccuccag

SEQ ID NO: 621286 - RNA, 20 nt, Human
accugcacacaccugugcac

SEQ ID NO: 621287 - RNA, 22 nt, Human
acucaccagagcccuggcaaca

SEQ ID NO: 621288 - RNA, 20 nt, Human
agaaaaaccccgcgacaguc

SEQ ID NO: 621289 - RNA, 22 nt, Human
agaccaggggccagguggggga

SEQ ID NO: 621290 - RNA, 19 nt, Human
agcaguuguguuugaaggc

SEQ ID NO: 621291 - RNA, 20 nt, Human
agcgagggcugccucggcca

SEQ ID NO: 621292 - RNA, 19 nt, Human
agcuucuggaaucccugcu

SEQ ID NO: 621293 - RNA, 21 nt, Human
aggcagucaaagacugggagc

SEQ ID NO: 621294 - RNA, 23 nt, Human
aggcguucagcuggagcgagggc

SEQ ID NO: 621295 - RNA, 19 nt, Human
agggcugccucggccaucc

SEQ ID NO: 621296 - RNA, 21 nt, Human
aggggcuguggcaccaugagc

SEQ ID NO: 621297 - RNA, 23 nt, Human
agucaaagacugggagccuaaga

SEQ ID NO: 621298 - RNA, 18 nt, Human
aguuguguuugaaggcgg

SEQ ID NO: 621299 - RNA, 23 nt, Human
caaaaaaaaaaagucugaaagca

SEQ ID NO: 621300 - RNA, 24 nt, Human
caaaaaugaaacuaaaagcagacc

SEQ ID NO: 621301 - RNA, 20 nt, Human
caacagaaaaaccccgcgac

SEQ ID NO: 621302 - RNA, 22 nt, Human
caagguccacuuuucugcuggu

SEQ ID NO: 621303 - RNA, 20 nt, Human
caccagagcccuggcaacaa

SEQ ID NO: 621304 - RNA, 22 nt, Human
caccaugagccgcccacccucc

SEQ ID NO: 621305 - RNA, 24 nt, Human
cagcaaccccuagguuuaaggaca

SEQ ID NO: 621306 - RNA, 20 nt, Human
cagcaauggaggcguucagc

SEQ ID NO: 621307 - RNA, 19 nt, Human
cagcccuucgccucugccc

SEQ ID NO: 621308 - RNA, 22 nt, Human
caggagcagaaccagcccccaa

SEQ ID NO: 621309 - RNA, 22 nt, Human
caggggcuguggcaccaugagc

SEQ ID NO: 621310 - RNA, 23 nt, Human
caucgaaaugaauagaaaaaagg

SEQ ID NO: 621311 - RNA, 23 nt, Human
caugagccgcccacccuccaggg

SEQ ID NO: 621312 - RNA, 25 nt, Human
ccacaucguccucuguugggucccg

SEQ ID NO: 621313 - RNA, 19 nt, Human
ccacccuccagggcacagg

SEQ ID NO: 621314 - RNA, 18 nt, Human
ccagcccccuagcccuga

SEQ ID NO: 621315 - RNA, 18 nt, Human
ccauggccguggccucug

SEQ ID NO: 621316 - RNA, 18 nt, Human
ccauggccguggccucug

SEQ ID NO: 621317 - RNA, 24 nt, Human
cccaccagcccuucgccucugccc

SEQ ID NO: 621318 - RNA, 19 nt, Human
cccacgggaaagguccccc

SEQ ID NO: 621319 - RNA, 22 nt, Human
cccaugcgcaucacagugucca

SEQ ID NO: 621320 - RNA, 27 nt, Human
cccauggccauggccguggccucuguu

SEQ ID NO: 621321 - RNA, 20 nt, Human
ccccgcgacaguccccccuc

SEQ ID NO: 621322 - RNA, 21 nt, Human
cccgcgacaguccccccucca

SEQ ID NO: 621323 - RNA, 22 nt, Human
ccgcccgugugccggcaggggc

SEQ ID NO: 621324 - RNA, 18 nt, Human
ccggccgucccugccagg

SEQ ID NO: 621325 - RNA, 24 nt, Human
ccuagcccugaugaaacuuugcag

SEQ ID NO: 621326 - RNA, 20 nt, Human
ccuagguuuaaggacagguu

SEQ ID NO: 621327 - RNA, 23 nt, Human
ccucccaggagcaaggccagggu

SEQ ID NO: 621328 - RNA, 19 nt, Human
cgcuggccuugcccaugcg

SEQ ID NO: 621329 - RNA, 22 nt, Human
cgggaaaggucccccagcgaug

SEQ ID NO: 621330 - RNA, 20 nt, Human
cgggccggccgucccugccg

SEQ ID NO: 621331 - RNA, 20 nt, Human
cguggucagcccauucacuc

SEQ ID NO: 621332 - RNA, 24 nt, Human
cucauggagacauacguauguacg

SEQ ID NO: 621333 - RNA, 21 nt, Human
cucucuccauuuuuauuuucu

SEQ ID NO: 621334 - RNA, 24 nt, Human
cucugcccauggccauggccgugg

SEQ ID NO: 621335 - RNA, 19 nt, Human
cugucagucagucacgggg

SEQ ID NO: 621336 - RNA, 22 nt, Human
cuucggucauucugaacucacc

SEQ ID NO: 621337 - RNA, 24 nt, Human
gaaaagcaaaaaaaugaaacaccc

SEQ ID NO: 621338 - RNA, 22 nt, Human
gacagguucuaaacuagaccca

SEQ ID NO: 621339 - RNA, 20 nt, Human
gagccgcccacccuccaggg

SEQ ID NO: 621340 - RNA, 22 nt, Human
gcaauggaggcguucagcugga

SEQ ID NO: 621341 - RNA, 20 nt, Human
gcagcuucuggaaucccugc

SEQ ID NO: 621342 - RNA, 20 nt, Human
gcauggguaggaaaaccagg

SEQ ID NO: 621343 - RNA, 19 nt, Human
gccaacaauccucucucca

SEQ ID NO: 621344 - RNA, 22 nt, Human
gccaacaauccucucuccauuu

SEQ ID NO: 621345 - RNA, 22 nt, Human
gcccacgggaaaggucccccag

SEQ ID NO: 621346 - RNA, 21 nt, Human
gcccuggcaacaaucuccccu

SEQ ID NO: 621347 - RNA, 19 nt, Human
gccugcaagagacacggaa

SEQ ID NO: 621348 - RNA, 23 nt, Human
ggcaaacuaaaggcaaagagaga

SEQ ID NO: 621349 - RNA, 18 nt, Human
ggcccuacaaaaaaaaaa

SEQ ID NO: 621350 - RNA, 20 nt, Human
ggucccguucaagcgcucgu

SEQ ID NO: 621351 - RNA, 20 nt, Human
gguuggaccugcucccggcu

SEQ ID NO: 621352 - RNA, 20 nt, Human
gucuccagaacaagcagcaa

SEQ ID NO: 621353 - RNA, 18 nt, Human
gucuccuucaaggccacc

SEQ ID NO: 621354 - RNA, 22 nt, Human
gucuggaaggugcgggggcggg

SEQ ID NO: 621355 - RNA, 22 nt, Human
guucaagcgcucguuucugacu

SEQ ID NO: 621356 - RNA, 19 nt, Human
guucagcuggagcgagggc

SEQ ID NO: 621357 - RNA, 23 nt, Human
uaaacuagacccaaacggaaauc

SEQ ID NO: 621358 - RNA, 23 nt, Human
uaaagggaauuacaaaaaaaaaa

SEQ ID NO: 621359 - RNA, 26 nt, Human
uacaaaaaaaaaaagucugaaagcaa

SEQ ID NO: 621360 - RNA, 18 nt, Human
uagaccaggggccaggug

SEQ ID NO: 621361 - RNA, 22 nt, Human
uccagaacaagcagcaauggag

SEQ ID NO: 621362 - RNA, 21 nt, Human
ucccugcuucucuggcugggu

SEQ ID NO: 621363 - RNA, 21 nt, Human
ucccuuaaugggcagcuucug

SEQ ID NO: 621364 - RNA, 20 nt, Human
uccuucaaggccaccguggu

SEQ ID NO: 621365 - RNA, 23 nt, Human
uccuuggguuggaccugcucccg

SEQ ID NO: 621366 - RNA, 24 nt, Human
uccuuggguuggaccugcucccgg

SEQ ID NO: 621367 - RNA, 24 nt, Human
ucgggcaaacuaaaggcaaagaga

SEQ ID NO: 621368 - RNA, 22 nt, Human
ucuaaagggaauuacaaaaaaa

SEQ ID NO: 621369 - RNA, 18 nt, Human
ucugccuaugaggcggca

SEQ ID NO: 621370 - RNA, 21 nt, Human
ucuugcucuccacaucguccu

SEQ ID NO: 621371 - RNA, 23 nt, Human
ugaaacuaaaagcagaccugauc

SEQ ID NO: 621372 - RNA, 23 nt, Human
ugaggucuugccucugcagcaug

SEQ ID NO: 621373 - RNA, 23 nt, Human
ugaggugauuaaaaaaaaaaaaa

SEQ ID NO: 621374 - RNA, 18 nt, Human
ugcgcauguccacgggcc

SEQ ID NO: 621375 - RNA, 19 nt, Human
ugcgcauguccacgggccc

SEQ ID NO: 621376 - RNA, 22 nt, Human
uggcaacaaucuccccucgugc

SEQ ID NO: 621377 - RNA, 19 nt, Human
uggccguggccucuguugc

SEQ ID NO: 621378 - RNA, 20 nt, Human
ugggaaggcagucaaagacu

SEQ ID NO: 621379 - RNA, 19 nt, Human
ugggacgggaaagaaacaa

SEQ ID NO: 621380 - RNA, 21 nt, Human
ugggcagcuucuggaaucccu

SEQ ID NO: 621381 - RNA, 18 nt, Human
ugucagucagucacgggg

SEQ ID NO: 621382 - RNA, 24 nt, Human
uuaacuccaucaucaugaggugau

SEQ ID NO: 621383 - RNA, 20 nt, Human
uuaaugggcagcuucuggaa

SEQ ID NO: 621384 - RNA, 20 nt, Human
uucaaggccaccguggucag

SEQ ID NO: 621385 - RNA, 24 nt, Human
uuccucacggaaccaguuuuuaaa

SEQ ID NO: 621386 - RNA, 22 nt, Human
uucuggggguuaaaugagccuu

SEQ ID NO: 621387 - RNA, 22 nt, Human
uucuucaguuuguucuucugcu

SEQ ID NO: 621388 - RNA, 18 nt, Human
uugcccucagcaauccuu

SEQ ID NO: 621389 - RNA, 23 nt, Human
uugcccucagcaauccuuggguu

SEQ ID NO: 621390 - RNA, 20 nt, Human
uuggguuggaccugcucccg

SEQ ID NO: 621391 - RNA, 18 nt, Human
uuuuuuuuuuucuggggg

SEQ ID NO: 621392 - RNA, 19 nt, Human
uuuuuuuuuuucugggggu

SEQ ID NO: 621393 - RNA, 18 nt, Human
uuuuuuuuuuuuuuucug

SEQ ID NO: 621394 - RNA, 24 nt, Human
aaacaaaauuuaagaauccaaagc

SEQ ID NO: 621395 - RNA, 20 nt, Human
aaaugaauacugccuugcuc

SEQ ID NO: 621396 - RNA, 21 nt, Human
aacagcaccacugagcucacc

SEQ ID NO: 621397 - RNA, 25 nt, Human
aacagcaccacugagcucaccugau

SEQ ID NO: 621398 - RNA, 22 nt, Human
aaccuacaacagcaccacugag

SEQ ID NO: 621399 - RNA, 21 nt, Human
aagcacauuuuaagaaguaaa

SEQ ID NO: 621400 - RNA, 20 nt, Human
aagcauuuuaaauaaaaguu

SEQ ID NO: 621401 - RNA, 24 nt, Human
aagccagaaacaucacuuaggaaa

SEQ ID NO: 621402 - RNA, 22 nt, Human
accagcaucauccucacaaaua

SEQ ID NO: 621403 - RNA, 22 nt, Human
acugagcucaccugauagcacu

SEQ ID NO: 621404 - RNA, 20 nt, Human
agcacaaauauaaauuuaua

SEQ ID NO: 621405 - RNA, 21 nt, Human
agguaauaaagauuuuuagcu

SEQ ID NO: 621406 - RNA, 22 nt, Human
auccaaauucucauuagaucaa

SEQ ID NO: 621407 - RNA, 21 nt, Human
augccaggacauguuuucagu

SEQ ID NO: 621408 - RNA, 22 nt, Human
auggagucagagguuccaaaug

SEQ ID NO: 621409 - RNA, 24 nt, Human
caaaaagcacaaauauaaauuuau

SEQ ID NO: 621410 - RNA, 21 nt, Human
caaaaccaguucuuuuacauc

SEQ ID NO: 621411 - RNA, 23 nt, Human
caaaaccaguucuuuuacaucac

SEQ ID NO: 621412 - RNA, 23 nt, Human
caaaauuuaagaauccaaagcac

SEQ ID NO: 621413 - RNA, 22 nt, Human
caaacuacuguucuucauauua

SEQ ID NO: 621414 - RNA, 19 nt, Human
caacagcaccacugagcuc

SEQ ID NO: 621415 - RNA, 22 nt, Human
caaucagccauuguuuuuaauc

SEQ ID NO: 621416 - RNA, 18 nt, Human
caauuacagaaaagucac

SEQ ID NO: 621417 - RNA, 18 nt, Human
caauuacagaaaagucac

SEQ ID NO: 621418 - RNA, 22 nt, Human
cacaucuucaacuccauuuccu

SEQ ID NO: 621419 - RNA, 22 nt, Human
ccaguuuccuggucugcaagac

SEQ ID NO: 621420 - RNA, 21 nt, Human
ccauuuaccagcaucauccuc

SEQ ID NO: 621421 - RNA, 18 nt, Human
cugaaacuuaaaaugacu

SEQ ID NO: 621422 - RNA, 18 nt, Human
cugaaucaauaguugugu

SEQ ID NO: 621423 - RNA, 21 nt, Human
cuggcaggcuaacacuuguau

SEQ ID NO: 621424 - RNA, 21 nt, Human
cuuacagccuggcaggcuaac

SEQ ID NO: 621425 - RNA, 24 nt, Human
cuuucuucacuuuuuguuguugau

SEQ ID NO: 621426 - RNA, 20 nt, Human
gacagguuucauuuuccuua

SEQ ID NO: 621427 - RNA, 22 nt, Human
gaugauaaaaagaacugaaaaa

SEQ ID NO: 621428 - RNA, 18 nt, Human
gccauauuaucuaagcca

SEQ ID NO: 621429 - RNA, 19 nt, Human
gguacacugaaacuuaaaa

SEQ ID NO: 621430 - RNA, 19 nt, Human
guaaaguguaugugugacc

SEQ ID NO: 621431 - RNA, 23 nt, Human
guugaugagccuucaaaugaauu

SEQ ID NO: 621432 - RNA, 20 nt, Human
uaagaaguaaaaaugaagca

SEQ ID NO: 621433 - RNA, 19 nt, Human
uaagccagaaacaucacuu

SEQ ID NO: 621434 - RNA, 25 nt, Human
uaagcuuacagccuggcaggcuaac

SEQ ID NO: 621435 - RNA, 21 nt, Human
uacaaacagaaacuuucugca

SEQ ID NO: 621436 - RNA, 23 nt, Human
uacagcagaguauuuuaaucgcc

SEQ ID NO: 621437 - RNA, 20 nt, Human
uacuucaucagucuuggcug

SEQ ID NO: 621438 - RNA, 18 nt, Human
uacuuugguuuggcuucc

SEQ ID NO: 621439 - RNA, 20 nt, Human
uaucugaaacuguuaugcuu

SEQ ID NO: 621440 - RNA, 19 nt, Human
uauucauuucuauaucuau

SEQ ID NO: 621441 - RNA, 23 nt, Human
ucagaacuaacagauucagguuc

SEQ ID NO: 621442 - RNA, 18 nt, Human
ucccauuuccuugaaaac

SEQ ID NO: 621443 - RNA, 19 nt, Human
ucccauuuccuugaaaacc

SEQ ID NO: 621444 - RNA, 23 nt, Human
uccccaaaaguacaugguuucca

SEQ ID NO: 621445 - RNA, 19 nt, Human
ucuacuuuacauuaauaca

SEQ ID NO: 621446 - RNA, 18 nt, Human
ucugaaccuacaacagca

SEQ ID NO: 621447 - RNA, 20 nt, Human
ucugaaccuacaacagcacc

SEQ ID NO: 621448 - RNA, 21 nt, Human
ucuuucuuuuucaucuucccc

SEQ ID NO: 621449 - RNA, 24 nt, Human
ugaaacaaaauuuaagaauccaaa

SEQ ID NO: 621450 - RNA, 26 nt, Human
ugaaacaaaauuuaagaauccaaagc

SEQ ID NO: 621451 - RNA, 23 nt, Human
ugaaccuacaacagcaccacuga

SEQ ID NO: 621452 - RNA, 18 nt, Human
ugauguuucuguuucucu

SEQ ID NO: 621453 - RNA, 20 nt, Human
ugguuuccaaaucccuuccu

SEQ ID NO: 621454 - RNA, 19 nt, Human
uguuguauuuguuuuuucu

SEQ ID NO: 621455 - RNA, 18 nt, Human
uguuucuguuucucuuuc

SEQ ID NO: 621456 - RNA, 22 nt, Human
uuacaauuacagaaaagucacu

SEQ ID NO: 621457 - RNA, 22 nt, Human
uucaacuucuuucuuuuucauc

SEQ ID NO: 621458 - RNA, 27 nt, Human
uuccaaaucccuuccucucaguuaacu

SEQ ID NO: 621459 - RNA, 23 nt, Human
uuuauuuuacaauuacagaaaag

SEQ ID NO: 621460 - RNA, 21 nt, Human
uuucgggggcagauuuuuauu

SEQ ID NO: 621461 - RNA, 20 nt, Human
uuuuugagccaguuuccugg

SEQ ID NO: 621462 - RNA, 20 nt, Human
uuuuuuucuuuugaagaagc

SEQ ID NO: 621463 - RNA, 24 nt, Human
uuuuuuucuuuugaagaagcagcu

SEQ ID NO: 621464 - RNA, 21 nt, Human
uuuuuuuuuuucgggggcaga

SEQ ID NO: 621465 - RNA, 19 nt, Human
uuuuuuuuuuuucgggggc

SEQ ID NO: 621466 - RNA, 20 nt, Human
uuuuuuuuuuuuuucggggg

SEQ ID NO: 621467 - RNA, 29 nt, Human
uuuuuuuuuuuuuuuuuuuuuuuucgggg

SEQ ID NO: 621468 - RNA, 19 nt, Human
aaaaaacaaaacaaggaaa

SEQ ID NO: 621469 - RNA, 22 nt, Human
aaaaaggacaccucacuguaga

SEQ ID NO: 621470 - RNA, 20 nt, Human
aaaaccccaaaaaacaaaac

SEQ ID NO: 621471 - RNA, 21 nt, Human
aaaaccccaaaaaacaaaaca

SEQ ID NO: 621472 - RNA, 22 nt, Human
aaaaccccaaaaaacaaaacaa

SEQ ID NO: 621473 - RNA, 18 nt, Human
aaaaccuccagagaccaa

SEQ ID NO: 621474 - RNA, 18 nt, Human
aaaaccuucaaccacaug

SEQ ID NO: 621475 - RNA, 20 nt, Human
aaaauguuaguaacacucuu

SEQ ID NO: 621476 - RNA, 21 nt, Human
aaaauucucucaguuaacugg

SEQ ID NO: 621477 - RNA, 22 nt, Human
aaagacaaacauucucuucuuc

SEQ ID NO: 621478 - RNA, 18 nt, Human
aaagcagaaaaccccaaa

SEQ ID NO: 621479 - RNA, 25 nt, Human
aaauagcuguguuccgucaaauucu

SEQ ID NO: 621480 - RNA, 23 nt, Human
aacaaaacaaggaaaaaagaaaa

SEQ ID NO: 621481 - RNA, 25 nt, Human
aacaauaaauccaaacgcagcccca

SEQ ID NO: 621482 - RNA, 21 nt, Human
aacacugguuuguucauuuga

SEQ ID NO: 621483 - RNA, 23 nt, Human
aaccacauggugaucugcaaagc

SEQ ID NO: 621484 - RNA, 18 nt, Human
aagagauaaauuaccagg

SEQ ID NO: 621485 - RNA, 23 nt, Human
aagcagaaaaccccaaaaaacaa

SEQ ID NO: 621486 - RNA, 21 nt, Human
aaggacuccugcguuuccgag

SEQ ID NO: 621487 - RNA, 24 nt, Human
aagugcaccuuauaaaaaggacac

SEQ ID NO: 621488 - RNA, 18 nt, Human
accccaaaaaacaaaaca

SEQ ID NO: 621489 - RNA, 21 nt, Human
acgcagccccaggcugggccu

SEQ ID NO: 621490 - RNA, 21 nt, Human
acuccugcguuuccgagagcc

SEQ ID NO: 621491 - RNA, 24 nt, Human
agaaaaccccaaaaaacaaaacaa

SEQ ID NO: 621492 - RNA, 19 nt, Human
agcagaaaaccccaaaaaa

SEQ ID NO: 621493 - RNA, 24 nt, Human
agcagaaaaccccaaaaaacaaaa

SEQ ID NO: 621494 - RNA, 24 nt, Human
aggaaaaaagaaaauacaugucaa

SEQ ID NO: 621495 - RNA, 20 nt, Human
auacaugucaacagucaguu

SEQ ID NO: 621496 - RNA, 18 nt, Human
auccaaacgcagccccag

SEQ ID NO: 621497 - RNA, 22 nt, Human
augcaguuuuauuaagagaguc

SEQ ID NO: 621498 - RNA, 24 nt, Human
caaaaaucaaaaaaguaaaaauuc

SEQ ID NO: 621499 - RNA, 19 nt, Human
caacuaaaaccuucaacca

SEQ ID NO: 621500 - RNA, 21 nt, Human
cacaacuaaaaccuucaaccc

SEQ ID NO: 621501 - RNA, 26 nt, Human
cagaaaaccccaaaaaacaaaacaag

SEQ ID NO: 621502 - RNA, 18 nt, Human
ccaaacgcagccccaggc

SEQ ID NO: 621503 - RNA, 21 nt, Human
ccacaacuaaaaccuucaacc

SEQ ID NO: 621504 - RNA, 27 nt, Human
ccccaaaaaacaaaacaaggaaaaaag

SEQ ID NO: 621505 - RNA, 18 nt, Human
cuacucaugcacaaacaa

SEQ ID NO: 621506 - RNA, 21 nt, Human
cucaugcacaaacaagcaguu

SEQ ID NO: 621507 - RNA, 18 nt, Human
cugagcuggcuaccagga

SEQ ID NO: 621508 - RNA, 18 nt, Human
cuggugacaguauuaaaa

SEQ ID NO: 621509 - RNA, 19 nt, Human
cuguguccacaacuaaaac

SEQ ID NO: 621510 - RNA, 26 nt, Human
gaaaaccccaaaaaacaaaacaagga

SEQ ID NO: 621511 - RNA, 21 nt, Human
gaccaaguaggaaguguggaa

SEQ ID NO: 621512 - RNA, 18 nt, Human
ggaaucuguuacaugugg

SEQ ID NO: 621513 - RNA, 20 nt, Human
ggcucgcuggccuagaggac

SEQ ID NO: 621514 - RNA, 21 nt, Human
gugaaggacaguuuuagaaca

SEQ ID NO: 621515 - RNA, 24 nt, Human
gugacaguauuaaaaagacaaugu

SEQ ID NO: 621516 - RNA, 19 nt, Human
uaaagcagaaaaccccaaa

SEQ ID NO: 621517 - RNA, 25 nt, Human
uaaagcagaaaaccccaaaaaacaa

SEQ ID NO: 621518 - RNA, 18 nt, Human
uacaaaaaucaaaaaagu

SEQ ID NO: 621519 - RNA, 25 nt, Human
uaccaggcaccugauuuaccacccc

SEQ ID NO: 621520 - RNA, 24 nt, Human
uaguaacacucuuagaacacuggu

SEQ ID NO: 621521 - RNA, 21 nt, Human
ucacacaaaucacugcagaaa

SEQ ID NO: 621522 - RNA, 22 nt, Human
ucagaaaaacuccaaaagugca

SEQ ID NO: 621523 - RNA, 20 nt, Human
uccacaacuaaaaccuucaa

SEQ ID NO: 621524 - RNA, 18 nt, Human
uccgagagccaggucagc

SEQ ID NO: 621525 - RNA, 19 nt, Human
ugcacaaacaagcaguugc

SEQ ID NO: 621526 - RNA, 22 nt, Human
ugcagaaaucuuuguaaggcug

SEQ ID NO: 621527 - RNA, 24 nt, Human
ugccuagacaaaagcuaauuucua

SEQ ID NO: 621528 - RNA, 24 nt, Human
uggauauacauagugguauauauc

SEQ ID NO: 621529 - RNA, 20 nt, Human
uggcaauaucuggugacagu

SEQ ID NO: 621530 - RNA, 18 nt, Human
uggcaucagaaaaacucc

SEQ ID NO: 621531 - RNA, 18 nt, Human
ugugcaaagagauaaauu

SEQ ID NO: 621532 - RNA, 21 nt, Human
ugugcaaagagauaaauuacc

SEQ ID NO: 621533 - RNA, 18 nt, Human
uguggaauaaaaacaaua

SEQ ID NO: 621534 - RNA, 25 nt, Human
uguggaauaaaaacaauaaauccaa

SEQ ID NO: 621535 - RNA, 23 nt, Human
uucagaaaguugaaguauauaaa

SEQ ID NO: 621536 - RNA, 24 nt, Human
uuugcagaguauaaccacuaggac

SEQ ID NO: 621537 - RNA, 23 nt, Human
aaaaaaacaagauucacccuuca

SEQ ID NO: 621538 - RNA, 22 nt, Human
aaaaaaagcuuuuaauaaaagg

SEQ ID NO: 621539 - RNA, 28 nt, Human
aaaaauagcaaaaagcaauccgguaccc

SEQ ID NO: 621540 - RNA, 21 nt, Human
aaaagucucucucuauaagcc

SEQ ID NO: 621541 - RNA, 21 nt, Human
aaacaagauucacccuucaaa

SEQ ID NO: 621542 - RNA, 21 nt, Human
aaacugacaauuacaggcucc

SEQ ID NO: 621543 - RNA, 20 nt, Human
aaauguaaaaauagagcaca

SEQ ID NO: 621544 - RNA, 19 nt, Human
aacauuauaaaaugugccu

SEQ ID NO: 621545 - RNA, 21 nt, Human
aagcauuagaaauccacugcc

SEQ ID NO: 621546 - RNA, 18 nt, Human
acaaacuauaauaccaua

SEQ ID NO: 621547 - RNA, 26 nt, Human
acaccagauuaauccuagucauucau

SEQ ID NO: 621548 - RNA, 21 nt, Human
acauggcugcuuucuuuucug

SEQ ID NO: 621549 - RNA, 21 nt, Human
agaauacugugauguuaaacc

SEQ ID NO: 621550 - RNA, 23 nt, Human
agacaaacauuauaaaaugugcc

SEQ ID NO: 621551 - RNA, 22 nt, Human
auaaaaauauaaaaaagacaac

SEQ ID NO: 621552 - RNA, 23 nt, Human
auauuuucaaaaauagcaaaaag

SEQ ID NO: 621553 - RNA, 24 nt, Human
auuaccuuuacagagacaaacauu

SEQ ID NO: 621554 - RNA, 19 nt, Human
cacauucuuuucucauccg

SEQ ID NO: 621555 - RNA, 22 nt, Human
cacugccagauauccugacgca

SEQ ID NO: 621556 - RNA, 23 nt, Human
cagaagaaaaugaaugacguaac

SEQ ID NO: 621557 - RNA, 23 nt, Human
cagcauucaaaaacuauaaauau

SEQ ID NO: 621558 - RNA, 18 nt, Human
caguccaauaugaaugga

SEQ ID NO: 621559 - RNA, 20 nt, Human
cauaaauguaaaaauagagc

SEQ ID NO: 621560 - RNA, 21 nt, Human
caugcuagauuucaacuaugu

SEQ ID NO: 621561 - RNA, 22 nt, Human
ccuauauuuaacccaaaucaaa

SEQ ID NO: 621562 - RNA, 24 nt, Human
cuacugcuuuuucauaaaaauaua

SEQ ID NO: 621563 - RNA, 18 nt, Human
cuccuaagcuuacaguaa

SEQ ID NO: 621564 - RNA, 21 nt, Human
cuucuuccuaccuuucccccu

SEQ ID NO: 621565 - RNA, 20 nt, Human
cuuucccccugcuuugaaug

SEQ ID NO: 621566 - RNA, 19 nt, Human
cuuuuuagguuccucuaga

SEQ ID NO: 621567 - RNA, 24 nt, Human
gaaccagaagaaaaugaaugacgu

SEQ ID NO: 621568 - RNA, 21 nt, Human
gagacaaacauuauaaaaugu

SEQ ID NO: 621569 - RNA, 24 nt, Human
gauuucaacuauguauauccuauu

SEQ ID NO: 621570 - RNA, 20 nt, Human
gcaaaaagcaaucuuuauga

SEQ ID NO: 621571 - RNA, 21 nt, Human
guuaaccuacuuggccuuaac

SEQ ID NO: 621572 - RNA, 24 nt, Human
uaacacagcaauuugaaacuuaca

SEQ ID NO: 621573 - RNA, 21 nt, Human
uaacucuaucugucaagugau

SEQ ID NO: 621574 - RNA, 24 nt, Human
uaauuuuccucagaaaaggauaac

SEQ ID NO: 621575 - RNA, 28 nt, Human
uacauaccacuaacauauauaacaaagu

SEQ ID NO: 621576 - RNA, 22 nt, Human
uaccauacaaacuauaauacca

SEQ ID NO: 621577 - RNA, 25 nt, Human
uaggaaaacuccuaagcuuacagua

SEQ ID NO: 621578 - RNA, 19 nt, Human
uaugaccaguuaccauaca

SEQ ID NO: 621579 - RNA, 19 nt, Human
uauugugcaguaucuccuu

SEQ ID NO: 621580 - RNA, 21 nt, Human
ucauccguguucuuuaacugc

SEQ ID NO: 621581 - RNA, 27 nt, Human
uccaaaaaguuaaaaagacaucacaga

SEQ ID NO: 621582 - RNA, 23 nt, Human
ucccccugcuuugaaugguaccu

SEQ ID NO: 621583 - RNA, 19 nt, Human
ucuaaauucccuuucaaga

SEQ ID NO: 621584 - RNA, 19 nt, Human
ucugaacauaaauguaaaa

SEQ ID NO: 621585 - RNA, 23 nt, Human
ucuuuaacugcuaauauuaccuu

SEQ ID NO: 621586 - RNA, 22 nt, Human
ugaaaauaugucugauacauac

SEQ ID NO: 621587 - RNA, 18 nt, Human
ugacgcaccauccugaaa

SEQ ID NO: 621588 - RNA, 22 nt, Human
ugacuuuuaacagaaggcacca

SEQ ID NO: 621589 - RNA, 24 nt, Human
ugauacauaccacuaacauauaua

SEQ ID NO: 621590 - RNA, 26 nt, Human
ugccagauauccugacgcaccauccu

SEQ ID NO: 621591 - RNA, 19 nt, Human
ugucaagugauaauauucu

SEQ ID NO: 621592 - RNA, 22 nt, Human
ugucugauacauaccacuaaca

SEQ ID NO: 621593 - RNA, 18 nt, Human
uuaaauagccuguuuucu

SEQ ID NO: 621594 - RNA, 19 nt, Human
uucaguaaaaauuaccucu

SEQ ID NO: 621595 - RNA, 25 nt, Human
uuuaaagauaaaaaaaacaagauuc

SEQ ID NO: 621596 - RNA, 20 nt, Human
uuuuuuuuuuuuuuuuuaag

SEQ ID NO: 621597 - RNA, 23 nt, Human
aaaaacaagcagccagcagcuca

SEQ ID NO: 621598 - RNA, 23 nt, Human
aaacaagcagccagcagcucaaa

SEQ ID NO: 621599 - RNA, 22 nt, Human
aaacauuugacaucucaaaacg

SEQ ID NO: 621600 - RNA, 22 nt, Human
aacuacuuaaaaucaagcugga

SEQ ID NO: 621601 - RNA, 20 nt, Human
aagcagccagcagcucaaaa

SEQ ID NO: 621602 - RNA, 21 nt, Human
aagcagccagcagcucaaaac

SEQ ID NO: 621603 - RNA, 25 nt, Human
accaccauuccccucuccucuccag

SEQ ID NO: 621604 - RNA, 23 nt, Human
accauaagagggccaaaaaggag

SEQ ID NO: 621605 - RNA, 24 nt, Human
agcacuuugggaggccgaggcggg

SEQ ID NO: 621606 - RNA, 19 nt, Human
agcuggaacugcaggaguc

SEQ ID NO: 621607 - RNA, 21 nt, Human
aggccgaggcgggcggaucac

SEQ ID NO: 621608 - RNA, 23 nt, Human
aggccgaggcgggcggaucacga

SEQ ID NO: 621609 - RNA, 24 nt, Human
aggcgggcggaucacgaggucagg

SEQ ID NO: 621610 - RNA, 21 nt, Human
auaaaacaaaauagaaacccu

SEQ ID NO: 621611 - RNA, 19 nt, Human
auaagagggccaaaaagga

SEQ ID NO: 621612 - RNA, 19 nt, Human
augccuguaaucccagcac

SEQ ID NO: 621613 - RNA, 25 nt, Human
caccaccauuccccucuccucucca

SEQ ID NO: 621614 - RNA, 24 nt, Human
cagcacuuugggaggccgaggcgg

SEQ ID NO: 621615 - RNA, 20 nt, Human
caugccuguaaucccagcac

SEQ ID NO: 621616 - RNA, 24 nt, Human
caugccuguaaucccagcacuuug

SEQ ID NO: 621617 - RNA, 22 nt, Human
cauuccccaccaccaccauucc

SEQ ID NO: 621618 - RNA, 19 nt, Human
ccauaaaacaaaauagaaa

SEQ ID NO: 621619 - RNA, 22 nt, Human
cccauaaaacaaaauagaaacc

SEQ ID NO: 621620 - RNA, 24 nt, Human
ccccaccaccaccauuccccucuc

SEQ ID NO: 621621 - RNA, 22 nt, Human
ccuguaaucccagcacuuuggg

SEQ ID NO: 621622 - RNA, 21 nt, Human
cucuccucuccagcaguuaga

SEQ ID NO: 621623 - RNA, 24 nt, Human
cugcuagaauuuacccauaaaaca

SEQ ID NO: 621624 - RNA, 21 nt, Human
cuugcagauuuuggaaagagc

SEQ ID NO: 621625 - RNA, 19 nt, Human
gaaaaacgaucaagcuaca

SEQ ID NO: 621626 - RNA, 23 nt, Human
gaggcgggcggaucacgagguca

SEQ ID NO: 621627 - RNA, 19 nt, Human
gauggaaaaacauaagcca

SEQ ID NO: 621628 - RNA, 23 nt, Human
gcuguuccucaaucuguuccaaa

SEQ ID NO: 621629 - RNA, 24 nt, Human
gggagcggugguucaugccuguaa

SEQ ID NO: 621630 - RNA, 24 nt, Human
gggcggaucacgaggucaggagau

SEQ ID NO: 621631 - RNA, 23 nt, Human
ggugguucaugccuguaauccca

SEQ ID NO: 621632 - RNA, 24 nt, Human
ggugguucaugccuguaaucccag

SEQ ID NO: 621633 - RNA, 22 nt, Human
uaagagggccaaaaaggaggug

SEQ ID NO: 621634 - RNA, 22 nt, Human
uaggacaguaacuacuuaaaau

SEQ ID NO: 621635 - RNA, 19 nt, Human
ucaaaacauuugacaucuc

SEQ ID NO: 621636 - RNA, 24 nt, Human
ucacgaggucaggagauagagacc

SEQ ID NO: 621637 - RNA, 22 nt, Human
ucaugccuguaaucccagcacu

SEQ ID NO: 621638 - RNA, 23 nt, Human
ucaugccuguaaucccagcacuu

SEQ ID NO: 621639 - RNA, 26 nt, Human
uccaagaagucgauaagcuuguugaa

SEQ ID NO: 621640 - RNA, 21 nt, Human
ucucuaaaagaaaugauaagc

SEQ ID NO: 621641 - RNA, 23 nt, Human
ugccuguaaucccagcacuuugg

SEQ ID NO: 621642 - RNA, 23 nt, Human
ugccuguaaucccagcacuuugg

SEQ ID NO: 621643 - RNA, 21 nt, Human
ugcugucuguguuuuuccaag

SEQ ID NO: 621644 - RNA, 21 nt, Human
uggaaagagcuacguccagcu

SEQ ID NO: 621645 - RNA, 19 nt, Human
ugggaggccgaggcgggcg

SEQ ID NO: 621646 - RNA, 24 nt, Human
ugggaggccgaggcgggcggauca

SEQ ID NO: 621647 - RNA, 22 nt, Human
ugguucaugccuguaaucccag

SEQ ID NO: 621648 - RNA, 24 nt, Human
ugguucaugccuguaaucccagca

SEQ ID NO: 621649 - RNA, 19 nt, Human
uuccccaccaccaccauuc

SEQ ID NO: 621650 - RNA, 28 nt, Human
uugaaccuugguauaaugguuaauguca

SEQ ID NO: 621651 - RNA, 25 nt, Human
uugggaggccgaggcgggcggauca

SEQ ID NO: 621652 - RNA, 18 nt, Human
uuuuuuuuuuuuaugggu

SEQ ID NO: 621653 - RNA, 24 nt, Human
uuuuuuuuuuuuuuuuuuuauggg

SEQ ID NO: 621654 - RNA, 22 nt, Human
aaaguaacuuuaauuuucuuau

SEQ ID NO: 621655 - RNA, 21 nt, Human
aagaauauucaagugaagaaa

SEQ ID NO: 621656 - RNA, 18 nt, Human
aaucauggucugagauuc

SEQ ID NO: 621657 - RNA, 18 nt, Human
agaaaaguaacuuuaauu

SEQ ID NO: 621658 - RNA, 21 nt, Human
agacucgaauucaacgaggaa

SEQ ID NO: 621659 - RNA, 22 nt, Human
aggcccccucauuucuaguucu

SEQ ID NO: 621660 - RNA, 24 nt, Human
agucagcacuaccuguaccuuacc

SEQ ID NO: 621661 - RNA, 19 nt, Human
auguucccaaagaauccaa

SEQ ID NO: 621662 - RNA, 23 nt, Human
caaaacuuuccaagaaacaacac

SEQ ID NO: 621663 - RNA, 21 nt, Human
caagcucuucuuuaacagaca

SEQ ID NO: 621664 - RNA, 20 nt, Human
ccccaaagacugcagguagg

SEQ ID NO: 621665 - RNA, 21 nt, Human
cugaagauccucgauuguaaa

SEQ ID NO: 621666 - RNA, 18 nt, Human
cugaagcugcagcugggu

SEQ ID NO: 621667 - RNA, 19 nt, Human
cugagcagcaugcaaagac

SEQ ID NO: 621668 - RNA, 20 nt, Human
cuuacccaucuugcaaggug

SEQ ID NO: 621669 - RNA, 19 nt, Human
cuucuuuguugaagaagga

SEQ ID NO: 621670 - RNA, 21 nt, Human
gaagauccucgauuguaaaga

SEQ ID NO: 621671 - RNA, 20 nt, Human
gcugcagcuggguuacagag

SEQ ID NO: 621672 - RNA, 20 nt, Human
ggcagaaguugcuuuuugag

SEQ ID NO: 621673 - RNA, 23 nt, Human
uacagguucucuuagccaggccc

SEQ ID NO: 621674 - RNA, 24 nt, Human
uacuuagaagaggugaaggcuucg

SEQ ID NO: 621675 - RNA, 22 nt, Human
uagaagaggugaaggcugaggc

SEQ ID NO: 621676 - RNA, 26 nt, Human
uagccaggcccccucauuucuaguuu

SEQ ID NO: 621677 - RNA, 18 nt, Human
uagggcauuucuucuuug

SEQ ID NO: 621678 - RNA, 24 nt, Human
uaguacaaaguucuucuacacuuc

SEQ ID NO: 621679 - RNA, 23 nt, Human
uaucugaacuguuauauacaaag

SEQ ID NO: 621680 - RNA, 22 nt, Human
uccaagaaacaacacaguuaaa

SEQ ID NO: 621681 - RNA, 19 nt, Human
uccagcuauccccaaagac

SEQ ID NO: 621682 - RNA, 26 nt, Human
ucccaaagaauccaauuaugggaaca

SEQ ID NO: 621683 - RNA, 20 nt, Human
uccucgauuguaaagagcuc

SEQ ID NO: 621684 - RNA, 22 nt, Human
ucugaacccuuuguugaauaua

SEQ ID NO: 621685 - RNA, 19 nt, Human
ugcuuuuugagaucuuucu

SEQ ID NO: 621686 - RNA, 19 nt, Human
uggucugagauuccagcua

SEQ ID NO: 621687 - RNA, 18 nt, Human
uguaaagagcucucuuaa

SEQ ID NO: 621688 - RNA, 19 nt, Human
uuccucugagcagcaugca

SEQ ID NO: 621689 - RNA, 26 nt, Human
uucuucuaccacaucaagcucuucuu

SEQ ID NO: 621690 - RNA, 19 nt, Human
uucuugccuuaagccugaa

SEQ ID NO: 621691 - RNA, 22 nt, Human
uuuguugaagaaggaaauacag

SEQ ID NO: 621692 - RNA, 25 nt, Human
uuuuuuuuuuugagaaaaguaacuu

SEQ ID NO: 621693 - RNA, 20 nt, Human
uuuuuuuuuuuuuuuuuugg

SEQ ID NO: 621694 - RNA, 24 nt, Human
aaaaaggcaggcaaugcagagaca

SEQ ID NO: 621695 - RNA, 23 nt, Human
aaaaggcaggcaaugcagagaca

SEQ ID NO: 621696 - RNA, 21 nt, Human
aagaagggggugaaauaggac

SEQ ID NO: 621697 - RNA, 21 nt, Human
aagaggccuggccccucaaac

SEQ ID NO: 621698 - RNA, 19 nt, Human
aagcagaacccaacgaagc

SEQ ID NO: 621699 - RNA, 21 nt, Human
aagcaggaggggccuccaaga

SEQ ID NO: 621700 - RNA, 30 nt, Human
aaggccccuccacccaggacucccaaccag

SEQ ID NO: 621701 - RNA, 22 nt, Human
acacguuugaaggcugcccucc

SEQ ID NO: 621702 - RNA, 23 nt, Human
acccaacgaagcaggaggggccu

SEQ ID NO: 621703 - RNA, 21 nt, Human
agaaaaaccucuguacauguc

SEQ ID NO: 621704 - RNA, 29 nt, Human
agaaaagaggugaaggcaaaagggacccc

SEQ ID NO: 621705 - RNA, 21 nt, Human
agagacaccguggcccaagca

SEQ ID NO: 621706 - RNA, 23 nt, Human
agcuggggucuggggcccagccg

SEQ ID NO: 621707 - RNA, 21 nt, Human
aggaagaagggggugaaauag

SEQ ID NO: 621708 - RNA, 22 nt, Human
aggaagaagggggugaaauagg

SEQ ID NO: 621709 - RNA, 23 nt, Human
aggaagcuggggucuggggccca

SEQ ID NO: 621710 - RNA, 20 nt, Human
aggcaggcacaggcaggggg

SEQ ID NO: 621711 - RNA, 22 nt, Human
aggccccuccacccaggacucc

SEQ ID NO: 621712 - RNA, 21 nt, Human
aggccuggccccucaaaccug

SEQ ID NO: 621713 - RNA, 20 nt, Human
agggagcagaugaagugugg

SEQ ID NO: 621714 - RNA, 19 nt, Human
agggggcggggaagaaaag

SEQ ID NO: 621715 - RNA, 22 nt, Human
cacacacggcucaccaccagca

SEQ ID NO: 621716 - RNA, 22 nt, Human
cacacggcucaccaccagcacc

SEQ ID NO: 621717 - RNA, 20 nt, Human
cacaggcagggggccuggga

SEQ ID NO: 621718 - RNA, 18 nt, Human
cagcagacagagcagcca

SEQ ID NO: 621719 - RNA, 18 nt, Human
cagcagagcagggacacg

SEQ ID NO: 621720 - RNA, 20 nt, Human
caggaguagauaggugaaaa

SEQ ID NO: 621721 - RNA, 21 nt, Human
cagggcagcagcgggcuggag

SEQ ID NO: 621722 - RNA, 18 nt, Human
ccaaccaugcagacuccc

SEQ ID NO: 621723 - RNA, 19 nt, Human
ccacccaggacucccaacc

SEQ ID NO: 621724 - RNA, 22 nt, Human
ccagcacccccuuuaauaaaac

SEQ ID NO: 621725 - RNA, 19 nt, Human
ccauagaagccccugagcc

SEQ ID NO: 621726 - RNA, 22 nt, Human
cccccaaggagcucacagccuu

SEQ ID NO: 621727 - RNA, 18 nt, Human
cccuccacccaggacucc

SEQ ID NO: 621728 - RNA, 20 nt, Human
cccugccuagaccugaggac

SEQ ID NO: 621729 - RNA, 18 nt, Human
ccugggacccugggcaag

SEQ ID NO: 621730 - RNA, 21 nt, Human
ccuguuggggaagcucaggag

SEQ ID NO: 621731 - RNA, 22 nt, Human
cggcagcagcaguucacauuua

SEQ ID NO: 621732 - RNA, 19 nt, Human
cucacaaaggccccuccac

SEQ ID NO: 621733 - RNA, 21 nt, Human
cucacaaaggccccuccaccc

SEQ ID NO: 621734 - RNA, 26 nt, Human
cucaccaccagcacccccuuuaauaa

SEQ ID NO: 621735 - RNA, 20 nt, Human
cugagaccccgaaugugcag

SEQ ID NO: 621736 - RNA, 26 nt, Human
gaaaagcagggggacccaccuggggg

SEQ ID NO: 621737 - RNA, 20 nt, Human
gaagaagggggugaaauagg

SEQ ID NO: 621738 - RNA, 22 nt, Human
gacaggaagaagggggugaagu

SEQ ID NO: 621739 - RNA, 19 nt, Human
gauggggagguggagaacc

SEQ ID NO: 621740 - RNA, 22 nt, Human
gcagaggggggcagcagggcag

SEQ ID NO: 621741 - RNA, 21 nt, Human
gcagcagacagagcagccagg

SEQ ID NO: 621742 - RNA, 19 nt, Human
gcccagccgggacguggag

SEQ ID NO: 621743 - RNA, 22 nt, Human
gcccugagccggguccagccuc

SEQ ID NO: 621744 - RNA, 20 nt, Human
gccuggggcggauggggagg

SEQ ID NO: 621745 - RNA, 22 nt, Human
gcugagaccccgaaugugcagg

SEQ ID NO: 621746 - RNA, 19 nt, Human
gcugcccucccccaccagg

SEQ ID NO: 621747 - RNA, 19 nt, Human
ggacguggagguggggccu

SEQ ID NO: 621748 - RNA, 18 nt, Human
ggagggggcagcagacag

SEQ ID NO: 621749 - RNA, 21 nt, Human
ggcagaggggggcagcagggc

SEQ ID NO: 621750 - RNA, 18 nt, Human
gggcagcagcgggcugga

SEQ ID NO: 621751 - RNA, 20 nt, Human
gggcagcagcgggcuggagc

SEQ ID NO: 621752 - RNA, 24 nt, Human
ggggggcagcagggcagcagcggg

SEQ ID NO: 621753 - RNA, 21 nt, Human
guggagggcaggaagcugggg

SEQ ID NO: 621754 - RNA, 25 nt, Human
guggcccugggacccugggcaaguc

SEQ ID NO: 621755 - RNA, 20 nt, Human
guggguggcccugggacccu

SEQ ID NO: 621756 - RNA, 25 nt, Human
uaauaaaacaugggggggggucaug

SEQ ID NO: 621757 - RNA, 24 nt, Human
uagauaggugaaaagcagggggac

SEQ ID NO: 621758 - RNA, 18 nt, Human
ucacaaaggccccuccac

SEQ ID NO: 621759 - RNA, 21 nt, Human
uccaggaucccauagaagccc

SEQ ID NO: 621760 - RNA, 18 nt, Human
ucccauagaagccccuga

SEQ ID NO: 621761 - RNA, 24 nt, Human
ugaaggcaaaaaggcaggcaaugc

SEQ ID NO: 621762 - RNA, 21 nt, Human
ugaaguguggguggcccuggg

SEQ ID NO: 621763 - RNA, 21 nt, Human
ugagccggguccagccucaca

SEQ ID NO: 621764 - RNA, 18 nt, Human
ugaggacuguagacccca

SEQ ID NO: 621765 - RNA, 24 nt, Human
ugcccucccccaccaggauggcac

SEQ ID NO: 621766 - RNA, 26 nt, Human
ugcccucccccaccaggauggcacug

SEQ ID NO: 621767 - RNA, 20 nt, Human
ugcccugagccggguccagc

SEQ ID NO: 621768 - RNA, 25 nt, Human
uggagggcaggaagcuggggucugg

SEQ ID NO: 621769 - RNA, 21 nt, Human
uggagguggggccuaugaggg

SEQ ID NO: 621770 - RNA, 19 nt, Human
uggcagaggggggcagcag

SEQ ID NO: 621771 - RNA, 21 nt, Human
uggccccucaaaccugcuccu

SEQ ID NO: 621772 - RNA, 22 nt, Human
uggccccucaaaccugcuccug

SEQ ID NO: 621773 - RNA, 20 nt, Human
uggcccugggacccugggca

SEQ ID NO: 621774 - RNA, 18 nt, Human
uggcggcagcagcaguuc

SEQ ID NO: 621775 - RNA, 21 nt, Human
uggggcccagccgggacgugg

SEQ ID NO: 621776 - RNA, 18 nt, Human
uggggccuaugagggagc

SEQ ID NO: 621777 - RNA, 19 nt, Human
uggggggagggggcagcag

SEQ ID NO: 621778 - RNA, 24 nt, Human
uguggguggcccugggacccuggg

SEQ ID NO: 621779 - RNA, 22 nt, Human
uuuuuuuuuuuuuuuuuggcgg

SEQ ID NO: 621780 - RNA, 20 nt, Human
uuuuuuuuuuuuuuuuuugg

SEQ ID NO: 621781 - RNA, 22 nt, Human
aaagcacucccaggagacaggc

SEQ ID NO: 621782 - RNA, 22 nt, Human
aaggaggaggacacagcagcug

SEQ ID NO: 621783 - RNA, 19 nt, Human
aaggugcuggauguguacc

SEQ ID NO: 621784 - RNA, 23 nt, Human
acauuuuccccuacauucuacca

SEQ ID NO: 621785 - RNA, 22 nt, Human
agaaaagccaguuccccaaggg

SEQ ID NO: 621786 - RNA, 21 nt, Human
agaacagucucagagaagaca

SEQ ID NO: 621787 - RNA, 24 nt, Human
agagggcaaaggagaaggagcggg

SEQ ID NO: 621788 - RNA, 21 nt, Human
agcaggaggccaaccugggca

SEQ ID NO: 621789 - RNA, 23 nt, Human
agcaggccaccgcugaaggcacu

SEQ ID NO: 621790 - RNA, 21 nt, Human
agcugcuagagaaccuggagc

SEQ ID NO: 621791 - RNA, 18 nt, Human
agcuggagcucaaagccc

SEQ ID NO: 621792 - RNA, 19 nt, Human
aggaggacacagcagcuga

SEQ ID NO: 621793 - RNA, 20 nt, Human
aucacagucaaguggggggu

SEQ ID NO: 621794 - RNA, 23 nt, Human
caagaaaagccaguuccccaagu

SEQ ID NO: 621795 - RNA, 21 nt, Human
caaggaggaggacacagcagc

SEQ ID NO: 621796 - RNA, 18 nt, Human
caccacaaugaugauguc

SEQ ID NO: 621797 - RNA, 19 nt, Human
cacccucaaagcacuccca

SEQ ID NO: 621798 - RNA, 18 nt, Human
cacugugugccaagcggu

SEQ ID NO: 621799 - RNA, 23 nt, Human
cacugugugccaagcgguggccc

SEQ ID NO: 621800 - RNA, 22 nt, Human
cagcugaagcagugggucacca

SEQ ID NO: 621801 - RNA, 19 nt, Human
cagcugguaggggcaaagc

SEQ ID NO: 621802 - RNA, 21 nt, Human
caggagacaggccccuccugc

SEQ ID NO: 621803 - RNA, 24 nt, Human
caggagacaggccccuccugcucu

SEQ ID NO: 621804 - RNA, 19 nt, Human
caggccgagagggcaaagg

SEQ ID NO: 621805 - RNA, 24 nt, Human
caucaggugagcucuaggcucucc

SEQ ID NO: 621806 - RNA, 21 nt, Human
caugucuuggggggaucuaga

SEQ ID NO: 621807 - RNA, 24 nt, Human
caugucuuggggggaucuagaggg

SEQ ID NO: 621808 - RNA, 22 nt, Human
cauucuaccagcauuucugacc

SEQ ID NO: 621809 - RNA, 24 nt, Human
ccacccugggaggucagcaggcca

SEQ ID NO: 621810 - RNA, 19 nt, Human
ccaggagacaggccccucc

SEQ ID NO: 621811 - RNA, 21 nt, Human
cccugccgguuuuccccucuu

SEQ ID NO: 621812 - RNA, 18 nt, Human
cccuggaggaggggacug

SEQ ID NO: 621813 - RNA, 22 nt, Human
ccgcugaaggcacuggcauggg

SEQ ID NO: 621814 - RNA, 21 nt, Human
ccugcugcuccucucuccuca

SEQ ID NO: 621815 - RNA, 23 nt, Human
ccugcuggaagccaccuccucca

SEQ ID NO: 621816 - RNA, 22 nt, Human
ccuggagcacgugccccagguu

SEQ ID NO: 621817 - RNA, 24 nt, Human
cucaaagcccgagucuuccacuuc

SEQ ID NO: 621818 - RNA, 20 nt, Human
cucccugccagcugcugugu

SEQ ID NO: 621819 - RNA, 23 nt, Human
cugaugcccugccgguuuucccc

SEQ ID NO: 621820 - RNA, 22 nt, Human
cuggcccugagggcagagggca

SEQ ID NO: 621821 - RNA, 20 nt, Human
cugugcccaggcugggcuga

SEQ ID NO: 621822 - RNA, 23 nt, Human
cugugugccaagcgguggccccc

SEQ ID NO: 621823 - RNA, 18 nt, Human
gagcugccugccugcugc

SEQ ID NO: 621824 - RNA, 24 nt, Human
gcaccggcacccagcaggaggcca

SEQ ID NO: 621825 - RNA, 21 nt, Human
gcagcugggagaggggcugga

SEQ ID NO: 621826 - RNA, 18 nt, Human
gccugccugcugcuccuc

SEQ ID NO: 621827 - RNA, 19 nt, Human
gcugccugccugcugcucc

SEQ ID NO: 621828 - RNA, 18 nt, Human
gcuggagcucaaagcccg

SEQ ID NO: 621829 - RNA, 18 nt, Human
ggaaccagggaucuggcu

SEQ ID NO: 621830 - RNA, 22 nt, Human
ggacagcugguaggggcaaagc

SEQ ID NO: 621831 - RNA, 18 nt, Human
ggcagcugggagaggggc

SEQ ID NO: 621832 - RNA, 19 nt, Human
ggcagcugggagaggggcu

SEQ ID NO: 621833 - RNA, 20 nt, Human
ggccaagaaaagccaguucc

SEQ ID NO: 621834 - RNA, 21 nt, Human
ggcccgggggauaggcugcuc

SEQ ID NO: 621835 - RNA, 24 nt, Human
gguggguuucugccugccagcacc

SEQ ID NO: 621836 - RNA, 21 nt, Human
uaagugucagaacagucucag

SEQ ID NO: 621837 - RNA, 18 nt, Human
uacaggccccacccucaa

SEQ ID NO: 621838 - RNA, 18 nt, Human
uaugagagacaaaagccc

SEQ ID NO: 621839 - RNA, 26 nt, Human
ucaaagcacucccaggagacaggccc

SEQ ID NO: 621840 - RNA, 20 nt, Human
ucaaagcccgagucuuccac

SEQ ID NO: 621841 - RNA, 22 nt, Human
uccuccacaggauaagcugcua

SEQ ID NO: 621842 - RNA, 18 nt, Human
ucucagagcucccacugu

SEQ ID NO: 621843 - RNA, 19 nt, Human
ucugacccccugggcaugc

SEQ ID NO: 621844 - RNA, 22 nt, Human
ucuggcugacuccagggggccc

SEQ ID NO: 621845 - RNA, 22 nt, Human
ucugugcuaugagagacaaaag

SEQ ID NO: 621846 - RNA, 24 nt, Human
ucuuggggggaucuagaggggcau

SEQ ID NO: 621847 - RNA, 19 nt, Human
ugaaggcacuggcaugggg

SEQ ID NO: 621848 - RNA, 22 nt, Human
ugaaggcacuggcaugggggug

SEQ ID NO: 621849 - RNA, 21 nt, Human
ugacuccagggggcccggggg

SEQ ID NO: 621850 - RNA, 19 nt, Human
ugagcucuaggcucucccu

SEQ ID NO: 621851 - RNA, 21 nt, Human
ugccagcacccugcuggaagc

SEQ ID NO: 621852 - RNA, 19 nt, Human
ugcccaggcugggcugagc

SEQ ID NO: 621853 - RNA, 20 nt, Human
ugcccaggcugggcugagcu

SEQ ID NO: 621854 - RNA, 19 nt, Human
ugcccagggcugugcugag

SEQ ID NO: 621855 - RNA, 20 nt, Human
ugcccagggcugugcugagu

SEQ ID NO: 621856 - RNA, 26 nt, Human
ugcccugccgguuuuccccucuucca

SEQ ID NO: 621857 - RNA, 21 nt, Human
ugccucaaugaagcuguuuau

SEQ ID NO: 621858 - RNA, 22 nt, Human
ugcugagugacugaugcccugc

SEQ ID NO: 621859 - RNA, 20 nt, Human
uggcccugagggcagagggc

SEQ ID NO: 621860 - RNA, 19 nt, Human
uggcugugcccaggcuggg

SEQ ID NO: 621861 - RNA, 19 nt, Human
uggcugugcccaggcuggg

SEQ ID NO: 621862 - RNA, 20 nt, Human
uggcugugcccaggcugggc

SEQ ID NO: 621863 - RNA, 21 nt, Human
ugucagaacagucucagagaa

SEQ ID NO: 621864 - RNA, 26 nt, Human
uguccaucaccaaggaggaggacaca

SEQ ID NO: 621865 - RNA, 20 nt, Human
ugugaauuaugccucaauga

SEQ ID NO: 621866 - RNA, 25 nt, Human
uguguaccggcacugcaccggcacc

SEQ ID NO: 621867 - RNA, 19 nt, Human
uguguccuggcuggcccug

SEQ ID NO: 621868 - RNA, 22 nt, Human
uuuuuuuuuuuuuuuaugaugg

SEQ ID NO: 621869 - RNA, 24 nt, Human
aagacuuucuuguucacuggauuc

SEQ ID NO: 621870 - RNA, 26 nt, Human
aggacagcacauccacuuucuguaau

SEQ ID NO: 621871 - RNA, 25 nt, Human
cacuggauucucuuauguagggcuu

SEQ ID NO: 621872 - RNA, 19 nt, Human
cucaggacagcacauccac

SEQ ID NO: 621873 - RNA, 21 nt, Human
cucucaggacagcacauccac

SEQ ID NO: 621874 - RNA, 24 nt, Human
gacuauaccaauaguugcaucuuc

SEQ ID NO: 621875 - RNA, 22 nt, Human
uaaagacuuucuuguucacugg

SEQ ID NO: 621876 - RNA, 23 nt, Human
uaaauucaaacgacagauuuaag

SEQ ID NO: 621877 - RNA, 22 nt, Human
uaagauaucauuaagaauuuau

SEQ ID NO: 621878 - RNA, 19 nt, Human
ucacuggauucucuuaugu

SEQ ID NO: 621879 - RNA, 20 nt, Human
uccaacagacugaaagucug

SEQ ID NO: 621880 - RNA, 21 nt, Human
uccaccagaauauuugcuuga

SEQ ID NO: 621881 - RNA, 24 nt, Human
ucucgugauuuaucucgcgcugcc

SEQ ID NO: 621882 - RNA, 23 nt, Human
ucugccacuacugaaccuugcaa

SEQ ID NO: 621883 - RNA, 23 nt, Human
ugaaccgaggugguccuaaauuc

SEQ ID NO: 621884 - RNA, 22 nt, Human
ugcaucuuccaccagaauauuu

SEQ ID NO: 621885 - RNA, 20 nt, Human
uuauauucuaaacaagcacu

SEQ ID NO: 621886 - RNA, 24 nt, Human
acccucaaaagggucauuauugac

SEQ ID NO: 621887 - RNA, 20 nt, Human
cacuuucacauuacugcagu

SEQ ID NO: 621888 - RNA, 18 nt, Human
ccucucugggacaagaau

SEQ ID NO: 621889 - RNA, 20 nt, Human
cuccagaugccgccgccacc

SEQ ID NO: 621890 - RNA, 24 nt, Human
cuguauaccaucucuccauacccu

SEQ ID NO: 621891 - RNA, 24 nt, Human
cuuaaaccaauuggaaaagcagca

SEQ ID NO: 621892 - RNA, 19 nt, Human
gcaguucccgccaccggaa

SEQ ID NO: 621893 - RNA, 26 nt, Human
ggaaaacagacaguagaaccagcuua

SEQ ID NO: 621894 - RNA, 20 nt, Human
ggacaagaaucauuguagcu

SEQ ID NO: 621895 - RNA, 22 nt, Human
uaaaccaauuggaaaagcagca

SEQ ID NO: 621896 - RNA, 26 nt, Human
ucuauaguuaaaucccauuuuagaac

SEQ ID NO: 621897 - RNA, 20 nt, Human
ugcaguucccgccaccggaa

SEQ ID NO: 621898 - RNA, 21 nt, Human
ugggacaagaaucauuguagc

SEQ ID NO: 621899 - RNA, 20 nt, Human
uggggagaggggugcccugg

SEQ ID NO: 621900 - RNA, 24 nt, Human
ugucucagcugagaggcaacauuu

SEQ ID NO: 621901 - RNA, 23 nt, Human
uucuauaguuaaaucccauuuua

SEQ ID NO: 621902 - RNA, 22 nt, Human
uuuuuuuuuuuuaaaauuuucu

SEQ ID NO: 621903 - RNA, 18 nt, Human
aacagugccaauagugac

SEQ ID NO: 621904 - RNA, 21 nt, Human
aaguuuagagcagaccaaacc

SEQ ID NO: 621905 - RNA, 22 nt, Human
acuuuguggaguuguuccagua

SEQ ID NO: 621906 - RNA, 18 nt, Human
agaccaaaccuuugugga

SEQ ID NO: 621907 - RNA, 20 nt, Human
agaugcugaauggcuuugug

SEQ ID NO: 621908 - RNA, 23 nt, Human
auaaguugcaguuuguuuaccuu

SEQ ID NO: 621909 - RNA, 21 nt, Human
auuagaaacaucucauuuagc

SEQ ID NO: 621910 - RNA, 18 nt, Human
auugcagauauaaguugc

SEQ ID NO: 621911 - RNA, 23 nt, Human
caaugauacucacacugagaucc

SEQ ID NO: 621912 - RNA, 24 nt, Human
cacagcaucuggccugcuaguaga

SEQ ID NO: 621913 - RNA, 22 nt, Human
cagauuagaaacaucucauuua

SEQ ID NO: 621914 - RNA, 20 nt, Human
cauaccucuugucuauacca

SEQ ID NO: 621915 - RNA, 20 nt, Human
ccauaauguagauucucugc

SEQ ID NO: 621916 - RNA, 23 nt, Human
ccuccaguaggaugugcagcugg

SEQ ID NO: 621917 - RNA, 21 nt, Human
cuccaguaggaugugcagcug

SEQ ID NO: 621918 - RNA, 22 nt, Human
gauuagaaacaucucauuuagc

SEQ ID NO: 621919 - RNA, 21 nt, Human
gcucugaucaagaaggguagg

SEQ ID NO: 621920 - RNA, 18 nt, Human
ggagauggauaaguuuag

SEQ ID NO: 621921 - RNA, 19 nt, Human
gugcuauguguggcgcugg

SEQ ID NO: 621922 - RNA, 23 nt, Human
uacacccacauuugaccuccagu

SEQ ID NO: 621923 - RNA, 19 nt, Human
uacuggcauaccucuuguc

SEQ ID NO: 621924 - RNA, 23 nt, Human
uagcugaauugguggcuuaugga

SEQ ID NO: 621925 - RNA, 21 nt, Human
uauggcucugaucaagaaggg

SEQ ID NO: 621926 - RNA, 25 nt, Human
uauguguggcgcugguggugguguu

SEQ ID NO: 621927 - RNA, 21 nt, Human
uauucugaguucagucucugu

SEQ ID NO: 621928 - RNA, 20 nt, Human
uccaguaggaugugcagcug

SEQ ID NO: 621929 - RNA, 26 nt, Human
uccccugcaguacguaucucgagggu

SEQ ID NO: 621930 - RNA, 18 nt, Human
ucccugauguuuucuguu

SEQ ID NO: 621931 - RNA, 19 nt, Human
ucuacacccacauuugacc

SEQ ID NO: 621932 - RNA, 24 nt, Human
ucuucugaagccaccagugugcua

SEQ ID NO: 621933 - RNA, 22 nt, Human
ugagguggguguacauuauuug

SEQ ID NO: 621934 - RNA, 18 nt, Human
ugaucaagaaggguaggc

SEQ ID NO: 621935 - RNA, 21 nt, Human
ugcagcuggucuccccugcag

SEQ ID NO: 621936 - RNA, 23 nt, Human
ugcagcuggucuccccugcagua

SEQ ID NO: 621937 - RNA, 21 nt, Human
ugcaguacguaucucgagggu

SEQ ID NO: 621938 - RNA, 18 nt, Human
ugcuauguguggcgcugg

SEQ ID NO: 621939 - RNA, 18 nt, Human
ugggaucugcugaucuag

SEQ ID NO: 621940 - RNA, 22 nt, Human
uuaaugauaucagugguguuuu

SEQ ID NO: 621941 - RNA, 23 nt, Human
uuagagcagaccaaaccuuugug

SEQ ID NO: 621942 - RNA, 22 nt, Human
uuccaguaauggagggagaugg

SEQ ID NO: 621943 - RNA, 18 nt, Human
uugagguggguguacauu

SEQ ID NO: 621944 - RNA, 18 nt, Human
uuuacagauuguucaauc

SEQ ID NO: 621945 - RNA, 19 nt, Human
uuuuuuuuuuuuuuuugcu

SEQ ID NO: 621946 - RNA, 18 nt, Human
uuuuuuuuuuuuuuuuug

SEQ ID NO: 621947 - RNA, 22 nt, Human
uuuuuuuuuuuuuuuuugcuuu

SEQ ID NO: 621948 - RNA, 24 nt, Human
aagaggagagagccgaggguugcc

SEQ ID NO: 621949 - RNA, 20 nt, Human
acagauggggaaagaaagga

SEQ ID NO: 621950 - RNA, 19 nt, Human
acucuguccccacucaggc

SEQ ID NO: 621951 - RNA, 19 nt, Human
agaucuggucacuguucca

SEQ ID NO: 621952 - RNA, 18 nt, Human
agcaggggagggggcugg

SEQ ID NO: 621953 - RNA, 24 nt, Human
agcggggcuucuccccuccuccag

SEQ ID NO: 621954 - RNA, 19 nt, Human
agcugggggcagugugugu

SEQ ID NO: 621955 - RNA, 21 nt, Human
aggaagagcagagacugaagg

SEQ ID NO: 621956 - RNA, 23 nt, Human
aggcuccccccacccgccccacc

SEQ ID NO: 621957 - RNA, 22 nt, Human
aggugguugaugaaggaagagc

SEQ ID NO: 621958 - RNA, 19 nt, Human
caaacauacacagggaccg

SEQ ID NO: 621959 - RNA, 21 nt, Human
caggaacagauggggaaagaa

SEQ ID NO: 621960 - RNA, 21 nt, Human
cagguguggcagagggcaagu

SEQ ID NO: 621961 - RNA, 19 nt, Human
ccagaagggcugcuugaua

SEQ ID NO: 621962 - RNA, 19 nt, Human
ccagacaugagcugaggcu

SEQ ID NO: 621963 - RNA, 22 nt, Human
ccaggguaaaggggcuuaaaga

SEQ ID NO: 621964 - RNA, 18 nt, Human
ccauccagguaggauggg

SEQ ID NO: 621965 - RNA, 24 nt, Human
ccccuccuccagcaggggaggggg

SEQ ID NO: 621966 - RNA, 18 nt, Human
ccucccuuccuccuuccc

SEQ ID NO: 621967 - RNA, 21 nt, Human
cuccccuccuccagcagggga

SEQ ID NO: 621968 - RNA, 22 nt, Human
cuccuggccacagccuccaccu

SEQ ID NO: 621969 - RNA, 18 nt, Human
cugaggcugugacugucc

SEQ ID NO: 621970 - RNA, 25 nt, Human
gaacagggcuacagcgaagcgucac

SEQ ID NO: 621971 - RNA, 21 nt, Human
ggaaagaaaggaggaagaaga

SEQ ID NO: 621972 - RNA, 22 nt, Human
gggaaagaaaggaggaagaaga

SEQ ID NO: 621973 - RNA, 18 nt, Human
ggucaaaauggccaggug

SEQ ID NO: 621974 - RNA, 23 nt, Human
guucaccccgugcuggagugggg

SEQ ID NO: 621975 - RNA, 21 nt, Human
ucagggucaaaauggccaggu

SEQ ID NO: 621976 - RNA, 25 nt, Human
ucaguacaggaccaggguaaagggg

SEQ ID NO: 621977 - RNA, 23 nt, Human
uccaggcuccccccacccgcccc

SEQ ID NO: 621978 - RNA, 21 nt, Human
ucccaggaacagauggggaaa

SEQ ID NO: 621979 - RNA, 28 nt, Human
ugaaggaagagcagagacugaaggguag

SEQ ID NO: 621980 - RNA, 21 nt, Human
ugaugaaggaagagcagagac

SEQ ID NO: 621981 - RNA, 21 nt, Human
uggaacagggcuacagcgaag

SEQ ID NO: 621982 - RNA, 21 nt, Human
ugggccuccguucaccccgug

SEQ ID NO: 621983 - RNA, 22 nt, Human
uggggaaggugguugaugaagg

SEQ ID NO: 621984 - RNA, 23 nt, Human
uggggcugaccaagggaagcugg

SEQ ID NO: 621985 - RNA, 23 nt, Human
ugugacuguccacucagggucaa

SEQ ID NO: 621986 - RNA, 23 nt, Human
uguuccaggcuccccccacccgc

SEQ ID NO: 621987 - RNA, 24 nt, Human
uuccaggcuccccccacccgcccc

SEQ ID NO: 621988 - RNA, 23 nt, Human
uucccuaguacucugggccuccg

SEQ ID NO: 621989 - RNA, 21 nt, Human
uuggcuguucaguuucccaug

SEQ ID NO: 621990 - RNA, 19 nt, Human
uuuuuuuuuuuuuuuuugg

SEQ ID NO: 621991 - RNA, 22 nt, Human
aaaaaaaaagaaaaacaaacaa

SEQ ID NO: 621992 - RNA, 23 nt, Human
aaaaaaaaagaaaaacaaacaaa

SEQ ID NO: 621993 - RNA, 24 nt, Human
aaaaaagaaaaacaaacaaauaua

SEQ ID NO: 621994 - RNA, 20 nt, Human
aaaacaaacaaacaaaaaaa

SEQ ID NO: 621995 - RNA, 19 nt, Human
aaaaccaaauaaaaugcca

SEQ ID NO: 621996 - RNA, 21 nt, Human
aaacaaaacaaaacaaacaaa

SEQ ID NO: 621997 - RNA, 30 nt, Human
aaacaaaacaaacaaacaaaaaaaaagaaa

SEQ ID NO: 621998 - RNA, 21 nt, Human
aaaccugcugaugacuccaaa

SEQ ID NO: 621999 - RNA, 23 nt, Human
aaaguuccuccaaaauuaaaccu

SEQ ID NO: 622000 - RNA, 25 nt, Human
acaaaacaaaacaaacaaacaaaaa

SEQ ID NO: 622001 - RNA, 23 nt, Human
acaaacaaaaaaaaagaaaaaca

SEQ ID NO: 622002 - RNA, 23 nt, Human
acuggagugaggaggaugaugug

SEQ ID NO: 622003 - RNA, 23 nt, Human
agaaaaacaaacaaauauacgga

SEQ ID NO: 622004 - RNA, 27 nt, Human
auaugcuaaaaccaaauaaaaugccaa

SEQ ID NO: 622005 - RNA, 20 nt, Human
augaaacacaggagaccaga

SEQ ID NO: 622006 - RNA, 18 nt, Human
augauguguacugaugcc

SEQ ID NO: 622007 - RNA, 20 nt, Human
auugugugcaugcuccucgu

SEQ ID NO: 622008 - RNA, 19 nt, Human
caaaacaaaacaaacaaac

SEQ ID NO: 622009 - RNA, 27 nt, Human
caaaacaaaacaaacaaacaaaaaaaa

SEQ ID NO: 622010 - RNA, 24 nt, Human
caaacaaacaaaaaaaaagaaaaa

SEQ ID NO: 622011 - RNA, 22 nt, Human
caagucgccgccgcucgcuguc

SEQ ID NO: 622012 - RNA, 19 nt, Human
cacaauucauuaugaucaa

SEQ ID NO: 622013 - RNA, 19 nt, Human
cagaaacgacaugcugaag

SEQ ID NO: 622014 - RNA, 18 nt, Human
cagcaugccugaauuccg

SEQ ID NO: 622015 - RNA, 23 nt, Human
caucacccuaugauucaacugga

SEQ ID NO: 622016 - RNA, 22 nt, Human
cuaaaaccaaauaaaaugccag

SEQ ID NO: 622017 - RNA, 23 nt, Human
cuaaaaccaaauaaaaugccagu

SEQ ID NO: 622018 - RNA, 19 nt, Human
gaacuaguggugguggcaa

SEQ ID NO: 622019 - RNA, 19 nt, Human
ggaaaucaccaacuauaaa

SEQ ID NO: 622020 - RNA, 22 nt, Human
guaaaguuccuccaaaauuaaa

SEQ ID NO: 622021 - RNA, 19 nt, Human
uaaaaagcaguguugacau

SEQ ID NO: 622022 - RNA, 22 nt, Human
uaaaacaaaacaaaacaaacaa

SEQ ID NO: 622023 - RNA, 26 nt, Human
uaaaacaaaacaaaacaaacaaacaa

SEQ ID NO: 622024 - RNA, 24 nt, Human
uaagaacaaggcuuauuuaaaaca

SEQ ID NO: 622025 - RNA, 22 nt, Human
uaauaauccagaaacgacaugc

SEQ ID NO: 622026 - RNA, 19 nt, Human
uacuuaaaugaaaaaaagg

SEQ ID NO: 622027 - RNA, 21 nt, Human
uaggugaaacaugaaacacag

SEQ ID NO: 622028 - RNA, 21 nt, Human
ucacccuaugauucaacugga

SEQ ID NO: 622029 - RNA, 26 nt, Human
uccaaaauuaaaccugcugaugacuc

SEQ ID NO: 622030 - RNA, 18 nt, Human
ucccugcucugaaucucu

SEQ ID NO: 622031 - RNA, 23 nt, Human
uccuccaaaauuaaaccugcuga

SEQ ID NO: 622032 - RNA, 24 nt, Human
ucgaaaacccguguuaccacuucu

SEQ ID NO: 622033 - RNA, 20 nt, Human
ucuaagagguugcugucugg

SEQ ID NO: 622034 - RNA, 23 nt, Human
ugagaagaagagacuuuacagua

SEQ ID NO: 622035 - RNA, 23 nt, Human
ugccugaauuccgaucaauccac

SEQ ID NO: 622036 - RNA, 21 nt, Human
uggcaacagcagcugcuggag

SEQ ID NO: 622037 - RNA, 24 nt, Human
uuccgaucaauccacugcagggag

SEQ ID NO: 622038 - RNA, 21 nt, Human
uugaacuaguggugguggcaa

SEQ ID NO: 622039 - RNA, 22 nt, Human
uuuuuaggacauuaccuuuauu

SEQ ID NO: 622040 - RNA, 23 nt, Human
uuuuuuuuuuuuuuuuuuuuagg

SEQ ID NO: 622041 - RNA, 20 nt, Human
aagaacucccgccccuagca

SEQ ID NO: 622042 - RNA, 20 nt, Human
aggcaguggggguugggaag

SEQ ID NO: 622043 - RNA, 23 nt, Human
cagagcagcucucgccacaggag

SEQ ID NO: 622044 - RNA, 20 nt, Human
caggaguuuguagaugcucc

SEQ ID NO: 622045 - RNA, 20 nt, Human
ccuagcacagcgccaaacac

SEQ ID NO: 622046 - RNA, 18 nt, Human
gacacugauagagaccuc

SEQ ID NO: 622047 - RNA, 23 nt, Human
gcaggacacugauagagaccucu

SEQ ID NO: 622048 - RNA, 20 nt, Human
gccacaggaguuuguagaug

SEQ ID NO: 622049 - RNA, 20 nt, Human
gggcgggcugguccaagagu

SEQ ID NO: 622050 - RNA, 24 nt, Human
uaccaaaugcuuuaaugccauucu

SEQ ID NO: 622051 - RNA, 19 nt, Human
uagaacccaaggaagcaga

SEQ ID NO: 622052 - RNA, 21 nt, Human
uagaacccaaggaagcagagc

SEQ ID NO: 622053 - RNA, 21 nt, Human
uagagcugguggucagggcgg

SEQ ID NO: 622054 - RNA, 20 nt, Human
uauaccaaaugcuuuaaugc

SEQ ID NO: 622055 - RNA, 18 nt, Human
uaugcagaccgggacacc

SEQ ID NO: 622056 - RNA, 21 nt, Human
ucauccucaugacaacucgag

SEQ ID NO: 622057 - RNA, 21 nt, Human
uccaagagucuggaagaacuc

SEQ ID NO: 622058 - RNA, 18 nt, Human
ugcgugggugccgugcag

SEQ ID NO: 622059 - RNA, 21 nt, Human
uggaagaacucccgccccuaa

SEQ ID NO: 622060 - RNA, 26 nt, Human
uugaguaaaaaucacuagcaauuuau

SEQ ID NO: 622061 - RNA, 20 nt, Human
uuuuuuuuuuuuuuuuuugg

SEQ ID NO: 622062 - RNA, 24 nt, Human
aaaaaaaaaaaaaaaaccccaaaa

SEQ ID NO: 622063 - RNA, 24 nt, Human
aaaaaaaaaaaaaaccccaaaaaa

SEQ ID NO: 622064 - RNA, 22 nt, Human
aaaaaaaaaaaaaauuacccag

SEQ ID NO: 622065 - RNA, 23 nt, Human
aaaaaaaaaaaaaccccaaaaaa

SEQ ID NO: 622066 - RNA, 25 nt, Human
aaaaaaaaccccaaaaaaacaaaaa

SEQ ID NO: 622067 - RNA, 22 nt, Human
aaaaaaaccuuucaaagaacac

SEQ ID NO: 622068 - RNA, 19 nt, Human
aaaaaccccaaaaaaacaa

SEQ ID NO: 622069 - RNA, 26 nt, Human
aaaacaaaaauaaaaaaaccuuucaa

SEQ ID NO: 622070 - RNA, 21 nt, Human
aaaaccccaaaaaaacaaaaa

SEQ ID NO: 622071 - RNA, 23 nt, Human
aaaagacuuucaaccuguaagaa

SEQ ID NO: 622072 - RNA, 22 nt, Human
aaacaaaaauagagcaaaccaa

SEQ ID NO: 622073 - RNA, 22 nt, Human
aaacaaaaugucaggauccaac

SEQ ID NO: 622074 - RNA, 18 nt, Human
aaacauuaugagcaaauc

SEQ ID NO: 622075 - RNA, 21 nt, Human
aaaccuuucaaagaacacuag

SEQ ID NO: 622076 - RNA, 25 nt, Human
aaacuaaaaggugaaaaaacuagaa

SEQ ID NO: 622077 - RNA, 18 nt, Human
aacauggugaaacucauc

SEQ ID NO: 622078 - RNA, 19 nt, Human
aacauggugaaacucaucu

SEQ ID NO: 622079 - RNA, 20 nt, Human
aacauggugaaacucaucuc

SEQ ID NO: 622080 - RNA, 23 nt, Human
aaccccaaaaaaacaaaaauaaa

SEQ ID NO: 622081 - RNA, 24 nt, Human
aaccgcuugaacccgagaggcaga

SEQ ID NO: 622082 - RNA, 21 nt, Human
aaccuguaagaaacaauuucu

SEQ ID NO: 622083 - RNA, 21 nt, Human
aacuaaaacuaaaggauugcu

SEQ ID NO: 622084 - RNA, 25 nt, Human
aauacaaaaaaaaaaaaaauuaccc

SEQ ID NO: 622085 - RNA, 27 nt, Human
acaaaaauagagcaaaccaagcguguc

SEQ ID NO: 622086 - RNA, 20 nt, Human
acagaaaaaaauaauuuuga

SEQ ID NO: 622087 - RNA, 24 nt, Human
acagagcaagacucggucucaaaa

SEQ ID NO: 622088 - RNA, 23 nt, Human
accaacauggugaaacucaucuc

SEQ ID NO: 622089 - RNA, 19 nt, Human
accacuaucacacauaaac

SEQ ID NO: 622090 - RNA, 22 nt, Human
accacugcauuccagccugggc

SEQ ID NO: 622091 - RNA, 24 nt, Human
accacugcauuccagccugggcga

SEQ ID NO: 622092 - RNA, 19 nt, Human
accccaaaaaaacaaaaau

SEQ ID NO: 622093 - RNA, 24 nt, Human
acugcauuccagccugggcgacag

SEQ ID NO: 622094 - RNA, 26 nt, Human
acugcauuccagccugggcgacagag

SEQ ID NO: 622095 - RNA, 20 nt, Human
agaaccgcuugaacccgaga

SEQ ID NO: 622096 - RNA, 22 nt, Human
agaaguggacugcuagcauaua

SEQ ID NO: 622097 - RNA, 24 nt, Human
agacugaccaacauggugaaacuc

SEQ ID NO: 622098 - RNA, 19 nt, Human
agagauugcagugagccaa

SEQ ID NO: 622099 - RNA, 24 nt, Human
agagauugcagugagccaagaucg

SEQ ID NO: 622100 - RNA, 21 nt, Human
agaguaaaaacuaaaagguga

SEQ ID NO: 622101 - RNA, 20 nt, Human
agcacuuugggaggcugagg

SEQ ID NO: 622102 - RNA, 24 nt, Human
agccugggcgacagagcaagacuc

SEQ ID NO: 622103 - RNA, 19 nt, Human
aggaaaaauaagcaccaaa

SEQ ID NO: 622104 - RNA, 23 nt, Human
aggaguucgagacuagacugacc

SEQ ID NO: 622105 - RNA, 24 nt, Human
aggauggagaaaggacaaaaaaaa

SEQ ID NO: 622106 - RNA, 24 nt, Human
aggcagagauugcagugagccaag

SEQ ID NO: 622107 - RNA, 24 nt, Human
aggcaguagaaccgcuugaacccg

SEQ ID NO: 622108 - RNA, 24 nt, Human
aggcaugcggaucacaaggucagg

SEQ ID NO: 622109 - RNA, 24 nt, Human
aggcgugguggcacacaccuguaa

SEQ ID NO: 622110 - RNA, 24 nt, Human
aggcugaggcaguagaaccgcuug

SEQ ID NO: 622111 - RNA, 22 nt, Human
auaaugaucccuuuaauaaacu

SEQ ID NO: 622112 - RNA, 20 nt, Human
auauauaaaacaaccaaaga

SEQ ID NO: 622113 - RNA, 21 nt, Human
aucacaaggucaggaguucga

SEQ ID NO: 622114 - RNA, 18 nt, Human
aucacacauaaacaaaaa

SEQ ID NO: 622115 - RNA, 24 nt, Human
aucgcaccacugcauuccagccug

SEQ ID NO: 622116 - RNA, 19 nt, Human
augccuguaaucccagcac

SEQ ID NO: 622117 - RNA, 24 nt, Human
augcggaucacaaggucaggaguu

SEQ ID NO: 622118 - RNA, 20 nt, Human
augguuacaaaauuagagua

SEQ ID NO: 622119 - RNA, 24 nt, Human
caaaacacuagaacaguugcuaug

SEQ ID NO: 622120 - RNA, 21 nt, Human
caaaauguuacaaauaguauc

SEQ ID NO: 622121 - RNA, 23 nt, Human
caacauggugaaacucaucucua

SEQ ID NO: 622122 - RNA, 23 nt, Human
caaccuguaagaaacaauuucug

SEQ ID NO: 622123 - RNA, 22 nt, Human
caagauaaagcagagugacuua

SEQ ID NO: 622124 - RNA, 22 nt, Human
caauuaccugguuuaccaagaa

SEQ ID NO: 622125 - RNA, 21 nt, Human
cacaccuguaaacaaugugcc

SEQ ID NO: 622126 - RNA, 22 nt, Human
cacaccuguaaacaaugugcca

SEQ ID NO: 622127 - RNA, 18 nt, Human
cacaccuguaauccuagc

SEQ ID NO: 622128 - RNA, 30 nt, Human
cacauaaacaaaaauagagcaaaccaagcc

SEQ ID NO: 622129 - RNA, 24 nt, Human
caccuguaauccuagcuacucagg

SEQ ID NO: 622130 - RNA, 19 nt, Human
cacugcauuccagccuggg

SEQ ID NO: 622131 - RNA, 22 nt, Human
cacugcauuccagccugggcga

SEQ ID NO: 622132 - RNA, 23 nt, Human
cacugcauuccagccugggcgac

SEQ ID NO: 622133 - RNA, 24 nt, Human
cacugcauuccagccugggcgaca

SEQ ID NO: 622134 - RNA, 22 nt, Human
cagagucuugagaaacuuaaag

SEQ ID NO: 622135 - RNA, 23 nt, Human
cagcacuuugggaggcugaggca

SEQ ID NO: 622136 - RNA, 19 nt, Human
caggaguucgagacuagac

SEQ ID NO: 622137 - RNA, 20 nt, Human
caugccuguaaucccagcac

SEQ ID NO: 622138 - RNA, 24 nt, Human
caugccuguaaucccagcacuuug

SEQ ID NO: 622139 - RNA, 20 nt, Human
ccacugcauuccagccuggg

SEQ ID NO: 622140 - RNA, 21 nt, Human
ccacugcauuccagccugggc

SEQ ID NO: 622141 - RNA, 21 nt, Human
ccacugcauuccagccugggc

SEQ ID NO: 622142 - RNA, 21 nt, Human
ccacugcauuccagccugggc

SEQ ID NO: 622143 - RNA, 24 nt, Human
ccacugcauuccagccugggcgac

SEQ ID NO: 622144 - RNA, 23 nt, Human
ccccaaaaaaacaaaaauaaaaa

SEQ ID NO: 622145 - RNA, 20 nt, Human
ccucucaaagcauuuuuaaa

SEQ ID NO: 622146 - RNA, 22 nt, Human
ccugggcgacagagcaagacuc

SEQ ID NO: 622147 - RNA, 20 nt, Human
ccuguuggagccccugaggu

SEQ ID NO: 622148 - RNA, 20 nt, Human
ccuuuagugaccuuucuuca

SEQ ID NO: 622149 - RNA, 21 nt, Human
cgcaccacugcauuccagccu

SEQ ID NO: 622150 - RNA, 22 nt, Human
cggaucacaaggucaggaguuc

SEQ ID NO: 622151 - RNA, 18 nt, Human
cucaaaaaaaaaaaaaaa

SEQ ID NO: 622152 - RNA, 18 nt, Human
cucaaaaaaaaaaaaaaa

SEQ ID NO: 622153 - RNA, 25 nt, Human
cucaaaaaaaaaaaaaaaaacccca

SEQ ID NO: 622154 - RNA, 20 nt, Human
cucacagaacacagugucau

SEQ ID NO: 622155 - RNA, 23 nt, Human
cucaugccuguaaucccagcacu

SEQ ID NO: 622156 - RNA, 24 nt, Human
cucaugccuguaaucccagcacuu

SEQ ID NO: 622157 - RNA, 20 nt, Human
cuccaugaauucagugauuu

SEQ ID NO: 622158 - RNA, 24 nt, Human
cucggucucaaaaaaaaaaaaaaa

SEQ ID NO: 622159 - RNA, 19 nt, Human
cugaucaaggauggagaaa

SEQ ID NO: 622160 - RNA, 21 nt, Human
cuguaauccuagcuacucagg

SEQ ID NO: 622161 - RNA, 18 nt, Human
gagauugcagugagccaa

SEQ ID NO: 622162 - RNA, 20 nt, Human
gagcaagacucggucucaaa

SEQ ID NO: 622163 - RNA, 21 nt, Human
gaucacaaggucaggaguucg

SEQ ID NO: 622164 - RNA, 22 nt, Human
gaucacaaggucaggaguucga

SEQ ID NO: 622165 - RNA, 24 nt, Human
gaucacaaggucaggaguucgaga

SEQ ID NO: 622166 - RNA, 20 nt, Human
gcaaaccaagcguguccaca

SEQ ID NO: 622167 - RNA, 20 nt, Human
gcaccacugcauuccagccu

SEQ ID NO: 622168 - RNA, 24 nt, Human
gcauuccagccugggcgacagagc

SEQ ID NO: 622169 - RNA, 20 nt, Human
gccaagaucgcaccacugca

SEQ ID NO: 622170 - RNA, 20 nt, Human
gcuauuuuaagguuugauug

SEQ ID NO: 622171 - RNA, 21 nt, Human
ggaaaaacaguguuuucauga

SEQ ID NO: 622172 - RNA, 23 nt, Human
ggagaaaggacaaaaaaaaauac

SEQ ID NO: 622173 - RNA, 24 nt, Human
ggccgugguggcucaugccuguaa

SEQ ID NO: 622174 - RNA, 21 nt, Human
ggcucaugccuguaaucccag

SEQ ID NO: 622175 - RNA, 24 nt, Human
gguggcucaugccuguaaucccag

SEQ ID NO: 622176 - RNA, 24 nt, Human
guuuuauuucucucauaugcaagu

SEQ ID NO: 622177 - RNA, 24 nt, Human
uaaaaaacgcauuauuacacuuua

SEQ ID NO: 622178 - RNA, 25 nt, Human
uaaaaaacgcauuauuacacuuuac

SEQ ID NO: 622179 - RNA, 23 nt, Human
uaaaaacacaaaacacuagaaca

SEQ ID NO: 622180 - RNA, 20 nt, Human
uaaauauaagccuauugacc

SEQ ID NO: 622181 - RNA, 22 nt, Human
uaacucaguucaauuauugaac

SEQ ID NO: 622182 - RNA, 19 nt, Human
uaagcaccaaaguaaaaua

SEQ ID NO: 622183 - RNA, 18 nt, Human
uaccaagaauguuaacuc

SEQ ID NO: 622184 - RNA, 21 nt, Human
uagaaaacccaauacuagcua

SEQ ID NO: 622185 - RNA, 22 nt, Human
uagaaccgcuugaacccgagag

SEQ ID NO: 622186 - RNA, 19 nt, Human
uagagcaaaccaagcgugu

SEQ ID NO: 622187 - RNA, 24 nt, Human
uagcuacucaggaggcugaggcag

SEQ ID NO: 622188 - RNA, 23 nt, Human
uauaaucagauaucucaaauucc

SEQ ID NO: 622189 - RNA, 23 nt, Human
uaugcaaguaauuaccucucaaa

SEQ ID NO: 622190 - RNA, 21 nt, Human
uaugcuuuauuagggggaaaa

SEQ ID NO: 622191 - RNA, 26 nt, Human
ucaaaaaaaaaaaaaaaaaccccaaa

SEQ ID NO: 622192 - RNA, 23 nt, Human
ucacaaggucaggaguucgagac

SEQ ID NO: 622193 - RNA, 24 nt, Human
ucacaaggucaggaguucgagacu

SEQ ID NO: 622194 - RNA, 23 nt, Human
ucacacauaaacaaaaauagagc

SEQ ID NO: 622195 - RNA, 23 nt, Human
ucagagucuugagaaacuuaaag

SEQ ID NO: 622196 - RNA, 19 nt, Human
uccacaucuccaugaauuc

SEQ ID NO: 622197 - RNA, 24 nt, Human
uccagccugggcgacagagcaaga

SEQ ID NO: 622198 - RNA, 21 nt, Human
ucccuggagauuaaaucaaau

SEQ ID NO: 622199 - RNA, 23 nt, Human
ucgcaccacugcauuccagccug

SEQ ID NO: 622200 - RNA, 21 nt, Human
ucggucucaaaaaaaaaaaaa

SEQ ID NO: 622201 - RNA, 25 nt, Human
ucggucucaaaaaaaaaaaaaaaaa

SEQ ID NO: 622202 - RNA, 22 nt, Human
ucucuacuaaaaauacaaaaaa

SEQ ID NO: 622203 - RNA, 21 nt, Human
ugaaaaaacuagaaaacccaa

SEQ ID NO: 622204 - RNA, 20 nt, Human
ugaacaaaucacucuuaaac

SEQ ID NO: 622205 - RNA, 24 nt, Human
ugacagaaccacuaucacacauag

SEQ ID NO: 622206 - RNA, 18 nt, Human
ugaccaacauggugaaac

SEQ ID NO: 622207 - RNA, 18 nt, Human
ugacuuauagacaagacc

SEQ ID NO: 622208 - RNA, 19 nt, Human
ugacuuauagacaagacca

SEQ ID NO: 622209 - RNA, 19 nt, Human
ugagaaacuuaaagugcag

SEQ ID NO: 622210 - RNA, 24 nt, Human
ugaggcaguagaaccgcuugaacc

SEQ ID NO: 622211 - RNA, 25 nt, Human
ugaggcaguagaaccgcuugaaccc

SEQ ID NO: 622212 - RNA, 24 nt, Human
ugaggcaugcggaucacaagguca

SEQ ID NO: 622213 - RNA, 20 nt, Human
ugcaaguaauuaccucucaa

SEQ ID NO: 622214 - RNA, 23 nt, Human
ugccuguaaucccagcacuuugg

SEQ ID NO: 622215 - RNA, 23 nt, Human
ugccuguaaucccagcacuuugg

SEQ ID NO: 622216 - RNA, 24 nt, Human
ugccuguaaucccagcacuuuggg

SEQ ID NO: 622217 - RNA, 19 nt, Human
uggcacacaccuguaaucc

SEQ ID NO: 622218 - RNA, 24 nt, Human
uggcgggccgugguggcucaugcc

SEQ ID NO: 622219 - RNA, 22 nt, Human
uggcucaugccuguaaucccag

SEQ ID NO: 622220 - RNA, 24 nt, Human
uggcucaugccuguaaucccagca

SEQ ID NO: 622221 - RNA, 24 nt, Human
ugggaggcugaggcaugcggauca

SEQ ID NO: 622222 - RNA, 22 nt, Human
ugguggcacacaccuguaaucc

SEQ ID NO: 622223 - RNA, 24 nt, Human
ugguggcucaugccuguaauccca

SEQ ID NO: 622224 - RNA, 26 nt, Human
uguaagaaacaauuucugggaauaua

SEQ ID NO: 622225 - RNA, 19 nt, Human
ugucaacagcugugauuca

SEQ ID NO: 622226 - RNA, 19 nt, Human
ugugauucauaugaaaaau

SEQ ID NO: 622227 - RNA, 19 nt, Human
uguuggagccccugagguc

SEQ ID NO: 622228 - RNA, 21 nt, Human
uuaaaguuuuaauaguuuauc

SEQ ID NO: 622229 - RNA, 22 nt, Human
uugcagugagccaagaucgcac

SEQ ID NO: 622230 - RNA, 25 nt, Human
uugggaggcugaggcaugcggauca

SEQ ID NO: 622231 - RNA, 22 nt, Human
uuuucucccuguuggagccccu

SEQ ID NO: 622232 - RNA, 19 nt, Human
aaaaugcugggauuacagg

SEQ ID NO: 622233 - RNA, 24 nt, Human
aaaaugcugggauuacaggugcga

SEQ ID NO: 622234 - RNA, 25 nt, Human
aaacugaaguuuaucacacagcuaa

SEQ ID NO: 622235 - RNA, 24 nt, Human
aaaguguugggauuacagguguga

SEQ ID NO: 622236 - RNA, 19 nt, Human
aaaugcugggauuacaggu

SEQ ID NO: 622237 - RNA, 20 nt, Human
aaccucugccucccgggcuc

SEQ ID NO: 622238 - RNA, 20 nt, Human
aagaccccuuucccaacuaa

SEQ ID NO: 622239 - RNA, 25 nt, Human
aagcaauccucccaccucagccucc

SEQ ID NO: 622240 - RNA, 24 nt, Human
aagcgauccgccugccucagccuc

SEQ ID NO: 622241 - RNA, 25 nt, Human
aaguccuaaaagcuuaguguaagcc

SEQ ID NO: 622242 - RNA, 21 nt, Human
aaguguugggauuacaggugu

SEQ ID NO: 622243 - RNA, 26 nt, Human
aaguguugggauuacaggugugaacc

SEQ ID NO: 622244 - RNA, 18 nt, Human
acaggguuucaccauguu

SEQ ID NO: 622245 - RNA, 19 nt, Human
acaggguuucaccauguug

SEQ ID NO: 622246 - RNA, 24 nt, Human
acaggguuucaccauguugcccag

SEQ ID NO: 622247 - RNA, 20 nt, Human
accaccacgccuggcccacu

SEQ ID NO: 622248 - RNA, 25 nt, Human
accauguugcccaggcuuuucucga

SEQ ID NO: 622249 - RNA, 24 nt, Human
acccagcuaauuuuuuuguauuuu

SEQ ID NO: 622250 - RNA, 20 nt, Human
accuuagccacuugaguagc

SEQ ID NO: 622251 - RNA, 21 nt, Human
acuacaagugcaugccaccau

SEQ ID NO: 622252 - RNA, 19 nt, Human
acuacaggugcaugccacc

SEQ ID NO: 622253 - RNA, 24 nt, Human
acuugaguagcugggacuacaggu

SEQ ID NO: 622254 - RNA, 23 nt, Human
agacaggguuucaccauguugcc

SEQ ID NO: 622255 - RNA, 24 nt, Human
agcgauccgccugccucagccucc

SEQ ID NO: 622256 - RNA, 24 nt, Human
agcuggucucaaacuccugagcuc

SEQ ID NO: 622257 - RNA, 19 nt, Human
aggugugaaccaccacgcc

SEQ ID NO: 622258 - RNA, 18 nt, Human
aguagcugggacuacagg

SEQ ID NO: 622259 - RNA, 18 nt, Human
aguagcugggacuacagg

SEQ ID NO: 622260 - RNA, 20 nt, Human
agugcaguggugcaaucaug

SEQ ID NO: 622261 - RNA, 23 nt, Human
agugcaguggugcaaucauggcu

SEQ ID NO: 622262 - RNA, 22 nt, Human
auagugagcuuucaugagaucu

SEQ ID NO: 622263 - RNA, 18 nt, Human
aucauggcucacugcaac

SEQ ID NO: 622264 - RNA, 18 nt, Human
augggguuucaccauguu

SEQ ID NO: 622265 - RNA, 19 nt, Human
augggguuucaccauguug

SEQ ID NO: 622266 - RNA, 26 nt, Human
auguucuauauccauaacuuuguaca

SEQ ID NO: 622267 - RNA, 24 nt, Human
caaaaugcugggauuacaggugcg

SEQ ID NO: 622268 - RNA, 24 nt, Human
caaaguguugggauuacaggugug

SEQ ID NO: 622269 - RNA, 23 nt, Human
caaccucugccucccgggcucaa

SEQ ID NO: 622270 - RNA, 22 nt, Human
caagcaaguuauuaaaaaccug

SEQ ID NO: 622271 - RNA, 27 nt, Human
caagcaauccucccaccucagccuccc

SEQ ID NO: 622272 - RNA, 27 nt, Human
caagcaauccucccaccucagccuccc

SEQ ID NO: 622273 - RNA, 21 nt, Human
caaucaagaccccuuucccaa

SEQ ID NO: 622274 - RNA, 23 nt, Human
caccauguugcccagcuggucuc

SEQ ID NO: 622275 - RNA, 26 nt, Human
caccauguugcccagcuggucucaaa

SEQ ID NO: 622276 - RNA, 22 nt, Human
caccauguugcccaggcuuuuc

SEQ ID NO: 622277 - RNA, 24 nt, Human
caccauguugcccaggcuuuucuc

SEQ ID NO: 622278 - RNA, 18 nt, Human
cacccaagucucaucuug

SEQ ID NO: 622279 - RNA, 20 nt, Human
cacccagucaagagauucuu

SEQ ID NO: 622280 - RNA, 20 nt, Human
cacccucucaccuuagccac

SEQ ID NO: 622281 - RNA, 23 nt, Human
caccucagccucccaaagccucc

SEQ ID NO: 622282 - RNA, 21 nt, Human
cacugcaaccucugccucccg

SEQ ID NO: 622283 - RNA, 23 nt, Human
cacugcaaccucugccucccggg

SEQ ID NO: 622284 - RNA, 22 nt, Human
cagaaaauagcucagaaucuca

SEQ ID NO: 622285 - RNA, 20 nt, Human
cagaaucucaaagcaucaau

SEQ ID NO: 622286 - RNA, 19 nt, Human
cagccuccaccuccugggc

SEQ ID NO: 622287 - RNA, 23 nt, Human
cagccuccaccuccugggcucaa

SEQ ID NO: 622288 - RNA, 24 nt, Human
cagccuccaccuccugggcucaag

SEQ ID NO: 622289 - RNA, 24 nt, Human
caggguuucaccauguugcccagg

SEQ ID NO: 622290 - RNA, 24 nt, Human
caugccaccacacccagcuaauuu

SEQ ID NO: 622291 - RNA, 21 nt, Human
cauggcucacugcaaccucug

SEQ ID NO: 622292 - RNA, 23 nt, Human
cauguugcccagcuggucucaaa

SEQ ID NO: 622293 - RNA, 21 nt, Human
cauguugcccaggcuuuucuc

SEQ ID NO: 622294 - RNA, 24 nt, Human
cauguugcccaggcuuuucucgaa

SEQ ID NO: 622295 - RNA, 21 nt, Human
ccaaaaugcugggauuacagg

SEQ ID NO: 622296 - RNA, 22 nt, Human
ccaaaaugcugggauuacaggu

SEQ ID NO: 622297 - RNA, 21 nt, Human
ccaaaguguugggauuacagg

SEQ ID NO: 622298 - RNA, 21 nt, Human
ccaaaguguugggauuacagg

SEQ ID NO: 622299 - RNA, 24 nt, Human
ccaaaguguugggauuacaggugu

SEQ ID NO: 622300 - RNA, 24 nt, Human
ccaccuccugggcucaagugaucc

SEQ ID NO: 622301 - RNA, 24 nt, Human
ccacuugaguagcugggacuacag

SEQ ID NO: 622302 - RNA, 18 nt, Human
cccgggcucaagccaccc

SEQ ID NO: 622303 - RNA, 26 nt, Human
ccgccugccucagccucccaaaaugc

SEQ ID NO: 622304 - RNA, 22 nt, Human
ccuccaccuccugggcucaagu

SEQ ID NO: 622305 - RNA, 21 nt, Human
ccugagcucaagcgauccgcc

SEQ ID NO: 622306 - RNA, 22 nt, Human
ccugggcucaagugauccuccc

SEQ ID NO: 622307 - RNA, 23 nt, Human
ccuuggcucaagcaauccuccca

SEQ ID NO: 622308 - RNA, 20 nt, Human
cgggcucaagccacccucuc

SEQ ID NO: 622309 - RNA, 24 nt, Human
cucaagcaauccucccaccucagc

SEQ ID NO: 622310 - RNA, 24 nt, Human
cucaagugauccucccaccuuagc

SEQ ID NO: 622311 - RNA, 24 nt, Human
cucacugcaaccucugccucccgg

SEQ ID NO: 622312 - RNA, 24 nt, Human
cucacuuugucacgcaggcuggag

SEQ ID NO: 622313 - RNA, 19 nt, Human
cucaugauagugagcuuuc

SEQ ID NO: 622314 - RNA, 24 nt, Human
cucauugcagccuccaccuccugg

SEQ ID NO: 622315 - RNA, 23 nt, Human
cucccaccuuagcugaacuacaa

SEQ ID NO: 622316 - RNA, 25 nt, Human
cucccgggcucaagccacccucuca

SEQ ID NO: 622317 - RNA, 21 nt, Human
cuccugggcucaagugauccu

SEQ ID NO: 622318 - RNA, 25 nt, Human
cuccugggcucaagugauccuccca

SEQ ID NO: 622319 - RNA, 19 nt, Human
cugcaaccucugccucccg

SEQ ID NO: 622320 - RNA, 23 nt, Human
cugcaaccucugccucccgggcu

SEQ ID NO: 622321 - RNA, 23 nt, Human
cugccucagccucccaaaaugcu

SEQ ID NO: 622322 - RNA, 24 nt, Human
cugccucagccucccaaaaugcug

SEQ ID NO: 622323 - RNA, 24 nt, Human
cuuagccacuugaguagcugggac

SEQ ID NO: 622324 - RNA, 23 nt, Human
cuugaguagcugggacuacaggu

SEQ ID NO: 622325 - RNA, 19 nt, Human
cuuuagcuguagcaccaga

SEQ ID NO: 622326 - RNA, 24 nt, Human
cuuuguguguuuuugguagagaca

SEQ ID NO: 622327 - RNA, 19 nt, Human
gaaaggguaaaguuuggaa

SEQ ID NO: 622328 - RNA, 22 nt, Human
gaacuacaagugcaugccacca

SEQ ID NO: 622329 - RNA, 23 nt, Human
gaauuccuuggcucaagcaaucc

SEQ ID NO: 622330 - RNA, 20 nt, Human
gacuuuuuuuuuuuuuugaa

SEQ ID NO: 622331 - RNA, 18 nt, Human
gagaugggguuucaccau

SEQ ID NO: 622332 - RNA, 23 nt, Human
gagaugggguuucaccauguugc

SEQ ID NO: 622333 - RNA, 24 nt, Human
gagcucaagcgauccgccugccuc

SEQ ID NO: 622334 - RNA, 19 nt, Human
gaguagcugggacuacagg

SEQ ID NO: 622335 - RNA, 26 nt, Human
gaguagcugggacuacaggugcaugc

SEQ ID NO: 622336 - RNA, 22 nt, Human
gagugaauaauacuaaagcuaa

SEQ ID NO: 622337 - RNA, 22 nt, Human
gaugggguuucaccauguugcc

SEQ ID NO: 622338 - RNA, 18 nt, Human
gauuacaggugcgaguca

SEQ ID NO: 622339 - RNA, 22 nt, Human
gauuacaggugcgagucaccgc

SEQ ID NO: 622340 - RNA, 21 nt, Human
gauuacaggugugaaccacca

SEQ ID NO: 622341 - RNA, 22 nt, Human
gcaaccucugccucccgggcuc

SEQ ID NO: 622342 - RNA, 20 nt, Human
gcagccuccaccuccugggc

SEQ ID NO: 622343 - RNA, 18 nt, Human
gcgauccgccugccucag

SEQ ID NO: 622344 - RNA, 24 nt, Human
gcgauccgccugccucagccuccc

SEQ ID NO: 622345 - RNA, 24 nt, Human
gcucaagcgauccgccugccucag

SEQ ID NO: 622346 - RNA, 21 nt, Human
gcucacugcaaccucugccuc

SEQ ID NO: 622347 - RNA, 20 nt, Human
gcuggagugcagaggcacua

SEQ ID NO: 622348 - RNA, 20 nt, Human
ggcuggagugcagaggcacu

SEQ ID NO: 622349 - RNA, 21 nt, Human
gggcucaagugauccucccac

SEQ ID NO: 622350 - RNA, 22 nt, Human
gggcucaagugauccucccacc

SEQ ID NO: 622351 - RNA, 22 nt, Human
gggguuucaccauguugcccag

SEQ ID NO: 622352 - RNA, 22 nt, Human
gggucuugcuuuguugcccaag

SEQ ID NO: 622353 - RNA, 21 nt, Human
gguagagacaggguuucacca

SEQ ID NO: 622354 - RNA, 21 nt, Human
gguggagaugggguuucacca

SEQ ID NO: 622355 - RNA, 21 nt, Human
guagagacaggguuucaccau

SEQ ID NO: 622356 - RNA, 22 nt, Human
guagagacaggguuucaccaug

SEQ ID NO: 622357 - RNA, 19 nt, Human
guggagaugggguuucacc

SEQ ID NO: 622358 - RNA, 21 nt, Human
guggagaugggguuucaccau

SEQ ID NO: 622359 - RNA, 22 nt, Human
guggagaugggguuucaccaug

SEQ ID NO: 622360 - RNA, 23 nt, Human
guggagaugggguuucaccaugu

SEQ ID NO: 622361 - RNA, 28 nt, Human
uaauuucuuuguguguuuuugguagaga

SEQ ID NO: 622362 - RNA, 23 nt, Human
uaauuuuuuuguauuuuuggugg

SEQ ID NO: 622363 - RNA, 26 nt, Human
uaauuuuuuuguauuuuugguggaga

SEQ ID NO: 622364 - RNA, 24 nt, Human
uacaggugcaugccaccacaccca

SEQ ID NO: 622365 - RNA, 22 nt, Human
uacaggugugaaccaccacgcc

SEQ ID NO: 622366 - RNA, 22 nt, Human
uagagacaggguuucaccaugu

SEQ ID NO: 622367 - RNA, 21 nt, Human
uagagugcaguggugcaauca

SEQ ID NO: 622368 - RNA, 24 nt, Human
uagagugcaguggugcaaucaugg

SEQ ID NO: 622369 - RNA, 20 nt, Human
uagcaccagagugaauaaua

SEQ ID NO: 622370 - RNA, 24 nt, Human
uaucacacagcuaauuggauggca

SEQ ID NO: 622371 - RNA, 24 nt, Human
uauuuuauucucauuaguaggcca

SEQ ID NO: 622372 - RNA, 21 nt, Human
ucaaagcaucaauggacuuug

SEQ ID NO: 622373 - RNA, 24 nt, Human
ucacugcaaccucugccucccggg

SEQ ID NO: 622374 - RNA, 25 nt, Human
ucacugcaaccucugccucccgggc

SEQ ID NO: 622375 - RNA, 20 nt, Human
ucagccucccaaagccuccc

SEQ ID NO: 622376 - RNA, 24 nt, Human
ucauugcagccuccaccuccuggg

SEQ ID NO: 622377 - RNA, 25 nt, Human
ucauugcagccuccaccuccugggc

SEQ ID NO: 622378 - RNA, 19 nt, Human
ucauuguucaaucaagacc

SEQ ID NO: 622379 - RNA, 23 nt, Human
ucccaaaaugcugggauuacagg

SEQ ID NO: 622380 - RNA, 23 nt, Human
ucccaaagccucccaaaguguug

SEQ ID NO: 622381 - RNA, 23 nt, Human
ucccaaaguguugggauuacagg

SEQ ID NO: 622382 - RNA, 25 nt, Human
uccccacccaagucucaucuugaau

SEQ ID NO: 622383 - RNA, 21 nt, Human
ucccgggcucaagccacccuc

SEQ ID NO: 622384 - RNA, 23 nt, Human
ucccgggcucaagccacccucuc

SEQ ID NO: 622385 - RNA, 24 nt, Human
uccgccugccucagccucccaaaa

SEQ ID NO: 622386 - RNA, 25 nt, Human
uccucccaccucagccucccaaagc

SEQ ID NO: 622387 - RNA, 21 nt, Human
uccugggcucaagugauccuc

SEQ ID NO: 622388 - RNA, 22 nt, Human
uccugggcucaagugauccucc

SEQ ID NO: 622389 - RNA, 24 nt, Human
uccuuggcucaagcaauccuccca

SEQ ID NO: 622390 - RNA, 23 nt, Human
ucucaaacuccugagcucaagcg

SEQ ID NO: 622391 - RNA, 24 nt, Human
ucucacuuugucacgcaggcugga

SEQ ID NO: 622392 - RNA, 21 nt, Human
ucucaugauagugagcuuuca

SEQ ID NO: 622393 - RNA, 22 nt, Human
ucucaugguuucuucaguauau

SEQ ID NO: 622394 - RNA, 23 nt, Human
ucucgaauuccuuggcucaagca

SEQ ID NO: 622395 - RNA, 18 nt, Human
ucuugcuuuguugcccaa

SEQ ID NO: 622396 - RNA, 19 nt, Human
ucuugcuuuguugcccaag

SEQ ID NO: 622397 - RNA, 23 nt, Human
ucuuuguguguuuuugguagaga

SEQ ID NO: 622398 - RNA, 24 nt, Human
ugaaacaaauagucugcaaggaug

SEQ ID NO: 622399 - RNA, 20 nt, Human
ugaaaggguaaaguuuggaa

SEQ ID NO: 622400 - RNA, 19 nt, Human
ugaacuacaagugcaugcc

SEQ ID NO: 622401 - RNA, 21 nt, Human
ugaaguuuaucacacagcuaa

SEQ ID NO: 622402 - RNA, 21 nt, Human
ugagaucugaugguuuuauaa

SEQ ID NO: 622403 - RNA, 26 nt, Human
ugauguaaauuucagccauauaugga

SEQ ID NO: 622404 - RNA, 19 nt, Human
ugauuuaaaagagggagua

SEQ ID NO: 622405 - RNA, 20 nt, Human
ugcagccuccaccuccuggg

SEQ ID NO: 622406 - RNA, 22 nt, Human
ugcaguggugcaaucauggcuc

SEQ ID NO: 622407 - RNA, 23 nt, Human
ugcaguggugcaaucauggcuca

SEQ ID NO: 622408 - RNA, 20 nt, Human
ugcaugccaccacacccagc

SEQ ID NO: 622409 - RNA, 21 nt, Human
ugcccaaguuagagugcagug

SEQ ID NO: 622410 - RNA, 24 nt, Human
ugccucagccucccaaaaugcugg

SEQ ID NO: 622411 - RNA, 24 nt, Human
ugcugggauuacaggugcgaguca

SEQ ID NO: 622412 - RNA, 23 nt, Human
uggagugcagaggcacuaucuca

SEQ ID NO: 622413 - RNA, 20 nt, Human
uggcaaggcagaaacucaaa

SEQ ID NO: 622414 - RNA, 20 nt, Human
uggcucaagcaauccuccca

SEQ ID NO: 622415 - RNA, 21 nt, Human
ugggacuacaggugcaugcca

SEQ ID NO: 622416 - RNA, 22 nt, Human
ugggacuacaggugcaugccac

SEQ ID NO: 622417 - RNA, 24 nt, Human
ugggacuacaggugcaugccacca

SEQ ID NO: 622418 - RNA, 18 nt, Human
ugggauuacaggugcgag

SEQ ID NO: 622419 - RNA, 21 nt, Human
ugggauuacaggugcgaguca

SEQ ID NO: 622420 - RNA, 22 nt, Human
ugggauuacaggugcgagucac

SEQ ID NO: 622421 - RNA, 23 nt, Human
ugggauuacaggugcgagucacc

SEQ ID NO: 622422 - RNA, 24 nt, Human
ugggauuacaggugcgagucaccg

SEQ ID NO: 622423 - RNA, 22 nt, Human
ugggauuacaggugugaaccac

SEQ ID NO: 622424 - RNA, 23 nt, Human
ugggauuacaggugugaaccacc

SEQ ID NO: 622425 - RNA, 24 nt, Human
ugggauuacaggugugaaccacca

SEQ ID NO: 622426 - RNA, 24 nt, Human
ugggauuacaggugugaaccacca

SEQ ID NO: 622427 - RNA, 24 nt, Human
ugggcucaagugauccucccaccu

SEQ ID NO: 622428 - RNA, 24 nt, Human
uggggucuugcuuuguugcccaag

SEQ ID NO: 622429 - RNA, 18 nt, Human
ugggguuucaccauguug

SEQ ID NO: 622430 - RNA, 24 nt, Human
ugguagagacaggguuucaccaug

SEQ ID NO: 622431 - RNA, 24 nt, Human
ugguggagaugggguuucaccaug

SEQ ID NO: 622432 - RNA, 18 nt, Human
uguugcuuauuuuauucu

SEQ ID NO: 622433 - RNA, 23 nt, Human
uuaucucaagcaaguuauuaaaa

SEQ ID NO: 622434 - RNA, 19 nt, Human
uuccugcauuccuguuugu

SEQ ID NO: 622435 - RNA, 22 nt, Human
uuccuuggcucaagcaauccuc

SEQ ID NO: 622436 - RNA, 23 nt, Human
uucuuuguguguuuuugguagag

SEQ ID NO: 622437 - RNA, 23 nt, Human
uugcagccuccaccuccugggcu

SEQ ID NO: 622438 - RNA, 24 nt, Human
uugcagccuccaccuccugggcuc

SEQ ID NO: 622439 - RNA, 24 nt, Human
uugcuuuguugcccaaguuagagu

SEQ ID NO: 622440 - RNA, 21 nt, Human
uugggauuacaggugugaacc

SEQ ID NO: 622441 - RNA, 24 nt, Human
uugguagagacaggguuucaccau

SEQ ID NO: 622442 - RNA, 24 nt, Human
uugguggagaugggguuucaccau

SEQ ID NO: 622443 - RNA, 18 nt, Human
uuucaccauguugcccag

SEQ ID NO: 622444 - RNA, 21 nt, Human
uuucaccauguugcccaggcu

SEQ ID NO: 622445 - RNA, 24 nt, Human
uuugucacgcaggcuggagugcag

SEQ ID NO: 622446 - RNA, 23 nt, Human
uuuguugcccaaguuagagugca

SEQ ID NO: 622447 - RNA, 24 nt, Human
uuuuugagauggggucuugcuuug

SEQ ID NO: 622448 - RNA, 22 nt, Human
uuuuugguagagacaggguuuc

SEQ ID NO: 622449 - RNA, 24 nt, Human
uuuuugguagagacaggguuucac

SEQ ID NO: 622450 - RNA, 22 nt, Human
uuuuugguggagaugggguuuc

SEQ ID NO: 622451 - RNA, 24 nt, Human
uuuuugguggagaugggguuucac

SEQ ID NO: 622452 - RNA, 21 nt, Human
uuuuuguauuuuugguggaga

SEQ ID NO: 622453 - RNA, 21 nt, Human
uuuuuuguauuuuugguggag

SEQ ID NO: 622454 - RNA, 24 nt, Human
uuuuuuguauuuuugguggagaug

SEQ ID NO: 622455 - RNA, 24 nt, Human
uuuuuuuuuugagauggggucuug

SEQ ID NO: 622456 - RNA, 23 nt, Human
uuuuuuuuuuuugagagaggguc

SEQ ID NO: 622457 - RNA, 26 nt, Human
uuuuuuuuuuuugagagagggucuca

SEQ ID NO: 622458 - RNA, 24 nt, Human
uuuuuuuuuuuugagauggggucu

SEQ ID NO: 622459 - RNA, 22 nt, Human
uuuuuuuuuuuuuugagauggg

SEQ ID NO: 622460 - RNA, 22 nt, Human
uuuuuuuuuuuuuugagauggg

SEQ ID NO: 622461 - RNA, 25 nt, Human
uuuuuuuuuuuuuuuugagagaggg

SEQ ID NO: 622462 - RNA, 18 nt, Human
uuuuuuuuuuuuuuuuug

SEQ ID NO: 622463 - RNA, 24 nt, Human
aaaaaaaacuauuuuaauugggga

SEQ ID NO: 622464 - RNA, 19 nt, Human
aacacagcaagacccuauc

SEQ ID NO: 622465 - RNA, 20 nt, Human
aacacagcaagacccuaucu

SEQ ID NO: 622466 - RNA, 21 nt, Human
aacacagcaagacccuaucuc

SEQ ID NO: 622467 - RNA, 20 nt, Human
aacauagcaaguccccaucu

SEQ ID NO: 622468 - RNA, 24 nt, Human
aagaaggaauaacaggccaggugu

SEQ ID NO: 622469 - RNA, 20 nt, Human
aagcaaaagguaguaaacua

SEQ ID NO: 622470 - RNA, 22 nt, Human
aagcagaaggauccugagccca

SEQ ID NO: 622471 - RNA, 18 nt, Human
aaucacacagcaaacuuu

SEQ ID NO: 622472 - RNA, 27 nt, Human
acaauacauuccaacucuauacaaaca

SEQ ID NO: 622473 - RNA, 21 nt, Human
acaggcaugcacgaacaauac

SEQ ID NO: 622474 - RNA, 26 nt, Human
acuacaacaaaauuguucugccauau

SEQ ID NO: 622475 - RNA, 18 nt, Human
acugcugcacucuagccu

SEQ ID NO: 622476 - RNA, 24 nt, Human
acugcugcacucuagccugggcaa

SEQ ID NO: 622477 - RNA, 18 nt, Human
agaaaaaaauauaaucaa

SEQ ID NO: 622478 - RNA, 22 nt, Human
agaaacaugaaguuagcacagc

SEQ ID NO: 622479 - RNA, 26 nt, Human
agccacuggacucucguuccaaacaa

SEQ ID NO: 622480 - RNA, 24 nt, Human
agccugggcaacacagcaagaccc

SEQ ID NO: 622481 - RNA, 18 nt, Human
agccuuuggaauaagaaa

SEQ ID NO: 622482 - RNA, 19 nt, Human
aggaagguauaccucaaag

SEQ ID NO: 622483 - RNA, 18 nt, Human
aggaggccgaagcagaag

SEQ ID NO: 622484 - RNA, 24 nt, Human
aggccaggugugguggcucaugcu

SEQ ID NO: 622485 - RNA, 24 nt, Human
aggugugguggcacacaccugugg

SEQ ID NO: 622486 - RNA, 24 nt, Human
aggugugguggcucaugcuuguaa

SEQ ID NO: 622487 - RNA, 22 nt, Human
agucugggcaacauagcaaguc

SEQ ID NO: 622488 - RNA, 23 nt, Human
agucugggcaacauagcaagucc

SEQ ID NO: 622489 - RNA, 28 nt, Human
auaacugaccauuugcuuaaugcuauau

SEQ ID NO: 622490 - RNA, 24 nt, Human
aucucuacaaaaaauuuuaaaaaa

SEQ ID NO: 622491 - RNA, 19 nt, Human
augggaagggaaaaaaaaa

SEQ ID NO: 622492 - RNA, 21 nt, Human
caaaauuguucugccauaucu

SEQ ID NO: 622493 - RNA, 22 nt, Human
caaagacaugggaaaaaagcaa

SEQ ID NO: 622494 - RNA, 24 nt, Human
caacacagcaagacccuaucucuu

SEQ ID NO: 622495 - RNA, 22 nt, Human
caccaaguacauucuuuuagaa

SEQ ID NO: 622496 - RNA, 21 nt, Human
caccuguggucuuagcuacuc

SEQ ID NO: 622497 - RNA, 24 nt, Human
caccuguggucuuagcuacucagg

SEQ ID NO: 622498 - RNA, 18 nt, Human
cacucuagccugggcaac

SEQ ID NO: 622499 - RNA, 21 nt, Human
caggccaggugugguggcuca

SEQ ID NO: 622500 - RNA, 23 nt, Human
caggccaggugugguggcucaug

SEQ ID NO: 622501 - RNA, 22 nt, Human
cauagcaaguccccaucucuac

SEQ ID NO: 622502 - RNA, 23 nt, Human
cauagcaaguccccaucucuaca

SEQ ID NO: 622503 - RNA, 22 nt, Human
ccaggaguuccaggcugcagug

SEQ ID NO: 622504 - RNA, 25 nt, Human
ccaggaguucgagaccagucugggc

SEQ ID NO: 622505 - RNA, 18 nt, Human
ccuccuuuaaaaacugag

SEQ ID NO: 622506 - RNA, 22 nt, Human
ccugggcaacacagcaagaccc

SEQ ID NO: 622507 - RNA, 19 nt, Human
cgaaaaaaauguacaaagc

SEQ ID NO: 622508 - RNA, 26 nt, Human
cucaaugcaacuuaacagugagaauu

SEQ ID NO: 622509 - RNA, 23 nt, Human
cugaaaaguacagucuugaaaua

SEQ ID NO: 622510 - RNA, 18 nt, Human
cugcacucuagccugggc

SEQ ID NO: 622511 - RNA, 19 nt, Human
cugcacucuagccugggca

SEQ ID NO: 622512 - RNA, 20 nt, Human
cugcacucuagccugggcaa

SEQ ID NO: 622513 - RNA, 21 nt, Human
cugcacucuagccugggcaac

SEQ ID NO: 622514 - RNA, 22 nt, Human
cugcacucuagccugggcaaca

SEQ ID NO: 622515 - RNA, 20 nt, Human
cugcugcacucuagccuggg

SEQ ID NO: 622516 - RNA, 21 nt, Human
cugcugcacucuagccugggc

SEQ ID NO: 622517 - RNA, 24 nt, Human
cugcugcacucuagccugggcaac

SEQ ID NO: 622518 - RNA, 21 nt, Human
gacaugggaaaaaagcaaacu

SEQ ID NO: 622519 - RNA, 18 nt, Human
gauccugagcccaggagu

SEQ ID NO: 622520 - RNA, 20 nt, Human
gcaacauagcaaguccccau

SEQ ID NO: 622521 - RNA, 22 nt, Human
gcacacaccuguggucuuagcu

SEQ ID NO: 622522 - RNA, 20 nt, Human
gccgaagcagaaggauccug

SEQ ID NO: 622523 - RNA, 24 nt, Human
gcuauauuacuuaaagccaccaag

SEQ ID NO: 622524 - RNA, 23 nt, Human
gggagcccacccuguacaugcuc

SEQ ID NO: 622525 - RNA, 24 nt, Human
gguggcacacaccuguggucuuag

SEQ ID NO: 622526 - RNA, 24 nt, Human
gguggcucaugcuuguaauucuag

SEQ ID NO: 622527 - RNA, 24 nt, Human
gguggcuugaggccaggaguucga

SEQ ID NO: 622528 - RNA, 27 nt, Human
uaaaaaaaacagccuauguaaaauaua

SEQ ID NO: 622529 - RNA, 18 nt, Human
uaaacuuaaaaaaaacag

SEQ ID NO: 622530 - RNA, 21 nt, Human
uaagaaaugcuacggaaaaaa

SEQ ID NO: 622531 - RNA, 28 nt, Human
uaagaaaugcuacggaaaaaaauacuac

SEQ ID NO: 622532 - RNA, 21 nt, Human
uaauaaauacaacagggagcc

SEQ ID NO: 622533 - RNA, 18 nt, Human
uacaguauaaacacauuc

SEQ ID NO: 622534 - RNA, 22 nt, Human
uacaugaaacacuuaaaaaugc

SEQ ID NO: 622535 - RNA, 24 nt, Human
uagagagaaaauauuuaaucuauu

SEQ ID NO: 622536 - RNA, 23 nt, Human
uagcauaauuuaucaacuaaugu

SEQ ID NO: 622537 - RNA, 21 nt, Human
uauacaguauaaacacauucu

SEQ ID NO: 622538 - RNA, 24 nt, Human
uauccuauugcaaagacaugggaa

SEQ ID NO: 622539 - RNA, 27 nt, Human
uaucucuuaaaaacaaaaaaaugggaa

SEQ ID NO: 622540 - RNA, 28 nt, Human
uauuauuaagaaaugcuacggaaaaaaa

SEQ ID NO: 622541 - RNA, 21 nt, Human
uauucaggacaaaauagugac

SEQ ID NO: 622542 - RNA, 22 nt, Human
uauugcaaagacaugggaaaaa

SEQ ID NO: 622543 - RNA, 24 nt, Human
uauugcaaagacaugggaaaaaag

SEQ ID NO: 622544 - RNA, 21 nt, Human
ucacugcugcacucuagccug

SEQ ID NO: 622545 - RNA, 20 nt, Human
uccacauguaaagauaugac

SEQ ID NO: 622546 - RNA, 18 nt, Human
uccauauacaguauaaac

SEQ ID NO: 622547 - RNA, 18 nt, Human
uccugagcccaggaguuc

SEQ ID NO: 622548 - RNA, 18 nt, Human
uccuuuaaaaacugagcu

SEQ ID NO: 622549 - RNA, 22 nt, Human
ugcaaagacaugggaaaaaagc

SEQ ID NO: 622550 - RNA, 18 nt, Human
ugcccuauuuaccucaac

SEQ ID NO: 622551 - RNA, 22 nt, Human
ugcuacggaaaaaaauacuaca

SEQ ID NO: 622552 - RNA, 24 nt, Human
ugcuacggaaaaaaauacuacaag

SEQ ID NO: 622553 - RNA, 23 nt, Human
ugcugcacucuagccugggcaac

SEQ ID NO: 622554 - RNA, 24 nt, Human
ugcugcacucuagccugggcaaca

SEQ ID NO: 622555 - RNA, 21 nt, Human
ugggaaaaaagcaaacucuua

SEQ ID NO: 622556 - RNA, 21 nt, Human
ugguggcacacaccugugguc

SEQ ID NO: 622557 - RNA, 20 nt, Human
ugguggcucaugcuuguaau

SEQ ID NO: 622558 - RNA, 18 nt, Human
ugguggcuugaggccagg

SEQ ID NO: 622559 - RNA, 19 nt, Human
ugguggcuugaggccagga

SEQ ID NO: 622560 - RNA, 19 nt, Human
ugucuagaaauaccaauau

SEQ ID NO: 622561 - RNA, 23 nt, Human
ugugguggcacacaccugugguc

SEQ ID NO: 622562 - RNA, 23 nt, Human
uuaaaaaaaacagccuauguaaa

SEQ ID NO: 622563 - RNA, 18 nt, Human
uuauauuauccuauugca

SEQ ID NO: 622564 - RNA, 21 nt, Human
uuccccuccuuuaaaaacuga

SEQ ID NO: 622565 - RNA, 22 nt, Human
uugaggccaggaguucgagacc

SEQ ID NO: 622566 - RNA, 24 nt, Human
uugguggcuugaggccaggaguuc

SEQ ID NO: 622567 - RNA, 19 nt, Human
uuuggaauaagaaacauga

SEQ ID NO: 622568 - RNA, 19 nt, Human
aaacagauccccaucccuc

SEQ ID NO: 622569 - RNA, 19 nt, Human
aaugcccacgugcccuaag

SEQ ID NO: 622570 - RNA, 21 nt, Human
acagguacccagcacucaaag

SEQ ID NO: 622571 - RNA, 19 nt, Human
acaugauccccugguccuc

SEQ ID NO: 622572 - RNA, 19 nt, Human
acccagcacucaaagcagc

SEQ ID NO: 622573 - RNA, 19 nt, Human
agacaaaagcacugaguua

SEQ ID NO: 622574 - RNA, 21 nt, Human
agaccacaacauccacccagu

SEQ ID NO: 622575 - RNA, 21 nt, Human
agcacucaaagcagcaaucuc

SEQ ID NO: 622576 - RNA, 25 nt, Human
aggggcuacagucggguuaccugga

SEQ ID NO: 622577 - RNA, 29 nt, Human
agguacccagcacucaaagcagcaaucuu

SEQ ID NO: 622578 - RNA, 22 nt, Human
agguuaugccuagaucugaaac

SEQ ID NO: 622579 - RNA, 26 nt, Human
auacacagacuuuuuuuuuuuuuuuu

SEQ ID NO: 622580 - RNA, 27 nt, Human
auccccaucccuccuaaagcugcccac

SEQ ID NO: 622581 - RNA, 21 nt, Human
caaagcagcaaucuccaaccc

SEQ ID NO: 622582 - RNA, 22 nt, Human
caaggacuuuuuugcuuaucug

SEQ ID NO: 622583 - RNA, 21 nt, Human
cagcaaucuccaacccuuuga

SEQ ID NO: 622584 - RNA, 20 nt, Human
cagccagcaggggcuacagg

SEQ ID NO: 622585 - RNA, 19 nt, Human
cagcugcucuaagagaaag

SEQ ID NO: 622586 - RNA, 22 nt, Human
caggcuucucugccugugaaga

SEQ ID NO: 622587 - RNA, 24 nt, Human
caugcucacuaugcaccaggcacc

SEQ ID NO: 622588 - RNA, 24 nt, Human
cauuugggaaaagcacacugagua

SEQ ID NO: 622589 - RNA, 19 nt, Human
ccacaggcuucucugccug

SEQ ID NO: 622590 - RNA, 21 nt, Human
ccaggcaccaugcuagaugcc

SEQ ID NO: 622591 - RNA, 24 nt, Human
cccuguuucucuuagaaacaccac

SEQ ID NO: 622592 - RNA, 26 nt, Human
ccuacauucaccuauccaucuaucca

SEQ ID NO: 622593 - RNA, 23 nt, Human
ccuauccaucuauccauccacuc

SEQ ID NO: 622594 - RNA, 21 nt, Human
cggcaggacguccgccacaua

SEQ ID NO: 622595 - RNA, 21 nt, Human
cgggacagaguccccuagccg

SEQ ID NO: 622596 - RNA, 23 nt, Human
cuagaucugaaacagauccccau

SEQ ID NO: 622597 - RNA, 20 nt, Human
cuccagagaccacaacaucc

SEQ ID NO: 622598 - RNA, 22 nt, Human
cucccucagcucuuucuggcuu

SEQ ID NO: 622599 - RNA, 21 nt, Human
cuggagcucagccagcagggg

SEQ ID NO: 622600 - RNA, 21 nt, Human
cuguccaccuacauucaccua

SEQ ID NO: 622601 - RNA, 22 nt, Human
gaugccagagacaaagugaaga

SEQ ID NO: 622602 - RNA, 19 nt, Human
gcccucuuaacucccucag

SEQ ID NO: 622603 - RNA, 19 nt, Human
gccuaggcaggacaugggg

SEQ ID NO: 622604 - RNA, 24 nt, Human
gcuacagucggguuaccuggagac

SEQ ID NO: 622605 - RNA, 22 nt, Human
ggaagccaaaaguuuggacacc

SEQ ID NO: 622606 - RNA, 23 nt, Human
ggacagaguccccuagccaggag

SEQ ID NO: 622607 - RNA, 23 nt, Human
ggagacaugauccccugguccuc

SEQ ID NO: 622608 - RNA, 22 nt, Human
uacagucggguuaccuggagac

SEQ ID NO: 622609 - RNA, 20 nt, Human
uagccacaggcuucucugcc

SEQ ID NO: 622610 - RNA, 18 nt, Human
uagccaggagcagccuuu

SEQ ID NO: 622611 - RNA, 18 nt, Human
uaggcaggacauggggga

SEQ ID NO: 622612 - RNA, 20 nt, Human
uaguagguuccccacaggua

SEQ ID NO: 622613 - RNA, 24 nt, Human
uauacacagacuuuuuuuuuuuuu

SEQ ID NO: 622614 - RNA, 22 nt, Human
ucagaggggcagaugcauggug

SEQ ID NO: 622615 - RNA, 19 nt, Human
ucagccagcaggggcuaca

SEQ ID NO: 622616 - RNA, 19 nt, Human
uccagagaccacaacaucc

SEQ ID NO: 622617 - RNA, 21 nt, Human
ucuccaacccuuugaaugcaa

SEQ ID NO: 622618 - RNA, 21 nt, Human
ucugcucuuugauucuucccc

SEQ ID NO: 622619 - RNA, 24 nt, Human
ugaaacagauccccaucccuccua

SEQ ID NO: 622620 - RNA, 22 nt, Human
ugaacagcuggagcaggaggcu

SEQ ID NO: 622621 - RNA, 25 nt, Human
ugcaccaggcaccaugcuagaugcc

SEQ ID NO: 622622 - RNA, 18 nt, Human
ugcaugugaacagcugga

SEQ ID NO: 622623 - RNA, 23 nt, Human
ugccuagaucugaaacagauccc

SEQ ID NO: 622624 - RNA, 22 nt, Human
ugccugugaagagagcauuucu

SEQ ID NO: 622625 - RNA, 23 nt, Human
uggcagcacucuguaacugcagc

SEQ ID NO: 622626 - RNA, 21 nt, Human
uggcagugcuucuccagagac

SEQ ID NO: 622627 - RNA, 23 nt, Human
uggcccagggaagccaaaaguuu

SEQ ID NO: 622628 - RNA, 18 nt, Human
uggcuuuaagccaucacc

SEQ ID NO: 622629 - RNA, 19 nt, Human
ugggaaaagcacacugagu

SEQ ID NO: 622630 - RNA, 20 nt, Human
ugggaaaagcacacugagua

SEQ ID NO: 622631 - RNA, 21 nt, Human
ugggagacuaaggcccaggga

SEQ ID NO: 622632 - RNA, 21 nt, Human
ugggggaggacacgguccccc

SEQ ID NO: 622633 - RNA, 25 nt, Human
ugguggauuugggagacuaaggccc

SEQ ID NO: 622634 - RNA, 20 nt, Human
ugugguggcagauaucacaa

SEQ ID NO: 622635 - RNA, 19 nt, Human
uugcucuugugugcuagaa

SEQ ID NO: 622636 - RNA, 22 nt, Human
uuggcccucuuaacucccucag

SEQ ID NO: 622637 - RNA, 19 nt, Human
uuggugauggcagcacucu

SEQ ID NO: 622638 - RNA, 25 nt, Human
uuggugauggcagcacucuguaacu

SEQ ID NO: 622639 - RNA, 19 nt, Human
uuucuggcuuuaagccauc

SEQ ID NO: 622640 - RNA, 22 nt, Human
uuucuggcuuuaagccaucacc

SEQ ID NO: 622641 - RNA, 20 nt, Human
uuuugcuuaucugugguggc

SEQ ID NO: 622642 - RNA, 22 nt, Human
uuuuuuuuuuuaaugcuuuuaa

SEQ ID NO: 622643 - RNA, 19 nt, Human
uuuuuuuuuuuuuuuuuaa

SEQ ID NO: 622644 - RNA, 26 nt, Human
uuuuuuuuuuuuuuuuuaaugcuuuu

SEQ ID NO: 622645 - RNA, 22 nt, Human
aacacacagagagacacacaca

SEQ ID NO: 622646 - RNA, 21 nt, Human
aacagaacaaagaaagagauu

SEQ ID NO: 622647 - RNA, 24 nt, Human
aacagaacaaagaaagagauucaa

SEQ ID NO: 622648 - RNA, 19 nt, Human
aacagaccauuaucacagu

SEQ ID NO: 622649 - RNA, 22 nt, Human
aagcagcuucgcgaccugcagc

SEQ ID NO: 622650 - RNA, 21 nt, Human
acacacacacacaaacacaca

SEQ ID NO: 622651 - RNA, 23 nt, Human
agacacacacacauuugagcucc

SEQ ID NO: 622652 - RNA, 24 nt, Human
agacacacacacauuugagcuccc

SEQ ID NO: 622653 - RNA, 19 nt, Human
agagaggcuagugaagagg

SEQ ID NO: 622654 - RNA, 21 nt, Human
agcagaagcauccuguguucu

SEQ ID NO: 622655 - RNA, 21 nt, Human
agcuccgaucccaccuccucc

SEQ ID NO: 622656 - RNA, 19 nt, Human
aucagcuuauuuuccuuug

SEQ ID NO: 622657 - RNA, 21 nt, Human
auccuaaaggagggccugagu

SEQ ID NO: 622658 - RNA, 19 nt, Human
auggccauccuaaaggagg

SEQ ID NO: 622659 - RNA, 21 nt, Human
caaaaaaaaaaaaagaacagc

SEQ ID NO: 622660 - RNA, 25 nt, Human
caaagaaagagauucaagaucucac

SEQ ID NO: 622661 - RNA, 21 nt, Human
caaagcugggccagguacugu

SEQ ID NO: 622662 - RNA, 18 nt, Human
caaggccgggaugccacc

SEQ ID NO: 622663 - RNA, 22 nt, Human
cacacagagagacacacacaca

SEQ ID NO: 622664 - RNA, 22 nt, Human
cagaagcauccuguguucuagc

SEQ ID NO: 622665 - RNA, 20 nt, Human
cauaacagggagcuacagag

SEQ ID NO: 622666 - RNA, 21 nt, Human
ccaaagcugggccagguacug

SEQ ID NO: 622667 - RNA, 22 nt, Human
ccacacaugccauaggccucca

SEQ ID NO: 622668 - RNA, 24 nt, Human
ccccucuggcccuggccccagccu

SEQ ID NO: 622669 - RNA, 18 nt, Human
cccuggccccagccuggg

SEQ ID NO: 622670 - RNA, 21 nt, Human
ccuccaaaaaaaaaaaaagaa

SEQ ID NO: 622671 - RNA, 19 nt, Human
ccucccugaucauucagcc

SEQ ID NO: 622672 - RNA, 23 nt, Human
ccucgccuccaaaaaaaaaaaaa

SEQ ID NO: 622673 - RNA, 23 nt, Human
ccucuaggcuucccagcaccauu

SEQ ID NO: 622674 - RNA, 20 nt, Human
ccugaguucccucugccgac

SEQ ID NO: 622675 - RNA, 19 nt, Human
ccugcagccacacaugcca

SEQ ID NO: 622676 - RNA, 26 nt, Human
ccuggccccagccugggccuuguuuu

SEQ ID NO: 622677 - RNA, 27 nt, Human
ccuggccccagccugggccuuguuuuu

SEQ ID NO: 622678 - RNA, 26 nt, Human
ccuuccccucuggcccuggccccagc

SEQ ID NO: 622679 - RNA, 18 nt, Human
ccuuuacuggacugccuc

SEQ ID NO: 622680 - RNA, 22 nt, Human
cuccaaaaaaaaaaaaagaaca

SEQ ID NO: 622681 - RNA, 19 nt, Human
cuccaggagugcucucccc

SEQ ID NO: 622682 - RNA, 20 nt, Human
cucuggcccuggccccagcc

SEQ ID NO: 622683 - RNA, 25 nt, Human
cucuggcccuggccccagccugggc

SEQ ID NO: 622684 - RNA, 20 nt, Human
cugcuaugccucccugauca

SEQ ID NO: 622685 - RNA, 21 nt, Human
cuggccccagccugggccuug

SEQ ID NO: 622686 - RNA, 22 nt, Human
cuggccccagccugggccuugu

SEQ ID NO: 622687 - RNA, 19 nt, Human
cugugggcugaggcacagg

SEQ ID NO: 622688 - RNA, 25 nt, Human
cuuccccucuggcccuggccccagc

SEQ ID NO: 622689 - RNA, 21 nt, Human
gaagucuggauuuagacaaaa

SEQ ID NO: 622690 - RNA, 19 nt, Human
gauaguauguuuugcaaaa

SEQ ID NO: 622691 - RNA, 22 nt, Human
gcccuggccccagccugggccu

SEQ ID NO: 622692 - RNA, 22 nt, Human
gccuccaaaaaaaaaaaaagaa

SEQ ID NO: 622693 - RNA, 19 nt, Human
gcucauuuccugcuccagg

SEQ ID NO: 622694 - RNA, 22 nt, Human
gcugcugagacucacacaccac

SEQ ID NO: 622695 - RNA, 26 nt, Human
ggcuucccagcaccauuaagcagcuu

SEQ ID NO: 622696 - RNA, 18 nt, Human
gggaacucuggcuucccg

SEQ ID NO: 622697 - RNA, 21 nt, Human
gguuguccuugucaucugaug

SEQ ID NO: 622698 - RNA, 26 nt, Human
guggccaugacaccuggcaggaugcc

SEQ ID NO: 622699 - RNA, 25 nt, Human
uaacaggcaaccaagaggggcugcc

SEQ ID NO: 622700 - RNA, 20 nt, Human
uaacagggagcuacagagug

SEQ ID NO: 622701 - RNA, 24 nt, Human
uaaggcaaacaaugaugguacccc

SEQ ID NO: 622702 - RNA, 20 nt, Human
uacagaguuuuuuguuguuu

SEQ ID NO: 622703 - RNA, 18 nt, Human
uaucacaguggccugugg

SEQ ID NO: 622704 - RNA, 19 nt, Human
ucaaaauaagguaacaggc

SEQ ID NO: 622705 - RNA, 21 nt, Human
ucaaugcagcacaugcuagaa

SEQ ID NO: 622706 - RNA, 19 nt, Human
ucaucugaugaugcaugag

SEQ ID NO: 622707 - RNA, 19 nt, Human
ucauucagccaguggaugu

SEQ ID NO: 622708 - RNA, 21 nt, Human
uccaaaaaaaaaaaaagaaca

SEQ ID NO: 622709 - RNA, 24 nt, Human
uccagggcuggccaggacaccuuc

SEQ ID NO: 622710 - RNA, 24 nt, Human
ucccucugccgaccuauggcucuc

SEQ ID NO: 622711 - RNA, 18 nt, Human
ucccuguaucaugucccc

SEQ ID NO: 622712 - RNA, 19 nt, Human
uccucuaggcuucccagca

SEQ ID NO: 622713 - RNA, 20 nt, Human
ucuagaugguugauuuggcu

SEQ ID NO: 622714 - RNA, 21 nt, Human
ucuagaugguugauuuggcug

SEQ ID NO: 622715 - RNA, 19 nt, Human
ugagugagaauccagggcc

SEQ ID NO: 622716 - RNA, 20 nt, Human
ugagugcacacacacacaca

SEQ ID NO: 622717 - RNA, 21 nt, Human
ugagugcacacacacacacaa

SEQ ID NO: 622718 - RNA, 22 nt, Human
ugagugcacacacacacacaaa

SEQ ID NO: 622719 - RNA, 26 nt, Human
ugagugcacacacacacacaaacaca

SEQ ID NO: 622720 - RNA, 23 nt, Human
ugagugcuucgugggaacucugg

SEQ ID NO: 622721 - RNA, 23 nt, Human
ugcagcuccgaucccaccuccuc

SEQ ID NO: 622722 - RNA, 18 nt, Human
ugccauaggccuccaucc

SEQ ID NO: 622723 - RNA, 24 nt, Human
ugccauaggccuccauccucagga

SEQ ID NO: 622724 - RNA, 19 nt, Human
uggauguggaauucaggga

SEQ ID NO: 622725 - RNA, 18 nt, Human
uggccaugacaccuggca

SEQ ID NO: 622726 - RNA, 19 nt, Human
uggcccuggccccagccug

SEQ ID NO: 622727 - RNA, 24 nt, Human
uggcccuggccccagccugggccu

SEQ ID NO: 622728 - RNA, 20 nt, Human
ugggaacucuggcuucccgg

SEQ ID NO: 622729 - RNA, 18 nt, Human
ugggccagguacugucac

SEQ ID NO: 622730 - RNA, 22 nt, Human
ugucacccacuggagccaaagu

SEQ ID NO: 622731 - RNA, 20 nt, Human
ugugaagucuggauuuagac

SEQ ID NO: 622732 - RNA, 22 nt, Human
uuacuggacugccucuuuuugc

SEQ ID NO: 622733 - RNA, 27 nt, Human
uuaggagcgugugggcggcugcugaga

SEQ ID NO: 622734 - RNA, 23 nt, Human
uuuccaccuaggcaucugccaug

SEQ ID NO: 622735 - RNA, 18 nt, Human
aaaaagugcuccucccuu

SEQ ID NO: 622736 - RNA, 18 nt, Human
aaaaauaauaacaguggc

SEQ ID NO: 622737 - RNA, 20 nt, Human
aaagaaaaagaauauuuauu

SEQ ID NO: 622738 - RNA, 23 nt, Human
aacccaguagagacguuccccga

SEQ ID NO: 622739 - RNA, 22 nt, Human
aaugaacaacaaaacaacugaa

SEQ ID NO: 622740 - RNA, 21 nt, Human
aaugcugaauaucaggaggaa

SEQ ID NO: 622741 - RNA, 21 nt, Human
acaacaaaacaacugaaucug

SEQ ID NO: 622742 - RNA, 21 nt, Human
acaguucaauuuuuuucuuuu

SEQ ID NO: 622743 - RNA, 24 nt, Human
acgaaugaacaacaaaacaacuga

SEQ ID NO: 622744 - RNA, 18 nt, Human
acuguauuuuucuuccug

SEQ ID NO: 622745 - RNA, 21 nt, Human
agaaagaaaaaauaaauaaga

SEQ ID NO: 622746 - RNA, 21 nt, Human
aggaaaaaaacccaguagaga

SEQ ID NO: 622747 - RNA, 27 nt, Human
aggaagcugguaacagcauuacaacgg

SEQ ID NO: 622748 - RNA, 22 nt, Human
aggcugcagcaccugcuaacca

SEQ ID NO: 622749 - RNA, 22 nt, Human
agguauuaggaauaaggaagcu

SEQ ID NO: 622750 - RNA, 20 nt, Human
auaaaacaaaucuaaaguaa

SEQ ID NO: 622751 - RNA, 27 nt, Human
auaauaacaguggcaaaggcugcagca

SEQ ID NO: 622752 - RNA, 19 nt, Human
augcaucugccaaaaugcc

SEQ ID NO: 622753 - RNA, 18 nt, Human
caacaaaacaacugaauc

SEQ ID NO: 622754 - RNA, 22 nt, Human
cagaauagagcugugcucccaa

SEQ ID NO: 622755 - RNA, 19 nt, Human
caggaggaaaaaaacccag

SEQ ID NO: 622756 - RNA, 18 nt, Human
ccaagcaaguuccucucc

SEQ ID NO: 622757 - RNA, 27 nt, Human
cccacacaguucagagauuuucaaaca

SEQ ID NO: 622758 - RNA, 18 nt, Human
cuacaacugcagaaauaa

SEQ ID NO: 622759 - RNA, 23 nt, Human
cucagaaaguugguguuuacaaa

SEQ ID NO: 622760 - RNA, 21 nt, Human
cucuauacaggcuaagaaaac

SEQ ID NO: 622761 - RNA, 23 nt, Human
cucuauacaggcuaagaaaacag

SEQ ID NO: 622762 - RNA, 19 nt, Human
cugccaaaaugccagcugu

SEQ ID NO: 622763 - RNA, 22 nt, Human
cuuccaaagcgccugccucccu

SEQ ID NO: 622764 - RNA, 24 nt, Human
cuuguuugaaauuuuuuugguguu

SEQ ID NO: 622765 - RNA, 19 nt, Human
gaaaaaauaaauaagagua

SEQ ID NO: 622766 - RNA, 25 nt, Human
gagcaugcuucuuuacaaauaagcc

SEQ ID NO: 622767 - RNA, 22 nt, Human
gccaaaaugccagcuguaccug

SEQ ID NO: 622768 - RNA, 21 nt, Human
gcucccaacaucccuaucaca

SEQ ID NO: 622769 - RNA, 20 nt, Human
gcucuguugcaagcugauuc

SEQ ID NO: 622770 - RNA, 19 nt, Human
gcugcagcaccugcuaacc

SEQ ID NO: 622771 - RNA, 24 nt, Human
ggcagaauagagcugugcucccaa

SEQ ID NO: 622772 - RNA, 22 nt, Human
gggcaagauaaugaaggcacag

SEQ ID NO: 622773 - RNA, 24 nt, Human
guuacaauaaacuguuuugcaugc

SEQ ID NO: 622774 - RNA, 21 nt, Human
guuuuuuucuuuuugcuuuaa

SEQ ID NO: 622775 - RNA, 20 nt, Human
uaaaagugaccuuaaaaagu

SEQ ID NO: 622776 - RNA, 21 nt, Human
uaaaauucagguauauuccuc

SEQ ID NO: 622777 - RNA, 24 nt, Human
uaacaguggcaaaggcugcagcac

SEQ ID NO: 622778 - RNA, 22 nt, Human
uaagagauuuuugguaguugcu

SEQ ID NO: 622779 - RNA, 19 nt, Human
uaauucacugcaggaggga

SEQ ID NO: 622780 - RNA, 24 nt, Human
uacaucauaaccauugucuaugug

SEQ ID NO: 622781 - RNA, 24 nt, Human
uaguuugguuuuuguuuuuuucuu

SEQ ID NO: 622782 - RNA, 18 nt, Human
uaucaauaaaggacauca

SEQ ID NO: 622783 - RNA, 22 nt, Human
uaucaauaaaggacaucaaacu

SEQ ID NO: 622784 - RNA, 20 nt, Human
uaucacaaaaacaaaacuag

SEQ ID NO: 622785 - RNA, 19 nt, Human
uauugaauaaaauucaggu

SEQ ID NO: 622786 - RNA, 24 nt, Human
ucaaacacagucaugaggcacuaa

SEQ ID NO: 622787 - RNA, 21 nt, Human
ucagucuauccagaguacuua

SEQ ID NO: 622788 - RNA, 22 nt, Human
ucccuaucacaaacauaugacg

SEQ ID NO: 622789 - RNA, 18 nt, Human
uccuuuuuuuuuuuuuuu

SEQ ID NO: 622790 - RNA, 22 nt, Human
ugaaaaacuguaaagaaaaaga

SEQ ID NO: 622791 - RNA, 18 nt, Human
ugaaucuguuuacaucau

SEQ ID NO: 622792 - RNA, 26 nt, Human
ugcucccaacaucccuaucacaaaca

SEQ ID NO: 622793 - RNA, 26 nt, Human
uggcauggucccucgacacuuaaagu

SEQ ID NO: 622794 - RNA, 19 nt, Human
uggguuaauaccacccacu

SEQ ID NO: 622795 - RNA, 23 nt, Human
uggucccucgacacuuaaaguuu

SEQ ID NO: 622796 - RNA, 20 nt, Human
ugguguuuuuugugcucugu

SEQ ID NO: 622797 - RNA, 20 nt, Human
uguaacuguauuuuucuucc

SEQ ID NO: 622798 - RNA, 24 nt, Human
uguggccaaacaauaguuucuuuu

SEQ ID NO: 622799 - RNA, 24 nt, Human
uucccaauaagaaacagauuccau

SEQ ID NO: 622800 - RNA, 24 nt, Human
uuccuccaaaacccacacaguuca

SEQ ID NO: 622801 - RNA, 24 nt, Human
uuuacaaacuuccaaagcgccugc

SEQ ID NO: 622802 - RNA, 18 nt, Human
uuuccagguauuaggaau

SEQ ID NO: 622803 - RNA, 21 nt, Human
uuuggcaaaacucaguccaga

SEQ ID NO: 622804 - RNA, 24 nt, Human
uuuuaauaguuugguuuuuguuuu

SEQ ID NO: 622805 - RNA, 18 nt, Human
uuuuuuuuuuuuuucuug

SEQ ID NO: 622806 - RNA, 23 nt, Human
aaaaaaaaaaaaaaaaccccaca

SEQ ID NO: 622807 - RNA, 27 nt, Human
aaaaaaaaaaaaaaccccacaaaaaag

SEQ ID NO: 622808 - RNA, 23 nt, Human
aaaaaaaaaaccccacaaaaaau

SEQ ID NO: 622809 - RNA, 21 nt, Human
aaaaaugagucacccgacuca

SEQ ID NO: 622810 - RNA, 21 nt, Human
aaaacaaacaacugccaccaa

SEQ ID NO: 622811 - RNA, 19 nt, Human
aaaaccccacaaaaaauau

SEQ ID NO: 622812 - RNA, 22 nt, Human
aaaaggaaaggcauccugcaag

SEQ ID NO: 622813 - RNA, 21 nt, Human
aaacaaaaaggaaccaagugg

SEQ ID NO: 622814 - RNA, 19 nt, Human
aaacaaacaaaaaggaacc

SEQ ID NO: 622815 - RNA, 23 nt, Human
aaacaaagaaaaggcaguauaag

SEQ ID NO: 622816 - RNA, 20 nt, Human
aaagucacuuaaugcuucuc

SEQ ID NO: 622817 - RNA, 23 nt, Human
aacaaacaaacaaagaaaaggca

SEQ ID NO: 622818 - RNA, 21 nt, Human
aacaacugccaccaaaaaaaa

SEQ ID NO: 622819 - RNA, 20 nt, Human
aaccaacuuagcccuccaca

SEQ ID NO: 622820 - RNA, 25 nt, Human
aaccacagauaaccaagguguuucu

SEQ ID NO: 622821 - RNA, 22 nt, Human
aaggcaugaaaaccacagauaa

SEQ ID NO: 622822 - RNA, 19 nt, Human
aaugcaggagaggagaagg

SEQ ID NO: 622823 - RNA, 20 nt, Human
acaaaccuauuccaucacca

SEQ ID NO: 622824 - RNA, 24 nt, Human
acaaagaaaaggcaguauaaccuu

SEQ ID NO: 622825 - RNA, 28 nt, Human
acaacugccaccaaaaaaaaaaaaaaaa

SEQ ID NO: 622826 - RNA, 28 nt, Human
accaaaaaaaaaaaaaaaaccccacaaa

SEQ ID NO: 622827 - RNA, 23 nt, Human
acuagaaucagagcacaaaccua

SEQ ID NO: 622828 - RNA, 26 nt, Human
agaaaaaaacaaacaaacaaagaaaa

SEQ ID NO: 622829 - RNA, 21 nt, Human
agaaaggagauggaguuaggg

SEQ ID NO: 622830 - RNA, 22 nt, Human
agaaaggagauggaguuagggu

SEQ ID NO: 622831 - RNA, 21 nt, Human
agaaggaaaacaaacaaaaag

SEQ ID NO: 622832 - RNA, 23 nt, Human
agaaggaaaacaaacaaaaagga

SEQ ID NO: 622833 - RNA, 20 nt, Human
agaaucaugucagggcacag

SEQ ID NO: 622834 - RNA, 19 nt, Human
agacaaggggcugcucugu

SEQ ID NO: 622835 - RNA, 26 nt, Human
agacacuggcagcccaaugacaagcc

SEQ ID NO: 622836 - RNA, 22 nt, Human
agacuugaaggcccgcagggug

SEQ ID NO: 622837 - RNA, 22 nt, Human
agagaaaaaaacaaacaaacaa

SEQ ID NO: 622838 - RNA, 26 nt, Human
agagaaaaaaacaaacaaacaaagaa

SEQ ID NO: 622839 - RNA, 20 nt, Human
agaucaacaagccccuacca

SEQ ID NO: 622840 - RNA, 22 nt, Human
aggagaaggaaaacaaacaaaa

SEQ ID NO: 622841 - RNA, 23 nt, Human
aggaguuggaggucgguucaccu

SEQ ID NO: 622842 - RNA, 19 nt, Human
aggcacaaggguccccagg

SEQ ID NO: 622843 - RNA, 23 nt, Human
aggcaugaaaaccacagauaacc

SEQ ID NO: 622844 - RNA, 21 nt, Human
aggcggugcuuggcucggcgg

SEQ ID NO: 622845 - RNA, 19 nt, Human
agggguggggguagaggca

SEQ ID NO: 622846 - RNA, 19 nt, Human
aguagcucucauccuccca

SEQ ID NO: 622847 - RNA, 22 nt, Human
aucaccaagaaucaugucaggg

SEQ ID NO: 622848 - RNA, 24 nt, Human
auugccccuggugggccugugugu

SEQ ID NO: 622849 - RNA, 20 nt, Human
caaaaaaaaaaaaaaaaccc

SEQ ID NO: 622850 - RNA, 25 nt, Human
caaaaaaaaaaaaaaaaccccacaa

SEQ ID NO: 622851 - RNA, 24 nt, Human
caaaaaggaaccaaguggcugguu

SEQ ID NO: 622852 - RNA, 20 nt, Human
caaacaaacaaagaaaaggc

SEQ ID NO: 622853 - RNA, 25 nt, Human
caaacaaacaaagaaaaggcaguau

SEQ ID NO: 622854 - RNA, 20 nt, Human
caacugccaccaaaaaaaaa

SEQ ID NO: 622855 - RNA, 25 nt, Human
caaggcaugaaaaccacagauaacc

SEQ ID NO: 622856 - RNA, 20 nt, Human
caaguugcugggugcuggca

SEQ ID NO: 622857 - RNA, 20 nt, Human
cacaccagccagaaccacca

SEQ ID NO: 622858 - RNA, 20 nt, Human
cacagaaccaacuuagcccu

SEQ ID NO: 622859 - RNA, 18 nt, Human
cacagcagcagcucagga

SEQ ID NO: 622860 - RNA, 30 nt, Human
cacaggcuuccuuauccugucuaagacccu

SEQ ID NO: 622861 - RNA, 23 nt, Human
caccagaaccagccugcggccag

SEQ ID NO: 622862 - RNA, 19 nt, Human
caccagccagaaccaccag

SEQ ID NO: 622863 - RNA, 19 nt, Human
cagcagcagcucaggauga

SEQ ID NO: 622864 - RNA, 23 nt, Human
cagcaguguccugugucggcguc

SEQ ID NO: 622865 - RNA, 19 nt, Human
cagccagagccugcgggga

SEQ ID NO: 622866 - RNA, 19 nt, Human
cagcccaaugacaagcccu

SEQ ID NO: 622867 - RNA, 18 nt, Human
caggcuacaggggcccuu

SEQ ID NO: 622868 - RNA, 20 nt, Human
cagggacaaggcaugaaaac

SEQ ID NO: 622869 - RNA, 18 nt, Human
cagggccacacuguggag

SEQ ID NO: 622870 - RNA, 23 nt, Human
caguagcucucauccucccacag

SEQ ID NO: 622871 - RNA, 23 nt, Human
caucaucguucaagaguuggggg

SEQ ID NO: 622872 - RNA, 19 nt, Human
caugaaaaccacagauaac

SEQ ID NO: 622873 - RNA, 21 nt, Human
caugaaaaccacagauaacca

SEQ ID NO: 622874 - RNA, 22 nt, Human
caugaaaaccacagauaaccaa

SEQ ID NO: 622875 - RNA, 25 nt, Human
ccaaaaaaaaaaaaaaaaccccaca

SEQ ID NO: 622876 - RNA, 23 nt, Human
ccacagcaguguccugugucaca

SEQ ID NO: 622877 - RNA, 25 nt, Human
ccaccaaaaaaaaaaaaaaaacccc

SEQ ID NO: 622878 - RNA, 21 nt, Human
ccaccagaguucauaguagua

SEQ ID NO: 622879 - RNA, 21 nt, Human
ccccugggauccccugguggg

SEQ ID NO: 622880 - RNA, 21 nt, Human
ccgagucucuacacagaaaaa

SEQ ID NO: 622881 - RNA, 22 nt, Human
ccgcugcugggccugaaggcgg

SEQ ID NO: 622882 - RNA, 23 nt, Human
ccgcugcugggccugaaggcggu

SEQ ID NO: 622883 - RNA, 19 nt, Human
ccuccacaacacugugccc

SEQ ID NO: 622884 - RNA, 18 nt, Human
ccuggacugagauacagc

SEQ ID NO: 622885 - RNA, 23 nt, Human
cggauggcugcuuucaccuccug

SEQ ID NO: 622886 - RNA, 22 nt, Human
cgucugaauaucaucaucguuc

SEQ ID NO: 622887 - RNA, 21 nt, Human
cugccaccaaaaaaaaaaaaa

SEQ ID NO: 622888 - RNA, 23 nt, Human
cugccaccaaaaaaaaaaaaaaa

SEQ ID NO: 622889 - RNA, 26 nt, Human
cugccaccaaaaaaaaaaaaaaaacc

SEQ ID NO: 622890 - RNA, 18 nt, Human
cugggccucuguggguuu

SEQ ID NO: 622891 - RNA, 22 nt, Human
cugucuguuuccucauacggaa

SEQ ID NO: 622892 - RNA, 20 nt, Human
cuuaaacuagaaucagagca

SEQ ID NO: 622893 - RNA, 18 nt, Human
cuugggggucuugugcug

SEQ ID NO: 622894 - RNA, 25 nt, Human
gaaaaaaacaaacaaacaaagaaaa

SEQ ID NO: 622895 - RNA, 24 nt, Human
gaacuguaccuggagauggaggaa

SEQ ID NO: 622896 - RNA, 20 nt, Human
gaaggcacuguauggugggg

SEQ ID NO: 622897 - RNA, 19 nt, Human
gaaggcgagcaacaggcac

SEQ ID NO: 622898 - RNA, 27 nt, Human
gagaaaaaaacaaacaaacaaagaaaa

SEQ ID NO: 622899 - RNA, 24 nt, Human
gagaaggaaaacaaacaaaaagga

SEQ ID NO: 622900 - RNA, 18 nt, Human
gagccugcggggaagagg

SEQ ID NO: 622901 - RNA, 19 nt, Human
gagcugcaccucuauccac

SEQ ID NO: 622902 - RNA, 19 nt, Human
gaggaaaaugcaggagagg

SEQ ID NO: 622903 - RNA, 19 nt, Human
gaggcagcagcugcugcug

SEQ ID NO: 622904 - RNA, 18 nt, Human
gagucacccgacucaaaa

SEQ ID NO: 622905 - RNA, 20 nt, Human
gcagcagcugcugcugcugu

SEQ ID NO: 622906 - RNA, 18 nt, Human
gcagggccacacugugga

SEQ ID NO: 622907 - RNA, 18 nt, Human
gccuccuuccuugggggc

SEQ ID NO: 622908 - RNA, 19 nt, Human
gcggcuuagggccuccugc

SEQ ID NO: 622909 - RNA, 18 nt, Human
gcugcucggucaacuggu

SEQ ID NO: 622910 - RNA, 20 nt, Human
gcuguagcuggaaggcacug

SEQ ID NO: 622911 - RNA, 24 nt, Human
gcuuucaccuccugccugggccac

SEQ ID NO: 622912 - RNA, 19 nt, Human
ggaggcagcagcugcugcu

SEQ ID NO: 622913 - RNA, 23 nt, Human
ggccagccagagccugcggggaa

SEQ ID NO: 622914 - RNA, 22 nt, Human
gggcucuuaaaaguuaaggucu

SEQ ID NO: 622915 - RNA, 22 nt, Human
gggugugugcuugcgaugcagg

SEQ ID NO: 622916 - RNA, 19 nt, Human
ggugcuggcaggaccugcu

SEQ ID NO: 622917 - RNA, 21 nt, Human
guggaggaagaggcauccaca

SEQ ID NO: 622918 - RNA, 22 nt, Human
uaaaacaaacaacugccaccaa

SEQ ID NO: 622919 - RNA, 23 nt, Human
uaaaacaaacaacugccaccaaa

SEQ ID NO: 622920 - RNA, 22 nt, Human
uaaaacacaucucucugaccca

SEQ ID NO: 622921 - RNA, 19 nt, Human
uaaaauggcagcgcugagu

SEQ ID NO: 622922 - RNA, 20 nt, Human
uaaccuuucacaccagaacc

SEQ ID NO: 622923 - RNA, 19 nt, Human
uacacagaaaaaugaguca

SEQ ID NO: 622924 - RNA, 23 nt, Human
uagaaucagagcacaaaccuauu

SEQ ID NO: 622925 - RNA, 21 nt, Human
uagcaaagcagacaaaguaaa

SEQ ID NO: 622926 - RNA, 20 nt, Human
uagcaaagcagacaaaguag

SEQ ID NO: 622927 - RNA, 22 nt, Human
uagcucaaugcuggcuuggcag

SEQ ID NO: 622928 - RNA, 25 nt, Human
ucaaugcuucgucugaauaucauca

SEQ ID NO: 622929 - RNA, 21 nt, Human
ucacaccagaaccagccugcg

SEQ ID NO: 622930 - RNA, 19 nt, Human
ucaccggccuucuuuagca

SEQ ID NO: 622931 - RNA, 23 nt, Human
uccaagacagccgccaccccagc

SEQ ID NO: 622932 - RNA, 21 nt, Human
uccaucaccaagaaucauguc

SEQ ID NO: 622933 - RNA, 27 nt, Human
uccaucaccaagaaucaugucagggca

SEQ ID NO: 622934 - RNA, 24 nt, Human
ucccacaggauuagcucaaugcug

SEQ ID NO: 622935 - RNA, 23 nt, Human
uccuugggggcuuuuaaaacaca

SEQ ID NO: 622936 - RNA, 18 nt, Human
ucuauccacugcugcggc

SEQ ID NO: 622937 - RNA, 21 nt, Human
ucugacccaaacagguaggug

SEQ ID NO: 622938 - RNA, 21 nt, Human
ugaccugaaggcgagcaacag

SEQ ID NO: 622939 - RNA, 24 nt, Human
ugagacuugaaggcccgcagggug

SEQ ID NO: 622940 - RNA, 23 nt, Human
ugaguaauugugggcuucucggu

SEQ ID NO: 622941 - RNA, 18 nt, Human
ugcaccucuauccacugc

SEQ ID NO: 622942 - RNA, 23 nt, Human
ugccaccaaaaaaaaaaaaaaaa

SEQ ID NO: 622943 - RNA, 18 nt, Human
ugcccccugggauccccu

SEQ ID NO: 622944 - RNA, 23 nt, Human
ugccgcugcugggccugaaggcg

SEQ ID NO: 622945 - RNA, 22 nt, Human
ugccugggccaccgagucucua

SEQ ID NO: 622946 - RNA, 24 nt, Human
ugcuugggggucuugugcugcuuc

SEQ ID NO: 622947 - RNA, 18 nt, Human
uggcucaacagcaggcag

SEQ ID NO: 622948 - RNA, 20 nt, Human
uggcucggcggugguggcaa

SEQ ID NO: 622949 - RNA, 18 nt, Human
uggcugcucggucaacug

SEQ ID NO: 622950 - RNA, 20 nt, Human
ugggaaagagccacaaacgg

SEQ ID NO: 622951 - RNA, 22 nt, Human
ugggccugugugugcggugguc

SEQ ID NO: 622952 - RNA, 22 nt, Human
uggggcuuugguggcugcucgg

SEQ ID NO: 622953 - RNA, 19 nt, Human
uggguuuccuucuucaucc

SEQ ID NO: 622954 - RNA, 18 nt, Human
uggugggggaggaguugg

SEQ ID NO: 622955 - RNA, 19 nt, Human
uggugggggaggaguugga

SEQ ID NO: 622956 - RNA, 23 nt, Human
uggugggggaggaguuggagguc

SEQ ID NO: 622957 - RNA, 22 nt, Human
ugguugcuuugccaaguugcug

SEQ ID NO: 622958 - RNA, 22 nt, Human
ugucacagauguagcuuugauu

SEQ ID NO: 622959 - RNA, 20 nt, Human
uuaaaacacaucucucugac

SEQ ID NO: 622960 - RNA, 21 nt, Human
uucaccacuuccucauaagga

SEQ ID NO: 622961 - RNA, 19 nt, Human
uucaccuccugccugggcc

SEQ ID NO: 622962 - RNA, 21 nt, Human
uucaccuccugccugggccac

SEQ ID NO: 622963 - RNA, 19 nt, Human
uucagaaucaaagauaaaa

SEQ ID NO: 622964 - RNA, 18 nt, Human
uuccaagacagccgccac

SEQ ID NO: 622965 - RNA, 22 nt, Human
uugcuuugccaaguugcugggu

SEQ ID NO: 622966 - RNA, 23 nt, Human
uugguacccacacaggcuuccuu

SEQ ID NO: 622967 - RNA, 32 nt, Human
uuuagagaaaaaaacaaacaaacaaagaaaaa

SEQ ID NO: 622968 - RNA, 22 nt, Human
uuucauguugccgcugcugggc

SEQ ID NO: 622969 - RNA, 23 nt, Human
uuuggcaaaaaccugaaauaaaa

SEQ ID NO: 622970 - RNA, 22 nt, Human
aaauaaaaagggaaauaacuga

SEQ ID NO: 622971 - RNA, 20 nt, Human
agagcccagugcgucaccac

SEQ ID NO: 622972 - RNA, 19 nt, Human
agagcccagugcgucaccc

SEQ ID NO: 622973 - RNA, 22 nt, Human
agaggucaucucccaggcaacc

SEQ ID NO: 622974 - RNA, 21 nt, Human
caaaaaauaaaacugccaaaa

SEQ ID NO: 622975 - RNA, 23 nt, Human
caaaaucaacuguaacuaaaggc

SEQ ID NO: 622976 - RNA, 23 nt, Human
caaagcaagaaccaaggaugcag

SEQ ID NO: 622977 - RNA, 22 nt, Human
caggugacgcuacagcggagau

SEQ ID NO: 622978 - RNA, 24 nt, Human
caugcugaaucaucagcaaauacu

SEQ ID NO: 622979 - RNA, 19 nt, Human
cccagugcgucaccacuuc

SEQ ID NO: 622980 - RNA, 24 nt, Human
ccugcauauuuucaaccuucaaaa

SEQ ID NO: 622981 - RNA, 27 nt, Human
ccugcuuuccuucuuuccuucuuaacu

SEQ ID NO: 622982 - RNA, 23 nt, Human
cucccgaaucgauagagccacac

SEQ ID NO: 622983 - RNA, 20 nt, Human
cuucaaaaaauaaaacugcc

SEQ ID NO: 622984 - RNA, 22 nt, Human
cuucaaaaaauaaaacugccaa

SEQ ID NO: 622985 - RNA, 18 nt, Human
cuucuuuccuucuuaacu

SEQ ID NO: 622986 - RNA, 19 nt, Human
gacauaaaauaaaaaggga

SEQ ID NO: 622987 - RNA, 19 nt, Human
guucuauuuucccagccuc

SEQ ID NO: 622988 - RNA, 21 nt, Human
uaacuuuuagcuaugagaaca

SEQ ID NO: 622989 - RNA, 18 nt, Human
uacuacgugcuuugggcu

SEQ ID NO: 622990 - RNA, 21 nt, Human
uaguaaguuuauucuucacuc

SEQ ID NO: 622991 - RNA, 18 nt, Human
ucaaagcaagaaccaagg

SEQ ID NO: 622992 - RNA, 19 nt, Human
ucguugcagcuucuaguug

SEQ ID NO: 622993 - RNA, 18 nt, Human
ucucccaggcaaccugcu

SEQ ID NO: 622994 - RNA, 21 nt, Human
ucucugaaaacuguuuaguuc

SEQ ID NO: 622995 - RNA, 21 nt, Human
ucuuuccuucuuaacuuuuag

SEQ ID NO: 622996 - RNA, 18 nt, Human
ugacuaauuuguuaguaa

SEQ ID NO: 622997 - RNA, 19 nt, Human
uucaaaaaauaaaacugcc

SEQ ID NO: 622998 - RNA, 21 nt, Human
uucaaagagacccgaaagagg

SEQ ID NO: 622999 - RNA, 24 nt, Human
uuccuucuuuccuucuuaacuuuu

SEQ ID NO: 623000 - RNA, 22 nt, Human
uuuuuggcuuugaaaucaugac

SEQ ID NO: 623001 - RNA, 21 nt, Human
aaaaaagaaaguauagaugaa

SEQ ID NO: 623002 - RNA, 22 nt, Human
aaaaaagaaaguauagaugaaa

SEQ ID NO: 623003 - RNA, 24 nt, Human
aaaguccucauugaacuccauuuc

SEQ ID NO: 623004 - RNA, 23 nt, Human
aagaaaaaagaaaguauagauga

SEQ ID NO: 623005 - RNA, 25 nt, Human
aagaacugaaaguccucauugaacu

SEQ ID NO: 623006 - RNA, 18 nt, Human
aagcucggcuuagcuugc

SEQ ID NO: 623007 - RNA, 20 nt, Human
acaaaagcacaugugcuacu

SEQ ID NO: 623008 - RNA, 21 nt, Human
accaagcaaagaacugaaagu

SEQ ID NO: 623009 - RNA, 23 nt, Human
acccuguguccuggcugaggagc

SEQ ID NO: 623010 - RNA, 22 nt, Human
agaaauucuaucauccuuaacc

SEQ ID NO: 623011 - RNA, 20 nt, Human
agcaaagaacugaaaguccu

SEQ ID NO: 623012 - RNA, 22 nt, Human
agcaaagaacugaaaguccuca

SEQ ID NO: 623013 - RNA, 19 nt, Human
caacccauagcgaucucug

SEQ ID NO: 623014 - RNA, 24 nt, Human
caagaaaaaagaaaguauagauga

SEQ ID NO: 623015 - RNA, 22 nt, Human
cacccuguguccuggcugagga

SEQ ID NO: 623016 - RNA, 22 nt, Human
cauagcgaucucuguguuuucc

SEQ ID NO: 623017 - RNA, 18 nt, Human
ccagauacuggaguguga

SEQ ID NO: 623018 - RNA, 24 nt, Human
cuaaccaagcaaagaacugaaagu

SEQ ID NO: 623019 - RNA, 24 nt, Human
gaaacacuuucauucccuccacuu

SEQ ID NO: 623020 - RNA, 21 nt, Human
gaggcauauccuggcuggggg

SEQ ID NO: 623021 - RNA, 24 nt, Human
uaaccaagcaaagaacugaaaguc

SEQ ID NO: 623022 - RNA, 19 nt, Human
uaacugccgguuucaacuc

SEQ ID NO: 623023 - RNA, 19 nt, Human
uauaugccauacacauaua

SEQ ID NO: 623024 - RNA, 22 nt, Human
uauguacuguagcuccugugug

SEQ ID NO: 623025 - RNA, 27 nt, Human
ucaccucgaaacacuuucauucccucc

SEQ ID NO: 623026 - RNA, 25 nt, Human
ucagaagagggaaauuauauccaca

SEQ ID NO: 623027 - RNA, 23 nt, Human
ucuacgauugugacagaagaggc

SEQ ID NO: 623028 - RNA, 19 nt, Human
ugagaugagcaggaugccc

SEQ ID NO: 623029 - RNA, 19 nt, Human
ugcagggugugagaugagc

SEQ ID NO: 623030 - RNA, 21 nt, Human
uguacuguagcuccugugugu

SEQ ID NO: 623031 - RNA, 19 nt, Human
uguccuggcugaggagccu

SEQ ID NO: 623032 - RNA, 20 nt, Human
uguguguguguuuccauguu

SEQ ID NO: 623033 - RNA, 18 nt, Human
uuaaacgguucucuccaa

SEQ ID NO: 623034 - RNA, 21 nt, Human
uuucccuguuguaauuccaau

SEQ ID NO: 623035 - RNA, 25 nt, Human
uuuuaacaaaagcacaugugcuacu

SEQ ID NO: 623036 - RNA, 21 nt, Human
uuuuuuuuuucucaaagccca

SEQ ID NO: 623037 - RNA, 23 nt, Human
uuuuuuuuuuuuuuuucucaaag

SEQ ID NO: 623038 - RNA, 25 nt, Human
aaaaaaaaaaaaaguagaaaagagg

SEQ ID NO: 623039 - RNA, 23 nt, Human
aaaaaacagaaacagcuucagga

SEQ ID NO: 623040 - RNA, 23 nt, Human
aaaaacagaaacagcuucaggaa

SEQ ID NO: 623041 - RNA, 28 nt, Human
aaaacaaaaaacagaaacagcuucagga

SEQ ID NO: 623042 - RNA, 21 nt, Human
aaaacaaaacaaaacaaaaaa

SEQ ID NO: 623043 - RNA, 26 nt, Human
aaaacaaaacaaaacaaaaaacagaa

SEQ ID NO: 623044 - RNA, 27 nt, Human
aaacaaaaaacagaaacagcuucagga

SEQ ID NO: 623045 - RNA, 19 nt, Human
aaacaaaacaaaacaaaaa

SEQ ID NO: 623046 - RNA, 21 nt, Human
aacaaaacaaaaaacagaaac

SEQ ID NO: 623047 - RNA, 23 nt, Human
aacaaaacaaaaaacagaaacag

SEQ ID NO: 623048 - RNA, 22 nt, Human
aacaaaacaaaacaaaaaacag

SEQ ID NO: 623049 - RNA, 21 nt, Human
aagaaagaaaggacaacucag

SEQ ID NO: 623050 - RNA, 22 nt, Human
aagacaagugaaucacaacuua

SEQ ID NO: 623051 - RNA, 21 nt, Human
aagcacauagaaagacaaagc

SEQ ID NO: 623052 - RNA, 24 nt, Human
aagucaugaagauuaaccugaaau

SEQ ID NO: 623053 - RNA, 27 nt, Human
acaaaaaaaaaaaaaaaaaaguagaaa

SEQ ID NO: 623054 - RNA, 27 nt, Human
acaaaacaaaaaacagaaacagcuuca

SEQ ID NO: 623055 - RNA, 24 nt, Human
acaaaacaaaacaaaaaacagaaa

SEQ ID NO: 623056 - RNA, 25 nt, Human
acaaaacaaaacaaaaaacagaaac

SEQ ID NO: 623057 - RNA, 21 nt, Human
acagaaacagcuucaggaaca

SEQ ID NO: 623058 - RNA, 20 nt, Human
accacagcucacuguaaccc

SEQ ID NO: 623059 - RNA, 26 nt, Human
accacagcucacuguaaccccgaacu

SEQ ID NO: 623060 - RNA, 20 nt, Human
acuagaaaaauagucugauu

SEQ ID NO: 623061 - RNA, 18 nt, Human
acucugucacccaggcug

SEQ ID NO: 623062 - RNA, 25 nt, Human
acucugucacccaggcuggaauaca

SEQ ID NO: 623063 - RNA, 21 nt, Human
agaaagaaaagcauuagucac

SEQ ID NO: 623064 - RNA, 22 nt, Human
agaaagaaaggacaacucagaa

SEQ ID NO: 623065 - RNA, 19 nt, Human
agaaagccuuaagggggag

SEQ ID NO: 623066 - RNA, 26 nt, Human
agacaagugaaucacaacuuaguagg

SEQ ID NO: 623067 - RNA, 18 nt, Human
aggaauacaaguacucca

SEQ ID NO: 623068 - RNA, 21 nt, Human
aucauccugccucagccuccc

SEQ ID NO: 623069 - RNA, 18 nt, Human
aucucacucugucaccca

SEQ ID NO: 623070 - RNA, 20 nt, Human
caaaaaacagaaacagcuuc

SEQ ID NO: 623071 - RNA, 19 nt, Human
caaaacaaaaaacagaaac

SEQ ID NO: 623072 - RNA, 27 nt, Human
caaaagucccucugacaauuaaacaau

SEQ ID NO: 623073 - RNA, 22 nt, Human
caaaggaguggaucaguuuuga

SEQ ID NO: 623074 - RNA, 23 nt, Human
caccuucucucuugguccguguu

SEQ ID NO: 623075 - RNA, 19 nt, Human
cacucugucacccaggcug

SEQ ID NO: 623076 - RNA, 23 nt, Human
cacucugucacccaggcuggaau

SEQ ID NO: 623077 - RNA, 21 nt, Human
cacuguaaccccgaacuccug

SEQ ID NO: 623078 - RNA, 19 nt, Human
caggagugagucacugugc

SEQ ID NO: 623079 - RNA, 24 nt, Human
caggagugagucacugugccuggc

SEQ ID NO: 623080 - RNA, 23 nt, Human
ccaaaaacaguacauaauuuccu

SEQ ID NO: 623081 - RNA, 18 nt, Human
ccaagagaaaaaagaauc

SEQ ID NO: 623082 - RNA, 19 nt, Human
cccaagagaaaaaagaauc

SEQ ID NO: 623083 - RNA, 20 nt, Human
cccaggcuggaauacagugg

SEQ ID NO: 623084 - RNA, 25 nt, Human
ccccuuaaaaacaaaacaaaacaaa

SEQ ID NO: 623085 - RNA, 22 nt, Human
ccggcaaggcugcgucucuucu

SEQ ID NO: 623086 - RNA, 18 nt, Human
ccguguuucucugguggc

SEQ ID NO: 623087 - RNA, 21 nt, Human
ccucucccccuuaaaaacaaa

SEQ ID NO: 623088 - RNA, 19 nt, Human
ccugaagguccucugugga

SEQ ID NO: 623089 - RNA, 23 nt, Human
ccugggcuuaagcaaucauccug

SEQ ID NO: 623090 - RNA, 21 nt, Human
cggcaaggcugcgucucuucu

SEQ ID NO: 623091 - RNA, 23 nt, Human
cucaaagaaagaaaagcauuagu

SEQ ID NO: 623092 - RNA, 22 nt, Human
cucaagaaagaaaggacaacuc

SEQ ID NO: 623093 - RNA, 21 nt, Human
cucacuguaaccccgaacucc

SEQ ID NO: 623094 - RNA, 24 nt, Human
cucacuguaaccccgaacuccugg

SEQ ID NO: 623095 - RNA, 24 nt, Human
cugccucagccuccccgaguagcu

SEQ ID NO: 623096 - RNA, 19 nt, Human
cugcugguaucacacugac

SEQ ID NO: 623097 - RNA, 23 nt, Human
cuggagaucugguuuccuggggu

SEQ ID NO: 623098 - RNA, 25 nt, Human
cugguggcugcugcgacaccuccuu

SEQ ID NO: 623099 - RNA, 21 nt, Human
cuucuuguucuacgcugggaa

SEQ ID NO: 623100 - RNA, 18 nt, Human
gaaguacaaaauguuggc

SEQ ID NO: 623101 - RNA, 18 nt, Human
gacuacaggagugaguca

SEQ ID NO: 623102 - RNA, 21 nt, Human
gacuacaggagugagucacug

SEQ ID NO: 623103 - RNA, 24 nt, Human
gacuacaggagugagucacugugc

SEQ ID NO: 623104 - RNA, 19 nt, Human
gaggaugggaagggacugu

SEQ ID NO: 623105 - RNA, 20 nt, Human
gaguagcuaggacuacagga

SEQ ID NO: 623106 - RNA, 22 nt, Human
gcccccaagagaaaaaagaauc

SEQ ID NO: 623107 - RNA, 21 nt, Human
gcucaagaaagaaaggacaac

SEQ ID NO: 623108 - RNA, 19 nt, Human
ggaagaaccucucccccuu

SEQ ID NO: 623109 - RNA, 20 nt, Human
ggacuacaggagugagucac

SEQ ID NO: 623110 - RNA, 23 nt, Human
ggacuacaggagugagucacugu

SEQ ID NO: 623111 - RNA, 24 nt, Human
ggacuacaggagugagucacugug

SEQ ID NO: 623112 - RNA, 22 nt, Human
gggagccaguauucagagugau

SEQ ID NO: 623113 - RNA, 21 nt, Human
guccguguuucucugguggcu

SEQ ID NO: 623114 - RNA, 22 nt, Human
uaagcacaacauaauuaauuca

SEQ ID NO: 623115 - RNA, 21 nt, Human
uacaggagugagucacugugc

SEQ ID NO: 623116 - RNA, 22 nt, Human
uacaggagugagucacugugcc

SEQ ID NO: 623117 - RNA, 23 nt, Human
uacaggagugagucacugugccu

SEQ ID NO: 623118 - RNA, 18 nt, Human
uaccauauugauauccug

SEQ ID NO: 623119 - RNA, 19 nt, Human
uagaaaagaguucaucugc

SEQ ID NO: 623120 - RNA, 22 nt, Human
uagagacaggaucucacucugu

SEQ ID NO: 623121 - RNA, 18 nt, Human
uauuuuaguugcaccagg

SEQ ID NO: 623122 - RNA, 19 nt, Human
ucacccaggcuggaauaca

SEQ ID NO: 623123 - RNA, 24 nt, Human
ucacuguaaccccgaacuccuggg

SEQ ID NO: 623124 - RNA, 21 nt, Human
ucagagugauccucaauaugg

SEQ ID NO: 623125 - RNA, 19 nt, Human
ucaggaacaggaauacaag

SEQ ID NO: 623126 - RNA, 22 nt, Human
uccaggugaaaauacaaaaaaa

SEQ ID NO: 623127 - RNA, 21 nt, Human
ucccccuuaaaaacaaaacaa

SEQ ID NO: 623128 - RNA, 22 nt, Human
ucccccuuaaaaacaaaacaaa

SEQ ID NO: 623129 - RNA, 24 nt, Human
uccccgaguagcuaggacuacagg

SEQ ID NO: 623130 - RNA, 23 nt, Human
uccugccucagccuccccgagua

SEQ ID NO: 623131 - RNA, 18 nt, Human
uccugggcuuaagcaauc

SEQ ID NO: 623132 - RNA, 24 nt, Human
uccugggcuuaagcaaucauccug

SEQ ID NO: 623133 - RNA, 19 nt, Human
uccuugguuuuaaagacaa

SEQ ID NO: 623134 - RNA, 22 nt, Human
ucucacccuguggcugacugga

SEQ ID NO: 623135 - RNA, 23 nt, Human
ucucacucugucacccaggcugg

SEQ ID NO: 623136 - RNA, 24 nt, Human
ucucacucugucacccaggcugga

SEQ ID NO: 623137 - RNA, 18 nt, Human
ucugucacccaggcugga

SEQ ID NO: 623138 - RNA, 24 nt, Human
ucugucacccaggcuggaauacag

SEQ ID NO: 623139 - RNA, 19 nt, Human
ucuguggaguugaagaagg

SEQ ID NO: 623140 - RNA, 23 nt, Human
ugaaagaagaaauuaaucuaggg

SEQ ID NO: 623141 - RNA, 21 nt, Human
ugaccacagcucacuguaacc

SEQ ID NO: 623142 - RNA, 23 nt, Human
ugaccucaacugauuauacaacu

SEQ ID NO: 623143 - RNA, 24 nt, Human
ugaccucaacugauuauacaacuu

SEQ ID NO: 623144 - RNA, 25 nt, Human
ugccucagccuccccgaguagcuag

SEQ ID NO: 623145 - RNA, 21 nt, Human
ugcugguaucacacugaccuc

SEQ ID NO: 623146 - RNA, 21 nt, Human
uggaauacaguggugugacca

SEQ ID NO: 623147 - RNA, 28 nt, Human
uggaauacaguggugugacggcucuagc

SEQ ID NO: 623148 - RNA, 22 nt, Human
uggcucaagaaagaaaggacaa

SEQ ID NO: 623149 - RNA, 22 nt, Human
ugggaaauuuuaggacuaugaa

SEQ ID NO: 623150 - RNA, 20 nt, Human
uggguagaugagacaugaug

SEQ ID NO: 623151 - RNA, 23 nt, Human
uggugugaccacagcucacugua

SEQ ID NO: 623152 - RNA, 24 nt, Human
uggugugaccacagcucacuguaa

SEQ ID NO: 623153 - RNA, 18 nt, Human
ugucugggcuauguacag

SEQ ID NO: 623154 - RNA, 18 nt, Human
ugugaccacagcucacug

SEQ ID NO: 623155 - RNA, 18 nt, Human
uguggaguugaagaaggu

SEQ ID NO: 623156 - RNA, 19 nt, Human
uguggaguugaagaaggug

SEQ ID NO: 623157 - RNA, 18 nt, Human
uucacuguacuuagccca

SEQ ID NO: 623158 - RNA, 25 nt, Human
uuccaggugaaaauacaaaaaaaaa

SEQ ID NO: 623159 - RNA, 18 nt, Human
uucucugguggcugcugc

SEQ ID NO: 623160 - RNA, 24 nt, Human
uuuuuuuuuuuuuuuuaaauuuuu

SEQ ID NO: 623161 - RNA, 22 nt, Human
aaguagccaagacuauuaggcg

SEQ ID NO: 623162 - RNA, 19 nt, Human
acaaaguucaucuccucag

SEQ ID NO: 623163 - RNA, 21 nt, Human
acagagggcugguaaauggca

SEQ ID NO: 623164 - RNA, 24 nt, Human
agaaaagagcgggaauauacaaaa

SEQ ID NO: 623165 - RNA, 19 nt, Human
agacagggaaaugaagaga

SEQ ID NO: 623166 - RNA, 27 nt, Human
agacagggaaaugaagagaagggaccc

SEQ ID NO: 623167 - RNA, 21 nt, Human
agcaaagagccagguaugcug

SEQ ID NO: 623168 - RNA, 21 nt, Human
agggaggagacaggcauggua

SEQ ID NO: 623169 - RNA, 20 nt, Human
agggcugguaaauggcagcu

SEQ ID NO: 623170 - RNA, 19 nt, Human
aucuccucagcugaacacu

SEQ ID NO: 623171 - RNA, 18 nt, Human
auggcgguggggauaagc

SEQ ID NO: 623172 - RNA, 20 nt, Human
augguggagaugguagacac

SEQ ID NO: 623173 - RNA, 18 nt, Human
caccuaugaugccacuuu

SEQ ID NO: 623174 - RNA, 20 nt, Human
cacuagcucaaacuuuuuca

SEQ ID NO: 623175 - RNA, 23 nt, Human
ccaagacuuaaaacuuaggaaac

SEQ ID NO: 623176 - RNA, 19 nt, Human
ccccugaauuugcuagaag

SEQ ID NO: 623177 - RNA, 22 nt, Human
ccuuggaagaaguuaagaauuu

SEQ ID NO: 623178 - RNA, 22 nt, Human
cuagaaguuuucuugugucugg

SEQ ID NO: 623179 - RNA, 22 nt, Human
cuagcucaaacuuuuucacucc

SEQ ID NO: 623180 - RNA, 19 nt, Human
cuuuuucacuccaccaaaa

SEQ ID NO: 623181 - RNA, 21 nt, Human
gaagacagggaaaugaagaga

SEQ ID NO: 623182 - RNA, 22 nt, Human
gcagugcucguggauucaaaau

SEQ ID NO: 623183 - RNA, 22 nt, Human
ggagguuucaagaucaccauac

SEQ ID NO: 623184 - RNA, 23 nt, Human
ggaguuuuuauccaagacuuaaa

SEQ ID NO: 623185 - RNA, 18 nt, Human
guaaauggcagcuucugu

SEQ ID NO: 623186 - RNA, 24 nt, Human
guaggagggaggagacaggcaugg

SEQ ID NO: 623187 - RNA, 18 nt, Human
gugccccccauuaacaca

SEQ ID NO: 623188 - RNA, 18 nt, Human
uaacacaaaguucaucuc

SEQ ID NO: 623189 - RNA, 20 nt, Human
uaacacaaaguucaucuccu

SEQ ID NO: 623190 - RNA, 25 nt, Human
uaaccuuggaagaaguuaagaauuu

SEQ ID NO: 623191 - RNA, 20 nt, Human
uaagauaucaucauggccaa

SEQ ID NO: 623192 - RNA, 23 nt, Human
uacaaaaaugaagcuuccuuaac

SEQ ID NO: 623193 - RNA, 22 nt, Human
uaggaaacaccuaugaugccac

SEQ ID NO: 623194 - RNA, 20 nt, Human
ucaugguggagaugguagac

SEQ ID NO: 623195 - RNA, 18 nt, Human
ugaaaauacugcagccug

SEQ ID NO: 623196 - RNA, 20 nt, Human
ugaaccagggcaacauuucu

SEQ ID NO: 623197 - RNA, 23 nt, Human
ugaagagcugagugccugcuggg

SEQ ID NO: 623198 - RNA, 19 nt, Human
ugcaaucagcaaagagcca

SEQ ID NO: 623199 - RNA, 21 nt, Human
uggagguuucaagaucaccau

SEQ ID NO: 623200 - RNA, 18 nt, Human
uggauucaaaaucacaga

SEQ ID NO: 623201 - RNA, 24 nt, Human
uggcuucacuagcucaaacuuuuu

SEQ ID NO: 623202 - RNA, 22 nt, Human
ugggauaguacgcuguguaguu

SEQ ID NO: 623203 - RNA, 18 nt, Human
ugucuggagguuucaaga

SEQ ID NO: 623204 - RNA, 22 nt, Human
uuuaaagugccccccauuaaca

SEQ ID NO: 623205 - RNA, 26 nt, Human
uuuuuuuuuuuuuuuucagguguuuu

SEQ ID NO: 623206 - RNA, 21 nt, Human
uuuuuuuuuuuuuuuuucagg

SEQ ID NO: 623207 - RNA, 24 nt, Human
aaaacauggcuccccuucugccuc

SEQ ID NO: 623208 - RNA, 20 nt, Human
aaaaugccugauccauuucu

SEQ ID NO: 623209 - RNA, 23 nt, Human
aaagaauaaggaauaacagaagg

SEQ ID NO: 623210 - RNA, 23 nt, Human
aacacaaugcaaauaguuuagag

SEQ ID NO: 623211 - RNA, 21 nt, Human
aaccccacuccugagcccuuc

SEQ ID NO: 623212 - RNA, 23 nt, Human
aaccccacuccugagcccuucug

SEQ ID NO: 623213 - RNA, 21 nt, Human
aagcaaauacauacgcaugug

SEQ ID NO: 623214 - RNA, 26 nt, Human
aagcacccaggacucggucccaguga

SEQ ID NO: 623215 - RNA, 24 nt, Human
aaggaauauguaagcacccaggac

SEQ ID NO: 623216 - RNA, 18 nt, Human
aagucuccgugagggugg

SEQ ID NO: 623217 - RNA, 20 nt, Human
aaguggagauguggggcugc

SEQ ID NO: 623218 - RNA, 23 nt, Human
acaagcaaauacauacgcaugug

SEQ ID NO: 623219 - RNA, 19 nt, Human
accuguaaauuccagcacu

SEQ ID NO: 623220 - RNA, 22 nt, Human
accuguaaauuccagcacuuug

SEQ ID NO: 623221 - RNA, 24 nt, Human
accuguaaauuccagcacuuuggg

SEQ ID NO: 623222 - RNA, 19 nt, Human
agaacuucucagacacaga

SEQ ID NO: 623223 - RNA, 21 nt, Human
agaccgaucucuucucccuca

SEQ ID NO: 623224 - RNA, 24 nt, Human
agcacuuugggauuacaggcguga

SEQ ID NO: 623225 - RNA, 18 nt, Human
aggaaagcagaggcaaga

SEQ ID NO: 623226 - RNA, 24 nt, Human
agggaagugugcagcagcauucug

SEQ ID NO: 623227 - RNA, 18 nt, Human
agggugggagggacccca

SEQ ID NO: 623228 - RNA, 18 nt, Human
aggugaugugggcacaga

SEQ ID NO: 623229 - RNA, 20 nt, Human
caaaggugaugugggcacag

SEQ ID NO: 623230 - RNA, 26 nt, Human
caagauugaucgcucccuccccucuc

SEQ ID NO: 623231 - RNA, 19 nt, Human
caauggaagccaacacugc

SEQ ID NO: 623232 - RNA, 19 nt, Human
cagacacagagcugccaga

SEQ ID NO: 623233 - RNA, 23 nt, Human
cagagaggguccuuccaaagccc

SEQ ID NO: 623234 - RNA, 21 nt, Human
cagagccgagcgggugaugcc

SEQ ID NO: 623235 - RNA, 22 nt, Human
cagcagcauucugccauugcuu

SEQ ID NO: 623236 - RNA, 26 nt, Human
cagggccaggcguccgcuucagagcc

SEQ ID NO: 623237 - RNA, 18 nt, Human
cagugagaugaagacacg

SEQ ID NO: 623238 - RNA, 24 nt, Human
cauacgcaugugcacauuuauacg

SEQ ID NO: 623239 - RNA, 20 nt, Human
caucgccgagaaucccccca

SEQ ID NO: 623240 - RNA, 22 nt, Human
cauggcuccccuucugccuccu

SEQ ID NO: 623241 - RNA, 21 nt, Human
cauuuggggacuuuaaaaaaa

SEQ ID NO: 623242 - RNA, 19 nt, Human
ccagacaucuguggaguga

SEQ ID NO: 623243 - RNA, 22 nt, Human
ccagaugcugagcuugccaaca

SEQ ID NO: 623244 - RNA, 22 nt, Human
ccagcacuuugggauuacaggc

SEQ ID NO: 623245 - RNA, 24 nt, Human
ccagcacuuugggauuacaggcgu

SEQ ID NO: 623246 - RNA, 22 nt, Human
ccagccggccagggcuggcagc

SEQ ID NO: 623247 - RNA, 23 nt, Human
cccacuccugagcccuucugaug

SEQ ID NO: 623248 - RNA, 23 nt, Human
cccagaugcugagcuugccaaca

SEQ ID NO: 623249 - RNA, 18 nt, Human
ccccacuuacccagccag

SEQ ID NO: 623250 - RNA, 21 nt, Human
ccccucucuuaauguuggagg

SEQ ID NO: 623251 - RNA, 21 nt, Human
cccgccauauucuaaagaauc

SEQ ID NO: 623252 - RNA, 20 nt, Human
cccgggcucgaaagcggagc

SEQ ID NO: 623253 - RNA, 19 nt, Human
ccgcagccccucuccuucc

SEQ ID NO: 623254 - RNA, 20 nt, Human
ccggugcagggccaggcguc

SEQ ID NO: 623255 - RNA, 18 nt, Human
ccuguaaauuccagcacu

SEQ ID NO: 623256 - RNA, 18 nt, Human
ccugugugaaugcagagu

SEQ ID NO: 623257 - RNA, 18 nt, Human
ccuucugccuccuuucuu

SEQ ID NO: 623258 - RNA, 23 nt, Human
cgaacccagccggccagggcugg

SEQ ID NO: 623259 - RNA, 22 nt, Human
cgagcgcagagaggguccuucc

SEQ ID NO: 623260 - RNA, 24 nt, Human
cgccgagaauccccccacuuaccc

SEQ ID NO: 623261 - RNA, 21 nt, Human
cggcuucuaagucccccguuu

SEQ ID NO: 623262 - RNA, 24 nt, Human
cuagaacccugaucuacauaaagu

SEQ ID NO: 623263 - RNA, 21 nt, Human
cucagguuugcgucuguccuc

SEQ ID NO: 623264 - RNA, 24 nt, Human
cucaucgccgagaauccccccacu

SEQ ID NO: 623265 - RNA, 28 nt, Human
cucccgcagccccucuccuuccugugug

SEQ ID NO: 623266 - RNA, 21 nt, Human
cuccuuccugugugaaugcag

SEQ ID NO: 623267 - RNA, 19 nt, Human
cucuucucccucaaccuca

SEQ ID NO: 623268 - RNA, 20 nt, Human
cuggagcagcagguguugca

SEQ ID NO: 623269 - RNA, 23 nt, Human
cuggggagagaaugucaggugca

SEQ ID NO: 623270 - RNA, 20 nt, Human
gacucgcuguggaggacucc

SEQ ID NO: 623271 - RNA, 28 nt, Human
gagaaagaauaauaauuuaaaaaaaugc

SEQ ID NO: 623272 - RNA, 21 nt, Human
gagaauccccccacuuaccca

SEQ ID NO: 623273 - RNA, 25 nt, Human
gagaauccccccacuuacccagccc

SEQ ID NO: 623274 - RNA, 18 nt, Human
gagagacaacauuagauu

SEQ ID NO: 623275 - RNA, 19 nt, Human
gagaugaagacacgaagga

SEQ ID NO: 623276 - RNA, 22 nt, Human
gagcagcagguguugcagaggu

SEQ ID NO: 623277 - RNA, 21 nt, Human
gaggaaugugugacaaacccc

SEQ ID NO: 623278 - RNA, 19 nt, Human
gagugaugagguccacaca

SEQ ID NO: 623279 - RNA, 18 nt, Human
gauuacaggcgugagcca

SEQ ID NO: 623280 - RNA, 21 nt, Human
gauuacaggcgugagccacug

SEQ ID NO: 623281 - RNA, 24 nt, Human
gauuacaggcgugagccacugugc

SEQ ID NO: 623282 - RNA, 27 nt, Human
gcacucccaaagcugcaggauacaaua

SEQ ID NO: 623283 - RNA, 20 nt, Human
gcagagaggguccuuccaaa

SEQ ID NO: 623284 - RNA, 21 nt, Human
gcagcagcauucugccauugc

SEQ ID NO: 623285 - RNA, 21 nt, Human
gcagugccuaucccuguugca

SEQ ID NO: 623286 - RNA, 18 nt, Human
gccuggucaauguagaac

SEQ ID NO: 623287 - RNA, 23 nt, Human
gccugucuggcugcugcugcugu

SEQ ID NO: 623288 - RNA, 18 nt, Human
gcugcuggccuuucuggg

SEQ ID NO: 623289 - RNA, 18 nt, Human
gcuguggaggacuccuga

SEQ ID NO: 623290 - RNA, 18 nt, Human
ggaaauguacagaguuuc

SEQ ID NO: 623291 - RNA, 23 nt, Human
ggaaauguacagaguuucuucug

SEQ ID NO: 623292 - RNA, 20 nt, Human
ggaagccaacacugcuuaaa

SEQ ID NO: 623293 - RNA, 19 nt, Human
ggcaagaggugacuuuaau

SEQ ID NO: 623294 - RNA, 19 nt, Human
ggcagagucagagugauga

SEQ ID NO: 623295 - RNA, 18 nt, Human
ggcaggaaguccaagcug

SEQ ID NO: 623296 - RNA, 21 nt, Human
ggcagggugacaacuggaggg

SEQ ID NO: 623297 - RNA, 23 nt, Human
ggccaggcguccgcuucagagcc

SEQ ID NO: 623298 - RNA, 20 nt, Human
ggccuggucaauguagaacu

SEQ ID NO: 623299 - RNA, 19 nt, Human
gggaaauguacagaguuuc

SEQ ID NO: 623300 - RNA, 18 nt, Human
gggcaggaaguccaagcu

SEQ ID NO: 623301 - RNA, 20 nt, Human
gggcuggcagcgugcugacg

SEQ ID NO: 623302 - RNA, 27 nt, Human
uaaaaaaaucacaaaauauuucauuga

SEQ ID NO: 623303 - RNA, 24 nt, Human
uaaagaaucacauccucuugcugg

SEQ ID NO: 623304 - RNA, 25 nt, Human
uaaagaaucacauccucuugcugga

SEQ ID NO: 623305 - RNA, 20 nt, Human
uaaguacacauuuggggacu

SEQ ID NO: 623306 - RNA, 23 nt, Human
uacaggcgugagccacugugccc

SEQ ID NO: 623307 - RNA, 24 nt, Human
uacaggcgugagccacugugcccu

SEQ ID NO: 623308 - RNA, 18 nt, Human
uacuccaggcaacaaggg

SEQ ID NO: 623309 - RNA, 19 nt, Human
uagaacuucucagacacag

SEQ ID NO: 623310 - RNA, 21 nt, Human
uagaaugcugauuucuucccc

SEQ ID NO: 623311 - RNA, 23 nt, Human
ucaccuccccgccauauucuaaa

SEQ ID NO: 623312 - RNA, 20 nt, Human
uccacacaggucagugagau

SEQ ID NO: 623313 - RNA, 23 nt, Human
uccagcacuuugggauuacaggc

SEQ ID NO: 623314 - RNA, 21 nt, Human
ucccaaagcugcagauggaag

SEQ ID NO: 623315 - RNA, 22 nt, Human
ucccaaagcugcagauggaagg

SEQ ID NO: 623316 - RNA, 19 nt, Human
ucccagugacaguuacuuu

SEQ ID NO: 623317 - RNA, 23 nt, Human
ucucaucgccgagaaucccccca

SEQ ID NO: 623318 - RNA, 22 nt, Human
ucuccuuccugugugaaugcag

SEQ ID NO: 623319 - RNA, 27 nt, Human
ugaaguagugucccugauuagaaugcu

SEQ ID NO: 623320 - RNA, 23 nt, Human
ugagcugugugaaugggaggcca

SEQ ID NO: 623321 - RNA, 18 nt, Human
ugaguggagcaucuggca

SEQ ID NO: 623322 - RNA, 19 nt, Human
ugcaagaagaggggaagag

SEQ ID NO: 623323 - RNA, 20 nt, Human
ugcaagaagaggggaagagg

SEQ ID NO: 623324 - RNA, 25 nt, Human
ugcaagaagaggggaagaggacaau

SEQ ID NO: 623325 - RNA, 22 nt, Human
ugcagaggugugaagggggcca

SEQ ID NO: 623326 - RNA, 19 nt, Human
ugcugcuguuaaaagagcu

SEQ ID NO: 623327 - RNA, 18 nt, Human
uggagauguggggcugcu

SEQ ID NO: 623328 - RNA, 22 nt, Human
uggagcagcagguguugcagag

SEQ ID NO: 623329 - RNA, 24 nt, Human
uggcagcccaaguccuuaagguga

SEQ ID NO: 623330 - RNA, 22 nt, Human
uggccagacaucuguggaguga

SEQ ID NO: 623331 - RNA, 19 nt, Human
uggcuccccuucugccucc

SEQ ID NO: 623332 - RNA, 18 nt, Human
ugggauuacaggcgugag

SEQ ID NO: 623333 - RNA, 21 nt, Human
ugggauuacaggcgugagcca

SEQ ID NO: 623334 - RNA, 22 nt, Human
ugggauuacaggcgugagccac

SEQ ID NO: 623335 - RNA, 22 nt, Human
ugggauuacaggcgugagccac

SEQ ID NO: 623336 - RNA, 22 nt, Human
ugggauuacaggcgugagccac

SEQ ID NO: 623337 - RNA, 23 nt, Human
ugggauuacaggcgugagccacu

SEQ ID NO: 623338 - RNA, 24 nt, Human
ugggauuacaggcgugagccacug

SEQ ID NO: 623339 - RNA, 21 nt, Human
ugggcaggaaguccaagcugc

SEQ ID NO: 623340 - RNA, 21 nt, Human
ugggcagggugacaacuggag

SEQ ID NO: 623341 - RNA, 26 nt, Human
uggggagggggcgagcgcagagaggg

SEQ ID NO: 623342 - RNA, 20 nt, Human
uggugaguugacuuggaugc

SEQ ID NO: 623343 - RNA, 18 nt, Human
ugguuagucauuucucuu

SEQ ID NO: 623344 - RNA, 21 nt, Human
uguacagaguuucuucuggga

SEQ ID NO: 623345 - RNA, 22 nt, Human
ugugaaacagcaccaagauuga

SEQ ID NO: 623346 - RNA, 18 nt, Human
ugugugaaugggaggcca

SEQ ID NO: 623347 - RNA, 18 nt, Human
ugugugaaugggaggcca

SEQ ID NO: 623348 - RNA, 20 nt, Human
uguuaagaggaaugugugac

SEQ ID NO: 623349 - RNA, 18 nt, Human
uguugcagaggugugaag

SEQ ID NO: 623350 - RNA, 20 nt, Human
uuaaaaaaaugccugaucca

SEQ ID NO: 623351 - RNA, 28 nt, Human
uuaaaaaaaugccugauccauuucucua

SEQ ID NO: 623352 - RNA, 23 nt, Human
uuaaaucucccgcagccccucuc

SEQ ID NO: 623353 - RNA, 28 nt, Human
uucacaagcaaauacauacgcaugugca

SEQ ID NO: 623354 - RNA, 23 nt, Human
uuugcuguggucacuguaauuuu

SEQ ID NO: 623355 - RNA, 24 nt, Human
uuuuuuuuuuuuuuuuuuuuaacg

SEQ ID NO: 623356 - RNA, 20 nt, Human
aagaagaggcuuuucuucca

SEQ ID NO: 623357 - RNA, 19 nt, Human
aaggccugacuugucuuca

SEQ ID NO: 623358 - RNA, 20 nt, Human
aaggugccucagggugaggg

SEQ ID NO: 623359 - RNA, 21 nt, Human
acccaugugcuccagugguca

SEQ ID NO: 623360 - RNA, 21 nt, Human
acgaguuuaucugcucccuuc

SEQ ID NO: 623361 - RNA, 20 nt, Human
agcucccagcaagucucaua

SEQ ID NO: 623362 - RNA, 22 nt, Human
aggcaugaguaauuguucugaa

SEQ ID NO: 623363 - RNA, 19 nt, Human
agggaaugcaaagcagagc

SEQ ID NO: 623364 - RNA, 21 nt, Human
augugagaccuuucaucuaca

SEQ ID NO: 623365 - RNA, 23 nt, Human
cacagugaauagauacuuccucu

SEQ ID NO: 623366 - RNA, 21 nt, Human
cacuccaggguuaccuggcug

SEQ ID NO: 623367 - RNA, 20 nt, Human
cagagcucccagcaagucuc

SEQ ID NO: 623368 - RNA, 24 nt, Human
ccacguguuaucucacauaauccu

SEQ ID NO: 623369 - RNA, 23 nt, Human
cccacagugaguuuggggaaaga

SEQ ID NO: 623370 - RNA, 21 nt, Human
cuacguggggccaggcaaguu

SEQ ID NO: 623371 - RNA, 19 nt, Human
gaaaggaaggcaugaguaa

SEQ ID NO: 623372 - RNA, 18 nt, Human
gagcucccagcaagucuc

SEQ ID NO: 623373 - RNA, 18 nt, Human
ggaaucaucauuugaaaa

SEQ ID NO: 623374 - RNA, 23 nt, Human
uaagaagaggcuuuucuuccaca

SEQ ID NO: 623375 - RNA, 22 nt, Human
ucccagcaagucucauaaaaca

SEQ ID NO: 623376 - RNA, 23 nt, Human
ucccccaccaauguuuuagggau

SEQ ID NO: 623377 - RNA, 20 nt, Human
uccccuaacuccauuaaccc

SEQ ID NO: 623378 - RNA, 18 nt, Human
ugagaaaggaaggcauga

SEQ ID NO: 623379 - RNA, 19 nt, Human
ugagaaaggaaggcaugag

SEQ ID NO: 623380 - RNA, 23 nt, Human
ugaggguuaaagcuacuagagug

SEQ ID NO: 623381 - RNA, 22 nt, Human
uggggccaggcaaguuacaauu

SEQ ID NO: 623382 - RNA, 19 nt, Human
uguagcucccccaccaaug

SEQ ID NO: 623383 - RNA, 19 nt, Human
ugugagaccuuucaucuac

SEQ ID NO: 623384 - RNA, 28 nt, Human
uguuauuuuuagucauucucgcaggggg

SEQ ID NO: 623385 - RNA, 23 nt, Human
uuaagaagaggcuuuucuuccac

SEQ ID NO: 623386 - RNA, 21 nt, Human
uuccccuaacuccauuaaccc

SEQ ID NO: 623387 - RNA, 21 nt, Human
uugaaauagcaagggguuuuu

SEQ ID NO: 623388 - RNA, 20 nt, Human
uuggaggcuugcaggcaaug

SEQ ID NO: 623389 - RNA, 24 nt, Human
uuuuucagauuuucacagugaaua

SEQ ID NO: 623390 - RNA, 25 nt, Human
uuuuuuuuuuugaaauagcaagggg

SEQ ID NO: 623391 - RNA, 18 nt, Human
uuuuuuuuuuuuuuuuug

SEQ ID NO: 623392 - RNA, 21 nt, Human
agacaguacaacgaggaaaug

SEQ ID NO: 623393 - RNA, 22 nt, Human
aguggccaccacacuggauagc

SEQ ID NO: 623394 - RNA, 22 nt, Human
auccagaacagcccuguccaau

SEQ ID NO: 623395 - RNA, 18 nt, Human
cagaacagcccuguccaa

SEQ ID NO: 623396 - RNA, 20 nt, Human
cggcaccugcugaccgccgc

SEQ ID NO: 623397 - RNA, 23 nt, Human
ggccguggguucggcaccugcug

SEQ ID NO: 623398 - RNA, 27 nt, Human
uagacaguacaacgaggaaaugcauau

SEQ ID NO: 623399 - RNA, 19 nt, Human
ucgccugccagggcccagg

SEQ ID NO: 623400 - RNA, 19 nt, Human
ugccagggcccaggggcuc

SEQ ID NO: 623401 - RNA, 19 nt, Human
uucggcaccugcugaccgc

SEQ ID NO: 623402 - RNA, 21 nt, Human
uucucauccagaacagcccug

SEQ ID NO: 623403 - RNA, 20 nt, Human
uuuuuuuuuuuuuuuuuugg

SEQ ID NO: 623404 - RNA, 24 nt, Human
uuuuuuuuuuuuuuuuuuguaauu

SEQ ID NO: 623405 - RNA, 23 nt, Human
aaggugcugcucagagggucugg

SEQ ID NO: 623406 - RNA, 19 nt, Human
agagacccgagggguccug

SEQ ID NO: 623407 - RNA, 19 nt, Human
agagccucuggaggcuggg

SEQ ID NO: 623408 - RNA, 21 nt, Human
agccucuggaggcugggagcu

SEQ ID NO: 623409 - RNA, 20 nt, Human
aggcggcugacagggcggcg

SEQ ID NO: 623410 - RNA, 20 nt, Human
aguaaaauaauauacgucuu

SEQ ID NO: 623411 - RNA, 18 nt, Human
augauaugaccaaggcca

SEQ ID NO: 623412 - RNA, 22 nt, Human
augaucauccuuauuuccagau

SEQ ID NO: 623413 - RNA, 23 nt, Human
auuuccagaugugggaacuaggc

SEQ ID NO: 623414 - RNA, 20 nt, Human
caauguaaccgugagguagc

SEQ ID NO: 623415 - RNA, 21 nt, Human
cacacagcuggcaaacaguga

SEQ ID NO: 623416 - RNA, 22 nt, Human
cacuuccgcuuccgguuaaaga

SEQ ID NO: 623417 - RNA, 18 nt, Human
cagaaaauauaauugagc

SEQ ID NO: 623418 - RNA, 24 nt, Human
cauccuuauuuccagaugugggaa

SEQ ID NO: 623419 - RNA, 22 nt, Human
cccugagucuuaaccccacccc

SEQ ID NO: 623420 - RNA, 25 nt, Human
cccuucuucauccguccuguuccug

SEQ ID NO: 623421 - RNA, 21 nt, Human
ccucuggaggcugggagcuuu

SEQ ID NO: 623422 - RNA, 21 nt, Human
ccucuguucucucaaccuggg

SEQ ID NO: 623423 - RNA, 18 nt, Human
ccuucuucauccguccug

SEQ ID NO: 623424 - RNA, 25 nt, Human
cgcgagucugcaucgccuaucucuc

SEQ ID NO: 623425 - RNA, 21 nt, Human
cgcgucucuugcgugcgugua

SEQ ID NO: 623426 - RNA, 23 nt, Human
cuucauugagagccucuggaggc

SEQ ID NO: 623427 - RNA, 21 nt, Human
cuucccguagccggucgagaa

SEQ ID NO: 623428 - RNA, 21 nt, Human
gacccgagggguccugggggc

SEQ ID NO: 623429 - RNA, 19 nt, Human
gaccuuccucucgcuggga

SEQ ID NO: 623430 - RNA, 19 nt, Human
gaggcggcugacagggcgg

SEQ ID NO: 623431 - RNA, 21 nt, Human
gccucuguucucucaaccugg

SEQ ID NO: 623432 - RNA, 21 nt, Human
gccuggaaagcguggcugagg

SEQ ID NO: 623433 - RNA, 26 nt, Human
gcgccgaggcggcugacagggcggcg

SEQ ID NO: 623434 - RNA, 22 nt, Human
ggaaagcguggcugaggcagug

SEQ ID NO: 623435 - RNA, 22 nt, Human
ggaccagaaaccagccuggaaa

SEQ ID NO: 623436 - RNA, 21 nt, Human
ggcggcggccgcgaccuuccc

SEQ ID NO: 623437 - RNA, 21 nt, Human
ggguccugggggcgccgaggc

SEQ ID NO: 623438 - RNA, 20 nt, Human
uaugaccaaggccacacagc

SEQ ID NO: 623439 - RNA, 26 nt, Human
ucaaccuggggcuuucaguuuccuca

SEQ ID NO: 623440 - RNA, 19 nt, Human
ugaagacgaccaugaaggu

SEQ ID NO: 623441 - RNA, 19 nt, Human
ugaccaaggccacacagcu

SEQ ID NO: 623442 - RNA, 19 nt, Human
ugagagccucuggaggcug

SEQ ID NO: 623443 - RNA, 21 nt, Human
ugagagccucuggaggcuggg

SEQ ID NO: 623444 - RNA, 22 nt, Human
ugaugaaaacugggaugggucc

SEQ ID NO: 623445 - RNA, 19 nt, Human
ugauuaucugcccucuuca

SEQ ID NO: 623446 - RNA, 19 nt, Human
ugcaucgccuaucucuccg

SEQ ID NO: 623447 - RNA, 27 nt, Human
ugccccugagucuuaaccccaccccuu

SEQ ID NO: 623448 - RNA, 21 nt, Human
uggaaagcguggcugaggcag

SEQ ID NO: 623449 - RNA, 19 nt, Human
uggcugaggcagugagagg

SEQ ID NO: 623450 - RNA, 24 nt, Human
uggggcuuucaguuuccucaaguc

SEQ ID NO: 623451 - RNA, 20 nt, Human
uugcgggagguggcugaggc

SEQ ID NO: 623452 - RNA, 21 nt, Human
uugcgggagguggcugaggcg

SEQ ID NO: 623453 - RNA, 24 nt, Human
uuuuuuuuuuuuuuuuuucucggg

SEQ ID NO: 623454 - RNA, 24 nt, Human
aaaacuuguacuuuauuuuucuca

SEQ ID NO: 623455 - RNA, 22 nt, Human
aaaagcauuucaaaugccagga

SEQ ID NO: 623456 - RNA, 23 nt, Human
aaacuuguacuuuauuuuucuca

SEQ ID NO: 623457 - RNA, 21 nt, Human
aaauacccaacaaagauccag

SEQ ID NO: 623458 - RNA, 19 nt, Human
acccaacaaagauccagga

SEQ ID NO: 623459 - RNA, 19 nt, Human
acgucaacuuugauuaugg

SEQ ID NO: 623460 - RNA, 20 nt, Human
acuuuauuuuucucaaauau

SEQ ID NO: 623461 - RNA, 24 nt, Human
aggaugugggauauuuaaaaauac

SEQ ID NO: 623462 - RNA, 18 nt, Human
aggcacugguauuuagaa

SEQ ID NO: 623463 - RNA, 25 nt, Human
aucacaaacuccacagaaauaauua

SEQ ID NO: 623464 - RNA, 18 nt, Human
augcaaauuacuuucaaa

SEQ ID NO: 623465 - RNA, 19 nt, Human
caggcaauucacuuggaag

SEQ ID NO: 623466 - RNA, 18 nt, Human
gagguaggacuauccaca

SEQ ID NO: 623467 - RNA, 19 nt, Human
gcucugguuuaaaaugaaa

SEQ ID NO: 623468 - RNA, 23 nt, Human
gugguuuuagccucaauauaaua

SEQ ID NO: 623469 - RNA, 28 nt, Human
uaaaaaaaucacaaacuccacagaaaua

SEQ ID NO: 623470 - RNA, 21 nt, Human
uaaaaugaaagcaacuggcua

SEQ ID NO: 623471 - RNA, 23 nt, Human
uaaauacccaacaaagauccagg

SEQ ID NO: 623472 - RNA, 24 nt, Human
uaacugcuuuccugaaaauggucu

SEQ ID NO: 623473 - RNA, 26 nt, Human
uaauaaucauccccuuacucuuagac

SEQ ID NO: 623474 - RNA, 20 nt, Human
uacaauauucaugaauuaaa

SEQ ID NO: 623475 - RNA, 21 nt, Human
uacuuaugcuuuuugucauua

SEQ ID NO: 623476 - RNA, 24 nt, Human
uccaggaugugggauauuuaaaaa

SEQ ID NO: 623477 - RNA, 24 nt, Human
ugacgucaacuuugauuaugggaa

SEQ ID NO: 623478 - RNA, 20 nt, Human
ugaggaccuuagaaaaucaa

SEQ ID NO: 623479 - RNA, 20 nt, Human
ugaggaccuuagaaaaucaa

SEQ ID NO: 623480 - RNA, 25 nt, Human
ugcaaauuacuuucaaauacauuuu

SEQ ID NO: 623481 - RNA, 18 nt, Human
ugugcaugucuacaaggu

SEQ ID NO: 623482 - RNA, 20 nt, Human
uuagaaaaucaacauuuccu

SEQ ID NO: 623483 - RNA, 24 nt, Human
uuggaagaauguuauaaugaaugu

SEQ ID NO: 623484 - RNA, 25 nt, Human
uuguacuuuauuuuucucaaauauu

SEQ ID NO: 623485 - RNA, 21 nt, Human
uuuccugugaacuugagagac

SEQ ID NO: 623486 - RNA, 21 nt, Human
uuuuuuuuuuuuuuguucaaa

SEQ ID NO: 623487 - RNA, 20 nt, Human
uuuuuuuuuuuuuuuuuguu

SEQ ID NO: 623488 - RNA, 27 nt, Human
uuuuuuuuuuuuuuuuuuuuuuugggg

SEQ ID NO: 623489 - RNA, 22 nt, Human
aagacaccaaccauuaugaaua

SEQ ID NO: 623490 - RNA, 19 nt, Human
aagagcacggcuggaauuc

SEQ ID NO: 623491 - RNA, 23 nt, Human
aagcuguaaccaccuccggcuua

SEQ ID NO: 623492 - RNA, 26 nt, Human
aauucaccuccucagacuccuccucu

SEQ ID NO: 623493 - RNA, 23 nt, Human
agcacggcuggaauucaccuccu

SEQ ID NO: 623494 - RNA, 23 nt, Human
agcuuaauguugacaucuggcau

SEQ ID NO: 623495 - RNA, 22 nt, Human
aggaggcccagccagaggcucc

SEQ ID NO: 623496 - RNA, 19 nt, Human
aggcaaaaaugaugcaucc

SEQ ID NO: 623497 - RNA, 21 nt, Human
aggcaaaaaugaugcauccag

SEQ ID NO: 623498 - RNA, 22 nt, Human
aggcaaaaaugaugcauccaga

SEQ ID NO: 623499 - RNA, 23 nt, Human
aggcaaaaaugaugcauccagaa

SEQ ID NO: 623500 - RNA, 22 nt, Human
agguggagaagggaagaagggc

SEQ ID NO: 623501 - RNA, 24 nt, Human
auccaugggggggaaugguccaga

SEQ ID NO: 623502 - RNA, 21 nt, Human
cacacacacagaaucagugua

SEQ ID NO: 623503 - RNA, 22 nt, Human
cacacugcccagccagccugca

SEQ ID NO: 623504 - RNA, 26 nt, Human
cacugcccagccagccugcaagagcu

SEQ ID NO: 623505 - RNA, 19 nt, Human
cagaggcucccucuccucc

SEQ ID NO: 623506 - RNA, 19 nt, Human
caggagagcuguuuucccu

SEQ ID NO: 623507 - RNA, 26 nt, Human
ccaacuuucuuucacagguccuccca

SEQ ID NO: 623508 - RNA, 23 nt, Human
ccacauuuuaaguaaauuuaaaa

SEQ ID NO: 623509 - RNA, 21 nt, Human
ccagaggcucccucuccuccc

SEQ ID NO: 623510 - RNA, 23 nt, Human
ccaguaggugacagcgccucccu

SEQ ID NO: 623511 - RNA, 23 nt, Human
ccauuccagucaaauccuuggug

SEQ ID NO: 623512 - RNA, 20 nt, Human
ccccaaggcacucagugacc

SEQ ID NO: 623513 - RNA, 22 nt, Human
ccccaaggcacucagugaccaa

SEQ ID NO: 623514 - RNA, 23 nt, Human
ccucccagugacugaccuggcuc

SEQ ID NO: 623515 - RNA, 19 nt, Human
ccuccccagcacacugccc

SEQ ID NO: 623516 - RNA, 21 nt, Human
ccucuguucuuuucaggccuu

SEQ ID NO: 623517 - RNA, 23 nt, Human
ccuucuguucucccuucacuagg

SEQ ID NO: 623518 - RNA, 21 nt, Human
ccuuggugaaaugcccaguuu

SEQ ID NO: 623519 - RNA, 26 nt, Human
cgggguguucccagcacaccaggccc

SEQ ID NO: 623520 - RNA, 23 nt, Human
cuccagaguaauaugcuuaaucc

SEQ ID NO: 623521 - RNA, 21 nt, Human
cucccuguuaccaggccucac

SEQ ID NO: 623522 - RNA, 21 nt, Human
cuccuccccagcacacugccc

SEQ ID NO: 623523 - RNA, 23 nt, Human
cucuccccagacagcucucuuca

SEQ ID NO: 623524 - RNA, 23 nt, Human
cugaauaacauuuuugacaugaa

SEQ ID NO: 623525 - RNA, 19 nt, Human
cugccuagcuggugcugug

SEQ ID NO: 623526 - RNA, 21 nt, Human
cugcucaggaccacacagcga

SEQ ID NO: 623527 - RNA, 23 nt, Human
gaaaaaaacugacaaacuccaaa

SEQ ID NO: 623528 - RNA, 23 nt, Human
gcacggcuggaauucaccuccuc

SEQ ID NO: 623529 - RNA, 23 nt, Human
ggagagcuguuuucccuuugaaa

SEQ ID NO: 623530 - RNA, 18 nt, Human
ggauuggcaaggccagua

SEQ ID NO: 623531 - RNA, 21 nt, Human
ggccucacucaaagcucuaac

SEQ ID NO: 623532 - RNA, 23 nt, Human
gguggagaagggaagaagggccg

SEQ ID NO: 623533 - RNA, 22 nt, Human
uaaaaucacacacacagaauca

SEQ ID NO: 623534 - RNA, 20 nt, Human
uaagaaaaaaacugacaaac

SEQ ID NO: 623535 - RNA, 23 nt, Human
uaaguaaauuuaaaauuaaugaa

SEQ ID NO: 623536 - RNA, 22 nt, Human
uaccaggccucacucaaagcuc

SEQ ID NO: 623537 - RNA, 23 nt, Human
uagcuggugcugugccgcuuccc

SEQ ID NO: 623538 - RNA, 20 nt, Human
ucaaaagacaccaaccauua

SEQ ID NO: 623539 - RNA, 21 nt, Human
ucaaagcucuaacauggccug

SEQ ID NO: 623540 - RNA, 23 nt, Human
ucacagguccucccagugacuga

SEQ ID NO: 623541 - RNA, 24 nt, Human
ucacuagguggagaagggaagaag

SEQ ID NO: 623542 - RNA, 20 nt, Human
uccaaauguuuaaauagaau

SEQ ID NO: 623543 - RNA, 19 nt, Human
uccagaagaaaggccaggu

SEQ ID NO: 623544 - RNA, 21 nt, Human
ucccagugacugaccuggcuc

SEQ ID NO: 623545 - RNA, 24 nt, Human
uccccaaagggcuuuaauuggcuc

SEQ ID NO: 623546 - RNA, 22 nt, Human
uccuccucuguucuuuucaggc

SEQ ID NO: 623547 - RNA, 22 nt, Human
uccucuguucuuuucaggccuu

SEQ ID NO: 623548 - RNA, 24 nt, Human
uccucuguucuuuucaggccuuua

SEQ ID NO: 623549 - RNA, 20 nt, Human
ugaaauaucaauaguuugcc

SEQ ID NO: 623550 - RNA, 24 nt, Human
ugaagcaaagacuuuaucauccau

SEQ ID NO: 623551 - RNA, 19 nt, Human
ugaaggcagaauggacuug

SEQ ID NO: 623552 - RNA, 26 nt, Human
ugacaaacuccaaauccauaaugaca

SEQ ID NO: 623553 - RNA, 24 nt, Human
ugacaugaaauucaucaaaugaag

SEQ ID NO: 623554 - RNA, 18 nt, Human
ugacaugagaacuuacac

SEQ ID NO: 623555 - RNA, 28 nt, Human
ugaccuggcucauucuccgaaagugggg

SEQ ID NO: 623556 - RNA, 18 nt, Human
ugagagaagcuuugugaa

SEQ ID NO: 623557 - RNA, 21 nt, Human
uggaauguuuugccagucccc

SEQ ID NO: 623558 - RNA, 21 nt, Human
uggaggaggcccagccagagg

SEQ ID NO: 623559 - RNA, 19 nt, Human
ugggaagagaggacucccc

SEQ ID NO: 623560 - RNA, 23 nt, Human
ugggaagagaggacuccccuucu

SEQ ID NO: 623561 - RNA, 18 nt, Human
uggggcgucucugccuag

SEQ ID NO: 623562 - RNA, 23 nt, Human
uggugcugugccgcuucccacag

SEQ ID NO: 623563 - RNA, 21 nt, Human
ugugggaagagaggacucccc

SEQ ID NO: 623564 - RNA, 20 nt, Human
uguguggacaagguaugagg

SEQ ID NO: 623565 - RNA, 19 nt, Human
uugcuugaaccauguucuc

SEQ ID NO: 623566 - RNA, 21 nt, Human
uuuuuuuuuuuuuuccccgcu

SEQ ID NO: 623567 - RNA, 21 nt, Human
aaccauccgcugcggccgucc

SEQ ID NO: 623568 - RNA, 24 nt, Human
aagaugccaaggcagccauccccg

SEQ ID NO: 623569 - RNA, 19 nt, Human
aagcggcuggcgacuuggg

SEQ ID NO: 623570 - RNA, 21 nt, Human
aauguagggauggaaaaggga

SEQ ID NO: 623571 - RNA, 24 nt, Human
acccugagguucuugucuccagcg

SEQ ID NO: 623572 - RNA, 22 nt, Human
accugcuggcuggcaccgcuuc

SEQ ID NO: 623573 - RNA, 22 nt, Human
acgagcaccagcuuaucccgcu

SEQ ID NO: 623574 - RNA, 21 nt, Human
acucugugccagcccccuugu

SEQ ID NO: 623575 - RNA, 23 nt, Human
agagccaaugagagcuugcgggg

SEQ ID NO: 623576 - RNA, 19 nt, Human
agagguguucaucgggcgg

SEQ ID NO: 623577 - RNA, 20 nt, Human
agcuccuugguuucucccuc

SEQ ID NO: 623578 - RNA, 22 nt, Human
aggaaguauggcgggccacccc

SEQ ID NO: 623579 - RNA, 24 nt, Human
aggagaggugggggcgcgcuuggc

SEQ ID NO: 623580 - RNA, 21 nt, Human
aggcccaggaggcuuagucca

SEQ ID NO: 623581 - RNA, 23 nt, Human
aggcggcgcuggaggcguggguc

SEQ ID NO: 623582 - RNA, 23 nt, Human
aggcuggggcgggggugcugguu

SEQ ID NO: 623583 - RNA, 19 nt, Human
agggguagggaagcuucca

SEQ ID NO: 623584 - RNA, 22 nt, Human
agguggugauuccugggcaucc

SEQ ID NO: 623585 - RNA, 23 nt, Human
agugaugccuagccccgccuucc

SEQ ID NO: 623586 - RNA, 20 nt, Human
aguggauaccuccacccccc

SEQ ID NO: 623587 - RNA, 20 nt, Human
auaccccccagcaaaggagg

SEQ ID NO: 623588 - RNA, 18 nt, Human
auggugaccugaugacca

SEQ ID NO: 623589 - RNA, 24 nt, Human
auuccaaccuuccuuucccucuca

SEQ ID NO: 623590 - RNA, 23 nt, Human
caaaaaggcccugguggaaggua

SEQ ID NO: 623591 - RNA, 20 nt, Human
caaccuuccuuucccucuca

SEQ ID NO: 623592 - RNA, 18 nt, Human
cagcagcagcuuuuuggc

SEQ ID NO: 623593 - RNA, 22 nt, Human
cagcccccuuguuagcgcaguc

SEQ ID NO: 623594 - RNA, 18 nt, Human
cagcggccucaucugggu

SEQ ID NO: 623595 - RNA, 24 nt, Human
cagcucaaaccgacgccucuuaaa

SEQ ID NO: 623596 - RNA, 19 nt, Human
cagcucgaggcgcggcgcg

SEQ ID NO: 623597 - RNA, 23 nt, Human
caggguacggguguaaacccauu

SEQ ID NO: 623598 - RNA, 20 nt, Human
caguggauaccuccaccccc

SEQ ID NO: 623599 - RNA, 22 nt, Human
ccagagcuccuugguuucuccc

SEQ ID NO: 623600 - RNA, 18 nt, Human
ccagcagaagacuauuga

SEQ ID NO: 623601 - RNA, 19 nt, Human
ccagcuggagagccaugca

SEQ ID NO: 623602 - RNA, 18 nt, Human
ccauggccaaaaaggccc

SEQ ID NO: 623603 - RNA, 22 nt, Human
cccacaggcugggugagcagcc

SEQ ID NO: 623604 - RNA, 22 nt, Human
cccagacugagguucugagagc

SEQ ID NO: 623605 - RNA, 20 nt, Human
cccagccugagaugguccca

SEQ ID NO: 623606 - RNA, 23 nt, Human
cccaguaccacaggagagguggg

SEQ ID NO: 623607 - RNA, 18 nt, Human
ccccagacugagguucug

SEQ ID NO: 623608 - RNA, 25 nt, Human
cccccagguacgguagucccagccc

SEQ ID NO: 623609 - RNA, 19 nt, Human
cccccgcgcgcuggguccg

SEQ ID NO: 623610 - RNA, 19 nt, Human
cccccgcgcgcuggguccg

SEQ ID NO: 623611 - RNA, 21 nt, Human
cccccgcgcgcuggguccgug

SEQ ID NO: 623612 - RNA, 19 nt, Human
cccgccccgucgagggagg

SEQ ID NO: 623613 - RNA, 23 nt, Human
cccgccccgucgagggagggggc

SEQ ID NO: 623614 - RNA, 19 nt, Human
cccgggcggcgcacgugca

SEQ ID NO: 623615 - RNA, 18 nt, Human
cccuccuuccgcuggucc

SEQ ID NO: 623616 - RNA, 22 nt, Human
cccugagguucuugucuccagc

SEQ ID NO: 623617 - RNA, 20 nt, Human
ccgagccuucacugucagaa

SEQ ID NO: 623618 - RNA, 25 nt, Human
ccgccgaaucugacccgcagcgcgc

SEQ ID NO: 623619 - RNA, 19 nt, Human
ccgggaugggcaugaggug

SEQ ID NO: 623620 - RNA, 18 nt, Human
ccuagccccgccuucccc

SEQ ID NO: 623621 - RNA, 21 nt, Human
ccuagccccgccuuccccagc

SEQ ID NO: 623622 - RNA, 23 nt, Human
ccuccaccccccugggaggcggg

SEQ ID NO: 623623 - RNA, 21 nt, Human
ccuccccaccaccaauugcca

SEQ ID NO: 623624 - RNA, 22 nt, Human
ccugaugaccagagcuccuugg

SEQ ID NO: 623625 - RNA, 19 nt, Human
ccugccgccgaaucugacc

SEQ ID NO: 623626 - RNA, 19 nt, Human
ccuucagcggccugaaccg

SEQ ID NO: 623627 - RNA, 19 nt, Human
ccuugcauacccucuuccc

SEQ ID NO: 623628 - RNA, 20 nt, Human
cgcugcagccgcuggguccc

SEQ ID NO: 623629 - RNA, 23 nt, Human
cgggcagaggaaguauggcgggc

SEQ ID NO: 623630 - RNA, 18 nt, Human
cgggcggcugccucagga

SEQ ID NO: 623631 - RNA, 24 nt, Human
cgugggccgccucuacgaguuccg

SEQ ID NO: 623632 - RNA, 22 nt, Human
cgugugccgcagcaccgagaag

SEQ ID NO: 623633 - RNA, 23 nt, Human
cuacucugugccagcccccuugu

SEQ ID NO: 623634 - RNA, 24 nt, Human
cucauccaccagcagaagacuauu

SEQ ID NO: 623635 - RNA, 19 nt, Human
cuccucgggaggcagcccc

SEQ ID NO: 623636 - RNA, 20 nt, Human
cuccugggcuacaaggaccc

SEQ ID NO: 623637 - RNA, 18 nt, Human
cugaaccgcggcuucgcc

SEQ ID NO: 623638 - RNA, 21 nt, Human
cugaugaugaccuucagcggc

SEQ ID NO: 623639 - RNA, 21 nt, Human
cugcagccgcugggucccggc

SEQ ID NO: 623640 - RNA, 18 nt, Human
cugcugcucgcgcugcag

SEQ ID NO: 623641 - RNA, 18 nt, Human
cuggguccgugggcucag

SEQ ID NO: 623642 - RNA, 22 nt, Human
cuguggucugcuggggcuggug

SEQ ID NO: 623643 - RNA, 19 nt, Human
cuugggagcuccuccucgg

SEQ ID NO: 623644 - RNA, 18 nt, Human
cuuuauacugagcauagc

SEQ ID NO: 623645 - RNA, 19 nt, Human
cuuuuuggcuggauccaga

SEQ ID NO: 623646 - RNA, 19 nt, Human
gaaaagacgaacacguccc

SEQ ID NO: 623647 - RNA, 22 nt, Human
gcacaaccauccgcugcggccg

SEQ ID NO: 623648 - RNA, 18 nt, Human
gcagccgcugggucccgg

SEQ ID NO: 623649 - RNA, 20 nt, Human
gcccccuuugggggaggggc

SEQ ID NO: 623650 - RNA, 21 nt, Human
gcccgcugcucgugugccgca

SEQ ID NO: 623651 - RNA, 20 nt, Human
gccuugagauggugaccuga

SEQ ID NO: 623652 - RNA, 20 nt, Human
gcgacuuugcagcuuucacc

SEQ ID NO: 623653 - RNA, 18 nt, Human
gcgcccgggcagaucgcu

SEQ ID NO: 623654 - RNA, 21 nt, Human
gcgcgcugcugcucgcgcugc

SEQ ID NO: 623655 - RNA, 19 nt, Human
gcggcgcuggaggcguggg

SEQ ID NO: 623656 - RNA, 25 nt, Human
gcugcacaaccauccgcugcggccg

SEQ ID NO: 623657 - RNA, 24 nt, Human
gcugcagccgcugggucccggcuu

SEQ ID NO: 623658 - RNA, 20 nt, Human
gcuggcuggcaccgcuucug

SEQ ID NO: 623659 - RNA, 27 nt, Human
gcuggggcgggggugcugguugacggc

SEQ ID NO: 623660 - RNA, 21 nt, Human
gcuggugaggacccgucucaa

SEQ ID NO: 623661 - RNA, 24 nt, Human
gcuuuuuggcuggauccagagcca

SEQ ID NO: 623662 - RNA, 21 nt, Human
ggaaaagacgaacacgucccu

SEQ ID NO: 623663 - RNA, 19 nt, Human
ggagaggugggggcgcgcu

SEQ ID NO: 623664 - RNA, 20 nt, Human
ggcaccgcuucugguaccag

SEQ ID NO: 623665 - RNA, 18 nt, Human
ggcauaggaccugcuggc

SEQ ID NO: 623666 - RNA, 22 nt, Human
ggccgggaugggcaugaggugg

SEQ ID NO: 623667 - RNA, 21 nt, Human
ggccuugagauggugaccuga

SEQ ID NO: 623668 - RNA, 19 nt, Human
ggcuugggagcuccuccuc

SEQ ID NO: 623669 - RNA, 20 nt, Human
gggaggaaguuauaaagagg

SEQ ID NO: 623670 - RNA, 22 nt, Human
gggaugggcaugagguggccaa

SEQ ID NO: 623671 - RNA, 23 nt, Human
gggcaccaugagccuuggaaaca

SEQ ID NO: 623672 - RNA, 21 nt, Human
gggcaugagguggccaaggaa

SEQ ID NO: 623673 - RNA, 18 nt, Human
gggccggcgagccccgcc

SEQ ID NO: 623674 - RNA, 22 nt, Human
gggcgggggugcugguuggggc

SEQ ID NO: 623675 - RNA, 21 nt, Human
ggggaggaaguuauaaagagg

SEQ ID NO: 623676 - RNA, 22 nt, Human
ggggaggaaguuauaaagaggg

SEQ ID NO: 623677 - RNA, 23 nt, Human
ggggaggaaguuauaaagagggu

SEQ ID NO: 623678 - RNA, 24 nt, Human
ggggcuggugaggacccgucucaa

SEQ ID NO: 623679 - RNA, 19 nt, Human
ggguagggaagcuuccaga

SEQ ID NO: 623680 - RNA, 21 nt, Human
gggucccggcuugcaggaggc

SEQ ID NO: 623681 - RNA, 21 nt, Human
gguacggguguaaacccauuu

SEQ ID NO: 623682 - RNA, 22 nt, Human
gguagucccagccccuccgccu

SEQ ID NO: 623683 - RNA, 18 nt, Human
guaaacuugugacccuga

SEQ ID NO: 623684 - RNA, 19 nt, Human
guacgguagucccagcccc

SEQ ID NO: 623685 - RNA, 24 nt, Human
gucagcagcagcuuuuuggcugga

SEQ ID NO: 623686 - RNA, 20 nt, Human
guccagucugugcuccuggg

SEQ ID NO: 623687 - RNA, 24 nt, Human
gucccggcuugcaggaggcgcggc

SEQ ID NO: 623688 - RNA, 26 nt, Human
gucccggcuugcaggaggcgcggcug

SEQ ID NO: 623689 - RNA, 18 nt, Human
guggcuccacguccaccc

SEQ ID NO: 623690 - RNA, 19 nt, Human
uaaaaugccucaaccacgg

SEQ ID NO: 623691 - RNA, 25 nt, Human
uaaggggcccuccuuccgcuggucc

SEQ ID NO: 623692 - RNA, 22 nt, Human
uacaacaccuuuuucauacaag

SEQ ID NO: 623693 - RNA, 19 nt, Human
uacucugugccagcccccu

SEQ ID NO: 623694 - RNA, 22 nt, Human
uaggaccugcuggcuggcaccg

SEQ ID NO: 623695 - RNA, 19 nt, Human
uauggcgggccacccccag

SEQ ID NO: 623696 - RNA, 21 nt, Human
uauggcgggccacccccaggu

SEQ ID NO: 623697 - RNA, 25 nt, Human
ucagugaugccuagccccgccuucc

SEQ ID NO: 623698 - RNA, 23 nt, Human
uccacaucuagaacauggauggc

SEQ ID NO: 623699 - RNA, 20 nt, Human
uccagucugugcuccugggc

SEQ ID NO: 623700 - RNA, 20 nt, Human
ucccagagacggauaccacc

SEQ ID NO: 623701 - RNA, 24 nt, Human
uccccagacugagguucugagagc

SEQ ID NO: 623702 - RNA, 23 nt, Human
ucccggcuugcaggaggcgcggc

SEQ ID NO: 623703 - RNA, 23 nt, Human
uccggcuacaccagcccccuuug

SEQ ID NO: 623704 - RNA, 19 nt, Human
uccugggcuacaaggaccc

SEQ ID NO: 623705 - RNA, 23 nt, Human
uccuugguuucucccucuugggg

SEQ ID NO: 623706 - RNA, 23 nt, Human
ucgccacgcugcacaaccauccg

SEQ ID NO: 623707 - RNA, 24 nt, Human
ucugcccaucuucagagaaggcca

SEQ ID NO: 623708 - RNA, 19 nt, Human
ucugugcuccugggcuaca

SEQ ID NO: 623709 - RNA, 18 nt, Human
ugaccagagcuccuuggu

SEQ ID NO: 623710 - RNA, 25 nt, Human
ugacgguggccuugcauacccucuu

SEQ ID NO: 623711 - RNA, 18 nt, Human
ugagauggugaccugauu

SEQ ID NO: 623712 - RNA, 23 nt, Human
ugagcauagcaaguguuugggca

SEQ ID NO: 623713 - RNA, 18 nt, Human
ugaugccuagccccgccu

SEQ ID NO: 623714 - RNA, 22 nt, Human
ugauuccugggcauccggugcc

SEQ ID NO: 623715 - RNA, 19 nt, Human
ugcauacccucuucccaca

SEQ ID NO: 623716 - RNA, 18 nt, Human
ugccaaagguccaauaaa

SEQ ID NO: 623717 - RNA, 18 nt, Human
ugccaaggcagccauccc

SEQ ID NO: 623718 - RNA, 19 nt, Human
ugccauggccaaaaaggcc

SEQ ID NO: 623719 - RNA, 21 nt, Human
ugccucaaccacggagucugc

SEQ ID NO: 623720 - RNA, 19 nt, Human
ugccucaggacguguacga

SEQ ID NO: 623721 - RNA, 22 nt, Human
ugcugacccuagauggccggga

SEQ ID NO: 623722 - RNA, 23 nt, Human
ugcugcccagccccggaccggcg

SEQ ID NO: 623723 - RNA, 23 nt, Human
ugcugguuggggccaaacgcguu

SEQ ID NO: 623724 - RNA, 19 nt, Human
uggauaccuccaccccccu

SEQ ID NO: 623725 - RNA, 19 nt, Human
uggcaaaaacggccaggua

SEQ ID NO: 623726 - RNA, 26 nt, Human
uggcaagaguaggaaaagacgaacac

SEQ ID NO: 623727 - RNA, 19 nt, Human
uggccaaggaugcuguguc

SEQ ID NO: 623728 - RNA, 23 nt, Human
uggccgggaugggcaugaggugg

SEQ ID NO: 623729 - RNA, 24 nt, Human
uggcugucagcagcagcuuuuugg

SEQ ID NO: 623730 - RNA, 20 nt, Human
uggggaggaaguuauaaaga

SEQ ID NO: 623731 - RNA, 23 nt, Human
uggggaggaaguuauaaagaggg

SEQ ID NO: 623732 - RNA, 23 nt, Human
ugugcugacccuagauggccggg

SEQ ID NO: 623733 - RNA, 21 nt, Human
uguggucugcuggggcuggug

SEQ ID NO: 623734 - RNA, 20 nt, Human
uucacugucagaaacugcga

SEQ ID NO: 623735 - RNA, 21 nt, Human
uuccugggcauccggugcccu

SEQ ID NO: 623736 - RNA, 19 nt, Human
uugcauacccucuucccac

SEQ ID NO: 623737 - RNA, 22 nt, Human
uuggagacaguaaugagcuucu

SEQ ID NO: 623738 - RNA, 19 nt, Human
uuucucccucuuggcaaga

SEQ ID NO: 623739 - RNA, 24 nt, Human
aaagugcagggauuacaggcauga

SEQ ID NO: 623740 - RNA, 25 nt, Human
aacuccucgccuuaagcaacccucc

SEQ ID NO: 623741 - RNA, 22 nt, Human
accuuagccucccaaagugcag

SEQ ID NO: 623742 - RNA, 25 nt, Human
acuauguugcccaggcuggucucca

SEQ ID NO: 623743 - RNA, 19 nt, Human
agacgccgaggccagaagc

SEQ ID NO: 623744 - RNA, 21 nt, Human
agacgccgaggccagaagccu

SEQ ID NO: 623745 - RNA, 22 nt, Human
agccuuguccaaggcagggcau

SEQ ID NO: 623746 - RNA, 23 nt, Human
agggauuacaggcaugagccacc

SEQ ID NO: 623747 - RNA, 24 nt, Human
agggauuacaggcaugagccacca

SEQ ID NO: 623748 - RNA, 19 nt, Human
auggggucucacuauguug

SEQ ID NO: 623749 - RNA, 22 nt, Human
auguugcccaggcuggucucca

SEQ ID NO: 623750 - RNA, 24 nt, Human
caaagugcagggauuacaggcaug

SEQ ID NO: 623751 - RNA, 19 nt, Human
caaauggcucccugcagca

SEQ ID NO: 623752 - RNA, 22 nt, Human
caacccucccaccuuagccucc

SEQ ID NO: 623753 - RNA, 19 nt, Human
cacuauguugcccaggcug

SEQ ID NO: 623754 - RNA, 24 nt, Human
cacuauguugcccaggcuggucuc

SEQ ID NO: 623755 - RNA, 24 nt, Human
cagcagccccugcaacacuguucu

SEQ ID NO: 623756 - RNA, 20 nt, Human
cagcccaaguugcagaacaa

SEQ ID NO: 623757 - RNA, 18 nt, Human
cagggcauugaggcagag

SEQ ID NO: 623758 - RNA, 19 nt, Human
caugagccaccacucccag

SEQ ID NO: 623759 - RNA, 24 nt, Human
ccaaagugcagggauuacaggcau

SEQ ID NO: 623760 - RNA, 20 nt, Human
ccaggcuggucuccaacucc

SEQ ID NO: 623761 - RNA, 21 nt, Human
cccuacguggccauccgaggc

SEQ ID NO: 623762 - RNA, 19 nt, Human
ccucccaaagugcagggau

SEQ ID NO: 623763 - RNA, 20 nt, Human
ccucccaaagugcagggauu

SEQ ID NO: 623764 - RNA, 26 nt, Human
ccucccaccuuagccucccaaagugc

SEQ ID NO: 623765 - RNA, 23 nt, Human
ccugcagcagccccugcaacacc

SEQ ID NO: 623766 - RNA, 24 nt, Human
cuuaagcaacccucccaccuuagc

SEQ ID NO: 623767 - RNA, 20 nt, Human
gacgccgaggccagaagccu

SEQ ID NO: 623768 - RNA, 18 nt, Human
gauuacaggcaugagcca

SEQ ID NO: 623769 - RNA, 21 nt, Human
gauuacaggcaugagccacca

SEQ ID NO: 623770 - RNA, 22 nt, Human
gauuacaggcaugagccaccac

SEQ ID NO: 623771 - RNA, 23 nt, Human
gcaacccucccaccuuagccucc

SEQ ID NO: 623772 - RNA, 19 nt, Human
ggauuacaggcaugagcca

SEQ ID NO: 623773 - RNA, 21 nt, Human
gggauuacaggcaugagccac

SEQ ID NO: 623774 - RNA, 23 nt, Human
gggauuacaggcaugagccacca

SEQ ID NO: 623775 - RNA, 21 nt, Human
gggcauugaggcagagggcuc

SEQ ID NO: 623776 - RNA, 20 nt, Human
ggggacugugaucaucuggg

SEQ ID NO: 623777 - RNA, 18 nt, Human
gggggucuggcugucucu

SEQ ID NO: 623778 - RNA, 22 nt, Human
ggggucucacuauguugcccag

SEQ ID NO: 623779 - RNA, 18 nt, Human
ggggucuggcugucucug

SEQ ID NO: 623780 - RNA, 18 nt, Human
gggugggaggacugacug

SEQ ID NO: 623781 - RNA, 27 nt, Human
uaagcaacccucccaccuuagccuccc

SEQ ID NO: 623782 - RNA, 27 nt, Human
uaagcaacccucccaccuuagccuccc

SEQ ID NO: 623783 - RNA, 24 nt, Human
uacaggcaugagccaccacuccca

SEQ ID NO: 623784 - RNA, 22 nt, Human
uagagauggggucucacuaugu

SEQ ID NO: 623785 - RNA, 19 nt, Human
uauguugcccaggcugguc

SEQ ID NO: 623786 - RNA, 24 nt, Human
uauguugcccaggcuggucuccaa

SEQ ID NO: 623787 - RNA, 18 nt, Human
ucacucgggugggaggac

SEQ ID NO: 623788 - RNA, 19 nt, Human
uccaaggcagggcauugag

SEQ ID NO: 623789 - RNA, 24 nt, Human
ucccaaagugcagggauuacaggc

SEQ ID NO: 623790 - RNA, 23 nt, Human
uccccgggggucuggcugucucu

SEQ ID NO: 623791 - RNA, 21 nt, Human
ucccugcagcagccccugcaa

SEQ ID NO: 623792 - RNA, 24 nt, Human
ucccugcagcagccccugcaacac

SEQ ID NO: 623793 - RNA, 18 nt, Human
uccgaggccuccgggggg

SEQ ID NO: 623794 - RNA, 21 nt, Human
ucgggugggaggacugacugu

SEQ ID NO: 623795 - RNA, 19 nt, Human
ucucacuauguugcccagg

SEQ ID NO: 623796 - RNA, 23 nt, Human
ucucacuauguugcccaggcugg

SEQ ID NO: 623797 - RNA, 24 nt, Human
ucucacuauguugcccaggcuggu

SEQ ID NO: 623798 - RNA, 26 nt, Human
ucucacuauguugcccaggcuggucu

SEQ ID NO: 623799 - RNA, 27 nt, Human
ucucacuauguugcccaggcuggucuc

SEQ ID NO: 623800 - RNA, 21 nt, Human
ugacagacgccgaggccagaa

SEQ ID NO: 623801 - RNA, 20 nt, Human
ugagaggcuggguccccggg

SEQ ID NO: 623802 - RNA, 21 nt, Human
ugagccaccacucccagccca

SEQ ID NO: 623803 - RNA, 19 nt, Human
ugagccgacaguuguccgg

SEQ ID NO: 623804 - RNA, 24 nt, Human
ugagccgacaguuguccggcacug

SEQ ID NO: 623805 - RNA, 21 nt, Human
ugaggcagagggcucugagcc

SEQ ID NO: 623806 - RNA, 24 nt, Human
ugcccaggcuggucuccaacuccu

SEQ ID NO: 623807 - RNA, 24 nt, Human
uggggucucacuauguugcccagg

SEQ ID NO: 623808 - RNA, 19 nt, Human
uggguccccgggggucugg

SEQ ID NO: 623809 - RNA, 24 nt, Human
uguagagauggggucucacuaugu

SEQ ID NO: 623810 - RNA, 25 nt, Human
uuaagcaacccucccaccuuagccu

SEQ ID NO: 623811 - RNA, 23 nt, Human
uuguagagauggggucucacuau

SEQ ID NO: 623812 - RNA, 24 nt, Human
uuguagagauggggucucacuaug

SEQ ID NO: 623813 - RNA, 28 nt, Human
aaaaaaaaaaaaaaaagcagaaucagag

SEQ ID NO: 623814 - RNA, 23 nt, Human
aaaaaaaaaaagcagaaucagag

SEQ ID NO: 623815 - RNA, 24 nt, Human
aaaaaaaagcagaaucagagcuga

SEQ ID NO: 623816 - RNA, 22 nt, Human
aaaaaagcagaaucagagcuga

SEQ ID NO: 623817 - RNA, 22 nt, Human
aaaccacuuucaaccagaucuc

SEQ ID NO: 623818 - RNA, 21 nt, Human
aaagccaaaugccuacaucua

SEQ ID NO: 623819 - RNA, 22 nt, Human
aagagcacccucauguuuacca

SEQ ID NO: 623820 - RNA, 19 nt, Human
acagggaauaaacauaagc

SEQ ID NO: 623821 - RNA, 19 nt, Human
acuccgcugacagggaaua

SEQ ID NO: 623822 - RNA, 20 nt, Human
acuguggaaacccucagguc

SEQ ID NO: 623823 - RNA, 23 nt, Human
agcggcgcgaccucuacagcccc

SEQ ID NO: 623824 - RNA, 23 nt, Human
aggcagcggcaccgagugagaga

SEQ ID NO: 623825 - RNA, 21 nt, Human
agguccuuggcgugggcaggc

SEQ ID NO: 623826 - RNA, 21 nt, Human
caaaggaaaaaaaaaaaaaaa

SEQ ID NO: 623827 - RNA, 20 nt, Human
cacagagcucaacccccacg

SEQ ID NO: 623828 - RNA, 19 nt, Human
cacuguggaaacccucagg

SEQ ID NO: 623829 - RNA, 22 nt, Human
cagaucucaauucuccagcuau

SEQ ID NO: 623830 - RNA, 27 nt, Human
cagcaauaucucgcaauuccucaggau

SEQ ID NO: 623831 - RNA, 22 nt, Human
cauguuuaccauuuucugccug

SEQ ID NO: 623832 - RNA, 26 nt, Human
ccccucagcaauaucucgcaauuccu

SEQ ID NO: 623833 - RNA, 24 nt, Human
cccucagcaauaucucgcaauucc

SEQ ID NO: 623834 - RNA, 20 nt, Human
cgugggcaggccccagcagg

SEQ ID NO: 623835 - RNA, 20 nt, Human
cuacagccccuaggcagcgg

SEQ ID NO: 623836 - RNA, 24 nt, Human
cucaugauacacuguagacccauu

SEQ ID NO: 623837 - RNA, 22 nt, Human
cuccacuccgcugacagggaau

SEQ ID NO: 623838 - RNA, 22 nt, Human
cuccccuaccugagagcccuag

SEQ ID NO: 623839 - RNA, 18 nt, Human
gauguucuggcuggggaa

SEQ ID NO: 623840 - RNA, 19 nt, Human
gcccaaauucucccaaucu

SEQ ID NO: 623841 - RNA, 22 nt, Human
gcgcgaccucuacagccccuag

SEQ ID NO: 623842 - RNA, 24 nt, Human
gcuccccuaccugagagcccuagc

SEQ ID NO: 623843 - RNA, 22 nt, Human
ggcaggccccagcaggagcggc

SEQ ID NO: 623844 - RNA, 19 nt, Human
gguacacaaaggaaaaaaa

SEQ ID NO: 623845 - RNA, 24 nt, Human
guccuuggcgugggcaggccccag

SEQ ID NO: 623846 - RNA, 21 nt, Human
uaaacauaagcaauuuagucc

SEQ ID NO: 623847 - RNA, 21 nt, Human
uaacugcugagaaucccaagu

SEQ ID NO: 623848 - RNA, 23 nt, Human
uacccgggcucaagugagaaaac

SEQ ID NO: 623849 - RNA, 18 nt, Human
uacugcacagagcucaac

SEQ ID NO: 623850 - RNA, 24 nt, Human
ucacgcgcugcccaaauucuccca

SEQ ID NO: 623851 - RNA, 25 nt, Human
ucacgcgcugcccaaauucucccuc

SEQ ID NO: 623852 - RNA, 18 nt, Human
ucccaagugagggccaac

SEQ ID NO: 623853 - RNA, 19 nt, Human
ucccacuguggaaacccuc

SEQ ID NO: 623854 - RNA, 21 nt, Human
uccccuaccugagagcccuag

SEQ ID NO: 623855 - RNA, 22 nt, Human
ugagaaucccaagugagggcca

SEQ ID NO: 623856 - RNA, 21 nt, Human
ugaguuccccuuuaaaagcca

SEQ ID NO: 623857 - RNA, 18 nt, Human
uggguacacaaaggaaaa

SEQ ID NO: 623858 - RNA, 18 nt, Human
uuccaacguggcacugua

SEQ ID NO: 623859 - RNA, 18 nt, Human
uuccuguagcguuuucca

SEQ ID NO: 623860 - RNA, 24 nt, Human
aaaaaaaguagagaaaggagccgg

SEQ ID NO: 623861 - RNA, 22 nt, Human
aaaaacagcuggaugcaggagc

SEQ ID NO: 623862 - RNA, 19 nt, Human
aaggacuguacaagcagag

SEQ ID NO: 623863 - RNA, 18 nt, Human
aaguagagaaaggagcug

SEQ ID NO: 623864 - RNA, 20 nt, Human
accuugaaugaugccuagga

SEQ ID NO: 623865 - RNA, 22 nt, Human
agaaacacugugauuagaccac

SEQ ID NO: 623866 - RNA, 18 nt, Human
agaggagcucaaugucgc

SEQ ID NO: 623867 - RNA, 18 nt, Human
agccuuuguccuuguccu

SEQ ID NO: 623868 - RNA, 18 nt, Human
agcuggaugcaggagccc

SEQ ID NO: 623869 - RNA, 21 nt, Human
agugugggagaaaggagcuag

SEQ ID NO: 623870 - RNA, 20 nt, Human
augacguagcagagcugcug

SEQ ID NO: 623871 - RNA, 22 nt, Human
caacuacccccuccccggugcc

SEQ ID NO: 623872 - RNA, 19 nt, Human
cacgaugacguagcagagc

SEQ ID NO: 623873 - RNA, 22 nt, Human
cagggcagaauaaucauccauc

SEQ ID NO: 623874 - RNA, 21 nt, Human
caguguuuggggcacuguguu

SEQ ID NO: 623875 - RNA, 18 nt, Human
cauccaucuacaggucuc

SEQ ID NO: 623876 - RNA, 19 nt, Human
ccccuggguccuacuccau

SEQ ID NO: 623877 - RNA, 23 nt, Human
ccuggcccagugcuaccagggug

SEQ ID NO: 623878 - RNA, 18 nt, Human
cgaugacguagcagagcu

SEQ ID NO: 623879 - RNA, 19 nt, Human
cuaccaggguggugacagc

SEQ ID NO: 623880 - RNA, 19 nt, Human
cuggcccagugcuaccagg

SEQ ID NO: 623881 - RNA, 23 nt, Human
cuuuauucacccuauggcuccca

SEQ ID NO: 623882 - RNA, 21 nt, Human
gaaaagcauucuuccucugga

SEQ ID NO: 623883 - RNA, 19 nt, Human
gaagccuuggccagagacc

SEQ ID NO: 623884 - RNA, 18 nt, Human
gacccuggaagccuuggc

SEQ ID NO: 623885 - RNA, 22 nt, Human
gacuguacaagcagaguacaac

SEQ ID NO: 623886 - RNA, 18 nt, Human
gacuugcggcgcugggcc

SEQ ID NO: 623887 - RNA, 18 nt, Human
gagccccuggguccuacu

SEQ ID NO: 623888 - RNA, 18 nt, Human
gcaauaaaaacagcugga

SEQ ID NO: 623889 - RNA, 21 nt, Human
gcuggaugcaggagcccagug

SEQ ID NO: 623890 - RNA, 29 nt, Human
ggcgcugggccagcuucauggaugcuggg

SEQ ID NO: 623891 - RNA, 23 nt, Human
uaaggggacaauacaccaaauuu

SEQ ID NO: 623892 - RNA, 21 nt, Human
uaccaggguggugacagccuc

SEQ ID NO: 623893 - RNA, 18 nt, Human
ucaccaaacucgacuugc

SEQ ID NO: 623894 - RNA, 23 nt, Human
ucccugcaccagacccuggaagc

SEQ ID NO: 623895 - RNA, 18 nt, Human
ucuguuuccucucccucc

SEQ ID NO: 623896 - RNA, 21 nt, Human
ugaaugaugccuaggauggca

SEQ ID NO: 623897 - RNA, 18 nt, Human
ugacagccucguggacua

SEQ ID NO: 623898 - RNA, 18 nt, Human
ugcaccagacccuggaag

SEQ ID NO: 623899 - RNA, 20 nt, Human
ugcuauuuacagaggacauc

SEQ ID NO: 623900 - RNA, 19 nt, Human
uggcccagugcuaccaggg

SEQ ID NO: 623901 - RNA, 24 nt, Human
uggcucccaagaaaagcauucuuu

SEQ ID NO: 623902 - RNA, 23 nt, Human
uguacaagcagaguacaacuacc

SEQ ID NO: 623903 - RNA, 19 nt, Human
uguccuuguccuggccucc

SEQ ID NO: 623904 - RNA, 20 nt, Human
ugugggagaaaggagcuagu

SEQ ID NO: 623905 - RNA, 20 nt, Human
uucacccuauggcucccaaa

SEQ ID NO: 623906 - RNA, 19 nt, Human
uuuguccuuguccuggccu

SEQ ID NO: 623907 - RNA, 22 nt, Human
uuuuuuuuuuuccacaguuaaa

SEQ ID NO: 623908 - RNA, 24 nt, Human
uuuuuuuuuuuuuuccacaguuaa

SEQ ID NO: 623909 - RNA, 20 nt, Human
uuuuuuuuuuuuuuuuccac

SEQ ID NO: 623910 - RNA, 24 nt, Human
uuuuuuuuuuuuuuuuuuccacag

SEQ ID NO: 623911 - RNA, 25 nt, Human
aagcuccccccacuugcaacccacc

SEQ ID NO: 623912 - RNA, 22 nt, Human
acuuaagccacucuccaacccu

SEQ ID NO: 623913 - RNA, 21 nt, Human
caaaaccccaaagggagcaga

SEQ ID NO: 623914 - RNA, 20 nt, Human
caaacagguggcacuguugc

SEQ ID NO: 623915 - RNA, 19 nt, Human
caaacaucucaggucaaaa

SEQ ID NO: 623916 - RNA, 20 nt, Human
cagagggcccucaugguuca

SEQ ID NO: 623917 - RNA, 18 nt, Human
cagcugcucuguggccug

SEQ ID NO: 623918 - RNA, 24 nt, Human
cagcuuagggaaugcccaucaccu

SEQ ID NO: 623919 - RNA, 23 nt, Human
caggucaaaaccccaaagggagc

SEQ ID NO: 623920 - RNA, 24 nt, Human
ccacuuaagccacucuccaacccu

SEQ ID NO: 623921 - RNA, 23 nt, Human
cccccacuugcaacccaccaccc

SEQ ID NO: 623922 - RNA, 24 nt, Human
cccccacuugcaacccaccacccc

SEQ ID NO: 623923 - RNA, 19 nt, Human
ccccccacuugcaacccac

SEQ ID NO: 623924 - RNA, 19 nt, Human
ccugcagcugcucuguggc

SEQ ID NO: 623925 - RNA, 20 nt, Human
ccugcagcugcucuguggcc

SEQ ID NO: 623926 - RNA, 24 nt, Human
cgagcaaucucccuuuuacuuccu

SEQ ID NO: 623927 - RNA, 21 nt, Human
cgcuccgcucuccucucugca

SEQ ID NO: 623928 - RNA, 21 nt, Human
cuguuggcaaagcucccccca

SEQ ID NO: 623929 - RNA, 20 nt, Human
gaagaugggagggaggaagc

SEQ ID NO: 623930 - RNA, 22 nt, Human
gcaaucucccuuuuacuuccuc

SEQ ID NO: 623931 - RNA, 18 nt, Human
gcacagcccgggugggaa

SEQ ID NO: 623932 - RNA, 18 nt, Human
gccugggcacagcccggg

SEQ ID NO: 623933 - RNA, 21 nt, Human
gggagggaggaagcgggaggg

SEQ ID NO: 623934 - RNA, 22 nt, Human
gggcaauguagacuggcuuggg

SEQ ID NO: 623935 - RNA, 21 nt, Human
guggguccucucccaaggccu

SEQ ID NO: 623936 - RNA, 18 nt, Human
uacaggaggcuguguggg

SEQ ID NO: 623937 - RNA, 19 nt, Human
ucugccuccucccuuuuuc

SEQ ID NO: 623938 - RNA, 21 nt, Human
ucuguggccugggcacagccc

SEQ ID NO: 623939 - RNA, 27 nt, Human
ucuguggccugggcacagccggggucc

SEQ ID NO: 623940 - RNA, 21 nt, Human
ugcucuguggccugggcacag

SEQ ID NO: 623941 - RNA, 18 nt, Human
uggcacuguugccaccua

SEQ ID NO: 623942 - RNA, 24 nt, Human
uguuugggcaauguagacuggcuu

SEQ ID NO: 623943 - RNA, 18 nt, Human
uugcucagcggcagcucc

SEQ ID NO: 623944 - RNA, 18 nt, Human
uuuuuuuuuuuuuuuccg

SEQ ID NO: 623945 - RNA, 21 nt, Human
uuuuuuuuuuuuuuuuuccga

SEQ ID NO: 623946 - RNA, 20 nt, Human
aaacacuuuuguuguuggcu

SEQ ID NO: 623947 - RNA, 23 nt, Human
aaagcaggugaacauauggcccc

SEQ ID NO: 623948 - RNA, 21 nt, Human
aagaaagaaagaaagaaagaa

SEQ ID NO: 623949 - RNA, 21 nt, Human
aagaaagaaagaaagaaagaa

SEQ ID NO: 623950 - RNA, 21 nt, Human
aagaaagaaagaaagaaagaa

SEQ ID NO: 623951 - RNA, 21 nt, Human
aagaaagaaagaaagaaagaa

SEQ ID NO: 623952 - RNA, 21 nt, Human
aagaaagaaagaaagaaagaa

SEQ ID NO: 623953 - RNA, 21 nt, Human
aagaaagaaagaaagaaagaa

SEQ ID NO: 623954 - RNA, 21 nt, Human
aagaaagaaagaaagaaagaa

SEQ ID NO: 623955 - RNA, 21 nt, Human
aagaaagaaagaaagaaagaa

SEQ ID NO: 623956 - RNA, 21 nt, Human
aagaaagaaagaaagaaagaa

SEQ ID NO: 623957 - RNA, 21 nt, Human
aagaaagaaagaaagaaagaa

SEQ ID NO: 623958 - RNA, 23 nt, Human
aagaaagaaagaaagcaagaaag

SEQ ID NO: 623959 - RNA, 20 nt, Human
aagaaagaaagcaagaaaga

SEQ ID NO: 623960 - RNA, 20 nt, Human
aagaaagaaagcaagaaaga

SEQ ID NO: 623961 - RNA, 20 nt, Human
aagaaagaaagcaagaaaga

SEQ ID NO: 623962 - RNA, 20 nt, Human
aagaaagaaagcaagaaaga

SEQ ID NO: 623963 - RNA, 20 nt, Human
aagaaggaagaggagguggg

SEQ ID NO: 623964 - RNA, 23 nt, Human
aagaggaggugggcagaucagaa

SEQ ID NO: 623965 - RNA, 22 nt, Human
aagcaagaaagaaagaaagaaa

SEQ ID NO: 623966 - RNA, 24 nt, Human
aagcaagaaagaaagaaagcaaga

SEQ ID NO: 623967 - RNA, 26 nt, Human
aagcaagaaagaaagaaaggggaccc

SEQ ID NO: 623968 - RNA, 19 nt, Human
aagcaagaaagaaagcaag

SEQ ID NO: 623969 - RNA, 19 nt, Human
aagcaagaaagaaagcaag

SEQ ID NO: 623970 - RNA, 19 nt, Human
acacuuuuguuguuggcua

SEQ ID NO: 623971 - RNA, 21 nt, Human
accagaccucugggugacccc

SEQ ID NO: 623972 - RNA, 22 nt, Human
accccguucccaaacuaucuag

SEQ ID NO: 623973 - RNA, 20 nt, Human
acucugugcccaaacuagca

SEQ ID NO: 623974 - RNA, 20 nt, Human
acucugugcccaaacuagca

SEQ ID NO: 623975 - RNA, 26 nt, Human
agaaagcaagaaagaaagaaagcaag

SEQ ID NO: 623976 - RNA, 22 nt, Human
agaaagcaagaaagaaagcaag

SEQ ID NO: 623977 - RNA, 22 nt, Human
agaaagcaagaaagaaagcaag

SEQ ID NO: 623978 - RNA, 19 nt, Human
agaagaaagaaagcaagaa

SEQ ID NO: 623979 - RNA, 19 nt, Human
agaccucugggugaccccu

SEQ ID NO: 623980 - RNA, 21 nt, Human
agagaaagcccaagacuugga

SEQ ID NO: 623981 - RNA, 20 nt, Human
agagagaagaaagaaagcaa

SEQ ID NO: 623982 - RNA, 19 nt, Human
agagcaagaugaaaccuga

SEQ ID NO: 623983 - RNA, 20 nt, Human
agaucagaaucucucuuccg

SEQ ID NO: 623984 - RNA, 23 nt, Human
agcaagaaagaaagcaagaaaga

SEQ ID NO: 623985 - RNA, 23 nt, Human
agcaagaaagaaagcaagaaaga

SEQ ID NO: 623986 - RNA, 23 nt, Human
agcacuauuuaaaaaaaaaaaaa

SEQ ID NO: 623987 - RNA, 18 nt, Human
agcuaugucacacagugc

SEQ ID NO: 623988 - RNA, 23 nt, Human
agcuguguccccagaugcaggga

SEQ ID NO: 623989 - RNA, 23 nt, Human
aggaaggugaacgcugaagaaaa

SEQ ID NO: 623990 - RNA, 20 nt, Human
aggacacagagcuaccaggg

SEQ ID NO: 623991 - RNA, 18 nt, Human
aggaggugggcagaucag

SEQ ID NO: 623992 - RNA, 23 nt, Human
aguggcucaugccuguaauccca

SEQ ID NO: 623993 - RNA, 24 nt, Human
aguggcucaugccuguaaucccag

SEQ ID NO: 623994 - RNA, 19 nt, Human
augccuguaaucccagcca

SEQ ID NO: 623995 - RNA, 20 nt, Human
caaaagaggccacagcuucc

SEQ ID NO: 623996 - RNA, 23 nt, Human
caagaaagaaagaaagaaagaaa

SEQ ID NO: 623997 - RNA, 22 nt, Human
caaggaaggugaacgcugaaga

SEQ ID NO: 623998 - RNA, 20 nt, Human
cacagaaacccaucaacccc

SEQ ID NO: 623999 - RNA, 23 nt, Human
caccagaccaagauucucccugg

SEQ ID NO: 624000 - RNA, 28 nt, Human
cacugccaggcgcccacugcaagucacc

SEQ ID NO: 624001 - RNA, 18 nt, Human
cagagaaagcccaagacu

SEQ ID NO: 624002 - RNA, 23 nt, Human
cagaucggauccccaagcugaag

SEQ ID NO: 624003 - RNA, 24 nt, Human
cagcaaaaaaaaagcuggcaugga

SEQ ID NO: 624004 - RNA, 18 nt, Human
cagcaggaugaggucuua

SEQ ID NO: 624005 - RNA, 22 nt, Human
cagcuguguccccagaugcagg

SEQ ID NO: 624006 - RNA, 24 nt, Human
cagcuguuuuaagaaagaacuggg

SEQ ID NO: 624007 - RNA, 23 nt, Human
caggcgcccacugcaagucaccc

SEQ ID NO: 624008 - RNA, 20 nt, Human
cagugcuuuaaacacagagg

SEQ ID NO: 624009 - RNA, 21 nt, Human
caguucaggccuggcacaccc

SEQ ID NO: 624010 - RNA, 21 nt, Human
caugccuguaaucccagccaa

SEQ ID NO: 624011 - RNA, 18 nt, Human
ccacacccacugccaggc

SEQ ID NO: 624012 - RNA, 18 nt, Human
ccagggguguggaggggg

SEQ ID NO: 624013 - RNA, 23 nt, Human
cccacagaccagaccuuugagga

SEQ ID NO: 624014 - RNA, 23 nt, Human
cccacauucaaaagaggccacaa

SEQ ID NO: 624015 - RNA, 19 nt, Human
ccccagaaagggccaggcu

SEQ ID NO: 624016 - RNA, 21 nt, Human
cccccuuccccauuuuguccc

SEQ ID NO: 624017 - RNA, 18 nt, Human
ccccugagucuucaguug

SEQ ID NO: 624018 - RNA, 27 nt, Human
cccgccagcauccaccuuccccuccaa

SEQ ID NO: 624019 - RNA, 23 nt, Human
cccguucccaaacuaucuagaaa

SEQ ID NO: 624020 - RNA, 18 nt, Human
cccuccagagaaagccca

SEQ ID NO: 624021 - RNA, 18 nt, Human
cccugggcaucuggaccu

SEQ ID NO: 624022 - RNA, 19 nt, Human
cccuucacagaagcugggg

SEQ ID NO: 624023 - RNA, 21 nt, Human
ccucagaggcccacagaccag

SEQ ID NO: 624024 - RNA, 19 nt, Human
ccucccaggcuggccuccc

SEQ ID NO: 624025 - RNA, 22 nt, Human
ccucugggugaccccugagucu

SEQ ID NO: 624026 - RNA, 22 nt, Human
ccugcauuuuaaccaaagggaa

SEQ ID NO: 624027 - RNA, 18 nt, Human
ccuggccacaccccagag

SEQ ID NO: 624028 - RNA, 19 nt, Human
ccuggccacaccccagagg

SEQ ID NO: 624029 - RNA, 19 nt, Human
ccugucuuggcuagaccug

SEQ ID NO: 624030 - RNA, 23 nt, Human
cggauccccaagcugaagagcuu

SEQ ID NO: 624031 - RNA, 22 nt, Human
cggcagcuguguccccagaugc

SEQ ID NO: 624032 - RNA, 19 nt, Human
cucaugccuguaaucccag

SEQ ID NO: 624033 - RNA, 27 nt, Human
cucauuuccaccugucaguuacagucc

SEQ ID NO: 624034 - RNA, 23 nt, Human
cucucuuccagaucggaucccca

SEQ ID NO: 624035 - RNA, 19 nt, Human
cugccaggcgcccacugca

SEQ ID NO: 624036 - RNA, 24 nt, Human
cugggugaccccugagucuucagu

SEQ ID NO: 624037 - RNA, 24 nt, Human
gaccuguuuucuccucagaggccc

SEQ ID NO: 624038 - RNA, 22 nt, Human
gagaagaaggaagaggaggugg

SEQ ID NO: 624039 - RNA, 24 nt, Human
gaguggggguggggggaaaacacu

SEQ ID NO: 624040 - RNA, 22 nt, Human
gcaaaaaaaaagcuggcaugga

SEQ ID NO: 624041 - RNA, 19 nt, Human
gcaagucacccgccagcau

SEQ ID NO: 624042 - RNA, 20 nt, Human
gccccagaaagggccaggcu

SEQ ID NO: 624043 - RNA, 18 nt, Human
gcuggccucccuggucac

SEQ ID NO: 624044 - RNA, 19 nt, Human
gcugggugcaguggcucau

SEQ ID NO: 624045 - RNA, 19 nt, Human
ggaaccacugccagcaucg

SEQ ID NO: 624046 - RNA, 19 nt, Human
ggccccagaaagggccagg

SEQ ID NO: 624047 - RNA, 21 nt, Human
ggcgcccacugcaagucaccc

SEQ ID NO: 624048 - RNA, 19 nt, Human
ggcuaaaaagccugcauuu

SEQ ID NO: 624049 - RNA, 19 nt, Human
ggcugggugcaguggcuca

SEQ ID NO: 624050 - RNA, 23 nt, Human
ggcugggugcaguggcucaugcc

SEQ ID NO: 624051 - RNA, 21 nt, Human
gggggcauuuccagcaaaaaa

SEQ ID NO: 624052 - RNA, 24 nt, Human
gggugcaguggcucaugccuguaa

SEQ ID NO: 624053 - RNA, 23 nt, Human
ggguguggagggggcauuuccag

SEQ ID NO: 624054 - RNA, 18 nt, Human
guaaaagccagucuugga

SEQ ID NO: 624055 - RNA, 22 nt, Human
uaagaaagaacugggcugggug

SEQ ID NO: 624056 - RNA, 21 nt, Human
uaccagggguguggagggggc

SEQ ID NO: 624057 - RNA, 21 nt, Human
uaggaaccacugccagcaucg

SEQ ID NO: 624058 - RNA, 22 nt, Human
ucaaccccguucccaaacuauc

SEQ ID NO: 624059 - RNA, 18 nt, Human
ucacggcagcuguguccc

SEQ ID NO: 624060 - RNA, 20 nt, Human
ucagcuguuuuaagaaagaa

SEQ ID NO: 624061 - RNA, 19 nt, Human
ucaguuacaguccacaccc

SEQ ID NO: 624062 - RNA, 20 nt, Human
uccacacccacugccaggcg

SEQ ID NO: 624063 - RNA, 24 nt, Human
uccacacccacugccaggcgccca

SEQ ID NO: 624064 - RNA, 22 nt, Human
uccagcaaaaaaaaagcuggca

SEQ ID NO: 624065 - RNA, 25 nt, Human
ucccagccaagacauggccgggguc

SEQ ID NO: 624066 - RNA, 18 nt, Human
ucccucgaaucaaccgga

SEQ ID NO: 624067 - RNA, 22 nt, Human
ucccuggucacggcagcugugu

SEQ ID NO: 624068 - RNA, 19 nt, Human
ucuagaaacccaacagagg

SEQ ID NO: 624069 - RNA, 19 nt, Human
ucuucaguuguuccccaca

SEQ ID NO: 624070 - RNA, 23 nt, Human
ugagucuucaguuguuccccaca

SEQ ID NO: 624071 - RNA, 23 nt, Human
ugcagugaugucucccacacucu

SEQ ID NO: 624072 - RNA, 21 nt, Human
uggcaucacccuggugggcga

SEQ ID NO: 624073 - RNA, 21 nt, Human
uggcucaugccuguaauccca

SEQ ID NO: 624074 - RNA, 22 nt, Human
uggcucaugccuguaaucccag

SEQ ID NO: 624075 - RNA, 21 nt, Human
ugggcgagugggggugggggg

SEQ ID NO: 624076 - RNA, 20 nt, Human
ugggcugggugcaguggcuc

SEQ ID NO: 624077 - RNA, 19 nt, Human
uggggggacagaugcagug

SEQ ID NO: 624078 - RNA, 19 nt, Human
uggggguggggggaaaaca

SEQ ID NO: 624079 - RNA, 24 nt, Human
uggggguggggggaaaacacuuuu

SEQ ID NO: 624080 - RNA, 22 nt, Human
ugucccugucuuggcuagaccu

SEQ ID NO: 624081 - RNA, 22 nt, Human
uucacagaaacccaucaacccc

SEQ ID NO: 624082 - RNA, 21 nt, Human
uuggcuaaaaagccugcauuu

SEQ ID NO: 624083 - RNA, 21 nt, Human
uuuaaaaaaaaaaaaaagaga

SEQ ID NO: 624084 - RNA, 23 nt, Human
uuuaaacacagaggugaaaugaa

SEQ ID NO: 624085 - RNA, 19 nt, Human
uuucacagaaacccaucaa

SEQ ID NO: 624086 - RNA, 22 nt, Human
uuuccuggccacaccccagagg

SEQ ID NO: 624087 - RNA, 19 nt, Human
uuuuaagaaagaacugggc

SEQ ID NO: 624088 - RNA, 18 nt, Human
uuuuuuuuuuuuuuuuug

SEQ ID NO: 624089 - RNA, 24 nt, Human
uuuuuuuuuuuuuuuuugacaaug

SEQ ID NO: 624090 - RNA, 24 nt, Human
aaagaugcuguccaagaaccagga

SEQ ID NO: 624091 - RNA, 24 nt, Human
aaagcugauaaggaccaagaaagu

SEQ ID NO: 624092 - RNA, 25 nt, Human
aaccaggaugcugcuuggcucuuuu

SEQ ID NO: 624093 - RNA, 24 nt, Human
aacugcugcccccuaggagacucc

SEQ ID NO: 624094 - RNA, 23 nt, Human
aaucucucucccuguaagaucuc

SEQ ID NO: 624095 - RNA, 24 nt, Human
acacugcuguccucaggccugaac

SEQ ID NO: 624096 - RNA, 18 nt, Human
accaggaugcugcuuggc

SEQ ID NO: 624097 - RNA, 21 nt, Human
accauccuggcagcccagagc

SEQ ID NO: 624098 - RNA, 21 nt, Human
acccaaucucucucccuguaa

SEQ ID NO: 624099 - RNA, 23 nt, Human
agaaagaggcaaauugcacccaa

SEQ ID NO: 624100 - RNA, 18 nt, Human
agaaucccaccaucaccc

SEQ ID NO: 624101 - RNA, 20 nt, Human
agacccuggccaucacccau

SEQ ID NO: 624102 - RNA, 23 nt, Human
agagcaaccaaucugaaaacaga

SEQ ID NO: 624103 - RNA, 21 nt, Human
agcagacccuggccaucaccc

SEQ ID NO: 624104 - RNA, 21 nt, Human
agccacaggccccuuggggcc

SEQ ID NO: 624105 - RNA, 20 nt, Human
aggcagggucagccucugug

SEQ ID NO: 624106 - RNA, 23 nt, Human
agugaagaggggaggcaggguca

SEQ ID NO: 624107 - RNA, 25 nt, Human
aucguugcccuucacagagugucca

SEQ ID NO: 624108 - RNA, 24 nt, Human
caaguaaaaugcccccucacccca

SEQ ID NO: 624109 - RNA, 22 nt, Human
caccauccuggcagcccagagc

SEQ ID NO: 624110 - RNA, 22 nt, Human
cacccaaucucucucccuguaa

SEQ ID NO: 624111 - RNA, 21 nt, Human
caccccagccuuccuuuccag

SEQ ID NO: 624112 - RNA, 19 nt, Human
cagaacagggacugacaug

SEQ ID NO: 624113 - RNA, 19 nt, Human
cauaguuggagagcucugg

SEQ ID NO: 624114 - RNA, 21 nt, Human
caucugguuuugacaucaguu

SEQ ID NO: 624115 - RNA, 18 nt, Human
ccaagaaccaggaugcug

SEQ ID NO: 624116 - RNA, 18 nt, Human
ccaaucugaaaacagaau

SEQ ID NO: 624117 - RNA, 18 nt, Human
ccaauuugggagaacugg

SEQ ID NO: 624118 - RNA, 19 nt, Human
ccacuguguugcuggugug

SEQ ID NO: 624119 - RNA, 18 nt, Human
ccccuaggagacuccagg

SEQ ID NO: 624120 - RNA, 30 nt, Human
ccccucaccccagccuuccuuuccagagcc

SEQ ID NO: 624121 - RNA, 22 nt, Human
cccuuugagcaauuaaccccag

SEQ ID NO: 624122 - RNA, 23 nt, Human
ccuacagucagagcagcucuuac

SEQ ID NO: 624123 - RNA, 21 nt, Human
ccucccagaacagggacugac

SEQ ID NO: 624124 - RNA, 19 nt, Human
ccuggagcuggaagggggg

SEQ ID NO: 624125 - RNA, 25 nt, Human
cuccagggggcaggcauugcuuccu

SEQ ID NO: 624126 - RNA, 24 nt, Human
cucugaacugcagccacaggcccc

SEQ ID NO: 624127 - RNA, 24 nt, Human
cugcagccacaggccccuuggggc

SEQ ID NO: 624128 - RNA, 22 nt, Human
cugguguggggaggcgaggcuc

SEQ ID NO: 624129 - RNA, 19 nt, Human
cuuggcucuuuucuuucuc

SEQ ID NO: 624130 - RNA, 20 nt, Human
cuuuugccuggagcuggaag

SEQ ID NO: 624131 - RNA, 24 nt, Human
gaacugcagccacaggccccuugg

SEQ ID NO: 624132 - RNA, 25 nt, Human
gaaucccaccaucaccccucucgug

SEQ ID NO: 624133 - RNA, 21 nt, Human
gaccacuguguugcuggugug

SEQ ID NO: 624134 - RNA, 24 nt, Human
gacuccagggggcaggcauugcuu

SEQ ID NO: 624135 - RNA, 19 nt, Human
gagcaaccaaucugaaaac

SEQ ID NO: 624136 - RNA, 20 nt, Human
gcccccucaccccagccuuc

SEQ ID NO: 624137 - RNA, 20 nt, Human
gcccuacagucagagcagcu

SEQ ID NO: 624138 - RNA, 19 nt, Human
gcugcaccuccaaacacug

SEQ ID NO: 624139 - RNA, 24 nt, Human
ggcagcccagagcugcuucugggu

SEQ ID NO: 624140 - RNA, 23 nt, Human
ggcagggucagccucugugcaag

SEQ ID NO: 624141 - RNA, 22 nt, Human
ggccaucacccaucuuuucaga

SEQ ID NO: 624142 - RNA, 19 nt, Human
ggccugaacucaccaugga

SEQ ID NO: 624143 - RNA, 25 nt, Human
ggccugaacucaccauggaaaccca

SEQ ID NO: 624144 - RNA, 21 nt, Human
gggccaggacucaugcccuuu

SEQ ID NO: 624145 - RNA, 20 nt, Human
guaaaaugcccccucacccc

SEQ ID NO: 624146 - RNA, 21 nt, Human
gucauuaauaaauauuaaagc

SEQ ID NO: 624147 - RNA, 18 nt, Human
uaaaaugcccccucaccc

SEQ ID NO: 624148 - RNA, 21 nt, Human
uaaaaugcccccucaccccag

SEQ ID NO: 624149 - RNA, 21 nt, Human
uacccaaaguggugagcguca

SEQ ID NO: 624150 - RNA, 19 nt, Human
uaccuacauaacccuggcu

SEQ ID NO: 624151 - RNA, 22 nt, Human
uagaaucccaccaucaccccuc

SEQ ID NO: 624152 - RNA, 24 nt, Human
uccaccauccuggcagcccagagc

SEQ ID NO: 624153 - RNA, 21 nt, Human
ucccuagaagaggaguuugaa

SEQ ID NO: 624154 - RNA, 19 nt, Human
ucgccaguuuccuuucuca

SEQ ID NO: 624155 - RNA, 25 nt, Human
ucucaagggccaugugguuuugcag

SEQ ID NO: 624156 - RNA, 18 nt, Human
ucucucccuguaagaucu

SEQ ID NO: 624157 - RNA, 21 nt, Human
ucucuggcaggaucguugccc

SEQ ID NO: 624158 - RNA, 19 nt, Human
ucucugguauuccauccac

SEQ ID NO: 624159 - RNA, 27 nt, Human
ucuggguuaggacaacaaauagggggc

SEQ ID NO: 624160 - RNA, 21 nt, Human
ucuguugauguuagaauccca

SEQ ID NO: 624161 - RNA, 22 nt, Human
ugagggugagcaaagagcuuuu

SEQ ID NO: 624162 - RNA, 23 nt, Human
ugagugugggaggcccaaugucu

SEQ ID NO: 624163 - RNA, 20 nt, Human
ugauaaggaccaagaaagug

SEQ ID NO: 624164 - RNA, 22 nt, Human
ugccuggagcuggaaggggggc

SEQ ID NO: 624165 - RNA, 19 nt, Human
uggagauggggucagugaa

SEQ ID NO: 624166 - RNA, 18 nt, Human
uggcagcccagagcugcu

SEQ ID NO: 624167 - RNA, 20 nt, Human
ugggucauaguuggagagcu

SEQ ID NO: 624168 - RNA, 21 nt, Human
uggucaguucuaccuacaugu

SEQ ID NO: 624169 - RNA, 18 nt, Human
uuggagauggggucagug

SEQ ID NO: 624170 - RNA, 23 nt, Human
uuggggcugguguuguaccucug

SEQ ID NO: 624171 - RNA, 21 nt, Human
uuucucaagggccaugugguu

SEQ ID NO: 624172 - RNA, 21 nt, Human
uuugugaacacugggcccuuu

SEQ ID NO: 624173 - RNA, 24 nt, Human
aaagugcugggauuacaggcguga

SEQ ID NO: 624174 - RNA, 18 nt, Human
aaguagcuggauuauggg

SEQ ID NO: 624175 - RNA, 19 nt, Human
aagugcugggauuacaggc

SEQ ID NO: 624176 - RNA, 19 nt, Human
aagugcugggauuacaggc

SEQ ID NO: 624177 - RNA, 26 nt, Human
aagugcugggauuacaggcgugagcc

SEQ ID NO: 624178 - RNA, 19 nt, Human
aauuuccaguguuucccuu

SEQ ID NO: 624179 - RNA, 20 nt, Human
acgccugcugcaguacugcg

SEQ ID NO: 624180 - RNA, 18 nt, Human
acuauguuggccaggcug

SEQ ID NO: 624181 - RNA, 24 nt, Human
acucugucgcccaggcuggagugc

SEQ ID NO: 624182 - RNA, 25 nt, Human
acucuguugcccaggcuggagugca

SEQ ID NO: 624183 - RNA, 21 nt, Human
acugcaaccucugccucccag

SEQ ID NO: 624184 - RNA, 21 nt, Human
acugcaaccucugccucccag

SEQ ID NO: 624185 - RNA, 22 nt, Human
acugcaaccucugccucccagg

SEQ ID NO: 624186 - RNA, 20 nt, Human
agcuccugggacuagcgcuc

SEQ ID NO: 624187 - RNA, 22 nt, Human
aggaagcugugguggaggcuug

SEQ ID NO: 624188 - RNA, 22 nt, Human
aggcgugagccacugugcccgg

SEQ ID NO: 624189 - RNA, 25 nt, Human
aggcuggagugcaguggcgcaaucu

SEQ ID NO: 624190 - RNA, 24 nt, Human
aggugauccgcccaccucggccuc

SEQ ID NO: 624191 - RNA, 23 nt, Human
agugcaguggcgcaaucuuggcu

SEQ ID NO: 624192 - RNA, 24 nt, Human
agugcaguggcgcaaucuuggcuu

SEQ ID NO: 624193 - RNA, 18 nt, Human
agugcugggauuacaggc

SEQ ID NO: 624194 - RNA, 19 nt, Human
aguggcagcaguuggggca

SEQ ID NO: 624195 - RNA, 24 nt, Human
auuuuuguauuuuuaguagaggcg

SEQ ID NO: 624196 - RNA, 24 nt, Human
caaagugcugggauuacaggcgug

SEQ ID NO: 624197 - RNA, 23 nt, Human
caauuuuuguauuuuuaguagag

SEQ ID NO: 624198 - RNA, 24 nt, Human
caauuuuuguauuuuuaguagagg

SEQ ID NO: 624199 - RNA, 24 nt, Human
cacacccgacagcccggcucgcgc

SEQ ID NO: 624200 - RNA, 24 nt, Human
caccucggccucccaaagugcugg

SEQ ID NO: 624201 - RNA, 21 nt, Human
cacuauguuggccaggcuggu

SEQ ID NO: 624202 - RNA, 22 nt, Human
cacuauguuggccaggcugguc

SEQ ID NO: 624203 - RNA, 24 nt, Human
cacucugucgcccaggcuggagug

SEQ ID NO: 624204 - RNA, 24 nt, Human
cacucuguugcccaggcuggagug

SEQ ID NO: 624205 - RNA, 20 nt, Human
cacucuuauugggucaggag

SEQ ID NO: 624206 - RNA, 18 nt, Human
cagaacacacccgacagc

SEQ ID NO: 624207 - RNA, 24 nt, Human
cagagucucacucuguugcccagg

SEQ ID NO: 624208 - RNA, 24 nt, Human
cagcagcaccuucuccucaggccc

SEQ ID NO: 624209 - RNA, 25 nt, Human
cagcaguuggggcagcaacccuggu

SEQ ID NO: 624210 - RNA, 22 nt, Human
caggcaauucuccugcuucagc

SEQ ID NO: 624211 - RNA, 22 nt, Human
ccaaagugcugggauuacaggc

SEQ ID NO: 624212 - RNA, 22 nt, Human
ccaaagugcugggauuacaggc

SEQ ID NO: 624213 - RNA, 24 nt, Human
ccaaagugcugggauuacaggcgu

SEQ ID NO: 624214 - RNA, 21 nt, Human
ccacauggcagcccauuuaga

SEQ ID NO: 624215 - RNA, 18 nt, Human
ccaccugaagucaugucc

SEQ ID NO: 624216 - RNA, 22 nt, Human
ccacggguacggccuccccaag

SEQ ID NO: 624217 - RNA, 21 nt, Human
cccaaguacuccaauuguucu

SEQ ID NO: 624218 - RNA, 18 nt, Human
cccaaguagcuggauuau

SEQ ID NO: 624219 - RNA, 23 nt, Human
cccaaguagcuggauuaugggug

SEQ ID NO: 624220 - RNA, 19 nt, Human
cccaggcuggagugcagug

SEQ ID NO: 624221 - RNA, 23 nt, Human
cccagguucaggcaauucuccug

SEQ ID NO: 624222 - RNA, 22 nt, Human
ccccugcauuccacucuagaca

SEQ ID NO: 624223 - RNA, 23 nt, Human
ccucccagggcaggacucucagu

SEQ ID NO: 624224 - RNA, 24 nt, Human
ccucccagguucaggcaauucucc

SEQ ID NO: 624225 - RNA, 19 nt, Human
ccugggacuagcgcucugg

SEQ ID NO: 624226 - RNA, 23 nt, Human
cgggguuucacuauguuggccag

SEQ ID NO: 624227 - RNA, 24 nt, Human
cgggguuucacuauguuggccagg

SEQ ID NO: 624228 - RNA, 24 nt, Human
cucacucugucgcccaggcuggag

SEQ ID NO: 624229 - RNA, 24 nt, Human
cucacucuguugcccaggcuggag

SEQ ID NO: 624230 - RNA, 23 nt, Human
cugaccucaggugauccgcccac

SEQ ID NO: 624231 - RNA, 23 nt, Human
cugcaaccucugccucccagguu

SEQ ID NO: 624232 - RNA, 24 nt, Human
cugcaaccucugccucccagguuc

SEQ ID NO: 624233 - RNA, 18 nt, Human
cugcugcaguacugcgga

SEQ ID NO: 624234 - RNA, 23 nt, Human
cugcuucagccucccaaguagcu

SEQ ID NO: 624235 - RNA, 19 nt, Human
cuggagcaggucuauuacc

SEQ ID NO: 624236 - RNA, 21 nt, Human
cuggagcaggucuauuaccug

SEQ ID NO: 624237 - RNA, 19 nt, Human
cuguugcccaggcuggagu

SEQ ID NO: 624238 - RNA, 21 nt, Human
gaaaacgugggcugguccaug

SEQ ID NO: 624239 - RNA, 18 nt, Human
gaagucaugucccaaccg

SEQ ID NO: 624240 - RNA, 24 nt, Human
gaccucaggugauccgcccaccuc

SEQ ID NO: 624241 - RNA, 18 nt, Human
gacucugggccaagacuc

SEQ ID NO: 624242 - RNA, 24 nt, Human
gagcaggucuauuaccugaagucu

SEQ ID NO: 624243 - RNA, 21 nt, Human
gagcuccugggacuagcgcuc

SEQ ID NO: 624244 - RNA, 24 nt, Human
gaggcgggguuucacuauguuggc

SEQ ID NO: 624245 - RNA, 22 nt, Human
gaggcuugggagugguuccaga

SEQ ID NO: 624246 - RNA, 21 nt, Human
gaguggcagcaguuggggcag

SEQ ID NO: 624247 - RNA, 18 nt, Human
gauuacaggcgugagcca

SEQ ID NO: 624248 - RNA, 21 nt, Human
gauuacaggcgugagccacug

SEQ ID NO: 624249 - RNA, 24 nt, Human
gauuacaggcgugagccacugugc

SEQ ID NO: 624250 - RNA, 24 nt, Human
gauuaugggugcgcaucaccaugc

SEQ ID NO: 624251 - RNA, 19 nt, Human
gcccaggcuggagugcagu

SEQ ID NO: 624252 - RNA, 19 nt, Human
gcccggucccuuuguucuu

SEQ ID NO: 624253 - RNA, 18 nt, Human
gcgggguuucacuauguu

SEQ ID NO: 624254 - RNA, 23 nt, Human
gcgggguuucacuauguuggcca

SEQ ID NO: 624255 - RNA, 19 nt, Human
gcuggagugcaguggcgca

SEQ ID NO: 624256 - RNA, 22 nt, Human
gcuggagugcaguguugaccug

SEQ ID NO: 624257 - RNA, 19 nt, Human
gcugggcuugguccucugu

SEQ ID NO: 624258 - RNA, 21 nt, Human
gcuuacugcaaccucugccuc

SEQ ID NO: 624259 - RNA, 23 nt, Human
gggcagcaacccugguccacggg

SEQ ID NO: 624260 - RNA, 23 nt, Human
gggguuucacuauguuggccagg

SEQ ID NO: 624261 - RNA, 24 nt, Human
gugauccgcccaccucggccuccc

SEQ ID NO: 624262 - RNA, 18 nt, Human
gugguggaggcuugggag

SEQ ID NO: 624263 - RNA, 19 nt, Human
gugguggaggcuugggagu

SEQ ID NO: 624264 - RNA, 26 nt, Human
guuuuucuuuuuucuuuuuuugaaau

SEQ ID NO: 624265 - RNA, 18 nt, Human
uacaaugcucuggggguc

SEQ ID NO: 624266 - RNA, 23 nt, Human
uacaggcgugagccacugugccc

SEQ ID NO: 624267 - RNA, 23 nt, Human
uacaggcgugagccacugugccc

SEQ ID NO: 624268 - RNA, 21 nt, Human
uacugcaaccucugccuccca

SEQ ID NO: 624269 - RNA, 23 nt, Human
uacugcaaccucugccucccagg

SEQ ID NO: 624270 - RNA, 24 nt, Human
uaguagaggcgggguuucacuaug

SEQ ID NO: 624271 - RNA, 22 nt, Human
uauguuggccaggcuggucugg

SEQ ID NO: 624272 - RNA, 23 nt, Human
uauguuggccaggcuggucugga

SEQ ID NO: 624273 - RNA, 24 nt, Human
uauguuggccaggcuggucuggaa

SEQ ID NO: 624274 - RNA, 22 nt, Human
ucacuauguuggccaggcuggu

SEQ ID NO: 624275 - RNA, 24 nt, Human
ucacucugucgcccaggcuggagu

SEQ ID NO: 624276 - RNA, 20 nt, Human
ucagccucccaaguagcugg

SEQ ID NO: 624277 - RNA, 21 nt, Human
uccacggguacggccucccca

SEQ ID NO: 624278 - RNA, 21 nt, Human
uccagaagagaaguuugagaa

SEQ ID NO: 624279 - RNA, 24 nt, Human
ucccaaagugcugggauuacaggc

SEQ ID NO: 624280 - RNA, 22 nt, Human
ucccaaguagcuggauuauggg

SEQ ID NO: 624281 - RNA, 21 nt, Human
ucccagguucaggcaauucuc

SEQ ID NO: 624282 - RNA, 24 nt, Human
ucccagguucaggcaauucuccug

SEQ ID NO: 624283 - RNA, 24 nt, Human
ucgcccaggcuggagugcaguguu

SEQ ID NO: 624284 - RNA, 18 nt, Human
ucggccucccaaagugcu

SEQ ID NO: 624285 - RNA, 23 nt, Human
ucucacucugucgcccaggcugg

SEQ ID NO: 624286 - RNA, 24 nt, Human
ucucacucugucgcccaggcugga

SEQ ID NO: 624287 - RNA, 26 nt, Human
ucucacucugucgcccaggcuggagu

SEQ ID NO: 624288 - RNA, 27 nt, Human
ucucacucugucgcccaggcuggagug

SEQ ID NO: 624289 - RNA, 23 nt, Human
ucucacucuguugcccaggcugg

SEQ ID NO: 624290 - RNA, 24 nt, Human
ucucacucuguugcccaggcugga

SEQ ID NO: 624291 - RNA, 26 nt, Human
ucucacucuguugcccaggcuggagu

SEQ ID NO: 624292 - RNA, 27 nt, Human
ucucacucuguugcccaggcuggagug

SEQ ID NO: 624293 - RNA, 24 nt, Human
ucugucgcccaggcuggagugcag

SEQ ID NO: 624294 - RNA, 18 nt, Human
ucuguugcccaggcugga

SEQ ID NO: 624295 - RNA, 24 nt, Human
ucuguugcccaggcuggagugcag

SEQ ID NO: 624296 - RNA, 22 nt, Human
ugaagcagagucucacucuguu

SEQ ID NO: 624297 - RNA, 18 nt, Human
ugaccucaggugauccgc

SEQ ID NO: 624298 - RNA, 21 nt, Human
ugaccucaggugauccgccca

SEQ ID NO: 624299 - RNA, 24 nt, Human
ugaccucaggugauccgcccaccu

SEQ ID NO: 624300 - RNA, 18 nt, Human
ugaccugaauagacgacg

SEQ ID NO: 624301 - RNA, 25 nt, Human
ugagaaggcacagagccacauggca

SEQ ID NO: 624302 - RNA, 18 nt, Human
ugagacagagucucacuc

SEQ ID NO: 624303 - RNA, 22 nt, Human
ugagacagagucucacucuguc

SEQ ID NO: 624304 - RNA, 18 nt, Human
ugaguggcagcaguuggg

SEQ ID NO: 624305 - RNA, 24 nt, Human
ugauccgcccaccucggccuccca

SEQ ID NO: 624306 - RNA, 18 nt, Human
ugcagcacuacacacaua

SEQ ID NO: 624307 - RNA, 18 nt, Human
ugcccaggcuggagugca

SEQ ID NO: 624308 - RNA, 21 nt, Human
ugcccaggcuggagugcagug

SEQ ID NO: 624309 - RNA, 22 nt, Human
ugcccaggcuggagugcagugg

SEQ ID NO: 624310 - RNA, 24 nt, Human
ugcccaggcuggagugcaguggcg

SEQ ID NO: 624311 - RNA, 24 nt, Human
ugccugggcaauuuuuguauuuuu

SEQ ID NO: 624312 - RNA, 22 nt, Human
ugcucaacuugaaguuaaccag

SEQ ID NO: 624313 - RNA, 18 nt, Human
ugcucugggggucuggcu

SEQ ID NO: 624314 - RNA, 25 nt, Human
ugcucugggggucuggcuggccggg

SEQ ID NO: 624315 - RNA, 24 nt, Human
ugcugggauuacaggcgugagcca

SEQ ID NO: 624316 - RNA, 24 nt, Human
ugcuucagccucccaaguagcugg

SEQ ID NO: 624317 - RNA, 23 nt, Human
uggagugcaguggcgcaaucuug

SEQ ID NO: 624318 - RNA, 24 nt, Human
uggagugcaguggcgcaaucuugg

SEQ ID NO: 624319 - RNA, 19 nt, Human
uggagugcaguguugaccu

SEQ ID NO: 624320 - RNA, 20 nt, Human
uggagugcaguguugaccug

SEQ ID NO: 624321 - RNA, 21 nt, Human
uggccaggcuggucuggaacu

SEQ ID NO: 624322 - RNA, 23 nt, Human
uggcugaagagaggccacagcug

SEQ ID NO: 624323 - RNA, 24 nt, Human
uggcugaagagaggccacagcugc

SEQ ID NO: 624324 - RNA, 18 nt, Human
ugggauuacaggcgugag

SEQ ID NO: 624325 - RNA, 21 nt, Human
ugggauuacaggcgugagcca

SEQ ID NO: 624326 - RNA, 22 nt, Human
ugggauuacaggcgugagccac

SEQ ID NO: 624327 - RNA, 22 nt, Human
ugggauuacaggcgugagccac

SEQ ID NO: 624328 - RNA, 22 nt, Human
ugggauuacaggcgugagccac

SEQ ID NO: 624329 - RNA, 24 nt, Human
ugggauuacaggcgugagccacug

SEQ ID NO: 624330 - RNA, 26 nt, Human
ugggauuacaggcgugagccacugug

SEQ ID NO: 624331 - RNA, 18 nt, Human
ugggcuugguccucugug

SEQ ID NO: 624332 - RNA, 21 nt, Human
uggggcagcaacccuggucca

SEQ ID NO: 624333 - RNA, 19 nt, Human
uuacugcaaccucugccuc

SEQ ID NO: 624334 - RNA, 24 nt, Human
uuacugcaaccucugccucccagg

SEQ ID NO: 624335 - RNA, 18 nt, Human
uuaguagaggcgggguuu

SEQ ID NO: 624336 - RNA, 21 nt, Human
uuaguagaggcgggguuucac

SEQ ID NO: 624337 - RNA, 21 nt, Human
uuaguagaggcgggguuucac

SEQ ID NO: 624338 - RNA, 24 nt, Human
uuaguagaggcgggguuucacuau

SEQ ID NO: 624339 - RNA, 20 nt, Human
uugauggcaugccccugcau

SEQ ID NO: 624340 - RNA, 22 nt, Human
uugauggcaugccccugcauuc

SEQ ID NO: 624341 - RNA, 24 nt, Human
uugcccaggcuggagugcaguggc

SEQ ID NO: 624342 - RNA, 23 nt, Human
uuguauuuuuaguagaggcgggg

SEQ ID NO: 624343 - RNA, 23 nt, Human
uuucacuauguuggccaggcugu

SEQ ID NO: 624344 - RNA, 20 nt, Human
uuucuuuuuuugagacagag

SEQ ID NO: 624345 - RNA, 26 nt, Human
uuuguucuuucuucuaagcaugguuu

SEQ ID NO: 624346 - RNA, 26 nt, Human
uuuucuuuuuuugagacagagucuca

SEQ ID NO: 624347 - RNA, 24 nt, Human
uuuuuaguagaggcgggguuucac

SEQ ID NO: 624348 - RNA, 20 nt, Human
uuuuuguauuuuuaguagag

SEQ ID NO: 624349 - RNA, 18 nt, Human
uuuuuuuuugaagcagag

SEQ ID NO: 624350 - RNA, 20 nt, Human
uuuuuuuuuuugaagcagag

SEQ ID NO: 624351 - RNA, 26 nt, Human
uuuuuuuuuuuugaagcagagucuca

SEQ ID NO: 624352 - RNA, 23 nt, Human
aaaaaggaucuuuuaaauuuggu

SEQ ID NO: 624353 - RNA, 24 nt, Human
aaagaaaaaaaaaauuauacaaaa

SEQ ID NO: 624354 - RNA, 18 nt, Human
aaccuaucuuucucuucc

SEQ ID NO: 624355 - RNA, 20 nt, Human
aaccuaucuuucucuucccc

SEQ ID NO: 624356 - RNA, 21 nt, Human
agauggagaccguggguaggg

SEQ ID NO: 624357 - RNA, 23 nt, Human
caaaaugugcaaauucagagguu

SEQ ID NO: 624358 - RNA, 19 nt, Human
caacacugcucaaagaaaa

SEQ ID NO: 624359 - RNA, 22 nt, Human
cagcaaacuuaugguuugcauu

SEQ ID NO: 624360 - RNA, 19 nt, Human
caucccauugcuuuuaaga

SEQ ID NO: 624361 - RNA, 24 nt, Human
ccaaucccagcaucggcuauuaac

SEQ ID NO: 624362 - RNA, 19 nt, Human
ccccgagauuagcugcaaa

SEQ ID NO: 624363 - RNA, 19 nt, Human
gaccggacaauugacuucu

SEQ ID NO: 624364 - RNA, 21 nt, Human
gagcacauauauuacaaauaa

SEQ ID NO: 624365 - RNA, 22 nt, Human
gcugcaaauucagaaaguucuc

SEQ ID NO: 624366 - RNA, 23 nt, Human
guauuaacuaaaaaggaucuuuu

SEQ ID NO: 624367 - RNA, 23 nt, Human
guugaaaccgagagccuccaauc

SEQ ID NO: 624368 - RNA, 20 nt, Human
uaaaaaggaucuuuuaaauu

SEQ ID NO: 624369 - RNA, 23 nt, Human
uaaacaaaaauauuaacaccaug

SEQ ID NO: 624370 - RNA, 23 nt, Human
uaacaccaugaaaacuucaaaua

SEQ ID NO: 624371 - RNA, 22 nt, Human
uacaucugaaauaugcuuaaau

SEQ ID NO: 624372 - RNA, 22 nt, Human
ucugaugcugcagagcccucag

SEQ ID NO: 624373 - RNA, 20 nt, Human
ugaucaacacugcucaaaga

SEQ ID NO: 624374 - RNA, 21 nt, Human
ugcuuaaauguuacaaaaaca

SEQ ID NO: 624375 - RNA, 24 nt, Human
uggagaccguggguagggccggag

SEQ ID NO: 624376 - RNA, 18 nt, Human
uggcaaaauucugaagcu

SEQ ID NO: 624377 - RNA, 23 nt, Human
uggcaaaauucugaagcuagcga

SEQ ID NO: 624378 - RNA, 26 nt, Human
uguacacauacacaaauauuuuaaua

SEQ ID NO: 624379 - RNA, 24 nt, Human
uguuacaaaaacauucacuuuaac

SEQ ID NO: 624380 - RNA, 22 nt, Human
uuaaauguuacaaaaacauuca

SEQ ID NO: 624381 - RNA, 18 nt, Human
uuggcaaaauucugaagc

SEQ ID NO: 624382 - RNA, 18 nt, Human
uuggcgaaauuauuggua

SEQ ID NO: 624383 - RNA, 22 nt, Human
uuuuuuuuuuuuuugcaaagua

SEQ ID NO: 624384 - RNA, 19 nt, Human
uuuuuuuuuuuuuuuuugc

SEQ ID NO: 624385 - RNA, 21 nt, Human
uuuuuuuuuuuuuuuuugcaa

SEQ ID NO: 624386 - RNA, 27 nt, Human
uuuuuuuuuuuuuuuuuuuuuuugggg

SEQ ID NO: 624387 - RNA, 21 nt, Human
aaccaagaacauuggaauaag

SEQ ID NO: 624388 - RNA, 20 nt, Human
aguuauauaaagaaaaacca

SEQ ID NO: 624389 - RNA, 18 nt, Human
auaaagaaaaaccaagaa

SEQ ID NO: 624390 - RNA, 22 nt, Human
caaaggagccagucuuaguccg

SEQ ID NO: 624391 - RNA, 19 nt, Human
cccccaucuugucauguuc

SEQ ID NO: 624392 - RNA, 23 nt, Human
cucagcaccugggcauuggcaga

SEQ ID NO: 624393 - RNA, 22 nt, Human
cuccccuagccaccaacaguuu

SEQ ID NO: 624394 - RNA, 21 nt, Human
cuuggauggaaucugccccuc

SEQ ID NO: 624395 - RNA, 19 nt, Human
gcaagugcaagccugucau

SEQ ID NO: 624396 - RNA, 18 nt, Human
ggcuugcaagucccgcug

SEQ ID NO: 624397 - RNA, 20 nt, Human
uaaagaaaaaccaagaacau

SEQ ID NO: 624398 - RNA, 21 nt, Human
uaaauugcaaaaagaauggaa

SEQ ID NO: 624399 - RNA, 19 nt, Human
uagccucaucagagggcac

SEQ ID NO: 624400 - RNA, 20 nt, Human
ucgcucagcaccugggcauu

SEQ ID NO: 624401 - RNA, 21 nt, Human
ucucccagagcugcccagcuu

SEQ ID NO: 624402 - RNA, 20 nt, Human
ucugccccuccuuuucacuc

SEQ ID NO: 624403 - RNA, 18 nt, Human
ugacccaggcuggccauc

SEQ ID NO: 624404 - RNA, 20 nt, Human
uggcagagagugucagcugg

SEQ ID NO: 624405 - RNA, 18 nt, Human
uggcuugcaagucccgcu

SEQ ID NO: 624406 - RNA, 22 nt, Human
ugucugacacuccucucuccca

SEQ ID NO: 624407 - RNA, 21 nt, Human
ugucugcuccccuagccacca

SEQ ID NO: 624408 - RNA, 20 nt, Human
aaaaggugugaaaaccagca

SEQ ID NO: 624409 - RNA, 21 nt, Human
aaacaccccucucacauuccu

SEQ ID NO: 624410 - RNA, 22 nt, Human
aaacagaaggcaugaacgagag

SEQ ID NO: 624411 - RNA, 24 nt, Human
aaacagggaaaaacacaaaccaag

SEQ ID NO: 624412 - RNA, 20 nt, Human
aaacauggccaccaaacccc

SEQ ID NO: 624413 - RNA, 21 nt, Human
aaacugaaaccaccauaagaa

SEQ ID NO: 624414 - RNA, 21 nt, Human
aacaccccucucacauuccua

SEQ ID NO: 624415 - RNA, 24 nt, Human
aagugaccagggugaugaucagca

SEQ ID NO: 624416 - RNA, 20 nt, Human
acagggaaaaacacaaacca

SEQ ID NO: 624417 - RNA, 29 nt, Human
acagggaaaaacacaaaccaagaugacac

SEQ ID NO: 624418 - RNA, 22 nt, Human
accagccucacucccagaaacc

SEQ ID NO: 624419 - RNA, 24 nt, Human
accaggcagcaggaacccugugag

SEQ ID NO: 624420 - RNA, 20 nt, Human
acccgcuuuggccuucaccu

SEQ ID NO: 624421 - RNA, 25 nt, Human
agcaagacaccaggcagcaggaacc

SEQ ID NO: 624422 - RNA, 18 nt, Human
aggaaaaaauagaaaaga

SEQ ID NO: 624423 - RNA, 23 nt, Human
aggaaaaaauagaaaagagggac

SEQ ID NO: 624424 - RNA, 21 nt, Human
aggcaaacgggcaaggcagac

SEQ ID NO: 624425 - RNA, 21 nt, Human
aggcagcaaacaugggccaaa

SEQ ID NO: 624426 - RNA, 22 nt, Human
aggcagcaaacaugggccaaaa

SEQ ID NO: 624427 - RNA, 24 nt, Human
aggcagcaaacaugggccaaaacg

SEQ ID NO: 624428 - RNA, 22 nt, Human
aggcgcuggaggaugaagggcu

SEQ ID NO: 624429 - RNA, 21 nt, Human
agggacaagagcaaaacagaa

SEQ ID NO: 624430 - RNA, 20 nt, Human
aucugugugcucucuuccuu

SEQ ID NO: 624431 - RNA, 21 nt, Human
augcccaccuccuccccucug

SEQ ID NO: 624432 - RNA, 19 nt, Human
caaaacagaaggcaugaac

SEQ ID NO: 624433 - RNA, 22 nt, Human
caacucuucuaccagccucacu

SEQ ID NO: 624434 - RNA, 19 nt, Human
caccagaaccucaaugaug

SEQ ID NO: 624435 - RNA, 18 nt, Human
cagaccagauagaggcag

SEQ ID NO: 624436 - RNA, 19 nt, Human
cagcaaacaugggccaaaa

SEQ ID NO: 624437 - RNA, 20 nt, Human
cagcagcggcaaacaaggag

SEQ ID NO: 624438 - RNA, 24 nt, Human
cagcaugaagugaccagggugaug

SEQ ID NO: 624439 - RNA, 22 nt, Human
caggccagcacgccaccuucuc

SEQ ID NO: 624440 - RNA, 20 nt, Human
cauccuagaaaagcagggcc

SEQ ID NO: 624441 - RNA, 18 nt, Human
cauggccaccaaacccca

SEQ ID NO: 624442 - RNA, 23 nt, Human
cauuccagaaaaauuagccugga

SEQ ID NO: 624443 - RNA, 22 nt, Human
ccagccucacucccagaaaccc

SEQ ID NO: 624444 - RNA, 19 nt, Human
ccagggccugaccaccaac

SEQ ID NO: 624445 - RNA, 20 nt, Human
ccagggugaugaucagcaag

SEQ ID NO: 624446 - RNA, 21 nt, Human
ccaguuggguucuucccagcu

SEQ ID NO: 624447 - RNA, 21 nt, Human
ccggagcgcucagcaaacacc

SEQ ID NO: 624448 - RNA, 26 nt, Human
ccgguaguaaguaagaaguuucuccu

SEQ ID NO: 624449 - RNA, 19 nt, Human
ccuaaauacugucucagca

SEQ ID NO: 624450 - RNA, 26 nt, Human
ccuccaucauccucaccugaugucua

SEQ ID NO: 624451 - RNA, 19 nt, Human
ccucuggccgugcccggag

SEQ ID NO: 624452 - RNA, 21 nt, Human
cgagagaggaaaaaauagaaa

SEQ ID NO: 624453 - RNA, 21 nt, Human
cgagcagacacugggcacaca

SEQ ID NO: 624454 - RNA, 19 nt, Human
cgaucuccccaggugcugg

SEQ ID NO: 624455 - RNA, 21 nt, Human
cgcaaaacaccaaguggucca

SEQ ID NO: 624456 - RNA, 19 nt, Human
cggcacauauguccacagc

SEQ ID NO: 624457 - RNA, 24 nt, Human
cuaaauauagucaagguuaacccu

SEQ ID NO: 624458 - RNA, 19 nt, Human
cuccugugucgaaggugga

SEQ ID NO: 624459 - RNA, 24 nt, Human
cugaaugggcagaugagaaacaga

SEQ ID NO: 624460 - RNA, 19 nt, Human
cugaccaccaacacccgcu

SEQ ID NO: 624461 - RNA, 18 nt, Human
cugcguuccuucaaggcc

SEQ ID NO: 624462 - RNA, 19 nt, Human
cugcuaauagccaccaaga

SEQ ID NO: 624463 - RNA, 21 nt, Human
cuuggcccgagccugcucucc

SEQ ID NO: 624464 - RNA, 24 nt, Human
cuuggcccgagccugcucuccagc

SEQ ID NO: 624465 - RNA, 22 nt, Human
gaagugaccagggugaugauca

SEQ ID NO: 624466 - RNA, 24 nt, Human
gagcagacacugggcacacaaacc

SEQ ID NO: 624467 - RNA, 22 nt, Human
gagcgcucagcaaacaccccuc

SEQ ID NO: 624468 - RNA, 20 nt, Human
gcaaaacagaaggcaugaac

SEQ ID NO: 624469 - RNA, 20 nt, Human
gcugcguuccuucaaggccu

SEQ ID NO: 624470 - RNA, 21 nt, Human
gcuggcuguugggucuguucu

SEQ ID NO: 624471 - RNA, 19 nt, Human
ggaaaugcccaccuccucc

SEQ ID NO: 624472 - RNA, 22 nt, Human
ggccaaaacgcaaaacaccaag

SEQ ID NO: 624473 - RNA, 24 nt, Human
ggccaaaacgcaaaacaccaagug

SEQ ID NO: 624474 - RNA, 21 nt, Human
gggaaaagaggcaaaaagacc

SEQ ID NO: 624475 - RNA, 19 nt, Human
gguaacaaaaauaggaaga

SEQ ID NO: 624476 - RNA, 26 nt, Human
gguaacaaaauaggagacgaaagaga

SEQ ID NO: 624477 - RNA, 20 nt, Human
gguaguaaguaagaaguuuc

SEQ ID NO: 624478 - RNA, 22 nt, Human
ggugagaaacaggacaggggga

SEQ ID NO: 624479 - RNA, 21 nt, Human
gucgaagguggaggagucugu

SEQ ID NO: 624480 - RNA, 25 nt, Human
gucguggggagcccauccaguuggg

SEQ ID NO: 624481 - RNA, 24 nt, Human
gucuggguagaaaacauggccacc

SEQ ID NO: 624482 - RNA, 21 nt, Human
gucugucugaccccugcagcc

SEQ ID NO: 624483 - RNA, 19 nt, Human
gugaaaaccagcauucaug

SEQ ID NO: 624484 - RNA, 23 nt, Human
gugucgaagguggaggagucugu

SEQ ID NO: 624485 - RNA, 22 nt, Human
uaaauacugcaaucucagcagc

SEQ ID NO: 624486 - RNA, 20 nt, Human
uaacaaaauaggagacgaaa

SEQ ID NO: 624487 - RNA, 21 nt, Human
uaccuccaucauccucaccug

SEQ ID NO: 624488 - RNA, 24 nt, Human
uagaaaagacacugaauaggaaca

SEQ ID NO: 624489 - RNA, 22 nt, Human
uagcaccgaucuccccaggugc

SEQ ID NO: 624490 - RNA, 25 nt, Human
uaggagacgaaagagaugucauucu

SEQ ID NO: 624491 - RNA, 24 nt, Human
uauccugugugggucauuaacagu

SEQ ID NO: 624492 - RNA, 25 nt, Human
uaugaaugggucaggagguuggggg

SEQ ID NO: 624493 - RNA, 20 nt, Human
ucacucccagaaacccuaaa

SEQ ID NO: 624494 - RNA, 18 nt, Human
ucagcagcggcaaacaag

SEQ ID NO: 624495 - RNA, 19 nt, Human
uccacagcagcuugcuugg

SEQ ID NO: 624496 - RNA, 27 nt, Human
ucccagaaacccuaaauacugucucag

SEQ ID NO: 624497 - RNA, 22 nt, Human
ucugucuuaucugugugcucuc

SEQ ID NO: 624498 - RNA, 18 nt, Human
ucugugacaaaggagggg

SEQ ID NO: 624499 - RNA, 18 nt, Human
ugaagggcuggcuguugg

SEQ ID NO: 624500 - RNA, 23 nt, Human
ugaagugaccagggugaugauca

SEQ ID NO: 624501 - RNA, 21 nt, Human
ugaaugggcagaugagaaaca

SEQ ID NO: 624502 - RNA, 20 nt, Human
ugaccagggugaugaucagc

SEQ ID NO: 624503 - RNA, 20 nt, Human
ugagguaucgaugcuaaaga

SEQ ID NO: 624504 - RNA, 19 nt, Human
ugcccggagcgcucagcaa

SEQ ID NO: 624505 - RNA, 19 nt, Human
ugcccgguuccgguaguaa

SEQ ID NO: 624506 - RNA, 24 nt, Human
ugcccuggcaguccccauccuugu

SEQ ID NO: 624507 - RNA, 24 nt, Human
uggcaggcgcuggaggaugaaggg

SEQ ID NO: 624508 - RNA, 26 nt, Human
ugggaaggaaugagacagccgaccuc

SEQ ID NO: 624509 - RNA, 20 nt, Human
ugggaaggaaugagacagcu

SEQ ID NO: 624510 - RNA, 21 nt, Human
uggggagcccauccaguuggg

SEQ ID NO: 624511 - RNA, 26 nt, Human
ugggucaggagguuggggggaggaug

SEQ ID NO: 624512 - RNA, 18 nt, Human
uggguucuucccagcucc

SEQ ID NO: 624513 - RNA, 20 nt, Human
ugguagauuaaacauuccuc

SEQ ID NO: 624514 - RNA, 19 nt, Human
ugucucagcacucgcucug

SEQ ID NO: 624515 - RNA, 26 nt, Human
uguuacuaucguugggaaggaaugag

SEQ ID NO: 624516 - RNA, 21 nt, Human
uuaucugugugcucucuuccu

SEQ ID NO: 624517 - RNA, 20 nt, Human
uucccagcuccuuuuccccg

SEQ ID NO: 624518 - RNA, 20 nt, Human
uuguucccucucaauaccuu

SEQ ID NO: 624519 - RNA, 21 nt, Human
uuugcauucagcuuauccugu

SEQ ID NO: 624520 - RNA, 21 nt, Human
uuuguucccucucaauaccuu

SEQ ID NO: 624521 - RNA, 21 nt, Human
agcccgcuggucccuggugug

SEQ ID NO: 624522 - RNA, 21 nt, Human
ccagugggugccccagcuggg

SEQ ID NO: 624523 - RNA, 18 nt, Human
cccugggacuagcccgcu

SEQ ID NO: 624524 - RNA, 21 nt, Human
ccuuccagugggugccccagc

SEQ ID NO: 624525 - RNA, 25 nt, Human
cuggccgcugggccaugcccuggga

SEQ ID NO: 624526 - RNA, 20 nt, Human
gcugggccaugcccugggac

SEQ ID NO: 624527 - RNA, 18 nt, Human
ucagaguuuuaauccugg

SEQ ID NO: 624528 - RNA, 23 nt, Human
uccagugggugccccagcugggc

SEQ ID NO: 624529 - RNA, 18 nt, Human
uccugggaaaaagaaucu

SEQ ID NO: 624530 - RNA, 21 nt, Human
uccuuccagugggugccccag

SEQ ID NO: 624531 - RNA, 26 nt, Human
ucuggccgcugggccaugcccuggga

SEQ ID NO: 624532 - RNA, 22 nt, Human
ugggacuagcccgcuggucccc

SEQ ID NO: 624533 - RNA, 22 nt, Human
ugggugccccagcugggcuggg

SEQ ID NO: 624534 - RNA, 24 nt, Human
uuuuuuuuuuuuuuuuuuuuuccu

SEQ ID NO: 624535 - RNA, 19 nt, Human
aacuuggugguuucaguga

SEQ ID NO: 624536 - RNA, 19 nt, Human
aagguggucuccagccccg

SEQ ID NO: 624537 - RNA, 18 nt, Human
acugcaagcuccgccucc

SEQ ID NO: 624538 - RNA, 18 nt, Human
agcuccgccuccuggguu

SEQ ID NO: 624539 - RNA, 25 nt, Human
aggcuggagugcaguggugcaaucu

SEQ ID NO: 624540 - RNA, 18 nt, Human
aguagcugggacuacagg

SEQ ID NO: 624541 - RNA, 19 nt, Human
aguagcugggacuacaggc

SEQ ID NO: 624542 - RNA, 19 nt, Human
agugcaguggugcaaucug

SEQ ID NO: 624543 - RNA, 24 nt, Human
agugcaguggugcaaucugggcuc

SEQ ID NO: 624544 - RNA, 22 nt, Human
aucuucucaauggccuccaucg

SEQ ID NO: 624545 - RNA, 24 nt, Human
aucuuggcgcugucuccagcuugu

SEQ ID NO: 624546 - RNA, 19 nt, Human
caucaucagccuccaaguc

SEQ ID NO: 624547 - RNA, 18 nt, Human
ccaggcuggagugcagug

SEQ ID NO: 624548 - RNA, 19 nt, Human
ccccuccuccucauccuca

SEQ ID NO: 624549 - RNA, 23 nt, Human
cccgaguagcugggacuacaggc

SEQ ID NO: 624550 - RNA, 24 nt, Human
cccgaguagcugggacuacaggcg

SEQ ID NO: 624551 - RNA, 18 nt, Human
cccuccuccucauccuca

SEQ ID NO: 624552 - RNA, 19 nt, Human
ccuauggccacuggcggcg

SEQ ID NO: 624553 - RNA, 23 nt, Human
ccugccucagccucccgaguagc

SEQ ID NO: 624554 - RNA, 21 nt, Human
ccuucugcuccucuccaagga

SEQ ID NO: 624555 - RNA, 24 nt, Human
cucagccucccgaguagcugggac

SEQ ID NO: 624556 - RNA, 22 nt, Human
cucauccguccccuccuccuca

SEQ ID NO: 624557 - RNA, 19 nt, Human
cuccuggguuuacuuacgc

SEQ ID NO: 624558 - RNA, 24 nt, Human
cucgcucuguuguccaggcuggag

SEQ ID NO: 624559 - RNA, 24 nt, Human
cucucaugcacaggcuggccaucu

SEQ ID NO: 624560 - RNA, 21 nt, Human
cucugaagccuucugcuccuc

SEQ ID NO: 624561 - RNA, 23 nt, Human
cugauagagcgccagccucuccu

SEQ ID NO: 624562 - RNA, 23 nt, Human
cugccucagccucccgaguagcu

SEQ ID NO: 624563 - RNA, 24 nt, Human
gacuacaggcgcccgccaccaugc

SEQ ID NO: 624564 - RNA, 25 nt, Human
gaguagcugggacuacaggcgcccg

SEQ ID NO: 624565 - RNA, 19 nt, Human
gccauucuccugccucagc

SEQ ID NO: 624566 - RNA, 24 nt, Human
gcuggagugcaguggugcaaucug

SEQ ID NO: 624567 - RNA, 24 nt, Human
gucucgcucuguuguccaggcugg

SEQ ID NO: 624568 - RNA, 24 nt, Human
gucucugaagccuucugcuccucu

SEQ ID NO: 624569 - RNA, 18 nt, Human
guggggucucugaagccu

SEQ ID NO: 624570 - RNA, 22 nt, Human
uacaguccuccgccaacuuuuc

SEQ ID NO: 624571 - RNA, 18 nt, Human
ucacugcaagcuccgccu

SEQ ID NO: 624572 - RNA, 23 nt, Human
ucacugcaagcuccgccuccugg

SEQ ID NO: 624573 - RNA, 24 nt, Human
ucacugcaagcuccgccuccuggg

SEQ ID NO: 624574 - RNA, 23 nt, Human
ucagccucccgaguagcugggac

SEQ ID NO: 624575 - RNA, 18 nt, Human
ucagugauguugcccagc

SEQ ID NO: 624576 - RNA, 19 nt, Human
ucauccguccccuccuccu

SEQ ID NO: 624577 - RNA, 22 nt, Human
ucauccucauccgggucucuca

SEQ ID NO: 624578 - RNA, 24 nt, Human
ucccgaguagcugggacuacaggc

SEQ ID NO: 624579 - RNA, 22 nt, Human
uccucauccucauccgggucuc

SEQ ID NO: 624580 - RNA, 23 nt, Human
uccuccucauccucauccggguc

SEQ ID NO: 624581 - RNA, 24 nt, Human
ucgcucuguuguccaggcuggagu

SEQ ID NO: 624582 - RNA, 23 nt, Human
ucuccaaggaccucauuuagcuc

SEQ ID NO: 624583 - RNA, 24 nt, Human
ucuccugccucagccucccgagua

SEQ ID NO: 624584 - RNA, 19 nt, Human
ucucgcucuguuguccagg

SEQ ID NO: 624585 - RNA, 22 nt, Human
ucucgcucuguuguccaggcug

SEQ ID NO: 624586 - RNA, 23 nt, Human
ucucgcucuguuguccaggcugg

SEQ ID NO: 624587 - RNA, 24 nt, Human
ucucgcucuguuguccaggcugga

SEQ ID NO: 624588 - RNA, 19 nt, Human
ucucucaugcacaggcugg

SEQ ID NO: 624589 - RNA, 24 nt, Human
ucuguuguccaggcuggagugcag

SEQ ID NO: 624590 - RNA, 24 nt, Human
ugaagccuucugcuccucuccaag

SEQ ID NO: 624591 - RNA, 18 nt, Human
ugagauagagucucgcuc

SEQ ID NO: 624592 - RNA, 22 nt, Human
ugagauagagucucgcucuguu

SEQ ID NO: 624593 - RNA, 22 nt, Human
ugcaaucugggcucacugcaag

SEQ ID NO: 624594 - RNA, 22 nt, Human
ugcacaggcuggccaucuucuc

SEQ ID NO: 624595 - RNA, 24 nt, Human
ugccucagccucccgaguagcugg

SEQ ID NO: 624596 - RNA, 23 nt, Human
uggagugcaguggugcaaucugg

SEQ ID NO: 624597 - RNA, 21 nt, Human
ugggacuacaggcgcccgcca

SEQ ID NO: 624598 - RNA, 22 nt, Human
ugggacuacaggcgcccgccac

SEQ ID NO: 624599 - RNA, 24 nt, Human
ugggacuacaggcgcccgccacca

SEQ ID NO: 624600 - RNA, 25 nt, Human
ugggacuacaggcgcccgccaccau

SEQ ID NO: 624601 - RNA, 23 nt, Human
uggguuuacuuacgccauucucc

SEQ ID NO: 624602 - RNA, 20 nt, Human
uguccaggcuggagugcagu

SEQ ID NO: 624603 - RNA, 24 nt, Human
uguccaggcuggagugcaguggug

SEQ ID NO: 624604 - RNA, 19 nt, Human
uguuguccaggcuggagug

SEQ ID NO: 624605 - RNA, 22 nt, Human
uucagugauguugcccagcugg

SEQ ID NO: 624606 - RNA, 22 nt, Human
uucggcugggccacaggaggug

SEQ ID NO: 624607 - RNA, 21 nt, Human
uugucuggcgcuuucaauugc

SEQ ID NO: 624608 - RNA, 25 nt, Human
uuuuuuuuuuuugagauagagucuc

SEQ ID NO: 624609 - RNA, 27 nt, Human
uuuuuuuuuuuuuuuuuuuuuuugggg

SEQ ID NO: 624610 - RNA, 24 nt, Human
uccgcuggcgccuccgcccgccaa

SEQ ID NO: 624611 - RNA, 21 nt, Human
ugaaggugacgugacaucucu

SEQ ID NO: 624612 - RNA, 21 nt, Human
uuuuuuuuuuuuuuuugaagg

SEQ ID NO: 624613 - RNA, 18 nt, Human
uuuuuuuuuuuuuuuuug

SEQ ID NO: 624614 - RNA, 22 nt, Human
aagacuacaaagagguuaaccg

SEQ ID NO: 624615 - RNA, 25 nt, Human
agaaaggacugugcugacucccuca

SEQ ID NO: 624616 - RNA, 18 nt, Human
agagaagaagaggugaua

SEQ ID NO: 624617 - RNA, 22 nt, Human
agcaagacuacaaagagguuaa

SEQ ID NO: 624618 - RNA, 24 nt, Human
augguccuggguuagaagcugcag

SEQ ID NO: 624619 - RNA, 19 nt, Human
cacaauauuuagaaaucag

SEQ ID NO: 624620 - RNA, 18 nt, Human
cacagcccccagcauucc

SEQ ID NO: 624621 - RNA, 18 nt, Human
cagaagaccugcagaccu

SEQ ID NO: 624622 - RNA, 23 nt, Human
cagcccccagcauuccuuguccu

SEQ ID NO: 624623 - RNA, 19 nt, Human
cagcucuuuccuucuuggg

SEQ ID NO: 624624 - RNA, 18 nt, Human
cauccgucauugcugggu

SEQ ID NO: 624625 - RNA, 22 nt, Human
ccucuugaugcugcugucuuuu

SEQ ID NO: 624626 - RNA, 22 nt, Human
ccuuuaccagaccuuuagucuc

SEQ ID NO: 624627 - RNA, 20 nt, Human
ccuuuagucucucuucuucu

SEQ ID NO: 624628 - RNA, 18 nt, Human
cgcuugcuccucucagca

SEQ ID NO: 624629 - RNA, 23 nt, Human
cucagacucucaccagagaagaa

SEQ ID NO: 624630 - RNA, 23 nt, Human
cuccucuugaugcugcugucuuu

SEQ ID NO: 624631 - RNA, 21 nt, Human
cuguucccacagcccccagca

SEQ ID NO: 624632 - RNA, 18 nt, Human
cuuuagucucucuucuuc

SEQ ID NO: 624633 - RNA, 18 nt, Human
gacucccucaacuaaggg

SEQ ID NO: 624634 - RNA, 21 nt, Human
gacuccucauugaggggggug

SEQ ID NO: 624635 - RNA, 19 nt, Human
gcagaccugcaucaacccu

SEQ ID NO: 624636 - RNA, 21 nt, Human
gcucucugcuucccuagcccc

SEQ ID NO: 624637 - RNA, 22 nt, Human
gugcucugcucucugcuucccu

SEQ ID NO: 624638 - RNA, 18 nt, Human
uaccagaccuuuagucuc

SEQ ID NO: 624639 - RNA, 27 nt, Human
uaccagaccuuuagucucucuucuucu

SEQ ID NO: 624640 - RNA, 27 nt, Human
uagcaagacuacaaagagguuaaccga

SEQ ID NO: 624641 - RNA, 18 nt, Human
uagcaggaaugcuccuuc

SEQ ID NO: 624642 - RNA, 22 nt, Human
ucaccagagaagaagaggugau

SEQ ID NO: 624643 - RNA, 26 nt, Human
ucccuagccccgccauccuucucauc

SEQ ID NO: 624644 - RNA, 20 nt, Human
uccuggguuagaagcugcag

SEQ ID NO: 624645 - RNA, 21 nt, Human
uccuucuugggaugcugcugc

SEQ ID NO: 624646 - RNA, 18 nt, Human
ucucuaggcaccugaguu

SEQ ID NO: 624647 - RNA, 21 nt, Human
ucucuaggcaccugaguucau

SEQ ID NO: 624648 - RNA, 18 nt, Human
ucugggagggacuccuca

SEQ ID NO: 624649 - RNA, 18 nt, Human
ucuguuucuuuuuggcuu

SEQ ID NO: 624650 - RNA, 20 nt, Human
ucuuccucuuaccucugcug

SEQ ID NO: 624651 - RNA, 24 nt, Human
ucuucuugcuuuuccugcuucuuc

SEQ ID NO: 624652 - RNA, 22 nt, Human
ucuuuucuucuugcuuuuccug

SEQ ID NO: 624653 - RNA, 22 nt, Human
ugagaaaaaagucucuauccuc

SEQ ID NO: 624654 - RNA, 28 nt, Human
ugcagaaaggacugugcugaucagugga

SEQ ID NO: 624655 - RNA, 18 nt, Human
ugcucugcucucugcuuc

SEQ ID NO: 624656 - RNA, 22 nt, Human
ugcugcuugagccagugugugc

SEQ ID NO: 624657 - RNA, 21 nt, Human
ugcuggguccgcuccgcggaa

SEQ ID NO: 624658 - RNA, 22 nt, Human
ugcuugagccagugugugcucc

SEQ ID NO: 624659 - RNA, 20 nt, Human
ugcuuuuccugcuucuucca

SEQ ID NO: 624660 - RNA, 20 nt, Human
uggacagugcugacuccagc

SEQ ID NO: 624661 - RNA, 21 nt, Human
uggcaacugugggcuaaaucu

SEQ ID NO: 624662 - RNA, 21 nt, Human
uguucccacagcccccagcau

SEQ ID NO: 624663 - RNA, 18 nt, Human
uguuucuuuuuggcuuuc

SEQ ID NO: 624664 - RNA, 21 nt, Human
uuccuucuugggaugcugcug

SEQ ID NO: 624665 - RNA, 24 nt, Human
uugaggggggugcagaagaccugc

SEQ ID NO: 624666 - RNA, 19 nt, Human
uuuagcugccuggcuucuc

SEQ ID NO: 624667 - RNA, 23 nt, Human
uuucuggacagugcugacuccag

SEQ ID NO: 624668 - RNA, 25 nt, Human
aaagccccgcucauaaagggugcuu

SEQ ID NO: 624669 - RNA, 23 nt, Human
acagacaguggucaaaaaagagc

SEQ ID NO: 624670 - RNA, 20 nt, Human
accaagacccccagcaugaa

SEQ ID NO: 624671 - RNA, 22 nt, Human
accaagacccccagcaugaugg

SEQ ID NO: 624672 - RNA, 23 nt, Human
accugguagggcauacccaagaa

SEQ ID NO: 624673 - RNA, 26 nt, Human
acucuggcucuuguccaguuccuucu

SEQ ID NO: 624674 - RNA, 18 nt, Human
agaaaugagauggaagga

SEQ ID NO: 624675 - RNA, 19 nt, Human
agagaacacacucuggcuc

SEQ ID NO: 624676 - RNA, 19 nt, Human
agcugugaccaagaauggg

SEQ ID NO: 624677 - RNA, 19 nt, Human
aggagagaacucaggcacc

SEQ ID NO: 624678 - RNA, 23 nt, Human
agggaggggcuuagaggcauuug

SEQ ID NO: 624679 - RNA, 21 nt, Human
aguguucaguggaauuguggg

SEQ ID NO: 624680 - RNA, 21 nt, Human
augauauucucaaagccccgc

SEQ ID NO: 624681 - RNA, 24 nt, Human
augcugcugggcccugucccgucc

SEQ ID NO: 624682 - RNA, 21 nt, Human
caagggaggggacagggaggg

SEQ ID NO: 624683 - RNA, 22 nt, Human
caaguuaaaaagacucccauga

SEQ ID NO: 624684 - RNA, 20 nt, Human
cacguagcucccggcucacc

SEQ ID NO: 624685 - RNA, 24 nt, Human
cacuccguuugcuuccccgagcgc

SEQ ID NO: 624686 - RNA, 22 nt, Human
cacucuggcucuuguccaguuc

SEQ ID NO: 624687 - RNA, 20 nt, Human
cagaagaacacagaagccac

SEQ ID NO: 624688 - RNA, 19 nt, Human
cagaagccaccugcuggga

SEQ ID NO: 624689 - RNA, 20 nt, Human
cagaagccaccugcugggag

SEQ ID NO: 624690 - RNA, 26 nt, Human
cagcguggguucacuuagaggagcuu

SEQ ID NO: 624691 - RNA, 23 nt, Human
caggaggcugcuaaagucuggag

SEQ ID NO: 624692 - RNA, 18 nt, Human
cagguggaggugaggcug

SEQ ID NO: 624693 - RNA, 20 nt, Human
cagguggaggugaggcugcu

SEQ ID NO: 624694 - RNA, 18 nt, Human
caguagggccagaaaagu

SEQ ID NO: 624695 - RNA, 22 nt, Human
cauggugaacagacagugguca

SEQ ID NO: 624696 - RNA, 18 nt, Human
ccaagacccccagcauga

SEQ ID NO: 624697 - RNA, 19 nt, Human
ccacacccaggcuucaggu

SEQ ID NO: 624698 - RNA, 25 nt, Human
ccagagacccugcugccuucgccag

SEQ ID NO: 624699 - RNA, 20 nt, Human
cccugcgguuccugccgccu

SEQ ID NO: 624700 - RNA, 19 nt, Human
ccgaccccaggccgccgac

SEQ ID NO: 624701 - RNA, 23 nt, Human
ccuccaggcugcggaagcggccc

SEQ ID NO: 624702 - RNA, 26 nt, Human
ccuucugcuguggcuagagcugugac

SEQ ID NO: 624703 - RNA, 22 nt, Human
cgaccccaggccgccgaccccu

SEQ ID NO: 624704 - RNA, 28 nt, Human
cggcucuggugggaccucagcaguucca

SEQ ID NO: 624705 - RNA, 20 nt, Human
cuccagagacccugcugccu

SEQ ID NO: 624706 - RNA, 24 nt, Human
cuccuuauucugccgcuucaugau

SEQ ID NO: 624707 - RNA, 22 nt, Human
cucggccgccggcgccggcgcc

SEQ ID NO: 624708 - RNA, 20 nt, Human
cugcugccuucgccagcagc

SEQ ID NO: 624709 - RNA, 24 nt, Human
cuggcucuuguccaguuccuucug

SEQ ID NO: 624710 - RNA, 28 nt, Human
cuggcucuuguccaguuccuucugcagg

SEQ ID NO: 624711 - RNA, 18 nt, Human
cugugaccaagaauggga

SEQ ID NO: 624712 - RNA, 23 nt, Human
cuucagguggaggugaggcugcu

SEQ ID NO: 624713 - RNA, 19 nt, Human
gaagaacugagguggaggc

SEQ ID NO: 624714 - RNA, 20 nt, Human
gcauuuugaagugagaggca

SEQ ID NO: 624715 - RNA, 20 nt, Human
gccagguccuucaaccauau

SEQ ID NO: 624716 - RNA, 18 nt, Human
gccuggauacagaugcgg

SEQ ID NO: 624717 - RNA, 21 nt, Human
gcggaagcggcccugcuucug

SEQ ID NO: 624718 - RNA, 18 nt, Human
gggaauggaaaguuggaa

SEQ ID NO: 624719 - RNA, 20 nt, Human
gggacagggaggggcuuaga

SEQ ID NO: 624720 - RNA, 21 nt, Human
guaggaggcugagaugcugcu

SEQ ID NO: 624721 - RNA, 22 nt, Human
gucaggucguauuuccacacuc

SEQ ID NO: 624722 - RNA, 23 nt, Human
uacaagggaggggacagggaggg

SEQ ID NO: 624723 - RNA, 20 nt, Human
uagggccagaaaaguguuca

SEQ ID NO: 624724 - RNA, 19 nt, Human
uagugacuccccugguguc

SEQ ID NO: 624725 - RNA, 21 nt, Human
uauucucaaagccccgcucau

SEQ ID NO: 624726 - RNA, 26 nt, Human
uauucugccgcuucaugauauucuca

SEQ ID NO: 624727 - RNA, 21 nt, Human
ucaaaaaagagcuccagagac

SEQ ID NO: 624728 - RNA, 22 nt, Human
ucaguggccaggaaggcagggc

SEQ ID NO: 624729 - RNA, 19 nt, Human
uccacagcaggggguggga

SEQ ID NO: 624730 - RNA, 24 nt, Human
uccacugacagccacacccaggcu

SEQ ID NO: 624731 - RNA, 21 nt, Human
ucccaugaagaacugccaccu

SEQ ID NO: 624732 - RNA, 21 nt, Human
uccccgagcgcccugcgguuc

SEQ ID NO: 624733 - RNA, 24 nt, Human
uccccgagcgcccugcgguuccug

SEQ ID NO: 624734 - RNA, 22 nt, Human
ucugcuguggcuagagcugugg

SEQ ID NO: 624735 - RNA, 23 nt, Human
ucuggaagccccuuuccuucugc

SEQ ID NO: 624736 - RNA, 25 nt, Human
ucuggcucuuguccaguuccuucug

SEQ ID NO: 624737 - RNA, 24 nt, Human
ucuggugggaccucagcaguucca

SEQ ID NO: 624738 - RNA, 28 nt, Human
ucuugcaggauggccuggauacagaugc

SEQ ID NO: 624739 - RNA, 19 nt, Human
ugaccaagaaugggaacag

SEQ ID NO: 624740 - RNA, 24 nt, Human
ugaccaagacccccagcaugaugg

SEQ ID NO: 624741 - RNA, 20 nt, Human
ugauggggaauggaaaguug

SEQ ID NO: 624742 - RNA, 21 nt, Human
ugccuaggagagaacucaggc

SEQ ID NO: 624743 - RNA, 22 nt, Human
ugcggaagcggcccugcuucug

SEQ ID NO: 624744 - RNA, 20 nt, Human
uggaagaacugagguggagg

SEQ ID NO: 624745 - RNA, 27 nt, Human
uggaagaaguaggacuacaagggagga

SEQ ID NO: 624746 - RNA, 22 nt, Human
uggaagccccuuuccuucugcu

SEQ ID NO: 624747 - RNA, 19 nt, Human
uggaaggaaguggaaggca

SEQ ID NO: 624748 - RNA, 21 nt, Human
uggaaggaaguggaaggcaga

SEQ ID NO: 624749 - RNA, 23 nt, Human
uggaaggcagagggcaagggcgg

SEQ ID NO: 624750 - RNA, 19 nt, Human
uggagagaagcugagccuu

SEQ ID NO: 624751 - RNA, 18 nt, Human
uggaggcugggggccaug

SEQ ID NO: 624752 - RNA, 21 nt, Human
uggaggcugggggccaugugc

SEQ ID NO: 624753 - RNA, 20 nt, Human
uggauacagaugcgguaacc

SEQ ID NO: 624754 - RNA, 19 nt, Human
uggcucagcguggguucac

SEQ ID NO: 624755 - RNA, 24 nt, Human
ugggaacaggaggcugccgggauc

SEQ ID NO: 624756 - RNA, 20 nt, Human
ugggaacaggaggcugcuaa

SEQ ID NO: 624757 - RNA, 24 nt, Human
uggggcaggcugggcauuuugaag

SEQ ID NO: 624758 - RNA, 18 nt, Human
ugggguuuagaaaugaga

SEQ ID NO: 624759 - RNA, 19 nt, Human
uguccaguuccuucugcag

SEQ ID NO: 624760 - RNA, 22 nt, Human
uuucagugcuuccuccaggcug

SEQ ID NO: 624761 - RNA, 19 nt, Human
uuugcuuccccgagcgccc

SEQ ID NO: 624762 - RNA, 20 nt, Human
uuugcuuccccgagcgcccu

SEQ ID NO: 624763 - RNA, 26 nt, Human
uuugucagaagaacacagaagccacc

SEQ ID NO: 624764 - RNA, 20 nt, Human
aacagccaggagcugcuggc

SEQ ID NO: 624765 - RNA, 19 nt, Human
aagcucucuccagcuuucc

SEQ ID NO: 624766 - RNA, 20 nt, Human
acaggacgcuuccacuuccc

SEQ ID NO: 624767 - RNA, 21 nt, Human
acugcccaccuccaccaccca

SEQ ID NO: 624768 - RNA, 23 nt, Human
aggaacagccaggagcugcuggc

SEQ ID NO: 624769 - RNA, 19 nt, Human
caccacucugacucuggcc

SEQ ID NO: 624770 - RNA, 23 nt, Human
cacucugacucuggccuuugccu

SEQ ID NO: 624771 - RNA, 25 nt, Human
cacucugacucuggccuuugccugu

SEQ ID NO: 624772 - RNA, 18 nt, Human
cagcagccccuguccucc

SEQ ID NO: 624773 - RNA, 25 nt, Human
cagcgcagccagcucgaccccuugg

SEQ ID NO: 624774 - RNA, 18 nt, Human
caggagcugcuggcauga

SEQ ID NO: 624775 - RNA, 18 nt, Human
ccacucugacucuggccu

SEQ ID NO: 624776 - RNA, 21 nt, Human
ccacugcccaccuccaccacc

SEQ ID NO: 624777 - RNA, 23 nt, Human
ccacugcccaccuccaccaccca

SEQ ID NO: 624778 - RNA, 21 nt, Human
cccccagacaggacgcuucca

SEQ ID NO: 624779 - RNA, 25 nt, Human
cccguagugaggacagcuguguggc

SEQ ID NO: 624780 - RNA, 22 nt, Human
cccuguccuccccaccacucug

SEQ ID NO: 624781 - RNA, 19 nt, Human
ccuccagucugcaaucaac

SEQ ID NO: 624782 - RNA, 27 nt, Human
ccuccagucugcaaucaacaccauuuu

SEQ ID NO: 624783 - RNA, 22 nt, Human
cucgcaagccgccgucucccgc

SEQ ID NO: 624784 - RNA, 22 nt, Human
cugaauagcuuuauugagcauu

SEQ ID NO: 624785 - RNA, 21 nt, Human
cugcaguggcuuuccaggagc

SEQ ID NO: 624786 - RNA, 20 nt, Human
gaacagccaggagcugcugg

SEQ ID NO: 624787 - RNA, 22 nt, Human
gccgguccgcugcugccggcgc

SEQ ID NO: 624788 - RNA, 19 nt, Human
ggaggacaggucacggagg

SEQ ID NO: 624789 - RNA, 22 nt, Human
ggaggacaggucacggaggcuc

SEQ ID NO: 624790 - RNA, 20 nt, Human
gggaggacaggucacggagg

SEQ ID NO: 624791 - RNA, 22 nt, Human
ucaacaccauuggccccaggug

SEQ ID NO: 624792 - RNA, 22 nt, Human
ucacccuugcuugggaaucugc

SEQ ID NO: 624793 - RNA, 21 nt, Human
ucacggaggcucgcugccuca

SEQ ID NO: 624794 - RNA, 23 nt, Human
ucacggaggcucgcugccucaaa

SEQ ID NO: 624795 - RNA, 21 nt, Human
ucacugaauagcuuuauugag

SEQ ID NO: 624796 - RNA, 19 nt, Human
ucaggugaggaacagccag

SEQ ID NO: 624797 - RNA, 19 nt, Human
uccaccacccagcagugcu

SEQ ID NO: 624798 - RNA, 23 nt, Human
uccgccccaucuauaagcuggca

SEQ ID NO: 624799 - RNA, 19 nt, Human
uccuccccaccacucugac

SEQ ID NO: 624800 - RNA, 23 nt, Human
ugacccucagcggagguuacccc

SEQ ID NO: 624801 - RNA, 23 nt, Human
ugagggaggacaggucacggagg

SEQ ID NO: 624802 - RNA, 22 nt, Human
ugcaaggacggcggcugccgcg

SEQ ID NO: 624803 - RNA, 21 nt, Human
ugcagaaaguacccaaugcca

SEQ ID NO: 624804 - RNA, 18 nt, Human
uggcaggcccggcugccu

SEQ ID NO: 624805 - RNA, 19 nt, Human
uggcaggcccggcugccug

SEQ ID NO: 624806 - RNA, 18 nt, Human
uggcaugaggcucugggg

SEQ ID NO: 624807 - RNA, 23 nt, Human
ugggcugggcacuaagcucagca

SEQ ID NO: 624808 - RNA, 22 nt, Human
uggugccacugcccaccuccac

SEQ ID NO: 624809 - RNA, 19 nt, Human
uguugccgaggcugcuccc

SEQ ID NO: 624810 - RNA, 19 nt, Human
uuuccaggagcggggcagc

SEQ ID NO: 624811 - RNA, 22 nt, Human
uuuuuuuuuuuuucacugaaua

SEQ ID NO: 624812 - RNA, 24 nt, Human
uuuuuuuuuuuuuuuuuucacuga

SEQ ID NO: 624813 - RNA, 24 nt, Human
uuuuuuuuuuuuuuuuuuucacug

SEQ ID NO: 624814 - RNA, 20 nt, Human
aaaacccaacccccucuccc

SEQ ID NO: 624815 - RNA, 22 nt, Human
aaaacccaacccccucucccac

SEQ ID NO: 624816 - RNA, 21 nt, Human
aaacccaacccccucucccac

SEQ ID NO: 624817 - RNA, 24 nt, Human
aaccacucaggcuucaacacccga

SEQ ID NO: 624818 - RNA, 27 nt, Human
accaaaacaagaggcccgcgagacccg

SEQ ID NO: 624819 - RNA, 24 nt, Human
accacucaggcuucaacacccgaa

SEQ ID NO: 624820 - RNA, 20 nt, Human
acccaacccccucucccacu

SEQ ID NO: 624821 - RNA, 20 nt, Human
accccuuucuccuccgccac

SEQ ID NO: 624822 - RNA, 19 nt, Human
agcagggggacccagcucu

SEQ ID NO: 624823 - RNA, 18 nt, Human
agcccgcgagaccaaaac

SEQ ID NO: 624824 - RNA, 25 nt, Human
agcuagggacaagagcuagguacaa

SEQ ID NO: 624825 - RNA, 19 nt, Human
aggaagaugauggugacuc

SEQ ID NO: 624826 - RNA, 23 nt, Human
aggaagaugauggugacuccagc

SEQ ID NO: 624827 - RNA, 20 nt, Human
aggaggaaagggcuagagaa

SEQ ID NO: 624828 - RNA, 21 nt, Human
aggaggaagaugggggugcag

SEQ ID NO: 624829 - RNA, 21 nt, Human
aggagguggccgcggccccgg

SEQ ID NO: 624830 - RNA, 22 nt, Human
aggcugaggcagcgacggaaga

SEQ ID NO: 624831 - RNA, 24 nt, Human
agggcagccucuucacacuuucug

SEQ ID NO: 624832 - RNA, 24 nt, Human
aggggcugugggcggcacggggug

SEQ ID NO: 624833 - RNA, 24 nt, Human
aggguuggggggcaucccgguucu

SEQ ID NO: 624834 - RNA, 23 nt, Human
agguggccgguggggcugauagc

SEQ ID NO: 624835 - RNA, 19 nt, Human
auaucuuuggggaugagga

SEQ ID NO: 624836 - RNA, 20 nt, Human
aucuuugagcggcggcggcg

SEQ ID NO: 624837 - RNA, 21 nt, Human
auggcccacauugcagcccag

SEQ ID NO: 624838 - RNA, 22 nt, Human
augggggugcagagauaacuga

SEQ ID NO: 624839 - RNA, 25 nt, Human
caaaacaagaggcccgcgagacccg

SEQ ID NO: 624840 - RNA, 21 nt, Human
caacucccucggcccuuuucc

SEQ ID NO: 624841 - RNA, 20 nt, Human
caccacuucaucccugcagu

SEQ ID NO: 624842 - RNA, 21 nt, Human
cacccgaaggcgcccauccuc

SEQ ID NO: 624843 - RNA, 18 nt, Human
caccguggggccgccccc

SEQ ID NO: 624844 - RNA, 18 nt, Human
cagccugggaggcugggg

SEQ ID NO: 624845 - RNA, 21 nt, Human
cagcgacggaagaaaagcuuu

SEQ ID NO: 624846 - RNA, 20 nt, Human
cagggggccuaacccccccu

SEQ ID NO: 624847 - RNA, 22 nt, Human
caguaccugcgugccucccugc

SEQ ID NO: 624848 - RNA, 24 nt, Human
ccacuugcaggcaaugcucagggu

SEQ ID NO: 624849 - RNA, 23 nt, Human
ccagucuucuccgucuaacccuc

SEQ ID NO: 624850 - RNA, 21 nt, Human
ccaugccauccagccugggag

SEQ ID NO: 624851 - RNA, 18 nt, Human
cccaacccccucucccac

SEQ ID NO: 624852 - RNA, 22 nt, Human
cccaccucccaugcccuaagag

SEQ ID NO: 624853 - RNA, 18 nt, Human
cccccagguggccggugg

SEQ ID NO: 624854 - RNA, 22 nt, Human
cccccccugccuggacccugcu

SEQ ID NO: 624855 - RNA, 22 nt, Human
cccccgccucccccuacauuac

SEQ ID NO: 624856 - RNA, 23 nt, Human
ccccgccccccccagguggccgg

SEQ ID NO: 624857 - RNA, 21 nt, Human
ccccuacauuacagcuauuuc

SEQ ID NO: 624858 - RNA, 24 nt, Human
cccgcagauggcgcgcaacgaccc

SEQ ID NO: 624859 - RNA, 25 nt, Human
cccgcccccuccccggcgcuccucc

SEQ ID NO: 624860 - RNA, 19 nt, Human
cccuagccccugccuccga

SEQ ID NO: 624861 - RNA, 19 nt, Human
cccuccgcccgacucaucu

SEQ ID NO: 624862 - RNA, 23 nt, Human
cccucggugcugcugcgccuggg

SEQ ID NO: 624863 - RNA, 23 nt, Human
cccugccuggacccugcucccuu

SEQ ID NO: 624864 - RNA, 19 nt, Human
cccugugccgcggcugcug

SEQ ID NO: 624865 - RNA, 20 nt, Human
ccgcagauggcgcgcaacga

SEQ ID NO: 624866 - RNA, 23 nt, Human
ccgcagauggcgcgcaacgaccc

SEQ ID NO: 624867 - RNA, 18 nt, Human
ccgcccccucggugcugc

SEQ ID NO: 624868 - RNA, 24 nt, Human
ccgccugcgccucuugaaggccgg

SEQ ID NO: 624869 - RNA, 19 nt, Human
ccgcgcgugcgccgacccc

SEQ ID NO: 624870 - RNA, 23 nt, Human
ccgucccgccgcggagcuccccc

SEQ ID NO: 624871 - RNA, 22 nt, Human
ccguggggccgcccccuccgcc

SEQ ID NO: 624872 - RNA, 20 nt, Human
ccuagccccugccuccgacc

SEQ ID NO: 624873 - RNA, 20 nt, Human
ccucccccacguccggggga

SEQ ID NO: 624874 - RNA, 19 nt, Human
ccuccccggcgcuccuccc

SEQ ID NO: 624875 - RNA, 26 nt, Human
ccuccggcugccugcugcugcuggug

SEQ ID NO: 624876 - RNA, 21 nt, Human
ccugcaguugauggcuguguu

SEQ ID NO: 624877 - RNA, 19 nt, Human
ccugcugcaggcagugggu

SEQ ID NO: 624878 - RNA, 20 nt, Human
ccuggccuccaccccuagcc

SEQ ID NO: 624879 - RNA, 24 nt, Human
ccugggggccgcccccucggugcu

SEQ ID NO: 624880 - RNA, 23 nt, Human
ccugugccgcggcugcugugagg

SEQ ID NO: 624881 - RNA, 26 nt, Human
cgacaggcgggccuccccaugcgacu

SEQ ID NO: 624882 - RNA, 18 nt, Human
cgacccggaccacgcucc

SEQ ID NO: 624883 - RNA, 20 nt, Human
cgagaccaaaacaagaggcu

SEQ ID NO: 624884 - RNA, 25 nt, Human
cgcaugcgcacuccgccaccacccu

SEQ ID NO: 624885 - RNA, 19 nt, Human
cgcccaagcgccuccccgc

SEQ ID NO: 624886 - RNA, 22 nt, Human
cgcccgacucaucuuugagcgg

SEQ ID NO: 624887 - RNA, 22 nt, Human
cgccgcggagcuccccagaggc

SEQ ID NO: 624888 - RNA, 24 nt, Human
cgccuagucucgcgcccaagcgcc

SEQ ID NO: 624889 - RNA, 19 nt, Human
cgccugcgccucuugaagg

SEQ ID NO: 624890 - RNA, 22 nt, Human
cgcgcccaagcgccuccccgcc

SEQ ID NO: 624891 - RNA, 21 nt, Human
cggcgcuccucccccacgucc

SEQ ID NO: 624892 - RNA, 23 nt, Human
cuagacaucaaguuuauugugcu

SEQ ID NO: 624893 - RNA, 18 nt, Human
cucccccgccucccccua

SEQ ID NO: 624894 - RNA, 18 nt, Human
cucccuuccccccuuucc

SEQ ID NO: 624895 - RNA, 19 nt, Human
cucccuuccccccuuuccc

SEQ ID NO: 624896 - RNA, 22 nt, Human
cucugcucuucacgccuagucu

SEQ ID NO: 624897 - RNA, 18 nt, Human
cugcagagcagauggaag

SEQ ID NO: 624898 - RNA, 22 nt, Human
cugcagagcagauggaagggga

SEQ ID NO: 624899 - RNA, 23 nt, Human
cugcaggcagugggugguggugg

SEQ ID NO: 624900 - RNA, 21 nt, Human
cugcugcugcugguggugcug

SEQ ID NO: 624901 - RNA, 24 nt, Human
cugcugcugcugguggugcugucc

SEQ ID NO: 624902 - RNA, 18 nt, Human
cuggccccugugccgcgg

SEQ ID NO: 624903 - RNA, 19 nt, Human
cuugcccccgcccccccca

SEQ ID NO: 624904 - RNA, 19 nt, Human
cuuggaacccuggccucca

SEQ ID NO: 624905 - RNA, 18 nt, Human
cuuugagcggcggcggcg

SEQ ID NO: 624906 - RNA, 20 nt, Human
gaacccuggccuccaccccu

SEQ ID NO: 624907 - RNA, 18 nt, Human
gaagccucccccgccucc

SEQ ID NO: 624908 - RNA, 19 nt, Human
gaaggauuuucacaguacc

SEQ ID NO: 624909 - RNA, 20 nt, Human
gaauaggaggaaagggcuag

SEQ ID NO: 624910 - RNA, 21 nt, Human
gaccccuuucuccuccgccac

SEQ ID NO: 624911 - RNA, 21 nt, Human
gaccgcagcggcuggggaccc

SEQ ID NO: 624912 - RNA, 20 nt, Human
gaccuugggacacuuuccuc

SEQ ID NO: 624913 - RNA, 20 nt, Human
gacucaucuuugagcggcgg

SEQ ID NO: 624914 - RNA, 24 nt, Human
gacuugcuggaaguccugcgacgu

SEQ ID NO: 624915 - RNA, 21 nt, Human
gagaauaggaggaaagggccg

SEQ ID NO: 624916 - RNA, 24 nt, Human
gaggaagaugauggugacuccagc

SEQ ID NO: 624917 - RNA, 20 nt, Human
gaggaggcugaggcagcgac

SEQ ID NO: 624918 - RNA, 18 nt, Human
gagggcagccucuucaca

SEQ ID NO: 624919 - RNA, 22 nt, Human
gaguucauaggguuggggggca

SEQ ID NO: 624920 - RNA, 19 nt, Human
gauaacugaggcagcugga

SEQ ID NO: 624921 - RNA, 26 nt, Human
gcccccuccccggcgcuccuccccca

SEQ ID NO: 624922 - RNA, 21 nt, Human
gccccgaaaccacucaggcuu

SEQ ID NO: 624923 - RNA, 23 nt, Human
gccccggaaccacgcaugcgcac

SEQ ID NO: 624924 - RNA, 18 nt, Human
gccuccaccccuagcccc

SEQ ID NO: 624925 - RNA, 26 nt, Human
gccucuuggugcgguggcaccguggg

SEQ ID NO: 624926 - RNA, 24 nt, Human
gcgaagcaagaacuacauggcccu

SEQ ID NO: 624927 - RNA, 18 nt, Human
gcggccuccccaacuccc

SEQ ID NO: 624928 - RNA, 21 nt, Human
gcggcggcggcggggccggca

SEQ ID NO: 624929 - RNA, 18 nt, Human
gcugugggcggcacgggg

SEQ ID NO: 624930 - RNA, 24 nt, Human
ggacacuuuccucuucccccaggu

SEQ ID NO: 624931 - RNA, 19 nt, Human
ggaggaaguuggaagguaa

SEQ ID NO: 624932 - RNA, 20 nt, Human
ggaggcugggggagaggaag

SEQ ID NO: 624933 - RNA, 20 nt, Human
ggaguaagggggugagaggg

SEQ ID NO: 624934 - RNA, 19 nt, Human
ggcuauucagguucagggg

SEQ ID NO: 624935 - RNA, 21 nt, Human
gggaggcugggggagaggaag

SEQ ID NO: 624936 - RNA, 21 nt, Human
gggccgcccccucggugcugc

SEQ ID NO: 624937 - RNA, 24 nt, Human
ggggacccagcucugucccgcccc

SEQ ID NO: 624938 - RNA, 18 nt, Human
ggggagaggaagaugaug

SEQ ID NO: 624939 - RNA, 21 nt, Human
ggggagcggcucgccccgggg

SEQ ID NO: 624940 - RNA, 19 nt, Human
ggggagggcaaagggaagg

SEQ ID NO: 624941 - RNA, 19 nt, Human
gggggacccagcucugucc

SEQ ID NO: 624942 - RNA, 18 nt, Human
gggugguggugguggugg

SEQ ID NO: 624943 - RNA, 25 nt, Human
ggucgaggaggagcagggggaccca

SEQ ID NO: 624944 - RNA, 19 nt, Human
ggugccagaggcauaggga

SEQ ID NO: 624945 - RNA, 19 nt, Human
ggugcgguggcaccguggg

SEQ ID NO: 624946 - RNA, 21 nt, Human
gguggugcuguccccgguguc

SEQ ID NO: 624947 - RNA, 20 nt, Human
gucccggccccgaaaccacu

SEQ ID NO: 624948 - RNA, 23 nt, Human
guggugguggugguggcggccuc

SEQ ID NO: 624949 - RNA, 19 nt, Human
guugauggcuguguugagu

SEQ ID NO: 624950 - RNA, 21 nt, Human
uaccacccggccgcgagcgcg

SEQ ID NO: 624951 - RNA, 21 nt, Human
uaggacgucccggccccgaaa

SEQ ID NO: 624952 - RNA, 22 nt, Human
ucagacuacgaaccaacuuaac

SEQ ID NO: 624953 - RNA, 22 nt, Human
ucccacugggggagggcaaagg

SEQ ID NO: 624954 - RNA, 29 nt, Human
ucccaugcccuaagagaacagagguuggg

SEQ ID NO: 624955 - RNA, 24 nt, Human
ucccgccgcggagcuccccagagg

SEQ ID NO: 624956 - RNA, 20 nt, Human
ucccggccccgaaaccacuc

SEQ ID NO: 624957 - RNA, 20 nt, Human
ucccugcaguugauggcugu

SEQ ID NO: 624958 - RNA, 19 nt, Human
uccggcugccugcugcugc

SEQ ID NO: 624959 - RNA, 20 nt, Human
uccucuugcccccgcccccc

SEQ ID NO: 624960 - RNA, 18 nt, Human
ucgggaggaggaagaugg

SEQ ID NO: 624961 - RNA, 23 nt, Human
ucucacauugaaaacccaacccc

SEQ ID NO: 624962 - RNA, 18 nt, Human
ucuugcccccgccccccc

SEQ ID NO: 624963 - RNA, 20 nt, Human
ucuugcccccgcccccccca

SEQ ID NO: 624964 - RNA, 22 nt, Human
ugaaaacccaacccccucuccc

SEQ ID NO: 624965 - RNA, 19 nt, Human
ugaagccucccccgccucc

SEQ ID NO: 624966 - RNA, 21 nt, Human
ugagaggggcugugggcggca

SEQ ID NO: 624967 - RNA, 18 nt, Human
ugagcggcggcggcgggc

SEQ ID NO: 624968 - RNA, 22 nt, Human
ugaggcagcuggaggggcugau

SEQ ID NO: 624969 - RNA, 19 nt, Human
ugcagagauaacugaggca

SEQ ID NO: 624970 - RNA, 19 nt, Human
ugcaggcaguggguggugg

SEQ ID NO: 624971 - RNA, 24 nt, Human
ugcaggcaguggguggugguggug

SEQ ID NO: 624972 - RNA, 25 nt, Human
ugccugcugcugcugguggugcugu

SEQ ID NO: 624973 - RNA, 20 nt, Human
ugcgcaggugccagaggcau

SEQ ID NO: 624974 - RNA, 20 nt, Human
ugcgcuguugcuuuuugaag

SEQ ID NO: 624975 - RNA, 22 nt, Human
ugcgugccucccugccagucuu

SEQ ID NO: 624976 - RNA, 24 nt, Human
ugcugcgccuggggaccacuggag

SEQ ID NO: 624977 - RNA, 19 nt, Human
uggaacccuggccuccacc

SEQ ID NO: 624978 - RNA, 21 nt, Human
uggaggggcugauagggagcc

SEQ ID NO: 624979 - RNA, 22 nt, Human
uggcaccguggggccgcccccu

SEQ ID NO: 624980 - RNA, 18 nt, Human
ugggaggcugggggagag

SEQ ID NO: 624981 - RNA, 21 nt, Human
uggggaccacuggaggaggug

SEQ ID NO: 624982 - RNA, 23 nt, Human
uggggaccacuggaggagguggc

SEQ ID NO: 624983 - RNA, 22 nt, Human
ugggggagaggaagaugauggu

SEQ ID NO: 624984 - RNA, 24 nt, Human
ugggggagaggaagaugaugguga

SEQ ID NO: 624985 - RNA, 18 nt, Human
ugggugguggugguggug

SEQ ID NO: 624986 - RNA, 23 nt, Human
uggugcgguggcaccguggggcc

SEQ ID NO: 624987 - RNA, 20 nt, Human
uggugguggugguggcggcc

SEQ ID NO: 624988 - RNA, 21 nt, Human
ugucgggaggaggaagauggg

SEQ ID NO: 624989 - RNA, 22 nt, Human
uuacagcuauuucuccucuugc

SEQ ID NO: 624990 - RNA, 21 nt, Human
uuccucauccaggaggcuauu

SEQ ID NO: 624991 - RNA, 22 nt, Human
uuccuccccuuauuccgugcca

SEQ ID NO: 624992 - RNA, 19 nt, Human
uuugaagccucccccgccu

SEQ ID NO: 624993 - RNA, 19 nt, Human
uuuuccuuggaacccuggc

SEQ ID NO: 624994 - RNA, 22 nt, Human
uuuuccuuggaacccuggccuc

SEQ ID NO: 624995 - RNA, 20 nt, Human
uuuuuuuuuuuuugggggcc

SEQ ID NO: 624996 - RNA, 20 nt, Human
uuuuuuuuuuuuuuuggggg

SEQ ID NO: 624997 - RNA, 22 nt, Human
uuuuuuuuuuuuuuuuuggggg

SEQ ID NO: 624998 - RNA, 24 nt, Human
aaaguaaauuuauugaagcauaga

SEQ ID NO: 624999 - RNA, 22 nt, Human
cagaaagaugccuagauugaug

SEQ ID NO: 625000 - RNA, 19 nt, Human
guccuucuugauuuuuuuu

SEQ ID NO: 625001 - RNA, 19 nt, Human
uaagaagaugcagaaaagu

SEQ ID NO: 625002 - RNA, 23 nt, Human
uccuucuugauuuuuuuuuucuu

SEQ ID NO: 625003 - RNA, 25 nt, Human
ugaagcauagaaacaauuaaagcaa

SEQ ID NO: 625004 - RNA, 22 nt, Human
uuaaagcaaaguuguuaauuca

SEQ ID NO: 625005 - RNA, 24 nt, Human
uucuucgcuuguguccuucuugau

SEQ ID NO: 625006 - RNA, 21 nt, Human
uucuugauuuuuuuuuucuuu

SEQ ID NO: 625007 - RNA, 22 nt, Human
uuuauugaagcauagaaacaau

SEQ ID NO: 625008 - RNA, 21 nt, Human
uuuuuuuucuuugaaagacac

SEQ ID NO: 625009 - RNA, 24 nt, Human
uuuuuuuuuuuuuuuuuuaacuug

SEQ ID NO: 625010 - RNA, 22 nt, Human
uagaauaacagcagacuuuaag

SEQ ID NO: 625011 - RNA, 21 nt, Human
ucagguagagcagucaaagaa

SEQ ID NO: 625012 - RNA, 21 nt, Human
uucagguagagcagucaaaga

SEQ ID NO: 625013 - RNA, 21 nt, Human
acaccgcugcagccaaaacag

SEQ ID NO: 625014 - RNA, 23 nt, Human
acaccgcugcagccaaaacaggc

SEQ ID NO: 625015 - RNA, 19 nt, Human
accagcaggugaaagcacc

SEQ ID NO: 625016 - RNA, 19 nt, Human
caccugcggcccuagaauu

SEQ ID NO: 625017 - RNA, 20 nt, Human
caccugcggcccuagaauuc

SEQ ID NO: 625018 - RNA, 21 nt, Human
cagccaaaacaggcucccacg

SEQ ID NO: 625019 - RNA, 24 nt, Human
ccagcaggugaaagcaccuuuucc

SEQ ID NO: 625020 - RNA, 20 nt, Human
cccagacaccgcugcagcca

SEQ ID NO: 625021 - RNA, 19 nt, Human
ccccagacaccgcugcagc

SEQ ID NO: 625022 - RNA, 19 nt, Human
ccccagacaccgcugcagc

SEQ ID NO: 625023 - RNA, 20 nt, Human
ccccagacaccgcugcagcc

SEQ ID NO: 625024 - RNA, 25 nt, Human
gcucccacgagggccacacgggagu

SEQ ID NO: 625025 - RNA, 23 nt, Human
guggcgacaguuaccguaaauac

SEQ ID NO: 625026 - RNA, 20 nt, Human
uacaccugcggcccuagaau

SEQ ID NO: 625027 - RNA, 22 nt, Human
ucuuuuaccagcaggugaaagc

SEQ ID NO: 625028 - RNA, 19 nt, Human
aaaaaacaacgaaacaaca

SEQ ID NO: 625029 - RNA, 19 nt, Human
aaaaacaagcauuagaaga

SEQ ID NO: 625030 - RNA, 26 nt, Human
aaaaacuagugaaaacuucauguaua

SEQ ID NO: 625031 - RNA, 22 nt, Human
aaaacaacgaaacaacaaaccc

SEQ ID NO: 625032 - RNA, 24 nt, Human
aaacaaaaaaaaaacaaaaaacaa

SEQ ID NO: 625033 - RNA, 21 nt, Human
aaacaaaaaacaacgaaacaa

SEQ ID NO: 625034 - RNA, 24 nt, Human
aaacaaaacaaaaguacuugcuaa

SEQ ID NO: 625035 - RNA, 18 nt, Human
aaacaaaagccuuuaaac

SEQ ID NO: 625036 - RNA, 24 nt, Human
aaacaacaacaaaaaccucuauac

SEQ ID NO: 625037 - RNA, 26 nt, Human
aaacaacaacaaaaaccucuauacaa

SEQ ID NO: 625038 - RNA, 18 nt, Human
aaacaggcacaaaacacu

SEQ ID NO: 625039 - RNA, 21 nt, Human
aaacaggcacaaaacacugca

SEQ ID NO: 625040 - RNA, 25 nt, Human
aaacaggcacaaaacacugcaacaa

SEQ ID NO: 625041 - RNA, 24 nt, Human
aaacaggcacaaaacacugcaacu

SEQ ID NO: 625042 - RNA, 20 nt, Human
aaacucaucucauuucaaga

SEQ ID NO: 625043 - RNA, 21 nt, Human
aacaaaaacccaggaagaagu

SEQ ID NO: 625044 - RNA, 22 nt, Human
aacaaaaacccaggaagaagua

SEQ ID NO: 625045 - RNA, 22 nt, Human
aacaaaccccaacaaaaaccca

SEQ ID NO: 625046 - RNA, 25 nt, Human
aacaacaaaaaccucuauacaaaug

SEQ ID NO: 625047 - RNA, 19 nt, Human
aacgaaacaacaaacccca

SEQ ID NO: 625048 - RNA, 25 nt, Human
aacgaaacaacaaaccccaacaaaa

SEQ ID NO: 625049 - RNA, 18 nt, Human
aacuucuccaacauaaaa

SEQ ID NO: 625050 - RNA, 18 nt, Human
aagcauuagaaauggcau

SEQ ID NO: 625051 - RNA, 20 nt, Human
aauaacauugaaauaaaaug

SEQ ID NO: 625052 - RNA, 24 nt, Human
aauucagaaauaaaucugcuaaca

SEQ ID NO: 625053 - RNA, 19 nt, Human
acaaaaacccaggaagaag

SEQ ID NO: 625054 - RNA, 25 nt, Human
acaacaacaaaaaccucuauacaaa

SEQ ID NO: 625055 - RNA, 20 nt, Human
acaccaucaacccuuaaugc

SEQ ID NO: 625056 - RNA, 19 nt, Human
acaccccaauccaguucac

SEQ ID NO: 625057 - RNA, 27 nt, Human
acaggcacaaaacacugcaacaauaca

SEQ ID NO: 625058 - RNA, 23 nt, Human
acauaccaugaacuucuccaaca

SEQ ID NO: 625059 - RNA, 21 nt, Human
accucacuuccuugauugagc

SEQ ID NO: 625060 - RNA, 21 nt, Human
agaagauauuuacaaacuauc

SEQ ID NO: 625061 - RNA, 24 nt, Human
agccaucaacaaaaaucccgugag

SEQ ID NO: 625062 - RNA, 21 nt, Human
aggcaugcuaaguugaaaaua

SEQ ID NO: 625063 - RNA, 19 nt, Human
auggagaaugagccccggc

SEQ ID NO: 625064 - RNA, 19 nt, Human
auggaucucuaacaugaca

SEQ ID NO: 625065 - RNA, 22 nt, Human
caaaaaacaacgaaacaacaaa

SEQ ID NO: 625066 - RNA, 22 nt, Human
caaaauagaaaucucuggagug

SEQ ID NO: 625067 - RNA, 24 nt, Human
caaaauaguucccuagcuccucaa

SEQ ID NO: 625068 - RNA, 22 nt, Human
caacauaaaaggacuaaaaaca

SEQ ID NO: 625069 - RNA, 26 nt, Human
caacgaaacaacaaaccccaacaaaa

SEQ ID NO: 625070 - RNA, 30 nt, Human
caacgaaacaacaaaccccaacaaaaaccc

SEQ ID NO: 625071 - RNA, 20 nt, Human
caagaaacaugguaaggcaa

SEQ ID NO: 625072 - RNA, 21 nt, Human
cacaaaacacugcaacaauac

SEQ ID NO: 625073 - RNA, 23 nt, Human
cacaaaacacugcaacaauacau

SEQ ID NO: 625074 - RNA, 21 nt, Human
cacccuugaggaccauggaca

SEQ ID NO: 625075 - RNA, 19 nt, Human
caggaagaaguauaaaagc

SEQ ID NO: 625076 - RNA, 22 nt, Human
caggcacaaaacacugcaacaa

SEQ ID NO: 625077 - RNA, 20 nt, Human
caucaagugcacagcaaagg

SEQ ID NO: 625078 - RNA, 20 nt, Human
caugcuaaguugaaaauagu

SEQ ID NO: 625079 - RNA, 22 nt, Human
cauggagaaugagccccggcua

SEQ ID NO: 625080 - RNA, 18 nt, Human
cauucacucugcuaaaca

SEQ ID NO: 625081 - RNA, 24 nt, Human
ccaaacaaaaaaaaaacaaaaaac

SEQ ID NO: 625082 - RNA, 18 nt, Human
ccagcagaaauacagagg

SEQ ID NO: 625083 - RNA, 23 nt, Human
cccaacaaaaacccaggaagaag

SEQ ID NO: 625084 - RNA, 23 nt, Human
cccaggaagaaguauaaaagcca

SEQ ID NO: 625085 - RNA, 21 nt, Human
ccccaauccaguucacccauc

SEQ ID NO: 625086 - RNA, 22 nt, Human
ccucacuuccuugauugagccu

SEQ ID NO: 625087 - RNA, 18 nt, Human
ccuggaugugcacacccc

SEQ ID NO: 625088 - RNA, 22 nt, Human
cuuaaaaaaacaacaacaaaaa

SEQ ID NO: 625089 - RNA, 22 nt, Human
cuuccccaaccaaacaaaaaaa

SEQ ID NO: 625090 - RNA, 23 nt, Human
cuuucugcugaaaagagucucug

SEQ ID NO: 625091 - RNA, 19 nt, Human
cuuucuuccucuucuucuu

SEQ ID NO: 625092 - RNA, 22 nt, Human
gacagggugagagaugugggag

SEQ ID NO: 625093 - RNA, 20 nt, Human
gaguuugaaugcagcugugg

SEQ ID NO: 625094 - RNA, 21 nt, Human
gauaacauacauucuuugucc

SEQ ID NO: 625095 - RNA, 21 nt, Human
gcaaauccuuauguggauggg

SEQ ID NO: 625096 - RNA, 20 nt, Human
gccuuuaaacaggcacaaaa

SEQ ID NO: 625097 - RNA, 18 nt, Human
ggacucagaagugcggca

SEQ ID NO: 625098 - RNA, 19 nt, Human
ggacucagaagugcggcaa

SEQ ID NO: 625099 - RNA, 19 nt, Human
ggacucagaagugcggcaa

SEQ ID NO: 625100 - RNA, 21 nt, Human
gggaaaaaggcauuugggaau

SEQ ID NO: 625101 - RNA, 20 nt, Human
gggaaucuggggaggagggg

SEQ ID NO: 625102 - RNA, 21 nt, Human
guaaggcaacuagaagcauaa

SEQ ID NO: 625103 - RNA, 20 nt, Human
guggcaaggagagcuuucca

SEQ ID NO: 625104 - RNA, 20 nt, Human
guucaauuuuugcagugccc

SEQ ID NO: 625105 - RNA, 20 nt, Human
guucacccaucaagugcaca

SEQ ID NO: 625106 - RNA, 22 nt, Human
uaaaaaacuagugaaaacuuca

SEQ ID NO: 625107 - RNA, 23 nt, Human
uaaaaaguagaugacaaucuuaa

SEQ ID NO: 625108 - RNA, 22 nt, Human
uaaacaggcacaaaacacugca

SEQ ID NO: 625109 - RNA, 29 nt, Human
uaaacaggcacaaaacacugcaacaauac

SEQ ID NO: 625110 - RNA, 19 nt, Human
uaaguugaaaauagucuua

SEQ ID NO: 625111 - RNA, 22 nt, Human
uacauaccaugaacuucuccaa

SEQ ID NO: 625112 - RNA, 25 nt, Human
uaccaugaacuucuccaacauaaaa

SEQ ID NO: 625113 - RNA, 22 nt, Human
uacuuuuuucacacagucaggg

SEQ ID NO: 625114 - RNA, 20 nt, Human
uagaagauauuuacaaacua

SEQ ID NO: 625115 - RNA, 19 nt, Human
uaguacagcauacaaauuu

SEQ ID NO: 625116 - RNA, 23 nt, Human
uauuuuacauucacucugcuaaa

SEQ ID NO: 625117 - RNA, 23 nt, Human
ucaagaugagggggaaaaaggca

SEQ ID NO: 625118 - RNA, 21 nt, Human
ucacacagucaggggaugagg

SEQ ID NO: 625119 - RNA, 21 nt, Human
ucacuagaaggagaguacuuu

SEQ ID NO: 625120 - RNA, 24 nt, Human
uccacagcuggcggaaaccaaaac

SEQ ID NO: 625121 - RNA, 24 nt, Human
uccaucuuauuuucaauguccucc

SEQ ID NO: 625122 - RNA, 31 nt, Human
uccccaaccaaacaaaaaaaaaacaaaaaaa

SEQ ID NO: 625123 - RNA, 19 nt, Human
ucccgugaguggaaaauug

SEQ ID NO: 625124 - RNA, 22 nt, Human
uccuuauguggauggguuccau

SEQ ID NO: 625125 - RNA, 25 nt, Human
uccuuuauaagucgcagaacgagag

SEQ ID NO: 625126 - RNA, 19 nt, Human
ucuuucuuccucuucuucu

SEQ ID NO: 625127 - RNA, 21 nt, Human
ugaaaagagucucuggggguc

SEQ ID NO: 625128 - RNA, 24 nt, Human
ugaaaauagcacacguagaagaca

SEQ ID NO: 625129 - RNA, 24 nt, Human
ugaaggcacgaaccauugcaaguc

SEQ ID NO: 625130 - RNA, 20 nt, Human
ugagggggaaaaaggcauuu

SEQ ID NO: 625131 - RNA, 19 nt, Human
ugaguggaaaauuguaugg

SEQ ID NO: 625132 - RNA, 18 nt, Human
uggcggaaaccaaaacca

SEQ ID NO: 625133 - RNA, 24 nt, Human
ugggagugggggcauguuuaaggc

SEQ ID NO: 625134 - RNA, 25 nt, Human
ugggagugggggcauguuuaaggcu

SEQ ID NO: 625135 - RNA, 18 nt, Human
uggggaggaggggacagg

SEQ ID NO: 625136 - RNA, 24 nt, Human
uggggaggaggggacagggugaag

SEQ ID NO: 625137 - RNA, 18 nt, Human
uuaaaaaauaguaccgcc

SEQ ID NO: 625138 - RNA, 23 nt, Human
uuaaaacaaaacaaaaguacuug

SEQ ID NO: 625139 - RNA, 25 nt, Human
uuauuuuuuuuuucuacuguucuuu

SEQ ID NO: 625140 - RNA, 21 nt, Human
uucaaaauaguucccuagcuc

SEQ ID NO: 625141 - RNA, 18 nt, Human
uucaagaugagggggaaa

SEQ ID NO: 625142 - RNA, 21 nt, Human
uuccccaaccaaacaaaaaaa

SEQ ID NO: 625143 - RNA, 23 nt, Human
uucuucauaaauagucaagcguu

SEQ ID NO: 625144 - RNA, 22 nt, Human
uugucccuacaaacucauacuu

SEQ ID NO: 625145 - RNA, 21 nt, Human
uuucaauguccuccuguugca

SEQ ID NO: 625146 - RNA, 19 nt, Human
uuuggucgagucacucauu

SEQ ID NO: 625147 - RNA, 23 nt, Human
uuugucccuacaaacucauacuu

SEQ ID NO: 625148 - RNA, 24 nt, Human
aaaaaaaaaaaaaacagacauaaa

SEQ ID NO: 625149 - RNA, 27 nt, Human
aaaaaaaaaaaaaacagacauaaacaa

SEQ ID NO: 625150 - RNA, 25 nt, Human
aaaaaaaaacagacauaaacaagaa

SEQ ID NO: 625151 - RNA, 18 nt, Human
aaaaaaacagacauaaac

SEQ ID NO: 625152 - RNA, 25 nt, Human
aaaaaaacagacauaaacaagaaaa

SEQ ID NO: 625153 - RNA, 24 nt, Human
aaaaaacagacauaaacaagaaaa

SEQ ID NO: 625154 - RNA, 26 nt, Human
aaacaagaaaaucacaaaaguacaaa

SEQ ID NO: 625155 - RNA, 21 nt, Human
aaacccaccuccaacaccaaa

SEQ ID NO: 625156 - RNA, 20 nt, Human
aagaaaaucacaaaaguaca

SEQ ID NO: 625157 - RNA, 23 nt, Human
aauauccuuucuugucaaguggc

SEQ ID NO: 625158 - RNA, 26 nt, Human
aauguuauuagauucucaccaaccaa

SEQ ID NO: 625159 - RNA, 23 nt, Human
acaaaaguacaaaaacuucacua

SEQ ID NO: 625160 - RNA, 21 nt, Human
acacuggacugucagcuauau

SEQ ID NO: 625161 - RNA, 21 nt, Human
acagacaaugcacaaugggac

SEQ ID NO: 625162 - RNA, 21 nt, Human
agaaacccaccuccaacacca

SEQ ID NO: 625163 - RNA, 23 nt, Human
agaagaggagccugggagaggcc

SEQ ID NO: 625164 - RNA, 22 nt, Human
agccccaggugagaaacccacc

SEQ ID NO: 625165 - RNA, 25 nt, Human
aggcuccuagcaauagaaaaaguuu

SEQ ID NO: 625166 - RNA, 19 nt, Human
augcacaaugggacaggag

SEQ ID NO: 625167 - RNA, 24 nt, Human
caaaaguacaaaaacuucacuaaa

SEQ ID NO: 625168 - RNA, 20 nt, Human
caaccacugauggggcacca

SEQ ID NO: 625169 - RNA, 22 nt, Human
caacuuauugagaauaaagucu

SEQ ID NO: 625170 - RNA, 24 nt, Human
caacuuuguacugcaucuugcccc

SEQ ID NO: 625171 - RNA, 22 nt, Human
cacaauuuaagguggagcccca

SEQ ID NO: 625172 - RNA, 31 nt, Human
cacacaaauguuaaaaaaaaaaaaaaaaaaa

SEQ ID NO: 625173 - RNA, 23 nt, Human
cagcaacaucucguagagcccca

SEQ ID NO: 625174 - RNA, 24 nt, Human
caggcagacagcugagcuguggca

SEQ ID NO: 625175 - RNA, 24 nt, Human
caugacaaauauuagugaaaccug

SEQ ID NO: 625176 - RNA, 23 nt, Human
ccaacaucccccuccuauccucc

SEQ ID NO: 625177 - RNA, 26 nt, Human
ccagaccucugguuaucagauaugau

SEQ ID NO: 625178 - RNA, 21 nt, Human
ccaugcauauuuuccuuuccu

SEQ ID NO: 625179 - RNA, 24 nt, Human
ccuccuauccuccccucuuugcaa

SEQ ID NO: 625180 - RNA, 22 nt, Human
ccucgucuaucgccggcgcgaa

SEQ ID NO: 625181 - RNA, 19 nt, Human
cuagcaauagaaaaaguuu

SEQ ID NO: 625182 - RNA, 19 nt, Human
cucgucucucucacaucuu

SEQ ID NO: 625183 - RNA, 18 nt, Human
cuugccuuccaaaauugc

SEQ ID NO: 625184 - RNA, 18 nt, Human
gacaaugcacaaugggac

SEQ ID NO: 625185 - RNA, 21 nt, Human
gagaggccaacaucccccucc

SEQ ID NO: 625186 - RNA, 20 nt, Human
gauccacauuuuugcaaugu

SEQ ID NO: 625187 - RNA, 18 nt, Human
gccccagcauuuuaaugu

SEQ ID NO: 625188 - RNA, 19 nt, Human
gugucccuuguugcacuag

SEQ ID NO: 625189 - RNA, 20 nt, Human
guucucgucucucucacauc

SEQ ID NO: 625190 - RNA, 19 nt, Human
uaaaaugguucucgucucu

SEQ ID NO: 625191 - RNA, 21 nt, Human
uaagacagaauuucuuugugu

SEQ ID NO: 625192 - RNA, 23 nt, Human
uaagguggagccccagcaacauc

SEQ ID NO: 625193 - RNA, 24 nt, Human
uacagcaugacaaauauuagugaa

SEQ ID NO: 625194 - RNA, 26 nt, Human
uacuucacagguaguucacucccuua

SEQ ID NO: 625195 - RNA, 20 nt, Human
ucacaucuugccuuccaaaa

SEQ ID NO: 625196 - RNA, 22 nt, Human
ucagaagacugaaguucuucau

SEQ ID NO: 625197 - RNA, 21 nt, Human
ucucacaucuugccuuccaaa

SEQ ID NO: 625198 - RNA, 22 nt, Human
ucucacaucuugccuuccaaaa

SEQ ID NO: 625199 - RNA, 24 nt, Human
ucuuugugucccuuguugcacuag

SEQ ID NO: 625200 - RNA, 21 nt, Human
ugacacaaaaccuuuuuugca

SEQ ID NO: 625201 - RNA, 21 nt, Human
ugacuuauggagacaaccacu

SEQ ID NO: 625202 - RNA, 21 nt, Human
ugagaacagcauaaugcagca

SEQ ID NO: 625203 - RNA, 21 nt, Human
ugagaauaaagucucuucaac

SEQ ID NO: 625204 - RNA, 22 nt, Human
ugcaauguuuacaacaaagugg

SEQ ID NO: 625205 - RNA, 20 nt, Human
ugccccagcauuuuaauguu

SEQ ID NO: 625206 - RNA, 25 nt, Human
ugcgcaaacugagaggaaagagaaa

SEQ ID NO: 625207 - RNA, 23 nt, Human
ugggacaggagagcuuggacucc

SEQ ID NO: 625208 - RNA, 23 nt, Human
uguuuacaacaaaguggcaggca

SEQ ID NO: 625209 - RNA, 21 nt, Human
uuccugagauaaguucugcua

SEQ ID NO: 625210 - RNA, 20 nt, Human
uucuccgcugcuguuggcgu

SEQ ID NO: 625211 - RNA, 22 nt, Human
uugcuaguuuuguaaguugcau

SEQ ID NO: 625212 - RNA, 19 nt, Human
uuguacugcaucuugcccc

SEQ ID NO: 625213 - RNA, 22 nt, Human
uuucuugucaaguggcugugaa

SEQ ID NO: 625214 - RNA, 21 nt, Human
aaaagccaauuaaaacagagc

SEQ ID NO: 625215 - RNA, 26 nt, Human
aaacaaacaguagcuugaaaagaaca

SEQ ID NO: 625216 - RNA, 21 nt, Human
aaagcagcugcauguaaccuc

SEQ ID NO: 625217 - RNA, 20 nt, Human
aaauaaccccccaccugccc

SEQ ID NO: 625218 - RNA, 19 nt, Human
aaauaacccuguaacgaga

SEQ ID NO: 625219 - RNA, 22 nt, Human
aaccccccaccugccccaucuc

SEQ ID NO: 625220 - RNA, 18 nt, Human
aacugggcuguaggcuac

SEQ ID NO: 625221 - RNA, 22 nt, Human
aagaaaucaacaugugcacaaa

SEQ ID NO: 625222 - RNA, 24 nt, Human
aagcagcugcauguaaccuccuuc

SEQ ID NO: 625223 - RNA, 19 nt, Human
acuagauucuucccagacu

SEQ ID NO: 625224 - RNA, 24 nt, Human
agaaaaacaaacaguagcuugaaa

SEQ ID NO: 625225 - RNA, 20 nt, Human
agaagacaaacacagccaga

SEQ ID NO: 625226 - RNA, 25 nt, Human
agaaucacaaaugcgaggcaggaca

SEQ ID NO: 625227 - RNA, 18 nt, Human
agacacugacagauggca

SEQ ID NO: 625228 - RNA, 23 nt, Human
agugcuggagauguuugacaaag

SEQ ID NO: 625229 - RNA, 24 nt, Human
aguuaaagcaggucgcacugagcu

SEQ ID NO: 625230 - RNA, 21 nt, Human
aguuaguccuuacaagaaagu

SEQ ID NO: 625231 - RNA, 18 nt, Human
aguugcuuguaaaucuga

SEQ ID NO: 625232 - RNA, 21 nt, Human
auaauacacaaaccauuucac

SEQ ID NO: 625233 - RNA, 22 nt, Human
aucgucauaacccaaaauaaaa

SEQ ID NO: 625234 - RNA, 23 nt, Human
augaagauucagugguacaaaua

SEQ ID NO: 625235 - RNA, 18 nt, Human
auggcaaggaucugacag

SEQ ID NO: 625236 - RNA, 19 nt, Human
auggcaaggaucugacaga

SEQ ID NO: 625237 - RNA, 18 nt, Human
auuguuggcuuuuucuuu

SEQ ID NO: 625238 - RNA, 19 nt, Human
caaaacaaggcuuugacaa

SEQ ID NO: 625239 - RNA, 23 nt, Human
caaacaaaagcaucacguggaaa

SEQ ID NO: 625240 - RNA, 20 nt, Human
caaacaugaucgucauaacc

SEQ ID NO: 625241 - RNA, 20 nt, Human
cacauuuuuugacagcucug

SEQ ID NO: 625242 - RNA, 23 nt, Human
caccacuaagaaauuaguuaaga

SEQ ID NO: 625243 - RNA, 18 nt, Human
caccaugagcaacaggag

SEQ ID NO: 625244 - RNA, 18 nt, Human
cacuguauaugguagagc

SEQ ID NO: 625245 - RNA, 20 nt, Human
cagaagacaaacacagccag

SEQ ID NO: 625246 - RNA, 21 nt, Human
cagaagacaaacacagccaga

SEQ ID NO: 625247 - RNA, 21 nt, Human
cagaaucacaaaugcgaggca

SEQ ID NO: 625248 - RNA, 23 nt, Human
caggcagacacugacagauggca

SEQ ID NO: 625249 - RNA, 20 nt, Human
cauaaauacuucagguucac

SEQ ID NO: 625250 - RNA, 23 nt, Human
cauaacccaaaauaaaaagacaa

SEQ ID NO: 625251 - RNA, 20 nt, Human
cccaucucccuauuacaaca

SEQ ID NO: 625252 - RNA, 27 nt, Human
ccccaaaagcagcugcauguaaccucc

SEQ ID NO: 625253 - RNA, 21 nt, Human
ccccaccugccccaucucccu

SEQ ID NO: 625254 - RNA, 20 nt, Human
cccccaccugccccaucucc

SEQ ID NO: 625255 - RNA, 22 nt, Human
ccccccaccugccccaucuccc

SEQ ID NO: 625256 - RNA, 24 nt, Human
ccccucaaaacaguaaagaaccaa

SEQ ID NO: 625257 - RNA, 21 nt, Human
ccuaccgaggcuacaucggca

SEQ ID NO: 625258 - RNA, 18 nt, Human
ccuauuauaauaacccau

SEQ ID NO: 625259 - RNA, 21 nt, Human
cuacuucuucguaaugccaaa

SEQ ID NO: 625260 - RNA, 21 nt, Human
cuuguaaaucugaggaaucac

SEQ ID NO: 625261 - RNA, 24 nt, Human
cuuguaaaucugaggaaucacuac

SEQ ID NO: 625262 - RNA, 20 nt, Human
gaaaaacaaacaguagcuug

SEQ ID NO: 625263 - RNA, 19 nt, Human
gaagcaaauccugcuuuua

SEQ ID NO: 625264 - RNA, 20 nt, Human
gacaagaacaagggaaucua

SEQ ID NO: 625265 - RNA, 18 nt, Human
gagggaagacaauccugu

SEQ ID NO: 625266 - RNA, 23 nt, Human
gauggaaacauuagugcuggaga

SEQ ID NO: 625267 - RNA, 19 nt, Human
gauggcaaggaucugacag

SEQ ID NO: 625268 - RNA, 21 nt, Human
gauggcaaggaucugacagau

SEQ ID NO: 625269 - RNA, 19 nt, Human
gauucagugguacaaauaa

SEQ ID NO: 625270 - RNA, 20 nt, Human
gcagacacugacagauggca

SEQ ID NO: 625271 - RNA, 23 nt, Human
gucauaacccaaaauaaaaagac

SEQ ID NO: 625272 - RNA, 20 nt, Human
gugguacaaauaaccccccc

SEQ ID NO: 625273 - RNA, 22 nt, Human
uaaaaacaauguauggaaaugc

SEQ ID NO: 625274 - RNA, 23 nt, Human
uaaaacuucucauaaaaccacug

SEQ ID NO: 625275 - RNA, 19 nt, Human
uaacagaaucacaaaugcg

SEQ ID NO: 625276 - RNA, 24 nt, Human
uaacagaaucacaaaugcgaggca

SEQ ID NO: 625277 - RNA, 23 nt, Human
uaaccccccaccugccccaucuc

SEQ ID NO: 625278 - RNA, 24 nt, Human
uaauaacccauauacagguugcac

SEQ ID NO: 625279 - RNA, 21 nt, Human
uacaaauaaccccccaccugc

SEQ ID NO: 625280 - RNA, 25 nt, Human
uacaaauaaccccccaccugcccca

SEQ ID NO: 625281 - RNA, 19 nt, Human
uacccucccccaaaagcag

SEQ ID NO: 625282 - RNA, 21 nt, Human
uagccaaaaaaccauaagcac

SEQ ID NO: 625283 - RNA, 22 nt, Human
uagccaaaaaaccauaagcacu

SEQ ID NO: 625284 - RNA, 21 nt, Human
uauagcagugugcacaaauac

SEQ ID NO: 625285 - RNA, 24 nt, Human
uaucagguucaaacaaaagcauca

SEQ ID NO: 625286 - RNA, 19 nt, Human
uauuguuggcuuuuucuuu

SEQ ID NO: 625287 - RNA, 19 nt, Human
ucaaaacaguaaagaacca

SEQ ID NO: 625288 - RNA, 18 nt, Human
ugaaaagaacaguuaguc

SEQ ID NO: 625289 - RNA, 23 nt, Human
ugaagaugcaccacuguauaugg

SEQ ID NO: 625290 - RNA, 23 nt, Human
ugaauaaugucacauuauauaaa

SEQ ID NO: 625291 - RNA, 22 nt, Human
ugacaagaacaagggaaucuaa

SEQ ID NO: 625292 - RNA, 18 nt, Human
ugacaauaguccuuuguc

SEQ ID NO: 625293 - RNA, 21 nt, Human
ugagguggugaauaucuucug

SEQ ID NO: 625294 - RNA, 19 nt, Human
ugaucgucauaacccaaaa

SEQ ID NO: 625295 - RNA, 21 nt, Human
ugcaugcacucaugcaacuug

SEQ ID NO: 625296 - RNA, 21 nt, Human
ugccugaaaaaucuagcucaa

SEQ ID NO: 625297 - RNA, 23 nt, Human
uggcaaggaucugacagauagug

SEQ ID NO: 625298 - RNA, 22 nt, Human
ugggaaaaaguuauuaaagcag

SEQ ID NO: 625299 - RNA, 23 nt, Human
uguaaaacaaaacaaggcuuuga

SEQ ID NO: 625300 - RNA, 21 nt, Human
uguaguugcuuguaaaucuga

SEQ ID NO: 625301 - RNA, 20 nt, Human
ugucugcaugcacucaugca

SEQ ID NO: 625302 - RNA, 24 nt, Human
uguugggacagcuaauguaagaca

SEQ ID NO: 625303 - RNA, 18 nt, Human
uuaaaauaaaaauagcac

SEQ ID NO: 625304 - RNA, 23 nt, Human
uuacaaguaaaagugcacauagg

SEQ ID NO: 625305 - RNA, 21 nt, Human
uucaaagaguucuuucaacug

SEQ ID NO: 625306 - RNA, 21 nt, Human
uucuguguuuauuaugccagg

SEQ ID NO: 625307 - RNA, 21 nt, Human
uugcacuacaaauguaaaaca

SEQ ID NO: 625308 - RNA, 22 nt, Human
uugggggaggcccauaaaacuu

SEQ ID NO: 625309 - RNA, 24 nt, Human
uuucaacugggcuguaggcuacag

SEQ ID NO: 625310 - RNA, 19 nt, Human
uuucacacaauugucauuc

SEQ ID NO: 625311 - RNA, 18 nt, Human
uuugacaagaacaaggga

SEQ ID NO: 625312 - RNA, 24 nt, Human
uuugacagcucugcauucuuuauu

SEQ ID NO: 625313 - RNA, 19 nt, Human
uuugcacuacaaauguaaa

SEQ ID NO: 625314 - RNA, 26 nt, Human
uuuuuuuuuuuuuuuuuuuuaacagg

SEQ ID NO: 625315 - RNA, 21 nt, Human
aaaacuuuauuaacagacacc

SEQ ID NO: 625316 - RNA, 19 nt, Human
aaaagaagaaaauaaacaa

SEQ ID NO: 625317 - RNA, 22 nt, Human
aaaagaagaaaauaaacaagaa

SEQ ID NO: 625318 - RNA, 23 nt, Human
aaagaagaaaauaaacaagaaaa

SEQ ID NO: 625319 - RNA, 21 nt, Human
aaauauccuucaacuaguuuc

SEQ ID NO: 625320 - RNA, 22 nt, Human
aagaagaaaauaaacaagaaaa

SEQ ID NO: 625321 - RNA, 18 nt, Human
aagagggaaaagaagaaa

SEQ ID NO: 625322 - RNA, 19 nt, Human
aagggcaaaugugggaggc

SEQ ID NO: 625323 - RNA, 20 nt, Human
agaagaccaagggcaaaugu

SEQ ID NO: 625324 - RNA, 18 nt, Human
agagaagaagaaaauguu

SEQ ID NO: 625325 - RNA, 24 nt, Human
agagagaagaagaaaauguuuuug

SEQ ID NO: 625326 - RNA, 18 nt, Human
aggcaggcaccaguaugg

SEQ ID NO: 625327 - RNA, 22 nt, Human
auucuagaaagagagaagacca

SEQ ID NO: 625328 - RNA, 23 nt, Human
auugcaaugcauguauuccaauc

SEQ ID NO: 625329 - RNA, 21 nt, Human
caaaaggaagcuguaguccca

SEQ ID NO: 625330 - RNA, 22 nt, Human
caagaaaacaaauacaugaaca

SEQ ID NO: 625331 - RNA, 20 nt, Human
caccaguauggugaauuaga

SEQ ID NO: 625332 - RNA, 22 nt, Human
caguaucuccuacauaaaccag

SEQ ID NO: 625333 - RNA, 21 nt, Human
cauaaaccagcacaucaauga

SEQ ID NO: 625334 - RNA, 24 nt, Human
caugaacagauagauaauuuugug

SEQ ID NO: 625335 - RNA, 23 nt, Human
ccaaaaaggguauggcaggaaca

SEQ ID NO: 625336 - RNA, 22 nt, Human
ccagcacaucaaugagagcaga

SEQ ID NO: 625337 - RNA, 23 nt, Human
cccugcaggcuauaaucugccaa

SEQ ID NO: 625338 - RNA, 24 nt, Human
ccugacuauugauaguuggagcag

SEQ ID NO: 625339 - RNA, 21 nt, Human
cuagaaagagagaagaccaag

SEQ ID NO: 625340 - RNA, 24 nt, Human
cuaguaaauaugaggcaaaaggaa

SEQ ID NO: 625341 - RNA, 20 nt, Human
cucauacuacaaaucuguug

SEQ ID NO: 625342 - RNA, 20 nt, Human
cuccuacauaaaccagcaca

SEQ ID NO: 625343 - RNA, 20 nt, Human
cugagggaccggggaaggug

SEQ ID NO: 625344 - RNA, 20 nt, Human
gaaccaaaaaggguauggca

SEQ ID NO: 625345 - RNA, 19 nt, Human
gaagguggagcugaaugau

SEQ ID NO: 625346 - RNA, 20 nt, Human
gaggugggaauguucaggaa

SEQ ID NO: 625347 - RNA, 26 nt, Human
gcuucaauuaaauugucuucaaaggu

SEQ ID NO: 625348 - RNA, 20 nt, Human
gugaaauauccuucaacuag

SEQ ID NO: 625349 - RNA, 18 nt, Human
gugucucugagggaccgg

SEQ ID NO: 625350 - RNA, 21 nt, Human
uaaagagggaaaagaagaaaa

SEQ ID NO: 625351 - RNA, 21 nt, Human
uaacagacaccaaaauuugaa

SEQ ID NO: 625352 - RNA, 18 nt, Human
uaagagagagaagaagaa

SEQ ID NO: 625353 - RNA, 23 nt, Human
uacauacuaaagagggaaaagaa

SEQ ID NO: 625354 - RNA, 24 nt, Human
uacuuuuucuucuuaugcucaggc

SEQ ID NO: 625355 - RNA, 24 nt, Human
uagaaauacacaguaucuccuaca

SEQ ID NO: 625356 - RNA, 27 nt, Human
uauauaauuuucacaugcuauaaaaua

SEQ ID NO: 625357 - RNA, 22 nt, Human
uaugcucaggccaauuugugug

SEQ ID NO: 625358 - RNA, 26 nt, Human
uauuacucaacuguaaugauagagca

SEQ ID NO: 625359 - RNA, 23 nt, Human
ucaugguuaagaauguaacuuua

SEQ ID NO: 625360 - RNA, 20 nt, Human
ucccuggaccacuuauggcc

SEQ ID NO: 625361 - RNA, 23 nt, Human
ucuccuacauaaaccagcacauc

SEQ ID NO: 625362 - RNA, 22 nt, Human
ucucugagggaccggggaaggu

SEQ ID NO: 625363 - RNA, 25 nt, Human
ucucugagggaccggggaaggugga

SEQ ID NO: 625364 - RNA, 24 nt, Human
ugcauguauuccaaucacaccaca

SEQ ID NO: 625365 - RNA, 20 nt, Human
uggaccacuuauggccaucu

SEQ ID NO: 625366 - RNA, 18 nt, Human
uggcaauauuuguauucg

SEQ ID NO: 625367 - RNA, 24 nt, Human
uguaaaaagucuaguuucuucaug

SEQ ID NO: 625368 - RNA, 27 nt, Human
uuagaggaaccaaaaaggguauggcag

SEQ ID NO: 625369 - RNA, 25 nt, Human
uucaacuucuuuccuugcuucaauu

SEQ ID NO: 625370 - RNA, 23 nt, Human
uucuagaaagagagaagaccaag

SEQ ID NO: 625371 - RNA, 18 nt, Human
uugcucccuggaccacuu

SEQ ID NO: 625372 - RNA, 22 nt, Human
uuggguuugugguucccugcaa

SEQ ID NO: 625373 - RNA, 22 nt, Human
uuuauuucaauaaaugcucaag

SEQ ID NO: 625374 - RNA, 18 nt, Human
uuugcucauacuacaaau

SEQ ID NO: 625375 - RNA, 23 nt, Human
aaaaagaaauccaggcccuccag

SEQ ID NO: 625376 - RNA, 22 nt, Human
aaacaagguagccccagccccu

SEQ ID NO: 625377 - RNA, 18 nt, Human
aaagaaauccaggcccuc

SEQ ID NO: 625378 - RNA, 22 nt, Human
aacaagguagccccagccccua

SEQ ID NO: 625379 - RNA, 20 nt, Human
aagagccagccccacccuca

SEQ ID NO: 625380 - RNA, 18 nt, Human
aagggucucugagugagu

SEQ ID NO: 625381 - RNA, 18 nt, Human
aggaggccugguccagug

SEQ ID NO: 625382 - RNA, 23 nt, Human
auccagcuuuggaaaucuggaca

SEQ ID NO: 625383 - RNA, 21 nt, Human
cacaguacccagccccgcagg

SEQ ID NO: 625384 - RNA, 22 nt, Human
cacccucaggggcagcauucca

SEQ ID NO: 625385 - RNA, 23 nt, Human
cacugcucggcccggcucgccgc

SEQ ID NO: 625386 - RNA, 26 nt, Human
cacugcucggcccggcucgccgcggc

SEQ ID NO: 625387 - RNA, 23 nt, Human
cagcauuccagcccaaaaagaaa

SEQ ID NO: 625388 - RNA, 20 nt, Human
cagccccgcaggguccugga

SEQ ID NO: 625389 - RNA, 25 nt, Human
caggggaacccuccccuuggaguua

SEQ ID NO: 625390 - RNA, 25 nt, Human
ccagcccaaaaagaaauccaggccc

SEQ ID NO: 625391 - RNA, 20 nt, Human
ccaggcccuccagguucggc

SEQ ID NO: 625392 - RNA, 19 nt, Human
ccagguacucuccugcccu

SEQ ID NO: 625393 - RNA, 18 nt, Human
ccccgggccccgcucggg

SEQ ID NO: 625394 - RNA, 21 nt, Human
ccuccgccuccuccaugccgc

SEQ ID NO: 625395 - RNA, 20 nt, Human
cgcuagggcccucacugcuc

SEQ ID NO: 625396 - RNA, 24 nt, Human
cuagccagccuggggguacacagu

SEQ ID NO: 625397 - RNA, 20 nt, Human
gaaaucuggacaaagagaag

SEQ ID NO: 625398 - RNA, 22 nt, Human
gccccgggccccgcucgggccc

SEQ ID NO: 625399 - RNA, 24 nt, Human
gccccgggccccgcucgggcccca

SEQ ID NO: 625400 - RNA, 20 nt, Human
ggauggagggaagggcuagc

SEQ ID NO: 625401 - RNA, 19 nt, Human
ggccuggaaagugagggua

SEQ ID NO: 625402 - RNA, 22 nt, Human
ggcugagaggaggccuggucca

SEQ ID NO: 625403 - RNA, 23 nt, Human
gggcagcauuccagcccaaaaag

SEQ ID NO: 625404 - RNA, 21 nt, Human
uaaucaaugaccaacuuaucc

SEQ ID NO: 625405 - RNA, 23 nt, Human
uacacaguacccagccccgcagg

SEQ ID NO: 625406 - RNA, 19 nt, Human
uagauucugagccaggccu

SEQ ID NO: 625407 - RNA, 24 nt, Human
ucaccaauguccuggccagcccau

SEQ ID NO: 625408 - RNA, 18 nt, Human
uccauggguugggcacag

SEQ ID NO: 625409 - RNA, 25 nt, Human
ucccagagggcuucuccuuuuuuaa

SEQ ID NO: 625410 - RNA, 20 nt, Human
uccugaguaagagccagccc

SEQ ID NO: 625411 - RNA, 19 nt, Human
ucgccgcggccuccgccuc

SEQ ID NO: 625412 - RNA, 22 nt, Human
ucgccgcggccuccgccuccuc

SEQ ID NO: 625413 - RNA, 26 nt, Human
ucgggccccgcuagggcccucacugc

SEQ ID NO: 625414 - RNA, 18 nt, Human
ucuccugcccuucuccaa

SEQ ID NO: 625415 - RNA, 25 nt, Human
ugaguaagagccagccccacccuca

SEQ ID NO: 625416 - RNA, 22 nt, Human
uggcgggucaccaauguccugg

SEQ ID NO: 625417 - RNA, 22 nt, Human
ugugggccccagcugggccuga

SEQ ID NO: 625418 - RNA, 24 nt, Human
ugugucagcaugugggccccagcu

SEQ ID NO: 625419 - RNA, 21 nt, Human
uuuuuuuuuuuuuuucccaga

SEQ ID NO: 625420 - RNA, 28 nt, Human
uuuuuuuuuuuuuuuuuuucccagaggg

SEQ ID NO: 625421 - RNA, 21 nt, Human
aaacuucugacuucagcagau

SEQ ID NO: 625422 - RNA, 24 nt, Human
aaagugcugggauuacagguguga

SEQ ID NO: 625423 - RNA, 24 nt, Human
aaccagaaaaagguaauaaucuaa

SEQ ID NO: 625424 - RNA, 19 nt, Human
aaguaugcuuguggcccau

SEQ ID NO: 625425 - RNA, 18 nt, Human
aagugcugggauuacagg

SEQ ID NO: 625426 - RNA, 19 nt, Human
aagugcugggauuacaggu

SEQ ID NO: 625427 - RNA, 26 nt, Human
aagugcugggauuacaggugugagcc

SEQ ID NO: 625428 - RNA, 24 nt, Human
aauaagagaugaaaaauccuuuca

SEQ ID NO: 625429 - RNA, 22 nt, Human
acaggguuucacuguguuggca

SEQ ID NO: 625430 - RNA, 23 nt, Human
acaggguuucacuguguuggcaa

SEQ ID NO: 625431 - RNA, 24 nt, Human
acaggguuucacuguguuggcaag

SEQ ID NO: 625432 - RNA, 24 nt, Human
acccaggcuggaguacaguggcau

SEQ ID NO: 625433 - RNA, 25 nt, Human
acccgccucagccucccaaagugcu

SEQ ID NO: 625434 - RNA, 19 nt, Human
agaacacugacuaacacug

SEQ ID NO: 625435 - RNA, 18 nt, Human
agacaggguuucacugug

SEQ ID NO: 625436 - RNA, 19 nt, Human
agagacaggguuucacugu

SEQ ID NO: 625437 - RNA, 19 nt, Human
aguagcagggauuacaggc

SEQ ID NO: 625438 - RNA, 21 nt, Human
auaaaacacaguaaggaacca

SEQ ID NO: 625439 - RNA, 20 nt, Human
auaaaguaugcuuguggccc

SEQ ID NO: 625440 - RNA, 18 nt, Human
auucuccuguuucagccu

SEQ ID NO: 625441 - RNA, 24 nt, Human
auuuuuuuauuuuuaguagagaca

SEQ ID NO: 625442 - RNA, 26 nt, Human
caaacuucugacuucagcagauccaa

SEQ ID NO: 625443 - RNA, 24 nt, Human
caaagugcugggauuacaggugug

SEQ ID NO: 625444 - RNA, 22 nt, Human
caaauagaaauaagagaugaaa

SEQ ID NO: 625445 - RNA, 22 nt, Human
caagugauucuccuguuucagc

SEQ ID NO: 625446 - RNA, 21 nt, Human
cacaguaaggaaccagaaaaa

SEQ ID NO: 625447 - RNA, 23 nt, Human
cacccgccucagccucccaaagu

SEQ ID NO: 625448 - RNA, 21 nt, Human
cacugugccguucuucaagau

SEQ ID NO: 625449 - RNA, 19 nt, Human
cacuguguuggcaaggcug

SEQ ID NO: 625450 - RNA, 21 nt, Human
cacuguguuggcaaggcuggu

SEQ ID NO: 625451 - RNA, 24 nt, Human
cacuguguuggcaaggcuggucuc

SEQ ID NO: 625452 - RNA, 21 nt, Human
cagaacacugacuaacacugg

SEQ ID NO: 625453 - RNA, 19 nt, Human
cagcagaacacugacuaac

SEQ ID NO: 625454 - RNA, 22 nt, Human
cagcagaacacugacuaacacu

SEQ ID NO: 625455 - RNA, 24 nt, Human
caggguuucacuguguuggcaagg

SEQ ID NO: 625456 - RNA, 21 nt, Human
ccaaagugcugggauuacagg

SEQ ID NO: 625457 - RNA, 21 nt, Human
ccaaagugcugggauuacagg

SEQ ID NO: 625458 - RNA, 24 nt, Human
ccaaagugcugggauuacaggugu

SEQ ID NO: 625459 - RNA, 26 nt, Human
ccacccgccucagccucccaaagugc

SEQ ID NO: 625460 - RNA, 19 nt, Human
cccgaguagcagggauuac

SEQ ID NO: 625461 - RNA, 24 nt, Human
ccgaguagcagggauuacaggcgu

SEQ ID NO: 625462 - RNA, 23 nt, Human
ccgcaaccuccgucuccuggguu

SEQ ID NO: 625463 - RNA, 24 nt, Human
ccgcaaccuccgucuccuggguuc

SEQ ID NO: 625464 - RNA, 24 nt, Human
ccgccucagccucccaaagugcug

SEQ ID NO: 625465 - RNA, 20 nt, Human
ccucccgaguagcagggauu

SEQ ID NO: 625466 - RNA, 22 nt, Human
ccuccgucuccuggguucaagu

SEQ ID NO: 625467 - RNA, 23 nt, Human
ccuggguucaagugauucuccuc

SEQ ID NO: 625468 - RNA, 23 nt, Human
ccuggguucaagugauucuccug

SEQ ID NO: 625469 - RNA, 22 nt, Human
cgcucugucacccaggcuggag

SEQ ID NO: 625470 - RNA, 20 nt, Human
cguuacacacauaaaguaug

SEQ ID NO: 625471 - RNA, 22 nt, Human
cucaaacuucugacuucagcag

SEQ ID NO: 625472 - RNA, 20 nt, Human
cuccuggguucaagugauuc

SEQ ID NO: 625473 - RNA, 21 nt, Human
cuccuggguucaagugauucu

SEQ ID NO: 625474 - RNA, 24 nt, Human
cucgcucugucacccaggcuggag

SEQ ID NO: 625475 - RNA, 21 nt, Human
cugacuucagcagauccaccc

SEQ ID NO: 625476 - RNA, 22 nt, Human
cuguuucagccucccgaguagc

SEQ ID NO: 625477 - RNA, 24 nt, Human
gacuucagcagauccacccgccuc

SEQ ID NO: 625478 - RNA, 21 nt, Human
gagccaccaugccugaccuug

SEQ ID NO: 625479 - RNA, 22 nt, Human
gauccacccgccucagccuccc

SEQ ID NO: 625480 - RNA, 19 nt, Human
gauuacaggcgugcacugc

SEQ ID NO: 625481 - RNA, 18 nt, Human
gauuacaggugugagcca

SEQ ID NO: 625482 - RNA, 21 nt, Human
gauuacaggugugagccacca

SEQ ID NO: 625483 - RNA, 24 nt, Human
gauuacaggugugagccaccaugc

SEQ ID NO: 625484 - RNA, 21 nt, Human
gauucuccuguuucagccucc

SEQ ID NO: 625485 - RNA, 23 nt, Human
gccucagccucccaaagugcugg

SEQ ID NO: 625486 - RNA, 23 nt, Human
gccugaccuugauauuaucauuu

SEQ ID NO: 625487 - RNA, 25 nt, Human
gcucugucacccaggcuggaguaca

SEQ ID NO: 625488 - RNA, 19 nt, Human
gcuggaguacaguggcaua

SEQ ID NO: 625489 - RNA, 24 nt, Human
ggauuacaggugugagccaccaug

SEQ ID NO: 625490 - RNA, 18 nt, Human
gggauuacaggcgugcac

SEQ ID NO: 625491 - RNA, 20 nt, Human
gggauuacaggcgugcacug

SEQ ID NO: 625492 - RNA, 18 nt, Human
guagcagggauuacaggc

SEQ ID NO: 625493 - RNA, 24 nt, Human
gucucgcucugucacccaggcugg

SEQ ID NO: 625494 - RNA, 24 nt, Human
gugauucuccuguuucagccuccc

SEQ ID NO: 625495 - RNA, 20 nt, Human
uaaaacacaguaaggaacca

SEQ ID NO: 625496 - RNA, 25 nt, Human
uaagccagcagaacacugacuaaca

SEQ ID NO: 625497 - RNA, 23 nt, Human
uaauuuuuuuauuuuuaguagag

SEQ ID NO: 625498 - RNA, 24 nt, Human
uaauuuuuuuauuuuuaguagaga

SEQ ID NO: 625499 - RNA, 22 nt, Human
uacaggugugagccaccaugcc

SEQ ID NO: 625500 - RNA, 22 nt, Human
uacaggugugagccaccaugcc

SEQ ID NO: 625501 - RNA, 23 nt, Human
uacaggugugagccaccaugccu

SEQ ID NO: 625502 - RNA, 23 nt, Human
uacaguggcauaaucucaacuca

SEQ ID NO: 625503 - RNA, 22 nt, Human
uagagacaggguuucacugugu

SEQ ID NO: 625504 - RNA, 19 nt, Human
uagcaacaucagagauauc

SEQ ID NO: 625505 - RNA, 20 nt, Human
uaguagagacaggguuucac

SEQ ID NO: 625506 - RNA, 24 nt, Human
uaguagagacaggguuucacugug

SEQ ID NO: 625507 - RNA, 24 nt, Human
ucaccgcaaccuccgucuccuggg

SEQ ID NO: 625508 - RNA, 25 nt, Human
ucaccgcaaccuccgucuccugggu

SEQ ID NO: 625509 - RNA, 27 nt, Human
ucaccgcaaccuccgucuccuggguuc

SEQ ID NO: 625510 - RNA, 22 nt, Human
ucacuguguuggcaaggcuggu

SEQ ID NO: 625511 - RNA, 21 nt, Human
uccacccgccucagccuccca

SEQ ID NO: 625512 - RNA, 23 nt, Human
ucccaaagugcugggauuacagg

SEQ ID NO: 625513 - RNA, 24 nt, Human
ucccgaguagcagggauuacaggc

SEQ ID NO: 625514 - RNA, 21 nt, Human
uccuggguucaagugauucuc

SEQ ID NO: 625515 - RNA, 24 nt, Human
uccuggguucaagugauucuccug

SEQ ID NO: 625516 - RNA, 24 nt, Human
ucgcucugucacccaggcuggagu

SEQ ID NO: 625517 - RNA, 24 nt, Human
ucuccuggguucaagugauucucc

SEQ ID NO: 625518 - RNA, 19 nt, Human
ucucgcucugucacccagg

SEQ ID NO: 625519 - RNA, 23 nt, Human
ucucgcucugucacccaggcugg

SEQ ID NO: 625520 - RNA, 24 nt, Human
ucucgcucugucacccaggcugga

SEQ ID NO: 625521 - RNA, 25 nt, Human
ucucgcucugucacccaggcuggag

SEQ ID NO: 625522 - RNA, 26 nt, Human
ucucgcucugucacccaggcuggagu

SEQ ID NO: 625523 - RNA, 18 nt, Human
ucugucacccaggcugga

SEQ ID NO: 625524 - RNA, 24 nt, Human
ucugucacccaggcuggaguacag

SEQ ID NO: 625525 - RNA, 21 nt, Human
ugaaaaauccuuucaccaaga

SEQ ID NO: 625526 - RNA, 24 nt, Human
ugacugagaaggcauuagugggcu

SEQ ID NO: 625527 - RNA, 23 nt, Human
ugagucucgcucugucacccagg

SEQ ID NO: 625528 - RNA, 24 nt, Human
ugcugggauuacaggugugagcca

SEQ ID NO: 625529 - RNA, 24 nt, Human
uggcaaggcuggucucaaacuucu

SEQ ID NO: 625530 - RNA, 24 nt, Human
uggcauaaucucaacucaccgcaa

SEQ ID NO: 625531 - RNA, 18 nt, Human
ugggauuacaggugugag

SEQ ID NO: 625532 - RNA, 22 nt, Human
ugggauuacaggugugagccac

SEQ ID NO: 625533 - RNA, 23 nt, Human
ugggauuacaggugugagccacc

SEQ ID NO: 625534 - RNA, 24 nt, Human
ugggauuacaggugugagccacca

SEQ ID NO: 625535 - RNA, 25 nt, Human
ugggauuacaggugugagccaccau

SEQ ID NO: 625536 - RNA, 20 nt, Human
uggguucaagugauucuccu

SEQ ID NO: 625537 - RNA, 24 nt, Human
uggguucaagugauucuccuguuu

SEQ ID NO: 625538 - RNA, 21 nt, Human
uuaguagagacaggguuucac

SEQ ID NO: 625539 - RNA, 24 nt, Human
uuaguagagacaggguuucacugu

SEQ ID NO: 625540 - RNA, 23 nt, Human
uucaagugauucuccuguuucag

SEQ ID NO: 625541 - RNA, 22 nt, Human
uucacuguguuggcaaggcugg

SEQ ID NO: 625542 - RNA, 23 nt, Human
uuuuauuuuuaguagagacaggg

SEQ ID NO: 625543 - RNA, 24 nt, Human
uuuuuaguagagacaggguuucac

SEQ ID NO: 625544 - RNA, 26 nt, Human
uuuuuuuauuuuuaguagagacaggg

SEQ ID NO: 625545 - RNA, 25 nt, Human
uuuuuuuuuuuugagacugagucuc

SEQ ID NO: 625546 - RNA, 18 nt, Human
uuuuuuuuuuuuuuuuug

SEQ ID NO: 625547 - RNA, 26 nt, Human
aaaaaaaaaaaaaaaagcacgcacca

SEQ ID NO: 625548 - RNA, 19 nt, Human
aaaaaggucaaauacacag

SEQ ID NO: 625549 - RNA, 18 nt, Human
aaaaugaaacccccaccc

SEQ ID NO: 625550 - RNA, 20 nt, Human
aaagcugggaagaagcaaaa

SEQ ID NO: 625551 - RNA, 18 nt, Human
aaauaugcugauacuugg

SEQ ID NO: 625552 - RNA, 20 nt, Human
aaauaugcugauacuugggu

SEQ ID NO: 625553 - RNA, 26 nt, Human
aacaggacuaggaacaagcauccccu

SEQ ID NO: 625554 - RNA, 18 nt, Human
aacgcggcccauaagugg

SEQ ID NO: 625555 - RNA, 22 nt, Human
aacuuucuuucuaaauuaaagc

SEQ ID NO: 625556 - RNA, 20 nt, Human
aacuuuuuuuuuuuuuuaaa

SEQ ID NO: 625557 - RNA, 25 nt, Human
aagaaaucuucacucaaguaguguc

SEQ ID NO: 625558 - RNA, 22 nt, Human
aagcccauccaauggagaacaa

SEQ ID NO: 625559 - RNA, 26 nt, Human
aagcgggaguacuacuguguggaagg

SEQ ID NO: 625560 - RNA, 25 nt, Human
aagcuccauaaaguacaacuggcaa

SEQ ID NO: 625561 - RNA, 29 nt, Human
aaugggacuuuucccaguaugguaacgac

SEQ ID NO: 625562 - RNA, 18 nt, Human
acacccaccccuucccca

SEQ ID NO: 625563 - RNA, 22 nt, Human
acagugcucuggguguugaaug

SEQ ID NO: 625564 - RNA, 25 nt, Human
acagugcucuggguguugaauggug

SEQ ID NO: 625565 - RNA, 26 nt, Human
acccaccccuuccccauaacucccac

SEQ ID NO: 625566 - RNA, 19 nt, Human
accccuucacacccacccc

SEQ ID NO: 625567 - RNA, 22 nt, Human
accuuuccuuuccuccccucca

SEQ ID NO: 625568 - RNA, 18 nt, Human
acugcuggcugcuccugc

SEQ ID NO: 625569 - RNA, 19 nt, Human
agaaaagcugggaagaagc

SEQ ID NO: 625570 - RNA, 22 nt, Human
agaaauagcaacaggacuagga

SEQ ID NO: 625571 - RNA, 20 nt, Human
agcaacaggagagccuggga

SEQ ID NO: 625572 - RNA, 19 nt, Human
agcaacaggcuaaaaaagg

SEQ ID NO: 625573 - RNA, 19 nt, Human
agccgaggucacacagugc

SEQ ID NO: 625574 - RNA, 19 nt, Human
agcugguacagggaaagaa

SEQ ID NO: 625575 - RNA, 25 nt, Human
aggcaguguuuggugaugcgaugcu

SEQ ID NO: 625576 - RNA, 20 nt, Human
aggcuaaaaaaggaugaugg

SEQ ID NO: 625577 - RNA, 19 nt, Human
aggcuucugaaccaagacc

SEQ ID NO: 625578 - RNA, 21 nt, Human
agggagucugaugauauggac

SEQ ID NO: 625579 - RNA, 22 nt, Human
aggggaagccaguaacucaagg

SEQ ID NO: 625580 - RNA, 27 nt, Human
agguauuggagcuugcucuauuaagcu

SEQ ID NO: 625581 - RNA, 20 nt, Human
aguaacucaaggugcuuuuc

SEQ ID NO: 625582 - RNA, 24 nt, Human
agugaagcaauuugaacagguggc

SEQ ID NO: 625583 - RNA, 21 nt, Human
agugagaaaagcugggaagaa

SEQ ID NO: 625584 - RNA, 22 nt, Human
aucagaccaauuuacuuugaaa

SEQ ID NO: 625585 - RNA, 22 nt, Human
auggacugaaagaagcugugua

SEQ ID NO: 625586 - RNA, 20 nt, Human
auggagaacaacuuguacca

SEQ ID NO: 625587 - RNA, 23 nt, Human
caaaaaauacacccaaucuucca

SEQ ID NO: 625588 - RNA, 22 nt, Human
caacaagcacugcauauaugua

SEQ ID NO: 625589 - RNA, 18 nt, Human
caacaggcuaaaaaagga

SEQ ID NO: 625590 - RNA, 22 nt, Human
caagaccaaauguuuacguucc

SEQ ID NO: 625591 - RNA, 21 nt, Human
caagugauucacaacgcggcc

SEQ ID NO: 625592 - RNA, 20 nt, Human
cacaucuuucacaguaccac

SEQ ID NO: 625593 - RNA, 24 nt, Human
caccccaugacuccccacacuuga

SEQ ID NO: 625594 - RNA, 22 nt, Human
caccccuuccccauaacuccca

SEQ ID NO: 625595 - RNA, 23 nt, Human
cacuuucaaaacuuucucuucca

SEQ ID NO: 625596 - RNA, 20 nt, Human
cacuuugugucucucugaag

SEQ ID NO: 625597 - RNA, 18 nt, Human
cagaauccucagaauugc

SEQ ID NO: 625598 - RNA, 20 nt, Human
cagaauuccgccuuucacau

SEQ ID NO: 625599 - RNA, 21 nt, Human
cagagugaggcuggcugggga

SEQ ID NO: 625600 - RNA, 21 nt, Human
caugaaauuaagcuucuuuuu

SEQ ID NO: 625601 - RNA, 23 nt, Human
ccaaaaaauacacccaaucuucc

SEQ ID NO: 625602 - RNA, 21 nt, Human
ccaaaaauacccagaucaaau

SEQ ID NO: 625603 - RNA, 24 nt, Human
ccaaaaauacccagaucaaauaaa

SEQ ID NO: 625604 - RNA, 23 nt, Human
ccacaccccaugacuccccacac

SEQ ID NO: 625605 - RNA, 24 nt, Human
ccagagccaauguccaaauucaca

SEQ ID NO: 625606 - RNA, 21 nt, Human
cccacccccugaccccuagga

SEQ ID NO: 625607 - RNA, 22 nt, Human
cccacccccugaccccuaggac

SEQ ID NO: 625608 - RNA, 21 nt, Human
cccauaacucccaccccugaa

SEQ ID NO: 625609 - RNA, 22 nt, Human
cccauaacucccaccccugaaa

SEQ ID NO: 625610 - RNA, 24 nt, Human
cccuaguauuccaacagggguuga

SEQ ID NO: 625611 - RNA, 20 nt, Human
ccgauucuccagugcaagcu

SEQ ID NO: 625612 - RNA, 27 nt, Human
ccugaccccuaggacuauacaguggaa

SEQ ID NO: 625613 - RNA, 24 nt, Human
cuaauaccauuuauucuacuauuc

SEQ ID NO: 625614 - RNA, 21 nt, Human
cuccacaccccaugacucccc

SEQ ID NO: 625615 - RNA, 24 nt, Human
cuccccuccacaccccaugacucc

SEQ ID NO: 625616 - RNA, 23 nt, Human
cuccugcugcgggccggagacag

SEQ ID NO: 625617 - RNA, 19 nt, Human
cucuaggucaggaugucgc

SEQ ID NO: 625618 - RNA, 22 nt, Human
cugcgggccggagacagaguga

SEQ ID NO: 625619 - RNA, 19 nt, Human
cugcuccugcugcgggccg

SEQ ID NO: 625620 - RNA, 21 nt, Human
cuguugucaguuuucuuaauu

SEQ ID NO: 625621 - RNA, 26 nt, Human
cuucacuuucaaaacuuucucuucca

SEQ ID NO: 625622 - RNA, 20 nt, Human
cuuuccuuuccuccccucca

SEQ ID NO: 625623 - RNA, 24 nt, Human
cuuucugacuuuguagaaaagcuu

SEQ ID NO: 625624 - RNA, 24 nt, Human
cuuugcuaugagagacagguuagg

SEQ ID NO: 625625 - RNA, 20 nt, Human
gaaacaaaauaccuuuccuu

SEQ ID NO: 625626 - RNA, 18 nt, Human
gaaagaagaaaucuucac

SEQ ID NO: 625627 - RNA, 18 nt, Human
gaacaacucaacugcagc

SEQ ID NO: 625628 - RNA, 18 nt, Human
gacacaguguaacguugg

SEQ ID NO: 625629 - RNA, 19 nt, Human
gacaguuccuuuggaagcu

SEQ ID NO: 625630 - RNA, 22 nt, Human
gagagucuaauaccauuuauuc

SEQ ID NO: 625631 - RNA, 24 nt, Human
gaugcagauuuugugauggggucc

SEQ ID NO: 625632 - RNA, 21 nt, Human
gcacaacacggugguagacaa

SEQ ID NO: 625633 - RNA, 24 nt, Human
gccaguaacucaaggugcuuuucc

SEQ ID NO: 625634 - RNA, 19 nt, Human
gccguuccucccuuuucaa

SEQ ID NO: 625635 - RNA, 19 nt, Human
gcuucaguagaaauuccug

SEQ ID NO: 625636 - RNA, 18 nt, Human
ggaagaagcaaaauuucu

SEQ ID NO: 625637 - RNA, 19 nt, Human
ggacauugguacaagagaa

SEQ ID NO: 625638 - RNA, 18 nt, Human
ggccggagacagagugag

SEQ ID NO: 625639 - RNA, 20 nt, Human
gggaaagaagaaaucuucac

SEQ ID NO: 625640 - RNA, 18 nt, Human
gggaagccaguaacucaa

SEQ ID NO: 625641 - RNA, 23 nt, Human
ggguccgugguagcaacaggaga

SEQ ID NO: 625642 - RNA, 26 nt, Human
gguaaacauacaaauaaggagaaggu

SEQ ID NO: 625643 - RNA, 24 nt, Human
ggugcuauaaauauaaaugcuacu

SEQ ID NO: 625644 - RNA, 21 nt, Human
guaguucuugguggguuuuug

SEQ ID NO: 625645 - RNA, 21 nt, Human
guccaaaaauacccagaucaa

SEQ ID NO: 625646 - RNA, 21 nt, Human
guguacuuucugacuuuguag

SEQ ID NO: 625647 - RNA, 22 nt, Human
guucacaaugggacuuuuccca

SEQ ID NO: 625648 - RNA, 21 nt, Human
uaaaaaaaaaaaaaaaagcac

SEQ ID NO: 625649 - RNA, 21 nt, Human
uaaaaaaggaugauggaagua

SEQ ID NO: 625650 - RNA, 20 nt, Human
uaaguaggcaagcuuuacuc

SEQ ID NO: 625651 - RNA, 19 nt, Human
uacacccaaucuuccagau

SEQ ID NO: 625652 - RNA, 18 nt, Human
uacagcuuugcuuccucc

SEQ ID NO: 625653 - RNA, 19 nt, Human
uacauguaucauacauaua

SEQ ID NO: 625654 - RNA, 19 nt, Human
uacauuggugcuauaaaua

SEQ ID NO: 625655 - RNA, 21 nt, Human
uaccccuucacacccaccccu

SEQ ID NO: 625656 - RNA, 19 nt, Human
uacuguguggaaggaaggu

SEQ ID NO: 625657 - RNA, 19 nt, Human
uaugaagcaugaaauuaag

SEQ ID NO: 625658 - RNA, 24 nt, Human
ucaaaaauuaccuggaagcaauuu

SEQ ID NO: 625659 - RNA, 22 nt, Human
ucacaccaguguguucacuuug

SEQ ID NO: 625660 - RNA, 23 nt, Human
ucacaccaguguguucacuuugg

SEQ ID NO: 625661 - RNA, 21 nt, Human
ucacaucuuucacaguacccu

SEQ ID NO: 625662 - RNA, 18 nt, Human
ucagcagaaugcugguca

SEQ ID NO: 625663 - RNA, 22 nt, Human
ucaguguaaaaaaaaaaaaaaa

SEQ ID NO: 625664 - RNA, 23 nt, Human
ucaguguaaaaaaaaaaaaaaaa

SEQ ID NO: 625665 - RNA, 27 nt, Human
ucaguguaaaaaaaaaaaaaaaagcac

SEQ ID NO: 625666 - RNA, 25 nt, Human
uccaaaaauacccagaucaaauaaa

SEQ ID NO: 625667 - RNA, 20 nt, Human
uccccauaacucccaccccu

SEQ ID NO: 625668 - RNA, 20 nt, Human
uccguccugagguauuggaa

SEQ ID NO: 625669 - RNA, 20 nt, Human
ucucucugaagcaacaggcu

SEQ ID NO: 625670 - RNA, 22 nt, Human
ucugaagacaguuccuuuggaa

SEQ ID NO: 625671 - RNA, 18 nt, Human
ucugucuuucucuucuuc

SEQ ID NO: 625672 - RNA, 18 nt, Human
ucuucuucacuuucaaaa

SEQ ID NO: 625673 - RNA, 21 nt, Human
ucuuucucuucuucacuuucc

SEQ ID NO: 625674 - RNA, 22 nt, Human
ugaaaaaucccaacugcauaga

SEQ ID NO: 625675 - RNA, 24 nt, Human
ugaaaaaucccaacugcauagaaa

SEQ ID NO: 625676 - RNA, 23 nt, Human
ugaaacccccacccccugacccc

SEQ ID NO: 625677 - RNA, 23 nt, Human
ugaaagaagcuguguacuuucug

SEQ ID NO: 625678 - RNA, 23 nt, Human
ugaagacaguuccuuuggaagcu

SEQ ID NO: 625679 - RNA, 20 nt, Human
ugacacaguguaacguuggc

SEQ ID NO: 625680 - RNA, 19 nt, Human
ugacaugacaccgacauga

SEQ ID NO: 625681 - RNA, 22 nt, Human
ugacaugacaccgacaugauua

SEQ ID NO: 625682 - RNA, 20 nt, Human
ugauauggacugaaagaagc

SEQ ID NO: 625683 - RNA, 24 nt, Human
ugaugcgaugcucaggcuuccggg

SEQ ID NO: 625684 - RNA, 21 nt, Human
ugauggaaguaaaaaguugga

SEQ ID NO: 625685 - RNA, 21 nt, Human
ugauuaauaccaucuuaacac

SEQ ID NO: 625686 - RNA, 19 nt, Human
ugcagcagucaccaaaaaa

SEQ ID NO: 625687 - RNA, 18 nt, Human
ugcgaugcucaggcuucc

SEQ ID NO: 625688 - RNA, 22 nt, Human
ugcuggucagccgaggucacac

SEQ ID NO: 625689 - RNA, 23 nt, Human
ugcuguuaauucaaggaaaaaag

SEQ ID NO: 625690 - RNA, 24 nt, Human
uggaaaaugaaacccccacccccu

SEQ ID NO: 625691 - RNA, 26 nt, Human
uggaaaaugaaacccccacccccuga

SEQ ID NO: 625692 - RNA, 20 nt, Human
uggaagcuucaguagaaauu

SEQ ID NO: 625693 - RNA, 23 nt, Human
uggaauagguaaaggggaagcca

SEQ ID NO: 625694 - RNA, 19 nt, Human
uggcaagugauucacaacg

SEQ ID NO: 625695 - RNA, 20 nt, Human
uggcuggggaggaagugucg

SEQ ID NO: 625696 - RNA, 23 nt, Human
ugguuuugccaucagcggguuug

SEQ ID NO: 625697 - RNA, 26 nt, Human
uguaaaaaaaaaaaaaaaagcacgca

SEQ ID NO: 625698 - RNA, 22 nt, Human
uguauagacaaagaaacaaaau

SEQ ID NO: 625699 - RNA, 25 nt, Human
ugucaccaguguuguaaaaaaaagg

SEQ ID NO: 625700 - RNA, 21 nt, Human
uguguacagcuucucgcugag

SEQ ID NO: 625701 - RNA, 20 nt, Human
uguucagaauauugcauggu

SEQ ID NO: 625702 - RNA, 22 nt, Human
uuaauaccaucuuaacacacuc

SEQ ID NO: 625703 - RNA, 22 nt, Human
uucaaaauguacauuggugcua

SEQ ID NO: 625704 - RNA, 21 nt, Human
uucacacccaccccuucccca

SEQ ID NO: 625705 - RNA, 19 nt, Human
uucagagcugucuucuuuu

SEQ ID NO: 625706 - RNA, 22 nt, Human
uucccagaauccucagaauugc

SEQ ID NO: 625707 - RNA, 18 nt, Human
uuccccauaacucccacc

SEQ ID NO: 625708 - RNA, 26 nt, Human
uuccccauaacucccaccccugaaag

SEQ ID NO: 625709 - RNA, 20 nt, Human
uucucauuuccuagugaagc

SEQ ID NO: 625710 - RNA, 23 nt, Human
uucuucuugacuugaagcuucag

SEQ ID NO: 625711 - RNA, 20 nt, Human
uugauggaauagguaaaggg

SEQ ID NO: 625712 - RNA, 23 nt, Human
uuggugcuauaaauauaaaugcu

SEQ ID NO: 625713 - RNA, 24 nt, Human
uuguggcuuuccuuucuucuuauu

SEQ ID NO: 625714 - RNA, 24 nt, Human
uuucagaaaaagcuuuuuguccau

SEQ ID NO: 625715 - RNA, 22 nt, Human
uuugcagacucccuuauugcag

SEQ ID NO: 625716 - RNA, 27 nt, Human
uuuggaagcuucaguagaaauuccugg

SEQ ID NO: 625717 - RNA, 19 nt, Human
uuugucagcucuuuuucuc

SEQ ID NO: 625718 - RNA, 18 nt, Human
uuugugaugggguccgug

SEQ ID NO: 625719 - RNA, 19 nt, Human
uuuuucagcagaaugcugg

SEQ ID NO: 625720 - RNA, 23 nt, Human
uuuuuucuucaaguuuuuucucu

SEQ ID NO: 625721 - RNA, 20 nt, Human
uuuuuuuucaaaaccauaug

SEQ ID NO: 625722 - RNA, 18 nt, Human
aaacaggagguacuaugg

SEQ ID NO: 625723 - RNA, 21 nt, Human
aacaacuucaaacaggaggua

SEQ ID NO: 625724 - RNA, 21 nt, Human
aagcgagggagcagaagccca

SEQ ID NO: 625725 - RNA, 23 nt, Human
agaagacaagcgagggagcagaa

SEQ ID NO: 625726 - RNA, 24 nt, Human
agcagaagcccacggggcaacagc

SEQ ID NO: 625727 - RNA, 18 nt, Human
cccggccgcggccggggc

SEQ ID NO: 625728 - RNA, 20 nt, Human
ccgcggccggggcgagaagc

SEQ ID NO: 625729 - RNA, 22 nt, Human
cgaccucaggcucuagcucccg

SEQ ID NO: 625730 - RNA, 24 nt, Human
cgagaagacaagcgagggagcaga

SEQ ID NO: 625731 - RNA, 25 nt, Human
cgccgccgaccucaggcucuagcuc

SEQ ID NO: 625732 - RNA, 20 nt, Human
cggggcgagaagcccgagaa

SEQ ID NO: 625733 - RNA, 20 nt, Human
gagaagacaagcgagggagc

SEQ ID NO: 625734 - RNA, 19 nt, Human
gcgagggagcagaagccca

SEQ ID NO: 625735 - RNA, 18 nt, Human
uaagauagaugugaauaa

SEQ ID NO: 625736 - RNA, 18 nt, Human
uacugaggacccggccgc

SEQ ID NO: 625737 - RNA, 22 nt, Human
uuuuuuuuuuuuuaaaaguuca

SEQ ID NO: 625738 - RNA, 23 nt, Human
uuuuuuuuuuuuuuuuuuaaaag

SEQ ID NO: 625739 - RNA, 21 nt, Human
aaccucggacacuucguccuc

SEQ ID NO: 625740 - RNA, 19 nt, Human
accgccgccgcugaucucg

SEQ ID NO: 625741 - RNA, 22 nt, Human
accgcugccgcugccgccgccg

SEQ ID NO: 625742 - RNA, 24 nt, Human
accucaggaucugcaaaagcuuua

SEQ ID NO: 625743 - RNA, 19 nt, Human
accuccacccccgguccuc

SEQ ID NO: 625744 - RNA, 19 nt, Human
accuccacccccgguccuc

SEQ ID NO: 625745 - RNA, 21 nt, Human
agagcagcaagaggaagaagc

SEQ ID NO: 625746 - RNA, 21 nt, Human
agaggcaccaccuccaccccc

SEQ ID NO: 625747 - RNA, 19 nt, Human
agucgugccugugucucug

SEQ ID NO: 625748 - RNA, 20 nt, Human
aucucgggaacgagaagagc

SEQ ID NO: 625749 - RNA, 21 nt, Human
caaaagcuuuaccaucagcag

SEQ ID NO: 625750 - RNA, 24 nt, Human
caccaccuccacccccgguccuca

SEQ ID NO: 625751 - RNA, 19 nt, Human
caccgccgccgcugaucuc

SEQ ID NO: 625752 - RNA, 21 nt, Human
cagaggcaccaccuccacccc

SEQ ID NO: 625753 - RNA, 22 nt, Human
cagcagcagcuucauccagugc

SEQ ID NO: 625754 - RNA, 20 nt, Human
cagucuccggaguaccucag

SEQ ID NO: 625755 - RNA, 22 nt, Human
cagugcacaacuaacugaggau

SEQ ID NO: 625756 - RNA, 19 nt, Human
ccagcgccgcguccccucc

SEQ ID NO: 625757 - RNA, 22 nt, Human
ccagugcacaacuaacugagga

SEQ ID NO: 625758 - RNA, 23 nt, Human
ccccagaccgaccccucccggcg

SEQ ID NO: 625759 - RNA, 18 nt, Human
cccguaccgcugccgcug

SEQ ID NO: 625760 - RNA, 21 nt, Human
cccguaccgcugccgcugccg

SEQ ID NO: 625761 - RNA, 21 nt, Human
ccgccgccgcugcugccgacu

SEQ ID NO: 625762 - RNA, 22 nt, Human
ccgcguccccuccgcccguacc

SEQ ID NO: 625763 - RNA, 20 nt, Human
ccgcugaucucgggaacgag

SEQ ID NO: 625764 - RNA, 19 nt, Human
ccgcugccgccgccgccgc

SEQ ID NO: 625765 - RNA, 25 nt, Human
ccgcugccgccgccgccgcugcugc

SEQ ID NO: 625766 - RNA, 18 nt, Human
ccgcugccgcugccgccg

SEQ ID NO: 625767 - RNA, 21 nt, Human
ccgcugccgcugccgccgccg

SEQ ID NO: 625768 - RNA, 24 nt, Human
ccgcugccgcugccgccgccgccg

SEQ ID NO: 625769 - RNA, 18 nt, Human
ccguaccgcugccgcugc

SEQ ID NO: 625770 - RNA, 21 nt, Human
ccgugucagugcagcagcagc

SEQ ID NO: 625771 - RNA, 21 nt, Human
ccuccccaaagagccucacgg

SEQ ID NO: 625772 - RNA, 24 nt, Human
ccuucugcaguacuugauaagaau

SEQ ID NO: 625773 - RNA, 21 nt, Human
cgagaagagcagcaagaggaa

SEQ ID NO: 625774 - RNA, 26 nt, Human
cgagaagagcagcaagaggaagaagc

SEQ ID NO: 625775 - RNA, 22 nt, Human
cgccgccgcugcugccgacucc

SEQ ID NO: 625776 - RNA, 22 nt, Human
cggcggaggcggcuccgaggcc

SEQ ID NO: 625777 - RNA, 22 nt, Human
cuagcaaugcuucuagucgugc

SEQ ID NO: 625778 - RNA, 27 nt, Human
cucccggcggaggcggcuccgaggccc

SEQ ID NO: 625779 - RNA, 19 nt, Human
cuccgaggccccagcuggg

SEQ ID NO: 625780 - RNA, 21 nt, Human
cugccgcugccgccgccgccg

SEQ ID NO: 625781 - RNA, 19 nt, Human
cuucuagcaaugcuucuag

SEQ ID NO: 625782 - RNA, 18 nt, Human
gagaagagcagcaagagg

SEQ ID NO: 625783 - RNA, 22 nt, Human
gccgccgccgccgcugcugccg

SEQ ID NO: 625784 - RNA, 21 nt, Human
gccgccgcugaucucgggaac

SEQ ID NO: 625785 - RNA, 20 nt, Human
gccgcugccgccgccgccgc

SEQ ID NO: 625786 - RNA, 18 nt, Human
gcugccgacucccgacgc

SEQ ID NO: 625787 - RNA, 22 nt, Human
ggaacgagaagagcagcaagag

SEQ ID NO: 625788 - RNA, 18 nt, Human
ggauccccagaccgaccc

SEQ ID NO: 625789 - RNA, 19 nt, Human
ggcagccgccaacuugaaa

SEQ ID NO: 625790 - RNA, 23 nt, Human
ggcagccgccaacuugaaaucca

SEQ ID NO: 625791 - RNA, 18 nt, Human
ggugccgacccacucgcg

SEQ ID NO: 625792 - RNA, 21 nt, Human
guccaaaauaaaugauucaac

SEQ ID NO: 625793 - RNA, 22 nt, Human
gugcagcagcagcuucauccag

SEQ ID NO: 625794 - RNA, 21 nt, Human
uaccagcaauacaaaucucuu

SEQ ID NO: 625795 - RNA, 24 nt, Human
ucagugcagcagcagcuucaucca

SEQ ID NO: 625796 - RNA, 19 nt, Human
uccacagugcguaagucug

SEQ ID NO: 625797 - RNA, 18 nt, Human
uccagaucuucuuggucc

SEQ ID NO: 625798 - RNA, 19 nt, Human
uccccagaccgaccccucc

SEQ ID NO: 625799 - RNA, 21 nt, Human
uccccagaccgaccccucccg

SEQ ID NO: 625800 - RNA, 21 nt, Human
uccugcugcuucuagcaaugc

SEQ ID NO: 625801 - RNA, 19 nt, Human
uccuuugucacccagcagg

SEQ ID NO: 625802 - RNA, 19 nt, Human
ucgcggucaccgccgccgc

SEQ ID NO: 625803 - RNA, 22 nt, Human
ucgugccugugucucuggaucc

SEQ ID NO: 625804 - RNA, 19 nt, Human
ugcagcagcagcuucaucc

SEQ ID NO: 625805 - RNA, 19 nt, Human
uucuagucgugccuguguc

SEQ ID NO: 625806 - RNA, 24 nt, Human
uuuauugggacuucauaaucuuuu

SEQ ID NO: 625807 - RNA, 22 nt, Human
uuuuuuuuuuuuuuuuuaccag

SEQ ID NO: 625808 - RNA, 22 nt, Human
aaaagcauguaaaaauuguaca

SEQ ID NO: 625809 - RNA, 19 nt, Human
aaacaucacaaccccaggg

SEQ ID NO: 625810 - RNA, 20 nt, Human
aaagcaagucacacuagcuc

SEQ ID NO: 625811 - RNA, 18 nt, Human
aaaggaagugagcuguuu

SEQ ID NO: 625812 - RNA, 19 nt, Human
aagagaaaacguagagaaa

SEQ ID NO: 625813 - RNA, 22 nt, Human
aagcaagucacacuagcucuca

SEQ ID NO: 625814 - RNA, 18 nt, Human
aaucuaucugggugacac

SEQ ID NO: 625815 - RNA, 22 nt, Human
acaaagcaagucacacuagcuc

SEQ ID NO: 625816 - RNA, 20 nt, Human
acaccagagagguuucugaa

SEQ ID NO: 625817 - RNA, 20 nt, Human
accaaacaagguauuuucac

SEQ ID NO: 625818 - RNA, 19 nt, Human
acccaggcuccuccuaaac

SEQ ID NO: 625819 - RNA, 23 nt, Human
acucuuauaaagagaauuaaggg

SEQ ID NO: 625820 - RNA, 21 nt, Human
acugcaagcaguggaaaagaa

SEQ ID NO: 625821 - RNA, 23 nt, Human
agaaaaacgagcuggccugccuu

SEQ ID NO: 625822 - RNA, 19 nt, Human
agagaaaacguagagaaau

SEQ ID NO: 625823 - RNA, 24 nt, Human
agcacaaucuaucugggugacacc

SEQ ID NO: 625824 - RNA, 22 nt, Human
agcaguggaaaagaauagauac

SEQ ID NO: 625825 - RNA, 20 nt, Human
agggucacuuugaacacugg

SEQ ID NO: 625826 - RNA, 23 nt, Human
agguaagaaggaaguggcaugag

SEQ ID NO: 625827 - RNA, 21 nt, Human
aucacaaccccagggaacagc

SEQ ID NO: 625828 - RNA, 19 nt, Human
cacaagcacucccaccgag

SEQ ID NO: 625829 - RNA, 21 nt, Human
cacaaucuaucugggugacac

SEQ ID NO: 625830 - RNA, 21 nt, Human
cacuacgcggaucuggaagau

SEQ ID NO: 625831 - RNA, 19 nt, Human
cacucccaccgagaugguc

SEQ ID NO: 625832 - RNA, 20 nt, Human
caggagccgucaacugccag

SEQ ID NO: 625833 - RNA, 24 nt, Human
cauucugucacauuaucuucuaaa

SEQ ID NO: 625834 - RNA, 20 nt, Human
cauuuuauuuuccuuuagga

SEQ ID NO: 625835 - RNA, 21 nt, Human
ccacccguuaaagagucaaaa

SEQ ID NO: 625836 - RNA, 21 nt, Human
ccaggagccgucaacugccag

SEQ ID NO: 625837 - RNA, 23 nt, Human
ccuccuaaaccagccagauucag

SEQ ID NO: 625838 - RNA, 23 nt, Human
cgguggagacgauuccucacuac

SEQ ID NO: 625839 - RNA, 21 nt, Human
cguuaaagagucaaaacccaa

SEQ ID NO: 625840 - RNA, 22 nt, Human
cuauaccuuuacacugccuaca

SEQ ID NO: 625841 - RNA, 23 nt, Human
cucccuuggcuuugaccuaaccu

SEQ ID NO: 625842 - RNA, 19 nt, Human
cucgcgggaucuaguccca

SEQ ID NO: 625843 - RNA, 18 nt, Human
gagaaaacguagagaaau

SEQ ID NO: 625844 - RNA, 23 nt, Human
gagcuguuucaggacucaaugaa

SEQ ID NO: 625845 - RNA, 24 nt, Human
ggaaaaccaauaagagaggggaca

SEQ ID NO: 625846 - RNA, 19 nt, Human
guuucaccaccgcucuaga

SEQ ID NO: 625847 - RNA, 21 nt, Human
ucaagagaaaacguagagaaa

SEQ ID NO: 625848 - RNA, 19 nt, Human
ucacuuccggccucgugcc

SEQ ID NO: 625849 - RNA, 20 nt, Human
ucagagagaaaaacgagcug

SEQ ID NO: 625850 - RNA, 25 nt, Human
ucccaccgagaugguccagugcccu

SEQ ID NO: 625851 - RNA, 18 nt, Human
ucccuggaaaaugcagga

SEQ ID NO: 625852 - RNA, 21 nt, Human
ucccuggaaaaugcaggaaaa

SEQ ID NO: 625853 - RNA, 22 nt, Human
ucccuuggcuuugaccuaaccu

SEQ ID NO: 625854 - RNA, 21 nt, Human
ugaggcagugaaauaggucug

SEQ ID NO: 625855 - RNA, 21 nt, Human
uggaaaaugcaggaaaaccaa

SEQ ID NO: 625856 - RNA, 24 nt, Human
uggcaugauaaacaucacaacccc

SEQ ID NO: 625857 - RNA, 19 nt, Human
uguacauauacgcauuaca

SEQ ID NO: 625858 - RNA, 21 nt, Human
uuggcacagguaagaaggaag

SEQ ID NO: 625859 - RNA, 23 nt, Human
uuguacauuuguacauauacgca

SEQ ID NO: 625860 - RNA, 24 nt, Human
uuuccagauucugucacucccuug

SEQ ID NO: 625861 - RNA, 21 nt, Human
uuuuccagauucugucacucc

SEQ ID NO: 625862 - RNA, 21 nt, Human
aaaaagaaagaggagacagga

SEQ ID NO: 625863 - RNA, 22 nt, Human
aaaacaaaaugaucagagccuu

SEQ ID NO: 625864 - RNA, 21 nt, Human
aagauuccagcagccucggcc

SEQ ID NO: 625865 - RNA, 21 nt, Human
aagcaggcgcccccuuacccc

SEQ ID NO: 625866 - RNA, 18 nt, Human
aagggccagagucugggu

SEQ ID NO: 625867 - RNA, 20 nt, Human
aaggugcagacauccgggcc

SEQ ID NO: 625868 - RNA, 19 nt, Human
acaacucagcccucgaccc

SEQ ID NO: 625869 - RNA, 22 nt, Human
accuguuccgugguucuccccu

SEQ ID NO: 625870 - RNA, 22 nt, Human
acggagacgguucuguugguag

SEQ ID NO: 625871 - RNA, 26 nt, Human
agacaggaauaaaggaagggggaccc

SEQ ID NO: 625872 - RNA, 25 nt, Human
agacaggaauaaaggaagggguccg

SEQ ID NO: 625873 - RNA, 22 nt, Human
agcccaauggcauucaucagcc

SEQ ID NO: 625874 - RNA, 20 nt, Human
agccuacaccccccacuccu

SEQ ID NO: 625875 - RNA, 20 nt, Human
agcgaaggugcagacauccg

SEQ ID NO: 625876 - RNA, 18 nt, Human
aggaagcuguccgggggc

SEQ ID NO: 625877 - RNA, 19 nt, Human
aggaagcuguccgggggcu

SEQ ID NO: 625878 - RNA, 20 nt, Human
aggaccugcccacugucccu

SEQ ID NO: 625879 - RNA, 22 nt, Human
aggagaaaguggggugccuggc

SEQ ID NO: 625880 - RNA, 20 nt, Human
aggaggagguggaagaacgg

SEQ ID NO: 625881 - RNA, 22 nt, Human
aggaggagguggaagaagggac

SEQ ID NO: 625882 - RNA, 20 nt, Human
aggaugccuucaucaggaaa

SEQ ID NO: 625883 - RNA, 21 nt, Human
aggccaagcccaccauuacau

SEQ ID NO: 625884 - RNA, 18 nt, Human
aggggaggaagagggcag

SEQ ID NO: 625885 - RNA, 20 nt, Human
agucuguguuucggcauucu

SEQ ID NO: 625886 - RNA, 21 nt, Human
auggagcgcuggcgaauacug

SEQ ID NO: 625887 - RNA, 26 nt, Human
auggcauucaucagccccaugucucu

SEQ ID NO: 625888 - RNA, 19 nt, Human
augucuccgcuggucggca

SEQ ID NO: 625889 - RNA, 19 nt, Human
auuccagcagccucggcca

SEQ ID NO: 625890 - RNA, 21 nt, Human
caacaccuuaaaucacagacu

SEQ ID NO: 625891 - RNA, 21 nt, Human
caagucgguucccucuacuga

SEQ ID NO: 625892 - RNA, 22 nt, Human
caccucccucucagucuguguu

SEQ ID NO: 625893 - RNA, 23 nt, Human
caccuuaaaucacagacugagac

SEQ ID NO: 625894 - RNA, 24 nt, Human
cacguacaguuaagaguccacaug

SEQ ID NO: 625895 - RNA, 25 nt, Human
cacuggcaccauacucugaacccuc

SEQ ID NO: 625896 - RNA, 22 nt, Human
cagcacauucacggaagcauua

SEQ ID NO: 625897 - RNA, 23 nt, Human
cagccaacgggcagaguugauac

SEQ ID NO: 625898 - RNA, 24 nt, Human
cagccagcagcucuuccacauguc

SEQ ID NO: 625899 - RNA, 19 nt, Human
cagcuaaaaugaggccaua

SEQ ID NO: 625900 - RNA, 18 nt, Human
cagcuccaacacacugaa

SEQ ID NO: 625901 - RNA, 19 nt, Human
caggaugccuucaucagga

SEQ ID NO: 625902 - RNA, 21 nt, Human
caguugcccggccucugggag

SEQ ID NO: 625903 - RNA, 25 nt, Human
caugaaaaaucccagcauaaggcag

SEQ ID NO: 625904 - RNA, 22 nt, Human
cauuaguaaaugccgaaguccc

SEQ ID NO: 625905 - RNA, 18 nt, Human
ccaagccaggcuguccac

SEQ ID NO: 625906 - RNA, 23 nt, Human
ccaccacaauguuucuaugauga

SEQ ID NO: 625907 - RNA, 22 nt, Human
ccagcagcucuuccacaugucc

SEQ ID NO: 625908 - RNA, 21 nt, Human
ccauaggccaagccaagcccu

SEQ ID NO: 625909 - RNA, 18 nt, Human
cccacaguagucccccau

SEQ ID NO: 625910 - RNA, 23 nt, Human
cccagccuugggcuagcuuuggc

SEQ ID NO: 625911 - RNA, 21 nt, Human
ccccagccuugggcuagcuuu

SEQ ID NO: 625912 - RNA, 20 nt, Human
ccccuagggccugcagcguc

SEQ ID NO: 625913 - RNA, 18 nt, Human
ccccucuccucccaccac

SEQ ID NO: 625914 - RNA, 18 nt, Human
ccccucuggcugcugggg

SEQ ID NO: 625915 - RNA, 21 nt, Human
cccucuuccuccuccuguucc

SEQ ID NO: 625916 - RNA, 21 nt, Human
cccugacccucuuccuccucc

SEQ ID NO: 625917 - RNA, 22 nt, Human
cccugaugcagccagcagcucu

SEQ ID NO: 625918 - RNA, 18 nt, Human
ccgaagccgcccauggag

SEQ ID NO: 625919 - RNA, 21 nt, Human
ccggggcugaagcccaauggc

SEQ ID NO: 625920 - RNA, 20 nt, Human
ccuacaccccccacuccuga

SEQ ID NO: 625921 - RNA, 20 nt, Human
ccucaaaguccucaaauucc

SEQ ID NO: 625922 - RNA, 19 nt, Human
ccuccccuuccccagccuu

SEQ ID NO: 625923 - RNA, 26 nt, Human
ccucgcggacaacucagcccucgacc

SEQ ID NO: 625924 - RNA, 18 nt, Human
ccucucagucuguguuuc

SEQ ID NO: 625925 - RNA, 24 nt, Human
ccugcugcugccaccauccagaag

SEQ ID NO: 625926 - RNA, 23 nt, Human
ccuggagucuccuccccuucccc

SEQ ID NO: 625927 - RNA, 22 nt, Human
ccuguccucaagaaucugggag

SEQ ID NO: 625928 - RNA, 20 nt, Human
cgaaggugcagacauccggg

SEQ ID NO: 625929 - RNA, 21 nt, Human
cgagagguggagggcuggggu

SEQ ID NO: 625930 - RNA, 21 nt, Human
cgcggacaacucagcccucga

SEQ ID NO: 625931 - RNA, 19 nt, Human
cgcucaguagccacuguca

SEQ ID NO: 625932 - RNA, 22 nt, Human
cgcucaguagccacugucacac

SEQ ID NO: 625933 - RNA, 21 nt, Human
cgggcuccagauccuggaagg

SEQ ID NO: 625934 - RNA, 24 nt, Human
cggggcugaagcccaauggcauuu

SEQ ID NO: 625935 - RNA, 22 nt, Human
cgguagguaguauuggcaaugu

SEQ ID NO: 625936 - RNA, 18 nt, Human
cuaaaaugaggccauaca

SEQ ID NO: 625937 - RNA, 26 nt, Human
cucaaaguccucaaauuccaagucgg

SEQ ID NO: 625938 - RNA, 21 nt, Human
cuccaacacacugaagcagcu

SEQ ID NO: 625939 - RNA, 21 nt, Human
cucccgggcuccagauccugg

SEQ ID NO: 625940 - RNA, 20 nt, Human
cucuuccuccuccuguuccc

SEQ ID NO: 625941 - RNA, 18 nt, Human
cugaacccucaccuucac

SEQ ID NO: 625942 - RNA, 20 nt, Human
cugaagcagcuaaaaugagg

SEQ ID NO: 625943 - RNA, 18 nt, Human
cugacacccacaggcgcu

SEQ ID NO: 625944 - RNA, 20 nt, Human
cugacugaucuuccucucca

SEQ ID NO: 625945 - RNA, 18 nt, Human
cugagagcugcggugaau

SEQ ID NO: 625946 - RNA, 20 nt, Human
cugaggaagaggaggagguu

SEQ ID NO: 625947 - RNA, 22 nt, Human
cugccaggagcuggccaucugc

SEQ ID NO: 625948 - RNA, 23 nt, Human
cuggcucaggcagccaacgggca

SEQ ID NO: 625949 - RNA, 18 nt, Human
cuguuaacagaagaguga

SEQ ID NO: 625950 - RNA, 19 nt, Human
cuugugcccacugacugau

SEQ ID NO: 625951 - RNA, 22 nt, Human
gaaacaggaauggggacagggg

SEQ ID NO: 625952 - RNA, 18 nt, Human
gaaaguggggugccuggc

SEQ ID NO: 625953 - RNA, 26 nt, Human
gaagcauuacugauuucagggagguc

SEQ ID NO: 625954 - RNA, 20 nt, Human
gaagguucuaguuccccgag

SEQ ID NO: 625955 - RNA, 23 nt, Human
gacccuguuaacagaagagugag

SEQ ID NO: 625956 - RNA, 18 nt, Human
gaccugcccacugucccu

SEQ ID NO: 625957 - RNA, 25 nt, Human
gaggagacaggaauaaaggaagggg

SEQ ID NO: 625958 - RNA, 18 nt, Human
gagggcuggggugaggag

SEQ ID NO: 625959 - RNA, 22 nt, Human
gaguagccaagccaggcugucc

SEQ ID NO: 625960 - RNA, 23 nt, Human
gaucacugccccugccaggaccc

SEQ ID NO: 625961 - RNA, 20 nt, Human
gcagccugaagaccugggcc

SEQ ID NO: 625962 - RNA, 24 nt, Human
gcccaauggcauucaucagcccca

SEQ ID NO: 625963 - RNA, 22 nt, Human
gcucaguagccacugucacacc

SEQ ID NO: 625964 - RNA, 19 nt, Human
gcuccggcaccucccucuc

SEQ ID NO: 625965 - RNA, 19 nt, Human
ggaauggacagugaagacc

SEQ ID NO: 625966 - RNA, 19 nt, Human
ggacagugaagaccgucuc

SEQ ID NO: 625967 - RNA, 23 nt, Human
ggagcaaguaacagcuccaacac

SEQ ID NO: 625968 - RNA, 21 nt, Human
ggagggcuggggugaggaggu

SEQ ID NO: 625969 - RNA, 21 nt, Human
ggaugaaagcugccaggagcu

SEQ ID NO: 625970 - RNA, 21 nt, Human
ggcaccagguucagugcccgu

SEQ ID NO: 625971 - RNA, 23 nt, Human
ggcuggggugaggaggugugggc

SEQ ID NO: 625972 - RNA, 18 nt, Human
gggacaggggaggaagag

SEQ ID NO: 625973 - RNA, 20 nt, Human
gggacaggggaggaagaggg

SEQ ID NO: 625974 - RNA, 21 nt, Human
gggacaggggaggaagagggc

SEQ ID NO: 625975 - RNA, 21 nt, Human
gggccaccaugugcucugugg

SEQ ID NO: 625976 - RNA, 18 nt, Human
gggcuggggugaggaggu

SEQ ID NO: 625977 - RNA, 25 nt, Human
ggggacaggggaggaagagggcagg

SEQ ID NO: 625978 - RNA, 19 nt, Human
ggggugaggaggugugggc

SEQ ID NO: 625979 - RNA, 19 nt, Human
gguagcgcauggagcgcug

SEQ ID NO: 625980 - RNA, 24 nt, Human
gguucuaguuccccgaggcaggcc

SEQ ID NO: 625981 - RNA, 22 nt, Human
guccagggcugaguccccugag

SEQ ID NO: 625982 - RNA, 21 nt, Human
guccccugagcccauguuacu

SEQ ID NO: 625983 - RNA, 19 nt, Human
gucucguucagcugguccc

SEQ ID NO: 625984 - RNA, 22 nt, Human
uaaaggacguugaaaacucucc

SEQ ID NO: 625985 - RNA, 18 nt, Human
uaagacgacgaagagagg

SEQ ID NO: 625986 - RNA, 22 nt, Human
uacaaacagaaaggaaaucaca

SEQ ID NO: 625987 - RNA, 23 nt, Human
uacacguacaguuaagaguccac

SEQ ID NO: 625988 - RNA, 21 nt, Human
uacaguuaagaguccacaugc

SEQ ID NO: 625989 - RNA, 21 nt, Human
uaccauaggccaagccaagcc

SEQ ID NO: 625990 - RNA, 18 nt, Human
uaccccacaguagucccc

SEQ ID NO: 625991 - RNA, 19 nt, Human
uacuggccacagcagacug

SEQ ID NO: 625992 - RNA, 19 nt, Human
uagccaagccaggcugucc

SEQ ID NO: 625993 - RNA, 22 nt, Human
uaggagaaaguggggugccugg

SEQ ID NO: 625994 - RNA, 20 nt, Human
uaguuccccgaggcaggccu

SEQ ID NO: 625995 - RNA, 21 nt, Human
ucaacaccagaguuuaaggcc

SEQ ID NO: 625996 - RNA, 18 nt, Human
ucagcccucgacccggcg

SEQ ID NO: 625997 - RNA, 18 nt, Human
ucaggcagcaagaaacgc

SEQ ID NO: 625998 - RNA, 19 nt, Human
ucaggcagcaagaaacgcc

SEQ ID NO: 625999 - RNA, 22 nt, Human
uccacuggcaccauacucugaa

SEQ ID NO: 626000 - RNA, 20 nt, Human
uccagcagccucggccaggc

SEQ ID NO: 626001 - RNA, 22 nt, Human
ucccaguaguacucaacaccag

SEQ ID NO: 626002 - RNA, 20 nt, Human
uccccgaggcaggccuugcc

SEQ ID NO: 626003 - RNA, 21 nt, Human
ucccuguugguuucagugggg

SEQ ID NO: 626004 - RNA, 24 nt, Human
uccggggcugaagcccaauggcau

SEQ ID NO: 626005 - RNA, 21 nt, Human
uccgggggcuuaggccucgcu

SEQ ID NO: 626006 - RNA, 22 nt, Human
ucuccaccaugggccuguugca

SEQ ID NO: 626007 - RNA, 25 nt, Human
ucuccacuagaaacuacacguacag

SEQ ID NO: 626008 - RNA, 23 nt, Human
ucugccaguugcccggccucugg

SEQ ID NO: 626009 - RNA, 18 nt, Human
ucugcugguuccaggccg

SEQ ID NO: 626010 - RNA, 22 nt, Human
ucuuccuccuccuguucccccc

SEQ ID NO: 626011 - RNA, 20 nt, Human
ucuugcaguucugcaccagc

SEQ ID NO: 626012 - RNA, 22 nt, Human
ugaagcagcuaaaaugaggcca

SEQ ID NO: 626013 - RNA, 18 nt, Human
ugaagggccagagucugg

SEQ ID NO: 626014 - RNA, 20 nt, Human
ugaccuggagucuccucccc

SEQ ID NO: 626015 - RNA, 19 nt, Human
ugacugucuugugcccacu

SEQ ID NO: 626016 - RNA, 18 nt, Human
ugaggaagaggaggaggu

SEQ ID NO: 626017 - RNA, 24 nt, Human
ugagggaagauuccagcagccucg

SEQ ID NO: 626018 - RNA, 22 nt, Human
ugagguggcaggguuccggggc

SEQ ID NO: 626019 - RNA, 22 nt, Human
ugagguggcaggguuccggggc

SEQ ID NO: 626020 - RNA, 20 nt, Human
ugaucuuugguguuucccuc

SEQ ID NO: 626021 - RNA, 19 nt, Human
ugccaggagcuggccaucu

SEQ ID NO: 626022 - RNA, 22 nt, Human
ugccgaagccgcccauggaggc

SEQ ID NO: 626023 - RNA, 20 nt, Human
ugccuucaucaggaaagccc

SEQ ID NO: 626024 - RNA, 20 nt, Human
ugcugagcgcaucuucucca

SEQ ID NO: 626025 - RNA, 22 nt, Human
uggaaaucugcaaggcagacgg

SEQ ID NO: 626026 - RNA, 23 nt, Human
uggaagaacggagacgguucugu

SEQ ID NO: 626027 - RNA, 21 nt, Human
uggaagacuguucacucucug

SEQ ID NO: 626028 - RNA, 20 nt, Human
uggaaggcucagaguuggag

SEQ ID NO: 626029 - RNA, 22 nt, Human
uggagggcuggggugaggaggu

SEQ ID NO: 626030 - RNA, 20 nt, Human
uggcagagauacccacuugu

SEQ ID NO: 626031 - RNA, 19 nt, Human
uggcucaggcagccaacgg

SEQ ID NO: 626032 - RNA, 21 nt, Human
uggcucugcugguuccaggcc

SEQ ID NO: 626033 - RNA, 19 nt, Human
ugggaccaaaucgcuuggu

SEQ ID NO: 626034 - RNA, 23 nt, Human
uggggaugaaagcugccaggagc

SEQ ID NO: 626035 - RNA, 21 nt, Human
uggguuccugguggcucugcc

SEQ ID NO: 626036 - RNA, 21 nt, Human
uguaucaggcaagcaggcgcc

SEQ ID NO: 626037 - RNA, 21 nt, Human
ugucaccauuguccucaaagu

SEQ ID NO: 626038 - RNA, 18 nt, Human
uguccaggaugauuggcc

SEQ ID NO: 626039 - RNA, 24 nt, Human
uguccagggcugaguccccugagc

SEQ ID NO: 626040 - RNA, 21 nt, Human
uguggcucucccgggcuccag

SEQ ID NO: 626041 - RNA, 20 nt, Human
ugugggcggcaccagguuca

SEQ ID NO: 626042 - RNA, 22 nt, Human
uuaaugaugugaucuuuggugu

SEQ ID NO: 626043 - RNA, 22 nt, Human
uuccgugguucuccccuagggc

SEQ ID NO: 626044 - RNA, 21 nt, Human
uuggaauggacagugaagacc

SEQ ID NO: 626045 - RNA, 22 nt, Human
uuggagguggugucuggguucc

SEQ ID NO: 626046 - RNA, 21 nt, Human
uugguagcgcauggagcgcug

SEQ ID NO: 626047 - RNA, 20 nt, Human
uuggucaacucgcaguggag

SEQ ID NO: 626048 - RNA, 26 nt, Human
uuuucauacuaaaaacaaaaugauca

SEQ ID NO: 626049 - RNA, 20 nt, Human
uuuuuuuuuugaggggcaug

SEQ ID NO: 626050 - RNA, 22 nt, Human
uuuuuuuuuuuugaggggcaug

SEQ ID NO: 626051 - RNA, 18 nt, Human
aaaagucauuuuuccaaa

SEQ ID NO: 626052 - RNA, 19 nt, Human
aacaggauggcaugagggg

SEQ ID NO: 626053 - RNA, 19 nt, Human
aaccacacuggccagacac

SEQ ID NO: 626054 - RNA, 24 nt, Human
aagcaauggaaucaauaaauuuau

SEQ ID NO: 626055 - RNA, 23 nt, Human
aauggaaucaauaaauuuauuaa

SEQ ID NO: 626056 - RNA, 21 nt, Human
acaccguaaguggggaagaug

SEQ ID NO: 626057 - RNA, 19 nt, Human
acacgaacuacaaagagac

SEQ ID NO: 626058 - RNA, 22 nt, Human
accccgaugauaaggaagacag

SEQ ID NO: 626059 - RNA, 18 nt, Human
agagcucuccaaaccuau

SEQ ID NO: 626060 - RNA, 20 nt, Human
aggaauggagagaaacgcgu

SEQ ID NO: 626061 - RNA, 22 nt, Human
augagacaucaagcuauccaag

SEQ ID NO: 626062 - RNA, 21 nt, Human
cacaggcauuuccuguccccu

SEQ ID NO: 626063 - RNA, 21 nt, Human
cagcacaaaagagaucuagag

SEQ ID NO: 626064 - RNA, 26 nt, Human
cagcacaaaagagaucuagagcucuc

SEQ ID NO: 626065 - RNA, 23 nt, Human
caggacagaacugaacccaccag

SEQ ID NO: 626066 - RNA, 20 nt, Human
cagguugagcugacaacacu

SEQ ID NO: 626067 - RNA, 19 nt, Human
cauugagaaccagcugcca

SEQ ID NO: 626068 - RNA, 23 nt, Human
ccaaagacauaacugaaaaguca

SEQ ID NO: 626069 - RNA, 23 nt, Human
ccaaagcuccagaaccacacugg

SEQ ID NO: 626070 - RNA, 21 nt, Human
ccagaaccacacuggccagac

SEQ ID NO: 626071 - RNA, 25 nt, Human
ccagaaccacacuggccagacacag

SEQ ID NO: 626072 - RNA, 18 nt, Human
ccauugccccagauucgg

SEQ ID NO: 626073 - RNA, 22 nt, Human
cccagcuggaagcagugauucc

SEQ ID NO: 626074 - RNA, 18 nt, Human
ccccaaagcuccagaacc

SEQ ID NO: 626075 - RNA, 22 nt, Human
ccccugaagagccacugaaccc

SEQ ID NO: 626076 - RNA, 25 nt, Human
ccucccugcacuguccccugcugug

SEQ ID NO: 626077 - RNA, 20 nt, Human
ccugaagagccacugaaccc

SEQ ID NO: 626078 - RNA, 19 nt, Human
ccugcagccugcuucagcc

SEQ ID NO: 626079 - RNA, 19 nt, Human
ccuuaccccacaccucccu

SEQ ID NO: 626080 - RNA, 23 nt, Human
cucuccaaaccuauggaguggca

SEQ ID NO: 626081 - RNA, 19 nt, Human
cugcacuguccccugcugu

SEQ ID NO: 626082 - RNA, 18 nt, Human
cuguccccugcugugccc

SEQ ID NO: 626083 - RNA, 23 nt, Human
gaacccaccagguugagcugaca

SEQ ID NO: 626084 - RNA, 21 nt, Human
gaacugaacccaccagguuga

SEQ ID NO: 626085 - RNA, 24 nt, Human
gaagccucaggacagaacugaacc

SEQ ID NO: 626086 - RNA, 21 nt, Human
gagagcagaagccucaggaca

SEQ ID NO: 626087 - RNA, 22 nt, Human
gauaaggaagacagacccggga

SEQ ID NO: 626088 - RNA, 19 nt, Human
gauaugaucaucugacaug

SEQ ID NO: 626089 - RNA, 20 nt, Human
gaugauaaggaagacagacc

SEQ ID NO: 626090 - RNA, 24 nt, Human
gcccagcaaaguauucaucuuacc

SEQ ID NO: 626091 - RNA, 21 nt, Human
ggccagacacaggcauuuccu

SEQ ID NO: 626092 - RNA, 23 nt, Human
guggggaagauguagcugaguac

SEQ ID NO: 626093 - RNA, 21 nt, Human
uaaaaggcguaaagaucucac

SEQ ID NO: 626094 - RNA, 21 nt, Human
uaaggaagacagacccgggac

SEQ ID NO: 626095 - RNA, 22 nt, Human
uaccaguccaugcccugacucc

SEQ ID NO: 626096 - RNA, 24 nt, Human
uaccccaaagcuccagaaccacac

SEQ ID NO: 626097 - RNA, 18 nt, Human
uaccccacaccucccugc

SEQ ID NO: 626098 - RNA, 22 nt, Human
ucacugaguuaggaggcauggg

SEQ ID NO: 626099 - RNA, 20 nt, Human
uccacagauggaauauucgc

SEQ ID NO: 626100 - RNA, 22 nt, Human
uccagaaccacacuggccagac

SEQ ID NO: 626101 - RNA, 20 nt, Human
uccuguccccugaagagcca

SEQ ID NO: 626102 - RNA, 20 nt, Human
ugaacccagcacaaaagaga

SEQ ID NO: 626103 - RNA, 19 nt, Human
ugacuccugaugucacccu

SEQ ID NO: 626104 - RNA, 28 nt, Human
ugacuucccucccuuaccccacaccucc

SEQ ID NO: 626105 - RNA, 25 nt, Human
ugagaaccagcugccaccccgauga

SEQ ID NO: 626106 - RNA, 19 nt, Human
ugcagaaagacauuauggg

SEQ ID NO: 626107 - RNA, 18 nt, Human
ugccccagcuggaagcag

SEQ ID NO: 626108 - RNA, 18 nt, Human
uggauaugaucaucugac

SEQ ID NO: 626109 - RNA, 23 nt, Human
uggaugcuugaaggaauggagag

SEQ ID NO: 626110 - RNA, 19 nt, Human
uguuauaaaaggcguaaag

SEQ ID NO: 626111 - RNA, 20 nt, Human
uugagcugacaacacugcca

SEQ ID NO: 626112 - RNA, 25 nt, Human
uuuaaagcaauggaaucaauaaauu

SEQ ID NO: 626113 - RNA, 20 nt, Human
uuuuuuuuuuuaaagcaauu

SEQ ID NO: 626114 - RNA, 19 nt, Human
uuuuuuuuuuuuuuuuuaa

SEQ ID NO: 626115 - RNA, 22 nt, Human
aaaaacauuaaagcaaaccccc

SEQ ID NO: 626116 - RNA, 22 nt, Human
aacauuaaagcaaacccccaaa

SEQ ID NO: 626117 - RNA, 19 nt, Human
aacccacucugccaaccuc

SEQ ID NO: 626118 - RNA, 19 nt, Human
aacccacucugccaaccuc

SEQ ID NO: 626119 - RNA, 20 nt, Human
aacccacucugccaaccuca

SEQ ID NO: 626120 - RNA, 20 nt, Human
aacccacucugccaaccuca

SEQ ID NO: 626121 - RNA, 25 nt, Human
aacccccaaaaccccacaccgaaaa

SEQ ID NO: 626122 - RNA, 25 nt, Human
aacccccaaaaccccacaccgaaaa

SEQ ID NO: 626123 - RNA, 20 nt, Human
aagcaaacccccaaaacccc

SEQ ID NO: 626124 - RNA, 20 nt, Human
aagcaaacccccaaaacccc

SEQ ID NO: 626125 - RNA, 23 nt, Human
aagcaaacccccaaaaccccaca

SEQ ID NO: 626126 - RNA, 23 nt, Human
aagcaaacccccaaaaccccaca

SEQ ID NO: 626127 - RNA, 23 nt, Human
acagagagaggaagcgccacaac

SEQ ID NO: 626128 - RNA, 23 nt, Human
acagagagaggaagcgccacaac

SEQ ID NO: 626129 - RNA, 22 nt, Human
acagagcguagcuguugagccc

SEQ ID NO: 626130 - RNA, 22 nt, Human
acagagcguagcuguugagccc

SEQ ID NO: 626131 - RNA, 23 nt, Human
acagagcguagcuguugagcccu

SEQ ID NO: 626132 - RNA, 23 nt, Human
acagagcguagcuguugagcccu

SEQ ID NO: 626133 - RNA, 21 nt, Human
acauuaaagcaaacccccaaa

SEQ ID NO: 626134 - RNA, 23 nt, Human
accaaggcccccaguagggguga

SEQ ID NO: 626135 - RNA, 29 nt, Human
acccccaaaaccccacaccgaaaacaaag

SEQ ID NO: 626136 - RNA, 18 nt, Human
accgaaaacaaaggcuug

SEQ ID NO: 626137 - RNA, 18 nt, Human
accgaaaacaaaggcuug

SEQ ID NO: 626138 - RNA, 22 nt, Human
agaaacuggcagaauccgaccc

SEQ ID NO: 626139 - RNA, 22 nt, Human
agaaacuggcagaauccgaccc

SEQ ID NO: 626140 - RNA, 19 nt, Human
agcaaaccacugugggauc

SEQ ID NO: 626141 - RNA, 20 nt, Human
agcaaacccccaaaacccca

SEQ ID NO: 626142 - RNA, 18 nt, Human
agccaaaugggcagugga

SEQ ID NO: 626143 - RNA, 20 nt, Human
aggccccgagagcuggcuug

SEQ ID NO: 626144 - RNA, 20 nt, Human
aggccccgagagcuggcuug

SEQ ID NO: 626145 - RNA, 21 nt, Human
aggggcugguccccccugggc

SEQ ID NO: 626146 - RNA, 18 nt, Human
auggccuucuuagcaaac

SEQ ID NO: 626147 - RNA, 22 nt, Human
caaaaaccuggagcagaguuuc

SEQ ID NO: 626148 - RNA, 23 nt, Human
caaaauacaaagcccaacauuua

SEQ ID NO: 626149 - RNA, 20 nt, Human
caaaggguauggcugguguc

SEQ ID NO: 626150 - RNA, 26 nt, Human
caacgccugaggaccagcacccaucu

SEQ ID NO: 626151 - RNA, 26 nt, Human
caacgccugaggaccagcacccaucu

SEQ ID NO: 626152 - RNA, 19 nt, Human
caaggcaaagaagaauaug

SEQ ID NO: 626153 - RNA, 21 nt, Human
cacucugccaaccucaaggcc

SEQ ID NO: 626154 - RNA, 21 nt, Human
cacucugccaaccucaaggcc

SEQ ID NO: 626155 - RNA, 25 nt, Human
cacucugccaaccucaaggccagcc

SEQ ID NO: 626156 - RNA, 25 nt, Human
cacucugccaaccucaaggccagcc

SEQ ID NO: 626157 - RNA, 19 nt, Human
cacuggaaaaaaggccccg

SEQ ID NO: 626158 - RNA, 24 nt, Human
cacuggaaaaaaggccccgagagc

SEQ ID NO: 626159 - RNA, 19 nt, Human
cagaguagccaaaugggca

SEQ ID NO: 626160 - RNA, 21 nt, Human
cagcagaguagccaaaugggc

SEQ ID NO: 626161 - RNA, 21 nt, Human
cagcagaguagccaaaugggc

SEQ ID NO: 626162 - RNA, 24 nt, Human
cagcaguguccccaacgccugagg

SEQ ID NO: 626163 - RNA, 23 nt, Human
caggaaguggcuucugagugaug

SEQ ID NO: 626164 - RNA, 24 nt, Human
caggcuggcucccaagcuuggugc

SEQ ID NO: 626165 - RNA, 25 nt, Human
caggcuggcucccaagcuuggugca

SEQ ID NO: 626166 - RNA, 21 nt, Human
caucaaaauaaaaagcccaac

SEQ ID NO: 626167 - RNA, 21 nt, Human
caugacagguaccuguccacc

SEQ ID NO: 626168 - RNA, 21 nt, Human
caugucuuugagcacuugaug

SEQ ID NO: 626169 - RNA, 21 nt, Human
caugucuuugagcacuugaug

SEQ ID NO: 626170 - RNA, 23 nt, Human
cauuaaagcaaacccccaaaacc

SEQ ID NO: 626171 - RNA, 23 nt, Human
cauuaaagcaaacccccaaaacc

SEQ ID NO: 626172 - RNA, 18 nt, Human
ccaaggguggggcugugg

SEQ ID NO: 626173 - RNA, 18 nt, Human
ccaaggguggggcugugu

SEQ ID NO: 626174 - RNA, 21 nt, Human
ccaaggguggggcuguguggc

SEQ ID NO: 626175 - RNA, 26 nt, Human
ccagcaguguccccaacgccugagga

SEQ ID NO: 626176 - RNA, 22 nt, Human
cccaaaaccccacaccgaaaac

SEQ ID NO: 626177 - RNA, 22 nt, Human
cccaaaaccccacaccgaaaac

SEQ ID NO: 626178 - RNA, 20 nt, Human
cccacacagagagaggaagc

SEQ ID NO: 626179 - RNA, 20 nt, Human
cccacacagagagaggaagc

SEQ ID NO: 626180 - RNA, 18 nt, Human
cccacaccgaaaacaaag

SEQ ID NO: 626181 - RNA, 18 nt, Human
cccacaccgaaaacaaag

SEQ ID NO: 626182 - RNA, 20 nt, Human
cccacaccgaaaacaaaggc

SEQ ID NO: 626183 - RNA, 20 nt, Human
cccacaccgaaaacaaaggc

SEQ ID NO: 626184 - RNA, 21 nt, Human
ccccacaccgaaaacaaaggc

SEQ ID NO: 626185 - RNA, 23 nt, Human
ccccacaccgaaaacaaaggcug

SEQ ID NO: 626186 - RNA, 24 nt, Human
ccccaucgacccagcagugucccc

SEQ ID NO: 626187 - RNA, 24 nt, Human
ccccaucgacccagcagugucccc

SEQ ID NO: 626188 - RNA, 23 nt, Human
cccccaaaaccccacaccgaaaa

SEQ ID NO: 626189 - RNA, 23 nt, Human
cccccaaaaccccacaccgaaaa

SEQ ID NO: 626190 - RNA, 24 nt, Human
cccccaaaaccccacaccgaaaac

SEQ ID NO: 626191 - RNA, 24 nt, Human
cccccaaaaccccacaccgaaaac

SEQ ID NO: 626192 - RNA, 28 nt, Human
cccccaaaaccccacaccgaaaacaaag

SEQ ID NO: 626193 - RNA, 22 nt, Human
ccccugggcuggaggagagugg

SEQ ID NO: 626194 - RNA, 20 nt, Human
ccucucagcccaaggguggg

SEQ ID NO: 626195 - RNA, 25 nt, Human
ccucucagcccaaggguggggcugu

SEQ ID NO: 626196 - RNA, 27 nt, Human
ccucucagcccaaggguggggcugugu

SEQ ID NO: 626197 - RNA, 19 nt, Human
ccucugcggcugcaggaac

SEQ ID NO: 626198 - RNA, 20 nt, Human
ccucugcggcugcaggaacu

SEQ ID NO: 626199 - RNA, 20 nt, Human
cggcgcugagcucugcgcug

SEQ ID NO: 626200 - RNA, 22 nt, Human
cggcgcugagcucugcgcuguc

SEQ ID NO: 626201 - RNA, 18 nt, Human
cuaaaaugccauuaugcu

SEQ ID NO: 626202 - RNA, 18 nt, Human
cuaaaaugccauuauucu

SEQ ID NO: 626203 - RNA, 23 nt, Human
cucaaggcaaagaagaauaugua

SEQ ID NO: 626204 - RNA, 24 nt, Human
cucagcccaaggguggggcugugg

SEQ ID NO: 626205 - RNA, 25 nt, Human
cucugcggcugcaggaaccccgcuc

SEQ ID NO: 626206 - RNA, 25 nt, Human
cucugcggcugcaggaaccccgcuc

SEQ ID NO: 626207 - RNA, 20 nt, Human
cuggaggggcuucccagguc

SEQ ID NO: 626208 - RNA, 20 nt, Human
cuggaggggcuucccagguc

SEQ ID NO: 626209 - RNA, 20 nt, Human
cuuggccgugaguccuuggc

SEQ ID NO: 626210 - RNA, 21 nt, Human
cuuggccgugaguccuuggcc

SEQ ID NO: 626211 - RNA, 22 nt, Human
gaacgccccucacagugaagaa

SEQ ID NO: 626212 - RNA, 22 nt, Human
gaacgccccucacagugaagaa

SEQ ID NO: 626213 - RNA, 20 nt, Human
gaagaccccgugcugguuuc

SEQ ID NO: 626214 - RNA, 20 nt, Human
gaagaccccgugcugguuuc

SEQ ID NO: 626215 - RNA, 22 nt, Human
gacacaggaaguggcuucugag

SEQ ID NO: 626216 - RNA, 25 nt, Human
gaccccaucgacccagcaguguccc

SEQ ID NO: 626217 - RNA, 25 nt, Human
gaccccaucgacccagcaguguccc

SEQ ID NO: 626218 - RNA, 18 nt, Human
gagguggugaggggcugg

SEQ ID NO: 626219 - RNA, 18 nt, Human
gcaaacccccaaaacccc

SEQ ID NO: 626220 - RNA, 19 nt, Human
gcaaacccccaaaacccca

SEQ ID NO: 626221 - RNA, 19 nt, Human
gcaaacccccaaaacccca

SEQ ID NO: 626222 - RNA, 21 nt, Human
gcagagcagaaacuggcagaa

SEQ ID NO: 626223 - RNA, 21 nt, Human
gcagagcagaaacuggcagaa

SEQ ID NO: 626224 - RNA, 20 nt, Human
gcagcagaguagccaaaugg

SEQ ID NO: 626225 - RNA, 20 nt, Human
gcagcagaguagccaaaugg

SEQ ID NO: 626226 - RNA, 18 nt, Human
gcaggcuggcucccaagc

SEQ ID NO: 626227 - RNA, 20 nt, Human
gcggagggagggaaaggccg

SEQ ID NO: 626228 - RNA, 20 nt, Human
gcggagggagggaaaggccg

SEQ ID NO: 626229 - RNA, 21 nt, Human
gcugguccccccugggcugga

SEQ ID NO: 626230 - RNA, 24 nt, Human
ggugaagccccugggcucugggag

SEQ ID NO: 626231 - RNA, 24 nt, Human
ggugaagccccugggcucugggag

SEQ ID NO: 626232 - RNA, 21 nt, Human
gucugaaguacggacguggag

SEQ ID NO: 626233 - RNA, 23 nt, Human
gugugguggaggccauaggaagc

SEQ ID NO: 626234 - RNA, 26 nt, Human
uaaaaagcccaacauuuacaauuuca

SEQ ID NO: 626235 - RNA, 23 nt, Human
uaaaaugccauuaugcucaguuu

SEQ ID NO: 626236 - RNA, 22 nt, Human
uaaagcaaacccccaaaacccc

SEQ ID NO: 626237 - RNA, 22 nt, Human
uaaagcaaacccccaaaacccc

SEQ ID NO: 626238 - RNA, 23 nt, Human
uaagccacuguccuggucccaca

SEQ ID NO: 626239 - RNA, 23 nt, Human
uaagccacuguccuggucccaca

SEQ ID NO: 626240 - RNA, 24 nt, Human
ucaaaaacauuaaagcaaaccccc

SEQ ID NO: 626241 - RNA, 19 nt, Human
ucaacaaaaaccuggagca

SEQ ID NO: 626242 - RNA, 21 nt, Human
uccucucagcccaaggguggg

SEQ ID NO: 626243 - RNA, 20 nt, Human
ucgaacggauucagggccaa

SEQ ID NO: 626244 - RNA, 18 nt, Human
ucgacccagcaguguccc

SEQ ID NO: 626245 - RNA, 18 nt, Human
ucgacccagcaguguccc

SEQ ID NO: 626246 - RNA, 23 nt, Human
ucgccuguggggugaaugaaggu

SEQ ID NO: 626247 - RNA, 23 nt, Human
ucgccuguggggugaaugaaggu

SEQ ID NO: 626248 - RNA, 23 nt, Human
ucgcucgccucagagauggaagc

SEQ ID NO: 626249 - RNA, 21 nt, Human
ucuacggcccagucuuggaac

SEQ ID NO: 626250 - RNA, 21 nt, Human
ucuacggcccagucuuggaac

SEQ ID NO: 626251 - RNA, 19 nt, Human
ucugaccuccagaucucgu

SEQ ID NO: 626252 - RNA, 18 nt, Human
ucugugacaaggcacagg

SEQ ID NO: 626253 - RNA, 18 nt, Human
ucugugacaaggcacagg

SEQ ID NO: 626254 - RNA, 22 nt, Human
ucuuuggcugcagagcagaaac

SEQ ID NO: 626255 - RNA, 21 nt, Human
ucuuuggcugcagagcagaac

SEQ ID NO: 626256 - RNA, 22 nt, Human
ugaagaacgccccucacaguga

SEQ ID NO: 626257 - RNA, 22 nt, Human
ugaagaacgccccucacaguga

SEQ ID NO: 626258 - RNA, 19 nt, Human
ugaagccccugggcucugg

SEQ ID NO: 626259 - RNA, 19 nt, Human
ugaagccccugggcucugg

SEQ ID NO: 626260 - RNA, 22 nt, Human
ugaauacuuaaguaccacugaa

SEQ ID NO: 626261 - RNA, 22 nt, Human
ugaauacuuaaguaccacugaa

SEQ ID NO: 626262 - RNA, 18 nt, Human
ugagaugcuguucucccu

SEQ ID NO: 626263 - RNA, 18 nt, Human
ugagaugcuguucucccu

SEQ ID NO: 626264 - RNA, 18 nt, Human
ugaggcucaaggcaaaga

SEQ ID NO: 626265 - RNA, 23 nt, Human
ugauguuacugaagugacaaugc

SEQ ID NO: 626266 - RNA, 23 nt, Human
ugauguuacugaagugacaaugc

SEQ ID NO: 626267 - RNA, 25 nt, Human
ugcagcagaguagccaaaugggcac

SEQ ID NO: 626268 - RNA, 23 nt, Human
ugcauucacagaugucugaugag

SEQ ID NO: 626269 - RNA, 20 nt, Human
ugcguuuccuccagaugccu

SEQ ID NO: 626270 - RNA, 20 nt, Human
ugcguuuccuccagaugccu

SEQ ID NO: 626271 - RNA, 21 nt, Human
ugcucaauggcuuggggucug

SEQ ID NO: 626272 - RNA, 21 nt, Human
ugcucaauggcuuggggucug

SEQ ID NO: 626273 - RNA, 18 nt, Human
ugcuggggcccaccugcc

SEQ ID NO: 626274 - RNA, 18 nt, Human
ugcuggggcccaccugcc

SEQ ID NO: 626275 - RNA, 21 nt, Human
uggaaaaaaggccccgagagc

SEQ ID NO: 626276 - RNA, 21 nt, Human
uggaaaaaaggccccgagagc

SEQ ID NO: 626277 - RNA, 21 nt, Human
uggaggagaguggugggggca

SEQ ID NO: 626278 - RNA, 19 nt, Human
uggcagaauccgaccccau

SEQ ID NO: 626279 - RNA, 19 nt, Human
uggcagaauccgaccccau

SEQ ID NO: 626280 - RNA, 21 nt, Human
uggcaggcuggcucccaagcu

SEQ ID NO: 626281 - RNA, 25 nt, Human
uggcaggcuggcucccaagcuuggu

SEQ ID NO: 626282 - RNA, 25 nt, Human
uggcaggcuggcucccaagcuuggu

SEQ ID NO: 626283 - RNA, 22 nt, Human
uggccacugcuuugggugaugu

SEQ ID NO: 626284 - RNA, 22 nt, Human
uggccacugcuuugggugaugu

SEQ ID NO: 626285 - RNA, 23 nt, Human
uggcggagggagggaaaggccgg

SEQ ID NO: 626286 - RNA, 20 nt, Human
uggcugcagagcagaaacug

SEQ ID NO: 626287 - RNA, 20 nt, Human
uggcugcagagcagaaacug

SEQ ID NO: 626288 - RNA, 19 nt, Human
ugggagguggugaggggcu

SEQ ID NO: 626289 - RNA, 19 nt, Human
ugggcaguggaaaaaaggc

SEQ ID NO: 626290 - RNA, 18 nt, Human
ugggcuggaggagagugg

SEQ ID NO: 626291 - RNA, 25 nt, Human
ugggcuggaggagaguggugggggc

SEQ ID NO: 626292 - RNA, 18 nt, Human
ugugguggaggccauagg

SEQ ID NO: 626293 - RNA, 21 nt, Human
uuaaagcaaacccccaaaacc

SEQ ID NO: 626294 - RNA, 21 nt, Human
uuaaagcaaacccccaaaacc

SEQ ID NO: 626295 - RNA, 25 nt, Human
uuaaagcaaacccccaaaaccccac

SEQ ID NO: 626296 - RNA, 25 nt, Human
uuaaagcaaacccccaaaaccccac

SEQ ID NO: 626297 - RNA, 24 nt, Human
uucaaaaacauuaaagcaaacccc

SEQ ID NO: 626298 - RNA, 24 nt, Human
uucaaaaacauuaaagcaaacccc

SEQ ID NO: 626299 - RNA, 21 nt, Human
uuccuuucuugguugcguuuc

SEQ ID NO: 626300 - RNA, 21 nt, Human
uuccuuucuugguugcguuuc

SEQ ID NO: 626301 - RNA, 19 nt, Human
uugcuggggcccaccugcc

SEQ ID NO: 626302 - RNA, 21 nt, Human
uugcuggggcccaccugccuu

SEQ ID NO: 626303 - RNA, 22 nt, Human
uugggugaugugcucaauggcu

SEQ ID NO: 626304 - RNA, 22 nt, Human
uugggugaugugcucaauggcu

SEQ ID NO: 626305 - RNA, 27 nt, Human
uuuuuuuuucagaagcaaggacauguu

SEQ ID NO: 626306 - RNA, 22 nt, Human
uuuuuuuuuuuuuuuuuuucag

SEQ ID NO: 626307 - RNA, 21 nt, Human
aaacagcagugcccagaauuu

SEQ ID NO: 626308 - RNA, 20 nt, Human
aaagcccauuaucaacaaca

SEQ ID NO: 626309 - RNA, 18 nt, Human
aaauaccacaaacagcag

SEQ ID NO: 626310 - RNA, 22 nt, Human
aagcuagaaccaaaacagucau

SEQ ID NO: 626311 - RNA, 18 nt, Human
aagugauaugcuugugcc

SEQ ID NO: 626312 - RNA, 23 nt, Human
acaaagcccauuaucaacaacaa

SEQ ID NO: 626313 - RNA, 21 nt, Human
accaauaacaagauaaaaaca

SEQ ID NO: 626314 - RNA, 19 nt, Human
acccaagcauaacaccguc

SEQ ID NO: 626315 - RNA, 24 nt, Human
acccagauuaaauccaaauccaau

SEQ ID NO: 626316 - RNA, 19 nt, Human
acugggcaacccaaacacc

SEQ ID NO: 626317 - RNA, 22 nt, Human
agacaaauaccacaaacagcag

SEQ ID NO: 626318 - RNA, 27 nt, Human
agacaaauaccacaaacagcagugccc

SEQ ID NO: 626319 - RNA, 28 nt, Human
agacaaauaccacaaacagcagugcccu

SEQ ID NO: 626320 - RNA, 24 nt, Human
agauaacuugaaaacaagggcccc

SEQ ID NO: 626321 - RNA, 22 nt, Human
agcagugugagucagcagccuc

SEQ ID NO: 626322 - RNA, 20 nt, Human
agcccagaauuuagaguuau

SEQ ID NO: 626323 - RNA, 22 nt, Human
aggaagacuguagaagguacuu

SEQ ID NO: 626324 - RNA, 21 nt, Human
aguuaauugaacuguuucuua

SEQ ID NO: 626325 - RNA, 19 nt, Human
auugauuugcuuuugucag

SEQ ID NO: 626326 - RNA, 23 nt, Human
caaaaucuaaagcuagaaccaaa

SEQ ID NO: 626327 - RNA, 24 nt, Human
caagauaaaaacagcucuuucuua

SEQ ID NO: 626328 - RNA, 18 nt, Human
caagauaaaucccugagc

SEQ ID NO: 626329 - RNA, 19 nt, Human
caagauaaaucccugagcc

SEQ ID NO: 626330 - RNA, 22 nt, Human
caagauaaaucccugagcccua

SEQ ID NO: 626331 - RNA, 21 nt, Human
caccaauaacaagauaaaaac

SEQ ID NO: 626332 - RNA, 21 nt, Human
cagcaauucuguuaccuuggc

SEQ ID NO: 626333 - RNA, 21 nt, Human
ccucugaaccccucagguagg

SEQ ID NO: 626334 - RNA, 23 nt, Human
cuaacacccaagcauaacaccgu

SEQ ID NO: 626335 - RNA, 28 nt, Human
cuagaagacugaaugagauuaacuuaag

SEQ ID NO: 626336 - RNA, 21 nt, Human
gaaaauccaaaaucuaaagcu

SEQ ID NO: 626337 - RNA, 19 nt, Human
gaaugagauuaacuuaaaa

SEQ ID NO: 626338 - RNA, 19 nt, Human
gagcccagggacucaacaa

SEQ ID NO: 626339 - RNA, 20 nt, Human
gaguuuucaucuaacaaucu

SEQ ID NO: 626340 - RNA, 19 nt, Human
gaugcauugugcuucugga

SEQ ID NO: 626341 - RNA, 23 nt, Human
uaaaucccugagcccuacucaca

SEQ ID NO: 626342 - RNA, 24 nt, Human
uaacaaagcccauuaucucuaaau

SEQ ID NO: 626343 - RNA, 27 nt, Human
uaaugacugaaauauaaacagcauaaa

SEQ ID NO: 626344 - RNA, 21 nt, Human
uacaacgcucugaacugcugg

SEQ ID NO: 626345 - RNA, 21 nt, Human
uaccacaaacagcagugccca

SEQ ID NO: 626346 - RNA, 23 nt, Human
uacccagauuaaauccaaaucca

SEQ ID NO: 626347 - RNA, 18 nt, Human
uacucugagacaaauacc

SEQ ID NO: 626348 - RNA, 22 nt, Human
uagaaccaaaacagucauaagc

SEQ ID NO: 626349 - RNA, 23 nt, Human
uagauaauuuggaaaguaggguu

SEQ ID NO: 626350 - RNA, 20 nt, Human
uaggaagacuguagaaggua

SEQ ID NO: 626351 - RNA, 19 nt, Human
uaucuaauguaaauuaaca

SEQ ID NO: 626352 - RNA, 24 nt, Human
uauugugaaauauaaaaaaguaua

SEQ ID NO: 626353 - RNA, 20 nt, Human
uccaaaaucuaaagcuagaa

SEQ ID NO: 626354 - RNA, 21 nt, Human
uccaaauauggcagacugggg

SEQ ID NO: 626355 - RNA, 28 nt, Human
ucuaaagcuagaaccaaaaccggggucc

SEQ ID NO: 626356 - RNA, 21 nt, Human
ucucagaaggcugauuuuacc

SEQ ID NO: 626357 - RNA, 23 nt, Human
ugacagcuacaggaauguuagua

SEQ ID NO: 626358 - RNA, 23 nt, Human
ugagucagcagccucugaacccc

SEQ ID NO: 626359 - RNA, 18 nt, Human
ugauaugcuugugcccuc

SEQ ID NO: 626360 - RNA, 20 nt, Human
ugauaugcuugugcccucug

SEQ ID NO: 626361 - RNA, 24 nt, Human
ugcagaaugagcccagggacucaa

SEQ ID NO: 626362 - RNA, 27 nt, Human
ugcagaaugagcccagggacucaacaa

SEQ ID NO: 626363 - RNA, 22 nt, Human
uguaaauuaacacaugacuggu

SEQ ID NO: 626364 - RNA, 22 nt, Human
uguuuuaaaaagugcuaacaaa

SEQ ID NO: 626365 - RNA, 25 nt, Human
uuaaaaaagcauuuauuacuagaag

SEQ ID NO: 626366 - RNA, 21 nt, Human
uuaacacaugacuggugaaaa

SEQ ID NO: 626367 - RNA, 21 nt, Human
uuggccuucagacacauuggu

SEQ ID NO: 626368 - RNA, 18 nt, Human
uuuguuuguuuguuuuaa

SEQ ID NO: 626369 - RNA, 24 nt, Human
aaaaaaaaaaaaaaucagggcaag

SEQ ID NO: 626370 - RNA, 24 nt, Human
aaaaaaaaaaauauguacaaaaaa

SEQ ID NO: 626371 - RNA, 24 nt, Human
aaaaaacagcuugugacacaucag

SEQ ID NO: 626372 - RNA, 21 nt, Human
aaaaaaucagggcaagcuaca

SEQ ID NO: 626373 - RNA, 21 nt, Human
aaacaacgucaaccauugaau

SEQ ID NO: 626374 - RNA, 21 nt, Human
aaacaacgucaaccauugaau

SEQ ID NO: 626375 - RNA, 22 nt, Human
aaacagcuugugacacaucagu

SEQ ID NO: 626376 - RNA, 20 nt, Human
aacauuguccuuccugcagc

SEQ ID NO: 626377 - RNA, 23 nt, Human
aauauguacaaaaaaagcugaga

SEQ ID NO: 626378 - RNA, 20 nt, Human
acugcccuaaugccaugaaa

SEQ ID NO: 626379 - RNA, 18 nt, Human
acuuguuccuaauccucc

SEQ ID NO: 626380 - RNA, 19 nt, Human
agacugcaccgucaaaaac

SEQ ID NO: 626381 - RNA, 24 nt, Human
agagaucagagugcaacauucuuu

SEQ ID NO: 626382 - RNA, 23 nt, Human
agccacaaagugaaacuguuguu

SEQ ID NO: 626383 - RNA, 18 nt, Human
auaaccccaauacccucc

SEQ ID NO: 626384 - RNA, 19 nt, Human
auacccuccaaauccagaa

SEQ ID NO: 626385 - RNA, 22 nt, Human
auagaauucuaauugccuagua

SEQ ID NO: 626386 - RNA, 18 nt, Human
auauaaccccaauacccu

SEQ ID NO: 626387 - RNA, 25 nt, Human
auauagcaagacugcaccgucaaaa

SEQ ID NO: 626388 - RNA, 22 nt, Human
aucacaaaacaacgucaaccau

SEQ ID NO: 626389 - RNA, 23 nt, Human
caaaaaaagcugagaagagccaa

SEQ ID NO: 626390 - RNA, 25 nt, Human
caaaacaacgucaaccauugaauaa

SEQ ID NO: 626391 - RNA, 21 nt, Human
caccauauagcaagacugcac

SEQ ID NO: 626392 - RNA, 18 nt, Human
caccgucaaaaacugucc

SEQ ID NO: 626393 - RNA, 19 nt, Human
cagagugcaacauucuuuu

SEQ ID NO: 626394 - RNA, 20 nt, Human
cccaauacccuccaaaucca

SEQ ID NO: 626395 - RNA, 25 nt, Human
cccaauacccuccaaauccagaauu

SEQ ID NO: 626396 - RNA, 23 nt, Human
ccccaguagacugcccuaaugcc

SEQ ID NO: 626397 - RNA, 21 nt, Human
cugaccaaaaaaaaaaaaaaa

SEQ ID NO: 626398 - RNA, 21 nt, Human
cugaccaaaaaaaaaaaaaaa

SEQ ID NO: 626399 - RNA, 23 nt, Human
cugaccaaaaaaaaaaaaaaaau

SEQ ID NO: 626400 - RNA, 22 nt, Human
cuuacuuguuccuaauccuccc

SEQ ID NO: 626401 - RNA, 18 nt, Human
cuuugaacguaacaauuu

SEQ ID NO: 626402 - RNA, 19 nt, Human
gaaaagcugacaguggcac

SEQ ID NO: 626403 - RNA, 23 nt, Human
gccauuaucuaagaaagaaucau

SEQ ID NO: 626404 - RNA, 21 nt, Human
ggagaaaagcugacaguggca

SEQ ID NO: 626405 - RNA, 20 nt, Human
ggcaagcuacaucacuuccu

SEQ ID NO: 626406 - RNA, 21 nt, Human
uaaaaaacagcuugugacaca

SEQ ID NO: 626407 - RNA, 23 nt, Human
uaacuaggugacuuuguuaauau

SEQ ID NO: 626408 - RNA, 24 nt, Human
uagcaagacugcaccgucaaaaaa

SEQ ID NO: 626409 - RNA, 24 nt, Human
uauagaauuggaagaugauuuuaa

SEQ ID NO: 626410 - RNA, 20 nt, Human
uauagcaagacugcaccguc

SEQ ID NO: 626411 - RNA, 18 nt, Human
ucaaaaauucuggaggag

SEQ ID NO: 626412 - RNA, 24 nt, Human
ucaaugcacgcuugaacaagaaaa

SEQ ID NO: 626413 - RNA, 21 nt, Human
uccugcagcucaaaaguuugc

SEQ ID NO: 626414 - RNA, 24 nt, Human
ucuagaauaauuaaaagccacaaa

SEQ ID NO: 626415 - RNA, 21 nt, Human
ucuucucuuuaaaaaaaaaaa

SEQ ID NO: 626416 - RNA, 18 nt, Human
ugaauaguuuuacagcca

SEQ ID NO: 626417 - RNA, 26 nt, Human
ugaccaaaaaaaaaaaaaaaaucagg

SEQ ID NO: 626418 - RNA, 20 nt, Human
ugaccaggucaggagccgcu

SEQ ID NO: 626419 - RNA, 18 nt, Human
ugagaagagccaacaugg

SEQ ID NO: 626420 - RNA, 19 nt, Human
ugagaagagccaacaugga

SEQ ID NO: 626421 - RNA, 21 nt, Human
ugagaagagccaacauggaag

SEQ ID NO: 626422 - RNA, 21 nt, Human
ugagaagagccaacauggaag

SEQ ID NO: 626423 - RNA, 22 nt, Human
ugcaguuaaaauucuagaauaa

SEQ ID NO: 626424 - RNA, 21 nt, Human
ugccagaagacauuccagaaa

SEQ ID NO: 626425 - RNA, 21 nt, Human
uggagaaaagcugacaguggc

SEQ ID NO: 626426 - RNA, 23 nt, Human
uggcauaaauauauuaaagcuga

SEQ ID NO: 626427 - RNA, 25 nt, Human
uuaaccaacauuguccuuccugcag

SEQ ID NO: 626428 - RNA, 21 nt, Human
uuaguucucaccaugcuagaa

SEQ ID NO: 626429 - RNA, 23 nt, Human
uugaaguauagaauuggaagaug

SEQ ID NO: 626430 - RNA, 20 nt, Human
uuuaaacuuugaacguaaca

SEQ ID NO: 626431 - RNA, 23 nt, Human
uuuuacagccaaaaugaccaggu

SEQ ID NO: 626432 - RNA, 20 nt, Human
uuuugugauaacuuuuucuu

SEQ ID NO: 626433 - RNA, 24 nt, Human
uuuuuggagaaaagcugacagugg

SEQ ID NO: 626434 - RNA, 23 nt, Human
uuuuuuuuuuuuuuugugauaac

SEQ ID NO: 626435 - RNA, 18 nt, Human
uuuuuuuuuuuuuuuuug

SEQ ID NO: 626436 - RNA, 19 nt, Human
uuuuuuuuuuuuuuuuugu

SEQ ID NO: 626437 - RNA, 25 nt, Human
aaaagaccugaaauuucugcaaggg

SEQ ID NO: 626438 - RNA, 22 nt, Human
aaaaggcacaaagucaucugag

SEQ ID NO: 626439 - RNA, 24 nt, Human
aacacacuuccccaagaauuuaua

SEQ ID NO: 626440 - RNA, 22 nt, Human
aacacuagacccagcuuggcca

SEQ ID NO: 626441 - RNA, 23 nt, Human
aagaaaacaaaauaaaacaagug

SEQ ID NO: 626442 - RNA, 18 nt, Human
acacuagacccagcuugg

SEQ ID NO: 626443 - RNA, 25 nt, Human
acaggcugcucuggauuugacaggg

SEQ ID NO: 626444 - RNA, 18 nt, Human
accccacugcauguuaau

SEQ ID NO: 626445 - RNA, 19 nt, Human
agaagaagccaguuuugcg

SEQ ID NO: 626446 - RNA, 21 nt, Human
agaaggcuccuaugaucccac

SEQ ID NO: 626447 - RNA, 18 nt, Human
agugaccagaagaagcca

SEQ ID NO: 626448 - RNA, 24 nt, Human
cacaucauucgcaauaacaaaucc

SEQ ID NO: 626449 - RNA, 22 nt, Human
cagaaggcuccuaugaucccac

SEQ ID NO: 626450 - RNA, 21 nt, Human
cagcaaaagaaacacuagacc

SEQ ID NO: 626451 - RNA, 22 nt, Human
cagcaaaagaaacacuagaccc

SEQ ID NO: 626452 - RNA, 20 nt, Human
ccagucugcagucacuagaa

SEQ ID NO: 626453 - RNA, 25 nt, Human
cccaaccccauuuaaaaauaaaaau

SEQ ID NO: 626454 - RNA, 18 nt, Human
ccccgcugccuugggccu

SEQ ID NO: 626455 - RNA, 20 nt, Human
ccccgcugccuugggccugc

SEQ ID NO: 626456 - RNA, 19 nt, Human
ccugaaauuucugcaaggg

SEQ ID NO: 626457 - RNA, 18 nt, Human
cgagcagguagcagcgcu

SEQ ID NO: 626458 - RNA, 24 nt, Human
gaaguacaacuuuugaaagucuau

SEQ ID NO: 626459 - RNA, 20 nt, Human
gcaaaagaaacacuagaccc

SEQ ID NO: 626460 - RNA, 21 nt, Human
guaaagcacuccauucaauaa

SEQ ID NO: 626461 - RNA, 23 nt, Human
guaaagcacuccauucaauaaaa

SEQ ID NO: 626462 - RNA, 22 nt, Human
guagcagcgcuuguuguccaca

SEQ ID NO: 626463 - RNA, 18 nt, Human
uaaaaaauacugcaccuu

SEQ ID NO: 626464 - RNA, 22 nt, Human
uaaaaaauacugcaccuuaaga

SEQ ID NO: 626465 - RNA, 20 nt, Human
uaaaacaagugauuucuaac

SEQ ID NO: 626466 - RNA, 26 nt, Human
uaaagcuuauaacacacuuccccaag

SEQ ID NO: 626467 - RNA, 24 nt, Human
uaacaaaagaccugaaauuucugc

SEQ ID NO: 626468 - RNA, 23 nt, Human
uaaccccacugcauguuaaugac

SEQ ID NO: 626469 - RNA, 21 nt, Human
uacugcaccuuaagaccaaua

SEQ ID NO: 626470 - RNA, 24 nt, Human
uauaacacacuuccccaagaauuu

SEQ ID NO: 626471 - RNA, 22 nt, Human
uccaaggaucccaaccccauuu

SEQ ID NO: 626472 - RNA, 21 nt, Human
ucccaccagucugcagucacu

SEQ ID NO: 626473 - RNA, 21 nt, Human
uccuggucauucagaaggcuc

SEQ ID NO: 626474 - RNA, 20 nt, Human
ugaaauauuccaaggauccc

SEQ ID NO: 626475 - RNA, 26 nt, Human
ugaaauauuccaaggaucccaacccc

SEQ ID NO: 626476 - RNA, 19 nt, Human
ugauagaaguacaacuuuu

SEQ ID NO: 626477 - RNA, 24 nt, Human
uuacaggccacaggcugcucugga

SEQ ID NO: 626478 - RNA, 23 nt, Human
uuauaacacacuuccccaagaau

SEQ ID NO: 626479 - RNA, 23 nt, Human
aacuccuaggcucaaaggauccu

SEQ ID NO: 626480 - RNA, 23 nt, Human
aagcaauccuccugccuuagccu

SEQ ID NO: 626481 - RNA, 24 nt, Human
aaggauccuccuguuucggccucu

SEQ ID NO: 626482 - RNA, 18 nt, Human
aagugcugggauuacagg

SEQ ID NO: 626483 - RNA, 18 nt, Human
aagugcugggauuacagg

SEQ ID NO: 626484 - RNA, 18 nt, Human
aagugcugggauuacagg

SEQ ID NO: 626485 - RNA, 26 nt, Human
aagugcugggauuacagggaugagcc

SEQ ID NO: 626486 - RNA, 19 nt, Human
aaucaugguucaccgcagc

SEQ ID NO: 626487 - RNA, 20 nt, Human
acccugcccgugcaagaccg

SEQ ID NO: 626488 - RNA, 22 nt, Human
accucggccaccccacggcucg

SEQ ID NO: 626489 - RNA, 18 nt, Human
acgggguuucaccacguu

SEQ ID NO: 626490 - RNA, 20 nt, Human
acgggguuucaccacguugg

SEQ ID NO: 626491 - RNA, 24 nt, Human
acgggguuucaccacguuggccag

SEQ ID NO: 626492 - RNA, 18 nt, Human
acucagucguccaggcug

SEQ ID NO: 626493 - RNA, 19 nt, Human
acucagucguccaggcugg

SEQ ID NO: 626494 - RNA, 18 nt, Human
acugcaaccuucuccucc

SEQ ID NO: 626495 - RNA, 19 nt, Human
agagacgggggguggagga

SEQ ID NO: 626496 - RNA, 18 nt, Human
agccuuuaaaauagcugg

SEQ ID NO: 626497 - RNA, 21 nt, Human
aggaacucucauuagguugcc

SEQ ID NO: 626498 - RNA, 19 nt, Human
aggacccgccgaccucggc

SEQ ID NO: 626499 - RNA, 22 nt, Human
aggaggaugggcaggaucgugg

SEQ ID NO: 626500 - RNA, 25 nt, Human
aggcuggagugcaguggcaccaucu

SEQ ID NO: 626501 - RNA, 23 nt, Human
aguagcugggauuacaggugcgu

SEQ ID NO: 626502 - RNA, 24 nt, Human
agugcugggauuacagggaugagc

SEQ ID NO: 626503 - RNA, 24 nt, Human
auuagguugcccaggcuggucucg

SEQ ID NO: 626504 - RNA, 24 nt, Human
caaacugcuagaauuucaggcaug

SEQ ID NO: 626505 - RNA, 22 nt, Human
caagcaauccuccugccuuagc

SEQ ID NO: 626506 - RNA, 24 nt, Human
caagcccuuggguccaggaucaca

SEQ ID NO: 626507 - RNA, 24 nt, Human
caccacgcccggcuaauuuuugua

SEQ ID NO: 626508 - RNA, 20 nt, Human
caccacguuggccagcaugc

SEQ ID NO: 626509 - RNA, 19 nt, Human
cacccccucggccggccua

SEQ ID NO: 626510 - RNA, 18 nt, Human
caccuucaauguugaccu

SEQ ID NO: 626511 - RNA, 21 nt, Human
cacugcaaccuucuccuccca

SEQ ID NO: 626512 - RNA, 24 nt, Human
cagccucgauguccugggcucaag

SEQ ID NO: 626513 - RNA, 23 nt, Human
cagcgccggaccccgcucugcag

SEQ ID NO: 626514 - RNA, 21 nt, Human
caggcaugagccaccgcaccc

SEQ ID NO: 626515 - RNA, 18 nt, Human
caggccuggcuaauuuuu

SEQ ID NO: 626516 - RNA, 19 nt, Human
caguagagacgggguuuca

SEQ ID NO: 626517 - RNA, 26 nt, Human
caguagagacgggguuucaccacguu

SEQ ID NO: 626518 - RNA, 23 nt, Human
caucacccaagcccuugggucca

SEQ ID NO: 626519 - RNA, 24 nt, Human
cauuagguugcccaggcuggucuc

SEQ ID NO: 626520 - RNA, 20 nt, Human
ccaccacgcccggcuaauuu

SEQ ID NO: 626521 - RNA, 18 nt, Human
ccaccuucaauguugacc

SEQ ID NO: 626522 - RNA, 18 nt, Human
ccaggcuggaauacagug

SEQ ID NO: 626523 - RNA, 22 nt, Human
cccagccagcucgggagguggg

SEQ ID NO: 626524 - RNA, 20 nt, Human
cccagguucaagcgauucuc

SEQ ID NO: 626525 - RNA, 22 nt, Human
cccagguucaagcgauucuccc

SEQ ID NO: 626526 - RNA, 23 nt, Human
cccgaguagcugggauuacaggu

SEQ ID NO: 626527 - RNA, 24 nt, Human
cccgaguagcugggauuacaggug

SEQ ID NO: 626528 - RNA, 24 nt, Human
cccggccuucucuuacacuuuuuc

SEQ ID NO: 626529 - RNA, 26 nt, Human
cccggucagacguucacuuuucuacc

SEQ ID NO: 626530 - RNA, 24 nt, Human
cccugccucagccucccgaguagc

SEQ ID NO: 626531 - RNA, 21 nt, Human
ccgaguagcugggauuacagg

SEQ ID NO: 626532 - RNA, 22 nt, Human
ccgcacccggccuucucuuaca

SEQ ID NO: 626533 - RNA, 23 nt, Human
ccgcagccucgauguccugggcu

SEQ ID NO: 626534 - RNA, 22 nt, Human
ccgggccgggugucgcagcgcc

SEQ ID NO: 626535 - RNA, 21 nt, Human
ccuaggcucaaaggauccucc

SEQ ID NO: 626536 - RNA, 24 nt, Human
ccucccagguucaagcgauucucc

SEQ ID NO: 626537 - RNA, 26 nt, Human
ccuccugccuuagccuuuaaaauagc

SEQ ID NO: 626538 - RNA, 22 nt, Human
ccuccuguuucggccucucaaa

SEQ ID NO: 626539 - RNA, 19 nt, Human
ccucgauguccugggcuca

SEQ ID NO: 626540 - RNA, 20 nt, Human
ccucgauguccugggcucaa

SEQ ID NO: 626541 - RNA, 24 nt, Human
ccucggccaccccacggcucgcgg

SEQ ID NO: 626542 - RNA, 23 nt, Human
ccucucugggcuugaaugggggc

SEQ ID NO: 626543 - RNA, 23 nt, Human
ccugccuuagccuuuaaaauagc

SEQ ID NO: 626544 - RNA, 19 nt, Human
ccugcugcugaagaucugg

SEQ ID NO: 626545 - RNA, 20 nt, Human
ccugggcucaagcaauccuc

SEQ ID NO: 626546 - RNA, 23 nt, Human
ccugggcucaagcaauccuccug

SEQ ID NO: 626547 - RNA, 21 nt, Human
cgacaggcguggccccucucu

SEQ ID NO: 626548 - RNA, 23 nt, Human
cgaccucggccaccccacggcuc

SEQ ID NO: 626549 - RNA, 21 nt, Human
cggcccgacacacccccucgg

SEQ ID NO: 626550 - RNA, 22 nt, Human
cggcugcgcggggcccugcugu

SEQ ID NO: 626551 - RNA, 19 nt, Human
cgggguuucaccacguugg

SEQ ID NO: 626552 - RNA, 24 nt, Human
cucaagcaauccuccugccuuagc

SEQ ID NO: 626553 - RNA, 23 nt, Human
cucacugcaaccuucuccuccca

SEQ ID NO: 626554 - RNA, 24 nt, Human
cucacugcaaccuucuccucccag

SEQ ID NO: 626555 - RNA, 24 nt, Human
cucagccucccgaguagcugggau

SEQ ID NO: 626556 - RNA, 24 nt, Human
cucccugccucagccucccgagua

SEQ ID NO: 626557 - RNA, 24 nt, Human
cucuugaccucgugauccucccgu

SEQ ID NO: 626558 - RNA, 23 nt, Human
cugcaaccuucuccucccagguu

SEQ ID NO: 626559 - RNA, 24 nt, Human
cugcaaccuucuccucccagguuc

SEQ ID NO: 626560 - RNA, 23 nt, Human
cugccucagccucccgaguagcu

SEQ ID NO: 626561 - RNA, 23 nt, Human
cugccuuagccuuuaaaauagcu

SEQ ID NO: 626562 - RNA, 19 nt, Human
cuuaagugcugggauuaca

SEQ ID NO: 626563 - RNA, 23 nt, Human
gaaagaaaagauccccagggagu

SEQ ID NO: 626564 - RNA, 21 nt, Human
gaaugguaaaaucuucagacc

SEQ ID NO: 626565 - RNA, 23 nt, Human
gacccgccgaccucggccacccc

SEQ ID NO: 626566 - RNA, 22 nt, Human
gaccucgugauccucccgucuc

SEQ ID NO: 626567 - RNA, 24 nt, Human
gagacgggguuucaccacguuggc

SEQ ID NO: 626568 - RNA, 19 nt, Human
gagcgcacccggcugcgcg

SEQ ID NO: 626569 - RNA, 20 nt, Human
gagucuugcucugucgccag

SEQ ID NO: 626570 - RNA, 18 nt, Human
gauuacagggaugagcca

SEQ ID NO: 626571 - RNA, 18 nt, Human
gauuacaggugcgugcca

SEQ ID NO: 626572 - RNA, 22 nt, Human
gcccggcuaauuuuuguauuuu

SEQ ID NO: 626573 - RNA, 18 nt, Human
gcccuuggguccaggauc

SEQ ID NO: 626574 - RNA, 19 nt, Human
gccggugagcggcggggga

SEQ ID NO: 626575 - RNA, 18 nt, Human
gccugcgccggcccgaca

SEQ ID NO: 626576 - RNA, 19 nt, Human
gcggccugcgggcccucgg

SEQ ID NO: 626577 - RNA, 20 nt, Human
gcucacugcaaccuucuccu

SEQ ID NO: 626578 - RNA, 23 nt, Human
gcugcgcggggcccugcuguguc

SEQ ID NO: 626579 - RNA, 20 nt, Human
gcuggagugcaguggcacca

SEQ ID NO: 626580 - RNA, 18 nt, Human
ggacccggggggcagcgg

SEQ ID NO: 626581 - RNA, 18 nt, Human
ggcagcggccugcgggcc

SEQ ID NO: 626582 - RNA, 26 nt, Human
ggcaucacccaagcccuuggguccag

SEQ ID NO: 626583 - RNA, 18 nt, Human
gggaggaggaugggcagg

SEQ ID NO: 626584 - RNA, 19 nt, Human
gggcgggcgccgggagggg

SEQ ID NO: 626585 - RNA, 22 nt, Human
gggcucaagcaauccuccugcc

SEQ ID NO: 626586 - RNA, 18 nt, Human
guagcugggauuacaggu

SEQ ID NO: 626587 - RNA, 25 nt, Human
guccugggcucaagcaauccuccug

SEQ ID NO: 626588 - RNA, 24 nt, Human
gucuugcucugucgccaggcugga

SEQ ID NO: 626589 - RNA, 21 nt, Human
guugcccaggcuggucucgaa

SEQ ID NO: 626590 - RNA, 22 nt, Human
uaaaauagcugguacuacaggc

SEQ ID NO: 626591 - RNA, 19 nt, Human
uaagugcugggauuacagg

SEQ ID NO: 626592 - RNA, 20 nt, Human
uaagugcugggauuacaggg

SEQ ID NO: 626593 - RNA, 24 nt, Human
uaauuuuuguauuuucaguagaga

SEQ ID NO: 626594 - RNA, 23 nt, Human
uacagggaugagccaccgcgccc

SEQ ID NO: 626595 - RNA, 23 nt, Human
uacaggugcgugccaccacgccc

SEQ ID NO: 626596 - RNA, 24 nt, Human
uagaauuucaggcaugagccaccg

SEQ ID NO: 626597 - RNA, 22 nt, Human
uagagacgggguuucaccacgu

SEQ ID NO: 626598 - RNA, 18 nt, Human
uagcugguacuacaggca

SEQ ID NO: 626599 - RNA, 24 nt, Human
uagguugcccaggcuggucucgaa

SEQ ID NO: 626600 - RNA, 22 nt, Human
ucaaugggacgggcgggaggag

SEQ ID NO: 626601 - RNA, 24 nt, Human
ucaccgcagccucgauguccuggg

SEQ ID NO: 626602 - RNA, 24 nt, Human
ucacugcaaccuucuccucccagg

SEQ ID NO: 626603 - RNA, 20 nt, Human
ucagccucccgaguagcugg

SEQ ID NO: 626604 - RNA, 25 nt, Human
ucagcucacugcaaccuucuccucc

SEQ ID NO: 626605 - RNA, 21 nt, Human
ucaggcaugagccaccgcacc

SEQ ID NO: 626606 - RNA, 18 nt, Human
ucaguagagacgggguuu

SEQ ID NO: 626607 - RNA, 18 nt, Human
uccaccuucaauguugac

SEQ ID NO: 626608 - RNA, 19 nt, Human
ucccagguucaagcgauuc

SEQ ID NO: 626609 - RNA, 21 nt, Human
ucccagguucaagcgauucuc

SEQ ID NO: 626610 - RNA, 25 nt, Human
ucccagguucaagcgauucucccug

SEQ ID NO: 626611 - RNA, 21 nt, Human
uccccagaaugguaaaaucuu

SEQ ID NO: 626612 - RNA, 23 nt, Human
ucccgaguagcugggauuacagg

SEQ ID NO: 626613 - RNA, 24 nt, Human
ucccgaguagcugggauuacaggu

SEQ ID NO: 626614 - RNA, 18 nt, Human
uccugggcucaagcaauc

SEQ ID NO: 626615 - RNA, 24 nt, Human
uccugggcucaagcaauccuccug

SEQ ID NO: 626616 - RNA, 18 nt, Human
uccuuaagugcugggauu

SEQ ID NO: 626617 - RNA, 18 nt, Human
ucgcagcgccggaccccg

SEQ ID NO: 626618 - RNA, 19 nt, Human
ucgcagcgccggaccccgc

SEQ ID NO: 626619 - RNA, 21 nt, Human
ucgccgaggacccgccgaccu

SEQ ID NO: 626620 - RNA, 23 nt, Human
ucucacucagucguccaggcugg

SEQ ID NO: 626621 - RNA, 24 nt, Human
ucucacucagucguccaggcugga

SEQ ID NO: 626622 - RNA, 23 nt, Human
ucucauuagguugcccaggcugg

SEQ ID NO: 626623 - RNA, 18 nt, Human
ucuccucccagguucaag

SEQ ID NO: 626624 - RNA, 21 nt, Human
ucucgaacuccuaggcucaaa

SEQ ID NO: 626625 - RNA, 22 nt, Human
ucugcagucgguccccgcguga

SEQ ID NO: 626626 - RNA, 18 nt, Human
ucugucgccaggcuggag

SEQ ID NO: 626627 - RNA, 21 nt, Human
ucugucgccaggcuggagugc

SEQ ID NO: 626628 - RNA, 21 nt, Human
ucuugcucugucgccaggcug

SEQ ID NO: 626629 - RNA, 22 nt, Human
ucuugcucugucgccaggcugg

SEQ ID NO: 626630 - RNA, 23 nt, Human
ucuugcucugucgccaggcugga

SEQ ID NO: 626631 - RNA, 22 nt, Human
ugaccucgugauccucccgucu

SEQ ID NO: 626632 - RNA, 22 nt, Human
ugcaguggcaccaucucagcuc

SEQ ID NO: 626633 - RNA, 24 nt, Human
ugcccaggcuggucucgaacuccu

SEQ ID NO: 626634 - RNA, 24 nt, Human
ugccucagccucccgaguagcugg

SEQ ID NO: 626635 - RNA, 21 nt, Human
ugccuuagccuuuaaaauagc

SEQ ID NO: 626636 - RNA, 24 nt, Human
ugccuuagccuuuaaaauagcugg

SEQ ID NO: 626637 - RNA, 23 nt, Human
ugcucugucgccaggcuggagug

SEQ ID NO: 626638 - RNA, 21 nt, Human
uggaauacagugguacaauca

SEQ ID NO: 626639 - RNA, 24 nt, Human
uggaauacagugguacaaucaugg

SEQ ID NO: 626640 - RNA, 18 nt, Human
uggagucuugcucugucg

SEQ ID NO: 626641 - RNA, 19 nt, Human
uggagugcaguggcaccau

SEQ ID NO: 626642 - RNA, 23 nt, Human
uggagugcaguggcaccaucuca

SEQ ID NO: 626643 - RNA, 19 nt, Human
uggcaccaucucagcucac

SEQ ID NO: 626644 - RNA, 24 nt, Human
uggcaccaucucagcucacugcaa

SEQ ID NO: 626645 - RNA, 19 nt, Human
uggcagcccagccagcucg

SEQ ID NO: 626646 - RNA, 19 nt, Human
ugggacgggcgggaggagg

SEQ ID NO: 626647 - RNA, 25 nt, Human
ugggacgggcgggaggaggaugggc

SEQ ID NO: 626648 - RNA, 19 nt, Human
ugggauggagucuugcucu

SEQ ID NO: 626649 - RNA, 20 nt, Human
ugggauggagucuugcucug

SEQ ID NO: 626650 - RNA, 22 nt, Human
ugggauggagucuugcucuguc

SEQ ID NO: 626651 - RNA, 22 nt, Human
ugggauuacagggaugagccac

SEQ ID NO: 626652 - RNA, 23 nt, Human
ugggauuacagggaugagccacc

SEQ ID NO: 626653 - RNA, 24 nt, Human
ugggauuacagggaugagccaccg

SEQ ID NO: 626654 - RNA, 18 nt, Human
ugggauuacaggugcgug

SEQ ID NO: 626655 - RNA, 21 nt, Human
ugggauuacaggugcgugcca

SEQ ID NO: 626656 - RNA, 22 nt, Human
ugggauuacaggugcgugccac

SEQ ID NO: 626657 - RNA, 24 nt, Human
ugggauuacaggugcgugccacca

SEQ ID NO: 626658 - RNA, 22 nt, Human
ugggcaucacccaagcccuugg

SEQ ID NO: 626659 - RNA, 24 nt, Human
ugggcucaagcaauccuccugccu

SEQ ID NO: 626660 - RNA, 23 nt, Human
uggggaggggcuugccgagaggu

SEQ ID NO: 626661 - RNA, 22 nt, Human
uggggcgggcgccgggaggggu

SEQ ID NO: 626662 - RNA, 21 nt, Human
ugguacuacaggcacccacca

SEQ ID NO: 626663 - RNA, 24 nt, Human
uguccugggcucaagcaauccucc

SEQ ID NO: 626664 - RNA, 20 nt, Human
ugucgccaggcuggagugca

SEQ ID NO: 626665 - RNA, 18 nt, Human
ugucggagcgcacccggc

SEQ ID NO: 626666 - RNA, 19 nt, Human
ugucugaaaaguuggcgug

SEQ ID NO: 626667 - RNA, 22 nt, Human
ugucugaaaaguuggcguggga

SEQ ID NO: 626668 - RNA, 24 nt, Human
ugugugggcaucacccaagcccuu

SEQ ID NO: 626669 - RNA, 23 nt, Human
uguuucggccucucaaacugcua

SEQ ID NO: 626670 - RNA, 21 nt, Human
uguuuuguuuuguuuuguuug

SEQ ID NO: 626671 - RNA, 18 nt, Human
uuaaagacaguccccaga

SEQ ID NO: 626672 - RNA, 23 nt, Human
uuaagugcugggauuacagggau

SEQ ID NO: 626673 - RNA, 22 nt, Human
uucaagcgauucucccugccuc

SEQ ID NO: 626674 - RNA, 24 nt, Human
uucaagcgauucucccugccucag

SEQ ID NO: 626675 - RNA, 18 nt, Human
uuucaccacguuggccag

SEQ ID NO: 626676 - RNA, 24 nt, Human
uuuucaguagagacgggguuucac

SEQ ID NO: 626677 - RNA, 21 nt, Human
uuuuguauuuucaguagagac

SEQ ID NO: 626678 - RNA, 24 nt, Human
uuuuugggauggagucuugcucug

SEQ ID NO: 626679 - RNA, 25 nt, Human
uuuuuguagagacgggggguggagg

SEQ ID NO: 626680 - RNA, 20 nt, Human
uuuuuguauuuucaguagag

SEQ ID NO: 626681 - RNA, 24 nt, Human
uuuuuuuuuuuugggauggagucu

SEQ ID NO: 626682 - RNA, 22 nt, Human
uuuuuuuuuuuuuugggaugga

SEQ ID NO: 626683 - RNA, 22 nt, Human
uuuuuuuuuuuuuuuuugggau

SEQ ID NO: 626684 - RNA, 24 nt, Human
uuuuuuuuuuuuuuuuuuuuuggg

SEQ ID NO: 626685 - RNA, 22 nt, Human
aauaaaucaugguaauguacaa

SEQ ID NO: 626686 - RNA, 22 nt, Human
cuauauggccuucaauccuucc

SEQ ID NO: 626687 - RNA, 23 nt, Human
uaacugcugugaucacaugaaau

SEQ ID NO: 626688 - RNA, 18 nt, Human
ugggaucaaacuggaaug

SEQ ID NO: 626689 - RNA, 21 nt, Human
uuucaggucaacuaugcuuua

SEQ ID NO: 626690 - RNA, 22 nt, Human
uuuuuuuuuuuuuuuucuuuuu

SEQ ID NO: 626691 - RNA, 26 nt, Human
aaaaaacaaaaaacaaaaaacaaaaa

SEQ ID NO: 626692 - RNA, 23 nt, Human
aaaaaccccccaaugaacaaaaa

SEQ ID NO: 626693 - RNA, 22 nt, Human
aaaaagccaggagacuaguggg

SEQ ID NO: 626694 - RNA, 24 nt, Human
aaaacaaaaaacaaaaaacaaaaa

SEQ ID NO: 626695 - RNA, 23 nt, Human
aaaacaaaaaacaaaaacccccc

SEQ ID NO: 626696 - RNA, 22 nt, Human
aaaacaaaaaccccccaaugaa

SEQ ID NO: 626697 - RNA, 22 nt, Human
aaaaccccccaaugaacaaaaa

SEQ ID NO: 626698 - RNA, 22 nt, Human
aaaacccuaccacacaccacaa

SEQ ID NO: 626699 - RNA, 23 nt, Human
aaacaaaaaacaaaaacccccca

SEQ ID NO: 626700 - RNA, 24 nt, Human
aaacaaaaaacaaaaaccccccaa

SEQ ID NO: 626701 - RNA, 26 nt, Human
aaacaaaaaacaaaaaccccccaaug

SEQ ID NO: 626702 - RNA, 23 nt, Human
aaacaaaaacccuaccacacacc

SEQ ID NO: 626703 - RNA, 24 nt, Human
aaaccccccaaugaacaaaaacaa

SEQ ID NO: 626704 - RNA, 19 nt, Human
aaagccccuucaccaacuc

SEQ ID NO: 626705 - RNA, 18 nt, Human
aacaggcaacaaaaccaa

SEQ ID NO: 626706 - RNA, 21 nt, Human
aaccaagugcagacaucagug

SEQ ID NO: 626707 - RNA, 24 nt, Human
aagcaaaauaauuuucuuaaccaa

SEQ ID NO: 626708 - RNA, 19 nt, Human
aagugcagacaucagugag

SEQ ID NO: 626709 - RNA, 20 nt, Human
aauuucuaaaacugacccaa

SEQ ID NO: 626710 - RNA, 22 nt, Human
acaaaaaacaaaaaacaaaaac

SEQ ID NO: 626711 - RNA, 27 nt, Human
acaaaaaacaaaaaacaaaaacccccc

SEQ ID NO: 626712 - RNA, 20 nt, Human
accccccaaugaacaaaaac

SEQ ID NO: 626713 - RNA, 22 nt, Human
acccuaccacacaccacaacaa

SEQ ID NO: 626714 - RNA, 20 nt, Human
agcagagccugugaggcucc

SEQ ID NO: 626715 - RNA, 19 nt, Human
agccccacuuaaaagaugg

SEQ ID NO: 626716 - RNA, 27 nt, Human
aggaaaaauauauagaaucaaaaaaaa

SEQ ID NO: 626717 - RNA, 22 nt, Human
aggcccaagcuggccaguggag

SEQ ID NO: 626718 - RNA, 19 nt, Human
aggcuagugggcgugggug

SEQ ID NO: 626719 - RNA, 24 nt, Human
caaaaacccuaccacacaccacaa

SEQ ID NO: 626720 - RNA, 23 nt, Human
caaaacaaaaggaggggcaacua

SEQ ID NO: 626721 - RNA, 26 nt, Human
caaaacaaaaggaggggcaacuacgu

SEQ ID NO: 626722 - RNA, 22 nt, Human
caaaacccucaaaacaaaagga

SEQ ID NO: 626723 - RNA, 24 nt, Human
caaaacccucaaaacaaaaggagg

SEQ ID NO: 626724 - RNA, 22 nt, Human
caaggaaaaauauauagaauca

SEQ ID NO: 626725 - RNA, 21 nt, Human
caaggaacuguggacauggca

SEQ ID NO: 626726 - RNA, 20 nt, Human
cacugcacuagccccucagc

SEQ ID NO: 626727 - RNA, 19 nt, Human
cagcagagccugugaggcu

SEQ ID NO: 626728 - RNA, 21 nt, Human
cagcaucagccucuguccccu

SEQ ID NO: 626729 - RNA, 23 nt, Human
ccaaaacauuuuguugcuuuuaa

SEQ ID NO: 626730 - RNA, 22 nt, Human
ccagcaucagccucuguccccu

SEQ ID NO: 626731 - RNA, 26 nt, Human
ccagcccagucugcaggccugagcuc

SEQ ID NO: 626732 - RNA, 18 nt, Human
ccagccugauacagcccc

SEQ ID NO: 626733 - RNA, 21 nt, Human
ccauccaggaggaauaccaag

SEQ ID NO: 626734 - RNA, 23 nt, Human
cccccaaugaacaaaaacaaaac

SEQ ID NO: 626735 - RNA, 21 nt, Human
ccccccaaugaacaaaaacaa

SEQ ID NO: 626736 - RNA, 23 nt, Human
ccugaacaacucugccgcaggag

SEQ ID NO: 626737 - RNA, 19 nt, Human
cuagccccucagcagccca

SEQ ID NO: 626738 - RNA, 20 nt, Human
cuagcuagaaacaauuucua

SEQ ID NO: 626739 - RNA, 23 nt, Human
cucaaaaaagaaaacaaaaaccc

SEQ ID NO: 626740 - RNA, 22 nt, Human
cucaaaacaaaaggaggggcaa

SEQ ID NO: 626741 - RNA, 19 nt, Human
cugcacuagccccucagca

SEQ ID NO: 626742 - RNA, 23 nt, Human
cugcucugcuccaccaccucuac

SEQ ID NO: 626743 - RNA, 24 nt, Human
cugugaggcuccaggagaccucaa

SEQ ID NO: 626744 - RNA, 26 nt, Human
gaacaaaaacaaaacccucaaaacaa

SEQ ID NO: 626745 - RNA, 20 nt, Human
gaggaugaggcccaagcugg

SEQ ID NO: 626746 - RNA, 21 nt, Human
ggaaaaaaaacucaaaaaaga

SEQ ID NO: 626747 - RNA, 25 nt, Human
ggaaaaauauauagaaucaaaaaaa

SEQ ID NO: 626748 - RNA, 19 nt, Human
ggaagggaaaggaaaaagc

SEQ ID NO: 626749 - RNA, 21 nt, Human
ggcaacaaaaccaaggaaaaa

SEQ ID NO: 626750 - RNA, 22 nt, Human
gggaaaaaaaacucaaaaaaga

SEQ ID NO: 626751 - RNA, 23 nt, Human
gggaagggaaaggaaaaagccag

SEQ ID NO: 626752 - RNA, 24 nt, Human
gggcguggguggaggacgccuggg

SEQ ID NO: 626753 - RNA, 24 nt, Human
uaaaagauggcugcucugcuccac

SEQ ID NO: 626754 - RNA, 23 nt, Human
uaacaggcaacaaaaccaaggaa

SEQ ID NO: 626755 - RNA, 25 nt, Human
uaacaggcaacaaaaccaaggaaaa

SEQ ID NO: 626756 - RNA, 18 nt, Human
uaagccccugcccaggca

SEQ ID NO: 626757 - RNA, 23 nt, Human
uaaggaugagccagaguucccag

SEQ ID NO: 626758 - RNA, 18 nt, Human
uaccaagaauaugagaac

SEQ ID NO: 626759 - RNA, 20 nt, Human
ucaaaacaaaaggaggggca

SEQ ID NO: 626760 - RNA, 21 nt, Human
ucaaaaggagcaaccagcaaa

SEQ ID NO: 626761 - RNA, 21 nt, Human
ucagcccuaacaggcaacaaa

SEQ ID NO: 626762 - RNA, 19 nt, Human
uccaggaggaauaccaaga

SEQ ID NO: 626763 - RNA, 22 nt, Human
ucccucuagcuagaaacaauuu

SEQ ID NO: 626764 - RNA, 23 nt, Human
ugauacagccccacuuaaaagau

SEQ ID NO: 626765 - RNA, 20 nt, Human
ugcacuagccccucagcagc

SEQ ID NO: 626766 - RNA, 18 nt, Human
ugcagggcguggauggca

SEQ ID NO: 626767 - RNA, 21 nt, Human
ugcgaagauuuacacugaaag

SEQ ID NO: 626768 - RNA, 28 nt, Human
ugcuccaccaccucuacuggccacucca

SEQ ID NO: 626769 - RNA, 21 nt, Human
ugcucugcuccaccaccucua

SEQ ID NO: 626770 - RNA, 24 nt, Human
uggaugcaugcugccggcagacaa

SEQ ID NO: 626771 - RNA, 24 nt, Human
uggcaggcuagugggcgugggugg

SEQ ID NO: 626772 - RNA, 21 nt, Human
ugggauggcaggggcuggcac

SEQ ID NO: 626773 - RNA, 19 nt, Human
uuaaauaaacccagccuga

SEQ ID NO: 626774 - RNA, 23 nt, Human
uuccauaccccaaaugcuagacu

SEQ ID NO: 626775 - RNA, 20 nt, Human
uugaugccaacagccuuucc

SEQ ID NO: 626776 - RNA, 21 nt, Human
aacaccccuauuccucuaucu

SEQ ID NO: 626777 - RNA, 24 nt, Human
agugagacgcuggcaggcaugcug

SEQ ID NO: 626778 - RNA, 23 nt, Human
caaggauuguauuccugaagcuc

SEQ ID NO: 626779 - RNA, 23 nt, Human
ccuauuccucuaucugacaacuc

SEQ ID NO: 626780 - RNA, 19 nt, Human
ccucugggaggcauggcug

SEQ ID NO: 626781 - RNA, 23 nt, Human
cuccaguaccuguggagaacacc

SEQ ID NO: 626782 - RNA, 21 nt, Human
cuccuggacuggcacaccauc

SEQ ID NO: 626783 - RNA, 19 nt, Human
cugccccuggaucugcccu

SEQ ID NO: 626784 - RNA, 20 nt, Human
cuucucuucuucuuguguuu

SEQ ID NO: 626785 - RNA, 20 nt, Human
gaacugccccuggaucugcc

SEQ ID NO: 626786 - RNA, 21 nt, Human
gacgcuggcaggcaugcugag

SEQ ID NO: 626787 - RNA, 25 nt, Human
gacugcagguggaauggguuuuugg

SEQ ID NO: 626788 - RNA, 19 nt, Human
gagagaaguuacagccugc

SEQ ID NO: 626789 - RNA, 22 nt, Human
gagagaaguuacagccugcaag

SEQ ID NO: 626790 - RNA, 21 nt, Human
gauuaggucaucugccuugcu

SEQ ID NO: 626791 - RNA, 23 nt, Human
gcaggacaucugaaaaguccucc

SEQ ID NO: 626792 - RNA, 19 nt, Human
gcaggauguggccucuggg

SEQ ID NO: 626793 - RNA, 23 nt, Human
gcuccucagccucuucgguaguu

SEQ ID NO: 626794 - RNA, 20 nt, Human
guggaugggcuccggaugug

SEQ ID NO: 626795 - RNA, 19 nt, Human
uccucagccucuucgguag

SEQ ID NO: 626796 - RNA, 22 nt, Human
uccucugcugcuggugcugaac

SEQ ID NO: 626797 - RNA, 21 nt, Human
uccuggguuuccucugcugcu

SEQ ID NO: 626798 - RNA, 21 nt, Human
ucgagagaaguuacagccugc

SEQ ID NO: 626799 - RNA, 18 nt, Human
ucuaucugacaacuccug

SEQ ID NO: 626800 - RNA, 18 nt, Human
ucuggcugaucagagugg

SEQ ID NO: 626801 - RNA, 23 nt, Human
ugaaacuguccugggaaggcucu

SEQ ID NO: 626802 - RNA, 20 nt, Human
ugccagggguguaggugggu

SEQ ID NO: 626803 - RNA, 24 nt, Human
ugcugcuggugcugaacuuuacgg

SEQ ID NO: 626804 - RNA, 19 nt, Human
uggaaugucagugaucuca

SEQ ID NO: 626805 - RNA, 20 nt, Human
uggaaugucagugaucucau

SEQ ID NO: 626806 - RNA, 20 nt, Human
uggaucugcccugccagggg

SEQ ID NO: 626807 - RNA, 21 nt, Human
uggaucugcccugccaggggu

SEQ ID NO: 626808 - RNA, 19 nt, Human
uggcaaugucauccggcaa

SEQ ID NO: 626809 - RNA, 21 nt, Human
uggcagaaguaaggccaacgu

SEQ ID NO: 626810 - RNA, 21 nt, Human
uggcagaaguaaggccaacgu

SEQ ID NO: 626811 - RNA, 26 nt, Human
uggcagaaguaaggccaacguuggcu

SEQ ID NO: 626812 - RNA, 25 nt, Human
uggggcagagaacugccccuggauc

SEQ ID NO: 626813 - RNA, 24 nt, Human
ugggggacugcagguggaaugggg

SEQ ID NO: 626814 - RNA, 24 nt, Human
uguguucaccucucggcucaagga

SEQ ID NO: 626815 - RNA, 23 nt, Human
uguuuuuugguuagugcaggagg

SEQ ID NO: 626816 - RNA, 22 nt, Human
uuccaagucauguggaauguca

SEQ ID NO: 626817 - RNA, 20 nt, Human
uuccucuaucugacaacucc

SEQ ID NO: 626818 - RNA, 23 nt, Human
uuuugggggugagguaaaauggc

SEQ ID NO: 626819 - RNA, 19 nt, Human
uuuuuuuuuuuuugggggu

SEQ ID NO: 626820 - RNA, 21 nt, Human
uuuuuuuuuuuuuggggguga

SEQ ID NO: 626821 - RNA, 20 nt, Human
uuuuuuuuuuuuuuuggggg

SEQ ID NO: 626822 - RNA, 18 nt, Human
uuuuuuuuuuuuuuuuug

SEQ ID NO: 626823 - RNA, 22 nt, Human
uuuuuuuuuuuuuuuuuggggg

SEQ ID NO: 626824 - RNA, 20 nt, Human
aaaaacaaccagguuugcua

SEQ ID NO: 626825 - RNA, 25 nt, Human
aaaaacaauaggaaaauacacaggc

SEQ ID NO: 626826 - RNA, 25 nt, Human
aacccccaccuucccacauucccac

SEQ ID NO: 626827 - RNA, 21 nt, Human
aagucauuuuaaaaacaaccg

SEQ ID NO: 626828 - RNA, 21 nt, Human
auaaucaaagcaauauaaagc

SEQ ID NO: 626829 - RNA, 22 nt, Human
aucccacccuuucccuauuaua

SEQ ID NO: 626830 - RNA, 20 nt, Human
aucuccuccauaacccccag

SEQ ID NO: 626831 - RNA, 21 nt, Human
auuuauaccuggaguccuuua

SEQ ID NO: 626832 - RNA, 24 nt, Human
caaaaaaaucccacccuuucccua

SEQ ID NO: 626833 - RNA, 23 nt, Human
ccaaagccgacauacgucugcac

SEQ ID NO: 626834 - RNA, 19 nt, Human
ccauaacccccaccuuccc

SEQ ID NO: 626835 - RNA, 19 nt, Human
cccaccuucccacauuccc

SEQ ID NO: 626836 - RNA, 19 nt, Human
cccccaccuucccacauuc

SEQ ID NO: 626837 - RNA, 19 nt, Human
uaaaaacaauaggaaaaua

SEQ ID NO: 626838 - RNA, 24 nt, Human
uaacauuaaaaacaauaggaaaau

SEQ ID NO: 626839 - RNA, 21 nt, Human
uccauaacccccaccuuccca

SEQ ID NO: 626840 - RNA, 22 nt, Human
ugcuuuauuacucauaguuucc

SEQ ID NO: 626841 - RNA, 24 nt, Human
uuuucuuggaaucauggauuucua

SEQ ID NO: 626842 - RNA, 22 nt, Human
uuuuuuguugucauugcuuuau

SEQ ID NO: 626843 - RNA, 25 nt, Human
uuuuuuguugucauugcuuuauuac

SEQ ID NO: 626844 - RNA, 20 nt, Human
uuuuuuuuuuuuuuguuguc

SEQ ID NO: 626845 - RNA, 23 nt, Human
aaacaaaaacaaaacaucacugg

SEQ ID NO: 626846 - RNA, 21 nt, Human
aagccucccucccuuuccagg

SEQ ID NO: 626847 - RNA, 21 nt, Human
aaguuacucaguugagaacac

SEQ ID NO: 626848 - RNA, 21 nt, Human
aauacaaaaauguauuuugaa

SEQ ID NO: 626849 - RNA, 19 nt, Human
acauggcucuuucuccccu

SEQ ID NO: 626850 - RNA, 18 nt, Human
accccagcuucuacaacc

SEQ ID NO: 626851 - RNA, 24 nt, Human
acuaacgcggcagcggcucccucu

SEQ ID NO: 626852 - RNA, 18 nt, Human
agcaaauucauacuaaaa

SEQ ID NO: 626853 - RNA, 21 nt, Human
agcucggaacuaacgcggcag

SEQ ID NO: 626854 - RNA, 21 nt, Human
aggaaaaaaagauagucccau

SEQ ID NO: 626855 - RNA, 25 nt, Human
auaaaaaacaguccacggucuuaca

SEQ ID NO: 626856 - RNA, 19 nt, Human
auaucacagugcacacaac

SEQ ID NO: 626857 - RNA, 18 nt, Human
auguacauuaaguacuac

SEQ ID NO: 626858 - RNA, 19 nt, Human
auucauacuaaaauacucc

SEQ ID NO: 626859 - RNA, 30 nt, Human
caaaacaucacuggcaccauacucgaaaaa

SEQ ID NO: 626860 - RNA, 23 nt, Human
caaucuacugguccaugaaugau

SEQ ID NO: 626861 - RNA, 24 nt, Human
cacggaccgacaaagcccacgaac

SEQ ID NO: 626862 - RNA, 24 nt, Human
cagcggcucccucucgacgucgaa

SEQ ID NO: 626863 - RNA, 27 nt, Human
cagcuucuacaacccgaccuucuccuu

SEQ ID NO: 626864 - RNA, 19 nt, Human
cauacauacacuggcacuu

SEQ ID NO: 626865 - RNA, 28 nt, Human
cauuucacaucucuuaaaaauaguuuua

SEQ ID NO: 626866 - RNA, 22 nt, Human
ccaagcccaagauaacaagugu

SEQ ID NO: 626867 - RNA, 21 nt, Human
ccacuacauuuaauaaacagg

SEQ ID NO: 626868 - RNA, 18 nt, Human
ccccaaagcaagcuuugc

SEQ ID NO: 626869 - RNA, 20 nt, Human
ccccuugaccaaacaaaaac

SEQ ID NO: 626870 - RNA, 28 nt, Human
ccccuugaccaaacaaaaacaaaacauc

SEQ ID NO: 626871 - RNA, 21 nt, Human
ccggccaccccagcuucuaca

SEQ ID NO: 626872 - RNA, 22 nt, Human
ccuguccucuuccuugcugcca

SEQ ID NO: 626873 - RNA, 22 nt, Human
ccuucagauguuuaccuaauuc

SEQ ID NO: 626874 - RNA, 30 nt, Human
cuaccccuugaccaaacaaaaacaaaacaa

SEQ ID NO: 626875 - RNA, 25 nt, Human
cugccaagcccaagauaacaagugu

SEQ ID NO: 626876 - RNA, 23 nt, Human
cuguacaauucacuaaaaugcaa

SEQ ID NO: 626877 - RNA, 22 nt, Human
cuuuaccacuccccaaaucuaa

SEQ ID NO: 626878 - RNA, 22 nt, Human
gaagccucccucccuuuccagg

SEQ ID NO: 626879 - RNA, 18 nt, Human
gacgucgaagccucccuc

SEQ ID NO: 626880 - RNA, 24 nt, Human
gagaacacuuaauaucaaguacaa

SEQ ID NO: 626881 - RNA, 19 nt, Human
gaguucagccuaggagcug

SEQ ID NO: 626882 - RNA, 20 nt, Human
gccaaauuagaaaauagggc

SEQ ID NO: 626883 - RNA, 24 nt, Human
gcuuauguuuaagcauuuaaaguu

SEQ ID NO: 626884 - RNA, 24 nt, Human
uaaaauacuccauuuuuguaagau

SEQ ID NO: 626885 - RNA, 22 nt, Human
uaacuaaauuuaaacauuuguc

SEQ ID NO: 626886 - RNA, 22 nt, Human
uaagauaaaggccaagaaaacu

SEQ ID NO: 626887 - RNA, 23 nt, Human
uaagcugacccacauacuugcua

SEQ ID NO: 626888 - RNA, 21 nt, Human
uacaacccgaccuucuccuuc

SEQ ID NO: 626889 - RNA, 19 nt, Human
uacugcauuucacaucucu

SEQ ID NO: 626890 - RNA, 24 nt, Human
uacuucaucuugauuuauuuggag

SEQ ID NO: 626891 - RNA, 18 nt, Human
uagcacaagggcaaacuu

SEQ ID NO: 626892 - RNA, 21 nt, Human
uauaacauacauacacuggca

SEQ ID NO: 626893 - RNA, 24 nt, Human
uaucacagugcacacaacacgaga

SEQ ID NO: 626894 - RNA, 23 nt, Human
uaucauguacauuaaguacuaca

SEQ ID NO: 626895 - RNA, 18 nt, Human
ucacagugcacacaacac

SEQ ID NO: 626896 - RNA, 26 nt, Human
uccaaaugcccuuuccacccacugua

SEQ ID NO: 626897 - RNA, 20 nt, Human
uccacggucuuacauucagc

SEQ ID NO: 626898 - RNA, 21 nt, Human
uccccaaagcaagcuuugcag

SEQ ID NO: 626899 - RNA, 22 nt, Human
uccccaaaucuaaacuugguuu

SEQ ID NO: 626900 - RNA, 21 nt, Human
uccuuguguuagcuagaagcu

SEQ ID NO: 626901 - RNA, 23 nt, Human
uccuuguguuagcuagaagcuua

SEQ ID NO: 626902 - RNA, 24 nt, Human
ucugacagaucccuuccuuugucu

SEQ ID NO: 626903 - RNA, 20 nt, Human
ugaaauauaguuuacaacca

SEQ ID NO: 626904 - RNA, 23 nt, Human
ugagagaaguccuagugacuuca

SEQ ID NO: 626905 - RNA, 23 nt, Human
ugcuuaggcaucaagaggugcca

SEQ ID NO: 626906 - RNA, 19 nt, Human
uggguguuucuaauauacu

SEQ ID NO: 626907 - RNA, 22 nt, Human
ugucucauucuaaugagcucca

SEQ ID NO: 626908 - RNA, 18 nt, Human
uguuagcuagaagcuuau

SEQ ID NO: 626909 - RNA, 18 nt, Human
uuacauggcucuuucucc

SEQ ID NO: 626910 - RNA, 19 nt, Human
uuaggcaucaagaggugcc

SEQ ID NO: 626911 - RNA, 23 nt, Human
uucaacaaucuacugguccauga

SEQ ID NO: 626912 - RNA, 23 nt, Human
uucacuaaaaugcaauuauuacg

SEQ ID NO: 626913 - RNA, 18 nt, Human
uucagauugcaggaucuc

SEQ ID NO: 626914 - RNA, 25 nt, Human
uuccuuuaccacuccccaaaucuaa

SEQ ID NO: 626915 - RNA, 20 nt, Human
uuuaaaguuggcaaaacaug

SEQ ID NO: 626916 - RNA, 21 nt, Human
uuuaagcauuuaaaguuggca

SEQ ID NO: 626917 - RNA, 24 nt, Human
uuuuaugcuucacauucauaucau

SEQ ID NO: 626918 - RNA, 19 nt, Human
uuuuuuuuuuuuaaugggg

SEQ ID NO: 626919 - RNA, 24 nt, Human
uuuuuuuuuuuuuuuuuaaugggg

SEQ ID NO: 626920 - RNA, 20 nt, Human
aauccucuuccuagaaaggc

SEQ ID NO: 626921 - RNA, 23 nt, Human
agaaaggcuuccugaagguccac

SEQ ID NO: 626922 - RNA, 19 nt, Human
aggcagccgcgcugcugug

SEQ ID NO: 626923 - RNA, 20 nt, Human
aggugggugaaauggcacuu

SEQ ID NO: 626924 - RNA, 18 nt, Human
auuugcauaaugauucac

SEQ ID NO: 626925 - RNA, 21 nt, Human
caaccuggacucucaggcuga

SEQ ID NO: 626926 - RNA, 23 nt, Human
caaccuggacucucaggcugaag

SEQ ID NO: 626927 - RNA, 18 nt, Human
caccucauacaaugagac

SEQ ID NO: 626928 - RNA, 21 nt, Human
cacugccuagcccagggccuu

SEQ ID NO: 626929 - RNA, 19 nt, Human
cagaacucagguuucccgc

SEQ ID NO: 626930 - RNA, 21 nt, Human
cagccgcgcugcugugggcag

SEQ ID NO: 626931 - RNA, 21 nt, Human
cagccuccugggguccuccag

SEQ ID NO: 626932 - RNA, 23 nt, Human
cauacaaugagacuaaaggcaua

SEQ ID NO: 626933 - RNA, 21 nt, Human
cauaucagcuuuccccacaaa

SEQ ID NO: 626934 - RNA, 22 nt, Human
ccagaacucagguuucccgcuc

SEQ ID NO: 626935 - RNA, 20 nt, Human
ccagggccagaacucagguu

SEQ ID NO: 626936 - RNA, 23 nt, Human
cccuaggucacacugccuagccc

SEQ ID NO: 626937 - RNA, 23 nt, Human
cccugcuuagucauaaauccucu

SEQ ID NO: 626938 - RNA, 19 nt, Human
ccgagccagugggggcucc

SEQ ID NO: 626939 - RNA, 21 nt, Human
ccuaggucacacugccuagcc

SEQ ID NO: 626940 - RNA, 19 nt, Human
ccugggguccuccaguucc

SEQ ID NO: 626941 - RNA, 22 nt, Human
cgagaaggcgcauuucgcggcg

SEQ ID NO: 626942 - RNA, 23 nt, Human
cgcgcagccuccugggguccucc

SEQ ID NO: 626943 - RNA, 19 nt, Human
cucauacaaugagacuaaa

SEQ ID NO: 626944 - RNA, 26 nt, Human
cugaggcugaagaccccggagcucac

SEQ ID NO: 626945 - RNA, 21 nt, Human
cugggguccuccaguucccgg

SEQ ID NO: 626946 - RNA, 21 nt, Human
cuuccugaagguccacaagag

SEQ ID NO: 626947 - RNA, 25 nt, Human
ggaacaugggccuagcacuuuuccc

SEQ ID NO: 626948 - RNA, 23 nt, Human
ggacucucaggcugaagccugag

SEQ ID NO: 626949 - RNA, 19 nt, Human
gggagacgcgcgcagccuc

SEQ ID NO: 626950 - RNA, 21 nt, Human
uacaaaauguuacaccucaua

SEQ ID NO: 626951 - RNA, 18 nt, Human
uacagguuagcaaccugg

SEQ ID NO: 626952 - RNA, 22 nt, Human
uacaucaaugaauugugaccag

SEQ ID NO: 626953 - RNA, 18 nt, Human
uagcccagggccuuacgg

SEQ ID NO: 626954 - RNA, 23 nt, Human
ucacuaugagggcaauccucuuc

SEQ ID NO: 626955 - RNA, 24 nt, Human
ucauuuacgacaauuucuccuggc

SEQ ID NO: 626956 - RNA, 22 nt, Human
ucccgagaaggcgcauuucgcg

SEQ ID NO: 626957 - RNA, 18 nt, Human
ucccuaggucacacugcc

SEQ ID NO: 626958 - RNA, 24 nt, Human
ucccuaggucacacugccuagccc

SEQ ID NO: 626959 - RNA, 20 nt, Human
ucuccuggcaaaaggacugg

SEQ ID NO: 626960 - RNA, 18 nt, Human
ugagacuaaaggcauaag

SEQ ID NO: 626961 - RNA, 21 nt, Human
ugcauaucagcuuuccccaca

SEQ ID NO: 626962 - RNA, 21 nt, Human
ugggugaaauggcacuuuggu

SEQ ID NO: 626963 - RNA, 19 nt, Human
uguuguugguucgaggugg

SEQ ID NO: 626964 - RNA, 19 nt, Human
uuccccacaaaucguacug

SEQ ID NO: 626965 - RNA, 21 nt, Human
uuuuauaccaacaaauccaga

SEQ ID NO: 626966 - RNA, 22 nt, Human
aaacggcacccucucacccucc

SEQ ID NO: 626967 - RNA, 23 nt, Human
aaacggcacccucucacccucca

SEQ ID NO: 626968 - RNA, 24 nt, Human
aaacggcacccucucacccuccac

SEQ ID NO: 626969 - RNA, 23 nt, Human
aacggcacccucucacccuccac

SEQ ID NO: 626970 - RNA, 24 nt, Human
aagaacucuuuguuguccccgcuc

SEQ ID NO: 626971 - RNA, 18 nt, Human
aaggagcagcaccuuugu

SEQ ID NO: 626972 - RNA, 21 nt, Human
acccucucacccuccaccauc

SEQ ID NO: 626973 - RNA, 19 nt, Human
agcaggacucugugccagg

SEQ ID NO: 626974 - RNA, 19 nt, Human
aggaaguacggcaaaaaga

SEQ ID NO: 626975 - RNA, 21 nt, Human
aggaguuuuucccuccccacu

SEQ ID NO: 626976 - RNA, 21 nt, Human
aggcagcagcugguugccugg

SEQ ID NO: 626977 - RNA, 22 nt, Human
aggcagcagcugguugccuggc

SEQ ID NO: 626978 - RNA, 23 nt, Human
aggggccaaagcugguguucaga

SEQ ID NO: 626979 - RNA, 18 nt, Human
agguagggcccaaacaca

SEQ ID NO: 626980 - RNA, 22 nt, Human
aguagggguuggagaaggagca

SEQ ID NO: 626981 - RNA, 21 nt, Human
auuccauccuuccucugccca

SEQ ID NO: 626982 - RNA, 21 nt, Human
cacccuccaccaucaccaguc

SEQ ID NO: 626983 - RNA, 18 nt, Human
cacccucucacccuccac

SEQ ID NO: 626984 - RNA, 20 nt, Human
cacccucucacccuccacca

SEQ ID NO: 626985 - RNA, 27 nt, Human
cacuucaaccauacauacugcuuccac

SEQ ID NO: 626986 - RNA, 20 nt, Human
cagccuuacuguggaggggc

SEQ ID NO: 626987 - RNA, 19 nt, Human
cagcugcagcaaugcacuu

SEQ ID NO: 626988 - RNA, 21 nt, Human
caggaaacggcacccucucac

SEQ ID NO: 626989 - RNA, 25 nt, Human
caggugggguccucugcccacuuug

SEQ ID NO: 626990 - RNA, 21 nt, Human
ccacuuugccaccacauucac

SEQ ID NO: 626991 - RNA, 18 nt, Human
ccagaggaaccaaggcug

SEQ ID NO: 626992 - RNA, 19 nt, Human
ccagcagaaauuccuccuu

SEQ ID NO: 626993 - RNA, 19 nt, Human
ccagcccacacacgccaca

SEQ ID NO: 626994 - RNA, 24 nt, Human
ccaggagcaggacucugugccagg

SEQ ID NO: 626995 - RNA, 22 nt, Human
ccagguagggcccaaacacauc

SEQ ID NO: 626996 - RNA, 23 nt, Human
ccccacuaacugagggaaaaagg

SEQ ID NO: 626997 - RNA, 19 nt, Human
ccccagaggaaccaaggcu

SEQ ID NO: 626998 - RNA, 22 nt, Human
ccccagaggaaccaaggcugcu

SEQ ID NO: 626999 - RNA, 24 nt, Human
cccugauguagcagccuuacugug

SEQ ID NO: 627000 - RNA, 22 nt, Human
ccuaggugcuagucuccccacu

SEQ ID NO: 627001 - RNA, 21 nt, Human
ccucaaaaacucagccuucaa

SEQ ID NO: 627002 - RNA, 22 nt, Human
ccuuuguaacaccuggcuaccc

SEQ ID NO: 627003 - RNA, 24 nt, Human
cuaauccacucuccuguggguccc

SEQ ID NO: 627004 - RNA, 24 nt, Human
cucacccuccaccaucaccagucc

SEQ ID NO: 627005 - RNA, 23 nt, Human
cucagggacagaacuccacacua

SEQ ID NO: 627006 - RNA, 26 nt, Human
cugaacccacuggcugguaugaacaa

SEQ ID NO: 627007 - RNA, 21 nt, Human
cugcugaacccacuggcuggu

SEQ ID NO: 627008 - RNA, 21 nt, Human
cuggagcuggagcaggaaacg

SEQ ID NO: 627009 - RNA, 22 nt, Human
cugguccuuuuggcaaaaaagg

SEQ ID NO: 627010 - RNA, 22 nt, Human
cuugugcucuaauccacucucc

SEQ ID NO: 627011 - RNA, 19 nt, Human
gaaauuccuccuuucuacc

SEQ ID NO: 627012 - RNA, 23 nt, Human
gacaaggucuggagcuggagcag

SEQ ID NO: 627013 - RNA, 18 nt, Human
gagcaggacucugugcca

SEQ ID NO: 627014 - RNA, 20 nt, Human
gaggaaaagaacauuuaugc

SEQ ID NO: 627015 - RNA, 18 nt, Human
gagggaaaccaaguaggg

SEQ ID NO: 627016 - RNA, 23 nt, Human
gcccaaacacaucuggagcacac

SEQ ID NO: 627017 - RNA, 23 nt, Human
gcccacacacgccacaggcagca

SEQ ID NO: 627018 - RNA, 20 nt, Human
gccucugggcuguccaaacc

SEQ ID NO: 627019 - RNA, 21 nt, Human
gcugguaugaacaugaggcuu

SEQ ID NO: 627020 - RNA, 23 nt, Human
ggaaacggcacccucucacccuc

SEQ ID NO: 627021 - RNA, 20 nt, Human
ggagcugggccucugggcug

SEQ ID NO: 627022 - RNA, 21 nt, Human
ggaggggccaaagcugguguu

SEQ ID NO: 627023 - RNA, 19 nt, Human
gggagcugggccucugggc

SEQ ID NO: 627024 - RNA, 20 nt, Human
gggguccucugcccacuuug

SEQ ID NO: 627025 - RNA, 24 nt, Human
gggugagggaaaccaaguaggggu

SEQ ID NO: 627026 - RNA, 24 nt, Human
ggucacacuuugcuuuuccuuugu

SEQ ID NO: 627027 - RNA, 21 nt, Human
gguuggagcuaggccugaaca

SEQ ID NO: 627028 - RNA, 22 nt, Human
guuguccccauuuuccauccuu

SEQ ID NO: 627029 - RNA, 18 nt, Human
ucacacuuugcuuuuccu

SEQ ID NO: 627030 - RNA, 25 nt, Human
ucaccaguccucuuccagugcuucu

SEQ ID NO: 627031 - RNA, 22 nt, Human
ucacccuccaccaucaccaguc

SEQ ID NO: 627032 - RNA, 22 nt, Human
ucauuccauccuuccucugccc

SEQ ID NO: 627033 - RNA, 19 nt, Human
ucguaguuuuggcccuucc

SEQ ID NO: 627034 - RNA, 21 nt, Human
ucuaagacaaaacuuuuccca

SEQ ID NO: 627035 - RNA, 25 nt, Human
ucuaagacaaaacuuuucccagaga

SEQ ID NO: 627036 - RNA, 18 nt, Human
ucucacccuccaccauca

SEQ ID NO: 627037 - RNA, 20 nt, Human
ucuccccacuaacugaggga

SEQ ID NO: 627038 - RNA, 19 nt, Human
ucucugggacucugagaca

SEQ ID NO: 627039 - RNA, 21 nt, Human
ucuggagcuggagcaggaaac

SEQ ID NO: 627040 - RNA, 23 nt, Human
ucugggcuguccaaacccaaggg

SEQ ID NO: 627041 - RNA, 22 nt, Human
ugaggcuuggggugagggaaac

SEQ ID NO: 627042 - RNA, 20 nt, Human
ugaugaggcccaucagcucu

SEQ ID NO: 627043 - RNA, 25 nt, Human
ugcccagauaaaguccagcagaaau

SEQ ID NO: 627044 - RNA, 22 nt, Human
ugccccugauguagcagccuua

SEQ ID NO: 627045 - RNA, 21 nt, Human
ugccuggcuggacauggauuu

SEQ ID NO: 627046 - RNA, 20 nt, Human
uggaggggccaaagcuggug

SEQ ID NO: 627047 - RNA, 23 nt, Human
uggcaaaaaaggaaaaugauaga

SEQ ID NO: 627048 - RNA, 24 nt, Human
uggcccuuccuuucucuaaaguuu

SEQ ID NO: 627049 - RNA, 18 nt, Human
ugggauaaugccugaggg

SEQ ID NO: 627050 - RNA, 18 nt, Human
ugggauaaugccugaggg

SEQ ID NO: 627051 - RNA, 20 nt, Human
ugggccucugggcuguccaa

SEQ ID NO: 627052 - RNA, 18 nt, Human
ugggcuguccaaacccaa

SEQ ID NO: 627053 - RNA, 23 nt, Human
ugggucccuggccuguauggcuu

SEQ ID NO: 627054 - RNA, 22 nt, Human
uguacccaccucagggacagaa

SEQ ID NO: 627055 - RNA, 23 nt, Human
uguacccaccucagggacagaac

SEQ ID NO: 627056 - RNA, 22 nt, Human
ugucaugcguucugcugaaccc

SEQ ID NO: 627057 - RNA, 19 nt, Human
uguggaggggccaaagcug

SEQ ID NO: 627058 - RNA, 20 nt, Human
uguucagagcucacccaagg

SEQ ID NO: 627059 - RNA, 24 nt, Human
uguuuucugcagacaaggucugga

SEQ ID NO: 627060 - RNA, 21 nt, Human
uuggagcuaggccugaacauc

SEQ ID NO: 627061 - RNA, 21 nt, Human
uugguuggagcuaggccugaa

SEQ ID NO: 627062 - RNA, 23 nt, Human
uugugcucuaauccacucuccug

SEQ ID NO: 627063 - RNA, 25 nt, Human
uuuggcaaaaaaggaaaaugauaga

SEQ ID NO: 627064 - RNA, 20 nt, Human
uuuuuuuuuuuuuuugugga

SEQ ID NO: 627065 - RNA, 19 nt, Human
uuuuuuuuuuuuuuuuugu

SEQ ID NO: 627066 - RNA, 22 nt, Human
uuuuuuuuuuuuuuuuuugugg

SEQ ID NO: 627067 - RNA, 23 nt, Human
aagcaaauauagccauuguuuau

SEQ ID NO: 627068 - RNA, 21 nt, Human
aagcagagaauggagaucaag

SEQ ID NO: 627069 - RNA, 21 nt, Human
acacaaagucugugcuccccg

SEQ ID NO: 627070 - RNA, 22 nt, Human
acagggcacuccccagggggag

SEQ ID NO: 627071 - RNA, 18 nt, Human
accaaguucuuccagccc

SEQ ID NO: 627072 - RNA, 19 nt, Human
accacacuuggggcucaug

SEQ ID NO: 627073 - RNA, 20 nt, Human
acugugcccccagaucuuca

SEQ ID NO: 627074 - RNA, 19 nt, Human
acugugugccaggugcugg

SEQ ID NO: 627075 - RNA, 19 nt, Human
agaauggagaucaagccca

SEQ ID NO: 627076 - RNA, 18 nt, Human
agaggagacucagguuug

SEQ ID NO: 627077 - RNA, 23 nt, Human
agaggcccuggggucuccgcucc

SEQ ID NO: 627078 - RNA, 20 nt, Human
agcacuuugagaggcugagg

SEQ ID NO: 627079 - RNA, 21 nt, Human
aggaguucgagaccagcaggc

SEQ ID NO: 627080 - RNA, 21 nt, Human
aggcaagcagaucaccugagg

SEQ ID NO: 627081 - RNA, 22 nt, Human
aggcaagcagaucaccugaggg

SEQ ID NO: 627082 - RNA, 22 nt, Human
aggcaagcagaucaccugaggu

SEQ ID NO: 627083 - RNA, 18 nt, Human
aggcagacaguauuacug

SEQ ID NO: 627084 - RNA, 19 nt, Human
aggcaguguaggcccucgg

SEQ ID NO: 627085 - RNA, 23 nt, Human
aggccagcaaggguuccuaagca

SEQ ID NO: 627086 - RNA, 18 nt, Human
aggcuuugaugaacuggg

SEQ ID NO: 627087 - RNA, 24 nt, Human
agggagccuggguccagcaggguu

SEQ ID NO: 627088 - RNA, 20 nt, Human
agggaggagcgucccagcuc

SEQ ID NO: 627089 - RNA, 19 nt, Human
agggccagaggcucagcaa

SEQ ID NO: 627090 - RNA, 21 nt, Human
aucagauuggaggccuccuga

SEQ ID NO: 627091 - RNA, 27 nt, Human
aucucacucuuccccacccggccccag

SEQ ID NO: 627092 - RNA, 21 nt, Human
caaaagcugguguuucccagg

SEQ ID NO: 627093 - RNA, 21 nt, Human
caaagcagagaauggagauca

SEQ ID NO: 627094 - RNA, 26 nt, Human
caaagcagagaauggagaucaagccc

SEQ ID NO: 627095 - RNA, 24 nt, Human
caagcagaucaccugagguaagga

SEQ ID NO: 627096 - RNA, 23 nt, Human
caagcccaggcccacgcuggccu

SEQ ID NO: 627097 - RNA, 24 nt, Human
caaggguuccuaagcacggcgugg

SEQ ID NO: 627098 - RNA, 22 nt, Human
caauugugcugagacuguucuc

SEQ ID NO: 627099 - RNA, 22 nt, Human
cacaccuguaaucccagcacuu

SEQ ID NO: 627100 - RNA, 24 nt, Human
cacaccuguaaucccagcacuuug

SEQ ID NO: 627101 - RNA, 21 nt, Human
cacauucacccuaacacaucc

SEQ ID NO: 627102 - RNA, 24 nt, Human
caccccaucagagaagggccucca

SEQ ID NO: 627103 - RNA, 21 nt, Human
caccggagggagggcgcuggu

SEQ ID NO: 627104 - RNA, 22 nt, Human
caccugccuccagcaucagaau

SEQ ID NO: 627105 - RNA, 18 nt, Human
caccuguaaucccagcac

SEQ ID NO: 627106 - RNA, 23 nt, Human
caccuguaaucccagcacuuuga

SEQ ID NO: 627107 - RNA, 25 nt, Human
cacuggauggagccacuggggcagc

SEQ ID NO: 627108 - RNA, 24 nt, Human
cagaucaccugagguaaggaguuc

SEQ ID NO: 627109 - RNA, 21 nt, Human
cagcaaagcagagaauggaga

SEQ ID NO: 627110 - RNA, 23 nt, Human
cagcacuuugagaggcugaggca

SEQ ID NO: 627111 - RNA, 25 nt, Human
cagcacuuugagaggcugaggcaag

SEQ ID NO: 627112 - RNA, 19 nt, Human
caggcacuuacugugugcc

SEQ ID NO: 627113 - RNA, 18 nt, Human
caggccagggcaagcugg

SEQ ID NO: 627114 - RNA, 20 nt, Human
cauucacccuaacacauccc

SEQ ID NO: 627115 - RNA, 22 nt, Human
ccacacuuggggcucauguggc

SEQ ID NO: 627116 - RNA, 21 nt, Human
ccacccgcaggcugaugcagg

SEQ ID NO: 627117 - RNA, 23 nt, Human
ccacuggauggagccacuggggc

SEQ ID NO: 627118 - RNA, 22 nt, Human
ccagaggccacccgcaggcuga

SEQ ID NO: 627119 - RNA, 26 nt, Human
ccagcuccuucaacagggcuccaggg

SEQ ID NO: 627120 - RNA, 23 nt, Human
ccaggcacuuacugugugccagg

SEQ ID NO: 627121 - RNA, 21 nt, Human
ccaucucacucuuccccaccc

SEQ ID NO: 627122 - RNA, 18 nt, Human
cccaaaagcugguguuuc

SEQ ID NO: 627123 - RNA, 23 nt, Human
cccagcucggggcuaccacccac

SEQ ID NO: 627124 - RNA, 19 nt, Human
cccaguuucuuccagacca

SEQ ID NO: 627125 - RNA, 25 nt, Human
cccaucuguaaaauggucauaaaaa

SEQ ID NO: 627126 - RNA, 18 nt, Human
cccaucuuggccgggcgc

SEQ ID NO: 627127 - RNA, 20 nt, Human
ccccaaaagcugguguuucc

SEQ ID NO: 627128 - RNA, 24 nt, Human
ccccaacaguuugaauccuccuug

SEQ ID NO: 627129 - RNA, 22 nt, Human
ccgcaggcugaugcagggccgc

SEQ ID NO: 627130 - RNA, 25 nt, Human
ccgcaggcugaugcagggccgccgu

SEQ ID NO: 627131 - RNA, 18 nt, Human
ccuaagcacggcguggga

SEQ ID NO: 627132 - RNA, 19 nt, Human
ccuccuggugacucagccc

SEQ ID NO: 627133 - RNA, 19 nt, Human
ccuccuuggggcgcuggaa

SEQ ID NO: 627134 - RNA, 22 nt, Human
ccucggccacagcucccuccug

SEQ ID NO: 627135 - RNA, 23 nt, Human
ccucggucccugcagaccugggg

SEQ ID NO: 627136 - RNA, 19 nt, Human
ccuggguccagcaggguuc

SEQ ID NO: 627137 - RNA, 22 nt, Human
ccuuggggcgcuggaaugaggc

SEQ ID NO: 627138 - RNA, 18 nt, Human
cggaggauccagaggcca

SEQ ID NO: 627139 - RNA, 23 nt, Human
cgggcgcgguggcacaccuguaa

SEQ ID NO: 627140 - RNA, 23 nt, Human
cgguggcacaccuguaaucccag

SEQ ID NO: 627141 - RNA, 25 nt, Human
cguuggccaggugugggaggcaugc

SEQ ID NO: 627142 - RNA, 18 nt, Human
cuagcuggcaccugaggc

SEQ ID NO: 627143 - RNA, 21 nt, Human
cucaucuugaucacggcuaug

SEQ ID NO: 627144 - RNA, 22 nt, Human
cuccagccccggccuugaggcu

SEQ ID NO: 627145 - RNA, 20 nt, Human
cuccagggacccaggccacc

SEQ ID NO: 627146 - RNA, 23 nt, Human
cuccagggacccaggccaccaag

SEQ ID NO: 627147 - RNA, 19 nt, Human
cugcugcuccuagcugggc

SEQ ID NO: 627148 - RNA, 23 nt, Human
cugugcuccccgucaccugccuc

SEQ ID NO: 627149 - RNA, 18 nt, Human
cugugugccaggugcugg

SEQ ID NO: 627150 - RNA, 24 nt, Human
cuuccagccccaacaguuugaauc

SEQ ID NO: 627151 - RNA, 23 nt, Human
cuucggggucuaccugaaggugu

SEQ ID NO: 627152 - RNA, 22 nt, Human
cuuggccgggcgcgguggcaca

SEQ ID NO: 627153 - RNA, 22 nt, Human
gaggaaggaaccauagcuccug

SEQ ID NO: 627154 - RNA, 19 nt, Human
gaggccagcaaggguuccu

SEQ ID NO: 627155 - RNA, 24 nt, Human
gaucaccugagguaaggaguucga

SEQ ID NO: 627156 - RNA, 18 nt, Human
gaucacggcuauguucug

SEQ ID NO: 627157 - RNA, 18 nt, Human
gcacacuuggagcucagu

SEQ ID NO: 627158 - RNA, 22 nt, Human
gcaccuacuggucccagguaac

SEQ ID NO: 627159 - RNA, 18 nt, Human
gccacaagccaugggccc

SEQ ID NO: 627160 - RNA, 22 nt, Human
gccaccaaguucuuccagcccc

SEQ ID NO: 627161 - RNA, 18 nt, Human
gccugguguggcauccgg

SEQ ID NO: 627162 - RNA, 24 nt, Human
gcgguggcacaccuguaaucccag

SEQ ID NO: 627163 - RNA, 23 nt, Human
gcuggccucgucccagccguccu

SEQ ID NO: 627164 - RNA, 18 nt, Human
ggagacucagguuuggau

SEQ ID NO: 627165 - RNA, 21 nt, Human
ggagggaggagcgucccagcu

SEQ ID NO: 627166 - RNA, 22 nt, Human
ggagggaggagcgucccagcuc

SEQ ID NO: 627167 - RNA, 19 nt, Human
ggccagaggcucagcaaag

SEQ ID NO: 627168 - RNA, 18 nt, Human
ggccucggcguccucggc

SEQ ID NO: 627169 - RNA, 20 nt, Human
ggcguccucggccacagcuc

SEQ ID NO: 627170 - RNA, 23 nt, Human
ggcuguggaggaggggcccccgg

SEQ ID NO: 627171 - RNA, 20 nt, Human
gggcacacuuggagcucagu

SEQ ID NO: 627172 - RNA, 20 nt, Human
ggggcuaccacccacuccag

SEQ ID NO: 627173 - RNA, 22 nt, Human
ggucucguguugcugcugcucc

SEQ ID NO: 627174 - RNA, 21 nt, Human
gguggcacaccuguaauccca

SEQ ID NO: 627175 - RNA, 24 nt, Human
gguggcacaccuguaaucccagca

SEQ ID NO: 627176 - RNA, 20 nt, Human
ggugugggguggcucccaaa

SEQ ID NO: 627177 - RNA, 18 nt, Human
guggcuauacugugcccc

SEQ ID NO: 627178 - RNA, 21 nt, Human
uaccugaagguguguuccugg

SEQ ID NO: 627179 - RNA, 18 nt, Human
uacugugugccaggugcu

SEQ ID NO: 627180 - RNA, 18 nt, Human
uagcuggcaccugaggca

SEQ ID NO: 627181 - RNA, 25 nt, Human
uaggcuuugaugaacugggggaagg

SEQ ID NO: 627182 - RNA, 18 nt, Human
uaggugguaggaggggca

SEQ ID NO: 627183 - RNA, 19 nt, Human
uauacugugcccccagauc

SEQ ID NO: 627184 - RNA, 21 nt, Human
uauccugaaaucucggcaggg

SEQ ID NO: 627185 - RNA, 20 nt, Human
ucaccccaucagagaagggc

SEQ ID NO: 627186 - RNA, 20 nt, Human
ucagcccggcgcgggccgcc

SEQ ID NO: 627187 - RNA, 25 nt, Human
ucaguggcuggggcacacuuggagc

SEQ ID NO: 627188 - RNA, 20 nt, Human
uccacaccuccuccugccug

SEQ ID NO: 627189 - RNA, 22 nt, Human
uccagauccgccgccagggccc

SEQ ID NO: 627190 - RNA, 19 nt, Human
uccagcaggguucgggcca

SEQ ID NO: 627191 - RNA, 20 nt, Human
uccagcaggguucgggccac

SEQ ID NO: 627192 - RNA, 21 nt, Human
ucccaucucacucuuccccac

SEQ ID NO: 627193 - RNA, 18 nt, Human
uccccagggggaggggcc

SEQ ID NO: 627194 - RNA, 23 nt, Human
uccuucaacagggcuccagggac

SEQ ID NO: 627195 - RNA, 22 nt, Human
ucucggcagggccagaggcuca

SEQ ID NO: 627196 - RNA, 20 nt, Human
ucucguguugcugcugcucc

SEQ ID NO: 627197 - RNA, 20 nt, Human
ugaacugccacaagccaugg

SEQ ID NO: 627198 - RNA, 19 nt, Human
ugaagaaacggcuucggac

SEQ ID NO: 627199 - RNA, 18 nt, Human
ugaagguguguuccuggg

SEQ ID NO: 627200 - RNA, 18 nt, Human
ugagaggcccuggggucu

SEQ ID NO: 627201 - RNA, 24 nt, Human
ugagaggcugaggcaagcagauca

SEQ ID NO: 627202 - RNA, 20 nt, Human
ugaggcaagcagaucaccug

SEQ ID NO: 627203 - RNA, 23 nt, Human
ugaggcagacaguauuacugguc

SEQ ID NO: 627204 - RNA, 22 nt, Human
ugagguaaggaguucgagacca

SEQ ID NO: 627205 - RNA, 25 nt, Human
ugccacaagccaugggcccccagca

SEQ ID NO: 627206 - RNA, 30 nt, Human
ugccuccagcaucagaaugucaccagcucu

SEQ ID NO: 627207 - RNA, 20 nt, Human
ugccuguccuccugcgcuca

SEQ ID NO: 627208 - RNA, 20 nt, Human
ugcugcugcuccuagcuggg

SEQ ID NO: 627209 - RNA, 20 nt, Human
ugcugggacacgagccuccg

SEQ ID NO: 627210 - RNA, 21 nt, Human
uggaggaaggggacacgggcc

SEQ ID NO: 627211 - RNA, 22 nt, Human
uggcacaccuguaaucccagca

SEQ ID NO: 627212 - RNA, 19 nt, Human
uggccgggcgcgguggcac

SEQ ID NO: 627213 - RNA, 24 nt, Human
uggcuggggcacacuuggagcuca

SEQ ID NO: 627214 - RNA, 19 nt, Human
uggcuguggaggaggggcc

SEQ ID NO: 627215 - RNA, 19 nt, Human
ugggaggaggcaguguagg

SEQ ID NO: 627216 - RNA, 24 nt, Human
ugggaggaggcaguguaggcccuc

SEQ ID NO: 627217 - RNA, 20 nt, Human
ugggcacauucacccuaacc

SEQ ID NO: 627218 - RNA, 18 nt, Human
ugggggaagguagaugca

SEQ ID NO: 627219 - RNA, 21 nt, Human
uggucucaugggaugaagaaa

SEQ ID NO: 627220 - RNA, 18 nt, Human
uguggaggaggggccccc

SEQ ID NO: 627221 - RNA, 21 nt, Human
uguucugaggccagcaagggu

SEQ ID NO: 627222 - RNA, 25 nt, Human
uugagaggcugaggcaagcagauca

SEQ ID NO: 627223 - RNA, 19 nt, Human
uuggaugagcugcaggcca

SEQ ID NO: 627224 - RNA, 18 nt, Human
uuuuuuuuuuuuuuuuug

SEQ ID NO: 627225 - RNA, 23 nt, Human
uuuuuuuuuuuuuuuuugacaag

SEQ ID NO: 627226 - RNA, 21 nt, Human
acaucacccgauggccaugcc

SEQ ID NO: 627227 - RNA, 23 nt, Human
acgcccaguccaccccaccuggc

SEQ ID NO: 627228 - RNA, 18 nt, Human
acugccgccaccaucggc

SEQ ID NO: 627229 - RNA, 24 nt, Human
aggcagugagguaggagcagcagc

SEQ ID NO: 627230 - RNA, 23 nt, Human
caaggagccaccaccauccagug

SEQ ID NO: 627231 - RNA, 20 nt, Human
cacacaugacaauacaaagu

SEQ ID NO: 627232 - RNA, 21 nt, Human
caccacaugcccugcaggagc

SEQ ID NO: 627233 - RNA, 19 nt, Human
caccuggcccuggcaggau

SEQ ID NO: 627234 - RNA, 21 nt, Human
cagagauucagccaugggugu

SEQ ID NO: 627235 - RNA, 20 nt, Human
caggagcaguagccacugcc

SEQ ID NO: 627236 - RNA, 24 nt, Human
caugacaauacaaagucaccguuu

SEQ ID NO: 627237 - RNA, 22 nt, Human
ccaagagcucagaccacugugc

SEQ ID NO: 627238 - RNA, 23 nt, Human
ccacagaggaggccaauacggag

SEQ ID NO: 627239 - RNA, 18 nt, Human
ccacugccgccaccaucg

SEQ ID NO: 627240 - RNA, 21 nt, Human
ccacugccgccaccaucggcc

SEQ ID NO: 627241 - RNA, 21 nt, Human
ccaguccaccccaccuggccc

SEQ ID NO: 627242 - RNA, 19 nt, Human
cccaagagcucagaccacu

SEQ ID NO: 627243 - RNA, 24 nt, Human
cccaagagcucagaccacugugca

SEQ ID NO: 627244 - RNA, 21 nt, Human
ccuagcgcccuugcuagcacc

SEQ ID NO: 627245 - RNA, 26 nt, Human
ccucugaggaccaccacgcccagucc

SEQ ID NO: 627246 - RNA, 20 nt, Human
ccuggccccuacccgugacc

SEQ ID NO: 627247 - RNA, 25 nt, Human
cgcgggcuggccugcucucccccug

SEQ ID NO: 627248 - RNA, 18 nt, Human
cggccuggaggggccugg

SEQ ID NO: 627249 - RNA, 19 nt, Human
cuggaggggccuggccccu

SEQ ID NO: 627250 - RNA, 20 nt, Human
gacaggcagugagguaggag

SEQ ID NO: 627251 - RNA, 24 nt, Human
gccccagagaggcuggggacagca

SEQ ID NO: 627252 - RNA, 18 nt, Human
gggcuggccugcucuggg

SEQ ID NO: 627253 - RNA, 23 nt, Human
gugcaggccagugacggccugga

SEQ ID NO: 627254 - RNA, 21 nt, Human
uacccgugacuucacgugccc

SEQ ID NO: 627255 - RNA, 19 nt, Human
uagcgcccuugcuagcacc

SEQ ID NO: 627256 - RNA, 22 nt, Human
uccaccccaccuggcccuggca

SEQ ID NO: 627257 - RNA, 18 nt, Human
ugagaacaggaagccgca

SEQ ID NO: 627258 - RNA, 18 nt, Human
ugagccacagaggaggcc

SEQ ID NO: 627259 - RNA, 23 nt, Human
ugaggaccaccacgcccagucca

SEQ ID NO: 627260 - RNA, 18 nt, Human
ugagguaggagcagcagc

SEQ ID NO: 627261 - RNA, 18 nt, Human
uggcaggaucaccacaug

SEQ ID NO: 627262 - RNA, 21 nt, Human
aaauuuccagccucuuucauu

SEQ ID NO: 627263 - RNA, 22 nt, Human
aacccuguaacauacaguaacu

SEQ ID NO: 627264 - RNA, 24 nt, Human
aaggccuguaagcaaaauuccuuc

SEQ ID NO: 627265 - RNA, 21 nt, Human
acaaaaacuugugcuaaaggc

SEQ ID NO: 627266 - RNA, 21 nt, Human
agcuagaaacugguguuccca

SEQ ID NO: 627267 - RNA, 22 nt, Human
agcucguuuaugccaaaaccuc

SEQ ID NO: 627268 - RNA, 24 nt, Human
aggaagugguuuucgacagccagg

SEQ ID NO: 627269 - RNA, 21 nt, Human
caaauacggguuauuuagcug

SEQ ID NO: 627270 - RNA, 26 nt, Human
caacagcacguggcaaauuacgagag

SEQ ID NO: 627271 - RNA, 21 nt, Human
caacucacaaaaacuugugcu

SEQ ID NO: 627272 - RNA, 23 nt, Human
caacucacaaaaacuugugcuaa

SEQ ID NO: 627273 - RNA, 19 nt, Human
cacuuuuucaucugauuug

SEQ ID NO: 627274 - RNA, 22 nt, Human
caggcaucuaauaaauuucuau

SEQ ID NO: 627275 - RNA, 20 nt, Human
ccacagaaauugcaacucac

SEQ ID NO: 627276 - RNA, 25 nt, Human
ccugcaauuaugacaccauguaaac

SEQ ID NO: 627277 - RNA, 20 nt, Human
ccugcaauuaugacaccauu

SEQ ID NO: 627278 - RNA, 19 nt, Human
ccugugaauaucaaauuca

SEQ ID NO: 627279 - RNA, 25 nt, Human
cuaaaaccucugcccugaugaggca

SEQ ID NO: 627280 - RNA, 21 nt, Human
cuaaggaauuuacaagcaaau

SEQ ID NO: 627281 - RNA, 18 nt, Human
cuacuagaaagcuccaca

SEQ ID NO: 627282 - RNA, 19 nt, Human
cuagaaagcuccacacuug

SEQ ID NO: 627283 - RNA, 23 nt, Human
cucacaccauacugacuaaaacc

SEQ ID NO: 627284 - RNA, 24 nt, Human
cucguuuaugccaaaaccuccagg

SEQ ID NO: 627285 - RNA, 21 nt, Human
cucuuucauuucauuggucaa

SEQ ID NO: 627286 - RNA, 24 nt, Human
cugcauggucccugaaccaacuaa

SEQ ID NO: 627287 - RNA, 22 nt, Human
cugcccugaugaggcacagcug

SEQ ID NO: 627288 - RNA, 21 nt, Human
gagauugacuugccacagaaa

SEQ ID NO: 627289 - RNA, 19 nt, Human
gcaaacaugacacacaaau

SEQ ID NO: 627290 - RNA, 19 nt, Human
gguuuucgacagccaggac

SEQ ID NO: 627291 - RNA, 29 nt, Human
uaacaagucucacuucccaucagugauuu

SEQ ID NO: 627292 - RNA, 20 nt, Human
uaacauacaguaacuugcug

SEQ ID NO: 627293 - RNA, 22 nt, Human
uaccagauuccccguuguaucc

SEQ ID NO: 627294 - RNA, 18 nt, Human
uaugaaggacaccuacua

SEQ ID NO: 627295 - RNA, 24 nt, Human
ucagugauuucucagcaaaggaaa

SEQ ID NO: 627296 - RNA, 23 nt, Human
ucccauauuaaugagacaaagcg

SEQ ID NO: 627297 - RNA, 24 nt, Human
ucgacagccaggacaacuugugac

SEQ ID NO: 627298 - RNA, 25 nt, Human
ucguaagauccuguuucacuugucc

SEQ ID NO: 627299 - RNA, 18 nt, Human
ucguuggugagccacuca

SEQ ID NO: 627300 - RNA, 24 nt, Human
ucuuaaggugguaacauuuuaugg

SEQ ID NO: 627301 - RNA, 20 nt, Human
ugaauggcuuguucugaggu

SEQ ID NO: 627302 - RNA, 24 nt, Human
ugcagacacagggcacucugcaug

SEQ ID NO: 627303 - RNA, 24 nt, Human
ugcauacauuuacacgugcaugca

SEQ ID NO: 627304 - RNA, 20 nt, Human
ugccaaaaccuccaggcauu

SEQ ID NO: 627305 - RNA, 19 nt, Human
uucaccagaauauuugcaa

SEQ ID NO: 627306 - RNA, 22 nt, Human
uugugacuuuagauuucguugg

SEQ ID NO: 627307 - RNA, 22 nt, Human
uuuaagaacaucuaaaggugaa

SEQ ID NO: 627308 - RNA, 28 nt, Human
uuuaugccaaaaccuccaggcaucuaau

SEQ ID NO: 627309 - RNA, 18 nt, Human
uuuuuuuuuuuuuuucug

SEQ ID NO: 627310 - RNA, 24 nt, Human
aaccaaguacaaagacacacccuc

SEQ ID NO: 627311 - RNA, 18 nt, Human
aagcccccuggagccccg

SEQ ID NO: 627312 - RNA, 21 nt, Human
aaggccaaggugugugggaug

SEQ ID NO: 627313 - RNA, 21 nt, Human
aauaaaaaguggcuuccugga

SEQ ID NO: 627314 - RNA, 18 nt, Human
acacacccaccucuagcc

SEQ ID NO: 627315 - RNA, 24 nt, Human
acagacaaacgucuacacccugcc

SEQ ID NO: 627316 - RNA, 18 nt, Human
accaaguacaaagacaca

SEQ ID NO: 627317 - RNA, 25 nt, Human
accagcccaucccacccccagcccc

SEQ ID NO: 627318 - RNA, 19 nt, Human
accccuccuugcuugucac

SEQ ID NO: 627319 - RNA, 22 nt, Human
accuccuggcuaggcucacuuu

SEQ ID NO: 627320 - RNA, 18 nt, Human
accucucuuucucuacca

SEQ ID NO: 627321 - RNA, 21 nt, Human
agcagugggaaucccgggcac

SEQ ID NO: 627322 - RNA, 22 nt, Human
agcccaucccacccccagcccc

SEQ ID NO: 627323 - RNA, 18 nt, Human
agccgcggugcgccagcc

SEQ ID NO: 627324 - RNA, 21 nt, Human
agccggcgaaucgcacagaca

SEQ ID NO: 627325 - RNA, 20 nt, Human
agcugcagcgcggcagcggc

SEQ ID NO: 627326 - RNA, 19 nt, Human
aggagcucagcccaccaac

SEQ ID NO: 627327 - RNA, 21 nt, Human
aggcgcccgggugcccagagc

SEQ ID NO: 627328 - RNA, 18 nt, Human
aucccacccccagcccca

SEQ ID NO: 627329 - RNA, 24 nt, Human
aucccacccccagccccagccuaa

SEQ ID NO: 627330 - RNA, 25 nt, Human
caaaccacucucgugcaaauaccca

SEQ ID NO: 627331 - RNA, 24 nt, Human
caagcucggggcgccucagaacgg

SEQ ID NO: 627332 - RNA, 19 nt, Human
caaguacaaagacacaccc

SEQ ID NO: 627333 - RNA, 21 nt, Human
caaguacaaagacacacccuc

SEQ ID NO: 627334 - RNA, 22 nt, Human
caauaaaaaguggcuuccugga

SEQ ID NO: 627335 - RNA, 19 nt, Human
caccgggcaaggcgcccgg

SEQ ID NO: 627336 - RNA, 18 nt, Human
caccuccuggcuaggcuc

SEQ ID NO: 627337 - RNA, 19 nt, Human
cacuuggcuugcagaaggc

SEQ ID NO: 627338 - RNA, 21 nt, Human
cagacaaacgucuacacccug

SEQ ID NO: 627339 - RNA, 22 nt, Human
caguccaacgcgcgcacacacc

SEQ ID NO: 627340 - RNA, 18 nt, Human
cagugcuuccuaugagga

SEQ ID NO: 627341 - RNA, 22 nt, Human
ccacccccagccccagccuaac

SEQ ID NO: 627342 - RNA, 22 nt, Human
ccagcagugggaaucccgggca

SEQ ID NO: 627343 - RNA, 23 nt, Human
ccagcccaucccacccccagccc

SEQ ID NO: 627344 - RNA, 24 nt, Human
ccagcccaucccacccccagcccc

SEQ ID NO: 627345 - RNA, 19 nt, Human
ccaucccacccccagcccc

SEQ ID NO: 627346 - RNA, 21 nt, Human
ccaucccacccccagccccag

SEQ ID NO: 627347 - RNA, 18 nt, Human
cccacccccagccccagc

SEQ ID NO: 627348 - RNA, 23 nt, Human
cccacccccagccccagccuaac

SEQ ID NO: 627349 - RNA, 21 nt, Human
ccccaaacaccuccuggcuag

SEQ ID NO: 627350 - RNA, 23 nt, Human
ccccagccccagccuaacacgcu

SEQ ID NO: 627351 - RNA, 19 nt, Human
ccccauggucacccucucc

SEQ ID NO: 627352 - RNA, 19 nt, Human
cccccagccccagccuaac

SEQ ID NO: 627353 - RNA, 18 nt, Human
ccccuggagccccggcuc

SEQ ID NO: 627354 - RNA, 20 nt, Human
cccgagcugcagcgcggcag

SEQ ID NO: 627355 - RNA, 30 nt, Human
cccgcggccgcgccgccgcagcccgggacc

SEQ ID NO: 627356 - RNA, 21 nt, Human
cccgcgucguuugcgcagccg

SEQ ID NO: 627357 - RNA, 18 nt, Human
cccucagugcuuccuaug

SEQ ID NO: 627358 - RNA, 23 nt, Human
cccuccaccucccugauccccac

SEQ ID NO: 627359 - RNA, 19 nt, Human
cccucucuguggacauccc

SEQ ID NO: 627360 - RNA, 21 nt, Human
cccuggagccccggcucaggc

SEQ ID NO: 627361 - RNA, 18 nt, Human
ccggcuaaggaugcggcc

SEQ ID NO: 627362 - RNA, 21 nt, Human
ccgggcaaggcgcccgggugc

SEQ ID NO: 627363 - RNA, 19 nt, Human
ccucggcccuucccucucu

SEQ ID NO: 627364 - RNA, 22 nt, Human
ccugcagaaggcucaagucccc

SEQ ID NO: 627365 - RNA, 22 nt, Human
ccugcuuuggugcagccugugc

SEQ ID NO: 627366 - RNA, 20 nt, Human
ccuguagccaaucuagccgc

SEQ ID NO: 627367 - RNA, 25 nt, Human
ccuuaacaccgcaguaaucccucug

SEQ ID NO: 627368 - RNA, 21 nt, Human
cgcacagacaaacgucuacac

SEQ ID NO: 627369 - RNA, 19 nt, Human
cgccaguccgcugcgugcg

SEQ ID NO: 627370 - RNA, 20 nt, Human
cgccgugcaccgggcaaggc

SEQ ID NO: 627371 - RNA, 26 nt, Human
cgccucagaacggugacugcggcagg

SEQ ID NO: 627372 - RNA, 22 nt, Human
cgcgauagagccccaaacaccu

SEQ ID NO: 627373 - RNA, 22 nt, Human
cgcgcgcacacacccaccucua

SEQ ID NO: 627374 - RNA, 18 nt, Human
cgcguccuucccggaguc

SEQ ID NO: 627375 - RNA, 20 nt, Human
cggcagcggcggccacgacc

SEQ ID NO: 627376 - RNA, 18 nt, Human
cggcccggagcgcgccgg

SEQ ID NO: 627377 - RNA, 20 nt, Human
cgggcacugagcuugccauc

SEQ ID NO: 627378 - RNA, 18 nt, Human
cgugcaaauacccagcag

SEQ ID NO: 627379 - RNA, 23 nt, Human
cuaaaagcucuugcccagcuugg

SEQ ID NO: 627380 - RNA, 18 nt, Human
cuccaccucccugauccc

SEQ ID NO: 627381 - RNA, 23 nt, Human
cucggcccuucccucucugugga

SEQ ID NO: 627382 - RNA, 23 nt, Human
cucuagccaguccugcaccccgc

SEQ ID NO: 627383 - RNA, 24 nt, Human
cucugauacucaauuccaccuuua

SEQ ID NO: 627384 - RNA, 26 nt, Human
cugcgugcgccccgccaaggccgcuc

SEQ ID NO: 627385 - RNA, 19 nt, Human
cuugcagaaggccaaggug

SEQ ID NO: 627386 - RNA, 20 nt, Human
cuuguggcuccugggagucc

SEQ ID NO: 627387 - RNA, 23 nt, Human
cuuucuaaauccacaaagcugga

SEQ ID NO: 627388 - RNA, 18 nt, Human
gaacuuucucaccagccc

SEQ ID NO: 627389 - RNA, 22 nt, Human
gagcacggaaccgcuccgcggg

SEQ ID NO: 627390 - RNA, 25 nt, Human
gagcacggaaccgcuccgcggggga

SEQ ID NO: 627391 - RNA, 19 nt, Human
gagggaagcaaccccuccu

SEQ ID NO: 627392 - RNA, 21 nt, Human
gauggaugagguagggaggga

SEQ ID NO: 627393 - RNA, 23 nt, Human
gcacagacaaacgucuacacccu

SEQ ID NO: 627394 - RNA, 20 nt, Human
gcaguuuuuuaauuguugac

SEQ ID NO: 627395 - RNA, 22 nt, Human
gccagagcacggaaccgcuccg

SEQ ID NO: 627396 - RNA, 18 nt, Human
gccgcgccgccgcagccc

SEQ ID NO: 627397 - RNA, 24 nt, Human
gcgggggagucuccuuucucccua

SEQ ID NO: 627398 - RNA, 25 nt, Human
gcggugcgccagccgccgugcaccg

SEQ ID NO: 627399 - RNA, 22 nt, Human
gcgugcgccccgccaaggccgc

SEQ ID NO: 627400 - RNA, 21 nt, Human
ggagccccggcucaggcugcg

SEQ ID NO: 627401 - RNA, 19 nt, Human
ggcagcagaggcagcuaaa

SEQ ID NO: 627402 - RNA, 20 nt, Human
ggcccggagcgcgccggacu

SEQ ID NO: 627403 - RNA, 21 nt, Human
ggcgccggaggcuucgaagcc

SEQ ID NO: 627404 - RNA, 18 nt, Human
uaaaagcucuugcccagc

SEQ ID NO: 627405 - RNA, 18 nt, Human
uaaggaugcggcccggag

SEQ ID NO: 627406 - RNA, 22 nt, Human
uagugccuugaccuugcagaac

SEQ ID NO: 627407 - RNA, 19 nt, Human
ucacacugcaacacugagg

SEQ ID NO: 627408 - RNA, 23 nt, Human
ucacacugucccuccaccucccu

SEQ ID NO: 627409 - RNA, 22 nt, Human
ucacaguaaagggcagcagagg

SEQ ID NO: 627410 - RNA, 19 nt, Human
ucaccagcccaucccaccc

SEQ ID NO: 627411 - RNA, 18 nt, Human
ucagcccaccaacagucu

SEQ ID NO: 627412 - RNA, 18 nt, Human
uccaccucccugaucccc

SEQ ID NO: 627413 - RNA, 21 nt, Human
ucccacccccagccccagccu

SEQ ID NO: 627414 - RNA, 20 nt, Human
ucccaggaauggcaggcucu

SEQ ID NO: 627415 - RNA, 21 nt, Human
uccccagucuuugggggcagc

SEQ ID NO: 627416 - RNA, 23 nt, Human
uccccgcggccgcgccgccgcag

SEQ ID NO: 627417 - RNA, 21 nt, Human
uccccugcagaaggcucaagu

SEQ ID NO: 627418 - RNA, 19 nt, Human
ucccgcggcagcgccaguc

SEQ ID NO: 627419 - RNA, 18 nt, Human
ucccugauccccacauuc

SEQ ID NO: 627420 - RNA, 21 nt, Human
ucuaccaggugaagggcaaug

SEQ ID NO: 627421 - RNA, 21 nt, Human
ucuccugccagcagugggaau

SEQ ID NO: 627422 - RNA, 21 nt, Human
ucugcucggaucuccagucca

SEQ ID NO: 627423 - RNA, 18 nt, Human
ugaaaaugggccuucucc

SEQ ID NO: 627424 - RNA, 23 nt, Human
ugaaaaugggccuucuccugcca

SEQ ID NO: 627425 - RNA, 21 nt, Human
ugcagaaggcucaaguccccg

SEQ ID NO: 627426 - RNA, 24 nt, Human
ugccagcagugggaaucccgggca

SEQ ID NO: 627427 - RNA, 22 nt, Human
ugccccugcuuuggugcagccu

SEQ ID NO: 627428 - RNA, 22 nt, Human
ugcgcgauagagccccaaacac

SEQ ID NO: 627429 - RNA, 22 nt, Human
uggcaggcucuccugaaugcuu

SEQ ID NO: 627430 - RNA, 21 nt, Human
ugggauggaugagguagggag

SEQ ID NO: 627431 - RNA, 22 nt, Human
ugguuuggggucggucaccggg

SEQ ID NO: 627432 - RNA, 24 nt, Human
ugguuuggggucggucaccgggau

SEQ ID NO: 627433 - RNA, 21 nt, Human
ugucacaguaaagggcagcag

SEQ ID NO: 627434 - RNA, 23 nt, Human
ugucacaguaaagggcagcagag

SEQ ID NO: 627435 - RNA, 23 nt, Human
ugucccuccaccucccugauccc

SEQ ID NO: 627436 - RNA, 24 nt, Human
ugugcugucuucuuggcccugccu

SEQ ID NO: 627437 - RNA, 21 nt, Human
uguggcuccugggaguccugc

SEQ ID NO: 627438 - RNA, 24 nt, Human
uuccaggcuaggagcucagcccac

SEQ ID NO: 627439 - RNA, 21 nt, Human
uuccccauggucacccucucc

SEQ ID NO: 627440 - RNA, 18 nt, Human
uucgaagcccccuggagc

SEQ ID NO: 627441 - RNA, 20 nt, Human
uucgaagcccccuggagccc

SEQ ID NO: 627442 - RNA, 23 nt, Human
uucgaagcccccuggagccccgg

SEQ ID NO: 627443 - RNA, 21 nt, Human
uucucccuagcucuccguugg

SEQ ID NO: 627444 - RNA, 19 nt, Human
uuggaacugaaggcuuccu

SEQ ID NO: 627445 - RNA, 23 nt, Human
uuggcuugcagaaggccaaggug

SEQ ID NO: 627446 - RNA, 19 nt, Human
uuugcuugcuauuucugac

SEQ ID NO: 627447 - RNA, 20 nt, Human
uuuuuuuuuuuuuaaaggaa

SEQ ID NO: 627448 - RNA, 20 nt, Human
uuuuuuuuuuuuuuaaagga

SEQ ID NO: 627449 - RNA, 22 nt, Human
uuuuuuuuuuuuuuuuuaaagg

SEQ ID NO: 627450 - RNA, 20 nt, Human
aaaaaaaccaguucuacaaa

SEQ ID NO: 627451 - RNA, 24 nt, Human
aaaaacugcuugcuauaagaaaau

SEQ ID NO: 627452 - RNA, 22 nt, Human
aaaaaugcuuuguuauuauaau

SEQ ID NO: 627453 - RNA, 20 nt, Human
aaaacaaauguuacauccuc

SEQ ID NO: 627454 - RNA, 19 nt, Human
aaacaaauguuacauccuc

SEQ ID NO: 627455 - RNA, 25 nt, Human
aaaucauaagcaaaacauuuagaac

SEQ ID NO: 627456 - RNA, 24 nt, Human
aaucauaagcaaaacauuuagaaa

SEQ ID NO: 627457 - RNA, 23 nt, Human
agaaaaaaaaccaguucuacaaa

SEQ ID NO: 627458 - RNA, 24 nt, Human
auauggcccaggcuaauuauacca

SEQ ID NO: 627459 - RNA, 18 nt, Human
caaaaauaaaugagaaaa

SEQ ID NO: 627460 - RNA, 24 nt, Human
cacaacaccuuacaaaaaucuuaa

SEQ ID NO: 627461 - RNA, 20 nt, Human
ccauuacaaauguacacaac

SEQ ID NO: 627462 - RNA, 21 nt, Human
ccuaucaaauucccuuuuaga

SEQ ID NO: 627463 - RNA, 33 nt, Human
cuacugaauugacuucuuaauagaaucauauug

SEQ ID NO: 627464 - RNA, 26 nt, Human
cuauauaaauugauauacaugcuacu

SEQ ID NO: 627465 - RNA, 30 nt, Human
gagaaaaaaaaccaguucuacaaaaaugcu

SEQ ID NO: 627466 - RNA, 18 nt, Human
uaauacaugacaaggguu

SEQ ID NO: 627467 - RNA, 24 nt, Human
uacaugacaaggguuauaaagcaa

SEQ ID NO: 627468 - RNA, 18 nt, Human
uaccuaucuauauaaauu

SEQ ID NO: 627469 - RNA, 20 nt, Human
uagaacaaauguaugaacac

SEQ ID NO: 627470 - RNA, 20 nt, Human
uagcaggauaaaucauaagc

SEQ ID NO: 627471 - RNA, 25 nt, Human
uaucacaaaaguccuaucauggguu

SEQ ID NO: 627472 - RNA, 24 nt, Human
uccuagguccagaagcugcagccc

SEQ ID NO: 627473 - RNA, 21 nt, Human
ucuacaaaaaugcuuuguuau

SEQ ID NO: 627474 - RNA, 23 nt, Human
ugaaccacauuaaauaaaaauuc

SEQ ID NO: 627475 - RNA, 26 nt, Human
ugagaaaaaaaaccaguucuacaaaa

SEQ ID NO: 627476 - RNA, 24 nt, Human
ugccaaagaacaguauucaacaaa

SEQ ID NO: 627477 - RNA, 20 nt, Human
ugccucaaucauccaaaagc

SEQ ID NO: 627478 - RNA, 19 nt, Human
uuaaaucaaguuuaccuau

SEQ ID NO: 627479 - RNA, 24 nt, Human
uuaaaucaaguuuaccuaucaaau

SEQ ID NO: 627480 - RNA, 24 nt, Human
uuagcaauuuuuuucauaauauaa

SEQ ID NO: 627481 - RNA, 22 nt, Human
uugaaaaaacugcuucugugcg

SEQ ID NO: 627482 - RNA, 21 nt, Human
uugaaaaaacugcuucugugg

SEQ ID NO: 627483 - RNA, 21 nt, Human
accauaccuaaauaaaaucca

SEQ ID NO: 627484 - RNA, 18 nt, Human
caaagugaugaugaaaag

SEQ ID NO: 627485 - RNA, 18 nt, Human
cagagccucagugccacu

SEQ ID NO: 627486 - RNA, 20 nt, Human
ccauaccuaaauaaaaucca

SEQ ID NO: 627487 - RNA, 19 nt, Human
ccucagugccacuuuuccc

SEQ ID NO: 627488 - RNA, 20 nt, Human
cuauaucaagaaaaugagaa

SEQ ID NO: 627489 - RNA, 24 nt, Human
gugaugaugaaaagguuagugaaa

SEQ ID NO: 627490 - RNA, 23 nt, Human
uaccuaaauaaaauccauacaac

SEQ ID NO: 627491 - RNA, 24 nt, Human
ucaaagugaugaugaaaagguuuu

SEQ ID NO: 627492 - RNA, 23 nt, Human
uuaggucaagaagcuaacuaguu

SEQ ID NO: 627493 - RNA, 19 nt, Human
uucaaagugaugaugaaaa

SEQ ID NO: 627494 - RNA, 25 nt, Human
uuuguucaaagugaugaugaaaagg

SEQ ID NO: 627495 - RNA, 27 nt, Human
uuuuuuuuuuuuuuuuuuuuuuugggg

SEQ ID NO: 627496 - RNA, 25 nt, Human
aauaaaggagcaagaucuuaaggga

SEQ ID NO: 627497 - RNA, 23 nt, Human
acaggguuaauaaaggagcaaga

SEQ ID NO: 627498 - RNA, 21 nt, Human
agcaaugccagccuaacuuua

SEQ ID NO: 627499 - RNA, 23 nt, Human
aggaagaggguaguuuggggggu

SEQ ID NO: 627500 - RNA, 20 nt, Human
cuccaaguguaaacaggaag

SEQ ID NO: 627501 - RNA, 18 nt, Human
cuggccauuagaggauaa

SEQ ID NO: 627502 - RNA, 22 nt, Human
uaaaaaagaacuuuucccucca

SEQ ID NO: 627503 - RNA, 19 nt, Human
uauuucaauaugcugcugu

SEQ ID NO: 627504 - RNA, 18 nt, Human
ugauugaauauugucauu

SEQ ID NO: 627505 - RNA, 19 nt, Human
uugggggguaggggugagu

SEQ ID NO: 627506 - RNA, 30 nt, Human
uuucccaggaagaggguaguuugggggguu

SEQ ID NO: 627507 - RNA, 21 nt, Human
aaaacguaaaaacaaaagccc

SEQ ID NO: 627508 - RNA, 21 nt, Human
aaaagcccuccccagauuccg

SEQ ID NO: 627509 - RNA, 22 nt, Human
aaaagcuaccccucacuggcuc

SEQ ID NO: 627510 - RNA, 23 nt, Human
aaaaggaagaggguugggaagaa

SEQ ID NO: 627511 - RNA, 22 nt, Human
aaacacauagagagggcuugcc

SEQ ID NO: 627512 - RNA, 18 nt, Human
aaagcccuccccagauuc

SEQ ID NO: 627513 - RNA, 20 nt, Human
aaagcuaccccucacuggcu

SEQ ID NO: 627514 - RNA, 21 nt, Human
aaaggggcgaggaggacucug

SEQ ID NO: 627515 - RNA, 19 nt, Human
aaaguucuccacauccucu

SEQ ID NO: 627516 - RNA, 20 nt, Human
aagaaugccugagaaacagc

SEQ ID NO: 627517 - RNA, 23 nt, Human
aagagccccaaacccgagggaca

SEQ ID NO: 627518 - RNA, 23 nt, Human
acaaaaaaaagaaaagcaacggu

SEQ ID NO: 627519 - RNA, 19 nt, Human
acaaagaggacauauauuu

SEQ ID NO: 627520 - RNA, 22 nt, Human
acaaagaggacauauauuugua

SEQ ID NO: 627521 - RNA, 18 nt, Human
acaagaagccccuuuccu

SEQ ID NO: 627522 - RNA, 20 nt, Human
acagcuccagaugagaaacc

SEQ ID NO: 627523 - RNA, 21 nt, Human
accaaauaccaaaacucaaac

SEQ ID NO: 627524 - RNA, 19 nt, Human
accaccuuuucuguccucu

SEQ ID NO: 627525 - RNA, 22 nt, Human
acccaccagggacacugcucgg

SEQ ID NO: 627526 - RNA, 21 nt, Human
acccugagccuuccccuucuu

SEQ ID NO: 627527 - RNA, 18 nt, Human
accuggaggugcugaagc

SEQ ID NO: 627528 - RNA, 22 nt, Human
accuggaggugcugaagccacc

SEQ ID NO: 627529 - RNA, 18 nt, Human
agaaaggggcgaggagga

SEQ ID NO: 627530 - RNA, 19 nt, Human
agaagagccccaaacccga

SEQ ID NO: 627531 - RNA, 22 nt, Human
agacacugaugcuugggauggc

SEQ ID NO: 627532 - RNA, 26 nt, Human
agacugccaucagagaugaaggcagg

SEQ ID NO: 627533 - RNA, 25 nt, Human
agagccccuucugccuccccugccc

SEQ ID NO: 627534 - RNA, 22 nt, Human
agagggaagaggggccaggagu

SEQ ID NO: 627535 - RNA, 22 nt, Human
agaugcuccaggaaagucuggg

SEQ ID NO: 627536 - RNA, 22 nt, Human
agcuacucacuucagcagccuc

SEQ ID NO: 627537 - RNA, 18 nt, Human
agcuuuguacaacaggag

SEQ ID NO: 627538 - RNA, 19 nt, Human
aggaaagucuggggguugg

SEQ ID NO: 627539 - RNA, 19 nt, Human
aggggcgaggaggacucug

SEQ ID NO: 627540 - RNA, 19 nt, Human
aggggcgaggaggacucug

SEQ ID NO: 627541 - RNA, 22 nt, Human
auggaauacugacaguggucca

SEQ ID NO: 627542 - RNA, 22 nt, Human
caaaguucuccacauccucuuc

SEQ ID NO: 627543 - RNA, 19 nt, Human
caagugacacauccagaga

SEQ ID NO: 627544 - RNA, 24 nt, Human
caagugucuuucuuuaauuagucc

SEQ ID NO: 627545 - RNA, 21 nt, Human
cacacacacaugcagacaccu

SEQ ID NO: 627546 - RNA, 23 nt, Human
cacacacaugcagacaccuggug

SEQ ID NO: 627547 - RNA, 24 nt, Human
cacacccacacacacaugcagaca

SEQ ID NO: 627548 - RNA, 21 nt, Human
cacauuauaaauauaaaauca

SEQ ID NO: 627549 - RNA, 19 nt, Human
cacccuccacuaccaaaua

SEQ ID NO: 627550 - RNA, 21 nt, Human
caccuuuucuguccucuccca

SEQ ID NO: 627551 - RNA, 25 nt, Human
cacuucagcagccucccguucuacc

SEQ ID NO: 627552 - RNA, 24 nt, Human
cagcagccucccguucuaccccuc

SEQ ID NO: 627553 - RNA, 20 nt, Human
cagccucccguucuaccccu

SEQ ID NO: 627554 - RNA, 21 nt, Human
caggacacccagaaccaaccu

SEQ ID NO: 627555 - RNA, 27 nt, Human
cauauacauaauaacacaauuuacaca

SEQ ID NO: 627556 - RNA, 20 nt, Human
caucagugccuccuccaucu

SEQ ID NO: 627557 - RNA, 22 nt, Human
ccauacaaacauaaaaacuaaa

SEQ ID NO: 627558 - RNA, 20 nt, Human
cccacacacacaugcagaca

SEQ ID NO: 627559 - RNA, 23 nt, Human
cccacacacacaugcagacaccu

SEQ ID NO: 627560 - RNA, 18 nt, Human
ccccacccuccacuacca

SEQ ID NO: 627561 - RNA, 19 nt, Human
ccccacccuccacuaccaa

SEQ ID NO: 627562 - RNA, 20 nt, Human
ccccacccuccacuaccaaa

SEQ ID NO: 627563 - RNA, 23 nt, Human
ccccacccuccacuaccaaauac

SEQ ID NO: 627564 - RNA, 19 nt, Human
ccccauccccccacccucc

SEQ ID NO: 627565 - RNA, 21 nt, Human
ccccccacccuccacuaccaa

SEQ ID NO: 627566 - RNA, 22 nt, Human
ccccccacccuccacuaccaaa

SEQ ID NO: 627567 - RNA, 19 nt, Human
ccccuuuccuuggcacuga

SEQ ID NO: 627568 - RNA, 19 nt, Human
cccuccacuaccaaauacc

SEQ ID NO: 627569 - RNA, 20 nt, Human
cccugccccaaucccucuuc

SEQ ID NO: 627570 - RNA, 18 nt, Human
cccuggacauacccacug

SEQ ID NO: 627571 - RNA, 19 nt, Human
ccucacuggcucagacugg

SEQ ID NO: 627572 - RNA, 24 nt, Human
ccugugaucaaaucaaaccggggc

SEQ ID NO: 627573 - RNA, 29 nt, Human
ccuuccccuucuuuguccaguuucuuuuu

SEQ ID NO: 627574 - RNA, 20 nt, Human
cgcacaguggccacagugau

SEQ ID NO: 627575 - RNA, 22 nt, Human
cuaccccucacagcaggacacc

SEQ ID NO: 627576 - RNA, 22 nt, Human
cuccagaugagaaaccuaacuc

SEQ ID NO: 627577 - RNA, 24 nt, Human
cuccagaugagaaaccuaacucac

SEQ ID NO: 627578 - RNA, 19 nt, Human
cucccagaacugggcccau

SEQ ID NO: 627579 - RNA, 22 nt, Human
cugccuccccugccccaauccc

SEQ ID NO: 627580 - RNA, 22 nt, Human
cuggcaggguggcggauggccc

SEQ ID NO: 627581 - RNA, 24 nt, Human
cuuggcacugagucuucagucaca

SEQ ID NO: 627582 - RNA, 23 nt, Human
gacacagaaauucagacauguga

SEQ ID NO: 627583 - RNA, 21 nt, Human
gacagugguccaagugacaca

SEQ ID NO: 627584 - RNA, 21 nt, Human
gagaaaccuaacucacaccga

SEQ ID NO: 627585 - RNA, 19 nt, Human
gauggggcucgucuggaca

SEQ ID NO: 627586 - RNA, 22 nt, Human
gcccccauccccccacccucca

SEQ ID NO: 627587 - RNA, 19 nt, Human
gccuccccugccccaaucc

SEQ ID NO: 627588 - RNA, 24 nt, Human
ggaaagucuggggguuggggggcg

SEQ ID NO: 627589 - RNA, 18 nt, Human
ggaagagggaagaggggc

SEQ ID NO: 627590 - RNA, 20 nt, Human
ggacacccagaaccaaccug

SEQ ID NO: 627591 - RNA, 21 nt, Human
ggacacugcucggcuucccag

SEQ ID NO: 627592 - RNA, 21 nt, Human
ggagauaaaaacacauagaga

SEQ ID NO: 627593 - RNA, 22 nt, Human
ggaggacucugagacacugaug

SEQ ID NO: 627594 - RNA, 25 nt, Human
ggcacugagucuucaggaccacggu

SEQ ID NO: 627595 - RNA, 24 nt, Human
ggcccccauccccccacccuccac

SEQ ID NO: 627596 - RNA, 21 nt, Human
gggaagguggagauaaaaaca

SEQ ID NO: 627597 - RNA, 20 nt, Human
gggaugcuuauacacuuggu

SEQ ID NO: 627598 - RNA, 21 nt, Human
guaaaaacaaaagcccucccc

SEQ ID NO: 627599 - RNA, 21 nt, Human
guacaucuuuacccauauaca

SEQ ID NO: 627600 - RNA, 22 nt, Human
guccuuguagggacaaugugag

SEQ ID NO: 627601 - RNA, 27 nt, Human
uaaaaacaaaagcccuccccagauucc

SEQ ID NO: 627602 - RNA, 21 nt, Human
uaccaaauaccaaaacucaaa

SEQ ID NO: 627603 - RNA, 24 nt, Human
ucagacaugugacuaaaugcugau

SEQ ID NO: 627604 - RNA, 18 nt, Human
ucagacuggggcagaagg

SEQ ID NO: 627605 - RNA, 21 nt, Human
ucagacuggggcagaagggga

SEQ ID NO: 627606 - RNA, 21 nt, Human
uccccccacccuccacuacca

SEQ ID NO: 627607 - RNA, 18 nt, Human
ucccucuucaagggaugc

SEQ ID NO: 627608 - RNA, 21 nt, Human
ucccuuccuggggaggcugcu

SEQ ID NO: 627609 - RNA, 20 nt, Human
uccuggccgggguccacggc

SEQ ID NO: 627610 - RNA, 18 nt, Human
ucgucuggacacagaaau

SEQ ID NO: 627611 - RNA, 26 nt, Human
ucuggggguuggggggcgggguaguc

SEQ ID NO: 627612 - RNA, 20 nt, Human
ugaagaaaggggcgaggagg

SEQ ID NO: 627613 - RNA, 18 nt, Human
ugaagccaccuuccuggc

SEQ ID NO: 627614 - RNA, 23 nt, Human
ugagaagagccccaaacccgagg

SEQ ID NO: 627615 - RNA, 18 nt, Human
ugagacaaguuggucacg

SEQ ID NO: 627616 - RNA, 21 nt, Human
ugaggcacaccgaaggggaaa

SEQ ID NO: 627617 - RNA, 24 nt, Human
ugaugcuugggauggcuccagcug

SEQ ID NO: 627618 - RNA, 27 nt, Human
ugccugagaaacagcuccagaugagaa

SEQ ID NO: 627619 - RNA, 21 nt, Human
ugcuggcccccauccccccac

SEQ ID NO: 627620 - RNA, 19 nt, Human
uggaauacugacagugguc

SEQ ID NO: 627621 - RNA, 23 nt, Human
uggaggaggaaauacaccauuua

SEQ ID NO: 627622 - RNA, 22 nt, Human
uggagugggucaucauggaaaa

SEQ ID NO: 627623 - RNA, 22 nt, Human
uggcaacuuccucugugcuagu

SEQ ID NO: 627624 - RNA, 22 nt, Human
uggcccccauccccccacccuc

SEQ ID NO: 627625 - RNA, 18 nt, Human
uggcucagacuggggcag

SEQ ID NO: 627626 - RNA, 20 nt, Human
uggucacuggggcccuuccc

SEQ ID NO: 627627 - RNA, 22 nt, Human
uguccaguuucuuuuaaagggg

SEQ ID NO: 627628 - RNA, 22 nt, Human
ugucuuucuuuaauuaguccgg

SEQ ID NO: 627629 - RNA, 20 nt, Human
uucaagggaugcuuauacac

SEQ ID NO: 627630 - RNA, 25 nt, Human
uucacaaaaaaaagaaaagcaacgg

SEQ ID NO: 627631 - RNA, 24 nt, Human
uucagcagccucccguucuacccc

SEQ ID NO: 627632 - RNA, 19 nt, Human
uuccagaguuacaagcauc

SEQ ID NO: 627633 - RNA, 18 nt, Human
uucuccacauccucuucc

SEQ ID NO: 627634 - RNA, 19 nt, Human
uuuaaaaagcuaccccuca

SEQ ID NO: 627635 - RNA, 25 nt, Human
uuuacaauucuuuucacuuuaucca

SEQ ID NO: 627636 - RNA, 19 nt, Human
uuugauggggcucgucugg

SEQ ID NO: 627637 - RNA, 18 nt, Human
uuuuuuuuuuuuuuuuug

SEQ ID NO: 627638 - RNA, 24 nt, Human
aaaaugcugggauuacaggcauga

SEQ ID NO: 627639 - RNA, 20 nt, Human
aaaauuacaaauuagagaca

SEQ ID NO: 627640 - RNA, 23 nt, Human
aaagugcugggauuacgggugug

SEQ ID NO: 627641 - RNA, 24 nt, Human
aaagugcugggauuacggguguga

SEQ ID NO: 627642 - RNA, 26 nt, Human
aaaugcugggauuacaggcaugagcc

SEQ ID NO: 627643 - RNA, 19 nt, Human
aagauguuggugaucuggu

SEQ ID NO: 627644 - RNA, 18 nt, Human
aagugcugggauuacggg

SEQ ID NO: 627645 - RNA, 26 nt, Human
aagugcugggauuacgggugugagcc

SEQ ID NO: 627646 - RNA, 20 nt, Human
aauguuagagacaguagaga

SEQ ID NO: 627647 - RNA, 21 nt, Human
aauuccacaagaugcagaaaa

SEQ ID NO: 627648 - RNA, 22 nt, Human
acagcuuauccaaucaccuguu

SEQ ID NO: 627649 - RNA, 19 nt, Human
acaggguuucaccauguug

SEQ ID NO: 627650 - RNA, 20 nt, Human
acaggguuucaccauguugu

SEQ ID NO: 627651 - RNA, 24 nt, Human
acaggguuucaccauguuguccag

SEQ ID NO: 627652 - RNA, 20 nt, Human
acaguggcacaaucucggcu

SEQ ID NO: 627653 - RNA, 24 nt, Human
accaaaaugcugggauuacaggca

SEQ ID NO: 627654 - RNA, 21 nt, Human
accccacuccacuccaacuuc

SEQ ID NO: 627655 - RNA, 19 nt, Human
agagacaguagagacaggg

SEQ ID NO: 627656 - RNA, 20 nt, Human
agaguuccuguucuucuuca

SEQ ID NO: 627657 - RNA, 23 nt, Human
agaugcagaaaaccgcaacgacc

SEQ ID NO: 627658 - RNA, 20 nt, Human
aggaggauggcgaggagucc

SEQ ID NO: 627659 - RNA, 23 nt, Human
aguacaguggcacaaucucggcu

SEQ ID NO: 627660 - RNA, 18 nt, Human
aguagcugggauuacagg

SEQ ID NO: 627661 - RNA, 25 nt, Human
aguagcugggauuacaggggcacac

SEQ ID NO: 627662 - RNA, 19 nt, Human
auacagaacagcuccauca

SEQ ID NO: 627663 - RNA, 18 nt, Human
aucagccuauucccuuug

SEQ ID NO: 627664 - RNA, 26 nt, Human
auguauccaccacacaguaccauaca

SEQ ID NO: 627665 - RNA, 21 nt, Human
auuugguugcccacacuucuu

SEQ ID NO: 627666 - RNA, 18 nt, Human
caaaccugacaacaacug

SEQ ID NO: 627667 - RNA, 20 nt, Human
caaagugcugggauuacggg

SEQ ID NO: 627668 - RNA, 24 nt, Human
caaagugcugggauuacgggugug

SEQ ID NO: 627669 - RNA, 20 nt, Human
caaauuagagacagguuuaa

SEQ ID NO: 627670 - RNA, 20 nt, Human
caaccuccaccucccggguu

SEQ ID NO: 627671 - RNA, 23 nt, Human
caaccuccaccucccggguucaa

SEQ ID NO: 627672 - RNA, 20 nt, Human
caagaugcagaaaaccgcaa

SEQ ID NO: 627673 - RNA, 22 nt, Human
caagaugcagaaaaccgcaacg

SEQ ID NO: 627674 - RNA, 22 nt, Human
caagcgauucuccugcuucagc

SEQ ID NO: 627675 - RNA, 20 nt, Human
caauguggcuuuauggcugg

SEQ ID NO: 627676 - RNA, 23 nt, Human
caauuccacaagaugcagaaaac

SEQ ID NO: 627677 - RNA, 20 nt, Human
cacaagaugcagaaaaccgc

SEQ ID NO: 627678 - RNA, 24 nt, Human
cacacaguaccauacagaacagcu

SEQ ID NO: 627679 - RNA, 24 nt, Human
cacaccaccacgccuggcuaauuu

SEQ ID NO: 627680 - RNA, 18 nt, Human
caccacacaguaccauac

SEQ ID NO: 627681 - RNA, 24 nt, Human
caccacgccuggcuaauuuuugua

SEQ ID NO: 627682 - RNA, 22 nt, Human
caccauguuguccaggacaguc

SEQ ID NO: 627683 - RNA, 23 nt, Human
caccauguuguccaggacagucu

SEQ ID NO: 627684 - RNA, 18 nt, Human
cacgggucugcacuagac

SEQ ID NO: 627685 - RNA, 20 nt, Human
cagccuccugaguagcuggg

SEQ ID NO: 627686 - RNA, 24 nt, Human
caggguuucaccauguuguccagg

SEQ ID NO: 627687 - RNA, 23 nt, Human
caguagagacaggguuucaccau

SEQ ID NO: 627688 - RNA, 24 nt, Human
caguagagacaggguuucaccaug

SEQ ID NO: 627689 - RNA, 25 nt, Human
caguagagacaggguuucaccaugu

SEQ ID NO: 627690 - RNA, 18 nt, Human
cauguuggccaggcuggu

SEQ ID NO: 627691 - RNA, 19 nt, Human
cauguuggccaggcugguc

SEQ ID NO: 627692 - RNA, 24 nt, Human
cauguuggccaggcuggucuagaa

SEQ ID NO: 627693 - RNA, 22 nt, Human
ccaaaaugcugggauuacaggc

SEQ ID NO: 627694 - RNA, 23 nt, Human
ccaaaaugcugggauuacaggca

SEQ ID NO: 627695 - RNA, 24 nt, Human
ccaaaaugcugggauuacaggcau

SEQ ID NO: 627696 - RNA, 25 nt, Human
ccaaaaugcugggauuacaggcaug

SEQ ID NO: 627697 - RNA, 21 nt, Human
ccaacauguagacuuuuaggc

SEQ ID NO: 627698 - RNA, 22 nt, Human
ccaccccacuccacuccaacuu

SEQ ID NO: 627699 - RNA, 24 nt, Human
ccaccucccggguucaagcgauuc

SEQ ID NO: 627700 - RNA, 20 nt, Human
cccaccccacuccacuccaa

SEQ ID NO: 627701 - RNA, 23 nt, Human
cccaccccacuccacuccaacuu

SEQ ID NO: 627702 - RNA, 23 nt, Human
cccggguucaagcgauucuccug

SEQ ID NO: 627703 - RNA, 18 nt, Human
cccugccucggccccgca

SEQ ID NO: 627704 - RNA, 23 nt, Human
ccgcaaagugcugggauuacggg

SEQ ID NO: 627705 - RNA, 28 nt, Human
ccuaccaaaaugcugggauuacaggcau

SEQ ID NO: 627706 - RNA, 24 nt, Human
ccucccggguucaagcgauucucc

SEQ ID NO: 627707 - RNA, 20 nt, Human
ccucggccuaccaaaaugcu

SEQ ID NO: 627708 - RNA, 19 nt, Human
ccugaccuuguguuccccu

SEQ ID NO: 627709 - RNA, 23 nt, Human
ccugaguagcugggauuacaggg

SEQ ID NO: 627710 - RNA, 20 nt, Human
ccuggcaccaagugaucugc

SEQ ID NO: 627711 - RNA, 24 nt, Human
ccuggcaccaagugaucugcccuc

SEQ ID NO: 627712 - RNA, 25 nt, Human
ccuggcaccaagugaucugcccucc

SEQ ID NO: 627713 - RNA, 21 nt, Human
cgcuuugcaaucccaucagcc

SEQ ID NO: 627714 - RNA, 24 nt, Human
cuaaccagugaauccacugaagca

SEQ ID NO: 627715 - RNA, 18 nt, Human
cucaaaccugacaacaac

SEQ ID NO: 627716 - RNA, 21 nt, Human
cucaaaccugacaacaacuga

SEQ ID NO: 627717 - RNA, 25 nt, Human
cuccaacuucuuccuuccuuuugac

SEQ ID NO: 627718 - RNA, 23 nt, Human
cuccugaccuuguguuccccugc

SEQ ID NO: 627719 - RNA, 23 nt, Human
cucgcucugucaccaggcuggag

SEQ ID NO: 627720 - RNA, 25 nt, Human
cucuuaguucacugcucaucucagc

SEQ ID NO: 627721 - RNA, 20 nt, Human
cugcaaccuccaccucccgg

SEQ ID NO: 627722 - RNA, 20 nt, Human
cugcaaccuccaccucccgg

SEQ ID NO: 627723 - RNA, 21 nt, Human
cugcaaccuccaccucccggg

SEQ ID NO: 627724 - RNA, 23 nt, Human
cugcuucagccuccugaguagcu

SEQ ID NO: 627725 - RNA, 24 nt, Human
cuugcugcaaccuccaccucccgg

SEQ ID NO: 627726 - RNA, 23 nt, Human
gacaggguuucaccauguugucc

SEQ ID NO: 627727 - RNA, 19 nt, Human
gaccuuguguuccccugcc

SEQ ID NO: 627728 - RNA, 21 nt, Human
gaccuuguguuccccugccuc

SEQ ID NO: 627729 - RNA, 19 nt, Human
gagaagaauucccuucugg

SEQ ID NO: 627730 - RNA, 21 nt, Human
gagagggagucucgcucuguc

SEQ ID NO: 627731 - RNA, 18 nt, Human
gauuacaggcaugagcca

SEQ ID NO: 627732 - RNA, 22 nt, Human
gauuacaggcaugagccacugc

SEQ ID NO: 627733 - RNA, 23 nt, Human
gauuacaggcaugagccacugca

SEQ ID NO: 627734 - RNA, 18 nt, Human
gauuacaggggcacacca

SEQ ID NO: 627735 - RNA, 18 nt, Human
gauuacgggugugagcca

SEQ ID NO: 627736 - RNA, 22 nt, Human
gauuacgggugugagccaccgc

SEQ ID NO: 627737 - RNA, 22 nt, Human
gauuacgggugugagccaccgc

SEQ ID NO: 627738 - RNA, 21 nt, Human
gauucuccugcuucagccucc

SEQ ID NO: 627739 - RNA, 24 nt, Human
gcaaagugcugggauuacgggugu

SEQ ID NO: 627740 - RNA, 22 nt, Human
gcaaccuccaccucccggguuc

SEQ ID NO: 627741 - RNA, 19 nt, Human
gcaacgaccaggaggaugg

SEQ ID NO: 627742 - RNA, 24 nt, Human
gcgauucuccugcuucagccuccu

SEQ ID NO: 627743 - RNA, 19 nt, Human
gcuggaguacaguggcaca

SEQ ID NO: 627744 - RNA, 23 nt, Human
gcuggucuagaacuccuggcacc

SEQ ID NO: 627745 - RNA, 21 nt, Human
ggaauucccaaaccucugcuu

SEQ ID NO: 627746 - RNA, 22 nt, Human
ggauuacaggcaugagccacug

SEQ ID NO: 627747 - RNA, 18 nt, Human
ggccccgcaaagugcugg

SEQ ID NO: 627748 - RNA, 22 nt, Human
ggucauguuggccaggcugguc

SEQ ID NO: 627749 - RNA, 18 nt, Human
gucauguuggccaggcug

SEQ ID NO: 627750 - RNA, 24 nt, Human
gucucgcucugucaccaggcugga

SEQ ID NO: 627751 - RNA, 22 nt, Human
guucacugcucaucucagccuc

SEQ ID NO: 627752 - RNA, 22 nt, Human
uaaggaacuugucgcuucuucc

SEQ ID NO: 627753 - RNA, 24 nt, Human
uaauuuuuguauuuuuaguaaaga

SEQ ID NO: 627754 - RNA, 19 nt, Human
uacaaaauaugagagacag

SEQ ID NO: 627755 - RNA, 23 nt, Human
uacaaaauuacaaauuagagaca

SEQ ID NO: 627756 - RNA, 22 nt, Human
uacaggcaugagccacugcacc

SEQ ID NO: 627757 - RNA, 22 nt, Human
uacaggggcacaccaccacgcc

SEQ ID NO: 627758 - RNA, 28 nt, Human
uaccaaaaugcugggauuacaggcauga

SEQ ID NO: 627759 - RNA, 23 nt, Human
uacgggugugagccaccgcgccu

SEQ ID NO: 627760 - RNA, 24 nt, Human
uacgggugugagccaccgcgccug

SEQ ID NO: 627761 - RNA, 21 nt, Human
uagagacaggguuucaccaug

SEQ ID NO: 627762 - RNA, 22 nt, Human
uagagacaggguuucaccaugu

SEQ ID NO: 627763 - RNA, 21 nt, Human
uagagacagguuuacaaaugu

SEQ ID NO: 627764 - RNA, 31 nt, Human
uagagacaguagagacaggguuucaccaugg

SEQ ID NO: 627765 - RNA, 25 nt, Human
uaguucuuguguuugcaaauggaua

SEQ ID NO: 627766 - RNA, 20 nt, Human
ucagccuccugaguagcugg

SEQ ID NO: 627767 - RNA, 22 nt, Human
uccacaagaugcagaaaaccgc

SEQ ID NO: 627768 - RNA, 20 nt, Human
uccacuccaacuucuuccuu

SEQ ID NO: 627769 - RNA, 21 nt, Human
uccacugaagcacuaagguga

SEQ ID NO: 627770 - RNA, 21 nt, Human
ucccggguucaagcgauucuc

SEQ ID NO: 627771 - RNA, 24 nt, Human
ucccggguucaagcgauucuccug

SEQ ID NO: 627772 - RNA, 25 nt, Human
ucccuuugcagccccuuuguagcaa

SEQ ID NO: 627773 - RNA, 25 nt, Human
uccugaguagcugggauuacagggg

SEQ ID NO: 627774 - RNA, 22 nt, Human
ucucgcucugucaccaggcugg

SEQ ID NO: 627775 - RNA, 23 nt, Human
ucucgcucugucaccaggcugga

SEQ ID NO: 627776 - RNA, 18 nt, Human
ucugcacuagacucugca

SEQ ID NO: 627777 - RNA, 21 nt, Human
ucugcccuccucggccuacca

SEQ ID NO: 627778 - RNA, 23 nt, Human
ucuggaauucccaaaccucugcu

SEQ ID NO: 627779 - RNA, 19 nt, Human
ugaaauggcugggccauau

SEQ ID NO: 627780 - RNA, 22 nt, Human
ugaagguaauaaucuuagacua

SEQ ID NO: 627781 - RNA, 19 nt, Human
ugagaguuccuguucuucu

SEQ ID NO: 627782 - RNA, 18 nt, Human
ugaucacgggucugcacu

SEQ ID NO: 627783 - RNA, 21 nt, Human
ugcagaaaaccgcaacgacca

SEQ ID NO: 627784 - RNA, 26 nt, Human
ugcccacacuucuuuuuuguuuguuu

SEQ ID NO: 627785 - RNA, 24 nt, Human
ugcuucagccuccugaguagcugg

SEQ ID NO: 627786 - RNA, 19 nt, Human
uggaguacaguggcacaau

SEQ ID NO: 627787 - RNA, 24 nt, Human
uggaguacaguggcacaaucucgg

SEQ ID NO: 627788 - RNA, 24 nt, Human
uggcacaaucucggcuugcugcaa

SEQ ID NO: 627789 - RNA, 24 nt, Human
uggccaggcuggucuagaacuccu

SEQ ID NO: 627790 - RNA, 19 nt, Human
ugggauagacuacucaaug

SEQ ID NO: 627791 - RNA, 18 nt, Human
ugggauuacaggcaugag

SEQ ID NO: 627792 - RNA, 19 nt, Human
ugggauuacaggcaugagc

SEQ ID NO: 627793 - RNA, 21 nt, Human
ugggauuacaggcaugagcca

SEQ ID NO: 627794 - RNA, 22 nt, Human
ugggauuacaggcaugagccac

SEQ ID NO: 627795 - RNA, 22 nt, Human
ugggauuacaggcaugagccac

SEQ ID NO: 627796 - RNA, 24 nt, Human
ugggauuacaggcaugagccacug

SEQ ID NO: 627797 - RNA, 24 nt, Human
ugggauuacaggcaugagccacug

SEQ ID NO: 627798 - RNA, 22 nt, Human
ugggauuacaggggcacaccac

SEQ ID NO: 627799 - RNA, 24 nt, Human
ugggauuacaggggcacaccacca

SEQ ID NO: 627800 - RNA, 18 nt, Human
ugggauuacgggugugag

SEQ ID NO: 627801 - RNA, 19 nt, Human
ugggauuacgggugugagc

SEQ ID NO: 627802 - RNA, 22 nt, Human
ugggauuacgggugugagccac

SEQ ID NO: 627803 - RNA, 23 nt, Human
ugggauuacgggugugagccacc

SEQ ID NO: 627804 - RNA, 24 nt, Human
ugggauuacgggugugagccaccg

SEQ ID NO: 627805 - RNA, 19 nt, Human
uguccaggacagucuugau

SEQ ID NO: 627806 - RNA, 19 nt, Human
uguuuguuuuguuuuuuug

SEQ ID NO: 627807 - RNA, 18 nt, Human
uuacaggggcacaccacc

SEQ ID NO: 627808 - RNA, 18 nt, Human
uuaguaaagaugggucau

SEQ ID NO: 627809 - RNA, 24 nt, Human
uuaguucacugcucaucucagccu

SEQ ID NO: 627810 - RNA, 23 nt, Human
uucaagcgauucuccugcuucag

SEQ ID NO: 627811 - RNA, 24 nt, Human
uucaagcgauucuccugcuucagc

SEQ ID NO: 627812 - RNA, 24 nt, Human
uucagccuccugaguagcugggau

SEQ ID NO: 627813 - RNA, 20 nt, Human
uucaucccuauaguuuugcc

SEQ ID NO: 627814 - RNA, 23 nt, Human
uugcagccccuuuguagcaaacu

SEQ ID NO: 627815 - RNA, 27 nt, Human
uugcagccccuuuguagcaaacuuccc

SEQ ID NO: 627816 - RNA, 24 nt, Human
uugcugcaaccuccaccucccggg

SEQ ID NO: 627817 - RNA, 25 nt, Human
uugcugcaaccuccaccucccgggu

SEQ ID NO: 627818 - RNA, 24 nt, Human
uugggucaauuucuaguagugaaa

SEQ ID NO: 627819 - RNA, 19 nt, Human
uuguuuguuuuguuuuuuu

SEQ ID NO: 627820 - RNA, 18 nt, Human
uuuaaaauggaaauugcc

SEQ ID NO: 627821 - RNA, 22 nt, Human
uuucaccauguuguccaggaca

SEQ ID NO: 627822 - RNA, 23 nt, Human
uuuuaggccuagcuucuuucacu

SEQ ID NO: 627823 - RNA, 18 nt, Human
uuuuguuuguuuuguuuu

SEQ ID NO: 627824 - RNA, 26 nt, Human
uuuuguuuuuuugagagggagucucg

SEQ ID NO: 627825 - RNA, 21 nt, Human
uuuuuaguaaagaugggucau

SEQ ID NO: 627826 - RNA, 20 nt, Human
uuuuuguauuuuuaguaaag

SEQ ID NO: 627827 - RNA, 23 nt, Human
uuuuuguauuuuuaguaaagaug

SEQ ID NO: 627828 - RNA, 20 nt, Human
uuuuuuuuuuuuuuuuccac

SEQ ID NO: 627829 - RNA, 19 nt, Human
aaaaaaaaacaaagaaaaa

SEQ ID NO: 627830 - RNA, 20 nt, Human
aaaaaccaguccaaagugag

SEQ ID NO: 627831 - RNA, 24 nt, Human
aaacaaacagaaaaaaugcaaccg

SEQ ID NO: 627832 - RNA, 21 nt, Human
aaagauuagagauugaaacaa

SEQ ID NO: 627833 - RNA, 19 nt, Human
aaauaaccaaugggcccaa

SEQ ID NO: 627834 - RNA, 19 nt, Human
aacauagugacacucaucu

SEQ ID NO: 627835 - RNA, 25 nt, Human
aagccugggcaacauagugacacuc

SEQ ID NO: 627836 - RNA, 24 nt, Human
aaucguuugaacccaggaggcaga

SEQ ID NO: 627837 - RNA, 19 nt, Human
acaagagcgaaacuccauc

SEQ ID NO: 627838 - RNA, 20 nt, Human
acaagagcgaaacuccaucu

SEQ ID NO: 627839 - RNA, 23 nt, Human
accacuccagccugggggacaag

SEQ ID NO: 627840 - RNA, 24 nt, Human
acccaggaggcagagguugcagug

SEQ ID NO: 627841 - RNA, 18 nt, Human
acucaaugugagacaggg

SEQ ID NO: 627842 - RNA, 21 nt, Human
acuccagccugggggacaaga

SEQ ID NO: 627843 - RNA, 21 nt, Human
acuccaucuggaaaaaaaaaa

SEQ ID NO: 627844 - RNA, 19 nt, Human
acugcaccacuccagccug

SEQ ID NO: 627845 - RNA, 23 nt, Human
agagguugcagugaccugagauc

SEQ ID NO: 627846 - RNA, 24 nt, Human
agagguugcagugaccugagaucg

SEQ ID NO: 627847 - RNA, 20 nt, Human
agcacuuugggaggcugagg

SEQ ID NO: 627848 - RNA, 23 nt, Human
agccugggcaacauagugacacu

SEQ ID NO: 627849 - RNA, 20 nt, Human
aggcagagguugcagugacc

SEQ ID NO: 627850 - RNA, 24 nt, Human
aggcagagguugcagugaccugag

SEQ ID NO: 627851 - RNA, 24 nt, Human
aggcugaggcaagaagacugcuug

SEQ ID NO: 627852 - RNA, 24 nt, Human
aggcugagguaggagaaucguuug

SEQ ID NO: 627853 - RNA, 26 nt, Human
agguagaaauaaaaacauuuaaucug

SEQ ID NO: 627854 - RNA, 23 nt, Human
agguaggagaaucguuugaaccc

SEQ ID NO: 627855 - RNA, 19 nt, Human
aguccagaagucgggaagu

SEQ ID NO: 627856 - RNA, 24 nt, Human
aguggcucacgccuguaaucccag

SEQ ID NO: 627857 - RNA, 27 nt, Human
aucgugccacugcaccacuccagccug

SEQ ID NO: 627858 - RNA, 22 nt, Human
aucucuacaaaaaauuaaaaaa

SEQ ID NO: 627859 - RNA, 19 nt, Human
auuagagauugaaacaaac

SEQ ID NO: 627860 - RNA, 18 nt, Human
auugcccuuggagaaugg

SEQ ID NO: 627861 - RNA, 26 nt, Human
caaacagaaaaaaugcaaccgcuugc

SEQ ID NO: 627862 - RNA, 24 nt, Human
cacgccuguaaucccagcacuuug

SEQ ID NO: 627863 - RNA, 24 nt, Human
cacuccagccugggggacaagagc

SEQ ID NO: 627864 - RNA, 25 nt, Human
cacuccagccugggggacaagagcg

SEQ ID NO: 627865 - RNA, 18 nt, Human
cacugcaccacuccagcc

SEQ ID NO: 627866 - RNA, 23 nt, Human
cagcacuuugggaggcugaggca

SEQ ID NO: 627867 - RNA, 25 nt, Human
cagcacuuugggaggcugaggcaag

SEQ ID NO: 627868 - RNA, 22 nt, Human
caguccaaagugagaaaaucaa

SEQ ID NO: 627869 - RNA, 27 nt, Human
ccacugcaccacuccagccugggggac

SEQ ID NO: 627870 - RNA, 19 nt, Human
ccaguacaaauuauugccc

SEQ ID NO: 627871 - RNA, 23 nt, Human
ccaucuggaaaaaaaaaacaaag

SEQ ID NO: 627872 - RNA, 22 nt, Human
ccuguaaucccagcacuuuggg

SEQ ID NO: 627873 - RNA, 24 nt, Human
cgaaacuccaucuggaaaaaaaaa

SEQ ID NO: 627874 - RNA, 23 nt, Human
cgccuguaaucccagcacuuugg

SEQ ID NO: 627875 - RNA, 22 nt, Human
cucacgccuguaaucccagcac

SEQ ID NO: 627876 - RNA, 24 nt, Human
cucacgccuguaaucccagcacuu

SEQ ID NO: 627877 - RNA, 18 nt, Human
cuggaaaaaaaaaacaaa

SEQ ID NO: 627878 - RNA, 24 nt, Human
cuggaaaaaaaaaacaaagaaaaa

SEQ ID NO: 627879 - RNA, 19 nt, Human
cuugcauuucuugcuaaaa

SEQ ID NO: 627880 - RNA, 20 nt, Human
gaaagaugaguccagaaguc

SEQ ID NO: 627881 - RNA, 21 nt, Human
gaagaguggcugagaaggagg

SEQ ID NO: 627882 - RNA, 22 nt, Human
gacaagagcgaaacuccaucug

SEQ ID NO: 627883 - RNA, 23 nt, Human
gagaaucguuugaacccaggagg

SEQ ID NO: 627884 - RNA, 19 nt, Human
gagccucauuaagaagagu

SEQ ID NO: 627885 - RNA, 20 nt, Human
ggaaaaaaaaaacaaagaaa

SEQ ID NO: 627886 - RNA, 21 nt, Human
ggaaaaaaaaaacaaagaaaa

SEQ ID NO: 627887 - RNA, 22 nt, Human
gggaggcugagguaggagaauc

SEQ ID NO: 627888 - RNA, 26 nt, Human
gggcauggugguauaugccuguagcc

SEQ ID NO: 627889 - RNA, 24 nt, Human
ggguggaguggcucacgccuguaa

SEQ ID NO: 627890 - RNA, 20 nt, Human
guaaaccaaaagcaguuuaa

SEQ ID NO: 627891 - RNA, 18 nt, Human
guccagaagucgggaagu

SEQ ID NO: 627892 - RNA, 18 nt, Human
guggaguggcucacgccu

SEQ ID NO: 627893 - RNA, 25 nt, Human
uaaaccaaaagcaguuuaauuugaa

SEQ ID NO: 627894 - RNA, 23 nt, Human
uagaaaauucuuccacaugagga

SEQ ID NO: 627895 - RNA, 21 nt, Human
uaguaaagaccaaugauggca

SEQ ID NO: 627896 - RNA, 19 nt, Human
uccaaagugagaaaaucaa

SEQ ID NO: 627897 - RNA, 22 nt, Human
ugaaacaaacagaaaaaaugca

SEQ ID NO: 627898 - RNA, 22 nt, Human
ugaccugagaucgugccacugc

SEQ ID NO: 627899 - RNA, 22 nt, Human
ugagaaggaggcagcaugacca

SEQ ID NO: 627900 - RNA, 20 nt, Human
ugagacagggggagccucau

SEQ ID NO: 627901 - RNA, 27 nt, Human
ugagaucgugccacugcaccacuccag

SEQ ID NO: 627902 - RNA, 20 nt, Human
ugaggaaaagauggccagag

SEQ ID NO: 627903 - RNA, 23 nt, Human
ugaggcaagaagacugcuugagg

SEQ ID NO: 627904 - RNA, 24 nt, Human
ugagguaggagaaucguuugaacc

SEQ ID NO: 627905 - RNA, 19 nt, Human
ugccuguagccccuggcua

SEQ ID NO: 627906 - RNA, 22 nt, Human
uggaaaaaaaaaacaaagaaaa

SEQ ID NO: 627907 - RNA, 22 nt, Human
uggcucacgccuguaaucccag

SEQ ID NO: 627908 - RNA, 24 nt, Human
uggcucacgccuguaaucccagca

SEQ ID NO: 627909 - RNA, 19 nt, Human
uggcugagaaggaggcagc

SEQ ID NO: 627910 - RNA, 23 nt, Human
uggugguauaugccuguagcccc

SEQ ID NO: 627911 - RNA, 18 nt, Human
uuaguugggcaugguggu

SEQ ID NO: 627912 - RNA, 24 nt, Human
uuaguugggcauggugguauaugc

SEQ ID NO: 627913 - RNA, 21 nt, Human
uugcagugaccugagaucgug

SEQ ID NO: 627914 - RNA, 22 nt, Human
uugcagugaccugagaucgugc

SEQ ID NO: 627915 - RNA, 20 nt, Human
uuuuuuuuuuuuuuuugcuu

SEQ ID NO: 627916 - RNA, 22 nt, Human
uuuuuuuuuuuuuuuugcuuag

SEQ ID NO: 627917 - RNA, 24 nt, Human
aaaacgacagauuuaagccauuga

SEQ ID NO: 627918 - RNA, 19 nt, Human
aaacgacagauuuaagcca

SEQ ID NO: 627919 - RNA, 18 nt, Human
aaagaguacuugagauga

SEQ ID NO: 627920 - RNA, 21 nt, Human
aaaucagcagaccaaaaacuu

SEQ ID NO: 627921 - RNA, 20 nt, Human
aacaauucaccauaaucccc

SEQ ID NO: 627922 - RNA, 26 nt, Human
aaccaaaaguaucaguuuaucagucc

SEQ ID NO: 627923 - RNA, 25 nt, Human
aaccaaauaccuucccccacagcua

SEQ ID NO: 627924 - RNA, 20 nt, Human
aagauacugaaauugcaaaa

SEQ ID NO: 627925 - RNA, 24 nt, Human
aagauccaggucaguaguucagcu

SEQ ID NO: 627926 - RNA, 21 nt, Human
aagcaucacuugacgacaucc

SEQ ID NO: 627927 - RNA, 18 nt, Human
acagcgcacaggaacacc

SEQ ID NO: 627928 - RNA, 22 nt, Human
agauaacacagacaaaagguua

SEQ ID NO: 627929 - RNA, 23 nt, Human
agauacugaaauugcaaaagcaa

SEQ ID NO: 627930 - RNA, 18 nt, Human
agcagaccaaaaacuuau

SEQ ID NO: 627931 - RNA, 23 nt, Human
aggaagguaauucuggucaguuu

SEQ ID NO: 627932 - RNA, 18 nt, Human
aggcugaaucaccacacc

SEQ ID NO: 627933 - RNA, 23 nt, Human
aggcugaaucaccacacccacag

SEQ ID NO: 627934 - RNA, 24 nt, Human
auaaacacccccauuuuuaguuuu

SEQ ID NO: 627935 - RNA, 20 nt, Human
auaaagcucuuucagcacag

SEQ ID NO: 627936 - RNA, 20 nt, Human
auggcaguguguacaacccc

SEQ ID NO: 627937 - RNA, 23 nt, Human
auugcaaaagcaaaaaggcuagg

SEQ ID NO: 627938 - RNA, 21 nt, Human
caaaagcaaaaaggcuaggac

SEQ ID NO: 627939 - RNA, 23 nt, Human
caaaagcaaaaaggcuaggacua

SEQ ID NO: 627940 - RNA, 20 nt, Human
cacacccacagcgcacagga

SEQ ID NO: 627941 - RNA, 20 nt, Human
cacaggcauaccaacagggu

SEQ ID NO: 627942 - RNA, 20 nt, Human
cacuugugcuucaugaaaca

SEQ ID NO: 627943 - RNA, 27 nt, Human
cagcacagcagucuauucauucaaagu

SEQ ID NO: 627944 - RNA, 21 nt, Human
caggcugaaucaccacaccca

SEQ ID NO: 627945 - RNA, 24 nt, Human
cagucccacucacaucccaccccc

SEQ ID NO: 627946 - RNA, 22 nt, Human
ccacacccacagcgcacaggaa

SEQ ID NO: 627947 - RNA, 19 nt, Human
cuaaccaaauaccuucccc

SEQ ID NO: 627948 - RNA, 26 nt, Human
cuaauccccacuuuacaacuucaugc

SEQ ID NO: 627949 - RNA, 20 nt, Human
cugaauaucaaaaacgacaa

SEQ ID NO: 627950 - RNA, 19 nt, Human
cugaaucaccacacccaca

SEQ ID NO: 627951 - RNA, 20 nt, Human
cugacucagaacagccuggg

SEQ ID NO: 627952 - RNA, 22 nt, Human
gaaagucauuuuuccuuuaaaa

SEQ ID NO: 627953 - RNA, 19 nt, Human
gacauuauucucccuacac

SEQ ID NO: 627954 - RNA, 21 nt, Human
gcgcacaggaacaccagccca

SEQ ID NO: 627955 - RNA, 20 nt, Human
guaaaguaagagaagacagg

SEQ ID NO: 627956 - RNA, 20 nt, Human
guaaaguaagagaagacagg

SEQ ID NO: 627957 - RNA, 22 nt, Human
gucaguaguucagcuauaccag

SEQ ID NO: 627958 - RNA, 21 nt, Human
uaaaaauguauucaugacugc

SEQ ID NO: 627959 - RNA, 21 nt, Human
uaaauugaggaaaccugaaua

SEQ ID NO: 627960 - RNA, 22 nt, Human
uaaccagauaaauaugguucac

SEQ ID NO: 627961 - RNA, 24 nt, Human
uaagaacaacaauucaccauaauc

SEQ ID NO: 627962 - RNA, 22 nt, Human
uaagagcauccaccuauguauc

SEQ ID NO: 627963 - RNA, 18 nt, Human
uaccuagaaaaacugucu

SEQ ID NO: 627964 - RNA, 20 nt, Human
uacuugagaugacucaguug

SEQ ID NO: 627965 - RNA, 24 nt, Human
uaggacuaagauccaggucaguag

SEQ ID NO: 627966 - RNA, 21 nt, Human
uauaagaacaacaauucacca

SEQ ID NO: 627967 - RNA, 24 nt, Human
ucccacccccacaggcauaccaac

SEQ ID NO: 627968 - RNA, 25 nt, Human
ucuaaccaaauaccuucccccacag

SEQ ID NO: 627969 - RNA, 24 nt, Human
ucuacaguucuacuuagaccagca

SEQ ID NO: 627970 - RNA, 18 nt, Human
ucucuuuuauguauuaaa

SEQ ID NO: 627971 - RNA, 19 nt, Human
ugaaaggucauaaucaguu

SEQ ID NO: 627972 - RNA, 23 nt, Human
ugaaagucauuuuuccuuuaaaa

SEQ ID NO: 627973 - RNA, 18 nt, Human
ugacugcugcaguaagag

SEQ ID NO: 627974 - RNA, 24 nt, Human
ugguagcaaacuaagauauuuuuc

SEQ ID NO: 627975 - RNA, 19 nt, Human
uguauuaaauuccacuugu

SEQ ID NO: 627976 - RNA, 24 nt, Human
uguguacaaccccuccuucacuaa

SEQ ID NO: 627977 - RNA, 20 nt, Human
ugugugacuaaggcugcaaa

SEQ ID NO: 627978 - RNA, 24 nt, Human
uuacaacugaaagcaucacuugac

SEQ ID NO: 627979 - RNA, 22 nt, Human
uuacauacuuugagacagugug

SEQ ID NO: 627980 - RNA, 19 nt, Human
uuagaauuacgaagaguuu

SEQ ID NO: 627981 - RNA, 19 nt, Human
uuagaccagcagggacagc

SEQ ID NO: 627982 - RNA, 23 nt, Human
uucaccauaaucccccuuugcca

SEQ ID NO: 627983 - RNA, 19 nt, Human
uucaugguaccuagaaaaa

SEQ ID NO: 627984 - RNA, 23 nt, Human
uucccuaguuuagagaugaagau

SEQ ID NO: 627985 - RNA, 22 nt, Human
uuuuuuuuuuuguguguagucu

SEQ ID NO: 627986 - RNA, 25 nt, Human
uuuuuuuuuuuuguguguagucuca

SEQ ID NO: 627987 - RNA, 19 nt, Human
uuuuuuuuuuuuuuugugu

SEQ ID NO: 627988 - RNA, 19 nt, Human
uuuuuuuuuuuuuuuuugu

SEQ ID NO: 627989 - RNA, 26 nt, Human
uuuuuuuuuuuuuuuuuuuuuugggg

SEQ ID NO: 627990 - RNA, 22 nt, Human
aaaaauacaaauuagcugcgua

SEQ ID NO: 627991 - RNA, 19 nt, Human
aaaugauaucugagagcuu

SEQ ID NO: 627992 - RNA, 19 nt, Human
aacacuaaaagauuuccca

SEQ ID NO: 627993 - RNA, 20 nt, Human
aacauggugaaacccugucu

SEQ ID NO: 627994 - RNA, 21 nt, Human
aacauggugaaacccugucuc

SEQ ID NO: 627995 - RNA, 25 nt, Human
aacccauuucuauucacgccuucca

SEQ ID NO: 627996 - RNA, 18 nt, Human
aaccucagcauacauuuu

SEQ ID NO: 627997 - RNA, 24 nt, Human
acagagcaagacucugucucaaaa

SEQ ID NO: 627998 - RNA, 19 nt, Human
acccauuucuauucacgcc

SEQ ID NO: 627999 - RNA, 24 nt, Human
acccugucucuacuaaaaauacaa

SEQ ID NO: 628000 - RNA, 18 nt, Human
acucaaugaauucuuuaa

SEQ ID NO: 628001 - RNA, 24 nt, Human
acugcacuccaguuuggaugacag

SEQ ID NO: 628002 - RNA, 26 nt, Human
acugcacuccaguuuggaugacagag

SEQ ID NO: 628003 - RNA, 24 nt, Human
acuugaggucaggaguucaagacc

SEQ ID NO: 628004 - RNA, 23 nt, Human
acuuuuucuaagggcuugcuuuu

SEQ ID NO: 628005 - RNA, 18 nt, Human
agagcaagacucugucuc

SEQ ID NO: 628006 - RNA, 22 nt, Human
agaggcggagguugcagugagc

SEQ ID NO: 628007 - RNA, 24 nt, Human
agcacuuugggaggcugaggcagg

SEQ ID NO: 628008 - RNA, 21 nt, Human
agccaagauugugccacugca

SEQ ID NO: 628009 - RNA, 23 nt, Human
agcugcguaugguggcaugugcc

SEQ ID NO: 628010 - RNA, 23 nt, Human
aggaguucaagaccaggcuggcc

SEQ ID NO: 628011 - RNA, 23 nt, Human
aggcaggagaaucgguugaaccc

SEQ ID NO: 628012 - RNA, 24 nt, Human
aggcaggagaaucgguugaaccca

SEQ ID NO: 628013 - RNA, 18 nt, Human
aggcaggcggaucacuug

SEQ ID NO: 628014 - RNA, 22 nt, Human
aggcaggcggaucacuugaggu

SEQ ID NO: 628015 - RNA, 26 nt, Human
aggcaggcggaucacuugaggucagg

SEQ ID NO: 628016 - RNA, 24 nt, Human
aggcggagguugcagugagccaag

SEQ ID NO: 628017 - RNA, 21 nt, Human
aggcugaggcaggcggaucac

SEQ ID NO: 628018 - RNA, 24 nt, Human
aggcugaggcaggcggaucacuug

SEQ ID NO: 628019 - RNA, 24 nt, Human
aggcuggccaacauggugaaaccc

SEQ ID NO: 628020 - RNA, 24 nt, Human
agguugaggcaggagaaucgguug

SEQ ID NO: 628021 - RNA, 23 nt, Human
aguggcucaugccuguaauccca

SEQ ID NO: 628022 - RNA, 24 nt, Human
aguggcucaugccuguaaucccag

SEQ ID NO: 628023 - RNA, 24 nt, Human
aguuuggaugacagagcaagacuc

SEQ ID NO: 628024 - RNA, 24 nt, Human
aucacuugaggucaggaguucaag

SEQ ID NO: 628025 - RNA, 19 nt, Human
augccuguaaucccagcac

SEQ ID NO: 628026 - RNA, 24 nt, Human
auugugccacugcacuccaguuug

SEQ ID NO: 628027 - RNA, 19 nt, Human
auuuguagaguuucucccc

SEQ ID NO: 628028 - RNA, 24 nt, Human
caacauggugaaacccugucucua

SEQ ID NO: 628029 - RNA, 24 nt, Human
caacuauuugggagguugaggcag

SEQ ID NO: 628030 - RNA, 24 nt, Human
caagaccaggcuggccaacauggu

SEQ ID NO: 628031 - RNA, 24 nt, Human
caagauugugccacugcacuccag

SEQ ID NO: 628032 - RNA, 19 nt, Human
caaguuucuuuuuccuccu

SEQ ID NO: 628033 - RNA, 18 nt, Human
cacaauagcaugcaacuu

SEQ ID NO: 628034 - RNA, 19 nt, Human
cacuaaaagauuucccaca

SEQ ID NO: 628035 - RNA, 18 nt, Human
cacugcacuccaguuugg

SEQ ID NO: 628036 - RNA, 19 nt, Human
cacugcacuccaguuugga

SEQ ID NO: 628037 - RNA, 19 nt, Human
cacugcacuccaguuugga

SEQ ID NO: 628038 - RNA, 22 nt, Human
cacugcacuccaguuuggauga

SEQ ID NO: 628039 - RNA, 23 nt, Human
cacuugaggucaggaguucaaga

SEQ ID NO: 628040 - RNA, 24 nt, Human
cagcacuuugggaggcugaggcag

SEQ ID NO: 628041 - RNA, 24 nt, Human
cagcacuuugggaggcugaggcag

SEQ ID NO: 628042 - RNA, 24 nt, Human
caggcggaucacuugaggucagga

SEQ ID NO: 628043 - RNA, 19 nt, Human
cauauacagcauggauaua

SEQ ID NO: 628044 - RNA, 19 nt, Human
caucacacuauucacaaua

SEQ ID NO: 628045 - RNA, 19 nt, Human
ccacugcacuccaguuugg

SEQ ID NO: 628046 - RNA, 21 nt, Human
ccacugcacuccaguuuggau

SEQ ID NO: 628047 - RNA, 24 nt, Human
ccacugcacuccaguuuggaugac

SEQ ID NO: 628048 - RNA, 20 nt, Human
ccuguaaucccagcacuuug

SEQ ID NO: 628049 - RNA, 22 nt, Human
ccuguaaucccagcacuuuggg

SEQ ID NO: 628050 - RNA, 24 nt, Human
cggaucacuugaggucaggaguuc

SEQ ID NO: 628051 - RNA, 27 nt, Human
cggaucacuugaggucaggaguucaag

SEQ ID NO: 628052 - RNA, 18 nt, Human
cucaaaaaaaaaaaaaaa

SEQ ID NO: 628053 - RNA, 24 nt, Human
cucaugccuguaaucccagcacuu

SEQ ID NO: 628054 - RNA, 22 nt, Human
cucucugcagguugagcuuuau

SEQ ID NO: 628055 - RNA, 19 nt, Human
cucugucucaaaaaaaaaa

SEQ ID NO: 628056 - RNA, 27 nt, Human
cugaaacugugaauaguaccgaaccug

SEQ ID NO: 628057 - RNA, 18 nt, Human
cugaccuucaccgccaag

SEQ ID NO: 628058 - RNA, 21 nt, Human
cuggccaacauggugaaaccc

SEQ ID NO: 628059 - RNA, 24 nt, Human
cuggccaacauggugaaacccugu

SEQ ID NO: 628060 - RNA, 26 nt, Human
cuggcugaaggcuuuuggagcucauu

SEQ ID NO: 628061 - RNA, 19 nt, Human
cuuuggggucauuauacaa

SEQ ID NO: 628062 - RNA, 22 nt, Human
gacaacugagacagcuaaggga

SEQ ID NO: 628063 - RNA, 24 nt, Human
gacagagcaagacucugucucaaa

SEQ ID NO: 628064 - RNA, 23 nt, Human
gagguugcagugagccaagauug

SEQ ID NO: 628065 - RNA, 19 nt, Human
gauaaagguuuuuccacau

SEQ ID NO: 628066 - RNA, 23 nt, Human
gaucacuugaggucaggaguuca

SEQ ID NO: 628067 - RNA, 24 nt, Human
gaucacuugaggucaggaguucaa

SEQ ID NO: 628068 - RNA, 24 nt, Human
gcacuccaguuuggaugacagagc

SEQ ID NO: 628069 - RNA, 22 nt, Human
gcaggagaaucgguugaaccca

SEQ ID NO: 628070 - RNA, 24 nt, Human
gccaacauggugaaacccugucuc

SEQ ID NO: 628071 - RNA, 22 nt, Human
gcuaugaggguugacuucuggc

SEQ ID NO: 628072 - RNA, 24 nt, Human
gcuggccaacauggugaaacccug

SEQ ID NO: 628073 - RNA, 22 nt, Human
ggagguugcagugagccaagau

SEQ ID NO: 628074 - RNA, 24 nt, Human
ggagguugcagugagccaagauug

SEQ ID NO: 628075 - RNA, 22 nt, Human
ggaucacuugaggucaggaguu

SEQ ID NO: 628076 - RNA, 23 nt, Human
ggaucacuugaggucaggaguuc

SEQ ID NO: 628077 - RNA, 18 nt, Human
gggcuugcuuuuggugga

SEQ ID NO: 628078 - RNA, 23 nt, Human
ggugcaguggcucaugccuguaa

SEQ ID NO: 628079 - RNA, 21 nt, Human
gugaaacccugucucuacuaa

SEQ ID NO: 628080 - RNA, 20 nt, Human
uaaaaauacaaauuagcugc

SEQ ID NO: 628081 - RNA, 22 nt, Human
uaaacacuuuuccacauucagu

SEQ ID NO: 628082 - RNA, 18 nt, Human
uaacaaccucagcauaca

SEQ ID NO: 628083 - RNA, 23 nt, Human
uaacacuaaaagauuucccacau

SEQ ID NO: 628084 - RNA, 24 nt, Human
uaacacuaaaagauuucccacauu

SEQ ID NO: 628085 - RNA, 18 nt, Human
uaaugcacaauaugacaa

SEQ ID NO: 628086 - RNA, 20 nt, Human
ucaaaaaaaaaaaaaaaaaa

SEQ ID NO: 628087 - RNA, 21 nt, Human
ucaaaaaaaaaaaaaaaaaaa

SEQ ID NO: 628088 - RNA, 24 nt, Human
ucaaaaaaaaaaaaaaaaaaagau

SEQ ID NO: 628089 - RNA, 25 nt, Human
ucaagccgggugcaguggcucaugc

SEQ ID NO: 628090 - RNA, 22 nt, Human
ucaugccuguaaucccagcacu

SEQ ID NO: 628091 - RNA, 24 nt, Human
uccaguuuggaugacagagcaaga

SEQ ID NO: 628092 - RNA, 24 nt, Human
ucucacagacacugcauuuauagg

SEQ ID NO: 628093 - RNA, 19 nt, Human
ucucuacuaaaaauacaaa

SEQ ID NO: 628094 - RNA, 18 nt, Human
ucucugcagguugagcuu

SEQ ID NO: 628095 - RNA, 26 nt, Human
ucugacaacugagacagcuaagggac

SEQ ID NO: 628096 - RNA, 23 nt, Human
ucugucucaaaaaaaaaaaaaaa

SEQ ID NO: 628097 - RNA, 25 nt, Human
ugacagcaaaacuagcacaaguuuc

SEQ ID NO: 628098 - RNA, 22 nt, Human
ugagacuaagugaggaagcugg

SEQ ID NO: 628099 - RNA, 24 nt, Human
ugagaguugauuuaacacuaaaag

SEQ ID NO: 628100 - RNA, 22 nt, Human
ugagccaagauugugccacugc

SEQ ID NO: 628101 - RNA, 20 nt, Human
ugaggcaggagaaucgguug

SEQ ID NO: 628102 - RNA, 24 nt, Human
ugaggcaggagaaucgguugaacc

SEQ ID NO: 628103 - RNA, 25 nt, Human
ugaggcaggagaaucgguugaaccc

SEQ ID NO: 628104 - RNA, 24 nt, Human
ugaggcaggcggaucacuugaggu

SEQ ID NO: 628105 - RNA, 26 nt, Human
ugaggcaggcggaucacuugagguca

SEQ ID NO: 628106 - RNA, 19 nt, Human
ugauuugcauccugagcag

SEQ ID NO: 628107 - RNA, 21 nt, Human
ugcaacuuaugcauuuauguu

SEQ ID NO: 628108 - RNA, 22 nt, Human
ugcacuguggccacaacuuuug

SEQ ID NO: 628109 - RNA, 23 nt, Human
ugccuguaaucccaacuauuugg

SEQ ID NO: 628110 - RNA, 24 nt, Human
ugccuguaaucccaacuauuuggg

SEQ ID NO: 628111 - RNA, 23 nt, Human
ugccuguaaucccagcacuuugg

SEQ ID NO: 628112 - RNA, 22 nt, Human
uggagaucuccuucugaggccu

SEQ ID NO: 628113 - RNA, 20 nt, Human
uggaugacagagcaagacuc

SEQ ID NO: 628114 - RNA, 21 nt, Human
uggcaugugccuguaauccca

SEQ ID NO: 628115 - RNA, 24 nt, Human
uggccaacauggugaaacccuguc

SEQ ID NO: 628116 - RNA, 24 nt, Human
uggcucaugccuguaaucccagca

SEQ ID NO: 628117 - RNA, 18 nt, Human
ugggaggcugaggcaggc

SEQ ID NO: 628118 - RNA, 20 nt, Human
ugggaggcugaggcaggcgg

SEQ ID NO: 628119 - RNA, 24 nt, Human
ugggaggcugaggcaggcggauca

SEQ ID NO: 628120 - RNA, 23 nt, Human
ugggagguugaggcaggagaauc

SEQ ID NO: 628121 - RNA, 22 nt, Human
ugggcggguagcauauacagca

SEQ ID NO: 628122 - RNA, 24 nt, Human
ugguggcaugugccuguaauccca

SEQ ID NO: 628123 - RNA, 23 nt, Human
uguagaguuucuccccaguuuga

SEQ ID NO: 628124 - RNA, 22 nt, Human
ugugccacugcacuccaguuug

SEQ ID NO: 628125 - RNA, 24 nt, Human
ugugccuguaaucccaacuauuug

SEQ ID NO: 628126 - RNA, 19 nt, Human
uuacacucaaugaauucuu

SEQ ID NO: 628127 - RNA, 24 nt, Human
uuagcugcguaugguggcaugugc

SEQ ID NO: 628128 - RNA, 22 nt, Human
uucaagccgggugcaguggcuc

SEQ ID NO: 628129 - RNA, 24 nt, Human
uuccuacugaaggcuuucucacag

SEQ ID NO: 628130 - RNA, 20 nt, Human
uuccuccuucacaauuucug

SEQ ID NO: 628131 - RNA, 23 nt, Human
uucugcucuggacaaaggaugga

SEQ ID NO: 628132 - RNA, 24 nt, Human
uugaacccaagaggcggagguugc

SEQ ID NO: 628133 - RNA, 20 nt, Human
uugacuuccuacugaaggcu

SEQ ID NO: 628134 - RNA, 22 nt, Human
uugcagugagccaagauugugc

SEQ ID NO: 628135 - RNA, 25 nt, Human
uugggaggcugaggcaggcggauca

SEQ ID NO: 628136 - RNA, 24 nt, Human
uuuaacacuaaaagauuucccaca

SEQ ID NO: 628137 - RNA, 19 nt, Human
uuuauagggucucucucca

SEQ ID NO: 628138 - RNA, 23 nt, Human
uuuauugaaugauuugaguagcu

SEQ ID NO: 628139 - RNA, 19 nt, Human
uuuguagaguuucucccca

SEQ ID NO: 628140 - RNA, 24 nt, Human
uuuuccacauucacugcauucaua

SEQ ID NO: 628141 - RNA, 23 nt, Human
aaaaaaacacaguaaaagauacc

SEQ ID NO: 628142 - RNA, 22 nt, Human
aaaaaacaaaaaaacaaacaaa

SEQ ID NO: 628143 - RNA, 25 nt, Human
aaaaaacaaaaaaacaaacaaacaa

SEQ ID NO: 628144 - RNA, 26 nt, Human
aaaaaacaaaaaaacaaacaaacaaa

SEQ ID NO: 628145 - RNA, 26 nt, Human
aaaaacaaacaaacaaaaaaacacag

SEQ ID NO: 628146 - RNA, 23 nt, Human
aaaacaaaaaaacaaacaaacaa

SEQ ID NO: 628147 - RNA, 22 nt, Human
aaaacaaacaaacaaaaaaaca

SEQ ID NO: 628148 - RNA, 23 nt, Human
aaacaaaaaaacacaguaaaaga

SEQ ID NO: 628149 - RNA, 21 nt, Human
aaacaaacaaaaaaacacagu

SEQ ID NO: 628150 - RNA, 21 nt, Human
aaacaaacaaacaaaaaaaca

SEQ ID NO: 628151 - RNA, 18 nt, Human
aaagauaccacccagcua

SEQ ID NO: 628152 - RNA, 21 nt, Human
aacaaaaaaacaaacaaacaa

SEQ ID NO: 628153 - RNA, 22 nt, Human
aacaaaaaaacacaguaaaaga

SEQ ID NO: 628154 - RNA, 22 nt, Human
aacacaguaaaagauaccaccc

SEQ ID NO: 628155 - RNA, 22 nt, Human
aaccucagcaagccccaagcag

SEQ ID NO: 628156 - RNA, 21 nt, Human
aagacccucucaccguccacc

SEQ ID NO: 628157 - RNA, 19 nt, Human
aagggggggccacaggguc

SEQ ID NO: 628158 - RNA, 21 nt, Human
aauccaaaggacucugacagg

SEQ ID NO: 628159 - RNA, 23 nt, Human
acaaaaaacaaaaaaacaaacaa

SEQ ID NO: 628160 - RNA, 21 nt, Human
acagcuucagaucaaaaagcc

SEQ ID NO: 628161 - RNA, 23 nt, Human
accucagcaagccccaagcagua

SEQ ID NO: 628162 - RNA, 23 nt, Human
accuuccuuccuucuuuggucuu

SEQ ID NO: 628163 - RNA, 22 nt, Human
agaaaagugagucaaggccaga

SEQ ID NO: 628164 - RNA, 18 nt, Human
agaaagacgaagaggcag

SEQ ID NO: 628165 - RNA, 24 nt, Human
agaaagacgaagaggcaggagagc

SEQ ID NO: 628166 - RNA, 19 nt, Human
agccagaaaagugagucaa

SEQ ID NO: 628167 - RNA, 23 nt, Human
agugcuccuccaaauugguguau

SEQ ID NO: 628168 - RNA, 21 nt, Human
auaaaagggguuuauguaaca

SEQ ID NO: 628169 - RNA, 22 nt, Human
auuuaagacccucucaccgucc

SEQ ID NO: 628170 - RNA, 23 nt, Human
caaaaaacaaaaaaacaaacaaa

SEQ ID NO: 628171 - RNA, 20 nt, Human
caaacaaacaaaaaaacaca

SEQ ID NO: 628172 - RNA, 21 nt, Human
caagccccaagcaguagaagg

SEQ ID NO: 628173 - RNA, 24 nt, Human
caaggccagacucacuaugggguc

SEQ ID NO: 628174 - RNA, 23 nt, Human
caccccaaacagcuucagaucaa

SEQ ID NO: 628175 - RNA, 19 nt, Human
cacugccuucagccuucac

SEQ ID NO: 628176 - RNA, 23 nt, Human
cagaaaagugagucaaggccaga

SEQ ID NO: 628177 - RNA, 22 nt, Human
cagauaucccccaucuuguccu

SEQ ID NO: 628178 - RNA, 19 nt, Human
cagauccccugcuacugug

SEQ ID NO: 628179 - RNA, 18 nt, Human
cagcuagcagaaaggacu

SEQ ID NO: 628180 - RNA, 19 nt, Human
caguagaaugaggcuuccc

SEQ ID NO: 628181 - RNA, 24 nt, Human
cagugcuccuccaaauugguguau

SEQ ID NO: 628182 - RNA, 21 nt, Human
ccagaaaagugagucaaggcc

SEQ ID NO: 628183 - RNA, 18 nt, Human
ccaucuuguccucuugca

SEQ ID NO: 628184 - RNA, 23 nt, Human
ccccaaacagcuucagaucaaaa

SEQ ID NO: 628185 - RNA, 19 nt, Human
ccucagauaucccccaucu

SEQ ID NO: 628186 - RNA, 20 nt, Human
ccuuccuuccuucuuugguc

SEQ ID NO: 628187 - RNA, 21 nt, Human
cucaaccucagcaagccccaa

SEQ ID NO: 628188 - RNA, 27 nt, Human
cugacgguacugauaauccaaaggacu

SEQ ID NO: 628189 - RNA, 19 nt, Human
cugccuugcugugaugccc

SEQ ID NO: 628190 - RNA, 19 nt, Human
cuucagaucaaaaagccug

SEQ ID NO: 628191 - RNA, 24 nt, Human
gcaguagaaugaggcuucccugga

SEQ ID NO: 628192 - RNA, 25 nt, Human
gccuucacuuacucagaaauaacuc

SEQ ID NO: 628193 - RNA, 20 nt, Human
ggcuaggcagaggggccagc

SEQ ID NO: 628194 - RNA, 22 nt, Human
uaaaagauaccacccagcuagc

SEQ ID NO: 628195 - RNA, 19 nt, Human
uaaaggguggagaacagca

SEQ ID NO: 628196 - RNA, 23 nt, Human
uaacaaaaaacaaaaaaacaaac

SEQ ID NO: 628197 - RNA, 18 nt, Human
uaucucaaccucagcaag

SEQ ID NO: 628198 - RNA, 23 nt, Human
ucaaggccagacucacuaugggg

SEQ ID NO: 628199 - RNA, 23 nt, Human
ucaccccaaacagcuucagauca

SEQ ID NO: 628200 - RNA, 18 nt, Human
ucagaaagacgaagaggc

SEQ ID NO: 628201 - RNA, 19 nt, Human
ucagaaagacgaagaggca

SEQ ID NO: 628202 - RNA, 20 nt, Human
ucagaaagacgaagaggcag

SEQ ID NO: 628203 - RNA, 22 nt, Human
ucagagucaguguagguaaaga

SEQ ID NO: 628204 - RNA, 23 nt, Human
ucaggaucuccugacgguacuga

SEQ ID NO: 628205 - RNA, 20 nt, Human
ucauaucucaaccucagcaa

SEQ ID NO: 628206 - RNA, 18 nt, Human
uccaaaggacucugacag

SEQ ID NO: 628207 - RNA, 18 nt, Human
ucucugacagugcuccuc

SEQ ID NO: 628208 - RNA, 21 nt, Human
ucucugacagugcuccuccaa

SEQ ID NO: 628209 - RNA, 23 nt, Human
ucugacaggcuguuucauuuugg

SEQ ID NO: 628210 - RNA, 23 nt, Human
ucuugcacugugggccagggcug

SEQ ID NO: 628211 - RNA, 20 nt, Human
ucuuggaagaugaaaggcuc

SEQ ID NO: 628212 - RNA, 19 nt, Human
ucuuuggucuuggaagaug

SEQ ID NO: 628213 - RNA, 19 nt, Human
ugcccaucugacaguggcu

SEQ ID NO: 628214 - RNA, 19 nt, Human
uggaaagaggcugagacuc

SEQ ID NO: 628215 - RNA, 21 nt, Human
uggaaagaggcugagacucac

SEQ ID NO: 628216 - RNA, 24 nt, Human
uggagaacagcagauccccugcua

SEQ ID NO: 628217 - RNA, 19 nt, Human
uggccucagauauccccca

SEQ ID NO: 628218 - RNA, 25 nt, Human
uggggucaccccaaacagcuucaga

SEQ ID NO: 628219 - RNA, 18 nt, Human
uucaggaucuccugacgg

SEQ ID NO: 628220 - RNA, 25 nt, Human
uuuaagacccucucaccguccaccu

SEQ ID NO: 628221 - RNA, 21 nt, Human
cggcgaaggcgacacucaggc

SEQ ID NO: 628222 - RNA, 23 nt, Human
gcggcaguggugagucucggcac

SEQ ID NO: 628223 - RNA, 18 nt, Human
guuuuuuuuuuuuccuuu

SEQ ID NO: 628224 - RNA, 19 nt, Human
uaaucugcuuacaguauga

SEQ ID NO: 628225 - RNA, 21 nt, Human
ucaggcccagcggccgcggca

SEQ ID NO: 628226 - RNA, 20 nt, Human
ucuccaggauuuucaauaug

SEQ ID NO: 628227 - RNA, 24 nt, Human
ugagagguagaaacuuuuugcuca

SEQ ID NO: 628228 - RNA, 24 nt, Human
ugucccuuuuuuaaguagucaaga

SEQ ID NO: 628229 - RNA, 18 nt, Human
uguuuuuuuuuuuuccuu

SEQ ID NO: 628230 - RNA, 20 nt, Human
uuaggcaaaggagcaaauag

SEQ ID NO: 628231 - RNA, 20 nt, Human
uuuuuuuuuuuuuuuuuugg

SEQ ID NO: 628232 - RNA, 24 nt, Human
uuuuuuuuuuuuuuuuuuguuuuu

SEQ ID NO: 628233 - RNA, 25 nt, Human
acccccagcccuugcacaaaaccca

SEQ ID NO: 628234 - RNA, 21 nt, Human
agacccccagcccuugcacaa

SEQ ID NO: 628235 - RNA, 22 nt, Human
aggcaggagacccccagcccuu

SEQ ID NO: 628236 - RNA, 22 nt, Human
cacaaaacccacucccuuggau

SEQ ID NO: 628237 - RNA, 23 nt, Human
caccaggagaggcaggagacccc

SEQ ID NO: 628238 - RNA, 18 nt, Human
caccggcgacaccaggag

SEQ ID NO: 628239 - RNA, 23 nt, Human
cccccagcccuugcacaaaaccc

SEQ ID NO: 628240 - RNA, 25 nt, Human
cccccagcccuugcacaaaacccac

SEQ ID NO: 628241 - RNA, 21 nt, Human
cccgcagagaccucacaugcc

SEQ ID NO: 628242 - RNA, 18 nt, Human
ccuggcccugcggcgugu

SEQ ID NO: 628243 - RNA, 21 nt, Human
ccuugcacaaaacccacuccc

SEQ ID NO: 628244 - RNA, 24 nt, Human
ccuugcacaaaacccacucccuug

SEQ ID NO: 628245 - RNA, 22 nt, Human
cugcggcguguuccucagaggc

SEQ ID NO: 628246 - RNA, 22 nt, Human
cugcguucgugccuccauuugc

SEQ ID NO: 628247 - RNA, 21 nt, Human
gacaccaggagaggcaggaga

SEQ ID NO: 628248 - RNA, 24 nt, Human
uauugcaaaaaaaaaacaaaaccc

SEQ ID NO: 628249 - RNA, 21 nt, Human
ucgugccuccauuugccagaa

SEQ ID NO: 628250 - RNA, 21 nt, Human
ugcaaaaaaaaaacaaaaccc

SEQ ID NO: 628251 - RNA, 23 nt, Human
ugcaaaaaaaaaacaaaacccau

SEQ ID NO: 628252 - RNA, 20 nt, Human
uggccccugcguucgugccu

SEQ ID NO: 628253 - RNA, 21 nt, Human
uuugccagaaaaugagccacc

SEQ ID NO: 628254 - RNA, 23 nt, Human
uuugccagaaaaugagccaccgg

SEQ ID NO: 628255 - RNA, 24 nt, Human
aaagugcugggauuacaggcauga

SEQ ID NO: 628256 - RNA, 22 nt, Human
aagagcucgguccuggccaggc

SEQ ID NO: 628257 - RNA, 19 nt, Human
aagugcugggauuacaggc

SEQ ID NO: 628258 - RNA, 21 nt, Human
aagugcugggauuacaggcau

SEQ ID NO: 628259 - RNA, 26 nt, Human
aagugcugggauuacaggcaugagcc

SEQ ID NO: 628260 - RNA, 24 nt, Human
accauguugggcaggcuggucucg

SEQ ID NO: 628261 - RNA, 20 nt, Human
agaggggugggggucccaca

SEQ ID NO: 628262 - RNA, 23 nt, Human
agagggugggaggacccagggcc

SEQ ID NO: 628263 - RNA, 22 nt, Human
agagugggcugcaccaggccug

SEQ ID NO: 628264 - RNA, 19 nt, Human
agcacaggagcagccacca

SEQ ID NO: 628265 - RNA, 20 nt, Human
aggccgacugccuccaggca

SEQ ID NO: 628266 - RNA, 23 nt, Human
aggggugggagagugggcggggc

SEQ ID NO: 628267 - RNA, 22 nt, Human
agggugggaggacccagggcug

SEQ ID NO: 628268 - RNA, 28 nt, Human
agggugggaggacccagggcugggaggg

SEQ ID NO: 628269 - RNA, 18 nt, Human
agugcagcuucaggggug

SEQ ID NO: 628270 - RNA, 19 nt, Human
agugccugucucugaagga

SEQ ID NO: 628271 - RNA, 24 nt, Human
auuuuuaguagagacagguuucac

SEQ ID NO: 628272 - RNA, 24 nt, Human
caaagugcugggauuacaggcaug

SEQ ID NO: 628273 - RNA, 24 nt, Human
caccauguugggcaggcuggucuc

SEQ ID NO: 628274 - RNA, 21 nt, Human
caccgcacacagggccugggc

SEQ ID NO: 628275 - RNA, 22 nt, Human
caggaggaccugggggcugggg

SEQ ID NO: 628276 - RNA, 21 nt, Human
caggccgacugccuccaggca

SEQ ID NO: 628277 - RNA, 24 nt, Human
cagggcccucccagagcaguccga

SEQ ID NO: 628278 - RNA, 27 nt, Human
cagggcugggaggggaguggucaggag

SEQ ID NO: 628279 - RNA, 23 nt, Human
ccaaagugcugggauuacaggca

SEQ ID NO: 628280 - RNA, 24 nt, Human
ccaaagugcugggauuacaggcau

SEQ ID NO: 628281 - RNA, 20 nt, Human
ccagugccugucucugaagg

SEQ ID NO: 628282 - RNA, 26 nt, Human
ccaguggcuuggcucagagucugggg

SEQ ID NO: 628283 - RNA, 24 nt, Human
cccaaagugcugggauuacaggca

SEQ ID NO: 628284 - RNA, 22 nt, Human
cccaggaccuggggggugcagg

SEQ ID NO: 628285 - RNA, 19 nt, Human
ccccccgccccaaggaagc

SEQ ID NO: 628286 - RNA, 22 nt, Human
cccuggaggcgcuccugggggc

SEQ ID NO: 628287 - RNA, 21 nt, Human
ccugaccucgugauucgccug

SEQ ID NO: 628288 - RNA, 19 nt, Human
ccugcagccccagcuguag

SEQ ID NO: 628289 - RNA, 24 nt, Human
ccugccucggccucccaaagugcu

SEQ ID NO: 628290 - RNA, 24 nt, Human
cuccugaccucgugauucgccugc

SEQ ID NO: 628291 - RNA, 23 nt, Human
cuggaggcgcuccugggggcugg

SEQ ID NO: 628292 - RNA, 24 nt, Human
cugggggcugggggagcuccuagg

SEQ ID NO: 628293 - RNA, 26 nt, Human
cuggggggagcuaggugggugggagu

SEQ ID NO: 628294 - RNA, 25 nt, Human
cuucaggggcuggggugcccucccc

SEQ ID NO: 628295 - RNA, 21 nt, Human
gaauggaguggggucugcagg

SEQ ID NO: 628296 - RNA, 22 nt, Human
gaccucgugauucgccugccuc

SEQ ID NO: 628297 - RNA, 24 nt, Human
gaccucgugauucgccugccucgg

SEQ ID NO: 628298 - RNA, 22 nt, Human
gaccugggggcugggggagcuc

SEQ ID NO: 628299 - RNA, 21 nt, Human
gaccuggggggugcagggcuc

SEQ ID NO: 628300 - RNA, 22 nt, Human
gacugccuccaggcacagcugc

SEQ ID NO: 628301 - RNA, 23 nt, Human
gagcaguccgagcuguggggugg

SEQ ID NO: 628302 - RNA, 18 nt, Human
gaggaccugggggcuggg

SEQ ID NO: 628303 - RNA, 18 nt, Human
gauuacaggcaugagcca

SEQ ID NO: 628304 - RNA, 22 nt, Human
gauuacaggcaugagccaccgc

SEQ ID NO: 628305 - RNA, 23 nt, Human
gauuacaggcaugagccaccgca

SEQ ID NO: 628306 - RNA, 26 nt, Human
gcaaacagcaggaagagccgguaccc

SEQ ID NO: 628307 - RNA, 26 nt, Human
gcagcuucagggguggggggaacgcc

SEQ ID NO: 628308 - RNA, 20 nt, Human
gcagugcugcuugucuucag

SEQ ID NO: 628309 - RNA, 20 nt, Human
gccuugccucccugcaccag

SEQ ID NO: 628310 - RNA, 25 nt, Human
gcgccagugccugucucugaaggag

SEQ ID NO: 628311 - RNA, 24 nt, Human
gcggcggccugcgggggaugucca

SEQ ID NO: 628312 - RNA, 23 nt, Human
gcuggucucgaacuccugaccuc

SEQ ID NO: 628313 - RNA, 21 nt, Human
ggaagccucuggcgccagugc

SEQ ID NO: 628314 - RNA, 22 nt, Human
ggauuacaggcaugagccaccg

SEQ ID NO: 628315 - RNA, 21 nt, Human
ggccuugccucccugcaccag

SEQ ID NO: 628316 - RNA, 24 nt, Human
ggcuggucucgaacuccugaccuc

SEQ ID NO: 628317 - RNA, 20 nt, Human
gggcagcaggcgguaccucu

SEQ ID NO: 628318 - RNA, 18 nt, Human
gggcggggcccuggaggc

SEQ ID NO: 628319 - RNA, 19 nt, Human
gggcgugguguccagggag

SEQ ID NO: 628320 - RNA, 21 nt, Human
gggcugggaggggagugguca

SEQ ID NO: 628321 - RNA, 21 nt, Human
ggggagcuccuagggccuggg

SEQ ID NO: 628322 - RNA, 21 nt, Human
ggggcugggggagcuccuagg

SEQ ID NO: 628323 - RNA, 23 nt, Human
ggggcugggggagcuccuagggc

SEQ ID NO: 628324 - RNA, 18 nt, Human
gggggcccuggggggagc

SEQ ID NO: 628325 - RNA, 19 nt, Human
ggggugagggugggagucc

SEQ ID NO: 628326 - RNA, 21 nt, Human
ggggugcccuccccccgcccc

SEQ ID NO: 628327 - RNA, 22 nt, Human
ggggugggggugagggugggag

SEQ ID NO: 628328 - RNA, 19 nt, Human
ggucucgaacuccugaccu

SEQ ID NO: 628329 - RNA, 23 nt, Human
gguggggaccuccccaggggagc

SEQ ID NO: 628330 - RNA, 28 nt, Human
gugcagcuucagggguggggggaacgcc

SEQ ID NO: 628331 - RNA, 19 nt, Human
gugggaggacccagggcug

SEQ ID NO: 628332 - RNA, 19 nt, Human
gugggggugggggugaggg

SEQ ID NO: 628333 - RNA, 22 nt, Human
uacaggcaugagccaccgcacc

SEQ ID NO: 628334 - RNA, 21 nt, Human
uagagacagguuucaccaugu

SEQ ID NO: 628335 - RNA, 23 nt, Human
uaguagagacagguuucaccaug

SEQ ID NO: 628336 - RNA, 20 nt, Human
uccauuuuugccacugcagu

SEQ ID NO: 628337 - RNA, 24 nt, Human
ucccaaagugcugggauuacaggc

SEQ ID NO: 628338 - RNA, 18 nt, Human
ucggccucccaaagugcu

SEQ ID NO: 628339 - RNA, 19 nt, Human
ucgguccuggccaggcgcu

SEQ ID NO: 628340 - RNA, 19 nt, Human
ucucgaacuccugaccucg

SEQ ID NO: 628341 - RNA, 20 nt, Human
ugacgccaggcgggggcagc

SEQ ID NO: 628342 - RNA, 23 nt, Human
ugaggacacccaccugcgccugu

SEQ ID NO: 628343 - RNA, 24 nt, Human
ugcagccccagcuguaggugcugg

SEQ ID NO: 628344 - RNA, 25 nt, Human
ugcagugcugcuugucuucaggggc

SEQ ID NO: 628345 - RNA, 26 nt, Human
ugcagugcugcuugucuucaggggcu

SEQ ID NO: 628346 - RNA, 21 nt, Human
ugccucggccucccaaagugc

SEQ ID NO: 628347 - RNA, 24 nt, Human
ugccucggccucccaaagugcugg

SEQ ID NO: 628348 - RNA, 25 nt, Human
uggcacugcaggccgacugccucca

SEQ ID NO: 628349 - RNA, 23 nt, Human
uggcagggacugagcugcagaca

SEQ ID NO: 628350 - RNA, 21 nt, Human
uggcuuggcucagagucuggc

SEQ ID NO: 628351 - RNA, 19 nt, Human
ugggagagugggcggggcc

SEQ ID NO: 628352 - RNA, 18 nt, Human
ugggaggacccagggcug

SEQ ID NO: 628353 - RNA, 24 nt, Human
ugggaggggaguggucaggaggaa

SEQ ID NO: 628354 - RNA, 18 nt, Human
ugggauuacaggcaugag

SEQ ID NO: 628355 - RNA, 19 nt, Human
ugggauuacaggcaugagc

SEQ ID NO: 628356 - RNA, 21 nt, Human
ugggauuacaggcaugagcca

SEQ ID NO: 628357 - RNA, 22 nt, Human
ugggauuacaggcaugagccac

SEQ ID NO: 628358 - RNA, 23 nt, Human
ugggauuacaggcaugagccacc

SEQ ID NO: 628359 - RNA, 24 nt, Human
ugggauuacaggcaugagccaccg

SEQ ID NO: 628360 - RNA, 24 nt, Human
ugggauuacaggcaugagccaccg

SEQ ID NO: 628361 - RNA, 26 nt, Human
ugggauuacaggcaugagccaccgca

SEQ ID NO: 628362 - RNA, 24 nt, Human
ugggcaggcuggucucgaacuccu

SEQ ID NO: 628363 - RNA, 19 nt, Human
uggggggcccuggggggag

SEQ ID NO: 628364 - RNA, 21 nt, Human
ugggugggagugcagcuucag

SEQ ID NO: 628365 - RNA, 23 nt, Human
uuaguagagacagguuucaccau

SEQ ID NO: 628366 - RNA, 24 nt, Human
uuaguagagacagguuucaccaug

SEQ ID NO: 628367 - RNA, 22 nt, Human
uugcagccacccguugucuccc

SEQ ID NO: 628368 - RNA, 22 nt, Human
uugucuucaggggcuggggugc

SEQ ID NO: 628369 - RNA, 24 nt, Human
uuuaguagagacagguuucaccau

SEQ ID NO: 628370 - RNA, 21 nt, Human
uuucaccauguugggcaggcu

SEQ ID NO: 628371 - RNA, 22 nt, Human
uuuuguauuuuuaguagagaca

SEQ ID NO: 628372 - RNA, 21 nt, Human
uuuuuguauuuuuaguagaga

SEQ ID NO: 628373 - RNA, 21 nt, Human
uuuuuuguauuuuuaguagag

SEQ ID NO: 628374 - RNA, 22 nt, Human
uuuuuuuuuuuuuuuuguuuuu

SEQ ID NO: 628375 - RNA, 24 nt, Human
aaaaugaaacacauuaguuacaaa

SEQ ID NO: 628376 - RNA, 20 nt, Human
aaacaauaucuagcacugca

SEQ ID NO: 628377 - RNA, 24 nt, Human
aaacaauaucuagcacugcaaccc

SEQ ID NO: 628378 - RNA, 21 nt, Human
aacacauuaguuacaaaaacc

SEQ ID NO: 628379 - RNA, 23 nt, Human
acagcaaauaaaaccauuuaaga

SEQ ID NO: 628380 - RNA, 24 nt, Human
acuggcucugcauuuauuggucuu

SEQ ID NO: 628381 - RNA, 20 nt, Human
agaaagcugauuuuuguagu

SEQ ID NO: 628382 - RNA, 23 nt, Human
aggcaucuuguuuaaaaugaaaa

SEQ ID NO: 628383 - RNA, 18 nt, Human
auuuguuaaaauagacuu

SEQ ID NO: 628384 - RNA, 21 nt, Human
caacccaaagcuaacagacaa

SEQ ID NO: 628385 - RNA, 20 nt, Human
cagcaaaauauaaaaaauga

SEQ ID NO: 628386 - RNA, 25 nt, Human
ccaacuaaguaaacauguaaaauua

SEQ ID NO: 628387 - RNA, 21 nt, Human
ccacugugacauauuucagca

SEQ ID NO: 628388 - RNA, 18 nt, Human
cccaaagcuaacagacaa

SEQ ID NO: 628389 - RNA, 19 nt, Human
ccugugcuugaaacacugg

SEQ ID NO: 628390 - RNA, 20 nt, Human
ccuuuaaaacagagcauaau

SEQ ID NO: 628391 - RNA, 21 nt, Human
gccugcugguauuuccugugc

SEQ ID NO: 628392 - RNA, 19 nt, Human
gcuccaaauagauaccgug

SEQ ID NO: 628393 - RNA, 19 nt, Human
uaaaaaaugaaacacauua

SEQ ID NO: 628394 - RNA, 20 nt, Human
uaacagcaaauaaaaccauu

SEQ ID NO: 628395 - RNA, 24 nt, Human
uaggaaaaaauguuuuauguagug

SEQ ID NO: 628396 - RNA, 18 nt, Human
uaguguuguuuguguaac

SEQ ID NO: 628397 - RNA, 24 nt, Human
uauuggcaucauccauauccaggg

SEQ ID NO: 628398 - RNA, 23 nt, Human
uauuuguuaaaauagacuuauuu

SEQ ID NO: 628399 - RNA, 24 nt, Human
ucacauguucacaaguuuuccaaa

SEQ ID NO: 628400 - RNA, 22 nt, Human
ugaaaacuuuccaaguuguaga

SEQ ID NO: 628401 - RNA, 24 nt, Human
ugaaacacauuaguuacaaaaacc

SEQ ID NO: 628402 - RNA, 23 nt, Human
uguaguguaguauuuacaaauac

SEQ ID NO: 628403 - RNA, 22 nt, Human
uguucacauguguauucacaug

SEQ ID NO: 628404 - RNA, 21 nt, Human
uucaaauguaagacuguucac

SEQ ID NO: 628405 - RNA, 24 nt, Human
uucagcaaaauauaaaaaaugaaa

SEQ ID NO: 628406 - RNA, 28 nt, Human
uuuaaaacaauaucuagcacugcaaccc

SEQ ID NO: 628407 - RNA, 22 nt, Human
uuuguaguguaguauuuacaaa

SEQ ID NO: 628408 - RNA, 23 nt, Human
uuuuugcuccaacuaaguaaaca

SEQ ID NO: 628409 - RNA, 18 nt, Human
uuuuuugcuugguuuuga

SEQ ID NO: 628410 - RNA, 21 nt, Human
aaaaaaaaguacauaggaaaa

SEQ ID NO: 628411 - RNA, 22 nt, Human
aacaauauaauguauauauuuu

SEQ ID NO: 628412 - RNA, 19 nt, Human
aauucugaacacuugguca

SEQ ID NO: 628413 - RNA, 20 nt, Human
acaaugcagcaaauagauac

SEQ ID NO: 628414 - RNA, 28 nt, Human
augaacauugguucuuuaaacacugaca

SEQ ID NO: 628415 - RNA, 19 nt, Human
caaaauccugaaacaauau

SEQ ID NO: 628416 - RNA, 24 nt, Human
caaaggcacaugaaaaugccaguc

SEQ ID NO: 628417 - RNA, 19 nt, Human
caaauacauggcucugagg

SEQ ID NO: 628418 - RNA, 23 nt, Human
ccaacuuucacgcuaguccccug

SEQ ID NO: 628419 - RNA, 20 nt, Human
cugcugccgcagccagcggc

SEQ ID NO: 628420 - RNA, 25 nt, Human
gcuaguccccugcugccgcagccag

SEQ ID NO: 628421 - RNA, 20 nt, Human
gggagcucagggcguccaca

SEQ ID NO: 628422 - RNA, 22 nt, Human
guccccugcugccgcagccagc

SEQ ID NO: 628423 - RNA, 18 nt, Human
uaacccagaaggugauau

SEQ ID NO: 628424 - RNA, 19 nt, Human
uaauuauaacauuuuccuu

SEQ ID NO: 628425 - RNA, 18 nt, Human
uacaaagaugaacauugg

SEQ ID NO: 628426 - RNA, 18 nt, Human
uacaaugcagcaaauaga

SEQ ID NO: 628427 - RNA, 21 nt, Human
ucaaauacauggcucugaggg

SEQ ID NO: 628428 - RNA, 21 nt, Human
uccccugcugccgcagccagc

SEQ ID NO: 628429 - RNA, 24 nt, Human
ucuuuucuuuuuuuuagccaacuu

SEQ ID NO: 628430 - RNA, 21 nt, Human
ugaacacuuggucaaaggcac

SEQ ID NO: 628431 - RNA, 22 nt, Human
ugaacacuuggucaaaggcaca

SEQ ID NO: 628432 - RNA, 22 nt, Human
ugauugaagcauucucaaauac

SEQ ID NO: 628433 - RNA, 24 nt, Human
ugcagcaaauagauacauuaauua

SEQ ID NO: 628434 - RNA, 21 nt, Human
uguauauauuuuaagccacau

SEQ ID NO: 628435 - RNA, 23 nt, Human
uguauauauuuuaagccacauuu

SEQ ID NO: 628436 - RNA, 23 nt, Human
uuuuuuuuuuuuuuuuuuuacgg

SEQ ID NO: 628437 - RNA, 23 nt, Human
aaacaagccauuuaagacuugga

SEQ ID NO: 628438 - RNA, 20 nt, Human
aacugcguuuucucuuccug

SEQ ID NO: 628439 - RNA, 21 nt, Human
aagcaaaauaaguuaguacau

SEQ ID NO: 628440 - RNA, 23 nt, Human
acagugaacaggcuucaacuaaa

SEQ ID NO: 628441 - RNA, 19 nt, Human
accaaggagcaaaacgacg

SEQ ID NO: 628442 - RNA, 21 nt, Human
acggcaaaaagcaaagcaagg

SEQ ID NO: 628443 - RNA, 21 nt, Human
agaccgggccccggcugggcc

SEQ ID NO: 628444 - RNA, 19 nt, Human
agcaaggagauaacaugcc

SEQ ID NO: 628445 - RNA, 20 nt, Human
aggcccggggagccgggccc

SEQ ID NO: 628446 - RNA, 20 nt, Human
aggcuucaacuaaauauagu

SEQ ID NO: 628447 - RNA, 21 nt, Human
aggcuucaacuaaauauagug

SEQ ID NO: 628448 - RNA, 25 nt, Human
aucaaauaccaaggagcaaaacgac

SEQ ID NO: 628449 - RNA, 22 nt, Human
augagcaugcuuucuauacccc

SEQ ID NO: 628450 - RNA, 22 nt, Human
auuuacuggaaccaggucucca

SEQ ID NO: 628451 - RNA, 23 nt, Human
caaaaagcaaagcaaggagauaa

SEQ ID NO: 628452 - RNA, 23 nt, Human
cacaugggacacauuggcacacg

SEQ ID NO: 628453 - RNA, 21 nt, Human
cacuauauauaauaagcaaaa

SEQ ID NO: 628454 - RNA, 22 nt, Human
cacuauauauaauaagcaaaau

SEQ ID NO: 628455 - RNA, 22 nt, Human
cacuggugggacauuuacugga

SEQ ID NO: 628456 - RNA, 20 nt, Human
cagaauagagacugucacag

SEQ ID NO: 628457 - RNA, 22 nt, Human
caugggacacauuggcacacgg

SEQ ID NO: 628458 - RNA, 19 nt, Human
ccacuaggauaagaacggg

SEQ ID NO: 628459 - RNA, 20 nt, Human
ccacuaggauaagaacgggu

SEQ ID NO: 628460 - RNA, 20 nt, Human
ccccggcugggccgggugcc

SEQ ID NO: 628461 - RNA, 25 nt, Human
ccgcccgccuuagcccggcuuggac

SEQ ID NO: 628462 - RNA, 21 nt, Human
ccggugcggacgggaccccgc

SEQ ID NO: 628463 - RNA, 23 nt, Human
cggcaaaaagcaaagcaaggaga

SEQ ID NO: 628464 - RNA, 19 nt, Human
cggcugcuggggcugagga

SEQ ID NO: 628465 - RNA, 22 nt, Human
cggcugggccgggugccggugc

SEQ ID NO: 628466 - RNA, 22 nt, Human
cgggcggcugcuggggcugagg

SEQ ID NO: 628467 - RNA, 18 nt, Human
cuggggcugaggacaaaa

SEQ ID NO: 628468 - RNA, 18 nt, Human
cugucuugaaagugcaaa

SEQ ID NO: 628469 - RNA, 19 nt, Human
gaauagagacugucacaga

SEQ ID NO: 628470 - RNA, 19 nt, Human
gccagccgggcggcugcug

SEQ ID NO: 628471 - RNA, 18 nt, Human
gcgcucaggcccggggag

SEQ ID NO: 628472 - RNA, 20 nt, Human
gggacacauuggcacacggu

SEQ ID NO: 628473 - RNA, 22 nt, Human
uaaaacggcaaaaagcaaagca

SEQ ID NO: 628474 - RNA, 22 nt, Human
uaaagagcuauucaagacuucu

SEQ ID NO: 628475 - RNA, 21 nt, Human
uaacaugccagccuuagagaa

SEQ ID NO: 628476 - RNA, 21 nt, Human
uaauaagcaaaauaaguuagu

SEQ ID NO: 628477 - RNA, 21 nt, Human
uaccaaggagcaaaacgacag

SEQ ID NO: 628478 - RNA, 21 nt, Human
uaguacauguaaacuuaugca

SEQ ID NO: 628479 - RNA, 24 nt, Human
ucaugagcaugcuuucuauacccc

SEQ ID NO: 628480 - RNA, 23 nt, Human
uccugaaccacuaggauaagaac

SEQ ID NO: 628481 - RNA, 19 nt, Human
ugcagccagccgggcggcu

SEQ ID NO: 628482 - RNA, 19 nt, Human
ugcccucggccccucggcc

SEQ ID NO: 628483 - RNA, 18 nt, Human
ugcgcuccggugcccucg

SEQ ID NO: 628484 - RNA, 19 nt, Human
uggcacacgguaacaacaa

SEQ ID NO: 628485 - RNA, 19 nt, Human
uuuuuuuuuuuuaugggag

SEQ ID NO: 628486 - RNA, 24 nt, Human
uuuuuuuuuuuuuuuuuuuauggg

SEQ ID NO: 628487 - RNA, 20 nt, Human
aaaaagaaccuucccauucc

SEQ ID NO: 628488 - RNA, 18 nt, Human
aaagaaccuucccauucc

SEQ ID NO: 628489 - RNA, 19 nt, Human
aacaaagucuuuugucaag

SEQ ID NO: 628490 - RNA, 25 nt, Human
aagaaccuucccauucccaacucaa

SEQ ID NO: 628491 - RNA, 20 nt, Human
aagcaccacaguauugcagc

SEQ ID NO: 628492 - RNA, 22 nt, Human
aagcaccacaguauugcagcca

SEQ ID NO: 628493 - RNA, 24 nt, Human
aauaggccauccaugccacaaaua

SEQ ID NO: 628494 - RNA, 23 nt, Human
acacacacacacacacaugcaga

SEQ ID NO: 628495 - RNA, 29 nt, Human
acacacacacacacacaugcagacacaca

SEQ ID NO: 628496 - RNA, 26 nt, Human
acacacacacaugcagacacacacaa

SEQ ID NO: 628497 - RNA, 22 nt, Human
acacaugcagacacacacaaac

SEQ ID NO: 628498 - RNA, 21 nt, Human
accccuucccucuuaucucuc

SEQ ID NO: 628499 - RNA, 21 nt, Human
accuagguagguagcccuccu

SEQ ID NO: 628500 - RNA, 19 nt, Human
agaagaaacagagacuaga

SEQ ID NO: 628501 - RNA, 22 nt, Human
agaagaaacagagacuagaggc

SEQ ID NO: 628502 - RNA, 22 nt, Human
agacagcacaguggucacgauc

SEQ ID NO: 628503 - RNA, 25 nt, Human
agagacuagaggcugcguaaaagcc

SEQ ID NO: 628504 - RNA, 20 nt, Human
agcacuugggcugauggcug

SEQ ID NO: 628505 - RNA, 18 nt, Human
agcaggugaggagagggg

SEQ ID NO: 628506 - RNA, 24 nt, Human
agccaaacagcaggcuagauagga

SEQ ID NO: 628507 - RNA, 20 nt, Human
agcccuuugugcuggcggug

SEQ ID NO: 628508 - RNA, 23 nt, Human
aggggcaccuuuccuucuacccc

SEQ ID NO: 628509 - RNA, 20 nt, Human
aucaaaaaguaaagcacacc

SEQ ID NO: 628510 - RNA, 24 nt, Human
auggaggaaaagagggaaggcaag

SEQ ID NO: 628511 - RNA, 23 nt, Human
caaaaacaucucuagcgaagccc

SEQ ID NO: 628512 - RNA, 22 nt, Human
caaaaaguaaagcacacccuca

SEQ ID NO: 628513 - RNA, 23 nt, Human
caaaaaguaaagcacacccucac

SEQ ID NO: 628514 - RNA, 21 nt, Human
caacaccaacucccauaaccu

SEQ ID NO: 628515 - RNA, 23 nt, Human
caacuaaaucauccaagcucuua

SEQ ID NO: 628516 - RNA, 21 nt, Human
caagcuccugcucccacuuuu

SEQ ID NO: 628517 - RNA, 23 nt, Human
cacacccucaccucucuuccaca

SEQ ID NO: 628518 - RNA, 18 nt, Human
caccacaguauugcagcc

SEQ ID NO: 628519 - RNA, 20 nt, Human
caccacaguauugcagccag

SEQ ID NO: 628520 - RNA, 22 nt, Human
caccuccaagcuccugcuccca

SEQ ID NO: 628521 - RNA, 22 nt, Human
cagaagaaacagagacuagagg

SEQ ID NO: 628522 - RNA, 19 nt, Human
cagaagguagcccccagca

SEQ ID NO: 628523 - RNA, 20 nt, Human
cagacacacacaaaccuggc

SEQ ID NO: 628524 - RNA, 24 nt, Human
cagaguucccaaauaugugcuuuc

SEQ ID NO: 628525 - RNA, 19 nt, Human
cagcagaggugagauaagc

SEQ ID NO: 628526 - RNA, 24 nt, Human
caguggcuggagcaagacagcaca

SEQ ID NO: 628527 - RNA, 24 nt, Human
cauucccaacucaagcuaccagag

SEQ ID NO: 628528 - RNA, 18 nt, Human
ccaaagcccaugaguaca

SEQ ID NO: 628529 - RNA, 20 nt, Human
ccagcagaggugagauaagc

SEQ ID NO: 628530 - RNA, 21 nt, Human
ccauaaccuaaaagggggugg

SEQ ID NO: 628531 - RNA, 19 nt, Human
cccaacaccaacucccaua

SEQ ID NO: 628532 - RNA, 21 nt, Human
cccaacaccaacucccauaac

SEQ ID NO: 628533 - RNA, 19 nt, Human
cccauucccaacucaagcu

SEQ ID NO: 628534 - RNA, 23 nt, Human
ccccagcagaggugagauaagcu

SEQ ID NO: 628535 - RNA, 24 nt, Human
ccccggcagagcagcuugccacuu

SEQ ID NO: 628536 - RNA, 23 nt, Human
cccgcggcgaucgcugucccaag

SEQ ID NO: 628537 - RNA, 25 nt, Human
cccgguggagcuguucguggcgccc

SEQ ID NO: 628538 - RNA, 25 nt, Human
cccuccaaaaacaucucuagcgaag

SEQ ID NO: 628539 - RNA, 22 nt, Human
cccugaguugucaccaccuucc

SEQ ID NO: 628540 - RNA, 18 nt, Human
cccuggggaaguacuucu

SEQ ID NO: 628541 - RNA, 21 nt, Human
ccggccgcacacgccgcagcc

SEQ ID NO: 628542 - RNA, 19 nt, Human
ccuccaaaaacaucucuag

SEQ ID NO: 628543 - RNA, 27 nt, Human
ccucuggaauccuggagaaguggugag

SEQ ID NO: 628544 - RNA, 24 nt, Human
ccuugugcaggaaaaguucucucc

SEQ ID NO: 628545 - RNA, 18 nt, Human
cggcuccggaccgcuccu

SEQ ID NO: 628546 - RNA, 20 nt, Human
cuaccccuucccucuuaucu

SEQ ID NO: 628547 - RNA, 24 nt, Human
cuaggauugacuccaauauucucu

SEQ ID NO: 628548 - RNA, 20 nt, Human
cuccugagucgguaucucug

SEQ ID NO: 628549 - RNA, 25 nt, Human
cucucuguugccacccgcggcgauc

SEQ ID NO: 628550 - RNA, 19 nt, Human
cugucauggccacaacaaa

SEQ ID NO: 628551 - RNA, 18 nt, Human
cugugcugaaggaaaagg

SEQ ID NO: 628552 - RNA, 22 nt, Human
cuuaggaaagaggguuuggaga

SEQ ID NO: 628553 - RNA, 23 nt, Human
cuuaggacacuggaaauuucaag

SEQ ID NO: 628554 - RNA, 20 nt, Human
gaggagagggguugguggug

SEQ ID NO: 628555 - RNA, 23 nt, Human
gaguacagccaaacagcaggcua

SEQ ID NO: 628556 - RNA, 22 nt, Human
gauggauggaggaaaagaggga

SEQ ID NO: 628557 - RNA, 25 nt, Human
gcucucuguugccacccgcggcgau

SEQ ID NO: 628558 - RNA, 22 nt, Human
gcugucccaaggccggccgcac

SEQ ID NO: 628559 - RNA, 24 nt, Human
ggaggaaaagagggaaggcaagag

SEQ ID NO: 628560 - RNA, 19 nt, Human
uaaaaaagaaccuucccau

SEQ ID NO: 628561 - RNA, 18 nt, Human
uaaaaggggguggaggug

SEQ ID NO: 628562 - RNA, 24 nt, Human
uacucagaagguagcccccagcau

SEQ ID NO: 628563 - RNA, 20 nt, Human
uagcccccagcaugaucaca

SEQ ID NO: 628564 - RNA, 19 nt, Human
ucaagauaaaggcaucaga

SEQ ID NO: 628565 - RNA, 19 nt, Human
ucaagauaaaggcaucaga

SEQ ID NO: 628566 - RNA, 22 nt, Human
ucaccuccaagcuccugcuccc

SEQ ID NO: 628567 - RNA, 22 nt, Human
ucagaguagaaugaaucaagau

SEQ ID NO: 628568 - RNA, 18 nt, Human
ucaggcaguggcccaagc

SEQ ID NO: 628569 - RNA, 21 nt, Human
ucccaacaccaacucccauaa

SEQ ID NO: 628570 - RNA, 25 nt, Human
ucccaacaccaacucccauaaccua

SEQ ID NO: 628571 - RNA, 21 nt, Human
ucccaaggccggccgcacacg

SEQ ID NO: 628572 - RNA, 22 nt, Human
ucccuccaaaaacaucucuagc

SEQ ID NO: 628573 - RNA, 20 nt, Human
ucccuggggaaguacuucug

SEQ ID NO: 628574 - RNA, 22 nt, Human
uccugcucccacuuuugcuugg

SEQ ID NO: 628575 - RNA, 24 nt, Human
ucuagcgaagcccuuugugcuggc

SEQ ID NO: 628576 - RNA, 20 nt, Human
ucuuccacacugacucacua

SEQ ID NO: 628577 - RNA, 23 nt, Human
ucuuccacacugacucacuacuu

SEQ ID NO: 628578 - RNA, 24 nt, Human
ugacccaggagaugaccccggcag

SEQ ID NO: 628579 - RNA, 25 nt, Human
ugacggggauuacccugccuuggaa

SEQ ID NO: 628580 - RNA, 20 nt, Human
ugagagcugugcugaaggaa

SEQ ID NO: 628581 - RNA, 22 nt, Human
ugagauucccaaugcaacauca

SEQ ID NO: 628582 - RNA, 22 nt, Human
ugaggccagggcaguggcugga

SEQ ID NO: 628583 - RNA, 21 nt, Human
ugaguugucaccaccuuccuc

SEQ ID NO: 628584 - RNA, 22 nt, Human
ugauucccuccaaaaacaucuc

SEQ ID NO: 628585 - RNA, 23 nt, Human
ugccuugggucuccccacgaggc

SEQ ID NO: 628586 - RNA, 19 nt, Human
ugcguaaaagccucaagga

SEQ ID NO: 628587 - RNA, 19 nt, Human
uggaauccuggagaagugg

SEQ ID NO: 628588 - RNA, 23 nt, Human
uggcccaagcaccacaguauugc

SEQ ID NO: 628589 - RNA, 19 nt, Human
uggcuggagcaagacagca

SEQ ID NO: 628590 - RNA, 21 nt, Human
uggcuggagcaagacagcaca

SEQ ID NO: 628591 - RNA, 29 nt, Human
uguacaaacacacacacacacacaugcag

SEQ ID NO: 628592 - RNA, 20 nt, Human
ugucccaaggccggccgcac

SEQ ID NO: 628593 - RNA, 19 nt, Human
ugugaaaauuuugcaggca

SEQ ID NO: 628594 - RNA, 20 nt, Human
ugugcuggcggugagagcug

SEQ ID NO: 628595 - RNA, 22 nt, Human
uguucguguucccugaguuguc

SEQ ID NO: 628596 - RNA, 18 nt, Human
uuagaguaaguugacggg

SEQ ID NO: 628597 - RNA, 18 nt, Human
uuaggcccacaagucccg

SEQ ID NO: 628598 - RNA, 19 nt, Human
uucacaaauauacucagaa

SEQ ID NO: 628599 - RNA, 18 nt, Human
uucuucuauuacauacag

SEQ ID NO: 628600 - RNA, 21 nt, Human
uuucacaaauauacucagaag

SEQ ID NO: 628601 - RNA, 21 nt, Human
uuuuuuuuuuuuuuuuucugg

SEQ ID NO: 628602 - RNA, 23 nt, Human
aaaaagccaaguaaagcaguggg

SEQ ID NO: 628603 - RNA, 21 nt, Human
aaacucccccacccccaagaa

SEQ ID NO: 628604 - RNA, 19 nt, Human
aaaggguggggggacaaca

SEQ ID NO: 628605 - RNA, 21 nt, Human
aacaagagagcaagugagaaa

SEQ ID NO: 628606 - RNA, 24 nt, Human
aacccauaaaaagucacuuaaaau

SEQ ID NO: 628607 - RNA, 20 nt, Human
aagacgggaaggaaaaaagc

SEQ ID NO: 628608 - RNA, 19 nt, Human
aagaugcccacuuuaugaa

SEQ ID NO: 628609 - RNA, 24 nt, Human
aagccaaguaaagcacagaccagg

SEQ ID NO: 628610 - RNA, 21 nt, Human
aagggcuguguacuugccacc

SEQ ID NO: 628611 - RNA, 18 nt, Human
aaggggggaaaauaauuc

SEQ ID NO: 628612 - RNA, 20 nt, Human
aaguaaagcacagaccagga

SEQ ID NO: 628613 - RNA, 19 nt, Human
aauaagcagaauuaacuac

SEQ ID NO: 628614 - RNA, 21 nt, Human
acccccaagaaaagguuccug

SEQ ID NO: 628615 - RNA, 21 nt, Human
acccuguaaaaggggggaaaa

SEQ ID NO: 628616 - RNA, 24 nt, Human
acgagaaaagccaggacuucgaua

SEQ ID NO: 628617 - RNA, 21 nt, Human
agaaaagaguaaaaaacacug

SEQ ID NO: 628618 - RNA, 21 nt, Human
agaccaggaagcccccgccga

SEQ ID NO: 628619 - RNA, 21 nt, Human
agccaaguaaagcacagacca

SEQ ID NO: 628620 - RNA, 24 nt, Human
agccaaguaaagcacagaccagga

SEQ ID NO: 628621 - RNA, 21 nt, Human
agggcuguguacuugccacca

SEQ ID NO: 628622 - RNA, 19 nt, Human
agugagaaaacgagaaaag

SEQ ID NO: 628623 - RNA, 24 nt, Human
aguucuaagcacuugguaauucca

SEQ ID NO: 628624 - RNA, 20 nt, Human
caagagagcaagugagaaaa

SEQ ID NO: 628625 - RNA, 21 nt, Human
caaguaaagcacagaccagga

SEQ ID NO: 628626 - RNA, 26 nt, Human
caccacaaacaccaccagagugccca

SEQ ID NO: 628627 - RNA, 18 nt, Human
caccagucugcuugcagc

SEQ ID NO: 628628 - RNA, 18 nt, Human
caccgggugccuggagcu

SEQ ID NO: 628629 - RNA, 25 nt, Human
caccugucugcuaccaaccccucua

SEQ ID NO: 628630 - RNA, 20 nt, Human
caccugugccuuuccuucuu

SEQ ID NO: 628631 - RNA, 18 nt, Human
cacuguggcauguuucau

SEQ ID NO: 628632 - RNA, 20 nt, Human
cauaaaaagucacuuaaaau

SEQ ID NO: 628633 - RNA, 18 nt, Human
cauucuuaaaauaguuuu

SEQ ID NO: 628634 - RNA, 21 nt, Human
cauuuuuguuuuguuuggaag

SEQ ID NO: 628635 - RNA, 21 nt, Human
ccccaagaaaagguuccugca

SEQ ID NO: 628636 - RNA, 24 nt, Human
cccuuuaccaccuaugggaaagcc

SEQ ID NO: 628637 - RNA, 23 nt, Human
ccuaaaacacagaagaugcccag

SEQ ID NO: 628638 - RNA, 21 nt, Human
ccuaccucaaaucccuuuaaa

SEQ ID NO: 628639 - RNA, 24 nt, Human
cuaagacgggaaggaaaaaagcca

SEQ ID NO: 628640 - RNA, 20 nt, Human
cugcaaaaaaaagggcugug

SEQ ID NO: 628641 - RNA, 22 nt, Human
cugcacaagcaagccaagcaca

SEQ ID NO: 628642 - RNA, 19 nt, Human
gaaacucccccacccccaa

SEQ ID NO: 628643 - RNA, 22 nt, Human
gaaagguuauuacuugugaaag

SEQ ID NO: 628644 - RNA, 21 nt, Human
gaccccuuuaccaccuauggg

SEQ ID NO: 628645 - RNA, 20 nt, Human
gagcuucaagucuuuggaua

SEQ ID NO: 628646 - RNA, 22 nt, Human
gccacauccuuuguucucugcc

SEQ ID NO: 628647 - RNA, 23 nt, Human
gcccaccuuuuacuguucuccac

SEQ ID NO: 628648 - RNA, 18 nt, Human
gcuauagcaacucaaucu

SEQ ID NO: 628649 - RNA, 18 nt, Human
ggaaggaaaaaagccaag

SEQ ID NO: 628650 - RNA, 24 nt, Human
guaaagcacagaccaggaagcccc

SEQ ID NO: 628651 - RNA, 19 nt, Human
uaaaaaaacagagaacaag

SEQ ID NO: 628652 - RNA, 23 nt, Human
uaaaaaaacagagaacaagagag

SEQ ID NO: 628653 - RNA, 25 nt, Human
uaaaaaaacagagaacaagagagca

SEQ ID NO: 628654 - RNA, 28 nt, Human
uaaagcacagaccaggaagcccccgccg

SEQ ID NO: 628655 - RNA, 22 nt, Human
uaacuaaaguccuguggcgaug

SEQ ID NO: 628656 - RNA, 24 nt, Human
uaagacgaaaaccuaaauaaccca

SEQ ID NO: 628657 - RNA, 21 nt, Human
uaagacgggaaggaaaaaagc

SEQ ID NO: 628658 - RNA, 23 nt, Human
uaagacgggaaggaaaaaagcca

SEQ ID NO: 628659 - RNA, 21 nt, Human
uagaaaagggaaacuccccca

SEQ ID NO: 628660 - RNA, 24 nt, Human
uagacaaguuagcacugcaaaaaa

SEQ ID NO: 628661 - RNA, 24 nt, Human
uagggugucauuuuuacuuuauuu

SEQ ID NO: 628662 - RNA, 22 nt, Human
uauuggcacuucuguggagaag

SEQ ID NO: 628663 - RNA, 23 nt, Human
ucaauguuccuuauguaauggug

SEQ ID NO: 628664 - RNA, 23 nt, Human
ucacugggucccugcaucaagcu

SEQ ID NO: 628665 - RNA, 18 nt, Human
ucagaccccuuuaccacc

SEQ ID NO: 628666 - RNA, 19 nt, Human
ucuguggagaaguuacuac

SEQ ID NO: 628667 - RNA, 21 nt, Human
ucuucaaagacaucugcccac

SEQ ID NO: 628668 - RNA, 19 nt, Human
ugaaaagccuaaacaugga

SEQ ID NO: 628669 - RNA, 21 nt, Human
ugaaacaccauuugcauuuuu

SEQ ID NO: 628670 - RNA, 21 nt, Human
ugagaaaacgagaaaagccag

SEQ ID NO: 628671 - RNA, 23 nt, Human
ugagaaaacgagaaaagccagga

SEQ ID NO: 628672 - RNA, 21 nt, Human
ugagaaaagaguaaaaaacac

SEQ ID NO: 628673 - RNA, 22 nt, Human
ugauauguacacgaguguguuc

SEQ ID NO: 628674 - RNA, 21 nt, Human
ugcauuuuuagaaaagggaaa

SEQ ID NO: 628675 - RNA, 23 nt, Human
ugccacauccuuuguucucugcc

SEQ ID NO: 628676 - RNA, 18 nt, Human
ugcccaccgggugccugg

SEQ ID NO: 628677 - RNA, 22 nt, Human
uggcgauggaauccagccuacc

SEQ ID NO: 628678 - RNA, 30 nt, Human
ugggucccugcaucaagcuauagcaacucu

SEQ ID NO: 628679 - RNA, 21 nt, Human
uucaaagacaucugcccaccu

SEQ ID NO: 628680 - RNA, 22 nt, Human
uucaguucaccacaaacaccac

SEQ ID NO: 628681 - RNA, 18 nt, Human
uucuguggagaaguuacu

SEQ ID NO: 628682 - RNA, 23 nt, Human
uuuaaggaaaaaagggugggggg

SEQ ID NO: 628683 - RNA, 20 nt, Human
uuuuuuuuuuuuaggguguc

SEQ ID NO: 628684 - RNA, 25 nt, Human
uuuuuuuuuuuuuuuuuuuuagggg

SEQ ID NO: 628685 - RNA, 25 nt, Human
acccucagagaugcuccucugaagg

SEQ ID NO: 628686 - RNA, 21 nt, Human
acuccgcgccuccccgcgggc

SEQ ID NO: 628687 - RNA, 20 nt, Human
agcagagugcgggaggggcu

SEQ ID NO: 628688 - RNA, 20 nt, Human
agccuuuccuggcgagucug

SEQ ID NO: 628689 - RNA, 18 nt, Human
aggaggccuggagaguuc

SEQ ID NO: 628690 - RNA, 27 nt, Human
aggcucccggacccccguccaccccuu

SEQ ID NO: 628691 - RNA, 24 nt, Human
agucuggguccucagcuacgcggg

SEQ ID NO: 628692 - RNA, 26 nt, Human
aucccacuguccaccauucuccccca

SEQ ID NO: 628693 - RNA, 21 nt, Human
cagaaaaggugaaguuccgug

SEQ ID NO: 628694 - RNA, 18 nt, Human
cagccagcugcagggcuc

SEQ ID NO: 628695 - RNA, 19 nt, Human
ccacuccgcgccuccccgc

SEQ ID NO: 628696 - RNA, 19 nt, Human
ccagaaucccacuguccac

SEQ ID NO: 628697 - RNA, 19 nt, Human
ccaggccccuccccugacc

SEQ ID NO: 628698 - RNA, 21 nt, Human
cccaccuuuuuuccgcuccca

SEQ ID NO: 628699 - RNA, 22 nt, Human
ccccagccucacuagccuuucc

SEQ ID NO: 628700 - RNA, 19 nt, Human
ccccgccccugccgccagg

SEQ ID NO: 628701 - RNA, 18 nt, Human
ccccuccucccccgcccc

SEQ ID NO: 628702 - RNA, 20 nt, Human
ccccugccgccaggccccuc

SEQ ID NO: 628703 - RNA, 22 nt, Human
ccccugggacgugaggagugag

SEQ ID NO: 628704 - RNA, 19 nt, Human
cccgccccugccgccaggc

SEQ ID NO: 628705 - RNA, 22 nt, Human
cccgggccccagccucacuagc

SEQ ID NO: 628706 - RNA, 21 nt, Human
cccucacaaaccggcagucua

SEQ ID NO: 628707 - RNA, 20 nt, Human
cccucguccccucccaggga

SEQ ID NO: 628708 - RNA, 20 nt, Human
cccugccgccaggccccucc

SEQ ID NO: 628709 - RNA, 24 nt, Human
cccugccgccaggccccuccccug

SEQ ID NO: 628710 - RNA, 23 nt, Human
ccgccaggccccuccccugaccc

SEQ ID NO: 628711 - RNA, 21 nt, Human
ccgccccugccgccaggcccc

SEQ ID NO: 628712 - RNA, 21 nt, Human
ccucccagggagagauuucca

SEQ ID NO: 628713 - RNA, 22 nt, Human
ccuggagaguucaguccugggu

SEQ ID NO: 628714 - RNA, 20 nt, Human
cgagcgggcgccgcucuacu

SEQ ID NO: 628715 - RNA, 20 nt, Human
cgcacgaaguuucccuaggg

SEQ ID NO: 628716 - RNA, 18 nt, Human
cgccaggccccuccccug

SEQ ID NO: 628717 - RNA, 20 nt, Human
cgcugcggggcgcauagcag

SEQ ID NO: 628718 - RNA, 24 nt, Human
cuaggguggucggggauccucucc

SEQ ID NO: 628719 - RNA, 19 nt, Human
cucugaagcaggggaaaga

SEQ ID NO: 628720 - RNA, 19 nt, Human
cugggacggcgcgaucucg

SEQ ID NO: 628721 - RNA, 22 nt, Human
cuuuaacccuugggggucccaa

SEQ ID NO: 628722 - RNA, 18 nt, Human
gaagguggaggcgcuggc

SEQ ID NO: 628723 - RNA, 21 nt, Human
gacuccagccagcugcagggc

SEQ ID NO: 628724 - RNA, 21 nt, Human
gagccaacccucacaaaccgg

SEQ ID NO: 628725 - RNA, 20 nt, Human
gaggcuugcuggggccuugc

SEQ ID NO: 628726 - RNA, 18 nt, Human
gccacgccugcccggagc

SEQ ID NO: 628727 - RNA, 23 nt, Human
gccagcugcagggcucaggggag

SEQ ID NO: 628728 - RNA, 25 nt, Human
gcugaggccccgccccugccgccag

SEQ ID NO: 628729 - RNA, 18 nt, Human
gcugcagggcucagggga

SEQ ID NO: 628730 - RNA, 20 nt, Human
gcuggggccuugccccuccu

SEQ ID NO: 628731 - RNA, 21 nt, Human
ggaaacaagacuccagccagc

SEQ ID NO: 628732 - RNA, 18 nt, Human
ggaaagaaaacuagaaag

SEQ ID NO: 628733 - RNA, 23 nt, Human
ggagcucgaggcucccggacccc

SEQ ID NO: 628734 - RNA, 18 nt, Human
ggcgugguccucgcgggg

SEQ ID NO: 628735 - RNA, 19 nt, Human
gggaccgccggcuuugcca

SEQ ID NO: 628736 - RNA, 22 nt, Human
gggcucaggggaggaggccugg

SEQ ID NO: 628737 - RNA, 18 nt, Human
gguugugggcuccggagg

SEQ ID NO: 628738 - RNA, 22 nt, Human
uaagcagcaauuaucgcacgaa

SEQ ID NO: 628739 - RNA, 23 nt, Human
uagaacccucagagaugcuccuc

SEQ ID NO: 628740 - RNA, 26 nt, Human
uagccuuuccuggcgagucugggucc

SEQ ID NO: 628741 - RNA, 19 nt, Human
uaggguggucggggauccu

SEQ ID NO: 628742 - RNA, 21 nt, Human
ucagcagagugcgggaggggc

SEQ ID NO: 628743 - RNA, 22 nt, Human
uccagaaucccacuguccaccc

SEQ ID NO: 628744 - RNA, 19 nt, Human
ucccagaaaaggugaaguu

SEQ ID NO: 628745 - RNA, 22 nt, Human
ucccagggagagauuuccaaga

SEQ ID NO: 628746 - RNA, 20 nt, Human
ucgcggggcgcggaagaccc

SEQ ID NO: 628747 - RNA, 20 nt, Human
ugaagguggaggcgcuggcg

SEQ ID NO: 628748 - RNA, 21 nt, Human
ugcagggcucaggggaggagg

SEQ ID NO: 628749 - RNA, 20 nt, Human
ugccccuccucccccgcccc

SEQ ID NO: 628750 - RNA, 22 nt, Human
ugcccggagcucgaggcucccg

SEQ ID NO: 628751 - RNA, 22 nt, Human
ugcgggaggggcuggcugcggc

SEQ ID NO: 628752 - RNA, 20 nt, Human
ugcuccgcgccuuuagcuga

SEQ ID NO: 628753 - RNA, 23 nt, Human
ugggacgugaggagugaggcuuu

SEQ ID NO: 628754 - RNA, 18 nt, Human
ugggccaggcuguucccc

SEQ ID NO: 628755 - RNA, 21 nt, Human
ugggggucccaaacaaguuuc

SEQ ID NO: 628756 - RNA, 22 nt, Human
uuccauacuucaggugcucuuc

SEQ ID NO: 628757 - RNA, 20 nt, Human
uucgugaaugcuggguggcu

SEQ ID NO: 628758 - RNA, 18 nt, Human
uugcuggggccuugcccc

SEQ ID NO: 628759 - RNA, 18 nt, Human
uugugcuuguuuuauugg

SEQ ID NO: 628760 - RNA, 22 nt, Human
uuuccagaaucccacuguccac

SEQ ID NO: 628761 - RNA, 20 nt, Human
uuuuuuuuuuugugcuuguu

SEQ ID NO: 628762 - RNA, 18 nt, Human
uuuuuuuuuuuuuuuugu

SEQ ID NO: 628763 - RNA, 19 nt, Human
aagaagaaguccaaagccu

SEQ ID NO: 628764 - RNA, 23 nt, Human
aagaagccagacugcauuugacu

SEQ ID NO: 628765 - RNA, 22 nt, Human
aauucugaaaaacuucuuccac

SEQ ID NO: 628766 - RNA, 18 nt, Human
acuuauaugguuuuccuc

SEQ ID NO: 628767 - RNA, 21 nt, Human
agacacuaaugaccugaguua

SEQ ID NO: 628768 - RNA, 19 nt, Human
agaggggcaguguggucag

SEQ ID NO: 628769 - RNA, 23 nt, Human
agggaaggaggcacagauucagg

SEQ ID NO: 628770 - RNA, 20 nt, Human
agucaguaggaacagaggcu

SEQ ID NO: 628771 - RNA, 23 nt, Human
aucagcaagaagaaguccaaagc

SEQ ID NO: 628772 - RNA, 24 nt, Human
caaaagaucccuggacugugcuga

SEQ ID NO: 628773 - RNA, 19 nt, Human
caaccacugcgguugcaaa

SEQ ID NO: 628774 - RNA, 18 nt, Human
caagaagaaguccaaagc

SEQ ID NO: 628775 - RNA, 24 nt, Human
caaguagcuauagucaguaggaac

SEQ ID NO: 628776 - RNA, 26 nt, Human
caccaaccauaugcucugguccauac

SEQ ID NO: 628777 - RNA, 18 nt, Human
cagagacacuaaugaccu

SEQ ID NO: 628778 - RNA, 21 nt, Human
cccaugcaaccacugcgguug

SEQ ID NO: 628779 - RNA, 22 nt, Human
cccaugcaaccacugcgguugc

SEQ ID NO: 628780 - RNA, 21 nt, Human
ccccagagacacuaaugaccu

SEQ ID NO: 628781 - RNA, 22 nt, Human
ccggguacuaaagcaaugcacu

SEQ ID NO: 628782 - RNA, 19 nt, Human
cgaggaggagaggggcagu

SEQ ID NO: 628783 - RNA, 19 nt, Human
cugagagggcuucuuuagg

SEQ ID NO: 628784 - RNA, 21 nt, Human
cugaggccgaggaggagaggg

SEQ ID NO: 628785 - RNA, 18 nt, Human
cuggcacugaggccgagg

SEQ ID NO: 628786 - RNA, 20 nt, Human
cugggucuguuccuuccaug

SEQ ID NO: 628787 - RNA, 20 nt, Human
cugggucuguuccuuccaug

SEQ ID NO: 628788 - RNA, 20 nt, Human
gaacuucugggucuguuccu

SEQ ID NO: 628789 - RNA, 27 nt, Human
gaccuuuuuuuccuccugcaaugaaga

SEQ ID NO: 628790 - RNA, 20 nt, Human
gagaggggcaguguggucag

SEQ ID NO: 628791 - RNA, 18 nt, Human
gaggccgaggaggagagg

SEQ ID NO: 628792 - RNA, 24 nt, Human
gauguggccaucuuuucaugaccc

SEQ ID NO: 628793 - RNA, 23 nt, Human
gcaagaagaaguccaaagccucg

SEQ ID NO: 628794 - RNA, 25 nt, Human
gccaucuuuucaugacccuuaacuc

SEQ ID NO: 628795 - RNA, 19 nt, Human
ggaggagaggggcagugug

SEQ ID NO: 628796 - RNA, 27 nt, Human
ggcccagccgggccauucuccugaugc

SEQ ID NO: 628797 - RNA, 20 nt, Human
gguacuggcccagccgggcc

SEQ ID NO: 628798 - RNA, 23 nt, Human
uaaagaaaauccaaguuccuguu

SEQ ID NO: 628799 - RNA, 23 nt, Human
uaagaagggaaggaggcacagau

SEQ ID NO: 628800 - RNA, 21 nt, Human
uagaguagauagaugaagaug

SEQ ID NO: 628801 - RNA, 19 nt, Human
uaggaggcaugugucaagc

SEQ ID NO: 628802 - RNA, 27 nt, Human
uaucagcaagaagaaguccaaagccuc

SEQ ID NO: 628803 - RNA, 18 nt, Human
ucaaugaacuucuggguc

SEQ ID NO: 628804 - RNA, 18 nt, Human
ucaggaccuuuuuuuccu

SEQ ID NO: 628805 - RNA, 28 nt, Human
uccacauugaacucaagccaaauaaaga

SEQ ID NO: 628806 - RNA, 24 nt, Human
ucuccugaugccauggcaaccaac

SEQ ID NO: 628807 - RNA, 21 nt, Human
ucugaaaaacuucuuccacuu

SEQ ID NO: 628808 - RNA, 23 nt, Human
ucugggucuguuccuuccauggc

SEQ ID NO: 628809 - RNA, 20 nt, Human
ucuguuccuuccauggcucu

SEQ ID NO: 628810 - RNA, 23 nt, Human
ugagaaccuccugcagagugacc

SEQ ID NO: 628811 - RNA, 22 nt, Human
ugagaaugcugcugguuacugc

SEQ ID NO: 628812 - RNA, 20 nt, Human
ugcauuggacuccugccaag

SEQ ID NO: 628813 - RNA, 19 nt, Human
uggacugugcugagagggc

SEQ ID NO: 628814 - RNA, 24 nt, Human
uggcaaccaacuggcacugaggcc

SEQ ID NO: 628815 - RNA, 20 nt, Human
uggcccggguacuaaagcaa

SEQ ID NO: 628816 - RNA, 20 nt, Human
ugggaaggagagugagaacc

SEQ ID NO: 628817 - RNA, 19 nt, Human
ugggagaacucucaaggac

SEQ ID NO: 628818 - RNA, 21 nt, Human
ugggucuguuccuuccauggc

SEQ ID NO: 628819 - RNA, 22 nt, Human
uuagggcuuuccaugaugcuga

SEQ ID NO: 628820 - RNA, 18 nt, Human
uuuuuuuuuuuuuuuuug

SEQ ID NO: 628821 - RNA, 19 nt, Human
aaaagcauuucagcuuucc

SEQ ID NO: 628822 - RNA, 18 nt, Human
acacguuuuaaagaaggc

SEQ ID NO: 628823 - RNA, 24 nt, Human
acagacccacgacccacccacgcc

SEQ ID NO: 628824 - RNA, 24 nt, Human
acagacccauguccauccccacac

SEQ ID NO: 628825 - RNA, 19 nt, Human
acccagaaguccuggggcc

SEQ ID NO: 628826 - RNA, 19 nt, Human
accccacagccccugccug

SEQ ID NO: 628827 - RNA, 19 nt, Human
accccuaaggaaagaugag

SEQ ID NO: 628828 - RNA, 24 nt, Human
accccuuaauuuuaaagaugacuu

SEQ ID NO: 628829 - RNA, 28 nt, Human
acuuugaagguacacuugugaagaaaag

SEQ ID NO: 628830 - RNA, 24 nt, Human
agaaaccauucccugcagugaguc

SEQ ID NO: 628831 - RNA, 18 nt, Human
agaaguccuggggccugg

SEQ ID NO: 628832 - RNA, 24 nt, Human
agcagcggcucacaccaccacaga

SEQ ID NO: 628833 - RNA, 24 nt, Human
agcccugcccccucauccacccac

SEQ ID NO: 628834 - RNA, 22 nt, Human
agcccugcccucacccacccac

SEQ ID NO: 628835 - RNA, 22 nt, Human
agcccugcccucacccacccac

SEQ ID NO: 628836 - RNA, 22 nt, Human
agcccugcccucacccauccac

SEQ ID NO: 628837 - RNA, 21 nt, Human
aggagcagcggcucacaccac

SEQ ID NO: 628838 - RNA, 20 nt, Human
aggggaggagagggaaaagg

SEQ ID NO: 628839 - RNA, 21 nt, Human
aggggaggagagggaaaaggu

SEQ ID NO: 628840 - RNA, 18 nt, Human
aguccuggggccugggac

SEQ ID NO: 628841 - RNA, 24 nt, Human
aguggcuugggcacagggcagggg

SEQ ID NO: 628842 - RNA, 24 nt, Human
auaugauugagugugcaaauuggg

SEQ ID NO: 628843 - RNA, 29 nt, Human
auguccacagacccauguccauccccacc

SEQ ID NO: 628844 - RNA, 19 nt, Human
caacaaggaagccaggacu

SEQ ID NO: 628845 - RNA, 22 nt, Human
caauugguguaauuuguggggu

SEQ ID NO: 628846 - RNA, 21 nt, Human
cacaccaccacagacccacga

SEQ ID NO: 628847 - RNA, 24 nt, Human
cacaccaccacagacccacgaccc

SEQ ID NO: 628848 - RNA, 28 nt, Human
cacagacccacgacccacccacgccccc

SEQ ID NO: 628849 - RNA, 19 nt, Human
caccacagacccacgaccc

SEQ ID NO: 628850 - RNA, 19 nt, Human
caccaugcuggcuucagcc

SEQ ID NO: 628851 - RNA, 19 nt, Human
caccaugcuggcuucagcu

SEQ ID NO: 628852 - RNA, 23 nt, Human
cacgccuccccagaaaccauucc

SEQ ID NO: 628853 - RNA, 18 nt, Human
cagaaaccauucccugca

SEQ ID NO: 628854 - RNA, 19 nt, Human
cagauaggacggccccagg

SEQ ID NO: 628855 - RNA, 18 nt, Human
cagcaccaggcucugggg

SEQ ID NO: 628856 - RNA, 19 nt, Human
cagcaccaggcucuggggu

SEQ ID NO: 628857 - RNA, 22 nt, Human
cagccccccaccccaccucucc

SEQ ID NO: 628858 - RNA, 26 nt, Human
cagccccccaccccaccucuccugcc

SEQ ID NO: 628859 - RNA, 20 nt, Human
cagccccuaccccacagccc

SEQ ID NO: 628860 - RNA, 25 nt, Human
cagccccuaccccacagccccugcc

SEQ ID NO: 628861 - RNA, 22 nt, Human
caggcacacaugccccuuucca

SEQ ID NO: 628862 - RNA, 24 nt, Human
caggccccucaugcaguggcuugg

SEQ ID NO: 628863 - RNA, 20 nt, Human
cagggcaggggaggggagga

SEQ ID NO: 628864 - RNA, 20 nt, Human
caggggaggggaggagaggg

SEQ ID NO: 628865 - RNA, 21 nt, Human
ccacaccugucagcccugccc

SEQ ID NO: 628866 - RNA, 23 nt, Human
ccacaccugucagcccugcccuc

SEQ ID NO: 628867 - RNA, 23 nt, Human
ccacaccugucagcccugcccuc

SEQ ID NO: 628868 - RNA, 23 nt, Human
ccacaccugucagcccugcccuc

SEQ ID NO: 628869 - RNA, 25 nt, Human
ccacagacccacgacccacccacgc

SEQ ID NO: 628870 - RNA, 18 nt, Human
ccacccacgcccccacuc

SEQ ID NO: 628871 - RNA, 25 nt, Human
ccacccacgcccccacucaaaaagc

SEQ ID NO: 628872 - RNA, 22 nt, Human
ccaccuggcuguuaacacgggg

SEQ ID NO: 628873 - RNA, 20 nt, Human
ccacuccuggguuuccgccu

SEQ ID NO: 628874 - RNA, 22 nt, Human
ccaggcccacaccugucagcgc

SEQ ID NO: 628875 - RNA, 24 nt, Human
ccauccauguccacagacccaugu

SEQ ID NO: 628876 - RNA, 19 nt, Human
cccacaacucccgcaagcc

SEQ ID NO: 628877 - RNA, 24 nt, Human
cccacaacucccgcaagccuucaa

SEQ ID NO: 628878 - RNA, 24 nt, Human
cccacccacgcccccacucaaaaa

SEQ ID NO: 628879 - RNA, 23 nt, Human
cccacgacccacccacgccccca

SEQ ID NO: 628880 - RNA, 24 nt, Human
cccacguccacaccugucagcccu

SEQ ID NO: 628881 - RNA, 24 nt, Human
cccacguccacaccugucagcccu

SEQ ID NO: 628882 - RNA, 24 nt, Human
cccacguccacaccugucagcccu

SEQ ID NO: 628883 - RNA, 24 nt, Human
cccacguccacaccugucagcccu

SEQ ID NO: 628884 - RNA, 24 nt, Human
cccacguccacaccugucggcccu

SEQ ID NO: 628885 - RNA, 24 nt, Human
cccacguccacaucugucagcccu

SEQ ID NO: 628886 - RNA, 22 nt, Human
cccauccaccagauaggacggc

SEQ ID NO: 628887 - RNA, 20 nt, Human
cccauuuguaacucagcccc

SEQ ID NO: 628888 - RNA, 24 nt, Human
ccccaccaugcuggcuucagcccc

SEQ ID NO: 628889 - RNA, 19 nt, Human
ccccaccccaccucuccug

SEQ ID NO: 628890 - RNA, 24 nt, Human
cccccaccccaccucuccugcccc

SEQ ID NO: 628891 - RNA, 22 nt, Human
ccccccaccccaccucuccugc

SEQ ID NO: 628892 - RNA, 23 nt, Human
ccccccaccccaccucuccugcc

SEQ ID NO: 628893 - RNA, 18 nt, Human
ccccuaccccacagcccc

SEQ ID NO: 628894 - RNA, 20 nt, Human
ccccuccagccccccacccc

SEQ ID NO: 628895 - RNA, 24 nt, Human
ccccuccucuuccccuccagcccc

SEQ ID NO: 628896 - RNA, 20 nt, Human
ccccuuagcccacccacauc

SEQ ID NO: 628897 - RNA, 21 nt, Human
cccucacccacccacguccac

SEQ ID NO: 628898 - RNA, 21 nt, Human
cccucacccacccacguccac

SEQ ID NO: 628899 - RNA, 21 nt, Human
cccucacccacccacguccac

SEQ ID NO: 628900 - RNA, 21 nt, Human
cccucacccacccacguccac

SEQ ID NO: 628901 - RNA, 21 nt, Human
cccucacccacccacguccac

SEQ ID NO: 628902 - RNA, 21 nt, Human
cccucauccacccacguccac

SEQ ID NO: 628903 - RNA, 22 nt, Human
cccugcccccucacccacccac

SEQ ID NO: 628904 - RNA, 20 nt, Human
cccugcccucacccacccac

SEQ ID NO: 628905 - RNA, 20 nt, Human
cccugcccucacccacccac

SEQ ID NO: 628906 - RNA, 21 nt, Human
ccgcaagccuucaaugcuacc

SEQ ID NO: 628907 - RNA, 20 nt, Human
ccggaggagaggaggagagu

SEQ ID NO: 628908 - RNA, 26 nt, Human
ccgucagcccugcccccucacccacc

SEQ ID NO: 628909 - RNA, 22 nt, Human
ccucacccauccauguccacag

SEQ ID NO: 628910 - RNA, 23 nt, Human
ccuccagccccccaccccaccuc

SEQ ID NO: 628911 - RNA, 21 nt, Human
ccucccugggguccaggucca

SEQ ID NO: 628912 - RNA, 24 nt, Human
ccugaagauccucuaugucacccu

SEQ ID NO: 628913 - RNA, 26 nt, Human
ccugaagauccucuaugucacccuuu

SEQ ID NO: 628914 - RNA, 21 nt, Human
ccugcccccucacccacccac

SEQ ID NO: 628915 - RNA, 21 nt, Human
ccugcccccucauccacccac

SEQ ID NO: 628916 - RNA, 22 nt, Human
ccugggacgaggcggggcuggc

SEQ ID NO: 628917 - RNA, 21 nt, Human
ccugucagcccugcccucacc

SEQ ID NO: 628918 - RNA, 21 nt, Human
ccugucagcccugcccucacc

SEQ ID NO: 628919 - RNA, 21 nt, Human
ccugucagcccugcccucacc

SEQ ID NO: 628920 - RNA, 21 nt, Human
ccugucagcccugcccucacc

SEQ ID NO: 628921 - RNA, 22 nt, Human
ccugucagcccugcccucaccc

SEQ ID NO: 628922 - RNA, 22 nt, Human
ccugucagcccugcccucaccc

SEQ ID NO: 628923 - RNA, 22 nt, Human
ccugucagcccugcccucaccc

SEQ ID NO: 628924 - RNA, 22 nt, Human
ccugucagcccugcccucaccc

SEQ ID NO: 628925 - RNA, 24 nt, Human
cgagauaacaauacuuacuaaaac

SEQ ID NO: 628926 - RNA, 21 nt, Human
cgcaagccuucaaugcuacca

SEQ ID NO: 628927 - RNA, 19 nt, Human
cggaggagaggaggagagu

SEQ ID NO: 628928 - RNA, 22 nt, Human
cuaccacacguuuuaaagaagg

SEQ ID NO: 628929 - RNA, 22 nt, Human
cuaccccacagccccugccugu

SEQ ID NO: 628930 - RNA, 24 nt, Human
cucaaaucucuccacuccuggguu

SEQ ID NO: 628931 - RNA, 26 nt, Human
cucacccacccacguccacaccuguc

SEQ ID NO: 628932 - RNA, 26 nt, Human
cucacccacccacguccacaccuguc

SEQ ID NO: 628933 - RNA, 26 nt, Human
cucacccacccacguccacaccuguc

SEQ ID NO: 628934 - RNA, 26 nt, Human
cucacccacccacguccacaccuguc

SEQ ID NO: 628935 - RNA, 26 nt, Human
cucacccacccacguccacaucuguc

SEQ ID NO: 628936 - RNA, 26 nt, Human
cucacccauccacguccacaccuguc

SEQ ID NO: 628937 - RNA, 20 nt, Human
cucauccacccacguccaca

SEQ ID NO: 628938 - RNA, 21 nt, Human
cuccaccagcacuguccccuc

SEQ ID NO: 628939 - RNA, 20 nt, Human
cuccagccccccaccccacc

SEQ ID NO: 628940 - RNA, 21 nt, Human
cuccagccccccaccccaccu

SEQ ID NO: 628941 - RNA, 19 nt, Human
cuccucuuccccuccagcc

SEQ ID NO: 628942 - RNA, 21 nt, Human
cuccuggguuuccgccuuucc

SEQ ID NO: 628943 - RNA, 22 nt, Human
cucugucccccuccucuucccc

SEQ ID NO: 628944 - RNA, 27 nt, Human
cugaagauccucuaugucacccccugg

SEQ ID NO: 628945 - RNA, 19 nt, Human
cugcuacacaacaaggaag

SEQ ID NO: 628946 - RNA, 24 nt, Human
cugucagcccugcccucacccacc

SEQ ID NO: 628947 - RNA, 24 nt, Human
cugucagcccugcccucacccacc

SEQ ID NO: 628948 - RNA, 24 nt, Human
cugucagcccugcccucacccacc

SEQ ID NO: 628949 - RNA, 24 nt, Human
cugucagcccugcccucacccacc

SEQ ID NO: 628950 - RNA, 24 nt, Human
cugucagcccugcccucacccauc

SEQ ID NO: 628951 - RNA, 26 nt, Human
cugucggcccugacuccucacccauc

SEQ ID NO: 628952 - RNA, 25 nt, Human
cugugaguuuucuuuaaucaagcuc

SEQ ID NO: 628953 - RNA, 19 nt, Human
gaagguacacuugugaaga

SEQ ID NO: 628954 - RNA, 23 nt, Human
gacccacgacccacccacgcccc

SEQ ID NO: 628955 - RNA, 20 nt, Human
gagaggaggagagucugugu

SEQ ID NO: 628956 - RNA, 21 nt, Human
gagauaacaauacuuacuaaa

SEQ ID NO: 628957 - RNA, 20 nt, Human
gagucccggaggagaggagg

SEQ ID NO: 628958 - RNA, 21 nt, Human
gaguuaaucuaggucaacacu

SEQ ID NO: 628959 - RNA, 18 nt, Human
gccaccuuuccucugacc

SEQ ID NO: 628960 - RNA, 18 nt, Human
gcccccucauccacccac

SEQ ID NO: 628961 - RNA, 20 nt, Human
gccccucaugcaguggcuug

SEQ ID NO: 628962 - RNA, 21 nt, Human
gcgcagcucugucccccuccu

SEQ ID NO: 628963 - RNA, 19 nt, Human
gcggggcuggcgggcgagc

SEQ ID NO: 628964 - RNA, 20 nt, Human
gcuucagccccaucagcucu

SEQ ID NO: 628965 - RNA, 21 nt, Human
gcuucagccccaucagcucuc

SEQ ID NO: 628966 - RNA, 22 nt, Human
ggcaggggaggggaggagaggg

SEQ ID NO: 628967 - RNA, 23 nt, Human
gggagugucagggcuugcuccgg

SEQ ID NO: 628968 - RNA, 23 nt, Human
gggcaggggaggggaggagaggg

SEQ ID NO: 628969 - RNA, 23 nt, Human
gguccagguccaguuacccuggu

SEQ ID NO: 628970 - RNA, 24 nt, Human
guacacuugugaagaaaagaguua

SEQ ID NO: 628971 - RNA, 18 nt, Human
uaaaacagcagcaagggc

SEQ ID NO: 628972 - RNA, 21 nt, Human
uaacucagccccuaccccaca

SEQ ID NO: 628973 - RNA, 22 nt, Human
uaacucagccccuaccccacag

SEQ ID NO: 628974 - RNA, 24 nt, Human
uaacucagccccuaccccacagcc

SEQ ID NO: 628975 - RNA, 25 nt, Human
uaauaaauucccgcccugugaguuu

SEQ ID NO: 628976 - RNA, 18 nt, Human
uaccccacagccccugcc

SEQ ID NO: 628977 - RNA, 24 nt, Human
uacggugccucuucucaaaucucu

SEQ ID NO: 628978 - RNA, 22 nt, Human
uaggaaagacccacaacucccg

SEQ ID NO: 628979 - RNA, 18 nt, Human
uaggacggccccaggccu

SEQ ID NO: 628980 - RNA, 23 nt, Human
uaugucacccccuggaggucuca

SEQ ID NO: 628981 - RNA, 21 nt, Human
ucacccauccauguccacaga

SEQ ID NO: 628982 - RNA, 24 nt, Human
ucacccccuggaggucucaagggc

SEQ ID NO: 628983 - RNA, 23 nt, Human
ucagcccugcccccucauccacc

SEQ ID NO: 628984 - RNA, 20 nt, Human
uccacagacccauguccauc

SEQ ID NO: 628985 - RNA, 25 nt, Human
uccaccagcacuguccccucugccc

SEQ ID NO: 628986 - RNA, 24 nt, Human
uccacguccacaccugucagcccu

SEQ ID NO: 628987 - RNA, 23 nt, Human
uccccuccagccccccaccccac

SEQ ID NO: 628988 - RNA, 20 nt, Human
ucccugcagugagucccgga

SEQ ID NO: 628989 - RNA, 22 nt, Human
uccgagauguccuagggcacga

SEQ ID NO: 628990 - RNA, 23 nt, Human
uccgucagcccugcccccucacc

SEQ ID NO: 628991 - RNA, 24 nt, Human
uccgucagcccugcccccucaccc

SEQ ID NO: 628992 - RNA, 18 nt, Human
uccucuuccccuccagcc

SEQ ID NO: 628993 - RNA, 18 nt, Human
uccuggggccugggacga

SEQ ID NO: 628994 - RNA, 21 nt, Human
uccuggggccugggacgaggc

SEQ ID NO: 628995 - RNA, 19 nt, Human
uccuggguuuccgccuuuc

SEQ ID NO: 628996 - RNA, 21 nt, Human
ucugucagcccugcccucacc

SEQ ID NO: 628997 - RNA, 22 nt, Human
ucugucagcccugcccucaccc

SEQ ID NO: 628998 - RNA, 20 nt, Human
ugacuccucacccauccaug

SEQ ID NO: 628999 - RNA, 22 nt, Human
ugaggguccuuuucucagccca

SEQ ID NO: 629000 - RNA, 21 nt, Human
ugagggugugugugugaguga

SEQ ID NO: 629001 - RNA, 18 nt, Human
ugcaguggcuugggcaca

SEQ ID NO: 629002 - RNA, 23 nt, Human
ugccccaccaugcuggcuucagc

SEQ ID NO: 629003 - RNA, 25 nt, Human
uggaccccccggggauaugcagucc

SEQ ID NO: 629004 - RNA, 22 nt, Human
uggcgggcgagcgucaggaucu

SEQ ID NO: 629005 - RNA, 23 nt, Human
uggguuuccgccuuucccagcug

SEQ ID NO: 629006 - RNA, 21 nt, Human
uguccaccugcucagaaaccc

SEQ ID NO: 629007 - RNA, 23 nt, Human
ugucccccuccucuuccccucca

SEQ ID NO: 629008 - RNA, 23 nt, Human
uuccccuccagccccccacccca

SEQ ID NO: 629009 - RNA, 20 nt, Human
uucccugcagugagucccgg

SEQ ID NO: 629010 - RNA, 22 nt, Human
uuccucugacccugaagauccu

SEQ ID NO: 629011 - RNA, 26 nt, Human
uuucccagcugcaggcacacaugccc

SEQ ID NO: 629012 - RNA, 21 nt, Human
uuugaagguacacuugugaag

SEQ ID NO: 629013 - RNA, 20 nt, Human
uuuuuuuuuuuccagcaccc

SEQ ID NO: 629014 - RNA, 22 nt, Human
uuuuuuuuuuuuuuuuuuccag

SEQ ID NO: 629015 - RNA, 20 nt, Human
accagcagagaaguacaggc

SEQ ID NO: 629016 - RNA, 18 nt, Human
acugaucccaauaagcau

SEQ ID NO: 629017 - RNA, 19 nt, Human
agcaccaauuuuagcuacc

SEQ ID NO: 629018 - RNA, 18 nt, Human
aggaaacagaaaaugucu

SEQ ID NO: 629019 - RNA, 21 nt, Human
aggccacagcagaaagcacca

SEQ ID NO: 629020 - RNA, 20 nt, Human
aguauuauugugugcugguu

SEQ ID NO: 629021 - RNA, 22 nt, Human
auagggcagcaaaccagcagag

SEQ ID NO: 629022 - RNA, 24 nt, Human
auccuauuucagauuuggccaggc

SEQ ID NO: 629023 - RNA, 21 nt, Human
caauuuuagcuaccuuugauc

SEQ ID NO: 629024 - RNA, 24 nt, Human
caggaaacagaaaaugucuuuggu

SEQ ID NO: 629025 - RNA, 19 nt, Human
cauaaacuaaggccacagc

SEQ ID NO: 629026 - RNA, 22 nt, Human
cauaaacuaaggccacagcaga

SEQ ID NO: 629027 - RNA, 19 nt, Human
ccagcagagaaguacaggc

SEQ ID NO: 629028 - RNA, 18 nt, Human
ccauauucuucccugaga

SEQ ID NO: 629029 - RNA, 19 nt, Human
cccagggagaguuccuucu

SEQ ID NO: 629030 - RNA, 18 nt, Human
cuaaggccacagcagaaa

SEQ ID NO: 629031 - RNA, 24 nt, Human
cuaaggccacagcagaaagcacca

SEQ ID NO: 629032 - RNA, 24 nt, Human
cuccccagguccaccgggcgugau

SEQ ID NO: 629033 - RNA, 23 nt, Human
cugcuggaccaugauacuuauau

SEQ ID NO: 629034 - RNA, 22 nt, Human
cuucuuuuuuaaaaguugaaag

SEQ ID NO: 629035 - RNA, 18 nt, Human
gaagacuuuucaaaagcu

SEQ ID NO: 629036 - RNA, 21 nt, Human
gaccaugauacuuauaucugg

SEQ ID NO: 629037 - RNA, 26 nt, Human
gcucaacuucaacaaagagggaacgc

SEQ ID NO: 629038 - RNA, 23 nt, Human
gggaagguggacauagggcagca

SEQ ID NO: 629039 - RNA, 22 nt, Human
uaaacuaaggccacagcagaaa

SEQ ID NO: 629040 - RNA, 21 nt, Human
uaacacgggauaaacagaauu

SEQ ID NO: 629041 - RNA, 24 nt, Human
uaaggccacagcagaaagcaccaa

SEQ ID NO: 629042 - RNA, 28 nt, Human
uacauaaacuaaggccacagcagaaagc

SEQ ID NO: 629043 - RNA, 21 nt, Human
uagggcagcaaaccagcagag

SEQ ID NO: 629044 - RNA, 22 nt, Human
uaucugggagaugacuuaguuu

SEQ ID NO: 629045 - RNA, 20 nt, Human
uccaggaaacagaaaauguc

SEQ ID NO: 629046 - RNA, 20 nt, Human
uccuucuuuuuuaaaaguug

SEQ ID NO: 629047 - RNA, 19 nt, Human
ugaaagacuggaagucaga

SEQ ID NO: 629048 - RNA, 18 nt, Human
ugagaugggaagguggac

SEQ ID NO: 629049 - RNA, 19 nt, Human
ugagaugggaagguggaca

SEQ ID NO: 629050 - RNA, 22 nt, Human
ugagaugggaagguggacauag

SEQ ID NO: 629051 - RNA, 20 nt, Human
uuagcaguugcugcuuccuc

SEQ ID NO: 629052 - RNA, 21 nt, Human
uuuuuuuuuuuuuuuuuccag

SEQ ID NO: 629053 - RNA, 23 nt, Human
uuuuuuuuuuuuuuuuuuccagg

SEQ ID NO: 629054 - RNA, 24 nt, Human
aaaaaaaacagauuggcuucaaag

SEQ ID NO: 629055 - RNA, 19 nt, Human
aaaacaaucuuuuuuuuac

SEQ ID NO: 629056 - RNA, 21 nt, Human
aaaacugccuucuugaccuuc

SEQ ID NO: 629057 - RNA, 22 nt, Human
aaaauaccaacaucucccauac

SEQ ID NO: 629058 - RNA, 18 nt, Human
aacaauuucuaaguagau

SEQ ID NO: 629059 - RNA, 21 nt, Human
aagaaaacacuaaggaagacc

SEQ ID NO: 629060 - RNA, 21 nt, Human
aagggcccaagauucaggacc

SEQ ID NO: 629061 - RNA, 26 nt, Human
aaucauaugccaacaggggaaucgaa

SEQ ID NO: 629062 - RNA, 22 nt, Human
acaacugacaaaaagugucaga

SEQ ID NO: 629063 - RNA, 20 nt, Human
acagagaagaggcaucucga

SEQ ID NO: 629064 - RNA, 26 nt, Human
agacaacugacaaaaagugucagagc

SEQ ID NO: 629065 - RNA, 20 nt, Human
agacagagaagaggcaucuc

SEQ ID NO: 629066 - RNA, 22 nt, Human
agccuaguaaaagaaugaccug

SEQ ID NO: 629067 - RNA, 21 nt, Human
agcgcggcggccgcagcaacc

SEQ ID NO: 629068 - RNA, 25 nt, Human
aggaagacccacagagcuguauuaa

SEQ ID NO: 629069 - RNA, 18 nt, Human
aucuggccuacuuugugg

SEQ ID NO: 629070 - RNA, 23 nt, Human
auuggcuucaaagaaaacacuaa

SEQ ID NO: 629071 - RNA, 23 nt, Human
caaccaaggugcaguauaaacac

SEQ ID NO: 629072 - RNA, 23 nt, Human
cacauaaaauaccaacaucuccc

SEQ ID NO: 629073 - RNA, 24 nt, Human
caccaaaaucuccauuugagauaa

SEQ ID NO: 629074 - RNA, 26 nt, Human
cagagccagaggccaaccucugcuag

SEQ ID NO: 629075 - RNA, 24 nt, Human
ccaccuaaagacaacugacaaaaa

SEQ ID NO: 629076 - RNA, 24 nt, Human
cccuugcucuccaaaagaaguggu

SEQ ID NO: 629077 - RNA, 21 nt, Human
cgaacagaugaaaaaccaaag

SEQ ID NO: 629078 - RNA, 22 nt, Human
cgggaggcggccgucacuuccu

SEQ ID NO: 629079 - RNA, 21 nt, Human
cuaaguagaugaauauaauca

SEQ ID NO: 629080 - RNA, 21 nt, Human
cuacacaguauucacaaucaa

SEQ ID NO: 629081 - RNA, 23 nt, Human
cuacuuuguggugacugacacaa

SEQ ID NO: 629082 - RNA, 25 nt, Human
cucccaccaaaaucuccauuugaga

SEQ ID NO: 629083 - RNA, 19 nt, Human
gaacagaugaaaaaccaaa

SEQ ID NO: 629084 - RNA, 23 nt, Human
gaauauaaucacgauguuuauac

SEQ ID NO: 629085 - RNA, 20 nt, Human
gaccaccuaaagacaacuga

SEQ ID NO: 629086 - RNA, 22 nt, Human
gccggggagcgcggcggccgca

SEQ ID NO: 629087 - RNA, 22 nt, Human
uaaaaaaaacagauuggcuuca

SEQ ID NO: 629088 - RNA, 26 nt, Human
uaaaaacaauuguuuucuccuccucc

SEQ ID NO: 629089 - RNA, 24 nt, Human
uaacagaaugacagaaucauuuau

SEQ ID NO: 629090 - RNA, 21 nt, Human
uaagccuaguaaaagaaugac

SEQ ID NO: 629091 - RNA, 19 nt, Human
uaaggaaaaaaaccuagac

SEQ ID NO: 629092 - RNA, 22 nt, Human
uaaguagaugaauauaaucacg

SEQ ID NO: 629093 - RNA, 23 nt, Human
ucaaaagggcccaagauucagga

SEQ ID NO: 629094 - RNA, 19 nt, Human
uccaaaagaagugguuuaa

SEQ ID NO: 629095 - RNA, 18 nt, Human
ucgggccggggagcgcgg

SEQ ID NO: 629096 - RNA, 26 nt, Human
ugaauauaaucacgauguuuauacag

SEQ ID NO: 629097 - RNA, 25 nt, Human
ugacuucucggacuccagaaguccc

SEQ ID NO: 629098 - RNA, 21 nt, Human
ugagugaaauacaguaaagcc

SEQ ID NO: 629099 - RNA, 21 nt, Human
ugauuuaaaaacaauuguuuu

SEQ ID NO: 629100 - RNA, 22 nt, Human
ugccaaagacaaacuagagcaa

SEQ ID NO: 629101 - RNA, 23 nt, Human
ugcuuuuauacacauaaaauacc

SEQ ID NO: 629102 - RNA, 24 nt, Human
ugguaaguggucaaagcuuguuuu

SEQ ID NO: 629103 - RNA, 21 nt, Human
uguaacagaaugacagaauca

SEQ ID NO: 629104 - RNA, 20 nt, Human
uguaagaacaaggacucuca

SEQ ID NO: 629105 - RNA, 23 nt, Human
uuaacuuaucuggccuacuuugu

SEQ ID NO: 629106 - RNA, 22 nt, Human
uuaauaaccguuauccaaaaau

SEQ ID NO: 629107 - RNA, 18 nt, Human
uuaguaaaaauaaucaua

SEQ ID NO: 629108 - RNA, 24 nt, Human
uucagauacuugguaaguggucaa

SEQ ID NO: 629109 - RNA, 20 nt, Human
uucuugaccuuccccuugcu

SEQ ID NO: 629110 - RNA, 22 nt, Human
uuuauacacauaaaauaccaac

SEQ ID NO: 629111 - RNA, 20 nt, Human
uuuuauaauuacuuucacug

SEQ ID NO: 629112 - RNA, 20 nt, Human
uuuuuuuuuuuuuugccaaa

SEQ ID NO: 629113 - RNA, 18 nt, Human
uuuuuuuuuuuuuuuuug

SEQ ID NO: 629114 - RNA, 22 nt, Human
uuuuuuuuuuuuuuuuugccaa

SEQ ID NO: 629115 - RNA, 21 nt, Human
aaaucagcugcagauguuugg

SEQ ID NO: 629116 - RNA, 20 nt, Human
aaccacaauuagaucucaug

SEQ ID NO: 629117 - RNA, 21 nt, Human
aagucccaguauauuuaaaac

SEQ ID NO: 629118 - RNA, 18 nt, Human
acccacuuacaaugagau

SEQ ID NO: 629119 - RNA, 20 nt, Human
agacacuuccgcccggacca

SEQ ID NO: 629120 - RNA, 19 nt, Human
agauuuaaaggccacaaac

SEQ ID NO: 629121 - RNA, 22 nt, Human
agcauuaacaccgacuuaaaac

SEQ ID NO: 629122 - RNA, 21 nt, Human
aggauacuuccgcccgggcca

SEQ ID NO: 629123 - RNA, 22 nt, Human
aguagacagaacccaaaaagag

SEQ ID NO: 629124 - RNA, 24 nt, Human
auacggcauuucccccgugugaac

SEQ ID NO: 629125 - RNA, 21 nt, Human
auuaaauuucaguagacagaa

SEQ ID NO: 629126 - RNA, 24 nt, Human
caaaucacauaacaugcagaaucc

SEQ ID NO: 629127 - RNA, 18 nt, Human
cacgacguguggcagggc

SEQ ID NO: 629128 - RNA, 23 nt, Human
cacugcuggcacagaggugccuu

SEQ ID NO: 629129 - RNA, 22 nt, Human
cacuuccacgggaccauguguc

SEQ ID NO: 629130 - RNA, 20 nt, Human
cagaacaaaucacauaacau

SEQ ID NO: 629131 - RNA, 22 nt, Human
cagcacuagcgcuccugcuugc

SEQ ID NO: 629132 - RNA, 18 nt, Human
cagccaauaguucaugaa

SEQ ID NO: 629133 - RNA, 23 nt, Human
caggaugcagccaauaguucaug

SEQ ID NO: 629134 - RNA, 21 nt, Human
caguagacagaacccaaaaag

SEQ ID NO: 629135 - RNA, 21 nt, Human
ccaagcacgagcgcuccugcu

SEQ ID NO: 629136 - RNA, 23 nt, Human
ccagggcagggccugucuccgcu

SEQ ID NO: 629137 - RNA, 19 nt, Human
cccgggccacgugucuacc

SEQ ID NO: 629138 - RNA, 21 nt, Human
ccggacauauaaccuuuaaag

SEQ ID NO: 629139 - RNA, 23 nt, Human
ccggaccacgugucugcccuccc

SEQ ID NO: 629140 - RNA, 21 nt, Human
ccucccagcgccagcuccugc

SEQ ID NO: 629141 - RNA, 23 nt, Human
ccucccagcgugagcuccugcuc

SEQ ID NO: 629142 - RNA, 22 nt, Human
cguguccgcccucccagcacua

SEQ ID NO: 629143 - RNA, 22 nt, Human
cgugucugcccucccagcgcca

SEQ ID NO: 629144 - RNA, 20 nt, Human
cucccagcgccagcuccugc

SEQ ID NO: 629145 - RNA, 22 nt, Human
cucccgcuggcugcacagacac

SEQ ID NO: 629146 - RNA, 19 nt, Human
cugcgggaggagcggcugc

SEQ ID NO: 629147 - RNA, 23 nt, Human
gaacagaacaaaucacauaacau

SEQ ID NO: 629148 - RNA, 20 nt, Human
gcauuaacaccgacuuaaaa

SEQ ID NO: 629149 - RNA, 20 nt, Human
gcugcugaaguggcugcggg

SEQ ID NO: 629150 - RNA, 21 nt, Human
gggcagggccugucuccgcuc

SEQ ID NO: 629151 - RNA, 22 nt, Human
gguguagaaugugcgagaggga

SEQ ID NO: 629152 - RNA, 19 nt, Human
uagacagaacccaaaaaga

SEQ ID NO: 629153 - RNA, 21 nt, Human
uagacagaacccaaaaagaga

SEQ ID NO: 629154 - RNA, 24 nt, Human
ucaguagacagaacccaaaaagag

SEQ ID NO: 629155 - RNA, 20 nt, Human
ucucccagggcagggccugu

SEQ ID NO: 629156 - RNA, 22 nt, Human
ucuuggugggcaccuaagcagg

SEQ ID NO: 629157 - RNA, 19 nt, Human
ugaggaguacauucuugcu

SEQ ID NO: 629158 - RNA, 22 nt, Human
ugcgggucuugggagggcugca

SEQ ID NO: 629159 - RNA, 21 nt, Human
uggcugcgggaggagcggcuu

SEQ ID NO: 629160 - RNA, 24 nt, Human
ugggagggcugcagacaggcccuc

SEQ ID NO: 629161 - RNA, 20 nt, Human
ugggcacgacguguggcagg

SEQ ID NO: 629162 - RNA, 24 nt, Human
uguccgcccucccagcacuagcgc

SEQ ID NO: 629163 - RNA, 18 nt, Human
uuuaauuucaaaucagcu

SEQ ID NO: 629164 - RNA, 20 nt, Human
uuuuuuuuuuaaaacaaaua

SEQ ID NO: 629165 - RNA, 19 nt, Human
aaccucgcuucuuccucac

SEQ ID NO: 629166 - RNA, 18 nt, Human
accaaaggggccaggauc

SEQ ID NO: 629167 - RNA, 21 nt, Human
acuucaggauuacuuugauau

SEQ ID NO: 629168 - RNA, 22 nt, Human
caacggcaucugguucaugcug

SEQ ID NO: 629169 - RNA, 23 nt, Human
caagaccagcaaacuguucaacg

SEQ ID NO: 629170 - RNA, 18 nt, Human
caccccugggcggccccu

SEQ ID NO: 629171 - RNA, 23 nt, Human
cagcugaacucuuaaaaagaacc

SEQ ID NO: 629172 - RNA, 23 nt, Human
caucugguucaugcuguggcauc

SEQ ID NO: 629173 - RNA, 19 nt, Human
ccaccccugggcggccccu

SEQ ID NO: 629174 - RNA, 18 nt, Human
ccaggcccauggaggggu

SEQ ID NO: 629175 - RNA, 24 nt, Human
ccaggcccauggaggggugacuaa

SEQ ID NO: 629176 - RNA, 22 nt, Human
cccugucacucagauccaccaa

SEQ ID NO: 629177 - RNA, 23 nt, Human
cgcuucuuccucacggugcucca

SEQ ID NO: 629178 - RNA, 20 nt, Human
cuuaaaaagaaccucgcuuc

SEQ ID NO: 629179 - RNA, 21 nt, Human
gacccugucacucagauccac

SEQ ID NO: 629180 - RNA, 23 nt, Human
gauacuucaggauuacuuugaua

SEQ ID NO: 629181 - RNA, 20 nt, Human
gccaggauccaccccugggc

SEQ ID NO: 629182 - RNA, 23 nt, Human
gccaggauccaccccugggcggc

SEQ ID NO: 629183 - RNA, 19 nt, Human
ggugacuaaggcaggaaga

SEQ ID NO: 629184 - RNA, 18 nt, Human
guggcauccacagccacc

SEQ ID NO: 629185 - RNA, 19 nt, Human
uauuuuguucugauacuuc

SEQ ID NO: 629186 - RNA, 20 nt, Human
ucugguucaugcuguggcau

SEQ ID NO: 629187 - RNA, 19 nt, Human
ugaaaagcuccuguuuuca

SEQ ID NO: 629188 - RNA, 20 nt, Human
uggggaguuaccaccugaaa

SEQ ID NO: 629189 - RNA, 20 nt, Human
uguggcauccacagccaccu

SEQ ID NO: 629190 - RNA, 20 nt, Human
uuagcaccaggcccauggag

SEQ ID NO: 629191 - RNA, 21 nt, Human
uucugccaggcaagaccagca

SEQ ID NO: 629192 - RNA, 28 nt, Human
uuuuuuuuuuuugaggguaggggguguc

SEQ ID NO: 629193 - RNA, 18 nt, Human
uuuuuuuuuuuuugaggg

SEQ ID NO: 629194 - RNA, 27 nt, Human
uuuuuuuuuuuuuuuuugaggguaggg

SEQ ID NO: 629195 - RNA, 28 nt, Human
uuuuuuuuuuuuuuuuuuuuuuugaggg

SEQ ID NO: 629196 - RNA, 24 nt, Human
aaaaacgcaaaggaaaaagauggc

SEQ ID NO: 629197 - RNA, 19 nt, Human
aaccgaaccucccgccgcc

SEQ ID NO: 629198 - RNA, 21 nt, Human
aagaaaagauacaaugcagga

SEQ ID NO: 629199 - RNA, 24 nt, Human
aagacagccccugccaagaaccag

SEQ ID NO: 629200 - RNA, 22 nt, Human
aagcacagcaggcuucugggaa

SEQ ID NO: 629201 - RNA, 19 nt, Human
aaggaucuugucuuugaug

SEQ ID NO: 629202 - RNA, 18 nt, Human
aaguccacaagaacaauu

SEQ ID NO: 629203 - RNA, 20 nt, Human
acaccaggccgaacaaagca

SEQ ID NO: 629204 - RNA, 20 nt, Human
acagugccuagaaaccaagg

SEQ ID NO: 629205 - RNA, 21 nt, Human
accucccgccgccgucgccgc

SEQ ID NO: 629206 - RNA, 28 nt, Human
agaaacaaugggcagaaagccgguaccc

SEQ ID NO: 629207 - RNA, 20 nt, Human
agaaacaguaagaaaagaua

SEQ ID NO: 629208 - RNA, 24 nt, Human
agaaacugcauucggugggucuuu

SEQ ID NO: 629209 - RNA, 18 nt, Human
agcaggggacuacaugug

SEQ ID NO: 629210 - RNA, 23 nt, Human
agcaugguccguucaccaacgcc

SEQ ID NO: 629211 - RNA, 22 nt, Human
agggagcugcaggcccagucag

SEQ ID NO: 629212 - RNA, 22 nt, Human
aggugguccuggagggaaaaug

SEQ ID NO: 629213 - RNA, 20 nt, Human
augguccguucaccaacgcc

SEQ ID NO: 629214 - RNA, 24 nt, Human
caaagcacagugauuucuucccuu

SEQ ID NO: 629215 - RNA, 20 nt, Human
caacgggcgacaaccgaacc

SEQ ID NO: 629216 - RNA, 21 nt, Human
caagaaacuaguaagaaacaa

SEQ ID NO: 629217 - RNA, 22 nt, Human
caagaacaauucaagaaacuag

SEQ ID NO: 629218 - RNA, 19 nt, Human
caccaaccauccuugcaca

SEQ ID NO: 629219 - RNA, 21 nt, Human
caccaaccauccuugcacacc

SEQ ID NO: 629220 - RNA, 19 nt, Human
caccugccacaguucacau

SEQ ID NO: 629221 - RNA, 23 nt, Human
cagaaacugcauucggugggucu

SEQ ID NO: 629222 - RNA, 23 nt, Human
cagaaagcugugggacgaaagca

SEQ ID NO: 629223 - RNA, 24 nt, Human
cagcaggcuucugggaggcuggag

SEQ ID NO: 629224 - RNA, 19 nt, Human
caggaaaaccaccaaccau

SEQ ID NO: 629225 - RNA, 22 nt, Human
cagucaagcagaaacugcauuc

SEQ ID NO: 629226 - RNA, 19 nt, Human
cagugaagagggaguugga

SEQ ID NO: 629227 - RNA, 22 nt, Human
cauccuugcacaccaggccgaa

SEQ ID NO: 629228 - RNA, 18 nt, Human
ccacaaauaacaucucac

SEQ ID NO: 629229 - RNA, 19 nt, Human
cccacccccacccuaauuc

SEQ ID NO: 629230 - RNA, 22 nt, Human
cccacccccacccuaauuccca

SEQ ID NO: 629231 - RNA, 22 nt, Human
cccaggucagagcuacggaagc

SEQ ID NO: 629232 - RNA, 18 nt, Human
cccauauucccauccaca

SEQ ID NO: 629233 - RNA, 21 nt, Human
cccauccacaucaguuuaaau

SEQ ID NO: 629234 - RNA, 23 nt, Human
ccccacccccacccuaauuccca

SEQ ID NO: 629235 - RNA, 22 nt, Human
cccccacccccacccuaauucc

SEQ ID NO: 629236 - RNA, 22 nt, Human
cccucucaucccauuuauuaaa

SEQ ID NO: 629237 - RNA, 21 nt, Human
cccuucaucccccacccccac

SEQ ID NO: 629238 - RNA, 18 nt, Human
ccgccgccgucgccgccg

SEQ ID NO: 629239 - RNA, 18 nt, Human
ccgccgucgccgccgccg

SEQ ID NO: 629240 - RNA, 21 nt, Human
ccgccgucgccgccgccgcga

SEQ ID NO: 629241 - RNA, 23 nt, Human
ccucccgccgccgucgccgccgc

SEQ ID NO: 629242 - RNA, 20 nt, Human
ccucuaagucccaggagaag

SEQ ID NO: 629243 - RNA, 21 nt, Human
cgaaccucccgccgccgucgc

SEQ ID NO: 629244 - RNA, 23 nt, Human
cuccacaacuacccuuuuaccua

SEQ ID NO: 629245 - RNA, 23 nt, Human
cucuaagucccaggagaagggag

SEQ ID NO: 629246 - RNA, 19 nt, Human
gaggaaaaguccacaagaa

SEQ ID NO: 629247 - RNA, 26 nt, Human
gaggaaaaguccacaagaacaauuca

SEQ ID NO: 629248 - RNA, 19 nt, Human
gauugggaguaccagugaa

SEQ ID NO: 629249 - RNA, 18 nt, Human
gcaggaaaaccaccaacc

SEQ ID NO: 629250 - RNA, 19 nt, Human
gcuuggggcggguuuugaa

SEQ ID NO: 629251 - RNA, 18 nt, Human
ggaaaaccaccaaccauc

SEQ ID NO: 629252 - RNA, 18 nt, Human
uaagacagccccugccaa

SEQ ID NO: 629253 - RNA, 24 nt, Human
uaagacagccccugccaagaacca

SEQ ID NO: 629254 - RNA, 18 nt, Human
uauggcaguagaggauga

SEQ ID NO: 629255 - RNA, 21 nt, Human
ucaagaaaaacgcaaaggaaa

SEQ ID NO: 629256 - RNA, 27 nt, Human
ucacaugccacaaauaacaucucaccu

SEQ ID NO: 629257 - RNA, 21 nt, Human
uccacaacuacccuuuuaccu

SEQ ID NO: 629258 - RNA, 24 nt, Human
ucccgccgccgucgccgccgccgg

SEQ ID NO: 629259 - RNA, 23 nt, Human
uccuugcacaccaggccgaacaa

SEQ ID NO: 629260 - RNA, 26 nt, Human
ucugggaggcuggagauccuuucucu

SEQ ID NO: 629261 - RNA, 20 nt, Human
ugauuucuucccuucauccc

SEQ ID NO: 629262 - RNA, 19 nt, Human
ugcaauggcggccgccgag

SEQ ID NO: 629263 - RNA, 21 nt, Human
ugccaagaaccacagugccua

SEQ ID NO: 629264 - RNA, 20 nt, Human
ugggaggcuggagauccuuu

SEQ ID NO: 629265 - RNA, 19 nt, Human
ugguccuggagggaaaaug

SEQ ID NO: 629266 - RNA, 21 nt, Human
ugucaccagguaccgggugcc

SEQ ID NO: 629267 - RNA, 26 nt, Human
uucaucccccacccccacccuaauuc

SEQ ID NO: 629268 - RNA, 22 nt, Human
uucccuucaucccccaccccca

SEQ ID NO: 629269 - RNA, 21 nt, Human
uugauugggaguaccagugaa

SEQ ID NO: 629270 - RNA, 22 nt, Human
uuucuuggggacgcuggugaua

SEQ ID NO: 629271 - RNA, 21 nt, Human
acacagcuucaggagucaggg

SEQ ID NO: 629272 - RNA, 27 nt, Human
acuacaacucccagaaagcuuugcgcu

SEQ ID NO: 629273 - RNA, 20 nt, Human
agacggccuccuugaugagc

SEQ ID NO: 629274 - RNA, 19 nt, Human
agucguggcagguggcccu

SEQ ID NO: 629275 - RNA, 19 nt, Human
cacagcuucaggagucagg

SEQ ID NO: 629276 - RNA, 21 nt, Human
cacauccuaagcccaugcucc

SEQ ID NO: 629277 - RNA, 18 nt, Human
cagcagcguggcgggccc

SEQ ID NO: 629278 - RNA, 26 nt, Human
ccacagacacagcuucaggagucagg

SEQ ID NO: 629279 - RNA, 22 nt, Human
ccagcagcguggcgggcccgag

SEQ ID NO: 629280 - RNA, 21 nt, Human
cccauccgcuacuucccgaaa

SEQ ID NO: 629281 - RNA, 20 nt, Human
cgauaccacggauaccuuua

SEQ ID NO: 629282 - RNA, 23 nt, Human
cgcucaggcgggcuccuguccgu

SEQ ID NO: 629283 - RNA, 20 nt, Human
cggcccagcagucguggcag

SEQ ID NO: 629284 - RNA, 22 nt, Human
cucccuggcauucacauccuaa

SEQ ID NO: 629285 - RNA, 21 nt, Human
cuuugcgcucaggcgggcucc

SEQ ID NO: 629286 - RNA, 20 nt, Human
gagccgggccaggcggccca

SEQ ID NO: 629287 - RNA, 21 nt, Human
ggcccagcagucguggcaggu

SEQ ID NO: 629288 - RNA, 24 nt, Human
ggcgggcuccuguccguagaagcc

SEQ ID NO: 629289 - RNA, 19 nt, Human
gggauaagaacuacaacuc

SEQ ID NO: 629290 - RNA, 18 nt, Human
gggcccgaggggcggcag

SEQ ID NO: 629291 - RNA, 19 nt, Human
gggcccgaggggcggcagg

SEQ ID NO: 629292 - RNA, 22 nt, Human
uauugcucccuggcauucacau

SEQ ID NO: 629293 - RNA, 21 nt, Human
ucccauccgcuacuucccgaa

SEQ ID NO: 629294 - RNA, 18 nt, Human
ucuggcugacggucucca

SEQ ID NO: 629295 - RNA, 19 nt, Human
ugcgcucaggcgggcuccu

SEQ ID NO: 629296 - RNA, 21 nt, Human
ugcucccaccgucccauccgc

SEQ ID NO: 629297 - RNA, 19 nt, Human
uggcagguggcccagcucc

SEQ ID NO: 629298 - RNA, 20 nt, Human
uggccgcagcuccacagaca

SEQ ID NO: 629299 - RNA, 23 nt, Human
uggcgggcccgaggggcggcagg

SEQ ID NO: 629300 - RNA, 19 nt, Human
uuuuuuuuuugccgauacc

SEQ ID NO: 629301 - RNA, 19 nt, Human
uuuuuuuuuuuuuugccga

SEQ ID NO: 629302 - RNA, 18 nt, Human
uuuuuuuuuuuuuuuuug

SEQ ID NO: 629303 - RNA, 22 nt, Human
uuuuuuuuuuuuuuuuugccga

SEQ ID NO: 629304 - RNA, 23 nt, Human
uuuuuuuuuuuuuuuuugccgau

SEQ ID NO: 629305 - RNA, 20 nt, Human
cccggggaccugggacuggc

SEQ ID NO: 629306 - RNA, 23 nt, Human
ccgcggcugucagagcggccagg

SEQ ID NO: 629307 - RNA, 24 nt, Human
cgcugucagcugugaggcggggcg

SEQ ID NO: 629308 - RNA, 19 nt, Human
gcaggccaggaaggucuuu

SEQ ID NO: 629309 - RNA, 22 nt, Human
gcccacggccagggguccucag

SEQ ID NO: 629310 - RNA, 20 nt, Human
gcgggccuucucuggagccc

SEQ ID NO: 629311 - RNA, 23 nt, Human
gggcggggcgggggacgggccuc

SEQ ID NO: 629312 - RNA, 23 nt, Human
ggggcggggcgggggacgggccu

SEQ ID NO: 629313 - RNA, 23 nt, Human
ugaagccgaggcccaagcccacg

SEQ ID NO: 629314 - RNA, 20 nt, Human
ugaagccgaggcccaagccu

SEQ ID NO: 629315 - RNA, 20 nt, Human
ugucuggggcaggccaggaa

SEQ ID NO: 629316 - RNA, 18 nt, Human
uuuuuuuuuuuuuuuucg

SEQ ID NO: 629317 - RNA, 23 nt, Human
uuuuuuuuuuuuuuuuucgcuuu

SEQ ID NO: 629318 - RNA, 19 nt, Human
aagacguugucuuccagga

SEQ ID NO: 629319 - RNA, 23 nt, Human
aagugcucggauuacaggcauga

SEQ ID NO: 629320 - RNA, 19 nt, Human
accaaaucaaugucucugc

SEQ ID NO: 629321 - RNA, 20 nt, Human
accaucuaucggacagggag

SEQ ID NO: 629322 - RNA, 18 nt, Human
accccagggauccaggaa

SEQ ID NO: 629323 - RNA, 24 nt, Human
accuugugauccgcccgccucagc

SEQ ID NO: 629324 - RNA, 18 nt, Human
acggaguuucaccguguu

SEQ ID NO: 629325 - RNA, 20 nt, Human
acggaguuucaccguguuag

SEQ ID NO: 629326 - RNA, 24 nt, Human
acggaguuucaccguguuagccag

SEQ ID NO: 629327 - RNA, 23 nt, Human
agaagacguugucuuccaggaug

SEQ ID NO: 629328 - RNA, 21 nt, Human
agaguccaguuuccuucuucu

SEQ ID NO: 629329 - RNA, 22 nt, Human
agcacagcacccgccaaagaca

SEQ ID NO: 629330 - RNA, 24 nt, Human
agcccacgcuggagugcaguggcg

SEQ ID NO: 629331 - RNA, 18 nt, Human
aggcccggcucugcccag

SEQ ID NO: 629332 - RNA, 19 nt, Human
aggcuggugucucucacuc

SEQ ID NO: 629333 - RNA, 22 nt, Human
aggggucaggggcuggaguggg

SEQ ID NO: 629334 - RNA, 24 nt, Human
aggguaagaguccaguuuccuucu

SEQ ID NO: 629335 - RNA, 18 nt, Human
agguggucaggggucagg

SEQ ID NO: 629336 - RNA, 18 nt, Human
aguagcugggacuacagg

SEQ ID NO: 629337 - RNA, 19 nt, Human
aguagcugggacuacaggc

SEQ ID NO: 629338 - RNA, 22 nt, Human
aguccuuuccccgcggcuuguu

SEQ ID NO: 629339 - RNA, 20 nt, Human
agugcaguggcgcaaucucg

SEQ ID NO: 629340 - RNA, 24 nt, Human
agugcaguggcgcaaucucggcuc

SEQ ID NO: 629341 - RNA, 25 nt, Human
augauaaugaaaccaaaucaauguc

SEQ ID NO: 629342 - RNA, 20 nt, Human
auucauuugcagggauugag

SEQ ID NO: 629343 - RNA, 21 nt, Human
auucuccugccucagccuccc

SEQ ID NO: 629344 - RNA, 19 nt, Human
cacagcacccgccaaagac

SEQ ID NO: 629345 - RNA, 24 nt, Human
caccauggcguuagggccacagcc

SEQ ID NO: 629346 - RNA, 18 nt, Human
caccguguuagccaggau

SEQ ID NO: 629347 - RNA, 24 nt, Human
caccguguuagccaggauggucuc

SEQ ID NO: 629348 - RNA, 22 nt, Human
cacgccauucuccugccucagc

SEQ ID NO: 629349 - RNA, 24 nt, Human
cacucuguagcccacgcuggagug

SEQ ID NO: 629350 - RNA, 20 nt, Human
cacugugacuucaaaggucc

SEQ ID NO: 629351 - RNA, 18 nt, Human
cagcugggacgggaccag

SEQ ID NO: 629352 - RNA, 20 nt, Human
cagcugggacgggaccagca

SEQ ID NO: 629353 - RNA, 24 nt, Human
caguagacaccacggccuucaagc

SEQ ID NO: 629354 - RNA, 18 nt, Human
ccaccgcgcccggccgcc

SEQ ID NO: 629355 - RNA, 26 nt, Human
ccagcaccaucuaucggacagggagu

SEQ ID NO: 629356 - RNA, 22 nt, Human
ccagcagugcaugcggcucugg

SEQ ID NO: 629357 - RNA, 21 nt, Human
ccagcguucuuugccaacgcc

SEQ ID NO: 629358 - RNA, 20 nt, Human
cccacgcuggagugcagugg

SEQ ID NO: 629359 - RNA, 21 nt, Human
cccagcucccugcagcugcgc

SEQ ID NO: 629360 - RNA, 21 nt, Human
cccaugugccaggcccggcuc

SEQ ID NO: 629361 - RNA, 23 nt, Human
cccgaguagcugggacuacaggc

SEQ ID NO: 629362 - RNA, 24 nt, Human
cccgaguagcugggacuacaggcg

SEQ ID NO: 629363 - RNA, 21 nt, Human
cccggcccucucuccgcuggu

SEQ ID NO: 629364 - RNA, 25 nt, Human
cccggcccucucuccgcugguuuuc

SEQ ID NO: 629365 - RNA, 21 nt, Human
cccugaguuccggccuggcuc

SEQ ID NO: 629366 - RNA, 19 nt, Human
ccgaagugcucggauuaca

SEQ ID NO: 629367 - RNA, 24 nt, Human
ccgaagugcucggauuacaggcau

SEQ ID NO: 629368 - RNA, 24 nt, Human
ccucccugguucacgccauucucc

SEQ ID NO: 629369 - RNA, 22 nt, Human
ccuccugccccaugugccaggc

SEQ ID NO: 629370 - RNA, 23 nt, Human
ccugccucagccucccgaguagc

SEQ ID NO: 629371 - RNA, 24 nt, Human
ccugccucagccucccgaguagcu

SEQ ID NO: 629372 - RNA, 19 nt, Human
ccugugggggagccuuucc

SEQ ID NO: 629373 - RNA, 20 nt, Human
cgaggacccuggcagcggcc

SEQ ID NO: 629374 - RNA, 24 nt, Human
cggaguuucaccguguuagccagg

SEQ ID NO: 629375 - RNA, 20 nt, Human
cggauuacaggcaugagcca

SEQ ID NO: 629376 - RNA, 23 nt, Human
cggauuacaggcaugagccaccg

SEQ ID NO: 629377 - RNA, 23 nt, Human
cggccgggcuccaccugugcacc

SEQ ID NO: 629378 - RNA, 28 nt, Human
cuaauuuuuuaauauuuuuuaguagaga

SEQ ID NO: 629379 - RNA, 24 nt, Human
cucagccucccgaguagcugggac

SEQ ID NO: 629380 - RNA, 24 nt, Human
cuccugaccuugugauccgcccgc

SEQ ID NO: 629381 - RNA, 20 nt, Human
cucggauuacaggcaugagc

SEQ ID NO: 629382 - RNA, 23 nt, Human
cugaggacccugggccuuccugg

SEQ ID NO: 629383 - RNA, 19 nt, Human
cuggcagcggccgucuccu

SEQ ID NO: 629384 - RNA, 25 nt, Human
cuggcaguggaggcuggugucucuc

SEQ ID NO: 629385 - RNA, 21 nt, Human
cuguagcccacgcuggagugc

SEQ ID NO: 629386 - RNA, 21 nt, Human
cuuccuggcaguggaggcugg

SEQ ID NO: 629387 - RNA, 19 nt, Human
cuuucccggcccucucucc

SEQ ID NO: 629388 - RNA, 24 nt, Human
gaccuugugauccgcccgccucag

SEQ ID NO: 629389 - RNA, 25 nt, Human
gagcugcuuaucccagcaccaucua

SEQ ID NO: 629390 - RNA, 19 nt, Human
gaggacccugggccuuccu

SEQ ID NO: 629391 - RNA, 25 nt, Human
gaguagcugggacuacaggcggcca

SEQ ID NO: 629392 - RNA, 18 nt, Human
gauuacaggcaugagcca

SEQ ID NO: 629393 - RNA, 22 nt, Human
gauuacaggcaugagccaccgc

SEQ ID NO: 629394 - RNA, 22 nt, Human
gauuacaggcaugagccaccgc

SEQ ID NO: 629395 - RNA, 20 nt, Human
gcagcugcgccagugugugc

SEQ ID NO: 629396 - RNA, 20 nt, Human
gcaguggaggcuggugucuc

SEQ ID NO: 629397 - RNA, 24 nt, Human
gcccauuuuuuaaugggguuguuu

SEQ ID NO: 629398 - RNA, 24 nt, Human
gccucagcuucccgaagugcucgg

SEQ ID NO: 629399 - RNA, 23 nt, Human
gccugggagggggcuggagggug

SEQ ID NO: 629400 - RNA, 18 nt, Human
gccuuccuggcaguggag

SEQ ID NO: 629401 - RNA, 20 nt, Human
gcucacugcaagcuccuccu

SEQ ID NO: 629402 - RNA, 22 nt, Human
gcucacugcaagcuccuccucc

SEQ ID NO: 629403 - RNA, 19 nt, Human
gcuggagugcaguggcgca

SEQ ID NO: 629404 - RNA, 18 nt, Human
ggaaauggccauucuagg

SEQ ID NO: 629405 - RNA, 23 nt, Human
ggaccagcagugcaugcggcucu

SEQ ID NO: 629406 - RNA, 19 nt, Human
ggagccuuucccggcccuc

SEQ ID NO: 629407 - RNA, 23 nt, Human
ggaggcucccuuacagaagugaa

SEQ ID NO: 629408 - RNA, 21 nt, Human
ggauuacaggcaugagccacc

SEQ ID NO: 629409 - RNA, 22 nt, Human
ggauuacaggcaugagccaccg

SEQ ID NO: 629410 - RNA, 18 nt, Human
gggcuggaggguguggug

SEQ ID NO: 629411 - RNA, 18 nt, Human
ggggauggcgccucaggg

SEQ ID NO: 629412 - RNA, 19 nt, Human
ggucucgaucuccugaccu

SEQ ID NO: 629413 - RNA, 20 nt, Human
ggucucgaucuccugaccuu

SEQ ID NO: 629414 - RNA, 24 nt, Human
gugauccgcccgccucagcuuccc

SEQ ID NO: 629415 - RNA, 19 nt, Human
guggaacugcagguucucu

SEQ ID NO: 629416 - RNA, 26 nt, Human
uaauuuuuuaauauuuuuuaguagag

SEQ ID NO: 629417 - RNA, 27 nt, Human
uaauuuuuuaauauuuuuuaguagaga

SEQ ID NO: 629418 - RNA, 23 nt, Human
uacaggcaugagccaccgcgccc

SEQ ID NO: 629419 - RNA, 23 nt, Human
uagcacagcacccgccaaagaca

SEQ ID NO: 629420 - RNA, 24 nt, Human
uagggccacagccuccugccccau

SEQ ID NO: 629421 - RNA, 21 nt, Human
uaguagagacggaguuucacc

SEQ ID NO: 629422 - RNA, 24 nt, Human
uaguagagacggaguuucaccgug

SEQ ID NO: 629423 - RNA, 25 nt, Human
uaguagagacggaguuucaccgugu

SEQ ID NO: 629424 - RNA, 23 nt, Human
uaguuugcagacauuuucuccca

SEQ ID NO: 629425 - RNA, 24 nt, Human
ucaaucggguccaaaguaaaaaua

SEQ ID NO: 629426 - RNA, 24 nt, Human
ucaccguguuagccaggauggucu

SEQ ID NO: 629427 - RNA, 21 nt, Human
ucacucuguagcccacgcugg

SEQ ID NO: 629428 - RNA, 22 nt, Human
ucacucuguagcccacgcugga

SEQ ID NO: 629429 - RNA, 24 nt, Human
ucacugcaagcuccuccucccugg

SEQ ID NO: 629430 - RNA, 23 nt, Human
ucagccucccgaguagcugggac

SEQ ID NO: 629431 - RNA, 19 nt, Human
ucaggggcuggagugggga

SEQ ID NO: 629432 - RNA, 19 nt, Human
ucaggugccuaucggccgg

SEQ ID NO: 629433 - RNA, 18 nt, Human
ucauuugcagggauugag

SEQ ID NO: 629434 - RNA, 19 nt, Human
ucccgaagugcucggauua

SEQ ID NO: 629435 - RNA, 24 nt, Human
ucccgaagugcucggauuacaggc

SEQ ID NO: 629436 - RNA, 24 nt, Human
ucccgaguagcugggacuacaggc

SEQ ID NO: 629437 - RNA, 22 nt, Human
ucccugaguuccggccuggcuc

SEQ ID NO: 629438 - RNA, 24 nt, Human
ucccugguucacgccauucuccug

SEQ ID NO: 629439 - RNA, 21 nt, Human
uccgcccgccucagcuucccg

SEQ ID NO: 629440 - RNA, 24 nt, Human
uccuugauacugaaaaggggcguu

SEQ ID NO: 629441 - RNA, 18 nt, Human
ucggauuacaggcaugag

SEQ ID NO: 629442 - RNA, 22 nt, Human
ucggauuacaggcaugagccac

SEQ ID NO: 629443 - RNA, 24 nt, Human
ucggauuacaggcaugagccaccg

SEQ ID NO: 629444 - RNA, 19 nt, Human
ucucccauucuguagggug

SEQ ID NO: 629445 - RNA, 23 nt, Human
ucucccauucuguagggugucug

SEQ ID NO: 629446 - RNA, 24 nt, Human
ucuccugccucagccucccgagua

SEQ ID NO: 629447 - RNA, 22 nt, Human
ucugccugugacugagcugcuu

SEQ ID NO: 629448 - RNA, 21 nt, Human
ucuggauaccaaggagcaagg

SEQ ID NO: 629449 - RNA, 24 nt, Human
ucuguagcccacgcuggagugcag

SEQ ID NO: 629450 - RNA, 20 nt, Human
ugaaaccaaaucaaugucuc

SEQ ID NO: 629451 - RNA, 23 nt, Human
ugacugagcugcuuaucccagca

SEQ ID NO: 629452 - RNA, 18 nt, Human
ugacuucaaagguccccg

SEQ ID NO: 629453 - RNA, 24 nt, Human
ugagucagucccauuguuccgugu

SEQ ID NO: 629454 - RNA, 22 nt, Human
ugcaguggcgcaaucucggcuc

SEQ ID NO: 629455 - RNA, 23 nt, Human
ugcaguggcgcaaucucggcuca

SEQ ID NO: 629456 - RNA, 21 nt, Human
ugccaggcccggcucugccca

SEQ ID NO: 629457 - RNA, 24 nt, Human
ugccucagccucccgaguagcugg

SEQ ID NO: 629458 - RNA, 20 nt, Human
ugccucucaguagacaccac

SEQ ID NO: 629459 - RNA, 23 nt, Human
ugccucucaguagacaccacggc

SEQ ID NO: 629460 - RNA, 19 nt, Human
ugccugugacugagcugcu

SEQ ID NO: 629461 - RNA, 20 nt, Human
uggaacugcagguucucucc

SEQ ID NO: 629462 - RNA, 23 nt, Human
uggagugcaguggcgcaaucucg

SEQ ID NO: 629463 - RNA, 24 nt, Human
uggagugcaguggcgcaaucucgg

SEQ ID NO: 629464 - RNA, 22 nt, Human
uggauucauguuuguugaauga

SEQ ID NO: 629465 - RNA, 20 nt, Human
ugggacgggaccagcagugc

SEQ ID NO: 629466 - RNA, 21 nt, Human
ugggacuacaggcggccacca

SEQ ID NO: 629467 - RNA, 25 nt, Human
ugggagggggcuggaggguguggug

SEQ ID NO: 629468 - RNA, 20 nt, Human
uggucccugaggacccuggg

SEQ ID NO: 629469 - RNA, 19 nt, Human
ugguucacgccauucuccu

SEQ ID NO: 629470 - RNA, 18 nt, Human
uguaugugugcagcuuca

SEQ ID NO: 629471 - RNA, 24 nt, Human
ugugauccgcccgccucagcuucc

SEQ ID NO: 629472 - RNA, 21 nt, Human
ugugcagcuucaugucugagu

SEQ ID NO: 629473 - RNA, 23 nt, Human
ugugcugugacucgugcuccugg

SEQ ID NO: 629474 - RNA, 21 nt, Human
uguggccgccucacugugacu

SEQ ID NO: 629475 - RNA, 18 nt, Human
uuaguagagacggaguuu

SEQ ID NO: 629476 - RNA, 22 nt, Human
uuaguagagacggaguuucacc

SEQ ID NO: 629477 - RNA, 24 nt, Human
uuaguagagacggaguuucaccgu

SEQ ID NO: 629478 - RNA, 21 nt, Human
uuggcaguuucuucugcugug

SEQ ID NO: 629479 - RNA, 19 nt, Human
uuucaccguguuagccagg

SEQ ID NO: 629480 - RNA, 24 nt, Human
uuucacucuguagcccacgcugga

SEQ ID NO: 629481 - RNA, 19 nt, Human
uuugcagacauuuucuccc

SEQ ID NO: 629482 - RNA, 23 nt, Human
uuuuuguuuuuguugcaauugcu

SEQ ID NO: 629483 - RNA, 26 nt, Human
uuuuuuaauauuuuuuaguagagacg

SEQ ID NO: 629484 - RNA, 18 nt, Human
uuuuuuaguagagacgga

SEQ ID NO: 629485 - RNA, 25 nt, Human
uuuuuuaguagagacggaguuucac

SEQ ID NO: 629486 - RNA, 20 nt, Human
uuuuuuuuuuugagacagag

SEQ ID NO: 629487 - RNA, 26 nt, Human
uuuuuuuuuuuugagacagaguuuca

SEQ ID NO: 629488 - RNA, 19 nt, Human
aaagagcagugucuucugc

SEQ ID NO: 629489 - RNA, 19 nt, Human
aagucacuuagggaaacag

SEQ ID NO: 629490 - RNA, 21 nt, Human
acagcagaagaaagcucauac

SEQ ID NO: 629491 - RNA, 21 nt, Human
acuuuaagagacaaucaggaa

SEQ ID NO: 629492 - RNA, 23 nt, Human
aggcacagccaggagaggucagc

SEQ ID NO: 629493 - RNA, 23 nt, Human
aucuuacaaaaaauuaaccugga

SEQ ID NO: 629494 - RNA, 24 nt, Human
augaugagggcaauaauaaaagga

SEQ ID NO: 629495 - RNA, 22 nt, Human
caauaauaaaaggagaaauccu

SEQ ID NO: 629496 - RNA, 26 nt, Human
caguaagauaggacucuggagucaca

SEQ ID NO: 629497 - RNA, 24 nt, Human
ccaguagucaguaggucuguugca

SEQ ID NO: 629498 - RNA, 18 nt, Human
ccuacagcuuucucucca

SEQ ID NO: 629499 - RNA, 24 nt, Human
cuccaagccuuuuuguagcucaga

SEQ ID NO: 629500 - RNA, 22 nt, Human
cuccugguccuagacauggguc

SEQ ID NO: 629501 - RNA, 18 nt, Human
cugaagguagcaguauua

SEQ ID NO: 629502 - RNA, 22 nt, Human
cugacuccugguccuagacaug

SEQ ID NO: 629503 - RNA, 23 nt, Human
gaacaggaagacccugguuuccu

SEQ ID NO: 629504 - RNA, 22 nt, Human
gagaaaucuuacaaaaaauuaa

SEQ ID NO: 629505 - RNA, 21 nt, Human
gcacagccaggagaggucagc

SEQ ID NO: 629506 - RNA, 19 nt, Human
gcagaagaaagcucauaca

SEQ ID NO: 629507 - RNA, 19 nt, Human
gcccugaagguagcaguau

SEQ ID NO: 629508 - RNA, 24 nt, Human
ggcuggguuacaaagagcaguguc

SEQ ID NO: 629509 - RNA, 24 nt, Human
guaggucuguugcaaagucaggga

SEQ ID NO: 629510 - RNA, 19 nt, Human
guuugcuuuuugguggugg

SEQ ID NO: 629511 - RNA, 19 nt, Human
uagacaugggucuuaagau

SEQ ID NO: 629512 - RNA, 20 nt, Human
uccacagcagaagaaagcuc

SEQ ID NO: 629513 - RNA, 20 nt, Human
ugaggaacuuaaucugacag

SEQ ID NO: 629514 - RNA, 20 nt, Human
ugcuaggaacaggaagaccc

SEQ ID NO: 629515 - RNA, 20 nt, Human
uggagucacaggcacagcca

SEQ ID NO: 629516 - RNA, 22 nt, Human
uggauccuacagcuuucucucc

SEQ ID NO: 629517 - RNA, 18 nt, Human
uggcuagaucucuccaca

SEQ ID NO: 629518 - RNA, 24 nt, Human
uuagggaaacagauucaguauuau

SEQ ID NO: 629519 - RNA, 21 nt, Human
uuggugguggcuggguuacaa

SEQ ID NO: 629520 - RNA, 18 nt, Human
uuuuuuuuuuuuggaggg

SEQ ID NO: 629521 - RNA, 19 nt, Human
uuuuuuuuuuuuuuggagg

SEQ ID NO: 629522 - RNA, 24 nt, Human
uuuuuuuuuuuuuuuuuuggaggg

SEQ ID NO: 629523 - RNA, 23 nt, Human
aaaaacaaagucugauuucucuc

SEQ ID NO: 629524 - RNA, 26 nt, Human
aaacaucuugaaagacuauugaauuc

SEQ ID NO: 629525 - RNA, 24 nt, Human
aaggagcacauuucaucaggcuua

SEQ ID NO: 629526 - RNA, 25 nt, Human
aaguuuguuuuguggguuuuuuucc

SEQ ID NO: 629527 - RNA, 22 nt, Human
acaaagucccugaugcccacca

SEQ ID NO: 629528 - RNA, 18 nt, Human
agccuuaggaaaggaaag

SEQ ID NO: 629529 - RNA, 22 nt, Human
agccuuaggaaaggaaagaaac

SEQ ID NO: 629530 - RNA, 19 nt, Human
aggagcaaacugagaucca

SEQ ID NO: 629531 - RNA, 21 nt, Human
aggggccauggccaggucccc

SEQ ID NO: 629532 - RNA, 19 nt, Human
aguacaggggcacugaagg

SEQ ID NO: 629533 - RNA, 21 nt, Human
agucugauuucucuccucaga

SEQ ID NO: 629534 - RNA, 23 nt, Human
auggccagguccccacuugcucc

SEQ ID NO: 629535 - RNA, 22 nt, Human
cacacggcccgugggcccgccc

SEQ ID NO: 629536 - RNA, 22 nt, Human
caccaccauggggcugaacgaa

SEQ ID NO: 629537 - RNA, 20 nt, Human
cacccggcgggccagaccag

SEQ ID NO: 629538 - RNA, 24 nt, Human
cacuugcuccccucccuuuggccu

SEQ ID NO: 629539 - RNA, 19 nt, Human
cagaccaaacguguuuugc

SEQ ID NO: 629540 - RNA, 24 nt, Human
cagaccaaacguguuuugcuguga

SEQ ID NO: 629541 - RNA, 19 nt, Human
cagcacuugugaacuccca

SEQ ID NO: 629542 - RNA, 19 nt, Human
cagcuaaaccuuggcaaau

SEQ ID NO: 629543 - RNA, 24 nt, Human
cauggccagguccccacuugcucc

SEQ ID NO: 629544 - RNA, 22 nt, Human
ccaggccccacacggcccgugg

SEQ ID NO: 629545 - RNA, 18 nt, Human
ccccacuugcuccccucc

SEQ ID NO: 629546 - RNA, 22 nt, Human
cgaaugcacacacacuaaugua

SEQ ID NO: 629547 - RNA, 22 nt, Human
cgcccuccggccgggcagcacc

SEQ ID NO: 629548 - RNA, 21 nt, Human
cgcggcggcggcggcggcggc

SEQ ID NO: 629549 - RNA, 22 nt, Human
cgcggcggcggcggcggcggcg

SEQ ID NO: 629550 - RNA, 20 nt, Human
cggcggcggcggcgccgggc

SEQ ID NO: 629551 - RNA, 23 nt, Human
cugaacgaaugcacacacacuaa

SEQ ID NO: 629552 - RNA, 20 nt, Human
gaaucuaaaaacagaccaaa

SEQ ID NO: 629553 - RNA, 20 nt, Human
gagcuguguguguuucccca

SEQ ID NO: 629554 - RNA, 18 nt, Human
gaugcccaccauguccca

SEQ ID NO: 629555 - RNA, 18 nt, Human
gcccgggccccaguccuc

SEQ ID NO: 629556 - RNA, 20 nt, Human
gcccgggguccuccucacac

SEQ ID NO: 629557 - RNA, 22 nt, Human
gcggcggcggcggcgccgggcc

SEQ ID NO: 629558 - RNA, 18 nt, Human
gcggcggcggcggcggcg

SEQ ID NO: 629559 - RNA, 25 nt, Human
gcggcggcggcggcggcgccgggcc

SEQ ID NO: 629560 - RNA, 24 nt, Human
gcggcggcggcggcggcggcgccu

SEQ ID NO: 629561 - RNA, 23 nt, Human
gcggcggcggcggcggcggcggc

SEQ ID NO: 629562 - RNA, 20 nt, Human
ggccgggcagcaccgggccc

SEQ ID NO: 629563 - RNA, 19 nt, Human
ggcggcggcgccgggcccg

SEQ ID NO: 629564 - RNA, 19 nt, Human
ggcggcggcggcggcgccg

SEQ ID NO: 629565 - RNA, 20 nt, Human
ggcggcggcggcggcggcgg

SEQ ID NO: 629566 - RNA, 20 nt, Human
gggcagcaccgggccccggu

SEQ ID NO: 629567 - RNA, 30 nt, Human
uaaaaaaagaaucaauauagugauggaagg

SEQ ID NO: 629568 - RNA, 24 nt, Human
uaaaaaggagcaaacugagaucca

SEQ ID NO: 629569 - RNA, 19 nt, Human
uaaagguccauaaaaagga

SEQ ID NO: 629570 - RNA, 22 nt, Human
uagagacgaagugaggcgggaa

SEQ ID NO: 629571 - RNA, 23 nt, Human
uauagugauggaaggguaaagaa

SEQ ID NO: 629572 - RNA, 20 nt, Human
uauugaauucuucaagaauc

SEQ ID NO: 629573 - RNA, 25 nt, Human
uccaugcuacgaugguuucauggag

SEQ ID NO: 629574 - RNA, 20 nt, Human
ucccugaugcccaccauguc

SEQ ID NO: 629575 - RNA, 22 nt, Human
uccucacgcaccggccgggccg

SEQ ID NO: 629576 - RNA, 25 nt, Human
ugaacucccaacagguucccagcuu

SEQ ID NO: 629577 - RNA, 26 nt, Human
uggcaaauuuguuuuuuuuuuuuuuu

SEQ ID NO: 629578 - RNA, 23 nt, Human
uguaaaugagcagcuaaaccuug

SEQ ID NO: 629579 - RNA, 23 nt, Human
ugugaauagguuuuugcugaggg

SEQ ID NO: 629580 - RNA, 22 nt, Human
uuacucucucuccauuaaaggu

SEQ ID NO: 629581 - RNA, 27 nt, Human
uucccagcuuuaaacacauuaaacauc

SEQ ID NO: 629582 - RNA, 19 nt, Human
uuuguggguuuuuuuccau

SEQ ID NO: 629583 - RNA, 23 nt, Human
aaguaccaaaagguggagagggc

SEQ ID NO: 629584 - RNA, 25 nt, Human
aaugauggggcuuguucagaagaga

SEQ ID NO: 629585 - RNA, 18 nt, Human
accuagcggggaaccacg

SEQ ID NO: 629586 - RNA, 19 nt, Human
agacaauuccauccagcac

SEQ ID NO: 629587 - RNA, 21 nt, Human
agcgggagcaaggccacgacc

SEQ ID NO: 629588 - RNA, 19 nt, Human
aggagaaaagaaagacaaa

SEQ ID NO: 629589 - RNA, 22 nt, Human
aggccacgacccccagaaacca

SEQ ID NO: 629590 - RNA, 21 nt, Human
aucaaggcuuuggcccuucaa

SEQ ID NO: 629591 - RNA, 24 nt, Human
auggggcuuguucagaagagaaac

SEQ ID NO: 629592 - RNA, 22 nt, Human
caaggccacgacccccagaaac

SEQ ID NO: 629593 - RNA, 22 nt, Human
cacagccuagacaauuccaucc

SEQ ID NO: 629594 - RNA, 19 nt, Human
cacccacacgcgcguggaa

SEQ ID NO: 629595 - RNA, 19 nt, Human
cacccagcacugcugcccu

SEQ ID NO: 629596 - RNA, 21 nt, Human
cacgagcacuucggggccccc

SEQ ID NO: 629597 - RNA, 24 nt, Human
cacuaggaaaaaaaauguuccauc

SEQ ID NO: 629598 - RNA, 20 nt, Human
cacugcugccuccagaucug

SEQ ID NO: 629599 - RNA, 18 nt, Human
cagcacugcugcccucgg

SEQ ID NO: 629600 - RNA, 21 nt, Human
cccacacgcgcguggaagggc

SEQ ID NO: 629601 - RNA, 25 nt, Human
cccacuccaauuaauuuagccccca

SEQ ID NO: 629602 - RNA, 18 nt, Human
ccccaaccccauccuacu

SEQ ID NO: 629603 - RNA, 24 nt, Human
cccccgcacccacacgcgcgugga

SEQ ID NO: 629604 - RNA, 21 nt, Human
cccgcacagcgggagcaaggc

SEQ ID NO: 629605 - RNA, 20 nt, Human
cccgcacccacacgcgcgug

SEQ ID NO: 629606 - RNA, 22 nt, Human
cugcugaauccauucuugaugu

SEQ ID NO: 629607 - RNA, 25 nt, Human
cugcugaauccauucuugaugucuc

SEQ ID NO: 629608 - RNA, 20 nt, Human
cugcugccuccagaucuguu

SEQ ID NO: 629609 - RNA, 22 nt, Human
gaaacauuuuauggucagugca

SEQ ID NO: 629610 - RNA, 18 nt, Human
gagggcugcccuucucuu

SEQ ID NO: 629611 - RNA, 20 nt, Human
ggagguucaccaaaugaugg

SEQ ID NO: 629612 - RNA, 24 nt, Human
gugcaaguugaauagaaaguacca

SEQ ID NO: 629613 - RNA, 21 nt, Human
guggagguucaccaaaugaug

SEQ ID NO: 629614 - RNA, 19 nt, Human
uaauuuagcccccaacccc

SEQ ID NO: 629615 - RNA, 24 nt, Human
uagaaaguaccaaaagguggagag

SEQ ID NO: 629616 - RNA, 19 nt, Human
uagcccccaaccccauccu

SEQ ID NO: 629617 - RNA, 20 nt, Human
uagcccccaaccccauccua

SEQ ID NO: 629618 - RNA, 21 nt, Human
ucauuaguggucuucucuuca

SEQ ID NO: 629619 - RNA, 20 nt, Human
uccauucuugaugucucucu

SEQ ID NO: 629620 - RNA, 18 nt, Human
ucucuccuuuuugucuuc

SEQ ID NO: 629621 - RNA, 18 nt, Human
ucuggcucucuccaccca

SEQ ID NO: 629622 - RNA, 18 nt, Human
ucuuuaguggucuucuca

SEQ ID NO: 629623 - RNA, 25 nt, Human
ugccuccagaucuguuuucuggcuc

SEQ ID NO: 629624 - RNA, 18 nt, Human
uuagcccccaaccccauc

SEQ ID NO: 629625 - RNA, 22 nt, Human
uuaguggucuucucauuagugg

SEQ ID NO: 629626 - RNA, 29 nt, Human
uuaguggucuucucauuaguggucuucuu

SEQ ID NO: 629627 - RNA, 18 nt, Human
uuccaguagaagagguac

SEQ ID NO: 629628 - RNA, 22 nt, Human
uucugcugaauccauucuugau

SEQ ID NO: 629629 - RNA, 18 nt, Human
uuucuggcucucuccacc

SEQ ID NO: 629630 - RNA, 24 nt, Human
uuuucuggcucucuccacccagca

SEQ ID NO: 629631 - RNA, 18 nt, Human
uuuuuuuuuuuuuuuuug

SEQ ID NO: 629632 - RNA, 22 nt, Human
uuuuuuuuuuuuuuuuugccag

SEQ ID NO: 629633 - RNA, 23 nt, Human
uuuuuuuuuuuuuuuuugccagu

SEQ ID NO: 629634 - RNA, 24 nt, Human
aaaaaguucgggauggccuuaacc

SEQ ID NO: 629635 - RNA, 22 nt, Human
aaagacaauacuugagacacaa

SEQ ID NO: 629636 - RNA, 22 nt, Human
aagaccaccaacgccgccccgc

SEQ ID NO: 629637 - RNA, 18 nt, Human
aagcuuccagcaucucag

SEQ ID NO: 629638 - RNA, 21 nt, Human
acaaagcaacccauuuucccu

SEQ ID NO: 629639 - RNA, 22 nt, Human
acacaaagcaacccauuuuccc

SEQ ID NO: 629640 - RNA, 19 nt, Human
aggccuccagcgcccgccg

SEQ ID NO: 629641 - RNA, 22 nt, Human
agucuccaccaauccuuugaag

SEQ ID NO: 629642 - RNA, 19 nt, Human
caaagcaacccauuuuccc

SEQ ID NO: 629643 - RNA, 21 nt, Human
caauacuugagacacaaagca

SEQ ID NO: 629644 - RNA, 21 nt, Human
caggcuaaccauuucagcugu

SEQ ID NO: 629645 - RNA, 25 nt, Human
ccagcgcccgccgccgccgccgccg

SEQ ID NO: 629646 - RNA, 18 nt, Human
ccaucacucccucccagg

SEQ ID NO: 629647 - RNA, 24 nt, Human
ccaugcauagucuccaccaauccu

SEQ ID NO: 629648 - RNA, 19 nt, Human
ccccgcgcgccugacucgc

SEQ ID NO: 629649 - RNA, 22 nt, Human
ccccgcgcgccugacucgccag

SEQ ID NO: 629650 - RNA, 21 nt, Human
ccccggugcgccccaucacuc

SEQ ID NO: 629651 - RNA, 18 nt, Human
cccgcuccccggccccgg

SEQ ID NO: 629652 - RNA, 21 nt, Human
cccgcuccccggccccggugc

SEQ ID NO: 629653 - RNA, 19 nt, Human
ccgccccgcgcgccugacu

SEQ ID NO: 629654 - RNA, 21 nt, Human
ccgccgccgccgccgcagccg

SEQ ID NO: 629655 - RNA, 24 nt, Human
ccgccgccgccgccgcagccgccg

SEQ ID NO: 629656 - RNA, 18 nt, Human
ccgccgccgccgccgccg

SEQ ID NO: 629657 - RNA, 19 nt, Human
ccgccgccgccgccgccgc

SEQ ID NO: 629658 - RNA, 21 nt, Human
ccggcugguccgacuuccacg

SEQ ID NO: 629659 - RNA, 21 nt, Human
cgccccaucacucccucccag

SEQ ID NO: 629660 - RNA, 23 nt, Human
cgccgccgccgccgccgcagccg

SEQ ID NO: 629661 - RNA, 21 nt, Human
cuacacuggcgcccgcucccc

SEQ ID NO: 629662 - RNA, 20 nt, Human
cuccccggccccggugcgcc

SEQ ID NO: 629663 - RNA, 26 nt, Human
cuuuaaaaaguucgggauggccuuaa

SEQ ID NO: 629664 - RNA, 18 nt, Human
gccccgcgcgccugacuc

SEQ ID NO: 629665 - RNA, 21 nt, Human
gccuuguguaugacaacugua

SEQ ID NO: 629666 - RNA, 20 nt, Human
ggcucucacaggccuccagc

SEQ ID NO: 629667 - RNA, 21 nt, Human
uaagucucugaugcuucauaa

SEQ ID NO: 629668 - RNA, 21 nt, Human
uaagucucugaugcuucauaa

SEQ ID NO: 629669 - RNA, 21 nt, Human
uauauauaugcgccuugugua

SEQ ID NO: 629670 - RNA, 22 nt, Human
uauauauaugcgccuuguguau

SEQ ID NO: 629671 - RNA, 23 nt, Human
uauauauaugcgccuuguguaug

SEQ ID NO: 629672 - RNA, 24 nt, Human
uauuacagggaaaauaagucucug

SEQ ID NO: 629673 - RNA, 18 nt, Human
ucacaggccuccagcgcc

SEQ ID NO: 629674 - RNA, 21 nt, Human
uccagcaucucaggcuaacca

SEQ ID NO: 629675 - RNA, 23 nt, Human
uccagcaucucaggcuaaccauu

SEQ ID NO: 629676 - RNA, 20 nt, Human
uccccggccccggugcgccc

SEQ ID NO: 629677 - RNA, 22 nt, Human
ucucaggcuaaccauuucagcu

SEQ ID NO: 629678 - RNA, 20 nt, Human
ugaagaacuguacccuguaa

SEQ ID NO: 629679 - RNA, 22 nt, Human
uggccuuaaccaugcauagucu

SEQ ID NO: 629680 - RNA, 21 nt, Human
uugaagcuuccagcaucucag

SEQ ID NO: 629681 - RNA, 22 nt, Human
aauggccucgggacccucaugc

SEQ ID NO: 629682 - RNA, 22 nt, Human
accucagggccccuggaggguc

SEQ ID NO: 629683 - RNA, 19 nt, Human
aggcagaaacucggcgucc

SEQ ID NO: 629684 - RNA, 18 nt, Human
aggggggccgcgggucag

SEQ ID NO: 629685 - RNA, 20 nt, Human
cacccucgccacucaaaccu

SEQ ID NO: 629686 - RNA, 18 nt, Human
cacuguggugaagggaac

SEQ ID NO: 629687 - RNA, 22 nt, Human
cagaccucagggccccuggagg

SEQ ID NO: 629688 - RNA, 22 nt, Human
cagcaucacccucgccacucaa

SEQ ID NO: 629689 - RNA, 26 nt, Human
cagccagcaucacccucgccacucaa

SEQ ID NO: 629690 - RNA, 21 nt, Human
ccagcaucacccucgccacuc

SEQ ID NO: 629691 - RNA, 22 nt, Human
ccccaccuugcagcuggggaca

SEQ ID NO: 629692 - RNA, 20 nt, Human
ccggccccaccuugcagcug

SEQ ID NO: 629693 - RNA, 23 nt, Human
ccucaugcugcugggcccaggag

SEQ ID NO: 629694 - RNA, 25 nt, Human
cugggcccaggagagacaguucuga

SEQ ID NO: 629695 - RNA, 22 nt, Human
gccccuggagggucugcaggca

SEQ ID NO: 629696 - RNA, 19 nt, Human
gcgcaaacagagggggcag

SEQ ID NO: 629697 - RNA, 21 nt, Human
gggcgcaaacagagggggcag

SEQ ID NO: 629698 - RNA, 18 nt, Human
ggggcaggcuaguguccc

SEQ ID NO: 629699 - RNA, 22 nt, Human
gggggcaggcuagugucccgcu

SEQ ID NO: 629700 - RNA, 22 nt, Human
ucagggccccuggagggucugc

SEQ ID NO: 629701 - RNA, 23 nt, Human
ucagggccccuggagggucugca

SEQ ID NO: 629702 - RNA, 28 nt, Human
ugucccgcugccccaggaacagaccuca

SEQ ID NO: 629703 - RNA, 22 nt, Human
aaaaaauaaagagaaaccagga

SEQ ID NO: 629704 - RNA, 20 nt, Human
acacacagcuaugcauaaaa

SEQ ID NO: 629705 - RNA, 21 nt, Human
accccagaacccgcccgcgcc

SEQ ID NO: 629706 - RNA, 18 nt, Human
acccgcccgcgccggggc

SEQ ID NO: 629707 - RNA, 23 nt, Human
agaaaccaggagagugccuaaau

SEQ ID NO: 629708 - RNA, 22 nt, Human
agcagcgucuacaccccagaac

SEQ ID NO: 629709 - RNA, 24 nt, Human
aggaagauuaggaggcagcagcua

SEQ ID NO: 629710 - RNA, 19 nt, Human
aggcccggaaagaccaagc

SEQ ID NO: 629711 - RNA, 21 nt, Human
caagcguaagcauuuccacac

SEQ ID NO: 629712 - RNA, 22 nt, Human
caccccagaacccgcccgcgcc

SEQ ID NO: 629713 - RNA, 19 nt, Human
cagaagaggcccagucaua

SEQ ID NO: 629714 - RNA, 19 nt, Human
caggagagugccuaaaugg

SEQ ID NO: 629715 - RNA, 20 nt, Human
ccccagaacccgcccgcgcc

SEQ ID NO: 629716 - RNA, 21 nt, Human
cccgcgccggggcuccggaac

SEQ ID NO: 629717 - RNA, 21 nt, Human
ccuugcacugaaggcagcccc

SEQ ID NO: 629718 - RNA, 20 nt, Human
cgaggcccggaaagaccaag

SEQ ID NO: 629719 - RNA, 20 nt, Human
cgcccgcgccggggcuccgg

SEQ ID NO: 629720 - RNA, 19 nt, Human
cggaaagaccaagcugaaa

SEQ ID NO: 629721 - RNA, 19 nt, Human
cucaaggcggugccgagaa

SEQ ID NO: 629722 - RNA, 24 nt, Human
cugacacacagcuaugcauaaaaa

SEQ ID NO: 629723 - RNA, 21 nt, Human
gcaggggcugggggaagcgag

SEQ ID NO: 629724 - RNA, 26 nt, Human
ggaaagaccaagcugaaaggcccggg

SEQ ID NO: 629725 - RNA, 24 nt, Human
ggcgcaggggcugggggaagcgag

SEQ ID NO: 629726 - RNA, 19 nt, Human
ggcuggggagggcuggcca

SEQ ID NO: 629727 - RNA, 22 nt, Human
ggugaagguggucccacuagca

SEQ ID NO: 629728 - RNA, 21 nt, Human
uaacuuuauucaggagauaau

SEQ ID NO: 629729 - RNA, 22 nt, Human
uacaauacagggcugacacuga

SEQ ID NO: 629730 - RNA, 23 nt, Human
ucuugggauucuaauccuggggc

SEQ ID NO: 629731 - RNA, 21 nt, Human
ugaagguggucccacuagcag

SEQ ID NO: 629732 - RNA, 22 nt, Human
uggccagcagcgucuacacccc

SEQ ID NO: 629733 - RNA, 22 nt, Human
uuucuugggauucuaauccugg

SEQ ID NO: 629734 - RNA, 19 nt, Human
uuuuuuuuuuuuuuuuuaa

SEQ ID NO: 629735 - RNA, 21 nt, Human
acagcagugaaaggaagaagu

SEQ ID NO: 629736 - RNA, 18 nt, Human
agaaauucagucacucca

SEQ ID NO: 629737 - RNA, 19 nt, Human
cagcaaacauugccucuca

SEQ ID NO: 629738 - RNA, 22 nt, Human
cuaaauauucucuauccaagac

SEQ ID NO: 629739 - RNA, 23 nt, Human
ucgccgccgccagcccagcgccg

SEQ ID NO: 629740 - RNA, 22 nt, Human
uuuuuuuuuuuuuuggaccaga

SEQ ID NO: 629741 - RNA, 18 nt, Human
uuuuuuuuuuuuuuuuug

SEQ ID NO: 629742 - RNA, 19 nt, Human
aacacauuccauaaggguu

SEQ ID NO: 629743 - RNA, 21 nt, Human
aacacauucuucuugcacacu

SEQ ID NO: 629744 - RNA, 22 nt, Human
acaaaaccccaggagugcagag

SEQ ID NO: 629745 - RNA, 20 nt, Human
accccaggagugcagagaua

SEQ ID NO: 629746 - RNA, 21 nt, Human
acccuggaggacgaaggacuc

SEQ ID NO: 629747 - RNA, 21 nt, Human
acgcagccuacccaacagucu

SEQ ID NO: 629748 - RNA, 19 nt, Human
agccauguaacaaaacccc

SEQ ID NO: 629749 - RNA, 23 nt, Human
auauuuuuuuuuuuugcuguguu

SEQ ID NO: 629750 - RNA, 25 nt, Human
caacccuacagucaguugggaaaga

SEQ ID NO: 629751 - RNA, 23 nt, Human
cagccuacccaacagucuacaca

SEQ ID NO: 629752 - RNA, 23 nt, Human
caguaaacaaaguauaaucccaa

SEQ ID NO: 629753 - RNA, 18 nt, Human
caucaaauguucucauuu

SEQ ID NO: 629754 - RNA, 18 nt, Human
ccaggagugcagagauag

SEQ ID NO: 629755 - RNA, 23 nt, Human
cccgcuggcgcaaagaacaggga

SEQ ID NO: 629756 - RNA, 20 nt, Human
cugguggcagcuagaggauc

SEQ ID NO: 629757 - RNA, 21 nt, Human
gaaagcagccauguaacaaaa

SEQ ID NO: 629758 - RNA, 19 nt, Human
gaacucucugguggcagcu

SEQ ID NO: 629759 - RNA, 18 nt, Human
gaagacauguaucucugc

SEQ ID NO: 629760 - RNA, 21 nt, Human
gaggaaagcagccauguaaca

SEQ ID NO: 629761 - RNA, 20 nt, Human
gccuacccaacagucuacac

SEQ ID NO: 629762 - RNA, 20 nt, Human
ggaaaagacacaacccuaca

SEQ ID NO: 629763 - RNA, 19 nt, Human
ggaaagcagccauguaaca

SEQ ID NO: 629764 - RNA, 22 nt, Human
guaaacaaaguauaaucccaaa

SEQ ID NO: 629765 - RNA, 21 nt, Human
guaaauggcaccaaaaaccug

SEQ ID NO: 629766 - RNA, 20 nt, Human
uaagccaucaaauguucuca

SEQ ID NO: 629767 - RNA, 20 nt, Human
uagaaacacauuccauaagg

SEQ ID NO: 629768 - RNA, 21 nt, Human
uagaaacacauuccauaaggg

SEQ ID NO: 629769 - RNA, 22 nt, Human
uauaaucccaaaguucugcaga

SEQ ID NO: 629770 - RNA, 19 nt, Human
ucagaaggggguguacucu

SEQ ID NO: 629771 - RNA, 23 nt, Human
ucagaaggggguguacucucauu

SEQ ID NO: 629772 - RNA, 23 nt, Human
ucucugcaaaauuguuaaguuau

SEQ ID NO: 629773 - RNA, 18 nt, Human
ucugguggcagcuagagg

SEQ ID NO: 629774 - RNA, 19 nt, Human
ucuucagugauguguucug

SEQ ID NO: 629775 - RNA, 18 nt, Human
ugaggaaagcagccaugu

SEQ ID NO: 629776 - RNA, 21 nt, Human
uggcaccaaaaaccuggugaa

SEQ ID NO: 629777 - RNA, 21 nt, Human
uggcagcuagaggaucuucau

SEQ ID NO: 629778 - RNA, 23 nt, Human
ugguggcagcuagaggaucuuca

SEQ ID NO: 629779 - RNA, 22 nt, Human
uguaacaaaaccccaggagugc

SEQ ID NO: 629780 - RNA, 19 nt, Human
uguuagaaacacauuccau

SEQ ID NO: 629781 - RNA, 20 nt, Human
uuccacuuauccaacucuag

SEQ ID NO: 629782 - RNA, 20 nt, Human
uucucauuugagccacgugu

SEQ ID NO: 629783 - RNA, 19 nt, Human
uugagcucuucuucaguga

SEQ ID NO: 629784 - RNA, 25 nt, Human
uuuagaagagaaaaaugaauuguuu

SEQ ID NO: 629785 - RNA, 18 nt, Human
uuuauuaucuuucuacag

SEQ ID NO: 629786 - RNA, 23 nt, Human
uuuuggaagacauguaucucugc

SEQ ID NO: 629787 - RNA, 20 nt, Human
uuuuuugcuguguuagaaac

SEQ ID NO: 629788 - RNA, 18 nt, Human
uuuuuuuuuuuuuuuuug

SEQ ID NO: 629789 - RNA, 21 nt, Human
aagaggccaacaaccuaccug

SEQ ID NO: 629790 - RNA, 18 nt, Human
aauugacuuacaauaggg

SEQ ID NO: 629791 - RNA, 24 nt, Human
aauuguuagccuuuucugagacuu

SEQ ID NO: 629792 - RNA, 24 nt, Human
acacaaggcccacccguggcugac

SEQ ID NO: 629793 - RNA, 25 nt, Human
accggauuuuccaaaucaauggucu

SEQ ID NO: 629794 - RNA, 24 nt, Human
agcaaggaacaacagugucaacag

SEQ ID NO: 629795 - RNA, 24 nt, Human
aggaaaaggcgaggcuucugguaa

SEQ ID NO: 629796 - RNA, 24 nt, Human
aggaacaacagugucaacagccgg

SEQ ID NO: 629797 - RNA, 21 nt, Human
auccaauucagcaaggaacaa

SEQ ID NO: 629798 - RNA, 21 nt, Human
augccugcuuuauuuccuacg

SEQ ID NO: 629799 - RNA, 21 nt, Human
cacccucacuccaucccgggg

SEQ ID NO: 629800 - RNA, 22 nt, Human
cacccucacuccaucccggggc

SEQ ID NO: 629801 - RNA, 26 nt, Human
caucacauaacaagucuaaucgccaa

SEQ ID NO: 629802 - RNA, 18 nt, Human
cccaaguaagaggccaac

SEQ ID NO: 629803 - RNA, 19 nt, Human
ccccaauccugagaacaga

SEQ ID NO: 629804 - RNA, 21 nt, Human
ccuccacccucacuccauccc

SEQ ID NO: 629805 - RNA, 22 nt, Human
cgcgcccuccacccucacucca

SEQ ID NO: 629806 - RNA, 20 nt, Human
cugguaauuucucaucuuug

SEQ ID NO: 629807 - RNA, 21 nt, Human
cuggugcuuaggaaaaggcga

SEQ ID NO: 629808 - RNA, 21 nt, Human
cuucugguaauuucucaucuu

SEQ ID NO: 629809 - RNA, 19 nt, Human
gcgcccuccacccucacuc

SEQ ID NO: 629810 - RNA, 19 nt, Human
uaccugggccgauacgagg

SEQ ID NO: 629811 - RNA, 24 nt, Human
uagccuuuucugagacuucucugu

SEQ ID NO: 629812 - RNA, 21 nt, Human
ucauagagucuuccuuuuuuu

SEQ ID NO: 629813 - RNA, 20 nt, Human
ucaucuuuguaguucccuuu

SEQ ID NO: 629814 - RNA, 21 nt, Human
ucccggggcacagcuccuucc

SEQ ID NO: 629815 - RNA, 24 nt, Human
uccuccagauggcucuuuuuauua

SEQ ID NO: 629816 - RNA, 22 nt, Human
ucugaacuacaagucaacaauc

SEQ ID NO: 629817 - RNA, 23 nt, Human
ucuguuucuucauagagucuucc

SEQ ID NO: 629818 - RNA, 21 nt, Human
ugagguccagagaugccugcu

SEQ ID NO: 629819 - RNA, 19 nt, Human
uggcuggcagagugcugag

SEQ ID NO: 629820 - RNA, 21 nt, Human
ugggccgauacgaggcgacac

SEQ ID NO: 629821 - RNA, 20 nt, Human
uuuguaguucccuuucuaca

SEQ ID NO: 629822 - RNA, 20 nt, Human
uuuguaguucccuuucuaca

SEQ ID NO: 629823 - RNA, 19 nt, Human
uuuuuuuuuuuugaggucc

SEQ ID NO: 629824 - RNA, 23 nt, Human
aaacccacgguccacguccucaa

SEQ ID NO: 629825 - RNA, 19 nt, Human
aaagacaccacucacaaag

SEQ ID NO: 629826 - RNA, 19 nt, Human
aaagcaagacggauaagga

SEQ ID NO: 629827 - RNA, 21 nt, Human
aagacaccacucacaaagaca

SEQ ID NO: 629828 - RNA, 25 nt, Human
aagcaaaggugaaggaggagggacc

SEQ ID NO: 629829 - RNA, 21 nt, Human
aaucagggccacuucuucugc

SEQ ID NO: 629830 - RNA, 24 nt, Human
acaccccaucuuucuucucuggcu

SEQ ID NO: 629831 - RNA, 18 nt, Human
accccaucuuucuucucu

SEQ ID NO: 629832 - RNA, 21 nt, Human
accccaucuuucuucucuggc

SEQ ID NO: 629833 - RNA, 24 nt, Human
acuccugccccuccagacgagggu

SEQ ID NO: 629834 - RNA, 23 nt, Human
acucugagacaauggugcagagg

SEQ ID NO: 629835 - RNA, 21 nt, Human
agaaaaacaagguagucuggg

SEQ ID NO: 629836 - RNA, 20 nt, Human
agagguuccugagaccuggg

SEQ ID NO: 629837 - RNA, 23 nt, Human
aggaggacccaguccugugggcu

SEQ ID NO: 629838 - RNA, 18 nt, Human
aggaucaaaaagcaaagg

SEQ ID NO: 629839 - RNA, 18 nt, Human
agggguuaaagacugccc

SEQ ID NO: 629840 - RNA, 22 nt, Human
agucugagaccccagcucuguc

SEQ ID NO: 629841 - RNA, 19 nt, Human
agugaaggaucaaaaagca

SEQ ID NO: 629842 - RNA, 21 nt, Human
aguggguucuggcuucccauu

SEQ ID NO: 629843 - RNA, 22 nt, Human
auagucccaaaugaucccagaa

SEQ ID NO: 629844 - RNA, 20 nt, Human
auuaucucucuuucucuucc

SEQ ID NO: 629845 - RNA, 21 nt, Human
caaaauauccacugugucuuc

SEQ ID NO: 629846 - RNA, 21 nt, Human
caaagacagcucccaccuagc

SEQ ID NO: 629847 - RNA, 21 nt, Human
caaaggugaaggaggacacug

SEQ ID NO: 629848 - RNA, 20 nt, Human
caagacagagguuccugaga

SEQ ID NO: 629849 - RNA, 21 nt, Human
caauccagaagaaaaacaagg

SEQ ID NO: 629850 - RNA, 21 nt, Human
caccacucacaaagacagcuc

SEQ ID NO: 629851 - RNA, 24 nt, Human
caggaguguuucacccacaggccc

SEQ ID NO: 629852 - RNA, 22 nt, Human
caucacccacaacauccaaguc

SEQ ID NO: 629853 - RNA, 24 nt, Human
caucacccacaacauccaagucaa

SEQ ID NO: 629854 - RNA, 19 nt, Human
cauuccuacggacauguuc

SEQ ID NO: 629855 - RNA, 26 nt, Human
ccaaaauauccacugugucuucagca

SEQ ID NO: 629856 - RNA, 19 nt, Human
ccaauccacucugagacaa

SEQ ID NO: 629857 - RNA, 21 nt, Human
ccaguccugugggcuguuuuc

SEQ ID NO: 629858 - RNA, 22 nt, Human
ccaucugcaucuggcccaaaau

SEQ ID NO: 629859 - RNA, 23 nt, Human
ccccuccagacgagggugagagc

SEQ ID NO: 629860 - RNA, 18 nt, Human
ccucaggagcugcgcugc

SEQ ID NO: 629861 - RNA, 20 nt, Human
ccugagaccugggcacugga

SEQ ID NO: 629862 - RNA, 22 nt, Human
cuagguuggucuucuucauuug

SEQ ID NO: 629863 - RNA, 21 nt, Human
cucaauccagaagaaaaacaa

SEQ ID NO: 629864 - RNA, 18 nt, Human
cucacaaagacagcuccc

SEQ ID NO: 629865 - RNA, 20 nt, Human
cucacaaagacagcucccac

SEQ ID NO: 629866 - RNA, 21 nt, Human
cucacaaagacagcucccacc

SEQ ID NO: 629867 - RNA, 23 nt, Human
cucagaggauaaaaagccagagu

SEQ ID NO: 629868 - RNA, 23 nt, Human
cugcacccaucuccagccaucug

SEQ ID NO: 629869 - RNA, 24 nt, Human
cugggcacuggagugauccucccc

SEQ ID NO: 629870 - RNA, 24 nt, Human
cuuucuucucuggcuuuggggcag

SEQ ID NO: 629871 - RNA, 22 nt, Human
gaccccagcucugucuuagcau

SEQ ID NO: 629872 - RNA, 22 nt, Human
gcacaggaguguuucacccaca

SEQ ID NO: 629873 - RNA, 18 nt, Human
gcacccaucuccagccau

SEQ ID NO: 629874 - RNA, 21 nt, Human
gcuacuuaaguggauuucuau

SEQ ID NO: 629875 - RNA, 23 nt, Human
ggaaaucccauuacaaagauguc

SEQ ID NO: 629876 - RNA, 21 nt, Human
ggaggacccaguccugugggc

SEQ ID NO: 629877 - RNA, 19 nt, Human
gggaagaaacccacggucc

SEQ ID NO: 629878 - RNA, 22 nt, Human
gggcacuggagugauccucccc

SEQ ID NO: 629879 - RNA, 23 nt, Human
gggcacuggagugauccuccccc

SEQ ID NO: 629880 - RNA, 19 nt, Human
gugcagaggcuuucucaga

SEQ ID NO: 629881 - RNA, 20 nt, Human
gugcagaggcuuucucagaa

SEQ ID NO: 629882 - RNA, 28 nt, Human
uaaaaugguuccccaaacuaucaacuaa

SEQ ID NO: 629883 - RNA, 19 nt, Human
uaaccaaaaccucaggagc

SEQ ID NO: 629884 - RNA, 25 nt, Human
uaaccaaaaccucaggagcugcgcu

SEQ ID NO: 629885 - RNA, 25 nt, Human
uaagauagcaaccacagaaauuuac

SEQ ID NO: 629886 - RNA, 24 nt, Human
uaaguagaggugaagaaaagcuaa

SEQ ID NO: 629887 - RNA, 22 nt, Human
uaaugcaaaacuccugccccuc

SEQ ID NO: 629888 - RNA, 22 nt, Human
uaguauucggcuggcuucacug

SEQ ID NO: 629889 - RNA, 21 nt, Human
ucaaggauaugcuuaaugcaa

SEQ ID NO: 629890 - RNA, 20 nt, Human
ucccaaaugaucccagaagc

SEQ ID NO: 629891 - RNA, 19 nt, Human
ucccugggaucugcaccca

SEQ ID NO: 629892 - RNA, 23 nt, Human
ucuggagucugagaccccagcuc

SEQ ID NO: 629893 - RNA, 19 nt, Human
ugaagaaaagcuaaacugc

SEQ ID NO: 629894 - RNA, 19 nt, Human
ugagacaauggugcagagg

SEQ ID NO: 629895 - RNA, 25 nt, Human
ugagacaauggugcagaggcuuucu

SEQ ID NO: 629896 - RNA, 24 nt, Human
ugcauaccaucacccacaacaucc

SEQ ID NO: 629897 - RNA, 28 nt, Human
ugcauaccaucacccacaacauccaagu

SEQ ID NO: 629898 - RNA, 24 nt, Human
ugcauucuugucuucaaggauaug

SEQ ID NO: 629899 - RNA, 23 nt, Human
ugccuguguuuugugagagauga

SEQ ID NO: 629900 - RNA, 20 nt, Human
ugggaagaaacccacggucc

SEQ ID NO: 629901 - RNA, 21 nt, Human
ugggaagaaacccacggucca

SEQ ID NO: 629902 - RNA, 18 nt, Human
uuccugagaccugggcac

SEQ ID NO: 629903 - RNA, 22 nt, Human
uuccugagaccugggcacugga

SEQ ID NO: 629904 - RNA, 19 nt, Human
uuuuuuuuuuuuuuuugca

SEQ ID NO: 629905 - RNA, 18 nt, Human
uuuuuuuuuuuuuuuuug

SEQ ID NO: 629906 - RNA, 22 nt, Human
uuuuuuuuuuuuuuuuugcauu

SEQ ID NO: 629907 - RNA, 24 nt, Human
aacaaagcaguacaagccuccccu

SEQ ID NO: 629908 - RNA, 22 nt, Human
auuuauucaacaaagcaguaca

SEQ ID NO: 629909 - RNA, 25 nt, Human
caacaaagcaguacaagccuccccu

SEQ ID NO: 629910 - RNA, 22 nt, Human
cauggggaaggggagugagggc

SEQ ID NO: 629911 - RNA, 23 nt, Human
cccuucaaucaggaccugccugc

SEQ ID NO: 629912 - RNA, 20 nt, Human
cgacaacauggggaagggga

SEQ ID NO: 629913 - RNA, 23 nt, Human
cguaaaacucauuuauucaacaa

SEQ ID NO: 629914 - RNA, 18 nt, Human
ggaaggggagugagggcc

SEQ ID NO: 629915 - RNA, 20 nt, Human
ggccucggcgccucccgggc

SEQ ID NO: 629916 - RNA, 22 nt, Human
gggugggcuacuucagugucuu

SEQ ID NO: 629917 - RNA, 24 nt, Human
uacaagccuccccuucaaucagga

SEQ ID NO: 629918 - RNA, 19 nt, Human
ucaacaaagcaguacaagc

SEQ ID NO: 629919 - RNA, 18 nt, Human
ucuuuuuuuuuuuuuuuu

SEQ ID NO: 629920 - RNA, 19 nt, Human
uucagugucuucagccaau

SEQ ID NO: 629921 - RNA, 18 nt, Human
uuuuuuuuuuuuucccug

SEQ ID NO: 629922 - RNA, 25 nt, Human
uuuuuuuuuuuuuuuuuuucuuuuu

SEQ ID NO: 629923 - RNA, 22 nt, Human
aaaaaaauuacagcaaaguuag

SEQ ID NO: 629924 - RNA, 23 nt, Human
aaaaaacccucccuccugcccca

SEQ ID NO: 629925 - RNA, 26 nt, Human
aaaaaacccucccuccugccccaaaa

SEQ ID NO: 629926 - RNA, 21 nt, Human
aaaaacccucccuccugcccc

SEQ ID NO: 629927 - RNA, 24 nt, Human
aaaaauucuuuauuuaaccuaauc

SEQ ID NO: 629928 - RNA, 19 nt, Human
aaacaaugaaaacaaauca

SEQ ID NO: 629929 - RNA, 20 nt, Human
aaacaucauauaacucaaaa

SEQ ID NO: 629930 - RNA, 22 nt, Human
aaacccucccuccugccccaaa

SEQ ID NO: 629931 - RNA, 18 nt, Human
aaacuuaagccaaaaaca

SEQ ID NO: 629932 - RNA, 20 nt, Human
aaauaaacaucauauaacuc

SEQ ID NO: 629933 - RNA, 19 nt, Human
aaauauaggagcagcagcu

SEQ ID NO: 629934 - RNA, 19 nt, Human
aacccucccuccugcccca

SEQ ID NO: 629935 - RNA, 22 nt, Human
acaaaacccagguuuaccaugc

SEQ ID NO: 629936 - RNA, 23 nt, Human
acaaaacccagguuuaccaugcu

SEQ ID NO: 629937 - RNA, 23 nt, Human
acacacacacacacacacacaca

SEQ ID NO: 629938 - RNA, 23 nt, Human
acacacacacacacacacacaca

SEQ ID NO: 629939 - RNA, 23 nt, Human
acacacacacacacacacacaca

SEQ ID NO: 629940 - RNA, 19 nt, Human
acagcacucugcacagugc

SEQ ID NO: 629941 - RNA, 19 nt, Human
acggccuuccccaguggac

SEQ ID NO: 629942 - RNA, 18 nt, Human
acuaacauagcucaaucu

SEQ ID NO: 629943 - RNA, 19 nt, Human
acuucaugaaguaugagau

SEQ ID NO: 629944 - RNA, 22 nt, Human
agaaaacaccacaaaaucucau

SEQ ID NO: 629945 - RNA, 19 nt, Human
agaaauaugaaaauaaacu

SEQ ID NO: 629946 - RNA, 19 nt, Human
agaguuguuccccggccuu

SEQ ID NO: 629947 - RNA, 21 nt, Human
aggcaggucaccuuccuggga

SEQ ID NO: 629948 - RNA, 19 nt, Human
aggcggcgaucgcggcccg

SEQ ID NO: 629949 - RNA, 22 nt, Human
agucaaauccuuuagccaaaau

SEQ ID NO: 629950 - RNA, 19 nt, Human
aguuauugaaagcugaacu

SEQ ID NO: 629951 - RNA, 19 nt, Human
auaaaauauacccacccau

SEQ ID NO: 629952 - RNA, 21 nt, Human
aucauauaacucaaaauuaag

SEQ ID NO: 629953 - RNA, 21 nt, Human
auucuaguagucgucauugaa

SEQ ID NO: 629954 - RNA, 24 nt, Human
caaaacaacacaacagauucauaa

SEQ ID NO: 629955 - RNA, 25 nt, Human
caaauuaugucagugagaaaaaucc

SEQ ID NO: 629956 - RNA, 21 nt, Human
cacaagucuccacaagugcau

SEQ ID NO: 629957 - RNA, 20 nt, Human
cacacacacacacacacaca

SEQ ID NO: 629958 - RNA, 20 nt, Human
cacacacacacacacacaca

SEQ ID NO: 629959 - RNA, 20 nt, Human
cacacacacacacacacaca

SEQ ID NO: 629960 - RNA, 20 nt, Human
cacacacacacacacacaca

SEQ ID NO: 629961 - RNA, 19 nt, Human
cacacacgacugcaugagu

SEQ ID NO: 629962 - RNA, 18 nt, Human
cacccagcuucccggggc

SEQ ID NO: 629963 - RNA, 19 nt, Human
cacccagcuucccggggca

SEQ ID NO: 629964 - RNA, 24 nt, Human
cacugaaacacacaaauacacaca

SEQ ID NO: 629965 - RNA, 19 nt, Human
cagcuccgcuagccuggcg

SEQ ID NO: 629966 - RNA, 21 nt, Human
cagggacaauagcacugagag

SEQ ID NO: 629967 - RNA, 23 nt, Human
caggucaccuuccugggaagacu

SEQ ID NO: 629968 - RNA, 22 nt, Human
caguggacccgcucaaggccag

SEQ ID NO: 629969 - RNA, 20 nt, Human
caguucccuccccgcaaccc

SEQ ID NO: 629970 - RNA, 19 nt, Human
cauaaaaguaguacauaca

SEQ ID NO: 629971 - RNA, 20 nt, Human
cauccgaaaaaucuacauca

SEQ ID NO: 629972 - RNA, 19 nt, Human
cauucauacuauagaaacc

SEQ ID NO: 629973 - RNA, 20 nt, Human
cccgcaacccuaaaaaaacc

SEQ ID NO: 629974 - RNA, 19 nt, Human
cccuaaaaaaacccucccu

SEQ ID NO: 629975 - RNA, 25 nt, Human
cccuaaaaaaacccucccuccugcc

SEQ ID NO: 629976 - RNA, 22 nt, Human
cccuaauaccuauaaaaccaag

SEQ ID NO: 629977 - RNA, 21 nt, Human
ccucuccauuuacuuuuccua

SEQ ID NO: 629978 - RNA, 20 nt, Human
cggcggcagccgcgaacccg

SEQ ID NO: 629979 - RNA, 22 nt, Human
cggcggcagccgcgaacccguc

SEQ ID NO: 629980 - RNA, 20 nt, Human
cggcggcggugcagggccug

SEQ ID NO: 629981 - RNA, 24 nt, Human
cuuucacauugaaaacaaaagcca

SEQ ID NO: 629982 - RNA, 21 nt, Human
gaaaaaacucccagagaugga

SEQ ID NO: 629983 - RNA, 22 nt, Human
gaaacacugaaacacacaaaua

SEQ ID NO: 629984 - RNA, 18 nt, Human
gaggaggagccugaggcg

SEQ ID NO: 629985 - RNA, 22 nt, Human
gccggcgcacacggccuucccc

SEQ ID NO: 629986 - RNA, 23 nt, Human
gcggagccggcgcacacggccuu

SEQ ID NO: 629987 - RNA, 19 nt, Human
gcggaguaggccgcagucc

SEQ ID NO: 629988 - RNA, 18 nt, Human
gcggcggagagcgaggag

SEQ ID NO: 629989 - RNA, 19 nt, Human
ggaggaggagccugaggcg

SEQ ID NO: 629990 - RNA, 18 nt, Human
ggcccggguucccguccg

SEQ ID NO: 629991 - RNA, 20 nt, Human
ggcggcggugcagggccugc

SEQ ID NO: 629992 - RNA, 18 nt, Human
uaaaaaaacccucccucc

SEQ ID NO: 629993 - RNA, 25 nt, Human
uaaaaaaacccucccuccugcccca

SEQ ID NO: 629994 - RNA, 19 nt, Human
uaaaaaauauaggagcagc

SEQ ID NO: 629995 - RNA, 24 nt, Human
uaaaaucuaaaaacauuaguguug

SEQ ID NO: 629996 - RNA, 21 nt, Human
uaaaguuuccagaaauaacac

SEQ ID NO: 629997 - RNA, 21 nt, Human
uaaccuaauccagccaguauu

SEQ ID NO: 629998 - RNA, 22 nt, Human
uaagccaaaaacaaugaccuca

SEQ ID NO: 629999 - RNA, 21 nt, Human
uaauaaacuuaagccaaaaac

SEQ ID NO: 630000 - RNA, 21 nt, Human
uaauaauaauaaggcucuuua

SEQ ID NO: 630001 - RNA, 20 nt, Human
uacacacacacacacacaca

SEQ ID NO: 630002 - RNA, 26 nt, Human
uagcucaaucuauauuugcuacacuu

SEQ ID NO: 630003 - RNA, 25 nt, Human
uauaaaaacaaagagcucaaggccu

SEQ ID NO: 630004 - RNA, 19 nt, Human
uauauuugcuacacuccua

SEQ ID NO: 630005 - RNA, 19 nt, Human
uaucaguaaggggaaacau

SEQ ID NO: 630006 - RNA, 24 nt, Human
uaugaacaaaacccagguuuacca

SEQ ID NO: 630007 - RNA, 23 nt, Human
uauuauauuucuuaaaaaauaua

SEQ ID NO: 630008 - RNA, 22 nt, Human
uauuuaaccuaauccagccagu

SEQ ID NO: 630009 - RNA, 21 nt, Human
ucaaauccuuuagccaaaauc

SEQ ID NO: 630010 - RNA, 18 nt, Human
ucaaggccaggcccaggg

SEQ ID NO: 630011 - RNA, 23 nt, Human
ucaucucuuucauuuguccccaa

SEQ ID NO: 630012 - RNA, 19 nt, Human
ucccagagauggaaggacc

SEQ ID NO: 630013 - RNA, 21 nt, Human
ucccagagauggaaggaccuc

SEQ ID NO: 630014 - RNA, 21 nt, Human
uccccgcaacccuaaaaaaac

SEQ ID NO: 630015 - RNA, 28 nt, Human
uccccgcaacccuaaaaaaacccucccu

SEQ ID NO: 630016 - RNA, 21 nt, Human
uccccggccuucaugagcccu

SEQ ID NO: 630017 - RNA, 18 nt, Human
ucccuccccgcaacccua

SEQ ID NO: 630018 - RNA, 20 nt, Human
ucccugucaagggcauuaau

SEQ ID NO: 630019 - RNA, 24 nt, Human
uccgcuagccuggcggcggcggug

SEQ ID NO: 630020 - RNA, 22 nt, Human
uccggcggaggcggcggagagc

SEQ ID NO: 630021 - RNA, 18 nt, Human
uccucaggcacuugcagu

SEQ ID NO: 630022 - RNA, 21 nt, Human
ucuauugaaaauggcuucaau

SEQ ID NO: 630023 - RNA, 21 nt, Human
ucuguaagagcuuggaccaag

SEQ ID NO: 630024 - RNA, 18 nt, Human
ugaaaaaacucccagaga

SEQ ID NO: 630025 - RNA, 22 nt, Human
ugaacaaaacccagguuuacca

SEQ ID NO: 630026 - RNA, 19 nt, Human
ugagaaaacacuaaacaug

SEQ ID NO: 630027 - RNA, 23 nt, Human
ugagucaaaauuacuucaugaag

SEQ ID NO: 630028 - RNA, 24 nt, Human
ugcauaacuuuaguaaaggcugcc

SEQ ID NO: 630029 - RNA, 20 nt, Human
ugcugauucugagaaaacac

SEQ ID NO: 630030 - RNA, 20 nt, Human
uggaaucaaaacaacacaac

SEQ ID NO: 630031 - RNA, 21 nt, Human
uggaaucaaaacaacacaacu

SEQ ID NO: 630032 - RNA, 19 nt, Human
uggagaaaauaugaacaaa

SEQ ID NO: 630033 - RNA, 22 nt, Human
uggagaaaauaugaacaaaacc

SEQ ID NO: 630034 - RNA, 18 nt, Human
uggguuaaagaaaacacc

SEQ ID NO: 630035 - RNA, 21 nt, Human
uggguuaaagaaaacaccaca

SEQ ID NO: 630036 - RNA, 21 nt, Human
uggucaggcaggucaccuucc

SEQ ID NO: 630037 - RNA, 19 nt, Human
uguaaauaaaauuuaauau

SEQ ID NO: 630038 - RNA, 23 nt, Human
uuaauccuagaaauagucuucug

SEQ ID NO: 630039 - RNA, 23 nt, Human
uuccugggaagacuggcaugugg

SEQ ID NO: 630040 - RNA, 19 nt, Human
uuucauaaucauguaaugg

SEQ ID NO: 630041 - RNA, 21 nt, Human
uuugaauaaaacagcaugugc

SEQ ID NO: 630042 - RNA, 21 nt, Human
uuuucagccacuuuggagaua

SEQ ID NO: 630043 - RNA, 21 nt, Human
aaaaugccacaaguaccccuc

SEQ ID NO: 630044 - RNA, 22 nt, Human
aacuguuuauugcgacuuccac

SEQ ID NO: 630045 - RNA, 21 nt, Human
aagagccaggugugaccuaga

SEQ ID NO: 630046 - RNA, 23 nt, Human
aaguaccccuccaaaauaaaccc

SEQ ID NO: 630047 - RNA, 20 nt, Human
aagugggaagccacacucaa

SEQ ID NO: 630048 - RNA, 18 nt, Human
acaaguaccccuccaaaa

SEQ ID NO: 630049 - RNA, 24 nt, Human
acaaugcaggaaaagugggaagcc

SEQ ID NO: 630050 - RNA, 18 nt, Human
agccccaacagcuguagc

SEQ ID NO: 630051 - RNA, 18 nt, Human
aggaugcgcuugcuggca

SEQ ID NO: 630052 - RNA, 21 nt, Human
agugggaagccacacucaagg

SEQ ID NO: 630053 - RNA, 22 nt, Human
augccacaaguaccccuccaaa

SEQ ID NO: 630054 - RNA, 21 nt, Human
auuuccaccuccccacauccc

SEQ ID NO: 630055 - RNA, 21 nt, Human
caaacuggcuaaaacccaaca

SEQ ID NO: 630056 - RNA, 22 nt, Human
caagacaauacaggaaaaugcc

SEQ ID NO: 630057 - RNA, 19 nt, Human
caagagccaggugugaccu

SEQ ID NO: 630058 - RNA, 18 nt, Human
caccagcgaggcaccagu

SEQ ID NO: 630059 - RNA, 22 nt, Human
cagagccccaacagcuguagcc

SEQ ID NO: 630060 - RNA, 20 nt, Human
cagcgaggcaccagucccuu

SEQ ID NO: 630061 - RNA, 24 nt, Human
cagugaccuccccugcagagaccc

SEQ ID NO: 630062 - RNA, 21 nt, Human
ccagcgaggcaccagucccuu

SEQ ID NO: 630063 - RNA, 27 nt, Human
cccauguccaagacaauaccggggucc

SEQ ID NO: 630064 - RNA, 25 nt, Human
ccugcagagaccccagccucaccgg

SEQ ID NO: 630065 - RNA, 19 nt, Human
cuaaaacccaacagggaga

SEQ ID NO: 630066 - RNA, 18 nt, Human
cuccccugcagagacccc

SEQ ID NO: 630067 - RNA, 19 nt, Human
cugcagcaaaccagagacc

SEQ ID NO: 630068 - RNA, 22 nt, Human
gaccuccccugcagagacccca

SEQ ID NO: 630069 - RNA, 25 nt, Human
gaggagccaggaguguccuacggaa

SEQ ID NO: 630070 - RNA, 22 nt, Human
gcaaaccagagacccagcacca

SEQ ID NO: 630071 - RNA, 22 nt, Human
gcagagaccccagccucaccgg

SEQ ID NO: 630072 - RNA, 21 nt, Human
gcucgcuguuccagugaccuc

SEQ ID NO: 630073 - RNA, 21 nt, Human
ggaaaaugccacaaguacccc

SEQ ID NO: 630074 - RNA, 21 nt, Human
ggcaaacuggcuaaaacccaa

SEQ ID NO: 630075 - RNA, 18 nt, Human
gucagcuccacaaugcag

SEQ ID NO: 630076 - RNA, 22 nt, Human
gugggaagccacacucaaggaa

SEQ ID NO: 630077 - RNA, 22 nt, Human
ucaucauuuccaccuccccaca

SEQ ID NO: 630078 - RNA, 22 nt, Human
ucauccacacaaccugcugcuc

SEQ ID NO: 630079 - RNA, 19 nt, Human
uccaaaauaaacccgccug

SEQ ID NO: 630080 - RNA, 20 nt, Human
uccaagacaauacaggaaaa

SEQ ID NO: 630081 - RNA, 18 nt, Human
uccaccuccccacauccc

SEQ ID NO: 630082 - RNA, 21 nt, Human
uccacuggaagcuguuaauaa

SEQ ID NO: 630083 - RNA, 25 nt, Human
uccccacaucccauguccaagacaa

SEQ ID NO: 630084 - RNA, 19 nt, Human
ucccuugcucgcuguucca

SEQ ID NO: 630085 - RNA, 24 nt, Human
ucccuugcucgcuguuccagugac

SEQ ID NO: 630086 - RNA, 22 nt, Human
uccuacggcucugcagcaaacc

SEQ ID NO: 630087 - RNA, 23 nt, Human
uggaagcuguuaauaagccacau

SEQ ID NO: 630088 - RNA, 24 nt, Human
uggcaaacuggcuaaaacccaaca

SEQ ID NO: 630089 - RNA, 19 nt, Human
uguccaagacaauacagga

SEQ ID NO: 630090 - RNA, 21 nt, Human
uguuccagugaccuccccugc

SEQ ID NO: 630091 - RNA, 19 nt, Human
uuuuuugagauuuaccaaa

SEQ ID NO: 630092 - RNA, 18 nt, Human
uuuuuuuuuuuuuuuuug

SEQ ID NO: 630093 - RNA, 23 nt, Human
aaaccccucuuucagcaucucuc

SEQ ID NO: 630094 - RNA, 21 nt, Human
acacaccuucccaaucuaauc

SEQ ID NO: 630095 - RNA, 22 nt, Human
acuguccuuucuaauacccaua

SEQ ID NO: 630096 - RNA, 19 nt, Human
acuuaagguccagaaagaa

SEQ ID NO: 630097 - RNA, 25 nt, Human
agagaugaaaaacaaaaaaccugcu

SEQ ID NO: 630098 - RNA, 21 nt, Human
aggaagagaugaaaaacaaaa

SEQ ID NO: 630099 - RNA, 19 nt, Human
aguguaggucacugaggcc

SEQ ID NO: 630100 - RNA, 22 nt, Human
auaaaacaaaccuuuuuccccc

SEQ ID NO: 630101 - RNA, 22 nt, Human
cacaagguaucaacacaccuuc

SEQ ID NO: 630102 - RNA, 21 nt, Human
cccccuuauuuucaacugucc

SEQ ID NO: 630103 - RNA, 18 nt, Human
gaagccaaaccaugccaa

SEQ ID NO: 630104 - RNA, 18 nt, Human
ggaaacucucuaaaaugu

SEQ ID NO: 630105 - RNA, 18 nt, Human
gugaaaugcaaaagcaca

SEQ ID NO: 630106 - RNA, 23 nt, Human
guguguggccagcuuuuucgcug

SEQ ID NO: 630107 - RNA, 24 nt, Human
uaaucauuuuaucgugucuacaug

SEQ ID NO: 630108 - RNA, 24 nt, Human
uagcaugcuuuuuucauaaauugu

SEQ ID NO: 630109 - RNA, 21 nt, Human
ucaaguuguaauaucuguacu

SEQ ID NO: 630110 - RNA, 24 nt, Human
ucagugaaauauaaaacaaaccuu

SEQ ID NO: 630111 - RNA, 19 nt, Human
uccaaguguguaugaagau

SEQ ID NO: 630112 - RNA, 19 nt, Human
uccagaaagaaauauuuac

SEQ ID NO: 630113 - RNA, 23 nt, Human
ucccccuuauuuucaacuguccu

SEQ ID NO: 630114 - RNA, 18 nt, Human
ucucugcauaucuuaguu

SEQ ID NO: 630115 - RNA, 21 nt, Human
ucuguacucagugacacaagg

SEQ ID NO: 630116 - RNA, 21 nt, Human
ugaaaugcaaaagcacacauc

SEQ ID NO: 630117 - RNA, 18 nt, Human
ugaauuucaaacaugugc

SEQ ID NO: 630118 - RNA, 24 nt, Human
ugacacaagguaucaacacaccuu

SEQ ID NO: 630119 - RNA, 21 nt, Human
ugucaaauaaggaaaagaccc

SEQ ID NO: 630120 - RNA, 22 nt, Human
uuccuagauugucaaacugcgc

SEQ ID NO: 630121 - RNA, 25 nt, Human
uuuuuuuuuuuuuuuuuuucagggg

SEQ ID NO: 630122 - RNA, 18 nt, Human
acaggaagaacacagaug

SEQ ID NO: 630123 - RNA, 18 nt, Human
accauuuauuggggacuu

SEQ ID NO: 630124 - RNA, 19 nt, Human
accccgugguccaggggcc

SEQ ID NO: 630125 - RNA, 24 nt, Human
acucugaggcagcaaggacagagg

SEQ ID NO: 630126 - RNA, 26 nt, Human
acuguaggaggaaagaaggaaggagg

SEQ ID NO: 630127 - RNA, 21 nt, Human
agaaggaaggagggauggaag

SEQ ID NO: 630128 - RNA, 22 nt, Human
agaaggaaggagggauggaagc

SEQ ID NO: 630129 - RNA, 21 nt, Human
agcaacacaggucccaggugu

SEQ ID NO: 630130 - RNA, 23 nt, Human
aggagagguggaccccguggucc

SEQ ID NO: 630131 - RNA, 18 nt, Human
aggcagcaaggacagagg

SEQ ID NO: 630132 - RNA, 27 nt, Human
agguggaccccgugguccaggggcccg

SEQ ID NO: 630133 - RNA, 21 nt, Human
cagcaacacaggucccaggug

SEQ ID NO: 630134 - RNA, 18 nt, Human
cagcacuguaggaggaaa

SEQ ID NO: 630135 - RNA, 20 nt, Human
caggucccagguguccgggg

SEQ ID NO: 630136 - RNA, 23 nt, Human
caggucccagguguccggggucu

SEQ ID NO: 630137 - RNA, 24 nt, Human
cccaaucgucgucugugucccgcc

SEQ ID NO: 630138 - RNA, 18 nt, Human
cccccgagggcugcugug

SEQ ID NO: 630139 - RNA, 19 nt, Human
ccccgagggcugcuguggg

SEQ ID NO: 630140 - RNA, 21 nt, Human
ccuagaaccguaaagcccaga

SEQ ID NO: 630141 - RNA, 19 nt, Human
ccucugcuucuccuguccc

SEQ ID NO: 630142 - RNA, 23 nt, Human
cgaaccugaccgugacgagccaa

SEQ ID NO: 630143 - RNA, 24 nt, Human
cgggcguggagcugacaggaagaa

SEQ ID NO: 630144 - RNA, 21 nt, Human
cgggcucagcaacacaggucc

SEQ ID NO: 630145 - RNA, 22 nt, Human
cgucccgcccacuccgcguuua

SEQ ID NO: 630146 - RNA, 18 nt, Human
cgugguccaggggcccgg

SEQ ID NO: 630147 - RNA, 19 nt, Human
cugaggcagcaaggacaga

SEQ ID NO: 630148 - RNA, 23 nt, Human
gaccccgugguccaggggccccu

SEQ ID NO: 630149 - RNA, 19 nt, Human
ggaagccucuuccucugcu

SEQ ID NO: 630150 - RNA, 22 nt, Human
ggcguggagcugacaggaagaa

SEQ ID NO: 630151 - RNA, 22 nt, Human
uagaccaauugcaaggcagcga

SEQ ID NO: 630152 - RNA, 22 nt, Human
ucagcaacacaggucccaggug

SEQ ID NO: 630153 - RNA, 19 nt, Human
ucagugacugacucugagg

SEQ ID NO: 630154 - RNA, 19 nt, Human
uccggggucuccugaacuc

SEQ ID NO: 630155 - RNA, 18 nt, Human
uccugaacuccaggaagc

SEQ ID NO: 630156 - RNA, 20 nt, Human
uggaagccucuuccucugcu

SEQ ID NO: 630157 - RNA, 21 nt, Human
uugaccgcgauagaguccuuc

SEQ ID NO: 630158 - RNA, 23 nt, Human
aaagugcugggauuacaggcaug

SEQ ID NO: 630159 - RNA, 24 nt, Human
aaagugcugggauuacaggcaugg

SEQ ID NO: 630160 - RNA, 25 nt, Human
aaagugcugggauuacaggcauggg

SEQ ID NO: 630161 - RNA, 24 nt, Human
aacaccguuccucuugccaaugac

SEQ ID NO: 630162 - RNA, 20 nt, Human
aaggagcccuggcuggucug

SEQ ID NO: 630163 - RNA, 24 nt, Human
aaggagcccuggcuggucugggcc

SEQ ID NO: 630164 - RNA, 22 nt, Human
aagguaaugcugggaaaggucc

SEQ ID NO: 630165 - RNA, 19 nt, Human
aagugcugggauuacaggc

SEQ ID NO: 630166 - RNA, 21 nt, Human
aagugcugggauuacaggcau

SEQ ID NO: 630167 - RNA, 20 nt, Human
aauuucucucuguggagccu

SEQ ID NO: 630168 - RNA, 18 nt, Human
acacaggccuggaacacc

SEQ ID NO: 630169 - RNA, 24 nt, Human
accugaggucaggaguucgagacc

SEQ ID NO: 630170 - RNA, 21 nt, Human
acgccuguaaucccagcacuu

SEQ ID NO: 630171 - RNA, 20 nt, Human
acuccaggcgaguccuccuu

SEQ ID NO: 630172 - RNA, 20 nt, Human
agaugauggcaguggcuggg

SEQ ID NO: 630173 - RNA, 24 nt, Human
agcacuuugggagggcaagguggg

SEQ ID NO: 630174 - RNA, 22 nt, Human
aggagcccugagccaaguucuc

SEQ ID NO: 630175 - RNA, 18 nt, Human
agggaagggaagguaaug

SEQ ID NO: 630176 - RNA, 24 nt, Human
aguggcuuacgccuguaaucccag

SEQ ID NO: 630177 - RNA, 20 nt, Human
auuccacucucuuccuccuu

SEQ ID NO: 630178 - RNA, 24 nt, Human
auugucccaccucccaaagugcug

SEQ ID NO: 630179 - RNA, 24 nt, Human
caaagugcugggauuacaggcaug

SEQ ID NO: 630180 - RNA, 24 nt, Human
caagguggguggaucaccugaggu

SEQ ID NO: 630181 - RNA, 26 nt, Human
caagguggguggaucaccugagguca

SEQ ID NO: 630182 - RNA, 21 nt, Human
cacaggccuggaacacccuuc

SEQ ID NO: 630183 - RNA, 20 nt, Human
caccguuccucuugccaaug

SEQ ID NO: 630184 - RNA, 23 nt, Human
caccugaggucaggaguucgaga

SEQ ID NO: 630185 - RNA, 19 nt, Human
cacuuugggagggcaaggu

SEQ ID NO: 630186 - RNA, 18 nt, Human
cagaagucaggaguggag

SEQ ID NO: 630187 - RNA, 21 nt, Human
cagcacuuugggagggcaagg

SEQ ID NO: 630188 - RNA, 24 nt, Human
cagcacuuugggagggcaaggugg

SEQ ID NO: 630189 - RNA, 24 nt, Human
cagccugaccaacauggagaaacc

SEQ ID NO: 630190 - RNA, 19 nt, Human
cauccuagaaccagggcug

SEQ ID NO: 630191 - RNA, 18 nt, Human
caucugccuuagucuucu

SEQ ID NO: 630192 - RNA, 24 nt, Human
cauuccacucucuuccuccuuacc

SEQ ID NO: 630193 - RNA, 23 nt, Human
ccaaagugcugggauuacaggca

SEQ ID NO: 630194 - RNA, 24 nt, Human
ccaaagugcugggauuacaggcau

SEQ ID NO: 630195 - RNA, 19 nt, Human
ccacacaggccuggaacac

SEQ ID NO: 630196 - RNA, 20 nt, Human
ccacugcaccuggccuuuag

SEQ ID NO: 630197 - RNA, 21 nt, Human
ccacugcaccuggccuuuagu

SEQ ID NO: 630198 - RNA, 23 nt, Human
ccacugcaccuggccuuuaguga

SEQ ID NO: 630199 - RNA, 24 nt, Human
cccaaagugcugggauuacaggca

SEQ ID NO: 630200 - RNA, 19 nt, Human
cccuguguugcucaggcca

SEQ ID NO: 630201 - RNA, 19 nt, Human
ccucgugugcgcacauggc

SEQ ID NO: 630202 - RNA, 24 nt, Human
ccugaccaacauggagaaaccuca

SEQ ID NO: 630203 - RNA, 22 nt, Human
ccugaggucaggaguucgagac

SEQ ID NO: 630204 - RNA, 19 nt, Human
ccuguguugcucaggccag

SEQ ID NO: 630205 - RNA, 23 nt, Human
ccuucugagacccuaaucaugaa

SEQ ID NO: 630206 - RNA, 21 nt, Human
cgaagagcaguucagagggcg

SEQ ID NO: 630207 - RNA, 24 nt, Human
cgccuguaaucccagcacuuuggg

SEQ ID NO: 630208 - RNA, 19 nt, Human
cuagggugccuucucucca

SEQ ID NO: 630209 - RNA, 22 nt, Human
cuccacacaggccuggaacacc

SEQ ID NO: 630210 - RNA, 26 nt, Human
cuccacacaggccuggaacacccuuc

SEQ ID NO: 630211 - RNA, 19 nt, Human
cucuuccuccuuaccuucu

SEQ ID NO: 630212 - RNA, 18 nt, Human
cuggaagcccaucugccu

SEQ ID NO: 630213 - RNA, 22 nt, Human
cuuacgccuguaaucccagcac

SEQ ID NO: 630214 - RNA, 21 nt, Human
cuuuucuacaaggagcccugg

SEQ ID NO: 630215 - RNA, 20 nt, Human
gaagagcaguucagagggcg

SEQ ID NO: 630216 - RNA, 23 nt, Human
gaagagcaguucagagggcguga

SEQ ID NO: 630217 - RNA, 19 nt, Human
gaagcagaagucaggagug

SEQ ID NO: 630218 - RNA, 19 nt, Human
gaaguucaagaucaaggug

SEQ ID NO: 630219 - RNA, 22 nt, Human
gacagcccucuuucuggccuug

SEQ ID NO: 630220 - RNA, 18 nt, Human
gacugggccauggggucc

SEQ ID NO: 630221 - RNA, 23 nt, Human
gagaccagccugaccaacaugga

SEQ ID NO: 630222 - RNA, 20 nt, Human
gaguccuccuuguacccucc

SEQ ID NO: 630223 - RNA, 24 nt, Human
gaucaccugaggucaggaguucga

SEQ ID NO: 630224 - RNA, 18 nt, Human
gauuacaggcaugggcca

SEQ ID NO: 630225 - RNA, 22 nt, Human
gauuacaggcaugggccacugc

SEQ ID NO: 630226 - RNA, 23 nt, Human
gauuacaggcaugggccacugca

SEQ ID NO: 630227 - RNA, 23 nt, Human
gcagcuggggaucugggaggcca

SEQ ID NO: 630228 - RNA, 18 nt, Human
gcaguggcuuacgccugu

SEQ ID NO: 630229 - RNA, 20 nt, Human
gcccuggcuggucugggcca

SEQ ID NO: 630230 - RNA, 20 nt, Human
gcgcaguggcuuacgccugu

SEQ ID NO: 630231 - RNA, 23 nt, Human
gcugcuauaacaaugccacagac

SEQ ID NO: 630232 - RNA, 21 nt, Human
gcuucagcauaugaauucugg

SEQ ID NO: 630233 - RNA, 18 nt, Human
ggaauagggaaaacaccu

SEQ ID NO: 630234 - RNA, 18 nt, Human
ggagcccuggcuggucug

SEQ ID NO: 630235 - RNA, 22 nt, Human
ggaucaccugaggucaggaguu

SEQ ID NO: 630236 - RNA, 22 nt, Human
ggauuacaggcaugggccacug

SEQ ID NO: 630237 - RNA, 22 nt, Human
ggccaguugcaaggucuaaagc

SEQ ID NO: 630238 - RNA, 18 nt, Human
ggcgcaguggcuuacgcc

SEQ ID NO: 630239 - RNA, 24 nt, Human
ggcgcaguggcuuacgccuguaaa

SEQ ID NO: 630240 - RNA, 21 nt, Human
gguggaucaccugaggucagg

SEQ ID NO: 630241 - RNA, 21 nt, Human
guucuggaggcugggaaguuc

SEQ ID NO: 630242 - RNA, 19 nt, Human
uacaaggagcccuggcugg

SEQ ID NO: 630243 - RNA, 22 nt, Human
uacaggcaugggccacugcacc

SEQ ID NO: 630244 - RNA, 24 nt, Human
uacgccuguaaucccagcacuuug

SEQ ID NO: 630245 - RNA, 22 nt, Human
uacuuuuuccauuccacucucu

SEQ ID NO: 630246 - RNA, 20 nt, Human
ucaccugaggucaggaguuc

SEQ ID NO: 630247 - RNA, 25 nt, Human
ucagaagcagaagucaggaguggag

SEQ ID NO: 630248 - RNA, 20 nt, Human
ucaguccauaacaccguucc

SEQ ID NO: 630249 - RNA, 24 nt, Human
ucccaaagugcugggauuacaggc

SEQ ID NO: 630250 - RNA, 26 nt, Human
ucccuguguugcucaggccaguugcc

SEQ ID NO: 630251 - RNA, 19 nt, Human
ucucccuguguugcucagg

SEQ ID NO: 630252 - RNA, 23 nt, Human
ucucgagcugcuauaacaaugcc

SEQ ID NO: 630253 - RNA, 21 nt, Human
ucucuguggagccucaggucc

SEQ ID NO: 630254 - RNA, 20 nt, Human
ucucuuccuccuuaccuucu

SEQ ID NO: 630255 - RNA, 22 nt, Human
ucucuuccuccuuaccuucuga

SEQ ID NO: 630256 - RNA, 21 nt, Human
ucugggaggccagaguccggg

SEQ ID NO: 630257 - RNA, 18 nt, Human
ugacugguucaggcaugg

SEQ ID NO: 630258 - RNA, 20 nt, Human
ugcugggaaagguccucagg

SEQ ID NO: 630259 - RNA, 19 nt, Human
uggaggaacaugaacauuc

SEQ ID NO: 630260 - RNA, 24 nt, Human
uggaucaccugaggucaggaguuc

SEQ ID NO: 630261 - RNA, 26 nt, Human
uggaucaccugaggucaggaguucga

SEQ ID NO: 630262 - RNA, 21 nt, Human
uggcaguggcugggcgcagug

SEQ ID NO: 630263 - RNA, 19 nt, Human
uggcaucagccuuuucuac

SEQ ID NO: 630264 - RNA, 21 nt, Human
uggccuuguagacagccaccu

SEQ ID NO: 630265 - RNA, 21 nt, Human
uggcugggcgcaguggcuuac

SEQ ID NO: 630266 - RNA, 23 nt, Human
uggcuggucugggccaguccugg

SEQ ID NO: 630267 - RNA, 22 nt, Human
uggcuuacgccuguaaucccag

SEQ ID NO: 630268 - RNA, 24 nt, Human
uggcuuacgccuguaaucccagca

SEQ ID NO: 630269 - RNA, 21 nt, Human
ugggaaagguccucaggagcc

SEQ ID NO: 630270 - RNA, 22 nt, Human
ugggaaguucaagaucaaggug

SEQ ID NO: 630271 - RNA, 24 nt, Human
ugggaaguucaagaucaaggugcc

SEQ ID NO: 630272 - RNA, 18 nt, Human
ugggaggaauagggaaaa

SEQ ID NO: 630273 - RNA, 18 nt, Human
ugggauuacaggcauggg

SEQ ID NO: 630274 - RNA, 19 nt, Human
ugggauuacaggcaugggc

SEQ ID NO: 630275 - RNA, 21 nt, Human
ugggauuacaggcaugggcca

SEQ ID NO: 630276 - RNA, 22 nt, Human
ugggauuacaggcaugggccac

SEQ ID NO: 630277 - RNA, 22 nt, Human
ugggauuacaggcaugggccac

SEQ ID NO: 630278 - RNA, 24 nt, Human
ugggauuacaggcaugggccacug

SEQ ID NO: 630279 - RNA, 24 nt, Human
ugggauuacaggcaugggccacug

SEQ ID NO: 630280 - RNA, 24 nt, Human
uggguggaucaccugaggucagga

SEQ ID NO: 630281 - RNA, 24 nt, Human
uggucugggccaguccuggaagcc

SEQ ID NO: 630282 - RNA, 24 nt, Human
uguguugcucaggccaguugcaag

SEQ ID NO: 630283 - RNA, 21 nt, Human
uuuugaauacuuuuuccauuc

SEQ ID NO: 630284 - RNA, 18 nt, Human
aaagugcugggacuacaa

SEQ ID NO: 630285 - RNA, 19 nt, Human
aaccauuaaaauuaaagca

SEQ ID NO: 630286 - RNA, 19 nt, Human
aacccuggucuagggcagg

SEQ ID NO: 630287 - RNA, 18 nt, Human
aaccgagauccuccaccu

SEQ ID NO: 630288 - RNA, 20 nt, Human
aaccuccgccucccgggcuc

SEQ ID NO: 630289 - RNA, 18 nt, Human
aagcagcaucuuaaaugg

SEQ ID NO: 630290 - RNA, 19 nt, Human
aagugcugggacuacaagc

SEQ ID NO: 630291 - RNA, 26 nt, Human
aagugcugggacuacaagcguaagcc

SEQ ID NO: 630292 - RNA, 27 nt, Human
aauggacuuucuugacuuccaaaauuu

SEQ ID NO: 630293 - RNA, 18 nt, Human
acaagcguaagccaccgc

SEQ ID NO: 630294 - RNA, 23 nt, Human
accaccugucuuuuccauguaac

SEQ ID NO: 630295 - RNA, 21 nt, Human
accaguguuggccaggcuggu

SEQ ID NO: 630296 - RNA, 25 nt, Human
accaguguuggccaggcuggucucc

SEQ ID NO: 630297 - RNA, 25 nt, Human
accaguguuggccaggcuggucucg

SEQ ID NO: 630298 - RNA, 22 nt, Human
accgagauccuccaccuacuug

SEQ ID NO: 630299 - RNA, 19 nt, Human
accucaacugcagagaaga

SEQ ID NO: 630300 - RNA, 21 nt, Human
acggaguuucacagagaccag

SEQ ID NO: 630301 - RNA, 18 nt, Human
acuggcgcgaucucagcu

SEQ ID NO: 630302 - RNA, 20 nt, Human
agagaccaguguuggccagg

SEQ ID NO: 630303 - RNA, 24 nt, Human
agcgauucuucugccucagccucc

SEQ ID NO: 630304 - RNA, 24 nt, Human
agcucuguuacccaggcuggagug

SEQ ID NO: 630305 - RNA, 23 nt, Human
aggaaggaagucccggcccagcu

SEQ ID NO: 630306 - RNA, 21 nt, Human
aggcagcaguaaaccuuccaa

SEQ ID NO: 630307 - RNA, 24 nt, Human
aggcagcaguaaaccuuccaagcu

SEQ ID NO: 630308 - RNA, 21 nt, Human
aguguacuggcgcgaucucag

SEQ ID NO: 630309 - RNA, 24 nt, Human
caaagugcugggacuacaagcgua

SEQ ID NO: 630310 - RNA, 23 nt, Human
caaccuccgccucccgggcucaa

SEQ ID NO: 630311 - RNA, 22 nt, Human
caagcgauucuucugccucagc

SEQ ID NO: 630312 - RNA, 27 nt, Human
caagcgauucuucugccucagccuccc

SEQ ID NO: 630313 - RNA, 18 nt, Human
cacagagaccaguguugg

SEQ ID NO: 630314 - RNA, 22 nt, Human
caccuccgccgcugcgcccaac

SEQ ID NO: 630315 - RNA, 21 nt, Human
cacugcaaccuccgccucccg

SEQ ID NO: 630316 - RNA, 23 nt, Human
cacugcaaccuccgccucccggg

SEQ ID NO: 630317 - RNA, 18 nt, Human
cagggcgagcgcgcggcc

SEQ ID NO: 630318 - RNA, 26 nt, Human
caguagagacggaguuucacagagac

SEQ ID NO: 630319 - RNA, 24 nt, Human
caguggucccuuuucccuucguuu

SEQ ID NO: 630320 - RNA, 24 nt, Human
ccaaagugcugggacuacaagcgu

SEQ ID NO: 630321 - RNA, 23 nt, Human
ccaccgcguccggccuaaaugga

SEQ ID NO: 630322 - RNA, 22 nt, Human
ccaccuacuugccuaccaccug

SEQ ID NO: 630323 - RNA, 18 nt, Human
cccagacagcugcgaagc

SEQ ID NO: 630324 - RNA, 23 nt, Human
cccgggcucaagcgauucuucug

SEQ ID NO: 630325 - RNA, 24 nt, Human
ccgccucccgggcucaagcgauuc

SEQ ID NO: 630326 - RNA, 26 nt, Human
ccgccugccucagccucccaaagugc

SEQ ID NO: 630327 - RNA, 25 nt, Human
ccgcugcgcccaacccuggucuagg

SEQ ID NO: 630328 - RNA, 21 nt, Human
ccuagguuaaggcgcggaggc

SEQ ID NO: 630329 - RNA, 24 nt, Human
ccuccaccuacuugccuaccaccu

SEQ ID NO: 630330 - RNA, 24 nt, Human
ccucccgggcucaagcgauucuuc

SEQ ID NO: 630331 - RNA, 21 nt, Human
ccuggucuagggcagggcgag

SEQ ID NO: 630332 - RNA, 18 nt, Human
ccugugauccgccugccu

SEQ ID NO: 630333 - RNA, 19 nt, Human
cgagauccuccaccuacuu

SEQ ID NO: 630334 - RNA, 21 nt, Human
cgagcgcgcggccgcggggcu

SEQ ID NO: 630335 - RNA, 22 nt, Human
cgccgcugcgcccaacccuggu

SEQ ID NO: 630336 - RNA, 24 nt, Human
cucaagcgauucuucugccucagc

SEQ ID NO: 630337 - RNA, 24 nt, Human
cucacugcaaccuccgccucccgg

SEQ ID NO: 630338 - RNA, 24 nt, Human
cucccgacccugugauccgccugc

SEQ ID NO: 630339 - RNA, 18 nt, Human
cucuccauauuuuuuuac

SEQ ID NO: 630340 - RNA, 23 nt, Human
cugcaaccuccgccucccgggcu

SEQ ID NO: 630341 - RNA, 23 nt, Human
cugccucagccucccaaagugcu

SEQ ID NO: 630342 - RNA, 24 nt, Human
cugccucagccucccaaagugcug

SEQ ID NO: 630343 - RNA, 23 nt, Human
cugccucagccucccaaguagcu

SEQ ID NO: 630344 - RNA, 25 nt, Human
cugugauccgccugccucagccucc

SEQ ID NO: 630345 - RNA, 19 nt, Human
cuguuacccaggcuggagu

SEQ ID NO: 630346 - RNA, 24 nt, Human
cuuugaaugucugcacuuuguuuc

SEQ ID NO: 630347 - RNA, 24 nt, Human
gaccaguguuggccaggcuggucu

SEQ ID NO: 630348 - RNA, 24 nt, Human
gacccugugauccgccugccucag

SEQ ID NO: 630349 - RNA, 22 nt, Human
gcaaccuccgccucccgggcuc

SEQ ID NO: 630350 - RNA, 19 nt, Human
gcagagaagaggacuugag

SEQ ID NO: 630351 - RNA, 18 nt, Human
gcagcccagaagccaccu

SEQ ID NO: 630352 - RNA, 18 nt, Human
gcccagacagcugcgaag

SEQ ID NO: 630353 - RNA, 21 nt, Human
gccgcugcgcccaacccuggu

SEQ ID NO: 630354 - RNA, 22 nt, Human
gccuagguuaaggcgcggaggc

SEQ ID NO: 630355 - RNA, 19 nt, Human
gcgaucgccgccucccagc

SEQ ID NO: 630356 - RNA, 24 nt, Human
gcgauucuucugccucagccuccc

SEQ ID NO: 630357 - RNA, 20 nt, Human
gcgcagcccagaagccaccu

SEQ ID NO: 630358 - RNA, 23 nt, Human
gcgcagcccagaagccaccuccg

SEQ ID NO: 630359 - RNA, 18 nt, Human
gcgguggaggaaggaagu

SEQ ID NO: 630360 - RNA, 27 nt, Human
gcucuguuacccaggcuggaguguacu

SEQ ID NO: 630361 - RNA, 21 nt, Human
ggacuacaagcguaagccacc

SEQ ID NO: 630362 - RNA, 22 nt, Human
ggacuacaagcguaagccaccg

SEQ ID NO: 630363 - RNA, 18 nt, Human
ggcggaggcggcagccgc

SEQ ID NO: 630364 - RNA, 23 nt, Human
guaacaaugacugauguagauaa

SEQ ID NO: 630365 - RNA, 18 nt, Human
gugauccgccugccucag

SEQ ID NO: 630366 - RNA, 24 nt, Human
gugauccgccugccucagccuccc

SEQ ID NO: 630367 - RNA, 21 nt, Human
uaaacauggacaaacacauaa

SEQ ID NO: 630368 - RNA, 24 nt, Human
uaaaccuuccaagcuaucacacac

SEQ ID NO: 630369 - RNA, 21 nt, Human
uaaaugcacuauaacaauaaa

SEQ ID NO: 630370 - RNA, 22 nt, Human
uaauuugcaaaccgagauccuc

SEQ ID NO: 630371 - RNA, 23 nt, Human
uacaagcguaagccaccgcgucc

SEQ ID NO: 630372 - RNA, 24 nt, Human
uacacagaacaaagauuaguuauc

SEQ ID NO: 630373 - RNA, 20 nt, Human
uacccaggcuggaguguacu

SEQ ID NO: 630374 - RNA, 24 nt, Human
uacccaggcuggaguguacuggcg

SEQ ID NO: 630375 - RNA, 21 nt, Human
uaucacagaugcccgccaaca

SEQ ID NO: 630376 - RNA, 22 nt, Human
uauugggaggauugaaaccuga

SEQ ID NO: 630377 - RNA, 23 nt, Human
ucacugcaaccuccgccucccgg

SEQ ID NO: 630378 - RNA, 24 nt, Human
ucacugcaaccuccgccucccggg

SEQ ID NO: 630379 - RNA, 25 nt, Human
ucacugcaaccuccgccucccgggc

SEQ ID NO: 630380 - RNA, 27 nt, Human
ucacugcaaccuccgccucccgggcuc

SEQ ID NO: 630381 - RNA, 18 nt, Human
ucagccucccaaguagcu

SEQ ID NO: 630382 - RNA, 20 nt, Human
ucagccucccaaguagcugg

SEQ ID NO: 630383 - RNA, 18 nt, Human
ucaguagagacggaguuu

SEQ ID NO: 630384 - RNA, 23 nt, Human
ucagugccugccgcaggguuguu

SEQ ID NO: 630385 - RNA, 22 nt, Human
uccaaaauuuuccuuuccaacu

SEQ ID NO: 630386 - RNA, 24 nt, Human
ucccaaagugcugggacuacaagc

SEQ ID NO: 630387 - RNA, 20 nt, Human
ucccgggcucaagcgauucu

SEQ ID NO: 630388 - RNA, 24 nt, Human
ucccgggcucaagcgauucuucug

SEQ ID NO: 630389 - RNA, 24 nt, Human
ucuagcucuguuacccaggcugga

SEQ ID NO: 630390 - RNA, 20 nt, Human
ucucccagcucgcgcagccc

SEQ ID NO: 630391 - RNA, 18 nt, Human
ucuguuacccaggcugga

SEQ ID NO: 630392 - RNA, 19 nt, Human
ucuucggcaagccgccuag

SEQ ID NO: 630393 - RNA, 21 nt, Human
ugaaaccugaaaccucaacug

SEQ ID NO: 630394 - RNA, 20 nt, Human
ugacuuccaaaauuuuccuu

SEQ ID NO: 630395 - RNA, 30 nt, Human
ugacuuccaaaauuuuccuuuccaacuccu

SEQ ID NO: 630396 - RNA, 24 nt, Human
ugagaucuucggcaagccgccuag

SEQ ID NO: 630397 - RNA, 22 nt, Human
ugagauggagucuagcucuguu

SEQ ID NO: 630398 - RNA, 22 nt, Human
ugauauguagcauuauacacaa

SEQ ID NO: 630399 - RNA, 24 nt, Human
ugccucagccucccaaagugcugg

SEQ ID NO: 630400 - RNA, 24 nt, Human
ugccucagccucccaaguagcugg

SEQ ID NO: 630401 - RNA, 24 nt, Human
ugcugggacuacaagcguaagcca

SEQ ID NO: 630402 - RNA, 19 nt, Human
uggaggaaggaagucccgg

SEQ ID NO: 630403 - RNA, 18 nt, Human
uggaguguacuggcgcga

SEQ ID NO: 630404 - RNA, 24 nt, Human
uggaguguacuggcgcgaucucag

SEQ ID NO: 630405 - RNA, 24 nt, Human
uggcgcgaucucagcucacugcaa

SEQ ID NO: 630406 - RNA, 21 nt, Human
ugggacuacaagcguaagcca

SEQ ID NO: 630407 - RNA, 22 nt, Human
ugggacuacaagcguaagccac

SEQ ID NO: 630408 - RNA, 24 nt, Human
ugggacuacaagcguaagccaccg

SEQ ID NO: 630409 - RNA, 18 nt, Human
ugguaucacagaugcccg

SEQ ID NO: 630410 - RNA, 21 nt, Human
ugguaucacagaugcccgcca

SEQ ID NO: 630411 - RNA, 21 nt, Human
uguagauaauuuuuuuuguug

SEQ ID NO: 630412 - RNA, 19 nt, Human
uguguaagaaucucaagga

SEQ ID NO: 630413 - RNA, 24 nt, Human
uguuucacucuccauauuuuuuua

SEQ ID NO: 630414 - RNA, 20 nt, Human
uuaaauggugcaauucagug

SEQ ID NO: 630415 - RNA, 18 nt, Human
uuacccaggcuggagugu

SEQ ID NO: 630416 - RNA, 22 nt, Human
uugaggcagcaguaaaccuucc

SEQ ID NO: 630417 - RNA, 24 nt, Human
uuggccaggcuggucucgaacucc

SEQ ID NO: 630418 - RNA, 24 nt, Human
uuuucaguagagacggaguuucac

SEQ ID NO: 630419 - RNA, 22 nt, Human
uuuuuuuuuuuuuugagaugga

SEQ ID NO: 630420 - RNA, 21 nt, Human
uuuuuuuuuuuuuuuuuuugg

SEQ ID NO: 630421 - RNA, 25 nt, Human
aagcaauaaccauaccauauguuca

SEQ ID NO: 630422 - RNA, 23 nt, Human
aaguccugcaguuggcccuuugg

SEQ ID NO: 630423 - RNA, 19 nt, Human
acacauuuccuaggaaagc

SEQ ID NO: 630424 - RNA, 22 nt, Human
accaccccccccgcccccccca

SEQ ID NO: 630425 - RNA, 21 nt, Human
accccccccgccccccccaau

SEQ ID NO: 630426 - RNA, 19 nt, Human
accugcucuauaagugggu

SEQ ID NO: 630427 - RNA, 18 nt, Human
agaacucaaguccugcag

SEQ ID NO: 630428 - RNA, 23 nt, Human
aggcaaaagcaauaaccauacca

SEQ ID NO: 630429 - RNA, 18 nt, Human
agggcagagggacagggg

SEQ ID NO: 630430 - RNA, 22 nt, Human
agguuccaccaccccccccgcc

SEQ ID NO: 630431 - RNA, 18 nt, Human
auaguugaaaauagucca

SEQ ID NO: 630432 - RNA, 18 nt, Human
auauacccaaauccauac

SEQ ID NO: 630433 - RNA, 20 nt, Human
caagagaacagugugaguac

SEQ ID NO: 630434 - RNA, 24 nt, Human
cacauaucccucauuuaagaaguc

SEQ ID NO: 630435 - RNA, 20 nt, Human
caccaccccccccgcccccc

SEQ ID NO: 630436 - RNA, 21 nt, Human
cacccccgcccuccgggaccc

SEQ ID NO: 630437 - RNA, 25 nt, Human
cacuccggccucuucccuacaaccu

SEQ ID NO: 630438 - RNA, 24 nt, Human
cauauacccaaauccauacguggu

SEQ ID NO: 630439 - RNA, 24 nt, Human
ccaauguagcuccucuaccucuac

SEQ ID NO: 630440 - RNA, 23 nt, Human
ccaccaccccccccgcccccccc

SEQ ID NO: 630441 - RNA, 22 nt, Human
ccaggccuacaaagaaggccgg

SEQ ID NO: 630442 - RNA, 23 nt, Human
cccaaauccauacgugagaacuc

SEQ ID NO: 630443 - RNA, 19 nt, Human
ccccccccgccccccccaa

SEQ ID NO: 630444 - RNA, 21 nt, Human
ccccgccccccccaauuacag

SEQ ID NO: 630445 - RNA, 22 nt, Human
ccccgcccuccgggaccccagc

SEQ ID NO: 630446 - RNA, 22 nt, Human
ccgccacccccgcccuccggga

SEQ ID NO: 630447 - RNA, 19 nt, Human
ccggcgccgccacccccgc

SEQ ID NO: 630448 - RNA, 19 nt, Human
ccuccgggaccccagcgcu

SEQ ID NO: 630449 - RNA, 22 nt, Human
ccugcaguuggcccuuuggaac

SEQ ID NO: 630450 - RNA, 23 nt, Human
cgaccuccggcgccgccaccccc

SEQ ID NO: 630451 - RNA, 19 nt, Human
cgcuuccuccgcgcagccc

SEQ ID NO: 630452 - RNA, 26 nt, Human
cuccggcgccgccacccccgcccucc

SEQ ID NO: 630453 - RNA, 22 nt, Human
cucucagguccgcagguuccac

SEQ ID NO: 630454 - RNA, 21 nt, Human
gaccuccggcgccgccacccc

SEQ ID NO: 630455 - RNA, 21 nt, Human
gaggaguugaggcagaugggc

SEQ ID NO: 630456 - RNA, 18 nt, Human
gaggcaaaagcaauaacc

SEQ ID NO: 630457 - RNA, 22 nt, Human
gauugguuccaggaacuuccac

SEQ ID NO: 630458 - RNA, 20 nt, Human
gcagaugggcaagagggcag

SEQ ID NO: 630459 - RNA, 20 nt, Human
gcagguuccaccaccccccc

SEQ ID NO: 630460 - RNA, 22 nt, Human
gccccccccaauuacagugcuu

SEQ ID NO: 630461 - RNA, 22 nt, Human
ggaaccugaguauaugaaccug

SEQ ID NO: 630462 - RNA, 18 nt, Human
ggcaagagggcagaggga

SEQ ID NO: 630463 - RNA, 21 nt, Human
gguucuucuccuuuaguaccc

SEQ ID NO: 630464 - RNA, 24 nt, Human
guaguaguuaucccuugguuuaca

SEQ ID NO: 630465 - RNA, 19 nt, Human
gugaagcacuaggccuccc

SEQ ID NO: 630466 - RNA, 22 nt, Human
uaaccauaccauauguucaaac

SEQ ID NO: 630467 - RNA, 24 nt, Human
uaagugaagcacuaggccuccccu

SEQ ID NO: 630468 - RNA, 20 nt, Human
uacagugcuuugggguucga

SEQ ID NO: 630469 - RNA, 22 nt, Human
uaguuaucccuugguuuacaua

SEQ ID NO: 630470 - RNA, 21 nt, Human
uaugaagacagagagggaaaa

SEQ ID NO: 630471 - RNA, 20 nt, Human
uauguugcucaagggucaaa

SEQ ID NO: 630472 - RNA, 22 nt, Human
ucaagggucaaauguauuuacu

SEQ ID NO: 630473 - RNA, 26 nt, Human
ucagaaaaacaugccuugcaugccag

SEQ ID NO: 630474 - RNA, 18 nt, Human
ucagaggggaaggccauc

SEQ ID NO: 630475 - RNA, 21 nt, Human
ucagguccgcagguuccacca

SEQ ID NO: 630476 - RNA, 18 nt, Human
uccaccaccccccccgcc

SEQ ID NO: 630477 - RNA, 20 nt, Human
ucgacaucaaaacagagauc

SEQ ID NO: 630478 - RNA, 26 nt, Human
ucgacaucaaaacagagaucaaauac

SEQ ID NO: 630479 - RNA, 24 nt, Human
ucuacggugccaggccuacaaaga

SEQ ID NO: 630480 - RNA, 20 nt, Human
ucuccuuuaguacccugaug

SEQ ID NO: 630481 - RNA, 24 nt, Human
ucuggcaggcuguagacaaauggg

SEQ ID NO: 630482 - RNA, 25 nt, Human
ugacauguauguuauagcccuuaca

SEQ ID NO: 630483 - RNA, 18 nt, Human
ugagaacucaaguccugc

SEQ ID NO: 630484 - RNA, 24 nt, Human
uggagguuuuuuuuuuacuuuaaa

SEQ ID NO: 630485 - RNA, 18 nt, Human
ugggcuaggacuaggcuu

SEQ ID NO: 630486 - RNA, 18 nt, Human
uguuagagagaugcaaga

SEQ ID NO: 630487 - RNA, 23 nt, Human
uucaaaggccccuaugccuuuga

SEQ ID NO: 630488 - RNA, 24 nt, Human
uucauagccuuuucacauaucccu

SEQ ID NO: 630489 - RNA, 19 nt, Human
uuccaccaccccccccgcc

SEQ ID NO: 630490 - RNA, 21 nt, Human
uucuccuuuaguacccugaug

SEQ ID NO: 630491 - RNA, 24 nt, Human
uuguuuguuuuuaaucagaaaaac

SEQ ID NO: 630492 - RNA, 23 nt, Human
uuuaagaagucacaguguugcag

SEQ ID NO: 630493 - RNA, 27 nt, Human
uuuaaucagaaaaacaugccuugcaug

SEQ ID NO: 630494 - RNA, 21 nt, Human
uuuauaguugaaaauagucca

SEQ ID NO: 630495 - RNA, 22 nt, Human
uuugaaauucaguguaaaucac

SEQ ID NO: 630496 - RNA, 22 nt, Human
uuugggcagaugggcaagagga

SEQ ID NO: 630497 - RNA, 19 nt, Human
uuuguauuuuucauagccu

SEQ ID NO: 630498 - RNA, 18 nt, Human
uuuuuuuuuuuucuucug

SEQ ID NO: 630499 - RNA, 24 nt, Human
aaagugcugggauaacaggcguga

SEQ ID NO: 630500 - RNA, 24 nt, Human
aaagugcugggauuacaggcauga

SEQ ID NO: 630501 - RNA, 24 nt, Human
aagaaacaguuuaacugaaucuca

SEQ ID NO: 630502 - RNA, 20 nt, Human
aagcucggcgugcugugguu

SEQ ID NO: 630503 - RNA, 19 nt, Human
aagugcugggauuacaggc

SEQ ID NO: 630504 - RNA, 21 nt, Human
aagugcugggauuacaggcau

SEQ ID NO: 630505 - RNA, 26 nt, Human
aagugcugggauuacaggcaugagcc

SEQ ID NO: 630506 - RNA, 24 nt, Human
aauuuuguauuuuuaguagagacg

SEQ ID NO: 630507 - RNA, 22 nt, Human
acaggcgugagccaccgcgccc

SEQ ID NO: 630508 - RNA, 21 nt, Human
accccgggcccucucuggugu

SEQ ID NO: 630509 - RNA, 22 nt, Human
accgggugcagaagcagcuccg

SEQ ID NO: 630510 - RNA, 20 nt, Human
acgggguuucuccauguugg

SEQ ID NO: 630511 - RNA, 21 nt, Human
acgggguuucuccauguuggu

SEQ ID NO: 630512 - RNA, 24 nt, Human
acgggguuucuccauguuggucag

SEQ ID NO: 630513 - RNA, 23 nt, Human
acuggucucgaacucccgaccuc

SEQ ID NO: 630514 - RNA, 19 nt, Human
agaagcuggacgcuggcuu

SEQ ID NO: 630515 - RNA, 19 nt, Human
agauuacaggcaugugcca

SEQ ID NO: 630516 - RNA, 24 nt, Human
agcgauucuccugccucagccucu

SEQ ID NO: 630517 - RNA, 19 nt, Human
agcucggcgugcugugguu

SEQ ID NO: 630518 - RNA, 20 nt, Human
aggcaugugccaccacgccc

SEQ ID NO: 630519 - RNA, 24 nt, Human
aggugauccgcccgccucagccuc

SEQ ID NO: 630520 - RNA, 20 nt, Human
aguagagaugggguuucucc

SEQ ID NO: 630521 - RNA, 23 nt, Human
aguagcucggauuauaggcaugu

SEQ ID NO: 630522 - RNA, 21 nt, Human
aguagcugagauuacaggcau

SEQ ID NO: 630523 - RNA, 23 nt, Human
aguagcugagauuacaggcaugu

SEQ ID NO: 630524 - RNA, 21 nt, Human
agucugggcuuagaacacaga

SEQ ID NO: 630525 - RNA, 24 nt, Human
agugauucuccugccucagccucc

SEQ ID NO: 630526 - RNA, 24 nt, Human
agugcaauggcacgaucucggcuc

SEQ ID NO: 630527 - RNA, 20 nt, Human
agugcaauggcgcgaucucg

SEQ ID NO: 630528 - RNA, 24 nt, Human
agugcaauggcgcgaucucggcuc

SEQ ID NO: 630529 - RNA, 18 nt, Human
agugcugggauuacaggc

SEQ ID NO: 630530 - RNA, 24 nt, Human
aguuucguauuuuuaguagagaug

SEQ ID NO: 630531 - RNA, 19 nt, Human
auaaaacgugccaguuccc

SEQ ID NO: 630532 - RNA, 24 nt, Human
augggguuucuccguguuggucag

SEQ ID NO: 630533 - RNA, 23 nt, Human
auugcuggggcuuccgggggucc

SEQ ID NO: 630534 - RNA, 24 nt, Human
caaagugcugggauaacaggcgug

SEQ ID NO: 630535 - RNA, 24 nt, Human
caaagugcugggauuacaggcaug

SEQ ID NO: 630536 - RNA, 22 nt, Human
caacuccgccucccggguucaa

SEQ ID NO: 630537 - RNA, 22 nt, Human
caagcgauucuccugccucagc

SEQ ID NO: 630538 - RNA, 20 nt, Human
caagugauucuccugccuca

SEQ ID NO: 630539 - RNA, 22 nt, Human
caagugauucuccugccucagc

SEQ ID NO: 630540 - RNA, 19 nt, Human
caccaggacacgaaaccag

SEQ ID NO: 630541 - RNA, 23 nt, Human
caguucccaaaauccgcccaaga

SEQ ID NO: 630542 - RNA, 23 nt, Human
cauucucuccaacaggaguuugg

SEQ ID NO: 630543 - RNA, 22 nt, Human
ccaaagugcugggauaacaggc

SEQ ID NO: 630544 - RNA, 24 nt, Human
ccaaagugcugggauaacaggcgu

SEQ ID NO: 630545 - RNA, 23 nt, Human
ccaaagugcugggauuacaggca

SEQ ID NO: 630546 - RNA, 24 nt, Human
ccaaagugcugggauuacaggcau

SEQ ID NO: 630547 - RNA, 20 nt, Human
ccaccacgcccggcuaauuu

SEQ ID NO: 630548 - RNA, 20 nt, Human
ccaccacgcccggcuaauuu

SEQ ID NO: 630549 - RNA, 19 nt, Human
ccauguuggucaggcuggu

SEQ ID NO: 630550 - RNA, 24 nt, Human
cccaaagugcugggauuacaggca

SEQ ID NO: 630551 - RNA, 20 nt, Human
cccagguucaagcgauucuc

SEQ ID NO: 630552 - RNA, 23 nt, Human
cccagguucaagcgauucuccug

SEQ ID NO: 630553 - RNA, 18 nt, Human
cccgaccucaggugaucc

SEQ ID NO: 630554 - RNA, 18 nt, Human
cccgaccucaggugaucc

SEQ ID NO: 630555 - RNA, 21 nt, Human
cccgaccucaggugauccgcc

SEQ ID NO: 630556 - RNA, 22 nt, Human
cccgaccucaggugauccgccc

SEQ ID NO: 630557 - RNA, 23 nt, Human
cccgaccucaggugauccgccug

SEQ ID NO: 630558 - RNA, 22 nt, Human
cccggccccuuucucuuucuuu

SEQ ID NO: 630559 - RNA, 21 nt, Human
cccggguucaagugauucucc

SEQ ID NO: 630560 - RNA, 23 nt, Human
cccggguucaagugauucuccug

SEQ ID NO: 630561 - RNA, 22 nt, Human
ccgcaacuccgccucccggguu

SEQ ID NO: 630562 - RNA, 22 nt, Human
ccgcccaagaaagcuguggcuc

SEQ ID NO: 630563 - RNA, 26 nt, Human
ccgcccgccucagccucccaaagugc

SEQ ID NO: 630564 - RNA, 24 nt, Human
ccgccucagccucccaaagugcug

SEQ ID NO: 630565 - RNA, 24 nt, Human
ccgccucccagguucaagcgauuc

SEQ ID NO: 630566 - RNA, 24 nt, Human
ccgccucccggguucaagugauuc

SEQ ID NO: 630567 - RNA, 19 nt, Human
ccguguuggucagacuggu

SEQ ID NO: 630568 - RNA, 23 nt, Human
ccguguuggucagacuggucucg

SEQ ID NO: 630569 - RNA, 24 nt, Human
ccucccagguucaagcgauucucc

SEQ ID NO: 630570 - RNA, 21 nt, Human
ccucccggguucaagugauuc

SEQ ID NO: 630571 - RNA, 24 nt, Human
ccucccggguucaagugauucucc

SEQ ID NO: 630572 - RNA, 20 nt, Human
ccucuaauucauucucucca

SEQ ID NO: 630573 - RNA, 24 nt, Human
ccugccucagccuccccaguagcu

SEQ ID NO: 630574 - RNA, 20 nt, Human
ccuggcuucguguccaggga

SEQ ID NO: 630575 - RNA, 18 nt, Human
cgaccucaggugauccgc

SEQ ID NO: 630576 - RNA, 18 nt, Human
cgaccucaggugauccgc

SEQ ID NO: 630577 - RNA, 24 nt, Human
cgaccucaggugauccgcccgccu

SEQ ID NO: 630578 - RNA, 24 nt, Human
cgaccucaggugauccgccugccu

SEQ ID NO: 630579 - RNA, 19 nt, Human
cgacuccuccggcaccccc

SEQ ID NO: 630580 - RNA, 24 nt, Human
cgccucagccucccaaagugcugg

SEQ ID NO: 630581 - RNA, 21 nt, Human
cgccugccucgaccucccaaa

SEQ ID NO: 630582 - RNA, 19 nt, Human
cggauuauaggcaugugcc

SEQ ID NO: 630583 - RNA, 24 nt, Human
cggcaaccuccgccucccagguuc

SEQ ID NO: 630584 - RNA, 24 nt, Human
cgggguuucuccauguuggucagg

SEQ ID NO: 630585 - RNA, 25 nt, Human
cuaauucauucucuccaacaggagu

SEQ ID NO: 630586 - RNA, 24 nt, Human
cuaauuuuguauuuuuaguagaga

SEQ ID NO: 630587 - RNA, 22 nt, Human
cuaguagcugagauuacaggca

SEQ ID NO: 630588 - RNA, 23 nt, Human
cuaguagcugagauuacaggcau

SEQ ID NO: 630589 - RNA, 24 nt, Human
cucacggcaaccuccgccucccag

SEQ ID NO: 630590 - RNA, 21 nt, Human
cucauauugucgccucccgga

SEQ ID NO: 630591 - RNA, 22 nt, Human
cuccauguuggucaggcugguc

SEQ ID NO: 630592 - RNA, 26 nt, Human
cucccgaccucaggugauccgcccgc

SEQ ID NO: 630593 - RNA, 26 nt, Human
cucccgaccucaggugauccgccugc

SEQ ID NO: 630594 - RNA, 24 nt, Human
cuccguguuggucagacuggucuc

SEQ ID NO: 630595 - RNA, 23 nt, Human
cuccugccucagccucucuagua

SEQ ID NO: 630596 - RNA, 20 nt, Human
cucggauuauaggcaugugc

SEQ ID NO: 630597 - RNA, 21 nt, Human
cucuuguugcccaggcuagag

SEQ ID NO: 630598 - RNA, 23 nt, Human
cugccucagccucucuaguagcu

SEQ ID NO: 630599 - RNA, 24 nt, Human
cugccucgaccucccaaagugcug

SEQ ID NO: 630600 - RNA, 22 nt, Human
cuucacgcuccccggggacaaa

SEQ ID NO: 630601 - RNA, 23 nt, Human
gaccucaggugauccgcccgccu

SEQ ID NO: 630602 - RNA, 24 nt, Human
gaccucaggugauccgcccgccuc

SEQ ID NO: 630603 - RNA, 23 nt, Human
gaccucaggugauccgccugccu

SEQ ID NO: 630604 - RNA, 24 nt, Human
gaccucaggugauccgccugccuc

SEQ ID NO: 630605 - RNA, 23 nt, Human
gagacgggguuucuccauguugg

SEQ ID NO: 630606 - RNA, 24 nt, Human
gagacgggguuucuccauguuggu

SEQ ID NO: 630607 - RNA, 24 nt, Human
gagaugggguuucuccguguuggu

SEQ ID NO: 630608 - RNA, 18 nt, Human
gauaacaggcgugagcca

SEQ ID NO: 630609 - RNA, 18 nt, Human
gauuacaggcaugagcca

SEQ ID NO: 630610 - RNA, 22 nt, Human
gauuacaggcaugagccacugc

SEQ ID NO: 630611 - RNA, 22 nt, Human
gauuacaggcaugagccacugc

SEQ ID NO: 630612 - RNA, 18 nt, Human
gauuacaggcaugugcca

SEQ ID NO: 630613 - RNA, 18 nt, Human
gauuauaggcaugugcca

SEQ ID NO: 630614 - RNA, 24 nt, Human
gccaggaccccgggcccucucugg

SEQ ID NO: 630615 - RNA, 24 nt, Human
gcgauucuccugccucagccucuc

SEQ ID NO: 630616 - RNA, 19 nt, Human
gcuagagugcaauggcgcg

SEQ ID NO: 630617 - RNA, 21 nt, Human
gcucuuguugcccaggcuaga

SEQ ID NO: 630618 - RNA, 23 nt, Human
gcuggucuagaacucccgaccuc

SEQ ID NO: 630619 - RNA, 21 nt, Human
gcugugguuugggggagaagc

SEQ ID NO: 630620 - RNA, 22 nt, Human
ggauuacaggcaugagccacug

SEQ ID NO: 630621 - RNA, 19 nt, Human
ggauuauaggcaugugcca

SEQ ID NO: 630622 - RNA, 21 nt, Human
ggccaggaccccgggcccucu

SEQ ID NO: 630623 - RNA, 26 nt, Human
gggcgcuggggaugcuccgggcuugg

SEQ ID NO: 630624 - RNA, 23 nt, Human
gggguuucuccauguuggucagg

SEQ ID NO: 630625 - RNA, 18 nt, Human
gggguuucuccguguugg

SEQ ID NO: 630626 - RNA, 22 nt, Human
ggguucaagugauucuccugcc

SEQ ID NO: 630627 - RNA, 23 nt, Human
ggguucaagugauucuccugccu

SEQ ID NO: 630628 - RNA, 20 nt, Human
ggugcagaagcagcuccgga

SEQ ID NO: 630629 - RNA, 23 nt, Human
guagagacgggguuucuccaugu

SEQ ID NO: 630630 - RNA, 20 nt, Human
guagcugagauuacaggcau

SEQ ID NO: 630631 - RNA, 20 nt, Human
gucuccggccaggaccccgg

SEQ ID NO: 630632 - RNA, 24 nt, Human
gugacagugagucugggcuuagaa

SEQ ID NO: 630633 - RNA, 24 nt, Human
gugauccgcccgccucagccuccc

SEQ ID NO: 630634 - RNA, 24 nt, Human
gugauucuccugccucagccuccc

SEQ ID NO: 630635 - RNA, 25 nt, Human
guuucuccguguuggucagacuggu

SEQ ID NO: 630636 - RNA, 21 nt, Human
uaaaacgugccaguucccaaa

SEQ ID NO: 630637 - RNA, 23 nt, Human
uacaggcaugagccacugcgccc

SEQ ID NO: 630638 - RNA, 23 nt, Human
uacaggcaugugccaccacgccc

SEQ ID NO: 630639 - RNA, 24 nt, Human
uaccagagcacccggcgucucaca

SEQ ID NO: 630640 - RNA, 23 nt, Human
uagagugcaauggcgcgaucucg

SEQ ID NO: 630641 - RNA, 24 nt, Human
uagagugcaauggcgcgaucucgg

SEQ ID NO: 630642 - RNA, 24 nt, Human
uaguagagacgggguuucuccaug

SEQ ID NO: 630643 - RNA, 21 nt, Human
uaguagagaugggguuucucc

SEQ ID NO: 630644 - RNA, 22 nt, Human
uaguagagaugggguuucuccg

SEQ ID NO: 630645 - RNA, 24 nt, Human
uaguagagaugggguuucuccgug

SEQ ID NO: 630646 - RNA, 25 nt, Human
uaguagagaugggguuucuccgugu

SEQ ID NO: 630647 - RNA, 24 nt, Human
uaguagcugagauuacaggcaugu

SEQ ID NO: 630648 - RNA, 18 nt, Human
uauuuuuuuuuuuuuuga

SEQ ID NO: 630649 - RNA, 19 nt, Human
ucaagugauucuccugccu

SEQ ID NO: 630650 - RNA, 23 nt, Human
ucaccgcaacuccgccucccggg

SEQ ID NO: 630651 - RNA, 24 nt, Human
ucacggcaaccuccgccucccagg

SEQ ID NO: 630652 - RNA, 25 nt, Human
ucacggcaaccuccgccucccaggu

SEQ ID NO: 630653 - RNA, 21 nt, Human
ucagccuccccaguagcucgg

SEQ ID NO: 630654 - RNA, 18 nt, Human
ucccaaaauccgcccaag

SEQ ID NO: 630655 - RNA, 24 nt, Human
ucccaaagugcugggauaacaggc

SEQ ID NO: 630656 - RNA, 24 nt, Human
ucccaaagugcugggauuacaggc

SEQ ID NO: 630657 - RNA, 21 nt, Human
ucccagguucaagcgauucuc

SEQ ID NO: 630658 - RNA, 24 nt, Human
ucccagguucaagcgauucuccug

SEQ ID NO: 630659 - RNA, 19 nt, Human
uccccggggacaaagcucg

SEQ ID NO: 630660 - RNA, 21 nt, Human
ucccggguucaagugauucuc

SEQ ID NO: 630661 - RNA, 24 nt, Human
ucccggguucaagugauucuccug

SEQ ID NO: 630662 - RNA, 25 nt, Human
ucccugaggauugcuggggcuuccg

SEQ ID NO: 630663 - RNA, 21 nt, Human
uccgcccgccucagccuccca

SEQ ID NO: 630664 - RNA, 18 nt, Human
ucgccucccggagcuggu

SEQ ID NO: 630665 - RNA, 18 nt, Human
ucgcucuuguugcccagg

SEQ ID NO: 630666 - RNA, 24 nt, Human
ucggauuauaggcaugugccacca

SEQ ID NO: 630667 - RNA, 23 nt, Human
ucuaguagcugagauuacaggca

SEQ ID NO: 630668 - RNA, 21 nt, Human
ucuccggccaggaccccgggc

SEQ ID NO: 630669 - RNA, 25 nt, Human
ucuccugccucagccuccccaguag

SEQ ID NO: 630670 - RNA, 24 nt, Human
ucucuaguagcugagauuacaggc

SEQ ID NO: 630671 - RNA, 18 nt, Human
ucuuguugcccaggcuag

SEQ ID NO: 630672 - RNA, 18 nt, Human
ucuuuuuuuuuuuuuuga

SEQ ID NO: 630673 - RNA, 18 nt, Human
ugagauuacaggcaugug

SEQ ID NO: 630674 - RNA, 21 nt, Human
ugagauuacaggcaugugcca

SEQ ID NO: 630675 - RNA, 22 nt, Human
ugagauuacaggcaugugccac

SEQ ID NO: 630676 - RNA, 24 nt, Human
ugagauuacaggcaugugccacca

SEQ ID NO: 630677 - RNA, 20 nt, Human
ugauucuccugccucagccu

SEQ ID NO: 630678 - RNA, 21 nt, Human
ugcccaggcuagagugcaaug

SEQ ID NO: 630679 - RNA, 19 nt, Human
ugccccguccaucgcccuc

SEQ ID NO: 630680 - RNA, 25 nt, Human
ugccccguccaucgcccucauauug

SEQ ID NO: 630681 - RNA, 21 nt, Human
ugccucagccuccccaguagc

SEQ ID NO: 630682 - RNA, 23 nt, Human
ugccucagccuccccaguagcuc

SEQ ID NO: 630683 - RNA, 24 nt, Human
ugccucagccucucuaguagcuga

SEQ ID NO: 630684 - RNA, 24 nt, Human
ugccucgaccucccaaagugcugg

SEQ ID NO: 630685 - RNA, 22 nt, Human
ugcgggcgcuggggaugcuccg

SEQ ID NO: 630686 - RNA, 20 nt, Human
ugcuggggcuuccggggguc

SEQ ID NO: 630687 - RNA, 19 nt, Human
ugggauaacaggcgugagc

SEQ ID NO: 630688 - RNA, 22 nt, Human
ugggauaacaggcgugagccac

SEQ ID NO: 630689 - RNA, 23 nt, Human
ugggauaacaggcgugagccacc

SEQ ID NO: 630690 - RNA, 24 nt, Human
ugggauaacaggcgugagccaccg

SEQ ID NO: 630691 - RNA, 18 nt, Human
ugggauuacaggcaugag

SEQ ID NO: 630692 - RNA, 19 nt, Human
ugggauuacaggcaugagc

SEQ ID NO: 630693 - RNA, 21 nt, Human
ugggauuacaggcaugagcca

SEQ ID NO: 630694 - RNA, 22 nt, Human
ugggauuacaggcaugagccac

SEQ ID NO: 630695 - RNA, 22 nt, Human
ugggauuacaggcaugagccac

SEQ ID NO: 630696 - RNA, 23 nt, Human
ugggauuacaggcaugagccacu

SEQ ID NO: 630697 - RNA, 24 nt, Human
ugggauuacaggcaugagccacug

SEQ ID NO: 630698 - RNA, 26 nt, Human
ugggauuacaggcaugagccacugcg

SEQ ID NO: 630699 - RNA, 22 nt, Human
ugggggagaagcuggacgcugg

SEQ ID NO: 630700 - RNA, 23 nt, Human
uggucagacuggucucgaacucc

SEQ ID NO: 630701 - RNA, 21 nt, Human
uggucaggcuggucuagaacu

SEQ ID NO: 630702 - RNA, 23 nt, Human
uggucuagaacucccgaccucag

SEQ ID NO: 630703 - RNA, 19 nt, Human
uggucucgaacucccgacc

SEQ ID NO: 630704 - RNA, 24 nt, Human
uguagugcaauggcacgaucucgg

SEQ ID NO: 630705 - RNA, 21 nt, Human
uguauuuuuaguagagacggg

SEQ ID NO: 630706 - RNA, 20 nt, Human
uguugcccaggcuagagugc

SEQ ID NO: 630707 - RNA, 22 nt, Human
uguugcccaggcuagagugcaa

SEQ ID NO: 630708 - RNA, 18 nt, Human
uuaguagagacgggguuu

SEQ ID NO: 630709 - RNA, 24 nt, Human
uuaguagagacgggguuucuccau

SEQ ID NO: 630710 - RNA, 18 nt, Human
uuaguagagaugggguuu

SEQ ID NO: 630711 - RNA, 24 nt, Human
uuaguagagaugggguuucuccgu

SEQ ID NO: 630712 - RNA, 21 nt, Human
uucaagcgauucuccugccuc

SEQ ID NO: 630713 - RNA, 23 nt, Human
uucaagcgauucuccugccucag

SEQ ID NO: 630714 - RNA, 24 nt, Human
uucaagcgauucuccugccucagc

SEQ ID NO: 630715 - RNA, 21 nt, Human
uucaagugauucuccugccuc

SEQ ID NO: 630716 - RNA, 23 nt, Human
uucaagugauucuccugccucag

SEQ ID NO: 630717 - RNA, 24 nt, Human
uucaagugauucuccugccucagc

SEQ ID NO: 630718 - RNA, 20 nt, Human
uucacgcaugaaagcggggc

SEQ ID NO: 630719 - RNA, 19 nt, Human
uucccagcagcucucucaa

SEQ ID NO: 630720 - RNA, 23 nt, Human
uucucuuucuuuguggauguucc

SEQ ID NO: 630721 - RNA, 20 nt, Human
uucuuuguggauguucccag

SEQ ID NO: 630722 - RNA, 18 nt, Human
uucuuuuuuuuuuuuuug

SEQ ID NO: 630723 - RNA, 25 nt, Human
uugaaacaguuuugcucuuguugcc

SEQ ID NO: 630724 - RNA, 18 nt, Human
uugcccaggcuagagugc

SEQ ID NO: 630725 - RNA, 18 nt, Human
uugcccaggcuguagugc

SEQ ID NO: 630726 - RNA, 18 nt, Human
uugcucuuguugcccagg

SEQ ID NO: 630727 - RNA, 23 nt, Human
uuguauuuuuaguagagacgggg

SEQ ID NO: 630728 - RNA, 23 nt, Human
uuguugcccaggcuagagugcaa

SEQ ID NO: 630729 - RNA, 23 nt, Human
uuguugcccaggcuguagugcaa

SEQ ID NO: 630730 - RNA, 23 nt, Human
uuucgcucuuguugcccaggcug

SEQ ID NO: 630731 - RNA, 19 nt, Human
uuucguauuuuuaguagag

SEQ ID NO: 630732 - RNA, 20 nt, Human
uuucguauuuuuaguagaga

SEQ ID NO: 630733 - RNA, 21 nt, Human
uuucuccauguuggucaggcu

SEQ ID NO: 630734 - RNA, 20 nt, Human
uuuugcucuuguugcccagg

SEQ ID NO: 630735 - RNA, 23 nt, Human
uuuugcucuuguugcccaggcua

SEQ ID NO: 630736 - RNA, 19 nt, Human
uuuuguauuuuuaguagag

SEQ ID NO: 630737 - RNA, 20 nt, Human
uuuuguauuuuuaguagaga

SEQ ID NO: 630738 - RNA, 22 nt, Human
uuuuuaguagagacgggguuuc

SEQ ID NO: 630739 - RNA, 22 nt, Human
uuuuuaguagagaugggguuuc

SEQ ID NO: 630740 - RNA, 20 nt, Human
uuuuuuuuuuugaaacaguu

SEQ ID NO: 630741 - RNA, 24 nt, Human
uuuuuuuuuuuucuucuucuuuuu

SEQ ID NO: 630742 - RNA, 25 nt, Human
uuuuuuuuuuuugagacggaguuuc

SEQ ID NO: 630743 - RNA, 22 nt, Human
uuuuuuuuuuuuuugagacgga

SEQ ID NO: 630744 - RNA, 21 nt, Human
acagcugggcgccuggcagcc

SEQ ID NO: 630745 - RNA, 22 nt, Human
cacagcugggcgccuggcagcc

SEQ ID NO: 630746 - RNA, 22 nt, Human
ccuggcagcccggguccccucc

SEQ ID NO: 630747 - RNA, 18 nt, Human
gcccggguccccucccag

SEQ ID NO: 630748 - RNA, 23 nt, Human
uggcagcccggguccccucccag

SEQ ID NO: 630749 - RNA, 19 nt, Human
aaaaaaaacaucagaaaca

SEQ ID NO: 630750 - RNA, 21 nt, Human
aaaaaaaacaucagaaacaau

SEQ ID NO: 630751 - RNA, 23 nt, Human
aagagaaagauuauaauggacac

SEQ ID NO: 630752 - RNA, 22 nt, Human
aaggaccacucccgagggagcc

SEQ ID NO: 630753 - RNA, 18 nt, Human
acagggccggaagcagac

SEQ ID NO: 630754 - RNA, 21 nt, Human
agaaagagaaagauuauaaug

SEQ ID NO: 630755 - RNA, 23 nt, Human
agccccugcccgucccgaccucc

SEQ ID NO: 630756 - RNA, 19 nt, Human
aggaagaggcggcgcccga

SEQ ID NO: 630757 - RNA, 24 nt, Human
aggaccacucccgagggagccugc

SEQ ID NO: 630758 - RNA, 21 nt, Human
aggaccagaaggggcucucua

SEQ ID NO: 630759 - RNA, 19 nt, Human
augaaauuuacacuucaau

SEQ ID NO: 630760 - RNA, 22 nt, Human
cacggcccaaggaccacucccg

SEQ ID NO: 630761 - RNA, 23 nt, Human
cacuguucaggccuauaccaucu

SEQ ID NO: 630762 - RNA, 19 nt, Human
cagaaggggcucucuagug

SEQ ID NO: 630763 - RNA, 18 nt, Human
cagccccugcccgucccg

SEQ ID NO: 630764 - RNA, 26 nt, Human
caggaccagaaggggcucucuagugu

SEQ ID NO: 630765 - RNA, 20 nt, Human
cccaagcuggcgcggggucc

SEQ ID NO: 630766 - RNA, 19 nt, Human
ccccuggguuaaguuggcu

SEQ ID NO: 630767 - RNA, 23 nt, Human
cccuagccaggaccagaaggggc

SEQ ID NO: 630768 - RNA, 22 nt, Human
cccugcccgucccgaccucccc

SEQ ID NO: 630769 - RNA, 23 nt, Human
ccgccagaacuccagggcuccca

SEQ ID NO: 630770 - RNA, 19 nt, Human
ccgcuucuccgggcgucug

SEQ ID NO: 630771 - RNA, 26 nt, Human
ccggcuuccauuugacagcuucccuc

SEQ ID NO: 630772 - RNA, 21 nt, Human
cgcauuuggaaaaaauggucc

SEQ ID NO: 630773 - RNA, 21 nt, Human
cgccagaacuccagggcuccc

SEQ ID NO: 630774 - RNA, 21 nt, Human
cgcccgaggcugcuauggcgg

SEQ ID NO: 630775 - RNA, 19 nt, Human
cggcccaaggaccacuccc

SEQ ID NO: 630776 - RNA, 22 nt, Human
cucagccccugcccgucccgac

SEQ ID NO: 630777 - RNA, 19 nt, Human
cuuucagaccccuggguua

SEQ ID NO: 630778 - RNA, 19 nt, Human
gaagcagacgagggcggga

SEQ ID NO: 630779 - RNA, 24 nt, Human
gacacuucucccauuccugaccag

SEQ ID NO: 630780 - RNA, 18 nt, Human
gagcucccucaggccucc

SEQ ID NO: 630781 - RNA, 24 nt, Human
ggaccagaaggggcucucuagugg

SEQ ID NO: 630782 - RNA, 21 nt, Human
ggagccugcagagccccacca

SEQ ID NO: 630783 - RNA, 24 nt, Human
ggcgggaggcuggaaagggggacc

SEQ ID NO: 630784 - RNA, 25 nt, Human
gggccggaagcagacgagggcggga

SEQ ID NO: 630785 - RNA, 20 nt, Human
guguauuuuuacuuucagac

SEQ ID NO: 630786 - RNA, 21 nt, Human
uaaaaauacaugcacaaauca

SEQ ID NO: 630787 - RNA, 24 nt, Human
uacaugcacaaaucauaaaaaaaa

SEQ ID NO: 630788 - RNA, 24 nt, Human
uauguugauugacuagacagaucc

SEQ ID NO: 630789 - RNA, 18 nt, Human
ucaaagagaaagagaaag

SEQ ID NO: 630790 - RNA, 23 nt, Human
ucaggccuauaccaucuugugug

SEQ ID NO: 630791 - RNA, 20 nt, Human
uccagguguauuuuagacuu

SEQ ID NO: 630792 - RNA, 25 nt, Human
ucccucaggccucccagaggggcca

SEQ ID NO: 630793 - RNA, 21 nt, Human
ucccucccgccagaacuccag

SEQ ID NO: 630794 - RNA, 27 nt, Human
ucucuagugucugacacuucucccauu

SEQ ID NO: 630795 - RNA, 24 nt, Human
ucugucucauuucuaccggcuucc

SEQ ID NO: 630796 - RNA, 20 nt, Human
ugacuagacagauccaggug

SEQ ID NO: 630797 - RNA, 19 nt, Human
ugcagagccccaccaggcc

SEQ ID NO: 630798 - RNA, 18 nt, Human
uggaaaaaauggucccac

SEQ ID NO: 630799 - RNA, 18 nt, Human
uggaaaaaauggucccac

SEQ ID NO: 630800 - RNA, 19 nt, Human
uggaaaggaagaggcggcg

SEQ ID NO: 630801 - RNA, 22 nt, Human
ugguagguuuaagacugucucu

SEQ ID NO: 630802 - RNA, 18 nt, Human
uguauuuuagacuuggaa

SEQ ID NO: 630803 - RNA, 21 nt, Human
uguauuuuagacuuggaauac

SEQ ID NO: 630804 - RNA, 21 nt, Human
uuaaauuuacacacaggucaa

SEQ ID NO: 630805 - RNA, 25 nt, Human
uuuaaauuuacacacaggucaaugg

SEQ ID NO: 630806 - RNA, 20 nt, Human
uuuuuuuuuuuuuuuauaac

SEQ ID NO: 630807 - RNA, 21 nt, Human
aaaaaacccggccagcacagc

SEQ ID NO: 630808 - RNA, 25 nt, Human
aaaaaacccggccagcacagcucau

SEQ ID NO: 630809 - RNA, 27 nt, Human
aaauauugcaaauuauuucuuuaagcu

SEQ ID NO: 630810 - RNA, 22 nt, Human
aaaugcaaaagccaccgcaacc

SEQ ID NO: 630811 - RNA, 21 nt, Human
aaugcaaaagccaccgcaacc

SEQ ID NO: 630812 - RNA, 24 nt, Human
aaugcaaaagccaccgcaaccaaa

SEQ ID NO: 630813 - RNA, 20 nt, Human
acagagugagauccugucuc

SEQ ID NO: 630814 - RNA, 24 nt, Human
acagagugagauccugucucgaaa

SEQ ID NO: 630815 - RNA, 22 nt, Human
acagcucaugccuguaauccca

SEQ ID NO: 630816 - RNA, 23 nt, Human
acagcucaugccuguaaucccag

SEQ ID NO: 630817 - RNA, 20 nt, Human
acaucaagaaaaaaaaaccc

SEQ ID NO: 630818 - RNA, 24 nt, Human
acugcaauccagccugugcuacag

SEQ ID NO: 630819 - RNA, 26 nt, Human
acugcaauccagccugugcuacagag

SEQ ID NO: 630820 - RNA, 20 nt, Human
acuggagccugggaggucga

SEQ ID NO: 630821 - RNA, 19 nt, Human
agaaaggagauuuuaaaaa

SEQ ID NO: 630822 - RNA, 22 nt, Human
agacaaaaaugcacagggagcc

SEQ ID NO: 630823 - RNA, 21 nt, Human
agacauggaaauaccaaagcc

SEQ ID NO: 630824 - RNA, 20 nt, Human
agcaaaaccuaaaccugcua

SEQ ID NO: 630825 - RNA, 24 nt, Human
agcuacuuaggaggcugagguggg

SEQ ID NO: 630826 - RNA, 23 nt, Human
agcuaggcgugguggugcgcgcc

SEQ ID NO: 630827 - RNA, 21 nt, Human
aggcauauuuauccuuucaca

SEQ ID NO: 630828 - RNA, 23 nt, Human
aggcgugguggugcgcgccugua

SEQ ID NO: 630829 - RNA, 21 nt, Human
aggucgaggcugcagugcaag

SEQ ID NO: 630830 - RNA, 20 nt, Human
aguacuguauuuauauuugu

SEQ ID NO: 630831 - RNA, 23 nt, Human
auagaagaaagccuuguccauuu

SEQ ID NO: 630832 - RNA, 24 nt, Human
auagaagaaagccuuguccauuuu

SEQ ID NO: 630833 - RNA, 21 nt, Human
auugcacugcaauccagccug

SEQ ID NO: 630834 - RNA, 22 nt, Human
caaccaaaaagucuauaaugcu

SEQ ID NO: 630835 - RNA, 19 nt, Human
caagaaaaaaaaacccggc

SEQ ID NO: 630836 - RNA, 23 nt, Human
caauccagccugugcuacagagu

SEQ ID NO: 630837 - RNA, 21 nt, Human
cacagcucaugccuguaaucc

SEQ ID NO: 630838 - RNA, 24 nt, Human
cacagcucaugccuguaaucccag

SEQ ID NO: 630839 - RNA, 21 nt, Human
caccuagaguaaaaauuagac

SEQ ID NO: 630840 - RNA, 19 nt, Human
cacugcaauccagccugug

SEQ ID NO: 630841 - RNA, 19 nt, Human
cacugcaauccagccugug

SEQ ID NO: 630842 - RNA, 24 nt, Human
cacugcaauccagccugugcuaca

SEQ ID NO: 630843 - RNA, 21 nt, Human
cagcuacuuaggaggcugagg

SEQ ID NO: 630844 - RNA, 24 nt, Human
cagcuacuuaggaggcugaggugg

SEQ ID NO: 630845 - RNA, 19 nt, Human
caguagaaaggagauuuua

SEQ ID NO: 630846 - RNA, 25 nt, Human
caguagaaaggagauuuuaaaaaua

SEQ ID NO: 630847 - RNA, 19 nt, Human
caguggaaagaguucugaa

SEQ ID NO: 630848 - RNA, 20 nt, Human
caucaagaaaaaaaaacccg

SEQ ID NO: 630849 - RNA, 19 nt, Human
cauggaaauaccaaagcca

SEQ ID NO: 630850 - RNA, 20 nt, Human
cauggccaaacccccgucuc

SEQ ID NO: 630851 - RNA, 22 nt, Human
cccgucucuacaaaaaaauaca

SEQ ID NO: 630852 - RNA, 19 nt, Human
ccugugcuacagagugaga

SEQ ID NO: 630853 - RNA, 22 nt, Human
ccuuccacacaccuuuugacag

SEQ ID NO: 630854 - RNA, 24 nt, Human
cgccuguacucccagcuacuuagg

SEQ ID NO: 630855 - RNA, 20 nt, Human
cggccagcacagcucaugcc

SEQ ID NO: 630856 - RNA, 19 nt, Human
cuacaaaaaaauacaaaaa

SEQ ID NO: 630857 - RNA, 19 nt, Human
cucaugccuguaaucccag

SEQ ID NO: 630858 - RNA, 23 nt, Human
cugagggcagcaguugggucuuu

SEQ ID NO: 630859 - RNA, 21 nt, Human
cuggagccugggaggucgagg

SEQ ID NO: 630860 - RNA, 19 nt, Human
cugugcuacagagugagau

SEQ ID NO: 630861 - RNA, 23 nt, Human
cuuuggucuuugcccauucuucu

SEQ ID NO: 630862 - RNA, 23 nt, Human
gagccugggaggucgaggcugca

SEQ ID NO: 630863 - RNA, 24 nt, Human
gccugggaggucgaggcugcagug

SEQ ID NO: 630864 - RNA, 23 nt, Human
gcuacagagugagauccugucuc

SEQ ID NO: 630865 - RNA, 21 nt, Human
gcugcagugcaagauugagaa

SEQ ID NO: 630866 - RNA, 21 nt, Human
ggagagucacuggagccuggg

SEQ ID NO: 630867 - RNA, 18 nt, Human
ggagccugggaggucgag

SEQ ID NO: 630868 - RNA, 22 nt, Human
ggaggcugaggugggagaguca

SEQ ID NO: 630869 - RNA, 18 nt, Human
ggcagcaguugggucuuu

SEQ ID NO: 630870 - RNA, 24 nt, Human
ggccagcacagcucaugccuguaa

SEQ ID NO: 630871 - RNA, 24 nt, Human
gguggugcgcgccuguacucccag

SEQ ID NO: 630872 - RNA, 20 nt, Human
gugcuacagagugagauccu

SEQ ID NO: 630873 - RNA, 24 nt, Human
guggugcgcgccuguacucccagc

SEQ ID NO: 630874 - RNA, 21 nt, Human
uacagagugagauccugucuc

SEQ ID NO: 630875 - RNA, 22 nt, Human
uaccaaagccacuggugacaaa

SEQ ID NO: 630876 - RNA, 18 nt, Human
uacuguauuuauauuugu

SEQ ID NO: 630877 - RNA, 20 nt, Human
uagaagaaagccuuguccau

SEQ ID NO: 630878 - RNA, 19 nt, Human
uaggaggcugaggugggag

SEQ ID NO: 630879 - RNA, 24 nt, Human
uaggaggcugaggugggagaguca

SEQ ID NO: 630880 - RNA, 19 nt, Human
uaugagucugaacuaagac

SEQ ID NO: 630881 - RNA, 23 nt, Human
ucacuggagccugggaggucgag

SEQ ID NO: 630882 - RNA, 24 nt, Human
ucagcuaggcgugguggugcgcgc

SEQ ID NO: 630883 - RNA, 22 nt, Human
ucaugccuguaaucccaggagu

SEQ ID NO: 630884 - RNA, 23 nt, Human
uccagccugugcuacagagugag

SEQ ID NO: 630885 - RNA, 24 nt, Human
uccagccugugcuacagagugaga

SEQ ID NO: 630886 - RNA, 18 nt, Human
ucuagaaaucauagaaaa

SEQ ID NO: 630887 - RNA, 19 nt, Human
ucuuuggucuuugcccauu

SEQ ID NO: 630888 - RNA, 24 nt, Human
ugagaauugcaggauugcacugca

SEQ ID NO: 630889 - RNA, 22 nt, Human
ugagcuaaaauuaagaaccuca

SEQ ID NO: 630890 - RNA, 24 nt, Human
ugagggcagcaguugggucuuugg

SEQ ID NO: 630891 - RNA, 18 nt, Human
ugaggugggagagucacu

SEQ ID NO: 630892 - RNA, 24 nt, Human
ugaggugggagagucacuggagcc

SEQ ID NO: 630893 - RNA, 20 nt, Human
ugcaaaagccaccgcaacca

SEQ ID NO: 630894 - RNA, 19 nt, Human
uggaaagaguucugaacag

SEQ ID NO: 630895 - RNA, 18 nt, Human
uggaaauaccaaagccac

SEQ ID NO: 630896 - RNA, 19 nt, Human
uggaaauaccaaagccacu

SEQ ID NO: 630897 - RNA, 24 nt, Human
ugguggugcgcgccuguacuccca

SEQ ID NO: 630898 - RNA, 22 nt, Human
uguagcaaaaccuaaaccugcu

SEQ ID NO: 630899 - RNA, 21 nt, Human
uguguacauguacaaauauug

SEQ ID NO: 630900 - RNA, 23 nt, Human
uguguacauguacaaauauugca

SEQ ID NO: 630901 - RNA, 18 nt, Human
uguguacguuuucuaauc

SEQ ID NO: 630902 - RNA, 21 nt, Human
uuacauaaccaguagaaagga

SEQ ID NO: 630903 - RNA, 20 nt, Human
uugagaauguagcaaaaccu

SEQ ID NO: 630904 - RNA, 21 nt, Human
uugauauacaacuuuagaaag

SEQ ID NO: 630905 - RNA, 19 nt, Human
uugcccauucuucucugca

SEQ ID NO: 630906 - RNA, 18 nt, Human
uuuacauaaccaguagaa

SEQ ID NO: 630907 - RNA, 22 nt, Human
uuuacaucaagaaaaaaaaacc

SEQ ID NO: 630908 - RNA, 18 nt, Human
uuuuuuuuuuuuuuuuug

SEQ ID NO: 630909 - RNA, 18 nt, Human
acagacugaacccccaug

SEQ ID NO: 630910 - RNA, 20 nt, Human
agaaagcccaaugaugaaga

SEQ ID NO: 630911 - RNA, 21 nt, Human
agcugcagggagggcgggagg

SEQ ID NO: 630912 - RNA, 20 nt, Human
aggcaaagccugcaugccag

SEQ ID NO: 630913 - RNA, 18 nt, Human
aggcucagagcugaacaa

SEQ ID NO: 630914 - RNA, 21 nt, Human
aggcucagagcugaacaaaaa

SEQ ID NO: 630915 - RNA, 22 nt, Human
aggcucagagcugaacaaaaaa

SEQ ID NO: 630916 - RNA, 21 nt, Human
auccacagacugaacccccau

SEQ ID NO: 630917 - RNA, 22 nt, Human
caaagccugcaugccagcgcug

SEQ ID NO: 630918 - RNA, 19 nt, Human
cacaacugcuucgccugca

SEQ ID NO: 630919 - RNA, 21 nt, Human
cacaacugcuucgccugcagu

SEQ ID NO: 630920 - RNA, 19 nt, Human
cacuucaacaaagcccugg

SEQ ID NO: 630921 - RNA, 22 nt, Human
cacuugaggcaggaccaguggu

SEQ ID NO: 630922 - RNA, 22 nt, Human
cacuugggcugaggcaaugagc

SEQ ID NO: 630923 - RNA, 21 nt, Human
cagcugggcaucuaagaagcc

SEQ ID NO: 630924 - RNA, 19 nt, Human
caggaccaguggucugggg

SEQ ID NO: 630925 - RNA, 18 nt, Human
cagugugcccacaccacu

SEQ ID NO: 630926 - RNA, 22 nt, Human
caucuaagaagccggaagcaag

SEQ ID NO: 630927 - RNA, 21 nt, Human
cccugggccacugagggcggg

SEQ ID NO: 630928 - RNA, 20 nt, Human
ccucucguggcagacuugcc

SEQ ID NO: 630929 - RNA, 21 nt, Human
ccugcagugcccucucguggc

SEQ ID NO: 630930 - RNA, 21 nt, Human
cgcagaaggagccauaccagg

SEQ ID NO: 630931 - RNA, 24 nt, Human
cgcagaaggagccauaccagguug

SEQ ID NO: 630932 - RNA, 18 nt, Human
cucauucugccugcugug

SEQ ID NO: 630933 - RNA, 19 nt, Human
cucuuucaaauuacaaagu

SEQ ID NO: 630934 - RNA, 20 nt, Human
cugcagugcccucucguggc

SEQ ID NO: 630935 - RNA, 24 nt, Human
cugccuguggcccucauucugccu

SEQ ID NO: 630936 - RNA, 18 nt, Human
gaaguggggaguuccacu

SEQ ID NO: 630937 - RNA, 23 nt, Human
gcacaacugcuucgccugcagug

SEQ ID NO: 630938 - RNA, 18 nt, Human
gcagugugcccacaccac

SEQ ID NO: 630939 - RNA, 22 nt, Human
gcccugggccacugagggcggg

SEQ ID NO: 630940 - RNA, 19 nt, Human
gccuguggcccucauucug

SEQ ID NO: 630941 - RNA, 23 nt, Human
ggagcugcagggagggcgggagg

SEQ ID NO: 630942 - RNA, 24 nt, Human
ggaggcugggauuagcuucccuuc

SEQ ID NO: 630943 - RNA, 19 nt, Human
ggaggcuuuccguacagca

SEQ ID NO: 630944 - RNA, 21 nt, Human
ggcugaggcaaugagcaagca

SEQ ID NO: 630945 - RNA, 24 nt, Human
uagcagccaggcaaagccugcaug

SEQ ID NO: 630946 - RNA, 21 nt, Human
uccguacagcacgcacagccg

SEQ ID NO: 630947 - RNA, 23 nt, Human
uccugccuguggcccucauucug

SEQ ID NO: 630948 - RNA, 21 nt, Human
ucucguggcagacuugccucu

SEQ ID NO: 630949 - RNA, 23 nt, Human
ugaaggauucagcucaggaggcu

SEQ ID NO: 630950 - RNA, 21 nt, Human
ugacuccuaagcagugugccc

SEQ ID NO: 630951 - RNA, 23 nt, Human
ugacuccuaagcagugugcccuu

SEQ ID NO: 630952 - RNA, 21 nt, Human
ugcuuuaauaauucucuuuca

SEQ ID NO: 630953 - RNA, 18 nt, Human
ugggccacugagggcggg

SEQ ID NO: 630954 - RNA, 18 nt, Human
ugugcauuuacauguaug

SEQ ID NO: 630955 - RNA, 19 nt, Human
uguggcccucauucugccu

SEQ ID NO: 630956 - RNA, 22 nt, Human
uuaccauccacagacugaaccc

SEQ ID NO: 630957 - RNA, 22 nt, Human
uuuugaggcucagagcugaaca

SEQ ID NO: 630958 - RNA, 21 nt, Human
uuuuuuuuuugugagggcugg

SEQ ID NO: 630959 - RNA, 20 nt, Human
uuuuuuuuuuugugagggcu

SEQ ID NO: 630960 - RNA, 20 nt, Human
uuuuuuuuuuuugugagggc

SEQ ID NO: 630961 - RNA, 20 nt, Human
uuuuuuuuuuuuuugugagg

SEQ ID NO: 630962 - RNA, 18 nt, Human
uuuuuuuuuuuuuuuuug

SEQ ID NO: 630963 - RNA, 19 nt, Human
uuuuuuuuuuuuuuuuugu

SEQ ID NO: 630964 - RNA, 26 nt, Human
uuuuuuuuuuuuuuuuuuugugaggg

SEQ ID NO: 630965 - RNA, 19 nt, Human
aacaggauggggugcuggg

SEQ ID NO: 630966 - RNA, 23 nt, Human
aacaggauggggugcugggaugg

SEQ ID NO: 630967 - RNA, 22 nt, Human
aacugaccuccccaggugccca

SEQ ID NO: 630968 - RNA, 21 nt, Human
aagaagaagccgcgcagcccc

SEQ ID NO: 630969 - RNA, 27 nt, Human
aagcagauuuguguccuuccugguaag

SEQ ID NO: 630970 - RNA, 18 nt, Human
aagccgcgcagccccuug

SEQ ID NO: 630971 - RNA, 18 nt, Human
aagccggccacggagcug

SEQ ID NO: 630972 - RNA, 21 nt, Human
aagugacagugacacagauaa

SEQ ID NO: 630973 - RNA, 23 nt, Human
acagugccagcaccccugcgagc

SEQ ID NO: 630974 - RNA, 20 nt, Human
acccccacgaagaagaagcc

SEQ ID NO: 630975 - RNA, 18 nt, Human
agacggccgagaagagga

SEQ ID NO: 630976 - RNA, 19 nt, Human
agccccuucccucccaagu

SEQ ID NO: 630977 - RNA, 25 nt, Human
agcgauggagacggccgagaagagg

SEQ ID NO: 630978 - RNA, 21 nt, Human
caaagcccuuacaggggcaga

SEQ ID NO: 630979 - RNA, 21 nt, Human
caacagccccuucccucccaa

SEQ ID NO: 630980 - RNA, 18 nt, Human
caccaggacccacagugc

SEQ ID NO: 630981 - RNA, 25 nt, Human
cacgaagaagaagccgcgcagcccc

SEQ ID NO: 630982 - RNA, 19 nt, Human
cacucugagaaggcagaau

SEQ ID NO: 630983 - RNA, 22 nt, Human
cacucugagaaggcagaaugga

SEQ ID NO: 630984 - RNA, 21 nt, Human
cagccccuugagccagguccu

SEQ ID NO: 630985 - RNA, 21 nt, Human
cagggcccgaagccgccagcc

SEQ ID NO: 630986 - RNA, 26 nt, Human
ccacgaagaagaagccgcgcagcccc

SEQ ID NO: 630987 - RNA, 20 nt, Human
ccacuugaaggaaaugaagc

SEQ ID NO: 630988 - RNA, 19 nt, Human
ccagcucugggaacaacag

SEQ ID NO: 630989 - RNA, 19 nt, Human
cccugagucuggccucauu

SEQ ID NO: 630990 - RNA, 21 nt, Human
ccgaagccgccagccggagcc

SEQ ID NO: 630991 - RNA, 27 nt, Human
ccgugacccugagucuggccggcgccg

SEQ ID NO: 630992 - RNA, 20 nt, Human
ccuuguaccaacagccccuu

SEQ ID NO: 630993 - RNA, 23 nt, Human
cgaagaagaagccgcgcagcccc

SEQ ID NO: 630994 - RNA, 23 nt, Human
cgagaagaggacccccacgaaga

SEQ ID NO: 630995 - RNA, 19 nt, Human
cggccgagagucacaggug

SEQ ID NO: 630996 - RNA, 26 nt, Human
cuauguugcccccuuccccaaagccc

SEQ ID NO: 630997 - RNA, 25 nt, Human
cuccccaggugcccaaccuggccga

SEQ ID NO: 630998 - RNA, 20 nt, Human
cucugaugccgggugauggc

SEQ ID NO: 630999 - RNA, 18 nt, Human
cugggauggggguuuaag

SEQ ID NO: 631000 - RNA, 23 nt, Human
gaagcacauuccccgugacccug

SEQ ID NO: 631001 - RNA, 19 nt, Human
gcccuuacaggggcagaag

SEQ ID NO: 631002 - RNA, 18 nt, Human
gcggcgcggaggccgagc

SEQ ID NO: 631003 - RNA, 22 nt, Human
ggaaauguaaaaaggugaaagc

SEQ ID NO: 631004 - RNA, 19 nt, Human
ggcaaagagcugaggggca

SEQ ID NO: 631005 - RNA, 25 nt, Human
ggccgguggucugggugcagcaagg

SEQ ID NO: 631006 - RNA, 21 nt, Human
ggcugcggcgccgggcgggcc

SEQ ID NO: 631007 - RNA, 24 nt, Human
gggaacaacaggauggggugcugg

SEQ ID NO: 631008 - RNA, 25 nt, Human
gggcagaagcacauuccccgugacc

SEQ ID NO: 631009 - RNA, 18 nt, Human
gggcaugggcacagguuu

SEQ ID NO: 631010 - RNA, 21 nt, Human
gggcaugggcacagguuuggg

SEQ ID NO: 631011 - RNA, 22 nt, Human
gggccaguguaugggcagaaaa

SEQ ID NO: 631012 - RNA, 25 nt, Human
gggccgagggcgagcgcggccgaga

SEQ ID NO: 631013 - RNA, 22 nt, Human
gggcugcggcgccgggcgggcc

SEQ ID NO: 631014 - RNA, 18 nt, Human
gggcuggaggggcauggg

SEQ ID NO: 631015 - RNA, 24 nt, Human
ggggcaugggcacagguuuggggg

SEQ ID NO: 631016 - RNA, 18 nt, Human
ggggcugcggcgccgggc

SEQ ID NO: 631017 - RNA, 21 nt, Human
ucagauggggagggggagacc

SEQ ID NO: 631018 - RNA, 22 nt, Human
uccagacgaggaagauggagaa

SEQ ID NO: 631019 - RNA, 20 nt, Human
uccccaggugcccaaccugg

SEQ ID NO: 631020 - RNA, 23 nt, Human
uccccaggugcccaaccuggccu

SEQ ID NO: 631021 - RNA, 20 nt, Human
ucuacuauguugcccccuuc

SEQ ID NO: 631022 - RNA, 19 nt, Human
ucugaacugaccuccccag

SEQ ID NO: 631023 - RNA, 22 nt, Human
ucuggccucauuugggaagucu

SEQ ID NO: 631024 - RNA, 23 nt, Human
ucuucugggguguauggaugccu

SEQ ID NO: 631025 - RNA, 24 nt, Human
ugaagggcagugagaggggcugga

SEQ ID NO: 631026 - RNA, 18 nt, Human
ugacccugagucuggccu

SEQ ID NO: 631027 - RNA, 20 nt, Human
ugagaggggcuggaguggga

SEQ ID NO: 631028 - RNA, 22 nt, Human
ugagauggguggggggccacgg

SEQ ID NO: 631029 - RNA, 19 nt, Human
ugcauguacaucacgugcg

SEQ ID NO: 631030 - RNA, 24 nt, Human
ugcgucaccaggacccacagugcc

SEQ ID NO: 631031 - RNA, 18 nt, Human
uggagagguaguagcugg

SEQ ID NO: 631032 - RNA, 22 nt, Human
uggagagguaguagcugguggg

SEQ ID NO: 631033 - RNA, 18 nt, Human
uggagugggagagaaggu

SEQ ID NO: 631034 - RNA, 21 nt, Human
uggagugggagagaaggucuc

SEQ ID NO: 631035 - RNA, 24 nt, Human
ugggaacaacaggauggggugcug

SEQ ID NO: 631036 - RNA, 25 nt, Human
ugggaacaacaggauggggugcugg

SEQ ID NO: 631037 - RNA, 24 nt, Human
ugggcagaaaagcagauuuguguc

SEQ ID NO: 631038 - RNA, 20 nt, Human
uggggcugcggcgccgggcg

SEQ ID NO: 631039 - RNA, 22 nt, Human
uggggggccacggcuaucuggc

SEQ ID NO: 631040 - RNA, 19 nt, Human
uggggugcugggauggggg

SEQ ID NO: 631041 - RNA, 23 nt, Human
ugggugcagcaagggcacucuga

SEQ ID NO: 631042 - RNA, 18 nt, Human
ugguggggucugugaggc

SEQ ID NO: 631043 - RNA, 22 nt, Human
uguauggaugccugugugugug

SEQ ID NO: 631044 - RNA, 18 nt, Human
uguguccuucagaaggga

SEQ ID NO: 631045 - RNA, 23 nt, Human
ugugugugagugagauggguggg

SEQ ID NO: 631046 - RNA, 26 nt, Human
ugugugugagugagaugggugggggg

SEQ ID NO: 631047 - RNA, 21 nt, Human
uucagaagggaaauguaaaaa

SEQ ID NO: 631048 - RNA, 19 nt, Human
uuccccaaagcccuuacag

SEQ ID NO: 631049 - RNA, 20 nt, Human
uucugggguguauggaugcc

SEQ ID NO: 631050 - RNA, 24 nt, Human
uuucugaacugaccuccccaggug

SEQ ID NO: 631051 - RNA, 27 nt, Human
uuuuuuuuuuuuuuuuuuuuuuugggg

SEQ ID NO: 631052 - RNA, 23 nt, Human
agaaauggcggcaccauuuuaua

SEQ ID NO: 631053 - RNA, 25 nt, Human
aguuaaaaaaugagaaauggcggca

SEQ ID NO: 631054 - RNA, 20 nt, Human
auccauuuugcuugagcggc

SEQ ID NO: 631055 - RNA, 21 nt, Human
augccacagccugggcccagc

SEQ ID NO: 631056 - RNA, 18 nt, Human
cacagccugggcccagcc

SEQ ID NO: 631057 - RNA, 20 nt, Human
cccagccgcuuggcggauuc

SEQ ID NO: 631058 - RNA, 18 nt, Human
ccuguguuuuucaaggag

SEQ ID NO: 631059 - RNA, 18 nt, Human
gaaggaaaaauuuaaaag

SEQ ID NO: 631060 - RNA, 22 nt, Human
guguuuuucaaggaguggaggg

SEQ ID NO: 631061 - RNA, 24 nt, Human
ucaaggaguggagggucaaauugu

SEQ ID NO: 631062 - RNA, 18 nt, Human
ucugcugugcuaguucug

SEQ ID NO: 631063 - RNA, 25 nt, Human
ugagaaauggcggcaccauuuuaua

SEQ ID NO: 631064 - RNA, 21 nt, Human
ugcagcgacuaaggaggaauc

SEQ ID NO: 631065 - RNA, 26 nt, Human
ugccuccggccaucaugccacagccu

SEQ ID NO: 631066 - RNA, 22 nt, Human
uggagggucaaauuguuaagaa

SEQ ID NO: 631067 - RNA, 22 nt, Human
uguaaaaaguuaaaaaaugaga

SEQ ID NO: 631068 - RNA, 22 nt, Human
ugucauagaauucugcaugcag

SEQ ID NO: 631069 - RNA, 24 nt, Human
uuaaaaguauuucugcugugcuag

SEQ ID NO: 631070 - RNA, 19 nt, Human
uucaaggaguggaggguca

SEQ ID NO: 631071 - RNA, 19 nt, Human
uucaaggaguggaggguca

SEQ ID NO: 631072 - RNA, 22 nt, Human
uucaaggaguggagggucaaau

SEQ ID NO: 631073 - RNA, 25 nt, Human
uucaaggaguggagggucaaauugu

SEQ ID NO: 631074 - RNA, 20 nt, Human
uuucaaggaguggaggguca

SEQ ID NO: 631075 - RNA, 24 nt, Human
uuucaaggaguggagggucaaauu

SEQ ID NO: 631076 - RNA, 18 nt, Human
uuugacauuuuuuggcgu

SEQ ID NO: 631077 - RNA, 27 nt, Human
uuuuuuuuuuugacauuuuuuggcguu

SEQ ID NO: 631078 - RNA, 18 nt, Human
uuuuuuuuuuuuuuuuug

SEQ ID NO: 631079 - RNA, 24 nt, Human
aagcaugacccaaaggugcagaaa

SEQ ID NO: 631080 - RNA, 20 nt, Human
aagggagacacugcuacaaa

SEQ ID NO: 631081 - RNA, 19 nt, Human
aaggugcagaaaugccugc

SEQ ID NO: 631082 - RNA, 21 nt, Human
accaagcaagacucgaagagc

SEQ ID NO: 631083 - RNA, 20 nt, Human
acugcagccaccgcggacgc

SEQ ID NO: 631084 - RNA, 23 nt, Human
acugcagccaccgcggacgcccg

SEQ ID NO: 631085 - RNA, 18 nt, Human
agacucgaagagcucgcg

SEQ ID NO: 631086 - RNA, 24 nt, Human
agcagggagaccgacgggacugca

SEQ ID NO: 631087 - RNA, 22 nt, Human
caaaaucaccccguggggccaa

SEQ ID NO: 631088 - RNA, 24 nt, Human
cacugcuacaaagcaugacccaaa

SEQ ID NO: 631089 - RNA, 19 nt, Human
caugacccaaaggugcaga

SEQ ID NO: 631090 - RNA, 18 nt, Human
ccaagcaagacucgaaga

SEQ ID NO: 631091 - RNA, 22 nt, Human
cgccggacagcagggagaccga

SEQ ID NO: 631092 - RNA, 22 nt, Human
cucaggcagguaagaaacccac

SEQ ID NO: 631093 - RNA, 23 nt, Human
gccggacagcagggagaccgacg

SEQ ID NO: 631094 - RNA, 21 nt, Human
uacaaagcaugacccaaaggu

SEQ ID NO: 631095 - RNA, 22 nt, Human
ucaggcagguaagaaacccaca

SEQ ID NO: 631096 - RNA, 19 nt, Human
uccaaccaagcaagacucg

SEQ ID NO: 631097 - RNA, 19 nt, Human
ucccugagguggcucaggc

SEQ ID NO: 631098 - RNA, 21 nt, Human
ucccugagguggcucaggcag

SEQ ID NO: 631099 - RNA, 18 nt, Human
uuuuuuuuuuuuuuuuug

SEQ ID NO: 631100 - RNA, 20 nt, Human
acauggaaucuccugaguua

SEQ ID NO: 631101 - RNA, 23 nt, Human
agacauggaaucuccugaguuau

SEQ ID NO: 631102 - RNA, 25 nt, Human
augacagcuauuuuuuaucagagcc

SEQ ID NO: 631103 - RNA, 18 nt, Human
caugaaaauauaaacugc

SEQ ID NO: 631104 - RNA, 25 nt, Human
ccaaacauagaagcgcagaaguaaa

SEQ ID NO: 631105 - RNA, 24 nt, Human
ccuggugcaacagucaagacauca

SEQ ID NO: 631106 - RNA, 19 nt, Human
gcgcgaagcuggggcuugg

SEQ ID NO: 631107 - RNA, 20 nt, Human
ggcaaaacaaucaugaaaau

SEQ ID NO: 631108 - RNA, 19 nt, Human
uacauagucuuaucucaua

SEQ ID NO: 631109 - RNA, 20 nt, Human
uagaauucauaaacucaaaa

SEQ ID NO: 631110 - RNA, 23 nt, Human
uaucagagcaauguuucccaaac

SEQ ID NO: 631111 - RNA, 29 nt, Human
ucaucuuucauuuuaugcauuuccucuca

SEQ ID NO: 631112 - RNA, 18 nt, Human
ugaggcaaaacaaucaug

SEQ ID NO: 631113 - RNA, 19 nt, Human
uguucuuguuuaucucuga

SEQ ID NO: 631114 - RNA, 24 nt, Human
agggggcggcggcggcggcagcgg

SEQ ID NO: 631115 - RNA, 19 nt, Human
cacccaaggcagcgggcgg

SEQ ID NO: 631116 - RNA, 23 nt, Human
cacccaaggcagcgggcggaagc

SEQ ID NO: 631117 - RNA, 19 nt, Human
cacccgggccccgggcagc

SEQ ID NO: 631118 - RNA, 19 nt, Human
cacccgggccccgggcagc

SEQ ID NO: 631119 - RNA, 21 nt, Human
ccacgggcaccacggccccgg

SEQ ID NO: 631120 - RNA, 24 nt, Human
ccauagagccgcggcagcgccgag

SEQ ID NO: 631121 - RNA, 26 nt, Human
ccccgcgcccccggaguaggcaccca

SEQ ID NO: 631122 - RNA, 22 nt, Human
ccgggccccgggcagcugaggg

SEQ ID NO: 631123 - RNA, 20 nt, Human
cgagaccgugcgcgcgaguu

SEQ ID NO: 631124 - RNA, 18 nt, Human
cgcgaguuuuaggagguc

SEQ ID NO: 631125 - RNA, 24 nt, Human
cgcgcccccggaguaggcacccaa

SEQ ID NO: 631126 - RNA, 25 nt, Human
cucaaggucuccuacaggcuucaag

SEQ ID NO: 631127 - RNA, 19 nt, Human
cuucaaucaaggugccagc

SEQ ID NO: 631128 - RNA, 19 nt, Human
cuuccaagcucacucacgu

SEQ ID NO: 631129 - RNA, 19 nt, Human
cuucgucggugggcagacg

SEQ ID NO: 631130 - RNA, 21 nt, Human
gaagcccuggacacccaugcu

SEQ ID NO: 631131 - RNA, 23 nt, Human
gagggggcggcggcggcggcagc

SEQ ID NO: 631132 - RNA, 20 nt, Human
gagggggcggcggcggcggg

SEQ ID NO: 631133 - RNA, 18 nt, Human
gccccgggacagcgcuuc

SEQ ID NO: 631134 - RNA, 21 nt, Human
gcggcagcggagggugcagcc

SEQ ID NO: 631135 - RNA, 24 nt, Human
gcggcggcagcggagggugcagcc

SEQ ID NO: 631136 - RNA, 18 nt, Human
gcggcggcggcagcggag

SEQ ID NO: 631137 - RNA, 22 nt, Human
gcugcagucaucucaaggcuug

SEQ ID NO: 631138 - RNA, 22 nt, Human
gcuuagcuggguccucuggcuc

SEQ ID NO: 631139 - RNA, 18 nt, Human
ggcagcugagggggcggc

SEQ ID NO: 631140 - RNA, 25 nt, Human
ggcggcggcagcggagggugcagcc

SEQ ID NO: 631141 - RNA, 23 nt, Human
gggcugcagucaucucaaggcuu

SEQ ID NO: 631142 - RNA, 22 nt, Human
ggggugauggugccgagucggc

SEQ ID NO: 631143 - RNA, 22 nt, Human
gugcaagugcugcugcugcugc

SEQ ID NO: 631144 - RNA, 19 nt, Human
gugcugcugcugcugcugg

SEQ ID NO: 631145 - RNA, 18 nt, Human
uaguaucuguaggcaugg

SEQ ID NO: 631146 - RNA, 22 nt, Human
uaguaucuguaggcauggcuua

SEQ ID NO: 631147 - RNA, 18 nt, Human
uccacgggcaccacggcc

SEQ ID NO: 631148 - RNA, 22 nt, Human
uccucuggcucaaggucuccua

SEQ ID NO: 631149 - RNA, 20 nt, Human
ucggcggcagcuggcggugc

SEQ ID NO: 631150 - RNA, 23 nt, Human
ucucaaggcuugccuggggaagg

SEQ ID NO: 631151 - RNA, 18 nt, Human
ugcagcccgggcugcgcu

SEQ ID NO: 631152 - RNA, 19 nt, Human
ugcugcugcugcuggcgcg

SEQ ID NO: 631153 - RNA, 20 nt, Human
uggaagcccuggacacccau

SEQ ID NO: 631154 - RNA, 19 nt, Human
uggcuuagcuggguccucu

SEQ ID NO: 631155 - RNA, 18 nt, Human
uuagcuggguccucuggc

SEQ ID NO: 631156 - RNA, 23 nt, Human
uugcagaggcacggagccccugg

SEQ ID NO: 631157 - RNA, 19 nt, Human
uuuuuucuuuuuuuuuuua

SEQ ID NO: 631158 - RNA, 23 nt, Human
uuuuuucuuuuuuuuuuuagugg

SEQ ID NO: 631159 - RNA, 23 nt, Human
uuuuuuuuuuuuuuuuucuuuuu

SEQ ID NO: 631160 - RNA, 21 nt, Human
aaaaaaaacacaacccggggg

SEQ ID NO: 631161 - RNA, 18 nt, Human
aaaaaaacacaacccggg

SEQ ID NO: 631162 - RNA, 21 nt, Human
aaaaaaacacaacccggggaa

SEQ ID NO: 631163 - RNA, 22 nt, Human
aaaaacaagaaaaagaaaaaaa

SEQ ID NO: 631164 - RNA, 18 nt, Human
aaacaggauuaggaagcu

SEQ ID NO: 631165 - RNA, 18 nt, Human
aaacucaggacuuaacag

SEQ ID NO: 631166 - RNA, 21 nt, Human
aaagaagaggaaggccaaaga

SEQ ID NO: 631167 - RNA, 21 nt, Human
aaagacagaaaaacacacaaa

SEQ ID NO: 631168 - RNA, 24 nt, Human
aaagacuuaguucaguuccuuggc

SEQ ID NO: 631169 - RNA, 20 nt, Human
aacauggugaaacccugucu

SEQ ID NO: 631170 - RNA, 21 nt, Human
aacauggugaaacccugucuc

SEQ ID NO: 631171 - RNA, 20 nt, Human
aagaagcaaguaacuuaaca

SEQ ID NO: 631172 - RNA, 26 nt, Human
aagaagcaaguaacuuaacaaggaca

SEQ ID NO: 631173 - RNA, 22 nt, Human
aagccacagcccaaagaagucu

SEQ ID NO: 631174 - RNA, 20 nt, Human
aagccgggacugggcaguca

SEQ ID NO: 631175 - RNA, 20 nt, Human
aaggaagaaggaacggagag

SEQ ID NO: 631176 - RNA, 23 nt, Human
aauaaagacagaaaaacacacaa

SEQ ID NO: 631177 - RNA, 24 nt, Human
aaucgcuugaacccaggaggcaga

SEQ ID NO: 631178 - RNA, 23 nt, Human
acaacaaaagagaccuaaauggg

SEQ ID NO: 631179 - RNA, 21 nt, Human
acacaacccggggaauuuaua

SEQ ID NO: 631180 - RNA, 24 nt, Human
acacuccagcccgggugacagagc

SEQ ID NO: 631181 - RNA, 28 nt, Human
acacugaaggucuuucaaguuucaucca

SEQ ID NO: 631182 - RNA, 21 nt, Human
accacucauauuuaaaaggug

SEQ ID NO: 631183 - RNA, 23 nt, Human
acccagagcaaacaaggugaccc

SEQ ID NO: 631184 - RNA, 24 nt, Human
acccaggaggcagagguugcagug

SEQ ID NO: 631185 - RNA, 24 nt, Human
acccugucucuacuaaaaauacaa

SEQ ID NO: 631186 - RNA, 19 nt, Human
acugcucugccuucccaac

SEQ ID NO: 631187 - RNA, 23 nt, Human
agaaaaaaaaacacaacccgggg

SEQ ID NO: 631188 - RNA, 21 nt, Human
agaaaaagaaaaaaaaauaca

SEQ ID NO: 631189 - RNA, 22 nt, Human
agaaaaagaaaaaaaaauacag

SEQ ID NO: 631190 - RNA, 20 nt, Human
agacacccaagggcagagag

SEQ ID NO: 631191 - RNA, 22 nt, Human
agacccagagcaaacaagguga

SEQ ID NO: 631192 - RNA, 21 nt, Human
agagagagcuggccacaagua

SEQ ID NO: 631193 - RNA, 23 nt, Human
agagagcuggccacaaguaaacc

SEQ ID NO: 631194 - RNA, 22 nt, Human
agagggaaggggccagggaagg

SEQ ID NO: 631195 - RNA, 18 nt, Human
agagguugcagugagcug

SEQ ID NO: 631196 - RNA, 22 nt, Human
agagguugcagugagcugagau

SEQ ID NO: 631197 - RNA, 23 nt, Human
agagguugcagugagcugagauc

SEQ ID NO: 631198 - RNA, 24 nt, Human
agagguugcagugagcugagauca

SEQ ID NO: 631199 - RNA, 20 nt, Human
agagguugcagugagcuggc

SEQ ID NO: 631200 - RNA, 24 nt, Human
agcacuuugggaggccaagguggg

SEQ ID NO: 631201 - RNA, 18 nt, Human
agcagcacacugcaagac

SEQ ID NO: 631202 - RNA, 20 nt, Human
agcaggcagccugcagccuu

SEQ ID NO: 631203 - RNA, 21 nt, Human
agccacagcccaaagaagucu

SEQ ID NO: 631204 - RNA, 21 nt, Human
agccagacccagagcaaacaa

SEQ ID NO: 631205 - RNA, 24 nt, Human
agcccgggugacagagcgagacuc

SEQ ID NO: 631206 - RNA, 22 nt, Human
agccuggccaacauggugaaac

SEQ ID NO: 631207 - RNA, 24 nt, Human
agccuggccaacauggugaaaccc

SEQ ID NO: 631208 - RNA, 21 nt, Human
aggaagagagcccagggcugg

SEQ ID NO: 631209 - RNA, 18 nt, Human
aggaaggggucugggggg

SEQ ID NO: 631210 - RNA, 18 nt, Human
aggaaggggucugggggg

SEQ ID NO: 631211 - RNA, 20 nt, Human
aggaaggggucuggggggcg

SEQ ID NO: 631212 - RNA, 23 nt, Human
aggagcugcagaguugagggagg

SEQ ID NO: 631213 - RNA, 24 nt, Human
aggcacggugguucaugccuauaa

SEQ ID NO: 631214 - RNA, 20 nt, Human
aggcagagguugcagugagc

SEQ ID NO: 631215 - RNA, 24 nt, Human
aggcagagguugcagugagcugag

SEQ ID NO: 631216 - RNA, 23 nt, Human
aggcaggauaaucgcuugaaccc

SEQ ID NO: 631217 - RNA, 18 nt, Human
aggccaagguggguggau

SEQ ID NO: 631218 - RNA, 20 nt, Human
aggcugaggcaggauaaucg

SEQ ID NO: 631219 - RNA, 24 nt, Human
aggcugaggcaggauaaucgcuug

SEQ ID NO: 631220 - RNA, 20 nt, Human
agggaaggggccagggaagg

SEQ ID NO: 631221 - RNA, 23 nt, Human
agggacuaccaugggcuuggaag

SEQ ID NO: 631222 - RNA, 24 nt, Human
agggauacuuggaugacccuaaag

SEQ ID NO: 631223 - RNA, 22 nt, Human
agggggcaggauguggcaggag

SEQ ID NO: 631224 - RNA, 19 nt, Human
agguuuggagaagaugguc

SEQ ID NO: 631225 - RNA, 21 nt, Human
agucagagucuagggcagcac

SEQ ID NO: 631226 - RNA, 26 nt, Human
agucagcuacuauuucuagcuguucu

SEQ ID NO: 631227 - RNA, 24 nt, Human
aguggcgcaugccuguaaucccag

SEQ ID NO: 631228 - RNA, 29 nt, Human
auacagaaaauaaagacagaagggacccc

SEQ ID NO: 631229 - RNA, 22 nt, Human
auagaaaaccaguggaccuccg

SEQ ID NO: 631230 - RNA, 26 nt, Human
aucaaauguaugaaggaagaaggaac

SEQ ID NO: 631231 - RNA, 22 nt, Human
aucccagcacuuugggaggcca

SEQ ID NO: 631232 - RNA, 19 nt, Human
augccuauaaucccagcac

SEQ ID NO: 631233 - RNA, 19 nt, Human
auggugcugcucagcccag

SEQ ID NO: 631234 - RNA, 24 nt, Human
caaaaacaagaaaaagaaaaaaaa

SEQ ID NO: 631235 - RNA, 24 nt, Human
caacauggugaaacccugucucua

SEQ ID NO: 631236 - RNA, 26 nt, Human
caacgcccggacagacccggggccga

SEQ ID NO: 631237 - RNA, 21 nt, Human
caagguggguggauaaccuga

SEQ ID NO: 631238 - RNA, 24 nt, Human
caagguggguggauaaccugaggu

SEQ ID NO: 631239 - RNA, 19 nt, Human
caaguaacuuaacaaggac

SEQ ID NO: 631240 - RNA, 20 nt, Human
caccacgcuggcccgccagc

SEQ ID NO: 631241 - RNA, 22 nt, Human
cacuccagcccgggugacagag

SEQ ID NO: 631242 - RNA, 23 nt, Human
cacuccagcccgggugacagagc

SEQ ID NO: 631243 - RNA, 24 nt, Human
cacuccagcccgggugacagagcg

SEQ ID NO: 631244 - RNA, 28 nt, Human
cagaaaauaaagacagaaaaacacacaa

SEQ ID NO: 631245 - RNA, 26 nt, Human
cagaacuccccggagcagguggcccu

SEQ ID NO: 631246 - RNA, 24 nt, Human
cagagcgagacucuugucucaaaa

SEQ ID NO: 631247 - RNA, 24 nt, Human
cagcacuuugggaggccaaggugg

SEQ ID NO: 631248 - RNA, 21 nt, Human
cagccacaugaagcaagggca

SEQ ID NO: 631249 - RNA, 22 nt, Human
cagccagacccagagcaaacaa

SEQ ID NO: 631250 - RNA, 23 nt, Human
cagccagacccagagcaaacaag

SEQ ID NO: 631251 - RNA, 27 nt, Human
cagccccaaauauugcagagccaaaag

SEQ ID NO: 631252 - RNA, 20 nt, Human
cagcccgggugacagagcga

SEQ ID NO: 631253 - RNA, 24 nt, Human
cagcuacucaggaggcugaggcag

SEQ ID NO: 631254 - RNA, 19 nt, Human
caggaggcuuacaggucac

SEQ ID NO: 631255 - RNA, 19 nt, Human
cagggucugaaggacacag

SEQ ID NO: 631256 - RNA, 18 nt, Human
cagguuccaucucagugc

SEQ ID NO: 631257 - RNA, 21 nt, Human
caguuucuagggagugaagga

SEQ ID NO: 631258 - RNA, 22 nt, Human
ccaagaaagauguguauucucc

SEQ ID NO: 631259 - RNA, 21 nt, Human
ccagaacugucucuaucccca

SEQ ID NO: 631260 - RNA, 24 nt, Human
ccagaccagccuggccaacauggu

SEQ ID NO: 631261 - RNA, 19 nt, Human
ccagagcuacagcugugga

SEQ ID NO: 631262 - RNA, 20 nt, Human
ccagagcuacagcuguggag

SEQ ID NO: 631263 - RNA, 22 nt, Human
ccagagugauggcugagcaagg

SEQ ID NO: 631264 - RNA, 21 nt, Human
cccaaagaagucuauuuccuc

SEQ ID NO: 631265 - RNA, 25 nt, Human
cccaaagaagucuauuuccucccac

SEQ ID NO: 631266 - RNA, 27 nt, Human
cccaacagcgauucccucuccccauaa

SEQ ID NO: 631267 - RNA, 21 nt, Human
cccaggccccaaucccgcaac

SEQ ID NO: 631268 - RNA, 23 nt, Human
cccagggcugggauggugcugcu

SEQ ID NO: 631269 - RNA, 21 nt, Human
ccccaaucccgcaacgcccgg

SEQ ID NO: 631270 - RNA, 22 nt, Human
ccccaaucccgcaacgcccgga

SEQ ID NO: 631271 - RNA, 24 nt, Human
ccccagggcugggauggugcugcu

SEQ ID NO: 631272 - RNA, 19 nt, Human
cccgagucagagucuaggg

SEQ ID NO: 631273 - RNA, 20 nt, Human
cccgcaacgcccggacagac

SEQ ID NO: 631274 - RNA, 25 nt, Human
cccgcaacgcccggacagacccggg

SEQ ID NO: 631275 - RNA, 26 nt, Human
cccgcaacgcccggacagacccgggg

SEQ ID NO: 631276 - RNA, 22 nt, Human
cccggggccgcccgccgucgcu

SEQ ID NO: 631277 - RNA, 22 nt, Human
cccgggugacagagcgagacuc

SEQ ID NO: 631278 - RNA, 25 nt, Human
cccuguuguggccccuguuccuaaa

SEQ ID NO: 631279 - RNA, 21 nt, Human
ccgagaaggaaggggucuggg

SEQ ID NO: 631280 - RNA, 21 nt, Human
ccgcagucgcugcuggucgcc

SEQ ID NO: 631281 - RNA, 20 nt, Human
ccuauaaucccagcacuuug

SEQ ID NO: 631282 - RNA, 22 nt, Human
ccuauaaucccagcacuuuggg

SEQ ID NO: 631283 - RNA, 24 nt, Human
ccugcagccuuucuugccugagag

SEQ ID NO: 631284 - RNA, 22 nt, Human
ccuggccaacauggugaaaccc

SEQ ID NO: 631285 - RNA, 24 nt, Human
ccuggccaacauggugaaacccug

SEQ ID NO: 631286 - RNA, 22 nt, Human
ccuggucuucuggucugccugc

SEQ ID NO: 631287 - RNA, 19 nt, Human
ccuguaaucccagcuacuc

SEQ ID NO: 631288 - RNA, 21 nt, Human
ccuguaaucccagcuacucag

SEQ ID NO: 631289 - RNA, 22 nt, Human
ccuguaaucccagcuacucagg

SEQ ID NO: 631290 - RNA, 18 nt, Human
ccugugugaaaacaggau

SEQ ID NO: 631291 - RNA, 21 nt, Human
cgagaaggaaggggucugggg

SEQ ID NO: 631292 - RNA, 22 nt, Human
cgagaaggaaggggucuggggg

SEQ ID NO: 631293 - RNA, 18 nt, Human
cgagaggagcugcagagu

SEQ ID NO: 631294 - RNA, 23 nt, Human
cgagucagagucuagggcagcac

SEQ ID NO: 631295 - RNA, 22 nt, Human
cgccgaccuccgcggggcgcgc

SEQ ID NO: 631296 - RNA, 20 nt, Human
cggggcuggguguaggcugu

SEQ ID NO: 631297 - RNA, 23 nt, Human
cguuacacuccagcccgggugac

SEQ ID NO: 631298 - RNA, 24 nt, Human
cguuacacuccagcccgggugaca

SEQ ID NO: 631299 - RNA, 21 nt, Human
cuacagccccaaauauugcag

SEQ ID NO: 631300 - RNA, 22 nt, Human
cucacgcuggcuccugcucucc

SEQ ID NO: 631301 - RNA, 19 nt, Human
cucaggacuuaacagaaag

SEQ ID NO: 631302 - RNA, 20 nt, Human
cucaggacuuaacagaaagg

SEQ ID NO: 631303 - RNA, 20 nt, Human
cuccucuauagcucaccaga

SEQ ID NO: 631304 - RNA, 19 nt, Human
cuccuugccugggcuccag

SEQ ID NO: 631305 - RNA, 21 nt, Human
cucggggcuggguguaggcug

SEQ ID NO: 631306 - RNA, 23 nt, Human
cugaagagcucaggguuugaagg

SEQ ID NO: 631307 - RNA, 24 nt, Human
cuggccaacauggugaaacccugu

SEQ ID NO: 631308 - RNA, 20 nt, Human
cuucucugagacaaagggaa

SEQ ID NO: 631309 - RNA, 26 nt, Human
gaaaauaaagacagaaaaacacacaa

SEQ ID NO: 631310 - RNA, 19 nt, Human
gaaacccugucucuacuaa

SEQ ID NO: 631311 - RNA, 21 nt, Human
gaaggaagaaggaacggagag

SEQ ID NO: 631312 - RNA, 21 nt, Human
gaagguuuggagaagaugguc

SEQ ID NO: 631313 - RNA, 21 nt, Human
gaaugugaagggggcaggaug

SEQ ID NO: 631314 - RNA, 23 nt, Human
gagaaagaagaggaaggccaaag

SEQ ID NO: 631315 - RNA, 18 nt, Human
gagaaagaagaggaaggg

SEQ ID NO: 631316 - RNA, 19 nt, Human
gagaaggaaggggucuggg

SEQ ID NO: 631317 - RNA, 21 nt, Human
gagcaaggaagucccagcagc

SEQ ID NO: 631318 - RNA, 18 nt, Human
gagcuacagccccaaaua

SEQ ID NO: 631319 - RNA, 18 nt, Human
gaggagcugcagaguuga

SEQ ID NO: 631320 - RNA, 21 nt, Human
gaggcagagguugcagugagc

SEQ ID NO: 631321 - RNA, 24 nt, Human
gauaaccugagguuaggaguucca

SEQ ID NO: 631322 - RNA, 22 nt, Human
gauggcuagaguuuaggagcca

SEQ ID NO: 631323 - RNA, 20 nt, Human
gcacuuugggaggccaaggu

SEQ ID NO: 631324 - RNA, 19 nt, Human
gcagagagagcuggccaca

SEQ ID NO: 631325 - RNA, 20 nt, Human
gcagagggaaagagaaagaa

SEQ ID NO: 631326 - RNA, 24 nt, Human
gccaacauggugaaacccugucuc

SEQ ID NO: 631327 - RNA, 22 nt, Human
gccaggcacggugguucaugcc

SEQ ID NO: 631328 - RNA, 21 nt, Human
gccagguuccaucucagugcu

SEQ ID NO: 631329 - RNA, 18 nt, Human
gcccggacagacccgggg

SEQ ID NO: 631330 - RNA, 22 nt, Human
gcccggacagacccggggccga

SEQ ID NO: 631331 - RNA, 23 nt, Human
gcuccugcucuccuugccugggc

SEQ ID NO: 631332 - RNA, 20 nt, Human
gcuggggaaaggagcuccuc

SEQ ID NO: 631333 - RNA, 22 nt, Human
gcuucucugagacaaagggaac

SEQ ID NO: 631334 - RNA, 18 nt, Human
ggaaagagaaagaagagg

SEQ ID NO: 631335 - RNA, 21 nt, Human
ggaaagagaaagaagaggaag

SEQ ID NO: 631336 - RNA, 23 nt, Human
ggaguuccagaccagccuggccg

SEQ ID NO: 631337 - RNA, 21 nt, Human
ggcagucagcaggccccaggg

SEQ ID NO: 631338 - RNA, 23 nt, Human
ggcauaguggcgcaugccuguaa

SEQ ID NO: 631339 - RNA, 19 nt, Human
ggcuggguguaggcugugu

SEQ ID NO: 631340 - RNA, 19 nt, Human
gggaaagagaaagaagagg

SEQ ID NO: 631341 - RNA, 24 nt, Human
gggaaagagaaagaagaggaaggg

SEQ ID NO: 631342 - RNA, 22 nt, Human
gggcagagaggguugcaacugc

SEQ ID NO: 631343 - RNA, 19 nt, Human
gggcagcacugggucugaa

SEQ ID NO: 631344 - RNA, 20 nt, Human
ggguguaggcugugugguca

SEQ ID NO: 631345 - RNA, 23 nt, Human
ggguuccugcccuguuguggccc

SEQ ID NO: 631346 - RNA, 23 nt, Human
ggugguucaugccuauaauccca

SEQ ID NO: 631347 - RNA, 24 nt, Human
ggugguucaugccuauaaucccag

SEQ ID NO: 631348 - RNA, 24 nt, Human
gguuccugcccuguuguggccccu

SEQ ID NO: 631349 - RNA, 26 nt, Human
guaguccccuucacucugguccuuga

SEQ ID NO: 631350 - RNA, 26 nt, Human
gucaaauguaugaaggaagaaggaac

SEQ ID NO: 631351 - RNA, 21 nt, Human
gucacugagagggaaggggcc

SEQ ID NO: 631352 - RNA, 20 nt, Human
gucaggauggcagagggaaa

SEQ ID NO: 631353 - RNA, 25 nt, Human
guccucaggagaugaccagucccuu

SEQ ID NO: 631354 - RNA, 21 nt, Human
gugaaacccugucucuacuaa

SEQ ID NO: 631355 - RNA, 23 nt, Human
gugguucaugccuauaaucccag

SEQ ID NO: 631356 - RNA, 24 nt, Human
guuacacuccagcccgggugacag

SEQ ID NO: 631357 - RNA, 21 nt, Human
guuccugcccuguuguggccc

SEQ ID NO: 631358 - RNA, 24 nt, Human
guugcagugagcugagaucaugcc

SEQ ID NO: 631359 - RNA, 20 nt, Human
uaaaaggugaagggcuggga

SEQ ID NO: 631360 - RNA, 21 nt, Human
uaaagacagaaaaacacacaa

SEQ ID NO: 631361 - RNA, 23 nt, Human
uaaagacagaaaaacacacaaau

SEQ ID NO: 631362 - RNA, 25 nt, Human
uaaagugcacagaacuccccggagc

SEQ ID NO: 631363 - RNA, 21 nt, Human
uaacaacaacaaaagagaccu

SEQ ID NO: 631364 - RNA, 19 nt, Human
uaacuuaacaaggacaggu

SEQ ID NO: 631365 - RNA, 22 nt, Human
uacacuccagcccgggugacag

SEQ ID NO: 631366 - RNA, 20 nt, Human
uacagcuguggagcaaacac

SEQ ID NO: 631367 - RNA, 20 nt, Human
uaccgugaugcacacucggg

SEQ ID NO: 631368 - RNA, 21 nt, Human
uacuuggaugacccuaaaggc

SEQ ID NO: 631369 - RNA, 24 nt, Human
uagcaggcagccugcagccuuucu

SEQ ID NO: 631370 - RNA, 25 nt, Human
uagcaggcagccugcagccuuucuu

SEQ ID NO: 631371 - RNA, 24 nt, Human
uaguggcgcaugccuguaauccca

SEQ ID NO: 631372 - RNA, 23 nt, Human
uauagaaaaccaguggaccuccg

SEQ ID NO: 631373 - RNA, 24 nt, Human
uauuuuaaauuacaucuuuggcca

SEQ ID NO: 631374 - RNA, 22 nt, Human
ucaaaaacaagaaaaagaaaaa

SEQ ID NO: 631375 - RNA, 22 nt, Human
ucagacacccaagggcagagag

SEQ ID NO: 631376 - RNA, 27 nt, Human
ucagagucuagggcagcacagggagaa

SEQ ID NO: 631377 - RNA, 23 nt, Human
ucagagucuagggcagcacuggg

SEQ ID NO: 631378 - RNA, 23 nt, Human
ucagcuacuauuucuagcuguuc

SEQ ID NO: 631379 - RNA, 24 nt, Human
ucaggacuuaacagaaagacuuag

SEQ ID NO: 631380 - RNA, 19 nt, Human
ucaggauggcagagggaaa

SEQ ID NO: 631381 - RNA, 20 nt, Human
ucagugcugcaguccugagg

SEQ ID NO: 631382 - RNA, 23 nt, Human
ucaugccuauaaucccagcacuu

SEQ ID NO: 631383 - RNA, 18 nt, Human
ucauuuacagguccucag

SEQ ID NO: 631384 - RNA, 24 nt, Human
uccagcccgggugacagagcgaga

SEQ ID NO: 631385 - RNA, 21 nt, Human
ucccaacagcgauucccucuc

SEQ ID NO: 631386 - RNA, 25 nt, Human
ucccaggccccaaucccgcaacgcc

SEQ ID NO: 631387 - RNA, 23 nt, Human
ucccugaagagagcccucagcuc

SEQ ID NO: 631388 - RNA, 21 nt, Human
uccucagccccucuggguucc

SEQ ID NO: 631389 - RNA, 19 nt, Human
uccugugugaaaacaggau

SEQ ID NO: 631390 - RNA, 22 nt, Human
ucgcugcaggugaagccgggac

SEQ ID NO: 631391 - RNA, 23 nt, Human
ucucacgcuggcuccugcucucc

SEQ ID NO: 631392 - RNA, 22 nt, Human
ucuccaaggaaagucucggucc

SEQ ID NO: 631393 - RNA, 22 nt, Human
ucuccugcuucucugagacaaa

SEQ ID NO: 631394 - RNA, 22 nt, Human
ucucuacuaaaaauacaaaaaa

SEQ ID NO: 631395 - RNA, 25 nt, Human
ucucuacuaaaaauacaaaaaaauu

SEQ ID NO: 631396 - RNA, 22 nt, Human
ucucuauccccaugccucuccu

SEQ ID NO: 631397 - RNA, 24 nt, Human
ucugccugcucagacacccaaggg

SEQ ID NO: 631398 - RNA, 19 nt, Human
ugaacacacucuggcauca

SEQ ID NO: 631399 - RNA, 20 nt, Human
ugacucgugaaugugaaggg

SEQ ID NO: 631400 - RNA, 21 nt, Human
ugagacaaagggaacaaacca

SEQ ID NO: 631401 - RNA, 19 nt, Human
ugagagcagggauacuugg

SEQ ID NO: 631402 - RNA, 21 nt, Human
ugaggagaaguccaaagagua

SEQ ID NO: 631403 - RNA, 22 nt, Human
ugaggagcaccacgcuggcccg

SEQ ID NO: 631404 - RNA, 24 nt, Human
ugaggcaggauaaucgcuugaacc

SEQ ID NO: 631405 - RNA, 25 nt, Human
ugaggcaggauaaucgcuugaaccc

SEQ ID NO: 631406 - RNA, 20 nt, Human
ugaggccugcuggggaaagg

SEQ ID NO: 631407 - RNA, 19 nt, Human
ugcaacugcucugccuucc

SEQ ID NO: 631408 - RNA, 20 nt, Human
ugcacggagcuggcccaugc

SEQ ID NO: 631409 - RNA, 21 nt, Human
ugcaguccugaggagcaccac

SEQ ID NO: 631410 - RNA, 23 nt, Human
ugcaguuucuagggagugaagga

SEQ ID NO: 631411 - RNA, 18 nt, Human
ugccgaggaagagagccc

SEQ ID NO: 631412 - RNA, 23 nt, Human
ugccuauaaucccagcacuuugg

SEQ ID NO: 631413 - RNA, 23 nt, Human
ugccucacaugauguggccccac

SEQ ID NO: 631414 - RNA, 24 nt, Human
ugccuguaaucccagcuacucagg

SEQ ID NO: 631415 - RNA, 18 nt, Human
ugcucagcccagucacgg

SEQ ID NO: 631416 - RNA, 23 nt, Human
uggaccuccgguucugagagcag

SEQ ID NO: 631417 - RNA, 24 nt, Human
uggauaaccugagguuaggaguuc

SEQ ID NO: 631418 - RNA, 19 nt, Human
uggcaggagggaaagagua

SEQ ID NO: 631419 - RNA, 22 nt, Human
uggcaggagggaaagaguacau

SEQ ID NO: 631420 - RNA, 33 nt, Human
uggcaucacagcagugaacugcaagcagccaac

SEQ ID NO: 631421 - RNA, 24 nt, Human
uggccaacauggugaaacccuguc

SEQ ID NO: 631422 - RNA, 24 nt, Human
uggccaggcacggugguucaugcc

SEQ ID NO: 631423 - RNA, 21 nt, Human
uggcgcaugccuguaauccca

SEQ ID NO: 631424 - RNA, 22 nt, Human
uggcgcaugccuguaaucccag

SEQ ID NO: 631425 - RNA, 22 nt, Human
ugggaggccaagguggguggau

SEQ ID NO: 631426 - RNA, 22 nt, Human
ugggcagucagcaggccccagg

SEQ ID NO: 631427 - RNA, 21 nt, Human
ugggcugacagugugggucug

SEQ ID NO: 631428 - RNA, 19 nt, Human
uggguguaggcuguguggu

SEQ ID NO: 631429 - RNA, 21 nt, Human
ugguucaugccuauaauccca

SEQ ID NO: 631430 - RNA, 22 nt, Human
ugguucaugccuauaaucccag

SEQ ID NO: 631431 - RNA, 24 nt, Human
ugguucaugccuauaaucccagca

SEQ ID NO: 631432 - RNA, 22 nt, Human
ugguuuuguuuucccuuuuaau

SEQ ID NO: 631433 - RNA, 20 nt, Human
ugucucuauccccaugccuc

SEQ ID NO: 631434 - RNA, 21 nt, Human
ugugcagauguggcccucacc

SEQ ID NO: 631435 - RNA, 22 nt, Human
uuacacuccagcccgggugaca

SEQ ID NO: 631436 - RNA, 20 nt, Human
uuaguucaguuccuuggcuu

SEQ ID NO: 631437 - RNA, 25 nt, Human
uuaguucaguuccuuggcuuugugc

SEQ ID NO: 631438 - RNA, 23 nt, Human
uucaugccuauaaucccagcacu

SEQ ID NO: 631439 - RNA, 21 nt, Human
uuccugcccuguuguggcccc

SEQ ID NO: 631440 - RNA, 25 nt, Human
uucucggcugccgggggccgagcgu

SEQ ID NO: 631441 - RNA, 18 nt, Human
uugcagugagcugagauc

SEQ ID NO: 631442 - RNA, 19 nt, Human
uugcagugagcugagauca

SEQ ID NO: 631443 - RNA, 20 nt, Human
uugcagugagcugagaucau

SEQ ID NO: 631444 - RNA, 21 nt, Human
uugcagugagcugagaucaug

SEQ ID NO: 631445 - RNA, 23 nt, Human
uugcagugagcugagaucaugcc

SEQ ID NO: 631446 - RNA, 21 nt, Human
uugccugggcuccagccacau

SEQ ID NO: 631447 - RNA, 18 nt, Human
aaaagacacaaaaccagg

SEQ ID NO: 631448 - RNA, 20 nt, Human
aaaagacacaaaaccaggac

SEQ ID NO: 631449 - RNA, 21 nt, Human
aaccaggaccuggugucaacc

SEQ ID NO: 631450 - RNA, 22 nt, Human
aagcauucagaaugauucaugc

SEQ ID NO: 631451 - RNA, 21 nt, Human
acaguccugucuccccugccc

SEQ ID NO: 631452 - RNA, 24 nt, Human
agcaauaggggagcacuucaaaga

SEQ ID NO: 631453 - RNA, 24 nt, Human
agcagaccuuggaaauguaacccc

SEQ ID NO: 631454 - RNA, 28 nt, Human
agcagaccuuggaaauguaaccccgauu

SEQ ID NO: 631455 - RNA, 21 nt, Human
agcugggcaauauagugagac

SEQ ID NO: 631456 - RNA, 23 nt, Human
agcugggcaauauagugagaccc

SEQ ID NO: 631457 - RNA, 21 nt, Human
aggagcaguggcucaugccug

SEQ ID NO: 631458 - RNA, 19 nt, Human
agguucuggaaauuggcuu

SEQ ID NO: 631459 - RNA, 25 nt, Human
aguccugucuccccugcccgaggcu

SEQ ID NO: 631460 - RNA, 18 nt, Human
agucucaccaugcccagu

SEQ ID NO: 631461 - RNA, 24 nt, Human
aguuuguuuuacaauuuucuacau

SEQ ID NO: 631462 - RNA, 23 nt, Human
auccuccccaagacccaguccua

SEQ ID NO: 631463 - RNA, 21 nt, Human
caaaaccaggaccugguguca

SEQ ID NO: 631464 - RNA, 24 nt, Human
caaaaucagacaucuaggcgcuaa

SEQ ID NO: 631465 - RNA, 22 nt, Human
caaagcgugagaacccuccagg

SEQ ID NO: 631466 - RNA, 21 nt, Human
caguguggcucuuugccucuu

SEQ ID NO: 631467 - RNA, 22 nt, Human
caguguggcucuuugccucuug

SEQ ID NO: 631468 - RNA, 27 nt, Human
cauucagaaugauucaugcugcaucac

SEQ ID NO: 631469 - RNA, 24 nt, Human
ccaaaaucagacaucuaaucaacg

SEQ ID NO: 631470 - RNA, 22 nt, Human
ccacaacacucugggaagcuga

SEQ ID NO: 631471 - RNA, 22 nt, Human
ccaggaccuggugucaaccaga

SEQ ID NO: 631472 - RNA, 27 nt, Human
cccacaacacucugggaagcugaaaga

SEQ ID NO: 631473 - RNA, 24 nt, Human
cccgaggcugccggucgccuuccu

SEQ ID NO: 631474 - RNA, 21 nt, Human
cccugagccucagaaaagggc

SEQ ID NO: 631475 - RNA, 21 nt, Human
ccugcggcuacuccagacuca

SEQ ID NO: 631476 - RNA, 21 nt, Human
gaaaaagcggaaaaacuuaaa

SEQ ID NO: 631477 - RNA, 21 nt, Human
gacaaaagacacaaaaccagg

SEQ ID NO: 631478 - RNA, 23 nt, Human
gaccuuggaaauguaaccccgau

SEQ ID NO: 631479 - RNA, 20 nt, Human
gagugagcugggcaauauag

SEQ ID NO: 631480 - RNA, 19 nt, Human
gcacugauguuucaaauau

SEQ ID NO: 631481 - RNA, 18 nt, Human
gcauucucccaccccugc

SEQ ID NO: 631482 - RNA, 22 nt, Human
gcucuuugccucuuguccuugc

SEQ ID NO: 631483 - RNA, 24 nt, Human
gcuuuggaugaugccaagggcagu

SEQ ID NO: 631484 - RNA, 23 nt, Human
gggcuggcauucucccaccccug

SEQ ID NO: 631485 - RNA, 18 nt, Human
ggucaggagcaguggcuc

SEQ ID NO: 631486 - RNA, 19 nt, Human
guucagaaugucagucuuc

SEQ ID NO: 631487 - RNA, 25 nt, Human
uaaaaagaugaacaaauuacauuag

SEQ ID NO: 631488 - RNA, 21 nt, Human
uaaauagacacugaaaaggua

SEQ ID NO: 631489 - RNA, 26 nt, Human
uaaauagacacugaaaagguaucuau

SEQ ID NO: 631490 - RNA, 20 nt, Human
uaaauuguagauauaauaca

SEQ ID NO: 631491 - RNA, 19 nt, Human
uaagguucaaggcacugau

SEQ ID NO: 631492 - RNA, 20 nt, Human
ucagacaucuaggcgcuaau

SEQ ID NO: 631493 - RNA, 23 nt, Human
ucccaccccugcggcuacucccc

SEQ ID NO: 631494 - RNA, 21 nt, Human
uccccaccucuuuagguccac

SEQ ID NO: 631495 - RNA, 22 nt, Human
uccccaccucuuuagguccaca

SEQ ID NO: 631496 - RNA, 24 nt, Human
ucuaaugaaguuuguuuuacaauu

SEQ ID NO: 631497 - RNA, 21 nt, Human
ucucuagcuccauccacuucc

SEQ ID NO: 631498 - RNA, 20 nt, Human
ucugaaaguaacacggccau

SEQ ID NO: 631499 - RNA, 20 nt, Human
ucuucaacuguggugcccgu

SEQ ID NO: 631500 - RNA, 22 nt, Human
ucuuuauaaaagcuuaucacuu

SEQ ID NO: 631501 - RNA, 18 nt, Human
ugaaaaagcggaaaaacu

SEQ ID NO: 631502 - RNA, 21 nt, Human
ugacaaaagacacaaaaccag

SEQ ID NO: 631503 - RNA, 23 nt, Human
ugacaaaagacacaaaaccagga

SEQ ID NO: 631504 - RNA, 19 nt, Human
ugacauacaguccugucuc

SEQ ID NO: 631505 - RNA, 23 nt, Human
ugacucugggcuggcauucuccc

SEQ ID NO: 631506 - RNA, 25 nt, Human
ugagcugggcaauauagugagaccc

SEQ ID NO: 631507 - RNA, 25 nt, Human
ugauucaugcugcaucaccuccccc

SEQ ID NO: 631508 - RNA, 25 nt, Human
ugcaauuggucaaaauuuuuaaaau

SEQ ID NO: 631509 - RNA, 21 nt, Human
ugccaagggcaguguggcucc

SEQ ID NO: 631510 - RNA, 18 nt, Human
uggccaaaaaaacuccug

SEQ ID NO: 631511 - RNA, 23 nt, Human
uggugucaaccagacaaugcuuu

SEQ ID NO: 631512 - RNA, 25 nt, Human
uuaaaauauauuuucugucaaaauc

SEQ ID NO: 631513 - RNA, 19 nt, Human
uuccugaaaaagcggaaaa

SEQ ID NO: 631514 - RNA, 23 nt, Human
uugaaaaauaucuauacccuuua

SEQ ID NO: 631515 - RNA, 23 nt, Human
uuuccuaugaucuuuauaaaagc

SEQ ID NO: 631516 - RNA, 20 nt, Human
uuugccucuuguccuugcuu

SEQ ID NO: 631517 - RNA, 19 nt, Human
uuugggaggcuaugguggg

SEQ ID NO: 631518 - RNA, 22 nt, Human
uuuuuuugcuuuuuaaguuuua

SEQ ID NO: 631519 - RNA, 20 nt, Human
uuuuuuuuuuuuuugcuuuu

SEQ ID NO: 631520 - RNA, 18 nt, Human
uuuuuuuuuuuuuuuuug

SEQ ID NO: 631521 - RNA, 25 nt, Human
uuuuuuuuuuuuuuuuuugcuuuuu

SEQ ID NO: 631522 - RNA, 26 nt, Human
aaaaaaucagaaaacaaacauuuggu

SEQ ID NO: 631523 - RNA, 26 nt, Human
aacaggaggcgagccuauagcucaaa

SEQ ID NO: 631524 - RNA, 23 nt, Human
aacuggccccuaggcucaaccug

SEQ ID NO: 631525 - RNA, 19 nt, Human
aagcagggcuccggcucuc

SEQ ID NO: 631526 - RNA, 21 nt, Human
aaguuaccauaaggcacauag

SEQ ID NO: 631527 - RNA, 20 nt, Human
acaaugggccgucaggggcc

SEQ ID NO: 631528 - RNA, 18 nt, Human
acagucaaggcagcuuug

SEQ ID NO: 631529 - RNA, 18 nt, Human
agaccugaaagcauggca

SEQ ID NO: 631530 - RNA, 22 nt, Human
agagaaagggccaaccucugcc

SEQ ID NO: 631531 - RNA, 21 nt, Human
agagagagaccgaggccugga

SEQ ID NO: 631532 - RNA, 23 nt, Human
agcaagcagggcuccggcucucu

SEQ ID NO: 631533 - RNA, 23 nt, Human
agcccaggcugagucucaaagac

SEQ ID NO: 631534 - RNA, 27 nt, Human
agcuauuaaaaaaaaaucagaaaacaa

SEQ ID NO: 631535 - RNA, 18 nt, Human
aggaagaagggagcagag

SEQ ID NO: 631536 - RNA, 20 nt, Human
aggaagaagggagcagagaa

SEQ ID NO: 631537 - RNA, 20 nt, Human
aggccacagaagaccugaaa

SEQ ID NO: 631538 - RNA, 22 nt, Human
agggggcugagaugacaggggu

SEQ ID NO: 631539 - RNA, 22 nt, Human
augcagcagggcuuuuuccuuu

SEQ ID NO: 631540 - RNA, 22 nt, Human
auuuccccuuuuacucagcaaa

SEQ ID NO: 631541 - RNA, 25 nt, Human
caaauuauagaaaaaugauuuuucc

SEQ ID NO: 631542 - RNA, 22 nt, Human
cacauacaaaggcugauggaau

SEQ ID NO: 631543 - RNA, 23 nt, Human
cagcagggcuuuuuccuuuggcc

SEQ ID NO: 631544 - RNA, 20 nt, Human
ccaacuggccccuaggcuca

SEQ ID NO: 631545 - RNA, 18 nt, Human
ccacagucaaggcagcuu

SEQ ID NO: 631546 - RNA, 23 nt, Human
ccaguaggccacagaagaccuga

SEQ ID NO: 631547 - RNA, 18 nt, Human
cccaacuggccccuaggc

SEQ ID NO: 631548 - RNA, 22 nt, Human
cccacauauuccgccuuccaga

SEQ ID NO: 631549 - RNA, 23 nt, Human
cccagcaggaagaagggagcaga

SEQ ID NO: 631550 - RNA, 21 nt, Human
cccccaacuggccccuaggcu

SEQ ID NO: 631551 - RNA, 23 nt, Human
cccccacaccaggcccagaaaga

SEQ ID NO: 631552 - RNA, 26 nt, Human
ccgggguagacgcgcugguuaggggc

SEQ ID NO: 631553 - RNA, 21 nt, Human
ccuacacauuaaagcccaggc

SEQ ID NO: 631554 - RNA, 19 nt, Human
cggcucucuggguggccag

SEQ ID NO: 631555 - RNA, 22 nt, Human
cuaaaacacagccagaaaagag

SEQ ID NO: 631556 - RNA, 18 nt, Human
cuacacauuaaagcccag

SEQ ID NO: 631557 - RNA, 22 nt, Human
cucaaagaccugugaccccucu

SEQ ID NO: 631558 - RNA, 24 nt, Human
cucaaaucccuuucucuaaaacac

SEQ ID NO: 631559 - RNA, 23 nt, Human
cucaucuugaguugcucauuaag

SEQ ID NO: 631560 - RNA, 24 nt, Human
cucccaaaucguaccgggcccuau

SEQ ID NO: 631561 - RNA, 19 nt, Human
cucuggguggccagaaggc

SEQ ID NO: 631562 - RNA, 19 nt, Human
cuggccccuaggcucaacc

SEQ ID NO: 631563 - RNA, 25 nt, Human
gaagaagggagcagagaauacagca

SEQ ID NO: 631564 - RNA, 20 nt, Human
gacacuggccaaacagugca

SEQ ID NO: 631565 - RNA, 23 nt, Human
gcagauggaaggacuccccuaaa

SEQ ID NO: 631566 - RNA, 18 nt, Human
gcucaaccuggcuggaca

SEQ ID NO: 631567 - RNA, 25 nt, Human
ggaaggacuccccuaaaaccuaaga

SEQ ID NO: 631568 - RNA, 20 nt, Human
ggccaaacagugcacuaggu

SEQ ID NO: 631569 - RNA, 20 nt, Human
ggccuggggcgggaagcagc

SEQ ID NO: 631570 - RNA, 23 nt, Human
ggcggggagguugggcccaggga

SEQ ID NO: 631571 - RNA, 18 nt, Human
ggcugagucucaaagacc

SEQ ID NO: 631572 - RNA, 22 nt, Human
gggaagcagcccccgggggacg

SEQ ID NO: 631573 - RNA, 23 nt, Human
gggccggguucccaagccugggg

SEQ ID NO: 631574 - RNA, 20 nt, Human
gggcugagaugacaggggug

SEQ ID NO: 631575 - RNA, 24 nt, Human
gggcuuuuuccuuuggcccuggcu

SEQ ID NO: 631576 - RNA, 20 nt, Human
ggggaagggcuaugacaaug

SEQ ID NO: 631577 - RNA, 19 nt, Human
gguagacgcgcugguuagg

SEQ ID NO: 631578 - RNA, 24 nt, Human
uaaaacacagccagaaaagaggcc

SEQ ID NO: 631579 - RNA, 25 nt, Human
uaaaacacagccagaaaagaggcug

SEQ ID NO: 631580 - RNA, 22 nt, Human
uacagaaaugucacucccaaau

SEQ ID NO: 631581 - RNA, 22 nt, Human
uaccgggcccuauuauggcuaa

SEQ ID NO: 631582 - RNA, 19 nt, Human
uagcccccacaccaggccc

SEQ ID NO: 631583 - RNA, 26 nt, Human
uauggcuaaaacccagcaggaagaag

SEQ ID NO: 631584 - RNA, 19 nt, Human
ucaaagaccugugaccccu

SEQ ID NO: 631585 - RNA, 19 nt, Human
ucacugcgcguugccgggg

SEQ ID NO: 631586 - RNA, 19 nt, Human
uccagaaggcauuagagaa

SEQ ID NO: 631587 - RNA, 27 nt, Human
ucucuggguggccagaaggccgacuuc

SEQ ID NO: 631588 - RNA, 28 nt, Human
ucucuggguggccagaaggccgacuuuc

SEQ ID NO: 631589 - RNA, 22 nt, Human
ucucuggguggccagaaggcuu

SEQ ID NO: 631590 - RNA, 23 nt, Human
ugaaaagccaacucccuaggaca

SEQ ID NO: 631591 - RNA, 22 nt, Human
ugaaaagccaacucccuagggg

SEQ ID NO: 631592 - RNA, 20 nt, Human
ugaaggaggcuccauccaca

SEQ ID NO: 631593 - RNA, 24 nt, Human
ugagguagcccccacaccaggccc

SEQ ID NO: 631594 - RNA, 23 nt, Human
uggaaaaagagcaguuuucucau

SEQ ID NO: 631595 - RNA, 22 nt, Human
uggccccuaggcucaaccuggc

SEQ ID NO: 631596 - RNA, 26 nt, Human
uggcugaaaagccaacucccuaggac

SEQ ID NO: 631597 - RNA, 23 nt, Human
uggggcuggugggggggaggggu

SEQ ID NO: 631598 - RNA, 18 nt, Human
ugucucaagucaaaacaa

SEQ ID NO: 631599 - RNA, 24 nt, Human
uuggcccuggcugaaaagccaacu

SEQ ID NO: 631600 - RNA, 19 nt, Human
uuuccuacacauuaaagcc

SEQ ID NO: 631601 - RNA, 21 nt, Human
uuugagaaaacuguuaaaaug

SEQ ID NO: 631602 - RNA, 22 nt, Human
aaaaaggcuccaaaauaaaaca

SEQ ID NO: 631603 - RNA, 26 nt, Human
aaaauaaaacaaacuugucugcucaa

SEQ ID NO: 631604 - RNA, 20 nt, Human
aaaaugaacaccaaugacuu

SEQ ID NO: 631605 - RNA, 21 nt, Human
aacacggugaaacugcgccuc

SEQ ID NO: 631606 - RNA, 18 nt, Human
aacagaaaacgcacaagc

SEQ ID NO: 631607 - RNA, 22 nt, Human
aagaaaaacauuagaaagagaa

SEQ ID NO: 631608 - RNA, 27 nt, Human
aagaggccagaggugauggugggcacc

SEQ ID NO: 631609 - RNA, 24 nt, Human
aagcaggagaauggcaugaaccca

SEQ ID NO: 631610 - RNA, 27 nt, Human
aagcaggagaauggcaugaacccagga

SEQ ID NO: 631611 - RNA, 26 nt, Human
aagccagagccaaaaaggcuccaaaa

SEQ ID NO: 631612 - RNA, 18 nt, Human
aagcugccucacccaugg

SEQ ID NO: 631613 - RNA, 23 nt, Human
aaguuguacuagccaauguuugg

SEQ ID NO: 631614 - RNA, 19 nt, Human
aaucaaguuguacuagcca

SEQ ID NO: 631615 - RNA, 23 nt, Human
acaagagugacucggucucaaaa

SEQ ID NO: 631616 - RNA, 19 nt, Human
acacggugaaacugcgccu

SEQ ID NO: 631617 - RNA, 18 nt, Human
acagugcugcucugaaca

SEQ ID NO: 631618 - RNA, 25 nt, Human
acuccagccugggugacaagaguga

SEQ ID NO: 631619 - RNA, 18 nt, Human
acugcacuccagccuggg

SEQ ID NO: 631620 - RNA, 25 nt, Human
acugcacuccagccugggugacaag

SEQ ID NO: 631621 - RNA, 18 nt, Human
acuuuugcuucuauggga

SEQ ID NO: 631622 - RNA, 24 nt, Human
agccaaaaaggcuccaaaauaaaa

SEQ ID NO: 631623 - RNA, 23 nt, Human
agccaaaagcaagacucauggca

SEQ ID NO: 631624 - RNA, 23 nt, Human
agccugggugacaagagugacuc

SEQ ID NO: 631625 - RNA, 24 nt, Human
aggagggcagaucacgaggucagg

SEQ ID NO: 631626 - RNA, 18 nt, Human
aggcaggcagguccagag

SEQ ID NO: 631627 - RNA, 18 nt, Human
aggcaggcagguccagag

SEQ ID NO: 631628 - RNA, 22 nt, Human
aggcaggcagguccagaguuca

SEQ ID NO: 631629 - RNA, 21 nt, Human
aggcugaggagggcagaucac

SEQ ID NO: 631630 - RNA, 21 nt, Human
agguggagcuugcagugagcc

SEQ ID NO: 631631 - RNA, 24 nt, Human
agguggagcuugcagugagccgag

SEQ ID NO: 631632 - RNA, 21 nt, Human
auaaaacaaacuugucugcuc

SEQ ID NO: 631633 - RNA, 24 nt, Human
aucgcgccacugcacuccagccug

SEQ ID NO: 631634 - RNA, 21 nt, Human
caaaggacuccagaaacacag

SEQ ID NO: 631635 - RNA, 21 nt, Human
caaccacuucucggaagagcc

SEQ ID NO: 631636 - RNA, 22 nt, Human
caaccacuucucggaagagccc

SEQ ID NO: 631637 - RNA, 26 nt, Human
caagccggacaggacccuaagaccaa

SEQ ID NO: 631638 - RNA, 24 nt, Human
caaguuguacuagccaauguuugg

SEQ ID NO: 631639 - RNA, 24 nt, Human
caauguuuaaaagccagagccaaa

SEQ ID NO: 631640 - RNA, 22 nt, Human
cacacaugcacccagcuagggu

SEQ ID NO: 631641 - RNA, 23 nt, Human
cacgccuauaaucccagcaccug

SEQ ID NO: 631642 - RNA, 23 nt, Human
cacuccagccugggugacaagag

SEQ ID NO: 631643 - RNA, 24 nt, Human
cacuccagccugggugacaagagu

SEQ ID NO: 631644 - RNA, 25 nt, Human
cacuccagccugggugacaagagug

SEQ ID NO: 631645 - RNA, 19 nt, Human
cacugcacuccagccuggg

SEQ ID NO: 631646 - RNA, 19 nt, Human
cacugcacuccagccuggg

SEQ ID NO: 631647 - RNA, 22 nt, Human
cacugcacuccagccuggguga

SEQ ID NO: 631648 - RNA, 23 nt, Human
cacugcacuccagccugggugac

SEQ ID NO: 631649 - RNA, 24 nt, Human
cacugcacuccagccugggugaca

SEQ ID NO: 631650 - RNA, 25 nt, Human
cacugcacuccagccugggugacaa

SEQ ID NO: 631651 - RNA, 20 nt, Human
cagcucugcaccuacccucu

SEQ ID NO: 631652 - RNA, 29 nt, Human
caggagguggagcuugcagugacaacggu

SEQ ID NO: 631653 - RNA, 23 nt, Human
caggcagguccagaguucaugca

SEQ ID NO: 631654 - RNA, 19 nt, Human
caucagagaaccagugggg

SEQ ID NO: 631655 - RNA, 22 nt, Human
cauggcaccccucccugcagga

SEQ ID NO: 631656 - RNA, 18 nt, Human
cauggcucuccagcucug

SEQ ID NO: 631657 - RNA, 22 nt, Human
caugguggcgggcgccuguagu

SEQ ID NO: 631658 - RNA, 24 nt, Human
ccaaaggacuccagaaacacagca

SEQ ID NO: 631659 - RNA, 19 nt, Human
ccaagccggacaggacccu

SEQ ID NO: 631660 - RNA, 20 nt, Human
ccacugcacuccagccuggg

SEQ ID NO: 631661 - RNA, 20 nt, Human
ccacugcacuccagccuggg

SEQ ID NO: 631662 - RNA, 21 nt, Human
ccacugcacuccagccugggu

SEQ ID NO: 631663 - RNA, 21 nt, Human
ccacugcacuccagccugggu

SEQ ID NO: 631664 - RNA, 23 nt, Human
ccacugcacuccagccuggguga

SEQ ID NO: 631665 - RNA, 24 nt, Human
ccacugcacuccagccugggugac

SEQ ID NO: 631666 - RNA, 19 nt, Human
ccacuucucggaagagccc

SEQ ID NO: 631667 - RNA, 22 nt, Human
ccagagccaaaaaggcuccaaa

SEQ ID NO: 631668 - RNA, 22 nt, Human
ccagcucugcaccuacccucuc

SEQ ID NO: 631669 - RNA, 20 nt, Human
ccauggcucuccagcucugc

SEQ ID NO: 631670 - RNA, 20 nt, Human
ccccaagccggacaggaccc

SEQ ID NO: 631671 - RNA, 18 nt, Human
cccugcaggaaaggggug

SEQ ID NO: 631672 - RNA, 20 nt, Human
ccucacucccuuucacuuug

SEQ ID NO: 631673 - RNA, 21 nt, Human
ccucacucccuuucacuuugu

SEQ ID NO: 631674 - RNA, 21 nt, Human
ccucaggaagaggcagcagcu

SEQ ID NO: 631675 - RNA, 23 nt, Human
ccucaggaagaggcagcagcuuc

SEQ ID NO: 631676 - RNA, 19 nt, Human
ccuguagucccagcuacuc

SEQ ID NO: 631677 - RNA, 21 nt, Human
ccuguagucccagcuacucag

SEQ ID NO: 631678 - RNA, 22 nt, Human
ccuguagucccagcuacucagg

SEQ ID NO: 631679 - RNA, 23 nt, Human
ccuguaugagccaaaagcaagac

SEQ ID NO: 631680 - RNA, 20 nt, Human
ccuuucaucagccccaagcc

SEQ ID NO: 631681 - RNA, 24 nt, Human
cgagaccaucuuggcuaacacggu

SEQ ID NO: 631682 - RNA, 19 nt, Human
cgaggaaccggcaaagggg

SEQ ID NO: 631683 - RNA, 26 nt, Human
cgccacugcacuccagccugggugac

SEQ ID NO: 631684 - RNA, 20 nt, Human
cgccgccucacucccuuuca

SEQ ID NO: 631685 - RNA, 23 nt, Human
cgccuauaaucccagcaccuggg

SEQ ID NO: 631686 - RNA, 24 nt, Human
cgccuguagucccagcuacucagg

SEQ ID NO: 631687 - RNA, 21 nt, Human
cgggcgcggacagcuccuuuc

SEQ ID NO: 631688 - RNA, 20 nt, Human
cggucucaaaaaaaaaaaaa

SEQ ID NO: 631689 - RNA, 21 nt, Human
cuaagauggcuguuguagcuc

SEQ ID NO: 631690 - RNA, 18 nt, Human
cucaaaaaaaaaaaaaaa

SEQ ID NO: 631691 - RNA, 19 nt, Human
cucacgccuauaaucccag

SEQ ID NO: 631692 - RNA, 23 nt, Human
cucacgccuauaaucccagcacc

SEQ ID NO: 631693 - RNA, 19 nt, Human
cuccuguaugagccaaaag

SEQ ID NO: 631694 - RNA, 18 nt, Human
cuccuuucaucagcccca

SEQ ID NO: 631695 - RNA, 24 nt, Human
cucggucucaaaaaaaaaaaaaaa

SEQ ID NO: 631696 - RNA, 21 nt, Human
cugcucugaggcuugcaggga

SEQ ID NO: 631697 - RNA, 21 nt, Human
cugggacacauguuuccaaag

SEQ ID NO: 631698 - RNA, 19 nt, Human
cuugcagugagccgagauc

SEQ ID NO: 631699 - RNA, 21 nt, Human
cuugcagugagccgagaucgc

SEQ ID NO: 631700 - RNA, 22 nt, Human
cuuggcuaacacggugaaacug

SEQ ID NO: 631701 - RNA, 22 nt, Human
gaaaaugaacaccaaugacuug

SEQ ID NO: 631702 - RNA, 22 nt, Human
gaaagcacgagggauguaugag

SEQ ID NO: 631703 - RNA, 20 nt, Human
gacucauggcaccccucccu

SEQ ID NO: 631704 - RNA, 23 nt, Human
gagaucgcgccacugcacuccag

SEQ ID NO: 631705 - RNA, 18 nt, Human
gagcuugcagugagccga

SEQ ID NO: 631706 - RNA, 23 nt, Human
gagcuugcagugagccgagaucg

SEQ ID NO: 631707 - RNA, 19 nt, Human
gagugguggauggugaagg

SEQ ID NO: 631708 - RNA, 25 nt, Human
gauaaagaaaaacauuagaaagaga

SEQ ID NO: 631709 - RNA, 21 nt, Human
gcacaagcgcagaaaagaaac

SEQ ID NO: 631710 - RNA, 19 nt, Human
gcagaaaagaaacuccugg

SEQ ID NO: 631711 - RNA, 19 nt, Human
gccacugcacuccagccug

SEQ ID NO: 631712 - RNA, 24 nt, Human
gccacugcacuccagccuggguga

SEQ ID NO: 631713 - RNA, 22 nt, Human
gcccacgguugcgccaggcacc

SEQ ID NO: 631714 - RNA, 20 nt, Human
gccgagaucgcgccacugca

SEQ ID NO: 631715 - RNA, 21 nt, Human
gcgcgcgguggcucacgccua

SEQ ID NO: 631716 - RNA, 24 nt, Human
gcuaacacggugaaacugcgccuc

SEQ ID NO: 631717 - RNA, 24 nt, Human
gcugcucugaggcuugcagggagu

SEQ ID NO: 631718 - RNA, 21 nt, Human
ggaaaaaucugcuccugcuaa

SEQ ID NO: 631719 - RNA, 24 nt, Human
ggagcuugcagugagccgagaucg

SEQ ID NO: 631720 - RNA, 22 nt, Human
ggcaugguggcgggcgccugua

SEQ ID NO: 631721 - RNA, 19 nt, Human
ggcccccgcucaacagccc

SEQ ID NO: 631722 - RNA, 24 nt, Human
gggcagaucacgaggucaggagau

SEQ ID NO: 631723 - RNA, 24 nt, Human
gggugugggggugugugugugugu

SEQ ID NO: 631724 - RNA, 24 nt, Human
gguggcgggcgccuguagucccag

SEQ ID NO: 631725 - RNA, 24 nt, Human
gguggcucacgccuauaaucccag

SEQ ID NO: 631726 - RNA, 21 nt, Human
ggugugugugugugugugugu

SEQ ID NO: 631727 - RNA, 22 nt, Human
gugggggugugugugugugugu

SEQ ID NO: 631728 - RNA, 30 nt, Human
gugugggggugugugugugugugugugugg

SEQ ID NO: 631729 - RNA, 20 nt, Human
gugugugugugugugugugu

SEQ ID NO: 631730 - RNA, 19 nt, Human
uaaaacaggcaaaucccau

SEQ ID NO: 631731 - RNA, 22 nt, Human
uaacacggugaaacugcgccuc

SEQ ID NO: 631732 - RNA, 24 nt, Human
uaacacggugaaacugcgccucua

SEQ ID NO: 631733 - RNA, 18 nt, Human
ucacgaggucaggagauc

SEQ ID NO: 631734 - RNA, 24 nt, Human
ucacgaggucaggagaucgagacc

SEQ ID NO: 631735 - RNA, 20 nt, Human
uccacgccgccucacucccu

SEQ ID NO: 631736 - RNA, 18 nt, Human
uccagaguucaugcagga

SEQ ID NO: 631737 - RNA, 19 nt, Human
uccagccugggugacaaga

SEQ ID NO: 631738 - RNA, 20 nt, Human
ucccugcaggaaaggggugg

SEQ ID NO: 631739 - RNA, 23 nt, Human
ucgcgccacugcacuccagccug

SEQ ID NO: 631740 - RNA, 21 nt, Human
ucggucucaaaaaaaaaaaaa

SEQ ID NO: 631741 - RNA, 24 nt, Human
ucggucucaaaaaaaaaaaaaaaa

SEQ ID NO: 631742 - RNA, 19 nt, Human
ucuauaaaaauacaaaaaa

SEQ ID NO: 631743 - RNA, 21 nt, Human
ugaagagaaccuacaguaaua

SEQ ID NO: 631744 - RNA, 23 nt, Human
ugaagcaggagaauggcaugaac

SEQ ID NO: 631745 - RNA, 24 nt, Human
ugaagcaggagaauggcaugaacc

SEQ ID NO: 631746 - RNA, 18 nt, Human
ugaauccucacugucacu

SEQ ID NO: 631747 - RNA, 18 nt, Human
ugacaagagugacucggu

SEQ ID NO: 631748 - RNA, 22 nt, Human
ugagccgagaucgcgccacugc

SEQ ID NO: 631749 - RNA, 24 nt, Human
ugaggagggcagaucacgagguca

SEQ ID NO: 631750 - RNA, 24 nt, Human
ugaggcuugcagggaguagacagu

SEQ ID NO: 631751 - RNA, 19 nt, Human
ugcaggaaagggguggaau

SEQ ID NO: 631752 - RNA, 19 nt, Human
ugccucaggaagaggcagc

SEQ ID NO: 631753 - RNA, 21 nt, Human
ugccucaggaagaggcagcag

SEQ ID NO: 631754 - RNA, 18 nt, Human
ugcugggcaccucgggga

SEQ ID NO: 631755 - RNA, 21 nt, Human
uggaagaggccagaggugaug

SEQ ID NO: 631756 - RNA, 19 nt, Human
uggaauggagccccuggca

SEQ ID NO: 631757 - RNA, 20 nt, Human
uggagccccuggcaaagggg

SEQ ID NO: 631758 - RNA, 23 nt, Human
uggagccccuggcaaagggggcu

SEQ ID NO: 631759 - RNA, 18 nt, Human
uggcuaacacggugaaac

SEQ ID NO: 631760 - RNA, 21 nt, Human
uggcucacgccuauaauccca

SEQ ID NO: 631761 - RNA, 24 nt, Human
uggcucacgccuauaaucccagca

SEQ ID NO: 631762 - RNA, 24 nt, Human
ugggaggcugaggagggcagauca

SEQ ID NO: 631763 - RNA, 25 nt, Human
ugggggugugugugugugugugugg

SEQ ID NO: 631764 - RNA, 24 nt, Human
ugguggcgggcgccuguaguccca

SEQ ID NO: 631765 - RNA, 21 nt, Human
ugugugcacacacaugcaccc

SEQ ID NO: 631766 - RNA, 18 nt, Human
ugugugugugcacacaca

SEQ ID NO: 631767 - RNA, 19 nt, Human
ugugugugugugugcacac

SEQ ID NO: 631768 - RNA, 23 nt, Human
ugugugugugugugcacacacau

SEQ ID NO: 631769 - RNA, 18 nt, Human
ugugugugugugugugug

SEQ ID NO: 631770 - RNA, 19 nt, Human
ugugugugugugugugugu

SEQ ID NO: 631771 - RNA, 18 nt, Human
uuagcugggcaugguggc

SEQ ID NO: 631772 - RNA, 24 nt, Human
uuagcugggcaugguggcgggcgc

SEQ ID NO: 631773 - RNA, 21 nt, Human
uucacagaagucugaggcagg

SEQ ID NO: 631774 - RNA, 24 nt, Human
uuccuggagugacucccuccucuu

SEQ ID NO: 631775 - RNA, 25 nt, Human
uugaaauaacccaaaugugaauccu

SEQ ID NO: 631776 - RNA, 24 nt, Human
uugcagugacagugcugcucugaa

SEQ ID NO: 631777 - RNA, 19 nt, Human
uugcagugagccgagaucg

SEQ ID NO: 631778 - RNA, 22 nt, Human
uugcagugagccgagaucgcgc

SEQ ID NO: 631779 - RNA, 18 nt, Human
uuggcuaacacggugaaa

SEQ ID NO: 631780 - RNA, 19 nt, Human
uuggcuaacacggugaaac

SEQ ID NO: 631781 - RNA, 22 nt, Human
uuuaaagaggagcaguaacuug

SEQ ID NO: 631782 - RNA, 20 nt, Human
uuuguucuucuuagcauauc

SEQ ID NO: 631783 - RNA, 23 nt, Human
uuuuauucuuucacagaagucug

SEQ ID NO: 631784 - RNA, 25 nt, Human
uuuuuuuuuuuuuuuuuuuuuuagg

SEQ ID NO: 631785 - RNA, 18 nt, Human
agcgccugccaggcccca

SEQ ID NO: 631786 - RNA, 20 nt, Human
gaggucagguuuaauguccc

SEQ ID NO: 631787 - RNA, 24 nt, Human
uccagcgccugccaggccccacgg

SEQ ID NO: 631788 - RNA, 18 nt, Human
uggaggaggggaggucag

SEQ ID NO: 631789 - RNA, 19 nt, Human
uuuuuuuuuuuggaggagg

SEQ ID NO: 631790 - RNA, 24 nt, Human
uuuuuuuuuuuuuuuggaggaggg

SEQ ID NO: 631791 - RNA, 18 nt, Human
uuuuuuuuuuuuuuuuug

SEQ ID NO: 631792 - RNA, 23 nt, Human
aaguaaaaacaaauuuaggagaa

SEQ ID NO: 631793 - RNA, 22 nt, Human
aaugauaggauauuugaagaga

SEQ ID NO: 631794 - RNA, 21 nt, Human
auuuucuaugacauauuuaaa

SEQ ID NO: 631795 - RNA, 21 nt, Human
ccauuuugcagaggcaucauu

SEQ ID NO: 631796 - RNA, 21 nt, Human
cuucaucaguuccaaucacaa

SEQ ID NO: 631797 - RNA, 18 nt, Human
gaagcuaauagccuaaaa

SEQ ID NO: 631798 - RNA, 20 nt, Human
ggguacuaccauuuugcaga

SEQ ID NO: 631799 - RNA, 22 nt, Human
guaagacaagacucauuacaug

SEQ ID NO: 631800 - RNA, 27 nt, Human
ucaucaguuccaaucacaacacucauc

SEQ ID NO: 631801 - RNA, 23 nt, Human
uuagauacuuauuuuacuucauc

SEQ ID NO: 631802 - RNA, 20 nt, Human
aaaagagagcugaugguugc

SEQ ID NO: 631803 - RNA, 24 nt, Human
aaagauauucacucucuggcccuc

SEQ ID NO: 631804 - RNA, 23 nt, Human
aaugucucccacucuuuuauggc

SEQ ID NO: 631805 - RNA, 18 nt, Human
acucucaaagaaaagaga

SEQ ID NO: 631806 - RNA, 20 nt, Human
acuuggcucauuuuuagugg

SEQ ID NO: 631807 - RNA, 19 nt, Human
agaacaugcaucccucucc

SEQ ID NO: 631808 - RNA, 20 nt, Human
agacaagaaaagauaaaaaa

SEQ ID NO: 631809 - RNA, 18 nt, Human
agagagcugaugguugcu

SEQ ID NO: 631810 - RNA, 20 nt, Human
aggaagaaggagaggcuggu

SEQ ID NO: 631811 - RNA, 25 nt, Human
aggauaucugguuuuuuaaaggcau

SEQ ID NO: 631812 - RNA, 21 nt, Human
auaaagagcguguacccaaaa

SEQ ID NO: 631813 - RNA, 21 nt, Human
auucacucucuggcccucuau

SEQ ID NO: 631814 - RNA, 25 nt, Human
caacauaaaaaaccaguauaguaua

SEQ ID NO: 631815 - RNA, 21 nt, Human
caagaaaagauaaaaaagcaa

SEQ ID NO: 631816 - RNA, 23 nt, Human
ccccgugacaggcccacugggac

SEQ ID NO: 631817 - RNA, 22 nt, Human
cccgugacaggcccacugggac

SEQ ID NO: 631818 - RNA, 22 nt, Human
cccuaagaaguguacagaagga

SEQ ID NO: 631819 - RNA, 20 nt, Human
cucaaagaaaagagagcuga

SEQ ID NO: 631820 - RNA, 18 nt, Human
cuugcggauccugggcgu

SEQ ID NO: 631821 - RNA, 25 nt, Human
cuuucacacuacaaagggaggguug

SEQ ID NO: 631822 - RNA, 19 nt, Human
gaacaugcaucccucuccc

SEQ ID NO: 631823 - RNA, 21 nt, Human
gcaacagaacauguccugcag

SEQ ID NO: 631824 - RNA, 23 nt, Human
gcuagagucagagaggauaucug

SEQ ID NO: 631825 - RNA, 24 nt, Human
gggagugggggacgcgagggaggc

SEQ ID NO: 631826 - RNA, 21 nt, Human
guccugcagaccuccaagugg

SEQ ID NO: 631827 - RNA, 21 nt, Human
uaaaaaagcaaaacaccaggc

SEQ ID NO: 631828 - RNA, 22 nt, Human
uaaaaaagcaaaacaccaggca

SEQ ID NO: 631829 - RNA, 18 nt, Human
uaccaacaacauaaaaaa

SEQ ID NO: 631830 - RNA, 22 nt, Human
uaccaacaacauaaaaaaccag

SEQ ID NO: 631831 - RNA, 18 nt, Human
uagaacacagccacaccc

SEQ ID NO: 631832 - RNA, 19 nt, Human
uauuagaacacagccacac

SEQ ID NO: 631833 - RNA, 18 nt, Human
uccuuggagagacagagg

SEQ ID NO: 631834 - RNA, 19 nt, Human
ucucacuacacacuuggcu

SEQ ID NO: 631835 - RNA, 23 nt, Human
uggcaacagaacauguccugcag

SEQ ID NO: 631836 - RNA, 23 nt, Human
ugggcgcgcagcuugcggauccu

SEQ ID NO: 631837 - RNA, 18 nt, Human
ugggcugguggagcucgu

SEQ ID NO: 631838 - RNA, 24 nt, Human
ugugaaaguccaaaugggugcugg

SEQ ID NO: 631839 - RNA, 21 nt, Human
uguuaccaacaacauaaaaaa

SEQ ID NO: 631840 - RNA, 26 nt, Human
uuuucuguuuuuauaaauagaguuuu

SEQ ID NO: 631841 - RNA, 18 nt, Human
uuuuuuuuuuuuuuucug

SEQ ID NO: 631842 - RNA, 26 nt, Human
uuuuuuuuuuuuuuuuuucuguuuuu

SEQ ID NO: 631843 - RNA, 25 nt, Human
aagaaaaaauacauaguaacgccaa

SEQ ID NO: 631844 - RNA, 23 nt, Human
acuaucuaaggauuuucacucca

SEQ ID NO: 631845 - RNA, 22 nt, Human
cacuccaagaagaaaaaauaca

SEQ ID NO: 631846 - RNA, 21 nt, Human
ggacgaugacuuaacagauac

SEQ ID NO: 631847 - RNA, 23 nt, Human
uaucuaaggauuuucacuccaag

SEQ ID NO: 631848 - RNA, 25 nt, Human
uccaagaagaaaaaauacauaguaa

SEQ ID NO: 631849 - RNA, 21 nt, Human
aagcaugaaggcaagaagacc

SEQ ID NO: 631850 - RNA, 24 nt, Human
agaaacacaagaccaaacaaugug

SEQ ID NO: 631851 - RNA, 26 nt, Human
agcaauaucaacauuuuauccugguu

SEQ ID NO: 631852 - RNA, 19 nt, Human
aguuuuguuuuucuguacu

SEQ ID NO: 631853 - RNA, 19 nt, Human
aucuucggccucauucuaa

SEQ ID NO: 631854 - RNA, 22 nt, Human
auuaagcaaaauaguugcacag

SEQ ID NO: 631855 - RNA, 21 nt, Human
caagagagguugagauacuga

SEQ ID NO: 631856 - RNA, 22 nt, Human
ccagucaagcugguugcucuga

SEQ ID NO: 631857 - RNA, 19 nt, Human
ccuccuaccuucgcucccc

SEQ ID NO: 631858 - RNA, 22 nt, Human
ccuccuaccuucgcuccccucg

SEQ ID NO: 631859 - RNA, 20 nt, Human
gauacugacaucuccucaug

SEQ ID NO: 631860 - RNA, 22 nt, Human
gccaagcaugaaggcaagaaga

SEQ ID NO: 631861 - RNA, 22 nt, Human
gggugcuaggauugaaagggca

SEQ ID NO: 631862 - RNA, 18 nt, Human
gguggccagugaggcaag

SEQ ID NO: 631863 - RNA, 21 nt, Human
uaaagaaacacaagaccaaac

SEQ ID NO: 631864 - RNA, 25 nt, Human
uaauauguaugcuaccaucacuaau

SEQ ID NO: 631865 - RNA, 20 nt, Human
uagaaaacaagccagaggcu

SEQ ID NO: 631866 - RNA, 23 nt, Human
ucaagccuguaaaagaaguacuu

SEQ ID NO: 631867 - RNA, 18 nt, Human
ucccucagguaccucugu

SEQ ID NO: 631868 - RNA, 18 nt, Human
uccucauguggaugaagu

SEQ ID NO: 631869 - RNA, 21 nt, Human
ucgaaaguggcugagauggaa

SEQ ID NO: 631870 - RNA, 23 nt, Human
ucucuugccuuuagcuaccuucu

SEQ ID NO: 631871 - RNA, 18 nt, Human
ugaaagggcaagagaggu

SEQ ID NO: 631872 - RNA, 20 nt, Human
ugaaagggcaagagagguug

SEQ ID NO: 631873 - RNA, 18 nt, Human
ugaaggcaagaagaccac

SEQ ID NO: 631874 - RNA, 19 nt, Human
ugaaggcaagaagaccacu

SEQ ID NO: 631875 - RNA, 24 nt, Human
ugagauuuuucaagccuguaaaag

SEQ ID NO: 631876 - RNA, 22 nt, Human
ugaggagagagggccaagcaug

SEQ ID NO: 631877 - RNA, 24 nt, Human
ugaucuucggccucauucuaauac

SEQ ID NO: 631878 - RNA, 22 nt, Human
ugcucuaaaauaccucaguagc

SEQ ID NO: 631879 - RNA, 19 nt, Human
ugggguugggaggguggcc

SEQ ID NO: 631880 - RNA, 20 nt, Human
uguaaagaaacacaagacca

SEQ ID NO: 631881 - RNA, 18 nt, Human
uguaccaacauugcccuu

SEQ ID NO: 631882 - RNA, 21 nt, Human
uuuccauguauuuucugccau

SEQ ID NO: 631883 - RNA, 22 nt, Human
uuugaggagagagggccaagca

SEQ ID NO: 631884 - RNA, 20 nt, Human
uuuggugcucucuugccuuu

SEQ ID NO: 631885 - RNA, 25 nt, Human
uuuuguuuuucuguacuaaaaauau

SEQ ID NO: 631886 - RNA, 29 nt, Human
aaaaaaccagauuaaaagacagugggcac

SEQ ID NO: 631887 - RNA, 20 nt, Human
aacauuuuaucugcucauug

SEQ ID NO: 631888 - RNA, 20 nt, Human
aagaaagaaaaaagaaaaaa

SEQ ID NO: 631889 - RNA, 20 nt, Human
aagaaagaaaaaagaaaaaa

SEQ ID NO: 631890 - RNA, 21 nt, Human
aagaaagaaaaaagaaaaaaa

SEQ ID NO: 631891 - RNA, 21 nt, Human
aagaaggaacaaguaaaacaa

SEQ ID NO: 631892 - RNA, 20 nt, Human
acaacagaaaaaaaaaaaga

SEQ ID NO: 631893 - RNA, 23 nt, Human
acaacagaaaaaaaaaaagaaaa

SEQ ID NO: 631894 - RNA, 22 nt, Human
acagaaaaaaaaaaagaaagaa

SEQ ID NO: 631895 - RNA, 26 nt, Human
acaggcagcauaacggggcucaaaac

SEQ ID NO: 631896 - RNA, 20 nt, Human
agaaaaaaaaaaagaaagaa

SEQ ID NO: 631897 - RNA, 20 nt, Human
agaaaaaaaaaaagaaagaa

SEQ ID NO: 631898 - RNA, 25 nt, Human
agaaaaaaaaaaccagauuaaaaga

SEQ ID NO: 631899 - RNA, 26 nt, Human
aggaaagauaaacagaauaaaaaugc

SEQ ID NO: 631900 - RNA, 21 nt, Human
augacaacagaaaaaaaaaaa

SEQ ID NO: 631901 - RNA, 25 nt, Human
augccuuuucaguuaaaugcuuugg

SEQ ID NO: 631902 - RNA, 25 nt, Human
caacagaaaaaaaaaaagaaagaaa

SEQ ID NO: 631903 - RNA, 20 nt, Human
caggcagcauaacggggcuc

SEQ ID NO: 631904 - RNA, 21 nt, Human
ccacccguuagugagcccccc

SEQ ID NO: 631905 - RNA, 24 nt, Human
ccagugaugaaugaaccacaggua

SEQ ID NO: 631906 - RNA, 18 nt, Human
ccuuuugggccgucccag

SEQ ID NO: 631907 - RNA, 18 nt, Human
cuccucagacacuguggc

SEQ ID NO: 631908 - RNA, 19 nt, Human
gcagaugaagcacgaggcc

SEQ ID NO: 631909 - RNA, 20 nt, Human
ggaagcccucaggucacggc

SEQ ID NO: 631910 - RNA, 20 nt, Human
ggccugggcaccgcuugugg

SEQ ID NO: 631911 - RNA, 22 nt, Human
guaaaacaacaaacaccgcaag

SEQ ID NO: 631912 - RNA, 23 nt, Human
guggcagaugaagcacgaggccu

SEQ ID NO: 631913 - RNA, 21 nt, Human
uaaaacaacaaacaccgcaag

SEQ ID NO: 631914 - RNA, 21 nt, Human
uaaaaggaaagauaaacagaa

SEQ ID NO: 631915 - RNA, 28 nt, Human
uaauaaguuauuucccuaagcuggguuc

SEQ ID NO: 631916 - RNA, 19 nt, Human
uauuccuaaggaaccagug

SEQ ID NO: 631917 - RNA, 24 nt, Human
ucagucauugaacuuaauaacauu

SEQ ID NO: 631918 - RNA, 23 nt, Human
ucccuaagcuggguuccuggucc

SEQ ID NO: 631919 - RNA, 19 nt, Human
uccucagacacuguggcau

SEQ ID NO: 631920 - RNA, 22 nt, Human
ugacaacagaaaaaaaaaaaga

SEQ ID NO: 631921 - RNA, 20 nt, Human
ugagagaagaugaaagaggg

SEQ ID NO: 631922 - RNA, 24 nt, Human
ugccuuuaacaugcugucccugau

SEQ ID NO: 631923 - RNA, 25 nt, Human
uggaacaauacagguuguacaggca

SEQ ID NO: 631924 - RNA, 25 nt, Human
uggcagaugaagcacgaggccuccu

SEQ ID NO: 631925 - RNA, 19 nt, Human
uggcaugggacccacccgu

SEQ ID NO: 631926 - RNA, 26 nt, Human
ugggacccacccguuagugagccccu

SEQ ID NO: 631927 - RNA, 20 nt, Human
uggugaugcuuuaaugacaa

SEQ ID NO: 631928 - RNA, 19 nt, Human
uuuaacaugcugucccuga

SEQ ID NO: 631929 - RNA, 21 nt, Human
uuuaucugcucauugagucug

SEQ ID NO: 631930 - RNA, 21 nt, Human
uuuugggccgucccaggccuc

SEQ ID NO: 631931 - RNA, 18 nt, Human
uuuuuuuuuuuuuuuuug

SEQ ID NO: 631932 - RNA, 19 nt, Human
uuuuuuuuuuuuuuuuugc

SEQ ID NO: 631933 - RNA, 18 nt, Human
aagccaaagcuggaggag

SEQ ID NO: 631934 - RNA, 19 nt, Human
acccugcacucugucgccu

SEQ ID NO: 631935 - RNA, 21 nt, Human
aggcugugcgcccccacgcgc

SEQ ID NO: 631936 - RNA, 25 nt, Human
caagcagacccucuccuuguugcuc

SEQ ID NO: 631937 - RNA, 24 nt, Human
cacccccacugcgccugcgccugc

SEQ ID NO: 631938 - RNA, 21 nt, Human
cacugcgccugcgccugcgcc

SEQ ID NO: 631939 - RNA, 27 nt, Human
cagcuccccuacagcccagucuugccc

SEQ ID NO: 631940 - RNA, 20 nt, Human
ccaaagccaaagcuggagga

SEQ ID NO: 631941 - RNA, 24 nt, Human
ccaaagccaaagcuggaggagagc

SEQ ID NO: 631942 - RNA, 30 nt, Human
cccacgcgcccucacccccacugcgccugg

SEQ ID NO: 631943 - RNA, 19 nt, Human
ccccacgcgcccucacccc

SEQ ID NO: 631944 - RNA, 19 nt, Human
ccccacugcgccugcgccu

SEQ ID NO: 631945 - RNA, 23 nt, Human
cccccacgcgcccucacccccac

SEQ ID NO: 631946 - RNA, 27 nt, Human
cccccacgcgcccucacccccacugcg

SEQ ID NO: 631947 - RNA, 19 nt, Human
cccccacugcgccugcgcc

SEQ ID NO: 631948 - RNA, 22 nt, Human
cccugcacucugucgccuuagu

SEQ ID NO: 631949 - RNA, 26 nt, Human
ccucgcgcgcgcagcguuucucuuuu

SEQ ID NO: 631950 - RNA, 23 nt, Human
cuacagcccagucuugcccccac

SEQ ID NO: 631951 - RNA, 19 nt, Human
cucccgggccuagcgagca

SEQ ID NO: 631952 - RNA, 18 nt, Human
cucuccuuguugcuccuu

SEQ ID NO: 631953 - RNA, 23 nt, Human
cugcgccugcgccucccgggccu

SEQ ID NO: 631954 - RNA, 25 nt, Human
gaccaagcaucuggcauuucucaag

SEQ ID NO: 631955 - RNA, 20 nt, Human
gcccagucuugcccccaccc

SEQ ID NO: 631956 - RNA, 19 nt, Human
gcuggaagacaggggccca

SEQ ID NO: 631957 - RNA, 22 nt, Human
gcuggaagacaggggcccaccu

SEQ ID NO: 631958 - RNA, 19 nt, Human
ggggcccaccucgcgcgcg

SEQ ID NO: 631959 - RNA, 18 nt, Human
gugcgcccccacgcgccc

SEQ ID NO: 631960 - RNA, 22 nt, Human
uaagaagaaacggugccucucg

SEQ ID NO: 631961 - RNA, 20 nt, Human
uacagcccagucuugccccc

SEQ ID NO: 631962 - RNA, 23 nt, Human
uauuuuguccuuuaggaagacua

SEQ ID NO: 631963 - RNA, 20 nt, Human
ucagucccuggagucuggcu

SEQ ID NO: 631964 - RNA, 19 nt, Human
ucccaaagccaaagcugga

SEQ ID NO: 631965 - RNA, 19 nt, Human
uccuuguugcuccuuuuca

SEQ ID NO: 631966 - RNA, 19 nt, Human
ugcuggaagacaggggccc

SEQ ID NO: 631967 - RNA, 23 nt, Human
uuaguuccuggggaccaagcauc

SEQ ID NO: 631968 - RNA, 22 nt, Human
uucccaaagccaaagcuggagg

SEQ ID NO: 631969 - RNA, 23 nt, Human
uuucucaagcagacccucuccuu

SEQ ID NO: 631970 - RNA, 18 nt, Human
uuuuuuuuuuuuuuccug

SEQ ID NO: 631971 - RNA, 19 nt, Human
aaaaauccauacacaaaga

SEQ ID NO: 631972 - RNA, 20 nt, Human
aaacugguccuuucacugau

SEQ ID NO: 631973 - RNA, 21 nt, Human
aaagaauaaagcaacucuccc

SEQ ID NO: 631974 - RNA, 21 nt, Human
aaagcuuugauaauuucaaau

SEQ ID NO: 631975 - RNA, 19 nt, Human
aagaagacuuaaaacugcu

SEQ ID NO: 631976 - RNA, 23 nt, Human
aagaaucgaacauauccuuccca

SEQ ID NO: 631977 - RNA, 18 nt, Human
acauguauguucuuaugg

SEQ ID NO: 631978 - RNA, 21 nt, Human
accuaugacugugucuuccuc

SEQ ID NO: 631979 - RNA, 22 nt, Human
acgcgggugacgagcggcugcg

SEQ ID NO: 631980 - RNA, 22 nt, Human
agacagaggcccggggaccucg

SEQ ID NO: 631981 - RNA, 25 nt, Human
agauacugaagacaacacuacuuac

SEQ ID NO: 631982 - RNA, 19 nt, Human
agcaaagagcagugaguca

SEQ ID NO: 631983 - RNA, 21 nt, Human
agcaaagagcagugagucagg

SEQ ID NO: 631984 - RNA, 18 nt, Human
aggcaaaaaccuguguuc

SEQ ID NO: 631985 - RNA, 22 nt, Human
aggcaacagcaaagagcaguga

SEQ ID NO: 631986 - RNA, 19 nt, Human
agggaucugcgcucgaccc

SEQ ID NO: 631987 - RNA, 18 nt, Human
auacacuuagaaaaaucc

SEQ ID NO: 631988 - RNA, 20 nt, Human
aucaagucagcacacaccuu

SEQ ID NO: 631989 - RNA, 24 nt, Human
aucugcuuaacuaucugaggacug

SEQ ID NO: 631990 - RNA, 23 nt, Human
caaagagcagugagucaggagca

SEQ ID NO: 631991 - RNA, 20 nt, Human
caccucugacuccacgggug

SEQ ID NO: 631992 - RNA, 22 nt, Human
cacuuagaaaaauccauacaca

SEQ ID NO: 631993 - RNA, 24 nt, Human
cagccggcuaccggccccgaaggc

SEQ ID NO: 631994 - RNA, 19 nt, Human
caggcaacagcaaagagca

SEQ ID NO: 631995 - RNA, 18 nt, Human
caucagauccccaguuua

SEQ ID NO: 631996 - RNA, 24 nt, Human
ccaacgccagaaacagcaucacgc

SEQ ID NO: 631997 - RNA, 19 nt, Human
ccgaaggccccguacucca

SEQ ID NO: 631998 - RNA, 20 nt, Human
ccgaaggccccguacuccaa

SEQ ID NO: 631999 - RNA, 22 nt, Human
cgacccggacgccggagaaggc

SEQ ID NO: 632000 - RNA, 22 nt, Human
cgccagaaacagcaucacgcgg

SEQ ID NO: 632001 - RNA, 24 nt, Human
cggcugcggacgccccagcugcac

SEQ ID NO: 632002 - RNA, 20 nt, Human
cugcggacgccccagcugcc

SEQ ID NO: 632003 - RNA, 21 nt, Human
gacccggacgccggagaaggc

SEQ ID NO: 632004 - RNA, 22 nt, Human
gagcagugagucaggagcagga

SEQ ID NO: 632005 - RNA, 21 nt, Human
gaucaagucagcacacaccuu

SEQ ID NO: 632006 - RNA, 21 nt, Human
gccccguacuccagccggcua

SEQ ID NO: 632007 - RNA, 19 nt, Human
gccggcuaccggccccgaa

SEQ ID NO: 632008 - RNA, 19 nt, Human
gcggccgcacacaaugcag

SEQ ID NO: 632009 - RNA, 18 nt, Human
gcucaauacugauggaag

SEQ ID NO: 632010 - RNA, 24 nt, Human
ggcaaaaaccuguguucugaacca

SEQ ID NO: 632011 - RNA, 20 nt, Human
gggaccucggagcgcggcgg

SEQ ID NO: 632012 - RNA, 23 nt, Human
guaaguuuuucuuguagugauuc

SEQ ID NO: 632013 - RNA, 23 nt, Human
gugagucaggagcaggagcaggu

SEQ ID NO: 632014 - RNA, 21 nt, Human
uaaaagccauggcugcugcaa

SEQ ID NO: 632015 - RNA, 19 nt, Human
uaaccaccaguucaacugu

SEQ ID NO: 632016 - RNA, 23 nt, Human
uaagauacugaagacaacacuac

SEQ ID NO: 632017 - RNA, 27 nt, Human
uacauuaaaacguaaaucacauuugag

SEQ ID NO: 632018 - RNA, 18 nt, Human
uagcaugaacauauuuau

SEQ ID NO: 632019 - RNA, 19 nt, Human
ucaauacugauggaaguaa

SEQ ID NO: 632020 - RNA, 24 nt, Human
ucaaugagucgcuuguggauucuc

SEQ ID NO: 632021 - RNA, 22 nt, Human
ucaucuggaaacgaucccaugc

SEQ ID NO: 632022 - RNA, 22 nt, Human
uccauacacaaagaauaaagca

SEQ ID NO: 632023 - RNA, 23 nt, Human
ucucaaagucuugguaggcauuc

SEQ ID NO: 632024 - RNA, 18 nt, Human
ucucaucuggaaacgauc

SEQ ID NO: 632025 - RNA, 19 nt, Human
ugaaaacaguugacuuaag

SEQ ID NO: 632026 - RNA, 23 nt, Human
ugaagacaacacuacuuaccauu

SEQ ID NO: 632027 - RNA, 18 nt, Human
ugacuuccaucucaacuc

SEQ ID NO: 632028 - RNA, 21 nt, Human
ugacuuccaucucaacuccug

SEQ ID NO: 632029 - RNA, 21 nt, Human
ugauggaaguaaucugcuuaa

SEQ ID NO: 632030 - RNA, 18 nt, Human
ugcccaacgccagaaaca

SEQ ID NO: 632031 - RNA, 23 nt, Human
ugccuuagaaccuucaccguaag

SEQ ID NO: 632032 - RNA, 23 nt, Human
uguagugauucucaaagucuugg

SEQ ID NO: 632033 - RNA, 22 nt, Human
uuaagcauuugcaauggugacu

SEQ ID NO: 632034 - RNA, 22 nt, Human
uucccaauaaacagggaucugc

SEQ ID NO: 632035 - RNA, 21 nt, Human
uucgaccgcccacgggcugcc

SEQ ID NO: 632036 - RNA, 26 nt, Human
uucuuaugggcaaucaugccaggggu

SEQ ID NO: 632037 - RNA, 22 nt, Human
uugaaaauuuuuuaacaacugg

SEQ ID NO: 632038 - RNA, 18 nt, Human
uuuuuuuuuuuuuuuuug

SEQ ID NO: 632039 - RNA, 20 nt, Human
uaaaaacaaaacaaaaauca

SEQ ID NO: 632040 - RNA, 23 nt, Human
uaaaaacaaaacaaaaaucacaa

SEQ ID NO: 632041 - RNA, 24 nt, Human
uaaaaacaaaacaaaaaucacaag

SEQ ID NO: 632042 - RNA, 20 nt, Human
uacuguacaccaaucaaagc

SEQ ID NO: 632043 - RNA, 19 nt, Human
uauuuuuuguauuccuuaa

SEQ ID NO: 632044 - RNA, 22 nt, Human
ugaaauacuguacaccaaucaa

SEQ ID NO: 632045 - RNA, 23 nt, Human
uuugaaauacuguacaccaauca

SEQ ID NO: 632046 - RNA, 25 nt, Human
uuuuuuuuuuuuuuuaaacguuuuu

SEQ ID NO: 632047 - RNA, 23 nt, Human
uuuuuuuuuuuuuuuuuuaaacg

SEQ ID NO: 632048 - RNA, 18 nt, Human
aaguggauacaucaaagg

SEQ ID NO: 632049 - RNA, 24 nt, Human
caacacacggugugcaucugugug

SEQ ID NO: 632050 - RNA, 22 nt, Human
ccaaaugcacacaaacccuguc

SEQ ID NO: 632051 - RNA, 21 nt, Human
ccccaaaugcacacaaacccu

SEQ ID NO: 632052 - RNA, 19 nt, Human
ugcacacaaacccugucuc

SEQ ID NO: 632053 - RNA, 22 nt, Human
uuuuuuuuuuuuuugaagugga

SEQ ID NO: 632054 - RNA, 20 nt, Human
acccgcuccgcgccgucccc

SEQ ID NO: 632055 - RNA, 18 nt, Human
agcugguggcugaccagg

SEQ ID NO: 632056 - RNA, 20 nt, Human
aguggcgggggcaggcgaga

SEQ ID NO: 632057 - RNA, 21 nt, Human
aguggcgggggcaggcgagag

SEQ ID NO: 632058 - RNA, 18 nt, Human
cacccucguugccccagc

SEQ ID NO: 632059 - RNA, 19 nt, Human
cagugggaccuccacccuc

SEQ ID NO: 632060 - RNA, 21 nt, Human
caugagcccuuccucacgacc

SEQ ID NO: 632061 - RNA, 23 nt, Human
caugguccaugacaaggggcagg

SEQ ID NO: 632062 - RNA, 20 nt, Human
ccagacgaguggcgggggca

SEQ ID NO: 632063 - RNA, 22 nt, Human
cccucguugccccagcuggugg

SEQ ID NO: 632064 - RNA, 24 nt, Human
ccgcacccgcuccgcgccgucccc

SEQ ID NO: 632065 - RNA, 22 nt, Human
ccgcacggcaucucccgcaccc

SEQ ID NO: 632066 - RNA, 19 nt, Human
ccgcccgccccgcggcugc

SEQ ID NO: 632067 - RNA, 19 nt, Human
ccgccgccgcccgccccgc

SEQ ID NO: 632068 - RNA, 18 nt, Human
ccgccgccgccgccgccg

SEQ ID NO: 632069 - RNA, 18 nt, Human
ccgccgccgccgccgccg

SEQ ID NO: 632070 - RNA, 24 nt, Human
ccgccgccgccgccgccgcccgcc

SEQ ID NO: 632071 - RNA, 24 nt, Human
ccgccgccgccgccgccgccgccc

SEQ ID NO: 632072 - RNA, 23 nt, Human
ccgcgccguccccaccuggcccg

SEQ ID NO: 632073 - RNA, 22 nt, Human
ccuccacccucguugccccagc

SEQ ID NO: 632074 - RNA, 19 nt, Human
ccucguugccccagcuggu

SEQ ID NO: 632075 - RNA, 21 nt, Human
ccuucccacagaaggcgggga

SEQ ID NO: 632076 - RNA, 19 nt, Human
cgccgccgccgccgccgcc

SEQ ID NO: 632077 - RNA, 21 nt, Human
cucccgcacccgcuccgcgcc

SEQ ID NO: 632078 - RNA, 23 nt, Human
gacgaggcgggcggcucaggugg

SEQ ID NO: 632079 - RNA, 22 nt, Human
gccgccgccgccgccgccgccg

SEQ ID NO: 632080 - RNA, 25 nt, Human
gccgccgccgccgccgccgccgccc

SEQ ID NO: 632081 - RNA, 21 nt, Human
gggacgaggcgggcggcucag

SEQ ID NO: 632082 - RNA, 18 nt, Human
gggcagggcagagggggc

SEQ ID NO: 632083 - RNA, 23 nt, Human
ucccgcacggcaucucccgcacc

SEQ ID NO: 632084 - RNA, 24 nt, Human
ucccggccgccgccgccgccgccg

SEQ ID NO: 632085 - RNA, 18 nt, Human
uuggaucaacaagcacca

SEQ ID NO: 632086 - RNA, 18 nt, Human
uuuuuuuuuuuuuuucug

SEQ ID NO: 632087 - RNA, 24 nt, Human
uuuuuuuuuuuuuuuuucugguuu

SEQ ID NO: 632088 - RNA, 19 nt, Human
aaccaggaauaaaggcaag

SEQ ID NO: 632089 - RNA, 19 nt, Human
acagcugccugggcaggca

SEQ ID NO: 632090 - RNA, 22 nt, Human
agccgaggcuucuuggccucag

SEQ ID NO: 632091 - RNA, 23 nt, Human
agccgggcaugaugaccauguuc

SEQ ID NO: 632092 - RNA, 18 nt, Human
aggaagcuccccagcucc

SEQ ID NO: 632093 - RNA, 18 nt, Human
aggacaccagccggaagu

SEQ ID NO: 632094 - RNA, 18 nt, Human
cacagucacagagccguc

SEQ ID NO: 632095 - RNA, 19 nt, Human
caccagcugcaugaugccc

SEQ ID NO: 632096 - RNA, 23 nt, Human
cagcagcaccuuggugccugggu

SEQ ID NO: 632097 - RNA, 20 nt, Human
cagccccugcgccaucuccc

SEQ ID NO: 632098 - RNA, 20 nt, Human
cagcugggggccugggggag

SEQ ID NO: 632099 - RNA, 24 nt, Human
ccaucucccgcuucagcagcccca

SEQ ID NO: 632100 - RNA, 24 nt, Human
ccaugcaccagcagcacgcucucc

SEQ ID NO: 632101 - RNA, 19 nt, Human
cccuccaucucgagcuucc

SEQ ID NO: 632102 - RNA, 18 nt, Human
ccgccgcgcucccggacc

SEQ ID NO: 632103 - RNA, 20 nt, Human
ccgcugcccgcugaggaucu

SEQ ID NO: 632104 - RNA, 18 nt, Human
ccuccagcaccugccgcc

SEQ ID NO: 632105 - RNA, 24 nt, Human
ccucuguccccagggaugggagag

SEQ ID NO: 632106 - RNA, 24 nt, Human
ccugcccuaaccaggaauaaaggc

SEQ ID NO: 632107 - RNA, 25 nt, Human
ccuggcccaccagcugguccccugg

SEQ ID NO: 632108 - RNA, 18 nt, Human
ccugggggaggcccuucu

SEQ ID NO: 632109 - RNA, 21 nt, Human
cgcgaggcccgccugcgguga

SEQ ID NO: 632110 - RNA, 23 nt, Human
cggccucagcugggggccugggg

SEQ ID NO: 632111 - RNA, 21 nt, Human
cuccagcaccugccgccccuc

SEQ ID NO: 632112 - RNA, 22 nt, Human
cuccagcaccugccgccccucc

SEQ ID NO: 632113 - RNA, 23 nt, Human
cucccggacccgcgaggcccgcc

SEQ ID NO: 632114 - RNA, 18 nt, Human
cuccgccgcgcucccgga

SEQ ID NO: 632115 - RNA, 22 nt, Human
cugaaugacauguacuccaccu

SEQ ID NO: 632116 - RNA, 19 nt, Human
cugcaucuugaccuccagc

SEQ ID NO: 632117 - RNA, 22 nt, Human
cugccuggcccaccagcugcau

SEQ ID NO: 632118 - RNA, 21 nt, Human
cugcuccuugcgugugucaug

SEQ ID NO: 632119 - RNA, 19 nt, Human
cugcugucuaggaccaccu

SEQ ID NO: 632120 - RNA, 19 nt, Human
cuugcgugugucaugcagg

SEQ ID NO: 632121 - RNA, 21 nt, Human
gcagcgucaccgucucgccau

SEQ ID NO: 632122 - RNA, 21 nt, Human
gcaggagccgaggcuucuugg

SEQ ID NO: 632123 - RNA, 21 nt, Human
gccucuguccccagggauggg

SEQ ID NO: 632124 - RNA, 22 nt, Human
gccucuguccccagggauggga

SEQ ID NO: 632125 - RNA, 21 nt, Human
gcuggggcuugugggcagcgu

SEQ ID NO: 632126 - RNA, 20 nt, Human
ggaaacugcugucuaggacc

SEQ ID NO: 632127 - RNA, 21 nt, Human
ggagagggcagagguggcggc

SEQ ID NO: 632128 - RNA, 21 nt, Human
ggcaagacagccuggagacca

SEQ ID NO: 632129 - RNA, 18 nt, Human
ggcggccuggaggaggac

SEQ ID NO: 632130 - RNA, 22 nt, Human
ggggccugggggaggcccuucu

SEQ ID NO: 632131 - RNA, 23 nt, Human
guccugguagguccaggagacca

SEQ ID NO: 632132 - RNA, 22 nt, Human
gugugucaugcaggugcacgcg

SEQ ID NO: 632133 - RNA, 20 nt, Human
ucagcugggggccuggggga

SEQ ID NO: 632134 - RNA, 19 nt, Human
ucccggacccgcgaggccc

SEQ ID NO: 632135 - RNA, 23 nt, Human
uccuucaugaucagggugccgug

SEQ ID NO: 632136 - RNA, 24 nt, Human
ucgguccuggguugucagcaaaag

SEQ ID NO: 632137 - RNA, 19 nt, Human
ucuccggcucugccuggcc

SEQ ID NO: 632138 - RNA, 23 nt, Human
ucuccggcucugccuggcccacc

SEQ ID NO: 632139 - RNA, 20 nt, Human
ugacacaaggccucuguccc

SEQ ID NO: 632140 - RNA, 19 nt, Human
ugacauguacuccaccugc

SEQ ID NO: 632141 - RNA, 20 nt, Human
ugacauguacuccaccugca

SEQ ID NO: 632142 - RNA, 19 nt, Human
ugacccggagcuccugcuc

SEQ ID NO: 632143 - RNA, 24 nt, Human
ugaccuccagcaccugccgccccu

SEQ ID NO: 632144 - RNA, 19 nt, Human
ugaggacaccagccggaag

SEQ ID NO: 632145 - RNA, 19 nt, Human
ugaggaucuuguggccgac

SEQ ID NO: 632146 - RNA, 21 nt, Human
ugagguggcuguagacgcgcc

SEQ ID NO: 632147 - RNA, 20 nt, Human
ugcaaacagcugccugggca

SEQ ID NO: 632148 - RNA, 21 nt, Human
uggaggaggacggacuccaca

SEQ ID NO: 632149 - RNA, 18 nt, Human
ugggagagggcagaggug

SEQ ID NO: 632150 - RNA, 21 nt, Human
ugggagagggcagagguggcg

SEQ ID NO: 632151 - RNA, 21 nt, Human
ugggaggugcugcacacagug

SEQ ID NO: 632152 - RNA, 23 nt, Human
uucuucagcugcaaacagcugcc

SEQ ID NO: 632153 - RNA, 21 nt, Human
uucuuggccucgccaugcacc

SEQ ID NO: 632154 - RNA, 23 nt, Human
uuggugccuggguccucagaagg

SEQ ID NO: 632155 - RNA, 28 nt, Human
uuggugccuggguccucagaaggggcgg

SEQ ID NO: 632156 - RNA, 24 nt, Human
aaaaaaaagcacuucugccaaagg

SEQ ID NO: 632157 - RNA, 25 nt, Human
aaagcacuucugccaaaggaaccag

SEQ ID NO: 632158 - RNA, 27 nt, Human
aaaugauucuccugccucaaccuccca

SEQ ID NO: 632159 - RNA, 20 nt, Human
aacuuccgccuccugaguuc

SEQ ID NO: 632160 - RNA, 18 nt, Human
aagcacaccagaacugaa

SEQ ID NO: 632161 - RNA, 20 nt, Human
aagcacaccagaacugaagc

SEQ ID NO: 632162 - RNA, 22 nt, Human
aagcacuucugccaaaggaacc

SEQ ID NO: 632163 - RNA, 24 nt, Human
aaggugcugggauuacagacguga

SEQ ID NO: 632164 - RNA, 24 nt, Human
aaguagcuggaaucacaggcaugc

SEQ ID NO: 632165 - RNA, 21 nt, Human
acaagguguucugcuuaaaca

SEQ ID NO: 632166 - RNA, 20 nt, Human
acacugaagccacuacucau

SEQ ID NO: 632167 - RNA, 18 nt, Human
acagacgugagccaccgc

SEQ ID NO: 632168 - RNA, 22 nt, Human
acagaguaagauacaccacccc

SEQ ID NO: 632169 - RNA, 21 nt, Human
acgugagccaccgcacccagc

SEQ ID NO: 632170 - RNA, 19 nt, Human
agacuggcacaaagccccg

SEQ ID NO: 632171 - RNA, 23 nt, Human
agagaaaaaugugaguucucuca

SEQ ID NO: 632172 - RNA, 20 nt, Human
agccaccgcacccagccucu

SEQ ID NO: 632173 - RNA, 20 nt, Human
aggcaugcaccaccaugccc

SEQ ID NO: 632174 - RNA, 20 nt, Human
agguaaauggccuuggcaac

SEQ ID NO: 632175 - RNA, 26 nt, Human
aggugcugggauuacagacgugagcc

SEQ ID NO: 632176 - RNA, 24 nt, Human
agugcaauggcacaaucuuggcuc

SEQ ID NO: 632177 - RNA, 20 nt, Human
augguuaagcacaccagaac

SEQ ID NO: 632178 - RNA, 20 nt, Human
caacagaagguggcgcuauu

SEQ ID NO: 632179 - RNA, 24 nt, Human
caaggugcugggauuacagacgug

SEQ ID NO: 632180 - RNA, 22 nt, Human
caccaccaugcccagcuaauuu

SEQ ID NO: 632181 - RNA, 19 nt, Human
caccaccuauucccacuac

SEQ ID NO: 632182 - RNA, 22 nt, Human
caccaguguccugggugguagg

SEQ ID NO: 632183 - RNA, 23 nt, Human
cacccagccucuuaauucuuaau

SEQ ID NO: 632184 - RNA, 21 nt, Human
caccgcaacuuccgccuccug

SEQ ID NO: 632185 - RNA, 21 nt, Human
caccgcacccagccucuuaau

SEQ ID NO: 632186 - RNA, 25 nt, Human
cagaguaagauacaccacccccauc

SEQ ID NO: 632187 - RNA, 21 nt, Human
cagccaaaguugccaacuuag

SEQ ID NO: 632188 - RNA, 23 nt, Human
cagccaccuaaggcaaggagccc

SEQ ID NO: 632189 - RNA, 22 nt, Human
ccaaggugcugggauuacagac

SEQ ID NO: 632190 - RNA, 24 nt, Human
ccaaggugcugggauuacagacgu

SEQ ID NO: 632191 - RNA, 22 nt, Human
ccaucccuuccuucccuguucc

SEQ ID NO: 632192 - RNA, 18 nt, Human
ccauuaaaucaauccaca

SEQ ID NO: 632193 - RNA, 19 nt, Human
cccaggcuggagugcaaug

SEQ ID NO: 632194 - RNA, 21 nt, Human
cccgaccucaggugaucugcc

SEQ ID NO: 632195 - RNA, 23 nt, Human
cccgaccucaggugaucugccug

SEQ ID NO: 632196 - RNA, 20 nt, Human
cccugggaggugggagggcu

SEQ ID NO: 632197 - RNA, 22 nt, Human
cccuguuccccucccaacuuuu

SEQ ID NO: 632198 - RNA, 21 nt, Human
ccgcaaacaagguguucugcu

SEQ ID NO: 632199 - RNA, 23 nt, Human
ccgcaacuuccgccuccugaguu

SEQ ID NO: 632200 - RNA, 24 nt, Human
ccgccuccugaguucaaaugauuc

SEQ ID NO: 632201 - RNA, 26 nt, Human
ccuccgaaauauaaaaccaggacaag

SEQ ID NO: 632202 - RNA, 24 nt, Human
ccuccugaguucaaaugauucucc

SEQ ID NO: 632203 - RNA, 23 nt, Human
ccucuucucucauagaugaaaau

SEQ ID NO: 632204 - RNA, 23 nt, Human
ccugccucaaccucccaaguagc

SEQ ID NO: 632205 - RNA, 18 nt, Human
ccugcugcucugugcugc

SEQ ID NO: 632206 - RNA, 21 nt, Human
ccugggugguagggaugcuac

SEQ ID NO: 632207 - RNA, 18 nt, Human
cgaccucaggugaucugc

SEQ ID NO: 632208 - RNA, 20 nt, Human
cgaccucaggugaucugccu

SEQ ID NO: 632209 - RNA, 24 nt, Human
cgaccucaggugaucugccugccu

SEQ ID NO: 632210 - RNA, 21 nt, Human
cgcucguugcccaggcuggag

SEQ ID NO: 632211 - RNA, 20 nt, Human
cguugcccaggcuggagugc

SEQ ID NO: 632212 - RNA, 26 nt, Human
cucccgaccucaggugaucugccugc

SEQ ID NO: 632213 - RNA, 24 nt, Human
cucguugcccaggcuggagugcaa

SEQ ID NO: 632214 - RNA, 20 nt, Human
cugcuaccugucgauuagca

SEQ ID NO: 632215 - RNA, 19 nt, Human
cugguuaagaacagguggg

SEQ ID NO: 632216 - RNA, 30 nt, Human
cuucccuguuccccucccaacuuuucccug

SEQ ID NO: 632217 - RNA, 23 nt, Human
gaaugcaaguagauggguggcag

SEQ ID NO: 632218 - RNA, 22 nt, Human
gaccucaggugaucugccugcc

SEQ ID NO: 632219 - RNA, 23 nt, Human
gaccucaggugaucugccugccu

SEQ ID NO: 632220 - RNA, 21 nt, Human
gagacggggguuucuccacgu

SEQ ID NO: 632221 - RNA, 18 nt, Human
gauuacagacgugagcca

SEQ ID NO: 632222 - RNA, 23 nt, Human
gauuacagacgugagccaccgca

SEQ ID NO: 632223 - RNA, 19 nt, Human
gcacaccagaacugaagcg

SEQ ID NO: 632224 - RNA, 20 nt, Human
gcaccaccaugcccagcuaa

SEQ ID NO: 632225 - RNA, 23 nt, Human
gcccagcuaauuuuuuguauuuu

SEQ ID NO: 632226 - RNA, 19 nt, Human
gcccaggcuggagugcaau

SEQ ID NO: 632227 - RNA, 19 nt, Human
gcuacagccaccuaaggca

SEQ ID NO: 632228 - RNA, 22 nt, Human
gcugcuccucacccaucuccac

SEQ ID NO: 632229 - RNA, 19 nt, Human
gcuggagugcaauggcaca

SEQ ID NO: 632230 - RNA, 23 nt, Human
gcuggucucgaacucccgaccuc

SEQ ID NO: 632231 - RNA, 23 nt, Human
ggaggugggagggcuugcauggu

SEQ ID NO: 632232 - RNA, 24 nt, Human
ggugcugggauuacagacgugagc

SEQ ID NO: 632233 - RNA, 18 nt, Human
gguuuucugguuaagaac

SEQ ID NO: 632234 - RNA, 19 nt, Human
gugacuuuuaaaacugaaa

SEQ ID NO: 632235 - RNA, 24 nt, Human
gugagccaccgcacccagccucuu

SEQ ID NO: 632236 - RNA, 24 nt, Human
guuucgcucguugcccaggcugga

SEQ ID NO: 632237 - RNA, 23 nt, Human
uaaaaccaggacaagagaaaaau

SEQ ID NO: 632238 - RNA, 25 nt, Human
uaagauacaccacccccauccaucc

SEQ ID NO: 632239 - RNA, 24 nt, Human
uaauuuuuuguauuuuuaguagag

SEQ ID NO: 632240 - RNA, 25 nt, Human
uaauuuuuuguauuuuuaguagaga

SEQ ID NO: 632241 - RNA, 24 nt, Human
uacagacgugagccaccgcaccca

SEQ ID NO: 632242 - RNA, 18 nt, Human
uacagccaccuaaggcaa

SEQ ID NO: 632243 - RNA, 22 nt, Human
uagaagaugaugaucaugcuga

SEQ ID NO: 632244 - RNA, 22 nt, Human
uagcagaggauguuuaccccuc

SEQ ID NO: 632245 - RNA, 18 nt, Human
uagggaugcuacagccac

SEQ ID NO: 632246 - RNA, 19 nt, Human
uaguagagacggggguuuc

SEQ ID NO: 632247 - RNA, 25 nt, Human
uaguagagacggggguuucuccacg

SEQ ID NO: 632248 - RNA, 18 nt, Human
uaugccuccucugacacc

SEQ ID NO: 632249 - RNA, 24 nt, Human
uauucccacuaccuucccccuuca

SEQ ID NO: 632250 - RNA, 20 nt, Human
ucaccgcaacuuccgccucc

SEQ ID NO: 632251 - RNA, 22 nt, Human
ucaccgcaacuuccgccuccug

SEQ ID NO: 632252 - RNA, 25 nt, Human
ucaccgcaacuuccgccuccugagu

SEQ ID NO: 632253 - RNA, 27 nt, Human
ucaccgcaacuuccgccuccugaguuc

SEQ ID NO: 632254 - RNA, 20 nt, Human
uccaacaccgcaaacaaggu

SEQ ID NO: 632255 - RNA, 18 nt, Human
ucccaaggugcugggauu

SEQ ID NO: 632256 - RNA, 24 nt, Human
ucccaaggugcugggauuacagac

SEQ ID NO: 632257 - RNA, 24 nt, Human
ucccaaguagcuggaaucacaggc

SEQ ID NO: 632258 - RNA, 21 nt, Human
ucccacuaccuucccccuuca

SEQ ID NO: 632259 - RNA, 23 nt, Human
ucccacuaccuucccccuucaga

SEQ ID NO: 632260 - RNA, 20 nt, Human
ucccugcaauuccugaauuc

SEQ ID NO: 632261 - RNA, 20 nt, Human
ucccugcugcucugugcugc

SEQ ID NO: 632262 - RNA, 22 nt, Human
ucccugcugcucugugcugcuc

SEQ ID NO: 632263 - RNA, 21 nt, Human
ucccuguuccccucccaacuu

SEQ ID NO: 632264 - RNA, 21 nt, Human
uccugaauucagaggcaucau

SEQ ID NO: 632265 - RNA, 21 nt, Human
uccugaguucaaaugauucuc

SEQ ID NO: 632266 - RNA, 24 nt, Human
uccugaguucaaaugauucuccug

SEQ ID NO: 632267 - RNA, 19 nt, Human
uccugggugguagggaugc

SEQ ID NO: 632268 - RNA, 19 nt, Human
ucgcucguugcccaggcug

SEQ ID NO: 632269 - RNA, 20 nt, Human
ucgcucguugcccaggcugg

SEQ ID NO: 632270 - RNA, 21 nt, Human
ucgcucguugcccaggcugga

SEQ ID NO: 632271 - RNA, 26 nt, Human
ucuccugccucaaccucccaaguagc

SEQ ID NO: 632272 - RNA, 19 nt, Human
ucugcucuugaaaucaaau

SEQ ID NO: 632273 - RNA, 21 nt, Human
ugacccaacagaagguggcgc

SEQ ID NO: 632274 - RNA, 24 nt, Human
ugaguucaaaugauucuccugccu

SEQ ID NO: 632275 - RNA, 18 nt, Human
ugaguucucucaccaccu

SEQ ID NO: 632276 - RNA, 23 nt, Human
ugaguucucucaccaccuauucc

SEQ ID NO: 632277 - RNA, 18 nt, Human
ugcccaggcuggagugca

SEQ ID NO: 632278 - RNA, 21 nt, Human
ugcccaggcuggagugcaaug

SEQ ID NO: 632279 - RNA, 24 nt, Human
ugcccaggcuggagugcaauggca

SEQ ID NO: 632280 - RNA, 24 nt, Human
ugccucaaccucccaaguagcugg

SEQ ID NO: 632281 - RNA, 21 nt, Human
ugccugggccucccaaggugc

SEQ ID NO: 632282 - RNA, 24 nt, Human
ugcugggauuacagacgugagcca

SEQ ID NO: 632283 - RNA, 21 nt, Human
uggaaucacaggcaugcacca

SEQ ID NO: 632284 - RNA, 24 nt, Human
uggaaucacaggcaugcaccacca

SEQ ID NO: 632285 - RNA, 23 nt, Human
uggagugcaauggcacaaucuug

SEQ ID NO: 632286 - RNA, 24 nt, Human
uggagugcaauggcacaaucuugg

SEQ ID NO: 632287 - RNA, 24 nt, Human
uggcacaaucuuggcucaccgcaa

SEQ ID NO: 632288 - RNA, 21 nt, Human
ugggaggugggagggcuugca

SEQ ID NO: 632289 - RNA, 18 nt, Human
ugggauuacagacgugag

SEQ ID NO: 632290 - RNA, 19 nt, Human
ugggauuacagacgugagc

SEQ ID NO: 632291 - RNA, 21 nt, Human
ugggauuacagacgugagcca

SEQ ID NO: 632292 - RNA, 22 nt, Human
ugggauuacagacgugagccac

SEQ ID NO: 632293 - RNA, 23 nt, Human
ugggauuacagacgugagccacc

SEQ ID NO: 632294 - RNA, 24 nt, Human
ugggauuacagacgugagccaccg

SEQ ID NO: 632295 - RNA, 21 nt, Human
uggucacgcuggucucgaacu

SEQ ID NO: 632296 - RNA, 19 nt, Human
uggucucgaacucccgacc

SEQ ID NO: 632297 - RNA, 21 nt, Human
uguauuuuuaguagagacggg

SEQ ID NO: 632298 - RNA, 24 nt, Human
uguguacgcaaggacacugaagcc

SEQ ID NO: 632299 - RNA, 19 nt, Human
uuaguagagacggggguuu

SEQ ID NO: 632300 - RNA, 24 nt, Human
uucaaaugauucuccugccucaac

SEQ ID NO: 632301 - RNA, 20 nt, Human
uucaagaagucuaauaggaa

SEQ ID NO: 632302 - RNA, 18 nt, Human
uucacaccaguguccugg

SEQ ID NO: 632303 - RNA, 25 nt, Human
uuccaacaccgcaaacaagguguuc

SEQ ID NO: 632304 - RNA, 20 nt, Human
uucccuguuccccucccaac

SEQ ID NO: 632305 - RNA, 18 nt, Human
uuccugaauucagaggca

SEQ ID NO: 632306 - RNA, 24 nt, Human
uucgcucguugcccaggcuggagu

SEQ ID NO: 632307 - RNA, 18 nt, Human
uugcccaggcuggagugc

SEQ ID NO: 632308 - RNA, 24 nt, Human
uuguauuuuuaguagagacggggg

SEQ ID NO: 632309 - RNA, 21 nt, Human
uuucgcucguugcccaggcug

SEQ ID NO: 632310 - RNA, 22 nt, Human
uuucgcucguugcccaggcugg

SEQ ID NO: 632311 - RNA, 23 nt, Human
uuucgcucguugcccaggcugga

SEQ ID NO: 632312 - RNA, 20 nt, Human
uuuuuaguagagacgggggu

SEQ ID NO: 632313 - RNA, 21 nt, Human
uuuuuguauuuuuaguagaga

SEQ ID NO: 632314 - RNA, 24 nt, Human
uuuuuuguauuuuuaguagagacg

SEQ ID NO: 632315 - RNA, 22 nt, Human
aaaaagacccucuucuaaugcu

SEQ ID NO: 632316 - RNA, 20 nt, Human
aaaaggggcagggguggggc

SEQ ID NO: 632317 - RNA, 19 nt, Human
aacaucaauccaagcccug

SEQ ID NO: 632318 - RNA, 20 nt, Human
aaccuggaaggaaaaggggc

SEQ ID NO: 632319 - RNA, 25 nt, Human
acagaaccuggaaggaaaaggggca

SEQ ID NO: 632320 - RNA, 18 nt, Human
accccaccugcuccgcca

SEQ ID NO: 632321 - RNA, 21 nt, Human
accccaccugcuccgccaguc

SEQ ID NO: 632322 - RNA, 25 nt, Human
accccaccugcuccgccaguccagc

SEQ ID NO: 632323 - RNA, 20 nt, Human
accugagcugcccguguccc

SEQ ID NO: 632324 - RNA, 20 nt, Human
accuggcuggcuuuucucau

SEQ ID NO: 632325 - RNA, 21 nt, Human
agccacgcacucaugauugcu

SEQ ID NO: 632326 - RNA, 20 nt, Human
agcuuggcuugcaacaccau

SEQ ID NO: 632327 - RNA, 21 nt, Human
aggaaaaggggcagggguggg

SEQ ID NO: 632328 - RNA, 20 nt, Human
aggaacaggcaggggccagc

SEQ ID NO: 632329 - RNA, 18 nt, Human
aggcaggggccagcuugg

SEQ ID NO: 632330 - RNA, 20 nt, Human
aguaacagaaccuggaagga

SEQ ID NO: 632331 - RNA, 21 nt, Human
aguggguggcacagucggcuc

SEQ ID NO: 632332 - RNA, 23 nt, Human
aucuaccaacaggcugaccugag

SEQ ID NO: 632333 - RNA, 23 nt, Human
augaaacaagccuguggggcccu

SEQ ID NO: 632334 - RNA, 19 nt, Human
cacgugcggccaacaagag

SEQ ID NO: 632335 - RNA, 21 nt, Human
cagacgccgaccggaacgcuc

SEQ ID NO: 632336 - RNA, 21 nt, Human
caggagacacuucagagaggu

SEQ ID NO: 632337 - RNA, 21 nt, Human
cagucggcucuucaguggcuc

SEQ ID NO: 632338 - RNA, 23 nt, Human
ccaccagaaacacuucugugagu

SEQ ID NO: 632339 - RNA, 20 nt, Human
ccacgcacucaugauugccg

SEQ ID NO: 632340 - RNA, 24 nt, Human
ccacggcugaccuggccccagagc

SEQ ID NO: 632341 - RNA, 22 nt, Human
ccagccccugcgcccggccggg

SEQ ID NO: 632342 - RNA, 24 nt, Human
ccagugcagcuuggaagggacuga

SEQ ID NO: 632343 - RNA, 21 nt, Human
ccccagagcuacaggaacagg

SEQ ID NO: 632344 - RNA, 20 nt, Human
ccccaggcuuccucuccagc

SEQ ID NO: 632345 - RNA, 18 nt, Human
cccgcagagcccaccaga

SEQ ID NO: 632346 - RNA, 18 nt, Human
cccgcagagcccaccagg

SEQ ID NO: 632347 - RNA, 28 nt, Human
cccugcgcccggccggguccgcuccucc

SEQ ID NO: 632348 - RNA, 19 nt, Human
ccuugguggcaccgcacag

SEQ ID NO: 632349 - RNA, 20 nt, Human
cgaccggaacgcuccggcgg

SEQ ID NO: 632350 - RNA, 20 nt, Human
cgcaaguggguggcacaguc

SEQ ID NO: 632351 - RNA, 20 nt, Human
cgccgcgggccccgcgcagc

SEQ ID NO: 632352 - RNA, 20 nt, Human
cucccagaucaaaaagaccc

SEQ ID NO: 632353 - RNA, 21 nt, Human
cuccggcggccgcggacccca

SEQ ID NO: 632354 - RNA, 19 nt, Human
cugaggcuugguccuuccc

SEQ ID NO: 632355 - RNA, 22 nt, Human
cugcaaaugcccuggcacugcc

SEQ ID NO: 632356 - RNA, 19 nt, Human
cugccgaggccgagaugcc

SEQ ID NO: 632357 - RNA, 20 nt, Human
cuucaggcucuaccuggcug

SEQ ID NO: 632358 - RNA, 29 nt, Human
cuucuaaugcugucccagcaucuaccaau

SEQ ID NO: 632359 - RNA, 18 nt, Human
gagcacaguucugguagg

SEQ ID NO: 632360 - RNA, 23 nt, Human
gauugcuuuuuagcagaagucau

SEQ ID NO: 632361 - RNA, 19 nt, Human
gcacagcugccagcagagc

SEQ ID NO: 632362 - RNA, 22 nt, Human
gccccgcagcccuggggugcug

SEQ ID NO: 632363 - RNA, 23 nt, Human
ggaaggaaaaggggcaggggugg

SEQ ID NO: 632364 - RNA, 21 nt, Human
ggcagggguggggccuuggug

SEQ ID NO: 632365 - RNA, 24 nt, Human
gguagguggggccacggcugaccu

SEQ ID NO: 632366 - RNA, 21 nt, Human
uacacaauucccaaugaccag

SEQ ID NO: 632367 - RNA, 23 nt, Human
ucaguccaagccgcgcccccgcc

SEQ ID NO: 632368 - RNA, 22 nt, Human
ucccagcuucugcaaaugcccu

SEQ ID NO: 632369 - RNA, 18 nt, Human
ucgcugaggcccuggguu

SEQ ID NO: 632370 - RNA, 22 nt, Human
ucucccgcagagcccaccagaa

SEQ ID NO: 632371 - RNA, 27 nt, Human
ucucuggaagaaccagagcugcacccu

SEQ ID NO: 632372 - RNA, 18 nt, Human
ucugguagguggggccac

SEQ ID NO: 632373 - RNA, 23 nt, Human
ugcaaaugcccuggcacugcccu

SEQ ID NO: 632374 - RNA, 24 nt, Human
ugcaaaugcccuggcacugcccuc

SEQ ID NO: 632375 - RNA, 24 nt, Human
ugcaacaccaugaaacaagccugu

SEQ ID NO: 632376 - RNA, 26 nt, Human
ugcccagacgccgaccggaacgcucc

SEQ ID NO: 632377 - RNA, 22 nt, Human
ugccccaggcuuccucuccagc

SEQ ID NO: 632378 - RNA, 23 nt, Human
ugccgaggccgagaugcccagac

SEQ ID NO: 632379 - RNA, 23 nt, Human
ugcggccaacaagagccccgcag

SEQ ID NO: 632380 - RNA, 19 nt, Human
uggagggaagggggcaguc

SEQ ID NO: 632381 - RNA, 20 nt, Human
uggagugccgcuggagggaa

SEQ ID NO: 632382 - RNA, 19 nt, Human
ugguagguggggccacggc

SEQ ID NO: 632383 - RNA, 21 nt, Human
ugguagguggggccacggcug

SEQ ID NO: 632384 - RNA, 22 nt, Human
uguuccucuuuccaacaugggg

SEQ ID NO: 632385 - RNA, 27 nt, Human
uuccucuuuccaacaugggggggacuu

SEQ ID NO: 632386 - RNA, 25 nt, Human
uuucugccgaggccgagaugcccag

SEQ ID NO: 632387 - RNA, 18 nt, Human
uuuuuuuuuuuuaaggcc

SEQ ID NO: 632388 - RNA, 23 nt, Human
uuuuuuuuuuuuuuuuuuuaagg

SEQ ID NO: 632389 - RNA, 23 nt, Human
aaaaugccuuuccaaguagccuc

SEQ ID NO: 632390 - RNA, 22 nt, Human
aaagcucucuccuaacacccuu

SEQ ID NO: 632391 - RNA, 20 nt, Human
aacauacccaaggagacccu

SEQ ID NO: 632392 - RNA, 24 nt, Human
aaccaauuaaagaagggcaucugu

SEQ ID NO: 632393 - RNA, 20 nt, Human
aagaacauacccaaggagac

SEQ ID NO: 632394 - RNA, 23 nt, Human
acaguacaggggccaagaccaaa

SEQ ID NO: 632395 - RNA, 22 nt, Human
acauucagaggcuagaaagcca

SEQ ID NO: 632396 - RNA, 20 nt, Human
acuccgcggcucugcucucc

SEQ ID NO: 632397 - RNA, 19 nt, Human
acugaaggcaaaggcaaca

SEQ ID NO: 632398 - RNA, 22 nt, Human
acugaaggcaaaggcaacacaa

SEQ ID NO: 632399 - RNA, 21 nt, Human
agagguaaaacaguacagggg

SEQ ID NO: 632400 - RNA, 23 nt, Human
agcagcccuuggcagaaaccagg

SEQ ID NO: 632401 - RNA, 18 nt, Human
aggcuagaaagccacugu

SEQ ID NO: 632402 - RNA, 25 nt, Human
agggaaaaaaaaaugccagaauuua

SEQ ID NO: 632403 - RNA, 21 nt, Human
agggguggggcugaagcgcag

SEQ ID NO: 632404 - RNA, 23 nt, Human
caaagcucucuccuaacacccua

SEQ ID NO: 632405 - RNA, 18 nt, Human
caagaacauacccaagga

SEQ ID NO: 632406 - RNA, 22 nt, Human
caagaacauacccaaggagacc

SEQ ID NO: 632407 - RNA, 20 nt, Human
cagaauaguaagaagcagca

SEQ ID NO: 632408 - RNA, 27 nt, Human
cagaauaguaagaagcagccgguaccc

SEQ ID NO: 632409 - RNA, 28 nt, Human
cagagcucuccugggaaaaugccuuucc

SEQ ID NO: 632410 - RNA, 20 nt, Human
caggcgacgcgcuuuaagcc

SEQ ID NO: 632411 - RNA, 24 nt, Human
cauccugcccugcugcaggcuuca

SEQ ID NO: 632412 - RNA, 21 nt, Human
caucuguuccuccucauccua

SEQ ID NO: 632413 - RNA, 25 nt, Human
cauucagaggcuagaaagccacugu

SEQ ID NO: 632414 - RNA, 21 nt, Human
cccgcgccgcagacuccgcgg

SEQ ID NO: 632415 - RNA, 22 nt, Human
ccgggguggaggaagcgccgga

SEQ ID NO: 632416 - RNA, 20 nt, Human
ccucaggcccggcaggcagc

SEQ ID NO: 632417 - RNA, 22 nt, Human
ccucugggcccagggugccguc

SEQ ID NO: 632418 - RNA, 19 nt, Human
ccugugguguagggguggg

SEQ ID NO: 632419 - RNA, 21 nt, Human
ccugugguguagggguggggc

SEQ ID NO: 632420 - RNA, 18 nt, Human
cgcagccaccugacagag

SEQ ID NO: 632421 - RNA, 23 nt, Human
cgcuugggcccagcccuggaggc

SEQ ID NO: 632422 - RNA, 23 nt, Human
cuccucaggcccggcaggcagcu

SEQ ID NO: 632423 - RNA, 23 nt, Human
cuccucauccuaccaucaccuca

SEQ ID NO: 632424 - RNA, 21 nt, Human
cuugggcccagcccuggaggc

SEQ ID NO: 632425 - RNA, 23 nt, Human
gaaagccacugucccguucucca

SEQ ID NO: 632426 - RNA, 19 nt, Human
gacgcgcuuuaagccgcgg

SEQ ID NO: 632427 - RNA, 27 nt, Human
gacucuguagaaggggagauuucgcuu

SEQ ID NO: 632428 - RNA, 24 nt, Human
gcaaagcucucuccuaacacccua

SEQ ID NO: 632429 - RNA, 25 nt, Human
gcaaagcucucuccuaacacccuag

SEQ ID NO: 632430 - RNA, 18 nt, Human
gcagccgccgggguucgg

SEQ ID NO: 632431 - RNA, 22 nt, Human
gcagcuuacagcuucucuggcu

SEQ ID NO: 632432 - RNA, 19 nt, Human
gcugaagcgcagccaccug

SEQ ID NO: 632433 - RNA, 24 nt, Human
ggauccugcuaguccaggggcugc

SEQ ID NO: 632434 - RNA, 22 nt, Human
ggcccggcaggcagcuuacagc

SEQ ID NO: 632435 - RNA, 22 nt, Human
gggcccagggugccgucgacgg

SEQ ID NO: 632436 - RNA, 20 nt, Human
uaaaguacagcacuuuaauu

SEQ ID NO: 632437 - RNA, 21 nt, Human
uccaaguagccucucagagua

SEQ ID NO: 632438 - RNA, 24 nt, Human
uccagagccucugagaaguuaacu

SEQ ID NO: 632439 - RNA, 25 nt, Human
uccugcccauccugcccugcugcag

SEQ ID NO: 632440 - RNA, 19 nt, Human
ucugaaggcugaaaucagg

SEQ ID NO: 632441 - RNA, 18 nt, Human
ugaagaaggcuagggggu

SEQ ID NO: 632442 - RNA, 23 nt, Human
ugccagaauuuagagguaaaaca

SEQ ID NO: 632443 - RNA, 21 nt, Human
ugcccugcugcaggcuucagc

SEQ ID NO: 632444 - RNA, 23 nt, Human
uggaggaagcgccggagggacuc

SEQ ID NO: 632445 - RNA, 19 nt, Human
uggaggccuugaagaaggc

SEQ ID NO: 632446 - RNA, 19 nt, Human
uggaggccuugaagaaggc

SEQ ID NO: 632447 - RNA, 20 nt, Human
ugguuggagcuccucaggcc

SEQ ID NO: 632448 - RNA, 18 nt, Human
uuagguuuuccaaacagc

SEQ ID NO: 632449 - RNA, 19 nt, Human
uuagguuuuccaaacagcu

SEQ ID NO: 632450 - RNA, 23 nt, Human
uugcagggaaaaaaaaaugccag

SEQ ID NO: 632451 - RNA, 23 nt, Human
uuuccagguaggacuucaucucc

SEQ ID NO: 632452 - RNA, 25 nt, Human
uuuuuuagguuuuccaaacagcuuu

SEQ ID NO: 632453 - RNA, 22 nt, Human
aaacguccguuuauuucaaagc

SEQ ID NO: 632454 - RNA, 22 nt, Human
agacagaggacggggaggcugg

SEQ ID NO: 632455 - RNA, 22 nt, Human
agccgcugggccccgucuuccg

SEQ ID NO: 632456 - RNA, 18 nt, Human
cagaggggaccauguggc

SEQ ID NO: 632457 - RNA, 21 nt, Human
cagcgcugggggagccgcugg

SEQ ID NO: 632458 - RNA, 21 nt, Human
cagcgcugggggagccgcugg

SEQ ID NO: 632459 - RNA, 18 nt, Human
cccccgcgcggcacccgc

SEQ ID NO: 632460 - RNA, 23 nt, Human
ccccgcgcggcacccgccgccgg

SEQ ID NO: 632461 - RNA, 25 nt, Human
cccgcgcggcacccgccgccggcca

SEQ ID NO: 632462 - RNA, 19 nt, Human
cccgugcuucagcgcuggg

SEQ ID NO: 632463 - RNA, 20 nt, Human
cccgugcuucagcgcugggg

SEQ ID NO: 632464 - RNA, 24 nt, Human
ccgagggggaggcugggggcccac

SEQ ID NO: 632465 - RNA, 23 nt, Human
ccgccccccgcgcggcacccgcc

SEQ ID NO: 632466 - RNA, 20 nt, Human
ccgcccgccccccgcgcggc

SEQ ID NO: 632467 - RNA, 18 nt, Human
ccgccggggcacccaguc

SEQ ID NO: 632468 - RNA, 24 nt, Human
ccgggucguggaggcggccgaggg

SEQ ID NO: 632469 - RNA, 19 nt, Human
cgccccccgcgcggcaccc

SEQ ID NO: 632470 - RNA, 22 nt, Human
cgccggggcacccagucugugg

SEQ ID NO: 632471 - RNA, 24 nt, Human
cugaaccccgugcuucagcgcugg

SEQ ID NO: 632472 - RNA, 19 nt, Human
cuuccgccacaaaccaugc

SEQ ID NO: 632473 - RNA, 22 nt, Human
gacagaggacggggaggcuggg

SEQ ID NO: 632474 - RNA, 27 nt, Human
gagguuagacagaggacggggaggcuc

SEQ ID NO: 632475 - RNA, 19 nt, Human
gcccacguggcccguccug

SEQ ID NO: 632476 - RNA, 18 nt, Human
gcugaaccccgugcuuca

SEQ ID NO: 632477 - RNA, 22 nt, Human
gcugaaccccgugcuucagcgc

SEQ ID NO: 632478 - RNA, 20 nt, Human
gcugaaccccgugcuucagg

SEQ ID NO: 632479 - RNA, 22 nt, Human
gcugggccccgucuuccgccaa

SEQ ID NO: 632480 - RNA, 23 nt, Human
ggccgagggggaggcugggggcc

SEQ ID NO: 632481 - RNA, 19 nt, Human
ggccgccacgugagcucaa

SEQ ID NO: 632482 - RNA, 18 nt, Human
ggccggugggccgggccc

SEQ ID NO: 632483 - RNA, 19 nt, Human
gucccgagccccccuacuc

SEQ ID NO: 632484 - RNA, 23 nt, Human
uaugucagaguugaugaggaggu

SEQ ID NO: 632485 - RNA, 23 nt, Human
ucugugggugccguguggcgcug

SEQ ID NO: 632486 - RNA, 21 nt, Human
uggaggcggccgagggggagg

SEQ ID NO: 632487 - RNA, 19 nt, Human
ugucagaguugaugaggag

SEQ ID NO: 632488 - RNA, 20 nt, Human
uucaagauacacauauuuuu

SEQ ID NO: 632489 - RNA, 19 nt, Human
uuuuuuuuuuuuucuuugu

SEQ ID NO: 632490 - RNA, 26 nt, Human
uuuuuuuuuuuuuuuuuucuuugggg

SEQ ID NO: 632491 - RNA, 19 nt, Human
accagccuguguggccuca

SEQ ID NO: 632492 - RNA, 21 nt, Human
accagccuguguggccucagu

SEQ ID NO: 632493 - RNA, 24 nt, Human
acucaggcuugugggggcugggua

SEQ ID NO: 632494 - RNA, 20 nt, Human
acugcacucaggcuuguggg

SEQ ID NO: 632495 - RNA, 20 nt, Human
aggagggguccagagagcug

SEQ ID NO: 632496 - RNA, 22 nt, Human
agggaggggacagggugaggcc

SEQ ID NO: 632497 - RNA, 22 nt, Human
agggcauucggggcccaccagc

SEQ ID NO: 632498 - RNA, 19 nt, Human
aggugguagugagaaaaag

SEQ ID NO: 632499 - RNA, 26 nt, Human
cacccggggucuccugcgcgagcgcu

SEQ ID NO: 632500 - RNA, 21 nt, Human
cacccggguggcaguagaagc

SEQ ID NO: 632501 - RNA, 18 nt, Human
ccacugcacucaggcuug

SEQ ID NO: 632502 - RNA, 22 nt, Human
ccacugcacucaggcuuguggg

SEQ ID NO: 632503 - RNA, 22 nt, Human
ccacugcacucaggcuuguggg

SEQ ID NO: 632504 - RNA, 24 nt, Human
ccacugcacucaggcuuguggggg

SEQ ID NO: 632505 - RNA, 25 nt, Human
ccacugcacucaggcuugugggggc

SEQ ID NO: 632506 - RNA, 20 nt, Human
ccagagagcugaggucugcc

SEQ ID NO: 632507 - RNA, 22 nt, Human
ccggguggcaguagaagccucc

SEQ ID NO: 632508 - RNA, 18 nt, Human
cugccacugcacucaggc

SEQ ID NO: 632509 - RNA, 21 nt, Human
cugcgcgagcgcuuccgggcc

SEQ ID NO: 632510 - RNA, 22 nt, Human
gagaaggagcacccggguggca

SEQ ID NO: 632511 - RNA, 18 nt, Human
ggcagcagcugcccuggg

SEQ ID NO: 632512 - RNA, 21 nt, Human
ggggcccaccagccugugugg

SEQ ID NO: 632513 - RNA, 23 nt, Human
ggggguucugcagggaggggaca

SEQ ID NO: 632514 - RNA, 20 nt, Human
uaacaccacccugcaggugg

SEQ ID NO: 632515 - RNA, 21 nt, Human
uaacaccacccugcagguggu

SEQ ID NO: 632516 - RNA, 22 nt, Human
ucagucucagggagaaggagca

SEQ ID NO: 632517 - RNA, 19 nt, Human
ugguagugagaaaaagagg

SEQ ID NO: 632518 - RNA, 23 nt, Human
uucggggcccaccagccugugug

SEQ ID NO: 632519 - RNA, 20 nt, Human
uucugcagggaggggacagg

SEQ ID NO: 632520 - RNA, 21 nt, Human
aaaggcucucuauagccauaa

SEQ ID NO: 632521 - RNA, 22 nt, Human
aaccaccaaaauuaccaucucg

SEQ ID NO: 632522 - RNA, 21 nt, Human
aaccagagcaaugugaggcag

SEQ ID NO: 632523 - RNA, 24 nt, Human
acauggcacauucccugcaggucu

SEQ ID NO: 632524 - RNA, 19 nt, Human
accagcgccagcgacccac

SEQ ID NO: 632525 - RNA, 21 nt, Human
accagcgccagcgacccaccg

SEQ ID NO: 632526 - RNA, 21 nt, Human
acccccgcucugugccggagg

SEQ ID NO: 632527 - RNA, 27 nt, Human
agaaagacauggcacauucccugcagg

SEQ ID NO: 632528 - RNA, 21 nt, Human
agagaaccaccaaaauuacca

SEQ ID NO: 632529 - RNA, 22 nt, Human
agcagaacccaggcugggcccu

SEQ ID NO: 632530 - RNA, 18 nt, Human
aggcggcgugggccgagg

SEQ ID NO: 632531 - RNA, 21 nt, Human
agucagaaaagggaaggaauu

SEQ ID NO: 632532 - RNA, 25 nt, Human
auaacacugaagaaagacauggcac

SEQ ID NO: 632533 - RNA, 21 nt, Human
auagccauaacacugaagaaa

SEQ ID NO: 632534 - RNA, 20 nt, Human
augaagggaagccuuccaca

SEQ ID NO: 632535 - RNA, 20 nt, Human
caaaauuaccaucucggagc

SEQ ID NO: 632536 - RNA, 22 nt, Human
cagcuuccagcagaacccaggc

SEQ ID NO: 632537 - RNA, 21 nt, Human
ccaccagcgccagcgacccac

SEQ ID NO: 632538 - RNA, 20 nt, Human
cccggggcgggaacccaggc

SEQ ID NO: 632539 - RNA, 18 nt, Human
ccuucuggccaaaacugg

SEQ ID NO: 632540 - RNA, 18 nt, Human
cgagguagagaaccacca

SEQ ID NO: 632541 - RNA, 27 nt, Human
cggggcgggaacccaggcacggcugcc

SEQ ID NO: 632542 - RNA, 19 nt, Human
cugaugcgcagcggggcga

SEQ ID NO: 632543 - RNA, 19 nt, Human
cugccucgccuuaguaugc

SEQ ID NO: 632544 - RNA, 19 nt, Human
gaagucccgccuuaccgua

SEQ ID NO: 632545 - RNA, 19 nt, Human
gacccggggcgggaaccca

SEQ ID NO: 632546 - RNA, 22 nt, Human
gacccggggcgggaacccaggc

SEQ ID NO: 632547 - RNA, 19 nt, Human
gcagaacccaggcugggcc

SEQ ID NO: 632548 - RNA, 19 nt, Human
ggaacuaaugggagucuga

SEQ ID NO: 632549 - RNA, 21 nt, Human
ggaagccuuccacaucagcuu

SEQ ID NO: 632550 - RNA, 22 nt, Human
ggaauuuccuccaaggguuggg

SEQ ID NO: 632551 - RNA, 18 nt, Human
ggagcuccugcaagacac

SEQ ID NO: 632552 - RNA, 18 nt, Human
ggcaaaggccuccagcag

SEQ ID NO: 632553 - RNA, 24 nt, Human
ggcugggcccuucuggccaaaacu

SEQ ID NO: 632554 - RNA, 25 nt, Human
gggaacccaggcacggcugccacca

SEQ ID NO: 632555 - RNA, 30 nt, Human
gguggugacuuggaggcuggaaaaacuacc

SEQ ID NO: 632556 - RNA, 20 nt, Human
gugccggaggcagcguuucu

SEQ ID NO: 632557 - RNA, 19 nt, Human
uaacuuuaggcagacggcu

SEQ ID NO: 632558 - RNA, 19 nt, Human
uacuagguggugacuugga

SEQ ID NO: 632559 - RNA, 23 nt, Human
uacuagguggugacuuggaggcu

SEQ ID NO: 632560 - RNA, 22 nt, Human
uagccauaacacugaagaaaga

SEQ ID NO: 632561 - RNA, 21 nt, Human
ucagcuuccagcagaacccag

SEQ ID NO: 632562 - RNA, 24 nt, Human
ucaggcggcgugggccgagguaga

SEQ ID NO: 632563 - RNA, 18 nt, Human
ucagucagaaaagggaag

SEQ ID NO: 632564 - RNA, 26 nt, Human
uccacaucagcuuccagcagaaccca

SEQ ID NO: 632565 - RNA, 20 nt, Human
ugccaccagcgccagcgacc

SEQ ID NO: 632566 - RNA, 18 nt, Human
ugccuggaacuaauggga

SEQ ID NO: 632567 - RNA, 23 nt, Human
ugugaaaacaagaauuuccauga

SEQ ID NO: 632568 - RNA, 19 nt, Human
ugugagcggagcggggccg

SEQ ID NO: 632569 - RNA, 19 nt, Human
uuuaacucuggcaaaggcc

SEQ ID NO: 632570 - RNA, 19 nt, Human
aaaaggcuauuuacaagag

SEQ ID NO: 632571 - RNA, 19 nt, Human
aaagaugaguccguaagaa

SEQ ID NO: 632572 - RNA, 20 nt, Human
aacauucugcccuaaccagg

SEQ ID NO: 632573 - RNA, 20 nt, Human
acagaauaaagagcguggcu

SEQ ID NO: 632574 - RNA, 21 nt, Human
agacuguacacagcagcauca

SEQ ID NO: 632575 - RNA, 20 nt, Human
auucugccuccuccuucucc

SEQ ID NO: 632576 - RNA, 22 nt, Human
caaugcagacauucugccuccu

SEQ ID NO: 632577 - RNA, 22 nt, Human
cacagcagcaucaaaaaggcua

SEQ ID NO: 632578 - RNA, 19 nt, Human
caccagccaauggcaaagc

SEQ ID NO: 632579 - RNA, 19 nt, Human
cagcagcaucaaaaaggcu

SEQ ID NO: 632580 - RNA, 25 nt, Human
caucuggaaaacaguguaaccugaa

SEQ ID NO: 632581 - RNA, 19 nt, Human
cauucugccuccuccuucu

SEQ ID NO: 632582 - RNA, 21 nt, Human
ccagccaauggcaaagcuucu

SEQ ID NO: 632583 - RNA, 18 nt, Human
cccaaaaucuucugaagu

SEQ ID NO: 632584 - RNA, 24 nt, Human
ccgcaaauaagauucccacuuccc

SEQ ID NO: 632585 - RNA, 18 nt, Human
ccuccuccuucuccacca

SEQ ID NO: 632586 - RNA, 19 nt, Human
ccuuuuaaaacucuagcca

SEQ ID NO: 632587 - RNA, 18 nt, Human
cuagugacacugcuuuau

SEQ ID NO: 632588 - RNA, 21 nt, Human
cuguacacagcagcaucaaaa

SEQ ID NO: 632589 - RNA, 23 nt, Human
gagcaguuuaccaaggaacaggg

SEQ ID NO: 632590 - RNA, 23 nt, Human
gcaucaaaaaggcuauuuacaag

SEQ ID NO: 632591 - RNA, 19 nt, Human
gccuccuccuucuccacca

SEQ ID NO: 632592 - RNA, 22 nt, Human
uaacaaugcagacauucugccu

SEQ ID NO: 632593 - RNA, 18 nt, Human
uaggaaaaacuagugaca

SEQ ID NO: 632594 - RNA, 23 nt, Human
ucaacagaauccacuugaaagca

SEQ ID NO: 632595 - RNA, 23 nt, Human
ucagaggcccuguaccagcugcc

SEQ ID NO: 632596 - RNA, 21 nt, Human
ucugaaguuugagcuguaugg

SEQ ID NO: 632597 - RNA, 24 nt, Human
ugaaauaaacgcuaaagaugaguc

SEQ ID NO: 632598 - RNA, 22 nt, Human
ugaaguuugagcuguauggugu

SEQ ID NO: 632599 - RNA, 18 nt, Human
ugccaaggcaucuggaaa

SEQ ID NO: 632600 - RNA, 19 nt, Human
uggaaaacaguguaaccug

SEQ ID NO: 632601 - RNA, 23 nt, Human
ugguguaacaaugcagacauucu

SEQ ID NO: 632602 - RNA, 24 nt, Human
ugguguaacaaugcagacauucug

SEQ ID NO: 632603 - RNA, 21 nt, Human
uguuucauuaguuucuaauga

SEQ ID NO: 632604 - RNA, 22 nt, Human
uuaaaacucuagccagaaauac

SEQ ID NO: 632605 - RNA, 23 nt, Human
uugaaauaaacgcuaaagaugag

SEQ ID NO: 632606 - RNA, 21 nt, Human
uuucagaggcccuguaccaac

SEQ ID NO: 632607 - RNA, 21 nt, Human
uuuuuuuuuuuuuuuuuuagg

SEQ ID NO: 632608 - RNA, 24 nt, Human
aaacacagcggaagaggcgacagc

SEQ ID NO: 632609 - RNA, 20 nt, Human
aaguggagacuuucugacuc

SEQ ID NO: 632610 - RNA, 23 nt, Human
aauaaaaaucaaacauaugaaac

SEQ ID NO: 632611 - RNA, 20 nt, Human
acagcuuccuaauauuuccu

SEQ ID NO: 632612 - RNA, 21 nt, Human
cacagcuuccuaauauuuccu

SEQ ID NO: 632613 - RNA, 24 nt, Human
cagccccuuuccccacgcuccucc

SEQ ID NO: 632614 - RNA, 21 nt, Human
cauguugggaaaaccaugugc

SEQ ID NO: 632615 - RNA, 19 nt, Human
ccaagcgcgcgccuguacc

SEQ ID NO: 632616 - RNA, 20 nt, Human
ccccacgcuccuccuggguu

SEQ ID NO: 632617 - RNA, 21 nt, Human
ccuuuccccacgcuccuccug

SEQ ID NO: 632618 - RNA, 21 nt, Human
cggaagaggcgacagccaagc

SEQ ID NO: 632619 - RNA, 22 nt, Human
cggaagaggcgacagccaagcg

SEQ ID NO: 632620 - RNA, 23 nt, Human
cuccccgagaggcccacagcccc

SEQ ID NO: 632621 - RNA, 24 nt, Human
gaagguucuuaaauuacuccuugg

SEQ ID NO: 632622 - RNA, 21 nt, Human
gagcucugcuguaucuaugcg

SEQ ID NO: 632623 - RNA, 21 nt, Human
gcucccuggagagggagcaac

SEQ ID NO: 632624 - RNA, 19 nt, Human
ggagagggagcaacuugcu

SEQ ID NO: 632625 - RNA, 21 nt, Human
uccccgagaggcccacagccc

SEQ ID NO: 632626 - RNA, 20 nt, Human
ugggaaaaccaugugcaaua

SEQ ID NO: 632627 - RNA, 19 nt, Human
uguuauagagcuauguuca

SEQ ID NO: 632628 - RNA, 23 nt, Human
aaccuugucccuuugcgggaguc

SEQ ID NO: 632629 - RNA, 20 nt, Human
agaaggaaggugggaggggc

SEQ ID NO: 632630 - RNA, 21 nt, Human
aggaaggugggaggggcacug

SEQ ID NO: 632631 - RNA, 23 nt, Human
caccccucccaucccagaacucc

SEQ ID NO: 632632 - RNA, 24 nt, Human
caccccucccaucccagaacuccg

SEQ ID NO: 632633 - RNA, 18 nt, Human
caguguccucuguugagg

SEQ ID NO: 632634 - RNA, 18 nt, Human
caucccagaacuccguug

SEQ ID NO: 632635 - RNA, 20 nt, Human
ccaugcucccaccccuccca

SEQ ID NO: 632636 - RNA, 21 nt, Human
cccagaacuccguugggcuca

SEQ ID NO: 632637 - RNA, 21 nt, Human
cccaugcucccaccccuccca

SEQ ID NO: 632638 - RNA, 20 nt, Human
ccucccuucccaugcuccca

SEQ ID NO: 632639 - RNA, 18 nt, Human
cucugcaggagagggagg

SEQ ID NO: 632640 - RNA, 18 nt, Human
ggcacuguccaccagcac

SEQ ID NO: 632641 - RNA, 18 nt, Human
guggggaagaaggaaggu

SEQ ID NO: 632642 - RNA, 25 nt, Human
ucagcaaucuuuauucaguucuucu

SEQ ID NO: 632643 - RNA, 20 nt, Human
ucccaccccucccaucccag

SEQ ID NO: 632644 - RNA, 22 nt, Human
ugcaggagagggaggaaccuug

SEQ ID NO: 632645 - RNA, 21 nt, Human
ugcucccaccccucccauccc

SEQ ID NO: 632646 - RNA, 19 nt, Human
ugggaugccucccuuccca

SEQ ID NO: 632647 - RNA, 22 nt, Human
uggggaagaaggaaggugggag

SEQ ID NO: 632648 - RNA, 18 nt, Human
uguuguggggaagaagga

SEQ ID NO: 632649 - RNA, 23 nt, Human
uucccaugcucccaccccuccca

SEQ ID NO: 632650 - RNA, 18 nt, Human
uugagggaaggucuuggu

SEQ ID NO: 632651 - RNA, 22 nt, Human
uuuuuuuuuuuuuuuugcucag

SEQ ID NO: 632652 - RNA, 18 nt, Human
uuuuuuuuuuuuuuuuug

SEQ ID NO: 632653 - RNA, 20 nt, Human
uuuuuuuuuuuuuuuuugcu

SEQ ID NO: 632654 - RNA, 22 nt, Human
aaguccacagccacauccucaa

SEQ ID NO: 632655 - RNA, 19 nt, Human
acugacuucugggaauagg

SEQ ID NO: 632656 - RNA, 18 nt, Human
agccacauccucaaaugu

SEQ ID NO: 632657 - RNA, 19 nt, Human
cugcugccacucuuccugc

SEQ ID NO: 632658 - RNA, 28 nt, Human
guccacagccacauccucaaaugucacu

SEQ ID NO: 632659 - RNA, 19 nt, Human
uaagcagaucauucugugg

SEQ ID NO: 632660 - RNA, 20 nt, Human
uaagcagaucauucugugga

SEQ ID NO: 632661 - RNA, 22 nt, Human
ucuacaguugagaaguugucac

SEQ ID NO: 632662 - RNA, 23 nt, Human
ugagggccuaagcagaucauucu

SEQ ID NO: 632663 - RNA, 18 nt, Human
ugugaagagggcugagac

SEQ ID NO: 632664 - RNA, 24 nt, Human
uucuacaguugagaaguugucacu

SEQ ID NO: 632665 - RNA, 21 nt, Human
aaagaguccaguccacuuggc

SEQ ID NO: 632666 - RNA, 21 nt, Human
aaagaguccaguccacuuggc

SEQ ID NO: 632667 - RNA, 18 nt, Human
aaagcccugggccugagc

SEQ ID NO: 632668 - RNA, 18 nt, Human
aacacgcucuuccccuuc

SEQ ID NO: 632669 - RNA, 22 nt, Human
aacagcaucucuagcuccuggu

SEQ ID NO: 632670 - RNA, 23 nt, Human
agauagaucagcuccccaagggu

SEQ ID NO: 632671 - RNA, 21 nt, Human
agcacucucuaggguucuuuu

SEQ ID NO: 632672 - RNA, 22 nt, Human
agcacucucuaggguucuuuuu

SEQ ID NO: 632673 - RNA, 25 nt, Human
agcaguggagugucugaauagguac

SEQ ID NO: 632674 - RNA, 21 nt, Human
aggagaauggcgagugauucu

SEQ ID NO: 632675 - RNA, 20 nt, Human
aggguucuuuuuuuuuucuu

SEQ ID NO: 632676 - RNA, 23 nt, Human
agucuuugaagaugaaucccaca

SEQ ID NO: 632677 - RNA, 21 nt, Human
aucuccuuuuuuuuuccuuua

SEQ ID NO: 632678 - RNA, 20 nt, Human
aucugcuguuccugaaguuu

SEQ ID NO: 632679 - RNA, 27 nt, Human
auggcagugaauaaggucaacauguac

SEQ ID NO: 632680 - RNA, 21 nt, Human
caagggaacagcccagcacuc

SEQ ID NO: 632681 - RNA, 19 nt, Human
caauugccucaacaacagg

SEQ ID NO: 632682 - RNA, 21 nt, Human
cacuaaaaugcagaagaaaac

SEQ ID NO: 632683 - RNA, 19 nt, Human
cagaagaaaacaauuuuua

SEQ ID NO: 632684 - RNA, 21 nt, Human
caugugauucacaacacgcuc

SEQ ID NO: 632685 - RNA, 19 nt, Human
ccuguaauaaagcccuggg

SEQ ID NO: 632686 - RNA, 24 nt, Human
cuguuuuaaucugcuguuccugaa

SEQ ID NO: 632687 - RNA, 20 nt, Human
gcagaaaaggugguacagac

SEQ ID NO: 632688 - RNA, 21 nt, Human
ggccugagcagaaaagguggu

SEQ ID NO: 632689 - RNA, 19 nt, Human
gggccugagcagaaaaggu

SEQ ID NO: 632690 - RNA, 21 nt, Human
gugaauaaggucaacauguac

SEQ ID NO: 632691 - RNA, 24 nt, Human
uaaaaaaugaauucuacaaacaug

SEQ ID NO: 632692 - RNA, 23 nt, Human
uaacagguaaaaucuaagucaaa

SEQ ID NO: 632693 - RNA, 24 nt, Human
uaacagguaaaaucuaagucaaac

SEQ ID NO: 632694 - RNA, 18 nt, Human
uaaggucaacauguacug

SEQ ID NO: 632695 - RNA, 24 nt, Human
uaagucaagaaaagaguccagucc

SEQ ID NO: 632696 - RNA, 24 nt, Human
uaagucaagaaaagaguccagucc

SEQ ID NO: 632697 - RNA, 22 nt, Human
uaaucugcuguuccugaaguuu

SEQ ID NO: 632698 - RNA, 27 nt, Human
uaggguucuuuuuuuuuucuuccuggg

SEQ ID NO: 632699 - RNA, 22 nt, Human
ucccgaaggcaccucauuagca

SEQ ID NO: 632700 - RNA, 26 nt, Human
ucccgcgguugcgcgcaucuccuuuu

SEQ ID NO: 632701 - RNA, 24 nt, Human
ucuacaaacaugacauuacuugug

SEQ ID NO: 632702 - RNA, 24 nt, Human
ucuuggaacauguucagaugaaca

SEQ ID NO: 632703 - RNA, 18 nt, Human
ucuuuuuuuuuucuuccu

SEQ ID NO: 632704 - RNA, 19 nt, Human
ucuuuuuuuuuucuuccug

SEQ ID NO: 632705 - RNA, 23 nt, Human
ugacauuacuuguggaaccacua

SEQ ID NO: 632706 - RNA, 23 nt, Human
ugauucacaacacgcucuucccc

SEQ ID NO: 632707 - RNA, 18 nt, Human
ugcagauggcagaggcca

SEQ ID NO: 632708 - RNA, 21 nt, Human
uggaaggcaguaggagaaugg

SEQ ID NO: 632709 - RNA, 22 nt, Human
uggaaggcaguaggagaauggc

SEQ ID NO: 632710 - RNA, 22 nt, Human
uggcaaaguucaaaaaggccuc

SEQ ID NO: 632711 - RNA, 25 nt, Human
aagcagaaauaaaguuuaauuuuug

SEQ ID NO: 632712 - RNA, 20 nt, Human
aaggagugaacugcugcugc

SEQ ID NO: 632713 - RNA, 23 nt, Human
aagggcauuuaaucaggaggaaa

SEQ ID NO: 632714 - RNA, 18 nt, Human
agggucaaaggaacgagc

SEQ ID NO: 632715 - RNA, 18 nt, Human
agguaacaguacgucacc

SEQ ID NO: 632716 - RNA, 19 nt, Human
aucucuguaaacuugcccu

SEQ ID NO: 632717 - RNA, 24 nt, Human
cagugcagcgugaacaggggcuuu

SEQ ID NO: 632718 - RNA, 21 nt, Human
caucucuguaaacuugcccuu

SEQ ID NO: 632719 - RNA, 24 nt, Human
caucucuguaaacuugcccuugac

SEQ ID NO: 632720 - RNA, 21 nt, Human
ccucugugggcucugcugcuu

SEQ ID NO: 632721 - RNA, 18 nt, Human
cuaauccucacaaagauc

SEQ ID NO: 632722 - RNA, 23 nt, Human
cuuuccaacagcaaguucagucg

SEQ ID NO: 632723 - RNA, 20 nt, Human
cuuuguccuuucucaguucu

SEQ ID NO: 632724 - RNA, 20 nt, Human
gagauaccaucuccuuaaaa

SEQ ID NO: 632725 - RNA, 24 nt, Human
ggaaagguuuggaaaacuaacuca

SEQ ID NO: 632726 - RNA, 20 nt, Human
ggagacaagggucaaaggaa

SEQ ID NO: 632727 - RNA, 21 nt, Human
ggggagauaccaucuccuuaa

SEQ ID NO: 632728 - RNA, 24 nt, Human
guacgucaccauuggcuucuggcu

SEQ ID NO: 632729 - RNA, 21 nt, Human
guucagguaacaguacgucac

SEQ ID NO: 632730 - RNA, 21 nt, Human
uaacaguacgucaccauuggc

SEQ ID NO: 632731 - RNA, 18 nt, Human
uacuuuguccuuucucag

SEQ ID NO: 632732 - RNA, 22 nt, Human
ucaggaggaaagguuuggaaaa

SEQ ID NO: 632733 - RNA, 21 nt, Human
ugugaagguuucguauagcca

SEQ ID NO: 632734 - RNA, 25 nt, Human
uugaagaugguucuuaauuucuuuu

SEQ ID NO: 632735 - RNA, 19 nt, Human
uuuuuuuuuuuuuuuuuaa

SEQ ID NO: 632736 - RNA, 24 nt, Human
uuuuuuuuuuuuuuuuuaaguuuu

SEQ ID NO: 632737 - RNA, 22 nt, Human
aagcaaacuugaauaaagcuag

SEQ ID NO: 632738 - RNA, 21 nt, Human
aauucaaagauuucaagugga

SEQ ID NO: 632739 - RNA, 21 nt, Human
acucuaucucacaucuacuga

SEQ ID NO: 632740 - RNA, 26 nt, Human
agacaggaagggaucagaagggaccc

SEQ ID NO: 632741 - RNA, 20 nt, Human
aggcauguuuguacaccaac

SEQ ID NO: 632742 - RNA, 23 nt, Human
agggcaaaaaacuauccaugaag

SEQ ID NO: 632743 - RNA, 26 nt, Human
auagggcaaaaaacuauccaugaagc

SEQ ID NO: 632744 - RNA, 25 nt, Human
augaagcuaauaaaaaagaaaugug

SEQ ID NO: 632745 - RNA, 20 nt, Human
caaaaaacuauccaugaagc

SEQ ID NO: 632746 - RNA, 23 nt, Human
caaaaaacuauccaugaagcuaa

SEQ ID NO: 632747 - RNA, 25 nt, Human
caaaaaacuauccaugaagcuaaua

SEQ ID NO: 632748 - RNA, 18 nt, Human
ccccgccggcagugcugc

SEQ ID NO: 632749 - RNA, 22 nt, Human
ccccuccaccuccaagucccug

SEQ ID NO: 632750 - RNA, 19 nt, Human
ccgccgcguccccuccacc

SEQ ID NO: 632751 - RNA, 20 nt, Human
ccgccgcguccccuccaccu

SEQ ID NO: 632752 - RNA, 20 nt, Human
cugcuccugugcuccccguc

SEQ ID NO: 632753 - RNA, 19 nt, Human
gcugcuccugugcuccccg

SEQ ID NO: 632754 - RNA, 22 nt, Human
ggaggagccauguaauuuuaug

SEQ ID NO: 632755 - RNA, 23 nt, Human
uacaccaacugaaugauucaaua

SEQ ID NO: 632756 - RNA, 19 nt, Human
uaccgccgcguccccucca

SEQ ID NO: 632757 - RNA, 18 nt, Human
ucccuggcacccgccccc

SEQ ID NO: 632758 - RNA, 25 nt, Human
ucucacaucuacugaaugcaaagca

SEQ ID NO: 632759 - RNA, 26 nt, Human
uuuuuugcuguuccuuucuuuuuuaa

SEQ ID NO: 632760 - RNA, 20 nt, Human
uuuuuuuuuuuuuuuugcug

SEQ ID NO: 632761 - RNA, 21 nt, Human
uuuuuuuuuuuuuuuugcugu

SEQ ID NO: 632762 - RNA, 20 nt, Human
uuuuuuuuuuuuuuuuugcu

SEQ ID NO: 632763 - RNA, 20 nt, Human
uuuuuuuuuuuuuuuuuugg

SEQ ID NO: 632764 - RNA, 21 nt, Human
aaaaacagagaucaagaggaa

SEQ ID NO: 632765 - RNA, 19 nt, Human
aaaacagagaucaagagga

SEQ ID NO: 632766 - RNA, 19 nt, Human
acccuuuggcguccgucgc

SEQ ID NO: 632767 - RNA, 18 nt, Human
agcacacccagugccccc

SEQ ID NO: 632768 - RNA, 18 nt, Human
agugcguggcguggucuc

SEQ ID NO: 632769 - RNA, 19 nt, Human
agugcguggcguggucucg

SEQ ID NO: 632770 - RNA, 24 nt, Human
augaauuucugcuuaaaaacagag

SEQ ID NO: 632771 - RNA, 21 nt, Human
cacccacaguggacuucgcaa

SEQ ID NO: 632772 - RNA, 21 nt, Human
cacccagugcccccacguucc

SEQ ID NO: 632773 - RNA, 24 nt, Human
cacccagugcccccacguucccgc

SEQ ID NO: 632774 - RNA, 22 nt, Human
cacugggugugguggugcugga

SEQ ID NO: 632775 - RNA, 23 nt, Human
cagcgccagggcagccuuggcag

SEQ ID NO: 632776 - RNA, 19 nt, Human
ccaaggccucgaucugaag

SEQ ID NO: 632777 - RNA, 19 nt, Human
ccacugggugugguggugc

SEQ ID NO: 632778 - RNA, 21 nt, Human
ccagagccgaggcugugccca

SEQ ID NO: 632779 - RNA, 19 nt, Human
ccaggauggggacuaccga

SEQ ID NO: 632780 - RNA, 22 nt, Human
cccacaguggacuucgcaaagg

SEQ ID NO: 632781 - RNA, 18 nt, Human
cccacgguggagcccggg

SEQ ID NO: 632782 - RNA, 26 nt, Human
cccagagccgaggcugugcccaggac

SEQ ID NO: 632783 - RNA, 23 nt, Human
cccaugcuaaagcagaccggggc

SEQ ID NO: 632784 - RNA, 18 nt, Human
ccccacgugggcagggau

SEQ ID NO: 632785 - RNA, 27 nt, Human
ccccacgugggcagggaucagccaggc

SEQ ID NO: 632786 - RNA, 22 nt, Human
ccccacguucccgcuggcccag

SEQ ID NO: 632787 - RNA, 18 nt, Human
ccccauagaucgugccag

SEQ ID NO: 632788 - RNA, 19 nt, Human
ccccgaaggccaggccacc

SEQ ID NO: 632789 - RNA, 22 nt, Human
cccgcugugggcucuggagggc

SEQ ID NO: 632790 - RNA, 18 nt, Human
cccggcccaguccccggc

SEQ ID NO: 632791 - RNA, 25 nt, Human
cccggcgcccuccggguuucucuuu

SEQ ID NO: 632792 - RNA, 23 nt, Human
cccuccaggauggggacuaccga

SEQ ID NO: 632793 - RNA, 24 nt, Human
ccgaggcugugcccaggacugucc

SEQ ID NO: 632794 - RNA, 19 nt, Human
ccgcagggcgucugagacc

SEQ ID NO: 632795 - RNA, 23 nt, Human
ccggcgcccuccggguuucucuu

SEQ ID NO: 632796 - RNA, 25 nt, Human
ccgggucccugccgccaagugcgug

SEQ ID NO: 632797 - RNA, 18 nt, Human
ccucagauggggguccca

SEQ ID NO: 632798 - RNA, 20 nt, Human
ccucaggcggcccgggaccc

SEQ ID NO: 632799 - RNA, 21 nt, Human
ccucaggcggcccgggacccu

SEQ ID NO: 632800 - RNA, 19 nt, Human
ccugcagaccccggcccag

SEQ ID NO: 632801 - RNA, 20 nt, Human
ccugcagcuccggaaauggg

SEQ ID NO: 632802 - RNA, 19 nt, Human
cgccaaggggucggccucc

SEQ ID NO: 632803 - RNA, 22 nt, Human
cgcgggaggacagcccagaggc

SEQ ID NO: 632804 - RNA, 22 nt, Human
cgcuggcccaggucccggagac

SEQ ID NO: 632805 - RNA, 19 nt, Human
cggccuccgggucccugcc

SEQ ID NO: 632806 - RNA, 20 nt, Human
cgucugagacccacggugga

SEQ ID NO: 632807 - RNA, 24 nt, Human
cgucugagacccacgguggagccc

SEQ ID NO: 632808 - RNA, 18 nt, Human
cgugccagcuuuggcugc

SEQ ID NO: 632809 - RNA, 22 nt, Human
cgugggcagggaucagccaggc

SEQ ID NO: 632810 - RNA, 20 nt, Human
cguggggaccccgaaggcca

SEQ ID NO: 632811 - RNA, 21 nt, Human
cuaggcagagcggcaccugcc

SEQ ID NO: 632812 - RNA, 23 nt, Human
cucagcgccagggcagccuuggc

SEQ ID NO: 632813 - RNA, 23 nt, Human
cucaggcagcugguuccuaggcu

SEQ ID NO: 632814 - RNA, 22 nt, Human
cucuauccugcagcuccggaaa

SEQ ID NO: 632815 - RNA, 21 nt, Human
cugagcccugcagaccccggc

SEQ ID NO: 632816 - RNA, 20 nt, Human
cugguucccgccaagggguc

SEQ ID NO: 632817 - RNA, 18 nt, Human
cugugguggggaggagcc

SEQ ID NO: 632818 - RNA, 20 nt, Human
cuuucucccaggaacuccgg

SEQ ID NO: 632819 - RNA, 23 nt, Human
gaccccccaaggccucgaucuga

SEQ ID NO: 632820 - RNA, 24 nt, Human
gcagaugcgcagagccugccccuc

SEQ ID NO: 632821 - RNA, 20 nt, Human
gccccuggcuuuucuaggca

SEQ ID NO: 632822 - RNA, 21 nt, Human
gcccgggacccuuuggcgucc

SEQ ID NO: 632823 - RNA, 18 nt, Human
gccgggcaccggcuggaa

SEQ ID NO: 632824 - RNA, 18 nt, Human
gcucagcugagcccugca

SEQ ID NO: 632825 - RNA, 21 nt, Human
gcuggcccaggucccggagac

SEQ ID NO: 632826 - RNA, 18 nt, Human
gcuggggccucaccgugu

SEQ ID NO: 632827 - RNA, 19 nt, Human
ggaccccgaaggccaggcc

SEQ ID NO: 632828 - RNA, 20 nt, Human
ggaggagccucaggcggccc

SEQ ID NO: 632829 - RNA, 20 nt, Human
ggaggcggagggacccagag

SEQ ID NO: 632830 - RNA, 20 nt, Human
ggcggagggacccagagccg

SEQ ID NO: 632831 - RNA, 19 nt, Human
gugccagcuuuggcugcag

SEQ ID NO: 632832 - RNA, 21 nt, Human
guggugcuggaggaguccugc

SEQ ID NO: 632833 - RNA, 21 nt, Human
guguuuccugggggggcccgg

SEQ ID NO: 632834 - RNA, 18 nt, Human
ucagcugagcccugcaga

SEQ ID NO: 632835 - RNA, 19 nt, Human
ucccgcuggcccagguccc

SEQ ID NO: 632836 - RNA, 18 nt, Human
ucccugccgccaagugcg

SEQ ID NO: 632837 - RNA, 21 nt, Human
uccuaggcuguguccucccca

SEQ ID NO: 632838 - RNA, 18 nt, Human
ucgggccacugggugugg

SEQ ID NO: 632839 - RNA, 18 nt, Human
ucgugccagcuuuggcug

SEQ ID NO: 632840 - RNA, 23 nt, Human
ucucaggcagcugguuccuaggc

SEQ ID NO: 632841 - RNA, 20 nt, Human
ucugcuuaaaaacagagauu

SEQ ID NO: 632842 - RNA, 20 nt, Human
ugaggcagugacuugugggg

SEQ ID NO: 632843 - RNA, 21 nt, Human
ugaggcagugacuuguggggg

SEQ ID NO: 632844 - RNA, 20 nt, Human
ugauggcacccacaguggac

SEQ ID NO: 632845 - RNA, 23 nt, Human
ugccaacacuuugugcugguucc

SEQ ID NO: 632846 - RNA, 18 nt, Human
ugcccaggacugucccgg

SEQ ID NO: 632847 - RNA, 23 nt, Human
ugccccauagaucgugccagcuu

SEQ ID NO: 632848 - RNA, 18 nt, Human
ugcgcagagccugccccu

SEQ ID NO: 632849 - RNA, 20 nt, Human
ugcugguucccgccaagggg

SEQ ID NO: 632850 - RNA, 18 nt, Human
uggcugcaggcgcugggg

SEQ ID NO: 632851 - RNA, 18 nt, Human
uggcugcgugcuuggggu

SEQ ID NO: 632852 - RNA, 18 nt, Human
uggcugugguggggagga

SEQ ID NO: 632853 - RNA, 19 nt, Human
uggggaccccgaaggccag

SEQ ID NO: 632854 - RNA, 20 nt, Human
uggggaccccgaaggccagg

SEQ ID NO: 632855 - RNA, 20 nt, Human
ugguggugcuggaggagucc

SEQ ID NO: 632856 - RNA, 23 nt, Human
ugguuccuaggcuguguccuccc

SEQ ID NO: 632857 - RNA, 19 nt, Human
uguggggguuagauguggg

SEQ ID NO: 632858 - RNA, 24 nt, Human
uugugcugguucccgccaaggggu

SEQ ID NO: 632859 - RNA, 22 nt, Human
uuugugcugguucccgccaagg

SEQ ID NO: 632860 - RNA, 22 nt, Human
uuuuuuuuugaguaaugccgac

SEQ ID NO: 632861 - RNA, 18 nt, Human
uuuuuuuuuuuuuuuuug

SEQ ID NO: 632862 - RNA, 18 nt, Human
aaccugaggccucuccuc

SEQ ID NO: 632863 - RNA, 19 nt, Human
acaaagaccaacaaagaca

SEQ ID NO: 632864 - RNA, 21 nt, Human
accucagucuucuccagccag

SEQ ID NO: 632865 - RNA, 24 nt, Human
caaauaacaaccugaggccucucc

SEQ ID NO: 632866 - RNA, 23 nt, Human
caccucugacaccugcugagacc

SEQ ID NO: 632867 - RNA, 24 nt, Human
caccucugacaccugcugagaccu

SEQ ID NO: 632868 - RNA, 19 nt, Human
cagguaagacacuucccuc

SEQ ID NO: 632869 - RNA, 20 nt, Human
ccaacaaagacaaucucaga

SEQ ID NO: 632870 - RNA, 24 nt, Human
ccaacaaagacaaucucagaggca

SEQ ID NO: 632871 - RNA, 26 nt, Human
ccaaccaaauaacaaccugaggccuc

SEQ ID NO: 632872 - RNA, 23 nt, Human
cccaaccaaauaacaaccugagg

SEQ ID NO: 632873 - RNA, 19 nt, Human
cccccgggcucggcccggc

SEQ ID NO: 632874 - RNA, 21 nt, Human
cccccgggcucggcccggccc

SEQ ID NO: 632875 - RNA, 24 nt, Human
ccccugcugcaagguggaugggaa

SEQ ID NO: 632876 - RNA, 20 nt, Human
cccgggcucggcccggcccc

SEQ ID NO: 632877 - RNA, 18 nt, Human
cgcccccgggcucggccc

SEQ ID NO: 632878 - RNA, 23 nt, Human
cgcccccgggcucggcccggccc

SEQ ID NO: 632879 - RNA, 20 nt, Human
cuccaucacucucuccucca

SEQ ID NO: 632880 - RNA, 22 nt, Human
cuccccaaccaaauaacaaccu

SEQ ID NO: 632881 - RNA, 19 nt, Human
cucugcucugugccucccc

SEQ ID NO: 632882 - RNA, 24 nt, Human
cucuugggagaccagguccugcuc

SEQ ID NO: 632883 - RNA, 19 nt, Human
cugagaccugaaccucugc

SEQ ID NO: 632884 - RNA, 20 nt, Human
cugcucugugccuccccaac

SEQ ID NO: 632885 - RNA, 19 nt, Human
gaccucagucuucuccagc

SEQ ID NO: 632886 - RNA, 21 nt, Human
ggaugguccccauugguuccc

SEQ ID NO: 632887 - RNA, 18 nt, Human
gggaagggcuguaaucac

SEQ ID NO: 632888 - RNA, 22 nt, Human
uaaacaaagaccaacaaagaca

SEQ ID NO: 632889 - RNA, 23 nt, Human
uaaacaaagaccaacaaagacaa

SEQ ID NO: 632890 - RNA, 25 nt, Human
ucaaauaucaacaaguagucccgcu

SEQ ID NO: 632891 - RNA, 18 nt, Human
ucagcccuccaucacucu

SEQ ID NO: 632892 - RNA, 26 nt, Human
uccccaaccaaauaacaaccugaggc

SEQ ID NO: 632893 - RNA, 18 nt, Human
uccuggggcaaucacuua

SEQ ID NO: 632894 - RNA, 22 nt, Human
ucuccucagcccuccaucacuc

SEQ ID NO: 632895 - RNA, 19 nt, Human
ucugacuggagauccagaa

SEQ ID NO: 632896 - RNA, 18 nt, Human
ucuugggagaccaggucc

SEQ ID NO: 632897 - RNA, 20 nt, Human
ugaaaggcacaaagccccug

SEQ ID NO: 632898 - RNA, 21 nt, Human
ugaaaggcacaaagccccugc

SEQ ID NO: 632899 - RNA, 20 nt, Human
ugacuggagauccagaaguu

SEQ ID NO: 632900 - RNA, 20 nt, Human
uggaccucagucuucuccag

SEQ ID NO: 632901 - RNA, 20 nt, Human
uucaugaggaaggucggggc

SEQ ID NO: 632902 - RNA, 23 nt, Human
uuuuuuuuuuuuuuuucaugagg

SEQ ID NO: 632903 - RNA, 19 nt, Human
cacuucuccacagucgggg

SEQ ID NO: 632904 - RNA, 20 nt, Human
uaccccggacacuucuccac

SEQ ID NO: 632905 - RNA, 22 nt, Human
uaccccggacacuucuccacag

SEQ ID NO: 632906 - RNA, 23 nt, Human
ucagaaacacauuccuguaacgg

SEQ ID NO: 632907 - RNA, 20 nt, Human
ucgggggcgaugacgcucuc

SEQ ID NO: 632908 - RNA, 23 nt, Human
ucgggggcgaugacgcucucaag

SEQ ID NO: 632909 - RNA, 24 nt, Human
acccuaguggauccaucacucauc

SEQ ID NO: 632910 - RNA, 19 nt, Human
aguugauucauuaaacuug

SEQ ID NO: 632911 - RNA, 20 nt, Human
auguucuucccuucauguuu

SEQ ID NO: 632912 - RNA, 21 nt, Human
auucaaaauagcauuuuugau

SEQ ID NO: 632913 - RNA, 21 nt, Human
cacagugaucuguugcuuccc

SEQ ID NO: 632914 - RNA, 18 nt, Human
cagugaguauuuuugcuu

SEQ ID NO: 632915 - RNA, 18 nt, Human
cccucuaauacuuuccuu

SEQ ID NO: 632916 - RNA, 22 nt, Human
ccuugcauuccuacucucaaaa

SEQ ID NO: 632917 - RNA, 18 nt, Human
cugaagccauaucacccu

SEQ ID NO: 632918 - RNA, 29 nt, Human
cugccucauugccacagucucugccuuua

SEQ ID NO: 632919 - RNA, 25 nt, Human
cuuaagaucauaccaaaguuguucg

SEQ ID NO: 632920 - RNA, 18 nt, Human
gcacugaaaaaaauaugu

SEQ ID NO: 632921 - RNA, 19 nt, Human
gcccagauuccauaaugcu

SEQ ID NO: 632922 - RNA, 18 nt, Human
gcuagaguaaaaagcaca

SEQ ID NO: 632923 - RNA, 24 nt, Human
ggggagaaguuuucuugauguucu

SEQ ID NO: 632924 - RNA, 22 nt, Human
ggguaggccaccuggaaauucu

SEQ ID NO: 632925 - RNA, 20 nt, Human
gugaucuguugcuucccauu

SEQ ID NO: 632926 - RNA, 22 nt, Human
gugaucuguugcuucccauuuc

SEQ ID NO: 632927 - RNA, 19 nt, Human
uaaaaagcacaugagugga

SEQ ID NO: 632928 - RNA, 21 nt, Human
uaaaaagcacaugaguggaaa

SEQ ID NO: 632929 - RNA, 24 nt, Human
uaaaaggcacacauuuuaaaaaca

SEQ ID NO: 632930 - RNA, 21 nt, Human
uaaagccuucaguaccuaaaa

SEQ ID NO: 632931 - RNA, 27 nt, Human
uacacacaaacagauuacuuuuaugug

SEQ ID NO: 632932 - RNA, 23 nt, Human
uagcauuuuugaugaucuuaauu

SEQ ID NO: 632933 - RNA, 19 nt, Human
uaguugaaggcuggauaau

SEQ ID NO: 632934 - RNA, 21 nt, Human
uccaggguaaagauaguugaa

SEQ ID NO: 632935 - RNA, 21 nt, Human
ucucaaaauuccauucucuuu

SEQ ID NO: 632936 - RNA, 20 nt, Human
ucucccaaaacauagacuga

SEQ ID NO: 632937 - RNA, 22 nt, Human
ucuggguaggccaccuggaaau

SEQ ID NO: 632938 - RNA, 22 nt, Human
ucuguugcuucccauuucuccc

SEQ ID NO: 632939 - RNA, 18 nt, Human
ugaaaagucaaaaaucga

SEQ ID NO: 632940 - RNA, 22 nt, Human
ugaguggaaagucaacaggacu

SEQ ID NO: 632941 - RNA, 18 nt, Human
ugccucauugccacaguc

SEQ ID NO: 632942 - RNA, 20 nt, Human
ugccuuuaaugucaaggcca

SEQ ID NO: 632943 - RNA, 19 nt, Human
ugcuucccauuucucccaa

SEQ ID NO: 632944 - RNA, 22 nt, Human
uggagcauacacaacuuugaaa

SEQ ID NO: 632945 - RNA, 19 nt, Human
uguucaugcugucuuccuu

SEQ ID NO: 632946 - RNA, 22 nt, Human
uuaaagccuucaguaccuaaaa

SEQ ID NO: 632947 - RNA, 19 nt, Human
uuauauauauacuuucaua

SEQ ID NO: 632948 - RNA, 24 nt, Human
uuauauauauacuuucauauuccc

SEQ ID NO: 632949 - RNA, 23 nt, Human
uucauauuccccccucuaauacu

SEQ ID NO: 632950 - RNA, 23 nt, Human
uuccaggugguauaucuggcagu

SEQ ID NO: 632951 - RNA, 24 nt, Human
uuuuaaaugucauccucuuccuua

SEQ ID NO: 632952 - RNA, 18 nt, Human
uuuuuuuuuuuuuuuuug

SEQ ID NO: 632953 - RNA, 22 nt, Human
uuuuuuuuuuuuuuuuuggauu

SEQ ID NO: 632954 - RNA, 24 nt, Human
acagcagcaacgggcgggaagggc

SEQ ID NO: 632955 - RNA, 21 nt, Human
ccacaggucccaggggagcuc

SEQ ID NO: 632956 - RNA, 21 nt, Human
cugaguccucugagaauuuau

SEQ ID NO: 632957 - RNA, 21 nt, Human
gucugugggcggcggccacag

SEQ ID NO: 632958 - RNA, 18 nt, Human
uauuacuacggaucacag

SEQ ID NO: 632959 - RNA, 22 nt, Human
ucacagcagcaacgggcgggaa

SEQ ID NO: 632960 - RNA, 21 nt, Human
uuuuuuuuuuuuuaaaggcug

SEQ ID NO: 632961 - RNA, 22 nt, Human
uuuuuuuuuuuuuuuuuaaagg

SEQ ID NO: 632962 - RNA, 20 nt, Human
aaaaacaggguccagugacc

SEQ ID NO: 632963 - RNA, 22 nt, Human
aaaaccaaugaucuaagaauaa

SEQ ID NO: 632964 - RNA, 21 nt, Human
aaagagcaaaaagaccaacac

SEQ ID NO: 632965 - RNA, 29 nt, Human
aaagggaauagucaauugauuucagaggg

SEQ ID NO: 632966 - RNA, 22 nt, Human
aaccuccaauccuggacaucuc

SEQ ID NO: 632967 - RNA, 18 nt, Human
aaguucugguuccugagu

SEQ ID NO: 632968 - RNA, 18 nt, Human
acaagacaggaguggagg

SEQ ID NO: 632969 - RNA, 19 nt, Human
acaggaguggagguaaagg

SEQ ID NO: 632970 - RNA, 21 nt, Human
acuuuuacucugggcuucugc

SEQ ID NO: 632971 - RNA, 22 nt, Human
aguuguuuuuuuucccuccuuu

SEQ ID NO: 632972 - RNA, 20 nt, Human
auucagguauucauggaggg

SEQ ID NO: 632973 - RNA, 24 nt, Human
caaaacccgcuugcugauaauuca

SEQ ID NO: 632974 - RNA, 23 nt, Human
caaugggucagaauauguuuucu

SEQ ID NO: 632975 - RNA, 20 nt, Human
cacuggauauccaucuggag

SEQ ID NO: 632976 - RNA, 19 nt, Human
cauggagggucaagacuuc

SEQ ID NO: 632977 - RNA, 22 nt, Human
ccagugaccuucaugggauccu

SEQ ID NO: 632978 - RNA, 21 nt, Human
ccaucuggaguggagggcugu

SEQ ID NO: 632979 - RNA, 24 nt, Human
ccaucuucagcaaaugaucauucc

SEQ ID NO: 632980 - RNA, 21 nt, Human
cuaugaggaguucacugugcc

SEQ ID NO: 632981 - RNA, 20 nt, Human
cugaaaguuaucugcuccaa

SEQ ID NO: 632982 - RNA, 18 nt, Human
cuggggcagugguuuuca

SEQ ID NO: 632983 - RNA, 22 nt, Human
cuugacaccaucuucagcaaau

SEQ ID NO: 632984 - RNA, 21 nt, Human
cuuuucaaccuccaauccugg

SEQ ID NO: 632985 - RNA, 24 nt, Human
gaguuccaguuguuuuuuuucccu

SEQ ID NO: 632986 - RNA, 24 nt, Human
gauucaggccccuacucuugcuuc

SEQ ID NO: 632987 - RNA, 23 nt, Human
ggaaaagggaauagucaauugau

SEQ ID NO: 632988 - RNA, 22 nt, Human
gguguugcuuaagggagucugu

SEQ ID NO: 632989 - RNA, 23 nt, Human
guggggugugguccaaugcugcu

SEQ ID NO: 632990 - RNA, 23 nt, Human
uaaggaaguccccuuagguguca

SEQ ID NO: 632991 - RNA, 19 nt, Human
uaagucggucacaaaaugc

SEQ ID NO: 632992 - RNA, 18 nt, Human
uaccaguagagcaucugg

SEQ ID NO: 632993 - RNA, 21 nt, Human
uagaaaaaacaggguccagug

SEQ ID NO: 632994 - RNA, 24 nt, Human
uagaacaagacaggaguggaggua

SEQ ID NO: 632995 - RNA, 18 nt, Human
uagaguaccauggcugau

SEQ ID NO: 632996 - RNA, 24 nt, Human
uagaguaccauggcugauaacaag

SEQ ID NO: 632997 - RNA, 24 nt, Human
uaucaagagaagccuuccggacgg

SEQ ID NO: 632998 - RNA, 25 nt, Human
ucaaccuccaauccuggacaucuca

SEQ ID NO: 632999 - RNA, 19 nt, Human
ucagaauauguuuucucau

SEQ ID NO: 633000 - RNA, 22 nt, Human
ucauuugagauuguggggugug

SEQ ID NO: 633001 - RNA, 24 nt, Human
ucccuccuuucugcugaggaaagc

SEQ ID NO: 633002 - RNA, 23 nt, Human
ucuaagaauguucagcaucuacu

SEQ ID NO: 633003 - RNA, 18 nt, Human
ugaaaugcacacucaugg

SEQ ID NO: 633004 - RNA, 24 nt, Human
ugaauaaaaaccaaggggcaauau

SEQ ID NO: 633005 - RNA, 18 nt, Human
ugaggaguucacugugcc

SEQ ID NO: 633006 - RNA, 18 nt, Human
ugaggcaccagcuucaaa

SEQ ID NO: 633007 - RNA, 19 nt, Human
ugaggcaccagcuucaaaa

SEQ ID NO: 633008 - RNA, 21 nt, Human
ugauaagauauugagccccuu

SEQ ID NO: 633009 - RNA, 19 nt, Human
ugccacagaauuucaagcu

SEQ ID NO: 633010 - RNA, 24 nt, Human
ugccacagaauuucaagcuuugag

SEQ ID NO: 633011 - RNA, 25 nt, Human
ugcuccaacuauugcagaacacugu

SEQ ID NO: 633012 - RNA, 19 nt, Human
ugcucucaaaaagauguug

SEQ ID NO: 633013 - RNA, 31 nt, Human
ugcuucacuacuucauccagagcagcuucaa

SEQ ID NO: 633014 - RNA, 21 nt, Human
uggaaaagaagacgaaugaua

SEQ ID NO: 633015 - RNA, 18 nt, Human
uggaacaaacuaggccuu

SEQ ID NO: 633016 - RNA, 25 nt, Human
uggaaucuggugcagccuugugaga

SEQ ID NO: 633017 - RNA, 21 nt, Human
uggaaugccauucaggucaaa

SEQ ID NO: 633018 - RNA, 20 nt, Human
uggcuauaucccauucuagg

SEQ ID NO: 633019 - RNA, 19 nt, Human
uggcugauaacaagagguc

SEQ ID NO: 633020 - RNA, 19 nt, Human
ugguaaaggaagauaguug

SEQ ID NO: 633021 - RNA, 21 nt, Human
uguaaaaaguucugguuccug

SEQ ID NO: 633022 - RNA, 21 nt, Human
ugucaccacggugguaaagga

SEQ ID NO: 633023 - RNA, 24 nt, Human
ugucucugcccuuuaggaaaaggg

SEQ ID NO: 633024 - RNA, 20 nt, Human
ugugauaaaacagcuuuagc

SEQ ID NO: 633025 - RNA, 20 nt, Human
uuauugugugucucugaagg

SEQ ID NO: 633026 - RNA, 18 nt, Human
uucauggagggucaagac

SEQ ID NO: 633027 - RNA, 19 nt, Human
uuccaaagaagaugcuaug

SEQ ID NO: 633028 - RNA, 18 nt, Human
uucuaggaaucacuggau

SEQ ID NO: 633029 - RNA, 24 nt, Human
uucucuggcuauaucccauucuag

SEQ ID NO: 633030 - RNA, 20 nt, Human
uugaucccaaugggucagaa

SEQ ID NO: 633031 - RNA, 19 nt, Human
uuguggggugugguccaau

SEQ ID NO: 633032 - RNA, 24 nt, Human
uuuuuaaagcuuauuagcucauuu

SEQ ID NO: 633033 - RNA, 21 nt, Human
uuuuuuuuuuuuuuuuuaaag

SEQ ID NO: 633034 - RNA, 19 nt, Human
aagcacccccuauguccaa

SEQ ID NO: 633035 - RNA, 18 nt, Human
aaggucccguagcacgug

SEQ ID NO: 633036 - RNA, 22 nt, Human
acagauuugggaacugaaguuu

SEQ ID NO: 633037 - RNA, 21 nt, Human
acugcucccucugcuccccug

SEQ ID NO: 633038 - RNA, 23 nt, Human
agaagaugaggggaugggaggac

SEQ ID NO: 633039 - RNA, 29 nt, Human
agacagugagauaauucaaaagggacccc

SEQ ID NO: 633040 - RNA, 20 nt, Human
aggaggcaggucugggacca

SEQ ID NO: 633041 - RNA, 18 nt, Human
aggggaugggaggacucu

SEQ ID NO: 633042 - RNA, 20 nt, Human
auaguaguggagaagaugag

SEQ ID NO: 633043 - RNA, 21 nt, Human
caagcacaugggcucugugug

SEQ ID NO: 633044 - RNA, 24 nt, Human
caagcacaugggcucugugugggc

SEQ ID NO: 633045 - RNA, 18 nt, Human
caaggcggagaagccaga

SEQ ID NO: 633046 - RNA, 25 nt, Human
cacaaggcggagaagccagauuuca

SEQ ID NO: 633047 - RNA, 18 nt, Human
cacucaaaaaccuuacag

SEQ ID NO: 633048 - RNA, 22 nt, Human
cagucagucucuuaugaaaucu

SEQ ID NO: 633049 - RNA, 26 nt, Human
ccacugagaccaagacugggaguaga

SEQ ID NO: 633050 - RNA, 20 nt, Human
cccguagcacgugguguugu

SEQ ID NO: 633051 - RNA, 21 nt, Human
cccucugcuccccuggccuca

SEQ ID NO: 633052 - RNA, 20 nt, Human
cgacagugaaggaauuucac

SEQ ID NO: 633053 - RNA, 18 nt, Human
cucagaaucugggcaaga

SEQ ID NO: 633054 - RNA, 20 nt, Human
cucuggucagucugauuccc

SEQ ID NO: 633055 - RNA, 24 nt, Human
cugcuccccuggccucacccuugu

SEQ ID NO: 633056 - RNA, 18 nt, Human
cuugcugcaaguuccaca

SEQ ID NO: 633057 - RNA, 18 nt, Human
cuuuagaugcuaccucac

SEQ ID NO: 633058 - RNA, 21 nt, Human
gcucuaggaggcaggucuggg

SEQ ID NO: 633059 - RNA, 19 nt, Human
gcugcaaguuccacaaggc

SEQ ID NO: 633060 - RNA, 22 nt, Human
ggaccagugcgggaagcuagca

SEQ ID NO: 633061 - RNA, 21 nt, Human
ggcucuaggaggcaggucugg

SEQ ID NO: 633062 - RNA, 20 nt, Human
ggggaugggaggacucuucg

SEQ ID NO: 633063 - RNA, 19 nt, Human
gucugggaccagugcggga

SEQ ID NO: 633064 - RNA, 24 nt, Human
uaaauuaguagcagucagucucuu

SEQ ID NO: 633065 - RNA, 18 nt, Human
uaaccacauccacgacag

SEQ ID NO: 633066 - RNA, 18 nt, Human
uaaggaaaguguuguuau

SEQ ID NO: 633067 - RNA, 25 nt, Human
uagaauaauaaccacauccacgaca

SEQ ID NO: 633068 - RNA, 21 nt, Human
uccagucuacagauaaagaaa

SEQ ID NO: 633069 - RNA, 22 nt, Human
ucccguagcacgugguguugug

SEQ ID NO: 633070 - RNA, 21 nt, Human
ucccucugcuccccuggccuc

SEQ ID NO: 633071 - RNA, 23 nt, Human
ugaaaugcagaauuuuauagaga

SEQ ID NO: 633072 - RNA, 22 nt, Human
ugaaugacuaugcaguggacug

SEQ ID NO: 633073 - RNA, 19 nt, Human
ugaggggaugggaggacuc

SEQ ID NO: 633074 - RNA, 20 nt, Human
ugaggggaugggaggacucu

SEQ ID NO: 633075 - RNA, 24 nt, Human
ugaguggaggcuccugcauucuuu

SEQ ID NO: 633076 - RNA, 19 nt, Human
ugcuccccuggccucaccc

SEQ ID NO: 633077 - RNA, 22 nt, Human
uggcuuucagaaaagcaccccc

SEQ ID NO: 633078 - RNA, 26 nt, Human
ugggaccagugcgggaagcuagcagg

SEQ ID NO: 633079 - RNA, 24 nt, Human
uguggggguaaguggcuugcugca

SEQ ID NO: 633080 - RNA, 19 nt, Human
uuccugcagugaguggagg

SEQ ID NO: 633081 - RNA, 23 nt, Human
uuuguggggguaaguggcuugcu

SEQ ID NO: 633082 - RNA, 18 nt, Human
uuuuuuuuuuuuuuuuug

SEQ ID NO: 633083 - RNA, 21 nt, Human
uuuuuuuuuuuuuuuuugcuu

SEQ ID NO: 633084 - RNA, 25 nt, Human
uuuuuuuuuuuuuuuuuuugcuuga

SEQ ID NO: 633085 - RNA, 27 nt, Human
acugagcuugcaugucagacacacauu

SEQ ID NO: 633086 - RNA, 19 nt, Human
caauccacgggucucugcc

SEQ ID NO: 633087 - RNA, 22 nt, Human
cagcaauccacgggucucugcc

SEQ ID NO: 633088 - RNA, 21 nt, Human
ccgcgcccgcccguccggccc

SEQ ID NO: 633089 - RNA, 19 nt, Human
ccgcggccugggccgggcu

SEQ ID NO: 633090 - RNA, 22 nt, Human
ccgcggccugggccgggcucug

SEQ ID NO: 633091 - RNA, 22 nt, Human
cgcagggauccgcgcccgcccg

SEQ ID NO: 633092 - RNA, 18 nt, Human
cgggaccagggaggccgg

SEQ ID NO: 633093 - RNA, 26 nt, Human
cuugcaucccuucccaggcgggacca

SEQ ID NO: 633094 - RNA, 18 nt, Human
gguccggagggcagggca

SEQ ID NO: 633095 - RNA, 22 nt, Human
uaaaauggaaagguaaagaaug

SEQ ID NO: 633096 - RNA, 28 nt, Human
ucagacacacauuuucagcgggacgcag

SEQ ID NO: 633097 - RNA, 24 nt, Human
uccacgggucucugccccacugag

SEQ ID NO: 633098 - RNA, 27 nt, Human
uccgcggccugggccgggcucugaggc

SEQ ID NO: 633099 - RNA, 21 nt, Human
ugaggcgccaggacccgaggg

SEQ ID NO: 633100 - RNA, 18 nt, Human
ugggccgggcucugaggc

SEQ ID NO: 633101 - RNA, 21 nt, Human
aaaaaaaccaucuaaaagugg

SEQ ID NO: 633102 - RNA, 19 nt, Human
aaacacugucugccaaaag

SEQ ID NO: 633103 - RNA, 27 nt, Human
ccaaaaguaauuuuaccaguuuuuuuu

SEQ ID NO: 633104 - RNA, 19 nt, Human
uaagguacauuugaguaga

SEQ ID NO: 633105 - RNA, 23 nt, Human
ucagcagcgcacgugccucuucc

SEQ ID NO: 633106 - RNA, 18 nt, Human
uccaaaggaagaaauuuc

SEQ ID NO: 633107 - RNA, 24 nt, Human
uuuaauauauauauuuuuuccaaa

SEQ ID NO: 633108 - RNA, 28 nt, Human
uuuuaccaguuuuuuuuuuuuuuuuaaa

SEQ ID NO: 633109 - RNA, 21 nt, Human
uuuuuuaauauauauauuuuu

SEQ ID NO: 633110 - RNA, 20 nt, Human
aaaaagaccaaacauguaaa

SEQ ID NO: 633111 - RNA, 22 nt, Human
aaacugguaucuccacauucuc

SEQ ID NO: 633112 - RNA, 24 nt, Human
aagggggugggguagagaugggaa

SEQ ID NO: 633113 - RNA, 23 nt, Human
acaaaaaaagaccaaacauguaa

SEQ ID NO: 633114 - RNA, 25 nt, Human
acaaaccaaaacaaaaaaagaccaa

SEQ ID NO: 633115 - RNA, 20 nt, Human
accccccacccaaacuggua

SEQ ID NO: 633116 - RNA, 22 nt, Human
acccucacuugcucaggcuucu

SEQ ID NO: 633117 - RNA, 20 nt, Human
acccuggucacaaacccuag

SEQ ID NO: 633118 - RNA, 24 nt, Human
agagggggcaggagugacucugag

SEQ ID NO: 633119 - RNA, 20 nt, Human
agcuucaaaggccaguccca

SEQ ID NO: 633120 - RNA, 23 nt, Human
aggcugggggccaaggggguggg

SEQ ID NO: 633121 - RNA, 19 nt, Human
agggggugggguagagaug

SEQ ID NO: 633122 - RNA, 24 nt, Human
augaagacauaccaggcucugucc

SEQ ID NO: 633123 - RNA, 21 nt, Human
auucaagcucauccagacccu

SEQ ID NO: 633124 - RNA, 21 nt, Human
caaaaaaagaccaaacaugua

SEQ ID NO: 633125 - RNA, 27 nt, Human
caaaaaaagaccaaacauguaaaaacc

SEQ ID NO: 633126 - RNA, 20 nt, Human
caaaacaaaaaaagaccaaa

SEQ ID NO: 633127 - RNA, 21 nt, Human
caaaacaaaaaaagaccaaac

SEQ ID NO: 633128 - RNA, 23 nt, Human
caaaccaaaacaaaaaaagacca

SEQ ID NO: 633129 - RNA, 24 nt, Human
caaaccaaaacaaaaaaagaccaa

SEQ ID NO: 633130 - RNA, 25 nt, Human
caaaccaaaacaaaaaaagaccaaa

SEQ ID NO: 633131 - RNA, 25 nt, Human
caccccccacccaaacugguaucuc

SEQ ID NO: 633132 - RNA, 20 nt, Human
ccaaaacaaaaaaagaccaa

SEQ ID NO: 633133 - RNA, 26 nt, Human
ccaccccaucccuggccagagcuuca

SEQ ID NO: 633134 - RNA, 22 nt, Human
ccccaccccaucccuggccaga

SEQ ID NO: 633135 - RNA, 18 nt, Human
ccucuucuccuccuucuu

SEQ ID NO: 633136 - RNA, 23 nt, Human
ccuggccagagcuucaaaggcca

SEQ ID NO: 633137 - RNA, 24 nt, Human
cgggccgggcgcucaggccgcgcc

SEQ ID NO: 633138 - RNA, 21 nt, Human
cuagccuuccucuucuccucc

SEQ ID NO: 633139 - RNA, 22 nt, Human
cucccuagguccccuggugauc

SEQ ID NO: 633140 - RNA, 20 nt, Human
cuuuuggcccccaccccauc

SEQ ID NO: 633141 - RNA, 19 nt, Human
gagaugggaugaagagagg

SEQ ID NO: 633142 - RNA, 22 nt, Human
gaucaccccccacccaaacugg

SEQ ID NO: 633143 - RNA, 18 nt, Human
gcgccgaggagggacggc

SEQ ID NO: 633144 - RNA, 18 nt, Human
gcgccgaggagggacggc

SEQ ID NO: 633145 - RNA, 23 nt, Human
gcgcucaggccgcgccgaggagg

SEQ ID NO: 633146 - RNA, 25 nt, Human
ggcccccaccccaucccuggccaga

SEQ ID NO: 633147 - RNA, 19 nt, Human
ggccgggcgcucaggccgc

SEQ ID NO: 633148 - RNA, 22 nt, Human
ggccggggucgggccgggcgcu

SEQ ID NO: 633149 - RNA, 26 nt, Human
ggcucuguccuuuuggcccccacccc

SEQ ID NO: 633150 - RNA, 21 nt, Human
ggcugggggccaagggggugg

SEQ ID NO: 633151 - RNA, 22 nt, Human
gggggcaggagugacucugagg

SEQ ID NO: 633152 - RNA, 19 nt, Human
uccccuggugaucaccccc

SEQ ID NO: 633153 - RNA, 23 nt, Human
ucccuggccagagcuucaaaggc

SEQ ID NO: 633154 - RNA, 18 nt, Human
ucgagggugacaaaccaa

SEQ ID NO: 633155 - RNA, 23 nt, Human
ugaagacauaccaggcucugucc

SEQ ID NO: 633156 - RNA, 22 nt, Human
ugacaaaccaaaacaaaaaaag

SEQ ID NO: 633157 - RNA, 23 nt, Human
ugacaaaccaaaacaaaaaaaga

SEQ ID NO: 633158 - RNA, 19 nt, Human
uggccagagcuucaaaggc

SEQ ID NO: 633159 - RNA, 24 nt, Human
uuaguagcagguuaggguacugua

SEQ ID NO: 633160 - RNA, 23 nt, Human
uucaaauucaagcucauccagac

SEQ ID NO: 633161 - RNA, 18 nt, Human
uuuuuuuuuuuuuuuuug

SEQ ID NO: 633162 - RNA, 21 nt, Human
uuuuuuuuuuuuuuuuuggau

SEQ ID NO: 633163 - RNA, 25 nt, Human
aacuggcuugggaccccuuguucac

SEQ ID NO: 633164 - RNA, 18 nt, Human
acaccgaggccccgaggg

SEQ ID NO: 633165 - RNA, 22 nt, Human
acacugagaccucaggcccagc

SEQ ID NO: 633166 - RNA, 22 nt, Human
acagggagcaggagaaacggaa

SEQ ID NO: 633167 - RNA, 22 nt, Human
accccacaggcacuggucagcc

SEQ ID NO: 633168 - RNA, 18 nt, Human
agaccagaccaggggcag

SEQ ID NO: 633169 - RNA, 21 nt, Human
agaccaggccugacacccggc

SEQ ID NO: 633170 - RNA, 22 nt, Human
aggcacuggucagccauagaag

SEQ ID NO: 633171 - RNA, 21 nt, Human
agggaguguugucagcccagg

SEQ ID NO: 633172 - RNA, 23 nt, Human
aggggcaagaagagagagagcag

SEQ ID NO: 633173 - RNA, 18 nt, Human
agucaccccacaggcacu

SEQ ID NO: 633174 - RNA, 22 nt, Human
auccaggccccgagaacaccga

SEQ ID NO: 633175 - RNA, 20 nt, Human
caaggggguggucuuggaau

SEQ ID NO: 633176 - RNA, 21 nt, Human
cacacugagaccucaggccca

SEQ ID NO: 633177 - RNA, 18 nt, Human
cagagucuucugcuggug

SEQ ID NO: 633178 - RNA, 19 nt, Human
cagagucuucugcuggugc

SEQ ID NO: 633179 - RNA, 21 nt, Human
caggccccgagaacaccgagg

SEQ ID NO: 633180 - RNA, 19 nt, Human
ccaggccccgagaacaccg

SEQ ID NO: 633181 - RNA, 24 nt, Human
ccaggccccgagaacaccgaggcc

SEQ ID NO: 633182 - RNA, 23 nt, Human
cccacaggcacuggucagccaua

SEQ ID NO: 633183 - RNA, 18 nt, Human
cccaccugaggcaaggag

SEQ ID NO: 633184 - RNA, 23 nt, Human
cccagaccucccucuaggaggca

SEQ ID NO: 633185 - RNA, 24 nt, Human
ccccagaggcuguauccaggcccc

SEQ ID NO: 633186 - RNA, 22 nt, Human
cccucuaggaggcaggggcaag

SEQ ID NO: 633187 - RNA, 21 nt, Human
ccugggucuucugcugcucuc

SEQ ID NO: 633188 - RNA, 24 nt, Human
cgagaacaccgaggccccgaggga

SEQ ID NO: 633189 - RNA, 27 nt, Human
cgagaacaccgaggccccgagggacug

SEQ ID NO: 633190 - RNA, 19 nt, Human
cuaggaggcaggggcaaga

SEQ ID NO: 633191 - RNA, 24 nt, Human
cuccacacugagaccucaggcccc

SEQ ID NO: 633192 - RNA, 22 nt, Human
cugcugccuccagagucuucug

SEQ ID NO: 633193 - RNA, 19 nt, Human
gaacccagaccucccucua

SEQ ID NO: 633194 - RNA, 22 nt, Human
gaccccuuguucacucuggcau

SEQ ID NO: 633195 - RNA, 20 nt, Human
gccauagaagggaacccaga

SEQ ID NO: 633196 - RNA, 23 nt, Human
gccuggacgggccugagagacca

SEQ ID NO: 633197 - RNA, 22 nt, Human
ggcaaggaggucccaggagagg

SEQ ID NO: 633198 - RNA, 22 nt, Human
gggcaagaagagagagagcagc

SEQ ID NO: 633199 - RNA, 25 nt, Human
uccacacugagaccucaggcccagc

SEQ ID NO: 633200 - RNA, 27 nt, Human
uccaggccccgagaacaccgaggcccc

SEQ ID NO: 633201 - RNA, 18 nt, Human
ucccaggagagggagugu

SEQ ID NO: 633202 - RNA, 20 nt, Human
ucccucuaggaggcaggggc

SEQ ID NO: 633203 - RNA, 21 nt, Human
ucccucuaggaggcaggggca

SEQ ID NO: 633204 - RNA, 27 nt, Human
ugggccuggacgggccugagagaccag

SEQ ID NO: 633205 - RNA, 19 nt, Human
ugggggagaccagaccagg

SEQ ID NO: 633206 - RNA, 21 nt, Human
ugucacagggagggagggagc

SEQ ID NO: 633207 - RNA, 24 nt, Human
uuccugggucuucugcugcucucc

SEQ ID NO: 633208 - RNA, 20 nt, Human
uuugaacacccaccugaggc

SEQ ID NO: 633209 - RNA, 23 nt, Human
uuugggggagaccagaccagggg

SEQ ID NO: 633210 - RNA, 24 nt, Human
uuuugggggagaccagaccagggg

SEQ ID NO: 633211 - RNA, 22 nt, Human
aaagugcugggauuacaggcau

SEQ ID NO: 633212 - RNA, 24 nt, Human
aaagugcugggauuacaggcauga

SEQ ID NO: 633213 - RNA, 23 nt, Human
aagagaagaaggaagcgccaggg

SEQ ID NO: 633214 - RNA, 19 nt, Human
aagugcugggauuacaggc

SEQ ID NO: 633215 - RNA, 21 nt, Human
aagugcugggauuacaggcau

SEQ ID NO: 633216 - RNA, 24 nt, Human
accauguuggccaggcuugucuug

SEQ ID NO: 633217 - RNA, 22 nt, Human
agagaagaaggaagcgccaggg

SEQ ID NO: 633218 - RNA, 24 nt, Human
agagauucuccugccucagccucc

SEQ ID NO: 633219 - RNA, 21 nt, Human
agggaaagagccgcaccccca

SEQ ID NO: 633220 - RNA, 23 nt, Human
aguagcugagaugacgggcgugu

SEQ ID NO: 633221 - RNA, 19 nt, Human
agugcaguggugugaucuu

SEQ ID NO: 633222 - RNA, 21 nt, Human
agugcaguggugugaucuuag

SEQ ID NO: 633223 - RNA, 23 nt, Human
agugcaguggugugaucuuagcu

SEQ ID NO: 633224 - RNA, 24 nt, Human
agugcaguggugugaucuuagcuc

SEQ ID NO: 633225 - RNA, 18 nt, Human
agugcugggauuacaggc

SEQ ID NO: 633226 - RNA, 19 nt, Human
agugcugggauuacaggca

SEQ ID NO: 633227 - RNA, 18 nt, Human
augggguuucaccauguu

SEQ ID NO: 633228 - RNA, 22 nt, Human
augggguuucaccauguuggcc

SEQ ID NO: 633229 - RNA, 23 nt, Human
augggguuucaccauguuggcca

SEQ ID NO: 633230 - RNA, 24 nt, Human
augggguuucaccauguuggccag

SEQ ID NO: 633231 - RNA, 24 nt, Human
auuuugguauuuuuaguagagaug

SEQ ID NO: 633232 - RNA, 22 nt, Human
caagagauucuccugccucagc

SEQ ID NO: 633233 - RNA, 22 nt, Human
caccauguuggccaggcuuguc

SEQ ID NO: 633234 - RNA, 23 nt, Human
caccauguuggccaggcuugucu

SEQ ID NO: 633235 - RNA, 24 nt, Human
caccauguuggccaggcuugucuu

SEQ ID NO: 633236 - RNA, 24 nt, Human
cacccuucuuggccuccgaaagug

SEQ ID NO: 633237 - RNA, 21 nt, Human
cacugcaaccuccgccuccca

SEQ ID NO: 633238 - RNA, 20 nt, Human
cagccuccugaguagcugag

SEQ ID NO: 633239 - RNA, 20 nt, Human
cccuucuuggccuccgaaag

SEQ ID NO: 633240 - RNA, 23 nt, Human
ccgaaagugcugggauuacaggc

SEQ ID NO: 633241 - RNA, 24 nt, Human
ccucccaaguucaagagauucucc

SEQ ID NO: 633242 - RNA, 19 nt, Human
ccucucacuacugcagcca

SEQ ID NO: 633243 - RNA, 24 nt, Human
ccugccucagccuccugaguagcu

SEQ ID NO: 633244 - RNA, 24 nt, Human
cgaaagugcugggauuacaggcau

SEQ ID NO: 633245 - RNA, 24 nt, Human
cucacugcaaccuccgccucccaa

SEQ ID NO: 633246 - RNA, 22 nt, Human
cucuccgccggaagagaagaag

SEQ ID NO: 633247 - RNA, 23 nt, Human
cugcaaccuccgccucccaaguu

SEQ ID NO: 633248 - RNA, 24 nt, Human
gaaagugcugggauuacaggcaug

SEQ ID NO: 633249 - RNA, 22 nt, Human
gaagagaagaaggaagcgccag

SEQ ID NO: 633250 - RNA, 18 nt, Human
gagaugggguuucaccau

SEQ ID NO: 633251 - RNA, 24 nt, Human
gagaugggguuucaccauguuggc

SEQ ID NO: 633252 - RNA, 21 nt, Human
gagccgcacccccagccucuc

SEQ ID NO: 633253 - RNA, 18 nt, Human
gauuacaggcaugaggca

SEQ ID NO: 633254 - RNA, 22 nt, Human
gauuacaggcaugaggcaccgc

SEQ ID NO: 633255 - RNA, 21 nt, Human
gauucuccugccucagccucc

SEQ ID NO: 633256 - RNA, 22 nt, Human
gcaaccuccgccucccaaguuc

SEQ ID NO: 633257 - RNA, 24 nt, Human
gcccuggcuggagugcaguggugu

SEQ ID NO: 633258 - RNA, 20 nt, Human
gccucagccuccugaguagc

SEQ ID NO: 633259 - RNA, 22 nt, Human
ggauuacaggcaugaggcaccg

SEQ ID NO: 633260 - RNA, 18 nt, Human
ggccuccgaaagugcugg

SEQ ID NO: 633261 - RNA, 22 nt, Human
gggguuucaccauguuggccag

SEQ ID NO: 633262 - RNA, 22 nt, Human
ggguuucaccauguuggccagg

SEQ ID NO: 633263 - RNA, 23 nt, Human
guagagaugggguuucaccaugu

SEQ ID NO: 633264 - RNA, 19 nt, Human
gugcugggauuacaggcau

SEQ ID NO: 633265 - RNA, 23 nt, Human
uaauuuugguauuuuuaguagag

SEQ ID NO: 633266 - RNA, 24 nt, Human
uaauuuugguauuuuuaguagaga

SEQ ID NO: 633267 - RNA, 22 nt, Human
uagagaugggguuucaccaugu

SEQ ID NO: 633268 - RNA, 24 nt, Human
uaguagagaugggguuucaccaug

SEQ ID NO: 633269 - RNA, 26 nt, Human
uaguagagaugggguuucaccauguu

SEQ ID NO: 633270 - RNA, 21 nt, Human
ucaagccacccuucuuggccu

SEQ ID NO: 633271 - RNA, 18 nt, Human
ucacugcaaccuccgccu

SEQ ID NO: 633272 - RNA, 19 nt, Human
ucacugcaaccuccgccuc

SEQ ID NO: 633273 - RNA, 24 nt, Human
ucacugcaaccuccgccucccaag

SEQ ID NO: 633274 - RNA, 27 nt, Human
ucacugcaaccuccgccucccaaguuc

SEQ ID NO: 633275 - RNA, 21 nt, Human
ucccaaguucaagagauucuc

SEQ ID NO: 633276 - RNA, 24 nt, Human
ucccaaguucaagagauucuccug

SEQ ID NO: 633277 - RNA, 24 nt, Human
uccgaaagugcugggauuacaggc

SEQ ID NO: 633278 - RNA, 24 nt, Human
uccugaguagcugagaugacgggc

SEQ ID NO: 633279 - RNA, 22 nt, Human
ucucacuguugcccuggcugga

SEQ ID NO: 633280 - RNA, 24 nt, Human
ucucacuguugcccuggcuggagu

SEQ ID NO: 633281 - RNA, 24 nt, Human
ucuccugccucagccuccugagua

SEQ ID NO: 633282 - RNA, 21 nt, Human
ugcccuggcuggagugcagug

SEQ ID NO: 633283 - RNA, 24 nt, Human
ugcccuggcuggagugcaguggug

SEQ ID NO: 633284 - RNA, 24 nt, Human
ugccucagccuccugaguagcuga

SEQ ID NO: 633285 - RNA, 24 nt, Human
ugcugggauuacaggcaugaggca

SEQ ID NO: 633286 - RNA, 19 nt, Human
uggagugcaguggugugau

SEQ ID NO: 633287 - RNA, 23 nt, Human
uggagugcaguggugugaucuua

SEQ ID NO: 633288 - RNA, 24 nt, Human
uggagugcaguggugugaucuuag

SEQ ID NO: 633289 - RNA, 24 nt, Human
uggccaggcuugucuugagcuccu

SEQ ID NO: 633290 - RNA, 23 nt, Human
uggcuggagugcaguggugugau

SEQ ID NO: 633291 - RNA, 18 nt, Human
ugggauuacaggcaugag

SEQ ID NO: 633292 - RNA, 18 nt, Human
ugggauuacaggcaugag

SEQ ID NO: 633293 - RNA, 19 nt, Human
ugggauuacaggcaugagg

SEQ ID NO: 633294 - RNA, 21 nt, Human
ugggauuacaggcaugaggca

SEQ ID NO: 633295 - RNA, 22 nt, Human
ugggauuacaggcaugaggcac

SEQ ID NO: 633296 - RNA, 23 nt, Human
ugggauuacaggcaugaggcacc

SEQ ID NO: 633297 - RNA, 24 nt, Human
ugggauuacaggcaugaggcaccg

SEQ ID NO: 633298 - RNA, 24 nt, Human
ugggguuucaccauguuggccagg

SEQ ID NO: 633299 - RNA, 24 nt, Human
uggugugaucuuagcucacugcaa

SEQ ID NO: 633300 - RNA, 19 nt, Human
uguagaacuugaauaucuc

SEQ ID NO: 633301 - RNA, 19 nt, Human
ugucuugagcuccugaucu

SEQ ID NO: 633302 - RNA, 20 nt, Human
uuacaggcaugaggcaccgc

SEQ ID NO: 633303 - RNA, 27 nt, Human
uuagcucacugcaaccuccgccuccca

SEQ ID NO: 633304 - RNA, 18 nt, Human
uuaguagagaugggguuu

SEQ ID NO: 633305 - RNA, 22 nt, Human
uuaguagagaugggguuucacc

SEQ ID NO: 633306 - RNA, 24 nt, Human
uuaguagagaugggguuucaccau

SEQ ID NO: 633307 - RNA, 18 nt, Human
uucaagagauucuccugc

SEQ ID NO: 633308 - RNA, 23 nt, Human
uucaagagauucuccugccucag

SEQ ID NO: 633309 - RNA, 24 nt, Human
uugcccuggcuggagugcaguggu

SEQ ID NO: 633310 - RNA, 24 nt, Human
uuucaccauguuggccaggcuugu

SEQ ID NO: 633311 - RNA, 24 nt, Human
uuuuuaguagagaugggguuucac

SEQ ID NO: 633312 - RNA, 31 nt, Human
uuuuuuuuuuugaacauuuauuuauuuauuu

SEQ ID NO: 633313 - RNA, 20 nt, Human
uuuuuuuuuuuuuuuuuugg

SEQ ID NO: 633314 - RNA, 19 nt, Human
aaaaaugccaaucuaugga

SEQ ID NO: 633315 - RNA, 20 nt, Human
aagaaagacaaaucuaugga

SEQ ID NO: 633316 - RNA, 23 nt, Human
aagacaagugucaaaaugggaug

SEQ ID NO: 633317 - RNA, 23 nt, Human
cauaguaauagcuaaaaaugcca

SEQ ID NO: 633318 - RNA, 21 nt, Human
cuaaaaaugccaaucuaugga

SEQ ID NO: 633319 - RNA, 24 nt, Human
uaaaaaugccaaucuauggaagca

SEQ ID NO: 633320 - RNA, 18 nt, Human
ugcuauguuauacaucuu

SEQ ID NO: 633321 - RNA, 23 nt, Human
uugaagaaagacaaaucuaugga

SEQ ID NO: 633322 - RNA, 20 nt, Human
uuuuauuucaguagucaaug

SEQ ID NO: 633323 - RNA, 22 nt, Human
uuuugcuauguuauacaucuuu

SEQ ID NO: 633324 - RNA, 18 nt, Human
accccugacgcugggcgg

SEQ ID NO: 633325 - RNA, 20 nt, Human
accucuucgccuccgcagcc

SEQ ID NO: 633326 - RNA, 24 nt, Human
acgggaacaccagguccaucccuu

SEQ ID NO: 633327 - RNA, 21 nt, Human
aguucaacacacaggggagcc

SEQ ID NO: 633328 - RNA, 18 nt, Human
ccacggauucuggucccu

SEQ ID NO: 633329 - RNA, 21 nt, Human
ccagagcggacgccacgccgc

SEQ ID NO: 633330 - RNA, 23 nt, Human
ccaggcgccccuccgcguuagcc

SEQ ID NO: 633331 - RNA, 20 nt, Human
ccaucccuucccacggauuc

SEQ ID NO: 633332 - RNA, 22 nt, Human
ccuccaggcgccccuccgcguu

SEQ ID NO: 633333 - RNA, 24 nt, Human
ccuccgagacgcuggucccagcuc

SEQ ID NO: 633334 - RNA, 24 nt, Human
cgcgucacccuccugcauaguuca

SEQ ID NO: 633335 - RNA, 18 nt, Human
cgcugggcggggcaaggg

SEQ ID NO: 633336 - RNA, 20 nt, Human
cugccaccucuucgccuccg

SEQ ID NO: 633337 - RNA, 18 nt, Human
gaguucuccauacauucc

SEQ ID NO: 633338 - RNA, 21 nt, Human
gccgccuccaggcgccccucc

SEQ ID NO: 633339 - RNA, 20 nt, Human
gcucgcgcugccaccucuuc

SEQ ID NO: 633340 - RNA, 19 nt, Human
ggagcccucucacccagcc

SEQ ID NO: 633341 - RNA, 20 nt, Human
ggaguucuccauacauuccu

SEQ ID NO: 633342 - RNA, 18 nt, Human
ggcacugugguuacagaa

SEQ ID NO: 633343 - RNA, 18 nt, Human
gggaacgggaacaccagg

SEQ ID NO: 633344 - RNA, 19 nt, Human
ggggaugguucucggggag

SEQ ID NO: 633345 - RNA, 19 nt, Human
ucacccagccuucagggcc

SEQ ID NO: 633346 - RNA, 19 nt, Human
ucagaugggaacgggaaca

SEQ ID NO: 633347 - RNA, 19 nt, Human
ucagggccacaugcccaug

SEQ ID NO: 633348 - RNA, 19 nt, Human
ucaguccuugcaaagucca

SEQ ID NO: 633349 - RNA, 24 nt, Human
ucugcggcgccuccgagacgcugg

SEQ ID NO: 633350 - RNA, 21 nt, Human
ugaaauguguccgcgucaccc

SEQ ID NO: 633351 - RNA, 25 nt, Human
uuacucuuccccuuuuauuacgaaa

SEQ ID NO: 633352 - RNA, 18 nt, Human
uuuuuuuuuuuuuuuuug

SEQ ID NO: 633353 - RNA, 23 nt, Human
uuuuuuuuuuuuuuuuugucuuu

SEQ ID NO: 633354 - RNA, 21 nt, Human
acaaggcagugaagcagcaaa

SEQ ID NO: 633355 - RNA, 21 nt, Human
agaaggauccaagugugagaa

SEQ ID NO: 633356 - RNA, 21 nt, Human
aggugguuaucccgaaagagc

SEQ ID NO: 633357 - RNA, 21 nt, Human
agugaagcagcaaaagugaaa

SEQ ID NO: 633358 - RNA, 24 nt, Human
aucaucaucuccccauucccccaa

SEQ ID NO: 633359 - RNA, 21 nt, Human
auucccccaaucucucccuca

SEQ ID NO: 633360 - RNA, 19 nt, Human
cacccuauguaaaugaaag

SEQ ID NO: 633361 - RNA, 20 nt, Human
cagccaauuagagacugagg

SEQ ID NO: 633362 - RNA, 18 nt, Human
cauuccacagggugggag

SEQ ID NO: 633363 - RNA, 21 nt, Human
ccaauuagagacugaggugaa

SEQ ID NO: 633364 - RNA, 25 nt, Human
cccaaucucucccucaacuacuucu

SEQ ID NO: 633365 - RNA, 25 nt, Human
ccccaaucucucccucaacuacuuc

SEQ ID NO: 633366 - RNA, 27 nt, Human
ccccaaucucucccucaacuacuucua

SEQ ID NO: 633367 - RNA, 23 nt, Human
ccccauucccccaaucucucccu

SEQ ID NO: 633368 - RNA, 19 nt, Human
cccccaaucucucccucaa

SEQ ID NO: 633369 - RNA, 18 nt, Human
cccgaaagagcugucuuc

SEQ ID NO: 633370 - RNA, 18 nt, Human
cugaggugaauuggcuca

SEQ ID NO: 633371 - RNA, 22 nt, Human
gcaaaaucuucuggggcuuaag

SEQ ID NO: 633372 - RNA, 18 nt, Human
gcaggucuggcccauggc

SEQ ID NO: 633373 - RNA, 22 nt, Human
gguguaaggaagaacagaagga

SEQ ID NO: 633374 - RNA, 22 nt, Human
guagcaaaaucuucuggggcuu

SEQ ID NO: 633375 - RNA, 21 nt, Human
uacccuauucuccugccucag

SEQ ID NO: 633376 - RNA, 21 nt, Human
uacccuauucuccugccucag

SEQ ID NO: 633377 - RNA, 21 nt, Human
uagcaaaaucuucuggggcuu

SEQ ID NO: 633378 - RNA, 19 nt, Human
uauucuccugccucagucu

SEQ ID NO: 633379 - RNA, 20 nt, Human
ucacaggccaguguucagac

SEQ ID NO: 633380 - RNA, 24 nt, Human
ucagacucuucagugccagggagu

SEQ ID NO: 633381 - RNA, 24 nt, Human
ucaggugguuaucccgaaagagcu

SEQ ID NO: 633382 - RNA, 22 nt, Human
uccaagacuggugugguuugac

SEQ ID NO: 633383 - RNA, 18 nt, Human
uccccauucccccaaucu

SEQ ID NO: 633384 - RNA, 19 nt, Human
ucugcagguaucagguggu

SEQ ID NO: 633385 - RNA, 23 nt, Human
ugaagcagcaaaagugaaaguac

SEQ ID NO: 633386 - RNA, 18 nt, Human
ugaauuggcucacagcca

SEQ ID NO: 633387 - RNA, 22 nt, Human
ugaccaucaucaucaucucccu

SEQ ID NO: 633388 - RNA, 20 nt, Human
ugaggugaauuggcucacag

SEQ ID NO: 633389 - RNA, 22 nt, Human
uggaauggaccaaucacaggcc

SEQ ID NO: 633390 - RNA, 18 nt, Human
uggaccaaucacaggcca

SEQ ID NO: 633391 - RNA, 22 nt, Human
uggugugguuugacuccuuaug

SEQ ID NO: 633392 - RNA, 20 nt, Human
uguaaaugaaagacugacuc

SEQ ID NO: 633393 - RNA, 23 nt, Human
uguaaggaagaacagaaggaucc

SEQ ID NO: 633394 - RNA, 21 nt, Human
uuagaucccuaucucuguacc

SEQ ID NO: 633395 - RNA, 19 nt, Human
uuuuuuuuuuuggguggug

SEQ ID NO: 633396 - RNA, 20 nt, Human
uuuuuuuuuuuuuugggugg

SEQ ID NO: 633397 - RNA, 21 nt, Human
uuuuuuuuuuuuuuuuugggu

SEQ ID NO: 633398 - RNA, 24 nt, Human
uuuuuuuuuuuuuuuuuuuuuggg

SEQ ID NO: 633399 - RNA, 23 nt, Human
accccaggcgcaggcuggagagc

SEQ ID NO: 633400 - RNA, 18 nt, Human
ccgggacucaaagaccgu

SEQ ID NO: 633401 - RNA, 23 nt, Human
cucagcaucaucucagauuccgg

SEQ ID NO: 633402 - RNA, 21 nt, Human
cuccaaccccaggcgcaggcu

SEQ ID NO: 633403 - RNA, 19 nt, Human
cuccucgucgcuguccagc

SEQ ID NO: 633404 - RNA, 19 nt, Human
gcgcaggcuggagagcggg

SEQ ID NO: 633405 - RNA, 20 nt, Human
ggaaacgggcagcgucaccc

SEQ ID NO: 633406 - RNA, 21 nt, Human
gggccgccucccuggcucagc

SEQ ID NO: 633407 - RNA, 23 nt, Human
uccaaccccaggcgcaggcugga

SEQ ID NO: 633408 - RNA, 21 nt, Human
ucuccgugggguccucagugu

SEQ ID NO: 633409 - RNA, 20 nt, Human
ugcuggaagggccgccuccc

SEQ ID NO: 633410 - RNA, 26 nt, Human
ugggaaacgggcagcgucacccccga

SEQ ID NO: 633411 - RNA, 18 nt, Human
uuuuuuuuuuuuuuuuug

SEQ ID NO: 633412 - RNA, 21 nt, Human
uuuuuuuuuuuuuuuuugcag

SEQ ID NO: 633413 - RNA, 23 nt, Human
acccucaacgugggaaacuuugc

SEQ ID NO: 633414 - RNA, 20 nt, Human
agaccgaacaccaucgucaa

SEQ ID NO: 633415 - RNA, 21 nt, Human
ccuaagacuacauuuccauuc

SEQ ID NO: 633416 - RNA, 21 nt, Human
ccucgagacccucaacguggg

SEQ ID NO: 633417 - RNA, 19 nt, Human
cucgagacccucaacgugg

SEQ ID NO: 633418 - RNA, 20 nt, Human
cucuagacgcacuacccucc

SEQ ID NO: 633419 - RNA, 18 nt, Human
gaaccccagugccugcuc

SEQ ID NO: 633420 - RNA, 20 nt, Human
uaagacuggccuaagacuac

SEQ ID NO: 633421 - RNA, 21 nt, Human
ugccugcucuggcccucaauc

SEQ ID NO: 633422 - RNA, 24 nt, Human
uuagggaagccagcagccucuucu

SEQ ID NO: 633423 - RNA, 24 nt, Human
uuuuagggaagccagcagccucuu

SEQ ID NO: 633424 - RNA, 23 nt, Human
uuuuauuucaacuuuuagggaag

SEQ ID NO: 633425 - RNA, 25 nt, Human
uuuuuuuuuuaaaggcaaaaaucuu

SEQ ID NO: 633426 - RNA, 20 nt, Human
uuuuuuuuuuuuuaaaggca

SEQ ID NO: 633427 - RNA, 21 nt, Human
uuuuuuuuuuuuuuuuaaagg

SEQ ID NO: 633428 - RNA, 23 nt, Human
aaaaaacuaugaaagagauggaa

SEQ ID NO: 633429 - RNA, 22 nt, Human
aaaaacuaugaaagagauggaa

SEQ ID NO: 633430 - RNA, 21 nt, Human
caccccuaccagcucaggcgu

SEQ ID NO: 633431 - RNA, 23 nt, Human
cauuugcuguuuccuaccugcuc

SEQ ID NO: 633432 - RNA, 18 nt, Human
ccaaccaccaucuugauc

SEQ ID NO: 633433 - RNA, 21 nt, Human
cccgcgcagcagcuucugcau

SEQ ID NO: 633434 - RNA, 24 nt, Human
ccuucagaggcgacccaagcucac

SEQ ID NO: 633435 - RNA, 18 nt, Human
cucauaauauaagacagu

SEQ ID NO: 633436 - RNA, 18 nt, Human
cugcauuugcuguuuccu

SEQ ID NO: 633437 - RNA, 19 nt, Human
gacucccgcgcagcagcuu

SEQ ID NO: 633438 - RNA, 21 nt, Human
gcagcuucugcauuugcuguu

SEQ ID NO: 633439 - RNA, 22 nt, Human
uaccgcuaccacgcugacuggg

SEQ ID NO: 633440 - RNA, 18 nt, Human
uaucaaguguuuuauuua

SEQ ID NO: 633441 - RNA, 22 nt, Human
uccaccccuaccagcucaggcg

SEQ ID NO: 633442 - RNA, 21 nt, Human
uccuaccugcuccaccccuac

SEQ ID NO: 633443 - RNA, 26 nt, Human
ucgagggcggaagucuuggcuaaaga

SEQ ID NO: 633444 - RNA, 18 nt, Human
ucugcauuugcuguuucc

SEQ ID NO: 633445 - RNA, 20 nt, Human
ucuugaucgagggcggaagu

SEQ ID NO: 633446 - RNA, 23 nt, Human
ugacugggggaaaaaacuaugaa

SEQ ID NO: 633447 - RNA, 21 nt, Human
ugcuccaccccuaccagcuca

SEQ ID NO: 633448 - RNA, 22 nt, Human
uggaaaaugguucuccuucaga

SEQ ID NO: 633449 - RNA, 19 nt, Human
uguuuccuaccugcuccac

SEQ ID NO: 633450 - RNA, 18 nt, Human
uuuuuuuuuuuuuuuuug

SEQ ID NO: 633451 - RNA, 23 nt, Human
uuuuuuuuuuuuuuuuuuguguu

SEQ ID NO: 633452 - RNA, 27 nt, Human
aaaaugaaccaugggacucaaaaacau

SEQ ID NO: 633453 - RNA, 19 nt, Human
aacauccuaaguugcaaaa

SEQ ID NO: 633454 - RNA, 19 nt, Human
aaccuggggcggaggcggc

SEQ ID NO: 633455 - RNA, 21 nt, Human
aauacauaauggaaaaucuga

SEQ ID NO: 633456 - RNA, 22 nt, Human
acacagcuucacacgcaaaacc

SEQ ID NO: 633457 - RNA, 24 nt, Human
aggugccaggggucggcagcagcc

SEQ ID NO: 633458 - RNA, 27 nt, Human
auccucccucagccgggcuccucguca

SEQ ID NO: 633459 - RNA, 21 nt, Human
auggaaaaucugacgacauuu

SEQ ID NO: 633460 - RNA, 19 nt, Human
cacacagcuucacacgcaa

SEQ ID NO: 633461 - RNA, 19 nt, Human
cagaggccccucuggagca

SEQ ID NO: 633462 - RNA, 22 nt, Human
cagccgcgugcgccacggccag

SEQ ID NO: 633463 - RNA, 18 nt, Human
cagcggcgcauccucccu

SEQ ID NO: 633464 - RNA, 25 nt, Human
ccacggccagaggccccucuggagc

SEQ ID NO: 633465 - RNA, 20 nt, Human
ccccucuggagcauccuccc

SEQ ID NO: 633466 - RNA, 22 nt, Human
cgcaaaaccuggggcggaggcg

SEQ ID NO: 633467 - RNA, 23 nt, Human
cuucacacgcaaaaccuggggcg

SEQ ID NO: 633468 - RNA, 18 nt, Human
gcggcagcggccacgggc

SEQ ID NO: 633469 - RNA, 21 nt, Human
gcuucacacgcaaaaccuggg

SEQ ID NO: 633470 - RNA, 19 nt, Human
gucagcggcgcauccuccc

SEQ ID NO: 633471 - RNA, 18 nt, Human
ucaauacauaauggaaaa

SEQ ID NO: 633472 - RNA, 20 nt, Human
uggaaaaucugacgacauuu

SEQ ID NO: 633473 - RNA, 19 nt, Human
uggagcauccucccgcccc

SEQ ID NO: 633474 - RNA, 23 nt, Human
ugggacucaaaaacauccuaagu

SEQ ID NO: 633475 - RNA, 18 nt, Human
uuuuuuuuuuuuuuucug

SEQ ID NO: 633476 - RNA, 24 nt, Human
uuuuuuuuuuuuuuuuucuguuuu

SEQ ID NO: 633477 - RNA, 26 nt, Human
uuuuuuuuuuuuuuuuuuucuguuuu

SEQ ID NO: 633478 - RNA, 24 nt, Human
uuuuuuuuuuuuuuuuuuuuucuu

SEQ ID NO: 633479 - RNA, 20 nt, Human
aaaccucaauaaucuacacu

SEQ ID NO: 633480 - RNA, 23 nt, Human
aaacucuaacaauguugaaaaua

SEQ ID NO: 633481 - RNA, 20 nt, Human
aacaccccagcaaacaacaa

SEQ ID NO: 633482 - RNA, 20 nt, Human
aacagagaugacagacaaga

SEQ ID NO: 633483 - RNA, 25 nt, Human
aaccucaauaaucuacacuuagcau

SEQ ID NO: 633484 - RNA, 24 nt, Human
acaucuccaugaacaccccagcaa

SEQ ID NO: 633485 - RNA, 22 nt, Human
accccagcaaacaacaaaauau

SEQ ID NO: 633486 - RNA, 19 nt, Human
agacaggcugacagaccaa

SEQ ID NO: 633487 - RNA, 21 nt, Human
agacaggcugacagaccaagc

SEQ ID NO: 633488 - RNA, 19 nt, Human
agaggggagcugccuguag

SEQ ID NO: 633489 - RNA, 22 nt, Human
agcaaacaacaaaauauaucca

SEQ ID NO: 633490 - RNA, 20 nt, Human
agcaccacaccauuccccgg

SEQ ID NO: 633491 - RNA, 22 nt, Human
agccaucaauaaaaguuacuaa

SEQ ID NO: 633492 - RNA, 23 nt, Human
agcuccuggcagagagacagcuc

SEQ ID NO: 633493 - RNA, 20 nt, Human
agggacaugaaagguagcca

SEQ ID NO: 633494 - RNA, 19 nt, Human
agggagggacagcacaggg

SEQ ID NO: 633495 - RNA, 18 nt, Human
agguguuagaagacaggc

SEQ ID NO: 633496 - RNA, 19 nt, Human
agguguugagauuagcacc

SEQ ID NO: 633497 - RNA, 23 nt, Human
agguucaguuuucacauuuccag

SEQ ID NO: 633498 - RNA, 21 nt, Human
auggugcuguuucacuggauu

SEQ ID NO: 633499 - RNA, 23 nt, Human
caaauugcaauaggguucgccaa

SEQ ID NO: 633500 - RNA, 19 nt, Human
cagaaagaaagaagugaua

SEQ ID NO: 633501 - RNA, 23 nt, Human
cagaaagaaagaagugauaaacc

SEQ ID NO: 633502 - RNA, 21 nt, Human
cagagagacagcucacaccuu

SEQ ID NO: 633503 - RNA, 19 nt, Human
cagcaaacaacaaaauaua

SEQ ID NO: 633504 - RNA, 22 nt, Human
cagcaaacaacaaaauauaucc

SEQ ID NO: 633505 - RNA, 19 nt, Human
cagcugaaaagaagacugg

SEQ ID NO: 633506 - RNA, 28 nt, Human
cagcugaaaagaagacugggucagauac

SEQ ID NO: 633507 - RNA, 18 nt, Human
cauccaauccccuaauga

SEQ ID NO: 633508 - RNA, 24 nt, Human
caugcgguugggcugggccaugcu

SEQ ID NO: 633509 - RNA, 25 nt, Human
cauuuaucacacuucaaucccacuu

SEQ ID NO: 633510 - RNA, 24 nt, Human
ccaugaacaccccagcaaacaaca

SEQ ID NO: 633511 - RNA, 19 nt, Human
cccagcaaacaacaaaaua

SEQ ID NO: 633512 - RNA, 22 nt, Human
cccccagagaccagcugaaaag

SEQ ID NO: 633513 - RNA, 18 nt, Human
ccuaccacuugaaauucu

SEQ ID NO: 633514 - RNA, 19 nt, Human
ccucaauaaucuacacuua

SEQ ID NO: 633515 - RNA, 22 nt, Human
ccugguaacagcugucuucucc

SEQ ID NO: 633516 - RNA, 23 nt, Human
cuccuauuuuaaaugaguugggg

SEQ ID NO: 633517 - RNA, 22 nt, Human
cuccucacuaggcccugauuuc

SEQ ID NO: 633518 - RNA, 23 nt, Human
cuuaacaucuccaugaacacccc

SEQ ID NO: 633519 - RNA, 19 nt, Human
gagaaagguaagcauggga

SEQ ID NO: 633520 - RNA, 23 nt, Human
guaaggcaaaaagugauuccucc

SEQ ID NO: 633521 - RNA, 25 nt, Human
guagaguucaccccagaaaccaaag

SEQ ID NO: 633522 - RNA, 20 nt, Human
gugcuccucacuaggcccug

SEQ ID NO: 633523 - RNA, 21 nt, Human
uaaaaagucuggggaaaagga

SEQ ID NO: 633524 - RNA, 21 nt, Human
uaagaaauggugcuguuucac

SEQ ID NO: 633525 - RNA, 21 nt, Human
uaaugauacuaagaaauggug

SEQ ID NO: 633526 - RNA, 21 nt, Human
uacauuauauacccucagccc

SEQ ID NO: 633527 - RNA, 25 nt, Human
uagacagggacaugaaagguagcca

SEQ ID NO: 633528 - RNA, 19 nt, Human
uagcaccacaccauucccc

SEQ ID NO: 633529 - RNA, 24 nt, Human
uaggaggggaugaacagagaugac

SEQ ID NO: 633530 - RNA, 18 nt, Human
uagguucaguuuucacau

SEQ ID NO: 633531 - RNA, 19 nt, Human
ucaccccucaaaacuggaa

SEQ ID NO: 633532 - RNA, 20 nt, Human
ucacuggauuucauugauga

SEQ ID NO: 633533 - RNA, 21 nt, Human
ucauuuuagcccaaacucuaa

SEQ ID NO: 633534 - RNA, 20 nt, Human
uccaauccccuaaugaaccu

SEQ ID NO: 633535 - RNA, 20 nt, Human
uccaugaacaccccagcaaa

SEQ ID NO: 633536 - RNA, 20 nt, Human
uccccgggucugagucuugc

SEQ ID NO: 633537 - RNA, 21 nt, Human
uccccuaaugaaccuuagcuc

SEQ ID NO: 633538 - RNA, 19 nt, Human
ucccugguaacagcugucu

SEQ ID NO: 633539 - RNA, 23 nt, Human
ucccugguaacagcugucuucuc

SEQ ID NO: 633540 - RNA, 24 nt, Human
ucucuuaacaucuccaugaacacc

SEQ ID NO: 633541 - RNA, 22 nt, Human
ucugcgguuugagauagacaug

SEQ ID NO: 633542 - RNA, 21 nt, Human
ugaaaagaagacugggucaga

SEQ ID NO: 633543 - RNA, 25 nt, Human
ugaaaagaagacugggucagaucaa

SEQ ID NO: 633544 - RNA, 19 nt, Human
ugaaagagaaagucucuuu

SEQ ID NO: 633545 - RNA, 22 nt, Human
ugaacaccccagcaaacaacaa

SEQ ID NO: 633546 - RNA, 24 nt, Human
ugaacaccccagcaaacaacaaaa

SEQ ID NO: 633547 - RNA, 18 nt, Human
ugaacagagaugacagac

SEQ ID NO: 633548 - RNA, 26 nt, Human
ugacggaguguccaacagcagcaaag

SEQ ID NO: 633549 - RNA, 21 nt, Human
ugagagaauuccucauuauac

SEQ ID NO: 633550 - RNA, 26 nt, Human
ugagauagacaugcgguugggcuggg

SEQ ID NO: 633551 - RNA, 20 nt, Human
ugagauuagcaccacaccau

SEQ ID NO: 633552 - RNA, 20 nt, Human
ugaguugggguacagagggg

SEQ ID NO: 633553 - RNA, 19 nt, Human
ugcaggugcccaucccugu

SEQ ID NO: 633554 - RNA, 20 nt, Human
uggaagagaaguugagccuc

SEQ ID NO: 633555 - RNA, 27 nt, Human
uggugguuuuuuucuccuugcucauuu

SEQ ID NO: 633556 - RNA, 28 nt, Human
uuaaaugaguugggguacagagggggaa

SEQ ID NO: 633557 - RNA, 18 nt, Human
uuacaagggagggacagc

SEQ ID NO: 633558 - RNA, 24 nt, Human
uuauagguucaguuuucacauuuc

SEQ ID NO: 633559 - RNA, 27 nt, Human
uuuuaccuagagguuauaggaggggau

SEQ ID NO: 633560 - RNA, 20 nt, Human
uuuuuuuuuuuuuuuuuugg

SEQ ID NO: 633561 - RNA, 23 nt, Human
aaaaaaaaaaaggagguaaauaa

SEQ ID NO: 633562 - RNA, 23 nt, Human
aaaaaaaaaagggagguaaauaa

SEQ ID NO: 633563 - RNA, 25 nt, Human
aaaaaaaaaggagguaaauaaccag

SEQ ID NO: 633564 - RNA, 21 nt, Human
aaaaucugucaaaugccuucc

SEQ ID NO: 633565 - RNA, 23 nt, Human
aaacagacaaaaccuugucagca

SEQ ID NO: 633566 - RNA, 23 nt, Human
aaacagacaaaaccuugucagca

SEQ ID NO: 633567 - RNA, 22 nt, Human
aaacgaaccauugccaauccua

SEQ ID NO: 633568 - RNA, 21 nt, Human
aaaugccuuccuggcagcccc

SEQ ID NO: 633569 - RNA, 21 nt, Human
aagcagaccaucuccuaaugc

SEQ ID NO: 633570 - RNA, 20 nt, Human
aaggaagacagguuaucaaa

SEQ ID NO: 633571 - RNA, 20 nt, Human
aaggaagacagguuaucaaa

SEQ ID NO: 633572 - RNA, 18 nt, Human
aaugcaaaaaucaaaaaa

SEQ ID NO: 633573 - RNA, 21 nt, Human
aaugcaaaaaucaaaaaauaa

SEQ ID NO: 633574 - RNA, 22 nt, Human
acagaaaagaggaaauacugaa

SEQ ID NO: 633575 - RNA, 23 nt, Human
acagcagccgccacccgcgccac

SEQ ID NO: 633576 - RNA, 24 nt, Human
acugcaaagcuugacaaacuguag

SEQ ID NO: 633577 - RNA, 21 nt, Human
agaaaacaagcaaguguucac

SEQ ID NO: 633578 - RNA, 22 nt, Human
agcaaauguucagcuucuucca

SEQ ID NO: 633579 - RNA, 22 nt, Human
agccagcacagcagccgccacc

SEQ ID NO: 633580 - RNA, 26 nt, Human
agccggagccugugacgaccuagccg

SEQ ID NO: 633581 - RNA, 20 nt, Human
auacaaagucuccugaaaca

SEQ ID NO: 633582 - RNA, 20 nt, Human
auacaaagucuccugaaaca

SEQ ID NO: 633583 - RNA, 22 nt, Human
auaugaacaacauucaacagaa

SEQ ID NO: 633584 - RNA, 27 nt, Human
aucauguuacacagaaacaaggaagac

SEQ ID NO: 633585 - RNA, 27 nt, Human
aucauguuacacagaaacaaggaagac

SEQ ID NO: 633586 - RNA, 19 nt, Human
aucuucuguaugugcuuuc

SEQ ID NO: 633587 - RNA, 19 nt, Human
auggcacuucaccgccucc

SEQ ID NO: 633588 - RNA, 22 nt, Human
caaggucugcauacuuuuucca

SEQ ID NO: 633589 - RNA, 21 nt, Human
caaguuuuacaugaauauucu

SEQ ID NO: 633590 - RNA, 21 nt, Human
cacaaguauaacugaaacaga

SEQ ID NO: 633591 - RNA, 21 nt, Human
cacaaguauaacugaaacaga

SEQ ID NO: 633592 - RNA, 23 nt, Human
cacaaguuuuacaugaauauucu

SEQ ID NO: 633593 - RNA, 23 nt, Human
cacaauucacaaguauaacugaa

SEQ ID NO: 633594 - RNA, 23 nt, Human
caccaaagaauguauuacacaau

SEQ ID NO: 633595 - RNA, 24 nt, Human
caccauggguuucuuugggagaug

SEQ ID NO: 633596 - RNA, 20 nt, Human
cacugcaaagcuugacaaac

SEQ ID NO: 633597 - RNA, 19 nt, Human
cacuucaccgccuccgucc

SEQ ID NO: 633598 - RNA, 24 nt, Human
cagacccauuagagcaucaaugac

SEQ ID NO: 633599 - RNA, 20 nt, Human
cagcacagcagccgccaccc

SEQ ID NO: 633600 - RNA, 18 nt, Human
cauaagcauucagaagcu

SEQ ID NO: 633601 - RNA, 22 nt, Human
cauucagcaccuuuauugaacc

SEQ ID NO: 633602 - RNA, 21 nt, Human
cauuccauuuucucauuuaua

SEQ ID NO: 633603 - RNA, 21 nt, Human
cauuccauuuucucauuuaua

SEQ ID NO: 633604 - RNA, 23 nt, Human
cauuuuucccaucagguuggagg

SEQ ID NO: 633605 - RNA, 23 nt, Human
cauuuuucccaucagguuggagg

SEQ ID NO: 633606 - RNA, 24 nt, Human
ccaaaaaugcaauaagacguagca

SEQ ID NO: 633607 - RNA, 18 nt, Human
ccauuagagcaucaauga

SEQ ID NO: 633608 - RNA, 23 nt, Human
ccauugccaauccuagaacacau

SEQ ID NO: 633609 - RNA, 19 nt, Human
cccauuagagcaucaauga

SEQ ID NO: 633610 - RNA, 18 nt, Human
ccccacagccagcacagc

SEQ ID NO: 633611 - RNA, 27 nt, Human
ccccacagccagcacagcagccgccac

SEQ ID NO: 633612 - RNA, 21 nt, Human
cccccuauuacuaaacaaauc

SEQ ID NO: 633613 - RNA, 21 nt, Human
cccccuauuacuaaacaaauc

SEQ ID NO: 633614 - RNA, 19 nt, Human
ccgggcuaguuugacagca

SEQ ID NO: 633615 - RNA, 20 nt, Human
ccucaaaagcugcccaaagc

SEQ ID NO: 633616 - RNA, 22 nt, Human
ccucugguucuucugauccauu

SEQ ID NO: 633617 - RNA, 21 nt, Human
ccugaaacaacauacuuuuga

SEQ ID NO: 633618 - RNA, 21 nt, Human
ccuguaaaauccugaggauua

SEQ ID NO: 633619 - RNA, 24 nt, Human
cggauaguguaugaaaaaucuguc

SEQ ID NO: 633620 - RNA, 21 nt, Human
cuccguccccacagccagcac

SEQ ID NO: 633621 - RNA, 20 nt, Human
cugaaacagacaaaaccuug

SEQ ID NO: 633622 - RNA, 20 nt, Human
cugaaacagacaaaaccuug

SEQ ID NO: 633623 - RNA, 21 nt, Human
cuguaugugcuuucuuuuccu

SEQ ID NO: 633624 - RNA, 24 nt, Human
cuugcacugcaaagcuugacaaac

SEQ ID NO: 633625 - RNA, 24 nt, Human
cuuucaagagaaccacaacucguu

SEQ ID NO: 633626 - RNA, 21 nt, Human
gaagacaugccucacuccuuc

SEQ ID NO: 633627 - RNA, 21 nt, Human
gacccauuagagcaucaauga

SEQ ID NO: 633628 - RNA, 20 nt, Human
gacgaagagaggcaacgagg

SEQ ID NO: 633629 - RNA, 21 nt, Human
gaggucaccacuauauuccau

SEQ ID NO: 633630 - RNA, 22 nt, Human
gcaacagauauaguuauaugaa

SEQ ID NO: 633631 - RNA, 21 nt, Human
gcacagcagccgccacccgcg

SEQ ID NO: 633632 - RNA, 22 nt, Human
gcagaccaucuccuaaugcaac

SEQ ID NO: 633633 - RNA, 23 nt, Human
gcagccaucaagugauucuccug

SEQ ID NO: 633634 - RNA, 19 nt, Human
gccaucaagugauucuccu

SEQ ID NO: 633635 - RNA, 19 nt, Human
guaagugagagaaaagccc

SEQ ID NO: 633636 - RNA, 21 nt, Human
guugcaagcagaccaucuccu

SEQ ID NO: 633637 - RNA, 21 nt, Human
uaaaaaaaaaaaaaaaaggga

SEQ ID NO: 633638 - RNA, 24 nt, Human
uaaaaaaaaaaaaaaaagggaggg

SEQ ID NO: 633639 - RNA, 23 nt, Human
uaaagcagcuauguuuaagaaaa

SEQ ID NO: 633640 - RNA, 24 nt, Human
uaauguauccuuucugcaguuaga

SEQ ID NO: 633641 - RNA, 20 nt, Human
uacagaccauagggcacaga

SEQ ID NO: 633642 - RNA, 20 nt, Human
uauaacugaaacagacaaaa

SEQ ID NO: 633643 - RNA, 20 nt, Human
uauaacugaaacagacaaaa

SEQ ID NO: 633644 - RNA, 20 nt, Human
uauacuguuuacaucccuca

SEQ ID NO: 633645 - RNA, 20 nt, Human
uauacuguuuacaucccuca

SEQ ID NO: 633646 - RNA, 21 nt, Human
uauaguuauaugaacaacauu

SEQ ID NO: 633647 - RNA, 18 nt, Human
ucaaaagcugcccaaagc

SEQ ID NO: 633648 - RNA, 18 nt, Human
ucaagagaaccacaacuc

SEQ ID NO: 633649 - RNA, 22 nt, Human
ucaagugauucuccuguucuac

SEQ ID NO: 633650 - RNA, 22 nt, Human
ucagaauuuuguacuacacuga

SEQ ID NO: 633651 - RNA, 22 nt, Human
ucagaauuuuguacuacacuga

SEQ ID NO: 633652 - RNA, 18 nt, Human
ucagcgucacuggaaggu

SEQ ID NO: 633653 - RNA, 24 nt, Human
ucaguuaacgaucuuaugauggau

SEQ ID NO: 633654 - RNA, 20 nt, Human
uccaaaagcaccuuucuuga

SEQ ID NO: 633655 - RNA, 26 nt, Human
uccacagcacuugccauuucaguuuc

SEQ ID NO: 633656 - RNA, 20 nt, Human
uccauauguaaaaguauaau

SEQ ID NO: 633657 - RNA, 24 nt, Human
uccccacagccagcacagcagccg

SEQ ID NO: 633658 - RNA, 29 nt, Human
uccccacagccagcacagcagccgccacc

SEQ ID NO: 633659 - RNA, 19 nt, Human
ucccccuauuacuaaacaa

SEQ ID NO: 633660 - RNA, 19 nt, Human
ucccccuauuacuaaacaa

SEQ ID NO: 633661 - RNA, 28 nt, Human
ucuuccguuuuauuacaaaaaugaagau

SEQ ID NO: 633662 - RNA, 20 nt, Human
ucuuuaaaaaaaaaaaaaaa

SEQ ID NO: 633663 - RNA, 20 nt, Human
ucuuuaaaaaaaaaaaaaaa

SEQ ID NO: 633664 - RNA, 21 nt, Human
ugaaaagaugccgggcuaguu

SEQ ID NO: 633665 - RNA, 19 nt, Human
ugaaacaacauacuuuuga

SEQ ID NO: 633666 - RNA, 22 nt, Human
ugaaacagacaaaaccuuguca

SEQ ID NO: 633667 - RNA, 22 nt, Human
ugaaacagacaaaaccuuguca

SEQ ID NO: 633668 - RNA, 24 nt, Human
ugaagcaaauguucagcuucuucc

SEQ ID NO: 633669 - RNA, 19 nt, Human
ugaauaauuuacaguugaa

SEQ ID NO: 633670 - RNA, 23 nt, Human
ugacagcgucugaccaaaaaugc

SEQ ID NO: 633671 - RNA, 18 nt, Human
ugaccaaaaaugcaauaa

SEQ ID NO: 633672 - RNA, 23 nt, Human
ugacuagcaaaccaacuauauug

SEQ ID NO: 633673 - RNA, 19 nt, Human
ugagaaaauguaauucuca

SEQ ID NO: 633674 - RNA, 20 nt, Human
ugagaaauaaauguaaguga

SEQ ID NO: 633675 - RNA, 22 nt, Human
ugagagaaaagcccugcccuag

SEQ ID NO: 633676 - RNA, 22 nt, Human
ugauccauuuucugcuuuccuu

SEQ ID NO: 633677 - RNA, 20 nt, Human
ugcaaaagaauucuagacca

SEQ ID NO: 633678 - RNA, 20 nt, Human
ugcaaaagaauucuagacca

SEQ ID NO: 633679 - RNA, 24 nt, Human
ugcagucagguuuuucuuccuacc

SEQ ID NO: 633680 - RNA, 24 nt, Human
ugcagucagguuuuucuuccuacc

SEQ ID NO: 633681 - RNA, 19 nt, Human
ugcaguuagaucucaauuc

SEQ ID NO: 633682 - RNA, 18 nt, Human
ugcccuacuuguuaagcu

SEQ ID NO: 633683 - RNA, 21 nt, Human
ugccugugcugccauuacuag

SEQ ID NO: 633684 - RNA, 22 nt, Human
ugcuaugguuuuccauguacuu

SEQ ID NO: 633685 - RNA, 18 nt, Human
ugcugccauuacuagaau

SEQ ID NO: 633686 - RNA, 22 nt, Human
uggaagguccacagcacuugcc

SEQ ID NO: 633687 - RNA, 22 nt, Human
uggaugccacuugaugccauga

SEQ ID NO: 633688 - RNA, 21 nt, Human
ugguaagcuacuaauugacau

SEQ ID NO: 633689 - RNA, 21 nt, Human
ugguaagcuacuaauugacau

SEQ ID NO: 633690 - RNA, 18 nt, Human
uguaacguucauaaucuc

SEQ ID NO: 633691 - RNA, 24 nt, Human
uguaauacagaggcuugcacugca

SEQ ID NO: 633692 - RNA, 18 nt, Human
ugugugggcaggcuuugg

SEQ ID NO: 633693 - RNA, 21 nt, Human
uguguuuucagaauuuuguac

SEQ ID NO: 633694 - RNA, 21 nt, Human
uguguuuucagaauuuuguac

SEQ ID NO: 633695 - RNA, 19 nt, Human
uguuuaagaaaacaagcaa

SEQ ID NO: 633696 - RNA, 20 nt, Human
uuaaaaaaaaaaaaaaaaaa

SEQ ID NO: 633697 - RNA, 27 nt, Human
uuaaaaguccuuuuuucuccucucgug

SEQ ID NO: 633698 - RNA, 27 nt, Human
uuaaaaguccuuuuuucuccucucgug

SEQ ID NO: 633699 - RNA, 18 nt, Human
uuagaucucaauucacaa

SEQ ID NO: 633700 - RNA, 22 nt, Human
uuauuuucuacaguuuuccaaa

SEQ ID NO: 633701 - RNA, 22 nt, Human
uucacaaguauaacugaaacag

SEQ ID NO: 633702 - RNA, 22 nt, Human
uucacaaguauaacugaaacag

SEQ ID NO: 633703 - RNA, 22 nt, Human
uuccuaccccuuaaggcuacaa

SEQ ID NO: 633704 - RNA, 22 nt, Human
uuccuaccccuuaaggcuacaa

SEQ ID NO: 633705 - RNA, 18 nt, Human
uuccucaaaagcugccca

SEQ ID NO: 633706 - RNA, 24 nt, Human
uuccuggcagccaucaagugauuc

SEQ ID NO: 633707 - RNA, 19 nt, Human
uuguacugaaaggaaaaag

SEQ ID NO: 633708 - RNA, 27 nt, Human
uuuaaaaaaaaaaaaaaaagggaggua

SEQ ID NO: 633709 - RNA, 18 nt, Human
uuuacaucccucauuaaa

SEQ ID NO: 633710 - RNA, 18 nt, Human
uuuacaucccucauuaaa

SEQ ID NO: 633711 - RNA, 25 nt, Human
uuucaaggucugcauacuuuuucca

SEQ ID NO: 633712 - RNA, 21 nt, Human
uuucuuccuaccccuuaaggc

SEQ ID NO: 633713 - RNA, 21 nt, Human
uuucuuccuaccccuuaaggc

SEQ ID NO: 633714 - RNA, 22 nt, Human
uuuuccauguacuuggcauacu

SEQ ID NO: 633715 - RNA, 28 nt, Human
uuuuuucuuuaaaaaaaaaaaaaaaaaa

SEQ ID NO: 633716 - RNA, 22 nt, Human
uuuuuuuuuuuuuuuuacugga

SEQ ID NO: 633717 - RNA, 22 nt, Human
uuuuuuuuuuuuuuuuuacugg

SEQ ID NO: 633718 - RNA, 22 nt, Human
aaaaagacaugcaucugucaaa

SEQ ID NO: 633719 - RNA, 20 nt, Human
aaaauaugcauccuccaagg

SEQ ID NO: 633720 - RNA, 22 nt, Human
aaauccugucagcuuuuaaaag

SEQ ID NO: 633721 - RNA, 19 nt, Human
aaaucuguuagcugucaaa

SEQ ID NO: 633722 - RNA, 21 nt, Human
aaaugugucaguaggagaaag

SEQ ID NO: 633723 - RNA, 24 nt, Human
aacacaauaaucaacugucaaacc

SEQ ID NO: 633724 - RNA, 23 nt, Human
aagaaacagauguaaacuaucaa

SEQ ID NO: 633725 - RNA, 22 nt, Human
acugcaaugucauucacacauc

SEQ ID NO: 633726 - RNA, 19 nt, Human
aggagaaaggaggagcuga

SEQ ID NO: 633727 - RNA, 20 nt, Human
aggaggagcugaagggagua

SEQ ID NO: 633728 - RNA, 22 nt, Human
aggcagauuguuuuaucuuucu

SEQ ID NO: 633729 - RNA, 18 nt, Human
aucaaaauaugcauccuc

SEQ ID NO: 633730 - RNA, 22 nt, Human
auucacacaucaguuuuacaug

SEQ ID NO: 633731 - RNA, 21 nt, Human
auuuguaguggcugagggcua

SEQ ID NO: 633732 - RNA, 23 nt, Human
caaaauaaccagacuccacuaaa

SEQ ID NO: 633733 - RNA, 26 nt, Human
caaaauaugcauccuccaaguucacu

SEQ ID NO: 633734 - RNA, 21 nt, Human
caaguugacaccucauaugga

SEQ ID NO: 633735 - RNA, 24 nt, Human
cacuaaaccauacaaaucuguuag

SEQ ID NO: 633736 - RNA, 21 nt, Human
ccagacuccacuaaaccauac

SEQ ID NO: 633737 - RNA, 22 nt, Human
ccagaugaaaauauaagaccug

SEQ ID NO: 633738 - RNA, 18 nt, Human
ccuccaaguucacuucca

SEQ ID NO: 633739 - RNA, 21 nt, Human
cuuaauugucuuggaaaucau

SEQ ID NO: 633740 - RNA, 19 nt, Human
gagaaaggaggagcugaag

SEQ ID NO: 633741 - RNA, 22 nt, Human
gcagacaauuucaggcuuaaaa

SEQ ID NO: 633742 - RNA, 24 nt, Human
gccccaguaguucuuaauugucuu

SEQ ID NO: 633743 - RNA, 19 nt, Human
guaguucuuaauugucuug

SEQ ID NO: 633744 - RNA, 21 nt, Human
gugucaguaggagaaaggagg

SEQ ID NO: 633745 - RNA, 22 nt, Human
guuacugugaagaagaguauca

SEQ ID NO: 633746 - RNA, 23 nt, Human
guuuugaaauacucaacaacugu

SEQ ID NO: 633747 - RNA, 21 nt, Human
guuuuucuccuuuccucuuug

SEQ ID NO: 633748 - RNA, 20 nt, Human
uaaaagaaugaauuaaacug

SEQ ID NO: 633749 - RNA, 20 nt, Human
uaaaagcauucauugcccca

SEQ ID NO: 633750 - RNA, 20 nt, Human
uaaccagacuccacuaaacc

SEQ ID NO: 633751 - RNA, 23 nt, Human
uaaguacuucauaguaacaauuu

SEQ ID NO: 633752 - RNA, 23 nt, Human
uagauucuuagucauaauuacuc

SEQ ID NO: 633753 - RNA, 23 nt, Human
uauccgaacauuuucugaaaauc

SEQ ID NO: 633754 - RNA, 18 nt, Human
ucauauggaugaaauaag

SEQ ID NO: 633755 - RNA, 22 nt, Human
ucaucugucaaguugacaccuc

SEQ ID NO: 633756 - RNA, 20 nt, Human
ucuuugaacaaagucaggaa

SEQ ID NO: 633757 - RNA, 22 nt, Human
ugaacaaagucaggaaaaaugu

SEQ ID NO: 633758 - RNA, 26 nt, Human
ugaagggaguaaauaauucaagauca

SEQ ID NO: 633759 - RNA, 23 nt, Human
ugcagacaauuucaggcuuaaaa

SEQ ID NO: 633760 - RNA, 22 nt, Human
uggcugagggcuagaaagauau

SEQ ID NO: 633761 - RNA, 23 nt, Human
ugucuuggaaaucauucucuugc

SEQ ID NO: 633762 - RNA, 20 nt, Human
uguuuguuuuucuccuuucc

SEQ ID NO: 633763 - RNA, 22 nt, Human
uuacggcugugcuauccaauau

SEQ ID NO: 633764 - RNA, 22 nt, Human
aaaaggccagguaugaugguuc

SEQ ID NO: 633765 - RNA, 18 nt, Human
aacacauucccccaucuc

SEQ ID NO: 633766 - RNA, 20 nt, Human
aacacauucccccaucucua

SEQ ID NO: 633767 - RNA, 19 nt, Human
aagaagccaucaaauucuu

SEQ ID NO: 633768 - RNA, 21 nt, Human
aagcaaacuuacagaauagga

SEQ ID NO: 633769 - RNA, 27 nt, Human
aagcaacccaccggccucugccuccca

SEQ ID NO: 633770 - RNA, 21 nt, Human
aagcaacuaauuaucucccuc

SEQ ID NO: 633771 - RNA, 19 nt, Human
aaguagcugggacuacagg

SEQ ID NO: 633772 - RNA, 20 nt, Human
aaguagcugggacuacaggu

SEQ ID NO: 633773 - RNA, 26 nt, Human
aaguagcugggacuacaggugcacac

SEQ ID NO: 633774 - RNA, 20 nt, Human
aagugcugggagccacugcc

SEQ ID NO: 633775 - RNA, 20 nt, Human
aaucccuccaugacccaccu

SEQ ID NO: 633776 - RNA, 19 nt, Human
aaugcaguggggugaucuc

SEQ ID NO: 633777 - RNA, 24 nt, Human
aaugcaguggggugaucucagcuc

SEQ ID NO: 633778 - RNA, 24 nt, Human
aauugcuugagccugggaggcgga

SEQ ID NO: 633779 - RNA, 20 nt, Human
acaccacugcacuccagccu

SEQ ID NO: 633780 - RNA, 24 nt, Human
acaccacugcacuccagccugggc

SEQ ID NO: 633781 - RNA, 18 nt, Human
acauaugccuuagaaaaa

SEQ ID NO: 633782 - RNA, 22 nt, Human
accacugcacuccagccugggc

SEQ ID NO: 633783 - RNA, 18 nt, Human
accaucugccucuuacca

SEQ ID NO: 633784 - RNA, 18 nt, Human
accauguugcccaggcuu

SEQ ID NO: 633785 - RNA, 21 nt, Human
accccuguaucuacagaauaa

SEQ ID NO: 633786 - RNA, 25 nt, Human
acuaguagacugaugagcuggauuu

SEQ ID NO: 633787 - RNA, 21 nt, Human
acucccagcccccuuccuuuc

SEQ ID NO: 633788 - RNA, 21 nt, Human
acugcacuccaaacuuaagug

SEQ ID NO: 633789 - RNA, 24 nt, Human
acugcacuccagccugggcaacag

SEQ ID NO: 633790 - RNA, 22 nt, Human
agaauugcuugagccugggagg

SEQ ID NO: 633791 - RNA, 18 nt, Human
agacaacuggauggaaaa

SEQ ID NO: 633792 - RNA, 18 nt, Human
agacuagaaaacguagca

SEQ ID NO: 633793 - RNA, 18 nt, Human
agagaauaauuucuugug

SEQ ID NO: 633794 - RNA, 18 nt, Human
agcaaacuaguagacuga

SEQ ID NO: 633795 - RNA, 23 nt, Human
agcaacccaccggccucugccuc

SEQ ID NO: 633796 - RNA, 18 nt, Human
agccagacgugguggugc

SEQ ID NO: 633797 - RNA, 24 nt, Human
agccugggcaacagaccaagaccu

SEQ ID NO: 633798 - RNA, 22 nt, Human
aggcaggagaauugcuugagcc

SEQ ID NO: 633799 - RNA, 24 nt, Human
aggcaggagaauugcuugagccug

SEQ ID NO: 633800 - RNA, 22 nt, Human
aggccagcaguucaagaccaga

SEQ ID NO: 633801 - RNA, 24 nt, Human
aggcggagauuacggugagccaag

SEQ ID NO: 633802 - RNA, 21 nt, Human
aggcucaagugauucccccac

SEQ ID NO: 633803 - RNA, 18 nt, Human
aggggguaaggaagagaa

SEQ ID NO: 633804 - RNA, 24 nt, Human
agguaugaugguucaugccuguaa

SEQ ID NO: 633805 - RNA, 19 nt, Human
aggugagaauggaucgcuu

SEQ ID NO: 633806 - RNA, 24 nt, Human
agguugaggcaggagaauugcuug

SEQ ID NO: 633807 - RNA, 24 nt, Human
agugauucccccaccucagccucc

SEQ ID NO: 633808 - RNA, 24 nt, Human
aguggggugaucucagcucacugu

SEQ ID NO: 633809 - RNA, 24 nt, Human
aucacaccacugcacuccagccug

SEQ ID NO: 633810 - RNA, 28 nt, Human
aucacaccacugcacuccagccugggca

SEQ ID NO: 633811 - RNA, 19 nt, Human
aucaugccacugcacucca

SEQ ID NO: 633812 - RNA, 22 nt, Human
aucccagcacuuugggaggcca

SEQ ID NO: 633813 - RNA, 22 nt, Human
aucuuaguccccuccccccacc

SEQ ID NO: 633814 - RNA, 18 nt, Human
aucuugaucuuauuucua

SEQ ID NO: 633815 - RNA, 22 nt, Human
augacaggggguaaggaagaga

SEQ ID NO: 633816 - RNA, 25 nt, Human
augccacugcacuccaaacuuaagu

SEQ ID NO: 633817 - RNA, 19 nt, Human
augccuguaaucccagcac

SEQ ID NO: 633818 - RNA, 23 nt, Human
augguucaugccuguaaucccag

SEQ ID NO: 633819 - RNA, 20 nt, Human
caaagugcugggagccacug

SEQ ID NO: 633820 - RNA, 18 nt, Human
caacccaccggccucugc

SEQ ID NO: 633821 - RNA, 27 nt, Human
caagugauucccccaccucagccuccc

SEQ ID NO: 633822 - RNA, 23 nt, Human
cacaccaccaugccagcuaauuu

SEQ ID NO: 633823 - RNA, 21 nt, Human
cacaccacugcacuccagccu

SEQ ID NO: 633824 - RNA, 23 nt, Human
caccaugccagcuaauuuuugua

SEQ ID NO: 633825 - RNA, 24 nt, Human
caccauguugcccaggcuugucuc

SEQ ID NO: 633826 - RNA, 27 nt, Human
caccauguugcccaggcuugucuccaa

SEQ ID NO: 633827 - RNA, 24 nt, Human
caccucagccucccaaguagcugg

SEQ ID NO: 633828 - RNA, 19 nt, Human
cacugcacuccagccuggg

SEQ ID NO: 633829 - RNA, 21 nt, Human
cacugcacuccagccugggca

SEQ ID NO: 633830 - RNA, 22 nt, Human
cacugcacuccagccugggcaa

SEQ ID NO: 633831 - RNA, 23 nt, Human
cacugcacuccagccugggcaac

SEQ ID NO: 633832 - RNA, 24 nt, Human
cacugcacuccagccugggcaaca

SEQ ID NO: 633833 - RNA, 25 nt, Human
cacugcacuccagccugggcaacaa

SEQ ID NO: 633834 - RNA, 26 nt, Human
cacugcacuccagccugggcaacaga

SEQ ID NO: 633835 - RNA, 21 nt, Human
cacugccaccacucccagccc

SEQ ID NO: 633836 - RNA, 20 nt, Human
cacuguggccucgaccuccc

SEQ ID NO: 633837 - RNA, 19 nt, Human
cagaacaugacagggggua

SEQ ID NO: 633838 - RNA, 18 nt, Human
cagaauaggaacaccugc

SEQ ID NO: 633839 - RNA, 22 nt, Human
cagacuagaaaacguagcauga

SEQ ID NO: 633840 - RNA, 20 nt, Human
cagcacuuugggaggccaag

SEQ ID NO: 633841 - RNA, 23 nt, Human
cagcacuuugggaggccaaggug

SEQ ID NO: 633842 - RNA, 27 nt, Human
cagccuaccagaaaagagggccaaugg

SEQ ID NO: 633843 - RNA, 24 nt, Human
cagcuauucggaagguugaggcag

SEQ ID NO: 633844 - RNA, 23 nt, Human
cagcucacuguggccucgaccuc

SEQ ID NO: 633845 - RNA, 21 nt, Human
caggagacugaggcagaaaga

SEQ ID NO: 633846 - RNA, 24 nt, Human
cauguugcccaggcuugucuccaa

SEQ ID NO: 633847 - RNA, 21 nt, Human
ccaaaaaaaaaaaaaaaaaaa

SEQ ID NO: 633848 - RNA, 23 nt, Human
ccaaacuuaagugacaacccaug

SEQ ID NO: 633849 - RNA, 23 nt, Human
ccaacuccugagcuaaagcaacc

SEQ ID NO: 633850 - RNA, 20 nt, Human
ccacugcacuccagccuggg

SEQ ID NO: 633851 - RNA, 21 nt, Human
ccacugcacuccagccugggc

SEQ ID NO: 633852 - RNA, 23 nt, Human
ccacugcacuccagccugggcaa

SEQ ID NO: 633853 - RNA, 24 nt, Human
ccacugcacuccagccugggcaac

SEQ ID NO: 633854 - RNA, 23 nt, Human
ccaugggacucugccuaaugcug

SEQ ID NO: 633855 - RNA, 22 nt, Human
cccaaguagcugggacuacagg

SEQ ID NO: 633856 - RNA, 23 nt, Human
cccaaguagcugggacuacaggu

SEQ ID NO: 633857 - RNA, 19 nt, Human
cccaccuuuuucuucuucu

SEQ ID NO: 633858 - RNA, 21 nt, Human
cccaggcuugucuccaacucc

SEQ ID NO: 633859 - RNA, 24 nt, Human
ccccaccucagccucccaaguagc

SEQ ID NO: 633860 - RNA, 19 nt, Human
ccccaccuuuuucuucuuc

SEQ ID NO: 633861 - RNA, 20 nt, Human
ccccaccuuuuucuucuucu

SEQ ID NO: 633862 - RNA, 18 nt, Human
ccccccaccuuuuucuuc

SEQ ID NO: 633863 - RNA, 18 nt, Human
ccccuuuucucucgaagg

SEQ ID NO: 633864 - RNA, 19 nt, Human
ccuaccagaaaagagccac

SEQ ID NO: 633865 - RNA, 22 nt, Human
ccuaggcucaagugauuccccc

SEQ ID NO: 633866 - RNA, 23 nt, Human
ccuccaugacccaccuaaggcug

SEQ ID NO: 633867 - RNA, 24 nt, Human
ccugagcuaaagcaacccaccggc

SEQ ID NO: 633868 - RNA, 20 nt, Human
ccuguaaucccagcacuuug

SEQ ID NO: 633869 - RNA, 22 nt, Human
ccuguaaucccagcacuuuggg

SEQ ID NO: 633870 - RNA, 21 nt, Human
ccuguagucccagcuauucgg

SEQ ID NO: 633871 - RNA, 19 nt, Human
cgccuguagucccagcuau

SEQ ID NO: 633872 - RNA, 23 nt, Human
cgccuguagucccagcuauucgg

SEQ ID NO: 633873 - RNA, 24 nt, Human
cgcucugucacccaggcuggaaug

SEQ ID NO: 633874 - RNA, 20 nt, Human
cggaagguugaggcaggaga

SEQ ID NO: 633875 - RNA, 19 nt, Human
cuaggcauuauuccaugcc

SEQ ID NO: 633876 - RNA, 21 nt, Human
cucaagugauucccccaccuc

SEQ ID NO: 633877 - RNA, 23 nt, Human
cucaagugauucccccaccucag

SEQ ID NO: 633878 - RNA, 24 nt, Human
cucaagugauucccccaccucagc

SEQ ID NO: 633879 - RNA, 24 nt, Human
cucagccucccaaguagcugggac

SEQ ID NO: 633880 - RNA, 20 nt, Human
cuccccccaccuuuuucuuc

SEQ ID NO: 633881 - RNA, 20 nt, Human
cugacucccuccucccauac

SEQ ID NO: 633882 - RNA, 19 nt, Human
cugccucuuaccauucacc

SEQ ID NO: 633883 - RNA, 19 nt, Human
cuugagccugggaggcgga

SEQ ID NO: 633884 - RNA, 23 nt, Human
gaccauaaucccuccaugaccca

SEQ ID NO: 633885 - RNA, 21 nt, Human
gacuacaggugcacaccacca

SEQ ID NO: 633886 - RNA, 24 nt, Human
gaucgcuugaggccagcaguucaa

SEQ ID NO: 633887 - RNA, 24 nt, Human
gaugguucaugccuguaaucccag

SEQ ID NO: 633888 - RNA, 20 nt, Human
gccaagaucacaccacugca

SEQ ID NO: 633889 - RNA, 22 nt, Human
gccagguaugaugguucaugcc

SEQ ID NO: 633890 - RNA, 19 nt, Human
gccuguacuggucagugag

SEQ ID NO: 633891 - RNA, 23 nt, Human
gcggcgugcgccuguagucccag

SEQ ID NO: 633892 - RNA, 25 nt, Human
gcucugucacccaggcuggaaugca

SEQ ID NO: 633893 - RNA, 21 nt, Human
ggccucgaccucccuaggcuc

SEQ ID NO: 633894 - RNA, 24 nt, Human
ggccuguaguccuagauacucagg

SEQ ID NO: 633895 - RNA, 24 nt, Human
gggccuguaguccuagauacucag

SEQ ID NO: 633896 - RNA, 20 nt, Human
gguaaaguacaaaaacgcca

SEQ ID NO: 633897 - RNA, 24 nt, Human
ggugagaauggaucgcuugaggcc

SEQ ID NO: 633898 - RNA, 18 nt, Human
gugagacaacuggaugga

SEQ ID NO: 633899 - RNA, 24 nt, Human
gugauucccccaccucagccuccc

SEQ ID NO: 633900 - RNA, 19 nt, Human
guggugcggcgugcgccug

SEQ ID NO: 633901 - RNA, 21 nt, Human
guggugcggcgugcgccugua

SEQ ID NO: 633902 - RNA, 18 nt, Human
guugugcgggccuguagu

SEQ ID NO: 633903 - RNA, 20 nt, Human
guugugcgggccuguagucc

SEQ ID NO: 633904 - RNA, 20 nt, Human
uaaagcaacccaccggccuc

SEQ ID NO: 633905 - RNA, 21 nt, Human
uaaagcaacccaccggccucu

SEQ ID NO: 633906 - RNA, 24 nt, Human
uaaaguacaaaaacgccaccuuuu

SEQ ID NO: 633907 - RNA, 21 nt, Human
uaaucccuccaugacccaccu

SEQ ID NO: 633908 - RNA, 24 nt, Human
uaauuuuuguauuuuugauagaga

SEQ ID NO: 633909 - RNA, 18 nt, Human
uaccagaaaagagccacu

SEQ ID NO: 633910 - RNA, 22 nt, Human
uaccuaaagaacauagacugac

SEQ ID NO: 633911 - RNA, 21 nt, Human
uaggaguccaguugacaugcu

SEQ ID NO: 633912 - RNA, 19 nt, Human
uauguuccuagguugcugg

SEQ ID NO: 633913 - RNA, 21 nt, Human
uauguuccuagguugcuggaa

SEQ ID NO: 633914 - RNA, 26 nt, Human
ucaauauuauauagccuggcaaugaa

SEQ ID NO: 633915 - RNA, 23 nt, Human
ucacaccacugcacuccagccug

SEQ ID NO: 633916 - RNA, 19 nt, Human
ucacccaggcuggaaugca

SEQ ID NO: 633917 - RNA, 23 nt, Human
ucacugaugaucaugccacugca

SEQ ID NO: 633918 - RNA, 23 nt, Human
ucacuguggccucgaccucccua

SEQ ID NO: 633919 - RNA, 20 nt, Human
ucagccucccaaguagcugg

SEQ ID NO: 633920 - RNA, 22 nt, Human
ucaugccuguaaucccagcacu

SEQ ID NO: 633921 - RNA, 23 nt, Human
ucaugccuguaaucccagcacuu

SEQ ID NO: 633922 - RNA, 22 nt, Human
uccagguaaaguacaaaaacgc

SEQ ID NO: 633923 - RNA, 24 nt, Human
uccaucagcuaugguuaucuucuu

SEQ ID NO: 633924 - RNA, 24 nt, Human
ucccaaguagcugggacuacaggu

SEQ ID NO: 633925 - RNA, 20 nt, Human
ucccauacaauaacacauuc

SEQ ID NO: 633926 - RNA, 23 nt, Human
ucccccaccucagccucccaagu

SEQ ID NO: 633927 - RNA, 26 nt, Human
ucccccaccucagccucccaaguagc

SEQ ID NO: 633928 - RNA, 25 nt, Human
ucccuaggcucaagugauuccccca

SEQ ID NO: 633929 - RNA, 18 nt, Human
ucccuccaugacccaccu

SEQ ID NO: 633930 - RNA, 20 nt, Human
ucccuccaugacccaccuaa

SEQ ID NO: 633931 - RNA, 26 nt, Human
ucgauagucccucuuaaugauuuccu

SEQ ID NO: 633932 - RNA, 19 nt, Human
ucgauucaaacagugugaa

SEQ ID NO: 633933 - RNA, 23 nt, Human
ucggaagguugaggcaggagaau

SEQ ID NO: 633934 - RNA, 20 nt, Human
ucuauguuccuagguugcug

SEQ ID NO: 633935 - RNA, 20 nt, Human
ucuccaaaaaaaaaaaaaaa

SEQ ID NO: 633936 - RNA, 21 nt, Human
ucuccaacuccugagcuaaag

SEQ ID NO: 633937 - RNA, 19 nt, Human
ucucgcucugucacccagg

SEQ ID NO: 633938 - RNA, 22 nt, Human
ucucgcucugucacccaggcug

SEQ ID NO: 633939 - RNA, 23 nt, Human
ucucgcucugucacccaggcugg

SEQ ID NO: 633940 - RNA, 24 nt, Human
ucucgcucugucacccaggcugga

SEQ ID NO: 633941 - RNA, 26 nt, Human
ucucgcucugucacccaggcuggaau

SEQ ID NO: 633942 - RNA, 27 nt, Human
ucucgcucugucacccaggcuggaaug

SEQ ID NO: 633943 - RNA, 18 nt, Human
ucucgggaaggaggguuc

SEQ ID NO: 633944 - RNA, 24 nt, Human
ucugucacccaggcuggaaugcag

SEQ ID NO: 633945 - RNA, 20 nt, Human
ucuucuuuuuugagacaggg

SEQ ID NO: 633946 - RNA, 19 nt, Human
ucuugaggacuugacaucu

SEQ ID NO: 633947 - RNA, 25 nt, Human
ucuuuggaaugccucuuuccccggu

SEQ ID NO: 633948 - RNA, 22 nt, Human
ugagacagggucucgcucuguc

SEQ ID NO: 633949 - RNA, 18 nt, Human
ugagccugggaggcggag

SEQ ID NO: 633950 - RNA, 24 nt, Human
ugaggcaggagaauugcuugagcc

SEQ ID NO: 633951 - RNA, 25 nt, Human
ugaggcaggagaauugcuugagccu

SEQ ID NO: 633952 - RNA, 22 nt, Human
ugaggccagcaguucaagacca

SEQ ID NO: 633953 - RNA, 24 nt, Human
ugaugguucaugccuguaauccca

SEQ ID NO: 633954 - RNA, 26 nt, Human
ugcagaagaagccaucaaauucuuga

SEQ ID NO: 633955 - RNA, 18 nt, Human
ugcccaggcuugucucca

SEQ ID NO: 633956 - RNA, 23 nt, Human
ugccuguaaucccagcacuuugg

SEQ ID NO: 633957 - RNA, 23 nt, Human
ugccuguaaucccagcacuuugg

SEQ ID NO: 633958 - RNA, 20 nt, Human
ugccuuagaaaaaggccagg

SEQ ID NO: 633959 - RNA, 18 nt, Human
uggaaaaucuauugugua

SEQ ID NO: 633960 - RNA, 19 nt, Human
uggaaugcaguggggugau

SEQ ID NO: 633961 - RNA, 23 nt, Human
uggaaugcaguggggugaucuca

SEQ ID NO: 633962 - RNA, 24 nt, Human
uggaaugcaguggggugaucucag

SEQ ID NO: 633963 - RNA, 21 nt, Human
uggaaugccucuuuccccggu

SEQ ID NO: 633964 - RNA, 24 nt, Human
uggaucgcuugaggccagcaguuc

SEQ ID NO: 633965 - RNA, 20 nt, Human
uggccucgaccucccuaggc

SEQ ID NO: 633966 - RNA, 22 nt, Human
ugggacuacaggugcacaccac

SEQ ID NO: 633967 - RNA, 24 nt, Human
ugggacuacaggugcacaccacca

SEQ ID NO: 633968 - RNA, 25 nt, Human
ugggaggccaaggugagaauggauc

SEQ ID NO: 633969 - RNA, 24 nt, Human
ugggaggcggagauuacggugagc

SEQ ID NO: 633970 - RNA, 23 nt, Human
uggggugaucucagcucacugug

SEQ ID NO: 633971 - RNA, 24 nt, Human
uggggugaucucagcucacugugg

SEQ ID NO: 633972 - RNA, 22 nt, Human
uggucagugaguucggucagcu

SEQ ID NO: 633973 - RNA, 30 nt, Human
ugguggugcggcgugcgccuguagucccaa

SEQ ID NO: 633974 - RNA, 24 nt, Human
ugguucaugccuguaaucccagca

SEQ ID NO: 633975 - RNA, 24 nt, Human
uguagucccagcuauucggaaggu

SEQ ID NO: 633976 - RNA, 24 nt, Human
ugucuccaacuccugagcuaaagc

SEQ ID NO: 633977 - RNA, 22 nt, Human
uuacacuacaaucugauaggag

SEQ ID NO: 633978 - RNA, 19 nt, Human
uucccccaccucagccucc

SEQ ID NO: 633979 - RNA, 22 nt, Human
uucucgggaaggaggguucuac

SEQ ID NO: 633980 - RNA, 22 nt, Human
uugagacagggucucgcucugu

SEQ ID NO: 633981 - RNA, 21 nt, Human
uugagccugggaggcggagau

SEQ ID NO: 633982 - RNA, 18 nt, Human
uugcccagaacaugacag

SEQ ID NO: 633983 - RNA, 18 nt, Human
uugcuugagccugggagg

SEQ ID NO: 633984 - RNA, 23 nt, Human
uugcuugagccugggaggcggag

SEQ ID NO: 633985 - RNA, 23 nt, Human
uugugguuauagcugcagaagaa

SEQ ID NO: 633986 - RNA, 20 nt, Human
uuuaaaaaaaaaaaaaaguu

SEQ ID NO: 633987 - RNA, 24 nt, Human
uuucaccauguugcccaggcuugu

SEQ ID NO: 633988 - RNA, 20 nt, Human
uuuggaaugccucuuucccc

SEQ ID NO: 633989 - RNA, 19 nt, Human
uuuuacaguucuaaagauc

SEQ ID NO: 633990 - RNA, 20 nt, Human
uuuuuguauuuuugauagag

SEQ ID NO: 633991 - RNA, 23 nt, Human
uuuuuguauuuuugauagagaca

SEQ ID NO: 633992 - RNA, 24 nt, Human
aaagugcugggauuacaggccuga

SEQ ID NO: 633993 - RNA, 19 nt, Human
aagaaucucugaagacaga

SEQ ID NO: 633994 - RNA, 19 nt, Human
aagugcugggauuacaggc

SEQ ID NO: 633995 - RNA, 19 nt, Human
aagugcugggauuacaggc

SEQ ID NO: 633996 - RNA, 26 nt, Human
aagugcugggauuacaggccugagcc

SEQ ID NO: 633997 - RNA, 23 nt, Human
aauauaaacaaugccuagaauga

SEQ ID NO: 633998 - RNA, 20 nt, Human
acaauacugcugccccaugc

SEQ ID NO: 633999 - RNA, 24 nt, Human
acagggucucaccguguuggccag

SEQ ID NO: 634000 - RNA, 24 nt, Human
accguguuggccaggcuggucucg

SEQ ID NO: 634001 - RNA, 20 nt, Human
accuugcucagccucccaaa

SEQ ID NO: 634002 - RNA, 21 nt, Human
acucacuguagccucugccuc

SEQ ID NO: 634003 - RNA, 18 nt, Human
acucugucacccaagcug

SEQ ID NO: 634004 - RNA, 26 nt, Human
acucugucacccaagcuggaguugca

SEQ ID NO: 634005 - RNA, 18 nt, Human
agacagggucucaccgug

SEQ ID NO: 634006 - RNA, 21 nt, Human
aggcagaaaagcaguucaggg

SEQ ID NO: 634007 - RNA, 23 nt, Human
aggccugagccaccgugcccggc

SEQ ID NO: 634008 - RNA, 20 nt, Human
aguaaagacagggucucacc

SEQ ID NO: 634009 - RNA, 24 nt, Human
aguaacuucaaauauaaacaaugc

SEQ ID NO: 634010 - RNA, 23 nt, Human
aguagcugggacuacaguggugc

SEQ ID NO: 634011 - RNA, 24 nt, Human
agugcugggauuacaggccugagc

SEQ ID NO: 634012 - RNA, 22 nt, Human
caaaguaguuuuccacagaggc

SEQ ID NO: 634013 - RNA, 24 nt, Human
caaagugcugggauuacaggccug

SEQ ID NO: 634014 - RNA, 20 nt, Human
caagcgauucuccugccuca

SEQ ID NO: 634015 - RNA, 22 nt, Human
caagcgauucuccugccucagc

SEQ ID NO: 634016 - RNA, 23 nt, Human
caagugauccacccaccuugcuc

SEQ ID NO: 634017 - RNA, 21 nt, Human
caccguguuggccaggcuggu

SEQ ID NO: 634018 - RNA, 24 nt, Human
caccguguuggccaggcuggucuc

SEQ ID NO: 634019 - RNA, 25 nt, Human
caccuugcucagccucccaaagugc

SEQ ID NO: 634020 - RNA, 19 nt, Human
cacucacuguagccucugc

SEQ ID NO: 634021 - RNA, 24 nt, Human
cacucugucacccaagcuggaguu

SEQ ID NO: 634022 - RNA, 18 nt, Human
cacuguagccucugccuc

SEQ ID NO: 634023 - RNA, 25 nt, Human
cagaggcagaaaagcaguucagggg

SEQ ID NO: 634024 - RNA, 24 nt, Human
cagggucucaccguguuggccagg

SEQ ID NO: 634025 - RNA, 18 nt, Human
ccaaaacacuuccugcac

SEQ ID NO: 634026 - RNA, 23 nt, Human
ccaaagacugcaucuucaacugg

SEQ ID NO: 634027 - RNA, 19 nt, Human
ccaaagugcugggauuaca

SEQ ID NO: 634028 - RNA, 22 nt, Human
ccaaagugcugggauuacaggc

SEQ ID NO: 634029 - RNA, 24 nt, Human
ccaaagugcugggauuacaggccu

SEQ ID NO: 634030 - RNA, 23 nt, Human
cccaccuugcucagccucccaaa

SEQ ID NO: 634031 - RNA, 20 nt, Human
ccucaguucaagcgauucuc

SEQ ID NO: 634032 - RNA, 22 nt, Human
ccugaguagcugggacuacagu

SEQ ID NO: 634033 - RNA, 22 nt, Human
ccugcaccacucgacacuggca

SEQ ID NO: 634034 - RNA, 18 nt, Human
ccuggccucaagugaucc

SEQ ID NO: 634035 - RNA, 24 nt, Human
ccuggccucaagugauccacccac

SEQ ID NO: 634036 - RNA, 23 nt, Human
cuaccagugcuacuuuuccugcu

SEQ ID NO: 634037 - RNA, 23 nt, Human
cuauuuaaaugagaggcgcucca

SEQ ID NO: 634038 - RNA, 23 nt, Human
cucaagugauccacccaccuugc

SEQ ID NO: 634039 - RNA, 24 nt, Human
cucacucugucacccaagcuggag

SEQ ID NO: 634040 - RNA, 19 nt, Human
cucacuguagccucugccu

SEQ ID NO: 634041 - RNA, 21 nt, Human
cucagccugaguagcugggac

SEQ ID NO: 634042 - RNA, 21 nt, Human
cuccaaaacacuuccugcacc

SEQ ID NO: 634043 - RNA, 20 nt, Human
cuccugccucagccugagua

SEQ ID NO: 634044 - RNA, 23 nt, Human
cuccuggccucaagugauccacc

SEQ ID NO: 634045 - RNA, 27 nt, Human
cuccuggccucaagugauccacccacc

SEQ ID NO: 634046 - RNA, 24 nt, Human
cuugcucagccucccaaagugcug

SEQ ID NO: 634047 - RNA, 24 nt, Human
gaguagcugggacuacaguggugc

SEQ ID NO: 634048 - RNA, 18 nt, Human
gauuacaggccugagcca

SEQ ID NO: 634049 - RNA, 21 nt, Human
gauuacaggccugagccaccg

SEQ ID NO: 634050 - RNA, 24 nt, Human
gauuacaggccugagccaccgugc

SEQ ID NO: 634051 - RNA, 21 nt, Human
gccauguugcuuuuauaauug

SEQ ID NO: 634052 - RNA, 24 nt, Human
gccucaguucaagcgauucuccug

SEQ ID NO: 634053 - RNA, 18 nt, Human
gccuggcuaauuuuugua

SEQ ID NO: 634054 - RNA, 23 nt, Human
gcuggucucgaacuccuggccuc

SEQ ID NO: 634055 - RNA, 26 nt, Human
ggaacuuucacaauacugcugccccu

SEQ ID NO: 634056 - RNA, 24 nt, Human
ggccucaagugauccacccaccuu

SEQ ID NO: 634057 - RNA, 24 nt, Human
ggcuggucucgaacuccuggccuc

SEQ ID NO: 634058 - RNA, 22 nt, Human
gggucucaccguguuggccagg

SEQ ID NO: 634059 - RNA, 28 nt, Human
gugauccacccaccuugcucagccuccc

SEQ ID NO: 634060 - RNA, 19 nt, Human
guugcaguggcgugaucuc

SEQ ID NO: 634061 - RNA, 22 nt, Human
uaaagacagggucucaccgugu

SEQ ID NO: 634062 - RNA, 24 nt, Human
uaauaagcccugggacauucaaau

SEQ ID NO: 634063 - RNA, 24 nt, Human
uaauuuuuguauuuuuaguaaaga

SEQ ID NO: 634064 - RNA, 23 nt, Human
uacaaauacugaagaaucccaaa

SEQ ID NO: 634065 - RNA, 23 nt, Human
uacaggccugagccaccgugccc

SEQ ID NO: 634066 - RNA, 22 nt, Human
uaccagugcuacuuuuccuggg

SEQ ID NO: 634067 - RNA, 24 nt, Human
uacuacaaauacugaagaauccca

SEQ ID NO: 634068 - RNA, 19 nt, Human
uacugcugccccaugcagg

SEQ ID NO: 634069 - RNA, 26 nt, Human
uaguaaagacagggucucaccguguu

SEQ ID NO: 634070 - RNA, 18 nt, Human
ucaccaguucuuacgauu

SEQ ID NO: 634071 - RNA, 24 nt, Human
ucaccguguuggccaggcuggucu

SEQ ID NO: 634072 - RNA, 19 nt, Human
ucacuguagccucugccuc

SEQ ID NO: 634073 - RNA, 21 nt, Human
ucacuguagccucugccucag

SEQ ID NO: 634074 - RNA, 18 nt, Human
ucagaacuaaaacuacaa

SEQ ID NO: 634075 - RNA, 26 nt, Human
ucagaacuaaaacuacaacuccucuc

SEQ ID NO: 634076 - RNA, 24 nt, Human
ucccaaagugcugggauuacaggc

SEQ ID NO: 634077 - RNA, 19 nt, Human
ucucaccguguuggccagg

SEQ ID NO: 634078 - RNA, 24 nt, Human
ucucaccguguuggccaggcuggu

SEQ ID NO: 634079 - RNA, 24 nt, Human
ucucacucugucacccaagcugga

SEQ ID NO: 634080 - RNA, 21 nt, Human
ucucaggaaaaugcuuuuguc

SEQ ID NO: 634081 - RNA, 23 nt, Human
ucuccugccucagccugaguagc

SEQ ID NO: 634082 - RNA, 21 nt, Human
ucucgaacuccuggccucaag

SEQ ID NO: 634083 - RNA, 25 nt, Human
ucugucacccaagcuggaguugcag

SEQ ID NO: 634084 - RNA, 26 nt, Human
ugauccacccaccuugcucagccucc

SEQ ID NO: 634085 - RNA, 22 nt, Human
ugcaguggcgugaucuccacuc

SEQ ID NO: 634086 - RNA, 21 nt, Human
ugccucagccugaguagcugg

SEQ ID NO: 634087 - RNA, 23 nt, Human
ugcucagccucccaaagugcugg

SEQ ID NO: 634088 - RNA, 21 nt, Human
uggaaaaaaaaaacuugaaug

SEQ ID NO: 634089 - RNA, 24 nt, Human
uggagcaucaauuuucugcaaccu

SEQ ID NO: 634090 - RNA, 24 nt, Human
uggccaggcuggucucgaacuccu

SEQ ID NO: 634091 - RNA, 22 nt, Human
uggccucaagugauccacccac

SEQ ID NO: 634092 - RNA, 27 nt, Human
uggccucaagugauccacccaccuugc

SEQ ID NO: 634093 - RNA, 23 nt, Human
uggcgugaucuccacucacugua

SEQ ID NO: 634094 - RNA, 24 nt, Human
uggcgugaucuccacucacuguag

SEQ ID NO: 634095 - RNA, 18 nt, Human
ugggauuacaggccugag

SEQ ID NO: 634096 - RNA, 21 nt, Human
ugggauuacaggccugagcca

SEQ ID NO: 634097 - RNA, 22 nt, Human
ugggauuacaggccugagccac

SEQ ID NO: 634098 - RNA, 23 nt, Human
ugggauuacaggccugagccacc

SEQ ID NO: 634099 - RNA, 23 nt, Human
ugggauuacaggccugagccacc

SEQ ID NO: 634100 - RNA, 24 nt, Human
ugggauuacaggccugagccaccg

SEQ ID NO: 634101 - RNA, 21 nt, Human
uucaagcgauucuccugccuc

SEQ ID NO: 634102 - RNA, 23 nt, Human
uucaagcgauucuccugccucag

SEQ ID NO: 634103 - RNA, 24 nt, Human
uucaagcgauucuccugccucagc

SEQ ID NO: 634104 - RNA, 29 nt, Human
uucuccucuaucaccauucuucuugagau

SEQ ID NO: 634105 - RNA, 23 nt, Human
uugagacggucucacucugucac

SEQ ID NO: 634106 - RNA, 18 nt, Human
uuuccugcuguugacauc

SEQ ID NO: 634107 - RNA, 24 nt, Human
uuuguuuuggggguuaggcaaauu

SEQ ID NO: 634108 - RNA, 21 nt, Human
uuuucugcaaccuuucaagaa

SEQ ID NO: 634109 - RNA, 20 nt, Human
uuuuuguauuuuuaguaaag

SEQ ID NO: 634110 - RNA, 23 nt, Human
uuuuuguauuuuuaguaaagaca

SEQ ID NO: 634111 - RNA, 25 nt, Human
uuuuuuuuuuuuugagacggucuca

SEQ ID NO: 634112 - RNA, 27 nt, Human
uuuuuuuuuuuuuuuuuuuuuuugggg

SEQ ID NO: 634113 - RNA, 22 nt, Human
aaaaaagauucccacaacauga

SEQ ID NO: 634114 - RNA, 22 nt, Human
aaaaaagauucccacaacauga

SEQ ID NO: 634115 - RNA, 24 nt, Human
aaaaaagauucccacaacaugacc

SEQ ID NO: 634116 - RNA, 24 nt, Human
aaaaaagauucccacaacaugacc

SEQ ID NO: 634117 - RNA, 22 nt, Human
aaauuugcuguacaccuaaacc

SEQ ID NO: 634118 - RNA, 22 nt, Human
aaauuugcuguacaccuaaacc

SEQ ID NO: 634119 - RNA, 24 nt, Human
aagaacaaagacaacugcaaaaaa

SEQ ID NO: 634120 - RNA, 25 nt, Human
aagaacaaagacaacugcaaaaaaa

SEQ ID NO: 634121 - RNA, 22 nt, Human
aagacaacugcaaaaaaagcaa

SEQ ID NO: 634122 - RNA, 26 nt, Human
aaucucugugugugugugugugugug

SEQ ID NO: 634123 - RNA, 22 nt, Human
acaacugcaaaaaaagcaacag

SEQ ID NO: 634124 - RNA, 20 nt, Human
acauaaacucugaagaugag

SEQ ID NO: 634125 - RNA, 18 nt, Human
acugcaaaaaaagcaaca

SEQ ID NO: 634126 - RNA, 23 nt, Human
acuuccccaaagcauggccccaa

SEQ ID NO: 634127 - RNA, 23 nt, Human
acuuccccaaagcauggccccaa

SEQ ID NO: 634128 - RNA, 23 nt, Human
agaacaaagacaacugcaaaaaa

SEQ ID NO: 634129 - RNA, 24 nt, Human
agaacaaagacaacugcaaaaaaa

SEQ ID NO: 634130 - RNA, 19 nt, Human
agacaacugcaaaaaaagc

SEQ ID NO: 634131 - RNA, 24 nt, Human
agacagcaauaacaagguaacaaa

SEQ ID NO: 634132 - RNA, 24 nt, Human
agacagcaauaacaagguaacaaa

SEQ ID NO: 634133 - RNA, 25 nt, Human
auaaaguccugcuuaggacauaaag

SEQ ID NO: 634134 - RNA, 25 nt, Human
auaaaguccugcuuaggacauaaag

SEQ ID NO: 634135 - RNA, 19 nt, Human
auagagcagaggaugaccu

SEQ ID NO: 634136 - RNA, 19 nt, Human
auagagcagaggaugaccu

SEQ ID NO: 634137 - RNA, 21 nt, Human
auagagcagaggaugaccuuu

SEQ ID NO: 634138 - RNA, 21 nt, Human
auagagcagaggaugaccuuu

SEQ ID NO: 634139 - RNA, 18 nt, Human
aucuuauuggcacucugc

SEQ ID NO: 634140 - RNA, 18 nt, Human
aucuuauuggcacucugc

SEQ ID NO: 634141 - RNA, 23 nt, Human
augaaucaagaguaggcucaaag

SEQ ID NO: 634142 - RNA, 23 nt, Human
augaaucaagaguaggcucaaag

SEQ ID NO: 634143 - RNA, 19 nt, Human
auguagcaguaguugcguc

SEQ ID NO: 634144 - RNA, 24 nt, Human
caacggccgccgcuuuuugggccg

SEQ ID NO: 634145 - RNA, 20 nt, Human
caacugcaaaaaagcaacag

SEQ ID NO: 634146 - RNA, 25 nt, Human
caaucugcaaaaaaauggaaguucu

SEQ ID NO: 634147 - RNA, 25 nt, Human
caaucugcaaaaaaauggaaguucu

SEQ ID NO: 634148 - RNA, 19 nt, Human
cacccagucagcuccugga

SEQ ID NO: 634149 - RNA, 19 nt, Human
cacccagucagcuccugga

SEQ ID NO: 634150 - RNA, 22 nt, Human
cacccagucagcuccuggaggg

SEQ ID NO: 634151 - RNA, 22 nt, Human
cacccagucagcuccuggaggg

SEQ ID NO: 634152 - RNA, 22 nt, Human
cacuauuuaaaaaaaagauucc

SEQ ID NO: 634153 - RNA, 22 nt, Human
cacuauuuaaaaaaaagauucc

SEQ ID NO: 634154 - RNA, 20 nt, Human
cacucugcaugaaucaagag

SEQ ID NO: 634155 - RNA, 20 nt, Human
cacucugcaugaaucaagag

SEQ ID NO: 634156 - RNA, 21 nt, Human
cacucugcaugaaucaagagu

SEQ ID NO: 634157 - RNA, 21 nt, Human
cacucugcaugaaucaagagu

SEQ ID NO: 634158 - RNA, 21 nt, Human
cagcaacacccagucagcucc

SEQ ID NO: 634159 - RNA, 21 nt, Human
cagcaacacccagucagcucc

SEQ ID NO: 634160 - RNA, 20 nt, Human
ccaaagcauggccccaagaa

SEQ ID NO: 634161 - RNA, 20 nt, Human
ccaaagcauggccccaagaa

SEQ ID NO: 634162 - RNA, 21 nt, Human
ccacaucagcugccgcagcca

SEQ ID NO: 634163 - RNA, 25 nt, Human
cccaagaagccauuauuauaauaga

SEQ ID NO: 634164 - RNA, 25 nt, Human
cccaagaagccauuauuauaauaga

SEQ ID NO: 634165 - RNA, 21 nt, Human
cccacaacaugaccuucugag

SEQ ID NO: 634166 - RNA, 21 nt, Human
cccacaacaugaccuucugag

SEQ ID NO: 634167 - RNA, 27 nt, Human
cuaacacaaaguccaacauuugcuuca

SEQ ID NO: 634168 - RNA, 27 nt, Human
cuaacacaaaguccaacauuugcuuca

SEQ ID NO: 634169 - RNA, 24 nt, Human
cucaaaugauauuaaaagcucuac

SEQ ID NO: 634170 - RNA, 24 nt, Human
cucaaaugauauuaaaagcucuac

SEQ ID NO: 634171 - RNA, 19 nt, Human
cucaaggcccaguugcugg

SEQ ID NO: 634172 - RNA, 19 nt, Human
cucaaggcccaguugcugg

SEQ ID NO: 634173 - RNA, 21 nt, Human
gaaucaagaguaggcucaaag

SEQ ID NO: 634174 - RNA, 21 nt, Human
gaaucaagaguaggcucaaag

SEQ ID NO: 634175 - RNA, 18 nt, Human
gcauggccccaagaagcc

SEQ ID NO: 634176 - RNA, 18 nt, Human
gcauggccccaagaagcc

SEQ ID NO: 634177 - RNA, 20 nt, Human
ggaugaccuuuuuguaaaaa

SEQ ID NO: 634178 - RNA, 20 nt, Human
ggaugaccuuuuuguaaaaa

SEQ ID NO: 634179 - RNA, 22 nt, Human
ggccacaucagcugccgcagcc

SEQ ID NO: 634180 - RNA, 21 nt, Human
gugugugugugugugugugug

SEQ ID NO: 634181 - RNA, 21 nt, Human
gugugugugugugugugugug

SEQ ID NO: 634182 - RNA, 21 nt, Human
gugugugugugugugugugug

SEQ ID NO: 634183 - RNA, 19 nt, Human
guuuugcuuaggaaagucc

SEQ ID NO: 634184 - RNA, 19 nt, Human
uaaaaaaaagauucccaca

SEQ ID NO: 634185 - RNA, 19 nt, Human
uaaaaaaaagauucccaca

SEQ ID NO: 634186 - RNA, 19 nt, Human
uaaaagcucuacacaaaag

SEQ ID NO: 634187 - RNA, 19 nt, Human
uaaaagcucuacacaaaag

SEQ ID NO: 634188 - RNA, 23 nt, Human
uaagacacaauccacugacuauu

SEQ ID NO: 634189 - RNA, 23 nt, Human
uaagacacaauccacugacuauu

SEQ ID NO: 634190 - RNA, 27 nt, Human
uaagacacaauccacugacuauuuuaa

SEQ ID NO: 634191 - RNA, 27 nt, Human
uaagacacaauccacugacuauuuuaa

SEQ ID NO: 634192 - RNA, 18 nt, Human
uacagcugcugcugcuga

SEQ ID NO: 634193 - RNA, 18 nt, Human
uacagcugcugcugcuga

SEQ ID NO: 634194 - RNA, 20 nt, Human
uaguugcgucuguggcuuuc

SEQ ID NO: 634195 - RNA, 18 nt, Human
ucuagcuguauccagggc

SEQ ID NO: 634196 - RNA, 18 nt, Human
ucugcaaaaaaauggaag

SEQ ID NO: 634197 - RNA, 18 nt, Human
ucugcaaaaaaauggaag

SEQ ID NO: 634198 - RNA, 24 nt, Human
ucugugugugugugugugugugug

SEQ ID NO: 634199 - RNA, 24 nt, Human
ucugugugugugugugugugugug

SEQ ID NO: 634200 - RNA, 25 nt, Human
ucuuucaguagaacauaaacucuga

SEQ ID NO: 634201 - RNA, 25 nt, Human
ucuuucaguagaacauaaacucuga

SEQ ID NO: 634202 - RNA, 23 nt, Human
ugaaaggacugggaaugucgauu

SEQ ID NO: 634203 - RNA, 23 nt, Human
ugaaaggacugggaaugucgauu

SEQ ID NO: 634204 - RNA, 25 nt, Human
ugagguaaaauacaauacagcugcu

SEQ ID NO: 634205 - RNA, 25 nt, Human
ugagguaaaauacaauacagcugcu

SEQ ID NO: 634206 - RNA, 19 nt, Human
ugaguuucugcagacaauc

SEQ ID NO: 634207 - RNA, 19 nt, Human
ugaguuucugcagacaauc

SEQ ID NO: 634208 - RNA, 23 nt, Human
ugcagacaaucugcaaaaaaaug

SEQ ID NO: 634209 - RNA, 23 nt, Human
ugcagacaaucugcaaaaaaaug

SEQ ID NO: 634210 - RNA, 20 nt, Human
ugcugcugcugaugagcugu

SEQ ID NO: 634211 - RNA, 20 nt, Human
ugcugcugcugaugagcugu

SEQ ID NO: 634212 - RNA, 22 nt, Human
ugggaaugucgauuaagauaug

SEQ ID NO: 634213 - RNA, 22 nt, Human
ugggaaugucgauuaagauaug

SEQ ID NO: 634214 - RNA, 19 nt, Human
ugucaaaaagacauuuuac

SEQ ID NO: 634215 - RNA, 19 nt, Human
ugucaaaaagacauuuuac

SEQ ID NO: 634216 - RNA, 19 nt, Human
uguguguguguauacacac

SEQ ID NO: 634217 - RNA, 19 nt, Human
uguguguguguauacacac

SEQ ID NO: 634218 - RNA, 21 nt, Human
uguguguguguauacacacgu

SEQ ID NO: 634219 - RNA, 21 nt, Human
uguguguguguauacacacgu

SEQ ID NO: 634220 - RNA, 21 nt, Human
uguguguguguguauacacac

SEQ ID NO: 634221 - RNA, 21 nt, Human
uguguguguguguauacacac

SEQ ID NO: 634222 - RNA, 18 nt, Human
uguguguguguguguaua

SEQ ID NO: 634223 - RNA, 18 nt, Human
uguguguguguguguaua

SEQ ID NO: 634224 - RNA, 22 nt, Human
uguguguguguguguauacaca

SEQ ID NO: 634225 - RNA, 22 nt, Human
uguguguguguguguauacaca

SEQ ID NO: 634226 - RNA, 18 nt, Human
ugugugugugugugugug

SEQ ID NO: 634227 - RNA, 18 nt, Human
ugugugugugugugugug

SEQ ID NO: 634228 - RNA, 18 nt, Human
ugugugugugugugugug

SEQ ID NO: 634229 - RNA, 18 nt, Human
ugugugugugugugugug

SEQ ID NO: 634230 - RNA, 18 nt, Human
ugugugugugugugugug

SEQ ID NO: 634231 - RNA, 18 nt, Human
ugugugugugugugugug

SEQ ID NO: 634232 - RNA, 18 nt, Human
ugugugugugugugugug

SEQ ID NO: 634233 - RNA, 18 nt, Human
ugugugugugugugugug

SEQ ID NO: 634234 - RNA, 18 nt, Human
ugugugugugugugugug

SEQ ID NO: 634235 - RNA, 18 nt, Human
ugugugugugugugugug

SEQ ID NO: 634236 - RNA, 18 nt, Human
ugugugugugugugugug

SEQ ID NO: 634237 - RNA, 22 nt, Human
uguguguguguguguguguaua

SEQ ID NO: 634238 - RNA, 22 nt, Human
uguguguguguguguguguaua

SEQ ID NO: 634239 - RNA, 20 nt, Human
ugugugugugugugugugug

SEQ ID NO: 634240 - RNA, 21 nt, Human
ugugugugugugugugugugu

SEQ ID NO: 634241 - RNA, 21 nt, Human
ugugugugugugugugugugu

SEQ ID NO: 634242 - RNA, 21 nt, Human
ugugugugugugugugugugu

SEQ ID NO: 634243 - RNA, 21 nt, Human
ugugugugugugugugugugu

SEQ ID NO: 634244 - RNA, 21 nt, Human
ugugugugugugugugugugu

SEQ ID NO: 634245 - RNA, 21 nt, Human
ugugugugugugugugugugu

SEQ ID NO: 634246 - RNA, 21 nt, Human
ugugugugugugugugugugu

SEQ ID NO: 634247 - RNA, 21 nt, Human
ugugugugugugugugugugu

SEQ ID NO: 634248 - RNA, 21 nt, Human
ugugugugugugugugugugu

SEQ ID NO: 634249 - RNA, 21 nt, Human
ugugugugugugugugugugu

SEQ ID NO: 634250 - RNA, 21 nt, Human
ugugugugugugugugugugu

SEQ ID NO: 634251 - RNA, 21 nt, Human
ugugugugugugugugugugu

SEQ ID NO: 634252 - RNA, 21 nt, Human
ugugugugugugugugugugu

SEQ ID NO: 634253 - RNA, 21 nt, Human
ugugugugugugugugugugu

SEQ ID NO: 634254 - RNA, 22 nt, Human
ugugugugugugugugugugua

SEQ ID NO: 634255 - RNA, 22 nt, Human
ugugugugugugugugugugua

SEQ ID NO: 634256 - RNA, 22 nt, Human
ugugugugugugugugugugug

SEQ ID NO: 634257 - RNA, 22 nt, Human
ugugugugugugugugugugug

SEQ ID NO: 634258 - RNA, 21 nt, Human
uuguaaaaaauugcugccuca

SEQ ID NO: 634259 - RNA, 21 nt, Human
uuguaaaaaauugcugccuca

SEQ ID NO: 634260 - RNA, 21 nt, Human
uuugcuguacaccuaaaccau

SEQ ID NO: 634261 - RNA, 21 nt, Human
uuugcuguacaccuaaaccau

SEQ ID NO: 634262 - RNA, 20 nt, Human
uuugcuguacaccuaaaccc

SEQ ID NO: 634263 - RNA, 20 nt, Human
uuuuuuuuuuuuuaaaggca

SEQ ID NO: 634264 - RNA, 22 nt, Human
uuuuuuuuuuuuuuuuuaaagg

SEQ ID NO: 634265 - RNA, 24 nt, Human
aaagccugcuuugcaccaggcacu

SEQ ID NO: 634266 - RNA, 19 nt, Human
aaagugcugggauuacagg

SEQ ID NO: 634267 - RNA, 22 nt, Human
aaagugcugggauuacaggggg

SEQ ID NO: 634268 - RNA, 25 nt, Human
aaagugcugggauuacaggggguga

SEQ ID NO: 634269 - RNA, 22 nt, Human
aaaucgcucuugagauuccuac

SEQ ID NO: 634270 - RNA, 23 nt, Human
aaauguauagcccugggggcccu

SEQ ID NO: 634271 - RNA, 18 nt, Human
aagaagcagaaagacccc

SEQ ID NO: 634272 - RNA, 18 nt, Human
aagcagauggucaguuug

SEQ ID NO: 634273 - RNA, 21 nt, Human
aaggagcugagacaguauuuu

SEQ ID NO: 634274 - RNA, 21 nt, Human
aagucaggaaaagggcaguaa

SEQ ID NO: 634275 - RNA, 18 nt, Human
aagugcugggauuacagg

SEQ ID NO: 634276 - RNA, 22 nt, Human
aagugcugggauuacagggggu

SEQ ID NO: 634277 - RNA, 27 nt, Human
aagugcugggauuacagggggugagcc

SEQ ID NO: 634278 - RNA, 25 nt, Human
acaaaggacaaggaugccccacuuc

SEQ ID NO: 634279 - RNA, 23 nt, Human
acaagaaagaagcagaaagaccc

SEQ ID NO: 634280 - RNA, 20 nt, Human
acccccacuccuccagaaau

SEQ ID NO: 634281 - RNA, 19 nt, Human
acuacaggugugcgccacc

SEQ ID NO: 634282 - RNA, 22 nt, Human
acuggguuucacuauauguugg

SEQ ID NO: 634283 - RNA, 26 nt, Human
acuggguuucacuauauguuggccag

SEQ ID NO: 634284 - RNA, 23 nt, Human
agacaggugucacuggguuucuu

SEQ ID NO: 634285 - RNA, 22 nt, Human
agagacagagucuugcucuguc

SEQ ID NO: 634286 - RNA, 18 nt, Human
agauccagagggcagagg

SEQ ID NO: 634287 - RNA, 23 nt, Human
agaugucucugugcuccuggagu

SEQ ID NO: 634288 - RNA, 18 nt, Human
aggaaacaaaauaccugu

SEQ ID NO: 634289 - RNA, 25 nt, Human
aggcuggagugcaguggcgcaaucu

SEQ ID NO: 634290 - RNA, 23 nt, Human
agggaaauguauagcccuggggg

SEQ ID NO: 634291 - RNA, 24 nt, Human
aggugauccgcccaccuuggcuuc

SEQ ID NO: 634292 - RNA, 19 nt, Human
aguagagacuggguuucac

SEQ ID NO: 634293 - RNA, 21 nt, Human
agugcaguggcgcaaucucag

SEQ ID NO: 634294 - RNA, 24 nt, Human
augcaauggauauuuaaacacauc

SEQ ID NO: 634295 - RNA, 18 nt, Human
auguuggccaggcugguc

SEQ ID NO: 634296 - RNA, 25 nt, Human
caaagugcugggauuacagggggug

SEQ ID NO: 634297 - RNA, 21 nt, Human
cacauauucugucaaucugga

SEQ ID NO: 634298 - RNA, 24 nt, Human
caccacaccuagcuaauuuuugua

SEQ ID NO: 634299 - RNA, 22 nt, Human
caccuagacaggugucacuggg

SEQ ID NO: 634300 - RNA, 21 nt, Human
cacugcaaccucugccuccug

SEQ ID NO: 634301 - RNA, 23 nt, Human
cacugcaaccucugccuccuggg

SEQ ID NO: 634302 - RNA, 20 nt, Human
cacuuccacuuccugcccug

SEQ ID NO: 634303 - RNA, 21 nt, Human
cacuuggguccguuguuggca

SEQ ID NO: 634304 - RNA, 21 nt, Human
cacuuugcauuagcugagggu

SEQ ID NO: 634305 - RNA, 25 nt, Human
cagaagagacagauauuaauaaaug

SEQ ID NO: 634306 - RNA, 18 nt, Human
cagaggaggugaagagcu

SEQ ID NO: 634307 - RNA, 18 nt, Human
cagccccuuccucagcag

SEQ ID NO: 634308 - RNA, 19 nt, Human
cagccccuuccucagcagc

SEQ ID NO: 634309 - RNA, 21 nt, Human
cagcuuauccuccccuucuca

SEQ ID NO: 634310 - RNA, 22 nt, Human
cagcuuauccuccccuucucaa

SEQ ID NO: 634311 - RNA, 22 nt, Human
caggugauucuccugccucagc

SEQ ID NO: 634312 - RNA, 24 nt, Human
ccaaagaugucucugugcuccugg

SEQ ID NO: 634313 - RNA, 19 nt, Human
ccaaagugcugggauuaca

SEQ ID NO: 634314 - RNA, 20 nt, Human
ccaaagugcugggauuacag

SEQ ID NO: 634315 - RNA, 21 nt, Human
ccaaagugcugggauuacagg

SEQ ID NO: 634316 - RNA, 25 nt, Human
ccaaagugcugggauuacagggggu

SEQ ID NO: 634317 - RNA, 21 nt, Human
ccaccacccccacuccuccag

SEQ ID NO: 634318 - RNA, 21 nt, Human
ccaggcuggagugcaguggcg

SEQ ID NO: 634319 - RNA, 21 nt, Human
cccaccacccccacuccucca

SEQ ID NO: 634320 - RNA, 26 nt, Human
cccauuauauccacugaagacagaaa

SEQ ID NO: 634321 - RNA, 23 nt, Human
ccccugauucuagacaucaaaau

SEQ ID NO: 634322 - RNA, 18 nt, Human
ccucagcuucccauguag

SEQ ID NO: 634323 - RNA, 24 nt, Human
ccuccuggguucaggugauucucc

SEQ ID NO: 634324 - RNA, 22 nt, Human
ccucugccuccuggguucaggu

SEQ ID NO: 634325 - RNA, 24 nt, Human
ccugaccucaggugauccgcccac

SEQ ID NO: 634326 - RNA, 24 nt, Human
ccugccucagcuucccauguagcu

SEQ ID NO: 634327 - RNA, 18 nt, Human
ccugggaguauuuaauaa

SEQ ID NO: 634328 - RNA, 21 nt, Human
ccuggguucaggugauucucc

SEQ ID NO: 634329 - RNA, 21 nt, Human
cuacccaccacccccacuccu

SEQ ID NO: 634330 - RNA, 20 nt, Human
cuagauccagagggcagagg

SEQ ID NO: 634331 - RNA, 24 nt, Human
cucacugcaaccucugccuccugg

SEQ ID NO: 634332 - RNA, 24 nt, Human
cucagcuucccauguagcugggac

SEQ ID NO: 634333 - RNA, 24 nt, Human
cucaggugauccgcccaccuuggc

SEQ ID NO: 634334 - RNA, 19 nt, Human
cuccacucguucugguuua

SEQ ID NO: 634335 - RNA, 21 nt, Human
cuccuggguucaggugauucu

SEQ ID NO: 634336 - RNA, 19 nt, Human
cugcaaccucugccuccug

SEQ ID NO: 634337 - RNA, 23 nt, Human
cugcaaccucugccuccuggguu

SEQ ID NO: 634338 - RNA, 24 nt, Human
cugcaaccucugccuccuggguuc

SEQ ID NO: 634339 - RNA, 20 nt, Human
cuggaguuugcaggccagca

SEQ ID NO: 634340 - RNA, 26 nt, Human
cuggguuucacuauauguuggccagg

SEQ ID NO: 634341 - RNA, 19 nt, Human
cugugcuccuggaguuugc

SEQ ID NO: 634342 - RNA, 19 nt, Human
cuuacaauauccacugaac

SEQ ID NO: 634343 - RNA, 21 nt, Human
gacaagaaagaagcagaaaga

SEQ ID NO: 634344 - RNA, 24 nt, Human
gacagagucuugcucugucgccag

SEQ ID NO: 634345 - RNA, 24 nt, Human
gaccucaggugauccgcccaccuu

SEQ ID NO: 634346 - RNA, 18 nt, Human
gagggaagggaaaggagu

SEQ ID NO: 634347 - RNA, 19 nt, Human
gauuacagggggugagcca

SEQ ID NO: 634348 - RNA, 23 nt, Human
gauuauuuauuuauuuauuuauu

SEQ ID NO: 634349 - RNA, 22 nt, Human
gauuauuugagcugacaucuga

SEQ ID NO: 634350 - RNA, 19 nt, Human
gauuccuacccaccacccc

SEQ ID NO: 634351 - RNA, 22 nt, Human
gcaaccucugccuccuggguuc

SEQ ID NO: 634352 - RNA, 24 nt, Human
gccucagcuucccauguagcuggg

SEQ ID NO: 634353 - RNA, 18 nt, Human
gcucugggauguaugccc

SEQ ID NO: 634354 - RNA, 19 nt, Human
gcuggagugcaguggcgca

SEQ ID NO: 634355 - RNA, 23 nt, Human
gcuggucuagaacuccugaccuc

SEQ ID NO: 634356 - RNA, 21 nt, Human
ggaaaucauguucaaaaaucc

SEQ ID NO: 634357 - RNA, 24 nt, Human
ggcuggucuagaacuccugaccuc

SEQ ID NO: 634358 - RNA, 22 nt, Human
gggaaaaggcaagucaggaaaa

SEQ ID NO: 634359 - RNA, 24 nt, Human
gggcagaggaggugaagagcuuuu

SEQ ID NO: 634360 - RNA, 24 nt, Human
ggugauucuccugccucagcuucc

SEQ ID NO: 634361 - RNA, 24 nt, Human
gucuugcucugucgccaggcugga

SEQ ID NO: 634362 - RNA, 24 nt, Human
gugauucuccugccucagcuuccc

SEQ ID NO: 634363 - RNA, 21 nt, Human
uaaaaugaguuccacuuccug

SEQ ID NO: 634364 - RNA, 22 nt, Human
uaaacacaagcucuaaaucacc

SEQ ID NO: 634365 - RNA, 27 nt, Human
uaauuuuuguauuuuuuuuaguagaga

SEQ ID NO: 634366 - RNA, 22 nt, Human
uacaggugugcgccaccacacc

SEQ ID NO: 634367 - RNA, 23 nt, Human
uagagacuggguuucacuauaug

SEQ ID NO: 634368 - RNA, 20 nt, Human
uaguagagacuggguuucac

SEQ ID NO: 634369 - RNA, 24 nt, Human
uaguagagacuggguuucacuaua

SEQ ID NO: 634370 - RNA, 25 nt, Human
uaguagagacuggguuucacuauau

SEQ ID NO: 634371 - RNA, 22 nt, Human
uaugccaggccuuuuguguauu

SEQ ID NO: 634372 - RNA, 19 nt, Human
uauguuggccaggcugguc

SEQ ID NO: 634373 - RNA, 20 nt, Human
uauguuggccaggcuggucu

SEQ ID NO: 634374 - RNA, 24 nt, Human
uauguuggccaggcuggucuagaa

SEQ ID NO: 634375 - RNA, 24 nt, Human
uauuacagcauaaauaauccuaaa

SEQ ID NO: 634376 - RNA, 24 nt, Human
uauucugucaaucuggagcuucca

SEQ ID NO: 634377 - RNA, 19 nt, Human
uauuuugagagacagaguc

SEQ ID NO: 634378 - RNA, 20 nt, Human
ucacuagauccagagggcag

SEQ ID NO: 634379 - RNA, 24 nt, Human
ucacugcaaccucugccuccuggg

SEQ ID NO: 634380 - RNA, 25 nt, Human
ucacugcaaccucugccuccugggu

SEQ ID NO: 634381 - RNA, 26 nt, Human
ucacugcaaccucugccuccuggguu

SEQ ID NO: 634382 - RNA, 20 nt, Human
ucagagauuuucauaucuag

SEQ ID NO: 634383 - RNA, 19 nt, Human
ucaggugauucuccugccu

SEQ ID NO: 634384 - RNA, 20 nt, Human
ucaggugauucuccugccuc

SEQ ID NO: 634385 - RNA, 19 nt, Human
uccagagggcagaggaggu

SEQ ID NO: 634386 - RNA, 19 nt, Human
ucccaaagaugucucugug

SEQ ID NO: 634387 - RNA, 18 nt, Human
ucccaaagugcugggauu

SEQ ID NO: 634388 - RNA, 23 nt, Human
ucccaaagugcugggauuacagg

SEQ ID NO: 634389 - RNA, 21 nt, Human
uccccgauguccuguuccggu

SEQ ID NO: 634390 - RNA, 22 nt, Human
uccccgauguccuguuccgguu

SEQ ID NO: 634391 - RNA, 24 nt, Human
uccuggguucaggugauucuccug

SEQ ID NO: 634392 - RNA, 20 nt, Human
ucuaaaucacccauaaauuc

SEQ ID NO: 634393 - RNA, 22 nt, Human
ucuccugccucagcuucccaug

SEQ ID NO: 634394 - RNA, 18 nt, Human
ucugucgccaggcuggag

SEQ ID NO: 634395 - RNA, 21 nt, Human
ucugucgccaggcuggagugc

SEQ ID NO: 634396 - RNA, 23 nt, Human
ucugucgccaggcuggagugcag

SEQ ID NO: 634397 - RNA, 21 nt, Human
ucuugcucugucgccaggcug

SEQ ID NO: 634398 - RNA, 22 nt, Human
ucuugcucugucgccaggcugg

SEQ ID NO: 634399 - RNA, 23 nt, Human
ucuugcucugucgccaggcugga

SEQ ID NO: 634400 - RNA, 19 nt, Human
ugaagacagaaagcuugca

SEQ ID NO: 634401 - RNA, 18 nt, Human
ugacaagaaagaagcaga

SEQ ID NO: 634402 - RNA, 24 nt, Human
ugacaagaaagaagcagaaagacc

SEQ ID NO: 634403 - RNA, 18 nt, Human
ugaccucaggugauccgc

SEQ ID NO: 634404 - RNA, 21 nt, Human
ugaccucaggugauccgccca

SEQ ID NO: 634405 - RNA, 24 nt, Human
ugaccucaggugauccgcccaccu

SEQ ID NO: 634406 - RNA, 26 nt, Human
ugagaagauacaguaugaacuaaaag

SEQ ID NO: 634407 - RNA, 23 nt, Human
ugauccgcccaccuuggcuuccc

SEQ ID NO: 634408 - RNA, 22 nt, Human
ugcaguggcgcaaucucagcuc

SEQ ID NO: 634409 - RNA, 23 nt, Human
ugcaguggcgcaaucucagcuca

SEQ ID NO: 634410 - RNA, 24 nt, Human
ugccucagcuucccauguagcugg

SEQ ID NO: 634411 - RNA, 23 nt, Human
ugcucugucgccaggcuggagug

SEQ ID NO: 634412 - RNA, 27 nt, Human
uggaaagcagauggucaguuuggcuuu

SEQ ID NO: 634413 - RNA, 18 nt, Human
uggagugcaguggcgcaa

SEQ ID NO: 634414 - RNA, 23 nt, Human
uggagugcaguggcgcaaucuca

SEQ ID NO: 634415 - RNA, 24 nt, Human
uggagugcaguggcgcaaucucag

SEQ ID NO: 634416 - RNA, 21 nt, Human
uggaguuugcaggccagcaga

SEQ ID NO: 634417 - RNA, 25 nt, Human
uggcaaguguggauuugugccuucu

SEQ ID NO: 634418 - RNA, 24 nt, Human
uggccaggcuggucuagaacuccu

SEQ ID NO: 634419 - RNA, 24 nt, Human
uggcgcaaucucagcucacugcaa

SEQ ID NO: 634420 - RNA, 18 nt, Human
ugggaaaaugaccuuggu

SEQ ID NO: 634421 - RNA, 23 nt, Human
ugggauuacagggggugagccac

SEQ ID NO: 634422 - RNA, 25 nt, Human
ugggauuacagggggugagccacca

SEQ ID NO: 634423 - RNA, 21 nt, Human
ugggcacauacacacuuugca

SEQ ID NO: 634424 - RNA, 22 nt, Human
ugggcuaagcccuggggaaauc

SEQ ID NO: 634425 - RNA, 21 nt, Human
uggguccguuguuggcaagug

SEQ ID NO: 634426 - RNA, 23 nt, Human
uggucuagaacuccugaccucag

SEQ ID NO: 634427 - RNA, 18 nt, Human
uguagcugggacuacuac

SEQ ID NO: 634428 - RNA, 24 nt, Human
ugucucugugcuccuggaguuugc

SEQ ID NO: 634429 - RNA, 18 nt, Human
ugugcagaggagcaaauc

SEQ ID NO: 634430 - RNA, 20 nt, Human
ugugcgccaccacaccuagc

SEQ ID NO: 634431 - RNA, 20 nt, Human
uuaaucaccacccaaaucau

SEQ ID NO: 634432 - RNA, 21 nt, Human
uuaguagagacuggguuucac

SEQ ID NO: 634433 - RNA, 24 nt, Human
uuaguagagacuggguuucacuau

SEQ ID NO: 634434 - RNA, 21 nt, Human
uuaguagguuuugguaacuca

SEQ ID NO: 634435 - RNA, 18 nt, Human
uuauuuauuuauuuauuu

SEQ ID NO: 634436 - RNA, 18 nt, Human
uuauuuauuuauuuauuu

SEQ ID NO: 634437 - RNA, 19 nt, Human
uuauuuauuuauuuauuua

SEQ ID NO: 634438 - RNA, 25 nt, Human
uuauuuauuuauuuauuuauuuauu

SEQ ID NO: 634439 - RNA, 25 nt, Human
uuauuuauuuauuuauuuauuuauu

SEQ ID NO: 634440 - RNA, 25 nt, Human
uuauuuauuuauuuauuuauuuauu

SEQ ID NO: 634441 - RNA, 28 nt, Human
uuauuuauuuauuuauuuauuuauuuug

SEQ ID NO: 634442 - RNA, 23 nt, Human
uucaggugauucuccugccucag

SEQ ID NO: 634443 - RNA, 22 nt, Human
uuccacuuccugcccugcagcu

SEQ ID NO: 634444 - RNA, 18 nt, Human
uuccgguucagccaugag

SEQ ID NO: 634445 - RNA, 21 nt, Human
uuccucagcagcugugcauga

SEQ ID NO: 634446 - RNA, 23 nt, Human
uucuuugggguucugaauucuga

SEQ ID NO: 634447 - RNA, 21 nt, Human
uugaaagccugcuuugcaccg

SEQ ID NO: 634448 - RNA, 22 nt, Human
uuuauuuauuuauuuauuuauu

SEQ ID NO: 634449 - RNA, 22 nt, Human
uuucaugggcacauacacacuu

SEQ ID NO: 634450 - RNA, 21 nt, Human
uuuuguguauuucuuucuuuu

SEQ ID NO: 634451 - RNA, 24 nt, Human
uuuuuaguagagacuggguuucac

SEQ ID NO: 634452 - RNA, 23 nt, Human
uuuuuguauuuuuuuuaguagag

SEQ ID NO: 634453 - RNA, 21 nt, Human
aaaaccagcacauaggggccu

SEQ ID NO: 634454 - RNA, 24 nt, Human
aaaccccuccuuuucaaggggccu

SEQ ID NO: 634455 - RNA, 24 nt, Human
aaaggccaagggucacuucaccag

SEQ ID NO: 634456 - RNA, 24 nt, Human
aaagugcugggaccacaggcguga

SEQ ID NO: 634457 - RNA, 19 nt, Human
aaagugcugggauuacagg

SEQ ID NO: 634458 - RNA, 23 nt, Human
aaagugcugggauuacaggcaug

SEQ ID NO: 634459 - RNA, 24 nt, Human
aaagugcugggauuacaggcaugc

SEQ ID NO: 634460 - RNA, 23 nt, Human
aaccccuugccuucaccaagaag

SEQ ID NO: 634461 - RNA, 18 nt, Human
aacccuccgcccccaccc

SEQ ID NO: 634462 - RNA, 22 nt, Human
aacgaguccggguccaaggccc

SEQ ID NO: 634463 - RNA, 22 nt, Human
aacuauuuccucaucccuucua

SEQ ID NO: 634464 - RNA, 26 nt, Human
aagugcugggaccacaggcgugagcc

SEQ ID NO: 634465 - RNA, 19 nt, Human
aagugcugggauuacaggc

SEQ ID NO: 634466 - RNA, 21 nt, Human
aagugcugggauuacaggcau

SEQ ID NO: 634467 - RNA, 25 nt, Human
acacagcaagacuaaaaaaaaacaa

SEQ ID NO: 634468 - RNA, 23 nt, Human
agagcaggugcuaggccucccaa

SEQ ID NO: 634469 - RNA, 19 nt, Human
agauguuauccagugagcc

SEQ ID NO: 634470 - RNA, 18 nt, Human
agcaggugcuaggccuuc

SEQ ID NO: 634471 - RNA, 22 nt, Human
agccuguuuccucuccauucca

SEQ ID NO: 634472 - RNA, 25 nt, Human
agcgauaugaaacaggucccgggaa

SEQ ID NO: 634473 - RNA, 23 nt, Human
agcugugauggugggcagcugga

SEQ ID NO: 634474 - RNA, 18 nt, Human
aggccuucaguaggaaca

SEQ ID NO: 634475 - RNA, 19 nt, Human
aggcgaacccuccgccccc

SEQ ID NO: 634476 - RNA, 24 nt, Human
aggugauucacccaccuuggccuc

SEQ ID NO: 634477 - RNA, 23 nt, Human
aguagagauggggcuucaccaug

SEQ ID NO: 634478 - RNA, 18 nt, Human
agugcugggauuacaggc

SEQ ID NO: 634479 - RNA, 25 nt, Human
augcgccaccgcgcccagccgagaa

SEQ ID NO: 634480 - RNA, 18 nt, Human
auggggcuucaccauguu

SEQ ID NO: 634481 - RNA, 20 nt, Human
auggggcuucaccauguugg

SEQ ID NO: 634482 - RNA, 23 nt, Human
auggggcuucaccauguuggcca

SEQ ID NO: 634483 - RNA, 22 nt, Human
auuguuuuuuuucuuuuuaaac

SEQ ID NO: 634484 - RNA, 24 nt, Human
caaagugcugggaccacaggcgug

SEQ ID NO: 634485 - RNA, 24 nt, Human
caaagugcugggauuacaggcaug

SEQ ID NO: 634486 - RNA, 24 nt, Human
caacacagcaagacuaaaaaaaaa

SEQ ID NO: 634487 - RNA, 18 nt, Human
caacaggggacccacauc

SEQ ID NO: 634488 - RNA, 23 nt, Human
caagacuaaaaaaaaacaacuuu

SEQ ID NO: 634489 - RNA, 20 nt, Human
cacacuguaggcccagcuac

SEQ ID NO: 634490 - RNA, 18 nt, Human
cacagaggccaaggggag

SEQ ID NO: 634491 - RNA, 24 nt, Human
cacaggcgugagccaccaugccca

SEQ ID NO: 634492 - RNA, 21 nt, Human
cacaucaucuaccgcgaccag

SEQ ID NO: 634493 - RNA, 22 nt, Human
caccaagaagauggaauguuuc

SEQ ID NO: 634494 - RNA, 21 nt, Human
caccauguuggccaugcugau

SEQ ID NO: 634495 - RNA, 24 nt, Human
caccauguuggccaugcugaucuc

SEQ ID NO: 634496 - RNA, 22 nt, Human
cacccaccuuggccucccaaag

SEQ ID NO: 634497 - RNA, 23 nt, Human
cacccaccuuggccucccaaagu

SEQ ID NO: 634498 - RNA, 23 nt, Human
caccccucucccccacccuccca

SEQ ID NO: 634499 - RNA, 21 nt, Human
cacccucccaucccaccacag

SEQ ID NO: 634500 - RNA, 26 nt, Human
cagguccagccugggcaacacagcaa

SEQ ID NO: 634501 - RNA, 19 nt, Human
caggucccgggacacaggg

SEQ ID NO: 634502 - RNA, 27 nt, Human
caugcgccaccgcgcccagccgagaau

SEQ ID NO: 634503 - RNA, 22 nt, Human
caugcugaucucgaacuccuga

SEQ ID NO: 634504 - RNA, 21 nt, Human
ccaaaccccuccuuuucaagg

SEQ ID NO: 634505 - RNA, 20 nt, Human
ccaaagugcugggaccacag

SEQ ID NO: 634506 - RNA, 22 nt, Human
ccaaagugcugggaccacaggc

SEQ ID NO: 634507 - RNA, 22 nt, Human
ccaaagugcugggaccacaggc

SEQ ID NO: 634508 - RNA, 24 nt, Human
ccaaagugcugggaccacaggcgu

SEQ ID NO: 634509 - RNA, 23 nt, Human
ccaaagugcugggauuacaggca

SEQ ID NO: 634510 - RNA, 24 nt, Human
ccaaagugcugggauuacaggcau

SEQ ID NO: 634511 - RNA, 24 nt, Human
ccacagaagcgauaugaaacaggu

SEQ ID NO: 634512 - RNA, 21 nt, Human
ccacccagggcuggccaacaa

SEQ ID NO: 634513 - RNA, 24 nt, Human
cccaaagugcugggauuacaggca

SEQ ID NO: 634514 - RNA, 18 nt, Human
cccaccacagaagaggau

SEQ ID NO: 634515 - RNA, 24 nt, Human
cccaccuccacccagggcuggcca

SEQ ID NO: 634516 - RNA, 21 nt, Human
cccaucccaccacagaagagg

SEQ ID NO: 634517 - RNA, 19 nt, Human
ccccagaggcuccgggaua

SEQ ID NO: 634518 - RNA, 31 nt, Human
ccccaggcacuaucuguccugcuugcacccc

SEQ ID NO: 634519 - RNA, 22 nt, Human
cccccaggcacuaucuguccug

SEQ ID NO: 634520 - RNA, 24 nt, Human
ccccucucccccacccucccaucc

SEQ ID NO: 634521 - RNA, 22 nt, Human
cccuccgcccccacccccaggc

SEQ ID NO: 634522 - RNA, 22 nt, Human
ccgcccccacccccaggcacua

SEQ ID NO: 634523 - RNA, 23 nt, Human
ccucagcucucggcccaucgccu

SEQ ID NO: 634524 - RNA, 24 nt, Human
ccucuccauuccaccccucucccc

SEQ ID NO: 634525 - RNA, 24 nt, Human
ccugacuucaggugauucacccac

SEQ ID NO: 634526 - RNA, 21 nt, Human
cgcccagccccgcagccgcgc

SEQ ID NO: 634527 - RNA, 24 nt, Human
cgcccccacccccaggcacuaucu

SEQ ID NO: 634528 - RNA, 23 nt, Human
cgccccuaaauuuaaagguaucu

SEQ ID NO: 634529 - RNA, 24 nt, Human
cgcgauggcucacaccugccaaag

SEQ ID NO: 634530 - RNA, 20 nt, Human
cgugaggagcagagaggcug

SEQ ID NO: 634531 - RNA, 24 nt, Human
cgugaggagcagagaggcuguggu

SEQ ID NO: 634532 - RNA, 18 nt, Human
cucaagaagugaaaggcc

SEQ ID NO: 634533 - RNA, 18 nt, Human
cucaagcccaggaguuca

SEQ ID NO: 634534 - RNA, 29 nt, Human
cucaugugcaaacacauacacgcagugug

SEQ ID NO: 634535 - RNA, 21 nt, Human
cuccacccagggcuggccaac

SEQ ID NO: 634536 - RNA, 23 nt, Human
cuccauuccaccccucuccccca

SEQ ID NO: 634537 - RNA, 19 nt, Human
cuccgcccccacccccagg

SEQ ID NO: 634538 - RNA, 24 nt, Human
cugguccugcuuuguuuccacauu

SEQ ID NO: 634539 - RNA, 22 nt, Human
cuguaggcccagcuacuccaga

SEQ ID NO: 634540 - RNA, 18 nt, Human
cuguccugcuugcaccca

SEQ ID NO: 634541 - RNA, 23 nt, Human
cuugcucaagcccaggaguucag

SEQ ID NO: 634542 - RNA, 25 nt, Human
cuuucuuuuccaagaauacccuuuu

SEQ ID NO: 634543 - RNA, 22 nt, Human
gaacagugcgagccaaggcacu

SEQ ID NO: 634544 - RNA, 20 nt, Human
gaacccuccgcccccacccc

SEQ ID NO: 634545 - RNA, 21 nt, Human
gaacccuccgcccccaccccc

SEQ ID NO: 634546 - RNA, 22 nt, Human
gaccgccuccccagaggcuccg

SEQ ID NO: 634547 - RNA, 24 nt, Human
gacuucaggugauucacccaccuu

SEQ ID NO: 634548 - RNA, 20 nt, Human
gagccaaggcacagaggcca

SEQ ID NO: 634549 - RNA, 26 nt, Human
gagccaaggcacagaggccaagggga

SEQ ID NO: 634550 - RNA, 24 nt, Human
gagggcacccaggcagcaagacac

SEQ ID NO: 634551 - RNA, 18 nt, Human
gauuacaggcaugcgcca

SEQ ID NO: 634552 - RNA, 20 nt, Human
gcaacacagcaagacuaaaa

SEQ ID NO: 634553 - RNA, 19 nt, Human
gccucuggucauccggggc

SEQ ID NO: 634554 - RNA, 21 nt, Human
gcgaacccuccgcccccaccc

SEQ ID NO: 634555 - RNA, 19 nt, Human
gcgccuguggaugugucgc

SEQ ID NO: 634556 - RNA, 24 nt, Human
gcgcggcgucccggcggcgcggag

SEQ ID NO: 634557 - RNA, 20 nt, Human
gcugaaguagggugcaaagg

SEQ ID NO: 634558 - RNA, 24 nt, Human
ggaccacaggcgugagccaccaug

SEQ ID NO: 634559 - RNA, 20 nt, Human
ggagggauaaacagacuggc

SEQ ID NO: 634560 - RNA, 18 nt, Human
ggagugaccgccucccca

SEQ ID NO: 634561 - RNA, 22 nt, Human
ggaguucagguccagccugggc

SEQ ID NO: 634562 - RNA, 22 nt, Human
ggauuacaggcaugcgccaccg

SEQ ID NO: 634563 - RNA, 18 nt, Human
ggccaaggggagcgagcu

SEQ ID NO: 634564 - RNA, 18 nt, Human
ggcuucaccauguuggcc

SEQ ID NO: 634565 - RNA, 19 nt, Human
ggggaauagagagcgggag

SEQ ID NO: 634566 - RNA, 21 nt, Human
ggggagcgagcuguagcugug

SEQ ID NO: 634567 - RNA, 21 nt, Human
ggggcuucaccauguuggcca

SEQ ID NO: 634568 - RNA, 23 nt, Human
guagagauggggcuucaccaugu

SEQ ID NO: 634569 - RNA, 22 nt, Human
guagggugcaaaggagagggca

SEQ ID NO: 634570 - RNA, 24 nt, Human
gugauucacccaccuuggccuccc

SEQ ID NO: 634571 - RNA, 24 nt, Human
guuggccgggcgcgauggcucaca

SEQ ID NO: 634572 - RNA, 24 nt, Human
uacaggcaugcgccaccgcgccca

SEQ ID NO: 634573 - RNA, 22 nt, Human
uaccgcgaccagcugaaguagg

SEQ ID NO: 634574 - RNA, 21 nt, Human
uagaaacaaccagcaaaucca

SEQ ID NO: 634575 - RNA, 24 nt, Human
uagaaacaaccagcaaauccacug

SEQ ID NO: 634576 - RNA, 22 nt, Human
uagaaggaaucucaaaccucac

SEQ ID NO: 634577 - RNA, 22 nt, Human
uagagauggggcuucaccaugu

SEQ ID NO: 634578 - RNA, 22 nt, Human
uagaggcgaacccuccgccccc

SEQ ID NO: 634579 - RNA, 22 nt, Human
ucaaggggccucuggucauccg

SEQ ID NO: 634580 - RNA, 20 nt, Human
ucacaauuacaagaccaugg

SEQ ID NO: 634581 - RNA, 18 nt, Human
ucagguccagccugggca

SEQ ID NO: 634582 - RNA, 21 nt, Human
ucagguccagccugggcaaca

SEQ ID NO: 634583 - RNA, 24 nt, Human
ucaguaggaacagugcgagccaag

SEQ ID NO: 634584 - RNA, 22 nt, Human
uccacaucaucuaccgcgacca

SEQ ID NO: 634585 - RNA, 20 nt, Human
uccaccccucucccccaccc

SEQ ID NO: 634586 - RNA, 23 nt, Human
uccauuaacauccugaccugaag

SEQ ID NO: 634587 - RNA, 22 nt, Human
uccauuccaccccucuccccca

SEQ ID NO: 634588 - RNA, 24 nt, Human
ucccaaagugcugggauuacaggc

SEQ ID NO: 634589 - RNA, 22 nt, Human
uccccaaaccccuccuuuucaa

SEQ ID NO: 634590 - RNA, 24 nt, Human
uccccaggggcgccuguggaugug

SEQ ID NO: 634591 - RNA, 27 nt, Human
ucccccacccucccaucccaccacaga

SEQ ID NO: 634592 - RNA, 18 nt, Human
ucccuguccccaaacccc

SEQ ID NO: 634593 - RNA, 21 nt, Human
uccgcccccacccccaggcac

SEQ ID NO: 634594 - RNA, 22 nt, Human
uccuagaggcgaacccuccgcc

SEQ ID NO: 634595 - RNA, 22 nt, Human
ucgcccagccccgcagccgcgc

SEQ ID NO: 634596 - RNA, 21 nt, Human
ucucaagaagugaaaggccaa

SEQ ID NO: 634597 - RNA, 19 nt, Human
ucucccccacccucccauc

SEQ ID NO: 634598 - RNA, 19 nt, Human
ucucgaacuccugacuuca

SEQ ID NO: 634599 - RNA, 24 nt, Human
ucuguggccacggacgugaggagc

SEQ ID NO: 634600 - RNA, 21 nt, Human
ugaccugaagaaccaaccccu

SEQ ID NO: 634601 - RNA, 24 nt, Human
ugacuucaggugauucacccaccu

SEQ ID NO: 634602 - RNA, 19 nt, Human
ugauggugggcagcuggaa

SEQ ID NO: 634603 - RNA, 24 nt, Human
ugauucacccaccuuggccuccca

SEQ ID NO: 634604 - RNA, 24 nt, Human
ugcugggaccacaggcgugagcca

SEQ ID NO: 634605 - RNA, 21 nt, Human
ugcugguccugcuuuguuucc

SEQ ID NO: 634606 - RNA, 25 nt, Human
ugcugguccugcuuuguuuccacau

SEQ ID NO: 634607 - RNA, 18 nt, Human
ugcugugccugcuggucc

SEQ ID NO: 634608 - RNA, 19 nt, Human
uggcagcacacacuguagg

SEQ ID NO: 634609 - RNA, 24 nt, Human
uggccaugcugaucucgaacuccu

SEQ ID NO: 634610 - RNA, 24 nt, Human
ugggaccacaggcgugagccacca

SEQ ID NO: 634611 - RNA, 18 nt, Human
ugggauuacaggcaugcg

SEQ ID NO: 634612 - RNA, 21 nt, Human
ugggauuacaggcaugcgcca

SEQ ID NO: 634613 - RNA, 22 nt, Human
ugggauuacaggcaugcgccac

SEQ ID NO: 634614 - RNA, 23 nt, Human
ugggauuacaggcaugcgccacc

SEQ ID NO: 634615 - RNA, 24 nt, Human
ugggauuacaggcaugcgccaccg

SEQ ID NO: 634616 - RNA, 19 nt, Human
uggggcuucaccauguugg

SEQ ID NO: 634617 - RNA, 25 nt, Human
ugugcaaacacauacacgcagaaua

SEQ ID NO: 634618 - RNA, 19 nt, Human
ugugccugcugguccugcu

SEQ ID NO: 634619 - RNA, 21 nt, Human
uguggcagcacacacuguagg

SEQ ID NO: 634620 - RNA, 21 nt, Human
uguuucauggacacagucccu

SEQ ID NO: 634621 - RNA, 19 nt, Human
uuacugguuccugcuuucc

SEQ ID NO: 634622 - RNA, 22 nt, Human
uucacaauuacaagaccauggg

SEQ ID NO: 634623 - RNA, 24 nt, Human
uucaggugauucacccaccuuggc

SEQ ID NO: 634624 - RNA, 21 nt, Human
uuccaccccucucccccaccc

SEQ ID NO: 634625 - RNA, 18 nt, Human
uuccucagcucucggccc

SEQ ID NO: 634626 - RNA, 22 nt, Human
uucuaaagaaaaguuggccggg

SEQ ID NO: 634627 - RNA, 20 nt, Human
uucuauguugcaugcuucag

SEQ ID NO: 634628 - RNA, 18 nt, Human
uuggccucccaaagugcu

SEQ ID NO: 634629 - RNA, 19 nt, Human
uuuccacaucaucuaccgc

SEQ ID NO: 634630 - RNA, 18 nt, Human
aaaaaugcucauuggccc

SEQ ID NO: 634631 - RNA, 19 nt, Human
aaaaaugcucauuggcccu

SEQ ID NO: 634632 - RNA, 23 nt, Human
aaaagagaaacggguccaaauca

SEQ ID NO: 634633 - RNA, 18 nt, Human
aacaaacaggcucuggcc

SEQ ID NO: 634634 - RNA, 21 nt, Human
aacacaaugagacaacagaga

SEQ ID NO: 634635 - RNA, 18 nt, Human
aacagcccuaacaaacag

SEQ ID NO: 634636 - RNA, 19 nt, Human
acagcagaaggaccccaug

SEQ ID NO: 634637 - RNA, 21 nt, Human
accaggcaguagacacauucc

SEQ ID NO: 634638 - RNA, 22 nt, Human
accugaaaaaugggacagcaac

SEQ ID NO: 634639 - RNA, 18 nt, Human
agacacauuccccuggga

SEQ ID NO: 634640 - RNA, 24 nt, Human
agacgucucucugggcauugcucc

SEQ ID NO: 634641 - RNA, 26 nt, Human
agagacagcagaaggaccccaugugc

SEQ ID NO: 634642 - RNA, 22 nt, Human
agaggcggcgcucacaggaccc

SEQ ID NO: 634643 - RNA, 18 nt, Human
agcaccaacagagccccc

SEQ ID NO: 634644 - RNA, 22 nt, Human
agccccacgucucgggccagga

SEQ ID NO: 634645 - RNA, 22 nt, Human
agccugguggggacggggacag

SEQ ID NO: 634646 - RNA, 18 nt, Human
agcuccuguguggucugg

SEQ ID NO: 634647 - RNA, 25 nt, Human
aggcagcaggugggggccugggacc

SEQ ID NO: 634648 - RNA, 19 nt, Human
aggcagguggaaagagcag

SEQ ID NO: 634649 - RNA, 18 nt, Human
aggcaguagacacauucc

SEQ ID NO: 634650 - RNA, 22 nt, Human
aggcguucagugaggaagcaac

SEQ ID NO: 634651 - RNA, 22 nt, Human
aggguucccguccucagccucc

SEQ ID NO: 634652 - RNA, 20 nt, Human
agguccaucccaagggcagc

SEQ ID NO: 634653 - RNA, 20 nt, Human
agugaggaagcaggagacag

SEQ ID NO: 634654 - RNA, 19 nt, Human
auaaagaaaagaaugaaaa

SEQ ID NO: 634655 - RNA, 25 nt, Human
augagacaacagagacugucuagaa

SEQ ID NO: 634656 - RNA, 23 nt, Human
caaacugaggaacuugaaaaaca

SEQ ID NO: 634657 - RNA, 21 nt, Human
caacagagcagcucugagcuc

SEQ ID NO: 634658 - RNA, 18 nt, Human
caccaacagagcccccca

SEQ ID NO: 634659 - RNA, 21 nt, Human
cagagccccccagggggcucc

SEQ ID NO: 634660 - RNA, 19 nt, Human
cagcaacacaaugagacaa

SEQ ID NO: 634661 - RNA, 24 nt, Human
cagcaacacaaugagacaacagag

SEQ ID NO: 634662 - RNA, 22 nt, Human
cagcagaaucagcccccaccuc

SEQ ID NO: 634663 - RNA, 23 nt, Human
cagcagcagggggcugcguccaa

SEQ ID NO: 634664 - RNA, 23 nt, Human
cagcuccuguguggucugggggg

SEQ ID NO: 634665 - RNA, 19 nt, Human
cagcucugagcucaauccu

SEQ ID NO: 634666 - RNA, 24 nt, Human
caggacccgcuccaggcuugucac

SEQ ID NO: 634667 - RNA, 20 nt, Human
caggagggcugaaagcagca

SEQ ID NO: 634668 - RNA, 19 nt, Human
caggguggagcggccaggc

SEQ ID NO: 634669 - RNA, 19 nt, Human
ccaccagggccuggcacag

SEQ ID NO: 634670 - RNA, 25 nt, Human
cccagagacagcagaaggaccccau

SEQ ID NO: 634671 - RNA, 20 nt, Human
cccagcagaaucagccccca

SEQ ID NO: 634672 - RNA, 22 nt, Human
cccagcagaaucagcccccacc

SEQ ID NO: 634673 - RNA, 23 nt, Human
ccccagagacagcagaaggaccc

SEQ ID NO: 634674 - RNA, 23 nt, Human
ccccucacaggagggcugaaagc

SEQ ID NO: 634675 - RNA, 18 nt, Human
cccgugacccacuuccug

SEQ ID NO: 634676 - RNA, 18 nt, Human
cccuaacaaacaggcucu

SEQ ID NO: 634677 - RNA, 20 nt, Human
cccugggcaggccacucccc

SEQ ID NO: 634678 - RNA, 26 nt, Human
ccuaccccgguacccucaccugaaaa

SEQ ID NO: 634679 - RNA, 20 nt, Human
ccucaccugaaaaaugggac

SEQ ID NO: 634680 - RNA, 25 nt, Human
ccugacccuaacccgguggagcagc

SEQ ID NO: 634681 - RNA, 25 nt, Human
ccugggcuugagcaaacugugggga

SEQ ID NO: 634682 - RNA, 20 nt, Human
ccuguaaaacugaagaucac

SEQ ID NO: 634683 - RNA, 19 nt, Human
ccuugcaccucagaagugc

SEQ ID NO: 634684 - RNA, 18 nt, Human
cucacaggacccgcucca

SEQ ID NO: 634685 - RNA, 23 nt, Human
cucagccuccaccagggccuggc

SEQ ID NO: 634686 - RNA, 20 nt, Human
cugaaagcagcacagcugag

SEQ ID NO: 634687 - RNA, 22 nt, Human
cuggccgucuccugacccuaac

SEQ ID NO: 634688 - RNA, 19 nt, Human
cugucccagcagaaucagc

SEQ ID NO: 634689 - RNA, 22 nt, Human
cugugcacugggaccgccccuc

SEQ ID NO: 634690 - RNA, 20 nt, Human
gaacuugaaaaacaucugug

SEQ ID NO: 634691 - RNA, 21 nt, Human
gagcagcucugagcucaaucc

SEQ ID NO: 634692 - RNA, 24 nt, Human
gagcagcugacuggacgcagugac

SEQ ID NO: 634693 - RNA, 22 nt, Human
gaucacccucuaacagcccuaa

SEQ ID NO: 634694 - RNA, 23 nt, Human
gcaacacaaugagacaacagaga

SEQ ID NO: 634695 - RNA, 19 nt, Human
gcaggagacagaggcggcg

SEQ ID NO: 634696 - RNA, 22 nt, Human
gccacacaucacagcacuuugg

SEQ ID NO: 634697 - RNA, 24 nt, Human
gccccagagacagcagaaggaccc

SEQ ID NO: 634698 - RNA, 22 nt, Human
gcccuaacaaacaggcucuggc

SEQ ID NO: 634699 - RNA, 19 nt, Human
ggaaagagcagcacucaca

SEQ ID NO: 634700 - RNA, 23 nt, Human
ggagggcugaaagcagcacagcu

SEQ ID NO: 634701 - RNA, 24 nt, Human
ggcaggagcagcuccagggguccc

SEQ ID NO: 634702 - RNA, 21 nt, Human
gggcaggagcagcuccaggac

SEQ ID NO: 634703 - RNA, 24 nt, Human
gggcuacguucuuauggacgcugg

SEQ ID NO: 634704 - RNA, 19 nt, Human
uaaaauuaacccgugaccc

SEQ ID NO: 634705 - RNA, 24 nt, Human
uaacaaacaggcucuggccgucuc

SEQ ID NO: 634706 - RNA, 23 nt, Human
uaagaagggugguggaugcagca

SEQ ID NO: 634707 - RNA, 24 nt, Human
ucagcaccaacagagccccccagg

SEQ ID NO: 634708 - RNA, 18 nt, Human
ucaguacaaacugaggaa

SEQ ID NO: 634709 - RNA, 20 nt, Human
ucccaccgagcuggacgauc

SEQ ID NO: 634710 - RNA, 21 nt, Human
ucggucaggggcgaguugggc

SEQ ID NO: 634711 - RNA, 21 nt, Human
ugaaaaaugggacagcaacac

SEQ ID NO: 634712 - RNA, 21 nt, Human
ugaagcccuguuaugaugugc

SEQ ID NO: 634713 - RNA, 22 nt, Human
ugacccugggcaggccacuccc

SEQ ID NO: 634714 - RNA, 22 nt, Human
ugacgccaccacugagguucug

SEQ ID NO: 634715 - RNA, 24 nt, Human
ugagacaacagagacugucuagaa

SEQ ID NO: 634716 - RNA, 21 nt, Human
ugagcaaacuguggggacuca

SEQ ID NO: 634717 - RNA, 24 nt, Human
ugaggaacuugaaaaacaucugug

SEQ ID NO: 634718 - RNA, 18 nt, Human
ugcacugccuuccaaccu

SEQ ID NO: 634719 - RNA, 18 nt, Human
ugcacugggaccgccccu

SEQ ID NO: 634720 - RNA, 20 nt, Human
ugcaggguggagcggccagg

SEQ ID NO: 634721 - RNA, 22 nt, Human
ugccugggcuugagcaaacugu

SEQ ID NO: 634722 - RNA, 23 nt, Human
ugcuuccugcccugaugaauccc

SEQ ID NO: 634723 - RNA, 19 nt, Human
uggaaagagcagcacucac

SEQ ID NO: 634724 - RNA, 18 nt, Human
uggggacggggacaggca

SEQ ID NO: 634725 - RNA, 20 nt, Human
uggggacggggacaggcagu

SEQ ID NO: 634726 - RNA, 19 nt, Human
uggggggaggcugccucug

SEQ ID NO: 634727 - RNA, 23 nt, Human
ugugcaguuuaaaaagagaaacg

SEQ ID NO: 634728 - RNA, 19 nt, Human
uuaaaaucaugcucgacau

SEQ ID NO: 634729 - RNA, 19 nt, Human
uucuuauggacgcuggagg

SEQ ID NO: 634730 - RNA, 22 nt, Human
uugccugggcuugagcaaacug

SEQ ID NO: 634731 - RNA, 24 nt, Human
uuggaggccuccucucccuucuga

SEQ ID NO: 634732 - RNA, 22 nt, Human
uuugaaccaccaggcaguagac

SEQ ID NO: 634733 - RNA, 18 nt, Human
uuuuuuuuuuuuuuuuug

SEQ ID NO: 634734 - RNA, 26 nt, Human
aaaaaaccaaccaaccaacuacccac

SEQ ID NO: 634735 - RNA, 21 nt, Human
aaacaggaccaggaaccacaa

SEQ ID NO: 634736 - RNA, 24 nt, Human
aaacaggaccaggaaccacaaaga

SEQ ID NO: 634737 - RNA, 25 nt, Human
aaacaggaccaggaaccacaaagag

SEQ ID NO: 634738 - RNA, 24 nt, Human
aaagugcugggauuacaggcauga

SEQ ID NO: 634739 - RNA, 19 nt, Human
aaagugcugggauuucagg

SEQ ID NO: 634740 - RNA, 24 nt, Human
aaagugcugggauuucaggcguga

SEQ ID NO: 634741 - RNA, 21 nt, Human
aagcaccacccagcccaggcc

SEQ ID NO: 634742 - RNA, 23 nt, Human
aagcaccacccagcccaggccga

SEQ ID NO: 634743 - RNA, 23 nt, Human
aagugaucugcccccuuggccuc

SEQ ID NO: 634744 - RNA, 19 nt, Human
aagugcugggauuacaggc

SEQ ID NO: 634745 - RNA, 21 nt, Human
aagugcugggauuacaggcau

SEQ ID NO: 634746 - RNA, 26 nt, Human
aagugcugggauuacaggcaugagcc

SEQ ID NO: 634747 - RNA, 19 nt, Human
aagugcugggauuucaggc

SEQ ID NO: 634748 - RNA, 19 nt, Human
aauauggugaaacccgucu

SEQ ID NO: 634749 - RNA, 24 nt, Human
aaucacuuaaacccaggagacaga

SEQ ID NO: 634750 - RNA, 19 nt, Human
aauuuccuuuccucaaaga

SEQ ID NO: 634751 - RNA, 18 nt, Human
acaaaggagaggcacaga

SEQ ID NO: 634752 - RNA, 19 nt, Human
acaagcaccacccagccca

SEQ ID NO: 634753 - RNA, 19 nt, Human
acaggaccaggaaccacaa

SEQ ID NO: 634754 - RNA, 22 nt, Human
acaggaccaggaaccacaaaga

SEQ ID NO: 634755 - RNA, 20 nt, Human
acaggguuucaccaaguuag

SEQ ID NO: 634756 - RNA, 20 nt, Human
acaggguuucauucuguugg

SEQ ID NO: 634757 - RNA, 23 nt, Human
acaggguuucauucuguuggcca

SEQ ID NO: 634758 - RNA, 24 nt, Human
acaggguuucauucuguuggccag

SEQ ID NO: 634759 - RNA, 20 nt, Human
acagugcugagguuacaggc

SEQ ID NO: 634760 - RNA, 24 nt, Human
acagugcugagguuacaggcguga

SEQ ID NO: 634761 - RNA, 21 nt, Human
accaaccaaccaacuacccac

SEQ ID NO: 634762 - RNA, 22 nt, Human
accaaccaaccaacuacccacc

SEQ ID NO: 634763 - RNA, 22 nt, Human
accaacuacccaccugggccac

SEQ ID NO: 634764 - RNA, 24 nt, Human
accacccagcccaggccgaaacaa

SEQ ID NO: 634765 - RNA, 22 nt, Human
accacugcacuccagccugggc

SEQ ID NO: 634766 - RNA, 24 nt, Human
accuugugaucugcccgccucggc

SEQ ID NO: 634767 - RNA, 18 nt, Human
acugcacuccagccuggg

SEQ ID NO: 634768 - RNA, 22 nt, Human
acugcacuccagccugggcgag

SEQ ID NO: 634769 - RNA, 24 nt, Human
acugcacuccagccugggcgagag

SEQ ID NO: 634770 - RNA, 21 nt, Human
acuguagucccagcuacuugg

SEQ ID NO: 634771 - RNA, 23 nt, Human
agaagaagaaucacuuaaaccca

SEQ ID NO: 634772 - RNA, 21 nt, Human
agacagagguugcagugagcc

SEQ ID NO: 634773 - RNA, 24 nt, Human
agacagagguugcagugagccgag

SEQ ID NO: 634774 - RNA, 19 nt, Human
agacaggguuucaccaagu

SEQ ID NO: 634775 - RNA, 19 nt, Human
agagaagcuaagagcagca

SEQ ID NO: 634776 - RNA, 19 nt, Human
agagacugcauccuccacu

SEQ ID NO: 634777 - RNA, 24 nt, Human
agagguugcagugagccgaggucg

SEQ ID NO: 634778 - RNA, 24 nt, Human
agcaccacccagcccaggccgaaa

SEQ ID NO: 634779 - RNA, 24 nt, Human
agcacuuugggaggcugaggcggg

SEQ ID NO: 634780 - RNA, 26 nt, Human
agcccaggccgaaacaaaggagaggc

SEQ ID NO: 634781 - RNA, 19 nt, Human
agcccggcuaauuuuugua

SEQ ID NO: 634782 - RNA, 18 nt, Human
agccuccagaguagcugg

SEQ ID NO: 634783 - RNA, 23 nt, Human
agccugggcugggugugguggcu

SEQ ID NO: 634784 - RNA, 19 nt, Human
agccuggucaauaugguga

SEQ ID NO: 634785 - RNA, 22 nt, Human
agccuggucaauauggugaaac

SEQ ID NO: 634786 - RNA, 24 nt, Human
agccuggucaauauggugaaaccc

SEQ ID NO: 634787 - RNA, 22 nt, Human
aggaguucgagaccagccuggu

SEQ ID NO: 634788 - RNA, 28 nt, Human
aggcagaagaagaaucacuuaaacccag

SEQ ID NO: 634789 - RNA, 24 nt, Human
aggcgggcagaucaugaggucagg

SEQ ID NO: 634790 - RNA, 21 nt, Human
aggcugaggcagaagaagaau

SEQ ID NO: 634791 - RNA, 21 nt, Human
aggcugaggcgggcagaucau

SEQ ID NO: 634792 - RNA, 22 nt, Human
agguuacaggcgugagccacca

SEQ ID NO: 634793 - RNA, 18 nt, Human
aguagcugggacuacagg

SEQ ID NO: 634794 - RNA, 25 nt, Human
agucugaucuugacauccugaccuc

SEQ ID NO: 634795 - RNA, 19 nt, Human
agugcaguggugggagcuc

SEQ ID NO: 634796 - RNA, 24 nt, Human
agugcaguggugggagcucagcuc

SEQ ID NO: 634797 - RNA, 22 nt, Human
agugcugagguuacaggcguga

SEQ ID NO: 634798 - RNA, 18 nt, Human
agugcugggauuacaggc

SEQ ID NO: 634799 - RNA, 22 nt, Human
aucugcccccuuggccucccac

SEQ ID NO: 634800 - RNA, 23 nt, Human
augagccugggcuggguguggug

SEQ ID NO: 634801 - RNA, 22 nt, Human
augcaaguggaaccaggccaag

SEQ ID NO: 634802 - RNA, 18 nt, Human
augggguuucgccauguu

SEQ ID NO: 634803 - RNA, 19 nt, Human
augggguuucgccauguug

SEQ ID NO: 634804 - RNA, 24 nt, Human
augggguuucgccauguugaacag

SEQ ID NO: 634805 - RNA, 19 nt, Human
auggugaaacccgucucua

SEQ ID NO: 634806 - RNA, 24 nt, Human
caaagugcugggauuacaggcaug

SEQ ID NO: 634807 - RNA, 24 nt, Human
caaagugcugggauuucaggcgug

SEQ ID NO: 634808 - RNA, 22 nt, Human
caaaugcucacaagcaccaccc

SEQ ID NO: 634809 - RNA, 22 nt, Human
caacuacccaccugggccacuc

SEQ ID NO: 634810 - RNA, 19 nt, Human
caauauggugaaacccguc

SEQ ID NO: 634811 - RNA, 21 nt, Human
caauauggugaaacccgucuc

SEQ ID NO: 634812 - RNA, 23 nt, Human
caauauggugaaacccgucucua

SEQ ID NO: 634813 - RNA, 22 nt, Human
cacaaagagacugcauccucca

SEQ ID NO: 634814 - RNA, 24 nt, Human
caccaaguuagccaggauggucuc

SEQ ID NO: 634815 - RNA, 18 nt, Human
caccacccagcccaggcc

SEQ ID NO: 634816 - RNA, 21 nt, Human
caccacccagcccaggccgaa

SEQ ID NO: 634817 - RNA, 21 nt, Human
caccaugcccggcccaucuga

SEQ ID NO: 634818 - RNA, 19 nt, Human
cacccggccuaauuuuugu

SEQ ID NO: 634819 - RNA, 25 nt, Human
caccgucugaaaaaaaaaaaccaac

SEQ ID NO: 634820 - RNA, 22 nt, Human
caccucaagaccccagguucuc

SEQ ID NO: 634821 - RNA, 24 nt, Human
caccugaccuugugaucugcccgc

SEQ ID NO: 634822 - RNA, 24 nt, Human
cacgccuguaaucccagcacuuug

SEQ ID NO: 634823 - RNA, 23 nt, Human
cacuccagccugggcgagagagc

SEQ ID NO: 634824 - RNA, 24 nt, Human
cacuccagccugggcgagagagcg

SEQ ID NO: 634825 - RNA, 20 nt, Human
cacugcacuccagccugggc

SEQ ID NO: 634826 - RNA, 21 nt, Human
cacugcacuccagccugggcg

SEQ ID NO: 634827 - RNA, 22 nt, Human
cacugcacuccagccugggcga

SEQ ID NO: 634828 - RNA, 22 nt, Human
cacugcacuccagccugggcga

SEQ ID NO: 634829 - RNA, 24 nt, Human
cacugcacuccagccugggcgaga

SEQ ID NO: 634830 - RNA, 24 nt, Human
cagaucaugaggucaggaguucga

SEQ ID NO: 634831 - RNA, 24 nt, Human
cagcacuuugggaggcugaggcgg

SEQ ID NO: 634832 - RNA, 19 nt, Human
cagcccaggccgaaacaaa

SEQ ID NO: 634833 - RNA, 24 nt, Human
cagcuacuugggaggcugaggcag

SEQ ID NO: 634834 - RNA, 24 nt, Human
caggguuucaccaaguuagccagg

SEQ ID NO: 634835 - RNA, 23 nt, Human
caggguuucauucuguuggccag

SEQ ID NO: 634836 - RNA, 22 nt, Human
caggugaccccuccucagucuc

SEQ ID NO: 634837 - RNA, 22 nt, Human
caugccauucuccugcuucagc

SEQ ID NO: 634838 - RNA, 24 nt, Human
cauucuguuggccagucugaucuu

SEQ ID NO: 634839 - RNA, 23 nt, Human
ccaaagugcugggauuacaggca

SEQ ID NO: 634840 - RNA, 24 nt, Human
ccaaagugcugggauuacaggcau

SEQ ID NO: 634841 - RNA, 22 nt, Human
ccaaagugcugggauuucaggc

SEQ ID NO: 634842 - RNA, 24 nt, Human
ccaaagugcugggauuucaggcgu

SEQ ID NO: 634843 - RNA, 22 nt, Human
ccaaccaaccaacuacccaccu

SEQ ID NO: 634844 - RNA, 22 nt, Human
ccacagugcugagguuacaggc

SEQ ID NO: 634845 - RNA, 24 nt, Human
ccacagugcugagguuacaggcgu

SEQ ID NO: 634846 - RNA, 19 nt, Human
ccacccagcccaggccgaa

SEQ ID NO: 634847 - RNA, 20 nt, Human
ccacugcacuccagccuggg

SEQ ID NO: 634848 - RNA, 21 nt, Human
ccacugcacuccagccugggc

SEQ ID NO: 634849 - RNA, 21 nt, Human
ccacugcacuccagccugggc

SEQ ID NO: 634850 - RNA, 22 nt, Human
ccacugcacuccagccugggcg

SEQ ID NO: 634851 - RNA, 23 nt, Human
ccacugcacuccagccugggcga

SEQ ID NO: 634852 - RNA, 24 nt, Human
ccacugcacuccagccugggcgag

SEQ ID NO: 634853 - RNA, 24 nt, Human
ccagaguagcugggacuacaggug

SEQ ID NO: 634854 - RNA, 22 nt, Human
ccaggagacagagguugcagug

SEQ ID NO: 634855 - RNA, 18 nt, Human
ccaggccaagcugccaug

SEQ ID NO: 634856 - RNA, 24 nt, Human
cccaaagugcugggauuacaggca

SEQ ID NO: 634857 - RNA, 24 nt, Human
cccaggccgaaacaaaggagaggc

SEQ ID NO: 634858 - RNA, 19 nt, Human
cccaggcuggagugcagug

SEQ ID NO: 634859 - RNA, 24 nt, Human
cccgaccugaagugaucugccccc

SEQ ID NO: 634860 - RNA, 23 nt, Human
cccggcccaucugagcaaccccu

SEQ ID NO: 634861 - RNA, 23 nt, Human
cccggguucaugccauucuccug

SEQ ID NO: 634862 - RNA, 22 nt, Human
cccgucucuacuaaaaauacaa

SEQ ID NO: 634863 - RNA, 21 nt, Human
ccgaaacaaaggagaggcaca

SEQ ID NO: 634864 - RNA, 21 nt, Human
ccggcccaucugagcaacccc

SEQ ID NO: 634865 - RNA, 23 nt, Human
ccucaagaccccagguucucaaa

SEQ ID NO: 634866 - RNA, 28 nt, Human
ccucaagaccccagguucucaaacaggg

SEQ ID NO: 634867 - RNA, 24 nt, Human
ccucaggugaccccuccucagucu

SEQ ID NO: 634868 - RNA, 24 nt, Human
ccucagucucccaaagugcuggga

SEQ ID NO: 634869 - RNA, 18 nt, Human
ccugaccucaggugaccc

SEQ ID NO: 634870 - RNA, 22 nt, Human
ccuggucaauauggugaaaccc

SEQ ID NO: 634871 - RNA, 23 nt, Human
ccuggucaauauggugaaacccg

SEQ ID NO: 634872 - RNA, 22 nt, Human
ccuguaaucccagcacuuuggg

SEQ ID NO: 634873 - RNA, 18 nt, Human
cgagaccagccuggucaa

SEQ ID NO: 634874 - RNA, 22 nt, Human
cgaugcaaguggaaccaggcca

SEQ ID NO: 634875 - RNA, 21 nt, Human
cgcaccacugcacuccagccu

SEQ ID NO: 634876 - RNA, 24 nt, Human
cgccucggccucccaaagugcugg

SEQ ID NO: 634877 - RNA, 23 nt, Human
cgccuguaaucccagcacuuugg

SEQ ID NO: 634878 - RNA, 24 nt, Human
cgcugugucgcccaggcuggagug

SEQ ID NO: 634879 - RNA, 22 nt, Human
cgggcagaucaugaggucagga

SEQ ID NO: 634880 - RNA, 30 nt, Human
cgucugaaaaaaaaaaaccaaccaaccuug

SEQ ID NO: 634881 - RNA, 24 nt, Human
cgugagccaccaugcccggcccau

SEQ ID NO: 634882 - RNA, 18 nt, Human
cguggcaggugucaccac

SEQ ID NO: 634883 - RNA, 23 nt, Human
cucacaccuguaaucugcaucuu

SEQ ID NO: 634884 - RNA, 22 nt, Human
cucacgccuguaaucccagcac

SEQ ID NO: 634885 - RNA, 24 nt, Human
cucacgccuguaaucccagcacuu

SEQ ID NO: 634886 - RNA, 23 nt, Human
cuccucagucucccaaagugcug

SEQ ID NO: 634887 - RNA, 21 nt, Human
cucuugguggcauuaguaguu

SEQ ID NO: 634888 - RNA, 20 nt, Human
cugcaucuuaaacacacguu

SEQ ID NO: 634889 - RNA, 23 nt, Human
cugcuucagccuccagaguagcu

SEQ ID NO: 634890 - RNA, 21 nt, Human
cuguagucccagcuacuuggg

SEQ ID NO: 634891 - RNA, 19 nt, Human
gaagcuaagagcagcagug

SEQ ID NO: 634892 - RNA, 19 nt, Human
gacaggccaccucaagacc

SEQ ID NO: 634893 - RNA, 22 nt, Human
gaccccuccucagucucccaaa

SEQ ID NO: 634894 - RNA, 22 nt, Human
gaccuugugaucugcccgccuc

SEQ ID NO: 634895 - RNA, 21 nt, Human
gagacagagguugcagugagc

SEQ ID NO: 634896 - RNA, 23 nt, Human
gaggucgcaccacugcacuccag

SEQ ID NO: 634897 - RNA, 27 nt, Human
gaguagcugggacuacaggugccacgc

SEQ ID NO: 634898 - RNA, 22 nt, Human
gaucaugaggucaggaguucga

SEQ ID NO: 634899 - RNA, 24 nt, Human
gaucaugaggucaggaguucgaga

SEQ ID NO: 634900 - RNA, 19 nt, Human
gauccuggagcaaaugcuc

SEQ ID NO: 634901 - RNA, 20 nt, Human
gaucugcccccuuggccucc

SEQ ID NO: 634902 - RNA, 18 nt, Human
gauuacaggcaugagcca

SEQ ID NO: 634903 - RNA, 23 nt, Human
gauuacaggcaugagccacggca

SEQ ID NO: 634904 - RNA, 20 nt, Human
gcaccacugcacuccagccu

SEQ ID NO: 634905 - RNA, 18 nt, Human
gcacgugugcguggcagg

SEQ ID NO: 634906 - RNA, 23 nt, Human
gccagagaagcuaagagcagcag

SEQ ID NO: 634907 - RNA, 19 nt, Human
gcccaggcuggagugcagu

SEQ ID NO: 634908 - RNA, 20 nt, Human
gcccaggcuggagugcagug

SEQ ID NO: 634909 - RNA, 23 nt, Human
gcccaggcuggagugcaguggug

SEQ ID NO: 634910 - RNA, 19 nt, Human
gcgugagccaccaugcccg

SEQ ID NO: 634911 - RNA, 19 nt, Human
gcugggugugguggcucac

SEQ ID NO: 634912 - RNA, 22 nt, Human
gcuggucuggaacucccgaccu

SEQ ID NO: 634913 - RNA, 19 nt, Human
ggaccaggaaccacaaaga

SEQ ID NO: 634914 - RNA, 21 nt, Human
ggauuacaggcaugagccacg

SEQ ID NO: 634915 - RNA, 22 nt, Human
ggccaagcugccauguuucacc

SEQ ID NO: 634916 - RNA, 24 nt, Human
ggccgcgguggcucacgccuguaa

SEQ ID NO: 634917 - RNA, 23 nt, Human
ggcgggcagaucaugaggucagg

SEQ ID NO: 634918 - RNA, 19 nt, Human
ggcugggugugguggcuca

SEQ ID NO: 634919 - RNA, 24 nt, Human
gggcagaucaugaggucaggaguu

SEQ ID NO: 634920 - RNA, 20 nt, Human
gggcugggugugguggcuca

SEQ ID NO: 634921 - RNA, 26 nt, Human
ggggaugggacccaggccuuccuguc

SEQ ID NO: 634922 - RNA, 24 nt, Human
gggugugguggcucacaccuguaa

SEQ ID NO: 634923 - RNA, 20 nt, Human
ggucucgaucaccugaccuu

SEQ ID NO: 634924 - RNA, 22 nt, Human
gguggcucacaccuguaaucug

SEQ ID NO: 634925 - RNA, 23 nt, Human
gguggcucacgccuguaauccca

SEQ ID NO: 634926 - RNA, 24 nt, Human
gguggcucacgccuguaaucccag

SEQ ID NO: 634927 - RNA, 18 nt, Human
gguuacaggcgugagcca

SEQ ID NO: 634928 - RNA, 21 nt, Human
gguuacaggcgugagccacca

SEQ ID NO: 634929 - RNA, 23 nt, Human
gguuacaggcgugagccaccaug

SEQ ID NO: 634930 - RNA, 24 nt, Human
gguuacaggcgugagccaccaugc

SEQ ID NO: 634931 - RNA, 21 nt, Human
guaaucugcaucuuaaacaca

SEQ ID NO: 634932 - RNA, 18 nt, Human
guagaaugggguuucgcc

SEQ ID NO: 634933 - RNA, 20 nt, Human
guagaaugggguuucgccau

SEQ ID NO: 634934 - RNA, 24 nt, Human
gugaucugcccgccucggccuccc

SEQ ID NO: 634935 - RNA, 18 nt, Human
gugcggcacgugugcgug

SEQ ID NO: 634936 - RNA, 23 nt, Human
guggcucacgccuguaaucccag

SEQ ID NO: 634937 - RNA, 18 nt, Human
gugugguggcucacaccu

SEQ ID NO: 634938 - RNA, 19 nt, Human
guugcagugagccgagguc

SEQ ID NO: 634939 - RNA, 23 nt, Human
guuuugguagaaugggguuucgc

SEQ ID NO: 634940 - RNA, 22 nt, Human
uaauuuuuguaguuuugguaga

SEQ ID NO: 634941 - RNA, 23 nt, Human
uaauuuuuguauuuuuguagaga

SEQ ID NO: 634942 - RNA, 23 nt, Human
uacaggcaugagccacggcaccc

SEQ ID NO: 634943 - RNA, 23 nt, Human
uacaggcgugagccaccaugccc

SEQ ID NO: 634944 - RNA, 21 nt, Human
uagaaugggguuucgccaugu

SEQ ID NO: 634945 - RNA, 22 nt, Human
uagagacaggguuucaccaagu

SEQ ID NO: 634946 - RNA, 22 nt, Human
uagccgggcgugguggcacaug

SEQ ID NO: 634947 - RNA, 19 nt, Human
uaguagagacaggguuuca

SEQ ID NO: 634948 - RNA, 26 nt, Human
uaguagagacaggguuucaccaaguu

SEQ ID NO: 634949 - RNA, 25 nt, Human
uauuuuuuuuuuaguagagacaggg

SEQ ID NO: 634950 - RNA, 24 nt, Human
ucaccaaguuagccaggauggucu

SEQ ID NO: 634951 - RNA, 21 nt, Human
ucacugcaagcgccgccaccc

SEQ ID NO: 634952 - RNA, 23 nt, Human
ucagccuccagaguagcugggac

SEQ ID NO: 634953 - RNA, 24 nt, Human
ucaugaggucaggaguucgagacc

SEQ ID NO: 634954 - RNA, 24 nt, Human
uccagaguagcugggacuacaggu

SEQ ID NO: 634955 - RNA, 23 nt, Human
uccagccugggcgagagagcgag

SEQ ID NO: 634956 - RNA, 24 nt, Human
uccagccugggcgagagagcgaga

SEQ ID NO: 634957 - RNA, 24 nt, Human
ucccaaagugcugggauuacaggc

SEQ ID NO: 634958 - RNA, 24 nt, Human
ucccaaagugcugggauuucaggc

SEQ ID NO: 634959 - RNA, 24 nt, Human
ucccacagugcugagguuacaggc

SEQ ID NO: 634960 - RNA, 20 nt, Human
uccucaaagacaggccucua

SEQ ID NO: 634961 - RNA, 23 nt, Human
ucgcaccacugcacuccagccug

SEQ ID NO: 634962 - RNA, 22 nt, Human
ucgccauguugaacaggcuggu

SEQ ID NO: 634963 - RNA, 24 nt, Human
ucgcccaggcuggagugcaguggu

SEQ ID NO: 634964 - RNA, 24 nt, Human
ucgcugugucgcccaggcuggagu

SEQ ID NO: 634965 - RNA, 18 nt, Human
ucggccucccaaagugcu

SEQ ID NO: 634966 - RNA, 23 nt, Human
ucucgcugugucgcccaggcugg

SEQ ID NO: 634967 - RNA, 24 nt, Human
ucucgcugugucgcccaggcugga

SEQ ID NO: 634968 - RNA, 22 nt, Human
ucucuacuaaaaauacaaaaaa

SEQ ID NO: 634969 - RNA, 19 nt, Human
ugaaaaaaaaaaaccaacc

SEQ ID NO: 634970 - RNA, 23 nt, Human
ugaaaaaaaaaaaccaaccaacc

SEQ ID NO: 634971 - RNA, 18 nt, Human
ugaccccuccucagucuc

SEQ ID NO: 634972 - RNA, 18 nt, Human
ugaccucaggugaccccu

SEQ ID NO: 634973 - RNA, 19 nt, Human
ugaccucaggugaccccuc

SEQ ID NO: 634974 - RNA, 23 nt, Human
ugaccucaggugaccccuccuca

SEQ ID NO: 634975 - RNA, 23 nt, Human
ugacuguagucccagcuacuugg

SEQ ID NO: 634976 - RNA, 24 nt, Human
ugacuguagucccagcuacuuggg

SEQ ID NO: 634977 - RNA, 22 nt, Human
ugagccgaggucgcaccacugc

SEQ ID NO: 634978 - RNA, 22 nt, Human
ugagccugggcuggguguggug

SEQ ID NO: 634979 - RNA, 27 nt, Human
ugaggcagaagaagaaucacuuaaacc

SEQ ID NO: 634980 - RNA, 24 nt, Human
ugaggcgggcagaucaugagguca

SEQ ID NO: 634981 - RNA, 18 nt, Human
ugagguuacaggcgugag

SEQ ID NO: 634982 - RNA, 22 nt, Human
ugagguuacaggcgugagccac

SEQ ID NO: 634983 - RNA, 23 nt, Human
ugagguuacaggcgugagccacc

SEQ ID NO: 634984 - RNA, 24 nt, Human
ugagguuacaggcgugagccacca

SEQ ID NO: 634985 - RNA, 25 nt, Human
ugagguuacaggcgugagccaccau

SEQ ID NO: 634986 - RNA, 23 nt, Human
ugaucugcccccuuggccuccca

SEQ ID NO: 634987 - RNA, 20 nt, Human
ugcccggcccaucugagcaa

SEQ ID NO: 634988 - RNA, 24 nt, Human
ugcuucagccuccagaguagcugg

SEQ ID NO: 634989 - RNA, 19 nt, Human
uggagugcaguggugggag

SEQ ID NO: 634990 - RNA, 22 nt, Human
uggagugcaguggugggagcuc

SEQ ID NO: 634991 - RNA, 23 nt, Human
uggagugcaguggugggagcuca

SEQ ID NO: 634992 - RNA, 28 nt, Human
uggagugcaguggugggagggcucuagc

SEQ ID NO: 634993 - RNA, 18 nt, Human
uggcucacaccuguaauc

SEQ ID NO: 634994 - RNA, 20 nt, Human
uggcucacaccuguaaucug

SEQ ID NO: 634995 - RNA, 22 nt, Human
uggcucacgccuguaaucccag

SEQ ID NO: 634996 - RNA, 24 nt, Human
uggcucacgccuguaaucccagca

SEQ ID NO: 634997 - RNA, 18 nt, Human
ugggacccaggccuuccu

SEQ ID NO: 634998 - RNA, 22 nt, Human
ugggagcucagcucacugcaag

SEQ ID NO: 634999 - RNA, 27 nt, Human
ugggaggcugaggcagaagaagaauca

SEQ ID NO: 635000 - RNA, 19 nt, Human
ugggaggcugaggcgggca

SEQ ID NO: 635001 - RNA, 20 nt, Human
ugggaggcugaggcgggcag

SEQ ID NO: 635002 - RNA, 24 nt, Human
ugggaggcugaggcgggcagauca

SEQ ID NO: 635003 - RNA, 18 nt, Human
ugggauuacaggcaugag

SEQ ID NO: 635004 - RNA, 19 nt, Human
ugggauuacaggcaugagc

SEQ ID NO: 635005 - RNA, 21 nt, Human
ugggauuacaggcaugagcca

SEQ ID NO: 635006 - RNA, 22 nt, Human
ugggauuacaggcaugagccac

SEQ ID NO: 635007 - RNA, 22 nt, Human
ugggauuacaggcaugagccac

SEQ ID NO: 635008 - RNA, 23 nt, Human
ugggauuacaggcaugagccacg

SEQ ID NO: 635009 - RNA, 24 nt, Human
ugggauuacaggcaugagccacgg

SEQ ID NO: 635010 - RNA, 24 nt, Human
ugggauuacaggcaugagccacgg

SEQ ID NO: 635011 - RNA, 26 nt, Human
ugggauuacaggcaugagccacggca

SEQ ID NO: 635012 - RNA, 27 nt, Human
ugggauuacaggcaugagccacggcac

SEQ ID NO: 635013 - RNA, 19 nt, Human
ugggauuucaggcgugagc

SEQ ID NO: 635014 - RNA, 22 nt, Human
ugggauuucaggcgugagcccg

SEQ ID NO: 635015 - RNA, 24 nt, Human
ugggguuucgccauguugaacagg

SEQ ID NO: 635016 - RNA, 24 nt, Human
uggugggagcucagcucacugcaa

SEQ ID NO: 635017 - RNA, 21 nt, Human
uguaaucugcaucuuaaacac

SEQ ID NO: 635018 - RNA, 24 nt, Human
uguaaucugcaucuuaaacacacg

SEQ ID NO: 635019 - RNA, 24 nt, Human
uguauuuuuuuuuuaguagagaca

SEQ ID NO: 635020 - RNA, 21 nt, Human
ugucgcccaggcuggagugca

SEQ ID NO: 635021 - RNA, 18 nt, Human
ugugucgcccaggcugga

SEQ ID NO: 635022 - RNA, 18 nt, Human
uuagccgggcgugguggc

SEQ ID NO: 635023 - RNA, 20 nt, Human
uuagccgggcgugguggcac

SEQ ID NO: 635024 - RNA, 18 nt, Human
uuaguagagacaggguuu

SEQ ID NO: 635025 - RNA, 18 nt, Human
uucaugccauucuccugc

SEQ ID NO: 635026 - RNA, 18 nt, Human
uugcagugagccgagguc

SEQ ID NO: 635027 - RNA, 19 nt, Human
uugcagugagccgaggucg

SEQ ID NO: 635028 - RNA, 22 nt, Human
uugcagugagccgaggucgcac

SEQ ID NO: 635029 - RNA, 29 nt, Human
uugggaggcugaggcagaagaagaaucaa

SEQ ID NO: 635030 - RNA, 25 nt, Human
uugggaggcugaggcgggcagauca

SEQ ID NO: 635031 - RNA, 24 nt, Human
uugguagaaugggguuucgccaug

SEQ ID NO: 635032 - RNA, 24 nt, Human
uuguagagacaggguuucauucug

SEQ ID NO: 635033 - RNA, 18 nt, Human
uuucauucuguuggccag

SEQ ID NO: 635034 - RNA, 24 nt, Human
uuugguagaaugggguuucgccau

SEQ ID NO: 635035 - RNA, 25 nt, Human
uuuguagagacaggguuucauucug

SEQ ID NO: 635036 - RNA, 18 nt, Human
uuuuguaguuuugguaga

SEQ ID NO: 635037 - RNA, 24 nt, Human
uuuuuaguagagacaggguuucac

SEQ ID NO: 635038 - RNA, 23 nt, Human
uuuuuguagagacaggguuucau

SEQ ID NO: 635039 - RNA, 23 nt, Human
uuuuuuaguagagacaggguuuc

SEQ ID NO: 635040 - RNA, 26 nt, Human
uuuuuuuuuuuuagaugggaaaucuc

SEQ ID NO: 635041 - RNA, 21 nt, Human
uuuuuuuuuuuuuuagauggg

SEQ ID NO: 635042 - RNA, 22 nt, Human
uuuuuuuuuuuuuuuagauggg

SEQ ID NO: 635043 - RNA, 19 nt, Human
aaaaaaagggcaauucuga

SEQ ID NO: 635044 - RNA, 24 nt, Human
aaaaauaagaagagagccuagaac

SEQ ID NO: 635045 - RNA, 23 nt, Human
aaacuggcaugaagcucucccac

SEQ ID NO: 635046 - RNA, 18 nt, Human
aacaagcauaucuucaag

SEQ ID NO: 635047 - RNA, 18 nt, Human
aaccuuccuccccaucca

SEQ ID NO: 635048 - RNA, 26 nt, Human
aaccuuccuccccauccacacuccca

SEQ ID NO: 635049 - RNA, 21 nt, Human
aacuggcaugaagcucuccca

SEQ ID NO: 635050 - RNA, 21 nt, Human
aaugagaaaaauaagaagaga

SEQ ID NO: 635051 - RNA, 20 nt, Human
acagauaugcagaccgaaau

SEQ ID NO: 635052 - RNA, 22 nt, Human
acaugccugaaaacugggccca

SEQ ID NO: 635053 - RNA, 19 nt, Human
acuuauuccucuuugccaa

SEQ ID NO: 635054 - RNA, 20 nt, Human
agaccgaaaugcugacacca

SEQ ID NO: 635055 - RNA, 21 nt, Human
agacuuuuaggaaggagcagc

SEQ ID NO: 635056 - RNA, 18 nt, Human
agauacggacacacagau

SEQ ID NO: 635057 - RNA, 21 nt, Human
agauaugcagaccgaaaugcu

SEQ ID NO: 635058 - RNA, 20 nt, Human
agccuagaaccuuccucccc

SEQ ID NO: 635059 - RNA, 24 nt, Human
aggcauugggaaaugagaaaaaua

SEQ ID NO: 635060 - RNA, 18 nt, Human
aguuaccauaaaucucag

SEQ ID NO: 635061 - RNA, 21 nt, Human
augccugaaaacugggcccac

SEQ ID NO: 635062 - RNA, 21 nt, Human
caaggcuucuguuguuggggu

SEQ ID NO: 635063 - RNA, 25 nt, Human
cacguacacgcacacaaacgcagau

SEQ ID NO: 635064 - RNA, 21 nt, Human
cagaccgaaaugcugacacca

SEQ ID NO: 635065 - RNA, 20 nt, Human
cagauuugaagcuugccauc

SEQ ID NO: 635066 - RNA, 28 nt, Human
cagcagcagguuucaaugucguaagggc

SEQ ID NO: 635067 - RNA, 22 nt, Human
caugccugaaaacugggcccac

SEQ ID NO: 635068 - RNA, 20 nt, Human
cauucuauguugacucugug

SEQ ID NO: 635069 - RNA, 18 nt, Human
ccauccacacucccaccc

SEQ ID NO: 635070 - RNA, 24 nt, Human
ccccauccacacucccacccuccu

SEQ ID NO: 635071 - RNA, 20 nt, Human
cguacacgcacacaaacgca

SEQ ID NO: 635072 - RNA, 20 nt, Human
cuauucccuugaacuccgug

SEQ ID NO: 635073 - RNA, 22 nt, Human
cuccccauccacacucccaccc

SEQ ID NO: 635074 - RNA, 28 nt, Human
cuccccauccacacucccacccuccuca

SEQ ID NO: 635075 - RNA, 20 nt, Human
cuccgugaccaaugcugccu

SEQ ID NO: 635076 - RNA, 22 nt, Human
cuccugguuuguuugacuguuu

SEQ ID NO: 635077 - RNA, 20 nt, Human
cugcucuuguccuccaaugu

SEQ ID NO: 635078 - RNA, 21 nt, Human
cuugauuguuuucuuccuuuu

SEQ ID NO: 635079 - RNA, 23 nt, Human
gaagcucucccacagagaggcau

SEQ ID NO: 635080 - RNA, 28 nt, Human
gagaaaaauaagaagagagccgguaccc

SEQ ID NO: 635081 - RNA, 20 nt, Human
gagagcuucccauucaaaag

SEQ ID NO: 635082 - RNA, 21 nt, Human
gauacggacacacagauaugc

SEQ ID NO: 635083 - RNA, 19 nt, Human
gcacgaagccucuuguaca

SEQ ID NO: 635084 - RNA, 22 nt, Human
gcagaucggaauggcccaucca

SEQ ID NO: 635085 - RNA, 21 nt, Human
ggcauugggaaaugagaaaaa

SEQ ID NO: 635086 - RNA, 18 nt, Human
uaaaaggagaguugacau

SEQ ID NO: 635087 - RNA, 19 nt, Human
uaagaagagagccuagaac

SEQ ID NO: 635088 - RNA, 27 nt, Human
uaagaagagagccuagaaccuuccucc

SEQ ID NO: 635089 - RNA, 25 nt, Human
uaagauaucaucaauuuuaugauaa

SEQ ID NO: 635090 - RNA, 24 nt, Human
uacacgcacacaaacgcagauacg

SEQ ID NO: 635091 - RNA, 20 nt, Human
uaccauaaaucucagcugga

SEQ ID NO: 635092 - RNA, 19 nt, Human
uaugcagaccgaaaugcug

SEQ ID NO: 635093 - RNA, 20 nt, Human
uccacacucccacccuccuc

SEQ ID NO: 635094 - RNA, 23 nt, Human
uccacacucccacccuccucaca

SEQ ID NO: 635095 - RNA, 21 nt, Human
uccccauccacacucccaccc

SEQ ID NO: 635096 - RNA, 22 nt, Human
uccccauccacacucccacccu

SEQ ID NO: 635097 - RNA, 20 nt, Human
ucgaaaaguagucaucugcu

SEQ ID NO: 635098 - RNA, 21 nt, Human
ucggaauggcccauccaauaa

SEQ ID NO: 635099 - RNA, 21 nt, Human
ucuacaugccugaaaacuggg

SEQ ID NO: 635100 - RNA, 25 nt, Human
ucucccacagagaggcauugggaaa

SEQ ID NO: 635101 - RNA, 20 nt, Human
ucucuaaauuggauuagcuc

SEQ ID NO: 635102 - RNA, 18 nt, Human
ugacaugggucucuagac

SEQ ID NO: 635103 - RNA, 22 nt, Human
ugcagaccgaaaugcugacacc

SEQ ID NO: 635104 - RNA, 25 nt, Human
ugccccuaacauucuuguggaauuu

SEQ ID NO: 635105 - RNA, 19 nt, Human
ugccugagcguggugaaaa

SEQ ID NO: 635106 - RNA, 19 nt, Human
ugcuugauuguuuucuucc

SEQ ID NO: 635107 - RNA, 20 nt, Human
uggaauuucauaaggcagau

SEQ ID NO: 635108 - RNA, 18 nt, Human
uggcaugaagcucuccca

SEQ ID NO: 635109 - RNA, 20 nt, Human
uggcaugaagcucucccaca

SEQ ID NO: 635110 - RNA, 21 nt, Human
uggcaugaagcucucccacag

SEQ ID NO: 635111 - RNA, 23 nt, Human
uggcaugaagcucucccacagag

SEQ ID NO: 635112 - RNA, 21 nt, Human
uggcccauccaauaacagcug

SEQ ID NO: 635113 - RNA, 24 nt, Human
ugggucucuagacaagccaaguuu

SEQ ID NO: 635114 - RNA, 20 nt, Human
uguuguuuuaaacuccuggu

SEQ ID NO: 635115 - RNA, 20 nt, Human
uucuauguugacucuguguu

SEQ ID NO: 635116 - RNA, 19 nt, Human
uugcuuacucaucuauucc

SEQ ID NO: 635117 - RNA, 21 nt, Human
uuucaauguaacguaauuacu

SEQ ID NO: 635118 - RNA, 19 nt, Human
uuuuuuuuuuuuuuuuuaa

SEQ ID NO: 635119 - RNA, 22 nt, Human
agacagcagcgagaccgggagc

SEQ ID NO: 635120 - RNA, 21 nt, Human
auccauaauaucaucaucauu

SEQ ID NO: 635121 - RNA, 18 nt, Human
cagcagcgagaccgggag

SEQ ID NO: 635122 - RNA, 19 nt, Human
caugagcagguagccaggc

SEQ ID NO: 635123 - RNA, 20 nt, Human
caugagcagguagccaggca

SEQ ID NO: 635124 - RNA, 22 nt, Human
cgggagcgcagggagcggagga

SEQ ID NO: 635125 - RNA, 18 nt, Human
gagcgcagggagcggagg

SEQ ID NO: 635126 - RNA, 22 nt, Human
ggagacacuacagcuucuccau

SEQ ID NO: 635127 - RNA, 21 nt, Human
guuuugucagauggagacacu

SEQ ID NO: 635128 - RNA, 23 nt, Human
uaaaccacaucucuucuucaucu

SEQ ID NO: 635129 - RNA, 20 nt, Human
uaucuugccuuucucuuugu

SEQ ID NO: 635130 - RNA, 23 nt, Human
ucagauggagacacuacagcuuc

SEQ ID NO: 635131 - RNA, 19 nt, Human
ucaugagcagguagccagg

SEQ ID NO: 635132 - RNA, 24 nt, Human
ucccucaugagcagguagccaggc

SEQ ID NO: 635133 - RNA, 22 nt, Human
ugagcagguagccaggcaacca

SEQ ID NO: 635134 - RNA, 18 nt, Human
uggauccauaauaucauc

SEQ ID NO: 635135 - RNA, 19 nt, Human
uucuuuggagaucauggaa

SEQ ID NO: 635136 - RNA, 22 nt, Human
uuucuuuggagaucauggaagu

SEQ ID NO: 635137 - RNA, 21 nt, Human
aaacacagagccgcgaugucc

SEQ ID NO: 635138 - RNA, 20 nt, Human
aaccacagcaaugagaucug

SEQ ID NO: 635139 - RNA, 18 nt, Human
agaagggaaggaagggaa

SEQ ID NO: 635140 - RNA, 23 nt, Human
agacaggagaccgaaacucagag

SEQ ID NO: 635141 - RNA, 21 nt, Human
agacagguagcaacuccagag

SEQ ID NO: 635142 - RNA, 22 nt, Human
agggaaggaagggaaggguagg

SEQ ID NO: 635143 - RNA, 19 nt, Human
caaaaacacagagccgcga

SEQ ID NO: 635144 - RNA, 19 nt, Human
caggagaagacagguagca

SEQ ID NO: 635145 - RNA, 19 nt, Human
caggagaccgaaacucaga

SEQ ID NO: 635146 - RNA, 19 nt, Human
cugguuguggaaccucuuc

SEQ ID NO: 635147 - RNA, 20 nt, Human
cuuccagaacacacaacauc

SEQ ID NO: 635148 - RNA, 22 nt, Human
cuucugauucugccguuucacu

SEQ ID NO: 635149 - RNA, 23 nt, Human
gagaagacagguagcaacuccag

SEQ ID NO: 635150 - RNA, 19 nt, Human
gaucaccaacaagauuccu

SEQ ID NO: 635151 - RNA, 26 nt, Human
gccaagauuuucugguuguggaaccu

SEQ ID NO: 635152 - RNA, 21 nt, Human
uaagaaaggcuaucuggggca

SEQ ID NO: 635153 - RNA, 18 nt, Human
ucaaaaacacagagccgc

SEQ ID NO: 635154 - RNA, 18 nt, Human
uccagagaagggaaggaa

SEQ ID NO: 635155 - RNA, 20 nt, Human
uccagccaagauuuucuggu

SEQ ID NO: 635156 - RNA, 23 nt, Human
uccugcgaccugucacaggcccc

SEQ ID NO: 635157 - RNA, 20 nt, Human
ucuaugugccaggcagcaug

SEQ ID NO: 635158 - RNA, 19 nt, Human
uggauggaucaccaacaag

SEQ ID NO: 635159 - RNA, 19 nt, Human
uguccacuuccagaacaca

SEQ ID NO: 635160 - RNA, 19 nt, Human
uuagacaggagaccgaaac

SEQ ID NO: 635161 - RNA, 20 nt, Human
uucaagaagcuauuaucacc

SEQ ID NO: 635162 - RNA, 21 nt, Human
uuccugauggugaaauuccag

SEQ ID NO: 635163 - RNA, 21 nt, Human
aaaaauacauagaaaugagcc

SEQ ID NO: 635164 - RNA, 24 nt, Human
aaaccaggugcuucaaccuaggga

SEQ ID NO: 635165 - RNA, 19 nt, Human
aaacuguguaauggugccu

SEQ ID NO: 635166 - RNA, 19 nt, Human
aaagauuaguaacaauuca

SEQ ID NO: 635167 - RNA, 23 nt, Human
aaauagucacaaagauuaguaac

SEQ ID NO: 635168 - RNA, 21 nt, Human
aaauccauucauuacagcaaa

SEQ ID NO: 635169 - RNA, 19 nt, Human
aagcagaaauacaaaagcc

SEQ ID NO: 635170 - RNA, 27 nt, Human
aagcagaaauacaaaagccacaauaau

SEQ ID NO: 635171 - RNA, 23 nt, Human
aagccacaauaaucucaauagcc

SEQ ID NO: 635172 - RNA, 20 nt, Human
aagugaaaaagauggcaacc

SEQ ID NO: 635173 - RNA, 21 nt, Human
aauauggacauucacuaaagc

SEQ ID NO: 635174 - RNA, 23 nt, Human
acaaugaagguguucauucugaa

SEQ ID NO: 635175 - RNA, 22 nt, Human
accacacuucugcugaauacag

SEQ ID NO: 635176 - RNA, 20 nt, Human
accuaauuuauaacauuuuu

SEQ ID NO: 635177 - RNA, 19 nt, Human
accuaggugcugggguggc

SEQ ID NO: 635178 - RNA, 19 nt, Human
agaacauucaugaugcuga

SEQ ID NO: 635179 - RNA, 21 nt, Human
agaacucucuguauuggaacu

SEQ ID NO: 635180 - RNA, 21 nt, Human
agacacaagcaaacaaaaucu

SEQ ID NO: 635181 - RNA, 19 nt, Human
agagaaggaaggaguaaga

SEQ ID NO: 635182 - RNA, 19 nt, Human
agagugcacuucuugugcc

SEQ ID NO: 635183 - RNA, 20 nt, Human
agauggauuuuaaaucugcc

SEQ ID NO: 635184 - RNA, 25 nt, Human
agguaccaauaacaaaagcugagcu

SEQ ID NO: 635185 - RNA, 20 nt, Human
aucacaacagccauuuuuac

SEQ ID NO: 635186 - RNA, 25 nt, Human
aucacgacccaagaaccuaauuuag

SEQ ID NO: 635187 - RNA, 24 nt, Human
aucuuucccuagccuggcaggcca

SEQ ID NO: 635188 - RNA, 21 nt, Human
caaaagaguaaagcagcaaau

SEQ ID NO: 635189 - RNA, 18 nt, Human
caaaaugcagucaagaua

SEQ ID NO: 635190 - RNA, 21 nt, Human
caaacaaaaucuuagccagaa

SEQ ID NO: 635191 - RNA, 22 nt, Human
caacagccauuuuuacaauacu

SEQ ID NO: 635192 - RNA, 20 nt, Human
caacauccagacacaagcaa

SEQ ID NO: 635193 - RNA, 23 nt, Human
caacauccagacacaagcaaaca

SEQ ID NO: 635194 - RNA, 23 nt, Human
caaccauaagauuuauaucuccu

SEQ ID NO: 635195 - RNA, 23 nt, Human
caagcaaacaaaaucuuagccag

SEQ ID NO: 635196 - RNA, 24 nt, Human
caagcaaacaaaaucuuagccaga

SEQ ID NO: 635197 - RNA, 22 nt, Human
caauaacaaaagcugagcugag

SEQ ID NO: 635198 - RNA, 18 nt, Human
cagcucucucccccaucc

SEQ ID NO: 635199 - RNA, 25 nt, Human
caggugcuucaaccuaggugcuggg

SEQ ID NO: 635200 - RNA, 19 nt, Human
cauucauuacagcaaaugu

SEQ ID NO: 635201 - RNA, 21 nt, Human
ccacuacugaagaugcaagaa

SEQ ID NO: 635202 - RNA, 22 nt, Human
cuucuugcugggcuggcucccc

SEQ ID NO: 635203 - RNA, 20 nt, Human
cuugcugggcuggcucccca

SEQ ID NO: 635204 - RNA, 20 nt, Human
gcagaaauacaaaagccaca

SEQ ID NO: 635205 - RNA, 24 nt, Human
ggaggauaguuuuauucauuugaa

SEQ ID NO: 635206 - RNA, 21 nt, Human
ggcuacguuugagguuuugca

SEQ ID NO: 635207 - RNA, 24 nt, Human
gggagcaccagcauaugcgcuacc

SEQ ID NO: 635208 - RNA, 19 nt, Human
guaaagcagcaaauacuaa

SEQ ID NO: 635209 - RNA, 20 nt, Human
guaacacuuucauaaucuug

SEQ ID NO: 635210 - RNA, 21 nt, Human
gugaaaaagauggcaaccaca

SEQ ID NO: 635211 - RNA, 21 nt, Human
uaaauagucacaaagauuagu

SEQ ID NO: 635212 - RNA, 23 nt, Human
uaaauuuuguacccuacacacuu

SEQ ID NO: 635213 - RNA, 22 nt, Human
uaagaaaaauacauagaaauga

SEQ ID NO: 635214 - RNA, 22 nt, Human
uaagaaaugugauaaauguagg

SEQ ID NO: 635215 - RNA, 21 nt, Human
uaagaacauucaugaugcuga

SEQ ID NO: 635216 - RNA, 19 nt, Human
uaagcacaauauuugaaga

SEQ ID NO: 635217 - RNA, 18 nt, Human
uaagugaucuacuuaaaa

SEQ ID NO: 635218 - RNA, 23 nt, Human
uacaaaaucuauacuguuucagg

SEQ ID NO: 635219 - RNA, 24 nt, Human
uacaaauaccuaccacggugugcc

SEQ ID NO: 635220 - RNA, 20 nt, Human
uacacacuuccacugaagca

SEQ ID NO: 635221 - RNA, 22 nt, Human
uacacacuuccacugaagcaga

SEQ ID NO: 635222 - RNA, 22 nt, Human
uacccuacacacuuccacugaa

SEQ ID NO: 635223 - RNA, 19 nt, Human
uaucacgacccaagaaccg

SEQ ID NO: 635224 - RNA, 18 nt, Human
uaucacgacccaagaacu

SEQ ID NO: 635225 - RNA, 22 nt, Human
ucaacauccagacacaagcaaa

SEQ ID NO: 635226 - RNA, 18 nt, Human
ucaaguugggagguagcc

SEQ ID NO: 635227 - RNA, 18 nt, Human
ucaugcccaguucaguac

SEQ ID NO: 635228 - RNA, 21 nt, Human
uccagacacaagcaaacaaaa

SEQ ID NO: 635229 - RNA, 19 nt, Human
ucccccauccagaugcaau

SEQ ID NO: 635230 - RNA, 22 nt, Human
ugaaacaucacaaaagcagucu

SEQ ID NO: 635231 - RNA, 21 nt, Human
ugaagcagaaauacaaaagcc

SEQ ID NO: 635232 - RNA, 22 nt, Human
ugaagcagaaauacaaaagcca

SEQ ID NO: 635233 - RNA, 23 nt, Human
ugaagcggcauuguaacacuuuc

SEQ ID NO: 635234 - RNA, 24 nt, Human
ugagcugcccuucugugcugcguu

SEQ ID NO: 635235 - RNA, 20 nt, Human
ugaucacaacagccauuuuu

SEQ ID NO: 635236 - RNA, 19 nt, Human
ugaugcugaaaguuaaacu

SEQ ID NO: 635237 - RNA, 20 nt, Human
ugcugcguucagccugacca

SEQ ID NO: 635238 - RNA, 19 nt, Human
ugcugggcuggcuccccag

SEQ ID NO: 635239 - RNA, 19 nt, Human
uggacauucacuaaagcca

SEQ ID NO: 635240 - RNA, 22 nt, Human
uggcuacguuugagguuuugca

SEQ ID NO: 635241 - RNA, 21 nt, Human
ugggguggcaaucugccaagg

SEQ ID NO: 635242 - RNA, 18 nt, Human
ugggguggggugcaggau

SEQ ID NO: 635243 - RNA, 26 nt, Human
ugggguggggugcaggauacgugcgg

SEQ ID NO: 635244 - RNA, 22 nt, Human
uguaauuaaaagaacuguacaa

SEQ ID NO: 635245 - RNA, 19 nt, Human
uguacaaauaccuaccacg

SEQ ID NO: 635246 - RNA, 19 nt, Human
uguaguagaaccacugucu

SEQ ID NO: 635247 - RNA, 20 nt, Human
uguccagcucucucccccaa

SEQ ID NO: 635248 - RNA, 18 nt, Human
uguguuuggagaacuguc

SEQ ID NO: 635249 - RNA, 24 nt, Human
uuaaauuuuguacccuacacacuu

SEQ ID NO: 635250 - RNA, 22 nt, Human
uuaauauuuuaauguuucaugc

SEQ ID NO: 635251 - RNA, 18 nt, Human
uuacauaaagugaaaaag

SEQ ID NO: 635252 - RNA, 24 nt, Human
uuaguuagucaguuggguauuagu

SEQ ID NO: 635253 - RNA, 23 nt, Human
uucuguguuuggagaacugucua

SEQ ID NO: 635254 - RNA, 18 nt, Human
uugaaugcugucaugacu

SEQ ID NO: 635255 - RNA, 22 nt, Human
uugcugggcuggcuccccaguu

SEQ ID NO: 635256 - RNA, 20 nt, Human
uuggaacuacuguguagccc

SEQ ID NO: 635257 - RNA, 18 nt, Human
uuuacaauacucacagag

SEQ ID NO: 635258 - RNA, 23 nt, Human
uuuauaacauuuuuaaacucuga

SEQ ID NO: 635259 - RNA, 21 nt, Human
uuugcagacuugaagcggcau

SEQ ID NO: 635260 - RNA, 19 nt, Human
aaaaggcaaacauaauuga

SEQ ID NO: 635261 - RNA, 19 nt, Human
aaaauaccuucucccaauu

SEQ ID NO: 635262 - RNA, 23 nt, Human
accaccgagagaggagggcaaca

SEQ ID NO: 635263 - RNA, 21 nt, Human
acgugcgcugggcggacagac

SEQ ID NO: 635264 - RNA, 21 nt, Human
agagcgcuagaaaugccacac

SEQ ID NO: 635265 - RNA, 24 nt, Human
aggcacgguggcucacgccuguaa

SEQ ID NO: 635266 - RNA, 22 nt, Human
aggcgguggaggcugccgcgcc

SEQ ID NO: 635267 - RNA, 19 nt, Human
agggcaacagcaggcggug

SEQ ID NO: 635268 - RNA, 24 nt, Human
caagcaaugcuuuggauuuucuuu

SEQ ID NO: 635269 - RNA, 21 nt, Human
ccgccgcagccgccucggccu

SEQ ID NO: 635270 - RNA, 23 nt, Human
ccgccucggccugacagucgccc

SEQ ID NO: 635271 - RNA, 18 nt, Human
ccugagauuccuucgcac

SEQ ID NO: 635272 - RNA, 26 nt, Human
ccugagauuccuucgcacuuccacuc

SEQ ID NO: 635273 - RNA, 23 nt, Human
ccuguaaucauuaaaaaaugacu

SEQ ID NO: 635274 - RNA, 22 nt, Human
cgcugggcggacagaccaccga

SEQ ID NO: 635275 - RNA, 23 nt, Human
cucuuugaguuuccagugauuaa

SEQ ID NO: 635276 - RNA, 18 nt, Human
gaaguuucuucacugcug

SEQ ID NO: 635277 - RNA, 19 nt, Human
gcgcuagaaaugccacaca

SEQ ID NO: 635278 - RNA, 20 nt, Human
gcugcucagcugggccggcu

SEQ ID NO: 635279 - RNA, 18 nt, Human
gcuuuggauuuucuuucu

SEQ ID NO: 635280 - RNA, 22 nt, Human
ggcaacagcaggcgguggaggc

SEQ ID NO: 635281 - RNA, 20 nt, Human
ggggaagaacugguuucuuu

SEQ ID NO: 635282 - RNA, 19 nt, Human
gguggcucacgccuguaau

SEQ ID NO: 635283 - RNA, 20 nt, Human
uaaaagaacauccaagcaaa

SEQ ID NO: 635284 - RNA, 21 nt, Human
uagaaaugccacacagaucuc

SEQ ID NO: 635285 - RNA, 23 nt, Human
uaggggagaacugaggucgcuug

SEQ ID NO: 635286 - RNA, 19 nt, Human
ucgccgccgcagccgccuc

SEQ ID NO: 635287 - RNA, 24 nt, Human
ucuggccaggcacgguggcucacg

SEQ ID NO: 635288 - RNA, 24 nt, Human
ugaauacuuugggggaagaacugg

SEQ ID NO: 635289 - RNA, 23 nt, Human
ugcucagcugggccggcugacgg

SEQ ID NO: 635290 - RNA, 18 nt, Human
uggcucacgccuguaauc

SEQ ID NO: 635291 - RNA, 19 nt, Human
uggcucacgccuguaauca

SEQ ID NO: 635292 - RNA, 21 nt, Human
ugggggaagaacugguuucuu

SEQ ID NO: 635293 - RNA, 22 nt, Human
uuacagcaauaacucaucaaag

SEQ ID NO: 635294 - RNA, 22 nt, Human
uuuaaaaauaccuucucccaau

SEQ ID NO: 635295 - RNA, 23 nt, Human
uuuaaaaauaccuucucccaauu

SEQ ID NO: 635296 - RNA, 22 nt, Human
uuugggggaagaacugguuucu

SEQ ID NO: 635297 - RNA, 20 nt, Human
ccugcaagacuucaggcucu

SEQ ID NO: 635298 - RNA, 19 nt, Human
ucccugggggcagacgauu

SEQ ID NO: 635299 - RNA, 21 nt, Human
aagcccaggcggccccggcga

SEQ ID NO: 635300 - RNA, 24 nt, Human
aaugcuccugauaaccuugagggc

SEQ ID NO: 635301 - RNA, 18 nt, Human
accuugagggcugaaaag

SEQ ID NO: 635302 - RNA, 19 nt, Human
agaccugaaagcccaggcg

SEQ ID NO: 635303 - RNA, 26 nt, Human
agccucggaagaccugaaagcccagg

SEQ ID NO: 635304 - RNA, 23 nt, Human
ccacuacacuuagguguuacagg

SEQ ID NO: 635305 - RNA, 23 nt, Human
ccucggaagaccugaaagcccag

SEQ ID NO: 635306 - RNA, 18 nt, Human
ccugaaagcccaggcggc

SEQ ID NO: 635307 - RNA, 19 nt, Human
ccugauaaccuugagggcu

SEQ ID NO: 635308 - RNA, 19 nt, Human
cgaaggcacuagagagaag

SEQ ID NO: 635309 - RNA, 19 nt, Human
cgaaggcacuagagagaag

SEQ ID NO: 635310 - RNA, 22 nt, Human
cuccugauaaccuugagggcug

SEQ ID NO: 635311 - RNA, 21 nt, Human
ggcacgaaggcacuagagaga

SEQ ID NO: 635312 - RNA, 21 nt, Human
uagcagugauacaaaugcucc

SEQ ID NO: 635313 - RNA, 18 nt, Human
ugaaaagcuaucccuuaa

SEQ ID NO: 635314 - RNA, 24 nt, Human
ugaaaagcuaucccuuaaugcuac

SEQ ID NO: 635315 - RNA, 19 nt, Human
uuugacaagugauacuacu

SEQ ID NO: 635316 - RNA, 23 nt, Human
uuuuuuuuuuuuuuuuugacaag

SEQ ID NO: 635317 - RNA, 20 nt, Human
uuuuuuuuuuuuuuuuuugg

SEQ ID NO: 635318 - RNA, 25 nt, Human
aaaaaaacacaaaauuauagccgca

SEQ ID NO: 635319 - RNA, 24 nt, Human
aaaacacaaccauuauauacacug

SEQ ID NO: 635320 - RNA, 26 nt, Human
aaacaacaagaccaauuuuuuuguac

SEQ ID NO: 635321 - RNA, 18 nt, Human
aaacaccauagggcauga

SEQ ID NO: 635322 - RNA, 18 nt, Human
aacacuauccuagcugca

SEQ ID NO: 635323 - RNA, 19 nt, Human
aacuauuuagagcuucuuc

SEQ ID NO: 635324 - RNA, 22 nt, Human
aagaauguuauuaucuaacuau

SEQ ID NO: 635325 - RNA, 21 nt, Human
aagcacucaucuaaagguaaa

SEQ ID NO: 635326 - RNA, 19 nt, Human
acaaacaucaaucucacag

SEQ ID NO: 635327 - RNA, 24 nt, Human
acauucauauauuauacaggaaac

SEQ ID NO: 635328 - RNA, 21 nt, Human
agucuucauccuuugaggaug

SEQ ID NO: 635329 - RNA, 19 nt, Human
caacuggauuuuaaucgug

SEQ ID NO: 635330 - RNA, 23 nt, Human
caauuaaaaaaaaaaacacaaaa

SEQ ID NO: 635331 - RNA, 21 nt, Human
cacaggaucaagcauacgagg

SEQ ID NO: 635332 - RNA, 25 nt, Human
caccuccagccacaaacaucaaucu

SEQ ID NO: 635333 - RNA, 22 nt, Human
caggauaaaguagacaagaaug

SEQ ID NO: 635334 - RNA, 19 nt, Human
caggaucaagcauacgagg

SEQ ID NO: 635335 - RNA, 24 nt, Human
cauagccccaugaaaacacaacca

SEQ ID NO: 635336 - RNA, 23 nt, Human
ccaaagcacucaucuaaagguaa

SEQ ID NO: 635337 - RNA, 23 nt, Human
ccgcaacacuauccuagcugcau

SEQ ID NO: 635338 - RNA, 22 nt, Human
ccugcagcaucugcagugaacu

SEQ ID NO: 635339 - RNA, 23 nt, Human
cugcagugaacucuucugaaugu

SEQ ID NO: 635340 - RNA, 19 nt, Human
gcagcaucugcagugaacu

SEQ ID NO: 635341 - RNA, 23 nt, Human
gcagugaacucuucugaaugucc

SEQ ID NO: 635342 - RNA, 24 nt, Human
gugagucuucauccuuugaggaug

SEQ ID NO: 635343 - RNA, 20 nt, Human
uaagguggggugccugacuu

SEQ ID NO: 635344 - RNA, 23 nt, Human
uaggaaaacaggcaguuauucac

SEQ ID NO: 635345 - RNA, 18 nt, Human
uauguugccagugcucaa

SEQ ID NO: 635346 - RNA, 19 nt, Human
ucugcagugaacucuucuc

SEQ ID NO: 635347 - RNA, 27 nt, Human
ugaaaacacaaccauuauauacacugu

SEQ ID NO: 635348 - RNA, 22 nt, Human
ugggauaccacccggguucaaa

SEQ ID NO: 635349 - RNA, 21 nt, Human
aaacacaacuucacaauuccu

SEQ ID NO: 635350 - RNA, 22 nt, Human
aaaccaaaacucccccagggaa

SEQ ID NO: 635351 - RNA, 19 nt, Human
accauguccggccaaaaug

SEQ ID NO: 635352 - RNA, 18 nt, Human
acucauuccccugucccc

SEQ ID NO: 635353 - RNA, 23 nt, Human
agggaaacguucugauguuccag

SEQ ID NO: 635354 - RNA, 23 nt, Human
agucuucuucugcuguaucccau

SEQ ID NO: 635355 - RNA, 19 nt, Human
aucugagcauugucugcau

SEQ ID NO: 635356 - RNA, 25 nt, Human
caaaacucccccagggaaaaugcua

SEQ ID NO: 635357 - RNA, 26 nt, Human
caaaauaaaaacacaacuucacaauu

SEQ ID NO: 635358 - RNA, 23 nt, Human
caagaauuucuuuucuucagcuc

SEQ ID NO: 635359 - RNA, 18 nt, Human
caaguccauuagccaaag

SEQ ID NO: 635360 - RNA, 18 nt, Human
cacugcuaugacuggagc

SEQ ID NO: 635361 - RNA, 23 nt, Human
cauccuguuugaggcuaguuuua

SEQ ID NO: 635362 - RNA, 19 nt, Human
caucugagucugaucguuc

SEQ ID NO: 635363 - RNA, 20 nt, Human
cauugggcacugagcuucug

SEQ ID NO: 635364 - RNA, 21 nt, Human
ccauguccggccaaaauggca

SEQ ID NO: 635365 - RNA, 18 nt, Human
cccauugggcacugagcu

SEQ ID NO: 635366 - RNA, 20 nt, Human
cggccaaaauggcacuaccc

SEQ ID NO: 635367 - RNA, 18 nt, Human
cuaugugcacauuugucc

SEQ ID NO: 635368 - RNA, 18 nt, Human
gcugaauaaaugaaugaa

SEQ ID NO: 635369 - RNA, 24 nt, Human
guuccaagaauuucuuuucuucag

SEQ ID NO: 635370 - RNA, 21 nt, Human
uaaaaccaaaacucccccagg

SEQ ID NO: 635371 - RNA, 27 nt, Human
uagugaaccaucuaauuaaaaccaaaa

SEQ ID NO: 635372 - RNA, 19 nt, Human
ucaaugagguaaugugugc

SEQ ID NO: 635373 - RNA, 23 nt, Human
ucacuggguuaccccaaccaugu

SEQ ID NO: 635374 - RNA, 25 nt, Human
uccaagaauuucuuuucuucagcuc

SEQ ID NO: 635375 - RNA, 23 nt, Human
uccaagagucaacacacguugga

SEQ ID NO: 635376 - RNA, 19 nt, Human
uccgagucaaaacaguggc

SEQ ID NO: 635377 - RNA, 20 nt, Human
uccgcaauaaaagaaguuua

SEQ ID NO: 635378 - RNA, 27 nt, Human
ucuucagcuccuguuuuuggggccgcc

SEQ ID NO: 635379 - RNA, 20 nt, Human
ucuucuucugcuguauccca

SEQ ID NO: 635380 - RNA, 21 nt, Human
ugaaacaaaauaaaaacacaa

SEQ ID NO: 635381 - RNA, 19 nt, Human
ugcugaauaaaugaaugaa

SEQ ID NO: 635382 - RNA, 20 nt, Human
ugcuuucguucuucuacuaa

SEQ ID NO: 635383 - RNA, 20 nt, Human
ugucauuauucacaucugag

SEQ ID NO: 635384 - RNA, 24 nt, Human
ugugcaucagugaaauaaacagaa

SEQ ID NO: 635385 - RNA, 18 nt, Human
uguuccagaauaauguuc

SEQ ID NO: 635386 - RNA, 22 nt, Human
uguuguuuuuuuuuauuuuuuu

SEQ ID NO: 635387 - RNA, 21 nt, Human
uucacaauuccuuacuggguu

SEQ ID NO: 635388 - RNA, 24 nt, Human
uuccaagaauuucuuuucuucagc

SEQ ID NO: 635389 - RNA, 23 nt, Human
uuguuguuuuuuuuuauuuuuuu

SEQ ID NO: 635390 - RNA, 18 nt, Human
uuugcacagcuuuuauua

SEQ ID NO: 635391 - RNA, 22 nt, Human
aaaaaaacaacaaaaaacuuag

SEQ ID NO: 635392 - RNA, 23 nt, Human
aaaaagccagggccuaauaagua

SEQ ID NO: 635393 - RNA, 20 nt, Human
aaacaauguggagccacuga

SEQ ID NO: 635394 - RNA, 21 nt, Human
aacccugucucuaccaaaaaa

SEQ ID NO: 635395 - RNA, 23 nt, Human
aacuccaaagaagaaagggcaac

SEQ ID NO: 635396 - RNA, 21 nt, Human
aagaaaaaauuccaaucaccc

SEQ ID NO: 635397 - RNA, 21 nt, Human
aagaaagaaaaaagaaaaaaa

SEQ ID NO: 635398 - RNA, 21 nt, Human
aauaaaaaauguucaaggcca

SEQ ID NO: 635399 - RNA, 19 nt, Human
acauaaaaacuccaaagaa

SEQ ID NO: 635400 - RNA, 18 nt, Human
acccugucucuaccaaaa

SEQ ID NO: 635401 - RNA, 18 nt, Human
acuccaaagaagaaaggg

SEQ ID NO: 635402 - RNA, 22 nt, Human
agacauaucaaaacacaguaua

SEQ ID NO: 635403 - RNA, 24 nt, Human
agccaagcagccacaaacccggaa

SEQ ID NO: 635404 - RNA, 22 nt, Human
agccuguugggaggcugcagug

SEQ ID NO: 635405 - RNA, 21 nt, Human
aggcugcagugagaggaccau

SEQ ID NO: 635406 - RNA, 23 nt, Human
agguggaaggauugcuugaggcc

SEQ ID NO: 635407 - RNA, 24 nt, Human
aggugugguggcugaugccuguaa

SEQ ID NO: 635408 - RNA, 22 nt, Human
aguaguuaauaguauuuaucca

SEQ ID NO: 635409 - RNA, 21 nt, Human
agucugagguggaaggauugc

SEQ ID NO: 635410 - RNA, 18 nt, Human
agugcaaaggagaguucu

SEQ ID NO: 635411 - RNA, 20 nt, Human
agugcaaaggagaguucuua

SEQ ID NO: 635412 - RNA, 18 nt, Human
agugguauaaacuccaau

SEQ ID NO: 635413 - RNA, 23 nt, Human
caagaccccaucucaaaaaaaga

SEQ ID NO: 635414 - RNA, 24 nt, Human
caaggccaggugugguggcugaug

SEQ ID NO: 635415 - RNA, 21 nt, Human
cacguguggagccaagcagcc

SEQ ID NO: 635416 - RNA, 19 nt, Human
cacuccaagaccccaucuc

SEQ ID NO: 635417 - RNA, 21 nt, Human
cacuccaagaccccaucucaa

SEQ ID NO: 635418 - RNA, 18 nt, Human
cauaaaaacuccaaagaa

SEQ ID NO: 635419 - RNA, 26 nt, Human
cauacaaagaaaaaauuccaaucacc

SEQ ID NO: 635420 - RNA, 20 nt, Human
caucacaacacccuucugca

SEQ ID NO: 635421 - RNA, 28 nt, Human
cauguauauacauuaauacauacauaua

SEQ ID NO: 635422 - RNA, 22 nt, Human
ccagccugggcgaaagagcgca

SEQ ID NO: 635423 - RNA, 21 nt, Human
ccaucucaaaaaaagaaagaa

SEQ ID NO: 635424 - RNA, 23 nt, Human
cccacguguggagccaagcagcc

SEQ ID NO: 635425 - RNA, 26 nt, Human
cccauugacaauaccccaaucagcca

SEQ ID NO: 635426 - RNA, 20 nt, Human
ccuguaaucccaaugcuuug

SEQ ID NO: 635427 - RNA, 22 nt, Human
ccuucugcaguaaugaugagag

SEQ ID NO: 635428 - RNA, 23 nt, Human
ccuucugcaguaaugaugagagu

SEQ ID NO: 635429 - RNA, 19 nt, Human
cggcggcccacguguggag

SEQ ID NO: 635430 - RNA, 19 nt, Human
cucaaaaaaagaaagaaaa

SEQ ID NO: 635431 - RNA, 20 nt, Human
cucuaccaaaaaaaaaaaac

SEQ ID NO: 635432 - RNA, 19 nt, Human
cugaucaagugcaaaggag

SEQ ID NO: 635433 - RNA, 18 nt, Human
cuuggccucugcugccac

SEQ ID NO: 635434 - RNA, 24 nt, Human
gaccauucgagcccaggaauuuga

SEQ ID NO: 635435 - RNA, 24 nt, Human
gauugcuugaggccacaaauuuga

SEQ ID NO: 635436 - RNA, 24 nt, Human
gcacuccaagaccccaucucaaaa

SEQ ID NO: 635437 - RNA, 23 nt, Human
gccacaaauuugagaccagccug

SEQ ID NO: 635438 - RNA, 20 nt, Human
gccucugcugccacucuauc

SEQ ID NO: 635439 - RNA, 27 nt, Human
gccucugcugccacucuauccuucaau

SEQ ID NO: 635440 - RNA, 19 nt, Human
gccuguaaucccaaugcuu

SEQ ID NO: 635441 - RNA, 23 nt, Human
ggccaggugugguggcugaugcc

SEQ ID NO: 635442 - RNA, 23 nt, Human
gguggcugaugccuguaauccca

SEQ ID NO: 635443 - RNA, 20 nt, Human
gucucuaccaaaaaaaaaaa

SEQ ID NO: 635444 - RNA, 18 nt, Human
guggcugcugcacaccaa

SEQ ID NO: 635445 - RNA, 19 nt, Human
uaaaaacuccaaagaagaa

SEQ ID NO: 635446 - RNA, 21 nt, Human
uaacaaauaaaaaauguucaa

SEQ ID NO: 635447 - RNA, 24 nt, Human
uaacauguugaagauuucccaggg

SEQ ID NO: 635448 - RNA, 19 nt, Human
uaaguagauccaaauuugu

SEQ ID NO: 635449 - RNA, 19 nt, Human
uaccaaaaaaaaaaaacaa

SEQ ID NO: 635450 - RNA, 26 nt, Human
uaccaaaaaaaaaaaacaacaaaaaa

SEQ ID NO: 635451 - RNA, 26 nt, Human
uaccaaaaaaaaaaaacaacaaaaaa

SEQ ID NO: 635452 - RNA, 22 nt, Human
uagaaaacuugucucacaaggg

SEQ ID NO: 635453 - RNA, 18 nt, Human
uauuaaaaagccagggcc

SEQ ID NO: 635454 - RNA, 19 nt, Human
ucaaaaaaagaaagaaaaa

SEQ ID NO: 635455 - RNA, 21 nt, Human
ucaaugcagagucugcugcag

SEQ ID NO: 635456 - RNA, 28 nt, Human
uccaagaccccaucucaaaaaaagaaag

SEQ ID NO: 635457 - RNA, 28 nt, Human
ucuaccaaaaaaaaaaaacaacaaaaaa

SEQ ID NO: 635458 - RNA, 20 nt, Human
ucucuaccaaaaaaaaaaaa

SEQ ID NO: 635459 - RNA, 18 nt, Human
ucugaagugaauauaaga

SEQ ID NO: 635460 - RNA, 19 nt, Human
ugaaaggcacagaauucau

SEQ ID NO: 635461 - RNA, 19 nt, Human
ugacaauaccccaaucagc

SEQ ID NO: 635462 - RNA, 19 nt, Human
ugacaauaccccaaucagc

SEQ ID NO: 635463 - RNA, 23 nt, Human
ugagagugggcuaggaaugugau

SEQ ID NO: 635464 - RNA, 24 nt, Human
ugagguggaaggauugcuugaggc

SEQ ID NO: 635465 - RNA, 26 nt, Human
ugagguggaaggauugcuugaggcca

SEQ ID NO: 635466 - RNA, 23 nt, Human
ugccuguaaucccaaugcuuugg

SEQ ID NO: 635467 - RNA, 18 nt, Human
ugcugaucaagugcaaag

SEQ ID NO: 635468 - RNA, 20 nt, Human
uggaaguuuucacuuucuuc

SEQ ID NO: 635469 - RNA, 21 nt, Human
uggcugaugccuguaauccca

SEQ ID NO: 635470 - RNA, 22 nt, Human
uggcugaugccuguaaucccaa

SEQ ID NO: 635471 - RNA, 24 nt, Human
ugguggcugaugccuguaauccca

SEQ ID NO: 635472 - RNA, 19 nt, Human
uguugggaggcugcaguga

SEQ ID NO: 635473 - RNA, 26 nt, Human
uuaacaaauaaaaaauguucaaggcc

SEQ ID NO: 635474 - RNA, 24 nt, Human
uuaauacauacauauauguuccaa

SEQ ID NO: 635475 - RNA, 18 nt, Human
uuagcugagugugguggu

SEQ ID NO: 635476 - RNA, 18 nt, Human
uuccaaucacccauugac

SEQ ID NO: 635477 - RNA, 24 nt, Human
aaagccccucccucuaagccgccu

SEQ ID NO: 635478 - RNA, 25 nt, Human
aaagugaaaagauaaauauuacaaa

SEQ ID NO: 635479 - RNA, 22 nt, Human
aacacugaaaaugugaaaauaa

SEQ ID NO: 635480 - RNA, 22 nt, Human
aaccaauguuuaaaacaucaaa

SEQ ID NO: 635481 - RNA, 26 nt, Human
aagagacaaccuagcuuuuauaaugu

SEQ ID NO: 635482 - RNA, 22 nt, Human
aagucacuuuuguuugcuaauu

SEQ ID NO: 635483 - RNA, 28 nt, Human
acacugaaaaugugaaaauugagggguc

SEQ ID NO: 635484 - RNA, 21 nt, Human
agccagcauuucaacucuugg

SEQ ID NO: 635485 - RNA, 18 nt, Human
agcugcaaacuauguggg

SEQ ID NO: 635486 - RNA, 19 nt, Human
agcugcaugacccugagca

SEQ ID NO: 635487 - RNA, 20 nt, Human
aggcaucagcuucacugaca

SEQ ID NO: 635488 - RNA, 20 nt, Human
auaccaugaaaaauaccaug

SEQ ID NO: 635489 - RNA, 25 nt, Human
augcaaaauaccaugaaaaauacca

SEQ ID NO: 635490 - RNA, 23 nt, Human
cacugaaaaugugaaaauaaggu

SEQ ID NO: 635491 - RNA, 26 nt, Human
cagcuucacugacaaucugguaugau

SEQ ID NO: 635492 - RNA, 22 nt, Human
cagcuugaauuaguaacuaaua

SEQ ID NO: 635493 - RNA, 20 nt, Human
caucccaaaucuaugguaug

SEQ ID NO: 635494 - RNA, 20 nt, Human
ccccucccucuaagccgccu

SEQ ID NO: 635495 - RNA, 24 nt, Human
cccguaguagcagcaguagccuuu

SEQ ID NO: 635496 - RNA, 20 nt, Human
ccuagagcugagacaguaac

SEQ ID NO: 635497 - RNA, 18 nt, Human
cgaaaaagccccucccuc

SEQ ID NO: 635498 - RNA, 28 nt, Human
cguaguagcagcaguagccuuuaggguc

SEQ ID NO: 635499 - RNA, 20 nt, Human
cuucuaucaucacccagcug

SEQ ID NO: 635500 - RNA, 20 nt, Human
gacaguaacugucuagcccc

SEQ ID NO: 635501 - RNA, 21 nt, Human
gagaaaggagagcggaaaugu

SEQ ID NO: 635502 - RNA, 25 nt, Human
ggaagaacgcacauccuagagcuga

SEQ ID NO: 635503 - RNA, 20 nt, Human
ggcgaaaaagccccucccuc

SEQ ID NO: 635504 - RNA, 20 nt, Human
uaaaaugcccucuuauucuc

SEQ ID NO: 635505 - RNA, 22 nt, Human
uaaaugacuuaaaauacaagug

SEQ ID NO: 635506 - RNA, 20 nt, Human
uagcacuguaaagugacuua

SEQ ID NO: 635507 - RNA, 20 nt, Human
uagccccguaguagcagcag

SEQ ID NO: 635508 - RNA, 21 nt, Human
uagguauaggcgaaaaagccc

SEQ ID NO: 635509 - RNA, 24 nt, Human
uauacaagcuauagcuaacaugau

SEQ ID NO: 635510 - RNA, 22 nt, Human
uauaggcgaaaaagccccuccc

SEQ ID NO: 635511 - RNA, 20 nt, Human
uaucaaagugaaaagauaaa

SEQ ID NO: 635512 - RNA, 21 nt, Human
uauguguauauacaagcuaua

SEQ ID NO: 635513 - RNA, 23 nt, Human
uauuacaaacacugaaaauguga

SEQ ID NO: 635514 - RNA, 20 nt, Human
ucaggaguaaugacaucaag

SEQ ID NO: 635515 - RNA, 19 nt, Human
ucaucuaucaccugacuuc

SEQ ID NO: 635516 - RNA, 18 nt, Human
ucccucagaagagcuucu

SEQ ID NO: 635517 - RNA, 20 nt, Human
ucugagaaacugcuucuuca

SEQ ID NO: 635518 - RNA, 19 nt, Human
ugaaaggaucccuuuaaaa

SEQ ID NO: 635519 - RNA, 19 nt, Human
ugaagccagcauuucaacu

SEQ ID NO: 635520 - RNA, 25 nt, Human
ugcaaaauaccaugaaaaauaccau

SEQ ID NO: 635521 - RNA, 19 nt, Human
uggaagaacgcacauccua

SEQ ID NO: 635522 - RNA, 19 nt, Human
uggcaaauugaucucuaug

SEQ ID NO: 635523 - RNA, 21 nt, Human
uggcaaauugaucucuaugug

SEQ ID NO: 635524 - RNA, 18 nt, Human
ugugucugagaaacugcu

SEQ ID NO: 635525 - RNA, 22 nt, Human
uuacuugcaaaaugacuaucuc

SEQ ID NO: 635526 - RNA, 18 nt, Human
uucaagagacaaccuagc

SEQ ID NO: 635527 - RNA, 21 nt, Human
uucacugacaaucugguauga

SEQ ID NO: 635528 - RNA, 19 nt, Human
uuccaccaauucuugccag

SEQ ID NO: 635529 - RNA, 21 nt, Human
uugugucugagaaacugcuuc

SEQ ID NO: 635530 - RNA, 18 nt, Human
uuuacaguaugguagucu

SEQ ID NO: 635531 - RNA, 20 nt, Human
aaaacuguuuucugggucag

SEQ ID NO: 635532 - RNA, 19 nt, Human
aaaauuccuucacucugaa

SEQ ID NO: 635533 - RNA, 25 nt, Human
aaauagccuauaauucacacaaagc

SEQ ID NO: 635534 - RNA, 21 nt, Human
agaaaaagauggcaaccagaa

SEQ ID NO: 635535 - RNA, 21 nt, Human
agaaaugcagaggaguuccac

SEQ ID NO: 635536 - RNA, 22 nt, Human
aggaagaaaugcagaggaguuc

SEQ ID NO: 635537 - RNA, 20 nt, Human
aggaguuccacagaaaaaga

SEQ ID NO: 635538 - RNA, 23 nt, Human
auucacacaaagccuaggcugga

SEQ ID NO: 635539 - RNA, 20 nt, Human
ccacagaaaaagauggcaac

SEQ ID NO: 635540 - RNA, 21 nt, Human
ccacagaaaaagauggcaacc

SEQ ID NO: 635541 - RNA, 18 nt, Human
cucaggauagagggcaaa

SEQ ID NO: 635542 - RNA, 24 nt, Human
cuuguucacauucaguaucaaaac

SEQ ID NO: 635543 - RNA, 20 nt, Human
cuuguucuuccuuuauaaga

SEQ ID NO: 635544 - RNA, 25 nt, Human
uaaaaaaggcuucauguaaaccuug

SEQ ID NO: 635545 - RNA, 26 nt, Human
uaggcuggaaaauacaagugcuuuga

SEQ ID NO: 635546 - RNA, 18 nt, Human
uaucuuguucuuccuuua

SEQ ID NO: 635547 - RNA, 22 nt, Human
ucaguuuaaacaaaaaugacaa

SEQ ID NO: 635548 - RNA, 20 nt, Human
uccacagaaaaagauggcaa

SEQ ID NO: 635549 - RNA, 22 nt, Human
uccacagaaaaagauggcaacc

SEQ ID NO: 635550 - RNA, 18 nt, Human
ugacucauuuauuaaaaa

SEQ ID NO: 635551 - RNA, 24 nt, Human
ugcagaggaguuccacagaaaaag

SEQ ID NO: 635552 - RNA, 28 nt, Human
ugcaugagaagauguccauuaguuacuc

SEQ ID NO: 635553 - RNA, 21 nt, Human
ugggucaguuuccuuagguga

SEQ ID NO: 635554 - RNA, 22 nt, Human
uguuuucugggucaguuuccuu

SEQ ID NO: 635555 - RNA, 21 nt, Human
uuacucaggauagagggcaaa

SEQ ID NO: 635556 - RNA, 23 nt, Human
uucauguaaaccuugcaugagaa

SEQ ID NO: 635557 - RNA, 22 nt, Human
uuguucacauucaguaucaaaa

SEQ ID NO: 635558 - RNA, 19 nt, Human
uuugaaguaauuacuuagg

SEQ ID NO: 635559 - RNA, 20 nt, Human
cacagcgcaugcgcgcuucc

SEQ ID NO: 635560 - RNA, 18 nt, Human
caugcgcgcuuccagccg

SEQ ID NO: 635561 - RNA, 20 nt, Human
caugcgcgcuuccagccgcg

SEQ ID NO: 635562 - RNA, 18 nt, Human
cauuagccacagcgcaug

SEQ ID NO: 635563 - RNA, 22 nt, Human
cgcaugcgcgcuuccagccgcg

SEQ ID NO: 635564 - RNA, 24 nt, Human
cuugcucucagacagcauuucugu

SEQ ID NO: 635565 - RNA, 18 nt, Human
gcaugcgcgcuuccagcc

SEQ ID NO: 635566 - RNA, 18 nt, Human
gcgcuuccagccgcgcuc

SEQ ID NO: 635567 - RNA, 23 nt, Human
gucgaauugucgguggggaucag

SEQ ID NO: 635568 - RNA, 24 nt, Human
uacaauaguaaagcagcagaguac

SEQ ID NO: 635569 - RNA, 23 nt, Human
uccaauauauucuugcucucaga

SEQ ID NO: 635570 - RNA, 21 nt, Human
ucuugguauucuuuuuucagu

SEQ ID NO: 635571 - RNA, 24 nt, Human
uguguggggucgaauugucggugg

SEQ ID NO: 635572 - RNA, 23 nt, Human
uguucuuuaaucuugcugcuuag

SEQ ID NO: 635573 - RNA, 20 nt, Human
uuagauccuccuuguguggg

SEQ ID NO: 635574 - RNA, 23 nt, Human
uugucgguggggaucagcacaga

SEQ ID NO: 635575 - RNA, 23 nt, Human
uuuucaguucauccaauauauuc

SEQ ID NO: 635576 - RNA, 24 nt, Human
aguccugaagugugacaacaugcu

SEQ ID NO: 635577 - RNA, 22 nt, Human
cacaauccuacuuagcaauacc

SEQ ID NO: 635578 - RNA, 20 nt, Human
cugcgcaugcacguuuuaua

SEQ ID NO: 635579 - RNA, 28 nt, Human
uaaaaaaggcuauauagcauccuggugg

SEQ ID NO: 635580 - RNA, 18 nt, Human
uauaaaaaaggcuauaua

SEQ ID NO: 635581 - RNA, 20 nt, Human
ucaaucggauuggcacaguc

SEQ ID NO: 635582 - RNA, 21 nt, Human
ugaaacaccgcugccgggggc

SEQ ID NO: 635583 - RNA, 22 nt, Human
aaaaauacaaacguguacacua

SEQ ID NO: 635584 - RNA, 24 nt, Human
aaaagcugaucaaacauguccaca

SEQ ID NO: 635585 - RNA, 20 nt, Human
aacuuggccacauucucccc

SEQ ID NO: 635586 - RNA, 25 nt, Human
aaggcagaaguccagcagcaggaga

SEQ ID NO: 635587 - RNA, 24 nt, Human
agccagcgaacagcagauacaacc

SEQ ID NO: 635588 - RNA, 24 nt, Human
agcggcuauauuaacaaaaauaca

SEQ ID NO: 635589 - RNA, 21 nt, Human
aggaauguucauuuuucucug

SEQ ID NO: 635590 - RNA, 18 nt, Human
aggcagaaguccagcagc

SEQ ID NO: 635591 - RNA, 18 nt, Human
aggcagaaguccagcagc

SEQ ID NO: 635592 - RNA, 22 nt, Human
aggcagaaguccagcagcagga

SEQ ID NO: 635593 - RNA, 20 nt, Human
agugguuccugcuugcaaaa

SEQ ID NO: 635594 - RNA, 19 nt, Human
auccugaugacaagagcca

SEQ ID NO: 635595 - RNA, 20 nt, Human
caaaaauacaaacguguaca

SEQ ID NO: 635596 - RNA, 25 nt, Human
caaaguacucaggcauuaaacacgg

SEQ ID NO: 635597 - RNA, 19 nt, Human
caaauucaccaaaucugua

SEQ ID NO: 635598 - RNA, 23 nt, Human
caagagccauggaccucaccaug

SEQ ID NO: 635599 - RNA, 19 nt, Human
caaugcauuaaauguguau

SEQ ID NO: 635600 - RNA, 19 nt, Human
cacaaacccgcccgccgac

SEQ ID NO: 635601 - RNA, 22 nt, Human
cacaaacccgcccgccgacccg

SEQ ID NO: 635602 - RNA, 24 nt, Human
caccauaguaacacaauaaaucca

SEQ ID NO: 635603 - RNA, 22 nt, Human
cagauacaaccgccaucccucg

SEQ ID NO: 635604 - RNA, 24 nt, Human
cagcacaucaggccaacaaaggca

SEQ ID NO: 635605 - RNA, 19 nt, Human
cagcagcaggagagggcaa

SEQ ID NO: 635606 - RNA, 18 nt, Human
cagcaucgugaggucagc

SEQ ID NO: 635607 - RNA, 24 nt, Human
caucaggccaacaaaggcagaagu

SEQ ID NO: 635608 - RNA, 26 nt, Human
cauuccuaagaugcguuauuucugac

SEQ ID NO: 635609 - RNA, 21 nt, Human
ccaaccccaacuguguuagaa

SEQ ID NO: 635610 - RNA, 21 nt, Human
ccagaauaaaaucugcagcug

SEQ ID NO: 635611 - RNA, 18 nt, Human
ccagccagcgaacagcag

SEQ ID NO: 635612 - RNA, 21 nt, Human
cccgccgacccgucagcggcu

SEQ ID NO: 635613 - RNA, 27 nt, Human
cuaccagaauaaaaucugcagcugcgu

SEQ ID NO: 635614 - RNA, 21 nt, Human
cuauauuaacaaaaauacaaa

SEQ ID NO: 635615 - RNA, 24 nt, Human
cuauugacccaaccccaacugugu

SEQ ID NO: 635616 - RNA, 19 nt, Human
cucacaguaacaaauucac

SEQ ID NO: 635617 - RNA, 20 nt, Human
cugaaaaccgcaauguugcu

SEQ ID NO: 635618 - RNA, 21 nt, Human
cuggccaagccugcugcggag

SEQ ID NO: 635619 - RNA, 18 nt, Human
cuucaccauuccucggau

SEQ ID NO: 635620 - RNA, 22 nt, Human
gauuccaaagaugaugcuggca

SEQ ID NO: 635621 - RNA, 19 nt, Human
gcacuaccagaauaaaauc

SEQ ID NO: 635622 - RNA, 28 nt, Human
gccacauucuccccggauuucuuugccc

SEQ ID NO: 635623 - RNA, 31 nt, Human
uaacaaaaauacaaacguguacacuaauuag

SEQ ID NO: 635624 - RNA, 21 nt, Human
uaagaugaaggaccagcauca

SEQ ID NO: 635625 - RNA, 20 nt, Human
uaauaaacuuggccacauuc

SEQ ID NO: 635626 - RNA, 21 nt, Human
uaccucacaguaacaaauuca

SEQ ID NO: 635627 - RNA, 20 nt, Human
uacuacuucuucaaucccug

SEQ ID NO: 635628 - RNA, 22 nt, Human
uacuacuucuucaaucccuguu

SEQ ID NO: 635629 - RNA, 21 nt, Human
uagaugucucaucauuuuccu

SEQ ID NO: 635630 - RNA, 23 nt, Human
uaucccaaguuuucuuuuuugga

SEQ ID NO: 635631 - RNA, 25 nt, Human
uauggcagcggcuauauuaacaaaa

SEQ ID NO: 635632 - RNA, 26 nt, Human
ucacacaaacccgcccgccgacccgu

SEQ ID NO: 635633 - RNA, 24 nt, Human
ucucaggugugauuccagcagcua

SEQ ID NO: 635634 - RNA, 20 nt, Human
ucugaaaauauuugggguau

SEQ ID NO: 635635 - RNA, 19 nt, Human
ucugagguucaaaguacuc

SEQ ID NO: 635636 - RNA, 21 nt, Human
ucuguaucuuuucuucuuugu

SEQ ID NO: 635637 - RNA, 20 nt, Human
ugacaagagccauggaccuc

SEQ ID NO: 635638 - RNA, 22 nt, Human
ugacaagagccauggaccucac

SEQ ID NO: 635639 - RNA, 22 nt, Human
ugacuguaccucacaguaacug

SEQ ID NO: 635640 - RNA, 22 nt, Human
ugagaccauugcugcuccugaa

SEQ ID NO: 635641 - RNA, 23 nt, Human
ugaggucagcucaccgacacucc

SEQ ID NO: 635642 - RNA, 21 nt, Human
ugagguucaaaguacucaggc

SEQ ID NO: 635643 - RNA, 21 nt, Human
ugaugacaagagccauggacc

SEQ ID NO: 635644 - RNA, 21 nt, Human
uggcauuagagaaaagauucu

SEQ ID NO: 635645 - RNA, 30 nt, Human
uggccacauucuccccggauuucuuugccc

SEQ ID NO: 635646 - RNA, 19 nt, Human
ugggaaacuauugacccaa

SEQ ID NO: 635647 - RNA, 23 nt, Human
ugucucaucauuuuccucuucca

SEQ ID NO: 635648 - RNA, 21 nt, Human
ugugguaucccuguuuacugu

SEQ ID NO: 635649 - RNA, 21 nt, Human
uguguuagaacugcaugaaca

SEQ ID NO: 635650 - RNA, 20 nt, Human
uucaaucaaugcauuaaaug

SEQ ID NO: 635651 - RNA, 23 nt, Human
uucguuccuucagggcggcuuca

SEQ ID NO: 635652 - RNA, 18 nt, Human
uucugacuguccaguuug

SEQ ID NO: 635653 - RNA, 22 nt, Human
uuuaucccaaguuuucuuuuuu

SEQ ID NO: 635654 - RNA, 28 nt, Human
uuuuaccaguugugcagccuaaacugcc

SEQ ID NO: 635655 - RNA, 21 nt, Human
uuuuuuuuuuuuuuuuuggcu

SEQ ID NO: 635656 - RNA, 22 nt, Human
uuuuuuuuuuuuuuuuuuuggc

SEQ ID NO: 635657 - RNA, 28 nt, Human
uuuuuuuuuuuuuuuuuuuuuuuggggg

SEQ ID NO: 635658 - RNA, 18 nt, Human
aaaacaaacaaugaaugu

SEQ ID NO: 635659 - RNA, 22 nt, Human
aaacaaugucgaucaaggucuu

SEQ ID NO: 635660 - RNA, 19 nt, Human
cgucggacuuugacagcug

SEQ ID NO: 635661 - RNA, 25 nt, Human
ugacaguaccacgucggacuuugac

SEQ ID NO: 635662 - RNA, 19 nt, Human
uggccaaaacaaacaauga

SEQ ID NO: 635663 - RNA, 20 nt, Human
uuuuuuuuuuuuaaagaaau

SEQ ID NO: 635664 - RNA, 19 nt, Human
uuuuuuuuuuuuuuuuuaa

SEQ ID NO: 635665 - RNA, 24 nt, Human
aaauaacgaaacccgaggccaaaa

SEQ ID NO: 635666 - RNA, 19 nt, Human
aaccacagaagccuccuca

SEQ ID NO: 635667 - RNA, 19 nt, Human
aaccuggacugaacugaua

SEQ ID NO: 635668 - RNA, 21 nt, Human
aaccuggacugaacugauaca

SEQ ID NO: 635669 - RNA, 19 nt, Human
acgaaacccgaggccaaaa

SEQ ID NO: 635670 - RNA, 25 nt, Human
acgaaacccgaggccaaaacauacu

SEQ ID NO: 635671 - RNA, 18 nt, Human
auaacgaaacccgaggcc

SEQ ID NO: 635672 - RNA, 22 nt, Human
caccucagaccuggacaaccac

SEQ ID NO: 635673 - RNA, 19 nt, Human
cauuaccaccauccgaguc

SEQ ID NO: 635674 - RNA, 24 nt, Human
cauuucaaugggccaugcugcuuc

SEQ ID NO: 635675 - RNA, 19 nt, Human
ccaaaacauacugaaacuu

SEQ ID NO: 635676 - RNA, 19 nt, Human
ccacucgcacguggauccc

SEQ ID NO: 635677 - RNA, 21 nt, Human
ccacucgcacguggaucccau

SEQ ID NO: 635678 - RNA, 21 nt, Human
ccauuaccaccauccgagucc

SEQ ID NO: 635679 - RNA, 22 nt, Human
cccauuaccaccauccgagucc

SEQ ID NO: 635680 - RNA, 24 nt, Human
cccgaggccaaaacauacugaaac

SEQ ID NO: 635681 - RNA, 24 nt, Human
ccucccauuaccaccauccgaguc

SEQ ID NO: 635682 - RNA, 23 nt, Human
cgcacguggaucccauguguccc

SEQ ID NO: 635683 - RNA, 20 nt, Human
cguggaucccauguguccca

SEQ ID NO: 635684 - RNA, 23 nt, Human
cuaccucccauuaccaccauccg

SEQ ID NO: 635685 - RNA, 25 nt, Human
cucagaccuggacaaccacagaagc

SEQ ID NO: 635686 - RNA, 18 nt, Human
cugaaacuucaauuccag

SEQ ID NO: 635687 - RNA, 24 nt, Human
cugaggucagaauuuggaauucau

SEQ ID NO: 635688 - RNA, 24 nt, Human
cugaucaccaggggacaaaaggga

SEQ ID NO: 635689 - RNA, 20 nt, Human
gccagagcaauuuggaaaaa

SEQ ID NO: 635690 - RNA, 19 nt, Human
ggacaaaagggaugacaac

SEQ ID NO: 635691 - RNA, 24 nt, Human
uaaauaagguagccugcagcucac

SEQ ID NO: 635692 - RNA, 22 nt, Human
uaacgaaacccgaggccaaaac

SEQ ID NO: 635693 - RNA, 19 nt, Human
uagagccugcuuucagggc

SEQ ID NO: 635694 - RNA, 26 nt, Human
ucaauuccagaacugaggucagaauu

SEQ ID NO: 635695 - RNA, 23 nt, Human
ucaccaggcugacuaaauucccg

SEQ ID NO: 635696 - RNA, 18 nt, Human
ucaccaggggacaaaagg

SEQ ID NO: 635697 - RNA, 20 nt, Human
ucagagucggcucaccaggc

SEQ ID NO: 635698 - RNA, 22 nt, Human
uccaucuuggcccuccuucagu

SEQ ID NO: 635699 - RNA, 20 nt, Human
uccucacuggucucucuguu

SEQ ID NO: 635700 - RNA, 24 nt, Human
uggaaaaagcacugugucuuucac

SEQ ID NO: 635701 - RNA, 24 nt, Human
uguuuccaucuuggcccuccuuca

SEQ ID NO: 635702 - RNA, 22 nt, Human
uuaccaccauccgaguccaagu

SEQ ID NO: 635703 - RNA, 24 nt, Human
uuauuuaucauaucaaucuaccuc

SEQ ID NO: 635704 - RNA, 22 nt, Human
uucauaauugcacagaugagcc

SEQ ID NO: 635705 - RNA, 18 nt, Human
uugcacagaugagccuca

SEQ ID NO: 635706 - RNA, 18 nt, Human
uuuuuuuuuuuuuuuuug

SEQ ID NO: 635707 - RNA, 24 nt, Human
uuuuuuuuuuuuuuuuuuuuuggg

SEQ ID NO: 635708 - RNA, 23 nt, Human
aaaaacuuuugucacaaacagaa

SEQ ID NO: 635709 - RNA, 19 nt, Human
aaacgcaaagaagcuguag

SEQ ID NO: 635710 - RNA, 24 nt, Human
aaagugcugggauuacaggcguga

SEQ ID NO: 635711 - RNA, 19 nt, Human
aaguaccugggagcuuacc

SEQ ID NO: 635712 - RNA, 19 nt, Human
aagugcugggauuacaggc

SEQ ID NO: 635713 - RNA, 19 nt, Human
aagugcugggauuacaggc

SEQ ID NO: 635714 - RNA, 26 nt, Human
aagugcugggauuacaggcgugagcc

SEQ ID NO: 635715 - RNA, 20 nt, Human
acaaacagaaaugcccugca

SEQ ID NO: 635716 - RNA, 18 nt, Human
acucugucacccaggcug

SEQ ID NO: 635717 - RNA, 25 nt, Human
acucugucacccaggcugaagugca

SEQ ID NO: 635718 - RNA, 20 nt, Human
acugcaagcuccgccuccug

SEQ ID NO: 635719 - RNA, 23 nt, Human
agaagcuaugcacaucaagaccu

SEQ ID NO: 635720 - RNA, 19 nt, Human
agagaugggguuucaccgu

SEQ ID NO: 635721 - RNA, 20 nt, Human
agagggcaggacgggggcuc

SEQ ID NO: 635722 - RNA, 18 nt, Human
agcuccgccuccuggguu

SEQ ID NO: 635723 - RNA, 24 nt, Human
agcuccgccuccuggguucacacu

SEQ ID NO: 635724 - RNA, 23 nt, Human
agugcaguggcacuaucuuggcu

SEQ ID NO: 635725 - RNA, 24 nt, Human
agugcaguggcacuaucuuggcuc

SEQ ID NO: 635726 - RNA, 18 nt, Human
augggguuucaccguguu

SEQ ID NO: 635727 - RNA, 20 nt, Human
auuaaagcccucaaacucuc

SEQ ID NO: 635728 - RNA, 21 nt, Human
auucuccugccucagccuccc

SEQ ID NO: 635729 - RNA, 19 nt, Human
caaaacagguaugcucaaa

SEQ ID NO: 635730 - RNA, 21 nt, Human
caaaacagguaugcucaaaua

SEQ ID NO: 635731 - RNA, 23 nt, Human
caaaauagcacaguucaaacccc

SEQ ID NO: 635732 - RNA, 21 nt, Human
caaagugcugggauuacaggc

SEQ ID NO: 635733 - RNA, 24 nt, Human
caaagugcugggauuacaggcgug

SEQ ID NO: 635734 - RNA, 20 nt, Human
cacaacuccuaaaguaacau

SEQ ID NO: 635735 - RNA, 22 nt, Human
cacacuauucuccugccucagc

SEQ ID NO: 635736 - RNA, 24 nt, Human
cacaggcgccugccaccacgccca

SEQ ID NO: 635737 - RNA, 18 nt, Human
caccaagacgccacggcg

SEQ ID NO: 635738 - RNA, 23 nt, Human
cacccaggcugaagugcaguggc

SEQ ID NO: 635739 - RNA, 18 nt, Human
caccguguuagccaggau

SEQ ID NO: 635740 - RNA, 24 nt, Human
caccguguuagccaggauggucuc

SEQ ID NO: 635741 - RNA, 23 nt, Human
cacucugucacccaggcugaagu

SEQ ID NO: 635742 - RNA, 24 nt, Human
cacucugucacccaggcugaagug

SEQ ID NO: 635743 - RNA, 19 nt, Human
cagauuucugaagcaugau

SEQ ID NO: 635744 - RNA, 22 nt, Human
cagcagcagcagcuagggucag

SEQ ID NO: 635745 - RNA, 21 nt, Human
caggcgccugccaccacgccc

SEQ ID NO: 635746 - RNA, 20 nt, Human
ccaccacgcccagcuaauuu

SEQ ID NO: 635747 - RNA, 20 nt, Human
ccccagagggcaggacgggg

SEQ ID NO: 635748 - RNA, 22 nt, Human
cccuuaagcacuacaccuaacu

SEQ ID NO: 635749 - RNA, 21 nt, Human
ccucgccugcucgccugcaac

SEQ ID NO: 635750 - RNA, 23 nt, Human
ccugccucagccucccgaguagc

SEQ ID NO: 635751 - RNA, 19 nt, Human
cgccuccuggguucacacu

SEQ ID NO: 635752 - RNA, 24 nt, Human
cucagccucccgaguagcugggac

SEQ ID NO: 635753 - RNA, 24 nt, Human
cucccgaguagcugggaccacagg

SEQ ID NO: 635754 - RNA, 24 nt, Human
cuccugaccucgugauccgcccgc

SEQ ID NO: 635755 - RNA, 21 nt, Human
cuccuggguucacacuauucu

SEQ ID NO: 635756 - RNA, 23 nt, Human
cugccucagccucccgaguagcu

SEQ ID NO: 635757 - RNA, 21 nt, Human
cuggcauaacaugaaaauaaa

SEQ ID NO: 635758 - RNA, 22 nt, Human
gaccucgugauccgcccgccuc

SEQ ID NO: 635759 - RNA, 22 nt, Human
gaccucgugauccgcccgccuc

SEQ ID NO: 635760 - RNA, 24 nt, Human
gaccucgugauccgcccgccucgg

SEQ ID NO: 635761 - RNA, 22 nt, Human
gagaacaccaagacgccacggc

SEQ ID NO: 635762 - RNA, 24 nt, Human
gagaugggguuucaccguguuagc

SEQ ID NO: 635763 - RNA, 26 nt, Human
gaguagcugggaccacaggcgccugc

SEQ ID NO: 635764 - RNA, 26 nt, Human
gagucaacauuugaacaaaauagcac

SEQ ID NO: 635765 - RNA, 18 nt, Human
gauuacaggcgugagcca

SEQ ID NO: 635766 - RNA, 22 nt, Human
gauuacaggcgugagccaccgc

SEQ ID NO: 635767 - RNA, 22 nt, Human
gauuacaggcgugagccaccgc

SEQ ID NO: 635768 - RNA, 19 nt, Human
gcagcagcagcagcuaggg

SEQ ID NO: 635769 - RNA, 23 nt, Human
gcccagcuaauuuuuuguauuuu

SEQ ID NO: 635770 - RNA, 25 nt, Human
gccuccuggguucacacuauucucc

SEQ ID NO: 635771 - RNA, 20 nt, Human
gcugaagugcaguggcacua

SEQ ID NO: 635772 - RNA, 21 nt, Human
ggagccccagagggcaggacg

SEQ ID NO: 635773 - RNA, 18 nt, Human
ggccuguggagccccaga

SEQ ID NO: 635774 - RNA, 21 nt, Human
ggccuugccaggggccugugg

SEQ ID NO: 635775 - RNA, 18 nt, Human
gggguuucaccguguuag

SEQ ID NO: 635776 - RNA, 22 nt, Human
gggguuucaccguguuagccag

SEQ ID NO: 635777 - RNA, 20 nt, Human
ggucucgaucuccugaccuc

SEQ ID NO: 635778 - RNA, 22 nt, Human
gugauccgcccgccucggucuc

SEQ ID NO: 635779 - RNA, 24 nt, Human
gugcaguggcacuaucuuggcuca

SEQ ID NO: 635780 - RNA, 19 nt, Human
guucaaaggcgggcugugc

SEQ ID NO: 635781 - RNA, 18 nt, Human
uaaagcccucaaacucuc

SEQ ID NO: 635782 - RNA, 19 nt, Human
uaaagugagcagcagcagc

SEQ ID NO: 635783 - RNA, 24 nt, Human
uaacaugaaaauaaauuaacccuu

SEQ ID NO: 635784 - RNA, 20 nt, Human
uaacccuuaagcacuacacc

SEQ ID NO: 635785 - RNA, 22 nt, Human
uaacucuaaaaagaaaaugccu

SEQ ID NO: 635786 - RNA, 24 nt, Human
uaauuuuuuguauuuuuaguagag

SEQ ID NO: 635787 - RNA, 25 nt, Human
uaauuuuuuguauuuuuaguagaga

SEQ ID NO: 635788 - RNA, 24 nt, Human
uacaggcgugagccaccgcgccca

SEQ ID NO: 635789 - RNA, 24 nt, Human
uaccaaagccauacaagaauaaag

SEQ ID NO: 635790 - RNA, 22 nt, Human
uaccaacccacaacuccuaaag

SEQ ID NO: 635791 - RNA, 19 nt, Human
uagcacaguucaaacccuu

SEQ ID NO: 635792 - RNA, 21 nt, Human
uaguagagaugggguuucacc

SEQ ID NO: 635793 - RNA, 24 nt, Human
uaguagagaugggguuucaccgug

SEQ ID NO: 635794 - RNA, 26 nt, Human
uaguagagaugggguuucaccguguu

SEQ ID NO: 635795 - RNA, 22 nt, Human
uaugacaucacuacuuucaaag

SEQ ID NO: 635796 - RNA, 19 nt, Human
uauucuccugccucagccu

SEQ ID NO: 635797 - RNA, 20 nt, Human
ucaaaggcgggcugugcccc

SEQ ID NO: 635798 - RNA, 22 nt, Human
ucaaagugcugggauuacaggc

SEQ ID NO: 635799 - RNA, 24 nt, Human
ucaaagugcugggauuacaggcgu

SEQ ID NO: 635800 - RNA, 19 nt, Human
ucacaccauagccucggga

SEQ ID NO: 635801 - RNA, 21 nt, Human
ucacacuauucuccugccuca

SEQ ID NO: 635802 - RNA, 24 nt, Human
ucaccguguuagccaggauggucu

SEQ ID NO: 635803 - RNA, 18 nt, Human
ucacugcaagcuccgccu

SEQ ID NO: 635804 - RNA, 23 nt, Human
ucacugcaagcuccgccuccugg

SEQ ID NO: 635805 - RNA, 24 nt, Human
ucacugcaagcuccgccuccuggg

SEQ ID NO: 635806 - RNA, 23 nt, Human
ucagccucccgaguagcugggac

SEQ ID NO: 635807 - RNA, 24 nt, Human
ucccgaguagcugggaccacaggc

SEQ ID NO: 635808 - RNA, 29 nt, Human
uccgcccgccucggucucucaaagugcug

SEQ ID NO: 635809 - RNA, 24 nt, Human
uccuggguucacacuauucuccug

SEQ ID NO: 635810 - RNA, 24 nt, Human
ucucaaagugcugggauuacaggc

SEQ ID NO: 635811 - RNA, 19 nt, Human
ucucacucugucacccagg

SEQ ID NO: 635812 - RNA, 24 nt, Human
ucucacucugucacccaggcugaa

SEQ ID NO: 635813 - RNA, 26 nt, Human
ucucacucugucacccaggcugaagu

SEQ ID NO: 635814 - RNA, 27 nt, Human
ucucacucugucacccaggcugaagug

SEQ ID NO: 635815 - RNA, 24 nt, Human
ucuccugccucagccucccgagua

SEQ ID NO: 635816 - RNA, 24 nt, Human
ucugucacccaggcugaagugcag

SEQ ID NO: 635817 - RNA, 21 nt, Human
ugaaaauaaauuaacccuuaa

SEQ ID NO: 635818 - RNA, 24 nt, Human
ugaagugcaguggcacuaucuugg

SEQ ID NO: 635819 - RNA, 18 nt, Human
ugagacagagucucacuc

SEQ ID NO: 635820 - RNA, 22 nt, Human
ugagacagagucucacucuguc

SEQ ID NO: 635821 - RNA, 23 nt, Human
ugagaguugcacaagaacagucu

SEQ ID NO: 635822 - RNA, 22 nt, Human
ugcaguggcacuaucuuggcuc

SEQ ID NO: 635823 - RNA, 24 nt, Human
ugccucagccucccgaguagcugg

SEQ ID NO: 635824 - RNA, 24 nt, Human
ugcugggauuacaggcgugagcca

SEQ ID NO: 635825 - RNA, 20 nt, Human
uggaaugagccagugccccc

SEQ ID NO: 635826 - RNA, 21 nt, Human
uggagaacaccaagacgccac

SEQ ID NO: 635827 - RNA, 18 nt, Human
uggcucacugcaagcucc

SEQ ID NO: 635828 - RNA, 21 nt, Human
ugggaccacaggcgccugcca

SEQ ID NO: 635829 - RNA, 24 nt, Human
ugggaccacaggcgccugccacca

SEQ ID NO: 635830 - RNA, 18 nt, Human
ugggauuacaggcgugag

SEQ ID NO: 635831 - RNA, 19 nt, Human
ugggauuacaggcgugagc

SEQ ID NO: 635832 - RNA, 21 nt, Human
ugggauuacaggcgugagcca

SEQ ID NO: 635833 - RNA, 22 nt, Human
ugggauuacaggcgugagccac

SEQ ID NO: 635834 - RNA, 23 nt, Human
ugggauuacaggcgugagccacc

SEQ ID NO: 635835 - RNA, 24 nt, Human
ugggauuacaggcgugagccaccg

SEQ ID NO: 635836 - RNA, 24 nt, Human
ugggguuucaccguguuagccagg

SEQ ID NO: 635837 - RNA, 21 nt, Human
uguauuuuuaguagagauggg

SEQ ID NO: 635838 - RNA, 20 nt, Human
uuaaaggauuaaagcccuca

SEQ ID NO: 635839 - RNA, 18 nt, Human
uuaguagagaugggguuu

SEQ ID NO: 635840 - RNA, 22 nt, Human
uuaguagagaugggguuucacc

SEQ ID NO: 635841 - RNA, 24 nt, Human
uuaguagagaugggguuucaccgu

SEQ ID NO: 635842 - RNA, 22 nt, Human
uucaaaacagguaugcucaaau

SEQ ID NO: 635843 - RNA, 19 nt, Human
uucaaacccuucucugugg

SEQ ID NO: 635844 - RNA, 21 nt, Human
uuggaaugagccagugccccc

SEQ ID NO: 635845 - RNA, 23 nt, Human
uuguauuuuuaguagagaugggg

SEQ ID NO: 635846 - RNA, 19 nt, Human
uuucaccguguuagccagg

SEQ ID NO: 635847 - RNA, 23 nt, Human
uuugucacaaacagaaaugcccu

SEQ ID NO: 635848 - RNA, 24 nt, Human
uuuuuaguagagaugggguuucac

SEQ ID NO: 635849 - RNA, 21 nt, Human
uuuuuguauuuuuaguagaga

SEQ ID NO: 635850 - RNA, 24 nt, Human
uuuuuuguauuuuuaguagagaug

SEQ ID NO: 635851 - RNA, 20 nt, Human
uuuuuuuuuuugagacagag

SEQ ID NO: 635852 - RNA, 26 nt, Human
uuuuuuuuuuuugagacagagucuca

SEQ ID NO: 635853 - RNA, 18 nt, Human
uuuuuuuuuuuuuuuuug

SEQ ID NO: 635854 - RNA, 22 nt, Human
aaaaaccucuauagauuagucc

SEQ ID NO: 635855 - RNA, 22 nt, Human
aaaaaggucccaaagcaaaaca

SEQ ID NO: 635856 - RNA, 24 nt, Human
aaacaucucccaaaguagagaaaa

SEQ ID NO: 635857 - RNA, 18 nt, Human
aaacuguucaucucuuug

SEQ ID NO: 635858 - RNA, 21 nt, Human
aaauauguaaaugacuaauua

SEQ ID NO: 635859 - RNA, 21 nt, Human
aaaugucaagccuaaucccac

SEQ ID NO: 635860 - RNA, 19 nt, Human
aacaucacagaauauaaac

SEQ ID NO: 635861 - RNA, 21 nt, Human
aagagaaggcaaaaauuccaa

SEQ ID NO: 635862 - RNA, 26 nt, Human
aaggucccaaagcaaaacacacacaa

SEQ ID NO: 635863 - RNA, 20 nt, Human
aaugauaccuauguucuucc

SEQ ID NO: 635864 - RNA, 23 nt, Human
acacacacaaaaagucacuaaca

SEQ ID NO: 635865 - RNA, 19 nt, Human
acacaccagaaacauaaaa

SEQ ID NO: 635866 - RNA, 22 nt, Human
acacaccagaaacauaaaaaua

SEQ ID NO: 635867 - RNA, 20 nt, Human
acacugagcuuuacucuuuu

SEQ ID NO: 635868 - RNA, 20 nt, Human
accaaaauaaaaagguccca

SEQ ID NO: 635869 - RNA, 19 nt, Human
accauaaaguucacacacc

SEQ ID NO: 635870 - RNA, 23 nt, Human
acuaugcuauauaaaaccacauu

SEQ ID NO: 635871 - RNA, 21 nt, Human
agaaaauuauuuuuugcccac

SEQ ID NO: 635872 - RNA, 23 nt, Human
agaaagaaaaugaaaauucuagg

SEQ ID NO: 635873 - RNA, 24 nt, Human
agacacugggguccgccgccugcc

SEQ ID NO: 635874 - RNA, 19 nt, Human
agaugugucaauaaacugu

SEQ ID NO: 635875 - RNA, 23 nt, Human
agcaccaaauucugcaaaagcaa

SEQ ID NO: 635876 - RNA, 21 nt, Human
aguaguuccugaauuuuggac

SEQ ID NO: 635877 - RNA, 19 nt, Human
auaaggcaaacaguacaaa

SEQ ID NO: 635878 - RNA, 22 nt, Human
auaccacuuuucaaaaagcaga

SEQ ID NO: 635879 - RNA, 20 nt, Human
augaagcaaugaugaaaaua

SEQ ID NO: 635880 - RNA, 25 nt, Human
caaacacuaagaauagguauuuaau

SEQ ID NO: 635881 - RNA, 19 nt, Human
caaccuacaaugacugaug

SEQ ID NO: 635882 - RNA, 22 nt, Human
caagacaaaaauauguaaauga

SEQ ID NO: 635883 - RNA, 21 nt, Human
caccaaauucugcaaaagcaa

SEQ ID NO: 635884 - RNA, 19 nt, Human
cacggaaugaaacuaacau

SEQ ID NO: 635885 - RNA, 23 nt, Human
cagaacuaagacaauggagaagg

SEQ ID NO: 635886 - RNA, 18 nt, Human
cagcauacgagcaaacaa

SEQ ID NO: 635887 - RNA, 29 nt, Human
caguugauauuagcaaaauacgaauaacc

SEQ ID NO: 635888 - RNA, 22 nt, Human
cauauuuguuucauuuccaaaa

SEQ ID NO: 635889 - RNA, 24 nt, Human
caucacagaauauaaacgaagauc

SEQ ID NO: 635890 - RNA, 20 nt, Human
cccaaagcaaaacacacaca

SEQ ID NO: 635891 - RNA, 30 nt, Human
cccaaagcaaaacacacacaaaaagucacc

SEQ ID NO: 635892 - RNA, 20 nt, Human
cccaaaguagagaaaaaaac

SEQ ID NO: 635893 - RNA, 22 nt, Human
ccuuccuucaaucccccagaua

SEQ ID NO: 635894 - RNA, 23 nt, Human
cgcccggaaagggaaacggagcc

SEQ ID NO: 635895 - RNA, 22 nt, Human
cgucaguguccagaccaugaau

SEQ ID NO: 635896 - RNA, 21 nt, Human
cucccaaaguagagaaaaaaa

SEQ ID NO: 635897 - RNA, 22 nt, Human
cucccaaaguagagaaaaaaac

SEQ ID NO: 635898 - RNA, 20 nt, Human
cugcaauuaaaagagaaggc

SEQ ID NO: 635899 - RNA, 20 nt, Human
cugggguccgccgccugccc

SEQ ID NO: 635900 - RNA, 22 nt, Human
cuuaaauauugucugagcacca

SEQ ID NO: 635901 - RNA, 19 nt, Human
cuuguccaaaauauaugag

SEQ ID NO: 635902 - RNA, 23 nt, Human
gaauauaaggcaaacaguacaaa

SEQ ID NO: 635903 - RNA, 20 nt, Human
gaauuagaaugauaccuaug

SEQ ID NO: 635904 - RNA, 21 nt, Human
gacuuuuuuuccccauuaucu

SEQ ID NO: 635905 - RNA, 19 nt, Human
gagaaaaaaacaaaauuuu

SEQ ID NO: 635906 - RNA, 21 nt, Human
gagacccuucccaaccuacaa

SEQ ID NO: 635907 - RNA, 19 nt, Human
gaucaugauuaaaugucua

SEQ ID NO: 635908 - RNA, 19 nt, Human
gaugacuaaaucccuaaac

SEQ ID NO: 635909 - RNA, 20 nt, Human
gcccggaaagggaaacggag

SEQ ID NO: 635910 - RNA, 21 nt, Human
gcugaaaccucuacucaguaa

SEQ ID NO: 635911 - RNA, 25 nt, Human
ggaaaauuacucaaugaauaaccac

SEQ ID NO: 635912 - RNA, 28 nt, Human
ggaaagaauuccuguauuaguuuauaga

SEQ ID NO: 635913 - RNA, 22 nt, Human
guacugcuaauucaccugcuca

SEQ ID NO: 635914 - RNA, 25 nt, Human
gucacuaacaauauccacuaaacaa

SEQ ID NO: 635915 - RNA, 25 nt, Human
uaaaaauuauucacuuacaaaccac

SEQ ID NO: 635916 - RNA, 20 nt, Human
uaaaauagaaauaaaauacu

SEQ ID NO: 635917 - RNA, 21 nt, Human
uaaacgaagaucauauuuugu

SEQ ID NO: 635918 - RNA, 21 nt, Human
uaaagacacugggguccgccg

SEQ ID NO: 635919 - RNA, 21 nt, Human
uaaaguucacacaccagaaac

SEQ ID NO: 635920 - RNA, 23 nt, Human
uaaauccuguuuauuuugcgaaa

SEQ ID NO: 635921 - RNA, 18 nt, Human
uaacagagacccuuccca

SEQ ID NO: 635922 - RNA, 20 nt, Human
uaaccucauaaucuugauac

SEQ ID NO: 635923 - RNA, 23 nt, Human
uaagagaucugucuuuauaugga

SEQ ID NO: 635924 - RNA, 20 nt, Human
uaaugcauaaggaguguugg

SEQ ID NO: 635925 - RNA, 20 nt, Human
uacaagaagaaauaaaaauu

SEQ ID NO: 635926 - RNA, 24 nt, Human
uacaagaagaaauaaaaauuauuc

SEQ ID NO: 635927 - RNA, 18 nt, Human
uaccaggaagcaacuaug

SEQ ID NO: 635928 - RNA, 19 nt, Human
uaccauaaaguucacacac

SEQ ID NO: 635929 - RNA, 24 nt, Human
uaccauggaauuagaaugauaccu

SEQ ID NO: 635930 - RNA, 19 nt, Human
uaccuguuaguauuccaag

SEQ ID NO: 635931 - RNA, 21 nt, Human
uacuaggcuauucuggcuaaa

SEQ ID NO: 635932 - RNA, 21 nt, Human
uacucaucuaagcuuuucacu

SEQ ID NO: 635933 - RNA, 18 nt, Human
uagaaaauuauuuuuugc

SEQ ID NO: 635934 - RNA, 21 nt, Human
uagcagagaacugaggcauuc

SEQ ID NO: 635935 - RNA, 19 nt, Human
uagcccgggagagcugcag

SEQ ID NO: 635936 - RNA, 21 nt, Human
uaggauuaacagagacccuuc

SEQ ID NO: 635937 - RNA, 20 nt, Human
uaugaaaaaauucagugaca

SEQ ID NO: 635938 - RNA, 18 nt, Human
uauguuacuuuuugcaac

SEQ ID NO: 635939 - RNA, 24 nt, Human
ucacuaacaauauccacuaaacaa

SEQ ID NO: 635940 - RNA, 28 nt, Human
ucagugacauuuucuauaacuauuuccc

SEQ ID NO: 635941 - RNA, 21 nt, Human
uccaaaauauaugagggaaac

SEQ ID NO: 635942 - RNA, 21 nt, Human
uccaaggaaugggcugaaacc

SEQ ID NO: 635943 - RNA, 20 nt, Human
uccacuaaacaaaaacagua

SEQ ID NO: 635944 - RNA, 22 nt, Human
ucgcugaaauguccuuaaauau

SEQ ID NO: 635945 - RNA, 22 nt, Human
ucuaaaucagauaccaggaagc

SEQ ID NO: 635946 - RNA, 23 nt, Human
ugaaaaggguagcagagaacuga

SEQ ID NO: 635947 - RNA, 21 nt, Human
ugaaaauauguuacuuuuugc

SEQ ID NO: 635948 - RNA, 20 nt, Human
ugaaaauucuaggucuaaua

SEQ ID NO: 635949 - RNA, 18 nt, Human
ugaaauguccuuaaauau

SEQ ID NO: 635950 - RNA, 20 nt, Human
ugaaauguccuuaaauauug

SEQ ID NO: 635951 - RNA, 23 nt, Human
ugaaauguccuuaaauauugucc

SEQ ID NO: 635952 - RNA, 18 nt, Human
ugaaggaccccauuauuc

SEQ ID NO: 635953 - RNA, 20 nt, Human
ugaagggaacagcauacgag

SEQ ID NO: 635954 - RNA, 23 nt, Human
ugaauuuuggacugcauauuugu

SEQ ID NO: 635955 - RNA, 22 nt, Human
ugacuaaaucccuaaacaacgu

SEQ ID NO: 635956 - RNA, 23 nt, Human
ugacuaaaucccuaaacaacguc

SEQ ID NO: 635957 - RNA, 23 nt, Human
ugagaaagaaaaugaaaauucua

SEQ ID NO: 635958 - RNA, 23 nt, Human
ugcauucacacugagcuuuacuc

SEQ ID NO: 635959 - RNA, 19 nt, Human
ugccauaggcagaauauca

SEQ ID NO: 635960 - RNA, 19 nt, Human
ugcuaaguuuucacuuccu

SEQ ID NO: 635961 - RNA, 19 nt, Human
uggacugcauauuuguuuc

SEQ ID NO: 635962 - RNA, 21 nt, Human
ugugucaauaaacugugugug

SEQ ID NO: 635963 - RNA, 19 nt, Human
uuaacagcauuuaucucug

SEQ ID NO: 635964 - RNA, 19 nt, Human
uucacacugagcuuuacuc

SEQ ID NO: 635965 - RNA, 19 nt, Human
uucacuuccuuacuaggcu

SEQ ID NO: 635966 - RNA, 25 nt, Human
uucaucucuuugcuccaaacacuuc

SEQ ID NO: 635967 - RNA, 19 nt, Human
uucuagaguagaaguuacc

SEQ ID NO: 635968 - RNA, 26 nt, Human
uugcaacaccaaaauaaaaagguccc

SEQ ID NO: 635969 - RNA, 23 nt, Human
uugcauucacacugagcuuuacu

SEQ ID NO: 635970 - RNA, 21 nt, Human
uugccagauauaauguggugc

SEQ ID NO: 635971 - RNA, 23 nt, Human
uuucacuuccuuacuaggcugag

SEQ ID NO: 635972 - RNA, 21 nt, Human
uuuccaaaaaaaagaaauaug

SEQ ID NO: 635973 - RNA, 18 nt, Human
uuugcuccaaacacuucc

SEQ ID NO: 635974 - RNA, 20 nt, Human
uuuuaugacaaugcaacuga

SEQ ID NO: 635975 - RNA, 23 nt, Human
aaaaaccaccuguaccccaaaac

SEQ ID NO: 635976 - RNA, 19 nt, Human
aaaaagccuagccuugguc

SEQ ID NO: 635977 - RNA, 22 nt, Human
aaaaucucagaacucaccacua

SEQ ID NO: 635978 - RNA, 20 nt, Human
aaagaacuuauccguguaac

SEQ ID NO: 635979 - RNA, 18 nt, Human
aaccaccuguaccccaaa

SEQ ID NO: 635980 - RNA, 22 nt, Human
aacugguccccccugcauccug

SEQ ID NO: 635981 - RNA, 18 nt, Human
aagaagaauaauauaaug

SEQ ID NO: 635982 - RNA, 20 nt, Human
aagaagaauaauauaaugga

SEQ ID NO: 635983 - RNA, 18 nt, Human
aagcagcauuugaagcug

SEQ ID NO: 635984 - RNA, 19 nt, Human
aaguagcugggacuacagg

SEQ ID NO: 635985 - RNA, 20 nt, Human
aaguagcugggacuacaggu

SEQ ID NO: 635986 - RNA, 26 nt, Human
aaguagcugggacuacaggugcgcac

SEQ ID NO: 635987 - RNA, 22 nt, Human
accaugcuggcccggcuggucu

SEQ ID NO: 635988 - RNA, 19 nt, Human
acgggguuucaccaugcug

SEQ ID NO: 635989 - RNA, 20 nt, Human
acgggguuucaccaugcugg

SEQ ID NO: 635990 - RNA, 24 nt, Human
acuggguacaguguacacugcucc

SEQ ID NO: 635991 - RNA, 21 nt, Human
agaaggcagcagaaagaugag

SEQ ID NO: 635992 - RNA, 18 nt, Human
agacacuagaggcggaac

SEQ ID NO: 635993 - RNA, 24 nt, Human
agccagcccugaucugcugacaca

SEQ ID NO: 635994 - RNA, 18 nt, Human
agccuugguccugcccag

SEQ ID NO: 635995 - RNA, 19 nt, Human
aggcuggagugcaguggca

SEQ ID NO: 635996 - RNA, 22 nt, Human
agggagaggcagcaugaccuga

SEQ ID NO: 635997 - RNA, 21 nt, Human
agggauuagaggcuacauacu

SEQ ID NO: 635998 - RNA, 22 nt, Human
aguaugaggacagccauugcca

SEQ ID NO: 635999 - RNA, 25 nt, Human
agugcaguggcaugcgaacucggcu

SEQ ID NO: 636000 - RNA, 26 nt, Human
agugcaguggcaugcgaacucggcuc

SEQ ID NO: 636001 - RNA, 24 nt, Human
auuuuuguauuuuuaguagagacg

SEQ ID NO: 636002 - RNA, 22 nt, Human
caagcaauucuccugccuuagc

SEQ ID NO: 636003 - RNA, 27 nt, Human
caagcaauucuccugccuuagccuccc

SEQ ID NO: 636004 - RNA, 24 nt, Human
cacaccaccaugccuggcuaauuu

SEQ ID NO: 636005 - RNA, 24 nt, Human
caccaugccuggcuaauuuuugua

SEQ ID NO: 636006 - RNA, 18 nt, Human
caccaugcuggcccggcu

SEQ ID NO: 636007 - RNA, 24 nt, Human
caccaugcuggcccggcuggucuu

SEQ ID NO: 636008 - RNA, 19 nt, Human
caccuagauugaauagcua

SEQ ID NO: 636009 - RNA, 24 nt, Human
caguugacagguguaccaaaaucu

SEQ ID NO: 636010 - RNA, 19 nt, Human
ccagguucaagcaauucuc

SEQ ID NO: 636011 - RNA, 22 nt, Human
cccaaguagcugggacuacagg

SEQ ID NO: 636012 - RNA, 23 nt, Human
cccaaguagcugggacuacaggu

SEQ ID NO: 636013 - RNA, 23 nt, Human
cccaggcuggagugcaguggcau

SEQ ID NO: 636014 - RNA, 20 nt, Human
ccccuucugagcagagaaau

SEQ ID NO: 636015 - RNA, 24 nt, Human
ccuaccagguucaagcaauucucc

SEQ ID NO: 636016 - RNA, 22 nt, Human
ccuagccuugguccugcccagc

SEQ ID NO: 636017 - RNA, 23 nt, Human
ccuccaauagccagcccugaucu

SEQ ID NO: 636018 - RNA, 20 nt, Human
ccugcauccuggccggaagc

SEQ ID NO: 636019 - RNA, 23 nt, Human
ccugccuuagccucccaaguagc

SEQ ID NO: 636020 - RNA, 21 nt, Human
ccuucugagcagagaaaugga

SEQ ID NO: 636021 - RNA, 23 nt, Human
cgcacaccaccaugccuggcuaa

SEQ ID NO: 636022 - RNA, 24 nt, Human
cgcucugucgcccaggcuggagug

SEQ ID NO: 636023 - RNA, 19 nt, Human
cgggguuucaccaugcugg

SEQ ID NO: 636024 - RNA, 24 nt, Human
cuagaggcggaacugguccccccu

SEQ ID NO: 636025 - RNA, 19 nt, Human
cucacugcaaccucugccu

SEQ ID NO: 636026 - RNA, 22 nt, Human
cucacugcaaccucugccuacc

SEQ ID NO: 636027 - RNA, 24 nt, Human
cucgcucugucgcccaggcuggag

SEQ ID NO: 636028 - RNA, 19 nt, Human
cugcaaccucugccuacca

SEQ ID NO: 636029 - RNA, 24 nt, Human
cugcaaccucugccuaccagguuc

SEQ ID NO: 636030 - RNA, 23 nt, Human
cugccuuagccucccaaguagcu

SEQ ID NO: 636031 - RNA, 20 nt, Human
cugcucaguugacaggugua

SEQ ID NO: 636032 - RNA, 24 nt, Human
cuuagccucccaaguagcugggac

SEQ ID NO: 636033 - RNA, 22 nt, Human
cuuccaaaagccuccaauagcc

SEQ ID NO: 636034 - RNA, 19 nt, Human
cuuucuggggagauucugg

SEQ ID NO: 636035 - RNA, 24 nt, Human
gagacgggguuucaccaugcuggc

SEQ ID NO: 636036 - RNA, 23 nt, Human
gcccaggcuggagugcaguggca

SEQ ID NO: 636037 - RNA, 21 nt, Human
gccccagacacuagaggcgga

SEQ ID NO: 636038 - RNA, 20 nt, Human
gcccuggagaggucaaauga

SEQ ID NO: 636039 - RNA, 25 nt, Human
gcucugucgcccaggcuggagugca

SEQ ID NO: 636040 - RNA, 19 nt, Human
gcuggagugcaguggcaug

SEQ ID NO: 636041 - RNA, 18 nt, Human
ggacagccauugccauug

SEQ ID NO: 636042 - RNA, 24 nt, Human
ggagaaggcagcagaaagaugaga

SEQ ID NO: 636043 - RNA, 24 nt, Human
ggcuggucuugaacuccugacuuu

SEQ ID NO: 636044 - RNA, 21 nt, Human
ggggacucacaggggagggug

SEQ ID NO: 636045 - RNA, 21 nt, Human
guaaccaaaaaccaccuguac

SEQ ID NO: 636046 - RNA, 24 nt, Human
uaaagaacuuauccguguaaccaa

SEQ ID NO: 636047 - RNA, 24 nt, Human
uaaccaaaaaccaccuguacccca

SEQ ID NO: 636048 - RNA, 21 nt, Human
uaagccccagacacuagaggg

SEQ ID NO: 636049 - RNA, 24 nt, Human
uaauuuuuguauuuuuaguagaga

SEQ ID NO: 636050 - RNA, 19 nt, Human
uacaggugcgcacaccacc

SEQ ID NO: 636051 - RNA, 24 nt, Human
uaccagguucaagcaauucuccug

SEQ ID NO: 636052 - RNA, 24 nt, Human
uaguagagacgggguuucaccaug

SEQ ID NO: 636053 - RNA, 26 nt, Human
uaguagagacgggguuucaccaugcu

SEQ ID NO: 636054 - RNA, 18 nt, Human
ucacugcaaccucugccu

SEQ ID NO: 636055 - RNA, 19 nt, Human
ucacugcaaccucugccua

SEQ ID NO: 636056 - RNA, 24 nt, Human
ucacugcaaccucugccuaccagg

SEQ ID NO: 636057 - RNA, 19 nt, Human
ucaguugacagguguacca

SEQ ID NO: 636058 - RNA, 24 nt, Human
ucaguugacagguguaccaaaauc

SEQ ID NO: 636059 - RNA, 20 nt, Human
uccaauagccagcccugauu

SEQ ID NO: 636060 - RNA, 25 nt, Human
uccaggugaguaugccauuuuggag

SEQ ID NO: 636061 - RNA, 23 nt, Human
ucccaaguagcugggacuacagg

SEQ ID NO: 636062 - RNA, 18 nt, Human
ucccaugagaucaggggc

SEQ ID NO: 636063 - RNA, 22 nt, Human
ucgcccaggcuggagugcagug

SEQ ID NO: 636064 - RNA, 24 nt, Human
ucgcucugucgcccaggcuggagu

SEQ ID NO: 636065 - RNA, 19 nt, Human
ucuaaucucagggaagugu

SEQ ID NO: 636066 - RNA, 20 nt, Human
ucucccaugagaucaggggc

SEQ ID NO: 636067 - RNA, 26 nt, Human
ucuccugccuuagccucccaaguagc

SEQ ID NO: 636068 - RNA, 19 nt, Human
ucucgcucugucgcccagg

SEQ ID NO: 636069 - RNA, 23 nt, Human
ucucgcucugucgcccaggcugg

SEQ ID NO: 636070 - RNA, 24 nt, Human
ucucgcucugucgcccaggcugga

SEQ ID NO: 636071 - RNA, 26 nt, Human
ucucgcucugucgcccaggcuggagu

SEQ ID NO: 636072 - RNA, 19 nt, Human
ucucucuuuuaagugggag

SEQ ID NO: 636073 - RNA, 24 nt, Human
ucugucgcccaggcuggagugcag

SEQ ID NO: 636074 - RNA, 20 nt, Human
ugaaauaaaaaagccuagcc

SEQ ID NO: 636075 - RNA, 20 nt, Human
ugaagaagaauaauauaaug

SEQ ID NO: 636076 - RNA, 22 nt, Human
ugagaaagaaucucccaugaga

SEQ ID NO: 636077 - RNA, 22 nt, Human
ugagacggagucucgcucuguc

SEQ ID NO: 636078 - RNA, 18 nt, Human
ugaggacagccauugcca

SEQ ID NO: 636079 - RNA, 20 nt, Human
ugaggacagccauugccauu

SEQ ID NO: 636080 - RNA, 24 nt, Human
ugaucugcugacacaguuccccuu

SEQ ID NO: 636081 - RNA, 25 nt, Human
ugcccagcgcagagagacaugaagg

SEQ ID NO: 636082 - RNA, 24 nt, Human
ugccuuagccucccaaguagcugg

SEQ ID NO: 636083 - RNA, 26 nt, Human
uggagugcaguggcaugcgaacucgg

SEQ ID NO: 636084 - RNA, 24 nt, Human
uggcccggcuggucuugaacuccu

SEQ ID NO: 636085 - RNA, 23 nt, Human
ugggacuacaggugcgcacacca

SEQ ID NO: 636086 - RNA, 26 nt, Human
ugggacuacaggugcgcacaccacca

SEQ ID NO: 636087 - RNA, 22 nt, Human
uggggacucacaggggagggug

SEQ ID NO: 636088 - RNA, 23 nt, Human
uguaaccaaaaaccaccuguacc

SEQ ID NO: 636089 - RNA, 21 nt, Human
uguauuuuuaguagagacggg

SEQ ID NO: 636090 - RNA, 18 nt, Human
uuaguagagacgggguuu

SEQ ID NO: 636091 - RNA, 22 nt, Human
uuaguagagacgggguuucacc

SEQ ID NO: 636092 - RNA, 24 nt, Human
uuaguagagacgggguuucaccau

SEQ ID NO: 636093 - RNA, 24 nt, Human
uucaagcaauucuccugccuuagc

SEQ ID NO: 636094 - RNA, 22 nt, Human
uucugagcagagaaauggagga

SEQ ID NO: 636095 - RNA, 18 nt, Human
uugcacccaguaggccug

SEQ ID NO: 636096 - RNA, 22 nt, Human
uuuacucuuccaaaagccucca

SEQ ID NO: 636097 - RNA, 23 nt, Human
uuuuguuuuuugagacggagucu

SEQ ID NO: 636098 - RNA, 24 nt, Human
uuuuuaguagagacgggguuucac

SEQ ID NO: 636099 - RNA, 20 nt, Human
uuuuuguauuuuuaguagag

SEQ ID NO: 636100 - RNA, 25 nt, Human
uuuuuguuuuuugagacggagucuc

SEQ ID NO: 636101 - RNA, 24 nt, Human
uuuuuuuuuuuuguuuuuguuuuu

SEQ ID NO: 636102 - RNA, 22 nt, Human
uuuuuuuuuuuuuuuuguuuuu

SEQ ID NO: 636103 - RNA, 23 nt, Human
aaagugcugggauuaugggugug

SEQ ID NO: 636104 - RNA, 24 nt, Human
aaagugcugggauuauggguguga

SEQ ID NO: 636105 - RNA, 22 nt, Human
aagaaaaaggaaguuauacuga

SEQ ID NO: 636106 - RNA, 18 nt, Human
aagugcugggauuauggg

SEQ ID NO: 636107 - RNA, 26 nt, Human
aagugcugggauuaugggugugagcc

SEQ ID NO: 636108 - RNA, 18 nt, Human
acgggguuucaccguguu

SEQ ID NO: 636109 - RNA, 19 nt, Human
acgggguuucaccguguua

SEQ ID NO: 636110 - RNA, 20 nt, Human
acgggguuucaccguguuag

SEQ ID NO: 636111 - RNA, 24 nt, Human
acgggguuucaccguguuagccag

SEQ ID NO: 636112 - RNA, 19 nt, Human
agagacgggguuucaccgu

SEQ ID NO: 636113 - RNA, 21 nt, Human
aguagagacgggguuucaccg

SEQ ID NO: 636114 - RNA, 24 nt, Human
caaagugcugggauuaugggugug

SEQ ID NO: 636115 - RNA, 18 nt, Human
caccguguuagccaggau

SEQ ID NO: 636116 - RNA, 24 nt, Human
caccguguuagccaggauggucuc

SEQ ID NO: 636117 - RNA, 24 nt, Human
caccucagccucccaaagugcugg

SEQ ID NO: 636118 - RNA, 21 nt, Human
cacugcauuaaccucaaaaaa

SEQ ID NO: 636119 - RNA, 22 nt, Human
caggauggucuccaucuccuga

SEQ ID NO: 636120 - RNA, 21 nt, Human
ccaaagugcugggauuauggg

SEQ ID NO: 636121 - RNA, 24 nt, Human
ccaaagugcugggauuaugggugu

SEQ ID NO: 636122 - RNA, 22 nt, Human
ccaucuccugagcucgugaucu

SEQ ID NO: 636123 - RNA, 19 nt, Human
cccccacaaaaaaagaaaa

SEQ ID NO: 636124 - RNA, 20 nt, Human
cccccacaaaaaaagaaaaa

SEQ ID NO: 636125 - RNA, 20 nt, Human
cccccacaaaaaaagaaaaa

SEQ ID NO: 636126 - RNA, 22 nt, Human
ccucaaaaaauggaaaaucucc

SEQ ID NO: 636127 - RNA, 20 nt, Human
cuccugagcucgugaucugc

SEQ ID NO: 636128 - RNA, 21 nt, Human
cugggauuaugggugugagcc

SEQ ID NO: 636129 - RNA, 24 nt, Human
gagacgggguuucaccguguuagc

SEQ ID NO: 636130 - RNA, 22 nt, Human
gagcucgugaucugcccaccuc

SEQ ID NO: 636131 - RNA, 18 nt, Human
gauuaugggugugagcca

SEQ ID NO: 636132 - RNA, 21 nt, Human
gauuaugggugugagccacug

SEQ ID NO: 636133 - RNA, 24 nt, Human
gauuaugggugugagccacugugc

SEQ ID NO: 636134 - RNA, 21 nt, Human
gcugggauuaugggugugagc

SEQ ID NO: 636135 - RNA, 24 nt, Human
gggagucagccucgaagacggccu

SEQ ID NO: 636136 - RNA, 23 nt, Human
gggguuucaccguguuagccagg

SEQ ID NO: 636137 - RNA, 20 nt, Human
gggugugagccacugugccc

SEQ ID NO: 636138 - RNA, 23 nt, Human
gggugugagccacugugcccggc

SEQ ID NO: 636139 - RNA, 22 nt, Human
ggguuucaccguguuagccagg

SEQ ID NO: 636140 - RNA, 23 nt, Human
guagagacgggguuucaccgugu

SEQ ID NO: 636141 - RNA, 20 nt, Human
gucuccucucauugucuucc

SEQ ID NO: 636142 - RNA, 24 nt, Human
gugaucugcccaccucagccuccc

SEQ ID NO: 636143 - RNA, 24 nt, Human
uagccaggauggucuccaucuccu

SEQ ID NO: 636144 - RNA, 21 nt, Human
uaguagagacgggguuucacc

SEQ ID NO: 636145 - RNA, 24 nt, Human
uaguagagacgggguuucaccgug

SEQ ID NO: 636146 - RNA, 26 nt, Human
uaguagagacgggguuucaccguguu

SEQ ID NO: 636147 - RNA, 25 nt, Human
uaguucuaaauugugucccccacaa

SEQ ID NO: 636148 - RNA, 22 nt, Human
uauacugaaguccuaacccuca

SEQ ID NO: 636149 - RNA, 23 nt, Human
uaugggugugagccacugugccc

SEQ ID NO: 636150 - RNA, 24 nt, Human
ucaccguguuagccaggauggucu

SEQ ID NO: 636151 - RNA, 19 nt, Human
ucacugcauuaaccucaaa

SEQ ID NO: 636152 - RNA, 18 nt, Human
ucagccucccaaagugcu

SEQ ID NO: 636153 - RNA, 23 nt, Human
ucccaaagugcugggauuauggg

SEQ ID NO: 636154 - RNA, 27 nt, Human
ucccccacaaaaaaagaaaaaggaagu

SEQ ID NO: 636155 - RNA, 21 nt, Human
ucugcccaccucagccuccca

SEQ ID NO: 636156 - RNA, 18 nt, Human
ugaaaauagggucuuuuc

SEQ ID NO: 636157 - RNA, 24 nt, Human
ugaucugcccaccucagccuccca

SEQ ID NO: 636158 - RNA, 22 nt, Human
ugggauuaugggugugagccac

SEQ ID NO: 636159 - RNA, 22 nt, Human
ugggauuaugggugugagccac

SEQ ID NO: 636160 - RNA, 22 nt, Human
ugggauuaugggugugagccac

SEQ ID NO: 636161 - RNA, 24 nt, Human
ugggauuaugggugugagccacug

SEQ ID NO: 636162 - RNA, 18 nt, Human
uuaguagagacgggguuu

SEQ ID NO: 636163 - RNA, 22 nt, Human
uuaguagagacgggguuucacc

SEQ ID NO: 636164 - RNA, 24 nt, Human
uuaguagagacgggguuucaccgu

SEQ ID NO: 636165 - RNA, 19 nt, Human
uuucaccguguuagccagg

SEQ ID NO: 636166 - RNA, 22 nt, Human
uuuuauuuuuaguagagacggg

SEQ ID NO: 636167 - RNA, 24 nt, Human
uuuuuaguagagacgggguuucac

SEQ ID NO: 636168 - RNA, 24 nt, Human
uuuuuuuuauuuuuaguagagacg

SEQ ID NO: 636169 - RNA, 25 nt, Human
aaagagcaaacgaaaaauaauucaa

SEQ ID NO: 636170 - RNA, 24 nt, Human
aaagcucugugggagccccugccu

SEQ ID NO: 636171 - RNA, 19 nt, Human
aacccacuucccgagcccg

SEQ ID NO: 636172 - RNA, 20 nt, Human
aaugccaacauugccugcag

SEQ ID NO: 636173 - RNA, 20 nt, Human
acaaugccaacauugccugg

SEQ ID NO: 636174 - RNA, 19 nt, Human
acuuggguggaagagguua

SEQ ID NO: 636175 - RNA, 21 nt, Human
agacggaggcgacuagcagga

SEQ ID NO: 636176 - RNA, 23 nt, Human
aggaauuuacaaugccaacauug

SEQ ID NO: 636177 - RNA, 22 nt, Human
aucgucccacuccucuuccccc

SEQ ID NO: 636178 - RNA, 22 nt, Human
augcucaagucugugccagccu

SEQ ID NO: 636179 - RNA, 24 nt, Human
caaaccaaauaucaggcuccuccu

SEQ ID NO: 636180 - RNA, 22 nt, Human
caacccacuucccgagcccggc

SEQ ID NO: 636181 - RNA, 24 nt, Human
caagaaguuacucaaagcucugug

SEQ ID NO: 636182 - RNA, 24 nt, Human
cacaaccaagaaguuacucaaagc

SEQ ID NO: 636183 - RNA, 21 nt, Human
caccagccccaaucaucaguc

SEQ ID NO: 636184 - RNA, 19 nt, Human
cacccaaugagguggugau

SEQ ID NO: 636185 - RNA, 21 nt, Human
cacuucccgagcccggcccau

SEQ ID NO: 636186 - RNA, 27 nt, Human
cagcuccuggucaucgucccacuccuu

SEQ ID NO: 636187 - RNA, 23 nt, Human
caggcaccagccccaaucaucag

SEQ ID NO: 636188 - RNA, 19 nt, Human
caguagcacccucugcaga

SEQ ID NO: 636189 - RNA, 22 nt, Human
caguagcacccucugcagauuc

SEQ ID NO: 636190 - RNA, 22 nt, Human
cauccaacccacuucccgagcc

SEQ ID NO: 636191 - RNA, 21 nt, Human
ccaaugagguggugauuggcu

SEQ ID NO: 636192 - RNA, 20 nt, Human
cccccuccuccuccagcuuc

SEQ ID NO: 636193 - RNA, 24 nt, Human
cccuccuccuccagcuucucacug

SEQ ID NO: 636194 - RNA, 21 nt, Human
ccuccagcuucucacugucau

SEQ ID NO: 636195 - RNA, 21 nt, Human
ccuggaacuuucacccaauga

SEQ ID NO: 636196 - RNA, 23 nt, Human
ccuggccaauaagaguguggucc

SEQ ID NO: 636197 - RNA, 25 nt, Human
ccuggccaauaagagugugguccug

SEQ ID NO: 636198 - RNA, 23 nt, Human
cuccagcuucucacugucaucuc

SEQ ID NO: 636199 - RNA, 20 nt, Human
cugaagugauccccucacca

SEQ ID NO: 636200 - RNA, 19 nt, Human
cuucaguagcacccucugc

SEQ ID NO: 636201 - RNA, 24 nt, Human
gaaaaauaauucaaccuaagcugc

SEQ ID NO: 636202 - RNA, 20 nt, Human
gggcaggacaggagagggcc

SEQ ID NO: 636203 - RNA, 18 nt, Human
ggggcaggacaggagagg

SEQ ID NO: 636204 - RNA, 22 nt, Human
guagcagucuucagcuucuucc

SEQ ID NO: 636205 - RNA, 25 nt, Human
gucccacuccucuucccccuccucc

SEQ ID NO: 636206 - RNA, 23 nt, Human
uaauagggggcugguacccagac

SEQ ID NO: 636207 - RNA, 19 nt, Human
uacccagacggaggcgacu

SEQ ID NO: 636208 - RNA, 18 nt, Human
uacucaaagcucuguggg

SEQ ID NO: 636209 - RNA, 22 nt, Human
uagcagucuucagcuucuucca

SEQ ID NO: 636210 - RNA, 18 nt, Human
uagggggcugguacccag

SEQ ID NO: 636211 - RNA, 25 nt, Human
uaucaggcuccuccucauccagcuc

SEQ ID NO: 636212 - RNA, 24 nt, Human
ucaccacaugaaggaggcugcaag

SEQ ID NO: 636213 - RNA, 21 nt, Human
ucccgagcccggcccaugcuc

SEQ ID NO: 636214 - RNA, 24 nt, Human
uccuccucauccagcuccuggucc

SEQ ID NO: 636215 - RNA, 20 nt, Human
uccuucuuucuucacacgcc

SEQ ID NO: 636216 - RNA, 21 nt, Human
ucucugcaaagcggucccgcu

SEQ ID NO: 636217 - RNA, 19 nt, Human
ucuucagcuucuuccaggc

SEQ ID NO: 636218 - RNA, 20 nt, Human
ugagguggugauuggcuaag

SEQ ID NO: 636219 - RNA, 21 nt, Human
uggaagagguuaagucgguac

SEQ ID NO: 636220 - RNA, 20 nt, Human
uggggcaggacaggagaggg

SEQ ID NO: 636221 - RNA, 19 nt, Human
ugguccuggauugagcccu

SEQ ID NO: 636222 - RNA, 23 nt, Human
uucccccuccuccuccagcuucu

SEQ ID NO: 636223 - RNA, 22 nt, Human
uucccgagcccggcccaugcuc

SEQ ID NO: 636224 - RNA, 23 nt, Human
uugacaucugcaaaccaagcgcg

SEQ ID NO: 636225 - RNA, 22 nt, Human
uuggggcaggacaggagagggc

SEQ ID NO: 636226 - RNA, 18 nt, Human
aaaaaaaacacaaagugu

SEQ ID NO: 636227 - RNA, 18 nt, Human
aaaauuagcugggcgugg

SEQ ID NO: 636228 - RNA, 18 nt, Human
aaaguguguauccuuucc

SEQ ID NO: 636229 - RNA, 20 nt, Human
aacguagugaaagcccaucu

SEQ ID NO: 636230 - RNA, 21 nt, Human
aacguagugaaagcccaucuc

SEQ ID NO: 636231 - RNA, 19 nt, Human
aagacaaaagccucagaac

SEQ ID NO: 636232 - RNA, 24 nt, Human
aauggcgugaacccgggaggugga

SEQ ID NO: 636233 - RNA, 18 nt, Human
acaccacaagagacaaac

SEQ ID NO: 636234 - RNA, 24 nt, Human
acuccagccugggugaaagaguga

SEQ ID NO: 636235 - RNA, 27 nt, Human
acucuauuccccaggcuagagugcgau

SEQ ID NO: 636236 - RNA, 18 nt, Human
acugcacuccagccuggg

SEQ ID NO: 636237 - RNA, 24 nt, Human
acugcacuccagccugggugaaag

SEQ ID NO: 636238 - RNA, 26 nt, Human
acugcacuccagccugggugaaagag

SEQ ID NO: 636239 - RNA, 20 nt, Human
acugcagagacuaaaauugc

SEQ ID NO: 636240 - RNA, 19 nt, Human
agaacugugaggaagccuc

SEQ ID NO: 636241 - RNA, 21 nt, Human
agaaggaugaagauauuacug

SEQ ID NO: 636242 - RNA, 18 nt, Human
agaggacucagagcucug

SEQ ID NO: 636243 - RNA, 19 nt, Human
agagugagacuucucaaaa

SEQ ID NO: 636244 - RNA, 27 nt, Human
agagugcgauggcaccaucucggcuga

SEQ ID NO: 636245 - RNA, 19 nt, Human
agccuggcuaacguaguga

SEQ ID NO: 636246 - RNA, 25 nt, Human
agccuggcuaacguagugaaagccc

SEQ ID NO: 636247 - RNA, 24 nt, Human
agccugggugaaagagugagacuu

SEQ ID NO: 636248 - RNA, 19 nt, Human
aggaggcugaggcaagaga

SEQ ID NO: 636249 - RNA, 20 nt, Human
aggaguuugagaccagccug

SEQ ID NO: 636250 - RNA, 22 nt, Human
aggaugaagauauuacugagaa

SEQ ID NO: 636251 - RNA, 24 nt, Human
aggcaagagaauggcgugaacccg

SEQ ID NO: 636252 - RNA, 20 nt, Human
aggccgagggggguggauca

SEQ ID NO: 636253 - RNA, 25 nt, Human
aggggcugagacuguuaacaucuga

SEQ ID NO: 636254 - RNA, 22 nt, Human
agggggguggaucaugagguca

SEQ ID NO: 636255 - RNA, 20 nt, Human
agguggaguugcagugagcc

SEQ ID NO: 636256 - RNA, 23 nt, Human
agguggaguugcagugagccgag

SEQ ID NO: 636257 - RNA, 21 nt, Human
aguaaguagcuagaagacaaa

SEQ ID NO: 636258 - RNA, 18 nt, Human
caccacaagagacaaaca

SEQ ID NO: 636259 - RNA, 20 nt, Human
caccacaagagacaaacaua

SEQ ID NO: 636260 - RNA, 19 nt, Human
cacucaauaacuuugcuug

SEQ ID NO: 636261 - RNA, 22 nt, Human
cacuccagccugggugaaagag

SEQ ID NO: 636262 - RNA, 22 nt, Human
cacuccagccugggugaaagag

SEQ ID NO: 636263 - RNA, 24 nt, Human
cacuccagccugggugaaagagug

SEQ ID NO: 636264 - RNA, 24 nt, Human
cacucuauuccccaggcuagagug

SEQ ID NO: 636265 - RNA, 19 nt, Human
cacugcacuccagccuggg

SEQ ID NO: 636266 - RNA, 19 nt, Human
cacugcacuccagccuggg

SEQ ID NO: 636267 - RNA, 22 nt, Human
cacugcacuccagccuggguga

SEQ ID NO: 636268 - RNA, 23 nt, Human
cacugcacuccagccugggugaa

SEQ ID NO: 636269 - RNA, 24 nt, Human
cacugcacuccagccugggugaaa

SEQ ID NO: 636270 - RNA, 22 nt, Human
cagcacuuuaggaggccgaggg

SEQ ID NO: 636271 - RNA, 24 nt, Human
caugaggucaggaguuugagacca

SEQ ID NO: 636272 - RNA, 20 nt, Human
ccacugcacuccagccuggg

SEQ ID NO: 636273 - RNA, 20 nt, Human
ccacugcacuccagccuggg

SEQ ID NO: 636274 - RNA, 20 nt, Human
ccacugcacuccagccuggg

SEQ ID NO: 636275 - RNA, 21 nt, Human
ccacugcacuccagccugggu

SEQ ID NO: 636276 - RNA, 21 nt, Human
ccacugcacuccagccugggu

SEQ ID NO: 636277 - RNA, 23 nt, Human
ccacugcacuccagccuggguga

SEQ ID NO: 636278 - RNA, 21 nt, Human
ccuauaggcccagcuacucag

SEQ ID NO: 636279 - RNA, 24 nt, Human
ccuggcuaacguagugaaagccca

SEQ ID NO: 636280 - RNA, 21 nt, Human
ccugggugaaagagugagacu

SEQ ID NO: 636281 - RNA, 24 nt, Human
cgagaucgugccacugcacuccag

SEQ ID NO: 636282 - RNA, 23 nt, Human
cgggagguggaguugcagugagc

SEQ ID NO: 636283 - RNA, 20 nt, Human
cucagaacacauaaaucuca

SEQ ID NO: 636284 - RNA, 20 nt, Human
cugagauaauuggagcucau

SEQ ID NO: 636285 - RNA, 21 nt, Human
cugaggcaagagaauggcgug

SEQ ID NO: 636286 - RNA, 24 nt, Human
gagaacugugaggaagccucgugc

SEQ ID NO: 636287 - RNA, 23 nt, Human
gagggggguggaucaugagguca

SEQ ID NO: 636288 - RNA, 22 nt, Human
gaucaugaggucaggaguuuga

SEQ ID NO: 636289 - RNA, 24 nt, Human
gaucaugaggucaggaguuugaga

SEQ ID NO: 636290 - RNA, 19 nt, Human
gaugccuguaaucccagca

SEQ ID NO: 636291 - RNA, 19 nt, Human
gccacugcacuccagccug

SEQ ID NO: 636292 - RNA, 19 nt, Human
gccacugcacuccagccug

SEQ ID NO: 636293 - RNA, 24 nt, Human
gccacugcacuccagccuggguga

SEQ ID NO: 636294 - RNA, 20 nt, Human
gccgagaucgugccacugca

SEQ ID NO: 636295 - RNA, 19 nt, Human
gccuguaaucccagcacuu

SEQ ID NO: 636296 - RNA, 20 nt, Human
gcgguggcagaugccuguaa

SEQ ID NO: 636297 - RNA, 20 nt, Human
gcuagaagacaaaagccuca

SEQ ID NO: 636298 - RNA, 23 nt, Human
ggaguugcagugagccgagaucg

SEQ ID NO: 636299 - RNA, 21 nt, Human
ggcagaugccuguaaucccag

SEQ ID NO: 636300 - RNA, 22 nt, Human
ggggguggaucaugaggucagg

SEQ ID NO: 636301 - RNA, 24 nt, Human
ggguggaucaugaggucaggaguu

SEQ ID NO: 636302 - RNA, 20 nt, Human
ggugaaagagugagacuucu

SEQ ID NO: 636303 - RNA, 23 nt, Human
gguggcagaugccuguaauccca

SEQ ID NO: 636304 - RNA, 24 nt, Human
gguggcagaugccuguaaucccag

SEQ ID NO: 636305 - RNA, 23 nt, Human
guggaucaugaggucaggaguuu

SEQ ID NO: 636306 - RNA, 24 nt, Human
guugcagugagccgagaucgugcc

SEQ ID NO: 636307 - RNA, 21 nt, Human
uaacuucauaagagaauuaac

SEQ ID NO: 636308 - RNA, 23 nt, Human
uaagccgagugcgguggcagaug

SEQ ID NO: 636309 - RNA, 22 nt, Human
uaaguagcuagaagacaaaagc

SEQ ID NO: 636310 - RNA, 24 nt, Human
uaauaaaaaaaaauuuacaccaca

SEQ ID NO: 636311 - RNA, 23 nt, Human
uagagugcgauggcaccaucucg

SEQ ID NO: 636312 - RNA, 23 nt, Human
uagcuagaagacaaaagccucag

SEQ ID NO: 636313 - RNA, 25 nt, Human
uagcuagaagacaaaagccucagaa

SEQ ID NO: 636314 - RNA, 24 nt, Human
uaggaggccgagggggguggauca

SEQ ID NO: 636315 - RNA, 22 nt, Human
uaggauuucuagggauaagccg

SEQ ID NO: 636316 - RNA, 24 nt, Human
ucaugaggucaggaguuugagacc

SEQ ID NO: 636317 - RNA, 21 nt, Human
ucauggcuauccuagaacuug

SEQ ID NO: 636318 - RNA, 23 nt, Human
uccagccugggugaaagagugag

SEQ ID NO: 636319 - RNA, 24 nt, Human
uccagccugggugaaagagugaga

SEQ ID NO: 636320 - RNA, 20 nt, Human
uccauuuuccaggaaggcuc

SEQ ID NO: 636321 - RNA, 20 nt, Human
ucccccugauuacaaagguu

SEQ ID NO: 636322 - RNA, 23 nt, Human
ucgugccacugcacuccagccug

SEQ ID NO: 636323 - RNA, 26 nt, Human
ucucaaaaaaaacacaaaguguccac

SEQ ID NO: 636324 - RNA, 24 nt, Human
ucucacucuauuccccaggcuaga

SEQ ID NO: 636325 - RNA, 21 nt, Human
ucucuacuaaaaauacaaaaa

SEQ ID NO: 636326 - RNA, 19 nt, Human
ucuuauucacauuucucaa

SEQ ID NO: 636327 - RNA, 19 nt, Human
ucuuuccagugagaaggau

SEQ ID NO: 636328 - RNA, 22 nt, Human
ugagaacugugaggaagccucg

SEQ ID NO: 636329 - RNA, 23 nt, Human
ugagaacugugaggaagccucgu

SEQ ID NO: 636330 - RNA, 26 nt, Human
ugagaccagccuggcuaaagguacac

SEQ ID NO: 636331 - RNA, 20 nt, Human
ugagauaauuggagcucaug

SEQ ID NO: 636332 - RNA, 22 nt, Human
ugagccgagaucgugccacugc

SEQ ID NO: 636333 - RNA, 23 nt, Human
ugaggcaagagaauggcgugaac

SEQ ID NO: 636334 - RNA, 24 nt, Human
ugaggcaagagaauggcgugaacc

SEQ ID NO: 636335 - RNA, 25 nt, Human
ugaggcaagagaauggcgugaaccc

SEQ ID NO: 636336 - RNA, 22 nt, Human
ugaggcaggaucucacucuauu

SEQ ID NO: 636337 - RNA, 18 nt, Human
ugaggucaggaguuugag

SEQ ID NO: 636338 - RNA, 20 nt, Human
ugcaaccuccauuuuccagg

SEQ ID NO: 636339 - RNA, 22 nt, Human
ugcacagggacuggagauuauc

SEQ ID NO: 636340 - RNA, 22 nt, Human
ugccuguaaucccagcacuuua

SEQ ID NO: 636341 - RNA, 24 nt, Human
ugccuguaaucccagcacuuuagg

SEQ ID NO: 636342 - RNA, 23 nt, Human
uggagaaugaaguaaguagcuag

SEQ ID NO: 636343 - RNA, 19 nt, Human
uggagggaaccuauaggcc

SEQ ID NO: 636344 - RNA, 19 nt, Human
uggagggaaccuauaggcc

SEQ ID NO: 636345 - RNA, 21 nt, Human
uggaucaugaggucaggaguu

SEQ ID NO: 636346 - RNA, 24 nt, Human
uggaucaugaggucaggaguuuga

SEQ ID NO: 636347 - RNA, 22 nt, Human
uggcagaugccuguaaucccag

SEQ ID NO: 636348 - RNA, 24 nt, Human
uggcagaugccuguaaucccagca

SEQ ID NO: 636349 - RNA, 21 nt, Human
uucaagacaagagacugcaga

SEQ ID NO: 636350 - RNA, 19 nt, Human
uucuagggauaagccgagu

SEQ ID NO: 636351 - RNA, 18 nt, Human
uugcagugagccgagauc

SEQ ID NO: 636352 - RNA, 21 nt, Human
uugcagugagccgagaucgug

SEQ ID NO: 636353 - RNA, 22 nt, Human
uugcagugagccgagaucgugc

SEQ ID NO: 636354 - RNA, 20 nt, Human
uuucuagggauaagccgagu

SEQ ID NO: 636355 - RNA, 21 nt, Human
uuuuuuucuuuuguacaaaaa

SEQ ID NO: 636356 - RNA, 23 nt, Human
uuuuuuuuugaggcaggaucuca

SEQ ID NO: 636357 - RNA, 19 nt, Human
uuuuuuuuuuuucuuuugu

SEQ ID NO: 636358 - RNA, 27 nt, Human
uuuuuuuuuuuuuuuuuucuuuugggg

SEQ ID NO: 636359 - RNA, 24 nt, Human
uuuuuuuuuuuuuuuuuuucuuuu

SEQ ID NO: 636360 - RNA, 24 nt, Human
aaagugcugggauuacaggcguga

SEQ ID NO: 636361 - RNA, 18 nt, Human
aacgcaaccucugccucc

SEQ ID NO: 636362 - RNA, 21 nt, Human
aagaguugggauuacaggcau

SEQ ID NO: 636363 - RNA, 23 nt, Human
aagaguugggauuacaggcauga

SEQ ID NO: 636364 - RNA, 24 nt, Human
aaggauccucuugccucagccucc

SEQ ID NO: 636365 - RNA, 20 nt, Human
aaguagcugggacuacaagc

SEQ ID NO: 636366 - RNA, 22 nt, Human
aaguagcugggacuacaagcau

SEQ ID NO: 636367 - RNA, 24 nt, Human
aaguagcugggacuacaagcaugc

SEQ ID NO: 636368 - RNA, 19 nt, Human
aagugcugggauuacaggc

SEQ ID NO: 636369 - RNA, 19 nt, Human
aagugcugggauuacaggc

SEQ ID NO: 636370 - RNA, 26 nt, Human
aagugcugggauuacaggcgugagcc

SEQ ID NO: 636371 - RNA, 19 nt, Human
aauccacuaugaccucauc

SEQ ID NO: 636372 - RNA, 18 nt, Human
acagcucacuguagccuc

SEQ ID NO: 636373 - RNA, 19 nt, Human
acaggaucucacucugugg

SEQ ID NO: 636374 - RNA, 19 nt, Human
accaugcccggcuaguuuc

SEQ ID NO: 636375 - RNA, 19 nt, Human
acgcaaccucugccuccug

SEQ ID NO: 636376 - RNA, 24 nt, Human
acgcaaccucugccuccuggguuc

SEQ ID NO: 636377 - RNA, 23 nt, Human
acugcaccuaugcccaccugcac

SEQ ID NO: 636378 - RNA, 20 nt, Human
acugcaguggcgcgaucuug

SEQ ID NO: 636379 - RNA, 24 nt, Human
acugcaguggcgcgaucuuggcuc

SEQ ID NO: 636380 - RNA, 24 nt, Human
agaguugggauuacaggcaugagc

SEQ ID NO: 636381 - RNA, 23 nt, Human
agcccuuaacagcaucacagcuu

SEQ ID NO: 636382 - RNA, 24 nt, Human
agcgauucuccugccucagccuuc

SEQ ID NO: 636383 - RNA, 21 nt, Human
agcugggacuacaagcaugca

SEQ ID NO: 636384 - RNA, 22 nt, Human
aggucauggaguccuugcuuug

SEQ ID NO: 636385 - RNA, 23 nt, Human
aguacaguggcacaagcacagcu

SEQ ID NO: 636386 - RNA, 21 nt, Human
aguagcugggauuacaggcau

SEQ ID NO: 636387 - RNA, 24 nt, Human
aguuucguauuuuuaguagagaug

SEQ ID NO: 636388 - RNA, 24 nt, Human
augaucugcccgccucagccuucc

SEQ ID NO: 636389 - RNA, 20 nt, Human
augggguuucuccauguugg

SEQ ID NO: 636390 - RNA, 21 nt, Human
augggguuucuccauguuggu

SEQ ID NO: 636391 - RNA, 24 nt, Human
caaagugcugggauuacaggcgug

SEQ ID NO: 636392 - RNA, 20 nt, Human
caacgcaaccucugccuccu

SEQ ID NO: 636393 - RNA, 24 nt, Human
caagaguugggauuacaggcauga

SEQ ID NO: 636394 - RNA, 27 nt, Human
caagaguugggauuacaggcaugagcc

SEQ ID NO: 636395 - RNA, 19 nt, Human
caagcgauccuccugccuc

SEQ ID NO: 636396 - RNA, 27 nt, Human
caagcgauccuccugccucugccuccc

SEQ ID NO: 636397 - RNA, 20 nt, Human
caagcgauucuccugccuca

SEQ ID NO: 636398 - RNA, 22 nt, Human
caagcgauucuccugccucagc

SEQ ID NO: 636399 - RNA, 21 nt, Human
caaggauccucuugccucagc

SEQ ID NO: 636400 - RNA, 23 nt, Human
cacaagcacagcucacuguagcc

SEQ ID NO: 636401 - RNA, 20 nt, Human
cacagcucacuguagccucc

SEQ ID NO: 636402 - RNA, 23 nt, Human
caccgugccaggccuggccuuuu

SEQ ID NO: 636403 - RNA, 20 nt, Human
cacgcagcccugggccugug

SEQ ID NO: 636404 - RNA, 24 nt, Human
cacucgaccugcgcccaccugcac

SEQ ID NO: 636405 - RNA, 21 nt, Human
cacugcaccugcaccuucugc

SEQ ID NO: 636406 - RNA, 21 nt, Human
cacugcaccugcaccuucugc

SEQ ID NO: 636407 - RNA, 23 nt, Human
cacugcaccugcaccuucugcac

SEQ ID NO: 636408 - RNA, 23 nt, Human
cacugcaccugcaccuucugcac

SEQ ID NO: 636409 - RNA, 24 nt, Human
cacugcaccugcaccuucugcacc

SEQ ID NO: 636410 - RNA, 24 nt, Human
cacugcaccugugcucaccugcac

SEQ ID NO: 636411 - RNA, 21 nt, Human
cagccagugugcacgcagccc

SEQ ID NO: 636412 - RNA, 23 nt, Human
cagguuccuggccuggguacaca

SEQ ID NO: 636413 - RNA, 19 nt, Human
caguggcgcgaucuuggcu

SEQ ID NO: 636414 - RNA, 23 nt, Human
caugcaccaucauaccuggcuaa

SEQ ID NO: 636415 - RNA, 24 nt, Human
caugcugggcucaagcgauccucc

SEQ ID NO: 636416 - RNA, 22 nt, Human
ccaaagugcugggauuacaggc

SEQ ID NO: 636417 - RNA, 22 nt, Human
ccaaagugcugggauuacaggc

SEQ ID NO: 636418 - RNA, 24 nt, Human
ccaaagugcugggauuacaggcgu

SEQ ID NO: 636419 - RNA, 22 nt, Human
ccaagaguugggauuacaggca

SEQ ID NO: 636420 - RNA, 23 nt, Human
ccaagaguugggauuacaggcau

SEQ ID NO: 636421 - RNA, 21 nt, Human
ccaccgugccaggccuggccu

SEQ ID NO: 636422 - RNA, 19 nt, Human
ccacuaugaccucaucuua

SEQ ID NO: 636423 - RNA, 19 nt, Human
ccauguuggucaggcuggu

SEQ ID NO: 636424 - RNA, 22 nt, Human
ccauguuggucaggcuggucuc

SEQ ID NO: 636425 - RNA, 23 nt, Human
ccauguuggucaggcuggucucg

SEQ ID NO: 636426 - RNA, 18 nt, Human
cccaagaguugggauuac

SEQ ID NO: 636427 - RNA, 23 nt, Human
cccaagaguugggauuacaggca

SEQ ID NO: 636428 - RNA, 24 nt, Human
cccaagaguugggauuacaggcau

SEQ ID NO: 636429 - RNA, 19 nt, Human
cccaaguagcugggacuac

SEQ ID NO: 636430 - RNA, 21 nt, Human
cccacugcaccugugcucacc

SEQ ID NO: 636431 - RNA, 23 nt, Human
ccccaagaguugggauuacaggc

SEQ ID NO: 636432 - RNA, 24 nt, Human
ccuccugccucugccuccccaaga

SEQ ID NO: 636433 - RNA, 24 nt, Human
ccuccuggguucaagcgauucucc

SEQ ID NO: 636434 - RNA, 26 nt, Human
ccucucguggccacuguauccuugac

SEQ ID NO: 636435 - RNA, 19 nt, Human
ccucugccuccuggguuca

SEQ ID NO: 636436 - RNA, 26 nt, Human
ccucuugccucagccucccaaguagc

SEQ ID NO: 636437 - RNA, 22 nt, Human
ccugaccucagaugaucugccc

SEQ ID NO: 636438 - RNA, 23 nt, Human
ccugaguagcugggauuacaggc

SEQ ID NO: 636439 - RNA, 24 nt, Human
ccugaguagcugggauuacaggca

SEQ ID NO: 636440 - RNA, 18 nt, Human
ccugcacccacucgaccu

SEQ ID NO: 636441 - RNA, 24 nt, Human
ccugccucagccuuccugaguagc

SEQ ID NO: 636442 - RNA, 22 nt, Human
ccugccucugccuccccaagag

SEQ ID NO: 636443 - RNA, 23 nt, Human
ccuggguucaagcgauucuccug

SEQ ID NO: 636444 - RNA, 24 nt, Human
cgccucagccuuccaaagugcugg

SEQ ID NO: 636445 - RNA, 24 nt, Human
cuaguuucguauuuuuaguagaga

SEQ ID NO: 636446 - RNA, 24 nt, Human
cucaacgcaaccucugccuccugg

SEQ ID NO: 636447 - RNA, 24 nt, Human
cucaagcgauccuccugccucugc

SEQ ID NO: 636448 - RNA, 21 nt, Human
cucacugcaccuaugcccacc

SEQ ID NO: 636449 - RNA, 21 nt, Human
cucacugcaccuaugcccacc

SEQ ID NO: 636450 - RNA, 24 nt, Human
cucagccucccaaguagcugggac

SEQ ID NO: 636451 - RNA, 26 nt, Human
cuccugaccucagaugaucugcccgc

SEQ ID NO: 636452 - RNA, 24 nt, Human
cuccugccucagccuuccugagua

SEQ ID NO: 636453 - RNA, 21 nt, Human
cuccuggguucaagcgauucu

SEQ ID NO: 636454 - RNA, 23 nt, Human
cugaguagcugggauuacaggca

SEQ ID NO: 636455 - RNA, 24 nt, Human
cugaguagcugggauuacaggcau

SEQ ID NO: 636456 - RNA, 24 nt, Human
cugcaccuacugcaccugcaccca

SEQ ID NO: 636457 - RNA, 18 nt, Human
cugcaccuaugcccaccu

SEQ ID NO: 636458 - RNA, 18 nt, Human
cugcaccugcacccacuc

SEQ ID NO: 636459 - RNA, 19 nt, Human
cugcaccugcaccuucugc

SEQ ID NO: 636460 - RNA, 19 nt, Human
cugcaccugcaccuucugc

SEQ ID NO: 636461 - RNA, 19 nt, Human
cugcaccugcacucacugc

SEQ ID NO: 636462 - RNA, 20 nt, Human
cugcaccugugcccaccugc

SEQ ID NO: 636463 - RNA, 20 nt, Human
cugcaccugugcucaccugc

SEQ ID NO: 636464 - RNA, 24 nt, Human
cugcaccuucugcaccugugccca

SEQ ID NO: 636465 - RNA, 24 nt, Human
cugcacucacugcaccuaugccca

SEQ ID NO: 636466 - RNA, 24 nt, Human
cugcacucacugcaccuaugccca

SEQ ID NO: 636467 - RNA, 18 nt, Human
cugcacuugugcccaccu

SEQ ID NO: 636468 - RNA, 24 nt, Human
cugccucagccuuccugaguagcu

SEQ ID NO: 636469 - RNA, 22 nt, Human
cuggcccuuuccuuuucuuuuc

SEQ ID NO: 636470 - RNA, 23 nt, Human
cuugccucagccucccaaguagc

SEQ ID NO: 636471 - RNA, 25 nt, Human
cuugccucagccucccaaguagcug

SEQ ID NO: 636472 - RNA, 19 nt, Human
cuuuccuuuucuuuucuuu

SEQ ID NO: 636473 - RNA, 22 nt, Human
cuuuucuuuuaaggaagcuggu

SEQ ID NO: 636474 - RNA, 24 nt, Human
gacagggucucccuauguggccca

SEQ ID NO: 636475 - RNA, 24 nt, Human
gaccucagaugaucugcccgccuc

SEQ ID NO: 636476 - RNA, 20 nt, Human
gacuucagcagacacauuuc

SEQ ID NO: 636477 - RNA, 24 nt, Human
gagaugggguuucuccauguuggu

SEQ ID NO: 636478 - RNA, 22 nt, Human
gaguagcugggauuacaggcau

SEQ ID NO: 636479 - RNA, 24 nt, Human
gaguagcugggauuacaggcaugc

SEQ ID NO: 636480 - RNA, 18 nt, Human
gauuacaggcaugagcca

SEQ ID NO: 636481 - RNA, 21 nt, Human
gauuacaggcaugagccacca

SEQ ID NO: 636482 - RNA, 22 nt, Human
gauuacaggcaugagccaccac

SEQ ID NO: 636483 - RNA, 18 nt, Human
gauuacaggcaugcgcca

SEQ ID NO: 636484 - RNA, 22 nt, Human
gauuacaggcaugcgccaccau

SEQ ID NO: 636485 - RNA, 18 nt, Human
gauuacaggcgugagcca

SEQ ID NO: 636486 - RNA, 21 nt, Human
gauuacaggcgugagccaccg

SEQ ID NO: 636487 - RNA, 24 nt, Human
gauuacaggcgugagccaccgugc

SEQ ID NO: 636488 - RNA, 21 nt, Human
gcaaagacccuauuuccaaau

SEQ ID NO: 636489 - RNA, 19 nt, Human
gcaaccucugccuccuggg

SEQ ID NO: 636490 - RNA, 22 nt, Human
gcacucacugcaccuaugccca

SEQ ID NO: 636491 - RNA, 22 nt, Human
gcacucacugcaccuaugccca

SEQ ID NO: 636492 - RNA, 20 nt, Human
gcccaccuguacccacugca

SEQ ID NO: 636493 - RNA, 20 nt, Human
gcccaccuguacccacugca

SEQ ID NO: 636494 - RNA, 21 nt, Human
gcccugggccuguggcagguc

SEQ ID NO: 636495 - RNA, 19 nt, Human
gcccuuuccuuuucuuuuc

SEQ ID NO: 636496 - RNA, 21 nt, Human
gccuggguacacagcagguca

SEQ ID NO: 636497 - RNA, 24 nt, Human
gcgauucuccugccucagccuucc

SEQ ID NO: 636498 - RNA, 20 nt, Human
gcucaccugcaccuacugca

SEQ ID NO: 636499 - RNA, 23 nt, Human
gcucacuguagccuccuucuccc

SEQ ID NO: 636500 - RNA, 19 nt, Human
gcuggaguacaguggcaca

SEQ ID NO: 636501 - RNA, 20 nt, Human
gcugggcucaagcgauccuc

SEQ ID NO: 636502 - RNA, 23 nt, Human
gcuggucucgaacuccugaccuc

SEQ ID NO: 636503 - RNA, 20 nt, Human
ggacagggucucccuaugug

SEQ ID NO: 636504 - RNA, 23 nt, Human
ggauccucuugccucagccuccc

SEQ ID NO: 636505 - RNA, 19 nt, Human
ggauuacaggcaugagcca

SEQ ID NO: 636506 - RNA, 24 nt, Human
ggauuacaggcaugcgccaccaug

SEQ ID NO: 636507 - RNA, 24 nt, Human
ggcuggucucgaacuccugaccuc

SEQ ID NO: 636508 - RNA, 24 nt, Human
gggccuguggcaggucagguuccu

SEQ ID NO: 636509 - RNA, 22 nt, Human
gggcucaagcgauccuccugcc

SEQ ID NO: 636510 - RNA, 22 nt, Human
gggguuucuccauguuggucag

SEQ ID NO: 636511 - RNA, 22 nt, Human
ggguuucuccauguuggucagg

SEQ ID NO: 636512 - RNA, 19 nt, Human
ggucucgaacuccugaccu

SEQ ID NO: 636513 - RNA, 18 nt, Human
guagcugggauuacaggc

SEQ ID NO: 636514 - RNA, 20 nt, Human
guagcugggauuacaggcau

SEQ ID NO: 636515 - RNA, 18 nt, Human
guagggacagggucuccc

SEQ ID NO: 636516 - RNA, 25 nt, Human
gugcacgcagcccugggccuguggc

SEQ ID NO: 636517 - RNA, 22 nt, Human
guggcacaagcacagcucaccg

SEQ ID NO: 636518 - RNA, 19 nt, Human
gugggccaggcuggaguac

SEQ ID NO: 636519 - RNA, 20 nt, Human
uacaggcaugagccaccaca

SEQ ID NO: 636520 - RNA, 23 nt, Human
uacaggcaugcgccaccaugccc

SEQ ID NO: 636521 - RNA, 23 nt, Human
uacaggcgugagccaccgugcca

SEQ ID NO: 636522 - RNA, 20 nt, Human
uacaguggcacaagcacagc

SEQ ID NO: 636523 - RNA, 24 nt, Human
uaguagagaugggguuucuccaug

SEQ ID NO: 636524 - RNA, 24 nt, Human
ucaacgcaaccucugccuccuggg

SEQ ID NO: 636525 - RNA, 22 nt, Human
ucaagcgauccuccugccucug

SEQ ID NO: 636526 - RNA, 19 nt, Human
ucaagcgauucuccugccu

SEQ ID NO: 636527 - RNA, 27 nt, Human
ucaaggauccucuugccucagccuccc

SEQ ID NO: 636528 - RNA, 23 nt, Human
ucacuguagccuccuucucccag

SEQ ID NO: 636529 - RNA, 24 nt, Human
ucagcagacacauuucagcccuua

SEQ ID NO: 636530 - RNA, 27 nt, Human
ucagcagcugcuaccucucguggccac

SEQ ID NO: 636531 - RNA, 18 nt, Human
ucagcccuuaacagcauc

SEQ ID NO: 636532 - RNA, 21 nt, Human
ucagcccuuaacagcaucaca

SEQ ID NO: 636533 - RNA, 18 nt, Human
ucagccucccaaguagcu

SEQ ID NO: 636534 - RNA, 20 nt, Human
ucagccucccaaguagcugg

SEQ ID NO: 636535 - RNA, 21 nt, Human
ucagccuuccugaguagcugg

SEQ ID NO: 636536 - RNA, 23 nt, Human
uccaaagugcugggauuacaggc

SEQ ID NO: 636537 - RNA, 24 nt, Human
uccaaagugcugggauuacaggcg

SEQ ID NO: 636538 - RNA, 25 nt, Human
uccacacaucagcagcugcuaccuc

SEQ ID NO: 636539 - RNA, 18 nt, Human
ucccaaguagcugggacu

SEQ ID NO: 636540 - RNA, 24 nt, Human
uccugaguagcugggauuacaggc

SEQ ID NO: 636541 - RNA, 22 nt, Human
uccugccucugccuccccaaga

SEQ ID NO: 636542 - RNA, 20 nt, Human
uccuggccuggguacacagc

SEQ ID NO: 636543 - RNA, 21 nt, Human
uccuggguucaagcgauucuc

SEQ ID NO: 636544 - RNA, 24 nt, Human
uccuggguucaagcgauucuccug

SEQ ID NO: 636545 - RNA, 22 nt, Human
ucgcucuuguugcccaggcugg

SEQ ID NO: 636546 - RNA, 23 nt, Human
ucgcucuuguugcccaggcugga

SEQ ID NO: 636547 - RNA, 24 nt, Human
ucucacucugugggccaggcugga

SEQ ID NO: 636548 - RNA, 24 nt, Human
ucucccagacucaaggauccucuu

SEQ ID NO: 636549 - RNA, 21 nt, Human
ucugcccgccucagccuucca

SEQ ID NO: 636550 - RNA, 21 nt, Human
ucuggcccuuuccuuuucuuu

SEQ ID NO: 636551 - RNA, 19 nt, Human
ucugugggccaggcuggag

SEQ ID NO: 636552 - RNA, 22 nt, Human
ucuuguugcccaggcuggacug

SEQ ID NO: 636553 - RNA, 18 nt, Human
ugaccucagaugaucugc

SEQ ID NO: 636554 - RNA, 24 nt, Human
ugaccucagaugaucugcccgccu

SEQ ID NO: 636555 - RNA, 20 nt, Human
ugagacaggaucucacucug

SEQ ID NO: 636556 - RNA, 21 nt, Human
ugcaccugcaccuucugcacu

SEQ ID NO: 636557 - RNA, 22 nt, Human
ugcccaccugcacucacugcac

SEQ ID NO: 636558 - RNA, 22 nt, Human
ugcccaccuguacccacugcac

SEQ ID NO: 636559 - RNA, 22 nt, Human
ugcccaccuguacccacugcac

SEQ ID NO: 636560 - RNA, 23 nt, Human
ugcccggcuaguuucguauuuuu

SEQ ID NO: 636561 - RNA, 22 nt, Human
ugccucagccucccaaguagcu

SEQ ID NO: 636562 - RNA, 24 nt, Human
ugccucagccucccaaguagcugg

SEQ ID NO: 636563 - RNA, 25 nt, Human
ugccucagccuuccugaguagcugg

SEQ ID NO: 636564 - RNA, 22 nt, Human
ugcucaccugcaccuacugcac

SEQ ID NO: 636565 - RNA, 24 nt, Human
ugcugggauuacaggcgugagcca

SEQ ID NO: 636566 - RNA, 24 nt, Human
uggacugcaguggcgcgaucuugg

SEQ ID NO: 636567 - RNA, 18 nt, Human
uggaguacaguggcacaa

SEQ ID NO: 636568 - RNA, 20 nt, Human
uggcacaagcacagcucacu

SEQ ID NO: 636569 - RNA, 21 nt, Human
ugggacuacaagcaugcacca

SEQ ID NO: 636570 - RNA, 23 nt, Human
ugggacuacaagcaugcaccauc

SEQ ID NO: 636571 - RNA, 18 nt, Human
ugggauuacaggcaugag

SEQ ID NO: 636572 - RNA, 19 nt, Human
ugggauuacaggcaugagc

SEQ ID NO: 636573 - RNA, 22 nt, Human
ugggauuacaggcaugagccac

SEQ ID NO: 636574 - RNA, 23 nt, Human
ugggauuacaggcaugagccacc

SEQ ID NO: 636575 - RNA, 24 nt, Human
ugggauuacaggcaugagccacca

SEQ ID NO: 636576 - RNA, 24 nt, Human
ugggauuacaggcaugagccacca

SEQ ID NO: 636577 - RNA, 18 nt, Human
ugggauuacaggcaugcg

SEQ ID NO: 636578 - RNA, 21 nt, Human
ugggauuacaggcaugcgcca

SEQ ID NO: 636579 - RNA, 22 nt, Human
ugggauuacaggcaugcgccac

SEQ ID NO: 636580 - RNA, 24 nt, Human
ugggauuacaggcaugcgccacca

SEQ ID NO: 636581 - RNA, 18 nt, Human
ugggauuacaggcgugag

SEQ ID NO: 636582 - RNA, 22 nt, Human
ugggauuacaggcgugagccac

SEQ ID NO: 636583 - RNA, 23 nt, Human
ugggauuacaggcgugagccacc

SEQ ID NO: 636584 - RNA, 23 nt, Human
ugggauuacaggcgugagccacc

SEQ ID NO: 636585 - RNA, 24 nt, Human
ugggauuacaggcgugagccaccg

SEQ ID NO: 636586 - RNA, 27 nt, Human
ugggauuacaggcgugagccaccgugc

SEQ ID NO: 636587 - RNA, 24 nt, Human
ugggcucaagcgauccuccugccu

SEQ ID NO: 636588 - RNA, 24 nt, Human
ugggguuucuccauguuggucagg

SEQ ID NO: 636589 - RNA, 20 nt, Human
uggguacacagcaggucaug

SEQ ID NO: 636590 - RNA, 23 nt, Human
uggguucaagcgauucuccugcc

SEQ ID NO: 636591 - RNA, 24 nt, Human
uggguucaagcgauucuccugccu

SEQ ID NO: 636592 - RNA, 24 nt, Human
uggucaggcuggucucgaacuccu

SEQ ID NO: 636593 - RNA, 18 nt, Human
uuaguagagaugggguuu

SEQ ID NO: 636594 - RNA, 24 nt, Human
uuaguagagaugggguuucuccau

SEQ ID NO: 636595 - RNA, 21 nt, Human
uucaagcgauucuccugccuc

SEQ ID NO: 636596 - RNA, 23 nt, Human
uucaagcgauucuccugccucag

SEQ ID NO: 636597 - RNA, 24 nt, Human
uucaagcgauucuccugccucagc

SEQ ID NO: 636598 - RNA, 18 nt, Human
uuccuggccuggguacac

SEQ ID NO: 636599 - RNA, 24 nt, Human
uucgcucuuguugcccaggcugga

SEQ ID NO: 636600 - RNA, 22 nt, Human
uugagacaggaucucacucugu

SEQ ID NO: 636601 - RNA, 24 nt, Human
uugcccaggcuggacugcaguggc

SEQ ID NO: 636602 - RNA, 23 nt, Human
uuguugcccaggcuggacugcag

SEQ ID NO: 636603 - RNA, 24 nt, Human
uuucgcucuuguugcccaggcugg

SEQ ID NO: 636604 - RNA, 19 nt, Human
uuucguauuuuuaguagag

SEQ ID NO: 636605 - RNA, 20 nt, Human
uuucguauuuuuaguagaga

SEQ ID NO: 636606 - RNA, 21 nt, Human
uuucuccauguuggucaggcu

SEQ ID NO: 636607 - RNA, 21 nt, Human
uuugcaaagacccuauuucca

SEQ ID NO: 636608 - RNA, 18 nt, Human
uuuguagggacagggucu

SEQ ID NO: 636609 - RNA, 18 nt, Human
uuuucuuuuuuuuuuuug

SEQ ID NO: 636610 - RNA, 22 nt, Human
uuuuuaguagagaugggguuuc

SEQ ID NO: 636611 - RNA, 20 nt, Human
uuuuuuuucuugagacaggg

SEQ ID NO: 636612 - RNA, 26 nt, Human
uuuuuuuuucuugagacaggaucuca

SEQ ID NO: 636613 - RNA, 21 nt, Human
uuuuuuuuuuuuuuuucuugg

SEQ ID NO: 636614 - RNA, 23 nt, Human
aaccaguagaguccauuagugag

SEQ ID NO: 636615 - RNA, 23 nt, Human
aaccuguuguuuuucccaacucu

SEQ ID NO: 636616 - RNA, 23 nt, Human
aacuuccuaagcaauagcagcuc

SEQ ID NO: 636617 - RNA, 24 nt, Human
acagacaccaacagcugcaucccu

SEQ ID NO: 636618 - RNA, 18 nt, Human
acucaaaccaguagaguc

SEQ ID NO: 636619 - RNA, 21 nt, Human
agacaccaacagcugcauccc

SEQ ID NO: 636620 - RNA, 18 nt, Human
agacauaauccccacccu

SEQ ID NO: 636621 - RNA, 27 nt, Human
agcaauagcagcuccaggcucuucccu

SEQ ID NO: 636622 - RNA, 25 nt, Human
agccgcaaguagaugcucauaaaug

SEQ ID NO: 636623 - RNA, 25 nt, Human
agcuccaggcucuucccugagaccu

SEQ ID NO: 636624 - RNA, 23 nt, Human
augcucauaaaugcgcacaugcg

SEQ ID NO: 636625 - RNA, 19 nt, Human
caaaccccacagugcaggg

SEQ ID NO: 636626 - RNA, 24 nt, Human
caaccaaguuaacacucaucacac

SEQ ID NO: 636627 - RNA, 27 nt, Human
caaccaaguuaacacucaucacacccc

SEQ ID NO: 636628 - RNA, 25 nt, Human
caacuuccuaagcaauagcagcucc

SEQ ID NO: 636629 - RNA, 24 nt, Human
caccaacagcugcaucccuuggca

SEQ ID NO: 636630 - RNA, 21 nt, Human
caugucaaauaugccaaaccc

SEQ ID NO: 636631 - RNA, 19 nt, Human
ccccacagugcagggggcu

SEQ ID NO: 636632 - RNA, 21 nt, Human
ccccagcagccccgggcccac

SEQ ID NO: 636633 - RNA, 21 nt, Human
ccccaggggagauggaggggg

SEQ ID NO: 636634 - RNA, 22 nt, Human
ccuccaauccaaccccugccac

SEQ ID NO: 636635 - RNA, 23 nt, Human
ccuccaauccaaccccugccaca

SEQ ID NO: 636636 - RNA, 18 nt, Human
cucaaaccaguagagucc

SEQ ID NO: 636637 - RNA, 21 nt, Human
gaacaugccccaaaccccaca

SEQ ID NO: 636638 - RNA, 19 nt, Human
gcucacucacacagacacc

SEQ ID NO: 636639 - RNA, 26 nt, Human
ggacagacaccaacagcugcaucccu

SEQ ID NO: 636640 - RNA, 21 nt, Human
ggcaggcaccagaaggucaag

SEQ ID NO: 636641 - RNA, 22 nt, Human
ggccuccucauagagauaacuc

SEQ ID NO: 636642 - RNA, 19 nt, Human
ggggagauggagggggcug

SEQ ID NO: 636643 - RNA, 19 nt, Human
gucaaauaugccaaacccc

SEQ ID NO: 636644 - RNA, 21 nt, Human
uaaacagagacauaaucccca

SEQ ID NO: 636645 - RNA, 20 nt, Human
uaaagaaccggcagcgcuga

SEQ ID NO: 636646 - RNA, 26 nt, Human
uaaaugcgcacaugcgcucacucaca

SEQ ID NO: 636647 - RNA, 24 nt, Human
ucaaggcacguacaacuuccuaag

SEQ ID NO: 636648 - RNA, 23 nt, Human
ucauccagcucagaagcacucaa

SEQ ID NO: 636649 - RNA, 21 nt, Human
ucauucuuauuacugaacaug

SEQ ID NO: 636650 - RNA, 20 nt, Human
ucccaacucuguucucuccc

SEQ ID NO: 636651 - RNA, 25 nt, Human
ucccugagaccugguuuaccucugg

SEQ ID NO: 636652 - RNA, 19 nt, Human
uccuuggccccagcagccc

SEQ ID NO: 636653 - RNA, 19 nt, Human
ugaccuagcgucacgcgga

SEQ ID NO: 636654 - RNA, 24 nt, Human
ugcacuggguucaaauggcccuga

SEQ ID NO: 636655 - RNA, 20 nt, Human
ugccccaaaccccacagugc

SEQ ID NO: 636656 - RNA, 20 nt, Human
ugcugcguccucagguagug

SEQ ID NO: 636657 - RNA, 24 nt, Human
uggcaauuaauuacacaaacauac

SEQ ID NO: 636658 - RNA, 22 nt, Human
ugguaaagaaccggcagcgcug

SEQ ID NO: 636659 - RNA, 18 nt, Human
aaccucgcugaucgccuc

SEQ ID NO: 636660 - RNA, 19 nt, Human
aucucccucggcgcauccc

SEQ ID NO: 636661 - RNA, 21 nt, Human
aucucccucggcgcaucccug

SEQ ID NO: 636662 - RNA, 23 nt, Human
ccauccgccccguuucccaucuc

SEQ ID NO: 636663 - RNA, 19 nt, Human
cccguuucccaucucccuc

SEQ ID NO: 636664 - RNA, 22 nt, Human
cgcaguggggcgcgaccccagc

SEQ ID NO: 636665 - RNA, 22 nt, Human
gcugggcugggcgccauccgcc

SEQ ID NO: 636666 - RNA, 23 nt, Human
ggcugggcugggcgccauccgcc

SEQ ID NO: 636667 - RNA, 21 nt, Human
gggaggugucuggaacugcag

SEQ ID NO: 636668 - RNA, 24 nt, Human
gggcugggcgccauccgccccguu

SEQ ID NO: 636669 - RNA, 21 nt, Human
uacagaggaggagcucuuuau

SEQ ID NO: 636670 - RNA, 19 nt, Human
ucccucggcgcaucccugg

SEQ ID NO: 636671 - RNA, 23 nt, Human
ucccuggggagccgccaucacuc

SEQ ID NO: 636672 - RNA, 25 nt, Human
ucccuggggagccgccaucacucgg

SEQ ID NO: 636673 - RNA, 20 nt, Human
ucgcugaucgccuccauggu

SEQ ID NO: 636674 - RNA, 21 nt, Human
uggcaguuagggcugggcugg

SEQ ID NO: 636675 - RNA, 23 nt, Human
uggcaguuagggcugggcugggc

SEQ ID NO: 636676 - RNA, 22 nt, Human
uuuuuuuuuuuuuuuuuuacag

SEQ ID NO: 636677 - RNA, 24 nt, Human
aaagaaauaaaggucuguagagag

SEQ ID NO: 636678 - RNA, 20 nt, Human
aacacgauuccuccuggagc

SEQ ID NO: 636679 - RNA, 20 nt, Human
aacucguagaagaagccccu

SEQ ID NO: 636680 - RNA, 19 nt, Human
aaggagccaggugggcagg

SEQ ID NO: 636681 - RNA, 22 nt, Human
aagguagagaaaugucuaaaaa

SEQ ID NO: 636682 - RNA, 19 nt, Human
aauccaccucauaaauuca

SEQ ID NO: 636683 - RNA, 26 nt, Human
acacagccuaaggacguucuuaagga

SEQ ID NO: 636684 - RNA, 18 nt, Human
acuucaacauggacugaa

SEQ ID NO: 636685 - RNA, 23 nt, Human
agaaauaaaggucuguagagaga

SEQ ID NO: 636686 - RNA, 18 nt, Human
agccaggugggcaggcac

SEQ ID NO: 636687 - RNA, 20 nt, Human
agugaaccucucuggugccc

SEQ ID NO: 636688 - RNA, 18 nt, Human
aucugagcaaugcaaagg

SEQ ID NO: 636689 - RNA, 24 nt, Human
aucuuccuccuggccucccuauca

SEQ ID NO: 636690 - RNA, 28 nt, Human
auuuucagaguuaccuugucggaaaucc

SEQ ID NO: 636691 - RNA, 18 nt, Human
caaaguagggcucauucc

SEQ ID NO: 636692 - RNA, 21 nt, Human
cacaggcuuccugcuccccga

SEQ ID NO: 636693 - RNA, 24 nt, Human
cagccuaaggacguucuuaaggac

SEQ ID NO: 636694 - RNA, 21 nt, Human
caggugggcaggcacauggug

SEQ ID NO: 636695 - RNA, 20 nt, Human
cauggacugaagccuccagg

SEQ ID NO: 636696 - RNA, 18 nt, Human
cauggugggugcuuaacc

SEQ ID NO: 636697 - RNA, 19 nt, Human
cccuaagguagagaaaugu

SEQ ID NO: 636698 - RNA, 24 nt, Human
cccuagacccucaucaaaaccaac

SEQ ID NO: 636699 - RNA, 24 nt, Human
ccuaucuuccuccuggccucccua

SEQ ID NO: 636700 - RNA, 19 nt, Human
ccuccuggagcugagugga

SEQ ID NO: 636701 - RNA, 21 nt, Human
ccuccuggccucccuaucaaa

SEQ ID NO: 636702 - RNA, 19 nt, Human
ccucugcguguccauugcu

SEQ ID NO: 636703 - RNA, 22 nt, Human
ccucuugacaaccauacaaagu

SEQ ID NO: 636704 - RNA, 22 nt, Human
ccuggugauaaagaaaacacga

SEQ ID NO: 636705 - RNA, 22 nt, Human
ccuuguacuuauugacuuccuc

SEQ ID NO: 636706 - RNA, 18 nt, Human
cugagcaaugcaaagggg

SEQ ID NO: 636707 - RNA, 21 nt, Human
cugcuccccgaucccaccccu

SEQ ID NO: 636708 - RNA, 22 nt, Human
cuggcaccaaccagcuauggaa

SEQ ID NO: 636709 - RNA, 30 nt, Human
cuggugauaaagaaaacacgauuccuccuu

SEQ ID NO: 636710 - RNA, 22 nt, Human
gagaagaccugguuucucguuc

SEQ ID NO: 636711 - RNA, 21 nt, Human
gaugacggugacagggagaaa

SEQ ID NO: 636712 - RNA, 20 nt, Human
gcacauggugggugcuuaac

SEQ ID NO: 636713 - RNA, 23 nt, Human
gcacauggugggugcuuaaccaa

SEQ ID NO: 636714 - RNA, 19 nt, Human
gcaggcacauggugggugc

SEQ ID NO: 636715 - RNA, 23 nt, Human
gcuccccgaucccaccccugagc

SEQ ID NO: 636716 - RNA, 23 nt, Human
ggaagagagaacauccaaaugac

SEQ ID NO: 636717 - RNA, 22 nt, Human
ggcucuuccuuucuagcaguuu

SEQ ID NO: 636718 - RNA, 18 nt, Human
gggcaagugaaccucucu

SEQ ID NO: 636719 - RNA, 18 nt, Human
gugaaccucucuggugcc

SEQ ID NO: 636720 - RNA, 24 nt, Human
guggaugacggugacagggagaaa

SEQ ID NO: 636721 - RNA, 21 nt, Human
guguccauugcuuuauacaua

SEQ ID NO: 636722 - RNA, 25 nt, Human
uaaccugcaaaggauugugguaucu

SEQ ID NO: 636723 - RNA, 26 nt, Human
uaagguagagaaaugucuaaaaauca

SEQ ID NO: 636724 - RNA, 21 nt, Human
uagaagaagccccuggugaua

SEQ ID NO: 636725 - RNA, 21 nt, Human
ucaaguucacacagguggugg

SEQ ID NO: 636726 - RNA, 19 nt, Human
ucagaguuaccuuguacuu

SEQ ID NO: 636727 - RNA, 26 nt, Human
ucagaguuaccuuguacuuauugacc

SEQ ID NO: 636728 - RNA, 19 nt, Human
uccccuuguuuacagauga

SEQ ID NO: 636729 - RNA, 19 nt, Human
ucccuagccucccuuuggu

SEQ ID NO: 636730 - RNA, 22 nt, Human
uccgugagguucgauaaauggc

SEQ ID NO: 636731 - RNA, 22 nt, Human
uccugcuccccgaucccacccc

SEQ ID NO: 636732 - RNA, 24 nt, Human
ucugcaaaacugugggugacagga

SEQ ID NO: 636733 - RNA, 19 nt, Human
ucuucauacaugcccaguu

SEQ ID NO: 636734 - RNA, 21 nt, Human
ugaagccuccagggaaagaaa

SEQ ID NO: 636735 - RNA, 26 nt, Human
ugacggugacagggagaaaccaauac

SEQ ID NO: 636736 - RNA, 24 nt, Human
ugagguucgauaaauggcucaagu

SEQ ID NO: 636737 - RNA, 22 nt, Human
ugaguucacaaggugaagggau

SEQ ID NO: 636738 - RNA, 19 nt, Human
ugcauuucuaacacagccu

SEQ ID NO: 636739 - RNA, 22 nt, Human
ugcccuagacccucaucaaaac

SEQ ID NO: 636740 - RNA, 19 nt, Human
ugucugcaaaacugugggu

SEQ ID NO: 636741 - RNA, 20 nt, Human
uuaaggacucagggauucau

SEQ ID NO: 636742 - RNA, 23 nt, Human
uuauacauauugucucaaauccu

SEQ ID NO: 636743 - RNA, 18 nt, Human
uucaacauggacugaagc

SEQ ID NO: 636744 - RNA, 23 nt, Human
uuccugcuccccgaucccacccc

SEQ ID NO: 636745 - RNA, 20 nt, Human
uuggcggagauggcuuuccu

SEQ ID NO: 636746 - RNA, 20 nt, Human
uugggccuaucuuccuccug

SEQ ID NO: 636747 - RNA, 22 nt, Human
uuuccugucccuagccucccuu

SEQ ID NO: 636748 - RNA, 23 nt, Human
uuuccugucccuagccucccuuu

SEQ ID NO: 636749 - RNA, 21 nt, Human
uuuuuuuuuuuuuuuuaucuu

SEQ ID NO: 636750 - RNA, 23 nt, Human
acaaacacagacauauggggaua

SEQ ID NO: 636751 - RNA, 26 nt, Human
caaacaaacacagacauauggggaua

SEQ ID NO: 636752 - RNA, 23 nt, Human
cuucagcccuggcaggcacgaua

SEQ ID NO: 636753 - RNA, 18 nt, Human
ggcagcuucagcccuggc

SEQ ID NO: 636754 - RNA, 22 nt, Human
uggcaggcacgauagaagaaaa

SEQ ID NO: 636755 - RNA, 22 nt, Human
uuuuuuuuuuuuuuuuuccauu

SEQ ID NO: 636756 - RNA, 25 nt, Human
uuuuuuuuuuuuuuuuuuccauucu

SEQ ID NO: 636757 - RNA, 20 nt, Human
accuggagagggacuugggg

SEQ ID NO: 636758 - RNA, 20 nt, Human
agagagcaccaugaaaguac

SEQ ID NO: 636759 - RNA, 25 nt, Human
aggagcuugagguucuccuuuggcc

SEQ ID NO: 636760 - RNA, 22 nt, Human
auugcaaacucccuaauaucac

SEQ ID NO: 636761 - RNA, 19 nt, Human
cagaagguagagagcacca

SEQ ID NO: 636762 - RNA, 23 nt, Human
caggaaggagcuggaucaggcca

SEQ ID NO: 636763 - RNA, 19 nt, Human
ccaggagcuugagguucuc

SEQ ID NO: 636764 - RNA, 22 nt, Human
ccaggagcuugagguucuccuu

SEQ ID NO: 636765 - RNA, 19 nt, Human
cccagguuuccagcuccuc

SEQ ID NO: 636766 - RNA, 20 nt, Human
cgggaugggggccagaaggu

SEQ ID NO: 636767 - RNA, 21 nt, Human
cgggaugggggccagaaggua

SEQ ID NO: 636768 - RNA, 23 nt, Human
cuugagguucuccuuuccuaagg

SEQ ID NO: 636769 - RNA, 18 nt, Human
gaaagcuuccaaggacuu

SEQ ID NO: 636770 - RNA, 18 nt, Human
gacuugggguagagaagg

SEQ ID NO: 636771 - RNA, 19 nt, Human
gacuugggguagagaaggc

SEQ ID NO: 636772 - RNA, 18 nt, Human
ggagagggacuuggggua

SEQ ID NO: 636773 - RNA, 22 nt, Human
guauuccauccuugucagcugg

SEQ ID NO: 636774 - RNA, 19 nt, Human
ucauggcguauuccauccu

SEQ ID NO: 636775 - RNA, 22 nt, Human
uccuuuggccaacccaccccag

SEQ ID NO: 636776 - RNA, 18 nt, Human
ugagggagguguggggag

SEQ ID NO: 636777 - RNA, 20 nt, Human
ugcguuggaccucccccuca

SEQ ID NO: 636778 - RNA, 20 nt, Human
uggagagggacuugggguag

SEQ ID NO: 636779 - RNA, 21 nt, Human
uggaugggcuaagcugccuug

SEQ ID NO: 636780 - RNA, 22 nt, Human
uggggagguucgcggcucuaca

SEQ ID NO: 636781 - RNA, 21 nt, Human
uguggccacuaccaguuaagc

SEQ ID NO: 636782 - RNA, 24 nt, Human
uguggccacuaccaguuaagcgug

SEQ ID NO: 636783 - RNA, 22 nt, Human
uuccagcuccuccuccucacuc

SEQ ID NO: 636784 - RNA, 19 nt, Human
uuggccaacccaccccagg

SEQ ID NO: 636785 - RNA, 19 nt, Human
uuuccagcuccuccuccuc

SEQ ID NO: 636786 - RNA, 23 nt, Human
uuuuuuuuuuuuuuuuucagccu

SEQ ID NO: 636787 - RNA, 22 nt, Human
uuuuuuuuuuuuuuuuuuucag

SEQ ID NO: 636788 - RNA, 24 nt, Human
aaaagcucuggacugccuuuaacu

SEQ ID NO: 636789 - RNA, 25 nt, Human
aaacaaaacaaauuaaaaaaaaaaa

SEQ ID NO: 636790 - RNA, 22 nt, Human
aacccuuaaagcuggagcuuaa

SEQ ID NO: 636791 - RNA, 26 nt, Human
aagcaggagaacgccucaccuuccac

SEQ ID NO: 636792 - RNA, 20 nt, Human
aagcaggaugaggaagagug

SEQ ID NO: 636793 - RNA, 24 nt, Human
aagggguuuggguggagaaaaaga

SEQ ID NO: 636794 - RNA, 22 nt, Human
aaucacuaccuaccaaaugcua

SEQ ID NO: 636795 - RNA, 25 nt, Human
aaucacuaccuaccaaaugcuaucc

SEQ ID NO: 636796 - RNA, 22 nt, Human
acaaaacuuaguucagcaaggc

SEQ ID NO: 636797 - RNA, 21 nt, Human
acccuuaaagcuggagcuuaa

SEQ ID NO: 636798 - RNA, 18 nt, Human
agaagagcugccgccucc

SEQ ID NO: 636799 - RNA, 21 nt, Human
agcaguucccugaacccccaa

SEQ ID NO: 636800 - RNA, 21 nt, Human
aggaagagugagggaaggccg

SEQ ID NO: 636801 - RNA, 18 nt, Human
aggaugaggaagagugag

SEQ ID NO: 636802 - RNA, 23 nt, Human
aggcagucuuguuuuugucgugg

SEQ ID NO: 636803 - RNA, 23 nt, Human
agguguagaaugccagauuccuu

SEQ ID NO: 636804 - RNA, 22 nt, Human
aguaggagacaaauuggcugaa

SEQ ID NO: 636805 - RNA, 20 nt, Human
agugagggaaggcggggaca

SEQ ID NO: 636806 - RNA, 24 nt, Human
auauacaccaauuccaaaauaaaa

SEQ ID NO: 636807 - RNA, 20 nt, Human
aucggccgcuuugggacuga

SEQ ID NO: 636808 - RNA, 21 nt, Human
caacccccgagacggugagga

SEQ ID NO: 636809 - RNA, 22 nt, Human
caagcaguucccugaaccccca

SEQ ID NO: 636810 - RNA, 24 nt, Human
cacagcaaacgcuccaggccuggg

SEQ ID NO: 636811 - RNA, 21 nt, Human
cacccugggcaagcaguuccc

SEQ ID NO: 636812 - RNA, 22 nt, Human
cagucuuguuuuugucguggga

SEQ ID NO: 636813 - RNA, 19 nt, Human
caucacacucacacugcac

SEQ ID NO: 636814 - RNA, 23 nt, Human
caucacacucacacugcacccug

SEQ ID NO: 636815 - RNA, 27 nt, Human
ccaauuccaaaauaaaacaaucaaaug

SEQ ID NO: 636816 - RNA, 18 nt, Human
cccagaagagcugccgcc

SEQ ID NO: 636817 - RNA, 22 nt, Human
ccccaaggggcucacaacccuu

SEQ ID NO: 636818 - RNA, 22 nt, Human
cccccaaggggcucacaacccu

SEQ ID NO: 636819 - RNA, 22 nt, Human
cccccgagacggugaggacagg

SEQ ID NO: 636820 - RNA, 29 nt, Human
cccccgagacggugaggacaggcuuccgg

SEQ ID NO: 636821 - RNA, 20 nt, Human
cccccuguaagccagaucca

SEQ ID NO: 636822 - RNA, 27 nt, Human
cccccuguaagccagauccagugggau

SEQ ID NO: 636823 - RNA, 21 nt, Human
cccugaacccccaaggggcuc

SEQ ID NO: 636824 - RNA, 18 nt, Human
ccgaccccccuguaagcc

SEQ ID NO: 636825 - RNA, 28 nt, Human
ccgguggcccaucacacucacacugcac

SEQ ID NO: 636826 - RNA, 23 nt, Human
ccuuccacuccugcuuugucucc

SEQ ID NO: 636827 - RNA, 19 nt, Human
cgccucaccuuccacuccu

SEQ ID NO: 636828 - RNA, 22 nt, Human
cggaagagagggaggcagucuu

SEQ ID NO: 636829 - RNA, 25 nt, Human
cuauccgcagaguuaaaggauuaag

SEQ ID NO: 636830 - RNA, 18 nt, Human
cucacaacccuuaaagcu

SEQ ID NO: 636831 - RNA, 18 nt, Human
cugaaaggcccaaggcug

SEQ ID NO: 636832 - RNA, 21 nt, Human
gagaagcaggaugaggaagag

SEQ ID NO: 636833 - RNA, 19 nt, Human
gcccaaggcugucaccagc

SEQ ID NO: 636834 - RNA, 21 nt, Human
gcuuccgaccccccuguaagc

SEQ ID NO: 636835 - RNA, 22 nt, Human
gggacugaaaggcccaaggcug

SEQ ID NO: 636836 - RNA, 18 nt, Human
gggcggucaccuucccuc

SEQ ID NO: 636837 - RNA, 18 nt, Human
guccagguguagaaugcc

SEQ ID NO: 636838 - RNA, 19 nt, Human
uaaaacaaaacaaauuaaa

SEQ ID NO: 636839 - RNA, 18 nt, Human
uaaagccuccuggcuuag

SEQ ID NO: 636840 - RNA, 24 nt, Human
uaaguacauaggucuuuauuuaaa

SEQ ID NO: 636841 - RNA, 27 nt, Human
uacaagcaggagaacgccucaccuucc

SEQ ID NO: 636842 - RNA, 23 nt, Human
uauauacacacaaaacuuaguuc

SEQ ID NO: 636843 - RNA, 18 nt, Human
ucacacugcacccugggc

SEQ ID NO: 636844 - RNA, 24 nt, Human
ucacuaccuaccaaaugcuauccg

SEQ ID NO: 636845 - RNA, 23 nt, Human
ucccggaagagagggaggcaguc

SEQ ID NO: 636846 - RNA, 22 nt, Human
ucccugaacccccaaggggcuc

SEQ ID NO: 636847 - RNA, 18 nt, Human
uccgcagaguuaaaggau

SEQ ID NO: 636848 - RNA, 23 nt, Human
ugaggaagagugagggaaggcgg

SEQ ID NO: 636849 - RNA, 19 nt, Human
ugccccgguggcccaucac

SEQ ID NO: 636850 - RNA, 21 nt, Human
ugcuuugucuccuuugcucua

SEQ ID NO: 636851 - RNA, 18 nt, Human
ugggaagggguuugggug

SEQ ID NO: 636852 - RNA, 19 nt, Human
uguguauuuauuauucaca

SEQ ID NO: 636853 - RNA, 19 nt, Human
uucauuguguauuuauuau

SEQ ID NO: 636854 - RNA, 19 nt, Human
aagacagcucucugccccc

SEQ ID NO: 636855 - RNA, 19 nt, Human
aagcacacacucugcaaac

SEQ ID NO: 636856 - RNA, 19 nt, Human
acaaauaccccauugcacc

SEQ ID NO: 636857 - RNA, 21 nt, Human
acagccaagcacacacucugc

SEQ ID NO: 636858 - RNA, 18 nt, Human
agcccagagccucggagg

SEQ ID NO: 636859 - RNA, 19 nt, Human
aggaagggcaggcuugaga

SEQ ID NO: 636860 - RNA, 20 nt, Human
aggcaaaaaggugguguuug

SEQ ID NO: 636861 - RNA, 21 nt, Human
aggcaaaaaggugguguuugg

SEQ ID NO: 636862 - RNA, 21 nt, Human
aggcugcccucccucucauuc

SEQ ID NO: 636863 - RNA, 24 nt, Human
agugcagugagugugggguccugg

SEQ ID NO: 636864 - RNA, 22 nt, Human
auuccccuccugauccacaauc

SEQ ID NO: 636865 - RNA, 27 nt, Human
cacagccaagcacacacucugcaaacc

SEQ ID NO: 636866 - RNA, 19 nt, Human
caccccccacccccagggc

SEQ ID NO: 636867 - RNA, 22 nt, Human
cacucugcaaaccuaucacugc

SEQ ID NO: 636868 - RNA, 20 nt, Human
cacugcgaguaguacaguuc

SEQ ID NO: 636869 - RNA, 18 nt, Human
cagaaggcugcccucccu

SEQ ID NO: 636870 - RNA, 24 nt, Human
cagcagcguucuccaagcuaggcu

SEQ ID NO: 636871 - RNA, 18 nt, Human
cagcaggggcucugaggc

SEQ ID NO: 636872 - RNA, 21 nt, Human
cagcguucuccaagcuaggcc

SEQ ID NO: 636873 - RNA, 19 nt, Human
cauuuugcgaauccugaca

SEQ ID NO: 636874 - RNA, 22 nt, Human
ccaagcuaggcugccacagcca

SEQ ID NO: 636875 - RNA, 18 nt, Human
ccacagccaagcacacac

SEQ ID NO: 636876 - RNA, 18 nt, Human
ccaccaccccccaccccc

SEQ ID NO: 636877 - RNA, 19 nt, Human
ccccccacccccagggcug

SEQ ID NO: 636878 - RNA, 18 nt, Human
cccugcccaccacccccc

SEQ ID NO: 636879 - RNA, 21 nt, Human
cccugcccaccaccccccacc

SEQ ID NO: 636880 - RNA, 19 nt, Human
ccugauccacaaucacagu

SEQ ID NO: 636881 - RNA, 20 nt, Human
ccugauccacaaucacaguu

SEQ ID NO: 636882 - RNA, 21 nt, Human
ccugcccaccaccccccaccc

SEQ ID NO: 636883 - RNA, 21 nt, Human
ccugugggugcagcccagagc

SEQ ID NO: 636884 - RNA, 18 nt, Human
cgucuaggaagggcaggc

SEQ ID NO: 636885 - RNA, 20 nt, Human
cgucuaggaagggcaggcuu

SEQ ID NO: 636886 - RNA, 23 nt, Human
uaccugugggugcagcccagagc

SEQ ID NO: 636887 - RNA, 24 nt, Human
ucagcaggggcucugaggccagga

SEQ ID NO: 636888 - RNA, 25 nt, Human
ucccucugacuugagaccaucuccc

SEQ ID NO: 636889 - RNA, 18 nt, Human
ucccugcccaccaccccc

SEQ ID NO: 636890 - RNA, 19 nt, Human
ucugcaaaccuaucacugc

SEQ ID NO: 636891 - RNA, 18 nt, Human
ucugcuucccucugacuu

SEQ ID NO: 636892 - RNA, 18 nt, Human
ugacugccaguggaggcg

SEQ ID NO: 636893 - RNA, 21 nt, Human
ugacugccaguggaggcgacc

SEQ ID NO: 636894 - RNA, 21 nt, Human
ugacuugagaccaucucccuu

SEQ ID NO: 636895 - RNA, 19 nt, Human
ugaggcaaaaagguggugu

SEQ ID NO: 636896 - RNA, 19 nt, Human
ugaggcaaaaagguggugu

SEQ ID NO: 636897 - RNA, 19 nt, Human
uggaggcgacacagguggc

SEQ ID NO: 636898 - RNA, 21 nt, Human
uggagguaccugugggugcag

SEQ ID NO: 636899 - RNA, 18 nt, Human
uggcagaaggcugcccuc

SEQ ID NO: 636900 - RNA, 25 nt, Human
uggcagaaggcugcccucccucuca

SEQ ID NO: 636901 - RNA, 22 nt, Human
uggccgucuaggaagggcaggc

SEQ ID NO: 636902 - RNA, 23 nt, Human
ugggguccugcagguggccgucu

SEQ ID NO: 636903 - RNA, 21 nt, Human
ugugggugcagcccagagccu

SEQ ID NO: 636904 - RNA, 21 nt, Human
uguuuggaaaacagcacacgg

SEQ ID NO: 636905 - RNA, 21 nt, Human
uuccccuccugauccacaauc

SEQ ID NO: 636906 - RNA, 19 nt, Human
uuuacagagaccuugaggc

SEQ ID NO: 636907 - RNA, 25 nt, Human
uuugcgaauccugacauuccccucu

SEQ ID NO: 636908 - RNA, 19 nt, Human
aacacguugaaaccccguc

SEQ ID NO: 636909 - RNA, 20 nt, Human
aacacguugaaaccccgucu

SEQ ID NO: 636910 - RNA, 21 nt, Human
aacacguugaaaccccgucuc

SEQ ID NO: 636911 - RNA, 19 nt, Human
agacugagaccauccuggc

SEQ ID NO: 636912 - RNA, 23 nt, Human
aggacgguggcucacaccuguaa

SEQ ID NO: 636913 - RNA, 21 nt, Human
aggccgaggcgggcggaucac

SEQ ID NO: 636914 - RNA, 19 nt, Human
agggccucacgcacgcccc

SEQ ID NO: 636915 - RNA, 21 nt, Human
auccuggccaacacguugaaa

SEQ ID NO: 636916 - RNA, 24 nt, Human
caacacguugaaaccccgucucua

SEQ ID NO: 636917 - RNA, 22 nt, Human
caacacuuugggaggccgaggc

SEQ ID NO: 636918 - RNA, 24 nt, Human
caacacuuugggaggccgaggcgg

SEQ ID NO: 636919 - RNA, 24 nt, Human
cacaccuguaaucccaacacuuug

SEQ ID NO: 636920 - RNA, 19 nt, Human
caccuguaaucccaacacu

SEQ ID NO: 636921 - RNA, 24 nt, Human
caccuguaaucccaacacuuuggg

SEQ ID NO: 636922 - RNA, 23 nt, Human
cacguugaaaccccgucucuaac

SEQ ID NO: 636923 - RNA, 19 nt, Human
cccucguacacacacucag

SEQ ID NO: 636924 - RNA, 23 nt, Human
ccuggccaacacguugaaacccc

SEQ ID NO: 636925 - RNA, 24 nt, Human
ccuggccaacacguugaaaccccg

SEQ ID NO: 636926 - RNA, 22 nt, Human
cgaggcgggcggaucacagggu

SEQ ID NO: 636927 - RNA, 26 nt, Human
cgaggcgggcggaucacagggucugg

SEQ ID NO: 636928 - RNA, 23 nt, Human
cggccaggacgguggcucacacc

SEQ ID NO: 636929 - RNA, 22 nt, Human
cucacaccuguaaucccaacac

SEQ ID NO: 636930 - RNA, 24 nt, Human
cucacaccuguaaucccaacacuu

SEQ ID NO: 636931 - RNA, 19 nt, Human
gaucacagggucuggagac

SEQ ID NO: 636932 - RNA, 20 nt, Human
gaucacagggucuggagacu

SEQ ID NO: 636933 - RNA, 20 nt, Human
ggccaggacgguggcucaca

SEQ ID NO: 636934 - RNA, 18 nt, Human
gggcggaucacagggucu

SEQ ID NO: 636935 - RNA, 23 nt, Human
gguggcucacaccuguaauccca

SEQ ID NO: 636936 - RNA, 24 nt, Human
ucacagggucuggagacugagacc

SEQ ID NO: 636937 - RNA, 19 nt, Human
ucucuaacgccagccaagg

SEQ ID NO: 636938 - RNA, 23 nt, Human
ugagaccauccuggccaacacgu

SEQ ID NO: 636939 - RNA, 21 nt, Human
uggcucacaccuguaauccca

SEQ ID NO: 636940 - RNA, 19 nt, Human
ugggaggccgaggcgggcg

SEQ ID NO: 636941 - RNA, 24 nt, Human
ugggaggccgaggcgggcggauca

SEQ ID NO: 636942 - RNA, 25 nt, Human
uugggaggccgaggcgggcggauca

SEQ ID NO: 636943 - RNA, 18 nt, Human
uuuuuuuuuugccgggcc

SEQ ID NO: 636944 - RNA, 19 nt, Human
uuuuuuuuuuuuuugccgg

SEQ ID NO: 636945 - RNA, 22 nt, Human
uuuuuuuuuuuuuuuuugccgg

SEQ ID NO: 636946 - RNA, 23 nt, Human
uuuuuuuuuuuuuuuuugccggg

SEQ ID NO: 636947 - RNA, 27 nt, Human
uuuuuuuuuuuuuuuuuuuuuuugggg

SEQ ID NO: 636948 - RNA, 18 nt, Human
aaacagacacgaacacga

SEQ ID NO: 636949 - RNA, 18 nt, Human
aagaacccagggccagga

SEQ ID NO: 636950 - RNA, 19 nt, Human
aagcggagcgcagggcagc

SEQ ID NO: 636951 - RNA, 21 nt, Human
aaggaaucgagcaaaacagac

SEQ ID NO: 636952 - RNA, 20 nt, Human
aagugcguguggucguggag

SEQ ID NO: 636953 - RNA, 20 nt, Human
aaucccaaagcaaagcggag

SEQ ID NO: 636954 - RNA, 20 nt, Human
aauguuccagaugagcaugg

SEQ ID NO: 636955 - RNA, 22 nt, Human
acccagggccaggagugcgccg

SEQ ID NO: 636956 - RNA, 19 nt, Human
acgcauggcgcagagguca

SEQ ID NO: 636957 - RNA, 22 nt, Human
agaauaaauuaaucccaaagca

SEQ ID NO: 636958 - RNA, 20 nt, Human
agcaaaacagacacgaacac

SEQ ID NO: 636959 - RNA, 18 nt, Human
agcaaagcggagcgcagg

SEQ ID NO: 636960 - RNA, 22 nt, Human
agcaaagcggagcgcagggcag

SEQ ID NO: 636961 - RNA, 19 nt, Human
aggagugcgccgucuuccc

SEQ ID NO: 636962 - RNA, 20 nt, Human
aggcagaacgagguuggccc

SEQ ID NO: 636963 - RNA, 20 nt, Human
agggagcagagggugggcag

SEQ ID NO: 636964 - RNA, 20 nt, Human
auggaacgcugagaagggcg

SEQ ID NO: 636965 - RNA, 20 nt, Human
cacacuccuuagcaccggcc

SEQ ID NO: 636966 - RNA, 18 nt, Human
cacgcauggcgcagaggu

SEQ ID NO: 636967 - RNA, 23 nt, Human
cagcagcaagaacccagggccag

SEQ ID NO: 636968 - RNA, 22 nt, Human
cagcagugggagucgagcccgc

SEQ ID NO: 636969 - RNA, 20 nt, Human
cagcuuccagcuuccacccu

SEQ ID NO: 636970 - RNA, 21 nt, Human
ccaaagcaaagcggagcgcag

SEQ ID NO: 636971 - RNA, 18 nt, Human
cccgggaagcggaggccg

SEQ ID NO: 636972 - RNA, 23 nt, Human
ccuccagggcaguuggccggucc

SEQ ID NO: 636973 - RNA, 22 nt, Human
ccucugcacgagcaggggaagu

SEQ ID NO: 636974 - RNA, 19 nt, Human
ccugcaccuggagcagggc

SEQ ID NO: 636975 - RNA, 24 nt, Human
ccugcaccuggagcagggccaggc

SEQ ID NO: 636976 - RNA, 19 nt, Human
ccuggaaagcagaguggcu

SEQ ID NO: 636977 - RNA, 18 nt, Human
ccugugccgcgcgugccu

SEQ ID NO: 636978 - RNA, 18 nt, Human
cgacauaacaguaaacgc

SEQ ID NO: 636979 - RNA, 20 nt, Human
cgccagcguggccagaaggc

SEQ ID NO: 636980 - RNA, 20 nt, Human
cggcagcagugggagucgag

SEQ ID NO: 636981 - RNA, 21 nt, Human
cgggaggccggcagcaguggg

SEQ ID NO: 636982 - RNA, 20 nt, Human
cggggcggcgcgggcggagg

SEQ ID NO: 636983 - RNA, 22 nt, Human
cggguucacagcuccucugugc

SEQ ID NO: 636984 - RNA, 21 nt, Human
cguggccagaaggcaggcgcc

SEQ ID NO: 636985 - RNA, 23 nt, Human
cuccagggcaguuggccgguccu

SEQ ID NO: 636986 - RNA, 20 nt, Human
cucgggaggccggcagcagu

SEQ ID NO: 636987 - RNA, 24 nt, Human
cugaaaccaucacuaaccggcuag

SEQ ID NO: 636988 - RNA, 21 nt, Human
cugcagcaguggaaaacagag

SEQ ID NO: 636989 - RNA, 18 nt, Human
cuggagcagggccaggcc

SEQ ID NO: 636990 - RNA, 20 nt, Human
cuggagcagggccaggccug

SEQ ID NO: 636991 - RNA, 19 nt, Human
cugugucucagcuuccagc

SEQ ID NO: 636992 - RNA, 22 nt, Human
cuuauccuccuuccugcaccug

SEQ ID NO: 636993 - RNA, 21 nt, Human
gagcaaaacagacacgaacac

SEQ ID NO: 636994 - RNA, 22 nt, Human
gagcccgcgccacacuccuuag

SEQ ID NO: 636995 - RNA, 26 nt, Human
gagcccgcgccacacuccuuagcacc

SEQ ID NO: 636996 - RNA, 23 nt, Human
gagcggcugaugacaaucacccg

SEQ ID NO: 636997 - RNA, 24 nt, Human
gagcggguucacagcuccucugug

SEQ ID NO: 636998 - RNA, 20 nt, Human
gagucacucgggaggccggc

SEQ ID NO: 636999 - RNA, 18 nt, Human
gcagagaggaaaugguug

SEQ ID NO: 637000 - RNA, 24 nt, Human
gcagaggucacccagacucauccc

SEQ ID NO: 637001 - RNA, 22 nt, Human
gcccaugggaugguccaggugu

SEQ ID NO: 637002 - RNA, 21 nt, Human
gcgcagggcagccucgcgcca

SEQ ID NO: 637003 - RNA, 19 nt, Human
ggcagcagcaagaacccag

SEQ ID NO: 637004 - RNA, 18 nt, Human
ggccggcagcagugggag

SEQ ID NO: 637005 - RNA, 18 nt, Human
gggagcagagggugggca

SEQ ID NO: 637006 - RNA, 18 nt, Human
gggcggcgcgggcggagg

SEQ ID NO: 637007 - RNA, 19 nt, Human
gguccuggaaagcagagug

SEQ ID NO: 637008 - RNA, 23 nt, Human
guaagauauggcuggggugcccc

SEQ ID NO: 637009 - RNA, 23 nt, Human
guucacagcuccucugugcugcc

SEQ ID NO: 637010 - RNA, 24 nt, Human
uaacaguaaacgcacacgugucuc

SEQ ID NO: 637011 - RNA, 22 nt, Human
ucacucgggaggccggcagcag

SEQ ID NO: 637012 - RNA, 22 nt, Human
uccagcccacggcgaaagcgcg

SEQ ID NO: 637013 - RNA, 19 nt, Human
ucccaaagcaaagcggagc

SEQ ID NO: 637014 - RNA, 23 nt, Human
ucccgggaagcggaggccggccu

SEQ ID NO: 637015 - RNA, 22 nt, Human
uccgcggccgcacguccaggga

SEQ ID NO: 637016 - RNA, 21 nt, Human
ucugugcugccugggccccug

SEQ ID NO: 637017 - RNA, 19 nt, Human
ucuucccgggaagcggagg

SEQ ID NO: 637018 - RNA, 22 nt, Human
ugaccgacauaacaguaaacgc

SEQ ID NO: 637019 - RNA, 24 nt, Human
ugagaagggcgacucagcauggug

SEQ ID NO: 637020 - RNA, 19 nt, Human
ugaugacaaucacccgggg

SEQ ID NO: 637021 - RNA, 21 nt, Human
ugccaggcuccgggcagggug

SEQ ID NO: 637022 - RNA, 20 nt, Human
uggagcagggccaggccugu

SEQ ID NO: 637023 - RNA, 20 nt, Human
uggagcggguucacagcucc

SEQ ID NO: 637024 - RNA, 18 nt, Human
uggaugccuccagggcag

SEQ ID NO: 637025 - RNA, 19 nt, Human
uggcccacgacacguacag

SEQ ID NO: 637026 - RNA, 19 nt, Human
uggccgguguggagcgggu

SEQ ID NO: 637027 - RNA, 19 nt, Human
ugggaugguccaggugugc

SEQ ID NO: 637028 - RNA, 21 nt, Human
uggugguggagucccuugguu

SEQ ID NO: 637029 - RNA, 21 nt, Human
ugugccgccucucggcccggc

SEQ ID NO: 637030 - RNA, 21 nt, Human
ugugcugccugggccccugug

SEQ ID NO: 637031 - RNA, 26 nt, Human
uuaaucccaaagcaaagcggagcgca

SEQ ID NO: 637032 - RNA, 21 nt, Human
uucacagcuccucugugcugc

SEQ ID NO: 637033 - RNA, 23 nt, Human
uucccuggcucucagcagagagg

SEQ ID NO: 637034 - RNA, 24 nt, Human
aaugugggggauggacaggaggga

SEQ ID NO: 637035 - RNA, 23 nt, Human
accuugugcccaggcgaguuccc

SEQ ID NO: 637036 - RNA, 21 nt, Human
aggagggagggccugggcagg

SEQ ID NO: 637037 - RNA, 20 nt, Human
ccaaccggccaggacaggcc

SEQ ID NO: 637038 - RNA, 23 nt, Human
cgaaaacagaaagcucuuuaugc

SEQ ID NO: 637039 - RNA, 20 nt, Human
gaaugugggggauggacagg

SEQ ID NO: 637040 - RNA, 21 nt, Human
gacaggggaaugugggggaug

SEQ ID NO: 637041 - RNA, 21 nt, Human
gccagguugcauucugacagg

SEQ ID NO: 637042 - RNA, 22 nt, Human
ggacaggagggagggccugggc

SEQ ID NO: 637043 - RNA, 19 nt, Human
ggggauggacaggagggag

SEQ ID NO: 637044 - RNA, 24 nt, Human
uaugccaaaucacaaggacagaca

SEQ ID NO: 637045 - RNA, 22 nt, Human
ucccggacccauccaggagcuc

SEQ ID NO: 637046 - RNA, 22 nt, Human
ugccaaaucacaaggacagaca

SEQ ID NO: 637047 - RNA, 18 nt, Human
ugugccuggcucagaacu

SEQ ID NO: 637048 - RNA, 21 nt, Human
uucccggacccauccaggagc

SEQ ID NO: 637049 - RNA, 26 nt, Human
uuuuuuuuuuucgaaaacagaaagcu

SEQ ID NO: 637050 - RNA, 18 nt, Human
uuuuuuuuuuuuuuuucg

SEQ ID NO: 637051 - RNA, 25 nt, Human
aaagacuuggcgaggauuuacagaa

SEQ ID NO: 637052 - RNA, 23 nt, Human
aauaaguagcagagaaucuuaca

SEQ ID NO: 637053 - RNA, 24 nt, Human
aaucuuacagagucgucccuuuga

SEQ ID NO: 637054 - RNA, 22 nt, Human
acaccacugcaguccccugugc

SEQ ID NO: 637055 - RNA, 21 nt, Human
accccuuccccaauugccacc

SEQ ID NO: 637056 - RNA, 23 nt, Human
agaaccccuuccccaauugccac

SEQ ID NO: 637057 - RNA, 18 nt, Human
agaguuguuuauuucuga

SEQ ID NO: 637058 - RNA, 18 nt, Human
agcccagaaccccuuccc

SEQ ID NO: 637059 - RNA, 21 nt, Human
agcccagaaccccuuccccaa

SEQ ID NO: 637060 - RNA, 23 nt, Human
agcccagaaccccuuccccaauu

SEQ ID NO: 637061 - RNA, 20 nt, Human
aggcaggguuaaacagggug

SEQ ID NO: 637062 - RNA, 21 nt, Human
aguggcucuggacaagucacu

SEQ ID NO: 637063 - RNA, 25 nt, Human
augaguaacagaaaccauggauggg

SEQ ID NO: 637064 - RNA, 20 nt, Human
caaagcacaccacugcaguc

SEQ ID NO: 637065 - RNA, 18 nt, Human
cacugcaguccccugugc

SEQ ID NO: 637066 - RNA, 26 nt, Human
cagcccagaaccccuuccccaauugc

SEQ ID NO: 637067 - RNA, 24 nt, Human
caguccccugugccauguuggagu

SEQ ID NO: 637068 - RNA, 19 nt, Human
ccaaagcacaccacugcag

SEQ ID NO: 637069 - RNA, 21 nt, Human
ccaaagcacaccacugcaguc

SEQ ID NO: 637070 - RNA, 19 nt, Human
ccaccucgcccacgcgucc

SEQ ID NO: 637071 - RNA, 19 nt, Human
ccacgaagcucuggccugu

SEQ ID NO: 637072 - RNA, 21 nt, Human
ccagagugaaggaggguugaa

SEQ ID NO: 637073 - RNA, 24 nt, Human
ccagccaacgcaggggugaucagc

SEQ ID NO: 637074 - RNA, 19 nt, Human
ccaggccaggcgaguguuc

SEQ ID NO: 637075 - RNA, 20 nt, Human
cccaauugccaccucgccca

SEQ ID NO: 637076 - RNA, 21 nt, Human
cccagaggaggcugagaugag

SEQ ID NO: 637077 - RNA, 21 nt, Human
ccccagagaaauguuguccuu

SEQ ID NO: 637078 - RNA, 23 nt, Human
ccgaagaccaguguuuacuagca

SEQ ID NO: 637079 - RNA, 21 nt, Human
ccuauccuacauggccuggga

SEQ ID NO: 637080 - RNA, 22 nt, Human
ccuauccuacauggccugggaa

SEQ ID NO: 637081 - RNA, 21 nt, Human
ccuuggguggguacacagguc

SEQ ID NO: 637082 - RNA, 25 nt, Human
ccuuugaaggcaggguuaaacagga

SEQ ID NO: 637083 - RNA, 22 nt, Human
ccuuuugacagaguggcucugg

SEQ ID NO: 637084 - RNA, 19 nt, Human
cucauagccaucacucacu

SEQ ID NO: 637085 - RNA, 25 nt, Human
cugaaaccaugaguaacagaaacca

SEQ ID NO: 637086 - RNA, 27 nt, Human
cugaaaccaugaguaacagaaaccaug

SEQ ID NO: 637087 - RNA, 24 nt, Human
gaggaggcugagaugagcuaacca

SEQ ID NO: 637088 - RNA, 21 nt, Human
gccuuuccuucuccaucuggc

SEQ ID NO: 637089 - RNA, 18 nt, Human
gggaggaugacuggaguc

SEQ ID NO: 637090 - RNA, 21 nt, Human
guggcucuggacaagucacuu

SEQ ID NO: 637091 - RNA, 23 nt, Human
uaacagaaaccauggauggggga

SEQ ID NO: 637092 - RNA, 23 nt, Human
uacacagguccaaagcacaccac

SEQ ID NO: 637093 - RNA, 22 nt, Human
uaugaguaacugaaaccaugag

SEQ ID NO: 637094 - RNA, 24 nt, Human
uauuucugaaauuuuucauuuagu

SEQ ID NO: 637095 - RNA, 23 nt, Human
ucacaaguguccccauaaguaac

SEQ ID NO: 637096 - RNA, 24 nt, Human
ucccagaggaggcugagaugagcu

SEQ ID NO: 637097 - RNA, 24 nt, Human
ucuggcucugccuuuagccuuggg

SEQ ID NO: 637098 - RNA, 19 nt, Human
ugaaggcaggguuaaacag

SEQ ID NO: 637099 - RNA, 19 nt, Human
ugagaugagcuaaccagug

SEQ ID NO: 637100 - RNA, 20 nt, Human
ugagaugagcuaaccagugg

SEQ ID NO: 637101 - RNA, 19 nt, Human
ugaguaacagaaaccaugg

SEQ ID NO: 637102 - RNA, 23 nt, Human
ugaguaacagaaaccauggaugg

SEQ ID NO: 637103 - RNA, 20 nt, Human
ugaguaacugaaaccaugag

SEQ ID NO: 637104 - RNA, 27 nt, Human
ugccuccagccaacgcaggggugaucc

SEQ ID NO: 637105 - RNA, 18 nt, Human
ugccugcggcagcccaga

SEQ ID NO: 637106 - RNA, 18 nt, Human
ugccuuuagccuuggguu

SEQ ID NO: 637107 - RNA, 23 nt, Human
uggaguauccuauccuacauggc

SEQ ID NO: 637108 - RNA, 20 nt, Human
uggccuggagaaagacuugg

SEQ ID NO: 637109 - RNA, 19 nt, Human
ugggggaggaugacuggag

SEQ ID NO: 637110 - RNA, 22 nt, Human
ugugccugcggcagcccagaac

SEQ ID NO: 637111 - RNA, 23 nt, Human
ugugccugcggcagcccagaacc

SEQ ID NO: 637112 - RNA, 20 nt, Human
uucguugcucaccgaagacc

SEQ ID NO: 637113 - RNA, 21 nt, Human
uuuacagaauucugccuccag

SEQ ID NO: 637114 - RNA, 18 nt, Human
aacauagugaucccaucu

SEQ ID NO: 637115 - RNA, 19 nt, Human
aacauagugaucccaucuc

SEQ ID NO: 637116 - RNA, 19 nt, Human
acaauucuuuuacucugcu

SEQ ID NO: 637117 - RNA, 22 nt, Human
acaggcgauaaaaucccagagc

SEQ ID NO: 637118 - RNA, 25 nt, Human
acucugcucuuuucuagguugaagu

SEQ ID NO: 637119 - RNA, 23 nt, Human
acuuuauuagauccacaggcgau

SEQ ID NO: 637120 - RNA, 21 nt, Human
acuuugaucacuucauccauu

SEQ ID NO: 637121 - RNA, 21 nt, Human
agcaugggcaacauagugauc

SEQ ID NO: 637122 - RNA, 23 nt, Human
agcucugacucuguuuucuuuuu

SEQ ID NO: 637123 - RNA, 21 nt, Human
aggcccagaguccgacagcgg

SEQ ID NO: 637124 - RNA, 23 nt, Human
aggcgauaaaaucccagagcuac

SEQ ID NO: 637125 - RNA, 24 nt, Human
agugguucacgccuguaaucccag

SEQ ID NO: 637126 - RNA, 19 nt, Human
aucaagcuugugugacuca

SEQ ID NO: 637127 - RNA, 22 nt, Human
auccuaacacucugggagacca

SEQ ID NO: 637128 - RNA, 18 nt, Human
augccacuauuucuguuc

SEQ ID NO: 637129 - RNA, 22 nt, Human
caaacccaaaauguuaacauug

SEQ ID NO: 637130 - RNA, 21 nt, Human
cacagcgcaggaccgcccuuu

SEQ ID NO: 637131 - RNA, 22 nt, Human
cacagcgcaggaccgcccuuuc

SEQ ID NO: 637132 - RNA, 19 nt, Human
cacgccuguaaucccagca

SEQ ID NO: 637133 - RNA, 24 nt, Human
cacgccuguaauccuaacacucug

SEQ ID NO: 637134 - RNA, 18 nt, Human
cacuggcccgggcgcgcg

SEQ ID NO: 637135 - RNA, 25 nt, Human
cacuuuaaauagacacuuuauuaga

SEQ ID NO: 637136 - RNA, 25 nt, Human
cauuuucugcucugagggcugaaaa

SEQ ID NO: 637137 - RNA, 21 nt, Human
ccccgagcaguucacuggccc

SEQ ID NO: 637138 - RNA, 22 nt, Human
ccuguaauccuaacacucuggg

SEQ ID NO: 637139 - RNA, 18 nt, Human
cgagcgugggccacagcg

SEQ ID NO: 637140 - RNA, 24 nt, Human
cgauguccauguuggccuccagga

SEQ ID NO: 637141 - RNA, 23 nt, Human
cgccuguaauccuaacacucugg

SEQ ID NO: 637142 - RNA, 24 nt, Human
cgggaggaucuuugagcccaggag

SEQ ID NO: 637143 - RNA, 21 nt, Human
cguucaaugaauacaauucuu

SEQ ID NO: 637144 - RNA, 20 nt, Human
cucacgccuguaauccuaac

SEQ ID NO: 637145 - RNA, 23 nt, Human
cucacgccuguaauccuaacacu

SEQ ID NO: 637146 - RNA, 18 nt, Human
cugagggcugaaaauuca

SEQ ID NO: 637147 - RNA, 23 nt, Human
gaagucuaauuugguaucuguuc

SEQ ID NO: 637148 - RNA, 19 nt, Human
gagcaguucacuggcccgg

SEQ ID NO: 637149 - RNA, 21 nt, Human
gaggaucuuugagcccaggag

SEQ ID NO: 637150 - RNA, 23 nt, Human
gcccagaguccgacagcgggagc

SEQ ID NO: 637151 - RNA, 18 nt, Human
gcugggugugguggcuca

SEQ ID NO: 637152 - RNA, 21 nt, Human
gcugggugugguggcucacgc

SEQ ID NO: 637153 - RNA, 24 nt, Human
ggacacagugguucacgccuguaa

SEQ ID NO: 637154 - RNA, 18 nt, Human
ggcucacgccuguaaucc

SEQ ID NO: 637155 - RNA, 19 nt, Human
ggcugggugugguggcuca

SEQ ID NO: 637156 - RNA, 21 nt, Human
ggcugggugugguggcucacg

SEQ ID NO: 637157 - RNA, 24 nt, Human
gggugugguggcucacgccuguaa

SEQ ID NO: 637158 - RNA, 23 nt, Human
gguggcucacgccuguaauccua

SEQ ID NO: 637159 - RNA, 23 nt, Human
uaacauuguuuagcucugacucu

SEQ ID NO: 637160 - RNA, 22 nt, Human
ucacgccuguaaucccagcacu

SEQ ID NO: 637161 - RNA, 21 nt, Human
ucccagagcuacuguuaggca

SEQ ID NO: 637162 - RNA, 19 nt, Human
ucgcuuuuggcgccggcca

SEQ ID NO: 637163 - RNA, 19 nt, Human
ucugcucuuuucuagguug

SEQ ID NO: 637164 - RNA, 20 nt, Human
ucuggguaagggcccgaucu

SEQ ID NO: 637165 - RNA, 23 nt, Human
ugagcccaggaguucagaaccag

SEQ ID NO: 637166 - RNA, 22 nt, Human
uggcaacuggacacagugguuc

SEQ ID NO: 637167 - RNA, 23 nt, Human
uggcccgggcgcgcgcucaugcc

SEQ ID NO: 637168 - RNA, 24 nt, Human
uggcucacgccuguaauccuaaca

SEQ ID NO: 637169 - RNA, 23 nt, Human
uggcugggugugguggcucacgc

SEQ ID NO: 637170 - RNA, 22 nt, Human
ugguggcucacgccuguaaucc

SEQ ID NO: 637171 - RNA, 24 nt, Human
ugguucacgccuguaaucccagca

SEQ ID NO: 637172 - RNA, 25 nt, Human
uucauccauuacuuguuguuuuaac

SEQ ID NO: 637173 - RNA, 21 nt, Human
uuucucauuuucugcucugag

SEQ ID NO: 637174 - RNA, 19 nt, Human
uuuuuuuuuuuuucacuuu

SEQ ID NO: 637175 - RNA, 22 nt, Human
uuuuuuuuuuuuuuuucacuuu

SEQ ID NO: 637176 - RNA, 24 nt, Human
uuuuuuuuuuuuuuuucacuuuaa

SEQ ID NO: 637177 - RNA, 25 nt, Human
uuuuuuuuuuuuuuuucacuuuaau

SEQ ID NO: 637178 - RNA, 25 nt, Human
aaacuucccaaacagcucacaaucc

SEQ ID NO: 637179 - RNA, 18 nt, Human
aaaugcuguucacugaac

SEQ ID NO: 637180 - RNA, 25 nt, Human
aaccacaaguagcauccaaacagcc

SEQ ID NO: 637181 - RNA, 19 nt, Human
aaccagugcugggcgcccc

SEQ ID NO: 637182 - RNA, 19 nt, Human
aacuugccucuuguccccu

SEQ ID NO: 637183 - RNA, 19 nt, Human
aagaaaacaaacucagcga

SEQ ID NO: 637184 - RNA, 19 nt, Human
aauccaaugugaccucauc

SEQ ID NO: 637185 - RNA, 24 nt, Human
aauucaaccacaaguagcauccaa

SEQ ID NO: 637186 - RNA, 23 nt, Human
accugucccaugccucucugcug

SEQ ID NO: 637187 - RNA, 24 nt, Human
aggcuuuugcuaccauuccaaagc

SEQ ID NO: 637188 - RNA, 25 nt, Human
agggaaaggcagaggcgucccaagc

SEQ ID NO: 637189 - RNA, 22 nt, Human
agggagggagggaaaggcagag

SEQ ID NO: 637190 - RNA, 19 nt, Human
agggugauuuuggcuucac

SEQ ID NO: 637191 - RNA, 22 nt, Human
caaaacucucucuucuccuaag

SEQ ID NO: 637192 - RNA, 23 nt, Human
cagaccuggcaccaaauguccug

SEQ ID NO: 637193 - RNA, 22 nt, Human
cagcgauguuugcucacuuucc

SEQ ID NO: 637194 - RNA, 19 nt, Human
caggccccugaaaccuccu

SEQ ID NO: 637195 - RNA, 23 nt, Human
caggggaggccaggccagccccg

SEQ ID NO: 637196 - RNA, 22 nt, Human
caggugucccuccaccugugcu

SEQ ID NO: 637197 - RNA, 20 nt, Human
caugacagguacuugcugaa

SEQ ID NO: 637198 - RNA, 23 nt, Human
caugacuucuguuuuucuauguc

SEQ ID NO: 637199 - RNA, 21 nt, Human
cauuccaaagccaacaugaaa

SEQ ID NO: 637200 - RNA, 19 nt, Human
ccccugaaaccuccugagg

SEQ ID NO: 637201 - RNA, 21 nt, Human
cccgccacauccgcuuggccg

SEQ ID NO: 637202 - RNA, 20 nt, Human
ccuccaggugucccuccacc

SEQ ID NO: 637203 - RNA, 21 nt, Human
ccuccaggugucccuccaccu

SEQ ID NO: 637204 - RNA, 22 nt, Human
cgcuuccacgaaacuucccaaa

SEQ ID NO: 637205 - RNA, 18 nt, Human
cuaaaaguuuuccauuuc

SEQ ID NO: 637206 - RNA, 24 nt, Human
cugaaccagugcugggcgccccug

SEQ ID NO: 637207 - RNA, 20 nt, Human
cuuccuucuaaggcuugugg

SEQ ID NO: 637208 - RNA, 21 nt, Human
cuucucccuuuugagcagagg

SEQ ID NO: 637209 - RNA, 21 nt, Human
gaaacuucccaaacagcucac

SEQ ID NO: 637210 - RNA, 22 nt, Human
gaaacuucccaaacagcucacu

SEQ ID NO: 637211 - RNA, 18 nt, Human
gagauccuuggugucccu

SEQ ID NO: 637212 - RNA, 19 nt, Human
gaguauauccaggggaggc

SEQ ID NO: 637213 - RNA, 21 nt, Human
gcaaagacccuauuuccaaac

SEQ ID NO: 637214 - RNA, 19 nt, Human
gcugggcgccccugggcag

SEQ ID NO: 637215 - RNA, 19 nt, Human
ggaagggagggagggaaag

SEQ ID NO: 637216 - RNA, 18 nt, Human
ggcugcaucacuccaacu

SEQ ID NO: 637217 - RNA, 20 nt, Human
gggaaagcccgcuuggaggc

SEQ ID NO: 637218 - RNA, 22 nt, Human
gggccaugcuuccuucuaaggc

SEQ ID NO: 637219 - RNA, 18 nt, Human
ggggaaagcccgcuugga

SEQ ID NO: 637220 - RNA, 19 nt, Human
ggggaagggagggagggaa

SEQ ID NO: 637221 - RNA, 24 nt, Human
ggugucccuccaccugugcuggca

SEQ ID NO: 637222 - RNA, 19 nt, Human
guccaggggaaagcccgcu

SEQ ID NO: 637223 - RNA, 19 nt, Human
gugcugggcgccccugggc

SEQ ID NO: 637224 - RNA, 23 nt, Human
uagaguauauccaggggaggcca

SEQ ID NO: 637225 - RNA, 21 nt, Human
uauagaguauauccaggggag

SEQ ID NO: 637226 - RNA, 25 nt, Human
uauucuuccaguucuggagucugga

SEQ ID NO: 637227 - RNA, 18 nt, Human
ucaacaggccccugaaac

SEQ ID NO: 637228 - RNA, 23 nt, Human
ucacggggauggggguuaagacu

SEQ ID NO: 637229 - RNA, 18 nt, Human
ucaugucaacaggccccu

SEQ ID NO: 637230 - RNA, 18 nt, Human
uccaccugugcuggcacu

SEQ ID NO: 637231 - RNA, 24 nt, Human
uccccuggucuucuucccacugca

SEQ ID NO: 637232 - RNA, 18 nt, Human
ucccuuuugagcagaggu

SEQ ID NO: 637233 - RNA, 21 nt, Human
ucccuuuugagcagaggucau

SEQ ID NO: 637234 - RNA, 18 nt, Human
uccuucuaaggcuugugg

SEQ ID NO: 637235 - RNA, 22 nt, Human
ucuaaaaguuuuccauuucuuc

SEQ ID NO: 637236 - RNA, 21 nt, Human
ucucuugacauugaauuccag

SEQ ID NO: 637237 - RNA, 21 nt, Human
ucugcaaagacccuauuucca

SEQ ID NO: 637238 - RNA, 30 nt, Human
ugauaaaaaauaaaaaaauacauguacagg

SEQ ID NO: 637239 - RNA, 21 nt, Human
ugauacagagggagugcaggg

SEQ ID NO: 637240 - RNA, 20 nt, Human
ugauuuuggcuucacacauu

SEQ ID NO: 637241 - RNA, 24 nt, Human
ugcacuauagaguauauccagggg

SEQ ID NO: 637242 - RNA, 22 nt, Human
ugcuuuauccuuuuggugcacu

SEQ ID NO: 637243 - RNA, 19 nt, Human
uggagucuggaauucugaa

SEQ ID NO: 637244 - RNA, 23 nt, Human
uggccuccaggugucccuccacc

SEQ ID NO: 637245 - RNA, 22 nt, Human
uggcucgaucacccgccacauc

SEQ ID NO: 637246 - RNA, 23 nt, Human
ugggcgccccugggcaggguggc

SEQ ID NO: 637247 - RNA, 23 nt, Human
ugggggaacacaauucaaccaca

SEQ ID NO: 637248 - RNA, 18 nt, Human
uguggggaaccuguccca

SEQ ID NO: 637249 - RNA, 22 nt, Human
uguucuugucuaagcacuucug

SEQ ID NO: 637250 - RNA, 22 nt, Human
uucaugucaacaggccccugaa

SEQ ID NO: 637251 - RNA, 24 nt, Human
uuccaguucuggagucuggaauuc

SEQ ID NO: 637252 - RNA, 18 nt, Human
uuccuucuaaggcuugug

SEQ ID NO: 637253 - RNA, 23 nt, Human
uucucccgaacaagaaaacaaac

SEQ ID NO: 637254 - RNA, 24 nt, Human
uuggccgccagaagccgucgggga

SEQ ID NO: 637255 - RNA, 21 nt, Human
uuuuaagcaucaucucagcca

SEQ ID NO: 637256 - RNA, 21 nt, Human
aaaaugauaacaugaaauccc

SEQ ID NO: 637257 - RNA, 18 nt, Human
aaagugcugggauuacaa

SEQ ID NO: 637258 - RNA, 24 nt, Human
aaagugcugggauuacaagcguga

SEQ ID NO: 637259 - RNA, 23 nt, Human
aaauuacugauuuagacuuccau

SEQ ID NO: 637260 - RNA, 21 nt, Human
aacaaucaaacgucugcuaaa

SEQ ID NO: 637261 - RNA, 22 nt, Human
aaccacaggaagaggguaaaug

SEQ ID NO: 637262 - RNA, 20 nt, Human
aacuacaagaagaagaaaac

SEQ ID NO: 637263 - RNA, 22 nt, Human
aaguaccugggauuauaggcau

SEQ ID NO: 637264 - RNA, 19 nt, Human
aagugcugggauuacaagc

SEQ ID NO: 637265 - RNA, 19 nt, Human
aagugcugggauuacaagc

SEQ ID NO: 637266 - RNA, 26 nt, Human
aagugcugggauuacaagcgugagcc

SEQ ID NO: 637267 - RNA, 24 nt, Human
aauuuuguauuuucgggagagaug

SEQ ID NO: 637268 - RNA, 19 nt, Human
acaaucaaacgucugcuaa

SEQ ID NO: 637269 - RNA, 24 nt, Human
acccucaccaggaacugacuuggc

SEQ ID NO: 637270 - RNA, 24 nt, Human
acugcaaacuacaaacugauugag

SEQ ID NO: 637271 - RNA, 22 nt, Human
agaaacacguauucuacagugc

SEQ ID NO: 637272 - RNA, 21 nt, Human
agaagaaaacagcuuccugaa

SEQ ID NO: 637273 - RNA, 20 nt, Human
agagcuaccccauuauuauu

SEQ ID NO: 637274 - RNA, 19 nt, Human
agauuaggggcacugcaaa

SEQ ID NO: 637275 - RNA, 20 nt, Human
aggaggugauaaaggucaaa

SEQ ID NO: 637276 - RNA, 21 nt, Human
aggcaguuuugugaugcgguc

SEQ ID NO: 637277 - RNA, 19 nt, Human
aggcaugcaccaccacgcc

SEQ ID NO: 637278 - RNA, 24 nt, Human
aggugauccgcccaccuuggccuc

SEQ ID NO: 637279 - RNA, 24 nt, Human
agugauucuccugccucagccucc

SEQ ID NO: 637280 - RNA, 24 nt, Human
agugcugggauuacaagcgugagc

SEQ ID NO: 637281 - RNA, 19 nt, Human
auaaaauuuacuucaggag

SEQ ID NO: 637282 - RNA, 21 nt, Human
aucccuaaauuagaacuacaa

SEQ ID NO: 637283 - RNA, 21 nt, Human
augggguuucuccauguuggu

SEQ ID NO: 637284 - RNA, 24 nt, Human
augggguuucuccauguuggucag

SEQ ID NO: 637285 - RNA, 18 nt, Human
auucuccugccucagccu

SEQ ID NO: 637286 - RNA, 24 nt, Human
caaagugcugggauuacaagcgug

SEQ ID NO: 637287 - RNA, 22 nt, Human
caagaagaagaaaacagcuucc

SEQ ID NO: 637288 - RNA, 22 nt, Human
caagugauucuccugccucagc

SEQ ID NO: 637289 - RNA, 27 nt, Human
caagugauucuccugccucagccuccc

SEQ ID NO: 637290 - RNA, 22 nt, Human
caccaccacgccuggcuaauuu

SEQ ID NO: 637291 - RNA, 23 nt, Human
cacugcaaucucugccuccuggg

SEQ ID NO: 637292 - RNA, 18 nt, Human
cagcuuccugaaugguaa

SEQ ID NO: 637293 - RNA, 19 nt, Human
cagcuuggagaaacaacag

SEQ ID NO: 637294 - RNA, 23 nt, Human
caugcaccaccacgccuggcuaa

SEQ ID NO: 637295 - RNA, 23 nt, Human
ccaaagccuugaagucaaagugg

SEQ ID NO: 637296 - RNA, 22 nt, Human
ccaaagugcugggauuacaagc

SEQ ID NO: 637297 - RNA, 24 nt, Human
ccaaagugcugggauuacaagcgu

SEQ ID NO: 637298 - RNA, 24 nt, Human
ccaaguaccugggauuauaggcau

SEQ ID NO: 637299 - RNA, 21 nt, Human
ccaucugcaagccaggaagag

SEQ ID NO: 637300 - RNA, 22 nt, Human
ccaucugcaagccaggaagaga

SEQ ID NO: 637301 - RNA, 19 nt, Human
ccauguuggucaggcuggu

SEQ ID NO: 637302 - RNA, 22 nt, Human
ccauguuggucaggcuggucuc

SEQ ID NO: 637303 - RNA, 23 nt, Human
ccauguuggucaggcuggucucg

SEQ ID NO: 637304 - RNA, 23 nt, Human
cccaaguaccugggauuauaggc

SEQ ID NO: 637305 - RNA, 24 nt, Human
cccaaguaccugggauuauaggca

SEQ ID NO: 637306 - RNA, 19 nt, Human
cccaggcuggagugcaaug

SEQ ID NO: 637307 - RNA, 20 nt, Human
ccgugcccaaccuaaaugca

SEQ ID NO: 637308 - RNA, 24 nt, Human
ccuccuggguucaagugauucucc

SEQ ID NO: 637309 - RNA, 24 nt, Human
ccugaccucaggugauccgcccac

SEQ ID NO: 637310 - RNA, 23 nt, Human
ccuggguucaagugauucuccuc

SEQ ID NO: 637311 - RNA, 23 nt, Human
ccuggguucaagugauucuccug

SEQ ID NO: 637312 - RNA, 22 nt, Human
cuagaacucagcuuggagaaac

SEQ ID NO: 637313 - RNA, 24 nt, Human
cucacugcaaucucugccuccugg

SEQ ID NO: 637314 - RNA, 22 nt, Human
cucacuuucaacuuucaaggcc

SEQ ID NO: 637315 - RNA, 24 nt, Human
cucaggugauccgcccaccuuggc

SEQ ID NO: 637316 - RNA, 19 nt, Human
cucccaaaaccacaggaag

SEQ ID NO: 637317 - RNA, 20 nt, Human
cuccuggguucaagugauuc

SEQ ID NO: 637318 - RNA, 21 nt, Human
cuccuggguucaagugauucu

SEQ ID NO: 637319 - RNA, 21 nt, Human
cucuuguugcccaggcuggag

SEQ ID NO: 637320 - RNA, 24 nt, Human
cugcaaucucugccuccuggguuc

SEQ ID NO: 637321 - RNA, 23 nt, Human
cugccuccuggguucaagugauu

SEQ ID NO: 637322 - RNA, 24 nt, Human
cuggagugcaauggcaugaucuca

SEQ ID NO: 637323 - RNA, 24 nt, Human
cuucucuuguugcccaggcuggag

SEQ ID NO: 637324 - RNA, 24 nt, Human
cuuguugcccaggcuggagugcaa

SEQ ID NO: 637325 - RNA, 23 nt, Human
gaccucaggugauccgcccaccu

SEQ ID NO: 637326 - RNA, 19 nt, Human
gacuguauuuggagauaga

SEQ ID NO: 637327 - RNA, 21 nt, Human
gagaaaauaaaauucuguucu

SEQ ID NO: 637328 - RNA, 24 nt, Human
gagaugggguuucuccauguuggu

SEQ ID NO: 637329 - RNA, 21 nt, Human
gauggcaggacaagaaguuaa

SEQ ID NO: 637330 - RNA, 18 nt, Human
gauuacaagcgugagcca

SEQ ID NO: 637331 - RNA, 24 nt, Human
gauuacaagcgugagccaccgugc

SEQ ID NO: 637332 - RNA, 23 nt, Human
gcaagaagguagaggguggccuc

SEQ ID NO: 637333 - RNA, 24 nt, Human
gcccaggcuggagugcaauggcau

SEQ ID NO: 637334 - RNA, 19 nt, Human
gcggucuuggcuuccaggg

SEQ ID NO: 637335 - RNA, 19 nt, Human
gcuggagugcaauggcaug

SEQ ID NO: 637336 - RNA, 23 nt, Human
gcuggucucgaacuccugaccuc

SEQ ID NO: 637337 - RNA, 19 nt, Human
ggagaggagcuacuuggua

SEQ ID NO: 637338 - RNA, 24 nt, Human
ggcuggucucgaacuccugaccuc

SEQ ID NO: 637339 - RNA, 19 nt, Human
ggcugguggaagacuuugg

SEQ ID NO: 637340 - RNA, 18 nt, Human
gggguuucuccauguugg

SEQ ID NO: 637341 - RNA, 22 nt, Human
gggguuucuccauguuggucag

SEQ ID NO: 637342 - RNA, 22 nt, Human
ggguuucuccauguuggucagg

SEQ ID NO: 637343 - RNA, 19 nt, Human
ggucucgaacuccugaccu

SEQ ID NO: 637344 - RNA, 22 nt, Human
ggugauaaaggucaaaugagga

SEQ ID NO: 637345 - RNA, 24 nt, Human
gugauucuccugccucagccuccc

SEQ ID NO: 637346 - RNA, 20 nt, Human
uaaaacgagcgauaagccca

SEQ ID NO: 637347 - RNA, 23 nt, Human
uaaaauucuguucuuugagacac

SEQ ID NO: 637348 - RNA, 19 nt, Human
uaaggaggugauaaagguc

SEQ ID NO: 637349 - RNA, 23 nt, Human
uacaagaagaagaaaacagcuuc

SEQ ID NO: 637350 - RNA, 24 nt, Human
uacaagcgugagccaccgugccca

SEQ ID NO: 637351 - RNA, 18 nt, Human
uagaaaggcuuagacaaa

SEQ ID NO: 637352 - RNA, 19 nt, Human
uaggaugagauuaggggca

SEQ ID NO: 637353 - RNA, 22 nt, Human
uauuucacugaaaauuccugua

SEQ ID NO: 637354 - RNA, 24 nt, Human
uauuucacugaaaauuccuguagg

SEQ ID NO: 637355 - RNA, 19 nt, Human
ucaagugauucuccugccu

SEQ ID NO: 637356 - RNA, 23 nt, Human
ucacucugucaugugaggacaca

SEQ ID NO: 637357 - RNA, 24 nt, Human
ucacugcaaucucugccuccuggg

SEQ ID NO: 637358 - RNA, 25 nt, Human
ucacugcaaucucugccuccugggu

SEQ ID NO: 637359 - RNA, 23 nt, Human
ucacuuccaggucucuuuucaua

SEQ ID NO: 637360 - RNA, 18 nt, Human
ucccaaagugcugggauu

SEQ ID NO: 637361 - RNA, 24 nt, Human
ucccaaagugcugggauuacaagc

SEQ ID NO: 637362 - RNA, 24 nt, Human
ucccaaguaccugggauuauaggc

SEQ ID NO: 637363 - RNA, 21 nt, Human
uccuggguucaagugauucuc

SEQ ID NO: 637364 - RNA, 24 nt, Human
uccuggguucaagugauucuccug

SEQ ID NO: 637365 - RNA, 22 nt, Human
ucuaugaacacuacaacaauca

SEQ ID NO: 637366 - RNA, 25 nt, Human
ucuccugccucagccucccaaguac

SEQ ID NO: 637367 - RNA, 23 nt, Human
ucucgaacuccugaccucaggug

SEQ ID NO: 637368 - RNA, 22 nt, Human
ucucugccuccuggguucaagu

SEQ ID NO: 637369 - RNA, 24 nt, Human
ucucugccuccuggguucaaguga

SEQ ID NO: 637370 - RNA, 21 nt, Human
ucucuuguugcccaggcugga

SEQ ID NO: 637371 - RNA, 22 nt, Human
ucugcaagccaggaagagaacc

SEQ ID NO: 637372 - RNA, 23 nt, Human
ucuucucuuguugcccaggcugg

SEQ ID NO: 637373 - RNA, 24 nt, Human
ucuucucuuguugcccaggcugga

SEQ ID NO: 637374 - RNA, 22 nt, Human
ucuuguugcccaggcuggagug

SEQ ID NO: 637375 - RNA, 18 nt, Human
ucuuugagacaccuaguc

SEQ ID NO: 637376 - RNA, 23 nt, Human
ucuuuuguacugguuucucuucu

SEQ ID NO: 637377 - RNA, 20 nt, Human
ugaaaucccuaaauuagaac

SEQ ID NO: 637378 - RNA, 19 nt, Human
ugaaugguaauaccucacu

SEQ ID NO: 637379 - RNA, 18 nt, Human
ugaccucaggugauccgc

SEQ ID NO: 637380 - RNA, 21 nt, Human
ugaccucaggugauccgccca

SEQ ID NO: 637381 - RNA, 24 nt, Human
ugaccucaggugauccgcccaccu

SEQ ID NO: 637382 - RNA, 20 nt, Human
ugacuuggcuggcaccuuga

SEQ ID NO: 637383 - RNA, 20 nt, Human
ugacuuggcuggcaccuuga

SEQ ID NO: 637384 - RNA, 19 nt, Human
ugagacaccuagucugugg

SEQ ID NO: 637385 - RNA, 21 nt, Human
ugagauggaguuucuucucuu

SEQ ID NO: 637386 - RNA, 18 nt, Human
ugagauuaggggcacugc

SEQ ID NO: 637387 - RNA, 19 nt, Human
ugaggacacagcaagaagg

SEQ ID NO: 637388 - RNA, 24 nt, Human
ugauccgcccaccuuggccuccca

SEQ ID NO: 637389 - RNA, 18 nt, Human
ugaucuuggacuuccccu

SEQ ID NO: 637390 - RNA, 19 nt, Human
ugaucuuggacuuccccuc

SEQ ID NO: 637391 - RNA, 18 nt, Human
ugcccaggcuggagugca

SEQ ID NO: 637392 - RNA, 21 nt, Human
ugcccaggcuggagugcaaug

SEQ ID NO: 637393 - RNA, 24 nt, Human
ugcccaggcuggagugcaauggca

SEQ ID NO: 637394 - RNA, 24 nt, Human
ugccucagccucccaaguaccugg

SEQ ID NO: 637395 - RNA, 22 nt, Human
ugccuccuggguucaagugauu

SEQ ID NO: 637396 - RNA, 24 nt, Human
ugcugggauuacaagcgugagcca

SEQ ID NO: 637397 - RNA, 22 nt, Human
uggaagacuuuggguugagagu

SEQ ID NO: 637398 - RNA, 24 nt, Human
uggaagacuuuggguugagaguca

SEQ ID NO: 637399 - RNA, 19 nt, Human
uggagugcaauggcaugau

SEQ ID NO: 637400 - RNA, 24 nt, Human
uggagugcaauggcaugaucucag

SEQ ID NO: 637401 - RNA, 19 nt, Human
uggcagcccaagcugagac

SEQ ID NO: 637402 - RNA, 19 nt, Human
uggcaggacaagaaguuaa

SEQ ID NO: 637403 - RNA, 24 nt, Human
uggcaugaucucagcucacugcaa

SEQ ID NO: 637404 - RNA, 23 nt, Human
ugggagguaaaugcugauuagaa

SEQ ID NO: 637405 - RNA, 21 nt, Human
ugggauuacaagcgugagcca

SEQ ID NO: 637406 - RNA, 22 nt, Human
ugggauuacaagcgugagccac

SEQ ID NO: 637407 - RNA, 23 nt, Human
ugggauuacaagcgugagccacc

SEQ ID NO: 637408 - RNA, 23 nt, Human
ugggauuacaagcgugagccacc

SEQ ID NO: 637409 - RNA, 24 nt, Human
ugggauuacaagcgugagccaccg

SEQ ID NO: 637410 - RNA, 21 nt, Human
ugggauuauaggcaugcacca

SEQ ID NO: 637411 - RNA, 24 nt, Human
ugggauuauaggcaugcaccacca

SEQ ID NO: 637412 - RNA, 24 nt, Human
ugggguuucuccauguuggucagg

SEQ ID NO: 637413 - RNA, 23 nt, Human
uggguucaagugauucuccugcc

SEQ ID NO: 637414 - RNA, 24 nt, Human
uggguucaagugauucuccugccu

SEQ ID NO: 637415 - RNA, 24 nt, Human
uggucaggcuggucucgaacuccu

SEQ ID NO: 637416 - RNA, 23 nt, Human
ugugagaaaauaaaauucuguuc

SEQ ID NO: 637417 - RNA, 23 nt, Human
ugugguguuugguuauggcagcc

SEQ ID NO: 637418 - RNA, 20 nt, Human
uguugcccaggcuggagugc

SEQ ID NO: 637419 - RNA, 21 nt, Human
uucaagugauucuccugccuc

SEQ ID NO: 637420 - RNA, 23 nt, Human
uucaagugauucuccugccucag

SEQ ID NO: 637421 - RNA, 24 nt, Human
uucaagugauucuccugccucagc

SEQ ID NO: 637422 - RNA, 19 nt, Human
uucauuuuuuucuuggcuc

SEQ ID NO: 637423 - RNA, 21 nt, Human
uuccaugaacucacuuccagg

SEQ ID NO: 637424 - RNA, 24 nt, Human
uucucuuguugcccaggcuggagu

SEQ ID NO: 637425 - RNA, 24 nt, Human
uucuucucuuguugcccaggcugg

SEQ ID NO: 637426 - RNA, 18 nt, Human
uugagacaccuagucugu

SEQ ID NO: 637427 - RNA, 18 nt, Human
uugcccaggcuggagugc

SEQ ID NO: 637428 - RNA, 18 nt, Human
uuggccucccaaagugcu

SEQ ID NO: 637429 - RNA, 21 nt, Human
uuucuccauguuggucaggcu

SEQ ID NO: 637430 - RNA, 18 nt, Human
uuuguacugguuucucuu

SEQ ID NO: 637431 - RNA, 20 nt, Human
uuuuguacugguuucucuuc

SEQ ID NO: 637432 - RNA, 22 nt, Human
uuuuuuuuuuuuuugagaugga

SEQ ID NO: 637433 - RNA, 24 nt, Human
uuuuuuuuuuuuuuuuuuuuuggg

SEQ ID NO: 637434 - RNA, 20 nt, Human
aaagagcugguuuacugcug

SEQ ID NO: 637435 - RNA, 18 nt, Human
ccuccuacgcgacgccag

SEQ ID NO: 637436 - RNA, 24 nt, Human
gagcugguuuacugcugugaaggg

SEQ ID NO: 637437 - RNA, 19 nt, Human
uccaaagagcugguuuacu

SEQ ID NO: 637438 - RNA, 23 nt, Human
uggaaucgguuccaaagagcugg

SEQ ID NO: 637439 - RNA, 18 nt, Human
uuuuuuuuuuuuuuuuug

SEQ ID NO: 637440 - RNA, 20 nt, Human
uuuuuuuuuuuuuuuuugcu

SEQ ID NO: 637441 - RNA, 24 nt, Human
uuuuuuuuuuuuuuuuugcuguga

SEQ ID NO: 637442 - RNA, 19 nt, Human
aagcgcgcugggguguggc

SEQ ID NO: 637443 - RNA, 21 nt, Human
aagcggcccgcgaccuugggc

SEQ ID NO: 637444 - RNA, 19 nt, Human
acacacccacauacugaaa

SEQ ID NO: 637445 - RNA, 24 nt, Human
acugcccccagcuacaccugaaag

SEQ ID NO: 637446 - RNA, 21 nt, Human
agagcagcaggcagguguaga

SEQ ID NO: 637447 - RNA, 21 nt, Human
agcaguguauaaaaauacuuu

SEQ ID NO: 637448 - RNA, 19 nt, Human
agcgcgcugggguguggcc

SEQ ID NO: 637449 - RNA, 19 nt, Human
aggcagguguagaugagaa

SEQ ID NO: 637450 - RNA, 21 nt, Human
aggccaaguggagucugugug

SEQ ID NO: 637451 - RNA, 26 nt, Human
auacugaaaccaucuccaaccggagg

SEQ ID NO: 637452 - RNA, 23 nt, Human
caagucucuuacccagguacaca

SEQ ID NO: 637453 - RNA, 26 nt, Human
cacacacccacauacugaaaccaucu

SEQ ID NO: 637454 - RNA, 23 nt, Human
cacacaggccucucccucggugc

SEQ ID NO: 637455 - RNA, 19 nt, Human
cacagccauaugggggcaa

SEQ ID NO: 637456 - RNA, 22 nt, Human
cacgugcacgcgcggucacgug

SEQ ID NO: 637457 - RNA, 21 nt, Human
cagccauaugggggcaaagac

SEQ ID NO: 637458 - RNA, 25 nt, Human
cagguguagaugagaaacuuacugg

SEQ ID NO: 637459 - RNA, 18 nt, Human
ccaaguggagucugugug

SEQ ID NO: 637460 - RNA, 22 nt, Human
ccaggaggagguucggagcggc

SEQ ID NO: 637461 - RNA, 21 nt, Human
ccccaagcggcccgcgaccuu

SEQ ID NO: 637462 - RNA, 19 nt, Human
ccccgcccaagccggcucc

SEQ ID NO: 637463 - RNA, 24 nt, Human
ccugaaagugcgaaccuggaaagc

SEQ ID NO: 637464 - RNA, 18 nt, Human
cgacuagaagcuuccaca

SEQ ID NO: 637465 - RNA, 21 nt, Human
cgagaagagcagcaggcaggu

SEQ ID NO: 637466 - RNA, 19 nt, Human
cgccucccgggccccgccc

SEQ ID NO: 637467 - RNA, 22 nt, Human
cgcugggguguggcgcgcgcgg

SEQ ID NO: 637468 - RNA, 21 nt, Human
cggccggaagcgcgcuggggu

SEQ ID NO: 637469 - RNA, 24 nt, Human
cguccaggcggaggggcagcagca

SEQ ID NO: 637470 - RNA, 22 nt, Human
cgugcacgcgcggucacguggc

SEQ ID NO: 637471 - RNA, 21 nt, Human
cuacaccugaaagugcgaacc

SEQ ID NO: 637472 - RNA, 22 nt, Human
cucaaacacggcgugagacgag

SEQ ID NO: 637473 - RNA, 20 nt, Human
cuccacacaggccucucccu

SEQ ID NO: 637474 - RNA, 20 nt, Human
cuccacacaggccucuccuu

SEQ ID NO: 637475 - RNA, 19 nt, Human
cucccgggccccgcccaag

SEQ ID NO: 637476 - RNA, 20 nt, Human
cucccgggccccgcccaagc

SEQ ID NO: 637477 - RNA, 21 nt, Human
cucccgggccccgcccaagcc

SEQ ID NO: 637478 - RNA, 23 nt, Human
cuccggccgccgccucccgggcc

SEQ ID NO: 637479 - RNA, 23 nt, Human
cugaugaggcggugaucucaaac

SEQ ID NO: 637480 - RNA, 24 nt, Human
cuuccacagccauaugggggcaaa

SEQ ID NO: 637481 - RNA, 21 nt, Human
gcacgcgcggucacguggccc

SEQ ID NO: 637482 - RNA, 18 nt, Human
gcccgcgcccacgaaggc

SEQ ID NO: 637483 - RNA, 21 nt, Human
gccucggucccgccgccgccc

SEQ ID NO: 637484 - RNA, 20 nt, Human
gcgccugcgacgacuagaag

SEQ ID NO: 637485 - RNA, 26 nt, Human
gcgcugccucggucccgccgccgccc

SEQ ID NO: 637486 - RNA, 24 nt, Human
gcgcugggguguggcgcgcgcggg

SEQ ID NO: 637487 - RNA, 26 nt, Human
gcguguggggcccgaaggggccuggc

SEQ ID NO: 637488 - RNA, 20 nt, Human
ggcccgcgaccuugggcgga

SEQ ID NO: 637489 - RNA, 18 nt, Human
ggccggaagcgcgcuggg

SEQ ID NO: 637490 - RNA, 21 nt, Human
gggcaaagacggcccaguagc

SEQ ID NO: 637491 - RNA, 18 nt, Human
gucugugugugccugggu

SEQ ID NO: 637492 - RNA, 21 nt, Human
guggggcccgaaggggccugg

SEQ ID NO: 637493 - RNA, 23 nt, Human
uaaacaauaguuuugauagguac

SEQ ID NO: 637494 - RNA, 23 nt, Human
ucccucggugcgguagcgagggu

SEQ ID NO: 637495 - RNA, 20 nt, Human
uccgcggcuucuccggccgc

SEQ ID NO: 637496 - RNA, 18 nt, Human
ucggugcgguagcgaggg

SEQ ID NO: 637497 - RNA, 22 nt, Human
ucuccggccgccgccucccggg

SEQ ID NO: 637498 - RNA, 24 nt, Human
ucuccggccgccgccucccgggcc

SEQ ID NO: 637499 - RNA, 25 nt, Human
ucugaaauacaauuuuagauuagca

SEQ ID NO: 637500 - RNA, 23 nt, Human
ugaagccuguuuccauuuccagg

SEQ ID NO: 637501 - RNA, 21 nt, Human
ugaggcggugaucucaaacac

SEQ ID NO: 637502 - RNA, 23 nt, Human
ugcgaaccuggaaagcaagucuc

SEQ ID NO: 637503 - RNA, 27 nt, Human
ugcguguggggcccgaaggggccuggc

SEQ ID NO: 637504 - RNA, 18 nt, Human
uggaacaggccccugggg

SEQ ID NO: 637505 - RNA, 20 nt, Human
uggggcccgaaggggccugg

SEQ ID NO: 637506 - RNA, 19 nt, Human
uguggggcccgaaggggcc

SEQ ID NO: 637507 - RNA, 22 nt, Human
uuacugcccccagcuacaccug

SEQ ID NO: 637508 - RNA, 22 nt, Human
uuuccagguuugggaugaauga

SEQ ID NO: 637509 - RNA, 19 nt, Human
uuugaagccuguuuccauu

SEQ ID NO: 637510 - RNA, 24 nt, Human
uuuuuuuuuuuuuuuuugaacuuu

SEQ ID NO: 637511 - RNA, 23 nt, Human
uuuuuuuuuuuuuuuuuuuuggg

SEQ ID NO: 637512 - RNA, 22 nt, Human
aaaacagcacuugaaaauucac

SEQ ID NO: 637513 - RNA, 20 nt, Human
aaaagaaaaagaaagcagca

SEQ ID NO: 637514 - RNA, 27 nt, Human
aaaagaaagcagcacuuccuuggaaaa

SEQ ID NO: 637515 - RNA, 19 nt, Human
aaacagcacuugaaaauuc

SEQ ID NO: 637516 - RNA, 19 nt, Human
acacagggcaacacagcag

SEQ ID NO: 637517 - RNA, 21 nt, Human
acaccacagccuccaggacgc

SEQ ID NO: 637518 - RNA, 18 nt, Human
accagacagagaagaagc

SEQ ID NO: 637519 - RNA, 24 nt, Human
acuguccuuaagggcauuuaggaa

SEQ ID NO: 637520 - RNA, 23 nt, Human
agacagagaagaagcacaccaca

SEQ ID NO: 637521 - RNA, 18 nt, Human
auccuguuugcugugaac

SEQ ID NO: 637522 - RNA, 19 nt, Human
caaagcacucagguugggg

SEQ ID NO: 637523 - RNA, 23 nt, Human
caaauauuaguagcauaacacau

SEQ ID NO: 637524 - RNA, 23 nt, Human
caacacagcaguugguaaagaua

SEQ ID NO: 637525 - RNA, 19 nt, Human
cacaauaucucaacacgag

SEQ ID NO: 637526 - RNA, 22 nt, Human
cacacaauaucucaacacgaga

SEQ ID NO: 637527 - RNA, 20 nt, Human
cacaccccuccgcucacucc

SEQ ID NO: 637528 - RNA, 20 nt, Human
cacacuccgauuccaccccu

SEQ ID NO: 637529 - RNA, 19 nt, Human
caccaaaagaaagcagcca

SEQ ID NO: 637530 - RNA, 26 nt, Human
caccacagccuccaggacgcuugcag

SEQ ID NO: 637531 - RNA, 19 nt, Human
caccccuccgcucacuccu

SEQ ID NO: 637532 - RNA, 22 nt, Human
cacgagaccucaucgagcggcc

SEQ ID NO: 637533 - RNA, 21 nt, Human
cacuccugcugcccauggagg

SEQ ID NO: 637534 - RNA, 19 nt, Human
cagacggcagcguggcaug

SEQ ID NO: 637535 - RNA, 19 nt, Human
cagagaagaagcacaccac

SEQ ID NO: 637536 - RNA, 21 nt, Human
cagccacccugugccauccua

SEQ ID NO: 637537 - RNA, 20 nt, Human
caggauccuuuaauguccuc

SEQ ID NO: 637538 - RNA, 22 nt, Human
ccaacaaaacagcacuugaaaa

SEQ ID NO: 637539 - RNA, 24 nt, Human
ccagacagagaagaagcacaccac

SEQ ID NO: 637540 - RNA, 25 nt, Human
ccagacagagaagaagcacaccaca

SEQ ID NO: 637541 - RNA, 23 nt, Human
ccagccgcccucugcagccccgg

SEQ ID NO: 637542 - RNA, 19 nt, Human
cccuccgcucacuccugcu

SEQ ID NO: 637543 - RNA, 22 nt, Human
ccgauuccaccccuggaggguc

SEQ ID NO: 637544 - RNA, 23 nt, Human
ccucugcagccccggugccaccu

SEQ ID NO: 637545 - RNA, 25 nt, Human
ccucugcagccccggugccaccucu

SEQ ID NO: 637546 - RNA, 19 nt, Human
ccucuggugucccccggcc

SEQ ID NO: 637547 - RNA, 23 nt, Human
ccucuuuuauuugaccaggaucc

SEQ ID NO: 637548 - RNA, 19 nt, Human
cgacggaaccccagccgcc

SEQ ID NO: 637549 - RNA, 21 nt, Human
cgccucagcccaguaagcuga

SEQ ID NO: 637550 - RNA, 23 nt, Human
cucagcauccggggccagccacc

SEQ ID NO: 637551 - RNA, 21 nt, Human
cucugcagccccggugccacc

SEQ ID NO: 637552 - RNA, 18 nt, Human
cucuguacccagaccugg

SEQ ID NO: 637553 - RNA, 22 nt, Human
cugcagccccggugccaccucu

SEQ ID NO: 637554 - RNA, 20 nt, Human
cuggugucccccggccuggg

SEQ ID NO: 637555 - RNA, 22 nt, Human
gaagaagcacaccacagccucc

SEQ ID NO: 637556 - RNA, 25 nt, Human
gagaagaagcacaccacagccucca

SEQ ID NO: 637557 - RNA, 20 nt, Human
gccacaagcgucagaagccu

SEQ ID NO: 637558 - RNA, 19 nt, Human
gccaccucuccacagacgc

SEQ ID NO: 637559 - RNA, 23 nt, Human
gcccauggaggagccucuggugu

SEQ ID NO: 637560 - RNA, 18 nt, Human
gcggcgugucgggcugga

SEQ ID NO: 637561 - RNA, 20 nt, Human
gcugcggcgugucgggcugg

SEQ ID NO: 637562 - RNA, 18 nt, Human
ggaggagccucugguguc

SEQ ID NO: 637563 - RNA, 19 nt, Human
ggcaugcagauccacaccu

SEQ ID NO: 637564 - RNA, 19 nt, Human
gggugcugcuggcugcggc

SEQ ID NO: 637565 - RNA, 19 nt, Human
guccucauuuguugucugg

SEQ ID NO: 637566 - RNA, 20 nt, Human
uaacacagacggcagcgugg

SEQ ID NO: 637567 - RNA, 21 nt, Human
uaacacauaagugcaauugca

SEQ ID NO: 637568 - RNA, 21 nt, Human
uaaguggucucuguacccaga

SEQ ID NO: 637569 - RNA, 19 nt, Human
uaccucuuuuauuugacca

SEQ ID NO: 637570 - RNA, 19 nt, Human
uagcaacaccacuguaaca

SEQ ID NO: 637571 - RNA, 27 nt, Human
uagcaacaccacuguaacacagacggc

SEQ ID NO: 637572 - RNA, 26 nt, Human
ucacaaaauuaaaaaaagaaaaagaa

SEQ ID NO: 637573 - RNA, 27 nt, Human
uccacagacgccucagcccaguaagcu

SEQ ID NO: 637574 - RNA, 20 nt, Human
ucucuauuuccauuguuguc

SEQ ID NO: 637575 - RNA, 21 nt, Human
ucuggugucccccggccuggg

SEQ ID NO: 637576 - RNA, 19 nt, Human
ucuguacccagaccugggg

SEQ ID NO: 637577 - RNA, 21 nt, Human
ugaugccauuggagggugcug

SEQ ID NO: 637578 - RNA, 22 nt, Human
ugcacugucuuccaacaaaaca

SEQ ID NO: 637579 - RNA, 21 nt, Human
uggaauccugagaggccaacg

SEQ ID NO: 637580 - RNA, 25 nt, Human
uggaauggcaggucuguuucaaaua

SEQ ID NO: 637581 - RNA, 22 nt, Human
uggagcugaucaaguaggugug

SEQ ID NO: 637582 - RNA, 20 nt, Human
uggagggucaccaaaagaaa

SEQ ID NO: 637583 - RNA, 22 nt, Human
uggccacaagcgucagaagccu

SEQ ID NO: 637584 - RNA, 24 nt, Human
uggugagaugggcccacacagggc

SEQ ID NO: 637585 - RNA, 20 nt, Human
uguggaauccugagaggcca

SEQ ID NO: 637586 - RNA, 18 nt, Human
uugcacugucuuccaaca

SEQ ID NO: 637587 - RNA, 22 nt, Human
aaaaaacuuuaaacaacccuga

SEQ ID NO: 637588 - RNA, 23 nt, Human
aaaaagauauucuuuaccuugga

SEQ ID NO: 637589 - RNA, 20 nt, Human
aaaaauacagcaaaugcuau

SEQ ID NO: 637590 - RNA, 21 nt, Human
aaaaauccaacaaauggcaag

SEQ ID NO: 637591 - RNA, 22 nt, Human
aaaacaagguaucaaugacaug

SEQ ID NO: 637592 - RNA, 22 nt, Human
aaaaguauuuauucuguuguug

SEQ ID NO: 637593 - RNA, 19 nt, Human
aaacagaaggaagcacuag

SEQ ID NO: 637594 - RNA, 22 nt, Human
aaacagcaccaacauccaucca

SEQ ID NO: 637595 - RNA, 26 nt, Human
aaacugugcaggacuuuccgguuccc

SEQ ID NO: 637596 - RNA, 25 nt, Human
aaagaucuucccucugguacaaguu

SEQ ID NO: 637597 - RNA, 24 nt, Human
aaagaugcaguaucauuucugaua

SEQ ID NO: 637598 - RNA, 18 nt, Human
aaagcggcuucugccucc

SEQ ID NO: 637599 - RNA, 21 nt, Human
aaaguaaaaauuugacuuuuc

SEQ ID NO: 637600 - RNA, 18 nt, Human
aaaguggggggggggugc

SEQ ID NO: 637601 - RNA, 20 nt, Human
aaaguucccaaccaccuccc

SEQ ID NO: 637602 - RNA, 20 nt, Human
aaaugcuuuuccagccaccu

SEQ ID NO: 637603 - RNA, 24 nt, Human
aacaaacuccgauuucuauaaucc

SEQ ID NO: 637604 - RNA, 20 nt, Human
aacaauauggacagaagaga

SEQ ID NO: 637605 - RNA, 19 nt, Human
aacagaaggaagcacuaga

SEQ ID NO: 637606 - RNA, 18 nt, Human
aacauccauccaccuagc

SEQ ID NO: 637607 - RNA, 23 nt, Human
aagaaagaaaaaucugaaaaaga

SEQ ID NO: 637608 - RNA, 27 nt, Human
aagaaagaaagaaaaaucugaaaaaga

SEQ ID NO: 637609 - RNA, 21 nt, Human
aagcacagggaaggaagcaau

SEQ ID NO: 637610 - RNA, 20 nt, Human
aagcauuauuugcagcauug

SEQ ID NO: 637611 - RNA, 31 nt, Human
aaggaagagacacaaugaguccacaaaggaa

SEQ ID NO: 637612 - RNA, 21 nt, Human
aauaacccaccuugucuauau

SEQ ID NO: 637613 - RNA, 20 nt, Human
acaaaaaccuauuuuuagau

SEQ ID NO: 637614 - RNA, 19 nt, Human
acaaaacauauaguuacca

SEQ ID NO: 637615 - RNA, 19 nt, Human
acaacccugagggagacac

SEQ ID NO: 637616 - RNA, 22 nt, Human
acacucuuucuuuccuuuuuuu

SEQ ID NO: 637617 - RNA, 18 nt, Human
accuacgagagaagacuc

SEQ ID NO: 637618 - RNA, 21 nt, Human
accucauuccuuugaaaacaa

SEQ ID NO: 637619 - RNA, 22 nt, Human
agaaaacaagguaucaaugaca

SEQ ID NO: 637620 - RNA, 20 nt, Human
agaaagaaagaaaaaucuga

SEQ ID NO: 637621 - RNA, 30 nt, Human
aggaagagacacaaugaguccacaaaggaa

SEQ ID NO: 637622 - RNA, 19 nt, Human
aggaagcacagggaaggaa

SEQ ID NO: 637623 - RNA, 23 nt, Human
aggcaucaauaagcuacacaucu

SEQ ID NO: 637624 - RNA, 24 nt, Human
agucaagaaaauggagacugauuu

SEQ ID NO: 637625 - RNA, 22 nt, Human
auaaaacccuuacuaacucuaa

SEQ ID NO: 637626 - RNA, 22 nt, Human
auaaacauggggaacaaaauaa

SEQ ID NO: 637627 - RNA, 22 nt, Human
auaaaguuacuuaaaaaaaucc

SEQ ID NO: 637628 - RNA, 20 nt, Human
auccaugccucagaugggaa

SEQ ID NO: 637629 - RNA, 19 nt, Human
caacagcagaacaagaaga

SEQ ID NO: 637630 - RNA, 23 nt, Human
caauauucaucuuaauacaucaa

SEQ ID NO: 637631 - RNA, 25 nt, Human
caccaacauccauccaccuagccag

SEQ ID NO: 637632 - RNA, 21 nt, Human
caccucccaccauaaauauac

SEQ ID NO: 637633 - RNA, 22 nt, Human
cacugccacuauuuauaaccuu

SEQ ID NO: 637634 - RNA, 19 nt, Human
cagccaccuaaacaccuca

SEQ ID NO: 637635 - RNA, 21 nt, Human
ccaaggcccaugaugcugugc

SEQ ID NO: 637636 - RNA, 20 nt, Human
ccaccauaaauauacaaaaa

SEQ ID NO: 637637 - RNA, 20 nt, Human
ccaccuaaacaccucauucc

SEQ ID NO: 637638 - RNA, 23 nt, Human
ccauucuugcaagccugcuucuc

SEQ ID NO: 637639 - RNA, 23 nt, Human
ccgaagggugaaaggcuuuucuu

SEQ ID NO: 637640 - RNA, 22 nt, Human
ccuagccagacacugcuccaug

SEQ ID NO: 637641 - RNA, 22 nt, Human
ccuccuuuaccucuucaacauc

SEQ ID NO: 637642 - RNA, 24 nt, Human
ccuccuuuaccucuucaacaucuu

SEQ ID NO: 637643 - RNA, 22 nt, Human
ccuugauucgggggggcauguc

SEQ ID NO: 637644 - RNA, 23 nt, Human
cucaugacaaccguccaugauaa

SEQ ID NO: 637645 - RNA, 21 nt, Human
cucauugccucaauauuccua

SEQ ID NO: 637646 - RNA, 20 nt, Human
cucccucucccuguccaggu

SEQ ID NO: 637647 - RNA, 23 nt, Human
cugaguaaaucaaagcggcuucu

SEQ ID NO: 637648 - RNA, 21 nt, Human
cugcuaggacaccagcugugc

SEQ ID NO: 637649 - RNA, 18 nt, Human
cugugcugccuccuuuac

SEQ ID NO: 637650 - RNA, 22 nt, Human
cuuuuaggcguaccagaaaaca

SEQ ID NO: 637651 - RNA, 23 nt, Human
gaacccacaccuggcuucacagg

SEQ ID NO: 637652 - RNA, 21 nt, Human
gaauauuuucuaaagcuugaa

SEQ ID NO: 637653 - RNA, 19 nt, Human
gacaaguuacacguccaaa

SEQ ID NO: 637654 - RNA, 22 nt, Human
gaucuucguuuuaaaaauaaga

SEQ ID NO: 637655 - RNA, 23 nt, Human
gcaccaacauccauccaccuagc

SEQ ID NO: 637656 - RNA, 19 nt, Human
gcagaacaagaagaggaga

SEQ ID NO: 637657 - RNA, 25 nt, Human
ggaaacagaaggaagcaccgguacc

SEQ ID NO: 637658 - RNA, 25 nt, Human
ggaagagacacaaugaguccacaaa

SEQ ID NO: 637659 - RNA, 22 nt, Human
ggagauggaugagaagaaacuu

SEQ ID NO: 637660 - RNA, 22 nt, Human
gucaaaauugcaugcaugaaua

SEQ ID NO: 637661 - RNA, 21 nt, Human
guccagguuuaauacugugcu

SEQ ID NO: 637662 - RNA, 20 nt, Human
gugcuagaagauacaaaaca

SEQ ID NO: 637663 - RNA, 24 nt, Human
gugugcuucaacacucaugacaac

SEQ ID NO: 637664 - RNA, 19 nt, Human
guuugugauguuagccugu

SEQ ID NO: 637665 - RNA, 22 nt, Human
uaaacaccucauuccuuugaaa

SEQ ID NO: 637666 - RNA, 22 nt, Human
uaaagcuugaauuuugcucuuc

SEQ ID NO: 637667 - RNA, 25 nt, Human
uaaaucaaagcggcuucugccucca

SEQ ID NO: 637668 - RNA, 23 nt, Human
uaaaugcccacagacuguacagu

SEQ ID NO: 637669 - RNA, 22 nt, Human
uaacuagaaguaacuuuuauua

SEQ ID NO: 637670 - RNA, 22 nt, Human
uaagacuauacaaaguggguaa

SEQ ID NO: 637671 - RNA, 22 nt, Human
uaauguuaucuauagcuguuuc

SEQ ID NO: 637672 - RNA, 27 nt, Human
uaauuuacuaaauuaugagggaacaac

SEQ ID NO: 637673 - RNA, 23 nt, Human
uacaaaugcuuuuccagccaccu

SEQ ID NO: 637674 - RNA, 18 nt, Human
uaccuugauucggggggg

SEQ ID NO: 637675 - RNA, 24 nt, Human
uagacuucagcuaagggaggcaga

SEQ ID NO: 637676 - RNA, 25 nt, Human
uagcuucaaucaaaaaagguuucau

SEQ ID NO: 637677 - RNA, 18 nt, Human
uaggcguaccagaaaaca

SEQ ID NO: 637678 - RNA, 19 nt, Human
uauaaaaguauuuauucug

SEQ ID NO: 637679 - RNA, 23 nt, Human
uauauuauuuaccaugccuuuga

SEQ ID NO: 637680 - RNA, 22 nt, Human
uauucucucucuuucccucuca

SEQ ID NO: 637681 - RNA, 18 nt, Human
ucagaagacagucacacu

SEQ ID NO: 637682 - RNA, 24 nt, Human
ucagaaucaaaauuacuauguaau

SEQ ID NO: 637683 - RNA, 18 nt, Human
uccaaggcccaugaugcu

SEQ ID NO: 637684 - RNA, 22 nt, Human
ucccuuggaaacagaaggaagc

SEQ ID NO: 637685 - RNA, 21 nt, Human
uccgcaauugcuaccuugauu

SEQ ID NO: 637686 - RNA, 24 nt, Human
ucucuaacacccucccucucccug

SEQ ID NO: 637687 - RNA, 18 nt, Human
ugaaaagaucuuccgaag

SEQ ID NO: 637688 - RNA, 19 nt, Human
ugaauguggacgccagaau

SEQ ID NO: 637689 - RNA, 20 nt, Human
ugacgaagcagguuaagugu

SEQ ID NO: 637690 - RNA, 19 nt, Human
ugagggagaaaaaaaacuu

SEQ ID NO: 637691 - RNA, 23 nt, Human
ugagucaagaaaauggagacuga

SEQ ID NO: 637692 - RNA, 24 nt, Human
ugauauauuauuuaccaugccuuu

SEQ ID NO: 637693 - RNA, 18 nt, Human
ugcuauucagaagucauc

SEQ ID NO: 637694 - RNA, 21 nt, Human
uggcacugaguagaacccaca

SEQ ID NO: 637695 - RNA, 22 nt, Human
uggcuuagccacuuguauucaa

SEQ ID NO: 637696 - RNA, 24 nt, Human
uggggggggggugucaaaaauagc

SEQ ID NO: 637697 - RNA, 22 nt, Human
uguacagauuuuaaaauuuagg

SEQ ID NO: 637698 - RNA, 19 nt, Human
uguuaaaaguucccaacca

SEQ ID NO: 637699 - RNA, 21 nt, Human
uucagcaacagcagaacaaga

SEQ ID NO: 637700 - RNA, 20 nt, Human
uucuuuagggucaccuuaua

SEQ ID NO: 637701 - RNA, 21 nt, Human
uuuacaaugcugaauguacaa

SEQ ID NO: 637702 - RNA, 22 nt, Human
uuuuccagccaccuaaacaccu

SEQ ID NO: 637703 - RNA, 21 nt, Human
aaacacauggaccuucgagcu

SEQ ID NO: 637704 - RNA, 20 nt, Human
accacagcuacuuauucuga

SEQ ID NO: 637705 - RNA, 21 nt, Human
accuuggaaagucgcgaggag

SEQ ID NO: 637706 - RNA, 20 nt, Human
aucugaaagauaccuuggaa

SEQ ID NO: 637707 - RNA, 22 nt, Human
caacagguuuccaccagggugu

SEQ ID NO: 637708 - RNA, 22 nt, Human
caacagguuuccaccagggugu

SEQ ID NO: 637709 - RNA, 26 nt, Human
caacagguuuccaccaggguguuuca

SEQ ID NO: 637710 - RNA, 20 nt, Human
cuuuccacuauugaugucac

SEQ ID NO: 637711 - RNA, 26 nt, Human
gaaaaauucuuccuuucacuuguaaa

SEQ ID NO: 637712 - RNA, 19 nt, Human
gacuguuuuuuccacccua

SEQ ID NO: 637713 - RNA, 20 nt, Human
gauauugagagcaaucagga

SEQ ID NO: 637714 - RNA, 22 nt, Human
gcagaagaaaaauucuuccuuu

SEQ ID NO: 637715 - RNA, 20 nt, Human
uaccuuggaaagucgcgagg

SEQ ID NO: 637716 - RNA, 19 nt, Human
ucaacagguuuccaccagg

SEQ ID NO: 637717 - RNA, 20 nt, Human
ucaguauuuuuuuccauucu

SEQ ID NO: 637718 - RNA, 28 nt, Human
ucaucugaaagauaccuuggaaagucgc

SEQ ID NO: 637719 - RNA, 19 nt, Human
ucugaaagauaccuuggaa

SEQ ID NO: 637720 - RNA, 24 nt, Human
ucuggagagcuugugcaagcuuca

SEQ ID NO: 637721 - RNA, 21 nt, Human
ucuucauuauccuuuggugca

SEQ ID NO: 637722 - RNA, 22 nt, Human
ugaagagaaaguggaaggucug

SEQ ID NO: 637723 - RNA, 22 nt, Human
ugcaaaacacauggaccuucga

SEQ ID NO: 637724 - RNA, 23 nt, Human
uggggaggaauuucuugccaauu

SEQ ID NO: 637725 - RNA, 21 nt, Human
ugucuggagagcuugugcaag

SEQ ID NO: 637726 - RNA, 28 nt, Human
uuaaacaauaauagcacaaugguuuuuu

SEQ ID NO: 637727 - RNA, 30 nt, Human
uuauugacggcagaagaaaaauucuuccuu

SEQ ID NO: 637728 - RNA, 24 nt, Human
uuccaccaggguguuucagucacu

SEQ ID NO: 637729 - RNA, 25 nt, Human
aaacuucauuacacagaagagcaac

SEQ ID NO: 637730 - RNA, 19 nt, Human
aaaguuuuccaaacaagca

SEQ ID NO: 637731 - RNA, 23 nt, Human
aacaagaaugguauccugccaga

SEQ ID NO: 637732 - RNA, 19 nt, Human
acugcgcaacgggcaaggc

SEQ ID NO: 637733 - RNA, 23 nt, Human
agacaggaaggaaaaaaagggac

SEQ ID NO: 637734 - RNA, 23 nt, Human
agcacaguucuucacaaccgaug

SEQ ID NO: 637735 - RNA, 22 nt, Human
aggaaaaaaauauauauacuga

SEQ ID NO: 637736 - RNA, 26 nt, Human
aggaaggaaaaaaauauauauacuga

SEQ ID NO: 637737 - RNA, 28 nt, Human
augaagcaagguguaaauguuuggcccc

SEQ ID NO: 637738 - RNA, 20 nt, Human
auguaauauugagagugcuu

SEQ ID NO: 637739 - RNA, 24 nt, Human
caagcugcaaagaucucaagcuaa

SEQ ID NO: 637740 - RNA, 24 nt, Human
ccaacaacguucuaacgacgugcu

SEQ ID NO: 637741 - RNA, 20 nt, Human
cccauucugcuuuugcacgu

SEQ ID NO: 637742 - RNA, 22 nt, Human
cugauggugguaaauaggucuu

SEQ ID NO: 637743 - RNA, 28 nt, Human
gaaauucuuuccuauccaauguauacuc

SEQ ID NO: 637744 - RNA, 22 nt, Human
gggaagcugucccuuagccuuc

SEQ ID NO: 637745 - RNA, 23 nt, Human
uaaauaaggcggaaagauuugga

SEQ ID NO: 637746 - RNA, 19 nt, Human
uaacccuuuuacggggcaa

SEQ ID NO: 637747 - RNA, 19 nt, Human
uaaugcacucuuucuauca

SEQ ID NO: 637748 - RNA, 18 nt, Human
ucaugacgagcaugucug

SEQ ID NO: 637749 - RNA, 23 nt, Human
ucccaagccauuaaaauacgacu

SEQ ID NO: 637750 - RNA, 20 nt, Human
ucuguccagcuaucaaucag

SEQ ID NO: 637751 - RNA, 21 nt, Human
ugaaaaguacaaaacuuuuug

SEQ ID NO: 637752 - RNA, 27 nt, Human
ugaauguagcacaguucuucacaaccc

SEQ ID NO: 637753 - RNA, 20 nt, Human
uggagaaacaaaagaaggaa

SEQ ID NO: 637754 - RNA, 30 nt, Human
uggccccaaucgggcuucagaaaugguucu

SEQ ID NO: 637755 - RNA, 21 nt, Human
uggguaagccugaauguagca

SEQ ID NO: 637756 - RNA, 23 nt, Human
uuggccccaaucgggcuucagaa

SEQ ID NO: 637757 - RNA, 21 nt, Human
aaacaaacuagaaaauuaccc

SEQ ID NO: 637758 - RNA, 20 nt, Human
aacuuuuuuuuuuuuuugcu

SEQ ID NO: 637759 - RNA, 21 nt, Human
aagaaacaaacuagaaaauua

SEQ ID NO: 637760 - RNA, 18 nt, Human
aaggccaggguguggggg

SEQ ID NO: 637761 - RNA, 23 nt, Human
acaaacuagaaaauuacccacac

SEQ ID NO: 637762 - RNA, 22 nt, Human
acuagaaaauuacccacaccca

SEQ ID NO: 637763 - RNA, 18 nt, Human
agaaaauuacccacaccc

SEQ ID NO: 637764 - RNA, 19 nt, Human
aggaggagcuggcucucuc

SEQ ID NO: 637765 - RNA, 20 nt, Human
aggcaggagggaagucguga

SEQ ID NO: 637766 - RNA, 22 nt, Human
aggcaggagggaagucgugacc

SEQ ID NO: 637767 - RNA, 20 nt, Human
aggcauucaccagcugcaug

SEQ ID NO: 637768 - RNA, 22 nt, Human
aggcucaguccugcagcugccc

SEQ ID NO: 637769 - RNA, 21 nt, Human
agggggucggaggaacuggcg

SEQ ID NO: 637770 - RNA, 23 nt, Human
agucgugaccucuuggcaggcuc

SEQ ID NO: 637771 - RNA, 22 nt, Human
cagcugccccaagcagccagac

SEQ ID NO: 637772 - RNA, 23 nt, Human
caggcucaguccugcagcugccc

SEQ ID NO: 637773 - RNA, 24 nt, Human
caugaucucuuccaccugggggcu

SEQ ID NO: 637774 - RNA, 18 nt, Human
cauggaggagaagagcug

SEQ ID NO: 637775 - RNA, 19 nt, Human
ccaccugggggcucugcag

SEQ ID NO: 637776 - RNA, 23 nt, Human
cccaggcugcaggcaggagggaa

SEQ ID NO: 637777 - RNA, 19 nt, Human
ccgggcgcuggcugggagg

SEQ ID NO: 637778 - RNA, 22 nt, Human
cgcuggcugggaggggaggugu

SEQ ID NO: 637779 - RNA, 21 nt, Human
cuagaaaauuacccacaccca

SEQ ID NO: 637780 - RNA, 19 nt, Human
cucuuggcaggcucagucc

SEQ ID NO: 637781 - RNA, 25 nt, Human
cugcagggccucucgggggaggggu

SEQ ID NO: 637782 - RNA, 20 nt, Human
cuggcccaggcugcaggcag

SEQ ID NO: 637783 - RNA, 20 nt, Human
cuggcugggaggggaggugu

SEQ ID NO: 637784 - RNA, 22 nt, Human
gcaggcucaguccugcagcugc

SEQ ID NO: 637785 - RNA, 21 nt, Human
gcugcaggcaggagggaaguc

SEQ ID NO: 637786 - RNA, 18 nt, Human
ggccaaaaggguccaugu

SEQ ID NO: 637787 - RNA, 26 nt, Human
ggcccgggcgcuggcugggaggggag

SEQ ID NO: 637788 - RNA, 18 nt, Human
ggcucaguccugcagcug

SEQ ID NO: 637789 - RNA, 18 nt, Human
ggggagggguuggccaag

SEQ ID NO: 637790 - RNA, 20 nt, Human
ggggaggugucuggcagguc

SEQ ID NO: 637791 - RNA, 22 nt, Human
uaggcauucaccagcugcauga

SEQ ID NO: 637792 - RNA, 20 nt, Human
ucagagcaguccuggcccag

SEQ ID NO: 637793 - RNA, 19 nt, Human
ucccuggggcucguccagg

SEQ ID NO: 637794 - RNA, 19 nt, Human
uccugcagcugccccaagc

SEQ ID NO: 637795 - RNA, 19 nt, Human
ucucagagcaguccuggcc

SEQ ID NO: 637796 - RNA, 20 nt, Human
ucucagagcaguccuggccc

SEQ ID NO: 637797 - RNA, 18 nt, Human
ucuuggcaggcucagucc

SEQ ID NO: 637798 - RNA, 23 nt, Human
ugaccucuuggcaggcucagucc

SEQ ID NO: 637799 - RNA, 22 nt, Human
ugcccugucccugcagggccaa

SEQ ID NO: 637800 - RNA, 19 nt, Human
uggcaggcucaguccugca

SEQ ID NO: 637801 - RNA, 23 nt, Human
uggcauggaggagaagagcugcu

SEQ ID NO: 637802 - RNA, 20 nt, Human
ugggaggggaggugucuggc

SEQ ID NO: 637803 - RNA, 21 nt, Human
ugggggcucugcaggaggagc

SEQ ID NO: 637804 - RNA, 21 nt, Human
uuacccacacccauuguagcc

SEQ ID NO: 637805 - RNA, 19 nt, Human
uuuuuuuuuuuuuuugugu

SEQ ID NO: 637806 - RNA, 19 nt, Human
uuuuuuuuuuuuuuuuugu

SEQ ID NO: 637807 - RNA, 20 nt, Human
uuuuuuuuuuuuuuuuuugg

SEQ ID NO: 637808 - RNA, 21 nt, Human
aaaaaaaaaaaaaaauagcag

SEQ ID NO: 637809 - RNA, 23 nt, Human
aaaaaaaaaaaaaaauagcaggg

SEQ ID NO: 637810 - RNA, 22 nt, Human
aaacagacuuuaaaccaacaaa

SEQ ID NO: 637811 - RNA, 20 nt, Human
acaagacagaaaauuaacaa

SEQ ID NO: 637812 - RNA, 18 nt, Human
accccacugucaauauua

SEQ ID NO: 637813 - RNA, 24 nt, Human
accucacgugcaaagacacauaua

SEQ ID NO: 637814 - RNA, 28 nt, Human
agacagaaugacaaaacugaagggaccc

SEQ ID NO: 637815 - RNA, 19 nt, Human
agacugcagcucugucuau

SEQ ID NO: 637816 - RNA, 22 nt, Human
agguuuuuagaaccuaaaguuu

SEQ ID NO: 637817 - RNA, 26 nt, Human
auaaaacagacuuuaaaccaacaaag

SEQ ID NO: 637818 - RNA, 21 nt, Human
caaaaaagacaaagaagggca

SEQ ID NO: 637819 - RNA, 22 nt, Human
caaagaagggcauuauauaaug

SEQ ID NO: 637820 - RNA, 22 nt, Human
caacaaagaucaaaaaagacaa

SEQ ID NO: 637821 - RNA, 25 nt, Human
caacaagacagaaaauuaacaagga

SEQ ID NO: 637822 - RNA, 23 nt, Human
caagaagagcuaacuauccuaaa

SEQ ID NO: 637823 - RNA, 19 nt, Human
cacaaauauuuauugcaca

SEQ ID NO: 637824 - RNA, 18 nt, Human
cacagacugcagcucugu

SEQ ID NO: 637825 - RNA, 20 nt, Human
cacgugcaaagacacauaua

SEQ ID NO: 637826 - RNA, 23 nt, Human
cagaucaacaagacagaaaauua

SEQ ID NO: 637827 - RNA, 24 nt, Human
cagcagcggcaggcaggcaggcgc

SEQ ID NO: 637828 - RNA, 20 nt, Human
cagcccuucucccgggcucc

SEQ ID NO: 637829 - RNA, 26 nt, Human
caggaauauuuaucaagcaaaaaaaa

SEQ ID NO: 637830 - RNA, 18 nt, Human
caggagcacccagauuca

SEQ ID NO: 637831 - RNA, 24 nt, Human
cagguuuuuagaaccuaaaguuuu

SEQ ID NO: 637832 - RNA, 21 nt, Human
ccaacaaagaucaaaaaagac

SEQ ID NO: 637833 - RNA, 21 nt, Human
ccaagcggaccuaacagacau

SEQ ID NO: 637834 - RNA, 22 nt, Human
ccagcccuucucccgggcuccu

SEQ ID NO: 637835 - RNA, 23 nt, Human
cccuucucccgggcuccugcgcu

SEQ ID NO: 637836 - RNA, 18 nt, Human
cgugcaaagacacauaua

SEQ ID NO: 637837 - RNA, 22 nt, Human
cucaaaauaaagggauacagga

SEQ ID NO: 637838 - RNA, 24 nt, Human
cuccugcgcucuuccccagggucu

SEQ ID NO: 637839 - RNA, 25 nt, Human
cuguuguauaucucucuucugaccu

SEQ ID NO: 637840 - RNA, 22 nt, Human
cuuccagcccuucucccgggcu

SEQ ID NO: 637841 - RNA, 23 nt, Human
cuuuaaaccaacaaagaucaaaa

SEQ ID NO: 637842 - RNA, 22 nt, Human
gaccuaacagacaucuauggaa

SEQ ID NO: 637843 - RNA, 24 nt, Human
gcaaagacacauauaggcucaaaa

SEQ ID NO: 637844 - RNA, 19 nt, Human
gcucuggaccaagcggacc

SEQ ID NO: 637845 - RNA, 24 nt, Human
gcuuaaacuccucuuaaucacuuu

SEQ ID NO: 637846 - RNA, 24 nt, Human
ggaauucuccgcacguccaguccc

SEQ ID NO: 637847 - RNA, 20 nt, Human
ggaccuaacagacaucuaug

SEQ ID NO: 637848 - RNA, 23 nt, Human
ggagcacccagauucauaaagca

SEQ ID NO: 637849 - RNA, 19 nt, Human
ggcaggcaggcaggcgcuc

SEQ ID NO: 637850 - RNA, 18 nt, Human
gggugggggcgggggcuu

SEQ ID NO: 637851 - RNA, 23 nt, Human
guaugcaccuaauacaggagcac

SEQ ID NO: 637852 - RNA, 24 nt, Human
guccaguccccuccuuccagcccu

SEQ ID NO: 637853 - RNA, 24 nt, Human
uaaaacagacuuuaaaccaacaaa

SEQ ID NO: 637854 - RNA, 19 nt, Human
uaaaccaacaaagaucaaa

SEQ ID NO: 637855 - RNA, 24 nt, Human
uaaagcaaguucuuagagaccuac

SEQ ID NO: 637856 - RNA, 25 nt, Human
uaauguauucucccaauaauuuugu

SEQ ID NO: 637857 - RNA, 25 nt, Human
uacagguuuuuagaaccuaaaguuu

SEQ ID NO: 637858 - RNA, 20 nt, Human
uagaaucucagagacagaau

SEQ ID NO: 637859 - RNA, 22 nt, Human
uagcugccuccuugugucaacu

SEQ ID NO: 637860 - RNA, 23 nt, Human
uauucuauacguuaucaccaagc

SEQ ID NO: 637861 - RNA, 22 nt, Human
ucaaaaaagacaaagaagggca

SEQ ID NO: 637862 - RNA, 23 nt, Human
ucaaaaaagacaaagaagggcaa

SEQ ID NO: 637863 - RNA, 19 nt, Human
ucaaaacccaucggugugc

SEQ ID NO: 637864 - RNA, 18 nt, Human
ucaaaauaaagggauaca

SEQ ID NO: 637865 - RNA, 21 nt, Human
ucaagcaaaaaaaaaaaaaaa

SEQ ID NO: 637866 - RNA, 21 nt, Human
ucaagcaaaaaaaaaaaaaaa

SEQ ID NO: 637867 - RNA, 23 nt, Human
ucaagcaaaaaaaaaaaaaaaaa

SEQ ID NO: 637868 - RNA, 28 nt, Human
ucaauaaauaaccuaauguuguaaugac

SEQ ID NO: 637869 - RNA, 22 nt, Human
ucaaugcagcaagaagagcuaa

SEQ ID NO: 637870 - RNA, 21 nt, Human
ucacgugcaaagacacauaua

SEQ ID NO: 637871 - RNA, 19 nt, Human
ucccgggcuccugcgcucu

SEQ ID NO: 637872 - RNA, 22 nt, Human
ucccgggcuccugcgcucuucc

SEQ ID NO: 637873 - RNA, 18 nt, Human
uccuuccagcccuucucc

SEQ ID NO: 637874 - RNA, 20 nt, Human
ucuagauguggaaauagaau

SEQ ID NO: 637875 - RNA, 23 nt, Human
ucuauggaacucuccaccccaaa

SEQ ID NO: 637876 - RNA, 19 nt, Human
ucuuagagaccuacaagga

SEQ ID NO: 637877 - RNA, 21 nt, Human
uggaacucuccaccccaaauc

SEQ ID NO: 637878 - RNA, 24 nt, Human
uuaaaaaaggccuggguguggagu

SEQ ID NO: 637879 - RNA, 24 nt, Human
uuaaaccaacaaagaucaaaaaag

SEQ ID NO: 637880 - RNA, 19 nt, Human
uuacccugcucuagaugug

SEQ ID NO: 637881 - RNA, 18 nt, Human
uuuuuuuuuuuuagaguc

SEQ ID NO: 637882 - RNA, 30 nt, Human
aaaaaaaaaaaaaaaaaaaaagccguaugg

SEQ ID NO: 637883 - RNA, 20 nt, Human
aaaaaaaaaaaaaaaagccg

SEQ ID NO: 637884 - RNA, 28 nt, Human
aaaaaaaaaaagccguaugugcaaaagg

SEQ ID NO: 637885 - RNA, 22 nt, Human
aaaaauguguguucuuuuccuc

SEQ ID NO: 637886 - RNA, 20 nt, Human
aagaacucagggcugauguu

SEQ ID NO: 637887 - RNA, 18 nt, Human
aagcaaaaaauccuucca

SEQ ID NO: 637888 - RNA, 23 nt, Human
acaauggugaaggcaaucucuuc

SEQ ID NO: 637889 - RNA, 24 nt, Human
agagggcagcuuuccugugccaca

SEQ ID NO: 637890 - RNA, 21 nt, Human
agaucaggaaaugcagucagc

SEQ ID NO: 637891 - RNA, 22 nt, Human
aggaauaaauaaucaaagagaa

SEQ ID NO: 637892 - RNA, 18 nt, Human
aggagauacaauagacac

SEQ ID NO: 637893 - RNA, 20 nt, Human
aggaguagauuacagggguu

SEQ ID NO: 637894 - RNA, 19 nt, Human
aucaaauuaauuccacaau

SEQ ID NO: 637895 - RNA, 22 nt, Human
caaaaaaaaaaaaaaaaaaaaa

SEQ ID NO: 637896 - RNA, 19 nt, Human
cacauaccugaaagcagcc

SEQ ID NO: 637897 - RNA, 20 nt, Human
cacucgguguugcagggagg

SEQ ID NO: 637898 - RNA, 20 nt, Human
cacucgguguugcagggagg

SEQ ID NO: 637899 - RNA, 22 nt, Human
cacucgguguugcagggagggc

SEQ ID NO: 637900 - RNA, 23 nt, Human
caucagaaagauaugauuauuuc

SEQ ID NO: 637901 - RNA, 19 nt, Human
ccugcaaguacuuuucugu

SEQ ID NO: 637902 - RNA, 23 nt, Human
cucuucuuggaaaaaaucagagg

SEQ ID NO: 637903 - RNA, 22 nt, Human
cuuuagcagcucaaccuucucc

SEQ ID NO: 637904 - RNA, 24 nt, Human
gaaagcagccaaucuccauuaaaa

SEQ ID NO: 637905 - RNA, 22 nt, Human
gaacaugacugguuuugggcug

SEQ ID NO: 637906 - RNA, 22 nt, Human
gaaggcaaucucuucuuggaaa

SEQ ID NO: 637907 - RNA, 20 nt, Human
gaucaggaaaugcagucagc

SEQ ID NO: 637908 - RNA, 25 nt, Human
gcaaaaaauccuuccaaggaguaga

SEQ ID NO: 637909 - RNA, 18 nt, Human
ggacaaaaaaaaaaaaaa

SEQ ID NO: 637910 - RNA, 19 nt, Human
ggacuggaagggagguggc

SEQ ID NO: 637911 - RNA, 20 nt, Human
ggaugggaucagugugucca

SEQ ID NO: 637912 - RNA, 24 nt, Human
ggcagcuuuccugugccacaagaa

SEQ ID NO: 637913 - RNA, 20 nt, Human
gggaaggagugacugcgacg

SEQ ID NO: 637914 - RNA, 23 nt, Human
gugagaaaaguaccuaagucuca

SEQ ID NO: 637915 - RNA, 20 nt, Human
uaaaaucagguagcagaugc

SEQ ID NO: 637916 - RNA, 23 nt, Human
uaauaggacaaaaaaaaaaaaaa

SEQ ID NO: 637917 - RNA, 19 nt, Human
uaggacaaaaaaaaaaaaa

SEQ ID NO: 637918 - RNA, 21 nt, Human
ucaaauuaauuccacaaucaa

SEQ ID NO: 637919 - RNA, 20 nt, Human
ucaaccuucuccuggucuuc

SEQ ID NO: 637920 - RNA, 23 nt, Human
uccuggucuucaggaugcuccug

SEQ ID NO: 637921 - RNA, 19 nt, Human
ugaggacaccggcuggagg

SEQ ID NO: 637922 - RNA, 22 nt, Human
ugaggacaccggcuggaggcca

SEQ ID NO: 637923 - RNA, 19 nt, Human
ugggagagggagagggcag

SEQ ID NO: 637924 - RNA, 22 nt, Human
ugggagagggagagggcagcuu

SEQ ID NO: 637925 - RNA, 19 nt, Human
uggugaaggcaaucucuuc

SEQ ID NO: 637926 - RNA, 24 nt, Human
uggugggagagggagagggcagcu

SEQ ID NO: 637927 - RNA, 18 nt, Human
uuccauguggacuggaag

SEQ ID NO: 637928 - RNA, 18 nt, Human
uugaguccaugcucuuuc

SEQ ID NO: 637929 - RNA, 20 nt, Human
aaagaaagggaggagcuagc

SEQ ID NO: 637930 - RNA, 24 nt, Human
aaagggaggagcuagcucucugcc

SEQ ID NO: 637931 - RNA, 22 nt, Human
aacaccucagaaucucuccaga

SEQ ID NO: 637932 - RNA, 23 nt, Human
aaggcccauggguggccuggaac

SEQ ID NO: 637933 - RNA, 21 nt, Human
agaaagaaagggaggagcuag

SEQ ID NO: 637934 - RNA, 19 nt, Human
aggaaguagcagaacucgg

SEQ ID NO: 637935 - RNA, 20 nt, Human
aggcaaaagaggcucaaaca

SEQ ID NO: 637936 - RNA, 24 nt, Human
agucucagguggaaaaagaaagaa

SEQ ID NO: 637937 - RNA, 26 nt, Human
aucucuccagagacgucccuuacuag

SEQ ID NO: 637938 - RNA, 21 nt, Human
cacagguuuccccagaagcuu

SEQ ID NO: 637939 - RNA, 22 nt, Human
cacuuugccucccucggcucca

SEQ ID NO: 637940 - RNA, 19 nt, Human
cagcagcuuccccuggguu

SEQ ID NO: 637941 - RNA, 19 nt, Human
cagcgggccccgccuuucc

SEQ ID NO: 637942 - RNA, 26 nt, Human
caggacccucgccaggggcggccgug

SEQ ID NO: 637943 - RNA, 23 nt, Human
cagggacccagaucuccugaggg

SEQ ID NO: 637944 - RNA, 24 nt, Human
cagguggaaaaagaaagaaaggga

SEQ ID NO: 637945 - RNA, 19 nt, Human
ccagagacgucccuuacua

SEQ ID NO: 637946 - RNA, 20 nt, Human
ccagagaggcccucugagug

SEQ ID NO: 637947 - RNA, 19 nt, Human
ccagccaugaguagggggc

SEQ ID NO: 637948 - RNA, 25 nt, Human
cccauggguggccuggaacuggcuc

SEQ ID NO: 637949 - RNA, 20 nt, Human
ccccacucaucacugcuggg

SEQ ID NO: 637950 - RNA, 21 nt, Human
ccccagaagcuucacuuugcc

SEQ ID NO: 637951 - RNA, 26 nt, Human
ccccagaagcuucacuuugccucccu

SEQ ID NO: 637952 - RNA, 19 nt, Human
cccccuggcuccacucugg

SEQ ID NO: 637953 - RNA, 21 nt, Human
ccuggguuccugggccgaggg

SEQ ID NO: 637954 - RNA, 19 nt, Human
cgccaggggcggccgugcc

SEQ ID NO: 637955 - RNA, 20 nt, Human
cgggaaggacacugccggug

SEQ ID NO: 637956 - RNA, 18 nt, Human
cuccagagaggcccucug

SEQ ID NO: 637957 - RNA, 19 nt, Human
cuccagggacccagaucuc

SEQ ID NO: 637958 - RNA, 24 nt, Human
cuccugagggauguugggggaagc

SEQ ID NO: 637959 - RNA, 21 nt, Human
cuucucagagagaccgggcuc

SEQ ID NO: 637960 - RNA, 19 nt, Human
cuuucagcgggccccgccu

SEQ ID NO: 637961 - RNA, 25 nt, Human
cuuuuuauuguuuuguuuuuuauaa

SEQ ID NO: 637962 - RNA, 25 nt, Human
gagaacuccucaccguuguaauauc

SEQ ID NO: 637963 - RNA, 18 nt, Human
gaggagcguacuggcucc

SEQ ID NO: 637964 - RNA, 23 nt, Human
gauguugggggaagcccccaugg

SEQ ID NO: 637965 - RNA, 22 nt, Human
gcuagauacagggagauuccug

SEQ ID NO: 637966 - RNA, 23 nt, Human
gcuccacucuggaggagcguacu

SEQ ID NO: 637967 - RNA, 22 nt, Human
gcuucagcuagccccacucauc

SEQ ID NO: 637968 - RNA, 22 nt, Human
gggggggaaaagacaucccuac

SEQ ID NO: 637969 - RNA, 22 nt, Human
guggaaaaagaaagaaagggag

SEQ ID NO: 637970 - RNA, 22 nt, Human
uaggcaaaagaggcucaaacac

SEQ ID NO: 637971 - RNA, 20 nt, Human
ucagccaauugaaaucgugg

SEQ ID NO: 637972 - RNA, 21 nt, Human
ucagccaauugaaaucgugga

SEQ ID NO: 637973 - RNA, 18 nt, Human
uccccuggguuccugggc

SEQ ID NO: 637974 - RNA, 18 nt, Human
ucccuacuccccuucccc

SEQ ID NO: 637975 - RNA, 21 nt, Human
ucccuacuccccuuccccgug

SEQ ID NO: 637976 - RNA, 23 nt, Human
ucccucggcuccacugucccccu

SEQ ID NO: 637977 - RNA, 22 nt, Human
uccgggucaggauugcuagggc

SEQ ID NO: 637978 - RNA, 23 nt, Human
ucugcagcuccucccccgcuggg

SEQ ID NO: 637979 - RNA, 22 nt, Human
ucugccagccaugaguaggggg

SEQ ID NO: 637980 - RNA, 24 nt, Human
ucugccuucucagccaauugaaau

SEQ ID NO: 637981 - RNA, 18 nt, Human
ugaguagggggcggggcc

SEQ ID NO: 637982 - RNA, 18 nt, Human
ugcuagggcagcagcuuc

SEQ ID NO: 637983 - RNA, 19 nt, Human
uggaaaaagaaagaaaggg

SEQ ID NO: 637984 - RNA, 18 nt, Human
uggaacuggcuccagaga

SEQ ID NO: 637985 - RNA, 19 nt, Human
uggaacuggcuccagagag

SEQ ID NO: 637986 - RNA, 18 nt, Human
uggaaggucugcagcucc

SEQ ID NO: 637987 - RNA, 21 nt, Human
uggaaggucugcagcuccucc

SEQ ID NO: 637988 - RNA, 19 nt, Human
uggggccacgaaucugcca

SEQ ID NO: 637989 - RNA, 22 nt, Human
uggguggggccacgaaucugcc

SEQ ID NO: 637990 - RNA, 27 nt, Human
uguuuuguuuuuuauaaacaagucuca

SEQ ID NO: 637991 - RNA, 18 nt, Human
uuuuuuuuuuuuuuucug

SEQ ID NO: 637992 - RNA, 23 nt, Human
aaauauucacaaaaauacaacug

SEQ ID NO: 637993 - RNA, 23 nt, Human
agaaagcagugaaaaaacaaugc

SEQ ID NO: 637994 - RNA, 27 nt, Human
auaauaaugagcuugaugguuuuuccc

SEQ ID NO: 637995 - RNA, 18 nt, Human
caagaacaagugaaggcu

SEQ ID NO: 637996 - RNA, 27 nt, Human
cacagcaccagcuucaccaacacaugg

SEQ ID NO: 637997 - RNA, 24 nt, Human
cagugaaaaaacaaugccccuuuu

SEQ ID NO: 637998 - RNA, 19 nt, Human
guggcccccacagcaccag

SEQ ID NO: 637999 - RNA, 24 nt, Human
uauuaaaauauucacaaaaauaca

SEQ ID NO: 638000 - RNA, 19 nt, Human
ucagaaauugaaaaagaug

SEQ ID NO: 638001 - RNA, 21 nt, Human
ugagaaagcagugaaaaaaca

SEQ ID NO: 638002 - RNA, 22 nt, Human
ugagaaagcagugaaaaaacaa

SEQ ID NO: 638003 - RNA, 21 nt, Human
ugagcuugaugguuuuucccu

SEQ ID NO: 638004 - RNA, 21 nt, Human
ugaguggcccccacagcacca

SEQ ID NO: 638005 - RNA, 21 nt, Human
uucacaaaaauacaacugaag

SEQ ID NO: 638006 - RNA, 24 nt, Human
uuuuuuuuuuuuuuuuuuuuucag

SEQ ID NO: 638007 - RNA, 21 nt, Human
uuuuuuuuuuuuuuuuucagg

SEQ ID NO: 638008 - RNA, 22 nt, Human
aaauggcaaauaauucugaaac

SEQ ID NO: 638009 - RNA, 24 nt, Human
aagaaucucauuuccaauaauguc

SEQ ID NO: 638010 - RNA, 19 nt, Human
acaccuuuucuccuacgug

SEQ ID NO: 638011 - RNA, 20 nt, Human
augaagauaaaauauaugca

SEQ ID NO: 638012 - RNA, 22 nt, Human
auucacauugcaaccucucuua

SEQ ID NO: 638013 - RNA, 20 nt, Human
caaaagauacagcacuccac

SEQ ID NO: 638014 - RNA, 19 nt, Human
cuaccaagcaaugcaaaag

SEQ ID NO: 638015 - RNA, 18 nt, Human
cucaaaauggcaaauaau

SEQ ID NO: 638016 - RNA, 20 nt, Human
cucaauacacuuaucacacc

SEQ ID NO: 638017 - RNA, 24 nt, Human
gucacuggugacauuuuuaauugc

SEQ ID NO: 638018 - RNA, 23 nt, Human
uaaaacucuaccaagcaaugccu

SEQ ID NO: 638019 - RNA, 26 nt, Human
uaucacaccuuuucuccuacguguua

SEQ ID NO: 638020 - RNA, 20 nt, Human
ucaaaaagaauuuccuggca

SEQ ID NO: 638021 - RNA, 23 nt, Human
ucucuuaagaaucucauuuccaa

SEQ ID NO: 638022 - RNA, 21 nt, Human
ugaugcaucauuaggaucaaa

SEQ ID NO: 638023 - RNA, 20 nt, Human
ugcaaaggagggaggaagaa

SEQ ID NO: 638024 - RNA, 25 nt, Human
uuccuuuaacuuuuauuaacaguuc

SEQ ID NO: 638025 - RNA, 21 nt, Human
uucugaaacugaaguuuuggg

SEQ ID NO: 638026 - RNA, 22 nt, Human
uuggaccugaggaacccacugu

SEQ ID NO: 638027 - RNA, 19 nt, Human
agaccuggaagucccagug

SEQ ID NO: 638028 - RNA, 24 nt, Human
auccaaguuguuuuguuuuuuuuu

SEQ ID NO: 638029 - RNA, 21 nt, Human
uaagaccuggaagucccagug

SEQ ID NO: 638030 - RNA, 20 nt, Human
uaaguggaauuuucugccuc

SEQ ID NO: 638031 - RNA, 22 nt, Human
uacgcagcaagauaauggcuaa

SEQ ID NO: 638032 - RNA, 24 nt, Human
uguuuuguuuuuuuuuuucuucug

SEQ ID NO: 638033 - RNA, 23 nt, Human
uuugucaguguugugacccacuc

SEQ ID NO: 638034 - RNA, 22 nt, Human
uuuuuuuuuucuucugagcauu

SEQ ID NO: 638035 - RNA, 18 nt, Human
uuuuuuuuuuucaggacc

SEQ ID NO: 638036 - RNA, 22 nt, Human
uuuuuuuuuuuuuuuuuucagg

SEQ ID NO: 638037 - RNA, 22 nt, Human
aauaaaaaaacaaacaacaaaa

SEQ ID NO: 638038 - RNA, 24 nt, Human
auaaaugauacaguaguuuuuucc

SEQ ID NO: 638039 - RNA, 27 nt, Human
caaaauaaaaaaacaaacaacaaaaug

SEQ ID NO: 638040 - RNA, 24 nt, Human
caguaguuuuuuccucucuagccu

SEQ ID NO: 638041 - RNA, 24 nt, Human
cauccaaaauaaaaaaacaaacaa

SEQ ID NO: 638042 - RNA, 19 nt, Human
cauugucauccaaaauaaa

SEQ ID NO: 638043 - RNA, 22 nt, Human
cucagggggaaaagccauugaa

SEQ ID NO: 638044 - RNA, 22 nt, Human
gaauacauucauuuauuggguc

SEQ ID NO: 638045 - RNA, 20 nt, Human
ggggaaaagccauugaaugg

SEQ ID NO: 638046 - RNA, 23 nt, Human
uaaaugauacaguaguuuuuucc

SEQ ID NO: 638047 - RNA, 19 nt, Human
uaggauaaaugauacagua

SEQ ID NO: 638048 - RNA, 26 nt, Human
uaguuaguucuuuggcauagaaguuc

SEQ ID NO: 638049 - RNA, 22 nt, Human
uaguucuuuggcauagaaguuc

SEQ ID NO: 638050 - RNA, 20 nt, Human
uaguuuuuuccucucuagcc

SEQ ID NO: 638051 - RNA, 20 nt, Human
uccaaaauaaaaaaacaaac

SEQ ID NO: 638052 - RNA, 24 nt, Human
ucuuuuguuuuuuugaauuccuca

SEQ ID NO: 638053 - RNA, 23 nt, Human
ugggucuuaucuuaaaucuccuu

SEQ ID NO: 638054 - RNA, 21 nt, Human
uuccucaauuucauauguagu

SEQ ID NO: 638055 - RNA, 18 nt, Human
uugaauguaagugugguu

SEQ ID NO: 638056 - RNA, 21 nt, Human
uuuuuuuuuuuuuuuuuacag

SEQ ID NO: 638057 - RNA, 27 nt, Human
aaggcagcugagcagaaggaggggagg

SEQ ID NO: 638058 - RNA, 24 nt, Human
acaaagcauagagugugugaccuc

SEQ ID NO: 638059 - RNA, 19 nt, Human
agaaaagccaauacacgga

SEQ ID NO: 638060 - RNA, 22 nt, Human
aggcagcugagcagaaggaggg

SEQ ID NO: 638061 - RNA, 22 nt, Human
cagcagagaaagaguuuaauua

SEQ ID NO: 638062 - RNA, 24 nt, Human
ccagaaaagccaauacacggagaa

SEQ ID NO: 638063 - RNA, 22 nt, Human
ccuacacaaacacggaacagaa

SEQ ID NO: 638064 - RNA, 20 nt, Human
gcagcugagcagaaggaggg

SEQ ID NO: 638065 - RNA, 21 nt, Human
gccaauacacggagaacagua

SEQ ID NO: 638066 - RNA, 24 nt, Human
ggagaacaguagggguguugcagc

SEQ ID NO: 638067 - RNA, 22 nt, Human
uaagagagguucacacagcuaa

SEQ ID NO: 638068 - RNA, 18 nt, Human
uagagugugugaccucaa

SEQ ID NO: 638069 - RNA, 20 nt, Human
uccugcugcccagaaaagcc

SEQ ID NO: 638070 - RNA, 20 nt, Human
ugagcagaaggaggggaggu

SEQ ID NO: 638071 - RNA, 24 nt, Human
ugagcagaaggaggggagguaucu

SEQ ID NO: 638072 - RNA, 21 nt, Human
uggcauccucaaccaaauguu

SEQ ID NO: 638073 - RNA, 19 nt, Human
uuuuuuuuuuuuggcaucc

SEQ ID NO: 638074 - RNA, 18 nt, Human
uuuuuuuuuuuuuuuuug

SEQ ID NO: 638075 - RNA, 22 nt, Human
uuuuuuuuuuuuuuuuuuuggc

SEQ ID NO: 638076 - RNA, 23 nt, Human
uuuuuuuuuuuuuuuuuuuuggg

SEQ ID NO: 638077 - RNA, 23 nt, Human
aaaaaaaucccaaugguuaugga

SEQ ID NO: 638078 - RNA, 24 nt, Human
aaaauggcacaccaggguguaaug

SEQ ID NO: 638079 - RNA, 23 nt, Human
aaaguagaaaauaaaaaucagaa

SEQ ID NO: 638080 - RNA, 22 nt, Human
aagagaaaauggcacaccaggg

SEQ ID NO: 638081 - RNA, 23 nt, Human
auaaaaaucagaauguagaucca

SEQ ID NO: 638082 - RNA, 25 nt, Human
auacugagauuguuuacacagcucc

SEQ ID NO: 638083 - RNA, 19 nt, Human
cacaaagcuuaaaaucuca

SEQ ID NO: 638084 - RNA, 19 nt, Human
cacccauccauccacccaa

SEQ ID NO: 638085 - RNA, 20 nt, Human
cagcuccugcggguccggcu

SEQ ID NO: 638086 - RNA, 24 nt, Human
ccaaugguuauggagaucccuccu

SEQ ID NO: 638087 - RNA, 19 nt, Human
gaaagaagaauuuguggag

SEQ ID NO: 638088 - RNA, 21 nt, Human
gaagaauuuguggagggcagg

SEQ ID NO: 638089 - RNA, 18 nt, Human
ggcaugcacgugcccucg

SEQ ID NO: 638090 - RNA, 18 nt, Human
gggauaucacaagagaaa

SEQ ID NO: 638091 - RNA, 19 nt, Human
guagaaaauaaaaaucaga

SEQ ID NO: 638092 - RNA, 18 nt, Human
guagaacacaaugaaaca

SEQ ID NO: 638093 - RNA, 20 nt, Human
uaaguagaacacaaugaaac

SEQ ID NO: 638094 - RNA, 24 nt, Human
ucagccacaaagcuuaaaaucuca

SEQ ID NO: 638095 - RNA, 20 nt, Human
ugagaaagaagaauuugugg

SEQ ID NO: 638096 - RNA, 26 nt, Human
ugcggguccggcuuucuguggcuuuc

SEQ ID NO: 638097 - RNA, 20 nt, Human
uguugggagaggagguuaac

SEQ ID NO: 638098 - RNA, 20 nt, Human
uuaaaaucucaaaugucaac

SEQ ID NO: 638099 - RNA, 22 nt, Human
aagagccacagugauuccaugg

SEQ ID NO: 638100 - RNA, 22 nt, Human
agaccccgaguccuucaugcag

SEQ ID NO: 638101 - RNA, 23 nt, Human
agaguacaaaacugcaacaagag

SEQ ID NO: 638102 - RNA, 21 nt, Human
agaucuagaaaacuagagcuu

SEQ ID NO: 638103 - RNA, 18 nt, Human
agcugcauuuggguccug

SEQ ID NO: 638104 - RNA, 21 nt, Human
agcugcauuuggguccugcug

SEQ ID NO: 638105 - RNA, 22 nt, Human
cacaagcaugucuagccugggg

SEQ ID NO: 638106 - RNA, 22 nt, Human
cacuguaaaagaucuagaaaac

SEQ ID NO: 638107 - RNA, 18 nt, Human
caugcagagcugcagccg

SEQ ID NO: 638108 - RNA, 24 nt, Human
ccaguuucgugcaaagaaugacaa

SEQ ID NO: 638109 - RNA, 22 nt, Human
ccgcccuucaaccucuggcuau

SEQ ID NO: 638110 - RNA, 20 nt, Human
ccucuucuaccccgcccuuc

SEQ ID NO: 638111 - RNA, 21 nt, Human
cuaaacgguggugauuucucu

SEQ ID NO: 638112 - RNA, 25 nt, Human
cucuggcuauuguuacuuucuggga

SEQ ID NO: 638113 - RNA, 19 nt, Human
cugcauuuggguccugcug

SEQ ID NO: 638114 - RNA, 19 nt, Human
cugugcagcuucugagaag

SEQ ID NO: 638115 - RNA, 18 nt, Human
gaacuugaacaggcggca

SEQ ID NO: 638116 - RNA, 22 nt, Human
gagcugcauuuggguccugcug

SEQ ID NO: 638117 - RNA, 22 nt, Human
gucuguaguagggccuuacagc

SEQ ID NO: 638118 - RNA, 19 nt, Human
uaaaagaucuagaaaacua

SEQ ID NO: 638119 - RNA, 22 nt, Human
uaaaagaucuagaaaacuagag

SEQ ID NO: 638120 - RNA, 18 nt, Human
uacuguacacuguaaaag

SEQ ID NO: 638121 - RNA, 22 nt, Human
ucuguaguagggccuuacagcu

SEQ ID NO: 638122 - RNA, 23 nt, Human
ucuguaguagggccuuacagcuu

SEQ ID NO: 638123 - RNA, 24 nt, Human
ucuuguaaguuuacuuguuaaaca

SEQ ID NO: 638124 - RNA, 23 nt, Human
ucuuucuuugucacugcuuuccu

SEQ ID NO: 638125 - RNA, 28 nt, Human
ugaacaggcggcagaauauuguaaugac

SEQ ID NO: 638126 - RNA, 20 nt, Human
ugcaaagaaugacaacuucu

SEQ ID NO: 638127 - RNA, 18 nt, Human
uggggaguggguugggag

SEQ ID NO: 638128 - RNA, 21 nt, Human
uguaaaagaucuagaaaacua

SEQ ID NO: 638129 - RNA, 18 nt, Human
ugugcagcuucugagaag

SEQ ID NO: 638130 - RNA, 21 nt, Human
uucuuugucacugcuuuccuc

SEQ ID NO: 638131 - RNA, 23 nt, Human
uugggagcugcauuuggguccug

SEQ ID NO: 638132 - RNA, 20 nt, Human
uuggguccugcugucgcuuu

SEQ ID NO: 638133 - RNA, 22 nt, Human
uuuuuuuuuuaaaugaacaagc

SEQ ID NO: 638134 - RNA, 23 nt, Human
uuuuuuuuuuuuuuuuuuaaaug

SEQ ID NO: 638135 - RNA, 20 nt, Human
aaaaauccagaaaacaaaca

SEQ ID NO: 638136 - RNA, 23 nt, Human
aaaauccagaaaacaaacaacaa

SEQ ID NO: 638137 - RNA, 20 nt, Human
aaacccggagcagggcggcg

SEQ ID NO: 638138 - RNA, 19 nt, Human
aaagugcugggauuacagg

SEQ ID NO: 638139 - RNA, 23 nt, Human
aaagugcugggauuacaggcgua

SEQ ID NO: 638140 - RNA, 24 nt, Human
aaccagauucuggcaucuuucccg

SEQ ID NO: 638141 - RNA, 25 nt, Human
aagcaaaaaauccagaaaacaaaca

SEQ ID NO: 638142 - RNA, 26 nt, Human
aagcaugccuauaauaugcaucaugc

SEQ ID NO: 638143 - RNA, 19 nt, Human
aagcauuggccgccaggug

SEQ ID NO: 638144 - RNA, 19 nt, Human
aagugcugggauuacaggc

SEQ ID NO: 638145 - RNA, 19 nt, Human
aagugcugggauuacaggc

SEQ ID NO: 638146 - RNA, 26 nt, Human
aagugcugggauuacaggcguaagcc

SEQ ID NO: 638147 - RNA, 18 nt, Human
acaggcguaagccaccgc

SEQ ID NO: 638148 - RNA, 20 nt, Human
acccgccuccgccucccaaa

SEQ ID NO: 638149 - RNA, 18 nt, Human
acgggguuucaccguguu

SEQ ID NO: 638150 - RNA, 19 nt, Human
acgggguuucaccguguua

SEQ ID NO: 638151 - RNA, 20 nt, Human
acgggguuucaccguguuag

SEQ ID NO: 638152 - RNA, 24 nt, Human
acgggguuucaccguguuagccag

SEQ ID NO: 638153 - RNA, 19 nt, Human
agagacgggguuucaccgu

SEQ ID NO: 638154 - RNA, 18 nt, Human
agauugaaacagacuaua

SEQ ID NO: 638155 - RNA, 21 nt, Human
agccacacgauaaagcaugcc

SEQ ID NO: 638156 - RNA, 21 nt, Human
agcggaaggagaaacggaggg

SEQ ID NO: 638157 - RNA, 19 nt, Human
agggaggaagacaaacccg

SEQ ID NO: 638158 - RNA, 18 nt, Human
agugcugggauuacaggc

SEQ ID NO: 638159 - RNA, 24 nt, Human
auaaagcaugccuauaauaugccc

SEQ ID NO: 638160 - RNA, 22 nt, Human
aucuaggaucuuacaaucugau

SEQ ID NO: 638161 - RNA, 24 nt, Human
caaagugcugggauuacaggcgua

SEQ ID NO: 638162 - RNA, 23 nt, Human
caagaugaaugcauacaggucua

SEQ ID NO: 638163 - RNA, 22 nt, Human
caaucaucuuucugaauucaaa

SEQ ID NO: 638164 - RNA, 23 nt, Human
cacccgccuccgccucccaaagu

SEQ ID NO: 638165 - RNA, 18 nt, Human
caccguguuagccaggau

SEQ ID NO: 638166 - RNA, 24 nt, Human
caccguguuagccaggauggccuu

SEQ ID NO: 638167 - RNA, 21 nt, Human
cagaauagagugaaaaaacuc

SEQ ID NO: 638168 - RNA, 24 nt, Human
caucagaauagagugaaaaaacuc

SEQ ID NO: 638169 - RNA, 20 nt, Human
cauccuaaaauaccuggcca

SEQ ID NO: 638170 - RNA, 22 nt, Human
ccaaagugcugggauuacaggc

SEQ ID NO: 638171 - RNA, 22 nt, Human
ccaaagugcugggauuacaggc

SEQ ID NO: 638172 - RNA, 24 nt, Human
ccaaagugcugggauuacaggcgu

SEQ ID NO: 638173 - RNA, 24 nt, Human
ccaccgcgcccagccagcauaaaa

SEQ ID NO: 638174 - RNA, 19 nt, Human
cccagcaccgccgcucucc

SEQ ID NO: 638175 - RNA, 24 nt, Human
ccgccuccgccucccaaagugcug

SEQ ID NO: 638176 - RNA, 18 nt, Human
ccucccagcaccgccgcu

SEQ ID NO: 638177 - RNA, 21 nt, Human
cgccuccaguaaugaugaucu

SEQ ID NO: 638178 - RNA, 24 nt, Human
cgggguuucaccguguuagccagg

SEQ ID NO: 638179 - RNA, 24 nt, Human
cuccugaccucgugauacacccgc

SEQ ID NO: 638180 - RNA, 19 nt, Human
cucugugagauuuguggga

SEQ ID NO: 638181 - RNA, 21 nt, Human
cuggccgggccucccagcacc

SEQ ID NO: 638182 - RNA, 21 nt, Human
cuguuccauucuuuaggcaca

SEQ ID NO: 638183 - RNA, 22 nt, Human
gaccucgugauacacccgccuc

SEQ ID NO: 638184 - RNA, 18 nt, Human
gagaaacggagggaggaa

SEQ ID NO: 638185 - RNA, 24 nt, Human
gagacgggguuucaccguguuagc

SEQ ID NO: 638186 - RNA, 18 nt, Human
gauuacaggcguaagcca

SEQ ID NO: 638187 - RNA, 22 nt, Human
gauuacaggcguaagccaccgc

SEQ ID NO: 638188 - RNA, 18 nt, Human
gccaugggggaaacaaag

SEQ ID NO: 638189 - RNA, 23 nt, Human
gccuccgccucccaaagugcugg

SEQ ID NO: 638190 - RNA, 21 nt, Human
ggagcagggcggcgcggcagu

SEQ ID NO: 638191 - RNA, 22 nt, Human
ggauuacaggcguaagccaccg

SEQ ID NO: 638192 - RNA, 22 nt, Human
gggccucccagcaccgccgcuc

SEQ ID NO: 638193 - RNA, 23 nt, Human
gggguuucaccguguuagccagg

SEQ ID NO: 638194 - RNA, 24 nt, Human
gugauacacccgccuccgccuccc

SEQ ID NO: 638195 - RNA, 18 nt, Human
uaacuugcucacacccau

SEQ ID NO: 638196 - RNA, 18 nt, Human
uaaucgcuugaaaccaga

SEQ ID NO: 638197 - RNA, 23 nt, Human
uacacccgccuccgccucccaaa

SEQ ID NO: 638198 - RNA, 24 nt, Human
uacaggcguaagccaccgcgccca

SEQ ID NO: 638199 - RNA, 24 nt, Human
uacuagagacgggguuucaccgug

SEQ ID NO: 638200 - RNA, 26 nt, Human
uacuagagacgggguuucaccguguu

SEQ ID NO: 638201 - RNA, 18 nt, Human
uagagacgggguuucacc

SEQ ID NO: 638202 - RNA, 18 nt, Human
uagagacgggguuucacc

SEQ ID NO: 638203 - RNA, 18 nt, Human
uaggagaagucuccggua

SEQ ID NO: 638204 - RNA, 18 nt, Human
uauaagguuguucacauu

SEQ ID NO: 638205 - RNA, 24 nt, Human
ucaccguguuagccaggauggccu

SEQ ID NO: 638206 - RNA, 18 nt, Human
uccacagauguucaggcc

SEQ ID NO: 638207 - RNA, 21 nt, Human
uccagaaaacaaacaacaaau

SEQ ID NO: 638208 - RNA, 24 nt, Human
ucccaaagugcugggauuacaggc

SEQ ID NO: 638209 - RNA, 20 nt, Human
ucccagcaccgccgcucucc

SEQ ID NO: 638210 - RNA, 21 nt, Human
ucccagccccaaucgcagcuc

SEQ ID NO: 638211 - RNA, 23 nt, Human
ucccuuuccaggacucaacuuug

SEQ ID NO: 638212 - RNA, 18 nt, Human
ucugaaaaaacaucagaa

SEQ ID NO: 638213 - RNA, 21 nt, Human
ugaaaaaacucuugaugcacc

SEQ ID NO: 638214 - RNA, 24 nt, Human
ugaagcaaaaaauccagaaaacaa

SEQ ID NO: 638215 - RNA, 24 nt, Human
ugcugggauuacaggcguaagcca

SEQ ID NO: 638216 - RNA, 25 nt, Human
uggcaugauaucaggcacauaguga

SEQ ID NO: 638217 - RNA, 18 nt, Human
ugggauuacaggcguaag

SEQ ID NO: 638218 - RNA, 19 nt, Human
ugggauuacaggcguaagc

SEQ ID NO: 638219 - RNA, 21 nt, Human
ugggauuacaggcguaagcca

SEQ ID NO: 638220 - RNA, 22 nt, Human
ugggauuacaggcguaagccac

SEQ ID NO: 638221 - RNA, 23 nt, Human
ugggauuacaggcguaagccacc

SEQ ID NO: 638222 - RNA, 24 nt, Human
ugggauuacaggcguaagccaccg

SEQ ID NO: 638223 - RNA, 20 nt, Human
uguuccauucuuuaggcaca

SEQ ID NO: 638224 - RNA, 22 nt, Human
uuaacaagccaugaucuuccuu

SEQ ID NO: 638225 - RNA, 24 nt, Human
uuacuagagacgggguuucaccgu

SEQ ID NO: 638226 - RNA, 18 nt, Human
uuauuccacagauguuca

SEQ ID NO: 638227 - RNA, 23 nt, Human
uugcuaaauuauuccacagaugu

SEQ ID NO: 638228 - RNA, 19 nt, Human
uuucaccguguuagccagg

SEQ ID NO: 638229 - RNA, 23 nt, Human
uuuccugcagccauaauaagggu

SEQ ID NO: 638230 - RNA, 27 nt, Human
uuugagaucuucuggccuuccccaucc

SEQ ID NO: 638231 - RNA, 24 nt, Human
uuuugagaucuucuggccuucccc

SEQ ID NO: 638232 - RNA, 24 nt, Human
uuuuuacuagagacgggguuucac

SEQ ID NO: 638233 - RNA, 24 nt, Human
uuuuuuguauuuuuacuagagacg

SEQ ID NO: 638234 - RNA, 18 nt, Human
uuuuuuuuuuuuuuuuug

SEQ ID NO: 638235 - RNA, 25 nt, Human
uuuuuuuuuuuuuuuuuuguauuuu

SEQ ID NO: 638236 - RNA, 22 nt, Human
aucaccaaucaaagaagcgaau

SEQ ID NO: 638237 - RNA, 25 nt, Human
auggcucuauucugagcaguuucac

SEQ ID NO: 638238 - RNA, 20 nt, Human
caacacucaggcuaggaaag

SEQ ID NO: 638239 - RNA, 19 nt, Human
ccaaaaucuaaguucccau

SEQ ID NO: 638240 - RNA, 21 nt, Human
gaacuugaugaaagauuauuu

SEQ ID NO: 638241 - RNA, 18 nt, Human
gaucauggcucuauucug

SEQ ID NO: 638242 - RNA, 21 nt, Human
gcucuauucugagcaguuuca

SEQ ID NO: 638243 - RNA, 25 nt, Human
gcugaaacgccaaggcaugacacug

SEQ ID NO: 638244 - RNA, 19 nt, Human
uaaaggagauggaacuuga

SEQ ID NO: 638245 - RNA, 18 nt, Human
ucaaaaucaccaaucaaa

SEQ ID NO: 638246 - RNA, 23 nt, Human
uccaaaaucuaaguucccauuuc

SEQ ID NO: 638247 - RNA, 18 nt, Human
ugaaacgccaaggcauga

SEQ ID NO: 638248 - RNA, 24 nt, Human
ugaaacgccaaggcaugacacugc

SEQ ID NO: 638249 - RNA, 19 nt, Human
uuuuuuuuuuuuuuuuugu

SEQ ID NO: 638250 - RNA, 22 nt, Human
uuuuuuuuuuuuuuuuuugugg

SEQ ID NO: 638251 - RNA, 21 nt, Human
aagggggguguuuuauggggg

SEQ ID NO: 638252 - RNA, 22 nt, Human
aagucacagggagcagagaggg

SEQ ID NO: 638253 - RNA, 19 nt, Human
acacgguguccccacagca

SEQ ID NO: 638254 - RNA, 23 nt, Human
acagaagucacagggagcagaga

SEQ ID NO: 638255 - RNA, 21 nt, Human
agaguccaaaacaagcgcauc

SEQ ID NO: 638256 - RNA, 18 nt, Human
agccagcagcagggaaag

SEQ ID NO: 638257 - RNA, 27 nt, Human
agcgcagaguccaaaacagcagggacu

SEQ ID NO: 638258 - RNA, 21 nt, Human
agcugacuaagacagagcccc

SEQ ID NO: 638259 - RNA, 23 nt, Human
agggaugcagcagagagccagca

SEQ ID NO: 638260 - RNA, 21 nt, Human
agggcacagggcggaggucaa

SEQ ID NO: 638261 - RNA, 23 nt, Human
aguggccacuuccuccaggcagc

SEQ ID NO: 638262 - RNA, 21 nt, Human
aucccaccuuccugcauccaa

SEQ ID NO: 638263 - RNA, 20 nt, Human
augccugcagcugagccugg

SEQ ID NO: 638264 - RNA, 23 nt, Human
caaaacgacccccucgugggagc

SEQ ID NO: 638265 - RNA, 19 nt, Human
caaaccuuccagcugccca

SEQ ID NO: 638266 - RNA, 20 nt, Human
caaaccuuccagcugcccag

SEQ ID NO: 638267 - RNA, 24 nt, Human
caagggggguguaugccaccccag

SEQ ID NO: 638268 - RNA, 18 nt, Human
cacagaaaccccauacag

SEQ ID NO: 638269 - RNA, 19 nt, Human
cacagagcugacuaagaca

SEQ ID NO: 638270 - RNA, 21 nt, Human
cacagagcugacuaagacaga

SEQ ID NO: 638271 - RNA, 19 nt, Human
cacaggaaacaucauucuu

SEQ ID NO: 638272 - RNA, 23 nt, Human
cacucaucccccagaaucaaagu

SEQ ID NO: 638273 - RNA, 23 nt, Human
cagcacagcagcagggaagagga

SEQ ID NO: 638274 - RNA, 18 nt, Human
cagcagggccgcucaauc

SEQ ID NO: 638275 - RNA, 25 nt, Human
cagcgcagaguccaaaacaagcgca

SEQ ID NO: 638276 - RNA, 19 nt, Human
caggagacgccuuguccau

SEQ ID NO: 638277 - RNA, 20 nt, Human
caggccacagagcugacuaa

SEQ ID NO: 638278 - RNA, 19 nt, Human
cauacaggaacgagguccc

SEQ ID NO: 638279 - RNA, 20 nt, Human
cauccaaaccuuccagcugc

SEQ ID NO: 638280 - RNA, 21 nt, Human
cauccaaaccuuccagcugcc

SEQ ID NO: 638281 - RNA, 21 nt, Human
cauuccagcugggacagaagu

SEQ ID NO: 638282 - RNA, 18 nt, Human
cccagaaucaaaguggcc

SEQ ID NO: 638283 - RNA, 21 nt, Human
ccccagaaucaaaguggccac

SEQ ID NO: 638284 - RNA, 22 nt, Human
ccccagaaucaaaguggccacu

SEQ ID NO: 638285 - RNA, 19 nt, Human
ccccauacaggaacgaggu

SEQ ID NO: 638286 - RNA, 18 nt, Human
ccugcagcugagccuggc

SEQ ID NO: 638287 - RNA, 18 nt, Human
ccugcuucagaacaccag

SEQ ID NO: 638288 - RNA, 28 nt, Human
cucaucccccagaaucaaaguggccacu

SEQ ID NO: 638289 - RNA, 18 nt, Human
cugaagucaucuggggac

SEQ ID NO: 638290 - RNA, 20 nt, Human
cugagccuggcaaggggcuu

SEQ ID NO: 638291 - RNA, 25 nt, Human
gacacagaaaccccauacaggaacg

SEQ ID NO: 638292 - RNA, 20 nt, Human
gacaccacucugcucugacu

SEQ ID NO: 638293 - RNA, 18 nt, Human
gagcagagaggguggggc

SEQ ID NO: 638294 - RNA, 25 nt, Human
gagcagagaggguggggcuaggggg

SEQ ID NO: 638295 - RNA, 24 nt, Human
gagccagcagcagggaaagggcaa

SEQ ID NO: 638296 - RNA, 20 nt, Human
gagccugcuucagaacaccg

SEQ ID NO: 638297 - RNA, 20 nt, Human
gaggcaugcugggagcacag

SEQ ID NO: 638298 - RNA, 20 nt, Human
gauggcagcacagcagcagg

SEQ ID NO: 638299 - RNA, 24 nt, Human
gcagacccaguucagucccagcca

SEQ ID NO: 638300 - RNA, 23 nt, Human
gcagggaaagggcacagggcgga

SEQ ID NO: 638301 - RNA, 20 nt, Human
gcccagaugggaaugcgagg

SEQ ID NO: 638302 - RNA, 19 nt, Human
gcggagugagcaggggaug

SEQ ID NO: 638303 - RNA, 22 nt, Human
gcggcugcccagaugggaaugc

SEQ ID NO: 638304 - RNA, 20 nt, Human
ggacagacacagaaacccca

SEQ ID NO: 638305 - RNA, 19 nt, Human
ggagcagagaggguggggc

SEQ ID NO: 638306 - RNA, 21 nt, Human
ggagugagcaggggauggcag

SEQ ID NO: 638307 - RNA, 22 nt, Human
gggcacagggcggaggucaagc

SEQ ID NO: 638308 - RNA, 27 nt, Human
gggggagcugguucugcucagcgcaga

SEQ ID NO: 638309 - RNA, 18 nt, Human
ggggguggaggugacaaa

SEQ ID NO: 638310 - RNA, 22 nt, Human
ggucacagucugccaggaggga

SEQ ID NO: 638311 - RNA, 19 nt, Human
uaagacagagccccugugc

SEQ ID NO: 638312 - RNA, 24 nt, Human
uaucccacucaucccccagaauca

SEQ ID NO: 638313 - RNA, 18 nt, Human
ucagucccagccagugug

SEQ ID NO: 638314 - RNA, 22 nt, Human
ucaucuggggacaccacucugc

SEQ ID NO: 638315 - RNA, 24 nt, Human
uccaacacguguuuaaugagcacc

SEQ ID NO: 638316 - RNA, 18 nt, Human
ucccaccuuccugcaucc

SEQ ID NO: 638317 - RNA, 19 nt, Human
uccccacagcagggccgcu

SEQ ID NO: 638318 - RNA, 18 nt, Human
ucgugggagcaggccugg

SEQ ID NO: 638319 - RNA, 21 nt, Human
ugacggcaccggccacgaggc

SEQ ID NO: 638320 - RNA, 19 nt, Human
ugacuaagacagagccccu

SEQ ID NO: 638321 - RNA, 25 nt, Human
ugacuggggacuauggggggagcac

SEQ ID NO: 638322 - RNA, 22 nt, Human
ugagccuggcaaggggcuugca

SEQ ID NO: 638323 - RNA, 19 nt, Human
ugagggucacagucugcca

SEQ ID NO: 638324 - RNA, 22 nt, Human
ugaucuacaaaacgacccccuc

SEQ ID NO: 638325 - RNA, 24 nt, Human
ugcccagaacugcugguaauccca

SEQ ID NO: 638326 - RNA, 18 nt, Human
uggaagacaccaaggggg

SEQ ID NO: 638327 - RNA, 22 nt, Human
uggaguugggggagcugguucu

SEQ ID NO: 638328 - RNA, 20 nt, Human
uguaccaggccacagagcuu

SEQ ID NO: 638329 - RNA, 19 nt, Human
uuagagcuacaguguuaac

SEQ ID NO: 638330 - RNA, 21 nt, Human
uucgcacacacacgguguccc

SEQ ID NO: 638331 - RNA, 21 nt, Human
uuuacacacuagggcuuaagu

SEQ ID NO: 638332 - RNA, 20 nt, Human
uuugccaagaugcuauccca

SEQ ID NO: 638333 - RNA, 22 nt, Human
uuuuuuuuuuuuuugccaguaa

SEQ ID NO: 638334 - RNA, 20 nt, Human
uuuuuuuuuuuuuuuuugcc

SEQ ID NO: 638335 - RNA, 22 nt, Human
uuuuuuuuuuuuuuuuugccag

SEQ ID NO: 638336 - RNA, 20 nt, Human
uuuuuuuuuuuuuuuuuugg

SEQ ID NO: 638337 - RNA, 20 nt, Human
aaccgccagcaucugauuug

SEQ ID NO: 638338 - RNA, 18 nt, Human
acugaagaguccuguuga

SEQ ID NO: 638339 - RNA, 18 nt, Human
acuuguggaauacuuccu

SEQ ID NO: 638340 - RNA, 21 nt, Human
agcaaaggaaagccaucacca

SEQ ID NO: 638341 - RNA, 20 nt, Human
aggcucaugaaguugaucug

SEQ ID NO: 638342 - RNA, 20 nt, Human
aggugccuucugaacaacag

SEQ ID NO: 638343 - RNA, 21 nt, Human
aguaacggaaguccaaaggaa

SEQ ID NO: 638344 - RNA, 25 nt, Human
aguuccuucauggcagugugggcuu

SEQ ID NO: 638345 - RNA, 21 nt, Human
auaugugcauauccauuuccu

SEQ ID NO: 638346 - RNA, 23 nt, Human
aucucuccuuaagauuuuuguug

SEQ ID NO: 638347 - RNA, 19 nt, Human
cacagacugagacugcugu

SEQ ID NO: 638348 - RNA, 24 nt, Human
cauauccauuuccucuucuguaaa

SEQ ID NO: 638349 - RNA, 19 nt, Human
ccaguacuauuuugaccag

SEQ ID NO: 638350 - RNA, 23 nt, Human
cccacgucuucugcucaacuucu

SEQ ID NO: 638351 - RNA, 19 nt, Human
cccaggaugugaaaaggcu

SEQ ID NO: 638352 - RNA, 18 nt, Human
cccuuugacacugaaccu

SEQ ID NO: 638353 - RNA, 18 nt, Human
ccuguauguaagaaaagg

SEQ ID NO: 638354 - RNA, 27 nt, Human
cugcaacugaaccgccagcaucugauu

SEQ ID NO: 638355 - RNA, 18 nt, Human
cuguggcagagcagguug

SEQ ID NO: 638356 - RNA, 21 nt, Human
cuucgaucauaccuuuuuguu

SEQ ID NO: 638357 - RNA, 22 nt, Human
cuucugaaaccuccaacagauu

SEQ ID NO: 638358 - RNA, 18 nt, Human
cuucugcuauagguugga

SEQ ID NO: 638359 - RNA, 24 nt, Human
gagcaggugguugugaagcaacau

SEQ ID NO: 638360 - RNA, 19 nt, Human
gcucucccucucaauauug

SEQ ID NO: 638361 - RNA, 24 nt, Human
ggaaguccaaaggaauggugagga

SEQ ID NO: 638362 - RNA, 18 nt, Human
ggcagguauaguaacgga

SEQ ID NO: 638363 - RNA, 21 nt, Human
ggccugaagggaacuugugga

SEQ ID NO: 638364 - RNA, 24 nt, Human
ggcuuuccccuaaaugcacagacu

SEQ ID NO: 638365 - RNA, 24 nt, Human
ggugaguauuuccagcaggagcug

SEQ ID NO: 638366 - RNA, 22 nt, Human
gucuucaacaucaccacauccu

SEQ ID NO: 638367 - RNA, 20 nt, Human
gucuucugcucaacuucuuu

SEQ ID NO: 638368 - RNA, 22 nt, Human
gugggcuguucuugcgaggcuu

SEQ ID NO: 638369 - RNA, 23 nt, Human
uaacggacuccgaacaaucuggu

SEQ ID NO: 638370 - RNA, 19 nt, Human
uaagucuaggugccuucug

SEQ ID NO: 638371 - RNA, 22 nt, Human
uacaguuucugcccacgucuuc

SEQ ID NO: 638372 - RNA, 19 nt, Human
uacuauuuugaccagaugg

SEQ ID NO: 638373 - RNA, 22 nt, Human
uaucugggagauuagcaaagga

SEQ ID NO: 638374 - RNA, 24 nt, Human
uauguaagaaaaggggcuggaauu

SEQ ID NO: 638375 - RNA, 19 nt, Human
uauugauccaaguucacau

SEQ ID NO: 638376 - RNA, 23 nt, Human
uauuuugacaagauuuauucuga

SEQ ID NO: 638377 - RNA, 23 nt, Human
ucaggauuuuuugcuucaguugg

SEQ ID NO: 638378 - RNA, 25 nt, Human
uccaacagauucuucaaugucuucu

SEQ ID NO: 638379 - RNA, 19 nt, Human
ucccauguggaacauucug

SEQ ID NO: 638380 - RNA, 22 nt, Human
uccccaagccucucuugguugu

SEQ ID NO: 638381 - RNA, 23 nt, Human
ucccuggcuuaacaucaaauagu

SEQ ID NO: 638382 - RNA, 18 nt, Human
ucuacuugcauugauuga

SEQ ID NO: 638383 - RNA, 19 nt, Human
ucucaagggucccuggcuc

SEQ ID NO: 638384 - RNA, 21 nt, Human
ucugauuugcucucccucuca

SEQ ID NO: 638385 - RNA, 22 nt, Human
ucugcucaacuucuuuuuuucu

SEQ ID NO: 638386 - RNA, 22 nt, Human
ucuucaacaucaccacauccuc

SEQ ID NO: 638387 - RNA, 27 nt, Human
ucuucuguaaaugcuucuacuucuaaa

SEQ ID NO: 638388 - RNA, 19 nt, Human
ucuugguuguggcaaaggc

SEQ ID NO: 638389 - RNA, 21 nt, Human
ugaggagugguaugcccagga

SEQ ID NO: 638390 - RNA, 23 nt, Human
ugaguauuuccagcaggagcugg

SEQ ID NO: 638391 - RNA, 18 nt, Human
ugagugauggaaauaaua

SEQ ID NO: 638392 - RNA, 20 nt, Human
ugauuuggggcauuucuuug

SEQ ID NO: 638393 - RNA, 24 nt, Human
ugcucaacuucuuuuuuucuggcu

SEQ ID NO: 638394 - RNA, 21 nt, Human
uggcagagcagguuggaagga

SEQ ID NO: 638395 - RNA, 18 nt, Human
ugugcugcucucuguggc

SEQ ID NO: 638396 - RNA, 18 nt, Human
uguuguguaucugggaga

SEQ ID NO: 638397 - RNA, 21 nt, Human
uuaggcucaugaaguugaucu

SEQ ID NO: 638398 - RNA, 20 nt, Human
uucaacaucaccacauccuc

SEQ ID NO: 638399 - RNA, 22 nt, Human
uucaaugucuucuucauagucu

SEQ ID NO: 638400 - RNA, 18 nt, Human
uuccuguauguaagaaaa

SEQ ID NO: 638401 - RNA, 19 nt, Human
uucugcccacgucuucugc

SEQ ID NO: 638402 - RNA, 19 nt, Human
uuggagcaggugguuguga

SEQ ID NO: 638403 - RNA, 18 nt, Human
uuuagacuuaaauugaag

SEQ ID NO: 638404 - RNA, 21 nt, Human
cagggagucccagcgaggccc

SEQ ID NO: 638405 - RNA, 22 nt, Human
cgacauggacagcgcguugccc

SEQ ID NO: 638406 - RNA, 24 nt, Human
uauuaaggaacugaugcaucugag

SEQ ID NO: 638407 - RNA, 21 nt, Human
aagcgggcagcgggucugggg

SEQ ID NO: 638408 - RNA, 23 nt, Human
aagcgggcagcgggucugggguc

SEQ ID NO: 638409 - RNA, 19 nt, Human
aaugguuugggguggcucc

SEQ ID NO: 638410 - RNA, 19 nt, Human
acccagcccugcccugccc

SEQ ID NO: 638411 - RNA, 21 nt, Human
acccagcccugcccugcccuu

SEQ ID NO: 638412 - RNA, 18 nt, Human
acuggguggugguggggc

SEQ ID NO: 638413 - RNA, 21 nt, Human
agaggucccuucaugaccucu

SEQ ID NO: 638414 - RNA, 21 nt, Human
agcgggcagcgggucuggggu

SEQ ID NO: 638415 - RNA, 24 nt, Human
agcuggagccacagaggucccuuc

SEQ ID NO: 638416 - RNA, 22 nt, Human
aggcggagcgggcugggcgggu

SEQ ID NO: 638417 - RNA, 23 nt, Human
aggggagggggcggugagccggg

SEQ ID NO: 638418 - RNA, 20 nt, Human
aguuccccucccuggccucc

SEQ ID NO: 638419 - RNA, 19 nt, Human
auggcaccuccagggcuga

SEQ ID NO: 638420 - RNA, 19 nt, Human
caacaagggucucaccccc

SEQ ID NO: 638421 - RNA, 20 nt, Human
caacccagggcggccgucgg

SEQ ID NO: 638422 - RNA, 21 nt, Human
cacccucugcccccgcaccuc

SEQ ID NO: 638423 - RNA, 22 nt, Human
cacuggguccccaaacugggug

SEQ ID NO: 638424 - RNA, 19 nt, Human
cagggagcugcaggcagag

SEQ ID NO: 638425 - RNA, 24 nt, Human
cauaacaggggccaggccggcacc

SEQ ID NO: 638426 - RNA, 21 nt, Human
ccacagaggucccuucaugac

SEQ ID NO: 638427 - RNA, 23 nt, Human
ccagaccacaggucggggugcgg

SEQ ID NO: 638428 - RNA, 20 nt, Human
ccaggccggcaccccucugu

SEQ ID NO: 638429 - RNA, 22 nt, Human
cccacccagcccugcccugccc

SEQ ID NO: 638430 - RNA, 18 nt, Human
cccauaacaggggccagg

SEQ ID NO: 638431 - RNA, 25 nt, Human
cccuccgccggcaccucggggaguc

SEQ ID NO: 638432 - RNA, 21 nt, Human
ccgcgagccacccccuccgcc

SEQ ID NO: 638433 - RNA, 21 nt, Human
ccgggccauggcgggcggggc

SEQ ID NO: 638434 - RNA, 18 nt, Human
ccuggagcggagucgcgg

SEQ ID NO: 638435 - RNA, 21 nt, Human
ccuggcucuugguaagucacc

SEQ ID NO: 638436 - RNA, 20 nt, Human
ccuugcccaaccccgggggg

SEQ ID NO: 638437 - RNA, 24 nt, Human
ccuugucuggcugccaacaagggu

SEQ ID NO: 638438 - RNA, 24 nt, Human
cgagccacccccuccgccggcacc

SEQ ID NO: 638439 - RNA, 22 nt, Human
cgggcgcgaagcgggcagcggg

SEQ ID NO: 638440 - RNA, 19 nt, Human
cgggcugggcggguugggg

SEQ ID NO: 638441 - RNA, 19 nt, Human
cgggcugggcggguugggg

SEQ ID NO: 638442 - RNA, 20 nt, Human
cggggcgcaaggcggagcgg

SEQ ID NO: 638443 - RNA, 22 nt, Human
cggggcugcaggggagggggcg

SEQ ID NO: 638444 - RNA, 22 nt, Human
cgucgggggcagccugagccgc

SEQ ID NO: 638445 - RNA, 20 nt, Human
cucccuggccuccuacaggg

SEQ ID NO: 638446 - RNA, 22 nt, Human
cuccgggcugggggcucccugg

SEQ ID NO: 638447 - RNA, 23 nt, Human
cuggguggugguggggcgccugu

SEQ ID NO: 638448 - RNA, 22 nt, Human
cuugcugucacuugggccuggg

SEQ ID NO: 638449 - RNA, 21 nt, Human
gaggcugacccauaacagggg

SEQ ID NO: 638450 - RNA, 18 nt, Human
gaggucccuucaugaccu

SEQ ID NO: 638451 - RNA, 20 nt, Human
gauggcaccuccagggcuga

SEQ ID NO: 638452 - RNA, 19 nt, Human
gcagcuggagccacagagg

SEQ ID NO: 638453 - RNA, 21 nt, Human
gccggcaccucggggaguccu

SEQ ID NO: 638454 - RNA, 20 nt, Human
gccgucgggauccgggccau

SEQ ID NO: 638455 - RNA, 23 nt, Human
gcggagcgggcugggcggguugg

SEQ ID NO: 638456 - RNA, 22 nt, Human
gcggguccccgcccaggcugcg

SEQ ID NO: 638457 - RNA, 21 nt, Human
gcuccugaacugcugaguucc

SEQ ID NO: 638458 - RNA, 20 nt, Human
ggagcugcaggcagaggagg

SEQ ID NO: 638459 - RNA, 24 nt, Human
ggaggcugaugcaacccagggcgg

SEQ ID NO: 638460 - RNA, 25 nt, Human
ggagggggcggugagccgggcacgu

SEQ ID NO: 638461 - RNA, 23 nt, Human
ggcccggugaagcuuccagacca

SEQ ID NO: 638462 - RNA, 23 nt, Human
ggccgucgggauccgggccaugg

SEQ ID NO: 638463 - RNA, 21 nt, Human
ggcggagcgggcugggcgggu

SEQ ID NO: 638464 - RNA, 22 nt, Human
ggcugcaggggagggggcggug

SEQ ID NO: 638465 - RNA, 22 nt, Human
gggcagcgggucuggggucggg

SEQ ID NO: 638466 - RNA, 20 nt, Human
gggcugcaggggagggggcg

SEQ ID NO: 638467 - RNA, 19 nt, Human
gggcugggcggguuggggg

SEQ ID NO: 638468 - RNA, 19 nt, Human
ggggcgccugugcugccug

SEQ ID NO: 638469 - RNA, 19 nt, Human
ggggcugcaggggaggggg

SEQ ID NO: 638470 - RNA, 19 nt, Human
ggggugccugggcugcagg

SEQ ID NO: 638471 - RNA, 21 nt, Human
gguccccaaacuggguggugg

SEQ ID NO: 638472 - RNA, 22 nt, Human
ggucggggugcggggugccugg

SEQ ID NO: 638473 - RNA, 19 nt, Human
gucccuucaugaccucugg

SEQ ID NO: 638474 - RNA, 24 nt, Human
guccugccuggagcggagucgcgg

SEQ ID NO: 638475 - RNA, 20 nt, Human
uaacaggggccaggccggca

SEQ ID NO: 638476 - RNA, 18 nt, Human
ucacuugggccugggcug

SEQ ID NO: 638477 - RNA, 23 nt, Human
uccccgcccaggcugcgggacag

SEQ ID NO: 638478 - RNA, 22 nt, Human
uccgcggucggggcgccgggcg

SEQ ID NO: 638479 - RNA, 20 nt, Human
uccugaacugcugaguuccc

SEQ ID NO: 638480 - RNA, 21 nt, Human
uccugaacugcugaguucccc

SEQ ID NO: 638481 - RNA, 18 nt, Human
ucggggcgccgggcgugg

SEQ ID NO: 638482 - RNA, 20 nt, Human
ugaacugcugaguuccccuc

SEQ ID NO: 638483 - RNA, 28 nt, Human
ugccugggcugcaggcugcuggaagggc

SEQ ID NO: 638484 - RNA, 19 nt, Human
ugccuguggagccccaccc

SEQ ID NO: 638485 - RNA, 19 nt, Human
ugcuggaagggcuccgggc

SEQ ID NO: 638486 - RNA, 27 nt, Human
ugcuggaagggcuccgggcugggggcu

SEQ ID NO: 638487 - RNA, 24 nt, Human
uggaagggcuccgggcugggggcu

SEQ ID NO: 638488 - RNA, 20 nt, Human
ugggcggguuggggguccug

SEQ ID NO: 638489 - RNA, 22 nt, Human
uggggucggccgcggguccggg

SEQ ID NO: 638490 - RNA, 19 nt, Human
ugguaagucacccucugcc

SEQ ID NO: 638491 - RNA, 22 nt, Human
uggugguggggcgccugugcug

SEQ ID NO: 638492 - RNA, 20 nt, Human
uguggagccccacccuuguc

SEQ ID NO: 638493 - RNA, 19 nt, Human
uuuuuuuuuuuuuuuuugu

SEQ ID NO: 638494 - RNA, 20 nt, Human
uuuuuuuuuuuuuuuuuugg

SEQ ID NO: 638495 - RNA, 22 nt, Human
aacagcccaccucacugugccc

SEQ ID NO: 638496 - RNA, 20 nt, Human
aaguggcugauaaauccaaa

SEQ ID NO: 638497 - RNA, 21 nt, Human
acacagcucacuggcugaguu

SEQ ID NO: 638498 - RNA, 22 nt, Human
acaguccugcugaauguuaaaa

SEQ ID NO: 638499 - RNA, 31 nt, Human
acccacuuguucacggacagggauagagguu

SEQ ID NO: 638500 - RNA, 22 nt, Human
acuggcaaguggggacagagug

SEQ ID NO: 638501 - RNA, 24 nt, Human
acugugcccucuaaaggagaucuu

SEQ ID NO: 638502 - RNA, 23 nt, Human
agaggucaacauucugaggaggu

SEQ ID NO: 638503 - RNA, 18 nt, Human
agcagaggggagacuauu

SEQ ID NO: 638504 - RNA, 22 nt, Human
aggaaauggacacagcucacug

SEQ ID NO: 638505 - RNA, 22 nt, Human
aggcagucucucuagaagaggu

SEQ ID NO: 638506 - RNA, 18 nt, Human
aggcaguggcagcagagg

SEQ ID NO: 638507 - RNA, 20 nt, Human
agggaggggaagugcauggg

SEQ ID NO: 638508 - RNA, 19 nt, Human
aguggagaaucaggcagug

SEQ ID NO: 638509 - RNA, 22 nt, Human
auaaauacuuggugcuaaaaag

SEQ ID NO: 638510 - RNA, 18 nt, Human
augaagaaggugaagaug

SEQ ID NO: 638511 - RNA, 24 nt, Human
augaccacaguccugcugaauguu

SEQ ID NO: 638512 - RNA, 24 nt, Human
auucugaggaggucagcagucuca

SEQ ID NO: 638513 - RNA, 19 nt, Human
caacugcaaguuugugcag

SEQ ID NO: 638514 - RNA, 22 nt, Human
cacccaccucagcaaucagaau

SEQ ID NO: 638515 - RNA, 21 nt, Human
cacugacagcuauuucauuca

SEQ ID NO: 638516 - RNA, 23 nt, Human
cacugugcccucuaaaggagauc

SEQ ID NO: 638517 - RNA, 20 nt, Human
cagaaggagcaaugagccac

SEQ ID NO: 638518 - RNA, 25 nt, Human
cagagccauuuuacagagucagaag

SEQ ID NO: 638519 - RNA, 18 nt, Human
cagugcacauacuuacag

SEQ ID NO: 638520 - RNA, 21 nt, Human
caucccaacagcccaccucac

SEQ ID NO: 638521 - RNA, 20 nt, Human
ccaaaacugggcugaugcua

SEQ ID NO: 638522 - RNA, 27 nt, Human
ccaacagcccaccucacugugcccucu

SEQ ID NO: 638523 - RNA, 19 nt, Human
ccccugccuacggccaucc

SEQ ID NO: 638524 - RNA, 23 nt, Human
cccuucaagaauauggauuuuca

SEQ ID NO: 638525 - RNA, 25 nt, Human
ccuacggccaucccaacagcccacc

SEQ ID NO: 638526 - RNA, 22 nt, Human
ccuccaugcagugcacauacuu

SEQ ID NO: 638527 - RNA, 21 nt, Human
ccugcugaauguuaaaaugga

SEQ ID NO: 638528 - RNA, 20 nt, Human
cuagugagaauaaauacuug

SEQ ID NO: 638529 - RNA, 19 nt, Human
cucaugcccugccagcuau

SEQ ID NO: 638530 - RNA, 18 nt, Human
cucauucaaucuggggca

SEQ ID NO: 638531 - RNA, 20 nt, Human
cucuguuuccugauggcccc

SEQ ID NO: 638532 - RNA, 18 nt, Human
cugaacugcacuccaccc

SEQ ID NO: 638533 - RNA, 20 nt, Human
cugaauguuaaaauggacaa

SEQ ID NO: 638534 - RNA, 20 nt, Human
cugcaaguuugugcagcuga

SEQ ID NO: 638535 - RNA, 21 nt, Human
gaagaaggugaagauguagua

SEQ ID NO: 638536 - RNA, 20 nt, Human
gaaguugcaacauaaacacu

SEQ ID NO: 638537 - RNA, 22 nt, Human
gaccacaguccugcugaauguu

SEQ ID NO: 638538 - RNA, 18 nt, Human
gagauucuuuagcuuugc

SEQ ID NO: 638539 - RNA, 19 nt, Human
gcagcugaauuucuguaaa

SEQ ID NO: 638540 - RNA, 21 nt, Human
gcaguggauaaccuuucugaa

SEQ ID NO: 638541 - RNA, 20 nt, Human
gcuaaaaagauaggugauau

SEQ ID NO: 638542 - RNA, 21 nt, Human
uaaacuaguuaacacuggcua

SEQ ID NO: 638543 - RNA, 26 nt, Human
uacauacaaaaauugcacacauagug

SEQ ID NO: 638544 - RNA, 27 nt, Human
uagaagggagcuggccaauuacugcuc

SEQ ID NO: 638545 - RNA, 23 nt, Human
uagagguuugucuuucuucuuuc

SEQ ID NO: 638546 - RNA, 23 nt, Human
uaguaaaagcaucauccagguac

SEQ ID NO: 638547 - RNA, 24 nt, Human
uauaagcucugaacugcacuccac

SEQ ID NO: 638548 - RNA, 22 nt, Human
uauccagaauuauggaggaaau

SEQ ID NO: 638549 - RNA, 19 nt, Human
ucaagggaaggcaacugca

SEQ ID NO: 638550 - RNA, 23 nt, Human
ucaaucacccaccucagcaauca

SEQ ID NO: 638551 - RNA, 25 nt, Human
ucagcagucucaucaguggccuucu

SEQ ID NO: 638552 - RNA, 21 nt, Human
ucaguggccuucuuccucucc

SEQ ID NO: 638553 - RNA, 27 nt, Human
uccacugacagcuauuucauucagggc

SEQ ID NO: 638554 - RNA, 28 nt, Human
uccacugacagcuauuucauucagggca

SEQ ID NO: 638555 - RNA, 19 nt, Human
uccugauggccccuagaga

SEQ ID NO: 638556 - RNA, 19 nt, Human
ucucauucaaucuggggca

SEQ ID NO: 638557 - RNA, 23 nt, Human
ucuccuggaacaaaagauauagu

SEQ ID NO: 638558 - RNA, 22 nt, Human
ucuuucuucuuuccuugaauuu

SEQ ID NO: 638559 - RNA, 19 nt, Human
ugaaaaugggucuaugacc

SEQ ID NO: 638560 - RNA, 21 nt, Human
ugaacagcucucaaucaccca

SEQ ID NO: 638561 - RNA, 22 nt, Human
ugaacugcacuccacccugcug

SEQ ID NO: 638562 - RNA, 24 nt, Human
ugaauagacccacuuguucacgga

SEQ ID NO: 638563 - RNA, 24 nt, Human
ugcagugcacauacuuacagauaa

SEQ ID NO: 638564 - RNA, 19 nt, Human
ugccuacggccaucccaac

SEQ ID NO: 638565 - RNA, 22 nt, Human
ugccuacggccaucccaacagc

SEQ ID NO: 638566 - RNA, 24 nt, Human
ugccuacggccaucccaacagccc

SEQ ID NO: 638567 - RNA, 21 nt, Human
uggcagcagaggggagacuau

SEQ ID NO: 638568 - RNA, 25 nt, Human
uggcuacugauagaagggagcuggc

SEQ ID NO: 638569 - RNA, 19 nt, Human
ugggucagcucuguaaugg

SEQ ID NO: 638570 - RNA, 20 nt, Human
ugggucagcucuguaauggg

SEQ ID NO: 638571 - RNA, 24 nt, Human
ugguaaccaaaacugggcugaugc

SEQ ID NO: 638572 - RNA, 20 nt, Human
uguuucaagggaaggcaacu

SEQ ID NO: 638573 - RNA, 21 nt, Human
uuaaaauggacagccagacuc

SEQ ID NO: 638574 - RNA, 22 nt, Human
uuagagcuccacugacagcuau

SEQ ID NO: 638575 - RNA, 22 nt, Human
uuauaagcucugaacugcacuc

SEQ ID NO: 638576 - RNA, 22 nt, Human
uuccugauggccccuagagaau

SEQ ID NO: 638577 - RNA, 20 nt, Human
uugaauuuggagugagcacu

SEQ ID NO: 638578 - RNA, 18 nt, Human
uuuuuuuuuuuuuuuuug

SEQ ID NO: 638579 - RNA, 23 nt, Human
aaaaagaaccaaaauaagaacac

SEQ ID NO: 638580 - RNA, 20 nt, Human
aaaagccaagcucagagacu

SEQ ID NO: 638581 - RNA, 23 nt, Human
aaagugcugggauuacaggcaug

SEQ ID NO: 638582 - RNA, 23 nt, Human
aacccaucucucccacucauccc

SEQ ID NO: 638583 - RNA, 24 nt, Human
aacccaucucucccacucaucccu

SEQ ID NO: 638584 - RNA, 20 nt, Human
aagccaagcucagagacugg

SEQ ID NO: 638585 - RNA, 19 nt, Human
aaguagcugggacuacagg

SEQ ID NO: 638586 - RNA, 20 nt, Human
aaguagcugggacuacaggc

SEQ ID NO: 638587 - RNA, 26 nt, Human
aaguagcugggacuacaggcgcacgc

SEQ ID NO: 638588 - RNA, 19 nt, Human
aagugcugggauuacaggc

SEQ ID NO: 638589 - RNA, 23 nt, Human
aagugcugggauuacaggcaugu

SEQ ID NO: 638590 - RNA, 25 nt, Human
acccaucucagcuucccaaagugcu

SEQ ID NO: 638591 - RNA, 24 nt, Human
accguauuggucagguugcucuug

SEQ ID NO: 638592 - RNA, 19 nt, Human
acgcucccggcgaggagac

SEQ ID NO: 638593 - RNA, 20 nt, Human
acgggcuuucaccguauugg

SEQ ID NO: 638594 - RNA, 24 nt, Human
acucuguugcccaggcuggagugc

SEQ ID NO: 638595 - RNA, 21 nt, Human
agcggacuacacagucggccc

SEQ ID NO: 638596 - RNA, 25 nt, Human
aggcuggagugcaguggcaugaucu

SEQ ID NO: 638597 - RNA, 24 nt, Human
aggugauccacccaucucagcuuc

SEQ ID NO: 638598 - RNA, 19 nt, Human
agugcaguggcaugaucuc

SEQ ID NO: 638599 - RNA, 21 nt, Human
agugcaguggcaugaucucag

SEQ ID NO: 638600 - RNA, 23 nt, Human
agugcaguggcaugaucucagcu

SEQ ID NO: 638601 - RNA, 24 nt, Human
aguggcaugaucucagcucacugu

SEQ ID NO: 638602 - RNA, 18 nt, Human
aucaguucaacuguccug

SEQ ID NO: 638603 - RNA, 19 nt, Human
augugccaccgcacccagc

SEQ ID NO: 638604 - RNA, 24 nt, Human
auuuuuguauuuuuaguagagacg

SEQ ID NO: 638605 - RNA, 24 nt, Human
caaagugcugggauuacaggcaug

SEQ ID NO: 638606 - RNA, 19 nt, Human
caagcuauucuccucucuc

SEQ ID NO: 638607 - RNA, 24 nt, Human
caccaccccaggcuaauuuuugua

SEQ ID NO: 638608 - RNA, 23 nt, Human
cacccaucucagcuucccaaagu

SEQ ID NO: 638609 - RNA, 22 nt, Human
caccguauuggucagguugcuc

SEQ ID NO: 638610 - RNA, 20 nt, Human
cacucuccauaaaagccaag

SEQ ID NO: 638611 - RNA, 22 nt, Human
cacucuguugcccaggcuggag

SEQ ID NO: 638612 - RNA, 18 nt, Human
cacuguaaccucugccuc

SEQ ID NO: 638613 - RNA, 18 nt, Human
cagaaugcugaaaugaca

SEQ ID NO: 638614 - RNA, 24 nt, Human
cagagucucacucuguugcccagg

SEQ ID NO: 638615 - RNA, 21 nt, Human
caggcgcacgccaccacccca

SEQ ID NO: 638616 - RNA, 18 nt, Human
cauaaaagccaagcucag

SEQ ID NO: 638617 - RNA, 20 nt, Human
caucuuugaaggacugcagu

SEQ ID NO: 638618 - RNA, 20 nt, Human
caugugccaccgcacccagc

SEQ ID NO: 638619 - RNA, 23 nt, Human
ccaaagugcugggauuacaggca

SEQ ID NO: 638620 - RNA, 24 nt, Human
ccaaagugcugggauuacaggcau

SEQ ID NO: 638621 - RNA, 25 nt, Human
ccaaagugcugggauuacaggcaug

SEQ ID NO: 638622 - RNA, 24 nt, Human
cccaaagugcugggauuacaggca

SEQ ID NO: 638623 - RNA, 23 nt, Human
cccaaguagcugggacuacaggc

SEQ ID NO: 638624 - RNA, 23 nt, Human
cccaaguagcugggacuacaggc

SEQ ID NO: 638625 - RNA, 21 nt, Human
ccgcacccagccauguauuau

SEQ ID NO: 638626 - RNA, 20 nt, Human
ccuccucauagggaaggcca

SEQ ID NO: 638627 - RNA, 22 nt, Human
ccugagcucaggugauccaccc

SEQ ID NO: 638628 - RNA, 23 nt, Human
ccugagcucaggugauccaccca

SEQ ID NO: 638629 - RNA, 20 nt, Human
cgcucccggcgaggagacug

SEQ ID NO: 638630 - RNA, 18 nt, Human
cgggcagagcgcgcugcc

SEQ ID NO: 638631 - RNA, 24 nt, Human
cucacucuguugcccaggcuggag

SEQ ID NO: 638632 - RNA, 19 nt, Human
cucacuguaaccucugccu

SEQ ID NO: 638633 - RNA, 24 nt, Human
cucacuguaaccucugccucucag

SEQ ID NO: 638634 - RNA, 24 nt, Human
cucagccucccaaguagcugggac

SEQ ID NO: 638635 - RNA, 21 nt, Human
cucagcuucccaaagugcugg

SEQ ID NO: 638636 - RNA, 24 nt, Human
cuggagugcaguggcaugaucuca

SEQ ID NO: 638637 - RNA, 24 nt, Human
cuguaaccucugccucucagguuc

SEQ ID NO: 638638 - RNA, 20 nt, Human
cuugaacuccugagcucagg

SEQ ID NO: 638639 - RNA, 24 nt, Human
gagcucaggugauccacccaucuc

SEQ ID NO: 638640 - RNA, 24 nt, Human
gagguuguggaaauaaaaaaaaga

SEQ ID NO: 638641 - RNA, 18 nt, Human
gauuacaggcaugugcca

SEQ ID NO: 638642 - RNA, 24 nt, Human
gcccaggcuggagugcaguggcau

SEQ ID NO: 638643 - RNA, 22 nt, Human
gcucaggugauccacccaucuc

SEQ ID NO: 638644 - RNA, 19 nt, Human
gcuggagugcaguggcaug

SEQ ID NO: 638645 - RNA, 25 nt, Human
ggaaauaaaaaaaagaaccgguacc

SEQ ID NO: 638646 - RNA, 22 nt, Human
ggauuacaggcaugugccaccg

SEQ ID NO: 638647 - RNA, 24 nt, Human
ggauugggcuagaagggcccugug

SEQ ID NO: 638648 - RNA, 21 nt, Human
gugacuucguugaucuuccuc

SEQ ID NO: 638649 - RNA, 24 nt, Human
gugauccacccaucucagcuuccc

SEQ ID NO: 638650 - RNA, 25 nt, Human
uaaaaaaaagaaccaaaauaagaac

SEQ ID NO: 638651 - RNA, 22 nt, Human
uaagaacacucuccauaaaagc

SEQ ID NO: 638652 - RNA, 25 nt, Human
uaagaacacucuccauaaaagccaa

SEQ ID NO: 638653 - RNA, 18 nt, Human
uaagacagagucucacuc

SEQ ID NO: 638654 - RNA, 22 nt, Human
uaagacagagucucacucuguu

SEQ ID NO: 638655 - RNA, 24 nt, Human
uaauuuuuguauuuuuaguagaga

SEQ ID NO: 638656 - RNA, 24 nt, Human
uacaggcaugugccaccgcaccca

SEQ ID NO: 638657 - RNA, 24 nt, Human
uaggaaagcaaaguuuacugaagg

SEQ ID NO: 638658 - RNA, 21 nt, Human
uaguagagacgggcuuucacc

SEQ ID NO: 638659 - RNA, 24 nt, Human
uaguagagacgggcuuucaccgua

SEQ ID NO: 638660 - RNA, 18 nt, Human
uauaacccaucucuccca

SEQ ID NO: 638661 - RNA, 21 nt, Human
uauguauauauuuaaaggcuu

SEQ ID NO: 638662 - RNA, 24 nt, Human
ucaagauaaaaauagggaugacuu

SEQ ID NO: 638663 - RNA, 18 nt, Human
ucaagcuauucuccucuc

SEQ ID NO: 638664 - RNA, 24 nt, Human
ucacucuguugcccaggcuggagu

SEQ ID NO: 638665 - RNA, 19 nt, Human
ucacuguaaccucugccuc

SEQ ID NO: 638666 - RNA, 24 nt, Human
ucacuguaaccucugccucucagg

SEQ ID NO: 638667 - RNA, 20 nt, Human
ucagaaacugaagaauuuuc

SEQ ID NO: 638668 - RNA, 20 nt, Human
ucagccucccaaguagcugg

SEQ ID NO: 638669 - RNA, 20 nt, Human
ucaggcaaucaugaugaagc

SEQ ID NO: 638670 - RNA, 18 nt, Human
ucagguugcucuugaacu

SEQ ID NO: 638671 - RNA, 24 nt, Human
ucccaaagugcugggauuacaggc

SEQ ID NO: 638672 - RNA, 24 nt, Human
ucccaaguagcugggacuacaggc

SEQ ID NO: 638673 - RNA, 20 nt, Human
ucccacucaucccugagccu

SEQ ID NO: 638674 - RNA, 20 nt, Human
ucccggcgaggagacugagg

SEQ ID NO: 638675 - RNA, 23 nt, Human
ucgccgcggccucggagcugcuc

SEQ ID NO: 638676 - RNA, 23 nt, Human
ucucacucuguugcccaggcugg

SEQ ID NO: 638677 - RNA, 24 nt, Human
ucucacucuguugcccaggcugga

SEQ ID NO: 638678 - RNA, 26 nt, Human
ucucacucuguugcccaggcuggagu

SEQ ID NO: 638679 - RNA, 27 nt, Human
ucucacucuguugcccaggcuggagug

SEQ ID NO: 638680 - RNA, 19 nt, Human
ucucagguucaagcuauuc

SEQ ID NO: 638681 - RNA, 21 nt, Human
ucucagguucaagcuauucuc

SEQ ID NO: 638682 - RNA, 20 nt, Human
ucuccucucucagccuccca

SEQ ID NO: 638683 - RNA, 18 nt, Human
ucugucuucucaggcaau

SEQ ID NO: 638684 - RNA, 18 nt, Human
ucuguugcccaggcugga

SEQ ID NO: 638685 - RNA, 23 nt, Human
ucuugaacuccugagcucaggug

SEQ ID NO: 638686 - RNA, 22 nt, Human
ugacuuccuguuucuacuucau

SEQ ID NO: 638687 - RNA, 20 nt, Human
ugacuucguugaucuuccuc

SEQ ID NO: 638688 - RNA, 22 nt, Human
ugagcucaggugauccacccau

SEQ ID NO: 638689 - RNA, 23 nt, Human
ugauccacccaucucagcuuccc

SEQ ID NO: 638690 - RNA, 22 nt, Human
ugcaguggcaugaucucagcuc

SEQ ID NO: 638691 - RNA, 18 nt, Human
ugcccaggcuggagugca

SEQ ID NO: 638692 - RNA, 21 nt, Human
ugcccaggcuggagugcagug

SEQ ID NO: 638693 - RNA, 22 nt, Human
ugcccaggcuggagugcagugg

SEQ ID NO: 638694 - RNA, 24 nt, Human
ugcccaggcuggagugcaguggca

SEQ ID NO: 638695 - RNA, 24 nt, Human
ugcucuugaacuccugagcucagg

SEQ ID NO: 638696 - RNA, 20 nt, Human
ugcugggauuacaggcaugu

SEQ ID NO: 638697 - RNA, 22 nt, Human
uggaaauaaaaaaaagaaccaa

SEQ ID NO: 638698 - RNA, 19 nt, Human
uggagugcaguggcaugau

SEQ ID NO: 638699 - RNA, 24 nt, Human
uggagugcaguggcaugaucucag

SEQ ID NO: 638700 - RNA, 19 nt, Human
uggauugggcuagaagggc

SEQ ID NO: 638701 - RNA, 24 nt, Human
uggcaugaucucagcucacuguaa

SEQ ID NO: 638702 - RNA, 22 nt, Human
ugggacuacaggcgcacgccac

SEQ ID NO: 638703 - RNA, 24 nt, Human
ugggacuacaggcgcacgccacca

SEQ ID NO: 638704 - RNA, 18 nt, Human
ugggauuacaggcaugug

SEQ ID NO: 638705 - RNA, 21 nt, Human
ugggauuacaggcaugugcca

SEQ ID NO: 638706 - RNA, 22 nt, Human
ugggauuacaggcaugugccac

SEQ ID NO: 638707 - RNA, 23 nt, Human
ugggauuacaggcaugugccacc

SEQ ID NO: 638708 - RNA, 24 nt, Human
ugggauuacaggcaugugccaccg

SEQ ID NO: 638709 - RNA, 24 nt, Human
uggucagguugcucuugaacuccu

SEQ ID NO: 638710 - RNA, 21 nt, Human
uguagaaagccuugaucaaga

SEQ ID NO: 638711 - RNA, 21 nt, Human
uguggaaauaaaaaaaagaac

SEQ ID NO: 638712 - RNA, 21 nt, Human
uguugcccaggcuggagugca

SEQ ID NO: 638713 - RNA, 18 nt, Human
uuaguagagacgggcuuu

SEQ ID NO: 638714 - RNA, 24 nt, Human
uuaguagagacgggcuuucaccgu

SEQ ID NO: 638715 - RNA, 23 nt, Human
uucauuuuauuauguaacuguag

SEQ ID NO: 638716 - RNA, 24 nt, Human
uugcccaggcuggagugcaguggc

SEQ ID NO: 638717 - RNA, 24 nt, Human
uuuuuaguagagacgggcuuucac

SEQ ID NO: 638718 - RNA, 20 nt, Human
uuuuuguauuuuuaguagag

SEQ ID NO: 638719 - RNA, 19 nt, Human
uuuuuuuuuuaagacagag

SEQ ID NO: 638720 - RNA, 26 nt, Human
uuuuuuuuuuuuaagacagagucuca

SEQ ID NO: 638721 - RNA, 20 nt, Human
aacuuugcuacuuuuccucu

SEQ ID NO: 638722 - RNA, 20 nt, Human
accaggggucuaccuccaaa

SEQ ID NO: 638723 - RNA, 19 nt, Human
acuuugcuacuuuuccucu

SEQ ID NO: 638724 - RNA, 21 nt, Human
agauuuaaaccaggggucuac

SEQ ID NO: 638725 - RNA, 19 nt, Human
aguuuuauggccagagagg

SEQ ID NO: 638726 - RNA, 24 nt, Human
auccagagucuuuucaauaaaggu

SEQ ID NO: 638727 - RNA, 24 nt, Human
auucccaagucugcuguucucaau

SEQ ID NO: 638728 - RNA, 22 nt, Human
caggggucuaccuccaaagucu

SEQ ID NO: 638729 - RNA, 22 nt, Human
ccagagucuuuucaauaaaggu

SEQ ID NO: 638730 - RNA, 22 nt, Human
guaagcaaaagaaagauccaaa

SEQ ID NO: 638731 - RNA, 22 nt, Human
uaaaugcugaaacacaacaaga

SEQ ID NO: 638732 - RNA, 18 nt, Human
uaagugacuuccucaaac

SEQ ID NO: 638733 - RNA, 22 nt, Human
uacacagcuuauuaaauccaga

SEQ ID NO: 638734 - RNA, 23 nt, Human
uagcacaccaacuuugcuacuuu

SEQ ID NO: 638735 - RNA, 20 nt, Human
uagcuuagaauaaaguucuu

SEQ ID NO: 638736 - RNA, 21 nt, Human
uaguaagcaaaagaaagaucc

SEQ ID NO: 638737 - RNA, 25 nt, Human
uccaaauuuuccucuuuuucaaaca

SEQ ID NO: 638738 - RNA, 18 nt, Human
ucccugagaggugguuug

SEQ ID NO: 638739 - RNA, 19 nt, Human
ugacugucaaguuuuaugg

SEQ ID NO: 638740 - RNA, 22 nt, Human
ugagaacaaaacagcuguaaca

SEQ ID NO: 638741 - RNA, 25 nt, Human
ugagaacaaaacagcuguaacaugc

SEQ ID NO: 638742 - RNA, 20 nt, Human
ugaguuaauccuagcacacc

SEQ ID NO: 638743 - RNA, 23 nt, Human
ugguuaaaacugagaacaaaaca

SEQ ID NO: 638744 - RNA, 22 nt, Human
uguucucaauccuaaaacacau

SEQ ID NO: 638745 - RNA, 19 nt, Human
uucagggaacagggaaacu

SEQ ID NO: 638746 - RNA, 25 nt, Human
uucucaauccuaaaacacaucaccu

SEQ ID NO: 638747 - RNA, 19 nt, Human
uuuuuuuuuuuuaaagaaa

SEQ ID NO: 638748 - RNA, 21 nt, Human
uuuuuuuuuuuuuuuuuaaag

SEQ ID NO: 638749 - RNA, 19 nt, Human
aaaaggccauaacuggccu

SEQ ID NO: 638750 - RNA, 19 nt, Human
aacagguuuaaggucuagg

SEQ ID NO: 638751 - RNA, 21 nt, Human
aacugcacacaggagcagggc

SEQ ID NO: 638752 - RNA, 24 nt, Human
agacugucaaaaauugccaaugcc

SEQ ID NO: 638753 - RNA, 22 nt, Human
agaguucacauugaguggaugu

SEQ ID NO: 638754 - RNA, 22 nt, Human
aggagaaaaaaggcggagcuga

SEQ ID NO: 638755 - RNA, 18 nt, Human
agggagaggggaaaagag

SEQ ID NO: 638756 - RNA, 22 nt, Human
agggaggaacgguaaacugggg

SEQ ID NO: 638757 - RNA, 24 nt, Human
aggggccuccacuaaccuccagug

SEQ ID NO: 638758 - RNA, 26 nt, Human
cacgucagccaaaccagggcagggaa

SEQ ID NO: 638759 - RNA, 22 nt, Human
cacuuuguguguugagacuggg

SEQ ID NO: 638760 - RNA, 19 nt, Human
cauagcucuaggaacaggu

SEQ ID NO: 638761 - RNA, 23 nt, Human
caugggguuuugcugagcacguc

SEQ ID NO: 638762 - RNA, 21 nt, Human
ccagagagaaaauaggagaaa

SEQ ID NO: 638763 - RNA, 18 nt, Human
ccagcacaugcagucucc

SEQ ID NO: 638764 - RNA, 21 nt, Human
ccaugccagcugccccuaccc

SEQ ID NO: 638765 - RNA, 28 nt, Human
cccugcccaucccaggcucccugcuugg

SEQ ID NO: 638766 - RNA, 21 nt, Human
ccuagauggcccccuucaagu

SEQ ID NO: 638767 - RNA, 19 nt, Human
cugccccuaccccaacugc

SEQ ID NO: 638768 - RNA, 18 nt, Human
cugguguggagggagagg

SEQ ID NO: 638769 - RNA, 19 nt, Human
cuugggggugaaagggcag

SEQ ID NO: 638770 - RNA, 22 nt, Human
gagaaaauaggagaaaaaaggc

SEQ ID NO: 638771 - RNA, 22 nt, Human
gagcuucaccagcacaugcagu

SEQ ID NO: 638772 - RNA, 19 nt, Human
gcccugagggaggaacggu

SEQ ID NO: 638773 - RNA, 22 nt, Human
gcugccccuaccccaacugcac

SEQ ID NO: 638774 - RNA, 19 nt, Human
ggagaggggaaaagagcag

SEQ ID NO: 638775 - RNA, 23 nt, Human
ggagcagggcacaugggguuuug

SEQ ID NO: 638776 - RNA, 22 nt, Human
ggagcaggugaccaaggaguuu

SEQ ID NO: 638777 - RNA, 21 nt, Human
ggagggagaggggaaaagagc

SEQ ID NO: 638778 - RNA, 20 nt, Human
ggugaaagggcagacaggga

SEQ ID NO: 638779 - RNA, 19 nt, Human
ggugauggagaagugagga

SEQ ID NO: 638780 - RNA, 18 nt, Human
guauugggaaaaguuuuc

SEQ ID NO: 638781 - RNA, 23 nt, Human
uaccucgggaagcaagccccagc

SEQ ID NO: 638782 - RNA, 20 nt, Human
uaccugaccaugccagcucc

SEQ ID NO: 638783 - RNA, 21 nt, Human
uagaagaacagagcucaccac

SEQ ID NO: 638784 - RNA, 22 nt, Human
uagaagaacagagcucaccaca

SEQ ID NO: 638785 - RNA, 23 nt, Human
uaggcuuuagaguuggggaaagg

SEQ ID NO: 638786 - RNA, 20 nt, Human
uccauggguuggggaccuag

SEQ ID NO: 638787 - RNA, 23 nt, Human
uccauuuauucaacuuuccggua

SEQ ID NO: 638788 - RNA, 20 nt, Human
ucccacagccggcggcacgc

SEQ ID NO: 638789 - RNA, 18 nt, Human
ucgugguaguagaguuca

SEQ ID NO: 638790 - RNA, 21 nt, Human
ucugcggggcugggccacuag

SEQ ID NO: 638791 - RNA, 19 nt, Human
ucuugggggugaaagggca

SEQ ID NO: 638792 - RNA, 20 nt, Human
ucuugggggugaaagggcag

SEQ ID NO: 638793 - RNA, 22 nt, Human
ugaaagggcagacagggaguca

SEQ ID NO: 638794 - RNA, 25 nt, Human
ugaccaugccagcugccccuacccc

SEQ ID NO: 638795 - RNA, 19 nt, Human
ugagucagggaagguggug

SEQ ID NO: 638796 - RNA, 24 nt, Human
ugaguggauguggguucugaguca

SEQ ID NO: 638797 - RNA, 21 nt, Human
uggagaagugaggaauauggg

SEQ ID NO: 638798 - RNA, 18 nt, Human
uggagcaggugaccaagg

SEQ ID NO: 638799 - RNA, 20 nt, Human
uggagggagaggggaaaaga

SEQ ID NO: 638800 - RNA, 19 nt, Human
ugggaaaaguuuucaauua

SEQ ID NO: 638801 - RNA, 20 nt, Human
ugggaaaaguuuucaauuag

SEQ ID NO: 638802 - RNA, 21 nt, Human
ugguagaagaacagagcucac

SEQ ID NO: 638803 - RNA, 21 nt, Human
ugugcugggcuuguggaagau

SEQ ID NO: 638804 - RNA, 21 nt, Human
ugugggucugcggggcugggc

SEQ ID NO: 638805 - RNA, 18 nt, Human
uguguguugagacugggu

SEQ ID NO: 638806 - RNA, 24 nt, Human
uuaagaggugaaauaccucgggaa

SEQ ID NO: 638807 - RNA, 19 nt, Human
uuagcaauaaucgcgccuc

SEQ ID NO: 638808 - RNA, 24 nt, Human
uuggagcaggugaccaaggaguuu

SEQ ID NO: 638809 - RNA, 21 nt, Human
uugugggucugcggggcuggg

SEQ ID NO: 638810 - RNA, 19 nt, Human
uuucauggagugucacgga

SEQ ID NO: 638811 - RNA, 23 nt, Human
uuuguguguugagacuggguugg

SEQ ID NO: 638812 - RNA, 18 nt, Human
uuuuuuuuuuuuuuuuug

SEQ ID NO: 638813 - RNA, 19 nt, Human
aaagcuuguagugcuucuc

SEQ ID NO: 638814 - RNA, 26 nt, Human
accgccgggucucucggguacccaac

SEQ ID NO: 638815 - RNA, 20 nt, Human
agcuuggucugggccuggcg

SEQ ID NO: 638816 - RNA, 23 nt, Human
caaaugaugcuaaugcuucuucu

SEQ ID NO: 638817 - RNA, 20 nt, Human
caacagcaguuaaauuaucu

SEQ ID NO: 638818 - RNA, 21 nt, Human
cagcauuuucuucuucaguuu

SEQ ID NO: 638819 - RNA, 23 nt, Human
cagcgucuucgggaggaagugac

SEQ ID NO: 638820 - RNA, 24 nt, Human
cauuccauuucucaacagcaguua

SEQ ID NO: 638821 - RNA, 23 nt, Human
cccaacaccgcucuucggcccaa

SEQ ID NO: 638822 - RNA, 19 nt, Human
cgagcgaggaggaggggcu

SEQ ID NO: 638823 - RNA, 21 nt, Human
cgagcgaggaggaggggcuaa

SEQ ID NO: 638824 - RNA, 20 nt, Human
cgagcgaggaggaggggcuu

SEQ ID NO: 638825 - RNA, 20 nt, Human
cgcccgcagagccgguccug

SEQ ID NO: 638826 - RNA, 25 nt, Human
cucuccuuucuauuuuucucuuuuc

SEQ ID NO: 638827 - RNA, 18 nt, Human
cucucggguacccaacac

SEQ ID NO: 638828 - RNA, 22 nt, Human
cucucggguacccaacaccgcu

SEQ ID NO: 638829 - RNA, 25 nt, Human
cucucuccuuucuauuuuucucuuu

SEQ ID NO: 638830 - RNA, 22 nt, Human
cucuucggcccaacgugucgcu

SEQ ID NO: 638831 - RNA, 22 nt, Human
cuuccuuuucuuucauagccuu

SEQ ID NO: 638832 - RNA, 18 nt, Human
gugacuuccccaccgccg

SEQ ID NO: 638833 - RNA, 25 nt, Human
uaagauauuccaucuuuuucucuuu

SEQ ID NO: 638834 - RNA, 19 nt, Human
uagcuuggucugggccugg

SEQ ID NO: 638835 - RNA, 18 nt, Human
uauucugugcauuucaug

SEQ ID NO: 638836 - RNA, 22 nt, Human
uccaucuuuuucucuuuccauu

SEQ ID NO: 638837 - RNA, 20 nt, Human
ucucuuuccauuuuucaaaa

SEQ ID NO: 638838 - RNA, 24 nt, Human
ucuuguuuuuuucuucaagccucu

SEQ ID NO: 638839 - RNA, 19 nt, Human
ugcuugaaaaaagcuuccu

SEQ ID NO: 638840 - RNA, 21 nt, Human
uucauguaaauauacauuuuu

SEQ ID NO: 638841 - RNA, 18 nt, Human
uucuucuuguuuuuuucu

SEQ ID NO: 638842 - RNA, 19 nt, Human
uucuuuuuauucugugcau

SEQ ID NO: 638843 - RNA, 23 nt, Human
uuggcagcuauuuucuuugcuuc

SEQ ID NO: 638844 - RNA, 21 nt, Human
uuuggcagcuauuuucuuugc

SEQ ID NO: 638845 - RNA, 24 nt, Human
uuuucuguucauuuuggauccuua

SEQ ID NO: 638846 - RNA, 20 nt, Human
uuuuuuuuuuuuuuuugcuu

SEQ ID NO: 638847 - RNA, 22 nt, Human
uuuuuuuuuuuuuuuugcuuga

SEQ ID NO: 638848 - RNA, 20 nt, Human
aaacaaagaagaggguccuc

SEQ ID NO: 638849 - RNA, 20 nt, Human
aaacaaagaagaggguccuc

SEQ ID NO: 638850 - RNA, 23 nt, Human
aaacaaagaagaggguccucagc

SEQ ID NO: 638851 - RNA, 24 nt, Human
aaagugcugggauuauaggcauga

SEQ ID NO: 638852 - RNA, 21 nt, Human
aaccucugccucccugggcuc

SEQ ID NO: 638853 - RNA, 21 nt, Human
aagaacuaaggcccuguggaa

SEQ ID NO: 638854 - RNA, 24 nt, Human
aagcaauccaccugccucagccuc

SEQ ID NO: 638855 - RNA, 19 nt, Human
aagcagaaagaaaaacagg

SEQ ID NO: 638856 - RNA, 26 nt, Human
aagugauccucccgccucaagccucc

SEQ ID NO: 638857 - RNA, 19 nt, Human
aagugcugggauuauaggc

SEQ ID NO: 638858 - RNA, 21 nt, Human
aagugcugggauuauaggcau

SEQ ID NO: 638859 - RNA, 21 nt, Human
acaaagaagaggguccucagc

SEQ ID NO: 638860 - RNA, 23 nt, Human
acaagccucaguauaaacaaaga

SEQ ID NO: 638861 - RNA, 23 nt, Human
acaauaucccugcagcaaacacu

SEQ ID NO: 638862 - RNA, 23 nt, Human
acacacacacacacacacacaca

SEQ ID NO: 638863 - RNA, 23 nt, Human
acacacacacacacacacacaca

SEQ ID NO: 638864 - RNA, 25 nt, Human
acacacacacacacacacacacagu

SEQ ID NO: 638865 - RNA, 23 nt, Human
acagcaaccucugccucccuggg

SEQ ID NO: 638866 - RNA, 21 nt, Human
accacuuauuuaauuuaacga

SEQ ID NO: 638867 - RNA, 18 nt, Human
acuaaggcccuguggaag

SEQ ID NO: 638868 - RNA, 25 nt, Human
acucuauuucccaggcuggagugca

SEQ ID NO: 638869 - RNA, 18 nt, Human
agaaaauaacagcaauag

SEQ ID NO: 638870 - RNA, 21 nt, Human
agaaagaaaaacaggggaaaa

SEQ ID NO: 638871 - RNA, 21 nt, Human
agcaauccaccugccucagcc

SEQ ID NO: 638872 - RNA, 23 nt, Human
agccauauagccaucaucauccc

SEQ ID NO: 638873 - RNA, 22 nt, Human
agcuaaagaacuaaggcccugu

SEQ ID NO: 638874 - RNA, 23 nt, Human
agcuggguuuauaggugugugcc

SEQ ID NO: 638875 - RNA, 26 nt, Human
aggaaaaacacagauuuaacuauaaa

SEQ ID NO: 638876 - RNA, 31 nt, Human
aggaaacacacacacacacacacacacacag

SEQ ID NO: 638877 - RNA, 21 nt, Human
aggcaugagccacugcaccca

SEQ ID NO: 638878 - RNA, 23 nt, Human
aggcuggagugcaguggcgaucu

SEQ ID NO: 638879 - RNA, 23 nt, Human
aguagcuggguuuauaggugugu

SEQ ID NO: 638880 - RNA, 25 nt, Human
aguggguggguagggggcacugagu

SEQ ID NO: 638881 - RNA, 19 nt, Human
auaccaaaggaaaacauga

SEQ ID NO: 638882 - RNA, 24 nt, Human
auaguagagaugggguuucaccau

SEQ ID NO: 638883 - RNA, 18 nt, Human
aucaacauacaauauccc

SEQ ID NO: 638884 - RNA, 19 nt, Human
augggguuucaccaugcug

SEQ ID NO: 638885 - RNA, 20 nt, Human
augggguuucaccaugcugg

SEQ ID NO: 638886 - RNA, 24 nt, Human
augggguuucaccaugcuggccag

SEQ ID NO: 638887 - RNA, 24 nt, Human
caaagugcugggauuauaggcaug

SEQ ID NO: 638888 - RNA, 24 nt, Human
caaccucugccucccugggcucaa

SEQ ID NO: 638889 - RNA, 20 nt, Human
cacacacacacacacacaca

SEQ ID NO: 638890 - RNA, 20 nt, Human
cacacacacacacacacaca

SEQ ID NO: 638891 - RNA, 20 nt, Human
cacacacacacacacacaca

SEQ ID NO: 638892 - RNA, 20 nt, Human
cacacacacacacacacaca

SEQ ID NO: 638893 - RNA, 20 nt, Human
cacacacacacacacacaca

SEQ ID NO: 638894 - RNA, 20 nt, Human
cacacacacacacacacaca

SEQ ID NO: 638895 - RNA, 22 nt, Human
cacacacacacacacacacaca

SEQ ID NO: 638896 - RNA, 22 nt, Human
cacacacacacacacacacaca

SEQ ID NO: 638897 - RNA, 22 nt, Human
cacacacacacacacacacaca

SEQ ID NO: 638898 - RNA, 26 nt, Human
cacacacacacacacacacacacaca

SEQ ID NO: 638899 - RNA, 26 nt, Human
cacacacacacacacacacacacaca

SEQ ID NO: 638900 - RNA, 26 nt, Human
cacacacacacacacacacacacaua

SEQ ID NO: 638901 - RNA, 26 nt, Human
cacacacacacacacacacacauaug

SEQ ID NO: 638902 - RNA, 22 nt, Human
cacacacacacacacacacaua

SEQ ID NO: 638903 - RNA, 26 nt, Human
cacacacacacacacacacauaugca

SEQ ID NO: 638904 - RNA, 20 nt, Human
cacacacacacacacacaua

SEQ ID NO: 638905 - RNA, 29 nt, Human
cacacacacacacacacauaugcacuuua

SEQ ID NO: 638906 - RNA, 19 nt, Human
cacagcauagccauauagc

SEQ ID NO: 638907 - RNA, 22 nt, Human
caccaucuuaaagaaaugaucu

SEQ ID NO: 638908 - RNA, 21 nt, Human
caccaugcuggccaggcuggu

SEQ ID NO: 638909 - RNA, 22 nt, Human
caccaugcuggccaggcugguc

SEQ ID NO: 638910 - RNA, 27 nt, Human
caccaugcuggccaggcuggucuagaa

SEQ ID NO: 638911 - RNA, 23 nt, Human
caccugccucagccucccaaagu

SEQ ID NO: 638912 - RNA, 23 nt, Human
cacgagccuggcuaauuuuugua

SEQ ID NO: 638913 - RNA, 22 nt, Human
cacucuauuucccaggcuggag

SEQ ID NO: 638914 - RNA, 19 nt, Human
cacugcacccagcccaaga

SEQ ID NO: 638915 - RNA, 19 nt, Human
cacugcacccagcccaaga

SEQ ID NO: 638916 - RNA, 20 nt, Human
caggaaacacacacacacac

SEQ ID NO: 638917 - RNA, 21 nt, Human
cauauagccaucaucauccca

SEQ ID NO: 638918 - RNA, 18 nt, Human
caucuuaaagaaaugauc

SEQ ID NO: 638919 - RNA, 24 nt, Human
caugcuggccaggcuggucuagaa

SEQ ID NO: 638920 - RNA, 24 nt, Human
ccaaagugcugggauuauaggcau

SEQ ID NO: 638921 - RNA, 26 nt, Human
ccaccugccucagccucccaaagugc

SEQ ID NO: 638922 - RNA, 19 nt, Human
ccacugcacccagcccaag

SEQ ID NO: 638923 - RNA, 19 nt, Human
ccacugcacccagcccaag

SEQ ID NO: 638924 - RNA, 20 nt, Human
ccacugcacccagcccaaga

SEQ ID NO: 638925 - RNA, 21 nt, Human
ccacugcacccagcccaagac

SEQ ID NO: 638926 - RNA, 27 nt, Human
ccauuuucauuuuaauuggcuugagga

SEQ ID NO: 638927 - RNA, 19 nt, Human
cccaggaaacacacacaca

SEQ ID NO: 638928 - RNA, 19 nt, Human
cccaggcuggagugcagug

SEQ ID NO: 638929 - RNA, 19 nt, Human
cccaggcuggagugcagug

SEQ ID NO: 638930 - RNA, 31 nt, Human
ccccaggaaacacacacacacacacacacag

SEQ ID NO: 638931 - RNA, 21 nt, Human
ccucagccacgcucccucguu

SEQ ID NO: 638932 - RNA, 26 nt, Human
ccucccgccucaagccuccugaguag

SEQ ID NO: 638933 - RNA, 22 nt, Human
ccugggcucaagugauccuccc

SEQ ID NO: 638934 - RNA, 22 nt, Human
cgccucaagccuccugaguagc

SEQ ID NO: 638935 - RNA, 25 nt, Human
cucaagugauccucccgccucaagc

SEQ ID NO: 638936 - RNA, 23 nt, Human
cucacucuauuucccaggcugga

SEQ ID NO: 638937 - RNA, 24 nt, Human
cuccuggccucaaagcaauccacc

SEQ ID NO: 638938 - RNA, 23 nt, Human
cugccucagccucccaaagugcu

SEQ ID NO: 638939 - RNA, 24 nt, Human
cugccucagccucccaaagugcug

SEQ ID NO: 638940 - RNA, 21 nt, Human
cuggaaguuguauuugguugu

SEQ ID NO: 638941 - RNA, 19 nt, Human
cuggccucaaagcaaucca

SEQ ID NO: 638942 - RNA, 21 nt, Human
cuggccucaaagcaauccacc

SEQ ID NO: 638943 - RNA, 21 nt, Human
cuuuuuuuuuuuuuuuuuuuu

SEQ ID NO: 638944 - RNA, 24 nt, Human
gaacuccuggccucaaagcaaucc

SEQ ID NO: 638945 - RNA, 27 nt, Human
gacuuugucuuccuuuuuuuuuuuuuu

SEQ ID NO: 638946 - RNA, 18 nt, Human
gagaugggguuucaccau

SEQ ID NO: 638947 - RNA, 24 nt, Human
gagaugggguuucaccaugcuggc

SEQ ID NO: 638948 - RNA, 18 nt, Human
gaucacugaggucaacaa

SEQ ID NO: 638949 - RNA, 22 nt, Human
gauuauaggcaugagccacugc

SEQ ID NO: 638950 - RNA, 23 nt, Human
gauuauaggcaugagccacugca

SEQ ID NO: 638951 - RNA, 24 nt, Human
gcaauccaccugccucagccuccc

SEQ ID NO: 638952 - RNA, 24 nt, Human
gccucaaagcaauccaccugccuc

SEQ ID NO: 638953 - RNA, 22 nt, Human
gccucaagccuccugaguagcu

SEQ ID NO: 638954 - RNA, 24 nt, Human
gccucaagccuccugaguagcugg

SEQ ID NO: 638955 - RNA, 19 nt, Human
gcucaagugauccucccgc

SEQ ID NO: 638956 - RNA, 22 nt, Human
gcuggagugcaguggcgaucuc

SEQ ID NO: 638957 - RNA, 23 nt, Human
gcuggucuagaacuccuggccuc

SEQ ID NO: 638958 - RNA, 19 nt, Human
ggaguggguggguaggggg

SEQ ID NO: 638959 - RNA, 24 nt, Human
ggcuggucuagaacuccuggccuc

SEQ ID NO: 638960 - RNA, 22 nt, Human
gggcucaagugauccucccgcc

SEQ ID NO: 638961 - RNA, 22 nt, Human
gggguuucaccaugcuggccag

SEQ ID NO: 638962 - RNA, 22 nt, Human
ggguuucaccaugcuggccagg

SEQ ID NO: 638963 - RNA, 24 nt, Human
guagcuggguuuauaggugugugc

SEQ ID NO: 638964 - RNA, 24 nt, Human
gugauccucccgccucaagccucc

SEQ ID NO: 638965 - RNA, 25 nt, Human
gugaugcaggcgcacaauuucucac

SEQ ID NO: 638966 - RNA, 19 nt, Human
guuuauaggugugugccac

SEQ ID NO: 638967 - RNA, 25 nt, Human
uaaaaaacacacaucaccguuaacc

SEQ ID NO: 638968 - RNA, 27 nt, Human
uaaaaaacacacaucaccguuaacuca

SEQ ID NO: 638969 - RNA, 18 nt, Human
uaacaggguagaugaugu

SEQ ID NO: 638970 - RNA, 24 nt, Human
uaauuuuuguauuuauaguagaga

SEQ ID NO: 638971 - RNA, 24 nt, Human
uacagcaaccucugccucccuggg

SEQ ID NO: 638972 - RNA, 21 nt, Human
uagcuaaagaacuaaggcccu

SEQ ID NO: 638973 - RNA, 23 nt, Human
uagcuggguuuauaggugugugc

SEQ ID NO: 638974 - RNA, 24 nt, Human
uaggugugugccacgagccuggcu

SEQ ID NO: 638975 - RNA, 21 nt, Human
uaguagagaugggguuucacc

SEQ ID NO: 638976 - RNA, 23 nt, Human
uaguagagaugggguuucaccau

SEQ ID NO: 638977 - RNA, 24 nt, Human
uaguagagaugggguuucaccaug

SEQ ID NO: 638978 - RNA, 26 nt, Human
uaguagagaugggguuucaccaugcu

SEQ ID NO: 638979 - RNA, 23 nt, Human
uauggacacagcauagccauaua

SEQ ID NO: 638980 - RNA, 19 nt, Human
ucaacaauauguagucaaa

SEQ ID NO: 638981 - RNA, 23 nt, Human
ucauaccaaaggaaaacaugacc

SEQ ID NO: 638982 - RNA, 25 nt, Human
ucauccaucugccaagucucauuuc

SEQ ID NO: 638983 - RNA, 21 nt, Human
uccaacagcaauaugcugaag

SEQ ID NO: 638984 - RNA, 24 nt, Human
ucccaaagugcugggauuauaggc

SEQ ID NO: 638985 - RNA, 25 nt, Human
ucccaggcuggagugcaguggcgau

SEQ ID NO: 638986 - RNA, 23 nt, Human
ucccaucaggacuuugucuuccu

SEQ ID NO: 638987 - RNA, 26 nt, Human
ucccugcagcaaacacugaguugccu

SEQ ID NO: 638988 - RNA, 25 nt, Human
ucccugggcucaagugauccucccg

SEQ ID NO: 638989 - RNA, 24 nt, Human
uccugaguagcuggguuuauaggu

SEQ ID NO: 638990 - RNA, 18 nt, Human
uccuuuuuuuuuuuuuuu

SEQ ID NO: 638991 - RNA, 18 nt, Human
uccuuuuuuuuuuuuuuu

SEQ ID NO: 638992 - RNA, 19 nt, Human
ucuauuucccaggcuggag

SEQ ID NO: 638993 - RNA, 24 nt, Human
ucuauuucccaggcuggagugcag

SEQ ID NO: 638994 - RNA, 21 nt, Human
ugagccacugcacccagccca

SEQ ID NO: 638995 - RNA, 24 nt, Human
ugccucagccucccaaagugcugg

SEQ ID NO: 638996 - RNA, 19 nt, Human
ugccuuuguggcagaaaca

SEQ ID NO: 638997 - RNA, 20 nt, Human
ugcugaagagauuuucaggg

SEQ ID NO: 638998 - RNA, 20 nt, Human
uggaaagcagaaagaaaaac

SEQ ID NO: 638999 - RNA, 21 nt, Human
uggaaagcagaaagaaaaaca

SEQ ID NO: 639000 - RNA, 21 nt, Human
uggaagaagaaugggagcaau

SEQ ID NO: 639001 - RNA, 24 nt, Human
uggaagaagaaugggagcaauguu

SEQ ID NO: 639002 - RNA, 18 nt, Human
uggagugcaguggcgauc

SEQ ID NO: 639003 - RNA, 24 nt, Human
uggccaggcuggucuagaacuccu

SEQ ID NO: 639004 - RNA, 24 nt, Human
uggccucaaagcaauccaccugcc

SEQ ID NO: 639005 - RNA, 18 nt, Human
ugggauuauaggcaugag

SEQ ID NO: 639006 - RNA, 19 nt, Human
ugggauuauaggcaugagc

SEQ ID NO: 639007 - RNA, 21 nt, Human
ugggauuauaggcaugagcca

SEQ ID NO: 639008 - RNA, 22 nt, Human
ugggauuauaggcaugagccac

SEQ ID NO: 639009 - RNA, 22 nt, Human
ugggauuauaggcaugagccac

SEQ ID NO: 639010 - RNA, 24 nt, Human
ugggauuauaggcaugagccacug

SEQ ID NO: 639011 - RNA, 24 nt, Human
ugggauuauaggcaugagccacug

SEQ ID NO: 639012 - RNA, 24 nt, Human
ugggcucaagugauccucccgccu

SEQ ID NO: 639013 - RNA, 24 nt, Human
ugggguuucaccaugcuggccagg

SEQ ID NO: 639014 - RNA, 22 nt, Human
uggguagggggcacugagucuu

SEQ ID NO: 639015 - RNA, 23 nt, Human
uggguagggggcacugagucuug

SEQ ID NO: 639016 - RNA, 24 nt, Human
uggugguguggaguggguggguag

SEQ ID NO: 639017 - RNA, 18 nt, Human
ugucuaaggaauagcuuc

SEQ ID NO: 639018 - RNA, 23 nt, Human
uuaaaaaugaacagaagugacug

SEQ ID NO: 639019 - RNA, 25 nt, Human
uuacagcaaccucugccucccuggg

SEQ ID NO: 639020 - RNA, 24 nt, Human
uucccaggcuggagugcaguggcg

SEQ ID NO: 639021 - RNA, 24 nt, Human
uuuaaauaaauuccauuuucauuu

SEQ ID NO: 639022 - RNA, 24 nt, Human
uuuauaguagagaugggguuucac

SEQ ID NO: 639023 - RNA, 21 nt, Human
uuucaccaugcuggccaggcu

SEQ ID NO: 639024 - RNA, 18 nt, Human
uuuucagggagucgugca

SEQ ID NO: 639025 - RNA, 20 nt, Human
uuuuuguauuuauaguagag

SEQ ID NO: 639026 - RNA, 23 nt, Human
uuuuuguauuuauaguagagaug

SEQ ID NO: 639027 - RNA, 18 nt, Human
uuuuuuuuuuuuuuuuug

SEQ ID NO: 639028 - RNA, 18 nt, Human
uuuuuuuuuuuuuuuuug

SEQ ID NO: 639029 - RNA, 22 nt, Human
uuuuuuuuuuuuuuuuuggugg

SEQ ID NO: 639030 - RNA, 25 nt, Human
aaaaaaaaagaaaaaagauaaaaaa

SEQ ID NO: 639031 - RNA, 19 nt, Human
aaacagaaauuugaaaaau

SEQ ID NO: 639032 - RNA, 18 nt, Human
aaaucagagaaucugcug

SEQ ID NO: 639033 - RNA, 22 nt, Human
aacacccacugcucuagaugac

SEQ ID NO: 639034 - RNA, 19 nt, Human
aagccaacuauuagugcua

SEQ ID NO: 639035 - RNA, 22 nt, Human
acaaaaaaaaagaaaaaagaua

SEQ ID NO: 639036 - RNA, 19 nt, Human
acagaaauuugaaaaauuc

SEQ ID NO: 639037 - RNA, 22 nt, Human
acccacugcucuagaugacauc

SEQ ID NO: 639038 - RNA, 21 nt, Human
agacuuaaaaugucacaggug

SEQ ID NO: 639039 - RNA, 24 nt, Human
agagaugugaaaaauaacaaagaa

SEQ ID NO: 639040 - RNA, 19 nt, Human
aggugaaugacauuacaaa

SEQ ID NO: 639041 - RNA, 24 nt, Human
agugcacaugugugcauucacaua

SEQ ID NO: 639042 - RNA, 21 nt, Human
aguuuauauaaaucaaggucc

SEQ ID NO: 639043 - RNA, 23 nt, Human
augugugcauucacauacacagg

SEQ ID NO: 639044 - RNA, 21 nt, Human
caaaaaaaauagcugacuuau

SEQ ID NO: 639045 - RNA, 22 nt, Human
caaauagauuuaaacaguuaaa

SEQ ID NO: 639046 - RNA, 20 nt, Human
caaauuaaaaguaaaggcac

SEQ ID NO: 639047 - RNA, 25 nt, Human
cacaggugaaugacauuacaaauca

SEQ ID NO: 639048 - RNA, 19 nt, Human
caccaccccagccccugcc

SEQ ID NO: 639049 - RNA, 18 nt, Human
cagagaugugaaaaauaa

SEQ ID NO: 639050 - RNA, 22 nt, Human
cccagccccugccgggcucagc

SEQ ID NO: 639051 - RNA, 18 nt, Human
ccccagccccugccgggc

SEQ ID NO: 639052 - RNA, 24 nt, Human
ccuauucauuaacacccacugcuc

SEQ ID NO: 639053 - RNA, 25 nt, Human
cucucccaugcaguauggugcuuaa

SEQ ID NO: 639054 - RNA, 23 nt, Human
gaaugggaagacaguaacuuccu

SEQ ID NO: 639055 - RNA, 22 nt, Human
uaaaaaaaaacccugcuucuau

SEQ ID NO: 639056 - RNA, 18 nt, Human
uaaaaugucacaggugaa

SEQ ID NO: 639057 - RNA, 22 nt, Human
uaaacaaaaaaaaagaaaaaag

SEQ ID NO: 639058 - RNA, 19 nt, Human
uaaacaaaaaaaaagaaag

SEQ ID NO: 639059 - RNA, 23 nt, Human
uaaacaaaaaaaaagaaagccaa

SEQ ID NO: 639060 - RNA, 22 nt, Human
uaaaggcaccaggcuauaaagu

SEQ ID NO: 639061 - RNA, 24 nt, Human
uaacauugaaaaacugacuacuua

SEQ ID NO: 639062 - RNA, 25 nt, Human
uaacauugaaaaacugacuacuuau

SEQ ID NO: 639063 - RNA, 18 nt, Human
uaagugcacaugugugca

SEQ ID NO: 639064 - RNA, 18 nt, Human
uacaaaucagagaaucug

SEQ ID NO: 639065 - RNA, 21 nt, Human
uaccuauucauuaacacccac

SEQ ID NO: 639066 - RNA, 25 nt, Human
uagcuuaaacaaaaaaaaagaaaaa

SEQ ID NO: 639067 - RNA, 20 nt, Human
uaggauaacauugaaaaacu

SEQ ID NO: 639068 - RNA, 23 nt, Human
uaggauaacauugaaaaacugac

SEQ ID NO: 639069 - RNA, 23 nt, Human
ucauuaacacccacugcucuaga

SEQ ID NO: 639070 - RNA, 24 nt, Human
ucgcucagaucuucugggagucug

SEQ ID NO: 639071 - RNA, 21 nt, Human
ugaaaaauaacaaagaacuga

SEQ ID NO: 639072 - RNA, 22 nt, Human
ugaaaaauaacaaagaacugaa

SEQ ID NO: 639073 - RNA, 24 nt, Human
ugaaaaauaacaaagaacugaaaa

SEQ ID NO: 639074 - RNA, 24 nt, Human
ugaaaacauaguuuauauaaauca

SEQ ID NO: 639075 - RNA, 22 nt, Human
ugaaagacauccaauccaagua

SEQ ID NO: 639076 - RNA, 25 nt, Human
ugcuucuauguaaacaaaaaaaaag

SEQ ID NO: 639077 - RNA, 24 nt, Human
uggaaaaaaaaaaucaagguuuau

SEQ ID NO: 639078 - RNA, 20 nt, Human
ugggaagacaguaacuuccu

SEQ ID NO: 639079 - RNA, 19 nt, Human
ugggacgggaaugaguuga

SEQ ID NO: 639080 - RNA, 23 nt, Human
uguaaacaaaaaaaaagaaagcc

SEQ ID NO: 639081 - RNA, 25 nt, Human
uguaaacaaaaaaaaagaaagccaa

SEQ ID NO: 639082 - RNA, 22 nt, Human
ugucaaauggaaaaaaaaaauc

SEQ ID NO: 639083 - RNA, 21 nt, Human
uuaauggacaguacuugaaug

SEQ ID NO: 639084 - RNA, 22 nt, Human
uuaauguuacuggaaaauauug

SEQ ID NO: 639085 - RNA, 22 nt, Human
uuauaaaaaaugcucaaaguuu

SEQ ID NO: 639086 - RNA, 19 nt, Human
uuccaaguguguuuccugg

SEQ ID NO: 639087 - RNA, 24 nt, Human
uucucucaaauuaaaaguaaaggc

SEQ ID NO: 639088 - RNA, 18 nt, Human
uuuuuauuuugugugugu

SEQ ID NO: 639089 - RNA, 24 nt, Human
uuuuuuuuuuuuuuuuuuguuuuu

SEQ ID NO: 639090 - RNA, 23 nt, Human
uuuuuuuuuuuuuuuuuuuuggg

SEQ ID NO: 639091 - RNA, 20 nt, Human
acagugcauggaaaaaaaaa

SEQ ID NO: 639092 - RNA, 23 nt, Human
acggcgcagagcgggaggaagac

SEQ ID NO: 639093 - RNA, 18 nt, Human
augggcagagccucucca

SEQ ID NO: 639094 - RNA, 18 nt, Human
caacgggcgcaggcgcgg

SEQ ID NO: 639095 - RNA, 19 nt, Human
ccugcaaaugugggauggg

SEQ ID NO: 639096 - RNA, 19 nt, Human
cgacggcgcagagcgggag

SEQ ID NO: 639097 - RNA, 18 nt, Human
cggaaaagcuagaaaaug

SEQ ID NO: 639098 - RNA, 21 nt, Human
cggaaaagcuagaaaauguug

SEQ ID NO: 639099 - RNA, 19 nt, Human
cggggcgacggcgcagagc

SEQ ID NO: 639100 - RNA, 23 nt, Human
cgugccaaugcuuuucccugcaa

SEQ ID NO: 639101 - RNA, 18 nt, Human
cuagaaaauguugaagua

SEQ ID NO: 639102 - RNA, 21 nt, Human
gaaguagcagaagagcagaug

SEQ ID NO: 639103 - RNA, 21 nt, Human
gcgcggcgccgggacccggag

SEQ ID NO: 639104 - RNA, 22 nt, Human
ggacccggagcgagcagggaga

SEQ ID NO: 639105 - RNA, 21 nt, Human
ggaggaagacucacgccuggc

SEQ ID NO: 639106 - RNA, 24 nt, Human
ggcgacggcgcagagcgggaggaa

SEQ ID NO: 639107 - RNA, 24 nt, Human
uacacacagugcauggaaaaaaaa

SEQ ID NO: 639108 - RNA, 19 nt, Human
uguggacggggcgacggcg

SEQ ID NO: 639109 - RNA, 23 nt, Human
uuacacacagugcauggaaaaaa

SEQ ID NO: 639110 - RNA, 23 nt, Human
uuuaacuccaucaacugccucaa

SEQ ID NO: 639111 - RNA, 21 nt, Human
uuuuuuuuuuuuuuugugaga

SEQ ID NO: 639112 - RNA, 18 nt, Human
uuuuuuuuuuuuuuuuug

SEQ ID NO: 639113 - RNA, 19 nt, Human
uuuuuuuuuuuuuuuuugu

SEQ ID NO: 639114 - RNA, 19 nt, Human
acacugcauugcagauagg

SEQ ID NO: 639115 - RNA, 23 nt, Human
aucaugagagucccaaaauaaga

SEQ ID NO: 639116 - RNA, 23 nt, Human
caaaauaagaaccuagcagcuga

SEQ ID NO: 639117 - RNA, 24 nt, Human
cacugcauugcagauaggucaaaa

SEQ ID NO: 639118 - RNA, 20 nt, Human
cagcccaugucuuagaccaa

SEQ ID NO: 639119 - RNA, 20 nt, Human
caggagggaugccuaaagua

SEQ ID NO: 639120 - RNA, 24 nt, Human
cccacaaagccugaaauagcggac

SEQ ID NO: 639121 - RNA, 21 nt, Human
ccugaaauauuuacuuucugg

SEQ ID NO: 639122 - RNA, 28 nt, Human
cucagcaucaugagagucccaaaauaag

SEQ ID NO: 639123 - RNA, 21 nt, Human
uaaauagauaucccacaaagc

SEQ ID NO: 639124 - RNA, 22 nt, Human
uaaccuguauaaaagaugaaau

SEQ ID NO: 639125 - RNA, 18 nt, Human
uaagaaccuagcagcuga

SEQ ID NO: 639126 - RNA, 24 nt, Human
uaauaaccuguauaaaagaugaaa

SEQ ID NO: 639127 - RNA, 18 nt, Human
uagauaucccacaaagcc

SEQ ID NO: 639128 - RNA, 23 nt, Human
uaugcagcaauacuaaccuuaau

SEQ ID NO: 639129 - RNA, 22 nt, Human
ucccacaaagccugaaauauuu

SEQ ID NO: 639130 - RNA, 24 nt, Human
ugcauugcagauaggucaaaaggc

SEQ ID NO: 639131 - RNA, 21 nt, Human
uggaaaaaguuugucagccca

SEQ ID NO: 639132 - RNA, 27 nt, Human
aaacaccuucugggccugcugucaucc

SEQ ID NO: 639133 - RNA, 20 nt, Human
aaaggggcgagcuggagugc

SEQ ID NO: 639134 - RNA, 21 nt, Human
acuccucccaucucccugccc

SEQ ID NO: 639135 - RNA, 23 nt, Human
agcaggagaggucugaggggccg

SEQ ID NO: 639136 - RNA, 18 nt, Human
aggcagcgugacaguggg

SEQ ID NO: 639137 - RNA, 18 nt, Human
aggcgagagcgcgccccg

SEQ ID NO: 639138 - RNA, 22 nt, Human
aggcgguggggacuugaggaug

SEQ ID NO: 639139 - RNA, 20 nt, Human
agggcggggccagggaaauc

SEQ ID NO: 639140 - RNA, 22 nt, Human
agguccagggaccagcaggaga

SEQ ID NO: 639141 - RNA, 19 nt, Human
auaccuauccaucccaagc

SEQ ID NO: 639142 - RNA, 28 nt, Human
caaggacaccgucagcccuaagagaagu

SEQ ID NO: 639143 - RNA, 20 nt, Human
caccagaguucaucuuuagu

SEQ ID NO: 639144 - RNA, 22 nt, Human
caccccacauaugcauauucca

SEQ ID NO: 639145 - RNA, 22 nt, Human
cagacugcagcagacgcccaua

SEQ ID NO: 639146 - RNA, 21 nt, Human
cagcagcgaccgagggcagcc

SEQ ID NO: 639147 - RNA, 21 nt, Human
caggaacacaucagcaaaagc

SEQ ID NO: 639148 - RNA, 23 nt, Human
ccaagccaauuucuacauugugc

SEQ ID NO: 639149 - RNA, 22 nt, Human
ccacaaauagggggcggggaca

SEQ ID NO: 639150 - RNA, 26 nt, Human
ccagacugcagcagacggugggaaac

SEQ ID NO: 639151 - RNA, 19 nt, Human
cccagccagagguccaggg

SEQ ID NO: 639152 - RNA, 22 nt, Human
cccugcccaaucuaaaaauagg

SEQ ID NO: 639153 - RNA, 18 nt, Human
cccuucucucucucucuc

SEQ ID NO: 639154 - RNA, 25 nt, Human
ccucccaucucccugcccaaucuaa

SEQ ID NO: 639155 - RNA, 21 nt, Human
cgaaugcccuucccuauaccu

SEQ ID NO: 639156 - RNA, 21 nt, Human
cgagggcagccugccagucac

SEQ ID NO: 639157 - RNA, 24 nt, Human
cgcagccagacugcagcagacgcc

SEQ ID NO: 639158 - RNA, 19 nt, Human
cggcggcgccacccagcgg

SEQ ID NO: 639159 - RNA, 21 nt, Human
cgggauccaaguggcucaagu

SEQ ID NO: 639160 - RNA, 19 nt, Human
cggucaggaacacaucagc

SEQ ID NO: 639161 - RNA, 21 nt, Human
cggucaggaacacaucagcaa

SEQ ID NO: 639162 - RNA, 20 nt, Human
cuucugggccugcugucauc

SEQ ID NO: 639163 - RNA, 22 nt, Human
gaagaggcgguggggacuugag

SEQ ID NO: 639164 - RNA, 23 nt, Human
gaccgagggcagccugccaguca

SEQ ID NO: 639165 - RNA, 20 nt, Human
gaccgcagccagacugcagc

SEQ ID NO: 639166 - RNA, 25 nt, Human
gaggcggcggcggcgccacccagcg

SEQ ID NO: 639167 - RNA, 21 nt, Human
gagggcagccugccagucaca

SEQ ID NO: 639168 - RNA, 22 nt, Human
gagguccagggaccagcaggag

SEQ ID NO: 639169 - RNA, 18 nt, Human
gauccacgucugugacaa

SEQ ID NO: 639170 - RNA, 23 nt, Human
gcagccagacugcagcagacgcc

SEQ ID NO: 639171 - RNA, 23 nt, Human
gcccacuucgggauccaaguggc

SEQ ID NO: 639172 - RNA, 23 nt, Human
gcucggagggcagggacagaggc

SEQ ID NO: 639173 - RNA, 19 nt, Human
gcugagggggaacaccagg

SEQ ID NO: 639174 - RNA, 24 nt, Human
gcuggagugcagggcggggccagu

SEQ ID NO: 639175 - RNA, 19 nt, Human
ggacaccgucagcccuaag

SEQ ID NO: 639176 - RNA, 19 nt, Human
ggccgggcgcgcgcggggc

SEQ ID NO: 639177 - RNA, 22 nt, Human
ggcuggcugcuccugcagaugu

SEQ ID NO: 639178 - RNA, 18 nt, Human
gggcacaggugggacccg

SEQ ID NO: 639179 - RNA, 23 nt, Human
ggggacagugaggaagaagaggc

SEQ ID NO: 639180 - RNA, 21 nt, Human
uaaaaccagcguuaauauaga

SEQ ID NO: 639181 - RNA, 19 nt, Human
uaacgucagugaaauagua

SEQ ID NO: 639182 - RNA, 21 nt, Human
uaccuauccaucccaagccaa

SEQ ID NO: 639183 - RNA, 19 nt, Human
uaggagacgccccguccac

SEQ ID NO: 639184 - RNA, 22 nt, Human
uagggggcacaggugggacccg

SEQ ID NO: 639185 - RNA, 20 nt, Human
uauaccuauccaucccaagc

SEQ ID NO: 639186 - RNA, 22 nt, Human
uauagagaccuuugugugugau

SEQ ID NO: 639187 - RNA, 21 nt, Human
uauaggggcuuucuaguuucc

SEQ ID NO: 639188 - RNA, 23 nt, Human
ucaaugccggauuuacagugcaa

SEQ ID NO: 639189 - RNA, 18 nt, Human
ucagcaaaagcuccacuu

SEQ ID NO: 639190 - RNA, 18 nt, Human
uccaccgacauauuuaug

SEQ ID NO: 639191 - RNA, 20 nt, Human
uccaccgacauauuuaugga

SEQ ID NO: 639192 - RNA, 24 nt, Human
ucccucugccuucucugaguucuc

SEQ ID NO: 639193 - RNA, 18 nt, Human
uccggucaucaauuuccc

SEQ ID NO: 639194 - RNA, 19 nt, Human
uccucgggucccuucucuc

SEQ ID NO: 639195 - RNA, 26 nt, Human
ucucccgccgccgcuuucaguucgac

SEQ ID NO: 639196 - RNA, 20 nt, Human
ucugccuucucugaguucuc

SEQ ID NO: 639197 - RNA, 19 nt, Human
ugacaaggacaccgucagc

SEQ ID NO: 639198 - RNA, 24 nt, Human
ugacugcuggguggcggugguggu

SEQ ID NO: 639199 - RNA, 23 nt, Human
ugauggaagccuccuccucgggu

SEQ ID NO: 639200 - RNA, 19 nt, Human
ugcuggguggcgguggugg

SEQ ID NO: 639201 - RNA, 20 nt, Human
ugcuggguggcggugguggu

SEQ ID NO: 639202 - RNA, 24 nt, Human
ugcuggguggcgguggugguuuuc

SEQ ID NO: 639203 - RNA, 24 nt, Human
ugcugucauccuuacuccgaaugg

SEQ ID NO: 639204 - RNA, 19 nt, Human
ugcuuaguaacgucaguga

SEQ ID NO: 639205 - RNA, 19 nt, Human
uggagugcagggcggggcc

SEQ ID NO: 639206 - RNA, 20 nt, Human
uggcucaaguugucuucuug

SEQ ID NO: 639207 - RNA, 22 nt, Human
ugugaaaggagcccggagacuu

SEQ ID NO: 639208 - RNA, 22 nt, Human
uguguagccugcucugcucgag

SEQ ID NO: 639209 - RNA, 20 nt, Human
uuccagcauuuuccuucggg

SEQ ID NO: 639210 - RNA, 20 nt, Human
uucccgggaagcccacuucg

SEQ ID NO: 639211 - RNA, 22 nt, Human
uucuacauugugcugcaaugcu

SEQ ID NO: 639212 - RNA, 18 nt, Human
uucucucucucucucucc

SEQ ID NO: 639213 - RNA, 19 nt, Human
uuucccgggaagcccacuu

SEQ ID NO: 639214 - RNA, 19 nt, Human
uuuuuuuuuuuuaacagga

SEQ ID NO: 639215 - RNA, 22 nt, Human
uuuuuuuuuuuuuuuaacagga

SEQ ID NO: 639216 - RNA, 23 nt, Human
uuuuuuuuuuuuuuuuuaacagg

SEQ ID NO: 639217 - RNA, 23 nt, Human
aaagccuuggguuuccccugcuu

SEQ ID NO: 639218 - RNA, 22 nt, Human
aacccuaaaaaauguggacgug

SEQ ID NO: 639219 - RNA, 19 nt, Human
aacggaagaaaaacaaugg

SEQ ID NO: 639220 - RNA, 21 nt, Human
aagaaaaacaauggaaggaag

SEQ ID NO: 639221 - RNA, 18 nt, Human
aagauaccuuugcuccuc

SEQ ID NO: 639222 - RNA, 24 nt, Human
aauggugugaucucagcucacugc

SEQ ID NO: 639223 - RNA, 24 nt, Human
acaacccuaaaaaauguggacgug

SEQ ID NO: 639224 - RNA, 25 nt, Human
acacagcugcacauauggaaaagcc

SEQ ID NO: 639225 - RNA, 19 nt, Human
acccuaaaaaauguggacg

SEQ ID NO: 639226 - RNA, 25 nt, Human
accuccuggguucaagcaauucucc

SEQ ID NO: 639227 - RNA, 24 nt, Human
acggaguuucuccacguuggucag

SEQ ID NO: 639228 - RNA, 21 nt, Human
agaaaaacaauggaaggaagg

SEQ ID NO: 639229 - RNA, 27 nt, Human
agaaaaacaauggaaggaaggcuugaa

SEQ ID NO: 639230 - RNA, 21 nt, Human
agaagcaacaggcagcaccau

SEQ ID NO: 639231 - RNA, 27 nt, Human
agcuaauuuuguauuuuaguggagacg

SEQ ID NO: 639232 - RNA, 19 nt, Human
agcuuagaagcaacaggca

SEQ ID NO: 639233 - RNA, 23 nt, Human
aggcagcaccaucuucacgcuca

SEQ ID NO: 639234 - RNA, 24 nt, Human
aggugcuccgccugccucggccuc

SEQ ID NO: 639235 - RNA, 23 nt, Human
aguagcugauauuacaggcaugu

SEQ ID NO: 639236 - RNA, 19 nt, Human
aguccauuacaaaacuaca

SEQ ID NO: 639237 - RNA, 21 nt, Human
agugcaauggugugaucucag

SEQ ID NO: 639238 - RNA, 24 nt, Human
agugcaauggugugaucucagcuc

SEQ ID NO: 639239 - RNA, 20 nt, Human
aguuuugcucuuuuugccca

SEQ ID NO: 639240 - RNA, 21 nt, Human
auaggugaaguucugaaauuu

SEQ ID NO: 639241 - RNA, 19 nt, Human
augugccaccacacccagc

SEQ ID NO: 639242 - RNA, 18 nt, Human
auuccaggcuacucccca

SEQ ID NO: 639243 - RNA, 19 nt, Human
caacuuaggugcuccgccu

SEQ ID NO: 639244 - RNA, 22 nt, Human
caagcaauucuccugccucagc

SEQ ID NO: 639245 - RNA, 18 nt, Human
cacuaggucagcuuagaa

SEQ ID NO: 639246 - RNA, 22 nt, Human
cagcaccaucuucacgcucagu

SEQ ID NO: 639247 - RNA, 18 nt, Human
cagccuccugaguagcug

SEQ ID NO: 639248 - RNA, 21 nt, Human
cagcucacugcaaacuccacc

SEQ ID NO: 639249 - RNA, 23 nt, Human
cagcugcacauauggaaaagccu

SEQ ID NO: 639250 - RNA, 20 nt, Human
caugugccaccacacccagc

SEQ ID NO: 639251 - RNA, 22 nt, Human
ccaaaguguugggauaacaggc

SEQ ID NO: 639252 - RNA, 24 nt, Human
ccaaaguguugggauaacaggcgu

SEQ ID NO: 639253 - RNA, 20 nt, Human
ccaccacacccagcuaauuu

SEQ ID NO: 639254 - RNA, 27 nt, Human
ccaccuccuggguucaagcaauucuuu

SEQ ID NO: 639255 - RNA, 19 nt, Human
ccacguuggucaggcuggu

SEQ ID NO: 639256 - RNA, 21 nt, Human
ccacguuggucaggcuggucu

SEQ ID NO: 639257 - RNA, 21 nt, Human
ccacguuggucaggcuggucu

SEQ ID NO: 639258 - RNA, 19 nt, Human
ccaggaaaccagugccaga

SEQ ID NO: 639259 - RNA, 19 nt, Human
cccaggcuggagugcaaug

SEQ ID NO: 639260 - RNA, 20 nt, Human
cccaggcuggagugcaaugg

SEQ ID NO: 639261 - RNA, 24 nt, Human
ccgcugcgcccagccacauguuuu

SEQ ID NO: 639262 - RNA, 24 nt, Human
ccugaguagcugauauuacaggca

SEQ ID NO: 639263 - RNA, 23 nt, Human
ccugccucagccuccugaguagc

SEQ ID NO: 639264 - RNA, 24 nt, Human
ccugccucagccuccugaguagcu

SEQ ID NO: 639265 - RNA, 23 nt, Human
ccuggguucaagcaauucuccug

SEQ ID NO: 639266 - RNA, 22 nt, Human
ccuuccaccgaccuuuucacua

SEQ ID NO: 639267 - RNA, 18 nt, Human
ccuuggguuuccccugcu

SEQ ID NO: 639268 - RNA, 18 nt, Human
ccuuggguuuccccugcu

SEQ ID NO: 639269 - RNA, 18 nt, Human
ccuuugcuccucugagca

SEQ ID NO: 639270 - RNA, 20 nt, Human
cgaccuuuucacuauccaaa

SEQ ID NO: 639271 - RNA, 22 nt, Human
cguuggucaggcuggucuugaa

SEQ ID NO: 639272 - RNA, 23 nt, Human
cucacugcaaacuccaccuccug

SEQ ID NO: 639273 - RNA, 22 nt, Human
cuccugccucagccuccugagu

SEQ ID NO: 639274 - RNA, 21 nt, Human
cuccuggguucaagcaauucu

SEQ ID NO: 639275 - RNA, 20 nt, Human
cucuguaggcucagcagaau

SEQ ID NO: 639276 - RNA, 20 nt, Human
cucuuuuugcccaggcugga

SEQ ID NO: 639277 - RNA, 18 nt, Human
cugccucggccucccaaa

SEQ ID NO: 639278 - RNA, 24 nt, Human
cuggagugcaauggugugaucuca

SEQ ID NO: 639279 - RNA, 24 nt, Human
cuuuuugcccaggcuggagugcaa

SEQ ID NO: 639280 - RNA, 19 nt, Human
gaagauaccuuugcuccuc

SEQ ID NO: 639281 - RNA, 20 nt, Human
gagacggaguuucuccacgu

SEQ ID NO: 639282 - RNA, 24 nt, Human
gagaguuuugcucuuuuugcccag

SEQ ID NO: 639283 - RNA, 18 nt, Human
gauaacaggcgugagccg

SEQ ID NO: 639284 - RNA, 22 nt, Human
gcaaacuccaccuccuggguuc

SEQ ID NO: 639285 - RNA, 18 nt, Human
gccggcaaauaucuuguu

SEQ ID NO: 639286 - RNA, 21 nt, Human
gccuuggguuuccccugcuuu

SEQ ID NO: 639287 - RNA, 22 nt, Human
gcuaguuuccuccaggaaacca

SEQ ID NO: 639288 - RNA, 20 nt, Human
gcucuuuuugcccaggcugg

SEQ ID NO: 639289 - RNA, 21 nt, Human
gcucuuuuugcccaggcugga

SEQ ID NO: 639290 - RNA, 24 nt, Human
gcucuuuuugcccaggcuggagug

SEQ ID NO: 639291 - RNA, 30 nt, Human
gcuggagugcaauggugugaucucagcucc

SEQ ID NO: 639292 - RNA, 21 nt, Human
gcuuaacaaauacgccagggg

SEQ ID NO: 639293 - RNA, 20 nt, Human
ggcagaucauaggugaaguu

SEQ ID NO: 639294 - RNA, 22 nt, Human
ggcuggagugcaauggugugau

SEQ ID NO: 639295 - RNA, 18 nt, Human
ggcuggucuugaacuccc

SEQ ID NO: 639296 - RNA, 24 nt, Human
gggcagaucauaggugaaguucug

SEQ ID NO: 639297 - RNA, 23 nt, Human
gggccagggaggcgauugugcuu

SEQ ID NO: 639298 - RNA, 26 nt, Human
gggcuggguuagguaaacacagcugc

SEQ ID NO: 639299 - RNA, 19 nt, Human
gugcuccgccugccucggc

SEQ ID NO: 639300 - RNA, 21 nt, Human
uaaaaugaaaacugauuacau

SEQ ID NO: 639301 - RNA, 21 nt, Human
uaacagcaacagcuuucuaaa

SEQ ID NO: 639302 - RNA, 24 nt, Human
uaauuuuguauuuuaguggagacg

SEQ ID NO: 639303 - RNA, 21 nt, Human
uacaaugagguauuuauugca

SEQ ID NO: 639304 - RNA, 24 nt, Human
uacaggcaugugccaccacaccca

SEQ ID NO: 639305 - RNA, 23 nt, Human
uagcugauauuacaggcaugugc

SEQ ID NO: 639306 - RNA, 19 nt, Human
uaguggagacggaguuucu

SEQ ID NO: 639307 - RNA, 24 nt, Human
uaguggagacggaguuucuccacg

SEQ ID NO: 639308 - RNA, 20 nt, Human
uauccaaagaaggcucaggg

SEQ ID NO: 639309 - RNA, 19 nt, Human
uauuacaggcaugugccac

SEQ ID NO: 639310 - RNA, 19 nt, Human
ucaagcaauucuccugccu

SEQ ID NO: 639311 - RNA, 21 nt, Human
ucacugcaaacuccaccuccu

SEQ ID NO: 639312 - RNA, 24 nt, Human
ucacugcaaacuccaccuccuggg

SEQ ID NO: 639313 - RNA, 26 nt, Human
ucacugcaaacuccaccuccuggguu

SEQ ID NO: 639314 - RNA, 18 nt, Human
ucagcagaaucacuaggu

SEQ ID NO: 639315 - RNA, 19 nt, Human
uccaggcuacuccccagga

SEQ ID NO: 639316 - RNA, 24 nt, Human
ucccaaaguguugggauaacaggc

SEQ ID NO: 639317 - RNA, 23 nt, Human
uccccaggaaacguguggagcca

SEQ ID NO: 639318 - RNA, 24 nt, Human
uccugaguagcugauauuacaggc

SEQ ID NO: 639319 - RNA, 21 nt, Human
uccuggguucaagcaauucuc

SEQ ID NO: 639320 - RNA, 24 nt, Human
uccuggguucaagcaauucuccug

SEQ ID NO: 639321 - RNA, 19 nt, Human
ucuaaaaccugcacccaac

SEQ ID NO: 639322 - RNA, 25 nt, Human
ugagguauuuauugcauaugguuuu

SEQ ID NO: 639323 - RNA, 21 nt, Human
ugauauuacaggcaugugcca

SEQ ID NO: 639324 - RNA, 24 nt, Human
ugauauuacaggcaugugccacca

SEQ ID NO: 639325 - RNA, 25 nt, Human
ugaugcagaagucccagccggcaaa

SEQ ID NO: 639326 - RNA, 18 nt, Human
ugcccaggcuggagugca

SEQ ID NO: 639327 - RNA, 21 nt, Human
ugcccaggcuggagugcaaug

SEQ ID NO: 639328 - RNA, 24 nt, Human
ugcccaggcuggagugcaauggug

SEQ ID NO: 639329 - RNA, 24 nt, Human
ugccucagccuccugaguagcuga

SEQ ID NO: 639330 - RNA, 24 nt, Human
ugccucggccucccaaaguguugg

SEQ ID NO: 639331 - RNA, 24 nt, Human
ugcuccgccugccucggccuccca

SEQ ID NO: 639332 - RNA, 22 nt, Human
ugcucuuuuugcccaggcugga

SEQ ID NO: 639333 - RNA, 24 nt, Human
ugcucuuuuugcccaggcuggagu

SEQ ID NO: 639334 - RNA, 22 nt, Human
uggaaaagccuaaacucaagaa

SEQ ID NO: 639335 - RNA, 19 nt, Human
uggagugcaauggugugau

SEQ ID NO: 639336 - RNA, 24 nt, Human
uggagugcaauggugugaucucag

SEQ ID NO: 639337 - RNA, 19 nt, Human
ugggauaacaggcgugagc

SEQ ID NO: 639338 - RNA, 20 nt, Human
ugggauaacaggcgugagcc

SEQ ID NO: 639339 - RNA, 21 nt, Human
ugggauaacaggcgugagccg

SEQ ID NO: 639340 - RNA, 22 nt, Human
ugggauaacaggcgugagccgc

SEQ ID NO: 639341 - RNA, 22 nt, Human
ugggcuggucugauuaacaggc

SEQ ID NO: 639342 - RNA, 21 nt, Human
uggguucaagcaauucuccug

SEQ ID NO: 639343 - RNA, 23 nt, Human
uggguucaagcaauucuccugcc

SEQ ID NO: 639344 - RNA, 23 nt, Human
uggucaggcuggucuugaacucc

SEQ ID NO: 639345 - RNA, 24 nt, Human
uggugugaucucagcucacugcaa

SEQ ID NO: 639346 - RNA, 19 nt, Human
uguaaaaguaaaugagucc

SEQ ID NO: 639347 - RNA, 25 nt, Human
ugugaaauaaaggcacaugcauuaa

SEQ ID NO: 639348 - RNA, 24 nt, Human
uguggaaaagcaggaaaauggcug

SEQ ID NO: 639349 - RNA, 18 nt, Human
uguugguuuuugguagag

SEQ ID NO: 639350 - RNA, 18 nt, Human
uuaguggagacggaguuu

SEQ ID NO: 639351 - RNA, 21 nt, Human
uucaagcaauucuccugccuc

SEQ ID NO: 639352 - RNA, 24 nt, Human
uucaagcaauucuccugccucagc

SEQ ID NO: 639353 - RNA, 22 nt, Human
uugacaucuaucaauuuugggu

SEQ ID NO: 639354 - RNA, 18 nt, Human
uugcccaggcuggagugc

SEQ ID NO: 639355 - RNA, 23 nt, Human
uugcucuuuuugcccaggcugga

SEQ ID NO: 639356 - RNA, 23 nt, Human
uuguaagcacaggaaaacaaccc

SEQ ID NO: 639357 - RNA, 24 nt, Human
uuugcucuuuuugcccaggcugga

SEQ ID NO: 639358 - RNA, 23 nt, Human
uuuucuaagucacugaagcccua

SEQ ID NO: 639359 - RNA, 23 nt, Human
uuuugcucuuuuugcccaggcug

SEQ ID NO: 639360 - RNA, 24 nt, Human
uuuugcucuuuuugcccaggcugg

SEQ ID NO: 639361 - RNA, 18 nt, Human
uuuuguauuuuaguggag

SEQ ID NO: 639362 - RNA, 19 nt, Human
uuuuguauuuuaguggaga

SEQ ID NO: 639363 - RNA, 24 nt, Human
uuuuuuucccaguuacaaaaauau

SEQ ID NO: 639364 - RNA, 22 nt, Human
uuuuuuuuuuuuuuuuucccag

SEQ ID NO: 639365 - RNA, 24 nt, Human
aaacaaaagggaaaacguguuuga

SEQ ID NO: 639366 - RNA, 24 nt, Human
aaacaaaagggaaaacguguuuga

SEQ ID NO: 639367 - RNA, 25 nt, Human
aagaaacaaaaaccaaaagccaccc

SEQ ID NO: 639368 - RNA, 22 nt, Human
aagaaagaaacaaaaaccaaaa

SEQ ID NO: 639369 - RNA, 23 nt, Human
aagaaagaaacaaaaaccaaaag

SEQ ID NO: 639370 - RNA, 25 nt, Human
aagacaagacaagaaagaaacaaaa

SEQ ID NO: 639371 - RNA, 23 nt, Human
aauaaaagacaagacaagaaaga

SEQ ID NO: 639372 - RNA, 22 nt, Human
acaagacaagaaagaaacaaaa

SEQ ID NO: 639373 - RNA, 23 nt, Human
acaagacaagaaagaaacaaaaa

SEQ ID NO: 639374 - RNA, 24 nt, Human
acaagacaagaaagaaacaaaaac

SEQ ID NO: 639375 - RNA, 26 nt, Human
acaagacaagaaagaaacaaaaacca

SEQ ID NO: 639376 - RNA, 29 nt, Human
agaaagaaacaaaaaccaaaagccacccu

SEQ ID NO: 639377 - RNA, 22 nt, Human
agacaagaaagaaacaaaaacc

SEQ ID NO: 639378 - RNA, 24 nt, Human
agacaagaaagaaacaaaaaccaa

SEQ ID NO: 639379 - RNA, 26 nt, Human
agacaagaaagaaacaaaaaccaaaa

SEQ ID NO: 639380 - RNA, 18 nt, Human
caacuuggaacucaugag

SEQ ID NO: 639381 - RNA, 24 nt, Human
caagacaagaaagaaacaaaaacc

SEQ ID NO: 639382 - RNA, 21 nt, Human
cauguuucaacuuggaacuca

SEQ ID NO: 639383 - RNA, 18 nt, Human
cauuggaaguaaaugagg

SEQ ID NO: 639384 - RNA, 18 nt, Human
ccucaaaauucuguuuag

SEQ ID NO: 639385 - RNA, 18 nt, Human
ccuuucaauaaaagacaa

SEQ ID NO: 639386 - RNA, 18 nt, Human
gacaagacaagaaagaaa

SEQ ID NO: 639387 - RNA, 20 nt, Human
ucaugaguuauuugggccau

SEQ ID NO: 639388 - RNA, 22 nt, Human
uggaaguaaaugaggauuguaa

SEQ ID NO: 639389 - RNA, 19 nt, Human
uguuucaacuuggaacuca

SEQ ID NO: 639390 - RNA, 26 nt, Human
uuuuuuuuuuuuuuagucacauugga

SEQ ID NO: 639391 - RNA, 18 nt, Human
aaaacacugcauuaagac

SEQ ID NO: 639392 - RNA, 22 nt, Human
aaauugcugggauuacaggcau

SEQ ID NO: 639393 - RNA, 24 nt, Human
aaauugcugggauuacaggcauga

SEQ ID NO: 639394 - RNA, 19 nt, Human
aaccaaugcuugugaaaca

SEQ ID NO: 639395 - RNA, 25 nt, Human
aagugaucuucccaccuuggccucc

SEQ ID NO: 639396 - RNA, 24 nt, Human
acagcacacaaaaccaucauccac

SEQ ID NO: 639397 - RNA, 23 nt, Human
acccagucuccaaacagcacaca

SEQ ID NO: 639398 - RNA, 25 nt, Human
acuauguugcccaggcuggucucaa

SEQ ID NO: 639399 - RNA, 25 nt, Human
agaaacaauaaaguauuugauuggc

SEQ ID NO: 639400 - RNA, 18 nt, Human
agcaaguaaauaaaaaag

SEQ ID NO: 639401 - RNA, 22 nt, Human
aguuagaaucugcaauaauuug

SEQ ID NO: 639402 - RNA, 22 nt, Human
auaaaauguugucguccuugac

SEQ ID NO: 639403 - RNA, 24 nt, Human
augaaauaagaaacauaucaaaac

SEQ ID NO: 639404 - RNA, 20 nt, Human
auguugcccaggcuggucuc

SEQ ID NO: 639405 - RNA, 27 nt, Human
caagugaucuucccaccuuggccuccu

SEQ ID NO: 639406 - RNA, 19 nt, Human
cacuauguugcccaggcug

SEQ ID NO: 639407 - RNA, 24 nt, Human
cacuauguugcccaggcuggucuc

SEQ ID NO: 639408 - RNA, 25 nt, Human
cacuuuauaaacuuaauaacaucac

SEQ ID NO: 639409 - RNA, 24 nt, Human
cacuuuauaaacuuaauaacaucc

SEQ ID NO: 639410 - RNA, 18 nt, Human
cagcacacaaaaccauca

SEQ ID NO: 639411 - RNA, 23 nt, Human
cagcacacaaaaccaucauccac

SEQ ID NO: 639412 - RNA, 22 nt, Human
cauccacuggguuuugcccccu

SEQ ID NO: 639413 - RNA, 18 nt, Human
ccaccacacccagccaca

SEQ ID NO: 639414 - RNA, 19 nt, Human
cccagcaucacaugguaaa

SEQ ID NO: 639415 - RNA, 24 nt, Human
ccuaaauugcugggauuacaggca

SEQ ID NO: 639416 - RNA, 22 nt, Human
ccugggcucaagugaucuuccc

SEQ ID NO: 639417 - RNA, 23 nt, Human
cuaaauugcugggauuacaggca

SEQ ID NO: 639418 - RNA, 24 nt, Human
cuaaauugcugggauuacaggcau

SEQ ID NO: 639419 - RNA, 24 nt, Human
cucaagugaucuucccaccuuggc

SEQ ID NO: 639420 - RNA, 23 nt, Human
cuccaaacagcacacaaaaccau

SEQ ID NO: 639421 - RNA, 22 nt, Human
cuucccaccuuggccuccuaaa

SEQ ID NO: 639422 - RNA, 18 nt, Human
cuuuauaaucucccccuc

SEQ ID NO: 639423 - RNA, 19 nt, Human
gaagguuaaaguggacuua

SEQ ID NO: 639424 - RNA, 20 nt, Human
gagucaauguuuaaauauga

SEQ ID NO: 639425 - RNA, 22 nt, Human
gaugacuacuuguucaacuugu

SEQ ID NO: 639426 - RNA, 18 nt, Human
gauuacaggcaugagcca

SEQ ID NO: 639427 - RNA, 21 nt, Human
gauuacaggcaugagccacca

SEQ ID NO: 639428 - RNA, 22 nt, Human
gauuacaggcaugagccaccac

SEQ ID NO: 639429 - RNA, 19 nt, Human
gcucaagugaucuucccac

SEQ ID NO: 639430 - RNA, 19 nt, Human
ggauuacaggcaugagcca

SEQ ID NO: 639431 - RNA, 19 nt, Human
ggauucggaaaacacugca

SEQ ID NO: 639432 - RNA, 22 nt, Human
gggcucaagugaucuucccacc

SEQ ID NO: 639433 - RNA, 18 nt, Human
gguaguaguuauauuucu

SEQ ID NO: 639434 - RNA, 21 nt, Human
guaaacacccagucuccaaac

SEQ ID NO: 639435 - RNA, 24 nt, Human
gucucacucacuauguugcccagg

SEQ ID NO: 639436 - RNA, 18 nt, Human
gugguaaacacccagucu

SEQ ID NO: 639437 - RNA, 22 nt, Human
guuauaaaauuuaaauaugggg

SEQ ID NO: 639438 - RNA, 24 nt, Human
uaaauagcagccaugaagaugaaa

SEQ ID NO: 639439 - RNA, 24 nt, Human
uacaggcaugagccaccacaccca

SEQ ID NO: 639440 - RNA, 21 nt, Human
uagcgagaaacaauaaaguau

SEQ ID NO: 639441 - RNA, 19 nt, Human
uaguaacagaaguuugauu

SEQ ID NO: 639442 - RNA, 23 nt, Human
uauguugcccaggcuggucucaa

SEQ ID NO: 639443 - RNA, 24 nt, Human
uauguugcccaggcuggucucaaa

SEQ ID NO: 639444 - RNA, 18 nt, Human
ucaaagcuagagaguuau

SEQ ID NO: 639445 - RNA, 21 nt, Human
uccacuggguuuugcccccug

SEQ ID NO: 639446 - RNA, 24 nt, Human
uccuaaauugcugggauuacaggc

SEQ ID NO: 639447 - RNA, 20 nt, Human
uccugggcucaagugaucuu

SEQ ID NO: 639448 - RNA, 22 nt, Human
uccugggcucaagugaucuucc

SEQ ID NO: 639449 - RNA, 24 nt, Human
uccugggcucaagugaucuuccca

SEQ ID NO: 639450 - RNA, 27 nt, Human
ucucacucacuauguugcccaggcugg

SEQ ID NO: 639451 - RNA, 26 nt, Human
ugaaauaagaaacauaucaaaacacu

SEQ ID NO: 639452 - RNA, 21 nt, Human
ugaauaaauagcagccaugaa

SEQ ID NO: 639453 - RNA, 23 nt, Human
ugacauuaacaauaaugcuacag

SEQ ID NO: 639454 - RNA, 21 nt, Human
ugacucuuuauaaucuccccc

SEQ ID NO: 639455 - RNA, 20 nt, Human
ugaggagacuaaaauagaua

SEQ ID NO: 639456 - RNA, 24 nt, Human
ugcccaggcuggucucaaauuccu

SEQ ID NO: 639457 - RNA, 28 nt, Human
ugcccaggcuggucucaaauuccugggc

SEQ ID NO: 639458 - RNA, 18 nt, Human
ugcugggauuacaggcau

SEQ ID NO: 639459 - RNA, 20 nt, Human
ugcugggauuacaggcauga

SEQ ID NO: 639460 - RNA, 22 nt, Human
uggaaggacacuucuuuaaaaa

SEQ ID NO: 639461 - RNA, 18 nt, Human
ugggauuacaggcaugag

SEQ ID NO: 639462 - RNA, 19 nt, Human
ugggauuacaggcaugagc

SEQ ID NO: 639463 - RNA, 22 nt, Human
ugggauuacaggcaugagccac

SEQ ID NO: 639464 - RNA, 23 nt, Human
ugggauuacaggcaugagccacc

SEQ ID NO: 639465 - RNA, 24 nt, Human
ugggauuacaggcaugagccacca

SEQ ID NO: 639466 - RNA, 24 nt, Human
ugggauuacaggcaugagccacca

SEQ ID NO: 639467 - RNA, 22 nt, Human
ugggcucaagugaucuucccac

SEQ ID NO: 639468 - RNA, 24 nt, Human
ugggcucaagugaucuucccaccu

SEQ ID NO: 639469 - RNA, 18 nt, Human
uguugcuaagaaacagaa

SEQ ID NO: 639470 - RNA, 20 nt, Human
uguuuguacuuaagagugaa

SEQ ID NO: 639471 - RNA, 23 nt, Human
uucccaccuuggccuccuaaauu

SEQ ID NO: 639472 - RNA, 25 nt, Human
uucuuuagcguuggaaggacacuuc

SEQ ID NO: 639473 - RNA, 20 nt, Human
uugacauuaacaauaaugcu

SEQ ID NO: 639474 - RNA, 20 nt, Human
uuggccuccuaaauugcugg

SEQ ID NO: 639475 - RNA, 22 nt, Human
uuguaaaaacauuaaaucaaac

SEQ ID NO: 639476 - RNA, 22 nt, Human
uuuauaaacuuaauaacaucac

SEQ ID NO: 639477 - RNA, 20 nt, Human
uuucuguugcuaagaaacag

SEQ ID NO: 639478 - RNA, 20 nt, Human
uuuuaaauuauaagaggagu

SEQ ID NO: 639479 - RNA, 22 nt, Human
uuuuuuuuuuuuuuuuuggcag

SEQ ID NO: 639480 - RNA, 20 nt, Human
uuuuuuuuuuuuuuuuuugg

SEQ ID NO: 639481 - RNA, 20 nt, Human
aaaacauaaaacaacagcaa

SEQ ID NO: 639482 - RNA, 19 nt, Human
aaacaacagcaaaaacguc

SEQ ID NO: 639483 - RNA, 21 nt, Human
aaacaacagcaaaaacgucaa

SEQ ID NO: 639484 - RNA, 18 nt, Human
aaacacacacacacagac

SEQ ID NO: 639485 - RNA, 19 nt, Human
aaagagagagagaaaggag

SEQ ID NO: 639486 - RNA, 23 nt, Human
aaagccaacucuguccucugccu

SEQ ID NO: 639487 - RNA, 27 nt, Human
aaaugcauguuuuaccaucacaaauaa

SEQ ID NO: 639488 - RNA, 24 nt, Human
aacacacacacacagacacacaca

SEQ ID NO: 639489 - RNA, 18 nt, Human
aacagcaaaaacgucaaa

SEQ ID NO: 639490 - RNA, 20 nt, Human
aacagcaaaaacgucaaacc

SEQ ID NO: 639491 - RNA, 21 nt, Human
aacauaaaacaacagcaaaaa

SEQ ID NO: 639492 - RNA, 21 nt, Human
aagaagaaacuccgggguccc

SEQ ID NO: 639493 - RNA, 23 nt, Human
aagcaaauaugcauugccugggc

SEQ ID NO: 639494 - RNA, 19 nt, Human
aaggaaggggaggaaaacg

SEQ ID NO: 639495 - RNA, 19 nt, Human
aaucguuccuccaaagcug

SEQ ID NO: 639496 - RNA, 25 nt, Human
acacacacacacacacacacacccc

SEQ ID NO: 639497 - RNA, 31 nt, Human
acacacacacacagacacacacacacacaca

SEQ ID NO: 639498 - RNA, 23 nt, Human
acacacacacagacacacacaca

SEQ ID NO: 639499 - RNA, 24 nt, Human
acacacacacagacacacacacac

SEQ ID NO: 639500 - RNA, 33 nt, Human
acacacacagacacacacacacacacacacagu

SEQ ID NO: 639501 - RNA, 33 nt, Human
acacacagacacacacacacacacacacacagu

SEQ ID NO: 639502 - RNA, 22 nt, Human
acucuggacuuuggguaaaacg

SEQ ID NO: 639503 - RNA, 19 nt, Human
acugccuccuuguuucucc

SEQ ID NO: 639504 - RNA, 21 nt, Human
acugccuccuuguuucuccca

SEQ ID NO: 639505 - RNA, 20 nt, Human
acuuguuuaugagaaccucg

SEQ ID NO: 639506 - RNA, 20 nt, Human
aggacccacagaauuaagcc

SEQ ID NO: 639507 - RNA, 21 nt, Human
aggacccacagaauuaagccc

SEQ ID NO: 639508 - RNA, 24 nt, Human
auaaaacaacagcaaaaacgucaa

SEQ ID NO: 639509 - RNA, 28 nt, Human
auaaaacaacagcaaaaacgucaaacca

SEQ ID NO: 639510 - RNA, 25 nt, Human
auauacacacacaagugugaacgca

SEQ ID NO: 639511 - RNA, 27 nt, Human
aucccucccacccugcccaccccuuca

SEQ ID NO: 639512 - RNA, 23 nt, Human
aucuacaugcacauauacacaca

SEQ ID NO: 639513 - RNA, 21 nt, Human
augacaaaugaaacgaaaaaa

SEQ ID NO: 639514 - RNA, 18 nt, Human
auggagauguguguagua

SEQ ID NO: 639515 - RNA, 25 nt, Human
caaacacaaagcagauacauuuuua

SEQ ID NO: 639516 - RNA, 22 nt, Human
caaagagcuggccuggaaaggc

SEQ ID NO: 639517 - RNA, 20 nt, Human
caaaugaaacgaaaaaaucc

SEQ ID NO: 639518 - RNA, 21 nt, Human
caacacacacacacagaaaga

SEQ ID NO: 639519 - RNA, 23 nt, Human
caacacacacacacagaaagaga

SEQ ID NO: 639520 - RNA, 20 nt, Human
caagaagaaaugaaagcaaa

SEQ ID NO: 639521 - RNA, 21 nt, Human
cacacaagugugaacgcauac

SEQ ID NO: 639522 - RNA, 20 nt, Human
cacacacacacacacacaca

SEQ ID NO: 639523 - RNA, 20 nt, Human
cacacacacacacacacaca

SEQ ID NO: 639524 - RNA, 22 nt, Human
cacacacacacacacacacaca

SEQ ID NO: 639525 - RNA, 21 nt, Human
cacacacacacaccccaugcc

SEQ ID NO: 639526 - RNA, 27 nt, Human
cacacacacacagaaagagagagagaa

SEQ ID NO: 639527 - RNA, 24 nt, Human
cacacacacacagacacacacaca

SEQ ID NO: 639528 - RNA, 28 nt, Human
cacacaccccaugccauugccccugagg

SEQ ID NO: 639529 - RNA, 21 nt, Human
cacagaucuaaggggucaucu

SEQ ID NO: 639530 - RNA, 22 nt, Human
caccccuucacaugcacacaca

SEQ ID NO: 639531 - RNA, 22 nt, Human
cagagaccgcgcaaagccaacu

SEQ ID NO: 639532 - RNA, 25 nt, Human
cagagauccucauuuuccaagauuu

SEQ ID NO: 639533 - RNA, 21 nt, Human
cagcccaaggaaauucccaga

SEQ ID NO: 639534 - RNA, 18 nt, Human
cagcucccuucagcggug

SEQ ID NO: 639535 - RNA, 25 nt, Human
cauacgcgugcaucccucccacccu

SEQ ID NO: 639536 - RNA, 19 nt, Human
cauauacacacacaagugu

SEQ ID NO: 639537 - RNA, 24 nt, Human
caucccucccacccugcccacccc

SEQ ID NO: 639538 - RNA, 24 nt, Human
cauccuuguucacaaucucagggg

SEQ ID NO: 639539 - RNA, 19 nt, Human
caugaaacacaccauucca

SEQ ID NO: 639540 - RNA, 24 nt, Human
ccaacacacacacacagaaagaga

SEQ ID NO: 639541 - RNA, 20 nt, Human
ccacccugcccaccccuuca

SEQ ID NO: 639542 - RNA, 23 nt, Human
ccagcccaaggaaauucccagau

SEQ ID NO: 639543 - RNA, 21 nt, Human
cccaaggaaauucccagauga

SEQ ID NO: 639544 - RNA, 19 nt, Human
cccacagaauuaagcccuc

SEQ ID NO: 639545 - RNA, 20 nt, Human
cccagaaagcuuaauuuauu

SEQ ID NO: 639546 - RNA, 21 nt, Human
cccaugccauugcuuggucca

SEQ ID NO: 639547 - RNA, 22 nt, Human
cccaugccauugcuugguccac

SEQ ID NO: 639548 - RNA, 23 nt, Human
cccaugccauugcuugguccaca

SEQ ID NO: 639549 - RNA, 20 nt, Human
ccccacccacuuuccuuuuc

SEQ ID NO: 639550 - RNA, 22 nt, Human
cccuggauggcggggaaggcuc

SEQ ID NO: 639551 - RNA, 21 nt, Human
cccuucacaugcacacacagc

SEQ ID NO: 639552 - RNA, 19 nt, Human
ccgcaggagugggcacagg

SEQ ID NO: 639553 - RNA, 21 nt, Human
ccgugcuuuuccagugggaag

SEQ ID NO: 639554 - RNA, 24 nt, Human
ccucccacccugcccaccccuuca

SEQ ID NO: 639555 - RNA, 23 nt, Human
ccuccuuguuucucccaugagag

SEQ ID NO: 639556 - RNA, 18 nt, Human
ccugcucccguccccugg

SEQ ID NO: 639557 - RNA, 21 nt, Human
ccuucccagaaagcuuaauuu

SEQ ID NO: 639558 - RNA, 19 nt, Human
cgaccugcugccuccagga

SEQ ID NO: 639559 - RNA, 22 nt, Human
cgcauacacaaacacacacaca

SEQ ID NO: 639560 - RNA, 22 nt, Human
cucaagcucaagaagaaaugaa

SEQ ID NO: 639561 - RNA, 22 nt, Human
cucccguccccugggaccucau

SEQ ID NO: 639562 - RNA, 20 nt, Human
cucuacccgaccugcugccu

SEQ ID NO: 639563 - RNA, 22 nt, Human
cugccugcccccgcaagggcug

SEQ ID NO: 639564 - RNA, 20 nt, Human
cugcuauccugagaaaaaga

SEQ ID NO: 639565 - RNA, 24 nt, Human
cuguugugcugaagcccagagcug

SEQ ID NO: 639566 - RNA, 21 nt, Human
gaagcccagagcuggaagcca

SEQ ID NO: 639567 - RNA, 27 nt, Human
gacacacacacacacacacacacaccc

SEQ ID NO: 639568 - RNA, 20 nt, Human
gaccuucccuucuuuaugga

SEQ ID NO: 639569 - RNA, 18 nt, Human
gacucaaggcgaucgcag

SEQ ID NO: 639570 - RNA, 21 nt, Human
gacugccuccuuguuucuccc

SEQ ID NO: 639571 - RNA, 24 nt, Human
gagacagucguuuggcuccaauac

SEQ ID NO: 639572 - RNA, 21 nt, Human
gagagagaaaggagaaaauuu

SEQ ID NO: 639573 - RNA, 19 nt, Human
gagcaggccaaacucacuc

SEQ ID NO: 639574 - RNA, 22 nt, Human
gaggagacauggggcccuccca

SEQ ID NO: 639575 - RNA, 19 nt, Human
gcacaagcgacugccuccu

SEQ ID NO: 639576 - RNA, 23 nt, Human
gcccaaggaaauucccagaugac

SEQ ID NO: 639577 - RNA, 24 nt, Human
gcuacaaaacaaagagcuggccug

SEQ ID NO: 639578 - RNA, 20 nt, Human
gcuuccuccuccccaguaaa

SEQ ID NO: 639579 - RNA, 18 nt, Human
ggagcuccucaagcucaa

SEQ ID NO: 639580 - RNA, 21 nt, Human
ggggggcuuuggaaugagggc

SEQ ID NO: 639581 - RNA, 21 nt, Human
ggucaugagcaggccaaacuc

SEQ ID NO: 639582 - RNA, 18 nt, Human
guaaaacguccugagccc

SEQ ID NO: 639583 - RNA, 19 nt, Human
guccgcuuccuccucccca

SEQ ID NO: 639584 - RNA, 21 nt, Human
gugaacuuguuuaugagaacc

SEQ ID NO: 639585 - RNA, 26 nt, Human
gugcugaagcccagagcuggaagcca

SEQ ID NO: 639586 - RNA, 22 nt, Human
uaaaacaacagcaaaaacguca

SEQ ID NO: 639587 - RNA, 23 nt, Human
uaaaacaacagcaaaaacgucaa

SEQ ID NO: 639588 - RNA, 20 nt, Human
uaaaacguccugagcccgau

SEQ ID NO: 639589 - RNA, 24 nt, Human
uaaaacuucuggaacaugcacaag

SEQ ID NO: 639590 - RNA, 18 nt, Human
uaaccaggucuccaggua

SEQ ID NO: 639591 - RNA, 20 nt, Human
uacccgaccugcugccucca

SEQ ID NO: 639592 - RNA, 18 nt, Human
uaccugcucccguccccu

SEQ ID NO: 639593 - RNA, 19 nt, Human
uagaacacugcuacuucca

SEQ ID NO: 639594 - RNA, 22 nt, Human
uaggacccacagaauuaagccc

SEQ ID NO: 639595 - RNA, 24 nt, Human
uauacacacacaagugugaacgca

SEQ ID NO: 639596 - RNA, 22 nt, Human
uaugcagaggcuggacucaagg

SEQ ID NO: 639597 - RNA, 27 nt, Human
uaugcagcaucuacaugcacauauaca

SEQ ID NO: 639598 - RNA, 20 nt, Human
uaugcucacauacgcgugca

SEQ ID NO: 639599 - RNA, 22 nt, Human
ucaaagccucaauugucugcua

SEQ ID NO: 639600 - RNA, 24 nt, Human
ucaaagccucaauugucugcuacu

SEQ ID NO: 639601 - RNA, 22 nt, Human
uccaaagcugguauuggaaacu

SEQ ID NO: 639602 - RNA, 20 nt, Human
uccaacuugcacaaaaggaa

SEQ ID NO: 639603 - RNA, 20 nt, Human
uccacacugcaugaaacaca

SEQ ID NO: 639604 - RNA, 22 nt, Human
ucccagaugacacagaucuaag

SEQ ID NO: 639605 - RNA, 20 nt, Human
uccccugggaccucauccug

SEQ ID NO: 639606 - RNA, 21 nt, Human
uccccugggaccucauccugg

SEQ ID NO: 639607 - RNA, 18 nt, Human
uccgcuuccuccucccca

SEQ ID NO: 639608 - RNA, 24 nt, Human
uccuccccaguaaaacuucuggaa

SEQ ID NO: 639609 - RNA, 23 nt, Human
uccucuguccgcuuccuccuccc

SEQ ID NO: 639610 - RNA, 22 nt, Human
uccugguguugccagcucccuu

SEQ ID NO: 639611 - RNA, 19 nt, Human
uccuuguuucucccaugag

SEQ ID NO: 639612 - RNA, 28 nt, Human
ucucucauacacagaagcuaagggagaa

SEQ ID NO: 639613 - RNA, 19 nt, Human
ucugaggagacauggggcc

SEQ ID NO: 639614 - RNA, 23 nt, Human
ucuuuuagaaacaaauuccuccu

SEQ ID NO: 639615 - RNA, 18 nt, Human
ugaaacacaccauuccag

SEQ ID NO: 639616 - RNA, 25 nt, Human
ugaaacgaaaaaauccaucugggug

SEQ ID NO: 639617 - RNA, 29 nt, Human
ugaacgcauacacaaacacacacacacag

SEQ ID NO: 639618 - RNA, 23 nt, Human
ugaagcccagagcuggaagccag

SEQ ID NO: 639619 - RNA, 23 nt, Human
ugacaaaugaaacgaaaaaaucc

SEQ ID NO: 639620 - RNA, 22 nt, Human
ugagagaccacaggcugguguc

SEQ ID NO: 639621 - RNA, 21 nt, Human
ugagaggaauuggaacugcuc

SEQ ID NO: 639622 - RNA, 18 nt, Human
ugaugagggccaccugug

SEQ ID NO: 639623 - RNA, 18 nt, Human
ugcacccaggagcuccuc

SEQ ID NO: 639624 - RNA, 22 nt, Human
ugccccugcuuuggaauguugc

SEQ ID NO: 639625 - RNA, 20 nt, Human
ugccuucccagaaagcuuaa

SEQ ID NO: 639626 - RNA, 22 nt, Human
ugcucccguccccugggaccuc

SEQ ID NO: 639627 - RNA, 21 nt, Human
ugcuugguccacacugcauga

SEQ ID NO: 639628 - RNA, 19 nt, Human
ugggagcagcuucaaaaac

SEQ ID NO: 639629 - RNA, 19 nt, Human
ugggccucugcugaagcag

SEQ ID NO: 639630 - RNA, 22 nt, Human
ugggccucugcugaagcagccu

SEQ ID NO: 639631 - RNA, 20 nt, Human
uggguaaaacguccugagcc

SEQ ID NO: 639632 - RNA, 19 nt, Human
ugucuaaaccagcccaagg

SEQ ID NO: 639633 - RNA, 18 nt, Human
uguugccagcucccuuca

SEQ ID NO: 639634 - RNA, 22 nt, Human
uucucucauacacagaagcuaa

SEQ ID NO: 639635 - RNA, 23 nt, Human
uuggaaacuugccauuuucccaa

SEQ ID NO: 639636 - RNA, 23 nt, Human
uuguucuuacuuugaaaaacaga

SEQ ID NO: 639637 - RNA, 22 nt, Human
uuucaaagcagguuaucugcua

SEQ ID NO: 639638 - RNA, 22 nt, Human
uuucccaacacacacacacaga

SEQ ID NO: 639639 - RNA, 23 nt, Human
uuuucccaacacacacacacaga

SEQ ID NO: 639640 - RNA, 23 nt, Human
uuuuuauuuccaaacacaaagca

SEQ ID NO: 639641 - RNA, 24 nt, Human
uuuuuuuucauagaccaaaauaga

SEQ ID NO: 639642 - RNA, 20 nt, Human
aaaaagauuugacauaucug

SEQ ID NO: 639643 - RNA, 21 nt, Human
aaaacccacagcaaacuaagc

SEQ ID NO: 639644 - RNA, 22 nt, Human
aaaagcuauaagacacagauaa

SEQ ID NO: 639645 - RNA, 25 nt, Human
aaacagauagucuuaugagaccaag

SEQ ID NO: 639646 - RNA, 18 nt, Human
aacagcacuuucaaggac

SEQ ID NO: 639647 - RNA, 23 nt, Human
aagcagcacaccagcacagcacc

SEQ ID NO: 639648 - RNA, 20 nt, Human
aagccaaaacccacagcaaa

SEQ ID NO: 639649 - RNA, 18 nt, Human
acccaacccuguccuacc

SEQ ID NO: 639650 - RNA, 22 nt, Human
acccacagcaaacuaagcagca

SEQ ID NO: 639651 - RNA, 23 nt, Human
agaccaggacagugugugaagga

SEQ ID NO: 639652 - RNA, 22 nt, Human
agaggcagaauauagagaagaa

SEQ ID NO: 639653 - RNA, 20 nt, Human
agccaaaacccacagcaaac

SEQ ID NO: 639654 - RNA, 22 nt, Human
agccaaaacccacagcaaacua

SEQ ID NO: 639655 - RNA, 19 nt, Human
agccuuccaagugaacagg

SEQ ID NO: 639656 - RNA, 26 nt, Human
aggcagaauauagagaagagggaccc

SEQ ID NO: 639657 - RNA, 23 nt, Human
agugaaaaugaaaaccaaaauga

SEQ ID NO: 639658 - RNA, 23 nt, Human
auaccaagucaucucgaaugucc

SEQ ID NO: 639659 - RNA, 22 nt, Human
augugugugugugcuugugugu

SEQ ID NO: 639660 - RNA, 22 nt, Human
auucccauuuuacaggcaggga

SEQ ID NO: 639661 - RNA, 27 nt, Human
caaacuaagcagcacaccagcacagca

SEQ ID NO: 639662 - RNA, 24 nt, Human
caaggaauguuugggaaaagccaa

SEQ ID NO: 639663 - RNA, 24 nt, Human
caaugugcuggaggaaggggguag

SEQ ID NO: 639664 - RNA, 18 nt, Human
cagcaaacuaagcagcac

SEQ ID NO: 639665 - RNA, 21 nt, Human
cagcaaacuaagcagcacacc

SEQ ID NO: 639666 - RNA, 21 nt, Human
cagcacaccagcacagcaccc

SEQ ID NO: 639667 - RNA, 21 nt, Human
cagcacagcacccaacccugu

SEQ ID NO: 639668 - RNA, 18 nt, Human
cagcacccaacccugucc

SEQ ID NO: 639669 - RNA, 22 nt, Human
cagccagagcauccaugggcag

SEQ ID NO: 639670 - RNA, 25 nt, Human
cagccugacacaaagauggagaugg

SEQ ID NO: 639671 - RNA, 25 nt, Human
caugugugugugugcuugugugugu

SEQ ID NO: 639672 - RNA, 22 nt, Human
ccaaaagcuauaagacacagau

SEQ ID NO: 639673 - RNA, 21 nt, Human
ccaagugaacaggccaaguca

SEQ ID NO: 639674 - RNA, 21 nt, Human
ccacagcaaacuaagcagcac

SEQ ID NO: 639675 - RNA, 22 nt, Human
ccacagcaaacuaagcagcaca

SEQ ID NO: 639676 - RNA, 21 nt, Human
ccugacacaaagauggagaug

SEQ ID NO: 639677 - RNA, 23 nt, Human
cuaugugugcaugugugugugug

SEQ ID NO: 639678 - RNA, 19 nt, Human
cucucuagcugaguucuag

SEQ ID NO: 639679 - RNA, 18 nt, Human
cucugguuucugggggac

SEQ ID NO: 639680 - RNA, 20 nt, Human
cugagaccaggacagugugu

SEQ ID NO: 639681 - RNA, 21 nt, Human
gaacaggccaagucacaccau

SEQ ID NO: 639682 - RNA, 23 nt, Human
gaauauagagaagaauuagaaau

SEQ ID NO: 639683 - RNA, 18 nt, Human
gcagcagaugggagcugg

SEQ ID NO: 639684 - RNA, 20 nt, Human
ggcagcagaugggagcuggg

SEQ ID NO: 639685 - RNA, 22 nt, Human
gggaaaagccaaaacccacagc

SEQ ID NO: 639686 - RNA, 18 nt, Human
gugugugugugugugugu

SEQ ID NO: 639687 - RNA, 19 nt, Human
uaaaaccauccaaaagcua

SEQ ID NO: 639688 - RNA, 21 nt, Human
uaacaaaaugaugagacacag

SEQ ID NO: 639689 - RNA, 19 nt, Human
uaagacacagauaacaaaa

SEQ ID NO: 639690 - RNA, 28 nt, Human
uaagccaccaaagucagccugucaaggg

SEQ ID NO: 639691 - RNA, 19 nt, Human
uacauguuauuagugccug

SEQ ID NO: 639692 - RNA, 22 nt, Human
uaggacaaggaauguuugggaa

SEQ ID NO: 639693 - RNA, 21 nt, Human
uaugugugcaugugugugugu

SEQ ID NO: 639694 - RNA, 23 nt, Human
ucacucagcugccagugcucugg

SEQ ID NO: 639695 - RNA, 24 nt, Human
ucacucagcugccagugcucuggu

SEQ ID NO: 639696 - RNA, 18 nt, Human
ucagccagagcauccaug

SEQ ID NO: 639697 - RNA, 20 nt, Human
ucaucaaggucacucagcug

SEQ ID NO: 639698 - RNA, 21 nt, Human
ucaucucgaauguccaauuau

SEQ ID NO: 639699 - RNA, 23 nt, Human
uccuaagccaccaaagucagccu

SEQ ID NO: 639700 - RNA, 21 nt, Human
uccuaugugugcaugugugug

SEQ ID NO: 639701 - RNA, 21 nt, Human
ucugucaggaaaaauauuacu

SEQ ID NO: 639702 - RNA, 22 nt, Human
ugaccuccaaauaccaagucau

SEQ ID NO: 639703 - RNA, 26 nt, Human
ugagaccaggacagugugugaaggaa

SEQ ID NO: 639704 - RNA, 19 nt, Human
ugaggcauccuaagccacc

SEQ ID NO: 639705 - RNA, 22 nt, Human
ugaugagacacaguucagcuca

SEQ ID NO: 639706 - RNA, 20 nt, Human
ugaugggaggugguaugugg

SEQ ID NO: 639707 - RNA, 18 nt, Human
ugcaugugugugugugcu

SEQ ID NO: 639708 - RNA, 18 nt, Human
ugccagugcucugguuuc

SEQ ID NO: 639709 - RNA, 24 nt, Human
ugcugccugaccuccaaauaccaa

SEQ ID NO: 639710 - RNA, 22 nt, Human
uggaauaauuagauuaaggaau

SEQ ID NO: 639711 - RNA, 22 nt, Human
uggaggaaggggguagauuuuc

SEQ ID NO: 639712 - RNA, 26 nt, Human
ugggaaaagccaaaacccacagcaaa

SEQ ID NO: 639713 - RNA, 20 nt, Human
ugggaaaagccaaaacccag

SEQ ID NO: 639714 - RNA, 20 nt, Human
ugugcaugugugugugugcu

SEQ ID NO: 639715 - RNA, 23 nt, Human
ugugcuugugugugugugugugu

SEQ ID NO: 639716 - RNA, 19 nt, Human
ugugugcaugugugugugu

SEQ ID NO: 639717 - RNA, 19 nt, Human
ugugugcaugugugugugu

SEQ ID NO: 639718 - RNA, 20 nt, Human
ugugugcaugugugugugug

SEQ ID NO: 639719 - RNA, 19 nt, Human
ugugugcuugugugugugu

SEQ ID NO: 639720 - RNA, 23 nt, Human
ugugugcuugugugugugugugu

SEQ ID NO: 639721 - RNA, 18 nt, Human
ugugugugcuugugugug

SEQ ID NO: 639722 - RNA, 21 nt, Human
ugugugugcuugugugugugu

SEQ ID NO: 639723 - RNA, 21 nt, Human
ugugugugcuugugugugugu

SEQ ID NO: 639724 - RNA, 21 nt, Human
ugugugugcuugugugugugu

SEQ ID NO: 639725 - RNA, 26 nt, Human
ugugugugugcuugugugugugugug

SEQ ID NO: 639726 - RNA, 20 nt, Human
ugugugugugugcuugugug

SEQ ID NO: 639727 - RNA, 21 nt, Human
ugugugugugugcuugugugu

SEQ ID NO: 639728 - RNA, 18 nt, Human
ugugugugugugugugug

SEQ ID NO: 639729 - RNA, 21 nt, Human
uguguguguguguguguuuug

SEQ ID NO: 639730 - RNA, 22 nt, Human
uguguguguguguuuuguccuu

SEQ ID NO: 639731 - RNA, 20 nt, Human
uguguguguguuuuguccuu

SEQ ID NO: 639732 - RNA, 27 nt, Human
uguuuuguccucucuagcugaguucua

SEQ ID NO: 639733 - RNA, 18 nt, Human
uucaaugcuauacaaauc

SEQ ID NO: 639734 - RNA, 19 nt, Human
uucaaugcuauacaaaucu

SEQ ID NO: 639735 - RNA, 20 nt, Human
uugugugugugugugugugu

SEQ ID NO: 639736 - RNA, 20 nt, Human
uuuacauuuacauguuauua

SEQ ID NO: 639737 - RNA, 18 nt, Human
uuuuuuuuuuuuuuuuug

SEQ ID NO: 639738 - RNA, 19 nt, Human
aaaaaaaaaaaaaagaaaa

SEQ ID NO: 639739 - RNA, 19 nt, Human
aaaaaaaaaaagaaaaaga

SEQ ID NO: 639740 - RNA, 18 nt, Human
aaacugagugagcugaua

SEQ ID NO: 639741 - RNA, 20 nt, Human
aacauggugaaacccugucu

SEQ ID NO: 639742 - RNA, 21 nt, Human
aacauggugaaacccugucuc

SEQ ID NO: 639743 - RNA, 19 nt, Human
aagaauggguuuuguuguc

SEQ ID NO: 639744 - RNA, 23 nt, Human
aagaauugcuugaacccaggagg

SEQ ID NO: 639745 - RNA, 20 nt, Human
aagcauuucaaaaaaauauu

SEQ ID NO: 639746 - RNA, 24 nt, Human
aaucucccagagagagguagaaau

SEQ ID NO: 639747 - RNA, 18 nt, Human
aauuagccaggcauggug

SEQ ID NO: 639748 - RNA, 20 nt, Human
aauugcuugaacccaggagg

SEQ ID NO: 639749 - RNA, 24 nt, Human
aauugcuugaacccaggaggcgga

SEQ ID NO: 639750 - RNA, 21 nt, Human
acaacauacacagaaguagca

SEQ ID NO: 639751 - RNA, 24 nt, Human
acagugcgagacuuugucucaaaa

SEQ ID NO: 639752 - RNA, 24 nt, Human
acccugucucuacuaaaaauacag

SEQ ID NO: 639753 - RNA, 22 nt, Human
acggcauuaaaaaaaguacauc

SEQ ID NO: 639754 - RNA, 24 nt, Human
acugcgcugcugcaguccagccug

SEQ ID NO: 639755 - RNA, 28 nt, Human
acuuugucucaaaaaaaaaaaaaaaaaa

SEQ ID NO: 639756 - RNA, 21 nt, Human
agaaauauguauuuuuaaaac

SEQ ID NO: 639757 - RNA, 24 nt, Human
agcacuuugggaggccgaggcggg

SEQ ID NO: 639758 - RNA, 23 nt, Human
agccaggcaugguggugugcacc

SEQ ID NO: 639759 - RNA, 22 nt, Human
agccuggccaacauggugaaac

SEQ ID NO: 639760 - RNA, 24 nt, Human
agccuggccaacauggugaaaccc

SEQ ID NO: 639761 - RNA, 23 nt, Human
agccugggagacagugcgagacu

SEQ ID NO: 639762 - RNA, 24 nt, Human
aggcacggugcuccaugccuguaa

SEQ ID NO: 639763 - RNA, 20 nt, Human
aggccgaggcggguagauca

SEQ ID NO: 639764 - RNA, 18 nt, Human
aggcggagguugcaguga

SEQ ID NO: 639765 - RNA, 24 nt, Human
aggcggagguugcagugaucugag

SEQ ID NO: 639766 - RNA, 24 nt, Human
aggcggguagaucaugaggucagg

SEQ ID NO: 639767 - RNA, 24 nt, Human
aggcugagucagaagaauugcuug

SEQ ID NO: 639768 - RNA, 21 nt, Human
auaaugcaaagaacauaauuu

SEQ ID NO: 639769 - RNA, 19 nt, Human
augccuguaaucccagcac

SEQ ID NO: 639770 - RNA, 22 nt, Human
caacauacacagaaguagcaua

SEQ ID NO: 639771 - RNA, 24 nt, Human
caacauggugaaacccugucucua

SEQ ID NO: 639772 - RNA, 20 nt, Human
cacccaucaauauauuucau

SEQ ID NO: 639773 - RNA, 23 nt, Human
caccuguacucccagcuacucgg

SEQ ID NO: 639774 - RNA, 24 nt, Human
caccuguacucccagcuacucggg

SEQ ID NO: 639775 - RNA, 24 nt, Human
cagcacuuugggaggccgaggcgg

SEQ ID NO: 639776 - RNA, 24 nt, Human
caguuuuuaauguacuguuugcau

SEQ ID NO: 639777 - RNA, 20 nt, Human
cauacacaacauacacagaa

SEQ ID NO: 639778 - RNA, 20 nt, Human
cauagcaaaaucuccauauc

SEQ ID NO: 639779 - RNA, 20 nt, Human
caugccuguaaucccagcac

SEQ ID NO: 639780 - RNA, 24 nt, Human
caugccuguaaucccagcacuuug

SEQ ID NO: 639781 - RNA, 21 nt, Human
cauggaccacaugaagauucc

SEQ ID NO: 639782 - RNA, 18 nt, Human
cauuaauaugaaugccug

SEQ ID NO: 639783 - RNA, 22 nt, Human
ccaggaggcggagguugcagug

SEQ ID NO: 639784 - RNA, 19 nt, Human
ccauccauaccucuagccc

SEQ ID NO: 639785 - RNA, 18 nt, Human
ccaugccuguaaucccag

SEQ ID NO: 639786 - RNA, 22 nt, Human
ccaugccuguaaucccagcacu

SEQ ID NO: 639787 - RNA, 23 nt, Human
ccaugccuguaaucccagcacuu

SEQ ID NO: 639788 - RNA, 22 nt, Human
ccuggccaacauggugaaaccc

SEQ ID NO: 639789 - RNA, 24 nt, Human
ccuggccaacauggugaaacccug

SEQ ID NO: 639790 - RNA, 22 nt, Human
ccuguaaucccagcacuuuggg

SEQ ID NO: 639791 - RNA, 21 nt, Human
ccuguacucccagcuacucgg

SEQ ID NO: 639792 - RNA, 24 nt, Human
cgagaccagccuggccaacauggu

SEQ ID NO: 639793 - RNA, 24 nt, Human
cgaggcggguagaucaugagguca

SEQ ID NO: 639794 - RNA, 18 nt, Human
cucaaaaaaaaaaaaaaa

SEQ ID NO: 639795 - RNA, 18 nt, Human
cucaaaaaaaaaaaaaaa

SEQ ID NO: 639796 - RNA, 21 nt, Human
cugcaguccagccugggagac

SEQ ID NO: 639797 - RNA, 23 nt, Human
cugcaguccagccugggagacag

SEQ ID NO: 639798 - RNA, 24 nt, Human
cugcugcaguccagccugggagac

SEQ ID NO: 639799 - RNA, 24 nt, Human
cuggccaacauggugaaacccugu

SEQ ID NO: 639800 - RNA, 21 nt, Human
cuguacucccagcuacucggg

SEQ ID NO: 639801 - RNA, 19 nt, Human
gaaacccugucucuacuaa

SEQ ID NO: 639802 - RNA, 24 nt, Human
gacagugcgagacuuugucucaaa

SEQ ID NO: 639803 - RNA, 26 nt, Human
gaccuuuuuuucuuuugucucuaaga

SEQ ID NO: 639804 - RNA, 24 nt, Human
gagucagaagaauugcuugaaccc

SEQ ID NO: 639805 - RNA, 24 nt, Human
gccaacauggugaaacccugucuc

SEQ ID NO: 639806 - RNA, 22 nt, Human
gccaggcacggugcuccaugcc

SEQ ID NO: 639807 - RNA, 18 nt, Human
gcuaaaggaaauuaacuc

SEQ ID NO: 639808 - RNA, 21 nt, Human
gcuccaugccuguaaucccag

SEQ ID NO: 639809 - RNA, 20 nt, Human
gcugcaguccagccugggag

SEQ ID NO: 639810 - RNA, 24 nt, Human
gcugcaguccagccugggagacag

SEQ ID NO: 639811 - RNA, 18 nt, Human
ggagguugcagugaucug

SEQ ID NO: 639812 - RNA, 22 nt, Human
ggagguugcagugaucugagac

SEQ ID NO: 639813 - RNA, 23 nt, Human
ggcggguagaucaugaggucagg

SEQ ID NO: 639814 - RNA, 23 nt, Human
gguagaucaugaggucaggcguu

SEQ ID NO: 639815 - RNA, 23 nt, Human
ggugcuccaugccuguaauccca

SEQ ID NO: 639816 - RNA, 24 nt, Human
ggugcuccaugccuguaaucccag

SEQ ID NO: 639817 - RNA, 24 nt, Human
guguuauaaugaagaaaauaccag

SEQ ID NO: 639818 - RNA, 22 nt, Human
guugcagaccuuuuuuucuuuu

SEQ ID NO: 639819 - RNA, 21 nt, Human
guugcagugaucugagacugc

SEQ ID NO: 639820 - RNA, 24 nt, Human
uaaaaagcaaacuuugaaagaaaa

SEQ ID NO: 639821 - RNA, 21 nt, Human
uaaaaauacagaaauuagcca

SEQ ID NO: 639822 - RNA, 21 nt, Human
uaaugaagaaaauaccagaaa

SEQ ID NO: 639823 - RNA, 22 nt, Human
uagaaaaacaauuugggaaaca

SEQ ID NO: 639824 - RNA, 18 nt, Human
uagaaauagcuguccaug

SEQ ID NO: 639825 - RNA, 23 nt, Human
uaugauuuuauucugggagcaua

SEQ ID NO: 639826 - RNA, 21 nt, Human
uauggucacccaagcacugcu

SEQ ID NO: 639827 - RNA, 22 nt, Human
ucaaaaaaaaaaaaaaaaaaaa

SEQ ID NO: 639828 - RNA, 25 nt, Human
ucaaaaaaaaaaaaaaaaaaaagaa

SEQ ID NO: 639829 - RNA, 19 nt, Human
ucaaauaccuguguuaaua

SEQ ID NO: 639830 - RNA, 27 nt, Human
ucacccaucaauauauuucauuauuuc

SEQ ID NO: 639831 - RNA, 18 nt, Human
ucagcacagaccaauuug

SEQ ID NO: 639832 - RNA, 23 nt, Human
ucagcacagaccaauuugaauaa

SEQ ID NO: 639833 - RNA, 25 nt, Human
ucagcucauauuugaccuugcucca

SEQ ID NO: 639834 - RNA, 24 nt, Human
ucaugaggucaggcguucgagacc

SEQ ID NO: 639835 - RNA, 23 nt, Human
ucgggaggcugagucagaagaau

SEQ ID NO: 639836 - RNA, 19 nt, Human
ucucaaaaaaaaaaaaaaa

SEQ ID NO: 639837 - RNA, 23 nt, Human
ucucuacuaaaaauacagaaauu

SEQ ID NO: 639838 - RNA, 21 nt, Human
ucuucuguaaauacuugugaa

SEQ ID NO: 639839 - RNA, 21 nt, Human
ugaacauacacagaaauagca

SEQ ID NO: 639840 - RNA, 18 nt, Human
ugacguagaucuauuuua

SEQ ID NO: 639841 - RNA, 27 nt, Human
ugacuuccauauauuaauaaauccuuu

SEQ ID NO: 639842 - RNA, 24 nt, Human
ugagucagaagaauugcuugaacc

SEQ ID NO: 639843 - RNA, 26 nt, Human
ugagucagaagaauugcuugaaccca

SEQ ID NO: 639844 - RNA, 19 nt, Human
ugcaccuguacucccagcu

SEQ ID NO: 639845 - RNA, 23 nt, Human
ugccuguaaucccagcacuuugg

SEQ ID NO: 639846 - RNA, 19 nt, Human
ugcuaugaaauuuuaaggg

SEQ ID NO: 639847 - RNA, 23 nt, Human
ugcuccauccauaccucuagcca

SEQ ID NO: 639848 - RNA, 24 nt, Human
ugcuccauccauaccucuagccac

SEQ ID NO: 639849 - RNA, 24 nt, Human
ugcuccaugccuguaaucccagca

SEQ ID NO: 639850 - RNA, 26 nt, Human
ugcugcaguccagccugggagacagu

SEQ ID NO: 639851 - RNA, 18 nt, Human
uggaagccaguaugacau

SEQ ID NO: 639852 - RNA, 20 nt, Human
uggaccacaugaagauucuu

SEQ ID NO: 639853 - RNA, 24 nt, Human
uggccaacauggugaaacccuguc

SEQ ID NO: 639854 - RNA, 20 nt, Human
ugggaggccgaggcggguag

SEQ ID NO: 639855 - RNA, 24 nt, Human
ugggaggccgaggcggguagauca

SEQ ID NO: 639856 - RNA, 22 nt, Human
uggugugcaccuguacucccag

SEQ ID NO: 639857 - RNA, 22 nt, Human
ugucaaguaaguucgagaaauu

SEQ ID NO: 639858 - RNA, 23 nt, Human
ugucacauagcaaaaucuccaua

SEQ ID NO: 639859 - RNA, 21 nt, Human
uuagccucuuuuuucuaagga

SEQ ID NO: 639860 - RNA, 18 nt, Human
uucgagaccagccuggcc

SEQ ID NO: 639861 - RNA, 24 nt, Human
uugaacccaggaggcggagguugc

SEQ ID NO: 639862 - RNA, 19 nt, Human
uugcagugaucugagacug

SEQ ID NO: 639863 - RNA, 22 nt, Human
uugcagugaucugagacugcgc

SEQ ID NO: 639864 - RNA, 24 nt, Human
uugcuugaacccaggaggcggagg

SEQ ID NO: 639865 - RNA, 25 nt, Human
uugggaggccgaggcggguagauca

SEQ ID NO: 639866 - RNA, 21 nt, Human
uugucauuaauaugaaugccu

SEQ ID NO: 639867 - RNA, 19 nt, Human
uuuaaauugcuaugaaauu

SEQ ID NO: 639868 - RNA, 19 nt, Human
uuuguugucaaguaaguuc

SEQ ID NO: 639869 - RNA, 23 nt, Human
uuuuauuucuuuacugauugaaa

SEQ ID NO: 639870 - RNA, 21 nt, Human
aaguagaaaauaaaugcaggg

SEQ ID NO: 639871 - RNA, 31 nt, Human
acccuacaauugauaaaucuuauaccauuuu

SEQ ID NO: 639872 - RNA, 25 nt, Human
caauugauaaaucuuauaccauuuu

SEQ ID NO: 639873 - RNA, 23 nt, Human
cauguuaauuaaauggugguccu

SEQ ID NO: 639874 - RNA, 18 nt, Human
cugcuccgcccugggauc

SEQ ID NO: 639875 - RNA, 27 nt, Human
gacuuugugacacacacaucaucaguc

SEQ ID NO: 639876 - RNA, 18 nt, Human
gcccugggaucgcuggac

SEQ ID NO: 639877 - RNA, 22 nt, Human
uaagaaaaaaaaucaguauuca

SEQ ID NO: 639878 - RNA, 24 nt, Human
uagaaauacuaagaaaaaaaauca

SEQ ID NO: 639879 - RNA, 24 nt, Human
uucuucucugacaacuuuuuauug

SEQ ID NO: 639880 - RNA, 24 nt, Human
uuuauuguaugagcaacccaaacu

SEQ ID NO: 639881 - RNA, 21 nt, Human
aaaaaaaagacaaaauguaga

SEQ ID NO: 639882 - RNA, 23 nt, Human
aaaaaccagccaacccauauggu

SEQ ID NO: 639883 - RNA, 23 nt, Human
aaaacgccucgggaagcaccuuc

SEQ ID NO: 639884 - RNA, 20 nt, Human
aaaagcagcaaaaucuuccu

SEQ ID NO: 639885 - RNA, 22 nt, Human
aaaauuauuucccuccccacuu

SEQ ID NO: 639886 - RNA, 23 nt, Human
aaacuacuaacauaguccaccua

SEQ ID NO: 639887 - RNA, 19 nt, Human
aagggagaggcaggagggc

SEQ ID NO: 639888 - RNA, 22 nt, Human
acagauacaaacgauguaacca

SEQ ID NO: 639889 - RNA, 23 nt, Human
acagcaacaaaacaaaacauaaa

SEQ ID NO: 639890 - RNA, 24 nt, Human
acauaacaggagaacugaaaaaaa

SEQ ID NO: 639891 - RNA, 22 nt, Human
agacaaaauguagagggacccc

SEQ ID NO: 639892 - RNA, 22 nt, Human
agagaugggucuguuuucuuca

SEQ ID NO: 639893 - RNA, 22 nt, Human
agcagggugcacucaaacaaaa

SEQ ID NO: 639894 - RNA, 20 nt, Human
agcuguccacuaggccaaca

SEQ ID NO: 639895 - RNA, 24 nt, Human
aggaaggaaguauaagugaguugg

SEQ ID NO: 639896 - RNA, 22 nt, Human
aggcaaaagcagcaaaaucuuc

SEQ ID NO: 639897 - RNA, 22 nt, Human
auuuauuaaaagccagaggugc

SEQ ID NO: 639898 - RNA, 22 nt, Human
caaaacauaaacauaauguuaa

SEQ ID NO: 639899 - RNA, 21 nt, Human
caaaagcagcaaaaucuuccu

SEQ ID NO: 639900 - RNA, 23 nt, Human
caaaagcagcaaaaucuuccuca

SEQ ID NO: 639901 - RNA, 21 nt, Human
caaccagaacauaacaggaga

SEQ ID NO: 639902 - RNA, 28 nt, Human
caagcaagcggcgccgugcuguaaugac

SEQ ID NO: 639903 - RNA, 22 nt, Human
caagcggcgccgugcccucccc

SEQ ID NO: 639904 - RNA, 18 nt, Human
caccaggcacagcugucc

SEQ ID NO: 639905 - RNA, 19 nt, Human
caccucugaccagcagggu

SEQ ID NO: 639906 - RNA, 22 nt, Human
cauaacaggagaacugaaaaaa

SEQ ID NO: 639907 - RNA, 22 nt, Human
ccaacccauaugguaaauaguu

SEQ ID NO: 639908 - RNA, 21 nt, Human
ccagccaacccauaugguaaa

SEQ ID NO: 639909 - RNA, 27 nt, Human
ccagccaacccauaugguaaauaguua

SEQ ID NO: 639910 - RNA, 19 nt, Human
ccgcgcgccuggcucugcc

SEQ ID NO: 639911 - RNA, 23 nt, Human
ccgggccgcgccaagcucccggg

SEQ ID NO: 639912 - RNA, 19 nt, Human
ccucagagagucaagguca

SEQ ID NO: 639913 - RNA, 25 nt, Human
ccuccccacuuuccugagcuggaga

SEQ ID NO: 639914 - RNA, 18 nt, Human
ccucgggaagcaccuucu

SEQ ID NO: 639915 - RNA, 23 nt, Human
cgcgccuggcucugccccggcuc

SEQ ID NO: 639916 - RNA, 22 nt, Human
cgugcccuccccugcacccucc

SEQ ID NO: 639917 - RNA, 23 nt, Human
cucgucccggcuucuagguccgg

SEQ ID NO: 639918 - RNA, 19 nt, Human
cuugguuaaaggaauuuac

SEQ ID NO: 639919 - RNA, 20 nt, Human
gaaaacuacuaacauagucc

SEQ ID NO: 639920 - RNA, 23 nt, Human
gagaggcaggagggcgggaagga

SEQ ID NO: 639921 - RNA, 19 nt, Human
gauggcccaagcaaucugg

SEQ ID NO: 639922 - RNA, 25 nt, Human
gcaaaaucuuccucagagagucaag

SEQ ID NO: 639923 - RNA, 21 nt, Human
gcaaaggauaaaaacauacaa

SEQ ID NO: 639924 - RNA, 21 nt, Human
gcaggccaagcaagcggcgcc

SEQ ID NO: 639925 - RNA, 23 nt, Human
gccaagcucccggggccgcggac

SEQ ID NO: 639926 - RNA, 21 nt, Human
gcgccuggcucugccccggcu

SEQ ID NO: 639927 - RNA, 21 nt, Human
gcgggaaggacuaaaaaggca

SEQ ID NO: 639928 - RNA, 18 nt, Human
ggaaacaugagguauucc

SEQ ID NO: 639929 - RNA, 21 nt, Human
ggacuaaaaaggcacagggug

SEQ ID NO: 639930 - RNA, 21 nt, Human
gguggaguguuugcugacgcc

SEQ ID NO: 639931 - RNA, 18 nt, Human
guuaagagggguguaagg

SEQ ID NO: 639932 - RNA, 22 nt, Human
uaaaaagcauaguuaagucuug

SEQ ID NO: 639933 - RNA, 27 nt, Human
uaaaagccagaggugcaccaggcacag

SEQ ID NO: 639934 - RNA, 26 nt, Human
uaacaggagaacugaaaaaaaaaaga

SEQ ID NO: 639935 - RNA, 21 nt, Human
uaagggagaggcaggagggcg

SEQ ID NO: 639936 - RNA, 20 nt, Human
uagguccgggugcgcaggcc

SEQ ID NO: 639937 - RNA, 23 nt, Human
uccgauggcccaagcaaucuggu

SEQ ID NO: 639938 - RNA, 21 nt, Human
ugacaaaacacaguguuagca

SEQ ID NO: 639939 - RNA, 19 nt, Human
ugagaaauuaagacacaca

SEQ ID NO: 639940 - RNA, 18 nt, Human
ugaguugguaguaguaga

SEQ ID NO: 639941 - RNA, 18 nt, Human
ugauauucuugccaaaaa

SEQ ID NO: 639942 - RNA, 18 nt, Human
ugauuaucaaaugcauug

SEQ ID NO: 639943 - RNA, 24 nt, Human
ugcacaagaaccaaaauuauuucc

SEQ ID NO: 639944 - RNA, 23 nt, Human
ugcagauagaaacagaauauccu

SEQ ID NO: 639945 - RNA, 21 nt, Human
ugccccggcucgucccggcuu

SEQ ID NO: 639946 - RNA, 22 nt, Human
uggaaaaagaguuaaaaagcau

SEQ ID NO: 639947 - RNA, 24 nt, Human
ugguaaauaguuagcaaaccacca

SEQ ID NO: 639948 - RNA, 23 nt, Human
uguuucaaccaaugaguauuuau

SEQ ID NO: 639949 - RNA, 26 nt, Human
uuaaaaagcauaguuaagucuugguu

SEQ ID NO: 639950 - RNA, 19 nt, Human
uuauccaagagaguguguu

SEQ ID NO: 639951 - RNA, 22 nt, Human
uucaccuugcuugauauucuug

SEQ ID NO: 639952 - RNA, 23 nt, Human
uucaugcugaaagggauuuuagc

SEQ ID NO: 639953 - RNA, 28 nt, Human
uucgcugggcccuuccugagaccuccaa

SEQ ID NO: 639954 - RNA, 20 nt, Human
uugaaugcugaauacagaca

SEQ ID NO: 639955 - RNA, 21 nt, Human
uugaaugcugaauacagacau

SEQ ID NO: 639956 - RNA, 22 nt, Human
uugaaugcugaauacagacauc

SEQ ID NO: 639957 - RNA, 21 nt, Human
uuugaaaugauuacuugggag

SEQ ID NO: 639958 - RNA, 18 nt, Human
uuuuuuuuuuuuuuuuug

SEQ ID NO: 639959 - RNA, 22 nt, Human
aaaaaaaaaaaaaaaagaaaaa

SEQ ID NO: 639960 - RNA, 31 nt, Human
aaaaaaaaaaaaacaaaaaaaaacaaaaaag

SEQ ID NO: 639961 - RNA, 19 nt, Human
aaaaaaaaaaagaaaaaga

SEQ ID NO: 639962 - RNA, 22 nt, Human
aaaaaaaaaagaaaaagaaaag

SEQ ID NO: 639963 - RNA, 24 nt, Human
aaaaaaaaacaaaaaaaaacaaaa

SEQ ID NO: 639964 - RNA, 20 nt, Human
aaaaauuccaagauuccgcc

SEQ ID NO: 639965 - RNA, 18 nt, Human
aaaacuaaaaacaccugu

SEQ ID NO: 639966 - RNA, 22 nt, Human
aaaagaaaaagaaaagcuuucc

SEQ ID NO: 639967 - RNA, 22 nt, Human
aaaagcccugcacccacaaagg

SEQ ID NO: 639968 - RNA, 21 nt, Human
aaaauccaagauucccaccuc

SEQ ID NO: 639969 - RNA, 23 nt, Human
aaacaaaaaauccaagauuccca

SEQ ID NO: 639970 - RNA, 18 nt, Human
aaacagaugcagccuaca

SEQ ID NO: 639971 - RNA, 23 nt, Human
aaaccugcaucuuuucgcuucag

SEQ ID NO: 639972 - RNA, 20 nt, Human
aaacgaagccacccccgaac

SEQ ID NO: 639973 - RNA, 19 nt, Human
aaacugaaacugaaggcca

SEQ ID NO: 639974 - RNA, 22 nt, Human
aaacuggcuccuaccaccuaac

SEQ ID NO: 639975 - RNA, 24 nt, Human
aaacuggcuccuaccaccuaacag

SEQ ID NO: 639976 - RNA, 20 nt, Human
aaagaaaagcuuuccuggug

SEQ ID NO: 639977 - RNA, 19 nt, Human
aacaccuguuuauucugcc

SEQ ID NO: 639978 - RNA, 19 nt, Human
aacauggugaaaccccauc

SEQ ID NO: 639979 - RNA, 20 nt, Human
aacauggugaaaccccaucu

SEQ ID NO: 639980 - RNA, 20 nt, Human
aacauggugaaaccccaucu

SEQ ID NO: 639981 - RNA, 21 nt, Human
aacauggugaaaccccaucuc

SEQ ID NO: 639982 - RNA, 24 nt, Human
aaccacuugaacccaggaagcgga

SEQ ID NO: 639983 - RNA, 19 nt, Human
aacgaagccacccccgaac

SEQ ID NO: 639984 - RNA, 23 nt, Human
aagaaaacagaagagaaguuuca

SEQ ID NO: 639985 - RNA, 24 nt, Human
aagcggaguuugcagugagccgag

SEQ ID NO: 639986 - RNA, 26 nt, Human
aagcuugcucgccagggcacaccgcc

SEQ ID NO: 639987 - RNA, 21 nt, Human
aaguccaagaacuaaagcuga

SEQ ID NO: 639988 - RNA, 18 nt, Human
aauggccucacaggaggg

SEQ ID NO: 639989 - RNA, 28 nt, Human
acaaaugaacacaccguguugcaaugaa

SEQ ID NO: 639990 - RNA, 25 nt, Human
acaagucaacaggaccagcacgaaa

SEQ ID NO: 639991 - RNA, 30 nt, Human
acacagcucucaccuggacucagaaagccc

SEQ ID NO: 639992 - RNA, 19 nt, Human
acacaggccacacacagag

SEQ ID NO: 639993 - RNA, 20 nt, Human
acaccacugcacgccagccu

SEQ ID NO: 639994 - RNA, 22 nt, Human
acacugaaaaaaguccccuaga

SEQ ID NO: 639995 - RNA, 24 nt, Human
acagagugggagagugggggaggg

SEQ ID NO: 639996 - RNA, 21 nt, Human
acagccaaagaaaacagaaga

SEQ ID NO: 639997 - RNA, 24 nt, Human
accacggaggcgacaggugcuuug

SEQ ID NO: 639998 - RNA, 24 nt, Human
accccaucucuacuaaaaauacaa

SEQ ID NO: 639999 - RNA, 23 nt, Human
acccgggcagcagaguacagucc

SEQ ID NO: 640000 - RNA, 19 nt, Human
acccuccccagggccuggg

SEQ ID NO: 640001 - RNA, 21 nt, Human
acccuggugggugaugggaug

SEQ ID NO: 640002 - RNA, 23 nt, Human
accucaaaaaaaaaaaaacaaaa

SEQ ID NO: 640003 - RNA, 18 nt, Human
accuggacucagaaagcc

SEQ ID NO: 640004 - RNA, 18 nt, Human
acgccacgaugccugcug

SEQ ID NO: 640005 - RNA, 18 nt, Human
acgggaggcgccugcagg

SEQ ID NO: 640006 - RNA, 18 nt, Human
acugcacgccagccuggg

SEQ ID NO: 640007 - RNA, 24 nt, Human
acuggcucaugccuguaaucccag

SEQ ID NO: 640008 - RNA, 19 nt, Human
acuggcugaggugggggag

SEQ ID NO: 640009 - RNA, 26 nt, Human
acuucaccucaaaaaaaaaaaaacaa

SEQ ID NO: 640010 - RNA, 24 nt, Human
acuugaggucaggaguuugagacc

SEQ ID NO: 640011 - RNA, 21 nt, Human
agaaagcccccagcaggagag

SEQ ID NO: 640012 - RNA, 20 nt, Human
agaacacucucaaccuccuc

SEQ ID NO: 640013 - RNA, 19 nt, Human
agagagaaugaggcuggag

SEQ ID NO: 640014 - RNA, 19 nt, Human
agagcccagccacgcacug

SEQ ID NO: 640015 - RNA, 22 nt, Human
agaucacuugaggucaggaguu

SEQ ID NO: 640016 - RNA, 25 nt, Human
agaucacuugaggucaggaguuuga

SEQ ID NO: 640017 - RNA, 21 nt, Human
agauucccaccuccuuccacc

SEQ ID NO: 640018 - RNA, 18 nt, Human
agcaggcagucuggggag

SEQ ID NO: 640019 - RNA, 20 nt, Human
agcccugcacccacaaaggc

SEQ ID NO: 640020 - RNA, 23 nt, Human
agccugggugucagagcgagacu

SEQ ID NO: 640021 - RNA, 23 nt, Human
agcugagcgugguggcgcaugcc

SEQ ID NO: 640022 - RNA, 22 nt, Human
agcuuggccaacauggugaaac

SEQ ID NO: 640023 - RNA, 24 nt, Human
agcuuggccaacauggugaaaccc

SEQ ID NO: 640024 - RNA, 23 nt, Human
aggaaacauucugcucugagaac

SEQ ID NO: 640025 - RNA, 18 nt, Human
aggaaggacaaggaaaag

SEQ ID NO: 640026 - RNA, 23 nt, Human
aggaguuugagaccagcuuggcc

SEQ ID NO: 640027 - RNA, 24 nt, Human
aggcaggaacacacgacaggccca

SEQ ID NO: 640028 - RNA, 21 nt, Human
aggcaggaggugugcggcugg

SEQ ID NO: 640029 - RNA, 22 nt, Human
aggcaggcgauccacagggagg

SEQ ID NO: 640030 - RNA, 21 nt, Human
aggcaggcggcaggggagaga

SEQ ID NO: 640031 - RNA, 18 nt, Human
aggcagucuggggagggg

SEQ ID NO: 640032 - RNA, 18 nt, Human
aggccacacacagagccc

SEQ ID NO: 640033 - RNA, 18 nt, Human
aggcccagcucugcccag

SEQ ID NO: 640034 - RNA, 21 nt, Human
aggcccagcucugcccagggg

SEQ ID NO: 640035 - RNA, 22 nt, Human
aggcggcguggaaggaaaaggc

SEQ ID NO: 640036 - RNA, 22 nt, Human
aggcgggcagaucacuugaggu

SEQ ID NO: 640037 - RNA, 23 nt, Human
aggcgggcagaucacuugagguc

SEQ ID NO: 640038 - RNA, 26 nt, Human
aggcgggcagaucacuugaggucagg

SEQ ID NO: 640039 - RNA, 21 nt, Human
aggcuccggacacagccaucc

SEQ ID NO: 640040 - RNA, 22 nt, Human
aggcugacaauuuccacaaaag

SEQ ID NO: 640041 - RNA, 24 nt, Human
aggcuggggcaggagaaccacuug

SEQ ID NO: 640042 - RNA, 21 nt, Human
agggaccaguggcucugggcu

SEQ ID NO: 640043 - RNA, 22 nt, Human
agggagaaguuugaaaaacugg

SEQ ID NO: 640044 - RNA, 22 nt, Human
agugagaggcggcguggaagga

SEQ ID NO: 640045 - RNA, 21 nt, Human
agugggggagggggugggggu

SEQ ID NO: 640046 - RNA, 18 nt, Human
auacagccaaagaaaaca

SEQ ID NO: 640047 - RNA, 24 nt, Human
aucacaccacugcacgccagccug

SEQ ID NO: 640048 - RNA, 20 nt, Human
aucacuugaggucaggaguu

SEQ ID NO: 640049 - RNA, 21 nt, Human
auccagaaggucaccacacac

SEQ ID NO: 640050 - RNA, 18 nt, Human
aucuauaccaccuucccu

SEQ ID NO: 640051 - RNA, 19 nt, Human
augccuguaaucccagcac

SEQ ID NO: 640052 - RNA, 26 nt, Human
caaaagcccugcacccacaaaggcac

SEQ ID NO: 640053 - RNA, 23 nt, Human
caaacauccacauggcacaagca

SEQ ID NO: 640054 - RNA, 22 nt, Human
caaacgaagccacccccgaacc

SEQ ID NO: 640055 - RNA, 22 nt, Human
caaacuggcuccuaccaccuaa

SEQ ID NO: 640056 - RNA, 25 nt, Human
caaagaacgcacuccuggcaagcga

SEQ ID NO: 640057 - RNA, 18 nt, Human
caaaggcaccaucugcuc

SEQ ID NO: 640058 - RNA, 26 nt, Human
caaaggcaccaucugcucucagaaac

SEQ ID NO: 640059 - RNA, 27 nt, Human
caaaugaacacaccguguugcaaugaa

SEQ ID NO: 640060 - RNA, 24 nt, Human
caacauggugaaaccccaucucua

SEQ ID NO: 640061 - RNA, 23 nt, Human
cacaaacauccacauggcacaag

SEQ ID NO: 640062 - RNA, 22 nt, Human
cacacaaacuggcuccuaccac

SEQ ID NO: 640063 - RNA, 18 nt, Human
cacacacagagcccagcc

SEQ ID NO: 640064 - RNA, 19 nt, Human
cacacaccuggcacccucc

SEQ ID NO: 640065 - RNA, 24 nt, Human
cacacagcucucaccuggacucag

SEQ ID NO: 640066 - RNA, 21 nt, Human
cacaccacugcacgccagccu

SEQ ID NO: 640067 - RNA, 23 nt, Human
cacacugaaaaaaguccccuaga

SEQ ID NO: 640068 - RNA, 21 nt, Human
cacagagcccagccacgcacu

SEQ ID NO: 640069 - RNA, 21 nt, Human
caccacacaccuggcacccuc

SEQ ID NO: 640070 - RNA, 22 nt, Human
caccacacaccuggcacccucc

SEQ ID NO: 640071 - RNA, 24 nt, Human
cacccguguccucggagccaggaa

SEQ ID NO: 640072 - RNA, 21 nt, Human
caccgugcaccuacugugggc

SEQ ID NO: 640073 - RNA, 21 nt, Human
caccucaaaaaaaaaaaaaca

SEQ ID NO: 640074 - RNA, 25 nt, Human
caccucaaaaaaaaaaaaacaaaaa

SEQ ID NO: 640075 - RNA, 27 nt, Human
caccuggacucagaaagccggggguuc

SEQ ID NO: 640076 - RNA, 21 nt, Human
caccuggcacccuccaagggc

SEQ ID NO: 640077 - RNA, 23 nt, Human
cacgccagccugggugucagagc

SEQ ID NO: 640078 - RNA, 20 nt, Human
cacugcacgccagccugggu

SEQ ID NO: 640079 - RNA, 24 nt, Human
cacugcacgccagccuggguguca

SEQ ID NO: 640080 - RNA, 24 nt, Human
cacugccaaugcccaagguuaccu

SEQ ID NO: 640081 - RNA, 23 nt, Human
cacugcguucucaugcuggguuu

SEQ ID NO: 640082 - RNA, 23 nt, Human
cacugcguucucaugcuggguuu

SEQ ID NO: 640083 - RNA, 25 nt, Human
cacugcguucucaugcuggguuuuu

SEQ ID NO: 640084 - RNA, 23 nt, Human
cacuugaggucaggaguuugaga

SEQ ID NO: 640085 - RNA, 24 nt, Human
cagaacgaacagagugggagagug

SEQ ID NO: 640086 - RNA, 25 nt, Human
cagaaggucaccacacaccuggcac

SEQ ID NO: 640087 - RNA, 21 nt, Human
cagaaucgaaagaaaaauucc

SEQ ID NO: 640088 - RNA, 21 nt, Human
cagagcccagccacgcacugu

SEQ ID NO: 640089 - RNA, 23 nt, Human
cagagcgagacuucaccucaaaa

SEQ ID NO: 640090 - RNA, 19 nt, Human
cagaggccgcacucccuca

SEQ ID NO: 640091 - RNA, 24 nt, Human
cagaucacuugaggucaggaguuu

SEQ ID NO: 640092 - RNA, 21 nt, Human
cagaugcacauaauaaccuug

SEQ ID NO: 640093 - RNA, 22 nt, Human
cagcacgaaacagaugcagccu

SEQ ID NO: 640094 - RNA, 24 nt, Human
cagcacucugggaggccgaggcgg

SEQ ID NO: 640095 - RNA, 18 nt, Human
cagcauccaucugagugc

SEQ ID NO: 640096 - RNA, 21 nt, Human
cagccucugaaacgagcucaa

SEQ ID NO: 640097 - RNA, 24 nt, Human
cagcuacuugggaggcuggggcag

SEQ ID NO: 640098 - RNA, 24 nt, Human
cagcuuggccaacauggugaaacc

SEQ ID NO: 640099 - RNA, 23 nt, Human
caggaccagcacgaaacagaugc

SEQ ID NO: 640100 - RNA, 19 nt, Human
caggagacacacaugcgac

SEQ ID NO: 640101 - RNA, 22 nt, Human
caggagagacgaacaugcccgg

SEQ ID NO: 640102 - RNA, 22 nt, Human
cagggcacaccgcccguaacac

SEQ ID NO: 640103 - RNA, 19 nt, Human
cagggcauuuuucaacaaa

SEQ ID NO: 640104 - RNA, 21 nt, Human
cagugggaaaacuaaaaacac

SEQ ID NO: 640105 - RNA, 20 nt, Human
caugccuguaaucccagcac

SEQ ID NO: 640106 - RNA, 24 nt, Human
caugccuguaaucccagcacucug

SEQ ID NO: 640107 - RNA, 22 nt, Human
cauggacacugcugccccgaca

SEQ ID NO: 640108 - RNA, 20 nt, Human
cauucugcucugagaacaaa

SEQ ID NO: 640109 - RNA, 18 nt, Human
ccaagauucccaccuccu

SEQ ID NO: 640110 - RNA, 21 nt, Human
ccacgcuccaggcuucccugg

SEQ ID NO: 640111 - RNA, 19 nt, Human
ccacggaggcgacaggugc

SEQ ID NO: 640112 - RNA, 20 nt, Human
ccacugcacgccagccuggg

SEQ ID NO: 640113 - RNA, 20 nt, Human
ccacugcacgccagccuggg

SEQ ID NO: 640114 - RNA, 20 nt, Human
ccacugcacgccagccuggg

SEQ ID NO: 640115 - RNA, 22 nt, Human
ccacugcacgccagccugggug

SEQ ID NO: 640116 - RNA, 20 nt, Human
ccagaaggucaccacacacc

SEQ ID NO: 640117 - RNA, 23 nt, Human
ccagaaucgaaagaaaaauucca

SEQ ID NO: 640118 - RNA, 20 nt, Human
ccagacccgccaggccacgc

SEQ ID NO: 640119 - RNA, 20 nt, Human
ccaggcuucccuggcuuagg

SEQ ID NO: 640120 - RNA, 23 nt, Human
ccagucaucuaaacuuacucauu

SEQ ID NO: 640121 - RNA, 18 nt, Human
ccauugguccaguuuugc

SEQ ID NO: 640122 - RNA, 19 nt, Human
cccacagccacccucccca

SEQ ID NO: 640123 - RNA, 20 nt, Human
cccacagccacccuccccag

SEQ ID NO: 640124 - RNA, 23 nt, Human
cccacagccacccuccccagggc

SEQ ID NO: 640125 - RNA, 18 nt, Human
ccccaggggcuuuggccu

SEQ ID NO: 640126 - RNA, 24 nt, Human
ccccaggggcuuuggccucuuacc

SEQ ID NO: 640127 - RNA, 19 nt, Human
ccccaugcuauacgugcuc

SEQ ID NO: 640128 - RNA, 18 nt, Human
cccgcaaucugagggcca

SEQ ID NO: 640129 - RNA, 19 nt, Human
cccgcaaucugagggccau

SEQ ID NO: 640130 - RNA, 23 nt, Human
cccguaacacccacugcaggggc

SEQ ID NO: 640131 - RNA, 20 nt, Human
cccugcucugggcccaggcc

SEQ ID NO: 640132 - RNA, 18 nt, Human
ccgaagagcugagcucca

SEQ ID NO: 640133 - RNA, 24 nt, Human
ccgcacucccucagcagggggacc

SEQ ID NO: 640134 - RNA, 22 nt, Human
ccgccaggcuccggacacagcc

SEQ ID NO: 640135 - RNA, 20 nt, Human
ccggcgggcagaguggcauc

SEQ ID NO: 640136 - RNA, 23 nt, Human
ccguaacacccacugcaggggca

SEQ ID NO: 640137 - RNA, 26 nt, Human
ccucaaaaaaaaaaaaacaaaaaaaa

SEQ ID NO: 640138 - RNA, 27 nt, Human
ccucaaaaaaaaaaaaacaaaaaaaaa

SEQ ID NO: 640139 - RNA, 22 nt, Human
ccucccacagccacccucccca

SEQ ID NO: 640140 - RNA, 19 nt, Human
ccuccggcgggcagagugg

SEQ ID NO: 640141 - RNA, 20 nt, Human
ccugcagauggccagcaccu

SEQ ID NO: 640142 - RNA, 22 nt, Human
ccugcaucuuuucgcuucaggg

SEQ ID NO: 640143 - RNA, 18 nt, Human
ccuggcccuggcucuggu

SEQ ID NO: 640144 - RNA, 23 nt, Human
ccuggcccuggcucuggucuggc

SEQ ID NO: 640145 - RNA, 21 nt, Human
ccugggugucagagcgagacu

SEQ ID NO: 640146 - RNA, 21 nt, Human
ccugguucggcugauacagcc

SEQ ID NO: 640147 - RNA, 18 nt, Human
ccuguaaucccagcacuc

SEQ ID NO: 640148 - RNA, 22 nt, Human
ccuguaaucccagcacucuggg

SEQ ID NO: 640149 - RNA, 19 nt, Human
ccuguaaucccagcuacuu

SEQ ID NO: 640150 - RNA, 21 nt, Human
ccuguaaucccagcuacuugg

SEQ ID NO: 640151 - RNA, 18 nt, Human
cgacaggagacacacaug

SEQ ID NO: 640152 - RNA, 22 nt, Human
cgacaggugcuuugaugccucc

SEQ ID NO: 640153 - RNA, 23 nt, Human
cgagaucacaccacugcacgcca

SEQ ID NO: 640154 - RNA, 24 nt, Human
cgaggcgggcagaucacuugaggu

SEQ ID NO: 640155 - RNA, 26 nt, Human
cgaggcgggcagaucacuugagguca

SEQ ID NO: 640156 - RNA, 22 nt, Human
cgcacuccuggcaagcgagucu

SEQ ID NO: 640157 - RNA, 19 nt, Human
cgcagcccaggccucuccu

SEQ ID NO: 640158 - RNA, 20 nt, Human
cgcccguaacacccacugca

SEQ ID NO: 640159 - RNA, 22 nt, Human
cggaguggggacgguguccacc

SEQ ID NO: 640160 - RNA, 24 nt, Human
cgggcagaucacuugaggucagga

SEQ ID NO: 640161 - RNA, 21 nt, Human
cgggcaguggacuuggccucc

SEQ ID NO: 640162 - RNA, 25 nt, Human
cucaaaaaaaaaaaaacaaaaaaaa

SEQ ID NO: 640163 - RNA, 26 nt, Human
cucaaaaaaaaaaaaacaaaaaaaaa

SEQ ID NO: 640164 - RNA, 24 nt, Human
cucagacagugggaaaacuaaaaa

SEQ ID NO: 640165 - RNA, 22 nt, Human
cucagguauccuccccugugcu

SEQ ID NO: 640166 - RNA, 23 nt, Human
cucaugccuguaaucccagcacu

SEQ ID NO: 640167 - RNA, 23 nt, Human
cuccaguuccccugcucugggcc

SEQ ID NO: 640168 - RNA, 23 nt, Human
cuccugguucggcugauacagcc

SEQ ID NO: 640169 - RNA, 18 nt, Human
cucgugaagacauucaga

SEQ ID NO: 640170 - RNA, 22 nt, Human
cucuaacgagcuuaagaacagg

SEQ ID NO: 640171 - RNA, 26 nt, Human
cugacucacuggcugaggugggggag

SEQ ID NO: 640172 - RNA, 20 nt, Human
cugaugcacgcucgugaaga

SEQ ID NO: 640173 - RNA, 24 nt, Human
cugcacccacaaaggcaccaucug

SEQ ID NO: 640174 - RNA, 18 nt, Human
cugcguucucaugcuggg

SEQ ID NO: 640175 - RNA, 19 nt, Human
cuuccuggaugagaaacug

SEQ ID NO: 640176 - RNA, 23 nt, Human
cuucuugggggccccaugggccc

SEQ ID NO: 640177 - RNA, 20 nt, Human
cuugcagaggccgcacuccc

SEQ ID NO: 640178 - RNA, 23 nt, Human
cuuggccaacauggugaaacccc

SEQ ID NO: 640179 - RNA, 18 nt, Human
cuuggcucagacaguggg

SEQ ID NO: 640180 - RNA, 23 nt, Human
gaaaaaaguccccuagaaggaug

SEQ ID NO: 640181 - RNA, 20 nt, Human
gaaaacuaaaaacaccuguu

SEQ ID NO: 640182 - RNA, 19 nt, Human
gaaaagagcuccagcugcc

SEQ ID NO: 640183 - RNA, 18 nt, Human
gaaaaggcucagcaggca

SEQ ID NO: 640184 - RNA, 18 nt, Human
gaagguggacgggcagag

SEQ ID NO: 640185 - RNA, 20 nt, Human
gacacagccauccuccuucc

SEQ ID NO: 640186 - RNA, 21 nt, Human
gacagugggaaaacuaaaaac

SEQ ID NO: 640187 - RNA, 21 nt, Human
gacuguuaccccaggggcuuu

SEQ ID NO: 640188 - RNA, 24 nt, Human
gagcgugguggcgcaugccuguaa

SEQ ID NO: 640189 - RNA, 19 nt, Human
gaggcuggggcaggagaac

SEQ ID NO: 640190 - RNA, 21 nt, Human
gaggggaugccggacucugcc

SEQ ID NO: 640191 - RNA, 21 nt, Human
gaguacaguccagccacacag

SEQ ID NO: 640192 - RNA, 19 nt, Human
gagugggggaggggguggg

SEQ ID NO: 640193 - RNA, 22 nt, Human
gagugggggagggggugggggu

SEQ ID NO: 640194 - RNA, 22 nt, Human
gaguuugcagugagccgagauc

SEQ ID NO: 640195 - RNA, 24 nt, Human
gaucacuugaggucaggaguuuga

SEQ ID NO: 640196 - RNA, 19 nt, Human
gcagaguggggagcugcuc

SEQ ID NO: 640197 - RNA, 22 nt, Human
gcaggagaaccacuugaaccca

SEQ ID NO: 640198 - RNA, 18 nt, Human
gcaggcuccagcugcucc

SEQ ID NO: 640199 - RNA, 23 nt, Human
gcaguggacuuggccucccacag

SEQ ID NO: 640200 - RNA, 24 nt, Human
gccaacauggugaaaccccaucuc

SEQ ID NO: 640201 - RNA, 19 nt, Human
gccacccccgaaccuugca

SEQ ID NO: 640202 - RNA, 18 nt, Human
gcccccagcaggagagac

SEQ ID NO: 640203 - RNA, 20 nt, Human
gccgagaucacaccacugca

SEQ ID NO: 640204 - RNA, 19 nt, Human
gccugggguccuucuggga

SEQ ID NO: 640205 - RNA, 20 nt, Human
gccuguaaucccagcuacuu

SEQ ID NO: 640206 - RNA, 19 nt, Human
gcugcaacgggccugccac

SEQ ID NO: 640207 - RNA, 19 nt, Human
ggaagguggacgggcagag

SEQ ID NO: 640208 - RNA, 23 nt, Human
ggacaggguccugcuuggcucag

SEQ ID NO: 640209 - RNA, 20 nt, Human
ggacucagaaagccaggucc

SEQ ID NO: 640210 - RNA, 21 nt, Human
ggagaaccacuugaacccagg

SEQ ID NO: 640211 - RNA, 20 nt, Human
ggagaaguuugaaaaacugg

SEQ ID NO: 640212 - RNA, 21 nt, Human
ggagaaguuugaaaaacugga

SEQ ID NO: 640213 - RNA, 18 nt, Human
ggagagugggggaggggg

SEQ ID NO: 640214 - RNA, 20 nt, Human
ggagccagcugaggacucac

SEQ ID NO: 640215 - RNA, 23 nt, Human
ggagccaggcgcccugaugcacg

SEQ ID NO: 640216 - RNA, 21 nt, Human
ggaggcgacaggugcuuugau

SEQ ID NO: 640217 - RNA, 20 nt, Human
ggaggggaugccggacucug

SEQ ID NO: 640218 - RNA, 18 nt, Human
ggaguuugcagugagccg

SEQ ID NO: 640219 - RNA, 24 nt, Human
ggaguuugcagugagccgagauca

SEQ ID NO: 640220 - RNA, 19 nt, Human
ggaugccggacucugcccg

SEQ ID NO: 640221 - RNA, 18 nt, Human
ggcacaagcagggccggc

SEQ ID NO: 640222 - RNA, 19 nt, Human
ggcagaguggcaucggggg

SEQ ID NO: 640223 - RNA, 21 nt, Human
ggcagaguggcaucggggggc

SEQ ID NO: 640224 - RNA, 20 nt, Human
ggcagaguggggagcugcuc

SEQ ID NO: 640225 - RNA, 25 nt, Human
ggcagaucacuugaggucaggaguu

SEQ ID NO: 640226 - RNA, 21 nt, Human
ggccugggguccuucugggag

SEQ ID NO: 640227 - RNA, 19 nt, Human
ggcggcaggggagagaggg

SEQ ID NO: 640228 - RNA, 22 nt, Human
ggcugauacagccaaagaaaac

SEQ ID NO: 640229 - RNA, 19 nt, Human
gggcagaguggcaucgggg

SEQ ID NO: 640230 - RNA, 25 nt, Human
gggcagaguggggagcugcucgggg

SEQ ID NO: 640231 - RNA, 23 nt, Human
ggggacuguuaccccaggggcuu

SEQ ID NO: 640232 - RNA, 23 nt, Human
gggguccuucugggagcccccuc

SEQ ID NO: 640233 - RNA, 24 nt, Human
gggugcacuggcucaugccuguaa

SEQ ID NO: 640234 - RNA, 19 nt, Human
ggucaggaguuugagacca

SEQ ID NO: 640235 - RNA, 24 nt, Human
gguggcgcaugccuguaaucccag

SEQ ID NO: 640236 - RNA, 20 nt, Human
gguguuuaaaaaaaaaaaaa

SEQ ID NO: 640237 - RNA, 18 nt, Human
gucaccuuaaaauaaauu

SEQ ID NO: 640238 - RNA, 20 nt, Human
guggcacaggccacacaaac

SEQ ID NO: 640239 - RNA, 23 nt, Human
guggcgcaugccuguaaucccag

SEQ ID NO: 640240 - RNA, 23 nt, Human
guuuaaaaaaaaaaaaaaaagaa

SEQ ID NO: 640241 - RNA, 20 nt, Human
uaaacauggacacugcugcc

SEQ ID NO: 640242 - RNA, 20 nt, Human
uaacagagacgagucgcaca

SEQ ID NO: 640243 - RNA, 22 nt, Human
uaagaaaguauuaaacuucugu

SEQ ID NO: 640244 - RNA, 20 nt, Human
uaagaacaggacauuaaacu

SEQ ID NO: 640245 - RNA, 24 nt, Human
uaagaccaaacguuucaaaacugg

SEQ ID NO: 640246 - RNA, 20 nt, Human
uacaggcucagguauccucc

SEQ ID NO: 640247 - RNA, 22 nt, Human
uagaagacacuggaauggccuc

SEQ ID NO: 640248 - RNA, 21 nt, Human
uagggaccaguggcucugggc

SEQ ID NO: 640249 - RNA, 26 nt, Human
uaucauacaagucaacaggaccagca

SEQ ID NO: 640250 - RNA, 19 nt, Human
uauuuugcauguuauuaac

SEQ ID NO: 640251 - RNA, 23 nt, Human
ucacaccacugcacgccagccug

SEQ ID NO: 640252 - RNA, 26 nt, Human
ucaccucaaaaaaaaaaaaacaaaaa

SEQ ID NO: 640253 - RNA, 21 nt, Human
ucacuggcugaggugggggag

SEQ ID NO: 640254 - RNA, 19 nt, Human
ucacuugaggucaggaguu

SEQ ID NO: 640255 - RNA, 19 nt, Human
ucagcagggggaccacgga

SEQ ID NO: 640256 - RNA, 19 nt, Human
ucagccucugaaacgagcu

SEQ ID NO: 640257 - RNA, 21 nt, Human
ucaucagcguggcuaagccaa

SEQ ID NO: 640258 - RNA, 22 nt, Human
ucaugccuguaaucccagcacu

SEQ ID NO: 640259 - RNA, 26 nt, Human
uccaagauucccaccuccuuccaccu

SEQ ID NO: 640260 - RNA, 22 nt, Human
uccacaaaagcccugcacccac

SEQ ID NO: 640261 - RNA, 24 nt, Human
uccacagggaggggugugugaagg

SEQ ID NO: 640262 - RNA, 21 nt, Human
uccacauggcacaagcagggc

SEQ ID NO: 640263 - RNA, 21 nt, Human
uccagaaggucaccacacacc

SEQ ID NO: 640264 - RNA, 19 nt, Human
ucccacagccacccucccc

SEQ ID NO: 640265 - RNA, 22 nt, Human
ucccacagccacccuccccagg

SEQ ID NO: 640266 - RNA, 19 nt, Human
ucccagggccuugcaccgu

SEQ ID NO: 640267 - RNA, 18 nt, Human
uccccagggccugggguc

SEQ ID NO: 640268 - RNA, 22 nt, Human
uccgaagagcugagcuccauuc

SEQ ID NO: 640269 - RNA, 21 nt, Human
uccgggcaguggacuuggccu

SEQ ID NO: 640270 - RNA, 20 nt, Human
uccguggggaagguagcggg

SEQ ID NO: 640271 - RNA, 19 nt, Human
ucgauuuuaaaaaggaucc

SEQ ID NO: 640272 - RNA, 21 nt, Human
ucgcagcccaggccucuccug

SEQ ID NO: 640273 - RNA, 18 nt, Human
ucucaaccuccucucuuu

SEQ ID NO: 640274 - RNA, 24 nt, Human
ucuccagcgagucucagcggaagc

SEQ ID NO: 640275 - RNA, 27 nt, Human
ucuccauaaacauggacacugcugccc

SEQ ID NO: 640276 - RNA, 21 nt, Human
ucucuacuaaaaauacaaaaa

SEQ ID NO: 640277 - RNA, 19 nt, Human
ugaaaccccaucucuacua

SEQ ID NO: 640278 - RNA, 18 nt, Human
ugaaaggcaggaacgugg

SEQ ID NO: 640279 - RNA, 19 nt, Human
ugaaguuaaaggcauccag

SEQ ID NO: 640280 - RNA, 22 nt, Human
ugacaauuuccacaaaagcccu

SEQ ID NO: 640281 - RNA, 23 nt, Human
ugagaaacugaaacugaaggcca

SEQ ID NO: 640282 - RNA, 23 nt, Human
ugagaccagcuuggccaacaugg

SEQ ID NO: 640283 - RNA, 24 nt, Human
ugagaccagcuuggccaacauggu

SEQ ID NO: 640284 - RNA, 20 nt, Human
ugagcuccauuccacggagg

SEQ ID NO: 640285 - RNA, 18 nt, Human
ugaggucaggaguuugag

SEQ ID NO: 640286 - RNA, 19 nt, Human
ugaggugggggagccaggc

SEQ ID NO: 640287 - RNA, 19 nt, Human
ugaugccuccgaagagcug

SEQ ID NO: 640288 - RNA, 19 nt, Human
ugaugggaugcccgggcag

SEQ ID NO: 640289 - RNA, 19 nt, Human
ugcaaugaaaggcaggaac

SEQ ID NO: 640290 - RNA, 22 nt, Human
ugcacccacaaaggcaccaucu

SEQ ID NO: 640291 - RNA, 21 nt, Human
ugccacccguguccucggagc

SEQ ID NO: 640292 - RNA, 20 nt, Human
ugccagaaucgaaagaaaaa

SEQ ID NO: 640293 - RNA, 23 nt, Human
ugccagaaucgaaagaaaaauuc

SEQ ID NO: 640294 - RNA, 23 nt, Human
ugccuguaaucccagcacucugg

SEQ ID NO: 640295 - RNA, 23 nt, Human
ugccuguaaucccagcuacuugg

SEQ ID NO: 640296 - RNA, 24 nt, Human
ugccuguaaucccagcuacuuggg

SEQ ID NO: 640297 - RNA, 21 nt, Human
ugcucugcucacucacaaacc

SEQ ID NO: 640298 - RNA, 24 nt, Human
ugcucugcucacucacaaacucca

SEQ ID NO: 640299 - RNA, 27 nt, Human
ugcugcaacuguuuacauguauuggga

SEQ ID NO: 640300 - RNA, 19 nt, Human
ugcuuggcucagacagugg

SEQ ID NO: 640301 - RNA, 24 nt, Human
uggaaaaauaacagaugcacauaa

SEQ ID NO: 640302 - RNA, 21 nt, Human
uggagaguccgcuucuugggg

SEQ ID NO: 640303 - RNA, 19 nt, Human
uggcacacgccccagucuc

SEQ ID NO: 640304 - RNA, 23 nt, Human
uggcagugagaggcggcguggaa

SEQ ID NO: 640305 - RNA, 25 nt, Human
uggcagugagaggcggcguggaagg

SEQ ID NO: 640306 - RNA, 22 nt, Human
uggccaacauggugaaacccca

SEQ ID NO: 640307 - RNA, 24 nt, Human
uggccaacauggugaaaccccauc

SEQ ID NO: 640308 - RNA, 21 nt, Human
uggcgcaugccuguaauccca

SEQ ID NO: 640309 - RNA, 22 nt, Human
uggcgcaugccuguaaucccag

SEQ ID NO: 640310 - RNA, 21 nt, Human
uggcucaugccuguaauccca

SEQ ID NO: 640311 - RNA, 22 nt, Human
uggcucaugccuguaaucccag

SEQ ID NO: 640312 - RNA, 24 nt, Human
uggcucaugccuguaaucccagca

SEQ ID NO: 640313 - RNA, 22 nt, Human
uggcucugggcugcaacgggcc

SEQ ID NO: 640314 - RNA, 22 nt, Human
ugggagagugggggagggggug

SEQ ID NO: 640315 - RNA, 23 nt, Human
ugggagagugggggagggggugg

SEQ ID NO: 640316 - RNA, 20 nt, Human
ugggaggccgaggcgggcag

SEQ ID NO: 640317 - RNA, 24 nt, Human
ugggaggccgaggcgggcagauca

SEQ ID NO: 640318 - RNA, 18 nt, Human
ugggaggcuggggcagga

SEQ ID NO: 640319 - RNA, 24 nt, Human
ugggaggcuggggcaggagaacca

SEQ ID NO: 640320 - RNA, 19 nt, Human
uggggagcugcucggggcc

SEQ ID NO: 640321 - RNA, 20 nt, Human
uggggaggggaugccggacu

SEQ ID NO: 640322 - RNA, 20 nt, Human
uggggcaggagaaccacuug

SEQ ID NO: 640323 - RNA, 24 nt, Human
uggggcaggagaaccacuugaacc

SEQ ID NO: 640324 - RNA, 24 nt, Human
ugggggccccaugggcccccacuu

SEQ ID NO: 640325 - RNA, 18 nt, Human
uggucuggcggcaacccc

SEQ ID NO: 640326 - RNA, 24 nt, Human
ugguggcgcaugccuguaauccca

SEQ ID NO: 640327 - RNA, 19 nt, Human
ugugcugggaguccggagu

SEQ ID NO: 640328 - RNA, 18 nt, Human
uguggggacucagccucu

SEQ ID NO: 640329 - RNA, 18 nt, Human
uucaccucaaaaaaaaaa

SEQ ID NO: 640330 - RNA, 19 nt, Human
uuccaggaagaacuucuua

SEQ ID NO: 640331 - RNA, 21 nt, Human
uuccccugcucugggcccagg

SEQ ID NO: 640332 - RNA, 22 nt, Human
uucccuggccagugcccuccca

SEQ ID NO: 640333 - RNA, 18 nt, Human
uugaugccuccgaagagc

SEQ ID NO: 640334 - RNA, 19 nt, Human
uugcagugagccgagauca

SEQ ID NO: 640335 - RNA, 20 nt, Human
uugcagugagccgagaucac

SEQ ID NO: 640336 - RNA, 23 nt, Human
uuggccaacauggugaaacccca

SEQ ID NO: 640337 - RNA, 26 nt, Human
uuuaaaaaaaaaaaaaaaagaaaaag

SEQ ID NO: 640338 - RNA, 21 nt, Human
uuucgcuucagggcauuuuuc

SEQ ID NO: 640339 - RNA, 19 nt, Human
uuugcagugagccgagauc

SEQ ID NO: 640340 - RNA, 27 nt, Human
uuuuucaacaaagaacgcacuccuggg

SEQ ID NO: 640341 - RNA, 24 nt, Human
agggccugagucucuagucaguug

SEQ ID NO: 640342 - RNA, 18 nt, Human
caccuucugccccacccc

SEQ ID NO: 640343 - RNA, 24 nt, Human
ccaaggggggcagugaguauggcc

SEQ ID NO: 640344 - RNA, 22 nt, Human
cccaccccaaggggguuggggc

SEQ ID NO: 640345 - RNA, 20 nt, Human
ccuucugccccaccccaagg

SEQ ID NO: 640346 - RNA, 20 nt, Human
cuucugccccaccccaaggg

SEQ ID NO: 640347 - RNA, 18 nt, Human
ugcagggccugagucucu

SEQ ID NO: 640348 - RNA, 21 nt, Human
ugcagggccugagucucuagu

SEQ ID NO: 640349 - RNA, 19 nt, Human
uggccacagguucuauagg

SEQ ID NO: 640350 - RNA, 24 nt, Human
uggccacagguucuauagggcccu

SEQ ID NO: 640351 - RNA, 21 nt, Human
ugggaugcuucaccuucugcc

SEQ ID NO: 640352 - RNA, 24 nt, Human
ugggaugcuucaccuucugcccca

SEQ ID NO: 640353 - RNA, 20 nt, Human
uuuuuuuuuuuuuuuuacca

SEQ ID NO: 640354 - RNA, 24 nt, Human
uuuuuuuuuuuuuuuuuaccacgg

SEQ ID NO: 640355 - RNA, 25 nt, Human
uuuuuuuuuuuuuuuuuaccacggg

SEQ ID NO: 640356 - RNA, 20 nt, Human
aaaacaaguguuacacccuc

SEQ ID NO: 640357 - RNA, 21 nt, Human
aaaauacugaaucaaaaucua

SEQ ID NO: 640358 - RNA, 19 nt, Human
aaacaaguguuacacccuc

SEQ ID NO: 640359 - RNA, 19 nt, Human
aaacuccaaauuucacgug

SEQ ID NO: 640360 - RNA, 23 nt, Human
aaacugcuggggguggggggggg

SEQ ID NO: 640361 - RNA, 24 nt, Human
aaagugcuggguuuacaggcauga

SEQ ID NO: 640362 - RNA, 24 nt, Human
aacauuguuaauguacuuaugcca

SEQ ID NO: 640363 - RNA, 19 nt, Human
aacugcugggggugggggg

SEQ ID NO: 640364 - RNA, 19 nt, Human
aacuugcaaucaucuuacc

SEQ ID NO: 640365 - RNA, 25 nt, Human
aagcucuuuacacacgcugcugccu

SEQ ID NO: 640366 - RNA, 20 nt, Human
aaguagcugggacugcaggc

SEQ ID NO: 640367 - RNA, 20 nt, Human
aaguagcugggacugcaggc

SEQ ID NO: 640368 - RNA, 24 nt, Human
aaucaaacuccuuacugagaccug

SEQ ID NO: 640369 - RNA, 21 nt, Human
aaucacuguuaaaaugauuug

SEQ ID NO: 640370 - RNA, 22 nt, Human
aaucucucuucugcaugcaguu

SEQ ID NO: 640371 - RNA, 21 nt, Human
aauucucgugccucggccucc

SEQ ID NO: 640372 - RNA, 24 nt, Human
acagggucucaccauguuggccag

SEQ ID NO: 640373 - RNA, 24 nt, Human
accaagcuauuguucugaaaacug

SEQ ID NO: 640374 - RNA, 18 nt, Human
accauguuggccaggcug

SEQ ID NO: 640375 - RNA, 20 nt, Human
acccaggcuggaguacuagu

SEQ ID NO: 640376 - RNA, 18 nt, Human
acccuugggggcaauuuu

SEQ ID NO: 640377 - RNA, 21 nt, Human
acuguaaccucugccuccugg

SEQ ID NO: 640378 - RNA, 22 nt, Human
acuguaaccucugccuccuggg

SEQ ID NO: 640379 - RNA, 23 nt, Human
agcaauucucgugccucggccuc

SEQ ID NO: 640380 - RNA, 22 nt, Human
agcagagacagggucucaccau

SEQ ID NO: 640381 - RNA, 24 nt, Human
aggugauccacccgcuucagccuc

SEQ ID NO: 640382 - RNA, 18 nt, Human
auggaugguggugauggc

SEQ ID NO: 640383 - RNA, 23 nt, Human
augucgugccuccugagucucac

SEQ ID NO: 640384 - RNA, 20 nt, Human
auguugaaaaaguucuggag

SEQ ID NO: 640385 - RNA, 26 nt, Human
caaacuucugaccucaggugauccaa

SEQ ID NO: 640386 - RNA, 24 nt, Human
caaagugcuggguuuacaggcaug

SEQ ID NO: 640387 - RNA, 28 nt, Human
caagcaauucucgugccucggccuccca

SEQ ID NO: 640388 - RNA, 19 nt, Human
cacagcccugcccaccucu

SEQ ID NO: 640389 - RNA, 20 nt, Human
cacagcccugcccaccucuc

SEQ ID NO: 640390 - RNA, 24 nt, Human
caccacaucuggcuaauuuuugua

SEQ ID NO: 640391 - RNA, 20 nt, Human
caccaugccuggccaagacu

SEQ ID NO: 640392 - RNA, 21 nt, Human
caccauguuggccaggcuggu

SEQ ID NO: 640393 - RNA, 24 nt, Human
caccauguuggccaggcuggucuc

SEQ ID NO: 640394 - RNA, 21 nt, Human
cagaaagcuccugccucccuc

SEQ ID NO: 640395 - RNA, 22 nt, Human
cagagacagggucucaccaugu

SEQ ID NO: 640396 - RNA, 18 nt, Human
caggcuuaugccaccaca

SEQ ID NO: 640397 - RNA, 24 nt, Human
cagggucucaccauguuggccagg

SEQ ID NO: 640398 - RNA, 24 nt, Human
cauguuggccaggcuggucucaaa

SEQ ID NO: 640399 - RNA, 24 nt, Human
ccaaagugcuggguuuacaggcau

SEQ ID NO: 640400 - RNA, 20 nt, Human
ccaccacaucuggcuaauuu

SEQ ID NO: 640401 - RNA, 20 nt, Human
ccaccaugccuggccaagac

SEQ ID NO: 640402 - RNA, 27 nt, Human
ccacccaaaaaauauuuuugccuaaaa

SEQ ID NO: 640403 - RNA, 18 nt, Human
cccaaaaaauauuuuugc

SEQ ID NO: 640404 - RNA, 24 nt, Human
cccaaguagcugggacugcaggcu

SEQ ID NO: 640405 - RNA, 22 nt, Human
cccaccucuccagccucauguc

SEQ ID NO: 640406 - RNA, 24 nt, Human
ccgcuucagccucccaaagugcug

SEQ ID NO: 640407 - RNA, 22 nt, Human
ccuacucaugaugcuccucccg

SEQ ID NO: 640408 - RNA, 22 nt, Human
ccuccuacucaugaugcuccuc

SEQ ID NO: 640409 - RNA, 22 nt, Human
ccuccuggguucaagcaauucu

SEQ ID NO: 640410 - RNA, 19 nt, Human
ccucugccuccuggguuca

SEQ ID NO: 640411 - RNA, 20 nt, Human
ccuggguucaagcaauucuc

SEQ ID NO: 640412 - RNA, 24 nt, Human
cgcuucagccucccaaagugcugg

SEQ ID NO: 640413 - RNA, 21 nt, Human
cuaaaauacugaaucaaaauc

SEQ ID NO: 640414 - RNA, 23 nt, Human
cuaauuuuuguauuuuuagcaga

SEQ ID NO: 640415 - RNA, 30 nt, Human
cuccagccucaugucgugccuccugagucu

SEQ ID NO: 640416 - RNA, 21 nt, Human
cuccaguuucauuuuuauucc

SEQ ID NO: 640417 - RNA, 22 nt, Human
cuccaguuucauuuuuauuccu

SEQ ID NO: 640418 - RNA, 21 nt, Human
cuccuggguucaagcaauucu

SEQ ID NO: 640419 - RNA, 24 nt, Human
cucggccucccaaguagcugggac

SEQ ID NO: 640420 - RNA, 25 nt, Human
cucgugccucggccucccaaguagc

SEQ ID NO: 640421 - RNA, 21 nt, Human
cugaccucaggugauccaccc

SEQ ID NO: 640422 - RNA, 21 nt, Human
cugcacagcccugcccaccuc

SEQ ID NO: 640423 - RNA, 18 nt, Human
cugcuggggguggggggg

SEQ ID NO: 640424 - RNA, 18 nt, Human
cugggggugggggggggg

SEQ ID NO: 640425 - RNA, 24 nt, Human
cuguaaccucugccuccuggguuc

SEQ ID NO: 640426 - RNA, 22 nt, Human
cuugauggagaaguuuaugaug

SEQ ID NO: 640427 - RNA, 24 nt, Human
cuugcucugucacccaggcuggag

SEQ ID NO: 640428 - RNA, 18 nt, Human
gaaagugcuuaaucaaag

SEQ ID NO: 640429 - RNA, 24 nt, Human
gaccucaggugauccacccgcuuc

SEQ ID NO: 640430 - RNA, 24 nt, Human
gaccugcacagcccugcccaccuc

SEQ ID NO: 640431 - RNA, 21 nt, Human
gagauggagucuugcucuguc

SEQ ID NO: 640432 - RNA, 21 nt, Human
gagguguuaaggcaccaagcu

SEQ ID NO: 640433 - RNA, 18 nt, Human
gcaccaagcuauuguucu

SEQ ID NO: 640434 - RNA, 18 nt, Human
gccacugaaauguauaau

SEQ ID NO: 640435 - RNA, 20 nt, Human
gcccugcccaccucuccagc

SEQ ID NO: 640436 - RNA, 24 nt, Human
gcccugcccaccucuccagccuca

SEQ ID NO: 640437 - RNA, 21 nt, Human
gccucggccucccaaguagcu

SEQ ID NO: 640438 - RNA, 26 nt, Human
gcucugucacccaggcuggaguacua

SEQ ID NO: 640439 - RNA, 20 nt, Human
gcuggggguggggggggggg

SEQ ID NO: 640440 - RNA, 24 nt, Human
ggcuggucucaaacuucugaccuc

SEQ ID NO: 640441 - RNA, 18 nt, Human
gggggugggggggggggg

SEQ ID NO: 640442 - RNA, 22 nt, Human
gggucucaccauguuggccagg

SEQ ID NO: 640443 - RNA, 19 nt, Human
ggucucaaacuucugaccu

SEQ ID NO: 640444 - RNA, 20 nt, Human
ggugaaacuugauggagaag

SEQ ID NO: 640445 - RNA, 24 nt, Human
gguuuacaggcaugagccaccaug

SEQ ID NO: 640446 - RNA, 24 nt, Human
gugauccacccgcuucagccuccc

SEQ ID NO: 640447 - RNA, 22 nt, Human
gugccucggccucccaaguagc

SEQ ID NO: 640448 - RNA, 23 nt, Human
gugccucggccucccaaguagcu

SEQ ID NO: 640449 - RNA, 24 nt, Human
guuuacaggcaugagccaccaugc

SEQ ID NO: 640450 - RNA, 19 nt, Human
uaaaaugauuuggugaaac

SEQ ID NO: 640451 - RNA, 22 nt, Human
uaaaaugauuuggugaaacuug

SEQ ID NO: 640452 - RNA, 21 nt, Human
uaauguacuuaugccacugaa

SEQ ID NO: 640453 - RNA, 24 nt, Human
uaauuuuuguauuuuuagcagaga

SEQ ID NO: 640454 - RNA, 22 nt, Human
uacaggcaugagccaccaugcc

SEQ ID NO: 640455 - RNA, 21 nt, Human
uacuguaaccucugccuccug

SEQ ID NO: 640456 - RNA, 23 nt, Human
uacuguaaccucugccuccuggg

SEQ ID NO: 640457 - RNA, 19 nt, Human
uagacccuugggggcaauu

SEQ ID NO: 640458 - RNA, 21 nt, Human
uagacccuugggggcaauuuu

SEQ ID NO: 640459 - RNA, 26 nt, Human
uagcagagacagggucucaccauguu

SEQ ID NO: 640460 - RNA, 25 nt, Human
uauaugccuaucauugugacaaaau

SEQ ID NO: 640461 - RNA, 21 nt, Human
uccacccgcuucagccuccca

SEQ ID NO: 640462 - RNA, 24 nt, Human
ucccaaagugcuggguuuacaggc

SEQ ID NO: 640463 - RNA, 24 nt, Human
ucccaaguagcugggacugcaggc

SEQ ID NO: 640464 - RNA, 23 nt, Human
ucccguucauccuuuagcucuca

SEQ ID NO: 640465 - RNA, 21 nt, Human
uccuggguucaagcaauucuc

SEQ ID NO: 640466 - RNA, 24 nt, Human
uccuggguucaagcaauucucgug

SEQ ID NO: 640467 - RNA, 24 nt, Human
ucucaccauguuggccaggcuggu

SEQ ID NO: 640468 - RNA, 24 nt, Human
ucugccuccuggguucaagcaauu

SEQ ID NO: 640469 - RNA, 18 nt, Human
ucugucacccaggcugga

SEQ ID NO: 640470 - RNA, 23 nt, Human
ucuugcucugucacccaggcugg

SEQ ID NO: 640471 - RNA, 24 nt, Human
ucuugcucugucacccaggcugga

SEQ ID NO: 640472 - RNA, 20 nt, Human
ugaaaucaagcauuuauccc

SEQ ID NO: 640473 - RNA, 21 nt, Human
ugaccucaggugauccacccg

SEQ ID NO: 640474 - RNA, 22 nt, Human
ugaccucaggugauccacccgc

SEQ ID NO: 640475 - RNA, 23 nt, Human
ugaccucaggugauccacccgcu

SEQ ID NO: 640476 - RNA, 24 nt, Human
ugaccucaggugauccacccgcuu

SEQ ID NO: 640477 - RNA, 21 nt, Human
ugccccaagcucuuuacacac

SEQ ID NO: 640478 - RNA, 18 nt, Human
ugccuccugagucucacu

SEQ ID NO: 640479 - RNA, 21 nt, Human
ugccucggccucccaaguagc

SEQ ID NO: 640480 - RNA, 24 nt, Human
ugccucggccucccaaguagcugg

SEQ ID NO: 640481 - RNA, 22 nt, Human
ugcucugucacccaggcuggag

SEQ ID NO: 640482 - RNA, 19 nt, Human
uggagucuugcucugucac

SEQ ID NO: 640483 - RNA, 24 nt, Human
uggccaggcuggucucaaacuucu

SEQ ID NO: 640484 - RNA, 18 nt, Human
uggcugcacaacauuguu

SEQ ID NO: 640485 - RNA, 24 nt, Human
ugggacugcaggcuuaugccacca

SEQ ID NO: 640486 - RNA, 22 nt, Human
uggguuuacaggcaugagccac

SEQ ID NO: 640487 - RNA, 23 nt, Human
uggguuuacaggcaugagccacc

SEQ ID NO: 640488 - RNA, 24 nt, Human
uggguuuacaggcaugagccacca

SEQ ID NO: 640489 - RNA, 21 nt, Human
uggugaaacuugauggagaag

SEQ ID NO: 640490 - RNA, 22 nt, Human
uguuaugcauauucuaccacaa

SEQ ID NO: 640491 - RNA, 22 nt, Human
uguuccuuuaaaguuucagguu

SEQ ID NO: 640492 - RNA, 20 nt, Human
uuaaucaaagaaaauuagcc

SEQ ID NO: 640493 - RNA, 24 nt, Human
uuacuguaaccucugccuccuggg

SEQ ID NO: 640494 - RNA, 25 nt, Human
uuacuguaaccucugccuccugggu

SEQ ID NO: 640495 - RNA, 23 nt, Human
uucaguuugggauguugaaaaag

SEQ ID NO: 640496 - RNA, 26 nt, Human
uucugaaaacugcugggggugggggg

SEQ ID NO: 640497 - RNA, 24 nt, Human
uugcucugucacccaggcuggagu

SEQ ID NO: 640498 - RNA, 18 nt, Human
uuggucuaagugaguuag

SEQ ID NO: 640499 - RNA, 24 nt, Human
uuuacuguaaccucugccuccugg

SEQ ID NO: 640500 - RNA, 22 nt, Human
uuucauaggucuuuucaaacgu

SEQ ID NO: 640501 - RNA, 23 nt, Human
uuuggugaaacuugauggagaag

SEQ ID NO: 640502 - RNA, 20 nt, Human
uuuuuguauuuuuagcagag

SEQ ID NO: 640503 - RNA, 23 nt, Human
uuuuuguauuuuuagcagagaca

SEQ ID NO: 640504 - RNA, 25 nt, Human
uuuuuuuuuuuuagagauggagucu

SEQ ID NO: 640505 - RNA, 18 nt, Human
aacuaaauaauucacagc

SEQ ID NO: 640506 - RNA, 23 nt, Human
agcuacaaaacaauaacuaaaua

SEQ ID NO: 640507 - RNA, 24 nt, Human
augauaugggugaaugcccuuuau

SEQ ID NO: 640508 - RNA, 20 nt, Human
caaaacaauaacuaaauaau

SEQ ID NO: 640509 - RNA, 21 nt, Human
cagcuacaaaacaauaacuaa

SEQ ID NO: 640510 - RNA, 21 nt, Human
uaaauaauucacagccaugaa

SEQ ID NO: 640511 - RNA, 22 nt, Human
uaaauaauucacagccaugaaa

SEQ ID NO: 640512 - RNA, 19 nt, Human
uacaaaacaauaacuaaau

SEQ ID NO: 640513 - RNA, 18 nt, Human
ugaaugcccuuuauuuuu

SEQ ID NO: 640514 - RNA, 23 nt, Human
ugauaugggugaaugcccuuuau

SEQ ID NO: 640515 - RNA, 18 nt, Human
ugcacuggagaaucagug

SEQ ID NO: 640516 - RNA, 21 nt, Human
uuacagcuacaaaacaauaac

SEQ ID NO: 640517 - RNA, 25 nt, Human
uuacagcuacaaaacaauaacuaaa

SEQ ID NO: 640518 - RNA, 24 nt, Human
uuuuuuuuuuuuuuuccuugauua

SEQ ID NO: 640519 - RNA, 27 nt, Human
uuuuuuuuuuuuuuuuuuuccuugggg

SEQ ID NO: 640520 - RNA, 25 nt, Human
uuuuuuuuuuuuuuuuuuuuuccuu

SEQ ID NO: 640521 - RNA, 22 nt, Human
aaacacauacagcaagcuacga

SEQ ID NO: 640522 - RNA, 21 nt, Human
aaacaggcacaggcugcccuu

SEQ ID NO: 640523 - RNA, 26 nt, Human
aaacaggcacaggcugcccuuuggua

SEQ ID NO: 640524 - RNA, 24 nt, Human
aaacucgagaacacagaacaacaa

SEQ ID NO: 640525 - RNA, 19 nt, Human
aaagaaaaagcuccacuga

SEQ ID NO: 640526 - RNA, 19 nt, Human
aaagagccuggaucaaaac

SEQ ID NO: 640527 - RNA, 24 nt, Human
aacaaaaauaacuuccuugaacau

SEQ ID NO: 640528 - RNA, 21 nt, Human
aacacagaacaacaacaaaaa

SEQ ID NO: 640529 - RNA, 22 nt, Human
aaccugagggcaggcacauggu

SEQ ID NO: 640530 - RNA, 29 nt, Human
aacgcggcaggcccgggucccgggcggca

SEQ ID NO: 640531 - RNA, 24 nt, Human
aagaaaaagcuccacugaaaaaaa

SEQ ID NO: 640532 - RNA, 22 nt, Human
aagaguuaaaauaagcucaaag

SEQ ID NO: 640533 - RNA, 19 nt, Human
aagcaaguuuaauucucca

SEQ ID NO: 640534 - RNA, 22 nt, Human
aaggggucaaagccaagguuuc

SEQ ID NO: 640535 - RNA, 22 nt, Human
aauaaagaauaaacacauacag

SEQ ID NO: 640536 - RNA, 20 nt, Human
aauaaagugaaccaaaaaaa

SEQ ID NO: 640537 - RNA, 23 nt, Human
aauacaaacaaaaauaacugccu

SEQ ID NO: 640538 - RNA, 19 nt, Human
aaugggacuggcuggaggg

SEQ ID NO: 640539 - RNA, 21 nt, Human
acaaaaauaacuuccuugaac

SEQ ID NO: 640540 - RNA, 18 nt, Human
acaccagcaaccuacacg

SEQ ID NO: 640541 - RNA, 19 nt, Human
acuauucgaagggcaugau

SEQ ID NO: 640542 - RNA, 19 nt, Human
acuccaccaccaccgugag

SEQ ID NO: 640543 - RNA, 18 nt, Human
acuccugaaaacaaagag

SEQ ID NO: 640544 - RNA, 20 nt, Human
agagcaguacuauucgaagg

SEQ ID NO: 640545 - RNA, 21 nt, Human
agaguuaaaauaagcucaaag

SEQ ID NO: 640546 - RNA, 18 nt, Human
agccuggcccgauggcug

SEQ ID NO: 640547 - RNA, 23 nt, Human
aggaaaacuuauuuaagggaggc

SEQ ID NO: 640548 - RNA, 22 nt, Human
aggagguugccucugaccuucc

SEQ ID NO: 640549 - RNA, 19 nt, Human
aggcccgggucccgggcgg

SEQ ID NO: 640550 - RNA, 25 nt, Human
agguuugugaggaauauaggagagu

SEQ ID NO: 640551 - RNA, 23 nt, Human
aguauaagagguaguaggaggaa

SEQ ID NO: 640552 - RNA, 20 nt, Human
auaauuuggggagaugagua

SEQ ID NO: 640553 - RNA, 22 nt, Human
auacugucgaaauacaaacaaa

SEQ ID NO: 640554 - RNA, 18 nt, Human
auggcuaacaggucacgu

SEQ ID NO: 640555 - RNA, 22 nt, Human
augggacuggcuggaggggcca

SEQ ID NO: 640556 - RNA, 23 nt, Human
caaagaaaaagcuccacugaaaa

SEQ ID NO: 640557 - RNA, 20 nt, Human
caaaggcagagaggauccau

SEQ ID NO: 640558 - RNA, 21 nt, Human
caauagauggaugagacaugc

SEQ ID NO: 640559 - RNA, 21 nt, Human
caccacuacauauugcaggaa

SEQ ID NO: 640560 - RNA, 22 nt, Human
cacgagaaggggucaaagccaa

SEQ ID NO: 640561 - RNA, 23 nt, Human
cagcaaccuacacguguagcauu

SEQ ID NO: 640562 - RNA, 21 nt, Human
cagccccaucccuccaggcaa

SEQ ID NO: 640563 - RNA, 19 nt, Human
caguuagauuagaauggaa

SEQ ID NO: 640564 - RNA, 22 nt, Human
cauccaagaacuccaccaccac

SEQ ID NO: 640565 - RNA, 19 nt, Human
ccaaaaaaauuacaaagac

SEQ ID NO: 640566 - RNA, 19 nt, Human
ccaccaccgugagcccggc

SEQ ID NO: 640567 - RNA, 18 nt, Human
ccauaaacaggcacaggc

SEQ ID NO: 640568 - RNA, 21 nt, Human
ccccaaagcugaaagcaauaa

SEQ ID NO: 640569 - RNA, 20 nt, Human
cccugugcaggucccagggc

SEQ ID NO: 640570 - RNA, 18 nt, Human
ccggccuccgguuucauc

SEQ ID NO: 640571 - RNA, 24 nt, Human
ccgggucccgggcggcauggcccc

SEQ ID NO: 640572 - RNA, 18 nt, Human
ccuccucacccaggcugg

SEQ ID NO: 640573 - RNA, 24 nt, Human
ccuggaucaaaacuggaagugacc

SEQ ID NO: 640574 - RNA, 22 nt, Human
ccuggcccgauggcugaagcug

SEQ ID NO: 640575 - RNA, 23 nt, Human
cgaugaacacaagucacaggucc

SEQ ID NO: 640576 - RNA, 24 nt, Human
cgcggcaggcccgggucccgggcg

SEQ ID NO: 640577 - RNA, 21 nt, Human
cggccccgccgcccgcagccc

SEQ ID NO: 640578 - RNA, 24 nt, Human
cggccggggcgcggaacgcggcag

SEQ ID NO: 640579 - RNA, 23 nt, Human
cggccuccgguuucaucuuuccc

SEQ ID NO: 640580 - RNA, 19 nt, Human
cgggcggcauggccccuac

SEQ ID NO: 640581 - RNA, 19 nt, Human
cggggcgcggaacgcggca

SEQ ID NO: 640582 - RNA, 24 nt, Human
cuccaggaagagaaauuagauuuc

SEQ ID NO: 640583 - RNA, 18 nt, Human
cugaccacagaauuagca

SEQ ID NO: 640584 - RNA, 18 nt, Human
cuggagcaaguccgcugc

SEQ ID NO: 640585 - RNA, 19 nt, Human
cuggagcaaguccgcugca

SEQ ID NO: 640586 - RNA, 22 nt, Human
gaaauacaaacaaaaauaacug

SEQ ID NO: 640587 - RNA, 24 nt, Human
gaaauacaaacaaaaauaacugcc

SEQ ID NO: 640588 - RNA, 18 nt, Human
gaacaaauuccuccagga

SEQ ID NO: 640589 - RNA, 20 nt, Human
gaacaggggaggagguugcc

SEQ ID NO: 640590 - RNA, 20 nt, Human
gaccagcuuaccuucuagga

SEQ ID NO: 640591 - RNA, 23 nt, Human
gacucuucucuugcagugcucug

SEQ ID NO: 640592 - RNA, 20 nt, Human
gagaacacagaacaacaaca

SEQ ID NO: 640593 - RNA, 22 nt, Human
gagaggauccauaaacaggcac

SEQ ID NO: 640594 - RNA, 19 nt, Human
gaggaagcuaagggaaauc

SEQ ID NO: 640595 - RNA, 20 nt, Human
gcaggcccgggucccgggcg

SEQ ID NO: 640596 - RNA, 19 nt, Human
gcaguuagauuagaaugga

SEQ ID NO: 640597 - RNA, 25 nt, Human
gcccgggucccgggcggcauggccc

SEQ ID NO: 640598 - RNA, 19 nt, Human
gccuccucacccaggcugg

SEQ ID NO: 640599 - RNA, 19 nt, Human
gcgcggacguggggcgcgg

SEQ ID NO: 640600 - RNA, 18 nt, Human
gcggaacgcggcaggccc

SEQ ID NO: 640601 - RNA, 21 nt, Human
gcuggaggggccaagcugcuu

SEQ ID NO: 640602 - RNA, 22 nt, Human
ggaauccgagaaguccaaugca

SEQ ID NO: 640603 - RNA, 19 nt, Human
ggagguugccucugaccuu

SEQ ID NO: 640604 - RNA, 20 nt, Human
ggcagguguaagacucuucu

SEQ ID NO: 640605 - RNA, 18 nt, Human
ggcccccgaugaacacaa

SEQ ID NO: 640606 - RNA, 20 nt, Human
ggcgcggcggccggggcgcg

SEQ ID NO: 640607 - RNA, 23 nt, Human
ggggucaaagccaagguuuccuc

SEQ ID NO: 640608 - RNA, 21 nt, Human
gguaguaggaggaagcuaagg

SEQ ID NO: 640609 - RNA, 21 nt, Human
gucccaggaggcgaguucuuc

SEQ ID NO: 640610 - RNA, 24 nt, Human
guguaagacucuucucuugcagaa

SEQ ID NO: 640611 - RNA, 18 nt, Human
uaaacaggcacaggcugc

SEQ ID NO: 640612 - RNA, 23 nt, Human
uaaagaauaaacacauacagcaa

SEQ ID NO: 640613 - RNA, 25 nt, Human
uaaagugaaccaaaaaaauuacaaa

SEQ ID NO: 640614 - RNA, 23 nt, Human
uaacuccugaaacucgagaacac

SEQ ID NO: 640615 - RNA, 18 nt, Human
uaauuuggggagaugagu

SEQ ID NO: 640616 - RNA, 21 nt, Human
uacacgucaggauauggcuaa

SEQ ID NO: 640617 - RNA, 26 nt, Human
uacagccccaaagcugaaagcaauaa

SEQ ID NO: 640618 - RNA, 18 nt, Human
uacagugaaagagccugg

SEQ ID NO: 640619 - RNA, 24 nt, Human
uaccacuggaaaauaaccugaggg

SEQ ID NO: 640620 - RNA, 22 nt, Human
uacccuggcugaguagcccaca

SEQ ID NO: 640621 - RNA, 21 nt, Human
uaccuguuacagccccaaagc

SEQ ID NO: 640622 - RNA, 19 nt, Human
uagaauguucccauuacuc

SEQ ID NO: 640623 - RNA, 23 nt, Human
uauggcccaaagaaaaagcucca

SEQ ID NO: 640624 - RNA, 20 nt, Human
uauguugcucaagaguuaaa

SEQ ID NO: 640625 - RNA, 19 nt, Human
uauucuagaccuugagccg

SEQ ID NO: 640626 - RNA, 19 nt, Human
ucaaaggagaggcugauuc

SEQ ID NO: 640627 - RNA, 18 nt, Human
ucacauuaaaucuauguu

SEQ ID NO: 640628 - RNA, 21 nt, Human
ucacccaggcuggagcaaguc

SEQ ID NO: 640629 - RNA, 22 nt, Human
ucccaggaggcgaguucuucag

SEQ ID NO: 640630 - RNA, 21 nt, Human
ucccgggcggcauggccccua

SEQ ID NO: 640631 - RNA, 20 nt, Human
ucccuccaggcaggcgccgg

SEQ ID NO: 640632 - RNA, 25 nt, Human
ucccuccaggcaggcgccggccccc

SEQ ID NO: 640633 - RNA, 23 nt, Human
ucuaggaaaacuuauuuaaggga

SEQ ID NO: 640634 - RNA, 20 nt, Human
ucuauguuauguugcucaag

SEQ ID NO: 640635 - RNA, 22 nt, Human
ucugcuaaaacagugcucucca

SEQ ID NO: 640636 - RNA, 20 nt, Human
ucuuccugcagccuggcccg

SEQ ID NO: 640637 - RNA, 18 nt, Human
ucuucuuccugcagccug

SEQ ID NO: 640638 - RNA, 28 nt, Human
ugaaaaaaacauugaauacugaccacag

SEQ ID NO: 640639 - RNA, 23 nt, Human
ugaaagcaauaaagaauaaacac

SEQ ID NO: 640640 - RNA, 21 nt, Human
ugagaacaaauuccuccagga

SEQ ID NO: 640641 - RNA, 18 nt, Human
ugagaacaaauuccuccc

SEQ ID NO: 640642 - RNA, 18 nt, Human
ugagggcaggcacauggu

SEQ ID NO: 640643 - RNA, 22 nt, Human
ugaguagcccacaguuaauuuu

SEQ ID NO: 640644 - RNA, 22 nt, Human
ugcaaacacauggaauccgaga

SEQ ID NO: 640645 - RNA, 18 nt, Human
uggaauccgagaagucca

SEQ ID NO: 640646 - RNA, 25 nt, Human
uggcaaaagaaaugagaacaaauuc

SEQ ID NO: 640647 - RNA, 19 nt, Human
uggcuggaggggccaagcu

SEQ ID NO: 640648 - RNA, 18 nt, Human
uggggagugcuuuaugcc

SEQ ID NO: 640649 - RNA, 19 nt, Human
uggggcgcggcggccgggg

SEQ ID NO: 640650 - RNA, 24 nt, Human
ugugcaggucccagggcugaguca

SEQ ID NO: 640651 - RNA, 24 nt, Human
uuccugaggcucccacuguacccu

SEQ ID NO: 640652 - RNA, 21 nt, Human
uuccugcagccuggcccgaug

SEQ ID NO: 640653 - RNA, 18 nt, Human
uucgaagggcaugauguc

SEQ ID NO: 640654 - RNA, 18 nt, Human
aaaauucucccucccucc

SEQ ID NO: 640655 - RNA, 19 nt, Human
aaacguucaaguucuucuc

SEQ ID NO: 640656 - RNA, 24 nt, Human
aaccaccagcuaaacuguuucgcc

SEQ ID NO: 640657 - RNA, 21 nt, Human
aacucaucuuuccuaauccaa

SEQ ID NO: 640658 - RNA, 21 nt, Human
aaguauaguuagggcagugau

SEQ ID NO: 640659 - RNA, 21 nt, Human
acaaugacacccuaacuagag

SEQ ID NO: 640660 - RNA, 18 nt, Human
accaagacaguguaccag

SEQ ID NO: 640661 - RNA, 18 nt, Human
agaagccaguuugccaag

SEQ ID NO: 640662 - RNA, 20 nt, Human
agagaguguuccagagcucc

SEQ ID NO: 640663 - RNA, 26 nt, Human
agagcuccuccauggccuccagcacc

SEQ ID NO: 640664 - RNA, 21 nt, Human
agaggcugcuacuucuguugg

SEQ ID NO: 640665 - RNA, 22 nt, Human
agagggaaauuuagagaguguu

SEQ ID NO: 640666 - RNA, 23 nt, Human
agauccuuccagcuuuggggugu

SEQ ID NO: 640667 - RNA, 22 nt, Human
agaugccuuucuggaaccccaa

SEQ ID NO: 640668 - RNA, 18 nt, Human
agggaaauuuagagagug

SEQ ID NO: 640669 - RNA, 21 nt, Human
agggauuaauacuguucuuua

SEQ ID NO: 640670 - RNA, 22 nt, Human
agggcuauacucucugccccau

SEQ ID NO: 640671 - RNA, 23 nt, Human
agucauguaccacgcagagcccc

SEQ ID NO: 640672 - RNA, 19 nt, Human
agugagguucagugagugc

SEQ ID NO: 640673 - RNA, 20 nt, Human
aguuuuggggcuccucuggu

SEQ ID NO: 640674 - RNA, 25 nt, Human
auaaagucuuauuuaaacaguuaga

SEQ ID NO: 640675 - RNA, 20 nt, Human
auauucccaaacaccuacug

SEQ ID NO: 640676 - RNA, 25 nt, Human
aucccaaagugcaugaccgaagagc

SEQ ID NO: 640677 - RNA, 19 nt, Human
augaagcuguagagguccc

SEQ ID NO: 640678 - RNA, 20 nt, Human
caagaggaagucauuauccu

SEQ ID NO: 640679 - RNA, 24 nt, Human
caagaucagaauuccaugaaccag

SEQ ID NO: 640680 - RNA, 22 nt, Human
cacagagcaagcaagccucuga

SEQ ID NO: 640681 - RNA, 22 nt, Human
cacauaccacuccccucuaccu

SEQ ID NO: 640682 - RNA, 23 nt, Human
cagaagccaguuugccaagggga

SEQ ID NO: 640683 - RNA, 22 nt, Human
cagagaaagguccauuucuauu

SEQ ID NO: 640684 - RNA, 22 nt, Human
caugaaccagauccuuucccca

SEQ ID NO: 640685 - RNA, 22 nt, Human
caugcaagaggaagucauuauc

SEQ ID NO: 640686 - RNA, 20 nt, Human
cauguaccacgcagagcccc

SEQ ID NO: 640687 - RNA, 23 nt, Human
cauuuaaaaucacacucccaccc

SEQ ID NO: 640688 - RNA, 18 nt, Human
ccaaccuucuaugauccc

SEQ ID NO: 640689 - RNA, 23 nt, Human
ccaaccuucuaugauccccaaaa

SEQ ID NO: 640690 - RNA, 18 nt, Human
cccacauacacacccgaa

SEQ ID NO: 640691 - RNA, 21 nt, Human
cccacgaggcugucaaaguuu

SEQ ID NO: 640692 - RNA, 23 nt, Human
cccgcaagugccgcaggcccugg

SEQ ID NO: 640693 - RNA, 19 nt, Human
cccucccucccuuaccccu

SEQ ID NO: 640694 - RNA, 19 nt, Human
cccucuaccucaggccucc

SEQ ID NO: 640695 - RNA, 21 nt, Human
cccugggccgucacaaagccc

SEQ ID NO: 640696 - RNA, 23 nt, Human
ccuacugaggacaccagucccca

SEQ ID NO: 640697 - RNA, 24 nt, Human
ccuuauccagaaccaaaacguuca

SEQ ID NO: 640698 - RNA, 21 nt, Human
cgugcuguugcucccaagaaa

SEQ ID NO: 640699 - RNA, 19 nt, Human
cuccccucuaccucaggcc

SEQ ID NO: 640700 - RNA, 18 nt, Human
cucuaccucaggccuccc

SEQ ID NO: 640701 - RNA, 19 nt, Human
cucuaccucaggccuccca

SEQ ID NO: 640702 - RNA, 20 nt, Human
cucucaaaugacaaugacac

SEQ ID NO: 640703 - RNA, 18 nt, Human
cugcaccuauacgcuguc

SEQ ID NO: 640704 - RNA, 21 nt, Human
cuucccauauucccaaacacc

SEQ ID NO: 640705 - RNA, 21 nt, Human
gacaguaaccuaagacucgag

SEQ ID NO: 640706 - RNA, 18 nt, Human
gagaagaaagaaccacca

SEQ ID NO: 640707 - RNA, 22 nt, Human
gcacuauuuuggugguucaccu

SEQ ID NO: 640708 - RNA, 19 nt, Human
gccuuuaucuaacauccug

SEQ ID NO: 640709 - RNA, 20 nt, Human
gcucgguccaccuagcaccu

SEQ ID NO: 640710 - RNA, 19 nt, Human
ggagaagaaagaaccacca

SEQ ID NO: 640711 - RNA, 21 nt, Human
ggcuauacucucugccccauu

SEQ ID NO: 640712 - RNA, 22 nt, Human
ggcuuuaagaguucugcuggcu

SEQ ID NO: 640713 - RNA, 18 nt, Human
gggaagagggaaaauacu

SEQ ID NO: 640714 - RNA, 21 nt, Human
gggauuaauacuguucuuuau

SEQ ID NO: 640715 - RNA, 22 nt, Human
gggcugcaccuauacgcuguau

SEQ ID NO: 640716 - RNA, 24 nt, Human
ggggaagagggaaaauacugaaaa

SEQ ID NO: 640717 - RNA, 19 nt, Human
gucaucccaagucuuugau

SEQ ID NO: 640718 - RNA, 22 nt, Human
gugcaugaccgaagagcaaguc

SEQ ID NO: 640719 - RNA, 20 nt, Human
gugucagucucucaaaugac

SEQ ID NO: 640720 - RNA, 20 nt, Human
uaaaaugccacaccacucuu

SEQ ID NO: 640721 - RNA, 23 nt, Human
uaaagugagguucagugagugcu

SEQ ID NO: 640722 - RNA, 22 nt, Human
uacaaaaauucucccucccucc

SEQ ID NO: 640723 - RNA, 19 nt, Human
uaccacuccccucuaccuc

SEQ ID NO: 640724 - RNA, 22 nt, Human
uaccacuccccucuaccucagg

SEQ ID NO: 640725 - RNA, 24 nt, Human
uaccucacucccuggcaauaacau

SEQ ID NO: 640726 - RNA, 26 nt, Human
uaccucaggccucccaaagggagugg

SEQ ID NO: 640727 - RNA, 21 nt, Human
uagagcuccuccauggccucc

SEQ ID NO: 640728 - RNA, 21 nt, Human
uagaucccaagaauaagccag

SEQ ID NO: 640729 - RNA, 23 nt, Human
uagaucccaagaauaagccaggg

SEQ ID NO: 640730 - RNA, 23 nt, Human
uagaugagcucaggagaaaccug

SEQ ID NO: 640731 - RNA, 23 nt, Human
uaggacagugaccuuauccagaa

SEQ ID NO: 640732 - RNA, 20 nt, Human
uauaaaggggaagagggaaa

SEQ ID NO: 640733 - RNA, 18 nt, Human
uauucugucaggcacugc

SEQ ID NO: 640734 - RNA, 22 nt, Human
uauuuuggugguucaccuaugg

SEQ ID NO: 640735 - RNA, 23 nt, Human
ucaaagggauuaauacuguucuu

SEQ ID NO: 640736 - RNA, 23 nt, Human
ucaaaguuuuggggcuccucugg

SEQ ID NO: 640737 - RNA, 19 nt, Human
ucaggucaagugcacaugg

SEQ ID NO: 640738 - RNA, 19 nt, Human
uccaaaggaagggucuacc

SEQ ID NO: 640739 - RNA, 24 nt, Human
uccacugagucuuuugcucggucc

SEQ ID NO: 640740 - RNA, 24 nt, Human
uccagcaccccuuuaccagcugcu

SEQ ID NO: 640741 - RNA, 19 nt, Human
ucccaaacaccuacugagg

SEQ ID NO: 640742 - RNA, 22 nt, Human
ucccaaacaccuacugaggaca

SEQ ID NO: 640743 - RNA, 26 nt, Human
ucccaaacaccuacugaggacaccag

SEQ ID NO: 640744 - RNA, 21 nt, Human
uccccaugcucaggaccucca

SEQ ID NO: 640745 - RNA, 21 nt, Human
uccggggcuaucaccugaucc

SEQ ID NO: 640746 - RNA, 25 nt, Human
uccguacuacaacuggcuuuaagag

SEQ ID NO: 640747 - RNA, 22 nt, Human
uccuccauggccuccagcaccc

SEQ ID NO: 640748 - RNA, 22 nt, Human
ucucucaaaugacaaugacacc

SEQ ID NO: 640749 - RNA, 24 nt, Human
ucucucaaaugacaaugacacccu

SEQ ID NO: 640750 - RNA, 23 nt, Human
ucuuccuagaucccaccuuuugc

SEQ ID NO: 640751 - RNA, 20 nt, Human
ucuuugaugacaguaaccua

SEQ ID NO: 640752 - RNA, 20 nt, Human
ucuuuguucucccaaaagag

SEQ ID NO: 640753 - RNA, 21 nt, Human
ugaccgaagagcaagucuggc

SEQ ID NO: 640754 - RNA, 24 nt, Human
ugagaauacagcaaguagggaaau

SEQ ID NO: 640755 - RNA, 20 nt, Human
ugauauggaucagaagccag

SEQ ID NO: 640756 - RNA, 21 nt, Human
ugauauggaucagaagccagu

SEQ ID NO: 640757 - RNA, 18 nt, Human
ugauuuauuuuuguuuuu

SEQ ID NO: 640758 - RNA, 22 nt, Human
ugcaagggcgagggaggaaaau

SEQ ID NO: 640759 - RNA, 21 nt, Human
ugcacagagcaagcaagccuc

SEQ ID NO: 640760 - RNA, 19 nt, Human
ugcacguagacacacacau

SEQ ID NO: 640761 - RNA, 19 nt, Human
ugcacuccauccuuugagg

SEQ ID NO: 640762 - RNA, 19 nt, Human
ugccacaccacucuuaucc

SEQ ID NO: 640763 - RNA, 18 nt, Human
ugcccacauacacacccg

SEQ ID NO: 640764 - RNA, 19 nt, Human
ugccuuucuggaaccccaa

SEQ ID NO: 640765 - RNA, 20 nt, Human
uggcaauaacauaccauugu

SEQ ID NO: 640766 - RNA, 18 nt, Human
uggcuggcucccaugccu

SEQ ID NO: 640767 - RNA, 22 nt, Human
ugggcacaugcccacauacaca

SEQ ID NO: 640768 - RNA, 21 nt, Human
ugggugacugcacccagaggc

SEQ ID NO: 640769 - RNA, 30 nt, Human
uguauuauugucauagagagagagaaaggg

SEQ ID NO: 640770 - RNA, 21 nt, Human
ugucaccacugggcuagggcu

SEQ ID NO: 640771 - RNA, 23 nt, Human
uguuccagagcuccacagcaagg

SEQ ID NO: 640772 - RNA, 18 nt, Human
uuaauacuguucuuuauu

SEQ ID NO: 640773 - RNA, 18 nt, Human
uuauugucauagagagag

SEQ ID NO: 640774 - RNA, 19 nt, Human
uucaccuaugggccaagau

SEQ ID NO: 640775 - RNA, 22 nt, Human
uucuacacuggauucuuucuuc

SEQ ID NO: 640776 - RNA, 22 nt, Human
uucucccaaaagagcauuuaaa

SEQ ID NO: 640777 - RNA, 24 nt, Human
uugaugcacuccauccuuugaggu

SEQ ID NO: 640778 - RNA, 21 nt, Human
uuuaaaaucacacucccaccc

SEQ ID NO: 640779 - RNA, 25 nt, Human
uuuaaaaugccacaccacucuuauc

SEQ ID NO: 640780 - RNA, 20 nt, Human
uuuuaauagagggaaauuua

SEQ ID NO: 640781 - RNA, 18 nt, Human
uuuugcuggagauugcaa

SEQ ID NO: 640782 - RNA, 22 nt, Human
aacccccgaacguuguggaccu

SEQ ID NO: 640783 - RNA, 22 nt, Human
aacccuugcuccuccaccgccc

SEQ ID NO: 640784 - RNA, 22 nt, Human
aagcaguggggcucccccagga

SEQ ID NO: 640785 - RNA, 19 nt, Human
aagcggccccagcggaacc

SEQ ID NO: 640786 - RNA, 20 nt, Human
acaggcacguuggguguggg

SEQ ID NO: 640787 - RNA, 22 nt, Human
acucugagcuccuguggggguc

SEQ ID NO: 640788 - RNA, 24 nt, Human
acugccagagugguugggaccagc

SEQ ID NO: 640789 - RNA, 19 nt, Human
agaagcagcggcuuccacc

SEQ ID NO: 640790 - RNA, 19 nt, Human
agaaggggcgggucugaua

SEQ ID NO: 640791 - RNA, 18 nt, Human
agagggccuuggagaguc

SEQ ID NO: 640792 - RNA, 18 nt, Human
agaguugggggcuccagg

SEQ ID NO: 640793 - RNA, 23 nt, Human
agccacagcucggcgcgcacgcc

SEQ ID NO: 640794 - RNA, 21 nt, Human
agccgcagcgacaggcgacgu

SEQ ID NO: 640795 - RNA, 21 nt, Human
agcgacucccuagagcccaga

SEQ ID NO: 640796 - RNA, 23 nt, Human
agcgacucccuagagcccagagc

SEQ ID NO: 640797 - RNA, 21 nt, Human
agcggaacccuccagccgccu

SEQ ID NO: 640798 - RNA, 18 nt, Human
aggacccuccuccucucc

SEQ ID NO: 640799 - RNA, 24 nt, Human
aggcaggaugggcagcucaggugg

SEQ ID NO: 640800 - RNA, 20 nt, Human
aggcagggccuggacagacu

SEQ ID NO: 640801 - RNA, 23 nt, Human
aggcgacgcgcccgaauccgcgc

SEQ ID NO: 640802 - RNA, 20 nt, Human
aggcggagcuuguccagacu

SEQ ID NO: 640803 - RNA, 23 nt, Human
aggcggggcagguguguuggggg

SEQ ID NO: 640804 - RNA, 24 nt, Human
aggcggggcagguguguugggggc

SEQ ID NO: 640805 - RNA, 22 nt, Human
aggcgguuacgcggaagucuuc

SEQ ID NO: 640806 - RNA, 19 nt, Human
aggcuggggugcaguggcc

SEQ ID NO: 640807 - RNA, 19 nt, Human
agggccuggucagaucuaa

SEQ ID NO: 640808 - RNA, 20 nt, Human
aggggcugggguugacucca

SEQ ID NO: 640809 - RNA, 21 nt, Human
agggugcuuugaggggcuggg

SEQ ID NO: 640810 - RNA, 19 nt, Human
auaguggaaggugaggaac

SEQ ID NO: 640811 - RNA, 22 nt, Human
auaucucagugcccggcccagc

SEQ ID NO: 640812 - RNA, 19 nt, Human
auggggccgggaguggaca

SEQ ID NO: 640813 - RNA, 20 nt, Human
caagagaagcagcggcuucc

SEQ ID NO: 640814 - RNA, 18 nt, Human
caagaggcagggccugga

SEQ ID NO: 640815 - RNA, 23 nt, Human
caccccaaagaaggcaccgcaag

SEQ ID NO: 640816 - RNA, 24 nt, Human
cacccccccuaagauggcuaucuc

SEQ ID NO: 640817 - RNA, 19 nt, Human
cacccggggccuucgagga

SEQ ID NO: 640818 - RNA, 19 nt, Human
caccgcgcuucccgggccc

SEQ ID NO: 640819 - RNA, 20 nt, Human
cagagcacugggggguccau

SEQ ID NO: 640820 - RNA, 19 nt, Human
cagcaaagcggccccagcg

SEQ ID NO: 640821 - RNA, 22 nt, Human
cagcaaagcggccccagcggaa

SEQ ID NO: 640822 - RNA, 19 nt, Human
cagccagguugggaggggc

SEQ ID NO: 640823 - RNA, 20 nt, Human
cagccucuugagcaaccccc

SEQ ID NO: 640824 - RNA, 21 nt, Human
cagcggccgagcgacaagaga

SEQ ID NO: 640825 - RNA, 23 nt, Human
cagcgggaaccagcgcuccagac

SEQ ID NO: 640826 - RNA, 20 nt, Human
cagcucggcgcgcacgccgg

SEQ ID NO: 640827 - RNA, 21 nt, Human
cagcucuggcuccggcuccag

SEQ ID NO: 640828 - RNA, 23 nt, Human
cagcucuggcuccggcuccagcu

SEQ ID NO: 640829 - RNA, 20 nt, Human
caggagagggcugcaccgca

SEQ ID NO: 640830 - RNA, 20 nt, Human
caggaugggcagcucaggug

SEQ ID NO: 640831 - RNA, 26 nt, Human
caggcgacgcgcccgaauccgcgccc

SEQ ID NO: 640832 - RNA, 18 nt, Human
caguucagagaguguggc

SEQ ID NO: 640833 - RNA, 23 nt, Human
caucccuuggaggugggguuugg

SEQ ID NO: 640834 - RNA, 21 nt, Human
ccaccgcccagaccugcccca

SEQ ID NO: 640835 - RNA, 26 nt, Human
ccacguuguccugcagaugggagugg

SEQ ID NO: 640836 - RNA, 25 nt, Human
ccagaccacgugugaugaggcagga

SEQ ID NO: 640837 - RNA, 21 nt, Human
ccagagggccuuggagagucg

SEQ ID NO: 640838 - RNA, 22 nt, Human
ccagcagcgcgccauccagcca

SEQ ID NO: 640839 - RNA, 19 nt, Human
ccagccagcaaagcggccc

SEQ ID NO: 640840 - RNA, 23 nt, Human
ccagccagguugggaggggcuga

SEQ ID NO: 640841 - RNA, 27 nt, Human
ccagccgccuucuccccaccgcccccu

SEQ ID NO: 640842 - RNA, 22 nt, Human
ccagcggucucucucagcggcc

SEQ ID NO: 640843 - RNA, 20 nt, Human
ccagggacuccgggggcgga

SEQ ID NO: 640844 - RNA, 19 nt, Human
ccaugguuggggggggggg

SEQ ID NO: 640845 - RNA, 22 nt, Human
cccagaccugccccagggcuca

SEQ ID NO: 640846 - RNA, 21 nt, Human
cccagcaccgcgcuucccggg

SEQ ID NO: 640847 - RNA, 23 nt, Human
cccagccagcaaagcggccccag

SEQ ID NO: 640848 - RNA, 27 nt, Human
cccauggccacguggaugcugccuugu

SEQ ID NO: 640849 - RNA, 24 nt, Human
ccccauggccacguggaugcugcc

SEQ ID NO: 640850 - RNA, 23 nt, Human
cccccaaugucccagacaggcac

SEQ ID NO: 640851 - RNA, 25 nt, Human
cccccgcguccuuggagaaagcugc

SEQ ID NO: 640852 - RNA, 21 nt, Human
ccccuucgcuucgugcaccca

SEQ ID NO: 640853 - RNA, 20 nt, Human
cccggggccuucgaggaccc

SEQ ID NO: 640854 - RNA, 22 nt, Human
cccuagagcccagagcacuggg

SEQ ID NO: 640855 - RNA, 22 nt, Human
cccugaaguuccccauggccac

SEQ ID NO: 640856 - RNA, 25 nt, Human
ccgcagcgcugcgcccgccggcgcc

SEQ ID NO: 640857 - RNA, 19 nt, Human
ccgccagcuccuccuuggc

SEQ ID NO: 640858 - RNA, 18 nt, Human
ccgcgcccgcagcgcugc

SEQ ID NO: 640859 - RNA, 19 nt, Human
ccgcgcccgcagcgcugcg

SEQ ID NO: 640860 - RNA, 25 nt, Human
ccgcgcccgcagcgcugcgcccgcc

SEQ ID NO: 640861 - RNA, 24 nt, Human
ccuaagauggcuaucucucugcuc

SEQ ID NO: 640862 - RNA, 25 nt, Human
ccucagcugagccugaguucucucc

SEQ ID NO: 640863 - RNA, 19 nt, Human
ccuccaagcagcaccagcu

SEQ ID NO: 640864 - RNA, 24 nt, Human
ccucgaaguggaagcgcucggccc

SEQ ID NO: 640865 - RNA, 20 nt, Human
ccugccccagccagcaaagc

SEQ ID NO: 640866 - RNA, 22 nt, Human
ccugguggcucagggcccugcc

SEQ ID NO: 640867 - RNA, 24 nt, Human
cgcagcgcugcgcccgccggcgcc

SEQ ID NO: 640868 - RNA, 23 nt, Human
cgccauccagccacagcucggcg

SEQ ID NO: 640869 - RNA, 21 nt, Human
cgccggcgccccgagcagcgg

SEQ ID NO: 640870 - RNA, 26 nt, Human
cuagcacuucccacccggggccuucg

SEQ ID NO: 640871 - RNA, 19 nt, Human
cucagugcccggcccagcc

SEQ ID NO: 640872 - RNA, 22 nt, Human
cucagugcccggcccagccagg

SEQ ID NO: 640873 - RNA, 19 nt, Human
cucuggcuccggcuccagc

SEQ ID NO: 640874 - RNA, 19 nt, Human
cugaaagcaguggggcucc

SEQ ID NO: 640875 - RNA, 22 nt, Human
cugaaguuccccauggccacgu

SEQ ID NO: 640876 - RNA, 22 nt, Human
cugauggagggguggggccugg

SEQ ID NO: 640877 - RNA, 21 nt, Human
cugcaccgcaacccuugcucc

SEQ ID NO: 640878 - RNA, 19 nt, Human
cugggccuuuggggaaaga

SEQ ID NO: 640879 - RNA, 20 nt, Human
cugggugggcuggaauuggc

SEQ ID NO: 640880 - RNA, 18 nt, Human
cuguuuuuccaggcaucc

SEQ ID NO: 640881 - RNA, 22 nt, Human
cuucauacugccagagugguug

SEQ ID NO: 640882 - RNA, 20 nt, Human
gaacccuccagccgccuucu

SEQ ID NO: 640883 - RNA, 20 nt, Human
gaaggggcgggucugauauu

SEQ ID NO: 640884 - RNA, 20 nt, Human
gaaggugaggaacuccgcca

SEQ ID NO: 640885 - RNA, 20 nt, Human
gaaguggaagcgcucggccc

SEQ ID NO: 640886 - RNA, 23 nt, Human
gaccacgugugaugaggcaggau

SEQ ID NO: 640887 - RNA, 19 nt, Human
gaccagcagcuccacuccc

SEQ ID NO: 640888 - RNA, 22 nt, Human
gacccuccuccucuccuccaag

SEQ ID NO: 640889 - RNA, 23 nt, Human
gacuccuugggaggcgcagauag

SEQ ID NO: 640890 - RNA, 24 nt, Human
gcagcgcgggcuccagggccccgc

SEQ ID NO: 640891 - RNA, 19 nt, Human
gcagggugcuuugaggggc

SEQ ID NO: 640892 - RNA, 19 nt, Human
gcagucuccgguucuguuu

SEQ ID NO: 640893 - RNA, 23 nt, Human
gccacgcggcccagcaccgcgcu

SEQ ID NO: 640894 - RNA, 20 nt, Human
gccagggccacgcggcccag

SEQ ID NO: 640895 - RNA, 18 nt, Human
gccaggguccuaggccga

SEQ ID NO: 640896 - RNA, 23 nt, Human
gcccgaauccgcgcccgcagcgc

SEQ ID NO: 640897 - RNA, 21 nt, Human
gccgggugcccccgccgcugc

SEQ ID NO: 640898 - RNA, 23 nt, Human
gccgggugcccccgccgcugcuc

SEQ ID NO: 640899 - RNA, 21 nt, Human
gccuggacagacuuauugggg

SEQ ID NO: 640900 - RNA, 20 nt, Human
gcgggccaggccugugggcg

SEQ ID NO: 640901 - RNA, 18 nt, Human
gcggggccaggguggggc

SEQ ID NO: 640902 - RNA, 21 nt, Human
gcucagggcccugccccagcc

SEQ ID NO: 640903 - RNA, 21 nt, Human
gcuccagggcauacaagagua

SEQ ID NO: 640904 - RNA, 23 nt, Human
ggaacccuccagccgccuucucc

SEQ ID NO: 640905 - RNA, 23 nt, Human
ggagagggcugcaccgcaacccu

SEQ ID NO: 640906 - RNA, 19 nt, Human
ggaggcaguggugaugggg

SEQ ID NO: 640907 - RNA, 19 nt, Human
ggaggcaguggugaugggg

SEQ ID NO: 640908 - RNA, 24 nt, Human
ggaggugggguuuggccaggggac

SEQ ID NO: 640909 - RNA, 21 nt, Human
ggagugccagggacuccgggg

SEQ ID NO: 640910 - RNA, 25 nt, Human
ggccuuuggggaaagaaguggagcc

SEQ ID NO: 640911 - RNA, 20 nt, Human
ggcggggccaggguggggcu

SEQ ID NO: 640912 - RNA, 18 nt, Human
ggcuccggcuccagcucu

SEQ ID NO: 640913 - RNA, 19 nt, Human
ggcucuccgggagaguugg

SEQ ID NO: 640914 - RNA, 24 nt, Human
gggaaccagcgcuccagaccggcg

SEQ ID NO: 640915 - RNA, 19 nt, Human
gggaaugguuggaaugaca

SEQ ID NO: 640916 - RNA, 19 nt, Human
gggaccagcagcuccacuc

SEQ ID NO: 640917 - RNA, 22 nt, Human
gggauggggggaagcguuuugg

SEQ ID NO: 640918 - RNA, 24 nt, Human
gggauuggggcgaagggcagaggc

SEQ ID NO: 640919 - RNA, 19 nt, Human
gggcggggccagggugggg

SEQ ID NO: 640920 - RNA, 21 nt, Human
ggggaggcaguggugaugggg

SEQ ID NO: 640921 - RNA, 20 nt, Human
ggggccaggguggggcuugg

SEQ ID NO: 640922 - RNA, 19 nt, Human
ggggggggggagggccugg

SEQ ID NO: 640923 - RNA, 21 nt, Human
gggugcuuugaggggcugggg

SEQ ID NO: 640924 - RNA, 24 nt, Human
gguugggggggggggucuccuugg

SEQ ID NO: 640925 - RNA, 21 nt, Human
gugaagcguggagccucaaac

SEQ ID NO: 640926 - RNA, 23 nt, Human
gugggguuuggccaguccugggu

SEQ ID NO: 640927 - RNA, 18 nt, Human
guggguccaccugggggc

SEQ ID NO: 640928 - RNA, 22 nt, Human
guuugggggggggggggagggc

SEQ ID NO: 640929 - RNA, 19 nt, Human
uaagauggcuaucucucug

SEQ ID NO: 640930 - RNA, 19 nt, Human
uaaggcaaagucagacacc

SEQ ID NO: 640931 - RNA, 20 nt, Human
uaaggcaaagucagacaccc

SEQ ID NO: 640932 - RNA, 18 nt, Human
uaccugaaagcagugggg

SEQ ID NO: 640933 - RNA, 20 nt, Human
uacugggcaacuucauacug

SEQ ID NO: 640934 - RNA, 18 nt, Human
uagguugugcucugaauc

SEQ ID NO: 640935 - RNA, 21 nt, Human
ucagauggcaaucucaccaac

SEQ ID NO: 640936 - RNA, 18 nt, Human
ucagcggccgagcgacaa

SEQ ID NO: 640937 - RNA, 21 nt, Human
ucagugcccggcccagccagg

SEQ ID NO: 640938 - RNA, 19 nt, Human
uccaccgcccagaccugcc

SEQ ID NO: 640939 - RNA, 22 nt, Human
uccacuccccacuguaggccaa

SEQ ID NO: 640940 - RNA, 19 nt, Human
uccagacugaggggcgggg

SEQ ID NO: 640941 - RNA, 21 nt, Human
uccagccgccuucuccccacc

SEQ ID NO: 640942 - RNA, 18 nt, Human
uccagcuccuccagcgcc

SEQ ID NO: 640943 - RNA, 20 nt, Human
uccccaccgcccccugugug

SEQ ID NO: 640944 - RNA, 28 nt, Human
uccccacuguaggccaaguagggcuaag

SEQ ID NO: 640945 - RNA, 26 nt, Human
uccccauggccacguggaugcugccc

SEQ ID NO: 640946 - RNA, 23 nt, Human
ucccccaggaggcuggggugcag

SEQ ID NO: 640947 - RNA, 21 nt, Human
ucccggggcuccaaccuggcc

SEQ ID NO: 640948 - RNA, 22 nt, Human
ucccggggcuccaaccuggccu

SEQ ID NO: 640949 - RNA, 24 nt, Human
ucccuuccagcuccuggugggagu

SEQ ID NO: 640950 - RNA, 19 nt, Human
uccgcacaucccgcucggc

SEQ ID NO: 640951 - RNA, 23 nt, Human
uccgguucuguuuuuccaggcau

SEQ ID NO: 640952 - RNA, 19 nt, Human
ucgaggacccuccuccucu

SEQ ID NO: 640953 - RNA, 21 nt, Human
ucuccauugaggcagggugcu

SEQ ID NO: 640954 - RNA, 18 nt, Human
ucuccgggagaguugggg

SEQ ID NO: 640955 - RNA, 21 nt, Human
ucugaaucaaacucugagcuc

SEQ ID NO: 640956 - RNA, 18 nt, Human
ucuggaucccugaaguuc

SEQ ID NO: 640957 - RNA, 18 nt, Human
ucugugggguagggggcu

SEQ ID NO: 640958 - RNA, 19 nt, Human
ucugugggguagggggcuc

SEQ ID NO: 640959 - RNA, 22 nt, Human
ugaaaucaagauuuuacugggc

SEQ ID NO: 640960 - RNA, 21 nt, Human
ugaagcccccaaugucccaga

SEQ ID NO: 640961 - RNA, 19 nt, Human
ugagcaacccccgaacguu

SEQ ID NO: 640962 - RNA, 21 nt, Human
ugauggagggguggggccugg

SEQ ID NO: 640963 - RNA, 18 nt, Human
ugccagcagcgcgccauc

SEQ ID NO: 640964 - RNA, 25 nt, Human
ugcccaggcugagauaucucagugc

SEQ ID NO: 640965 - RNA, 20 nt, Human
ugccccagggcucagauggc

SEQ ID NO: 640966 - RNA, 21 nt, Human
ugcuccggcuccgggucuggc

SEQ ID NO: 640967 - RNA, 22 nt, Human
ugcugaccaugggcuccuggug

SEQ ID NO: 640968 - RNA, 19 nt, Human
ugcugcccucggagcuagc

SEQ ID NO: 640969 - RNA, 24 nt, Human
ugcugggccuuuggggaaagaagu

SEQ ID NO: 640970 - RNA, 24 nt, Human
uggaugcugcccucggagcuagca

SEQ ID NO: 640971 - RNA, 19 nt, Human
uggcaaucucaccagguuu

SEQ ID NO: 640972 - RNA, 18 nt, Human
uggcaggcagggcuuugg

SEQ ID NO: 640973 - RNA, 23 nt, Human
uggccugcgcaggcagcgcgggc

SEQ ID NO: 640974 - RNA, 24 nt, Human
uggccuuuuucuucucuuucagcc

SEQ ID NO: 640975 - RNA, 21 nt, Human
ugggaccagcagcuccacucc

SEQ ID NO: 640976 - RNA, 23 nt, Human
ugggaggggcugauggaggggug

SEQ ID NO: 640977 - RNA, 18 nt, Human
ugggagugggaugggggg

SEQ ID NO: 640978 - RNA, 21 nt, Human
ugggagugggauggggggaag

SEQ ID NO: 640979 - RNA, 23 nt, Human
ugggauggggggaagcguuuugg

SEQ ID NO: 640980 - RNA, 22 nt, Human
uggggaggcaguggugaugggg

SEQ ID NO: 640981 - RNA, 23 nt, Human
uggggccgggaguggacagaagg

SEQ ID NO: 640982 - RNA, 19 nt, Human
uggggcggggccagggugg

SEQ ID NO: 640983 - RNA, 22 nt, Human
uggggcggggccaggguggggc

SEQ ID NO: 640984 - RNA, 23 nt, Human
uggggcggggccaggguggggcu

SEQ ID NO: 640985 - RNA, 20 nt, Human
uggggcguccagcuccucca

SEQ ID NO: 640986 - RNA, 24 nt, Human
ugggggcggagcuaauggagaggg

SEQ ID NO: 640987 - RNA, 22 nt, Human
ugggggggggggggagggccug

SEQ ID NO: 640988 - RNA, 23 nt, Human
ugggguugacuccaagacccccg

SEQ ID NO: 640989 - RNA, 27 nt, Human
uggguccaugguugggggggggggucu

SEQ ID NO: 640990 - RNA, 19 nt, Human
ugggugggcuggaauuggc

SEQ ID NO: 640991 - RNA, 20 nt, Human
uggguggguccaccuggggg

SEQ ID NO: 640992 - RNA, 23 nt, Human
uggugucuccauugaggcagggu

SEQ ID NO: 640993 - RNA, 22 nt, Human
ugguuuguuggcaccccaaaga

SEQ ID NO: 640994 - RNA, 21 nt, Human
uguccagacugaggggcgggg

SEQ ID NO: 640995 - RNA, 22 nt, Human
uguccagacugaggggcggggc

SEQ ID NO: 640996 - RNA, 24 nt, Human
ugucccagacaggcacguugggug

SEQ ID NO: 640997 - RNA, 22 nt, Human
uucagaaaccaggagagggcug

SEQ ID NO: 640998 - RNA, 19 nt, Human
uucccgggcccaagccgcg

SEQ ID NO: 640999 - RNA, 25 nt, Human
uucuccccaccgcccccugugugcc

SEQ ID NO: 641000 - RNA, 18 nt, Human
uucucuccaucucauuua

SEQ ID NO: 641001 - RNA, 21 nt, Human
uucuuaugccucccccagagg

SEQ ID NO: 641002 - RNA, 24 nt, Human
uugcugggccuuuggggaaagaag

SEQ ID NO: 641003 - RNA, 23 nt, Human
uugggaggggcugauggaggggu

SEQ ID NO: 641004 - RNA, 22 nt, Human
uuuaggcggugcuccuggggag

SEQ ID NO: 641005 - RNA, 24 nt, Human
uuucagacugugcccuucauugcu

SEQ ID NO: 641006 - RNA, 18 nt, Human
uuuggccaguccugggug

SEQ ID NO: 641007 - RNA, 21 nt, Human
uuuggguagaguggaaggggc

SEQ ID NO: 641008 - RNA, 25 nt, Human
uuuucagacugugcccuucauugcu

SEQ ID NO: 641009 - RNA, 26 nt, Human
uuuucugggcucuccgggagaguugg

SEQ ID NO: 641010 - RNA, 21 nt, Human
uuuuucuucucuuucagccuc

SEQ ID NO: 641011 - RNA, 22 nt, Human
aaaguagaagcuguccugagga

SEQ ID NO: 641012 - RNA, 25 nt, Human
aaucaucuaaaaucaaucuauuuua

SEQ ID NO: 641013 - RNA, 21 nt, Human
aucugucagaaucugcuaaca

SEQ ID NO: 641014 - RNA, 21 nt, Human
caagaaaacagacaccuauga

SEQ ID NO: 641015 - RNA, 22 nt, Human
caagaaaacagacaccuaugaa

SEQ ID NO: 641016 - RNA, 26 nt, Human
caaugcauucuucuucucaucacauc

SEQ ID NO: 641017 - RNA, 21 nt, Human
cauuauuggaucaucuaaagu

SEQ ID NO: 641018 - RNA, 27 nt, Human
gaucaucuaaaguagaagcuguccuga

SEQ ID NO: 641019 - RNA, 24 nt, Human
uaaaaugguguggaugaacaauca

SEQ ID NO: 641020 - RNA, 23 nt, Human
uaacaguacaagaaaacagacac

SEQ ID NO: 641021 - RNA, 21 nt, Human
uaauacuaguaucuauauaaa

SEQ ID NO: 641022 - RNA, 24 nt, Human
uaggaauuuccuccugaaaaguuu

SEQ ID NO: 641023 - RNA, 19 nt, Human
ucaucuaaaguagaagcug

SEQ ID NO: 641024 - RNA, 23 nt, Human
uccaaugcauucuucuucucauc

SEQ ID NO: 641025 - RNA, 24 nt, Human
ugaacaaucaucuaaaaucaaucu

SEQ ID NO: 641026 - RNA, 21 nt, Human
ugcuaacaguacaagaaaaca

SEQ ID NO: 641027 - RNA, 21 nt, Human
uugcuaccuacuacccacaaa

SEQ ID NO: 641028 - RNA, 19 nt, Human
aagaaggagauggucccac

SEQ ID NO: 641029 - RNA, 25 nt, Human
accccuggggaggaagggcgugguu

SEQ ID NO: 641030 - RNA, 18 nt, Human
accuuaauaucccuaaag

SEQ ID NO: 641031 - RNA, 23 nt, Human
accuuaauaucccuaaagaagaa

SEQ ID NO: 641032 - RNA, 21 nt, Human
acuuuggaucugggagagaga

SEQ ID NO: 641033 - RNA, 18 nt, Human
agccaccacacucuuccu

SEQ ID NO: 641034 - RNA, 21 nt, Human
aggugggguccuggggaagac

SEQ ID NO: 641035 - RNA, 22 nt, Human
aggugggguccuggggaagacg

SEQ ID NO: 641036 - RNA, 23 nt, Human
caagaggccucuuucucugauuc

SEQ ID NO: 641037 - RNA, 24 nt, Human
caccccuggggaggaagggcgugg

SEQ ID NO: 641038 - RNA, 20 nt, Human
cacguacuccuuccuccugu

SEQ ID NO: 641039 - RNA, 21 nt, Human
cacuguugcuugucucuggga

SEQ ID NO: 641040 - RNA, 24 nt, Human
cagaggcccuuugccaagaggccu

SEQ ID NO: 641041 - RNA, 19 nt, Human
cagccuucuucccucccag

SEQ ID NO: 641042 - RNA, 24 nt, Human
cauccuacauuucaccccugggga

SEQ ID NO: 641043 - RNA, 18 nt, Human
ccaccuuuuauugugucc

SEQ ID NO: 641044 - RNA, 21 nt, Human
cccacacucauaguccaggaa

SEQ ID NO: 641045 - RNA, 19 nt, Human
cccaugaucgggagacaaa

SEQ ID NO: 641046 - RNA, 22 nt, Human
ccccuggggaggaagggcgugg

SEQ ID NO: 641047 - RNA, 19 nt, Human
cccuuugccaagaggccuc

SEQ ID NO: 641048 - RNA, 21 nt, Human
ccuccuggggagcuuuucuau

SEQ ID NO: 641049 - RNA, 18 nt, Human
ccugggugacugggcaga

SEQ ID NO: 641050 - RNA, 23 nt, Human
cgggagacaaagucacguacucc

SEQ ID NO: 641051 - RNA, 21 nt, Human
cucacuguugcuugucucugg

SEQ ID NO: 641052 - RNA, 19 nt, Human
cucugcgugagcggagggc

SEQ ID NO: 641053 - RNA, 18 nt, Human
cugcgugagcggagggca

SEQ ID NO: 641054 - RNA, 19 nt, Human
cuuagccagauggagugag

SEQ ID NO: 641055 - RNA, 21 nt, Human
cuucucagagugaggcaccuc

SEQ ID NO: 641056 - RNA, 19 nt, Human
gaaauacaaauguucucca

SEQ ID NO: 641057 - RNA, 21 nt, Human
gagagcaaacuaaauguaaug

SEQ ID NO: 641058 - RNA, 21 nt, Human
gcauggaaacggaugacagga

SEQ ID NO: 641059 - RNA, 21 nt, Human
gcuugucucugggauugcaga

SEQ ID NO: 641060 - RNA, 22 nt, Human
gggcgugguugccugugaggag

SEQ ID NO: 641061 - RNA, 22 nt, Human
ggugacggauggauuagagaga

SEQ ID NO: 641062 - RNA, 21 nt, Human
gugagcggagggcaaacugcg

SEQ ID NO: 641063 - RNA, 23 nt, Human
uaaaucucuucucagagugaggc

SEQ ID NO: 641064 - RNA, 21 nt, Human
uauuucaagaucacuuagcca

SEQ ID NO: 641065 - RNA, 19 nt, Human
ucaagaucacuuagccaga

SEQ ID NO: 641066 - RNA, 18 nt, Human
ucaggguauaaauaaggg

SEQ ID NO: 641067 - RNA, 19 nt, Human
ucauaguccaggaagaccc

SEQ ID NO: 641068 - RNA, 18 nt, Human
ucccaguaauguuucccu

SEQ ID NO: 641069 - RNA, 18 nt, Human
ucccuaaagaagaaugug

SEQ ID NO: 641070 - RNA, 21 nt, Human
ucuacaccacagccugugaga

SEQ ID NO: 641071 - RNA, 19 nt, Human
ugggagagagaccuuaaua

SEQ ID NO: 641072 - RNA, 23 nt, Human
ugggugacugggcagaugacuau

SEQ ID NO: 641073 - RNA, 19 nt, Human
ugguugccugugaggagga

SEQ ID NO: 641074 - RNA, 22 nt, Human
uuagagagaagaggagaacugg

SEQ ID NO: 641075 - RNA, 18 nt, Human
uugaagaaggagaugguc

SEQ ID NO: 641076 - RNA, 18 nt, Human
uuuuuuuuuuuuacugaa

SEQ ID NO: 641077 - RNA, 23 nt, Human
uuuuuuuuuuuuuuuuuuacuga

SEQ ID NO: 641078 - RNA, 20 nt, Human
aaaaaaaaaaaaaaaagcac

SEQ ID NO: 641079 - RNA, 25 nt, Human
aaaaaaaaaaaaaaaagcacaacug

SEQ ID NO: 641080 - RNA, 28 nt, Human
aaaaaaaaaaaaaaagaccguccaagag

SEQ ID NO: 641081 - RNA, 23 nt, Human
aaaaaaaaaaaaagcacaacuga

SEQ ID NO: 641082 - RNA, 24 nt, Human
aaaaaaaaaaagaccguccaagag

SEQ ID NO: 641083 - RNA, 24 nt, Human
aaaaaaaaaaagcacaacugaaga

SEQ ID NO: 641084 - RNA, 22 nt, Human
aaaaaaaaaagcacaacugaag

SEQ ID NO: 641085 - RNA, 23 nt, Human
aaaaaaaaaagcacaacugaaga

SEQ ID NO: 641086 - RNA, 21 nt, Human
aaaaaaaagcacaacugaaga

SEQ ID NO: 641087 - RNA, 23 nt, Human
aaaaagaccguccaagaguggga

SEQ ID NO: 641088 - RNA, 24 nt, Human
aagcuucgcuggcuugccggcccc

SEQ ID NO: 641089 - RNA, 25 nt, Human
aaucccaccccauaaaccgaacaaa

SEQ ID NO: 641090 - RNA, 22 nt, Human
acagagugagacugucucaaaa

SEQ ID NO: 641091 - RNA, 23 nt, Human
acccuguuuccacaaaaaauaca

SEQ ID NO: 641092 - RNA, 24 nt, Human
accugaggucaggaguucgagacc

SEQ ID NO: 641093 - RNA, 21 nt, Human
accugcugugcaccccacuuc

SEQ ID NO: 641094 - RNA, 21 nt, Human
acuagacagccccaucugggg

SEQ ID NO: 641095 - RNA, 18 nt, Human
acugcaccccagccuggg

SEQ ID NO: 641096 - RNA, 24 nt, Human
acugcaccccagccugggugacag

SEQ ID NO: 641097 - RNA, 23 nt, Human
agccaagugugguggcguaugcc

SEQ ID NO: 641098 - RNA, 24 nt, Human
agccuggccaacaugguaacaccc

SEQ ID NO: 641099 - RNA, 22 nt, Human
agccugggugacagagugagac

SEQ ID NO: 641100 - RNA, 20 nt, Human
aggaggcugaggcaggagag

SEQ ID NO: 641101 - RNA, 24 nt, Human
aggcaggagagucgcuugaacccg

SEQ ID NO: 641102 - RNA, 21 nt, Human
aggcaugauggcucacaccug

SEQ ID NO: 641103 - RNA, 24 nt, Human
aggcaugauggcucacaccuguaa

SEQ ID NO: 641104 - RNA, 21 nt, Human
aggccgaggcggucggaucac

SEQ ID NO: 641105 - RNA, 24 nt, Human
aggcggaguuugcagugagccgag

SEQ ID NO: 641106 - RNA, 22 nt, Human
aggcggucggaucaccugaggu

SEQ ID NO: 641107 - RNA, 21 nt, Human
aggcugaggcaggagagucgc

SEQ ID NO: 641108 - RNA, 24 nt, Human
aggcugaggcaggagagucgcuug

SEQ ID NO: 641109 - RNA, 20 nt, Human
aguuuuuagcacuuauguuc

SEQ ID NO: 641110 - RNA, 24 nt, Human
auagcgccacugcaccccagccug

SEQ ID NO: 641111 - RNA, 19 nt, Human
auggagcgguccaccuaca

SEQ ID NO: 641112 - RNA, 23 nt, Human
auggcucacaccuguaaucccag

SEQ ID NO: 641113 - RNA, 18 nt, Human
caauggacugggcccacc

SEQ ID NO: 641114 - RNA, 24 nt, Human
cacaccuguaaucccagcaccuug

SEQ ID NO: 641115 - RNA, 19 nt, Human
cacagugcugguuccuucc

SEQ ID NO: 641116 - RNA, 22 nt, Human
caccccagccugggugacagag

SEQ ID NO: 641117 - RNA, 22 nt, Human
caccccagccugggugacagag

SEQ ID NO: 641118 - RNA, 24 nt, Human
caccccagccugggugacagagug

SEQ ID NO: 641119 - RNA, 23 nt, Human
caccugaggucaggaguucgaga

SEQ ID NO: 641120 - RNA, 23 nt, Human
caccuguaaucccagcaccuugg

SEQ ID NO: 641121 - RNA, 24 nt, Human
caccuguaaucccagcaccuuggg

SEQ ID NO: 641122 - RNA, 23 nt, Human
cacugcaccccagccugggugac

SEQ ID NO: 641123 - RNA, 24 nt, Human
cacugcaccccagccugggugaca

SEQ ID NO: 641124 - RNA, 24 nt, Human
cagcaaggcagccucucucuggcc

SEQ ID NO: 641125 - RNA, 24 nt, Human
cagcaccuugggaggccgaggcgg

SEQ ID NO: 641126 - RNA, 20 nt, Human
cagccccaucugggggugac

SEQ ID NO: 641127 - RNA, 24 nt, Human
caguuacucaggaggcugaggcag

SEQ ID NO: 641128 - RNA, 21 nt, Human
caucacagagacucaguggga

SEQ ID NO: 641129 - RNA, 22 nt, Human
ccaaaaccagcaaggcagccuc

SEQ ID NO: 641130 - RNA, 24 nt, Human
ccaaaaccagcaaggcagccucuc

SEQ ID NO: 641131 - RNA, 20 nt, Human
ccacugcaccccagccuggg

SEQ ID NO: 641132 - RNA, 21 nt, Human
ccacugcaccccagccugggu

SEQ ID NO: 641133 - RNA, 24 nt, Human
ccacugcaccccagccugggugac

SEQ ID NO: 641134 - RNA, 24 nt, Human
cccacagugcugguuccuuccaga

SEQ ID NO: 641135 - RNA, 24 nt, Human
cccagccugggugacagagugaga

SEQ ID NO: 641136 - RNA, 24 nt, Human
ccggccccuaaccugcugugcacc

SEQ ID NO: 641137 - RNA, 22 nt, Human
ccugaggucaggaguucgagac

SEQ ID NO: 641138 - RNA, 18 nt, Human
ccugcaacuagacagccc

SEQ ID NO: 641139 - RNA, 22 nt, Human
ccuggccaacaugguaacaccc

SEQ ID NO: 641140 - RNA, 24 nt, Human
ccuggccaacaugguaacacccug

SEQ ID NO: 641141 - RNA, 20 nt, Human
ccugggugacagagugagac

SEQ ID NO: 641142 - RNA, 19 nt, Human
ccuguaaucccagcaccuu

SEQ ID NO: 641143 - RNA, 19 nt, Human
ccuguaaucccaguuacuc

SEQ ID NO: 641144 - RNA, 21 nt, Human
ccuguaaucccaguuacucag

SEQ ID NO: 641145 - RNA, 22 nt, Human
ccuguaaucccaguuacucagg

SEQ ID NO: 641146 - RNA, 24 nt, Human
cgagaccagccuggccaacauggu

SEQ ID NO: 641147 - RNA, 20 nt, Human
cgaggcggucggaucaccug

SEQ ID NO: 641148 - RNA, 26 nt, Human
cgaggcggucggaucaccugagguca

SEQ ID NO: 641149 - RNA, 24 nt, Human
cgccacugcaccccagccgggugc

SEQ ID NO: 641150 - RNA, 26 nt, Human
cgccacugcaccccagccugggugac

SEQ ID NO: 641151 - RNA, 24 nt, Human
cggaucaccugaggucaggaguuc

SEQ ID NO: 641152 - RNA, 27 nt, Human
cggaucaccugaggucaggaguucgag

SEQ ID NO: 641153 - RNA, 24 nt, Human
cggucggaucaccugaggucagga

SEQ ID NO: 641154 - RNA, 24 nt, Human
cuagugguaccuccuuccaucucc

SEQ ID NO: 641155 - RNA, 18 nt, Human
cucaaaaaaaaaaaaaaa

SEQ ID NO: 641156 - RNA, 24 nt, Human
cucaaaaaaaaaaaaaaaagcaca

SEQ ID NO: 641157 - RNA, 25 nt, Human
cucaaaaaaaaaaaaaaaagcacaa

SEQ ID NO: 641158 - RNA, 23 nt, Human
cucacaccuguaaucccagcacc

SEQ ID NO: 641159 - RNA, 24 nt, Human
cucacaccuguaaucccagcaccu

SEQ ID NO: 641160 - RNA, 18 nt, Human
cuccaaaaccagcaaggc

SEQ ID NO: 641161 - RNA, 19 nt, Human
cucuggccagcagggaaag

SEQ ID NO: 641162 - RNA, 21 nt, Human
cugcugugcaccccacuuccu

SEQ ID NO: 641163 - RNA, 18 nt, Human
cuggccagcagggaaagg

SEQ ID NO: 641164 - RNA, 19 nt, Human
cuggccagcagggaaaggu

SEQ ID NO: 641165 - RNA, 23 nt, Human
cuggcuugccggccccuaaccug

SEQ ID NO: 641166 - RNA, 22 nt, Human
cugucucaaaaaaaaaaaaaaa

SEQ ID NO: 641167 - RNA, 24 nt, Human
cuguuuccacaaaaaauacagaaa

SEQ ID NO: 641168 - RNA, 25 nt, Human
cuguuuccacaaaaaauacagaaag

SEQ ID NO: 641169 - RNA, 21 nt, Human
cuuuuuggcaccagagaccgg

SEQ ID NO: 641170 - RNA, 24 nt, Human
gacugcuugcaauccuugacuagu

SEQ ID NO: 641171 - RNA, 24 nt, Human
gagcuuguuuuccugcaacuagac

SEQ ID NO: 641172 - RNA, 21 nt, Human
gaguuugcagugagccgagau

SEQ ID NO: 641173 - RNA, 21 nt, Human
gaucaccugaggucaggaguu

SEQ ID NO: 641174 - RNA, 24 nt, Human
gaucaccugaggucaggaguucga

SEQ ID NO: 641175 - RNA, 24 nt, Human
gauggcucacaccuguaaucccag

SEQ ID NO: 641176 - RNA, 23 nt, Human
gcaucaaaaaaaaaaaaaaaaaa

SEQ ID NO: 641177 - RNA, 21 nt, Human
gccaacaugguaacacccugu

SEQ ID NO: 641178 - RNA, 24 nt, Human
gccacugcaccccagccuggguga

SEQ ID NO: 641179 - RNA, 18 nt, Human
ggaguuugcagugagccg

SEQ ID NO: 641180 - RNA, 23 nt, Human
ggaucaccugaggucaggaguuc

SEQ ID NO: 641181 - RNA, 24 nt, Human
gguggcguaugccuguaaucccag

SEQ ID NO: 641182 - RNA, 24 nt, Human
guaacacccuguuuccacaaaaaa

SEQ ID NO: 641183 - RNA, 24 nt, Human
guaccuccuuccaucuccaaaacc

SEQ ID NO: 641184 - RNA, 22 nt, Human
gugacagagugagacugucuca

SEQ ID NO: 641185 - RNA, 23 nt, Human
guggcguaugccuguaaucccag

SEQ ID NO: 641186 - RNA, 22 nt, Human
uaaauaagaaaucccaccccau

SEQ ID NO: 641187 - RNA, 24 nt, Human
uaaggagcgugcaaccuacauccc

SEQ ID NO: 641188 - RNA, 24 nt, Human
uacagaugaagcuucgcuggcuug

SEQ ID NO: 641189 - RNA, 25 nt, Human
uacuggucuguguccggaguguugg

SEQ ID NO: 641190 - RNA, 21 nt, Human
uagugguaccuccuuccaucu

SEQ ID NO: 641191 - RNA, 23 nt, Human
uauaaauacagaugaagcuucgc

SEQ ID NO: 641192 - RNA, 22 nt, Human
uauugugcacuuuauuucuacu

SEQ ID NO: 641193 - RNA, 21 nt, Human
ucaaaaaaaaaaaaaaaaaaa

SEQ ID NO: 641194 - RNA, 20 nt, Human
ucaccugaggucaggaguuc

SEQ ID NO: 641195 - RNA, 23 nt, Human
ucagccaggcaugauggcucaca

SEQ ID NO: 641196 - RNA, 18 nt, Human
ucagugggagcccugagc

SEQ ID NO: 641197 - RNA, 18 nt, Human
uccagcuuuuccagaagc

SEQ ID NO: 641198 - RNA, 22 nt, Human
ucccaccccauaaaccgaacaa

SEQ ID NO: 641199 - RNA, 19 nt, Human
ucccacuccuaauaucuaa

SEQ ID NO: 641200 - RNA, 24 nt, Human
ucccucgugugugcaguucacaau

SEQ ID NO: 641201 - RNA, 18 nt, Human
ucgcuugaacccgggagg

SEQ ID NO: 641202 - RNA, 22 nt, Human
ucgcuugaacccgggaggcgga

SEQ ID NO: 641203 - RNA, 18 nt, Human
ucucaaaaaaaaaaaaaa

SEQ ID NO: 641204 - RNA, 27 nt, Human
ucucaaaaaaaaaaaaaaaagcacaac

SEQ ID NO: 641205 - RNA, 21 nt, Human
ugaaauaaguagucauuuaca

SEQ ID NO: 641206 - RNA, 23 nt, Human
ugacagagugagacugucucaaa

SEQ ID NO: 641207 - RNA, 20 nt, Human
ugacaggaggcggagcucgg

SEQ ID NO: 641208 - RNA, 22 nt, Human
ugagccgagauagcgccacugc

SEQ ID NO: 641209 - RNA, 24 nt, Human
ugaggcaggagagucgcuugaacc

SEQ ID NO: 641210 - RNA, 25 nt, Human
ugaggcaggagagucgcuugaaccc

SEQ ID NO: 641211 - RNA, 24 nt, Human
ugauggcucacaccuguaauccca

SEQ ID NO: 641212 - RNA, 19 nt, Human
ugcauuuauugugcacuuu

SEQ ID NO: 641213 - RNA, 19 nt, Human
ugccggccccuaaccugcu

SEQ ID NO: 641214 - RNA, 24 nt, Human
ugccuguaaucccaguuacucagg

SEQ ID NO: 641215 - RNA, 20 nt, Human
ugcuaugagaaucuaaugcc

SEQ ID NO: 641216 - RNA, 20 nt, Human
ugcugugcaccccacuuccu

SEQ ID NO: 641217 - RNA, 22 nt, Human
uggaccacuacuggucuguguc

SEQ ID NO: 641218 - RNA, 18 nt, Human
uggacugggcccacccag

SEQ ID NO: 641219 - RNA, 21 nt, Human
uggacuuucugucccacuccu

SEQ ID NO: 641220 - RNA, 22 nt, Human
uggauuggggucggggagggau

SEQ ID NO: 641221 - RNA, 25 nt, Human
uggauuggggucggggagggauggu

SEQ ID NO: 641222 - RNA, 24 nt, Human
uggccaacaugguaacacccuguu

SEQ ID NO: 641223 - RNA, 21 nt, Human
uggcguaugccuguaauccca

SEQ ID NO: 641224 - RNA, 22 nt, Human
uggcguaugccuguaaucccag

SEQ ID NO: 641225 - RNA, 24 nt, Human
uggcguaugccuguaaucccaguu

SEQ ID NO: 641226 - RNA, 25 nt, Human
uggcuauaaauacagaugaagcuuc

SEQ ID NO: 641227 - RNA, 21 nt, Human
uggcucacaccuguaauccca

SEQ ID NO: 641228 - RNA, 24 nt, Human
uggcucacaccuguaaucccagca

SEQ ID NO: 641229 - RNA, 19 nt, Human
ugggaggccgaggcggucg

SEQ ID NO: 641230 - RNA, 24 nt, Human
ugggaggccgaggcggucggauca

SEQ ID NO: 641231 - RNA, 20 nt, Human
uggggucggggagggauggu

SEQ ID NO: 641232 - RNA, 24 nt, Human
ugguggcguaugccuguaauccca

SEQ ID NO: 641233 - RNA, 23 nt, Human
uucuagagacugcuugcaauccu

SEQ ID NO: 641234 - RNA, 20 nt, Human
uugaaggacucacccaaugg

SEQ ID NO: 641235 - RNA, 22 nt, Human
uugaugacaagauggacuuucu

SEQ ID NO: 641236 - RNA, 19 nt, Human
uugcagugagccgagauag

SEQ ID NO: 641237 - RNA, 22 nt, Human
uugcagugagccgagauagcgc

SEQ ID NO: 641238 - RNA, 19 nt, Human
uugugcacuuuauuucuac

SEQ ID NO: 641239 - RNA, 22 nt, Human
uuuccacaaaaaauacagaaaa

SEQ ID NO: 641240 - RNA, 18 nt, Human
uuugcagugagccgagau

SEQ ID NO: 641241 - RNA, 24 nt, Human
uuugcagugagccgagauagcgcc

SEQ ID NO: 641242 - RNA, 22 nt, Human
aaaccaaauacugcauguucuc

SEQ ID NO: 641243 - RNA, 20 nt, Human
aaaguauugaaaaaaaagaa

SEQ ID NO: 641244 - RNA, 21 nt, Human
aaagugcuuugucuggcacca

SEQ ID NO: 641245 - RNA, 22 nt, Human
aacacaagaacagaaaaccaaa

SEQ ID NO: 641246 - RNA, 19 nt, Human
aaccugcacauucugcaca

SEQ ID NO: 641247 - RNA, 21 nt, Human
aauacugcucucuuaagaguu

SEQ ID NO: 641248 - RNA, 20 nt, Human
aauagaagacaucuucugga

SEQ ID NO: 641249 - RNA, 23 nt, Human
acaaagauuccucaaggaucuag

SEQ ID NO: 641250 - RNA, 25 nt, Human
acacaauugggaaaugucuccaauc

SEQ ID NO: 641251 - RNA, 21 nt, Human
acacggaugaacaggaaacca

SEQ ID NO: 641252 - RNA, 19 nt, Human
acacuggagcccaucgggg

SEQ ID NO: 641253 - RNA, 18 nt, Human
accaaauacugcauguuc

SEQ ID NO: 641254 - RNA, 19 nt, Human
acucucuccaucuuucucu

SEQ ID NO: 641255 - RNA, 20 nt, Human
agaaaaccaaauacugcaug

SEQ ID NO: 641256 - RNA, 25 nt, Human
agaauagaagacaucuucuggaugu

SEQ ID NO: 641257 - RNA, 22 nt, Human
agacuuggaaccaaccccagug

SEQ ID NO: 641258 - RNA, 22 nt, Human
agauuccucaaggaucuagaac

SEQ ID NO: 641259 - RNA, 22 nt, Human
agcccuaucuccuaaaucaaaa

SEQ ID NO: 641260 - RNA, 25 nt, Human
auucugcacauguaucccagaacuu

SEQ ID NO: 641261 - RNA, 23 nt, Human
caaaaaaugggugaaggauauga

SEQ ID NO: 641262 - RNA, 21 nt, Human
caagaacagaaaaccaaauac

SEQ ID NO: 641263 - RNA, 24 nt, Human
caagaacagaaaaccaaauacugc

SEQ ID NO: 641264 - RNA, 21 nt, Human
caagguaacaguccaggcauu

SEQ ID NO: 641265 - RNA, 21 nt, Human
caauagcaaagacuuggaacc

SEQ ID NO: 641266 - RNA, 19 nt, Human
cacaagaacagaaaaccaa

SEQ ID NO: 641267 - RNA, 20 nt, Human
caccauggcaaaggggauac

SEQ ID NO: 641268 - RNA, 18 nt, Human
cagaaaaccaaauacugc

SEQ ID NO: 641269 - RNA, 21 nt, Human
cagauaaaaaacucgucucau

SEQ ID NO: 641270 - RNA, 19 nt, Human
caggacacaacagaugcug

SEQ ID NO: 641271 - RNA, 25 nt, Human
cauauacaccauggaauauuaugca

SEQ ID NO: 641272 - RNA, 19 nt, Human
caucucacgccagugagaa

SEQ ID NO: 641273 - RNA, 24 nt, Human
cauuuuauagcccuaucuccuaaa

SEQ ID NO: 641274 - RNA, 21 nt, Human
ccaaccccagugcccaucagc

SEQ ID NO: 641275 - RNA, 22 nt, Human
ccaucagcaaacuaacacaaga

SEQ ID NO: 641276 - RNA, 20 nt, Human
ccaucccucacacucaaaag

SEQ ID NO: 641277 - RNA, 19 nt, Human
cgccagugagaauagugau

SEQ ID NO: 641278 - RNA, 23 nt, Human
cuagacacagaccugcccugaca

SEQ ID NO: 641279 - RNA, 21 nt, Human
cucccaugugaauggucugcu

SEQ ID NO: 641280 - RNA, 21 nt, Human
cucuccaucuuucucuuucuc

SEQ ID NO: 641281 - RNA, 23 nt, Human
cucucuccaucuuucucuuucuc

SEQ ID NO: 641282 - RNA, 24 nt, Human
cucucuccaucuuucucuuucucc

SEQ ID NO: 641283 - RNA, 24 nt, Human
cugcuaucaccauggcaaagggga

SEQ ID NO: 641284 - RNA, 19 nt, Human
cuggcacacaauugggaaa

SEQ ID NO: 641285 - RNA, 20 nt, Human
gaaaccaucagcaaacuaac

SEQ ID NO: 641286 - RNA, 20 nt, Human
gaaauaccauuugaccagca

SEQ ID NO: 641287 - RNA, 22 nt, Human
gaacagaaaaccaaauacugca

SEQ ID NO: 641288 - RNA, 22 nt, Human
gaacuuaaaguauugaaaaaaa

SEQ ID NO: 641289 - RNA, 23 nt, Human
gagaaacaggaauacuuuuacac

SEQ ID NO: 641290 - RNA, 22 nt, Human
gagaaaugcaaaucaaaaccac

SEQ ID NO: 641291 - RNA, 19 nt, Human
ggggagggauagcauuagg

SEQ ID NO: 641292 - RNA, 22 nt, Human
ggggguggggaggggaaccaag

SEQ ID NO: 641293 - RNA, 22 nt, Human
ggggguggggaggggaaccaag

SEQ ID NO: 641294 - RNA, 22 nt, Human
ggggguggggaggggaaccaag

SEQ ID NO: 641295 - RNA, 23 nt, Human
gggguggggaggggaaccaaguu

SEQ ID NO: 641296 - RNA, 19 nt, Human
gggguugggggcuagggga

SEQ ID NO: 641297 - RNA, 23 nt, Human
gggguugggggcuaggggaggga

SEQ ID NO: 641298 - RNA, 20 nt, Human
gguggggaggggaaccaagu

SEQ ID NO: 641299 - RNA, 25 nt, Human
gugaauggucugcuaucaccauggc

SEQ ID NO: 641300 - RNA, 18 nt, Human
guguguguguguguugug

SEQ ID NO: 641301 - RNA, 18 nt, Human
uaaagaaaauguggcaca

SEQ ID NO: 641302 - RNA, 21 nt, Human
uaacuagcauacucuaaguac

SEQ ID NO: 641303 - RNA, 20 nt, Human
uagaaagugugugugugugu

SEQ ID NO: 641304 - RNA, 18 nt, Human
uagaagacaucuucugga

SEQ ID NO: 641305 - RNA, 25 nt, Human
uagaauagaagacaucuucuggaug

SEQ ID NO: 641306 - RNA, 21 nt, Human
uagcccuaucuccuaaaucaa

SEQ ID NO: 641307 - RNA, 20 nt, Human
uaggagaaauaccuaaggua

SEQ ID NO: 641308 - RNA, 26 nt, Human
uagguuucuaacucauagggauguuu

SEQ ID NO: 641309 - RNA, 21 nt, Human
uaugaacagacacuucucaaa

SEQ ID NO: 641310 - RNA, 21 nt, Human
uauuaaaucugaccaugcacc

SEQ ID NO: 641311 - RNA, 19 nt, Human
uauuaugcagccauaaaaa

SEQ ID NO: 641312 - RNA, 19 nt, Human
ucaaaacuuugccucagug

SEQ ID NO: 641313 - RNA, 22 nt, Human
ucagcaaacuaacacaagaaca

SEQ ID NO: 641314 - RNA, 22 nt, Human
ucauucuacuaaagacacaugc

SEQ ID NO: 641315 - RNA, 25 nt, Human
uccuuugcagggacacggaugaaca

SEQ ID NO: 641316 - RNA, 28 nt, Human
ucuccaucuuucucuuucuccucugaag

SEQ ID NO: 641317 - RNA, 21 nt, Human
ucuguuagaauagaagacauc

SEQ ID NO: 641318 - RNA, 21 nt, Human
ugaaggggaaccacauauggg

SEQ ID NO: 641319 - RNA, 22 nt, Human
ugaaggggaaccacauauggga

SEQ ID NO: 641320 - RNA, 18 nt, Human
ugaccaugcaccuagaca

SEQ ID NO: 641321 - RNA, 19 nt, Human
ugagaaauuccuaagccuu

SEQ ID NO: 641322 - RNA, 20 nt, Human
ugagauaacaucucacgcca

SEQ ID NO: 641323 - RNA, 18 nt, Human
ugauggguuggugggugc

SEQ ID NO: 641324 - RNA, 19 nt, Human
ugcugaagaggauguagag

SEQ ID NO: 641325 - RNA, 20 nt, Human
uggauaaagaaaauguggca

SEQ ID NO: 641326 - RNA, 27 nt, Human
uguauaccuauguaacaaaccugcaca

SEQ ID NO: 641327 - RNA, 18 nt, Human
ugucaggacacaacagau

SEQ ID NO: 641328 - RNA, 23 nt, Human
uguguguguguguuguggggggg

SEQ ID NO: 641329 - RNA, 22 nt, Human
uuacuggguauauacccaaagg

SEQ ID NO: 641330 - RNA, 21 nt, Human
uuagagaaaugcaaaucaaaa

SEQ ID NO: 641331 - RNA, 23 nt, Human
uuagagaaaugcaaaucaaaacc

SEQ ID NO: 641332 - RNA, 21 nt, Human
uucucacucauaagugggaau

SEQ ID NO: 641333 - RNA, 23 nt, Human
uucuuagaaagugugugugugug

SEQ ID NO: 641334 - RNA, 22 nt, Human
uuugaccagcaaucccauuacu

SEQ ID NO: 641335 - RNA, 20 nt, Human
uuuuuuuuuuuuagguuucu

SEQ ID NO: 641336 - RNA, 22 nt, Human
uuuuuuuuuuuuuuuuuuuagg

SEQ ID NO: 641337 - RNA, 18 nt, Human
aaagguuuagggccagug

SEQ ID NO: 641338 - RNA, 18 nt, Human
aaaugccacaugcuuugg

SEQ ID NO: 641339 - RNA, 19 nt, Human
agaggcucuuugagaggag

SEQ ID NO: 641340 - RNA, 19 nt, Human
aggaggccacagagggaaa

SEQ ID NO: 641341 - RNA, 21 nt, Human
aggagggggaggcaagguugg

SEQ ID NO: 641342 - RNA, 19 nt, Human
aggcaagguugguaguggu

SEQ ID NO: 641343 - RNA, 22 nt, Human
aggcaggaggggaagcuuccaa

SEQ ID NO: 641344 - RNA, 20 nt, Human
aggcaggaggggaagcuugg

SEQ ID NO: 641345 - RNA, 23 nt, Human
aggcaggaggggaagcuugggac

SEQ ID NO: 641346 - RNA, 21 nt, Human
auaccauuguggcaaaggggg

SEQ ID NO: 641347 - RNA, 20 nt, Human
auuggaggggucagugcugu

SEQ ID NO: 641348 - RNA, 22 nt, Human
caagccaucauaccauuguggc

SEQ ID NO: 641349 - RNA, 26 nt, Human
cagcuaugcccauuccucugccucca

SEQ ID NO: 641350 - RNA, 19 nt, Human
caucuggauggcgacaccc

SEQ ID NO: 641351 - RNA, 19 nt, Human
cauuguggcaaagggggca

SEQ ID NO: 641352 - RNA, 21 nt, Human
ccgcugaaguugaggcgcagg

SEQ ID NO: 641353 - RNA, 22 nt, Human
cugccucgaggggcuaccaagc

SEQ ID NO: 641354 - RNA, 21 nt, Human
cuuugagaggagggggaggca

SEQ ID NO: 641355 - RNA, 27 nt, Human
cuuugagaggagggggaggcaagguug

SEQ ID NO: 641356 - RNA, 19 nt, Human
gaagugcaagguggcacaa

SEQ ID NO: 641357 - RNA, 24 nt, Human
gagcagugcaagccaggaggccac

SEQ ID NO: 641358 - RNA, 22 nt, Human
gaggaugaggagagagcaccaa

SEQ ID NO: 641359 - RNA, 23 nt, Human
gauuccagacucaguccugguca

SEQ ID NO: 641360 - RNA, 21 nt, Human
ggagcagugcaagccaggagg

SEQ ID NO: 641361 - RNA, 19 nt, Human
ggcaugaggaugaggagag

SEQ ID NO: 641362 - RNA, 20 nt, Human
ggcgugggggcaugcaggaa

SEQ ID NO: 641363 - RNA, 18 nt, Human
gggcaugaggaugaggag

SEQ ID NO: 641364 - RNA, 18 nt, Human
gugagccccuuggugaca

SEQ ID NO: 641365 - RNA, 20 nt, Human
uaauagcagcaagucaggug

SEQ ID NO: 641366 - RNA, 19 nt, Human
uaccauuguggcaaagggg

SEQ ID NO: 641367 - RNA, 23 nt, Human
uagcagcaagucaggugcaucug

SEQ ID NO: 641368 - RNA, 21 nt, Human
uccuucuagcugaauggagag

SEQ ID NO: 641369 - RNA, 19 nt, Human
ucuagagggagcagugcaa

SEQ ID NO: 641370 - RNA, 24 nt, Human
ugaaggaaucuuucuagagggagc

SEQ ID NO: 641371 - RNA, 22 nt, Human
ugagaggagggggaggcaaggu

SEQ ID NO: 641372 - RNA, 26 nt, Human
ugagaggagggggaggcaagguuggu

SEQ ID NO: 641373 - RNA, 19 nt, Human
ugauucaccaucuuuaacu

SEQ ID NO: 641374 - RNA, 18 nt, Human
ugccacaugcuuuggucc

SEQ ID NO: 641375 - RNA, 18 nt, Human
ugcccagcaggcgugggg

SEQ ID NO: 641376 - RNA, 20 nt, Human
ugcccauuccucugccucca

SEQ ID NO: 641377 - RNA, 20 nt, Human
uggcacaaacgagccagcaa

SEQ ID NO: 641378 - RNA, 18 nt, Human
uggcagacauaagaugug

SEQ ID NO: 641379 - RNA, 19 nt, Human
uggcauggcagacauaaga

SEQ ID NO: 641380 - RNA, 24 nt, Human
ugguagaaggcacacggcuuuuua

SEQ ID NO: 641381 - RNA, 21 nt, Human
uuuuuugguagaaggcacacg

SEQ ID NO: 641382 - RNA, 21 nt, Human
uuuuuuuuuuugguagaaggc

SEQ ID NO: 641383 - RNA, 20 nt, Human
uuuuuuuuuuuuuuuuuggu

SEQ ID NO: 641384 - RNA, 22 nt, Human
uuuuuuuuuuuuuuuuugguag

SEQ ID NO: 641385 - RNA, 21 nt, Human
aagugagccccagccaacuga

SEQ ID NO: 641386 - RNA, 22 nt, Human
cauguguauuuucccacuuuca

SEQ ID NO: 641387 - RNA, 24 nt, Human
cccacuuucauuaaucucuucuuu

SEQ ID NO: 641388 - RNA, 23 nt, Human
cccgccgccgcguccucccgggc

SEQ ID NO: 641389 - RNA, 19 nt, Human
cccgcugcccuagcccugc

SEQ ID NO: 641390 - RNA, 23 nt, Human
cccuagcccugcgcccccagguu

SEQ ID NO: 641391 - RNA, 20 nt, Human
ccgccgcguccucccgggcc

SEQ ID NO: 641392 - RNA, 18 nt, Human
ccgcgucccguugccaag

SEQ ID NO: 641393 - RNA, 20 nt, Human
ccgcugcccuagcccugcgc

SEQ ID NO: 641394 - RNA, 21 nt, Human
cgucccguugccaagugagcc

SEQ ID NO: 641395 - RNA, 22 nt, Human
cguugccaagugagccccagcc

SEQ ID NO: 641396 - RNA, 22 nt, Human
cucccgggccugcguccgcgcc

SEQ ID NO: 641397 - RNA, 23 nt, Human
cugcguccgcgccccucguuccc

SEQ ID NO: 641398 - RNA, 21 nt, Human
cuuuuuaucuuacauacuuuu

SEQ ID NO: 641399 - RNA, 22 nt, Human
gccgccgcguccucccgggccu

SEQ ID NO: 641400 - RNA, 21 nt, Human
gccgugcgggucgggcccgcu

SEQ ID NO: 641401 - RNA, 20 nt, Human
gcgaggggcagcgcuuucca

SEQ ID NO: 641402 - RNA, 24 nt, Human
uaccauguguuuuuuaaguugagg

SEQ ID NO: 641403 - RNA, 20 nt, Human
ucccgccgccgcguccuccc

SEQ ID NO: 641404 - RNA, 18 nt, Human
ucccgcgucccguugcca

SEQ ID NO: 641405 - RNA, 24 nt, Human
ugacccacuugccgaaccgaggca

SEQ ID NO: 641406 - RNA, 20 nt, Human
uggagguaauuucccacugc

SEQ ID NO: 641407 - RNA, 20 nt, Human
uuuuuuuuuuuuagagaaau

SEQ ID NO: 641408 - RNA, 27 nt, Human
aaaacaaaagcaaacacaaaaaggcaa

SEQ ID NO: 641409 - RNA, 21 nt, Human
aaacaacaaacaugggugcca

SEQ ID NO: 641410 - RNA, 23 nt, Human
aaacaugggugccaugaaauucu

SEQ ID NO: 641411 - RNA, 20 nt, Human
aaagcaaacacaaaaaggca

SEQ ID NO: 641412 - RNA, 24 nt, Human
aaaguguugggcuuacaggcauga

SEQ ID NO: 641413 - RNA, 23 nt, Human
aaaguuacgaccugaggugaaag

SEQ ID NO: 641414 - RNA, 22 nt, Human
aacaaaacacaugcugcuccuu

SEQ ID NO: 641415 - RNA, 24 nt, Human
aaccaagcaaacacaucugaacua

SEQ ID NO: 641416 - RNA, 20 nt, Human
aaccaugaucaugcacagca

SEQ ID NO: 641417 - RNA, 24 nt, Human
aagcaaacacaaaaaggcaaauca

SEQ ID NO: 641418 - RNA, 27 nt, Human
aagcagaaagcacagagucaagacuuc

SEQ ID NO: 641419 - RNA, 23 nt, Human
aagcuccucccccaaccucuuuu

SEQ ID NO: 641420 - RNA, 22 nt, Human
aaggaaaaggagaaagugggga

SEQ ID NO: 641421 - RNA, 19 nt, Human
aaguggauuauguggaauu

SEQ ID NO: 641422 - RNA, 19 nt, Human
aaugaugcuggugggugcc

SEQ ID NO: 641423 - RNA, 19 nt, Human
acagagcagccaauaccuu

SEQ ID NO: 641424 - RNA, 20 nt, Human
accuagagugcucaguggca

SEQ ID NO: 641425 - RNA, 18 nt, Human
acgggguuucaccagguu

SEQ ID NO: 641426 - RNA, 20 nt, Human
acgggguuucaccagguugg

SEQ ID NO: 641427 - RNA, 24 nt, Human
acgggguuucaccagguuggccag

SEQ ID NO: 641428 - RNA, 18 nt, Human
agaaguucagucaccagg

SEQ ID NO: 641429 - RNA, 20 nt, Human
agagacgggguuucaccagg

SEQ ID NO: 641430 - RNA, 21 nt, Human
agccacucuaagcagaaagca

SEQ ID NO: 641431 - RNA, 19 nt, Human
aggcaauccaccugccuca

SEQ ID NO: 641432 - RNA, 22 nt, Human
aggcaauccaccugccucagcc

SEQ ID NO: 641433 - RNA, 24 nt, Human
aggcaauccaccugccucagccuc

SEQ ID NO: 641434 - RNA, 18 nt, Human
aguauuucuuacaucuau

SEQ ID NO: 641435 - RNA, 23 nt, Human
agucugcagaaauaucauaaaua

SEQ ID NO: 641436 - RNA, 23 nt, Human
agugcguggcacgaucuuggcuc

SEQ ID NO: 641437 - RNA, 21 nt, Human
auuacaggcgcaugccaccau

SEQ ID NO: 641438 - RNA, 22 nt, Human
caacaaagcaaguuagauucuc

SEQ ID NO: 641439 - RNA, 23 nt, Human
caaccuccaccuccuggguucaa

SEQ ID NO: 641440 - RNA, 24 nt, Human
caagcaaacacaucugaacuagaa

SEQ ID NO: 641441 - RNA, 22 nt, Human
caagcgauucuccugucucagc

SEQ ID NO: 641442 - RNA, 18 nt, Human
cacaagacuucccaaagc

SEQ ID NO: 641443 - RNA, 23 nt, Human
cacagagcagccaauaccuuuaa

SEQ ID NO: 641444 - RNA, 23 nt, Human
cacauuuacaaaaaauacagaaa

SEQ ID NO: 641445 - RNA, 19 nt, Human
caccagguuggccagggug

SEQ ID NO: 641446 - RNA, 24 nt, Human
caccagguuggccaggguggucuu

SEQ ID NO: 641447 - RNA, 24 nt, Human
caccaugccagucuaauuuuugua

SEQ ID NO: 641448 - RNA, 22 nt, Human
cacccagguugcagugcguggc

SEQ ID NO: 641449 - RNA, 23 nt, Human
caccugccucagccucccaaagu

SEQ ID NO: 641450 - RNA, 21 nt, Human
cacugcaaccuccaccuccug

SEQ ID NO: 641451 - RNA, 23 nt, Human
cacugcaaccuccaccuccuggg

SEQ ID NO: 641452 - RNA, 26 nt, Human
cagaacaaaacacaugcugcuccuuu

SEQ ID NO: 641453 - RNA, 20 nt, Human
cagccuccuggguagcuggg

SEQ ID NO: 641454 - RNA, 26 nt, Human
caggaucagccaugugguuaacuccu

SEQ ID NO: 641455 - RNA, 21 nt, Human
caguuugcugauuucuucagc

SEQ ID NO: 641456 - RNA, 21 nt, Human
cauccagauuugcccagaagu

SEQ ID NO: 641457 - RNA, 24 nt, Human
ccaaaguguugggcuuacaggcau

SEQ ID NO: 641458 - RNA, 24 nt, Human
ccaccuccuggguucaagcgauuc

SEQ ID NO: 641459 - RNA, 19 nt, Human
ccaccugccucagccuccc

SEQ ID NO: 641460 - RNA, 20 nt, Human
ccauccagagaacauuugau

SEQ ID NO: 641461 - RNA, 19 nt, Human
ccuccaccuccuggguuca

SEQ ID NO: 641462 - RNA, 24 nt, Human
ccuccuggguucaagcgauucucc

SEQ ID NO: 641463 - RNA, 21 nt, Human
ccucuuugggauccuaaacuu

SEQ ID NO: 641464 - RNA, 22 nt, Human
ccugcagaauuaagcaaucacc

SEQ ID NO: 641465 - RNA, 23 nt, Human
ccuggguagcugggauuacaggc

SEQ ID NO: 641466 - RNA, 24 nt, Human
ccuggguagcugggauuacaggcg

SEQ ID NO: 641467 - RNA, 23 nt, Human
ccuggguucaagcgauucuccug

SEQ ID NO: 641468 - RNA, 21 nt, Human
cgcaugccaccaugccagucu

SEQ ID NO: 641469 - RNA, 24 nt, Human
cgggguuucaccagguuggccagg

SEQ ID NO: 641470 - RNA, 24 nt, Human
cucacugcaaccuccaccuccugg

SEQ ID NO: 641471 - RNA, 26 nt, Human
cucacugcaaccuccaccuccugggu

SEQ ID NO: 641472 - RNA, 24 nt, Human
cucagccuccuggguagcugggau

SEQ ID NO: 641473 - RNA, 21 nt, Human
cuccuggguucaagcgauucu

SEQ ID NO: 641474 - RNA, 22 nt, Human
cuccugucucagccuccugggu

SEQ ID NO: 641475 - RNA, 18 nt, Human
cugcaaccuccaccuccu

SEQ ID NO: 641476 - RNA, 23 nt, Human
cugcaaccuccaccuccuggguu

SEQ ID NO: 641477 - RNA, 24 nt, Human
cugcaaccuccaccuccuggguuc

SEQ ID NO: 641478 - RNA, 18 nt, Human
cugccucagccucccaaa

SEQ ID NO: 641479 - RNA, 24 nt, Human
cugccucagccucccaaaguguug

SEQ ID NO: 641480 - RNA, 20 nt, Human
cuggguagcugggauuacag

SEQ ID NO: 641481 - RNA, 23 nt, Human
cugucucagccuccuggguagcu

SEQ ID NO: 641482 - RNA, 22 nt, Human
cuugaacuacugaccucaggca

SEQ ID NO: 641483 - RNA, 21 nt, Human
cuugcaaaaacaaaagcaaac

SEQ ID NO: 641484 - RNA, 22 nt, Human
gaacaaaacacaugcugcuccu

SEQ ID NO: 641485 - RNA, 24 nt, Human
gaccucaggcaauccaccugccuc

SEQ ID NO: 641486 - RNA, 22 nt, Human
gagaacauuugauuagugguca

SEQ ID NO: 641487 - RNA, 19 nt, Human
gagaacuacaauaaaaaag

SEQ ID NO: 641488 - RNA, 20 nt, Human
gagacgggguuucaccaggu

SEQ ID NO: 641489 - RNA, 18 nt, Human
gauuacaggcgcaugcca

SEQ ID NO: 641490 - RNA, 22 nt, Human
gauuacaggcgcaugccaccau

SEQ ID NO: 641491 - RNA, 21 nt, Human
gauucuccugucucagccucc

SEQ ID NO: 641492 - RNA, 24 nt, Human
gcaauccaccugccucagccuccc

SEQ ID NO: 641493 - RNA, 20 nt, Human
gcaugccaccaugccagucu

SEQ ID NO: 641494 - RNA, 18 nt, Human
gcauuuuuaaggacaaaa

SEQ ID NO: 641495 - RNA, 23 nt, Human
gcgauucuccugucucagccucc

SEQ ID NO: 641496 - RNA, 21 nt, Human
gcuggugggugccucgcaacc

SEQ ID NO: 641497 - RNA, 22 nt, Human
gcuuacaggcaugagccgcugc

SEQ ID NO: 641498 - RNA, 23 nt, Human
ggaaggaaaaggagaaagugggg

SEQ ID NO: 641499 - RNA, 22 nt, Human
ggcuuacaggcaugagccgcug

SEQ ID NO: 641500 - RNA, 23 nt, Human
gggcauuuaguuagcaauuagca

SEQ ID NO: 641501 - RNA, 23 nt, Human
gggguuucaccagguuggccagg

SEQ ID NO: 641502 - RNA, 19 nt, Human
ggugaaaguaacaggaaag

SEQ ID NO: 641503 - RNA, 23 nt, Human
gguggucuugaacuacugaccuc

SEQ ID NO: 641504 - RNA, 29 nt, Human
guaagcuccucccccaaccucuuuuuuuu

SEQ ID NO: 641505 - RNA, 18 nt, Human
guagcugggauuacaggc

SEQ ID NO: 641506 - RNA, 18 nt, Human
guagcugggauuacaggc

SEQ ID NO: 641507 - RNA, 20 nt, Human
gugcaguuagcaacuccugg

SEQ ID NO: 641508 - RNA, 21 nt, Human
uaaaagaaaaacaacccaacc

SEQ ID NO: 641509 - RNA, 27 nt, Human
uaaaagaaaaacaacccaaccaaacaa

SEQ ID NO: 641510 - RNA, 25 nt, Human
uaaacacauuuacaaaaaauacaga

SEQ ID NO: 641511 - RNA, 22 nt, Human
uaaauauauuucauuuaaauuu

SEQ ID NO: 641512 - RNA, 18 nt, Human
uaagaugcaguaaaugug

SEQ ID NO: 641513 - RNA, 18 nt, Human
uaagcagaaagcacagag

SEQ ID NO: 641514 - RNA, 23 nt, Human
uaagcuugcaaaaacaaaagcaa

SEQ ID NO: 641515 - RNA, 19 nt, Human
uaauagagacgggguuuca

SEQ ID NO: 641516 - RNA, 26 nt, Human
uaauagagacgggguuucaccagguu

SEQ ID NO: 641517 - RNA, 24 nt, Human
uaauuuuuguauuuuuaauagaga

SEQ ID NO: 641518 - RNA, 18 nt, Human
uacaauauccaagguaau

SEQ ID NO: 641519 - RNA, 21 nt, Human
uacagaacaaaacacaugcug

SEQ ID NO: 641520 - RNA, 23 nt, Human
uacaggcaugagccgcugcaccc

SEQ ID NO: 641521 - RNA, 20 nt, Human
uaccuuuaauggaaauaacc

SEQ ID NO: 641522 - RNA, 25 nt, Human
uacgaccugaggugaaaguaacagg

SEQ ID NO: 641523 - RNA, 23 nt, Human
uagaguuuugguaacuacguggc

SEQ ID NO: 641524 - RNA, 19 nt, Human
uaugcacaagacuucccaa

SEQ ID NO: 641525 - RNA, 23 nt, Human
ucacugcaaccuccaccuccugg

SEQ ID NO: 641526 - RNA, 24 nt, Human
ucacugcaaccuccaccuccuggg

SEQ ID NO: 641527 - RNA, 25 nt, Human
ucacugcaaccuccaccuccugggu

SEQ ID NO: 641528 - RNA, 27 nt, Human
ucacugcaaccuccaccuccuggguuc

SEQ ID NO: 641529 - RNA, 20 nt, Human
ucagccuccuggguagcugg

SEQ ID NO: 641530 - RNA, 23 nt, Human
ucagucaccaggaucagccaugu

SEQ ID NO: 641531 - RNA, 18 nt, Human
ucauagggagagccucuu

SEQ ID NO: 641532 - RNA, 26 nt, Human
uccacccuuauuaaaccaaccccuag

SEQ ID NO: 641533 - RNA, 24 nt, Human
ucccaaaguguugggcuuacaggc

SEQ ID NO: 641534 - RNA, 24 nt, Human
uccuggguagcugggauuacaggc

SEQ ID NO: 641535 - RNA, 21 nt, Human
uccuggguucaagcgauucuc

SEQ ID NO: 641536 - RNA, 24 nt, Human
uccuggguucaagcgauucuccug

SEQ ID NO: 641537 - RNA, 19 nt, Human
ucucgcucugucacccagg

SEQ ID NO: 641538 - RNA, 22 nt, Human
ucucgcucugucacccagguug

SEQ ID NO: 641539 - RNA, 23 nt, Human
ucucgcucugucacccagguugc

SEQ ID NO: 641540 - RNA, 24 nt, Human
ucucgcucugucacccagguugca

SEQ ID NO: 641541 - RNA, 19 nt, Human
ucugucacccagguugcag

SEQ ID NO: 641542 - RNA, 21 nt, Human
ucugucuguauaacccagaga

SEQ ID NO: 641543 - RNA, 21 nt, Human
ucuuugggauccuaaacuuga

SEQ ID NO: 641544 - RNA, 22 nt, Human
ucuuuuuuuuuuuugagaugga

SEQ ID NO: 641545 - RNA, 21 nt, Human
ugaaagcuuuuaaaaauagag

SEQ ID NO: 641546 - RNA, 18 nt, Human
ugaaaguaacaggaaaga

SEQ ID NO: 641547 - RNA, 22 nt, Human
ugaccacuuaaaagaaaaacaa

SEQ ID NO: 641548 - RNA, 21 nt, Human
ugaccucaggcaauccaccug

SEQ ID NO: 641549 - RNA, 22 nt, Human
ugagauggagucucgcucuguc

SEQ ID NO: 641550 - RNA, 18 nt, Human
ugaggugaaaguaacagg

SEQ ID NO: 641551 - RNA, 21 nt, Human
ugaucaugcacagcaagcuuu

SEQ ID NO: 641552 - RNA, 21 nt, Human
ugcagaaaauccaaauagauu

SEQ ID NO: 641553 - RNA, 23 nt, Human
ugcagugcguggcacgaucuugg

SEQ ID NO: 641554 - RNA, 24 nt, Human
ugccucagccucccaaaguguugg

SEQ ID NO: 641555 - RNA, 21 nt, Human
uggccaggguggucuugaacu

SEQ ID NO: 641556 - RNA, 21 nt, Human
uggcugagaagaucaacauua

SEQ ID NO: 641557 - RNA, 21 nt, Human
ugggauuacaggcgcaugcca

SEQ ID NO: 641558 - RNA, 22 nt, Human
ugggauuacaggcgcaugccac

SEQ ID NO: 641559 - RNA, 24 nt, Human
ugggauuacaggcgcaugccacca

SEQ ID NO: 641560 - RNA, 25 nt, Human
ugggauuacaggcgcaugccaccau

SEQ ID NO: 641561 - RNA, 20 nt, Human
ugggcuuacaggcaugagcc

SEQ ID NO: 641562 - RNA, 22 nt, Human
ugggcuuacaggcaugagccgc

SEQ ID NO: 641563 - RNA, 24 nt, Human
ugggcuuacaggcaugagccgcug

SEQ ID NO: 641564 - RNA, 24 nt, Human
ugggcuuacaggcaugagccgcug

SEQ ID NO: 641565 - RNA, 23 nt, Human
uggguucaagcgauucuccuguc

SEQ ID NO: 641566 - RNA, 24 nt, Human
uggguucaagcgauucuccugucu

SEQ ID NO: 641567 - RNA, 19 nt, Human
ugguuaaguggcuaccaga

SEQ ID NO: 641568 - RNA, 24 nt, Human
ugucucagccuccuggguagcugg

SEQ ID NO: 641569 - RNA, 21 nt, Human
ugugguuaacucuucagugga

SEQ ID NO: 641570 - RNA, 20 nt, Human
uuaaaagcaugacacuuuug

SEQ ID NO: 641571 - RNA, 18 nt, Human
uuaauagagacgggguuu

SEQ ID NO: 641572 - RNA, 21 nt, Human
uuacaggcaugagccgcugca

SEQ ID NO: 641573 - RNA, 18 nt, Human
uuagcaauuagcauccag

SEQ ID NO: 641574 - RNA, 23 nt, Human
uucaagcgauucuccugucucag

SEQ ID NO: 641575 - RNA, 18 nt, Human
uucaguggaaucugucca

SEQ ID NO: 641576 - RNA, 23 nt, Human
uugaagcaugcauacaauaucca

SEQ ID NO: 641577 - RNA, 24 nt, Human
uugaagcaugcauacaauauccaa

SEQ ID NO: 641578 - RNA, 22 nt, Human
uugcugauuucuucagcuaugu

SEQ ID NO: 641579 - RNA, 21 nt, Human
uuggacucuucuuuccacccu

SEQ ID NO: 641580 - RNA, 19 nt, Human
uuucaccagguuggccagg

SEQ ID NO: 641581 - RNA, 22 nt, Human
uuugcccagaaguucagucacc

SEQ ID NO: 641582 - RNA, 18 nt, Human
uuuggacucuucuuucca

SEQ ID NO: 641583 - RNA, 21 nt, Human
uuuguucagugacauauugau

SEQ ID NO: 641584 - RNA, 20 nt, Human
uuuucugugaguccugggag

SEQ ID NO: 641585 - RNA, 19 nt, Human
uuuugccucaggaaauucu

SEQ ID NO: 641586 - RNA, 24 nt, Human
uuuuuaauagagacgggguuucac

SEQ ID NO: 641587 - RNA, 20 nt, Human
uuuuuguauuuuuaauagag

SEQ ID NO: 641588 - RNA, 23 nt, Human
uuuuuguauuuuuaauagagacg

SEQ ID NO: 641589 - RNA, 22 nt, Human
uuuuuuuuuuuuuuuuaacagg

SEQ ID NO: 641590 - RNA, 18 nt, Human
aaaaaaccaauagcagcc

SEQ ID NO: 641591 - RNA, 29 nt, Human
aaaaaaccaauagcagccaaaacagaaca

SEQ ID NO: 641592 - RNA, 22 nt, Human
aaaaccacaacuaucagcccug

SEQ ID NO: 641593 - RNA, 28 nt, Human
aaacaagcuuuagagaaagagaaacuga

SEQ ID NO: 641594 - RNA, 19 nt, Human
aaccacaacuaucagcccu

SEQ ID NO: 641595 - RNA, 28 nt, Human
aauacaaaaguauaaaaaaccucuuuaa

SEQ ID NO: 641596 - RNA, 21 nt, Human
agcagccaaaacagaacauuu

SEQ ID NO: 641597 - RNA, 24 nt, Human
agccaaacccgagcgguggaacgc

SEQ ID NO: 641598 - RNA, 18 nt, Human
auacaaaaguauaaaaaa

SEQ ID NO: 641599 - RNA, 22 nt, Human
auagaccaucuuuuuccuuaau

SEQ ID NO: 641600 - RNA, 25 nt, Human
caagcuuuagagaaagagaaacuga

SEQ ID NO: 641601 - RNA, 21 nt, Human
caccacauggccagcuggggg

SEQ ID NO: 641602 - RNA, 21 nt, Human
cacugaaaggaccaaccaguu

SEQ ID NO: 641603 - RNA, 23 nt, Human
cagaacauuuguaaacaaaacca

SEQ ID NO: 641604 - RNA, 24 nt, Human
cuuuaaaaaaccaauagcagccaa

SEQ ID NO: 641605 - RNA, 19 nt, Human
gcccugugcuuaaacacag

SEQ ID NO: 641606 - RNA, 23 nt, Human
gcgcggcuccgggcagcguuccg

SEQ ID NO: 641607 - RNA, 21 nt, Human
gcuggugugaauccauucaaa

SEQ ID NO: 641608 - RNA, 19 nt, Human
gggcccugaacucaccaca

SEQ ID NO: 641609 - RNA, 26 nt, Human
guauaaaaaaccucuuuaaaaaacca

SEQ ID NO: 641610 - RNA, 18 nt, Human
ucugcauucuuuugaaac

SEQ ID NO: 641611 - RNA, 26 nt, Human
ugaaacauaacuauucaaauacaaaa

SEQ ID NO: 641612 - RNA, 18 nt, Human
ugaauccauucaaaacag

SEQ ID NO: 641613 - RNA, 18 nt, Human
uggguaaacgccgcgcgu

SEQ ID NO: 641614 - RNA, 20 nt, Human
ugucaguuacaguucacaua

SEQ ID NO: 641615 - RNA, 25 nt, Human
uuaauauacaauacccaauaucuaa

SEQ ID NO: 641616 - RNA, 22 nt, Human
uucccugauugcugguacuacu

SEQ ID NO: 641617 - RNA, 23 nt, Human
uuuguaaacaaaaccacaacuau

SEQ ID NO: 641618 - RNA, 18 nt, Human
uuuuuuuuuuuugggguc

SEQ ID NO: 641619 - RNA, 18 nt, Human
uuuuuuuuuuuuuuuuug

SEQ ID NO: 641620 - RNA, 22 nt, Human
aaggugccugcuugccggcccc

SEQ ID NO: 641621 - RNA, 20 nt, Human
agcaggacuuuuuguguuuu

SEQ ID NO: 641622 - RNA, 22 nt, Human
aggcgcucauggcuggcuggua

SEQ ID NO: 641623 - RNA, 22 nt, Human
aggcggccuucucaggggcugc

SEQ ID NO: 641624 - RNA, 23 nt, Human
cacggccuggugagucuggugcc

SEQ ID NO: 641625 - RNA, 19 nt, Human
ccauccccaucucuuuccc

SEQ ID NO: 641626 - RNA, 27 nt, Human
ccgaccacggugacagcucccugagcg

SEQ ID NO: 641627 - RNA, 22 nt, Human
ccgccgccgccgccgaccacgg

SEQ ID NO: 641628 - RNA, 18 nt, Human
ccgccgccgccgccgccg

SEQ ID NO: 641629 - RNA, 23 nt, Human
ccgccgccgccgccgccgccgac

SEQ ID NO: 641630 - RNA, 24 nt, Human
ccgccgccgccgccgccgccgccg

SEQ ID NO: 641631 - RNA, 25 nt, Human
ccgccgccgccgccgccgccgccga

SEQ ID NO: 641632 - RNA, 19 nt, Human
ccgcugccuccccacuggc

SEQ ID NO: 641633 - RNA, 21 nt, Human
ccgcugccuccccacuggccc

SEQ ID NO: 641634 - RNA, 20 nt, Human
cgaccacggugacagcuccc

SEQ ID NO: 641635 - RNA, 21 nt, Human
cggccuggugagucuggugcc

SEQ ID NO: 641636 - RNA, 21 nt, Human
cuccaccaccggcucugugcc

SEQ ID NO: 641637 - RNA, 24 nt, Human
cuccaccaccggcucugugccgcc

SEQ ID NO: 641638 - RNA, 20 nt, Human
cucugugccgccgccgccgc

SEQ ID NO: 641639 - RNA, 24 nt, Human
cuuucccgcuagcgcagcuggggg

SEQ ID NO: 641640 - RNA, 19 nt, Human
gaacuuggggccccuagug

SEQ ID NO: 641641 - RNA, 25 nt, Human
gagcacggccuggugagucuggugc

SEQ ID NO: 641642 - RNA, 23 nt, Human
gagggguugaguugaacuugggg

SEQ ID NO: 641643 - RNA, 19 nt, Human
gcccgcacuuccggccucg

SEQ ID NO: 641644 - RNA, 18 nt, Human
gccgccgaccacggugac

SEQ ID NO: 641645 - RNA, 23 nt, Human
gccgccgccgccgccgccgccgg

SEQ ID NO: 641646 - RNA, 22 nt, Human
gccgccgccgccgccgccggcg

SEQ ID NO: 641647 - RNA, 20 nt, Human
ggcuguggcauaaggcacug

SEQ ID NO: 641648 - RNA, 20 nt, Human
gugagucuggugccgcugcc

SEQ ID NO: 641649 - RNA, 20 nt, Human
ucccugagcgcccgcacuuc

SEQ ID NO: 641650 - RNA, 22 nt, Human
ucccugagcgcccgcacuuccg

SEQ ID NO: 641651 - RNA, 26 nt, Human
ucccugagcgcccgcacuuccggccu

SEQ ID NO: 641652 - RNA, 22 nt, Human
ugagcgcccgcacuuccggccu

SEQ ID NO: 641653 - RNA, 24 nt, Human
ugagggguugaguugaacuugggg

SEQ ID NO: 641654 - RNA, 23 nt, Human
ugcaggaaggcgcucauggcugg

SEQ ID NO: 641655 - RNA, 20 nt, Human
ugccgccgccgccgccgccc

SEQ ID NO: 641656 - RNA, 24 nt, Human
uucugcaggaaggcgcucauggcu

SEQ ID NO: 641657 - RNA, 21 nt, Human
uuuuuuuuuuuugaaaggguc

SEQ ID NO: 641658 - RNA, 21 nt, Human
uuuuuuuuuuuuuugaaaggg

SEQ ID NO: 641659 - RNA, 18 nt, Human
uuuuuuuuuuuuuuuuug

SEQ ID NO: 641660 - RNA, 24 nt, Human
uuuuuuuuuuuuuuuuugaaaggg

SEQ ID NO: 641661 - RNA, 22 nt, Human
aaaaaaaccaaacugucuugga

SEQ ID NO: 641662 - RNA, 23 nt, Human
aaaaaaccaaacugucuuggaac

SEQ ID NO: 641663 - RNA, 21 nt, Human
aaaaacuauaccccuugggcc

SEQ ID NO: 641664 - RNA, 25 nt, Human
aaaaggcagaaugacgcugaaagua

SEQ ID NO: 641665 - RNA, 19 nt, Human
aaacagaaaacggaggccc

SEQ ID NO: 641666 - RNA, 23 nt, Human
aaacagaaaacggaggcccagaa

SEQ ID NO: 641667 - RNA, 22 nt, Human
aaacagaaaacggaggcccagg

SEQ ID NO: 641668 - RNA, 23 nt, Human
aaagcacacagcuacucaaacaa

SEQ ID NO: 641669 - RNA, 19 nt, Human
aacaggaccccugagcccc

SEQ ID NO: 641670 - RNA, 25 nt, Human
aacccauccagaauacugcaaccuc

SEQ ID NO: 641671 - RNA, 23 nt, Human
aaccuccugauuugcaaaacaga

SEQ ID NO: 641672 - RNA, 22 nt, Human
aaccuggccuaccuaccagcgg

SEQ ID NO: 641673 - RNA, 28 nt, Human
aaccuggccuaccuaccagcggcugcag

SEQ ID NO: 641674 - RNA, 19 nt, Human
aacuggccucucccucccc

SEQ ID NO: 641675 - RNA, 20 nt, Human
aagaagaugcuagaacucuu

SEQ ID NO: 641676 - RNA, 18 nt, Human
aagcaagacaccccgaca

SEQ ID NO: 641677 - RNA, 22 nt, Human
aagcuaagaaagguacagauac

SEQ ID NO: 641678 - RNA, 22 nt, Human
aaggugcccuggagcuacgggg

SEQ ID NO: 641679 - RNA, 19 nt, Human
aagucccauggaggcccac

SEQ ID NO: 641680 - RNA, 24 nt, Human
aauacugcaaccuccucccacccu

SEQ ID NO: 641681 - RNA, 22 nt, Human
acaaaacccagagacaaaaggc

SEQ ID NO: 641682 - RNA, 25 nt, Human
acaaagcacacagcuacucaaacaa

SEQ ID NO: 641683 - RNA, 21 nt, Human
acacagcuacucaaacaaagc

SEQ ID NO: 641684 - RNA, 21 nt, Human
acagaaggggccaggaggcug

SEQ ID NO: 641685 - RNA, 21 nt, Human
acagagaaaggcagauacaga

SEQ ID NO: 641686 - RNA, 21 nt, Human
acagagccuuuccaacuccaa

SEQ ID NO: 641687 - RNA, 24 nt, Human
acauuugucuguucuguauuuugg

SEQ ID NO: 641688 - RNA, 19 nt, Human
accccucccucugauucac

SEQ ID NO: 641689 - RNA, 21 nt, Human
acccuggggcccagaucucua

SEQ ID NO: 641690 - RNA, 20 nt, Human
accugggcagcuuuaaaaac

SEQ ID NO: 641691 - RNA, 19 nt, Human
acugaucuagcccaaccuc

SEQ ID NO: 641692 - RNA, 22 nt, Human
agaacaaaacccagagacaaaa

SEQ ID NO: 641693 - RNA, 25 nt, Human
agaauuaaaagcaagacaccccgac

SEQ ID NO: 641694 - RNA, 23 nt, Human
agacaaaaggcagaaugagggac

SEQ ID NO: 641695 - RNA, 20 nt, Human
agagagcaaaguaaagaaau

SEQ ID NO: 641696 - RNA, 20 nt, Human
agagccuuuccaacuccaac

SEQ ID NO: 641697 - RNA, 21 nt, Human
agaggguaaaacaguuuggaa

SEQ ID NO: 641698 - RNA, 22 nt, Human
agaggguaaaacaguuuggaaa

SEQ ID NO: 641699 - RNA, 23 nt, Human
agagguaccaagucccauggagg

SEQ ID NO: 641700 - RNA, 23 nt, Human
agcaaaguaaagaaauuggggcu

SEQ ID NO: 641701 - RNA, 19 nt, Human
aggcaagacccuggacacc

SEQ ID NO: 641702 - RNA, 23 nt, Human
aggcaagacccuggacaccugug

SEQ ID NO: 641703 - RNA, 20 nt, Human
aggcagcagaaaaaggggaa

SEQ ID NO: 641704 - RNA, 22 nt, Human
aggcagggacaaagagacacag

SEQ ID NO: 641705 - RNA, 22 nt, Human
auacuaucugccagaaggaucc

SEQ ID NO: 641706 - RNA, 28 nt, Human
auacugcaaccuccucccaaccggaggg

SEQ ID NO: 641707 - RNA, 21 nt, Human
aucgcuuucaccaugcaauga

SEQ ID NO: 641708 - RNA, 24 nt, Human
auggaauagccaggcagcagaaaa

SEQ ID NO: 641709 - RNA, 21 nt, Human
caaaacaaucacuaccuuaga

SEQ ID NO: 641710 - RNA, 21 nt, Human
caaaacagaaaacggaggccc

SEQ ID NO: 641711 - RNA, 22 nt, Human
caaaacccagagacaaaaggca

SEQ ID NO: 641712 - RNA, 24 nt, Human
caaaacccagagacaaaaggcaga

SEQ ID NO: 641713 - RNA, 27 nt, Human
caaagcagcuguguuugccaaaaaaac

SEQ ID NO: 641714 - RNA, 25 nt, Human
caacaagccaaaacucacauaagac

SEQ ID NO: 641715 - RNA, 24 nt, Human
caagacaccccgacaagcuaagaa

SEQ ID NO: 641716 - RNA, 21 nt, Human
caagccccagagaauuaaaag

SEQ ID NO: 641717 - RNA, 18 nt, Human
caaggaaaucauguacag

SEQ ID NO: 641718 - RNA, 22 nt, Human
cacacagcuacucaaacaaagc

SEQ ID NO: 641719 - RNA, 24 nt, Human
caccagaucauucuacuauacagg

SEQ ID NO: 641720 - RNA, 23 nt, Human
caccugggcagcuuuaaaaacaa

SEQ ID NO: 641721 - RNA, 23 nt, Human
cacucagcaaccauccacucagc

SEQ ID NO: 641722 - RNA, 22 nt, Human
cagaaaacggaggcccagaagu

SEQ ID NO: 641723 - RNA, 20 nt, Human
cagauuccagaagggaacaa

SEQ ID NO: 641724 - RNA, 21 nt, Human
cagcagagccugcaaagucuc

SEQ ID NO: 641725 - RNA, 20 nt, Human
caggaacuggccucucccuc

SEQ ID NO: 641726 - RNA, 18 nt, Human
cagggacaaagagacaca

SEQ ID NO: 641727 - RNA, 23 nt, Human
cagggcucuccucgcucaccggg

SEQ ID NO: 641728 - RNA, 24 nt, Human
caguaaagguguuuaaugucuucu

SEQ ID NO: 641729 - RNA, 23 nt, Human
cauacuaucugccagaaggaucc

SEQ ID NO: 641730 - RNA, 23 nt, Human
caugagcauggaauagccaggca

SEQ ID NO: 641731 - RNA, 27 nt, Human
caugcaaugacagauaauggccaugcg

SEQ ID NO: 641732 - RNA, 20 nt, Human
ccacuaagucuugagccaag

SEQ ID NO: 641733 - RNA, 21 nt, Human
ccagaauacugcaaccuccuc

SEQ ID NO: 641734 - RNA, 22 nt, Human
ccaugagcauggaauagccagg

SEQ ID NO: 641735 - RNA, 18 nt, Human
cccagaaguaggaaggcc

SEQ ID NO: 641736 - RNA, 26 nt, Human
ccccagagaauuaaaagcaagacacc

SEQ ID NO: 641737 - RNA, 22 nt, Human
ccccugagccccuucaucagau

SEQ ID NO: 641738 - RNA, 22 nt, Human
cccuggacaccugugccaggga

SEQ ID NO: 641739 - RNA, 22 nt, Human
ccgcuuacacuccauuuuguuu

SEQ ID NO: 641740 - RNA, 24 nt, Human
ccgcuuacacuccauuuuguuuuu

SEQ ID NO: 641741 - RNA, 21 nt, Human
ccucagccagggcucuccucg

SEQ ID NO: 641742 - RNA, 23 nt, Human
ccucucccuccccacucggcuuc

SEQ ID NO: 641743 - RNA, 28 nt, Human
ccucugauucacucagcaaccauccacu

SEQ ID NO: 641744 - RNA, 19 nt, Human
ccugaugccucagccaggg

SEQ ID NO: 641745 - RNA, 25 nt, Human
ccugcaaagucucaaacagcggacc

SEQ ID NO: 641746 - RNA, 20 nt, Human
ccuggagggaggguuccuga

SEQ ID NO: 641747 - RNA, 21 nt, Human
cgagcaaggccuuccucuccc

SEQ ID NO: 641748 - RNA, 19 nt, Human
cgccugggaugacugagag

SEQ ID NO: 641749 - RNA, 22 nt, Human
cuaagaaagguacagauaccau

SEQ ID NO: 641750 - RNA, 20 nt, Human
cuagcaucugcucucgucca

SEQ ID NO: 641751 - RNA, 24 nt, Human
cuauacaggcaagacccuggacac

SEQ ID NO: 641752 - RNA, 19 nt, Human
cucacauaagacaggcagu

SEQ ID NO: 641753 - RNA, 21 nt, Human
cucccagcacugccugccacg

SEQ ID NO: 641754 - RNA, 20 nt, Human
cugagaacaaaacccagaga

SEQ ID NO: 641755 - RNA, 25 nt, Human
cugcgcacaggccucuaccuuuccc

SEQ ID NO: 641756 - RNA, 18 nt, Human
cuggccucucccucccca

SEQ ID NO: 641757 - RNA, 20 nt, Human
cugggaggcagggacaaaga

SEQ ID NO: 641758 - RNA, 18 nt, Human
cuuacaagccccagagaa

SEQ ID NO: 641759 - RNA, 21 nt, Human
cuugacaaagaagaugcuaga

SEQ ID NO: 641760 - RNA, 19 nt, Human
gaaacaagcaaaacaauca

SEQ ID NO: 641761 - RNA, 24 nt, Human
gaaagacacagcagagccugcaaa

SEQ ID NO: 641762 - RNA, 21 nt, Human
gaacuggccucucccucccca

SEQ ID NO: 641763 - RNA, 22 nt, Human
gaagagcaggcaggaacuggcc

SEQ ID NO: 641764 - RNA, 20 nt, Human
gagaacaaaacccagagaca

SEQ ID NO: 641765 - RNA, 18 nt, Human
gagacuucuaccaucaca

SEQ ID NO: 641766 - RNA, 20 nt, Human
gagcaggcaggaacuggccu

SEQ ID NO: 641767 - RNA, 21 nt, Human
gaggcagggacaaagagacac

SEQ ID NO: 641768 - RNA, 24 nt, Human
gaucuagcccaaccuccugauuug

SEQ ID NO: 641769 - RNA, 24 nt, Human
gaugcugagaacaaaacccagaga

SEQ ID NO: 641770 - RNA, 22 nt, Human
gauucacucagcaaccauccac

SEQ ID NO: 641771 - RNA, 24 nt, Human
gcaaaaacuauaccccuugggcca

SEQ ID NO: 641772 - RNA, 23 nt, Human
gccaggcagcagaaaaaggggaa

SEQ ID NO: 641773 - RNA, 21 nt, Human
gcccaaccuccugauuugcaa

SEQ ID NO: 641774 - RNA, 21 nt, Human
gcgcucugggaggcagggaca

SEQ ID NO: 641775 - RNA, 25 nt, Human
gcuccaccccgugccacguuuugcc

SEQ ID NO: 641776 - RNA, 18 nt, Human
gcuuacacuccauuuugu

SEQ ID NO: 641777 - RNA, 23 nt, Human
ggaccuacaacuaacccauccag

SEQ ID NO: 641778 - RNA, 19 nt, Human
ggagaaacaagcaaaacaa

SEQ ID NO: 641779 - RNA, 21 nt, Human
ggccaggaggcugggagugca

SEQ ID NO: 641780 - RNA, 20 nt, Human
ggccucggggacgccgugag

SEQ ID NO: 641781 - RNA, 23 nt, Human
gggucuggacugaggggccucgg

SEQ ID NO: 641782 - RNA, 22 nt, Human
ggguuagaacacagcugguacc

SEQ ID NO: 641783 - RNA, 20 nt, Human
ggugggaggaguggcagaag

SEQ ID NO: 641784 - RNA, 18 nt, Human
gucaagcugugcccaucu

SEQ ID NO: 641785 - RNA, 18 nt, Human
guuuguuuugguucccaa

SEQ ID NO: 641786 - RNA, 21 nt, Human
uaaaagcaagacaccccgaca

SEQ ID NO: 641787 - RNA, 24 nt, Human
uaaggaaaaagucaacauugcaaa

SEQ ID NO: 641788 - RNA, 23 nt, Human
uaagggagagaaaagagggaggg

SEQ ID NO: 641789 - RNA, 20 nt, Human
uaagucuugagccaagaaaa

SEQ ID NO: 641790 - RNA, 22 nt, Human
uaaugaaccuggccuaccuacc

SEQ ID NO: 641791 - RNA, 23 nt, Human
uacagcuuagccgcuuacacucc

SEQ ID NO: 641792 - RNA, 21 nt, Human
uaccaagucccauggaggccc

SEQ ID NO: 641793 - RNA, 19 nt, Human
uaccagaugacacacuucc

SEQ ID NO: 641794 - RNA, 18 nt, Human
uaccccucccucugauuc

SEQ ID NO: 641795 - RNA, 21 nt, Human
uaccuggagggaggguuccug

SEQ ID NO: 641796 - RNA, 28 nt, Human
uacuauacaggcaagacccuggacaccu

SEQ ID NO: 641797 - RNA, 19 nt, Human
uaggauuuggaaucagaga

SEQ ID NO: 641798 - RNA, 18 nt, Human
uagggaccuacaacuaac

SEQ ID NO: 641799 - RNA, 26 nt, Human
uagggaccuacaacuaacccauccag

SEQ ID NO: 641800 - RNA, 19 nt, Human
uaguaaggaaaaagucaac

SEQ ID NO: 641801 - RNA, 28 nt, Human
uauaaaggaaaaacagaaaguuaugaca

SEQ ID NO: 641802 - RNA, 24 nt, Human
uaugggucccacccugagagacuu

SEQ ID NO: 641803 - RNA, 23 nt, Human
ucaacaagccaaaacucacauaa

SEQ ID NO: 641804 - RNA, 21 nt, Human
ucaccagaucauucuacuaua

SEQ ID NO: 641805 - RNA, 19 nt, Human
ucacuaccuuagagagcaa

SEQ ID NO: 641806 - RNA, 21 nt, Human
ucacuggguugcuugcuauaa

SEQ ID NO: 641807 - RNA, 24 nt, Human
ucagaggguaaaacaguuuggaaa

SEQ ID NO: 641808 - RNA, 20 nt, Human
ucagcaaccauccacucagc

SEQ ID NO: 641809 - RNA, 18 nt, Human
uccaacuccaacccaggc

SEQ ID NO: 641810 - RNA, 18 nt, Human
uccccacucggcuucauc

SEQ ID NO: 641811 - RNA, 18 nt, Human
ucuagagacagagaaagg

SEQ ID NO: 641812 - RNA, 23 nt, Human
ucuagagacagagaaaggcagau

SEQ ID NO: 641813 - RNA, 19 nt, Human
ucuagcuacaacagcagag

SEQ ID NO: 641814 - RNA, 23 nt, Human
ucucaaacauggacuauguggcc

SEQ ID NO: 641815 - RNA, 20 nt, Human
ucucucacaugacagcuugu

SEQ ID NO: 641816 - RNA, 18 nt, Human
ugaaagacacagcagagc

SEQ ID NO: 641817 - RNA, 23 nt, Human
ugaaagacacagcagagccugca

SEQ ID NO: 641818 - RNA, 18 nt, Human
ugaaagccaugagcaugg

SEQ ID NO: 641819 - RNA, 18 nt, Human
ugaaaguaggauuuggaa

SEQ ID NO: 641820 - RNA, 24 nt, Human
ugacaucagguuucuucuagaggg

SEQ ID NO: 641821 - RNA, 19 nt, Human
ugacugauagugcauggca

SEQ ID NO: 641822 - RNA, 21 nt, Human
ugagaacaaaacccagagaca

SEQ ID NO: 641823 - RNA, 24 nt, Human
ugagaacaaaacccagagacaaaa

SEQ ID NO: 641824 - RNA, 19 nt, Human
ugcaaagucucaaacaugg

SEQ ID NO: 641825 - RNA, 21 nt, Human
ugcaaccuccucccacccucc

SEQ ID NO: 641826 - RNA, 21 nt, Human
ugcauggaguggccacaagga

SEQ ID NO: 641827 - RNA, 20 nt, Human
ugcgccugggguguggcugc

SEQ ID NO: 641828 - RNA, 21 nt, Human
ugcucuagagcucaaggacac

SEQ ID NO: 641829 - RNA, 23 nt, Human
uggaaaaacacugaucuagccca

SEQ ID NO: 641830 - RNA, 23 nt, Human
uggaauagccaggcagcagaaaa

SEQ ID NO: 641831 - RNA, 18 nt, Human
uggaaucagagaugcgag

SEQ ID NO: 641832 - RNA, 18 nt, Human
uggccucucccuccccac

SEQ ID NO: 641833 - RNA, 30 nt, Human
ugucuacucaacaagccaaaacucacauag

SEQ ID NO: 641834 - RNA, 24 nt, Human
ugugauaaguucauuuuccugcag

SEQ ID NO: 641835 - RNA, 22 nt, Human
uucacucagcaaccauccacuc

SEQ ID NO: 641836 - RNA, 22 nt, Human
uucccagggcugggcgcucugg

SEQ ID NO: 641837 - RNA, 25 nt, Human
uuugccaaaaaaaccaaacugucuu

SEQ ID NO: 641838 - RNA, 22 nt, Human
uuuugggcuuugacaucagguu

SEQ ID NO: 641839 - RNA, 20 nt, Human
aaaagaaaaagaaaauucaa

SEQ ID NO: 641840 - RNA, 19 nt, Human
aacagggugaaaccccauc

SEQ ID NO: 641841 - RNA, 20 nt, Human
aacagggugaaaccccaucu

SEQ ID NO: 641842 - RNA, 21 nt, Human
aacagggugaaaccccaucuc

SEQ ID NO: 641843 - RNA, 20 nt, Human
aaccucugccucccaggcuc

SEQ ID NO: 641844 - RNA, 25 nt, Human
aagaaaaagaaaauucaagacuuau

SEQ ID NO: 641845 - RNA, 23 nt, Human
aaggcgggcagaucacgagguca

SEQ ID NO: 641846 - RNA, 22 nt, Human
aauacaaaggugauagauuaga

SEQ ID NO: 641847 - RNA, 22 nt, Human
acagagcgaggcugucucaaaa

SEQ ID NO: 641848 - RNA, 24 nt, Human
accccaucucuacuaaaaauacaa

SEQ ID NO: 641849 - RNA, 22 nt, Human
acuccagccugggugacagagc

SEQ ID NO: 641850 - RNA, 23 nt, Human
acucugugguccagacuggacug

SEQ ID NO: 641851 - RNA, 24 nt, Human
acugcaguguugcaaucucggcuc

SEQ ID NO: 641852 - RNA, 24 nt, Human
acuguacuccagccugggugacag

SEQ ID NO: 641853 - RNA, 26 nt, Human
acuguacuccagccugggugacagag

SEQ ID NO: 641854 - RNA, 21 nt, Human
agacuucuggauaaauauccu

SEQ ID NO: 641855 - RNA, 25 nt, Human
agccagacuucuggauaguccgggg

SEQ ID NO: 641856 - RNA, 18 nt, Human
aggaauacagaggugugg

SEQ ID NO: 641857 - RNA, 21 nt, Human
aggagcaguggcucacgccug

SEQ ID NO: 641858 - RNA, 24 nt, Human
aggcaggagaauggcaugaaccca

SEQ ID NO: 641859 - RNA, 27 nt, Human
aggcaggagaauggcaugaacccagga

SEQ ID NO: 641860 - RNA, 21 nt, Human
aggcagggcuugcagugagcc

SEQ ID NO: 641861 - RNA, 24 nt, Human
aggcagggcuugcagugagccgag

SEQ ID NO: 641862 - RNA, 23 nt, Human
aggccaaggcgggcagaucacga

SEQ ID NO: 641863 - RNA, 24 nt, Human
aggcgggcagaucacgaggucagg

SEQ ID NO: 641864 - RNA, 19 nt, Human
aggcugaggcaggagaaug

SEQ ID NO: 641865 - RNA, 23 nt, Human
agggcuugcagugagccgagauu

SEQ ID NO: 641866 - RNA, 23 nt, Human
aguggcucacgccugcaauccca

SEQ ID NO: 641867 - RNA, 18 nt, Human
aucaaugguugucugcau

SEQ ID NO: 641868 - RNA, 20 nt, Human
aucacgaggucaggagauuc

SEQ ID NO: 641869 - RNA, 22 nt, Human
augccacuguacuccagccugg

SEQ ID NO: 641870 - RNA, 24 nt, Human
auuaugccacuguacuccagccug

SEQ ID NO: 641871 - RNA, 23 nt, Human
caaauccucccauguagcaaucc

SEQ ID NO: 641872 - RNA, 24 nt, Human
caacacuuugagaggccaaggcgg

SEQ ID NO: 641873 - RNA, 23 nt, Human
caaccucugccucccaggcucaa

SEQ ID NO: 641874 - RNA, 24 nt, Human
cacgccugcaaucccaacacuuug

SEQ ID NO: 641875 - RNA, 18 nt, Human
cacugcaaccucugccuc

SEQ ID NO: 641876 - RNA, 21 nt, Human
cacugcaaccucugccuccca

SEQ ID NO: 641877 - RNA, 19 nt, Human
cacuguacuccagccuggg

SEQ ID NO: 641878 - RNA, 19 nt, Human
cacuguacuccagccuggg

SEQ ID NO: 641879 - RNA, 19 nt, Human
cacuguacuccagccuggg

SEQ ID NO: 641880 - RNA, 22 nt, Human
cacuguacuccagccuggguga

SEQ ID NO: 641881 - RNA, 23 nt, Human
cacuguacuccagccugggugac

SEQ ID NO: 641882 - RNA, 24 nt, Human
cacuguacuccagccugggugaca

SEQ ID NO: 641883 - RNA, 24 nt, Human
cacuguacuccagccugggugaca

SEQ ID NO: 641884 - RNA, 22 nt, Human
cagccagacuucuggauaaaua

SEQ ID NO: 641885 - RNA, 21 nt, Human
caugaacccaggaggcagggc

SEQ ID NO: 641886 - RNA, 19 nt, Human
ccaacacuuugagaggcca

SEQ ID NO: 641887 - RNA, 20 nt, Human
ccacuguacuccagccuggg

SEQ ID NO: 641888 - RNA, 20 nt, Human
ccacuguacuccagccuggg

SEQ ID NO: 641889 - RNA, 20 nt, Human
ccacuguacuccagccuggg

SEQ ID NO: 641890 - RNA, 21 nt, Human
ccacuguacuccagccugggu

SEQ ID NO: 641891 - RNA, 21 nt, Human
ccacuguacuccagccugggu

SEQ ID NO: 641892 - RNA, 23 nt, Human
ccacuguacuccagccuggguga

SEQ ID NO: 641893 - RNA, 24 nt, Human
ccacuguacuccagccugggugac

SEQ ID NO: 641894 - RNA, 21 nt, Human
cccaggcucaagcaaauccuc

SEQ ID NO: 641895 - RNA, 22 nt, Human
cccaggcucaagcaaauccucc

SEQ ID NO: 641896 - RNA, 21 nt, Human
ccuccacagcuguaauggcuu

SEQ ID NO: 641897 - RNA, 24 nt, Human
ccuggcuaacagggugaaacccca

SEQ ID NO: 641898 - RNA, 18 nt, Human
ccugggugacagagcgag

SEQ ID NO: 641899 - RNA, 21 nt, Human
ccuguagucccagcuauuagg

SEQ ID NO: 641900 - RNA, 22 nt, Human
ccuguagucccagcuauuaggg

SEQ ID NO: 641901 - RNA, 22 nt, Human
cgggcagaucacgaggucagga

SEQ ID NO: 641902 - RNA, 24 nt, Human
cucaagcaaauccucccauguagc

SEQ ID NO: 641903 - RNA, 22 nt, Human
cucacgccugcaaucccaacac

SEQ ID NO: 641904 - RNA, 24 nt, Human
cucacgccugcaaucccaacacuu

SEQ ID NO: 641905 - RNA, 24 nt, Human
cucacugcaaccucugccucccag

SEQ ID NO: 641906 - RNA, 24 nt, Human
cucacugcaaccucugccucccag

SEQ ID NO: 641907 - RNA, 26 nt, Human
cucccaggcucaagcaaauccuccca

SEQ ID NO: 641908 - RNA, 23 nt, Human
cucuacuaaaaauacaaaaaagg

SEQ ID NO: 641909 - RNA, 23 nt, Human
cugcaaccucugccucccaggcu

SEQ ID NO: 641910 - RNA, 24 nt, Human
cugcaaccucugccucccaggcuc

SEQ ID NO: 641911 - RNA, 23 nt, Human
cuggcuaacagggugaaacccca

SEQ ID NO: 641912 - RNA, 25 nt, Human
cuuccuggcuaacagggugaaaccc

SEQ ID NO: 641913 - RNA, 24 nt, Human
cuugcagugagccgagauuaugcc

SEQ ID NO: 641914 - RNA, 20 nt, Human
gauuauaagaaaauucaagc

SEQ ID NO: 641915 - RNA, 23 nt, Human
gcaauccucccacaugaaagcuc

SEQ ID NO: 641916 - RNA, 22 nt, Human
gcaggagaauggcaugaaccca

SEQ ID NO: 641917 - RNA, 19 nt, Human
gccacuguacuccagccug

SEQ ID NO: 641918 - RNA, 24 nt, Human
gccacuguacuccagccuggguga

SEQ ID NO: 641919 - RNA, 23 nt, Human
gccucccaggcucaagcaaaucc

SEQ ID NO: 641920 - RNA, 24 nt, Human
gcuaacagggugaaaccccaucuc

SEQ ID NO: 641921 - RNA, 21 nt, Human
ggcagaucacgaggucaggag

SEQ ID NO: 641922 - RNA, 24 nt, Human
guacuccagccugggugacagagc

SEQ ID NO: 641923 - RNA, 22 nt, Human
gucucaaaaaaaagaaaaagaa

SEQ ID NO: 641924 - RNA, 22 nt, Human
gugacagagcgaggcugucuca

SEQ ID NO: 641925 - RNA, 24 nt, Human
uaacagggugaaaccccaucucua

SEQ ID NO: 641926 - RNA, 19 nt, Human
uaauggcuuuuucccccau

SEQ ID NO: 641927 - RNA, 23 nt, Human
uacaucagucagaaaauucuaga

SEQ ID NO: 641928 - RNA, 22 nt, Human
uacuccagccugggugacagag

SEQ ID NO: 641929 - RNA, 24 nt, Human
uacuccagccugggugacagagcg

SEQ ID NO: 641930 - RNA, 24 nt, Human
uagaaaauggaaaguauuauacag

SEQ ID NO: 641931 - RNA, 22 nt, Human
uauaaaggcuccaggugaauac

SEQ ID NO: 641932 - RNA, 18 nt, Human
uaugcagccagacuucug

SEQ ID NO: 641933 - RNA, 22 nt, Human
uauuuuauuuuugaaacagggu

SEQ ID NO: 641934 - RNA, 24 nt, Human
uauuuuauuuuugaaacagggucu

SEQ ID NO: 641935 - RNA, 24 nt, Human
ucaagccaggagcaguggcucacg

SEQ ID NO: 641936 - RNA, 18 nt, Human
ucacgaggucaggagauu

SEQ ID NO: 641937 - RNA, 22 nt, Human
ucacgaggucaggagauugaga

SEQ ID NO: 641938 - RNA, 19 nt, Human
ucacugcaaccucugccuc

SEQ ID NO: 641939 - RNA, 24 nt, Human
ucacugcaaccucugccucccagg

SEQ ID NO: 641940 - RNA, 25 nt, Human
ucacugcaaccucugccucccaggc

SEQ ID NO: 641941 - RNA, 21 nt, Human
uccaaggagagcagaccuuug

SEQ ID NO: 641942 - RNA, 24 nt, Human
uccacagcuguaauggcuuuuucc

SEQ ID NO: 641943 - RNA, 23 nt, Human
uccagccugggugacagagcgag

SEQ ID NO: 641944 - RNA, 24 nt, Human
uccagccugggugacagagcgagg

SEQ ID NO: 641945 - RNA, 19 nt, Human
ucccaggcucaagcaaauc

SEQ ID NO: 641946 - RNA, 23 nt, Human
ucccccaugaaacagagacacac

SEQ ID NO: 641947 - RNA, 23 nt, Human
ucucaaaaaaaagaaaaagaaaa

SEQ ID NO: 641948 - RNA, 24 nt, Human
ucucacucugugguccagacugga

SEQ ID NO: 641949 - RNA, 22 nt, Human
ucucuacuaaaaauacaaaaaa

SEQ ID NO: 641950 - RNA, 18 nt, Human
ucugugguccagacugga

SEQ ID NO: 641951 - RNA, 19 nt, Human
ugaaaccccaucucuacua

SEQ ID NO: 641952 - RNA, 24 nt, Human
ugagaggccaaggcgggcagauca

SEQ ID NO: 641953 - RNA, 22 nt, Human
ugagccgagauuaugccacugu

SEQ ID NO: 641954 - RNA, 23 nt, Human
ugaggcaggagaauggcaugaac

SEQ ID NO: 641955 - RNA, 24 nt, Human
ugaggcaggagaauggcaugaacc

SEQ ID NO: 641956 - RNA, 25 nt, Human
ugaggcaggagaauggcaugaaccc

SEQ ID NO: 641957 - RNA, 23 nt, Human
ugccuguagucccagcuauuagg

SEQ ID NO: 641958 - RNA, 18 nt, Human
uggaaaguauuauacagc

SEQ ID NO: 641959 - RNA, 24 nt, Human
uggacugcaguguugcaaucucgg

SEQ ID NO: 641960 - RNA, 19 nt, Human
uggcuacaaaacugcccaa

SEQ ID NO: 641961 - RNA, 24 nt, Human
uggcucacgccugcaaucccaaca

SEQ ID NO: 641962 - RNA, 19 nt, Human
ugggauuauaagaaaauuc

SEQ ID NO: 641963 - RNA, 24 nt, Human
ugguggugguugccuguaguccca

SEQ ID NO: 641964 - RNA, 23 nt, Human
uguagucccagcuauuagggagg

SEQ ID NO: 641965 - RNA, 18 nt, Human
ugugacucugaugauggu

SEQ ID NO: 641966 - RNA, 23 nt, Human
uuaugccacuguacuccagccug

SEQ ID NO: 641967 - RNA, 22 nt, Human
uucaagccaggagcaguggcuc

SEQ ID NO: 641968 - RNA, 18 nt, Human
uugcagugagccgagauu

SEQ ID NO: 641969 - RNA, 20 nt, Human
uugcagugagccgagauuau

SEQ ID NO: 641970 - RNA, 21 nt, Human
uugcagugagccgagauuaug

SEQ ID NO: 641971 - RNA, 19 nt, Human
uuugcugcaaucacaggau

SEQ ID NO: 641972 - RNA, 23 nt, Human
uuuuauuuuugaaacagggucuc

SEQ ID NO: 641973 - RNA, 23 nt, Human
uuuuuuuuuuuuuuuauaagagg

SEQ ID NO: 641974 - RNA, 18 nt, Human
auaguaagaguuucucuu

SEQ ID NO: 641975 - RNA, 26 nt, Human
caguuuuguuccaugcuggccggggg

SEQ ID NO: 641976 - RNA, 23 nt, Human
cccccgccgccgccaccggcacc

SEQ ID NO: 641977 - RNA, 20 nt, Human
cccgaagccuccugucccgc

SEQ ID NO: 641978 - RNA, 23 nt, Human
ccgccgccgccaccggcaccacc

SEQ ID NO: 641979 - RNA, 25 nt, Human
ccgccgccgccaccggcaccacccg

SEQ ID NO: 641980 - RNA, 24 nt, Human
cucccccgccgccgccaccggcac

SEQ ID NO: 641981 - RNA, 20 nt, Human
uaauaaauaucauaccuucu

SEQ ID NO: 641982 - RNA, 24 nt, Human
ucugcacaugccuuuuuuucuuuu

SEQ ID NO: 641983 - RNA, 20 nt, Human
ucuguacagcauuuuuauug

SEQ ID NO: 641984 - RNA, 18 nt, Human
ugcaaaaacaugaaauug

SEQ ID NO: 641985 - RNA, 20 nt, Human
ugucccagcccaccccuucu

SEQ ID NO: 641986 - RNA, 22 nt, Human
uuuagcagcugcugaguguuug

SEQ ID NO: 641987 - RNA, 24 nt, Human
uuuuuuuuuuuuuaaagauuuuua

SEQ ID NO: 641988 - RNA, 24 nt, Human
acgccgccucggccgccgccgccc

SEQ ID NO: 641989 - RNA, 22 nt, Human
cacuguccggaccacggaaaua

SEQ ID NO: 641990 - RNA, 24 nt, Human
cccccuccccucucagcccagccc

SEQ ID NO: 641991 - RNA, 20 nt, Human
cccgcgccgccacgcacugu

SEQ ID NO: 641992 - RNA, 25 nt, Human
cccgcgccgccacgcacuguccgga

SEQ ID NO: 641993 - RNA, 22 nt, Human
ccgcccccuccccucucagccc

SEQ ID NO: 641994 - RNA, 21 nt, Human
ccgccucggccgccgccgccc

SEQ ID NO: 641995 - RNA, 18 nt, Human
ccgcgccgccacgcacug

SEQ ID NO: 641996 - RNA, 19 nt, Human
ccuccccucucagcccagc

SEQ ID NO: 641997 - RNA, 22 nt, Human
ccuuuccucugccauuugagag

SEQ ID NO: 641998 - RNA, 21 nt, Human
cgcccccuccccucucagcca

SEQ ID NO: 641999 - RNA, 20 nt, Human
cgccgccucggccgccgccg

SEQ ID NO: 642000 - RNA, 23 nt, Human
cgccgccucggccgccgccgccc

SEQ ID NO: 642001 - RNA, 23 nt, Human
cggcacgacucaauguugacauc

SEQ ID NO: 642002 - RNA, 24 nt, Human
cggcacgacucaauguugacauca

SEQ ID NO: 642003 - RNA, 23 nt, Human
cuacggccuuucugcugcucuuc

SEQ ID NO: 642004 - RNA, 20 nt, Human
cucccguggucacccgcgcc

SEQ ID NO: 642005 - RNA, 24 nt, Human
gcacuguccggaccacggaaauaa

SEQ ID NO: 642006 - RNA, 22 nt, Human
gccuacuucucccguggucacc

SEQ ID NO: 642007 - RNA, 18 nt, Human
gcgugcacgcaugcguau

SEQ ID NO: 642008 - RNA, 19 nt, Human
ucccguggucacccgcgcc

SEQ ID NO: 642009 - RNA, 22 nt, Human
ucccguggucacccgcgccgcc

SEQ ID NO: 642010 - RNA, 18 nt, Human
uuuuuuuuuuuuuuuuug

SEQ ID NO: 642011 - RNA, 23 nt, Human
uuuuuuuuuuuuuuuuuguuuuu

SEQ ID NO: 642012 - RNA, 18 nt, Human
aaacaagcauacacacuu

SEQ ID NO: 642013 - RNA, 24 nt, Human
aaacaccaagcauacucaggauca

SEQ ID NO: 642014 - RNA, 25 nt, Human
aaacagcucaugauccuuuaaaagu

SEQ ID NO: 642015 - RNA, 23 nt, Human
aagcccagagaugaaggucagga

SEQ ID NO: 642016 - RNA, 23 nt, Human
aaggccgcaaaaaggcaagcuga

SEQ ID NO: 642017 - RNA, 23 nt, Human
acaauuuuguuuuuggccaagug

SEQ ID NO: 642018 - RNA, 20 nt, Human
acaguucuuagagcaacccu

SEQ ID NO: 642019 - RNA, 19 nt, Human
acuguuuuccccagaagug

SEQ ID NO: 642020 - RNA, 20 nt, Human
agcauacacacuuacgcaua

SEQ ID NO: 642021 - RNA, 18 nt, Human
agccugaauacugccauu

SEQ ID NO: 642022 - RNA, 18 nt, Human
aggcucaaaauccagcaa

SEQ ID NO: 642023 - RNA, 25 nt, Human
auaaaauucaucuucagaaaugaag

SEQ ID NO: 642024 - RNA, 22 nt, Human
auacauuuuuaauuuuuaaaaa

SEQ ID NO: 642025 - RNA, 22 nt, Human
augauccuuuaaaaguuuaaau

SEQ ID NO: 642026 - RNA, 21 nt, Human
auguacauauguacguugagu

SEQ ID NO: 642027 - RNA, 24 nt, Human
auguauuuuuuaaaaauaaaauuc

SEQ ID NO: 642028 - RNA, 24 nt, Human
auuauauucuacuucauuguuccu

SEQ ID NO: 642029 - RNA, 19 nt, Human
caacuacucaaaaauucug

SEQ ID NO: 642030 - RNA, 24 nt, Human
caagcccagagaugaaggucagga

SEQ ID NO: 642031 - RNA, 22 nt, Human
caccauagacaucagcaagcag

SEQ ID NO: 642032 - RNA, 19 nt, Human
cacguggauaauaaaaaug

SEQ ID NO: 642033 - RNA, 20 nt, Human
cagcaagagcuaacacagca

SEQ ID NO: 642034 - RNA, 22 nt, Human
ccccagaagugagauuucuacu

SEQ ID NO: 642035 - RNA, 24 nt, Human
cucaaaauccagcaagagcuaaca

SEQ ID NO: 642036 - RNA, 22 nt, Human
cuuacgcauaccugcguaugua

SEQ ID NO: 642037 - RNA, 23 nt, Human
cuuuaugguucuguacauauuuc

SEQ ID NO: 642038 - RNA, 21 nt, Human
gcccaagaaacagcucaugau

SEQ ID NO: 642039 - RNA, 21 nt, Human
gccgcaaaaaggcaagcugaa

SEQ ID NO: 642040 - RNA, 21 nt, Human
ggugguucuuuaugguucugu

SEQ ID NO: 642041 - RNA, 18 nt, Human
guaggaccuaggcucaaa

SEQ ID NO: 642042 - RNA, 20 nt, Human
guauuuuuuuuuucugaagg

SEQ ID NO: 642043 - RNA, 18 nt, Human
guguagauuauguacaua

SEQ ID NO: 642044 - RNA, 22 nt, Human
uaaaaaaauccacagccacaaa

SEQ ID NO: 642045 - RNA, 25 nt, Human
uaaaaaaauccacagccacaaauua

SEQ ID NO: 642046 - RNA, 20 nt, Human
uaaaaauaaaauucaucuuc

SEQ ID NO: 642047 - RNA, 21 nt, Human
uaaaauauucaaguguuaugu

SEQ ID NO: 642048 - RNA, 21 nt, Human
uaacaccauagacaucagcaa

SEQ ID NO: 642049 - RNA, 24 nt, Human
uaacaccauagacaucagcaagca

SEQ ID NO: 642050 - RNA, 24 nt, Human
uacacacuuacgcauaccugcgua

SEQ ID NO: 642051 - RNA, 22 nt, Human
uacgcauaccugcguauguagc

SEQ ID NO: 642052 - RNA, 25 nt, Human
uagaauucuccagaauuuaaauuuc

SEQ ID NO: 642053 - RNA, 24 nt, Human
uagacaucagcaagcaggugaugu

SEQ ID NO: 642054 - RNA, 18 nt, Human
uagcacuucuguaacacc

SEQ ID NO: 642055 - RNA, 24 nt, Human
uagcaguuaaaaaaauccacagcc

SEQ ID NO: 642056 - RNA, 21 nt, Human
uaggcucaaaauccagcaaga

SEQ ID NO: 642057 - RNA, 20 nt, Human
uaggugauauauagguuuug

SEQ ID NO: 642058 - RNA, 26 nt, Human
uauagaacaauguguuugcaaauuua

SEQ ID NO: 642059 - RNA, 22 nt, Human
uaucaaagauaaauucaaguuu

SEQ ID NO: 642060 - RNA, 23 nt, Human
uaucaaagauaaauucaaguuua

SEQ ID NO: 642061 - RNA, 25 nt, Human
uauguacauauguacguugaguguu

SEQ ID NO: 642062 - RNA, 21 nt, Human
uaugugauauaaauaugugua

SEQ ID NO: 642063 - RNA, 26 nt, Human
uauguguagauuauguacauauguac

SEQ ID NO: 642064 - RNA, 21 nt, Human
uccccagaagugagauuucua

SEQ ID NO: 642065 - RNA, 23 nt, Human
uccuuuacaauuuuguuuuuggc

SEQ ID NO: 642066 - RNA, 23 nt, Human
ugaaauuuuaggauauguggaau

SEQ ID NO: 642067 - RNA, 19 nt, Human
ugacugaagaaagccacau

SEQ ID NO: 642068 - RNA, 21 nt, Human
ugagaagacaguucuuagagc

SEQ ID NO: 642069 - RNA, 24 nt, Human
ugagaauauucaucgcccaagaaa

SEQ ID NO: 642070 - RNA, 24 nt, Human
ugcaagccaguuuguuuuuaauga

SEQ ID NO: 642071 - RNA, 25 nt, Human
ugccuuugguuucagaaauuugucc

SEQ ID NO: 642072 - RNA, 21 nt, Human
uggcaggcaguaggaccuagg

SEQ ID NO: 642073 - RNA, 24 nt, Human
uggcauugagaugagaauaauuuu

SEQ ID NO: 642074 - RNA, 19 nt, Human
ugggagaacucccacaaua

SEQ ID NO: 642075 - RNA, 22 nt, Human
uguacauauuucuuuucuuccc

SEQ ID NO: 642076 - RNA, 21 nt, Human
ugucuaucaguucuaaaaugc

SEQ ID NO: 642077 - RNA, 25 nt, Human
uguguagauuauguacauauguacg

SEQ ID NO: 642078 - RNA, 24 nt, Human
uguguuugcaaauuuaaauaauau

SEQ ID NO: 642079 - RNA, 25 nt, Human
uguguuugcaaauuuaaauaauauc

SEQ ID NO: 642080 - RNA, 22 nt, Human
uuccuuuacaauuuuguuuuug

SEQ ID NO: 642081 - RNA, 25 nt, Human
uucuguacauauuucuuuucuuccc

SEQ ID NO: 642082 - RNA, 23 nt, Human
uugagaugagaauaauuuucuuu

SEQ ID NO: 642083 - RNA, 22 nt, Human
uuguuuuuggccaagugcuggu

SEQ ID NO: 642084 - RNA, 19 nt, Human
uuucuacugucaguuuucu

SEQ ID NO: 642085 - RNA, 18 nt, Human
uuuuaaugagcuuaaugc

SEQ ID NO: 642086 - RNA, 20 nt, Human
aauggugucugucauuccug

SEQ ID NO: 642087 - RNA, 23 nt, Human
acccaagauuuuacacguagucu

SEQ ID NO: 642088 - RNA, 20 nt, Human
agaguauaugcaaaggcuga

SEQ ID NO: 642089 - RNA, 24 nt, Human
agcacccaaagaaguauaaucuag

SEQ ID NO: 642090 - RNA, 31 nt, Human
aucauggucccaaaggcagaaggcaguauuu

SEQ ID NO: 642091 - RNA, 18 nt, Human
auuuuaucuacuaaguca

SEQ ID NO: 642092 - RNA, 22 nt, Human
caagacccuaacagcuaccuga

SEQ ID NO: 642093 - RNA, 20 nt, Human
cagaacaagacccuaacagc

SEQ ID NO: 642094 - RNA, 21 nt, Human
cauguuaacuucaaacaaaau

SEQ ID NO: 642095 - RNA, 18 nt, Human
cccaaaggcagaaggcag

SEQ ID NO: 642096 - RNA, 20 nt, Human
ccucacgcugagguggggau

SEQ ID NO: 642097 - RNA, 22 nt, Human
ccuuugacucuguggauacucc

SEQ ID NO: 642098 - RNA, 22 nt, Human
gaacugagggcuaucuaaauac

SEQ ID NO: 642099 - RNA, 21 nt, Human
ggcugggagagggaaguuugg

SEQ ID NO: 642100 - RNA, 21 nt, Human
guuuuugucuuuguuuuuaau

SEQ ID NO: 642101 - RNA, 21 nt, Human
uaacuugucauguuuaaccuc

SEQ ID NO: 642102 - RNA, 21 nt, Human
uaagaacacauguuaaggacc

SEQ ID NO: 642103 - RNA, 24 nt, Human
uagcacagcacccaaagaaguaua

SEQ ID NO: 642104 - RNA, 20 nt, Human
uagcuggaccuucuuccaaa

SEQ ID NO: 642105 - RNA, 23 nt, Human
uagcuggaccuucuuccaaacuu

SEQ ID NO: 642106 - RNA, 24 nt, Human
uauaaugaggcacggcuuauugca

SEQ ID NO: 642107 - RNA, 21 nt, Human
uccugugccacgaccucagcu

SEQ ID NO: 642108 - RNA, 18 nt, Human
ucuguggauacuccccaa

SEQ ID NO: 642109 - RNA, 22 nt, Human
ucuuggaaugcuaagacggagc

SEQ ID NO: 642110 - RNA, 20 nt, Human
ugacauacaagaaacugcaa

SEQ ID NO: 642111 - RNA, 23 nt, Human
ugccaucuucacagaacaagacc

SEQ ID NO: 642112 - RNA, 18 nt, Human
uggaagcuguagcuguag

SEQ ID NO: 642113 - RNA, 24 nt, Human
ugugccacgaccucagcuugcauc

SEQ ID NO: 642114 - RNA, 19 nt, Human
uuagcacagcacccaaaga

SEQ ID NO: 642115 - RNA, 24 nt, Human
uuccauugacauucuuagcacagc

SEQ ID NO: 642116 - RNA, 22 nt, Human
uucccauaugaacuuccuccau

SEQ ID NO: 642117 - RNA, 23 nt, Human
uuccuuugacucuguggauacuc

SEQ ID NO: 642118 - RNA, 19 nt, Human
uugguugguugguugguug

SEQ ID NO: 642119 - RNA, 21 nt, Human
uuuuuuuuuuuuuuuuuaaug

SEQ ID NO: 642120 - RNA, 26 nt, Human
aaacuggaaaugcacaacugggucug

SEQ ID NO: 642121 - RNA, 18 nt, Human
aagucuacagcgcucuuc

SEQ ID NO: 642122 - RNA, 23 nt, Human
cuagaacauagcuaagcacaagu

SEQ ID NO: 642123 - RNA, 23 nt, Human
gaaaugaauaaaacagcaggcca

SEQ ID NO: 642124 - RNA, 22 nt, Human
gaacauagcuaagcacaagucu

SEQ ID NO: 642125 - RNA, 19 nt, Human
gcaggccaggcgugguggc

SEQ ID NO: 642126 - RNA, 23 nt, Human
ggagugcuggggucagcugcugg

SEQ ID NO: 642127 - RNA, 24 nt, Human
ggagugcuggggucagcugcugga

SEQ ID NO: 642128 - RNA, 18 nt, Human
uaaaacagcaggccaggc

SEQ ID NO: 642129 - RNA, 25 nt, Human
uaaacccucuagaacauagcuaagc

SEQ ID NO: 642130 - RNA, 18 nt, Human
uagccccucgggaccccc

SEQ ID NO: 642131 - RNA, 18 nt, Human
uauuuuaacgggauugga

SEQ ID NO: 642132 - RNA, 25 nt, Human
ugcuggggucagcugcuggaagguc

SEQ ID NO: 642133 - RNA, 28 nt, Human
ugcuggggucagcugcuggaaggucgcu

SEQ ID NO: 642134 - RNA, 21 nt, Human
uggagugcuggggucagcugc

SEQ ID NO: 642135 - RNA, 21 nt, Human
uggggucagcugcuggaaggu

SEQ ID NO: 642136 - RNA, 25 nt, Human
ugugucauggcaaacuggaaaugca

SEQ ID NO: 642137 - RNA, 18 nt, Human
uuuuuugaugcugcuauc

SEQ ID NO: 642138 - RNA, 18 nt, Human
aacugaaagauucccaca

SEQ ID NO: 642139 - RNA, 21 nt, Human
acauuuauuagguuucuacau

SEQ ID NO: 642140 - RNA, 18 nt, Human
acuuaucuucagcaugac

SEQ ID NO: 642141 - RNA, 24 nt, Human
aggcaguggcagauuaggacuaca

SEQ ID NO: 642142 - RNA, 19 nt, Human
aggcaguggcagauuaggg

SEQ ID NO: 642143 - RNA, 24 nt, Human
auuacauuuauuagguuucuacau

SEQ ID NO: 642144 - RNA, 21 nt, Human
caaauaaagaaccauaaccug

SEQ ID NO: 642145 - RNA, 18 nt, Human
ggcaaguuguccaaggca

SEQ ID NO: 642146 - RNA, 23 nt, Human
guagcauuuuagagcuaacagag

SEQ ID NO: 642147 - RNA, 21 nt, Human
guggaaguaggcaaguugucc

SEQ ID NO: 642148 - RNA, 21 nt, Human
uaacagagcuccuacaagauu

SEQ ID NO: 642149 - RNA, 19 nt, Human
uaagggccagugaaaacau

SEQ ID NO: 642150 - RNA, 21 nt, Human
ucacauuuuucucuccagugu

SEQ ID NO: 642151 - RNA, 24 nt, Human
uuucuaacuccaaaaucauucauu

SEQ ID NO: 642152 - RNA, 18 nt, Human
uuugcuguguaucaagga

SEQ ID NO: 642153 - RNA, 23 nt, Human
uuuuuuuuuuuuuuuuuucccag

SEQ ID NO: 642154 - RNA, 28 nt, Human
aaaaaaaaacuccccuaaagagcuugaa

SEQ ID NO: 642155 - RNA, 22 nt, Human
aaaaaaacuccccuaaagagcu

SEQ ID NO: 642156 - RNA, 21 nt, Human
aaaauaaguagacuguaauau

SEQ ID NO: 642157 - RNA, 24 nt, Human
aaacaaacugauagcaacuaaaau

SEQ ID NO: 642158 - RNA, 23 nt, Human
aaacauucaacaccccggcuucu

SEQ ID NO: 642159 - RNA, 23 nt, Human
aaagugcuacuguagccaacaug

SEQ ID NO: 642160 - RNA, 24 nt, Human
aaaguguugggauuacaggcguga

SEQ ID NO: 642161 - RNA, 19 nt, Human
aagaaaaucugaagacagc

SEQ ID NO: 642162 - RNA, 26 nt, Human
aagaaaaucugaagacagcagaugcc

SEQ ID NO: 642163 - RNA, 21 nt, Human
aaguguugggauuacaggcgu

SEQ ID NO: 642164 - RNA, 26 nt, Human
aaguguugggauuacaggcgugagcc

SEQ ID NO: 642165 - RNA, 22 nt, Human
acaaccucugccucccagguuc

SEQ ID NO: 642166 - RNA, 24 nt, Human
accauguuggccaggcuggucucg

SEQ ID NO: 642167 - RNA, 18 nt, Human
acgggguuucaccauguu

SEQ ID NO: 642168 - RNA, 23 nt, Human
acgggguuucaccauguuggcca

SEQ ID NO: 642169 - RNA, 24 nt, Human
acgggguuucaccauguuggccag

SEQ ID NO: 642170 - RNA, 24 nt, Human
acuuauuauuuucaaaacaguuaa

SEQ ID NO: 642171 - RNA, 25 nt, Human
agaaaaaaaaaacuccccuaaagag

SEQ ID NO: 642172 - RNA, 23 nt, Human
agaaaaaguagaaaagguuuugc

SEQ ID NO: 642173 - RNA, 20 nt, Human
agaugccauauaugccacaa

SEQ ID NO: 642174 - RNA, 22 nt, Human
aguagagacgggguuucaccau

SEQ ID NO: 642175 - RNA, 24 nt, Human
agugcaguggccccaucucagcuc

SEQ ID NO: 642176 - RNA, 20 nt, Human
auaaacaccuaacuguauuu

SEQ ID NO: 642177 - RNA, 22 nt, Human
auaaagcauucugcaaauuaaa

SEQ ID NO: 642178 - RNA, 22 nt, Human
auaacuaaauaauauaaacacc

SEQ ID NO: 642179 - RNA, 19 nt, Human
auagcugaaacuacaggug

SEQ ID NO: 642180 - RNA, 25 nt, Human
aucaaauuuacccccacuauauaau

SEQ ID NO: 642181 - RNA, 19 nt, Human
augacauuucuggucuuuu

SEQ ID NO: 642182 - RNA, 22 nt, Human
auucuuauuuauuuauuuuaug

SEQ ID NO: 642183 - RNA, 24 nt, Human
auuuuuguauuuuuaguagagacg

SEQ ID NO: 642184 - RNA, 21 nt, Human
caaaacaguuaaaacuaacac

SEQ ID NO: 642185 - RNA, 24 nt, Human
caaaguguugggauuacaggcgug

SEQ ID NO: 642186 - RNA, 20 nt, Human
caaccucugccucccagguu

SEQ ID NO: 642187 - RNA, 22 nt, Human
caagugaccugccugccucggc

SEQ ID NO: 642188 - RNA, 21 nt, Human
cacaggcugcagugcaguggc

SEQ ID NO: 642189 - RNA, 21 nt, Human
caccauguuggccaggcuggu

SEQ ID NO: 642190 - RNA, 24 nt, Human
caccauguuggccaggcuggucuc

SEQ ID NO: 642191 - RNA, 27 nt, Human
caccauguuggccaggcuggucucgaa

SEQ ID NO: 642192 - RNA, 18 nt, Human
cacccuugcuggcauggg

SEQ ID NO: 642193 - RNA, 21 nt, Human
cacuacaaccucugccuccca

SEQ ID NO: 642194 - RNA, 22 nt, Human
cagaccuucucuccacuucucc

SEQ ID NO: 642195 - RNA, 24 nt, Human
cagcacgcccaguuaauuuuugua

SEQ ID NO: 642196 - RNA, 22 nt, Human
cagcagaugccauauaugccac

SEQ ID NO: 642197 - RNA, 18 nt, Human
caguuaaaacuaacacac

SEQ ID NO: 642198 - RNA, 22 nt, Human
caucaaaacuccauuacaaagu

SEQ ID NO: 642199 - RNA, 24 nt, Human
cauguuggccaggcuggucucgaa

SEQ ID NO: 642200 - RNA, 22 nt, Human
ccaaaguguugggauuacaggc

SEQ ID NO: 642201 - RNA, 22 nt, Human
ccaaaguguugggauuacaggc

SEQ ID NO: 642202 - RNA, 24 nt, Human
ccaaaguguugggauuacaggcgu

SEQ ID NO: 642203 - RNA, 21 nt, Human
ccacaaagaaaagcagguacc

SEQ ID NO: 642204 - RNA, 23 nt, Human
cccaguuaauuuuuguauuuuua

SEQ ID NO: 642205 - RNA, 22 nt, Human
ccccuaaagagcuugaaccuuc

SEQ ID NO: 642206 - RNA, 20 nt, Human
ccucccagguucaagccauu

SEQ ID NO: 642207 - RNA, 23 nt, Human
ccugaccucaagugaccugccug

SEQ ID NO: 642208 - RNA, 24 nt, Human
ccugccucggccucccaaaguguu

SEQ ID NO: 642209 - RNA, 21 nt, Human
ccuucucuccacuucuccaaa

SEQ ID NO: 642210 - RNA, 24 nt, Human
cgggguuucaccauguuggccagg

SEQ ID NO: 642211 - RNA, 19 nt, Human
cuagagauaccaaaaaaua

SEQ ID NO: 642212 - RNA, 24 nt, Human
cucacuacaaccucugccucccag

SEQ ID NO: 642213 - RNA, 24 nt, Human
cucccaucagaccuucucuccacu

SEQ ID NO: 642214 - RNA, 22 nt, Human
cucuaauauugcacuagaguug

SEQ ID NO: 642215 - RNA, 21 nt, Human
cugaaacuacaggugcacacc

SEQ ID NO: 642216 - RNA, 23 nt, Human
cugccucagccucccgaauagcu

SEQ ID NO: 642217 - RNA, 20 nt, Human
cugccucccagguucaagcc

SEQ ID NO: 642218 - RNA, 21 nt, Human
gaaaaaaacaguaaaaauaua

SEQ ID NO: 642219 - RNA, 21 nt, Human
gaaagaaaaaggaaaaagcaa

SEQ ID NO: 642220 - RNA, 26 nt, Human
gaauagcugaaacuacaggugcacac

SEQ ID NO: 642221 - RNA, 24 nt, Human
gaccucaagugaccugccugccuc

SEQ ID NO: 642222 - RNA, 24 nt, Human
gagacgggguuucaccauguuggc

SEQ ID NO: 642223 - RNA, 18 nt, Human
gauuacaggcgugagcca

SEQ ID NO: 642224 - RNA, 21 nt, Human
gauuacaggcgugagccacca

SEQ ID NO: 642225 - RNA, 22 nt, Human
gauuacaggcgugagccaccac

SEQ ID NO: 642226 - RNA, 22 nt, Human
gcccaguuaauuuuuguauuuu

SEQ ID NO: 642227 - RNA, 23 nt, Human
gcuggucucgaacuccugaccuc

SEQ ID NO: 642228 - RNA, 19 nt, Human
ggauuacaggcgugagcca

SEQ ID NO: 642229 - RNA, 24 nt, Human
ggcuggucucgaacuccugaccuc

SEQ ID NO: 642230 - RNA, 21 nt, Human
ggggaagaagcuggaccuggu

SEQ ID NO: 642231 - RNA, 23 nt, Human
gggguuucaccauguuggccagg

SEQ ID NO: 642232 - RNA, 19 nt, Human
ggucucgaacuccugaccu

SEQ ID NO: 642233 - RNA, 23 nt, Human
guagagacgggguuucaccaugu

SEQ ID NO: 642234 - RNA, 22 nt, Human
uaaaacuaacacacgagauucu

SEQ ID NO: 642235 - RNA, 21 nt, Human
uaaagugcuacuguagccaaa

SEQ ID NO: 642236 - RNA, 19 nt, Human
uaaauuuuccuucucuaau

SEQ ID NO: 642237 - RNA, 22 nt, Human
uaacaaguauaauuuuuaaaaa

SEQ ID NO: 642238 - RNA, 23 nt, Human
uaauaaagaggaaucauuuuaau

SEQ ID NO: 642239 - RNA, 24 nt, Human
uaauuuuuguauuuuuaguagaga

SEQ ID NO: 642240 - RNA, 24 nt, Human
uacaagaaaaucugcuguggauaa

SEQ ID NO: 642241 - RNA, 23 nt, Human
uacaggcgugagccaccacgucc

SEQ ID NO: 642242 - RNA, 18 nt, Human
uaccauuauaccaaccaa

SEQ ID NO: 642243 - RNA, 23 nt, Human
uagaaaacaaacauucaacaccc

SEQ ID NO: 642244 - RNA, 19 nt, Human
uagaagaucaaccugaaag

SEQ ID NO: 642245 - RNA, 22 nt, Human
uagagacgggguuucaccaugu

SEQ ID NO: 642246 - RNA, 23 nt, Human
uaggcuagagauaccaaaaaaua

SEQ ID NO: 642247 - RNA, 24 nt, Human
uaguagagacgggguuucaccaug

SEQ ID NO: 642248 - RNA, 26 nt, Human
uaguagagacgggguuucaccauguu

SEQ ID NO: 642249 - RNA, 23 nt, Human
uauaccaaccaaacuuauacaau

SEQ ID NO: 642250 - RNA, 21 nt, Human
uaucaggcagaguaaaauauu

SEQ ID NO: 642251 - RNA, 18 nt, Human
uaugcugucuuucaguaa

SEQ ID NO: 642252 - RNA, 22 nt, Human
uauuuccagaaaaugaacugga

SEQ ID NO: 642253 - RNA, 23 nt, Human
ucaaaacaguuaaaacuaacaca

SEQ ID NO: 642254 - RNA, 20 nt, Human
ucaaccugaaagaaaaagga

SEQ ID NO: 642255 - RNA, 23 nt, Human
ucaaccugaaagaaaaaggaaaa

SEQ ID NO: 642256 - RNA, 19 nt, Human
ucacuacaaccucugccuc

SEQ ID NO: 642257 - RNA, 24 nt, Human
ucacuacaaccucugccucccagg

SEQ ID NO: 642258 - RNA, 25 nt, Human
ucacuacaaccucugccucccaggu

SEQ ID NO: 642259 - RNA, 18 nt, Human
ucagccucccgaauagcu

SEQ ID NO: 642260 - RNA, 20 nt, Human
ucagccucccgaauagcugg

SEQ ID NO: 642261 - RNA, 27 nt, Human
ucagcucacuacaaccucugccuccca

SEQ ID NO: 642262 - RNA, 18 nt, Human
uccauggauuucugaagc

SEQ ID NO: 642263 - RNA, 24 nt, Human
ucccaaaguguugggauuacaggc

SEQ ID NO: 642264 - RNA, 18 nt, Human
ucccagguucaagccauu

SEQ ID NO: 642265 - RNA, 19 nt, Human
ucccagguucaagccauug

SEQ ID NO: 642266 - RNA, 24 nt, Human
ucccaucagaccuucucuccacuu

SEQ ID NO: 642267 - RNA, 20 nt, Human
ucccuuugucacacaggcug

SEQ ID NO: 642268 - RNA, 23 nt, Human
uccugggcccacaagugcagcuc

SEQ ID NO: 642269 - RNA, 19 nt, Human
uccuuucuauaaaccucag

SEQ ID NO: 642270 - RNA, 19 nt, Human
ucuauaaaccucaggauuu

SEQ ID NO: 642271 - RNA, 20 nt, Human
ucuccaaauccugggcccac

SEQ ID NO: 642272 - RNA, 21 nt, Human
ucucgaacuccugaccucaag

SEQ ID NO: 642273 - RNA, 23 nt, Human
ucucuccacuucuccaaauccug

SEQ ID NO: 642274 - RNA, 28 nt, Human
ucugaagccagugcuuaaaaaaaaaaga

SEQ ID NO: 642275 - RNA, 21 nt, Human
ugaaaaauaaguagacuguaa

SEQ ID NO: 642276 - RNA, 26 nt, Human
ugaaacuacaggugcacaccagcacg

SEQ ID NO: 642277 - RNA, 18 nt, Human
ugaccucaagugaccugc

SEQ ID NO: 642278 - RNA, 24 nt, Human
ugaccugccugccucggccuccca

SEQ ID NO: 642279 - RNA, 22 nt, Human
ugcaaaauauaauagauugcaa

SEQ ID NO: 642280 - RNA, 20 nt, Human
ugcaguggccccaucucagc

SEQ ID NO: 642281 - RNA, 27 nt, Human
ugccucagccucccgaauagcugaaac

SEQ ID NO: 642282 - RNA, 24 nt, Human
ugccucggccucccaaaguguugg

SEQ ID NO: 642283 - RNA, 21 nt, Human
ugcuguggauaaggcauugcu

SEQ ID NO: 642284 - RNA, 22 nt, Human
uggaauaaaugaaacucuaaua

SEQ ID NO: 642285 - RNA, 23 nt, Human
uggaauaaaugaaacucuaauau

SEQ ID NO: 642286 - RNA, 20 nt, Human
uggauaaggcauugcuuuau

SEQ ID NO: 642287 - RNA, 24 nt, Human
uggccaggcuggucucgaacuccu

SEQ ID NO: 642288 - RNA, 24 nt, Human
uggccccaucucagcucacuacaa

SEQ ID NO: 642289 - RNA, 18 nt, Human
ugggauuacaggcgugag

SEQ ID NO: 642290 - RNA, 19 nt, Human
ugggauuacaggcgugagc

SEQ ID NO: 642291 - RNA, 22 nt, Human
ugggauuacaggcgugagccac

SEQ ID NO: 642292 - RNA, 23 nt, Human
ugggauuacaggcgugagccacc

SEQ ID NO: 642293 - RNA, 24 nt, Human
ugggauuacaggcgugagccacca

SEQ ID NO: 642294 - RNA, 19 nt, Human
ugggcccacaagugcagcu

SEQ ID NO: 642295 - RNA, 20 nt, Human
uguggaauaaaugaaacucu

SEQ ID NO: 642296 - RNA, 18 nt, Human
uuaguagagacgggguuu

SEQ ID NO: 642297 - RNA, 22 nt, Human
uuaguagagacgggguuucacc

SEQ ID NO: 642298 - RNA, 24 nt, Human
uuaguagagacgggguuucaccau

SEQ ID NO: 642299 - RNA, 19 nt, Human
uuccauggauuucugaagc

SEQ ID NO: 642300 - RNA, 18 nt, Human
uuccuaaaacuuuauuuu

SEQ ID NO: 642301 - RNA, 23 nt, Human
uuguauuuuuaguagagacgggg

SEQ ID NO: 642302 - RNA, 24 nt, Human
uuucaccauguuggccaggcuggu

SEQ ID NO: 642303 - RNA, 23 nt, Human
uuuccuaaaacuuuauuuugaaa

SEQ ID NO: 642304 - RNA, 24 nt, Human
uuuuuaguagagacgggguuucac

SEQ ID NO: 642305 - RNA, 20 nt, Human
uuuuuguauuuuuaguagag

SEQ ID NO: 642306 - RNA, 18 nt, Human
uuuuuuuuuuuuuugccu

SEQ ID NO: 642307 - RNA, 18 nt, Human
uuuuuuuuuuuuuuuuug

SEQ ID NO: 642308 - RNA, 24 nt, Human
aaagugcugggauuacaggcguga

SEQ ID NO: 642309 - RNA, 24 nt, Human
aaccacaccuccaccaggcucuaa

SEQ ID NO: 642310 - RNA, 22 nt, Human
aaccauuuuauuaccucccccu

SEQ ID NO: 642311 - RNA, 18 nt, Human
aagcaaagauaacaugug

SEQ ID NO: 642312 - RNA, 19 nt, Human
aagcugcccugcuucuagg

SEQ ID NO: 642313 - RNA, 20 nt, Human
aagcugcccugcuucuaggc

SEQ ID NO: 642314 - RNA, 22 nt, Human
aaggaagcugcccugcuucuag

SEQ ID NO: 642315 - RNA, 19 nt, Human
aagugcugggauuacaggc

SEQ ID NO: 642316 - RNA, 19 nt, Human
aagugcugggauuacaggc

SEQ ID NO: 642317 - RNA, 26 nt, Human
aagugcugggauuacaggcgugagcc

SEQ ID NO: 642318 - RNA, 18 nt, Human
aaugucuaucuacagcuc

SEQ ID NO: 642319 - RNA, 22 nt, Human
acagaguggcccgggcagcccc

SEQ ID NO: 642320 - RNA, 23 nt, Human
accacaccuggcuaauuuuugua

SEQ ID NO: 642321 - RNA, 19 nt, Human
acccaggcuggagugcagu

SEQ ID NO: 642322 - RNA, 23 nt, Human
acccaggcuggagugcaguggug

SEQ ID NO: 642323 - RNA, 18 nt, Human
acgggguuucaccaucuu

SEQ ID NO: 642324 - RNA, 20 nt, Human
acgggguuucaccaucuugg

SEQ ID NO: 642325 - RNA, 24 nt, Human
acgggguuucaccaucuuggccag

SEQ ID NO: 642326 - RNA, 23 nt, Human
acuaggccggaagugggagaccg

SEQ ID NO: 642327 - RNA, 21 nt, Human
agaaaaagaaagcacgccaga

SEQ ID NO: 642328 - RNA, 18 nt, Human
agaaccagaagcgcaggc

SEQ ID NO: 642329 - RNA, 24 nt, Human
agaccgcaggccucuggcgaagga

SEQ ID NO: 642330 - RNA, 22 nt, Human
agagaaaaagaaagcacgccag

SEQ ID NO: 642331 - RNA, 18 nt, Human
agcgccuggcaagucaag

SEQ ID NO: 642332 - RNA, 19 nt, Human
aggccucuggcgaaggaag

SEQ ID NO: 642333 - RNA, 25 nt, Human
aggcuggagugcaguggugcgaucu

SEQ ID NO: 642334 - RNA, 21 nt, Human
aguagcugugauuacaggcac

SEQ ID NO: 642335 - RNA, 23 nt, Human
agugcaguggugcgaucuuggcu

SEQ ID NO: 642336 - RNA, 24 nt, Human
agugcaguggugcgaucuuggcuc

SEQ ID NO: 642337 - RNA, 18 nt, Human
agugcugggauuacaggc

SEQ ID NO: 642338 - RNA, 25 nt, Human
auugcaauaaagccaguagcaggga

SEQ ID NO: 642339 - RNA, 22 nt, Human
auuuuauuaccucccccuccca

SEQ ID NO: 642340 - RNA, 24 nt, Human
caaagugcugggauuacaggcgug

SEQ ID NO: 642341 - RNA, 23 nt, Human
caaccuccaccuccuggauucaa

SEQ ID NO: 642342 - RNA, 21 nt, Human
caagcaggaucgacccaccug

SEQ ID NO: 642343 - RNA, 19 nt, Human
caagugcccagcggccaca

SEQ ID NO: 642344 - RNA, 18 nt, Human
cacacaagcccggcugcg

SEQ ID NO: 642345 - RNA, 24 nt, Human
caccaucuuggccaggcugcucuu

SEQ ID NO: 642346 - RNA, 21 nt, Human
cacccaggcuggagugcagug

SEQ ID NO: 642347 - RNA, 27 nt, Human
cacgccagacugaggaccggcagaagc

SEQ ID NO: 642348 - RNA, 19 nt, Human
cagaguccagcacgcuaac

SEQ ID NO: 642349 - RNA, 19 nt, Human
cagggccccagccggugcc

SEQ ID NO: 642350 - RNA, 19 nt, Human
caggugaaauugagaggac

SEQ ID NO: 642351 - RNA, 19 nt, Human
caguagagacgggguuuca

SEQ ID NO: 642352 - RNA, 25 nt, Human
caguagagacgggguuucaccaucu

SEQ ID NO: 642353 - RNA, 19 nt, Human
caguggugcgaucuuggcu

SEQ ID NO: 642354 - RNA, 27 nt, Human
caugccaugcacaauaauuuaugugug

SEQ ID NO: 642355 - RNA, 24 nt, Human
cauuuuauuaccucccccucccag

SEQ ID NO: 642356 - RNA, 22 nt, Human
ccaaagugcugggauuacaggc

SEQ ID NO: 642357 - RNA, 22 nt, Human
ccaaagugcugggauuacaggc

SEQ ID NO: 642358 - RNA, 24 nt, Human
ccaaagugcugggauuacaggcgu

SEQ ID NO: 642359 - RNA, 26 nt, Human
ccaccuccuggauucaagcaauucuu

SEQ ID NO: 642360 - RNA, 21 nt, Human
ccaugcacaauaauuuaugug

SEQ ID NO: 642361 - RNA, 22 nt, Human
cccacaaugucuaucuacagcu

SEQ ID NO: 642362 - RNA, 18 nt, Human
ccccagccggugcccgga

SEQ ID NO: 642363 - RNA, 19 nt, Human
cccgaguagcugugauuac

SEQ ID NO: 642364 - RNA, 24 nt, Human
cccgaguagcugugauuacaggca

SEQ ID NO: 642365 - RNA, 22 nt, Human
cccggcccguccaggggcgcug

SEQ ID NO: 642366 - RNA, 18 nt, Human
ccggaagugggagaccgc

SEQ ID NO: 642367 - RNA, 24 nt, Human
ccuccuggauucaagcaauucucu

SEQ ID NO: 642368 - RNA, 21 nt, Human
ccucugccagcgccuuccucg

SEQ ID NO: 642369 - RNA, 22 nt, Human
ccucuucacccuccagcuccca

SEQ ID NO: 642370 - RNA, 21 nt, Human
ccugccacgacaggcucaccu

SEQ ID NO: 642371 - RNA, 20 nt, Human
ccuggauucaagcaauucuc

SEQ ID NO: 642372 - RNA, 22 nt, Human
cgaaccauuuuauuaccucccc

SEQ ID NO: 642373 - RNA, 19 nt, Human
cgcaggcuagccggcugga

SEQ ID NO: 642374 - RNA, 23 nt, Human
cgcugcgaggggaguguggucag

SEQ ID NO: 642375 - RNA, 24 nt, Human
cgggguuucaccaucuuggccagg

SEQ ID NO: 642376 - RNA, 21 nt, Human
cgugagccaccacgccuggcc

SEQ ID NO: 642377 - RNA, 24 nt, Human
cgugauccaccagccucggccucc

SEQ ID NO: 642378 - RNA, 23 nt, Human
cuaauuuuuguauuuucaguaga

SEQ ID NO: 642379 - RNA, 23 nt, Human
cuaccacaccuggcuaauuuuug

SEQ ID NO: 642380 - RNA, 20 nt, Human
cuacgugccagcaaaagcug

SEQ ID NO: 642381 - RNA, 21 nt, Human
cuccaaggccaccuggacucu

SEQ ID NO: 642382 - RNA, 21 nt, Human
cuccagcaucuccacaguacc

SEQ ID NO: 642383 - RNA, 21 nt, Human
cuccgccccaaagggggcucc

SEQ ID NO: 642384 - RNA, 21 nt, Human
cuccuuccggcgcaggcgcaa

SEQ ID NO: 642385 - RNA, 24 nt, Human
cucgcucugucacccaggcuggag

SEQ ID NO: 642386 - RNA, 24 nt, Human
cucgcugcaaccuccaccuccugg

SEQ ID NO: 642387 - RNA, 24 nt, Human
cucugccucagccucccgaguagc

SEQ ID NO: 642388 - RNA, 20 nt, Human
cucugucacccaggcuggag

SEQ ID NO: 642389 - RNA, 23 nt, Human
cucugucacccaggcuggagugc

SEQ ID NO: 642390 - RNA, 18 nt, Human
cucuugaccucgugaucc

SEQ ID NO: 642391 - RNA, 21 nt, Human
cugaagaaccacaccuccacc

SEQ ID NO: 642392 - RNA, 19 nt, Human
cugagcagcgggugggggg

SEQ ID NO: 642393 - RNA, 23 nt, Human
cugcaaccuccaccuccuggauu

SEQ ID NO: 642394 - RNA, 24 nt, Human
cugcaaccuccaccuccuggauuc

SEQ ID NO: 642395 - RNA, 23 nt, Human
cugccucagccucccgaguagcu

SEQ ID NO: 642396 - RNA, 18 nt, Human
cuggugcaguccugccac

SEQ ID NO: 642397 - RNA, 21 nt, Human
cuucuagccuugcuaucccga

SEQ ID NO: 642398 - RNA, 28 nt, Human
cuugaccucgugauccaccagccucggc

SEQ ID NO: 642399 - RNA, 19 nt, Human
cuuuaaauucuuucuuccu

SEQ ID NO: 642400 - RNA, 21 nt, Human
gaaaaugggggcacggcccaa

SEQ ID NO: 642401 - RNA, 20 nt, Human
gaaauggacauauucggaua

SEQ ID NO: 642402 - RNA, 22 nt, Human
gaaccacaccuccaccaggcuc

SEQ ID NO: 642403 - RNA, 19 nt, Human
gaagaaccacaccuccacc

SEQ ID NO: 642404 - RNA, 21 nt, Human
gaagcucuuggggaggugcca

SEQ ID NO: 642405 - RNA, 19 nt, Human
gaccucgugauccaccagc

SEQ ID NO: 642406 - RNA, 22 nt, Human
gaccucgugauccaccagccuc

SEQ ID NO: 642407 - RNA, 22 nt, Human
gaccucgugauccaccagccuc

SEQ ID NO: 642408 - RNA, 24 nt, Human
gagacgggguuucaccaucuuggc

SEQ ID NO: 642409 - RNA, 21 nt, Human
gauuacaggcaccugcuacca

SEQ ID NO: 642410 - RNA, 18 nt, Human
gauuacaggcgugagcca

SEQ ID NO: 642411 - RNA, 21 nt, Human
gauuacaggcgugagccacca

SEQ ID NO: 642412 - RNA, 22 nt, Human
gauuacaggcgugagccaccac

SEQ ID NO: 642413 - RNA, 23 nt, Human
gcaaaagcuggcagacuaggccg

SEQ ID NO: 642414 - RNA, 21 nt, Human
gcaggaaagcagcagcacgaa

SEQ ID NO: 642415 - RNA, 22 nt, Human
gcaggaaagcagcagcacgaag

SEQ ID NO: 642416 - RNA, 18 nt, Human
gcugcaaccuccaccucc

SEQ ID NO: 642417 - RNA, 24 nt, Human
gcugcaguucuucaccauguacgg

SEQ ID NO: 642418 - RNA, 18 nt, Human
ggaccaaaccaaguggaa

SEQ ID NO: 642419 - RNA, 21 nt, Human
ggaccaaaccaaguggaagcu

SEQ ID NO: 642420 - RNA, 19 nt, Human
ggauuacaggcgugagcca

SEQ ID NO: 642421 - RNA, 19 nt, Human
ggcccgggcagccccaccc

SEQ ID NO: 642422 - RNA, 18 nt, Human
gggcuccagggccccagc

SEQ ID NO: 642423 - RNA, 19 nt, Human
ggggauggggccgagugcu

SEQ ID NO: 642424 - RNA, 23 nt, Human
gggguuucaccaucuuggccagg

SEQ ID NO: 642425 - RNA, 24 nt, Human
gggugugacuguauuuauagacug

SEQ ID NO: 642426 - RNA, 22 nt, Human
ggucagagccacugagcagcgg

SEQ ID NO: 642427 - RNA, 23 nt, Human
gguucuaacagccuuuuuuagcc

SEQ ID NO: 642428 - RNA, 24 nt, Human
gucuuguuccuccagcaucuccac

SEQ ID NO: 642429 - RNA, 22 nt, Human
gugaaggaaacucugggccucu

SEQ ID NO: 642430 - RNA, 24 nt, Human
gugauccaccagccucggccuccc

SEQ ID NO: 642431 - RNA, 24 nt, Human
guggcccgggcagccccaccccgc

SEQ ID NO: 642432 - RNA, 23 nt, Human
gugugcacacaagcccggcugca

SEQ ID NO: 642433 - RNA, 22 nt, Human
guguggcgugugcacacaagcc

SEQ ID NO: 642434 - RNA, 18 nt, Human
uaacagccuccuuccggc

SEQ ID NO: 642435 - RNA, 18 nt, Human
uaaguacaugguggcugg

SEQ ID NO: 642436 - RNA, 24 nt, Human
uaauuuuuguauuuucaguagaga

SEQ ID NO: 642437 - RNA, 22 nt, Human
uacaggcaccugcuaccacacc

SEQ ID NO: 642438 - RNA, 22 nt, Human
uacaggcgugagccaccacgcc

SEQ ID NO: 642439 - RNA, 23 nt, Human
uacaggcgugagccaccacgccu

SEQ ID NO: 642440 - RNA, 18 nt, Human
uacaucagcuacacaaag

SEQ ID NO: 642441 - RNA, 19 nt, Human
uaccacugacgcugcgagg

SEQ ID NO: 642442 - RNA, 24 nt, Human
uagcacagugcaacauauacaguu

SEQ ID NO: 642443 - RNA, 25 nt, Human
uagcagggauaaaacuaaguacaug

SEQ ID NO: 642444 - RNA, 21 nt, Human
uauguccgcagaguccagcac

SEQ ID NO: 642445 - RNA, 24 nt, Human
ucacccaggcuggagugcaguggu

SEQ ID NO: 642446 - RNA, 18 nt, Human
ucaggauguggugacagc

SEQ ID NO: 642447 - RNA, 18 nt, Human
ucagggguagcuggaagc

SEQ ID NO: 642448 - RNA, 24 nt, Human
ucaguagagacgggguuucaccau

SEQ ID NO: 642449 - RNA, 18 nt, Human
uccaaggccaccuggacu

SEQ ID NO: 642450 - RNA, 22 nt, Human
uccagggccccagccggugccc

SEQ ID NO: 642451 - RNA, 24 nt, Human
ucccaaagugcugggauuacaggc

SEQ ID NO: 642452 - RNA, 24 nt, Human
ucccgaguagcugugauuacaggc

SEQ ID NO: 642453 - RNA, 22 nt, Human
ucccugggccucacuuuccucc

SEQ ID NO: 642454 - RNA, 24 nt, Human
uccgcagaguccagcacgcuaaca

SEQ ID NO: 642455 - RNA, 18 nt, Human
uccgucagaccacagcuu

SEQ ID NO: 642456 - RNA, 20 nt, Human
uccgucagaccacagcuucc

SEQ ID NO: 642457 - RNA, 24 nt, Human
uccucugcgaaauggacauauucg

SEQ ID NO: 642458 - RNA, 21 nt, Human
uccuggauucaagcaauucuc

SEQ ID NO: 642459 - RNA, 23 nt, Human
uccuggauucaagcaauucucug

SEQ ID NO: 642460 - RNA, 18 nt, Human
uccuguggggggaugggg

SEQ ID NO: 642461 - RNA, 24 nt, Human
ucgcucugucacccaggcuggagu

SEQ ID NO: 642462 - RNA, 19 nt, Human
ucgcugcaaccuccaccuc

SEQ ID NO: 642463 - RNA, 23 nt, Human
ucgcugcaaccuccaccuccugg

SEQ ID NO: 642464 - RNA, 24 nt, Human
ucgcugcaaccuccaccuccugga

SEQ ID NO: 642465 - RNA, 27 nt, Human
ucgcugcaaccuccaccuccuggauuc

SEQ ID NO: 642466 - RNA, 18 nt, Human
ucggccucccaaagugcu

SEQ ID NO: 642467 - RNA, 26 nt, Human
ucuacagcucuaaccacucaaguguu

SEQ ID NO: 642468 - RNA, 19 nt, Human
ucucgcucugucacccagg

SEQ ID NO: 642469 - RNA, 23 nt, Human
ucucgcucugucacccaggcugg

SEQ ID NO: 642470 - RNA, 24 nt, Human
ucucgcucugucacccaggcugga

SEQ ID NO: 642471 - RNA, 26 nt, Human
ucucgcucugucacccaggcuggagu

SEQ ID NO: 642472 - RNA, 27 nt, Human
ucucgcucugucacccaggcuggagug

SEQ ID NO: 642473 - RNA, 24 nt, Human
ucugucacccaggcuggagugcag

SEQ ID NO: 642474 - RNA, 23 nt, Human
ugacuucugaagaaccacaccuc

SEQ ID NO: 642475 - RNA, 21 nt, Human
ugagacccuguacaccucccc

SEQ ID NO: 642476 - RNA, 23 nt, Human
ugagaggacagacuugggaauca

SEQ ID NO: 642477 - RNA, 22 nt, Human
ugcaguggugcgaucuuggcuc

SEQ ID NO: 642478 - RNA, 24 nt, Human
ugccucagccucccgaguagcugu

SEQ ID NO: 642479 - RNA, 24 nt, Human
ugcugggauuacaggcgugagcca

SEQ ID NO: 642480 - RNA, 23 nt, Human
uggagugcaguggugcgaucuug

SEQ ID NO: 642481 - RNA, 24 nt, Human
uggagugcaguggugcgaucuugg

SEQ ID NO: 642482 - RNA, 24 nt, Human
uggccaggcugcucuugaacucuu

SEQ ID NO: 642483 - RNA, 24 nt, Human
uggcgugugcacacaagcccggcu

SEQ ID NO: 642484 - RNA, 20 nt, Human
uggcucgcugcaaccuccac

SEQ ID NO: 642485 - RNA, 22 nt, Human
ugggagaccgcaggccucuggc

SEQ ID NO: 642486 - RNA, 18 nt, Human
ugggauuacaggcgugag

SEQ ID NO: 642487 - RNA, 19 nt, Human
ugggauuacaggcgugagc

SEQ ID NO: 642488 - RNA, 22 nt, Human
ugggauuacaggcgugagccac

SEQ ID NO: 642489 - RNA, 23 nt, Human
ugggauuacaggcgugagccacc

SEQ ID NO: 642490 - RNA, 24 nt, Human
ugggauuacaggcgugagccacca

SEQ ID NO: 642491 - RNA, 18 nt, Human
ugggggcacggcccaaag

SEQ ID NO: 642492 - RNA, 19 nt, Human
ugggggcacggcccaaagg

SEQ ID NO: 642493 - RNA, 24 nt, Human
uggggggaccaaaccaaguggaag

SEQ ID NO: 642494 - RNA, 23 nt, Human
ugggguuacuauuauuagucucc

SEQ ID NO: 642495 - RNA, 19 nt, Human
uguauuuauagacuggggc

SEQ ID NO: 642496 - RNA, 24 nt, Human
ugucuuguuccuccagcaucucca

SEQ ID NO: 642497 - RNA, 24 nt, Human
ugugauuacaggcaccugcuacca

SEQ ID NO: 642498 - RNA, 19 nt, Human
uguggggggauggggccga

SEQ ID NO: 642499 - RNA, 23 nt, Human
uguguggcgugugcacacaagcc

SEQ ID NO: 642500 - RNA, 18 nt, Human
uuaaauucuuucuuccuu

SEQ ID NO: 642501 - RNA, 20 nt, Human
uuccgagacaggacugugga

SEQ ID NO: 642502 - RNA, 21 nt, Human
uuuacagaguggcccgggcag

SEQ ID NO: 642503 - RNA, 21 nt, Human
uuucaccaucuuggccaggcu

SEQ ID NO: 642504 - RNA, 24 nt, Human
uuuucaguagagacgggguuucac

SEQ ID NO: 642505 - RNA, 20 nt, Human
uuuuuguauuuucaguagag

SEQ ID NO: 642506 - RNA, 23 nt, Human
uuuuuguauuuucaguagagacg

SEQ ID NO: 642507 - RNA, 19 nt, Human
aacccuaagaacuuggcug

SEQ ID NO: 642508 - RNA, 18 nt, Human
aagcaccgaaccaaaccc

SEQ ID NO: 642509 - RNA, 21 nt, Human
aagcggaagagccacugcaga

SEQ ID NO: 642510 - RNA, 23 nt, Human
acagcagccugcuuggcacccac

SEQ ID NO: 642511 - RNA, 24 nt, Human
accaacaaucauguauccugccac

SEQ ID NO: 642512 - RNA, 31 nt, Human
acccuaagaacuuggcugcagcugggaaguu

SEQ ID NO: 642513 - RNA, 23 nt, Human
acugagcugguugucccgaaaac

SEQ ID NO: 642514 - RNA, 19 nt, Human
agaaagcccguuguuacug

SEQ ID NO: 642515 - RNA, 21 nt, Human
agacugggcuucuccacuccc

SEQ ID NO: 642516 - RNA, 18 nt, Human
agagaggcaaagcuuuca

SEQ ID NO: 642517 - RNA, 18 nt, Human
agaggcgggugaggcuug

SEQ ID NO: 642518 - RNA, 19 nt, Human
agcaggcucagcugaggga

SEQ ID NO: 642519 - RNA, 21 nt, Human
agcucuacaaccuuuggcccu

SEQ ID NO: 642520 - RNA, 20 nt, Human
aggauugaggcaggaggggg

SEQ ID NO: 642521 - RNA, 18 nt, Human
aggcaggaggggacuuaa

SEQ ID NO: 642522 - RNA, 21 nt, Human
aggcgggugaggcuugggggc

SEQ ID NO: 642523 - RNA, 31 nt, Human
aggggcuuuucggggacagucccgucuggcc

SEQ ID NO: 642524 - RNA, 22 nt, Human
agggucucaugggugucugggc

SEQ ID NO: 642525 - RNA, 23 nt, Human
agguaagcaguccaguagagucu

SEQ ID NO: 642526 - RNA, 18 nt, Human
agguggcagcuuccuccc

SEQ ID NO: 642527 - RNA, 23 nt, Human
agguggcagcuuccucccagagc

SEQ ID NO: 642528 - RNA, 19 nt, Human
augcagcgcugacggaacc

SEQ ID NO: 642529 - RNA, 18 nt, Human
augugugccuugagcugg

SEQ ID NO: 642530 - RNA, 22 nt, Human
caaaccggagaugggcaccugc

SEQ ID NO: 642531 - RNA, 22 nt, Human
caacuucuucaacaccugcacu

SEQ ID NO: 642532 - RNA, 23 nt, Human
caagcaaaccggagaugggcacc

SEQ ID NO: 642533 - RNA, 18 nt, Human
caagcagaguaggguuga

SEQ ID NO: 642534 - RNA, 27 nt, Human
cacacaguccucauugcccugcgccag

SEQ ID NO: 642535 - RNA, 19 nt, Human
caccccggccacagaaagc

SEQ ID NO: 642536 - RNA, 18 nt, Human
caccgaaccaaacccaac

SEQ ID NO: 642537 - RNA, 20 nt, Human
caccuggcugaggucuuuac

SEQ ID NO: 642538 - RNA, 25 nt, Human
cacgcacucacggcccucagcacac

SEQ ID NO: 642539 - RNA, 21 nt, Human
cacuugcucagcaaccagcag

SEQ ID NO: 642540 - RNA, 21 nt, Human
cagcacacaaugcaccccggc

SEQ ID NO: 642541 - RNA, 18 nt, Human
cagcgcugacggaacccu

SEQ ID NO: 642542 - RNA, 20 nt, Human
cagcucagagggcaucugga

SEQ ID NO: 642543 - RNA, 18 nt, Human
cagcucugccagggucca

SEQ ID NO: 642544 - RNA, 19 nt, Human
cagcugagccagccgggcu

SEQ ID NO: 642545 - RNA, 19 nt, Human
cagcugguucccugagagg

SEQ ID NO: 642546 - RNA, 20 nt, Human
cagcuguggacagagaggca

SEQ ID NO: 642547 - RNA, 19 nt, Human
caggcucagcugagggagu

SEQ ID NO: 642548 - RNA, 19 nt, Human
caggucggugcaggucagu

SEQ ID NO: 642549 - RNA, 21 nt, Human
caggugcaggaugccaggccc

SEQ ID NO: 642550 - RNA, 25 nt, Human
cauacacacaaucuauaaauaugua

SEQ ID NO: 642551 - RNA, 20 nt, Human
cauccagggacaaaccguuc

SEQ ID NO: 642552 - RNA, 21 nt, Human
caucugaguccgcugucgccc

SEQ ID NO: 642553 - RNA, 22 nt, Human
ccaaaaaaguucucccugagga

SEQ ID NO: 642554 - RNA, 21 nt, Human
ccaaacccaacacggcaucca

SEQ ID NO: 642555 - RNA, 20 nt, Human
ccaccuggucacugagcugg

SEQ ID NO: 642556 - RNA, 22 nt, Human
ccagcacccaugccacagaaca

SEQ ID NO: 642557 - RNA, 21 nt, Human
ccaguagagucuccaggcucu

SEQ ID NO: 642558 - RNA, 18 nt, Human
cccaaaaaaguucucccu

SEQ ID NO: 642559 - RNA, 21 nt, Human
cccacacaguccucauugccc

SEQ ID NO: 642560 - RNA, 20 nt, Human
cccacacuuccugcucuuaa

SEQ ID NO: 642561 - RNA, 24 nt, Human
cccagcaucugcagccuccccauu

SEQ ID NO: 642562 - RNA, 20 nt, Human
cccagcugaagacccuucuc

SEQ ID NO: 642563 - RNA, 23 nt, Human
cccauugucggcaagcuccugga

SEQ ID NO: 642564 - RNA, 19 nt, Human
ccccggccacagaaagccc

SEQ ID NO: 642565 - RNA, 21 nt, Human
cccgccaggcuggcccuaccu

SEQ ID NO: 642566 - RNA, 19 nt, Human
cccugaggacugcagcagg

SEQ ID NO: 642567 - RNA, 23 nt, Human
cccugcuugucuuguccccucuc

SEQ ID NO: 642568 - RNA, 21 nt, Human
cccuucugcuccucuggcucc

SEQ ID NO: 642569 - RNA, 20 nt, Human
ccucagcacacaaugcaccc

SEQ ID NO: 642570 - RNA, 23 nt, Human
ccuccacaauguucagcaccacc

SEQ ID NO: 642571 - RNA, 20 nt, Human
ccuccaggugagggccuucc

SEQ ID NO: 642572 - RNA, 22 nt, Human
ccucccagagccuugcagagcu

SEQ ID NO: 642573 - RNA, 22 nt, Human
ccugagucauuuaucccagugg

SEQ ID NO: 642574 - RNA, 24 nt, Human
ccugcacuacagcagccugcuugg

SEQ ID NO: 642575 - RNA, 21 nt, Human
ccugcgccagguggcuaagga

SEQ ID NO: 642576 - RNA, 19 nt, Human
ccugcggcagacauuccag

SEQ ID NO: 642577 - RNA, 19 nt, Human
ccuggcccuugagccccug

SEQ ID NO: 642578 - RNA, 19 nt, Human
ccuggggccccuucugcuc

SEQ ID NO: 642579 - RNA, 21 nt, Human
ccuuuguccagacccagcucc

SEQ ID NO: 642580 - RNA, 18 nt, Human
cgggcggaagacuuuucc

SEQ ID NO: 642581 - RNA, 25 nt, Human
cgugacugccacccuugccaagcag

SEQ ID NO: 642582 - RNA, 23 nt, Human
cuaugugugccuugagcuggauu

SEQ ID NO: 642583 - RNA, 21 nt, Human
cucccgccaggcuggcccuac

SEQ ID NO: 642584 - RNA, 23 nt, Human
cuccugguucccaaaaaaguucu

SEQ ID NO: 642585 - RNA, 24 nt, Human
cucugugggcggggaaagaagggg

SEQ ID NO: 642586 - RNA, 22 nt, Human
cugagcugguugucccgaaaac

SEQ ID NO: 642587 - RNA, 22 nt, Human
cugcagcaggacacacguaucc

SEQ ID NO: 642588 - RNA, 19 nt, Human
cuggagcagggcuaugagg

SEQ ID NO: 642589 - RNA, 20 nt, Human
cuggagcagggcuaugaggg

SEQ ID NO: 642590 - RNA, 18 nt, Human
cuuaagguguuggccagc

SEQ ID NO: 642591 - RNA, 22 nt, Human
cuuccuggcgaugugcagcugg

SEQ ID NO: 642592 - RNA, 26 nt, Human
cuucgggagcucagaggcagcucaga

SEQ ID NO: 642593 - RNA, 20 nt, Human
cuuuguccagacccagcucc

SEQ ID NO: 642594 - RNA, 23 nt, Human
gaccaacaaucauguauccugcc

SEQ ID NO: 642595 - RNA, 19 nt, Human
gacccuucucagcuccaag

SEQ ID NO: 642596 - RNA, 19 nt, Human
gagccuugcagagcugcuc

SEQ ID NO: 642597 - RNA, 22 nt, Human
gagcugacacuucugcagccug

SEQ ID NO: 642598 - RNA, 21 nt, Human
gagcugguugucccgaaaacu

SEQ ID NO: 642599 - RNA, 24 nt, Human
gagggucucaugggugucugggcu

SEQ ID NO: 642600 - RNA, 20 nt, Human
gaguggcacagaggcgggug

SEQ ID NO: 642601 - RNA, 19 nt, Human
gcaaagcuuucaccaggug

SEQ ID NO: 642602 - RNA, 24 nt, Human
gcaggacacacguauccuuccucc

SEQ ID NO: 642603 - RNA, 18 nt, Human
gcauggagacucaccuga

SEQ ID NO: 642604 - RNA, 19 nt, Human
gcccuggcccuugagcccc

SEQ ID NO: 642605 - RNA, 21 nt, Human
gcccuggcccuugagccccug

SEQ ID NO: 642606 - RNA, 20 nt, Human
gcuccagaggacacucacug

SEQ ID NO: 642607 - RNA, 19 nt, Human
gcugcagcugggaagucug

SEQ ID NO: 642608 - RNA, 20 nt, Human
gcuggacccaguagccuagc

SEQ ID NO: 642609 - RNA, 21 nt, Human
ggacacacguauccuuccucc

SEQ ID NO: 642610 - RNA, 20 nt, Human
ggagcagggcuaugagggcc

SEQ ID NO: 642611 - RNA, 23 nt, Human
ggcaaacaugaagaucacaguuu

SEQ ID NO: 642612 - RNA, 18 nt, Human
ggcaagcuccuggagagg

SEQ ID NO: 642613 - RNA, 19 nt, Human
gggcaguccuucagagugg

SEQ ID NO: 642614 - RNA, 21 nt, Human
gggcaguugauaggggaggcu

SEQ ID NO: 642615 - RNA, 22 nt, Human
gguccagcacgcacucacggcc

SEQ ID NO: 642616 - RNA, 21 nt, Human
gguggagugcagagcgcccug

SEQ ID NO: 642617 - RNA, 23 nt, Human
gucccuggcuuguuccagagccc

SEQ ID NO: 642618 - RNA, 21 nt, Human
gugaagugcauggagacucac

SEQ ID NO: 642619 - RNA, 21 nt, Human
gugacacagcucuacaaccuu

SEQ ID NO: 642620 - RNA, 18 nt, Human
gugagacuggccagcuca

SEQ ID NO: 642621 - RNA, 21 nt, Human
uaagaacuuggcugcagcugg

SEQ ID NO: 642622 - RNA, 23 nt, Human
uacacuugcucagcaaccagcag

SEQ ID NO: 642623 - RNA, 21 nt, Human
uaccagagccucagggcagug

SEQ ID NO: 642624 - RNA, 23 nt, Human
uaccagagccucagggcaguggg

SEQ ID NO: 642625 - RNA, 19 nt, Human
uagauggguaggcugagga

SEQ ID NO: 642626 - RNA, 23 nt, Human
uauccuuccuccuggguggagug

SEQ ID NO: 642627 - RNA, 24 nt, Human
uaucugcccacagccuaccagagc

SEQ ID NO: 642628 - RNA, 23 nt, Human
ucaacaccugcacuacagcagcc

SEQ ID NO: 642629 - RNA, 21 nt, Human
ucacugagcugguugucccga

SEQ ID NO: 642630 - RNA, 21 nt, Human
ucacugaggcagaggcuccug

SEQ ID NO: 642631 - RNA, 22 nt, Human
ucacugaggcagaggcuccugg

SEQ ID NO: 642632 - RNA, 23 nt, Human
ucacugaggcagaggcuccuggg

SEQ ID NO: 642633 - RNA, 23 nt, Human
ucacugagguucaaggacugcag

SEQ ID NO: 642634 - RNA, 19 nt, Human
ucagaggcagcucagaggg

SEQ ID NO: 642635 - RNA, 24 nt, Human
ucagcacacaaugcaccccggcca

SEQ ID NO: 642636 - RNA, 18 nt, Human
ucaggcuccugugucuca

SEQ ID NO: 642637 - RNA, 20 nt, Human
ucaugugucauauauagacc

SEQ ID NO: 642638 - RNA, 19 nt, Human
ucccaaaaaaguucucccu

SEQ ID NO: 642639 - RNA, 18 nt, Human
ucccacguaaugcagggu

SEQ ID NO: 642640 - RNA, 24 nt, Human
uccccaauugaucacacauauccc

SEQ ID NO: 642641 - RNA, 23 nt, Human
uccccauugucggcaagcuccug

SEQ ID NO: 642642 - RNA, 20 nt, Human
ucccugaggacugcagcagg

SEQ ID NO: 642643 - RNA, 22 nt, Human
ucccugugcucuaggauguugg

SEQ ID NO: 642644 - RNA, 18 nt, Human
uccucccagagccuugca

SEQ ID NO: 642645 - RNA, 23 nt, Human
uccugguucccaaaaaaguucuc

SEQ ID NO: 642646 - RNA, 23 nt, Human
uccuucagaguggcacagaggcg

SEQ ID NO: 642647 - RNA, 23 nt, Human
ucgagguggaggugaccgaggug

SEQ ID NO: 642648 - RNA, 19 nt, Human
ucgcauguccccaauugau

SEQ ID NO: 642649 - RNA, 21 nt, Human
ucgcccagcagguuugcugag

SEQ ID NO: 642650 - RNA, 20 nt, Human
ucuccaggcucuggucacuc

SEQ ID NO: 642651 - RNA, 21 nt, Human
ucuccaggcucuggucacuca

SEQ ID NO: 642652 - RNA, 22 nt, Human
ucuccuuggaaguaacaagaac

SEQ ID NO: 642653 - RNA, 23 nt, Human
ucuuuacacuugcucagcaacca

SEQ ID NO: 642654 - RNA, 19 nt, Human
ugacacagcucuacaaccu

SEQ ID NO: 642655 - RNA, 20 nt, Human
ugacgguaggacacgugacu

SEQ ID NO: 642656 - RNA, 21 nt, Human
ugagauccaccuuuuuaaccc

SEQ ID NO: 642657 - RNA, 20 nt, Human
ugagccccuggacuggucag

SEQ ID NO: 642658 - RNA, 23 nt, Human
ugagccccuuuccucuggccguc

SEQ ID NO: 642659 - RNA, 25 nt, Human
ugagccccuuuccucuggccguccu

SEQ ID NO: 642660 - RNA, 20 nt, Human
ugagcuggauugacagguug

SEQ ID NO: 642661 - RNA, 24 nt, Human
ugagcugguugucccgaaaacuga

SEQ ID NO: 642662 - RNA, 21 nt, Human
ugaggcagaggcuccugggga

SEQ ID NO: 642663 - RNA, 22 nt, Human
ugagggccuuccuggagcaggg

SEQ ID NO: 642664 - RNA, 19 nt, Human
ugagguccagcuuccuggc

SEQ ID NO: 642665 - RNA, 20 nt, Human
ugagucccuggcuuguucca

SEQ ID NO: 642666 - RNA, 24 nt, Human
ugagucccuggcuuguuccagagc

SEQ ID NO: 642667 - RNA, 23 nt, Human
ugaguccugugacauggacauuu

SEQ ID NO: 642668 - RNA, 18 nt, Human
ugcauugucaugacaccc

SEQ ID NO: 642669 - RNA, 19 nt, Human
ugccacagaacacgugcca

SEQ ID NO: 642670 - RNA, 23 nt, Human
ugccacagaacacgugccacacu

SEQ ID NO: 642671 - RNA, 22 nt, Human
ugccugagaagucgagguggag

SEQ ID NO: 642672 - RNA, 19 nt, Human
ugcggugagacuggccagc

SEQ ID NO: 642673 - RNA, 24 nt, Human
ugcggugagacuggccagcucagg

SEQ ID NO: 642674 - RNA, 19 nt, Human
ugcucagcaaccagcagag

SEQ ID NO: 642675 - RNA, 20 nt, Human
ugcugcaggcugaugugcag

SEQ ID NO: 642676 - RNA, 20 nt, Human
uggaaguaacaagaacacug

SEQ ID NO: 642677 - RNA, 19 nt, Human
uggacagagaggcaaagcu

SEQ ID NO: 642678 - RNA, 22 nt, Human
uggagugcagagcgcccugccg

SEQ ID NO: 642679 - RNA, 19 nt, Human
uggccagcaggaaggggcu

SEQ ID NO: 642680 - RNA, 19 nt, Human
uggcccugugagcuugcgg

SEQ ID NO: 642681 - RNA, 20 nt, Human
uggcccugugagcuugcggg

SEQ ID NO: 642682 - RNA, 20 nt, Human
uggcccuugagccccuggac

SEQ ID NO: 642683 - RNA, 18 nt, Human
uggcugaggcugcagccu

SEQ ID NO: 642684 - RNA, 22 nt, Human
uggcugcagcugggaagucugg

SEQ ID NO: 642685 - RNA, 21 nt, Human
uggcuucgagugugacagagc

SEQ ID NO: 642686 - RNA, 21 nt, Human
uggcuuguuccagagcccugg

SEQ ID NO: 642687 - RNA, 25 nt, Human
ugggagcagcugagccagccgggcu

SEQ ID NO: 642688 - RNA, 19 nt, Human
ugggcaccugcggcagaca

SEQ ID NO: 642689 - RNA, 19 nt, Human
uggucacucaggaacucac

SEQ ID NO: 642690 - RNA, 20 nt, Human
uguaaguaagggaggaguca

SEQ ID NO: 642691 - RNA, 21 nt, Human
ugugaagugcauggagacuca

SEQ ID NO: 642692 - RNA, 20 nt, Human
ugugacagagccauucuugg

SEQ ID NO: 642693 - RNA, 22 nt, Human
ugugcagcugggaugcagccuc

SEQ ID NO: 642694 - RNA, 24 nt, Human
uguugcugcucaggucaagcuucc

SEQ ID NO: 642695 - RNA, 25 nt, Human
uuacauaggacagacugggcuucuc

SEQ ID NO: 642696 - RNA, 27 nt, Human
uuacuuccugcuaaccaggcaucccca

SEQ ID NO: 642697 - RNA, 18 nt, Human
uucagcaccaccugguca

SEQ ID NO: 642698 - RNA, 21 nt, Human
uucaucccccagagcauugcc

SEQ ID NO: 642699 - RNA, 19 nt, Human
uucaucuuccagcugguuc

SEQ ID NO: 642700 - RNA, 20 nt, Human
uuccaggggucccgggcagu

SEQ ID NO: 642701 - RNA, 23 nt, Human
uuccuccuggguggagugcagag

SEQ ID NO: 642702 - RNA, 21 nt, Human
uucugcucugagccccuuucc

SEQ ID NO: 642703 - RNA, 20 nt, Human
uugauaggggaggcuuugug

SEQ ID NO: 642704 - RNA, 24 nt, Human
uugccugagaagucgagguggagg

SEQ ID NO: 642705 - RNA, 30 nt, Human
aaaaaaaaaaaaaagaaaagugaagaaaaa

SEQ ID NO: 642706 - RNA, 24 nt, Human
aaaaaaaaaaaaagaaaagugaag

SEQ ID NO: 642707 - RNA, 23 nt, Human
aaaaaaaaaagaaaagugaagaa

SEQ ID NO: 642708 - RNA, 24 nt, Human
aaaaaaaagaaaagugaagaaaaa

SEQ ID NO: 642709 - RNA, 22 nt, Human
aaaaacaaacaaacacacaaac

SEQ ID NO: 642710 - RNA, 21 nt, Human
aaacaaacaaacacacaaaca

SEQ ID NO: 642711 - RNA, 22 nt, Human
aaacaaacaaacacacaaacaa

SEQ ID NO: 642712 - RNA, 28 nt, Human
aaacaaacaaacacacaaaccggacccc

SEQ ID NO: 642713 - RNA, 22 nt, Human
aaacaaacacacaaacaacaac

SEQ ID NO: 642714 - RNA, 26 nt, Human
aaacaaacacacaaacaacaacaaca

SEQ ID NO: 642715 - RNA, 33 nt, Human
aacaaacaaacacacaaacaacaacaacaacua

SEQ ID NO: 642716 - RNA, 19 nt, Human
aacuggucuccccaagcca

SEQ ID NO: 642717 - RNA, 22 nt, Human
aagagcauaacuccagucacag

SEQ ID NO: 642718 - RNA, 22 nt, Human
aaggcucuggguucaaguucag

SEQ ID NO: 642719 - RNA, 20 nt, Human
aauggaagggacuuggcuca

SEQ ID NO: 642720 - RNA, 24 nt, Human
acaaacaaacacacaaacaacaac

SEQ ID NO: 642721 - RNA, 25 nt, Human
acaaacaaacacacaaacaacaacc

SEQ ID NO: 642722 - RNA, 18 nt, Human
acaaugucggugggggcc

SEQ ID NO: 642723 - RNA, 18 nt, Human
acaaugucggugggggcc

SEQ ID NO: 642724 - RNA, 24 nt, Human
acacaaacaacaacaacaacgaaa

SEQ ID NO: 642725 - RNA, 23 nt, Human
acacaaagguucuccacaucccc

SEQ ID NO: 642726 - RNA, 21 nt, Human
acacugucaccucucacuucc

SEQ ID NO: 642727 - RNA, 24 nt, Human
acccaguggauccagcacuggggc

SEQ ID NO: 642728 - RNA, 18 nt, Human
accccagcccugaggccc

SEQ ID NO: 642729 - RNA, 20 nt, Human
acccuucuggccagggugga

SEQ ID NO: 642730 - RNA, 22 nt, Human
acucagcaaacacccccuagcu

SEQ ID NO: 642731 - RNA, 22 nt, Human
agaaagcaggaaaggcacuuca

SEQ ID NO: 642732 - RNA, 20 nt, Human
agacacggugcuagccucgg

SEQ ID NO: 642733 - RNA, 18 nt, Human
agacucggggccgcacag

SEQ ID NO: 642734 - RNA, 24 nt, Human
agaggaggagaccccucccgcccu

SEQ ID NO: 642735 - RNA, 21 nt, Human
agcaaacacccccuagcucca

SEQ ID NO: 642736 - RNA, 20 nt, Human
agcaagauuuauugcaaaga

SEQ ID NO: 642737 - RNA, 20 nt, Human
agcagguggagcugccugcc

SEQ ID NO: 642738 - RNA, 21 nt, Human
agccaagaagguucaggccug

SEQ ID NO: 642739 - RNA, 19 nt, Human
agccagauacagagugugg

SEQ ID NO: 642740 - RNA, 25 nt, Human
agccaggaagggagggaggacccgg

SEQ ID NO: 642741 - RNA, 19 nt, Human
agcccagagaaggcaggga

SEQ ID NO: 642742 - RNA, 23 nt, Human
agcccagagaaggcagggaaggc

SEQ ID NO: 642743 - RNA, 24 nt, Human
agccuggaugauggaucgaggcuc

SEQ ID NO: 642744 - RNA, 19 nt, Human
aggacuucucccaucccag

SEQ ID NO: 642745 - RNA, 24 nt, Human
aggagaccccagcccugaggcccc

SEQ ID NO: 642746 - RNA, 21 nt, Human
aggcuggaucccuuggcgccc

SEQ ID NO: 642747 - RNA, 18 nt, Human
aggcuuccugggggagug

SEQ ID NO: 642748 - RNA, 18 nt, Human
agggagcuggcuccggcc

SEQ ID NO: 642749 - RNA, 22 nt, Human
agggcugugagggcugccagca

SEQ ID NO: 642750 - RNA, 26 nt, Human
aggggcuccuacagugcagcggcggg

SEQ ID NO: 642751 - RNA, 20 nt, Human
agggggcggcgcuccuuggg

SEQ ID NO: 642752 - RNA, 21 nt, Human
agggggguugucacugcuggc

SEQ ID NO: 642753 - RNA, 23 nt, Human
caaaaaacaaacaaacacacaaa

SEQ ID NO: 642754 - RNA, 23 nt, Human
caaacaaacacacaaacaacaac

SEQ ID NO: 642755 - RNA, 21 nt, Human
caaacaacaacaacaacgaaa

SEQ ID NO: 642756 - RNA, 21 nt, Human
caaugccccagaggugggagg

SEQ ID NO: 642757 - RNA, 23 nt, Human
cacacugucaccucucacuuccu

SEQ ID NO: 642758 - RNA, 19 nt, Human
cacagcccagagaaggcag

SEQ ID NO: 642759 - RNA, 24 nt, Human
cacagggugcugauugguguguuu

SEQ ID NO: 642760 - RNA, 22 nt, Human
cacauccccacuagauuagcua

SEQ ID NO: 642761 - RNA, 26 nt, Human
caccacuugaagagugguuugcccca

SEQ ID NO: 642762 - RNA, 21 nt, Human
caccagacucaggagcccagc

SEQ ID NO: 642763 - RNA, 23 nt, Human
caccagaguagccagauacagag

SEQ ID NO: 642764 - RNA, 24 nt, Human
cacccccuagcuccaggucccacc

SEQ ID NO: 642765 - RNA, 19 nt, Human
caccuggaaaggaauggaa

SEQ ID NO: 642766 - RNA, 18 nt, Human
cacuggggcagcaggugg

SEQ ID NO: 642767 - RNA, 25 nt, Human
cagaugcccuccccuggccuguccu

SEQ ID NO: 642768 - RNA, 22 nt, Human
cagcagcugcuggcccaggugc

SEQ ID NO: 642769 - RNA, 19 nt, Human
cagccaagaagguucaggc

SEQ ID NO: 642770 - RNA, 21 nt, Human
cagcccgagugggugggucuc

SEQ ID NO: 642771 - RNA, 21 nt, Human
cagcggcggguugaagggcuc

SEQ ID NO: 642772 - RNA, 23 nt, Human
cagcuaaggcccagcgagaaauc

SEQ ID NO: 642773 - RNA, 24 nt, Human
caggagaccccagcccugaggccc

SEQ ID NO: 642774 - RNA, 18 nt, Human
caggggccaggacugggc

SEQ ID NO: 642775 - RNA, 18 nt, Human
caggucccgagcccugcc

SEQ ID NO: 642776 - RNA, 20 nt, Human
caggucccgagcccugcccc

SEQ ID NO: 642777 - RNA, 19 nt, Human
ccaagacgaaaaaaaaaaa

SEQ ID NO: 642778 - RNA, 22 nt, Human
ccaagacgaaaaaaaaaaaaaa

SEQ ID NO: 642779 - RNA, 21 nt, Human
ccaggaagggagggaggaccc

SEQ ID NO: 642780 - RNA, 19 nt, Human
ccagucccgcgcugugcac

SEQ ID NO: 642781 - RNA, 25 nt, Human
ccagucccgcgcugugcacccgcac

SEQ ID NO: 642782 - RNA, 26 nt, Human
ccaucugaaaaccucuuggugcuuuu

SEQ ID NO: 642783 - RNA, 21 nt, Human
cccacgcccacccggaacuca

SEQ ID NO: 642784 - RNA, 23 nt, Human
cccacgcccacccggaacucacu

SEQ ID NO: 642785 - RNA, 19 nt, Human
cccagcccugaggcccgag

SEQ ID NO: 642786 - RNA, 22 nt, Human
ccccagaaacuggucuccccaa

SEQ ID NO: 642787 - RNA, 19 nt, Human
ccccauuuugagagagcuc

SEQ ID NO: 642788 - RNA, 22 nt, Human
ccccgguuccugcccgccccuc

SEQ ID NO: 642789 - RNA, 18 nt, Human
cccgcccuagucugaggc

SEQ ID NO: 642790 - RNA, 19 nt, Human
cccgccgagcccacgccca

SEQ ID NO: 642791 - RNA, 20 nt, Human
cccugaggcccgagcuacuc

SEQ ID NO: 642792 - RNA, 20 nt, Human
ccgccccucucccuccgcag

SEQ ID NO: 642793 - RNA, 18 nt, Human
ccggccuuggccagccca

SEQ ID NO: 642794 - RNA, 21 nt, Human
ccucccgcccuagucugaggc

SEQ ID NO: 642795 - RNA, 21 nt, Human
ccuccgcaccuccccgcaagc

SEQ ID NO: 642796 - RNA, 21 nt, Human
ccuggaugauggaucgaggcu

SEQ ID NO: 642797 - RNA, 20 nt, Human
cgagggggguugucacugcu

SEQ ID NO: 642798 - RNA, 29 nt, Human
cgcagccccgguuccugcccgccccucuu

SEQ ID NO: 642799 - RNA, 24 nt, Human
cgcuguggagcagggggcggcgcu

SEQ ID NO: 642800 - RNA, 22 nt, Human
cgggccugagagguugaggcag

SEQ ID NO: 642801 - RNA, 22 nt, Human
cuaaggucugcucuaggcugga

SEQ ID NO: 642802 - RNA, 21 nt, Human
cucaaaaaacaaacaaacaca

SEQ ID NO: 642803 - RNA, 20 nt, Human
cuccaggucccacccgaucc

SEQ ID NO: 642804 - RNA, 20 nt, Human
cucccuccgcaccuccccgc

SEQ ID NO: 642805 - RNA, 19 nt, Human
cuccuacagugcagcggcg

SEQ ID NO: 642806 - RNA, 22 nt, Human
cucuggcccgcaagcgcugcgc

SEQ ID NO: 642807 - RNA, 22 nt, Human
cucugucucaaaaaacaaacaa

SEQ ID NO: 642808 - RNA, 18 nt, Human
cugcacugcagccuggau

SEQ ID NO: 642809 - RNA, 21 nt, Human
cugcgcgcagccccgguuccu

SEQ ID NO: 642810 - RNA, 19 nt, Human
cugcucuaggcuggauccc

SEQ ID NO: 642811 - RNA, 21 nt, Human
cugcugcacugcagccuggau

SEQ ID NO: 642812 - RNA, 24 nt, Human
cugugucuuggugggugcucuugg

SEQ ID NO: 642813 - RNA, 20 nt, Human
gaaagaacaaagcuuccacg

SEQ ID NO: 642814 - RNA, 18 nt, Human
gagaaggcagggaaggcu

SEQ ID NO: 642815 - RNA, 18 nt, Human
gagagucaaguggucugu

SEQ ID NO: 642816 - RNA, 20 nt, Human
gaguauggcuuuggcaccug

SEQ ID NO: 642817 - RNA, 27 nt, Human
gagugggguuaggcuaauccccauuuu

SEQ ID NO: 642818 - RNA, 21 nt, Human
gaucgaggcucugucucaaaa

SEQ ID NO: 642819 - RNA, 24 nt, Human
gauggaucgaggcucugucucaaa

SEQ ID NO: 642820 - RNA, 18 nt, Human
gauugcucgggccugaga

SEQ ID NO: 642821 - RNA, 22 nt, Human
gcacagcccagagaaggcaggg

SEQ ID NO: 642822 - RNA, 20 nt, Human
gcacuggggcugggagcugg

SEQ ID NO: 642823 - RNA, 27 nt, Human
gccaagacgaaaaaaaaaaaaaaagaa

SEQ ID NO: 642824 - RNA, 23 nt, Human
gccaggaagggagggaggacccg

SEQ ID NO: 642825 - RNA, 24 nt, Human
gccccacccacauccugcugauug

SEQ ID NO: 642826 - RNA, 24 nt, Human
gccugaguauggcuuuggcaccug

SEQ ID NO: 642827 - RNA, 18 nt, Human
gcgcuguggagcaggggg

SEQ ID NO: 642828 - RNA, 21 nt, Human
gcuagacacaaagguucucca

SEQ ID NO: 642829 - RNA, 19 nt, Human
gcuagauacagagugccca

SEQ ID NO: 642830 - RNA, 20 nt, Human
gcugcacugcagccuggaug

SEQ ID NO: 642831 - RNA, 22 nt, Human
gcugggagcuggcauccagcgu

SEQ ID NO: 642832 - RNA, 21 nt, Human
ggaagggagggaggacccggc

SEQ ID NO: 642833 - RNA, 21 nt, Human
ggagaggcgggcugccgugcu

SEQ ID NO: 642834 - RNA, 24 nt, Human
ggcacuucagggagagggaagaac

SEQ ID NO: 642835 - RNA, 19 nt, Human
ggccagcccagaaaggggc

SEQ ID NO: 642836 - RNA, 18 nt, Human
ggccccgccgagcccacg

SEQ ID NO: 642837 - RNA, 24 nt, Human
ggccuguccugcugugucuuggug

SEQ ID NO: 642838 - RNA, 24 nt, Human
ggcgcuguggagcagggggcggcg

SEQ ID NO: 642839 - RNA, 21 nt, Human
ggcuccuacagugcagcggcg

SEQ ID NO: 642840 - RNA, 19 nt, Human
ggcuggaucccuuggcgcc

SEQ ID NO: 642841 - RNA, 26 nt, Human
gggaggcuccggccgcacaggagccc

SEQ ID NO: 642842 - RNA, 21 nt, Human
gggagugaguccuccaggaag

SEQ ID NO: 642843 - RNA, 24 nt, Human
gggccaggacugggcagcagagag

SEQ ID NO: 642844 - RNA, 19 nt, Human
gggcgcuguggagcagggg

SEQ ID NO: 642845 - RNA, 20 nt, Human
ggggcagcagguggagcugc

SEQ ID NO: 642846 - RNA, 23 nt, Human
ggggcugggagcuggcauccagc

SEQ ID NO: 642847 - RNA, 19 nt, Human
ggggguggggggaggguca

SEQ ID NO: 642848 - RNA, 21 nt, Human
gguugucacugcuggcucagg

SEQ ID NO: 642849 - RNA, 18 nt, Human
gugacagagugggguuag

SEQ ID NO: 642850 - RNA, 20 nt, Human
guggacugugcucuaaugga

SEQ ID NO: 642851 - RNA, 21 nt, Human
uagaagaauaagaaugacaga

SEQ ID NO: 642852 - RNA, 22 nt, Human
uagaagaauaagaaugacagaa

SEQ ID NO: 642853 - RNA, 24 nt, Human
uagaggaaugugcuagaaccuacc

SEQ ID NO: 642854 - RNA, 21 nt, Human
uagcaagauuuauugcaaaga

SEQ ID NO: 642855 - RNA, 20 nt, Human
uagccagauacagagugugg

SEQ ID NO: 642856 - RNA, 22 nt, Human
uagcuccaggucccacccgauc

SEQ ID NO: 642857 - RNA, 19 nt, Human
ucacucacucacucagcaa

SEQ ID NO: 642858 - RNA, 19 nt, Human
ucacucacucagcaaacac

SEQ ID NO: 642859 - RNA, 22 nt, Human
ucagcaaacacccccuagcucc

SEQ ID NO: 642860 - RNA, 19 nt, Human
ucagcagcugccauuccca

SEQ ID NO: 642861 - RNA, 21 nt, Human
ucagcagggggagaggcgggc

SEQ ID NO: 642862 - RNA, 23 nt, Human
ucagggagagggaagaacuugua

SEQ ID NO: 642863 - RNA, 19 nt, Human
uccaaguccccaccagacu

SEQ ID NO: 642864 - RNA, 19 nt, Human
uccaggaagcuagaggaau

SEQ ID NO: 642865 - RNA, 23 nt, Human
uccaggagaccccagcccugagg

SEQ ID NO: 642866 - RNA, 20 nt, Human
uccccagaaacuggucuccc

SEQ ID NO: 642867 - RNA, 21 nt, Human
ucccuccgcaccuccccgcaa

SEQ ID NO: 642868 - RNA, 22 nt, Human
uccugcccgccccucucccucc

SEQ ID NO: 642869 - RNA, 22 nt, Human
uccuggugugggugacagagug

SEQ ID NO: 642870 - RNA, 19 nt, Human
ucgagcacagcagcugcug

SEQ ID NO: 642871 - RNA, 19 nt, Human
ucuccaaguccccaccaga

SEQ ID NO: 642872 - RNA, 22 nt, Human
ucucccuccgcaccuccccgca

SEQ ID NO: 642873 - RNA, 30 nt, Human
ucucugugacaauagcccgacggaugcccu

SEQ ID NO: 642874 - RNA, 19 nt, Human
ucugccaccacuugaagag

SEQ ID NO: 642875 - RNA, 23 nt, Human
ugacagaaacaagaugcucggga

SEQ ID NO: 642876 - RNA, 22 nt, Human
ugacagagugggguuaggcuaa

SEQ ID NO: 642877 - RNA, 24 nt, Human
ugagcuagacacaaagguucucca

SEQ ID NO: 642878 - RNA, 22 nt, Human
ugagcuagauacagagugccca

SEQ ID NO: 642879 - RNA, 19 nt, Human
ugaggcccgagcuacucag

SEQ ID NO: 642880 - RNA, 20 nt, Human
ugagggggagacagacacag

SEQ ID NO: 642881 - RNA, 18 nt, Human
ugauggauucuguugucu

SEQ ID NO: 642882 - RNA, 26 nt, Human
ugcauucacaaacacugagcuagaca

SEQ ID NO: 642883 - RNA, 27 nt, Human
ugcauucacaaacacugagcuagacac

SEQ ID NO: 642884 - RNA, 27 nt, Human
ugccagucccgcgcugugcacccgcac

SEQ ID NO: 642885 - RNA, 19 nt, Human
ugccccagaggugggaggc

SEQ ID NO: 642886 - RNA, 22 nt, Human
ugcuagccucggguggacugug

SEQ ID NO: 642887 - RNA, 24 nt, Human
ugcucugaguggggccccgccgag

SEQ ID NO: 642888 - RNA, 27 nt, Human
uggaaaggaauggaagggacuuggcuc

SEQ ID NO: 642889 - RNA, 19 nt, Human
uggaagggacuuggcucau

SEQ ID NO: 642890 - RNA, 20 nt, Human
uggagcagggggcggcgcuc

SEQ ID NO: 642891 - RNA, 21 nt, Human
uggagcugccugccagucccg

SEQ ID NO: 642892 - RNA, 22 nt, Human
uggauuggugcauucacaaaca

SEQ ID NO: 642893 - RNA, 23 nt, Human
uggcaccugaaggcucuggguuu

SEQ ID NO: 642894 - RNA, 24 nt, Human
uggccuguccugcugugucuuggu

SEQ ID NO: 642895 - RNA, 18 nt, Human
uggcucaggcagccugcu

SEQ ID NO: 642896 - RNA, 19 nt, Human
ugggaggggacccgagggg

SEQ ID NO: 642897 - RNA, 21 nt, Human
ugggaggggacccgagggggg

SEQ ID NO: 642898 - RNA, 19 nt, Human
uggggccggccagcugcuc

SEQ ID NO: 642899 - RNA, 24 nt, Human
uggggccggccagcugcucugagu

SEQ ID NO: 642900 - RNA, 23 nt, Human
uggucgaugggacugggcgcugu

SEQ ID NO: 642901 - RNA, 19 nt, Human
uggugcauucacaaacacu

SEQ ID NO: 642902 - RNA, 19 nt, Human
uggugugggugacagagug

SEQ ID NO: 642903 - RNA, 21 nt, Human
uggugugggugacagaguggg

SEQ ID NO: 642904 - RNA, 24 nt, Human
uggugugggugacagagugggguu

SEQ ID NO: 642905 - RNA, 21 nt, Human
ugucuuggugggugcucuugg

SEQ ID NO: 642906 - RNA, 18 nt, Human
uguggagcagggggcggc

SEQ ID NO: 642907 - RNA, 19 nt, Human
uguggauuggugcauucac

SEQ ID NO: 642908 - RNA, 18 nt, Human
uguguuuacaaaccuuga

SEQ ID NO: 642909 - RNA, 20 nt, Human
uguguuuacaaaccuugagc

SEQ ID NO: 642910 - RNA, 21 nt, Human
uguguuuacaaaccuugagcu

SEQ ID NO: 642911 - RNA, 18 nt, Human
uguuucacucacucacuc

SEQ ID NO: 642912 - RNA, 18 nt, Human
uuccugggggagugaguc

SEQ ID NO: 642913 - RNA, 19 nt, Human
uuccugggggagugagucc

SEQ ID NO: 642914 - RNA, 18 nt, Human
uucuccacauccccacua

SEQ ID NO: 642915 - RNA, 24 nt, Human
uugcucgggccugagagguugagg

SEQ ID NO: 642916 - RNA, 22 nt, Human
uuggaagcuccccagaaacugg

SEQ ID NO: 642917 - RNA, 20 nt, Human
uuggugcauucacaaacacu

SEQ ID NO: 642918 - RNA, 21 nt, Human
uuugagagagcuccucugagg

SEQ ID NO: 642919 - RNA, 22 nt, Human
uuuuuuuuuuuuuuuuuuuggg

SEQ ID NO: 642920 - RNA, 23 nt, Human
aagcagccggcugccacagggcc

SEQ ID NO: 642921 - RNA, 21 nt, Human
acagguaaaagcgcagauguc

SEQ ID NO: 642922 - RNA, 19 nt, Human
accaccucagcggaacagc

SEQ ID NO: 642923 - RNA, 20 nt, Human
accccagauacacucaucac

SEQ ID NO: 642924 - RNA, 20 nt, Human
agaggagccacugggcugca

SEQ ID NO: 642925 - RNA, 28 nt, Human
agaggcagccgccacauuccccaagggg

SEQ ID NO: 642926 - RNA, 22 nt, Human
aggagccacugggcugcaggag

SEQ ID NO: 642927 - RNA, 23 nt, Human
agggcagugccugaggccccuuc

SEQ ID NO: 642928 - RNA, 23 nt, Human
agggcgugggcaccagaggagcc

SEQ ID NO: 642929 - RNA, 19 nt, Human
augaguucuuccgagcaaa

SEQ ID NO: 642930 - RNA, 21 nt, Human
augcucggagcccacagccac

SEQ ID NO: 642931 - RNA, 19 nt, Human
caagucuucaggcucguaa

SEQ ID NO: 642932 - RNA, 18 nt, Human
cacagcagcaggcucggc

SEQ ID NO: 642933 - RNA, 19 nt, Human
cacccuucccaguggucac

SEQ ID NO: 642934 - RNA, 18 nt, Human
cagaagaaguuagggaag

SEQ ID NO: 642935 - RNA, 20 nt, Human
cagauccaagagucgagggc

SEQ ID NO: 642936 - RNA, 18 nt, Human
cagccgccacauucaggc

SEQ ID NO: 642937 - RNA, 23 nt, Human
caggagaagaggaacagguaaaa

SEQ ID NO: 642938 - RNA, 22 nt, Human
cagggcccucagcccacccuuc

SEQ ID NO: 642939 - RNA, 20 nt, Human
caguggccggggggccaggg

SEQ ID NO: 642940 - RNA, 21 nt, Human
caucaggccucuccccacagc

SEQ ID NO: 642941 - RNA, 24 nt, Human
ccacugggcugcaggaggacagcc

SEQ ID NO: 642942 - RNA, 19 nt, Human
ccagagccccugcaucugg

SEQ ID NO: 642943 - RNA, 21 nt, Human
ccaguggucaccccuccuucc

SEQ ID NO: 642944 - RNA, 22 nt, Human
ccauccacuggggcaccugauc

SEQ ID NO: 642945 - RNA, 19 nt, Human
cccacagcggacccucgag

SEQ ID NO: 642946 - RNA, 23 nt, Human
cccauccacuggggcaccugauc

SEQ ID NO: 642947 - RNA, 18 nt, Human
cccaugagucaguguucc

SEQ ID NO: 642948 - RNA, 21 nt, Human
ccccaccaccucagcggaaca

SEQ ID NO: 642949 - RNA, 18 nt, Human
ccucagcccacccuuccc

SEQ ID NO: 642950 - RNA, 23 nt, Human
ccuccagaagccgcucccggucc

SEQ ID NO: 642951 - RNA, 24 nt, Human
ccuccuuccugugcugggcugcag

SEQ ID NO: 642952 - RNA, 20 nt, Human
ccugaggccccuuccugugg

SEQ ID NO: 642953 - RNA, 18 nt, Human
cgaggucucggagcagau

SEQ ID NO: 642954 - RNA, 19 nt, Human
cggagcagauccaagaguc

SEQ ID NO: 642955 - RNA, 19 nt, Human
cggucacgguccaggagcc

SEQ ID NO: 642956 - RNA, 21 nt, Human
cguggucacacacggaaugcc

SEQ ID NO: 642957 - RNA, 22 nt, Human
cuccagaagccgcucccggucc

SEQ ID NO: 642958 - RNA, 20 nt, Human
cuccccaggaagacgacgcc

SEQ ID NO: 642959 - RNA, 18 nt, Human
cuccuuccugugcugggc

SEQ ID NO: 642960 - RNA, 19 nt, Human
cuguggauuaacuccugau

SEQ ID NO: 642961 - RNA, 23 nt, Human
cuuaagugcugcgcugguaacuc

SEQ ID NO: 642962 - RNA, 18 nt, Human
cuuccuguggccucccca

SEQ ID NO: 642963 - RNA, 20 nt, Human
cuugguaccguugcuguggc

SEQ ID NO: 642964 - RNA, 18 nt, Human
gagcaaaaaugcgggccc

SEQ ID NO: 642965 - RNA, 19 nt, Human
gcagauccaagagucgagg

SEQ ID NO: 642966 - RNA, 21 nt, Human
gccucuccccacagcggaccc

SEQ ID NO: 642967 - RNA, 23 nt, Human
gccugaggccccuuccuguggcc

SEQ ID NO: 642968 - RNA, 20 nt, Human
gcggaacagcaggguggcaa

SEQ ID NO: 642969 - RNA, 22 nt, Human
gcggaacagcaggguggcaagg

SEQ ID NO: 642970 - RNA, 21 nt, Human
ggaacagcaggguggcaaggg

SEQ ID NO: 642971 - RNA, 19 nt, Human
ggccaggguccacagcuug

SEQ ID NO: 642972 - RNA, 23 nt, Human
ggcugcaggaggacagcccugug

SEQ ID NO: 642973 - RNA, 23 nt, Human
ggcugggugcagcccauccacug

SEQ ID NO: 642974 - RNA, 20 nt, Human
gggcgugggcaccagaggag

SEQ ID NO: 642975 - RNA, 21 nt, Human
ggguggucuaggaaccugagg

SEQ ID NO: 642976 - RNA, 20 nt, Human
ggugcuuugcuuuuguuaag

SEQ ID NO: 642977 - RNA, 20 nt, Human
ggugggcugggugcagccca

SEQ ID NO: 642978 - RNA, 20 nt, Human
gguggucuaggaaccugagg

SEQ ID NO: 642979 - RNA, 20 nt, Human
gugggcugggugcagcccau

SEQ ID NO: 642980 - RNA, 19 nt, Human
ucaaggucaaggucgcgcu

SEQ ID NO: 642981 - RNA, 19 nt, Human
ucagcccacccuucccagu

SEQ ID NO: 642982 - RNA, 19 nt, Human
uccacaaggccugaauuca

SEQ ID NO: 642983 - RNA, 21 nt, Human
uccacagaccaugggucccca

SEQ ID NO: 642984 - RNA, 21 nt, Human
uccacagaccaugggucccca

SEQ ID NO: 642985 - RNA, 23 nt, Human
uccacagaccauggguccccacc

SEQ ID NO: 642986 - RNA, 24 nt, Human
uccacagcuugugaugggugggag

SEQ ID NO: 642987 - RNA, 23 nt, Human
ucccaguggucaccccuccuucc

SEQ ID NO: 642988 - RNA, 23 nt, Human
uccccaccaccucagcggaacag

SEQ ID NO: 642989 - RNA, 24 nt, Human
ucgcggucccgguccaagucguca

SEQ ID NO: 642990 - RNA, 23 nt, Human
ucggagcccacagccacagggcc

SEQ ID NO: 642991 - RNA, 18 nt, Human
ucucggagcagauccaag

SEQ ID NO: 642992 - RNA, 19 nt, Human
ugaagggcguuuuaaugga

SEQ ID NO: 642993 - RNA, 23 nt, Human
ugaagggcguuuuaauggagaca

SEQ ID NO: 642994 - RNA, 21 nt, Human
ugagggccagggugggcuggg

SEQ ID NO: 642995 - RNA, 21 nt, Human
ugaguucuuccgagcaaaaau

SEQ ID NO: 642996 - RNA, 23 nt, Human
ugccugaggccccuuccuguggc

SEQ ID NO: 642997 - RNA, 24 nt, Human
ugcucggagcccacagccacaggg

SEQ ID NO: 642998 - RNA, 18 nt, Human
uggcaagggcgugggcac

SEQ ID NO: 642999 - RNA, 22 nt, Human
uggcaagggcgugggcaccaga

SEQ ID NO: 643000 - RNA, 19 nt, Human
ugggagcagaacggccucu

SEQ ID NO: 643001 - RNA, 20 nt, Human
ugggugcagcccauccacug

SEQ ID NO: 643002 - RNA, 24 nt, Human
ugucugcaguggccggggggccag

SEQ ID NO: 643003 - RNA, 23 nt, Human
uuuuuuuuuuuuucaaugaaggg

SEQ ID NO: 643004 - RNA, 28 nt, Human
uuuuuuuuuuuuuucaaugaagggcguu

SEQ ID NO: 643005 - RNA, 24 nt, Human
uuuuuuuuuuuuuuuuuuucaaug

SEQ ID NO: 643006 - RNA, 18 nt, Human
aaaaaaaaaaaaauuagc

SEQ ID NO: 643007 - RNA, 24 nt, Human
aaaaaagugacauauagaaaagaa

SEQ ID NO: 643008 - RNA, 19 nt, Human
aaacaagauuagcacugua

SEQ ID NO: 643009 - RNA, 21 nt, Human
aaauggucgguguacacgaac

SEQ ID NO: 643010 - RNA, 19 nt, Human
aacgugcugggauuacagg

SEQ ID NO: 643011 - RNA, 18 nt, Human
aagaaacaaaaagaugug

SEQ ID NO: 643012 - RNA, 22 nt, Human
aaggguaauaauaacacaaaac

SEQ ID NO: 643013 - RNA, 20 nt, Human
aaguccuuuuuuuuuuuuuu

SEQ ID NO: 643014 - RNA, 18 nt, Human
aaguucaccugcagguga

SEQ ID NO: 643015 - RNA, 25 nt, Human
aauaacacaaaacagagaugaggga

SEQ ID NO: 643016 - RNA, 20 nt, Human
aaucugcccgccuuggccuc

SEQ ID NO: 643017 - RNA, 23 nt, Human
acaggcgcccgccaccacgcccg

SEQ ID NO: 643018 - RNA, 22 nt, Human
accauguuggccaggcuggucu

SEQ ID NO: 643019 - RNA, 18 nt, Human
acgagguuucaccauguu

SEQ ID NO: 643020 - RNA, 20 nt, Human
acgagguuucaccauguugg

SEQ ID NO: 643021 - RNA, 24 nt, Human
acgagguuucaccauguuggccag

SEQ ID NO: 643022 - RNA, 21 nt, Human
acgugcuucggggccuguagu

SEQ ID NO: 643023 - RNA, 25 nt, Human
agacgggagugcaguggcgccaucu

SEQ ID NO: 643024 - RNA, 23 nt, Human
agcagcuaggauuacaggcgccc

SEQ ID NO: 643025 - RNA, 20 nt, Human
agcugcucugcggggccgug

SEQ ID NO: 643026 - RNA, 24 nt, Human
aggagugcaguggcgcgaucucgg

SEQ ID NO: 643027 - RNA, 23 nt, Human
aggaguucaagaccagccuaggc

SEQ ID NO: 643028 - RNA, 25 nt, Human
aggcaggagugcaguggcgcgaucu

SEQ ID NO: 643029 - RNA, 24 nt, Human
aggcugagggggguggaucgcuug

SEQ ID NO: 643030 - RNA, 20 nt, Human
aggcuuccggguggagcccu

SEQ ID NO: 643031 - RNA, 23 nt, Human
agggguucuucugccucagcucc

SEQ ID NO: 643032 - RNA, 20 nt, Human
agguguagugauccacaacc

SEQ ID NO: 643033 - RNA, 22 nt, Human
agguuucaccauguuggccagg

SEQ ID NO: 643034 - RNA, 22 nt, Human
aguagagacgagguuucaccau

SEQ ID NO: 643035 - RNA, 21 nt, Human
aguauagaagaaacaaaaaga

SEQ ID NO: 643036 - RNA, 19 nt, Human
agugcaguggcgccaucuc

SEQ ID NO: 643037 - RNA, 20 nt, Human
agugcaguggcgcgaucucg

SEQ ID NO: 643038 - RNA, 23 nt, Human
agugcaguggcgcgaucucggcu

SEQ ID NO: 643039 - RNA, 24 nt, Human
agugcaguggcgcgaucucggcuc

SEQ ID NO: 643040 - RNA, 24 nt, Human
auauauuuguauuuuuaguagaga

SEQ ID NO: 643041 - RNA, 24 nt, Human
auauuuguauuuuuaguagagacg

SEQ ID NO: 643042 - RNA, 21 nt, Human
auugcacuccagccuggguga

SEQ ID NO: 643043 - RNA, 24 nt, Human
auugcgccauugcacuccagccug

SEQ ID NO: 643044 - RNA, 22 nt, Human
caacauggagagaccuugucuc

SEQ ID NO: 643045 - RNA, 18 nt, Human
caaccaaaaaaaaaaaag

SEQ ID NO: 643046 - RNA, 22 nt, Human
caaccaaaaaaaaaaaagugac

SEQ ID NO: 643047 - RNA, 18 nt, Human
caacgugcugggauuaca

SEQ ID NO: 643048 - RNA, 26 nt, Human
caagcaauucucugccucagccuccc

SEQ ID NO: 643049 - RNA, 22 nt, Human
caagggguucuucugccucagc

SEQ ID NO: 643050 - RNA, 23 nt, Human
cacaaaacagagaugagggacaa

SEQ ID NO: 643051 - RNA, 24 nt, Human
cacaaaacagagaugagggacaag

SEQ ID NO: 643052 - RNA, 19 nt, Human
cacaacauguugggccugg

SEQ ID NO: 643053 - RNA, 20 nt, Human
caccauauugccuuaaugcc

SEQ ID NO: 643054 - RNA, 21 nt, Human
caccauguuggccaggcuggu

SEQ ID NO: 643055 - RNA, 22 nt, Human
caccauguuggccaggcugguc

SEQ ID NO: 643056 - RNA, 24 nt, Human
caccauguuggccaggcuggucuu

SEQ ID NO: 643057 - RNA, 18 nt, Human
cacuccagccugggugac

SEQ ID NO: 643058 - RNA, 22 nt, Human
cacuccagccugggugacacaa

SEQ ID NO: 643059 - RNA, 23 nt, Human
cacuccagccugggugacacaag

SEQ ID NO: 643060 - RNA, 24 nt, Human
cagccuaggcaacauggagagacc

SEQ ID NO: 643061 - RNA, 21 nt, Human
caggcgcccgccaccacgccc

SEQ ID NO: 643062 - RNA, 22 nt, Human
caggugggcgcagugacucaug

SEQ ID NO: 643063 - RNA, 24 nt, Human
caucuguguugccuacuacuuggg

SEQ ID NO: 643064 - RNA, 21 nt, Human
cauggagagaccuugucucca

SEQ ID NO: 643065 - RNA, 24 nt, Human
cauguuggccaggcuggucuugaa

SEQ ID NO: 643066 - RNA, 19 nt, Human
cauugcacuccagccuggg

SEQ ID NO: 643067 - RNA, 21 nt, Human
cauugcacuccagccugggug

SEQ ID NO: 643068 - RNA, 22 nt, Human
cauugcacuccagccuggguga

SEQ ID NO: 643069 - RNA, 24 nt, Human
cauugcacuccagccugggugaca

SEQ ID NO: 643070 - RNA, 26 nt, Human
cauugugucccaggcaggagugcagu

SEQ ID NO: 643071 - RNA, 19 nt, Human
ccaacgugcugggauuaca

SEQ ID NO: 643072 - RNA, 22 nt, Human
ccaacgugcugggauuacaggc

SEQ ID NO: 643073 - RNA, 19 nt, Human
ccaccuucuccucgccccg

SEQ ID NO: 643074 - RNA, 21 nt, Human
ccagacaggaagugaugagau

SEQ ID NO: 643075 - RNA, 20 nt, Human
ccaggguucaagcaauucuc

SEQ ID NO: 643076 - RNA, 20 nt, Human
ccaggguucaagcaauucuc

SEQ ID NO: 643077 - RNA, 18 nt, Human
ccauugcacuccagccug

SEQ ID NO: 643078 - RNA, 20 nt, Human
ccauugcacuccagccuggg

SEQ ID NO: 643079 - RNA, 21 nt, Human
ccauugcacuccagccugggu

SEQ ID NO: 643080 - RNA, 21 nt, Human
ccauugcacuccagccugggu

SEQ ID NO: 643081 - RNA, 22 nt, Human
ccauugcacuccagccugggug

SEQ ID NO: 643082 - RNA, 23 nt, Human
ccauugcacuccagccuggguga

SEQ ID NO: 643083 - RNA, 23 nt, Human
ccauugcacuccagccuggguga

SEQ ID NO: 643084 - RNA, 24 nt, Human
ccauugcacuccagccugggugac

SEQ ID NO: 643085 - RNA, 24 nt, Human
cccaacgugcugggauuacaggcu

SEQ ID NO: 643086 - RNA, 22 nt, Human
ccccgcuagggcgcuccccuug

SEQ ID NO: 643087 - RNA, 19 nt, Human
cccgccuuggccucccaac

SEQ ID NO: 643088 - RNA, 24 nt, Human
cccgggcuguaggacccucauuuc

SEQ ID NO: 643089 - RNA, 23 nt, Human
cccggguucaagggguucuucug

SEQ ID NO: 643090 - RNA, 18 nt, Human
cccuggggccccgcuagg

SEQ ID NO: 643091 - RNA, 18 nt, Human
cccuggggccccgcuagg

SEQ ID NO: 643092 - RNA, 18 nt, Human
cccuugcucugccgccug

SEQ ID NO: 643093 - RNA, 20 nt, Human
cccuugcucugccgccuggg

SEQ ID NO: 643094 - RNA, 21 nt, Human
ccgccuuggccucccaacgug

SEQ ID NO: 643095 - RNA, 24 nt, Human
ccggguggagcccugcgcccuauc

SEQ ID NO: 643096 - RNA, 24 nt, Human
ccuccaggguucaagcaauucucu

SEQ ID NO: 643097 - RNA, 21 nt, Human
ccugaccuugcccaggacggc

SEQ ID NO: 643098 - RNA, 19 nt, Human
ccuugucuccacaaaaaaa

SEQ ID NO: 643099 - RNA, 18 nt, Human
ccuuuuuuuuuuuuuuga

SEQ ID NO: 643100 - RNA, 20 nt, Human
cggcugcgcgcugcuccucg

SEQ ID NO: 643101 - RNA, 24 nt, Human
cgugcugggauuacaggcuugagc

SEQ ID NO: 643102 - RNA, 19 nt, Human
cuacuggccguuagcugug

SEQ ID NO: 643103 - RNA, 22 nt, Human
cucacaacauguugggccuggg

SEQ ID NO: 643104 - RNA, 22 nt, Human
cucacugaaaccuccgccuccc

SEQ ID NO: 643105 - RNA, 24 nt, Human
cucacugaaaccuccgccucccgg

SEQ ID NO: 643106 - RNA, 18 nt, Human
cucccggaaccugcggcc

SEQ ID NO: 643107 - RNA, 21 nt, Human
cucccggguucaagggguucu

SEQ ID NO: 643108 - RNA, 22 nt, Human
cucucucucucucccccagacg

SEQ ID NO: 643109 - RNA, 21 nt, Human
cucugccucagccucccaagc

SEQ ID NO: 643110 - RNA, 24 nt, Human
cugcaaccuccgccuccaggguuc

SEQ ID NO: 643111 - RNA, 23 nt, Human
cugccucagccucccaagcagcu

SEQ ID NO: 643112 - RNA, 22 nt, Human
cugccucagcuccugaguagcu

SEQ ID NO: 643113 - RNA, 21 nt, Human
cugcgcgcugcuccucgcccu

SEQ ID NO: 643114 - RNA, 21 nt, Human
cuggucuugaacgccuggucu

SEQ ID NO: 643115 - RNA, 20 nt, Human
cuuugggaggucgaaggggg

SEQ ID NO: 643116 - RNA, 23 nt, Human
gagguuucaccauguuggccagg

SEQ ID NO: 643117 - RNA, 24 nt, Human
gaucgcuugagcccaggaguucaa

SEQ ID NO: 643118 - RNA, 18 nt, Human
gauuacaggcgcccgcca

SEQ ID NO: 643119 - RNA, 18 nt, Human
gauuacaggcuugagcca

SEQ ID NO: 643120 - RNA, 22 nt, Human
gauuacaggcuugagccaccgc

SEQ ID NO: 643121 - RNA, 23 nt, Human
gauuucauuccccuuaagcuuca

SEQ ID NO: 643122 - RNA, 22 nt, Human
gcaaccuccgccuccaggguuc

SEQ ID NO: 643123 - RNA, 19 nt, Human
gcagcggccucagccgggg

SEQ ID NO: 643124 - RNA, 19 nt, Human
gccauugcacuccagccug

SEQ ID NO: 643125 - RNA, 24 nt, Human
gccauugcacuccagccuggguga

SEQ ID NO: 643126 - RNA, 22 nt, Human
gcccaggaguucaagaccagcc

SEQ ID NO: 643127 - RNA, 18 nt, Human
gcccggacccuggggccc

SEQ ID NO: 643128 - RNA, 18 nt, Human
gcccucgaaguuuuauuu

SEQ ID NO: 643129 - RNA, 21 nt, Human
gccucccaagcagcuaggauu

SEQ ID NO: 643130 - RNA, 20 nt, Human
ggaggcgggucgggggugcu

SEQ ID NO: 643131 - RNA, 22 nt, Human
ggauuacaggcgcccgccacca

SEQ ID NO: 643132 - RNA, 20 nt, Human
gggaggucgaagggggaaga

SEQ ID NO: 643133 - RNA, 19 nt, Human
gggcgcagugacucaugcu

SEQ ID NO: 643134 - RNA, 21 nt, Human
gggcgcuccccuugcucugcc

SEQ ID NO: 643135 - RNA, 27 nt, Human
ggggguggaucgcuugagcugggguug

SEQ ID NO: 643136 - RNA, 21 nt, Human
gggguggaucgcuugagcugg

SEQ ID NO: 643137 - RNA, 20 nt, Human
ggguggaccugucacuucgg

SEQ ID NO: 643138 - RNA, 24 nt, Human
guaucaaaaaacaaccaaaaaaaa

SEQ ID NO: 643139 - RNA, 18 nt, Human
uaacgcuuugggaggucg

SEQ ID NO: 643140 - RNA, 23 nt, Human
uacaggcgcccgccaccacgccc

SEQ ID NO: 643141 - RNA, 23 nt, Human
uacaggcuugagccaccgcgccc

SEQ ID NO: 643142 - RNA, 22 nt, Human
uacgugcuucggggccuguagu

SEQ ID NO: 643143 - RNA, 25 nt, Human
uagaagaaacaaaaagaugugacag

SEQ ID NO: 643144 - RNA, 22 nt, Human
uagagacgagguuucaccaugu

SEQ ID NO: 643145 - RNA, 25 nt, Human
uagcaauaaauuguguaacucuaau

SEQ ID NO: 643146 - RNA, 19 nt, Human
uagcugggcguagucgcac

SEQ ID NO: 643147 - RNA, 21 nt, Human
uaggauuacaggcgcccgcca

SEQ ID NO: 643148 - RNA, 22 nt, Human
uaggauuacaggcgcccgccac

SEQ ID NO: 643149 - RNA, 24 nt, Human
uaggauuacaggcgcccgccacca

SEQ ID NO: 643150 - RNA, 24 nt, Human
uaguagagacgagguuucaccaug

SEQ ID NO: 643151 - RNA, 26 nt, Human
uaguagagacgagguuucaccauguu

SEQ ID NO: 643152 - RNA, 18 nt, Human
uaucaaaaaacaaccaaa

SEQ ID NO: 643153 - RNA, 23 nt, Human
uaucaaaaaacaaccaaaaaaaa

SEQ ID NO: 643154 - RNA, 24 nt, Human
uaugauugcgccauugcacuccag

SEQ ID NO: 643155 - RNA, 24 nt, Human
ucacugaaaccuccgccucccggg

SEQ ID NO: 643156 - RNA, 25 nt, Human
ucacugaaaccuccgccucccgggu

SEQ ID NO: 643157 - RNA, 23 nt, Human
ucacugcaaccuccgccuccagg

SEQ ID NO: 643158 - RNA, 24 nt, Human
ucacugcaaccuccgccuccaggg

SEQ ID NO: 643159 - RNA, 25 nt, Human
ucacugcaaccuccgccuccagggu

SEQ ID NO: 643160 - RNA, 27 nt, Human
ucacugcaaccuccgccuccaggguuc

SEQ ID NO: 643161 - RNA, 20 nt, Human
ucagccucccaagcagcuag

SEQ ID NO: 643162 - RNA, 22 nt, Human
uccacagaagcagaaccagaca

SEQ ID NO: 643163 - RNA, 21 nt, Human
uccagccugggugacacaaga

SEQ ID NO: 643164 - RNA, 23 nt, Human
uccaggguucaagcaauucucug

SEQ ID NO: 643165 - RNA, 24 nt, Human
ucccaacgugcugggauuacaggc

SEQ ID NO: 643166 - RNA, 23 nt, Human
ucccaagcagcuaggauuacagg

SEQ ID NO: 643167 - RNA, 24 nt, Human
ucccaagcagcuaggauuacaggc

SEQ ID NO: 643168 - RNA, 19 nt, Human
ucccaggcaggagugcagu

SEQ ID NO: 643169 - RNA, 19 nt, Human
ucccggguucaagggguuc

SEQ ID NO: 643170 - RNA, 20 nt, Human
ucccggguucaagggguucu

SEQ ID NO: 643171 - RNA, 24 nt, Human
ucccggguucaagggguucuucug

SEQ ID NO: 643172 - RNA, 24 nt, Human
uccgccuccaggguucaagcaauu

SEQ ID NO: 643173 - RNA, 23 nt, Human
ucgcuugagcccaggaguucaag

SEQ ID NO: 643174 - RNA, 23 nt, Human
ucucaccgauuucauuccccuua

SEQ ID NO: 643175 - RNA, 20 nt, Human
ucuccacaaaaaaaaaaaaa

SEQ ID NO: 643176 - RNA, 18 nt, Human
ucucccccagacgggagu

SEQ ID NO: 643177 - RNA, 21 nt, Human
ucucucucucucucuccccca

SEQ ID NO: 643178 - RNA, 19 nt, Human
ucuguguugccuacuacuu

SEQ ID NO: 643179 - RNA, 19 nt, Human
ucuguguugccuacuacuu

SEQ ID NO: 643180 - RNA, 26 nt, Human
ugacacaagacccuguaucaaaaaac

SEQ ID NO: 643181 - RNA, 18 nt, Human
ugaccuguggcagaggug

SEQ ID NO: 643182 - RNA, 24 nt, Human
ugaccuguggcagagguggcgucu

SEQ ID NO: 643183 - RNA, 23 nt, Human
ugagcccaggaguucaagaccag

SEQ ID NO: 643184 - RNA, 22 nt, Human
ugagcugggguugucaaggcuu

SEQ ID NO: 643185 - RNA, 22 nt, Human
ugagggggguggaucgcuugag

SEQ ID NO: 643186 - RNA, 21 nt, Human
ugcacuccagccugggugaca

SEQ ID NO: 643187 - RNA, 20 nt, Human
ugcaggugaggcggcccgga

SEQ ID NO: 643188 - RNA, 22 nt, Human
ugcaguggcgcgaucucggcuc

SEQ ID NO: 643189 - RNA, 18 nt, Human
ugcccaggacggcugacc

SEQ ID NO: 643190 - RNA, 23 nt, Human
ugccucagccucccaagcagcua

SEQ ID NO: 643191 - RNA, 24 nt, Human
ugccucagccucccaagcagcuag

SEQ ID NO: 643192 - RNA, 19 nt, Human
ugccucagcuccugaguag

SEQ ID NO: 643193 - RNA, 20 nt, Human
ugccucagcuccugaguagc

SEQ ID NO: 643194 - RNA, 22 nt, Human
ugccucagcuccugaguagcuc

SEQ ID NO: 643195 - RNA, 23 nt, Human
ugcggccacggcuucccaccuuc

SEQ ID NO: 643196 - RNA, 21 nt, Human
ugcuaugauugcgccauugca

SEQ ID NO: 643197 - RNA, 18 nt, Human
uggagccugcagggccgg

SEQ ID NO: 643198 - RNA, 25 nt, Human
uggaggacaaguccuuuuuuuuuuu

SEQ ID NO: 643199 - RNA, 18 nt, Human
uggagucacuaggggugg

SEQ ID NO: 643200 - RNA, 18 nt, Human
uggaucgcuugagcuggg

SEQ ID NO: 643201 - RNA, 24 nt, Human
uggccaggcuggucuugaacgccu

SEQ ID NO: 643202 - RNA, 18 nt, Human
uggcgaggcuuccgggug

SEQ ID NO: 643203 - RNA, 21 nt, Human
uggcugacacauuaaaugucu

SEQ ID NO: 643204 - RNA, 19 nt, Human
ugggaggcugaggggggug

SEQ ID NO: 643205 - RNA, 23 nt, Human
ugggaggcugagggggguggauc

SEQ ID NO: 643206 - RNA, 18 nt, Human
ugggauuacaggcuugag

SEQ ID NO: 643207 - RNA, 19 nt, Human
ugggauuacaggcuugagc

SEQ ID NO: 643208 - RNA, 21 nt, Human
ugggauuacaggcuugagcca

SEQ ID NO: 643209 - RNA, 22 nt, Human
ugggauuacaggcuugagccac

SEQ ID NO: 643210 - RNA, 23 nt, Human
ugggauuacaggcuugagccacc

SEQ ID NO: 643211 - RNA, 24 nt, Human
ugggauuacaggcuugagccaccg

SEQ ID NO: 643212 - RNA, 22 nt, Human
ugggccuggguggcugacacau

SEQ ID NO: 643213 - RNA, 18 nt, Human
ugggucacauagcugacc

SEQ ID NO: 643214 - RNA, 18 nt, Human
ugucaaggcuucagugug

SEQ ID NO: 643215 - RNA, 18 nt, Human
uuagcugggcguagucgc

SEQ ID NO: 643216 - RNA, 24 nt, Human
uuaguagagacgagguuucaccau

SEQ ID NO: 643217 - RNA, 23 nt, Human
uucaagggguucuucugccucag

SEQ ID NO: 643218 - RNA, 21 nt, Human
uucccaccuucuccucgcccc

SEQ ID NO: 643219 - RNA, 18 nt, Human
uucuucugccucagcucc

SEQ ID NO: 643220 - RNA, 22 nt, Human
uucuuuagcaauaaauugugua

SEQ ID NO: 643221 - RNA, 22 nt, Human
uugagcccaggaguucaagacc

SEQ ID NO: 643222 - RNA, 24 nt, Human
uugggaggcugagggggguggauc

SEQ ID NO: 643223 - RNA, 24 nt, Human
uuucaccauguuggccaggcuggu

SEQ ID NO: 643224 - RNA, 18 nt, Human
uuuguauuuuuaguagag

SEQ ID NO: 643225 - RNA, 19 nt, Human
uuuguauuuuuaguagaga

SEQ ID NO: 643226 - RNA, 24 nt, Human
uuuuuaguagagacgagguuucac

SEQ ID NO: 643227 - RNA, 24 nt, Human
uuuuuugagacaagagucucucuc

SEQ ID NO: 643228 - RNA, 24 nt, Human
uuuuuuuuuuuugagacaagaguc

SEQ ID NO: 643229 - RNA, 18 nt, Human
aaaaaaaggcuaauugua

SEQ ID NO: 643230 - RNA, 26 nt, Human
aaaaagccaguugauuaccaauaaug

SEQ ID NO: 643231 - RNA, 22 nt, Human
aaaccacacugcaaauuaacaa

SEQ ID NO: 643232 - RNA, 26 nt, Human
aaagaaauaaaacagaaaauuuugcc

SEQ ID NO: 643233 - RNA, 26 nt, Human
aaagaacaaucccuuguuaggccuag

SEQ ID NO: 643234 - RNA, 23 nt, Human
aaagaagauuuuaaaagaacaau

SEQ ID NO: 643235 - RNA, 25 nt, Human
aacaaaaagaaaucagacaaucuaa

SEQ ID NO: 643236 - RNA, 24 nt, Human
aaccaacaaaaucuuagcaauuau

SEQ ID NO: 643237 - RNA, 19 nt, Human
aaguacauacagauauucu

SEQ ID NO: 643238 - RNA, 18 nt, Human
aagucaggucagcucuuu

SEQ ID NO: 643239 - RNA, 20 nt, Human
acaaaaagaaaucagacaau

SEQ ID NO: 643240 - RNA, 22 nt, Human
acaacaaaaagaaaucagacaa

SEQ ID NO: 643241 - RNA, 24 nt, Human
acacugcaaagucaauuuccuggg

SEQ ID NO: 643242 - RNA, 22 nt, Human
acagcuuuuugcucuuucuucu

SEQ ID NO: 643243 - RNA, 19 nt, Human
accacacugcaaauuaaca

SEQ ID NO: 643244 - RNA, 26 nt, Human
accauuauaaaagagacuugccugaa

SEQ ID NO: 643245 - RNA, 26 nt, Human
acucaauauauuuaacacacauauuu

SEQ ID NO: 643246 - RNA, 20 nt, Human
acuuucaaacaugcaaaaca

SEQ ID NO: 643247 - RNA, 20 nt, Human
aguguuuacagcucaaggga

SEQ ID NO: 643248 - RNA, 22 nt, Human
auaaaacagaaaauuuugccuu

SEQ ID NO: 643249 - RNA, 18 nt, Human
aucuaaaggacauuggcu

SEQ ID NO: 643250 - RNA, 24 nt, Human
caaaacaagcuccuaacaccagau

SEQ ID NO: 643251 - RNA, 22 nt, Human
caaauuaacaaaagaauuguac

SEQ ID NO: 643252 - RNA, 22 nt, Human
caagcuccuaacaccagauauu

SEQ ID NO: 643253 - RNA, 19 nt, Human
caauauauuuaacacacau

SEQ ID NO: 643254 - RNA, 24 nt, Human
caccaguggugacacugcaaaguc

SEQ ID NO: 643255 - RNA, 23 nt, Human
cacugcaaagucaauuuccuggg

SEQ ID NO: 643256 - RNA, 21 nt, Human
cacuugaaaaaccauuauaaa

SEQ ID NO: 643257 - RNA, 20 nt, Human
cagaacaauacgaaaugcag

SEQ ID NO: 643258 - RNA, 24 nt, Human
cagcaaaacaagcuccuaacacca

SEQ ID NO: 643259 - RNA, 25 nt, Human
caucugaacaaacaaucuugcaguc

SEQ ID NO: 643260 - RNA, 21 nt, Human
ccaaguacauacagauauucu

SEQ ID NO: 643261 - RNA, 23 nt, Human
ccacaacaaaaagaaaucagaca

SEQ ID NO: 643262 - RNA, 21 nt, Human
ccacacugcaaauuaacaaaa

SEQ ID NO: 643263 - RNA, 22 nt, Human
ccacacugcaaauuaacaaaag

SEQ ID NO: 643264 - RNA, 24 nt, Human
ccagugauuugggugauaaaguua

SEQ ID NO: 643265 - RNA, 23 nt, Human
cuccaagcccuuauuugcuuaug

SEQ ID NO: 643266 - RNA, 19 nt, Human
gaaaaaccauuauaaaaga

SEQ ID NO: 643267 - RNA, 19 nt, Human
gcaaauuaacaaaagaauu

SEQ ID NO: 643268 - RNA, 22 nt, Human
gcuacugguugccuuuauucuc

SEQ ID NO: 643269 - RNA, 22 nt, Human
uaaaagugaucgcugcaaaauc

SEQ ID NO: 643270 - RNA, 20 nt, Human
uaacacguauacguguauac

SEQ ID NO: 643271 - RNA, 23 nt, Human
uaaguugaacuucauuugccguu

SEQ ID NO: 643272 - RNA, 21 nt, Human
uacaccacuucugcaaauaag

SEQ ID NO: 643273 - RNA, 21 nt, Human
uacaccacuucugcaaauaag

SEQ ID NO: 643274 - RNA, 18 nt, Human
uacauuaaccaacaaaau

SEQ ID NO: 643275 - RNA, 21 nt, Human
uaccauuuugaaauauacaga

SEQ ID NO: 643276 - RNA, 21 nt, Human
uagaauaaauggcacuugaaa

SEQ ID NO: 643277 - RNA, 22 nt, Human
uagcuuacaccaguggugacac

SEQ ID NO: 643278 - RNA, 20 nt, Human
uauaaaagagacuugccuga

SEQ ID NO: 643279 - RNA, 20 nt, Human
ucaaugccagugauuugggu

SEQ ID NO: 643280 - RNA, 21 nt, Human
uccacaaucaugauuuuuguc

SEQ ID NO: 643281 - RNA, 22 nt, Human
uccacaaucaugauuuuugucc

SEQ ID NO: 643282 - RNA, 24 nt, Human
uccuaacaccagauauucucuuua

SEQ ID NO: 643283 - RNA, 18 nt, Human
uccugggcauuugauggc

SEQ ID NO: 643284 - RNA, 20 nt, Human
ugaaguggacuguugccuca

SEQ ID NO: 643285 - RNA, 21 nt, Human
ugaaguggacuguugccucag

SEQ ID NO: 643286 - RNA, 18 nt, Human
ugauccaauuuaucaaaa

SEQ ID NO: 643287 - RNA, 20 nt, Human
ugauuaaaaacaguuuauua

SEQ ID NO: 643288 - RNA, 21 nt, Human
ugcagaaaagucauaucuuua

SEQ ID NO: 643289 - RNA, 19 nt, Human
ugcccugaaguggacuguu

SEQ ID NO: 643290 - RNA, 18 nt, Human
uggacuguugccucaguu

SEQ ID NO: 643291 - RNA, 23 nt, Human
ugggugauaaaguuauucuguau

SEQ ID NO: 643292 - RNA, 23 nt, Human
uguuggguuuucucaucuggggu

SEQ ID NO: 643293 - RNA, 23 nt, Human
uuaggccuacaucugaacaaaca

SEQ ID NO: 643294 - RNA, 18 nt, Human
uucauucuuguaagagau

SEQ ID NO: 643295 - RNA, 22 nt, Human
uuccacagaagucaggucagcu

SEQ ID NO: 643296 - RNA, 22 nt, Human
uuggguuuucucaucugggguu

SEQ ID NO: 643297 - RNA, 23 nt, Human
uuguaaaaaauaaaauaaaauaa

SEQ ID NO: 643298 - RNA, 22 nt, Human
uuuacuacauauauauauacau

SEQ ID NO: 643299 - RNA, 22 nt, Human
uuucaaacaugcaaaacaugau

SEQ ID NO: 643300 - RNA, 26 nt, Human
aagcagugauaaagguaaaugugagc

SEQ ID NO: 643301 - RNA, 22 nt, Human
acaccagucuuccccgcccggc

SEQ ID NO: 643302 - RNA, 22 nt, Human
acugccuuguuuccagcaauca

SEQ ID NO: 643303 - RNA, 25 nt, Human
agaugagaugguucuuccuagaaaa

SEQ ID NO: 643304 - RNA, 20 nt, Human
agguuugugacacugaagca

SEQ ID NO: 643305 - RNA, 24 nt, Human
cagcggagaaucacuacugccuug

SEQ ID NO: 643306 - RNA, 21 nt, Human
ccacaccagucuuccccgccc

SEQ ID NO: 643307 - RNA, 18 nt, Human
ccaccuccaacuucuccu

SEQ ID NO: 643308 - RNA, 25 nt, Human
ccccgcccggccggccggggccgaa

SEQ ID NO: 643309 - RNA, 18 nt, Human
cccgacccgcccaugaaa

SEQ ID NO: 643310 - RNA, 20 nt, Human
cccgcccggccggccggggc

SEQ ID NO: 643311 - RNA, 19 nt, Human
cgacccgcccaugaaaaag

SEQ ID NO: 643312 - RNA, 21 nt, Human
cggccggccggggccgaagcu

SEQ ID NO: 643313 - RNA, 21 nt, Human
cuagaugagaugguucuuccu

SEQ ID NO: 643314 - RNA, 18 nt, Human
gaaaaagaacucagauga

SEQ ID NO: 643315 - RNA, 26 nt, Human
gcagugauaaagguaaaugugagcac

SEQ ID NO: 643316 - RNA, 18 nt, Human
uacaaauuuaacaauaac

SEQ ID NO: 643317 - RNA, 19 nt, Human
uagaagaccuuccgagguu

SEQ ID NO: 643318 - RNA, 19 nt, Human
uagcaguggcagcggagaa

SEQ ID NO: 643319 - RNA, 21 nt, Human
ucacuacugccuuguuuccag

SEQ ID NO: 643320 - RNA, 20 nt, Human
uccaaaaaaaaucuaauauc

SEQ ID NO: 643321 - RNA, 22 nt, Human
ugaaagauccaaauuccaaaaa

SEQ ID NO: 643322 - RNA, 23 nt, Human
ugaaguuggugcucugaaaugau

SEQ ID NO: 643323 - RNA, 19 nt, Human
ugccuuguuuccagcaauc

SEQ ID NO: 643324 - RNA, 21 nt, Human
uuaauaacuuuucuaagguuc

SEQ ID NO: 643325 - RNA, 22 nt, Human
uucuuccuagaagaccuuccga

SEQ ID NO: 643326 - RNA, 23 nt, Human
uuuaaggaaaaaaaaaaaaaaaa

SEQ ID NO: 643327 - RNA, 22 nt, Human
uuuuucauucuuuggcacuuua

SEQ ID NO: 643328 - RNA, 21 nt, Human
uuuuuuuuuuuuuuuuucauu

SEQ ID NO: 643329 - RNA, 24 nt, Human
aaaaauacuaagaggcccaauaua

SEQ ID NO: 643330 - RNA, 26 nt, Human
aaaugugggaaauuacaaaaaucaac

SEQ ID NO: 643331 - RNA, 24 nt, Human
aagaaagggaauccucuuuuugau

SEQ ID NO: 643332 - RNA, 22 nt, Human
accuaaaacccuuuuucucaaa

SEQ ID NO: 643333 - RNA, 21 nt, Human
acuccaaaaaauacuaagagg

SEQ ID NO: 643334 - RNA, 24 nt, Human
acuccaaaaaauacuaagaggccc

SEQ ID NO: 643335 - RNA, 19 nt, Human
aggcugauuuucuuuuucc

SEQ ID NO: 643336 - RNA, 20 nt, Human
auauuuaaaacuccaaaaaa

SEQ ID NO: 643337 - RNA, 23 nt, Human
cacuauuacuccaagaaagggaa

SEQ ID NO: 643338 - RNA, 23 nt, Human
caggcuagaaguuggcaaaagug

SEQ ID NO: 643339 - RNA, 25 nt, Human
cauccaagaucaguggugcuaccau

SEQ ID NO: 643340 - RNA, 27 nt, Human
cgacuuuucuucccuuucacuugaaua

SEQ ID NO: 643341 - RNA, 23 nt, Human
cuccaaaaaauacuaagaggccc

SEQ ID NO: 643342 - RNA, 24 nt, Human
cuggggugcaggcugauuuucuuu

SEQ ID NO: 643343 - RNA, 19 nt, Human
gaaagcaucaucauccaag

SEQ ID NO: 643344 - RNA, 22 nt, Human
ggaaauuacaaaaaucaaccua

SEQ ID NO: 643345 - RNA, 22 nt, Human
ggugcuugggcaacugccuucc

SEQ ID NO: 643346 - RNA, 28 nt, Human
uagaauaaaaaauaagucugucuggaca

SEQ ID NO: 643347 - RNA, 19 nt, Human
uaugaaauggagccgugaa

SEQ ID NO: 643348 - RNA, 26 nt, Human
ucaaaguauauauaaauguacauccu

SEQ ID NO: 643349 - RNA, 19 nt, Human
uccaagaaagggaauccuc

SEQ ID NO: 643350 - RNA, 19 nt, Human
uccaagaaagggaauccuc

SEQ ID NO: 643351 - RNA, 20 nt, Human
ucccuaugaaauggagccgu

SEQ ID NO: 643352 - RNA, 23 nt, Human
ugcuggggugcaggcugauuuuc

SEQ ID NO: 643353 - RNA, 20 nt, Human
ugcuugggcaacugccuucc

SEQ ID NO: 643354 - RNA, 30 nt, Human
uggacauaaacaagcaaucauuuuaagugg

SEQ ID NO: 643355 - RNA, 21 nt, Human
ugggcccagcgggagagcuga

SEQ ID NO: 643356 - RNA, 21 nt, Human
ugugaggugacuucuuccuug

SEQ ID NO: 643357 - RNA, 22 nt, Human
uugggcaacugccuuccuagac

SEQ ID NO: 643358 - RNA, 19 nt, Human
uuuccuguguaucuucuac

SEQ ID NO: 643359 - RNA, 22 nt, Human
uuugugugaggugacuucuucc

SEQ ID NO: 643360 - RNA, 23 nt, Human
uuuuuuuuuuuuuuuuuuuucag

SEQ ID NO: 643361 - RNA, 30 nt, Human
aaagcccuuucccacauccuccucugccuu

SEQ ID NO: 643362 - RNA, 20 nt, Human
aaucacaacacgugcccagu

SEQ ID NO: 643363 - RNA, 21 nt, Human
acaaaaacuagcugagaaaag

SEQ ID NO: 643364 - RNA, 21 nt, Human
agaaaagcccuuucccacauc

SEQ ID NO: 643365 - RNA, 20 nt, Human
agggaaggguucuuuccagg

SEQ ID NO: 643366 - RNA, 18 nt, Human
agggacaggacagcugau

SEQ ID NO: 643367 - RNA, 20 nt, Human
augaugcugaaccaugucuu

SEQ ID NO: 643368 - RNA, 23 nt, Human
auugcuucauugagaucuuaaaa

SEQ ID NO: 643369 - RNA, 22 nt, Human
caacugcccugacugugaaagu

SEQ ID NO: 643370 - RNA, 22 nt, Human
cagggacaggacagcugauuga

SEQ ID NO: 643371 - RNA, 18 nt, Human
ccacauccuccucugccu

SEQ ID NO: 643372 - RNA, 19 nt, Human
ccaggugcuggcagggaca

SEQ ID NO: 643373 - RNA, 20 nt, Human
cccagaagaaaugagcacac

SEQ ID NO: 643374 - RNA, 21 nt, Human
ccccuugugaauaccacucuu

SEQ ID NO: 643375 - RNA, 19 nt, Human
cucuagcgucaaaacaacu

SEQ ID NO: 643376 - RNA, 23 nt, Human
gagacaaaaaguuucucccaaaa

SEQ ID NO: 643377 - RNA, 19 nt, Human
gcaauuuggacacagacaa

SEQ ID NO: 643378 - RNA, 21 nt, Human
gcacugaggcaacugcccuga

SEQ ID NO: 643379 - RNA, 20 nt, Human
gcccuuucccacauccuccu

SEQ ID NO: 643380 - RNA, 22 nt, Human
ggugcuggcagggacaggacag

SEQ ID NO: 643381 - RNA, 20 nt, Human
uaaaauaguccugcuuauuc

SEQ ID NO: 643382 - RNA, 21 nt, Human
uaaugcucccagaagaaauga

SEQ ID NO: 643383 - RNA, 22 nt, Human
uacauacaaguauuuccgaaca

SEQ ID NO: 643384 - RNA, 22 nt, Human
uagacucaugccaaaaaaauga

SEQ ID NO: 643385 - RNA, 24 nt, Human
uagcugagaaaagcccuuucccac

SEQ ID NO: 643386 - RNA, 23 nt, Human
uaguuggugcuccaggugcuggc

SEQ ID NO: 643387 - RNA, 21 nt, Human
uauccaggcagcaaacuuaau

SEQ ID NO: 643388 - RNA, 18 nt, Human
ucacacagagacccauac

SEQ ID NO: 643389 - RNA, 23 nt, Human
uccaggcagcaaacuuaaugagg

SEQ ID NO: 643390 - RNA, 19 nt, Human
ucuccugguuucucacaca

SEQ ID NO: 643391 - RNA, 22 nt, Human
ugacugugaaaguucaccccuu

SEQ ID NO: 643392 - RNA, 22 nt, Human
ugagaaaagcccuuucccacau

SEQ ID NO: 643393 - RNA, 18 nt, Human
ugccaaaaaaaugagcuu

SEQ ID NO: 643394 - RNA, 27 nt, Human
ugccaguuuuccuuuguuaccaagugg

SEQ ID NO: 643395 - RNA, 27 nt, Human
ugcuuauucaaguuaguuucuccucca

SEQ ID NO: 643396 - RNA, 18 nt, Human
uggacacagacaaucaca

SEQ ID NO: 643397 - RNA, 19 nt, Human
uggcucagugacugaccaa

SEQ ID NO: 643398 - RNA, 20 nt, Human
ugggcacugaggcaacugcc

SEQ ID NO: 643399 - RNA, 18 nt, Human
uggguagaaaaugugaca

SEQ ID NO: 643400 - RNA, 19 nt, Human
uuagguacuaagcaagucc

SEQ ID NO: 643401 - RNA, 18 nt, Human
uucaaguuaguuucuccu

SEQ ID NO: 643402 - RNA, 19 nt, Human
uugaaaccccaccagcauu

SEQ ID NO: 643403 - RNA, 23 nt, Human
uugacaccaaaauacauacaagu

SEQ ID NO: 643404 - RNA, 21 nt, Human
uuggugcuccaggugcuggca

SEQ ID NO: 643405 - RNA, 21 nt, Human
uuggugcuccaggugcuggca

SEQ ID NO: 643406 - RNA, 20 nt, Human
uuuuuuuuuuuuaaugaggu

SEQ ID NO: 643407 - RNA, 23 nt, Human
uuuuuuuuuuuuuuuuaaugagg

SEQ ID NO: 643408 - RNA, 22 nt, Human
uuuuuuuuuuuuuuuuuuaaug

SEQ ID NO: 643409 - RNA, 20 nt, Human
aaauaggaauuaagaaugag

SEQ ID NO: 643410 - RNA, 23 nt, Human
aaauauggaguaacauuuaaaau

SEQ ID NO: 643411 - RNA, 18 nt, Human
aacagcacuccuugucug

SEQ ID NO: 643412 - RNA, 19 nt, Human
aaggaucuguguacagccc

SEQ ID NO: 643413 - RNA, 19 nt, Human
aaggcgcucagagccauga

SEQ ID NO: 643414 - RNA, 24 nt, Human
aaguuggcagcaaaucagagccaa

SEQ ID NO: 643415 - RNA, 19 nt, Human
aauguuacucuuuauucug

SEQ ID NO: 643416 - RNA, 22 nt, Human
acauucacugauuuauuuuaca

SEQ ID NO: 643417 - RNA, 21 nt, Human
acugagcaguuuaaaagaagc

SEQ ID NO: 643418 - RNA, 20 nt, Human
agaacuugcugguuguccug

SEQ ID NO: 643419 - RNA, 19 nt, Human
agaucacuguguucccuga

SEQ ID NO: 643420 - RNA, 25 nt, Human
agccugggcucaucuucaucuucug

SEQ ID NO: 643421 - RNA, 19 nt, Human
agcuuggcuuuuccccucu

SEQ ID NO: 643422 - RNA, 23 nt, Human
aggagaaaaaggaauauuucuga

SEQ ID NO: 643423 - RNA, 21 nt, Human
aguauuguuuacaugccuuga

SEQ ID NO: 643424 - RNA, 20 nt, Human
agugcaagaauuacagaagg

SEQ ID NO: 643425 - RNA, 21 nt, Human
agugcaagaauuacagaagga

SEQ ID NO: 643426 - RNA, 18 nt, Human
agugccucuccauccugg

SEQ ID NO: 643427 - RNA, 19 nt, Human
aucaaguacauguagauuu

SEQ ID NO: 643428 - RNA, 20 nt, Human
caucuucugucuuacaggag

SEQ ID NO: 643429 - RNA, 18 nt, Human
ccacugggcaucuugugc

SEQ ID NO: 643430 - RNA, 22 nt, Human
ccuauucuacaauguaacucaa

SEQ ID NO: 643431 - RNA, 18 nt, Human
ccugggcucaucuucauc

SEQ ID NO: 643432 - RNA, 23 nt, Human
cgugcagacuuuugaaauaugga

SEQ ID NO: 643433 - RNA, 20 nt, Human
cuaggagaaaaaggaauauu

SEQ ID NO: 643434 - RNA, 18 nt, Human
cugggcucaucuucaucu

SEQ ID NO: 643435 - RNA, 21 nt, Human
cuuacggccuauguaucuauu

SEQ ID NO: 643436 - RNA, 24 nt, Human
gauuuacccaguauuguuuacaug

SEQ ID NO: 643437 - RNA, 23 nt, Human
gccaaagcacaguaacucauuca

SEQ ID NO: 643438 - RNA, 18 nt, Human
ggaaugauucaucaacug

SEQ ID NO: 643439 - RNA, 23 nt, Human
guccuuagggaaugauaaugcca

SEQ ID NO: 643440 - RNA, 24 nt, Human
gugcagacuuuugaaauauggagu

SEQ ID NO: 643441 - RNA, 22 nt, Human
uaaaauaacagauaaaagaaaa

SEQ ID NO: 643442 - RNA, 21 nt, Human
uacacuucacauaucuaacua

SEQ ID NO: 643443 - RNA, 18 nt, Human
uaccaaaauaaaccauau

SEQ ID NO: 643444 - RNA, 23 nt, Human
uagaacuugcugguuguccugug

SEQ ID NO: 643445 - RNA, 18 nt, Human
uagcugaccagaguaaug

SEQ ID NO: 643446 - RNA, 21 nt, Human
uaguacacugacugccuccau

SEQ ID NO: 643447 - RNA, 24 nt, Human
uaucuaacuauacucuuaacauuc

SEQ ID NO: 643448 - RNA, 26 nt, Human
uaucuuucuuaggcucuaaaaaccag

SEQ ID NO: 643449 - RNA, 25 nt, Human
ucacauaucuaacuauacucuuaac

SEQ ID NO: 643450 - RNA, 24 nt, Human
ucagagccaaaucuuucaucaggg

SEQ ID NO: 643451 - RNA, 18 nt, Human
uccagaagaaaagaauca

SEQ ID NO: 643452 - RNA, 21 nt, Human
uccauccucaauggcuagcac

SEQ ID NO: 643453 - RNA, 19 nt, Human
uccauccuggcucuggaga

SEQ ID NO: 643454 - RNA, 23 nt, Human
uccuucaacaauucuuuaucugg

SEQ ID NO: 643455 - RNA, 18 nt, Human
ucuaauaucagucuucaa

SEQ ID NO: 643456 - RNA, 22 nt, Human
ucugcaaagauccugccuacca

SEQ ID NO: 643457 - RNA, 24 nt, Human
ucuuucuuaggcucuaaaaaccag

SEQ ID NO: 643458 - RNA, 18 nt, Human
ugaauguuacucuuuauu

SEQ ID NO: 643459 - RNA, 23 nt, Human
ugagucaauuuaggggaggcagc

SEQ ID NO: 643460 - RNA, 22 nt, Human
ugcaaacacaagacucugugua

SEQ ID NO: 643461 - RNA, 18 nt, Human
ugcaaagauccugccuac

SEQ ID NO: 643462 - RNA, 28 nt, Human
ugcuaaguuagccugggcucaucuucau

SEQ ID NO: 643463 - RNA, 21 nt, Human
ugcuuugggacagcccagugc

SEQ ID NO: 643464 - RNA, 19 nt, Human
uggaaggcugcccgcucuc

SEQ ID NO: 643465 - RNA, 25 nt, Human
uggagcuuggcuuuuccccucugag

SEQ ID NO: 643466 - RNA, 19 nt, Human
uggcaggaggcacaguugg

SEQ ID NO: 643467 - RNA, 20 nt, Human
ugggaggcuaaggcucagca

SEQ ID NO: 643468 - RNA, 19 nt, Human
ugggguccuucaacaauuc

SEQ ID NO: 643469 - RNA, 22 nt, Human
uguccuguggcaggaggcacag

SEQ ID NO: 643470 - RNA, 26 nt, Human
uguggcaggaggcacaguuggggucc

SEQ ID NO: 643471 - RNA, 18 nt, Human
uuaacauucacugauuua

SEQ ID NO: 643472 - RNA, 20 nt, Human
uuaaugcagaaauggagagu

SEQ ID NO: 643473 - RNA, 23 nt, Human
uuccuagcuucuaacauccgauu

SEQ ID NO: 643474 - RNA, 24 nt, Human
uugagucaauuuaggggaggcagc

SEQ ID NO: 643475 - RNA, 18 nt, Human
uuuugaaauauggaguaa

SEQ ID NO: 643476 - RNA, 23 nt, Human
uuuuuuuuuuuuuuugcugguaa

SEQ ID NO: 643477 - RNA, 18 nt, Human
uuuuuuuuuuuuuuuuug

SEQ ID NO: 643478 - RNA, 22 nt, Human
uuuuuuuuuuuuuuuuugcugg

SEQ ID NO: 643479 - RNA, 23 nt, Human
uuuuuuuuuuuuuuuuuugcugg

SEQ ID NO: 643480 - RNA, 26 nt, Human
aaaaacacccgagcgccgcggugccc

SEQ ID NO: 643481 - RNA, 18 nt, Human
aaaacacccgagcgccgc

SEQ ID NO: 643482 - RNA, 20 nt, Human
aaaacacccgagcgccgcgg

SEQ ID NO: 643483 - RNA, 19 nt, Human
aaacagucagugggggaga

SEQ ID NO: 643484 - RNA, 21 nt, Human
aagcugccacugaauagggcc

SEQ ID NO: 643485 - RNA, 22 nt, Human
aaucagcggccuggaggggaac

SEQ ID NO: 643486 - RNA, 22 nt, Human
aaugccacuggucagggcugac

SEQ ID NO: 643487 - RNA, 24 nt, Human
acaaaccucagguuggcccaaggg

SEQ ID NO: 643488 - RNA, 19 nt, Human
accuccuaccccuucccca

SEQ ID NO: 643489 - RNA, 18 nt, Human
agacccggggagaaacag

SEQ ID NO: 643490 - RNA, 19 nt, Human
aggcaggggcagagcgggg

SEQ ID NO: 643491 - RNA, 21 nt, Human
aggccgcaccuugggccccgg

SEQ ID NO: 643492 - RNA, 21 nt, Human
agggagggaagggguggcagg

SEQ ID NO: 643493 - RNA, 20 nt, Human
caaaccucagguuggcccaa

SEQ ID NO: 643494 - RNA, 22 nt, Human
cacacguugaauucauagucag

SEQ ID NO: 643495 - RNA, 25 nt, Human
cacccgggcccccaaaaacacccga

SEQ ID NO: 643496 - RNA, 26 nt, Human
caccuugggccccggcacccgggccc

SEQ ID NO: 643497 - RNA, 19 nt, Human
cacugcucucccugguccg

SEQ ID NO: 643498 - RNA, 20 nt, Human
cagcuccaugguggggcugg

SEQ ID NO: 643499 - RNA, 23 nt, Human
caggauauaggagaaaaggcagg

SEQ ID NO: 643500 - RNA, 19 nt, Human
ccacccgggcccccaaaaa

SEQ ID NO: 643501 - RNA, 19 nt, Human
ccacuguuaccccaucuug

SEQ ID NO: 643502 - RNA, 22 nt, Human
cccaccuccuaccccuucccca

SEQ ID NO: 643503 - RNA, 22 nt, Human
ccccaccuccuaccccuucccc

SEQ ID NO: 643504 - RNA, 19 nt, Human
cccccaaaaacacccgagc

SEQ ID NO: 643505 - RNA, 24 nt, Human
cccccaaaaacacccgagcgccgc

SEQ ID NO: 643506 - RNA, 18 nt, Human
ccccgcucuggcccugag

SEQ ID NO: 643507 - RNA, 19 nt, Human
cccgagcgccgcggugccc

SEQ ID NO: 643508 - RNA, 24 nt, Human
cccgggcccccaaaaacacccgag

SEQ ID NO: 643509 - RNA, 22 nt, Human
ccgcaccuugggccccggcacc

SEQ ID NO: 643510 - RNA, 19 nt, Human
ccuccacccgggcccccaa

SEQ ID NO: 643511 - RNA, 21 nt, Human
ccuccuaccccuuccccauca

SEQ ID NO: 643512 - RNA, 22 nt, Human
ccugaaucaaagcgagaacuga

SEQ ID NO: 643513 - RNA, 24 nt, Human
ccuugggccccggcacccgggccc

SEQ ID NO: 643514 - RNA, 25 nt, Human
ccuugggccccggcacccgggcccu

SEQ ID NO: 643515 - RNA, 20 nt, Human
cgcucuggcccugagagcuc

SEQ ID NO: 643516 - RNA, 18 nt, Human
cggccuggaggggaacua

SEQ ID NO: 643517 - RNA, 19 nt, Human
cuccacccgggcccccaaa

SEQ ID NO: 643518 - RNA, 19 nt, Human
cuccagcucacugcucucc

SEQ ID NO: 643519 - RNA, 18 nt, Human
cugaacagcaauccccca

SEQ ID NO: 643520 - RNA, 19 nt, Human
cuugggccccggcacccgg

SEQ ID NO: 643521 - RNA, 19 nt, Human
gcaggucccuguuuuguuc

SEQ ID NO: 643522 - RNA, 25 nt, Human
gccccaccuccuaccccuuccccau

SEQ ID NO: 643523 - RNA, 21 nt, Human
gcggggccgugggggccuggc

SEQ ID NO: 643524 - RNA, 22 nt, Human
ggaucccagcuccagcucacug

SEQ ID NO: 643525 - RNA, 20 nt, Human
ggcacccgggcccuccaccc

SEQ ID NO: 643526 - RNA, 19 nt, Human
ggccccggcacccgggccc

SEQ ID NO: 643527 - RNA, 19 nt, Human
ggccgugggggccuggccu

SEQ ID NO: 643528 - RNA, 20 nt, Human
ggccugaggcagcccuggug

SEQ ID NO: 643529 - RNA, 22 nt, Human
gggaccccugcuguaacaauuc

SEQ ID NO: 643530 - RNA, 21 nt, Human
gggcagagcggggccgugggg

SEQ ID NO: 643531 - RNA, 23 nt, Human
gggcagagcggggccgugggggc

SEQ ID NO: 643532 - RNA, 20 nt, Human
gggccccggcacccgggccc

SEQ ID NO: 643533 - RNA, 24 nt, Human
ggggccuggccugaggcagcccug

SEQ ID NO: 643534 - RNA, 18 nt, Human
ggggguaggggauguggg

SEQ ID NO: 643535 - RNA, 24 nt, Human
uagcagagcaggaucccagcucca

SEQ ID NO: 643536 - RNA, 20 nt, Human
uaggagaaaaggcaggggca

SEQ ID NO: 643537 - RNA, 21 nt, Human
uagggcccaguauaggggcuu

SEQ ID NO: 643538 - RNA, 22 nt, Human
uauagacuuuuuuuuguggucc

SEQ ID NO: 643539 - RNA, 21 nt, Human
uccacacguugaauucauagu

SEQ ID NO: 643540 - RNA, 18 nt, Human
uccaugguggggcuggga

SEQ ID NO: 643541 - RNA, 22 nt, Human
ucccagcuccagcucacugcuc

SEQ ID NO: 643542 - RNA, 21 nt, Human
uccccaucacuggacaaagau

SEQ ID NO: 643543 - RNA, 19 nt, Human
ucccccacagcgcagcucc

SEQ ID NO: 643544 - RNA, 21 nt, Human
ucccugaaucaaagcgagaac

SEQ ID NO: 643545 - RNA, 25 nt, Human
uccugccccgcucuggcccugagag

SEQ ID NO: 643546 - RNA, 21 nt, Human
ucuuggggcuauauccuggga

SEQ ID NO: 643547 - RNA, 22 nt, Human
ugaacagcaaucccccacagcg

SEQ ID NO: 643548 - RNA, 18 nt, Human
ugaaguagaaccaugacc

SEQ ID NO: 643549 - RNA, 22 nt, Human
ugaaguagaaccaugaccuguu

SEQ ID NO: 643550 - RNA, 21 nt, Human
ugaguuuuccuggcauuccuc

SEQ ID NO: 643551 - RNA, 23 nt, Human
ugccccgcucuggcccugagagc

SEQ ID NO: 643552 - RNA, 20 nt, Human
ugcugcggagggagggaagg

SEQ ID NO: 643553 - RNA, 19 nt, Human
ugggccccggcacccgggc

SEQ ID NO: 643554 - RNA, 21 nt, Human
ugguggggcugggaaagcauc

SEQ ID NO: 643555 - RNA, 18 nt, Human
uguggggccugaagagcc

SEQ ID NO: 643556 - RNA, 20 nt, Human
uuagggacaaaacaaaccuc

SEQ ID NO: 643557 - RNA, 21 nt, Human
uuuccuggcauuccuccccgg

SEQ ID NO: 643558 - RNA, 20 nt, Human
uuuuuuuuuuuuuuuuuugg

SEQ ID NO: 643559 - RNA, 24 nt, Human
uuuuuuuuuuuuuuuuuuggauuu

SEQ ID NO: 643560 - RNA, 21 nt, Human
aagccucugggccacaggccu

SEQ ID NO: 643561 - RNA, 20 nt, Human
accccuaaguccccagugcc

SEQ ID NO: 643562 - RNA, 21 nt, Human
agagcacuccccuccuccucc

SEQ ID NO: 643563 - RNA, 22 nt, Human
agccccugcccaagaggucuuc

SEQ ID NO: 643564 - RNA, 21 nt, Human
agcccguucaucacuccccca

SEQ ID NO: 643565 - RNA, 19 nt, Human
aggaacugacccuggccca

SEQ ID NO: 643566 - RNA, 21 nt, Human
aggccucucagccaggacccu

SEQ ID NO: 643567 - RNA, 20 nt, Human
agucagcacaugggagugcc

SEQ ID NO: 643568 - RNA, 19 nt, Human
agugagguggcgcagggcu

SEQ ID NO: 643569 - RNA, 19 nt, Human
cacuccccuccuccuccug

SEQ ID NO: 643570 - RNA, 19 nt, Human
cagccagaaaccguauguc

SEQ ID NO: 643571 - RNA, 22 nt, Human
cagcccguucaucacuccccca

SEQ ID NO: 643572 - RNA, 23 nt, Human
caggagggcgugcuacugcagug

SEQ ID NO: 643573 - RNA, 22 nt, Human
caggcagggacuagccaggcag

SEQ ID NO: 643574 - RNA, 19 nt, Human
caggcagggccacagcgug

SEQ ID NO: 643575 - RNA, 22 nt, Human
caggcagggccacagcguggca

SEQ ID NO: 643576 - RNA, 24 nt, Human
cagggcuggugagcuugggcacaa

SEQ ID NO: 643577 - RNA, 21 nt, Human
caugcugugacuuccccucca

SEQ ID NO: 643578 - RNA, 21 nt, Human
cccaagaggucuucagagcac

SEQ ID NO: 643579 - RNA, 19 nt, Human
cccaggugaacaggagccc

SEQ ID NO: 643580 - RNA, 23 nt, Human
cccagugccgggcagauggucuu

SEQ ID NO: 643581 - RNA, 23 nt, Human
ccccgcaccccuaaguccccagu

SEQ ID NO: 643582 - RNA, 26 nt, Human
ccccuaaguccccagugccgggcaga

SEQ ID NO: 643583 - RNA, 19 nt, Human
ccccugaggaccaggacuc

SEQ ID NO: 643584 - RNA, 19 nt, Human
cccguucaucacuccccca

SEQ ID NO: 643585 - RNA, 18 nt, Human
cccuaaguccccagugcc

SEQ ID NO: 643586 - RNA, 24 nt, Human
ccgcaccccuaaguccccagugcc

SEQ ID NO: 643587 - RNA, 22 nt, Human
ccucagagacuagcggcauucc

SEQ ID NO: 643588 - RNA, 20 nt, Human
ccuuccccuccccgcacccc

SEQ ID NO: 643589 - RNA, 19 nt, Human
cgcaccccuaaguccccag

SEQ ID NO: 643590 - RNA, 21 nt, Human
cggaagagaaaagagaccgac

SEQ ID NO: 643591 - RNA, 25 nt, Human
cguccuuccccuccccgcaccccua

SEQ ID NO: 643592 - RNA, 22 nt, Human
cgucugacccacugaggaugga

SEQ ID NO: 643593 - RNA, 25 nt, Human
cguucaucacucccccauucacaug

SEQ ID NO: 643594 - RNA, 21 nt, Human
cuagccaggcagggccacagc

SEQ ID NO: 643595 - RNA, 24 nt, Human
cuagcggcauuccuugccccacuu

SEQ ID NO: 643596 - RNA, 19 nt, Human
cuccugagcagggagcggg

SEQ ID NO: 643597 - RNA, 24 nt, Human
cuggcccaggugaacaggagcccc

SEQ ID NO: 643598 - RNA, 21 nt, Human
cugugacuuccccuccaaguu

SEQ ID NO: 643599 - RNA, 18 nt, Human
cuucagagcacuccccuc

SEQ ID NO: 643600 - RNA, 24 nt, Human
cuucaggaacugacccuggcccag

SEQ ID NO: 643601 - RNA, 21 nt, Human
gaaaagagaccgacggggaca

SEQ ID NO: 643602 - RNA, 24 nt, Human
gaccaggacucucuaucuccuucc

SEQ ID NO: 643603 - RNA, 21 nt, Human
gacggggacaaugacggggcg

SEQ ID NO: 643604 - RNA, 18 nt, Human
gaggcguccuuccccucc

SEQ ID NO: 643605 - RNA, 20 nt, Human
gagggcuuuccugagccagu

SEQ ID NO: 643606 - RNA, 19 nt, Human
gagugaacuucaggaacug

SEQ ID NO: 643607 - RNA, 19 nt, Human
gcagggcuggugagcuugg

SEQ ID NO: 643608 - RNA, 23 nt, Human
gccaguucugcagcccuccaucc

SEQ ID NO: 643609 - RNA, 18 nt, Human
gcccguucaucacucccc

SEQ ID NO: 643610 - RNA, 23 nt, Human
gcguggcagggauggggggaguc

SEQ ID NO: 643611 - RNA, 18 nt, Human
gcugcuccugagcaggga

SEQ ID NO: 643612 - RNA, 18 nt, Human
ggauggacagacgcgggg

SEQ ID NO: 643613 - RNA, 21 nt, Human
uccccgcaccccuaagucccc

SEQ ID NO: 643614 - RNA, 22 nt, Human
uccccgcaccccuaagucccca

SEQ ID NO: 643615 - RNA, 22 nt, Human
uccuacagccuccauucuugga

SEQ ID NO: 643616 - RNA, 23 nt, Human
uccugagccaguucugcagcccu

SEQ ID NO: 643617 - RNA, 23 nt, Human
ucucuaucuccuucccucugagu

SEQ ID NO: 643618 - RNA, 19 nt, Human
ugacccacugaggauggac

SEQ ID NO: 643619 - RNA, 18 nt, Human
ugacggggcggggcgggg

SEQ ID NO: 643620 - RNA, 21 nt, Human
ugacggggcggggcggggugg

SEQ ID NO: 643621 - RNA, 20 nt, Human
ugacuuagccuaugagaugg

SEQ ID NO: 643622 - RNA, 22 nt, Human
ugagcuugggcacaaaagccag

SEQ ID NO: 643623 - RNA, 24 nt, Human
ugagugaacuucaggaacugaccc

SEQ ID NO: 643624 - RNA, 25 nt, Human
ugccccacuuccucagacugcucca

SEQ ID NO: 643625 - RNA, 27 nt, Human
ugccccacuuccucagacugcuccagc

SEQ ID NO: 643626 - RNA, 25 nt, Human
ugcugugacuuccccuccaaguugg

SEQ ID NO: 643627 - RNA, 19 nt, Human
uggcgcagggcuggugagc

SEQ ID NO: 643628 - RNA, 18 nt, Human
uuaggacggaagagaaaa

SEQ ID NO: 643629 - RNA, 21 nt, Human
uucaucacucccccauucaca

SEQ ID NO: 643630 - RNA, 18 nt, Human
uuccccuccccgcacccc

SEQ ID NO: 643631 - RNA, 21 nt, Human
uuugccacaccccuuuucacc

SEQ ID NO: 643632 - RNA, 22 nt, Human
uuuuuuuuuuugaagcggaggc

SEQ ID NO: 643633 - RNA, 22 nt, Human
uuuuuuuuuuuuuugaagcgga

SEQ ID NO: 643634 - RNA, 18 nt, Human
uuuuuuuuuuuuuuuuug

SEQ ID NO: 643635 - RNA, 19 nt, Human
aacagaccccaccccagac

SEQ ID NO: 643636 - RNA, 21 nt, Human
aagagcacagaaccccuaauc

SEQ ID NO: 643637 - RNA, 24 nt, Human
aaggaccacaacagaccccacccc

SEQ ID NO: 643638 - RNA, 23 nt, Human
aaggagccccggcucagaguggc

SEQ ID NO: 643639 - RNA, 22 nt, Human
acaacagaccccaccccagacc

SEQ ID NO: 643640 - RNA, 19 nt, Human
acagccacuucccugcaug

SEQ ID NO: 643641 - RNA, 19 nt, Human
acccagccuugcccuccuc

SEQ ID NO: 643642 - RNA, 22 nt, Human
acccagccuugcccuccucuga

SEQ ID NO: 643643 - RNA, 23 nt, Human
accccagaccagccgcaggauga

SEQ ID NO: 643644 - RNA, 22 nt, Human
accguggaaggaccacaacaga

SEQ ID NO: 643645 - RNA, 18 nt, Human
acgaggcugagaagggag

SEQ ID NO: 643646 - RNA, 22 nt, Human
acucacuucuccuucugggacc

SEQ ID NO: 643647 - RNA, 19 nt, Human
acucaggcuggggcugggc

SEQ ID NO: 643648 - RNA, 25 nt, Human
agaaagagcaggaaggaccgguacc

SEQ ID NO: 643649 - RNA, 24 nt, Human
agaaccccuaaucccagucucugc

SEQ ID NO: 643650 - RNA, 30 nt, Human
agagaagaaagagcaggaaggacagaggag

SEQ ID NO: 643651 - RNA, 19 nt, Human
agagcaggaaggacagagg

SEQ ID NO: 643652 - RNA, 20 nt, Human
agccccggcucagaguggcu

SEQ ID NO: 643653 - RNA, 24 nt, Human
aggacacagagaggccaggagccc

SEQ ID NO: 643654 - RNA, 25 nt, Human
aggcaagagcacagaaccccuaauc

SEQ ID NO: 643655 - RNA, 19 nt, Human
aggccgugggguccagaca

SEQ ID NO: 643656 - RNA, 18 nt, Human
agggggucagcagaggga

SEQ ID NO: 643657 - RNA, 27 nt, Human
aggggucagccuggaggucuucccggg

SEQ ID NO: 643658 - RNA, 21 nt, Human
augcccacagcccggaagaga

SEQ ID NO: 643659 - RNA, 18 nt, Human
caaaagcgagggacuuca

SEQ ID NO: 643660 - RNA, 18 nt, Human
caacagaccccaccccag

SEQ ID NO: 643661 - RNA, 19 nt, Human
caacagaccccaccccaga

SEQ ID NO: 643662 - RNA, 22 nt, Human
caacagaccccaccccagacca

SEQ ID NO: 643663 - RNA, 18 nt, Human
cacagagcaucccagccc

SEQ ID NO: 643664 - RNA, 22 nt, Human
caccugugcugacugcugcuca

SEQ ID NO: 643665 - RNA, 23 nt, Human
cacgcccccacgcaccugugcug

SEQ ID NO: 643666 - RNA, 18 nt, Human
cacgcgagcccugcaugg

SEQ ID NO: 643667 - RNA, 21 nt, Human
cacucaggcuggggcugggcu

SEQ ID NO: 643668 - RNA, 20 nt, Human
cacugcagaggacacagaga

SEQ ID NO: 643669 - RNA, 23 nt, Human
cacuggcccuauguggccugggg

SEQ ID NO: 643670 - RNA, 21 nt, Human
cagagcaucccagcccucagc

SEQ ID NO: 643671 - RNA, 21 nt, Human
cagcccggaagagacgccgca

SEQ ID NO: 643672 - RNA, 22 nt, Human
cagcgcagacugccucacagcc

SEQ ID NO: 643673 - RNA, 20 nt, Human
cagcuccuggaaggagcccc

SEQ ID NO: 643674 - RNA, 23 nt, Human
cagcugcagcggccugggcagag

SEQ ID NO: 643675 - RNA, 21 nt, Human
caggaaggacagaggaaggcg

SEQ ID NO: 643676 - RNA, 18 nt, Human
caggacaguccccggcaa

SEQ ID NO: 643677 - RNA, 24 nt, Human
caggacaguccccgggcuggcucc

SEQ ID NO: 643678 - RNA, 23 nt, Human
caggagccccuuccugguucccc

SEQ ID NO: 643679 - RNA, 23 nt, Human
caggggcugcugaaaacgcuccg

SEQ ID NO: 643680 - RNA, 18 nt, Human
caguccccggcagcagcu

SEQ ID NO: 643681 - RNA, 18 nt, Human
caugaaagaagggcagca

SEQ ID NO: 643682 - RNA, 23 nt, Human
caugcccacagcccggaagagac

SEQ ID NO: 643683 - RNA, 23 nt, Human
ccacccaggacaguccccggcag

SEQ ID NO: 643684 - RNA, 19 nt, Human
ccaccugguggccucuucc

SEQ ID NO: 643685 - RNA, 21 nt, Human
ccagacugugagaaaauaauu

SEQ ID NO: 643686 - RNA, 21 nt, Human
ccagagcccacggccucucgc

SEQ ID NO: 643687 - RNA, 23 nt, Human
ccagcacuuaaaaaacagacuuc

SEQ ID NO: 643688 - RNA, 18 nt, Human
ccagcagaggggcacagg

SEQ ID NO: 643689 - RNA, 19 nt, Human
ccagcagaggggcacaggc

SEQ ID NO: 643690 - RNA, 19 nt, Human
ccagcagaggggcacaggc

SEQ ID NO: 643691 - RNA, 18 nt, Human
ccaggcaggcaaggaaga

SEQ ID NO: 643692 - RNA, 23 nt, Human
ccaggggcugcugaaaacgcucc

SEQ ID NO: 643693 - RNA, 26 nt, Human
cccacaacccccacugcagaggacac

SEQ ID NO: 643694 - RNA, 23 nt, Human
cccagcccucagcacugcccgac

SEQ ID NO: 643695 - RNA, 22 nt, Human
cccagccuugcccuccucugac

SEQ ID NO: 643696 - RNA, 20 nt, Human
cccccacaacccccacugca

SEQ ID NO: 643697 - RNA, 22 nt, Human
cccccacaacccccacugcaga

SEQ ID NO: 643698 - RNA, 23 nt, Human
cccccacaacccccacugcagag

SEQ ID NO: 643699 - RNA, 24 nt, Human
cccccacaacccccacugcagagg

SEQ ID NO: 643700 - RNA, 18 nt, Human
ccccuaaucccagucucu

SEQ ID NO: 643701 - RNA, 19 nt, Human
cccuauguggccugggggu

SEQ ID NO: 643702 - RNA, 21 nt, Human
cccugcauggcggugggcugg

SEQ ID NO: 643703 - RNA, 19 nt, Human
ccucucgcugggcagaggc

SEQ ID NO: 643704 - RNA, 27 nt, Human
ccucucgcugggcagaggcagggccac

SEQ ID NO: 643705 - RNA, 18 nt, Human
ccugcacucaggcugggg

SEQ ID NO: 643706 - RNA, 22 nt, Human
ccugcacucaggcuggggcugg

SEQ ID NO: 643707 - RNA, 22 nt, Human
ccugcauggcggugggcugggg

SEQ ID NO: 643708 - RNA, 18 nt, Human
ccugccguccacccagga

SEQ ID NO: 643709 - RNA, 18 nt, Human
ccugccucccucacgccc

SEQ ID NO: 643710 - RNA, 23 nt, Human
ccugcuaccccagccugaagggc

SEQ ID NO: 643711 - RNA, 21 nt, Human
ccuggaggucuucccggugcu

SEQ ID NO: 643712 - RNA, 20 nt, Human
ccugguucccccugguucca

SEQ ID NO: 643713 - RNA, 22 nt, Human
ccuguggugaagacccugccuc

SEQ ID NO: 643714 - RNA, 19 nt, Human
cgccccccacaacccccac

SEQ ID NO: 643715 - RNA, 19 nt, Human
cggguccugcagcuccugc

SEQ ID NO: 643716 - RNA, 21 nt, Human
cgugaaggaacagaguagcug

SEQ ID NO: 643717 - RNA, 25 nt, Human
cguggaaggaccacaacagacccca

SEQ ID NO: 643718 - RNA, 20 nt, Human
cucuacuaggcccccuuacu

SEQ ID NO: 643719 - RNA, 23 nt, Human
cugcccuccacccaggacagucc

SEQ ID NO: 643720 - RNA, 20 nt, Human
cuggcccuauguggccuggg

SEQ ID NO: 643721 - RNA, 18 nt, Human
cugguuccaaaugagaca

SEQ ID NO: 643722 - RNA, 24 nt, Human
cugugcagcugcagcggccugggc

SEQ ID NO: 643723 - RNA, 20 nt, Human
cuuguguucaccugcccucc

SEQ ID NO: 643724 - RNA, 25 nt, Human
gacccugccucccucacgcccccac

SEQ ID NO: 643725 - RNA, 22 nt, Human
gagccuccugccccauauccuu

SEQ ID NO: 643726 - RNA, 24 nt, Human
gaggacacagagaggccaggagcc

SEQ ID NO: 643727 - RNA, 20 nt, Human
gcaccugugcugacugcugc

SEQ ID NO: 643728 - RNA, 21 nt, Human
gcagaggcagggccacagcgc

SEQ ID NO: 643729 - RNA, 21 nt, Human
gcagcugcagcggccugggca

SEQ ID NO: 643730 - RNA, 19 nt, Human
gcuuguguucaccugcccu

SEQ ID NO: 643731 - RNA, 18 nt, Human
ggccgugggguccagaca

SEQ ID NO: 643732 - RNA, 18 nt, Human
ggcuggcuccaggcugca

SEQ ID NO: 643733 - RNA, 19 nt, Human
ggcuggggagccggggcgg

SEQ ID NO: 643734 - RNA, 22 nt, Human
gggcacaggcuuaaacgccggc

SEQ ID NO: 643735 - RNA, 21 nt, Human
gggugagagacccccccccca

SEQ ID NO: 643736 - RNA, 21 nt, Human
guccagagcccacggccucuc

SEQ ID NO: 643737 - RNA, 19 nt, Human
gugagagacccccccccca

SEQ ID NO: 643738 - RNA, 20 nt, Human
gugcagcugcagcggccugg

SEQ ID NO: 643739 - RNA, 20 nt, Human
gugcugccaccugguggccu

SEQ ID NO: 643740 - RNA, 21 nt, Human
gugugggcuccagcugggguc

SEQ ID NO: 643741 - RNA, 23 nt, Human
uaaaauauucgggggaaccagca

SEQ ID NO: 643742 - RNA, 22 nt, Human
uaccacuggcccuauguggccu

SEQ ID NO: 643743 - RNA, 18 nt, Human
uaccccagccugaagggc

SEQ ID NO: 643744 - RNA, 25 nt, Human
uagcagaggcugugcagcugcagcg

SEQ ID NO: 643745 - RNA, 21 nt, Human
ucaggccacugacaccgugga

SEQ ID NO: 643746 - RNA, 22 nt, Human
uccagacaccacaccaggaagc

SEQ ID NO: 643747 - RNA, 26 nt, Human
uccccggcagcagcuuguguucaccu

SEQ ID NO: 643748 - RNA, 22 nt, Human
uccugguucccccugguuccaa

SEQ ID NO: 643749 - RNA, 28 nt, Human
ugaaaaaaagucgagugaguggcuacau

SEQ ID NO: 643750 - RNA, 20 nt, Human
ugaaagaagggcagcaaggc

SEQ ID NO: 643751 - RNA, 19 nt, Human
ugaaaugauguggaugcca

SEQ ID NO: 643752 - RNA, 20 nt, Human
ugagaagggaggacgugaag

SEQ ID NO: 643753 - RNA, 22 nt, Human
ugagagaccccccccccaaaag

SEQ ID NO: 643754 - RNA, 23 nt, Human
ugagagaccccccccccaaaagc

SEQ ID NO: 643755 - RNA, 19 nt, Human
ugaguggcuacaugcggca

SEQ ID NO: 643756 - RNA, 21 nt, Human
ugauguggaugccagcccuua

SEQ ID NO: 643757 - RNA, 22 nt, Human
ugcccuccacccaggacagucc

SEQ ID NO: 643758 - RNA, 19 nt, Human
ugcucaaggggucagccug

SEQ ID NO: 643759 - RNA, 21 nt, Human
ugcucaaggggucagccugga

SEQ ID NO: 643760 - RNA, 26 nt, Human
ugcugaaaacgcuccggagaugaccu

SEQ ID NO: 643761 - RNA, 23 nt, Human
ugcugccaccugguggccucuuc

SEQ ID NO: 643762 - RNA, 24 nt, Human
ugcuuggacgaggcugagaaggga

SEQ ID NO: 643763 - RNA, 22 nt, Human
uggacgaggcugagaagggagg

SEQ ID NO: 643764 - RNA, 21 nt, Human
uggagacagguggauuucagc

SEQ ID NO: 643765 - RNA, 23 nt, Human
uggaugcugcgccccccacaacc

SEQ ID NO: 643766 - RNA, 24 nt, Human
uggaugcugcgccccccacaaccc

SEQ ID NO: 643767 - RNA, 22 nt, Human
uggcccuauguggccugggggu

SEQ ID NO: 643768 - RNA, 24 nt, Human
uggcggugggcuggggagccgggg

SEQ ID NO: 643769 - RNA, 20 nt, Human
uggcuacaugcggcagccgc

SEQ ID NO: 643770 - RNA, 23 nt, Human
uggggcugggcuggcgcgggggg

SEQ ID NO: 643771 - RNA, 25 nt, Human
ugugcugccaccugguggccucuuc

SEQ ID NO: 643772 - RNA, 26 nt, Human
uguguucaccugccguccacccagga

SEQ ID NO: 643773 - RNA, 18 nt, Human
uguucaccugccguccac

SEQ ID NO: 643774 - RNA, 22 nt, Human
uucugggaccacacaagagaca

SEQ ID NO: 643775 - RNA, 21 nt, Human
uuguguucaccugccguccac

SEQ ID NO: 643776 - RNA, 23 nt, Human
uuuuuuuuuuuuuuuuucacaau

SEQ ID NO: 643777 - RNA, 24 nt, Human
uuuuuuuuuuuuuuuuucacaaug

SEQ ID NO: 643778 - RNA, 27 nt, Human
aaacaaauucaaugaccaucuagagac

SEQ ID NO: 643779 - RNA, 20 nt, Human
aaaccagaaacaguuucugu

SEQ ID NO: 643780 - RNA, 22 nt, Human
aaagaagcaauuuuuacccaaa

SEQ ID NO: 643781 - RNA, 23 nt, Human
aaagacauccacuuuucccagaa

SEQ ID NO: 643782 - RNA, 24 nt, Human
aaagugcugggauuacaggcauga

SEQ ID NO: 643783 - RNA, 22 nt, Human
aaaguuagugagaauccgaaag

SEQ ID NO: 643784 - RNA, 18 nt, Human
aacuacgcgacccaaaag

SEQ ID NO: 643785 - RNA, 21 nt, Human
aacuacgcgacccaaaagacu

SEQ ID NO: 643786 - RNA, 19 nt, Human
aaguagcugggacuacagg

SEQ ID NO: 643787 - RNA, 20 nt, Human
aaguagcugggacuacaggc

SEQ ID NO: 643788 - RNA, 24 nt, Human
aaguagcugggacuacaggcacgc

SEQ ID NO: 643789 - RNA, 24 nt, Human
aagugauccaccugccucggccuc

SEQ ID NO: 643790 - RNA, 20 nt, Human
aagugauucucaugccucag

SEQ ID NO: 643791 - RNA, 21 nt, Human
aagugauucucaugccucagc

SEQ ID NO: 643792 - RNA, 19 nt, Human
aagugcugggauuacaggc

SEQ ID NO: 643793 - RNA, 21 nt, Human
aagugcugggauuacaggcau

SEQ ID NO: 643794 - RNA, 26 nt, Human
aagugcugggauuacaggcaugagcc

SEQ ID NO: 643795 - RNA, 24 nt, Human
acagguuuucaccauguuggccag

SEQ ID NO: 643796 - RNA, 22 nt, Human
accauacuuaaacgaguacuua

SEQ ID NO: 643797 - RNA, 18 nt, Human
accauguuggccaggcug

SEQ ID NO: 643798 - RNA, 22 nt, Human
acggcggcggagucuggcgggc

SEQ ID NO: 643799 - RNA, 19 nt, Human
acuuuggucucaaugugaa

SEQ ID NO: 643800 - RNA, 24 nt, Human
agagucuccguugcccaggcugga

SEQ ID NO: 643801 - RNA, 20 nt, Human
agcauuuaaauauagaaaua

SEQ ID NO: 643802 - RNA, 18 nt, Human
agcuucaccaccuccacg

SEQ ID NO: 643803 - RNA, 20 nt, Human
aggcugcuaaguguucucuu

SEQ ID NO: 643804 - RNA, 25 nt, Human
aggcuggagugcagugucgugaucu

SEQ ID NO: 643805 - RNA, 25 nt, Human
agggaaguggagggcagagaagagg

SEQ ID NO: 643806 - RNA, 21 nt, Human
agguggaaaccauacuacaga

SEQ ID NO: 643807 - RNA, 23 nt, Human
agguuuucaccauguuggccagg

SEQ ID NO: 643808 - RNA, 24 nt, Human
agugauucucaugccucagccucc

SEQ ID NO: 643809 - RNA, 20 nt, Human
agugcagugucgugaucuug

SEQ ID NO: 643810 - RNA, 24 nt, Human
agugcagugucgugaucuuggcuc

SEQ ID NO: 643811 - RNA, 19 nt, Human
aguggagggcagagaagag

SEQ ID NO: 643812 - RNA, 19 nt, Human
auagaacaaugguuaaaua

SEQ ID NO: 643813 - RNA, 23 nt, Human
auagugguguuagagauaggugg

SEQ ID NO: 643814 - RNA, 22 nt, Human
aucggauuuuguugagucuggg

SEQ ID NO: 643815 - RNA, 22 nt, Human
augccucagccuccuaaguagc

SEQ ID NO: 643816 - RNA, 21 nt, Human
auucccuuuuauaaagugcca

SEQ ID NO: 643817 - RNA, 24 nt, Human
auuuuuguauuuuuaguagagaca

SEQ ID NO: 643818 - RNA, 24 nt, Human
caaagugcugggauuacaggcaug

SEQ ID NO: 643819 - RNA, 26 nt, Human
caaaugcaauuaguaaaaacggggca

SEQ ID NO: 643820 - RNA, 21 nt, Human
caacugcaaccuccaccucuc

SEQ ID NO: 643821 - RNA, 24 nt, Human
caacugcaaccuccaccucucagg

SEQ ID NO: 643822 - RNA, 22 nt, Human
caagaaaagcuuggaaaauuaa

SEQ ID NO: 643823 - RNA, 24 nt, Human
caagucauagagacuaccaaugua

SEQ ID NO: 643824 - RNA, 22 nt, Human
caagugauccaccugccucggc

SEQ ID NO: 643825 - RNA, 22 nt, Human
caccaccacgcucggcuaauuu

SEQ ID NO: 643826 - RNA, 24 nt, Human
caccacgcucggcuaauuuuugua

SEQ ID NO: 643827 - RNA, 21 nt, Human
caccauguuggccaggcuggu

SEQ ID NO: 643828 - RNA, 21 nt, Human
caccauguuggccaggcuggu

SEQ ID NO: 643829 - RNA, 24 nt, Human
caccauguuggccaggcugguuuc

SEQ ID NO: 643830 - RNA, 31 nt, Human; identical to SEQ ID NO: 466129

SEQ ID NO: 643831 - RNA, 23 nt, Human
caccugccucggccucccaaagu

SEQ ID NO: 643832 - RNA, 19 nt, Human
cacucccuccuccccccug

SEQ ID NO: 643833 - RNA, 22 nt, Human
cacucccuccuccccccugccc

SEQ ID NO: 643834 - RNA, 19 nt, Human
cagagucuccguugcccag

SEQ ID NO: 643835 - RNA, 21 nt, Human
caggcacgcaccaccacgcuc

SEQ ID NO: 643836 - RNA, 24 nt, Human
cagguuuucaccauguuggccagg

SEQ ID NO: 643837 - RNA, 23 nt, Human
cauguuggccaggcugguuucaa

SEQ ID NO: 643838 - RNA, 20 nt, Human
cauuuuuuuguuacucuuga

SEQ ID NO: 643839 - RNA, 23 nt, Human
ccaaagugcugggauuacaggca

SEQ ID NO: 643840 - RNA, 24 nt, Human
ccaaagugcugggauuacaggcau

SEQ ID NO: 643841 - RNA, 22 nt, Human
ccacaucggcgucguaggcccc

SEQ ID NO: 643842 - RNA, 19 nt, Human
ccagcggcugcucuggguc

SEQ ID NO: 643843 - RNA, 18 nt, Human
ccaggaaugguuaaagca

SEQ ID NO: 643844 - RNA, 24 nt, Human
cccaaagugcugggauuacaggca

SEQ ID NO: 643845 - RNA, 18 nt, Human
cccaccagguucuugauc

SEQ ID NO: 643846 - RNA, 21 nt, Human
cccacucccuccuccccccug

SEQ ID NO: 643847 - RNA, 19 nt, Human
cccaggcuggagugcagug

SEQ ID NO: 643848 - RNA, 19 nt, Human
cccauagcgacgggcuccc

SEQ ID NO: 643849 - RNA, 24 nt, Human
cccccaccagcagcuucaccaccu

SEQ ID NO: 643850 - RNA, 22 nt, Human
cccccacucccuccuccccccc

SEQ ID NO: 643851 - RNA, 21 nt, Human
ccccgcucguccuggcgucca

SEQ ID NO: 643852 - RNA, 22 nt, Human
ccccugcccuccagcggcugcu

SEQ ID NO: 643853 - RNA, 21 nt, Human
cccgaggcuuugcgcccugga

SEQ ID NO: 643854 - RNA, 18 nt, Human
cccuccuccccccugccc

SEQ ID NO: 643855 - RNA, 18 nt, Human
cccuccuccccccugccc

SEQ ID NO: 643856 - RNA, 30 nt, Human
ccgacggcggcggagucuggcgggcucuuu

SEQ ID NO: 643857 - RNA, 21 nt, Human
ccgccccauccauuccgaucc

SEQ ID NO: 643858 - RNA, 23 nt, Human
ccuaaguagcugggacuacaggc

SEQ ID NO: 643859 - RNA, 24 nt, Human
ccuaaguagcugggacuacaggca

SEQ ID NO: 643860 - RNA, 20 nt, Human
ccucgaccgcgcugcucccc

SEQ ID NO: 643861 - RNA, 18 nt, Human
ccuggccucaagugaucc

SEQ ID NO: 643862 - RNA, 21 nt, Human
ccuggccucaagugauccacc

SEQ ID NO: 643863 - RNA, 23 nt, Human
ccuggccucaagugauccaccug

SEQ ID NO: 643864 - RNA, 23 nt, Human
ccuggccucaagugauccaccug

SEQ ID NO: 643865 - RNA, 23 nt, Human
ccugucguuuucacacuuagaaa

SEQ ID NO: 643866 - RNA, 22 nt, Human
ccuuugaaagccuccagcgccc

SEQ ID NO: 643867 - RNA, 18 nt, Human
ccuuuuauaaagugccau

SEQ ID NO: 643868 - RNA, 25 nt, Human
cgccagcgggcggcucagcgcgguc

SEQ ID NO: 643869 - RNA, 18 nt, Human
cgcgcugcucccccgcca

SEQ ID NO: 643870 - RNA, 21 nt, Human
cgcgcugcucccccgccagcg

SEQ ID NO: 643871 - RNA, 23 nt, Human
cguccagggcucccaccagguuc

SEQ ID NO: 643872 - RNA, 21 nt, Human
cucaagugauccaccugccuc

SEQ ID NO: 643873 - RNA, 24 nt, Human
cucagccuccuaaguagcugggac

SEQ ID NO: 643874 - RNA, 18 nt, Human
cucccuccuccccccugc

SEQ ID NO: 643875 - RNA, 20 nt, Human
cucccuccuccccccugccc

SEQ ID NO: 643876 - RNA, 19 nt, Human
cuccguugcccaggcugga

SEQ ID NO: 643877 - RNA, 23 nt, Human
cuccguugcccaggcuggagugc

SEQ ID NO: 643878 - RNA, 19 nt, Human
cuccuccccccugcccucc

SEQ ID NO: 643879 - RNA, 19 nt, Human
cuccucggcgaugcuccga

SEQ ID NO: 643880 - RNA, 23 nt, Human
cuccuggccucaagugauccacc

SEQ ID NO: 643881 - RNA, 22 nt, Human
cucuaauauaaaugaaugaaau

SEQ ID NO: 643882 - RNA, 21 nt, Human
cugcaaccuccaccucucagg

SEQ ID NO: 643883 - RNA, 23 nt, Human
cugccucggccucccaaagugcu

SEQ ID NO: 643884 - RNA, 21 nt, Human
cuuugaucugaccuucaguag

SEQ ID NO: 643885 - RNA, 22 nt, Human
cuuugccuccgacccaccccuc

SEQ ID NO: 643886 - RNA, 21 nt, Human
cuuugcgcccuggauccuugg

SEQ ID NO: 643887 - RNA, 19 nt, Human
gaauaaacaccccagcaaa

SEQ ID NO: 643888 - RNA, 19 nt, Human
gauuaaaacugaaauugcu

SEQ ID NO: 643889 - RNA, 18 nt, Human
gauuacaggcaugagcca

SEQ ID NO: 643890 - RNA, 21 nt, Human
gauuacaggcaugagccacca

SEQ ID NO: 643891 - RNA, 22 nt, Human
gauuacaggcaugagccaccau

SEQ ID NO: 643892 - RNA, 21 nt, Human
gcaaccuccaccucucagguu

SEQ ID NO: 643893 - RNA, 21 nt, Human
gcccaggcuggagugcagugu

SEQ ID NO: 643894 - RNA, 23 nt, Human
gccccauccauuccgaucccuca

SEQ ID NO: 643895 - RNA, 20 nt, Human
gccucagccuccuaaguagc

SEQ ID NO: 643896 - RNA, 23 nt, Human
gcucugggucccugaaagagggu

SEQ ID NO: 643897 - RNA, 23 nt, Human
gcugguuucaaacuccuggccuc

SEQ ID NO: 643898 - RNA, 24 nt, Human
ggauuacaggcaugagccaccaug

SEQ ID NO: 643899 - RNA, 20 nt, Human
ggcagagaagagguacaggu

SEQ ID NO: 643900 - RNA, 24 nt, Human
ggccucaagugauccaccugccuc

SEQ ID NO: 643901 - RNA, 22 nt, Human
ggcugcucugggucccugaaag

SEQ ID NO: 643902 - RNA, 24 nt, Human
ggcugguuucaaacuccuggccuc

SEQ ID NO: 643903 - RNA, 20 nt, Human
gggcucccagcggccggcuc

SEQ ID NO: 643904 - RNA, 23 nt, Human
gggugugguguggacgaucuggg

SEQ ID NO: 643905 - RNA, 20 nt, Human
gucuccguugcccaggcugg

SEQ ID NO: 643906 - RNA, 21 nt, Human
gucuccguugcccaggcugga

SEQ ID NO: 643907 - RNA, 23 nt, Human
gucuccguugcccaggcuggagu

SEQ ID NO: 643908 - RNA, 24 nt, Human
gucuccguugcccaggcuggagug

SEQ ID NO: 643909 - RNA, 24 nt, Human
gugauccaccugccucggccuccc

SEQ ID NO: 643910 - RNA, 24 nt, Human
gugauucucaugccucagccuccu

SEQ ID NO: 643911 - RNA, 22 nt, Human
guuaugccaaauagaacaaugg

SEQ ID NO: 643912 - RNA, 22 nt, Human
uaaaauaaaaaguguaccuuac

SEQ ID NO: 643913 - RNA, 22 nt, Human
uaaaccagaaacaguuucugua

SEQ ID NO: 643914 - RNA, 27 nt, Human
uaacaggucguuccucccccacucccu

SEQ ID NO: 643915 - RNA, 18 nt, Human
uaacccccgcucguccug

SEQ ID NO: 643916 - RNA, 27 nt, Human
uaagugauucucaugccucagccuccu

SEQ ID NO: 643917 - RNA, 24 nt, Human
uaauuuuuguauuuuuaguagaga

SEQ ID NO: 643918 - RNA, 22 nt, Human
uacaggcaugagccaccaugcc

SEQ ID NO: 643919 - RNA, 19 nt, Human
uacccagauuuucaguaac

SEQ ID NO: 643920 - RNA, 21 nt, Human
uagaaauacaauguaguuuca

SEQ ID NO: 643921 - RNA, 22 nt, Human
uagagacagguuuucaccaugu

SEQ ID NO: 643922 - RNA, 19 nt, Human
uagcccgaagagaacuccg

SEQ ID NO: 643923 - RNA, 23 nt, Human
uagccuccagaaacggacuccag

SEQ ID NO: 643924 - RNA, 23 nt, Human
uagcuuguccuucuggucucacu

SEQ ID NO: 643925 - RNA, 26 nt, Human
uagcuuguccuucugguuggaagacc

SEQ ID NO: 643926 - RNA, 26 nt, Human
uaggguuaugccaaauagaacaaagu

SEQ ID NO: 643927 - RNA, 22 nt, Human
uagguaauucagcucuaagcac

SEQ ID NO: 643928 - RNA, 21 nt, Human
uaguaaaaacggggcagccug

SEQ ID NO: 643929 - RNA, 23 nt, Human
uaguagagacagguuuucaccau

SEQ ID NO: 643930 - RNA, 24 nt, Human
uaguagagacagguuuucaccaug

SEQ ID NO: 643931 - RNA, 21 nt, Human
ucaagugauccaccugccucg

SEQ ID NO: 643932 - RNA, 22 nt, Human
ucagaauaaacaccccagcaaa

SEQ ID NO: 643933 - RNA, 22 nt, Human
ucauaggcugcuaaguguucuc

SEQ ID NO: 643934 - RNA, 22 nt, Human
ucauccaucuuuaaacaaauuc

SEQ ID NO: 643935 - RNA, 24 nt, Human
ucauucauucuguucccccaauuu

SEQ ID NO: 643936 - RNA, 22 nt, Human
uccacaucggcgucguaggccc

SEQ ID NO: 643937 - RNA, 19 nt, Human
uccacuagagcugcccgag

SEQ ID NO: 643938 - RNA, 20 nt, Human
uccagggcagggaaguggag

SEQ ID NO: 643939 - RNA, 24 nt, Human
ucccaaagugcugggauuacaggc

SEQ ID NO: 643940 - RNA, 21 nt, Human
ucccauagcgacgggcuccca

SEQ ID NO: 643941 - RNA, 21 nt, Human
ucccauagcgacgggcuccca

SEQ ID NO: 643942 - RNA, 19 nt, Human
ucccccacucccuccuccc

SEQ ID NO: 643943 - RNA, 22 nt, Human
ucccuccuccccccugcccucc

SEQ ID NO: 643944 - RNA, 19 nt, Human
ucccugaaagagggugugg

SEQ ID NO: 643945 - RNA, 20 nt, Human
uccgaaagagaggcaacauu

SEQ ID NO: 643946 - RNA, 24 nt, Human
uccguugcccaggcuggagugcag

SEQ ID NO: 643947 - RNA, 24 nt, Human
uccuaaguagcugggacuacaggc

SEQ ID NO: 643948 - RNA, 18 nt, Human
uccucagaauaaacaccc

SEQ ID NO: 643949 - RNA, 21 nt, Human
uccuggcguccauguucaccg

SEQ ID NO: 643950 - RNA, 25 nt, Human
uccuuacuuugcaggcauccaggaa

SEQ ID NO: 643951 - RNA, 19 nt, Human
uccuuggcuuugccuccga

SEQ ID NO: 643952 - RNA, 25 nt, Human
uccuuggcuuugccuccgacccacc

SEQ ID NO: 643953 - RNA, 18 nt, Human
ucggccucccaaagugcu

SEQ ID NO: 643954 - RNA, 18 nt, Human
ucuccguugcccaggcug

SEQ ID NO: 643955 - RNA, 19 nt, Human
ucuggcgggcucagcgggc

SEQ ID NO: 643956 - RNA, 20 nt, Human
ucugugcaguucacacaugg

SEQ ID NO: 643957 - RNA, 20 nt, Human
ugaaaaagacauccacuuuu

SEQ ID NO: 643958 - RNA, 24 nt, Human
ugaaaaagacauccacuuuuccca

SEQ ID NO: 643959 - RNA, 24 nt, Human
ugaaagaguaaccccuuauaaaau

SEQ ID NO: 643960 - RNA, 19 nt, Human
ugaaucucugaaaaagaca

SEQ ID NO: 643961 - RNA, 22 nt, Human
ugagacagagucuccguugccc

SEQ ID NO: 643962 - RNA, 21 nt, Human
ugcagggcgguguaacccccg

SEQ ID NO: 643963 - RNA, 18 nt, Human
ugcccaggcuggagugca

SEQ ID NO: 643964 - RNA, 21 nt, Human
ugcccaggcuggagugcagug

SEQ ID NO: 643965 - RNA, 19 nt, Human
ugcccuccagcggcugcuc

SEQ ID NO: 643966 - RNA, 22 nt, Human
ugccucagccuccuaaguagcu

SEQ ID NO: 643967 - RNA, 24 nt, Human
ugccucagccuccuaaguagcugg

SEQ ID NO: 643968 - RNA, 21 nt, Human
ugccucggccucccaaagugc

SEQ ID NO: 643969 - RNA, 24 nt, Human
ugccucggccucccaaagugcugg

SEQ ID NO: 643970 - RNA, 18 nt, Human
ugcgcccuggauccuugg

SEQ ID NO: 643971 - RNA, 21 nt, Human
uggagugcagugucgugaucc

SEQ ID NO: 643972 - RNA, 23 nt, Human
uggagugcagugucgugaucuug

SEQ ID NO: 643973 - RNA, 24 nt, Human
uggagugcagugucgugaucuugg

SEQ ID NO: 643974 - RNA, 24 nt, Human
uggccaggcugguuucaaacuccu

SEQ ID NO: 643975 - RNA, 24 nt, Human
uggccucaagugauccaccugccu

SEQ ID NO: 643976 - RNA, 22 nt, Human
uggcucaacugcaaccuccacc

SEQ ID NO: 643977 - RNA, 21 nt, Human
ugggacuacaggcacgcacca

SEQ ID NO: 643978 - RNA, 24 nt, Human
ugggacuacaggcacgcaccacca

SEQ ID NO: 643979 - RNA, 18 nt, Human
ugggauuacaggcaugag

SEQ ID NO: 643980 - RNA, 22 nt, Human
ugggauuacaggcaugagccac

SEQ ID NO: 643981 - RNA, 23 nt, Human
ugggauuacaggcaugagccacc

SEQ ID NO: 643982 - RNA, 24 nt, Human
ugggauuacaggcaugagccacca

SEQ ID NO: 643983 - RNA, 25 nt, Human
ugggauuacaggcaugagccaccau

SEQ ID NO: 643984 - RNA, 18 nt, Human
ugguguggacgaucuggg

SEQ ID NO: 643985 - RNA, 19 nt, Human
uguugccuguuucuuuugu

SEQ ID NO: 643986 - RNA, 20 nt, Human
uuaauucauucauucuguuc

SEQ ID NO: 643987 - RNA, 22 nt, Human
uuaauucauucauucuguuccc

SEQ ID NO: 643988 - RNA, 23 nt, Human
uuaauucauucauucuguucccc

SEQ ID NO: 643989 - RNA, 22 nt, Human
uuacuucacagaaacaugggcu

SEQ ID NO: 643990 - RNA, 22 nt, Human
uuagguuucagcaacuacgcga

SEQ ID NO: 643991 - RNA, 24 nt, Human
uuaguagagacagguuuucaccau

SEQ ID NO: 643992 - RNA, 23 nt, Human
uucaaacuuuuagaauaguaaca

SEQ ID NO: 643993 - RNA, 24 nt, Human
uucacacauggguucauucacccc

SEQ ID NO: 643994 - RNA, 21 nt, Human
uucacauuauucucuaauuag

SEQ ID NO: 643995 - RNA, 20 nt, Human
uucuaaaagaagcaauuuuu

SEQ ID NO: 643996 - RNA, 24 nt, Human
uugcccaggcuggagugcaguguc

SEQ ID NO: 643997 - RNA, 21 nt, Human
uugccuguuucuuuuguucag

SEQ ID NO: 643998 - RNA, 18 nt, Human
uuuaaacaaauucaauga

SEQ ID NO: 643999 - RNA, 24 nt, Human
uuucaccauguuggccaggcuggu

SEQ ID NO: 644000 - RNA, 22 nt, Human
uuugaaagccuccagcgcccgc

SEQ ID NO: 644001 - RNA, 21 nt, Human
uuugcauuuuuuuguuacucu

SEQ ID NO: 644002 - RNA, 23 nt, Human
uuuucaccauguuggccaggcug

SEQ ID NO: 644003 - RNA, 20 nt, Human
uuuuuguauuuuuaguagag

SEQ ID NO: 644004 - RNA, 20 nt, Human
uuuuuuuuuuugagacagag

SEQ ID NO: 644005 - RNA, 18 nt, Human
uuuuuuuuuuuuuuuuug

SEQ ID NO: 644006 - RNA, 19 nt, Human
aaaaauccacacauacccc

SEQ ID NO: 644007 - RNA, 23 nt, Human
acacauacccccaucccaauccc

SEQ ID NO: 644008 - RNA, 18 nt, Human
aggaaaaauccacacaua

SEQ ID NO: 644009 - RNA, 19 nt, Human
caacauguuuccugcagau

SEQ ID NO: 644010 - RNA, 22 nt, Human
caucccaaucccccagauuuuc

SEQ ID NO: 644011 - RNA, 22 nt, Human
ccccaucccaaucccccagauu

SEQ ID NO: 644012 - RNA, 22 nt, Human
ggaaaaauccacacauaccccc

SEQ ID NO: 644013 - RNA, 20 nt, Human
uccacacauacccccauccc

SEQ ID NO: 644014 - RNA, 23 nt, Human
uccuuugcccuuuuaacuccaaa

SEQ ID NO: 644015 - RNA, 21 nt, Human
uuuauguucaacauguuuccu

SEQ ID NO: 644016 - RNA, 22 nt, Human
uuuuuuuuuuuuuuuuugggau

SEQ ID NO: 644017 - RNA, 26 nt, Human
uuuuuuuuuuuuuuuuuuuuuuuggg

SEQ ID NO: 644018 - RNA, 27 nt, Human
ccuuuuuuuuuuuuuuuuuuuuuuuuu

SEQ ID NO: 644019 - RNA, 18 nt, Human
uccuuuuuuuuuuuuuuu

SEQ ID NO: 644020 - RNA, 18 nt, Human
uccuuuuuuuuuuuuuuu

SEQ ID NO: 644021 - RNA, 21 nt, Human
uuuuuuccuuuuuuuuuuuuu

SEQ ID NO: 644022 - RNA, 30 nt, Human
uuuuuuccuuuuuuuuuuuuuuuuuuuuuu

SEQ ID NO: 644023 - RNA, 30 nt, Human
uuuuuuuccuuuuuuuuuuuuuuuuuuuuu

SEQ ID NO: 644024 - RNA, 31 nt, Human
uuuuuuuuccuuuuuuuuuuuuuuuuuuuuu

SEQ ID NO: 644025 - RNA, 32 nt, Human
uuuuuuuuuccuuuuuuuuuuuuuuuuuuuuu

SEQ ID NO: 644026 - RNA, 21 nt, Human
uuuuuuuuuuuuuuccuuuuu

SEQ ID NO: 644027 - RNA, 22 nt, Human
uuuuuuuuuuuuuuuccuuuuu

SEQ ID NO: 644028 - RNA, 21 nt, Human
uuuuuuuuuuuuuuuuccuuu

SEQ ID NO: 644029 - RNA, 21 nt, Human
uuuuuuuuuuuuuuuuccuuu

SEQ ID NO: 644030 - RNA, 23 nt, Human
uuuuuuuuuuuuuuuuccuuuuu

SEQ ID NO: 644031 - RNA, 23 nt, Human
uuuuuuuuuuuuuuuuuuaauug

SEQ ID NO: 644032 - RNA, 22 nt, Human
agaaaaacagaguucacuugaa

SEQ ID NO: 644033 - RNA, 21 nt, Human
auuuucuuaaaaagcaaaaca

SEQ ID NO: 644034 - RNA, 23 nt, Human
caaaacacuuucaguagaaaaaa

SEQ ID NO: 644035 - RNA, 23 nt, Human
cagaaaaacagaguucacuugaa

SEQ ID NO: 644036 - RNA, 18 nt, Human
cccgccgcacugccaccc

SEQ ID NO: 644037 - RNA, 19 nt, Human
cccgccgcacugccacccc

SEQ ID NO: 644038 - RNA, 20 nt, Human
cguaacccgccgcacugcca

SEQ ID NO: 644039 - RNA, 28 nt, Human
guagaaaaaauuuacauaugaaagucaa

SEQ ID NO: 644040 - RNA, 22 nt, Human
uucaguagaaaaaauuuacaua

SEQ ID NO: 644041 - RNA, 23 nt, Human
uuuuuuuuuuuuuuuuucucauu

SEQ ID NO: 644042 - RNA, 20 nt, Human
aaacaagcucucaaagcaaa

SEQ ID NO: 644043 - RNA, 18 nt, Human
aaaccacaccgcagcccu

SEQ ID NO: 644044 - RNA, 23 nt, Human
aagaaacaaguccagagagggca

SEQ ID NO: 644045 - RNA, 27 nt, Human
aagaagccaggggcagccugcaaagcg

SEQ ID NO: 644046 - RNA, 19 nt, Human
aagcgggaaagggaggaag

SEQ ID NO: 644047 - RNA, 18 nt, Human
aaggcccagagcccaccu

SEQ ID NO: 644048 - RNA, 20 nt, Human
acagcccccuccccacuccu

SEQ ID NO: 644049 - RNA, 20 nt, Human
accagaggccccauuuuucu

SEQ ID NO: 644050 - RNA, 25 nt, Human
agacagaaauacacagauucugguc

SEQ ID NO: 644051 - RNA, 20 nt, Human
agagaauuauccaggaagug

SEQ ID NO: 644052 - RNA, 19 nt, Human
agagacaccagaggcccca

SEQ ID NO: 644053 - RNA, 20 nt, Human
agagggaauuucuccagcca

SEQ ID NO: 644054 - RNA, 25 nt, Human
agcagcaccaauagauuccccagug

SEQ ID NO: 644055 - RNA, 21 nt, Human
agccagagccuuuggauccaa

SEQ ID NO: 644056 - RNA, 23 nt, Human
aggaagcugcuggccggaauucc

SEQ ID NO: 644057 - RNA, 25 nt, Human
aggauuugcuggggaugaugggaca

SEQ ID NO: 644058 - RNA, 22 nt, Human
aggcaguucuagcccugagaga

SEQ ID NO: 644059 - RNA, 20 nt, Human
agggacugugcucuuucugu

SEQ ID NO: 644060 - RNA, 23 nt, Human
agggauccccuggagacuugucu

SEQ ID NO: 644061 - RNA, 22 nt, Human
agggcgugggggcggcggagaa

SEQ ID NO: 644062 - RNA, 21 nt, Human
aggugacccacccagggccuc

SEQ ID NO: 644063 - RNA, 21 nt, Human
agucugccaaacagcucugcu

SEQ ID NO: 644064 - RNA, 22 nt, Human
agugacacaaaucugacauuug

SEQ ID NO: 644065 - RNA, 23 nt, Human
augaaaccugugagaagguggcc

SEQ ID NO: 644066 - RNA, 25 nt, Human
augcagcagcaccaauagauuccag

SEQ ID NO: 644067 - RNA, 18 nt, Human
auggugggacacugaaca

SEQ ID NO: 644068 - RNA, 24 nt, Human
auugauuuaaaaguuuccuuugga

SEQ ID NO: 644069 - RNA, 22 nt, Human
caaagccugccacaccuuuuca

SEQ ID NO: 644070 - RNA, 23 nt, Human
cacaagccacaaauacagagaca

SEQ ID NO: 644071 - RNA, 30 nt, Human
cacacaagccacaaauacagagacauagcu

SEQ ID NO: 644072 - RNA, 21 nt, Human
cacagcacaggcaagucuccu

SEQ ID NO: 644073 - RNA, 23 nt, Human
cacuauguuuucccuucgagaca

SEQ ID NO: 644074 - RNA, 18 nt, Human
cagagcccaccuuacagc

SEQ ID NO: 644075 - RNA, 27 nt, Human
cagcagcaccaauagauuccccaguag

SEQ ID NO: 644076 - RNA, 28 nt, Human
cagcagcaccaauagauucccccaguag

SEQ ID NO: 644077 - RNA, 21 nt, Human
cagcauaggcagggaccuccu

SEQ ID NO: 644078 - RNA, 19 nt, Human
cagccaaggcgucauccag

SEQ ID NO: 644079 - RNA, 21 nt, Human
cagggacugugcucuuucugu

SEQ ID NO: 644080 - RNA, 21 nt, Human
caggucccgccccagcgagga

SEQ ID NO: 644081 - RNA, 20 nt, Human
caggugacccacccagggcc

SEQ ID NO: 644082 - RNA, 21 nt, Human
cagugcccuaugcuuccuguc

SEQ ID NO: 644083 - RNA, 20 nt, Human
cauucagaaugcagucccau

SEQ ID NO: 644084 - RNA, 18 nt, Human
ccacaaauacagagacau

SEQ ID NO: 644085 - RNA, 18 nt, Human
ccacaccuuuucauccac

SEQ ID NO: 644086 - RNA, 21 nt, Human
ccacccagggccucacugcga

SEQ ID NO: 644087 - RNA, 24 nt, Human
ccacccagggccucacugcgaacu

SEQ ID NO: 644088 - RNA, 21 nt, Human
cccaccuuacagccccuuaga

SEQ ID NO: 644089 - RNA, 22 nt, Human
ccccaaagggcaauuccacacc

SEQ ID NO: 644090 - RNA, 23 nt, Human
cccccacgcuuccaguguacuuc

SEQ ID NO: 644091 - RNA, 19 nt, Human
ccccuggaagccacucacu

SEQ ID NO: 644092 - RNA, 18 nt, Human
cccugaagggcucguccc

SEQ ID NO: 644093 - RNA, 18 nt, Human
cccugagagagguagagg

SEQ ID NO: 644094 - RNA, 22 nt, Human
ccugcauuuuccauuuccucuu

SEQ ID NO: 644095 - RNA, 23 nt, Human
cggaauucccaggcgguuuccac

SEQ ID NO: 644096 - RNA, 19 nt, Human
cuaccacacaagccacaaa

SEQ ID NO: 644097 - RNA, 26 nt, Human
cuagcccugagagagguagaggggcc

SEQ ID NO: 644098 - RNA, 27 nt, Human
cucacugaguuacagcccccuccccaa

SEQ ID NO: 644099 - RNA, 23 nt, Human
cuccccacuccuguaucugcuca

SEQ ID NO: 644100 - RNA, 18 nt, Human
cuccuacuaaaggcuaaa

SEQ ID NO: 644101 - RNA, 19 nt, Human
cuggacuuuggcaaaaaaa

SEQ ID NO: 644102 - RNA, 20 nt, Human
cugguucgguggcggggacc

SEQ ID NO: 644103 - RNA, 20 nt, Human
cuuacugccuagggaagcug

SEQ ID NO: 644104 - RNA, 23 nt, Human
cuucugaggcuaccacacaagcc

SEQ ID NO: 644105 - RNA, 26 nt, Human
gaagaaacaaguccagagagggcagg

SEQ ID NO: 644106 - RNA, 18 nt, Human
gaccagagccgccaggcc

SEQ ID NO: 644107 - RNA, 18 nt, Human
gacucuuuuguaggccug

SEQ ID NO: 644108 - RNA, 27 nt, Human
gagggccccugugaguuuccggggggc

SEQ ID NO: 644109 - RNA, 23 nt, Human
gauggaaucuugaagguccugag

SEQ ID NO: 644110 - RNA, 20 nt, Human
gauggcucuguggggugagg

SEQ ID NO: 644111 - RNA, 23 nt, Human
gcccagagcccaccuuacagccc

SEQ ID NO: 644112 - RNA, 20 nt, Human
gccccauuuuucuacaaugg

SEQ ID NO: 644113 - RNA, 20 nt, Human
gccgcgggaggcgcgggcgg

SEQ ID NO: 644114 - RNA, 21 nt, Human
gccucacugcgaacuggggug

SEQ ID NO: 644115 - RNA, 21 nt, Human
gccuuuggauccaaacuccag

SEQ ID NO: 644116 - RNA, 22 nt, Human
gccuuuggauccaaacuccagc

SEQ ID NO: 644117 - RNA, 22 nt, Human
gcuucugcugugcuugagagcc

SEQ ID NO: 644118 - RNA, 18 nt, Human
ggaaagggaggaagaagc

SEQ ID NO: 644119 - RNA, 21 nt, Human
ggaaagggaggaagaagccag

SEQ ID NO: 644120 - RNA, 22 nt, Human
ggacagguuggggaauaucccu

SEQ ID NO: 644121 - RNA, 22 nt, Human
ggagagaaaguaucauaauaaa

SEQ ID NO: 644122 - RNA, 25 nt, Human
ggaggaagaagccaggggcagccug

SEQ ID NO: 644123 - RNA, 19 nt, Human
ggccagguggcugaaggag

SEQ ID NO: 644124 - RNA, 24 nt, Human
ggccagugguuuuuugcaaaaagg

SEQ ID NO: 644125 - RNA, 19 nt, Human
ggccuggggccccuggaag

SEQ ID NO: 644126 - RNA, 19 nt, Human
ggcucagggaggugaagug

SEQ ID NO: 644127 - RNA, 24 nt, Human
gggaagccaccgagucacugccaa

SEQ ID NO: 644128 - RNA, 20 nt, Human
gggaaggacagguuggggaa

SEQ ID NO: 644129 - RNA, 21 nt, Human
gggaauuggggcucagggagg

SEQ ID NO: 644130 - RNA, 20 nt, Human
gggacagcugcagcuuccug

SEQ ID NO: 644131 - RNA, 21 nt, Human
gggcaggugacccacccaggg

SEQ ID NO: 644132 - RNA, 19 nt, Human
guaaagagacaccagaggc

SEQ ID NO: 644133 - RNA, 23 nt, Human
uaaaauaaauacuaaaaauccua

SEQ ID NO: 644134 - RNA, 21 nt, Human
uaaccaauaauccagugacac

SEQ ID NO: 644135 - RNA, 23 nt, Human
uaaggaaggaccccaaagggcaa

SEQ ID NO: 644136 - RNA, 18 nt, Human
uaccauaguccauagugg

SEQ ID NO: 644137 - RNA, 20 nt, Human
uagcagcaccucugcccagc

SEQ ID NO: 644138 - RNA, 21 nt, Human
uagcagcaccucugcccagcc

SEQ ID NO: 644139 - RNA, 19 nt, Human
uauggaaaccagggucccu

SEQ ID NO: 644140 - RNA, 18 nt, Human
ucagagcccaguccaaca

SEQ ID NO: 644141 - RNA, 18 nt, Human
ucagaggugacagucaaa

SEQ ID NO: 644142 - RNA, 20 nt, Human
ucagcauaggcagggaccuc

SEQ ID NO: 644143 - RNA, 18 nt, Human
ucagggaggugaagugac

SEQ ID NO: 644144 - RNA, 19 nt, Human
ucaguugggaaacagggau

SEQ ID NO: 644145 - RNA, 20 nt, Human
ucaugucauguguuccccca

SEQ ID NO: 644146 - RNA, 23 nt, Human
uccacaguggaaaucuccccacu

SEQ ID NO: 644147 - RNA, 22 nt, Human
ucccugcagaaugaaaccugug

SEQ ID NO: 644148 - RNA, 21 nt, Human
ucucaaagcaacucuccuucc

SEQ ID NO: 644149 - RNA, 21 nt, Human
ucucauagaccauggugggac

SEQ ID NO: 644150 - RNA, 19 nt, Human
ucugaggcuaccacacaag

SEQ ID NO: 644151 - RNA, 22 nt, Human
ucugccagagcuugaguguccu

SEQ ID NO: 644152 - RNA, 19 nt, Human
ugaagaaacaaguccagag

SEQ ID NO: 644153 - RNA, 19 nt, Human
ugaaggaggaagcugcugg

SEQ ID NO: 644154 - RNA, 22 nt, Human
ugaagugacuuggccaagauca

SEQ ID NO: 644155 - RNA, 22 nt, Human
ugacacauagguauuguugcca

SEQ ID NO: 644156 - RNA, 21 nt, Human
ugacuuagccagagccuuugg

SEQ ID NO: 644157 - RNA, 23 nt, Human
ugacuuggccaagaucauacagg

SEQ ID NO: 644158 - RNA, 21 nt, Human
ugagaaagugacauaaugacu

SEQ ID NO: 644159 - RNA, 19 nt, Human
ugagagagaacguggggga

SEQ ID NO: 644160 - RNA, 22 nt, Human
ugagagagguagaggggcccca

SEQ ID NO: 644161 - RNA, 23 nt, Human
ugagggcaguauggaaaccaggg

SEQ ID NO: 644162 - RNA, 21 nt, Human
ugcagugcccuaugcuuccuu

SEQ ID NO: 644163 - RNA, 22 nt, Human
ugccaaacagcucugcuucuga

SEQ ID NO: 644164 - RNA, 18 nt, Human
ugccacaccuuuucaucc

SEQ ID NO: 644165 - RNA, 18 nt, Human
ugccagagcuugaguguc

SEQ ID NO: 644166 - RNA, 19 nt, Human
ugccagagcuugagugucc

SEQ ID NO: 644167 - RNA, 20 nt, Human
ugccagagcuugaguguccu

SEQ ID NO: 644168 - RNA, 20 nt, Human
ugccggccagcccacagaug

SEQ ID NO: 644169 - RNA, 20 nt, Human
ugcucugcucagcugggucc

SEQ ID NO: 644170 - RNA, 20 nt, Human
uggaaaucuccccacugcca

SEQ ID NO: 644171 - RNA, 22 nt, Human
uggaagcacagcacaggcaagu

SEQ ID NO: 644172 - RNA, 28 nt, Human
uggacaagcaagguaacauuguaaugac

SEQ ID NO: 644173 - RNA, 22 nt, Human
uggacuggacucuuuuguaggc

SEQ ID NO: 644174 - RNA, 18 nt, Human
uggcaaaaaaaggaaguc

SEQ ID NO: 644175 - RNA, 19 nt, Human
uggcuccuagacucucucu

SEQ ID NO: 644176 - RNA, 19 nt, Human
uggcugaaggaggaagcug

SEQ ID NO: 644177 - RNA, 18 nt, Human
ugggaauuggggcucagg

SEQ ID NO: 644178 - RNA, 21 nt, Human
ugggaauuggggcucagggag

SEQ ID NO: 644179 - RNA, 22 nt, Human
uggggaugaugggacagcugca

SEQ ID NO: 644180 - RNA, 18 nt, Human
uggggugaggguagagaa

SEQ ID NO: 644181 - RNA, 19 nt, Human
ugguaaagagacaccagag

SEQ ID NO: 644182 - RNA, 19 nt, Human
uguggguccccacuggugc

SEQ ID NO: 644183 - RNA, 25 nt, Human
uuccacacccugcauuuuccauuuc

SEQ ID NO: 644184 - RNA, 21 nt, Human
uuccacaguggaaaucucccc

SEQ ID NO: 644185 - RNA, 24 nt, Human
uucccaggcgguuuccacagugga

SEQ ID NO: 644186 - RNA, 18 nt, Human
uugccggccagcccacag

SEQ ID NO: 644187 - RNA, 20 nt, Human
uugcuggggaugaugggaca

SEQ ID NO: 644188 - RNA, 20 nt, Human
uuuaagggguauggccaggu

SEQ ID NO: 644189 - RNA, 23 nt, Human
uuucugggaagagggccccugug

SEQ ID NO: 644190 - RNA, 18 nt, Human
aacaguauccuuaaucug

SEQ ID NO: 644191 - RNA, 21 nt, Human
aagagaagaucgaguuccaaa

SEQ ID NO: 644192 - RNA, 26 nt, Human
acaaauacaaagggaagaagagccag

SEQ ID NO: 644193 - RNA, 22 nt, Human
accagguugagggugcuggucu

SEQ ID NO: 644194 - RNA, 25 nt, Human
acccccagcccugcaugcagggucc

SEQ ID NO: 644195 - RNA, 21 nt, Human
accccuggcacaacauggucu

SEQ ID NO: 644196 - RNA, 21 nt, Human
acuuaagggcucuccaggugc

SEQ ID NO: 644197 - RNA, 18 nt, Human
agaaagaagcuaccaggu

SEQ ID NO: 644198 - RNA, 22 nt, Human
agcuggcucuuaccuccuggcu

SEQ ID NO: 644199 - RNA, 23 nt, Human
aggggcuggcucucuccccccug

SEQ ID NO: 644200 - RNA, 22 nt, Human
auacauugaagguaccagagcu

SEQ ID NO: 644201 - RNA, 22 nt, Human
augccuggcucaggccaucagg

SEQ ID NO: 644202 - RNA, 24 nt, Human
auggagcuggggcuugggcuccuc

SEQ ID NO: 644203 - RNA, 21 nt, Human
auuccacccccagcccugcau

SEQ ID NO: 644204 - RNA, 21 nt, Human
caaagggaagaagagccagca

SEQ ID NO: 644205 - RNA, 24 nt, Human
caacaguauccuuaaucugucuga

SEQ ID NO: 644206 - RNA, 26 nt, Human
caacauggucucugagguccagauac

SEQ ID NO: 644207 - RNA, 22 nt, Human
caccccuggcacaacauggucu

SEQ ID NO: 644208 - RNA, 20 nt, Human
cacgcggaccgacgaggcgc

SEQ ID NO: 644209 - RNA, 24 nt, Human
cacuuuggggcaaaguuaaggguc

SEQ ID NO: 644210 - RNA, 26 nt, Human
cagccaggacagacuuaagggcucuc

SEQ ID NO: 644211 - RNA, 20 nt, Human
caugcaggguccagccauug

SEQ ID NO: 644212 - RNA, 18 nt, Human
ccacagccaggacagacu

SEQ ID NO: 644213 - RNA, 25 nt, Human
ccacagccaggacagacuuaagggc

SEQ ID NO: 644214 - RNA, 19 nt, Human
ccccauuccacccccagcc

SEQ ID NO: 644215 - RNA, 21 nt, Human
ccccauuccacccccagcccu

SEQ ID NO: 644216 - RNA, 24 nt, Human
cccccagcccugcaugcagggucc

SEQ ID NO: 644217 - RNA, 22 nt, Human
cccuuuaaaauucaagccugaa

SEQ ID NO: 644218 - RNA, 19 nt, Human
ccuggcacaacauggucuc

SEQ ID NO: 644219 - RNA, 21 nt, Human
ccuggcacaacauggucucug

SEQ ID NO: 644220 - RNA, 21 nt, Human
cgcacgcaccgaccgaccgca

SEQ ID NO: 644221 - RNA, 19 nt, Human
cuuaccuccuggcuuucuc

SEQ ID NO: 644222 - RNA, 19 nt, Human
cuucaguucuguaccauuu

SEQ ID NO: 644223 - RNA, 27 nt, Human
cuuccgaggcuucaguuccuccgcggg

SEQ ID NO: 644224 - RNA, 18 nt, Human
gagcuggggcuugggcuc

SEQ ID NO: 644225 - RNA, 20 nt, Human
gaggauggagcuggggcuug

SEQ ID NO: 644226 - RNA, 18 nt, Human
gcacgcacgcaccgaccg

SEQ ID NO: 644227 - RNA, 24 nt, Human
gccuacugcccccuaaugucuucu

SEQ ID NO: 644228 - RNA, 19 nt, Human
gccugggguugguguggag

SEQ ID NO: 644229 - RNA, 22 nt, Human
gccugggguugguguggagccc

SEQ ID NO: 644230 - RNA, 19 nt, Human
ggcuucaguucuguaccau

SEQ ID NO: 644231 - RNA, 23 nt, Human
guucagggcaacuggcuuuccca

SEQ ID NO: 644232 - RNA, 23 nt, Human
uacaaagggaagaagagccagca

SEQ ID NO: 644233 - RNA, 19 nt, Human
uacacaaauacaaagggaa

SEQ ID NO: 644234 - RNA, 26 nt, Human
uaccagguugagggugcuggucuucu

SEQ ID NO: 644235 - RNA, 24 nt, Human
uacucagaggcucagauggacccu

SEQ ID NO: 644236 - RNA, 22 nt, Human
ucacuuuggggcaaaguuaagg

SEQ ID NO: 644237 - RNA, 19 nt, Human
ucagauggacccuugauuc

SEQ ID NO: 644238 - RNA, 21 nt, Human
uccagauacucugaggguagg

SEQ ID NO: 644239 - RNA, 25 nt, Human
uccccuacaagagggacagggagag

SEQ ID NO: 644240 - RNA, 20 nt, Human
ucugucugaguguuccuccg

SEQ ID NO: 644241 - RNA, 25 nt, Human
ugaaauaauaaacagugacagguca

SEQ ID NO: 644242 - RNA, 21 nt, Human
ugaagguaccagagcuuccag

SEQ ID NO: 644243 - RNA, 21 nt, Human
ugaagguuuugugugggggcc

SEQ ID NO: 644244 - RNA, 19 nt, Human
ugacaggucaacaguaucc

SEQ ID NO: 644245 - RNA, 19 nt, Human
ugaggguaggggcuggcuc

SEQ ID NO: 644246 - RNA, 19 nt, Human
uggagcuggggcuugggcc

SEQ ID NO: 644247 - RNA, 18 nt, Human
uggcacaacauggucucu

SEQ ID NO: 644248 - RNA, 26 nt, Human
ugggaccaccccuggcacaacauggu

SEQ ID NO: 644249 - RNA, 24 nt, Human
ugggggaaacaggcagaauaagug

SEQ ID NO: 644250 - RNA, 21 nt, Human
uguggagccccucacuuuggg

SEQ ID NO: 644251 - RNA, 19 nt, Human
uguguucuuguacauuuug

SEQ ID NO: 644252 - RNA, 21 nt, Human
uucauuuaaggaagagaagau

SEQ ID NO: 644253 - RNA, 19 nt, Human
uucccaaggcauacaagaa

SEQ ID NO: 644254 - RNA, 23 nt, Human
uucuggugauacugcagcacagu

SEQ ID NO: 644255 - RNA, 24 nt, Human
uugauucucccaggagucauacau

SEQ ID NO: 644256 - RNA, 18 nt, Human
uuuuuuuuuuuuuuuuug

SEQ ID NO: 644257 - RNA, 23 nt, Human
uuuuuuuuuuuuuuuuuggaauu

SEQ ID NO: 644258 - RNA, 29 nt, Human
uuuuuuuuuuuuuuuuuuuuuuggaauug

SEQ ID NO: 644259 - RNA, 23 nt, Human
aaaaaaaaaaacagacucaagga

SEQ ID NO: 644260 - RNA, 24 nt, Human
aaaaaaaaaacagacucaaggaaa

SEQ ID NO: 644261 - RNA, 21 nt, Human
aaaaaaaaacagacucaagga

SEQ ID NO: 644262 - RNA, 20 nt, Human
aaaaaaaaccaaaaaaaaaa

SEQ ID NO: 644263 - RNA, 24 nt, Human
aaaaaaacagacucaaggaaaugg

SEQ ID NO: 644264 - RNA, 19 nt, Human
aaaaaaaccaaaaaaaaaa

SEQ ID NO: 644265 - RNA, 23 nt, Human
aaaacaaaaaaaaaaacagacuc

SEQ ID NO: 644266 - RNA, 22 nt, Human
aaaaccaaaaaaaaaacaaaaa

SEQ ID NO: 644267 - RNA, 24 nt, Human
aaacaaaaaaaaaaacagacucaa

SEQ ID NO: 644268 - RNA, 20 nt, Human
aaaccaagaccugaagggga

SEQ ID NO: 644269 - RNA, 22 nt, Human
aaacgucccuucagaacaaacc

SEQ ID NO: 644270 - RNA, 18 nt, Human
aaagcuccuccuuccacc

SEQ ID NO: 644271 - RNA, 23 nt, Human
aagggacacccacacacugaguc

SEQ ID NO: 644272 - RNA, 22 nt, Human
accucagaccaaccuaagccuc

SEQ ID NO: 644273 - RNA, 19 nt, Human
agaccugaaggggaagcag

SEQ ID NO: 644274 - RNA, 23 nt, Human
agccagaggagaaagcuccuccu

SEQ ID NO: 644275 - RNA, 23 nt, Human
agccucuggcuucagucagaucc

SEQ ID NO: 644276 - RNA, 24 nt, Human
aggaggagggaaggggcuaggggc

SEQ ID NO: 644277 - RNA, 22 nt, Human
caaaaaaaaaaacagacucaac

SEQ ID NO: 644278 - RNA, 23 nt, Human
caccaagaaggagagggcagucc

SEQ ID NO: 644279 - RNA, 23 nt, Human
cagaucccaaauaucacugggaa

SEQ ID NO: 644280 - RNA, 19 nt, Human
ccaccgggggagcuugggg

SEQ ID NO: 644281 - RNA, 24 nt, Human
ccacuauggucugauuuuacagag

SEQ ID NO: 644282 - RNA, 24 nt, Human
ccagcugccccuuugucauuuccc

SEQ ID NO: 644283 - RNA, 18 nt, Human
cccaugauuaggaaugga

SEQ ID NO: 644284 - RNA, 22 nt, Human
ccccaggaggagggaaggggcu

SEQ ID NO: 644285 - RNA, 19 nt, Human
ccccaugauuaggaaugga

SEQ ID NO: 644286 - RNA, 20 nt, Human
cccucuucuuuccuuugcug

SEQ ID NO: 644287 - RNA, 30 nt, Human
ccucacacugggccuccguaucacucccuu

SEQ ID NO: 644288 - RNA, 18 nt, Human
ccucugggacucccuggg

SEQ ID NO: 644289 - RNA, 21 nt, Human
ccugcaaucuccucagccucu

SEQ ID NO: 644290 - RNA, 24 nt, Human
ccuucagaacaaaccaagaccuga

SEQ ID NO: 644291 - RNA, 21 nt, Human
ccuugauaggguggaagcgaa

SEQ ID NO: 644292 - RNA, 18 nt, Human
cgggggugggauggggaa

SEQ ID NO: 644293 - RNA, 23 nt, Human
cucaaacucagccagaggagaaa

SEQ ID NO: 644294 - RNA, 29 nt, Human
cucccucuucuuuccuuugcuguugagaa

SEQ ID NO: 644295 - RNA, 22 nt, Human
cucuauuaaccuuugaaucacc

SEQ ID NO: 644296 - RNA, 18 nt, Human
cucugccaaaaaaaaaac

SEQ ID NO: 644297 - RNA, 21 nt, Human
cugggacucccugggcucugg

SEQ ID NO: 644298 - RNA, 19 nt, Human
gaggagggaaggggcuagg

SEQ ID NO: 644299 - RNA, 24 nt, Human
gaggccccaggaggagggaagggg

SEQ ID NO: 644300 - RNA, 21 nt, Human
gccaaccucagaccaaccuaa

SEQ ID NO: 644301 - RNA, 19 nt, Human
gccagcugccccuuuguca

SEQ ID NO: 644302 - RNA, 21 nt, Human
gccccaggaggagggaagggg

SEQ ID NO: 644303 - RNA, 19 nt, Human
gccucugggacucccuggg

SEQ ID NO: 644304 - RNA, 19 nt, Human
gcgaaacucccucuucuuu

SEQ ID NO: 644305 - RNA, 18 nt, Human
gcuuaucuggccagcugc

SEQ ID NO: 644306 - RNA, 21 nt, Human
gggaagcaggaagggacaccc

SEQ ID NO: 644307 - RNA, 19 nt, Human
gggccuccguaucacuccc

SEQ ID NO: 644308 - RNA, 20 nt, Human
ggggcuguggccacccuuuc

SEQ ID NO: 644309 - RNA, 21 nt, Human
ggggugggauggggaaugcag

SEQ ID NO: 644310 - RNA, 22 nt, Human
uagcuggaguacuuugucccuc

SEQ ID NO: 644311 - RNA, 20 nt, Human
uaggaauggacacccugacc

SEQ ID NO: 644312 - RNA, 19 nt, Human
ucacuccccuucuguagcu

SEQ ID NO: 644313 - RNA, 21 nt, Human
ucuccuugauaggguggaagc

SEQ ID NO: 644314 - RNA, 18 nt, Human
ucucugccaaaaaaaaaa

SEQ ID NO: 644315 - RNA, 26 nt, Human
ucugccaaaaaaaaaaccaaaaaaaa

SEQ ID NO: 644316 - RNA, 24 nt, Human
ugaaugcuuguggcaucugcccca

SEQ ID NO: 644317 - RNA, 19 nt, Human
ugacauucuggcuuguuuu

SEQ ID NO: 644318 - RNA, 24 nt, Human
ugacuauaaaacgucccuucagaa

SEQ ID NO: 644319 - RNA, 21 nt, Human
ugaggggcuggaggccccagg

SEQ ID NO: 644320 - RNA, 24 nt, Human
ugccaaaaaaaaaaccaaaaaaaa

SEQ ID NO: 644321 - RNA, 27 nt, Human
ugccaaaaaaaaaaccaaaaaaaaaac

SEQ ID NO: 644322 - RNA, 25 nt, Human
ugccaaccucagaccaaccuaagcc

SEQ ID NO: 644323 - RNA, 21 nt, Human
ugcuuguggcaucugccccau

SEQ ID NO: 644324 - RNA, 21 nt, Human
ugggagacugggggaggagau

SEQ ID NO: 644325 - RNA, 18 nt, Human
uggggcuguggccacccu

SEQ ID NO: 644326 - RNA, 19 nt, Human
ugugaaacuugccucuggg

SEQ ID NO: 644327 - RNA, 19 nt, Human
uuucacacuggcaugugga

SEQ ID NO: 644328 - RNA, 18 nt, Human
uuuuuuuugacauucugg

SEQ ID NO: 644329 - RNA, 21 nt, Human
aagcaagcaccaacagcuuca

SEQ ID NO: 644330 - RNA, 26 nt, Human
aagcaagcaccaacagcuucaaaaca

SEQ ID NO: 644331 - RNA, 20 nt, Human
cucucuccacuuauacuucu

SEQ ID NO: 644332 - RNA, 21 nt, Human
gucacccccuaagguaaauuc

SEQ ID NO: 644333 - RNA, 22 nt, Human
uauggcgauguaaagcaagcac

SEQ ID NO: 644334 - RNA, 24 nt, Human
ucugauguagcacucucuccacuu

SEQ ID NO: 644335 - RNA, 18 nt, Human
uuuuuuuuuuuuuuuuug

SEQ ID NO: 644336 - RNA, 22 nt, Human
uuuuuuuuuuuuuuuuugcaau

SEQ ID NO: 644337 - RNA, 24 nt, Human
uuuuuuuuuuuuuuuuugcaauaa

SEQ ID NO: 644338 - RNA, 24 nt, Human
aaaauacaacgaaagaaugagaua

SEQ ID NO: 644339 - RNA, 19 nt, Human
aaacagaaaaaaguauugg

SEQ ID NO: 644340 - RNA, 23 nt, Human
aagaaaacagaaaaaaguauugg

SEQ ID NO: 644341 - RNA, 23 nt, Human
aauacagcaaacuuuucuaagca

SEQ ID NO: 644342 - RNA, 23 nt, Human
acaccaggaauaaucauauugca

SEQ ID NO: 644343 - RNA, 23 nt, Human
agaaguaaugacaucaucaaaac

SEQ ID NO: 644344 - RNA, 23 nt, Human
auggcaaucaugagaaaggucuu

SEQ ID NO: 644345 - RNA, 19 nt, Human
cacccuaucacuuaagguu

SEQ ID NO: 644346 - RNA, 20 nt, Human
cauagccagcuaaucucaua

SEQ ID NO: 644347 - RNA, 21 nt, Human
caucaagaaaacagaaaaaag

SEQ ID NO: 644348 - RNA, 20 nt, Human
cauuauguuucucauagcca

SEQ ID NO: 644349 - RNA, 22 nt, Human
ccagcuaaucucauagaacacu

SEQ ID NO: 644350 - RNA, 23 nt, Human
ccuugugucacaaagugagagaa

SEQ ID NO: 644351 - RNA, 22 nt, Human
cgaaagaaugagauauacucac

SEQ ID NO: 644352 - RNA, 24 nt, Human
cuugaauaucuuacugacauguuc

SEQ ID NO: 644353 - RNA, 18 nt, Human
gaacacuuaccugauuug

SEQ ID NO: 644354 - RNA, 19 nt, Human
gaaggcuuccuguagucaa

SEQ ID NO: 644355 - RNA, 20 nt, Human
gacaucaucaaaacagucau

SEQ ID NO: 644356 - RNA, 23 nt, Human
gucuauggaaauacagcaaacuu

SEQ ID NO: 644357 - RNA, 19 nt, Human
uaaagaauaaacauauaaa

SEQ ID NO: 644358 - RNA, 23 nt, Human
uaucagaaauaggaaaauuuaga

SEQ ID NO: 644359 - RNA, 24 nt, Human
uaucaucaagaaaacagaaaaaag

SEQ ID NO: 644360 - RNA, 23 nt, Human
uaucaucauuuuaaaauugaaau

SEQ ID NO: 644361 - RNA, 21 nt, Human
uaugacaguaaaaaaaugaga

SEQ ID NO: 644362 - RNA, 19 nt, Human
ucacccuaucacuuaaggu

SEQ ID NO: 644363 - RNA, 20 nt, Human
ucugagaucacugaugcugg

SEQ ID NO: 644364 - RNA, 22 nt, Human
ugaaaaagaaacaucauuaugu

SEQ ID NO: 644365 - RNA, 18 nt, Human
ugaaaagcaguucacuga

SEQ ID NO: 644366 - RNA, 19 nt, Human
ugaaaagcaguucacugau

SEQ ID NO: 644367 - RNA, 23 nt, Human
ugaaaagcaguucacugaucuua

SEQ ID NO: 644368 - RNA, 23 nt, Human
uucuuuaaguguacuaucaaaua

SEQ ID NO: 644369 - RNA, 22 nt, Human
uuugugugguuuacugaauuuu

SEQ ID NO: 644370 - RNA, 23 nt, Human
aaaccacgucuacaaucuccaau

SEQ ID NO: 644371 - RNA, 26 nt, Human
acagcgaagggagcugcuccgggcac

SEQ ID NO: 644372 - RNA, 22 nt, Human
accagcacgggccggagggagg

SEQ ID NO: 644373 - RNA, 18 nt, Human
aggaccacugaaagagau

SEQ ID NO: 644374 - RNA, 22 nt, Human
agggccgcccccaaggccgccg

SEQ ID NO: 644375 - RNA, 22 nt, Human
agucccauuucuucugacucgg

SEQ ID NO: 644376 - RNA, 25 nt, Human
aguuuguuaaauaauuucuugggag

SEQ ID NO: 644377 - RNA, 25 nt, Human
auggagcuagagggugcucuuucau

SEQ ID NO: 644378 - RNA, 22 nt, Human
caaaaucuccuuucaguuuguu

SEQ ID NO: 644379 - RNA, 22 nt, Human
caacaaaacacugugaccaaaa

SEQ ID NO: 644380 - RNA, 24 nt, Human
caacaaaacacugugaccaaaaaa

SEQ ID NO: 644381 - RNA, 23 nt, Human
cagaagccaggcuacguagggcc

SEQ ID NO: 644382 - RNA, 23 nt, Human
cagaagccaggcuacguagggga

SEQ ID NO: 644383 - RNA, 22 nt, Human
cauacuagaaaaccaacuaugu

SEQ ID NO: 644384 - RNA, 23 nt, Human
cgccgcuuccacagcgaagggag

SEQ ID NO: 644385 - RNA, 22 nt, Human
cgggaccagcacgggccggagg

SEQ ID NO: 644386 - RNA, 20 nt, Human
gccgaggcaggaggggccgg

SEQ ID NO: 644387 - RNA, 19 nt, Human
gggccggagggaggggaag

SEQ ID NO: 644388 - RNA, 19 nt, Human
uaaccuacucacauugcca

SEQ ID NO: 644389 - RNA, 18 nt, Human
uaugaacagauauuuaga

SEQ ID NO: 644390 - RNA, 22 nt, Human
uauguugguuuuuguacuauug

SEQ ID NO: 644391 - RNA, 22 nt, Human
ucgaagacaccgccgcuuccac

SEQ ID NO: 644392 - RNA, 20 nt, Human
ugaaacgcaauagcauauaa

SEQ ID NO: 644393 - RNA, 21 nt, Human
ugaaagagauaaguguccuca

SEQ ID NO: 644394 - RNA, 23 nt, Human
ugacucggcaggagcccgggacg

SEQ ID NO: 644395 - RNA, 20 nt, Human
uguacaguguguucaaauau

SEQ ID NO: 644396 - RNA, 18 nt, Human
ugugcugggacaaaguug

SEQ ID NO: 644397 - RNA, 21 nt, Human
uucaaauauagauacugaaga

SEQ ID NO: 644398 - RNA, 21 nt, Human
uugaagaaacauguucugugg

SEQ ID NO: 644399 - RNA, 18 nt, Human
uuucuugggaggaccacu

SEQ ID NO: 644400 - RNA, 23 nt, Human
uuugaagaaacauguucugugcg

SEQ ID NO: 644401 - RNA, 22 nt, Human
uuuguaaaaccacgucuacaau

SEQ ID NO: 644402 - RNA, 27 nt, Human
aaaaaaaauggaaggcggccgguaccc

SEQ ID NO: 644403 - RNA, 18 nt, Human
aaaaagcccauucguaac

SEQ ID NO: 644404 - RNA, 20 nt, Human
aaacaaauuccaggucuaca

SEQ ID NO: 644405 - RNA, 23 nt, Human
aaacauaagccagugaaaacaua

SEQ ID NO: 644406 - RNA, 23 nt, Human
aaauaggcaugauguucuuccac

SEQ ID NO: 644407 - RNA, 22 nt, Human
aaguguuaaaaagcccauucgu

SEQ ID NO: 644408 - RNA, 26 nt, Human
aaugcaggaaaggaguggggagagga

SEQ ID NO: 644409 - RNA, 23 nt, Human
acauaagccagugaaaacauacu

SEQ ID NO: 644410 - RNA, 24 nt, Human
acuauuuuauucauuacaaacauc

SEQ ID NO: 644411 - RNA, 18 nt, Human
acuguaauucaguguuuu

SEQ ID NO: 644412 - RNA, 24 nt, Human
agacgaaaacaaauuccaggucua

SEQ ID NO: 644413 - RNA, 24 nt, Human
aggaaagaguaagguacacaucag

SEQ ID NO: 644414 - RNA, 21 nt, Human
aggaagagagggaggaaagag

SEQ ID NO: 644415 - RNA, 20 nt, Human
aggaagggaggaagagaggg

SEQ ID NO: 644416 - RNA, 21 nt, Human
auaaucacagaaaaagaacau

SEQ ID NO: 644417 - RNA, 22 nt, Human
augcaggaaaggaguggggaga

SEQ ID NO: 644418 - RNA, 21 nt, Human
augugacgagggaaggaggga

SEQ ID NO: 644419 - RNA, 18 nt, Human
caacacucuaaaaguguu

SEQ ID NO: 644420 - RNA, 24 nt, Human
caacacucuaaaaguguuaaaaag

SEQ ID NO: 644421 - RNA, 18 nt, Human
cagaaaaagaacauccaa

SEQ ID NO: 644422 - RNA, 22 nt, Human
cagaaaaagaacauccaacuuu

SEQ ID NO: 644423 - RNA, 18 nt, Human
caucgcccugcccugccu

SEQ ID NO: 644424 - RNA, 25 nt, Human
ccauucguaacacacaccccaccuc

SEQ ID NO: 644425 - RNA, 22 nt, Human
cccaccucaguuuuugaaaguc

SEQ ID NO: 644426 - RNA, 19 nt, Human
cuuguuguuguuuuccccg

SEQ ID NO: 644427 - RNA, 25 nt, Human
gaacauccaacuuuauucuuaaaug

SEQ ID NO: 644428 - RNA, 21 nt, Human
gacgagggaaggagggaggga

SEQ ID NO: 644429 - RNA, 18 nt, Human
gagaggaggaagggagga

SEQ ID NO: 644430 - RNA, 22 nt, Human
gaggaagagagggaggaaagag

SEQ ID NO: 644431 - RNA, 19 nt, Human
gagggaaggagggagggag

SEQ ID NO: 644432 - RNA, 24 nt, Human
gcaacacucuaaaaguguuaaaaa

SEQ ID NO: 644433 - RNA, 20 nt, Human
ggaaaggaguggggagagga

SEQ ID NO: 644434 - RNA, 18 nt, Human
ggaaggagggagggagaa

SEQ ID NO: 644435 - RNA, 18 nt, Human
gggagggagaaaugcagg

SEQ ID NO: 644436 - RNA, 20 nt, Human
guggggagaggaggaaggga

SEQ ID NO: 644437 - RNA, 22 nt, Human
uaaaaggggcagaauuaggaau

SEQ ID NO: 644438 - RNA, 22 nt, Human
uaagguacacaucagguuaaaa

SEQ ID NO: 644439 - RNA, 22 nt, Human
uaaucacagaaaaagaacaucc

SEQ ID NO: 644440 - RNA, 24 nt, Human
uaaugaaacuacuauuuuauucau

SEQ ID NO: 644441 - RNA, 26 nt, Human
uaauuacugugcuccauauaaagaga

SEQ ID NO: 644442 - RNA, 22 nt, Human
uaggaauaaaacuaagcacuua

SEQ ID NO: 644443 - RNA, 23 nt, Human
uaggaauaaaacuaagcacuuaa

SEQ ID NO: 644444 - RNA, 26 nt, Human
uauaaaaauuuaaaugcuuccuuucu

SEQ ID NO: 644445 - RNA, 19 nt, Human
ucaaguuguagccaaaaca

SEQ ID NO: 644446 - RNA, 21 nt, Human
ucaaucaaguuguagccaaaa

SEQ ID NO: 644447 - RNA, 21 nt, Human
uccuuguuguuguuuuccccg

SEQ ID NO: 644448 - RNA, 21 nt, Human
ucuaaagcaacacucuaaaag

SEQ ID NO: 644449 - RNA, 21 nt, Human
ucuaaucugaucaggaagaaa

SEQ ID NO: 644450 - RNA, 24 nt, Human
ugaaaacauaagccagugaaaaca

SEQ ID NO: 644451 - RNA, 24 nt, Human
ugacgagggaaggagggagggaga

SEQ ID NO: 644452 - RNA, 18 nt, Human
ugcauuaaaaagucauca

SEQ ID NO: 644453 - RNA, 25 nt, Human
ugccaaauaaugaaacuacuauuuu

SEQ ID NO: 644454 - RNA, 19 nt, Human
uguagccaaaacaaaaagg

SEQ ID NO: 644455 - RNA, 21 nt, Human
uguuguuguccuuguuguugu

SEQ ID NO: 644456 - RNA, 21 nt, Human
uguuuucuaaugauaaucuua

SEQ ID NO: 644457 - RNA, 21 nt, Human
uuccacagcuaagaguucuga

SEQ ID NO: 644458 - RNA, 24 nt, Human
uuccacagcuaagaguucugaguc

SEQ ID NO: 644459 - RNA, 24 nt, Human
uuuuuuuuuuuuaauagaauuuca

SEQ ID NO: 644460 - RNA, 23 nt, Human
uuuuuuuuuuuuuuuuuuaauag

SEQ ID NO: 644461 - RNA, 20 nt, Human
acacugauguuuaaugaagu

SEQ ID NO: 644462 - RNA, 18 nt, Human
acuguauucaucaaauug

SEQ ID NO: 644463 - RNA, 18 nt, Human
caaauuauuucaccuccu

SEQ ID NO: 644464 - RNA, 21 nt, Human
caacaggcagcaccauguuua

SEQ ID NO: 644465 - RNA, 23 nt, Human
cacacaucugucaacaggcagca

SEQ ID NO: 644466 - RNA, 23 nt, Human
ccaauuggcuagaaacacacuga

SEQ ID NO: 644467 - RNA, 18 nt, Human
gcacuaccuuauuuacug

SEQ ID NO: 644468 - RNA, 18 nt, Human
uaaaagaccaccaaaggc

SEQ ID NO: 644469 - RNA, 25 nt, Human
uaaaagaccaccaaaggcuggagac

SEQ ID NO: 644470 - RNA, 22 nt, Human
ugacagugaagccuuuuccaca

SEQ ID NO: 644471 - RNA, 21 nt, Human
uuugacagugaagccuuuucc

SEQ ID NO: 644472 - RNA, 20 nt, Human
uuuuuuuuuuuccacauuaa

SEQ ID NO: 644473 - RNA, 20 nt, Human
uuuuuuuuuuuuuuuuccac

SEQ ID NO: 644474 - RNA, 18 nt, Human
aaaggaaggggggaaaag

SEQ ID NO: 644475 - RNA, 22 nt, Human
aagccaagaaaaagaccuauaa

SEQ ID NO: 644476 - RNA, 19 nt, Human
aagggacacaaagccucag

SEQ ID NO: 644477 - RNA, 26 nt, Human
acaaagccucagagaaaccgggacgu

SEQ ID NO: 644478 - RNA, 21 nt, Human
acacaaagccucagagaaacc

SEQ ID NO: 644479 - RNA, 22 nt, Human
acacaaagccucagagaaacca

SEQ ID NO: 644480 - RNA, 21 nt, Human
acagucaugaauacauaaaca

SEQ ID NO: 644481 - RNA, 23 nt, Human
accacacagucaugaauacauaa

SEQ ID NO: 644482 - RNA, 22 nt, Human
agacagacaggaguccccaagg

SEQ ID NO: 644483 - RNA, 22 nt, Human
agccaagaaaaagaccuauaag

SEQ ID NO: 644484 - RNA, 22 nt, Human
agugcagugggagucucauugg

SEQ ID NO: 644485 - RNA, 25 nt, Human
auaaaacaccauccauauggcacca

SEQ ID NO: 644486 - RNA, 18 nt, Human
augcagcuuuggacaagg

SEQ ID NO: 644487 - RNA, 21 nt, Human
caaccuccucuugaagccaag

SEQ ID NO: 644488 - RNA, 18 nt, Human
caagaaaaagaccuauaa

SEQ ID NO: 644489 - RNA, 22 nt, Human
caagaaaaagaccuauaacaau

SEQ ID NO: 644490 - RNA, 23 nt, Human
cacaaagccucagagaaaccaua

SEQ ID NO: 644491 - RNA, 28 nt, Human
cacacagucaugaauacauaaacaccac

SEQ ID NO: 644492 - RNA, 19 nt, Human
cacagcagcgagccucagc

SEQ ID NO: 644493 - RNA, 24 nt, Human
cacuugaaccacaaaaugggcccu

SEQ ID NO: 644494 - RNA, 19 nt, Human
cagcucaggggaaacaggg

SEQ ID NO: 644495 - RNA, 20 nt, Human
cagcuuuggacaagggacac

SEQ ID NO: 644496 - RNA, 20 nt, Human
caggagagccgaccauggca

SEQ ID NO: 644497 - RNA, 19 nt, Human
caggccuuguuuguaaugg

SEQ ID NO: 644498 - RNA, 23 nt, Human
cagugagaagugguguuaccauc

SEQ ID NO: 644499 - RNA, 18 nt, Human
cauggcaagcgcuucgcc

SEQ ID NO: 644500 - RNA, 20 nt, Human
ccacaaaaugggcccucacu

SEQ ID NO: 644501 - RNA, 24 nt, Human
ccagcagacuccucaaccuccucu

SEQ ID NO: 644502 - RNA, 18 nt, Human
ccaggagagccgaccaug

SEQ ID NO: 644503 - RNA, 20 nt, Human
ccaggccucagacuguucuc

SEQ ID NO: 644504 - RNA, 21 nt, Human
ccagugggucucugguccucc

SEQ ID NO: 644505 - RNA, 21 nt, Human
cccauaagugaaacaaaaugg

SEQ ID NO: 644506 - RNA, 18 nt, Human
ccccagauacuuccaagu

SEQ ID NO: 644507 - RNA, 18 nt, Human
ccccagcagcugucuagu

SEQ ID NO: 644508 - RNA, 23 nt, Human
cccucacuucuuuccuaacccag

SEQ ID NO: 644509 - RNA, 23 nt, Human
ccucaaccuccucuugaagccaa

SEQ ID NO: 644510 - RNA, 21 nt, Human
cucaggggaaacagggggaaa

SEQ ID NO: 644511 - RNA, 19 nt, Human
cuccucaaccuccucuuga

SEQ ID NO: 644512 - RNA, 23 nt, Human
cugcaguaggacuuaccugggcu

SEQ ID NO: 644513 - RNA, 27 nt, Human
cuuccuguuccugagagcagaagcugg

SEQ ID NO: 644514 - RNA, 20 nt, Human
gaaccacaaaaugggcccuc

SEQ ID NO: 644515 - RNA, 18 nt, Human
gagaaaccauaaaacacc

SEQ ID NO: 644516 - RNA, 19 nt, Human
gagccgaccauggcaagcg

SEQ ID NO: 644517 - RNA, 25 nt, Human
gcacaaccucaaguggaacccagag

SEQ ID NO: 644518 - RNA, 21 nt, Human
gccagaauuuguuaaggaagc

SEQ ID NO: 644519 - RNA, 25 nt, Human
ggaaacagggggaaaccaggagagc

SEQ ID NO: 644520 - RNA, 18 nt, Human
ggacaagggacacaaagc

SEQ ID NO: 644521 - RNA, 18 nt, Human
gugaaacaaaauggcacu

SEQ ID NO: 644522 - RNA, 18 nt, Human
gugcagugggagucucau

SEQ ID NO: 644523 - RNA, 19 nt, Human
uaaaacaccauccauaugg

SEQ ID NO: 644524 - RNA, 25 nt, Human
uaacagacagacaggaguccccaag

SEQ ID NO: 644525 - RNA, 18 nt, Human
uaacccagcuccaucuug

SEQ ID NO: 644526 - RNA, 25 nt, Human
uaauaaagacugagcucugcuacac

SEQ ID NO: 644527 - RNA, 18 nt, Human
ucaaguggaacccagagg

SEQ ID NO: 644528 - RNA, 26 nt, Human
ucacagauucucugcuggucucuaag

SEQ ID NO: 644529 - RNA, 21 nt, Human
ucacugaucaauuuguuaugc

SEQ ID NO: 644530 - RNA, 23 nt, Human
ucccaaaacuggauuuaaaaaaa

SEQ ID NO: 644531 - RNA, 26 nt, Human
ucccacagcugauugcagacauugcc

SEQ ID NO: 644532 - RNA, 24 nt, Human
uccucuugaagccaagaaaaagac

SEQ ID NO: 644533 - RNA, 24 nt, Human
ucgcaccccagauacuuccaagug

SEQ ID NO: 644534 - RNA, 22 nt, Human
ucuauggcugaaacaauuuauc

SEQ ID NO: 644535 - RNA, 22 nt, Human
ucucucacagauucucugcugg

SEQ ID NO: 644536 - RNA, 22 nt, Human
ugagagcagaagccaguggguc

SEQ ID NO: 644537 - RNA, 18 nt, Human
ugagugcagugggagucu

SEQ ID NO: 644538 - RNA, 21 nt, Human
ugagugcagugggagucucau

SEQ ID NO: 644539 - RNA, 22 nt, Human
ugagugcagugggagucucauu

SEQ ID NO: 644540 - RNA, 18 nt, Human
ugauugcagacauugccu

SEQ ID NO: 644541 - RNA, 22 nt, Human
ugccugugcuuccuaccccagc

SEQ ID NO: 644542 - RNA, 19 nt, Human
ugcuacacagcagcgagcc

SEQ ID NO: 644543 - RNA, 19 nt, Human
ugcuuccuaccccagcagc

SEQ ID NO: 644544 - RNA, 20 nt, Human
uggauuuaaaaaaaaaaaaa

SEQ ID NO: 644545 - RNA, 20 nt, Human
uggcaagcgcuucgccugag

SEQ ID NO: 644546 - RNA, 21 nt, Human
uggcaagcgcuucgccugagu

SEQ ID NO: 644547 - RNA, 21 nt, Human
ugggucucugguccuccuugg

SEQ ID NO: 644548 - RNA, 23 nt, Human
uuaaaggaaggggggaaaaggaa

SEQ ID NO: 644549 - RNA, 18 nt, Human
uuauuucagggacacuca

SEQ ID NO: 644550 - RNA, 22 nt, Human
uugaaauuucauucaaaauuuu

SEQ ID NO: 644551 - RNA, 18 nt, Human
uuuaaaggaaggggggaa

SEQ ID NO: 644552 - RNA, 18 nt, Human
uuuaagaguaccuggacc

SEQ ID NO: 644553 - RNA, 18 nt, Human
uuuuuuuuuuuuuuuccg

SEQ ID NO: 644554 - RNA, 23 nt, Human
uuuuuuuuuuuuuuuuuccguuu

SEQ ID NO: 644555 - RNA, 23 nt, Human
accacaugcagaugcuccuggca

SEQ ID NO: 644556 - RNA, 20 nt, Human
auauaagaaauaucaacuga

SEQ ID NO: 644557 - RNA, 21 nt, Human
augugccacaaguccaugugu

SEQ ID NO: 644558 - RNA, 27 nt, Human
caagccgagcaccucucggccagcgcc

SEQ ID NO: 644559 - RNA, 23 nt, Human
cacccggaacagauuuuuuccuc

SEQ ID NO: 644560 - RNA, 20 nt, Human
cagaaaaugccguuaacuua

SEQ ID NO: 644561 - RNA, 23 nt, Human
cagauuacaccauuuucacuguc

SEQ ID NO: 644562 - RNA, 22 nt, Human
cagcccaggacaagcagagagc

SEQ ID NO: 644563 - RNA, 21 nt, Human
caggacaagcagagagcaaac

SEQ ID NO: 644564 - RNA, 22 nt, Human
caggacaagcagagagcaaacc

SEQ ID NO: 644565 - RNA, 20 nt, Human
caguguggucccuggugucu

SEQ ID NO: 644566 - RNA, 19 nt, Human
cauggcacuagggcaccuu

SEQ ID NO: 644567 - RNA, 23 nt, Human
caugugccacaaguccaugugug

SEQ ID NO: 644568 - RNA, 20 nt, Human
ccuuugagggggaggaagag

SEQ ID NO: 644569 - RNA, 24 nt, Human
cgucauggacaccucagcccagga

SEQ ID NO: 644570 - RNA, 22 nt, Human
cuuugagggggaggaagaggug

SEQ ID NO: 644571 - RNA, 20 nt, Human
gaggaaaagaacaucuuaac

SEQ ID NO: 644572 - RNA, 20 nt, Human
gaggaagaggugguaaagaa

SEQ ID NO: 644573 - RNA, 20 nt, Human
gccagcgcccucgccaggac

SEQ ID NO: 644574 - RNA, 21 nt, Human
gcuggagugcgggaccugcua

SEQ ID NO: 644575 - RNA, 20 nt, Human
ggaaaagagaaguaccacau

SEQ ID NO: 644576 - RNA, 23 nt, Human
ggaugaaauguuuuuccuuugag

SEQ ID NO: 644577 - RNA, 19 nt, Human
gggaacuguaucugcaggu

SEQ ID NO: 644578 - RNA, 18 nt, Human
ggggaggaagagguggua

SEQ ID NO: 644579 - RNA, 21 nt, Human
gggggaacuguaucugcaggu

SEQ ID NO: 644580 - RNA, 19 nt, Human
uagggcaccuuugaggaaa

SEQ ID NO: 644581 - RNA, 24 nt, Human
ucugugcgcacauuuccaugugcc

SEQ ID NO: 644582 - RNA, 20 nt, Human
ugagggggaggaagaggugg

SEQ ID NO: 644583 - RNA, 21 nt, Human
ugagggggaggaagagguggu

SEQ ID NO: 644584 - RNA, 22 nt, Human
uggcagcgagaggcuggagugc

SEQ ID NO: 644585 - RNA, 21 nt, Human
uggucugaaacccaaccucag

SEQ ID NO: 644586 - RNA, 19 nt, Human
ugugccacaaguccaugug

SEQ ID NO: 644587 - RNA, 23 nt, Human
uuuggcaaggaagaaugccuucc

SEQ ID NO: 644588 - RNA, 20 nt, Human
acugaaauauuuauuucuga

SEQ ID NO: 644589 - RNA, 18 nt, Human
cucaaaauaggaauaaga

SEQ ID NO: 644590 - RNA, 24 nt, Human
uuuaggccaaguuuuacaauucac

SEQ ID NO: 644591 - RNA, 25 nt, Human
uuucugagaaacaacucaaauaauu

SEQ ID NO: 644592 - RNA, 24 nt, Human
uuuuuuuuuuuuuucacauguuuu

SEQ ID NO: 644593 - RNA, 24 nt, Human
uuuuuuuuuuuuuuuucacaugau

SEQ ID NO: 644594 - RNA, 20 nt, Human
uuuuuuuuuuuuuuuuucac

SEQ ID NO: 644595 - RNA, 21 nt, Human
uuuuuuuuuuuuuuuuucaca

SEQ ID NO: 644596 - RNA, 22 nt, Human
aacaacacagacacuggugccu

SEQ ID NO: 644597 - RNA, 27 nt, Human
aacacagacacuggugccugaaagccc

SEQ ID NO: 644598 - RNA, 25 nt, Human
aagcauuuuaguaaggucugagauc

SEQ ID NO: 644599 - RNA, 22 nt, Human
accucaugauccauucacuccc

SEQ ID NO: 644600 - RNA, 23 nt, Human
accuccuugcccuacccccacug

SEQ ID NO: 644601 - RNA, 19 nt, Human
accugugagguaccuccuu

SEQ ID NO: 644602 - RNA, 22 nt, Human
agaaaacagucccuuugugcca

SEQ ID NO: 644603 - RNA, 24 nt, Human
agaaagcauuuuaguaaggucugg

SEQ ID NO: 644604 - RNA, 25 nt, Human
agaagagaguggguaagugaauggc

SEQ ID NO: 644605 - RNA, 22 nt, Human
agaaggcuugagggggcucugg

SEQ ID NO: 644606 - RNA, 22 nt, Human
agaauucuggcugccucuacuu

SEQ ID NO: 644607 - RNA, 25 nt, Human
agacuggagcccaacagauuaaggc

SEQ ID NO: 644608 - RNA, 22 nt, Human
agagauccaguugcucuaccuu

SEQ ID NO: 644609 - RNA, 18 nt, Human
agaguaagaaaacagucc

SEQ ID NO: 644610 - RNA, 21 nt, Human
agcuccagggucuugagcagc

SEQ ID NO: 644611 - RNA, 18 nt, Human
aggcagaauucuccuugc

SEQ ID NO: 644612 - RNA, 21 nt, Human
aggccucaagccuagcagcuc

SEQ ID NO: 644613 - RNA, 21 nt, Human
agggaccacacacucuaccuu

SEQ ID NO: 644614 - RNA, 20 nt, Human
aggucugcgggaagggggug

SEQ ID NO: 644615 - RNA, 22 nt, Human
aucuacaggaggaagccccagc

SEQ ID NO: 644616 - RNA, 19 nt, Human
auggggccaucccaccuca

SEQ ID NO: 644617 - RNA, 20 nt, Human
auuuuaguaaggucugagau

SEQ ID NO: 644618 - RNA, 21 nt, Human
caacaaggaggccugucccuu

SEQ ID NO: 644619 - RNA, 19 nt, Human
caacacagacacuggugcc

SEQ ID NO: 644620 - RNA, 23 nt, Human
cacagcuaagcccaggagcuucc

SEQ ID NO: 644621 - RNA, 21 nt, Human
cacccuggccaaguacagcuc

SEQ ID NO: 644622 - RNA, 24 nt, Human
caccucaugauccauucacuccca

SEQ ID NO: 644623 - RNA, 24 nt, Human
cacucagacuaagaguaagaaaac

SEQ ID NO: 644624 - RNA, 20 nt, Human
cagaaacucaucauggggca

SEQ ID NO: 644625 - RNA, 21 nt, Human
cagaaacuccagagggggccu

SEQ ID NO: 644626 - RNA, 21 nt, Human
cagcucagccuuuaagccucc

SEQ ID NO: 644627 - RNA, 21 nt, Human
caggcuccugacaugaccccc

SEQ ID NO: 644628 - RNA, 18 nt, Human
caucauaaacaauggagc

SEQ ID NO: 644629 - RNA, 20 nt, Human
caugacccccugaaagcccc

SEQ ID NO: 644630 - RNA, 21 nt, Human
cccacagcuaagcccaggagc

SEQ ID NO: 644631 - RNA, 21 nt, Human
cccaccucaugauccauucac

SEQ ID NO: 644632 - RNA, 21 nt, Human
cccacugaggccucaggcccc

SEQ ID NO: 644633 - RNA, 23 nt, Human
cccccugucggcugcugccccug

SEQ ID NO: 644634 - RNA, 27 nt, Human
ccccugaaagccccugcagcucagccu

SEQ ID NO: 644635 - RNA, 19 nt, Human
cccugcugcugccagggag

SEQ ID NO: 644636 - RNA, 21 nt, Human
cccugcugcugccagggaguc

SEQ ID NO: 644637 - RNA, 19 nt, Human
ccucaugauccauucacuc

SEQ ID NO: 644638 - RNA, 20 nt, Human
ccucugaggucuucgaagcc

SEQ ID NO: 644639 - RNA, 22 nt, Human
ccucugaguucuaacaacacag

SEQ ID NO: 644640 - RNA, 22 nt, Human
ccugccucuuccucugaguucu

SEQ ID NO: 644641 - RNA, 21 nt, Human
cucaugauccauucacuccca

SEQ ID NO: 644642 - RNA, 21 nt, Human
cuccugacaugacccccugaa

SEQ ID NO: 644643 - RNA, 20 nt, Human
cugaaagccccugcagcuca

SEQ ID NO: 644644 - RNA, 18 nt, Human
cugaaagcccugcugcug

SEQ ID NO: 644645 - RNA, 21 nt, Human
cugaaagcccugcugcugcca

SEQ ID NO: 644646 - RNA, 23 nt, Human
gaauggccagaaacuccagaggg

SEQ ID NO: 644647 - RNA, 20 nt, Human
gacuaagaguaagaaaacag

SEQ ID NO: 644648 - RNA, 19 nt, Human
gagaaagugaaggagccuc

SEQ ID NO: 644649 - RNA, 19 nt, Human
gagacagcaaggggugugg

SEQ ID NO: 644650 - RNA, 19 nt, Human
gagcagccgugagagacac

SEQ ID NO: 644651 - RNA, 19 nt, Human
gccaauacuuccaacucug

SEQ ID NO: 644652 - RNA, 21 nt, Human
gccagaaacuccagagggggc

SEQ ID NO: 644653 - RNA, 21 nt, Human
gccugaaagcccugcugcugc

SEQ ID NO: 644654 - RNA, 21 nt, Human
gcuccugacaugacccccuga

SEQ ID NO: 644655 - RNA, 20 nt, Human
ggccagaaacucaucauggg

SEQ ID NO: 644656 - RNA, 22 nt, Human
ggccagaaacuccagagggggc

SEQ ID NO: 644657 - RNA, 21 nt, Human
ggcccagaaagcauuuuagua

SEQ ID NO: 644658 - RNA, 19 nt, Human
ggcucugggugacacaaca

SEQ ID NO: 644659 - RNA, 26 nt, Human
ggcugcugccccugccucuuccucug

SEQ ID NO: 644660 - RNA, 18 nt, Human
gggaguacccccaacccc

SEQ ID NO: 644661 - RNA, 22 nt, Human
gggcuaggauggagcagccgug

SEQ ID NO: 644662 - RNA, 18 nt, Human
gucccuuugacacccugg

SEQ ID NO: 644663 - RNA, 19 nt, Human
gugccugaaagcccugcug

SEQ ID NO: 644664 - RNA, 22 nt, Human
uaaaagagcuuucccggcacga

SEQ ID NO: 644665 - RNA, 21 nt, Human
uaagaaaacagucccuuugug

SEQ ID NO: 644666 - RNA, 21 nt, Human
uaagugaauggccagaaacuc

SEQ ID NO: 644667 - RNA, 24 nt, Human
uaggcuagggagccagcuacagcc

SEQ ID NO: 644668 - RNA, 21 nt, Human
uaugaauuuccuccuucccuc

SEQ ID NO: 644669 - RNA, 20 nt, Human
uccaucauaaacaauggagc

SEQ ID NO: 644670 - RNA, 26 nt, Human
uccaucauaaacaauggagcgggggu

SEQ ID NO: 644671 - RNA, 19 nt, Human
ucccacagcuaagcccagg

SEQ ID NO: 644672 - RNA, 21 nt, Human
ucuccuugcucuggaggcagg

SEQ ID NO: 644673 - RNA, 22 nt, Human
ucuuuuauuugaaaacugcugg

SEQ ID NO: 644674 - RNA, 21 nt, Human
ugaaagccccugcagcucagc

SEQ ID NO: 644675 - RNA, 18 nt, Human
ugaaggagccucagaugg

SEQ ID NO: 644676 - RNA, 18 nt, Human
ugaaggugagauccuuga

SEQ ID NO: 644677 - RNA, 22 nt, Human
ugaagucuagcugccccucaug

SEQ ID NO: 644678 - RNA, 21 nt, Human
ugacacaacagucaaggccuc

SEQ ID NO: 644679 - RNA, 20 nt, Human
ugacccccugaaagccccuu

SEQ ID NO: 644680 - RNA, 25 nt, Human
ugagacagcaagggguguggccugg

SEQ ID NO: 644681 - RNA, 25 nt, Human
ugagagacaccuagccaaauguccg

SEQ ID NO: 644682 - RNA, 18 nt, Human
ugaggguacuuggcuucc

SEQ ID NO: 644683 - RNA, 21 nt, Human
ugaggucuucgaagccucagc

SEQ ID NO: 644684 - RNA, 21 nt, Human
ugccggugaggguacuuggcu

SEQ ID NO: 644685 - RNA, 20 nt, Human
ugcugcugccagggagucag

SEQ ID NO: 644686 - RNA, 22 nt, Human
uggccaauacuuccaacucugc

SEQ ID NO: 644687 - RNA, 22 nt, Human
uggccagaaacuccagaggggg

SEQ ID NO: 644688 - RNA, 22 nt, Human
uggccaggcuccugacaugacc

SEQ ID NO: 644689 - RNA, 18 nt, Human
uggccuggccaggcuccu

SEQ ID NO: 644690 - RNA, 21 nt, Human
uggggccaucccaccucauga

SEQ ID NO: 644691 - RNA, 19 nt, Human
uggguaagugaauggccag

SEQ ID NO: 644692 - RNA, 19 nt, Human
ugugggggcuaggauggag

SEQ ID NO: 644693 - RNA, 22 nt, Human
uuaguaaggucugagaucagaa

SEQ ID NO: 644694 - RNA, 21 nt, Human
uucaugugagcuuuguccuug

SEQ ID NO: 644695 - RNA, 23 nt, Human
uugugggggcuaggauggagcag

SEQ ID NO: 644696 - RNA, 20 nt, Human
acacagagggacucacugga

SEQ ID NO: 644697 - RNA, 21 nt, Human
acccaauuaaaguuuauuacu

SEQ ID NO: 644698 - RNA, 21 nt, Human
acucacuggaaguugcaguuc

SEQ ID NO: 644699 - RNA, 20 nt, Human
agaaaaauaguccaggugau

SEQ ID NO: 644700 - RNA, 18 nt, Human
aggcaggagcgaaugagg

SEQ ID NO: 644701 - RNA, 21 nt, Human
aggcaggagcgaaugagggcc

SEQ ID NO: 644702 - RNA, 18 nt, Human
augugcagggguggggca

SEQ ID NO: 644703 - RNA, 18 nt, Human
caagugaaagggaaaauc

SEQ ID NO: 644704 - RNA, 21 nt, Human
cacacagagggacucacugga

SEQ ID NO: 644705 - RNA, 18 nt, Human
cagggguggggcagggag

SEQ ID NO: 644706 - RNA, 18 nt, Human
cauuuagggucccaggau

SEQ ID NO: 644707 - RNA, 27 nt, Human
gugcagggguggggcagggaggucauu

SEQ ID NO: 644708 - RNA, 19 nt, Human
uaggaugggggaaaccgca

SEQ ID NO: 644709 - RNA, 23 nt, Human
uauaaaaccaucagaucucguga

SEQ ID NO: 644710 - RNA, 20 nt, Human
uauuuccaguuucuugguug

SEQ ID NO: 644711 - RNA, 20 nt, Human
ucagaaaaauaguccaggug

SEQ ID NO: 644712 - RNA, 19 nt, Human
ugagacuuacucacuacca

SEQ ID NO: 644713 - RNA, 20 nt, Human
uggggcagggaggucauuua

SEQ ID NO: 644714 - RNA, 19 nt, Human
uucuugguugcauaguccc

SEQ ID NO: 644715 - RNA, 24 nt, Human
uuuguuuuuauuuccaguuucuug

SEQ ID NO: 644716 - RNA, 26 nt, Human
acagagcuucaagggaaggggaacgc

SEQ ID NO: 644717 - RNA, 21 nt, Human
acaggcugaagccccucacgc

SEQ ID NO: 644718 - RNA, 21 nt, Human
agaacccgucuugcucugccu

SEQ ID NO: 644719 - RNA, 18 nt, Human
agacaggccuggugggga

SEQ ID NO: 644720 - RNA, 21 nt, Human
agggccaacggaacaggcucu

SEQ ID NO: 644721 - RNA, 21 nt, Human
auuuugggggaagcccugggg

SEQ ID NO: 644722 - RNA, 21 nt, Human
caaccccgggacaggcugaag

SEQ ID NO: 644723 - RNA, 24 nt, Human
caacggaacaggcucugggaccuc

SEQ ID NO: 644724 - RNA, 19 nt, Human
caccccaccugggcagagc

SEQ ID NO: 644725 - RNA, 19 nt, Human
caccccccccugccagggu

SEQ ID NO: 644726 - RNA, 24 nt, Human
caccccccccugccaggguccaca

SEQ ID NO: 644727 - RNA, 24 nt, Human
caccugggcagagccagugggaac

SEQ ID NO: 644728 - RNA, 20 nt, Human
cagaauuuugggggaagccc

SEQ ID NO: 644729 - RNA, 19 nt, Human
cagcagcagcaagggcagc

SEQ ID NO: 644730 - RNA, 22 nt, Human
cagcagcagcaagggcagcacc

SEQ ID NO: 644731 - RNA, 22 nt, Human
cagccucguaacgguaaccccu

SEQ ID NO: 644732 - RNA, 22 nt, Human
caggggccuggcaccccccccu

SEQ ID NO: 644733 - RNA, 20 nt, Human
caggggugagaacccgucuu

SEQ ID NO: 644734 - RNA, 22 nt, Human
caggguccacacgcaggguugu

SEQ ID NO: 644735 - RNA, 19 nt, Human
cagguccagcucuguuucc

SEQ ID NO: 644736 - RNA, 19 nt, Human
ccaccccaccccaccuggg

SEQ ID NO: 644737 - RNA, 19 nt, Human
ccaccccugcagguccagc

SEQ ID NO: 644738 - RNA, 26 nt, Human
ccagcucuguuucccaccuuuugcca

SEQ ID NO: 644739 - RNA, 19 nt, Human
cccagaggcacccaacugg

SEQ ID NO: 644740 - RNA, 21 nt, Human
ccccccccugccaggguccac

SEQ ID NO: 644741 - RNA, 22 nt, Human
ccccugcuuuccaggggccugg

SEQ ID NO: 644742 - RNA, 18 nt, Human
ccccugggaguccugguc

SEQ ID NO: 644743 - RNA, 21 nt, Human
ccuccagaagucaggggugag

SEQ ID NO: 644744 - RNA, 24 nt, Human
ccuccagaagucaggggugagaac

SEQ ID NO: 644745 - RNA, 20 nt, Human
ccuggcaccccccccugcca

SEQ ID NO: 644746 - RNA, 22 nt, Human
ccugugggccucggcccagggc

SEQ ID NO: 644747 - RNA, 22 nt, Human
cgaccagcagcagcaagggcag

SEQ ID NO: 644748 - RNA, 22 nt, Human
cggcccagggccaacggaacag

SEQ ID NO: 644749 - RNA, 24 nt, Human
cgggaccaccccugcagguccagc

SEQ ID NO: 644750 - RNA, 18 nt, Human
cucugccucaggcaaccc

SEQ ID NO: 644751 - RNA, 21 nt, Human
cucugccucaggcaaccccgg

SEQ ID NO: 644752 - RNA, 18 nt, Human
cugcagcucacucagaau

SEQ ID NO: 644753 - RNA, 18 nt, Human
cuguuucccaccuuuugc

SEQ ID NO: 644754 - RNA, 20 nt, Human
cuucguacuuggcuugcccc

SEQ ID NO: 644755 - RNA, 21 nt, Human
cuuuccaggggccuggcaccc

SEQ ID NO: 644756 - RNA, 18 nt, Human
gaagccccucacgcacuu

SEQ ID NO: 644757 - RNA, 19 nt, Human
gaccuggcugggggaugau

SEQ ID NO: 644758 - RNA, 20 nt, Human
gcaaccccgggacaggcuga

SEQ ID NO: 644759 - RNA, 18 nt, Human
gcaccccccccugccagg

SEQ ID NO: 644760 - RNA, 18 nt, Human
gccaggguccacacgcag

SEQ ID NO: 644761 - RNA, 21 nt, Human
gcccccugggaguccuggucc

SEQ ID NO: 644762 - RNA, 21 nt, Human
gccugguggggaccuggcugg

SEQ ID NO: 644763 - RNA, 18 nt, Human
gcggcugcggguccuggc

SEQ ID NO: 644764 - RNA, 22 nt, Human
ggcagcaccugugggccucggc

SEQ ID NO: 644765 - RNA, 21 nt, Human
ggccugguggggaccuggcug

SEQ ID NO: 644766 - RNA, 24 nt, Human
gggucccagcacacccugcagcuc

SEQ ID NO: 644767 - RNA, 21 nt, Human
guccagcucuguuucccaccu

SEQ ID NO: 644768 - RNA, 25 nt, Human
uccacacgcaggguuguggcgggac

SEQ ID NO: 644769 - RNA, 22 nt, Human
uccaggggccuggcaccccccc

SEQ ID NO: 644770 - RNA, 24 nt, Human
ugccccggaccacagccucguaac

SEQ ID NO: 644771 - RNA, 21 nt, Human
uggcuaguccuagcuccuacu

SEQ ID NO: 644772 - RNA, 22 nt, Human
ugggaacccagaggcacccaac

SEQ ID NO: 644773 - RNA, 18 nt, Human
ugggagacaggccuggug

SEQ ID NO: 644774 - RNA, 19 nt, Human
ugggcagagccagugggaa

SEQ ID NO: 644775 - RNA, 21 nt, Human
ugggccucggcccagggccaa

SEQ ID NO: 644776 - RNA, 23 nt, Human
uggggcaugugguucugcuguca

SEQ ID NO: 644777 - RNA, 25 nt, Human
ugggggaagcccuggggucuugggg

SEQ ID NO: 644778 - RNA, 23 nt, Human
ugguggggaccuggcugggggau

SEQ ID NO: 644779 - RNA, 19 nt, Human
uuucccaccuuuugcacag

SEQ ID NO: 644780 - RNA, 21 nt, Human
uuuuuuuuuuuuaggaggggu

SEQ ID NO: 644781 - RNA, 23 nt, Human
uuuuuuuuuuuuuuuuaggaggg

SEQ ID NO: 644782 - RNA, 23 nt, Human
uuuuuuuuuuuuuuuuuuuuagg

SEQ ID NO: 644783 - RNA, 24 nt, Human
aaaaaaacaaacaaaaaacacugg

SEQ ID NO: 644784 - RNA, 27 nt, Human
aaaaaacaaacaaaaaacacuggccca

SEQ ID NO: 644785 - RNA, 22 nt, Human
aaaaauucuuuuuauagcuguc

SEQ ID NO: 644786 - RNA, 24 nt, Human
aaaacaaacaaaaaacacuggccc

SEQ ID NO: 644787 - RNA, 19 nt, Human
aaacaaaaaacacuggccc

SEQ ID NO: 644788 - RNA, 22 nt, Human
aaacagauauagagauauuuac

SEQ ID NO: 644789 - RNA, 22 nt, Human
aaacugcaccaaaaaaacaaac

SEQ ID NO: 644790 - RNA, 25 nt, Human
aaacugcaccaaaaaaacaaacaaa

SEQ ID NO: 644791 - RNA, 19 nt, Human
aacauggcgaaaccucauc

SEQ ID NO: 644792 - RNA, 20 nt, Human
aacauggcgaaaccucaucu

SEQ ID NO: 644793 - RNA, 21 nt, Human
aacauggcgaaaccucaucuc

SEQ ID NO: 644794 - RNA, 24 nt, Human
aaucacuugaaccugggaggcgga

SEQ ID NO: 644795 - RNA, 20 nt, Human
acagauguaguaccugaaaa

SEQ ID NO: 644796 - RNA, 27 nt, Human
accaaaaaaacaaacaaaaaacacugg

SEQ ID NO: 644797 - RNA, 19 nt, Human
accacagcuauccuuugcu

SEQ ID NO: 644798 - RNA, 22 nt, Human
accucaucucuauuaaaaauaa

SEQ ID NO: 644799 - RNA, 20 nt, Human
acuacuuccuccauucaagu

SEQ ID NO: 644800 - RNA, 19 nt, Human
acuccaaaucaguguuuga

SEQ ID NO: 644801 - RNA, 18 nt, Human
acuggcccaaauccuaau

SEQ ID NO: 644802 - RNA, 26 nt, Human
agaaaaagacaauguucacugaagaa

SEQ ID NO: 644803 - RNA, 24 nt, Human
agaggcucacgccuguaauccuag

SEQ ID NO: 644804 - RNA, 23 nt, Human
agcacuuugggaggccgaggugg

SEQ ID NO: 644805 - RNA, 23 nt, Human
agccaugugugguguugcaugcc

SEQ ID NO: 644806 - RNA, 18 nt, Human
agccuggaaaacauggcg

SEQ ID NO: 644807 - RNA, 22 nt, Human
aggcaggagaaucacuugaacc

SEQ ID NO: 644808 - RNA, 24 nt, Human
aggcaggagaaucacuugaaccug

SEQ ID NO: 644809 - RNA, 21 nt, Human
aggccgagguggauggaucac

SEQ ID NO: 644810 - RNA, 19 nt, Human
aggcggagguugcagugag

SEQ ID NO: 644811 - RNA, 20 nt, Human
aggcggagguugcagugagc

SEQ ID NO: 644812 - RNA, 22 nt, Human
aggcggagguugcagugagcug

SEQ ID NO: 644813 - RNA, 24 nt, Human
aggcugaggcaggagaaucacuug

SEQ ID NO: 644814 - RNA, 19 nt, Human
agggaaacugcugucuaca

SEQ ID NO: 644815 - RNA, 21 nt, Human
aggucagagguucaagaucag

SEQ ID NO: 644816 - RNA, 24 nt, Human
aggugcagaggcucacgccuguaa

SEQ ID NO: 644817 - RNA, 22 nt, Human
agguggauggaucaccugaggu

SEQ ID NO: 644818 - RNA, 18 nt, Human
aguaaauucacaaacaua

SEQ ID NO: 644819 - RNA, 22 nt, Human
caaaaucugacucaacacccac

SEQ ID NO: 644820 - RNA, 28 nt, Human
caaacaaaaaacacuggcccaaauccua

SEQ ID NO: 644821 - RNA, 18 nt, Human
caacacccacugcccauc

SEQ ID NO: 644822 - RNA, 18 nt, Human
caaccacagcuauccuuu

SEQ ID NO: 644823 - RNA, 21 nt, Human
caccaaaaaaacaaacaaaaa

SEQ ID NO: 644824 - RNA, 22 nt, Human
caccaaaaaaacaaacaaaaaa

SEQ ID NO: 644825 - RNA, 22 nt, Human
cacccuaaccguacacauccaa

SEQ ID NO: 644826 - RNA, 24 nt, Human
cacgccuguaauccuagcacuuug

SEQ ID NO: 644827 - RNA, 21 nt, Human
cacuugaaccugggaggcgga

SEQ ID NO: 644828 - RNA, 26 nt, Human
cagaaaaagacaauguucacugaaga

SEQ ID NO: 644829 - RNA, 22 nt, Human
cagacaucgacugggcuuccaa

SEQ ID NO: 644830 - RNA, 22 nt, Human
cagacaucgacugggcuuccaa

SEQ ID NO: 644831 - RNA, 24 nt, Human
cagcuaccugggaggcugaggcag

SEQ ID NO: 644832 - RNA, 19 nt, Human
caggaaaaaaugcaaccac

SEQ ID NO: 644833 - RNA, 19 nt, Human
caguguuugagauuuauua

SEQ ID NO: 644834 - RNA, 24 nt, Human
caugccuguaaucccagcuaccug

SEQ ID NO: 644835 - RNA, 23 nt, Human
ccaaaaaaacaaacaaaaaacac

SEQ ID NO: 644836 - RNA, 19 nt, Human
ccacugcccauccauuuuc

SEQ ID NO: 644837 - RNA, 24 nt, Human
ccacugcccauccauuuucucucu

SEQ ID NO: 644838 - RNA, 23 nt, Human
ccagacauuuugguccacauaac

SEQ ID NO: 644839 - RNA, 24 nt, Human
ccaguaaaaucagaaucauuaaaa

SEQ ID NO: 644840 - RNA, 23 nt, Human
ccauccauuuucucucugacugc

SEQ ID NO: 644841 - RNA, 25 nt, Human
ccccucaugagcagaaggcaaaagu

SEQ ID NO: 644842 - RNA, 23 nt, Human
cccuaaccguacacauccaaagg

SEQ ID NO: 644843 - RNA, 27 nt, Human
ccgagguggauggaucaccugagguca

SEQ ID NO: 644844 - RNA, 24 nt, Human
ccuagccaggugcagaggcucacg

SEQ ID NO: 644845 - RNA, 20 nt, Human
ccucaugagcagaaggcaaa

SEQ ID NO: 644846 - RNA, 19 nt, Human
ccugggaggcggagguugc

SEQ ID NO: 644847 - RNA, 18 nt, Human
ccuguaaucccagcuacc

SEQ ID NO: 644848 - RNA, 21 nt, Human
ccuguaaucccagcuaccugg

SEQ ID NO: 644849 - RNA, 22 nt, Human
ccuguaauccuagcacuuuggg

SEQ ID NO: 644850 - RNA, 20 nt, Human
cgagguggauggaucaccug

SEQ ID NO: 644851 - RNA, 24 nt, Human
cgagguggauggaucaccugaggu

SEQ ID NO: 644852 - RNA, 18 nt, Human
cgccuguaauccuagcac

SEQ ID NO: 644853 - RNA, 23 nt, Human
cgccuguaauccuagcacuuugg

SEQ ID NO: 644854 - RNA, 24 nt, Human
cucacgccuguaauccuagcacuu

SEQ ID NO: 644855 - RNA, 22 nt, Human
cugacucaacacccacugccca

SEQ ID NO: 644856 - RNA, 25 nt, Human
cugggaggcugaggcaggagaauca

SEQ ID NO: 644857 - RNA, 24 nt, Human
gaauuugaggaggguuaaaaacac

SEQ ID NO: 644858 - RNA, 23 nt, Human
gagaaucacuugaaccugggagg

SEQ ID NO: 644859 - RNA, 24 nt, Human
gaucaccugaggucagagguucaa

SEQ ID NO: 644860 - RNA, 20 nt, Human
gcaccaaaaaaacaaacaaa

SEQ ID NO: 644861 - RNA, 24 nt, Human
gcaccaaaaaaacaaacaaaaaac

SEQ ID NO: 644862 - RNA, 23 nt, Human
gcaggagaaucacuugaaccugg

SEQ ID NO: 644863 - RNA, 18 nt, Human
gcaugccuguaaucccag

SEQ ID NO: 644864 - RNA, 24 nt, Human
gccaggugcagaggcucacgccug

SEQ ID NO: 644865 - RNA, 19 nt, Human
ggaaacugcugucuacaaa

SEQ ID NO: 644866 - RNA, 18 nt, Human
ggagguugcagugagcug

SEQ ID NO: 644867 - RNA, 20 nt, Human
ggagguugcagugagcuggc

SEQ ID NO: 644868 - RNA, 18 nt, Human
ggccgagguggauggauc

SEQ ID NO: 644869 - RNA, 18 nt, Human
ggcucacgccuguaaucc

SEQ ID NO: 644870 - RNA, 18 nt, Human
ggcucacgccuguaaucc

SEQ ID NO: 644871 - RNA, 23 nt, Human
ggcucacgccuguaauccuagca

SEQ ID NO: 644872 - RNA, 19 nt, Human
guguaucaguugugugcag

SEQ ID NO: 644873 - RNA, 23 nt, Human
guguugcaugccuguaaucccag

SEQ ID NO: 644874 - RNA, 21 nt, Human
guugcagugagcugaaacugc

SEQ ID NO: 644875 - RNA, 21 nt, Human
uaaaaauaaaaaaauuagcca

SEQ ID NO: 644876 - RNA, 22 nt, Human
uaaaaauaaaaaaauuagccau

SEQ ID NO: 644877 - RNA, 24 nt, Human
uaaauccuugacuaacaagaucaa

SEQ ID NO: 644878 - RNA, 24 nt, Human
uaaauccuugacuaacaagaucaa

SEQ ID NO: 644879 - RNA, 23 nt, Human
uaagaaagccaguaaaaucagaa

SEQ ID NO: 644880 - RNA, 21 nt, Human
uaauuuuggaaaaccuuccuc

SEQ ID NO: 644881 - RNA, 21 nt, Human
uaccagacauuuugguccaca

SEQ ID NO: 644882 - RNA, 22 nt, Human
uagaaaaaaaaauuuacucuga

SEQ ID NO: 644883 - RNA, 24 nt, Human
uagcacuuugggaggccgaggugg

SEQ ID NO: 644884 - RNA, 23 nt, Human
ucacaaacauaaaucaugguuaa

SEQ ID NO: 644885 - RNA, 19 nt, Human
ucacuuccagauuaaagau

SEQ ID NO: 644886 - RNA, 24 nt, Human
ucacuugaaccugggaggcggagg

SEQ ID NO: 644887 - RNA, 25 nt, Human
ucacuugaaccugggaggcggaggu

SEQ ID NO: 644888 - RNA, 19 nt, Human
ucauccuggauuucaguua

SEQ ID NO: 644889 - RNA, 18 nt, Human
uccaaaauggaauuugag

SEQ ID NO: 644890 - RNA, 23 nt, Human
uccaaaggagagugaaggacaga

SEQ ID NO: 644891 - RNA, 24 nt, Human
uccacaguaagaaagccaguaaaa

SEQ ID NO: 644892 - RNA, 19 nt, Human
uccacauaacagugagggu

SEQ ID NO: 644893 - RNA, 22 nt, Human
uccauucucaggaaaaaaugca

SEQ ID NO: 644894 - RNA, 22 nt, Human
ucuaaucaacagaguauucacu

SEQ ID NO: 644895 - RNA, 22 nt, Human
ucuacaaauacacuccuauuga

SEQ ID NO: 644896 - RNA, 21 nt, Human
ucugacucaacacccacugcc

SEQ ID NO: 644897 - RNA, 22 nt, Human
ucugacucaacacccacugccc

SEQ ID NO: 644898 - RNA, 19 nt, Human
ucuggcaaaaaucaaaauc

SEQ ID NO: 644899 - RNA, 26 nt, Human
ucuggcaaaaaucaaaaucugacuca

SEQ ID NO: 644900 - RNA, 21 nt, Human
ugaaaaucacuuacuccauuc

SEQ ID NO: 644901 - RNA, 24 nt, Human
ugaaccugggaggcggagguugca

SEQ ID NO: 644902 - RNA, 22 nt, Human
ugaagaaauaaacaacaaauua

SEQ ID NO: 644903 - RNA, 22 nt, Human
ugacauggaguucucaugucag

SEQ ID NO: 644904 - RNA, 23 nt, Human
ugagauacacauuaguuguaguc

SEQ ID NO: 644905 - RNA, 25 nt, Human
ugagcugaaacugcaccaaccccgg

SEQ ID NO: 644906 - RNA, 20 nt, Human
ugaggcaggagaaucacuug

SEQ ID NO: 644907 - RNA, 24 nt, Human
ugaggcaggagaaucacuugaacc

SEQ ID NO: 644908 - RNA, 25 nt, Human
ugaggcaggagaaucacuugaaccu

SEQ ID NO: 644909 - RNA, 23 nt, Human
ugaggucagagguucaagaucag

SEQ ID NO: 644910 - RNA, 21 nt, Human
ugccagaaaaagacaauguuc

SEQ ID NO: 644911 - RNA, 24 nt, Human
ugccuguaaucccagcuaccuggg

SEQ ID NO: 644912 - RNA, 21 nt, Human
uggacagugugagauacacau

SEQ ID NO: 644913 - RNA, 24 nt, Human
uggaucaccugaggucagagguuc

SEQ ID NO: 644914 - RNA, 27 nt, Human
uggauggaucaccugaggucagagguu

SEQ ID NO: 644915 - RNA, 20 nt, Human
uggcaaaaaucaaaaucuga

SEQ ID NO: 644916 - RNA, 20 nt, Human
uggcauacacugcugcuaaa

SEQ ID NO: 644917 - RNA, 20 nt, Human
uggcauacacugcugcuaaa

SEQ ID NO: 644918 - RNA, 19 nt, Human
ugggaggccgagguggaug

SEQ ID NO: 644919 - RNA, 24 nt, Human
ugggaggccgagguggauggauca

SEQ ID NO: 644920 - RNA, 29 nt, Human
ugggaggcggagguugcagugacaacggu

SEQ ID NO: 644921 - RNA, 24 nt, Human
ugggaggcggagguugcagugagc

SEQ ID NO: 644922 - RNA, 19 nt, Human
ugggaggcugaggcaggag

SEQ ID NO: 644923 - RNA, 24 nt, Human
ugggaggcugaggcaggagaauca

SEQ ID NO: 644924 - RNA, 24 nt, Human
ugguguugcaugccuguaauccca

SEQ ID NO: 644925 - RNA, 19 nt, Human
ugucuggcaaaaaucaaaa

SEQ ID NO: 644926 - RNA, 25 nt, Human
uguguuaccuuuugucacuuccaga

SEQ ID NO: 644927 - RNA, 24 nt, Human
uuccaaacagauauagagauauuu

SEQ ID NO: 644928 - RNA, 19 nt, Human
uucuaaguaguucugcuua

SEQ ID NO: 644929 - RNA, 24 nt, Human
uugaaccugggaggcggagguugc

SEQ ID NO: 644930 - RNA, 23 nt, Human
uugacuaacaagaucaagauaug

SEQ ID NO: 644931 - RNA, 23 nt, Human
uugacuaacaagaucaagauaug

SEQ ID NO: 644932 - RNA, 22 nt, Human
uugcagugagcugaaacugcac

SEQ ID NO: 644933 - RNA, 25 nt, Human
uugggaggccgagguggauggauca

SEQ ID NO: 644934 - RNA, 18 nt, Human
uuucaaacaucgucaccc

SEQ ID NO: 644935 - RNA, 23 nt, Human
uuugaaaaucacuuacuccauuc

SEQ ID NO: 644936 - RNA, 25 nt, Human
uuuuuggucuugacaaucuuuaauu

SEQ ID NO: 644937 - RNA, 18 nt, Human
uuuuuuuuuuuuuuuuug

SEQ ID NO: 644938 - RNA, 18 nt, Human
uuuuuuuuuuuuuuuuug

SEQ ID NO: 644939 - RNA, 22 nt, Human
uuuuuuuuuuuuuuuuuggucu

SEQ ID NO: 644940 - RNA, 20 nt, Human
aaaaauauaauccacacuua

SEQ ID NO: 644941 - RNA, 19 nt, Human
aaggcaccuaaugcuauaa

SEQ ID NO: 644942 - RNA, 24 nt, Human
aaugaagaaaacagguaugagaaa

SEQ ID NO: 644943 - RNA, 25 nt, Human
aaugaagaaaacagguaugagaaaa

SEQ ID NO: 644944 - RNA, 20 nt, Human
acccaacuccacucggccca

SEQ ID NO: 644945 - RNA, 19 nt, Human
acuccacucggcccaggag

SEQ ID NO: 644946 - RNA, 21 nt, Human
acuuccccuuuaaaaauuugc

SEQ ID NO: 644947 - RNA, 22 nt, Human
agcauuuuaccugucagaaaua

SEQ ID NO: 644948 - RNA, 18 nt, Human
agcccggaagcgguggcg

SEQ ID NO: 644949 - RNA, 19 nt, Human
aggccccgcagccgcccag

SEQ ID NO: 644950 - RNA, 23 nt, Human
aggcucccgacaccacccaacuc

SEQ ID NO: 644951 - RNA, 22 nt, Human
auaauacaguaaauguagugua

SEQ ID NO: 644952 - RNA, 22 nt, Human
caaaacccaaaaauauaaucca

SEQ ID NO: 644953 - RNA, 23 nt, Human
cacagauuuaaaauacaaggcac

SEQ ID NO: 644954 - RNA, 25 nt, Human
cagcuccugaagccgcggugccccu

SEQ ID NO: 644955 - RNA, 21 nt, Human
ccacccaacuccacucggccc

SEQ ID NO: 644956 - RNA, 24 nt, Human
ccacccaacuccacucggcccagg

SEQ ID NO: 644957 - RNA, 22 nt, Human
cccaacuccacucggcccagga

SEQ ID NO: 644958 - RNA, 20 nt, Human
ccccagcccggaagcggugg

SEQ ID NO: 644959 - RNA, 19 nt, Human
cccccggcuugcccuccgc

SEQ ID NO: 644960 - RNA, 24 nt, Human
cccccggcuugcccuccgcgcggc

SEQ ID NO: 644961 - RNA, 21 nt, Human
ccccucagggagaggcucccg

SEQ ID NO: 644962 - RNA, 22 nt, Human
cccggccccgcccccggcuugc

SEQ ID NO: 644963 - RNA, 19 nt, Human
ccgcccagcgccacggccg

SEQ ID NO: 644964 - RNA, 21 nt, Human
ccgcccagcgccacggccgcg

SEQ ID NO: 644965 - RNA, 21 nt, Human
ccuugagauguguaaggcagg

SEQ ID NO: 644966 - RNA, 24 nt, Human
cgccacggccgcggccucggacuc

SEQ ID NO: 644967 - RNA, 23 nt, Human
cggcccaggagggcguggagcgg

SEQ ID NO: 644968 - RNA, 19 nt, Human
cucacagagcugucaccgc

SEQ ID NO: 644969 - RNA, 22 nt, Human
cuccugaagccgcggugccccu

SEQ ID NO: 644970 - RNA, 25 nt, Human
cugaaacauuuuuucuacaaaaacu

SEQ ID NO: 644971 - RNA, 21 nt, Human
cugcgcgcgggcgcguaugca

SEQ ID NO: 644972 - RNA, 23 nt, Human
cuggccccggccccgcccccggc

SEQ ID NO: 644973 - RNA, 19 nt, Human
gaagaaaacagguaugaga

SEQ ID NO: 644974 - RNA, 22 nt, Human
gaagaaaacagguaugagaaaa

SEQ ID NO: 644975 - RNA, 18 nt, Human
gaagccgcggugccccuc

SEQ ID NO: 644976 - RNA, 18 nt, Human
gaagccgcggugccccuc

SEQ ID NO: 644977 - RNA, 20 nt, Human
gagauguguaaggcagguug

SEQ ID NO: 644978 - RNA, 24 nt, Human
gaggcucccgacaccacccaacuc

SEQ ID NO: 644979 - RNA, 18 nt, Human
gcccaggagggcguggag

SEQ ID NO: 644980 - RNA, 21 nt, Human
gcgcgugggugacgucauagg

SEQ ID NO: 644981 - RNA, 20 nt, Human
gcgguggcgcgugggugacg

SEQ ID NO: 644982 - RNA, 23 nt, Human
ggagcgggugaggggaagggacg

SEQ ID NO: 644983 - RNA, 18 nt, Human
ggcccagcuccugaagcc

SEQ ID NO: 644984 - RNA, 22 nt, Human
ggccccgcccccaguccccagc

SEQ ID NO: 644985 - RNA, 19 nt, Human
guaaauguaguguaaguga

SEQ ID NO: 644986 - RNA, 28 nt, Human
uaaaagaauaauacaguaaauguagugg

SEQ ID NO: 644987 - RNA, 20 nt, Human
uaaguuuacagcaauauagc

SEQ ID NO: 644988 - RNA, 23 nt, Human
uacuuauucuuuuuaaaguccca

SEQ ID NO: 644989 - RNA, 18 nt, Human
uaguucaaaugauuucaa

SEQ ID NO: 644990 - RNA, 21 nt, Human
uaguuccauuaucaagcuggg

SEQ ID NO: 644991 - RNA, 20 nt, Human
uauaacuguagugauaugua

SEQ ID NO: 644992 - RNA, 23 nt, Human
uaugaaaaugaagaaaacaggua

SEQ ID NO: 644993 - RNA, 19 nt, Human
uccacacuuauuacaggua

SEQ ID NO: 644994 - RNA, 20 nt, Human
ucccaugaaauuugcacaaa

SEQ ID NO: 644995 - RNA, 22 nt, Human
ugcucuggccccggccccgccc

SEQ ID NO: 644996 - RNA, 22 nt, Human
uggaggcccagcuccugaagcc

SEQ ID NO: 644997 - RNA, 18 nt, Human
ugguuugucacagauuua

SEQ ID NO: 644998 - RNA, 18 nt, Human
ugugaaaauaaaguccca

SEQ ID NO: 644999 - RNA, 20 nt, Human
uuaacaugugaaaauaaagu

SEQ ID NO: 645000 - RNA, 24 nt, Human
uuccauuaucaagcugggcuacag

SEQ ID NO: 645001 - RNA, 21 nt, Human
uuccuugagauguguaaggca

SEQ ID NO: 645002 - RNA, 22 nt, Human
uuuagaguuucaaagaacucaa

SEQ ID NO: 645003 - RNA, 21 nt, Human
uuuagaguuucaaagaacucc

SEQ ID NO: 645004 - RNA, 23 nt, Human
uuucuucaaaacucuaaauuaaa

SEQ ID NO: 645005 - RNA, 18 nt, Human
uuugugugguuaauuugc

SEQ ID NO: 645006 - RNA, 18 nt, Human
aaagugcugcgauuacaa

SEQ ID NO: 645007 - RNA, 24 nt, Human
aaagugcugcgauuacaagcguga

SEQ ID NO: 645008 - RNA, 18 nt, Human
aagagaaaaauacuuuuu

SEQ ID NO: 645009 - RNA, 22 nt, Human
aagcccaaauaaucaaauauaa

SEQ ID NO: 645010 - RNA, 24 nt, Human
aaggauccucuagccucagccucc

SEQ ID NO: 645011 - RNA, 23 nt, Human
aagugcuaaagguaauuacacuu

SEQ ID NO: 645012 - RNA, 18 nt, Human
aauauuuuuaaagcuguu

SEQ ID NO: 645013 - RNA, 18 nt, Human
acacuaaaaaguuacuac

SEQ ID NO: 645014 - RNA, 19 nt, Human
acugcagccucaaccuccu

SEQ ID NO: 645015 - RNA, 23 nt, Human
agacagggucucacuauguugcc

SEQ ID NO: 645016 - RNA, 21 nt, Human
agacuuucagauaagcaaucu

SEQ ID NO: 645017 - RNA, 23 nt, Human
agagaaaaauacuuuuuuuuuuu

SEQ ID NO: 645018 - RNA, 20 nt, Human
agccucaaccuccugggcuc

SEQ ID NO: 645019 - RNA, 23 nt, Human
agccucagccuccugaguagcug

SEQ ID NO: 645020 - RNA, 24 nt, Human
agccucagccuccugaguagcugg

SEQ ID NO: 645021 - RNA, 20 nt, Human
aggauccucuagccucagcc

SEQ ID NO: 645022 - RNA, 19 nt, Human
aguagagacagggucucac

SEQ ID NO: 645023 - RNA, 23 nt, Human
aucacaccucacugcagccucaa

SEQ ID NO: 645024 - RNA, 24 nt, Human
caaagugcugcgauuacaagcgug

SEQ ID NO: 645025 - RNA, 24 nt, Human
caaccuccugggcucaaggauccu

SEQ ID NO: 645026 - RNA, 24 nt, Human
caagaacacccagcagauacaggu

SEQ ID NO: 645027 - RNA, 22 nt, Human
caagugauccuccugccucagc

SEQ ID NO: 645028 - RNA, 27 nt, Human
caagugauccuccugccucagccuccc

SEQ ID NO: 645029 - RNA, 27 nt, Human
caagugauccuccugccucagccuccc

SEQ ID NO: 645030 - RNA, 22 nt, Human
caccucacugcagccucaaccu

SEQ ID NO: 645031 - RNA, 24 nt, Human
caccucacugcagccucaaccucc

SEQ ID NO: 645032 - RNA, 20 nt, Human
cacuaaaaaguuacuaccag

SEQ ID NO: 645033 - RNA, 24 nt, Human
cacuauguugccuaggcuagucuu

SEQ ID NO: 645034 - RNA, 19 nt, Human
cacugcagccucaaccucc

SEQ ID NO: 645035 - RNA, 23 nt, Human
cagccucaaccuccugggcucaa

SEQ ID NO: 645036 - RNA, 24 nt, Human
cagccucaaccuccugggcucaag

SEQ ID NO: 645037 - RNA, 19 nt, Human
cagccuccugaguagcugg

SEQ ID NO: 645038 - RNA, 24 nt, Human
cagggucucacuauguugccuagg

SEQ ID NO: 645039 - RNA, 20 nt, Human
ccaaagugcugcgauuacaa

SEQ ID NO: 645040 - RNA, 24 nt, Human
ccaaagugcugcgauuacaagcgu

SEQ ID NO: 645041 - RNA, 19 nt, Human
ccucaaccuccugggcuca

SEQ ID NO: 645042 - RNA, 23 nt, Human
ccuccugggcucaaggauccucu

SEQ ID NO: 645043 - RNA, 24 nt, Human
ccugccucagccucccaaagugcu

SEQ ID NO: 645044 - RNA, 19 nt, Human
ccugggcucaaggauccuc

SEQ ID NO: 645045 - RNA, 22 nt, Human
ccugggcucaagugauccuccu

SEQ ID NO: 645046 - RNA, 23 nt, Human
ccugggcucaagugauccuccug

SEQ ID NO: 645047 - RNA, 18 nt, Human
ccuguaacucuccucaca

SEQ ID NO: 645048 - RNA, 19 nt, Human
ccuuccuuacuuccucguc

SEQ ID NO: 645049 - RNA, 19 nt, Human
cgcucugucgcccaagcug

SEQ ID NO: 645050 - RNA, 20 nt, Human
cgcuguuuugacgacugcau

SEQ ID NO: 645051 - RNA, 22 nt, Human
cuagccucagccuccugaguag

SEQ ID NO: 645052 - RNA, 24 nt, Human
cucaagugauccuccugccucagc

SEQ ID NO: 645053 - RNA, 24 nt, Human
cucacugcagccucaaccuccugg

SEQ ID NO: 645054 - RNA, 25 nt, Human
cucuagccucagccuccugaguagc

SEQ ID NO: 645055 - RNA, 22 nt, Human
cugcagccucaaccuccugggc

SEQ ID NO: 645056 - RNA, 24 nt, Human
cugccucagccucccaaagugcug

SEQ ID NO: 645057 - RNA, 18 nt, Human
cuggaacuacaugcaugc

SEQ ID NO: 645058 - RNA, 21 nt, Human
cuguaauugggaugaaaaggc

SEQ ID NO: 645059 - RNA, 20 nt, Human
cuugaacuccugggcucaag

SEQ ID NO: 645060 - RNA, 21 nt, Human
gaaccauguguauaagaaagc

SEQ ID NO: 645061 - RNA, 21 nt, Human
gacaauacagcaaacuacaau

SEQ ID NO: 645062 - RNA, 24 nt, Human
gaguagcuggaacuacaugcaugc

SEQ ID NO: 645063 - RNA, 22 nt, Human
gauaacaagaacacccagcaga

SEQ ID NO: 645064 - RNA, 21 nt, Human
gauccucuagccucagccucc

SEQ ID NO: 645065 - RNA, 25 nt, Human
gaugaaaaggcaacucuaagaagaa

SEQ ID NO: 645066 - RNA, 18 nt, Human
gauuacaagcgugagcca

SEQ ID NO: 645067 - RNA, 20 nt, Human
gcagugauucuuagggcagc

SEQ ID NO: 645068 - RNA, 20 nt, Human
gcccaagcuggaaugcagug

SEQ ID NO: 645069 - RNA, 20 nt, Human
gccucagccuccugaguagc

SEQ ID NO: 645070 - RNA, 21 nt, Human
gccucagccuccugaguagcu

SEQ ID NO: 645071 - RNA, 19 nt, Human
gcuagucuugaacuccugg

SEQ ID NO: 645072 - RNA, 20 nt, Human
gcuagucuugaacuccuggg

SEQ ID NO: 645073 - RNA, 25 nt, Human
gcucugucgcccaagcuggaaugca

SEQ ID NO: 645074 - RNA, 19 nt, Human
gcuggaaugcaguggcgca

SEQ ID NO: 645075 - RNA, 19 nt, Human
gcuuaauaugagagaacca

SEQ ID NO: 645076 - RNA, 21 nt, Human
gggcucaagugauccuccugc

SEQ ID NO: 645077 - RNA, 22 nt, Human
gggcucaagugauccuccugcc

SEQ ID NO: 645078 - RNA, 24 nt, Human
gugauccuccugccucagccuccc

SEQ ID NO: 645079 - RNA, 23 nt, Human
guggcgcaaucacaccucacugc

SEQ ID NO: 645080 - RNA, 22 nt, Human
uaaaauacagacaauacagcaa

SEQ ID NO: 645081 - RNA, 21 nt, Human
uaaauuuauuuuuaguagaga

SEQ ID NO: 645082 - RNA, 25 nt, Human
uaagaagaaugcuguacauaugaca

SEQ ID NO: 645083 - RNA, 18 nt, Human
uaagagaaaaauacuuuu

SEQ ID NO: 645084 - RNA, 23 nt, Human
uaagagaaaaauacuuuuuuuuu

SEQ ID NO: 645085 - RNA, 23 nt, Human
uaagcaaucuccaaauauuuucu

SEQ ID NO: 645086 - RNA, 23 nt, Human
uaaugcaaucuuaaucgagguuc

SEQ ID NO: 645087 - RNA, 18 nt, Human
uacaauggcagcagugau

SEQ ID NO: 645088 - RNA, 20 nt, Human
uacuuuuuuuuuuuuuugaa

SEQ ID NO: 645089 - RNA, 22 nt, Human
uagagacagggucucacuaugu

SEQ ID NO: 645090 - RNA, 18 nt, Human
uaggcuagucuugaacuc

SEQ ID NO: 645091 - RNA, 24 nt, Human
uaguagagacagggucucacuaug

SEQ ID NO: 645092 - RNA, 23 nt, Human
uaugagagaaccauguguauaag

SEQ ID NO: 645093 - RNA, 18 nt, Human
uaugauaacaagaacacc

SEQ ID NO: 645094 - RNA, 28 nt, Human
uaugauaacaagaacacccagcagauac

SEQ ID NO: 645095 - RNA, 19 nt, Human
uauguugccuaggcuaguc

SEQ ID NO: 645096 - RNA, 20 nt, Human
uauguugccuaggcuagucu

SEQ ID NO: 645097 - RNA, 24 nt, Human
uauguugccuaggcuagucuugaa

SEQ ID NO: 645098 - RNA, 23 nt, Human
ucacugcagccucaaccuccugg

SEQ ID NO: 645099 - RNA, 24 nt, Human
ucacugcagccucaaccuccuggg

SEQ ID NO: 645100 - RNA, 23 nt, Human
ucagccuccugaguagcuggaac

SEQ ID NO: 645101 - RNA, 24 nt, Human
ucccaaagugcugcgauuacaagc

SEQ ID NO: 645102 - RNA, 27 nt, Human
uccuccugccucagccucccaaagugc

SEQ ID NO: 645103 - RNA, 19 nt, Human
uccucuagccucagccucc

SEQ ID NO: 645104 - RNA, 20 nt, Human
uccugggcucaaggauccuc

SEQ ID NO: 645105 - RNA, 21 nt, Human
uccugggcucaagugauccuc

SEQ ID NO: 645106 - RNA, 22 nt, Human
uccugggcucaagugauccucc

SEQ ID NO: 645107 - RNA, 22 nt, Human
uccugggcucaagugauccucc

SEQ ID NO: 645108 - RNA, 24 nt, Human
uccugggcucaagugauccuccug

SEQ ID NO: 645109 - RNA, 21 nt, Human
ucucacuauguugccuaggcu

SEQ ID NO: 645110 - RNA, 23 nt, Human
ucucacuauguugccuaggcuag

SEQ ID NO: 645111 - RNA, 23 nt, Human
ucucgcucugucgcccaagcugg

SEQ ID NO: 645112 - RNA, 24 nt, Human
ucucgcucugucgcccaagcugga

SEQ ID NO: 645113 - RNA, 26 nt, Human
ucucgcucugucgcccaagcuggaau

SEQ ID NO: 645114 - RNA, 23 nt, Human
ucuugaacuccugggcucaagug

SEQ ID NO: 645115 - RNA, 22 nt, Human
ugaaaaggcaacucuaagaaga

SEQ ID NO: 645116 - RNA, 25 nt, Human
ugaacuccugggcucaagugauccu

SEQ ID NO: 645117 - RNA, 24 nt, Human
ugacgacugcauagcucaacagaa

SEQ ID NO: 645118 - RNA, 23 nt, Human
ugagccaccgccuggcccgaaaa

SEQ ID NO: 645119 - RNA, 22 nt, Human
ugcaugcaccaccacacucagc

SEQ ID NO: 645120 - RNA, 24 nt, Human
ugccuaggcuagucuugaacuccu

SEQ ID NO: 645121 - RNA, 25 nt, Human
ugccucagccucccaaagugcugcg

SEQ ID NO: 645122 - RNA, 22 nt, Human
ugcgauuacaagcgugagccac

SEQ ID NO: 645123 - RNA, 24 nt, Human
ugcgauuacaagcgugagccaccg

SEQ ID NO: 645124 - RNA, 24 nt, Human
ugcugcgauuacaagcgugagcca

SEQ ID NO: 645125 - RNA, 24 nt, Human
uggaacuacaugcaugcaccacca

SEQ ID NO: 645126 - RNA, 18 nt, Human
uggaaugcaguggcgcaa

SEQ ID NO: 645127 - RNA, 19 nt, Human
uggaaugcaguggcgcaau

SEQ ID NO: 645128 - RNA, 19 nt, Human
ugggaugaaaaggcaacuc

SEQ ID NO: 645129 - RNA, 20 nt, Human
ugggcucaagugauccuccu

SEQ ID NO: 645130 - RNA, 24 nt, Human
ugggcucaagugauccuccugccu

SEQ ID NO: 645131 - RNA, 25 nt, Human
uguacauaugacaccuauugcauuu

SEQ ID NO: 645132 - RNA, 18 nt, Human
uuaaagcuguuuuacaau

SEQ ID NO: 645133 - RNA, 24 nt, Human
uuaaauuuauuuuuaguagagaca

SEQ ID NO: 645134 - RNA, 19 nt, Human
uuaaugucacauacaguuu

SEQ ID NO: 645135 - RNA, 19 nt, Human
uuacuaccaggcuuaauau

SEQ ID NO: 645136 - RNA, 23 nt, Human
uuaggcagauaaauucccaauca

SEQ ID NO: 645137 - RNA, 24 nt, Human
uuaguagagacagggucucacuau

SEQ ID NO: 645138 - RNA, 22 nt, Human
uuccucgucuuugaagugcuaa

SEQ ID NO: 645139 - RNA, 22 nt, Human
uuucuuauaaagagggaguguu

SEQ ID NO: 645140 - RNA, 26 nt, Human
uuuuuuaaauuuauuuuuaguagagg

SEQ ID NO: 645141 - RNA, 25 nt, Human
uuuuuuuuuuuugagacugggucuc

SEQ ID NO: 645142 - RNA, 22 nt, Human
uuuuuuuuuuuuuugagacugg

SEQ ID NO: 645143 - RNA, 19 nt, Human
agacagggugcccagggcc

SEQ ID NO: 645144 - RNA, 24 nt, Human
aggcaggugcgggccagucccugc

SEQ ID NO: 645145 - RNA, 22 nt, Human
agggcagcuggucccagggccc

SEQ ID NO: 645146 - RNA, 18 nt, Human
agguggaggugacggggg

SEQ ID NO: 645147 - RNA, 21 nt, Human
augaggccaauccaggcuggg

SEQ ID NO: 645148 - RNA, 18 nt, Human
augcugcugaccccccgc

SEQ ID NO: 645149 - RNA, 19 nt, Human
augcugcugaccccccgcc

SEQ ID NO: 645150 - RNA, 20 nt, Human
caagauggggcagcgugggg

SEQ ID NO: 645151 - RNA, 19 nt, Human
caccccccuuauuggacca

SEQ ID NO: 645152 - RNA, 19 nt, Human
cacccugcaccccuggcca

SEQ ID NO: 645153 - RNA, 24 nt, Human
cagcagugagaccaggggagacag

SEQ ID NO: 645154 - RNA, 18 nt, Human
cagcugaccccagagaca

SEQ ID NO: 645155 - RNA, 19 nt, Human
ccccaaggcccuugaccag

SEQ ID NO: 645156 - RNA, 22 nt, Human
ccccagagacagcagaggugaa

SEQ ID NO: 645157 - RNA, 23 nt, Human
cccccaaggcccuugaccagaac

SEQ ID NO: 645158 - RNA, 20 nt, Human
cccccgccacccugcacccc

SEQ ID NO: 645159 - RNA, 19 nt, Human
ccccgccacccugcacccc

SEQ ID NO: 645160 - RNA, 21 nt, Human
ccccgccacccugcaccccug

SEQ ID NO: 645161 - RNA, 24 nt, Human
cccugggaacugccagaggcccag

SEQ ID NO: 645162 - RNA, 24 nt, Human
ccgccacccugcaccccuggccac

SEQ ID NO: 645163 - RNA, 23 nt, Human
ccugagacuggugcugcucuaga

SEQ ID NO: 645164 - RNA, 23 nt, Human
cucacaccccccuuauuggacca

SEQ ID NO: 645165 - RNA, 22 nt, Human
cucuagaaggccuggugggggg

SEQ ID NO: 645166 - RNA, 19 nt, Human
cuuccagcuugaggaugag

SEQ ID NO: 645167 - RNA, 18 nt, Human
cuucgaggaccccgggcg

SEQ ID NO: 645168 - RNA, 25 nt, Human
gagcagcagcugaccccagagacag

SEQ ID NO: 645169 - RNA, 18 nt, Human
gaggaccccgggcgucgg

SEQ ID NO: 645170 - RNA, 21 nt, Human
gccacaugcuagcgggcagcu

SEQ ID NO: 645171 - RNA, 22 nt, Human
gccacccugcaccccuggccac

SEQ ID NO: 645172 - RNA, 19 nt, Human
gcccugagacuggugcugc

SEQ ID NO: 645173 - RNA, 21 nt, Human
gcgggccagucccugcggggc

SEQ ID NO: 645174 - RNA, 20 nt, Human
gcggggcucacaccccccuu

SEQ ID NO: 645175 - RNA, 20 nt, Human
gggacaugcugcugaccccc

SEQ ID NO: 645176 - RNA, 18 nt, Human
gggcagcugaugagcagc

SEQ ID NO: 645177 - RNA, 21 nt, Human
gugcgggccagucccugcggg

SEQ ID NO: 645178 - RNA, 24 nt, Human
uccagcuugaggaugagccgugag

SEQ ID NO: 645179 - RNA, 20 nt, Human
ucuccuggcuacaaaccugg

SEQ ID NO: 645180 - RNA, 19 nt, Human
ugaccaaagauccuggaug

SEQ ID NO: 645181 - RNA, 21 nt, Human
ugaccagaacuggaacagcag

SEQ ID NO: 645182 - RNA, 22 nt, Human
ugaccccccgccacccugcacc

SEQ ID NO: 645183 - RNA, 24 nt, Human
ugaccccccgccacccugcacccc

SEQ ID NO: 645184 - RNA, 19 nt, Human
ugcccagggccugcccagg

SEQ ID NO: 645185 - RNA, 22 nt, Human
ugcccagggccugcccagggac

SEQ ID NO: 645186 - RNA, 19 nt, Human
ugcccccuucuccuggcua

SEQ ID NO: 645187 - RNA, 23 nt, Human
uggaacagcaggcaagauggggc

SEQ ID NO: 645188 - RNA, 20 nt, Human
ugugaugcccccuucuccug

SEQ ID NO: 645189 - RNA, 25 nt, Human
uuuaauugcugaaaacauccaaggc

SEQ ID NO: 645190 - RNA, 18 nt, Human
uuuuuuuuuuuuuuuuug

SEQ ID NO: 645191 - RNA, 24 nt, Human
uuuuuuuuuuuuuuuuugccagcu

SEQ ID NO: 645192 - RNA, 22 nt, Human
aaaaaaaaaaaaauugcaagaa

SEQ ID NO: 645193 - RNA, 25 nt, Human
aaaccauagccauauuuugacauuu

SEQ ID NO: 645194 - RNA, 19 nt, Human
aauacaggagcuaagaaaa

SEQ ID NO: 645195 - RNA, 20 nt, Human
agauggaggaaaaaaauuca

SEQ ID NO: 645196 - RNA, 24 nt, Human
augagcuuaaaaaaaaaaaaauug

SEQ ID NO: 645197 - RNA, 25 nt, Human
caacaaaaaaggaguaagucaucaa

SEQ ID NO: 645198 - RNA, 26 nt, Human
caacuuccagaagaaggcugcaaaca

SEQ ID NO: 645199 - RNA, 20 nt, Human
cagaagaaggcugcaaacau

SEQ ID NO: 645200 - RNA, 18 nt, Human
cugggcugcauuagaccc

SEQ ID NO: 645201 - RNA, 21 nt, Human
ggugauaaaaagauggaggaa

SEQ ID NO: 645202 - RNA, 23 nt, Human
guuuuuaaaagaauuucacugag

SEQ ID NO: 645203 - RNA, 26 nt, Human
uaaacauauuuauguuuaaaacacag

SEQ ID NO: 645204 - RNA, 23 nt, Human
uaaauaaacuuugaacugauuuc

SEQ ID NO: 645205 - RNA, 24 nt, Human
uaaauauguagaucaaggaugucc

SEQ ID NO: 645206 - RNA, 21 nt, Human
uaaauauguagaucagggaug

SEQ ID NO: 645207 - RNA, 23 nt, Human
uaagaaaguuuacaaaaaaugua

SEQ ID NO: 645208 - RNA, 31 nt, Human
uacaaaaaauguaaaauauuugagaauaagg

SEQ ID NO: 645209 - RNA, 19 nt, Human
uacaggagcuaagaaaaga

SEQ ID NO: 645210 - RNA, 24 nt, Human
uacauuuggcuaaguagauaacuu

SEQ ID NO: 645211 - RNA, 24 nt, Human
uacuuagcuauauuuuuucuuuug

SEQ ID NO: 645212 - RNA, 25 nt, Human
uagauaacuuaccuaaauuugcucc

SEQ ID NO: 645213 - RNA, 26 nt, Human
uagcugaugagcuuaaaaaaaaaaaa

SEQ ID NO: 645214 - RNA, 27 nt, Human
uauaaaaccagaaguacaauucaacaa

SEQ ID NO: 645215 - RNA, 18 nt, Human
uaugccauuauuuuugua

SEQ ID NO: 645216 - RNA, 21 nt, Human
uaugccauuauuuuuguaguu

SEQ ID NO: 645217 - RNA, 19 nt, Human
uaugcuaacacugaugaua

SEQ ID NO: 645218 - RNA, 20 nt, Human
ucauucauuuuauugacuug

SEQ ID NO: 645219 - RNA, 20 nt, Human
uccacgaauaucauuaucac

SEQ ID NO: 645220 - RNA, 18 nt, Human
ucuuaaguuuuuuaugcc

SEQ ID NO: 645221 - RNA, 23 nt, Human
ucuuuuggcuucccugagccaca

SEQ ID NO: 645222 - RNA, 23 nt, Human
ucuuuuggcuucccugagccaca

SEQ ID NO: 645223 - RNA, 21 nt, Human
ugacauuucacaaagaauggu

SEQ ID NO: 645224 - RNA, 19 nt, Human
ugauuuuucuggugucauu

SEQ ID NO: 645225 - RNA, 20 nt, Human
uggcuucccugagccacauu

SEQ ID NO: 645226 - RNA, 20 nt, Human
uggcuucccugagccacauu

SEQ ID NO: 645227 - RNA, 21 nt, Human
uguuuuaagaaaguuuacaaa

SEQ ID NO: 645228 - RNA, 21 nt, Human
uguuuuaagaaaguuuacaga

SEQ ID NO: 645229 - RNA, 20 nt, Human
uuaacucaauacagucauuc

SEQ ID NO: 645230 - RNA, 21 nt, Human
uucaaauguuucuucuaaauc

SEQ ID NO: 645231 - RNA, 19 nt, Human
uucaacaaaaaaggaguaa

SEQ ID NO: 645232 - RNA, 18 nt, Human
uuccagaagaaggcugca

SEQ ID NO: 645233 - RNA, 18 nt, Human
uuucaaacuuagaauuua

SEQ ID NO: 645234 - RNA, 18 nt, Human
uuucaguguggucaucau

SEQ ID NO: 645235 - RNA, 20 nt, Human
uuuggcuucccugagccaca

SEQ ID NO: 645236 - RNA, 23 nt, Human
uuuggcuucccugagccacauug

SEQ ID NO: 645237 - RNA, 19 nt, Human
uuuuuuuuuuuuuuuuugu

SEQ ID NO: 645238 - RNA, 22 nt, Human
uuuuuuuuuuuuuuuuuguagg

SEQ ID NO: 645239 - RNA, 21 nt, Human
aaaaaaaaccaaacaccaaaa

SEQ ID NO: 645240 - RNA, 20 nt, Human
aaaaacacaaaucuucaguc

SEQ ID NO: 645241 - RNA, 22 nt, Human
aaaaaggaaauugucuuaagga

SEQ ID NO: 645242 - RNA, 24 nt, Human
aaaacaaaaacacaaaucuucagu

SEQ ID NO: 645243 - RNA, 19 nt, Human
aaaagccuugaugcuggca

SEQ ID NO: 645244 - RNA, 24 nt, Human
aaacaagacaaauuaaaacagaaa

SEQ ID NO: 645245 - RNA, 22 nt, Human
aaacuugguucauuggcuagca

SEQ ID NO: 645246 - RNA, 21 nt, Human
aaagcgcuccucuccucgcca

SEQ ID NO: 645247 - RNA, 21 nt, Human
aaagugaacagaugaaaaaau

SEQ ID NO: 645248 - RNA, 27 nt, Human
aaauguuagaaaucugcuugauaaacu

SEQ ID NO: 645249 - RNA, 19 nt, Human
aacaagacaaauuaaaaca

SEQ ID NO: 645250 - RNA, 19 nt, Human
aaccaccggcugaaccaag

SEQ ID NO: 645251 - RNA, 22 nt, Human
aaccagguguucccgcacaggu

SEQ ID NO: 645252 - RNA, 19 nt, Human
aacuuguucauccaaaaua

SEQ ID NO: 645253 - RNA, 19 nt, Human
aaggacaaaaaggaaauug

SEQ ID NO: 645254 - RNA, 21 nt, Human
aaugcgcacauacugggcaac

SEQ ID NO: 645255 - RNA, 23 nt, Human
acaagacaaauuaaaacagaaac

SEQ ID NO: 645256 - RNA, 22 nt, Human
acacaaaggagaagcaaaacca

SEQ ID NO: 645257 - RNA, 23 nt, Human
accaaaaaaaaccaaacaccaaa

SEQ ID NO: 645258 - RNA, 21 nt, Human
accaaaacaaaaacacaaauc

SEQ ID NO: 645259 - RNA, 21 nt, Human
accaaacaccaaaacaaaaac

SEQ ID NO: 645260 - RNA, 18 nt, Human
acgcugcacuccagcgug

SEQ ID NO: 645261 - RNA, 18 nt, Human
acugcuaacuaccagccu

SEQ ID NO: 645262 - RNA, 19 nt, Human
acuuuacaaauuaaugugu

SEQ ID NO: 645263 - RNA, 21 nt, Human
agauaaagcaauagcaaaaaa

SEQ ID NO: 645264 - RNA, 22 nt, Human
agaugcugaaaacagcucaccu

SEQ ID NO: 645265 - RNA, 21 nt, Human
agcaauagcaaaaaauuuuaa

SEQ ID NO: 645266 - RNA, 27 nt, Human
aggcucagaaguugcuuaauuugaacu

SEQ ID NO: 645267 - RNA, 20 nt, Human
agggccaccacuaggcacca

SEQ ID NO: 645268 - RNA, 27 nt, Human
aggugaaauucuaaacuggaggacaca

SEQ ID NO: 645269 - RNA, 18 nt, Human
agucaacagcuaaucuga

SEQ ID NO: 645270 - RNA, 24 nt, Human
auaaagcaauagcaaaaaauuuua

SEQ ID NO: 645271 - RNA, 19 nt, Human
auaauccccccacacacau

SEQ ID NO: 645272 - RNA, 21 nt, Human
auccaaaauaggcuuuuuaau

SEQ ID NO: 645273 - RNA, 20 nt, Human
auucuuuuucuaguuuuccu

SEQ ID NO: 645274 - RNA, 20 nt, Human
caaaacaaaaacacaaaucu

SEQ ID NO: 645275 - RNA, 23 nt, Human
caaaacaaaaacacaaaucuuca

SEQ ID NO: 645276 - RNA, 23 nt, Human
caaaagcaucuggucacaacugc

SEQ ID NO: 645277 - RNA, 25 nt, Human
caacuauuuaccauaaauuauagau

SEQ ID NO: 645278 - RNA, 23 nt, Human
caauauagucucuucugugucaa

SEQ ID NO: 645279 - RNA, 21 nt, Human
cacagggccaccacuaggcac

SEQ ID NO: 645280 - RNA, 24 nt, Human
cacauacugggcaacauuugugua

SEQ ID NO: 645281 - RNA, 23 nt, Human
caccccuccagcucucucugucc

SEQ ID NO: 645282 - RNA, 21 nt, Human
cacuaugcugacuuuuaaagu

SEQ ID NO: 645283 - RNA, 24 nt, Human
cagccugagacagauuuuauucuu

SEQ ID NO: 645284 - RNA, 28 nt, Human
caggaacacaaaggagaagcaaaaccac

SEQ ID NO: 645285 - RNA, 25 nt, Human
cagguguucccgcacaggugauggc

SEQ ID NO: 645286 - RNA, 18 nt, Human
caugaaucccaagaucuu

SEQ ID NO: 645287 - RNA, 25 nt, Human
ccaaaaaaaaccaaacaccaaaaca

SEQ ID NO: 645288 - RNA, 22 nt, Human
ccacuggcaaugcgcacauacu

SEQ ID NO: 645289 - RNA, 25 nt, Human
ccauccuuagauuuagggcaaaaca

SEQ ID NO: 645290 - RNA, 23 nt, Human
ccccacacacauucuucccuuug

SEQ ID NO: 645291 - RNA, 18 nt, Human
cccccucuucuugguuac

SEQ ID NO: 645292 - RNA, 20 nt, Human
cccccucuucuugguuacac

SEQ ID NO: 645293 - RNA, 21 nt, Human
cccgcacaggugauggccgug

SEQ ID NO: 645294 - RNA, 19 nt, Human
cccuuugccucccaacuau

SEQ ID NO: 645295 - RNA, 21 nt, Human
cucagaacacagggccaccac

SEQ ID NO: 645296 - RNA, 27 nt, Human
cugaaaacagcucaccuucauuuaccu

SEQ ID NO: 645297 - RNA, 18 nt, Human
cugccauguccaguuaug

SEQ ID NO: 645298 - RNA, 25 nt, Human
cugccucuauuccauuuuuacaaaa

SEQ ID NO: 645299 - RNA, 20 nt, Human
cugguuuuuguucaaagcag

SEQ ID NO: 645300 - RNA, 20 nt, Human
cuuucccccucuucuugguu

SEQ ID NO: 645301 - RNA, 19 nt, Human
cuuuuucuaguuuuccuua

SEQ ID NO: 645302 - RNA, 20 nt, Human
gacaaaaaggaaauugucuu

SEQ ID NO: 645303 - RNA, 21 nt, Human
gaugaaagacuuauaaagcug

SEQ ID NO: 645304 - RNA, 21 nt, Human
gcaaaacacuagugcaagcca

SEQ ID NO: 645305 - RNA, 24 nt, Human
ggaacaaaacuuuuuuuuuuuuuu

SEQ ID NO: 645306 - RNA, 21 nt, Human
ggcugagugagacaaaccagc

SEQ ID NO: 645307 - RNA, 23 nt, Human
ggcugguuuuuguucaaagcagu

SEQ ID NO: 645308 - RNA, 25 nt, Human
gggguccauuccuuuaagacaauuu

SEQ ID NO: 645309 - RNA, 23 nt, Human
gguguucuuucuucucccugccc

SEQ ID NO: 645310 - RNA, 20 nt, Human
guagugcuccuuuguauucu

SEQ ID NO: 645311 - RNA, 22 nt, Human
uaaaaaugagagcuaugaagua

SEQ ID NO: 645312 - RNA, 20 nt, Human
uaaaagccuugaugcuggcc

SEQ ID NO: 645313 - RNA, 18 nt, Human
uaaaauaaguucaucucu

SEQ ID NO: 645314 - RNA, 20 nt, Human
uaacuaccagccugagacag

SEQ ID NO: 645315 - RNA, 18 nt, Human
uaaggaaaccagguguuc

SEQ ID NO: 645316 - RNA, 29 nt, Human
uacaaaaagucaacagcuaaucugaugaa

SEQ ID NO: 645317 - RNA, 24 nt, Human
uacaaaaugaaguccacuggcaaa

SEQ ID NO: 645318 - RNA, 25 nt, Human
uaccaaaaaaaaccaaacaccaaaa

SEQ ID NO: 645319 - RNA, 25 nt, Human
uaccaaaaaaaaccaaacaccaaaa

SEQ ID NO: 645320 - RNA, 20 nt, Human
uaccacguggcgcugcugcc

SEQ ID NO: 645321 - RNA, 23 nt, Human
uacguuaccaaaaaaaaccaaac

SEQ ID NO: 645322 - RNA, 18 nt, Human
uauuagauggcuaaccca

SEQ ID NO: 645323 - RNA, 18 nt, Human
ucagaacacagggccacc

SEQ ID NO: 645324 - RNA, 26 nt, Human
uccaauaacaugaacuuuccaaaaua

SEQ ID NO: 645325 - RNA, 19 nt, Human
uccuuuaaucuaugugaug

SEQ ID NO: 645326 - RNA, 18 nt, Human
ucuaacugaggaacaaaa

SEQ ID NO: 645327 - RNA, 18 nt, Human
ugaacuuuccaaaauaua

SEQ ID NO: 645328 - RNA, 25 nt, Human
ugagacagauuuuauucuuuaauac

SEQ ID NO: 645329 - RNA, 21 nt, Human
ugauuuuuucuuuuuuaagca

SEQ ID NO: 645330 - RNA, 18 nt, Human
ugccgaugcauuucccuc

SEQ ID NO: 645331 - RNA, 25 nt, Human
uggcaaugcgcacauacugggcaac

SEQ ID NO: 645332 - RNA, 18 nt, Human
uggcuaacccaaaauugu

SEQ ID NO: 645333 - RNA, 20 nt, Human
ugggcagccuuaaaggacug

SEQ ID NO: 645334 - RNA, 19 nt, Human
ugguuuuuguucaaagcag

SEQ ID NO: 645335 - RNA, 23 nt, Human
uguaccuguaacacuuaagauuc

SEQ ID NO: 645336 - RNA, 23 nt, Human
ugugucaaauauuuaaaauggcc

SEQ ID NO: 645337 - RNA, 20 nt, Human
uguucagaauuuaaccugau

SEQ ID NO: 645338 - RNA, 24 nt, Human
uuaaaagcugccuauaaauacaua

SEQ ID NO: 645339 - RNA, 28 nt, Human
uuaauaauccccccacacacauucuucc

SEQ ID NO: 645340 - RNA, 18 nt, Human
uucaagaguugacaguua

SEQ ID NO: 645341 - RNA, 19 nt, Human
uucaucucucauguuagaa

SEQ ID NO: 645342 - RNA, 21 nt, Human
uugaacacuuaaugcaaauuc

SEQ ID NO: 645343 - RNA, 22 nt, Human
uugacaguuacguuaccaaaaa

SEQ ID NO: 645344 - RNA, 23 nt, Human
uuuaaaauggccagaaucaaacu

SEQ ID NO: 645345 - RNA, 22 nt, Human
uuuaagaagugccugggucggg

SEQ ID NO: 645346 - RNA, 23 nt, Human
uuuaagcauauaaaaauuacacu

SEQ ID NO: 645347 - RNA, 23 nt, Human
uuugaacuucaauuccaauaaca

SEQ ID NO: 645348 - RNA, 28 nt, Human
uuuuuguauuacaaaaagucaacagcua

SEQ ID NO: 645349 - RNA, 19 nt, Human
uuuuuuuuuuuuuuuccuu

SEQ ID NO: 645350 - RNA, 27 nt, Human
aaaagagagcaaguccaggcaacaaaa

SEQ ID NO: 645351 - RNA, 26 nt, Human
aaaaugcccccuucaaaagaagcuga

SEQ ID NO: 645352 - RNA, 20 nt, Human
aacaaaaugcccccuucaaa

SEQ ID NO: 645353 - RNA, 18 nt, Human
aaggcaaauaugcauaua

SEQ ID NO: 645354 - RNA, 22 nt, Human
aaugccaaccuuaauucuacaa

SEQ ID NO: 645355 - RNA, 19 nt, Human
acaaugaccauauuuucua

SEQ ID NO: 645356 - RNA, 19 nt, Human
acaguaccuguagaaggac

SEQ ID NO: 645357 - RNA, 22 nt, Human
acaguaccuguagaaggacacu

SEQ ID NO: 645358 - RNA, 22 nt, Human
acuuugaagauaaaagaccaua

SEQ ID NO: 645359 - RNA, 21 nt, Human
agagagcaaguccaggcaaca

SEQ ID NO: 645360 - RNA, 21 nt, Human
agagcaagccucuguaguugc

SEQ ID NO: 645361 - RNA, 21 nt, Human
agggcucaaccuuuccaacuu

SEQ ID NO: 645362 - RNA, 24 nt, Human
augcauauagaaccaaacacaaag

SEQ ID NO: 645363 - RNA, 23 nt, Human
auucugggagaccuugauuugga

SEQ ID NO: 645364 - RNA, 20 nt, Human
cacugauucugggagaccuu

SEQ ID NO: 645365 - RNA, 23 nt, Human
cagaacucucuuagaaaaugcua

SEQ ID NO: 645366 - RNA, 22 nt, Human
caggcaacaaaaugcccccuuc

SEQ ID NO: 645367 - RNA, 21 nt, Human
ccaaagucuuuaccucaaugg

SEQ ID NO: 645368 - RNA, 22 nt, Human
ccaucugaaacugugaagugga

SEQ ID NO: 645369 - RNA, 25 nt, Human
cccaagcaaaauaguuaguuugaaa

SEQ ID NO: 645370 - RNA, 23 nt, Human
ccccugugucucucucucgguag

SEQ ID NO: 645371 - RNA, 21 nt, Human
ccuccaggucacuggcaguuu

SEQ ID NO: 645372 - RNA, 22 nt, Human
ccuggugccagccccuuuccac

SEQ ID NO: 645373 - RNA, 26 nt, Human
cucaaaauagcauuuaauguggcacc

SEQ ID NO: 645374 - RNA, 22 nt, Human
cuuccccaaaugccaaccuuaa

SEQ ID NO: 645375 - RNA, 21 nt, Human
gcagccauauuugggcagagc

SEQ ID NO: 645376 - RNA, 23 nt, Human
gcaguaaaauaagaaaaggcaaa

SEQ ID NO: 645377 - RNA, 21 nt, Human
gccccuuuccaccacugaccc

SEQ ID NO: 645378 - RNA, 22 nt, Human
gcuaagcauaccacaguaccug

SEQ ID NO: 645379 - RNA, 19 nt, Human
guccaggcaacaaaaugcc

SEQ ID NO: 645380 - RNA, 20 nt, Human
uaauguggcaccaucuuuac

SEQ ID NO: 645381 - RNA, 24 nt, Human
uacaaugaccauauuuucuagacc

SEQ ID NO: 645382 - RNA, 19 nt, Human
uaccacaguaccuguagaa

SEQ ID NO: 645383 - RNA, 22 nt, Human
uagaaaaugcuaagcauaccac

SEQ ID NO: 645384 - RNA, 18 nt, Human
uagauuucuaacucaagc

SEQ ID NO: 645385 - RNA, 18 nt, Human
ucccaagcaaaauaguua

SEQ ID NO: 645386 - RNA, 20 nt, Human
ucccaagcaaaauaguuagu

SEQ ID NO: 645387 - RNA, 23 nt, Human
uccccaaaugccaaccuuaauuc

SEQ ID NO: 645388 - RNA, 18 nt, Human
uccccuccccugugucuc

SEQ ID NO: 645389 - RNA, 21 nt, Human
ucucugaccuucacaaacugu

SEQ ID NO: 645390 - RNA, 19 nt, Human
ucugaccuucacaaacugu

SEQ ID NO: 645391 - RNA, 23 nt, Human
ucuucuuugcuuuugagucccua

SEQ ID NO: 645392 - RNA, 22 nt, Human
ugagauuuaucuuuccccuccc

SEQ ID NO: 645393 - RNA, 22 nt, Human
ugcagccauauuugggcagagc

SEQ ID NO: 645394 - RNA, 18 nt, Human
ugcccuggugccagcccc

SEQ ID NO: 645395 - RNA, 22 nt, Human
ugcccuggugccagccccuuuc

SEQ ID NO: 645396 - RNA, 20 nt, Human
uggaauuucacugauucugg

SEQ ID NO: 645397 - RNA, 21 nt, Human
uggacauuucauaaaaguuuu

SEQ ID NO: 645398 - RNA, 28 nt, Human
uguggucaagggcucaaccccguggucg

SEQ ID NO: 645399 - RNA, 25 nt, Human
uugaauaggaaaugaugccuccagg

SEQ ID NO: 645400 - RNA, 21 nt, Human
uugaugcugugaauuucugaa

SEQ ID NO: 645401 - RNA, 19 nt, Human
uuuuuuuuuuuucaccuca

SEQ ID NO: 645402 - RNA, 22 nt, Human
uuuuuuuuuuuuuuuuucaccu

SEQ ID NO: 645403 - RNA, 19 nt, Human
aaaguuuucugcaccccaa

SEQ ID NO: 645404 - RNA, 19 nt, Human
aacacagugaagaaauaaa

SEQ ID NO: 645405 - RNA, 23 nt, Human
aaccucaggcagauagguuaagg

SEQ ID NO: 645406 - RNA, 24 nt, Human
aagacuccucccagcucaacacag

SEQ ID NO: 645407 - RNA, 19 nt, Human
aagaggcagcagaaaccag

SEQ ID NO: 645408 - RNA, 21 nt, Human
aaggcaaggauaggcaagaaa

SEQ ID NO: 645409 - RNA, 26 nt, Human
aaggcaaggauaggcaagaaaggucu

SEQ ID NO: 645410 - RNA, 19 nt, Human
acaauguaagagaagaggc

SEQ ID NO: 645411 - RNA, 21 nt, Human
acaauguaagagaagaggcag

SEQ ID NO: 645412 - RNA, 25 nt, Human
acaauguaagagaagaggcagcaga

SEQ ID NO: 645413 - RNA, 23 nt, Human
acagcaaucuuuuggaauuuucu

SEQ ID NO: 645414 - RNA, 21 nt, Human
accccaaacccucacaaaaca

SEQ ID NO: 645415 - RNA, 27 nt, Human
accccaaacccucacaaaacagaccuc

SEQ ID NO: 645416 - RNA, 22 nt, Human
accccaacccagguuuagcuga

SEQ ID NO: 645417 - RNA, 19 nt, Human
accucaucuucuccucaca

SEQ ID NO: 645418 - RNA, 19 nt, Human
agaaaaucccuucccacau

SEQ ID NO: 645419 - RNA, 20 nt, Human
agaagauacugccccaggac

SEQ ID NO: 645420 - RNA, 20 nt, Human
agagaagaggcagcagaaac

SEQ ID NO: 645421 - RNA, 24 nt, Human
agauaauccaggucacccagccuc

SEQ ID NO: 645422 - RNA, 23 nt, Human
aggcaaaaagcagguuacuuugg

SEQ ID NO: 645423 - RNA, 21 nt, Human
aggcacuaauuagacuaagcu

SEQ ID NO: 645424 - RNA, 19 nt, Human
aggcagcagaaaccagagc

SEQ ID NO: 645425 - RNA, 21 nt, Human
aguaacaguaguugggagaaa

SEQ ID NO: 645426 - RNA, 23 nt, Human
aucccuucccacauugaagacuc

SEQ ID NO: 645427 - RNA, 19 nt, Human
auguaagagaagaggcagc

SEQ ID NO: 645428 - RNA, 25 nt, Human
caaaggcagaaaagcuaggggccaa

SEQ ID NO: 645429 - RNA, 23 nt, Human
caacuucugcacuucucaguccu

SEQ ID NO: 645430 - RNA, 23 nt, Human
cacagaaagauacauauuagucc

SEQ ID NO: 645431 - RNA, 19 nt, Human
caccccaaacccucacaaa

SEQ ID NO: 645432 - RNA, 19 nt, Human
cagaaaccagagccugccc

SEQ ID NO: 645433 - RNA, 20 nt, Human
cagcagaaaccagagccugg

SEQ ID NO: 645434 - RNA, 24 nt, Human
cagccuuaccacuguuccaacuuc

SEQ ID NO: 645435 - RNA, 22 nt, Human
caggcagauagguuaaggcaag

SEQ ID NO: 645436 - RNA, 18 nt, Human
caggucacccagccuccc

SEQ ID NO: 645437 - RNA, 20 nt, Human
cauugaagacuccucccagc

SEQ ID NO: 645438 - RNA, 21 nt, Human
ccaaacccucacaaaacagac

SEQ ID NO: 645439 - RNA, 23 nt, Human
ccaagacccacugggcagaaagc

SEQ ID NO: 645440 - RNA, 20 nt, Human
ccagguuuagcugaucuuua

SEQ ID NO: 645441 - RNA, 22 nt, Human
cccagcucaacacagugaagaa

SEQ ID NO: 645442 - RNA, 24 nt, Human
ccggggaucuggcugauucuucuc

SEQ ID NO: 645443 - RNA, 21 nt, Human
ccucacaaaacagaccucuau

SEQ ID NO: 645444 - RNA, 24 nt, Human
ccucacgggucagcugcuuggucu

SEQ ID NO: 645445 - RNA, 19 nt, Human
ccugcaguucacuuuucag

SEQ ID NO: 645446 - RNA, 18 nt, Human
ccugcuguaacugagccu

SEQ ID NO: 645447 - RNA, 23 nt, Human
cgggcagccucuuccugaaguuc

SEQ ID NO: 645448 - RNA, 19 nt, Human
cuagcuuugugccaggagc

SEQ ID NO: 645449 - RNA, 25 nt, Human
cuauaaccaguaacaguaguuggga

SEQ ID NO: 645450 - RNA, 24 nt, Human
cucuauaaccaguaacaguaguug

SEQ ID NO: 645451 - RNA, 21 nt, Human
cuucucaguccuaaccucauc

SEQ ID NO: 645452 - RNA, 21 nt, Human
cuuuucuuaaaagagcaggau

SEQ ID NO: 645453 - RNA, 20 nt, Human
gacucacaaucucaggccaa

SEQ ID NO: 645454 - RNA, 23 nt, Human
gagaacccccuuuccagacugcc

SEQ ID NO: 645455 - RNA, 20 nt, Human
gcaaggauaggcaagaaagg

SEQ ID NO: 645456 - RNA, 20 nt, Human
gcagaaagcaccccaaccca

SEQ ID NO: 645457 - RNA, 19 nt, Human
ggcucuuaaggcgggcagc

SEQ ID NO: 645458 - RNA, 20 nt, Human
gggucagcugcuuggucugc

SEQ ID NO: 645459 - RNA, 23 nt, Human
uaaaacaaaacaucuuauuuuaa

SEQ ID NO: 645460 - RNA, 22 nt, Human
uaacugaacucccuuuggaguc

SEQ ID NO: 645461 - RNA, 22 nt, Human
uaacugagccuggaaauggcuc

SEQ ID NO: 645462 - RNA, 21 nt, Human
uaaggcgggcagccucuuccc

SEQ ID NO: 645463 - RNA, 21 nt, Human
uacugccccaggacuuucagu

SEQ ID NO: 645464 - RNA, 18 nt, Human
uaguccaguuaguggcca

SEQ ID NO: 645465 - RNA, 22 nt, Human
ucaaaguuuucugcaccccaaa

SEQ ID NO: 645466 - RNA, 20 nt, Human
ucaaauccuuccaucuguuc

SEQ ID NO: 645467 - RNA, 24 nt, Human
ucacaugcacaccaucagaagaua

SEQ ID NO: 645468 - RNA, 21 nt, Human
ucacuuuucagcuccuccacc

SEQ ID NO: 645469 - RNA, 23 nt, Human
uccagaauaaacucacuauuccu

SEQ ID NO: 645470 - RNA, 25 nt, Human
uccagaauaaacucacuauuccuua

SEQ ID NO: 645471 - RNA, 18 nt, Human
uccaguuaguggccaaac

SEQ ID NO: 645472 - RNA, 22 nt, Human
ucccuaagaucaagcuggugcu

SEQ ID NO: 645473 - RNA, 19 nt, Human
ucccuacaaaggcagaaaa

SEQ ID NO: 645474 - RNA, 20 nt, Human
ucccuacaaaggcagaaaag

SEQ ID NO: 645475 - RNA, 21 nt, Human
ucucuagggccuaaggauaaa

SEQ ID NO: 645476 - RNA, 24 nt, Human
ucugagaacccccuuuccagacug

SEQ ID NO: 645477 - RNA, 22 nt, Human
ucugcaccccaaacccucacaa

SEQ ID NO: 645478 - RNA, 19 nt, Human
ucugcaguucaaauccuuc

SEQ ID NO: 645479 - RNA, 19 nt, Human
ugaagacuccucccagcuc

SEQ ID NO: 645480 - RNA, 18 nt, Human
ugagagggagaaaauagc

SEQ ID NO: 645481 - RNA, 18 nt, Human
ugcaguucacuuuucagc

SEQ ID NO: 645482 - RNA, 19 nt, Human
ugccccaggacuuucagua

SEQ ID NO: 645483 - RNA, 19 nt, Human
ugcuguaacugagccugga

SEQ ID NO: 645484 - RNA, 26 nt, Human
ugugccaggagcauauuauuaaaaca

SEQ ID NO: 645485 - RNA, 21 nt, Human
uuaaggcgggcagccucuucc

SEQ ID NO: 645486 - RNA, 22 nt, Human
uuacuccuagcuuugugccagg

SEQ ID NO: 645487 - RNA, 23 nt, Human
uuagcugaucuuuaccacuuccc

SEQ ID NO: 645488 - RNA, 24 nt, Human
uucagcugcauaugcucguccugc

SEQ ID NO: 645489 - RNA, 20 nt, Human
uuccugcuguaacugagccu

SEQ ID NO: 645490 - RNA, 22 nt, Human
uuccugcuguaacugagccugg

SEQ ID NO: 645491 - RNA, 23 nt, Human
uucucaguccuaaccucaucuuc

SEQ ID NO: 645492 - RNA, 19 nt, Human
uuggaauuuucugcagcaa

SEQ ID NO: 645493 - RNA, 27 nt, Human
uuuaacccuauccaggcaaaaagcagg

SEQ ID NO: 645494 - RNA, 19 nt, Human
uuuucagcuccuccaccuc

SEQ ID NO: 645495 - RNA, 24 nt, Human
uuuuuuuuuuuuuuuuuuuucaag

SEQ ID NO: 645496 - RNA, 23 nt, Human
aacuucugcaguucaugcacacc

SEQ ID NO: 645497 - RNA, 22 nt, Human
accuugcucucuucaaccucca

SEQ ID NO: 645498 - RNA, 19 nt, Human
acggagcugcaggaacuug

SEQ ID NO: 645499 - RNA, 18 nt, Human
acuugguccuccaggugg

SEQ ID NO: 645500 - RNA, 23 nt, Human
agaggucccccgucaggguacgg

SEQ ID NO: 645501 - RNA, 21 nt, Human
agcuccucuagggcccucuuc

SEQ ID NO: 645502 - RNA, 24 nt, Human
aucuuggcucucauggcccucuca

SEQ ID NO: 645503 - RNA, 19 nt, Human
augacuuucaggcccauuc

SEQ ID NO: 645504 - RNA, 25 nt, Human
caacugaauucgaaucaccuugcuc

SEQ ID NO: 645505 - RNA, 28 nt, Human
caacuucugcaguucaugcacacuccuu

SEQ ID NO: 645506 - RNA, 22 nt, Human
cagcucagccucccgcuugcgg

SEQ ID NO: 645507 - RNA, 19 nt, Human
cagcucggccauggagucc

SEQ ID NO: 645508 - RNA, 18 nt, Human
cagcucugacuugccucc

SEQ ID NO: 645509 - RNA, 25 nt, Human
cagcugccucuuguaaucauccacu

SEQ ID NO: 645510 - RNA, 21 nt, Human
cagcuucuuccagggccaccu

SEQ ID NO: 645511 - RNA, 19 nt, Human
caggcucuccacaugcucc

SEQ ID NO: 645512 - RNA, 23 nt, Human
cagggcggccucuuccagcuccc

SEQ ID NO: 645513 - RNA, 22 nt, Human
cccauucugcgaaaagaaucca

SEQ ID NO: 645514 - RNA, 21 nt, Human
cccggauuuucuuuuccugcu

SEQ ID NO: 645515 - RNA, 19 nt, Human
ccgcagcuucagcagcuca

SEQ ID NO: 645516 - RNA, 19 nt, Human
ccgccaugcccucuuccuc

SEQ ID NO: 645517 - RNA, 20 nt, Human
ccgucagcucggccauggag

SEQ ID NO: 645518 - RNA, 21 nt, Human
ccuccagggaagacucagcuu

SEQ ID NO: 645519 - RNA, 21 nt, Human
ccucguaggcagucuugaucu

SEQ ID NO: 645520 - RNA, 20 nt, Human
ccucuaggucccgcuucagg

SEQ ID NO: 645521 - RNA, 22 nt, Human
ccugagcuccuccuccuuggcc

SEQ ID NO: 645522 - RNA, 27 nt, Human
ccugcuucuccuucucugucuuggccc

SEQ ID NO: 645523 - RNA, 18 nt, Human
ccuggcugagcguggcug

SEQ ID NO: 645524 - RNA, 22 nt, Human
cggcggugcugcgagacuuuga

SEQ ID NO: 645525 - RNA, 21 nt, Human
cuagggcccucuucuccuucu

SEQ ID NO: 645526 - RNA, 18 nt, Human
cuaguucuucuuccagcu

SEQ ID NO: 645527 - RNA, 21 nt, Human
cucauggcccucucagcuucu

SEQ ID NO: 645528 - RNA, 23 nt, Human
cuccagggaagacucagcuucuu

SEQ ID NO: 645529 - RNA, 22 nt, Human
cucuagggcccucuucuccuuc

SEQ ID NO: 645530 - RNA, 27 nt, Human
cucuuuuucaccaccuccucgagaucc

SEQ ID NO: 645531 - RNA, 18 nt, Human
cugcagcguggaauucag

SEQ ID NO: 645532 - RNA, 18 nt, Human
cugcagcuggauggugag

SEQ ID NO: 645533 - RNA, 22 nt, Human
cuggauggugaggucauucuuc

SEQ ID NO: 645534 - RNA, 23 nt, Human
cuucucugucuuggccagcgugg

SEQ ID NO: 645535 - RNA, 20 nt, Human
cuucuugccgagccacauuc

SEQ ID NO: 645536 - RNA, 22 nt, Human
cuugacccucugcaggcucucc

SEQ ID NO: 645537 - RNA, 22 nt, Human
cuugcucucuucaaccuccagg

SEQ ID NO: 645538 - RNA, 18 nt, Human
cuuggccuucaucuccuc

SEQ ID NO: 645539 - RNA, 23 nt, Human
gacuugccucccugcuccuccuc

SEQ ID NO: 645540 - RNA, 23 nt, Human
gagccaguuccaacugaauucga

SEQ ID NO: 645541 - RNA, 22 nt, Human
gccaugcccucuuccuccucca

SEQ ID NO: 645542 - RNA, 25 nt, Human
gcgcugcagcucugacuugccuccc

SEQ ID NO: 645543 - RNA, 22 nt, Human
gcgguucugcucgaucuuggcu

SEQ ID NO: 645544 - RNA, 21 nt, Human
gcuuccaccagccccagaaac

SEQ ID NO: 645545 - RNA, 22 nt, Human
ggacucuucauauucccugcuc

SEQ ID NO: 645546 - RNA, 22 nt, Human
ggccauggaguccacgugcuuc

SEQ ID NO: 645547 - RNA, 24 nt, Human
ggugguucaccuuguccuccucag

SEQ ID NO: 645548 - RNA, 21 nt, Human
gucagcuuuaaccugagccag

SEQ ID NO: 645549 - RNA, 18 nt, Human
uaucuccuccugcagggu

SEQ ID NO: 645550 - RNA, 18 nt, Human
ucaaucucagccuucaug

SEQ ID NO: 645551 - RNA, 19 nt, Human
ucaaucucagccuucauga

SEQ ID NO: 645552 - RNA, 24 nt, Human
ucaccuuguccuccucagccugua

SEQ ID NO: 645553 - RNA, 24 nt, Human
ucagcuccccuuccaacuugcgcu

SEQ ID NO: 645554 - RNA, 19 nt, Human
ucaggaguggcuugaccuu

SEQ ID NO: 645555 - RNA, 21 nt, Human
uccaaaucccucuuuuucacc

SEQ ID NO: 645556 - RNA, 25 nt, Human
ucccugcuccuccuccagcugcucc

SEQ ID NO: 645557 - RNA, 21 nt, Human
uccgcugcagcguggaauuca

SEQ ID NO: 645558 - RNA, 20 nt, Human
uccuccuccagcugcuccuu

SEQ ID NO: 645559 - RNA, 18 nt, Human
uccuccugcagggucuua

SEQ ID NO: 645560 - RNA, 21 nt, Human
uccuggguuugggccauggcu

SEQ ID NO: 645561 - RNA, 23 nt, Human
uccuggguuugggccauggcuuu

SEQ ID NO: 645562 - RNA, 26 nt, Human
uccuggugcuccuucaguuuccgcug

SEQ ID NO: 645563 - RNA, 18 nt, Human
ucuaguucuucuuccagc

SEQ ID NO: 645564 - RNA, 20 nt, Human
ucuaguucuucuuccagcuc

SEQ ID NO: 645565 - RNA, 22 nt, Human
ucucagcuuuccgacgagccuu

SEQ ID NO: 645566 - RNA, 20 nt, Human
ucucuagcuuggacuugacc

SEQ ID NO: 645567 - RNA, 23 nt, Human
ucucuugcucagccugcagcugg

SEQ ID NO: 645568 - RNA, 20 nt, Human
ucugauaagcugucuuccag

SEQ ID NO: 645569 - RNA, 22 nt, Human
ucugcagggcggccucuuccag

SEQ ID NO: 645570 - RNA, 25 nt, Human
ucuucaggucacucucagcuuuccg

SEQ ID NO: 645571 - RNA, 19 nt, Human
ugaaugacuuucaggccca

SEQ ID NO: 645572 - RNA, 20 nt, Human
ugacccucugcaggcucucc

SEQ ID NO: 645573 - RNA, 22 nt, Human
ugacccucugcaggcucuccac

SEQ ID NO: 645574 - RNA, 21 nt, Human
ugaccuguuuaucuuucucua

SEQ ID NO: 645575 - RNA, 23 nt, Human
ugagauccuuuaucuccuccugc

SEQ ID NO: 645576 - RNA, 23 nt, Human
ugaggccgccaugcccucuuccu

SEQ ID NO: 645577 - RNA, 18 nt, Human
ugaggucauucuucuccu

SEQ ID NO: 645578 - RNA, 20 nt, Human
ugccucccugcuccuccucc

SEQ ID NO: 645579 - RNA, 23 nt, Human
ugccucccugcuccuccuccagc

SEQ ID NO: 645580 - RNA, 19 nt, Human
ugcuucuccuucucugucu

SEQ ID NO: 645581 - RNA, 20 nt, Human
uggcucucauggcccucuca

SEQ ID NO: 645582 - RNA, 21 nt, Human
uggcugagcguggcugucuuc

SEQ ID NO: 645583 - RNA, 25 nt, Human
ugugauccagggccugcuucuccuu

SEQ ID NO: 645584 - RNA, 19 nt, Human
uuacuagguccaggucgug

SEQ ID NO: 645585 - RNA, 25 nt, Human
uucaauucgguccuggugcuccuuc

SEQ ID NO: 645586 - RNA, 22 nt, Human
uucaccaccuccucgagaucca

SEQ ID NO: 645587 - RNA, 18 nt, Human
uuccaccuccgcccggau

SEQ ID NO: 645588 - RNA, 23 nt, Human
uuccaggcccucuaggucccgcu

SEQ ID NO: 645589 - RNA, 22 nt, Human
uucucuugcucagccugcagcu

SEQ ID NO: 645590 - RNA, 22 nt, Human
uugcucucuucaaccuccaggg

SEQ ID NO: 645591 - RNA, 22 nt, Human
uuggacacgaggcgcugcagcu

SEQ ID NO: 645592 - RNA, 19 nt, Human
uuggaggcggguccugaug

SEQ ID NO: 645593 - RNA, 22 nt, Human
uuggugauggagucuucacgga

SEQ ID NO: 645594 - RNA, 24 nt, Human
uuguacagcuuccaccagccccag

SEQ ID NO: 645595 - RNA, 21 nt, Human
uuuccaucuccaauuuuuucu

SEQ ID NO: 645596 - RNA, 20 nt, Human
uuuccugagcuccuccuccu

SEQ ID NO: 645597 - RNA, 23 nt, Human
uuucgaguugacagaguuuauuu

SEQ ID NO: 645598 - RNA, 20 nt, Human
uuuucaccaccuccucgaga

SEQ ID NO: 645599 - RNA, 23 nt, Human
aaagaaacccugaucucaauuca

SEQ ID NO: 645600 - RNA, 24 nt, Human
aaagugcugggauuacagguguga

SEQ ID NO: 645601 - RNA, 21 nt, Human
aacagguaauuuuaacagaug

SEQ ID NO: 645602 - RNA, 19 nt, Human
aagaguuaaacuaaugagu

SEQ ID NO: 645603 - RNA, 21 nt, Human
aagcaaauauacgauaaaacu

SEQ ID NO: 645604 - RNA, 20 nt, Human
aagggguuucaccauguugg

SEQ ID NO: 645605 - RNA, 23 nt, Human
aagguucugaacaugagugauuc

SEQ ID NO: 645606 - RNA, 18 nt, Human
aagugcugggauuacagg

SEQ ID NO: 645607 - RNA, 19 nt, Human
aagugcugggauuacaggu

SEQ ID NO: 645608 - RNA, 26 nt, Human
aagugcugggauuacaggugugagcc

SEQ ID NO: 645609 - RNA, 25 nt, Human
aauaauacagugggguuguauacaa

SEQ ID NO: 645610 - RNA, 24 nt, Human
accauguuggccaggcugaucucg

SEQ ID NO: 645611 - RNA, 18 nt, Human
agacaaggaaucaaagca

SEQ ID NO: 645612 - RNA, 20 nt, Human
agagaagggguuucaccaug

SEQ ID NO: 645613 - RNA, 25 nt, Human
aggcuggagugcaguggcaugaucu

SEQ ID NO: 645614 - RNA, 24 nt, Human
agggguuucaccauguuggccagg

SEQ ID NO: 645615 - RNA, 22 nt, Human
aggugauccgccagucugggcc

SEQ ID NO: 645616 - RNA, 20 nt, Human
agugcaguggcaugaucucg

SEQ ID NO: 645617 - RNA, 23 nt, Human
agugcaguggcaugaucucggcu

SEQ ID NO: 645618 - RNA, 24 nt, Human
agugcaguggcaugaucucggcuc

SEQ ID NO: 645619 - RNA, 24 nt, Human
aguggcaugaucucggcucacugc

SEQ ID NO: 645620 - RNA, 23 nt, Human
auaaaacagacaaggaaucaaag

SEQ ID NO: 645621 - RNA, 19 nt, Human
auauuacaaugaaaaaagg

SEQ ID NO: 645622 - RNA, 26 nt, Human
caaaaaauacuguuuaacaacacuau

SEQ ID NO: 645623 - RNA, 23 nt, Human
caaaaagcuauccacccgccccc

SEQ ID NO: 645624 - RNA, 22 nt, Human
caaaguaacuuaguuaagaaag

SEQ ID NO: 645625 - RNA, 24 nt, Human
caaagugcugggauuacaggugug

SEQ ID NO: 645626 - RNA, 23 nt, Human
caaccuccaccucccagguucaa

SEQ ID NO: 645627 - RNA, 21 nt, Human
caccauguuggccaggcugau

SEQ ID NO: 645628 - RNA, 24 nt, Human
caccauguuggccaggcugaucuc

SEQ ID NO: 645629 - RNA, 21 nt, Human
cacgucuggcuaauuuuugua

SEQ ID NO: 645630 - RNA, 21 nt, Human
cacugcaaccuccaccuccca

SEQ ID NO: 645631 - RNA, 24 nt, Human
caguagagaagggguuucaccaug

SEQ ID NO: 645632 - RNA, 23 nt, Human
cauguuggccaggcugaucucga

SEQ ID NO: 645633 - RNA, 21 nt, Human
ccaaagugcugggauuacagg

SEQ ID NO: 645634 - RNA, 21 nt, Human
ccaaagugcugggauuacagg

SEQ ID NO: 645635 - RNA, 24 nt, Human
ccaaagugcugggauuacaggugu

SEQ ID NO: 645636 - RNA, 20 nt, Human
ccacccgcccccaaaaaaua

SEQ ID NO: 645637 - RNA, 24 nt, Human
ccaccucccagguucaagcgauuc

SEQ ID NO: 645638 - RNA, 20 nt, Human
cccagguucaagcgauucuc

SEQ ID NO: 645639 - RNA, 24 nt, Human
ccucccagguucaagcgauucucc

SEQ ID NO: 645640 - RNA, 18 nt, Human
ccugaccucaggugaucc

SEQ ID NO: 645641 - RNA, 23 nt, Human
cggccucagcuccugggcagcuu

SEQ ID NO: 645642 - RNA, 23 nt, Human
cuagaguacccuuauucaaccag

SEQ ID NO: 645643 - RNA, 23 nt, Human
cuauaaugcucccuugaagcaca

SEQ ID NO: 645644 - RNA, 24 nt, Human
cucacugcaaccuccaccucccag

SEQ ID NO: 645645 - RNA, 20 nt, Human
cucuguugcccaggcuggag

SEQ ID NO: 645646 - RNA, 21 nt, Human
cugaaaucagaaucuaaagaa

SEQ ID NO: 645647 - RNA, 23 nt, Human
cugcaaccuccaccucccagguu

SEQ ID NO: 645648 - RNA, 24 nt, Human
cuggagugcaguggcaugaucucg

SEQ ID NO: 645649 - RNA, 21 nt, Human
cugggccucccaaagugcugg

SEQ ID NO: 645650 - RNA, 19 nt, Human
gaagggguuucaccauguu

SEQ ID NO: 645651 - RNA, 22 nt, Human
gaagggguuucaccauguuggc

SEQ ID NO: 645652 - RNA, 18 nt, Human
gaccucaggugauccgcc

SEQ ID NO: 645653 - RNA, 21 nt, Human
gagauggagucuugcucuguu

SEQ ID NO: 645654 - RNA, 18 nt, Human
gauuacagguaugugcca

SEQ ID NO: 645655 - RNA, 18 nt, Human
gauuacaggugugagcca

SEQ ID NO: 645656 - RNA, 21 nt, Human
gauuacaggugugagccacca

SEQ ID NO: 645657 - RNA, 22 nt, Human
gauuacaggugugagccaccac

SEQ ID NO: 645658 - RNA, 22 nt, Human
gcaaccuccaccucccagguuc

SEQ ID NO: 645659 - RNA, 22 nt, Human
gcagcuuggauuacagguaugu

SEQ ID NO: 645660 - RNA, 24 nt, Human
gcccaggcuggagugcaguggcau

SEQ ID NO: 645661 - RNA, 25 nt, Human
gcucuguugcccaggcuggagugca

SEQ ID NO: 645662 - RNA, 23 nt, Human
gcugaucucgaucuccugaccuc

SEQ ID NO: 645663 - RNA, 23 nt, Human
ggagucuugcucuguugcccagg

SEQ ID NO: 645664 - RNA, 19 nt, Human
ggauuacagguaugugcca

SEQ ID NO: 645665 - RNA, 22 nt, Human
ggauuacagguaugugccauca

SEQ ID NO: 645666 - RNA, 22 nt, Human
gggguuucaccauguuggccag

SEQ ID NO: 645667 - RNA, 23 nt, Human
gggguuucaccauguuggccagg

SEQ ID NO: 645668 - RNA, 24 nt, Human
gugcuuuaauuaaaaagcaagcaa

SEQ ID NO: 645669 - RNA, 20 nt, Human
uaaaaagcaagcaaauauac

SEQ ID NO: 645670 - RNA, 23 nt, Human
uaaaacagacaaggaaucaaagc

SEQ ID NO: 645671 - RNA, 21 nt, Human
uaaaaugcacccuggaaaaga

SEQ ID NO: 645672 - RNA, 18 nt, Human
uaaccaaauauuucauuu

SEQ ID NO: 645673 - RNA, 30 nt, Human
uaagaauaaacagguaauuuuaacagaugg

SEQ ID NO: 645674 - RNA, 24 nt, Human
uaauuauacagaagcgaucggagc

SEQ ID NO: 645675 - RNA, 24 nt, Human
uaauuuuuguauuuucaguagaga

SEQ ID NO: 645676 - RNA, 19 nt, Human
uacagguaugugccaucac

SEQ ID NO: 645677 - RNA, 24 nt, Human
uacaggugugagccaccacgccca

SEQ ID NO: 645678 - RNA, 23 nt, Human
uacagugggguuguauacaacuu

SEQ ID NO: 645679 - RNA, 21 nt, Human
uagagaagggguuucaccaug

SEQ ID NO: 645680 - RNA, 22 nt, Human
uagagaagggguuucaccaugu

SEQ ID NO: 645681 - RNA, 24 nt, Human
uaguaagaaauuauaauuauacag

SEQ ID NO: 645682 - RNA, 19 nt, Human
ucaaagcacagauccugaa

SEQ ID NO: 645683 - RNA, 19 nt, Human
ucaaagcacagauccugaa

SEQ ID NO: 645684 - RNA, 23 nt, Human
ucacugcaaccuccaccucccag

SEQ ID NO: 645685 - RNA, 24 nt, Human
ucacugcaaccuccaccucccagg

SEQ ID NO: 645686 - RNA, 27 nt, Human
ucacugcaaccuccaccucccagguuc

SEQ ID NO: 645687 - RNA, 24 nt, Human
ucaguagagaagggguuucaccau

SEQ ID NO: 645688 - RNA, 23 nt, Human
ucccaaagugcugggauuacagg

SEQ ID NO: 645689 - RNA, 21 nt, Human
ucccagguucaagcgauucuc

SEQ ID NO: 645690 - RNA, 22 nt, Human
ucccagguucaagcgauucucc

SEQ ID NO: 645691 - RNA, 24 nt, Human
uccugggcagcuuggauuacaggu

SEQ ID NO: 645692 - RNA, 19 nt, Human
ucuaaagaaaauaauacag

SEQ ID NO: 645693 - RNA, 23 nt, Human
ucuacauaaaacuagaguacccu

SEQ ID NO: 645694 - RNA, 18 nt, Human
ucuguugcccaggcugga

SEQ ID NO: 645695 - RNA, 24 nt, Human
ucuguugcccaggcuggagugcag

SEQ ID NO: 645696 - RNA, 23 nt, Human
ucuugcucuguugcccaggcugg

SEQ ID NO: 645697 - RNA, 24 nt, Human
ucuugcucuguugcccaggcugga

SEQ ID NO: 645698 - RNA, 18 nt, Human
ugaccucaggugauccgc

SEQ ID NO: 645699 - RNA, 19 nt, Human
ugaccucaggugauccgcc

SEQ ID NO: 645700 - RNA, 20 nt, Human
ugaccucaggugauccgcca

SEQ ID NO: 645701 - RNA, 20 nt, Human
ugaccucaggugauccgcca

SEQ ID NO: 645702 - RNA, 24 nt, Human
ugacugacaggcaaaccagccuuc

SEQ ID NO: 645703 - RNA, 18 nt, Human
ugagucuauaggaguccg

SEQ ID NO: 645704 - RNA, 18 nt, Human
ugcccaggcuggagugca

SEQ ID NO: 645705 - RNA, 21 nt, Human
ugcccaggcuggagugcagug

SEQ ID NO: 645706 - RNA, 22 nt, Human
ugcccaggcuggagugcagugg

SEQ ID NO: 645707 - RNA, 24 nt, Human
ugcccaggcuggagugcaguggca

SEQ ID NO: 645708 - RNA, 24 nt, Human
ugcugggauuacaggugugagcca

SEQ ID NO: 645709 - RNA, 24 nt, Human
uggagucuugcucuguugcccagg

SEQ ID NO: 645710 - RNA, 19 nt, Human
uggagugcaguggcaugau

SEQ ID NO: 645711 - RNA, 24 nt, Human
uggagugcaguggcaugaucucgg

SEQ ID NO: 645712 - RNA, 19 nt, Human
uggauuacagguaugugcc

SEQ ID NO: 645713 - RNA, 20 nt, Human
uggauuacagguaugugcca

SEQ ID NO: 645714 - RNA, 24 nt, Human
uggccaggcugaucucgaucuccu

SEQ ID NO: 645715 - RNA, 18 nt, Human
ugggauuacaggugugag

SEQ ID NO: 645716 - RNA, 19 nt, Human
ugggauuacaggugugagc

SEQ ID NO: 645717 - RNA, 22 nt, Human
ugggauuacaggugugagccac

SEQ ID NO: 645718 - RNA, 23 nt, Human
ugggauuacaggugugagccacc

SEQ ID NO: 645719 - RNA, 24 nt, Human
ugggauuacaggugugagccacca

SEQ ID NO: 645720 - RNA, 24 nt, Human
uggucaaugcauggcuauaacaac

SEQ ID NO: 645721 - RNA, 27 nt, Human
uuaacggcuuccucuaauggauuuucu

SEQ ID NO: 645722 - RNA, 23 nt, Human
uucaaauaaacuucaauaucugc

SEQ ID NO: 645723 - RNA, 22 nt, Human
uucaacaauuuuaccagugaau

SEQ ID NO: 645724 - RNA, 23 nt, Human
uucaagcgauucuccggccucag

SEQ ID NO: 645725 - RNA, 21 nt, Human
uucuccggccucagcuccugg

SEQ ID NO: 645726 - RNA, 21 nt, Human
uucuugccugugggcuuuuaa

SEQ ID NO: 645727 - RNA, 24 nt, Human
uugcccaggcuggagugcaguggc

SEQ ID NO: 645728 - RNA, 24 nt, Human
uugcucuguugcccaggcuggagu

SEQ ID NO: 645729 - RNA, 22 nt, Human
uuggauuacagguaugugccau

SEQ ID NO: 645730 - RNA, 24 nt, Human
uuggauuacagguaugugccauca

SEQ ID NO: 645731 - RNA, 24 nt, Human
uuggcaggucggguaaagaacaaa

SEQ ID NO: 645732 - RNA, 21 nt, Human
uuuacagcgaguuuuucccgu

SEQ ID NO: 645733 - RNA, 21 nt, Human
uuucaccauguuggccaggcu

SEQ ID NO: 645734 - RNA, 24 nt, Human
uuuucaguagagaagggguuucac

SEQ ID NO: 645735 - RNA, 20 nt, Human
uuuuuguauuuucaguagag

SEQ ID NO: 645736 - RNA, 24 nt, Human
aaaaaaaaaguggaagccucaagg

SEQ ID NO: 645737 - RNA, 19 nt, Human
aaacaacaggagauauuac

SEQ ID NO: 645738 - RNA, 25 nt, Human
aaacaacccccuuccccuagcuccu

SEQ ID NO: 645739 - RNA, 24 nt, Human
aaaugaccagaauugauccaagua

SEQ ID NO: 645740 - RNA, 19 nt, Human
aagaagagaacugguggcu

SEQ ID NO: 645741 - RNA, 23 nt, Human
aagagaacagaaaaacaaaucca

SEQ ID NO: 645742 - RNA, 20 nt, Human
aagcagacuucucaugggga

SEQ ID NO: 645743 - RNA, 19 nt, Human
aaggaagaagagaacuggu

SEQ ID NO: 645744 - RNA, 19 nt, Human
aaggcaaacaacccccuuc

SEQ ID NO: 645745 - RNA, 18 nt, Human
aagugucucagaacccca

SEQ ID NO: 645746 - RNA, 21 nt, Human
aagugucucagaaccccacca

SEQ ID NO: 645747 - RNA, 20 nt, Human
aauagucaaacaucuucccc

SEQ ID NO: 645748 - RNA, 24 nt, Human
aaucuaugacagagacccaaucca

SEQ ID NO: 645749 - RNA, 22 nt, Human
acacacccacugaaggguucca

SEQ ID NO: 645750 - RNA, 22 nt, Human
acacuugaggccuccauccucu

SEQ ID NO: 645751 - RNA, 18 nt, Human
acaggacagaagagaaca

SEQ ID NO: 645752 - RNA, 21 nt, Human
acaggagauauuacaaagauc

SEQ ID NO: 645753 - RNA, 21 nt, Human
acccuggcccaucauuccagc

SEQ ID NO: 645754 - RNA, 21 nt, Human
agaaaaacaaauccaacugga

SEQ ID NO: 645755 - RNA, 25 nt, Human
agaaacaacaggagauauuacaaag

SEQ ID NO: 645756 - RNA, 25 nt, Human
agagggaagaaaaaugggcaaagag

SEQ ID NO: 645757 - RNA, 24 nt, Human
agcaauagucaaacaucuuccccc

SEQ ID NO: 645758 - RNA, 18 nt, Human
aggaagagagggaagaaa

SEQ ID NO: 645759 - RNA, 24 nt, Human
aggaagagagggaagaaaaauggg

SEQ ID NO: 645760 - RNA, 22 nt, Human
aggagauauuacaaagaucaag

SEQ ID NO: 645761 - RNA, 21 nt, Human
aggauggaguuaucuggaugg

SEQ ID NO: 645762 - RNA, 23 nt, Human
agggaagaaaaaugggcaaagag

SEQ ID NO: 645763 - RNA, 25 nt, Human
agggaagaaaaaugggcaaagagga

SEQ ID NO: 645764 - RNA, 21 nt, Human
aggugugagguucuggugaag

SEQ ID NO: 645765 - RNA, 24 nt, Human
aggugugagguucuggugaagagc

SEQ ID NO: 645766 - RNA, 23 nt, Human
aguauaagacaggacagaagaga

SEQ ID NO: 645767 - RNA, 20 nt, Human
agugucauccauccuagggc

SEQ ID NO: 645768 - RNA, 22 nt, Human
aguugcugaugcccagcuuuau

SEQ ID NO: 645769 - RNA, 19 nt, Human
aucgggggaaagggagaug

SEQ ID NO: 645770 - RNA, 18 nt, Human
caaacaacccccuucccc

SEQ ID NO: 645771 - RNA, 22 nt, Human
caaacaucuucccccaggcuug

SEQ ID NO: 645772 - RNA, 21 nt, Human
caacccccuuccccuagcucc

SEQ ID NO: 645773 - RNA, 24 nt, Human
cagaaaaacaaauccaacuggaaa

SEQ ID NO: 645774 - RNA, 24 nt, Human
cagccugaauuuagcaaaggaaga

SEQ ID NO: 645775 - RNA, 23 nt, Human
caggagggaagcaugccauagug

SEQ ID NO: 645776 - RNA, 23 nt, Human
cagguccugaagaaggcaaacaa

SEQ ID NO: 645777 - RNA, 19 nt, Human
cagucuucugacaggaaga

SEQ ID NO: 645778 - RNA, 20 nt, Human
caucauuccagccuccaaaa

SEQ ID NO: 645779 - RNA, 18 nt, Human
caucgggggaaagggaga

SEQ ID NO: 645780 - RNA, 22 nt, Human
caugccugcacccacaucugua

SEQ ID NO: 645781 - RNA, 21 nt, Human
ccacaggccaguugcugaugc

SEQ ID NO: 645782 - RNA, 23 nt, Human
ccaccaggagggaagcaugccau

SEQ ID NO: 645783 - RNA, 18 nt, Human
ccagaguaguugcuugag

SEQ ID NO: 645784 - RNA, 22 nt, Human
ccauccucuugaaaugaccaga

SEQ ID NO: 645785 - RNA, 22 nt, Human
cccaagugucucagaaccccac

SEQ ID NO: 645786 - RNA, 24 nt, Human
cccacaauucccccaagugucuca

SEQ ID NO: 645787 - RNA, 19 nt, Human
cccacacuugaggccucca

SEQ ID NO: 645788 - RNA, 18 nt, Human
cccaggagaggugugagg

SEQ ID NO: 645789 - RNA, 21 nt, Human
ccuaacuggguacuccucuug

SEQ ID NO: 645790 - RNA, 19 nt, Human
ccuccaaaacuggccacac

SEQ ID NO: 645791 - RNA, 22 nt, Human
ccuccaaaacuggccacacacc

SEQ ID NO: 645792 - RNA, 24 nt, Human
ccugcacccacaucuguaguaucu

SEQ ID NO: 645793 - RNA, 25 nt, Human
cuacacccuggcccaucauuccagc

SEQ ID NO: 645794 - RNA, 24 nt, Human
cucgacaggauggaguuaucugga

SEQ ID NO: 645795 - RNA, 25 nt, Human
cucuuaggucccaccucugugaggu

SEQ ID NO: 645796 - RNA, 20 nt, Human
gaaaaaggggugggagaagg

SEQ ID NO: 645797 - RNA, 24 nt, Human
gaaacaacaggagauauuacaaag

SEQ ID NO: 645798 - RNA, 20 nt, Human
gaagaaaaaugggcaaagag

SEQ ID NO: 645799 - RNA, 24 nt, Human
gagcuucucccuauggccucaugg

SEQ ID NO: 645800 - RNA, 21 nt, Human
gaggaagagagggaagaaaaa

SEQ ID NO: 645801 - RNA, 21 nt, Human
gaggauagcaagaagaauggg

SEQ ID NO: 645802 - RNA, 18 nt, Human
gagguucuggugaagagc

SEQ ID NO: 645803 - RNA, 20 nt, Human
gaguccucuuaggucccacc

SEQ ID NO: 645804 - RNA, 19 nt, Human
gcaaacaacccccuucccc

SEQ ID NO: 645805 - RNA, 21 nt, Human
gcaaagaggaaaaaggacaau

SEQ ID NO: 645806 - RNA, 23 nt, Human
gcaugccugcacccacaucugua

SEQ ID NO: 645807 - RNA, 21 nt, Human
ggaagaaaaaugggcaaagag

SEQ ID NO: 645808 - RNA, 23 nt, Human
ggaagaaaaaugggcaaagagga

SEQ ID NO: 645809 - RNA, 20 nt, Human
ggagaaggaagugugcuagg

SEQ ID NO: 645810 - RNA, 19 nt, Human
ggagcagaagaugaagggg

SEQ ID NO: 645811 - RNA, 22 nt, Human
ggagcuucucccuauggccuca

SEQ ID NO: 645812 - RNA, 21 nt, Human
gggaagaaaaaugggcaaaga

SEQ ID NO: 645813 - RNA, 21 nt, Human
gggagaaggaagugugcuagg

SEQ ID NO: 645814 - RNA, 18 nt, Human
ggggaggaagagagggaa

SEQ ID NO: 645815 - RNA, 24 nt, Human
ggggauggaggauagcaagaagaa

SEQ ID NO: 645816 - RNA, 24 nt, Human
gguucuggugaagagcagcaauag

SEQ ID NO: 645817 - RNA, 22 nt, Human
uacaagcagacuucucaugggg

SEQ ID NO: 645818 - RNA, 24 nt, Human
uacaagcagacuucucauggggag

SEQ ID NO: 645819 - RNA, 26 nt, Human
uagcaagaagaaugggugccuuggcc

SEQ ID NO: 645820 - RNA, 22 nt, Human
uaggggaaguucccacacuuga

SEQ ID NO: 645821 - RNA, 19 nt, Human
uagucaaacaucuuccccc

SEQ ID NO: 645822 - RNA, 23 nt, Human
uaucagcaaaauucagacacuuu

SEQ ID NO: 645823 - RNA, 22 nt, Human
ucacacaucaacuaucuuugga

SEQ ID NO: 645824 - RNA, 21 nt, Human
ucagaaagagccuacucgaca

SEQ ID NO: 645825 - RNA, 23 nt, Human
ucagcaaaauucagacacuuuua

SEQ ID NO: 645826 - RNA, 23 nt, Human
ucaguccagccagauacagagca

SEQ ID NO: 645827 - RNA, 21 nt, Human
ucaucccacacagcaaagugc

SEQ ID NO: 645828 - RNA, 23 nt, Human
uccauccuagggcccaccaggag

SEQ ID NO: 645829 - RNA, 22 nt, Human
ucuaaaaaaaaaaaaaguggaa

SEQ ID NO: 645830 - RNA, 18 nt, Human
ucuaauacuacaagcaga

SEQ ID NO: 645831 - RNA, 20 nt, Human
ucugcauaaucaugaguccu

SEQ ID NO: 645832 - RNA, 21 nt, Human
ucuucuggaaauaaaccuugg

SEQ ID NO: 645833 - RNA, 19 nt, Human
ugaaaggaaacuuuacaug

SEQ ID NO: 645834 - RNA, 26 nt, Human
ugaaaugaccagaauugauccaagua

SEQ ID NO: 645835 - RNA, 22 nt, Human
ugaaugcuuuuggccaucucug

SEQ ID NO: 645836 - RNA, 20 nt, Human
ugaccagaauugauccaagu

SEQ ID NO: 645837 - RNA, 24 nt, Human
ugagugucauccauccuagggccc

SEQ ID NO: 645838 - RNA, 23 nt, Human
ugcugacccacucucuaccccac

SEQ ID NO: 645839 - RNA, 21 nt, Human
ugcuugagccagguccaucug

SEQ ID NO: 645840 - RNA, 23 nt, Human
uggaauugagguaagggaagaga

SEQ ID NO: 645841 - RNA, 27 nt, Human
uggccauauuccaucgugugugugcaa

SEQ ID NO: 645842 - RNA, 19 nt, Human
uggcuagaauauccccaca

SEQ ID NO: 645843 - RNA, 19 nt, Human
uggcuagaauauccccaca

SEQ ID NO: 645844 - RNA, 22 nt, Human
uggcuaggcaggaugaaaggaa

SEQ ID NO: 645845 - RNA, 19 nt, Human
ugggcaaagaggaaaaagg

SEQ ID NO: 645846 - RNA, 21 nt, Human
ugggcaaagaggaaaaaggac

SEQ ID NO: 645847 - RNA, 25 nt, Human
uggugaagagcagcaauagucaaac

SEQ ID NO: 645848 - RNA, 22 nt, Human
uguccagucagguccugaagaa

SEQ ID NO: 645849 - RNA, 18 nt, Human
uguccccuaggagacaca

SEQ ID NO: 645850 - RNA, 22 nt, Human
ugugugcaugccugcacccaca

SEQ ID NO: 645851 - RNA, 21 nt, Human
uuauaugggggcuccaacccc

SEQ ID NO: 645852 - RNA, 27 nt, Human
uuaugucuaaaaaaaaaaaaaguggaa

SEQ ID NO: 645853 - RNA, 27 nt, Human
uucuucuggaaauaaaccuuggggaug

SEQ ID NO: 645854 - RNA, 20 nt, Human
uugaacaucagagagaacca

SEQ ID NO: 645855 - RNA, 22 nt, Human
uuggagcagaagaugaagggga

SEQ ID NO: 645856 - RNA, 20 nt, Human
uuuuuuuuuuuuuuugcugg

SEQ ID NO: 645857 - RNA, 22 nt, Human
aacuuggugguaucuccagccc

SEQ ID NO: 645858 - RNA, 23 nt, Human
aaggagcuuaaggaguuguuuga

SEQ ID NO: 645859 - RNA, 23 nt, Human
acagcugcugggcguccucacac

SEQ ID NO: 645860 - RNA, 25 nt, Human
accauguccagcacggcggccgcgc

SEQ ID NO: 645861 - RNA, 21 nt, Human
accccaugggaggggacccug

SEQ ID NO: 645862 - RNA, 20 nt, Human
agaccgccccccacuccaac

SEQ ID NO: 645863 - RNA, 23 nt, Human
agcaaaggcagaccgccccccac

SEQ ID NO: 645864 - RNA, 25 nt, Human
agcaggugggaggcuggcacgugca

SEQ ID NO: 645865 - RNA, 22 nt, Human
agccacaacaccccaagaaggc

SEQ ID NO: 645866 - RNA, 20 nt, Human
agcccggaucauagcagcga

SEQ ID NO: 645867 - RNA, 19 nt, Human
agcugcagggcagaggccu

SEQ ID NO: 645868 - RNA, 18 nt, Human
agcuggccucugagcgga

SEQ ID NO: 645869 - RNA, 21 nt, Human
aggaagcaggugggaggcugg

SEQ ID NO: 645870 - RNA, 19 nt, Human
aggcuccaggagggccccg

SEQ ID NO: 645871 - RNA, 22 nt, Human
aggcugcaccgggcgcaugcgg

SEQ ID NO: 645872 - RNA, 18 nt, Human
aggcuggcacgugcaggc

SEQ ID NO: 645873 - RNA, 23 nt, Human
agggaauggccagcaggaggagg

SEQ ID NO: 645874 - RNA, 20 nt, Human
agggggcagcggcugcuggg

SEQ ID NO: 645875 - RNA, 24 nt, Human
agggggcaggcucggguagccugc

SEQ ID NO: 645876 - RNA, 19 nt, Human
auggccucaaacagcucga

SEQ ID NO: 645877 - RNA, 19 nt, Human
auuggccacgcauccagcc

SEQ ID NO: 645878 - RNA, 20 nt, Human
auuuugauuaaaccuugcug

SEQ ID NO: 645879 - RNA, 21 nt, Human
caaaggcagaccgccccccac

SEQ ID NO: 645880 - RNA, 26 nt, Human
caacaccccaagaaggcuccaggagg

SEQ ID NO: 645881 - RNA, 24 nt, Human
caagcaguaaagacuugcaaagca

SEQ ID NO: 645882 - RNA, 19 nt, Human
caccauguccagcacggcg

SEQ ID NO: 645883 - RNA, 18 nt, Human
caccccaagaaggcucca

SEQ ID NO: 645884 - RNA, 20 nt, Human
caccccaagaaggcuccagg

SEQ ID NO: 645885 - RNA, 23 nt, Human
cacccugcagccccucaggugga

SEQ ID NO: 645886 - RNA, 20 nt, Human
cagaauggcagcauguccug

SEQ ID NO: 645887 - RNA, 20 nt, Human
cagcaccccccgacuggccc

SEQ ID NO: 645888 - RNA, 23 nt, Human
cagcauguccuguggccugggcu

SEQ ID NO: 645889 - RNA, 19 nt, Human
cagcccggaucauagcagc

SEQ ID NO: 645890 - RNA, 20 nt, Human
cagcuuaccccugccuaggg

SEQ ID NO: 645891 - RNA, 22 nt, Human
caggagggcaccaggccuggca

SEQ ID NO: 645892 - RNA, 24 nt, Human
caggucccggggcagcugcaggag

SEQ ID NO: 645893 - RNA, 20 nt, Human
caugcgggugugggccaggg

SEQ ID NO: 645894 - RNA, 22 nt, Human
ccaacuucaggggcuggacaug

SEQ ID NO: 645895 - RNA, 23 nt, Human
ccaccuccaagcaguaaagacuu

SEQ ID NO: 645896 - RNA, 18 nt, Human
ccagccacaacaccccaa

SEQ ID NO: 645897 - RNA, 20 nt, Human
ccauggcacugccugccagc

SEQ ID NO: 645898 - RNA, 20 nt, Human
cccaacucagccaccuccaa

SEQ ID NO: 645899 - RNA, 22 nt, Human
cccagccacaacaccccaagaa

SEQ ID NO: 645900 - RNA, 26 nt, Human
ccccaagaaggcuccaggagggcccc

SEQ ID NO: 645901 - RNA, 25 nt, Human
ccccacuccaacuucaggggcugga

SEQ ID NO: 645902 - RNA, 19 nt, Human
ccccccacuccaacuucag

SEQ ID NO: 645903 - RNA, 22 nt, Human
ccccccacuccaacuucagggg

SEQ ID NO: 645904 - RNA, 21 nt, Human
cccuuggcaggcugcaccggg

SEQ ID NO: 645905 - RNA, 18 nt, Human
ccgccccccacuccaacu

SEQ ID NO: 645906 - RNA, 18 nt, Human
ccggggcccagucccagc

SEQ ID NO: 645907 - RNA, 26 nt, Human
ccuagggcccccaacucagccaccuc

SEQ ID NO: 645908 - RNA, 21 nt, Human
ccucugagcggaugaucucca

SEQ ID NO: 645909 - RNA, 23 nt, Human
ccuggcagggggcaggcucgggu

SEQ ID NO: 645910 - RNA, 24 nt, Human
ccuugcugggcugaagggcaggca

SEQ ID NO: 645911 - RNA, 19 nt, Human
cgugcaggcgguccaggag

SEQ ID NO: 645912 - RNA, 21 nt, Human
cuccaagcaguaaagacuugc

SEQ ID NO: 645913 - RNA, 25 nt, Human
cuccagggacagcugcugggcgucc

SEQ ID NO: 645914 - RNA, 21 nt, Human
cucgaccagugcccggaaggc

SEQ ID NO: 645915 - RNA, 18 nt, Human
cucuuuuccgcuuccucc

SEQ ID NO: 645916 - RNA, 25 nt, Human
cugcaggaggucgggguggcucuuu

SEQ ID NO: 645917 - RNA, 26 nt, Human
cuuggccuugggccugggccugaggc

SEQ ID NO: 645918 - RNA, 24 nt, Human
cuuuuuauuggccacgcauccagc

SEQ ID NO: 645919 - RNA, 24 nt, Human
gaacgggggccagaccccauggga

SEQ ID NO: 645920 - RNA, 18 nt, Human
gacacuggcaggacgcag

SEQ ID NO: 645921 - RNA, 24 nt, Human
gacgcagcaccccccgacuggccc

SEQ ID NO: 645922 - RNA, 24 nt, Human
gcagaccgccccccacuccaacuu

SEQ ID NO: 645923 - RNA, 20 nt, Human
gcagcuggcggcuggugagc

SEQ ID NO: 645924 - RNA, 22 nt, Human
gccuagggcccccaacucagcc

SEQ ID NO: 645925 - RNA, 22 nt, Human
gccugccagcuuaccccugccu

SEQ ID NO: 645926 - RNA, 18 nt, Human
gcugggugucacccugca

SEQ ID NO: 645927 - RNA, 21 nt, Human
ggcagcugcaggaggucgggg

SEQ ID NO: 645928 - RNA, 23 nt, Human
ggcaguggcagcaaaggcagacc

SEQ ID NO: 645929 - RNA, 23 nt, Human
ggccuugggccugggccugaggc

SEQ ID NO: 645930 - RNA, 18 nt, Human
gggaauggccagcaggag

SEQ ID NO: 645931 - RNA, 21 nt, Human
gggaggcuggcacgugcaggc

SEQ ID NO: 645932 - RNA, 23 nt, Human
gggcagcuggcggcuggugagca

SEQ ID NO: 645933 - RNA, 18 nt, Human
gggcgcaugcgggugugg

SEQ ID NO: 645934 - RNA, 23 nt, Human
gggugugggccaggguugccuuu

SEQ ID NO: 645935 - RNA, 19 nt, Human
guaaggcacggaguuuugg

SEQ ID NO: 645936 - RNA, 18 nt, Human
guagccugcccucgcugg

SEQ ID NO: 645937 - RNA, 20 nt, Human
gugagggggcagcggcugcu

SEQ ID NO: 645938 - RNA, 19 nt, Human
gugcagcagcgucacgcgg

SEQ ID NO: 645939 - RNA, 20 nt, Human
gugcagcagcgucacgcggu

SEQ ID NO: 645940 - RNA, 22 nt, Human
uaccccugccuagggcccccaa

SEQ ID NO: 645941 - RNA, 21 nt, Human
uagaaguggucggcgcuggcc

SEQ ID NO: 645942 - RNA, 19 nt, Human
uagggcccccaacucagcc

SEQ ID NO: 645943 - RNA, 22 nt, Human
ucacccugcagccccucaggug

SEQ ID NO: 645944 - RNA, 20 nt, Human
ucaggggcuggacaugcugg

SEQ ID NO: 645945 - RNA, 19 nt, Human
uccagaagcuucuucaggu

SEQ ID NO: 645946 - RNA, 23 nt, Human
ucccagccacaacaccccaagaa

SEQ ID NO: 645947 - RNA, 18 nt, Human
ucucacuuggccuuggga

SEQ ID NO: 645948 - RNA, 24 nt, Human
ucuccaggcugaucccugcugcuu

SEQ ID NO: 645949 - RNA, 22 nt, Human
ugagggggcagcggcugcuggg

SEQ ID NO: 645950 - RNA, 22 nt, Human
ugccuagggcccccaacucagc

SEQ ID NO: 645951 - RNA, 18 nt, Human
ugcugggcugaagggcag

SEQ ID NO: 645952 - RNA, 19 nt, Human
ugcugggcugaagggcagg

SEQ ID NO: 645953 - RNA, 19 nt, Human
uggcacugccugccagcuu

SEQ ID NO: 645954 - RNA, 18 nt, Human
uggcagcaaaggcagacc

SEQ ID NO: 645955 - RNA, 18 nt, Human
uggcagggcacuggugcc

SEQ ID NO: 645956 - RNA, 22 nt, Human
uggcagggcacuggugccuguc

SEQ ID NO: 645957 - RNA, 21 nt, Human
uggcagggggcaggcucgggu

SEQ ID NO: 645958 - RNA, 22 nt, Human
uggcaguggcagcaaaggcaga

SEQ ID NO: 645959 - RNA, 23 nt, Human
uggcaguggcagcaaaggcagac

SEQ ID NO: 645960 - RNA, 18 nt, Human
uggccucaaacagcucga

SEQ ID NO: 645961 - RNA, 21 nt, Human
uggccuggaggcgcucggugu

SEQ ID NO: 645962 - RNA, 18 nt, Human
uggccugggcucucucac

SEQ ID NO: 645963 - RNA, 24 nt, Human
ugggaggcuggcacgugcaggcgg

SEQ ID NO: 645964 - RNA, 22 nt, Human
ugggagggguuuucuguugaug

SEQ ID NO: 645965 - RNA, 21 nt, Human
ugggcucucucacuuggccuu

SEQ ID NO: 645966 - RNA, 24 nt, Human
ugggcucucucacuuggccuuggg

SEQ ID NO: 645967 - RNA, 21 nt, Human
ugggugucacccugcagcccc

SEQ ID NO: 645968 - RNA, 19 nt, Human
ugguagcagggaauggcca

SEQ ID NO: 645969 - RNA, 19 nt, Human
uguauuguccccagggccu

SEQ ID NO: 645970 - RNA, 21 nt, Human
uuauuggccacgcauccagcc

SEQ ID NO: 645971 - RNA, 18 nt, Human
uuccuccagcacgugggc

SEQ ID NO: 645972 - RNA, 21 nt, Human
uucugcugggacuuggucucc

SEQ ID NO: 645973 - RNA, 18 nt, Human
uucuucagguuggagcug

SEQ ID NO: 645974 - RNA, 26 nt, Human
uuuuauuggccacgcauccagccgcc

SEQ ID NO: 645975 - RNA, 18 nt, Human
uuuuuuuuuuuuaggucu

SEQ ID NO: 645976 - RNA, 23 nt, Human
uuuuuuuuuuuuuuuuuuuuagg

SEQ ID NO: 645977 - RNA, 21 nt, Human
aagagcuccuguguggcugcc

SEQ ID NO: 645978 - RNA, 20 nt, Human
aagagcuggucacaggcuga

SEQ ID NO: 645979 - RNA, 25 nt, Human
acacccccuaccccaugaguacgcc

SEQ ID NO: 645980 - RNA, 19 nt, Human
agaacuuacaagguggugg

SEQ ID NO: 645981 - RNA, 18 nt, Human
agaggaagggacacagua

SEQ ID NO: 645982 - RNA, 24 nt, Human
aggaagggacacaguauguacaga

SEQ ID NO: 645983 - RNA, 19 nt, Human
aggccugcaccuccugcug

SEQ ID NO: 645984 - RNA, 25 nt, Human
cagcaacagggaauggaggugccaa

SEQ ID NO: 645985 - RNA, 18 nt, Human
cagcgguaggugccuggg

SEQ ID NO: 645986 - RNA, 20 nt, Human
caggaggcagcgguaggugc

SEQ ID NO: 645987 - RNA, 23 nt, Human
caggggccucuggcucuccaguc

SEQ ID NO: 645988 - RNA, 18 nt, Human
ccacuguuguuccuccgg

SEQ ID NO: 645989 - RNA, 18 nt, Human
cccagagcaccccccuca

SEQ ID NO: 645990 - RNA, 24 nt, Human
cccagagcaccccccucacgagag

SEQ ID NO: 645991 - RNA, 18 nt, Human
ccccagagcaccccccuc

SEQ ID NO: 645992 - RNA, 20 nt, Human
ccccucacgagagaauaaau

SEQ ID NO: 645993 - RNA, 19 nt, Human
cccucccggugacuccgca

SEQ ID NO: 645994 - RNA, 20 nt, Human
cccugcgcccccggcgaucc

SEQ ID NO: 645995 - RNA, 19 nt, Human
ccugcgcccccggcgaucc

SEQ ID NO: 645996 - RNA, 22 nt, Human
ccugcugaggucuccucagaca

SEQ ID NO: 645997 - RNA, 19 nt, Human
cuccucagacacagggggc

SEQ ID NO: 645998 - RNA, 24 nt, Human
cuccugcuguaaggcaggcuccug

SEQ ID NO: 645999 - RNA, 21 nt, Human
cugcaaggccuuuccaaauuc

SEQ ID NO: 646000 - RNA, 22 nt, Human
cugcugaggucuccucagacac

SEQ ID NO: 646001 - RNA, 24 nt, Human
cuguaaggcaggcuccugagacuc

SEQ ID NO: 646002 - RNA, 18 nt, Human
cuucaccauugcgcagcu

SEQ ID NO: 646003 - RNA, 22 nt, Human
cuuuccaaauucacggcugcac

SEQ ID NO: 646004 - RNA, 19 nt, Human
gagcaccccccucacgaga

SEQ ID NO: 646005 - RNA, 22 nt, Human
gaggauucggggugugggcucc

SEQ ID NO: 646006 - RNA, 22 nt, Human
gcagcgggcccugcugaggucu

SEQ ID NO: 646007 - RNA, 24 nt, Human
gccaggaggagggccucugugccc

SEQ ID NO: 646008 - RNA, 18 nt, Human
gcgcccccggcgaucccg

SEQ ID NO: 646009 - RNA, 21 nt, Human
gcuauggucuccaaggugcug

SEQ ID NO: 646010 - RNA, 19 nt, Human
gcucaggggccucuggcuc

SEQ ID NO: 646011 - RNA, 22 nt, Human
ggaauggaggugccaaagagga

SEQ ID NO: 646012 - RNA, 21 nt, Human
ggacacccccuaccccaugag

SEQ ID NO: 646013 - RNA, 22 nt, Human
gggaauggaggugccaaagagg

SEQ ID NO: 646014 - RNA, 23 nt, Human
gggaauggaggugccaaagagga

SEQ ID NO: 646015 - RNA, 24 nt, Human
gggaauggaggugccaaagaggaa

SEQ ID NO: 646016 - RNA, 20 nt, Human
gggaugggaagaggaaggga

SEQ ID NO: 646017 - RNA, 18 nt, Human
gggccucuggcucuccag

SEQ ID NO: 646018 - RNA, 21 nt, Human
gggccucuggcucuccagucu

SEQ ID NO: 646019 - RNA, 19 nt, Human
ggggaugggaagaggaagg

SEQ ID NO: 646020 - RNA, 22 nt, Human
ggugggacugguguugugggca

SEQ ID NO: 646021 - RNA, 20 nt, Human
ggugguggggaugggaagag

SEQ ID NO: 646022 - RNA, 20 nt, Human
ggugguggggaugggaagga

SEQ ID NO: 646023 - RNA, 24 nt, Human
guggaaggugggggggcaccuuua

SEQ ID NO: 646024 - RNA, 19 nt, Human
gugggggggcaccuuuaug

SEQ ID NO: 646025 - RNA, 24 nt, Human
guuucauuuuuggggucaccagug

SEQ ID NO: 646026 - RNA, 19 nt, Human
uaggugccuggggcagcgg

SEQ ID NO: 646027 - RNA, 27 nt, Human
uaggugccuggggcagcgggcccugcu

SEQ ID NO: 646028 - RNA, 24 nt, Human
uccgggcccugcgcccccggcgau

SEQ ID NO: 646029 - RNA, 19 nt, Human
ucgcugcuauggucuccaa

SEQ ID NO: 646030 - RNA, 24 nt, Human
ucuccaaggugcugguccagacug

SEQ ID NO: 646031 - RNA, 23 nt, Human
ucucugcuggggcuggcucaggg

SEQ ID NO: 646032 - RNA, 24 nt, Human
ucugugccgaaggccaggccacag

SEQ ID NO: 646033 - RNA, 18 nt, Human
ugagacacaggcaccucu

SEQ ID NO: 646034 - RNA, 24 nt, Human
ugcacagggggcacuuaaccucag

SEQ ID NO: 646035 - RNA, 19 nt, Human
ugccaaagaggaagucggg

SEQ ID NO: 646036 - RNA, 22 nt, Human
ugccaaagaggaagucgggcag

SEQ ID NO: 646037 - RNA, 24 nt, Human
ugcgcccccggcgaucccgcccaa

SEQ ID NO: 646038 - RNA, 19 nt, Human
uggaggugccaaagaggaa

SEQ ID NO: 646039 - RNA, 20 nt, Human
uggcaaggggucaggcugag

SEQ ID NO: 646040 - RNA, 20 nt, Human
ugggacugguguugugggca

SEQ ID NO: 646041 - RNA, 19 nt, Human
uggggaugggaagaggaag

SEQ ID NO: 646042 - RNA, 21 nt, Human
ugggggggcaccuuuaugugu

SEQ ID NO: 646043 - RNA, 21 nt, Human
uggucagaagcuggcaagggg

SEQ ID NO: 646044 - RNA, 22 nt, Human
uggucagaagcuggcaaggggu

SEQ ID NO: 646045 - RNA, 18 nt, Human
uguggcugccccgccugc

SEQ ID NO: 646046 - RNA, 21 nt, Human
ugugucaaggaccccagagca

SEQ ID NO: 646047 - RNA, 24 nt, Human
uuaaagacgcccucccggugacuc

SEQ ID NO: 646048 - RNA, 21 nt, Human
uuagaacuuacaagguggugg

SEQ ID NO: 646049 - RNA, 19 nt, Human
uucggggugugggcucgcc

SEQ ID NO: 646050 - RNA, 24 nt, Human
uucuccacuguuguuccuccgggc

SEQ ID NO: 646051 - RNA, 18 nt, Human
uuuuuuuuuuggcaaccc

SEQ ID NO: 646052 - RNA, 19 nt, Human
uuuuuuuuuuuuuuuuugg

SEQ ID NO: 646053 - RNA, 25 nt, Human
aaaagacacagucccugcccacaag

SEQ ID NO: 646054 - RNA, 22 nt, Human
aaagacacagucccugcccaca

SEQ ID NO: 646055 - RNA, 21 nt, Human
aaauaacuagaauacaaggca

SEQ ID NO: 646056 - RNA, 23 nt, Human
aacacgaugaaauaguguugucu

SEQ ID NO: 646057 - RNA, 22 nt, Human
acacagucccugcccacaagga

SEQ ID NO: 646058 - RNA, 21 nt, Human
acauggugcugauauaaguac

SEQ ID NO: 646059 - RNA, 20 nt, Human
agacaaauacacaaauaacu

SEQ ID NO: 646060 - RNA, 24 nt, Human
agcaacaagaaggccuuaaagaga

SEQ ID NO: 646061 - RNA, 23 nt, Human
aggccaauaacaagugcugacca

SEQ ID NO: 646062 - RNA, 25 nt, Human
auaacaagugcugaccaccuccuuc

SEQ ID NO: 646063 - RNA, 18 nt, Human
auacauauauaucauaua

SEQ ID NO: 646064 - RNA, 25 nt, Human
auagcacuauucuaacagcaacaag

SEQ ID NO: 646065 - RNA, 26 nt, Human
auauauacauauauaucauauauaua

SEQ ID NO: 646066 - RNA, 18 nt, Human
aucacaccuacauacaug

SEQ ID NO: 646067 - RNA, 21 nt, Human
auccugccauaggcaauuuua

SEQ ID NO: 646068 - RNA, 18 nt, Human
augaaagauacaaagaug

SEQ ID NO: 646069 - RNA, 18 nt, Human
auggugcugauauaagua

SEQ ID NO: 646070 - RNA, 21 nt, Human
caaacagguggaaauaacaac

SEQ ID NO: 646071 - RNA, 20 nt, Human
caaagcacuaugcuaggugc

SEQ ID NO: 646072 - RNA, 21 nt, Human
caaagcacuaugcuaggugca

SEQ ID NO: 646073 - RNA, 20 nt, Human
caccuacauacauggugcug

SEQ ID NO: 646074 - RNA, 25 nt, Human
cauuuccuggcuccuuuucccacuu

SEQ ID NO: 646075 - RNA, 23 nt, Human
cucaagguuccaauuugaaacac

SEQ ID NO: 646076 - RNA, 19 nt, Human
gaaaacaucucaaugacag

SEQ ID NO: 646077 - RNA, 23 nt, Human
gacaaauacacaaauaacuagaa

SEQ ID NO: 646078 - RNA, 18 nt, Human
gcugaccaccuccucuug

SEQ ID NO: 646079 - RNA, 20 nt, Human
ggaaauaacagaguaggccc

SEQ ID NO: 646080 - RNA, 18 nt, Human
guccuuugguuaauggcu

SEQ ID NO: 646081 - RNA, 19 nt, Human
uacaaggcaguaaacaaga

SEQ ID NO: 646082 - RNA, 18 nt, Human
uagccucaagguuccaau

SEQ ID NO: 646083 - RNA, 21 nt, Human
uauacauauauaucauauaua

SEQ ID NO: 646084 - RNA, 21 nt, Human
uauauaucauauauauauaua

SEQ ID NO: 646085 - RNA, 20 nt, Human
uauaucauauauauauauau

SEQ ID NO: 646086 - RNA, 21 nt, Human
uauguucagccuucugaaaua

SEQ ID NO: 646087 - RNA, 24 nt, Human
ucaagguuccaauuugaaacacga

SEQ ID NO: 646088 - RNA, 20 nt, Human
ucacauaccugauauauagc

SEQ ID NO: 646089 - RNA, 21 nt, Human
ugaaagauacaaagaugaaaa

SEQ ID NO: 646090 - RNA, 21 nt, Human
ugaaaguacuaucacaccuac

SEQ ID NO: 646091 - RNA, 19 nt, Human
ugaaauaaauggucacaua

SEQ ID NO: 646092 - RNA, 20 nt, Human
ugaaauaacuggcaaaguag

SEQ ID NO: 646093 - RNA, 24 nt, Human
ugaaauaacuggcaaaguagaagc

SEQ ID NO: 646094 - RNA, 21 nt, Human
ugagugacuacuaugugcaaa

SEQ ID NO: 646095 - RNA, 19 nt, Human
ugcaugaaagauacaaaga

SEQ ID NO: 646096 - RNA, 20 nt, Human
ugucuuucauugguuucaug

SEQ ID NO: 646097 - RNA, 21 nt, Human
uuaaauggcccuacccaaaca

SEQ ID NO: 646098 - RNA, 25 nt, Human
uuaaauggcccuacccaaacaggug

SEQ ID NO: 646099 - RNA, 21 nt, Human
uucgaaaaucccaucccaagu

SEQ ID NO: 646100 - RNA, 23 nt, Human
uugcuuaugacuauggcaacccc

SEQ ID NO: 646101 - RNA, 20 nt, Human
uuuccuggcuccuuuuccca

SEQ ID NO: 646102 - RNA, 22 nt, Human
aaaacuacagauacaauacaca

SEQ ID NO: 646103 - RNA, 20 nt, Human
aacaacccugaccauggcca

SEQ ID NO: 646104 - RNA, 24 nt, Human
aauccuucuacauuuuuuuuuucu

SEQ ID NO: 646105 - RNA, 19 nt, Human
agcacuaacguccuccggg

SEQ ID NO: 646106 - RNA, 27 nt, Human
agucggcaagccuggacaagaagagca

SEQ ID NO: 646107 - RNA, 19 nt, Human
aguuuauuacaaaacuaca

SEQ ID NO: 646108 - RNA, 18 nt, Human
auggccagugcuauggag

SEQ ID NO: 646109 - RNA, 22 nt, Human
caacaacccugaccauggccag

SEQ ID NO: 646110 - RNA, 23 nt, Human
caagaagagcacuaacguccucc

SEQ ID NO: 646111 - RNA, 25 nt, Human
caagaagagcacuaacguccuccgg

SEQ ID NO: 646112 - RNA, 18 nt, Human
caccagagcugccagggc

SEQ ID NO: 646113 - RNA, 20 nt, Human
caccagagcugccagggcuu

SEQ ID NO: 646114 - RNA, 22 nt, Human
caggucagauguuccaacaacc

SEQ ID NO: 646115 - RNA, 23 nt, Human
cagugcuauggagucacuccaaa

SEQ ID NO: 646116 - RNA, 20 nt, Human
ccaugacuacgggacuccuc

SEQ ID NO: 646117 - RNA, 24 nt, Human
ccucaaagcccgucugcuuggccu

SEQ ID NO: 646118 - RNA, 23 nt, Human
ccuccggggccacgccacugccc

SEQ ID NO: 646119 - RNA, 21 nt, Human
ccugacuccucggcuccugga

SEQ ID NO: 646120 - RNA, 21 nt, Human
cgccuucgacaucuagaaagu

SEQ ID NO: 646121 - RNA, 19 nt, Human
cggagcugcugucauccgg

SEQ ID NO: 646122 - RNA, 25 nt, Human
cugccagggcuugaagaauuucccu

SEQ ID NO: 646123 - RNA, 18 nt, Human
cugccgccuucgacaucu

SEQ ID NO: 646124 - RNA, 20 nt, Human
cuuugcugacaagaugauuc

SEQ ID NO: 646125 - RNA, 19 nt, Human
gaaauccuucuacauuuuu

SEQ ID NO: 646126 - RNA, 24 nt, Human
gcacuaacguccuccggggccacg

SEQ ID NO: 646127 - RNA, 20 nt, Human
gcagagccuuucuuagaccg

SEQ ID NO: 646128 - RNA, 20 nt, Human
ggagucacuccaaagguggu

SEQ ID NO: 646129 - RNA, 20 nt, Human
ggucagauguuccaacaacc

SEQ ID NO: 646130 - RNA, 23 nt, Human
gucuuccuacugccgccuucgac

SEQ ID NO: 646131 - RNA, 20 nt, Human
guggaucucggugcgggcgg

SEQ ID NO: 646132 - RNA, 21 nt, Human
uagugaacggauuguuucugc

SEQ ID NO: 646133 - RNA, 22 nt, Human
ucaaagcccgucugcuuggccu

SEQ ID NO: 646134 - RNA, 21 nt, Human
uccaagugcuguucaucaaca

SEQ ID NO: 646135 - RNA, 21 nt, Human
ucggugcgggcggagcugcug

SEQ ID NO: 646136 - RNA, 19 nt, Human
ucugccccuaagaugaaau

SEQ ID NO: 646137 - RNA, 18 nt, Human
ugaacggauuguuucugc

SEQ ID NO: 646138 - RNA, 24 nt, Human
ugaacggauuguuucugccccuaa

SEQ ID NO: 646139 - RNA, 22 nt, Human
ugcuauggagucacuccaaagg

SEQ ID NO: 646140 - RNA, 23 nt, Human
ugguugagcccucugugaaaauu

SEQ ID NO: 646141 - RNA, 19 nt, Human
ugugaaaauuuaaauggcu

SEQ ID NO: 646142 - RNA, 18 nt, Human
uuaguuuauuacaaaacu

SEQ ID NO: 646143 - RNA, 21 nt, Human
uucaucaacaauuaccuguaa

SEQ ID NO: 646144 - RNA, 22 nt, Human
uugaagaauuucccuguguguc

SEQ ID NO: 646145 - RNA, 18 nt, Human
uuugacauuuggagccau

SEQ ID NO: 646146 - RNA, 18 nt, Human
uuuuggggacacacuauu

SEQ ID NO: 646147 - RNA, 22 nt, Human
aaaaacaaaacaaaugaaaaga

SEQ ID NO: 646148 - RNA, 22 nt, Human
aaaaacuguaaauagcgaccau

SEQ ID NO: 646149 - RNA, 18 nt, Human
aaacaaacaucauaaacc

SEQ ID NO: 646150 - RNA, 23 nt, Human
aaacaucuuuuuaaaccugacag

SEQ ID NO: 646151 - RNA, 18 nt, Human
aaagaaaaugaggugcag

SEQ ID NO: 646152 - RNA, 22 nt, Human
aaagaaaaugaggugcaguucc

SEQ ID NO: 646153 - RNA, 24 nt, Human
aaauaaacaggucaguucuacaaa

SEQ ID NO: 646154 - RNA, 22 nt, Human
aacagcauugccaaauaaacag

SEQ ID NO: 646155 - RNA, 20 nt, Human
aagaaaaacaaaacaaauga

SEQ ID NO: 646156 - RNA, 25 nt, Human
aagcaacaucuuccuaaaaagcuuc

SEQ ID NO: 646157 - RNA, 23 nt, Human
aaggccccauuagcaguuagaaa

SEQ ID NO: 646158 - RNA, 25 nt, Human
aaucaacuuugaagucugaaaccga

SEQ ID NO: 646159 - RNA, 22 nt, Human
aauggugacaaugauauucaag

SEQ ID NO: 646160 - RNA, 18 nt, Human
acaaaacaaaugaaaaga

SEQ ID NO: 646161 - RNA, 20 nt, Human
acaaaacaaaugaaaagaag

SEQ ID NO: 646162 - RNA, 23 nt, Human
acugcauaauuugcacuggccua

SEQ ID NO: 646163 - RNA, 20 nt, Human
aggugcaaaacauccauuac

SEQ ID NO: 646164 - RNA, 20 nt, Human
aguaaacacaguaccaacca

SEQ ID NO: 646165 - RNA, 21 nt, Human
aguauacaaggcuugaugaaa

SEQ ID NO: 646166 - RNA, 24 nt, Human
aguguaauacuucugugaaagauu

SEQ ID NO: 646167 - RNA, 31 nt, Human
auuauguccauauaaaugaaaacaaacaucu

SEQ ID NO: 646168 - RNA, 21 nt, Human
auugccaaauaaacaggucag

SEQ ID NO: 646169 - RNA, 21 nt, Human
caaacaucauaaaccuauagg

SEQ ID NO: 646170 - RNA, 22 nt, Human
caacaucuuccuaaaaagcuuc

SEQ ID NO: 646171 - RNA, 21 nt, Human
caacuuuuuagcaacaaaaug

SEQ ID NO: 646172 - RNA, 24 nt, Human
caauaauuuaugaauuaaaacauc

SEQ ID NO: 646173 - RNA, 21 nt, Human
cacugggcugccaaauagccc

SEQ ID NO: 646174 - RNA, 20 nt, Human
ccauuagcaguuagaaauga

SEQ ID NO: 646175 - RNA, 21 nt, Human
cccauuagcaguuagaaauga

SEQ ID NO: 646176 - RNA, 24 nt, Human
cucucauuaucagcaggacuuuau

SEQ ID NO: 646177 - RNA, 20 nt, Human
cuuuuuagcaacaaaaugua

SEQ ID NO: 646178 - RNA, 22 nt, Human
gaaaacaaacaucauaaaccua

SEQ ID NO: 646179 - RNA, 20 nt, Human
gaaccugaauggaauuagug

SEQ ID NO: 646180 - RNA, 21 nt, Human
gaaguuuaaaaguuuuguuuu

SEQ ID NO: 646181 - RNA, 20 nt, Human
gagucugucuuuuuguuggg

SEQ ID NO: 646182 - RNA, 19 nt, Human
ggagaaccugaauggaauu

SEQ ID NO: 646183 - RNA, 21 nt, Human
ggugacaaugauauucaagaa

SEQ ID NO: 646184 - RNA, 24 nt, Human
ggugacaaugauauucaagaagaa

SEQ ID NO: 646185 - RNA, 19 nt, Human
gucaguucuacaaagcuaa

SEQ ID NO: 646186 - RNA, 24 nt, Human
guucgagcuugggcccccuccuuu

SEQ ID NO: 646187 - RNA, 26 nt, Human
uaaagacaucuuuuaaaguaauuuua

SEQ ID NO: 646188 - RNA, 25 nt, Human
uaacugaaauaacacugaaguucga

SEQ ID NO: 646189 - RNA, 23 nt, Human
uaacuguagaccacuucagcucu

SEQ ID NO: 646190 - RNA, 21 nt, Human
uaagcacaauuucuggauaaa

SEQ ID NO: 646191 - RNA, 22 nt, Human
uaagcagaaguauacaaggcuu

SEQ ID NO: 646192 - RNA, 22 nt, Human
uacucuuguuuguuauuacacu

SEQ ID NO: 646193 - RNA, 20 nt, Human
uagaccaaacccauguaccc

SEQ ID NO: 646194 - RNA, 18 nt, Human
uauccaaaugguaugaga

SEQ ID NO: 646195 - RNA, 21 nt, Human
uauugcuuguggacauaauuu

SEQ ID NO: 646196 - RNA, 24 nt, Human
uccuuuaacagcauugccaaauaa

SEQ ID NO: 646197 - RNA, 21 nt, Human
ugaaaacaaacaucauaaacc

SEQ ID NO: 646198 - RNA, 22 nt, Human
ugaaaagaguaucucuaacuga

SEQ ID NO: 646199 - RNA, 19 nt, Human
ugaccaaaugauaaagugg

SEQ ID NO: 646200 - RNA, 25 nt, Human
ugauccagaaucuuauucuggcuau

SEQ ID NO: 646201 - RNA, 23 nt, Human
ugccaaauagcccaauuaacugg

SEQ ID NO: 646202 - RNA, 21 nt, Human
uggaauuagugacaaauggac

SEQ ID NO: 646203 - RNA, 18 nt, Human
uuaaacagcugagaggac

SEQ ID NO: 646204 - RNA, 21 nt, Human
uuaguacauagguucacuggg

SEQ ID NO: 646205 - RNA, 20 nt, Human
uucaagaugaaacauuuagu

SEQ ID NO: 646206 - RNA, 18 nt, Human
uucaauaucacaguccuu

SEQ ID NO: 646207 - RNA, 25 nt, Human
uugaaaaaaagcauggauaccacga

SEQ ID NO: 646208 - RNA, 23 nt, Human
uugaccaaaugauaaaguggcuc

SEQ ID NO: 646209 - RNA, 21 nt, Human
uuuaaaccugacaggaaaaua

SEQ ID NO: 646210 - RNA, 19 nt, Human
uuuagcaacaaaauguauu

SEQ ID NO: 646211 - RNA, 20 nt, Human
uuuauccaaaugguaugaga

SEQ ID NO: 646212 - RNA, 18 nt, Human
uuuguaaauccuaaaaug

SEQ ID NO: 646213 - RNA, 21 nt, Human
aaggaaccugaucggcggggc

SEQ ID NO: 646214 - RNA, 21 nt, Human
aguccagaauuuuuuuucccu

SEQ ID NO: 646215 - RNA, 23 nt, Human
ccacccugcgggcgucucgaccu

SEQ ID NO: 646216 - RNA, 18 nt, Human
ccccugggaaccgcgugc

SEQ ID NO: 646217 - RNA, 23 nt, Human
ccuucacaaauccuucaacauca

SEQ ID NO: 646218 - RNA, 20 nt, Human
cugaccgccgcuggcccccu

SEQ ID NO: 646219 - RNA, 24 nt, Human
gcuggcccccugggaaccgcgugc

SEQ ID NO: 646220 - RNA, 20 nt, Human
ucaacaucaggacaaggcau

SEQ ID NO: 646221 - RNA, 19 nt, Human
ucuacaaccuuucucuacc

SEQ ID NO: 646222 - RNA, 24 nt, Human
ucuacaaccuuucucuacccuaga

SEQ ID NO: 646223 - RNA, 22 nt, Human
uuccgcaauucccaauugggau

SEQ ID NO: 646224 - RNA, 22 nt, Human
uuuuuuuuuuuuuuuuuuucag

SEQ ID NO: 646225 - RNA, 25 nt, Human
aaaaaaaaaaaaaaaagcgccauca

SEQ ID NO: 646226 - RNA, 23 nt, Human
aaaaaaaaaaaaagcgccaucag

SEQ ID NO: 646227 - RNA, 21 nt, Human
aaaaaaaaaaagcgccaucag

SEQ ID NO: 646228 - RNA, 19 nt, Human
aaaaagcgccaucaguacc

SEQ ID NO: 646229 - RNA, 24 nt, Human
aaaugcuaaaauaucacaaaagcu

SEQ ID NO: 646230 - RNA, 22 nt, Human
aaauucuguuuaagccaaaaag

SEQ ID NO: 646231 - RNA, 19 nt, Human
aacagaagccaaccuuggu

SEQ ID NO: 646232 - RNA, 20 nt, Human
aacccgccugcuccuucuuc

SEQ ID NO: 646233 - RNA, 19 nt, Human
aagaaugggcuacacugaa

SEQ ID NO: 646234 - RNA, 27 nt, Human
aagcauggcugugugcacgauucauac

SEQ ID NO: 646235 - RNA, 18 nt, Human
aaggagcguggguuggag

SEQ ID NO: 646236 - RNA, 23 nt, Human
acacagcgaggcuccccaaccuu

SEQ ID NO: 646237 - RNA, 20 nt, Human
acacauuuccaucgcacacc

SEQ ID NO: 646238 - RNA, 22 nt, Human
acagaagccaaccuuggucaca

SEQ ID NO: 646239 - RNA, 23 nt, Human
acagggaaggagcguggguugga

SEQ ID NO: 646240 - RNA, 19 nt, Human
accacaagaguauggcagc

SEQ ID NO: 646241 - RNA, 21 nt, Human
acccuggugccucagacuccg

SEQ ID NO: 646242 - RNA, 20 nt, Human
acggcagaacgcuggacucu

SEQ ID NO: 646243 - RNA, 22 nt, Human
agagggugggugagggcagggc

SEQ ID NO: 646244 - RNA, 20 nt, Human
agccgcugcuccacaugugu

SEQ ID NO: 646245 - RNA, 19 nt, Human
aggcaacagcucuggauca

SEQ ID NO: 646246 - RNA, 25 nt, Human
aggcaagacagaagcaagugucuaa

SEQ ID NO: 646247 - RNA, 21 nt, Human
aggcuccccugccccggccuu

SEQ ID NO: 646248 - RNA, 26 nt, Human
aucuuuguaaaaaaacuguugccgga

SEQ ID NO: 646249 - RNA, 21 nt, Human
augcuuggcagacgggugggg

SEQ ID NO: 646250 - RNA, 22 nt, Human
caaaagcuuuaaaaaucaaugg

SEQ ID NO: 646251 - RNA, 22 nt, Human
cacaucguugucaaagucaucc

SEQ ID NO: 646252 - RNA, 27 nt, Human
caccacuguccacagucaccagcugcc

SEQ ID NO: 646253 - RNA, 21 nt, Human
caccaugugcaccuccugacc

SEQ ID NO: 646254 - RNA, 22 nt, Human
caccaugugcaccuccugacug

SEQ ID NO: 646255 - RNA, 21 nt, Human
caccuugaugguuugccucca

SEQ ID NO: 646256 - RNA, 23 nt, Human
cacgggccagccacaggacucag

SEQ ID NO: 646257 - RNA, 19 nt, Human
cacuaaagucuccacccua

SEQ ID NO: 646258 - RNA, 26 nt, Human
cagcaagacacagcgaggcuccccaa

SEQ ID NO: 646259 - RNA, 18 nt, Human
cagcgaggcuccccaacc

SEQ ID NO: 646260 - RNA, 21 nt, Human
caucacgggccagccacagga

SEQ ID NO: 646261 - RNA, 22 nt, Human
cauccagagaaaccgcugucac

SEQ ID NO: 646262 - RNA, 25 nt, Human
cauccagagaaaccgcugucacagg

SEQ ID NO: 646263 - RNA, 20 nt, Human
ccacaucguugucaaaguca

SEQ ID NO: 646264 - RNA, 23 nt, Human
ccaccaccagggccagccuuuga

SEQ ID NO: 646265 - RNA, 19 nt, Human
ccaggcacagcccagugcc

SEQ ID NO: 646266 - RNA, 25 nt, Human
cccaugcuuggcagacggguggggg

SEQ ID NO: 646267 - RNA, 18 nt, Human
cccgccugcuccuucuuc

SEQ ID NO: 646268 - RNA, 25 nt, Human
cccugccccggccuugaagcauggc

SEQ ID NO: 646269 - RNA, 23 nt, Human
ccugacagaaaaaaaaaaaaaaa

SEQ ID NO: 646270 - RNA, 22 nt, Human
ccuguagggggcaugguggggg

SEQ ID NO: 646271 - RNA, 24 nt, Human
ccuucuacucucacugugaaaguc

SEQ ID NO: 646272 - RNA, 27 nt, Human
cgccugcuccuucuucaucuagcucca

SEQ ID NO: 646273 - RNA, 19 nt, Human
cgcugcuccacaugugugc

SEQ ID NO: 646274 - RNA, 22 nt, Human
cucacugugaaagucuuucaaa

SEQ ID NO: 646275 - RNA, 21 nt, Human
cucaguguccaaagaggcgcu

SEQ ID NO: 646276 - RNA, 18 nt, Human
cuccacaugugugcugug

SEQ ID NO: 646277 - RNA, 21 nt, Human
cucgccuuccaggcacagccc

SEQ ID NO: 646278 - RNA, 18 nt, Human
cugaacgauugcuuuagc

SEQ ID NO: 646279 - RNA, 20 nt, Human
cugacagaaaaaaaaaaaaa

SEQ ID NO: 646280 - RNA, 18 nt, Human
cugaugcuaaaauucugu

SEQ ID NO: 646281 - RNA, 19 nt, Human
cugcacacuugucucucca

SEQ ID NO: 646282 - RNA, 21 nt, Human
cuggugccucagacuccggca

SEQ ID NO: 646283 - RNA, 24 nt, Human
cugugaaagucuuucaaaaugcua

SEQ ID NO: 646284 - RNA, 21 nt, Human
cugugugcacgauucauaccc

SEQ ID NO: 646285 - RNA, 18 nt, Human
cuguucgccucuuuuugg

SEQ ID NO: 646286 - RNA, 23 nt, Human
cuuccuguuucaacaaguccacu

SEQ ID NO: 646287 - RNA, 19 nt, Human
cuugcuggcaucgugucca

SEQ ID NO: 646288 - RNA, 23 nt, Human
cuuggcagacggguggggggggg

SEQ ID NO: 646289 - RNA, 21 nt, Human
cuuuaaaaaucaaugggugga

SEQ ID NO: 646290 - RNA, 23 nt, Human
cuuucaaaaugcuaaaauaucac

SEQ ID NO: 646291 - RNA, 23 nt, Human
cuuugguucacaggcgcaucugg

SEQ ID NO: 646292 - RNA, 23 nt, Human
gaggccaggguaacuccaggagg

SEQ ID NO: 646293 - RNA, 22 nt, Human
gaugguuugccuccaaucccag

SEQ ID NO: 646294 - RNA, 19 nt, Human
gcacacggcacucugcaca

SEQ ID NO: 646295 - RNA, 25 nt, Human
gcaccacaagcacacggcacucugc

SEQ ID NO: 646296 - RNA, 19 nt, Human
gcaccaugugcaccuccug

SEQ ID NO: 646297 - RNA, 19 nt, Human
gcacgauucauacccaugc

SEQ ID NO: 646298 - RNA, 18 nt, Human
gccaccagucgagaagca

SEQ ID NO: 646299 - RNA, 24 nt, Human
gccauccccucucaucugucaucc

SEQ ID NO: 646300 - RNA, 23 nt, Human
gcccugcaggcgcccugggcaca

SEQ ID NO: 646301 - RNA, 19 nt, Human
gcccugggcacaugggccc

SEQ ID NO: 646302 - RNA, 26 nt, Human
gcggcccccgcgcccuggcccgugcc

SEQ ID NO: 646303 - RNA, 19 nt, Human
gcggcuggcggcccccgcg

SEQ ID NO: 646304 - RNA, 25 nt, Human
gcuaaaaugcaugauuccaaaucua

SEQ ID NO: 646305 - RNA, 23 nt, Human
gcuaaaauucuguuuaagccaaa

SEQ ID NO: 646306 - RNA, 19 nt, Human
gcuaagggcaacagucaca

SEQ ID NO: 646307 - RNA, 20 nt, Human
ggagagggaccaccuugaug

SEQ ID NO: 646308 - RNA, 22 nt, Human
ggaggccugacacuguggugca

SEQ ID NO: 646309 - RNA, 22 nt, Human
ggcagacggguggggggggggg

SEQ ID NO: 646310 - RNA, 22 nt, Human
ggccaccuggcaucacgggcca

SEQ ID NO: 646311 - RNA, 19 nt, Human
ggcccccgcgcccuggccc

SEQ ID NO: 646312 - RNA, 18 nt, Human
gggaacagcaagacacag

SEQ ID NO: 646313 - RNA, 24 nt, Human
gguaacuccaggagguggcaggac

SEQ ID NO: 646314 - RNA, 19 nt, Human
gugggugagggcagggcac

SEQ ID NO: 646315 - RNA, 18 nt, Human
guucacaggcgcaucugg

SEQ ID NO: 646316 - RNA, 18 nt, Human
uaaaaagagccugcagca

SEQ ID NO: 646317 - RNA, 19 nt, Human
uaaaaagagccugcagcag

SEQ ID NO: 646318 - RNA, 24 nt, Human
uaaaauaucacaaaagcuuuaaaa

SEQ ID NO: 646319 - RNA, 19 nt, Human
uaaaauauuccuuucucuu

SEQ ID NO: 646320 - RNA, 22 nt, Human
uaagccaaaaagguuuaaaaua

SEQ ID NO: 646321 - RNA, 19 nt, Human
uaagggcaacagucacagu

SEQ ID NO: 646322 - RNA, 25 nt, Human
uacacuaaagucuccacccuaaggc

SEQ ID NO: 646323 - RNA, 18 nt, Human
uaggggccaccagucgag

SEQ ID NO: 646324 - RNA, 24 nt, Human
uaucacaaaagcuuuaaaaaucaa

SEQ ID NO: 646325 - RNA, 25 nt, Human
uauucacagcugcagacaggaggca

SEQ ID NO: 646326 - RNA, 25 nt, Human
ucaaagaaggggaaacacagagggu

SEQ ID NO: 646327 - RNA, 19 nt, Human
ucagacuccggcaggaaca

SEQ ID NO: 646328 - RNA, 21 nt, Human
ucccuguacacuaaagucucc

SEQ ID NO: 646329 - RNA, 22 nt, Human
ucccuguacacuaaagucucca

SEQ ID NO: 646330 - RNA, 26 nt, Human
ucccuguagcagcccugcaggcgccc

SEQ ID NO: 646331 - RNA, 22 nt, Human
uccugacagaaaaaaaaaaaaa

SEQ ID NO: 646332 - RNA, 21 nt, Human
uccuucuucaucuagcuccaa

SEQ ID NO: 646333 - RNA, 24 nt, Human
uccuuucucuucuaccuuuucaaa

SEQ ID NO: 646334 - RNA, 23 nt, Human
ucgcugaguccauccauucaggc

SEQ ID NO: 646335 - RNA, 24 nt, Human
ucucugaacgauugcuuuagccgu

SEQ ID NO: 646336 - RNA, 22 nt, Human
ugacagaaaaaaaaaaaaaaaa

SEQ ID NO: 646337 - RNA, 18 nt, Human
ugagggaaggauauguug

SEQ ID NO: 646338 - RNA, 22 nt, Human
ugagggaaggauauguuguggg

SEQ ID NO: 646339 - RNA, 22 nt, Human
ugaggguuucuuuuuuaaaagg

SEQ ID NO: 646340 - RNA, 23 nt, Human
ugccccggccuugaagcauggcu

SEQ ID NO: 646341 - RNA, 21 nt, Human
ugcccuggauggcaucagcac

SEQ ID NO: 646342 - RNA, 20 nt, Human
ugccuccaaucccagaaagc

SEQ ID NO: 646343 - RNA, 26 nt, Human
ugccuccaaucccagaaagcuaguuc

SEQ ID NO: 646344 - RNA, 23 nt, Human
ugccuuugacauccagagaaacc

SEQ ID NO: 646345 - RNA, 21 nt, Human
uggagcuuuccagggagagcc

SEQ ID NO: 646346 - RNA, 18 nt, Human
uggcagcaccugcugugg

SEQ ID NO: 646347 - RNA, 18 nt, Human
uggcaucacgggccagcc

SEQ ID NO: 646348 - RNA, 18 nt, Human
uggcggcccccgcgcccu

SEQ ID NO: 646349 - RNA, 22 nt, Human
uggcggcccccgcgcccuggcc

SEQ ID NO: 646350 - RNA, 21 nt, Human
ugggaacagcaagacacagcg

SEQ ID NO: 646351 - RNA, 24 nt, Human
uggguuggaggccugacacugugg

SEQ ID NO: 646352 - RNA, 22 nt, Human
uggugggggacagacacggcag

SEQ ID NO: 646353 - RNA, 23 nt, Human
uguaaaaaaacuguugccggagg

SEQ ID NO: 646354 - RNA, 20 nt, Human
uguccaaagaggcgcuuuua

SEQ ID NO: 646355 - RNA, 23 nt, Human
uguccaaagaggcgcuuuuaggg

SEQ ID NO: 646356 - RNA, 18 nt, Human
uguccagacuggagaggg

SEQ ID NO: 646357 - RNA, 21 nt, Human
uguuucaacaaguccacuugc

SEQ ID NO: 646358 - RNA, 20 nt, Human
uuccaggcacagcccagugc

SEQ ID NO: 646359 - RNA, 23 nt, Human
uuccucuguucgccucuuuuugg

SEQ ID NO: 646360 - RNA, 21 nt, Human
uugcuuccuguuucaacaagu

SEQ ID NO: 646361 - RNA, 21 nt, Human
uuggcagacgggugggggggg

SEQ ID NO: 646362 - RNA, 23 nt, Human
uugggggcacaaaggccuucuuc

SEQ ID NO: 646363 - RNA, 24 nt, Human
uugggggcacaaaggccuucuucc

SEQ ID NO: 646364 - RNA, 23 nt, Human
uuuuuccucuguucgccucuuuu

SEQ ID NO: 646365 - RNA, 22 nt, Human
uuuuuuuuuuuuuuuuucuggg

SEQ ID NO: 646366 - RNA, 21 nt, Human
aagccucuggguccaggcacu

SEQ ID NO: 646367 - RNA, 24 nt, Human
aauggguuucuuuccuggguucag

SEQ ID NO: 646368 - RNA, 18 nt, Human
accuuggcuuucuagucu

SEQ ID NO: 646369 - RNA, 18 nt, Human
agaagaugcaguuaccag

SEQ ID NO: 646370 - RNA, 18 nt, Human
aggacccccagggacggg

SEQ ID NO: 646371 - RNA, 26 nt, Human
agggaagagggggucggcaaaugggu

SEQ ID NO: 646372 - RNA, 23 nt, Human
augcaguuaccagggcuggugcc

SEQ ID NO: 646373 - RNA, 23 nt, Human
caccagggccugagucugguggu

SEQ ID NO: 646374 - RNA, 19 nt, Human
cagcaguaggggugccacg

SEQ ID NO: 646375 - RNA, 23 nt, Human
cagcaguaggggugccacggucu

SEQ ID NO: 646376 - RNA, 18 nt, Human
cagcgaaggcagcucucc

SEQ ID NO: 646377 - RNA, 20 nt, Human
caggcccagcuccugagaaa

SEQ ID NO: 646378 - RNA, 23 nt, Human
caguaggggugccacggucucgc

SEQ ID NO: 646379 - RNA, 22 nt, Human
cagugguccccuaaucugcccc

SEQ ID NO: 646380 - RNA, 25 nt, Human
cauccaccaggcccaaaugcccagc

SEQ ID NO: 646381 - RNA, 21 nt, Human
caucuucccagggugagaucc

SEQ ID NO: 646382 - RNA, 19 nt, Human
cauuaagucccugggcugu

SEQ ID NO: 646383 - RNA, 23 nt, Human
ccacaucuucccagggugagauc

SEQ ID NO: 646384 - RNA, 22 nt, Human
ccaccaggcccaaaugcccagc

SEQ ID NO: 646385 - RNA, 24 nt, Human
ccaccaggcccaaaugcccagcuu

SEQ ID NO: 646386 - RNA, 22 nt, Human
ccccauuuucccugagcuccac

SEQ ID NO: 646387 - RNA, 20 nt, Human
cccuugagcaacacucacug

SEQ ID NO: 646388 - RNA, 19 nt, Human
ccgagcgagacccucaccc

SEQ ID NO: 646389 - RNA, 22 nt, Human
ccgagcgagacccucacccgcu

SEQ ID NO: 646390 - RNA, 19 nt, Human
ccgcggugacggaggaccc

SEQ ID NO: 646391 - RNA, 22 nt, Human
ccugcaaagccucuggguccag

SEQ ID NO: 646392 - RNA, 22 nt, Human
ccugggcugucacucaagggca

SEQ ID NO: 646393 - RNA, 22 nt, Human
cgaggcaucucauuccuauacc

SEQ ID NO: 646394 - RNA, 22 nt, Human
cuaaucugccccauuuccaugc

SEQ ID NO: 646395 - RNA, 19 nt, Human
cucuggguccaggcacuug

SEQ ID NO: 646396 - RNA, 21 nt, Human
cuggcuuccucacucccagug

SEQ ID NO: 646397 - RNA, 20 nt, Human
cugguggugguggcaccuga

SEQ ID NO: 646398 - RNA, 18 nt, Human
gagagccccugggggagg

SEQ ID NO: 646399 - RNA, 26 nt, Human
gagcccuucccuccccucugaguccc

SEQ ID NO: 646400 - RNA, 18 nt, Human
gcaaggggagaagaugca

SEQ ID NO: 646401 - RNA, 21 nt, Human
gcaguuaccagggcuggugcc

SEQ ID NO: 646402 - RNA, 20 nt, Human
gccacauuaagucccugggc

SEQ ID NO: 646403 - RNA, 19 nt, Human
gccaugggguggcaagggg

SEQ ID NO: 646404 - RNA, 21 nt, Human
ggagggugggaaaggugcagg

SEQ ID NO: 646405 - RNA, 19 nt, Human
ggccgcggugacggaggac

SEQ ID NO: 646406 - RNA, 19 nt, Human
ggcgggagggugggaaagg

SEQ ID NO: 646407 - RNA, 19 nt, Human
gggaacauaaagggacagg

SEQ ID NO: 646408 - RNA, 23 nt, Human
gggagggugggaaaggugcaggg

SEQ ID NO: 646409 - RNA, 18 nt, Human
gggauaugggagauggga

SEQ ID NO: 646410 - RNA, 18 nt, Human
gggcgcgggagacaggga

SEQ ID NO: 646411 - RNA, 24 nt, Human
ggugccuaacagcaaggcugggug

SEQ ID NO: 646412 - RNA, 18 nt, Human
gguucagauucugcagua

SEQ ID NO: 646413 - RNA, 18 nt, Human
gguuggggcucgcggagg

SEQ ID NO: 646414 - RNA, 20 nt, Human
guagggcuccccaucauuga

SEQ ID NO: 646415 - RNA, 22 nt, Human
uaaaugccuguccugcugaaag

SEQ ID NO: 646416 - RNA, 20 nt, Human
uaacagcaaggcugggugga

SEQ ID NO: 646417 - RNA, 18 nt, Human
uaagucccugggcuguca

SEQ ID NO: 646418 - RNA, 23 nt, Human
uaccugaaaacuacuccagacac

SEQ ID NO: 646419 - RNA, 22 nt, Human
uauccagguuggcauccaccag

SEQ ID NO: 646420 - RNA, 18 nt, Human
uauuugggaacauaaagg

SEQ ID NO: 646421 - RNA, 26 nt, Human
ucaggcccagcuccugagaacacugu

SEQ ID NO: 646422 - RNA, 18 nt, Human
uccauccuccagagcccu

SEQ ID NO: 646423 - RNA, 23 nt, Human
ucccagggugagauccuuucacc

SEQ ID NO: 646424 - RNA, 20 nt, Human
ucccugggcugucacucaag

SEQ ID NO: 646425 - RNA, 23 nt, Human
ucccugggcugucacucaagggc

SEQ ID NO: 646426 - RNA, 22 nt, Human
uccuaagccucaggcccagcuc

SEQ ID NO: 646427 - RNA, 27 nt, Human
uccugggccaucuaaggggucagccuu

SEQ ID NO: 646428 - RNA, 22 nt, Human
ucgugggauacacuucuggggu

SEQ ID NO: 646429 - RNA, 19 nt, Human
ucugcaguaauuugcagcu

SEQ ID NO: 646430 - RNA, 18 nt, Human
ucuggagagggaagaggg

SEQ ID NO: 646431 - RNA, 23 nt, Human
ucuggagagggaagagggggucg

SEQ ID NO: 646432 - RNA, 21 nt, Human
ugaaaaggcaccaauggggca

SEQ ID NO: 646433 - RNA, 21 nt, Human
ugaaaaggcaccaauggggca

SEQ ID NO: 646434 - RNA, 19 nt, Human
ugaaagaacccgccuuuca

SEQ ID NO: 646435 - RNA, 26 nt, Human
ugagauccuuucaccacgaggcaucu

SEQ ID NO: 646436 - RNA, 19 nt, Human
uggacauggagccacaucc

SEQ ID NO: 646437 - RNA, 21 nt, Human
uggagagggaagagggggucg

SEQ ID NO: 646438 - RNA, 19 nt, Human
uggagucauggugccuaac

SEQ ID NO: 646439 - RNA, 18 nt, Human
uggcugaaaaggcaccaa

SEQ ID NO: 646440 - RNA, 19 nt, Human
uggcuuccucacucccagu

SEQ ID NO: 646441 - RNA, 20 nt, Human
ugggacggggucucagaauc

SEQ ID NO: 646442 - RNA, 24 nt, Human
uggggcucgcggagggggcacugg

SEQ ID NO: 646443 - RNA, 19 nt, Human
ugggguagggcuccccauc

SEQ ID NO: 646444 - RNA, 18 nt, Human
ugguccccagcaguaggg

SEQ ID NO: 646445 - RNA, 26 nt, Human
uguaggauugagagugccagccuaug

SEQ ID NO: 646446 - RNA, 18 nt, Human
uguccugcaaagccucug

SEQ ID NO: 646447 - RNA, 22 nt, Human
uucaucuuggagucauggugcc

SEQ ID NO: 646448 - RNA, 19 nt, Human
uuguagcaccugccauucc

SEQ ID NO: 646449 - RNA, 21 nt, Human
uuuuuuuuuuuuuuuuaccag

SEQ ID NO: 646450 - RNA, 22 nt, Human
uuuuuuuuuuuuuuuuuaccag

SEQ ID NO: 646451 - RNA, 25 nt, Human
uuuuuuuuuuuuuuuuuuuuaccag

SEQ ID NO: 646452 - RNA, 25 nt, Human
aaaaaaaaaaaaaacaacaaaaaag

SEQ ID NO: 646453 - RNA, 22 nt, Human
aaaaaaaaaaaacaacaaaaaa

SEQ ID NO: 646454 - RNA, 21 nt, Human
aaaaaacaacaaaaaaaaaac

SEQ ID NO: 646455 - RNA, 24 nt, Human
aaaaugcugggauuacaggcauga

SEQ ID NO: 646456 - RNA, 20 nt, Human
aaagauaaacaaguaaauaa

SEQ ID NO: 646457 - RNA, 26 nt, Human
aaaugcugggauuacaggcaugagcc

SEQ ID NO: 646458 - RNA, 19 nt, Human
aacacagugagaccccauc

SEQ ID NO: 646459 - RNA, 20 nt, Human
aacacagugagaccccaucu

SEQ ID NO: 646460 - RNA, 21 nt, Human
aacacagugagaccccaucuc

SEQ ID NO: 646461 - RNA, 21 nt, Human
aacgcugaucacaaauccaug

SEQ ID NO: 646462 - RNA, 21 nt, Human
aacugucuaccuacccaccca

SEQ ID NO: 646463 - RNA, 20 nt, Human
aagcagagaggugagagcag

SEQ ID NO: 646464 - RNA, 22 nt, Human
aagcagagaggugagagcagag

SEQ ID NO: 646465 - RNA, 24 nt, Human
aaguagcugggauuacaggagugu

SEQ ID NO: 646466 - RNA, 26 nt, Human
aaguagcugggauuacaggagugugc

SEQ ID NO: 646467 - RNA, 25 nt, Human
aagugauucucccaccucagccucc

SEQ ID NO: 646468 - RNA, 19 nt, Human
aagugcuguaggcagcaug

SEQ ID NO: 646469 - RNA, 18 nt, Human
acaaggugugcuucugua

SEQ ID NO: 646470 - RNA, 18 nt, Human
acagagucuccagaagac

SEQ ID NO: 646471 - RNA, 22 nt, Human
acaggcuaucuaucuguagaga

SEQ ID NO: 646472 - RNA, 20 nt, Human
accacaguucggggccugcu

SEQ ID NO: 646473 - RNA, 24 nt, Human
acccaagcuagggugcaguggcau

SEQ ID NO: 646474 - RNA, 24 nt, Human
accccaucucuacuaaaaauacaa

SEQ ID NO: 646475 - RNA, 25 nt, Human
acccgccucagccucucaaaaugcu

SEQ ID NO: 646476 - RNA, 19 nt, Human
accuacccacccacccacc

SEQ ID NO: 646477 - RNA, 23 nt, Human
accucagccuccuaaguagcugg

SEQ ID NO: 646478 - RNA, 24 nt, Human
acuauguuggccaggcugguuucg

SEQ ID NO: 646479 - RNA, 20 nt, Human
acugcaaccuccaccucugg

SEQ ID NO: 646480 - RNA, 21 nt, Human
acugcaaccuccaccucugga

SEQ ID NO: 646481 - RNA, 18 nt, Human
acugcacugcagccugag

SEQ ID NO: 646482 - RNA, 20 nt, Human
acugcacugcagccugagug

SEQ ID NO: 646483 - RNA, 21 nt, Human
acugcacugcagccugaguga

SEQ ID NO: 646484 - RNA, 23 nt, Human
acugcagccugagugaagaguga

SEQ ID NO: 646485 - RNA, 23 nt, Human
agaaacgugcaguccuugccuac

SEQ ID NO: 646486 - RNA, 21 nt, Human
agaagaccaguuccucacugg

SEQ ID NO: 646487 - RNA, 25 nt, Human
agaagacucaaaggaaaaccgagaa

SEQ ID NO: 646488 - RNA, 20 nt, Human
agacauaggccagaauauaa

SEQ ID NO: 646489 - RNA, 18 nt, Human
agagaggggguuucacua

SEQ ID NO: 646490 - RNA, 20 nt, Human
agagcaccaccaggcucgcc

SEQ ID NO: 646491 - RNA, 21 nt, Human
agagcaccaccaggcucgccg

SEQ ID NO: 646492 - RNA, 21 nt, Human
agagcaccaccaggcucgccg

SEQ ID NO: 646493 - RNA, 22 nt, Human
agagguggcagugagcugagau

SEQ ID NO: 646494 - RNA, 24 nt, Human
agagguggcagugagcugagauug

SEQ ID NO: 646495 - RNA, 19 nt, Human
agccaccgcacccggccug

SEQ ID NO: 646496 - RNA, 23 nt, Human
agccaggcgugauggugggcgcc

SEQ ID NO: 646497 - RNA, 23 nt, Human
agccugagugaagagugagacuc

SEQ ID NO: 646498 - RNA, 21 nt, Human
aggagagaaagaaacgugcag

SEQ ID NO: 646499 - RNA, 20 nt, Human
aggcagagguggcagugagc

SEQ ID NO: 646500 - RNA, 24 nt, Human
aggcagagguggcagugagcugag

SEQ ID NO: 646501 - RNA, 22 nt, Human
aggcaggagaauggcgugaacc

SEQ ID NO: 646502 - RNA, 24 nt, Human
aggcaggagaauggcgugaaccug

SEQ ID NO: 646503 - RNA, 21 nt, Human
aggccgaggcgggcggaucac

SEQ ID NO: 646504 - RNA, 23 nt, Human
aggccgaggcgggcggaucacga

SEQ ID NO: 646505 - RNA, 24 nt, Human
aggcgcgguugcucacgccuguaa

SEQ ID NO: 646506 - RNA, 24 nt, Human
aggcgggcggaucacgaggucagg

SEQ ID NO: 646507 - RNA, 24 nt, Human
aggcgugauggugggcgccuguag

SEQ ID NO: 646508 - RNA, 19 nt, Human
aggcugaggcaggagaaug

SEQ ID NO: 646509 - RNA, 18 nt, Human
aggggguuucacuauguu

SEQ ID NO: 646510 - RNA, 20 nt, Human
aggggguuucacuauguugg

SEQ ID NO: 646511 - RNA, 24 nt, Human
aggggguuucacuauguuggccag

SEQ ID NO: 646512 - RNA, 22 nt, Human
agguaggggcaagaguugcuuu

SEQ ID NO: 646513 - RNA, 24 nt, Human
aggugauccacccgccucagccuc

SEQ ID NO: 646514 - RNA, 25 nt, Human
agugaagagugagacucccguuuca

SEQ ID NO: 646515 - RNA, 24 nt, Human
aguggcaugaucucagcuuacugc

SEQ ID NO: 646516 - RNA, 23 nt, Human
auggugggcgccuguagucccag

SEQ ID NO: 646517 - RNA, 19 nt, Human
auuacaggagugugccacc

SEQ ID NO: 646518 - RNA, 18 nt, Human
auucucccaccucagccu

SEQ ID NO: 646519 - RNA, 24 nt, Human
auugcgccacugcacugcagccug

SEQ ID NO: 646520 - RNA, 23 nt, Human
caaaaugcugggauuacaggcau

SEQ ID NO: 646521 - RNA, 24 nt, Human
caaaaugcugggauuacaggcaug

SEQ ID NO: 646522 - RNA, 18 nt, Human
caacgcugaucacaaauc

SEQ ID NO: 646523 - RNA, 22 nt, Human
caagugauucucccaccucagc

SEQ ID NO: 646524 - RNA, 23 nt, Human
cacaaauccaugggagaugucuc

SEQ ID NO: 646525 - RNA, 21 nt, Human
cacagagucuccagaagacca

SEQ ID NO: 646526 - RNA, 23 nt, Human
cacccgccucagccucucaaaau

SEQ ID NO: 646527 - RNA, 18 nt, Human
caccgcacccggccuggc

SEQ ID NO: 646528 - RNA, 24 nt, Human
cacgccuguaaucccagcauuaug

SEQ ID NO: 646529 - RNA, 21 nt, Human
cacuauguuggccaggcuggu

SEQ ID NO: 646530 - RNA, 24 nt, Human
cacuauguuggccaggcugguuuc

SEQ ID NO: 646531 - RNA, 20 nt, Human
cacugcacugcagccugagu

SEQ ID NO: 646532 - RNA, 22 nt, Human
cacugcacugcagccugaguga

SEQ ID NO: 646533 - RNA, 22 nt, Human
cagaagacucaaaggaaaaccg

SEQ ID NO: 646534 - RNA, 24 nt, Human
cagcauuaugggaggccgaggcgg

SEQ ID NO: 646535 - RNA, 24 nt, Human
cagcccucagauuccggcuacccu

SEQ ID NO: 646536 - RNA, 24 nt, Human
cagcuacucgggaggcugaggcag

SEQ ID NO: 646537 - RNA, 20 nt, Human
ccaccacgccggacuaauuu

SEQ ID NO: 646538 - RNA, 19 nt, Human
ccacccgccucagccucuc

SEQ ID NO: 646539 - RNA, 20 nt, Human
ccacugcacugcagccugag

SEQ ID NO: 646540 - RNA, 21 nt, Human
ccacugcacugcagccugagu

SEQ ID NO: 646541 - RNA, 19 nt, Human
ccagaauauagucugugcu

SEQ ID NO: 646542 - RNA, 19 nt, Human
ccagaggucuucuuaaggu

SEQ ID NO: 646543 - RNA, 21 nt, Human
ccagaguuggagcagcagcca

SEQ ID NO: 646544 - RNA, 18 nt, Human
cccaagacucccaagguc

SEQ ID NO: 646545 - RNA, 23 nt, Human
cccaccucagccuccuaaguagc

SEQ ID NO: 646546 - RNA, 24 nt, Human
cccguuucaaaaaaaaaaaaaaaa

SEQ ID NO: 646547 - RNA, 24 nt, Human
ccgccucagccucucaaaaugcug

SEQ ID NO: 646548 - RNA, 23 nt, Human
ccuaaguagcugggauuacagga

SEQ ID NO: 646549 - RNA, 22 nt, Human
ccugaccucaggugauccaccc

SEQ ID NO: 646550 - RNA, 23 nt, Human
ccugaccucaggugauccacccg

SEQ ID NO: 646551 - RNA, 24 nt, Human
ccuggcuaacacagugagacccca

SEQ ID NO: 646552 - RNA, 19 nt, Human
ccuggcucugccacuuccu

SEQ ID NO: 646553 - RNA, 25 nt, Human
ccugggaggcagagguggcagugag

SEQ ID NO: 646554 - RNA, 22 nt, Human
ccuguaaucccagcauuauggg

SEQ ID NO: 646555 - RNA, 21 nt, Human
ccuguagucccagcuacucgg

SEQ ID NO: 646556 - RNA, 22 nt, Human
ccuguagucccagcuacucggg

SEQ ID NO: 646557 - RNA, 23 nt, Human
cgagaaucaggagagaaagaaac

SEQ ID NO: 646558 - RNA, 24 nt, Human
cgagaccauccuggcuaacacagu

SEQ ID NO: 646559 - RNA, 21 nt, Human
cgagcacuuucccaggaauac

SEQ ID NO: 646560 - RNA, 24 nt, Human
cgaggcgggcggaucacgagguca

SEQ ID NO: 646561 - RNA, 22 nt, Human
cgagguugaauccuggcucugc

SEQ ID NO: 646562 - RNA, 22 nt, Human
cgcccagaagagguaggggcaa

SEQ ID NO: 646563 - RNA, 20 nt, Human
cgccggacuaauuuuugcau

SEQ ID NO: 646564 - RNA, 24 nt, Human
cgccucagccucucaaaaugcugg

SEQ ID NO: 646565 - RNA, 23 nt, Human
cgccuguagucccagcuacucgg

SEQ ID NO: 646566 - RNA, 23 nt, Human
cuacccacccacccaccuacuua

SEQ ID NO: 646567 - RNA, 24 nt, Human
cuagggugcaguggcaugaucuca

SEQ ID NO: 646568 - RNA, 24 nt, Human
cucaaaaugcugggauuacaggca

SEQ ID NO: 646569 - RNA, 21 nt, Human
cucacgccuguaaucccagca

SEQ ID NO: 646570 - RNA, 21 nt, Human
cucacgccuguaaucccagca

SEQ ID NO: 646571 - RNA, 19 nt, Human
cucacugggagcuuucuca

SEQ ID NO: 646572 - RNA, 24 nt, Human
cucagccuccuaaguagcugggau

SEQ ID NO: 646573 - RNA, 22 nt, Human
cucuaugccacacagagucucc

SEQ ID NO: 646574 - RNA, 23 nt, Human
cugcaaccuccaccucuggaguc

SEQ ID NO: 646575 - RNA, 19 nt, Human
cugggaggcagagguggca

SEQ ID NO: 646576 - RNA, 18 nt, Human
cugugacggaucacuuua

SEQ ID NO: 646577 - RNA, 22 nt, Human
gaaccugggaggcagagguggc

SEQ ID NO: 646578 - RNA, 20 nt, Human
gaagugcuguaggcagcaug

SEQ ID NO: 646579 - RNA, 24 nt, Human
gaccucaggugauccacccgccuc

SEQ ID NO: 646580 - RNA, 23 nt, Human
gaccugcuuccccaugcgcccca

SEQ ID NO: 646581 - RNA, 20 nt, Human
gagaugucucgacaucugug

SEQ ID NO: 646582 - RNA, 22 nt, Human
gaggggguuucacuauguuggc

SEQ ID NO: 646583 - RNA, 20 nt, Human
gaggugagagcagaguacug

SEQ ID NO: 646584 - RNA, 18 nt, Human
gagucuccagaagaccag

SEQ ID NO: 646585 - RNA, 22 nt, Human
gagucuugcucugccacccaag

SEQ ID NO: 646586 - RNA, 21 nt, Human
gaugagaaggcagcuccagaa

SEQ ID NO: 646587 - RNA, 22 nt, Human
gauggagcccaagaagcagaga

SEQ ID NO: 646588 - RNA, 18 nt, Human
gauuacaggagugugcca

SEQ ID NO: 646589 - RNA, 18 nt, Human
gauuacaggcaugagcca

SEQ ID NO: 646590 - RNA, 22 nt, Human
gauuacaggcaugagccaccgc

SEQ ID NO: 646591 - RNA, 23 nt, Human
gauuacaggcaugagccaccgca

SEQ ID NO: 646592 - RNA, 21 nt, Human
gauucucccaccucagccucc

SEQ ID NO: 646593 - RNA, 20 nt, Human
gcagagaggugagagcagag

SEQ ID NO: 646594 - RNA, 19 nt, Human
gcagccugagugaagagug

SEQ ID NO: 646595 - RNA, 22 nt, Human
gcagcuccagaagacucaaagg

SEQ ID NO: 646596 - RNA, 18 nt, Human
gccagaguuggagcagcg

SEQ ID NO: 646597 - RNA, 23 nt, Human
gccuguagucccagcuacucggg

SEQ ID NO: 646598 - RNA, 19 nt, Human
gcgguugcucacgccugua

SEQ ID NO: 646599 - RNA, 20 nt, Human
gcucacgccuguaaucccag

SEQ ID NO: 646600 - RNA, 22 nt, Human
gcucacgccuguaaucccagca

SEQ ID NO: 646601 - RNA, 18 nt, Human
gcuccagaagacucaaag

SEQ ID NO: 646602 - RNA, 25 nt, Human
gcucugccacccaagcuagggugca

SEQ ID NO: 646603 - RNA, 22 nt, Human
gcugaggcaggagaauggcgug

SEQ ID NO: 646604 - RNA, 23 nt, Human
gcugguuucgaacuccugaccuc

SEQ ID NO: 646605 - RNA, 19 nt, Human
ggaaagccagaggucuucu

SEQ ID NO: 646606 - RNA, 20 nt, Human
ggagcuaaaagggcuugaug

SEQ ID NO: 646607 - RNA, 22 nt, Human
ggauuacaggcaugagccaccg

SEQ ID NO: 646608 - RNA, 21 nt, Human
ggcggaucacgaggucaggag

SEQ ID NO: 646609 - RNA, 24 nt, Human
ggcugguuucgaacuccugaccuc

SEQ ID NO: 646610 - RNA, 25 nt, Human
gggaacacgcagucaugcccauaac

SEQ ID NO: 646611 - RNA, 21 nt, Human
ggggaagggaacacgcaguca

SEQ ID NO: 646612 - RNA, 24 nt, Human
ggggguuucacuauguuggccagg

SEQ ID NO: 646613 - RNA, 22 nt, Human
gggguuucacuauguuggccag

SEQ ID NO: 646614 - RNA, 23 nt, Human
gggguuucacuauguuggccagg

SEQ ID NO: 646615 - RNA, 22 nt, Human
gggugcaguggcaugaucucag

SEQ ID NO: 646616 - RNA, 23 nt, Human
ggguguccuggagcccugugggu

SEQ ID NO: 646617 - RNA, 22 nt, Human
ggguuucacuauguuggccagg

SEQ ID NO: 646618 - RNA, 21 nt, Human
ggugcaguggcaugaucucag

SEQ ID NO: 646619 - RNA, 23 nt, Human
ggugcaguggcaugaucucagcu

SEQ ID NO: 646620 - RNA, 24 nt, Human
ggugcaguggcaugaucucagcuu

SEQ ID NO: 646621 - RNA, 24 nt, Human
gguugcucacgccuguaaucccag

SEQ ID NO: 646622 - RNA, 19 nt, Human
gguuucgaacuccugaccu

SEQ ID NO: 646623 - RNA, 24 nt, Human
guccaguugcagaauaauguggga

SEQ ID NO: 646624 - RNA, 22 nt, Human
gugauccacccgccucagccuc

SEQ ID NO: 646625 - RNA, 24 nt, Human
gugauucucccaccucagccuccu

SEQ ID NO: 646626 - RNA, 18 nt, Human
gugcaguggcaugaucuc

SEQ ID NO: 646627 - RNA, 19 nt, Human
guggcagugagcugagauu

SEQ ID NO: 646628 - RNA, 23 nt, Human
guugcucacgccuguaaucccag

SEQ ID NO: 646629 - RNA, 24 nt, Human
uaaacaaguaaauaagguggacaa

SEQ ID NO: 646630 - RNA, 28 nt, Human
uaaagauaaacaaguaaauaagguggac

SEQ ID NO: 646631 - RNA, 19 nt, Human
uaagguggacaaagaacag

SEQ ID NO: 646632 - RNA, 26 nt, Human
uaaggugguugaaucacucuaugcca

SEQ ID NO: 646633 - RNA, 24 nt, Human
uaauuuuugcauuuuuaguagaga

SEQ ID NO: 646634 - RNA, 23 nt, Human
uacaggcaugagccaccgcaccc

SEQ ID NO: 646635 - RNA, 19 nt, Human
uaccuggcucacaggaucc

SEQ ID NO: 646636 - RNA, 22 nt, Human
uagagaggggguuucacuaugu

SEQ ID NO: 646637 - RNA, 23 nt, Human
uaggccagaauauagucugugcu

SEQ ID NO: 646638 - RNA, 24 nt, Human
uagggugcaguggcaugaucucag

SEQ ID NO: 646639 - RNA, 24 nt, Human
uaguagagaggggguuucacuaug

SEQ ID NO: 646640 - RNA, 19 nt, Human
uagucugugcucacagcag

SEQ ID NO: 646641 - RNA, 21 nt, Human
uauguuggccaggcugguuuc

SEQ ID NO: 646642 - RNA, 24 nt, Human
uauguuggccaggcugguuucgaa

SEQ ID NO: 646643 - RNA, 23 nt, Human
ucaaaaugcugggauuacaggca

SEQ ID NO: 646644 - RNA, 24 nt, Human
ucaaaaugcugggauuacaggcau

SEQ ID NO: 646645 - RNA, 19 nt, Human
ucaccgccguccagggcug

SEQ ID NO: 646646 - RNA, 18 nt, Human
ucacgaggucaggagauc

SEQ ID NO: 646647 - RNA, 24 nt, Human
ucacgaggucaggagaucgagacc

SEQ ID NO: 646648 - RNA, 21 nt, Human
ucacgccuguaaucccagcau

SEQ ID NO: 646649 - RNA, 22 nt, Human
ucacuauguuggccaggcuggu

SEQ ID NO: 646650 - RNA, 23 nt, Human
ucagccaggcgcgguugcucacg

SEQ ID NO: 646651 - RNA, 22 nt, Human
ucaggagagaaagaaacgugca

SEQ ID NO: 646652 - RNA, 23 nt, Human
uccaagugauucucccaccucag

SEQ ID NO: 646653 - RNA, 24 nt, Human
uccaagugauucucccaccucagc

SEQ ID NO: 646654 - RNA, 24 nt, Human
ucccguuucaaaaaaaaaaaaaaa

SEQ ID NO: 646655 - RNA, 25 nt, Human
ucgacaucuguguuccaggaaagcc

SEQ ID NO: 646656 - RNA, 26 nt, Human
ucuaugccacacagagucuccagaag

SEQ ID NO: 646657 - RNA, 24 nt, Human
ucucaaaaugcugggauuacaggc

SEQ ID NO: 646658 - RNA, 24 nt, Human
ucucccaccucagccuccuaagua

SEQ ID NO: 646659 - RNA, 24 nt, Human
ucucuacuaaaaauacaaaaaauu

SEQ ID NO: 646660 - RNA, 19 nt, Human
ucucugugacggaucacuu

SEQ ID NO: 646661 - RNA, 24 nt, Human
ucugccacccaagcuagggugcag

SEQ ID NO: 646662 - RNA, 21 nt, Human
ucuggaguccaagugauucuc

SEQ ID NO: 646663 - RNA, 18 nt, Human
ucuugcucugccacccaa

SEQ ID NO: 646664 - RNA, 25 nt, Human
ucuugcucugccacccaagcuaggg

SEQ ID NO: 646665 - RNA, 27 nt, Human
ucuugcucugccacccaagcuagggug

SEQ ID NO: 646666 - RNA, 18 nt, Human
ugaaccugggaggcagag

SEQ ID NO: 646667 - RNA, 25 nt, Human
ugaagagugagacucccguuucaaa

SEQ ID NO: 646668 - RNA, 21 nt, Human
ugaccucaggugauccacccg

SEQ ID NO: 646669 - RNA, 24 nt, Human
ugaccucaggugauccacccgccu

SEQ ID NO: 646670 - RNA, 21 nt, Human
ugagaaggcagcuccagaaga

SEQ ID NO: 646671 - RNA, 19 nt, Human
ugagagcagaguacugucc

SEQ ID NO: 646672 - RNA, 22 nt, Human
ugagagcagaguacuguccugg

SEQ ID NO: 646673 - RNA, 24 nt, Human
ugagauugcgccacugcacugcag

SEQ ID NO: 646674 - RNA, 22 nt, Human
ugagcugagauugcgccacugc

SEQ ID NO: 646675 - RNA, 23 nt, Human
ugaggcaggagaauggcgugaac

SEQ ID NO: 646676 - RNA, 24 nt, Human
ugaggcaggagaauggcgugaacc

SEQ ID NO: 646677 - RNA, 25 nt, Human
ugaggcaggagaauggcgugaaccu

SEQ ID NO: 646678 - RNA, 22 nt, Human
ugagugaagagugagacucccg

SEQ ID NO: 646679 - RNA, 24 nt, Human
ugauggugggcgccuguaguccca

SEQ ID NO: 646680 - RNA, 22 nt, Human
ugcaccuuuuacaaggugugcu

SEQ ID NO: 646681 - RNA, 23 nt, Human
ugcagucgccuccugggccuggc

SEQ ID NO: 646682 - RNA, 24 nt, Human
ugcccagugcccucagggaucagc

SEQ ID NO: 646683 - RNA, 24 nt, Human
uggaguccaagugauucucccacc

SEQ ID NO: 646684 - RNA, 22 nt, Human
uggcagugagcugagauugcgc

SEQ ID NO: 646685 - RNA, 24 nt, Human
uggcaugaucucagcuuacugcaa

SEQ ID NO: 646686 - RNA, 24 nt, Human
uggccaggcugguuucgaacuccu

SEQ ID NO: 646687 - RNA, 18 nt, Human
ugggagcuuucucaaagc

SEQ ID NO: 646688 - RNA, 18 nt, Human
ugggaggcagagguggca

SEQ ID NO: 646689 - RNA, 19 nt, Human
ugggaggcagagguggcag

SEQ ID NO: 646690 - RNA, 21 nt, Human
ugggaggcagagguggcagug

SEQ ID NO: 646691 - RNA, 19 nt, Human
ugggaggccgaggcgggcg

SEQ ID NO: 646692 - RNA, 24 nt, Human
ugggaggccgaggcgggcggauca

SEQ ID NO: 646693 - RNA, 21 nt, Human
ugggauaucaucaaacugucu

SEQ ID NO: 646694 - RNA, 20 nt, Human
ugggauggagcccaagaagc

SEQ ID NO: 646695 - RNA, 18 nt, Human
ugggauuacaggagugug

SEQ ID NO: 646696 - RNA, 22 nt, Human
ugggauuacaggagugugccac

SEQ ID NO: 646697 - RNA, 24 nt, Human
ugggauuacaggagugugccacca

SEQ ID NO: 646698 - RNA, 18 nt, Human
ugggauuacaggcaugag

SEQ ID NO: 646699 - RNA, 19 nt, Human
ugggauuacaggcaugagc

SEQ ID NO: 646700 - RNA, 21 nt, Human
ugggauuacaggcaugagcca

SEQ ID NO: 646701 - RNA, 22 nt, Human
ugggauuacaggcaugagccac

SEQ ID NO: 646702 - RNA, 23 nt, Human
ugggauuacaggcaugagccacc

SEQ ID NO: 646703 - RNA, 24 nt, Human
ugggauuacaggcaugagccaccg

SEQ ID NO: 646704 - RNA, 24 nt, Human
ugggauuacaggcaugagccaccg

SEQ ID NO: 646705 - RNA, 18 nt, Human
uggggaguugggauggag

SEQ ID NO: 646706 - RNA, 19 nt, Human
ugggggaagggaacacgca

SEQ ID NO: 646707 - RNA, 21 nt, Human
uggugggcgccuguaguccca

SEQ ID NO: 646708 - RNA, 18 nt, Human
ugucagccaggcgcgguu

SEQ ID NO: 646709 - RNA, 21 nt, Human
ugugcucacagcagaagucca

SEQ ID NO: 646710 - RNA, 22 nt, Human
uguggguuugcaagaagaucag

SEQ ID NO: 646711 - RNA, 18 nt, Human
uuacugcaaccuccaccu

SEQ ID NO: 646712 - RNA, 22 nt, Human
uuacugcaaccuccaccucugg

SEQ ID NO: 646713 - RNA, 31 nt, Human
uuacugcaaccuccaccucuggaguccaagg

SEQ ID NO: 646714 - RNA, 24 nt, Human
uuagccaggcgugauggugggcgc

SEQ ID NO: 646715 - RNA, 18 nt, Human
uuaguagagaggggguuu

SEQ ID NO: 646716 - RNA, 21 nt, Human
uuaguagagaggggguuucac

SEQ ID NO: 646717 - RNA, 24 nt, Human
uuaguagagaggggguuucacuau

SEQ ID NO: 646718 - RNA, 24 nt, Human
uuccucacugggagcuuucucaaa

SEQ ID NO: 646719 - RNA, 24 nt, Human
uugauaguagggaccugcuucccc

SEQ ID NO: 646720 - RNA, 24 nt, Human
uugcucacgccuguaaucccagca

SEQ ID NO: 646721 - RNA, 20 nt, Human
uugucaucacugguggggag

SEQ ID NO: 646722 - RNA, 24 nt, Human
uuucacuauguuggccaggcuggu

SEQ ID NO: 646723 - RNA, 23 nt, Human
uuucgaacuccugaccucaggug

SEQ ID NO: 646724 - RNA, 23 nt, Human
uuugucauuaaagauaaacaagu

SEQ ID NO: 646725 - RNA, 24 nt, Human
uuuuuaguagagaggggguuucac

SEQ ID NO: 646726 - RNA, 20 nt, Human
uuuuugcauuuuuaguagag

SEQ ID NO: 646727 - RNA, 25 nt, Human
uuuuuuuuuuuuuuuuucggacuuu

SEQ ID NO: 646728 - RNA, 23 nt, Human
uuuuuuuuuuuuuuuuuuuucgg

SEQ ID NO: 646729 - RNA, 23 nt, Human
aaaguauuuccauccugcuccua

SEQ ID NO: 646730 - RNA, 19 nt, Human
aacugcaugagcucaaaga

SEQ ID NO: 646731 - RNA, 26 nt, Human
aacugcaugagcucaaagaucucccc

SEQ ID NO: 646732 - RNA, 22 nt, Human
aagaucuccccgaugagcauac

SEQ ID NO: 646733 - RNA, 20 nt, Human
aagcaaaagccgaacggaac

SEQ ID NO: 646734 - RNA, 24 nt, Human
aagcaaaagccgaacggaacggga

SEQ ID NO: 646735 - RNA, 25 nt, Human
aagcagcaaugagggcccaggaaga

SEQ ID NO: 646736 - RNA, 18 nt, Human
aagccgguggauccagaa

SEQ ID NO: 646737 - RNA, 23 nt, Human
acagcaccaggcucugcagcugu

SEQ ID NO: 646738 - RNA, 23 nt, Human
acccuaacgcaaagcaaaagccg

SEQ ID NO: 646739 - RNA, 28 nt, Human
agaagacaccagcaaugacuggagaccc

SEQ ID NO: 646740 - RNA, 21 nt, Human
agacaccagcaaugaccagga

SEQ ID NO: 646741 - RNA, 20 nt, Human
agcaagcgaacagaacagga

SEQ ID NO: 646742 - RNA, 21 nt, Human
agcaccaggcucugcagcugu

SEQ ID NO: 646743 - RNA, 18 nt, Human
agccugggccugcugcuu

SEQ ID NO: 646744 - RNA, 18 nt, Human
agcgagaugcgggccaga

SEQ ID NO: 646745 - RNA, 20 nt, Human
agcuccaggccggggugcug

SEQ ID NO: 646746 - RNA, 19 nt, Human
aggcaaccacaaagaggaa

SEQ ID NO: 646747 - RNA, 23 nt, Human
aggcacagacacacaaacaccac

SEQ ID NO: 646748 - RNA, 22 nt, Human
aggcagccgagagaaaugagag

SEQ ID NO: 646749 - RNA, 23 nt, Human
agggaagguugcagggguugagg

SEQ ID NO: 646750 - RNA, 18 nt, Human
agggauagcuagcagagc

SEQ ID NO: 646751 - RNA, 19 nt, Human
auggugcugugagcccggc

SEQ ID NO: 646752 - RNA, 24 nt, Human
caaacaccacacacguggggccag

SEQ ID NO: 646753 - RNA, 21 nt, Human
caaagcaaaagccgaacggaa

SEQ ID NO: 646754 - RNA, 20 nt, Human
caagcagcacacacaggcca

SEQ ID NO: 646755 - RNA, 23 nt, Human
cacacacaggccagugaugugca

SEQ ID NO: 646756 - RNA, 21 nt, Human
cacagccugaccugcucaucu

SEQ ID NO: 646757 - RNA, 21 nt, Human
caccagcaaugaccaggaugg

SEQ ID NO: 646758 - RNA, 20 nt, Human
caccccagagccugucaugg

SEQ ID NO: 646759 - RNA, 27 nt, Human
cacccuccaagaggcagccgagagaaa

SEQ ID NO: 646760 - RNA, 22 nt, Human
cacgcugcucccggagcuggcu

SEQ ID NO: 646761 - RNA, 24 nt, Human
cagaagacaccagcaaugaccagg

SEQ ID NO: 646762 - RNA, 25 nt, Human
cagacacacaaacaccacacacgug

SEQ ID NO: 646763 - RNA, 20 nt, Human
cagcccaaagccucgggcga

SEQ ID NO: 646764 - RNA, 18 nt, Human
cagcugggugaggggugg

SEQ ID NO: 646765 - RNA, 19 nt, Human
caggcccaaccuccccacu

SEQ ID NO: 646766 - RNA, 20 nt, Human
caggucucugggcaguggag

SEQ ID NO: 646767 - RNA, 23 nt, Human
ccacaaagaggaacugcaugagc

SEQ ID NO: 646768 - RNA, 22 nt, Human
ccacacacguggggccagggaa

SEQ ID NO: 646769 - RNA, 20 nt, Human
ccaggccggggugcugcaca

SEQ ID NO: 646770 - RNA, 19 nt, Human
cccaaagccggaccacagc

SEQ ID NO: 646771 - RNA, 21 nt, Human
cccacacgcugcucccggagc

SEQ ID NO: 646772 - RNA, 23 nt, Human
ccccaaauuccucuccuggggcu

SEQ ID NO: 646773 - RNA, 22 nt, Human
ccccaugcagggcgguggucuc

SEQ ID NO: 646774 - RNA, 20 nt, Human
cccggagcuggcuguccugg

SEQ ID NO: 646775 - RNA, 20 nt, Human
cccgggcgcccucucccccu

SEQ ID NO: 646776 - RNA, 21 nt, Human
cccgugugcccucgguuccua

SEQ ID NO: 646777 - RNA, 21 nt, Human
ccugugccuggagcccugcag

SEQ ID NO: 646778 - RNA, 24 nt, Human
cgacugcccaucuucugcccaccc

SEQ ID NO: 646779 - RNA, 23 nt, Human
cgggcagcgcaauucaccacucu

SEQ ID NO: 646780 - RNA, 23 nt, Human
cgguuccuaggccccaaauuccu

SEQ ID NO: 646781 - RNA, 21 nt, Human
cuacccugcuccgcuccgagu

SEQ ID NO: 646782 - RNA, 22 nt, Human
cuccaagaggcagccgagagaa

SEQ ID NO: 646783 - RNA, 20 nt, Human
cuccacaguuggcacagguu

SEQ ID NO: 646784 - RNA, 20 nt, Human
cucccaaagccggaccacag

SEQ ID NO: 646785 - RNA, 22 nt, Human
cucucccaaagccggaccacag

SEQ ID NO: 646786 - RNA, 19 nt, Human
cuguacacggucccuaccc

SEQ ID NO: 646787 - RNA, 18 nt, Human
gaacuugauaagccggug

SEQ ID NO: 646788 - RNA, 21 nt, Human
gagcuggacgcuagggucuuc

SEQ ID NO: 646789 - RNA, 22 nt, Human
gcaaagcaaaagccgaacggaa

SEQ ID NO: 646790 - RNA, 22 nt, Human
gcaaugagggcccaggaagacc

SEQ ID NO: 646791 - RNA, 18 nt, Human
gcaauucaccacucuccc

SEQ ID NO: 646792 - RNA, 18 nt, Human
gcacugugccaggaucug

SEQ ID NO: 646793 - RNA, 18 nt, Human
gcagcaaaguauuuccau

SEQ ID NO: 646794 - RNA, 18 nt, Human
gcccucucccccuucauc

SEQ ID NO: 646795 - RNA, 19 nt, Human
gcccucucccccuucauca

SEQ ID NO: 646796 - RNA, 20 nt, Human
gcccugugccuggagcccug

SEQ ID NO: 646797 - RNA, 19 nt, Human
gcgacuucagcccugugcc

SEQ ID NO: 646798 - RNA, 20 nt, Human
ggcacagacacacaaacacc

SEQ ID NO: 646799 - RNA, 18 nt, Human
ggcaguggagggccccgg

SEQ ID NO: 646800 - RNA, 21 nt, Human
ggcccauccuaaaagauggca

SEQ ID NO: 646801 - RNA, 23 nt, Human
gggagaaggagcgcagggcagag

SEQ ID NO: 646802 - RNA, 18 nt, Human
ggggagaaggagcgcagg

SEQ ID NO: 646803 - RNA, 25 nt, Human
ggggagaaggagcgcagggcagagg

SEQ ID NO: 646804 - RNA, 27 nt, Human
gguagugaaggcaaccacaaagaggaa

SEQ ID NO: 646805 - RNA, 24 nt, Human
ggucucugggcaguggagggcccc

SEQ ID NO: 646806 - RNA, 21 nt, Human
guuucuagcaccacacucuga

SEQ ID NO: 646807 - RNA, 21 nt, Human
uacagacuugagcaggcaaaa

SEQ ID NO: 646808 - RNA, 23 nt, Human
uacgauaagcagcaaugagggcc

SEQ ID NO: 646809 - RNA, 24 nt, Human
uacgauaagcagcaaugagggccc

SEQ ID NO: 646810 - RNA, 18 nt, Human
uagcucauccuccgagcc

SEQ ID NO: 646811 - RNA, 19 nt, Human
uaggagcagucccagcaug

SEQ ID NO: 646812 - RNA, 21 nt, Human
uaggccccaaauuccucuccu

SEQ ID NO: 646813 - RNA, 22 nt, Human
ucagaggagccgucccauggca

SEQ ID NO: 646814 - RNA, 21 nt, Human
ucagggcacagcgagaugcgg

SEQ ID NO: 646815 - RNA, 22 nt, Human
uccaagaggcagccgagagaaa

SEQ ID NO: 646816 - RNA, 23 nt, Human
uccaggcccaaccuccccacucc

SEQ ID NO: 646817 - RNA, 26 nt, Human
uccauccugcuccuacaauuuagaaa

SEQ ID NO: 646818 - RNA, 23 nt, Human
ucccagcaugcagugcagcagcc

SEQ ID NO: 646819 - RNA, 19 nt, Human
uccccgaugagcauacaug

SEQ ID NO: 646820 - RNA, 22 nt, Human
ucccugcuuggcagcuucuauc

SEQ ID NO: 646821 - RNA, 24 nt, Human
uccgagcccucuucgggcacgggc

SEQ ID NO: 646822 - RNA, 19 nt, Human
uccuaggccccaaauuccu

SEQ ID NO: 646823 - RNA, 20 nt, Human
uccuaggccccaaauuccuc

SEQ ID NO: 646824 - RNA, 25 nt, Human
uccuaggccccaaauuccucuccug

SEQ ID NO: 646825 - RNA, 19 nt, Human
uccugggccacaggaaccc

SEQ ID NO: 646826 - RNA, 24 nt, Human
uccugggccacaggaacccugcuc

SEQ ID NO: 646827 - RNA, 21 nt, Human
ucucugggcaguggagggccc

SEQ ID NO: 646828 - RNA, 23 nt, Human
ucugacagcaccaggcucugcag

SEQ ID NO: 646829 - RNA, 18 nt, Human
ugaauccuggcacuacag

SEQ ID NO: 646830 - RNA, 19 nt, Human
ugagagggaacccugggca

SEQ ID NO: 646831 - RNA, 22 nt, Human
ugagcaggcaaaaaggcgucug

SEQ ID NO: 646832 - RNA, 19 nt, Human
ugcagcggggagaaggagc

SEQ ID NO: 646833 - RNA, 18 nt, Human
ugcagcuguccuucccac

SEQ ID NO: 646834 - RNA, 22 nt, Human
ugcagggguugaggguccaggc

SEQ ID NO: 646835 - RNA, 20 nt, Human
ugcagguagaaggaguggaa

SEQ ID NO: 646836 - RNA, 21 nt, Human
ugcagugcagcagcccaaagc

SEQ ID NO: 646837 - RNA, 22 nt, Human
ugcagugcagcagcccaaagcc

SEQ ID NO: 646838 - RNA, 19 nt, Human
ugcccucgguuccuaggcc

SEQ ID NO: 646839 - RNA, 20 nt, Human
ugccgacugcccaucuucug

SEQ ID NO: 646840 - RNA, 26 nt, Human
ugcugugagcccggccugugggcgcc

SEQ ID NO: 646841 - RNA, 23 nt, Human
uggagcuggugcauauagagggc

SEQ ID NO: 646842 - RNA, 19 nt, Human
uggcacagguucucccugc

SEQ ID NO: 646843 - RNA, 24 nt, Human
uggcacuacagacuugagcaggca

SEQ ID NO: 646844 - RNA, 20 nt, Human
uguaaagguggcaguacugg

SEQ ID NO: 646845 - RNA, 20 nt, Human
uguccuucccacacgcugcu

SEQ ID NO: 646846 - RNA, 23 nt, Human
uucaccacucucccaaagccgga

SEQ ID NO: 646847 - RNA, 21 nt, Human
uuccuaggccccaaauuccuc

SEQ ID NO: 646848 - RNA, 21 nt, Human
uuuuucuggucaaacucccuu

SEQ ID NO: 646849 - RNA, 28 nt, Human
uuuuuuuuuuuuuuuuuuuuucuggggg

SEQ ID NO: 646850 - RNA, 19 nt, Human
aaagucuuucccagcacau

SEQ ID NO: 646851 - RNA, 24 nt, Human
accccaucuccuccuugccugcag

SEQ ID NO: 646852 - RNA, 23 nt, Human
accccgacagccccgcaaagcug

SEQ ID NO: 646853 - RNA, 21 nt, Human
agaaggagauuagucacacug

SEQ ID NO: 646854 - RNA, 21 nt, Human
aggccucuggccggcgaguuc

SEQ ID NO: 646855 - RNA, 18 nt, Human
agggcugugggaacucug

SEQ ID NO: 646856 - RNA, 24 nt, Human
agucaccccaucuccuccuugccu

SEQ ID NO: 646857 - RNA, 25 nt, Human
aucauccccucagcuucagggaccc

SEQ ID NO: 646858 - RNA, 22 nt, Human
aucgucuuucccaccuccccag

SEQ ID NO: 646859 - RNA, 23 nt, Human
caagcccguucucccaucgcuca

SEQ ID NO: 646860 - RNA, 18 nt, Human
cagccaccaccccaucuc

SEQ ID NO: 646861 - RNA, 22 nt, Human
cauccccucagcuucagggacc

SEQ ID NO: 646862 - RNA, 24 nt, Human
caucucugccuccucugagcaaaa

SEQ ID NO: 646863 - RNA, 22 nt, Human
ccaucgcucaucaaaugaacuc

SEQ ID NO: 646864 - RNA, 19 nt, Human
cccaucucugccuccucug

SEQ ID NO: 646865 - RNA, 19 nt, Human
ccccaucuccuccuugccu

SEQ ID NO: 646866 - RNA, 20 nt, Human
ccuccucugagcaaaaucgu

SEQ ID NO: 646867 - RNA, 21 nt, Human
ccugcagggucucgcuccauc

SEQ ID NO: 646868 - RNA, 21 nt, Human
ccuugaaggguagggaccaug

SEQ ID NO: 646869 - RNA, 23 nt, Human
cgucuuucccaccuccccagccc

SEQ ID NO: 646870 - RNA, 18 nt, Human
cugcuuccuuaccuuugc

SEQ ID NO: 646871 - RNA, 20 nt, Human
cuuggaccccgcagccuccc

SEQ ID NO: 646872 - RNA, 23 nt, Human
gacccugcaucucucucagccac

SEQ ID NO: 646873 - RNA, 24 nt, Human
gagcaaaaucgucuuucccaccuc

SEQ ID NO: 646874 - RNA, 22 nt, Human
gaguucucaagaugugcaaagg

SEQ ID NO: 646875 - RNA, 18 nt, Human
gccauccuuuccuugacc

SEQ ID NO: 646876 - RNA, 18 nt, Human
gccuuuugccccagcaaa

SEQ ID NO: 646877 - RNA, 19 nt, Human
ggaacucuggugcgauucu

SEQ ID NO: 646878 - RNA, 20 nt, Human
guccaccuagguucacuacc

SEQ ID NO: 646879 - RNA, 21 nt, Human
uagcucuggauuauauguccu

SEQ ID NO: 646880 - RNA, 19 nt, Human
uaggaucaagcccguucuc

SEQ ID NO: 646881 - RNA, 21 nt, Human
ucagcuguccucuuggacccc

SEQ ID NO: 646882 - RNA, 23 nt, Human
ucccaaccccgacagccccgcaa

SEQ ID NO: 646883 - RNA, 19 nt, Human
uccuguggccuuuugcccc

SEQ ID NO: 646884 - RNA, 18 nt, Human
ucucucagccaccacccc

SEQ ID NO: 646885 - RNA, 21 nt, Human
ucucugccuccucugagcaaa

SEQ ID NO: 646886 - RNA, 19 nt, Human
ucugcagacugccucggcc

SEQ ID NO: 646887 - RNA, 18 nt, Human
ugagucaccccaucuccu

SEQ ID NO: 646888 - RNA, 23 nt, Human
ugcacaccuuugcuuauuccuuu

SEQ ID NO: 646889 - RNA, 23 nt, Human
ugcaucucucucagccaccaccc

SEQ ID NO: 646890 - RNA, 24 nt, Human
ugcaucucucucagccaccacccc

SEQ ID NO: 646891 - RNA, 26 nt, Human
ugccucuccugccugaccaccgacuc

SEQ ID NO: 646892 - RNA, 19 nt, Human
ugccugcagggucucgcuc

SEQ ID NO: 646893 - RNA, 20 nt, Human
uggccuuuugccccagcaaa

SEQ ID NO: 646894 - RNA, 22 nt, Human
ugggcaucauccccucagcuuc

SEQ ID NO: 646895 - RNA, 19 nt, Human
ugucuuagcucuggauuau

SEQ ID NO: 646896 - RNA, 20 nt, Human
ugugcaaagguuuccugcuu

SEQ ID NO: 646897 - RNA, 24 nt, Human
uuaccuuugcacaccuuugcuuau

SEQ ID NO: 646898 - RNA, 19 nt, Human
uucccaccuccccagcccc

SEQ ID NO: 646899 - RNA, 20 nt, Human
uugccugcagggucucgcuc

SEQ ID NO: 646900 - RNA, 19 nt, Human
uuuccugcuuccuuaccuu

SEQ ID NO: 646901 - RNA, 22 nt, Human
aaaaaaaaguuuacacgaccag

SEQ ID NO: 646902 - RNA, 20 nt, Human
aaacaaaaacauguaaccuu

SEQ ID NO: 646903 - RNA, 20 nt, Human
aaagaacaaagugaagaaau

SEQ ID NO: 646904 - RNA, 23 nt, Human
aacaguguguguuuaauccagcc

SEQ ID NO: 646905 - RNA, 18 nt, Human
aaccuuuuuccuguuucu

SEQ ID NO: 646906 - RNA, 22 nt, Human
aagucagccucacacccacugg

SEQ ID NO: 646907 - RNA, 25 nt, Human
acacagcuuacagaggcguucaaag

SEQ ID NO: 646908 - RNA, 24 nt, Human
acaguuuuuauauuacaaccucaa

SEQ ID NO: 646909 - RNA, 23 nt, Human
acuccaaaaaagguaaaaggaag

SEQ ID NO: 646910 - RNA, 21 nt, Human
acucugcucccaagagcccag

SEQ ID NO: 646911 - RNA, 25 nt, Human
acuggacucugcucccaagagccca

SEQ ID NO: 646912 - RNA, 20 nt, Human
acuugguaaacagugugugu

SEQ ID NO: 646913 - RNA, 22 nt, Human
agaaaaagaacaaagugaagaa

SEQ ID NO: 646914 - RNA, 18 nt, Human
aggaagugguggugucug

SEQ ID NO: 646915 - RNA, 21 nt, Human
aggccucccuccacccaccuc

SEQ ID NO: 646916 - RNA, 22 nt, Human
agguacaacagaugcgacacca

SEQ ID NO: 646917 - RNA, 20 nt, Human
agguuuguuuuuguuuucuu

SEQ ID NO: 646918 - RNA, 28 nt, Human
caaaaaagguaaaaggaauuucacaagu

SEQ ID NO: 646919 - RNA, 22 nt, Human
caaccucaaggacagagggagg

SEQ ID NO: 646920 - RNA, 23 nt, Human
cacacgggacaugaaagcgaggu

SEQ ID NO: 646921 - RNA, 25 nt, Human
cacagaaucacaguguaagauauuc

SEQ ID NO: 646922 - RNA, 24 nt, Human
cacggaucagcagaacauacacga

SEQ ID NO: 646923 - RNA, 23 nt, Human
cacuggacucugcucccaagagc

SEQ ID NO: 646924 - RNA, 19 nt, Human
cagagaauucccacccaca

SEQ ID NO: 646925 - RNA, 18 nt, Human
cagaugcgacaccaugca

SEQ ID NO: 646926 - RNA, 26 nt, Human
cagcagaacauacacgaacaagggaa

SEQ ID NO: 646927 - RNA, 22 nt, Human
caguaaacaaaaacauguaacc

SEQ ID NO: 646928 - RNA, 18 nt, Human
cagugucuucguuggacc

SEQ ID NO: 646929 - RNA, 18 nt, Human
ccaaaacacacgggacau

SEQ ID NO: 646930 - RNA, 21 nt, Human
ccaaagguacaacagaugcga

SEQ ID NO: 646931 - RNA, 22 nt, Human
ccagugagacugcucgcaacuu

SEQ ID NO: 646932 - RNA, 20 nt, Human
cccacacguacagaaacaca

SEQ ID NO: 646933 - RNA, 24 nt, Human
cccacccacacguacagaaacaca

SEQ ID NO: 646934 - RNA, 22 nt, Human
ccgucagagaauucccacccac

SEQ ID NO: 646935 - RNA, 24 nt, Human
ccucaaggacagagggagggaagu

SEQ ID NO: 646936 - RNA, 23 nt, Human
ccucccccgcacaugcgauaccu

SEQ ID NO: 646937 - RNA, 18 nt, Human
ccucccuccacccaccuc

SEQ ID NO: 646938 - RNA, 28 nt, Human
ccucgcuggauccuucccaccuucccca

SEQ ID NO: 646939 - RNA, 18 nt, Human
ccuuuuuccuguuucucu

SEQ ID NO: 646940 - RNA, 20 nt, Human
cgacaccaugcagacacgca

SEQ ID NO: 646941 - RNA, 22 nt, Human
cuacagcuucaauuuccaaaaa

SEQ ID NO: 646942 - RNA, 18 nt, Human
cucccuccacccaccucg

SEQ ID NO: 646943 - RNA, 23 nt, Human
cucgcuggauccuucccaccuuc

SEQ ID NO: 646944 - RNA, 23 nt, Human
cuguucuguagccaaaccaauuu

SEQ ID NO: 646945 - RNA, 19 nt, Human
cuuacagaggcguucaaag

SEQ ID NO: 646946 - RNA, 19 nt, Human
cuuccccaacugccuacug

SEQ ID NO: 646947 - RNA, 27 nt, Human
gaaaaaaauuccucuuaauuuuacuga

SEQ ID NO: 646948 - RNA, 18 nt, Human
gaacauacacgaacaagg

SEQ ID NO: 646949 - RNA, 20 nt, Human
gaccaguuuuuuauugucau

SEQ ID NO: 646950 - RNA, 18 nt, Human
gcagaacauacacgaaca

SEQ ID NO: 646951 - RNA, 19 nt, Human
gcguucaaaguagugacgc

SEQ ID NO: 646952 - RNA, 22 nt, Human
ggaagacauuccagaggaaauc

SEQ ID NO: 646953 - RNA, 26 nt, Human
ggacucgaagcagagugagaggccuc

SEQ ID NO: 646954 - RNA, 23 nt, Human
ggacucugcucccaagagcccag

SEQ ID NO: 646955 - RNA, 18 nt, Human
ggacugcaggguggccug

SEQ ID NO: 646956 - RNA, 20 nt, Human
ggcugaagugcugagcagug

SEQ ID NO: 646957 - RNA, 22 nt, Human
ggucugaaugaacacggaggau

SEQ ID NO: 646958 - RNA, 21 nt, Human
guccugauggcugaagugcug

SEQ ID NO: 646959 - RNA, 18 nt, Human
gucugaaugaacacggag

SEQ ID NO: 646960 - RNA, 23 nt, Human
gugcagacguacaccuguccagg

SEQ ID NO: 646961 - RNA, 18 nt, Human
guuuguuuuuguuuucuu

SEQ ID NO: 646962 - RNA, 22 nt, Human
uacaacagaugcgacaccaugc

SEQ ID NO: 646963 - RNA, 22 nt, Human
uaccagcccgucuuccagaugc

SEQ ID NO: 646964 - RNA, 22 nt, Human
uacuccaaaaaagguaaaagga

SEQ ID NO: 646965 - RNA, 19 nt, Human
uacuuuauuaaagaaauau

SEQ ID NO: 646966 - RNA, 18 nt, Human
uagggcauuugauaagag

SEQ ID NO: 646967 - RNA, 18 nt, Human
uauagcaaguacuccaaa

SEQ ID NO: 646968 - RNA, 22 nt, Human
uauagcaaguacuccaaaaaag

SEQ ID NO: 646969 - RNA, 23 nt, Human
ucaauuuccaaaaaaaaaaaaaa

SEQ ID NO: 646970 - RNA, 23 nt, Human
ucaauuuccaaaaaaaaaaaaaa

SEQ ID NO: 646971 - RNA, 19 nt, Human
ucagaacucagcguaagcu

SEQ ID NO: 646972 - RNA, 20 nt, Human
ucaggccacggaucagcaga

SEQ ID NO: 646973 - RNA, 18 nt, Human
ucauuugagguggagauc

SEQ ID NO: 646974 - RNA, 22 nt, Human
ucgggcagcacucuacagcuuc

SEQ ID NO: 646975 - RNA, 19 nt, Human
ugaagaaauguucagcucc

SEQ ID NO: 646976 - RNA, 22 nt, Human
ugaagacacagcuuacagaggc

SEQ ID NO: 646977 - RNA, 21 nt, Human
ugagguggagaucagagauca

SEQ ID NO: 646978 - RNA, 24 nt, Human
ugaugggugcagacguacaccugu

SEQ ID NO: 646979 - RNA, 19 nt, Human
ugcagacacgcagcuguga

SEQ ID NO: 646980 - RNA, 19 nt, Human
ugcucccaagagcccaggc

SEQ ID NO: 646981 - RNA, 24 nt, Human
uguuuuuguuuucuuucuguucug

SEQ ID NO: 646982 - RNA, 20 nt, Human
uuccucaaagcuagccucuu

SEQ ID NO: 646983 - RNA, 23 nt, Human
uugagguggagaucagagaucau

SEQ ID NO: 646984 - RNA, 20 nt, Human
uuuguuuucuuucuguucug

SEQ ID NO: 646985 - RNA, 18 nt, Human
uuuuuuuuuuuuuuuuug

SEQ ID NO: 646986 - RNA, 18 nt, Human
uuuuuuuuuuuuuuuuug

SEQ ID NO: 646987 - RNA, 19 nt, Human
auugcaaacucaggcugug

SEQ ID NO: 646988 - RNA, 21 nt, Human
caagucccagugucccaguuu

SEQ ID NO: 646989 - RNA, 20 nt, Human
cagggcaguggaggcggggu

SEQ ID NO: 646990 - RNA, 22 nt, Human
cuaagacuaauccacccagcgg

SEQ ID NO: 646991 - RNA, 21 nt, Human
gcaguggaggcggggucuaaa

SEQ ID NO: 646992 - RNA, 24 nt, Human
ggcggauccuaaggcagggguggg

SEQ ID NO: 646993 - RNA, 25 nt, Human
ggcguguccuaggccaaaggggcgg

SEQ ID NO: 646994 - RNA, 25 nt, Human
gggcguguccuaggccaaaggggcg

SEQ ID NO: 646995 - RNA, 24 nt, Human
ggugccugaggagagugggaggcc

SEQ ID NO: 646996 - RNA, 18 nt, Human
uaaaacaaacggcguacc

SEQ ID NO: 646997 - RNA, 19 nt, Human
uaaaacaaacggcguaccc

SEQ ID NO: 646998 - RNA, 27 nt, Human
uaggucccgagccuccgaggccaaagg

SEQ ID NO: 646999 - RNA, 27 nt, Human
ucccgagccuccgaggccaaaggcucc

SEQ ID NO: 647000 - RNA, 20 nt, Human
ucggggaaacggggcguguc

SEQ ID NO: 647001 - RNA, 21 nt, Human
ugggguguagcaggcggggcu

SEQ ID NO: 647002 - RNA, 23 nt, Human
ugggguguagcaggcggggcugu

SEQ ID NO: 647003 - RNA, 19 nt, Human
uguccuaggccaaaggggc

SEQ ID NO: 647004 - RNA, 19 nt, Human
uguccuaggccaaaggggc

SEQ ID NO: 647005 - RNA, 21 nt, Human
uguccuaggccaaaggggcgg

SEQ ID NO: 647006 - RNA, 19 nt, Human
uuuuuuuuuugcaaguccc

SEQ ID NO: 647007 - RNA, 22 nt, Human
uuuuuuuuuuuugcaaguccca

SEQ ID NO: 647008 - RNA, 18 nt, Human
uuuuuuuuuuuuuuuuug

SEQ ID NO: 647009 - RNA, 21 nt, Human
uuuuuuuuuuuuuuuuugcaa

SEQ ID NO: 647010 - RNA, 23 nt, Human
uuuuuuuuuuuuuuuuugcaagu

SEQ ID NO: 647011 - RNA, 22 nt, Human
agggaggaacaggugcaacagc

SEQ ID NO: 647012 - RNA, 21 nt, Human
cugaagcuuugaccacauuga

SEQ ID NO: 647013 - RNA, 26 nt, Human
gaacaggugcaacagcuagcguccuu

SEQ ID NO: 647014 - RNA, 18 nt, Human
ggacagccccgaacaaag

SEQ ID NO: 647015 - RNA, 21 nt, Human
uggacagccccgaacaaagac

SEQ ID NO: 647016 - RNA, 18 nt, Human
uuuuuuuuuuuuuuuuug

SEQ ID NO: 647017 - RNA, 19 nt, Human
uuuuuuuuuuuuuuuuugg

SEQ ID NO: 647018 - RNA, 20 nt, Human
aaaaaaacaacagucucaga

SEQ ID NO: 647019 - RNA, 26 nt, Human
aaaaaaacaacagucucagaagagga

SEQ ID NO: 647020 - RNA, 20 nt, Human
aaaacaacagucucagaaga

SEQ ID NO: 647021 - RNA, 26 nt, Human
aaacaacacacauuuuuuggaacuca

SEQ ID NO: 647022 - RNA, 18 nt, Human
aagccauggaccccucug

SEQ ID NO: 647023 - RNA, 25 nt, Human
acaaacaacacacauuuuuuggaac

SEQ ID NO: 647024 - RNA, 24 nt, Human
acaagcuuuucucccacaaucaag

SEQ ID NO: 647025 - RNA, 24 nt, Human
accacgcuucucagcaggcuggcu

SEQ ID NO: 647026 - RNA, 20 nt, Human
accccucugucuccccaacu

SEQ ID NO: 647027 - RNA, 19 nt, Human
acccuaucaccuaaccaug

SEQ ID NO: 647028 - RNA, 19 nt, Human
acuccaugcacacugacag

SEQ ID NO: 647029 - RNA, 18 nt, Human
acuugcacuuacucuggc

SEQ ID NO: 647030 - RNA, 18 nt, Human
agaagaggaugaggagga

SEQ ID NO: 647031 - RNA, 20 nt, Human
agaguaagcucuagugaagu

SEQ ID NO: 647032 - RNA, 19 nt, Human
agcucuaaaaaaacaacag

SEQ ID NO: 647033 - RNA, 21 nt, Human
aggcagacccucacccccucg

SEQ ID NO: 647034 - RNA, 21 nt, Human
aggccacaccagcuguuuggu

SEQ ID NO: 647035 - RNA, 18 nt, Human
auccauccacacacacac

SEQ ID NO: 647036 - RNA, 20 nt, Human
caccauggccacccucaggc

SEQ ID NO: 647037 - RNA, 22 nt, Human
cacccaaggaaacaaaggaaag

SEQ ID NO: 647038 - RNA, 24 nt, Human
cacuaccaccccacuaggcagggg

SEQ ID NO: 647039 - RNA, 19 nt, Human
cacuaggcaggggagcaga

SEQ ID NO: 647040 - RNA, 23 nt, Human
cacuucugagcccuggcaacccu

SEQ ID NO: 647041 - RNA, 24 nt, Human
cacuucugagcccuggcaacccua

SEQ ID NO: 647042 - RNA, 18 nt, Human
cagacccagcugcaccac

SEQ ID NO: 647043 - RNA, 25 nt, Human
caggcagacccucacccccucgugc

SEQ ID NO: 647044 - RNA, 24 nt, Human
caggcaggcagacccucacccccu

SEQ ID NO: 647045 - RNA, 21 nt, Human
cauacaaauauucauuuauac

SEQ ID NO: 647046 - RNA, 18 nt, Human
cauccacacacacacacc

SEQ ID NO: 647047 - RNA, 26 nt, Human
caugcacacgugcacauccauccaca

SEQ ID NO: 647048 - RNA, 18 nt, Human
caugcccauuucccacca

SEQ ID NO: 647049 - RNA, 21 nt, Human
ccagacccagcugcaccacgc

SEQ ID NO: 647050 - RNA, 26 nt, Human
ccauccacacacacacaccucacucc

SEQ ID NO: 647051 - RNA, 23 nt, Human
cccuaccauccucuccugcuggg

SEQ ID NO: 647052 - RNA, 18 nt, Human
cccuaggcauugcucuga

SEQ ID NO: 647053 - RNA, 22 nt, Human
cccucaggccacaccagcuguu

SEQ ID NO: 647054 - RNA, 21 nt, Human
cccucugucuccccaacuggg

SEQ ID NO: 647055 - RNA, 22 nt, Human
ccucacuccaugcacacugacc

SEQ ID NO: 647056 - RNA, 20 nt, Human
ccucugucuccccaacuggg

SEQ ID NO: 647057 - RNA, 27 nt, Human
ccugccacuuggugaagauucuaagag

SEQ ID NO: 647058 - RNA, 19 nt, Human
cgaggcaggguggggugag

SEQ ID NO: 647059 - RNA, 22 nt, Human
cggcaaaaagaaaaaaagcaug

SEQ ID NO: 647060 - RNA, 25 nt, Human
cggcaaaaagaaaaaaagcaugcac

SEQ ID NO: 647061 - RNA, 30 nt, Human
cgugcacauccauccacacacacacaccuu

SEQ ID NO: 647062 - RNA, 23 nt, Human
cuaaaaaaacaacagucucagaa

SEQ ID NO: 647063 - RNA, 25 nt, Human
cuaggcauugcucugaacccauacc

SEQ ID NO: 647064 - RNA, 24 nt, Human
cucacuccaugcacacugacagga

SEQ ID NO: 647065 - RNA, 20 nt, Human
cucaggccacaccagcuguu

SEQ ID NO: 647066 - RNA, 18 nt, Human
cugaaccccucugucucc

SEQ ID NO: 647067 - RNA, 20 nt, Human
cugcaccacgcuucucagca

SEQ ID NO: 647068 - RNA, 18 nt, Human
cuggcuccagccaccccc

SEQ ID NO: 647069 - RNA, 22 nt, Human
gaagccauggaccccucugccu

SEQ ID NO: 647070 - RNA, 21 nt, Human
gaguaagcucuagugaagucc

SEQ ID NO: 647071 - RNA, 18 nt, Human
gcacagaaaauaggugcu

SEQ ID NO: 647072 - RNA, 22 nt, Human
gcaggcagacccucacccccuc

SEQ ID NO: 647073 - RNA, 18 nt, Human
gcaggugguccugcccag

SEQ ID NO: 647074 - RNA, 22 nt, Human
gcccccuuuuauuuuuuggggg

SEQ ID NO: 647075 - RNA, 22 nt, Human
ggaaacaaaggaaaggugcggc

SEQ ID NO: 647076 - RNA, 19 nt, Human
ggagguauuuauucucaug

SEQ ID NO: 647077 - RNA, 22 nt, Human
ggcaggcagacccucacccccu

SEQ ID NO: 647078 - RNA, 21 nt, Human
ggggguggggaggugaagagg

SEQ ID NO: 647079 - RNA, 21 nt, Human
gggguggggaggugaagaggg

SEQ ID NO: 647080 - RNA, 22 nt, Human
gggguggggaggugaagaggga

SEQ ID NO: 647081 - RNA, 18 nt, Human
ggugcggcgaggcagggu

SEQ ID NO: 647082 - RNA, 25 nt, Human
gugcacauccauccacacacacaca

SEQ ID NO: 647083 - RNA, 21 nt, Human
guggaauaaaguuuaugcccc

SEQ ID NO: 647084 - RNA, 18 nt, Human
guggccugccacuuggug

SEQ ID NO: 647085 - RNA, 27 nt, Human
uaaaaaaacaacagucucagaagagga

SEQ ID NO: 647086 - RNA, 24 nt, Human
uaagaggagcagggacuauugggg

SEQ ID NO: 647087 - RNA, 24 nt, Human
uaggcaccaugaggccccaccaca

SEQ ID NO: 647088 - RNA, 26 nt, Human
uaucuccuccuaggcaccaugaggcc

SEQ ID NO: 647089 - RNA, 23 nt, Human
uccacacacacacaccucacucc

SEQ ID NO: 647090 - RNA, 24 nt, Human
uccacacacacacaccucacucca

SEQ ID NO: 647091 - RNA, 26 nt, Human
uccacacacacacaccucacuccaug

SEQ ID NO: 647092 - RNA, 22 nt, Human
uccagaguaagcucuagugaag

SEQ ID NO: 647093 - RNA, 19 nt, Human
ucccugggcuggggaagcc

SEQ ID NO: 647094 - RNA, 20 nt, Human
uccuaggcaccaugaggccc

SEQ ID NO: 647095 - RNA, 21 nt, Human
uccuaggcaccaugaggcccc

SEQ ID NO: 647096 - RNA, 26 nt, Human
uccugggugccagacgcagguggucc

SEQ ID NO: 647097 - RNA, 20 nt, Human
ucuacacacaccacugucca

SEQ ID NO: 647098 - RNA, 22 nt, Human
ucuacacacaccacuguccagg

SEQ ID NO: 647099 - RNA, 21 nt, Human
ucucagcaggcuggcuccagc

SEQ ID NO: 647100 - RNA, 19 nt, Human
ucucccacaaucaagcucu

SEQ ID NO: 647101 - RNA, 27 nt, Human
ugaggccuguggcguggguaccuggca

SEQ ID NO: 647102 - RNA, 31 nt, Human
ugcacacgugcacauccauccacacacacag

SEQ ID NO: 647103 - RNA, 21 nt, Human
ugccucaccuccugggugcca

SEQ ID NO: 647104 - RNA, 21 nt, Human
ugccucaccuccugggugccg

SEQ ID NO: 647105 - RNA, 21 nt, Human
ugccugcacuccaugacuugc

SEQ ID NO: 647106 - RNA, 24 nt, Human
ugccugcacuccaugacuugcacu

SEQ ID NO: 647107 - RNA, 18 nt, Human
ugcucugaacccauacca

SEQ ID NO: 647108 - RNA, 21 nt, Human
uggaauaaaguuuaugccccc

SEQ ID NO: 647109 - RNA, 18 nt, Human
uggcaacccuaccauccu

SEQ ID NO: 647110 - RNA, 22 nt, Human
uucacccaaggaaacaaaggaa

SEQ ID NO: 647111 - RNA, 22 nt, Human
uucauuuauacaauaaggaaaa

SEQ ID NO: 647112 - RNA, 22 nt, Human
uucccaagucugaaccccucug

SEQ ID NO: 647113 - RNA, 22 nt, Human
uucccaccauggccacccucag

SEQ ID NO: 647114 - RNA, 22 nt, Human
uucuacacacaccacuguccag

SEQ ID NO: 647115 - RNA, 20 nt, Human
uucuccaguggaauaaaguu

SEQ ID NO: 647116 - RNA, 22 nt, Human
uucucccacaaucaagcucuaa

SEQ ID NO: 647117 - RNA, 21 nt, Human
uuugggggguggggaggugaa

SEQ ID NO: 647118 - RNA, 21 nt, Human
uuuuuugggggguggggaggu

SEQ ID NO: 647119 - RNA, 21 nt, Human
uuuuuuuuuuuggugugugug

SEQ ID NO: 647120 - RNA, 20 nt, Human
uuuuuuuuuuuuuuuuuggu

SEQ ID NO: 647121 - RNA, 23 nt, Human
uuuuuuuuuuuuuuuuuggugug

SEQ ID NO: 647122 - RNA, 20 nt, Human
uuuuuuuuuuuuuuuuuugg

SEQ ID NO: 647123 - RNA, 22 nt, Human
aaaaagaaacaugcaaaaaaaa

SEQ ID NO: 647124 - RNA, 18 nt, Human
aaaagaaacaugcaaaaa

SEQ ID NO: 647125 - RNA, 24 nt, Human
aaugauacaaacaacaauacaaaa

SEQ ID NO: 647126 - RNA, 18 nt, Human
acaguuggacauugcucu

SEQ ID NO: 647127 - RNA, 23 nt, Human
agacguucgacacugauuguaug

SEQ ID NO: 647128 - RNA, 21 nt, Human
agagagacguucgacacugau

SEQ ID NO: 647129 - RNA, 21 nt, Human
aggcugggggcugccugcuga

SEQ ID NO: 647130 - RNA, 18 nt, Human
aucucaguggacugugug

SEQ ID NO: 647131 - RNA, 19 nt, Human
augauacaaacaacaauac

SEQ ID NO: 647132 - RNA, 18 nt, Human
augcaaaaaaaaucggaa

SEQ ID NO: 647133 - RNA, 28 nt, Human
caaaaaaaaucggaaugaaaaaaggaga

SEQ ID NO: 647134 - RNA, 23 nt, Human
caaaaagaaacaugcaaaaaaaa

SEQ ID NO: 647135 - RNA, 23 nt, Human
caaaacaaaaauucccuaaagga

SEQ ID NO: 647136 - RNA, 24 nt, Human
caaaacaacugugcucaugcaggc

SEQ ID NO: 647137 - RNA, 21 nt, Human
caaaauaguugugcuguugac

SEQ ID NO: 647138 - RNA, 18 nt, Human
caccuggccagcauuggc

SEQ ID NO: 647139 - RNA, 24 nt, Human
cagaaauugagacuaccccucgcc

SEQ ID NO: 647140 - RNA, 22 nt, Human
caugcaaaaaaaaucggaauga

SEQ ID NO: 647141 - RNA, 24 nt, Human
ccagcauuggccucccggccucca

SEQ ID NO: 647142 - RNA, 20 nt, Human
ccagcugccccuugaccucu

SEQ ID NO: 647143 - RNA, 18 nt, Human
ccaggcccugaagaggac

SEQ ID NO: 647144 - RNA, 21 nt, Human
ccccuugaccucuguuggucc

SEQ ID NO: 647145 - RNA, 22 nt, Human
ccucccggccuccagugggagu

SEQ ID NO: 647146 - RNA, 21 nt, Human
ccuggccagcauuggccuccc

SEQ ID NO: 647147 - RNA, 22 nt, Human
ccuggccagcauuggccucccg

SEQ ID NO: 647148 - RNA, 22 nt, Human
cggccuccagugggaguccccu

SEQ ID NO: 647149 - RNA, 19 nt, Human
cuacggacccacggcgcca

SEQ ID NO: 647150 - RNA, 21 nt, Human
cuccaaccugcagcacagguu

SEQ ID NO: 647151 - RNA, 22 nt, Human
cuggacuggcugucugcagagg

SEQ ID NO: 647152 - RNA, 22 nt, Human
cugggucacgugugucugggag

SEQ ID NO: 647153 - RNA, 20 nt, Human
gaaauuggggcugcccaggc

SEQ ID NO: 647154 - RNA, 19 nt, Human
gaacucggggaccccggug

SEQ ID NO: 647155 - RNA, 18 nt, Human
gacagaaauugagacuac

SEQ ID NO: 647156 - RNA, 21 nt, Human
gagaaaagaaaaguaaaacgc

SEQ ID NO: 647157 - RNA, 23 nt, Human
gauuugcaggugugaguacauca

SEQ ID NO: 647158 - RNA, 24 nt, Human
gauuugcaggugugaguacaucau

SEQ ID NO: 647159 - RNA, 18 nt, Human
ggaaugaaaaaaggagag

SEQ ID NO: 647160 - RNA, 18 nt, Human
ggcccuaggcugggggcu

SEQ ID NO: 647161 - RNA, 20 nt, Human
ggccucccggccuccagugg

SEQ ID NO: 647162 - RNA, 22 nt, Human
ggggcugccugcugaccaaggc

SEQ ID NO: 647163 - RNA, 22 nt, Human
uccccaaaacaacugugcucau

SEQ ID NO: 647164 - RNA, 22 nt, Human
ucucugagagccugacaguugg

SEQ ID NO: 647165 - RNA, 21 nt, Human
ugaccucuguugguccaucuc

SEQ ID NO: 647166 - RNA, 18 nt, Human
ugaggcaucucugagagc

SEQ ID NO: 647167 - RNA, 23 nt, Human
ugauacaaacaacaauacaaaau

SEQ ID NO: 647168 - RNA, 25 nt, Human
ugauacaaacaacaauacaaaauag

SEQ ID NO: 647169 - RNA, 19 nt, Human
ugcagcacagguuucuccu

SEQ ID NO: 647170 - RNA, 24 nt, Human
ugcccaggcccugaagaggacugu

SEQ ID NO: 647171 - RNA, 24 nt, Human
ugcuagggaaacugaggcaucucu

SEQ ID NO: 647172 - RNA, 24 nt, Human
uggagagaacagaauuaucaucuc

SEQ ID NO: 647173 - RNA, 19 nt, Human
uggcccuaggcugggggcu

SEQ ID NO: 647174 - RNA, 18 nt, Human
ugggggcugccugcugac

SEQ ID NO: 647175 - RNA, 22 nt, Human
ugguacaaaaugauacaaacaa

SEQ ID NO: 647176 - RNA, 24 nt, Human
uucuccuguuugcaaaacaaaaau

SEQ ID NO: 647177 - RNA, 18 nt, Human
uuuuuuuuuuuuuuuuug

SEQ ID NO: 647178 - RNA, 28 nt, Human
uuuuuuuuuuuuuuuuuuuuuuuggggg

SEQ ID NO: 647179 - RNA, 22 nt, Human
aaacccaaaguccagccagcag

SEQ ID NO: 647180 - RNA, 21 nt, Human
aagaagauggugugguugcug

SEQ ID NO: 647181 - RNA, 21 nt, Human
aagaagauggugugguugcug

SEQ ID NO: 647182 - RNA, 21 nt, Human
aagaggcgaggugagcauugc

SEQ ID NO: 647183 - RNA, 21 nt, Human
aagaggcgaggugagcauugc

SEQ ID NO: 647184 - RNA, 23 nt, Human
aagcaacugcagcauggcccuuc

SEQ ID NO: 647185 - RNA, 28 nt, Human
acccaaaguccagccagcagggcccccc

SEQ ID NO: 647186 - RNA, 23 nt, Human
accccacuccccagaaaucuggg

SEQ ID NO: 647187 - RNA, 21 nt, Human
accucucacagcaagaagaug

SEQ ID NO: 647188 - RNA, 21 nt, Human
accucucacagcaagaagaug

SEQ ID NO: 647189 - RNA, 20 nt, Human
acggaagguuuccugucagu

SEQ ID NO: 647190 - RNA, 20 nt, Human
acggaagguuuccugucagu

SEQ ID NO: 647191 - RNA, 19 nt, Human
acggguauguggggagcag

SEQ ID NO: 647192 - RNA, 18 nt, Human
acucgcccuuccucuucu

SEQ ID NO: 647193 - RNA, 25 nt, Human
acugagaccccaggccucugucugg

SEQ ID NO: 647194 - RNA, 19 nt, Human
agaaacccaaaguccagcc

SEQ ID NO: 647195 - RNA, 19 nt, Human
agaaacccaaaguccagcc

SEQ ID NO: 647196 - RNA, 21 nt, Human
agauggugugguugcuggggc

SEQ ID NO: 647197 - RNA, 21 nt, Human
agauggugugguugcuggggc

SEQ ID NO: 647198 - RNA, 19 nt, Human
agcaggguuguggccaggg

SEQ ID NO: 647199 - RNA, 21 nt, Human
agccucugcacugcacccugg

SEQ ID NO: 647200 - RNA, 24 nt, Human
aggacuaggcggggcggggacugc

SEQ ID NO: 647201 - RNA, 24 nt, Human
aggacuaggcggggcggggacugc

SEQ ID NO: 647202 - RNA, 21 nt, Human
aggagguggggcccgaggccc

SEQ ID NO: 647203 - RNA, 18 nt, Human
aggcacccccacccuggg

SEQ ID NO: 647204 - RNA, 18 nt, Human
aggcacccccacccuggg

SEQ ID NO: 647205 - RNA, 23 nt, Human
aggcccgggccugcaacccuggc

SEQ ID NO: 647206 - RNA, 20 nt, Human
aggccgggccugcacccguc

SEQ ID NO: 647207 - RNA, 21 nt, Human
agggggcaggggcugcacgaa

SEQ ID NO: 647208 - RNA, 20 nt, Human
agggugcuccgugagcuggg

SEQ ID NO: 647209 - RNA, 18 nt, Human
agugacaggagguagccc

SEQ ID NO: 647210 - RNA, 18 nt, Human
agugacaggagguagccc

SEQ ID NO: 647211 - RNA, 24 nt, Human
aguggccuugugacguggccgggc

SEQ ID NO: 647212 - RNA, 19 nt, Human
aguggggaagaggcgaggu

SEQ ID NO: 647213 - RNA, 19 nt, Human
aguggggaagaggcgaggu

SEQ ID NO: 647214 - RNA, 20 nt, Human
caaaguccagccagcagggc

SEQ ID NO: 647215 - RNA, 19 nt, Human
caaagugcaggugcuucuc

SEQ ID NO: 647216 - RNA, 23 nt, Human
caaccugucagggacuggucugg

SEQ ID NO: 647217 - RNA, 24 nt, Human
caaccugucagggacuggucuggc

SEQ ID NO: 647218 - RNA, 22 nt, Human
caacuagaagcaacugcagcau

SEQ ID NO: 647219 - RNA, 19 nt, Human
cacaaccugucagggacug

SEQ ID NO: 647220 - RNA, 22 nt, Human
cacccccacccugggcaacuug

SEQ ID NO: 647221 - RNA, 22 nt, Human
cacccccacccugggcaacuug

SEQ ID NO: 647222 - RNA, 23 nt, Human
caccugcagugacacacacagcc

SEQ ID NO: 647223 - RNA, 22 nt, Human
caccuggcuaggcacccccacc

SEQ ID NO: 647224 - RNA, 22 nt, Human
caccuggcuaggcacccccacc

SEQ ID NO: 647225 - RNA, 20 nt, Human
cacggacccacacgacgccc

SEQ ID NO: 647226 - RNA, 18 nt, Human
cacuccggagaacagggu

SEQ ID NO: 647227 - RNA, 24 nt, Human
cagcagggcccccccacagacacc

SEQ ID NO: 647228 - RNA, 19 nt, Human
cagcccccucugccucucc

SEQ ID NO: 647229 - RNA, 20 nt, Human
cagccucugcacugcacccu

SEQ ID NO: 647230 - RNA, 24 nt, Human
cagcguccaggugccccuacucgc

SEQ ID NO: 647231 - RNA, 24 nt, Human
cagcguccaggugccccuacucgc

SEQ ID NO: 647232 - RNA, 19 nt, Human
cagcugagcauccuggcca

SEQ ID NO: 647233 - RNA, 19 nt, Human
cagcugagcauccuggcca

SEQ ID NO: 647234 - RNA, 20 nt, Human
cagcuucccgcgauuccccu

SEQ ID NO: 647235 - RNA, 20 nt, Human
cagcuucccgcgauuccccu

SEQ ID NO: 647236 - RNA, 23 nt, Human
caggacccaagcugcccgcccca

SEQ ID NO: 647237 - RNA, 19 nt, Human
caggagaaacccaaagucc

SEQ ID NO: 647238 - RNA, 24 nt, Human
caggcgccaggcggggaagcccug

SEQ ID NO: 647239 - RNA, 21 nt, Human
caggggcugcacgaaggagau

SEQ ID NO: 647240 - RNA, 19 nt, Human
caggugccccuacucgccc

SEQ ID NO: 647241 - RNA, 19 nt, Human
caggugccccuacucgccc

SEQ ID NO: 647242 - RNA, 19 nt, Human
caggugcugcccuccuggc

SEQ ID NO: 647243 - RNA, 19 nt, Human
caggugcugcccuccuggc

SEQ ID NO: 647244 - RNA, 21 nt, Human
caguggccuugugacguggcc

SEQ ID NO: 647245 - RNA, 18 nt, Human
caucuccucucacgugac

SEQ ID NO: 647246 - RNA, 20 nt, Human
cauugcgugacgccgaggac

SEQ ID NO: 647247 - RNA, 20 nt, Human
cauugcgugacgccgaggac

SEQ ID NO: 647248 - RNA, 22 nt, Human
ccagccagcagggcccccccac

SEQ ID NO: 647249 - RNA, 21 nt, Human
ccagcugagcauccuggccac

SEQ ID NO: 647250 - RNA, 21 nt, Human
ccagcugagcauccuggccac

SEQ ID NO: 647251 - RNA, 19 nt, Human
ccaggcgaggccccagccc

SEQ ID NO: 647252 - RNA, 23 nt, Human
ccagggcccccgcucugcccucu

SEQ ID NO: 647253 - RNA, 21 nt, Human
ccaggugccccuacucgcccu

SEQ ID NO: 647254 - RNA, 21 nt, Human
ccaggugccccuacucgcccu

SEQ ID NO: 647255 - RNA, 19 nt, Human
ccauuccucugauucccag

SEQ ID NO: 647256 - RNA, 19 nt, Human
ccauuccucugauucccag

SEQ ID NO: 647257 - RNA, 18 nt, Human
cccacacgacgcccggcu

SEQ ID NO: 647258 - RNA, 19 nt, Human
cccacagacacccccugca

SEQ ID NO: 647259 - RNA, 21 nt, Human
ccccagcaggugcugcccucc

SEQ ID NO: 647260 - RNA, 21 nt, Human
ccccagcaggugcugcccucc

SEQ ID NO: 647261 - RNA, 22 nt, Human
ccccagcaggugcugcccuccu

SEQ ID NO: 647262 - RNA, 22 nt, Human
ccccagcaggugcugcccuccu

SEQ ID NO: 647263 - RNA, 19 nt, Human
ccccagccuucugaacacc

SEQ ID NO: 647264 - RNA, 19 nt, Human
ccccaggccucugucuggc

SEQ ID NO: 647265 - RNA, 22 nt, Human
ccccauuccucugauucccagu

SEQ ID NO: 647266 - RNA, 22 nt, Human
ccccauuccucugauucccagu

SEQ ID NO: 647267 - RNA, 21 nt, Human
cccccagccuucugaacaccu

SEQ ID NO: 647268 - RNA, 19 nt, Human
ccccugggaagugcucccu

SEQ ID NO: 647269 - RNA, 19 nt, Human
ccccugggaagugcucccu

SEQ ID NO: 647270 - RNA, 23 nt, Human
cccgaauuucagcccccucugcc

SEQ ID NO: 647271 - RNA, 24 nt, Human
cccgcccccagccuucugaacacc

SEQ ID NO: 647272 - RNA, 19 nt, Human
cccgggccugcaacccugg

SEQ ID NO: 647273 - RNA, 18 nt, Human
cccggggccugauagugg

SEQ ID NO: 647274 - RNA, 26 nt, Human
cccugggcaacuugcccacggacccc

SEQ ID NO: 647275 - RNA, 26 nt, Human
cccugggcaacuugcccacggacccc

SEQ ID NO: 647276 - RNA, 21 nt, Human
ccgcugccaccugcagggugc

SEQ ID NO: 647277 - RNA, 20 nt, Human
ccgcuuccuaucaacgucca

SEQ ID NO: 647278 - RNA, 20 nt, Human
ccgcuuccuaucaacgucca

SEQ ID NO: 647279 - RNA, 20 nt, Human
ccguccccagcaggugcugc

SEQ ID NO: 647280 - RNA, 20 nt, Human
ccguccccagcaggugcugc

SEQ ID NO: 647281 - RNA, 24 nt, Human
ccgucugccggguugggcgccucc

SEQ ID NO: 647282 - RNA, 24 nt, Human
ccucccagcuucucaugugagucu

SEQ ID NO: 647283 - RNA, 27 nt, Human
ccuccuggccagcugagcauccuggcc

SEQ ID NO: 647284 - RNA, 27 nt, Human
ccuccuggccagcugagcauccuggcc

SEQ ID NO: 647285 - RNA, 18 nt, Human
ccucucggcugggcgggg

SEQ ID NO: 647286 - RNA, 25 nt, Human
ccugccgaccagcagugcaguugug

SEQ ID NO: 647287 - RNA, 26 nt, Human
ccugcggccccugggaagugcucccu

SEQ ID NO: 647288 - RNA, 26 nt, Human
ccugcggccccugggaagugcucccu

SEQ ID NO: 647289 - RNA, 24 nt, Human
ccugcucacagagaggguggaaac

SEQ ID NO: 647290 - RNA, 21 nt, Human
ccuggccaccaucagcgucca

SEQ ID NO: 647291 - RNA, 21 nt, Human
ccuggccaccaucagcgucca

SEQ ID NO: 647292 - RNA, 19 nt, Human
ccuggccagcugagcaucc

SEQ ID NO: 647293 - RNA, 19 nt, Human
ccuggccagcugagcaucc

SEQ ID NO: 647294 - RNA, 20 nt, Human
ccuggccagcugagcauccu

SEQ ID NO: 647295 - RNA, 21 nt, Human
ccugggcaugaaggcagggcc

SEQ ID NO: 647296 - RNA, 21 nt, Human
ccugggcaugaaggcagggcc

SEQ ID NO: 647297 - RNA, 23 nt, Human
cgaaguacccagggcucucccca

SEQ ID NO: 647298 - RNA, 22 nt, Human
cgagaauggagccccucagcuc

SEQ ID NO: 647299 - RNA, 23 nt, Human
cgcucugcccucucgggauugca

SEQ ID NO: 647300 - RNA, 21 nt, Human
cggccccugggaagugcuccc

SEQ ID NO: 647301 - RNA, 22 nt, Human
cggcucugggcggggauggggc

SEQ ID NO: 647302 - RNA, 21 nt, Human
cguccaggacccaagcugccc

SEQ ID NO: 647303 - RNA, 21 nt, Human
cguccaggacccaagcugccc

SEQ ID NO: 647304 - RNA, 24 nt, Human
cguccaggacccaagcugcccgcc

SEQ ID NO: 647305 - RNA, 24 nt, Human
cguccaggacccaagcugcccgcc

SEQ ID NO: 647306 - RNA, 23 nt, Human
cguccaggugccccuacucgccc

SEQ ID NO: 647307 - RNA, 23 nt, Human
cguccaggugccccuacucgccc

SEQ ID NO: 647308 - RNA, 19 nt, Human
cucaagguccugaaugccc

SEQ ID NO: 647309 - RNA, 19 nt, Human
cucaagguccugaaugccc

SEQ ID NO: 647310 - RNA, 24 nt, Human
cucacagcaagaagaugguguggu

SEQ ID NO: 647311 - RNA, 24 nt, Human
cucacagcaagaagaugguguggu

SEQ ID NO: 647312 - RNA, 28 nt, Human
cucacagcaagaagauggugugguucua

SEQ ID NO: 647313 - RNA, 28 nt, Human
cucacagcaagaagauggugugguucua

SEQ ID NO: 647314 - RNA, 24 nt, Human
cucucaauuaucacccacggaccc

SEQ ID NO: 647315 - RNA, 22 nt, Human
cugaacaccugccacguggauc

SEQ ID NO: 647316 - RNA, 21 nt, Human
cugagaccccaggccucuguc

SEQ ID NO: 647317 - RNA, 18 nt, Human
cugcacccgucugccggg

SEQ ID NO: 647318 - RNA, 18 nt, Human
cugcagcauggcccuucc

SEQ ID NO: 647319 - RNA, 21 nt, Human
cugccaccugcagggugcucc

SEQ ID NO: 647320 - RNA, 22 nt, Human
cugcggccgcagggagagggcc

SEQ ID NO: 647321 - RNA, 18 nt, Human
cugcggggucccgccagg

SEQ ID NO: 647322 - RNA, 22 nt, Human
cuucugaacaccugccacgugg

SEQ ID NO: 647323 - RNA, 22 nt, Human
gaagcaacugcagcauggcccu

SEQ ID NO: 647324 - RNA, 21 nt, Human
gaagguuuccugucagugcgg

SEQ ID NO: 647325 - RNA, 21 nt, Human
gaagguuuccugucagugcgg

SEQ ID NO: 647326 - RNA, 20 nt, Human
gacccaagcugcccgcccca

SEQ ID NO: 647327 - RNA, 21 nt, Human
gacgcggggacagccgguuca

SEQ ID NO: 647328 - RNA, 20 nt, Human
gacugcaccuggcuaggcac

SEQ ID NO: 647329 - RNA, 20 nt, Human
gacugcaccuggcuaggcac

SEQ ID NO: 647330 - RNA, 24 nt, Human
gagcagccucccuucggggucucc

SEQ ID NO: 647331 - RNA, 19 nt, Human
gagcugggccugggcucag

SEQ ID NO: 647332 - RNA, 20 nt, Human
gaggcccgggccugcaaccc

SEQ ID NO: 647333 - RNA, 19 nt, Human
gcacccccacccugggcaa

SEQ ID NO: 647334 - RNA, 19 nt, Human
gcacccccacccugggcaa

SEQ ID NO: 647335 - RNA, 20 nt, Human
gccacguggaucacaaccuu

SEQ ID NO: 647336 - RNA, 22 nt, Human
gcccuuggcaaggaaguccugg

SEQ ID NO: 647337 - RNA, 22 nt, Human
gccggugcugacaaugaacacg

SEQ ID NO: 647338 - RNA, 20 nt, Human
gcggggacagccgguucaca

SEQ ID NO: 647339 - RNA, 23 nt, Human
gcuccgugagcugggccugggcu

SEQ ID NO: 647340 - RNA, 19 nt, Human
gcuccucccugaacagucc

SEQ ID NO: 647341 - RNA, 19 nt, Human
gcuccucccugaacagucc

SEQ ID NO: 647342 - RNA, 19 nt, Human
gcuuggacaccccacuccc

SEQ ID NO: 647343 - RNA, 21 nt, Human
ggaagguuuccugucagugcg

SEQ ID NO: 647344 - RNA, 21 nt, Human
ggaagguuuccugucagugcg

SEQ ID NO: 647345 - RNA, 22 nt, Human
ggagcuccucccagcuucucau

SEQ ID NO: 647346 - RNA, 23 nt, Human
ggagguggggcccgaggcccggg

SEQ ID NO: 647347 - RNA, 19 nt, Human
ggcaggggcugaggcagcg

SEQ ID NO: 647348 - RNA, 21 nt, Human
ggcagugccuuuucacccucu

SEQ ID NO: 647349 - RNA, 20 nt, Human
ggccccugggaagugcuccc

SEQ ID NO: 647350 - RNA, 20 nt, Human
ggccgcagggagagggccgg

SEQ ID NO: 647351 - RNA, 20 nt, Human
ggcggggauggggccggggc

SEQ ID NO: 647352 - RNA, 23 nt, Human
gggaagugcucccucacgacgga

SEQ ID NO: 647353 - RNA, 23 nt, Human
gggaagugcucccucacgacgga

SEQ ID NO: 647354 - RNA, 20 nt, Human
gggacugcaccuggcuaggc

SEQ ID NO: 647355 - RNA, 20 nt, Human
gggacugcaccuggcuaggc

SEQ ID NO: 647356 - RNA, 18 nt, Human
gggagagggccggggucg

SEQ ID NO: 647357 - RNA, 20 nt, Human
gggagcaggguuguggccag

SEQ ID NO: 647358 - RNA, 19 nt, Human
gggaggugaccgcagcccu

SEQ ID NO: 647359 - RNA, 21 nt, Human
gggagguggaggagacgcggg

SEQ ID NO: 647360 - RNA, 23 nt, Human
gggcagaggggaggcagagccuc

SEQ ID NO: 647361 - RNA, 24 nt, Human
gggcagaggggaggcagagccucu

SEQ ID NO: 647362 - RNA, 19 nt, Human
gggcaggggcugcacgaag

SEQ ID NO: 647363 - RNA, 21 nt, Human
gggcaggggcugcacgaagga

SEQ ID NO: 647364 - RNA, 19 nt, Human
gggcaugaaggcagggcca

SEQ ID NO: 647365 - RNA, 19 nt, Human
gggcaugaaggcagggcca

SEQ ID NO: 647366 - RNA, 21 nt, Human
gggcccuuggcaaggaagucc

SEQ ID NO: 647367 - RNA, 19 nt, Human
gggccggggcugcugcggg

SEQ ID NO: 647368 - RNA, 21 nt, Human
gggcggggauggggccggggc

SEQ ID NO: 647369 - RNA, 19 nt, Human
ggggcccgaggcccgggcc

SEQ ID NO: 647370 - RNA, 19 nt, Human
gugcugcccuccuggccag

SEQ ID NO: 647371 - RNA, 19 nt, Human
gugcugcccuccuggccag

SEQ ID NO: 647372 - RNA, 20 nt, Human
uaaaaugccuggggcuacau

SEQ ID NO: 647373 - RNA, 18 nt, Human
uacccagggcucucccca

SEQ ID NO: 647374 - RNA, 18 nt, Human
uagaaacaggcgaccugc

SEQ ID NO: 647375 - RNA, 21 nt, Human
uagaagcaacugcagcauggc

SEQ ID NO: 647376 - RNA, 21 nt, Human
uaucaacguccaggacccaag

SEQ ID NO: 647377 - RNA, 21 nt, Human
uaucaacguccaggacccaag

SEQ ID NO: 647378 - RNA, 22 nt, Human
ucagaagccuuugcggaccuga

SEQ ID NO: 647379 - RNA, 22 nt, Human
ucagaagccuuugcggaccuga

SEQ ID NO: 647380 - RNA, 19 nt, Human
ucagcccccucugccucuc

SEQ ID NO: 647381 - RNA, 21 nt, Human
uccacagaagccacugaggcc

SEQ ID NO: 647382 - RNA, 19 nt, Human
ucccggggccugauagugg

SEQ ID NO: 647383 - RNA, 18 nt, Human
ucccucacgacggaaggu

SEQ ID NO: 647384 - RNA, 22 nt, Human
ucccuggagagugucgucccug

SEQ ID NO: 647385 - RNA, 22 nt, Human
ucccuggagagugucgucccug

SEQ ID NO: 647386 - RNA, 19 nt, Human
uccggggccagagcuguuc

SEQ ID NO: 647387 - RNA, 25 nt, Human
uccggggccagagcuguucugagac

SEQ ID NO: 647388 - RNA, 22 nt, Human
uccugaaugcccagcucugccc

SEQ ID NO: 647389 - RNA, 22 nt, Human
uccugaaugcccagcucugccc

SEQ ID NO: 647390 - RNA, 22 nt, Human
ucucacagcaagaagauggugu

SEQ ID NO: 647391 - RNA, 22 nt, Human
ucucacagcaagaagauggugu

SEQ ID NO: 647392 - RNA, 19 nt, Human
ucuggacugagaccccagg

SEQ ID NO: 647393 - RNA, 21 nt, Human
ucuggagagcuucacgugcug

SEQ ID NO: 647394 - RNA, 18 nt, Human
ugacaggagguagcccgg

SEQ ID NO: 647395 - RNA, 18 nt, Human
ugacaggagguagcccgg

SEQ ID NO: 647396 - RNA, 18 nt, Human
ugacuugguuuauuaccg

SEQ ID NO: 647397 - RNA, 20 nt, Human
ugaggcagcggcugacagcu

SEQ ID NO: 647398 - RNA, 19 nt, Human
ugcagagcuggagcuccuc

SEQ ID NO: 647399 - RNA, 24 nt, Human
ugcaguugugagcacgccaccugc

SEQ ID NO: 647400 - RNA, 20 nt, Human
ugccagacggguaugugggg

SEQ ID NO: 647401 - RNA, 21 nt, Human
ugccccauuccucugauuccc

SEQ ID NO: 647402 - RNA, 21 nt, Human
ugccccauuccucugauuccc

SEQ ID NO: 647403 - RNA, 19 nt, Human
ugcggccgcagggagaggg

SEQ ID NO: 647404 - RNA, 19 nt, Human
ugcuggggccucccuggag

SEQ ID NO: 647405 - RNA, 19 nt, Human
ugcuggggccucccuggag

SEQ ID NO: 647406 - RNA, 25 nt, Human
uggccgggcccuuggcaaggaaguc

SEQ ID NO: 647407 - RNA, 19 nt, Human
uggccugacuugggggcua

SEQ ID NO: 647408 - RNA, 21 nt, Human
uggcgcaggugugggagcagc

SEQ ID NO: 647409 - RNA, 20 nt, Human
ugggcagaggggaggcagag

SEQ ID NO: 647410 - RNA, 20 nt, Human
uggggcccgaggcccgggcc

SEQ ID NO: 647411 - RNA, 18 nt, Human
uguccugggcaugaaggc

SEQ ID NO: 647412 - RNA, 18 nt, Human
uguccugggcaugaaggc

SEQ ID NO: 647413 - RNA, 23 nt, Human
uucccuagguggcucccagcagc

SEQ ID NO: 647414 - RNA, 19 nt, Human
uuccucuucuucagaagcc

SEQ ID NO: 647415 - RNA, 19 nt, Human
uuccucuucuucagaagcc

SEQ ID NO: 647416 - RNA, 18 nt, Human
uuggcacugagauggaga

SEQ ID NO: 647417 - RNA, 23 nt, Human
uuggcacugagauggagacggca

SEQ ID NO: 647418 - RNA, 21 nt, Human
uuuauuaccgucacuauagaa

SEQ ID NO: 647419 - RNA, 21 nt, Human
uuuuuuuuuuuuuuuuucggu

SEQ ID NO: 647420 - RNA, 22 nt, Human
uuuuuuuuuuuuuuuuuucggg

SEQ ID NO: 647421 - RNA, 22 nt, Human
acacagcaguucucccagcuca

SEQ ID NO: 647422 - RNA, 25 nt, Human
agaaggccugaagcccaggcaaggg

SEQ ID NO: 647423 - RNA, 21 nt, Human
agaucuccagcagcaagggcc

SEQ ID NO: 647424 - RNA, 18 nt, Human
agcaagggccgcacucuc

SEQ ID NO: 647425 - RNA, 23 nt, Human
agcagugaccucagaucuccagc

SEQ ID NO: 647426 - RNA, 22 nt, Human
aggugccagaaggccugaagcc

SEQ ID NO: 647427 - RNA, 23 nt, Human
auccagccauccccuucccccaa

SEQ ID NO: 647428 - RNA, 22 nt, Human
auccccuucccccaaacuccag

SEQ ID NO: 647429 - RNA, 21 nt, Human
caagagguacacagcaguucu

SEQ ID NO: 647430 - RNA, 21 nt, Human
caaggcuguugggugcuggca

SEQ ID NO: 647431 - RNA, 18 nt, Human
cacagcacuaagcggcuu

SEQ ID NO: 647432 - RNA, 21 nt, Human
cacauccagccauccccuucc

SEQ ID NO: 647433 - RNA, 19 nt, Human
cagaaggccugaagcccag

SEQ ID NO: 647434 - RNA, 23 nt, Human
cagcagcaagggccgcacucucg

SEQ ID NO: 647435 - RNA, 24 nt, Human
cagcagugaccucagaucuccagc

SEQ ID NO: 647436 - RNA, 18 nt, Human
cagcccuucucagagggg

SEQ ID NO: 647437 - RNA, 20 nt, Human
ccagagcaaagccagguuuc

SEQ ID NO: 647438 - RNA, 19 nt, Human
cccaaacuccagcccuucu

SEQ ID NO: 647439 - RNA, 20 nt, Human
cccccggcaggaggggcggg

SEQ ID NO: 647440 - RNA, 21 nt, Human
ccccuucccccaaacuccagc

SEQ ID NO: 647441 - RNA, 23 nt, Human
cccucggcggccugauucccagg

SEQ ID NO: 647442 - RNA, 22 nt, Human
cccugggccucccccggcaggg

SEQ ID NO: 647443 - RNA, 21 nt, Human
cccuuuguccagagcaaagcc

SEQ ID NO: 647444 - RNA, 19 nt, Human
ccuccagcauggccuggag

SEQ ID NO: 647445 - RNA, 21 nt, Human
ccuggagcacauccagccauc

SEQ ID NO: 647446 - RNA, 22 nt, Human
ccugggccucccccggcaggag

SEQ ID NO: 647447 - RNA, 19 nt, Human
cuccggucccugggccucc

SEQ ID NO: 647448 - RNA, 24 nt, Human
cuccugccugcagugaggccacag

SEQ ID NO: 647449 - RNA, 18 nt, Human
cucgugcccacaagggcc

SEQ ID NO: 647450 - RNA, 21 nt, Human
gagcaaagccagguuuccaag

SEQ ID NO: 647451 - RNA, 18 nt, Human
gauggugcggcucuggag

SEQ ID NO: 647452 - RNA, 19 nt, Human
gcaggaggggcggggcucc

SEQ ID NO: 647453 - RNA, 21 nt, Human
gccagaaggccugaagcccag

SEQ ID NO: 647454 - RNA, 19 nt, Human
gcucacagcagugaccuca

SEQ ID NO: 647455 - RNA, 22 nt, Human
gggaacgggcagugccugugcc

SEQ ID NO: 647456 - RNA, 19 nt, Human
guccagagcaaagccaggu

SEQ ID NO: 647457 - RNA, 22 nt, Human
uccagcauggccuggagcacau

SEQ ID NO: 647458 - RNA, 20 nt, Human
ucccagggguccaagccacc

SEQ ID NO: 647459 - RNA, 19 nt, Human
uccccacggcaaggcuguu

SEQ ID NO: 647460 - RNA, 18 nt, Human
ucccccaaacuccagccc

SEQ ID NO: 647461 - RNA, 23 nt, Human
ucgugcccacaagggccuugcag

SEQ ID NO: 647462 - RNA, 18 nt, Human
ucucagaggggcucuggg

SEQ ID NO: 647463 - RNA, 21 nt, Human
ugaccucagaucuccagcagc

SEQ ID NO: 647464 - RNA, 22 nt, Human
ugagaaggugccagaaggccug

SEQ ID NO: 647465 - RNA, 22 nt, Human
uggcagauggugcggcucugga

SEQ ID NO: 647466 - RNA, 23 nt, Human
uggccuggagcacauccagccau

SEQ ID NO: 647467 - RNA, 23 nt, Human
uuuuuagcacccgcugcuuuugg

SEQ ID NO: 647468 - RNA, 27 nt, Human
uuuuuuuuagcacccgcugcuuuuggc

SEQ ID NO: 647469 - RNA, 24 nt, Human
uuuuuuuuuuuuuagcacccgcug

SEQ ID NO: 647470 - RNA, 22 nt, Human
aaaugcugugagauugauaccu

SEQ ID NO: 647471 - RNA, 18 nt, Human
aaggguggguacagcaca

SEQ ID NO: 647472 - RNA, 18 nt, Human
acacaggaaauucccaca

SEQ ID NO: 647473 - RNA, 19 nt, Human
accaugaggaauacagaaa

SEQ ID NO: 647474 - RNA, 24 nt, Human
accaugaggaauacagaaaccaac

SEQ ID NO: 647475 - RNA, 24 nt, Human
agaaaccaacgaggcaugauucuu

SEQ ID NO: 647476 - RNA, 19 nt, Human
agaaggcacuguguuuggg

SEQ ID NO: 647477 - RNA, 23 nt, Human
aggaagaaaacacuauuugggga

SEQ ID NO: 647478 - RNA, 19 nt, Human
aggcaugauucuugccuua

SEQ ID NO: 647479 - RNA, 18 nt, Human
augcugugagauugauac

SEQ ID NO: 647480 - RNA, 22 nt, Human
caacauuauaagaacccagagg

SEQ ID NO: 647481 - RNA, 25 nt, Human
caccuaagaaacaaugucuucagcu

SEQ ID NO: 647482 - RNA, 20 nt, Human
cacuauuuggggaugaggau

SEQ ID NO: 647483 - RNA, 23 nt, Human
cagcacaacccuguggccacguu

SEQ ID NO: 647484 - RNA, 21 nt, Human
caggaagcacuaaaugcugug

SEQ ID NO: 647485 - RNA, 24 nt, Human
ccacagaacacccaggagggugac

SEQ ID NO: 647486 - RNA, 20 nt, Human
cgccggggaaggguggguac

SEQ ID NO: 647487 - RNA, 19 nt, Human
cucccaugaacaaugccgu

SEQ ID NO: 647488 - RNA, 19 nt, Human
gaaauucccacagaacacc

SEQ ID NO: 647489 - RNA, 23 nt, Human
gaaggcucuaauuaaaaccagaa

SEQ ID NO: 647490 - RNA, 22 nt, Human
gccugcaauguagaaggcacug

SEQ ID NO: 647491 - RNA, 24 nt, Human
ggaaggguggguacagcacaaccc

SEQ ID NO: 647492 - RNA, 20 nt, Human
ggggaaggguggguacagca

SEQ ID NO: 647493 - RNA, 19 nt, Human
uaaaaccagaagcaggagg

SEQ ID NO: 647494 - RNA, 24 nt, Human
uacagcacaacccuguggccacgu

SEQ ID NO: 647495 - RNA, 20 nt, Human
uaggggguuuaaacaugaca

SEQ ID NO: 647496 - RNA, 18 nt, Human
ucccacagaacacccagg

SEQ ID NO: 647497 - RNA, 21 nt, Human
ucuguuuguccuuuguccccg

SEQ ID NO: 647498 - RNA, 23 nt, Human
ucuguuuguccuuuguccccgau

SEQ ID NO: 647499 - RNA, 22 nt, Human
ugccuuaggaagcucacagucu

SEQ ID NO: 647500 - RNA, 23 nt, Human
uggaggcaggagaagccccgcug

SEQ ID NO: 647501 - RNA, 18 nt, Human
ugugauggaggcaggaga

SEQ ID NO: 647502 - RNA, 20 nt, Human
ugugauggaggcaggagaag

SEQ ID NO: 647503 - RNA, 18 nt, Human
uguggccacguuuuccuc

SEQ ID NO: 647504 - RNA, 19 nt, Human
uugcacaugcacacaggua

SEQ ID NO: 647505 - RNA, 19 nt, Human
uuuuuuuuuuuuuugcuuu

SEQ ID NO: 647506 - RNA, 18 nt, Human
uuuuuuuuuuuuuuuuug

SEQ ID NO: 647507 - RNA, 22 nt, Human
uuuuuuuuuuuuuuuuugcuuu

SEQ ID NO: 647508 - RNA, 23 nt, Human
aacacacacacacacaaccagga

SEQ ID NO: 647509 - RNA, 24 nt, Human
aaccugaccucacucaccaacaca

SEQ ID NO: 647510 - RNA, 25 nt, Human
acacacacacacaaccaggacacaa

SEQ ID NO: 647511 - RNA, 33 nt, Human
acacacacacacacaaccaggacacauguggug

SEQ ID NO: 647512 - RNA, 22 nt, Human
acacucgcaaaccugaccucac

SEQ ID NO: 647513 - RNA, 19 nt, Human
accaacacacacacacaca

SEQ ID NO: 647514 - RNA, 19 nt, Human
accaggacacaugugccag

SEQ ID NO: 647515 - RNA, 20 nt, Human
acuuugaaggacaggaagga

SEQ ID NO: 647516 - RNA, 18 nt, Human
agacccgaggcaaagcgg

SEQ ID NO: 647517 - RNA, 24 nt, Human
agcucccacccgcccuuucugccg

SEQ ID NO: 647518 - RNA, 19 nt, Human
aggaagccgacuugggagc

SEQ ID NO: 647519 - RNA, 26 nt, Human
aggaaggaaugaacacacccaggugg

SEQ ID NO: 647520 - RNA, 21 nt, Human
aggaaugaacacacccaggug

SEQ ID NO: 647521 - RNA, 25 nt, Human
aggagucaggaggguggggcccagg

SEQ ID NO: 647522 - RNA, 18 nt, Human
aggcagagcccgccgccc

SEQ ID NO: 647523 - RNA, 25 nt, Human
agggguucagggaggguugcagggg

SEQ ID NO: 647524 - RNA, 23 nt, Human
agguaagaagggggcagaugcag

SEQ ID NO: 647525 - RNA, 22 nt, Human
augaacacacccagguggacgu

SEQ ID NO: 647526 - RNA, 20 nt, Human
caaccaggacacaugugcca

SEQ ID NO: 647527 - RNA, 22 nt, Human
caauaaauagaacccugggccc

SEQ ID NO: 647528 - RNA, 19 nt, Human
caggcagcuggugcaggca

SEQ ID NO: 647529 - RNA, 19 nt, Human
cagggcggaguucgcaacu

SEQ ID NO: 647530 - RNA, 26 nt, Human
ccaacacacacacacacaaccaggac

SEQ ID NO: 647531 - RNA, 25 nt, Human
cccacaaccggggaagggagagggc

SEQ ID NO: 647532 - RNA, 20 nt, Human
cccagguggacguuugguuu

SEQ ID NO: 647533 - RNA, 18 nt, Human
ccccagggcuccggcuug

SEQ ID NO: 647534 - RNA, 22 nt, Human
cccgccgcccacggccuccgac

SEQ ID NO: 647535 - RNA, 23 nt, Human
cccgcggccggggcaguuacagc

SEQ ID NO: 647536 - RNA, 21 nt, Human
cccggcccuuaaccaucagcc

SEQ ID NO: 647537 - RNA, 18 nt, Human
cccuggagcccugcaggg

SEQ ID NO: 647538 - RNA, 18 nt, Human
cccugggcccagccugcu

SEQ ID NO: 647539 - RNA, 22 nt, Human
cccugggcccagccugcuuugg

SEQ ID NO: 647540 - RNA, 23 nt, Human
ccgacuugggagcgggcgcgccc

SEQ ID NO: 647541 - RNA, 21 nt, Human
ccucacucaccaacacacaca

SEQ ID NO: 647542 - RNA, 23 nt, Human
ccuccaaauagcccuggagcccu

SEQ ID NO: 647543 - RNA, 23 nt, Human
ccuugcugcuggucccgcgcugg

SEQ ID NO: 647544 - RNA, 18 nt, Human
ccuuucugccgcggagaa

SEQ ID NO: 647545 - RNA, 18 nt, Human
cggccggggcaguuacag

SEQ ID NO: 647546 - RNA, 23 nt, Human
cggcggggaggaagccgacuugg

SEQ ID NO: 647547 - RNA, 19 nt, Human
cgguuccagcgcgccgggc

SEQ ID NO: 647548 - RNA, 24 nt, Human
cuccaaauagcccuggagcccugc

SEQ ID NO: 647549 - RNA, 19 nt, Human
cucccggcccuuaaccauc

SEQ ID NO: 647550 - RNA, 19 nt, Human
cucgcaaaccugaccucac

SEQ ID NO: 647551 - RNA, 25 nt, Human
cugaccucacucaccaacacacaca

SEQ ID NO: 647552 - RNA, 21 nt, Human
cuggucccgcgcuggagcggg

SEQ ID NO: 647553 - RNA, 20 nt, Human
gaagccgacuugggagcggg

SEQ ID NO: 647554 - RNA, 20 nt, Human
gagcaaggcaauaaauagaa

SEQ ID NO: 647555 - RNA, 24 nt, Human
gagcccgccgcccacggccuccga

SEQ ID NO: 647556 - RNA, 21 nt, Human
gaggguggggcccaggcagcu

SEQ ID NO: 647557 - RNA, 18 nt, Human
gcaggccagaugugcagc

SEQ ID NO: 647558 - RNA, 18 nt, Human
gcaucccugcauguggcc

SEQ ID NO: 647559 - RNA, 19 nt, Human
gcaucccugcauguggccu

SEQ ID NO: 647560 - RNA, 20 nt, Human
gcaucccugcauguggccuu

SEQ ID NO: 647561 - RNA, 23 nt, Human
gcccaaggucccuccaaauagcc

SEQ ID NO: 647562 - RNA, 22 nt, Human
gcccuggagcccugcagggcac

SEQ ID NO: 647563 - RNA, 23 nt, Human
gccgcgguuccagcgcgccgggc

SEQ ID NO: 647564 - RNA, 23 nt, Human
ggaaccgagugcugcccaacccc

SEQ ID NO: 647565 - RNA, 19 nt, Human
ggaagggagagggcagagc

SEQ ID NO: 647566 - RNA, 18 nt, Human
ggagacccgaggcaaagc

SEQ ID NO: 647567 - RNA, 22 nt, Human
gggaagcagaggggcgauccgg

SEQ ID NO: 647568 - RNA, 22 nt, Human
gggaggguugcagggguucagg

SEQ ID NO: 647569 - RNA, 21 nt, Human
gggggugaucagggcaguugc

SEQ ID NO: 647570 - RNA, 20 nt, Human
gguggggcccaggcagcugg

SEQ ID NO: 647571 - RNA, 20 nt, Human
gugcaguucaggggaccugg

SEQ ID NO: 647572 - RNA, 22 nt, Human
uaagaagggggcagaugcagca

SEQ ID NO: 647573 - RNA, 21 nt, Human
uacagcucccacccgcccuuu

SEQ ID NO: 647574 - RNA, 18 nt, Human
uagaacccugggcccagc

SEQ ID NO: 647575 - RNA, 19 nt, Human
uauuuauuuaucaaaacac

SEQ ID NO: 647576 - RNA, 21 nt, Human
ucaaaacacucgcaaaccuga

SEQ ID NO: 647577 - RNA, 22 nt, Human
ucaaaacacucgcaaaccugac

SEQ ID NO: 647578 - RNA, 24 nt, Human
ucccacccgcccuuucugccgcgg

SEQ ID NO: 647579 - RNA, 18 nt, Human
ugaucagggcaguugcgg

SEQ ID NO: 647580 - RNA, 22 nt, Human
ugcccaaccccagggcuccggc

SEQ ID NO: 647581 - RNA, 20 nt, Human
ugcuuugguacauugugggu

SEQ ID NO: 647582 - RNA, 20 nt, Human
uggcagcaucugcucccggc

SEQ ID NO: 647583 - RNA, 20 nt, Human
ugggagcgggcgcgccccgc

SEQ ID NO: 647584 - RNA, 22 nt, Human
uggggaggaccccaggaagccg

SEQ ID NO: 647585 - RNA, 23 nt, Human
uuuuuugccccuuuauguauuua

SEQ ID NO: 647586 - RNA, 18 nt, Human
uuuuuuuuuuuuuuuuug

SEQ ID NO: 647587 - RNA, 23 nt, Human
uuuuuuuuuuuuuuuuugccccu

SEQ ID NO: 647588 - RNA, 21 nt, Human
agcccuuucgcccccgcccgc

SEQ ID NO: 647589 - RNA, 22 nt, Human
ccccgcccgcagguggaccaga

SEQ ID NO: 647590 - RNA, 23 nt, Human
ccgcaaggagcccuuucgccccc

SEQ ID NO: 647591 - RNA, 18 nt, Human
ccgccugcgggcggaggu

SEQ ID NO: 647592 - RNA, 21 nt, Human
ccgccugcgggcggagguggg

SEQ ID NO: 647593 - RNA, 19 nt, Human
ccugcgggcggaggugggg

SEQ ID NO: 647594 - RNA, 19 nt, Human
cgccggucccgccggccgc

SEQ ID NO: 647595 - RNA, 21 nt, Human
cuccacgggucuccgccgguc

SEQ ID NO: 647596 - RNA, 20 nt, Human
gcagguggaccagauguucc

SEQ ID NO: 647597 - RNA, 18 nt, Human
ggccgggccacggggggc

SEQ ID NO: 647598 - RNA, 22 nt, Human
guggcgggcaaccuggacuaca

SEQ ID NO: 647599 - RNA, 23 nt, Human
uggaccagauguuccaguucgcc

SEQ ID NO: 647600 - RNA, 22 nt, Human
uuuuuuuuuuugcaggugcgcg

SEQ ID NO: 647601 - RNA, 19 nt, Human
uuuuuuuuuuuuuuuuugc

SEQ ID NO: 647602 - RNA, 21 nt, Human
uuuuuuuuuuuuuuuuugcag

SEQ ID NO: 647603 - RNA, 22 nt, Human
uuuuuuuuuuuuuuuuugcagg

SEQ ID NO: 647604 - RNA, 25 nt, Human
aaacagcuaccaaagccaucauuuc

SEQ ID NO: 647605 - RNA, 19 nt, Human
aaauccacuuuuuaaacua

SEQ ID NO: 647606 - RNA, 22 nt, Human
aaggacagugucacaguggggu

SEQ ID NO: 647607 - RNA, 26 nt, Human
aagucagccugcaaagguugugcuga

SEQ ID NO: 647608 - RNA, 26 nt, Human
acaggacccaauaguuguuacuacaa

SEQ ID NO: 647609 - RNA, 24 nt, Human
acaugaaaaggacagugucacagu

SEQ ID NO: 647610 - RNA, 23 nt, Human
accccaugcuuccaccucccaga

SEQ ID NO: 647611 - RNA, 22 nt, Human
aggcaaagaaccaauggguuau

SEQ ID NO: 647612 - RNA, 18 nt, Human
aggcaaagcacucaagua

SEQ ID NO: 647613 - RNA, 22 nt, Human
aggcagcuggugugaggcugcg

SEQ ID NO: 647614 - RNA, 18 nt, Human
agguaauaugaauauucu

SEQ ID NO: 647615 - RNA, 24 nt, Human
agguucccauccaugccuccugcc

SEQ ID NO: 647616 - RNA, 22 nt, Human
aguaaacgaucaauaacuaccu

SEQ ID NO: 647617 - RNA, 25 nt, Human
cacccccagccccaccagugagacu

SEQ ID NO: 647618 - RNA, 19 nt, Human
caccgaucccaccccaugc

SEQ ID NO: 647619 - RNA, 25 nt, Human
cagccccaccagugagacuucugau

SEQ ID NO: 647620 - RNA, 19 nt, Human
cauccaugccuccugccug

SEQ ID NO: 647621 - RNA, 25 nt, Human
cauuucacgcuucccuguaguuuua

SEQ ID NO: 647622 - RNA, 28 nt, Human
ccaaagucugaggcuacccagggcacaa

SEQ ID NO: 647623 - RNA, 24 nt, Human
ccaagaaccaagucaucccuugcu

SEQ ID NO: 647624 - RNA, 25 nt, Human
ccaccccaugcuuccaccucccaga

SEQ ID NO: 647625 - RNA, 21 nt, Human
ccacgggacagccacuggcca

SEQ ID NO: 647626 - RNA, 18 nt, Human
cccacccccagccccacc

SEQ ID NO: 647627 - RNA, 19 nt, Human
cccaugcuuccaccuccca

SEQ ID NO: 647628 - RNA, 20 nt, Human
cccaugcuuccaccucccag

SEQ ID NO: 647629 - RNA, 21 nt, Human
cccaugcuuccaccucccaga

SEQ ID NO: 647630 - RNA, 20 nt, Human
ccccagccccaccagugaga

SEQ ID NO: 647631 - RNA, 25 nt, Human
cccccagccccaccagugagacuuc

SEQ ID NO: 647632 - RNA, 23 nt, Human
cccugguccaccgaucccacccc

SEQ ID NO: 647633 - RNA, 20 nt, Human
ccggccgccucgcuggcgcc

SEQ ID NO: 647634 - RNA, 28 nt, Human
ccucacuccgcagccuucuguggcuaaa

SEQ ID NO: 647635 - RNA, 21 nt, Human
ccucccagagcucuugagaua

SEQ ID NO: 647636 - RNA, 20 nt, Human
ccugcccccacccccagccc

SEQ ID NO: 647637 - RNA, 22 nt, Human
cgaucaauaacuaccuacccac

SEQ ID NO: 647638 - RNA, 19 nt, Human
cgggacagccacuggccag

SEQ ID NO: 647639 - RNA, 18 nt, Human
cgggcaugaaggggugug

SEQ ID NO: 647640 - RNA, 18 nt, Human
cucaaguacucugcaguc

SEQ ID NO: 647641 - RNA, 18 nt, Human
cucgcuggcgccgcgugg

SEQ ID NO: 647642 - RNA, 21 nt, Human
cucuuggccacacuaccuacu

SEQ ID NO: 647643 - RNA, 21 nt, Human
cugcagucuagaugacacauu

SEQ ID NO: 647644 - RNA, 18 nt, Human
cugccugcccccaccccc

SEQ ID NO: 647645 - RNA, 18 nt, Human
cuuccaccucccagagcu

SEQ ID NO: 647646 - RNA, 20 nt, Human
gagaacacaugguagcacag

SEQ ID NO: 647647 - RNA, 21 nt, Human
gagauaagaccuuaagaagga

SEQ ID NO: 647648 - RNA, 18 nt, Human
gcaagucagccugcaaag

SEQ ID NO: 647649 - RNA, 19 nt, Human
gcaaguuagaagaaggagg

SEQ ID NO: 647650 - RNA, 26 nt, Human
gcccccacccccagccccaccaguga

SEQ ID NO: 647651 - RNA, 18 nt, Human
gccugacucccaggagca

SEQ ID NO: 647652 - RNA, 18 nt, Human
gcugccgccucacuccgc

SEQ ID NO: 647653 - RNA, 20 nt, Human
gcuuccaccucccagagcuc

SEQ ID NO: 647654 - RNA, 18 nt, Human
ggaaagccgggcaugaag

SEQ ID NO: 647655 - RNA, 19 nt, Human
ggaaagccgggcaugaagg

SEQ ID NO: 647656 - RNA, 23 nt, Human
ggggaaagccgggcaugaagggg

SEQ ID NO: 647657 - RNA, 19 nt, Human
guccggccgccucgcuggc

SEQ ID NO: 647658 - RNA, 19 nt, Human
guccugagugguuuggaag

SEQ ID NO: 647659 - RNA, 21 nt, Human
guggaggaggcagcuggugug

SEQ ID NO: 647660 - RNA, 21 nt, Human
uagcaagucagccugcaaagg

SEQ ID NO: 647661 - RNA, 21 nt, Human
uaguaaacgaucaauaacuac

SEQ ID NO: 647662 - RNA, 21 nt, Human
uaugagcucgcccucugcaug

SEQ ID NO: 647663 - RNA, 19 nt, Human
ucagacuuagcaagucagc

SEQ ID NO: 647664 - RNA, 19 nt, Human
ucagguucccauccaugcc

SEQ ID NO: 647665 - RNA, 21 nt, Human
ucccaccccaugcuuccaccu

SEQ ID NO: 647666 - RNA, 18 nt, Human
ucucuuggccacacuacc

SEQ ID NO: 647667 - RNA, 23 nt, Human
ucuuuagaaaaacucaaauccau

SEQ ID NO: 647668 - RNA, 18 nt, Human
ugaaaaagaacagccucu

SEQ ID NO: 647669 - RNA, 21 nt, Human
ugaaaaagaacagccucugug

SEQ ID NO: 647670 - RNA, 23 nt, Human
ugagaacacaugguagcacaguc

SEQ ID NO: 647671 - RNA, 23 nt, Human
ugagaacacaugguagcacaguc

SEQ ID NO: 647672 - RNA, 23 nt, Human
ugagaggaugaggcaaagaacca

SEQ ID NO: 647673 - RNA, 20 nt, Human
ugaggcaaagaaccaauggg

SEQ ID NO: 647674 - RNA, 18 nt, Human
ugcugaucucuuggccac

SEQ ID NO: 647675 - RNA, 20 nt, Human
ugcugaucucuuggccacac

SEQ ID NO: 647676 - RNA, 19 nt, Human
ugcuugcagaagggggcgc

SEQ ID NO: 647677 - RNA, 22 nt, Human
ugcuugcagaagggggcgcagg

SEQ ID NO: 647678 - RNA, 22 nt, Human
uggaagucuauagacauaagaa

SEQ ID NO: 647679 - RNA, 19 nt, Human
uggaggaggcagcuggugu

SEQ ID NO: 647680 - RNA, 24 nt, Human
uggcaggacggacacacaggaaug

SEQ ID NO: 647681 - RNA, 18 nt, Human
ugugaaaaagaacagccu

SEQ ID NO: 647682 - RNA, 20 nt, Human
uucaacucugacccauggau

SEQ ID NO: 647683 - RNA, 23 nt, Human
uucccauccaugccuccugccug

SEQ ID NO: 647684 - RNA, 19 nt, Human
uucuguggcuaaauggcag

SEQ ID NO: 647685 - RNA, 22 nt, Human
uuuaaacuaccacuugagaaca

SEQ ID NO: 647686 - RNA, 20 nt, Human
uuuagaaaaacucaaaucca

SEQ ID NO: 647687 - RNA, 18 nt, Human
uuuccacaucacaugaaa

SEQ ID NO: 647688 - RNA, 18 nt, Human
uuuuuuuuuuuuuuuuug

SEQ ID NO: 647689 - RNA, 21 nt, Human
aaacagacaaaacagcaaacc

SEQ ID NO: 647690 - RNA, 23 nt, Human
aaacagacaaaacagcaaacccg

SEQ ID NO: 647691 - RNA, 22 nt, Human
aaacagcaaacccggaagaacc

SEQ ID NO: 647692 - RNA, 19 nt, Human
aaaccacagcacagccagg

SEQ ID NO: 647693 - RNA, 22 nt, Human
aacagcaaacccggaagaacca

SEQ ID NO: 647694 - RNA, 22 nt, Human
aaccacacaagggggaaacaga

SEQ ID NO: 647695 - RNA, 20 nt, Human
aagcaaauggauaaaaguac

SEQ ID NO: 647696 - RNA, 19 nt, Human
acaaaacagcaaacccgga

SEQ ID NO: 647697 - RNA, 18 nt, Human
accccagggcucccacag

SEQ ID NO: 647698 - RNA, 21 nt, Human
acccugggaccccagcauagc

SEQ ID NO: 647699 - RNA, 19 nt, Human
agacaaaacagcaaacccg

SEQ ID NO: 647700 - RNA, 22 nt, Human
agccccacggagucacagcccu

SEQ ID NO: 647701 - RNA, 22 nt, Human
agcccucaacaaccugcagccc

SEQ ID NO: 647702 - RNA, 19 nt, Human
agccgacccggcagccaca

SEQ ID NO: 647703 - RNA, 18 nt, Human
aggccaggcgggcggggg

SEQ ID NO: 647704 - RNA, 22 nt, Human
aggccaggcgggcgggggaggu

SEQ ID NO: 647705 - RNA, 18 nt, Human
aggcggucuggcccaugg

SEQ ID NO: 647706 - RNA, 23 nt, Human
caacaaccugcagccccggcacc

SEQ ID NO: 647707 - RNA, 24 nt, Human
caacaaccugcagccccggcaccg

SEQ ID NO: 647708 - RNA, 18 nt, Human
caacagcagaaaaguucc

SEQ ID NO: 647709 - RNA, 19 nt, Human
cacaagggggaaacagaca

SEQ ID NO: 647710 - RNA, 18 nt, Human
cacagcacagccaggagu

SEQ ID NO: 647711 - RNA, 18 nt, Human
cacagcugcagagcacac

SEQ ID NO: 647712 - RNA, 21 nt, Human
caccgugcuguggaccagagc

SEQ ID NO: 647713 - RNA, 24 nt, Human
cacgucugacccugcuggagccuu

SEQ ID NO: 647714 - RNA, 21 nt, Human
cacucaggacaggccaggcgg

SEQ ID NO: 647715 - RNA, 21 nt, Human
cagagccgacccggcagccac

SEQ ID NO: 647716 - RNA, 26 nt, Human
cagcauagccauccgcgccgaugacu

SEQ ID NO: 647717 - RNA, 18 nt, Human
cagccuggagcauccacu

SEQ ID NO: 647718 - RNA, 20 nt, Human
cagccuggagcauccacuga

SEQ ID NO: 647719 - RNA, 20 nt, Human
caggacaggccaggcgggcg

SEQ ID NO: 647720 - RNA, 24 nt, Human
ccacagcaaacacgacacagagcu

SEQ ID NO: 647721 - RNA, 20 nt, Human
ccacagcacagccaggagua

SEQ ID NO: 647722 - RNA, 21 nt, Human
cccacagugacccugacugcu

SEQ ID NO: 647723 - RNA, 21 nt, Human
cccagcauagccauccgcgcc

SEQ ID NO: 647724 - RNA, 22 nt, Human
ccccagcauagccauccgcgcc

SEQ ID NO: 647725 - RNA, 18 nt, Human
ccccggcaccgugcugug

SEQ ID NO: 647726 - RNA, 22 nt, Human
cccgcuccucucccugcagcca

SEQ ID NO: 647727 - RNA, 23 nt, Human
cccucaacaaccugcagccccgg

SEQ ID NO: 647728 - RNA, 18 nt, Human
cccugacugcugcggcca

SEQ ID NO: 647729 - RNA, 22 nt, Human
ccuggcugagccccacggaguc

SEQ ID NO: 647730 - RNA, 21 nt, Human
ccugggaccccagcauagcca

SEQ ID NO: 647731 - RNA, 19 nt, Human
cgacacagagcagcggcuc

SEQ ID NO: 647732 - RNA, 22 nt, Human
cgucucugcucccgccucuaac

SEQ ID NO: 647733 - RNA, 25 nt, Human
cuggagcauccacugagaauggaca

SEQ ID NO: 647734 - RNA, 21 nt, Human
cuggagccuggcugagcccca

SEQ ID NO: 647735 - RNA, 20 nt, Human
gaacaacuuggcagggucag

SEQ ID NO: 647736 - RNA, 21 nt, Human
gacaaaacagcaaacccggaa

SEQ ID NO: 647737 - RNA, 18 nt, Human
gcagccagggcauguggc

SEQ ID NO: 647738 - RNA, 25 nt, Human
gcccucaacaaccugcagccccggc

SEQ ID NO: 647739 - RNA, 19 nt, Human
gcgguuugucacuccaccc

SEQ ID NO: 647740 - RNA, 18 nt, Human
gcugcggccacccuggga

SEQ ID NO: 647741 - RNA, 21 nt, Human
gcuggagccuggcugagcccc

SEQ ID NO: 647742 - RNA, 24 nt, Human
ggaaacagacaaaacagcaaaccc

SEQ ID NO: 647743 - RNA, 22 nt, Human
gggagaaaccacagcacagcca

SEQ ID NO: 647744 - RNA, 18 nt, Human
gggcgggggagguggagg

SEQ ID NO: 647745 - RNA, 19 nt, Human
gggcgggggagguggaggc

SEQ ID NO: 647746 - RNA, 23 nt, Human
gggggagguggaggcggucuggc

SEQ ID NO: 647747 - RNA, 24 nt, Human
gucccgcuccucucccugcagcca

SEQ ID NO: 647748 - RNA, 20 nt, Human
gugacccugacugcugcggc

SEQ ID NO: 647749 - RNA, 21 nt, Human
ucacaacagcagaaaaguucc

SEQ ID NO: 647750 - RNA, 24 nt, Human
uccaugaucacggcagaccggggc

SEQ ID NO: 647751 - RNA, 19 nt, Human
uccgaagcuccaugaucac

SEQ ID NO: 647752 - RNA, 19 nt, Human
uccgcgccgaugacugaga

SEQ ID NO: 647753 - RNA, 23 nt, Human
ucgucuguggcuuugcucuuaac

SEQ ID NO: 647754 - RNA, 24 nt, Human
ugacccugacugcugcggccaccc

SEQ ID NO: 647755 - RNA, 23 nt, Human
ugagaauggacaagucaucgucu

SEQ ID NO: 647756 - RNA, 23 nt, Human
ugagccccacggagucacagccc

SEQ ID NO: 647757 - RNA, 19 nt, Human
ugccauggcgggcacagga

SEQ ID NO: 647758 - RNA, 23 nt, Human
ugcuguguaggcacagccuggag

SEQ ID NO: 647759 - RNA, 21 nt, Human
uggcgggcacaggacaaugcg

SEQ ID NO: 647760 - RNA, 19 nt, Human
uggcugagccccacggagu

SEQ ID NO: 647761 - RNA, 22 nt, Human
ugggaccccagcauagccaucc

SEQ ID NO: 647762 - RNA, 23 nt, Human
ugggaccccagcauagccauccg

SEQ ID NO: 647763 - RNA, 22 nt, Human
ugucccgcuccucucccugcag

SEQ ID NO: 647764 - RNA, 21 nt, Human
uguguaggcacagccuggagc

SEQ ID NO: 647765 - RNA, 21 nt, Human
uucccgcuuccgaagcuccau

SEQ ID NO: 647766 - RNA, 21 nt, Human
uuuuuuuuuuuuuuggucugg

SEQ ID NO: 647767 - RNA, 20 nt, Human
uuuuuuuuuuuuuuuuuggu

SEQ ID NO: 647768 - RNA, 25 nt, Human
uuuuuuuuuuuuuuuuuggucuggg

SEQ ID NO: 647769 - RNA, 22 nt, Human
aaacuggaaagguaggaggcca

SEQ ID NO: 647770 - RNA, 23 nt, Human
aaacuggaaagguaggaggccac

SEQ ID NO: 647771 - RNA, 24 nt, Human
aaauaaccucauguuccacuuggc

SEQ ID NO: 647772 - RNA, 22 nt, Human
aacaugguucugagaggccccu

SEQ ID NO: 647773 - RNA, 20 nt, Human
aaccucauguuccacuuggc

SEQ ID NO: 647774 - RNA, 22 nt, Human
aagaggcaggacaacaaaagua

SEQ ID NO: 647775 - RNA, 23 nt, Human
aagaugugggcuggaaugagaua

SEQ ID NO: 647776 - RNA, 19 nt, Human
aaggagaagaugugggcug

SEQ ID NO: 647777 - RNA, 18 nt, Human
acaggcaaaagggucacg

SEQ ID NO: 647778 - RNA, 23 nt, Human
accaccuuuagagaagccucagc

SEQ ID NO: 647779 - RNA, 20 nt, Human
accggcuccaggggauuuuc

SEQ ID NO: 647780 - RNA, 22 nt, Human
accuggcuggggaacaugguuc

SEQ ID NO: 647781 - RNA, 24 nt, Human
agaauaaaggcaggaaaaucagaa

SEQ ID NO: 647782 - RNA, 19 nt, Human
agagaggaaagggggaggc

SEQ ID NO: 647783 - RNA, 22 nt, Human
agcuccuagcauggagacaucc

SEQ ID NO: 647784 - RNA, 26 nt, Human
aggcaggacaacaaaaguaaucagga

SEQ ID NO: 647785 - RNA, 21 nt, Human
aggccgcaaaaacuggucuga

SEQ ID NO: 647786 - RNA, 22 nt, Human
agucugggcucuggagcuucug

SEQ ID NO: 647787 - RNA, 20 nt, Human
auaggacaagagaagacaga

SEQ ID NO: 647788 - RNA, 21 nt, Human
auaggacaagagaagacagaa

SEQ ID NO: 647789 - RNA, 21 nt, Human
auguguggccaugcuaagggc

SEQ ID NO: 647790 - RNA, 18 nt, Human
caaaagggccgacagggu

SEQ ID NO: 647791 - RNA, 22 nt, Human
caaaagggccgacaggguagua

SEQ ID NO: 647792 - RNA, 23 nt, Human
caacagaaacuggaaagguagga

SEQ ID NO: 647793 - RNA, 19 nt, Human
caaccaccuuuagagaagc

SEQ ID NO: 647794 - RNA, 21 nt, Human
caagaagccacagggcuggua

SEQ ID NO: 647795 - RNA, 23 nt, Human
caccccaugcuggagcucauccc

SEQ ID NO: 647796 - RNA, 24 nt, Human
cacgcugggcaggaguagccgcau

SEQ ID NO: 647797 - RNA, 22 nt, Human
cagcauggcaaaagggccgaca

SEQ ID NO: 647798 - RNA, 24 nt, Human
caggaaaaucagaaacaccagaga

SEQ ID NO: 647799 - RNA, 22 nt, Human
cauguguggccaugcuaagggc

SEQ ID NO: 647800 - RNA, 22 nt, Human
ccaaaucugugaccauuaccug

SEQ ID NO: 647801 - RNA, 22 nt, Human
ccaaccaccuuuagagaagccu

SEQ ID NO: 647802 - RNA, 19 nt, Human
ccacaggcaaaagggucac

SEQ ID NO: 647803 - RNA, 18 nt, Human
ccacaucgucuuuuccca

SEQ ID NO: 647804 - RNA, 20 nt, Human
ccacccaccuccauacccac

SEQ ID NO: 647805 - RNA, 20 nt, Human
ccaggggauuuuccauccug

SEQ ID NO: 647806 - RNA, 24 nt, Human
ccaucuacgaguugccucaacugu

SEQ ID NO: 647807 - RNA, 21 nt, Human
cccacccaccuccauacccac

SEQ ID NO: 647808 - RNA, 24 nt, Human
ccccaccacgcugggcaggaguug

SEQ ID NO: 647809 - RNA, 19 nt, Human
ccccaugcuggagcucauc

SEQ ID NO: 647810 - RNA, 19 nt, Human
ccccucgggauggggaggu

SEQ ID NO: 647811 - RNA, 21 nt, Human
cccucgggauggggaggucac

SEQ ID NO: 647812 - RNA, 20 nt, Human
ccgcaugggauguccuccuc

SEQ ID NO: 647813 - RNA, 21 nt, Human
ccggucgccgacugccuccuc

SEQ ID NO: 647814 - RNA, 20 nt, Human
ccucaacuguccccgugaua

SEQ ID NO: 647815 - RNA, 18 nt, Human
ccucagcaagccucccuc

SEQ ID NO: 647816 - RNA, 23 nt, Human
ccuccauacccacauuucucaga

SEQ ID NO: 647817 - RNA, 19 nt, Human
cgcccgcgucggcuagugg

SEQ ID NO: 647818 - RNA, 23 nt, Human
cgcuugagucccaaggcacgcuc

SEQ ID NO: 647819 - RNA, 20 nt, Human
cgugacuggccaccucugcc

SEQ ID NO: 647820 - RNA, 22 nt, Human
cuccauacccacauuucucaga

SEQ ID NO: 647821 - RNA, 23 nt, Human
cucccaugauuuggaaauaaccu

SEQ ID NO: 647822 - RNA, 19 nt, Human
cucuggagcuucugcugcc

SEQ ID NO: 647823 - RNA, 21 nt, Human
cugcugccccaccacgcuggg

SEQ ID NO: 647824 - RNA, 18 nt, Human
cuggccaccucugccagg

SEQ ID NO: 647825 - RNA, 22 nt, Human
cugggcucuggagcuucugcug

SEQ ID NO: 647826 - RNA, 20 nt, Human
cuguaccucaccccaugcug

SEQ ID NO: 647827 - RNA, 24 nt, Human
cuucaagucucucuucuguaccuc

SEQ ID NO: 647828 - RNA, 23 nt, Human
cuuucccacccaccuccauaccc

SEQ ID NO: 647829 - RNA, 19 nt, Human
cuuugugcacccacauggu

SEQ ID NO: 647830 - RNA, 18 nt, Human
gaaaggagaagauguggg

SEQ ID NO: 647831 - RNA, 24 nt, Human
gaaccaagagucaagaagccacag

SEQ ID NO: 647832 - RNA, 27 nt, Human
gaauaaaggcaggaaaaucagaaacac

SEQ ID NO: 647833 - RNA, 25 nt, Human
gacaacaaaaguaaucaggaaagga

SEQ ID NO: 647834 - RNA, 20 nt, Human
gacuggggcgggggagcgag

SEQ ID NO: 647835 - RNA, 23 nt, Human
gagccugcaagucugggcucugg

SEQ ID NO: 647836 - RNA, 21 nt, Human
gagucccaaggcacgcucuuc

SEQ ID NO: 647837 - RNA, 22 nt, Human
gccuccgaguggggggagcggg

SEQ ID NO: 647838 - RNA, 19 nt, Human
gcuccugucccucucgccc

SEQ ID NO: 647839 - RNA, 26 nt, Human
ggcaggacaacaaaaguaaucaggaa

SEQ ID NO: 647840 - RNA, 26 nt, Human
ggcaggacaacaaaaguaaucaggaa

SEQ ID NO: 647841 - RNA, 18 nt, Human
ggcuccaggggauuuucc

SEQ ID NO: 647842 - RNA, 23 nt, Human
gggcgggggagcgaggaaggggc

SEQ ID NO: 647843 - RNA, 18 nt, Human
ggggcgggggagcgagga

SEQ ID NO: 647844 - RNA, 24 nt, Human
ggucugauuucaggguucuucucu

SEQ ID NO: 647845 - RNA, 18 nt, Human
guggccagguucacccug

SEQ ID NO: 647846 - RNA, 25 nt, Human
uaaaggcaggaaaaucagaaacacc

SEQ ID NO: 647847 - RNA, 20 nt, Human
uaagaugugcauuuccuucc

SEQ ID NO: 647848 - RNA, 25 nt, Human
uagcauuaaagggacacaccaacac

SEQ ID NO: 647849 - RNA, 21 nt, Human
uaggaggccacaucgucuuuu

SEQ ID NO: 647850 - RNA, 20 nt, Human
uauuucacuagccaugagca

SEQ ID NO: 647851 - RNA, 19 nt, Human
ucagaaacaccagagagca

SEQ ID NO: 647852 - RNA, 22 nt, Human
ucagaaacaccagagagcacag

SEQ ID NO: 647853 - RNA, 21 nt, Human
ucaucccacaggcaaaagggu

SEQ ID NO: 647854 - RNA, 18 nt, Human
uccauuacggaugcggag

SEQ ID NO: 647855 - RNA, 21 nt, Human
ucccugcaccuacaccugagg

SEQ ID NO: 647856 - RNA, 18 nt, Human
uccugcccucucccugcu

SEQ ID NO: 647857 - RNA, 22 nt, Human
ucuaaggggcagacauuguggc

SEQ ID NO: 647858 - RNA, 18 nt, Human
ucuggagcuucugcugcc

SEQ ID NO: 647859 - RNA, 21 nt, Human
ugaagaggcaggacaacaaaa

SEQ ID NO: 647860 - RNA, 24 nt, Human
ugaagaggcaggacaacaaaagua

SEQ ID NO: 647861 - RNA, 21 nt, Human
ugccgacccccgccucccgga

SEQ ID NO: 647862 - RNA, 22 nt, Human
ugccucaacuguccccgugaua

SEQ ID NO: 647863 - RNA, 19 nt, Human
uggaaagggcacuguaaca

SEQ ID NO: 647864 - RNA, 19 nt, Human
uggagacauccuucaugga

SEQ ID NO: 647865 - RNA, 18 nt, Human
ugggcucuggagcuucug

SEQ ID NO: 647866 - RNA, 25 nt, Human
ugggcucuugcacacaggggagucu

SEQ ID NO: 647867 - RNA, 24 nt, Human
ugugaccauuaccugaagaggcag

SEQ ID NO: 647868 - RNA, 25 nt, Human
ugugcacccacaugguuuuggccug

SEQ ID NO: 647869 - RNA, 23 nt, Human
uucacgugacuggccaccucugc

SEQ ID NO: 647870 - RNA, 19 nt, Human
uucauggaagugagcuuuc

SEQ ID NO: 647871 - RNA, 22 nt, Human
uugaucugcccuggggacaugu

SEQ ID NO: 647872 - RNA, 22 nt, Human
uuggcgcuugagucccaaggca

SEQ ID NO: 647873 - RNA, 22 nt, Human
aaaaaaaaaacucagauauuua

SEQ ID NO: 647874 - RNA, 25 nt, Human
aaaaaacucagauauuuaguagucc

SEQ ID NO: 647875 - RNA, 21 nt, Human
aaagaaauaagacaugaaaau

SEQ ID NO: 647876 - RNA, 19 nt, Human
aaagugcugggauuacaga

SEQ ID NO: 647877 - RNA, 24 nt, Human
aaagugcugggauuacagacguga

SEQ ID NO: 647878 - RNA, 22 nt, Human
aaauugcacuguuauuuaaacc

SEQ ID NO: 647879 - RNA, 23 nt, Human
aacccacccgccucggccuccca

SEQ ID NO: 647880 - RNA, 20 nt, Human
aagaugggguuucgccaugu

SEQ ID NO: 647881 - RNA, 18 nt, Human
aagcccaaaagagccgag

SEQ ID NO: 647882 - RNA, 22 nt, Human
aaguaacccacccgccucggcc

SEQ ID NO: 647883 - RNA, 24 nt, Human
aaguagcugggauuacaggcgcgu

SEQ ID NO: 647884 - RNA, 27 nt, Human
aaguagcugggauuacaggcgcgugac

SEQ ID NO: 647885 - RNA, 19 nt, Human
aagugcugggauuacagac

SEQ ID NO: 647886 - RNA, 26 nt, Human
aagugcugggauuacagacgugagcc

SEQ ID NO: 647887 - RNA, 25 nt, Human
acccgccucggccucccaaagugcu

SEQ ID NO: 647888 - RNA, 24 nt, Human
acccggcuaauuuuuuuguauuuu

SEQ ID NO: 647889 - RNA, 21 nt, Human
acgugagccauggcgcccggc

SEQ ID NO: 647890 - RNA, 25 nt, Human
acucugucgcccaggguggagugca

SEQ ID NO: 647891 - RNA, 20 nt, Human
agcccaaaagagccgagaug

SEQ ID NO: 647892 - RNA, 19 nt, Human
aggagaaaggaagcguccg

SEQ ID NO: 647893 - RNA, 21 nt, Human
agugcaguggcccaaucucag

SEQ ID NO: 647894 - RNA, 24 nt, Human
agugcaguggcccaaucucagcuc

SEQ ID NO: 647895 - RNA, 24 nt, Human
agugcugggauuacagacgugagc

SEQ ID NO: 647896 - RNA, 18 nt, Human
augggguuucgccauguu

SEQ ID NO: 647897 - RNA, 20 nt, Human
augggguuucgccauguuug

SEQ ID NO: 647898 - RNA, 19 nt, Human
auuacagacgugagccaug

SEQ ID NO: 647899 - RNA, 24 nt, Human
caaagugcugggauuacagacgug

SEQ ID NO: 647900 - RNA, 19 nt, Human
caaggauggacugaggugg

SEQ ID NO: 647901 - RNA, 23 nt, Human
cacccgccucggccucccaaagu

SEQ ID NO: 647902 - RNA, 20 nt, Human
cacggcccagccccgggucu

SEQ ID NO: 647903 - RNA, 22 nt, Human
cacucugucgcccaggguggag

SEQ ID NO: 647904 - RNA, 21 nt, Human
cacugcaaccuccgccuccug

SEQ ID NO: 647905 - RNA, 23 nt, Human
cacugcaaccuccgccuccuggg

SEQ ID NO: 647906 - RNA, 22 nt, Human
cagcucuuuaaagaaauaagac

SEQ ID NO: 647907 - RNA, 18 nt, Human
caguggcccaaucucagc

SEQ ID NO: 647908 - RNA, 22 nt, Human
ccaaagugcugggauuacagac

SEQ ID NO: 647909 - RNA, 24 nt, Human
ccaaagugcugggauuacagacgu

SEQ ID NO: 647910 - RNA, 22 nt, Human
ccaaguagcugggauuacaggc

SEQ ID NO: 647911 - RNA, 23 nt, Human
ccauguuugccaggcuggucucg

SEQ ID NO: 647912 - RNA, 23 nt, Human
cccaaguagcugggauuacaggc

SEQ ID NO: 647913 - RNA, 24 nt, Human
cccaaguagcugggauuacaggcg

SEQ ID NO: 647914 - RNA, 24 nt, Human
ccccaaguagcugggauuacaggc

SEQ ID NO: 647915 - RNA, 22 nt, Human
ccgccgggcuccggacugugga

SEQ ID NO: 647916 - RNA, 26 nt, Human
ccgccuccuggguucaggcaauucuu

SEQ ID NO: 647917 - RNA, 24 nt, Human
ccggccguggaggcagcucucccc

SEQ ID NO: 647918 - RNA, 18 nt, Human
ccuaaagaaaaaaaacac

SEQ ID NO: 647919 - RNA, 19 nt, Human
ccuccgccuccuggguuca

SEQ ID NO: 647920 - RNA, 24 nt, Human
ccuccuggguucaggcaauucucc

SEQ ID NO: 647921 - RNA, 23 nt, Human
ccugaccucaaguaacccacccg

SEQ ID NO: 647922 - RNA, 19 nt, Human
cgaagcccauugccgguac

SEQ ID NO: 647923 - RNA, 21 nt, Human
cgaagcccauugccgguacca

SEQ ID NO: 647924 - RNA, 24 nt, Human
cgccauguuugccaggcuggucuc

SEQ ID NO: 647925 - RNA, 24 nt, Human
cgccucggccucccaaagugcugg

SEQ ID NO: 647926 - RNA, 23 nt, Human
cgggugaaagggagagaagcuga

SEQ ID NO: 647927 - RNA, 24 nt, Human
cucacugcaaccuccgccuccugg

SEQ ID NO: 647928 - RNA, 21 nt, Human
cuccuggguucaggcaauucu

SEQ ID NO: 647929 - RNA, 24 nt, Human
cugagccccccaaguagcugggau

SEQ ID NO: 647930 - RNA, 19 nt, Human
cugaggugguggcgacugc

SEQ ID NO: 647931 - RNA, 23 nt, Human
cugcaaccuccgccuccuggguu

SEQ ID NO: 647932 - RNA, 24 nt, Human
cugcaaccuccgccuccuggguuc

SEQ ID NO: 647933 - RNA, 24 nt, Human
gaccucaaguaacccacccgccuc

SEQ ID NO: 647934 - RNA, 18 nt, Human
gauuacagacgugagcca

SEQ ID NO: 647935 - RNA, 22 nt, Human
gauuacagacgugagccauggc

SEQ ID NO: 647936 - RNA, 19 nt, Human
gcacuggaggauacgaagc

SEQ ID NO: 647937 - RNA, 22 nt, Human
gccaggcuggucucgaacuccu

SEQ ID NO: 647938 - RNA, 20 nt, Human
gccgagauggucaccgccgg

SEQ ID NO: 647939 - RNA, 23 nt, Human
gcuggucucgaacuccugaccuc

SEQ ID NO: 647940 - RNA, 18 nt, Human
ggacuguggaggccgucg

SEQ ID NO: 647941 - RNA, 21 nt, Human
ggaucuuuaaaaaaaaaaaaa

SEQ ID NO: 647942 - RNA, 24 nt, Human
ggcuggucucgaacuccugaccuc

SEQ ID NO: 647943 - RNA, 22 nt, Human
gggguuucgccauguuugccag

SEQ ID NO: 647944 - RNA, 19 nt, Human
ggucucgaacuccugaccu

SEQ ID NO: 647945 - RNA, 23 nt, Human
gguggagugcaguggcccaaucu

SEQ ID NO: 647946 - RNA, 24 nt, Human
guaacccacccgccucggccuccc

SEQ ID NO: 647947 - RNA, 24 nt, Human
uaaaauauucauaugcaugagaag

SEQ ID NO: 647948 - RNA, 18 nt, Human
uaaagaaaaaaaacaccu

SEQ ID NO: 647949 - RNA, 19 nt, Human
uaaagaaaaaaaacaccuc

SEQ ID NO: 647950 - RNA, 23 nt, Human
uaggaucuuuaaaaaaaaaaaaa

SEQ ID NO: 647951 - RNA, 24 nt, Human
uaguuaagaugggguuucgccaug

SEQ ID NO: 647952 - RNA, 23 nt, Human
ucacugcaaccuccgccuccugg

SEQ ID NO: 647953 - RNA, 24 nt, Human
ucacugcaaccuccgccuccuggg

SEQ ID NO: 647954 - RNA, 25 nt, Human
ucacugcaaccuccgccuccugggu

SEQ ID NO: 647955 - RNA, 27 nt, Human
ucacugcaaccuccgccuccuggguuc

SEQ ID NO: 647956 - RNA, 19 nt, Human
ucaggcaauucuccugccu

SEQ ID NO: 647957 - RNA, 22 nt, Human
uccauucgugcuuaaaauauuc

SEQ ID NO: 647958 - RNA, 18 nt, Human
ucccaaagugcugggauu

SEQ ID NO: 647959 - RNA, 24 nt, Human
ucccaaagugcugggauuacagac

SEQ ID NO: 647960 - RNA, 21 nt, Human
uccguggcagccgcucccuuc

SEQ ID NO: 647961 - RNA, 21 nt, Human
uccuggguucaggcaauucuc

SEQ ID NO: 647962 - RNA, 24 nt, Human
uccuggguucaggcaauucuccug

SEQ ID NO: 647963 - RNA, 22 nt, Human
ucgccauguuugccaggcuggu

SEQ ID NO: 647964 - RNA, 18 nt, Human
ucgcccaggguggagugc

SEQ ID NO: 647965 - RNA, 18 nt, Human
ucggccucccaaagugcu

SEQ ID NO: 647966 - RNA, 18 nt, Human
ucucacucugucgcccag

SEQ ID NO: 647967 - RNA, 19 nt, Human
ucucacucugucgcccagg

SEQ ID NO: 647968 - RNA, 20 nt, Human
ucucacucugucgcccaggg

SEQ ID NO: 647969 - RNA, 24 nt, Human
ucucacucugucgcccagggugga

SEQ ID NO: 647970 - RNA, 21 nt, Human
ucucgaacuccugaccucaag

SEQ ID NO: 647971 - RNA, 24 nt, Human
ucugucgcccaggguggagugcag

SEQ ID NO: 647972 - RNA, 20 nt, Human
ucuuuaaaaaaaaaaaaaaa

SEQ ID NO: 647973 - RNA, 26 nt, Human
ugaaaugaguaacaccuggaagacca

SEQ ID NO: 647974 - RNA, 23 nt, Human
ugaccucaaguaacccacccgcc

SEQ ID NO: 647975 - RNA, 23 nt, Human
ugagaagccuaaagaaaaaaaac

SEQ ID NO: 647976 - RNA, 19 nt, Human
ugagccccccaaguagcug

SEQ ID NO: 647977 - RNA, 19 nt, Human
ugcacuggaggauacgaag

SEQ ID NO: 647978 - RNA, 23 nt, Human
ugcaguggcccaaucucagcuca

SEQ ID NO: 647979 - RNA, 21 nt, Human
ugccugagccccccaaguagc

SEQ ID NO: 647980 - RNA, 24 nt, Human
ugccugagccccccaaguagcugg

SEQ ID NO: 647981 - RNA, 24 nt, Human
ugcugggauuacagacgugagcca

SEQ ID NO: 647982 - RNA, 21 nt, Human
uggaggcagcucuccccgcca

SEQ ID NO: 647983 - RNA, 19 nt, Human
uggagugcaguggcccaau

SEQ ID NO: 647984 - RNA, 23 nt, Human
uggagugcaguggcccaaucuca

SEQ ID NO: 647985 - RNA, 24 nt, Human
uggcccaaucucagcucacugcaa

SEQ ID NO: 647986 - RNA, 18 nt, Human
ugggauuacagacgugag

SEQ ID NO: 647987 - RNA, 19 nt, Human
ugggauuacagacgugagc

SEQ ID NO: 647988 - RNA, 21 nt, Human
ugggauuacagacgugagcca

SEQ ID NO: 647989 - RNA, 22 nt, Human
ugggauuacagacgugagccau

SEQ ID NO: 647990 - RNA, 27 nt, Human
ugggauuacagacgugagccauggcgc

SEQ ID NO: 647991 - RNA, 31 nt, Human
ugggauuacagacgugagccauggcgcccgg

SEQ ID NO: 647992 - RNA, 18 nt, Human
ugggauuacaggcgcgug

SEQ ID NO: 647993 - RNA, 24 nt, Human
ugggauuacaggcgcgugacacca

SEQ ID NO: 647994 - RNA, 20 nt, Human
uggggucugggugcccggcc

SEQ ID NO: 647995 - RNA, 24 nt, Human
uggguucaggcaauucuccugccu

SEQ ID NO: 647996 - RNA, 23 nt, Human
ugguauacuacacauaauugaaa

SEQ ID NO: 647997 - RNA, 30 nt, Human
uuaggaucuuuaaaaaaaaaaaaaaaaaaa

SEQ ID NO: 647998 - RNA, 24 nt, Human
uuaguuaagaugggguuucgccau

SEQ ID NO: 647999 - RNA, 19 nt, Human
uugaaaugaguaacaccug

SEQ ID NO: 648000 - RNA, 21 nt, Human
uuucgccauguuugccaggcu

SEQ ID NO: 648001 - RNA, 23 nt, Human
uuuuuaguuaagaugggguuucg

SEQ ID NO: 648002 - RNA, 24 nt, Human
uuuuuaguuaagaugggguuucgc

SEQ ID NO: 648003 - RNA, 24 nt, Human
uuuuuuguauuuuuaguuaagaug

SEQ ID NO: 648004 - RNA, 27 nt, Human
uuuuuuuuuuucugagaccgagucuca

SEQ ID NO: 648005 - RNA, 18 nt, Human
uuuuuuuuuuuuuuucug

SEQ ID NO: 648006 - RNA, 21 nt, Human
aaaaggaaaggggccugugca

SEQ ID NO: 648007 - RNA, 27 nt, Human
aacaaaacaagugacagacgggacaau

SEQ ID NO: 648008 - RNA, 20 nt, Human
aacauagcaagaccucaucu

SEQ ID NO: 648009 - RNA, 25 nt, Human
aagaaagaaaauggagaaaaaagga

SEQ ID NO: 648010 - RNA, 21 nt, Human
aagggggagaaaaaagaaaga

SEQ ID NO: 648011 - RNA, 21 nt, Human
aauggagaaaaaaggaaaggg

SEQ ID NO: 648012 - RNA, 20 nt, Human
acaaagggagacccugucuc

SEQ ID NO: 648013 - RNA, 20 nt, Human
acaccuguagucccagcuaa

SEQ ID NO: 648014 - RNA, 18 nt, Human
acccgccccacaaccaaa

SEQ ID NO: 648015 - RNA, 19 nt, Human
accucagcuuugaccucca

SEQ ID NO: 648016 - RNA, 18 nt, Human
accucaucucuacuaaag

SEQ ID NO: 648017 - RNA, 22 nt, Human
accuguagucccagcuacucau

SEQ ID NO: 648018 - RNA, 22 nt, Human
acuccagccugggagacaaagg

SEQ ID NO: 648019 - RNA, 18 nt, Human
acugcacuccagccuggg

SEQ ID NO: 648020 - RNA, 18 nt, Human
acugcacuccagccuggg

SEQ ID NO: 648021 - RNA, 20 nt, Human
agaaaaaagaaagaaaaugg

SEQ ID NO: 648022 - RNA, 22 nt, Human
agaaaaaagaaagaaaauggag

SEQ ID NO: 648023 - RNA, 24 nt, Human
agaaagaaaauggagaaaaaagga

SEQ ID NO: 648024 - RNA, 26 nt, Human
agaaagaaaauggagaaaagggaccc

SEQ ID NO: 648025 - RNA, 23 nt, Human
agaaguucaagaccagccugggc

SEQ ID NO: 648026 - RNA, 23 nt, Human
agccugggcaacauagcaagacc

SEQ ID NO: 648027 - RNA, 24 nt, Human
agccugggcaacauagcaagaccu

SEQ ID NO: 648028 - RNA, 18 nt, Human
aggcaagaggauugcuug

SEQ ID NO: 648029 - RNA, 18 nt, Human
aggcaagaggauugcuug

SEQ ID NO: 648030 - RNA, 24 nt, Human
aggcaagaggauugcuugagucua

SEQ ID NO: 648031 - RNA, 24 nt, Human
aggccgaggcaagaggauugcuug

SEQ ID NO: 648032 - RNA, 24 nt, Human
aggcugaggcgguaggauuacuug

SEQ ID NO: 648033 - RNA, 28 nt, Human
aguaauccuccuaauacgggcauuucuu

SEQ ID NO: 648034 - RNA, 27 nt, Human
agucuagaaguucaagaccagccuggg

SEQ ID NO: 648035 - RNA, 20 nt, Human
agugcaguggaguaaucaug

SEQ ID NO: 648036 - RNA, 24 nt, Human
agugcaguggaguaaucauggcuc

SEQ ID NO: 648037 - RNA, 23 nt, Human
aguggcucaugccuguaauccca

SEQ ID NO: 648038 - RNA, 24 nt, Human
aguggcucaugccuguaaucccag

SEQ ID NO: 648039 - RNA, 24 nt, Human
aucaugccacugcacuccagccug

SEQ ID NO: 648040 - RNA, 19 nt, Human
augccuguaaucccagcac

SEQ ID NO: 648041 - RNA, 20 nt, Human
cacaaccaaacauucagaug

SEQ ID NO: 648042 - RNA, 20 nt, Human
caccauuuguguucaagaca

SEQ ID NO: 648043 - RNA, 19 nt, Human
caccuguagucccagcuac

SEQ ID NO: 648044 - RNA, 21 nt, Human
caccuguagucccagcuacuc

SEQ ID NO: 648045 - RNA, 18 nt, Human
cacugcacuccagccugg

SEQ ID NO: 648046 - RNA, 19 nt, Human
cacugcacuccagccuggg

SEQ ID NO: 648047 - RNA, 22 nt, Human
cacugcacuccagccugggaga

SEQ ID NO: 648048 - RNA, 24 nt, Human
cacugcacuccagccugggagaca

SEQ ID NO: 648049 - RNA, 25 nt, Human
cacugcacuccagccugggagacaa

SEQ ID NO: 648050 - RNA, 23 nt, Human
cagcacuuugggaggccgaggca

SEQ ID NO: 648051 - RNA, 25 nt, Human
cagcacuuugggaggccgaggcaag

SEQ ID NO: 648052 - RNA, 19 nt, Human
cagggcacagacugaaucc

SEQ ID NO: 648053 - RNA, 24 nt, Human
cagggccuggcucuguugcccagg

SEQ ID NO: 648054 - RNA, 25 nt, Human
cauagcaagaccucaucucuacuaa

SEQ ID NO: 648055 - RNA, 24 nt, Human
caugccuguaaucccagcacuuug

SEQ ID NO: 648056 - RNA, 19 nt, Human
ccacaccuguagucccagc

SEQ ID NO: 648057 - RNA, 20 nt, Human
ccacaccuguagucccagcu

SEQ ID NO: 648058 - RNA, 19 nt, Human
ccacugcacuccagccugg

SEQ ID NO: 648059 - RNA, 20 nt, Human
ccacugcacuccagccuggg

SEQ ID NO: 648060 - RNA, 22 nt, Human
ccacugcacuccagccugggag

SEQ ID NO: 648061 - RNA, 24 nt, Human
ccacugcacuccagccugggagac

SEQ ID NO: 648062 - RNA, 21 nt, Human
ccaggcgggaccguaggcccc

SEQ ID NO: 648063 - RNA, 20 nt, Human
ccagggcucaaguaauccuc

SEQ ID NO: 648064 - RNA, 22 nt, Human
cccacaccuguagucccagcua

SEQ ID NO: 648065 - RNA, 24 nt, Human
cccacaccuguagucccagcuacu

SEQ ID NO: 648066 - RNA, 19 nt, Human
ccugccucccagaaaaggg

SEQ ID NO: 648067 - RNA, 24 nt, Human
ccuggcucuguugcccaggcugga

SEQ ID NO: 648068 - RNA, 24 nt, Human
ccugggcaacauagcaagaccuca

SEQ ID NO: 648069 - RNA, 22 nt, Human
ccuguaaucccagcacuuuggg

SEQ ID NO: 648070 - RNA, 22 nt, Human
ccuguagucccagcuacucaug

SEQ ID NO: 648071 - RNA, 20 nt, Human
ccugugcaguggcucaugcc

SEQ ID NO: 648072 - RNA, 25 nt, Human
cgaggcaagaggauugcuugagucu

SEQ ID NO: 648073 - RNA, 21 nt, Human
cucagcuuugaccuccagggc

SEQ ID NO: 648074 - RNA, 24 nt, Human
cucaugccuguaaucccagcacuu

SEQ ID NO: 648075 - RNA, 22 nt, Human
cucccagaaaagggggagaaaa

SEQ ID NO: 648076 - RNA, 25 nt, Human
cucuacuaaagaaaaaaaaaauuag

SEQ ID NO: 648077 - RNA, 20 nt, Human
cucuguugcccaggcuggag

SEQ ID NO: 648078 - RNA, 21 nt, Human
cugggagacaaagggagaccc

SEQ ID NO: 648079 - RNA, 24 nt, Human
cugugcaguggcucaugccuguaa

SEQ ID NO: 648080 - RNA, 22 nt, Human
cuucagaacccgccccacaacc

SEQ ID NO: 648081 - RNA, 21 nt, Human
gacaaagggagacccugucuc

SEQ ID NO: 648082 - RNA, 24 nt, Human
gagugcaguggaguaaucauggcu

SEQ ID NO: 648083 - RNA, 21 nt, Human
gaucaugccacugcacuccag

SEQ ID NO: 648084 - RNA, 21 nt, Human
gcaacaaaacaagugacagac

SEQ ID NO: 648085 - RNA, 29 nt, Human
gcacuccagccugggagacaaagggagag

SEQ ID NO: 648086 - RNA, 19 nt, Human
gcccaggcuggagugcagu

SEQ ID NO: 648087 - RNA, 28 nt, Human
gcguggacacccacaccuguagucccag

SEQ ID NO: 648088 - RNA, 22 nt, Human
gcucaaguaauccuccuaauac

SEQ ID NO: 648089 - RNA, 25 nt, Human
gcucuguugcccaggcuggagugca

SEQ ID NO: 648090 - RNA, 21 nt, Human
ggagacaaagggagacccugu

SEQ ID NO: 648091 - RNA, 19 nt, Human
ggcuggagugcaguggagu

SEQ ID NO: 648092 - RNA, 21 nt, Human
uaagacaacucccacagcugg

SEQ ID NO: 648093 - RNA, 23 nt, Human
uagcugggcguggacacccacag

SEQ ID NO: 648094 - RNA, 20 nt, Human
uaggauuacuugagcccaga

SEQ ID NO: 648095 - RNA, 24 nt, Human
uaggcuaugucucaugaggagacu

SEQ ID NO: 648096 - RNA, 25 nt, Human
ucaaccucaccauuuguguucaaga

SEQ ID NO: 648097 - RNA, 23 nt, Human
ucaagacagacccacaaccaggc

SEQ ID NO: 648098 - RNA, 23 nt, Human
ucagaacccgccccacaaccaaa

SEQ ID NO: 648099 - RNA, 24 nt, Human
ucagaacccgccccacaaccaaac

SEQ ID NO: 648100 - RNA, 25 nt, Human
ucaucucuacuaaagaaaaaaaaaa

SEQ ID NO: 648101 - RNA, 23 nt, Human
ucaugccacugcacuccagccug

SEQ ID NO: 648102 - RNA, 22 nt, Human
ucaugccuguaaucccagcacu

SEQ ID NO: 648103 - RNA, 22 nt, Human
uccagccugggagacaaaggga

SEQ ID NO: 648104 - RNA, 18 nt, Human
ucuaagcaagcaggcaag

SEQ ID NO: 648105 - RNA, 24 nt, Human
ucuaagcuagcaucuggaauacaa

SEQ ID NO: 648106 - RNA, 18 nt, Human
ucuagaaguucaagacca

SEQ ID NO: 648107 - RNA, 18 nt, Human
ucuguugcccaggcugga

SEQ ID NO: 648108 - RNA, 24 nt, Human
ucuguugcccaggcuggagugcag

SEQ ID NO: 648109 - RNA, 25 nt, Human
ugaccuccagggcucaaguaauccu

SEQ ID NO: 648110 - RNA, 23 nt, Human
ugagcccagaaguuugaaccugc

SEQ ID NO: 648111 - RNA, 22 nt, Human
ugauacagggccuggcucuguu

SEQ ID NO: 648112 - RNA, 18 nt, Human
ugcccaggcuggagugca

SEQ ID NO: 648113 - RNA, 21 nt, Human
ugcccaggcuggagugcagug

SEQ ID NO: 648114 - RNA, 22 nt, Human
ugcccaggcuggagugcagugg

SEQ ID NO: 648115 - RNA, 23 nt, Human
ugccuguaaucccagcacuuugg

SEQ ID NO: 648116 - RNA, 23 nt, Human
ugccuguaaucccagcacuuugg

SEQ ID NO: 648117 - RNA, 24 nt, Human
uggagugcaguggaguaaucaugg

SEQ ID NO: 648118 - RNA, 24 nt, Human
uggcucaccucagcuuugaccucc

SEQ ID NO: 648119 - RNA, 24 nt, Human
uggcucaugccuguaaucccagca

SEQ ID NO: 648120 - RNA, 24 nt, Human
uggcucuguugcccaggcuggagu

SEQ ID NO: 648121 - RNA, 19 nt, Human
ugggaggccgaggcaagag

SEQ ID NO: 648122 - RNA, 22 nt, Human
ugggaggccgaggcaagaggau

SEQ ID NO: 648123 - RNA, 24 nt, Human
ugggaggccgaggcaagaggauug

SEQ ID NO: 648124 - RNA, 20 nt, Human
ugggcguggacacccacacc

SEQ ID NO: 648125 - RNA, 18 nt, Human
uguucaagacagacccac

SEQ ID NO: 648126 - RNA, 23 nt, Human
uugcccaggcuggagugcagugg

SEQ ID NO: 648127 - RNA, 20 nt, Human
uugggaggccgaggcaagag

SEQ ID NO: 648128 - RNA, 22 nt, Human
uugggaggccgaggcaagagga

SEQ ID NO: 648129 - RNA, 24 nt, Human
uuuuuuuuuugauacagggccugg

SEQ ID NO: 648130 - RNA, 18 nt, Human
uuuuuuuuuuuuuuuuug

SEQ ID NO: 648131 - RNA, 28 nt, Human
uuuuuuuuuuuuuuuuuuugauacaggg

SEQ ID NO: 648132 - RNA, 27 nt, Human
aaacagaaacaggaaaagacagcagga

SEQ ID NO: 648133 - RNA, 18 nt, Human
aaacaggaaaagacagca

SEQ ID NO: 648134 - RNA, 18 nt, Human
aaacaggaaaagacagca

SEQ ID NO: 648135 - RNA, 21 nt, Human
aaacaggaaaagacagcagga

SEQ ID NO: 648136 - RNA, 21 nt, Human
aacuccucagccaggcgcucu

SEQ ID NO: 648137 - RNA, 24 nt, Human
aacucgccccgcagccccggcccc

SEQ ID NO: 648138 - RNA, 19 nt, Human
acagaaacaggaaaagaca

SEQ ID NO: 648139 - RNA, 24 nt, Human
accacaguccacugaaguugacca

SEQ ID NO: 648140 - RNA, 24 nt, Human
acucuugggccgaggggcaagggu

SEQ ID NO: 648141 - RNA, 23 nt, Human
agagacuuggcugagggcagggg

SEQ ID NO: 648142 - RNA, 23 nt, Human
agaggugggccaccgcuggacac

SEQ ID NO: 648143 - RNA, 19 nt, Human
agccaggcgcucugaaacc

SEQ ID NO: 648144 - RNA, 18 nt, Human
agccccggccccggcuuc

SEQ ID NO: 648145 - RNA, 20 nt, Human
aggguggacauagcauuggc

SEQ ID NO: 648146 - RNA, 21 nt, Human
aggguggacauagcauuggca

SEQ ID NO: 648147 - RNA, 21 nt, Human
aguggaacuccucagccaggc

SEQ ID NO: 648148 - RNA, 20 nt, Human
caaacagaaacaggaaaaga

SEQ ID NO: 648149 - RNA, 19 nt, Human
cagcucccggcccagggcc

SEQ ID NO: 648150 - RNA, 20 nt, Human
ccaaagggcugcuccagugc

SEQ ID NO: 648151 - RNA, 24 nt, Human
ccagcucccggcccagggccgaca

SEQ ID NO: 648152 - RNA, 19 nt, Human
cccagggccgacaacucgc

SEQ ID NO: 648153 - RNA, 18 nt, Human
ccccgcagccccggcccc

SEQ ID NO: 648154 - RNA, 20 nt, Human
ccccgcagccccggccccgg

SEQ ID NO: 648155 - RNA, 20 nt, Human
ccgacccagcgcggucgcac

SEQ ID NO: 648156 - RNA, 21 nt, Human
ccgagacagaccaaggcucac

SEQ ID NO: 648157 - RNA, 22 nt, Human
ccgagcaacuccccccggcuga

SEQ ID NO: 648158 - RNA, 25 nt, Human
ccgcagccccggccccggcuucccu

SEQ ID NO: 648159 - RNA, 22 nt, Human
ccggccccggcuucccucgugc

SEQ ID NO: 648160 - RNA, 21 nt, Human
cgacccagcgcggucgcacga

SEQ ID NO: 648161 - RNA, 18 nt, Human
cgcagccccggccccggc

SEQ ID NO: 648162 - RNA, 19 nt, Human
cgugggcugguccaucucc

SEQ ID NO: 648163 - RNA, 22 nt, Human
cucagccaggcgcucugaaacc

SEQ ID NO: 648164 - RNA, 21 nt, Human
cuccccccggcugaggcggcu

SEQ ID NO: 648165 - RNA, 25 nt, Human
cucgccccgcagccccggccccggc

SEQ ID NO: 648166 - RNA, 23 nt, Human
cucugaaaccaaccacaguccac

SEQ ID NO: 648167 - RNA, 22 nt, Human
cugaaaccaaccacaguccacu

SEQ ID NO: 648168 - RNA, 21 nt, Human
cugaagaccaaaucccuugcc

SEQ ID NO: 648169 - RNA, 22 nt, Human
gaaaagacagcaggagcacaga

SEQ ID NO: 648170 - RNA, 19 nt, Human
gccccggcuucccucgugc

SEQ ID NO: 648171 - RNA, 22 nt, Human
gccugcucacuuccgacccagc

SEQ ID NO: 648172 - RNA, 21 nt, Human
gcgugggcugguccaucuccc

SEQ ID NO: 648173 - RNA, 18 nt, Human
ggaaaagacagcaggagc

SEQ ID NO: 648174 - RNA, 21 nt, Human
ggcucuucgggggcugggccg

SEQ ID NO: 648175 - RNA, 24 nt, Human
ggcuguagugggaggaagaggugg

SEQ ID NO: 648176 - RNA, 18 nt, Human
gggccgaggggcaagggu

SEQ ID NO: 648177 - RNA, 24 nt, Human
gggcugggccgggaccuaugaguu

SEQ ID NO: 648178 - RNA, 20 nt, Human
gggcugguccaucucccucc

SEQ ID NO: 648179 - RNA, 20 nt, Human
guggaacuccucagccaggc

SEQ ID NO: 648180 - RNA, 22 nt, Human
uaagucaaacgcaaacagaaac

SEQ ID NO: 648181 - RNA, 20 nt, Human
ucagccugcucacuuccgac

SEQ ID NO: 648182 - RNA, 23 nt, Human
uccucagccaggcgcucugaaac

SEQ ID NO: 648183 - RNA, 18 nt, Human
ucucccuccucagccucu

SEQ ID NO: 648184 - RNA, 23 nt, Human
ucuugggccgaggggcaagggug

SEQ ID NO: 648185 - RNA, 19 nt, Human
ugaaaccaaccacagucca

SEQ ID NO: 648186 - RNA, 24 nt, Human
ugaaaccaaccacaguccacugaa

SEQ ID NO: 648187 - RNA, 25 nt, Human
ugaaaccaaccacaguccacugaag

SEQ ID NO: 648188 - RNA, 20 nt, Human
ugaccacccuaccgagacag

SEQ ID NO: 648189 - RNA, 21 nt, Human
ugagggcagggguggaaggau

SEQ ID NO: 648190 - RNA, 20 nt, Human
ugccauggagccaggugcca

SEQ ID NO: 648191 - RNA, 24 nt, Human
uggacguuugaguccgagcaacuc

SEQ ID NO: 648192 - RNA, 20 nt, Human
uggcagcaagagacuuggcu

SEQ ID NO: 648193 - RNA, 22 nt, Human
uggcauggcagcaagagacuug

SEQ ID NO: 648194 - RNA, 21 nt, Human
uuuuacuguugaggcuguagu

SEQ ID NO: 648195 - RNA, 22 nt, Human
aaaaaaaaaaaaaaucccagag

SEQ ID NO: 648196 - RNA, 24 nt, Human
aaaaaaaaaaucccagagccugga

SEQ ID NO: 648197 - RNA, 18 nt, Human
aaaaaaaucccagagccu

SEQ ID NO: 648198 - RNA, 21 nt, Human
aaaaaagaaaaaaguaaaaag

SEQ ID NO: 648199 - RNA, 18 nt, Human
aaacacaugaucccacca

SEQ ID NO: 648200 - RNA, 20 nt, Human
aaauguccuacccaggccac

SEQ ID NO: 648201 - RNA, 19 nt, Human
aacauggugaaaccccguc

SEQ ID NO: 648202 - RNA, 20 nt, Human
aacauggugaaaccccgucu

SEQ ID NO: 648203 - RNA, 21 nt, Human
aacauggugaaaccccgucuc

SEQ ID NO: 648204 - RNA, 19 nt, Human
aacuaagcaaguuaucccc

SEQ ID NO: 648205 - RNA, 23 nt, Human
aagaauugcuggacgcugggagg

SEQ ID NO: 648206 - RNA, 24 nt, Human
aagcaggcagggaccacaccugag

SEQ ID NO: 648207 - RNA, 23 nt, Human
aagcaucuuauuuaucucaauau

SEQ ID NO: 648208 - RNA, 21 nt, Human
aagcccccaaacacaugaucc

SEQ ID NO: 648209 - RNA, 22 nt, Human
aagcccccaaacacaugauccc

SEQ ID NO: 648210 - RNA, 24 nt, Human
aagcccccaaacacaugaucccuu

SEQ ID NO: 648211 - RNA, 18 nt, Human
acaccacugcacuccagc

SEQ ID NO: 648212 - RNA, 20 nt, Human
acaccacugcacuccagccu

SEQ ID NO: 648213 - RNA, 20 nt, Human
acacccagcccccgucucca

SEQ ID NO: 648214 - RNA, 26 nt, Human
acacgagagcccucuguggccugcca

SEQ ID NO: 648215 - RNA, 21 nt, Human
accacaccugagacacaaggg

SEQ ID NO: 648216 - RNA, 19 nt, Human
accacugcacuccagccug

SEQ ID NO: 648217 - RNA, 24 nt, Human
accccgucucuacuaaaaauacaa

SEQ ID NO: 648218 - RNA, 24 nt, Human
acugcacuccagccugggugacag

SEQ ID NO: 648219 - RNA, 26 nt, Human
acugcacuccagccugggugacagag

SEQ ID NO: 648220 - RNA, 24 nt, Human
acuugaggucaggaguucgagacc

SEQ ID NO: 648221 - RNA, 22 nt, Human
acuuguggcaugaagaagugaa

SEQ ID NO: 648222 - RNA, 22 nt, Human
agagggcuugguuccucccaau

SEQ ID NO: 648223 - RNA, 23 nt, Human
agaucacuugaggucaggaguuc

SEQ ID NO: 648224 - RNA, 21 nt, Human
agcacuuuggguggccaaggc

SEQ ID NO: 648225 - RNA, 18 nt, Human
agccugggcugggcacag

SEQ ID NO: 648226 - RNA, 23 nt, Human
agccugggcugggcacaguggcu

SEQ ID NO: 648227 - RNA, 24 nt, Human
agccugggugacagagacagacuc

SEQ ID NO: 648228 - RNA, 18 nt, Human
agcuggguccccuaaaag

SEQ ID NO: 648229 - RNA, 22 nt, Human
aggaagaaucaaacucagucaa

SEQ ID NO: 648230 - RNA, 23 nt, Human
aggaguucgagaccagucuggcc

SEQ ID NO: 648231 - RNA, 21 nt, Human
aggcgggcagaucacuugagg

SEQ ID NO: 648232 - RNA, 23 nt, Human
aggcgggcagaucacuugagguc

SEQ ID NO: 648233 - RNA, 26 nt, Human
aggcgggcagaucacuugaggucagg

SEQ ID NO: 648234 - RNA, 20 nt, Human
aggggaccgggagugggcca

SEQ ID NO: 648235 - RNA, 20 nt, Human
aguaagcacguggagccugg

SEQ ID NO: 648236 - RNA, 20 nt, Human
aguaggugaccaauaugugc

SEQ ID NO: 648237 - RNA, 22 nt, Human
agucuggccaacauggugaaac

SEQ ID NO: 648238 - RNA, 24 nt, Human
agucuggccaacauggugaaaccc

SEQ ID NO: 648239 - RNA, 24 nt, Human
aguggcucaugccuguaacccuag

SEQ ID NO: 648240 - RNA, 21 nt, Human
aucacuugaggucaggaguuc

SEQ ID NO: 648241 - RNA, 25 nt, Human
aucuuauuuaucucaauauucccaa

SEQ ID NO: 648242 - RNA, 23 nt, Human
aucuuguucaucucugugcccca

SEQ ID NO: 648243 - RNA, 19 nt, Human
augccuguaacccuagcac

SEQ ID NO: 648244 - RNA, 23 nt, Human
auggcacgcaccuauagucccag

SEQ ID NO: 648245 - RNA, 18 nt, Human
auucccaucccauagcuc

SEQ ID NO: 648246 - RNA, 24 nt, Human
caacauggugaaaccccgucucua

SEQ ID NO: 648247 - RNA, 24 nt, Human
caaggcgggcagaucacuugaggu

SEQ ID NO: 648248 - RNA, 26 nt, Human
caaggcgggcagaucacuugagguca

SEQ ID NO: 648249 - RNA, 19 nt, Human
cacacaguaggugaccaau

SEQ ID NO: 648250 - RNA, 21 nt, Human
cacaccacugcacuccagccu

SEQ ID NO: 648251 - RNA, 26 nt, Human
cacagcaggugcucaguaaguguacc

SEQ ID NO: 648252 - RNA, 20 nt, Human
cacaggugcucaauaaacac

SEQ ID NO: 648253 - RNA, 20 nt, Human
caccaccccacacgagagcc

SEQ ID NO: 648254 - RNA, 26 nt, Human
caccacugcacuccagccugggugac

SEQ ID NO: 648255 - RNA, 24 nt, Human
cacccagcccccgucuccaacugg

SEQ ID NO: 648256 - RNA, 21 nt, Human
caccuauagucccagcuacuu

SEQ ID NO: 648257 - RNA, 23 nt, Human
caccuauagucccagcuacuugg

SEQ ID NO: 648258 - RNA, 24 nt, Human
caccuauagucccagcuacuuggg

SEQ ID NO: 648259 - RNA, 18 nt, Human
cacuccagccugggugac

SEQ ID NO: 648260 - RNA, 22 nt, Human
cacuccagccugggugacagag

SEQ ID NO: 648261 - RNA, 19 nt, Human
cacugcacuccagccuggg

SEQ ID NO: 648262 - RNA, 19 nt, Human
cacugcacuccagccuggg

SEQ ID NO: 648263 - RNA, 21 nt, Human
cacugcacuccagccugggug

SEQ ID NO: 648264 - RNA, 22 nt, Human
cacugcacuccagccuggguga

SEQ ID NO: 648265 - RNA, 24 nt, Human
cacugcacuccagccugggugaca

SEQ ID NO: 648266 - RNA, 25 nt, Human
cacugcacuccagccugggugacag

SEQ ID NO: 648267 - RNA, 23 nt, Human
cacuugaggucaggaguucgaga

SEQ ID NO: 648268 - RNA, 27 nt, Human
cagaucacuugaggucaggaguucgag

SEQ ID NO: 648269 - RNA, 22 nt, Human
cagcuacuugggaggccgagaa

SEQ ID NO: 648270 - RNA, 18 nt, Human
caggaccugugcuugccc

SEQ ID NO: 648271 - RNA, 23 nt, Human
cagggaccacaccugagacacaa

SEQ ID NO: 648272 - RNA, 23 nt, Human
caggggaccgggagugggccagg

SEQ ID NO: 648273 - RNA, 21 nt, Human
caggggggcuaacauguggcg

SEQ ID NO: 648274 - RNA, 19 nt, Human
caggugcucaauaaacacu

SEQ ID NO: 648275 - RNA, 21 nt, Human
caggugcuuaauaaaugcugg

SEQ ID NO: 648276 - RNA, 19 nt, Human
cagugcagcuggguccccu

SEQ ID NO: 648277 - RNA, 20 nt, Human
caugccuguaacccuagcac

SEQ ID NO: 648278 - RNA, 24 nt, Human
caugccuguaacccuagcacuuug

SEQ ID NO: 648279 - RNA, 23 nt, Human
ccacaccugagacacaagggcca

SEQ ID NO: 648280 - RNA, 20 nt, Human
ccacugcacuccagccuggg

SEQ ID NO: 648281 - RNA, 20 nt, Human
ccacugcacuccagccuggg

SEQ ID NO: 648282 - RNA, 20 nt, Human
ccacugcacuccagccuggg

SEQ ID NO: 648283 - RNA, 21 nt, Human
ccacugcacuccagccugggu

SEQ ID NO: 648284 - RNA, 21 nt, Human
ccacugcacuccagccugggu

SEQ ID NO: 648285 - RNA, 23 nt, Human
ccacugcacuccagccuggguga

SEQ ID NO: 648286 - RNA, 24 nt, Human
ccacugcacuccagccugggugac

SEQ ID NO: 648287 - RNA, 28 nt, Human
cccaacacacaguaggcacucaauaaau

SEQ ID NO: 648288 - RNA, 21 nt, Human
cccaugaucgaaaaugcagac

SEQ ID NO: 648289 - RNA, 27 nt, Human
cccaugaucgaaaaugcagacugaaca

SEQ ID NO: 648290 - RNA, 20 nt, Human
cccccaaacacaugauccca

SEQ ID NO: 648291 - RNA, 18 nt, Human
cccuaaaagcccccaaac

SEQ ID NO: 648292 - RNA, 24 nt, Human
ccgauggcugcuuuggcuuucugg

SEQ ID NO: 648293 - RNA, 19 nt, Human
ccuaaaagcccccaaacac

SEQ ID NO: 648294 - RNA, 21 nt, Human
ccuauagucccagcuacuugg

SEQ ID NO: 648295 - RNA, 19 nt, Human
ccucccucuuggguggugg

SEQ ID NO: 648296 - RNA, 22 nt, Human
ccugggugacagagacagacuc

SEQ ID NO: 648297 - RNA, 22 nt, Human
ccuguaacccuagcacuuuggg

SEQ ID NO: 648298 - RNA, 24 nt, Human
cgagaccagucuggccaacauggu

SEQ ID NO: 648299 - RNA, 24 nt, Human
cgcugggaggcgcaggcugcagug

SEQ ID NO: 648300 - RNA, 18 nt, Human
cgggcagaucacuugagg

SEQ ID NO: 648301 - RNA, 24 nt, Human
cgggcagaucacuugaggucagga

SEQ ID NO: 648302 - RNA, 26 nt, Human
cuaaaagcccccaaacacaugauccc

SEQ ID NO: 648303 - RNA, 23 nt, Human
cuagcacuuuggguggccaaggc

SEQ ID NO: 648304 - RNA, 21 nt, Human
cuauagucccagcuacuuggg

SEQ ID NO: 648305 - RNA, 21 nt, Human
cucaguaaguguaccgaauca

SEQ ID NO: 648306 - RNA, 24 nt, Human
cucaugccuguaacccuagcacuu

SEQ ID NO: 648307 - RNA, 22 nt, Human
cuggccaacauggugaaacccc

SEQ ID NO: 648308 - RNA, 18 nt, Human
cuuaaaaaaaaaaaaaaa

SEQ ID NO: 648309 - RNA, 26 nt, Human
cuuaaaaaaaaaaaaaaaaaaaaaau

SEQ ID NO: 648310 - RNA, 22 nt, Human
cuugcugggaaauguccuaccc

SEQ ID NO: 648311 - RNA, 18 nt, Human
gaacaacugucacacucu

SEQ ID NO: 648312 - RNA, 23 nt, Human
gacgaccgaggguacaggaagaa

SEQ ID NO: 648313 - RNA, 23 nt, Human
gagagcccucuguggccugccaa

SEQ ID NO: 648314 - RNA, 24 nt, Human
gaucacuugaggucaggaguucga

SEQ ID NO: 648315 - RNA, 21 nt, Human
gcaggugcucaguaaguguac

SEQ ID NO: 648316 - RNA, 24 nt, Human
gccaacauggugaaaccccgucuc

SEQ ID NO: 648317 - RNA, 22 nt, Human
gccccugguggcggaagagcua

SEQ ID NO: 648318 - RNA, 20 nt, Human
gcucaauaaacacuuguggc

SEQ ID NO: 648319 - RNA, 18 nt, Human
gcucagcucccugcacac

SEQ ID NO: 648320 - RNA, 19 nt, Human
gcugggcacaguggcucau

SEQ ID NO: 648321 - RNA, 21 nt, Human
ggaaauguccuacccaggcca

SEQ ID NO: 648322 - RNA, 23 nt, Human
ggcacaguggcucaugccuguaa

SEQ ID NO: 648323 - RNA, 25 nt, Human
ggcacaguggcucaugccuguaacc

SEQ ID NO: 648324 - RNA, 21 nt, Human
ggcacgcaccuauagucccag

SEQ ID NO: 648325 - RNA, 25 nt, Human
ggcagaucacuugaggucaggaguu

SEQ ID NO: 648326 - RNA, 18 nt, Human
ggcagugccccagugcag

SEQ ID NO: 648327 - RNA, 23 nt, Human
ggcugggcacaguggcucaugcc

SEQ ID NO: 648328 - RNA, 18 nt, Human
gggcacaguggcucaugc

SEQ ID NO: 648329 - RNA, 23 nt, Human
ggguccagagguggcccugaugu

SEQ ID NO: 648330 - RNA, 24 nt, Human
gucacaccacugcacuccagccug

SEQ ID NO: 648331 - RNA, 19 nt, Human
gucugcacacagcucagac

SEQ ID NO: 648332 - RNA, 24 nt, Human
gugcagcuggguccccuaaaagcc

SEQ ID NO: 648333 - RNA, 21 nt, Human
gugugggaaagaagccaauga

SEQ ID NO: 648334 - RNA, 21 nt, Human
uaaaaauacaaaaacuagcca

SEQ ID NO: 648335 - RNA, 23 nt, Human
uaccuuguuuacucccauuccca

SEQ ID NO: 648336 - RNA, 24 nt, Human
uagaagcaucuuauuuaucucaau

SEQ ID NO: 648337 - RNA, 20 nt, Human
uagcaagagcuggcuggaca

SEQ ID NO: 648338 - RNA, 24 nt, Human
uagcacuuuggguggccaaggcgg

SEQ ID NO: 648339 - RNA, 19 nt, Human
uagcagugaggaaaaaaag

SEQ ID NO: 648340 - RNA, 21 nt, Human
uagcagugaggaaaaaaagaa

SEQ ID NO: 648341 - RNA, 24 nt, Human
uaucacuagugccugauucuuaau

SEQ ID NO: 648342 - RNA, 23 nt, Human
ucacaccacugcacuccagccug

SEQ ID NO: 648343 - RNA, 20 nt, Human
ucacuugaggucaggaguuc

SEQ ID NO: 648344 - RNA, 21 nt, Human
ucaucucugugccccagcacu

SEQ ID NO: 648345 - RNA, 20 nt, Human
uccagccugggugacagaga

SEQ ID NO: 648346 - RNA, 19 nt, Human
ucccagagccuggaauggc

SEQ ID NO: 648347 - RNA, 22 nt, Human
ucccagagccuggaauggcacc

SEQ ID NO: 648348 - RNA, 21 nt, Human
ucccagagccugggcugggca

SEQ ID NO: 648349 - RNA, 24 nt, Human
uccccaagagggugaagcaccgcu

SEQ ID NO: 648350 - RNA, 19 nt, Human
uccccuaaaagcccccaaa

SEQ ID NO: 648351 - RNA, 24 nt, Human
uccccuaaaagcccccaaacacau

SEQ ID NO: 648352 - RNA, 22 nt, Human
ucccucuuggguggugggggga

SEQ ID NO: 648353 - RNA, 22 nt, Human
ucccugcacacagcaggugcuc

SEQ ID NO: 648354 - RNA, 19 nt, Human
ucgaaaaugcagacugaac

SEQ ID NO: 648355 - RNA, 24 nt, Human
ucuacucuuaaaaaaaaaaaaaaa

SEQ ID NO: 648356 - RNA, 22 nt, Human
ucuccaacuggcgcccccucca

SEQ ID NO: 648357 - RNA, 21 nt, Human
ucucuacuaaaaauacaaaaa

SEQ ID NO: 648358 - RNA, 24 nt, Human
ucuggccaacauggugaaaccccg

SEQ ID NO: 648359 - RNA, 19 nt, Human
ugaagaagugaaggaaccg

SEQ ID NO: 648360 - RNA, 18 nt, Human
ugaagagggcuugguucc

SEQ ID NO: 648361 - RNA, 25 nt, Human
ugagaaguucccacaccgucuagca

SEQ ID NO: 648362 - RNA, 18 nt, Human
ugagugccaggcacacag

SEQ ID NO: 648363 - RNA, 21 nt, Human
ugaucaguaacugcuugauga

SEQ ID NO: 648364 - RNA, 19 nt, Human
ugccaagggguccagaggu

SEQ ID NO: 648365 - RNA, 26 nt, Human
uggacaccaccccacacgagagcccu

SEQ ID NO: 648366 - RNA, 20 nt, Human
uggagggaacaauuaugccu

SEQ ID NO: 648367 - RNA, 24 nt, Human
uggccaacauggugaaaccccguc

SEQ ID NO: 648368 - RNA, 19 nt, Human
uggcucaugccuguaaccc

SEQ ID NO: 648369 - RNA, 19 nt, Human
uggcucaugccuguaaccc

SEQ ID NO: 648370 - RNA, 23 nt, Human
uggcucaugccuguaacccuagc

SEQ ID NO: 648371 - RNA, 24 nt, Human
uggcucaugccuguaacccuagca

SEQ ID NO: 648372 - RNA, 19 nt, Human
ugggaaauguccuacccag

SEQ ID NO: 648373 - RNA, 23 nt, Human
ugggaaauguccuacccaggcca

SEQ ID NO: 648374 - RNA, 26 nt, Human
ugggaggccgagaaacaagaauugcu

SEQ ID NO: 648375 - RNA, 18 nt, Human
uggguccccuaaaagccc

SEQ ID NO: 648376 - RNA, 24 nt, Human
uggguggccaaggcgggcagauca

SEQ ID NO: 648377 - RNA, 18 nt, Human
ugggugguggggggaugu

SEQ ID NO: 648378 - RNA, 27 nt, Human
ugggugguggggggauguugucugcaa

SEQ ID NO: 648379 - RNA, 20 nt, Human
uguggccugccaaggggucc

SEQ ID NO: 648380 - RNA, 19 nt, Human
ugugugcacgugauugcuu

SEQ ID NO: 648381 - RNA, 21 nt, Human
ugugugcacgugauugcuuag

SEQ ID NO: 648382 - RNA, 20 nt, Human
uuaaaaaaaaaaaaaaaaaa

SEQ ID NO: 648383 - RNA, 20 nt, Human
uuaaaaaaaaaaaaaaaaaa

SEQ ID NO: 648384 - RNA, 21 nt, Human
uucccagagccugggcugggc

SEQ ID NO: 648385 - RNA, 23 nt, Human
uugggaggccgagaaacaagaau

SEQ ID NO: 648386 - RNA, 18 nt, Human
uuuuuuuuuuuuuuuuug

SEQ ID NO: 648387 - RNA, 19 nt, Human
aaacugacaccucaguuga

SEQ ID NO: 648388 - RNA, 22 nt, Human
aagauuuuucuaauucuugcca

SEQ ID NO: 648389 - RNA, 23 nt, Human
acugucacauggacaaaaugaaa

SEQ ID NO: 648390 - RNA, 19 nt, Human
acuugggucuucucccucu

SEQ ID NO: 648391 - RNA, 25 nt, Human
agaaacugacaccucaguugaauaa

SEQ ID NO: 648392 - RNA, 20 nt, Human
agaacugacagcauuuucag

SEQ ID NO: 648393 - RNA, 22 nt, Human
agcaauauuugugguuuugcuc

SEQ ID NO: 648394 - RNA, 19 nt, Human
auaaaacagguacaucccc

SEQ ID NO: 648395 - RNA, 32 nt, Human
auacuugggucuucucccucuuuuauaaaaag

SEQ ID NO: 648396 - RNA, 18 nt, Human
caauggcauugcugugca

SEQ ID NO: 648397 - RNA, 26 nt, Human
cauucucacugcuauuacucaaagau

SEQ ID NO: 648398 - RNA, 19 nt, Human
ccuuuucacaauggcuucg

SEQ ID NO: 648399 - RNA, 21 nt, Human
cuucaugacugucacauggac

SEQ ID NO: 648400 - RNA, 18 nt, Human
cuuucagggacugacuga

SEQ ID NO: 648401 - RNA, 18 nt, Human
gaaaacuggcugcugugu

SEQ ID NO: 648402 - RNA, 20 nt, Human
gcauuuucaguggaagaaac

SEQ ID NO: 648403 - RNA, 19 nt, Human
gcucugugguugcugcugg

SEQ ID NO: 648404 - RNA, 24 nt, Human
gcugcuguguacaaugaccgaggg

SEQ ID NO: 648405 - RNA, 20 nt, Human
guuuugcucagugauccucc

SEQ ID NO: 648406 - RNA, 21 nt, Human
uaacuaaaaaaaaccaccaac

SEQ ID NO: 648407 - RNA, 19 nt, Human
uacuauuuguggagguucc

SEQ ID NO: 648408 - RNA, 23 nt, Human
ucacaauggcuucguuuccaauu

SEQ ID NO: 648409 - RNA, 25 nt, Human
uccuucaugacugucacauggacaa

SEQ ID NO: 648410 - RNA, 20 nt, Human
ugcucagugauccuccaggg

SEQ ID NO: 648411 - RNA, 19 nt, Human
ugcuguguacaaugaccga

SEQ ID NO: 648412 - RNA, 21 nt, Human
ugguugcugcuggucauggca

SEQ ID NO: 648413 - RNA, 23 nt, Human
ugugauguaguuuucuuugguug

SEQ ID NO: 648414 - RNA, 22 nt, Human
uucaguggaagaaacugacacc

SEQ ID NO: 648415 - RNA, 24 nt, Human
uuugacuccuccgguauuucuccc

SEQ ID NO: 648416 - RNA, 20 nt, Human
uuuuuuuuuuuuucacuccu

SEQ ID NO: 648417 - RNA, 25 nt, Human
uuuuuuuuuuuuucacuccuucaug

SEQ ID NO: 648418 - RNA, 26 nt, Human
uuuuuuuuuuuuuuuuuucacuccuu

SEQ ID NO: 648419 - RNA, 23 nt, Human
aagaaaaggacccugccccagga

SEQ ID NO: 648420 - RNA, 20 nt, Human
acagagagcgcucugcagag

SEQ ID NO: 648421 - RNA, 20 nt, Human
accugggaagaaaaggaccc

SEQ ID NO: 648422 - RNA, 23 nt, Human
acgcggagucagccucgccuggc

SEQ ID NO: 648423 - RNA, 21 nt, Human
agaccgugauauaaacuggua

SEQ ID NO: 648424 - RNA, 19 nt, Human
agacucagagaggcaggug

SEQ ID NO: 648425 - RNA, 23 nt, Human
agaggaaggggcauggugggcac

SEQ ID NO: 648426 - RNA, 20 nt, Human
agcagaggcagcgcugagga

SEQ ID NO: 648427 - RNA, 19 nt, Human
agcaggcccugggguggcu

SEQ ID NO: 648428 - RNA, 21 nt, Human
agcaggcccugggguggcucc

SEQ ID NO: 648429 - RNA, 22 nt, Human
agcgcugaggaccugggaagaa

SEQ ID NO: 648430 - RNA, 21 nt, Human
agcuugggucaggaucucaca

SEQ ID NO: 648431 - RNA, 19 nt, Human
agguccagagcccgggccc

SEQ ID NO: 648432 - RNA, 24 nt, Human
cacguccccagcaagggcacgcuc

SEQ ID NO: 648433 - RNA, 22 nt, Human
cagaaaaaccccgccuuaacca

SEQ ID NO: 648434 - RNA, 27 nt, Human
cagagguaggaggagaaagaggaaggg

SEQ ID NO: 648435 - RNA, 19 nt, Human
cagccacguccccagcaag

SEQ ID NO: 648436 - RNA, 19 nt, Human
cagggcagagguaggagga

SEQ ID NO: 648437 - RNA, 18 nt, Human
cauggccaaagccuuucc

SEQ ID NO: 648438 - RNA, 23 nt, Human
cauggccaaagccuuuccuacaa

SEQ ID NO: 648439 - RNA, 22 nt, Human
ccaaccaucucacgcggaguca

SEQ ID NO: 648440 - RNA, 19 nt, Human
ccagcagaggcagcgcuga

SEQ ID NO: 648441 - RNA, 18 nt, Human
ccagguccagagcccggg

SEQ ID NO: 648442 - RNA, 23 nt, Human
ccauggccaaagccuuuccuaca

SEQ ID NO: 648443 - RNA, 19 nt, Human
cccugggggcaacugaggg

SEQ ID NO: 648444 - RNA, 21 nt, Human
ccucacgccccagaaaaaccc

SEQ ID NO: 648445 - RNA, 19 nt, Human
ccugggagcaggcccuggg

SEQ ID NO: 648446 - RNA, 22 nt, Human
cgcccggugucguucuaccuga

SEQ ID NO: 648447 - RNA, 23 nt, Human
cgccucgagcacucccugggagc

SEQ ID NO: 648448 - RNA, 21 nt, Human
gaaaaggacccugccccagga

SEQ ID NO: 648449 - RNA, 19 nt, Human
gaaggcaccagcagaggca

SEQ ID NO: 648450 - RNA, 18 nt, Human
gcagagggcagcccucgc

SEQ ID NO: 648451 - RNA, 23 nt, Human
gcagagggcagcccucgcaggca

SEQ ID NO: 648452 - RNA, 23 nt, Human
ggaacugagacccaagacucaga

SEQ ID NO: 648453 - RNA, 18 nt, Human
ggaggagaaagaggaagg

SEQ ID NO: 648454 - RNA, 20 nt, Human
ggcagcccucgcaggcagac

SEQ ID NO: 648455 - RNA, 21 nt, Human
ggcagccguguggcccagcgg

SEQ ID NO: 648456 - RNA, 19 nt, Human
gggaagaaaaggacccugc

SEQ ID NO: 648457 - RNA, 21 nt, Human
gggcacagccacguccccagc

SEQ ID NO: 648458 - RNA, 19 nt, Human
gggcacccagcccuggggg

SEQ ID NO: 648459 - RNA, 20 nt, Human
gggugugccugagcuugggu

SEQ ID NO: 648460 - RNA, 20 nt, Human
gguaggaggagaaagaggaa

SEQ ID NO: 648461 - RNA, 19 nt, Human
uaauccaugagacaucguc

SEQ ID NO: 648462 - RNA, 20 nt, Human
uacaaugucccaucugagag

SEQ ID NO: 648463 - RNA, 19 nt, Human
uaggaacugagacccaaga

SEQ ID NO: 648464 - RNA, 20 nt, Human
ucccugggagcaggcccugg

SEQ ID NO: 648465 - RNA, 24 nt, Human
ucccugggagcaggcccuggggug

SEQ ID NO: 648466 - RNA, 26 nt, Human
ucccugggagcaggcccugggguggc

SEQ ID NO: 648467 - RNA, 23 nt, Human
ucucacaggccucacgccccaga

SEQ ID NO: 648468 - RNA, 27 nt, Human
ucucacgcggagucagccucgccuggc

SEQ ID NO: 648469 - RNA, 18 nt, Human
ucuugggucucuggcucu

SEQ ID NO: 648470 - RNA, 21 nt, Human
ugagacccaagacucagagag

SEQ ID NO: 648471 - RNA, 27 nt, Human
uggcucucuggcacacagagagcgcuc

SEQ ID NO: 648472 - RNA, 22 nt, Human
ugggaagaaaaggacccugccc

SEQ ID NO: 648473 - RNA, 22 nt, Human
uggugggcacccagcccugggg

SEQ ID NO: 648474 - RNA, 19 nt, Human
ugucccaucugagagccuu

SEQ ID NO: 648475 - RNA, 21 nt, Human
ugucccaucugagagccuuau

SEQ ID NO: 648476 - RNA, 19 nt, Human
uguucucugcccccagacc

SEQ ID NO: 648477 - RNA, 20 nt, Human
uuaauccaugagacaucguc

SEQ ID NO: 648478 - RNA, 21 nt, Human
uuaauccaugagacaucgucc

SEQ ID NO: 648479 - RNA, 25 nt, Human
uuuccuacaaugucccaucugagag

SEQ ID NO: 648480 - RNA, 22 nt, Human
uuuuuuuuuuuuuuuuugccau

SEQ ID NO: 648481 - RNA, 25 nt, Human
uuuuuuuuuuuuuuuuuugccauaa

SEQ ID NO: 648482 - RNA, 20 nt, Human
uuuuuuuuuuuuuuuuuugg

SEQ ID NO: 648483 - RNA, 19 nt, Human
aaagaggcuguucaccucc

SEQ ID NO: 648484 - RNA, 18 nt, Human
aaaugcugcugaggcuga

SEQ ID NO: 648485 - RNA, 22 nt, Human
aagcagaaagaaaggggacccc

SEQ ID NO: 648486 - RNA, 22 nt, Human
aauaaaaagcagaaagaaagga

SEQ ID NO: 648487 - RNA, 23 nt, Human
agaaagaaaggaaaugcugcuga

SEQ ID NO: 648488 - RNA, 19 nt, Human
augauaaaaaggcaaaaua

SEQ ID NO: 648489 - RNA, 25 nt, Human
caaaagaggcuguucaccuccaagu

SEQ ID NO: 648490 - RNA, 26 nt, Human
caaaauaaauaaaaagcagaaagaaa

SEQ ID NO: 648491 - RNA, 21 nt, Human
caacagcccugcacggagcac

SEQ ID NO: 648492 - RNA, 18 nt, Human
cacagcaguagcaaaacc

SEQ ID NO: 648493 - RNA, 20 nt, Human
cacagcaguagcaaaaccuu

SEQ ID NO: 648494 - RNA, 23 nt, Human
ccaaacagaugcuggucuccuca

SEQ ID NO: 648495 - RNA, 20 nt, Human
ccacagcuaacaagguuuug

SEQ ID NO: 648496 - RNA, 24 nt, Human
cccugcacggagcacuugcugcuc

SEQ ID NO: 648497 - RNA, 21 nt, Human
ccuccaagugauagcaacagc

SEQ ID NO: 648498 - RNA, 18 nt, Human
cugcugaggcugagggcu

SEQ ID NO: 648499 - RNA, 18 nt, Human
ggagcacuugcugcucug

SEQ ID NO: 648500 - RNA, 19 nt, Human
ggagcacuugcugcucugc

SEQ ID NO: 648501 - RNA, 21 nt, Human
uaaaaagcagaaagaaaggaa

SEQ ID NO: 648502 - RNA, 26 nt, Human
uaaaaaggcaaaauaaauaaaaagca

SEQ ID NO: 648503 - RNA, 21 nt, Human
uaauccacuaguaauuagaua

SEQ ID NO: 648504 - RNA, 19 nt, Human
uagauuuaaucagagcaca

SEQ ID NO: 648505 - RNA, 23 nt, Human
uagcaacagcccugcacggagca

SEQ ID NO: 648506 - RNA, 23 nt, Human
ucacugaauaccggcaaaagagg

SEQ ID NO: 648507 - RNA, 22 nt, Human
ucaguguguuauauuauuaucc

SEQ ID NO: 648508 - RNA, 18 nt, Human
ucugcacagcagcgacuu

SEQ ID NO: 648509 - RNA, 24 nt, Human
ucuuccaguguuaucauucuuaua

SEQ ID NO: 648510 - RNA, 23 nt, Human
ucuuucacuccagugagagaacu

SEQ ID NO: 648511 - RNA, 19 nt, Human
ucuuuuaucuucccaaaca

SEQ ID NO: 648512 - RNA, 20 nt, Human
ugauaaaaaggcaaaauaaa

SEQ ID NO: 648513 - RNA, 24 nt, Human
ugauagcaacagcccugcacggag

SEQ ID NO: 648514 - RNA, 19 nt, Human
ugcacggagcacuugcugc

SEQ ID NO: 648515 - RNA, 19 nt, Human
ugcugcucugcacagcagc

SEQ ID NO: 648516 - RNA, 18 nt, Human
ugcuggucuccucauugc

SEQ ID NO: 648517 - RNA, 25 nt, Human
aaaaacacaagcaccucugccacca

SEQ ID NO: 648518 - RNA, 22 nt, Human
agcagcuuuauugcccuucagg

SEQ ID NO: 648519 - RNA, 26 nt, Human
caaaaacacaagcaccucugccacca

SEQ ID NO: 648520 - RNA, 26 nt, Human
caaaaacacaagcaccucugccagca

SEQ ID NO: 648521 - RNA, 19 nt, Human
cacaagcaccucugccacc

SEQ ID NO: 648522 - RNA, 19 nt, Human
ccucugccaccaccggaac

SEQ ID NO: 648523 - RNA, 22 nt, Human
uagcagcuuuauugcccuucag

SEQ ID NO: 648524 - RNA, 21 nt, Human
uauugcccuucaggggccaug

SEQ ID NO: 648525 - RNA, 20 nt, Human
ucuccuguaccgacaaaaac

SEQ ID NO: 648526 - RNA, 23 nt, Human
uguaccgacaaaaacacaagcac

SEQ ID NO: 648527 - RNA, 24 nt, Human
uguauuaauaaacuagcagcuuua

SEQ ID NO: 648528 - RNA, 20 nt, Human
uuuuuuuuuuuuuuuuuugg

SEQ ID NO: 648529 - RNA, 23 nt, Human
uuuuuuuuuuuuuuuuuuguauu

SEQ ID NO: 648530 - RNA, 21 nt, Human
acccagcuccagggggccggg

SEQ ID NO: 648531 - RNA, 26 nt, Human
agcaggguggcacccugacccguggc

SEQ ID NO: 648532 - RNA, 20 nt, Human
aggcagcucugugacacagu

SEQ ID NO: 648533 - RNA, 24 nt, Human
aggcagcucugugacacagugggg

SEQ ID NO: 648534 - RNA, 23 nt, Human
aggccccuucagcaggaggcccc

SEQ ID NO: 648535 - RNA, 19 nt, Human
aggcucgaagguccaacag

SEQ ID NO: 648536 - RNA, 20 nt, Human
aggggcugggaccugugcca

SEQ ID NO: 648537 - RNA, 18 nt, Human
aggguccaggcaggcauc

SEQ ID NO: 648538 - RNA, 21 nt, Human
caaccacaccuccaccucuuc

SEQ ID NO: 648539 - RNA, 26 nt, Human
cacaaccacaccuccaccucuucuuc

SEQ ID NO: 648540 - RNA, 19 nt, Human
caccacaaccacaccucca

SEQ ID NO: 648541 - RNA, 27 nt, Human
cagacccagcuccagggggccgggcaa

SEQ ID NO: 648542 - RNA, 18 nt, Human
cagccaccaacagggucc

SEQ ID NO: 648543 - RNA, 21 nt, Human
cagcuccagggggccgggcaa

SEQ ID NO: 648544 - RNA, 26 nt, Human
caggaagggcagguggccgaguccug

SEQ ID NO: 648545 - RNA, 18 nt, Human
caggaggccccugagaga

SEQ ID NO: 648546 - RNA, 24 nt, Human
caggcaggcauccuccugccuccc

SEQ ID NO: 648547 - RNA, 26 nt, Human
caggcaggcauccuccugccuccccc

SEQ ID NO: 648548 - RNA, 23 nt, Human
ccaccucuucuuccucccgaccu

SEQ ID NO: 648549 - RNA, 21 nt, Human
ccagaggucuucagccaccaa

SEQ ID NO: 648550 - RNA, 22 nt, Human
cccagcagucugcacaggguca

SEQ ID NO: 648551 - RNA, 21 nt, Human
ccccugagagaaaauccagcc

SEQ ID NO: 648552 - RNA, 21 nt, Human
ccccugagcccugagcugcuc

SEQ ID NO: 648553 - RNA, 25 nt, Human
ccccugagcccugagcugcuccagg

SEQ ID NO: 648554 - RNA, 20 nt, Human
cccugagcccugagcugcuc

SEQ ID NO: 648555 - RNA, 22 nt, Human
ccgggcaaauguggccuccccu

SEQ ID NO: 648556 - RNA, 21 nt, Human
ccuccuuguggcccccugagc

SEQ ID NO: 648557 - RNA, 24 nt, Human
ccuccuuguggcccccugagcccu

SEQ ID NO: 648558 - RNA, 23 nt, Human
ccugagcccugagcugcuccagg

SEQ ID NO: 648559 - RNA, 19 nt, Human
ccuucagcuggggcucaga

SEQ ID NO: 648560 - RNA, 20 nt, Human
ccuuguggcccccugagccc

SEQ ID NO: 648561 - RNA, 20 nt, Human
cuccugccucccccagcagu

SEQ ID NO: 648562 - RNA, 23 nt, Human
cucgaagguccaacaggcuaaca

SEQ ID NO: 648563 - RNA, 18 nt, Human
gaagccagcuggccagag

SEQ ID NO: 648564 - RNA, 21 nt, Human
gacccagcuccagggggccgg

SEQ ID NO: 648565 - RNA, 24 nt, Human
gaccugccuccuuguggcccccug

SEQ ID NO: 648566 - RNA, 19 nt, Human
gcacccugacccguggcuc

SEQ ID NO: 648567 - RNA, 21 nt, Human
gcugcuuccccaccaagggcc

SEQ ID NO: 648568 - RNA, 21 nt, Human
gggcaaauguggccuccccuu

SEQ ID NO: 648569 - RNA, 18 nt, Human
gggcuagcuggugcucuc

SEQ ID NO: 648570 - RNA, 21 nt, Human
ggucuucagccaccaacaggg

SEQ ID NO: 648571 - RNA, 21 nt, Human
gugcaggaagggcagguggcc

SEQ ID NO: 648572 - RNA, 19 nt, Human
uaaaauccucugaaggccc

SEQ ID NO: 648573 - RNA, 22 nt, Human
uaaaauccucugaaggccccuu

SEQ ID NO: 648574 - RNA, 19 nt, Human
ucaaaaccuaguucugcug

SEQ ID NO: 648575 - RNA, 20 nt, Human
uccaacaggcuaacagcaaa

SEQ ID NO: 648576 - RNA, 23 nt, Human
uccaacaggcuaacagcaaagca

SEQ ID NO: 648577 - RNA, 23 nt, Human
uccaccacaaccacaccuccacc

SEQ ID NO: 648578 - RNA, 20 nt, Human
uccccaccaagggcggaagc

SEQ ID NO: 648579 - RNA, 22 nt, Human
ucccccagcagucugcacaggg

SEQ ID NO: 648580 - RNA, 18 nt, Human
ucuugagcuggccagucg

SEQ ID NO: 648581 - RNA, 20 nt, Human
ugagagaaaauccagccauc

SEQ ID NO: 648582 - RNA, 25 nt, Human
ugagagaaaauccagccaucugagg

SEQ ID NO: 648583 - RNA, 18 nt, Human
ugccaggcagcucuguga

SEQ ID NO: 648584 - RNA, 18 nt, Human
ugccaggcagcucuguga

SEQ ID NO: 648585 - RNA, 24 nt, Human
ugcucuccaccacaaccacaccuc

SEQ ID NO: 648586 - RNA, 19 nt, Human
ugcuuccccaccaagggcg

SEQ ID NO: 648587 - RNA, 19 nt, Human
uggaaggggcuagcuggug

SEQ ID NO: 648588 - RNA, 19 nt, Human
uguggccuccccuucugga

SEQ ID NO: 648589 - RNA, 21 nt, Human
uguggccuccccuucuggaag

SEQ ID NO: 648590 - RNA, 24 nt, Human
uuuuuuuuuuucaaagggucugcu

SEQ ID NO: 648591 - RNA, 20 nt, Human
uuuuuuuuuuuucaaaggga

SEQ ID NO: 648592 - RNA, 23 nt, Human
uuuuuuuuuuuuuuuucaaaggg

SEQ ID NO: 648593 - RNA, 18 nt, Human
acacaacugacugcaagg

SEQ ID NO: 648594 - RNA, 21 nt, Human
acccucaacaccccccuccau

SEQ ID NO: 648595 - RNA, 25 nt, Human
accgcaaagucccaaagggcuacag

SEQ ID NO: 648596 - RNA, 19 nt, Human
agacagaggcccccaggag

SEQ ID NO: 648597 - RNA, 18 nt, Human
agcagacagaggccccca

SEQ ID NO: 648598 - RNA, 26 nt, Human
aggcacuccugccccuuaggauucug

SEQ ID NO: 648599 - RNA, 22 nt, Human
aggcauuuauuucuggagcaac

SEQ ID NO: 648600 - RNA, 26 nt, Human
cacaacugacugcaaggcucccacag

SEQ ID NO: 648601 - RNA, 20 nt, Human
caccccccuccauuugucaa

SEQ ID NO: 648602 - RNA, 18 nt, Human
cagacagaggcccccagg

SEQ ID NO: 648603 - RNA, 19 nt, Human
caugcccaggcacuccugc

SEQ ID NO: 648604 - RNA, 23 nt, Human
ccaaacacaacugacugcaaggc

SEQ ID NO: 648605 - RNA, 19 nt, Human
cccccaggagacaggccca

SEQ ID NO: 648606 - RNA, 19 nt, Human
cccccaggagacaggccca

SEQ ID NO: 648607 - RNA, 22 nt, Human
ccugcaugccacaggaaucagc

SEQ ID NO: 648608 - RNA, 25 nt, Human
cgacagauugcagguuguggggagg

SEQ ID NO: 648609 - RNA, 21 nt, Human
ucccacagacacaugcccagg

SEQ ID NO: 648610 - RNA, 19 nt, Human
ugaaggcgccggcccagag

SEQ ID NO: 648611 - RNA, 23 nt, Human
ugacugcaaggcucccacagaca

SEQ ID NO: 648612 - RNA, 19 nt, Human
ugccacaggaaucagcagc

SEQ ID NO: 648613 - RNA, 19 nt, Human
uguccaaacacaacugacu

SEQ ID NO: 648614 - RNA, 22 nt, Human
uuugucaaccucuacagccugc

SEQ ID NO: 648615 - RNA, 19 nt, Human
uuuuuuuuuuuuuuuuuaa

SEQ ID NO: 648616 - RNA, 24 nt, Human
aacaggccaguccccacauggagc

SEQ ID NO: 648617 - RNA, 20 nt, Human
acaaggcacaagaaagaggu

SEQ ID NO: 648618 - RNA, 19 nt, Human
aggaaacaggccagucccc

SEQ ID NO: 648619 - RNA, 23 nt, Human
aggcucagggaggucgugucugg

SEQ ID NO: 648620 - RNA, 21 nt, Human
agggaggucgugucuggcucu

SEQ ID NO: 648621 - RNA, 21 nt, Human
aguccauuuauuggccacaug

SEQ ID NO: 648622 - RNA, 22 nt, Human
agugaacaaggcacaagaaaga

SEQ ID NO: 648623 - RNA, 22 nt, Human
caagaaacaaguuagaagguua

SEQ ID NO: 648624 - RNA, 22 nt, Human
caggugacuccuguaagccugu

SEQ ID NO: 648625 - RNA, 21 nt, Human
caguacgagggguucaacaga

SEQ ID NO: 648626 - RNA, 19 nt, Human
gcgccggggaggaggggcu

SEQ ID NO: 648627 - RNA, 18 nt, Human
ggaggaggggcugccgcc

SEQ ID NO: 648628 - RNA, 18 nt, Human
ggcgccggggaggagggg

SEQ ID NO: 648629 - RNA, 23 nt, Human
gucaagaaacaaguuagaagguu

SEQ ID NO: 648630 - RNA, 21 nt, Human
gugucuggcucuggccugcug

SEQ ID NO: 648631 - RNA, 27 nt, Human
ucuggccugcuggagcacacggccgcu

SEQ ID NO: 648632 - RNA, 22 nt, Human
ucuguguucaggaaacaggcca

SEQ ID NO: 648633 - RNA, 22 nt, Human
ugagggcgccggggaggagggg

SEQ ID NO: 648634 - RNA, 22 nt, Human
ugggggguccugagggcgccgg

SEQ ID NO: 648635 - RNA, 18 nt, Human
ugugaggcucagggaggu

SEQ ID NO: 648636 - RNA, 24 nt, Human
uuuuuuuuuuuuuuuuuuuucaag

SEQ ID NO: 648637 - RNA, 19 nt, Human
aaacaccccucucugaggg

SEQ ID NO: 648638 - RNA, 20 nt, Human
aaacaccccucucugagggc

SEQ ID NO: 648639 - RNA, 24 nt, Human
aagaaccuuuauuggaaaaauguc

SEQ ID NO: 648640 - RNA, 22 nt, Human
aagaggauggguaccaggccug

SEQ ID NO: 648641 - RNA, 18 nt, Human
acagaaacaccccucucu

SEQ ID NO: 648642 - RNA, 22 nt, Human
acaguggaaagaggauggguac

SEQ ID NO: 648643 - RNA, 18 nt, Human
accccaucccuaucccca

SEQ ID NO: 648644 - RNA, 20 nt, Human
aggcaagauguggggcagcu

SEQ ID NO: 648645 - RNA, 19 nt, Human
agucuguccgggagcaggg

SEQ ID NO: 648646 - RNA, 18 nt, Human
caguuguuagugcaucuc

SEQ ID NO: 648647 - RNA, 19 nt, Human
cauuggaguagugcagugc

SEQ ID NO: 648648 - RNA, 21 nt, Human
ccacggagucuguccgggagc

SEQ ID NO: 648649 - RNA, 18 nt, Human
ccacuccccagguccagg

SEQ ID NO: 648650 - RNA, 18 nt, Human
ccccagggcucgagcggg

SEQ ID NO: 648651 - RNA, 24 nt, Human
ccccagguccaggggcacagacuc

SEQ ID NO: 648652 - RNA, 18 nt, Human
ccccaucccuauccccag

SEQ ID NO: 648653 - RNA, 20 nt, Human
ccccuggaccggggaaugga

SEQ ID NO: 648654 - RNA, 21 nt, Human
ccgucccggagagccagccgc

SEQ ID NO: 648655 - RNA, 21 nt, Human
ccucucugagggccagaggcu

SEQ ID NO: 648656 - RNA, 21 nt, Human
ccuggguccccggugcgggag

SEQ ID NO: 648657 - RNA, 21 nt, Human
cgacgcgggcagcgcggggcc

SEQ ID NO: 648658 - RNA, 18 nt, Human
cgacucgguggcgcugcc

SEQ ID NO: 648659 - RNA, 21 nt, Human
cgcgggcagcgcggggccgag

SEQ ID NO: 648660 - RNA, 20 nt, Human
cgggaggcagugcggcggcc

SEQ ID NO: 648661 - RNA, 22 nt, Human
cuagggucagacaauuccuuuu

SEQ ID NO: 648662 - RNA, 21 nt, Human
cucccccugaccccaucccua

SEQ ID NO: 648663 - RNA, 23 nt, Human
cugccucuagggucagacaauuc

SEQ ID NO: 648664 - RNA, 20 nt, Human
gagcugcgggcggagcgggc

SEQ ID NO: 648665 - RNA, 23 nt, Human
gcccggacgcuggccuggguccc

SEQ ID NO: 648666 - RNA, 21 nt, Human
gccgccgccuucugcagcgcu

SEQ ID NO: 648667 - RNA, 21 nt, Human
gccuggguccccggugcggga

SEQ ID NO: 648668 - RNA, 20 nt, Human
gcgggcgcgggucugcggag

SEQ ID NO: 648669 - RNA, 21 nt, Human
gcugcgggcggagcgggcgcg

SEQ ID NO: 648670 - RNA, 21 nt, Human
gcuggccuggguccccggugc

SEQ ID NO: 648671 - RNA, 19 nt, Human
ggcagaucaccaucuuggg

SEQ ID NO: 648672 - RNA, 21 nt, Human
ggccacggagucuguccggga

SEQ ID NO: 648673 - RNA, 18 nt, Human
gggaugcucagaguccug

SEQ ID NO: 648674 - RNA, 20 nt, Human
gggcguugcccggacgcugg

SEQ ID NO: 648675 - RNA, 19 nt, Human
ggggcacagacucugaaca

SEQ ID NO: 648676 - RNA, 21 nt, Human
gggggcugcucggugcccaga

SEQ ID NO: 648677 - RNA, 23 nt, Human
uagugcagugcagcaucugccuc

SEQ ID NO: 648678 - RNA, 25 nt, Human
uagugcaucucucuucugggugugu

SEQ ID NO: 648679 - RNA, 21 nt, Human
uauccacuccccagguccagg

SEQ ID NO: 648680 - RNA, 25 nt, Human
uccaagaaccuuuauuggaaaaaug

SEQ ID NO: 648681 - RNA, 21 nt, Human
uccaggggcacagacucugaa

SEQ ID NO: 648682 - RNA, 22 nt, Human
uccccaguuguuagugcaucuc

SEQ ID NO: 648683 - RNA, 22 nt, Human
ucccggagagccagccgccgcc

SEQ ID NO: 648684 - RNA, 20 nt, Human
ucugcagcgcuggccccgcu

SEQ ID NO: 648685 - RNA, 19 nt, Human
ucugcggagcccccagggc

SEQ ID NO: 648686 - RNA, 21 nt, Human
ucuugggcucccccugacccc

SEQ ID NO: 648687 - RNA, 26 nt, Human
ugcccggacgcuggccuggguccccg

SEQ ID NO: 648688 - RNA, 18 nt, Human
ugcggagcccccagggcu

SEQ ID NO: 648689 - RNA, 18 nt, Human
uggaagacauuggaguag

SEQ ID NO: 648690 - RNA, 18 nt, Human
uggaaggagauaucccau

SEQ ID NO: 648691 - RNA, 22 nt, Human
uggaaggagauaucccaucuga

SEQ ID NO: 648692 - RNA, 19 nt, Human
ugggagucucgggcagauc

SEQ ID NO: 648693 - RNA, 24 nt, Human
ugggagucucgggcagaucaccau

SEQ ID NO: 648694 - RNA, 25 nt, Human
uggucaggccucggggggcugcucg

SEQ ID NO: 648695 - RNA, 18 nt, Human
ugugggaguggcauuacc

SEQ ID NO: 648696 - RNA, 20 nt, Human
uuuauuggaaaaauguccaa

SEQ ID NO: 648697 - RNA, 22 nt, Human
uuuuuuuuuuuuuuuccaguuu

SEQ ID NO: 648698 - RNA, 23 nt, Human
uuuuuuuuuuuuuuuuuuuccag

SEQ ID NO: 648699 - RNA, 21 nt, Human
aacagcuauuauuuggugaag

SEQ ID NO: 648700 - RNA, 21 nt, Human
ccugcagcagccaaaauacaa

SEQ ID NO: 648701 - RNA, 22 nt, Human
cgccgguccaaaacacagaccc

SEQ ID NO: 648702 - RNA, 20 nt, Human
cgggcccgccuucccugucg

SEQ ID NO: 648703 - RNA, 18 nt, Human
cucgggcccgccuucccu

SEQ ID NO: 648704 - RNA, 22 nt, Human
cucgggcccgccuucccugucg

SEQ ID NO: 648705 - RNA, 22 nt, Human
gccaaaauacaaacagcuauua

SEQ ID NO: 648706 - RNA, 22 nt, Human
ggugaaguuuagcucagacacc

SEQ ID NO: 648707 - RNA, 24 nt, Human
uaaaauggcuccugcagcagccaa

SEQ ID NO: 648708 - RNA, 19 nt, Human
uagcucagacacccugcaa

SEQ ID NO: 648709 - RNA, 20 nt, Human
ucagacacccugcaaggaca

SEQ ID NO: 648710 - RNA, 20 nt, Human
ugcaaggacacccuaaccca

SEQ ID NO: 648711 - RNA, 21 nt, Human
ugcaaggacacccuaacccag

SEQ ID NO: 648712 - RNA, 21 nt, Human
ugcaaggacacccuaacccau

SEQ ID NO: 648713 - RNA, 19 nt, Human
uucaucuauugaaggaagg

SEQ ID NO: 648714 - RNA, 21 nt, Human
uucccugucgcgccauugggc

SEQ ID NO: 648715 - RNA, 20 nt, Human
aaaaacauccaaaacccucg

SEQ ID NO: 648716 - RNA, 19 nt, Human
aaaaagcuaagcaggaccc

SEQ ID NO: 648717 - RNA, 22 nt, Human
aaaagcccagggcagcagggua

SEQ ID NO: 648718 - RNA, 22 nt, Human
aaaauuuucaaagcaucucaca

SEQ ID NO: 648719 - RNA, 18 nt, Human
aaagcccagggcagcagg

SEQ ID NO: 648720 - RNA, 18 nt, Human
aaagcgccuuccaaacca

SEQ ID NO: 648721 - RNA, 21 nt, Human
aacccuggcuguccccgcuga

SEQ ID NO: 648722 - RNA, 21 nt, Human
aagcagggugucuggccaggg

SEQ ID NO: 648723 - RNA, 18 nt, Human
aagcauccaaaacucuga

SEQ ID NO: 648724 - RNA, 22 nt, Human
acaaacagcgucccagccccac

SEQ ID NO: 648725 - RNA, 22 nt, Human
acagaggcugauggagacccca

SEQ ID NO: 648726 - RNA, 21 nt, Human
acagcgucccagccccacccc

SEQ ID NO: 648727 - RNA, 20 nt, Human
acaucaaaacugcauccgga

SEQ ID NO: 648728 - RNA, 19 nt, Human
acccugagacaccccacag

SEQ ID NO: 648729 - RNA, 23 nt, Human
acccugcguccgcacagccgccu

SEQ ID NO: 648730 - RNA, 24 nt, Human
acccugcguccgcacagccgccuu

SEQ ID NO: 648731 - RNA, 18 nt, Human
accugcacggcaggggca

SEQ ID NO: 648732 - RNA, 23 nt, Human
accugcacggcaggggcagcccc

SEQ ID NO: 648733 - RNA, 25 nt, Human
acggggugggggcagagcgugcggu

SEQ ID NO: 648734 - RNA, 20 nt, Human
agaaggaaggggaucuccgc

SEQ ID NO: 648735 - RNA, 18 nt, Human
agacaccccacagaggcu

SEQ ID NO: 648736 - RNA, 19 nt, Human
agcaucucacaggccaaaa

SEQ ID NO: 648737 - RNA, 20 nt, Human
agccagaagugagggagcca

SEQ ID NO: 648738 - RNA, 18 nt, Human
agccauugcccaugaggg

SEQ ID NO: 648739 - RNA, 19 nt, Human
agcccuggcgaugcucagc

SEQ ID NO: 648740 - RNA, 23 nt, Human
agccucagcccggcccccucagc

SEQ ID NO: 648741 - RNA, 24 nt, Human
agcggccccuccaccugcggaagg

SEQ ID NO: 648742 - RNA, 20 nt, Human
agcgucccagccccaccccc

SEQ ID NO: 648743 - RNA, 22 nt, Human
agcguggaacaucuucccaugg

SEQ ID NO: 648744 - RNA, 23 nt, Human
aggcagcguggaacaucuuccca

SEQ ID NO: 648745 - RNA, 21 nt, Human
aggccaaaagcccagggcagc

SEQ ID NO: 648746 - RNA, 21 nt, Human
aggccccaguaccccccacuc

SEQ ID NO: 648747 - RNA, 20 nt, Human
aggccucgcagccacuccaa

SEQ ID NO: 648748 - RNA, 18 nt, Human
agggugucacggggucga

SEQ ID NO: 648749 - RNA, 19 nt, Human
agggugucuggccagggug

SEQ ID NO: 648750 - RNA, 19 nt, Human
auccucguccuccccacug

SEQ ID NO: 648751 - RNA, 18 nt, Human
caaaaagcuaagcaggac

SEQ ID NO: 648752 - RNA, 23 nt, Human
caaaacccucggggccagaucaa

SEQ ID NO: 648753 - RNA, 22 nt, Human
caaagcaucucacaggccaaaa

SEQ ID NO: 648754 - RNA, 19 nt, Human
cacagccucagcccggccc

SEQ ID NO: 648755 - RNA, 21 nt, Human
cacagccucagcccggccccc

SEQ ID NO: 648756 - RNA, 22 nt, Human
cacagccucagcccggcccccu

SEQ ID NO: 648757 - RNA, 19 nt, Human
cacaggccaaaaagcuaag

SEQ ID NO: 648758 - RNA, 22 nt, Human
cacccagaaggaaggggaucuc

SEQ ID NO: 648759 - RNA, 20 nt, Human
caccccaguccaagcagggu

SEQ ID NO: 648760 - RNA, 20 nt, Human
cacccugagacaccccacag

SEQ ID NO: 648761 - RNA, 21 nt, Human
caccgacugucagaaaacccg

SEQ ID NO: 648762 - RNA, 25 nt, Human
cagacuggcggcucccacugcagcc

SEQ ID NO: 648763 - RNA, 22 nt, Human
cagaggcugauggagaccccaa

SEQ ID NO: 648764 - RNA, 21 nt, Human
cagcacacgggggugggcagu

SEQ ID NO: 648765 - RNA, 20 nt, Human
caggauccacaaaugguuua

SEQ ID NO: 648766 - RNA, 20 nt, Human
caggccaaaaagcuaagcag

SEQ ID NO: 648767 - RNA, 20 nt, Human
caggccccaguaccccccac

SEQ ID NO: 648768 - RNA, 19 nt, Human
cauccuaaaaacauccaaa

SEQ ID NO: 648769 - RNA, 23 nt, Human
caucucugccacaccugcagggg

SEQ ID NO: 648770 - RNA, 20 nt, Human
ccaccuggagcagguuccug

SEQ ID NO: 648771 - RNA, 24 nt, Human
ccacugcagccagaagugagggag

SEQ ID NO: 648772 - RNA, 22 nt, Human
ccacugcccacccugagacacc

SEQ ID NO: 648773 - RNA, 28 nt, Human
ccacugcccacccugagacaccccacag

SEQ ID NO: 648774 - RNA, 19 nt, Human
ccagaggcugacaagagca

SEQ ID NO: 648775 - RNA, 22 nt, Human
ccagcagagcccaagaguggcg

SEQ ID NO: 648776 - RNA, 24 nt, Human
ccccaaggacucgaggagaaccag

SEQ ID NO: 648777 - RNA, 25 nt, Human
ccccaaugcccgugccccaucucug

SEQ ID NO: 648778 - RNA, 18 nt, Human
ccccacccccacugccca

SEQ ID NO: 648779 - RNA, 25 nt, Human
ccccacccccacugcccacccugag

SEQ ID NO: 648780 - RNA, 26 nt, Human
ccccacccccacugcccacccugaga

SEQ ID NO: 648781 - RNA, 20 nt, Human
ccccagcccucccccgugcc

SEQ ID NO: 648782 - RNA, 19 nt, Human
ccccaucucugccacaccu

SEQ ID NO: 648783 - RNA, 21 nt, Human
ccccaucucugccacaccugc

SEQ ID NO: 648784 - RNA, 19 nt, Human
cccguguguccaccuggag

SEQ ID NO: 648785 - RNA, 19 nt, Human
cccugcguccgcacagccg

SEQ ID NO: 648786 - RNA, 21 nt, Human
cccuggacccgagaccgucuc

SEQ ID NO: 648787 - RNA, 19 nt, Human
ccuaaaaacauccaaaacc

SEQ ID NO: 648788 - RNA, 22 nt, Human
ccuaaaaacauccaaaacccuc

SEQ ID NO: 648789 - RNA, 22 nt, Human
ccucuugcaacggggugggggc

SEQ ID NO: 648790 - RNA, 25 nt, Human
ccuggaagauggacaucaaaacugg

SEQ ID NO: 648791 - RNA, 21 nt, Human
cggaggugcagucugcaccca

SEQ ID NO: 648792 - RNA, 22 nt, Human
cggcugcggucagugcaaggcu

SEQ ID NO: 648793 - RNA, 23 nt, Human
cucaaagcgccuuccaaaccaga

SEQ ID NO: 648794 - RNA, 20 nt, Human
cucacaggccaaaaagcuaa

SEQ ID NO: 648795 - RNA, 22 nt, Human
cucacaggccaaaaagcuaagc

SEQ ID NO: 648796 - RNA, 19 nt, Human
cucccccgugccagacccc

SEQ ID NO: 648797 - RNA, 19 nt, Human
cuccugcggucaccccagc

SEQ ID NO: 648798 - RNA, 20 nt, Human
cucgcagccacuccaaaggc

SEQ ID NO: 648799 - RNA, 21 nt, Human
cucgcagccacuccaaaggcc

SEQ ID NO: 648800 - RNA, 18 nt, Human
cugccacaccugcagggg

SEQ ID NO: 648801 - RNA, 25 nt, Human
cugccacaccugcaggggccacggc

SEQ ID NO: 648802 - RNA, 19 nt, Human
cugccacagcagcggggac

SEQ ID NO: 648803 - RNA, 18 nt, Human
cuggagcagguuccugca

SEQ ID NO: 648804 - RNA, 19 nt, Human
cuggagcagguuccugcag

SEQ ID NO: 648805 - RNA, 18 nt, Human
gaagugagggagccagca

SEQ ID NO: 648806 - RNA, 25 nt, Human
gagcacggugacccugcguccgcac

SEQ ID NO: 648807 - RNA, 19 nt, Human
gcaggggcagcccccucca

SEQ ID NO: 648808 - RNA, 18 nt, Human
gccacggcacccacccuc

SEQ ID NO: 648809 - RNA, 18 nt, Human
gccccacccccacugccc

SEQ ID NO: 648810 - RNA, 22 nt, Human
gcuagcccuggcgaugcucagc

SEQ ID NO: 648811 - RNA, 21 nt, Human
gcugacauggugugaccucuu

SEQ ID NO: 648812 - RNA, 20 nt, Human
ggaaaacucgaggaggaggc

SEQ ID NO: 648813 - RNA, 23 nt, Human
ggacaggaugcggcaggccccag

SEQ ID NO: 648814 - RNA, 18 nt, Human
ggacucaaagcgccuucc

SEQ ID NO: 648815 - RNA, 24 nt, Human
ggaggucagggcccaccagugccc

SEQ ID NO: 648816 - RNA, 18 nt, Human
ggcaguggacaggacagg

SEQ ID NO: 648817 - RNA, 19 nt, Human
ggccugggggccggcugcg

SEQ ID NO: 648818 - RNA, 22 nt, Human
ggcgcucugccacagcagcggg

SEQ ID NO: 648819 - RNA, 22 nt, Human
ggugugaccucuugcaacgggg

SEQ ID NO: 648820 - RNA, 20 nt, Human
gugccagaccccuggguagc

SEQ ID NO: 648821 - RNA, 27 nt, Human
uaaaaacauccaaaacccucggggcca

SEQ ID NO: 648822 - RNA, 20 nt, Human
uaaggcgccaucggccagga

SEQ ID NO: 648823 - RNA, 23 nt, Human
uaccaggcagagaaagccccagc

SEQ ID NO: 648824 - RNA, 27 nt, Human
uaccaggcagagaaagccccagcccuc

SEQ ID NO: 648825 - RNA, 25 nt, Human
uagcagaggccaccccaaucaacgg

SEQ ID NO: 648826 - RNA, 20 nt, Human
ucagaaaacccggagcacgg

SEQ ID NO: 648827 - RNA, 18 nt, Human
uccaagcagggugucugg

SEQ ID NO: 648828 - RNA, 19 nt, Human
uccaagcagggugucuggc

SEQ ID NO: 648829 - RNA, 20 nt, Human
uccaccugcggaagggaaga

SEQ ID NO: 648830 - RNA, 19 nt, Human
ucccacauccucguccucc

SEQ ID NO: 648831 - RNA, 21 nt, Human
ucccacauccucguccucccc

SEQ ID NO: 648832 - RNA, 20 nt, Human
ucccacugcagccagaagug

SEQ ID NO: 648833 - RNA, 19 nt, Human
ucccagccccacccccacu

SEQ ID NO: 648834 - RNA, 19 nt, Human
ucccauggccacggccccg

SEQ ID NO: 648835 - RNA, 20 nt, Human
ucccccgugccagaccccug

SEQ ID NO: 648836 - RNA, 20 nt, Human
uccgcacagccgccuuuccg

SEQ ID NO: 648837 - RNA, 22 nt, Human
uccgcacagccgccuuuccgug

SEQ ID NO: 648838 - RNA, 20 nt, Human
uccgcucacaggccuuacag

SEQ ID NO: 648839 - RNA, 18 nt, Human
uccugcggucaccccagc

SEQ ID NO: 648840 - RNA, 19 nt, Human
ucgcggcugcuggcccgug

SEQ ID NO: 648841 - RNA, 21 nt, Human
ucgcuggcaucugccacgucc

SEQ ID NO: 648842 - RNA, 23 nt, Human
ucggggccagaucaacccuggag

SEQ ID NO: 648843 - RNA, 18 nt, Human
ucugccacagcagcgggg

SEQ ID NO: 648844 - RNA, 19 nt, Human
ugacaagagcagcaugagc

SEQ ID NO: 648845 - RNA, 21 nt, Human
ugacauggugugaccucuugc

SEQ ID NO: 648846 - RNA, 23 nt, Human
ugagcacaaacagcgucccagcc

SEQ ID NO: 648847 - RNA, 21 nt, Human
ugaggcaauuaccgcuacaaa

SEQ ID NO: 648848 - RNA, 21 nt, Human
ugagggagccagcacacgggg

SEQ ID NO: 648849 - RNA, 21 nt, Human
ugauggagaccccaaugcccg

SEQ ID NO: 648850 - RNA, 18 nt, Human
ugcggcaggccccaguac

SEQ ID NO: 648851 - RNA, 25 nt, Human
ugcucagccgggcuggacacagcgg

SEQ ID NO: 648852 - RNA, 18 nt, Human
ugcuggcccgugugucca

SEQ ID NO: 648853 - RNA, 22 nt, Human
ugcuucaggccaaaagcccagg

SEQ ID NO: 648854 - RNA, 22 nt, Human
uggaagauggacaucaaaacug

SEQ ID NO: 648855 - RNA, 21 nt, Human
uggacaggacaggaugcggca

SEQ ID NO: 648856 - RNA, 24 nt, Human
uggagccgcacggaagcauccaaa

SEQ ID NO: 648857 - RNA, 24 nt, Human
uggcgugcagacugcaugugcaca

SEQ ID NO: 648858 - RNA, 20 nt, Human
ugggcaguggacaggacagg

SEQ ID NO: 648859 - RNA, 19 nt, Human
uguaccuugggcucagacg

SEQ ID NO: 648860 - RNA, 22 nt, Human
ugucauccuaaaaacauccaaa

SEQ ID NO: 648861 - RNA, 20 nt, Human
uuuuuuuucaggauccacaa

SEQ ID NO: 648862 - RNA, 19 nt, Human
uuuuuuuuuuucaggaucc

SEQ ID NO: 648863 - RNA, 23 nt, Human
uuuuuuuuuuuuuuuuuuucagg

SEQ ID NO: 648864 - RNA, 23 nt, Human
aaacacagucaccagcacuauac

SEQ ID NO: 648865 - RNA, 18 nt, Human
agacagcccuggacuggg

SEQ ID NO: 648866 - RNA, 18 nt, Human
agacagcccuggacuggg

SEQ ID NO: 648867 - RNA, 18 nt, Human
caccagcacuauacucac

SEQ ID NO: 648868 - RNA, 21 nt, Human
caccagcacuauacucacucc

SEQ ID NO: 648869 - RNA, 23 nt, Human
caccagcacuauacucacuccua

SEQ ID NO: 648870 - RNA, 26 nt, Human
cacccuuggccccgccucccugaccu

SEQ ID NO: 648871 - RNA, 22 nt, Human
ccaaaccagccuuccuuccucc

SEQ ID NO: 648872 - RNA, 25 nt, Human
ccccaccaaaccagccuuccuuccu

SEQ ID NO: 648873 - RNA, 21 nt, Human
ccccccgacaccaugcccucc

SEQ ID NO: 648874 - RNA, 19 nt, Human
ccccgacaccaugcccucc

SEQ ID NO: 648875 - RNA, 19 nt, Human
ccggccgcugcuccugucc

SEQ ID NO: 648876 - RNA, 23 nt, Human
ccucccugaccuccccacuaccc

SEQ ID NO: 648877 - RNA, 21 nt, Human
ccuggacuggggcuaugaaac

SEQ ID NO: 648878 - RNA, 18 nt, Human
ccuguccugaguccaaag

SEQ ID NO: 648879 - RNA, 21 nt, Human
cgccgccgagcgcccucccca

SEQ ID NO: 648880 - RNA, 23 nt, Human
cgccgccgagcgcccuccccacc

SEQ ID NO: 648881 - RNA, 27 nt, Human
cuccccaccggccgcugcuccugucca

SEQ ID NO: 648882 - RNA, 20 nt, Human
cuccccacuaccccaccaaa

SEQ ID NO: 648883 - RNA, 22 nt, Human
cuggcuggugcucugugguggg

SEQ ID NO: 648884 - RNA, 23 nt, Human
gaccuccccacuaccccaccaaa

SEQ ID NO: 648885 - RNA, 22 nt, Human
gccgccgagcgcccuccccacc

SEQ ID NO: 648886 - RNA, 21 nt, Human
gccucccugaccuccccacua

SEQ ID NO: 648887 - RNA, 18 nt, Human
gcgaaggggagaggaggg

SEQ ID NO: 648888 - RNA, 22 nt, Human
ggacagcgaaggggagaggagg

SEQ ID NO: 648889 - RNA, 21 nt, Human
ggagacaagcuccugggugcu

SEQ ID NO: 648890 - RNA, 19 nt, Human
ggcccuguccugaguccaa

SEQ ID NO: 648891 - RNA, 28 nt, Human
uccagggggaggggacagcgaaggggag

SEQ ID NO: 648892 - RNA, 22 nt, Human
ucccugaccuccccacuacccc

SEQ ID NO: 648893 - RNA, 23 nt, Human
uccucgguccuccgguccucccg

SEQ ID NO: 648894 - RNA, 20 nt, Human
uccugaguccaaagauuccc

SEQ ID NO: 648895 - RNA, 21 nt, Human
uccugaguccaaagauuccca

SEQ ID NO: 648896 - RNA, 18 nt, Human
uccuggagacaagcuccu

SEQ ID NO: 648897 - RNA, 22 nt, Human
uccuggagacaagcuccugggu

SEQ ID NO: 648898 - RNA, 21 nt, Human
ucuuucuguccucgguccucc

SEQ ID NO: 648899 - RNA, 18 nt, Human
ugaccuccccacuacccc

SEQ ID NO: 648900 - RNA, 21 nt, Human
ugaccuccccacuaccccacc

SEQ ID NO: 648901 - RNA, 18 nt, Human
ugaguaggggacggggcc

SEQ ID NO: 648902 - RNA, 24 nt, Human
ugcaccuggcccuguccugagucc

SEQ ID NO: 648903 - RNA, 19 nt, Human
uuuuuuuuuuuuggagucu

SEQ ID NO: 648904 - RNA, 18 nt, Human
uuuuuuuuuuuuuuuuug

SEQ ID NO: 648905 - RNA, 19 nt, Human
uuuuuuuuuuuuuuuuugg

SEQ ID NO: 648906 - RNA, 24 nt, Human
aaaguucugggauuccgaguguga

SEQ ID NO: 648907 - RNA, 22 nt, Human
aaccagguggcuugacgaagac

SEQ ID NO: 648908 - RNA, 21 nt, Human
accagguggcuugacgaagac

SEQ ID NO: 648909 - RNA, 24 nt, Human
acuauauuguccaggcuggucuug

SEQ ID NO: 648910 - RNA, 24 nt, Human
caaaguucugggauuccgagugug

SEQ ID NO: 648911 - RNA, 27 nt, Human
caagugaucuuccugccuugaccuccc

SEQ ID NO: 648912 - RNA, 24 nt, Human
cacuauauuguccaggcuggucuu

SEQ ID NO: 648913 - RNA, 21 nt, Human
cagcugaaguucccacugcca

SEQ ID NO: 648914 - RNA, 24 nt, Human
ccaaaguucugggauuccgagugu

SEQ ID NO: 648915 - RNA, 24 nt, Human
ccaggcuggucuugaacuccuggg

SEQ ID NO: 648916 - RNA, 22 nt, Human
ccugggcucaagugaucuuccu

SEQ ID NO: 648917 - RNA, 23 nt, Human
ccugggcucaagugaucuuccug

SEQ ID NO: 648918 - RNA, 21 nt, Human
ccuguaguauguggaccccuc

SEQ ID NO: 648919 - RNA, 19 nt, Human
cgagugugagucaagugcu

SEQ ID NO: 648920 - RNA, 23 nt, Human
cucaagugaucuuccugccuuga

SEQ ID NO: 648921 - RNA, 25 nt, Human
cuccugggcucaagugaucuuccug

SEQ ID NO: 648922 - RNA, 22 nt, Human
cuuccugccuugaccucccaaa

SEQ ID NO: 648923 - RNA, 20 nt, Human
gccacggaaaugucaagaug

SEQ ID NO: 648924 - RNA, 18 nt, Human
ggcuggucuugaacuccu

SEQ ID NO: 648925 - RNA, 22 nt, Human
gggcucaagugaucuuccugcc

SEQ ID NO: 648926 - RNA, 24 nt, Human
gggggucucacuauauuguccagg

SEQ ID NO: 648927 - RNA, 19 nt, Human
guagagaugggggucucac

SEQ ID NO: 648928 - RNA, 22 nt, Human
guggaccccuccauccuggucc

SEQ ID NO: 648929 - RNA, 23 nt, Human
uaguauguggaccccuccauccu

SEQ ID NO: 648930 - RNA, 24 nt, Human
uauauuguccaggcuggucuugaa

SEQ ID NO: 648931 - RNA, 22 nt, Human
ucaauggccgucuguccccucu

SEQ ID NO: 648932 - RNA, 18 nt, Human
ucccaaaguucugggauu

SEQ ID NO: 648933 - RNA, 20 nt, Human
uccugggcucaagugaucuu

SEQ ID NO: 648934 - RNA, 22 nt, Human
uccugggcucaagugaucuucc

SEQ ID NO: 648935 - RNA, 24 nt, Human
uccugggcucaagugaucuuccug

SEQ ID NO: 648936 - RNA, 22 nt, Human
ucucacuauauuguccaggcug

SEQ ID NO: 648937 - RNA, 23 nt, Human
ucucacuauauuguccaggcugg

SEQ ID NO: 648938 - RNA, 22 nt, Human
ucuugaacuccugggcucaagu

SEQ ID NO: 648939 - RNA, 23 nt, Human
ucuugaacuccugggcucaagug

SEQ ID NO: 648940 - RNA, 18 nt, Human
ugacaguaacuguggcaa

SEQ ID NO: 648941 - RNA, 22 nt, Human
ugaucuuccugccuugaccucc

SEQ ID NO: 648942 - RNA, 24 nt, Human
ugggcucaagugaucuuccugccu

SEQ ID NO: 648943 - RNA, 24 nt, Human
uguccaggcuggucuugaacuccu

SEQ ID NO: 648944 - RNA, 20 nt, Human
ugugaauuuccaccuccugc

SEQ ID NO: 648945 - RNA, 24 nt, Human
uuguagagaugggggucucacuau

SEQ ID NO: 648946 - RNA, 25 nt, Human
uuuguagagaugggggucucacuau

SEQ ID NO: 648947 - RNA, 20 nt, Human
uuuuuuguagagaugggggu

SEQ ID NO: 648948 - RNA, 29 nt, Human
uuuuuuuuuuguagagaugggggucucaa

SEQ ID NO: 648949 - RNA, 19 nt, Human
uuuuuuuuuuuuuuuuugu

SEQ ID NO: 648950 - RNA, 26 nt, Human
uuuuuuuuuuuuuuuuuguagagaug

SEQ ID NO: 648951 - RNA, 22 nt, Human
aaaagcuagcccggggcuugag

SEQ ID NO: 648952 - RNA, 22 nt, Human
aaaggcaucuaauauuccagga

SEQ ID NO: 648953 - RNA, 19 nt, Human
aaccauccuccugagcacc

SEQ ID NO: 648954 - RNA, 24 nt, Human
aaccccgagccacccgggccggga

SEQ ID NO: 648955 - RNA, 21 nt, Human
aagaaaagggaaguggcauuc

SEQ ID NO: 648956 - RNA, 22 nt, Human
aagcagcagggccagauccaga

SEQ ID NO: 648957 - RNA, 18 nt, Human
aagcgcgccagcgcggag

SEQ ID NO: 648958 - RNA, 23 nt, Human
aauucagaacuuuuucacccgga

SEQ ID NO: 648959 - RNA, 26 nt, Human
agaagaaaagggaaguggcauuccag

SEQ ID NO: 648960 - RNA, 19 nt, Human
aggaccaggcgagguuccu

SEQ ID NO: 648961 - RNA, 19 nt, Human
aguuaaacggggaguuuuc

SEQ ID NO: 648962 - RNA, 23 nt, Human
aucagaucuuagaguuauacaau

SEQ ID NO: 648963 - RNA, 18 nt, Human
auggcaauaaaaaauaua

SEQ ID NO: 648964 - RNA, 19 nt, Human
auggcaauaaaaaauauac

SEQ ID NO: 648965 - RNA, 18 nt, Human
auggccgugcacuccgcc

SEQ ID NO: 648966 - RNA, 22 nt, Human
caaccccgagccacccgggccc

SEQ ID NO: 648967 - RNA, 19 nt, Human
caccgcggucaggcccagc

SEQ ID NO: 648968 - RNA, 22 nt, Human
cacugaaucacuuuucuucucc

SEQ ID NO: 648969 - RNA, 19 nt, Human
cagaaguccaaaagacgaa

SEQ ID NO: 648970 - RNA, 21 nt, Human
caggcgacagcccccagcgcc

SEQ ID NO: 648971 - RNA, 22 nt, Human
caggguagauccagagcugcgc

SEQ ID NO: 648972 - RNA, 20 nt, Human
cauggccgugcacuccgccc

SEQ ID NO: 648973 - RNA, 21 nt, Human
ccacccgggccgggauugcgc

SEQ ID NO: 648974 - RNA, 21 nt, Human
cccauggccgugcacuccgcc

SEQ ID NO: 648975 - RNA, 22 nt, Human
ccccauggccgugcacuccgcc

SEQ ID NO: 648976 - RNA, 26 nt, Human
cccccagcgccaccgcggucaggccc

SEQ ID NO: 648977 - RNA, 18 nt, Human
cccccuugcaggauuuca

SEQ ID NO: 648978 - RNA, 19 nt, Human
cccggaacuggagaaggag

SEQ ID NO: 648979 - RNA, 18 nt, Human
ccgcagguugccgcugcg

SEQ ID NO: 648980 - RNA, 22 nt, Human
ccggggcuugagaagaaaaggg

SEQ ID NO: 648981 - RNA, 23 nt, Human
ccucgcucaccggcacccccuug

SEQ ID NO: 648982 - RNA, 18 nt, Human
cggcgccaggcgacagcc

SEQ ID NO: 648983 - RNA, 21 nt, Human
cgugcacucugcacuugugca

SEQ ID NO: 648984 - RNA, 20 nt, Human
cuccaggccgugcacucugc

SEQ ID NO: 648985 - RNA, 19 nt, Human
cuccgucauuagcugaggg

SEQ ID NO: 648986 - RNA, 23 nt, Human
cucuuucucuucuucucuuucuc

SEQ ID NO: 648987 - RNA, 19 nt, Human
cugaaaucacugaaucacu

SEQ ID NO: 648988 - RNA, 19 nt, Human
cuuagaguuauacaaucag

SEQ ID NO: 648989 - RNA, 21 nt, Human
cuuccagcccacccacucuuc

SEQ ID NO: 648990 - RNA, 20 nt, Human
gacauucuuccagcccaccc

SEQ ID NO: 648991 - RNA, 23 nt, Human
gagaagaaaagggaaguggcauu

SEQ ID NO: 648992 - RNA, 19 nt, Human
gagaagcagcagggccaga

SEQ ID NO: 648993 - RNA, 23 nt, Human
gauaaacggagaagcaggagaaa

SEQ ID NO: 648994 - RNA, 20 nt, Human
gcagcagccgccggcgccgc

SEQ ID NO: 648995 - RNA, 23 nt, Human
gccccauggccgugcacuccgcc

SEQ ID NO: 648996 - RNA, 19 nt, Human
gccgugcacuccgccucgc

SEQ ID NO: 648997 - RNA, 19 nt, Human
gcgcggcgccaggcgacag

SEQ ID NO: 648998 - RNA, 22 nt, Human
gcugcgccacugugcccaccug

SEQ ID NO: 648999 - RNA, 22 nt, Human
ggagaagcaggagaaagaacua

SEQ ID NO: 649000 - RNA, 21 nt, Human
gggaguuuucagaauccuguc

SEQ ID NO: 649001 - RNA, 25 nt, Human
gggccagauccagaucuauggaaaa

SEQ ID NO: 649002 - RNA, 19 nt, Human
ggucagggaaaucaggacc

SEQ ID NO: 649003 - RNA, 24 nt, Human
gguugaucacaagccaaaaccugg

SEQ ID NO: 649004 - RNA, 22 nt, Human
gucagggugucaccaucgcagg

SEQ ID NO: 649005 - RNA, 19 nt, Human
uaaaaggcaucuaauauuc

SEQ ID NO: 649006 - RNA, 23 nt, Human
ucaaaggacaaaauggcaauaaa

SEQ ID NO: 649007 - RNA, 23 nt, Human
ucaaguguugucauuuuugagaa

SEQ ID NO: 649008 - RNA, 21 nt, Human
ucacaagccaaaaccuguccc

SEQ ID NO: 649009 - RNA, 20 nt, Human
ucacugaaucacuuuucuuu

SEQ ID NO: 649010 - RNA, 22 nt, Human
ucagaucuuagaguuauacaau

SEQ ID NO: 649011 - RNA, 23 nt, Human
ucaggcccagcgcggcaaccccg

SEQ ID NO: 649012 - RNA, 23 nt, Human
ucaguuaaaaaauagauauuggg

SEQ ID NO: 649013 - RNA, 18 nt, Human
uccaaaagacgaaaaaug

SEQ ID NO: 649014 - RNA, 22 nt, Human
uccagccauauuuggggugcaa

SEQ ID NO: 649015 - RNA, 18 nt, Human
uccuccaugacuacacaa

SEQ ID NO: 649016 - RNA, 24 nt, Human
ucgcaggucagggaaaucaggacc

SEQ ID NO: 649017 - RNA, 26 nt, Human
ucucaguucugaaacaccaugcuuca

SEQ ID NO: 649018 - RNA, 19 nt, Human
ucuuccucuuucucuucuu

SEQ ID NO: 649019 - RNA, 18 nt, Human
ucuuucucuucuucucuu

SEQ ID NO: 649020 - RNA, 21 nt, Human
ugacuacacaaccauccuccu

SEQ ID NO: 649021 - RNA, 22 nt, Human
ugagaacauuuuuaaaaggcau

SEQ ID NO: 649022 - RNA, 20 nt, Human
ugagaagaaaagggaagugg

SEQ ID NO: 649023 - RNA, 22 nt, Human
ugagacaccagaaguccaaaag

SEQ ID NO: 649024 - RNA, 26 nt, Human
ugcacuccgccucgcucaccggcacc

SEQ ID NO: 649025 - RNA, 22 nt, Human
ugcacugggacauugaagcauu

SEQ ID NO: 649026 - RNA, 18 nt, Human
ugcagcagccgccggcgc

SEQ ID NO: 649027 - RNA, 26 nt, Human
uguuucccuccugguugaucacaagc

SEQ ID NO: 649028 - RNA, 20 nt, Human
uuaaagguuuucaguagucu

SEQ ID NO: 649029 - RNA, 24 nt, Human
uuuuuuuuuuuuuuuuuuucaaag

SEQ ID NO: 649030 - RNA, 23 nt, Human
aaaaagguacucuacagcagcug

SEQ ID NO: 649031 - RNA, 23 nt, Human
aaacauuuuaaacaaauaaaguc

SEQ ID NO: 649032 - RNA, 24 nt, Human
aaagcaaaagcaaaaucaaacccc

SEQ ID NO: 649033 - RNA, 19 nt, Human
aaagcaaaaucaaacccac

SEQ ID NO: 649034 - RNA, 23 nt, Human
aacccacaucaaaagacccacag

SEQ ID NO: 649035 - RNA, 20 nt, Human
aacccugugcaagggugccu

SEQ ID NO: 649036 - RNA, 23 nt, Human
aagcaaaagcaaaaucaaaccca

SEQ ID NO: 649037 - RNA, 18 nt, Human
acaggguacggggcaccg

SEQ ID NO: 649038 - RNA, 25 nt, Human
acccacucgcccucccuucuuaguu

SEQ ID NO: 649039 - RNA, 23 nt, Human
acccagagcuucugaggaugcac

SEQ ID NO: 649040 - RNA, 21 nt, Human
acccugggacccccagguggc

SEQ ID NO: 649041 - RNA, 23 nt, Human
acccugggccgggcaccagcccu

SEQ ID NO: 649042 - RNA, 22 nt, Human
acccuggguccagagccccggc

SEQ ID NO: 649043 - RNA, 19 nt, Human
acuguacaagccacaaggc

SEQ ID NO: 649044 - RNA, 23 nt, Human
agaaaagcaaaagcaaaaucaaa

SEQ ID NO: 649045 - RNA, 21 nt, Human
agaaauggcaaaggcgguggc

SEQ ID NO: 649046 - RNA, 20 nt, Human
agaaugugacccaccugaaa

SEQ ID NO: 649047 - RNA, 25 nt, Human
agacaaauauauauauauguaugua

SEQ ID NO: 649048 - RNA, 24 nt, Human
agagaguuaacuucaagcucaaag

SEQ ID NO: 649049 - RNA, 22 nt, Human
agaguuaacuucaagcucaaag

SEQ ID NO: 649050 - RNA, 23 nt, Human
agcacccgucccaccccgagcag

SEQ ID NO: 649051 - RNA, 21 nt, Human
aggagaccucugcaagcugcg

SEQ ID NO: 649052 - RNA, 20 nt, Human
aggcgguggcaggugcuggg

SEQ ID NO: 649053 - RNA, 21 nt, Human
aguuggcaccagguggcuguc

SEQ ID NO: 649054 - RNA, 22 nt, Human
auguauguauauauauuaaaca

SEQ ID NO: 649055 - RNA, 19 nt, Human
caaaagacccacagaagac

SEQ ID NO: 649056 - RNA, 22 nt, Human
caaaagacccacagaagacuaa

SEQ ID NO: 649057 - RNA, 23 nt, Human
caaaauaauaaggggguaaugua

SEQ ID NO: 649058 - RNA, 23 nt, Human
caagcucaaagaaauggcaaagg

SEQ ID NO: 649059 - RNA, 22 nt, Human
caaggcaaacucaucaaucucc

SEQ ID NO: 649060 - RNA, 18 nt, Human
cacccgucccaccccgag

SEQ ID NO: 649061 - RNA, 22 nt, Human
cacccgucccaccccgagcaga

SEQ ID NO: 649062 - RNA, 25 nt, Human
cacccgucccaccccgagcagauug

SEQ ID NO: 649063 - RNA, 20 nt, Human
caccggcagccaggaugggu

SEQ ID NO: 649064 - RNA, 22 nt, Human
caccugccacccccaccacccu

SEQ ID NO: 649065 - RNA, 24 nt, Human
cacgugugcacaugugcccaggga

SEQ ID NO: 649066 - RNA, 21 nt, Human
cagagccccggcuggggugcu

SEQ ID NO: 649067 - RNA, 19 nt, Human
cagcuagaaaagcaaaagc

SEQ ID NO: 649068 - RNA, 24 nt, Human
caggugcugggguacgcuacgugg

SEQ ID NO: 649069 - RNA, 22 nt, Human
ccacccccaccacccugggacc

SEQ ID NO: 649070 - RNA, 24 nt, Human
ccacggaggaugagggaagaccag

SEQ ID NO: 649071 - RNA, 22 nt, Human
cccacagaagacuaaagaaaug

SEQ ID NO: 649072 - RNA, 24 nt, Human
cccacaucaaaagacccacagaag

SEQ ID NO: 649073 - RNA, 19 nt, Human
cccaccacccugggacccu

SEQ ID NO: 649074 - RNA, 19 nt, Human
ccccaucccacccugcccc

SEQ ID NO: 649075 - RNA, 22 nt, Human
cccccaccacccugggaccccc

SEQ ID NO: 649076 - RNA, 22 nt, Human
cccccgaagacacccagauugc

SEQ ID NO: 649077 - RNA, 18 nt, Human
ccccgcggccccggcgcc

SEQ ID NO: 649078 - RNA, 22 nt, Human
cccugccccgaaaaaaaaaacc

SEQ ID NO: 649079 - RNA, 22 nt, Human
cccugggacccccagguggcug

SEQ ID NO: 649080 - RNA, 18 nt, Human
ccgccgccgccgcugcuc

SEQ ID NO: 649081 - RNA, 23 nt, Human
ccgccgccgccgcugcucuccaa

SEQ ID NO: 649082 - RNA, 26 nt, Human
ccggcgccggcgccuggagccugguu

SEQ ID NO: 649083 - RNA, 22 nt, Human
ccggcgccuggagccugguucc

SEQ ID NO: 649084 - RNA, 24 nt, Human
ccugccccgaaaaaaaaaaccguc

SEQ ID NO: 649085 - RNA, 21 nt, Human
cgaaaaaaaaaaccgucaaaa

SEQ ID NO: 649086 - RNA, 20 nt, Human
cgaagacacccagauugcac

SEQ ID NO: 649087 - RNA, 28 nt, Human
cgacucccaaggcaaacucaucaaucuc

SEQ ID NO: 649088 - RNA, 23 nt, Human
cgcccggggugccgccgccgccg

SEQ ID NO: 649089 - RNA, 18 nt, Human
cucccugaggggcccgcu

SEQ ID NO: 649090 - RNA, 25 nt, Human
cugcagcccuuccagacgggccccc

SEQ ID NO: 649091 - RNA, 21 nt, Human
cugccccgaaaaaaaaaaccg

SEQ ID NO: 649092 - RNA, 21 nt, Human
cuggagccugguuccugcugc

SEQ ID NO: 649093 - RNA, 21 nt, Human
cuggcacacccagagcuucug

SEQ ID NO: 649094 - RNA, 23 nt, Human
cugguuaccuggagacacagggg

SEQ ID NO: 649095 - RNA, 18 nt, Human
cuuccccaucccacccug

SEQ ID NO: 649096 - RNA, 20 nt, Human
cuugguuucugccuuggggu

SEQ ID NO: 649097 - RNA, 24 nt, Human
cuugugccugggcacgugugcaca

SEQ ID NO: 649098 - RNA, 25 nt, Human
gaaaagcaaaagcaaaaucaaaccc

SEQ ID NO: 649099 - RNA, 23 nt, Human
gaacuuggagcagagcccccugg

SEQ ID NO: 649100 - RNA, 18 nt, Human
gacccacucgcccucccu

SEQ ID NO: 649101 - RNA, 21 nt, Human
gagcagauuggagcucaaugu

SEQ ID NO: 649102 - RNA, 21 nt, Human
gaugucgggaagggggaaaga

SEQ ID NO: 649103 - RNA, 19 nt, Human
gcagccaggaugggugcug

SEQ ID NO: 649104 - RNA, 20 nt, Human
gcagcccuuccagacgggcc

SEQ ID NO: 649105 - RNA, 25 nt, Human
gcaggcggcucagugaguuggcacc

SEQ ID NO: 649106 - RNA, 21 nt, Human
gcagggagcgaagucgccucc

SEQ ID NO: 649107 - RNA, 18 nt, Human
gccacccccaccacccug

SEQ ID NO: 649108 - RNA, 24 nt, Human
gccacccccaccacccugggaccc

SEQ ID NO: 649109 - RNA, 27 nt, Human
gccacccccaccacccugggaccccca

SEQ ID NO: 649110 - RNA, 26 nt, Human
gcgccuggagccugguuccugcugcg

SEQ ID NO: 649111 - RNA, 22 nt, Human
ggaaagaggagccuguguugga

SEQ ID NO: 649112 - RNA, 22 nt, Human
ggaaggaaaguaacagaacagc

SEQ ID NO: 649113 - RNA, 18 nt, Human
ggaagggggaaagaggag

SEQ ID NO: 649114 - RNA, 19 nt, Human
ggagacacaggggaauugc

SEQ ID NO: 649115 - RNA, 21 nt, Human
ggagaugcagagagagcuaga

SEQ ID NO: 649116 - RNA, 22 nt, Human
ggaucuguacaagggaaacauu

SEQ ID NO: 649117 - RNA, 22 nt, Human
gggaagcacccgucccaccccg

SEQ ID NO: 649118 - RNA, 23 nt, Human
gggaauugcugcagcccuuccag

SEQ ID NO: 649119 - RNA, 20 nt, Human
gggcacagguggaaggaaag

SEQ ID NO: 649120 - RNA, 22 nt, Human
gggcacgugugcacaugugccc

SEQ ID NO: 649121 - RNA, 20 nt, Human
gggccagacagaauuccuaa

SEQ ID NO: 649122 - RNA, 20 nt, Human
gggcccccgaagacacccag

SEQ ID NO: 649123 - RNA, 29 nt, Human
gggugcuuauuugccugcagacaguucuu

SEQ ID NO: 649124 - RNA, 23 nt, Human
ggguggggucgagggucccaggg

SEQ ID NO: 649125 - RNA, 20 nt, Human
gggugucggggggugggaga

SEQ ID NO: 649126 - RNA, 24 nt, Human
guccucuggcacacccagagcuuc

SEQ ID NO: 649127 - RNA, 20 nt, Human
gugcugggguacgcuacgug

SEQ ID NO: 649128 - RNA, 22 nt, Human
guuuaaaacauaauucuuacag

SEQ ID NO: 649129 - RNA, 21 nt, Human
uaaaagaauaaauacagggua

SEQ ID NO: 649130 - RNA, 25 nt, Human
uaacagaacagccagagagagggga

SEQ ID NO: 649131 - RNA, 18 nt, Human
uacaagccacaaggcucu

SEQ ID NO: 649132 - RNA, 19 nt, Human
uacagcagcuguuuaaaaa

SEQ ID NO: 649133 - RNA, 19 nt, Human
uacagguaagguccccugc

SEQ ID NO: 649134 - RNA, 23 nt, Human
uacguggagggguugccagggau

SEQ ID NO: 649135 - RNA, 20 nt, Human
uagaacgggaguuucaaaac

SEQ ID NO: 649136 - RNA, 20 nt, Human
uauauauauguauguauaua

SEQ ID NO: 649137 - RNA, 18 nt, Human
uauauauguauguauaua

SEQ ID NO: 649138 - RNA, 20 nt, Human
uaucccagggagggcacagg

SEQ ID NO: 649139 - RNA, 19 nt, Human
uauguauguauauauauua

SEQ ID NO: 649140 - RNA, 22 nt, Human
uauguauguauauauauuaaac

SEQ ID NO: 649141 - RNA, 23 nt, Human
uauguauguauauauauuaaacc

SEQ ID NO: 649142 - RNA, 24 nt, Human
ucaaacccacaucaaaagacccac

SEQ ID NO: 649143 - RNA, 18 nt, Human
ucagaaugugacccaccu

SEQ ID NO: 649144 - RNA, 25 nt, Human
ucagcuagaaaagcaaaagcaaaau

SEQ ID NO: 649145 - RNA, 26 nt, Human
ucagcuagaaaagcaaaagcaaaauc

SEQ ID NO: 649146 - RNA, 22 nt, Human
ucccagaggugugggaagcacc

SEQ ID NO: 649147 - RNA, 21 nt, Human
ucccagggagggcacagguga

SEQ ID NO: 649148 - RNA, 25 nt, Human
ucccagggagggcacagguggaagg

SEQ ID NO: 649149 - RNA, 20 nt, Human
ucccagggugucggggggug

SEQ ID NO: 649150 - RNA, 23 nt, Human
ucgccuccuccccgcggccccgg

SEQ ID NO: 649151 - RNA, 21 nt, Human
ucucagagcugugguaccacc

SEQ ID NO: 649152 - RNA, 23 nt, Human
ucucggggaauggagacccacuc

SEQ ID NO: 649153 - RNA, 21 nt, Human
ucugaggaugcacuugggaaa

SEQ ID NO: 649154 - RNA, 18 nt, Human
ucuuaguaccccugguau

SEQ ID NO: 649155 - RNA, 20 nt, Human
ucuuccccaucccacccugc

SEQ ID NO: 649156 - RNA, 18 nt, Human
ucuugguuucugccuugg

SEQ ID NO: 649157 - RNA, 22 nt, Human
ucuuuuuucaaagagggguugu

SEQ ID NO: 649158 - RNA, 22 nt, Human
ugagcccaagaguuagcuggga

SEQ ID NO: 649159 - RNA, 21 nt, Human
ugaggcucugagagggguugg

SEQ ID NO: 649160 - RNA, 21 nt, Human
ugaugucgggaagggggaaag

SEQ ID NO: 649161 - RNA, 23 nt, Human
ugcagggcaagggacccagagac

SEQ ID NO: 649162 - RNA, 20 nt, Human
ugcccagggagggcgggcga

SEQ ID NO: 649163 - RNA, 20 nt, Human
ugccgguccaaggugcaggg

SEQ ID NO: 649164 - RNA, 21 nt, Human
ugccugagcccaagaguuagc

SEQ ID NO: 649165 - RNA, 21 nt, Human
uggaaacugcagggcaaggga

SEQ ID NO: 649166 - RNA, 20 nt, Human
uggaaggaaaguaacagaac

SEQ ID NO: 649167 - RNA, 19 nt, Human
uggagacccacucgcccuc

SEQ ID NO: 649168 - RNA, 24 nt, Human
uggcacacccagagcuucugagga

SEQ ID NO: 649169 - RNA, 22 nt, Human
uggcuucugugaggcucgacuc

SEQ ID NO: 649170 - RNA, 18 nt, Human
ugggaucuguacaaggga

SEQ ID NO: 649171 - RNA, 24 nt, Human
ugggcacccugggccgggggaggu

SEQ ID NO: 649172 - RNA, 20 nt, Human
ugggcugguaggaaagaagg

SEQ ID NO: 649173 - RNA, 24 nt, Human
ugggcugguaggaaagaagggugg

SEQ ID NO: 649174 - RNA, 21 nt, Human
uguacaagggaaacauucauc

SEQ ID NO: 649175 - RNA, 21 nt, Human
uguaccugugcagaaaugaac

SEQ ID NO: 649176 - RNA, 19 nt, Human
ugugcccagggagggcggg

SEQ ID NO: 649177 - RNA, 21 nt, Human
ugugucuuuuuucaaagaggg

SEQ ID NO: 649178 - RNA, 22 nt, Human
uuacagacaaauauauauauau

SEQ ID NO: 649179 - RNA, 25 nt, Human
uuaccuggagacacaggggaauugc

SEQ ID NO: 649180 - RNA, 20 nt, Human
uuagcugguuaccuggagac

SEQ ID NO: 649181 - RNA, 19 nt, Human
uucuugguuucugccuugg

SEQ ID NO: 649182 - RNA, 18 nt, Human
uuucucacccagucuugg

SEQ ID NO: 649183 - RNA, 25 nt, Human
ggaaagagaaacauuauauaaacau

SEQ ID NO: 649184 - RNA, 23 nt, Human
uaaagagaaaucuuacagguaag

SEQ ID NO: 649185 - RNA, 20 nt, Human
uaagaugucauggaaagaga

SEQ ID NO: 649186 - RNA, 25 nt, Human
ugacaaaacauucauauaaagagaa

SEQ ID NO: 649187 - RNA, 25 nt, Human
uuuuuuuuuuuuuuuuuuuuagggg

SEQ ID NO: 649188 - RNA, 25 nt, Human
aaacagcuccagacaucucuucuca

SEQ ID NO: 649189 - RNA, 20 nt, Human
aacccugucuuuggccuugc

SEQ ID NO: 649190 - RNA, 19 nt, Human
aagccccagcuccugaggc

SEQ ID NO: 649191 - RNA, 23 nt, Human
aaggccccagggaaaccccacac

SEQ ID NO: 649192 - RNA, 20 nt, Human
aaguaccccuucggccaggc

SEQ ID NO: 649193 - RNA, 21 nt, Human
acucucaaacgugucuuucuc

SEQ ID NO: 649194 - RNA, 19 nt, Human
agaacuccuccagcagcuc

SEQ ID NO: 649195 - RNA, 24 nt, Human
agaacuccuccagcagcuccccaa

SEQ ID NO: 649196 - RNA, 22 nt, Human
agcuccccaagccccagcuccu

SEQ ID NO: 649197 - RNA, 20 nt, Human
aggagcaggaaaaugucaug

SEQ ID NO: 649198 - RNA, 24 nt, Human
aggcagcggcggcggcggcccgag

SEQ ID NO: 649199 - RNA, 19 nt, Human
agugacaagaagggguggu

SEQ ID NO: 649200 - RNA, 20 nt, Human
cacaaggccccagggaaacc

SEQ ID NO: 649201 - RNA, 22 nt, Human
caccuguacgguacucucaaac

SEQ ID NO: 649202 - RNA, 20 nt, Human
cagcaaagauggggugggug

SEQ ID NO: 649203 - RNA, 25 nt, Human
cagcagcuccccaagccccagcucc

SEQ ID NO: 649204 - RNA, 23 nt, Human
cagcuccccaagccccagcuccu

SEQ ID NO: 649205 - RNA, 22 nt, Human
cagcuccugaggcggcugguug

SEQ ID NO: 649206 - RNA, 22 nt, Human
cauggcccagccccgcgucccc

SEQ ID NO: 649207 - RNA, 23 nt, Human
ccagccccgcguccccucagugu

SEQ ID NO: 649208 - RNA, 22 nt, Human
ccccuucggccaggcauggcuu

SEQ ID NO: 649209 - RNA, 26 nt, Human
ccgaggcagcggcggcggcggcccuu

SEQ ID NO: 649210 - RNA, 19 nt, Human
ccuccagcagcuccccaag

SEQ ID NO: 649211 - RNA, 23 nt, Human
ccuggaaguaccccuucggccag

SEQ ID NO: 649212 - RNA, 21 nt, Human
cggccaaacagcuccagacau

SEQ ID NO: 649213 - RNA, 18 nt, Human
cucaaugcgcucaaccuu

SEQ ID NO: 649214 - RNA, 19 nt, Human
cucagaacucucauacucc

SEQ ID NO: 649215 - RNA, 20 nt, Human
cucagcuuuggggcugccau

SEQ ID NO: 649216 - RNA, 22 nt, Human
cucagugcaggugaucccuccu

SEQ ID NO: 649217 - RNA, 20 nt, Human
cuccagcagcuccccaagcc

SEQ ID NO: 649218 - RNA, 19 nt, Human
cuccccaagccccagcucc

SEQ ID NO: 649219 - RNA, 24 nt, Human
cuccuccagcagcuccccaagccc

SEQ ID NO: 649220 - RNA, 23 nt, Human
cugaguccgggagaacuccucca

SEQ ID NO: 649221 - RNA, 21 nt, Human
gaagaggccgaggaccccgcc

SEQ ID NO: 649222 - RNA, 18 nt, Human
gagcaggaaaaugucaug

SEQ ID NO: 649223 - RNA, 21 nt, Human
gaggcagcggcggcggcggcc

SEQ ID NO: 649224 - RNA, 20 nt, Human
gaggcuggggguuggaaaac

SEQ ID NO: 649225 - RNA, 23 nt, Human
gauaguggccacagauauccccc

SEQ ID NO: 649226 - RNA, 19 nt, Human
gaucccuccuccccagaaa

SEQ ID NO: 649227 - RNA, 21 nt, Human
gcagcggcggcggcggcccga

SEQ ID NO: 649228 - RNA, 25 nt, Human
gcagcggcggcggcggcccgagcgc

SEQ ID NO: 649229 - RNA, 20 nt, Human
gcggcggcggcggcccgagc

SEQ ID NO: 649230 - RNA, 22 nt, Human
ggcuggggguuggaaaacccug

SEQ ID NO: 649231 - RNA, 18 nt, Human
gggacugaaauuuccccu

SEQ ID NO: 649232 - RNA, 26 nt, Human
ggggugggugggagacagugacaaga

SEQ ID NO: 649233 - RNA, 22 nt, Human
gucaaacugccucauucucagu

SEQ ID NO: 649234 - RNA, 20 nt, Human
uccccaagccccagcuccug

SEQ ID NO: 649235 - RNA, 19 nt, Human
ucccuccuccccagaaaca

SEQ ID NO: 649236 - RNA, 20 nt, Human
uccuccccagaaacaagaac

SEQ ID NO: 649237 - RNA, 20 nt, Human
uccugaggcggcugguugcc

SEQ ID NO: 649238 - RNA, 23 nt, Human
ucuuucuccuucucagaacucuc

SEQ ID NO: 649239 - RNA, 22 nt, Human
ugauuuuauuuugugaucugug

SEQ ID NO: 649240 - RNA, 27 nt, Human
ugcgcucaaccuuagagccgccggucc

SEQ ID NO: 649241 - RNA, 19 nt, Human
uggaugaggucuugcaacu

SEQ ID NO: 649242 - RNA, 22 nt, Human
uggccacagauauccccauucg

SEQ ID NO: 649243 - RNA, 20 nt, Human
uggcuuccacaaggccccuc

SEQ ID NO: 649244 - RNA, 19 nt, Human
uggggugggugggagacag

SEQ ID NO: 649245 - RNA, 19 nt, Human
uggggugggugggagacag

SEQ ID NO: 649246 - RNA, 21 nt, Human
uggggugggugggagacagug

SEQ ID NO: 649247 - RNA, 22 nt, Human
ugucuuuggccuugcucagcuu

SEQ ID NO: 649248 - RNA, 24 nt, Human
uuccccugaccuggaaguaccccc

SEQ ID NO: 649249 - RNA, 18 nt, Human
uugcucagcuuuggggcu

SEQ ID NO: 649250 - RNA, 21 nt, Human
uuuuuuuuuuucaaaaagacu

SEQ ID NO: 649251 - RNA, 25 nt, Human
uuuuuuuuuuuucaaaaagacuuug

SEQ ID NO: 649252 - RNA, 18 nt, Human
aaaacagccagagcgcac

SEQ ID NO: 649253 - RNA, 24 nt, Human
aagcugaaguagccaaaugugguc

SEQ ID NO: 649254 - RNA, 18 nt, Human
acucggucucggcaucug

SEQ ID NO: 649255 - RNA, 19 nt, Human
agaaaacagccagagcgca

SEQ ID NO: 649256 - RNA, 23 nt, Human
agaaaacagccagagcgcaccac

SEQ ID NO: 649257 - RNA, 24 nt, Human
agaaaacagccagagcgcaccacu

SEQ ID NO: 649258 - RNA, 21 nt, Human
agagagguauacccaguuccc

SEQ ID NO: 649259 - RNA, 22 nt, Human
agccagagcgcaccacucaccu

SEQ ID NO: 649260 - RNA, 27 nt, Human
aggaagaggcgggcggcuccgacagaa

SEQ ID NO: 649261 - RNA, 19 nt, Human
aggaagggaggagguggga

SEQ ID NO: 649262 - RNA, 22 nt, Human
aggcaggaggucgaaggcaggg

SEQ ID NO: 649263 - RNA, 22 nt, Human
aggcagggacaggaaggucagg

SEQ ID NO: 649264 - RNA, 23 nt, Human
aggcagggacaggaaggucaggg

SEQ ID NO: 649265 - RNA, 26 nt, Human
aggcagggacaggaaggucaggguuu

SEQ ID NO: 649266 - RNA, 23 nt, Human
aguguuuguuacacacacaugca

SEQ ID NO: 649267 - RNA, 21 nt, Human
auccaugccugugugugagua

SEQ ID NO: 649268 - RNA, 21 nt, Human
auggguguguguuccuuccug

SEQ ID NO: 649269 - RNA, 28 nt, Human
cacacacaugcauccaugccugugugug

SEQ ID NO: 649270 - RNA, 22 nt, Human
caccugagugccagguaaacac

SEQ ID NO: 649271 - RNA, 21 nt, Human
caccugcagcagcggcgaagc

SEQ ID NO: 649272 - RNA, 24 nt, Human
cagaaaacagccagagcgcaccac

SEQ ID NO: 649273 - RNA, 19 nt, Human
cagagcgcaccacucaccu

SEQ ID NO: 649274 - RNA, 20 nt, Human
cagagugaggccccaggaag

SEQ ID NO: 649275 - RNA, 25 nt, Human
cagauaauggguguguguuccuucc

SEQ ID NO: 649276 - RNA, 23 nt, Human
cagcagcggcgaagcggugucag

SEQ ID NO: 649277 - RNA, 18 nt, Human
caggagucccaugccuau

SEQ ID NO: 649278 - RNA, 22 nt, Human
cccaucgcccuuggccuggggc

SEQ ID NO: 649279 - RNA, 24 nt, Human
ccuccugggcaggccagcaaggac

SEQ ID NO: 649280 - RNA, 19 nt, Human
ccugagugccagguaaaca

SEQ ID NO: 649281 - RNA, 18 nt, Human
cgacagaaaacagccaga

SEQ ID NO: 649282 - RNA, 24 nt, Human
cucaggggcccaucgcccuuggcc

SEQ ID NO: 649283 - RNA, 20 nt, Human
cugagugccagguaaacacc

SEQ ID NO: 649284 - RNA, 21 nt, Human
cugcagcagcggcgaagcggu

SEQ ID NO: 649285 - RNA, 19 nt, Human
gaagggaggaggugggaca

SEQ ID NO: 649286 - RNA, 18 nt, Human
gaccacggcggcgcugcc

SEQ ID NO: 649287 - RNA, 23 nt, Human
gccuggggccccuccgugccguc

SEQ ID NO: 649288 - RNA, 23 nt, Human
gcggcuccgacagaaaacagcca

SEQ ID NO: 649289 - RNA, 19 nt, Human
ggaccacggcggcgcugcc

SEQ ID NO: 649290 - RNA, 20 nt, Human
ggcaaagcgcagagugaggc

SEQ ID NO: 649291 - RNA, 25 nt, Human
ggcaaagcgcagagugaggccccag

SEQ ID NO: 649292 - RNA, 24 nt, Human
ggcgaagcggugucagggcucagg

SEQ ID NO: 649293 - RNA, 21 nt, Human
ggcgcugccggccaggggcac

SEQ ID NO: 649294 - RNA, 25 nt, Human
ggggcccaucgcccuuggccugggg

SEQ ID NO: 649295 - RNA, 22 nt, Human
ggggccccuccgugccgucggg

SEQ ID NO: 649296 - RNA, 28 nt, Human
uacacacacaugcauccaugccugugug

SEQ ID NO: 649297 - RNA, 18 nt, Human
ucagaguagcacugagcu

SEQ ID NO: 649298 - RNA, 18 nt, Human
ucccgaggcacccauggg

SEQ ID NO: 649299 - RNA, 21 nt, Human
ugaaguagccaaaugugguca

SEQ ID NO: 649300 - RNA, 21 nt, Human
ugaggccccaggaagggagga

SEQ ID NO: 649301 - RNA, 21 nt, Human
uggcaaagcgcagagugaggc

SEQ ID NO: 649302 - RNA, 18 nt, Human
uggcagagaagcgacuuu

SEQ ID NO: 649303 - RNA, 21 nt, Human
uggcagagaagcgacuuuggc

SEQ ID NO: 649304 - RNA, 19 nt, Human
uggucagcaguauuguauu

SEQ ID NO: 649305 - RNA, 23 nt, Human
uguuacacacacaugcauccaug

SEQ ID NO: 649306 - RNA, 24 nt, Human
uuaagcugaaguagccaaaugugg

SEQ ID NO: 649307 - RNA, 24 nt, Human
uucagaguagcacugagcugaaga

SEQ ID NO: 649308 - RNA, 22 nt, Human
uuuuuuuuuuugggacugagca

SEQ ID NO: 649309 - RNA, 18 nt, Human
uuuuuuuuuuuuuuuuug

SEQ ID NO: 649310 - RNA, 18 nt, Human
uuuuuuuuuuuuuuuuug

SEQ ID NO: 649311 - RNA, 21 nt, Human
aaaaaaaaaauucagcuggaa

SEQ ID NO: 649312 - RNA, 22 nt, Human
aaaaaaauucagcuggaaccac

SEQ ID NO: 649313 - RNA, 24 nt, Human
aaacugaucuaaucucccuuucua

SEQ ID NO: 649314 - RNA, 24 nt, Human
aaagaaaaaggagugaagaaagag

SEQ ID NO: 649315 - RNA, 18 nt, Human
aagaaaaaggagugaaga

SEQ ID NO: 649316 - RNA, 22 nt, Human
aagaaagagagagggaaaaaaa

SEQ ID NO: 649317 - RNA, 20 nt, Human
aagaaagagagagggaaaag

SEQ ID NO: 649318 - RNA, 20 nt, Human
aagaagagacuauaauggua

SEQ ID NO: 649319 - RNA, 24 nt, Human
aagacccugacuccuaggaaagcc

SEQ ID NO: 649320 - RNA, 18 nt, Human
aagagaaaacugaucuaa

SEQ ID NO: 649321 - RNA, 22 nt, Human
aaugacgagaagaguccaaaga

SEQ ID NO: 649322 - RNA, 24 nt, Human
aaugcucacugcuacuuagaugac

SEQ ID NO: 649323 - RNA, 19 nt, Human
aauuuacaaacagcauccc

SEQ ID NO: 649324 - RNA, 21 nt, Human
acaaacagcaucccauuuccu

SEQ ID NO: 649325 - RNA, 24 nt, Human
acccaggcuggagugcaauggcau

SEQ ID NO: 649326 - RNA, 19 nt, Human
accuuuccccaaccuucuc

SEQ ID NO: 649327 - RNA, 20 nt, Human
acugcaaccuccaccugcug

SEQ ID NO: 649328 - RNA, 23 nt, Human
agaaauaucuagcaggaaagucc

SEQ ID NO: 649329 - RNA, 19 nt, Human
agaagaauucuuucuaagg

SEQ ID NO: 649330 - RNA, 20 nt, Human
agaagugguuagcucaguac

SEQ ID NO: 649331 - RNA, 24 nt, Human
agagagagggaaaaaaaaaauuca

SEQ ID NO: 649332 - RNA, 22 nt, Human
agagagggaaaaaaaaaauuca

SEQ ID NO: 649333 - RNA, 23 nt, Human
agaugccuuuuuacagaugaauc

SEQ ID NO: 649334 - RNA, 20 nt, Human
agccgggaccagggucaggg

SEQ ID NO: 649335 - RNA, 21 nt, Human
agcuggaaccacaugguugcc

SEQ ID NO: 649336 - RNA, 21 nt, Human
aggaaaacgcgaggcggaaag

SEQ ID NO: 649337 - RNA, 19 nt, Human
agugaagaaagagagaggg

SEQ ID NO: 649338 - RNA, 24 nt, Human
agugcaauggcauaaucuuggcuc

SEQ ID NO: 649339 - RNA, 21 nt, Human
auucacucuucuccaucuccc

SEQ ID NO: 649340 - RNA, 24 nt, Human
caaauagugagauuaguauagagu

SEQ ID NO: 649341 - RNA, 19 nt, Human
caaaugaaguuaagucaga

SEQ ID NO: 649342 - RNA, 26 nt, Human
caaccuccaccugcuggauuuuccua

SEQ ID NO: 649343 - RNA, 22 nt, Human
caccaugcccggcuaccuuccu

SEQ ID NO: 649344 - RNA, 22 nt, Human
caccucaccuuuccccaaccuu

SEQ ID NO: 649345 - RNA, 21 nt, Human
cacugcaaccuccaccugcug

SEQ ID NO: 649346 - RNA, 23 nt, Human
cagaaagaagagacuauaauggu

SEQ ID NO: 649347 - RNA, 19 nt, Human
caucugguuguguggcugg

SEQ ID NO: 649348 - RNA, 21 nt, Human
caugaagauggaaagcucuuc

SEQ ID NO: 649349 - RNA, 20 nt, Human
ccaccagcuggcgcccggac

SEQ ID NO: 649350 - RNA, 22 nt, Human
ccaucucccacuauuucaacuc

SEQ ID NO: 649351 - RNA, 22 nt, Human
ccaugcccggcuaccuuccuug

SEQ ID NO: 649352 - RNA, 24 nt, Human
cccacuauuucaacuccccuugaa

SEQ ID NO: 649353 - RNA, 18 nt, Human
ccccugggggcagauggg

SEQ ID NO: 649354 - RNA, 24 nt, Human
ccccugggggcagaugggcucccg

SEQ ID NO: 649355 - RNA, 21 nt, Human
cccgcucagcugcugcuuggc

SEQ ID NO: 649356 - RNA, 20 nt, Human
ccgcucagcugcugcuuggc

SEQ ID NO: 649357 - RNA, 22 nt, Human
ccggccccgcgccccgugcccc

SEQ ID NO: 649358 - RNA, 21 nt, Human
ccgugcaaugcucacugcuac

SEQ ID NO: 649359 - RNA, 19 nt, Human
ccucgggcgagcugggcgc

SEQ ID NO: 649360 - RNA, 21 nt, Human
cgccccgugccccugggggca

SEQ ID NO: 649361 - RNA, 20 nt, Human
cggccgggcgccuccgacgg

SEQ ID NO: 649362 - RNA, 24 nt, Human
cgggcgagcugggcgcggcgccuc

SEQ ID NO: 649363 - RNA, 23 nt, Human
cucaccuuuccccaaccuucuca

SEQ ID NO: 649364 - RNA, 23 nt, Human
cucacugcaaccuccaccugcug

SEQ ID NO: 649365 - RNA, 19 nt, Human
cucagcugcugcuuggcuc

SEQ ID NO: 649366 - RNA, 21 nt, Human
cucauucacucuucuccaucu

SEQ ID NO: 649367 - RNA, 21 nt, Human
cuccaucucccacuauuucaa

SEQ ID NO: 649368 - RNA, 24 nt, Human
cugcaaccuccaccugcuggauuu

SEQ ID NO: 649369 - RNA, 25 nt, Human
cugcaaccuccaccugcuggauuuu

SEQ ID NO: 649370 - RNA, 23 nt, Human
cugcugcuuggcuccggggcggc

SEQ ID NO: 649371 - RNA, 21 nt, Human
cugguuucacauuuucucaga

SEQ ID NO: 649372 - RNA, 24 nt, Human
cuugcuuugucacccaggcuggag

SEQ ID NO: 649373 - RNA, 20 nt, Human
cuuugucacccaggcuggag

SEQ ID NO: 649374 - RNA, 18 nt, Human
gaaagaaaaaggagugaa

SEQ ID NO: 649375 - RNA, 23 nt, Human
gaagaaagagagagggaaaaaaa

SEQ ID NO: 649376 - RNA, 21 nt, Human
gacaaaugaaguuaagucaga

SEQ ID NO: 649377 - RNA, 18 nt, Human
gagaagaguccaaagacc

SEQ ID NO: 649378 - RNA, 25 nt, Human
gagccgggaccagggucagggagga

SEQ ID NO: 649379 - RNA, 18 nt, Human
gagucuugcuuugucacc

SEQ ID NO: 649380 - RNA, 25 nt, Human
gaucuaaucucccuuucuaguccac

SEQ ID NO: 649381 - RNA, 22 nt, Human
gccccgugccccugggggcaga

SEQ ID NO: 649382 - RNA, 20 nt, Human
gccuccgacggaccucgggc

SEQ ID NO: 649383 - RNA, 22 nt, Human
gcgcgcgagguggcugcagcca

SEQ ID NO: 649384 - RNA, 24 nt, Human
gcgcgcgagguggcugcagccaug

SEQ ID NO: 649385 - RNA, 23 nt, Human
gcuccggggcggccgggcgccuc

SEQ ID NO: 649386 - RNA, 19 nt, Human
gcugcugcuuggcuccggg

SEQ ID NO: 649387 - RNA, 20 nt, Human
gcugcuuggcuccggggcgg

SEQ ID NO: 649388 - RNA, 23 nt, Human
gcuggauuuuccuacaggugccu

SEQ ID NO: 649389 - RNA, 18 nt, Human
ggaaagcucuucacaauc

SEQ ID NO: 649390 - RNA, 19 nt, Human
ggaccagggucagggagga

SEQ ID NO: 649391 - RNA, 22 nt, Human
ggagccgggaccagggucaggg

SEQ ID NO: 649392 - RNA, 22 nt, Human
ggagugaagaaagagagaggga

SEQ ID NO: 649393 - RNA, 22 nt, Human
ggcuggugacuugagcucccgg

SEQ ID NO: 649394 - RNA, 22 nt, Human
gggagccgggaccagggucagg

SEQ ID NO: 649395 - RNA, 19 nt, Human
gggcagaugggcucccggc

SEQ ID NO: 649396 - RNA, 22 nt, Human
uagaaaauuuacaaacagcauc

SEQ ID NO: 649397 - RNA, 23 nt, Human
uauuaagagaaaacugaucuaau

SEQ ID NO: 649398 - RNA, 25 nt, Human
uauuuucuccuuccagaaauaucua

SEQ ID NO: 649399 - RNA, 22 nt, Human
ucaacaauccucauaacaucau

SEQ ID NO: 649400 - RNA, 23 nt, Human
ucacaaauuuuugucuccuuuca

SEQ ID NO: 649401 - RNA, 18 nt, Human
ucacccaggcuggagugc

SEQ ID NO: 649402 - RNA, 19 nt, Human
ucaccucaccuuuccccaa

SEQ ID NO: 649403 - RNA, 18 nt, Human
ucacugcaaccuccaccu

SEQ ID NO: 649404 - RNA, 19 nt, Human
ucacugcaaccuccaccug

SEQ ID NO: 649405 - RNA, 20 nt, Human
ucacugcaaccuccaccugc

SEQ ID NO: 649406 - RNA, 24 nt, Human
ucacugcaaccuccaccugcugga

SEQ ID NO: 649407 - RNA, 23 nt, Human
ucagcuggaaccacaugguugcc

SEQ ID NO: 649408 - RNA, 25 nt, Human
ucagggaggaaaacgcgaggcggaa

SEQ ID NO: 649409 - RNA, 19 nt, Human
ucaugaagauggaaagcuc

SEQ ID NO: 649410 - RNA, 21 nt, Human
uccaaagacccugacuccuag

SEQ ID NO: 649411 - RNA, 18 nt, Human
ucccacuauuucaacucc

SEQ ID NO: 649412 - RNA, 18 nt, Human
uccccaaccuucucacca

SEQ ID NO: 649413 - RNA, 19 nt, Human
uccccggacgcgggcgcuu

SEQ ID NO: 649414 - RNA, 23 nt, Human
uccccggacgcgggcgcuucccc

SEQ ID NO: 649415 - RNA, 20 nt, Human
ucccuuuuucucuagaagaa

SEQ ID NO: 649416 - RNA, 22 nt, Human
uccggggcggccgggcgccucc

SEQ ID NO: 649417 - RNA, 23 nt, Human
ucuugcuuugucacccaggcugg

SEQ ID NO: 649418 - RNA, 24 nt, Human
ucuugcuuugucacccaggcugga

SEQ ID NO: 649419 - RNA, 25 nt, Human
ugcgcgcgagguggcugcagccaug

SEQ ID NO: 649420 - RNA, 19 nt, Human
uggagucuugcuuugucac

SEQ ID NO: 649421 - RNA, 23 nt, Human
uggagugcaauggcauaaucuug

SEQ ID NO: 649422 - RNA, 24 nt, Human
uggagugcaauggcauaaucuugg

SEQ ID NO: 649423 - RNA, 21 nt, Human
uggcgcccggacgggagccgg

SEQ ID NO: 649424 - RNA, 24 nt, Human
uggcucacugcaaccuccaccugc

SEQ ID NO: 649425 - RNA, 18 nt, Human
uggcugcagccaugugcc

SEQ ID NO: 649426 - RNA, 22 nt, Human
ugggcucaauacaaauagugag

SEQ ID NO: 649427 - RNA, 19 nt, Human
ugguauguuggguaaucuu

SEQ ID NO: 649428 - RNA, 19 nt, Human
ugguuagcucaguacaugg

SEQ ID NO: 649429 - RNA, 18 nt, Human
ugucacccaggcuggagu

SEQ ID NO: 649430 - RNA, 20 nt, Human
ugucacccaggcuggagugc

SEQ ID NO: 649431 - RNA, 24 nt, Human
ugugaaucaaagcacugauacaaa

SEQ ID NO: 649432 - RNA, 21 nt, Human
uguuggguaaucuuucagcau

SEQ ID NO: 649433 - RNA, 18 nt, Human
uuacucuggucuaaaggc

SEQ ID NO: 649434 - RNA, 18 nt, Human
uucaccucaccuuucccc

SEQ ID NO: 649435 - RNA, 20 nt, Human
uucguggaacacuuuucccu

SEQ ID NO: 649436 - RNA, 18 nt, Human
uugagauggagucuugcu

SEQ ID NO: 649437 - RNA, 23 nt, Human
uugcaauucugguuucacauuuu

SEQ ID NO: 649438 - RNA, 24 nt, Human
uugcuuugucacccaggcuggagu

SEQ ID NO: 649439 - RNA, 23 nt, Human
uuggacuccugcuuucccuuacu

SEQ ID NO: 649440 - RNA, 22 nt, Human
uuguauuuucuccuuccagaaa

SEQ ID NO: 649441 - RNA, 22 nt, Human
uuuacagaugaaucagcuuaca

SEQ ID NO: 649442 - RNA, 24 nt, Human
uuugucacccaggcuggagugcaa

SEQ ID NO: 649443 - RNA, 20 nt, Human
uuuugggcucaauacaaaua

SEQ ID NO: 649444 - RNA, 24 nt, Human
uuuuuuuuuuuugagauggagucu

SEQ ID NO: 649445 - RNA, 22 nt, Human
uuuuuuuuuuuuuugagaugga

SEQ ID NO: 649446 - RNA, 22 nt, Human
aaacuuagaagcucaacaagcu

SEQ ID NO: 649447 - RNA, 25 nt, Human
aagaaaaccugagcuagaacucagg

SEQ ID NO: 649448 - RNA, 24 nt, Human
aagaaacuuagaagcucaacaagc

SEQ ID NO: 649449 - RNA, 19 nt, Human
aagcucaacaagcugaaga

SEQ ID NO: 649450 - RNA, 19 nt, Human
aaugcuuauuugccaauga

SEQ ID NO: 649451 - RNA, 24 nt, Human
acaaaguauucuuuuccuucaaag

SEQ ID NO: 649452 - RNA, 21 nt, Human
agagauguuauccuggugccc

SEQ ID NO: 649453 - RNA, 25 nt, Human
aggaagcagacagauuuguuggcuc

SEQ ID NO: 649454 - RNA, 19 nt, Human
agguccaggaaggcagugg

SEQ ID NO: 649455 - RNA, 20 nt, Human
auaguucuguagaucccugu

SEQ ID NO: 649456 - RNA, 20 nt, Human
aucccaucaggcauuuccca

SEQ ID NO: 649457 - RNA, 21 nt, Human
caauucaagcagucauugucc

SEQ ID NO: 649458 - RNA, 24 nt, Human
cacaugaauuauuuucccaacuuc

SEQ ID NO: 649459 - RNA, 20 nt, Human
ccccucuuuccaggcccuuu

SEQ ID NO: 649460 - RNA, 18 nt, Human
ccugagcuagaacucagg

SEQ ID NO: 649461 - RNA, 19 nt, Human
cugaggcagcagccaaaga

SEQ ID NO: 649462 - RNA, 22 nt, Human
cugugcugaggcagcagccaaa

SEQ ID NO: 649463 - RNA, 23 nt, Human
ggccaggcagggucuggagaucu

SEQ ID NO: 649464 - RNA, 19 nt, Human
gguagaaugaagggaaaga

SEQ ID NO: 649465 - RNA, 21 nt, Human
guagaaugaagggaaagaaac

SEQ ID NO: 649466 - RNA, 26 nt, Human
guggagcugccgcugccuuccuuggu

SEQ ID NO: 649467 - RNA, 19 nt, Human
uacagaacuuggcuugcag

SEQ ID NO: 649468 - RNA, 19 nt, Human
uagaacucaggcauuucuc

SEQ ID NO: 649469 - RNA, 25 nt, Human
uauauguuuguugccuuaauuugaa

SEQ ID NO: 649470 - RNA, 19 nt, Human
uaucuuguucauauuggag

SEQ ID NO: 649471 - RNA, 23 nt, Human
uauucuuuuccuucaaagcuuca

SEQ ID NO: 649472 - RNA, 19 nt, Human
ucauuccucaaggccucaa

SEQ ID NO: 649473 - RNA, 21 nt, Human
ucccauaggccuugucaacuc

SEQ ID NO: 649474 - RNA, 25 nt, Human
ucugugcugaggcagcagccaaaga

SEQ ID NO: 649475 - RNA, 28 nt, Human
ucuugcucuuguuugcucacggucggac

SEQ ID NO: 649476 - RNA, 27 nt, Human
ucuugcucuuguuugcucacggucggc

SEQ ID NO: 649477 - RNA, 26 nt, Human
uggaagguauauguuuguugccuuaa

SEQ ID NO: 649478 - RNA, 25 nt, Human
uggagaucuaaauucagaguaagaa

SEQ ID NO: 649479 - RNA, 18 nt, Human
ugugaggaagcagacaga

SEQ ID NO: 649480 - RNA, 24 nt, Human
uguggccaggcagggucuggagau

SEQ ID NO: 649481 - RNA, 21 nt, Human
uuagaagcucaacaagcugaa

SEQ ID NO: 649482 - RNA, 20 nt, Human
uucagaguaagaaaaccuga

SEQ ID NO: 649483 - RNA, 19 nt, Human
uuccaggcccuuuucuacu

SEQ ID NO: 649484 - RNA, 26 nt, Human
uuguuggcuccccucuuuccaggccc

SEQ ID NO: 649485 - RNA, 22 nt, Human
aaccauggcucucgggaagcuu

SEQ ID NO: 649486 - RNA, 21 nt, Human
accccaccccacccuggguua

SEQ ID NO: 649487 - RNA, 24 nt, Human
agaccccuccaccccaccccaccc

SEQ ID NO: 649488 - RNA, 21 nt, Human
agagcccuuucaugcuacauu

SEQ ID NO: 649489 - RNA, 21 nt, Human
caccccaccccaccccacccu

SEQ ID NO: 649490 - RNA, 19 nt, Human
cagacagcuggaaucccac

SEQ ID NO: 649491 - RNA, 19 nt, Human
cagaccccuccaccccacc

SEQ ID NO: 649492 - RNA, 24 nt, Human
cagcuggaaucccaccgcgguguc

SEQ ID NO: 649493 - RNA, 18 nt, Human
ccaccccaccccacccca

SEQ ID NO: 649494 - RNA, 19 nt, Human
ccaccccaccccaccccac

SEQ ID NO: 649495 - RNA, 20 nt, Human
ccaccccaccccaccccacc

SEQ ID NO: 649496 - RNA, 18 nt, Human
ccaccccaccccacccug

SEQ ID NO: 649497 - RNA, 24 nt, Human
cccaccccaccccacccuggguua

SEQ ID NO: 649498 - RNA, 22 nt, Human
cccaccccacccuggguuagca

SEQ ID NO: 649499 - RNA, 18 nt, Human
ccccaccccacccugggu

SEQ ID NO: 649500 - RNA, 24 nt, Human
ccccaccccacccuggguuagcag

SEQ ID NO: 649501 - RNA, 25 nt, Human
ccccuccaccccaccccaccccacc

SEQ ID NO: 649502 - RNA, 19 nt, Human
ccuccaccccaccccaccc

SEQ ID NO: 649503 - RNA, 24 nt, Human
cggcguggagagcagugagcgccg

SEQ ID NO: 649504 - RNA, 23 nt, Human
cuacaagcagaccccuccacccc

SEQ ID NO: 649505 - RNA, 20 nt, Human
cuccaccccaccccacccca

SEQ ID NO: 649506 - RNA, 23 nt, Human
cugcacugcccauccuuacugua

SEQ ID NO: 649507 - RNA, 19 nt, Human
gaccccuccaccccacccc

SEQ ID NO: 649508 - RNA, 20 nt, Human
gcagccgcuccacgaggugc

SEQ ID NO: 649509 - RNA, 18 nt, Human
uaauccgacuccuccuug

SEQ ID NO: 649510 - RNA, 19 nt, Human
uauugcaguacaauuacuc

SEQ ID NO: 649511 - RNA, 20 nt, Human
uccaccccaccccaccccac

SEQ ID NO: 649512 - RNA, 18 nt, Human
ucccaccgcggugucuuc

SEQ ID NO: 649513 - RNA, 22 nt, Human
ugagaguacuacaagcagaccc

SEQ ID NO: 649514 - RNA, 21 nt, Human
ugagcgccuugcaggcugccu

SEQ ID NO: 649515 - RNA, 18 nt, Human
ugccuggaccaaccaugg

SEQ ID NO: 649516 - RNA, 22 nt, Human
uggagagcagugagcgccgaga

SEQ ID NO: 649517 - RNA, 20 nt, Human
uguuuuguuuuuuguuuuuu

SEQ ID NO: 649518 - RNA, 21 nt, Human
uuauugcaguacaauuacucc

SEQ ID NO: 649519 - RNA, 24 nt, Human
uucgguggaaauguccccggcgug

SEQ ID NO: 649520 - RNA, 19 nt, Human
uugcaggcugccuuuccag

SEQ ID NO: 649521 - RNA, 23 nt, Human
uuuguuuuguuuuuuguuuuuug

SEQ ID NO: 649522 - RNA, 18 nt, Human
uuuuuuuuuuuuuuuuug

SEQ ID NO: 649523 - RNA, 25 nt, Human
uuuuuuuuuuuuuuuuuguuuuguu

SEQ ID NO: 649524 - RNA, 24 nt, Human
uuuuuuuuuuuuuuuuuuuguuuu

SEQ ID NO: 649525 - RNA, 23 nt, Human
aagcaauaccuggauaccaagac

SEQ ID NO: 649526 - RNA, 21 nt, Human
accaagacucagagugaggau

SEQ ID NO: 649527 - RNA, 22 nt, Human
aggcugagccuuucgaccacaa

SEQ ID NO: 649528 - RNA, 22 nt, Human
agggauccaaaucucagacacc

SEQ ID NO: 649529 - RNA, 21 nt, Human
aggggcugcuucggucuccag

SEQ ID NO: 649530 - RNA, 18 nt, Human
auggagcucugagcccag

SEQ ID NO: 649531 - RNA, 18 nt, Human
caacucugugaagccaag

SEQ ID NO: 649532 - RNA, 19 nt, Human
cacuggcaggggcugaagu

SEQ ID NO: 649533 - RNA, 24 nt, Human
cagagcggacuccccucuccccua

SEQ ID NO: 649534 - RNA, 21 nt, Human
cauguccacagacuucaugua

SEQ ID NO: 649535 - RNA, 23 nt, Human
ccuccaaaguccugagaaaucaa

SEQ ID NO: 649536 - RNA, 18 nt, Human
cucagagugaggauaugg

SEQ ID NO: 649537 - RNA, 24 nt, Human
gagcugacaguuuugcugauccug

SEQ ID NO: 649538 - RNA, 18 nt, Human
gcagcagcuucuaaccaa

SEQ ID NO: 649539 - RNA, 19 nt, Human
ggagcugacaguuuugcug

SEQ ID NO: 649540 - RNA, 22 nt, Human
gggcugaaguccagaaauggug

SEQ ID NO: 649541 - RNA, 21 nt, Human
ggugacaguaagccugagaaa

SEQ ID NO: 649542 - RNA, 24 nt, Human
gucagagcccuccaaaguccugag

SEQ ID NO: 649543 - RNA, 19 nt, Human
gucuccagccacaacucug

SEQ ID NO: 649544 - RNA, 19 nt, Human
gugaagccaagccacgcgc

SEQ ID NO: 649545 - RNA, 18 nt, Human
guugcagcagcuucuaac

SEQ ID NO: 649546 - RNA, 21 nt, Human
guuuccuaccugugucaccuc

SEQ ID NO: 649547 - RNA, 25 nt, Human
uauaaugaugggagagggcaguugc

SEQ ID NO: 649548 - RNA, 22 nt, Human
ucagacaccaguuugaagcaau

SEQ ID NO: 649549 - RNA, 23 nt, Human
ucaggacagagcggacuccccuc

SEQ ID NO: 649550 - RNA, 18 nt, Human
uccaaaucucagacacca

SEQ ID NO: 649551 - RNA, 18 nt, Human
ugaaguccagaaauggug

SEQ ID NO: 649552 - RNA, 21 nt, Human
ugaugggagagggcaguugca

SEQ ID NO: 649553 - RNA, 23 nt, Human
uggauuuugggagcugacaguuu

SEQ ID NO: 649554 - RNA, 19 nt, Human
uggcaggggcugaagucca

SEQ ID NO: 649555 - RNA, 20 nt, Human
ugggagagggcaguugcagc

SEQ ID NO: 649556 - RNA, 21 nt, Human
ugggagagggcaguugcagca

SEQ ID NO: 649557 - RNA, 24 nt, Human
uggugucagagcccuccaaagucc

SEQ ID NO: 649558 - RNA, 21 nt, Human
uguagcucuagucauucuuau

SEQ ID NO: 649559 - RNA, 25 nt, Human
ugugacgggacccaggccucgugcc

SEQ ID NO: 649560 - RNA, 23 nt, Human
uguguagcucuagucauucuuau

SEQ ID NO: 649561 - RNA, 22 nt, Human
uguuuccuaccugugucaccuc

SEQ ID NO: 649562 - RNA, 21 nt, Human
uuccauccugugcacccagug

SEQ ID NO: 649563 - RNA, 24 nt, Human
uugcagcagcuucuaaccaagugu

SEQ ID NO: 649564 - RNA, 20 nt, Human
uuuuuuuuuuuuuuauaaga

SEQ ID NO: 649565 - RNA, 19 nt, Human
aaaaaaauaugaacacaca

SEQ ID NO: 649566 - RNA, 20 nt, Human
aaaaauacugcgggcgccgc

SEQ ID NO: 649567 - RNA, 21 nt, Human
aaacagaaaagguguggcuga

SEQ ID NO: 649568 - RNA, 23 nt, Human
aagcagaaggagaauggggggac

SEQ ID NO: 649569 - RNA, 22 nt, Human
aagcagaaggagaaugggucgg

SEQ ID NO: 649570 - RNA, 19 nt, Human
agagggcaagagaagcagg

SEQ ID NO: 649571 - RNA, 19 nt, Human
aggagggagcaggggcugc

SEQ ID NO: 649572 - RNA, 21 nt, Human
agggagcaggggcugcucgga

SEQ ID NO: 649573 - RNA, 23 nt, Human
agggcaagagaagcagaaggaga

SEQ ID NO: 649574 - RNA, 19 nt, Human
cagaagcaagcgauucggc

SEQ ID NO: 649575 - RNA, 20 nt, Human
cagcacugaaaaauacugcg

SEQ ID NO: 649576 - RNA, 20 nt, Human
cagcgcgggguggggcacgg

SEQ ID NO: 649577 - RNA, 25 nt, Human
caucaguagugacgcagccguggcc

SEQ ID NO: 649578 - RNA, 22 nt, Human
ccaggagggagcaggggcugcu

SEQ ID NO: 649579 - RNA, 25 nt, Human
ccggcgggcggcggugggggcccuu

SEQ ID NO: 649580 - RNA, 18 nt, Human
cggagcgggaucagaagc

SEQ ID NO: 649581 - RNA, 21 nt, Human
cggcacacaggcgcuuggcca

SEQ ID NO: 649582 - RNA, 24 nt, Human
cgggcggcggugggggcccguggc

SEQ ID NO: 649583 - RNA, 25 nt, Human
cgggcggcggugggggcccguggcc

SEQ ID NO: 649584 - RNA, 22 nt, Human
cuaccagaguaauucaagacgc

SEQ ID NO: 649585 - RNA, 18 nt, Human
cuccaggaggagcucggg

SEQ ID NO: 649586 - RNA, 24 nt, Human
cuccaggagggagcaggggcugcu

SEQ ID NO: 649587 - RNA, 18 nt, Human
cuccgacuugagaaugaa

SEQ ID NO: 649588 - RNA, 21 nt, Human
gagaagcagaaggagaauggg

SEQ ID NO: 649589 - RNA, 22 nt, Human
gagaagcagaaggagaauggga

SEQ ID NO: 649590 - RNA, 25 nt, Human
ggaaauacauauucugcggcaggga

SEQ ID NO: 649591 - RNA, 21 nt, Human
ggagcaggggcugcucggcca

SEQ ID NO: 649592 - RNA, 26 nt, Human
ggagcuugaggauaaggucccagagg

SEQ ID NO: 649593 - RNA, 19 nt, Human
ggcaagagaagcagaagga

SEQ ID NO: 649594 - RNA, 20 nt, Human
ggccugggcuuugccugcag

SEQ ID NO: 649595 - RNA, 23 nt, Human
ggcggcggugggggcccguggcc

SEQ ID NO: 649596 - RNA, 24 nt, Human
ggugacaagggucuccaggaggga

SEQ ID NO: 649597 - RNA, 20 nt, Human
gguuguggugcuaugaggag

SEQ ID NO: 649598 - RNA, 22 nt, Human
gugccgcccugggaaagguugg

SEQ ID NO: 649599 - RNA, 24 nt, Human
uaaaacuaacaaaaaaauaugaac

SEQ ID NO: 649600 - RNA, 21 nt, Human
uaaggucaagguugguaugug

SEQ ID NO: 649601 - RNA, 21 nt, Human
ucuccaggagggagcaggggc

SEQ ID NO: 649602 - RNA, 18 nt, Human
ugcauggacagcgcgggg

SEQ ID NO: 649603 - RNA, 23 nt, Human
ugcccuggagcuugaggauaagg

SEQ ID NO: 649604 - RNA, 22 nt, Human
ugccgcccugggaaagguuggu

SEQ ID NO: 649605 - RNA, 19 nt, Human
ugcucggccaggcugcccu

SEQ ID NO: 649606 - RNA, 23 nt, Human
ugcucggccaggcugcccuggag

SEQ ID NO: 649607 - RNA, 19 nt, Human
uggacagcgcggggugggg

SEQ ID NO: 649608 - RNA, 18 nt, Human
uggccugggcuuugccug

SEQ ID NO: 649609 - RNA, 19 nt, Human
ugguauguguugcuccgac

SEQ ID NO: 649610 - RNA, 21 nt, Human
uuggcagguuuagaaaauaaa

SEQ ID NO: 649611 - RNA, 20 nt, Human
uuggugugaagaagagggca

SEQ ID NO: 649612 - RNA, 19 nt, Human
uuuggugugaagaagaggg

SEQ ID NO: 649613 - RNA, 18 nt, Human
uuuuuuuuuuuuuuuuug

SEQ ID NO: 649614 - RNA, 23 nt, Human
uuuuuuuuuuuuuuuuuggcagg

SEQ ID NO: 649615 - RNA, 24 nt, Human
uuuuuuuuuuuuuuuuuggcaggu

SEQ ID NO: 649616 - RNA, 22 nt, Human
uuuuuuuuuuuuuuuuuuuggc

SEQ ID NO: 649617 - RNA, 24 nt, Human
aaagugcugggacugcaggcguga

SEQ ID NO: 649618 - RNA, 26 nt, Human
aagacagggccgccauagacaggaaa

SEQ ID NO: 649619 - RNA, 19 nt, Human
aagugcugggacugcaggc

SEQ ID NO: 649620 - RNA, 26 nt, Human
aagugcugggacugcaggcgugagcc

SEQ ID NO: 649621 - RNA, 24 nt, Human
accguguuggccaggcuggucuug

SEQ ID NO: 649622 - RNA, 23 nt, Human
acgccuuggccucccaaagugcu

SEQ ID NO: 649623 - RNA, 18 nt, Human
acgggguuucaccguguu

SEQ ID NO: 649624 - RNA, 23 nt, Human
acgggguuucaccguguuggcca

SEQ ID NO: 649625 - RNA, 24 nt, Human
acgggguuucaccguguuggccag

SEQ ID NO: 649626 - RNA, 25 nt, Human
acucuguugcccaggcuggagugca

SEQ ID NO: 649627 - RNA, 19 nt, Human
agagacgggguuucaccgu

SEQ ID NO: 649628 - RNA, 18 nt, Human
agccacacuucuggcacc

SEQ ID NO: 649629 - RNA, 21 nt, Human
agcugcugaaauaccgcccac

SEQ ID NO: 649630 - RNA, 25 nt, Human
aggcuggagugcaguggcgcgaucu

SEQ ID NO: 649631 - RNA, 24 nt, Human
aggugauccacacgccuuggccuc

SEQ ID NO: 649632 - RNA, 20 nt, Human
aguagagacgggguuucacc

SEQ ID NO: 649633 - RNA, 21 nt, Human
aguagagacgggguuucaccg

SEQ ID NO: 649634 - RNA, 20 nt, Human
agugcaguggcgcgaucucg

SEQ ID NO: 649635 - RNA, 23 nt, Human
agugcaguggcgcgaucucggcu

SEQ ID NO: 649636 - RNA, 24 nt, Human
agugcaguggcgcgaucucggcuc

SEQ ID NO: 649637 - RNA, 24 nt, Human
caaagugcugggacugcaggcgug

SEQ ID NO: 649638 - RNA, 30 nt, Human
caacauggucuucucuuugaugaaggcccu

SEQ ID NO: 649639 - RNA, 22 nt, Human
caagugauucucgugccucagc

SEQ ID NO: 649640 - RNA, 28 nt, Human
caagugauucucgugccucagccucccg

SEQ ID NO: 649641 - RNA, 24 nt, Human
caccacaccuggcuaauuuuugua

SEQ ID NO: 649642 - RNA, 21 nt, Human
caccguguuggccaggcuggu

SEQ ID NO: 649643 - RNA, 24 nt, Human
caccguguuggccaggcuggucuu

SEQ ID NO: 649644 - RNA, 24 nt, Human
cacucuguugcccaggcuggagug

SEQ ID NO: 649645 - RNA, 21 nt, Human
cacugcaaccuccgccuccca

SEQ ID NO: 649646 - RNA, 24 nt, Human
cagagucucacucuguugcccagg

SEQ ID NO: 649647 - RNA, 19 nt, Human
cagcugcugaaauaccgcc

SEQ ID NO: 649648 - RNA, 26 nt, Human
caggacagagcuggaggcucauccug

SEQ ID NO: 649649 - RNA, 21 nt, Human
caggcgugagccaccgcgccc

SEQ ID NO: 649650 - RNA, 22 nt, Human
ccaaagugcugggacugcaggc

SEQ ID NO: 649651 - RNA, 24 nt, Human
ccaaagugcugggacugcaggcgu

SEQ ID NO: 649652 - RNA, 20 nt, Human
ccacacacagcagaugagua

SEQ ID NO: 649653 - RNA, 24 nt, Human
cccaaagugcugggacugcaggcg

SEQ ID NO: 649654 - RNA, 20 nt, Human
cccagguucaagugauucuc

SEQ ID NO: 649655 - RNA, 20 nt, Human
cccagguucaagugauucuc

SEQ ID NO: 649656 - RNA, 21 nt, Human
cccgagccuccacucccucuu

SEQ ID NO: 649657 - RNA, 20 nt, Human
cccgaguaacugggacuaca

SEQ ID NO: 649658 - RNA, 25 nt, Human
cccggccaacauggucuucucuuug

SEQ ID NO: 649659 - RNA, 24 nt, Human
ccgccucccagguucaagugauuc

SEQ ID NO: 649660 - RNA, 22 nt, Human
ccucccagguucaagugauucu

SEQ ID NO: 649661 - RNA, 20 nt, Human
ccugaccucaggugauccac

SEQ ID NO: 649662 - RNA, 20 nt, Human
ccugaccucaggugauccac

SEQ ID NO: 649663 - RNA, 22 nt, Human
cgccucccagguucaagugauu

SEQ ID NO: 649664 - RNA, 21 nt, Human
cggaggccaggcgcagggggc

SEQ ID NO: 649665 - RNA, 24 nt, Human
cgggguuucaccguguuggccagg

SEQ ID NO: 649666 - RNA, 24 nt, Human
cguguuggccaggcuggucuugaa

SEQ ID NO: 649667 - RNA, 18 nt, Human
cuacugacucccaggccu

SEQ ID NO: 649668 - RNA, 24 nt, Human
cucacucuguugcccaggcuggag

SEQ ID NO: 649669 - RNA, 24 nt, Human
cucacugcaaccuccgccucccag

SEQ ID NO: 649670 - RNA, 19 nt, Human
cucccagguucaagugauu

SEQ ID NO: 649671 - RNA, 23 nt, Human
cucgugccucagccucccgagua

SEQ ID NO: 649672 - RNA, 23 nt, Human
cugcaaccuccgccucccagguu

SEQ ID NO: 649673 - RNA, 24 nt, Human
cugcaaccuccgccucccagguuc

SEQ ID NO: 649674 - RNA, 23 nt, Human
gaccucaggugauccacacgccu

SEQ ID NO: 649675 - RNA, 18 nt, Human
gacugcaggcgugagcca

SEQ ID NO: 649676 - RNA, 21 nt, Human
gacugcaggcgugagccaccg

SEQ ID NO: 649677 - RNA, 22 nt, Human
gacugcaggcgugagccaccgc

SEQ ID NO: 649678 - RNA, 24 nt, Human
gagacgggguuucaccguguuggc

SEQ ID NO: 649679 - RNA, 22 nt, Human
gaguaacugggacuacauaagc

SEQ ID NO: 649680 - RNA, 21 nt, Human
gauucucgugccucagccucc

SEQ ID NO: 649681 - RNA, 22 nt, Human
gcaaccuccgccucccagguuc

SEQ ID NO: 649682 - RNA, 19 nt, Human
gcagugccagggccaagaa

SEQ ID NO: 649683 - RNA, 19 nt, Human
gcccaggcuggagugcagu

SEQ ID NO: 649684 - RNA, 20 nt, Human
gcccaggcuggagugcagug

SEQ ID NO: 649685 - RNA, 19 nt, Human
gccccgagccuccacuccc

SEQ ID NO: 649686 - RNA, 22 nt, Human
gccuuggccucccaaagugcug

SEQ ID NO: 649687 - RNA, 23 nt, Human
gcuggucuugaacuccugaccuc

SEQ ID NO: 649688 - RNA, 24 nt, Human
ggcuggucuugaacuccugaccuc

SEQ ID NO: 649689 - RNA, 23 nt, Human
gggguuucaccguguuggccagg

SEQ ID NO: 649690 - RNA, 19 nt, Human
ggucuugaacuccugaccu

SEQ ID NO: 649691 - RNA, 20 nt, Human
guacagcucccacaacgccc

SEQ ID NO: 649692 - RNA, 23 nt, Human
guagagacgggguuucaccgugu

SEQ ID NO: 649693 - RNA, 24 nt, Human
gugauccacacgccuuggccuccc

SEQ ID NO: 649694 - RNA, 24 nt, Human
gugauucucgugccucagccuccc

SEQ ID NO: 649695 - RNA, 19 nt, Human
gugccucagccucccgagu

SEQ ID NO: 649696 - RNA, 22 nt, Human
gugccucagccucccgaguaac

SEQ ID NO: 649697 - RNA, 18 nt, Human
guggccccgagccuccac

SEQ ID NO: 649698 - RNA, 22 nt, Human
guggccccgagccuccacuccc

SEQ ID NO: 649699 - RNA, 23 nt, Human
uaauuuuuguauuuuuuaguaga

SEQ ID NO: 649700 - RNA, 25 nt, Human
uaauuuuuguauuuuuuaguagaga

SEQ ID NO: 649701 - RNA, 21 nt, Human
uacagcucccacaacgcccuc

SEQ ID NO: 649702 - RNA, 24 nt, Human
uacauaagcgugagccaccacacc

SEQ ID NO: 649703 - RNA, 26 nt, Human
uaccgcccacguuugccaugcugcac

SEQ ID NO: 649704 - RNA, 19 nt, Human
uaggaaacuacugacuccc

SEQ ID NO: 649705 - RNA, 22 nt, Human
uaggaccaggagcagcguccgc

SEQ ID NO: 649706 - RNA, 21 nt, Human
uaguagagacgggguuucacc

SEQ ID NO: 649707 - RNA, 24 nt, Human
uaguagagacgggguuucaccgug

SEQ ID NO: 649708 - RNA, 26 nt, Human
uaguagagacgggguuucaccguguu

SEQ ID NO: 649709 - RNA, 24 nt, Human
ucaccguguuggccaggcuggucu

SEQ ID NO: 649710 - RNA, 24 nt, Human
ucacucuguugcccaggcuggagu

SEQ ID NO: 649711 - RNA, 19 nt, Human
ucacugcaaccuccgccuc

SEQ ID NO: 649712 - RNA, 24 nt, Human
ucacugcaaccuccgccucccagg

SEQ ID NO: 649713 - RNA, 25 nt, Human
ucacugcaaccuccgccucccaggu

SEQ ID NO: 649714 - RNA, 27 nt, Human
ucacugcaaccuccgccucccagguuc

SEQ ID NO: 649715 - RNA, 18 nt, Human
ucccaaagugcugggacu

SEQ ID NO: 649716 - RNA, 24 nt, Human
ucccaaagugcugggacugcaggc

SEQ ID NO: 649717 - RNA, 18 nt, Human
ucccaggccugagccucu

SEQ ID NO: 649718 - RNA, 21 nt, Human
ucccagguucaagugauucuc

SEQ ID NO: 649719 - RNA, 21 nt, Human
ucccagguucaagugauucuc

SEQ ID NO: 649720 - RNA, 23 nt, Human
ucucacucuguugcccaggcugg

SEQ ID NO: 649721 - RNA, 24 nt, Human
ucucacucuguugcccaggcugga

SEQ ID NO: 649722 - RNA, 26 nt, Human
ucucacucuguugcccaggcuggagu

SEQ ID NO: 649723 - RNA, 27 nt, Human
ucucacucuguugcccaggcuggagug

SEQ ID NO: 649724 - RNA, 18 nt, Human
ucuccuggcgucuuggcu

SEQ ID NO: 649725 - RNA, 22 nt, Human
ucuggcaccacacacagcagau

SEQ ID NO: 649726 - RNA, 18 nt, Human
ucuguugcccaggcugga

SEQ ID NO: 649727 - RNA, 24 nt, Human
ucuguugcccaggcuggagugcag

SEQ ID NO: 649728 - RNA, 23 nt, Human
ucuugaacuccugaccucaggug

SEQ ID NO: 649729 - RNA, 24 nt, Human
ugaaauaccgcccacguuugccau

SEQ ID NO: 649730 - RNA, 23 nt, Human
ugaccucaggugauccacacgcc

SEQ ID NO: 649731 - RNA, 24 nt, Human
ugaccucaggugauccacacgccu

SEQ ID NO: 649732 - RNA, 25 nt, Human
ugaccucaggugauccacacgccuu

SEQ ID NO: 649733 - RNA, 25 nt, Human
ugacucccaggccugagccucuccu

SEQ ID NO: 649734 - RNA, 18 nt, Human
ugagacagagucucacuc

SEQ ID NO: 649735 - RNA, 22 nt, Human
ugagacagagucucacucuguu

SEQ ID NO: 649736 - RNA, 20 nt, Human
ugaguacagccauuaggacc

SEQ ID NO: 649737 - RNA, 23 nt, Human
ugccagggccaagaagacagggc

SEQ ID NO: 649738 - RNA, 18 nt, Human
ugcccaggcuggagugca

SEQ ID NO: 649739 - RNA, 21 nt, Human
ugcccaggcuggagugcagug

SEQ ID NO: 649740 - RNA, 22 nt, Human
ugcccaggcuggagugcagugg

SEQ ID NO: 649741 - RNA, 24 nt, Human
ugcccaggcuggagugcaguggcg

SEQ ID NO: 649742 - RNA, 24 nt, Human
ugccucagccucccgaguaacugg

SEQ ID NO: 649743 - RNA, 23 nt, Human
uggagugcaguggcgcgaucucg

SEQ ID NO: 649744 - RNA, 24 nt, Human
uggagugcaguggcgcgaucucgg

SEQ ID NO: 649745 - RNA, 24 nt, Human
uggccaggcuggucuugaacuccu

SEQ ID NO: 649746 - RNA, 24 nt, Human
ugggacuacauaagcgugagccac

SEQ ID NO: 649747 - RNA, 26 nt, Human
ugggacuacauaagcgugagccacca

SEQ ID NO: 649748 - RNA, 18 nt, Human
ugggacugcaggcgugag

SEQ ID NO: 649749 - RNA, 19 nt, Human
ugggacugcaggcgugagc

SEQ ID NO: 649750 - RNA, 21 nt, Human
ugggacugcaggcgugagcca

SEQ ID NO: 649751 - RNA, 23 nt, Human
ugggacugcaggcgugagccacc

SEQ ID NO: 649752 - RNA, 24 nt, Human
ugggacugcaggcgugagccaccg

SEQ ID NO: 649753 - RNA, 19 nt, Human
uggggaggccgggccucgg

SEQ ID NO: 649754 - RNA, 18 nt, Human
uuaguagagacgggguuu

SEQ ID NO: 649755 - RNA, 22 nt, Human
uuaguagagacgggguuucacc

SEQ ID NO: 649756 - RNA, 24 nt, Human
uuaguagagacgggguuucaccgu

SEQ ID NO: 649757 - RNA, 23 nt, Human
uucaagugauucucgugccucag

SEQ ID NO: 649758 - RNA, 24 nt, Human
uuucaccguguuggccaggcuggu

SEQ ID NO: 649759 - RNA, 22 nt, Human
uuuuguauuuuuuaguagagac

SEQ ID NO: 649760 - RNA, 24 nt, Human
uuuuuaguagagacgggguuucac

SEQ ID NO: 649761 - RNA, 21 nt, Human
uuuuuguauuuuuuaguagag

SEQ ID NO: 649762 - RNA, 23 nt, Human
uuuuuuaguagagacgggguuuc

SEQ ID NO: 649763 - RNA, 20 nt, Human
uuuuuuuuuuugagacagag

SEQ ID NO: 649764 - RNA, 26 nt, Human
uuuuuuuuuuuugagacagagucuca

SEQ ID NO: 649765 - RNA, 18 nt, Human
uuuuuuuuuuuuuuuuug

SEQ ID NO: 649766 - RNA, 22 nt, Human
aagcacgcacaaaauggaguga

SEQ ID NO: 649767 - RNA, 22 nt, Human
aggaaagagaaccagguggccu

SEQ ID NO: 649768 - RNA, 18 nt, Human
cugcgcaaugaauugugg

SEQ ID NO: 649769 - RNA, 19 nt, Human
cugcgcaaugaauugugga

SEQ ID NO: 649770 - RNA, 20 nt, Human
gaaagcacgcacaaaaugga

SEQ ID NO: 649771 - RNA, 18 nt, Human
gggagaaacaaggaggcu

SEQ ID NO: 649772 - RNA, 20 nt, Human
ucacugggagaaacaaggag

SEQ ID NO: 649773 - RNA, 20 nt, Human
ucacugggagaaacaaggag

SEQ ID NO: 649774 - RNA, 19 nt, Human
uggagcacaaauuucacaa

SEQ ID NO: 649775 - RNA, 20 nt, Human
ugggagaaacaaggaggcuu

SEQ ID NO: 649776 - RNA, 23 nt, Human
uuuuuugacacuucauaaauguu

SEQ ID NO: 649777 - RNA, 18 nt, Human
uuuuuuuuuuuuuuuuug

SEQ ID NO: 649778 - RNA, 18 nt, Human
aaaaggagugggguggag

SEQ ID NO: 649779 - RNA, 22 nt, Human
aaacaaacgcccugucuggaac

SEQ ID NO: 649780 - RNA, 19 nt, Human
aaacauuucccaggacauc

SEQ ID NO: 649781 - RNA, 19 nt, Human
aaaugcacugaggcugggc

SEQ ID NO: 649782 - RNA, 22 nt, Human
aaaugcuucuguccaaacucca

SEQ ID NO: 649783 - RNA, 18 nt, Human
aagccgcccccgaccccg

SEQ ID NO: 649784 - RNA, 20 nt, Human
aagccgcccccgaccccggc

SEQ ID NO: 649785 - RNA, 21 nt, Human
aagccgcuagaaacuggggcc

SEQ ID NO: 649786 - RNA, 18 nt, Human
aaggugccagucuacaug

SEQ ID NO: 649787 - RNA, 31 nt, Human
aaucuucaaggugccagucuacaugcccaaa

SEQ ID NO: 649788 - RNA, 23 nt, Human
aaugcacugaggcugggcaaugg

SEQ ID NO: 649789 - RNA, 20 nt, Human
acaagcggcagagagggaag

SEQ ID NO: 649790 - RNA, 20 nt, Human
acagcaguggaggcaucagu

SEQ ID NO: 649791 - RNA, 22 nt, Human
accacagagggcagggagugac

SEQ ID NO: 649792 - RNA, 23 nt, Human
accaccacagagggcagggagug

SEQ ID NO: 649793 - RNA, 21 nt, Human
acgccgcaaaggcgagcacac

SEQ ID NO: 649794 - RNA, 24 nt, Human
acggagcuggcugugggcuggggg

SEQ ID NO: 649795 - RNA, 24 nt, Human
acuggcuuuucucgugagucuuuc

SEQ ID NO: 649796 - RNA, 23 nt, Human
agaaaaacagugaccaccacaga

SEQ ID NO: 649797 - RNA, 21 nt, Human
agaaaaccaccagccagccca

SEQ ID NO: 649798 - RNA, 19 nt, Human
agagaaaaacagugaccac

SEQ ID NO: 649799 - RNA, 21 nt, Human
agagggcagggagugacaaag

SEQ ID NO: 649800 - RNA, 22 nt, Human
agccgcuagaaacuggggccac

SEQ ID NO: 649801 - RNA, 24 nt, Human
agcuguucgccucuuccugacccc

SEQ ID NO: 649802 - RNA, 19 nt, Human
aggaaaacauuucccagga

SEQ ID NO: 649803 - RNA, 24 nt, Human
aggacauccucagguuggucucca

SEQ ID NO: 649804 - RNA, 19 nt, Human
aggagaugccaaccucagc

SEQ ID NO: 649805 - RNA, 22 nt, Human
agggaggaaggcauggacaaaa

SEQ ID NO: 649806 - RNA, 21 nt, Human
agggcagggagugacaaagcu

SEQ ID NO: 649807 - RNA, 19 nt, Human
aggggcuggggcaggugca

SEQ ID NO: 649808 - RNA, 19 nt, Human
auccgcgcgacgggcccac

SEQ ID NO: 649809 - RNA, 18 nt, Human
auucacuccagagucccg

SEQ ID NO: 649810 - RNA, 24 nt, Human
caaaacaaacgcccugucuggaac

SEQ ID NO: 649811 - RNA, 22 nt, Human
caaaggcgagcacacaccgcca

SEQ ID NO: 649812 - RNA, 21 nt, Human
caaagggcacgccucuaggac

SEQ ID NO: 649813 - RNA, 21 nt, Human
caaaguaagcauuugccaaau

SEQ ID NO: 649814 - RNA, 19 nt, Human
caccacagagggcagggag

SEQ ID NO: 649815 - RNA, 21 nt, Human
cacucuauccgcucacaggaa

SEQ ID NO: 649816 - RNA, 24 nt, Human
cagacacaaggacaagcggcagag

SEQ ID NO: 649817 - RNA, 26 nt, Human
cagaguucagagccccagagccaccc

SEQ ID NO: 649818 - RNA, 21 nt, Human
cagcacaaggacuuggagcag

SEQ ID NO: 649819 - RNA, 20 nt, Human
cagcccagacacaaggacaa

SEQ ID NO: 649820 - RNA, 18 nt, Human
cagcgagcagcgcggggg

SEQ ID NO: 649821 - RNA, 23 nt, Human
caggaagagcaccagucaggagg

SEQ ID NO: 649822 - RNA, 18 nt, Human
cauggggucuccaggcug

SEQ ID NO: 649823 - RNA, 19 nt, Human
ccaagccugagauccuacc

SEQ ID NO: 649824 - RNA, 21 nt, Human
ccacccgggauguggcggcaa

SEQ ID NO: 649825 - RNA, 23 nt, Human
ccagacacaaggacaagcggcag

SEQ ID NO: 649826 - RNA, 20 nt, Human
cccagaggccacuguugccu

SEQ ID NO: 649827 - RNA, 18 nt, Human
cccagaugcagguguggc

SEQ ID NO: 649828 - RNA, 25 nt, Human
cccgaccccggcgcuagccucgaug

SEQ ID NO: 649829 - RNA, 22 nt, Human
cccgauaucuggcugccacaau

SEQ ID NO: 649830 - RNA, 20 nt, Human
cccgcugcugccgcccugga

SEQ ID NO: 649831 - RNA, 18 nt, Human
cccggccccaagccugag

SEQ ID NO: 649832 - RNA, 29 nt, Human
cccggccccaagccugagauccgguuccg

SEQ ID NO: 649833 - RNA, 22 nt, Human
ccgccaugccgcccagugaccc

SEQ ID NO: 649834 - RNA, 22 nt, Human
ccgcccagugacccuccgugcc

SEQ ID NO: 649835 - RNA, 19 nt, Human
ccgguagagaaauggggau

SEQ ID NO: 649836 - RNA, 19 nt, Human
ccgugcccggcagcgacgg

SEQ ID NO: 649837 - RNA, 20 nt, Human
ccucggggucuguguccggc

SEQ ID NO: 649838 - RNA, 18 nt, Human
ccucuaggacugcguccc

SEQ ID NO: 649839 - RNA, 25 nt, Human
ccugagauccuaccaacuucccgag

SEQ ID NO: 649840 - RNA, 23 nt, Human
ccuguguggaccacucacugcuu

SEQ ID NO: 649841 - RNA, 24 nt, Human
cgcccccgaccccggcgcuagccu

SEQ ID NO: 649842 - RNA, 21 nt, Human
cgcgcgacgggcccacgccgc

SEQ ID NO: 649843 - RNA, 22 nt, Human
cgcuggggacgcccacucgggc

SEQ ID NO: 649844 - RNA, 22 nt, Human
cggcagcgacgcgaagaucucc

SEQ ID NO: 649845 - RNA, 23 nt, Human
cggccgccgccgucucggccggg

SEQ ID NO: 649846 - RNA, 19 nt, Human
cgggggcggcggcgagggg

SEQ ID NO: 649847 - RNA, 20 nt, Human
cucacggcaacgccuccucc

SEQ ID NO: 649848 - RNA, 21 nt, Human
cuccaaagcuggaggggcugg

SEQ ID NO: 649849 - RNA, 28 nt, Human
cuccuggcaccuguguggaccacucacu

SEQ ID NO: 649850 - RNA, 18 nt, Human
cugugcccaucacaccug

SEQ ID NO: 649851 - RNA, 19 nt, Human
cuucaggagaugccaaccu

SEQ ID NO: 649852 - RNA, 19 nt, Human
cuuccugacccccucccag

SEQ ID NO: 649853 - RNA, 22 nt, Human
cuuggcuccaaagcuggagggg

SEQ ID NO: 649854 - RNA, 27 nt, Human
gacacaaggacaagcggcagagaggga

SEQ ID NO: 649855 - RNA, 20 nt, Human
gagacaguggccggcagccg

SEQ ID NO: 649856 - RNA, 19 nt, Human
gagacaguggccggcagcu

SEQ ID NO: 649857 - RNA, 21 nt, Human
gagagggaaggcucgcugggg

SEQ ID NO: 649858 - RNA, 18 nt, Human
gagcuggcugugggcugg

SEQ ID NO: 649859 - RNA, 22 nt, Human
gaucuccaccagcagcucgggc

SEQ ID NO: 649860 - RNA, 21 nt, Human
gcaaaggcgagcacacaccgc

SEQ ID NO: 649861 - RNA, 19 nt, Human
gcaacgccuccuccagaug

SEQ ID NO: 649862 - RNA, 20 nt, Human
gcaccuguguggaccacuca

SEQ ID NO: 649863 - RNA, 21 nt, Human
gccaugccgcccagugacccu

SEQ ID NO: 649864 - RNA, 18 nt, Human
gcccagggugcgggaacc

SEQ ID NO: 649865 - RNA, 19 nt, Human
gcccggcagcgacgcgaag

SEQ ID NO: 649866 - RNA, 18 nt, Human
gccgggccccggcgcugc

SEQ ID NO: 649867 - RNA, 22 nt, Human
gccucuuccugacccccuccca

SEQ ID NO: 649868 - RNA, 21 nt, Human
gcgcacaagccgcccccgacc

SEQ ID NO: 649869 - RNA, 21 nt, Human
ggacgcccacucgggcacgga

SEQ ID NO: 649870 - RNA, 22 nt, Human
ggagaugccaaccucagccaag

SEQ ID NO: 649871 - RNA, 18 nt, Human
ggaggguccugcuucccg

SEQ ID NO: 649872 - RNA, 18 nt, Human
ggcaagagagaaaaacag

SEQ ID NO: 649873 - RNA, 19 nt, Human
ggcagggagugacaaagcu

SEQ ID NO: 649874 - RNA, 21 nt, Human
ggcagggagugacaaagcuug

SEQ ID NO: 649875 - RNA, 18 nt, Human
ggcgaggggcccgcgcac

SEQ ID NO: 649876 - RNA, 20 nt, Human
ggcggcagcuccagcagcga

SEQ ID NO: 649877 - RNA, 20 nt, Human
ggcuggggcaggugcauggg

SEQ ID NO: 649878 - RNA, 19 nt, Human
ggcuguccccuacaucugc

SEQ ID NO: 649879 - RNA, 18 nt, Human
ggcugugggcugggggaa

SEQ ID NO: 649880 - RNA, 19 nt, Human
gggcggcagcuccagcagc

SEQ ID NO: 649881 - RNA, 22 nt, Human
gggcugggggaagggccagcuc

SEQ ID NO: 649882 - RNA, 19 nt, Human
gggugcgggaaccccaccg

SEQ ID NO: 649883 - RNA, 18 nt, Human
ggguggagcacaugcguc

SEQ ID NO: 649884 - RNA, 24 nt, Human
gguggggaagcugagaucagaggu

SEQ ID NO: 649885 - RNA, 21 nt, Human
gucccacagugugcucuucaa

SEQ ID NO: 649886 - RNA, 25 nt, Human
guccccacacgcagguguuaacaca

SEQ ID NO: 649887 - RNA, 21 nt, Human
gucuccacaccaaggcacaca

SEQ ID NO: 649888 - RNA, 25 nt, Human
gucucggccgggccccggcgcugcu

SEQ ID NO: 649889 - RNA, 22 nt, Human
guucagagccccagagccaccc

SEQ ID NO: 649890 - RNA, 19 nt, Human
uagguccgugcccggcagg

SEQ ID NO: 649891 - RNA, 22 nt, Human
uauggcccgauaucuggcugcc

SEQ ID NO: 649892 - RNA, 20 nt, Human
uaugucacacucucuacaua

SEQ ID NO: 649893 - RNA, 20 nt, Human
ucaccgucacucagagacug

SEQ ID NO: 649894 - RNA, 24 nt, Human
ucagcaguccuccguauggcccga

SEQ ID NO: 649895 - RNA, 23 nt, Human
uccaaagcuggaggggcuggggc

SEQ ID NO: 649896 - RNA, 19 nt, Human
uccaagcaagccgguagag

SEQ ID NO: 649897 - RNA, 24 nt, Human
uccaagcaagccgguagagaaaug

SEQ ID NO: 649898 - RNA, 19 nt, Human
ucccagaggccacuguugc

SEQ ID NO: 649899 - RNA, 22 nt, Human
ucccaggacauccucagguugg

SEQ ID NO: 649900 - RNA, 19 nt, Human
ucccccaaaaggagugggg

SEQ ID NO: 649901 - RNA, 21 nt, Human
ucccgaggucccucaccagca

SEQ ID NO: 649902 - RNA, 22 nt, Human
ucccuuagagcgaggcucgggc

SEQ ID NO: 649903 - RNA, 25 nt, Human
ucccuuagagcgaggcucgggcucc

SEQ ID NO: 649904 - RNA, 23 nt, Human
uccgcgcgacgggcccacgccgc

SEQ ID NO: 649905 - RNA, 19 nt, Human
ucgcuggggacgcccacuc

SEQ ID NO: 649906 - RNA, 22 nt, Human
ucgcuggggacgcccacucggg

SEQ ID NO: 649907 - RNA, 18 nt, Human
ucgcugucggccgccgcc

SEQ ID NO: 649908 - RNA, 21 nt, Human
ucuagaaagcuguccccucac

SEQ ID NO: 649909 - RNA, 22 nt, Human
ucuccacaccaaggcacacaga

SEQ ID NO: 649910 - RNA, 22 nt, Human
ugaaaugcuucuguccaaacuc

SEQ ID NO: 649911 - RNA, 21 nt, Human
ugagauccuaccaacuucccc

SEQ ID NO: 649912 - RNA, 19 nt, Human
ugcacugaggcugggcaau

SEQ ID NO: 649913 - RNA, 24 nt, Human
ugcagaccugggccaagcugggua

SEQ ID NO: 649914 - RNA, 25 nt, Human
ugccagucuacaugcccaacagucc

SEQ ID NO: 649915 - RNA, 22 nt, Human
ugcccagcacaaggacuuggag

SEQ ID NO: 649916 - RNA, 21 nt, Human
ugcgccggaacuucgugcaga

SEQ ID NO: 649917 - RNA, 24 nt, Human
ugcgugcagggaggaaggcaugga

SEQ ID NO: 649918 - RNA, 24 nt, Human
ugcucagcuucuuccaucauggca

SEQ ID NO: 649919 - RNA, 18 nt, Human
ugcuggcggcgccgacau

SEQ ID NO: 649920 - RNA, 19 nt, Human
uggagccuugcguucugga

SEQ ID NO: 649921 - RNA, 20 nt, Human
uggaggggcuggggcaggug

SEQ ID NO: 649922 - RNA, 23 nt, Human
uggcaagagagaaaaacaguggc

SEQ ID NO: 649923 - RNA, 18 nt, Human
uggcuggacugggccccc

SEQ ID NO: 649924 - RNA, 21 nt, Human
uggggcaggugcaugggcugg

SEQ ID NO: 649925 - RNA, 22 nt, Human
uggggccacacacaagagccag

SEQ ID NO: 649926 - RNA, 22 nt, Human
ugucuggaacaggccgucgagg

SEQ ID NO: 649927 - RNA, 20 nt, Human
uucaaggccacagucaccgu

SEQ ID NO: 649928 - RNA, 20 nt, Human
uucaucaggaaaacauuucc

SEQ ID NO: 649929 - RNA, 21 nt, Human
uuccugacccccucccagagg

SEQ ID NO: 649930 - RNA, 23 nt, Human
uucgccucuuccugacccccucc

SEQ ID NO: 649931 - RNA, 23 nt, Human
uuuaaucagaagcacgugcgucc

SEQ ID NO: 649932 - RNA, 20 nt, Human
uuucgcaaacaccauacucc

SEQ ID NO: 649933 - RNA, 23 nt, Human
uuucgcaaacaccauacuccuca

SEQ ID NO: 649934 - RNA, 19 nt, Human
uuuuuuuuuuuugagaucu

SEQ ID NO: 649935 - RNA, 18 nt, Human
uuuuuuuuuuuuuuuuug

SEQ ID NO: 649936 - RNA, 22 nt, Human
aaaaaaaaaaaaccacaaagaa

SEQ ID NO: 649937 - RNA, 25 nt, Human
aaaacaguaaagauuaaugggaaag

SEQ ID NO: 649938 - RNA, 22 nt, Human
aaaaugccacacauacauguag

SEQ ID NO: 649939 - RNA, 24 nt, Human
aaaucagucuguaaaccauccuga

SEQ ID NO: 649940 - RNA, 23 nt, Human
aaccucacucccaccucuuucac

SEQ ID NO: 649941 - RNA, 22 nt, Human
aaccuggucugggaaggggcau

SEQ ID NO: 649942 - RNA, 19 nt, Human
aagaaacaaagugggggcc

SEQ ID NO: 649943 - RNA, 25 nt, Human
aagaagcauccccaauuagcaagcc

SEQ ID NO: 649944 - RNA, 20 nt, Human
acaagaaauuuucccaucuc

SEQ ID NO: 649945 - RNA, 23 nt, Human
acaccccuguccaccaggaaucc

SEQ ID NO: 649946 - RNA, 24 nt, Human
acauacagcucaugcacacacauc

SEQ ID NO: 649947 - RNA, 23 nt, Human
accgggcacucgcgcacggaggc

SEQ ID NO: 649948 - RNA, 21 nt, Human
acuuaaacagcgacagugaug

SEQ ID NO: 649949 - RNA, 21 nt, Human
agaaaaccucacucccaccuc

SEQ ID NO: 649950 - RNA, 19 nt, Human
agaaaagaguuaguacacc

SEQ ID NO: 649951 - RNA, 21 nt, Human
agaagcuccccacucaguagc

SEQ ID NO: 649952 - RNA, 20 nt, Human
agacaaacacaguccaaaca

SEQ ID NO: 649953 - RNA, 18 nt, Human
agacagaucugacacccc

SEQ ID NO: 649954 - RNA, 19 nt, Human
agacagaucugacaccccu

SEQ ID NO: 649955 - RNA, 27 nt, Human
agcagccaggggaguugauguggaaga

SEQ ID NO: 649956 - RNA, 26 nt, Human
agcgacagugaugacuccaaaaaaaa

SEQ ID NO: 649957 - RNA, 25 nt, Human
aggaggcccuagcgggaggcagccc

SEQ ID NO: 649958 - RNA, 26 nt, Human
aggcacaaaagcagcaaacagcagaa

SEQ ID NO: 649959 - RNA, 18 nt, Human
aggcagccugcugcggag

SEQ ID NO: 649960 - RNA, 19 nt, Human
aggcccuagcgggaggcag

SEQ ID NO: 649961 - RNA, 22 nt, Human
agucuguaaaccauccugaguc

SEQ ID NO: 649962 - RNA, 19 nt, Human
aguugugagaggcaaaguc

SEQ ID NO: 649963 - RNA, 21 nt, Human
auacccgcacacagacacaca

SEQ ID NO: 649964 - RNA, 21 nt, Human
augggagcacaaaagccucac

SEQ ID NO: 649965 - RNA, 18 nt, Human
caaaaaugccacacauac

SEQ ID NO: 649966 - RNA, 24 nt, Human
caaaaaugccacacauacauguag

SEQ ID NO: 649967 - RNA, 18 nt, Human
caaaagcagcaaacagca

SEQ ID NO: 649968 - RNA, 23 nt, Human
caacagagacauggauggacacg

SEQ ID NO: 649969 - RNA, 23 nt, Human
caacagccacgacauucagcaau

SEQ ID NO: 649970 - RNA, 20 nt, Human
cacacacacacacacacaca

SEQ ID NO: 649971 - RNA, 26 nt, Human
cacacacacacacacacacagccuca

SEQ ID NO: 649972 - RNA, 24 nt, Human
cagaaaagaguuaguacaccacaa

SEQ ID NO: 649973 - RNA, 20 nt, Human
cagcacccacugccugcucc

SEQ ID NO: 649974 - RNA, 20 nt, Human
cagcacccacugccugcucu

SEQ ID NO: 649975 - RNA, 19 nt, Human
cagcagccaggggaguuga

SEQ ID NO: 649976 - RNA, 23 nt, Human
cagcccauaaauauuuuuaacca

SEQ ID NO: 649977 - RNA, 20 nt, Human
cagcgacagugaugacucca

SEQ ID NO: 649978 - RNA, 22 nt, Human
cagcgacagugaugacuccaaa

SEQ ID NO: 649979 - RNA, 23 nt, Human
cagcgacagugaugacuccaaaa

SEQ ID NO: 649980 - RNA, 21 nt, Human
caggauccugccucuuccagg

SEQ ID NO: 649981 - RNA, 25 nt, Human
caggauccugccucuuccagggccg

SEQ ID NO: 649982 - RNA, 23 nt, Human
cagggccaugcaggucuccauga

SEQ ID NO: 649983 - RNA, 20 nt, Human
caggucuuucccuacacugu

SEQ ID NO: 649984 - RNA, 23 nt, Human
caugcacacacaucagcacccac

SEQ ID NO: 649985 - RNA, 23 nt, Human
ccaacagccacgacauucagcaa

SEQ ID NO: 649986 - RNA, 20 nt, Human
ccaggaaucccacccauacc

SEQ ID NO: 649987 - RNA, 19 nt, Human
cccaauuagcaagccucag

SEQ ID NO: 649988 - RNA, 20 nt, Human
cccaucucuggcccccucca

SEQ ID NO: 649989 - RNA, 25 nt, Human
cccccucccaacaacuaucugacuc

SEQ ID NO: 649990 - RNA, 19 nt, Human
ccccugugaauuacccaag

SEQ ID NO: 649991 - RNA, 20 nt, Human
cccuccauuagaaaugaaau

SEQ ID NO: 649992 - RNA, 20 nt, Human
ccucacucccaccucuuuca

SEQ ID NO: 649993 - RNA, 20 nt, Human
ccucagugaugacuuagcac

SEQ ID NO: 649994 - RNA, 20 nt, Human
cgcacacacacacacacaca

SEQ ID NO: 649995 - RNA, 20 nt, Human
cgcgcacacacacacacagu

SEQ ID NO: 649996 - RNA, 28 nt, Human
cgcgcacacaccgggcacucgcgcacgg

SEQ ID NO: 649997 - RNA, 24 nt, Human
cgggacuccagaggugauggaaag

SEQ ID NO: 649998 - RNA, 20 nt, Human
cgggccccugcucucgccgg

SEQ ID NO: 649999 - RNA, 23 nt, Human
cguccagacgggacuccagaggu

SEQ ID NO: 650000 - RNA, 19 nt, Human
cuaagaagcauccccaauu

SEQ ID NO: 650001 - RNA, 20 nt, Human
cuaaugcucccuuuaagacu

SEQ ID NO: 650002 - RNA, 24 nt, Human
cucaugcacacacaucagcaccca

SEQ ID NO: 650003 - RNA, 19 nt, Human
cuggcccccuccauuagaa

SEQ ID NO: 650004 - RNA, 24 nt, Human
cuuaaacagcgacagugaugacuc

SEQ ID NO: 650005 - RNA, 22 nt, Human
cuucauaagcccaucaccagca

SEQ ID NO: 650006 - RNA, 20 nt, Human
cuucuuuacacucaccacca

SEQ ID NO: 650007 - RNA, 26 nt, Human
gacagugaugacuccaaaaaaaaugg

SEQ ID NO: 650008 - RNA, 22 nt, Human
gagcacaaaagccucacaaaac

SEQ ID NO: 650009 - RNA, 23 nt, Human
gaguucgggccgcggcgggcggg

SEQ ID NO: 650010 - RNA, 22 nt, Human
gaucugacaccccuguccacca

SEQ ID NO: 650011 - RNA, 26 nt, Human
gcaaagucuucuuuacacucaccacc

SEQ ID NO: 650012 - RNA, 18 nt, Human
gcaggaagggacguccag

SEQ ID NO: 650013 - RNA, 22 nt, Human
gccuucccaggaauccuaaccu

SEQ ID NO: 650014 - RNA, 23 nt, Human
gcgcacacacacacacacacaca

SEQ ID NO: 650015 - RNA, 26 nt, Human
gcgcacacacacacacacacacagcc

SEQ ID NO: 650016 - RNA, 23 nt, Human
gcgcacacacacacacacacagg

SEQ ID NO: 650017 - RNA, 18 nt, Human
gcgggcggggagccgggc

SEQ ID NO: 650018 - RNA, 23 nt, Human
gcucaugcaccccaauuacagca

SEQ ID NO: 650019 - RNA, 20 nt, Human
ggaaucccacccauacccgc

SEQ ID NO: 650020 - RNA, 22 nt, Human
ggaaucccacccauacccgcac

SEQ ID NO: 650021 - RNA, 20 nt, Human
ggagggguucggccgaggcg

SEQ ID NO: 650022 - RNA, 23 nt, Human
ggauccugccucuuccagggccg

SEQ ID NO: 650023 - RNA, 30 nt, Human
ggcacaaaagcagcaaacagcagaaggaaa

SEQ ID NO: 650024 - RNA, 22 nt, Human
ggccaugcaggucuccaugaga

SEQ ID NO: 650025 - RNA, 22 nt, Human
guccagacgggacuccagaggu

SEQ ID NO: 650026 - RNA, 19 nt, Human
gugagcagccgugcuuagc

SEQ ID NO: 650027 - RNA, 18 nt, Human
gugguguguacaaggguc

SEQ ID NO: 650028 - RNA, 27 nt, Human
guuucaggccacuuggguaccuuucag

SEQ ID NO: 650029 - RNA, 23 nt, Human
uaaaaaaaaaaaaccacaaagaa

SEQ ID NO: 650030 - RNA, 18 nt, Human
uaacaaaaaugccacaca

SEQ ID NO: 650031 - RNA, 18 nt, Human
uaaccaacacaaccucau

SEQ ID NO: 650032 - RNA, 18 nt, Human
uaaccuggucugggaagg

SEQ ID NO: 650033 - RNA, 22 nt, Human
uacaccacaagcauuuucuaca

SEQ ID NO: 650034 - RNA, 21 nt, Human
uagcaagccucagccagaaac

SEQ ID NO: 650035 - RNA, 21 nt, Human
uagcaggaagggacguccaga

SEQ ID NO: 650036 - RNA, 18 nt, Human
uauuuuguggugauugug

SEQ ID NO: 650037 - RNA, 19 nt, Human
ucauucacucuagcucuag

SEQ ID NO: 650038 - RNA, 22 nt, Human
ucauucacucuagcucuagaau

SEQ ID NO: 650039 - RNA, 22 nt, Human
uccaugagaucaggcuuuuuug

SEQ ID NO: 650040 - RNA, 19 nt, Human
ucccaggaauccuaaccug

SEQ ID NO: 650041 - RNA, 23 nt, Human
uccgcggccuucccaggaauccu

SEQ ID NO: 650042 - RNA, 20 nt, Human
ucgggcuggcauaaaggcuu

SEQ ID NO: 650043 - RNA, 20 nt, Human
ucgguagccagcagccaggg

SEQ ID NO: 650044 - RNA, 20 nt, Human
ucuggcccccuccauuagaa

SEQ ID NO: 650045 - RNA, 19 nt, Human
ucuuguccucccccuccca

SEQ ID NO: 650046 - RNA, 23 nt, Human
ugagcaugacuggggcuccucag

SEQ ID NO: 650047 - RNA, 21 nt, Human
ugaugacuccaaaaaaaaugu

SEQ ID NO: 650048 - RNA, 23 nt, Human
ugccacacauacauguaguugug

SEQ ID NO: 650049 - RNA, 24 nt, Human
uggacacgggcacgcgcacacaca

SEQ ID NO: 650050 - RNA, 25 nt, Human
ugggagcacaaaagccucacaaaac

SEQ ID NO: 650051 - RNA, 19 nt, Human
ugggucauuuucuuggggc

SEQ ID NO: 650052 - RNA, 25 nt, Human
uguaacagauauaugcauguguaca

SEQ ID NO: 650053 - RNA, 18 nt, Human
ugucgggcuggcauaaag

SEQ ID NO: 650054 - RNA, 22 nt, Human
ugugagaggcaaagucuucuuu

SEQ ID NO: 650055 - RNA, 24 nt, Human
uguguacaagggucugagaguaua

SEQ ID NO: 650056 - RNA, 21 nt, Human
uguguacauacagcucaugca

SEQ ID NO: 650057 - RNA, 25 nt, Human
uguguacauacagcucaugcacaca

SEQ ID NO: 650058 - RNA, 24 nt, Human
uuaaaaggaucucuaaugcucccu

SEQ ID NO: 650059 - RNA, 25 nt, Human
uuagcaagccucagccagaaacuac

SEQ ID NO: 650060 - RNA, 23 nt, Human
aaucacagcuacaauagauguac

SEQ ID NO: 650061 - RNA, 21 nt, Human
accuuaaaaggcacuacuggg

SEQ ID NO: 650062 - RNA, 19 nt, Human
aggcacuacuggguccagu

SEQ ID NO: 650063 - RNA, 20 nt, Human
aguaauuacaguucccuuca

SEQ ID NO: 650064 - RNA, 22 nt, Human
auaaaucaauaaucauggccuu

SEQ ID NO: 650065 - RNA, 23 nt, Human
caauccaguucauuaccacccua

SEQ ID NO: 650066 - RNA, 23 nt, Human
cacacagaaacuggaauaaucac

SEQ ID NO: 650067 - RNA, 22 nt, Human
caccuuaaaaggcacuacuggg

SEQ ID NO: 650068 - RNA, 23 nt, Human
cuacuaaaugaauucuuuugcau

SEQ ID NO: 650069 - RNA, 18 nt, Human
gaugauggaaaaaaagua

SEQ ID NO: 650070 - RNA, 27 nt, Human
uaaaaauagaaacagaaagaugaugua

SEQ ID NO: 650071 - RNA, 22 nt, Human
uaacaaacauuuaacguauggc

SEQ ID NO: 650072 - RNA, 21 nt, Human
uacaaguaauuacaguucccu

SEQ ID NO: 650073 - RNA, 18 nt, Human
uacaggacguuuaagaca

SEQ ID NO: 650074 - RNA, 22 nt, Human
uauacaauucuauuauauaaau

SEQ ID NO: 650075 - RNA, 26 nt, Human
uauacagaugauggaaaaaaaguaac

SEQ ID NO: 650076 - RNA, 21 nt, Human
uauauacagaugauggaaaaa

SEQ ID NO: 650077 - RNA, 19 nt, Human
ugacaaaacugugcaaaaa

SEQ ID NO: 650078 - RNA, 20 nt, Human
uggaaaaaaaguaacuuuca

SEQ ID NO: 650079 - RNA, 20 nt, Human
uguacauaauauacaucaug

SEQ ID NO: 650080 - RNA, 23 nt, Human
uuuaagacacuuauucaccuuau

SEQ ID NO: 650081 - RNA, 24 nt, Human
uuucugcuguaucaguagcuacaa

SEQ ID NO: 650082 - RNA, 22 nt, Human
accuuccccagugccccuccau

SEQ ID NO: 650083 - RNA, 27 nt, Human
accuuccccagugccccuccaugcucg

SEQ ID NO: 650084 - RNA, 21 nt, Human
acgggcgccggcggcuccccg

SEQ ID NO: 650085 - RNA, 19 nt, Human
agagggagacaaguccgca

SEQ ID NO: 650086 - RNA, 21 nt, Human
agcugugcacgcuggaccccu

SEQ ID NO: 650087 - RNA, 21 nt, Human
aggagaugccacugggggugc

SEQ ID NO: 650088 - RNA, 19 nt, Human
aggagcugggggaaaggug

SEQ ID NO: 650089 - RNA, 19 nt, Human
aguaacaccucuuuacuca

SEQ ID NO: 650090 - RNA, 22 nt, Human
caaaggcuggaaucugcccaug

SEQ ID NO: 650091 - RNA, 21 nt, Human
caagaucccugaucgccagcc

SEQ ID NO: 650092 - RNA, 21 nt, Human
cacgcuggaccccuggccagc

SEQ ID NO: 650093 - RNA, 22 nt, Human
cagcgcccccgccaggcccucc

SEQ ID NO: 650094 - RNA, 23 nt, Human
cagguccugagcuuuggacuccu

SEQ ID NO: 650095 - RNA, 19 nt, Human
ccaaaggcuggaaucugcc

SEQ ID NO: 650096 - RNA, 22 nt, Human
ccaaaggcuggaaucugcccau

SEQ ID NO: 650097 - RNA, 20 nt, Human
ccaaggacggcacagaacgu

SEQ ID NO: 650098 - RNA, 20 nt, Human
cccaaaggcuggaaucugcc

SEQ ID NO: 650099 - RNA, 23 nt, Human
ccccagugccccuccaugcucga

SEQ ID NO: 650100 - RNA, 19 nt, Human
ccccgcuccuccacggaca

SEQ ID NO: 650101 - RNA, 22 nt, Human
cccgccaggcccuccgaggcca

SEQ ID NO: 650102 - RNA, 21 nt, Human
cccgcuccuccacggacagca

SEQ ID NO: 650103 - RNA, 22 nt, Human
ccuagcucccugucaccuccuc

SEQ ID NO: 650104 - RNA, 22 nt, Human
ccuccaggugggccauaccugu

SEQ ID NO: 650105 - RNA, 18 nt, Human
ccuccuccuucaccuccc

SEQ ID NO: 650106 - RNA, 27 nt, Human
cgaagcggacccaggaggggccccgcu

SEQ ID NO: 650107 - RNA, 21 nt, Human
cggaagccagcgcccccgcca

SEQ ID NO: 650108 - RNA, 21 nt, Human
cggaagccagcgcccccgccg

SEQ ID NO: 650109 - RNA, 20 nt, Human
cuccaggugggccauaccug

SEQ ID NO: 650110 - RNA, 23 nt, Human
cucccaaugcaacaagaucccug

SEQ ID NO: 650111 - RNA, 23 nt, Human
cucccugucaccuccuccaccuc

SEQ ID NO: 650112 - RNA, 27 nt, Human
cucgggcucacagugcagccccgccuc

SEQ ID NO: 650113 - RNA, 22 nt, Human
cugcucccaaugcaacaagauc

SEQ ID NO: 650114 - RNA, 19 nt, Human
cuggaccccuggccagcca

SEQ ID NO: 650115 - RNA, 21 nt, Human
gaaagcuccccaucccccugg

SEQ ID NO: 650116 - RNA, 22 nt, Human
gaggaacacggccagcaccacg

SEQ ID NO: 650117 - RNA, 20 nt, Human
gaguaacaccucuuuacuca

SEQ ID NO: 650118 - RNA, 27 nt, Human
gcccaaaggcuggaaucugcccaugcc

SEQ ID NO: 650119 - RNA, 21 nt, Human
gcucccugucaccuccuccac

SEQ ID NO: 650120 - RNA, 18 nt, Human
ggcggcgggccggauccu

SEQ ID NO: 650121 - RNA, 21 nt, Human
ggcugccuagcucccugucac

SEQ ID NO: 650122 - RNA, 19 nt, Human
gugcagccccgccuccucc

SEQ ID NO: 650123 - RNA, 21 nt, Human
uagucagguccugagcuuugg

SEQ ID NO: 650124 - RNA, 20 nt, Human
ucccucgggggaccuucccc

SEQ ID NO: 650125 - RNA, 19 nt, Human
ucccucuuggccucaugga

SEQ ID NO: 650126 - RNA, 21 nt, Human
uccgcacuggagggagcacgg

SEQ ID NO: 650127 - RNA, 20 nt, Human
uccuccuucaccucccgcug

SEQ ID NO: 650128 - RNA, 19 nt, Human
ugcaacaagaucccugauc

SEQ ID NO: 650129 - RNA, 22 nt, Human
ugcagaaagcuccccauccccc

SEQ ID NO: 650130 - RNA, 23 nt, Human
ugcaggccuuucccaaggacggc

SEQ ID NO: 650131 - RNA, 21 nt, Human
ugccaggcugugccagccaua

SEQ ID NO: 650132 - RNA, 18 nt, Human
uggagggagcacggcugc

SEQ ID NO: 650133 - RNA, 21 nt, Human
uggccagccagcacggaagcc

SEQ ID NO: 650134 - RNA, 21 nt, Human
uuccgcagccgcacgggcgcc

SEQ ID NO: 650135 - RNA, 23 nt, Human
uuuuuuuuuuuuuuuuuucaagg

SEQ ID NO: 650136 - RNA, 23 nt, Human
aaacagacccaaggcugaaagca

SEQ ID NO: 650137 - RNA, 21 nt, Human
aagcagacgaagauucccucg

SEQ ID NO: 650138 - RNA, 18 nt, Human
aagucccaggcacccuuc

SEQ ID NO: 650139 - RNA, 18 nt, Human
acagcaacccaggaaggc

SEQ ID NO: 650140 - RNA, 18 nt, Human
acccgcaggccuccucaa

SEQ ID NO: 650141 - RNA, 25 nt, Human
accuuccucuccagcagcugcccac

SEQ ID NO: 650142 - RNA, 24 nt, Human
acuguaggagagaccaagccgugg

SEQ ID NO: 650143 - RNA, 18 nt, Human
agaacaguauugcauaca

SEQ ID NO: 650144 - RNA, 20 nt, Human
agacccaaggcugaaagcag

SEQ ID NO: 650145 - RNA, 23 nt, Human
agauccuuggcugaaggcaacuc

SEQ ID NO: 650146 - RNA, 21 nt, Human
agcagcugcccacugcccaug

SEQ ID NO: 650147 - RNA, 18 nt, Human
agcaggcccuggggaguu

SEQ ID NO: 650148 - RNA, 19 nt, Human
agcagugcagaugggggca

SEQ ID NO: 650149 - RNA, 18 nt, Human
agccuccagucccaagca

SEQ ID NO: 650150 - RNA, 19 nt, Human
aggcacccuucccugauca

SEQ ID NO: 650151 - RNA, 23 nt, Human
augggggcagguggcccuggagg

SEQ ID NO: 650152 - RNA, 20 nt, Human
caagucccaggcacccuucc

SEQ ID NO: 650153 - RNA, 21 nt, Human
caauaggcucacagugccccc

SEQ ID NO: 650154 - RNA, 20 nt, Human
cacagugcccccgaagucaa

SEQ ID NO: 650155 - RNA, 24 nt, Human
cacugcccauguccagcaguucca

SEQ ID NO: 650156 - RNA, 22 nt, Human
cagacccaaggcugaaagcaga

SEQ ID NO: 650157 - RNA, 19 nt, Human
cagcaacccaggaaggccu

SEQ ID NO: 650158 - RNA, 21 nt, Human
cagcagugcagaugggggcag

SEQ ID NO: 650159 - RNA, 21 nt, Human
cagcagugcagaugggggcag

SEQ ID NO: 650160 - RNA, 22 nt, Human
cagcccacacaaaacagaccca

SEQ ID NO: 650161 - RNA, 22 nt, Human
caggccagagugcccugaaaug

SEQ ID NO: 650162 - RNA, 19 nt, Human
caguggcucccugggggac

SEQ ID NO: 650163 - RNA, 23 nt, Human
caugggacccuccaagucccagg

SEQ ID NO: 650164 - RNA, 23 nt, Human
ccaaggcugaaagcagacgaaga

SEQ ID NO: 650165 - RNA, 21 nt, Human
ccacagcccgcguaccaccgu

SEQ ID NO: 650166 - RNA, 24 nt, Human
ccagcccacacaaaacagacccaa

SEQ ID NO: 650167 - RNA, 21 nt, Human
ccagucccaagcaagccucca

SEQ ID NO: 650168 - RNA, 23 nt, Human
cccacacaaaacagacccaaggc

SEQ ID NO: 650169 - RNA, 24 nt, Human
cccacacaaaacagacccaaggcu

SEQ ID NO: 650170 - RNA, 19 nt, Human
cccgaagucaagcaacagc

SEQ ID NO: 650171 - RNA, 24 nt, Human
cccgaagucaagcaacagcaggcc

SEQ ID NO: 650172 - RNA, 24 nt, Human
cccgcaggccuccucaaacaccag

SEQ ID NO: 650173 - RNA, 19 nt, Human
cccgcaggcuccgccgcug

SEQ ID NO: 650174 - RNA, 20 nt, Human
cccuccaagucccaggcacc

SEQ ID NO: 650175 - RNA, 19 nt, Human
ccggaaugugcugcugugu

SEQ ID NO: 650176 - RNA, 18 nt, Human
ccuacaggugccuccugc

SEQ ID NO: 650177 - RNA, 18 nt, Human
ccucgggucuccagcucu

SEQ ID NO: 650178 - RNA, 20 nt, Human
cggagcaggguccggaaguc

SEQ ID NO: 650179 - RNA, 25 nt, Human
cucaguucuucuggagugagcuggg

SEQ ID NO: 650180 - RNA, 24 nt, Human
cucuccagcagcugcccacugccc

SEQ ID NO: 650181 - RNA, 22 nt, Human
cugcccacugcccauguccagc

SEQ ID NO: 650182 - RNA, 18 nt, Human
cuguguccuagaaaugau

SEQ ID NO: 650183 - RNA, 24 nt, Human
cuuccucauccuccaugccggggg

SEQ ID NO: 650184 - RNA, 19 nt, Human
gaccuuccucuccagcagc

SEQ ID NO: 650185 - RNA, 21 nt, Human
gaggauggaggccagagccug

SEQ ID NO: 650186 - RNA, 18 nt, Human
gcagguggcccuggagga

SEQ ID NO: 650187 - RNA, 22 nt, Human
gccaguggcucccugggggaca

SEQ ID NO: 650188 - RNA, 18 nt, Human
gcccagguguguacagcc

SEQ ID NO: 650189 - RNA, 19 nt, Human
gcugcagacccccacgggc

SEQ ID NO: 650190 - RNA, 19 nt, Human
ggaagucccaugugucccc

SEQ ID NO: 650191 - RNA, 22 nt, Human
ggccagagccugaggugcccgg

SEQ ID NO: 650192 - RNA, 20 nt, Human
ggcccuggggaguuggggcc

SEQ ID NO: 650193 - RNA, 19 nt, Human
gggcagguggcccuggagg

SEQ ID NO: 650194 - RNA, 24 nt, Human
ggucagcagugcagaugggggcag

SEQ ID NO: 650195 - RNA, 19 nt, Human
guccaagcaagccuccagg

SEQ ID NO: 650196 - RNA, 20 nt, Human
uacacagguccauacauggg

SEQ ID NO: 650197 - RNA, 19 nt, Human
uacccgcaggccuccucaa

SEQ ID NO: 650198 - RNA, 19 nt, Human
uaggagagaccaagccgug

SEQ ID NO: 650199 - RNA, 26 nt, Human
uauguauauauuuaacacacacaucu

SEQ ID NO: 650200 - RNA, 23 nt, Human
ucccaagcaagccuccaggcccu

SEQ ID NO: 650201 - RNA, 18 nt, Human
ucccagcccacacaaaac

SEQ ID NO: 650202 - RNA, 20 nt, Human
ucccugggggacagcaaccc

SEQ ID NO: 650203 - RNA, 25 nt, Human
ugcauacacagguccauacauggug

SEQ ID NO: 650204 - RNA, 24 nt, Human
ugccuagggcugcagacccccacg

SEQ ID NO: 650205 - RNA, 24 nt, Human
uggcucccugggggacagcaaccc

SEQ ID NO: 650206 - RNA, 21 nt, Human
uggcugaaggcaacucaacac

SEQ ID NO: 650207 - RNA, 18 nt, Human
ugggacccuccaaguccc

SEQ ID NO: 650208 - RNA, 20 nt, Human
ugggacccuccaagucccag

SEQ ID NO: 650209 - RNA, 21 nt, Human
uggggaguuggggcccaggug

SEQ ID NO: 650210 - RNA, 23 nt, Human
uggggaguuggggcccaggugug

SEQ ID NO: 650211 - RNA, 20 nt, Human
ugggggcagguggcccugga

SEQ ID NO: 650212 - RNA, 22 nt, Human
ugggggcagguggcccuggagg

SEQ ID NO: 650213 - RNA, 22 nt, Human
uguacccugucuguacuuagga

SEQ ID NO: 650214 - RNA, 20 nt, Human
uguaggagagaccaagccgu

SEQ ID NO: 650215 - RNA, 24 nt, Human
uguauauauuuaacacacacaucu

SEQ ID NO: 650216 - RNA, 19 nt, Human
ugugucucaguucuucugg

SEQ ID NO: 650217 - RNA, 24 nt, Human
uuccucauccuccaugccgggggc

SEQ ID NO: 650218 - RNA, 20 nt, Human
uugcauacacagguccauac

SEQ ID NO: 650219 - RNA, 21 nt, Human
ccuuccaccagacccucuucc

SEQ ID NO: 650220 - RNA, 19 nt, Human
uacauggauuaauaaaaag

SEQ ID NO: 650221 - RNA, 23 nt, Human
aaaaaaaaccaaaaaaaaacugg

SEQ ID NO: 650222 - RNA, 23 nt, Human
aaaaaaaccaaaaaaaaacuggc

SEQ ID NO: 650223 - RNA, 25 nt, Human
aaaaaaacuggcuccuuccccaggc

SEQ ID NO: 650224 - RNA, 27 nt, Human
aaaaaaccaaaaaaaaacuggccguua

SEQ ID NO: 650225 - RNA, 21 nt, Human
aaaaaacuaugaaauccuuaa

SEQ ID NO: 650226 - RNA, 24 nt, Human
aaaaaacuggcuccuuccccaggc

SEQ ID NO: 650227 - RNA, 20 nt, Human
aaaaaccaaaaaaaaacugg

SEQ ID NO: 650228 - RNA, 19 nt, Human
aaaaccaaaaaaaaacugg

SEQ ID NO: 650229 - RNA, 18 nt, Human
aaacuggcuccuucccca

SEQ ID NO: 650230 - RNA, 20 nt, Human
aaagcccagcccagagcuga

SEQ ID NO: 650231 - RNA, 21 nt, Human
aaagcccagcccagagcugac

SEQ ID NO: 650232 - RNA, 29 nt, Human
aaagggagcaguugcaguauuucagaggg

SEQ ID NO: 650233 - RNA, 20 nt, Human
aacaugaugaaacccugucu

SEQ ID NO: 650234 - RNA, 21 nt, Human
aacaugaugaaacccugucuc

SEQ ID NO: 650235 - RNA, 18 nt, Human
aagcccagcccagagcug

SEQ ID NO: 650236 - RNA, 25 nt, Human
aaggcaggcagaucacuugagguca

SEQ ID NO: 650237 - RNA, 21 nt, Human
aauguggugaaacccugucuc

SEQ ID NO: 650238 - RNA, 20 nt, Human
aauugcuugaaccugggugg

SEQ ID NO: 650239 - RNA, 23 nt, Human
acagccagugucacgcagaaagc

SEQ ID NO: 650240 - RNA, 22 nt, Human
acccuggguccuuucgggcccc

SEQ ID NO: 650241 - RNA, 24 nt, Human
acccugucucuacuaaaaauacaa

SEQ ID NO: 650242 - RNA, 20 nt, Human
acccugucucuacuaaauaa

SEQ ID NO: 650243 - RNA, 24 nt, Human
accuaaggucagggguuugagacu

SEQ ID NO: 650244 - RNA, 22 nt, Human
acugcagugaugcuucuggcuc

SEQ ID NO: 650245 - RNA, 24 nt, Human
acuugaggucaggaguucgagacc

SEQ ID NO: 650246 - RNA, 23 nt, Human
agaucacuugaggucaggaguuc

SEQ ID NO: 650247 - RNA, 24 nt, Human
agcagcuguguggcccccagaaag

SEQ ID NO: 650248 - RNA, 20 nt, Human
agccgggcaugauggcacgc

SEQ ID NO: 650249 - RNA, 24 nt, Human
agccuggccaacaugaugaaaccc

SEQ ID NO: 650250 - RNA, 22 nt, Human
agccuggccaauguggugaaac

SEQ ID NO: 650251 - RNA, 24 nt, Human
agccuggccaauguggugaaaccc

SEQ ID NO: 650252 - RNA, 25 nt, Human
agccuggccaauguggugaaacccu

SEQ ID NO: 650253 - RNA, 24 nt, Human
agcuguguggcccccagaaagccc

SEQ ID NO: 650254 - RNA, 26 nt, Human
aggcagaucacuugaggucaggaguu

SEQ ID NO: 650255 - RNA, 22 nt, Human
aggcaggauaauugcuugaacc

SEQ ID NO: 650256 - RNA, 24 nt, Human
aggcaggauaauugcuugaaccug

SEQ ID NO: 650257 - RNA, 26 nt, Human
aggcaggcagaucacuugaggucagg

SEQ ID NO: 650258 - RNA, 20 nt, Human
aggcugaggcaggauaauug

SEQ ID NO: 650259 - RNA, 24 nt, Human
aggcugaggcaggauaauugcuug

SEQ ID NO: 650260 - RNA, 22 nt, Human
agucaggcagcgggaugggcuc

SEQ ID NO: 650261 - RNA, 24 nt, Human
aguggcucacgccuguaaucccag

SEQ ID NO: 650262 - RNA, 19 nt, Human
auccauuuuuuugggcaac

SEQ ID NO: 650263 - RNA, 20 nt, Human
augaaauccuuaaaaaaaaa

SEQ ID NO: 650264 - RNA, 24 nt, Human
caacaucuccaaaaaaaaaaaaaa

SEQ ID NO: 650265 - RNA, 24 nt, Human
caacaugaugaaacccugucucua

SEQ ID NO: 650266 - RNA, 18 nt, Human
caagcacagccgaagcag

SEQ ID NO: 650267 - RNA, 24 nt, Human
caaggcaggcagaucacuugaggu

SEQ ID NO: 650268 - RNA, 23 nt, Human
caaggugaugcuguccgccuccu

SEQ ID NO: 650269 - RNA, 21 nt, Human
cacaaccaggccugagcaccc

SEQ ID NO: 650270 - RNA, 21 nt, Human
cacagccgaagcagagaaacc

SEQ ID NO: 650271 - RNA, 23 nt, Human
caccacagcggccagcuccaguc

SEQ ID NO: 650272 - RNA, 18 nt, Human
caccuaaggucagggguu

SEQ ID NO: 650273 - RNA, 24 nt, Human
caccuacucgggaggcugaggcag

SEQ ID NO: 650274 - RNA, 24 nt, Human
cacgccuguaaucccagcacucug

SEQ ID NO: 650275 - RNA, 23 nt, Human
cacuugaggucaggaguucgaga

SEQ ID NO: 650276 - RNA, 23 nt, Human
cagaaagcccagcccagagcuga

SEQ ID NO: 650277 - RNA, 24 nt, Human
cagaucacuugaggucaggaguuc

SEQ ID NO: 650278 - RNA, 27 nt, Human
cagaucacuugaggucaggaguucgag

SEQ ID NO: 650279 - RNA, 24 nt, Human
cagcacucugggaggccgaggcgg

SEQ ID NO: 650280 - RNA, 24 nt, Human
cagcacuuugggagaccaaggcag

SEQ ID NO: 650281 - RNA, 24 nt, Human
cagcacuuugggagaccaaggcag

SEQ ID NO: 650282 - RNA, 28 nt, Human
cagcagcauccucaguggggugacuggu

SEQ ID NO: 650283 - RNA, 21 nt, Human
cagcagcuguguggcccccag

SEQ ID NO: 650284 - RNA, 18 nt, Human
cagcugccggagauaccg

SEQ ID NO: 650285 - RNA, 24 nt, Human
caggcagaucacuugaggucagga

SEQ ID NO: 650286 - RNA, 18 nt, Human
cagggcagcccccucccu

SEQ ID NO: 650287 - RNA, 22 nt, Human
caugccacuucaagcacagccg

SEQ ID NO: 650288 - RNA, 24 nt, Human
caugccuguauucccagcacuuug

SEQ ID NO: 650289 - RNA, 26 nt, Human
ccaaaaaaaaacuggcuccuucccca

SEQ ID NO: 650290 - RNA, 19 nt, Human
ccacaagcagcuccucucc

SEQ ID NO: 650291 - RNA, 22 nt, Human
ccaccacagcggccagcuccag

SEQ ID NO: 650292 - RNA, 23 nt, Human
ccaccuaaggucagggguuugag

SEQ ID NO: 650293 - RNA, 25 nt, Human
ccagagcugacagccagugucacgc

SEQ ID NO: 650294 - RNA, 21 nt, Human
cccacaagcagcuccucucca

SEQ ID NO: 650295 - RNA, 23 nt, Human
cccagaaagcccagcccagagcu

SEQ ID NO: 650296 - RNA, 20 nt, Human
ccccagaaagcccagcccag

SEQ ID NO: 650297 - RNA, 21 nt, Human
ccccaggagcuacccgcugcc

SEQ ID NO: 650298 - RNA, 23 nt, Human
ccccaggagcuacccgcugccau

SEQ ID NO: 650299 - RNA, 22 nt, Human
cccccagaaagcccagcccaga

SEQ ID NO: 650300 - RNA, 20 nt, Human
cccgccgccucagcagcugu

SEQ ID NO: 650301 - RNA, 18 nt, Human
cccuucuugguccucuuc

SEQ ID NO: 650302 - RNA, 21 nt, Human
ccgccuccucacugcccacaa

SEQ ID NO: 650303 - RNA, 19 nt, Human
ccggagauaccggcccaag

SEQ ID NO: 650304 - RNA, 22 nt, Human
ccuaaggucagggguuugagac

SEQ ID NO: 650305 - RNA, 21 nt, Human
ccugagcacauauggcccagc

SEQ ID NO: 650306 - RNA, 22 nt, Human
ccuggccaacaugaugaaaccc

SEQ ID NO: 650307 - RNA, 24 nt, Human
ccuggccaacaugaugaaacccug

SEQ ID NO: 650308 - RNA, 22 nt, Human
ccuggccaauguggugaaaccc

SEQ ID NO: 650309 - RNA, 24 nt, Human
ccuggccaauguggugaaacccug

SEQ ID NO: 650310 - RNA, 18 nt, Human
ccuguaaucccagcacuc

SEQ ID NO: 650311 - RNA, 24 nt, Human
cgagaccagccuggccaauguggu

SEQ ID NO: 650312 - RNA, 25 nt, Human
cgccucaacccgccgccucagcagc

SEQ ID NO: 650313 - RNA, 24 nt, Human
cgccuguaaucccagcacucuggg

SEQ ID NO: 650314 - RNA, 23 nt, Human
cucacgccuguaaucccagcacu

SEQ ID NO: 650315 - RNA, 24 nt, Human
cucacgccuguaaucccagcacuc

SEQ ID NO: 650316 - RNA, 20 nt, Human
cucacugcccacaagcagcu

SEQ ID NO: 650317 - RNA, 23 nt, Human
cucaugccuguauucccagcacu

SEQ ID NO: 650318 - RNA, 24 nt, Human
cucaugccuguauucccagcacuu

SEQ ID NO: 650319 - RNA, 20 nt, Human
cuccacacaggccgcuaucc

SEQ ID NO: 650320 - RNA, 21 nt, Human
cucuacuaaaaauacaaaaag

SEQ ID NO: 650321 - RNA, 24 nt, Human
cugaccaccuaaggucagggguuu

SEQ ID NO: 650322 - RNA, 27 nt, Human
cugcacuagaggaaggcaguggagcag

SEQ ID NO: 650323 - RNA, 19 nt, Human
cugcagugaugcuucuggc

SEQ ID NO: 650324 - RNA, 24 nt, Human
cuggccaauguggugaaacccugu

SEQ ID NO: 650325 - RNA, 22 nt, Human
cuguccgccuccucacugccca

SEQ ID NO: 650326 - RNA, 22 nt, Human
cuuucgggccgccucaacccgc

SEQ ID NO: 650327 - RNA, 19 nt, Human
gaaacccugucucuacuaa

SEQ ID NO: 650328 - RNA, 24 nt, Human
gaccaccuaaggucagggguuuga

SEQ ID NO: 650329 - RNA, 21 nt, Human
gacuuacagucagcuuucccu

SEQ ID NO: 650330 - RNA, 20 nt, Human
gagacuagccuggccaacau

SEQ ID NO: 650331 - RNA, 25 nt, Human
gaggcgggcugaccaccuaagguca

SEQ ID NO: 650332 - RNA, 21 nt, Human
gagugcgguggcucaugccug

SEQ ID NO: 650333 - RNA, 24 nt, Human
gaucacuugaggucaggaguucga

SEQ ID NO: 650334 - RNA, 30 nt, Human
gcaacaucuccaaaaaaaaaaaaaaaaaaa

SEQ ID NO: 650335 - RNA, 24 nt, Human
gccaacaugaugaaacccugucuc

SEQ ID NO: 650336 - RNA, 24 nt, Human
gccaauguggugaaacccugucuc

SEQ ID NO: 650337 - RNA, 19 nt, Human
gccccaggagcuacccgcu

SEQ ID NO: 650338 - RNA, 18 nt, Human
gccccauggcaggccugu

SEQ ID NO: 650339 - RNA, 20 nt, Human
gccgaagcagagaaaccucu

SEQ ID NO: 650340 - RNA, 21 nt, Human
gccgcuauccacaaccaggcc

SEQ ID NO: 650341 - RNA, 20 nt, Human
gccucaacccgccgccucag

SEQ ID NO: 650342 - RNA, 21 nt, Human
gcugccggagauaccggccca

SEQ ID NO: 650343 - RNA, 24 nt, Human
ggccacaguggcucacgccuguaa

SEQ ID NO: 650344 - RNA, 21 nt, Human
ggccgagugcgguggcucaug

SEQ ID NO: 650345 - RNA, 19 nt, Human
ggguggacggagugggagg

SEQ ID NO: 650346 - RNA, 23 nt, Human
gguggcucaugccuguauuccca

SEQ ID NO: 650347 - RNA, 24 nt, Human
gguggcucaugccuguauucccag

SEQ ID NO: 650348 - RNA, 20 nt, Human
ggugggggagcccugcagca

SEQ ID NO: 650349 - RNA, 21 nt, Human
gugaaacccugucucuacuaa

SEQ ID NO: 650350 - RNA, 22 nt, Human
gugguuccugaguccaccacag

SEQ ID NO: 650351 - RNA, 26 nt, Human
uaaaaaaaaaaccaaaaaaaaacugg

SEQ ID NO: 650352 - RNA, 18 nt, Human
uagaggccgugugggggu

SEQ ID NO: 650353 - RNA, 24 nt, Human
uagccuggccaacaugaugaaacc

SEQ ID NO: 650354 - RNA, 23 nt, Human
uagguuggccacaguggcucacg

SEQ ID NO: 650355 - RNA, 21 nt, Human
ucacugcagugaugcuucugg

SEQ ID NO: 650356 - RNA, 22 nt, Human
ucacugcagugaugcuucuggc

SEQ ID NO: 650357 - RNA, 20 nt, Human
ucacuugaggucaggaguuc

SEQ ID NO: 650358 - RNA, 22 nt, Human
ucagcagcuguguggcccccag

SEQ ID NO: 650359 - RNA, 21 nt, Human
uccacacaggccgcuauccac

SEQ ID NO: 650360 - RNA, 23 nt, Human
uccacacaggccgcuauccacaa

SEQ ID NO: 650361 - RNA, 26 nt, Human
uccacacaggccgcuauccacaacca

SEQ ID NO: 650362 - RNA, 21 nt, Human
uccccaggcugccagcagcau

SEQ ID NO: 650363 - RNA, 21 nt, Human
ucccugacugggcaaaaggga

SEQ ID NO: 650364 - RNA, 21 nt, Human
ucccugagcacauauggccca

SEQ ID NO: 650365 - RNA, 27 nt, Human
ucccugagcacauauggcccagcccuu

SEQ ID NO: 650366 - RNA, 21 nt, Human
uccuuaaaaaaaaaaccaaaa

SEQ ID NO: 650367 - RNA, 23 nt, Human
ucgggaggcugaggcaggauaau

SEQ ID NO: 650368 - RNA, 20 nt, Human
ucuccaaaaaaaaaaaaaaa

SEQ ID NO: 650369 - RNA, 25 nt, Human
ucuccacacaggccgcuauccacaa

SEQ ID NO: 650370 - RNA, 21 nt, Human
ucucuacuaaaaauacaaaaa

SEQ ID NO: 650371 - RNA, 22 nt, Human
ucuuccaggcugcacuagagga

SEQ ID NO: 650372 - RNA, 24 nt, Human
ugaaauccuuaaaaaaaaaaccaa

SEQ ID NO: 650373 - RNA, 23 nt, Human
ugagacuagccuggccaacauga

SEQ ID NO: 650374 - RNA, 23 nt, Human
ugagcacccuggguccuuucggg

SEQ ID NO: 650375 - RNA, 24 nt, Human
ugagccagacagguaagcagagac

SEQ ID NO: 650376 - RNA, 24 nt, Human
ugaggcaggauaauugcuugaacc

SEQ ID NO: 650377 - RNA, 25 nt, Human
ugaggcaggauaauugcuugaaccu

SEQ ID NO: 650378 - RNA, 20 nt, Human
ugaugcuucuggcucagccc

SEQ ID NO: 650379 - RNA, 19 nt, Human
ugcccaagcugagccagac

SEQ ID NO: 650380 - RNA, 22 nt, Human
ugcccaagcugagccagacagg

SEQ ID NO: 650381 - RNA, 19 nt, Human
ugccuguauucccagcacu

SEQ ID NO: 650382 - RNA, 23 nt, Human
ugccuguauucccagcacuuugg

SEQ ID NO: 650383 - RNA, 24 nt, Human
uggcaggccugugugcaccacagg

SEQ ID NO: 650384 - RNA, 24 nt, Human
uggccaacaugaugaaacccuguc

SEQ ID NO: 650385 - RNA, 24 nt, Human
uggccaauguggugaaacccuguc

SEQ ID NO: 650386 - RNA, 19 nt, Human
uggccacaguggcucacgc

SEQ ID NO: 650387 - RNA, 24 nt, Human
uggccgagugcgguggcucaugcc

SEQ ID NO: 650388 - RNA, 22 nt, Human
uggcucacgccuguaaucccag

SEQ ID NO: 650389 - RNA, 24 nt, Human
uggcucacgccuguaaucccagca

SEQ ID NO: 650390 - RNA, 21 nt, Human
uggcucaugccuguauuccca

SEQ ID NO: 650391 - RNA, 24 nt, Human
uggcucaugccuguauucccagca

SEQ ID NO: 650392 - RNA, 24 nt, Human
ugggagaccaaggcaggcagauca

SEQ ID NO: 650393 - RNA, 18 nt, Human
ugggaggccgaggcgggc

SEQ ID NO: 650394 - RNA, 21 nt, Human
uggguggugguuucagugagc

SEQ ID NO: 650395 - RNA, 19 nt, Human
uggugaaacccugucucua

SEQ ID NO: 650396 - RNA, 27 nt, Human
uguguggcccccagaaagcccagccca

SEQ ID NO: 650397 - RNA, 21 nt, Human
uuacagucagcuuucccugac

SEQ ID NO: 650398 - RNA, 23 nt, Human
uucuugguccucuucuauccucc

SEQ ID NO: 650399 - RNA, 18 nt, Human
uugcuugaaccugggugg

SEQ ID NO: 650400 - RNA, 22 nt, Human
uuucagugagcccagauugcac

SEQ ID NO: 650401 - RNA, 21 nt, Human
uuuuugaggaaaaagaauggc

SEQ ID NO: 650402 - RNA, 19 nt, Human
uuuuuuuuuuuuuugagga

SEQ ID NO: 650403 - RNA, 18 nt, Human
uuuuuuuuuuuuuuuuug

SEQ ID NO: 650404 - RNA, 21 nt, Human
uuuuuuuuuuuuuuuuugagg

SEQ ID NO: 650405 - RNA, 19 nt, Human
aaacucagaaaagagacaa

SEQ ID NO: 650406 - RNA, 20 nt, Human
caaaacagagcaaaacaucc

SEQ ID NO: 650407 - RNA, 22 nt, Human
cagguaccaaaacagagcaaaa

SEQ ID NO: 650408 - RNA, 18 nt, Human
ccaaaacagagcaaaaca

SEQ ID NO: 650409 - RNA, 19 nt, Human
cucagaaaagagacaauuu

SEQ ID NO: 650410 - RNA, 23 nt, Human
ggagaaccaaauugaaacucaga

SEQ ID NO: 650411 - RNA, 20 nt, Human
guaaauauuagcugguugcu

SEQ ID NO: 650412 - RNA, 19 nt, Human
uaccaaaacagagcaaaac

SEQ ID NO: 650413 - RNA, 20 nt, Human
uaccaaaacagagcaaaaca

SEQ ID NO: 650414 - RNA, 23 nt, Human
uaccaaaacagagcaaaacaucc

SEQ ID NO: 650415 - RNA, 21 nt, Human
ucaaagggcuuucccaaaaaa

SEQ ID NO: 650416 - RNA, 18 nt, Human
ugaggcccaccagauccu

SEQ ID NO: 650417 - RNA, 22 nt, Human
uuucugaggcccaccagauccu

SEQ ID NO: 650418 - RNA, 23 nt, Human
uuucugaggcccaccagauccug

SEQ ID NO: 650419 - RNA, 25 nt, Human
uuucugaggcccaccagauccugau

SEQ ID NO: 650420 - RNA, 20 nt, Human
aacagagugagacuccaucu

SEQ ID NO: 650421 - RNA, 24 nt, Human
aaucacuugaaccugggaggugga

SEQ ID NO: 650422 - RNA, 18 nt, Human
aauuagccaggcauggug

SEQ ID NO: 650423 - RNA, 24 nt, Human
acugcacuccggccuggguaacag

SEQ ID NO: 650424 - RNA, 26 nt, Human
acugcacuccggccuggguaacagag

SEQ ID NO: 650425 - RNA, 24 nt, Human
acugcgccacugcacuccggccug

SEQ ID NO: 650426 - RNA, 20 nt, Human
agccaggcaugguggugggc

SEQ ID NO: 650427 - RNA, 22 nt, Human
aggcaugagaaucacuugaacc

SEQ ID NO: 650428 - RNA, 24 nt, Human
aggcaugagaaucacuugaaccug

SEQ ID NO: 650429 - RNA, 24 nt, Human
agguggagguugcagugagccgag

SEQ ID NO: 650430 - RNA, 22 nt, Human
cacuccggccuggguaacagag

SEQ ID NO: 650431 - RNA, 22 nt, Human
cacuccggccuggguaacagag

SEQ ID NO: 650432 - RNA, 24 nt, Human
cacuccggccuggguaacagagug

SEQ ID NO: 650433 - RNA, 18 nt, Human
cacugcacuccggccugg

SEQ ID NO: 650434 - RNA, 19 nt, Human
cacugcacuccggccuggg

SEQ ID NO: 650435 - RNA, 19 nt, Human
cacugcacuccggccuggg

SEQ ID NO: 650436 - RNA, 22 nt, Human
cacugcacuccggccuggguaa

SEQ ID NO: 650437 - RNA, 23 nt, Human
cacugcacuccggccuggguaac

SEQ ID NO: 650438 - RNA, 24 nt, Human
cacugcacuccggccuggguaaca

SEQ ID NO: 650439 - RNA, 21 nt, Human
cacuugaaccugggaggugga

SEQ ID NO: 650440 - RNA, 25 nt, Human
cagcuuuauuaaaccacgggauaac

SEQ ID NO: 650441 - RNA, 20 nt, Human
ccacugcacuccggccuggg

SEQ ID NO: 650442 - RNA, 20 nt, Human
ccacugcacuccggccuggg

SEQ ID NO: 650443 - RNA, 20 nt, Human
ccacugcacuccggccuggg

SEQ ID NO: 650444 - RNA, 21 nt, Human
ccacugcacuccggccugggu

SEQ ID NO: 650445 - RNA, 22 nt, Human
ccacugcacuccggccugggua

SEQ ID NO: 650446 - RNA, 24 nt, Human
ccacugcacuccggccuggguaac

SEQ ID NO: 650447 - RNA, 21 nt, Human
ccggccuggguaacagaguga

SEQ ID NO: 650448 - RNA, 21 nt, Human
ccugggagguggagguugcag

SEQ ID NO: 650449 - RNA, 22 nt, Human
ccuggguaacagagugagacuc

SEQ ID NO: 650450 - RNA, 24 nt, Human
cgggggacugaggcaugagaauca

SEQ ID NO: 650451 - RNA, 27 nt, Human
cuagcugcccuucuagcaaugcucccu

SEQ ID NO: 650452 - RNA, 18 nt, Human
cuguaaucccagcuacuc

SEQ ID NO: 650453 - RNA, 21 nt, Human
cuguaaucccagcuacucggg

SEQ ID NO: 650454 - RNA, 21 nt, Human
cuugaaccugggagguggagg

SEQ ID NO: 650455 - RNA, 24 nt, Human
gacuccaucuaguuguuacacaau

SEQ ID NO: 650456 - RNA, 23 nt, Human
gagaaucacuugaaccugggagg

SEQ ID NO: 650457 - RNA, 21 nt, Human
gagacugcgccacugcacucc

SEQ ID NO: 650458 - RNA, 23 nt, Human
gagguugcagugagccgagacug

SEQ ID NO: 650459 - RNA, 23 nt, Human
gcacuccggccuggguaacagag

SEQ ID NO: 650460 - RNA, 19 nt, Human
gccacugcacuccggccug

SEQ ID NO: 650461 - RNA, 24 nt, Human
gccacugcacuccggccuggguaa

SEQ ID NO: 650462 - RNA, 23 nt, Human
gccuggguaacagagugagacuc

SEQ ID NO: 650463 - RNA, 18 nt, Human
ggagguugcagugagccg

SEQ ID NO: 650464 - RNA, 20 nt, Human
ggagguugcagugagccgag

SEQ ID NO: 650465 - RNA, 22 nt, Human
ggagguugcagugagccgagac

SEQ ID NO: 650466 - RNA, 18 nt, Human
ggauaacggcugcccgca

SEQ ID NO: 650467 - RNA, 19 nt, Human
ggcaucuguaaucccagcu

SEQ ID NO: 650468 - RNA, 24 nt, Human
gguggugggcaucuguaaucccag

SEQ ID NO: 650469 - RNA, 22 nt, Human
uaacagagugagacuccaucua

SEQ ID NO: 650470 - RNA, 21 nt, Human
uaacggcugcccgcagccucc

SEQ ID NO: 650471 - RNA, 18 nt, Human
uacacaaugaagagcauu

SEQ ID NO: 650472 - RNA, 21 nt, Human
uagcugcccuucuagcaaugc

SEQ ID NO: 650473 - RNA, 19 nt, Human
ucacuugaaccugggaggu

SEQ ID NO: 650474 - RNA, 24 nt, Human
ucacuugaaccugggagguggagg

SEQ ID NO: 650475 - RNA, 24 nt, Human
uccggccuggguaacagagugaga

SEQ ID NO: 650476 - RNA, 21 nt, Human
ucuguaaucccagcuacucgg

SEQ ID NO: 650477 - RNA, 22 nt, Human
ucuguaaucccagcuacucggg

SEQ ID NO: 650478 - RNA, 24 nt, Human
ugaaccugggagguggagguugca

SEQ ID NO: 650479 - RNA, 22 nt, Human
ugagccgagacugcgccacugc

SEQ ID NO: 650480 - RNA, 20 nt, Human
ugaggcaugagaaucacuug

SEQ ID NO: 650481 - RNA, 24 nt, Human
ugaggcaugagaaucacuugaacc

SEQ ID NO: 650482 - RNA, 18 nt, Human
ugggagguggagguugca

SEQ ID NO: 650483 - RNA, 29 nt, Human
ugggagguggagguugcagugacaacggu

SEQ ID NO: 650484 - RNA, 24 nt, Human
ugggagguggagguugcagugagc

SEQ ID NO: 650485 - RNA, 21 nt, Human
uggugggcaucuguaauccca

SEQ ID NO: 650486 - RNA, 22 nt, Human
uggugggcaucuguaaucccag

SEQ ID NO: 650487 - RNA, 24 nt, Human
uuagccaggcaugguggugggcau

SEQ ID NO: 650488 - RNA, 24 nt, Human
uugaaccugggagguggagguugc

SEQ ID NO: 650489 - RNA, 18 nt, Human
uugcagugagccgagacu

SEQ ID NO: 650490 - RNA, 19 nt, Human
uugcagugagccgagacug

SEQ ID NO: 650491 - RNA, 20 nt, Human
uugcagugagccgagacugc

SEQ ID NO: 650492 - RNA, 22 nt, Human
uugcagugagccgagacugcgc

SEQ ID NO: 650493 - RNA, 20 nt, Human
uuuuuuuuuuuuuuuuuggu

SEQ ID NO: 650494 - RNA, 23 nt, Human
uuuuuuuuuuuuuuuuuggugag

SEQ ID NO: 650495 - RNA, 23 nt, Human
aaauaucaaguaaccauaaaaau

SEQ ID NO: 650496 - RNA, 19 nt, Human
aaccauaaaaauauucagc

SEQ ID NO: 650497 - RNA, 23 nt, Human
aagaaaucaugguacuucuuaga

SEQ ID NO: 650498 - RNA, 18 nt, Human
agccucaucauaagauaa

SEQ ID NO: 650499 - RNA, 24 nt, Human
cacagagccgcagagagcgcgucc

SEQ ID NO: 650500 - RNA, 18 nt, Human
cagcgagaaacggaggag

SEQ ID NO: 650501 - RNA, 20 nt, Human
ccgcuacacuccacggcggc

SEQ ID NO: 650502 - RNA, 24 nt, Human
ccgcuacacuccacggcggcgggg

SEQ ID NO: 650503 - RNA, 19 nt, Human
cgaagcagcgagaaacgga

SEQ ID NO: 650504 - RNA, 19 nt, Human
cggccgcugccggcgcuca

SEQ ID NO: 650505 - RNA, 24 nt, Human
cggcgagcccuuuccgcuacacuc

SEQ ID NO: 650506 - RNA, 21 nt, Human
cucacuacgccggcagccgcc

SEQ ID NO: 650507 - RNA, 21 nt, Human
cuccacggcggcgggcucacu

SEQ ID NO: 650508 - RNA, 22 nt, Human
gccgcagagagcgcgucccgaa

SEQ ID NO: 650509 - RNA, 21 nt, Human
ucagguuuuuuuuuuuuuugg

SEQ ID NO: 650510 - RNA, 22 nt, Human
uuagagcaauuugcaaaagggg

SEQ ID NO: 650511 - RNA, 20 nt, Human
aaaaagccuucuuaaccuuu

SEQ ID NO: 650512 - RNA, 21 nt, Human
aaccugucuccucagcugcug

SEQ ID NO: 650513 - RNA, 18 nt, Human
agagcaaaaaagccuucu

SEQ ID NO: 650514 - RNA, 23 nt, Human
agccagcucaaaccugucuccuc

SEQ ID NO: 650515 - RNA, 21 nt, Human
aggcaggagguggcgaucccg

SEQ ID NO: 650516 - RNA, 22 nt, Human
aggcaggagguggcgaucccgg

SEQ ID NO: 650517 - RNA, 21 nt, Human
aggcagggccggacccuggug

SEQ ID NO: 650518 - RNA, 23 nt, Human
agggggcugccgcgcuccgggcc

SEQ ID NO: 650519 - RNA, 18 nt, Human
cagagcaaaaaagccuuc

SEQ ID NO: 650520 - RNA, 23 nt, Human
cagccagcucaaaccugucuccu

SEQ ID NO: 650521 - RNA, 18 nt, Human
ccagcccggcgaacaucc

SEQ ID NO: 650522 - RNA, 18 nt, Human
ccgccgggcagccuuggg

SEQ ID NO: 650523 - RNA, 18 nt, Human
ccuggcucgggugggggg

SEQ ID NO: 650524 - RNA, 18 nt, Human
cgagaaggcaggaggugg

SEQ ID NO: 650525 - RNA, 25 nt, Human
cggcgaggucccaggucauacgggg

SEQ ID NO: 650526 - RNA, 24 nt, Human
cuccucuacacucaccaacuucuc

SEQ ID NO: 650527 - RNA, 22 nt, Human
cuucagccagcucaaaccuguc

SEQ ID NO: 650528 - RNA, 19 nt, Human
cuuccuccuuucagccucc

SEQ ID NO: 650529 - RNA, 24 nt, Human
cuuucagccuccucuacacucacc

SEQ ID NO: 650530 - RNA, 21 nt, Human
gaacauccgaacagccgagaa

SEQ ID NO: 650531 - RNA, 24 nt, Human
ggaaguccuggcucgggugggggg

SEQ ID NO: 650532 - RNA, 22 nt, Human
ggcucggagcagggggcugccg

SEQ ID NO: 650533 - RNA, 23 nt, Human
ggcucgggugggggggcaguccu

SEQ ID NO: 650534 - RNA, 19 nt, Human
ggugggggggcagucccgg

SEQ ID NO: 650535 - RNA, 21 nt, Human
uaaguugcaaaaacacauuaa

SEQ ID NO: 650536 - RNA, 24 nt, Human
uacagagcaaaaaagccuucuuaa

SEQ ID NO: 650537 - RNA, 24 nt, Human
uacggagggacccaggaggucucg

SEQ ID NO: 650538 - RNA, 24 nt, Human
uccagcuacggagggacccaggag

SEQ ID NO: 650539 - RNA, 18 nt, Human
uccaggcuacagagcaaa

SEQ ID NO: 650540 - RNA, 22 nt, Human
uccuuucagccuccucuacacu

SEQ ID NO: 650541 - RNA, 23 nt, Human
ucgggacggcgaggucccagguc

SEQ ID NO: 650542 - RNA, 19 nt, Human
ucucugauaggugggcaga

SEQ ID NO: 650543 - RNA, 21 nt, Human
ugauaggugggcagaccucuu

SEQ ID NO: 650544 - RNA, 20 nt, Human
ugggcagaccucuuccugcu

SEQ ID NO: 650545 - RNA, 18 nt, Human
ugucccuucuccugaugu

SEQ ID NO: 650546 - RNA, 20 nt, Human
uucugcuucucugauaggug

SEQ ID NO: 650547 - RNA, 23 nt, Human
uugcaaaaacacauuaagcuccu

SEQ ID NO: 650548 - RNA, 25 nt, Human
uuggggcagaggugcagggaggcag

SEQ ID NO: 650549 - RNA, 21 nt, Human
uuuuuuuuuuuuuuuuuacag

SEQ ID NO: 650550 - RNA, 21 nt, Human
acccgccccgcgcucggaccc

SEQ ID NO: 650551 - RNA, 23 nt, Human
acgcagcccaggccgaggcccuu

SEQ ID NO: 650552 - RNA, 21 nt, Human
acugcaaggaguauuucaaaa

SEQ ID NO: 650553 - RNA, 21 nt, Human
acuucuuuuaaagaaggugau

SEQ ID NO: 650554 - RNA, 23 nt, Human
agcccaggccgaggcccuucggc

SEQ ID NO: 650555 - RNA, 21 nt, Human
auggcgcugaggaacgcuuua

SEQ ID NO: 650556 - RNA, 27 nt, Human
caggccgaggcccuucggcaacccgcc

SEQ ID NO: 650557 - RNA, 24 nt, Human
ccccgcgcucggacccagccacuc

SEQ ID NO: 650558 - RNA, 19 nt, Human
ccccggugccugccggugg

SEQ ID NO: 650559 - RNA, 20 nt, Human
ccggugccugccggugcugu

SEQ ID NO: 650560 - RNA, 22 nt, Human
ccguccccgcucuccagcacgc

SEQ ID NO: 650561 - RNA, 22 nt, Human
ccucagcggugucggagaaaga

SEQ ID NO: 650562 - RNA, 18 nt, Human
ccuguugcugcagccucu

SEQ ID NO: 650563 - RNA, 18 nt, Human
cgcucggacccagccacu

SEQ ID NO: 650564 - RNA, 22 nt, Human
cucgcggaccuuuucucugucg

SEQ ID NO: 650565 - RNA, 19 nt, Human
gaaaaugcuuuuacuguau

SEQ ID NO: 650566 - RNA, 20 nt, Human
gaccuguugcugcagccucu

SEQ ID NO: 650567 - RNA, 19 nt, Human
gcucuccagcacgcagccc

SEQ ID NO: 650568 - RNA, 21 nt, Human
ggaccuguugcugcagccucu

SEQ ID NO: 650569 - RNA, 22 nt, Human
uaagugaagaucaaaugacccc

SEQ ID NO: 650570 - RNA, 18 nt, Human
uaugacaccaacaacgug

SEQ ID NO: 650571 - RNA, 23 nt, Human
uauugaauaugacaccaacaacg

SEQ ID NO: 650572 - RNA, 24 nt, Human
ucgcggaccuuuucucugucgcuc

SEQ ID NO: 650573 - RNA, 21 nt, Human
ugaggaacgcuuuagagccga

SEQ ID NO: 650574 - RNA, 22 nt, Human
uuuaguuuuuucaauaccuucu

SEQ ID NO: 650575 - RNA, 18 nt, Human
uuuccgggcggauggcgc

SEQ ID NO: 650576 - RNA, 24 nt, Human
uuuccgggcggauggcgcugagga

SEQ ID NO: 650577 - RNA, 26 nt, Human
uuuuuuuuuuuuuuuuuuuaguuuuu

SEQ ID NO: 650578 - RNA, 24 nt, Human
aaaaaauaucagagauacuaaaac

SEQ ID NO: 650579 - RNA, 23 nt, Human
aaaaagaccucauacagucugcu

SEQ ID NO: 650580 - RNA, 21 nt, Human
aaacauaacuuuuaagagcaa

SEQ ID NO: 650581 - RNA, 21 nt, Human
aaacauauguagugaaaaaga

SEQ ID NO: 650582 - RNA, 21 nt, Human
aaacauucauacaaaaacaua

SEQ ID NO: 650583 - RNA, 20 nt, Human
aaauauagcuacacaaaacc

SEQ ID NO: 650584 - RNA, 24 nt, Human
aaauauagcuacacaaaaccagaa

SEQ ID NO: 650585 - RNA, 22 nt, Human
aaauaucagagauacuaaaacu

SEQ ID NO: 650586 - RNA, 20 nt, Human
aaaugcuaaagguuuacauu

SEQ ID NO: 650587 - RNA, 18 nt, Human
aaccauauaacucccaaa

SEQ ID NO: 650588 - RNA, 27 nt, Human
aaguaaauauaaauuagccaaguccau

SEQ ID NO: 650589 - RNA, 21 nt, Human
aagugguauuuuaaaaaaaga

SEQ ID NO: 650590 - RNA, 20 nt, Human
acacucuacaagaauguaaa

SEQ ID NO: 650591 - RNA, 18 nt, Human
acauucauacaugacaug

SEQ ID NO: 650592 - RNA, 23 nt, Human
agugaaacauaacuuuuaagagc

SEQ ID NO: 650593 - RNA, 18 nt, Human
caaaaaauaucagagaua

SEQ ID NO: 650594 - RNA, 22 nt, Human
caagaacacucuacaagaaugu

SEQ ID NO: 650595 - RNA, 23 nt, Human
cacaguaucucagugugaacaaa

SEQ ID NO: 650596 - RNA, 22 nt, Human
caccagcagugguauuaaaccc

SEQ ID NO: 650597 - RNA, 25 nt, Human
cacuuucaccucaaugaaauugaag

SEQ ID NO: 650598 - RNA, 24 nt, Human
cagacgugcaauaaucugaaauua

SEQ ID NO: 650599 - RNA, 22 nt, Human
cagcagugguauuaaaccccaa

SEQ ID NO: 650600 - RNA, 22 nt, Human
cauauucaccuuuuuccuuaga

SEQ ID NO: 650601 - RNA, 18 nt, Human
cauuccagaauuugguuc

SEQ ID NO: 650602 - RNA, 19 nt, Human
cauuuuacauacacaguau

SEQ ID NO: 650603 - RNA, 25 nt, Human
cccagccucggcgcugacgaccagc

SEQ ID NO: 650604 - RNA, 22 nt, Human
cgcugacgaccagcgcccggca

SEQ ID NO: 650605 - RNA, 23 nt, Human
cucagcccagccucggcgcugac

SEQ ID NO: 650606 - RNA, 18 nt, Human
cugaaauuauuauaaucu

SEQ ID NO: 650607 - RNA, 21 nt, Human
cuguaaaccauucuaaaucac

SEQ ID NO: 650608 - RNA, 23 nt, Human
cugugaggaauaucuagcuauau

SEQ ID NO: 650609 - RNA, 24 nt, Human
cuugaaggacuacugcagagaaau

SEQ ID NO: 650610 - RNA, 25 nt, Human
gcacaaagaaagguuauauuuuauc

SEQ ID NO: 650611 - RNA, 19 nt, Human
gcacuuucaccucaaugaa

SEQ ID NO: 650612 - RNA, 22 nt, Human
ggauauuuuuccacuucaaugu

SEQ ID NO: 650613 - RNA, 20 nt, Human
ggaugaugugugaaccacca

SEQ ID NO: 650614 - RNA, 24 nt, Human
ggugcagagaguguuucaagaaca

SEQ ID NO: 650615 - RNA, 19 nt, Human
gucaggcauauuaaggaug

SEQ ID NO: 650616 - RNA, 25 nt, Human
uaaaaaaagaccucauacagucugc

SEQ ID NO: 650617 - RNA, 24 nt, Human
uaaaaaagcaaaaaaauagaaaua

SEQ ID NO: 650618 - RNA, 23 nt, Human
uaaaauauagcuacacaaaacca

SEQ ID NO: 650619 - RNA, 22 nt, Human
uaaauauaaauuagccaagucc

SEQ ID NO: 650620 - RNA, 18 nt, Human
uaagagcaagaaaucugc

SEQ ID NO: 650621 - RNA, 24 nt, Human
uaauaauuaaggcauuuuacauac

SEQ ID NO: 650622 - RNA, 22 nt, Human
uacaggaaugaaaaauauuaga

SEQ ID NO: 650623 - RNA, 26 nt, Human
uaccaaauaaccauauaacucccaaa

SEQ ID NO: 650624 - RNA, 24 nt, Human
uagcuacacaaaaccagaacucag

SEQ ID NO: 650625 - RNA, 19 nt, Human
uagugguuucauuacgugg

SEQ ID NO: 650626 - RNA, 18 nt, Human
uaguuuuuuaaaacagau

SEQ ID NO: 650627 - RNA, 18 nt, Human
uauaaaauauagcuacac

SEQ ID NO: 650628 - RNA, 18 nt, Human
uauuaaggaugggaugau

SEQ ID NO: 650629 - RNA, 30 nt, Human
ucaagaacacucuacaagaauguaaacccc

SEQ ID NO: 650630 - RNA, 23 nt, Human
ugaaacauaacuuuuaagagcaa

SEQ ID NO: 650631 - RNA, 21 nt, Human
ugaugauuggucuuggugguu

SEQ ID NO: 650632 - RNA, 21 nt, Human
ugcagagaaauucaauuacua

SEQ ID NO: 650633 - RNA, 23 nt, Human
uggccucuuaaauaacucaccuc

SEQ ID NO: 650634 - RNA, 22 nt, Human
ugggaugaugugugaaccacca

SEQ ID NO: 650635 - RNA, 23 nt, Human
ugggaugaugugugaaccaccag

SEQ ID NO: 650636 - RNA, 21 nt, Human
ugguauuuuaaaaaaagaccu

SEQ ID NO: 650637 - RNA, 24 nt, Human
uuaaaaaagcaaaaaaauagaaau

SEQ ID NO: 650638 - RNA, 21 nt, Human
uuaaaacagauauugguauca

SEQ ID NO: 650639 - RNA, 21 nt, Human
uuaaauaacucaccucucaaa

SEQ ID NO: 650640 - RNA, 23 nt, Human
uuaaggcauuuuacauacacagu

SEQ ID NO: 650641 - RNA, 23 nt, Human
uucaagaacacucuacaagaaug

SEQ ID NO: 650642 - RNA, 21 nt, Human
uuccuagugguaaguccuguc

SEQ ID NO: 650643 - RNA, 19 nt, Human
uugaaggacuacugcagag

SEQ ID NO: 650644 - RNA, 21 nt, Human
uuggaauuuaaaauacaagau

SEQ ID NO: 650645 - RNA, 19 nt, Human
uuggugguuccuaguggua

SEQ ID NO: 650646 - RNA, 19 nt, Human
uuuaaaacagauauuggua

SEQ ID NO: 650647 - RNA, 22 nt, Human
uuucagucuuuucaacauaaga

SEQ ID NO: 650648 - RNA, 18 nt, Human
aaaaaaaaaaugaaaggu

SEQ ID NO: 650649 - RNA, 20 nt, Human
aaaaagcagcacaaauacuu

SEQ ID NO: 650650 - RNA, 19 nt, Human
aagcagcacaaauacuugc

SEQ ID NO: 650651 - RNA, 25 nt, Human
acccugccacccacgacagaaacaa

SEQ ID NO: 650652 - RNA, 21 nt, Human
agaaacaggccgggaguccac

SEQ ID NO: 650653 - RNA, 19 nt, Human
auguuuacaucucuuugca

SEQ ID NO: 650654 - RNA, 19 nt, Human
cacccuacaaaucaucaua

SEQ ID NO: 650655 - RNA, 19 nt, Human
cagcucuaaacggcgccag

SEQ ID NO: 650656 - RNA, 20 nt, Human
ccacgacagaaacaagcacu

SEQ ID NO: 650657 - RNA, 25 nt, Human
cccacgacagaaacaagcacugagc

SEQ ID NO: 650658 - RNA, 22 nt, Human
cgggcccggggacagaaaccag

SEQ ID NO: 650659 - RNA, 19 nt, Human
gcuugaggggccuuggccc

SEQ ID NO: 650660 - RNA, 19 nt, Human
gcuuuuuuuuuuuccucca

SEQ ID NO: 650661 - RNA, 21 nt, Human
ggacagaaaccagacguucca

SEQ ID NO: 650662 - RNA, 20 nt, Human
ggauggcuuuuuuuuuuucc

SEQ ID NO: 650663 - RNA, 23 nt, Human
ggcaggaagggguggcuccaggu

SEQ ID NO: 650664 - RNA, 20 nt, Human
ggcaggaagggguggcuccg

SEQ ID NO: 650665 - RNA, 18 nt, Human
gggcaggaagggguggcu

SEQ ID NO: 650666 - RNA, 21 nt, Human
gguggcuccaggucucacugu

SEQ ID NO: 650667 - RNA, 24 nt, Human
gugcuugaggggccuuggcccugu

SEQ ID NO: 650668 - RNA, 22 nt, Human
uauuuuuuaagugugaauguaa

SEQ ID NO: 650669 - RNA, 18 nt, Human
uccaaaaagcagcacaaa

SEQ ID NO: 650670 - RNA, 22 nt, Human
uccacgggcucccagcucuaaa

SEQ ID NO: 650671 - RNA, 19 nt, Human
uccagggagaaggggagaa

SEQ ID NO: 650672 - RNA, 19 nt, Human
ucuccaaaaagcagcacaa

SEQ ID NO: 650673 - RNA, 22 nt, Human
ucugcagucaugcauuuaguuu

SEQ ID NO: 650674 - RNA, 22 nt, Human
uguauguuuacaucucuuugca

SEQ ID NO: 650675 - RNA, 21 nt, Human
uucaagaaaaaaaaaaugaaa

SEQ ID NO: 650676 - RNA, 24 nt, Human
uucaagaaaaaaaaaaugaaaggu

SEQ ID NO: 650677 - RNA, 24 nt, Human
uugccucauuggauggcuuuuuuu

SEQ ID NO: 650678 - RNA, 20 nt, Human
uuuuuuuuuuuccuccaggg

SEQ ID NO: 650679 - RNA, 18 nt, Human
accccgcccggcgcagga

SEQ ID NO: 650680 - RNA, 18 nt, Human
agcccugcgaccuggccc

SEQ ID NO: 650681 - RNA, 23 nt, Human
agcccugcgaccuggcccuuccg

SEQ ID NO: 650682 - RNA, 19 nt, Human
caggagcaguuggcugccu

SEQ ID NO: 650683 - RNA, 22 nt, Human
ccaccuuaucuuuguccuccuc

SEQ ID NO: 650684 - RNA, 19 nt, Human
cccgccgccugcagcucca

SEQ ID NO: 650685 - RNA, 18 nt, Human
ccggcgcucggagccgcu

SEQ ID NO: 650686 - RNA, 18 nt, Human
ccuccagacagauaagcc

SEQ ID NO: 650687 - RNA, 19 nt, Human
ccuccagacagauaagccc

SEQ ID NO: 650688 - RNA, 22 nt, Human
ccuccagacagauaagccccug

SEQ ID NO: 650689 - RNA, 21 nt, Human
cgccugcagcuccaggagccc

SEQ ID NO: 650690 - RNA, 20 nt, Human
cgcucggagccgcuggcggc

SEQ ID NO: 650691 - RNA, 26 nt, Human
cuccaggagcccugcgaccuggcccu

SEQ ID NO: 650692 - RNA, 20 nt, Human
gacagauaagccccugcaug

SEQ ID NO: 650693 - RNA, 23 nt, Human
ggcgacgaccccgcccggcgcag

SEQ ID NO: 650694 - RNA, 19 nt, Human
ugagucaagcauuuguagc

SEQ ID NO: 650695 - RNA, 20 nt, Human
ugagucaagcauuuguagcc

SEQ ID NO: 650696 - RNA, 24 nt, Human
uuccggcgcucggagccgcuggcg

SEQ ID NO: 650697 - RNA, 20 nt, Human
uuuuuuuuuuuuuuucccaa

SEQ ID NO: 650698 - RNA, 24 nt, Human
uuuuuuuuuuuuuuuuuucccaag

SEQ ID NO: 650699 - RNA, 19 nt, Human
aaaacaaaaaaguaaggac

SEQ ID NO: 650700 - RNA, 21 nt, Human
aaaaccuuuauaaccaccagg

SEQ ID NO: 650701 - RNA, 19 nt, Human
aacaaaaaaguaaggaccu

SEQ ID NO: 650702 - RNA, 23 nt, Human
aagaaaaacgauuuuagggucca

SEQ ID NO: 650703 - RNA, 22 nt, Human
acaaaaacauuuuccuaaacca

SEQ ID NO: 650704 - RNA, 18 nt, Human
aggaaggaaaacaaaaaa

SEQ ID NO: 650705 - RNA, 18 nt, Human
cacugcuggaaauuaucc

SEQ ID NO: 650706 - RNA, 20 nt, Human
cauuggaaauugaagggagu

SEQ ID NO: 650707 - RNA, 19 nt, Human
ccaccagaugucccuccuc

SEQ ID NO: 650708 - RNA, 21 nt, Human
ccuccucccucuaggaacaaa

SEQ ID NO: 650709 - RNA, 22 nt, Human
cguggaccaccagaugucccuc

SEQ ID NO: 650710 - RNA, 21 nt, Human
cucaggaaggaaaacaaaaaa

SEQ ID NO: 650711 - RNA, 20 nt, Human
cucccucuaggaacaaaaac

SEQ ID NO: 650712 - RNA, 20 nt, Human
cuccucccucuaggaacaaa

SEQ ID NO: 650713 - RNA, 25 nt, Human
cuccuuguccagagucaccacuguu

SEQ ID NO: 650714 - RNA, 18 nt, Human
cugggcugcucaccugag

SEQ ID NO: 650715 - RNA, 19 nt, Human
gcuggguaaaaggcaaggc

SEQ ID NO: 650716 - RNA, 18 nt, Human
uaaaaggcaaggcuacca

SEQ ID NO: 650717 - RNA, 25 nt, Human
uacuugaauaguuccaucaggauga

SEQ ID NO: 650718 - RNA, 19 nt, Human
uauacauucacagcuugac

SEQ ID NO: 650719 - RNA, 19 nt, Human
ucaugagggcaaagacuac

SEQ ID NO: 650720 - RNA, 23 nt, Human
uccucuaacagauccccggcuau

SEQ ID NO: 650721 - RNA, 20 nt, Human
ucguugucucuuucugggcu

SEQ ID NO: 650722 - RNA, 18 nt, Human
ucugugcuggguaaaagg

SEQ ID NO: 650723 - RNA, 24 nt, Human
ugggaauaaggugcuccagaauac

SEQ ID NO: 650724 - RNA, 21 nt, Human
uuaaagguuucguugucucuu

SEQ ID NO: 650725 - RNA, 20 nt, Human
uugcugcuuaagaaaaacga

SEQ ID NO: 650726 - RNA, 18 nt, Human
uuucguugucucuuucug

SEQ ID NO: 650727 - RNA, 21 nt, Human
uuuuuuuuuugcauguaacuu

SEQ ID NO: 650728 - RNA, 18 nt, Human
uuuuuuuuuuuuuuuuug

SEQ ID NO: 650729 - RNA, 21 nt, Human
uuuuuuuuuuuuuuuuugcau

SEQ ID NO: 650730 - RNA, 25 nt, Human
uuuuuuuuuuuuuuuuugcauguaa

SEQ ID NO: 650731 - RNA, 19 nt, Human
agcccacccuccuguccca

SEQ ID NO: 650732 - RNA, 18 nt, Human
caccucuccccucuggcc

SEQ ID NO: 650733 - RNA, 18 nt, Human
cagcccacccuccugucc

SEQ ID NO: 650734 - RNA, 20 nt, Human
cccagggggagcaccucucc

SEQ ID NO: 650735 - RNA, 18 nt, Human
ccccucuggccaccacuc

SEQ ID NO: 650736 - RNA, 18 nt, Human
ccgggagcugcucugagc

SEQ ID NO: 650737 - RNA, 23 nt, Human
ccucuggccaccacucugcuggg

SEQ ID NO: 650738 - RNA, 19 nt, Human
gaggagggcagggcagggc

SEQ ID NO: 650739 - RNA, 23 nt, Human
gccuuguuccugcaggccagggu

SEQ ID NO: 650740 - RNA, 22 nt, Human
gugccccugccgggagcugcuc

SEQ ID NO: 650741 - RNA, 21 nt, Human
ucaugaggagggcagggcagg

SEQ ID NO: 650742 - RNA, 21 nt, Human
ugcccaccagcccacccuccu

SEQ ID NO: 650743 - RNA, 21 nt, Human
ugccccugccgggagcugcuc

SEQ ID NO: 650744 - RNA, 23 nt, Human
ugccccugccgggagcugcucug

SEQ ID NO: 650745 - RNA, 20 nt, Human
ugccuuguuccugcaggcca

SEQ ID NO: 650746 - RNA, 24 nt, Human
uuuuuuuugccgugagugccccug

SEQ ID NO: 650747 - RNA, 21 nt, Human
uuuuuuuuuuuuuugccguga

SEQ ID NO: 650748 - RNA, 22 nt, Human
uuuuuuuuuuuuuuuuugccgu

SEQ ID NO: 650749 - RNA, 25 nt, Human
uuuuuuuuuuuuuuuuuugccguga

SEQ ID NO: 650750 - RNA, 27 nt, Human
uuuuuuuuuuuuuuuuuuuuuuugggg

SEQ ID NO: 650751 - RNA, 19 nt, Human
aagcuggccgugccaaguu

SEQ ID NO: 650752 - RNA, 24 nt, Human
agucagcaaaguucuuuauugggu

SEQ ID NO: 650753 - RNA, 19 nt, Human
ccgugauagcgggacuucc

SEQ ID NO: 650754 - RNA, 23 nt, Human
gugauagcgggacuuccaaacac

SEQ ID NO: 650755 - RNA, 20 nt, Human
uccugggucccaagcuggcc

SEQ ID NO: 650756 - RNA, 22 nt, Human
uuaguagucagcaaaguucuuu

SEQ ID NO: 650757 - RNA, 18 nt, Human
aacagcuuccucuggugu

SEQ ID NO: 650758 - RNA, 24 nt, Human
accgcaguccccuucccccccccc

SEQ ID NO: 650759 - RNA, 20 nt, Human
acggggucaugccaaacaga

SEQ ID NO: 650760 - RNA, 18 nt, Human
acggguccccugggcugg

SEQ ID NO: 650761 - RNA, 20 nt, Human
agaggcuccccgcacacugg

SEQ ID NO: 650762 - RNA, 22 nt, Human
aggccaucauggcuucccaugg

SEQ ID NO: 650763 - RNA, 19 nt, Human
agggccccgcccuccaccc

SEQ ID NO: 650764 - RNA, 20 nt, Human
aggugcggccgucccugacu

SEQ ID NO: 650765 - RNA, 22 nt, Human
cacaacaacccugugagguagg

SEQ ID NO: 650766 - RNA, 21 nt, Human
cacaucagggccccgcccucc

SEQ ID NO: 650767 - RNA, 19 nt, Human
cagaaagaugaggccugcg

SEQ ID NO: 650768 - RNA, 22 nt, Human
cagagccaggagacacgggguc

SEQ ID NO: 650769 - RNA, 24 nt, Human
cagcucggcccgcuuccccugcag

SEQ ID NO: 650770 - RNA, 19 nt, Human
caggagccgggccacagag

SEQ ID NO: 650771 - RNA, 23 nt, Human
cagggcggggccgugugugggcc

SEQ ID NO: 650772 - RNA, 21 nt, Human
ccacagagcggcgggcggccu

SEQ ID NO: 650773 - RNA, 24 nt, Human
ccagggcggggccgugugugggcc

SEQ ID NO: 650774 - RNA, 19 nt, Human
ccccccagacuguggucaa

SEQ ID NO: 650775 - RNA, 21 nt, Human
ccccgcgcuggacuugcugac

SEQ ID NO: 650776 - RNA, 18 nt, Human
cccgcgccucggccaucc

SEQ ID NO: 650777 - RNA, 23 nt, Human
cccgcggcacagaaagaugaggc

SEQ ID NO: 650778 - RNA, 20 nt, Human
ccuccaccccccgcauucuc

SEQ ID NO: 650779 - RNA, 19 nt, Human
ccugcagcccagcuuuacc

SEQ ID NO: 650780 - RNA, 22 nt, Human
ccugcgcucaaggccccagggc

SEQ ID NO: 650781 - RNA, 21 nt, Human
cggagucccgcggcacagaaa

SEQ ID NO: 650782 - RNA, 25 nt, Human
cuccaugcuaggccaucauggcuuc

SEQ ID NO: 650783 - RNA, 21 nt, Human
cugcagagccaggagacacgg

SEQ ID NO: 650784 - RNA, 24 nt, Human
cugguguccaccgcaguccccuuc

SEQ ID NO: 650785 - RNA, 21 nt, Human
gagcaggagccgggccacaga

SEQ ID NO: 650786 - RNA, 21 nt, Human
gcaggugcggccgucccugac

SEQ ID NO: 650787 - RNA, 23 nt, Human
ggcaaugacugguucaagaggaa

SEQ ID NO: 650788 - RNA, 23 nt, Human
ggcaggugcggccgucccugacu

SEQ ID NO: 650789 - RNA, 18 nt, Human
ggccugaggugcgcacug

SEQ ID NO: 650790 - RNA, 18 nt, Human
ggccugcagagccaggag

SEQ ID NO: 650791 - RNA, 22 nt, Human
gggccacagagcggcgggcggc

SEQ ID NO: 650792 - RNA, 20 nt, Human
gggccccgcccuccaccccc

SEQ ID NO: 650793 - RNA, 20 nt, Human
gggcggggccgugugugggc

SEQ ID NO: 650794 - RNA, 22 nt, Human
gggcggggccgugugugggccu

SEQ ID NO: 650795 - RNA, 23 nt, Human
gggcugggcugccugccucucug

SEQ ID NO: 650796 - RNA, 22 nt, Human
gugagcgggcagcuccaugcag

SEQ ID NO: 650797 - RNA, 24 nt, Human
uaaacuuucccucaacuuccaggc

SEQ ID NO: 650798 - RNA, 18 nt, Human
uagcccccgcgcuggacu

SEQ ID NO: 650799 - RNA, 22 nt, Human
uccaacaucacaacaggaaaca

SEQ ID NO: 650800 - RNA, 22 nt, Human
uccaggcagggccugggaacag

SEQ ID NO: 650801 - RNA, 20 nt, Human
uccaguuucugccgucuggg

SEQ ID NO: 650802 - RNA, 19 nt, Human
uccccgcacacuggagccg

SEQ ID NO: 650803 - RNA, 21 nt, Human
uccccugggcugggcugccug

SEQ ID NO: 650804 - RNA, 19 nt, Human
uccccuuccccccccccca

SEQ ID NO: 650805 - RNA, 23 nt, Human
uccccuucccccccccccagacu

SEQ ID NO: 650806 - RNA, 18 nt, Human
ucccgcgccucggccacc

SEQ ID NO: 650807 - RNA, 26 nt, Human
ucuacuccacaucagggccccgcccu

SEQ ID NO: 650808 - RNA, 20 nt, Human
ugacuccagcacaugaacac

SEQ ID NO: 650809 - RNA, 24 nt, Human
ugagccucacaacaacccugugag

SEQ ID NO: 650810 - RNA, 18 nt, Human
ugcagagccaggagacac

SEQ ID NO: 650811 - RNA, 18 nt, Human
uggaaugucccgcgccuc

SEQ ID NO: 650812 - RNA, 18 nt, Human
uggaaugucccgcgccuc

SEQ ID NO: 650813 - RNA, 22 nt, Human
uggaaugucccgcgccucggcc

SEQ ID NO: 650814 - RNA, 18 nt, Human
uuuuuuuuuuuuuuuuug

SEQ ID NO: 650815 - RNA, 20 nt, Human
uuuuuuuuuuuuuuuuugcu

SEQ ID NO: 650816 - RNA, 22 nt, Human
uuuuuuuuuuuuuuuuugcuga

SEQ ID NO: 650817 - RNA, 21 nt, Human
agcagugguagguagucccuc

SEQ ID NO: 650818 - RNA, 20 nt, Human
agccccugggcaggugcacu

SEQ ID NO: 650819 - RNA, 23 nt, Human
agcugguggcgauggcacagccg

SEQ ID NO: 650820 - RNA, 22 nt, Human
agggagaguccuggagccccug

SEQ ID NO: 650821 - RNA, 23 nt, Human
aggggcugucccgggucugagca

SEQ ID NO: 650822 - RNA, 23 nt, Human
agggggaaagagguuagggggcc

SEQ ID NO: 650823 - RNA, 22 nt, Human
agguuagggggcaagagguggg

SEQ ID NO: 650824 - RNA, 19 nt, Human
aguccuggagccccuggag

SEQ ID NO: 650825 - RNA, 19 nt, Human
caagaggugggccccccag

SEQ ID NO: 650826 - RNA, 24 nt, Human
caccccccgucucagggacccgcu

SEQ ID NO: 650827 - RNA, 27 nt, Human
cacuuccuuuauuucucaucauuuaca

SEQ ID NO: 650828 - RNA, 24 nt, Human
cagccaccccccgucucagggacc

SEQ ID NO: 650829 - RNA, 22 nt, Human
cagccccugggcaggugcacug

SEQ ID NO: 650830 - RNA, 22 nt, Human
cagcgaggaagccucggaccuc

SEQ ID NO: 650831 - RNA, 21 nt, Human
cauuuacaaaagauguacaga

SEQ ID NO: 650832 - RNA, 24 nt, Human
ccaccccccgucucagggacccgc

SEQ ID NO: 650833 - RNA, 18 nt, Human
ccccugggcaggugcacu

SEQ ID NO: 650834 - RNA, 18 nt, Human
cgacucagcuggcagcga

SEQ ID NO: 650835 - RNA, 18 nt, Human
cugaacagccccugggca

SEQ ID NO: 650836 - RNA, 21 nt, Human
cugagcaggaggcugggagcu

SEQ ID NO: 650837 - RNA, 21 nt, Human
cugguggcgauggcacagccu

SEQ ID NO: 650838 - RNA, 30 nt, Human
cuucuuggaucugcugcuguugcugccguc

SEQ ID NO: 650839 - RNA, 25 nt, Human
gagcaggaggcugggagcugguggc

SEQ ID NO: 650840 - RNA, 22 nt, Human
gcaagaggugggccccccaggg

SEQ ID NO: 650841 - RNA, 19 nt, Human
gcacggagcagguacaagg

SEQ ID NO: 650842 - RNA, 19 nt, Human
gcagaaaagggggaaagag

SEQ ID NO: 650843 - RNA, 21 nt, Human
gccauugccagcucugaacag

SEQ ID NO: 650844 - RNA, 21 nt, Human
gcgauggcacagccgggagca

SEQ ID NO: 650845 - RNA, 23 nt, Human
ggcaagaggugggccccccaggg

SEQ ID NO: 650846 - RNA, 24 nt, Human
gggcaagaggugggccccccaggg

SEQ ID NO: 650847 - RNA, 22 nt, Human
gggcagaaaagggggaaagagg

SEQ ID NO: 650848 - RNA, 24 nt, Human
gggcagaaaagggggaaagaggag

SEQ ID NO: 650849 - RNA, 22 nt, Human
ggggagggcagccaccccccgu

SEQ ID NO: 650850 - RNA, 21 nt, Human
gguggcgauggcacagccggg

SEQ ID NO: 650851 - RNA, 23 nt, Human
guagguagucccucaggugccca

SEQ ID NO: 650852 - RNA, 18 nt, Human
uccuggagccccuggagg

SEQ ID NO: 650853 - RNA, 19 nt, Human
ucugcugcuguugcugcug

SEQ ID NO: 650854 - RNA, 27 nt, Human
ucuuggaucugcugcuguugcugcugu

SEQ ID NO: 650855 - RNA, 23 nt, Human
ugaacagccccugggcaggugca

SEQ ID NO: 650856 - RNA, 23 nt, Human
uggaucugcugcuguugcugcug

SEQ ID NO: 650857 - RNA, 27 nt, Human
uguccuguccccccauuccgccugcuu

SEQ ID NO: 650858 - RNA, 23 nt, Human
ugucgcugccauugccagcucug

SEQ ID NO: 650859 - RNA, 18 nt, Human
uguguugggcacggagca

SEQ ID NO: 650860 - RNA, 23 nt, Human
uuuggagcugcucaggcugccgg

SEQ ID NO: 650861 - RNA, 19 nt, Human
uuuuuuuuuuuuuuuugcg

SEQ ID NO: 650862 - RNA, 21 nt, Human
uuuuuuuuuuuuuuuuugcgu

SEQ ID NO: 650863 - RNA, 20 nt, Human
uuuuuuuuuuuuuuuuuugg

SEQ ID NO: 650864 - RNA, 22 nt, Human
aaaaaaaaacaugguucaauaa

SEQ ID NO: 650865 - RNA, 21 nt, Human
aauaaaacaaaggacccacac

SEQ ID NO: 650866 - RNA, 20 nt, Human
aauuucuuuauaauuccaug

SEQ ID NO: 650867 - RNA, 22 nt, Human
aggaaggaguuauaugacuuua

SEQ ID NO: 650868 - RNA, 21 nt, Human
auggcccaggaaccuucuucc

SEQ ID NO: 650869 - RNA, 22 nt, Human
caggaaccuucuuccaugguuc

SEQ ID NO: 650870 - RNA, 24 nt, Human
cuccuauuugguuuuguuuuuguu

SEQ ID NO: 650871 - RNA, 23 nt, Human
cugcaacacauacugauggccca

SEQ ID NO: 650872 - RNA, 18 nt, Human
cuggcaaguacugucugc

SEQ ID NO: 650873 - RNA, 20 nt, Human
cugucugcauuguucaaaau

SEQ ID NO: 650874 - RNA, 18 nt, Human
cuuugaaaaauauccaga

SEQ ID NO: 650875 - RNA, 20 nt, Human
gaagcaagagguccggcccu

SEQ ID NO: 650876 - RNA, 24 nt, Human
gcccaggaaccuucuuccaugguu

SEQ ID NO: 650877 - RNA, 21 nt, Human
ggaaaaaaaaacaugguucaa

SEQ ID NO: 650878 - RNA, 24 nt, Human
gguucagaaaaguaaagaaaauga

SEQ ID NO: 650879 - RNA, 18 nt, Human
guaaaaagcaagucuuug

SEQ ID NO: 650880 - RNA, 19 nt, Human
uaauacauacgcuuucccu

SEQ ID NO: 650881 - RNA, 21 nt, Human
uauagaaaucacccugguuua

SEQ ID NO: 650882 - RNA, 19 nt, Human
uauuugguuuuguuuuugu

SEQ ID NO: 650883 - RNA, 21 nt, Human
ucacaaugugcguaaaaagca

SEQ ID NO: 650884 - RNA, 21 nt, Human
uccuggcugugagcucugcaa

SEQ ID NO: 650885 - RNA, 21 nt, Human
ucuaaaggaauacaaacacca

SEQ ID NO: 650886 - RNA, 21 nt, Human
ugacuuuauaagugggaacca

SEQ ID NO: 650887 - RNA, 26 nt, Human
ugagcucugcaacacauacugauggc

SEQ ID NO: 650888 - RNA, 19 nt, Human
ugauuuauagaaaucaccc

SEQ ID NO: 650889 - RNA, 20 nt, Human
ugauuuauagaaaucacccu

SEQ ID NO: 650890 - RNA, 25 nt, Human
uuccccccgaaagccucuuucauga

SEQ ID NO: 650891 - RNA, 22 nt, Human
uugaaaaauauccagaucucua

SEQ ID NO: 650892 - RNA, 21 nt, Human
uugggacucuggcaaguacug

SEQ ID NO: 650893 - RNA, 23 nt, Human
uuuuuuuucaaugccaaaaacug

SEQ ID NO: 650894 - RNA, 19 nt, Human
uuuuuuuuuuuuuuuucaa

SEQ ID NO: 650895 - RNA, 24 nt, Human
aaaaagaacaccucucuucgcaaa

SEQ ID NO: 650896 - RNA, 22 nt, Human
aaaaccauaggugugcuuacca

SEQ ID NO: 650897 - RNA, 21 nt, Human
acaaggcacagcaucagggca

SEQ ID NO: 650898 - RNA, 28 nt, Human
acagaaaaaaauacagaaauuaaaaaaa

SEQ ID NO: 650899 - RNA, 23 nt, Human
acaggccagccccuuggaggggu

SEQ ID NO: 650900 - RNA, 18 nt, Human
accagcaccaggaggggc

SEQ ID NO: 650901 - RNA, 18 nt, Human
accaggaggggcugacag

SEQ ID NO: 650902 - RNA, 21 nt, Human
agaaaaaaauacagaaauuaa

SEQ ID NO: 650903 - RNA, 25 nt, Human
agaaaaaaauacagaaauuaaaaaa

SEQ ID NO: 650904 - RNA, 22 nt, Human
agacaggccagugucacaagga

SEQ ID NO: 650905 - RNA, 20 nt, Human
agauccagcaaugguucacu

SEQ ID NO: 650906 - RNA, 19 nt, Human
agcagccccuuccuggcuc

SEQ ID NO: 650907 - RNA, 21 nt, Human
agccggcccugggccaggcug

SEQ ID NO: 650908 - RNA, 20 nt, Human
agcucaaugggugacaaggc

SEQ ID NO: 650909 - RNA, 24 nt, Human
aggaaaaagaacaccucucuucgc

SEQ ID NO: 650910 - RNA, 20 nt, Human
agggaagaaccgucuggaua

SEQ ID NO: 650911 - RNA, 21 nt, Human
aggggcugacagcagacagca

SEQ ID NO: 650912 - RNA, 24 nt, Human
caaggcucacaggccagccccuug

SEQ ID NO: 650913 - RNA, 23 nt, Human
caauacagaaaaaaauacagaaa

SEQ ID NO: 650914 - RNA, 21 nt, Human
cagcaccaguaaggaaaaaga

SEQ ID NO: 650915 - RNA, 19 nt, Human
cagcagccccuuccuggcu

SEQ ID NO: 650916 - RNA, 19 nt, Human
cagccucaccaggcaaagc

SEQ ID NO: 650917 - RNA, 18 nt, Human
caggccagccccuuggag

SEQ ID NO: 650918 - RNA, 24 nt, Human
ccaaaaccauaggugugcuuacca

SEQ ID NO: 650919 - RNA, 22 nt, Human
ccaggccaggugaguucagaca

SEQ ID NO: 650920 - RNA, 19 nt, Human
cccagcacagggccaggca

SEQ ID NO: 650921 - RNA, 24 nt, Human
ccccuuggaggggugggccgggca

SEQ ID NO: 650922 - RNA, 21 nt, Human
cccgugugcccaccccugcua

SEQ ID NO: 650923 - RNA, 21 nt, Human
ccucagcagccccuuccuggc

SEQ ID NO: 650924 - RNA, 21 nt, Human
ccugcuaggccuuagaugcca

SEQ ID NO: 650925 - RNA, 21 nt, Human
ccuggcucuggacucuggagg

SEQ ID NO: 650926 - RNA, 24 nt, Human
ccuggcucuggacucuggaggggg

SEQ ID NO: 650927 - RNA, 19 nt, Human
ccuggugcucccuccagcc

SEQ ID NO: 650928 - RNA, 21 nt, Human
ccuggugcucccuccagccuc

SEQ ID NO: 650929 - RNA, 22 nt, Human
ccuuccuggcucuggacucugg

SEQ ID NO: 650930 - RNA, 24 nt, Human
cgccaggcucccugggcucugcag

SEQ ID NO: 650931 - RNA, 20 nt, Human
cggcccugggccaggcuggg

SEQ ID NO: 650932 - RNA, 22 nt, Human
cugacagcagacagcagguccu

SEQ ID NO: 650933 - RNA, 24 nt, Human
cuggcuggcugcguggcccccucu

SEQ ID NO: 650934 - RNA, 18 nt, Human
gacccgugugcccacccc

SEQ ID NO: 650935 - RNA, 21 nt, Human
gcaaagccggcccugggccag

SEQ ID NO: 650936 - RNA, 23 nt, Human
gccacagaaucugagauccagca

SEQ ID NO: 650937 - RNA, 18 nt, Human
gccaggcucccugggcuc

SEQ ID NO: 650938 - RNA, 18 nt, Human
gccccuuccuggcucugg

SEQ ID NO: 650939 - RNA, 20 nt, Human
gcccucagcagccccuuccu

SEQ ID NO: 650940 - RNA, 19 nt, Human
gccggcccugggccaggcu

SEQ ID NO: 650941 - RNA, 19 nt, Human
gcgccuuguggcuuccuuu

SEQ ID NO: 650942 - RNA, 21 nt, Human
gcucacaggccagccccuugg

SEQ ID NO: 650943 - RNA, 21 nt, Human
ggaggggugggccgggcagag

SEQ ID NO: 650944 - RNA, 21 nt, Human
ggccaggcuggguguagggcc

SEQ ID NO: 650945 - RNA, 19 nt, Human
ggcucuggacucuggaggg

SEQ ID NO: 650946 - RNA, 18 nt, Human
gggcagggcuugggcccg

SEQ ID NO: 650947 - RNA, 20 nt, Human
gggcagggcuugggcccggg

SEQ ID NO: 650948 - RNA, 20 nt, Human
gggccaggcaucuggcuggc

SEQ ID NO: 650949 - RNA, 24 nt, Human
gggccaggcaucuggcuggcugcg

SEQ ID NO: 650950 - RNA, 24 nt, Human
uaaaaagcaauaguuaaaaagcau

SEQ ID NO: 650951 - RNA, 23 nt, Human
uaaagacuuguuuuucuucuagg

SEQ ID NO: 650952 - RNA, 23 nt, Human
uaaggaaaaagaacaccucucuu

SEQ ID NO: 650953 - RNA, 22 nt, Human
uacaauacagaaaaaaauacag

SEQ ID NO: 650954 - RNA, 27 nt, Human
uagaaaaccccuaaugucccaugaaga

SEQ ID NO: 650955 - RNA, 21 nt, Human
ucagcagccccuuccuggcuc

SEQ ID NO: 650956 - RNA, 22 nt, Human
ucagcagccccuuccuggcucu

SEQ ID NO: 650957 - RNA, 19 nt, Human
ucaguggcccccgcgccuu

SEQ ID NO: 650958 - RNA, 20 nt, Human
uccauccuuccuuucagcac

SEQ ID NO: 650959 - RNA, 21 nt, Human
ucccagucaaggcucacaggc

SEQ ID NO: 650960 - RNA, 23 nt, Human
ucccucuugcagcucaaugggug

SEQ ID NO: 650961 - RNA, 22 nt, Human
ucuagggaagaaccgucuggau

SEQ ID NO: 650962 - RNA, 22 nt, Human
ugaagauacaauacagaaaaaa

SEQ ID NO: 650963 - RNA, 23 nt, Human
ugacaaggcacagcaucagggca

SEQ ID NO: 650964 - RNA, 20 nt, Human
ugacccgugugcccaccccu

SEQ ID NO: 650965 - RNA, 18 nt, Human
ugaguucagacaggccag

SEQ ID NO: 650966 - RNA, 24 nt, Human
ugccacagaaucugagauccagca

SEQ ID NO: 650967 - RNA, 18 nt, Human
uggcugcguggcccccuc

SEQ ID NO: 650968 - RNA, 24 nt, Human
uuaaaaagcaauaguuaaaaagca

SEQ ID NO: 650969 - RNA, 18 nt, Human
uuccucaguggcccccgc

SEQ ID NO: 650970 - RNA, 19 nt, Human
uuggucccucuugcagcuc

SEQ ID NO: 650971 - RNA, 21 nt, Human
uuucuaaaucucagcaaguua

SEQ ID NO: 650972 - RNA, 27 nt, Human
uuuuuuuuuuuuuuuuuuuuuuugggg

SEQ ID NO: 650973 - RNA, 21 nt, Human
aaguucauuuuuuacaccacc

SEQ ID NO: 650974 - RNA, 20 nt, Human
agcagacagcuuacuaaaac

SEQ ID NO: 650975 - RNA, 19 nt, Human
auaccuuuuuuuucuuucu

SEQ ID NO: 650976 - RNA, 24 nt, Human
caacucauuaauuugauuuccuca

SEQ ID NO: 650977 - RNA, 18 nt, Human
cagccuuuuucucucucc

SEQ ID NO: 650978 - RNA, 19 nt, Human
cagcuggaaacaaucugga

SEQ ID NO: 650979 - RNA, 22 nt, Human
caugcuguauucuaagaacaag

SEQ ID NO: 650980 - RNA, 22 nt, Human
ccagagacaauguguccuuucu

SEQ ID NO: 650981 - RNA, 23 nt, Human
cuggaucucacaugaaaauguua

SEQ ID NO: 650982 - RNA, 19 nt, Human
cuuucaacuucaucagugu

SEQ ID NO: 650983 - RNA, 20 nt, Human
guguccuuucuggaucucac

SEQ ID NO: 650984 - RNA, 27 nt, Human
uacgcuucuuccacuccaaccccuggg

SEQ ID NO: 650985 - RNA, 23 nt, Human
uaggaagaaagaagaaagcaaau

SEQ ID NO: 650986 - RNA, 18 nt, Human
uccauaauuugaaguuca

SEQ ID NO: 650987 - RNA, 21 nt, Human
ucuaagaacaagaaccuagau

SEQ ID NO: 650988 - RNA, 21 nt, Human
ucuuucuuucucucuucgaau

SEQ ID NO: 650989 - RNA, 21 nt, Human
uggcauggaaaaacaauuacc

SEQ ID NO: 650990 - RNA, 18 nt, Human
uucuuucuuucuuucucu

SEQ ID NO: 650991 - RNA, 24 nt, Human
uucuuucuuucuuucucucuucga

SEQ ID NO: 650992 - RNA, 18 nt, Human
uuuuacaccacccagcug

SEQ ID NO: 650993 - RNA, 23 nt, Human
uuuuuuuuuuuuuuuuuuuaggg

SEQ ID NO: 650994 - RNA, 24 nt, Human
acagaaaaauuggagagaaggugg

SEQ ID NO: 650995 - RNA, 20 nt, Human
acagaugcaaccagcaaggc

SEQ ID NO: 650996 - RNA, 23 nt, Human
agccaugcuggucuugaacuccu

SEQ ID NO: 650997 - RNA, 27 nt, Human
aggggggcuuccuuccuagacagggcu

SEQ ID NO: 650998 - RNA, 19 nt, Human
agggucaugguugugccuc

SEQ ID NO: 650999 - RNA, 22 nt, Human
aggugccagauaccaucaagcc

SEQ ID NO: 651000 - RNA, 22 nt, Human
aguuacagaaaaauuggagaga

SEQ ID NO: 651001 - RNA, 22 nt, Human
auaucauagcggcaggcaacaa

SEQ ID NO: 651002 - RNA, 19 nt, Human
auccaccugccuuggccuc

SEQ ID NO: 651003 - RNA, 24 nt, Human
augauccaccugccuuggccuccc

SEQ ID NO: 651004 - RNA, 23 nt, Human
auggaagaaacuccaaaggccca

SEQ ID NO: 651005 - RNA, 23 nt, Human
caccugccuuggccucccaaagc

SEQ ID NO: 651006 - RNA, 19 nt, Human
cacuguccauggacccccc

SEQ ID NO: 651007 - RNA, 21 nt, Human
cacuguccauggaccccccca

SEQ ID NO: 651008 - RNA, 22 nt, Human
cagaaagaacagaugcaaccag

SEQ ID NO: 651009 - RNA, 23 nt, Human
cagaaagaacagaugcaaccagc

SEQ ID NO: 651010 - RNA, 18 nt, Human
caucaagccaucaggagg

SEQ ID NO: 651011 - RNA, 18 nt, Human
ccaaagcacaagcuggga

SEQ ID NO: 651012 - RNA, 21 nt, Human
ccagcccagaugccaaggacc

SEQ ID NO: 651013 - RNA, 18 nt, Human
ccccccagcccagaugcc

SEQ ID NO: 651014 - RNA, 29 nt, Human
ccuaauccugggacugaguuccaggaauc

SEQ ID NO: 651015 - RNA, 21 nt, Human
ccucaaagcagagcuggcacc

SEQ ID NO: 651016 - RNA, 20 nt, Human
ccugaccucaaaugauccac

SEQ ID NO: 651017 - RNA, 21 nt, Human
ccugaccucaaaugauccacc

SEQ ID NO: 651018 - RNA, 23 nt, Human
ccugaccucaaaugauccaccug

SEQ ID NO: 651019 - RNA, 23 nt, Human
ccugaccucaaaugauccaccug

SEQ ID NO: 651020 - RNA, 21 nt, Human
ccugccuuggccucccaaagc

SEQ ID NO: 651021 - RNA, 24 nt, Human
cucuugcccuuugaagggcugugg

SEQ ID NO: 651022 - RNA, 21 nt, Human
cugcaggggggcuuccuuccu

SEQ ID NO: 651023 - RNA, 23 nt, Human
gaaaacccuaauccugggacuga

SEQ ID NO: 651024 - RNA, 24 nt, Human
gaaagaacagaugcaaccagcaag

SEQ ID NO: 651025 - RNA, 22 nt, Human
gaagaaacuccaaaggcccagg

SEQ ID NO: 651026 - RNA, 23 nt, Human
gaagguggcagggaugagggcgg

SEQ ID NO: 651027 - RNA, 24 nt, Human
gaccucaaaugauccaccugccuu

SEQ ID NO: 651028 - RNA, 19 nt, Human
gagcuggcaccaacgggca

SEQ ID NO: 651029 - RNA, 25 nt, Human
gauauggaagaaacuccaaaggccc

SEQ ID NO: 651030 - RNA, 23 nt, Human
gccaugcuggucuugaacuccug

SEQ ID NO: 651031 - RNA, 21 nt, Human
gccucccaaagcacaagcugg

SEQ ID NO: 651032 - RNA, 21 nt, Human
gcugcaggggggcuuccuucc

SEQ ID NO: 651033 - RNA, 23 nt, Human
gcuggucuugaacuccugaccuc

SEQ ID NO: 651034 - RNA, 19 nt, Human
ggucuugaacuccugaccu

SEQ ID NO: 651035 - RNA, 19 nt, Human
uaagaagaccaagaacugg

SEQ ID NO: 651036 - RNA, 21 nt, Human
uacagucaggugccagauacc

SEQ ID NO: 651037 - RNA, 23 nt, Human
uagcggcaggcaacaagcaugag

SEQ ID NO: 651038 - RNA, 22 nt, Human
uaguagagacuggguuuuagca

SEQ ID NO: 651039 - RNA, 24 nt, Human
uaguagagacuggguuuuagcaug

SEQ ID NO: 651040 - RNA, 23 nt, Human
uauggaagaaacuccaaaggccc

SEQ ID NO: 651041 - RNA, 23 nt, Human
ucaaaugauccaccugccuuggc

SEQ ID NO: 651042 - RNA, 21 nt, Human
ucaccuaucuggaguaggagu

SEQ ID NO: 651043 - RNA, 27 nt, Human
ucagugugaagucagaugcccuuuggg

SEQ ID NO: 651044 - RNA, 23 nt, Human
uccauggacccccccagcccaga

SEQ ID NO: 651045 - RNA, 18 nt, Human
ucccaaagcacaagcugg

SEQ ID NO: 651046 - RNA, 18 nt, Human
uccugaccucaaaugauc

SEQ ID NO: 651047 - RNA, 22 nt, Human
ucggcacaggccugccacugca

SEQ ID NO: 651048 - RNA, 22 nt, Human
ucuggccagaaagaacagaugg

SEQ ID NO: 651049 - RNA, 19 nt, Human
ucuugaacuccugaccuca

SEQ ID NO: 651050 - RNA, 21 nt, Human
ugagauggggauggguccuuc

SEQ ID NO: 651051 - RNA, 23 nt, Human
ugagauggggauggguccuucgg

SEQ ID NO: 651052 - RNA, 23 nt, Human
ugagcacaugggcugugaggcug

SEQ ID NO: 651053 - RNA, 18 nt, Human
ugcaggggggcuuccuuc

SEQ ID NO: 651054 - RNA, 20 nt, Human
ugccaaggaccaggauaugg

SEQ ID NO: 651055 - RNA, 19 nt, Human
ugccuuggccucccaaagc

SEQ ID NO: 651056 - RNA, 22 nt, Human
ugcuuaugggaaucagcguggg

SEQ ID NO: 651057 - RNA, 21 nt, Human
uggaagaaacuccaaaggccc

SEQ ID NO: 651058 - RNA, 19 nt, Human
uggaaucaagagcuagccu

SEQ ID NO: 651059 - RNA, 18 nt, Human
uggacccccccagcccag

SEQ ID NO: 651060 - RNA, 18 nt, Human
uggcaggucugagggcag

SEQ ID NO: 651061 - RNA, 21 nt, Human
uggccuggaaucaagagcuag

SEQ ID NO: 651062 - RNA, 19 nt, Human
uggguccuucggcacaggc

SEQ ID NO: 651063 - RNA, 19 nt, Human
uggguuuuagcauguaagc

SEQ ID NO: 651064 - RNA, 22 nt, Human
uguccauggacccccccagccc

SEQ ID NO: 651065 - RNA, 21 nt, Human
uguuacccaccaaggucucug

SEQ ID NO: 651066 - RNA, 18 nt, Human
uuaguagagacuggguuu

SEQ ID NO: 651067 - RNA, 18 nt, Human
uuaguagagacuggguuu

SEQ ID NO: 651068 - RNA, 18 nt, Human
uuggagagaagguggcag

SEQ ID NO: 651069 - RNA, 19 nt, Human
uuuuuaguagagacugggu

SEQ ID NO: 651070 - RNA, 21 nt, Human
uuuuuguauuuuuaguagaga

SEQ ID NO: 651071 - RNA, 18 nt, Human
uuuuuuguauuuuuagua

SEQ ID NO: 651072 - RNA, 21 nt, Human
uuuuuuguauuuuuaguagag

SEQ ID NO: 651073 - RNA, 24 nt, Human
uuuuuuuuguauuuuuaguagaga

SEQ ID NO: 651074 - RNA, 18 nt, Human
uuuuuuuuuuuuuuuuug

SEQ ID NO: 651075 - RNA, 25 nt, Human
uuuuuuuuuuuuuuuuuuguauuuu

SEQ ID NO: 651076 - RNA, 22 nt, Human
aaaaaaaaacaaaaaucucaaa

SEQ ID NO: 651077 - RNA, 19 nt, Human
aaaacaaaccaaaaaaaaa

SEQ ID NO: 651078 - RNA, 18 nt, Human
aaaaucuucagcuuucac

SEQ ID NO: 651079 - RNA, 25 nt, Human
aaacaaaaaucucaaaaucuucagc

SEQ ID NO: 651080 - RNA, 24 nt, Human
aaaucauagagaauugaccaaaac

SEQ ID NO: 651081 - RNA, 19 nt, Human
aacaaaccaaaaaaaaaac

SEQ ID NO: 651082 - RNA, 20 nt, Human
aauuugauuuuguauuguca

SEQ ID NO: 651083 - RNA, 19 nt, Human
agaaguaaaucauagagaa

SEQ ID NO: 651084 - RNA, 21 nt, Human
agagaaguaaaucauagagaa

SEQ ID NO: 651085 - RNA, 19 nt, Human
agagaccaauauaugaaca

SEQ ID NO: 651086 - RNA, 24 nt, Human
aguaaaucauagagaauugaccaa

SEQ ID NO: 651087 - RNA, 19 nt, Human
aucaaauuauguuggauca

SEQ ID NO: 651088 - RNA, 27 nt, Human
augagugagauuuuuuuuuuuuuuuuu

SEQ ID NO: 651089 - RNA, 19 nt, Human
caaaaagguuucaaaaaug

SEQ ID NO: 651090 - RNA, 23 nt, Human
cacgugcgugugugugugugugu

SEQ ID NO: 651091 - RNA, 24 nt, Human
cacgugcgugugugugugugugug

SEQ ID NO: 651092 - RNA, 22 nt, Human
cauagagaauugaccaaaacug

SEQ ID NO: 651093 - RNA, 19 nt, Human
cucagagaccaauauauga

SEQ ID NO: 651094 - RNA, 22 nt, Human
gaaaaaagggcauuacaaauau

SEQ ID NO: 651095 - RNA, 21 nt, Human
gagugagauuuuuuuuuuuuu

SEQ ID NO: 651096 - RNA, 22 nt, Human
gccuagaagggaccucagagac

SEQ ID NO: 651097 - RNA, 23 nt, Human
gcgugggauguguguguaaaaca

SEQ ID NO: 651098 - RNA, 18 nt, Human
ggaccucagagaccaaua

SEQ ID NO: 651099 - RNA, 21 nt, Human
ggcauuacaaauauaaauacu

SEQ ID NO: 651100 - RNA, 24 nt, Human
ggcauuacaaauauaaauacugca

SEQ ID NO: 651101 - RNA, 20 nt, Human
guuggagguucuuuuucuuc

SEQ ID NO: 651102 - RNA, 19 nt, Human
uacgucggcaauguaacau

SEQ ID NO: 651103 - RNA, 19 nt, Human
uauacacacaugcauauag

SEQ ID NO: 651104 - RNA, 22 nt, Human
ucaaaaauuaucagaagauuuu

SEQ ID NO: 651105 - RNA, 20 nt, Human
ucugaauauuuaaaccucua

SEQ ID NO: 651106 - RNA, 19 nt, Human
ugacaaaauaggauuaauu

SEQ ID NO: 651107 - RNA, 21 nt, Human
ugacaagaguucugcugaaga

SEQ ID NO: 651108 - RNA, 19 nt, Human
ugagagaaguaaaucauag

SEQ ID NO: 651109 - RNA, 19 nt, Human
ugagagaaguaaaucauag

SEQ ID NO: 651110 - RNA, 21 nt, Human
ugagauuuuuuuuuuuuuuuu

SEQ ID NO: 651111 - RNA, 23 nt, Human
ugagauuuuuuuuuuuuuuuuuu

SEQ ID NO: 651112 - RNA, 18 nt, Human
ugagguggguugcuacaa

SEQ ID NO: 651113 - RNA, 24 nt, Human
ugcgugugugugugugugugugug

SEQ ID NO: 651114 - RNA, 24 nt, Human
uguaaaacaaaccaaaaaaaaaac

SEQ ID NO: 651115 - RNA, 18 nt, Human
ugugcacgugcgugugug

SEQ ID NO: 651116 - RNA, 22 nt, Human
ugugcacgugcgugugugugug

SEQ ID NO: 651117 - RNA, 18 nt, Human
ugugugugugugugugug

SEQ ID NO: 651118 - RNA, 18 nt, Human
ugugugugugugugugug

SEQ ID NO: 651119 - RNA, 18 nt, Human
ugugugugugugugugug

SEQ ID NO: 651120 - RNA, 18 nt, Human
ugugugugugugugugug

SEQ ID NO: 651121 - RNA, 21 nt, Human
ugugugugugugugugugugu

SEQ ID NO: 651122 - RNA, 21 nt, Human
ugugugugugugugugugugu

SEQ ID NO: 651123 - RNA, 21 nt, Human
ugugugugugugugugugugu

SEQ ID NO: 651124 - RNA, 21 nt, Human
ugugugugugugugugugugu

SEQ ID NO: 651125 - RNA, 21 nt, Human
ugugugugugugugugugugu

SEQ ID NO: 651126 - RNA, 21 nt, Human
ugugugugugugugugugugu

SEQ ID NO: 651127 - RNA, 22 nt, Human
ugugugugugugugugugugug

SEQ ID NO: 651128 - RNA, 22 nt, Human
ugugugugugugugugugugug

SEQ ID NO: 651129 - RNA, 19 nt, Human
uguguguguguguguguug

SEQ ID NO: 651130 - RNA, 24 nt, Human
uuauacacacaugcauauauuccu

SEQ ID NO: 651131 - RNA, 20 nt, Human
uuccauuuaauauaaaccuu

SEQ ID NO: 651132 - RNA, 24 nt, Human
uuuacuaaguucaaaagauaaaua

SEQ ID NO: 651133 - RNA, 19 nt, Human
uuugguauuaauaaaccau

SEQ ID NO: 651134 - RNA, 25 nt, Human
uuuuuuuuuuuacauggcuaugggu

SEQ ID NO: 651135 - RNA, 23 nt, Human
uuuuuuuuuuuuuuuuuacaugg

SEQ ID NO: 651136 - RNA, 24 nt, Human
uuuuuuuuuuuuuuuuuuuuuccu

SEQ ID NO: 651137 - RNA, 19 nt, Human
aaaagccacaucagaggcu

SEQ ID NO: 651138 - RNA, 22 nt, Human
aagcaccaaccgggaaccaaaa

SEQ ID NO: 651139 - RNA, 24 nt, Human
acagugccagaagguuauagacac

SEQ ID NO: 651140 - RNA, 21 nt, Human
agaagguuauagacacaaagg

SEQ ID NO: 651141 - RNA, 18 nt, Human
agcugcgaacaggaagca

SEQ ID NO: 651142 - RNA, 23 nt, Human
cacaaaggccaaaugaacaauga

SEQ ID NO: 651143 - RNA, 20 nt, Human
cagugccagaagguuauaga

SEQ ID NO: 651144 - RNA, 21 nt, Human
ccgcagcugcgaacaggaagc

SEQ ID NO: 651145 - RNA, 18 nt, Human
gaaaagccacaucagagg

SEQ ID NO: 651146 - RNA, 22 nt, Human
gauaauaaacacagugccagaa

SEQ ID NO: 651147 - RNA, 19 nt, Human
ugaagugccgcagcugcga

SEQ ID NO: 651148 - RNA, 24 nt, Human
ugccgcagcugcgaacaggaagca

SEQ ID NO: 651149 - RNA, 24 nt, Human
aagcaucuuaagacagaaaguuuc

SEQ ID NO: 651150 - RNA, 18 nt, Human
aaggcggagagcuugacc

SEQ ID NO: 651151 - RNA, 21 nt, Human
acagcaggcugaugccucugu

SEQ ID NO: 651152 - RNA, 21 nt, Human
acccccuucuguuaagauguu

SEQ ID NO: 651153 - RNA, 21 nt, Human
acggcaguggggaagguggga

SEQ ID NO: 651154 - RNA, 21 nt, Human
acucaauuucucucugugauc

SEQ ID NO: 651155 - RNA, 21 nt, Human
auugcaauuagauauauuuac

SEQ ID NO: 651156 - RNA, 19 nt, Human
ccucuguuugacacccccu

SEQ ID NO: 651157 - RNA, 24 nt, Human
cgacggcaguggggaaggugggag

SEQ ID NO: 651158 - RNA, 22 nt, Human
cggcaguggggaaggugggagc

SEQ ID NO: 651159 - RNA, 20 nt, Human
cucugugaucaacagcaggc

SEQ ID NO: 651160 - RNA, 21 nt, Human
ucaaauuauguuuuucugggc

SEQ ID NO: 651161 - RNA, 24 nt, Human
ugugaucaacagcaggcugaugcc

SEQ ID NO: 651162 - RNA, 27 nt, Human
uguuauugcaauuagauauauuuacaa

SEQ ID NO: 651163 - RNA, 22 nt, Human
uuucugggcucuuaaacaccuc

SEQ ID NO: 651164 - RNA, 24 nt, Human
uuuuuuuuuuuuuuaaacuuuugg

SEQ ID NO: 651165 - RNA, 25 nt, Human
uuuuuuuuuuuuuuaaacuuuugga

SEQ ID NO: 651166 - RNA, 18 nt, Human
aaccuggguccugcacag

SEQ ID NO: 651167 - RNA, 21 nt, Human
aagaggggccucugucuggca

SEQ ID NO: 651168 - RNA, 20 nt, Human
aagccaccugugagcagagu

SEQ ID NO: 651169 - RNA, 23 nt, Human
aaggaagccaccugugagcagag

SEQ ID NO: 651170 - RNA, 22 nt, Human
agcccaaccccagccagggcaa

SEQ ID NO: 651171 - RNA, 18 nt, Human
agcuucgccccuccgcca

SEQ ID NO: 651172 - RNA, 24 nt, Human
aggaguugcagagagggguucagg

SEQ ID NO: 651173 - RNA, 21 nt, Human
aggggccucugucuggcaggc

SEQ ID NO: 651174 - RNA, 24 nt, Human
agggggaggagcccuggggagacc

SEQ ID NO: 651175 - RNA, 20 nt, Human
agugguguucagggcacagg

SEQ ID NO: 651176 - RNA, 20 nt, Human
caaagaggcggccucaaugc

SEQ ID NO: 651177 - RNA, 18 nt, Human
cacagaaaggagaggguc

SEQ ID NO: 651178 - RNA, 19 nt, Human
cagacagugaagggggcag

SEQ ID NO: 651179 - RNA, 23 nt, Human
cagacagugaagggggcaguggu

SEQ ID NO: 651180 - RNA, 19 nt, Human
cagaguggguccugaggcc

SEQ ID NO: 651181 - RNA, 22 nt, Human
cagcccaaccccagccagggca

SEQ ID NO: 651182 - RNA, 19 nt, Human
cagcuagucccccacucuc

SEQ ID NO: 651183 - RNA, 21 nt, Human
cagcugggcugcaccagccca

SEQ ID NO: 651184 - RNA, 26 nt, Human
caugcuugucuccagugagcuggagg

SEQ ID NO: 651185 - RNA, 26 nt, Human
ccaccggaucagagcaggugccaugc

SEQ ID NO: 651186 - RNA, 21 nt, Human
ccaccugugagcagagugggu

SEQ ID NO: 651187 - RNA, 20 nt, Human
ccaggccauggggcucaagc

SEQ ID NO: 651188 - RNA, 19 nt, Human
cccacagaaccgaggucgc

SEQ ID NO: 651189 - RNA, 20 nt, Human
cccagcugugucaccuucuc

SEQ ID NO: 651190 - RNA, 18 nt, Human
ccccagccagggcaaugg

SEQ ID NO: 651191 - RNA, 19 nt, Human
ccggcuugggagcucuggc

SEQ ID NO: 651192 - RNA, 22 nt, Human
ccuacccugguggccuuccaga

SEQ ID NO: 651193 - RNA, 19 nt, Human
ccucaaugcacgcagcccu

SEQ ID NO: 651194 - RNA, 19 nt, Human
ccucauggcugagauggga

SEQ ID NO: 651195 - RNA, 20 nt, Human
ccuuccagagcccacagaac

SEQ ID NO: 651196 - RNA, 21 nt, Human
cggccucaaugcacgcagccc

SEQ ID NO: 651197 - RNA, 18 nt, Human
cucacugaccccggcugu

SEQ ID NO: 651198 - RNA, 20 nt, Human
cucauggcugagaugggagc

SEQ ID NO: 651199 - RNA, 19 nt, Human
cucucuggauucccugagc

SEQ ID NO: 651200 - RNA, 18 nt, Human
cugcggcugguccugggg

SEQ ID NO: 651201 - RNA, 18 nt, Human
cuggaggacggcuccuuc

SEQ ID NO: 651202 - RNA, 21 nt, Human
cuggagggugguguggcgugg

SEQ ID NO: 651203 - RNA, 21 nt, Human
cuggggagacccuacccuggu

SEQ ID NO: 651204 - RNA, 24 nt, Human
gcacacacacgauucccuuucaca

SEQ ID NO: 651205 - RNA, 23 nt, Human
gcggccucaaugcacgcagcccu

SEQ ID NO: 651206 - RNA, 21 nt, Human
gcugcaccagcccaaccccag

SEQ ID NO: 651207 - RNA, 23 nt, Human
gcugcggcugguccuggggcugg

SEQ ID NO: 651208 - RNA, 23 nt, Human
gcugcuccucacugaccccggcu

SEQ ID NO: 651209 - RNA, 26 nt, Human
ggcuggaucucaggugacagagcugg

SEQ ID NO: 651210 - RNA, 24 nt, Human
gggcagugguguucagggcacagg

SEQ ID NO: 651211 - RNA, 22 nt, Human
ggucucuggcuggaucucaggu

SEQ ID NO: 651212 - RNA, 27 nt, Human
gguggaggagggucucuggcuggaucu

SEQ ID NO: 651213 - RNA, 24 nt, Human
gugccuggggcacacacacggugu

SEQ ID NO: 651214 - RNA, 22 nt, Human
gugcugggguggcugcggcugg

SEQ ID NO: 651215 - RNA, 20 nt, Human
uaaggaagccaccugugagc

SEQ ID NO: 651216 - RNA, 18 nt, Human
uagcagggaugcacgggc

SEQ ID NO: 651217 - RNA, 19 nt, Human
uccaagggcacguccacag

SEQ ID NO: 651218 - RNA, 19 nt, Human
uccacagacaucucucugg

SEQ ID NO: 651219 - RNA, 18 nt, Human
ucccugagccaggaguug

SEQ ID NO: 651220 - RNA, 21 nt, Human
ucccugagccaggaguuggcc

SEQ ID NO: 651221 - RNA, 22 nt, Human
ucccugagccaggaguuggccu

SEQ ID NO: 651222 - RNA, 21 nt, Human
ucccuuucacagaaaggagag

SEQ ID NO: 651223 - RNA, 21 nt, Human
uccggcuugggagcucuggca

SEQ ID NO: 651224 - RNA, 18 nt, Human
uccggggcaguggggucu

SEQ ID NO: 651225 - RNA, 26 nt, Human
uccuggggcuggaggacggcuccuuc

SEQ ID NO: 651226 - RNA, 19 nt, Human
ucucuuggggagcugacag

SEQ ID NO: 651227 - RNA, 22 nt, Human
ucuggauucccugagccaggag

SEQ ID NO: 651228 - RNA, 22 nt, Human
ucugggaugggccugagacuag

SEQ ID NO: 651229 - RNA, 19 nt, Human
ucuuuggaagcccuggcuu

SEQ ID NO: 651230 - RNA, 21 nt, Human
ugacagagcugggcuugcacc

SEQ ID NO: 651231 - RNA, 18 nt, Human
ugacagugugggaaacug

SEQ ID NO: 651232 - RNA, 20 nt, Human
ugacgaguggcuuggcuguc

SEQ ID NO: 651233 - RNA, 20 nt, Human
ugcaccaggccauggggcuu

SEQ ID NO: 651234 - RNA, 22 nt, Human
ugcaggaguguugugcaggggg

SEQ ID NO: 651235 - RNA, 20 nt, Human
ugcagggggaggagcccugg

SEQ ID NO: 651236 - RNA, 23 nt, Human
ugcagggggaggagcccugggga

SEQ ID NO: 651237 - RNA, 18 nt, Human
ugcuugucuccagugaga

SEQ ID NO: 651238 - RNA, 22 nt, Human
uggagggugguguggcgugguc

SEQ ID NO: 651239 - RNA, 20 nt, Human
uggcaggcccagcgcuugca

SEQ ID NO: 651240 - RNA, 19 nt, Human
uggccucugguccugaccu

SEQ ID NO: 651241 - RNA, 23 nt, Human
uggcugcggcugguccuggggcu

SEQ ID NO: 651242 - RNA, 23 nt, Human
ugggcuugcaccacaagaggggc

SEQ ID NO: 651243 - RNA, 24 nt, Human
ugggugcagggcuccugacgaguc

SEQ ID NO: 651244 - RNA, 21 nt, Human
uggugcacggccucggcgcuc

SEQ ID NO: 651245 - RNA, 20 nt, Human
ugucuccagugagcuggagg

SEQ ID NO: 651246 - RNA, 24 nt, Human
ugugcagggggaggagcccugggg

SEQ ID NO: 651247 - RNA, 19 nt, Human
uguugugcagggggaggag

SEQ ID NO: 651248 - RNA, 19 nt, Human
uuccagagcccacagaacc

SEQ ID NO: 651249 - RNA, 20 nt, Human
uucgccccuccgccagcugg

SEQ ID NO: 651250 - RNA, 21 nt, Human
uugacuguggaugguggagga

SEQ ID NO: 651251 - RNA, 24 nt, Human
uuucacagaaaggagagggucccc

SEQ ID NO: 651252 - RNA, 19 nt, Human
aaguuccaggagcauuucu

SEQ ID NO: 651253 - RNA, 18 nt, Human
acagcuuucuucugaggg

SEQ ID NO: 651254 - RNA, 22 nt, Human
agacagcaaugucugacaagaa

SEQ ID NO: 651255 - RNA, 18 nt, Human
cagcaaugucugacaagc

SEQ ID NO: 651256 - RNA, 20 nt, Human
ccaucuaaaaacagcuuucu

SEQ ID NO: 651257 - RNA, 29 nt, Human
cgggagaagccgaagguaaggaguuggac

SEQ ID NO: 651258 - RNA, 24 nt, Human
cugacaagcagcaucgcuuuucuc

SEQ ID NO: 651259 - RNA, 22 nt, Human
gaggaacucuuaagcuuagucu

SEQ ID NO: 651260 - RNA, 22 nt, Human
gggagaagccgaagguaaggag

SEQ ID NO: 651261 - RNA, 24 nt, Human
gucuuugauucugacagagguauu

SEQ ID NO: 651262 - RNA, 21 nt, Human
ucucagaaugaauggucagcu

SEQ ID NO: 651263 - RNA, 18 nt, Human
ugaauggucagcuuuuuu

SEQ ID NO: 651264 - RNA, 23 nt, Human
ugaggacuuccgggagaagccga

SEQ ID NO: 651265 - RNA, 21 nt, Human
uucccagucaccaucauguug

SEQ ID NO: 651266 - RNA, 19 nt, Human
uuucucagaaugaaugguc

SEQ ID NO: 651267 - RNA, 19 nt, Human
uuuuuuuuuuuuuuuuuaa

SEQ ID NO: 651268 - RNA, 24 nt, Human
aaaaacugcaaagaaacagaaagc

SEQ ID NO: 651269 - RNA, 18 nt, Human
aacacgucacuggagaaa

SEQ ID NO: 651270 - RNA, 24 nt, Human
aacuucgugacaucuggcaacccu

SEQ ID NO: 651271 - RNA, 20 nt, Human
aaguuccucuuuccaacuuc

SEQ ID NO: 651272 - RNA, 24 nt, Human
acucuaaaacccuggaaacaauua

SEQ ID NO: 651273 - RNA, 24 nt, Human
agacguugcaggucguuuugaacu

SEQ ID NO: 651274 - RNA, 22 nt, Human
aggccaggcgcaguggcucaca

SEQ ID NO: 651275 - RNA, 21 nt, Human
aggccgaggcggguggaucac

SEQ ID NO: 651276 - RNA, 24 nt, Human
aggcgcaguggcucacaccugcaa

SEQ ID NO: 651277 - RNA, 22 nt, Human
aggcggguggaucaccugaagg

SEQ ID NO: 651278 - RNA, 23 nt, Human
aguggcucacaccugcaauccca

SEQ ID NO: 651279 - RNA, 18 nt, Human
auagaauaccugauaccc

SEQ ID NO: 651280 - RNA, 19 nt, Human
auggcucuggcagaggccc

SEQ ID NO: 651281 - RNA, 24 nt, Human
caacaccuugggaggccgaggcgg

SEQ ID NO: 651282 - RNA, 24 nt, Human
caacuacucuaaaacccuggaaac

SEQ ID NO: 651283 - RNA, 24 nt, Human
cacaccugcaaucccaacaccuug

SEQ ID NO: 651284 - RNA, 24 nt, Human
caccugcaaucccaacaccuuggg

SEQ ID NO: 651285 - RNA, 19 nt, Human
cagaaacaacuuaaaacac

SEQ ID NO: 651286 - RNA, 24 nt, Human
cagaggcccauggccuccuuucuu

SEQ ID NO: 651287 - RNA, 22 nt, Human
cagcaguuugagaccagccugc

SEQ ID NO: 651288 - RNA, 22 nt, Human
caggagccuuccuguucuaguc

SEQ ID NO: 651289 - RNA, 19 nt, Human
caucuuaacaccuggcagc

SEQ ID NO: 651290 - RNA, 24 nt, Human
cauucaacuacucuaaaacccugg

SEQ ID NO: 651291 - RNA, 24 nt, Human
ccacauagaauaccugauacccag

SEQ ID NO: 651292 - RNA, 22 nt, Human
ccagagccagaaaggcccagga

SEQ ID NO: 651293 - RNA, 21 nt, Human
cccagaaacaacuuaaaacac

SEQ ID NO: 651294 - RNA, 23 nt, Human
ccccgcgccgccaucuuaacacc

SEQ ID NO: 651295 - RNA, 21 nt, Human
ccgccuaaggaggguuuucca

SEQ ID NO: 651296 - RNA, 20 nt, Human
ccuaaccugugcuccccuac

SEQ ID NO: 651297 - RNA, 21 nt, Human
ccuauccacucagggcaggag

SEQ ID NO: 651298 - RNA, 19 nt, Human
ccugcaaucccaacaccuu

SEQ ID NO: 651299 - RNA, 19 nt, Human
cgaggcggguggaucaccu

SEQ ID NO: 651300 - RNA, 20 nt, Human
cgaggcggguggaucaccug

SEQ ID NO: 651301 - RNA, 26 nt, Human
cgaggcggguggaucaccugaaguca

SEQ ID NO: 651302 - RNA, 27 nt, Human
cggguggaucaccugaagucagcaguu

SEQ ID NO: 651303 - RNA, 23 nt, Human
cucacaccugcaaucccaacacc

SEQ ID NO: 651304 - RNA, 22 nt, Human
cucccuuacccagaaacaacuu

SEQ ID NO: 651305 - RNA, 23 nt, Human
cugaccccagagugcagagcaug

SEQ ID NO: 651306 - RNA, 23 nt, Human
gaaaaacugcaaagaaacagaaa

SEQ ID NO: 651307 - RNA, 19 nt, Human
gaaacagaaagcuaaccuu

SEQ ID NO: 651308 - RNA, 24 nt, Human
gaaggcugggggaggagagccugg

SEQ ID NO: 651309 - RNA, 24 nt, Human
gagaaaauguaugaaacuguagca

SEQ ID NO: 651310 - RNA, 18 nt, Human
gagcauggcucuggcaga

SEQ ID NO: 651311 - RNA, 24 nt, Human
gaucaccugaagucagcaguuuga

SEQ ID NO: 651312 - RNA, 26 nt, Human
gauuacuuuccaaauacuggauuacu

SEQ ID NO: 651313 - RNA, 24 nt, Human
gcagagcauggcucuggcagaggc

SEQ ID NO: 651314 - RNA, 19 nt, Human
gcccaggagccuuccuguu

SEQ ID NO: 651315 - RNA, 18 nt, Human
gcccauggccuccuuucu

SEQ ID NO: 651316 - RNA, 18 nt, Human
gccucuagccgcuggccg

SEQ ID NO: 651317 - RNA, 23 nt, Human
gcgcacggcuacgcgagucgugc

SEQ ID NO: 651318 - RNA, 23 nt, Human
gcuguggcgggcgccaucuugga

SEQ ID NO: 651319 - RNA, 20 nt, Human
gggagcgcgggcgcggcccc

SEQ ID NO: 651320 - RNA, 26 nt, Human
ggguuuccuuaaacuauuaccugaga

SEQ ID NO: 651321 - RNA, 19 nt, Human
gugcagaaacuuuggaggc

SEQ ID NO: 651322 - RNA, 26 nt, Human
uaacuucgugacaucuggcaacccua

SEQ ID NO: 651323 - RNA, 25 nt, Human
uaagggauauaccuuaaaacugagc

SEQ ID NO: 651324 - RNA, 21 nt, Human
uagaagaaaaacugcaaagaa

SEQ ID NO: 651325 - RNA, 20 nt, Human
ucccagagccagaaaggccc

SEQ ID NO: 651326 - RNA, 24 nt, Human
ucuagaagaaaaacugcaaagaaa

SEQ ID NO: 651327 - RNA, 22 nt, Human
ucuggcaacccuaacccuaccu

SEQ ID NO: 651328 - RNA, 20 nt, Human
ucuggcagaggcccauggcc

SEQ ID NO: 651329 - RNA, 21 nt, Human
ucuucacauuucaaacuggau

SEQ ID NO: 651330 - RNA, 22 nt, Human
ugaaguuccucuuuccaacuuc

SEQ ID NO: 651331 - RNA, 21 nt, Human
ugaauauuuuuuacuauaacc

SEQ ID NO: 651332 - RNA, 20 nt, Human
ugacaucuggcaacccuaac

SEQ ID NO: 651333 - RNA, 26 nt, Human
ugagaccagccugcugggagguacac

SEQ ID NO: 651334 - RNA, 20 nt, Human
ugcaaagaaacagaaagcua

SEQ ID NO: 651335 - RNA, 22 nt, Human
ugcaaagaaacagaaagcuaac

SEQ ID NO: 651336 - RNA, 22 nt, Human
ugccugaaguuucaagucaaca

SEQ ID NO: 651337 - RNA, 23 nt, Human
uggaucaccugaagucagcaguu

SEQ ID NO: 651338 - RNA, 24 nt, Human
uggaucaccugaagucagcaguuu

SEQ ID NO: 651339 - RNA, 21 nt, Human
uggcgggcgccaucuuggagu

SEQ ID NO: 651340 - RNA, 18 nt, Human
uggcucuggcagaggccc

SEQ ID NO: 651341 - RNA, 21 nt, Human
ugggaacauuuuaagguucaa

SEQ ID NO: 651342 - RNA, 23 nt, Human
ugggaggccgaggcggguggauc

SEQ ID NO: 651343 - RNA, 24 nt, Human
ugggaggccgaggcggguggauca

SEQ ID NO: 651344 - RNA, 24 nt, Human
ugucccaucgaggugcagaaacuu

SEQ ID NO: 651345 - RNA, 18 nt, Human
uugaauuucacauaauga

SEQ ID NO: 651346 - RNA, 25 nt, Human
uugggaggccgaggcggguggauca

SEQ ID NO: 651347 - RNA, 18 nt, Human
uuucaagucaacacguca
